United States Patent 8,178,503 (RIBONUCLEIC ACID INTERFERENCE MOLECULES AND BINDING SITES DERIVED BY ANALYZING INTERGENIC AND INTRONIC REGIONS OF GENOMES) - sequence listing, part 8

SEQ ID NO: 312234 - DNA, 16 bp, C. familiaris
cccaaggcagaccctc

SEQ ID NO: 312235 - DNA, 16 bp, C. familiaris
cccaaggcagccccag

SEQ ID NO: 312236 - DNA, 16 bp, C. familiaris
cccaaggccccacctc

SEQ ID NO: 312237 - DNA, 16 bp, C. familiaris
cccaagggaaatgaaa

SEQ ID NO: 312238 - DNA, 16 bp, C. familiaris
cccaagggcacctggg

SEQ ID NO: 312239 - DNA, 16 bp, C. familiaris
cccaaggtcacagagc

SEQ ID NO: 312240 - DNA, 16 bp, C. familiaris
cccaaggttttttttt

SEQ ID NO: 312241 - DNA, 16 bp, C. familiaris
cccaagtgcccctcca

SEQ ID NO: 312242 - DNA, 16 bp, C. familiaris
cccaagtggacaaagc

SEQ ID NO: 312243 - DNA, 16 bp, C. familiaris
cccaagtgtccaacaa

SEQ ID NO: 312244 - DNA, 16 bp, C. familiaris
cccaagtgtccctcaa

SEQ ID NO: 312245 - DNA, 16 bp, C. familiaris
cccaagtgtccttcaa

SEQ ID NO: 312246 - DNA, 16 bp, C. familiaris
cccaagttcatgacct

SEQ ID NO: 312247 - DNA, 16 bp, C. familiaris
cccaatgaaggacttg

SEQ ID NO: 312248 - DNA, 16 bp, C. familiaris
cccaatgcagggcttg

SEQ ID NO: 312249 - DNA, 16 bp, C. familiaris
cccaatgtgggcctca

SEQ ID NO: 312250 - DNA, 16 bp, C. familiaris
cccacaacgggctccc

SEQ ID NO: 312251 - DNA, 16 bp, C. familiaris
cccacaagactgtccc

SEQ ID NO: 312252 - DNA, 16 bp, C. familiaris
cccacagcaaatctca

SEQ ID NO: 312253 - DNA, 16 bp, C. familiaris
cccacagcctcctcct

SEQ ID NO: 312254 - DNA, 16 bp, C. familiaris
cccacaggaaatatca

SEQ ID NO: 312255 - DNA, 16 bp, C. familiaris
cccacagggagctgct

SEQ ID NO: 312256 - DNA, 16 bp, C. familiaris
cccacatcagaatccc

SEQ ID NO: 312257 - DNA, 16 bp, C. familiaris
cccacatcagagtccc

SEQ ID NO: 312258 - DNA, 16 bp, C. familiaris
cccacatcagtctcct

SEQ ID NO: 312259 - DNA, 16 bp, C. familiaris
cccacattatggaggg

SEQ ID NO: 312260 - DNA, 16 bp, C. familiaris
cccaccaaaatggaga

SEQ ID NO: 312261 - DNA, 16 bp, C. familiaris
cccaccaaagaggaga

SEQ ID NO: 312262 - DNA, 16 bp, C. familiaris
cccaccaacagtgccc

SEQ ID NO: 312263 - DNA, 16 bp, C. familiaris
cccaccatctgcttcg

SEQ ID NO: 312264 - DNA, 16 bp, C. familiaris
cccaccccagccctgg

SEQ ID NO: 312265 - DNA, 16 bp, C. familiaris
cccaccccagctccag

SEQ ID NO: 312266 - DNA, 16 bp, C. familiaris
cccaccccaggctctg

SEQ ID NO: 312267 - DNA, 16 bp, C. familiaris
cccacccccaactctg

SEQ ID NO: 312268 - DNA, 16 bp, C. familiaris
cccacccccagagttt

SEQ ID NO: 312269 - DNA, 16 bp, C. familiaris
cccacccccagcaggg

SEQ ID NO: 312270 - DNA, 16 bp, C. familiaris
cccacccccagcctgg

SEQ ID NO: 312271 - DNA, 16 bp, C. familiaris
cccacccccatcctgg

SEQ ID NO: 312272 - DNA, 16 bp, C. familiaris
cccacccctgccctgt

SEQ ID NO: 312273 - DNA, 16 bp, C. familiaris
cccacctcagactccc

SEQ ID NO: 312274 - DNA, 16 bp, C. familiaris
cccacctcatgctctc

SEQ ID NO: 312275 - DNA, 16 bp, C. familiaris
cccacctcctaatatc

SEQ ID NO: 312276 - DNA, 16 bp, C. familiaris
cccacctcgggcttcc

SEQ ID NO: 312277 - DNA, 16 bp, C. familiaris
cccacctctcctctgg

SEQ ID NO: 312278 - DNA, 16 bp, C. familiaris
cccacctgccacctgc

SEQ ID NO: 312279 - DNA, 16 bp, C. familiaris
cccacctggggctctg

SEQ ID NO: 312280 - DNA, 16 bp, C. familiaris
cccaccttaggctccc

SEQ ID NO: 312281 - DNA, 16 bp, C. familiaris
cccacgccgggctccc

SEQ ID NO: 312282 - DNA, 16 bp, C. familiaris
cccacgtccagctccc

SEQ ID NO: 312283 - DNA, 16 bp, C. familiaris
cccacgtcgggcgccc

SEQ ID NO: 312284 - DNA, 16 bp, C. familiaris
cccacgtcgggctccg

SEQ ID NO: 312285 - DNA, 16 bp, C. familiaris
cccactcagcagggag

SEQ ID NO: 312286 - DNA, 16 bp, C. familiaris
cccactcagtggagag

SEQ ID NO: 312287 - DNA, 16 bp, C. familiaris
cccactcagttcctct

SEQ ID NO: 312288 - DNA, 16 bp, C. familiaris
cccactccccctgctt

SEQ ID NO: 312289 - DNA, 16 bp, C. familiaris
cccactgaacaaggag

SEQ ID NO: 312290 - DNA, 16 bp, C. familiaris
cccactgagtgtgaag

SEQ ID NO: 312291 - DNA, 16 bp, C. familiaris
cccactgcctctgccc

SEQ ID NO: 312292 - DNA, 16 bp, C. familiaris
cccactgcctgctgct

SEQ ID NO: 312293 - DNA, 16 bp, C. familiaris
cccacttcccttccag

SEQ ID NO: 312294 - DNA, 16 bp, C. familiaris
cccacttctgctctct

SEQ ID NO: 312295 - DNA, 16 bp, C. familiaris
cccacttcttcctctg

SEQ ID NO: 312296 - DNA, 16 bp, C. familiaris
cccacttgtgtgtgtg

SEQ ID NO: 312297 - DNA, 16 bp, C. familiaris
cccactttacagatga

SEQ ID NO: 312298 - DNA, 16 bp, C. familiaris
cccagaaacaaatcca

SEQ ID NO: 312299 - DNA, 16 bp, C. familiaris
cccagaaagaggcaga

SEQ ID NO: 312300 - DNA, 16 bp, C. familiaris
cccagaaagcagagcc

SEQ ID NO: 312301 - DNA, 16 bp, C. familiaris
cccagaaataaatgca

SEQ ID NO: 312302 - DNA, 16 bp, C. familiaris
cccagaaccctgaggt

SEQ ID NO: 312303 - DNA, 16 bp, C. familiaris
cccagaacctgggatc

SEQ ID NO: 312304 - DNA, 16 bp, C. familiaris
cccagaactccagggt

SEQ ID NO: 312305 - DNA, 16 bp, C. familiaris
cccagaacttcaggat

SEQ ID NO: 312306 - DNA, 16 bp, C. familiaris
cccagaactttttttt

SEQ ID NO: 312307 - DNA, 16 bp, C. familiaris
cccagaagaaaaagag

SEQ ID NO: 312308 - DNA, 16 bp, C. familiaris
cccagaagaagaaaag

SEQ ID NO: 312309 - DNA, 16 bp, C. familiaris
cccagaagaagaggaa

SEQ ID NO: 312310 - DNA, 16 bp, C. familiaris
cccagaagaggaagag

SEQ ID NO: 312311 - DNA, 16 bp, C. familiaris
cccagaagatgaagag

SEQ ID NO: 312312 - DNA, 16 bp, C. familiaris
cccagaaggaacaacc

SEQ ID NO: 312313 - DNA, 16 bp, C. familiaris
cccagaaggaagagag

SEQ ID NO: 312314 - DNA, 16 bp, C. familiaris
cccagacaccccagga

SEQ ID NO: 312315 - DNA, 16 bp, C. familiaris
cccagacacccctaga

SEQ ID NO: 312316 - DNA, 16 bp, C. familiaris
cccagacacccctcca

SEQ ID NO: 312317 - DNA, 16 bp, C. familiaris
cccagacacccctgta

SEQ ID NO: 312318 - DNA, 16 bp, C. familiaris
cccagacatccctgaa

SEQ ID NO: 312319 - DNA, 16 bp, C. familiaris
cccagaccccaagatc

SEQ ID NO: 312320 - DNA, 16 bp, C. familiaris
cccagacttctgacct

SEQ ID NO: 312321 - DNA, 16 bp, C. familiaris
cccagagaccatgacc

SEQ ID NO: 312322 - DNA, 16 bp, C. familiaris
cccagagaggaggagg

SEQ ID NO: 312323 - DNA, 16 bp, C. familiaris
cccagagaggggcaga

SEQ ID NO: 312324 - DNA, 16 bp, C. familiaris
cccagagatcaagagt

SEQ ID NO: 312325 - DNA, 16 bp, C. familiaris
cccagagcaggtgctc

SEQ ID NO: 312326 - DNA, 16 bp, C. familiaris
cccagagccacccagg

SEQ ID NO: 312327 - DNA, 16 bp, C. familiaris
cccagagcccaaggca

SEQ ID NO: 312328 - DNA, 16 bp, C. familiaris
cccagagcccagccca

SEQ ID NO: 312329 - DNA, 16 bp, C. familiaris
cccagagcccagggca

SEQ ID NO: 312330 - DNA, 16 bp, C. familiaris
cccagagcctccagga

SEQ ID NO: 312331 - DNA, 16 bp, C. familiaris
cccagagcctgcttct

SEQ ID NO: 312332 - DNA, 16 bp, C. familiaris
cccagagcctggcaca

SEQ ID NO: 312333 - DNA, 17 bp, C. familiaris
cccagagctaggagtct

SEQ ID NO: 312334 - DNA, 16 bp, C. familiaris
cccagaggaagaagag

SEQ ID NO: 312335 - DNA, 16 bp, C. familiaris
cccagaggaggaggag

SEQ ID NO: 312336 - DNA, 16 bp, C. familiaris
cccagaggccccagga

SEQ ID NO: 312337 - DNA, 16 bp, C. familiaris
cccagagggaacctgc

SEQ ID NO: 312338 - DNA, 16 bp, C. familiaris
cccagagggagcctgt

SEQ ID NO: 312339 - DNA, 16 bp, C. familiaris
cccagaggggagcctg

SEQ ID NO: 312340 - DNA, 16 bp, C. familiaris
cccagagtccccagag

SEQ ID NO: 312341 - DNA, 16 bp, C. familiaris
cccagagtcctggatc

SEQ ID NO: 312342 - DNA, 16 bp, C. familiaris
cccagagtctggggat

SEQ ID NO: 312343 - DNA, 16 bp, C. familiaris
cccagataactttcaa

SEQ ID NO: 312344 - DNA, 16 bp, C. familiaris
cccagatcccagaatc

SEQ ID NO: 312345 - DNA, 16 bp, C. familiaris
cccagatctccgggat

SEQ ID NO: 312346 - DNA, 16 bp, C. familiaris
cccagatcttgatttc

SEQ ID NO: 312347 - DNA, 16 bp, C. familiaris
cccagatgaggaaagt

SEQ ID NO: 312348 - DNA, 16 bp, C. familiaris
cccagatgccccagat

SEQ ID NO: 312349 - DNA, 16 bp, C. familiaris
cccagatgccccagga

SEQ ID NO: 312350 - DNA, 16 bp, C. familiaris
cccagatgccccagta

SEQ ID NO: 312351 - DNA, 16 bp, C. familiaris
cccagatgcccctaaa

SEQ ID NO: 312352 - DNA, 16 bp, C. familiaris
cccagatgcccctaga

SEQ ID NO: 312353 - DNA, 16 bp, C. familiaris
cccagatgcccctcct

SEQ ID NO: 312354 - DNA, 16 bp, C. familiaris
cccagatggctcagtc

SEQ ID NO: 312355 - DNA, 16 bp, C. familiaris
cccagcacagagctca

SEQ ID NO: 312356 - DNA, 16 bp, C. familiaris
cccagcacagcacctg

SEQ ID NO: 312357 - DNA, 16 bp, C. familiaris
cccagcacagccccag

SEQ ID NO: 312358 - DNA, 16 bp, C. familiaris
cccagcaccaggcagg

SEQ ID NO: 312359 - DNA, 16 bp, C. familiaris
cccagcaccccaagat

SEQ ID NO: 312360 - DNA, 16 bp, C. familiaris
cccagcacctgcccca

SEQ ID NO: 312361 - DNA, 16 bp, C. familiaris
cccagcagaagaaaag

SEQ ID NO: 312362 - DNA, 16 bp, C. familiaris
cccagcagagagcctg

SEQ ID NO: 312363 - DNA, 16 bp, C. familiaris
cccagcagagcaggga

SEQ ID NO: 312364 - DNA, 16 bp, C. familiaris
cccagcagcacccagc

SEQ ID NO: 312365 - DNA, 16 bp, C. familiaris
cccagcagcactggaa

SEQ ID NO: 312366 - DNA, 16 bp, C. familiaris
cccagcagccagcagg

SEQ ID NO: 312367 - DNA, 16 bp, C. familiaris
cccagcagccccaggc

SEQ ID NO: 312368 - DNA, 16 bp, C. familiaris
cccagcagcctctgcc

SEQ ID NO: 312369 - DNA, 16 bp, C. familiaris
cccagcaggagaagag

SEQ ID NO: 312370 - DNA, 16 bp, C. familiaris
cccagcagggagccag

SEQ ID NO: 312371 - DNA, 16 bp, C. familiaris
cccagcagtgggctgg

SEQ ID NO: 312372 - DNA, 16 bp, C. familiaris
cccagcatcctggaat

SEQ ID NO: 312373 - DNA, 16 bp, C. familiaris
cccagcatggagccag

SEQ ID NO: 312374 - DNA, 16 bp, C. familiaris
cccagcatggggcctg

SEQ ID NO: 312375 - DNA, 16 bp, C. familiaris
cccagccactgagcca

SEQ ID NO: 312376 - DNA, 16 bp, C. familiaris
cccagccataaaaaag

SEQ ID NO: 312377 - DNA, 16 bp, C. familiaris
cccagcccagcccctg

SEQ ID NO: 312378 - DNA, 16 bp, C. familiaris
cccagcccagccctgc

SEQ ID NO: 312379 - DNA, 16 bp, C. familiaris
cccagcccagccctgg

SEQ ID NO: 312380 - DNA, 16 bp, C. familiaris
cccagcccaggcccag

SEQ ID NO: 312381 - DNA, 16 bp, C. familiaris
cccagcccagggcctg

SEQ ID NO: 312382 - DNA, 16 bp, C. familiaris
cccagcccagggctct

SEQ ID NO: 312383 - DNA, 16 bp, C. familiaris
cccagcccagtgcctg

SEQ ID NO: 312384 - DNA, 16 bp, C. familiaris
cccagccccagcctca

SEQ ID NO: 312385 - DNA, 16 bp, C. familiaris
cccagccccagcctgg

SEQ ID NO: 312386 - DNA, 16 bp, C. familiaris
cccagccccagctcca

SEQ ID NO: 312387 - DNA, 16 bp, C. familiaris
cccagccccagctgcc

SEQ ID NO: 312388 - DNA, 16 bp, C. familiaris
cccagccccaggccag

SEQ ID NO: 312389 - DNA, 16 bp, C. familiaris
cccagccccagtccca

SEQ ID NO: 312390 - DNA, 16 bp, C. familiaris
cccagcccccaggctc

SEQ ID NO: 312391 - DNA, 16 bp, C. familiaris
cccagccccctgccag

SEQ ID NO: 312392 - DNA, 16 bp, C. familiaris
cccagccccctggcaa

SEQ ID NO: 312393 - DNA, 16 bp, C. familiaris
cccagcccctgcagcc

SEQ ID NO: 312394 - DNA, 16 bp, C. familiaris
cccagcccctgccagg

SEQ ID NO: 312395 - DNA, 16 bp, C. familiaris
cccagcccctggcacc

SEQ ID NO: 312396 - DNA, 16 bp, C. familiaris
cccagccctgccccag

SEQ ID NO: 312397 - DNA, 16 bp, C. familiaris
cccagccctgccctct

SEQ ID NO: 312398 - DNA, 16 bp, C. familiaris
cccagccctgccctgc

SEQ ID NO: 312399 - DNA, 16 bp, C. familiaris
cccagccctgcctcag

SEQ ID NO: 312400 - DNA, 16 bp, C. familiaris
cccagccctggcccag

SEQ ID NO: 312401 - DNA, 16 bp, C. familiaris
cccagccctgggcccc

SEQ ID NO: 312402 - DNA, 16 bp, C. familiaris
cccagccctgggcctg

SEQ ID NO: 312403 - DNA, 16 bp, C. familiaris
cccagccctggggccc

SEQ ID NO: 312404 - DNA, 16 bp, C. familiaris
cccagcctcctccctg

SEQ ID NO: 312405 - DNA, 16 bp, C. familiaris
cccagcctcctgcctc

SEQ ID NO: 312406 - DNA, 16 bp, C. familiaris
cccagcctctgcccca

SEQ ID NO: 312407 - DNA, 16 bp, C. familiaris
cccagcctctgccctc

SEQ ID NO: 312408 - DNA, 16 bp, C. familiaris
cccagcctctgctccc

SEQ ID NO: 312409 - DNA, 16 bp, C. familiaris
cccagcctctggcccc

SEQ ID NO: 312410 - DNA, 16 bp, C. familiaris
cccagcctggagcctg

SEQ ID NO: 312411 - DNA, 16 bp, C. familiaris
cccagcctggccccca

SEQ ID NO: 312412 - DNA, 16 bp, C. familiaris
cccagcgaggagcctg

SEQ ID NO: 312413 - DNA, 16 bp, C. familiaris
cccagcgcatggagcc

SEQ ID NO: 312414 - DNA, 16 bp, C. familiaris
cccagcgtggggcctg

SEQ ID NO: 312415 - DNA, 16 bp, C. familiaris
cccagctcagccccag

SEQ ID NO: 312416 - DNA, 16 bp, C. familiaris
cccagctcagccctgc

SEQ ID NO: 312417 - DNA, 16 bp, C. familiaris
cccagctcagtgagga

SEQ ID NO: 312418 - DNA, 16 bp, C. familiaris
cccagctccagcccca

SEQ ID NO: 312419 - DNA, 16 bp, C. familiaris
cccagctcccagctcc

SEQ ID NO: 312420 - DNA, 16 bp, C. familiaris
cccagctcctcccagc

SEQ ID NO: 312421 - DNA, 16 bp, C. familiaris
cccagctcctccccag

SEQ ID NO: 312422 - DNA, 16 bp, C. familiaris
cccagctcctcctcct

SEQ ID NO: 312423 - DNA, 16 bp, C. familiaris
cccagctcctgccagg

SEQ ID NO: 312424 - DNA, 16 bp, C. familiaris
cccagctcctggcccc

SEQ ID NO: 312425 - DNA, 16 bp, C. familiaris
cccagctctgccctcc

SEQ ID NO: 312426 - DNA, 16 bp, C. familiaris
cccagctctgccctgg

SEQ ID NO: 312427 - DNA, 16 bp, C. familiaris
cccagctctgcctcca

SEQ ID NO: 312428 - DNA, 16 bp, C. familiaris
cccagctctgcttcct

SEQ ID NO: 312429 - DNA, 16 bp, C. familiaris
cccagctgacaccttg

SEQ ID NO: 312430 - DNA, 16 bp, C. familiaris
cccagctgagcaagga

SEQ ID NO: 312431 - DNA, 16 bp, C. familiaris
cccagctgagcaggaa

SEQ ID NO: 312432 - DNA, 16 bp, C. familiaris
cccagctgcaccccca

SEQ ID NO: 312433 - DNA, 16 bp, C. familiaris
cccagctgcccaggcc

SEQ ID NO: 312434 - DNA, 16 bp, C. familiaris
cccagctgctcctgga

SEQ ID NO: 312435 - DNA, 16 bp, C. familiaris
cccaggaaaactgagt

SEQ ID NO: 312436 - DNA, 16 bp, C. familiaris
cccaggaagccagcct

SEQ ID NO: 312437 - DNA, 16 bp, C. familiaris
cccaggaatccctggg

SEQ ID NO: 312438 - DNA, 16 bp, C. familiaris
cccaggaatctgcatt

SEQ ID NO: 312439 - DNA, 16 bp, C. familiaris
cccaggaccacacagc

SEQ ID NO: 312440 - DNA, 16 bp, C. familiaris
cccaggaccagatggc

SEQ ID NO: 312441 - DNA, 16 bp, C. familiaris
cccaggaccagcagca

SEQ ID NO: 312442 - DNA, 16 bp, C. familiaris
cccaggacccaggacc

SEQ ID NO: 312443 - DNA, 16 bp, C. familiaris
cccaggacccaggact

SEQ ID NO: 312444 - DNA, 16 bp, C. familiaris
cccaggacccaggggt

SEQ ID NO: 312445 - DNA, 16 bp, C. familiaris
cccaggaccccagatt

SEQ ID NO: 312446 - DNA, 16 bp, C. familiaris
cccaggaccccagggc

SEQ ID NO: 312447 - DNA, 16 bp, C. familiaris
cccaggacccccagat

SEQ ID NO: 312448 - DNA, 16 bp, C. familiaris
cccaggacccccagga

SEQ ID NO: 312449 - DNA, 16 bp, C. familiaris
cccaggacccccaggg

SEQ ID NO: 312450 - DNA, 16 bp, C. familiaris
cccaggacccccaggt

SEQ ID NO: 312451 - DNA, 16 bp, C. familiaris
cccaggacccccgaga

SEQ ID NO: 312452 - DNA, 16 bp, C. familiaris
cccaggacccccggga

SEQ ID NO: 312453 - DNA, 16 bp, C. familiaris
cccaggaccccggggt

SEQ ID NO: 312454 - DNA, 16 bp, C. familiaris
cccaggaccccgggtc

SEQ ID NO: 312455 - DNA, 16 bp, C. familiaris
cccaggaccctggacc

SEQ ID NO: 312456 - DNA, 16 bp, C. familiaris
cccaggaccctgggat

SEQ ID NO: 312457 - DNA, 16 bp, C. familiaris
cccaggacctcagggt

SEQ ID NO: 312458 - DNA, 16 bp, C. familiaris
cccaggacctctggga

SEQ ID NO: 312459 - DNA, 16 bp, C. familiaris
cccaggacctgagcag

SEQ ID NO: 312460 - DNA, 16 bp, C. familiaris
cccaggacctggagat

SEQ ID NO: 312461 - DNA, 16 bp, C. familiaris
cccaggacctgggacc

SEQ ID NO: 312462 - DNA, 16 bp, C. familiaris
cccaggacctgggggt

SEQ ID NO: 312463 - DNA, 16 bp, C. familiaris
cccaggacctggtcct

SEQ ID NO: 312464 - DNA, 16 bp, C. familiaris
cccaggaccttgtgat

SEQ ID NO: 312465 - DNA, 16 bp, C. familiaris
cccaggactccagaac

SEQ ID NO: 312466 - DNA, 16 bp, C. familiaris
cccaggactcccagga

SEQ ID NO: 312467 - DNA, 16 bp, C. familiaris
cccaggacttggagat

SEQ ID NO: 312468 - DNA, 16 bp, C. familiaris
cccaggagcatccagg

SEQ ID NO: 312469 - DNA, 16 bp, C. familiaris
cccaggagcccaggcc

SEQ ID NO: 312470 - DNA, 16 bp, C. familiaris
cccaggagccccacaa

SEQ ID NO: 312471 - DNA, 16 bp, C. familiaris
cccaggagccccagca

SEQ ID NO: 312472 - DNA, 16 bp, C. familiaris
cccaggagccccagga

SEQ ID NO: 312473 - DNA, 16 bp, C. familiaris
cccaggagccccaggc

SEQ ID NO: 312474 - DNA, 16 bp, C. familiaris
cccaggagccccaggt

SEQ ID NO: 312475 - DNA, 16 bp, C. familiaris
cccaggagcccccaaa

SEQ ID NO: 312476 - DNA, 16 bp, C. familiaris
cccaggagcccctcca

SEQ ID NO: 312477 - DNA, 16 bp, C. familiaris
cccaggagcccctgaa

SEQ ID NO: 312478 - DNA, 16 bp, C. familiaris
cccaggagcccctgat

SEQ ID NO: 312479 - DNA, 16 bp, C. familiaris
cccaggagcccctgca

SEQ ID NO: 312480 - DNA, 16 bp, C. familiaris
cccaggagcccctggc

SEQ ID NO: 312481 - DNA, 16 bp, C. familiaris
cccaggagcccctggg

SEQ ID NO: 312482 - DNA, 16 bp, C. familiaris
cccaggagcccgggat

SEQ ID NO: 312483 - DNA, 23 bp, C. familiaris
cccaggagggcggggatgccctc

SEQ ID NO: 312484 - DNA, 16 bp, C. familiaris
cccaggagtccctcct

SEQ ID NO: 312485 - DNA, 16 bp, C. familiaris
cccaggatcaagtctc

SEQ ID NO: 312486 - DNA, 16 bp, C. familiaris
cccaggatcatcacct

SEQ ID NO: 312487 - DNA, 16 bp, C. familiaris
cccaggatccagggat

SEQ ID NO: 312488 - DNA, 16 bp, C. familiaris
cccaggatcccgacct

SEQ ID NO: 312489 - DNA, 16 bp, C. familiaris
cccaggatcctgagat

SEQ ID NO: 312490 - DNA, 16 bp, C. familiaris
cccaggatcctgcctc

SEQ ID NO: 312491 - DNA, 16 bp, C. familiaris
cccaggatcctggaga

SEQ ID NO: 312492 - DNA, 16 bp, C. familiaris
cccaggattatgccct

SEQ ID NO: 312493 - DNA, 16 bp, C. familiaris
cccaggcaaaccagga

SEQ ID NO: 312494 - DNA, 16 bp, C. familiaris
cccaggcaaaccgcag

SEQ ID NO: 312495 - DNA, 16 bp, C. familiaris
cccaggcaacccaaga

SEQ ID NO: 312496 - DNA, 16 bp, C. familiaris
cccaggcaccccagca

SEQ ID NO: 312497 - DNA, 16 bp, C. familiaris
cccaggcaccccaggc

SEQ ID NO: 312498 - DNA, 16 bp, C. familiaris
cccaggcacccccagg

SEQ ID NO: 312499 - DNA, 16 bp, C. familiaris
cccaggcaccctgagg

SEQ ID NO: 312500 - DNA, 16 bp, C. familiaris
cccaggcacctctctc

SEQ ID NO: 312501 - DNA, 16 bp, C. familiaris
cccaggcacctctgaa

SEQ ID NO: 312502 - DNA, 16 bp, C. familiaris
cccaggcactccagga

SEQ ID NO: 312503 - DNA, 16 bp, C. familiaris
cccaggcactcctgga

SEQ ID NO: 312504 - DNA, 16 bp, C. familiaris
cccaggcagagggagc

SEQ ID NO: 312505 - DNA, 16 bp, C. familiaris
cccaggcagccccagg

SEQ ID NO: 312506 - DNA, 16 bp, C. familiaris
cccaggcaggctccac

SEQ ID NO: 312507 - DNA, 16 bp, C. familiaris
cccaggcatcccacca

SEQ ID NO: 312508 - DNA, 16 bp, C. familiaris
cccaggcatcccacta

SEQ ID NO: 312509 - DNA, 16 bp, C. familiaris
cccaggcatccccacc

SEQ ID NO: 312510 - DNA, 16 bp, C. familiaris
cccaggcatcccccca

SEQ ID NO: 312511 - DNA, 16 bp, C. familiaris
cccaggcatcccctga

SEQ ID NO: 312512 - DNA, 16 bp, C. familiaris
cccaggcatcccctgc

SEQ ID NO: 312513 - DNA, 16 bp, C. familiaris
cccaggcatccctggg

SEQ ID NO: 312514 - DNA, 16 bp, C. familiaris
cccaggcatcctgagt

SEQ ID NO: 312515 - DNA, 16 bp, C. familiaris
cccaggcatcctggtt

SEQ ID NO: 312516 - DNA, 16 bp, C. familiaris
cccaggcatctctgaa

SEQ ID NO: 312517 - DNA, 16 bp, C. familiaris
cccaggccacacagct

SEQ ID NO: 312518 - DNA, 16 bp, C. familiaris
cccaggccaggcctcc

SEQ ID NO: 312519 - DNA, 16 bp, C. familiaris
cccaggcccagcccag

SEQ ID NO: 312520 - DNA, 16 bp, C. familiaris
cccaggcccagctctg

SEQ ID NO: 312521 - DNA, 16 bp, C. familiaris
cccaggcccaggatca

SEQ ID NO: 312522 - DNA, 16 bp, C. familiaris
cccaggccccagcagg

SEQ ID NO: 312523 - DNA, 16 bp, C. familiaris
cccaggcccccaggat

SEQ ID NO: 312524 - DNA, 16 bp, C. familiaris
cccaggccccccagga

SEQ ID NO: 312525 - DNA, 16 bp, C. familiaris
cccaggcccctcccag

SEQ ID NO: 312526 - DNA, 16 bp, C. familiaris
cccaggcccctgccct

SEQ ID NO: 312527 - DNA, 16 bp, C. familiaris
cccaggcccctgggaa

SEQ ID NO: 312528 - DNA, 16 bp, C. familiaris
cccaggccctgcccac

SEQ ID NO: 312529 - DNA, 16 bp, C. familiaris
cccaggccctgcccag

SEQ ID NO: 312530 - DNA, 16 bp, C. familiaris
cccaggccctgcccca

SEQ ID NO: 312531 - DNA, 16 bp, C. familiaris
cccaggccctgcctcc

SEQ ID NO: 312532 - DNA, 16 bp, C. familiaris
cccaggccctgctgcc

SEQ ID NO: 312533 - DNA, 16 bp, C. familiaris
cccaggccctggcccc

SEQ ID NO: 312534 - DNA, 16 bp, C. familiaris
cccaggccctgtcccc

SEQ ID NO: 312535 - DNA, 16 bp, C. familiaris
cccaggccgcaggcag

SEQ ID NO: 312536 - DNA, 16 bp, C. familiaris
cccaggcctcacccca

SEQ ID NO: 312537 - DNA, 16 bp, C. familiaris
cccaggcctccccagg

SEQ ID NO: 312538 - DNA, 16 bp, C. familiaris
cccaggcctgccctgc

SEQ ID NO: 312539 - DNA, 16 bp, C. familiaris
cccaggcctgcctgcc

SEQ ID NO: 312540 - DNA, 16 bp, C. familiaris
cccaggcctgggcccc

SEQ ID NO: 312541 - DNA, 16 bp, C. familiaris
cccaggcctgggctcc

SEQ ID NO: 312542 - DNA, 16 bp, C. familiaris
cccaggcgccccactg

SEQ ID NO: 312543 - DNA, 16 bp, C. familiaris
cccaggcgcccctgca

SEQ ID NO: 312544 - DNA, 16 bp, C. familiaris
cccaggcgcccctgtc

SEQ ID NO: 312545 - DNA, 16 bp, C. familiaris
cccaggcgccccttcc

SEQ ID NO: 312546 - DNA, 16 bp, C. familiaris
cccaggcgtccccatc

SEQ ID NO: 312547 - DNA, 16 bp, C. familiaris
cccaggcgtccctcgt

SEQ ID NO: 312548 - DNA, 16 bp, C. familiaris
cccaggctcccagccc

SEQ ID NO: 312549 - DNA, 16 bp, C. familiaris
cccaggctcccagggg

SEQ ID NO: 312550 - DNA, 16 bp, C. familiaris
cccaggctccccagga

SEQ ID NO: 312551 - DNA, 16 bp, C. familiaris
cccaggctcccctctc

SEQ ID NO: 312552 - DNA, 16 bp, C. familiaris
cccaggctcccctctg

SEQ ID NO: 312553 - DNA, 16 bp, C. familiaris
cccaggctcctcctcc

SEQ ID NO: 312554 - DNA, 16 bp, C. familiaris
cccaggctcctgggat

SEQ ID NO: 312555 - DNA, 16 bp, C. familiaris
cccaggctctgccctc

SEQ ID NO: 312556 - DNA, 16 bp, C. familiaris
cccaggctgcccagct

SEQ ID NO: 312557 - DNA, 16 bp, C. familiaris
cccaggctgcccccaa

SEQ ID NO: 312558 - DNA, 16 bp, C. familiaris
cccaggctgcccctgc

SEQ ID NO: 312559 - DNA, 16 bp, C. familiaris
cccaggctgcccctta

SEQ ID NO: 312560 - DNA, 16 bp, C. familiaris
cccaggctgcccggaa

SEQ ID NO: 312561 - DNA, 16 bp, C. familiaris
cccaggctgccctctg

SEQ ID NO: 312562 - DNA, 16 bp, C. familiaris
cccaggctgccctgga

SEQ ID NO: 312563 - DNA, 16 bp, C. familiaris
cccaggctgccctggg

SEQ ID NO: 312564 - DNA, 16 bp, C. familiaris
cccaggctgcccttgg

SEQ ID NO: 312565 - DNA, 16 bp, C. familiaris
cccaggctggggtggg

SEQ ID NO: 312566 - DNA, 16 bp, C. familiaris
cccaggctgtggtatt

SEQ ID NO: 312567 - DNA, 16 bp, C. familiaris
cccagggagaggcaga

SEQ ID NO: 312568 - DNA, 16 bp, C. familiaris
cccagggagcaggagg

SEQ ID NO: 312569 - DNA, 16 bp, C. familiaris
cccagggagcccaagg

SEQ ID NO: 312570 - DNA, 16 bp, C. familiaris
cccagggagcccaggg

SEQ ID NO: 312571 - DNA, 16 bp, C. familiaris
cccagggagccccagt

SEQ ID NO: 312572 - DNA, 16 bp, C. familiaris
cccagggagcccccag

SEQ ID NO: 312573 - DNA, 16 bp, C. familiaris
cccagggaggggacag

SEQ ID NO: 312574 - DNA, 16 bp, C. familiaris
cccagggaggggctgg

SEQ ID NO: 312575 - DNA, 16 bp, C. familiaris
cccagggagtggtcct

SEQ ID NO: 312576 - DNA, 16 bp, C. familiaris
cccagggatcccaaga

SEQ ID NO: 312577 - DNA, 16 bp, C. familiaris
cccagggatcccaggc

SEQ ID NO: 312578 - DNA, 16 bp, C. familiaris
cccagggatcccaggg

SEQ ID NO: 312579 - DNA, 16 bp, C. familiaris
cccagggatccctgct

SEQ ID NO: 312580 - DNA, 16 bp, C. familiaris
cccagggatccctgga

SEQ ID NO: 312581 - DNA, 16 bp, C. familiaris
cccagggatcctcatt

SEQ ID NO: 312582 - DNA, 16 bp, C. familiaris
cccagggcaaaggcag

SEQ ID NO: 312583 - DNA, 16 bp, C. familiaris
cccagggcaagatcct

SEQ ID NO: 312584 - DNA, 16 bp, C. familiaris
cccagggcacccaggg

SEQ ID NO: 312585 - DNA, 16 bp, C. familiaris
cccagggcaccggggg

SEQ ID NO: 312586 - DNA, 16 bp, C. familiaris
cccagggcagagccca

SEQ ID NO: 312587 - DNA, 16 bp, C. familiaris
cccagggcagcagggc

SEQ ID NO: 312588 - DNA, 16 bp, C. familiaris
cccagggcagcccagg

SEQ ID NO: 312589 - DNA, 16 bp, C. familiaris
cccagggcagcctggg

SEQ ID NO: 312590 - DNA, 16 bp, C. familiaris
cccagggcagggcccc

SEQ ID NO: 312591 - DNA, 16 bp, C. familiaris
cccagggcatcatcct

SEQ ID NO: 312592 - DNA, 16 bp, C. familiaris
cccagggccagatcct

SEQ ID NO: 312593 - DNA, 16 bp, C. familiaris
cccagggccaggcagg

SEQ ID NO: 312594 - DNA, 16 bp, C. familiaris
cccagggccaggccag

SEQ ID NO: 312595 - DNA, 16 bp, C. familiaris
cccagggccaggctgc

SEQ ID NO: 312596 - DNA, 16 bp, C. familiaris
cccagggcccagccca

SEQ ID NO: 312597 - DNA, 16 bp, C. familiaris
cccagggcccaggagg

SEQ ID NO: 312598 - DNA, 16 bp, C. familiaris
cccagggccccaggat

SEQ ID NO: 312599 - DNA, 16 bp, C. familiaris
cccagggcccccaggg

SEQ ID NO: 312600 - DNA, 16 bp, C. familiaris
cccagggcccctgccc

SEQ ID NO: 312601 - DNA, 16 bp, C. familiaris
cccagggccctgcagc

SEQ ID NO: 312602 - DNA, 16 bp, C. familiaris
cccagggccctgcccc

SEQ ID NO: 312603 - DNA, 16 bp, C. familiaris
cccagggcctcccagg

SEQ ID NO: 312604 - DNA, 16 bp, C. familiaris
cccagggcctggcccc

SEQ ID NO: 312605 - DNA, 16 bp, C. familiaris
cccagggcctggggcc

SEQ ID NO: 312606 - DNA, 16 bp, C. familiaris
cccagggcgcgatcct

SEQ ID NO: 312607 - DNA, 16 bp, C. familiaris
cccagggcgggatcct

SEQ ID NO: 312608 - DNA, 16 bp, C. familiaris
cccagggctccaggac

SEQ ID NO: 312609 - DNA, 16 bp, C. familiaris
cccagggctcccaggg

SEQ ID NO: 312610 - DNA, 16 bp, C. familiaris
cccagggctgcagggg

SEQ ID NO: 312611 - DNA, 16 bp, C. familiaris
cccagggctggggctg

SEQ ID NO: 312612 - DNA, 16 bp, C. familiaris
cccaggggagcctgct

SEQ ID NO: 312613 - DNA, 16 bp, C. familiaris
cccaggggagcctggg

SEQ ID NO: 312614 - DNA, 16 bp, C. familiaris
cccaggggccccaaga

SEQ ID NO: 312615 - DNA, 16 bp, C. familiaris
cccaggggccccaggg

SEQ ID NO: 312616 - DNA, 16 bp, C. familiaris
cccaggggcccccaga

SEQ ID NO: 312617 - DNA, 16 bp, C. familiaris
cccaggggcccccagg

SEQ ID NO: 312618 - DNA, 16 bp, C. familiaris
cccaggggcccctcct

SEQ ID NO: 312619 - DNA, 16 bp, C. familiaris
cccaggggcccctgag

SEQ ID NO: 312620 - DNA, 16 bp, C. familiaris
cccaggggcccctgct

SEQ ID NO: 312621 - DNA, 16 bp, C. familiaris
cccaggggcccctggg

SEQ ID NO: 312622 - DNA, 16 bp, C. familiaris
cccaggggctcagcgg

SEQ ID NO: 312623 - DNA, 16 bp, C. familiaris
cccaggggctcctggg

SEQ ID NO: 312624 - DNA, 16 bp, C. familiaris
cccaggggtccccaag

SEQ ID NO: 312625 - DNA, 16 bp, C. familiaris
cccaggggtccctgga

SEQ ID NO: 312626 - DNA, 16 bp, C. familiaris
cccagggtcccacagc

SEQ ID NO: 312627 - DNA, 16 bp, C. familiaris
cccagggtcctggggt

SEQ ID NO: 312628 - DNA, 16 bp, C. familiaris
cccaggtaccccaagc

SEQ ID NO: 312629 - DNA, 16 bp, C. familiaris
cccaggtccctgggat

SEQ ID NO: 312630 - DNA, 16 bp, C. familiaris
cccaggtctccagcat

SEQ ID NO: 312631 - DNA, 16 bp, C. familiaris
cccaggtgatgctggt

SEQ ID NO: 312632 - DNA, 16 bp, C. familiaris
cccaggtgcccaggtg

SEQ ID NO: 312633 - DNA, 16 bp, C. familiaris
cccaggtgccccacca

SEQ ID NO: 312634 - DNA, 16 bp, C. familiaris
cccaggtgcccccact

SEQ ID NO: 312635 - DNA, 16 bp, C. familiaris
cccaggtgccccccaa

SEQ ID NO: 312636 - DNA, 16 bp, C. familiaris
cccaggtgccccctgc

SEQ ID NO: 312637 - DNA, 16 bp, C. familiaris
cccaggtgcccctaga

SEQ ID NO: 312638 - DNA, 16 bp, C. familiaris
cccaggtgcccctcat

SEQ ID NO: 312639 - DNA, 16 bp, C. familiaris
cccaggtgcccctggg

SEQ ID NO: 312640 - DNA, 16 bp, C. familiaris
cccaggtgccccttgg

SEQ ID NO: 312641 - DNA, 16 bp, C. familiaris
cccaggtgccctcaag

SEQ ID NO: 312642 - DNA, 16 bp, C. familiaris
cccaggtgccctctcc

SEQ ID NO: 312643 - DNA, 16 bp, C. familiaris
cccaggtgccctggaa

SEQ ID NO: 312644 - DNA, 16 bp, C. familiaris
cccaggtgccctggac

SEQ ID NO: 312645 - DNA, 16 bp, C. familiaris
cccaggtgccctgggg

SEQ ID NO: 312646 - DNA, 16 bp, C. familiaris
cccaggtgcccttctg

SEQ ID NO: 312647 - DNA, 16 bp, C. familiaris
cccaggtgcccttctt

SEQ ID NO: 312648 - DNA, 16 bp, C. familiaris
cccaggtgcccttgga

SEQ ID NO: 312649 - DNA, 16 bp, C. familiaris
cccaggtgcccttttt

SEQ ID NO: 312650 - DNA, 16 bp, C. familiaris
cccaggtgcctccatt

SEQ ID NO: 312651 - DNA, 16 bp, C. familiaris
cccaggtgcctctctg

SEQ ID NO: 312652 - DNA, 16 bp, C. familiaris
cccaggtgctccagca

SEQ ID NO: 312653 - DNA, 16 bp, C. familiaris
cccaggtgctcctgga

SEQ ID NO: 312654 - DNA, 16 bp, C. familiaris
cccaggtgctcctggc

SEQ ID NO: 312655 - DNA, 16 bp, C. familiaris
cccaggtgctcctggg

SEQ ID NO: 312656 - DNA, 16 bp, C. familiaris
cccaggtggcccagca

SEQ ID NO: 312657 - DNA, 16 bp, C. familiaris
cccaggtggcccaggg

SEQ ID NO: 312658 - DNA, 16 bp, C. familiaris
cccaggtggccctgaa

SEQ ID NO: 312659 - DNA, 17 bp, C. familiaris
cccaggtggcgcagcgg

SEQ ID NO: 312660 - DNA, 16 bp, C. familiaris
cccaggtgtcccagtg

SEQ ID NO: 312661 - DNA, 16 bp, C. familiaris
cccaggtgtccccagc

SEQ ID NO: 312662 - DNA, 16 bp, C. familiaris
cccaggtgtccccctg

SEQ ID NO: 312663 - DNA, 16 bp, C. familiaris
cccaggtgtcccctcc

SEQ ID NO: 312664 - DNA, 16 bp, C. familiaris
cccaggtgtccctctc

SEQ ID NO: 312665 - DNA, 16 bp, C. familiaris
cccaggtgtccctgaa

SEQ ID NO: 312666 - DNA, 16 bp, C. familiaris
cccaggtgtccctgca

SEQ ID NO: 312667 - DNA, 16 bp, C. familiaris
cccaggtgtccctgga

SEQ ID NO: 312668 - DNA, 16 bp, C. familiaris
cccaggtgtcccttgc

SEQ ID NO: 312669 - DNA, 16 bp, C. familiaris
cccaggtgtcctggta

SEQ ID NO: 312670 - DNA, 16 bp, C. familiaris
cccaggtgtccttctt

SEQ ID NO: 312671 - DNA, 16 bp, C. familiaris
cccagtacagagcctg

SEQ ID NO: 312672 - DNA, 16 bp, C. familiaris
cccagtcccagcccca

SEQ ID NO: 312673 - DNA, 16 bp, C. familiaris
cccagtcctggagaag

SEQ ID NO: 312674 - DNA, 16 bp, C. familiaris
cccagtctgtggtgtt

SEQ ID NO: 312675 - DNA, 16 bp, C. familiaris
cccagtgagcaggaag

SEQ ID NO: 312676 - DNA, 16 bp, C. familiaris
cccagtgcaggactgg

SEQ ID NO: 312677 - DNA, 16 bp, C. familiaris
cccagtgcctggcaca

SEQ ID NO: 312678 - DNA, 16 bp, C. familiaris
cccagtgcctgtcacc

SEQ ID NO: 312679 - DNA, 16 bp, C. familiaris
cccagtgctcatctcc

SEQ ID NO: 312680 - DNA, 16 bp, C. familiaris
cccagtgctttcccat

SEQ ID NO: 312681 - DNA, 16 bp, C. familiaris
cccagtggatattctt

SEQ ID NO: 312682 - DNA, 16 bp, C. familiaris
cccagtggcccagcgg

SEQ ID NO: 312683 - DNA, 16 bp, C. familiaris
cccagtggccctcttc

SEQ ID NO: 312684 - DNA, 16 bp, C. familiaris
cccagtggggagccca

SEQ ID NO: 312685 - DNA, 16 bp, C. familiaris
cccagtgtagagccca

SEQ ID NO: 312686 - DNA, 16 bp, C. familiaris
cccagtgtcaggctcc

SEQ ID NO: 312687 - DNA, 16 bp, C. familiaris
cccagtgtggggcttg

SEQ ID NO: 312688 - DNA, 16 bp, C. familiaris
cccagttctgccattt

SEQ ID NO: 312689 - DNA, 16 bp, C. familiaris
cccataaaaaccccta

SEQ ID NO: 312690 - DNA, 16 bp, C. familiaris
cccatcaaaaggctca

SEQ ID NO: 312691 - DNA, 16 bp, C. familiaris
cccatccatccatcca

SEQ ID NO: 312692 - DNA, 16 bp, C. familiaris
cccatcccctccagca

SEQ ID NO: 312693 - DNA, 16 bp, C. familiaris
cccatcgagtgccccc

SEQ ID NO: 312694 - DNA, 16 bp, C. familiaris
cccatctccaggatca

SEQ ID NO: 312695 - DNA, 16 bp, C. familiaris
cccatctccctgccca

SEQ ID NO: 312696 - DNA, 16 bp, C. familiaris
cccatcttcaaagcca

SEQ ID NO: 312697 - DNA, 16 bp, C. familiaris
cccatgaaaaaataaa

SEQ ID NO: 312698 - DNA, 16 bp, C. familiaris
cccatgacctcaagat

SEQ ID NO: 312699 - DNA, 16 bp, C. familiaris
cccatgcagggctcca

SEQ ID NO: 312700 - DNA, 16 bp, C. familiaris
cccatgctgggcatgg

SEQ ID NO: 312701 - DNA, 16 bp, C. familiaris
cccatgggatacacag

SEQ ID NO: 312702 - DNA, 16 bp, C. familiaris
cccatggggctccctg

SEQ ID NO: 312703 - DNA, 16 bp, C. familiaris
cccatgtcgggctccc

SEQ ID NO: 312704 - DNA, 16 bp, C. familiaris
cccatgttcactgcag

SEQ ID NO: 312705 - DNA, 16 bp, C. familiaris
cccattgagcatggag

SEQ ID NO: 312706 - DNA, 16 bp, C. familiaris
cccatttatgagggct

SEQ ID NO: 312707 - DNA, 16 bp, C. familiaris
cccatttcacagatga

SEQ ID NO: 312708 - DNA, 16 bp, C. familiaris
cccatttctggattct

SEQ ID NO: 312709 - DNA, 16 bp, C. familiaris
cccattttaaggatga

SEQ ID NO: 312710 - DNA, 16 bp, C. familiaris
cccattttcaattgca

SEQ ID NO: 312711 - DNA, 16 bp, C. familiaris
ccccaaaatatttttt

SEQ ID NO: 312712 - DNA, 16 bp, C. familiaris
ccccaaaccaaataat

SEQ ID NO: 312713 - DNA, 16 bp, C. familiaris
ccccaaactggaagca

SEQ ID NO: 312714 - DNA, 16 bp, C. familiaris
ccccaaagaaatggag

SEQ ID NO: 312715 - DNA, 16 bp, C. familiaris
ccccaaagaagaagta

SEQ ID NO: 312716 - DNA, 16 bp, C. familiaris
ccccaaattcacatgt

SEQ ID NO: 312717 - DNA, 16 bp, C. familiaris
ccccaactcatgttct

SEQ ID NO: 312718 - DNA, 16 bp, C. familiaris
ccccaagatcgtgacc

SEQ ID NO: 312719 - DNA, 16 bp, C. familiaris
ccccaagcagggagcc

SEQ ID NO: 312720 - DNA, 42 bp, C. familiaris
ccccaatacctgccaccccagtcttaatcagtggtggaagaa

SEQ ID NO: 312721 - DNA, 16 bp, C. familiaris
ccccaatccctggcaa

SEQ ID NO: 312722 - DNA, 16 bp, C. familiaris
ccccacactcagcagg

SEQ ID NO: 312723 - DNA, 16 bp, C. familiaris
ccccacagggagcctg

SEQ ID NO: 312724 - DNA, 16 bp, C. familiaris
ccccacagtgagcctg

SEQ ID NO: 312725 - DNA, 16 bp, C. familiaris
ccccacatagagcctg

SEQ ID NO: 312726 - DNA, 16 bp, C. familiaris
ccccacatcagtctct

SEQ ID NO: 312727 - DNA, 16 bp, C. familiaris
ccccacatggagccca

SEQ ID NO: 312728 - DNA, 16 bp, C. familiaris
ccccaccccaggcctg

SEQ ID NO: 312729 - DNA, 16 bp, C. familiaris
ccccaccccagggcct

SEQ ID NO: 312730 - DNA, 16 bp, C. familiaris
ccccaccctcatgacc

SEQ ID NO: 312731 - DNA, 16 bp, C. familiaris
ccccaccctgggcctc

SEQ ID NO: 312732 - DNA, 16 bp, C. familiaris
ccccacctccacctgt

SEQ ID NO: 312733 - DNA, 16 bp, C. familiaris
ccccacctcctccagg

SEQ ID NO: 312734 - DNA, 16 bp, C. familiaris
ccccacgaggagccgg

SEQ ID NO: 312735 - DNA, 16 bp, C. familiaris
ccccactgagcaggac

SEQ ID NO: 312736 - DNA, 16 bp, C. familiaris
ccccactgagcaggat

SEQ ID NO: 312737 - DNA, 16 bp, C. familiaris
ccccactgagccggga

SEQ ID NO: 312738 - DNA, 16 bp, C. familiaris
ccccactgggctccct

SEQ ID NO: 312739 - DNA, 16 bp, C. familiaris
ccccacttggtcatga

SEQ ID NO: 312740 - DNA, 16 bp, C. familiaris
ccccagaagaccacct

SEQ ID NO: 312741 - DNA, 16 bp, C. familiaris
ccccagaatcatgccc

SEQ ID NO: 312742 - DNA, 16 bp, C. familiaris
ccccagactggcccac

SEQ ID NO: 312743 - DNA, 16 bp, C. familiaris
ccccagagcccccaga

SEQ ID NO: 312744 - DNA, 16 bp, C. familiaris
ccccagagcccccagg

SEQ ID NO: 312745 - DNA, 16 bp, C. familiaris
ccccagagcctccagg

SEQ ID NO: 312746 - DNA, 16 bp, C. familiaris
ccccagagctgctccc

SEQ ID NO: 312747 - DNA, 16 bp, C. familiaris
ccccagaggaggaagt

SEQ ID NO: 312748 - DNA, 16 bp, C. familiaris
ccccagaggaggcccg

SEQ ID NO: 312749 - DNA, 16 bp, C. familiaris
ccccagagggagcctg

SEQ ID NO: 312750 - DNA, 16 bp, C. familiaris
ccccagagtcctggga

SEQ ID NO: 312751 - DNA, 16 bp, C. familiaris
ccccagcagccaggcc

SEQ ID NO: 312752 - DNA, 16 bp, C. familiaris
ccccagcatcacgccc

SEQ ID NO: 312753 - DNA, 16 bp, C. familiaris
ccccagcccactgctg

SEQ ID NO: 312754 - DNA, 16 bp, C. familiaris
ccccagccccagcctg

SEQ ID NO: 312755 - DNA, 16 bp, C. familiaris
ccccagccctgcctgg

SEQ ID NO: 312756 - DNA, 16 bp, C. familiaris
ccccagccctggccct

SEQ ID NO: 312757 - DNA, 16 bp, C. familiaris
ccccagcctcagcccg

SEQ ID NO: 312758 - DNA, 16 bp, C. familiaris
ccccagcctcagcctc

SEQ ID NO: 312759 - DNA, 16 bp, C. familiaris
ccccagcctccctctg

SEQ ID NO: 312760 - DNA, 16 bp, C. familiaris
ccccagcctgggcctc

SEQ ID NO: 312761 - DNA, 16 bp, C. familiaris
ccccagcctgggctcc

SEQ ID NO: 312762 - DNA, 16 bp, C. familiaris
ccccagcgccctgggc

SEQ ID NO: 312763 - DNA, 16 bp, C. familiaris
ccccagctccccagct

SEQ ID NO: 312764 - DNA, 16 bp, C. familiaris
ccccagctctgccctg

SEQ ID NO: 312765 - DNA, 16 bp, C. familiaris
ccccagctctgctcct

SEQ ID NO: 312766 - DNA, 16 bp, C. familiaris
ccccaggacagggaga

SEQ ID NO: 312767 - DNA, 16 bp, C. familiaris
ccccaggacccagcac

SEQ ID NO: 312768 - DNA, 16 bp, C. familiaris
ccccaggaccccaaga

SEQ ID NO: 312769 - DNA, 16 bp, C. familiaris
ccccaggaccccatcc

SEQ ID NO: 312770 - DNA, 16 bp, C. familiaris
ccccaggacctgagcc

SEQ ID NO: 312771 - DNA, 16 bp, C. familiaris
ccccaggagcccccag

SEQ ID NO: 312772 - DNA, 16 bp, C. familiaris
ccccaggaggagccgg

SEQ ID NO: 312773 - DNA, 16 bp, C. familiaris
ccccaggcagcctggg

SEQ ID NO: 312774 - DNA, 16 bp, C. familiaris
ccccaggccccaggat

SEQ ID NO: 312775 - DNA, 16 bp, C. familiaris
ccccaggcctggccac

SEQ ID NO: 312776 - DNA, 16 bp, C. familiaris
ccccaggcctggctgg

SEQ ID NO: 312777 - DNA, 16 bp, C. familiaris
ccccaggctctgtgct

SEQ ID NO: 312778 - DNA, 16 bp, C. familiaris
ccccaggctgcaggag

SEQ ID NO: 312779 - DNA, 16 bp, C. familiaris
ccccaggctgggcccc

SEQ ID NO: 312780 - DNA, 16 bp, C. familiaris
ccccagggaccccagc

SEQ ID NO: 312781 - DNA, 16 bp, C. familiaris
ccccagggagcctgcc

SEQ ID NO: 312782 - DNA, 16 bp, C. familiaris
ccccagggcagcccca

SEQ ID NO: 312783 - DNA, 16 bp, C. familiaris
ccccagggcagcctgg

SEQ ID NO: 312784 - DNA, 16 bp, C. familiaris
ccccagggcccagcag

SEQ ID NO: 312785 - DNA, 16 bp, C. familiaris
ccccagggccctgcct

SEQ ID NO: 312786 - DNA, 16 bp, C. familiaris
ccccagggccctgggg

SEQ ID NO: 312787 - DNA, 16 bp, C. familiaris
ccccagggcctggcac

SEQ ID NO: 312788 - DNA, 16 bp, C. familiaris
ccccagggctccccag

SEQ ID NO: 312789 - DNA, 16 bp, C. familiaris
ccccagggctccctcc

SEQ ID NO: 312790 - DNA, 16 bp, C. familiaris
ccccaggggcacctgg

SEQ ID NO: 312791 - DNA, 16 bp, C. familiaris
ccccagggtcctggga

SEQ ID NO: 312792 - DNA, 16 bp, C. familiaris
ccccagtcacctgtcc

SEQ ID NO: 312793 - DNA, 16 bp, C. familiaris
ccccagtgccctgggc

SEQ ID NO: 312794 - DNA, 16 bp, C. familiaris
ccccagtgctcatcac

SEQ ID NO: 312795 - DNA, 16 bp, C. familiaris
ccccagtggctcagca

SEQ ID NO: 312796 - DNA, 16 bp, C. familiaris
ccccatcctgaagcta

SEQ ID NO: 312797 - DNA, 16 bp, C. familiaris
ccccatggggaccctg

SEQ ID NO: 312798 - DNA, 16 bp, C. familiaris
ccccatgtggggttcc

SEQ ID NO: 312799 - DNA, 16 bp, C. familiaris
ccccatgtttgtgatg

SEQ ID NO: 312800 - DNA, 16 bp, C. familiaris
ccccattttatacatg

SEQ ID NO: 312801 - DNA, 16 bp, C. familiaris
ccccattttgcagatg

SEQ ID NO: 312802 - DNA, 16 bp, C. familiaris
ccccattttgcagatt

SEQ ID NO: 312803 - DNA, 16 bp, C. familiaris
cccccaaaaaagaaat

SEQ ID NO: 312804 - DNA, 16 bp, C. familiaris
cccccaactgagccag

SEQ ID NO: 312805 - DNA, 16 bp, C. familiaris
cccccaagtcacctgt

SEQ ID NO: 312806 - DNA, 16 bp, C. familiaris
cccccacaaggagcct

SEQ ID NO: 312807 - DNA, 16 bp, C. familiaris
cccccacagagagcct

SEQ ID NO: 312808 - DNA, 16 bp, C. familiaris
cccccaccccctgggg

SEQ ID NO: 312809 - DNA, 16 bp, C. familiaris
cccccaccccggggct

SEQ ID NO: 312810 - DNA, 16 bp, C. familiaris
cccccacccctgtgtc

SEQ ID NO: 312811 - DNA, 16 bp, C. familiaris
cccccaccctgctcat

SEQ ID NO: 312812 - DNA, 16 bp, C. familiaris
cccccacctcccaggg

SEQ ID NO: 312813 - DNA, 16 bp, C. familiaris
cccccacgtcaggctc

SEQ ID NO: 312814 - DNA, 16 bp, C. familiaris
cccccacttgcacaca

SEQ ID NO: 312815 - DNA, 16 bp, C. familiaris
cccccagaagaccagc

SEQ ID NO: 312816 - DNA, 16 bp, C. familiaris
cccccagaagatcagc

SEQ ID NO: 312817 - DNA, 16 bp, C. familiaris
cccccagagccccagg

SEQ ID NO: 312818 - DNA, 16 bp, C. familiaris
cccccagcaaccctca

SEQ ID NO: 312819 - DNA, 16 bp, C. familiaris
cccccagcaggctccc

SEQ ID NO: 312820 - DNA, 16 bp, C. familiaris
cccccagcccctggca

SEQ ID NO: 312821 - DNA, 16 bp, C. familiaris
cccccagccctgcagc

SEQ ID NO: 312822 - DNA, 16 bp, C. familiaris
cccccagccctgggag

SEQ ID NO: 312823 - DNA, 16 bp, C. familiaris
cccccagccctgggca

SEQ ID NO: 312824 - DNA, 16 bp, C. familiaris
cccccagctcctgctc

SEQ ID NO: 312825 - DNA, 16 bp, C. familiaris
cccccaggacctcaga

SEQ ID NO: 312826 - DNA, 16 bp, C. familiaris
cccccaggagccccta

SEQ ID NO: 312827 - DNA, 16 bp, C. familiaris
cccccaggcctccctg

SEQ ID NO: 312828 - DNA, 16 bp, C. familiaris
cccccaggcctcctgc

SEQ ID NO: 312829 - DNA, 16 bp, C. familiaris
cccccaggctcccagg

SEQ ID NO: 312830 - DNA, 16 bp, C. familiaris
cccccaggggctcccc

SEQ ID NO: 312831 - DNA, 16 bp, C. familiaris
cccccaggtgccccca

SEQ ID NO: 312832 - DNA, 16 bp, C. familiaris
cccccaggttcccagg

SEQ ID NO: 312833 - DNA, 16 bp, C. familiaris
cccccagtccctggca

SEQ ID NO: 312834 - DNA, 16 bp, C. familiaris
cccccagtcctgggat

SEQ ID NO: 312835 - DNA, 16 bp, C. familiaris
cccccagtgccctggg

SEQ ID NO: 312836 - DNA, 16 bp, C. familiaris
cccccagtgcctgtca

SEQ ID NO: 312837 - DNA, 16 bp, C. familiaris
cccccatcaagctccc

SEQ ID NO: 312838 - DNA, 16 bp, C. familiaris
ccccccaagctgctcc

SEQ ID NO: 312839 - DNA, 16 bp, C. familiaris
ccccccagcagggagc

SEQ ID NO: 312840 - DNA, 16 bp, C. familiaris
ccccccagctcctggc

SEQ ID NO: 312841 - DNA, 16 bp, C. familiaris
ccccccaggcaccctg

SEQ ID NO: 312842 - DNA, 16 bp, C. familiaris
ccccccaggggtccct

SEQ ID NO: 312843 - DNA, 16 bp, C. familiaris
ccccccaggtgccctc

SEQ ID NO: 312844 - DNA, 17 bp, C. familiaris
cccccccgagctgctcc

SEQ ID NO: 312845 - DNA, 18 bp, C. familiaris
ccccccgggacaggcaga

SEQ ID NO: 312846 - DNA, 16 bp, C. familiaris
cccccctgagccctgc

SEQ ID NO: 312847 - DNA, 16 bp, C. familiaris
cccccgcagtaactcc

SEQ ID NO: 312848 - DNA, 16 bp, C. familiaris
cccccggagcctccag

SEQ ID NO: 312849 - DNA, 16 bp, C. familiaris
cccccggagctgctcc

SEQ ID NO: 312850 - DNA, 16 bp, C. familiaris
ccccctcaaaaaaaag

SEQ ID NO: 312851 - DNA, 16 bp, C. familiaris
ccccctccgcacagag

SEQ ID NO: 312852 - DNA, 16 bp, C. familiaris
ccccctcctcatgctc

SEQ ID NO: 312853 - DNA, 16 bp, C. familiaris
ccccctgagccccagg

SEQ ID NO: 312854 - DNA, 16 bp, C. familiaris
ccccctgagctgctcc

SEQ ID NO: 312855 - DNA, 16 bp, C. familiaris
ccccctgcagcccggg

SEQ ID NO: 312856 - DNA, 16 bp, C. familiaris
ccccctgctcaggctc

SEQ ID NO: 312857 - DNA, 16 bp, C. familiaris
ccccctgctcatgtac

SEQ ID NO: 312858 - DNA, 16 bp, C. familiaris
ccccctggggagcctg

SEQ ID NO: 312859 - DNA, 16 bp, C. familiaris
ccccctgtcaggctct

SEQ ID NO: 312860 - DNA, 16 bp, C. familiaris
cccccttacagatgag

SEQ ID NO: 312861 - DNA, 16 bp, C. familiaris
cccccttggagccccc

SEQ ID NO: 312862 - DNA, 16 bp, C. familiaris
ccccctttgcctgtgt

SEQ ID NO: 312863 - DNA, 16 bp, C. familiaris
ccccgagtcccaggat

SEQ ID NO: 312864 - DNA, 16 bp, C. familiaris
ccccgctgagcaggag

SEQ ID NO: 312865 - DNA, 16 bp, C. familiaris
ccccggaactccagga

SEQ ID NO: 312866 - DNA, 16 bp, C. familiaris
ccccggagcccagggc

SEQ ID NO: 312867 - DNA, 16 bp, C. familiaris
ccccggagcctccaga

SEQ ID NO: 312868 - DNA, 16 bp, C. familiaris
ccccggctgcaggcgg

SEQ ID NO: 312869 - DNA, 16 bp, C. familiaris
ccccgggaacatgacc

SEQ ID NO: 312870 - DNA, 16 bp, C. familiaris
ccccgggaacccgagg

SEQ ID NO: 312871 - DNA, 16 bp, C. familiaris
ccccgggagccccagg

SEQ ID NO: 312872 - DNA, 16 bp, C. familiaris
ccccgggatcgtgccc

SEQ ID NO: 312873 - DNA, 16 bp, C. familiaris
ccccggggacctggga

SEQ ID NO: 312874 - DNA, 16 bp, C. familiaris
ccccggggccctggga

SEQ ID NO: 312875 - DNA, 16 bp, C. familiaris
ccccggggctgcccag

SEQ ID NO: 312876 - DNA, 16 bp, C. familiaris
ccccgggggtcctggg

SEQ ID NO: 312877 - DNA, 16 bp, C. familiaris
ccccggggtcaagccc

SEQ ID NO: 312878 - DNA, 16 bp, C. familiaris
ccccggggtcatggcc

SEQ ID NO: 312879 - DNA, 16 bp, C. familiaris
ccccggggtcccagga

SEQ ID NO: 312880 - DNA, 16 bp, C. familiaris
ccccgggtggctcagc

SEQ ID NO: 312881 - DNA, 16 bp, C. familiaris
ccccggtggctcagag

SEQ ID NO: 312882 - DNA, 16 bp, C. familiaris
ccccggtggctcagca

SEQ ID NO: 312883 - DNA, 16 bp, C. familiaris
ccccgtggggaccctg

SEQ ID NO: 312884 - DNA, 29 bp, C. familiaris
cccctatggtggtggaggccaatactttg

SEQ ID NO: 312885 - DNA, 36 bp, C. familiaris
cccctatggtggtggaggccaatactttgccaaacc

SEQ ID NO: 312886 - DNA, 16 bp, C. familiaris
cccctcaaggagccca

SEQ ID NO: 312887 - DNA, 16 bp, C. familiaris
cccctcagtgcccctc

SEQ ID NO: 312888 - DNA, 16 bp, C. familiaris
cccctccacacggagc

SEQ ID NO: 312889 - DNA, 16 bp, C. familiaris
cccctccagcaaccct

SEQ ID NO: 312890 - DNA, 16 bp, C. familiaris
cccctccagcagccct

SEQ ID NO: 312891 - DNA, 16 bp, C. familiaris
cccctccagctgctcc

SEQ ID NO: 312892 - DNA, 16 bp, C. familiaris
cccctccaggaaccct

SEQ ID NO: 312893 - DNA, 16 bp, C. familiaris
cccctccaggtcctgg

SEQ ID NO: 312894 - DNA, 16 bp, C. familiaris
cccctcccactgctca

SEQ ID NO: 312895 - DNA, 16 bp, C. familiaris
cccctccccacactgg

SEQ ID NO: 312896 - DNA, 16 bp, C. familiaris
cccctccccaccaggg

SEQ ID NO: 312897 - DNA, 16 bp, C. familiaris
cccctccccatgctca

SEQ ID NO: 312898 - DNA, 16 bp, C. familiaris
cccctcccccaggaga

SEQ ID NO: 312899 - DNA, 16 bp, C. familiaris
cccctcccctccagtg

SEQ ID NO: 312900 - DNA, 16 bp, C. familiaris
cccctccccttctgca

SEQ ID NO: 312901 - DNA, 16 bp, C. familiaris
cccctccctctctaaa

SEQ ID NO: 312902 - DNA, 16 bp, C. familiaris
cccctccctgagccca

SEQ ID NO: 312903 - DNA, 19 bp, C. familiaris
cccctccgagctgctccgg

SEQ ID NO: 312904 - DNA, 16 bp, C. familiaris
cccctccgcggagcct

SEQ ID NO: 312905 - DNA, 16 bp, C. familiaris
cccctcctcactgctc

SEQ ID NO: 312906 - DNA, 16 bp, C. familiaris
cccctcctcctccagg

SEQ ID NO: 312907 - DNA, 16 bp, C. familiaris
cccctctcagtgcctg

SEQ ID NO: 312908 - DNA, 16 bp, C. familiaris
cccctctccttgctca

SEQ ID NO: 312909 - DNA, 16 bp, C. familiaris
cccctctctgggcctg

SEQ ID NO: 312910 - DNA, 25 bp, C. familiaris
cccctctgcacggagcctcttcctc

SEQ ID NO: 312911 - DNA, 17 bp, C. familiaris
cccctctgcggagccgc

SEQ ID NO: 312912 - DNA, 16 bp, C. familiaris
cccctctgtgcccatc

SEQ ID NO: 312913 - DNA, 16 bp, C. familiaris
cccctgagccaccagg

SEQ ID NO: 312914 - DNA, 16 bp, C. familiaris
cccctgagccccccgg

SEQ ID NO: 312915 - DNA, 16 bp, C. familiaris
cccctgagccccctgg

SEQ ID NO: 312916 - DNA, 16 bp, C. familiaris
cccctgagtgtggagc

SEQ ID NO: 312917 - DNA, 16 bp, C. familiaris
cccctgatgaacatgg

SEQ ID NO: 312918 - DNA, 16 bp, C. familiaris
cccctgcacacacaca

SEQ ID NO: 312919 - DNA, 16 bp, C. familiaris
cccctgcacagttgaa

SEQ ID NO: 312920 - DNA, 16 bp, C. familiaris
cccctgcacccctgca

SEQ ID NO: 312921 - DNA, 16 bp, C. familiaris
cccctgcacctgctcc

SEQ ID NO: 312922 - DNA, 16 bp, C. familiaris
cccctgcacctgctgc

SEQ ID NO: 312923 - DNA, 16 bp, C. familiaris
cccctgcagcccctgc

SEQ ID NO: 312924 - DNA, 16 bp, C. familiaris
cccctgcccagcccag

SEQ ID NO: 312925 - DNA, 16 bp, C. familiaris
cccctgccccagaaga

SEQ ID NO: 312926 - DNA, 16 bp, C. familiaris
cccctgcccctcagca

SEQ ID NO: 312927 - DNA, 16 bp, C. familiaris
cccctgcccctgggga

SEQ ID NO: 312928 - DNA, 16 bp, C. familiaris
cccctgcctccccagg

SEQ ID NO: 312929 - DNA, 16 bp, C. familiaris
cccctgctcatgtact

SEQ ID NO: 312930 - DNA, 16 bp, C. familiaris
cccctgcttgtgctca

SEQ ID NO: 312931 - DNA, 16 bp, C. familiaris
cccctgcttgtgtttg

SEQ ID NO: 312932 - DNA, 16 bp, C. familiaris
cccctggagcctccag

SEQ ID NO: 312933 - DNA, 16 bp, C. familiaris
cccctggaggagcctg

SEQ ID NO: 312934 - DNA, 16 bp, C. familiaris
cccctggatcatgacc

SEQ ID NO: 312935 - DNA, 16 bp, C. familiaris
cccctggcaaccagca

SEQ ID NO: 312936 - DNA, 16 bp, C. familiaris
cccctgggaggccatc

SEQ ID NO: 312937 - DNA, 16 bp, C. familiaris
cccctgggccaccagg

SEQ ID NO: 312938 - DNA, 16 bp, C. familiaris
cccctgggccaccggg

SEQ ID NO: 312939 - DNA, 16 bp, C. familiaris
cccctgggcccctggg

SEQ ID NO: 312940 - DNA, 16 bp, C. familiaris
cccctggggagcccga

SEQ ID NO: 312941 - DNA, 16 bp, C. familiaris
cccctgggtgggtcag

SEQ ID NO: 312942 - DNA, 16 bp, C. familiaris
cccctgtgttttcttc

SEQ ID NO: 312943 - DNA, 16 bp, C. familiaris
ccccttccccagcttg

SEQ ID NO: 312944 - DNA, 16 bp, C. familiaris
ccccttcctctgctca

SEQ ID NO: 312945 - DNA, 16 bp, C. familiaris
cccctttccttccagc

SEQ ID NO: 312946 - DNA, 16 bp, C. familiaris
cccgagcacagggcgc

SEQ ID NO: 312947 - DNA, 16 bp, C. familiaris
cccgagcagaaggcag

SEQ ID NO: 312948 - DNA, 23 bp, C. familiaris
cccgagcccctccgagctgctcc

SEQ ID NO: 312949 - DNA, 16 bp, C. familiaris
cccgagcccggccgag

SEQ ID NO: 312950 - DNA, 34 bp, C. familiaris
cccgagggcatccccgccctcctgggtcctgctc

SEQ ID NO: 312951 - DNA, 16 bp, C. familiaris
cccgatgcaggacttg

SEQ ID NO: 312952 - DNA, 16 bp, C. familiaris
cccgatggcccagcag

SEQ ID NO: 312953 - DNA, 16 bp, C. familiaris
cccgcactgggctcct

SEQ ID NO: 312954 - DNA, 16 bp, C. familiaris
cccgcaggagcctgct

SEQ ID NO: 312955 - DNA, 16 bp, C. familiaris
cccgcatggggcctgc

SEQ ID NO: 312956 - DNA, 16 bp, C. familiaris
cccgccccctgccagg

SEQ ID NO: 312957 - DNA, 16 bp, C. familiaris
cccgccccggagcctc

SEQ ID NO: 312958 - DNA, 16 bp, C. familiaris
cccgccgggagcctgc

SEQ ID NO: 312959 - DNA, 16 bp, C. familiaris
cccgcctccacctgtc

SEQ ID NO: 312960 - DNA, 16 bp, C. familiaris
cccgcgaggagctggg

SEQ ID NO: 312961 - DNA, 16 bp, C. familiaris
cccgcgtctggctccc

SEQ ID NO: 312962 - DNA, 16 bp, C. familiaris
cccgctcattctctct

SEQ ID NO: 312963 - DNA, 16 bp, C. familiaris
cccgctgagtgaggag

SEQ ID NO: 312964 - DNA, 16 bp, C. familiaris
cccggagcatccaggc

SEQ ID NO: 312965 - DNA, 16 bp, C. familiaris
cccggagccccggagc

SEQ ID NO: 312966 - DNA, 24 bp, C. familiaris
cccggagcctccaggccctgcaga

SEQ ID NO: 312967 - DNA, 16 bp, C. familiaris
cccggagtccccggat

SEQ ID NO: 312968 - DNA, 16 bp, C. familiaris
cccggctcagcaggga

SEQ ID NO: 312969 - DNA, 16 bp, C. familiaris
cccgggaacctggggg

SEQ ID NO: 312970 - DNA, 16 bp, C. familiaris
cccgggaacgagtccc

SEQ ID NO: 312971 - DNA, 26 bp, C. familiaris
cccgggaaggtcggtgcagctcctgc

SEQ ID NO: 312972 - DNA, 16 bp, C. familiaris
cccgggaccgagtccc

SEQ ID NO: 312973 - DNA, 16 bp, C. familiaris
cccgggactccaggag

SEQ ID NO: 312974 - DNA, 16 bp, C. familiaris
cccgggagcccagggc

SEQ ID NO: 312975 - DNA, 16 bp, C. familiaris
cccgggaggctggagg

SEQ ID NO: 312976 - DNA, 16 bp, C. familiaris
cccgggatcccaggat

SEQ ID NO: 312977 - DNA, 16 bp, C. familiaris
cccgggatcgtgacct

SEQ ID NO: 312978 - DNA, 16 bp, C. familiaris
cccgggcagccctggt

SEQ ID NO: 312979 - DNA, 16 bp, C. familiaris
cccgggccagaggcag

SEQ ID NO: 312980 - DNA, 16 bp, C. familiaris
cccgggctaaaggcgg

SEQ ID NO: 312981 - DNA, 16 bp, C. familiaris
cccgggctgcaggcgg

SEQ ID NO: 312982 - DNA, 16 bp, C. familiaris
cccgggctgcccaggc

SEQ ID NO: 312983 - DNA, 16 bp, C. familiaris
cccgggctgccccgag

SEQ ID NO: 312984 - DNA, 16 bp, C. familiaris
cccggggccccaggat

SEQ ID NO: 312985 - DNA, 16 bp, C. familiaris
cccggggccctggggt

SEQ ID NO: 312986 - DNA, 16 bp, C. familiaris
cccggggctgcaggcg

SEQ ID NO: 312987 - DNA, 16 bp, C. familiaris
cccggggtccaggatc

SEQ ID NO: 312988 - DNA, 16 bp, C. familiaris
cccggggtcccagggt

SEQ ID NO: 312989 - DNA, 16 bp, C. familiaris
cccggggtccccagga

SEQ ID NO: 312990 - DNA, 16 bp, C. familiaris
cccggggtcctggagt

SEQ ID NO: 312991 - DNA, 16 bp, C. familiaris
cccgggtccaggatca

SEQ ID NO: 312992 - DNA, 16 bp, C. familiaris
cccgggtccccagggt

SEQ ID NO: 312993 - DNA, 16 bp, C. familiaris
cccgggtcccgggatc

SEQ ID NO: 312994 - DNA, 16 bp, C. familiaris
cccgggtctaccagga

SEQ ID NO: 312995 - DNA, 16 bp, C. familiaris
cccggtctccaggatc

SEQ ID NO: 312996 - DNA, 16 bp, C. familiaris
cccggtgccctgggat

SEQ ID NO: 312997 - DNA, 16 bp, C. familiaris
cccggtggcccagcag

SEQ ID NO: 312998 - DNA, 16 bp, C. familiaris
cccgtcccccagtcac

SEQ ID NO: 312999 - DNA, 16 bp, C. familiaris
cccgtcctggagaagc

SEQ ID NO: 313000 - DNA, 16 bp, C. familiaris
cccgtggggctccctg

SEQ ID NO: 313001 - DNA, 16 bp, C. familiaris
cccgtgtggctcagca

SEQ ID NO: 313002 - DNA, 16 bp, C. familiaris
ccctaaaaacaacaga

SEQ ID NO: 313003 - DNA, 16 bp, C. familiaris
ccctaaaaaggaagta

SEQ ID NO: 313004 - DNA, 16 bp, C. familiaris
ccctaaaataaagaaa

SEQ ID NO: 313005 - DNA, 16 bp, C. familiaris
ccctacaatccagcaa

SEQ ID NO: 313006 - DNA, 16 bp, C. familiaris
ccctacaccaggcagg

SEQ ID NO: 313007 - DNA, 16 bp, C. familiaris
ccctacatgaagcctg

SEQ ID NO: 313008 - DNA, 16 bp, C. familiaris
ccctatcaaaatatca

SEQ ID NO: 313009 - DNA, 16 bp, C. familiaris
ccctcaaccctatggt

SEQ ID NO: 313010 - DNA, 16 bp, C. familiaris
ccctcaagaagcctgc

SEQ ID NO: 313011 - DNA, 16 bp, C. familiaris
ccctcaaggagctcat

SEQ ID NO: 313012 - DNA, 16 bp, C. familiaris
ccctcaccctgctcat

SEQ ID NO: 313013 - DNA, 16 bp, C. familiaris
ccctcacctccttcag

SEQ ID NO: 313014 - DNA, 16 bp, C. familiaris
ccctcagacccaggag

SEQ ID NO: 313015 - DNA, 16 bp, C. familiaris
ccctcagagcctccag

SEQ ID NO: 313016 - DNA, 16 bp, C. familiaris
ccctcagcctgtgtcc

SEQ ID NO: 313017 - DNA, 16 bp, C. familiaris
ccctcagggaccctgc

SEQ ID NO: 313018 - DNA, 16 bp, C. familiaris
ccctcagggtcctgga

SEQ ID NO: 313019 - DNA, 16 bp, C. familiaris
ccctcagtccctggca

SEQ ID NO: 313020 - DNA, 16 bp, C. familiaris
ccctcagtgaccatca

SEQ ID NO: 313021 - DNA, 16 bp, C. familiaris
ccctcagtgcccagca

SEQ ID NO: 313022 - DNA, 16 bp, C. familiaris
ccctcagtgcccatca

SEQ ID NO: 313023 - DNA, 16 bp, C. familiaris
ccctcatgacttcatc

SEQ ID NO: 313024 - DNA, 16 bp, C. familiaris
ccctcattgagctccc

SEQ ID NO: 313025 - DNA, 16 bp, C. familiaris
ccctccaagtgccccc

SEQ ID NO: 313026 - DNA, 16 bp, C. familiaris
ccctccacctgctgct

SEQ ID NO: 313027 - DNA, 16 bp, C. familiaris
ccctccactcatgctc

SEQ ID NO: 313028 - DNA, 16 bp, C. familiaris
ccctccagaggctcta

SEQ ID NO: 313029 - DNA, 16 bp, C. familiaris
ccctccagccccaggc

SEQ ID NO: 313030 - DNA, 16 bp, C. familiaris
ccctccagcccctggc

SEQ ID NO: 313031 - DNA, 16 bp, C. familiaris
ccctccagccctggag

SEQ ID NO: 313032 - DNA, 16 bp, C. familiaris
ccctcccagctcccag

SEQ ID NO: 313033 - DNA, 16 bp, C. familiaris
ccctcccagggcccag

SEQ ID NO: 313034 - DNA, 16 bp, C. familiaris
ccctccccagcctctg

SEQ ID NO: 313035 - DNA, 16 bp, C. familiaris
ccctcccccagcctgg

SEQ ID NO: 313036 - DNA, 16 bp, C. familiaris
ccctcccccagctctg

SEQ ID NO: 313037 - DNA, 16 bp, C. familiaris
ccctcccccagcttgt

SEQ ID NO: 313038 - DNA, 16 bp, C. familiaris
ccctcccccaggccag

SEQ ID NO: 313039 - DNA, 16 bp, C. familiaris
ccctcccccattcatg

SEQ ID NO: 313040 - DNA, 16 bp, C. familiaris
ccctcccctcctgggg

SEQ ID NO: 313041 - DNA, 16 bp, C. familiaris
ccctcccctctggcag

SEQ ID NO: 313042 - DNA, 16 bp, C. familiaris
ccctccctccccagag

SEQ ID NO: 313043 - DNA, 16 bp, C. familiaris
ccctccctgcagccct

SEQ ID NO: 313044 - DNA, 16 bp, C. familiaris
ccctccctggagcctg

SEQ ID NO: 313045 - DNA, 16 bp, C. familiaris
ccctccctgggcctca

SEQ ID NO: 313046 - DNA, 16 bp, C. familiaris
ccctccctgggggctg

SEQ ID NO: 313047 - DNA, 16 bp, C. familiaris
ccctcccttatattcc

SEQ ID NO: 313048 - DNA, 16 bp, C. familiaris
ccctcctccagctctc

SEQ ID NO: 313049 - DNA, 16 bp, C. familiaris
ccctcctctgcccaca

SEQ ID NO: 313050 - DNA, 16 bp, C. familiaris
ccctcctctgccccag

SEQ ID NO: 313051 - DNA, 16 bp, C. familiaris
ccctcctcttccgcca

SEQ ID NO: 313052 - DNA, 16 bp, C. familiaris
ccctcctgccctgggg

SEQ ID NO: 313053 - DNA, 16 bp, C. familiaris
ccctcctgctcatgct

SEQ ID NO: 313054 - DNA, 16 bp, C. familiaris
ccctcctgggaccctg

SEQ ID NO: 313055 - DNA, 16 bp, C. familiaris
ccctcctggggcctgg

SEQ ID NO: 313056 - DNA, 16 bp, C. familiaris
ccctctcactctgccc

SEQ ID NO: 313057 - DNA, 16 bp, C. familiaris
ccctctcaggtcccct

SEQ ID NO: 313058 - DNA, 16 bp, C. familiaris
ccctctccctttgcac

SEQ ID NO: 313059 - DNA, 16 bp, C. familiaris
ccctctcctctgctca

SEQ ID NO: 313060 - DNA, 16 bp, C. familiaris
ccctctccttctgtgc

SEQ ID NO: 313061 - DNA, 16 bp, C. familiaris
ccctctctcctccagc

SEQ ID NO: 313062 - DNA, 16 bp, C. familiaris
ccctctgaccctctcc

SEQ ID NO: 313063 - DNA, 16 bp, C. familiaris
ccctctgactatgtct

SEQ ID NO: 313064 - DNA, 16 bp, C. familiaris
ccctctgactgtgttt

SEQ ID NO: 313065 - DNA, 16 bp, C. familiaris
ccctctgcaccccctg

SEQ ID NO: 313066 - DNA, 16 bp, C. familiaris
ccctctgcacctccct

SEQ ID NO: 313067 - DNA, 16 bp, C. familiaris
ccctctgcagcttccc

SEQ ID NO: 313068 - DNA, 16 bp, C. familiaris
ccctctgcatgactgt

SEQ ID NO: 313069 - DNA, 16 bp, C. familiaris
ccctctgccactccct

SEQ ID NO: 313070 - DNA, 16 bp, C. familiaris
ccctctgccccatcct

SEQ ID NO: 313071 - DNA, 16 bp, C. familiaris
ccctctgcccctacca

SEQ ID NO: 313072 - DNA, 16 bp, C. familiaris
ccctctgcccctcatt

SEQ ID NO: 313073 - DNA, 16 bp, C. familiaris
ccctctgcccctctac

SEQ ID NO: 313074 - DNA, 16 bp, C. familiaris
ccctctgcccctctca

SEQ ID NO: 313075 - DNA, 16 bp, C. familiaris
ccctctgcccctgcca

SEQ ID NO: 313076 - DNA, 16 bp, C. familiaris
ccctctgccctctggc

SEQ ID NO: 313077 - DNA, 16 bp, C. familiaris
ccctctgccctgccca

SEQ ID NO: 313078 - DNA, 16 bp, C. familiaris
ccctctgccctgtgtc

SEQ ID NO: 313079 - DNA, 16 bp, C. familiaris
ccctctgcctcactct

SEQ ID NO: 313080 - DNA, 16 bp, C. familiaris
ccctctgcctctccag

SEQ ID NO: 313081 - DNA, 16 bp, C. familiaris
ccctctgcctctccca

SEQ ID NO: 313082 - DNA, 16 bp, C. familiaris
ccctctgcctgcgcct

SEQ ID NO: 313083 - DNA, 16 bp, C. familiaris
ccctctgcctgtatgt

SEQ ID NO: 313084 - DNA, 16 bp, C. familiaris
ccctctgcctgtgcct

SEQ ID NO: 313085 - DNA, 16 bp, C. familiaris
ccctctgccttctctg

SEQ ID NO: 313086 - DNA, 16 bp, C. familiaris
ccctctgctccagcca

SEQ ID NO: 313087 - DNA, 16 bp, C. familiaris
ccctctgctccccact

SEQ ID NO: 313088 - DNA, 16 bp, C. familiaris
ccctctgctcctgctt

SEQ ID NO: 313089 - DNA, 16 bp, C. familiaris
ccctctggctgctgtg

SEQ ID NO: 313090 - DNA, 16 bp, C. familiaris
ccctctgggaagcctg

SEQ ID NO: 313091 - DNA, 16 bp, C. familiaris
ccctctgggaagctgt

SEQ ID NO: 313092 - DNA, 16 bp, C. familiaris
ccctctggggagcccg

SEQ ID NO: 313093 - DNA, 16 bp, C. familiaris
ccctctggtcaccatc

SEQ ID NO: 313094 - DNA, 16 bp, C. familiaris
ccctctgtcactcccc

SEQ ID NO: 313095 - DNA, 16 bp, C. familiaris
ccctctgtcccccact

SEQ ID NO: 313096 - DNA, 16 bp, C. familiaris
ccctctgtccctcttg

SEQ ID NO: 313097 - DNA, 16 bp, C. familiaris
ccctctgtgccccagg

SEQ ID NO: 313098 - DNA, 16 bp, C. familiaris
ccctctgtgcctctct

SEQ ID NO: 313099 - DNA, 16 bp, C. familiaris
ccctctgtgtctcatg

SEQ ID NO: 313100 - DNA, 16 bp, C. familiaris
ccctcttcctctgcca

SEQ ID NO: 313101 - DNA, 16 bp, C. familiaris
ccctctttgccgtcaa

SEQ ID NO: 313102 - DNA, 16 bp, C. familiaris
ccctgaaatcatgaac

SEQ ID NO: 313103 - DNA, 16 bp, C. familiaris
ccctgaagcccaggaa

SEQ ID NO: 313104 - DNA, 16 bp, C. familiaris
ccctgaaggcagatgc

SEQ ID NO: 313105 - DNA, 16 bp, C. familiaris
ccctgagaccatgagc

SEQ ID NO: 313106 - DNA, 16 bp, C. familiaris
ccctgagaccatggcc

SEQ ID NO: 313107 - DNA, 16 bp, C. familiaris
ccctgagaggagccca

SEQ ID NO: 313108 - DNA, 16 bp, C. familiaris
ccctgagatcacaacc

SEQ ID NO: 313109 - DNA, 16 bp, C. familiaris
ccctgagatcgtggcc

SEQ ID NO: 313110 - DNA, 16 bp, C. familiaris
ccctgagatgaagacc

SEQ ID NO: 313111 - DNA, 16 bp, C. familiaris
ccctgagcagagagcc

SEQ ID NO: 313112 - DNA, 16 bp, C. familiaris
ccctgagccaaaacca

SEQ ID NO: 313113 - DNA, 16 bp, C. familiaris
ccctgagccacctggg

SEQ ID NO: 313114 - DNA, 16 bp, C. familiaris
ccctgagccgcccagg

SEQ ID NO: 313115 - DNA, 16 bp, C. familiaris
ccctgagcctcagtct

SEQ ID NO: 313116 - DNA, 16 bp, C. familiaris
ccctgagctgaaggaa

SEQ ID NO: 313117 - DNA, 16 bp, C. familiaris
ccctgagctgaaggga

SEQ ID NO: 313118 - DNA, 16 bp, C. familiaris
ccctgagctgagcaga

SEQ ID NO: 313119 - DNA, 16 bp, C. familiaris
ccctgagggcagggac

SEQ ID NO: 313120 - DNA, 16 bp, C. familiaris
ccctgagggcaggggc

SEQ ID NO: 313121 - DNA, 16 bp, C. familiaris
ccctgatgaacacaga

SEQ ID NO: 313122 - DNA, 16 bp, C. familiaris
ccctgcaccaggcagg

SEQ ID NO: 313123 - DNA, 16 bp, C. familiaris
ccctgcaccctgcacc

SEQ ID NO: 313124 - DNA, 16 bp, C. familiaris
ccctgcacgaagcctg

SEQ ID NO: 313125 - DNA, 16 bp, C. familiaris
ccctgcagaaagccca

SEQ ID NO: 313126 - DNA, 16 bp, C. familiaris
ccctgcagactgagag

SEQ ID NO: 313127 - DNA, 16 bp, C. familiaris
ccctgcagagcaagga

SEQ ID NO: 313128 - DNA, 16 bp, C. familiaris
ccctgcagcaggctcc

SEQ ID NO: 313129 - DNA, 16 bp, C. familiaris
ccctgcagcccagccc

SEQ ID NO: 313130 - DNA, 16 bp, C. familiaris
ccctgcagccctgcag

SEQ ID NO: 313131 - DNA, 16 bp, C. familiaris
ccctgcaggaagccct

SEQ ID NO: 313132 - DNA, 16 bp, C. familiaris
ccctgcaggaagcttg

SEQ ID NO: 313133 - DNA, 16 bp, C. familiaris
ccctgcagggagagcc

SEQ ID NO: 313134 - DNA, 16 bp, C. familiaris
ccctgcagggagcaca

SEQ ID NO: 313135 - DNA, 16 bp, C. familiaris
ccctgcagggagcagg

SEQ ID NO: 313136 - DNA, 16 bp, C. familiaris
ccctgcagggagcccc

SEQ ID NO: 313137 - DNA, 16 bp, C. familiaris
ccctgcagggctgggg

SEQ ID NO: 313138 - DNA, 16 bp, C. familiaris
ccctgcagggggagcc

SEQ ID NO: 313139 - DNA, 16 bp, C. familiaris
ccctgcagggggccca

SEQ ID NO: 313140 - DNA, 16 bp, C. familiaris
ccctgcagtgcagtgt

SEQ ID NO: 313141 - DNA, 16 bp, C. familiaris
ccctgccagccctgcc

SEQ ID NO: 313142 - DNA, 16 bp, C. familiaris
ccctgccagccctttc

SEQ ID NO: 313143 - DNA, 16 bp, C. familiaris
ccctgcccacctcctg

SEQ ID NO: 313144 - DNA, 16 bp, C. familiaris
ccctgcccaccttcct

SEQ ID NO: 313145 - DNA, 16 bp, C. familiaris
ccctgcccagagcctg

SEQ ID NO: 313146 - DNA, 16 bp, C. familiaris
ccctgcccagccctgg

SEQ ID NO: 313147 - DNA, 16 bp, C. familiaris
ccctgcccagtgtgga

SEQ ID NO: 313148 - DNA, 16 bp, C. familiaris
ccctgccccaccctgg

SEQ ID NO: 313149 - DNA, 16 bp, C. familiaris
ccctgccccagcccag

SEQ ID NO: 313150 - DNA, 16 bp, C. familiaris
ccctgccccagctgcc

SEQ ID NO: 313151 - DNA, 16 bp, C. familiaris
ccctgccccaggcctc

SEQ ID NO: 313152 - DNA, 16 bp, C. familiaris
ccctgccccaggcctg

SEQ ID NO: 313153 - DNA, 16 bp, C. familiaris
ccctgccccagggccc

SEQ ID NO: 313154 - DNA, 16 bp, C. familiaris
ccctgcccccaccagg

SEQ ID NO: 313155 - DNA, 16 bp, C. familiaris
ccctgcccccagaggc

SEQ ID NO: 313156 - DNA, 16 bp, C. familiaris
ccctgcccccggagca

SEQ ID NO: 313157 - DNA, 16 bp, C. familiaris
ccctgccccctgccag

SEQ ID NO: 313158 - DNA, 16 bp, C. familiaris
ccctgcccctcctggg

SEQ ID NO: 313159 - DNA, 16 bp, C. familiaris
ccctgcccctgccact

SEQ ID NO: 313160 - DNA, 16 bp, C. familiaris
ccctgcccctgctcat

SEQ ID NO: 313161 - DNA, 16 bp, C. familiaris
ccctgccccttgccag

SEQ ID NO: 313162 - DNA, 16 bp, C. familiaris
ccctgccctcagcctg

SEQ ID NO: 313163 - DNA, 16 bp, C. familiaris
ccctgccctcccagag

SEQ ID NO: 313164 - DNA, 16 bp, C. familiaris
ccctgccctccccagg

SEQ ID NO: 313165 - DNA, 16 bp, C. familiaris
ccctgccctgcccagc

SEQ ID NO: 313166 - DNA, 16 bp, C. familiaris
ccctgccctgctcctg

SEQ ID NO: 313167 - DNA, 16 bp, C. familiaris
ccctgccctggcccag

SEQ ID NO: 313168 - DNA, 16 bp, C. familiaris
ccctgccctggccctg

SEQ ID NO: 313169 - DNA, 16 bp, C. familiaris
ccctgccctgggctgg

SEQ ID NO: 313170 - DNA, 16 bp, C. familiaris
ccctgccctggtggag

SEQ ID NO: 313171 - DNA, 16 bp, C. familiaris
ccctgcccttaaagag

SEQ ID NO: 313172 - DNA, 16 bp, C. familiaris
ccctgcctccacctgt

SEQ ID NO: 313173 - DNA, 16 bp, C. familiaris
ccctgcctccagcctc

SEQ ID NO: 313174 - DNA, 16 bp, C. familiaris
ccctgcctcccagcct

SEQ ID NO: 313175 - DNA, 16 bp, C. familiaris
ccctgcctcccaggcc

SEQ ID NO: 313176 - DNA, 16 bp, C. familiaris
ccctgcctccctccag

SEQ ID NO: 313177 - DNA, 16 bp, C. familiaris
ccctgcctctgcttct

SEQ ID NO: 313178 - DNA, 16 bp, C. familiaris
ccctgcctctggctcc

SEQ ID NO: 313179 - DNA, 16 bp, C. familiaris
ccctgcctgctgctcc

SEQ ID NO: 313180 - DNA, 16 bp, C. familiaris
ccctgcctgctgctct

SEQ ID NO: 313181 - DNA, 16 bp, C. familiaris
ccctgcctggccctgc

SEQ ID NO: 313182 - DNA, 16 bp, C. familiaris
ccctgcctggccctgg

SEQ ID NO: 313183 - DNA, 16 bp, C. familiaris
ccctgcctggggctcc

SEQ ID NO: 313184 - DNA, 16 bp, C. familiaris
ccctgcctgtgtctct

SEQ ID NO: 313185 - DNA, 16 bp, C. familiaris
ccctgcgaggatcctg

SEQ ID NO: 313186 - DNA, 16 bp, C. familiaris
ccctgcggagagcctg

SEQ ID NO: 313187 - DNA, 16 bp, C. familiaris
ccctgcggggagctgg

SEQ ID NO: 313188 - DNA, 16 bp, C. familiaris
ccctgcggggagtccg

SEQ ID NO: 313189 - DNA, 16 bp, C. familiaris
ccctgctaagtgagga

SEQ ID NO: 313190 - DNA, 16 bp, C. familiaris
ccctgctcaacaagga

SEQ ID NO: 313191 - DNA, 16 bp, C. familiaris
ccctgctcacctccct

SEQ ID NO: 313192 - DNA, 16 bp, C. familiaris
ccctgctcagcatgga

SEQ ID NO: 313193 - DNA, 16 bp, C. familiaris
ccctgctcagccaggg

SEQ ID NO: 313194 - DNA, 16 bp, C. familiaris
ccctgctcagcgtgga

SEQ ID NO: 313195 - DNA, 16 bp, C. familiaris
ccctgctcagctagga

SEQ ID NO: 313196 - DNA, 16 bp, C. familiaris
ccctgctcagtgagca

SEQ ID NO: 313197 - DNA, 16 bp, C. familiaris
ccctgctcgtgtgctc

SEQ ID NO: 313198 - DNA, 16 bp, C. familiaris
ccctgctctgcaggga

SEQ ID NO: 313199 - DNA, 16 bp, C. familiaris
ccctgctctgtcccag

SEQ ID NO: 313200 - DNA, 16 bp, C. familiaris
ccctgctctgtcccca

SEQ ID NO: 313201 - DNA, 16 bp, C. familiaris
ccctgctctgtggggg

SEQ ID NO: 313202 - DNA, 16 bp, C. familiaris
ccctgctcttccgcca

SEQ ID NO: 313203 - DNA, 16 bp, C. familiaris
ccctgctgaacacaga

SEQ ID NO: 313204 - DNA, 16 bp, C. familiaris
ccctgctgagcaaaga

SEQ ID NO: 313205 - DNA, 16 bp, C. familiaris
ccctgctgagcaaggg

SEQ ID NO: 313206 - DNA, 16 bp, C. familiaris
ccctgctgagcaggaa

SEQ ID NO: 313207 - DNA, 16 bp, C. familiaris
ccctgctgagccggga

SEQ ID NO: 313208 - DNA, 16 bp, C. familiaris
ccctgctgagcgggga

SEQ ID NO: 313209 - DNA, 16 bp, C. familiaris
ccctgctgagtgtggg

SEQ ID NO: 313210 - DNA, 16 bp, C. familiaris
ccctgctgccttcggg

SEQ ID NO: 313211 - DNA, 16 bp, C. familiaris
ccctgctgctcatgct

SEQ ID NO: 313212 - DNA, 16 bp, C. familiaris
ccctgctgctctgcct

SEQ ID NO: 313213 - DNA, 16 bp, C. familiaris
ccctgctgctgccctg

SEQ ID NO: 313214 - DNA, 16 bp, C. familiaris
ccctgctgctgctgct

SEQ ID NO: 313215 - DNA, 16 bp, C. familiaris
ccctgctggcctccag

SEQ ID NO: 313216 - DNA, 16 bp, C. familiaris
ccctgctggcctcctg

SEQ ID NO: 313217 - DNA, 16 bp, C. familiaris
ccctggaccaaaggtg

SEQ ID NO: 313218 - DNA, 16 bp, C. familiaris
ccctggaccagatgga

SEQ ID NO: 313219 - DNA, 16 bp, C. familiaris
ccctggaccagcagca

SEQ ID NO: 313220 - DNA, 16 bp, C. familiaris
ccctggaccctggggt

SEQ ID NO: 313221 - DNA, 16 bp, C. familiaris
ccctggactcttgttt

SEQ ID NO: 313222 - DNA, 16 bp, C. familiaris
ccctggactgaagggg

SEQ ID NO: 313223 - DNA, 16 bp, C. familiaris
ccctggagaccccgga

SEQ ID NO: 313224 - DNA, 16 bp, C. familiaris
ccctggagaccctgga

SEQ ID NO: 313225 - DNA, 16 bp, C. familiaris
ccctggagccagactg

SEQ ID NO: 313226 - DNA, 16 bp, C. familiaris
ccctggagcccagggc

SEQ ID NO: 313227 - DNA, 16 bp, C. familiaris
ccctggagcctccaga

SEQ ID NO: 313228 - DNA, 16 bp, C. familiaris
ccctggagtcagcccc

SEQ ID NO: 313229 - DNA, 16 bp, C. familiaris
ccctggagtccctgga

SEQ ID NO: 313230 - DNA, 16 bp, C. familiaris
ccctggatcccagggc

SEQ ID NO: 313231 - DNA, 16 bp, C. familiaris
ccctggccacctccct

SEQ ID NO: 313232 - DNA, 16 bp, C. familiaris
ccctggccctggccca

SEQ ID NO: 313233 - DNA, 16 bp, C. familiaris
ccctggcctctcccca

SEQ ID NO: 313234 - DNA, 16 bp, C. familiaris
ccctggcctctgccca

SEQ ID NO: 313235 - DNA, 16 bp, C. familiaris
ccctggcctctgccct

SEQ ID NO: 313236 - DNA, 16 bp, C. familiaris
ccctgggaccacaccc

SEQ ID NO: 313237 - DNA, 16 bp, C. familiaris
ccctgggaccaggacc

SEQ ID NO: 313238 - DNA, 16 bp, C. familiaris
ccctgggagcccagga

SEQ ID NO: 313239 - DNA, 16 bp, C. familiaris
ccctgggaggaggtgg

SEQ ID NO: 313240 - DNA, 16 bp, C. familiaris
ccctgggatcatgact

SEQ ID NO: 313241 - DNA, 16 bp, C. familiaris
ccctgggatcatggct

SEQ ID NO: 313242 - DNA, 16 bp, C. familiaris
ccctgggcagggaggg

SEQ ID NO: 313243 - DNA, 16 bp, C. familiaris
ccctgggccaaagcag

SEQ ID NO: 313244 - DNA, 16 bp, C. familiaris
ccctgggccagcagca

SEQ ID NO: 313245 - DNA, 16 bp, C. familiaris
ccctgggccccaggcc

SEQ ID NO: 313246 - DNA, 16 bp, C. familiaris
ccctgggccctggggc

SEQ ID NO: 313247 - DNA, 16 bp, C. familiaris
ccctgggccgacggca

SEQ ID NO: 313248 - DNA, 16 bp, C. familiaris
ccctgggctacaggtg

SEQ ID NO: 313249 - DNA, 16 bp, C. familiaris
ccctgggctccatccc

SEQ ID NO: 313250 - DNA, 16 bp, C. familiaris
ccctgggctcccaggc

SEQ ID NO: 313251 - DNA, 16 bp, C. familiaris
ccctgggctccctgct

SEQ ID NO: 313252 - DNA, 16 bp, C. familiaris
ccctgggctccctggg

SEQ ID NO: 313253 - DNA, 16 bp, C. familiaris
ccctgggctcctggcc

SEQ ID NO: 313254 - DNA, 16 bp, C. familiaris
ccctgggctgaggcag

SEQ ID NO: 313255 - DNA, 16 bp, C. familiaris
ccctgggctgcaggcg

SEQ ID NO: 313256 - DNA, 16 bp, C. familiaris
ccctggggacctggga

SEQ ID NO: 313257 - DNA, 16 bp, C. familiaris
ccctggggcaaaggca

SEQ ID NO: 313258 - DNA, 16 bp, C. familiaris
ccctggggccccaggg

SEQ ID NO: 313259 - DNA, 16 bp, C. familiaris
ccctggggcccctggg

SEQ ID NO: 313260 - DNA, 16 bp, C. familiaris
ccctggggccctgggg

SEQ ID NO: 313261 - DNA, 16 bp, C. familiaris
ccctggggctcctggg

SEQ ID NO: 313262 - DNA, 16 bp, C. familiaris
ccctggggctgcaggc

SEQ ID NO: 313263 - DNA, 16 bp, C. familiaris
ccctgggggaggaggg

SEQ ID NO: 313264 - DNA, 16 bp, C. familiaris
ccctgggggcaggggg

SEQ ID NO: 313265 - DNA, 16 bp, C. familiaris
ccctgggggctcagtg

SEQ ID NO: 313266 - DNA, 16 bp, C. familiaris
ccctgggggtggggag

SEQ ID NO: 313267 - DNA, 16 bp, C. familiaris
ccctggggtcaccccc

SEQ ID NO: 313268 - DNA, 16 bp, C. familiaris
ccctggggtcacggcc

SEQ ID NO: 313269 - DNA, 16 bp, C. familiaris
ccctgggtgctcctgg

SEQ ID NO: 313270 - DNA, 16 bp, C. familiaris
ccctgggtggcacagc

SEQ ID NO: 313271 - DNA, 16 bp, C. familiaris
ccctgggtggctcggc

SEQ ID NO: 313272 - DNA, 16 bp, C. familiaris
ccctgggtggggcagc

SEQ ID NO: 313273 - DNA, 16 bp, C. familiaris
ccctgggtggtgcaga

SEQ ID NO: 313274 - DNA, 16 bp, C. familiaris
ccctgggtggtgcagg

SEQ ID NO: 313275 - DNA, 16 bp, C. familiaris
ccctggtcagcaggga

SEQ ID NO: 313276 - DNA, 16 bp, C. familiaris
ccctggtttttggcct

SEQ ID NO: 313277 - DNA, 16 bp, C. familiaris
ccctgtaccaggaggt

SEQ ID NO: 313278 - DNA, 16 bp, C. familiaris
ccctgtcaacaccttg

SEQ ID NO: 313279 - DNA, 16 bp, C. familiaris
ccctgtccctgccctg

SEQ ID NO: 313280 - DNA, 16 bp, C. familiaris
ccctgtgaggaccctg

SEQ ID NO: 313281 - DNA, 16 bp, C. familiaris
ccctgtgcctctgccc

SEQ ID NO: 313282 - DNA, 16 bp, C. familiaris
ccctgtgcggagcctg

SEQ ID NO: 313283 - DNA, 16 bp, C. familiaris
ccctgtggggagcctc

SEQ ID NO: 313284 - DNA, 16 bp, C. familiaris
ccctgtgtctcagttt

SEQ ID NO: 313285 - DNA, 16 bp, C. familiaris
ccctgtgtctggctct

SEQ ID NO: 313286 - DNA, 16 bp, C. familiaris
ccctgtgtggaacctg

SEQ ID NO: 313287 - DNA, 16 bp, C. familiaris
ccctgtgtggagactg

SEQ ID NO: 313288 - DNA, 16 bp, C. familiaris
ccctgtgtgtgtgtgt

SEQ ID NO: 313289 - DNA, 16 bp, C. familiaris
ccctgttcagtgggag

SEQ ID NO: 313290 - DNA, 16 bp, C. familiaris
cccttcaaggagcctg

SEQ ID NO: 313291 - DNA, 16 bp, C. familiaris
cccttcaaggtcctgg

SEQ ID NO: 313292 - DNA, 16 bp, C. familiaris
cccttcaagtgccccc

SEQ ID NO: 313293 - DNA, 16 bp, C. familiaris
cccttcagatcactat

SEQ ID NO: 313294 - DNA, 16 bp, C. familiaris
cccttcagggagcccg

SEQ ID NO: 313295 - DNA, 16 bp, C. familiaris
cccttcatgaagcctg

SEQ ID NO: 313296 - DNA, 16 bp, C. familiaris
cccttcatggaacctg

SEQ ID NO: 313297 - DNA, 16 bp, C. familiaris
cccttcatggagcctg

SEQ ID NO: 313298 - DNA, 16 bp, C. familiaris
cccttcccctgctcac

SEQ ID NO: 313299 - DNA, 16 bp, C. familiaris
cccttcctggagcctg

SEQ ID NO: 313300 - DNA, 16 bp, C. familiaris
cccttctcagtgccca

SEQ ID NO: 313301 - DNA, 16 bp, C. familiaris
cccttctttaaaaaaa

SEQ ID NO: 313302 - DNA, 16 bp, C. familiaris
cccttgaaagccccac

SEQ ID NO: 313303 - DNA, 16 bp, C. familiaris
cccttgcctccagaga

SEQ ID NO: 313304 - DNA, 16 bp, C. familiaris
cccttgctcctgctct

SEQ ID NO: 313305 - DNA, 16 bp, C. familiaris
cccttgctgtgcagaa

SEQ ID NO: 313306 - DNA, 16 bp, C. familiaris
cccttggcctgtgtct

SEQ ID NO: 313307 - DNA, 16 bp, C. familiaris
cccttgggcagcctgg

SEQ ID NO: 313308 - DNA, 16 bp, C. familiaris
ccctttcactatttct

SEQ ID NO: 313309 - DNA, 16 bp, C. familiaris
ccctttctatctttcg

SEQ ID NO: 313310 - DNA, 16 bp, C. familiaris
ccctttctctgcaccc

SEQ ID NO: 313311 - DNA, 16 bp, C. familiaris
ccctttgaatcattat

SEQ ID NO: 313312 - DNA, 16 bp, C. familiaris
cccttttcctatgtct

SEQ ID NO: 313313 - DNA, 16 bp, C. familiaris
ccctttttgcagatga

SEQ ID NO: 313314 - DNA, 16 bp, C. familiaris
ccctttttggcctgcc

SEQ ID NO: 313315 - DNA, 16 bp, C. familiaris
ccgacttctccctctg

SEQ ID NO: 313316 - DNA, 16 bp, C. familiaris
ccgagccaaagacaga

SEQ ID NO: 313317 - DNA, 16 bp, C. familiaris
ccgagctgcaggcggc

SEQ ID NO: 313318 - DNA, 16 bp, C. familiaris
ccgaggccccgccagg

SEQ ID NO: 313319 - DNA, 16 bp, C. familiaris
ccgaggcccgaggccc

SEQ ID NO: 313320 - DNA, 16 bp, C. familiaris
ccgagggcaccaaaag

SEQ ID NO: 313321 - DNA, 17 bp, C. familiaris
ccgagtaagcatcgtta

SEQ ID NO: 313322 - DNA, 16 bp, C. familiaris
ccgcagagggggctgc

SEQ ID NO: 313323 - DNA, 16 bp, C. familiaris
ccgcagcagcagcagc

SEQ ID NO: 313324 - DNA, 16 bp, C. familiaris
ccgcagtctcccagtc

SEQ ID NO: 313325 - DNA, 16 bp, C. familiaris
ccgcatcagcctccct

SEQ ID NO: 313326 - DNA, 16 bp, C. familiaris
ccgcatcttctccaac

SEQ ID NO: 313327 - DNA, 16 bp, C. familiaris
ccgcatgaagcctgct

SEQ ID NO: 313328 - DNA, 16 bp, C. familiaris
ccgcccaggtgccccc

SEQ ID NO: 313329 - DNA, 16 bp, C. familiaris
ccgcccaggtggctca

SEQ ID NO: 313330 - DNA, 16 bp, C. familiaris
ccgcccccagagcatc

SEQ ID NO: 313331 - DNA, 16 bp, C. familiaris
ccgccgagccaccggg

SEQ ID NO: 313332 - DNA, 16 bp, C. familiaris
ccgccgccgccgccat

SEQ ID NO: 313333 - DNA, 16 bp, C. familiaris
ccgcctacagcctggg

SEQ ID NO: 313334 - DNA, 16 bp, C. familiaris
ccgcctccagcccagg

SEQ ID NO: 313335 - DNA, 16 bp, C. familiaris
ccgcctccccccggga

SEQ ID NO: 313336 - DNA, 16 bp, C. familiaris
ccgcctgagcccctcc

SEQ ID NO: 313337 - DNA, 16 bp, C. familiaris
ccgcctgcagcccaag

SEQ ID NO: 313338 - DNA, 16 bp, C. familiaris
ccgcctgcagcccagg

SEQ ID NO: 313339 - DNA, 16 bp, C. familiaris
ccgcctgcagccccag

SEQ ID NO: 313340 - DNA, 16 bp, C. familiaris
ccgcctgcagcccgag

SEQ ID NO: 313341 - DNA, 17 bp, C. familiaris
ccgcctgcagcctgagg

SEQ ID NO: 313342 - DNA, 16 bp, C. familiaris
ccgccttccacccagg

SEQ ID NO: 313343 - DNA, 16 bp, C. familiaris
ccgcggagccacctgg

SEQ ID NO: 313344 - DNA, 16 bp, C. familiaris
ccgcggagggggctgt

SEQ ID NO: 313345 - DNA, 16 bp, C. familiaris
ccgcgtcgggctccag

SEQ ID NO: 313346 - DNA, 16 bp, C. familiaris
ccgctcagtgcccatc

SEQ ID NO: 313347 - DNA, 16 bp, C. familiaris
ccgctgagccaggagc

SEQ ID NO: 313348 - DNA, 16 bp, C. familiaris
ccgctgagccccccgg

SEQ ID NO: 313349 - DNA, 16 bp, C. familiaris
ccgctgagctacccgg

SEQ ID NO: 313350 - DNA, 16 bp, C. familiaris
ccgctgcatcacccag

SEQ ID NO: 313351 - DNA, 16 bp, C. familiaris
ccgctggaccaccggg

SEQ ID NO: 313352 - DNA, 16 bp, C. familiaris
ccgctgtgccacccaa

SEQ ID NO: 313353 - DNA, 16 bp, C. familiaris
ccgctgtgccacctgg

SEQ ID NO: 313354 - DNA, 16 bp, C. familiaris
ccgctgtgccacgggg

SEQ ID NO: 313355 - DNA, 16 bp, C. familiaris
ccgctttgggctccct

SEQ ID NO: 313356 - DNA, 16 bp, C. familiaris
ccggaaggcagatgct

SEQ ID NO: 313357 - DNA, 16 bp, C. familiaris
ccggactccgggatca

SEQ ID NO: 313358 - DNA, 16 bp, C. familiaris
ccggagcccgacatgg

SEQ ID NO: 313359 - DNA, 16 bp, C. familiaris
ccggagcccgacgcgg

SEQ ID NO: 313360 - DNA, 23 bp, C. familiaris
ccggagcctgcgctgttggattc

SEQ ID NO: 313361 - DNA, 16 bp, C. familiaris
ccggagcctgcttctc

SEQ ID NO: 313362 - DNA, 16 bp, C. familiaris
ccggatcttgggatca

SEQ ID NO: 313363 - DNA, 16 bp, C. familiaris
ccggctcagcggggag

SEQ ID NO: 313364 - DNA, 16 bp, C. familiaris
ccggctccctgcatga

SEQ ID NO: 313365 - DNA, 16 bp, C. familiaris
ccggctcctcctgggg

SEQ ID NO: 313366 - DNA, 16 bp, C. familiaris
ccggctgcaggcggcg

SEQ ID NO: 313367 - DNA, 16 bp, C. familiaris
ccgggaattgagtccc

SEQ ID NO: 313368 - DNA, 16 bp, C. familiaris
ccgggacaggcagaga

SEQ ID NO: 313369 - DNA, 16 bp, C. familiaris
ccgggaccccgacgtg

SEQ ID NO: 313370 - DNA, 16 bp, C. familiaris
ccgggaccctggaatc

SEQ ID NO: 313371 - DNA, 16 bp, C. familiaris
ccgggaccgagtcccg

SEQ ID NO: 313372 - DNA, 16 bp, C. familiaris
ccgggagaagcaggag

SEQ ID NO: 313373 - DNA, 16 bp, C. familiaris
ccgggagcccgacctg

SEQ ID NO: 313374 - DNA, 16 bp, C. familiaris
ccgggaggctcagcag

SEQ ID NO: 313375 - DNA, 16 bp, C. familiaris
ccgggatccaggatcg

SEQ ID NO: 313376 - DNA, 16 bp, C. familiaris
ccgggccaaaggtggc

SEQ ID NO: 313377 - DNA, 16 bp, C. familiaris
ccgggccccaggatca

SEQ ID NO: 313378 - DNA, 16 bp, C. familiaris
ccgggcggctcagcag

SEQ ID NO: 313379 - DNA, 16 bp, C. familiaris
ccgggctgaaggcagc

SEQ ID NO: 313380 - DNA, 16 bp, C. familiaris
ccgggctgcccaggtc

SEQ ID NO: 313381 - DNA, 16 bp, C. familiaris
ccgggctgccccacag

SEQ ID NO: 313382 - DNA, 16 bp, C. familiaris
ccgggctgcccccaaa

SEQ ID NO: 313383 - DNA, 16 bp, C. familiaris
ccgggctgcccctcat

SEQ ID NO: 313384 - DNA, 16 bp, C. familiaris
ccgggctgccctctgc

SEQ ID NO: 313385 - DNA, 16 bp, C. familiaris
ccgggctgccctgata

SEQ ID NO: 313386 - DNA, 16 bp, C. familiaris
ccgggctgcccttttt

SEQ ID NO: 313387 - DNA, 16 bp, C. familiaris
ccggggatccctgggt

SEQ ID NO: 313388 - DNA, 16 bp, C. familiaris
ccggggcacctgggtg

SEQ ID NO: 313389 - DNA, 16 bp, C. familiaris
ccggggcctgcgctgc

SEQ ID NO: 313390 - DNA, 16 bp, C. familiaris
ccggggctgcccccac

SEQ ID NO: 313391 - DNA, 16 bp, C. familiaris
ccggggctgccccctg

SEQ ID NO: 313392 - DNA, 16 bp, C. familiaris
ccggggctgcccctgt

SEQ ID NO: 313393 - DNA, 16 bp, C. familiaris
ccggggctgccctgga

SEQ ID NO: 313394 - DNA, 16 bp, C. familiaris
ccggggctgccctggc

SEQ ID NO: 313395 - DNA, 16 bp, C. familiaris
ccggggctgccctttg

SEQ ID NO: 313396 - DNA, 16 bp, C. familiaris
ccggggtccaggattg

SEQ ID NO: 313397 - DNA, 16 bp, C. familiaris
ccggggtctctgcctc

SEQ ID NO: 313398 - DNA, 16 bp, C. familiaris
ccgggtctccagggat

SEQ ID NO: 313399 - DNA, 16 bp, C. familiaris
ccggtccccaggatca

SEQ ID NO: 313400 - DNA, 16 bp, C. familiaris
ccggtgctcatcatga

SEQ ID NO: 313401 - DNA, 16 bp, C. familiaris
ccgtcagcccagggcc

SEQ ID NO: 313402 - DNA, 17 bp, C. familiaris
ccgtcccggagaagcag

SEQ ID NO: 313403 - DNA, 16 bp, C. familiaris
ccgtctctgtctctct

SEQ ID NO: 313404 - DNA, 16 bp, C. familiaris
ccgtgctgagtgtgga

SEQ ID NO: 313405 - DNA, 16 bp, C. familiaris
ccgtgtcaggctctgt

SEQ ID NO: 313406 - DNA, 16 bp, C. familiaris
ccgtgtgtgtctctca

SEQ ID NO: 313407 - DNA, 16 bp, C. familiaris
ccgtgttcagcaggga

SEQ ID NO: 313408 - DNA, 16 bp, C. familiaris
ccgtgtttctgcctct

SEQ ID NO: 313409 - DNA, 16 bp, C. familiaris
cctaaaagaaatgaaa

SEQ ID NO: 313410 - DNA, 16 bp, C. familiaris
cctaaaagagagcaca

SEQ ID NO: 313411 - DNA, 16 bp, C. familiaris
cctaaagccagaagaa

SEQ ID NO: 313412 - DNA, 16 bp, C. familiaris
cctaaagtcacacagc

SEQ ID NO: 313413 - DNA, 16 bp, C. familiaris
cctaaatttaagagct

SEQ ID NO: 313414 - DNA, 16 bp, C. familiaris
cctaactgggaaacaa

SEQ ID NO: 313415 - DNA, 16 bp, C. familiaris
cctaaggaagaaaaac

SEQ ID NO: 313416 - DNA, 16 bp, C. familiaris
cctaaggacacttcca

SEQ ID NO: 313417 - DNA, 16 bp, C. familiaris
cctaaggggaaaaaaa

SEQ ID NO: 313418 - DNA, 16 bp, C. familiaris
cctacagcccagggcc

SEQ ID NO: 313419 - DNA, 16 bp, C. familiaris
cctacagcccagggtg

SEQ ID NO: 313420 - DNA, 16 bp, C. familiaris
cctacaggatgggaga

SEQ ID NO: 313421 - DNA, 16 bp, C. familiaris
cctacagggagccttc

SEQ ID NO: 313422 - DNA, 16 bp, C. familiaris
cctacatctctgcctc

SEQ ID NO: 313423 - DNA, 16 bp, C. familiaris
cctacctcaggaagca

SEQ ID NO: 313424 - DNA, 16 bp, C. familiaris
cctactctgtgccagg

SEQ ID NO: 313425 - DNA, 16 bp, C. familiaris
cctactttgttgagtg

SEQ ID NO: 313426 - DNA, 16 bp, C. familiaris
cctagaagaaatgaat

SEQ ID NO: 313427 - DNA, 16 bp, C. familiaris
cctagaagaccagctg

SEQ ID NO: 313428 - DNA, 16 bp, C. familiaris
cctagaccagcagcat

SEQ ID NO: 313429 - DNA, 16 bp, C. familiaris
cctagagaaaaacaca

SEQ ID NO: 313430 - DNA, 16 bp, C. familiaris
cctagagcagtgcctg

SEQ ID NO: 313431 - DNA, 16 bp, C. familiaris
cctagaggagaacata

SEQ ID NO: 313432 - DNA, 16 bp, C. familiaris
cctagggacacctggg

SEQ ID NO: 313433 - DNA, 16 bp, C. familiaris
cctatctcctggatct

SEQ ID NO: 313434 - DNA, 16 bp, C. familiaris
cctatgcctctgtctc

SEQ ID NO: 313435 - DNA, 16 bp, C. familiaris
cctattggatattctt

SEQ ID NO: 313436 - DNA, 16 bp, C. familiaris
cctatttatttgagag

SEQ ID NO: 313437 - DNA, 16 bp, C. familiaris
cctcaaaaaaactgga

SEQ ID NO: 313438 - DNA, 16 bp, C. familiaris
cctcaaaaaattaaac

SEQ ID NO: 313439 - DNA, 16 bp, C. familiaris
cctcaaaaacatgatg

SEQ ID NO: 313440 - DNA, 16 bp, C. familiaris
cctcaaattcctcatc

SEQ ID NO: 313441 - DNA, 16 bp, C. familiaris
cctcaacaaaatcaac

SEQ ID NO: 313442 - DNA, 16 bp, C. familiaris
cctcaactctgtggtc

SEQ ID NO: 313443 - DNA, 16 bp, C. familiaris
cctcaagagaaagcag

SEQ ID NO: 313444 - DNA, 16 bp, C. familiaris
cctcaaggagctcaca

SEQ ID NO: 313445 - DNA, 16 bp, C. familiaris
cctcaagtcttttttt

SEQ ID NO: 313446 - DNA, 16 bp, C. familiaris
cctcaataaatttaag

SEQ ID NO: 313447 - DNA, 16 bp, C. familiaris
cctcacactgggctcc

SEQ ID NO: 313448 - DNA, 16 bp, C. familiaris
cctcacaggcctgggg

SEQ ID NO: 313449 - DNA, 16 bp, C. familiaris
cctcaccaacatctat

SEQ ID NO: 313450 - DNA, 16 bp, C. familiaris
cctcaccctctgcctc

SEQ ID NO: 313451 - DNA, 16 bp, C. familiaris
cctcacctctctgggc

SEQ ID NO: 313452 - DNA, 16 bp, C. familiaris
cctcacctggggctcc

SEQ ID NO: 313453 - DNA, 16 bp, C. familiaris
cctcactgagctcaga

SEQ ID NO: 313454 - DNA, 16 bp, C. familiaris
cctcactggctcagtc

SEQ ID NO: 313455 - DNA, 16 bp, C. familiaris
cctcactgtcctgggc

SEQ ID NO: 313456 - DNA, 16 bp, C. familiaris
cctcactttaaatctg

SEQ ID NO: 313457 - DNA, 16 bp, C. familiaris
cctcactttgggctcc

SEQ ID NO: 313458 - DNA, 16 bp, C. familiaris
cctcagaagaaatcaa

SEQ ID NO: 313459 - DNA, 16 bp, C. familiaris
cctcagaaggaagaat

SEQ ID NO: 313460 - DNA, 16 bp, C. familiaris
cctcagagtcctggga

SEQ ID NO: 313461 - DNA, 16 bp, C. familiaris
cctcagccaaaggcag

SEQ ID NO: 313462 - DNA, 16 bp, C. familiaris
cctcagccctgctcct

SEQ ID NO: 313463 - DNA, 16 bp, C. familiaris
cctcagcctgctgctc

SEQ ID NO: 313464 - DNA, 16 bp, C. familiaris
cctcagcctgtctctg

SEQ ID NO: 313465 - DNA, 16 bp, C. familiaris
cctcagctcctccctc

SEQ ID NO: 313466 - DNA, 16 bp, C. familiaris
cctcagcttcctcctc

SEQ ID NO: 313467 - DNA, 16 bp, C. familiaris
cctcaggacacatatc

SEQ ID NO: 313468 - DNA, 16 bp, C. familiaris
cctcaggctcccgggg

SEQ ID NO: 313469 - DNA, 16 bp, C. familiaris
cctcaggctgcaggtg

SEQ ID NO: 313470 - DNA, 16 bp, C. familiaris
cctcaggcttcctgct

SEQ ID NO: 313471 - DNA, 16 bp, C. familiaris
cctcagggatcctgct

SEQ ID NO: 313472 - DNA, 16 bp, C. familiaris
cctcagggatgcctgg

SEQ ID NO: 313473 - DNA, 16 bp, C. familiaris
cctcagggctcctggg

SEQ ID NO: 313474 - DNA, 16 bp, C. familiaris
cctcagggtccaagtc

SEQ ID NO: 313475 - DNA, 16 bp, C. familiaris
cctcagggtcctggga

SEQ ID NO: 313476 - DNA, 16 bp, C. familiaris
cctcaggtaaccatca

SEQ ID NO: 313477 - DNA, 16 bp, C. familiaris
cctcagtgccagtcac

SEQ ID NO: 313478 - DNA, 16 bp, C. familiaris
cctcagtgcccaccac

SEQ ID NO: 313479 - DNA, 16 bp, C. familiaris
cctcagtggctgcacc

SEQ ID NO: 313480 - DNA, 16 bp, C. familiaris
cctcagtgtcctcctc

SEQ ID NO: 313481 - DNA, 16 bp, C. familiaris
cctcagtttccctgct

SEQ ID NO: 313482 - DNA, 16 bp, C. familiaris
cctcagtttcctcctg

SEQ ID NO: 313483 - DNA, 16 bp, C. familiaris
cctcagtttctccacc

SEQ ID NO: 313484 - DNA, 16 bp, C. familiaris
cctcagtttctcctct

SEQ ID NO: 313485 - DNA, 16 bp, C. familiaris
cctcagtttcttcttc

SEQ ID NO: 313486 - DNA, 16 bp, C. familiaris
cctcagttttttcatc

SEQ ID NO: 313487 - DNA, 16 bp, C. familiaris
cctcatcaaagaagat

SEQ ID NO: 313488 - DNA, 16 bp, C. familiaris
cctcatcctggagacc

SEQ ID NO: 313489 - DNA, 16 bp, C. familiaris
cctcatctgtaaaata

SEQ ID NO: 313490 - DNA, 16 bp, C. familiaris
cctcatgtttatagca

SEQ ID NO: 313491 - DNA, 16 bp, C. familiaris
cctcattcattcaaca

SEQ ID NO: 313492 - DNA, 16 bp, C. familiaris
cctccaaagaaagcag

SEQ ID NO: 313493 - DNA, 16 bp, C. familiaris
cctccaagaagccctc

SEQ ID NO: 313494 - DNA, 16 bp, C. familiaris
cctccaccccttctga

SEQ ID NO: 313495 - DNA, 16 bp, C. familiaris
cctccaccctgctcat

SEQ ID NO: 313496 - DNA, 16 bp, C. familiaris
cctccacctctctctg

SEQ ID NO: 313497 - DNA, 16 bp, C. familiaris
cctccacctctgcctc

SEQ ID NO: 313498 - DNA, 16 bp, C. familiaris
cctccacctgctgctc

SEQ ID NO: 313499 - DNA, 16 bp, C. familiaris
cctccactcacactct

SEQ ID NO: 313500 - DNA, 16 bp, C. familiaris
cctccacttccatcca

SEQ ID NO: 313501 - DNA, 16 bp, C. familiaris
cctccagaacaatgag

SEQ ID NO: 313502 - DNA, 16 bp, C. familiaris
cctccagaggctctgg

SEQ ID NO: 313503 - DNA, 16 bp, C. familiaris
cctccagcctccagag

SEQ ID NO: 313504 - DNA, 16 bp, C. familiaris
cctccagctcctcctc

SEQ ID NO: 313505 - DNA, 16 bp, C. familiaris
cctccagctttctttt

SEQ ID NO: 313506 - DNA, 16 bp, C. familiaris
cctccaggaagccctc

SEQ ID NO: 313507 - DNA, 16 bp, C. familiaris
cctccaggaagccctt

SEQ ID NO: 313508 - DNA, 16 bp, C. familiaris
cctccaggcagccctc

SEQ ID NO: 313509 - DNA, 16 bp, C. familiaris
cctccaggcctttgca

SEQ ID NO: 313510 - DNA, 16 bp, C. familiaris
cctccagggatgcctg

SEQ ID NO: 313511 - DNA, 16 bp, C. familiaris
cctccaggtccaccca

SEQ ID NO: 313512 - DNA, 16 bp, C. familiaris
cctccatcaaccctct

SEQ ID NO: 313513 - DNA, 16 bp, C. familiaris
cctccatccctctgtc

SEQ ID NO: 313514 - DNA, 16 bp, C. familiaris
cctccatcttgcccct

SEQ ID NO: 313515 - DNA, 16 bp, C. familiaris
cctccatgttttatgt

SEQ ID NO: 313516 - DNA, 16 bp, C. familiaris
cctcccaaactgaaac

SEQ ID NO: 313517 - DNA, 16 bp, C. familiaris
cctcccaaagatgtcc

SEQ ID NO: 313518 - DNA, 16 bp, C. familiaris
cctcccaatagatgca

SEQ ID NO: 313519 - DNA, 16 bp, C. familiaris
cctcccaccccagggc

SEQ ID NO: 313520 - DNA, 16 bp, C. familiaris
cctcccacccccagga

SEQ ID NO: 313521 - DNA, 16 bp, C. familiaris
cctcccattggccaaa

SEQ ID NO: 313522 - DNA, 16 bp, C. familiaris
cctccccactgagcag

SEQ ID NO: 313523 - DNA, 16 bp, C. familiaris
cctccccagagcccag

SEQ ID NO: 313524 - DNA, 16 bp, C. familiaris
cctccccagccctggg

SEQ ID NO: 313525 - DNA, 16 bp, C. familiaris
cctccccaggcctctc

SEQ ID NO: 313526 - DNA, 16 bp, C. familiaris
cctccccagggcccag

SEQ ID NO: 313527 - DNA, 16 bp, C. familiaris
cctcccccagctcctg

SEQ ID NO: 313528 - DNA, 16 bp, C. familiaris
cctcccccagggcctg

SEQ ID NO: 313529 - DNA, 16 bp, C. familiaris
cctccccctgctcagg

SEQ ID NO: 313530 - DNA, 16 bp, C. familiaris
cctccccgcttgtgct

SEQ ID NO: 313531 - DNA, 16 bp, C. familiaris
cctccccgggacaggc

SEQ ID NO: 313532 - DNA, 16 bp, C. familiaris
cctcccctctgcagca

SEQ ID NO: 313533 - DNA, 16 bp, C. familiaris
cctcccctctgctcca

SEQ ID NO: 313534 - DNA, 16 bp, C. familiaris
cctccctcagccccag

SEQ ID NO: 313535 - DNA, 16 bp, C. familiaris
cctccctcagggcctc

SEQ ID NO: 313536 - DNA, 16 bp, C. familiaris
cctccctcagtgcctg

SEQ ID NO: 313537 - DNA, 16 bp, C. familiaris
cctccctccccagctg

SEQ ID NO: 313538 - DNA, 16 bp, C. familiaris
cctccctccccagggc

SEQ ID NO: 313539 - DNA, 16 bp, C. familiaris
cctccctccctccatg

SEQ ID NO: 313540 - DNA, 16 bp, C. familiaris
cctccctcctggggtc

SEQ ID NO: 313541 - DNA, 16 bp, C. familiaris
cctccctcctgggtcc

SEQ ID NO: 313542 - DNA, 16 bp, C. familiaris
cctccctctctgcatc

SEQ ID NO: 313543 - DNA, 16 bp, C. familiaris
cctccctctgggcctc

SEQ ID NO: 313544 - DNA, 16 bp, C. familiaris
cctccctgcctccagg

SEQ ID NO: 313545 - DNA, 16 bp, C. familiaris
cctccctgcctcccag

SEQ ID NO: 313546 - DNA, 16 bp, C. familiaris
cctccctgctcagtgg

SEQ ID NO: 313547 - DNA, 16 bp, C. familiaris
cctccctgcttctctg

SEQ ID NO: 313548 - DNA, 16 bp, C. familiaris
cctccctggctccctg

SEQ ID NO: 313549 - DNA, 16 bp, C. familiaris
cctccctgggccccag

SEQ ID NO: 313550 - DNA, 16 bp, C. familiaris
cctccctgtgcctcag

SEQ ID NO: 313551 - DNA, 16 bp, C. familiaris
cctcccttctgcccag

SEQ ID NO: 313552 - DNA, 16 bp, C. familiaris
cctcctcacagggagc

SEQ ID NO: 313553 - DNA, 16 bp, C. familiaris
cctcctcagcctcctc

SEQ ID NO: 313554 - DNA, 16 bp, C. familiaris
cctcctccacctcctg

SEQ ID NO: 313555 - DNA, 16 bp, C. familiaris
cctcctccagcccctg

SEQ ID NO: 313556 - DNA, 16 bp, C. familiaris
cctcctccaggcagcc

SEQ ID NO: 313557 - DNA, 16 bp, C. familiaris
cctcctccagggagcc

SEQ ID NO: 313558 - DNA, 16 bp, C. familiaris
cctcctccatcttcaa

SEQ ID NO: 313559 - DNA, 16 bp, C. familiaris
cctcctccatgaagct

SEQ ID NO: 313560 - DNA, 16 bp, C. familiaris
cctcctcccacctgct

SEQ ID NO: 313561 - DNA, 16 bp, C. familiaris
cctcctcccacttgtg

SEQ ID NO: 313562 - DNA, 16 bp, C. familiaris
cctcctcccagctcct

SEQ ID NO: 313563 - DNA, 16 bp, C. familiaris
cctcctccccaggcct

SEQ ID NO: 313564 - DNA, 16 bp, C. familiaris
cctcctccctctgacc

SEQ ID NO: 313565 - DNA, 16 bp, C. familiaris
cctcctccctgcagcc

SEQ ID NO: 313566 - DNA, 16 bp, C. familiaris
cctcctccctgggctc

SEQ ID NO: 313567 - DNA, 16 bp, C. familiaris
cctcctcctccacctg

SEQ ID NO: 313568 - DNA, 16 bp, C. familiaris
cctcctcctcctggaa

SEQ ID NO: 313569 - DNA, 16 bp, C. familiaris
cctcctcctcctggga

SEQ ID NO: 313570 - DNA, 16 bp, C. familiaris
cctcctcctccttcag

SEQ ID NO: 313571 - DNA, 16 bp, C. familiaris
cctcctcctgctcaca

SEQ ID NO: 313572 - DNA, 16 bp, C. familiaris
cctcctcctgcttctg

SEQ ID NO: 313573 - DNA, 16 bp, C. familiaris
cctcctcttcctcagc

SEQ ID NO: 313574 - DNA, 16 bp, C. familiaris
cctcctgagcagggag

SEQ ID NO: 313575 - DNA, 16 bp, C. familiaris
cctcctgagccagcca

SEQ ID NO: 313576 - DNA, 16 bp, C. familiaris
cctcctgcagcccagg

SEQ ID NO: 313577 - DNA, 16 bp, C. familiaris
cctcctgcaggaagcc

SEQ ID NO: 313578 - DNA, 16 bp, C. familiaris
cctcctgccaacagcc

SEQ ID NO: 313579 - DNA, 16 bp, C. familiaris
cctcctgccacctgcc

SEQ ID NO: 313580 - DNA, 16 bp, C. familiaris
cctcctgccctgggct

SEQ ID NO: 313581 - DNA, 16 bp, C. familiaris
cctcctgcctggcctc

SEQ ID NO: 313582 - DNA, 16 bp, C. familiaris
cctcctgcctggtgca

SEQ ID NO: 313583 - DNA, 16 bp, C. familiaris
cctcctgctctgctct

SEQ ID NO: 313584 - DNA, 16 bp, C. familiaris
cctcctgctgccctgg

SEQ ID NO: 313585 - DNA, 16 bp, C. familiaris
cctcctgctgctgctc

SEQ ID NO: 313586 - DNA, 16 bp, C. familiaris
cctcctggaagccttc

SEQ ID NO: 313587 - DNA, 16 bp, C. familiaris
cctcctggcctccctg

SEQ ID NO: 313588 - DNA, 16 bp, C. familiaris
cctcctgggcctcctg

SEQ ID NO: 313589 - DNA, 16 bp, C. familiaris
cctcctggggagcctg

SEQ ID NO: 313590 - DNA, 16 bp, C. familiaris
cctcctggtccccacc

SEQ ID NO: 313591 - DNA, 16 bp, C. familiaris
cctccttttccactac

SEQ ID NO: 313592 - DNA, 16 bp, C. familiaris
cctcgctcgctcgctc

SEQ ID NO: 313593 - DNA, 16 bp, C. familiaris
cctcgcttgccttggc

SEQ ID NO: 313594 - DNA, 16 bp, C. familiaris
cctcggactccaggat

SEQ ID NO: 313595 - DNA, 16 bp, C. familiaris
cctcggcctgtgtctc

SEQ ID NO: 313596 - DNA, 16 bp, C. familiaris
cctcggctgaaggcgg

SEQ ID NO: 313597 - DNA, 16 bp, C. familiaris
cctcgggcagccctgg

SEQ ID NO: 313598 - DNA, 16 bp, C. familiaris
cctctaaaataataaa

SEQ ID NO: 313599 - DNA, 16 bp, C. familiaris
cctctacctctgcctc

SEQ ID NO: 313600 - DNA, 16 bp, C. familiaris
cctctacctctgcctg

SEQ ID NO: 313601 - DNA, 16 bp, C. familiaris
cctctacctgctgctc

SEQ ID NO: 313602 - DNA, 16 bp, C. familiaris
cctctacctgtgtttc

SEQ ID NO: 313603 - DNA, 16 bp, C. familiaris
cctctatgttttcttc

SEQ ID NO: 313604 - DNA, 16 bp, C. familiaris
cctctcagcattttct

SEQ ID NO: 313605 - DNA, 16 bp, C. familiaris
cctctcagggagccca

SEQ ID NO: 313606 - DNA, 16 bp, C. familiaris
cctctccacagggacc

SEQ ID NO: 313607 - DNA, 16 bp, C. familiaris
cctctcccactgcttg

SEQ ID NO: 313608 - DNA, 16 bp, C. familiaris
cctctccctctgacac

SEQ ID NO: 313609 - DNA, 16 bp, C. familiaris
cctctccctgcagctc

SEQ ID NO: 313610 - DNA, 16 bp, C. familiaris
cctctccctgctgctt

SEQ ID NO: 313611 - DNA, 16 bp, C. familiaris
cctctccctgcttctg

SEQ ID NO: 313612 - DNA, 16 bp, C. familiaris
cctctccctggggcag

SEQ ID NO: 313613 - DNA, 16 bp, C. familiaris
cctctcctcccagcct

SEQ ID NO: 313614 - DNA, 16 bp, C. familiaris
cctctcctcccccagg

SEQ ID NO: 313615 - DNA, 16 bp, C. familiaris
cctctcctctgctgtc

SEQ ID NO: 313616 - DNA, 16 bp, C. familiaris
cctctctatgtctatc

SEQ ID NO: 313617 - DNA, 16 bp, C. familiaris
cctctctcaggaataa

SEQ ID NO: 313618 - DNA, 16 bp, C. familiaris
cctctctctatgacta

SEQ ID NO: 313619 - DNA, 16 bp, C. familiaris
cctctctctctatctg

SEQ ID NO: 313620 - DNA, 16 bp, C. familiaris
cctctctctctgcctg

SEQ ID NO: 313621 - DNA, 16 bp, C. familiaris
cctctctctgccctca

SEQ ID NO: 313622 - DNA, 16 bp, C. familiaris
cctctctctgttttta

SEQ ID NO: 313623 - DNA, 16 bp, C. familiaris
cctctctgaagaggtg

SEQ ID NO: 313624 - DNA, 16 bp, C. familiaris
cctctctgagccctgg

SEQ ID NO: 313625 - DNA, 16 bp, C. familiaris
cctctctgagctgcag

SEQ ID NO: 313626 - DNA, 16 bp, C. familiaris
cctctctgaggctcag

SEQ ID NO: 313627 - DNA, 16 bp, C. familiaris
cctctctgagtctcag

SEQ ID NO: 313628 - DNA, 16 bp, C. familiaris
cctctctgcacctcag

SEQ ID NO: 313629 - DNA, 16 bp, C. familiaris
cctctctgtatctctc

SEQ ID NO: 313630 - DNA, 16 bp, C. familiaris
cctctctgtccctctg

SEQ ID NO: 313631 - DNA, 16 bp, C. familiaris
cctctctgtctctgtc

SEQ ID NO: 313632 - DNA, 16 bp, C. familiaris
cctctcttctgtgtgt

SEQ ID NO: 313633 - DNA, 16 bp, C. familiaris
cctctctttccctgtg

SEQ ID NO: 313634 - DNA, 16 bp, C. familiaris
cctctgactctgcctc

SEQ ID NO: 313635 - DNA, 16 bp, C. familiaris
cctctgagccacacag

SEQ ID NO: 313636 - DNA, 16 bp, C. familiaris
cctctgaggagcctga

SEQ ID NO: 313637 - DNA, 16 bp, C. familiaris
cctctgagtgcagagc

SEQ ID NO: 313638 - DNA, 16 bp, C. familiaris
cctctgatcctcctcc

SEQ ID NO: 313639 - DNA, 16 bp, C. familiaris
cctctgcacctgcccc

SEQ ID NO: 313640 - DNA, 16 bp, C. familiaris
cctctgcagctccctc

SEQ ID NO: 313641 - DNA, 16 bp, C. familiaris
cctctgccacctgccc

SEQ ID NO: 313642 - DNA, 16 bp, C. familiaris
cctctgccactgcccc

SEQ ID NO: 313643 - DNA, 16 bp, C. familiaris
cctctgcccactgccc

SEQ ID NO: 313644 - DNA, 16 bp, C. familiaris
cctctgcccatctccc

SEQ ID NO: 313645 - DNA, 16 bp, C. familiaris
cctctgccccagcctc

SEQ ID NO: 313646 - DNA, 16 bp, C. familiaris
cctctgcccctcaacc

SEQ ID NO: 313647 - DNA, 16 bp, C. familiaris
cctctgcccctcctac

SEQ ID NO: 313648 - DNA, 16 bp, C. familiaris
cctctgcccctgaccc

SEQ ID NO: 313649 - DNA, 16 bp, C. familiaris
cctctgccccttaccc

SEQ ID NO: 313650 - DNA, 16 bp, C. familiaris
cctctgccctgacccc

SEQ ID NO: 313651 - DNA, 16 bp, C. familiaris
cctctgccctgccctg

SEQ ID NO: 313652 - DNA, 16 bp, C. familiaris
cctctgcccttccact

SEQ ID NO: 313653 - DNA, 16 bp, C. familiaris
cctctgcctctcccca

SEQ ID NO: 313654 - DNA, 16 bp, C. familiaris
cctctgcctctgcctg

SEQ ID NO: 313655 - DNA, 16 bp, C. familiaris
cctctgcctctggctc

SEQ ID NO: 313656 - DNA, 16 bp, C. familiaris
cctctgcctcttccac

SEQ ID NO: 313657 - DNA, 16 bp, C. familiaris
cctctgcctgccacac

SEQ ID NO: 313658 - DNA, 16 bp, C. familiaris
cctctgcctgccccca

SEQ ID NO: 313659 - DNA, 16 bp, C. familiaris
cctctgcctgccctgc

SEQ ID NO: 313660 - DNA, 16 bp, C. familiaris
cctctgcctgctgccc

SEQ ID NO: 313661 - DNA, 16 bp, C. familiaris
cctctgcctgctgctc

SEQ ID NO: 313662 - DNA, 16 bp, C. familiaris
cctctgcctgggcctc

SEQ ID NO: 313663 - DNA, 16 bp, C. familiaris
cctctgcctggtgctc

SEQ ID NO: 313664 - DNA, 16 bp, C. familiaris
cctctgcctgtcctgg

SEQ ID NO: 313665 - DNA, 16 bp, C. familiaris
cctctgcctgtcgctc

SEQ ID NO: 313666 - DNA, 16 bp, C. familiaris
cctctgcctttggccc

SEQ ID NO: 313667 - DNA, 16 bp, C. familiaris
cctctgcgtctctctc

SEQ ID NO: 313668 - DNA, 16 bp, C. familiaris
cctctgctccccacca

SEQ ID NO: 313669 - DNA, 16 bp, C. familiaris
cctctgctcctcatcc

SEQ ID NO: 313670 - DNA, 16 bp, C. familiaris
cctctgctcctgctca

SEQ ID NO: 313671 - DNA, 16 bp, C. familiaris
cctctgctccttccac

SEQ ID NO: 313672 - DNA, 16 bp, C. familiaris
cctctgctctctgcct

SEQ ID NO: 313673 - DNA, 16 bp, C. familiaris
cctctgctgctccttc

SEQ ID NO: 313674 - DNA, 16 bp, C. familiaris
cctctgctgctgctcc

SEQ ID NO: 313675 - DNA, 16 bp, C. familiaris
cctctgctgcttcctc

SEQ ID NO: 313676 - DNA, 16 bp, C. familiaris
cctctgctgtgcagaa

SEQ ID NO: 313677 - DNA, 16 bp, C. familiaris
cctctggaggctccag

SEQ ID NO: 313678 - DNA, 16 bp, C. familiaris
cctctggctctgtgct

SEQ ID NO: 313679 - DNA, 16 bp, C. familiaris
cctctgggccaccagg

SEQ ID NO: 313680 - DNA, 16 bp, C. familiaris
cctctggggagcctgg

SEQ ID NO: 313681 - DNA, 16 bp, C. familiaris
cctctgtcatcacatg

SEQ ID NO: 313682 - DNA, 16 bp, C. familiaris
cctctgtctatggctc

SEQ ID NO: 313683 - DNA, 16 bp, C. familiaris
cctctgtcttcacatg

SEQ ID NO: 313684 - DNA, 16 bp, C. familiaris
cctctgtgctctgctt

SEQ ID NO: 313685 - DNA, 16 bp, C. familiaris
cctctgtgtccaaatt

SEQ ID NO: 313686 - DNA, 16 bp, C. familiaris
cctctgtgtgcgtgtg

SEQ ID NO: 313687 - DNA, 16 bp, C. familiaris
cctctgtttccttatc

SEQ ID NO: 313688 - DNA, 16 bp, C. familiaris
cctcttccagctcctg

SEQ ID NO: 313689 - DNA, 16 bp, C. familiaris
cctcttccattttttg

SEQ ID NO: 313690 - DNA, 16 bp, C. familiaris
cctcttcctgccccca

SEQ ID NO: 313691 - DNA, 16 bp, C. familiaris
cctcttcctgctcatg

SEQ ID NO: 313692 - DNA, 16 bp, C. familiaris
cctcttcctgctgctc

SEQ ID NO: 313693 - DNA, 16 bp, C. familiaris
cctcttcctgggtctc

SEQ ID NO: 313694 - DNA, 16 bp, C. familiaris
cctcttcctgtgtctc

SEQ ID NO: 313695 - DNA, 16 bp, C. familiaris
cctcttcctgtgtctt

SEQ ID NO: 313696 - DNA, 16 bp, C. familiaris
cctcttctggaatccc

SEQ ID NO: 313697 - DNA, 16 bp, C. familiaris
cctcttcttaaaagga

SEQ ID NO: 313698 - DNA, 16 bp, C. familiaris
cctcttcttttcagct

SEQ ID NO: 313699 - DNA, 16 bp, C. familiaris
cctcttgcactgttgt

SEQ ID NO: 313700 - DNA, 16 bp, C. familiaris
cctctttaagaagaag

SEQ ID NO: 313701 - DNA, 16 bp, C. familiaris
cctctttgacctcagc

SEQ ID NO: 313702 - DNA, 16 bp, C. familiaris
cctctttgacttcagc

SEQ ID NO: 313703 - DNA, 16 bp, C. familiaris
cctcttttttcctcag

SEQ ID NO: 313704 - DNA, 16 bp, C. familiaris
cctgaaaagaaagcag

SEQ ID NO: 313705 - DNA, 16 bp, C. familiaris
cctgaaaatgaagggg

SEQ ID NO: 313706 - DNA, 16 bp, C. familiaris
cctgaaactaataaaa

SEQ ID NO: 313707 - DNA, 16 bp, C. familiaris
cctgaaagcagctcaa

SEQ ID NO: 313708 - DNA, 16 bp, C. familiaris
cctgaaatcctggaat

SEQ ID NO: 313709 - DNA, 16 bp, C. familiaris
cctgaaatcctgggat

SEQ ID NO: 313710 - DNA, 16 bp, C. familiaris
cctgaaatcgagtccc

SEQ ID NO: 313711 - DNA, 16 bp, C. familiaris
cctgaaccatccaggc

SEQ ID NO: 313712 - DNA, 16 bp, C. familiaris
cctgaacccaaatcaa

SEQ ID NO: 313713 - DNA, 16 bp, C. familiaris
cctgaactgaaggtag

SEQ ID NO: 313714 - DNA, 16 bp, C. familiaris
cctgaacttttgtttg

SEQ ID NO: 313715 - DNA, 16 bp, C. familiaris
cctgaagaaaataaaa

SEQ ID NO: 313716 - DNA, 16 bp, C. familiaris
cctgaagaacttcctt

SEQ ID NO: 313717 - DNA, 16 bp, C. familiaris
cctgaagaagaaaaac

SEQ ID NO: 313718 - DNA, 16 bp, C. familiaris
cctgaagacccaggat

SEQ ID NO: 313719 - DNA, 16 bp, C. familiaris
cctgaagctgcccctg

SEQ ID NO: 313720 - DNA, 16 bp, C. familiaris
cctgaaggaactggag

SEQ ID NO: 313721 - DNA, 16 bp, C. familiaris
cctgaaggtggtgcta

SEQ ID NO: 313722 - DNA, 16 bp, C. familiaris
cctgacacagagctca

SEQ ID NO: 313723 - DNA, 16 bp, C. familiaris
cctgaccccaggaccc

SEQ ID NO: 313724 - DNA, 16 bp, C. familiaris
cctgaccccagggcct

SEQ ID NO: 313725 - DNA, 16 bp, C. familiaris
cctgaccctgaccctg

SEQ ID NO: 313726 - DNA, 16 bp, C. familiaris
cctgacctctgacctc

SEQ ID NO: 313727 - DNA, 16 bp, C. familiaris
cctgactcacagaaac

SEQ ID NO: 313728 - DNA, 16 bp, C. familiaris
cctgactcggggcttg

SEQ ID NO: 313729 - DNA, 16 bp, C. familiaris
cctgagaaccactgct

SEQ ID NO: 313730 - DNA, 16 bp, C. familiaris
cctgagaatcagcaga

SEQ ID NO: 313731 - DNA, 16 bp, C. familiaris
cctgagacaagggaaa

SEQ ID NO: 313732 - DNA, 16 bp, C. familiaris
cctgagacacctgggt

SEQ ID NO: 313733 - DNA, 16 bp, C. familiaris
cctgagacagtaacag

SEQ ID NO: 313734 - DNA, 16 bp, C. familiaris
cctgagaccaaggcag

SEQ ID NO: 313735 - DNA, 16 bp, C. familiaris
cctgagaccttgacct

SEQ ID NO: 313736 - DNA, 16 bp, C. familiaris
cctgagaggaaggcag

SEQ ID NO: 313737 - DNA, 16 bp, C. familiaris
cctgagataatgactt

SEQ ID NO: 313738 - DNA, 16 bp, C. familiaris
cctgagatcaagatca

SEQ ID NO: 313739 - DNA, 16 bp, C. familiaris
cctgagatcacaccct

SEQ ID NO: 313740 - DNA, 16 bp, C. familiaris
cctgagatggagcctc

SEQ ID NO: 313741 - DNA, 16 bp, C. familiaris
cctgagattgagcccc

SEQ ID NO: 313742 - DNA, 16 bp, C. familiaris
cctgagattgaggccc

SEQ ID NO: 313743 - DNA, 16 bp, C. familiaris
cctgagcagaagccaa

SEQ ID NO: 313744 - DNA, 16 bp, C. familiaris
cctgagcagaggcaga

SEQ ID NO: 313745 - DNA, 16 bp, C. familiaris
cctgagccaacagcag

SEQ ID NO: 313746 - DNA, 16 bp, C. familiaris
cctgagccaccaggca

SEQ ID NO: 313747 - DNA, 16 bp, C. familiaris
cctgagccagagggag

SEQ ID NO: 313748 - DNA, 16 bp, C. familiaris
cctgagccaggagcag

SEQ ID NO: 313749 - DNA, 16 bp, C. familiaris
cctgagcccaaggccg

SEQ ID NO: 313750 - DNA, 16 bp, C. familiaris
cctgagcccccagccc

SEQ ID NO: 313751 - DNA, 16 bp, C. familiaris
cctgagcccctccgag

SEQ ID NO: 313752 - DNA, 16 bp, C. familiaris
cctgagccgaaggaag

SEQ ID NO: 313753 - DNA, 16 bp, C. familiaris
cctgagctgaaacaaa

SEQ ID NO: 313754 - DNA, 16 bp, C. familiaris
cctgagctgaaggcag

SEQ ID NO: 313755 - DNA, 16 bp, C. familiaris
cctgagctgaatgcag

SEQ ID NO: 313756 - DNA, 16 bp, C. familiaris
cctgagctgatggcag

SEQ ID NO: 313757 - DNA, 16 bp, C. familiaris
cctgagctgcaggtgg

SEQ ID NO: 313758 - DNA, 16 bp, C. familiaris
cctgaggaagaaaaac

SEQ ID NO: 313759 - DNA, 16 bp, C. familiaris
cctgaggcaaaaggaa

SEQ ID NO: 313760 - DNA, 16 bp, C. familiaris
cctgaggcagaggcag

SEQ ID NO: 313761 - DNA, 16 bp, C. familiaris
cctgagggacacctgg

SEQ ID NO: 313762 - DNA, 16 bp, C. familiaris
cctgagggaggccctg

SEQ ID NO: 313763 - DNA, 16 bp, C. familiaris
cctgaggggctcagtt

SEQ ID NO: 313764 - DNA, 16 bp, C. familiaris
cctgaggtcacagagc

SEQ ID NO: 313765 - DNA, 16 bp, C. familiaris
cctgaggtcacccagc

SEQ ID NO: 313766 - DNA, 16 bp, C. familiaris
cctgaggtcatggcct

SEQ ID NO: 313767 - DNA, 16 bp, C. familiaris
cctgagtcaaaatcag

SEQ ID NO: 313768 - DNA, 16 bp, C. familiaris
cctgagtctccagaat

SEQ ID NO: 313769 - DNA, 16 bp, C. familiaris
cctgagtggaagacag

SEQ ID NO: 313770 - DNA, 16 bp, C. familiaris
cctgagtggctcagtg

SEQ ID NO: 313771 - DNA, 16 bp, C. familiaris
cctgagtgtctcagtg

SEQ ID NO: 313772 - DNA, 16 bp, C. familiaris
cctgagttcatgatct

SEQ ID NO: 313773 - DNA, 16 bp, C. familiaris
cctgagttctatgagc

SEQ ID NO: 313774 - DNA, 16 bp, C. familiaris
cctgatagaaaattta

SEQ ID NO: 313775 - DNA, 16 bp, C. familiaris
cctgatcagtcagcag

SEQ ID NO: 313776 - DNA, 16 bp, C. familiaris
cctgatcccgggatca

SEQ ID NO: 313777 - DNA, 16 bp, C. familiaris
cctgatcttaaaggaa

SEQ ID NO: 313778 - DNA, 16 bp, C. familiaris
cctgatgataaatgat

SEQ ID NO: 313779 - DNA, 16 bp, C. familiaris
cctgatgcaggactcc

SEQ ID NO: 313780 - DNA, 16 bp, C. familiaris
cctgatgcggggctca

SEQ ID NO: 313781 - DNA, 16 bp, C. familiaris
cctgatgcggggcttg

SEQ ID NO: 313782 - DNA, 16 bp, C. familiaris
cctgatgctggacttg

SEQ ID NO: 313783 - DNA, 16 bp, C. familiaris
cctgatggaaaagtgc

SEQ ID NO: 313784 - DNA, 16 bp, C. familiaris
cctgatggaggactca

SEQ ID NO: 313785 - DNA, 16 bp, C. familiaris
cctgattctccctcct

SEQ ID NO: 313786 - DNA, 16 bp, C. familiaris
cctgatttcaaattat

SEQ ID NO: 313787 - DNA, 16 bp, C. familiaris
cctgcaaattccaaag

SEQ ID NO: 313788 - DNA, 18 bp, C. familiaris
cctgcaagagctgttggc

SEQ ID NO: 313789 - DNA, 16 bp, C. familiaris
cctgcaaggagcccat

SEQ ID NO: 313790 - DNA, 16 bp, C. familiaris
cctgcaaggagcctgg

SEQ ID NO: 313791 - DNA, 16 bp, C. familiaris
cctgcaaggagtctga

SEQ ID NO: 313792 - DNA, 16 bp, C. familiaris
cctgcacagctggggg

SEQ ID NO: 313793 - DNA, 16 bp, C. familiaris
cctgcaccaggccggg

SEQ ID NO: 313794 - DNA, 16 bp, C. familiaris
cctgcaccccacctgc

SEQ ID NO: 313795 - DNA, 16 bp, C. familiaris
cctgcaccctggcccc

SEQ ID NO: 313796 - DNA, 16 bp, C. familiaris
cctgcaccgggagccc

SEQ ID NO: 313797 - DNA, 16 bp, C. familiaris
cctgcactccccctgg

SEQ ID NO: 313798 - DNA, 16 bp, C. familiaris
cctgcactcccctgtg

SEQ ID NO: 313799 - DNA, 16 bp, C. familiaris
cctgcactctcctgtg

SEQ ID NO: 313800 - DNA, 16 bp, C. familiaris
cctgcactgggcttcc

SEQ ID NO: 313801 - DNA, 16 bp, C. familiaris
cctgcagaaagcctgc

SEQ ID NO: 313802 - DNA, 16 bp, C. familiaris
cctgcagagcaaggag

SEQ ID NO: 313803 - DNA, 16 bp, C. familiaris
cctgcagcccacggcg

SEQ ID NO: 313804 - DNA, 16 bp, C. familiaris
cctgcagcccagagtg

SEQ ID NO: 313805 - DNA, 16 bp, C. familiaris
cctgcagcccaggatg

SEQ ID NO: 313806 - DNA, 16 bp, C. familiaris
cctgcagcccagggcc

SEQ ID NO: 313807 - DNA, 16 bp, C. familiaris
cctgcagccccagccc

SEQ ID NO: 313808 - DNA, 16 bp, C. familiaris
cctgcagccccaggga

SEQ ID NO: 313809 - DNA, 16 bp, C. familiaris
cctgcagccccagggc

SEQ ID NO: 313810 - DNA, 16 bp, C. familiaris
cctgcagccccgggtg

SEQ ID NO: 313811 - DNA, 16 bp, C. familiaris
cctgcagcccctgcag

SEQ ID NO: 313812 - DNA, 16 bp, C. familiaris
cctgcagccctgccct

SEQ ID NO: 313813 - DNA, 16 bp, C. familiaris
cctgcagccctgctgc

SEQ ID NO: 313814 - DNA, 16 bp, C. familiaris
cctgcagccctgggcc

SEQ ID NO: 313815 - DNA, 16 bp, C. familiaris
cctgcagccgggggtg

SEQ ID NO: 313816 - DNA, 16 bp, C. familiaris
cctgcagcctgggttg

SEQ ID NO: 313817 - DNA, 16 bp, C. familiaris
cctgcagctcctcctg

SEQ ID NO: 313818 - DNA, 16 bp, C. familiaris
cctgcagctctccctg

SEQ ID NO: 313819 - DNA, 16 bp, C. familiaris
cctgcaggaagcccga

SEQ ID NO: 313820 - DNA, 16 bp, C. familiaris
cctgcaggaggcctgc

SEQ ID NO: 313821 - DNA, 16 bp, C. familiaris
cctgcaggcagcctga

SEQ ID NO: 313822 - DNA, 16 bp, C. familiaris
cctgcagggagcccag

SEQ ID NO: 313823 - DNA, 16 bp, C. familiaris
cctgcagggagcccga

SEQ ID NO: 313824 - DNA, 16 bp, C. familiaris
cctgcagggagccttc

SEQ ID NO: 313825 - DNA, 16 bp, C. familiaris
cctgcagggagctgct

SEQ ID NO: 313826 - DNA, 16 bp, C. familiaris
cctgcagggccctggg

SEQ ID NO: 313827 - DNA, 16 bp, C. familiaris
cctgcagggcctggag

SEQ ID NO: 313828 - DNA, 16 bp, C. familiaris
cctgcaggggagcctg

SEQ ID NO: 313829 - DNA, 16 bp, C. familiaris
cctgcagggggcctga

SEQ ID NO: 313830 - DNA, 16 bp, C. familiaris
cctgcaggtggctctg

SEQ ID NO: 313831 - DNA, 16 bp, C. familiaris
cctgcagtgggcagtg

SEQ ID NO: 313832 - DNA, 16 bp, C. familiaris
cctgcatcagactcct

SEQ ID NO: 313833 - DNA, 16 bp, C. familiaris
cctgcatcgggctctc

SEQ ID NO: 313834 - DNA, 16 bp, C. familiaris
cctgcatctggctcct

SEQ ID NO: 313835 - DNA, 16 bp, C. familiaris
cctgcatgggagcctg

SEQ ID NO: 313836 - DNA, 16 bp, C. familiaris
cctgcattctcctcta

SEQ ID NO: 313837 - DNA, 16 bp, C. familiaris
cctgcattgggctcag

SEQ ID NO: 313838 - DNA, 16 bp, C. familiaris
cctgccacagtttcat

SEQ ID NO: 313839 - DNA, 16 bp, C. familiaris
cctgccacattgccaa

SEQ ID NO: 313840 - DNA, 16 bp, C. familiaris
cctgccaccaccacca

SEQ ID NO: 313841 - DNA, 16 bp, C. familiaris
cctgccacctgcctcc

SEQ ID NO: 313842 - DNA, 16 bp, C. familiaris
cctgccactcccccag

SEQ ID NO: 313843 - DNA, 16 bp, C. familiaris
cctgccactgggcacc

SEQ ID NO: 313844 - DNA, 18 bp, C. familiaris
cctgccagccctttctgg

SEQ ID NO: 313845 - DNA, 16 bp, C. familiaris
cctgccaggagcctga

SEQ ID NO: 313846 - DNA, 16 bp, C. familiaris
cctgccaggtgtctgt

SEQ ID NO: 313847 - DNA, 16 bp, C. familiaris
cctgccatctgtgaca

SEQ ID NO: 313848 - DNA, 16 bp, C. familiaris
cctgccatttgcagca

SEQ ID NO: 313849 - DNA, 16 bp, C. familiaris
cctgcccaaggtcatg

SEQ ID NO: 313850 - DNA, 16 bp, C. familiaris
cctgcccacaggtcct

SEQ ID NO: 313851 - DNA, 16 bp, C. familiaris
cctgcccacatcccct

SEQ ID NO: 313852 - DNA, 16 bp, C. familiaris
cctgcccacctcccag

SEQ ID NO: 313853 - DNA, 16 bp, C. familiaris
cctgcccacctcctgc

SEQ ID NO: 313854 - DNA, 16 bp, C. familiaris
cctgcccagccccagc

SEQ ID NO: 313855 - DNA, 16 bp, C. familiaris
cctgcccagccctggg

SEQ ID NO: 313856 - DNA, 16 bp, C. familiaris
cctgcccaggccccag

SEQ ID NO: 313857 - DNA, 16 bp, C. familiaris
cctgcccagtgaggag

SEQ ID NO: 313858 - DNA, 16 bp, C. familiaris
cctgcccagtgcagag

SEQ ID NO: 313859 - DNA, 16 bp, C. familiaris
cctgcccagtggggaa

SEQ ID NO: 313860 - DNA, 16 bp, C. familiaris
cctgcccagtggggag

SEQ ID NO: 313861 - DNA, 16 bp, C. familiaris
cctgcccagtgtggag

SEQ ID NO: 313862 - DNA, 16 bp, C. familiaris
cctgccccacccctgg

SEQ ID NO: 313863 - DNA, 16 bp, C. familiaris
cctgccccagacctgc

SEQ ID NO: 313864 - DNA, 16 bp, C. familiaris
cctgccccaggcccag

SEQ ID NO: 313865 - DNA, 16 bp, C. familiaris
cctgcccccagagcat

SEQ ID NO: 313866 - DNA, 16 bp, C. familiaris
cctgcccccagccctg

SEQ ID NO: 313867 - DNA, 16 bp, C. familiaris
cctgcccctgctccag

SEQ ID NO: 313868 - DNA, 16 bp, C. familiaris
cctgcccctggccctg

SEQ ID NO: 313869 - DNA, 16 bp, C. familiaris
cctgcccctgggcctc

SEQ ID NO: 313870 - DNA, 16 bp, C. familiaris
cctgcccctggggctg

SEQ ID NO: 313871 - DNA, 16 bp, C. familiaris
cctgccctactaccca

SEQ ID NO: 313872 - DNA, 16 bp, C. familiaris
cctgccctcaagaagc

SEQ ID NO: 313873 - DNA, 16 bp, C. familiaris
cctgccctcaggaagc

SEQ ID NO: 313874 - DNA, 16 bp, C. familiaris
cctgccctcaggagct

SEQ ID NO: 313875 - DNA, 16 bp, C. familiaris
cctgccctccacccag

SEQ ID NO: 313876 - DNA, 16 bp, C. familiaris
cctgccctccaccctg

SEQ ID NO: 313877 - DNA, 16 bp, C. familiaris
cctgccctccaggagc

SEQ ID NO: 313878 - DNA, 16 bp, C. familiaris
cctgccctcccccagg

SEQ ID NO: 313879 - DNA, 16 bp, C. familiaris
cctgccctcctgcagc

SEQ ID NO: 313880 - DNA, 16 bp, C. familiaris
cctgccctcctggagc

SEQ ID NO: 313881 - DNA, 16 bp, C. familiaris
cctgccctcctggggc

SEQ ID NO: 313882 - DNA, 16 bp, C. familiaris
cctgccctcggcccag

SEQ ID NO: 313883 - DNA, 16 bp, C. familiaris
cctgccctgagcccca

SEQ ID NO: 313884 - DNA, 16 bp, C. familiaris
cctgccctgcagattt

SEQ ID NO: 313885 - DNA, 16 bp, C. familiaris
cctgccctgcagcccc

SEQ ID NO: 313886 - DNA, 16 bp, C. familiaris
cctgccctgcccaggc

SEQ ID NO: 313887 - DNA, 16 bp, C. familiaris
cctgccctgccctctg

SEQ ID NO: 313888 - DNA, 16 bp, C. familiaris
cctgccctgccctgct

SEQ ID NO: 313889 - DNA, 16 bp, C. familiaris
cctgccctgccctggc

SEQ ID NO: 313890 - DNA, 16 bp, C. familiaris
cctgccctgccctggg

SEQ ID NO: 313891 - DNA, 16 bp, C. familiaris
cctgccctgctccctg

SEQ ID NO: 313892 - DNA, 16 bp, C. familiaris
cctgccctgctgccct

SEQ ID NO: 313893 - DNA, 16 bp, C. familiaris
cctgccctggccctgc

SEQ ID NO: 313894 - DNA, 16 bp, C. familiaris
cctgccctgggcccct

SEQ ID NO: 313895 - DNA, 16 bp, C. familiaris
cctgccctgggcctgg

SEQ ID NO: 313896 - DNA, 16 bp, C. familiaris
cctgccctgtcttgga

SEQ ID NO: 313897 - DNA, 16 bp, C. familiaris
cctgcctacggcccag

SEQ ID NO: 313898 - DNA, 16 bp, C. familiaris
cctgcctcaggctcct

SEQ ID NO: 313899 - DNA, 16 bp, C. familiaris
cctgcctccagcctcc

SEQ ID NO: 313900 - DNA, 16 bp, C. familiaris
cctgcctccccagcct

SEQ ID NO: 313901 - DNA, 16 bp, C. familiaris
cctgcctcccgcccag

SEQ ID NO: 313902 - DNA, 16 bp, C. familiaris
cctgcctcctgcttct

SEQ ID NO: 313903 - DNA, 16 bp, C. familiaris
cctgcctcgggcccag

SEQ ID NO: 313904 - DNA, 16 bp, C. familiaris
cctgcctctcccaggc

SEQ ID NO: 313905 - DNA, 16 bp, C. familiaris
cctgcctctccttctg

SEQ ID NO: 313906 - DNA, 16 bp, C. familiaris
cctgcctctgccccca

SEQ ID NO: 313907 - DNA, 16 bp, C. familiaris
cctgcctctgcctgcc

SEQ ID NO: 313908 - DNA, 16 bp, C. familiaris
cctgcctctgcctgtg

SEQ ID NO: 313909 - DNA, 16 bp, C. familiaris
cctgcctctggctcag

SEQ ID NO: 313910 - DNA, 16 bp, C. familiaris
cctgcctcttccccca

SEQ ID NO: 313911 - DNA, 16 bp, C. familiaris
cctgcctgccctctgc

SEQ ID NO: 313912 - DNA, 16 bp, C. familiaris
cctgcctgcctgcctc

SEQ ID NO: 313913 - DNA, 16 bp, C. familiaris
cctgcctgccttcttc

SEQ ID NO: 313914 - DNA, 16 bp, C. familiaris
cctgcctgccttcttt

SEQ ID NO: 313915 - DNA, 16 bp, C. familiaris
cctgcctgcctttcct

SEQ ID NO: 313916 - DNA, 16 bp, C. familiaris
cctgcctgctgctcct

SEQ ID NO: 313917 - DNA, 16 bp, C. familiaris
cctgcctgcttctctc

SEQ ID NO: 313918 - DNA, 16 bp, C. familiaris
cctgcctggagcctgc

SEQ ID NO: 313919 - DNA, 16 bp, C. familiaris
cctgcctggccctggc

SEQ ID NO: 313920 - DNA, 16 bp, C. familiaris
cctgcctgggccaccc

SEQ ID NO: 313921 - DNA, 16 bp, C. familiaris
cctgcctgggccctgg

SEQ ID NO: 313922 - DNA, 16 bp, C. familiaris
cctgcctggggcctgc

SEQ ID NO: 313923 - DNA, 16 bp, C. familiaris
cctgcctggggctccc

SEQ ID NO: 313924 - DNA, 16 bp, C. familiaris
cctgcctggggctctg

SEQ ID NO: 313925 - DNA, 16 bp, C. familiaris
cctgcctgggtggctc

SEQ ID NO: 313926 - DNA, 16 bp, C. familiaris
cctgcctgtggcccag

SEQ ID NO: 313927 - DNA, 16 bp, C. familiaris
cctgccttcagcaaga

SEQ ID NO: 313928 - DNA, 16 bp, C. familiaris
cctgccttcatgaagc

SEQ ID NO: 313929 - DNA, 16 bp, C. familiaris
cctgccttccatccag

SEQ ID NO: 313930 - DNA, 16 bp, C. familiaris
cctgccttcccccagg

SEQ ID NO: 313931 - DNA, 16 bp, C. familiaris
cctgccttcctacctt

SEQ ID NO: 313932 - DNA, 16 bp, C. familiaris
cctgccttgggctcca

SEQ ID NO: 313933 - DNA, 16 bp, C. familiaris
cctgccttgggctcct

SEQ ID NO: 313934 - DNA, 16 bp, C. familiaris
cctgcctttgacccag

SEQ ID NO: 313935 - DNA, 16 bp, C. familiaris
cctgcctttgccctgg

SEQ ID NO: 313936 - DNA, 16 bp, C. familiaris
cctgcctttggcccag

SEQ ID NO: 313937 - DNA, 16 bp, C. familiaris
cctgcctttggccccc

SEQ ID NO: 313938 - DNA, 16 bp, C. familiaris
cctgcctttgtcccag

SEQ ID NO: 313939 - DNA, 16 bp, C. familiaris
cctgcgggaagcctgc

SEQ ID NO: 313940 - DNA, 16 bp, C. familiaris
cctgcggggagcccga

SEQ ID NO: 313941 - DNA, 16 bp, C. familiaris
cctgcgtggggctctg

SEQ ID NO: 313942 - DNA, 16 bp, C. familiaris
cctgcgtggtgcctgc

SEQ ID NO: 313943 - DNA, 16 bp, C. familiaris
cctgctactccttctg

SEQ ID NO: 313944 - DNA, 16 bp, C. familiaris
cctgctaggtctctgt

SEQ ID NO: 313945 - DNA, 16 bp, C. familiaris
cctgctcactggggag

SEQ ID NO: 313946 - DNA, 16 bp, C. familiaris
cctgctcagaggggag

SEQ ID NO: 313947 - DNA, 16 bp, C. familiaris
cctgctcagcaaggag

SEQ ID NO: 313948 - DNA, 16 bp, C. familiaris
cctgctcagcagagga

SEQ ID NO: 313949 - DNA, 16 bp, C. familiaris
cctgctcagcagaggg

SEQ ID NO: 313950 - DNA, 16 bp, C. familiaris
cctgctcagcaggagg

SEQ ID NO: 313951 - DNA, 16 bp, C. familiaris
cctgctcagcgggaag

SEQ ID NO: 313952 - DNA, 16 bp, C. familiaris
cctgctcagcgggcag

SEQ ID NO: 313953 - DNA, 16 bp, C. familiaris
cctgctcagtgaggtg

SEQ ID NO: 313954 - DNA, 16 bp, C. familiaris
cctgctcagtggagga

SEQ ID NO: 313955 - DNA, 16 bp, C. familiaris
cctgctcagtgggaag

SEQ ID NO: 313956 - DNA, 16 bp, C. familiaris
cctgctcatgcacatg

SEQ ID NO: 313957 - DNA, 16 bp, C. familiaris
cctgctcattgaggag

SEQ ID NO: 313958 - DNA, 16 bp, C. familiaris
cctgctccctccccag

SEQ ID NO: 313959 - DNA, 16 bp, C. familiaris
cctgctccctgcctgc

SEQ ID NO: 313960 - DNA, 16 bp, C. familiaris
cctgctcctccctcca

SEQ ID NO: 313961 - DNA, 16 bp, C. familiaris
cctgctcctgcacctg

SEQ ID NO: 313962 - DNA, 16 bp, C. familiaris
cctgctcctgccccag

SEQ ID NO: 313963 - DNA, 16 bp, C. familiaris
cctgctctgaggggag

SEQ ID NO: 313964 - DNA, 16 bp, C. familiaris
cctgctctgtgccctg

SEQ ID NO: 313965 - DNA, 16 bp, C. familiaris
cctgctcttcctctgc

SEQ ID NO: 313966 - DNA, 16 bp, C. familiaris
cctgctcttctctctg

SEQ ID NO: 313967 - DNA, 16 bp, C. familiaris
cctgctgaatgcagag

SEQ ID NO: 313968 - DNA, 16 bp, C. familiaris
cctgctgaccagggag

SEQ ID NO: 313969 - DNA, 16 bp, C. familiaris
cctgctgaccatggag

SEQ ID NO: 313970 - DNA, 16 bp, C. familiaris
cctgctgagcaagaag

SEQ ID NO: 313971 - DNA, 16 bp, C. familiaris
cctgctgagccgggag

SEQ ID NO: 313972 - DNA, 16 bp, C. familiaris
cctgctgagcttggag

SEQ ID NO: 313973 - DNA, 16 bp, C. familiaris
cctgctgaggaaggag

SEQ ID NO: 313974 - DNA, 16 bp, C. familiaris
cctgctgagtgaggag

SEQ ID NO: 313975 - DNA, 16 bp, C. familiaris
cctgctgagtgggaag

SEQ ID NO: 313976 - DNA, 16 bp, C. familiaris
cctgctgagtggggag

SEQ ID NO: 313977 - DNA, 16 bp, C. familiaris
cctgctgatggacatt

SEQ ID NO: 313978 - DNA, 16 bp, C. familiaris
cctgctgcacctgctg

SEQ ID NO: 313979 - DNA, 16 bp, C. familiaris
cctgctgcaggactcg

SEQ ID NO: 313980 - DNA, 16 bp, C. familiaris
cctgctgcagggctca

SEQ ID NO: 313981 - DNA, 16 bp, C. familiaris
cctgctgccccagggc

SEQ ID NO: 313982 - DNA, 16 bp, C. familiaris
cctgctgcccctgctg

SEQ ID NO: 313983 - DNA, 16 bp, C. familiaris
cctgctgccctgctgc

SEQ ID NO: 313984 - DNA, 16 bp, C. familiaris
cctgctgccctggccc

SEQ ID NO: 313985 - DNA, 16 bp, C. familiaris
cctgctgccctgggag

SEQ ID NO: 313986 - DNA, 16 bp, C. familiaris
cctgctgcctcctgcc

SEQ ID NO: 313987 - DNA, 16 bp, C. familiaris
cctgctgcctctgccc

SEQ ID NO: 313988 - DNA, 16 bp, C. familiaris
cctgctgctcatgctc

SEQ ID NO: 313989 - DNA, 16 bp, C. familiaris
cctgctgctccctgct

SEQ ID NO: 313990 - DNA, 16 bp, C. familiaris
cctgctgctctccctg

SEQ ID NO: 313991 - DNA, 16 bp, C. familiaris
cctgctgctcttcctg

SEQ ID NO: 313992 - DNA, 16 bp, C. familiaris
cctgctgctgcttctc

SEQ ID NO: 313993 - DNA, 16 bp, C. familiaris
cctgctgctgggtgcc

SEQ ID NO: 313994 - DNA, 16 bp, C. familiaris
cctgctgctgtgagtc

SEQ ID NO: 313995 - DNA, 16 bp, C. familiaris
cctgctgcttctcctg

SEQ ID NO: 313996 - DNA, 16 bp, C. familiaris
cctgctggcctgccct

SEQ ID NO: 313997 - DNA, 16 bp, C. familiaris
cctgctgggcaggaag

SEQ ID NO: 313998 - DNA, 16 bp, C. familiaris
cctgctgggctccctg

SEQ ID NO: 313999 - DNA, 16 bp, C. familiaris
cctgctgggtgtggag

SEQ ID NO: 314000 - DNA, 16 bp, C. familiaris
cctgctgtgcagggag

SEQ ID NO: 314001 - DNA, 16 bp, C. familiaris
cctgctgtgggccagg

SEQ ID NO: 314002 - DNA, 16 bp, C. familiaris
cctgctgtgtgccagg

SEQ ID NO: 314003 - DNA, 16 bp, C. familiaris
cctgctgtgtgcccag

SEQ ID NO: 314004 - DNA, 16 bp, C. familiaris
cctgcttaacagggag

SEQ ID NO: 314005 - DNA, 16 bp, C. familiaris
cctgcttatactctct

SEQ ID NO: 314006 - DNA, 16 bp, C. familiaris
cctgcttatccttctg

SEQ ID NO: 314007 - DNA, 16 bp, C. familiaris
cctgcttcctctcctg

SEQ ID NO: 314008 - DNA, 16 bp, C. familiaris
cctgcttcctgctcag

SEQ ID NO: 314009 - DNA, 16 bp, C. familiaris
cctgcttctacttctg

SEQ ID NO: 314010 - DNA, 16 bp, C. familiaris
cctgcttctccaggcc

SEQ ID NO: 314011 - DNA, 27 bp, C. familiaris
cctgcttctccctctgcctgtgtctct

SEQ ID NO: 314012 - DNA, 16 bp, C. familiaris
cctgcttctccttccg

SEQ ID NO: 314013 - DNA, 16 bp, C. familiaris
cctgcttctcttcctg

SEQ ID NO: 314014 - DNA, 16 bp, C. familiaris
cctgcttctctttctg

SEQ ID NO: 314015 - DNA, 16 bp, C. familiaris
cctgcttctgtgtgtg

SEQ ID NO: 314016 - DNA, 16 bp, C. familiaris
cctgcttcttcctgtc

SEQ ID NO: 314017 - DNA, 16 bp, C. familiaris
cctgcttgatggggag

SEQ ID NO: 314018 - DNA, 16 bp, C. familiaris
cctgcttgcttctccc

SEQ ID NO: 314019 - DNA, 16 bp, C. familiaris
cctgcttggggcctgc

SEQ ID NO: 314020 - DNA, 16 bp, C. familiaris
cctggaaagccagaaa

SEQ ID NO: 314021 - DNA, 16 bp, C. familiaris
cctggaatccagtccc

SEQ ID NO: 314022 - DNA, 16 bp, C. familiaris
cctggaatcctggaat

SEQ ID NO: 314023 - DNA, 16 bp, C. familiaris
cctggaatctgtgaat

SEQ ID NO: 314024 - DNA, 16 bp, C. familiaris
cctggaatgttcttcc

SEQ ID NO: 314025 - DNA, 16 bp, C. familiaris
cctggaattgagccct

SEQ ID NO: 314026 - DNA, 16 bp, C. familiaris
cctggacacccgggat

SEQ ID NO: 314027 - DNA, 16 bp, C. familiaris
cctggacagaaggcag

SEQ ID NO: 314028 - DNA, 16 bp, C. familiaris
cctggactcctgggtc

SEQ ID NO: 314029 - DNA, 16 bp, C. familiaris
cctggactgaaggcag

SEQ ID NO: 314030 - DNA, 16 bp, C. familiaris
cctggacttccagcct

SEQ ID NO: 314031 - DNA, 16 bp, C. familiaris
cctggagaagcaggag

SEQ ID NO: 314032 - DNA, 16 bp, C. familiaris
cctggagaccaaggat

SEQ ID NO: 314033 - DNA, 16 bp, C. familiaris
cctggagaccatggat

SEQ ID NO: 314034 - DNA, 16 bp, C. familiaris
cctggagacccaagat

SEQ ID NO: 314035 - DNA, 16 bp, C. familiaris
cctggagacccagatc

SEQ ID NO: 314036 - DNA, 16 bp, C. familiaris
cctggagacccaggac

SEQ ID NO: 314037 - DNA, 16 bp, C. familiaris
cctggagacccaggct

SEQ ID NO: 314038 - DNA, 16 bp, C. familiaris
cctggagacccaggtc

SEQ ID NO: 314039 - DNA, 16 bp, C. familiaris
cctggagaccccgggg

SEQ ID NO: 314040 - DNA, 16 bp, C. familiaris
cctggagaccccgggt

SEQ ID NO: 314041 - DNA, 16 bp, C. familiaris
cctggagacccggatc

SEQ ID NO: 314042 - DNA, 16 bp, C. familiaris
cctggagaccctgcat

SEQ ID NO: 314043 - DNA, 16 bp, C. familiaris
cctggagacctgcccc

SEQ ID NO: 314044 - DNA, 16 bp, C. familiaris
cctggagacctgtgat

SEQ ID NO: 314045 - DNA, 16 bp, C. familiaris
cctggagatcaagacc

SEQ ID NO: 314046 - DNA, 16 bp, C. familiaris
cctggagatcacgacc

SEQ ID NO: 314047 - DNA, 16 bp, C. familiaris
cctggagatcctggat

SEQ ID NO: 314048 - DNA, 16 bp, C. familiaris
cctggagcatggagcc

SEQ ID NO: 314049 - DNA, 16 bp, C. familiaris
cctggagcccagggtg

SEQ ID NO: 314050 - DNA, 16 bp, C. familiaris
cctggagccccggaat

SEQ ID NO: 314051 - DNA, 16 bp, C. familiaris
cctggagctccaggat

SEQ ID NO: 314052 - DNA, 16 bp, C. familiaris
cctggagctgccctgg

SEQ ID NO: 314053 - DNA, 16 bp, C. familiaris
cctggagctgtggcag

SEQ ID NO: 314054 - DNA, 16 bp, C. familiaris
cctggagcttccagaa

SEQ ID NO: 314055 - DNA, 16 bp, C. familiaris
cctggaggaagtgaca

SEQ ID NO: 314056 - DNA, 16 bp, C. familiaris
cctggaggagcaggag

SEQ ID NO: 314057 - DNA, 16 bp, C. familiaris
cctggaggaggcagca

SEQ ID NO: 314058 - DNA, 16 bp, C. familiaris
cctggaggaggtgagg

SEQ ID NO: 314059 - DNA, 16 bp, C. familiaris
cctggaggaggtggtg

SEQ ID NO: 314060 - DNA, 16 bp, C. familiaris
cctggaggccctggat

SEQ ID NO: 314061 - DNA, 16 bp, C. familiaris
cctggaggcctggacc

SEQ ID NO: 314062 - DNA, 16 bp, C. familiaris
cctggaggctccgggg

SEQ ID NO: 314063 - DNA, 16 bp, C. familiaris
cctggaggcttttgcc

SEQ ID NO: 314064 - DNA, 16 bp, C. familiaris
cctggagggagcctgc

SEQ ID NO: 314065 - DNA, 16 bp, C. familiaris
cctggagggcagggac

SEQ ID NO: 314066 - DNA, 16 bp, C. familiaris
cctggaggggaggtgg

SEQ ID NO: 314067 - DNA, 16 bp, C. familiaris
cctggaggggcacctg

SEQ ID NO: 314068 - DNA, 16 bp, C. familiaris
cctggagtcccgggac

SEQ ID NO: 314069 - DNA, 16 bp, C. familiaris
cctggagtccctggga

SEQ ID NO: 314070 - DNA, 16 bp, C. familiaris
cctggagtccgaggat

SEQ ID NO: 314071 - DNA, 16 bp, C. familiaris
cctggagtcctgggga

SEQ ID NO: 314072 - DNA, 16 bp, C. familiaris
cctggagtctccagat

SEQ ID NO: 314073 - DNA, 16 bp, C. familiaris
cctggagtttcaggat

SEQ ID NO: 314074 - DNA, 16 bp, C. familiaris
cctggatatgaatgcc

SEQ ID NO: 314075 - DNA, 16 bp, C. familiaris
cctggatctgaatgcc

SEQ ID NO: 314076 - DNA, 16 bp, C. familiaris
cctggatggaaagttt

SEQ ID NO: 314077 - DNA, 16 bp, C. familiaris
cctggatgggatcctg

SEQ ID NO: 314078 - DNA, 16 bp, C. familiaris
cctggattctgggatc

SEQ ID NO: 314079 - DNA, 16 bp, C. familiaris
cctggattgaaggtgg

SEQ ID NO: 314080 - DNA, 16 bp, C. familiaris
cctggcacagagcaag

SEQ ID NO: 314081 - DNA, 16 bp, C. familiaris
cctggcacccagcaca

SEQ ID NO: 314082 - DNA, 16 bp, C. familiaris
cctggcacccagcagg

SEQ ID NO: 314083 - DNA, 16 bp, C. familiaris
cctggcagccctgctc

SEQ ID NO: 314084 - DNA, 16 bp, C. familiaris
cctggcagtgtgcaag

SEQ ID NO: 314085 - DNA, 16 bp, C. familiaris
cctggcattgagcccc

SEQ ID NO: 314086 - DNA, 16 bp, C. familiaris
cctggccaagatcctg

SEQ ID NO: 314087 - DNA, 16 bp, C. familiaris
cctggcccagcccagc

SEQ ID NO: 314088 - DNA, 16 bp, C. familiaris
cctggcccagggcctg

SEQ ID NO: 314089 - DNA, 16 bp, C. familiaris
cctggcccagggctgg

SEQ ID NO: 314090 - DNA, 16 bp, C. familiaris
cctggccccagagccc

SEQ ID NO: 314091 - DNA, 16 bp, C. familiaris
cctggccccagggccc

SEQ ID NO: 314092 - DNA, 16 bp, C. familiaris
cctggcccctcctggc

SEQ ID NO: 314093 - DNA, 16 bp, C. familiaris
cctggccctcctggcc

SEQ ID NO: 314094 - DNA, 16 bp, C. familiaris
cctggccctgccctgg

SEQ ID NO: 314095 - DNA, 16 bp, C. familiaris
cctggccctgcctgcc

SEQ ID NO: 314096 - DNA, 16 bp, C. familiaris
cctggccctggccctg

SEQ ID NO: 314097 - DNA, 16 bp, C. familiaris
cctggccctggctccc

SEQ ID NO: 314098 - DNA, 16 bp, C. familiaris
cctggcctccagcccc

SEQ ID NO: 314099 - DNA, 16 bp, C. familiaris
cctggcctccctggcc

SEQ ID NO: 314100 - DNA, 16 bp, C. familiaris
cctggcctctccccac

SEQ ID NO: 314101 - DNA, 16 bp, C. familiaris
cctggcctctccctgg

SEQ ID NO: 314102 - DNA, 16 bp, C. familiaris
cctggcctctctctct

SEQ ID NO: 314103 - DNA, 16 bp, C. familiaris
cctggcctctgcctgt

SEQ ID NO: 314104 - DNA, 16 bp, C. familiaris
cctggcctggagcctg

SEQ ID NO: 314105 - DNA, 16 bp, C. familiaris
cctggcctggcctggc

SEQ ID NO: 314106 - DNA, 16 bp, C. familiaris
cctggcctggcctggg

SEQ ID NO: 314107 - DNA, 16 bp, C. familiaris
cctggcctggctgctg

SEQ ID NO: 314108 - DNA, 16 bp, C. familiaris
cctggcggccctgctc

SEQ ID NO: 314109 - DNA, 16 bp, C. familiaris
cctggcgtcccaggat

SEQ ID NO: 314110 - DNA, 16 bp, C. familiaris
cctggctctgcccctg

SEQ ID NO: 314111 - DNA, 16 bp, C. familiaris
cctggctgacaccttg

SEQ ID NO: 314112 - DNA, 16 bp, C. familiaris
cctggctgactcagtg

SEQ ID NO: 314113 - DNA, 16 bp, C. familiaris
cctggctggctcagtc

SEQ ID NO: 314114 - DNA, 16 bp, C. familiaris
cctggctttggctcag

SEQ ID NO: 314115 - DNA, 16 bp, C. familiaris
cctgggaagccagctg

SEQ ID NO: 314116 - DNA, 16 bp, C. familiaris
cctgggaagccatcag

SEQ ID NO: 314117 - DNA, 17 bp, C. familiaris
cctgggaagccatctgg

SEQ ID NO: 314118 - DNA, 16 bp, C. familiaris
cctgggaatgagccct

SEQ ID NO: 314119 - DNA, 16 bp, C. familiaris
cctgggacacctgggt

SEQ ID NO: 314120 - DNA, 16 bp, C. familiaris
cctgggaccagacaaa

SEQ ID NO: 314121 - DNA, 16 bp, C. familiaris
cctgggaccatgaccc

SEQ ID NO: 314122 - DNA, 16 bp, C. familiaris
cctgggaccccaggac

SEQ ID NO: 314123 - DNA, 16 bp, C. familiaris
cctgggaccctggggt

SEQ ID NO: 314124 - DNA, 16 bp, C. familiaris
cctgggaccgagccct

SEQ ID NO: 314125 - DNA, 16 bp, C. familiaris
cctgggacctcgggat

SEQ ID NO: 314126 - DNA, 16 bp, C. familiaris
cctgggagaaaatatt

SEQ ID NO: 314127 - DNA, 16 bp, C. familiaris
cctgggaggaaggtgg

SEQ ID NO: 314128 - DNA, 16 bp, C. familiaris
cctgggaggccctggg

SEQ ID NO: 314129 - DNA, 16 bp, C. familiaris
cctgggagggagccct

SEQ ID NO: 314130 - DNA, 16 bp, C. familiaris
cctgggagtggggagg

SEQ ID NO: 314131 - DNA, 16 bp, C. familiaris
cctgggatcaagccca

SEQ ID NO: 314132 - DNA, 16 bp, C. familiaris
cctgggatccagcccc

SEQ ID NO: 314133 - DNA, 16 bp, C. familiaris
cctgggatccaggcct

SEQ ID NO: 314134 - DNA, 16 bp, C. familiaris
cctgggatcctgctcc

SEQ ID NO: 314135 - DNA, 16 bp, C. familiaris
cctgggatctgacctg

SEQ ID NO: 314136 - DNA, 16 bp, C. familiaris
cctgggatctggcccc

SEQ ID NO: 314137 - DNA, 16 bp, C. familiaris
cctgggatctggccct

SEQ ID NO: 314138 - DNA, 16 bp, C. familiaris
cctgggatgagtccca

SEQ ID NO: 314139 - DNA, 16 bp, C. familiaris
cctgggatgagtcctg

SEQ ID NO: 314140 - DNA, 16 bp, C. familiaris
cctgggatggaaccct

SEQ ID NO: 314141 - DNA, 16 bp, C. familiaris
cctgggatggagcagg

SEQ ID NO: 314142 - DNA, 16 bp, C. familiaris
cctgggatggagctca

SEQ ID NO: 314143 - DNA, 16 bp, C. familiaris
cctgggcaggggtggg

SEQ ID NO: 314144 - DNA, 16 bp, C. familiaris
cctgggccaaaggaag

SEQ ID NO: 314145 - DNA, 16 bp, C. familiaris
cctgggccaccagggc

SEQ ID NO: 314146 - DNA, 16 bp, C. familiaris
cctgggccacctgggc

SEQ ID NO: 314147 - DNA, 16 bp, C. familiaris
cctgggccagaaggca

SEQ ID NO: 314148 - DNA, 16 bp, C. familiaris
cctgggccagaggcag

SEQ ID NO: 314149 - DNA, 16 bp, C. familiaris
cctgggcccaagacag

SEQ ID NO: 314150 - DNA, 16 bp, C. familiaris
cctgggcccagccctg

SEQ ID NO: 314151 - DNA, 16 bp, C. familiaris
cctgggccccagggcc

SEQ ID NO: 314152 - DNA, 16 bp, C. familiaris
cctgggcccctgggcc

SEQ ID NO: 314153 - DNA, 16 bp, C. familiaris
cctgggccctccaggc

SEQ ID NO: 314154 - DNA, 16 bp, C. familiaris
cctgggccctgggccc

SEQ ID NO: 314155 - DNA, 16 bp, C. familiaris
cctgggccgaaggagg

SEQ ID NO: 314156 - DNA, 16 bp, C. familiaris
cctgggcctcacctgg

SEQ ID NO: 314157 - DNA, 16 bp, C. familiaris
cctgggcctcccctgg

SEQ ID NO: 314158 - DNA, 16 bp, C. familiaris
cctgggcctccctggg

SEQ ID NO: 314159 - DNA, 16 bp, C. familiaris
cctgggcctgaggcag

SEQ ID NO: 314160 - DNA, 16 bp, C. familiaris
cctgggcctggctctg

SEQ ID NO: 314161 - DNA, 16 bp, C. familiaris
cctgggcctgggctgg

SEQ ID NO: 314162 - DNA, 16 bp, C. familiaris
cctgggcctggggctc

SEQ ID NO: 314163 - DNA, 16 bp, C. familiaris
cctgggcgcgcaggtg

SEQ ID NO: 314164 - DNA, 16 bp, C. familiaris
cctgggcggaaggtgg

SEQ ID NO: 314165 - DNA, 16 bp, C. familiaris
cctgggctacaggtgg

SEQ ID NO: 314166 - DNA, 16 bp, C. familiaris
cctgggctcaagtccc

SEQ ID NO: 314167 - DNA, 16 bp, C. familiaris
cctgggctccagcccc

SEQ ID NO: 314168 - DNA, 16 bp, C. familiaris
cctgggctccaggatc

SEQ ID NO: 314169 - DNA, 16 bp, C. familiaris
cctgggctcctgggtg

SEQ ID NO: 314170 - DNA, 16 bp, C. familiaris
cctgggctctggggcc

SEQ ID NO: 314171 - DNA, 16 bp, C. familiaris
cctgggctgacagcag

SEQ ID NO: 314172 - DNA, 16 bp, C. familiaris
cctgggctgaggcagg

SEQ ID NO: 314173 - DNA, 16 bp, C. familiaris
cctgggctgcccacct

SEQ ID NO: 314174 - DNA, 16 bp, C. familiaris
cctgggctgcccagcc

SEQ ID NO: 314175 - DNA, 16 bp, C. familiaris
cctgggctgccccagg

SEQ ID NO: 314176 - DNA, 16 bp, C. familiaris
cctgggctgccccagt

SEQ ID NO: 314177 - DNA, 16 bp, C. familiaris
cctgggctgccccatt

SEQ ID NO: 314178 - DNA, 16 bp, C. familiaris
cctgggctgccccttc

SEQ ID NO: 314179 - DNA, 16 bp, C. familiaris
cctgggctgcccttcc

SEQ ID NO: 314180 - DNA, 16 bp, C. familiaris
cctgggctggagccct

SEQ ID NO: 314181 - DNA, 16 bp, C. familiaris
cctgggctggaggcag

SEQ ID NO: 314182 - DNA, 16 bp, C. familiaris
cctgggctgggcctgg

SEQ ID NO: 314183 - DNA, 16 bp, C. familiaris
cctgggctgggctggg

SEQ ID NO: 314184 - DNA, 16 bp, C. familiaris
cctgggctggggctgg

SEQ ID NO: 314185 - DNA, 16 bp, C. familiaris
cctgggcttcctcaca

SEQ ID NO: 314186 - DNA, 16 bp, C. familiaris
cctggggacccgggac

SEQ ID NO: 314187 - DNA, 16 bp, C. familiaris
cctggggaccctgggg

SEQ ID NO: 314188 - DNA, 16 bp, C. familiaris
cctggggagctgcccc

SEQ ID NO: 314189 - DNA, 16 bp, C. familiaris
cctggggaggcctggg

SEQ ID NO: 314190 - DNA, 16 bp, C. familiaris
cctggggatctctggg

SEQ ID NO: 314191 - DNA, 16 bp, C. familiaris
cctggggatgcctggg

SEQ ID NO: 314192 - DNA, 16 bp, C. familiaris
cctggggatggagccc

SEQ ID NO: 314193 - DNA, 16 bp, C. familiaris
cctggggcaggagggg

SEQ ID NO: 314194 - DNA, 16 bp, C. familiaris
cctggggcagggggca

SEQ ID NO: 314195 - DNA, 16 bp, C. familiaris
cctggggcagggtggg

SEQ ID NO: 314196 - DNA, 16 bp, C. familiaris
cctggggcaggtgggg

SEQ ID NO: 314197 - DNA, 16 bp, C. familiaris
cctggggccaggagcc

SEQ ID NO: 314198 - DNA, 16 bp, C. familiaris
cctggggcctggggag

SEQ ID NO: 314199 - DNA, 16 bp, C. familiaris
cctggggcctggggcc

SEQ ID NO: 314200 - DNA, 16 bp, C. familiaris
cctggggcctggtcct

SEQ ID NO: 314201 - DNA, 16 bp, C. familiaris
cctggggctccctggg

SEQ ID NO: 314202 - DNA, 16 bp, C. familiaris
cctggggctcctggct

SEQ ID NO: 314203 - DNA, 16 bp, C. familiaris
cctggggctggagggg

SEQ ID NO: 314204 - DNA, 16 bp, C. familiaris
cctggggcttgatcct

SEQ ID NO: 314205 - DNA, 16 bp, C. familiaris
cctgggggacctgggg

SEQ ID NO: 314206 - DNA, 16 bp, C. familiaris
cctgggggagctcagt

SEQ ID NO: 314207 - DNA, 16 bp, C. familiaris
cctgggggagctgtcc

SEQ ID NO: 314208 - DNA, 16 bp, C. familiaris
cctgggggagggggca

SEQ ID NO: 314209 - DNA, 16 bp, C. familiaris
cctgggggcccaggat

SEQ ID NO: 314210 - DNA, 16 bp, C. familiaris
cctgggggctcagcgg

SEQ ID NO: 314211 - DNA, 16 bp, C. familiaris
cctgggggctccctgg

SEQ ID NO: 314212 - DNA, 16 bp, C. familiaris
cctggggggagcccga

SEQ ID NO: 314213 - DNA, 16 bp, C. familiaris
cctggggtccctgggt

SEQ ID NO: 314214 - DNA, 16 bp, C. familiaris
cctggggtccggggcc

SEQ ID NO: 314215 - DNA, 16 bp, C. familiaris
cctggggtgccaggat

SEQ ID NO: 314216 - DNA, 16 bp, C. familiaris
cctgggtcatgacctg

SEQ ID NO: 314217 - DNA, 16 bp, C. familiaris
cctgggtccctgcctc

SEQ ID NO: 314218 - DNA, 16 bp, C. familiaris
cctgggtctccaggaa

SEQ ID NO: 314219 - DNA, 16 bp, C. familiaris
cctgggtctgagggag

SEQ ID NO: 314220 - DNA, 16 bp, C. familiaris
cctgggtggaaggcgg

SEQ ID NO: 314221 - DNA, 16 bp, C. familiaris
cctgggtggcacaatt

SEQ ID NO: 314222 - DNA, 16 bp, C. familiaris
cctgggtggctttgtc

SEQ ID NO: 314223 - DNA, 16 bp, C. familiaris
cctgggtggtgcagcg

SEQ ID NO: 314224 - DNA, 16 bp, C. familiaris
cctgggtggtgcagtt

SEQ ID NO: 314225 - DNA, 16 bp, C. familiaris
cctgggtggtggctca

SEQ ID NO: 314226 - DNA, 16 bp, C. familiaris
cctgggttctgggatc

SEQ ID NO: 314227 - DNA, 16 bp, C. familiaris
cctggtatggagtccc

SEQ ID NO: 314228 - DNA, 16 bp, C. familiaris
cctggtcagtgaggag

SEQ ID NO: 314229 - DNA, 16 bp, C. familiaris
cctggtcccctggtcc

SEQ ID NO: 314230 - DNA, 16 bp, C. familiaris
cctggtccctggtccc

SEQ ID NO: 314231 - DNA, 16 bp, C. familiaris
cctggtcctggggtcc

SEQ ID NO: 314232 - DNA, 16 bp, C. familiaris
cctggtctcagggtca

SEQ ID NO: 314233 - DNA, 16 bp, C. familiaris
cctggtctccgggatc

SEQ ID NO: 314234 - DNA, 16 bp, C. familiaris
cctggtcttaggggaa

SEQ ID NO: 314235 - DNA, 16 bp, C. familiaris
cctggtgcaggactcg

SEQ ID NO: 314236 - DNA, 16 bp, C. familiaris
cctggtggcacagcag

SEQ ID NO: 314237 - DNA, 16 bp, C. familiaris
cctggtggcccagcag

SEQ ID NO: 314238 - DNA, 16 bp, C. familiaris
cctggtggcgcagagg

SEQ ID NO: 314239 - DNA, 16 bp, C. familiaris
cctggtggctcagatg

SEQ ID NO: 314240 - DNA, 16 bp, C. familiaris
cctggtggtgcagtgg

SEQ ID NO: 314241 - DNA, 16 bp, C. familiaris
cctggttcctgctcca

SEQ ID NO: 314242 - DNA, 16 bp, C. familiaris
cctggttctcaggcct

SEQ ID NO: 314243 - DNA, 16 bp, C. familiaris
cctggttgagaaccac

SEQ ID NO: 314244 - DNA, 16 bp, C. familiaris
cctgtaaatgttacct

SEQ ID NO: 314245 - DNA, 16 bp, C. familiaris
cctgtacacaaatgtt

SEQ ID NO: 314246 - DNA, 16 bp, C. familiaris
cctgtagagagcctgc

SEQ ID NO: 314247 - DNA, 16 bp, C. familiaris
cctgtatgtctgcctc

SEQ ID NO: 314248 - DNA, 16 bp, C. familiaris
cctgtattttttttaa

SEQ ID NO: 314249 - DNA, 16 bp, C. familiaris
cctgtcaataattact

SEQ ID NO: 314250 - DNA, 16 bp, C. familiaris
cctgtcacagggctca

SEQ ID NO: 314251 - DNA, 16 bp, C. familiaris
cctgtcccagggggag

SEQ ID NO: 314252 - DNA, 16 bp, C. familiaris
cctgtccccaccagat

SEQ ID NO: 314253 - DNA, 16 bp, C. familiaris
cctgtccccagcccca

SEQ ID NO: 314254 - DNA, 16 bp, C. familiaris
cctgtccccaggctcc

SEQ ID NO: 314255 - DNA, 16 bp, C. familiaris
cctgtccccagggagc

SEQ ID NO: 314256 - DNA, 16 bp, C. familiaris
cctgtccccatctctt

SEQ ID NO: 314257 - DNA, 16 bp, C. familiaris
cctgtcctgggggagg

SEQ ID NO: 314258 - DNA, 16 bp, C. familiaris
cctgtctccaggatca

SEQ ID NO: 314259 - DNA, 16 bp, C. familiaris
cctgtctcctgtctcc

SEQ ID NO: 314260 - DNA, 16 bp, C. familiaris
cctgtctctgggcctc

SEQ ID NO: 314261 - DNA, 16 bp, C. familiaris
cctgtctctgtgtctc

SEQ ID NO: 314262 - DNA, 16 bp, C. familiaris
cctgtctgcctgcctg

SEQ ID NO: 314263 - DNA, 16 bp, C. familiaris
cctgtcttcggctcag

SEQ ID NO: 314264 - DNA, 16 bp, C. familiaris
cctgtcttcttcctga

SEQ ID NO: 314265 - DNA, 16 bp, C. familiaris
cctgtcttgttcattt

SEQ ID NO: 314266 - DNA, 16 bp, C. familiaris
cctgtgaagccacctg

SEQ ID NO: 314267 - DNA, 16 bp, C. familiaris
cctgtgaatatactaa

SEQ ID NO: 314268 - DNA, 16 bp, C. familiaris
cctgtgaatgtgactt

SEQ ID NO: 314269 - DNA, 16 bp, C. familiaris
cctgtgaggagccagc

SEQ ID NO: 314270 - DNA, 16 bp, C. familiaris
cctgtgaggcccctgg

SEQ ID NO: 314271 - DNA, 16 bp, C. familiaris
cctgtgccaggccctg

SEQ ID NO: 314272 - DNA, 16 bp, C. familiaris
cctgtgctaaaggcag

SEQ ID NO: 314273 - DNA, 16 bp, C. familiaris
cctgtgctcatcatga

SEQ ID NO: 314274 - DNA, 16 bp, C. familiaris
cctgtgctcccggggc

SEQ ID NO: 314275 - DNA, 16 bp, C. familiaris
cctgtgctcctgggcc

SEQ ID NO: 314276 - DNA, 16 bp, C. familiaris
cctgtgctgtctctct

SEQ ID NO: 314277 - DNA, 16 bp, C. familiaris
cctgtggagcctgatg

SEQ ID NO: 314278 - DNA, 16 bp, C. familiaris
cctgtggctctgcctc

SEQ ID NO: 314279 - DNA, 16 bp, C. familiaris
cctgtgggaagcctgc

SEQ ID NO: 314280 - DNA, 16 bp, C. familiaris
cctgtggggagcctaa

SEQ ID NO: 314281 - DNA, 16 bp, C. familiaris
cctgtggggagctcag

SEQ ID NO: 314282 - DNA, 16 bp, C. familiaris
cctgtgtcagacttct

SEQ ID NO: 314283 - DNA, 16 bp, C. familiaris
cctgtgtcccagcctc

SEQ ID NO: 314284 - DNA, 16 bp, C. familiaris
cctgtgtctcagcttc

SEQ ID NO: 314285 - DNA, 16 bp, C. familiaris
cctgtgtctctgcctc

SEQ ID NO: 314286 - DNA, 16 bp, C. familiaris
cctgtgtctgtgtgtc

SEQ ID NO: 314287 - DNA, 16 bp, C. familiaris
cctgtgtgccaggccc

SEQ ID NO: 314288 - DNA, 16 bp, C. familiaris
cctgtgtggctcaggg

SEQ ID NO: 314289 - DNA, 16 bp, C. familiaris
cctgtgtggggctccc

SEQ ID NO: 314290 - DNA, 16 bp, C. familiaris
cctgtgtgtctgtgtc

SEQ ID NO: 314291 - DNA, 16 bp, C. familiaris
cctgtgttcctctcta

SEQ ID NO: 314292 - DNA, 16 bp, C. familiaris
cctgtgttctcttcca

SEQ ID NO: 314293 - DNA, 16 bp, C. familiaris
cctgttcagtggggag

SEQ ID NO: 314294 - DNA, 16 bp, C. familiaris
cctgttcatgtcttct

SEQ ID NO: 314295 - DNA, 16 bp, C. familiaris
cctgttggtgggaatg

SEQ ID NO: 314296 - DNA, 16 bp, C. familiaris
cctgttgtatattctt

SEQ ID NO: 314297 - DNA, 16 bp, C. familiaris
cctgtttctccacatc

SEQ ID NO: 314298 - DNA, 16 bp, C. familiaris
cctgtttctctccctg

SEQ ID NO: 314299 - DNA, 16 bp, C. familiaris
cctgttttctcatctg

SEQ ID NO: 314300 - DNA, 16 bp, C. familiaris
cctgtttttatggatt

SEQ ID NO: 314301 - DNA, 16 bp, C. familiaris
ccttaagaaaaaataa

SEQ ID NO: 314302 - DNA, 16 bp, C. familiaris
ccttacacccaaagga

SEQ ID NO: 314303 - DNA, 16 bp, C. familiaris
ccttagaagaagagga

SEQ ID NO: 314304 - DNA, 16 bp, C. familiaris
ccttagccaaaaccaa

SEQ ID NO: 314305 - DNA, 16 bp, C. familiaris
ccttataagaagaaga

SEQ ID NO: 314306 - DNA, 16 bp, C. familiaris
ccttatcaataacata

SEQ ID NO: 314307 - DNA, 16 bp, C. familiaris
ccttcactgtgcagaa

SEQ ID NO: 314308 - DNA, 16 bp, C. familiaris
ccttcagccagggcct

SEQ ID NO: 314309 - DNA, 16 bp, C. familiaris
ccttcagcccagggct

SEQ ID NO: 314310 - DNA, 16 bp, C. familiaris
ccttcagcccagtgcc

SEQ ID NO: 314311 - DNA, 16 bp, C. familiaris
ccttcagccccagggc

SEQ ID NO: 314312 - DNA, 16 bp, C. familiaris
ccttcagccccgggcc

SEQ ID NO: 314313 - DNA, 16 bp, C. familiaris
ccttcagcctggggcc

SEQ ID NO: 314314 - DNA, 16 bp, C. familiaris
ccttcagctcaggtgg

SEQ ID NO: 314315 - DNA, 16 bp, C. familiaris
ccttcaggcccagggc

SEQ ID NO: 314316 - DNA, 16 bp, C. familiaris
ccttcagggagcctga

SEQ ID NO: 314317 - DNA, 16 bp, C. familiaris
ccttcagttcaggtta

SEQ ID NO: 314318 - DNA, 16 bp, C. familiaris
ccttcagttccatcca

SEQ ID NO: 314319 - DNA, 16 bp, C. familiaris
ccttcatgcactgttg

SEQ ID NO: 314320 - DNA, 16 bp, C. familiaris
ccttcatgcccatcac

SEQ ID NO: 314321 - DNA, 16 bp, C. familiaris
ccttccactacctctt

SEQ ID NO: 314322 - DNA, 16 bp, C. familiaris
ccttccactgcccctt

SEQ ID NO: 314323 - DNA, 16 bp, C. familiaris
ccttccagcaccccta

SEQ ID NO: 314324 - DNA, 16 bp, C. familiaris
ccttccatttatttat

SEQ ID NO: 314325 - DNA, 16 bp, C. familiaris
ccttccatttctactt

SEQ ID NO: 314326 - DNA, 16 bp, C. familiaris
ccttcccccaggcctg

SEQ ID NO: 314327 - DNA, 16 bp, C. familiaris
ccttccccccacttgt

SEQ ID NO: 314328 - DNA, 16 bp, C. familiaris
ccttccctccagcaac

SEQ ID NO: 314329 - DNA, 16 bp, C. familiaris
ccttccctgaccaccc

SEQ ID NO: 314330 - DNA, 16 bp, C. familiaris
ccttccctgcccccag

SEQ ID NO: 314331 - DNA, 16 bp, C. familiaris
ccttccctgctcccag

SEQ ID NO: 314332 - DNA, 16 bp, C. familiaris
ccttccctggagcctg

SEQ ID NO: 314333 - DNA, 16 bp, C. familiaris
ccttccgagctgctcc

SEQ ID NO: 314334 - DNA, 16 bp, C. familiaris
ccttcctctgctccca

SEQ ID NO: 314335 - DNA, 16 bp, C. familiaris
ccttcctgagcaggga

SEQ ID NO: 314336 - DNA, 16 bp, C. familiaris
ccttcctgcctgcctt

SEQ ID NO: 314337 - DNA, 16 bp, C. familiaris
ccttcctgctcatgct

SEQ ID NO: 314338 - DNA, 16 bp, C. familiaris
ccttcctggagcaggt

SEQ ID NO: 314339 - DNA, 16 bp, C. familiaris
ccttcctggcctctgc

SEQ ID NO: 314340 - DNA, 16 bp, C. familiaris
ccttcctgggcctcag

SEQ ID NO: 314341 - DNA, 16 bp, C. familiaris
ccttccttccttccag

SEQ ID NO: 314342 - DNA, 16 bp, C. familiaris
ccttccttctgctggt

SEQ ID NO: 314343 - DNA, 16 bp, C. familiaris
ccttctaccatgtgag

SEQ ID NO: 314344 - DNA, 16 bp, C. familiaris
ccttctaggttcttgg

SEQ ID NO: 314345 - DNA, 16 bp, C. familiaris
ccttctccagaatgtc

SEQ ID NO: 314346 - DNA, 16 bp, C. familiaris
ccttctccagctcctt

SEQ ID NO: 314347 - DNA, 16 bp, C. familiaris
ccttctccctttgctg

SEQ ID NO: 314348 - DNA, 16 bp, C. familiaris
ccttctctctgaagaa

SEQ ID NO: 314349 - DNA, 16 bp, C. familiaris
ccttctctgatgactt

SEQ ID NO: 314350 - DNA, 16 bp, C. familiaris
ccttctctgatggact

SEQ ID NO: 314351 - DNA, 16 bp, C. familiaris
ccttctctggacctca

SEQ ID NO: 314352 - DNA, 16 bp, C. familiaris
ccttctgcctccccca

SEQ ID NO: 314353 - DNA, 16 bp, C. familiaris
ccttctgctacccctt

SEQ ID NO: 314354 - DNA, 16 bp, C. familiaris
ccttctgctcagggca

SEQ ID NO: 314355 - DNA, 16 bp, C. familiaris
ccttctggaaccccaa

SEQ ID NO: 314356 - DNA, 16 bp, C. familiaris
ccttcttgcactgttg

SEQ ID NO: 314357 - DNA, 16 bp, C. familiaris
ccttcttttaaaaaaa

SEQ ID NO: 314358 - DNA, 16 bp, C. familiaris
ccttgaaacaaatgaa

SEQ ID NO: 314359 - DNA, 16 bp, C. familiaris
ccttgagtcaggctct

SEQ ID NO: 314360 - DNA, 16 bp, C. familiaris
ccttgagtgtgggcag

SEQ ID NO: 314361 - DNA, 16 bp, C. familiaris
ccttgcagcccaggaa

SEQ ID NO: 314362 - DNA, 16 bp, C. familiaris
ccttgcatcccagaaa

SEQ ID NO: 314363 - DNA, 16 bp, C. familiaris
ccttgcattcctggaa

SEQ ID NO: 314364 - DNA, 16 bp, C. familiaris
ccttgcctcaggaaac

SEQ ID NO: 314365 - DNA, 16 bp, C. familiaris
ccttgccttctccagc

SEQ ID NO: 314366 - DNA, 16 bp, C. familiaris
ccttgccttgcctttc

SEQ ID NO: 314367 - DNA, 16 bp, C. familiaris
ccttgccttgttccta

SEQ ID NO: 314368 - DNA, 16 bp, C. familiaris
ccttgctattcaaagt

SEQ ID NO: 314369 - DNA, 16 bp, C. familiaris
ccttgctctctgtgtc

SEQ ID NO: 314370 - DNA, 16 bp, C. familiaris
ccttgctgggagccca

SEQ ID NO: 314371 - DNA, 16 bp, C. familiaris
ccttgcttccttgctt

SEQ ID NO: 314372 - DNA, 16 bp, C. familiaris
ccttgcttggtgggga

SEQ ID NO: 314373 - DNA, 16 bp, C. familiaris
ccttggaaacattatg

SEQ ID NO: 314374 - DNA, 16 bp, C. familiaris
ccttggagaaatgact

SEQ ID NO: 314375 - DNA, 16 bp, C. familiaris
ccttggatggagccct

SEQ ID NO: 314376 - DNA, 16 bp, C. familiaris
ccttgggccaaaggca

SEQ ID NO: 314377 - DNA, 16 bp, C. familiaris
ccttgggctcagctca

SEQ ID NO: 314378 - DNA, 16 bp, C. familiaris
ccttgggctccctgtg

SEQ ID NO: 314379 - DNA, 16 bp, C. familiaris
ccttgggctctctgct

SEQ ID NO: 314380 - DNA, 16 bp, C. familiaris
ccttgggctgcaggca

SEQ ID NO: 314381 - DNA, 16 bp, C. familiaris
ccttgggtgtgatcct

SEQ ID NO: 314382 - DNA, 16 bp, C. familiaris
ccttggttttctcatc

SEQ ID NO: 314383 - DNA, 16 bp, C. familiaris
ccttgtatgtaactat

SEQ ID NO: 314384 - DNA, 16 bp, C. familiaris
ccttgtgctctgttgg

SEQ ID NO: 314385 - DNA, 16 bp, C. familiaris
ccttgtgtgtgtctct

SEQ ID NO: 314386 - DNA, 16 bp, C. familiaris
ccttgttcctgacctt

SEQ ID NO: 314387 - DNA, 16 bp, C. familiaris
cctttaaatatgatat

SEQ ID NO: 314388 - DNA, 16 bp, C. familiaris
cctttaatccattttt

SEQ ID NO: 314389 - DNA, 16 bp, C. familiaris
cctttatcagaaatat

SEQ ID NO: 314390 - DNA, 16 bp, C. familiaris
cctttcacaatttttt

SEQ ID NO: 314391 - DNA, 16 bp, C. familiaris
cctttcacgaagatgg

SEQ ID NO: 314392 - DNA, 16 bp, C. familiaris
cctttcattatattta

SEQ ID NO: 314393 - DNA, 16 bp, C. familiaris
cctttccaccaccact

SEQ ID NO: 314394 - DNA, 16 bp, C. familiaris
cctttccaccatgtga

SEQ ID NO: 314395 - DNA, 16 bp, C. familiaris
cctttcctgctcccag

SEQ ID NO: 314396 - DNA, 16 bp, C. familiaris
cctttctgaacctcag

SEQ ID NO: 314397 - DNA, 16 bp, C. familiaris
cctttctgacatttcc

SEQ ID NO: 314398 - DNA, 16 bp, C. familiaris
cctttgacccagaaat

SEQ ID NO: 314399 - DNA, 16 bp, C. familiaris
cctttgatccagcaat

SEQ ID NO: 314400 - DNA, 16 bp, C. familiaris
cctttgcccctcaccc

SEQ ID NO: 314401 - DNA, 16 bp, C. familiaris
cctttgcctttgcctt

SEQ ID NO: 314402 - DNA, 16 bp, C. familiaris
cctttgctcttgctgt

SEQ ID NO: 314403 - DNA, 16 bp, C. familiaris
cctttggatacatacc

SEQ ID NO: 314404 - DNA, 16 bp, C. familiaris
cctttggatcaggtca

SEQ ID NO: 314405 - DNA, 16 bp, C. familiaris
cctttggcccagagcc

SEQ ID NO: 314406 - DNA, 16 bp, C. familiaris
cctttggctcagggcc

SEQ ID NO: 314407 - DNA, 16 bp, C. familiaris
cctttggctggggtca

SEQ ID NO: 314408 - DNA, 16 bp, C. familiaris
cctttgggaagtgatt

SEQ ID NO: 314409 - DNA, 16 bp, C. familiaris
cctttgtcaggctctg

SEQ ID NO: 314410 - DNA, 16 bp, C. familiaris
cctttgtttctgcctc

SEQ ID NO: 314411 - DNA, 16 bp, C. familiaris
ccttttattgctgagt

SEQ ID NO: 314412 - DNA, 16 bp, C. familiaris
ccttttccctctgctg

SEQ ID NO: 314413 - DNA, 16 bp, C. familiaris
ccttttctgtgcaaaa

SEQ ID NO: 314414 - DNA, 16 bp, C. familiaris
ccttttctttaaaaaa

SEQ ID NO: 314415 - DNA, 16 bp, C. familiaris
ccttttggccattgtg

SEQ ID NO: 314416 - DNA, 16 bp, C. familiaris
ccttttgtttcaggaa

SEQ ID NO: 314417 - DNA, 16 bp, C. familiaris
cctttttccacatcct

SEQ ID NO: 314418 - DNA, 16 bp, C. familiaris
ccttttttttgagaga

SEQ ID NO: 314419 - DNA, 16 bp, C. familiaris
cgaaagatgaatggaa

SEQ ID NO: 314420 - DNA, 16 bp, C. familiaris
cgaaagatgagtggat

SEQ ID NO: 314421 - DNA, 16 bp, C. familiaris
cgaagccagctctgca

SEQ ID NO: 314422 - DNA, 16 bp, C. familiaris
cgaaggcagatgctga

SEQ ID NO: 314423 - DNA, 16 bp, C. familiaris
cgaatccaacagcaca

SEQ ID NO: 314424 - DNA, 16 bp, C. familiaris
cgaccagagccaaagg

SEQ ID NO: 314425 - DNA, 16 bp, C. familiaris
cgacgtgggacctgat

SEQ ID NO: 314426 - DNA, 16 bp, C. familiaris
cgagacagagagagag

SEQ ID NO: 314427 - DNA, 16 bp, C. familiaris
cgagaccctgggatca

SEQ ID NO: 314428 - DNA, 16 bp, C. familiaris
cgagatcgagtcccgc

SEQ ID NO: 314429 - DNA, 16 bp, C. familiaris
cgagcagggggagcag

SEQ ID NO: 314430 - DNA, 16 bp, C. familiaris
cgaggacgaggacgag

SEQ ID NO: 314431 - DNA, 16 bp, C. familiaris
cgagggcacctgggtg

SEQ ID NO: 314432 - DNA, 16 bp, C. familiaris
cgagggctccttccac

SEQ ID NO: 314433 - DNA, 16 bp, C. familiaris
cgagggtcctgggatt

SEQ ID NO: 314434 - DNA, 16 bp, C. familiaris
cgagtcccacatcgag

SEQ ID NO: 314435 - DNA, 16 bp, C. familiaris
cgagtccttcatcagg

SEQ ID NO: 314436 - DNA, 16 bp, C. familiaris
cgatccagggtcccca

SEQ ID NO: 314437 - DNA, 16 bp, C. familiaris
cgatcccaggacctgg

SEQ ID NO: 314438 - DNA, 16 bp, C. familiaris
cgatcccagtctccag

SEQ ID NO: 314439 - DNA, 16 bp, C. familiaris
cgatctcagggtcctg

SEQ ID NO: 314440 - DNA, 16 bp, C. familiaris
cgatgtcctttgacag

SEQ ID NO: 314441 - DNA, 16 bp, C. familiaris
cgcacacacatgcatg

SEQ ID NO: 314442 - DNA, 16 bp, C. familiaris
cgcagcctgcagcctg

SEQ ID NO: 314443 - DNA, 16 bp, C. familiaris
cgcaggccccggagcc

SEQ ID NO: 314444 - DNA, 16 bp, C. familiaris
cgcagggagctggagc

SEQ ID NO: 314445 - DNA, 16 bp, C. familiaris
cgccacctagggatcc

SEQ ID NO: 314446 - DNA, 16 bp, C. familiaris
cgccatcatcatcatc

SEQ ID NO: 314447 - DNA, 16 bp, C. familiaris
cgcccacctccctttc

SEQ ID NO: 314448 - DNA, 16 bp, C. familiaris
cgcccagcagcaggag

SEQ ID NO: 314449 - DNA, 19 bp, C. familiaris
cgccccgggagagtgcgcc

SEQ ID NO: 314450 - DNA, 16 bp, C. familiaris
cgccctggccgaaggc

SEQ ID NO: 314451 - DNA, 16 bp, C. familiaris
cgccctgggctccggg

SEQ ID NO: 314452 - DNA, 16 bp, C. familiaris
cgccgagctgctcccg

SEQ ID NO: 314453 - DNA, 16 bp, C. familiaris
cgccgccgccgccatc

SEQ ID NO: 314454 - DNA, 16 bp, C. familiaris
cgccgccttcggcctg

SEQ ID NO: 314455 - DNA, 16 bp, C. familiaris
cgcctctctgtgtctc

SEQ ID NO: 314456 - DNA, 16 bp, C. familiaris
cgcctgcagccccggg

SEQ ID NO: 314457 - DNA, 16 bp, C. familiaris
cgcctgggtaactcag

SEQ ID NO: 314458 - DNA, 16 bp, C. familiaris
cgcctgggtggctggg

SEQ ID NO: 314459 - DNA, 16 bp, C. familiaris
cgcctggtggctcagc

SEQ ID NO: 314460 - DNA, 16 bp, C. familiaris
cgccttcagaccaggg

SEQ ID NO: 314461 - DNA, 16 bp, C. familiaris
cgcgcacgcgcacaca

SEQ ID NO: 314462 - DNA, 16 bp, C. familiaris
cgcggagccgccgcct

SEQ ID NO: 314463 - DNA, 16 bp, C. familiaris
cgctcagctgctgagc

SEQ ID NO: 314464 - DNA, 16 bp, C. familiaris
cgctccagccctttac

SEQ ID NO: 314465 - DNA, 16 bp, C. familiaris
cgctctccctgcttgt

SEQ ID NO: 314466 - DNA, 16 bp, C. familiaris
cgctgagccagctggg

SEQ ID NO: 314467 - DNA, 17 bp, C. familiaris
cgctgatctgctcagct

SEQ ID NO: 314468 - DNA, 34 bp, C. familiaris
cgctgcagcccttagggagctcggcgcactctcc

SEQ ID NO: 314469 - DNA, 34 bp, C. familiaris
cgctgcagcccttggggagctcggcgcactctcc

SEQ ID NO: 314470 - DNA, 16 bp, C. familiaris
cgctgcatggagcctg

SEQ ID NO: 314471 - DNA, 16 bp, C. familiaris
cgctgggcatgaagcc

SEQ ID NO: 314472 - DNA, 16 bp, C. familiaris
cgctgggccacccagg

SEQ ID NO: 314473 - DNA, 17 bp, C. familiaris
cgctgtcctgggccctc

SEQ ID NO: 314474 - DNA, 16 bp, C. familiaris
cgcttgctcactctct

SEQ ID NO: 314475 - DNA, 16 bp, C. familiaris
cggaaccccaggatca

SEQ ID NO: 314476 - DNA, 16 bp, C. familiaris
cggaaggagaagcagg

SEQ ID NO: 314477 - DNA, 16 bp, C. familiaris
cggagccacccagatg

SEQ ID NO: 314478 - DNA, 16 bp, C. familiaris
cggagcccaaggcaga

SEQ ID NO: 314479 - DNA, 16 bp, C. familiaris
cggagcccagggcgcc

SEQ ID NO: 314480 - DNA, 16 bp, C. familiaris
cggagcccgacgcggg

SEQ ID NO: 314481 - DNA, 16 bp, C. familiaris
cggagccgccccgagc

SEQ ID NO: 314482 - DNA, 16 bp, C. familiaris
cggagggctcgggggc

SEQ ID NO: 314483 - DNA, 16 bp, C. familiaris
cggatgcgggactcca

SEQ ID NO: 314484 - DNA, 16 bp, C. familiaris
cggcaccggcaccggc

SEQ ID NO: 314485 - DNA, 16 bp, C. familiaris
cggcagcagcggcagc

SEQ ID NO: 314486 - DNA, 16 bp, C. familiaris
cggcatggagtctgct

SEQ ID NO: 314487 - DNA, 16 bp, C. familiaris
cggccccgggagcagc

SEQ ID NO: 314488 - DNA, 16 bp, C. familiaris
cggcctcggcctcggc

SEQ ID NO: 314489 - DNA, 16 bp, C. familiaris
cggcctgcagcctggg

SEQ ID NO: 314490 - DNA, 16 bp, C. familiaris
cggcgccctgtgctcc

SEQ ID NO: 314491 - DNA, 16 bp, C. familiaris
cggcggcggcagcagc

SEQ ID NO: 314492 - DNA, 16 bp, C. familiaris
cggcgggacccagagc

SEQ ID NO: 314493 - DNA, 16 bp, C. familiaris
cggctccctgcttctc

SEQ ID NO: 314494 - DNA, 16 bp, C. familiaris
cggctcctcgcgggcc

SEQ ID NO: 314495 - DNA, 16 bp, C. familiaris
cggctgaaggcggcgc

SEQ ID NO: 314496 - DNA, 16 bp, C. familiaris
cggctgcggctccggc

SEQ ID NO: 314497 - DNA, 16 bp, C. familiaris
cgggagcagctcgggg

SEQ ID NO: 314498 - DNA, 16 bp, C. familiaris
cgggagcgcgaatcca

SEQ ID NO: 314499 - DNA, 16 bp, C. familiaris
cgggatcacaaactga

SEQ ID NO: 314500 - DNA, 16 bp, C. familiaris
cgggatgagcactagg

SEQ ID NO: 314501 - DNA, 16 bp, C. familiaris
cgggatggagtcccac

SEQ ID NO: 314502 - DNA, 16 bp, C. familiaris
cgggctcccagcaggg

SEQ ID NO: 314503 - DNA, 16 bp, C. familiaris
cgggctccccacgtgg

SEQ ID NO: 314504 - DNA, 16 bp, C. familiaris
cgggctcccggtgcag

SEQ ID NO: 314505 - DNA, 16 bp, C. familiaris
cgggctccctgcgcag

SEQ ID NO: 314506 - DNA, 16 bp, C. familiaris
cgggctcctggtgtgg

SEQ ID NO: 314507 - DNA, 16 bp, C. familiaris
cgggctcgggcagagg

SEQ ID NO: 314508 - DNA, 16 bp, C. familiaris
cgggctcgggctccgg

SEQ ID NO: 314509 - DNA, 16 bp, C. familiaris
cgggctctgagggggg

SEQ ID NO: 314510 - DNA, 16 bp, C. familiaris
cgggctgagccaccca

SEQ ID NO: 314511 - DNA, 16 bp, C. familiaris
cgggcttcccgcaggg

SEQ ID NO: 314512 - DNA, 16 bp, C. familiaris
cgggcttcctgcagga

SEQ ID NO: 314513 - DNA, 16 bp, C. familiaris
cggggaccccaatgtg

SEQ ID NO: 314514 - DNA, 16 bp, C. familiaris
cggggaccccagggtc

SEQ ID NO: 314515 - DNA, 16 bp, C. familiaris
cggggaccctgcttct

SEQ ID NO: 314516 - DNA, 16 bp, C. familiaris
cggggagcaggtgtcc

SEQ ID NO: 314517 - DNA, 16 bp, C. familiaris
cggggcaagatggcag

SEQ ID NO: 314518 - DNA, 16 bp, C. familiaris
cggggcagcctgggtg

SEQ ID NO: 314519 - DNA, 16 bp, C. familiaris
cggggcccggagcagc

SEQ ID NO: 314520 - DNA, 16 bp, C. familiaris
cggggctccggggctc

SEQ ID NO: 314521 - DNA, 16 bp, C. familiaris
cggggctgcccaaggg

SEQ ID NO: 314522 - DNA, 16 bp, C. familiaris
cggggctgccccccaa

SEQ ID NO: 314523 - DNA, 16 bp, C. familiaris
cggggctgcccctgga

SEQ ID NO: 314524 - DNA, 16 bp, C. familiaris
cggggctgcccgagaa

SEQ ID NO: 314525 - DNA, 16 bp, C. familiaris
cggggctgccctcatc

SEQ ID NO: 314526 - DNA, 16 bp, C. familiaris
cggggctgccctgctc

SEQ ID NO: 314527 - DNA, 16 bp, C. familiaris
cggggtcctgggatag

SEQ ID NO: 314528 - DNA, 16 bp, C. familiaris
cgggtcccccgtgcgc

SEQ ID NO: 314529 - DNA, 16 bp, C. familiaris
cgggtggcccagcagt

SEQ ID NO: 314530 - DNA, 16 bp, C. familiaris
cggtggagcgcctgcc

SEQ ID NO: 314531 - DNA, 16 bp, C. familiaris
cgtccaggggcagaaa

SEQ ID NO: 314532 - DNA, 16 bp, C. familiaris
cgtcccaggaccctga

SEQ ID NO: 314533 - DNA, 16 bp, C. familiaris
cgtcctggctgtcctg

SEQ ID NO: 314534 - DNA, 16 bp, C. familiaris
cgtccttggggtcctg

SEQ ID NO: 314535 - DNA, 16 bp, C. familiaris
cgtgaccccggggccc

SEQ ID NO: 314536 - DNA, 16 bp, C. familiaris
cgtgatcctgaagacc

SEQ ID NO: 314537 - DNA, 16 bp, C. familiaris
cgtgcacacacacaca

SEQ ID NO: 314538 - DNA, 16 bp, C. familiaris
cgtgcacatgcatgca

SEQ ID NO: 314539 - DNA, 16 bp, C. familiaris
cgtggagccgccgccc

SEQ ID NO: 314540 - DNA, 16 bp, C. familiaris
cgtggagcctgcttaa

SEQ ID NO: 314541 - DNA, 16 bp, C. familiaris
cgtggctcagtggctg

SEQ ID NO: 314542 - DNA, 16 bp, C. familiaris
cgtggggctggatctc

SEQ ID NO: 314543 - DNA, 16 bp, C. familiaris
cgtgtcaggctctctg

SEQ ID NO: 314544 - DNA, 16 bp, C. familiaris
cgtgtctcatgaataa

SEQ ID NO: 314545 - DNA, 16 bp, C. familiaris
cgtgtgggtggctcag

SEQ ID NO: 314546 - DNA, 16 bp, C. familiaris
cgttctctctctgtct

SEQ ID NO: 314547 - DNA, 16 bp, C. familiaris
cgttgggctcctggca

SEQ ID NO: 314548 - DNA, 16 bp, C. familiaris
ctaaaaatgagactga

SEQ ID NO: 314549 - DNA, 16 bp, C. familiaris
ctaaaagtggaattgc

SEQ ID NO: 314550 - DNA, 16 bp, C. familiaris
ctaaaataaatgaatc

SEQ ID NO: 314551 - DNA, 16 bp, C. familiaris
ctaaaatatttgtttt

SEQ ID NO: 314552 - DNA, 16 bp, C. familiaris
ctaaaccacttagcca

SEQ ID NO: 314553 - DNA, 16 bp, C. familiaris
ctaaactttttttaaa

SEQ ID NO: 314554 - DNA, 16 bp, C. familiaris
ctaaagaaattaaaat

SEQ ID NO: 314555 - DNA, 16 bp, C. familiaris
ctaaagaagaaaaatc

SEQ ID NO: 314556 - DNA, 16 bp, C. familiaris
ctaaagaagaaaaatt

SEQ ID NO: 314557 - DNA, 16 bp, C. familiaris
ctaaagataaagagaa

SEQ ID NO: 314558 - DNA, 16 bp, C. familiaris
ctaaagcaaaaatgaa

SEQ ID NO: 314559 - DNA, 16 bp, C. familiaris
ctaaagcagcagaatg

SEQ ID NO: 314560 - DNA, 16 bp, C. familiaris
ctaaagctaagggaag

SEQ ID NO: 314561 - DNA, 16 bp, C. familiaris
ctaaaggagctggaga

SEQ ID NO: 314562 - DNA, 16 bp, C. familiaris
ctaaaggagtttatga

SEQ ID NO: 314563 - DNA, 16 bp, C. familiaris
ctaaatattttattca

SEQ ID NO: 314564 - DNA, 16 bp, C. familiaris
ctaaatcaagaagaaa

SEQ ID NO: 314565 - DNA, 16 bp, C. familiaris
ctaaatgaaaatgaaa

SEQ ID NO: 314566 - DNA, 16 bp, C. familiaris
ctaaatgatcctatca

SEQ ID NO: 314567 - DNA, 16 bp, C. familiaris
ctaaatgtagagaaga

SEQ ID NO: 314568 - DNA, 16 bp, C. familiaris
ctaaattctcctgaaa

SEQ ID NO: 314569 - DNA, 16 bp, C. familiaris
ctaacataaactatgg

SEQ ID NO: 314570 - DNA, 16 bp, C. familiaris
ctaacatcttgatttt

SEQ ID NO: 314571 - DNA, 16 bp, C. familiaris
ctaactctggggaaca

SEQ ID NO: 314572 - DNA, 16 bp, C. familiaris
ctaacttctctgagct

SEQ ID NO: 314573 - DNA, 16 bp, C. familiaris
ctaagaagtccaagat

SEQ ID NO: 314574 - DNA, 16 bp, C. familiaris
ctaagagaatagaact

SEQ ID NO: 314575 - DNA, 16 bp, C. familiaris
ctaagcagggagctgg

SEQ ID NO: 314576 - DNA, 16 bp, C. familiaris
ctaagctgaaggcagg

SEQ ID NO: 314577 - DNA, 16 bp, C. familiaris
ctaagctggaggcaga

SEQ ID NO: 314578 - DNA, 16 bp, C. familiaris
ctaagggaaataaatg

SEQ ID NO: 314579 - DNA, 16 bp, C. familiaris
ctaagtcaggctccct

SEQ ID NO: 314580 - DNA, 16 bp, C. familiaris
ctaagtgcaagaaggc

SEQ ID NO: 314581 - DNA, 16 bp, C. familiaris
ctaagtggctcagtgg

SEQ ID NO: 314582 - DNA, 16 bp, C. familiaris
ctaagtgtggagccca

SEQ ID NO: 314583 - DNA, 16 bp, C. familiaris
ctaataaatgtagaag

SEQ ID NO: 314584 - DNA, 16 bp, C. familiaris
ctaatatccaaaatct

SEQ ID NO: 314585 - DNA, 16 bp, C. familiaris
ctaatcatcaggaaaa

SEQ ID NO: 314586 - DNA, 16 bp, C. familiaris
ctaatgaacatagatg

SEQ ID NO: 314587 - DNA, 16 bp, C. familiaris
ctaatgagagacacag

SEQ ID NO: 314588 - DNA, 16 bp, C. familiaris
ctaatgagtaaataaa

SEQ ID NO: 314589 - DNA, 16 bp, C. familiaris
ctaatggctgaagaat

SEQ ID NO: 314590 - DNA, 16 bp, C. familiaris
ctaatggtttgtctat

SEQ ID NO: 314591 - DNA, 16 bp, C. familiaris
ctaatgtgggagctgc

SEQ ID NO: 314592 - DNA, 16 bp, C. familiaris
ctaatttgtttttaaa

SEQ ID NO: 314593 - DNA, 16 bp, C. familiaris
ctacaaaggaaaatat

SEQ ID NO: 314594 - DNA, 16 bp, C. familiaris
ctacaacatggatgaa

SEQ ID NO: 314595 - DNA, 16 bp, C. familiaris
ctacaactttgctgaa

SEQ ID NO: 314596 - DNA, 16 bp, C. familiaris
ctacaatggtggagtt

SEQ ID NO: 314597 - DNA, 16 bp, C. familiaris
ctacacagaaaaccca

SEQ ID NO: 314598 - DNA, 16 bp, C. familiaris
ctacaccaagcagaag

SEQ ID NO: 314599 - DNA, 16 bp, C. familiaris
ctacacttactgtggt

SEQ ID NO: 314600 - DNA, 16 bp, C. familiaris
ctacagaactgtaaga

SEQ ID NO: 314601 - DNA, 16 bp, C. familiaris
ctacagaatgggataa

SEQ ID NO: 314602 - DNA, 16 bp, C. familiaris
ctacagggcacctggg

SEQ ID NO: 314603 - DNA, 16 bp, C. familiaris
ctacagggcagcctgg

SEQ ID NO: 314604 - DNA, 16 bp, C. familiaris
ctacagtctgaagagt

SEQ ID NO: 314605 - DNA, 16 bp, C. familiaris
ctacagtgaggagagt

SEQ ID NO: 314606 - DNA, 16 bp, C. familiaris
ctacatcaaactcaaa

SEQ ID NO: 314607 - DNA, 16 bp, C. familiaris
ctacatccttgccaat

SEQ ID NO: 314608 - DNA, 16 bp, C. familiaris
ctacatgcaaaggaat

SEQ ID NO: 314609 - DNA, 16 bp, C. familiaris
ctacatgcagaagaat

SEQ ID NO: 314610 - DNA, 16 bp, C. familiaris
ctacatgttcttctca

SEQ ID NO: 314611 - DNA, 16 bp, C. familiaris
ctacatgttggcaaat

SEQ ID NO: 314612 - DNA, 16 bp, C. familiaris
ctacattgaaaatctg

SEQ ID NO: 314613 - DNA, 16 bp, C. familiaris
ctacattttaaaatat

SEQ ID NO: 314614 - DNA, 16 bp, C. familiaris
ctacccaaaggaatct

SEQ ID NO: 314615 - DNA, 16 bp, C. familiaris
ctacccctccctcctg

SEQ ID NO: 314616 - DNA, 16 bp, C. familiaris
ctacccctcctcctgc

SEQ ID NO: 314617 - DNA, 16 bp, C. familiaris
ctacccctgcccctgc

SEQ ID NO: 314618 - DNA, 16 bp, C. familiaris
ctacctcaagaaataa

SEQ ID NO: 314619 - DNA, 16 bp, C. familiaris
ctacctcaggaagcaa

SEQ ID NO: 314620 - DNA, 16 bp, C. familiaris
ctacctgagctgaagg

SEQ ID NO: 314621 - DNA, 16 bp, C. familiaris
ctacctggaatgttct

SEQ ID NO: 314622 - DNA, 16 bp, C. familiaris
ctacctgtgtctttgc

SEQ ID NO: 314623 - DNA, 16 bp, C. familiaris
ctaccttcagctcaga

SEQ ID NO: 314624 - DNA, 16 bp, C. familiaris
ctaccttcagctcggg

SEQ ID NO: 314625 - DNA, 16 bp, C. familiaris
ctaccttcttcaatgt

SEQ ID NO: 314626 - DNA, 16 bp, C. familiaris
ctactatttcttcaaa

SEQ ID NO: 314627 - DNA, 16 bp, C. familiaris
ctactctacaatccag

SEQ ID NO: 314628 - DNA, 16 bp, C. familiaris
ctactctggagaatgt

SEQ ID NO: 314629 - DNA, 16 bp, C. familiaris
ctactgaattggagaa

SEQ ID NO: 314630 - DNA, 16 bp, C. familiaris
ctacttagaaaaccca

SEQ ID NO: 314631 - DNA, 16 bp, C. familiaris
ctacttcaggctccct

SEQ ID NO: 314632 - DNA, 16 bp, C. familiaris
ctacttctccctgtcc

SEQ ID NO: 314633 - DNA, 16 bp, C. familiaris
ctactttgtcaaagat

SEQ ID NO: 314634 - DNA, 16 bp, C. familiaris
ctactttttgtttcta

SEQ ID NO: 314635 - DNA, 16 bp, C. familiaris
ctagaaaaagaagaac

SEQ ID NO: 314636 - DNA, 16 bp, C. familiaris
ctagaaaaggcaaaaa

SEQ ID NO: 314637 - DNA, 16 bp, C. familiaris
ctagaactcatacaga

SEQ ID NO: 314638 - DNA, 16 bp, C. familiaris
ctagaagaaaacaaag

SEQ ID NO: 314639 - DNA, 16 bp, C. familiaris
ctagaagctgcctgca

SEQ ID NO: 314640 - DNA, 16 bp, C. familiaris
ctagaagttggaaaag

SEQ ID NO: 314641 - DNA, 16 bp, C. familiaris
ctagaatatacaaaga

SEQ ID NO: 314642 - DNA, 16 bp, C. familiaris
ctagaattgataaatg

SEQ ID NO: 314643 - DNA, 16 bp, C. familiaris
ctagagaaaaaaacag

SEQ ID NO: 314644 - DNA, 16 bp, C. familiaris
ctagaggagaacagag

SEQ ID NO: 314645 - DNA, 16 bp, C. familiaris
ctagagggaaaaacca

SEQ ID NO: 314646 - DNA, 16 bp, C. familiaris
ctagagggtacccctc

SEQ ID NO: 314647 - DNA, 16 bp, C. familiaris
ctagcatccaagatct

SEQ ID NO: 314648 - DNA, 16 bp, C. familiaris
ctagctccctgcatgg

SEQ ID NO: 314649 - DNA, 16 bp, C. familiaris
ctaggaccctgggacc

SEQ ID NO: 314650 - DNA, 16 bp, C. familiaris
ctaggcacctgggtgg

SEQ ID NO: 314651 - DNA, 16 bp, C. familiaris
ctaggcatggagccca

SEQ ID NO: 314652 - DNA, 16 bp, C. familiaris
ctaggggggatccctg

SEQ ID NO: 314653 - DNA, 16 bp, C. familiaris
ctaggggtggtgggag

SEQ ID NO: 314654 - DNA, 16 bp, C. familiaris
ctagtactattttgaa

SEQ ID NO: 314655 - DNA, 16 bp, C. familiaris
ctagtgaaatccaaat

SEQ ID NO: 314656 - DNA, 16 bp, C. familiaris
ctagtgcagccactct

SEQ ID NO: 314657 - DNA, 16 bp, C. familiaris
ctagtggacactgggg

SEQ ID NO: 314658 - DNA, 16 bp, C. familiaris
ctagtgtaaataatgc

SEQ ID NO: 314659 - DNA, 16 bp, C. familiaris
ctataaaattcttaga

SEQ ID NO: 314660 - DNA, 16 bp, C. familiaris
ctataaacacagagaa

SEQ ID NO: 314661 - DNA, 16 bp, C. familiaris
ctatacccagtgtggg

SEQ ID NO: 314662 - DNA, 16 bp, C. familiaris
ctatatatacatatat

SEQ ID NO: 314663 - DNA, 16 bp, C. familiaris
ctatatcctcaccaac

SEQ ID NO: 314664 - DNA, 16 bp, C. familiaris
ctatatgaggaaaatt

SEQ ID NO: 314665 - DNA, 16 bp, C. familiaris
ctatatgccaaaaaat

SEQ ID NO: 314666 - DNA, 16 bp, C. familiaris
ctatatgttgggaaat

SEQ ID NO: 314667 - DNA, 16 bp, C. familiaris
ctatcaaaattccagt

SEQ ID NO: 314668 - DNA, 16 bp, C. familiaris
ctatcaaacatttaag

SEQ ID NO: 314669 - DNA, 16 bp, C. familiaris
ctatcaaatacataaa

SEQ ID NO: 314670 - DNA, 16 bp, C. familiaris
ctatcataaaagaaaa

SEQ ID NO: 314671 - DNA, 16 bp, C. familiaris
ctatcatgaataagta

SEQ ID NO: 314672 - DNA, 16 bp, C. familiaris
ctatcatttgcagaaa

SEQ ID NO: 314673 - DNA, 17 bp, C. familiaris
ctatccactggaagaaa

SEQ ID NO: 314674 - DNA, 16 bp, C. familiaris
ctatcccaggacccct

SEQ ID NO: 314675 - DNA, 16 bp, C. familiaris
ctatcctggacatttc

SEQ ID NO: 314676 - DNA, 16 bp, C. familiaris
ctatctccaggtagat

SEQ ID NO: 314677 - DNA, 16 bp, C. familiaris
ctatctctatatctat

SEQ ID NO: 314678 - DNA, 16 bp, C. familiaris
ctatctctatcatctc

SEQ ID NO: 314679 - DNA, 16 bp, C. familiaris
ctatctctatgtctct

SEQ ID NO: 314680 - DNA, 16 bp, C. familiaris
ctatctggaaaaaaaa

SEQ ID NO: 314681 - DNA, 16 bp, C. familiaris
ctatcttcatcatcat

SEQ ID NO: 314682 - DNA, 16 bp, C. familiaris
ctatgaatacagagaa

SEQ ID NO: 314683 - DNA, 16 bp, C. familiaris
ctatgagaaaaaaaat

SEQ ID NO: 314684 - DNA, 16 bp, C. familiaris
ctatgaggagcctgat

SEQ ID NO: 314685 - DNA, 16 bp, C. familiaris
ctatgatgatgatgat

SEQ ID NO: 314686 - DNA, 16 bp, C. familiaris
ctatgattaagtctct

SEQ ID NO: 314687 - DNA, 16 bp, C. familiaris
ctatggaaacaaaaga

SEQ ID NO: 314688 - DNA, 16 bp, C. familiaris
ctatggaaacagtatg

SEQ ID NO: 314689 - DNA, 22 bp, C. familiaris
ctatggcagtggcagaaggttt

SEQ ID NO: 314690 - DNA, 16 bp, C. familiaris
ctatgggcagcctggg

SEQ ID NO: 314691 - DNA, 16 bp, C. familiaris
ctatgggtggtggaag

SEQ ID NO: 314692 - DNA, 16 bp, C. familiaris
ctatgtctgtgcctct

SEQ ID NO: 314693 - DNA, 16 bp, C. familiaris
ctatgtgtcagacatt

SEQ ID NO: 314694 - DNA, 16 bp, C. familiaris
ctatgttaaaaataaa

SEQ ID NO: 314695 - DNA, 16 bp, C. familiaris
ctatgttttcttccaa

SEQ ID NO: 314696 - DNA, 16 bp, C. familiaris
ctattaaatgttgagg

SEQ ID NO: 314697 - DNA, 16 bp, C. familiaris
ctattattacctccat

SEQ ID NO: 314698 - DNA, 16 bp, C. familiaris
ctattcaaaaaaatag

SEQ ID NO: 314699 - DNA, 16 bp, C. familiaris
ctattctggagaatgc

SEQ ID NO: 314700 - DNA, 16 bp, C. familiaris
ctattcttgaacttca

SEQ ID NO: 314701 - DNA, 16 bp, C. familiaris
ctattgaattcagttt

SEQ ID NO: 314702 - DNA, 16 bp, C. familiaris
ctattgagaaaaaaaa

SEQ ID NO: 314703 - DNA, 16 bp, C. familiaris
ctattggaacttaatc

SEQ ID NO: 314704 - DNA, 16 bp, C. familiaris
ctattgtatgtatata

SEQ ID NO: 314705 - DNA, 16 bp, C. familiaris
ctattgtgttttcatt

SEQ ID NO: 314706 - DNA, 16 bp, C. familiaris
ctatttctggattttt

SEQ ID NO: 314707 - DNA, 16 bp, C. familiaris
ctatttctttgaaaaa

SEQ ID NO: 314708 - DNA, 16 bp, C. familiaris
ctatttgggtcttttc

SEQ ID NO: 314709 - DNA, 16 bp, C. familiaris
ctattttaaatggaat

SEQ ID NO: 314710 - DNA, 16 bp, C. familiaris
ctattttataataaag

SEQ ID NO: 314711 - DNA, 16 bp, C. familiaris
ctattttttagagcag

SEQ ID NO: 314712 - DNA, 16 bp, C. familiaris
ctcaaaaaattttcca

SEQ ID NO: 314713 - DNA, 16 bp, C. familiaris
ctcaaaaggttaaaca

SEQ ID NO: 314714 - DNA, 16 bp, C. familiaris
ctcaaaatatcttatt

SEQ ID NO: 314715 - DNA, 16 bp, C. familiaris
ctcaaaatatttttaa

SEQ ID NO: 314716 - DNA, 16 bp, C. familiaris
ctcaaaatggatgaag

SEQ ID NO: 314717 - DNA, 16 bp, C. familiaris
ctcaaactcttccaaa

SEQ ID NO: 314718 - DNA, 16 bp, C. familiaris
ctcaaagagatatctg

SEQ ID NO: 314719 - DNA, 16 bp, C. familiaris
ctcaaagagtgaaaaa

SEQ ID NO: 314720 - DNA, 16 bp, C. familiaris
ctcaaagttagtagaa

SEQ ID NO: 314721 - DNA, 16 bp, C. familiaris
ctcaacaacaaagaaa

SEQ ID NO: 314722 - DNA, 16 bp, C. familiaris
ctcaacaccctgagat

SEQ ID NO: 314723 - DNA, 16 bp, C. familiaris
ctcaacagagagtctg

SEQ ID NO: 314724 - DNA, 16 bp, C. familiaris
ctcaacaggaaaaaaa

SEQ ID NO: 314725 - DNA, 16 bp, C. familiaris
ctcaaccactgtgcca

SEQ ID NO: 314726 - DNA, 16 bp, C. familiaris
ctcaaccatgagccac

SEQ ID NO: 314727 - DNA, 16 bp, C. familiaris
ctcaaccccaagatca

SEQ ID NO: 314728 - DNA, 16 bp, C. familiaris
ctcaacccctgagcta

SEQ ID NO: 314729 - DNA, 16 bp, C. familiaris
ctcaacccgctgagcc

SEQ ID NO: 314730 - DNA, 16 bp, C. familiaris
ctcaacctcatgaccc

SEQ ID NO: 314731 - DNA, 16 bp, C. familiaris
ctcaactctatggtca

SEQ ID NO: 314732 - DNA, 16 bp, C. familiaris
ctcaacttcccctgga

SEQ ID NO: 314733 - DNA, 16 bp, C. familiaris
ctcaacttctttcaga

SEQ ID NO: 314734 - DNA, 16 bp, C. familiaris
ctcaactttatggcca

SEQ ID NO: 314735 - DNA, 16 bp, C. familiaris
ctcaagaagaaataaa

SEQ ID NO: 314736 - DNA, 16 bp, C. familiaris
ctcaagaagaatgtgt

SEQ ID NO: 314737 - DNA, 16 bp, C. familiaris
ctcaagaagcaaaaaa

SEQ ID NO: 314738 - DNA, 17 bp, C. familiaris
ctcaagaagctggcttc

SEQ ID NO: 314739 - DNA, 16 bp, C. familiaris
ctcaagaattcttcct

SEQ ID NO: 314740 - DNA, 16 bp, C. familiaris
ctcaagattttttttt

SEQ ID NO: 314741 - DNA, 16 bp, C. familiaris
ctcaagcactgagccc

SEQ ID NO: 314742 - DNA, 16 bp, C. familiaris
ctcaagcagaccctgc

SEQ ID NO: 314743 - DNA, 16 bp, C. familiaris
ctcaagcaggctctgc

SEQ ID NO: 314744 - DNA, 16 bp, C. familiaris
ctcaagcccaaggcag

SEQ ID NO: 314745 - DNA, 16 bp, C. familiaris
ctcaaggactttgttc

SEQ ID NO: 314746 - DNA, 16 bp, C. familiaris
ctcaagtcctttgccc

SEQ ID NO: 314747 - DNA, 16 bp, C. familiaris
ctcaagttcctcatct

SEQ ID NO: 314748 - DNA, 16 bp, C. familiaris
ctcaataagttaaaaa

SEQ ID NO: 314749 - DNA, 16 bp, C. familiaris
ctcaatatttttaaga

SEQ ID NO: 314750 - DNA, 16 bp, C. familiaris
ctcaatccagggaccc

SEQ ID NO: 314751 - DNA, 16 bp, C. familiaris
ctcaatgggggaaaac

SEQ ID NO: 314752 - DNA, 16 bp, C. familiaris
ctcaattccagaactc

SEQ ID NO: 314753 - DNA, 16 bp, C. familiaris
ctcaatttccttcctt

SEQ ID NO: 314754 - DNA, 16 bp, C. familiaris
ctcaatttctcttcct

SEQ ID NO: 314755 - DNA, 16 bp, C. familiaris
ctcaattttctcatct

SEQ ID NO: 314756 - DNA, 16 bp, C. familiaris
ctcacaaaagaagaaa

SEQ ID NO: 314757 - DNA, 16 bp, C. familiaris
ctcacaccagagagaa

SEQ ID NO: 314758 - DNA, 16 bp, C. familiaris
ctcacaccagggagaa

SEQ ID NO: 314759 - DNA, 16 bp, C. familiaris
ctcacaccctgagcca

SEQ ID NO: 314760 - DNA, 16 bp, C. familiaris
ctcacactggtgagaa

SEQ ID NO: 314761 - DNA, 16 bp, C. familiaris
ctcacagagctcagag

SEQ ID NO: 314762 - DNA, 16 bp, C. familiaris
ctcacagcaaagaatt

SEQ ID NO: 314763 - DNA, 16 bp, C. familiaris
ctcacagcagtgagaa

SEQ ID NO: 314764 - DNA, 16 bp, C. familiaris
ctcacagccccgagat

SEQ ID NO: 314765 - DNA, 16 bp, C. familiaris
ctcacagggaccctga

SEQ ID NO: 314766 - DNA, 16 bp, C. familiaris
ctcacagggagccaga

SEQ ID NO: 314767 - DNA, 16 bp, C. familiaris
ctcacatccagctccc

SEQ ID NO: 314768 - DNA, 16 bp, C. familiaris
ctcacatttaagtttt

SEQ ID NO: 314769 - DNA, 16 bp, C. familiaris
ctcacatttatttatt

SEQ ID NO: 314770 - DNA, 16 bp, C. familiaris
ctcaccaccctgaaat

SEQ ID NO: 314771 - DNA, 16 bp, C. familiaris
ctcaccagacaccaga

SEQ ID NO: 314772 - DNA, 16 bp, C. familiaris
ctcaccagataccaaa

SEQ ID NO: 314773 - DNA, 16 bp, C. familiaris
ctcaccctctgccctc

SEQ ID NO: 314774 - DNA, 16 bp, C. familiaris
ctcaccctggacacct

SEQ ID NO: 314775 - DNA, 16 bp, C. familiaris
ctcacctggaaaatgg

SEQ ID NO: 314776 - DNA, 16 bp, C. familiaris
ctcaccttcctcatct

SEQ ID NO: 314777 - DNA, 16 bp, C. familiaris
ctcactatgtgccagg

SEQ ID NO: 314778 - DNA, 16 bp, C. familiaris
ctcactctccctcaaa

SEQ ID NO: 314779 - DNA, 16 bp, C. familiaris
ctcactctctgtgtct

SEQ ID NO: 314780 - DNA, 16 bp, C. familiaris
ctcactgccctgagat

SEQ ID NO: 314781 - DNA, 16 bp, C. familiaris
ctcactgcctatgtct

SEQ ID NO: 314782 - DNA, 16 bp, C. familiaris
ctcactggcatggcct

SEQ ID NO: 314783 - DNA, 16 bp, C. familiaris
ctcactgtctctgtct

SEQ ID NO: 314784 - DNA, 17 bp, C. familiaris
ctcactgtctgcctatc

SEQ ID NO: 314785 - DNA, 16 bp, C. familiaris
ctcacttactctctct

SEQ ID NO: 314786 - DNA, 16 bp, C. familiaris
ctcacttctccctctg

SEQ ID NO: 314787 - DNA, 16 bp, C. familiaris
ctcagaaaaaaagatt

SEQ ID NO: 314788 - DNA, 16 bp, C. familiaris
ctcagaaaacaaaaca

SEQ ID NO: 314789 - DNA, 16 bp, C. familiaris
ctcagaaaactataga

SEQ ID NO: 314790 - DNA, 16 bp, C. familiaris
ctcagaaatatttgtt

SEQ ID NO: 314791 - DNA, 16 bp, C. familiaris
ctcagaacttactcat

SEQ ID NO: 314792 - DNA, 16 bp, C. familiaris
ctcagaagaaaccaaa

SEQ ID NO: 314793 - DNA, 16 bp, C. familiaris
ctcagaagaaatcaac

SEQ ID NO: 314794 - DNA, 16 bp, C. familiaris
ctcagaagaagaagag

SEQ ID NO: 314795 - DNA, 16 bp, C. familiaris
ctcagaagaagagaga

SEQ ID NO: 314796 - DNA, 16 bp, C. familiaris
ctcagaaggaaaaaat

SEQ ID NO: 314797 - DNA, 16 bp, C. familiaris
ctcagactcccagcct

SEQ ID NO: 314798 - DNA, 16 bp, C. familiaris
ctcagagaagccttcc

SEQ ID NO: 314799 - DNA, 16 bp, C. familiaris
ctcagagaggagcctg

SEQ ID NO: 314800 - DNA, 16 bp, C. familiaris
ctcagagaggcctttc

SEQ ID NO: 314801 - DNA, 16 bp, C. familiaris
ctcagagcacctgggt

SEQ ID NO: 314802 - DNA, 16 bp, C. familiaris
ctcagagcccagcaca

SEQ ID NO: 314803 - DNA, 16 bp, C. familiaris
ctcagagcttccagaa

SEQ ID NO: 314804 - DNA, 16 bp, C. familiaris
ctcagatttccagcct

SEQ ID NO: 314805 - DNA, 16 bp, C. familiaris
ctcagcaaacttgcaa

SEQ ID NO: 314806 - DNA, 16 bp, C. familiaris
ctcagcaaatgacaga

SEQ ID NO: 314807 - DNA, 16 bp, C. familiaris
ctcagcaagcacctca

SEQ ID NO: 314808 - DNA, 16 bp, C. familiaris
ctcagcaaggagactg

SEQ ID NO: 314809 - DNA, 16 bp, C. familiaris
ctcagcaaggagtttg

SEQ ID NO: 314810 - DNA, 16 bp, C. familiaris
ctcagcacagtgccta

SEQ ID NO: 314811 - DNA, 16 bp, C. familiaris
ctcagcagaagaagag

SEQ ID NO: 314812 - DNA, 16 bp, C. familiaris
ctcagcaggaaacctg

SEQ ID NO: 314813 - DNA, 16 bp, C. familiaris
ctcagcaggatgtctg

SEQ ID NO: 314814 - DNA, 16 bp, C. familiaris
ctcagcagggaaccca

SEQ ID NO: 314815 - DNA, 16 bp, C. familiaris
ctcagcagggactctg

SEQ ID NO: 314816 - DNA, 16 bp, C. familiaris
ctcagcaggggagcct

SEQ ID NO: 314817 - DNA, 16 bp, C. familiaris
ctcagcatggagctca

SEQ ID NO: 314818 - DNA, 16 bp, C. familiaris
ctcagccaagaactca

SEQ ID NO: 314819 - DNA, 25 bp, C. familiaris
ctcagccaagcacagtggtggcagg

SEQ ID NO: 314820 - DNA, 16 bp, C. familiaris
ctcagccacaacagca

SEQ ID NO: 314821 - DNA, 16 bp, C. familiaris
ctcagccactgagccc

SEQ ID NO: 314822 - DNA, 16 bp, C. familiaris
ctcagccagccaggca

SEQ ID NO: 314823 - DNA, 16 bp, C. familiaris
ctcagccccagcccca

SEQ ID NO: 314824 - DNA, 16 bp, C. familiaris
ctcagccccctgcctg

SEQ ID NO: 314825 - DNA, 16 bp, C. familiaris
ctcagcccctctccct

SEQ ID NO: 314826 - DNA, 16 bp, C. familiaris
ctcagcctcctcctcc

SEQ ID NO: 314827 - DNA, 16 bp, C. familiaris
ctcagcctctctgggc

SEQ ID NO: 314828 - DNA, 16 bp, C. familiaris
ctcagcctctgcccct

SEQ ID NO: 314829 - DNA, 16 bp, C. familiaris
ctcagcctctgcctct

SEQ ID NO: 314830 - DNA, 16 bp, C. familiaris
ctcagcctggagcctg

SEQ ID NO: 314831 - DNA, 16 bp, C. familiaris
ctcagcgtggagccca

SEQ ID NO: 314832 - DNA, 16 bp, C. familiaris
ctcagctcagatcatg

SEQ ID NO: 314833 - DNA, 16 bp, C. familiaris
ctcagctgaaggcagg

SEQ ID NO: 314834 - DNA, 16 bp, C. familiaris
ctcagctgtttagcgc

SEQ ID NO: 314835 - DNA, 16 bp, C. familiaris
ctcagcttcctcctct

SEQ ID NO: 314836 - DNA, 16 bp, C. familiaris
ctcagcttctccctct

SEQ ID NO: 314837 - DNA, 16 bp, C. familiaris
ctcaggaaaaaaacaa

SEQ ID NO: 314838 - DNA, 16 bp, C. familiaris
ctcaggaaacaacaga

SEQ ID NO: 314839 - DNA, 16 bp, C. familiaris
ctcaggaccccaagat

SEQ ID NO: 314840 - DNA, 16 bp, C. familiaris
ctcaggacctggagat

SEQ ID NO: 314841 - DNA, 16 bp, C. familiaris
ctcaggagagacacag

SEQ ID NO: 314842 - DNA, 16 bp, C. familiaris
ctcaggaggaagtctg

SEQ ID NO: 314843 - DNA, 16 bp, C. familiaris
ctcaggattctctctc

SEQ ID NO: 314844 - DNA, 16 bp, C. familiaris
ctcaggattttgagat

SEQ ID NO: 314845 - DNA, 16 bp, C. familiaris
ctcaggcaagggaaac

SEQ ID NO: 314846 - DNA, 16 bp, C. familiaris
ctcaggcagcagcttt

SEQ ID NO: 314847 - DNA, 16 bp, C. familiaris
ctcaggcatccctcaa

SEQ ID NO: 314848 - DNA, 16 bp, C. familiaris
ctcaggcatgatcctg

SEQ ID NO: 314849 - DNA, 16 bp, C. familiaris
ctcaggccatgacctc

SEQ ID NO: 314850 - DNA, 16 bp, C. familiaris
ctcaggccccacccag

SEQ ID NO: 314851 - DNA, 16 bp, C. familiaris
ctcaggcctcagtttc

SEQ ID NO: 314852 - DNA, 16 bp, C. familiaris
ctcagggatccctgag

SEQ ID NO: 314853 - DNA, 16 bp, C. familiaris
ctcagggatgcctggg

SEQ ID NO: 314854 - DNA, 16 bp, C. familiaris
ctcagggcagccctgg

SEQ ID NO: 314855 - DNA, 16 bp, C. familiaris
ctcagggcgtgatcac

SEQ ID NO: 314856 - DNA, 16 bp, C. familiaris
ctcaggggcccctggg

SEQ ID NO: 314857 - DNA, 16 bp, C. familiaris
ctcagggggtgatctc

SEQ ID NO: 314858 - DNA, 16 bp, C. familiaris
ctcagggtcacgagat

SEQ ID NO: 314859 - DNA, 16 bp, C. familiaris
ctcagggtcatgacct

SEQ ID NO: 314860 - DNA, 16 bp, C. familiaris
ctcagggtcgtgaatt

SEQ ID NO: 314861 - DNA, 16 bp, C. familiaris
ctcagggtgtgatcct

SEQ ID NO: 314862 - DNA, 16 bp, C. familiaris
ctcaggtgcccctgcc

SEQ ID NO: 314863 - DNA, 16 bp, C. familiaris
ctcaggtgccccttct

SEQ ID NO: 314864 - DNA, 16 bp, C. familiaris
ctcagtatctctctct

SEQ ID NO: 314865 - DNA, 16 bp, C. familiaris
ctcagtcaaaggcaga

SEQ ID NO: 314866 - DNA, 16 bp, C. familiaris
ctcagtcaatggagca

SEQ ID NO: 314867 - DNA, 16 bp, C. familiaris
ctcagtcagtgaagta

SEQ ID NO: 314868 - DNA, 16 bp, C. familiaris
ctcagtcctgggactc

SEQ ID NO: 314869 - DNA, 16 bp, C. familiaris
ctcagtctccagcccc

SEQ ID NO: 314870 - DNA, 16 bp, C. familiaris
ctcagtctgtagagca

SEQ ID NO: 314871 - DNA, 16 bp, C. familiaris
ctcagtctgtgcctct

SEQ ID NO: 314872 - DNA, 16 bp, C. familiaris
ctcagtctgttctcta

SEQ ID NO: 314873 - DNA, 16 bp, C. familiaris
ctcagtgcagaggctg

SEQ ID NO: 314874 - DNA, 16 bp, C. familiaris
ctcagtgcccaccacc

SEQ ID NO: 314875 - DNA, 16 bp, C. familiaris
ctcagtgcctgccacc

SEQ ID NO: 314876 - DNA, 16 bp, C. familiaris
ctcagtgctcatccca

SEQ ID NO: 314877 - DNA, 16 bp, C. familiaris
ctcagtggaaaaaaaa

SEQ ID NO: 314878 - DNA, 16 bp, C. familiaris
ctcagtggagaatctg

SEQ ID NO: 314879 - DNA, 16 bp, C. familiaris
ctcagtggagtgtctg

SEQ ID NO: 314880 - DNA, 16 bp, C. familiaris
ctcagtggcttaaagc

SEQ ID NO: 314881 - DNA, 16 bp, C. familiaris
ctcagtgggaactctg

SEQ ID NO: 314882 - DNA, 16 bp, C. familiaris
ctcagtgggaagcctg

SEQ ID NO: 314883 - DNA, 16 bp, C. familiaris
ctcagtgggtgagtgt

SEQ ID NO: 314884 - DNA, 16 bp, C. familiaris
ctcagtggttgaccct

SEQ ID NO: 314885 - DNA, 16 bp, C. familiaris
ctcagtggttgagtac

SEQ ID NO: 314886 - DNA, 16 bp, C. familiaris
ctcagtggtttagagt

SEQ ID NO: 314887 - DNA, 16 bp, C. familiaris
ctcagtggttttgtgc

SEQ ID NO: 314888 - DNA, 16 bp, C. familiaris
ctcagtgtagagccca

SEQ ID NO: 314889 - DNA, 16 bp, C. familiaris
ctcagtgtcctcctct

SEQ ID NO: 314890 - DNA, 16 bp, C. familiaris
ctcagtgtgatcctgg

SEQ ID NO: 314891 - DNA, 16 bp, C. familiaris
ctcagttccctcatct

SEQ ID NO: 314892 - DNA, 16 bp, C. familiaris
ctcagttctctctctc

SEQ ID NO: 314893 - DNA, 16 bp, C. familiaris
ctcagtttattcatct

SEQ ID NO: 314894 - DNA, 16 bp, C. familiaris
ctcagtttatttttta

SEQ ID NO: 314895 - DNA, 16 bp, C. familiaris
ctcagtttccccatca

SEQ ID NO: 314896 - DNA, 16 bp, C. familiaris
ctcagtttcctccctt

SEQ ID NO: 314897 - DNA, 16 bp, C. familiaris
ctcagtttcctttcct

SEQ ID NO: 314898 - DNA, 16 bp, C. familiaris
ctcatacacacataca

SEQ ID NO: 314899 - DNA, 16 bp, C. familiaris
ctcatactctctcttt

SEQ ID NO: 314900 - DNA, 16 bp, C. familiaris
ctcatatgaggaattt

SEQ ID NO: 314901 - DNA, 16 bp, C. familiaris
ctcatcaacacttgtt

SEQ ID NO: 314902 - DNA, 16 bp, C. familiaris
ctcatcaccagaaaaa

SEQ ID NO: 314903 - DNA, 16 bp, C. familiaris
ctcatcagacaccaaa

SEQ ID NO: 314904 - DNA, 16 bp, C. familiaris
ctcatcagcaaaatgg

SEQ ID NO: 314905 - DNA, 16 bp, C. familiaris
ctcatcatcaggaaaa

SEQ ID NO: 314906 - DNA, 16 bp, C. familiaris
ctcatcatgacaaatg

SEQ ID NO: 314907 - DNA, 16 bp, C. familiaris
ctcatccccttatcct

SEQ ID NO: 314908 - DNA, 16 bp, C. familiaris
ctcatcccgacaagtg

SEQ ID NO: 314909 - DNA, 16 bp, C. familiaris
ctcatctatgaaatga

SEQ ID NO: 314910 - DNA, 16 bp, C. familiaris
ctcatctccaaatacc

SEQ ID NO: 314911 - DNA, 16 bp, C. familiaris
ctcatctctgctccat

SEQ ID NO: 314912 - DNA, 16 bp, C. familiaris
ctcatctctttcttca

SEQ ID NO: 314913 - DNA, 16 bp, C. familiaris
ctcatctgtaaaaaga

SEQ ID NO: 314914 - DNA, 16 bp, C. familiaris
ctcatctgtaaaatgg

SEQ ID NO: 314915 - DNA, 16 bp, C. familiaris
ctcatctgtaagatgg

SEQ ID NO: 314916 - DNA, 16 bp, C. familiaris
ctcatgagtcatgaga

SEQ ID NO: 314917 - DNA, 16 bp, C. familiaris
ctcatgcaaaaaaaaa

SEQ ID NO: 314918 - DNA, 16 bp, C. familiaris
ctcatgcactgttgat

SEQ ID NO: 314919 - DNA, 16 bp, C. familiaris
ctcatgcattcattca

SEQ ID NO: 314920 - DNA, 16 bp, C. familiaris
ctcatggattagaaga

SEQ ID NO: 314921 - DNA, 16 bp, C. familiaris
ctcatggattgaaaga

SEQ ID NO: 314922 - DNA, 16 bp, C. familiaris
ctcatggggctccctg

SEQ ID NO: 314923 - DNA, 29 bp, C. familiaris
ctcatggtccacatggcctccaaggagta

SEQ ID NO: 314924 - DNA, 16 bp, C. familiaris
ctcattcaaataaata

SEQ ID NO: 314925 - DNA, 16 bp, C. familiaris
ctcattcaatcagttg

SEQ ID NO: 314926 - DNA, 16 bp, C. familiaris
ctcattcctctgcttc

SEQ ID NO: 314927 - DNA, 16 bp, C. familiaris
ctcattctaaaattta

SEQ ID NO: 314928 - DNA, 16 bp, C. familiaris
ctcattctttttgatg

SEQ ID NO: 314929 - DNA, 16 bp, C. familiaris
ctcattgtgcttttga

SEQ ID NO: 314930 - DNA, 16 bp, C. familiaris
ctcatttttgcctttg

SEQ ID NO: 314931 - DNA, 16 bp, C. familiaris
ctcatttttgcttttg

SEQ ID NO: 314932 - DNA, 16 bp, C. familiaris
ctccaaagaagacatc

SEQ ID NO: 314933 - DNA, 16 bp, C. familiaris
ctccaaagacatccag

SEQ ID NO: 314934 - DNA, 16 bp, C. familiaris
ctccaaatggatgaaa

SEQ ID NO: 314935 - DNA, 26 bp, C. familiaris
ctccaaccccctgcgagcccctttcc

SEQ ID NO: 314936 - DNA, 16 bp, C. familiaris
ctccaagatcacgacc

SEQ ID NO: 314937 - DNA, 16 bp, C. familiaris
ctccaagctgagcatg

SEQ ID NO: 314938 - DNA, 16 bp, C. familiaris
ctccaagctgctcctg

SEQ ID NO: 314939 - DNA, 16 bp, C. familiaris
ctccacacccagccca

SEQ ID NO: 314940 - DNA, 16 bp, C. familiaris
ctccacactggatgtg

SEQ ID NO: 314941 - DNA, 16 bp, C. familiaris
ctccacagcaaagaaa

SEQ ID NO: 314942 - DNA, 16 bp, C. familiaris
ctccacatcttcacca

SEQ ID NO: 314943 - DNA, 16 bp, C. familiaris
ctccaccacctgagcc

SEQ ID NO: 314944 - DNA, 16 bp, C. familiaris
ctccaccagctgagcc

SEQ ID NO: 314945 - DNA, 36 bp, C. familiaris
ctccaccccaagattgctagaactcatacagcaatt

SEQ ID NO: 314946 - DNA, 16 bp, C. familiaris
ctccaccctcatgacc

SEQ ID NO: 314947 - DNA, 16 bp, C. familiaris
ctccaccctgggtgtg

SEQ ID NO: 314948 - DNA, 16 bp, C. familiaris
ctccacctattcatcc

SEQ ID NO: 314949 - DNA, 16 bp, C. familiaris
ctccacctccacctgc

SEQ ID NO: 314950 - DNA, 16 bp, C. familiaris
ctccacctccctggag

SEQ ID NO: 314951 - DNA, 16 bp, C. familiaris
ctccacctgcctccac

SEQ ID NO: 314952 - DNA, 16 bp, C. familiaris
ctccacctgcctgtgt

SEQ ID NO: 314953 - DNA, 16 bp, C. familiaris
ctccactgagcaggag

SEQ ID NO: 314954 - DNA, 16 bp, C. familiaris
ctccagaaaacagtat

SEQ ID NO: 314955 - DNA, 16 bp, C. familiaris
ctccagaaatcaatat

SEQ ID NO: 314956 - DNA, 16 bp, C. familiaris
ctccagaactttctca

SEQ ID NO: 314957 - DNA, 16 bp, C. familiaris
ctccagaactttgaga

SEQ ID NO: 314958 - DNA, 16 bp, C. familiaris
ctccagaagaaatgca

SEQ ID NO: 314959 - DNA, 16 bp, C. familiaris
ctccagacattgccac

SEQ ID NO: 314960 - DNA, 16 bp, C. familiaris
ctccagacctcacccc

SEQ ID NO: 314961 - DNA, 16 bp, C. familiaris
ctccagagaaacagaa

SEQ ID NO: 314962 - DNA, 16 bp, C. familiaris
ctccagaggcaagaga

SEQ ID NO: 314963 - DNA, 16 bp, C. familiaris
ctccagatcacaccct

SEQ ID NO: 314964 - DNA, 16 bp, C. familiaris
ctccagatccatccac

SEQ ID NO: 314965 - DNA, 16 bp, C. familiaris
ctccagcaactctgtt

SEQ ID NO: 314966 - DNA, 16 bp, C. familiaris
ctccagcagactcctc

SEQ ID NO: 314967 - DNA, 16 bp, C. familiaris
ctccagcagccctcag

SEQ ID NO: 314968 - DNA, 16 bp, C. familiaris
ctccagccaccctcag

SEQ ID NO: 314969 - DNA, 16 bp, C. familiaris
ctccagccccactgcc

SEQ ID NO: 314970 - DNA, 16 bp, C. familiaris
ctccagccccagcctc

SEQ ID NO: 314971 - DNA, 16 bp, C. familiaris
ctccagccccagctcc

SEQ ID NO: 314972 - DNA, 16 bp, C. familiaris
ctccagcccctggaaa

SEQ ID NO: 314973 - DNA, 16 bp, C. familiaris
ctccagccctgcctgc

SEQ ID NO: 314974 - DNA, 16 bp, C. familiaris
ctccagcctccactgg

SEQ ID NO: 314975 - DNA, 16 bp, C. familiaris
ctccagcctcctgccc

SEQ ID NO: 314976 - DNA, 16 bp, C. familiaris
ctccagcctctctccc

SEQ ID NO: 314977 - DNA, 16 bp, C. familiaris
ctccagcctctgcctc

SEQ ID NO: 314978 - DNA, 16 bp, C. familiaris
ctccagcctctgctcc

SEQ ID NO: 314979 - DNA, 16 bp, C. familiaris
ctccagctccagctcc

SEQ ID NO: 314980 - DNA, 16 bp, C. familiaris
ctccagctcctcctcc

SEQ ID NO: 314981 - DNA, 16 bp, C. familiaris
ctccagctcctgctcc

SEQ ID NO: 314982 - DNA, 16 bp, C. familiaris
ctccagctttgatttt

SEQ ID NO: 314983 - DNA, 16 bp, C. familiaris
ctccaggaactcccaa

SEQ ID NO: 314984 - DNA, 16 bp, C. familiaris
ctccaggaccacaccc

SEQ ID NO: 314985 - DNA, 16 bp, C. familiaris
ctccaggaccgcaccc

SEQ ID NO: 314986 - DNA, 16 bp, C. familiaris
ctccaggagcaggccc

SEQ ID NO: 314987 - DNA, 16 bp, C. familiaris
ctccaggagcagggca

SEQ ID NO: 314988 - DNA, 16 bp, C. familiaris
ctccaggagctcacag

SEQ ID NO: 314989 - DNA, 16 bp, C. familiaris
ctccaggatcacaccc

SEQ ID NO: 314990 - DNA, 16 bp, C. familiaris
ctccaggatcacacct

SEQ ID NO: 314991 - DNA, 16 bp, C. familiaris
ctccaggatggcaccc

SEQ ID NO: 314992 - DNA, 16 bp, C. familiaris
ctccaggcccaggccc

SEQ ID NO: 314993 - DNA, 16 bp, C. familiaris
ctccaggccctgcagg

SEQ ID NO: 314994 - DNA, 16 bp, C. familiaris
ctccaggctcagcaca

SEQ ID NO: 314995 - DNA, 16 bp, C. familiaris
ctccaggctgcaggca

SEQ ID NO: 314996 - DNA, 16 bp, C. familiaris
ctccagggagccctcc

SEQ ID NO: 314997 - DNA, 16 bp, C. familiaris
ctccagggccagatgg

SEQ ID NO: 314998 - DNA, 16 bp, C. familiaris
ctccagggctgcagag

SEQ ID NO: 314999 - DNA, 16 bp, C. familiaris
ctccaggggattctga

SEQ ID NO: 315000 - DNA, 16 bp, C. familiaris
ctccaggggcacctgg

SEQ ID NO: 315001 - DNA, 16 bp, C. familiaris
ctccaggttcattcat

SEQ ID NO: 315002 - DNA, 16 bp, C. familiaris
ctccagttccctccac

SEQ ID NO: 315003 - DNA, 16 bp, C. familiaris
ctccagttttcttctt

SEQ ID NO: 315004 - DNA, 16 bp, C. familiaris
ctccatcaaacataat

SEQ ID NO: 315005 - DNA, 16 bp, C. familiaris
ctccatcccagaatcc

SEQ ID NO: 315006 - DNA, 16 bp, C. familiaris
ctccatcccaggatgc

SEQ ID NO: 315007 - DNA, 16 bp, C. familiaris
ctccatccggggaccc

SEQ ID NO: 315008 - DNA, 16 bp, C. familiaris
ctccatcctctcactt

SEQ ID NO: 315009 - DNA, 16 bp, C. familiaris
ctccatcctgggattc

SEQ ID NO: 315010 - DNA, 16 bp, C. familiaris
ctccatcctgggtgtg

SEQ ID NO: 315011 - DNA, 16 bp, C. familiaris
ctccatctcctggatc

SEQ ID NO: 315012 - DNA, 16 bp, C. familiaris
ctccatctgcacctgc

SEQ ID NO: 315013 - DNA, 16 bp, C. familiaris
ctccatctgcctctcc

SEQ ID NO: 315014 - DNA, 16 bp, C. familiaris
ctccatctgctgctcc

SEQ ID NO: 315015 - DNA, 16 bp, C. familiaris
ctccatgaagcctttc

SEQ ID NO: 315016 - DNA, 16 bp, C. familiaris
ctccatgcaccgggag

SEQ ID NO: 315017 - DNA, 16 bp, C. familiaris
ctccatgcagagccca

SEQ ID NO: 315018 - DNA, 16 bp, C. familiaris
ctccatgcagagtgcc

SEQ ID NO: 315019 - DNA, 16 bp, C. familiaris
ctccatgcagggcctg

SEQ ID NO: 315020 - DNA, 16 bp, C. familiaris
ctccatgctcagagca

SEQ ID NO: 315021 - DNA, 16 bp, C. familiaris
ctccatgctcaggagg

SEQ ID NO: 315022 - DNA, 16 bp, C. familiaris
ctccatgctcatgctc

SEQ ID NO: 315023 - DNA, 16 bp, C. familiaris
ctccatgctggacatg

SEQ ID NO: 315024 - DNA, 16 bp, C. familiaris
ctccatgctggctgtg

SEQ ID NO: 315025 - DNA, 16 bp, C. familiaris
ctccatgctgtgtgtg

SEQ ID NO: 315026 - DNA, 16 bp, C. familiaris
ctccatggagagagcc

SEQ ID NO: 315027 - DNA, 16 bp, C. familiaris
ctccatgtctggctcc

SEQ ID NO: 315028 - DNA, 16 bp, C. familiaris
ctccattttatagaag

SEQ ID NO: 315029 - DNA, 16 bp, C. familiaris
ctcccaaattcctgac

SEQ ID NO: 315030 - DNA, 16 bp, C. familiaris
ctcccacagagctaca

SEQ ID NO: 315031 - DNA, 16 bp, C. familiaris
ctcccacagttacaaa

SEQ ID NO: 315032 - DNA, 16 bp, C. familiaris
ctcccacctcagggcc

SEQ ID NO: 315033 - DNA, 16 bp, C. familiaris
ctcccagagcctccag

SEQ ID NO: 315034 - DNA, 16 bp, C. familiaris
ctcccagagggagcct

SEQ ID NO: 315035 - DNA, 16 bp, C. familiaris
ctcccagagtttctga

SEQ ID NO: 315036 - DNA, 16 bp, C. familiaris
ctcccagcagcccctg

SEQ ID NO: 315037 - DNA, 16 bp, C. familiaris
ctcccagcatgaagcc

SEQ ID NO: 315038 - DNA, 16 bp, C. familiaris
ctcccagccccaggca

SEQ ID NO: 315039 - DNA, 16 bp, C. familiaris
ctcccagcccctggca

SEQ ID NO: 315040 - DNA, 16 bp, C. familiaris
ctcccagccctgcctc

SEQ ID NO: 315041 - DNA, 16 bp, C. familiaris
ctcccagccctgctcc

SEQ ID NO: 315042 - DNA, 16 bp, C. familiaris
ctcccagcctcctcct

SEQ ID NO: 315043 - DNA, 16 bp, C. familiaris
ctcccagcctggagcc

SEQ ID NO: 315044 - DNA, 16 bp, C. familiaris
ctcccagcctgtggct

SEQ ID NO: 315045 - DNA, 16 bp, C. familiaris
ctcccagctccagctc

SEQ ID NO: 315046 - DNA, 16 bp, C. familiaris
ctcccagctctcccag

SEQ ID NO: 315047 - DNA, 16 bp, C. familiaris
ctcccaggagggagcc

SEQ ID NO: 315048 - DNA, 17 bp, C. familiaris
ctcccagggcatggagc

SEQ ID NO: 315049 - DNA, 16 bp, C. familiaris
ctcccagggcccccag

SEQ ID NO: 315050 - DNA, 16 bp, C. familiaris
ctcccagggctggggg

SEQ ID NO: 315051 - DNA, 16 bp, C. familiaris
ctcccaggggcacctg

SEQ ID NO: 315052 - DNA, 16 bp, C. familiaris
ctcccaggtgctgctg

SEQ ID NO: 315053 - DNA, 16 bp, C. familiaris
ctcccagtcctggagg

SEQ ID NO: 315054 - DNA, 16 bp, C. familiaris
ctcccatccaagtact

SEQ ID NO: 315055 - DNA, 16 bp, C. familiaris
ctcccatggacacacc

SEQ ID NO: 315056 - DNA, 16 bp, C. familiaris
ctcccattccccctgc

SEQ ID NO: 315057 - DNA, 16 bp, C. familiaris
ctcccattctgtgggc

SEQ ID NO: 315058 - DNA, 16 bp, C. familiaris
ctcccattctgtggtt

SEQ ID NO: 315059 - DNA, 16 bp, C. familiaris
ctccccaaggagagcc

SEQ ID NO: 315060 - DNA, 16 bp, C. familiaris
ctccccacagcccctg

SEQ ID NO: 315061 - DNA, 16 bp, C. familiaris
ctccccacagggagcc

SEQ ID NO: 315062 - DNA, 16 bp, C. familiaris
ctccccaccgagcagg

SEQ ID NO: 315063 - DNA, 20 bp, C. familiaris
ctccccacgagcccctttcc

SEQ ID NO: 315064 - DNA, 16 bp, C. familiaris
ctccccacggggagct

SEQ ID NO: 315065 - DNA, 16 bp, C. familiaris
ctccccactcagcagg

SEQ ID NO: 315066 - DNA, 16 bp, C. familiaris
ctccccactcctgctc

SEQ ID NO: 315067 - DNA, 16 bp, C. familiaris
ctccccactgagcact

SEQ ID NO: 315068 - DNA, 16 bp, C. familiaris
ctccccagccctggag

SEQ ID NO: 315069 - DNA, 16 bp, C. familiaris
ctccccagccctggcc

SEQ ID NO: 315070 - DNA, 16 bp, C. familiaris
ctccccagcctggccc

SEQ ID NO: 315071 - DNA, 16 bp, C. familiaris
ctccccagctccctgc

SEQ ID NO: 315072 - DNA, 16 bp, C. familiaris
ctccccagctcctggc

SEQ ID NO: 315073 - DNA, 16 bp, C. familiaris
ctccccaggccccagg

SEQ ID NO: 315074 - DNA, 16 bp, C. familiaris
ctccccaggctgcagg

SEQ ID NO: 315075 - DNA, 16 bp, C. familiaris
ctccccagggctcccc

SEQ ID NO: 315076 - DNA, 16 bp, C. familiaris
ctccccaggggcaggg

SEQ ID NO: 315077 - DNA, 16 bp, C. familiaris
ctccccatggagagcc

SEQ ID NO: 315078 - DNA, 16 bp, C. familiaris
ctcccccagccctgct

SEQ ID NO: 315079 - DNA, 16 bp, C. familiaris
ctcccccagctcatgc

SEQ ID NO: 315080 - DNA, 16 bp, C. familiaris
ctcccccagggacagg

SEQ ID NO: 315081 - DNA, 16 bp, C. familiaris
ctcccccagggagccc

SEQ ID NO: 315082 - DNA, 16 bp, C. familiaris
ctccccccagctcctg

SEQ ID NO: 315083 - DNA, 16 bp, C. familiaris
ctcccccctgctcgtg

SEQ ID NO: 315084 - DNA, 16 bp, C. familiaris
ctccccgcagggaccc

SEQ ID NO: 315085 - DNA, 20 bp, C. familiaris
ctccccgcgagcccctttcc

SEQ ID NO: 315086 - DNA, 16 bp, C. familiaris
ctccccgctgagcctg

SEQ ID NO: 315087 - DNA, 16 bp, C. familiaris
ctccccgtggggagcc

SEQ ID NO: 315088 - DNA, 16 bp, C. familiaris
ctcccctcactcctgc

SEQ ID NO: 315089 - DNA, 16 bp, C. familiaris
ctcccctccagagacc

SEQ ID NO: 315090 - DNA, 16 bp, C. familiaris
ctcccctcctgcagcc

SEQ ID NO: 315091 - DNA, 16 bp, C. familiaris
ctcccctctgtgtgtg

SEQ ID NO: 315092 - DNA, 16 bp, C. familiaris
ctcccctgggacaggc

SEQ ID NO: 315093 - DNA, 16 bp, C. familiaris
ctcccgaggccccgcc

SEQ ID NO: 315094 - DNA, 16 bp, C. familiaris
ctcccgccctgcagcc

SEQ ID NO: 315095 - DNA, 16 bp, C. familiaris
ctcccggatcgtgccc

SEQ ID NO: 315096 - DNA, 31 bp, C. familiaris
ctcccggcctctgcctgtcccgggggaggcc

SEQ ID NO: 315097 - DNA, 17 bp, C. familiaris
ctcccggtatggagcct

SEQ ID NO: 315098 - DNA, 16 bp, C. familiaris
ctccctatccctctgc

SEQ ID NO: 315099 - DNA, 16 bp, C. familiaris
ctccctcagctgctcc

SEQ ID NO: 315100 - DNA, 16 bp, C. familiaris
ctccctcagggcctcc

SEQ ID NO: 315101 - DNA, 16 bp, C. familiaris
ctccctcagtttacaa

SEQ ID NO: 315102 - DNA, 16 bp, C. familiaris
ctccctccagcccctg

SEQ ID NO: 315103 - DNA, 16 bp, C. familiaris
ctccctccctcccagg

SEQ ID NO: 315104 - DNA, 16 bp, C. familiaris
ctccctcctcagcggg

SEQ ID NO: 315105 - DNA, 16 bp, C. familiaris
ctccctcctgccagcc

SEQ ID NO: 315106 - DNA, 16 bp, C. familiaris
ctccctctacttctgc

SEQ ID NO: 315107 - DNA, 16 bp, C. familiaris
ctccctctatgcctcc

SEQ ID NO: 315108 - DNA, 16 bp, C. familiaris
ctccctctccctgcca

SEQ ID NO: 315109 - DNA, 16 bp, C. familiaris
ctccctctccctgggc

SEQ ID NO: 315110 - DNA, 16 bp, C. familiaris
ctccctctcctcccag

SEQ ID NO: 315111 - DNA, 16 bp, C. familiaris
ctccctctcctgccac

SEQ ID NO: 315112 - DNA, 16 bp, C. familiaris
ctccctctctgcagat

SEQ ID NO: 315113 - DNA, 16 bp, C. familiaris
ctccctctgcaccctc

SEQ ID NO: 315114 - DNA, 16 bp, C. familiaris
ctccctctgcccagcc

SEQ ID NO: 315115 - DNA, 16 bp, C. familiaris
ctccctctgccccaaa

SEQ ID NO: 315116 - DNA, 16 bp, C. familiaris
ctccctctgccccaca

SEQ ID NO: 315117 - DNA, 16 bp, C. familiaris
ctccctctgccccagc

SEQ ID NO: 315118 - DNA, 16 bp, C. familiaris
ctccctctgccctggc

SEQ ID NO: 315119 - DNA, 16 bp, C. familiaris
ctccctctgcctccca

SEQ ID NO: 315120 - DNA, 16 bp, C. familiaris
ctccctctgcctgcgg

SEQ ID NO: 315121 - DNA, 16 bp, C. familiaris
ctccctctgctccatc

SEQ ID NO: 315122 - DNA, 16 bp, C. familiaris
ctccctctgctcccac

SEQ ID NO: 315123 - DNA, 16 bp, C. familiaris
ctccctctgctcctgg

SEQ ID NO: 315124 - DNA, 16 bp, C. familiaris
ctccctctgctggtcc

SEQ ID NO: 315125 - DNA, 16 bp, C. familiaris
ctccctctgggtctct

SEQ ID NO: 315126 - DNA, 16 bp, C. familiaris
ctccctctgtctctgc

SEQ ID NO: 315127 - DNA, 16 bp, C. familiaris
ctccctctgtgctctt

SEQ ID NO: 315128 - DNA, 16 bp, C. familiaris
ctccctctgtggctcc

SEQ ID NO: 315129 - DNA, 16 bp, C. familiaris
ctccctctgtgtgact

SEQ ID NO: 315130 - DNA, 16 bp, C. familiaris
ctccctgagcaggaag

SEQ ID NO: 315131 - DNA, 16 bp, C. familiaris
ctccctgaggagcagg

SEQ ID NO: 315132 - DNA, 16 bp, C. familiaris
ctccctgaggagcctg

SEQ ID NO: 315133 - DNA, 16 bp, C. familiaris
ctccctgcaggaggcc

SEQ ID NO: 315134 - DNA, 16 bp, C. familiaris
ctccctgcaggcagcc

SEQ ID NO: 315135 - DNA, 16 bp, C. familiaris
ctccctgcagggagtg

SEQ ID NO: 315136 - DNA, 16 bp, C. familiaris
ctccctgcagggcccc

SEQ ID NO: 315137 - DNA, 16 bp, C. familiaris
ctccctgcagggcgcc

SEQ ID NO: 315138 - DNA, 16 bp, C. familiaris
ctccctgcccagagcc

SEQ ID NO: 315139 - DNA, 16 bp, C. familiaris
ctccctgccctgctca

SEQ ID NO: 315140 - DNA, 19 bp, C. familiaris
ctccctgcgagcccctttc

SEQ ID NO: 315141 - DNA, 16 bp, C. familiaris
ctccctgcgggaagcc

SEQ ID NO: 315142 - DNA, 16 bp, C. familiaris
ctccctgcggggaggc

SEQ ID NO: 315143 - DNA, 16 bp, C. familiaris
ctccctgctcacactc

SEQ ID NO: 315144 - DNA, 16 bp, C. familiaris
ctccctgctcagcgaa

SEQ ID NO: 315145 - DNA, 16 bp, C. familiaris
ctccctgctcagctgg

SEQ ID NO: 315146 - DNA, 16 bp, C. familiaris
ctccctgctccctggg

SEQ ID NO: 315147 - DNA, 16 bp, C. familiaris
ctccctgctcgtgctc

SEQ ID NO: 315148 - DNA, 16 bp, C. familiaris
ctccctgctctgtgag

SEQ ID NO: 315149 - DNA, 16 bp, C. familiaris
ctccctgctctgtgtg

SEQ ID NO: 315150 - DNA, 16 bp, C. familiaris
ctccctgctctttggg

SEQ ID NO: 315151 - DNA, 16 bp, C. familiaris
ctccctgctgagcagg

SEQ ID NO: 315152 - DNA, 16 bp, C. familiaris
ctccctgctgagccag

SEQ ID NO: 315153 - DNA, 16 bp, C. familiaris
ctccctgctgggcaag

SEQ ID NO: 315154 - DNA, 16 bp, C. familiaris
ctccctggagcctgct

SEQ ID NO: 315155 - DNA, 16 bp, C. familiaris
ctccctggccctctgc

SEQ ID NO: 315156 - DNA, 16 bp, C. familiaris
ctccctgggcctcagc

SEQ ID NO: 315157 - DNA, 16 bp, C. familiaris
ctccctgggggagccc

SEQ ID NO: 315158 - DNA, 16 bp, C. familiaris
ctccctggtggccctg

SEQ ID NO: 315159 - DNA, 16 bp, C. familiaris
ctccctgtatctctca

SEQ ID NO: 315160 - DNA, 16 bp, C. familiaris
ctccctgtctttcatg

SEQ ID NO: 315161 - DNA, 17 bp, C. familiaris
ctccctgtgcatggagc

SEQ ID NO: 315162 - DNA, 16 bp, C. familiaris
ctcccttctcagcagg

SEQ ID NO: 315163 - DNA, 16 bp, C. familiaris
ctccctttgcctgcct

SEQ ID NO: 315164 - DNA, 16 bp, C. familiaris
ctccctttgctgctcc

SEQ ID NO: 315165 - DNA, 16 bp, C. familiaris
ctccgcattctctcca

SEQ ID NO: 315166 - DNA, 16 bp, C. familiaris
ctccggagctctctgt

SEQ ID NO: 315167 - DNA, 17 bp, C. familiaris
ctccggcaggaactccg

SEQ ID NO: 315168 - DNA, 59 bp, C. familiaris
ctccgggacggggctctcctgtcctggggacactcgccccggcctcagcccggctcctc

SEQ ID NO: 315169 - DNA, 16 bp, C. familiaris
ctccgggcctgggctt

SEQ ID NO: 315170 - DNA, 16 bp, C. familiaris
ctccgggctgcaggcg

SEQ ID NO: 315171 - DNA, 16 bp, C. familiaris
ctccgtgcccgtcacc

SEQ ID NO: 315172 - DNA, 16 bp, C. familiaris
ctccgtgctcagcaag

SEQ ID NO: 315173 - DNA, 16 bp, C. familiaris
ctccgtgctgggtgtg

SEQ ID NO: 315174 - DNA, 16 bp, C. familiaris
ctccgtggagggagcc

SEQ ID NO: 315175 - DNA, 16 bp, C. familiaris
ctcctaaatgcccatc

SEQ ID NO: 315176 - DNA, 16 bp, C. familiaris
ctcctataagtggaat

SEQ ID NO: 315177 - DNA, 16 bp, C. familiaris
ctcctcaatttctctt

SEQ ID NO: 315178 - DNA, 16 bp, C. familiaris
ctcctcaccaagcagg

SEQ ID NO: 315179 - DNA, 16 bp, C. familiaris
ctcctcactaagcagg

SEQ ID NO: 315180 - DNA, 16 bp, C. familiaris
ctcctcactgagctca

SEQ ID NO: 315181 - DNA, 16 bp, C. familiaris
ctcctcactgagctgg

SEQ ID NO: 315182 - DNA, 16 bp, C. familiaris
ctcctcactgagtggg

SEQ ID NO: 315183 - DNA, 16 bp, C. familiaris
ctcctcaggctccctg

SEQ ID NO: 315184 - DNA, 16 bp, C. familiaris
ctcctcatccttgcca

SEQ ID NO: 315185 - DNA, 16 bp, C. familiaris
ctcctccaggaagcct

SEQ ID NO: 315186 - DNA, 16 bp, C. familiaris
ctcctccaggaggccc

SEQ ID NO: 315187 - DNA, 16 bp, C. familiaris
ctcctccaggaggcct

SEQ ID NO: 315188 - DNA, 16 bp, C. familiaris
ctcctcccagggagcc

SEQ ID NO: 315189 - DNA, 16 bp, C. familiaris
ctcctccccactcatg

SEQ ID NO: 315190 - DNA, 16 bp, C. familiaris
ctcctccccactcctg

SEQ ID NO: 315191 - DNA, 16 bp, C. familiaris
ctcctcccccagaaga

SEQ ID NO: 315192 - DNA, 16 bp, C. familiaris
ctcctccccctgccta

SEQ ID NO: 315193 - DNA, 16 bp, C. familiaris
ctcctccctcagcctg

SEQ ID NO: 315194 - DNA, 16 bp, C. familiaris
ctcctccctctgaccc

SEQ ID NO: 315195 - DNA, 16 bp, C. familiaris
ctcctccctgcagccc

SEQ ID NO: 315196 - DNA, 16 bp, C. familiaris
ctcctcctcagcccct

SEQ ID NO: 315197 - DNA, 16 bp, C. familiaris
ctcctcctcctcagct

SEQ ID NO: 315198 - DNA, 16 bp, C. familiaris
ctcctcctgcctgtgt

SEQ ID NO: 315199 - DNA, 16 bp, C. familiaris
ctcctcctgcttctgc

SEQ ID NO: 315200 - DNA, 16 bp, C. familiaris
ctcctctagagcctcc

SEQ ID NO: 315201 - DNA, 16 bp, C. familiaris
ctcctctctgctctca

SEQ ID NO: 315202 - DNA, 16 bp, C. familiaris
ctcctctctgcttgtg

SEQ ID NO: 315203 - DNA, 16 bp, C. familiaris
ctcctctgctgagcag

SEQ ID NO: 315204 - DNA, 16 bp, C. familiaris
ctcctctgtgtctgtg

SEQ ID NO: 315205 - DNA, 16 bp, C. familiaris
ctcctgaaaccaatat

SEQ ID NO: 315206 - DNA, 16 bp, C. familiaris
ctcctgactggctcag

SEQ ID NO: 315207 - DNA, 16 bp, C. familiaris
ctcctgagccacccag

SEQ ID NO: 315208 - DNA, 16 bp, C. familiaris
ctcctgcaccccaatg

SEQ ID NO: 315209 - DNA, 16 bp, C. familiaris
ctcctgccactgggtg

SEQ ID NO: 315210 - DNA, 16 bp, C. familiaris
ctcctgcccaccttcc

SEQ ID NO: 315211 - DNA, 16 bp, C. familiaris
ctcctgccccaggctg

SEQ ID NO: 315212 - DNA, 16 bp, C. familiaris
ctcctgcccccagctg

SEQ ID NO: 315213 - DNA, 16 bp, C. familiaris
ctcctgccccgcagcc

SEQ ID NO: 315214 - DNA, 16 bp, C. familiaris
ctcctgcccctgcagc

SEQ ID NO: 315215 - DNA, 16 bp, C. familiaris
ctcctgcccctgctgc

SEQ ID NO: 315216 - DNA, 18 bp, C. familiaris
ctcctgcccggagctgag

SEQ ID NO: 315217 - DNA, 16 bp, C. familiaris
ctcctgccctgcagcc

SEQ ID NO: 315218 - DNA, 16 bp, C. familiaris
ctcctgcctcaggacc

SEQ ID NO: 315219 - DNA, 16 bp, C. familiaris
ctcctgcctcctccca

SEQ ID NO: 315220 - DNA, 16 bp, C. familiaris
ctcctgcctggctgcc

SEQ ID NO: 315221 - DNA, 16 bp, C. familiaris
ctcctgcctgtgtctc

SEQ ID NO: 315222 - DNA, 16 bp, C. familiaris
ctcctgctcctgctct

SEQ ID NO: 315223 - DNA, 16 bp, C. familiaris
ctcctgctgcccctgc

SEQ ID NO: 315224 - DNA, 16 bp, C. familiaris
ctcctgctgcttctcc

SEQ ID NO: 315225 - DNA, 16 bp, C. familiaris
ctcctgctggtgctct

SEQ ID NO: 315226 - DNA, 16 bp, C. familiaris
ctcctggcccccagcc

SEQ ID NO: 315227 - DNA, 16 bp, C. familiaris
ctcctgggcagccctg

SEQ ID NO: 315228 - DNA, 16 bp, C. familiaris
ctcctgggctcctggg

SEQ ID NO: 315229 - DNA, 16 bp, C. familiaris
ctcctggggcacctgg

SEQ ID NO: 315230 - DNA, 16 bp, C. familiaris
ctcctggggcatctgg

SEQ ID NO: 315231 - DNA, 16 bp, C. familiaris
ctcctgggggaggggc

SEQ ID NO: 315232 - DNA, 16 bp, C. familiaris
ctcctgggtggtgcag

SEQ ID NO: 315233 - DNA, 16 bp, C. familiaris
ctcctggtgaagatgc

SEQ ID NO: 315234 - DNA, 16 bp, C. familiaris
ctcctggtgcagggag

SEQ ID NO: 315235 - DNA, 16 bp, C. familiaris
ctcctggtgtcacctt

SEQ ID NO: 315236 - DNA, 16 bp, C. familiaris
ctcctggttcctgctc

SEQ ID NO: 315237 - DNA, 16 bp, C. familiaris
ctcctggttttcttcc

SEQ ID NO: 315238 - DNA, 16 bp, C. familiaris
ctcctggttttgctga

SEQ ID NO: 315239 - DNA, 16 bp, C. familiaris
ctcctgtccccagccc

SEQ ID NO: 315240 - DNA, 16 bp, C. familiaris
ctcctgtccccaggct

SEQ ID NO: 315241 - DNA, 16 bp, C. familiaris
ctcctgtgcttgttgg

SEQ ID NO: 315242 - DNA, 16 bp, C. familiaris
ctcctgttctgtcacc

SEQ ID NO: 315243 - DNA, 16 bp, C. familiaris
ctccttacaaggagcc

SEQ ID NO: 315244 - DNA, 16 bp, C. familiaris
ctccttcagcccctcc

SEQ ID NO: 315245 - DNA, 16 bp, C. familiaris
ctccttccctctggca

SEQ ID NO: 315246 - DNA, 16 bp, C. familiaris
ctccttcctgcctctg

SEQ ID NO: 315247 - DNA, 16 bp, C. familiaris
ctccttctacctatgt

SEQ ID NO: 315248 - DNA, 16 bp, C. familiaris
ctccttctacctctgc

SEQ ID NO: 315249 - DNA, 16 bp, C. familiaris
ctccttctcccactgc

SEQ ID NO: 315250 - DNA, 16 bp, C. familiaris
ctccttctgcctctgt

SEQ ID NO: 315251 - DNA, 16 bp, C. familiaris
ctccttctgctcctca

SEQ ID NO: 315252 - DNA, 16 bp, C. familiaris
ctccttctgctgctct

SEQ ID NO: 315253 - DNA, 16 bp, C. familiaris
ctccttctgctgcttc

SEQ ID NO: 315254 - DNA, 16 bp, C. familiaris
ctccttcttttttaaa

SEQ ID NO: 315255 - DNA, 16 bp, C. familiaris
ctccttgaggagcctg

SEQ ID NO: 315256 - DNA, 16 bp, C. familiaris
ctccttggggcacctg

SEQ ID NO: 315257 - DNA, 16 bp, C. familiaris
ctcctttccccattat

SEQ ID NO: 315258 - DNA, 16 bp, C. familiaris
ctcctttcctctataa

SEQ ID NO: 315259 - DNA, 16 bp, C. familiaris
ctcctttctatctgct

SEQ ID NO: 315260 - DNA, 16 bp, C. familiaris
ctcctttctcctttaa

SEQ ID NO: 315261 - DNA, 16 bp, C. familiaris
ctcctttgccctttat

SEQ ID NO: 315262 - DNA, 16 bp, C. familiaris
ctcgacctcaggaccc

SEQ ID NO: 315263 - DNA, 16 bp, C. familiaris
ctcgatgcagggcttg

SEQ ID NO: 315264 - DNA, 16 bp, C. familiaris
ctcgcacctgtcagaa

SEQ ID NO: 315265 - DNA, 16 bp, C. familiaris
ctcgcagggagccgga

SEQ ID NO: 315266 - DNA, 16 bp, C. familiaris
ctcgctcactcgctct

SEQ ID NO: 315267 - DNA, 16 bp, C. familiaris
ctcgctgagcaaggag

SEQ ID NO: 315268 - DNA, 16 bp, C. familiaris
ctcggatcatgatccc

SEQ ID NO: 315269 - DNA, 16 bp, C. familiaris
ctcggcagagaatccc

SEQ ID NO: 315270 - DNA, 16 bp, C. familiaris
ctcggcggggagcctg

SEQ ID NO: 315271 - DNA, 16 bp, C. familiaris
ctcgggcggcggctcc

SEQ ID NO: 315272 - DNA, 16 bp, C. familiaris
ctcggggagaagccgg

SEQ ID NO: 315273 - DNA, 16 bp, C. familiaris
ctcggggtcatgacct

SEQ ID NO: 315274 - DNA, 17 bp, C. familiaris
ctcggtgcccatcaccc

SEQ ID NO: 315275 - DNA, 16 bp, C. familiaris
ctctaaaagaaatgaa

SEQ ID NO: 315276 - DNA, 16 bp, C. familiaris
ctctaaaatgaacaaa

SEQ ID NO: 315277 - DNA, 16 bp, C. familiaris
ctctacaaccaacatg

SEQ ID NO: 315278 - DNA, 16 bp, C. familiaris
ctctacagggagtctg

SEQ ID NO: 315279 - DNA, 16 bp, C. familiaris
ctctacctctctctgt

SEQ ID NO: 315280 - DNA, 16 bp, C. familiaris
ctctacctgtgcctct

SEQ ID NO: 315281 - DNA, 16 bp, C. familiaris
ctctacctgtgtgtgt

SEQ ID NO: 315282 - DNA, 16 bp, C. familiaris
ctctactgacagccag

SEQ ID NO: 315283 - DNA, 16 bp, C. familiaris
ctctacttctctgtgt

SEQ ID NO: 315284 - DNA, 16 bp, C. familiaris
ctctagaggaaaaaaa

SEQ ID NO: 315285 - DNA, 16 bp, C. familiaris
ctctagggaagaatcc

SEQ ID NO: 315286 - DNA, 16 bp, C. familiaris
ctctatatcttcacca

SEQ ID NO: 315287 - DNA, 16 bp, C. familiaris
ctctatatgttggcaa

SEQ ID NO: 315288 - DNA, 16 bp, C. familiaris
ctctatcccaggaccc

SEQ ID NO: 315289 - DNA, 16 bp, C. familiaris
ctctatctctctgtca

SEQ ID NO: 315290 - DNA, 16 bp, C. familiaris
ctctatctctgcctct

SEQ ID NO: 315291 - DNA, 16 bp, C. familiaris
ctctatgactctcatg

SEQ ID NO: 315292 - DNA, 16 bp, C. familiaris
ctctatgcccagcgtg

SEQ ID NO: 315293 - DNA, 16 bp, C. familiaris
ctctattttcttctaa

SEQ ID NO: 315294 - DNA, 16 bp, C. familiaris
ctctattttgggctgc

SEQ ID NO: 315295 - DNA, 16 bp, C. familiaris
ctctcaaaaagaaaaa

SEQ ID NO: 315296 - DNA, 16 bp, C. familiaris
ctctcaaaaggaaaaa

SEQ ID NO: 315297 - DNA, 16 bp, C. familiaris
ctctcaaacctttgtg

SEQ ID NO: 315298 - DNA, 16 bp, C. familiaris
ctctcaaataaatata

SEQ ID NO: 315299 - DNA, 16 bp, C. familiaris
ctctcaatagttgcag

SEQ ID NO: 315300 - DNA, 16 bp, C. familiaris
ctctcaccactgccat

SEQ ID NO: 315301 - DNA, 16 bp, C. familiaris
ctctcactcactcact

SEQ ID NO: 315302 - DNA, 16 bp, C. familiaris
ctctcactttctcaaa

SEQ ID NO: 315303 - DNA, 16 bp, C. familiaris
ctctcagaaagaaaga

SEQ ID NO: 315304 - DNA, 16 bp, C. familiaris
ctctcagagcctcagt

SEQ ID NO: 315305 - DNA, 16 bp, C. familiaris
ctctcagttctgttcc

SEQ ID NO: 315306 - DNA, 16 bp, C. familiaris
ctctcatgttctgtgt

SEQ ID NO: 315307 - DNA, 17 bp, C. familiaris
ctctcattcagaatgga

SEQ ID NO: 315308 - DNA, 16 bp, C. familiaris
ctctccaacatttttg

SEQ ID NO: 315309 - DNA, 16 bp, C. familiaris
ctctccacggggagcc

SEQ ID NO: 315310 - DNA, 16 bp, C. familiaris
ctctccagcccctggc

SEQ ID NO: 315311 - DNA, 16 bp, C. familiaris
ctctccagcctcacct

SEQ ID NO: 315312 - DNA, 16 bp, C. familiaris
ctctccagctctggag

SEQ ID NO: 315313 - DNA, 16 bp, C. familiaris
ctctccatctgctcct

SEQ ID NO: 315314 - DNA, 16 bp, C. familiaris
ctctccatctgcttct

SEQ ID NO: 315315 - DNA, 16 bp, C. familiaris
ctctccatgtgtctca

SEQ ID NO: 315316 - DNA, 16 bp, C. familiaris
ctctccatgtgtctct

SEQ ID NO: 315317 - DNA, 16 bp, C. familiaris
ctctcccactgcccct

SEQ ID NO: 315318 - DNA, 16 bp, C. familiaris
ctctcccctctggcaa

SEQ ID NO: 315319 - DNA, 16 bp, C. familiaris
ctctccctatgtctat

SEQ ID NO: 315320 - DNA, 16 bp, C. familiaris
ctctccctcagcccct

SEQ ID NO: 315321 - DNA, 16 bp, C. familiaris
ctctccctccagctca

SEQ ID NO: 315322 - DNA, 16 bp, C. familiaris
ctctccctctctgcca

SEQ ID NO: 315323 - DNA, 16 bp, C. familiaris
ctctccctctctgggc

SEQ ID NO: 315324 - DNA, 16 bp, C. familiaris
ctctccctctgcccat

SEQ ID NO: 315325 - DNA, 16 bp, C. familiaris
ctctccctctgcccca

SEQ ID NO: 315326 - DNA, 16 bp, C. familiaris
ctctccctgcttatgc

SEQ ID NO: 315327 - DNA, 16 bp, C. familiaris
ctctccctgtccctgt

SEQ ID NO: 315328 - DNA, 16 bp, C. familiaris
ctctccctgtgtctgt

SEQ ID NO: 315329 - DNA, 16 bp, C. familiaris
ctctcccttcccccag

SEQ ID NO: 315330 - DNA, 16 bp, C. familiaris
ctctcccttggtccct

SEQ ID NO: 315331 - DNA, 16 bp, C. familiaris
ctctccgcagggagcc

SEQ ID NO: 315332 - DNA, 16 bp, C. familiaris
ctctcctagcaacttt

SEQ ID NO: 315333 - DNA, 16 bp, C. familiaris
ctctcctccagcccct

SEQ ID NO: 315334 - DNA, 16 bp, C. familiaris
ctctcctccagcctcc

SEQ ID NO: 315335 - DNA, 16 bp, C. familiaris
ctctcctcccctccag

SEQ ID NO: 315336 - DNA, 16 bp, C. familiaris
ctctcctcctggcttg

SEQ ID NO: 315337 - DNA, 16 bp, C. familiaris
ctctcctcctgtgtct

SEQ ID NO: 315338 - DNA, 16 bp, C. familiaris
ctctcctctctgtgca

SEQ ID NO: 315339 - DNA, 16 bp, C. familiaris
ctctcctctgggctcc

SEQ ID NO: 315340 - DNA, 16 bp, C. familiaris
ctctcctgagcaggga

SEQ ID NO: 315341 - DNA, 16 bp, C. familiaris
ctctcctgccccagcc

SEQ ID NO: 315342 - DNA, 16 bp, C. familiaris
ctctccttataaggac

SEQ ID NO: 315343 - DNA, 16 bp, C. familiaris
ctctccttgtgcccct

SEQ ID NO: 315344 - DNA, 16 bp, C. familiaris
ctctcgctcgctctct

SEQ ID NO: 315345 - DNA, 16 bp, C. familiaris
ctctctaaaaataagt

SEQ ID NO: 315346 - DNA, 16 bp, C. familiaris
ctctctacctgtgtct

SEQ ID NO: 315347 - DNA, 16 bp, C. familiaris
ctctctatctcatgaa

SEQ ID NO: 315348 - DNA, 16 bp, C. familiaris
ctctctattctgtccc

SEQ ID NO: 315349 - DNA, 16 bp, C. familiaris
ctctctcaatctctgt

SEQ ID NO: 315350 - DNA, 16 bp, C. familiaris
ctctctcacactttct

SEQ ID NO: 315351 - DNA, 16 bp, C. familiaris
ctctctcactctatca

SEQ ID NO: 315352 - DNA, 16 bp, C. familiaris
ctctctcagccttcat

SEQ ID NO: 315353 - DNA, 16 bp, C. familiaris
ctctctcccaaagaaa

SEQ ID NO: 315354 - DNA, 16 bp, C. familiaris
ctctctcccagataaa

SEQ ID NO: 315355 - DNA, 16 bp, C. familiaris
ctctctccccagctcc

SEQ ID NO: 315356 - DNA, 16 bp, C. familiaris
ctctctcctcagcagg

SEQ ID NO: 315357 - DNA, 16 bp, C. familiaris
ctctctcctctctatg

SEQ ID NO: 315358 - DNA, 16 bp, C. familiaris
ctctctcctgcttgtg

SEQ ID NO: 315359 - DNA, 16 bp, C. familiaris
ctctctctaaaataaa

SEQ ID NO: 315360 - DNA, 16 bp, C. familiaris
ctctctctaaattaaa

SEQ ID NO: 315361 - DNA, 16 bp, C. familiaris
ctctctctatgtgtct

SEQ ID NO: 315362 - DNA, 16 bp, C. familiaris
ctctctctcatataaa

SEQ ID NO: 315363 - DNA, 16 bp, C. familiaris
ctctctctccaccatg

SEQ ID NO: 315364 - DNA, 16 bp, C. familiaris
ctctctctctaatcaa

SEQ ID NO: 315365 - DNA, 16 bp, C. familiaris
ctctctctctgtcatg

SEQ ID NO: 315366 - DNA, 16 bp, C. familiaris
ctctctctctgtgaga

SEQ ID NO: 315367 - DNA, 16 bp, C. familiaris
ctctctctgccccacc

SEQ ID NO: 315368 - DNA, 16 bp, C. familiaris
ctctctctgccccatc

SEQ ID NO: 315369 - DNA, 16 bp, C. familiaris
ctctctctgcccccca

SEQ ID NO: 315370 - DNA, 16 bp, C. familiaris
ctctctctgcccctca

SEQ ID NO: 315371 - DNA, 16 bp, C. familiaris
ctctctctgcctcctg

SEQ ID NO: 315372 - DNA, 16 bp, C. familiaris
ctctctctgcctctgt

SEQ ID NO: 315373 - DNA, 16 bp, C. familiaris
ctctctctgctcatgc

SEQ ID NO: 315374 - DNA, 16 bp, C. familiaris
ctctctctgggcctct

SEQ ID NO: 315375 - DNA, 16 bp, C. familiaris
ctctctctgtatatca

SEQ ID NO: 315376 - DNA, 16 bp, C. familiaris
ctctctctgtctcttg

SEQ ID NO: 315377 - DNA, 16 bp, C. familiaris
ctctctcttgctctaa

SEQ ID NO: 315378 - DNA, 16 bp, C. familiaris
ctctctcttgctctgt

SEQ ID NO: 315379 - DNA, 16 bp, C. familiaris
ctctctctttctgaat

SEQ ID NO: 315380 - DNA, 16 bp, C. familiaris
ctctctgaaaaaaata

SEQ ID NO: 315381 - DNA, 16 bp, C. familiaris
ctctctgacttcatct

SEQ ID NO: 315382 - DNA, 16 bp, C. familiaris
ctctctgagtctgtca

SEQ ID NO: 315383 - DNA, 16 bp, C. familiaris
ctctctgcacggagcc

SEQ ID NO: 315384 - DNA, 16 bp, C. familiaris
ctctctgcaggagcct

SEQ ID NO: 315385 - DNA, 16 bp, C. familiaris
ctctctgcagggaacc

SEQ ID NO: 315386 - DNA, 16 bp, C. familiaris
ctctctgcatggagct

SEQ ID NO: 315387 - DNA, 16 bp, C. familiaris
ctctctgcctcctgct

SEQ ID NO: 315388 - DNA, 16 bp, C. familiaris
ctctctgcctctgcct

SEQ ID NO: 315389 - DNA, 16 bp, C. familiaris
ctctctgcctgtcttt

SEQ ID NO: 315390 - DNA, 16 bp, C. familiaris
ctctctgctccagcca

SEQ ID NO: 315391 - DNA, 16 bp, C. familiaris
ctctctgctctgcagg

SEQ ID NO: 315392 - DNA, 16 bp, C. familiaris
ctctctgctgagcatg

SEQ ID NO: 315393 - DNA, 16 bp, C. familiaris
ctctctgctgagtggg

SEQ ID NO: 315394 - DNA, 16 bp, C. familiaris
ctctctggctgtgtct

SEQ ID NO: 315395 - DNA, 16 bp, C. familiaris
ctctctgggccaaagg

SEQ ID NO: 315396 - DNA, 16 bp, C. familiaris
ctctctgtctctgccc

SEQ ID NO: 315397 - DNA, 16 bp, C. familiaris
ctctctgtctcttctg

SEQ ID NO: 315398 - DNA, 16 bp, C. familiaris
ctctctgtctgctcct

SEQ ID NO: 315399 - DNA, 16 bp, C. familiaris
ctctctgtgactatca

SEQ ID NO: 315400 - DNA, 16 bp, C. familiaris
ctctctgtgcttcact

SEQ ID NO: 315401 - DNA, 16 bp, C. familiaris
ctctctgtggtgtctc

SEQ ID NO: 315402 - DNA, 16 bp, C. familiaris
ctctctgtgtctctcc

SEQ ID NO: 315403 - DNA, 16 bp, C. familiaris
ctctctgtgttctcat

SEQ ID NO: 315404 - DNA, 16 bp, C. familiaris
ctctctgtttctcata

SEQ ID NO: 315405 - DNA, 16 bp, C. familiaris
ctctctgtttctcatg

SEQ ID NO: 315406 - DNA, 16 bp, C. familiaris
ctctcttcatcttctg

SEQ ID NO: 315407 - DNA, 16 bp, C. familiaris
ctctcttggggatccc

SEQ ID NO: 315408 - DNA, 16 bp, C. familiaris
ctctctttatctttgt

SEQ ID NO: 315409 - DNA, 16 bp, C. familiaris
ctctctttctctcata

SEQ ID NO: 315410 - DNA, 16 bp, C. familiaris
ctctgaaaaacagtat

SEQ ID NO: 315411 - DNA, 16 bp, C. familiaris
ctctgaaaaagaaaag

SEQ ID NO: 315412 - DNA, 16 bp, C. familiaris
ctctgaagaaagccca

SEQ ID NO: 315413 - DNA, 16 bp, C. familiaris
ctctgaagaaagtcca

SEQ ID NO: 315414 - DNA, 16 bp, C. familiaris
ctctgaagcattttca

SEQ ID NO: 315415 - DNA, 16 bp, C. familiaris
ctctgaaggcaaggga

SEQ ID NO: 315416 - DNA, 16 bp, C. familiaris
ctctgaatccccttca

SEQ ID NO: 315417 - DNA, 16 bp, C. familiaris
ctctgaatctctctct

SEQ ID NO: 315418 - DNA, 17 bp, C. familiaris
ctctgaatgaataaata

SEQ ID NO: 315419 - DNA, 16 bp, C. familiaris
ctctgaatttttaaaa

SEQ ID NO: 315420 - DNA, 16 bp, C. familiaris
ctctgaccctccccac

SEQ ID NO: 315421 - DNA, 16 bp, C. familiaris
ctctgaccctcttccc

SEQ ID NO: 315422 - DNA, 16 bp, C. familiaris
ctctgacctctgcttc

SEQ ID NO: 315423 - DNA, 16 bp, C. familiaris
ctctgacctcttcaga

SEQ ID NO: 315424 - DNA, 16 bp, C. familiaris
ctctgactctgaccct

SEQ ID NO: 315425 - DNA, 16 bp, C. familiaris
ctctgactctgcctct

SEQ ID NO: 315426 - DNA, 16 bp, C. familiaris
ctctgagatcatgagc

SEQ ID NO: 315427 - DNA, 16 bp, C. familiaris
ctctgagccctgaccc

SEQ ID NO: 315428 - DNA, 16 bp, C. familiaris
ctctgagcctcactgt

SEQ ID NO: 315429 - DNA, 16 bp, C. familiaris
ctctgagccttacttt

SEQ ID NO: 315430 - DNA, 16 bp, C. familiaris
ctctgaggggcacctg

SEQ ID NO: 315431 - DNA, 16 bp, C. familiaris
ctctgatctctgcctc

SEQ ID NO: 315432 - DNA, 16 bp, C. familiaris
ctctgatggagatgga

SEQ ID NO: 315433 - DNA, 16 bp, C. familiaris
ctctgatttttgtctt

SEQ ID NO: 315434 - DNA, 16 bp, C. familiaris
ctctgcacccagtgtg

SEQ ID NO: 315435 - DNA, 16 bp, C. familiaris
ctctgcacctcctccc

SEQ ID NO: 315436 - DNA, 16 bp, C. familiaris
ctctgcactcagcatg

SEQ ID NO: 315437 - DNA, 16 bp, C. familiaris
ctctgcagatgactgg

SEQ ID NO: 315438 - DNA, 16 bp, C. familiaris
ctctgcatcacttacc

SEQ ID NO: 315439 - DNA, 16 bp, C. familiaris
ctctgcatccaatgag

SEQ ID NO: 315440 - DNA, 16 bp, C. familiaris
ctctgcatcctcacca

SEQ ID NO: 315441 - DNA, 16 bp, C. familiaris
ctctgcatcctcatca

SEQ ID NO: 315442 - DNA, 16 bp, C. familiaris
ctctgcatcctggcca

SEQ ID NO: 315443 - DNA, 16 bp, C. familiaris
ctctgcatctgtctct

SEQ ID NO: 315444 - DNA, 16 bp, C. familiaris
ctctgcatctttgcca

SEQ ID NO: 315445 - DNA, 16 bp, C. familiaris
ctctgcattcagcaca

SEQ ID NO: 315446 - DNA, 16 bp, C. familiaris
ctctgccacctaccag

SEQ ID NO: 315447 - DNA, 16 bp, C. familiaris
ctctgccactgaccag

SEQ ID NO: 315448 - DNA, 16 bp, C. familiaris
ctctgccatcttctct

SEQ ID NO: 315449 - DNA, 16 bp, C. familiaris
ctctgcccatccccct

SEQ ID NO: 315450 - DNA, 16 bp, C. familiaris
ctctgccccactctct

SEQ ID NO: 315451 - DNA, 16 bp, C. familiaris
ctctgccccagcccag

SEQ ID NO: 315452 - DNA, 16 bp, C. familiaris
ctctgcccctccctgg

SEQ ID NO: 315453 - DNA, 16 bp, C. familiaris
ctctgcccctctggct

SEQ ID NO: 315454 - DNA, 16 bp, C. familiaris
ctctgccccttcccca

SEQ ID NO: 315455 - DNA, 16 bp, C. familiaris
ctctgccccttctcac

SEQ ID NO: 315456 - DNA, 16 bp, C. familiaris
ctctgccccttctgct

SEQ ID NO: 315457 - DNA, 16 bp, C. familiaris
ctctgcccgtgtttct

SEQ ID NO: 315458 - DNA, 16 bp, C. familiaris
ctctgccctcagtgtg

SEQ ID NO: 315459 - DNA, 16 bp, C. familiaris
ctctgccctcctggag

SEQ ID NO: 315460 - DNA, 16 bp, C. familiaris
ctctgccctgcccctg

SEQ ID NO: 315461 - DNA, 16 bp, C. familiaris
ctctgccctgggcctg

SEQ ID NO: 315462 - DNA, 16 bp, C. familiaris
ctctgccctgggctcc

SEQ ID NO: 315463 - DNA, 16 bp, C. familiaris
ctctgcccttcccact

SEQ ID NO: 315464 - DNA, 16 bp, C. familiaris
ctctgcccttccccaa

SEQ ID NO: 315465 - DNA, 16 bp, C. familiaris
ctctgcccttccccag

SEQ ID NO: 315466 - DNA, 16 bp, C. familiaris
ctctgccctttcccac

SEQ ID NO: 315467 - DNA, 16 bp, C. familiaris
ctctgcctatggctct

SEQ ID NO: 315468 - DNA, 16 bp, C. familiaris
ctctgcctatgtattt

SEQ ID NO: 315469 - DNA, 16 bp, C. familiaris
ctctgcctatgttgct

SEQ ID NO: 315470 - DNA, 16 bp, C. familiaris
ctctgcctcagctccc

SEQ ID NO: 315471 - DNA, 16 bp, C. familiaris
ctctgcctcagggcct

SEQ ID NO: 315472 - DNA, 16 bp, C. familiaris
ctctgcctccaccttc

SEQ ID NO: 315473 - DNA, 16 bp, C. familiaris
ctctgcctccctcact

SEQ ID NO: 315474 - DNA, 16 bp, C. familiaris
ctctgcctccctctca

SEQ ID NO: 315475 - DNA, 16 bp, C. familiaris
ctctgcctcctctgtg

SEQ ID NO: 315476 - DNA, 16 bp, C. familiaris
ctctgcctccttctgt

SEQ ID NO: 315477 - DNA, 16 bp, C. familiaris
ctctgcctctagctct

SEQ ID NO: 315478 - DNA, 16 bp, C. familiaris
ctctgcctctatctct

SEQ ID NO: 315479 - DNA, 16 bp, C. familiaris
ctctgcctctcactgt

SEQ ID NO: 315480 - DNA, 16 bp, C. familiaris
ctctgcctctgactct

SEQ ID NO: 315481 - DNA, 16 bp, C. familiaris
ctctgcctctgcctct

SEQ ID NO: 315482 - DNA, 16 bp, C. familiaris
ctctgcctctgcctgt

SEQ ID NO: 315483 - DNA, 16 bp, C. familiaris
ctctgcctctgctcat

SEQ ID NO: 315484 - DNA, 16 bp, C. familiaris
ctctgcctctgctcct

SEQ ID NO: 315485 - DNA, 16 bp, C. familiaris
ctctgcctctgctgcc

SEQ ID NO: 315486 - DNA, 16 bp, C. familiaris
ctctgcctcttcctgc

SEQ ID NO: 315487 - DNA, 16 bp, C. familiaris
ctctgcctctttgcct

SEQ ID NO: 315488 - DNA, 16 bp, C. familiaris
ctctgcctgcagcctg

SEQ ID NO: 315489 - DNA, 16 bp, C. familiaris
ctctgcctgctgttcc

SEQ ID NO: 315490 - DNA, 16 bp, C. familiaris
ctctgcctggaactct

SEQ ID NO: 315491 - DNA, 16 bp, C. familiaris
ctctgcctggagcact

SEQ ID NO: 315492 - DNA, 16 bp, C. familiaris
ctctgcctgtctctgc

SEQ ID NO: 315493 - DNA, 16 bp, C. familiaris
ctctgcctgtttctct

SEQ ID NO: 315494 - DNA, 16 bp, C. familiaris
ctctgccttcatggag

SEQ ID NO: 315495 - DNA, 16 bp, C. familiaris
ctctgccttctgcctc

SEQ ID NO: 315496 - DNA, 16 bp, C. familiaris
ctctgcctttgctcct

SEQ ID NO: 315497 - DNA, 16 bp, C. familiaris
ctctgcgcagggagcc

SEQ ID NO: 315498 - DNA, 16 bp, C. familiaris
ctctgcggggagtctg

SEQ ID NO: 315499 - DNA, 16 bp, C. familiaris
ctctgctcagtggaga

SEQ ID NO: 315500 - DNA, 16 bp, C. familiaris
ctctgctccccactcc

SEQ ID NO: 315501 - DNA, 16 bp, C. familiaris
ctctgctccccactct

SEQ ID NO: 315502 - DNA, 16 bp, C. familiaris
ctctgctcctcaccac

SEQ ID NO: 315503 - DNA, 16 bp, C. familiaris
ctctgctcctccccca

SEQ ID NO: 315504 - DNA, 16 bp, C. familiaris
ctctgctcctctctgt

SEQ ID NO: 315505 - DNA, 16 bp, C. familiaris
ctctgctccttccctg

SEQ ID NO: 315506 - DNA, 16 bp, C. familiaris
ctctgctccttctgct

SEQ ID NO: 315507 - DNA, 16 bp, C. familiaris
ctctgctctgtgggga

SEQ ID NO: 315508 - DNA, 16 bp, C. familiaris
ctctgctgagtgagga

SEQ ID NO: 315509 - DNA, 16 bp, C. familiaris
ctctgctgccatcttc

SEQ ID NO: 315510 - DNA, 16 bp, C. familiaris
ctctgctgctcaccct

SEQ ID NO: 315511 - DNA, 16 bp, C. familiaris
ctctgctgctccccag

SEQ ID NO: 315512 - DNA, 16 bp, C. familiaris
ctctgctgctcctgct

SEQ ID NO: 315513 - DNA, 16 bp, C. familiaris
ctctgctgctctgtgt

SEQ ID NO: 315514 - DNA, 16 bp, C. familiaris
ctctgctgctgctccc

SEQ ID NO: 315515 - DNA, 16 bp, C. familiaris
ctctgctgctgtctct

SEQ ID NO: 315516 - DNA, 16 bp, C. familiaris
ctctgctgcttcctgg

SEQ ID NO: 315517 - DNA, 16 bp, C. familiaris
ctctgctggggattta

SEQ ID NO: 315518 - DNA, 16 bp, C. familiaris
ctctgctgtcaccatc

SEQ ID NO: 315519 - DNA, 16 bp, C. familiaris
ctctgctgtgtggagt

SEQ ID NO: 315520 - DNA, 16 bp, C. familiaris
ctctgcttccatcttc

SEQ ID NO: 315521 - DNA, 16 bp, C. familiaris
ctctgcttcctccctg

SEQ ID NO: 315522 - DNA, 16 bp, C. familiaris
ctctgcttctcccctg

SEQ ID NO: 315523 - DNA, 16 bp, C. familiaris
ctctgcttctctgctt

SEQ ID NO: 315524 - DNA, 16 bp, C. familiaris
ctctgcttcttccatt

SEQ ID NO: 315525 - DNA, 16 bp, C. familiaris
ctctgctttgtctctg

SEQ ID NO: 315526 - DNA, 16 bp, C. familiaris
ctctggaaaacagttt

SEQ ID NO: 315527 - DNA, 16 bp, C. familiaris
ctctggaaaaccctga

SEQ ID NO: 315528 - DNA, 16 bp, C. familiaris
ctctggaaaccctgga

SEQ ID NO: 315529 - DNA, 16 bp, C. familiaris
ctctggaaacctggag

SEQ ID NO: 315530 - DNA, 16 bp, C. familiaris
ctctggaagacagtgt

SEQ ID NO: 315531 - DNA, 16 bp, C. familiaris
ctctggaatcatgacc

SEQ ID NO: 315532 - DNA, 16 bp, C. familiaris
ctctggaatttgcaag

SEQ ID NO: 315533 - DNA, 16 bp, C. familiaris
ctctggagacatatct

SEQ ID NO: 315534 - DNA, 16 bp, C. familiaris
ctctggagccagacag

SEQ ID NO: 315535 - DNA, 21 bp, C. familiaris
ctctggagccctggattcagc

SEQ ID NO: 315536 - DNA, 16 bp, C. familiaris
ctctggattaggtttt

SEQ ID NO: 315537 - DNA, 16 bp, C. familiaris
ctctggcccagggcac

SEQ ID NO: 315538 - DNA, 16 bp, C. familiaris
ctctggccctcctgct

SEQ ID NO: 315539 - DNA, 16 bp, C. familiaris
ctctggccctgcccct

SEQ ID NO: 315540 - DNA, 16 bp, C. familiaris
ctctggctctctcttt

SEQ ID NO: 315541 - DNA, 16 bp, C. familiaris
ctctggctctgcccct

SEQ ID NO: 315542 - DNA, 16 bp, C. familiaris
ctctggctctggctcc

SEQ ID NO: 315543 - DNA, 16 bp, C. familiaris
ctctggctctggctct

SEQ ID NO: 315544 - DNA, 16 bp, C. familiaris
ctctggctctggtttt

SEQ ID NO: 315545 - DNA, 16 bp, C. familiaris
ctctggctctgtgtct

SEQ ID NO: 315546 - DNA, 16 bp, C. familiaris
ctctggctgctttcaa

SEQ ID NO: 315547 - DNA, 16 bp, C. familiaris
ctctggctgtgacctt

SEQ ID NO: 315548 - DNA, 16 bp, C. familiaris
ctctggctgtgcctct

SEQ ID NO: 315549 - DNA, 16 bp, C. familiaris
ctctgggaaacaaagg

SEQ ID NO: 315550 - DNA, 16 bp, C. familiaris
ctctgggaaatgaaga

SEQ ID NO: 315551 - DNA, 16 bp, C. familiaris
ctctgggaagtcttcc

SEQ ID NO: 315552 - DNA, 16 bp, C. familiaris
ctctgggacacctggg

SEQ ID NO: 315553 - DNA, 16 bp, C. familiaris
ctctgggcagccctgg

SEQ ID NO: 315554 - DNA, 16 bp, C. familiaris
ctctgggccaaagaca

SEQ ID NO: 315555 - DNA, 16 bp, C. familiaris
ctctgggccactgggg

SEQ ID NO: 315556 - DNA, 16 bp, C. familiaris
ctctgggcctgggctt

SEQ ID NO: 315557 - DNA, 16 bp, C. familiaris
ctctggggactctggg

SEQ ID NO: 315558 - DNA, 16 bp, C. familiaris
ctctggggcccctggg

SEQ ID NO: 315559 - DNA, 16 bp, C. familiaris
ctctgggggaggggag

SEQ ID NO: 315560 - DNA, 16 bp, C. familiaris
ctctggggtctcttct

SEQ ID NO: 315561 - DNA, 16 bp, C. familiaris
ctctgggtttgaatcc

SEQ ID NO: 315562 - DNA, 16 bp, C. familiaris
ctctggttgtgatccc

SEQ ID NO: 315563 - DNA, 16 bp, C. familiaris
ctctgtcactgtctct

SEQ ID NO: 315564 - DNA, 16 bp, C. familiaris
ctctgtccatttttaa

SEQ ID NO: 315565 - DNA, 16 bp, C. familiaris
ctctgtcccaggaccc

SEQ ID NO: 315566 - DNA, 16 bp, C. familiaris
ctctgtccctctgtcc

SEQ ID NO: 315567 - DNA, 16 bp, C. familiaris
ctctgtctcctctctg

SEQ ID NO: 315568 - DNA, 16 bp, C. familiaris
ctctgtctccttattt

SEQ ID NO: 315569 - DNA, 16 bp, C. familiaris
ctctgtctctatttct

SEQ ID NO: 315570 - DNA, 16 bp, C. familiaris
ctctgtctgcctgtgt

SEQ ID NO: 315571 - DNA, 16 bp, C. familiaris
ctctgtctgtgtgtgt

SEQ ID NO: 315572 - DNA, 16 bp, C. familiaris
ctctgtcttctctgtg

SEQ ID NO: 315573 - DNA, 16 bp, C. familiaris
ctctgtcttgaataaa

SEQ ID NO: 315574 - DNA, 16 bp, C. familiaris
ctctgtgacccagcaa

SEQ ID NO: 315575 - DNA, 16 bp, C. familiaris
ctctgtgagaaatgct

SEQ ID NO: 315576 - DNA, 16 bp, C. familiaris
ctctgtgccagatgct

SEQ ID NO: 315577 - DNA, 16 bp, C. familiaris
ctctgtgccaggagct

SEQ ID NO: 315578 - DNA, 16 bp, C. familiaris
ctctgtgccaggcctg

SEQ ID NO: 315579 - DNA, 16 bp, C. familiaris
ctctgtgcccagtgtg

SEQ ID NO: 315580 - DNA, 16 bp, C. familiaris
ctctgtgcctcctgga

SEQ ID NO: 315581 - DNA, 16 bp, C. familiaris
ctctgtgcctctcacg

SEQ ID NO: 315582 - DNA, 16 bp, C. familiaris
ctctgtgctaagcact

SEQ ID NO: 315583 - DNA, 16 bp, C. familiaris
ctctgtgctcagggag

SEQ ID NO: 315584 - DNA, 16 bp, C. familiaris
ctctgtgctcatcagg

SEQ ID NO: 315585 - DNA, 16 bp, C. familiaris
ctctgtgctctgtgca

SEQ ID NO: 315586 - DNA, 16 bp, C. familiaris
ctctgtgctgagggca

SEQ ID NO: 315587 - DNA, 16 bp, C. familiaris
ctctgtgctgggcatg

SEQ ID NO: 315588 - DNA, 16 bp, C. familiaris
ctctgtgctgtttctt

SEQ ID NO: 315589 - DNA, 16 bp, C. familiaris
ctctgtgcttcctgga

SEQ ID NO: 315590 - DNA, 16 bp, C. familiaris
ctctgtgcttctgttt

SEQ ID NO: 315591 - DNA, 16 bp, C. familiaris
ctctgtgcttcttgga

SEQ ID NO: 315592 - DNA, 16 bp, C. familiaris
ctctgtggagaggcct

SEQ ID NO: 315593 - DNA, 16 bp, C. familiaris
ctctgtgggagagagg

SEQ ID NO: 315594 - DNA, 16 bp, C. familiaris
ctctgtggggagccca

SEQ ID NO: 315595 - DNA, 16 bp, C. familiaris
ctctgtggggagcctg

SEQ ID NO: 315596 - DNA, 16 bp, C. familiaris
ctctgtgtatatctct

SEQ ID NO: 315597 - DNA, 16 bp, C. familiaris
ctctgtgtccctgcct

SEQ ID NO: 315598 - DNA, 16 bp, C. familiaris
ctctgtgtctctgact

SEQ ID NO: 315599 - DNA, 16 bp, C. familiaris
ctctgtgtgtctgtca

SEQ ID NO: 315600 - DNA, 16 bp, C. familiaris
ctctgtgtgtgcctct

SEQ ID NO: 315601 - DNA, 16 bp, C. familiaris
ctctgtgtgtgtctcc

SEQ ID NO: 315602 - DNA, 16 bp, C. familiaris
ctctgtgttgggctct

SEQ ID NO: 315603 - DNA, 16 bp, C. familiaris
ctctgttcatcagaga

SEQ ID NO: 315604 - DNA, 16 bp, C. familiaris
ctctgtttaaaaaaaa

SEQ ID NO: 315605 - DNA, 16 bp, C. familiaris
ctctgtttctcttatg

SEQ ID NO: 315606 - DNA, 16 bp, C. familiaris
ctcttacagtgttggt

SEQ ID NO: 315607 - DNA, 16 bp, C. familiaris
ctcttaccatttttat

SEQ ID NO: 315608 - DNA, 16 bp, C. familiaris
ctcttagcacatttca

SEQ ID NO: 315609 - DNA, 16 bp, C. familiaris
ctcttataattaaaaa

SEQ ID NO: 315610 - DNA, 16 bp, C. familiaris
ctcttcatctgtgaaa

SEQ ID NO: 315611 - DNA, 16 bp, C. familiaris
ctcttccagaaacact

SEQ ID NO: 315612 - DNA, 16 bp, C. familiaris
ctcttccagctcctgg

SEQ ID NO: 315613 - DNA, 16 bp, C. familiaris
ctcttccagcttctgg

SEQ ID NO: 315614 - DNA, 16 bp, C. familiaris
ctcttcccagcccctg

SEQ ID NO: 315615 - DNA, 16 bp, C. familiaris
ctcttccctctgcctg

SEQ ID NO: 315616 - DNA, 16 bp, C. familiaris
ctcttcccttggcttc

SEQ ID NO: 315617 - DNA, 16 bp, C. familiaris
ctcttcctccaggaag

SEQ ID NO: 315618 - DNA, 23 bp, C. familiaris
ctcttcgccgatgacatgatact

SEQ ID NO: 315619 - DNA, 16 bp, C. familiaris
ctcttctccctgcttg

SEQ ID NO: 315620 - DNA, 16 bp, C. familiaris
ctcttctctccacatc

SEQ ID NO: 315621 - DNA, 16 bp, C. familiaris
ctcttctgcctctgcc

SEQ ID NO: 315622 - DNA, 16 bp, C. familiaris
ctcttctgctgggtgt

SEQ ID NO: 315623 - DNA, 16 bp, C. familiaris
ctcttctggaacccca

SEQ ID NO: 315624 - DNA, 16 bp, C. familiaris
ctcttctggggcacct

SEQ ID NO: 315625 - DNA, 16 bp, C. familiaris
ctcttctgtgtctctc

SEQ ID NO: 315626 - DNA, 16 bp, C. familiaris
ctcttcttctggaact

SEQ ID NO: 315627 - DNA, 16 bp, C. familiaris
ctcttctttttctggg

SEQ ID NO: 315628 - DNA, 16 bp, C. familiaris
ctcttgattacagctc

SEQ ID NO: 315629 - DNA, 16 bp, C. familiaris
ctcttgctcactttct

SEQ ID NO: 315630 - DNA, 16 bp, C. familiaris
ctcttgctctatctct

SEQ ID NO: 315631 - DNA, 16 bp, C. familiaris
ctcttgctgatataat

SEQ ID NO: 315632 - DNA, 16 bp, C. familiaris
ctcttgcttgcttgct

SEQ ID NO: 315633 - DNA, 16 bp, C. familiaris
ctcttggaaatgaaca

SEQ ID NO: 315634 - DNA, 16 bp, C. familiaris
ctcttgggtggctcag

SEQ ID NO: 315635 - DNA, 16 bp, C. familiaris
ctcttgtgtgtctctc

SEQ ID NO: 315636 - DNA, 16 bp, C. familiaris
ctctttagcctccatg

SEQ ID NO: 315637 - DNA, 16 bp, C. familiaris
ctctttatctatttca

SEQ ID NO: 315638 - DNA, 16 bp, C. familiaris
ctctttatctctcaaa

SEQ ID NO: 315639 - DNA, 16 bp, C. familiaris
ctctttcatttctggt

SEQ ID NO: 315640 - DNA, 16 bp, C. familiaris
ctctttccaaataagg

SEQ ID NO: 315641 - DNA, 16 bp, C. familiaris
ctctttccttccccag

SEQ ID NO: 315642 - DNA, 16 bp, C. familiaris
ctctttctaaaatgaa

SEQ ID NO: 315643 - DNA, 16 bp, C. familiaris
ctctttctcaaaaata

SEQ ID NO: 315644 - DNA, 16 bp, C. familiaris
ctctttctcaaattaa

SEQ ID NO: 315645 - DNA, 16 bp, C. familiaris
ctctttctcagtctct

SEQ ID NO: 315646 - DNA, 16 bp, C. familiaris
ctctttctccctgtgt

SEQ ID NO: 315647 - DNA, 16 bp, C. familiaris
ctctttcttttctgaa

SEQ ID NO: 315648 - DNA, 16 bp, C. familiaris
ctctttgacctcagcc

SEQ ID NO: 315649 - DNA, 16 bp, C. familiaris
ctctttgagcctcagt

SEQ ID NO: 315650 - DNA, 16 bp, C. familiaris
ctctttgattttgtct

SEQ ID NO: 315651 - DNA, 16 bp, C. familiaris
ctctttgcaggagcct

SEQ ID NO: 315652 - DNA, 16 bp, C. familiaris
ctctttgcatggagcc

SEQ ID NO: 315653 - DNA, 16 bp, C. familiaris
ctctttgtgtctccct

SEQ ID NO: 315654 - DNA, 16 bp, C. familiaris
ctcttttttaaggttt

SEQ ID NO: 315655 - DNA, 16 bp, C. familiaris
ctcttttttctcagct

SEQ ID NO: 315656 - DNA, 16 bp, C. familiaris
ctgaaaaaaatccaca

SEQ ID NO: 315657 - DNA, 16 bp, C. familiaris
ctgaaaaacagaaaga

SEQ ID NO: 315658 - DNA, 16 bp, C. familiaris
ctgaaaaagaaaatca

SEQ ID NO: 315659 - DNA, 16 bp, C. familiaris
ctgaaaaagcatttga

SEQ ID NO: 315660 - DNA, 16 bp, C. familiaris
ctgaaaaaggcaaaaa

SEQ ID NO: 315661 - DNA, 16 bp, C. familiaris
ctgaaaaataaagtct

SEQ ID NO: 315662 - DNA, 16 bp, C. familiaris
ctgaaaaatataataa

SEQ ID NO: 315663 - DNA, 16 bp, C. familiaris
ctgaaaaatgctggtg

SEQ ID NO: 315664 - DNA, 16 bp, C. familiaris
ctgaaaaatgggaata

SEQ ID NO: 315665 - DNA, 16 bp, C. familiaris
ctgaaaaattccctaa

SEQ ID NO: 315666 - DNA, 16 bp, C. familiaris
ctgaaaaatttcctaa

SEQ ID NO: 315667 - DNA, 16 bp, C. familiaris
ctgaaaacattaaaaa

SEQ ID NO: 315668 - DNA, 16 bp, C. familiaris
ctgaaaactcagatga

SEQ ID NO: 315669 - DNA, 16 bp, C. familiaris
ctgaaaagaaatggca

SEQ ID NO: 315670 - DNA, 16 bp, C. familiaris
ctgaaaatatttacaa

SEQ ID NO: 315671 - DNA, 16 bp, C. familiaris
ctgaaaatcaacaact

SEQ ID NO: 315672 - DNA, 16 bp, C. familiaris
ctgaaaatctgaaaaa

SEQ ID NO: 315673 - DNA, 16 bp, C. familiaris
ctgaaaatgaaaggct

SEQ ID NO: 315674 - DNA, 16 bp, C. familiaris
ctgaaaatgtattttt

SEQ ID NO: 315675 - DNA, 16 bp, C. familiaris
ctgaaaattctttttt

SEQ ID NO: 315676 - DNA, 16 bp, C. familiaris
ctgaaaccatggatag

SEQ ID NO: 315677 - DNA, 16 bp, C. familiaris
ctgaaaccattaaaat

SEQ ID NO: 315678 - DNA, 16 bp, C. familiaris
ctgaaacctggcattg

SEQ ID NO: 315679 - DNA, 16 bp, C. familiaris
ctgaaagaaactgaag

SEQ ID NO: 315680 - DNA, 16 bp, C. familiaris
ctgaaagaaatgaaag

SEQ ID NO: 315681 - DNA, 16 bp, C. familiaris
ctgaaagaaattaaga

SEQ ID NO: 315682 - DNA, 16 bp, C. familiaris
ctgaaagaatctgtga

SEQ ID NO: 315683 - DNA, 16 bp, C. familiaris
ctgaaagaatttgtga

SEQ ID NO: 315684 - DNA, 16 bp, C. familiaris
ctgaaagatgtcactt

SEQ ID NO: 315685 - DNA, 16 bp, C. familiaris
ctgaaagcagatgccc

SEQ ID NO: 315686 - DNA, 16 bp, C. familiaris
ctgaaagcagctcagg

SEQ ID NO: 315687 - DNA, 16 bp, C. familiaris
ctgaaaggaaaaagaa

SEQ ID NO: 315688 - DNA, 16 bp, C. familiaris
ctgaaagggacagagg

SEQ ID NO: 315689 - DNA, 16 bp, C. familiaris
ctgaaagtaatataat

SEQ ID NO: 315690 - DNA, 16 bp, C. familiaris
ctgaaatgaaaatttc

SEQ ID NO: 315691 - DNA, 16 bp, C. familiaris
ctgaaatggctttctg

SEQ ID NO: 315692 - DNA, 16 bp, C. familiaris
ctgaaattaataatat

SEQ ID NO: 315693 - DNA, 16 bp, C. familiaris
ctgaacaaaatcaaga

SEQ ID NO: 315694 - DNA, 16 bp, C. familiaris
ctgaacaaatgaatga

SEQ ID NO: 315695 - DNA, 16 bp, C. familiaris
ctgaacagcaaaaaga

SEQ ID NO: 315696 - DNA, 16 bp, C. familiaris
ctgaacagcttctgca

SEQ ID NO: 315697 - DNA, 16 bp, C. familiaris
ctgaaccactcaggca

SEQ ID NO: 315698 - DNA, 16 bp, C. familiaris
ctgaaccagccaggca

SEQ ID NO: 315699 - DNA, 16 bp, C. familiaris
ctgaaccatccagatg

SEQ ID NO: 315700 - DNA, 16 bp, C. familiaris
ctgaaccatttgagaa

SEQ ID NO: 315701 - DNA, 16 bp, C. familiaris
ctgaactgaaggaaga

SEQ ID NO: 315702 - DNA, 16 bp, C. familiaris
ctgaactgtacaccta

SEQ ID NO: 315703 - DNA, 16 bp, C. familiaris
ctgaacttcatcaaaa

SEQ ID NO: 315704 - DNA, 16 bp, C. familiaris
ctgaagaaaatataaa

SEQ ID NO: 315705 - DNA, 16 bp, C. familiaris
ctgaagaaaatgaaaa

SEQ ID NO: 315706 - DNA, 16 bp, C. familiaris
ctgaagaaacagaaaa

SEQ ID NO: 315707 - DNA, 16 bp, C. familiaris
ctgaagaaattaaaaa

SEQ ID NO: 315708 - DNA, 16 bp, C. familiaris
ctgaagaacatcttgg

SEQ ID NO: 315709 - DNA, 16 bp, C. familiaris
ctgaagaagaaagaaa

SEQ ID NO: 315710 - DNA, 16 bp, C. familiaris
ctgaagaagagaaaga

SEQ ID NO: 315711 - DNA, 16 bp, C. familiaris
ctgaagaaggaaaaaa

SEQ ID NO: 315712 - DNA, 16 bp, C. familiaris
ctgaagaatacaatga

SEQ ID NO: 315713 - DNA, 16 bp, C. familiaris
ctgaagacagtgctaa

SEQ ID NO: 315714 - DNA, 16 bp, C. familiaris
ctgaagagacaaagca

SEQ ID NO: 315715 - DNA, 16 bp, C. familiaris
ctgaagagacatttct

SEQ ID NO: 315716 - DNA, 16 bp, C. familiaris
ctgaagatggtattta

SEQ ID NO: 315717 - DNA, 16 bp, C. familiaris
ctgaagcagaaaaaaa

SEQ ID NO: 315718 - DNA, 16 bp, C. familiaris
ctgaagcagactctgc

SEQ ID NO: 315719 - DNA, 16 bp, C. familiaris
ctgaagcccaaagagg

SEQ ID NO: 315720 - DNA, 16 bp, C. familiaris
ctgaagcccagagaga

SEQ ID NO: 315721 - DNA, 16 bp, C. familiaris
ctgaagctaatataat

SEQ ID NO: 315722 - DNA, 16 bp, C. familiaris
ctgaagctgaagtggg

SEQ ID NO: 315723 - DNA, 16 bp, C. familiaris
ctgaagctttgcagaa

SEQ ID NO: 315724 - DNA, 16 bp, C. familiaris
ctgaaggaaaaacaaa

SEQ ID NO: 315725 - DNA, 16 bp, C. familiaris
ctgaaggaaaaagtgg

SEQ ID NO: 315726 - DNA, 16 bp, C. familiaris
ctgaaggaaattgagg

SEQ ID NO: 315727 - DNA, 16 bp, C. familiaris
ctgaaggatgagaagg

SEQ ID NO: 315728 - DNA, 16 bp, C. familiaris
ctgaaggcaagtgctt

SEQ ID NO: 315729 - DNA, 16 bp, C. familiaris
ctgaaggcagaccctt

SEQ ID NO: 315730 - DNA, 16 bp, C. familiaris
ctgaaggcagaggccc

SEQ ID NO: 315731 - DNA, 16 bp, C. familiaris
ctgaaggcagatattt

SEQ ID NO: 315732 - DNA, 16 bp, C. familiaris
ctgaagggcacctggg

SEQ ID NO: 315733 - DNA, 16 bp, C. familiaris
ctgaagggggcacttg

SEQ ID NO: 315734 - DNA, 16 bp, C. familiaris
ctgaaggtcctgggat

SEQ ID NO: 315735 - DNA, 16 bp, C. familiaris
ctgaagtcctgggatc

SEQ ID NO: 315736 - DNA, 16 bp, C. familiaris
ctgaagtctcaggatc

SEQ ID NO: 315737 - DNA, 16 bp, C. familiaris
ctgaataaagaagaaa

SEQ ID NO: 315738 - DNA, 16 bp, C. familiaris
ctgaatatatccttcc

SEQ ID NO: 315739 - DNA, 16 bp, C. familiaris
ctgaatcagaacctgc

SEQ ID NO: 315740 - DNA, 16 bp, C. familiaris
ctgaatcatgatgaaa

SEQ ID NO: 315741 - DNA, 16 bp, C. familiaris
ctgaatctgaaactct

SEQ ID NO: 315742 - DNA, 16 bp, C. familiaris
ctgaatgaaataaaaa

SEQ ID NO: 315743 - DNA, 16 bp, C. familiaris
ctgaatgcagatgctc

SEQ ID NO: 315744 - DNA, 16 bp, C. familiaris
ctgaatggattaaaaa

SEQ ID NO: 315745 - DNA, 16 bp, C. familiaris
ctgaatgggaagaaat

SEQ ID NO: 315746 - DNA, 16 bp, C. familiaris
ctgaatggggaaaaat

SEQ ID NO: 315747 - DNA, 16 bp, C. familiaris
ctgaatgtgagaagat

SEQ ID NO: 315748 - DNA, 16 bp, C. familiaris
ctgaatgtggagcctg

SEQ ID NO: 315749 - DNA, 16 bp, C. familiaris
ctgaattaaaatttta

SEQ ID NO: 315750 - DNA, 16 bp, C. familiaris
ctgaatttctttcaga

SEQ ID NO: 315751 - DNA, 16 bp, C. familiaris
ctgaatttcttttctt

SEQ ID NO: 315752 - DNA, 16 bp, C. familiaris
ctgacaagtccttgaa

SEQ ID NO: 315753 - DNA, 16 bp, C. familiaris
ctgaccccagagccca

SEQ ID NO: 315754 - DNA, 16 bp, C. familiaris
ctgaccctccccctgc

SEQ ID NO: 315755 - DNA, 16 bp, C. familiaris
ctgaccctcctgcctc

SEQ ID NO: 315756 - DNA, 16 bp, C. familiaris
ctgaccctggagaccc

SEQ ID NO: 315757 - DNA, 16 bp, C. familiaris
ctgacctcaaggagct

SEQ ID NO: 315758 - DNA, 16 bp, C. familiaris
ctgacctcatttccta

SEQ ID NO: 315759 - DNA, 16 bp, C. familiaris
ctgactaaaccagcca

SEQ ID NO: 315760 - DNA, 16 bp, C. familiaris
ctgactccagagctca

SEQ ID NO: 315761 - DNA, 16 bp, C. familiaris
ctgactctggctcagg

SEQ ID NO: 315762 - DNA, 16 bp, C. familiaris
ctgactcttggtttca

SEQ ID NO: 315763 - DNA, 16 bp, C. familiaris
ctgactgagcaagcca

SEQ ID NO: 315764 - DNA, 16 bp, C. familiaris
ctgactgagctcccca

SEQ ID NO: 315765 - DNA, 16 bp, C. familiaris
ctgactgcaccagcca

SEQ ID NO: 315766 - DNA, 16 bp, C. familiaris
ctgactgtgctgtcct

SEQ ID NO: 315767 - DNA, 16 bp, C. familiaris
ctgacttcactcagca

SEQ ID NO: 315768 - DNA, 16 bp, C. familiaris
ctgacttgtgctctct

SEQ ID NO: 315769 - DNA, 16 bp, C. familiaris
ctgactttatttggaa

SEQ ID NO: 315770 - DNA, 16 bp, C. familiaris
ctgagaaatattccat

SEQ ID NO: 315771 - DNA, 16 bp, C. familiaris
ctgagaaattaaaaaa

SEQ ID NO: 315772 - DNA, 16 bp, C. familiaris
ctgagaaccaggagca

SEQ ID NO: 315773 - DNA, 16 bp, C. familiaris
ctgagaaggaagaatc

SEQ ID NO: 315774 - DNA, 16 bp, C. familiaris
ctgagaatttgctttt

SEQ ID NO: 315775 - DNA, 16 bp, C. familiaris
ctgagaccaaggcaga

SEQ ID NO: 315776 - DNA, 16 bp, C. familiaris
ctgagagagaggcaga

SEQ ID NO: 315777 - DNA, 16 bp, C. familiaris
ctgagatcaaggccca

SEQ ID NO: 315778 - DNA, 16 bp, C. familiaris
ctgagatcatgaacca

SEQ ID NO: 315779 - DNA, 16 bp, C. familiaris
ctgagatcgagtcaca

SEQ ID NO: 315780 - DNA, 16 bp, C. familiaris
ctgagatggagcctca

SEQ ID NO: 315781 - DNA, 16 bp, C. familiaris
ctgagattaaaaaaaa

SEQ ID NO: 315782 - DNA, 16 bp, C. familiaris
ctgagattctgaattt

SEQ ID NO: 315783 - DNA, 16 bp, C. familiaris
ctgagattgagtccta

SEQ ID NO: 315784 - DNA, 16 bp, C. familiaris
ctgagcaaaaggcaga

SEQ ID NO: 315785 - DNA, 16 bp, C. familiaris
ctgagcaagccaggca

SEQ ID NO: 315786 - DNA, 16 bp, C. familiaris
ctgagcaagccaggtg

SEQ ID NO: 315787 - DNA, 16 bp, C. familiaris
ctgagcaaggagccag

SEQ ID NO: 315788 - DNA, 16 bp, C. familiaris
ctgagcaaggagcccc

SEQ ID NO: 315789 - DNA, 16 bp, C. familiaris
ctgagcacaaagcccc

SEQ ID NO: 315790 - DNA, 16 bp, C. familiaris
ctgagcacagaacctg

SEQ ID NO: 315791 - DNA, 16 bp, C. familiaris
ctgagcacagacccca

SEQ ID NO: 315792 - DNA, 16 bp, C. familiaris
ctgagcacagagacca

SEQ ID NO: 315793 - DNA, 16 bp, C. familiaris
ctgagcacagagcctg

SEQ ID NO: 315794 - DNA, 16 bp, C. familiaris
ctgagcacagagctgg

SEQ ID NO: 315795 - DNA, 16 bp, C. familiaris
ctgagcacccaggcat

SEQ ID NO: 315796 - DNA, 16 bp, C. familiaris
ctgagcacctcctgcc

SEQ ID NO: 315797 - DNA, 16 bp, C. familiaris
ctgagcaccttctgtg

SEQ ID NO: 315798 - DNA, 16 bp, C. familiaris
ctgagcacggagcctg

SEQ ID NO: 315799 - DNA, 16 bp, C. familiaris
ctgagcagaaactgag

SEQ ID NO: 315800 - DNA, 16 bp, C. familiaris
ctgagcagaaagcaga

SEQ ID NO: 315801 - DNA, 16 bp, C. familiaris
ctgagcagaaggcaga

SEQ ID NO: 315802 - DNA, 16 bp, C. familiaris
ctgagcagaaggcagc

SEQ ID NO: 315803 - DNA, 16 bp, C. familiaris
ctgagcagaagggaga

SEQ ID NO: 315804 - DNA, 16 bp, C. familiaris
ctgagcagcccaggca

SEQ ID NO: 315805 - DNA, 16 bp, C. familiaris
ctgagcaggaagccag

SEQ ID NO: 315806 - DNA, 16 bp, C. familiaris
ctgagcaggagcccca

SEQ ID NO: 315807 - DNA, 16 bp, C. familiaris
ctgagcaggaggcaga

SEQ ID NO: 315808 - DNA, 16 bp, C. familiaris
ctgagcagggaagcct

SEQ ID NO: 315809 - DNA, 16 bp, C. familiaris
ctgagcagggagccca

SEQ ID NO: 315810 - DNA, 16 bp, C. familiaris
ctgagcagggaggccc

SEQ ID NO: 315811 - DNA, 16 bp, C. familiaris
ctgagcagggatccca

SEQ ID NO: 315812 - DNA, 16 bp, C. familiaris
ctgagcatggaggcca

SEQ ID NO: 315813 - DNA, 16 bp, C. familiaris
ctgagcatggagtctg

SEQ ID NO: 315814 - DNA, 16 bp, C. familiaris
ctgagcatggggctca

SEQ ID NO: 315815 - DNA, 16 bp, C. familiaris
ctgagccaaaggcaga

SEQ ID NO: 315816 - DNA, 16 bp, C. familiaris
ctgagccaaaggccaa

SEQ ID NO: 315817 - DNA, 16 bp, C. familiaris
ctgagccaaccagaca

SEQ ID NO: 315818 - DNA, 16 bp, C. familiaris
ctgagccaaccaggtg

SEQ ID NO: 315819 - DNA, 16 bp, C. familiaris
ctgagccacacccagg

SEQ ID NO: 315820 - DNA, 16 bp, C. familiaris
ctgagccacccaagcg

SEQ ID NO: 315821 - DNA, 16 bp, C. familiaris
ctgagccacctgagct

SEQ ID NO: 315822 - DNA, 16 bp, C. familiaris
ctgagccacctggatg

SEQ ID NO: 315823 - DNA, 16 bp, C. familiaris
ctgagccagaggtaga

SEQ ID NO: 315824 - DNA, 16 bp, C. familiaris
ctgagccagcaggtgc

SEQ ID NO: 315825 - DNA, 16 bp, C. familiaris
ctgagccagccaagag

SEQ ID NO: 315826 - DNA, 16 bp, C. familiaris
ctgagccagccagagg

SEQ ID NO: 315827 - DNA, 16 bp, C. familiaris
ctgagccagccagatg

SEQ ID NO: 315828 - DNA, 16 bp, C. familiaris
ctgagccagccaggag

SEQ ID NO: 315829 - DNA, 16 bp, C. familiaris
ctgagccagccaggcc

SEQ ID NO: 315830 - DNA, 16 bp, C. familiaris
ctgagccagccgggct

SEQ ID NO: 315831 - DNA, 16 bp, C. familiaris
ctgagccagcctggca

SEQ ID NO: 315832 - DNA, 16 bp, C. familiaris
ctgagccaggagccct

SEQ ID NO: 315833 - DNA, 16 bp, C. familiaris
ctgagccatcaaggca

SEQ ID NO: 315834 - DNA, 16 bp, C. familiaris
ctgagccattcaggga

SEQ ID NO: 315835 - DNA, 16 bp, C. familiaris
ctgagcccagggcaga

SEQ ID NO: 315836 - DNA, 16 bp, C. familiaris
ctgagccccaggcaga

SEQ ID NO: 315837 - DNA, 16 bp, C. familiaris
ctgagcccccagcccc

SEQ ID NO: 315838 - DNA, 16 bp, C. familiaris
ctgagcccccaggagc

SEQ ID NO: 315839 - DNA, 16 bp, C. familiaris
ctgagcccccaggcac

SEQ ID NO: 315840 - DNA, 16 bp, C. familiaris
ctgagccccccaggca

SEQ ID NO: 315841 - DNA, 16 bp, C. familiaris
ctgagcccctggggct

SEQ ID NO: 315842 - DNA, 16 bp, C. familiaris
ctgagccctgagccca

SEQ ID NO: 315843 - DNA, 16 bp, C. familiaris
ctgagccctgagcctg

SEQ ID NO: 315844 - DNA, 16 bp, C. familiaris
ctgagccgaaaggcag

SEQ ID NO: 315845 - DNA, 16 bp, C. familiaris
ctgagccgaaggcaga

SEQ ID NO: 315846 - DNA, 16 bp, C. familiaris
ctgagccgcctgggct

SEQ ID NO: 315847 - DNA, 16 bp, C. familiaris
ctgagccggatttccg

SEQ ID NO: 315848 - DNA, 16 bp, C. familiaris
ctgagcctcagcctcc

SEQ ID NO: 315849 - DNA, 16 bp, C. familiaris
ctgagcctcagtttcc

SEQ ID NO: 315850 - DNA, 16 bp, C. familiaris
ctgagcctcccaagtg

SEQ ID NO: 315851 - DNA, 16 bp, C. familiaris
ctgagcctctgcttcc

SEQ ID NO: 315852 - DNA, 16 bp, C. familiaris
ctgagcctgagcctga

SEQ ID NO: 315853 - DNA, 16 bp, C. familiaris
ctgagcctggagaccc

SEQ ID NO: 315854 - DNA, 16 bp, C. familiaris
ctgagcctggagtctg

SEQ ID NO: 315855 - DNA, 16 bp, C. familiaris
ctgagctactcaggag

SEQ ID NO: 315856 - DNA, 16 bp, C. familiaris
ctgagctcaaccactg

SEQ ID NO: 315857 - DNA, 16 bp, C. familiaris
ctgagctcagagccct

SEQ ID NO: 315858 - DNA, 16 bp, C. familiaris
ctgagctcagcaggga

SEQ ID NO: 315859 - DNA, 16 bp, C. familiaris
ctgagctccatgctgg

SEQ ID NO: 315860 - DNA, 16 bp, C. familiaris
ctgagctccccaggtg

SEQ ID NO: 315861 - DNA, 16 bp, C. familiaris
ctgagctctctctctc

SEQ ID NO: 315862 - DNA, 16 bp, C. familiaris
ctgagctgaagaaaga

SEQ ID NO: 315863 - DNA, 16 bp, C. familiaris
ctgagctgaaggcaca

SEQ ID NO: 315864 - DNA, 16 bp, C. familiaris
ctgagctgaaggcact

SEQ ID NO: 315865 - DNA, 16 bp, C. familiaris
ctgagctgacagcaga

SEQ ID NO: 315866 - DNA, 16 bp, C. familiaris
ctgagctgcaggcaga

SEQ ID NO: 315867 - DNA, 16 bp, C. familiaris
ctgagctgggagccag

SEQ ID NO: 315868 - DNA, 16 bp, C. familiaris
ctgagctgggagcctg

SEQ ID NO: 315869 - DNA, 16 bp, C. familiaris
ctgaggaattgaattt

SEQ ID NO: 315870 - DNA, 16 bp, C. familiaris
ctgaggaccagagagg

SEQ ID NO: 315871 - DNA, 16 bp, C. familiaris
ctgaggaccccaggat

SEQ ID NO: 315872 - DNA, 16 bp, C. familiaris
ctgaggacgaggctga

SEQ ID NO: 315873 - DNA, 16 bp, C. familiaris
ctgaggagagcacttg

SEQ ID NO: 315874 - DNA, 21 bp, C. familiaris
ctgaggagccattttgagcaa

SEQ ID NO: 315875 - DNA, 16 bp, C. familiaris
ctgaggcacccaagca

SEQ ID NO: 315876 - DNA, 16 bp, C. familiaris
ctgaggcaggagtgtg

SEQ ID NO: 315877 - DNA, 16 bp, C. familiaris
ctgaggcatggagaga

SEQ ID NO: 315878 - DNA, 16 bp, C. familiaris
ctgaggcccacagagg

SEQ ID NO: 315879 - DNA, 16 bp, C. familiaris
ctgaggcccagaggga

SEQ ID NO: 315880 - DNA, 16 bp, C. familiaris
ctgaggcccagagggg

SEQ ID NO: 315881 - DNA, 16 bp, C. familiaris
ctgaggcccaggccca

SEQ ID NO: 315882 - DNA, 16 bp, C. familiaris
ctgaggcccagggagg

SEQ ID NO: 315883 - DNA, 16 bp, C. familiaris
ctgaggcctctctgct

SEQ ID NO: 315884 - DNA, 16 bp, C. familiaris
ctgaggcctggggagg

SEQ ID NO: 315885 - DNA, 16 bp, C. familiaris
ctgaggctcagggagg

SEQ ID NO: 315886 - DNA, 16 bp, C. familiaris
ctgaggctgggagagg

SEQ ID NO: 315887 - DNA, 16 bp, C. familiaris
ctgaggctggggaagg

SEQ ID NO: 315888 - DNA, 16 bp, C. familiaris
ctgagggaaataagtc

SEQ ID NO: 315889 - DNA, 16 bp, C. familiaris
ctgagggacacagaga

SEQ ID NO: 315890 - DNA, 16 bp, C. familiaris
ctgagggagaaggaag

SEQ ID NO: 315891 - DNA, 16 bp, C. familiaris
ctgagggagagagaga

SEQ ID NO: 315892 - DNA, 16 bp, C. familiaris
ctgagggagaggcaga

SEQ ID NO: 315893 - DNA, 16 bp, C. familiaris
ctgagggaggaggagc

SEQ ID NO: 315894 - DNA, 16 bp, C. familiaris
ctgagggaggaggagg

SEQ ID NO: 315895 - DNA, 16 bp, C. familiaris
ctgagggaggccctga

SEQ ID NO: 315896 - DNA, 16 bp, C. familiaris
ctgagggcagagcctg

SEQ ID NO: 315897 - DNA, 16 bp, C. familiaris
ctgagggcagcccagg

SEQ ID NO: 315898 - DNA, 16 bp, C. familiaris
ctgagggcagcctggg

SEQ ID NO: 315899 - DNA, 16 bp, C. familiaris
ctgagggttttttttt

SEQ ID NO: 315900 - DNA, 16 bp, C. familiaris
ctgaggtcatggtctc

SEQ ID NO: 315901 - DNA, 16 bp, C. familiaris
ctgaggtgaagacaga

SEQ ID NO: 315902 - DNA, 16 bp, C. familiaris
ctgaggtgaaggcaga

SEQ ID NO: 315903 - DNA, 16 bp, C. familiaris
ctgagtagttgcaaca

SEQ ID NO: 315904 - DNA, 16 bp, C. familiaris
ctgagtcaaaagcaga

SEQ ID NO: 315905 - DNA, 16 bp, C. familiaris
ctgagtcaaaattaag

SEQ ID NO: 315906 - DNA, 16 bp, C. familiaris
ctgagtcaccctggtg

SEQ ID NO: 315907 - DNA, 16 bp, C. familiaris
ctgagtcactcaagtg

SEQ ID NO: 315908 - DNA, 16 bp, C. familiaris
ctgagtcaggctccat

SEQ ID NO: 315909 - DNA, 16 bp, C. familiaris
ctgagtgaagagccca

SEQ ID NO: 315910 - DNA, 16 bp, C. familiaris
ctgagtgaggagccca

SEQ ID NO: 315911 - DNA, 16 bp, C. familiaris
ctgagtgccaggcact

SEQ ID NO: 315912 - DNA, 16 bp, C. familiaris
ctgagtggctcagcga

SEQ ID NO: 315913 - DNA, 16 bp, C. familiaris
ctgagtggctcattca

SEQ ID NO: 315914 - DNA, 16 bp, C. familiaris
ctgagtggcttaagca

SEQ ID NO: 315915 - DNA, 16 bp, C. familiaris
ctgagtggggagctca

SEQ ID NO: 315916 - DNA, 16 bp, C. familiaris
ctgagtgtggaccctg

SEQ ID NO: 315917 - DNA, 16 bp, C. familiaris
ctgagtgtggagccag

SEQ ID NO: 315918 - DNA, 16 bp, C. familiaris
ctgagtgtggagcctg

SEQ ID NO: 315919 - DNA, 16 bp, C. familiaris
ctgagttcaaattcca

SEQ ID NO: 315920 - DNA, 16 bp, C. familiaris
ctgagttcatgaccta

SEQ ID NO: 315921 - DNA, 16 bp, C. familiaris
ctgataaagggtatct

SEQ ID NO: 315922 - DNA, 16 bp, C. familiaris
ctgataacttccctaa

SEQ ID NO: 315923 - DNA, 16 bp, C. familiaris
ctgatatttcccaatc

SEQ ID NO: 315924 - DNA, 38 bp, C. familiaris
ctgatcaaaactcttcagagtgtagggatagagggaac

SEQ ID NO: 315925 - DNA, 16 bp, C. familiaris
ctgatccaaagacaga

SEQ ID NO: 315926 - DNA, 16 bp, C. familiaris
ctgatccagtgtgtca

SEQ ID NO: 315927 - DNA, 16 bp, C. familiaris
ctgatcctggagaccc

SEQ ID NO: 315928 - DNA, 16 bp, C. familiaris
ctgatcctggggacca

SEQ ID NO: 315929 - DNA, 16 bp, C. familiaris
ctgatctgtgacccag

SEQ ID NO: 315930 - DNA, 16 bp, C. familiaris
ctgatcttaaggggaa

SEQ ID NO: 315931 - DNA, 16 bp, C. familiaris
ctgatgaaaaaaattg

SEQ ID NO: 315932 - DNA, 16 bp, C. familiaris
ctgatgaaagaaatta

SEQ ID NO: 315933 - DNA, 16 bp, C. familiaris
ctgatgaacatgggat

SEQ ID NO: 315934 - DNA, 16 bp, C. familiaris
ctgatgaaggactcaa

SEQ ID NO: 315935 - DNA, 16 bp, C. familiaris
ctgatgagcatggagc

SEQ ID NO: 315936 - DNA, 16 bp, C. familiaris
ctgatgagtgtggagc

SEQ ID NO: 315937 - DNA, 16 bp, C. familiaris
ctgatgatgagtggtg

SEQ ID NO: 315938 - DNA, 16 bp, C. familiaris
ctgatgcaaaaattct

SEQ ID NO: 315939 - DNA, 16 bp, C. familiaris
ctgatgcagggctcat

SEQ ID NO: 315940 - DNA, 16 bp, C. familiaris
ctgatgcagggtttga

SEQ ID NO: 315941 - DNA, 16 bp, C. familiaris
ctgatgccaagtgatg

SEQ ID NO: 315942 - DNA, 16 bp, C. familiaris
ctgatggggtgcctgg

SEQ ID NO: 315943 - DNA, 16 bp, C. familiaris
ctgatgtggaatttga

SEQ ID NO: 315944 - DNA, 16 bp, C. familiaris
ctgatgtggggtttga

SEQ ID NO: 315945 - DNA, 16 bp, C. familiaris
ctgatgtggtgcttga

SEQ ID NO: 315946 - DNA, 16 bp, C. familiaris
ctgattccaggtctgg

SEQ ID NO: 315947 - DNA, 16 bp, C. familiaris
ctgattctgcttttgt

SEQ ID NO: 315948 - DNA, 16 bp, C. familiaris
ctgattctttgaaaag

SEQ ID NO: 315949 - DNA, 16 bp, C. familiaris
ctgattgagccagtca

SEQ ID NO: 315950 - DNA, 16 bp, C. familiaris
ctgattgctgagggct

SEQ ID NO: 315951 - DNA, 16 bp, C. familiaris
ctgattgctgtggcta

SEQ ID NO: 315952 - DNA, 16 bp, C. familiaris
ctgattgggagaagat

SEQ ID NO: 315953 - DNA, 16 bp, C. familiaris
ctgatttaggctcagg

SEQ ID NO: 315954 - DNA, 16 bp, C. familiaris
ctgatttcattctttt

SEQ ID NO: 315955 - DNA, 16 bp, C. familiaris
ctgatttccagagttg

SEQ ID NO: 315956 - DNA, 16 bp, C. familiaris
ctgatttcttggttga

SEQ ID NO: 315957 - DNA, 16 bp, C. familiaris
ctgattttgaaaaaaa

SEQ ID NO: 315958 - DNA, 16 bp, C. familiaris
ctgcaaaaagggagag

SEQ ID NO: 315959 - DNA, 16 bp, C. familiaris
ctgcaaagctgaaaat

SEQ ID NO: 315960 - DNA, 16 bp, C. familiaris
ctgcaaagcttcagct

SEQ ID NO: 315961 - DNA, 16 bp, C. familiaris
ctgcaaagtgaaggaa

SEQ ID NO: 315962 - DNA, 16 bp, C. familiaris
ctgcaaatatttattg

SEQ ID NO: 315963 - DNA, 16 bp, C. familiaris
ctgcaacccaatgttt

SEQ ID NO: 315964 - DNA, 16 bp, C. familiaris
ctgcaagggaagctgg

SEQ ID NO: 315965 - DNA, 16 bp, C. familiaris
ctgcaagggagactgg

SEQ ID NO: 315966 - DNA, 16 bp, C. familiaris
ctgcaaggggcctgct

SEQ ID NO: 315967 - DNA, 16 bp, C. familiaris
ctgcacagaaaaagaa

SEQ ID NO: 315968 - DNA, 16 bp, C. familiaris
ctgcacagctcggggc

SEQ ID NO: 315969 - DNA, 16 bp, C. familiaris
ctgcaccaccaccacc

SEQ ID NO: 315970 - DNA, 16 bp, C. familiaris
ctgcaccagcttgcat

SEQ ID NO: 315971 - DNA, 16 bp, C. familiaris
ctgcaccaggctgggg

SEQ ID NO: 315972 - DNA, 16 bp, C. familiaris
ctgcaccccgaagttt

SEQ ID NO: 315973 - DNA, 16 bp, C. familiaris
ctgcaccctctgctcc

SEQ ID NO: 315974 - DNA, 16 bp, C. familiaris
ctgcacctcctcctgc

SEQ ID NO: 315975 - DNA, 16 bp, C. familiaris
ctgcacctgcccctcc

SEQ ID NO: 315976 - DNA, 16 bp, C. familiaris
ctgcacctgcgcctgc

SEQ ID NO: 315977 - DNA, 16 bp, C. familiaris
ctgcacctgctcctgg

SEQ ID NO: 315978 - DNA, 16 bp, C. familiaris
ctgcacctgctgcacc

SEQ ID NO: 315979 - DNA, 16 bp, C. familiaris
ctgcacctggcagggg

SEQ ID NO: 315980 - DNA, 16 bp, C. familiaris
ctgcactactgggtat

SEQ ID NO: 315981 - DNA, 16 bp, C. familiaris
ctgcactgagcctgga

SEQ ID NO: 315982 - DNA, 16 bp, C. familiaris
ctgcactggattcttc

SEQ ID NO: 315983 - DNA, 16 bp, C. familiaris
ctgcactgggctctgt

SEQ ID NO: 315984 - DNA, 16 bp, C. familiaris
ctgcacttggcaggga

SEQ ID NO: 315985 - DNA, 16 bp, C. familiaris
ctgcagaactctctgg

SEQ ID NO: 315986 - DNA, 16 bp, C. familiaris
ctgcagaagaaaagtt

SEQ ID NO: 315987 - DNA, 16 bp, C. familiaris
ctgcagagagcctgcc

SEQ ID NO: 315988 - DNA, 16 bp, C. familiaris
ctgcagaggcagaggg

SEQ ID NO: 315989 - DNA, 16 bp, C. familiaris
ctgcagcaagttatcc

SEQ ID NO: 315990 - DNA, 16 bp, C. familiaris
ctgcagcagcagcagc

SEQ ID NO: 315991 - DNA, 16 bp, C. familiaris
ctgcagcccagggcct

SEQ ID NO: 315992 - DNA, 16 bp, C. familiaris
ctgcagccccagctcc

SEQ ID NO: 315993 - DNA, 16 bp, C. familiaris
ctgcagccccagctga

SEQ ID NO: 315994 - DNA, 16 bp, C. familiaris
ctgcagccccttccct

SEQ ID NO: 315995 - DNA, 16 bp, C. familiaris
ctgcagccgccgccgc

SEQ ID NO: 315996 - DNA, 16 bp, C. familiaris
ctgcagctccccctgc

SEQ ID NO: 315997 - DNA, 16 bp, C. familiaris
ctgcagctctccctgc

SEQ ID NO: 315998 - DNA, 16 bp, C. familiaris
ctgcaggatcatgacc

SEQ ID NO: 315999 - DNA, 16 bp, C. familiaris
ctgcaggcccagctgc

SEQ ID NO: 316000 - DNA, 16 bp, C. familiaris
ctgcaggcggagctaa

SEQ ID NO: 316001 - DNA, 16 bp, C. familiaris
ctgcagggacacctgg

SEQ ID NO: 316002 - DNA, 16 bp, C. familiaris
ctgcagggaccccaat

SEQ ID NO: 316003 - DNA, 16 bp, C. familiaris
ctgcagggaccctgct

SEQ ID NO: 316004 - DNA, 16 bp, C. familiaris
ctgcagggagagcctg

SEQ ID NO: 316005 - DNA, 16 bp, C. familiaris
ctgcagggcagcccgg

SEQ ID NO: 316006 - DNA, 16 bp, C. familiaris
ctgcagggccctgggg

SEQ ID NO: 316007 - DNA, 16 bp, C. familiaris
ctgcagggcgggagcg

SEQ ID NO: 316008 - DNA, 16 bp, C. familiaris
ctgcaggggctgtggg

SEQ ID NO: 316009 - DNA, 16 bp, C. familiaris
ctgcaggtgattctga

SEQ ID NO: 316010 - DNA, 16 bp, C. familiaris
ctgcagtcagaccaga

SEQ ID NO: 316011 - DNA, 16 bp, C. familiaris
ctgcagtgacttcctc

SEQ ID NO: 316012 - DNA, 16 bp, C. familiaris
ctgcagtgggcagtgt

SEQ ID NO: 316013 - DNA, 16 bp, C. familiaris
ctgcatcaattgatat

SEQ ID NO: 316014 - DNA, 16 bp, C. familiaris
ctgcatcaggatccct

SEQ ID NO: 316015 - DNA, 16 bp, C. familiaris
ctgcatccagctcccc

SEQ ID NO: 316016 - DNA, 16 bp, C. familiaris
ctgcatccagctctgt

SEQ ID NO: 316017 - DNA, 16 bp, C. familiaris
ctgcatccttgccaat

SEQ ID NO: 316018 - DNA, 16 bp, C. familiaris
ctgcatctctacctct

SEQ ID NO: 316019 - DNA, 16 bp, C. familiaris
ctgcatctgtaaaatg

SEQ ID NO: 316020 - DNA, 16 bp, C. familiaris
ctgcatcttcaccaac

SEQ ID NO: 316021 - DNA, 16 bp, C. familiaris
ctgcatgaggcctgct

SEQ ID NO: 316022 - DNA, 16 bp, C. familiaris
ctgcatggaccctgct

SEQ ID NO: 316023 - DNA, 16 bp, C. familiaris
ctgcattgggctccac

SEQ ID NO: 316024 - DNA, 16 bp, C. familiaris
ctgccacagctccagg

SEQ ID NO: 316025 - DNA, 16 bp, C. familiaris
ctgccaccactgccac

SEQ ID NO: 316026 - DNA, 16 bp, C. familiaris
ctgccacccaggtgcc

SEQ ID NO: 316027 - DNA, 16 bp, C. familiaris
ctgccagccagccagc

SEQ ID NO: 316028 - DNA, 16 bp, C. familiaris
ctgccaggtctccgtg

SEQ ID NO: 316029 - DNA, 16 bp, C. familiaris
ctgccatcttccctgg

SEQ ID NO: 316030 - DNA, 16 bp, C. familiaris
ctgccatcttgcccct

SEQ ID NO: 316031 - DNA, 16 bp, C. familiaris
ctgccatcttgctcct

SEQ ID NO: 316032 - DNA, 16 bp, C. familiaris
ctgccattccccctgc

SEQ ID NO: 316033 - DNA, 16 bp, C. familiaris
ctgccatttttatttt

SEQ ID NO: 316034 - DNA, 16 bp, C. familiaris
ctgcccacacccctgc

SEQ ID NO: 316035 - DNA, 16 bp, C. familiaris
ctgcccacagcaggca

SEQ ID NO: 316036 - DNA, 16 bp, C. familiaris
ctgcccacagggagcc

SEQ ID NO: 316037 - DNA, 16 bp, C. familiaris
ctgcccacctcccttt

SEQ ID NO: 316038 - DNA, 16 bp, C. familiaris
ctgcccagcccccagc

SEQ ID NO: 316039 - DNA, 16 bp, C. familiaris
ctgcccagcccctggc

SEQ ID NO: 316040 - DNA, 16 bp, C. familiaris
ctgcccagggccctgg

SEQ ID NO: 316041 - DNA, 16 bp, C. familiaris
ctgcccatctccccac

SEQ ID NO: 316042 - DNA, 16 bp, C. familiaris
ctgccccactccctgc

SEQ ID NO: 316043 - DNA, 16 bp, C. familiaris
ctgccccagaagacca

SEQ ID NO: 316044 - DNA, 16 bp, C. familiaris
ctgccccagcccagcc

SEQ ID NO: 316045 - DNA, 16 bp, C. familiaris
ctgccccagccctggg

SEQ ID NO: 316046 - DNA, 16 bp, C. familiaris
ctgccccagcctggcc

SEQ ID NO: 316047 - DNA, 16 bp, C. familiaris
ctgccccagctcctgc

SEQ ID NO: 316048 - DNA, 16 bp, C. familiaris
ctgccccaggccctcc

SEQ ID NO: 316049 - DNA, 16 bp, C. familiaris
ctgccccaggccctgc

SEQ ID NO: 316050 - DNA, 16 bp, C. familiaris
ctgcccccacctgctc

SEQ ID NO: 316051 - DNA, 16 bp, C. familiaris
ctgcccccagcccagg

SEQ ID NO: 316052 - DNA, 16 bp, C. familiaris
ctgcccccaggcccca

SEQ ID NO: 316053 - DNA, 16 bp, C. familiaris
ctgccccccacacaca

SEQ ID NO: 316054 - DNA, 16 bp, C. familiaris
ctgccccccacccagg

SEQ ID NO: 316055 - DNA, 16 bp, C. familiaris
ctgccccctccccagg

SEQ ID NO: 316056 - DNA, 16 bp, C. familiaris
ctgccccctgagcagg

SEQ ID NO: 316057 - DNA, 16 bp, C. familiaris
ctgccccctgccccag

SEQ ID NO: 316058 - DNA, 16 bp, C. familiaris
ctgcccctacccctgc

SEQ ID NO: 316059 - DNA, 16 bp, C. familiaris
ctgcccctcaccctgc

SEQ ID NO: 316060 - DNA, 16 bp, C. familiaris
ctgcccctccacctca

SEQ ID NO: 316061 - DNA, 16 bp, C. familiaris
ctgcccctcccacctg

SEQ ID NO: 316062 - DNA, 16 bp, C. familiaris
ctgcccctcccactct

SEQ ID NO: 316063 - DNA, 16 bp, C. familiaris
ctgcccctccccacag

SEQ ID NO: 316064 - DNA, 16 bp, C. familiaris
ctgcccctccccactt

SEQ ID NO: 316065 - DNA, 16 bp, C. familiaris
ctgcccctccccagct

SEQ ID NO: 316066 - DNA, 16 bp, C. familiaris
ctgcccctccctggct

SEQ ID NO: 316067 - DNA, 16 bp, C. familiaris
ctgcccctcctgctgg

SEQ ID NO: 316068 - DNA, 16 bp, C. familiaris
ctgcccctcctgctgt

SEQ ID NO: 316069 - DNA, 16 bp, C. familiaris
ctgcccctctccccat

SEQ ID NO: 316070 - DNA, 16 bp, C. familiaris
ctgcccctctctcagt

SEQ ID NO: 316071 - DNA, 16 bp, C. familiaris
ctgcccctctctccat

SEQ ID NO: 316072 - DNA, 16 bp, C. familiaris
ctgcccctctctctgg

SEQ ID NO: 316073 - DNA, 16 bp, C. familiaris
ctgcccctgcccactg

SEQ ID NO: 316074 - DNA, 16 bp, C. familiaris
ctgcccctgcccctca

SEQ ID NO: 316075 - DNA, 16 bp, C. familiaris
ctgcccctgcctccac

SEQ ID NO: 316076 - DNA, 16 bp, C. familiaris
ctgcccctgcctctgc

SEQ ID NO: 316077 - DNA, 16 bp, C. familiaris
ctgcccctgctccctg

SEQ ID NO: 316078 - DNA, 16 bp, C. familiaris
ctgcccctgctcctgt

SEQ ID NO: 316079 - DNA, 16 bp, C. familiaris
ctgcccctggccctgg

SEQ ID NO: 316080 - DNA, 16 bp, C. familiaris
ctgcccctgtccccac

SEQ ID NO: 316081 - DNA, 16 bp, C. familiaris
ctgccccttcccacca

SEQ ID NO: 316082 - DNA, 16 bp, C. familiaris
ctgccccttcccactc

SEQ ID NO: 316083 - DNA, 16 bp, C. familiaris
ctgccccttctcccca

SEQ ID NO: 316084 - DNA, 16 bp, C. familiaris
ctgcccgagcccggcc

SEQ ID NO: 316085 - DNA, 16 bp, C. familiaris
ctgcccggggcccagg

SEQ ID NO: 316086 - DNA, 16 bp, C. familiaris
ctgccctcaggaagct

SEQ ID NO: 316087 - DNA, 16 bp, C. familiaris
ctgccctcatgaagct

SEQ ID NO: 316088 - DNA, 16 bp, C. familiaris
ctgccctcctcctcca

SEQ ID NO: 316089 - DNA, 16 bp, C. familiaris
ctgccctcctgccctg

SEQ ID NO: 316090 - DNA, 16 bp, C. familiaris
ctgccctcggcccagg

SEQ ID NO: 316091 - DNA, 16 bp, C. familiaris
ctgccctctgccctgc

SEQ ID NO: 316092 - DNA, 16 bp, C. familiaris
ctgccctgcccagccc

SEQ ID NO: 316093 - DNA, 16 bp, C. familiaris
ctgccctgcccctgct

SEQ ID NO: 316094 - DNA, 16 bp, C. familiaris
ctgccctgccctggcc

SEQ ID NO: 316095 - DNA, 16 bp, C. familiaris
ctgccctgctggcccc

SEQ ID NO: 316096 - DNA, 16 bp, C. familiaris
ctgccctggcccagcc

SEQ ID NO: 316097 - DNA, 16 bp, C. familiaris
ctgccctgggcatgga

SEQ ID NO: 316098 - DNA, 16 bp, C. familiaris
ctgccctgggcccagg

SEQ ID NO: 316099 - DNA, 16 bp, C. familiaris
ctgccctgggccctgg

SEQ ID NO: 316100 - DNA, 16 bp, C. familiaris
ctgccctgggctccct

SEQ ID NO: 316101 - DNA, 16 bp, C. familiaris
ctgccctggggccctg

SEQ ID NO: 316102 - DNA, 16 bp, C. familiaris
ctgccctgtcccctgc

SEQ ID NO: 316103 - DNA, 16 bp, C. familiaris
ctgccctgtgccctcc

SEQ ID NO: 316104 - DNA, 16 bp, C. familiaris
ctgcccttccacctgc

SEQ ID NO: 316105 - DNA, 16 bp, C. familiaris
ctgcccttcccctcca

SEQ ID NO: 316106 - DNA, 16 bp, C. familiaris
ctgcccttcctcccat

SEQ ID NO: 316107 - DNA, 16 bp, C. familiaris
ctgcccttcctgctca

SEQ ID NO: 316108 - DNA, 16 bp, C. familiaris
ctgcccttcctgctgc

SEQ ID NO: 316109 - DNA, 16 bp, C. familiaris
ctgccgctgccgctgc

SEQ ID NO: 316110 - DNA, 16 bp, C. familiaris
ctgccgctgggcgccc

SEQ ID NO: 316111 - DNA, 17 bp, C. familiaris
ctgccgtcagcccaggg

SEQ ID NO: 316112 - DNA, 16 bp, C. familiaris
ctgcctacattccttg

SEQ ID NO: 316113 - DNA, 16 bp, C. familiaris
ctgcctaggtttctgc

SEQ ID NO: 316114 - DNA, 16 bp, C. familiaris
ctgcctatgtttctgc

SEQ ID NO: 316115 - DNA, 16 bp, C. familiaris
ctgcctcaaggccttt

SEQ ID NO: 316116 - DNA, 16 bp, C. familiaris
ctgcctcagtttctcc

SEQ ID NO: 316117 - DNA, 16 bp, C. familiaris
ctgcctccaccaccac

SEQ ID NO: 316118 - DNA, 16 bp, C. familiaris
ctgcctccagaactgt

SEQ ID NO: 316119 - DNA, 16 bp, C. familiaris
ctgcctccagcccctg

SEQ ID NO: 316120 - DNA, 16 bp, C. familiaris
ctgcctccccagggcc

SEQ ID NO: 316121 - DNA, 16 bp, C. familiaris
ctgcctccctgcctgc

SEQ ID NO: 316122 - DNA, 16 bp, C. familiaris
ctgcctccctgtgtgt

SEQ ID NO: 316123 - DNA, 16 bp, C. familiaris
ctgcctcctggcctcc

SEQ ID NO: 316124 - DNA, 16 bp, C. familiaris
ctgcctcctggggctg

SEQ ID NO: 316125 - DNA, 16 bp, C. familiaris
ctgcctctcactctct

SEQ ID NO: 316126 - DNA, 16 bp, C. familiaris
ctgcctctccccactg

SEQ ID NO: 316127 - DNA, 16 bp, C. familiaris
ctgcctctcccctcac

SEQ ID NO: 316128 - DNA, 16 bp, C. familiaris
ctgcctctcctgcttc

SEQ ID NO: 316129 - DNA, 16 bp, C. familiaris
ctgcctctctccatct

SEQ ID NO: 316130 - DNA, 16 bp, C. familiaris
ctgcctctctccccca

SEQ ID NO: 316131 - DNA, 16 bp, C. familiaris
ctgcctctctctctgt

SEQ ID NO: 316132 - DNA, 16 bp, C. familiaris
ctgcctctctctgcct

SEQ ID NO: 316133 - DNA, 16 bp, C. familiaris
ctgcctctctgtgtcg

SEQ ID NO: 316134 - DNA, 16 bp, C. familiaris
ctgcctctgcagctcc

SEQ ID NO: 316135 - DNA, 16 bp, C. familiaris
ctgcctctgcccccca

SEQ ID NO: 316136 - DNA, 16 bp, C. familiaris
ctgcctctgccctgct

SEQ ID NO: 316137 - DNA, 16 bp, C. familiaris
ctgcctctgcctccac

SEQ ID NO: 316138 - DNA, 16 bp, C. familiaris
ctgcctctgcctccag

SEQ ID NO: 316139 - DNA, 16 bp, C. familiaris
ctgcctctgcctgtct

SEQ ID NO: 316140 - DNA, 17 bp, C. familiaris
ctgcctctgcctgtgtc

SEQ ID NO: 316141 - DNA, 16 bp, C. familiaris
ctgcctctgctcctct

SEQ ID NO: 316142 - DNA, 16 bp, C. familiaris
ctgcctctgctcctgc

SEQ ID NO: 316143 - DNA, 16 bp, C. familiaris
ctgcctctgctcttcc

SEQ ID NO: 316144 - DNA, 16 bp, C. familiaris
ctgcctctgctgctcc

SEQ ID NO: 316145 - DNA, 16 bp, C. familiaris
ctgcctctgctgctgc

SEQ ID NO: 316146 - DNA, 16 bp, C. familiaris
ctgcctctgcttgtgt

SEQ ID NO: 316147 - DNA, 16 bp, C. familiaris
ctgcctctgtctcttt

SEQ ID NO: 316148 - DNA, 16 bp, C. familiaris
ctgcctctgtcttccc

SEQ ID NO: 316149 - DNA, 16 bp, C. familiaris
ctgcctctgtgtctgt

SEQ ID NO: 316150 - DNA, 16 bp, C. familiaris
ctgcctctgtgtgcct

SEQ ID NO: 316151 - DNA, 16 bp, C. familiaris
ctgcctctgttctcct

SEQ ID NO: 316152 - DNA, 16 bp, C. familiaris
ctgcctctgtttctgt

SEQ ID NO: 316153 - DNA, 16 bp, C. familiaris
ctgcctcttccaggaa

SEQ ID NO: 316154 - DNA, 16 bp, C. familiaris
ctgcctcttccctggc

SEQ ID NO: 316155 - DNA, 16 bp, C. familiaris
ctgcctctttctctgc

SEQ ID NO: 316156 - DNA, 16 bp, C. familiaris
ctgcctgagctgctcc

SEQ ID NO: 316157 - DNA, 16 bp, C. familiaris
ctgcctgcacctgccc

SEQ ID NO: 316158 - DNA, 16 bp, C. familiaris
ctgcctgcagctctgc

SEQ ID NO: 316159 - DNA, 16 bp, C. familiaris
ctgcctgccactgccc

SEQ ID NO: 316160 - DNA, 16 bp, C. familiaris
ctgcctgccattctgc

SEQ ID NO: 316161 - DNA, 16 bp, C. familiaris
ctgcctgccccagccc

SEQ ID NO: 316162 - DNA, 16 bp, C. familiaris
ctgcctgccctcccca

SEQ ID NO: 316163 - DNA, 16 bp, C. familiaris
ctgcctgcctcccacc

SEQ ID NO: 316164 - DNA, 16 bp, C. familiaris
ctgcctgcctctgcct

SEQ ID NO: 316165 - DNA, 16 bp, C. familiaris
ctgcctgcctgcccac

SEQ ID NO: 316166 - DNA, 16 bp, C. familiaris
ctgcctgcctgccctc

SEQ ID NO: 316167 - DNA, 16 bp, C. familiaris
ctgcctgcctgccctg

SEQ ID NO: 316168 - DNA, 16 bp, C. familiaris
ctgcctgcctgcctcc

SEQ ID NO: 316169 - DNA, 16 bp, C. familiaris
ctgcctgcctgcctgc

SEQ ID NO: 316170 - DNA, 16 bp, C. familiaris
ctgcctgcctgcctgt

SEQ ID NO: 316171 - DNA, 16 bp, C. familiaris
ctgcctgcgcctctgc

SEQ ID NO: 316172 - DNA, 16 bp, C. familiaris
ctgcctgctgccctcc

SEQ ID NO: 316173 - DNA, 16 bp, C. familiaris
ctgcctgctgcttctc

SEQ ID NO: 316174 - DNA, 16 bp, C. familiaris
ctgcctggaatgctct

SEQ ID NO: 316175 - DNA, 16 bp, C. familiaris
ctgcctggaggaggag

SEQ ID NO: 316176 - DNA, 16 bp, C. familiaris
ctgcctggccctgggg

SEQ ID NO: 316177 - DNA, 16 bp, C. familiaris
ctgcctggcctggcct

SEQ ID NO: 316178 - DNA, 16 bp, C. familiaris
ctgcctggctcagtgg

SEQ ID NO: 316179 - DNA, 16 bp, C. familiaris
ctgcctggggcccagg

SEQ ID NO: 316180 - DNA, 16 bp, C. familiaris
ctgcctggggctgggg

SEQ ID NO: 316181 - DNA, 16 bp, C. familiaris
ctgcctgtattccttg

SEQ ID NO: 316182 - DNA, 16 bp, C. familiaris
ctgcctgtcccagggg

SEQ ID NO: 316183 - DNA, 16 bp, C. familiaris
ctgcctgtctctgctc

SEQ ID NO: 316184 - DNA, 16 bp, C. familiaris
ctgcctgtctctgtgc

SEQ ID NO: 316185 - DNA, 16 bp, C. familiaris
ctgcctgtgcctctgg

SEQ ID NO: 316186 - DNA, 16 bp, C. familiaris
ctgcctgtggcccagg

SEQ ID NO: 316187 - DNA, 16 bp, C. familiaris
ctgcctgtgtcctctg

SEQ ID NO: 316188 - DNA, 16 bp, C. familiaris
ctgcctgtgtctgcct

SEQ ID NO: 316189 - DNA, 16 bp, C. familiaris
ctgcctgtgtctgtct

SEQ ID NO: 316190 - DNA, 16 bp, C. familiaris
ctgccttcaaagagct

SEQ ID NO: 316191 - DNA, 16 bp, C. familiaris
ctgccttcacccaggg

SEQ ID NO: 316192 - DNA, 16 bp, C. familiaris
ctgccttcagccaggg

SEQ ID NO: 316193 - DNA, 16 bp, C. familiaris
ctgccttcagctttgg

SEQ ID NO: 316194 - DNA, 16 bp, C. familiaris
ctgccttcatcttcat

SEQ ID NO: 316195 - DNA, 16 bp, C. familiaris
ctgccttcccctcagg

SEQ ID NO: 316196 - DNA, 16 bp, C. familiaris
ctgccttcggcttagg

SEQ ID NO: 316197 - DNA, 16 bp, C. familiaris
ctgccttcgggcccag

SEQ ID NO: 316198 - DNA, 16 bp, C. familiaris
ctgccttctctccagg

SEQ ID NO: 316199 - DNA, 16 bp, C. familiaris
ctgccttctctctgtc

SEQ ID NO: 316200 - DNA, 16 bp, C. familiaris
ctgccttctgccctgg

SEQ ID NO: 316201 - DNA, 16 bp, C. familiaris
ctgccttctgcctggg

SEQ ID NO: 316202 - DNA, 16 bp, C. familiaris
ctgccttctgctcaag

SEQ ID NO: 316203 - DNA, 16 bp, C. familiaris
ctgccttctgctgagg

SEQ ID NO: 316204 - DNA, 16 bp, C. familiaris
ctgccttggacccagg

SEQ ID NO: 316205 - DNA, 16 bp, C. familiaris
ctgcctttcacccagg

SEQ ID NO: 316206 - DNA, 16 bp, C. familiaris
ctgcctttctctgcct

SEQ ID NO: 316207 - DNA, 16 bp, C. familiaris
ctgcctttgactctgg

SEQ ID NO: 316208 - DNA, 16 bp, C. familiaris
ctgcctttgccccagg

SEQ ID NO: 316209 - DNA, 16 bp, C. familiaris
ctgcctttggcacagg

SEQ ID NO: 316210 - DNA, 16 bp, C. familiaris
ctgcctttggccaagg

SEQ ID NO: 316211 - DNA, 17 bp, C. familiaris
ctgcctttggcccaggg

SEQ ID NO: 316212 - DNA, 16 bp, C. familiaris
ctgcctttggctcagg

SEQ ID NO: 316213 - DNA, 16 bp, C. familiaris
ctgcctttgtctcttc

SEQ ID NO: 316214 - DNA, 16 bp, C. familiaris
ctgcctttgtgtctgc

SEQ ID NO: 316215 - DNA, 16 bp, C. familiaris
ctgccttttcattttg

SEQ ID NO: 316216 - DNA, 16 bp, C. familiaris
ctgccttttcctctgc

SEQ ID NO: 316217 - DNA, 16 bp, C. familiaris
ctgccttttttaaaaa

SEQ ID NO: 316218 - DNA, 17 bp, C. familiaris
ctgcggcacccagggat

SEQ ID NO: 316219 - DNA, 19 bp, C. familiaris
ctgcgggagctgactccag

SEQ ID NO: 316220 - DNA, 16 bp, C. familiaris
ctgctaaaaggtgaaa

SEQ ID NO: 316221 - DNA, 16 bp, C. familiaris
ctgctaagcacctttc

SEQ ID NO: 316222 - DNA, 16 bp, C. familiaris
ctgctaagccacctgg

SEQ ID NO: 316223 - DNA, 16 bp, C. familiaris
ctgctaagctacccag

SEQ ID NO: 316224 - DNA, 16 bp, C. familiaris
ctgctacaaagaagac

SEQ ID NO: 316225 - DNA, 16 bp, C. familiaris
ctgctaccaccaccac

SEQ ID NO: 316226 - DNA, 16 bp, C. familiaris
ctgctacttcccctgc

SEQ ID NO: 316227 - DNA, 16 bp, C. familiaris
ctgctcaacatcctac

SEQ ID NO: 316228 - DNA, 16 bp, C. familiaris
ctgctcaagattctcc

SEQ ID NO: 316229 - DNA, 16 bp, C. familiaris
ctgctcaatgaggagt

SEQ ID NO: 316230 - DNA, 16 bp, C. familiaris
ctgctcaatggagagt

SEQ ID NO: 316231 - DNA, 16 bp, C. familiaris
ctgctcagatgtcacc

SEQ ID NO: 316232 - DNA, 16 bp, C. familiaris
ctgctcagccacctgg

SEQ ID NO: 316233 - DNA, 16 bp, C. familiaris
ctgctcagcccctgcc

SEQ ID NO: 316234 - DNA, 16 bp, C. familiaris
ctgctcagcgtggagc

SEQ ID NO: 316235 - DNA, 16 bp, C. familiaris
ctgctcagctccgggc

SEQ ID NO: 316236 - DNA, 16 bp, C. familiaris
ctgctcaggagggagc

SEQ ID NO: 316237 - DNA, 16 bp, C. familiaris
ctgctcaggctgctgt

SEQ ID NO: 316238 - DNA, 16 bp, C. familiaris
ctgctcagggaggagc

SEQ ID NO: 316239 - DNA, 16 bp, C. familiaris
ctgctcagggggaagt

SEQ ID NO: 316240 - DNA, 16 bp, C. familiaris
ctgctcagtgaagagc

SEQ ID NO: 316241 - DNA, 16 bp, C. familiaris
ctgctcagtggagaga

SEQ ID NO: 316242 - DNA, 16 bp, C. familiaris
ctgctcagtgggcagt

SEQ ID NO: 316243 - DNA, 16 bp, C. familiaris
ctgctcagtggggtgc

SEQ ID NO: 316244 - DNA, 16 bp, C. familiaris
ctgctcagtggggtgt

SEQ ID NO: 316245 - DNA, 16 bp, C. familiaris
ctgctcatcatcctgg

SEQ ID NO: 316246 - DNA, 16 bp, C. familiaris
ctgctcatgcacatgc

SEQ ID NO: 316247 - DNA, 16 bp, C. familiaris
ctgctccaaggacaca

SEQ ID NO: 316248 - DNA, 16 bp, C. familiaris
ctgctccacctccctg

SEQ ID NO: 316249 - DNA, 16 bp, C. familiaris
ctgctccagctccctg

SEQ ID NO: 316250 - DNA, 16 bp, C. familiaris
ctgctccaggccctgg

SEQ ID NO: 316251 - DNA, 16 bp, C. familiaris
ctgctccatggagagc

SEQ ID NO: 316252 - DNA, 16 bp, C. familiaris
ctgctccccacccctg

SEQ ID NO: 316253 - DNA, 16 bp, C. familiaris
ctgctcccccagcctc

SEQ ID NO: 316254 - DNA, 16 bp, C. familiaris
ctgctccctctgctca

SEQ ID NO: 316255 - DNA, 16 bp, C. familiaris
ctgctccctgcacccc

SEQ ID NO: 316256 - DNA, 16 bp, C. familiaris
ctgctccctggcagcc

SEQ ID NO: 316257 - DNA, 16 bp, C. familiaris
ctgctccgggtccccc

SEQ ID NO: 316258 - DNA, 16 bp, C. familiaris
ctgctcctcaccccac

SEQ ID NO: 316259 - DNA, 16 bp, C. familiaris
ctgctcctccacctgc

SEQ ID NO: 316260 - DNA, 16 bp, C. familiaris
ctgctcctccctctac

SEQ ID NO: 316261 - DNA, 16 bp, C. familiaris
ctgctcctcctcaccc

SEQ ID NO: 316262 - DNA, 16 bp, C. familiaris
ctgctcctcctctgct

SEQ ID NO: 316263 - DNA, 16 bp, C. familiaris
ctgctcctcctgcttg

SEQ ID NO: 316264 - DNA, 16 bp, C. familiaris
ctgctcctctctctgt

SEQ ID NO: 316265 - DNA, 16 bp, C. familiaris
ctgctcctgaaagtaa

SEQ ID NO: 316266 - DNA, 16 bp, C. familiaris
ctgctcctgcacctgc

SEQ ID NO: 316267 - DNA, 16 bp, C. familiaris
ctgctcctgcccccac

SEQ ID NO: 316268 - DNA, 16 bp, C. familiaris
ctgctcctgcccctgc

SEQ ID NO: 316269 - DNA, 16 bp, C. familiaris
ctgctcctgctcctgc

SEQ ID NO: 316270 - DNA, 16 bp, C. familiaris
ctgctcctgctccttc

SEQ ID NO: 316271 - DNA, 16 bp, C. familiaris
ctgctcctgggccttc

SEQ ID NO: 316272 - DNA, 16 bp, C. familiaris
ctgctcctggggcccc

SEQ ID NO: 316273 - DNA, 16 bp, C. familiaris
ctgctctcagcaggga

SEQ ID NO: 316274 - DNA, 16 bp, C. familiaris
ctgctctgcccctgcc

SEQ ID NO: 316275 - DNA, 16 bp, C. familiaris
ctgctctgcctcctgc

SEQ ID NO: 316276 - DNA, 16 bp, C. familiaris
ctgctctgctccagcc

SEQ ID NO: 316277 - DNA, 16 bp, C. familiaris
ctgctgaaaaattagc

SEQ ID NO: 316278 - DNA, 16 bp, C. familiaris
ctgctgaacaaggagc

SEQ ID NO: 316279 - DNA, 16 bp, C. familiaris
ctgctgaacaggaagc

SEQ ID NO: 316280 - DNA, 16 bp, C. familiaris
ctgctgagcaaggggc

SEQ ID NO: 316281 - DNA, 16 bp, C. familiaris
ctgctgagcagagccc

SEQ ID NO: 316282 - DNA, 16 bp, C. familiaris
ctgctgagcaggaacc

SEQ ID NO: 316283 - DNA, 16 bp, C. familiaris
ctgctgagcagggatt

SEQ ID NO: 316284 - DNA, 16 bp, C. familiaris
ctgctgagcatggaga

SEQ ID NO: 316285 - DNA, 16 bp, C. familiaris
ctgctgagcatggagg

SEQ ID NO: 316286 - DNA, 16 bp, C. familiaris
ctgctgagccaccttg

SEQ ID NO: 316287 - DNA, 16 bp, C. familiaris
ctgctgagccagaagc

SEQ ID NO: 316288 - DNA, 16 bp, C. familiaris
ctgctgagccaggagc

SEQ ID NO: 316289 - DNA, 16 bp, C. familiaris
ctgctgagcccccagg

SEQ ID NO: 316290 - DNA, 16 bp, C. familiaris
ctgctgagccccccca

SEQ ID NO: 316291 - DNA, 16 bp, C. familiaris
ctgctgagccccctgg

SEQ ID NO: 316292 - DNA, 16 bp, C. familiaris
ctgctgagcctggagc

SEQ ID NO: 316293 - DNA, 16 bp, C. familiaris
ctgctgagcggggagc

SEQ ID NO: 316294 - DNA, 16 bp, C. familiaris
ctgctgagctccccag

SEQ ID NO: 316295 - DNA, 16 bp, C. familiaris
ctgctgagcttggagc

SEQ ID NO: 316296 - DNA, 16 bp, C. familiaris
ctgctgagtgaggagc

SEQ ID NO: 316297 - DNA, 16 bp, C. familiaris
ctgctgagtgtggaga

SEQ ID NO: 316298 - DNA, 21 bp, C. familiaris
ctgctgcaagcccgtgtgctg

SEQ ID NO: 316299 - DNA, 16 bp, C. familiaris
ctgctgcaccaccagg

SEQ ID NO: 316300 - DNA, 16 bp, C. familiaris
ctgctgcaccacccag

SEQ ID NO: 316301 - DNA, 16 bp, C. familiaris
ctgctgcaccactggg

SEQ ID NO: 316302 - DNA, 16 bp, C. familiaris
ctgctgcacctgctgc

SEQ ID NO: 316303 - DNA, 16 bp, C. familiaris
ctgctgcatgccaggc

SEQ ID NO: 316304 - DNA, 16 bp, C. familiaris
ctgctgccaccaccac

SEQ ID NO: 316305 - DNA, 16 bp, C. familiaris
ctgctgccactgctgc

SEQ ID NO: 316306 - DNA, 16 bp, C. familiaris
ctgctgccccaggcct

SEQ ID NO: 316307 - DNA, 16 bp, C. familiaris
ctgctgcccctgctcc

SEQ ID NO: 316308 - DNA, 16 bp, C. familiaris
ctgctgcctcctgctg

SEQ ID NO: 316309 - DNA, 16 bp, C. familiaris
ctgctgcctctgcctc

SEQ ID NO: 316310 - DNA, 16 bp, C. familiaris
ctgctgcctgagggtc

SEQ ID NO: 316311 - DNA, 16 bp, C. familiaris
ctgctgccttcagctc

SEQ ID NO: 316312 - DNA, 16 bp, C. familiaris
ctgctgctacccctgc

SEQ ID NO: 316313 - DNA, 16 bp, C. familiaris
ctgctgctcccactgc

SEQ ID NO: 316314 - DNA, 16 bp, C. familiaris
ctgctgctcccccacc

SEQ ID NO: 316315 - DNA, 16 bp, C. familiaris
ctgctgctcccctggc

SEQ ID NO: 316316 - DNA, 16 bp, C. familiaris
ctgctgctcccgctgc

SEQ ID NO: 316317 - DNA, 16 bp, C. familiaris
ctgctgctccctgtgc

SEQ ID NO: 316318 - DNA, 16 bp, C. familiaris
ctgctgctccgcctgc

SEQ ID NO: 316319 - DNA, 16 bp, C. familiaris
ctgctgctcctcctgc

SEQ ID NO: 316320 - DNA, 16 bp, C. familiaris
ctgctgctcctgctcc

SEQ ID NO: 316321 - DNA, 16 bp, C. familiaris
ctgctgctcctgctgc

SEQ ID NO: 316322 - DNA, 16 bp, C. familiaris
ctgctgctcctgcttg

SEQ ID NO: 316323 - DNA, 16 bp, C. familiaris
ctgctgctccttctcc

SEQ ID NO: 316324 - DNA, 16 bp, C. familiaris
ctgctgctctccctct

SEQ ID NO: 316325 - DNA, 16 bp, C. familiaris
ctgctgctctctgtgt

SEQ ID NO: 316326 - DNA, 16 bp, C. familiaris
ctgctgctgcccctgc

SEQ ID NO: 316327 - DNA, 16 bp, C. familiaris
ctgctgctgcctctgc

SEQ ID NO: 316328 - DNA, 16 bp, C. familiaris
ctgctgctgctcctgc

SEQ ID NO: 316329 - DNA, 16 bp, C. familiaris
ctgctgctgctgccca

SEQ ID NO: 316330 - DNA, 16 bp, C. familiaris
ctgctgctgctgcctt

SEQ ID NO: 316331 - DNA, 16 bp, C. familiaris
ctgctgctgctgctag

SEQ ID NO: 316332 - DNA, 17 bp, C. familiaris
ctgctgctgctgctgca

SEQ ID NO: 316333 - DNA, 16 bp, C. familiaris
ctgctgctgctgctgg

SEQ ID NO: 316334 - DNA, 16 bp, C. familiaris
ctgctgctgctggggg

SEQ ID NO: 316335 - DNA, 16 bp, C. familiaris
ctgctgctgggcaccc

SEQ ID NO: 316336 - DNA, 16 bp, C. familiaris
ctgctgctgggcgccc

SEQ ID NO: 316337 - DNA, 16 bp, C. familiaris
ctgctgctgtgttttg

SEQ ID NO: 316338 - DNA, 16 bp, C. familiaris
ctgctgcttcctctgc

SEQ ID NO: 316339 - DNA, 16 bp, C. familiaris
ctgctgcttctgctgc

SEQ ID NO: 316340 - DNA, 16 bp, C. familiaris
ctgctgcttcttcttc

SEQ ID NO: 316341 - DNA, 16 bp, C. familiaris
ctgctggaagattctc

SEQ ID NO: 316342 - DNA, 16 bp, C. familiaris
ctgctggagactctct

SEQ ID NO: 316343 - DNA, 16 bp, C. familiaris
ctgctggagattctct

SEQ ID NO: 316344 - DNA, 16 bp, C. familiaris
ctgctggccacccagg

SEQ ID NO: 316345 - DNA, 16 bp, C. familiaris
ctgctggccatctgta

SEQ ID NO: 316346 - DNA, 16 bp, C. familiaris
ctgctggctttgaaga

SEQ ID NO: 316347 - DNA, 16 bp, C. familiaris
ctgctgggacacctgg

SEQ ID NO: 316348 - DNA, 16 bp, C. familiaris
ctgctgggccctgggg

SEQ ID NO: 316349 - DNA, 16 bp, C. familiaris
ctgctggggctgccat

SEQ ID NO: 316350 - DNA, 16 bp, C. familiaris
ctgctggtggctctgg

SEQ ID NO: 316351 - DNA, 16 bp, C. familiaris
ctgctggtgtgtgtgt

SEQ ID NO: 316352 - DNA, 16 bp, C. familiaris
ctgctgtcagaagccc

SEQ ID NO: 316353 - DNA, 16 bp, C. familiaris
ctgctgtcagctcagg

SEQ ID NO: 316354 - DNA, 16 bp, C. familiaris
ctgctgtgaacatgga

SEQ ID NO: 316355 - DNA, 16 bp, C. familiaris
ctgctgtgaacattca

SEQ ID NO: 316356 - DNA, 16 bp, C. familiaris
ctgctgtgcagggagc

SEQ ID NO: 316357 - DNA, 16 bp, C. familiaris
ctgctgtgtcctcagc

SEQ ID NO: 316358 - DNA, 16 bp, C. familiaris
ctgctgtgtgccagcc

SEQ ID NO: 316359 - DNA, 16 bp, C. familiaris
ctgcttatgtctctgc

SEQ ID NO: 316360 - DNA, 16 bp, C. familiaris
ctgcttcaccttctcc

SEQ ID NO: 316361 - DNA, 16 bp, C. familiaris
ctgcttcatcctctgc

SEQ ID NO: 316362 - DNA, 16 bp, C. familiaris
ctgcttcattattgct

SEQ ID NO: 316363 - DNA, 16 bp, C. familiaris
ctgcttcattgttagt

SEQ ID NO: 316364 - DNA, 16 bp, C. familiaris
ctgcttccagaccatg

SEQ ID NO: 316365 - DNA, 16 bp, C. familiaris
ctgcttcctctgctcc

SEQ ID NO: 316366 - DNA, 16 bp, C. familiaris
ctgcttcgtcctctgc

SEQ ID NO: 316367 - DNA, 16 bp, C. familiaris
ctgcttctatgagttt

SEQ ID NO: 316368 - DNA, 16 bp, C. familiaris
ctgcttctcactctgc

SEQ ID NO: 316369 - DNA, 16 bp, C. familiaris
ctgcttctccacctct

SEQ ID NO: 316370 - DNA, 16 bp, C. familiaris
ctgcttctccagctcc

SEQ ID NO: 316371 - DNA, 16 bp, C. familiaris
ctgcttctccctctac

SEQ ID NO: 316372 - DNA, 17 bp, C. familiaris
ctgcttctccctctgct

SEQ ID NO: 316373 - DNA, 16 bp, C. familiaris
ctgcttctcccttgtc

SEQ ID NO: 316374 - DNA, 16 bp, C. familiaris
ctgcttctcctgcctg

SEQ ID NO: 316375 - DNA, 16 bp, C. familiaris
ctgcttctcctgctgc

SEQ ID NO: 316376 - DNA, 16 bp, C. familiaris
ctgcttctccttctac

SEQ ID NO: 316377 - DNA, 16 bp, C. familiaris
ctgcttctctctatat

SEQ ID NO: 316378 - DNA, 16 bp, C. familiaris
ctgcttctctctatct

SEQ ID NO: 316379 - DNA, 16 bp, C. familiaris
ctgcttctctctgctg

SEQ ID NO: 316380 - DNA, 16 bp, C. familiaris
ctgcttctctcttgcc

SEQ ID NO: 316381 - DNA, 16 bp, C. familiaris
ctgcttctctgtgttt

SEQ ID NO: 316382 - DNA, 16 bp, C. familiaris
ctgcttctgcaaagtg

SEQ ID NO: 316383 - DNA, 16 bp, C. familiaris
ctgcttctgctgctgc

SEQ ID NO: 316384 - DNA, 16 bp, C. familiaris
ctgcttctggctcagg

SEQ ID NO: 316385 - DNA, 16 bp, C. familiaris
ctgcttctgtccctcc

SEQ ID NO: 316386 - DNA, 16 bp, C. familiaris
ctgcttcttctgcctg

SEQ ID NO: 316387 - DNA, 16 bp, C. familiaris
ctgcttctttctctat

SEQ ID NO: 316388 - DNA, 16 bp, C. familiaris
ctgcttgagccaccca

SEQ ID NO: 316389 - DNA, 16 bp, C. familiaris
ctgcttggattctctc

SEQ ID NO: 316390 - DNA, 16 bp, C. familiaris
ctgcttgtgccttctc

SEQ ID NO: 316391 - DNA, 16 bp, C. familiaris
ctgcttgtgtctgtgc

SEQ ID NO: 316392 - DNA, 16 bp, C. familiaris
ctgctttaaaaatttt

SEQ ID NO: 316393 - DNA, 16 bp, C. familiaris
ctgctttaccctctgc

SEQ ID NO: 316394 - DNA, 16 bp, C. familiaris
ctgctttatcaaatat

SEQ ID NO: 316395 - DNA, 16 bp, C. familiaris
ctgctttcaaatattt

SEQ ID NO: 316396 - DNA, 16 bp, C. familiaris
ctgctttctttgagga

SEQ ID NO: 316397 - DNA, 16 bp, C. familiaris
ctgctttggattctct

SEQ ID NO: 316398 - DNA, 16 bp, C. familiaris
ctgcttttcatttgtt

SEQ ID NO: 316399 - DNA, 16 bp, C. familiaris
ctgcttttcccactgc

SEQ ID NO: 316400 - DNA, 16 bp, C. familiaris
ctgcttttccctctgc

SEQ ID NO: 316401 - DNA, 16 bp, C. familiaris
ctgcttttccttctgc

SEQ ID NO: 316402 - DNA, 16 bp, C. familiaris
ctggaaaaaatccaaa

SEQ ID NO: 316403 - DNA, 16 bp, C. familiaris
ctggaaaaagcacaaa

SEQ ID NO: 316404 - DNA, 16 bp, C. familiaris
ctggaaaacaaacaag

SEQ ID NO: 316405 - DNA, 16 bp, C. familiaris
ctggaaaaccacaaac

SEQ ID NO: 316406 - DNA, 16 bp, C. familiaris
ctggaaacattttttt

SEQ ID NO: 316407 - DNA, 16 bp, C. familiaris
ctggaaagaaaaagaa

SEQ ID NO: 316408 - DNA, 16 bp, C. familiaris
ctggaaagctgtgtgg

SEQ ID NO: 316409 - DNA, 16 bp, C. familiaris
ctggaaatattttgaa

SEQ ID NO: 316410 - DNA, 16 bp, C. familiaris
ctggaaatctgtgtgg

SEQ ID NO: 316411 - DNA, 16 bp, C. familiaris
ctggaacaggaggaaa

SEQ ID NO: 316412 - DNA, 16 bp, C. familiaris
ctggaagaaacagaaa

SEQ ID NO: 316413 - DNA, 16 bp, C. familiaris
ctggaagaaatggacg

SEQ ID NO: 316414 - DNA, 16 bp, C. familiaris
ctggaagaagcaagga

SEQ ID NO: 316415 - DNA, 16 bp, C. familiaris
ctggaagaaggacagt

SEQ ID NO: 316416 - DNA, 16 bp, C. familiaris
ctggaagacagtgtgg

SEQ ID NO: 316417 - DNA, 16 bp, C. familiaris
ctggaagagcatgtga

SEQ ID NO: 316418 - DNA, 16 bp, C. familiaris
ctggaagaggaagaaa

SEQ ID NO: 316419 - DNA, 16 bp, C. familiaris
ctggaagaggcaagaa

SEQ ID NO: 316420 - DNA, 16 bp, C. familiaris
ctggaagcctgtattt

SEQ ID NO: 316421 - DNA, 16 bp, C. familiaris
ctggaagctggaagag

SEQ ID NO: 316422 - DNA, 16 bp, C. familiaris
ctggaagctggaagtt

SEQ ID NO: 316423 - DNA, 16 bp, C. familiaris
ctggaagctgggaagt

SEQ ID NO: 316424 - DNA, 16 bp, C. familiaris
ctggaaggaaaagaaa

SEQ ID NO: 316425 - DNA, 16 bp, C. familiaris
ctggaagggaagtggg

SEQ ID NO: 316426 - DNA, 16 bp, C. familiaris
ctggaatccagcccca

SEQ ID NO: 316427 - DNA, 16 bp, C. familiaris
ctggaattgagcccag

SEQ ID NO: 316428 - DNA, 16 bp, C. familiaris
ctggaatttctttctt

SEQ ID NO: 316429 - DNA, 16 bp, C. familiaris
ctggaatttgcttcaa

SEQ ID NO: 316430 - DNA, 16 bp, C. familiaris
ctggacaaaatgatga

SEQ ID NO: 316431 - DNA, 16 bp, C. familiaris
ctggacacagggctcc

SEQ ID NO: 316432 - DNA, 16 bp, C. familiaris
ctggacacctggcagg

SEQ ID NO: 316433 - DNA, 16 bp, C. familiaris
ctggacagctacatga

SEQ ID NO: 316434 - DNA, 16 bp, C. familiaris
ctggacagggagcctg

SEQ ID NO: 316435 - DNA, 16 bp, C. familiaris
ctggacattgccaaat

SEQ ID NO: 316436 - DNA, 16 bp, C. familiaris
ctggaccactttcttt

SEQ ID NO: 316437 - DNA, 16 bp, C. familiaris
ctggaccaggaagaaa

SEQ ID NO: 316438 - DNA, 16 bp, C. familiaris
ctggacccagggatca

SEQ ID NO: 316439 - DNA, 16 bp, C. familiaris
ctggaccccaggactc

SEQ ID NO: 316440 - DNA, 16 bp, C. familiaris
ctggacccctgggtct

SEQ ID NO: 316441 - DNA, 16 bp, C. familiaris
ctggaccgctttctta

SEQ ID NO: 316442 - DNA, 16 bp, C. familiaris
ctggacggaaggcagg

SEQ ID NO: 316443 - DNA, 16 bp, C. familiaris
ctggactctcagttct

SEQ ID NO: 316444 - DNA, 16 bp, C. familiaris
ctggactctttattct

SEQ ID NO: 316445 - DNA, 16 bp, C. familiaris
ctggacttcccctgga

SEQ ID NO: 316446 - DNA, 16 bp, C. familiaris
ctggagaaagagaaat

SEQ ID NO: 316447 - DNA, 16 bp, C. familiaris
ctggagaaagctgcca

SEQ ID NO: 316448 - DNA, 16 bp, C. familiaris
ctggagaaccaggaaa

SEQ ID NO: 316449 - DNA, 16 bp, C. familiaris
ctggagaaccctgacc

SEQ ID NO: 316450 - DNA, 16 bp, C. familiaris
ctggagaaggaaacag

SEQ ID NO: 316451 - DNA, 16 bp, C. familiaris
ctggagaaggaagaaa

SEQ ID NO: 316452 - DNA, 16 bp, C. familiaris
ctggagaaggaggagg

SEQ ID NO: 316453 - DNA, 16 bp, C. familiaris
ctggagacatttttca

SEQ ID NO: 316454 - DNA, 16 bp, C. familiaris
ctggagaccaaggatc

SEQ ID NO: 316455 - DNA, 16 bp, C. familiaris
ctggagacccagggtg

SEQ ID NO: 316456 - DNA, 16 bp, C. familiaris
ctggagaccccggatc

SEQ ID NO: 316457 - DNA, 16 bp, C. familiaris
ctggagacccgagatg

SEQ ID NO: 316458 - DNA, 16 bp, C. familiaris
ctggagaccctggaga

SEQ ID NO: 316459 - DNA, 16 bp, C. familiaris
ctggagacctggagac

SEQ ID NO: 316460 - DNA, 16 bp, C. familiaris
ctggagagccaggatc

SEQ ID NO: 316461 - DNA, 16 bp, C. familiaris
ctggagagctggccac

SEQ ID NO: 316462 - DNA, 16 bp, C. familiaris
ctggagagctggctgc

SEQ ID NO: 316463 - DNA, 16 bp, C. familiaris
ctggagaggcaggcag

SEQ ID NO: 316464 - DNA, 16 bp, C. familiaris
ctggagatccaggatt

SEQ ID NO: 316465 - DNA, 16 bp, C. familiaris
ctggagatcctggaga

SEQ ID NO: 316466 - DNA, 16 bp, C. familiaris
ctggagatggatgatg

SEQ ID NO: 316467 - DNA, 16 bp, C. familiaris
ctggagcacctgggtg

SEQ ID NO: 316468 - DNA, 16 bp, C. familiaris
ctggagcagactccct

SEQ ID NO: 316469 - DNA, 16 bp, C. familiaris
ctggagcagggcctgg

SEQ ID NO: 316470 - DNA, 16 bp, C. familiaris
ctggagcagggggagg

SEQ ID NO: 316471 - DNA, 16 bp, C. familiaris
ctggagcccagggatc

SEQ ID NO: 316472 - DNA, 16 bp, C. familiaris
ctggagccctggagtc

SEQ ID NO: 316473 - DNA, 16 bp, C. familiaris
ctggagctcagagaag

SEQ ID NO: 316474 - DNA, 16 bp, C. familiaris
ctggagctcaggagag

SEQ ID NO: 316475 - DNA, 16 bp, C. familiaris
ctggagctccagcagc

SEQ ID NO: 316476 - DNA, 16 bp, C. familiaris
ctggagctgggggtgg

SEQ ID NO: 316477 - DNA, 16 bp, C. familiaris
ctggaggaatgtcaca

SEQ ID NO: 316478 - DNA, 16 bp, C. familiaris
ctggaggagaaaaaaa

SEQ ID NO: 316479 - DNA, 16 bp, C. familiaris
ctggaggagaggaggg

SEQ ID NO: 316480 - DNA, 16 bp, C. familiaris
ctggaggagagggaga

SEQ ID NO: 316481 - DNA, 16 bp, C. familiaris
ctggaggaggaggcag

SEQ ID NO: 316482 - DNA, 16 bp, C. familiaris
ctggaggaggcaggag

SEQ ID NO: 316483 - DNA, 16 bp, C. familiaris
ctggaggccaaaagtc

SEQ ID NO: 316484 - DNA, 16 bp, C. familiaris
ctggaggccagaagtt

SEQ ID NO: 316485 - DNA, 16 bp, C. familiaris
ctggaggccagcaggg

SEQ ID NO: 316486 - DNA, 16 bp, C. familiaris
ctggaggctccagggg

SEQ ID NO: 316487 - DNA, 16 bp, C. familiaris
ctggaggctctgggag

SEQ ID NO: 316488 - DNA, 16 bp, C. familiaris
ctggaggctctggggg

SEQ ID NO: 316489 - DNA, 16 bp, C. familiaris
ctggaggctgggagtc

SEQ ID NO: 316490 - DNA, 16 bp, C. familiaris
ctggagggaggaggga

SEQ ID NO: 316491 - DNA, 16 bp, C. familiaris
ctggagggatccctgg

SEQ ID NO: 316492 - DNA, 16 bp, C. familiaris
ctggagggcagcccag

SEQ ID NO: 316493 - DNA, 16 bp, C. familiaris
ctggagggcagccctg

SEQ ID NO: 316494 - DNA, 16 bp, C. familiaris
ctggagggcagcctgg

SEQ ID NO: 316495 - DNA, 16 bp, C. familiaris
ctggagggctcagtgg

SEQ ID NO: 316496 - DNA, 16 bp, C. familiaris
ctggaggggaagaggg

SEQ ID NO: 316497 - DNA, 16 bp, C. familiaris
ctggaggggtattatg

SEQ ID NO: 316498 - DNA, 16 bp, C. familiaris
ctggagggtataatgc

SEQ ID NO: 316499 - DNA, 16 bp, C. familiaris
ctggaggtattatgct

SEQ ID NO: 316500 - DNA, 16 bp, C. familiaris
ctggaggtggaggtgg

SEQ ID NO: 316501 - DNA, 16 bp, C. familiaris
ctggaggtgggggcag

SEQ ID NO: 316502 - DNA, 16 bp, C. familiaris
ctggaggttctctctc

SEQ ID NO: 316503 - DNA, 16 bp, C. familiaris
ctggagtcagctccca

SEQ ID NO: 316504 - DNA, 16 bp, C. familiaris
ctggagtcagctccgg

SEQ ID NO: 316505 - DNA, 16 bp, C. familiaris
ctggagtcaggctgcc

SEQ ID NO: 316506 - DNA, 16 bp, C. familiaris
ctggagtcccaggaac

SEQ ID NO: 316507 - DNA, 16 bp, C. familiaris
ctggagtcccaggagc

SEQ ID NO: 316508 - DNA, 16 bp, C. familiaris
ctggagtccctggatg

SEQ ID NO: 316509 - DNA, 16 bp, C. familiaris
ctggagtccttggatc

SEQ ID NO: 316510 - DNA, 16 bp, C. familiaris
ctggagtctcagaatc

SEQ ID NO: 316511 - DNA, 16 bp, C. familiaris
ctggagtctctattct

SEQ ID NO: 316512 - DNA, 16 bp, C. familiaris
ctggagtttcgggatc

SEQ ID NO: 316513 - DNA, 16 bp, C. familiaris
ctggataaaaaagcca

SEQ ID NO: 316514 - DNA, 16 bp, C. familiaris
ctggataatttcaaat

SEQ ID NO: 316515 - DNA, 16 bp, C. familiaris
ctggatattttcttct

SEQ ID NO: 316516 - DNA, 16 bp, C. familiaris
ctggatcacaggaccc

SEQ ID NO: 316517 - DNA, 16 bp, C. familiaris
ctggatcatgtggtat

SEQ ID NO: 316518 - DNA, 16 bp, C. familiaris
ctggatcccaggatcc

SEQ ID NO: 316519 - DNA, 16 bp, C. familiaris
ctggatcctgagatca

SEQ ID NO: 316520 - DNA, 16 bp, C. familiaris
ctggatcctggatccc

SEQ ID NO: 316521 - DNA, 16 bp, C. familiaris
ctggatcgaatcccac

SEQ ID NO: 316522 - DNA, 16 bp, C. familiaris
ctggatgagcactggg

SEQ ID NO: 316523 - DNA, 16 bp, C. familiaris
ctggatggagcctgct

SEQ ID NO: 316524 - DNA, 16 bp, C. familiaris
ctggatggctcagatg

SEQ ID NO: 316525 - DNA, 16 bp, C. familiaris
ctggatggctcagcgg

SEQ ID NO: 316526 - DNA, 16 bp, C. familiaris
ctggatggctcagggg

SEQ ID NO: 316527 - DNA, 16 bp, C. familiaris
ctggatggctcaggtc

SEQ ID NO: 316528 - DNA, 16 bp, C. familiaris
ctggatgtcatctttg

SEQ ID NO: 316529 - DNA, 16 bp, C. familiaris
ctggatgtggagccca

SEQ ID NO: 316530 - DNA, 16 bp, C. familiaris
ctggatgtgtctgtga

SEQ ID NO: 316531 - DNA, 17 bp, C. familiaris
ctggattacaattcaat

SEQ ID NO: 316532 - DNA, 16 bp, C. familiaris
ctggattcctgaagga

SEQ ID NO: 316533 - DNA, 16 bp, C. familiaris
ctggatttccttcttt

SEQ ID NO: 316534 - DNA, 16 bp, C. familiaris
ctggatttgaactcag

SEQ ID NO: 316535 - DNA, 16 bp, C. familiaris
ctggatttgaattcca

SEQ ID NO: 316536 - DNA, 16 bp, C. familiaris
ctggcaaattctacca

SEQ ID NO: 316537 - DNA, 16 bp, C. familiaris
ctggcaaccagcattc

SEQ ID NO: 316538 - DNA, 16 bp, C. familiaris
ctggcaaggaagaagt

SEQ ID NO: 316539 - DNA, 16 bp, C. familiaris
ctggcaagtggcagag

SEQ ID NO: 316540 - DNA, 16 bp, C. familiaris
ctggcaagttggtgct

SEQ ID NO: 316541 - DNA, 16 bp, C. familiaris
ctggcagcttctgctt

SEQ ID NO: 316542 - DNA, 16 bp, C. familiaris
ctggcaggaatgcaaa

SEQ ID NO: 316543 - DNA, 16 bp, C. familiaris
ctggcaggccaggaag

SEQ ID NO: 316544 - DNA, 16 bp, C. familiaris
ctggcaggtgcagggg

SEQ ID NO: 316545 - DNA, 16 bp, C. familiaris
ctggcccagggcctga

SEQ ID NO: 316546 - DNA, 16 bp, C. familiaris
ctggcccagggcctgg

SEQ ID NO: 316547 - DNA, 16 bp, C. familiaris
ctggcccagtgtatca

SEQ ID NO: 316548 - DNA, 16 bp, C. familiaris
ctggccccagagccca

SEQ ID NO: 316549 - DNA, 16 bp, C. familiaris
ctggcccctgcctgcc

SEQ ID NO: 316550 - DNA, 16 bp, C. familiaris
ctggccctgaactttt

SEQ ID NO: 316551 - DNA, 16 bp, C. familiaris
ctggccctgccactgg

SEQ ID NO: 316552 - DNA, 16 bp, C. familiaris
ctggccctgccctcct

SEQ ID NO: 316553 - DNA, 16 bp, C. familiaris
ctggccctgctctggg

SEQ ID NO: 316554 - DNA, 16 bp, C. familiaris
ctggccctggccctgc

SEQ ID NO: 316555 - DNA, 16 bp, C. familiaris
ctggccctggccctgt

SEQ ID NO: 316556 - DNA, 16 bp, C. familiaris
ctggccgccaccagtg

SEQ ID NO: 316557 - DNA, 16 bp, C. familiaris
ctggcctatttcactt

SEQ ID NO: 316558 - DNA, 16 bp, C. familiaris
ctggcctcaaagaatg

SEQ ID NO: 316559 - DNA, 16 bp, C. familiaris
ctggcctccctgagcc

SEQ ID NO: 316560 - DNA, 16 bp, C. familiaris
ctggcctctactcact

SEQ ID NO: 316561 - DNA, 16 bp, C. familiaris
ctggcctctctgcctc

SEQ ID NO: 316562 - DNA, 16 bp, C. familiaris
ctggcctctgctgccc

SEQ ID NO: 316563 - DNA, 16 bp, C. familiaris
ctggcctggcctggcc

SEQ ID NO: 316564 - DNA, 16 bp, C. familiaris
ctggctcactctgaga

SEQ ID NO: 316565 - DNA, 16 bp, C. familiaris
ctggctcagccagtag

SEQ ID NO: 316566 - DNA, 16 bp, C. familiaris
ctggctcagcggggag

SEQ ID NO: 316567 - DNA, 16 bp, C. familiaris
ctggctcagctggtgg

SEQ ID NO: 316568 - DNA, 16 bp, C. familiaris
ctggctccaaagccca

SEQ ID NO: 316569 - DNA, 16 bp, C. familiaris
ctggctccagagcctg

SEQ ID NO: 316570 - DNA, 16 bp, C. familiaris
ctggctccccagcctc

SEQ ID NO: 316571 - DNA, 16 bp, C. familiaris
ctggctcctcacgggg

SEQ ID NO: 316572 - DNA, 16 bp, C. familiaris
ctggctcctgcctgcc

SEQ ID NO: 316573 - DNA, 16 bp, C. familiaris
ctggctcctggctcag

SEQ ID NO: 316574 - DNA, 16 bp, C. familiaris
ctggctctctgtgtct

SEQ ID NO: 316575 - DNA, 16 bp, C. familiaris
ctggctctgcaagaaa

SEQ ID NO: 316576 - DNA, 16 bp, C. familiaris
ctggctctgcccctcc

SEQ ID NO: 316577 - DNA, 16 bp, C. familiaris
ctggctctgccctctg

SEQ ID NO: 316578 - DNA, 16 bp, C. familiaris
ctggctgaaggcaggc

SEQ ID NO: 316579 - DNA, 16 bp, C. familiaris
ctggctgaaggtggca

SEQ ID NO: 316580 - DNA, 16 bp, C. familiaris
ctggctgcctcagtca

SEQ ID NO: 316581 - DNA, 16 bp, C. familiaris
ctggctgctgccactg

SEQ ID NO: 316582 - DNA, 16 bp, C. familiaris
ctggctgctgctcccc

SEQ ID NO: 316583 - DNA, 16 bp, C. familiaris
ctggctggctcagtgg

SEQ ID NO: 316584 - DNA, 16 bp, C. familiaris
ctggctggctggctgc

SEQ ID NO: 316585 - DNA, 16 bp, C. familiaris
ctggctggttcagtca

SEQ ID NO: 316586 - DNA, 16 bp, C. familiaris
ctggcttcaaatccca

SEQ ID NO: 316587 - DNA, 16 bp, C. familiaris
ctggcttcagagtctg

SEQ ID NO: 316588 - DNA, 16 bp, C. familiaris
ctggcttccctcagag

SEQ ID NO: 316589 - DNA, 16 bp, C. familiaris
ctggcttcctgcaggg

SEQ ID NO: 316590 - DNA, 16 bp, C. familiaris
ctggcttctttcatct

SEQ ID NO: 316591 - DNA, 16 bp, C. familiaris
ctggcttgttaatttt

SEQ ID NO: 316592 - DNA, 16 bp, C. familiaris
ctggctttctttagtg

SEQ ID NO: 316593 - DNA, 16 bp, C. familiaris
ctggctttgaaaatgg

SEQ ID NO: 316594 - DNA, 16 bp, C. familiaris
ctggctttggttttct

SEQ ID NO: 316595 - DNA, 16 bp, C. familiaris
ctgggaaaacaaaaca

SEQ ID NO: 316596 - DNA, 16 bp, C. familiaris
ctgggaaatgaagaag

SEQ ID NO: 316597 - DNA, 16 bp, C. familiaris
ctgggaacattggaca

SEQ ID NO: 316598 - DNA, 16 bp, C. familiaris
ctgggaaccctgggtg

SEQ ID NO: 316599 - DNA, 16 bp, C. familiaris
ctgggaaggagccctg

SEQ ID NO: 316600 - DNA, 16 bp, C. familiaris
ctgggaagggaaatag

SEQ ID NO: 316601 - DNA, 16 bp, C. familiaris
ctgggaccacaggatc

SEQ ID NO: 316602 - DNA, 16 bp, C. familiaris
ctgggacccccctctg

SEQ ID NO: 316603 - DNA, 16 bp, C. familiaris
ctgggaccgagtcctg

SEQ ID NO: 316604 - DNA, 16 bp, C. familiaris
ctgggacgcccgggtg

SEQ ID NO: 316605 - DNA, 16 bp, C. familiaris
ctgggactatcataaa

SEQ ID NO: 316606 - DNA, 16 bp, C. familiaris
ctgggactccaggaac

SEQ ID NO: 316607 - DNA, 16 bp, C. familiaris
ctgggagaagagcatt

SEQ ID NO: 316608 - DNA, 16 bp, C. familiaris
ctgggagacacagaga

SEQ ID NO: 316609 - DNA, 16 bp, C. familiaris
ctgggagagccaggag

SEQ ID NO: 316610 - DNA, 16 bp, C. familiaris
ctgggagaggagcaga

SEQ ID NO: 316611 - DNA, 16 bp, C. familiaris
ctgggagaggcagagg

SEQ ID NO: 316612 - DNA, 16 bp, C. familiaris
ctgggagaggcggggc

SEQ ID NO: 316613 - DNA, 16 bp, C. familiaris
ctgggagatgggcact

SEQ ID NO: 316614 - DNA, 16 bp, C. familiaris
ctgggagccagagccc

SEQ ID NO: 316615 - DNA, 16 bp, C. familiaris
ctgggagcctgggagc

SEQ ID NO: 316616 - DNA, 16 bp, C. familiaris
ctgggagctcagctgc

SEQ ID NO: 316617 - DNA, 16 bp, C. familiaris
ctgggagctgcaggtg

SEQ ID NO: 316618 - DNA, 16 bp, C. familiaris
ctgggaggaaggaagg

SEQ ID NO: 316619 - DNA, 16 bp, C. familiaris
ctgggaggacacagga

SEQ ID NO: 316620 - DNA, 16 bp, C. familiaris
ctgggaggagcagagg

SEQ ID NO: 316621 - DNA, 16 bp, C. familiaris
ctgggaggaggagcag

SEQ ID NO: 316622 - DNA, 16 bp, C. familiaris
ctgggagggcccagga

SEQ ID NO: 316623 - DNA, 16 bp, C. familiaris
ctgggatcaagccctt

SEQ ID NO: 316624 - DNA, 16 bp, C. familiaris
ctgggatcatgaccca

SEQ ID NO: 316625 - DNA, 16 bp, C. familiaris
ctgggatccagcctcc

SEQ ID NO: 316626 - DNA, 16 bp, C. familiaris
ctgggatccagcctgg

SEQ ID NO: 316627 - DNA, 16 bp, C. familiaris
ctgggatccagctctg

SEQ ID NO: 316628 - DNA, 16 bp, C. familiaris
ctgggatccaggcctg

SEQ ID NO: 316629 - DNA, 16 bp, C. familiaris
ctgggatccctgctca

SEQ ID NO: 316630 - DNA, 16 bp, C. familiaris
ctgggatcctaggatt

SEQ ID NO: 316631 - DNA, 16 bp, C. familiaris
ctgggatctggggcct

SEQ ID NO: 316632 - DNA, 16 bp, C. familiaris
ctgggatggaatcctg

SEQ ID NO: 316633 - DNA, 16 bp, C. familiaris
ctgggatggagtctgg

SEQ ID NO: 316634 - DNA, 16 bp, C. familiaris
ctgggattctgcattt

SEQ ID NO: 316635 - DNA, 16 bp, C. familiaris
ctgggattgagcctga

SEQ ID NO: 316636 - DNA, 16 bp, C. familiaris
ctgggattgtgacctg

SEQ ID NO: 316637 - DNA, 16 bp, C. familiaris
ctgggcacctggctgg

SEQ ID NO: 316638 - DNA, 16 bp, C. familiaris
ctgggcagaaggcaag

SEQ ID NO: 316639 - DNA, 16 bp, C. familiaris
ctgggcagctcagtga

SEQ ID NO: 316640 - DNA, 16 bp, C. familiaris
ctgggcaggaggcagg

SEQ ID NO: 316641 - DNA, 16 bp, C. familiaris
ctgggcagggagccct

SEQ ID NO: 316642 - DNA, 16 bp, C. familiaris
ctgggcagggagcctg

SEQ ID NO: 316643 - DNA, 16 bp, C. familiaris
ctgggcaggggcaggg

SEQ ID NO: 316644 - DNA, 16 bp, C. familiaris
ctgggcatggaatctg

SEQ ID NO: 316645 - DNA, 16 bp, C. familiaris
ctgggccaaggcaggc

SEQ ID NO: 316646 - DNA, 16 bp, C. familiaris
ctgggccacagcaact

SEQ ID NO: 316647 - DNA, 16 bp, C. familiaris
ctgggccacctaggca

SEQ ID NO: 316648 - DNA, 16 bp, C. familiaris
ctgggccagggctggg

SEQ ID NO: 316649 - DNA, 16 bp, C. familiaris
ctgggccccacctcca

SEQ ID NO: 316650 - DNA, 16 bp, C. familiaris
ctgggccccaggcctg

SEQ ID NO: 316651 - DNA, 16 bp, C. familiaris
ctgggcccctgggccc

SEQ ID NO: 316652 - DNA, 16 bp, C. familiaris
ctgggccctgcctccc

SEQ ID NO: 316653 - DNA, 16 bp, C. familiaris
ctgggccctggggaca

SEQ ID NO: 316654 - DNA, 16 bp, C. familiaris
ctgggccctggggagg

SEQ ID NO: 316655 - DNA, 16 bp, C. familiaris
ctgggccctgggtccc

SEQ ID NO: 316656 - DNA, 16 bp, C. familiaris
ctgggcctcacccaga

SEQ ID NO: 316657 - DNA, 16 bp, C. familiaris
ctgggcctcagtgtcc

SEQ ID NO: 316658 - DNA, 16 bp, C. familiaris
ctgggcctcagtgttc

SEQ ID NO: 316659 - DNA, 16 bp, C. familiaris
ctgggcctcagtttcc

SEQ ID NO: 316660 - DNA, 16 bp, C. familiaris
ctgggcctccaggacc

SEQ ID NO: 316661 - DNA, 16 bp, C. familiaris
ctgggcctccgtttcc

SEQ ID NO: 316662 - DNA, 16 bp, C. familiaris
ctgggcctctcatgaa

SEQ ID NO: 316663 - DNA, 16 bp, C. familiaris
ctgggcctctgtcctc

SEQ ID NO: 316664 - DNA, 16 bp, C. familiaris
ctgggcctggggctgg

SEQ ID NO: 316665 - DNA, 16 bp, C. familiaris
ctgggcctgggggagg

SEQ ID NO: 316666 - DNA, 16 bp, C. familiaris
ctgggccttcctgtcc

SEQ ID NO: 316667 - DNA, 16 bp, C. familiaris
ctgggcgcctgggtgg

SEQ ID NO: 316668 - DNA, 16 bp, C. familiaris
ctgggctaaaggcagc

SEQ ID NO: 316669 - DNA, 16 bp, C. familiaris
ctgggctcagctgggt

SEQ ID NO: 316670 - DNA, 16 bp, C. familiaris
ctgggctccatgctca

SEQ ID NO: 316671 - DNA, 16 bp, C. familiaris
ctgggctccatgctga

SEQ ID NO: 316672 - DNA, 16 bp, C. familiaris
ctgggctcccacagcc

SEQ ID NO: 316673 - DNA, 16 bp, C. familiaris
ctgggctcccagcagg

SEQ ID NO: 316674 - DNA, 16 bp, C. familiaris
ctgggctccccactca

SEQ ID NO: 316675 - DNA, 16 bp, C. familiaris
ctgggctccctattct

SEQ ID NO: 316676 - DNA, 16 bp, C. familiaris
ctgggctccctgcatg

SEQ ID NO: 316677 - DNA, 16 bp, C. familiaris
ctgggctccctgctca

SEQ ID NO: 316678 - DNA, 16 bp, C. familiaris
ctgggctcctgggcct

SEQ ID NO: 316679 - DNA, 16 bp, C. familiaris
ctgggctctctgctca

SEQ ID NO: 316680 - DNA, 16 bp, C. familiaris
ctgggctctttctgta

SEQ ID NO: 316681 - DNA, 16 bp, C. familiaris
ctgggctgagccaccc

SEQ ID NO: 316682 - DNA, 16 bp, C. familiaris
ctgggctgccccagag

SEQ ID NO: 316683 - DNA, 16 bp, C. familiaris
ctgggctgcccctgct

SEQ ID NO: 316684 - DNA, 16 bp, C. familiaris
ctgggctgcccctggg

SEQ ID NO: 316685 - DNA, 16 bp, C. familiaris
ctgggctgccctccct

SEQ ID NO: 316686 - DNA, 16 bp, C. familiaris
ctgggctgccctcttc

SEQ ID NO: 316687 - DNA, 16 bp, C. familiaris
ctgggctgccctgaag

SEQ ID NO: 316688 - DNA, 16 bp, C. familiaris
ctgggctgcccttaaa

SEQ ID NO: 316689 - DNA, 16 bp, C. familiaris
ctgggctgctgctgct

SEQ ID NO: 316690 - DNA, 16 bp, C. familiaris
ctgggctggatcccag

SEQ ID NO: 316691 - DNA, 16 bp, C. familiaris
ctgggctgggctggag

SEQ ID NO: 316692 - DNA, 16 bp, C. familiaris
ctgggctggggcctgg

SEQ ID NO: 316693 - DNA, 16 bp, C. familiaris
ctggggaaactgagtc

SEQ ID NO: 316694 - DNA, 16 bp, C. familiaris
ctggggaacctgggtg

SEQ ID NO: 316695 - DNA, 16 bp, C. familiaris
ctggggaaggggcctg

SEQ ID NO: 316696 - DNA, 16 bp, C. familiaris
ctggggacaaagacca

SEQ ID NO: 316697 - DNA, 16 bp, C. familiaris
ctggggacccaggagg

SEQ ID NO: 316698 - DNA, 16 bp, C. familiaris
ctggggacccaggata

SEQ ID NO: 316699 - DNA, 16 bp, C. familiaris
ctggggacccgagatc

SEQ ID NO: 316700 - DNA, 16 bp, C. familiaris
ctggggacctggccgc

SEQ ID NO: 316701 - DNA, 16 bp, C. familiaris
ctggggagaggggaag

SEQ ID NO: 316702 - DNA, 16 bp, C. familiaris
ctggggaggagagaga

SEQ ID NO: 316703 - DNA, 16 bp, C. familiaris
ctggggaggagctggg

SEQ ID NO: 316704 - DNA, 16 bp, C. familiaris
ctggggaggcagggag

SEQ ID NO: 316705 - DNA, 16 bp, C. familiaris
ctggggaggccctggg

SEQ ID NO: 316706 - DNA, 16 bp, C. familiaris
ctggggagggagcagg

SEQ ID NO: 316707 - DNA, 16 bp, C. familiaris
ctggggaggggagaag

SEQ ID NO: 316708 - DNA, 16 bp, C. familiaris
ctggggaggggagcag

SEQ ID NO: 316709 - DNA, 16 bp, C. familiaris
ctggggagtttttaaa

SEQ ID NO: 316710 - DNA, 16 bp, C. familiaris
ctggggatggagtccc

SEQ ID NO: 316711 - DNA, 16 bp, C. familiaris
ctggggatggggccca

SEQ ID NO: 316712 - DNA, 16 bp, C. familiaris
ctggggcagcagctct

SEQ ID NO: 316713 - DNA, 16 bp, C. familiaris
ctggggcaggaaggag

SEQ ID NO: 316714 - DNA, 16 bp, C. familiaris
ctggggcaggggcagg

SEQ ID NO: 316715 - DNA, 16 bp, C. familiaris
ctggggcaggggctgg

SEQ ID NO: 316716 - DNA, 16 bp, C. familiaris
ctggggcaggtgggag

SEQ ID NO: 316717 - DNA, 16 bp, C. familiaris
ctggggccaggctggg

SEQ ID NO: 316718 - DNA, 16 bp, C. familiaris
ctggggccagggctgg

SEQ ID NO: 316719 - DNA, 16 bp, C. familiaris
ctggggcccagggagg

SEQ ID NO: 316720 - DNA, 16 bp, C. familiaris
ctggggcccctgggtg

SEQ ID NO: 316721 - DNA, 16 bp, C. familiaris
ctggggcctgcgctgt

SEQ ID NO: 316722 - DNA, 16 bp, C. familiaris
ctggggcctgggctcc

SEQ ID NO: 316723 - DNA, 16 bp, C. familiaris
ctggggcctgggctgc

SEQ ID NO: 316724 - DNA, 16 bp, C. familiaris
ctggggcctggggcag

SEQ ID NO: 316725 - DNA, 16 bp, C. familiaris
ctggggcgcctggctg

SEQ ID NO: 316726 - DNA, 16 bp, C. familiaris
ctggggctccctgagg

SEQ ID NO: 316727 - DNA, 16 bp, C. familiaris
ctggggctcctggggc

SEQ ID NO: 316728 - DNA, 16 bp, C. familiaris
ctggggctctgcctct

SEQ ID NO: 316729 - DNA, 16 bp, C. familiaris
ctggggctctggggct

SEQ ID NO: 316730 - DNA, 16 bp, C. familiaris
ctggggctgaaggcag

SEQ ID NO: 316731 - DNA, 16 bp, C. familiaris
ctggggctgaggctgg

SEQ ID NO: 316732 - DNA, 16 bp, C. familiaris
ctggggctgagggagg

SEQ ID NO: 316733 - DNA, 16 bp, C. familiaris
ctggggctgcccaaag

SEQ ID NO: 316734 - DNA, 16 bp, C. familiaris
ctggggctgcccacca

SEQ ID NO: 316735 - DNA, 16 bp, C. familiaris
ctggggctgcccagga

SEQ ID NO: 316736 - DNA, 16 bp, C. familiaris
ctggggctgccccaat

SEQ ID NO: 316737 - DNA, 16 bp, C. familiaris
ctggggctgccccact

SEQ ID NO: 316738 - DNA, 16 bp, C. familiaris
ctggggctgccccaga

SEQ ID NO: 316739 - DNA, 16 bp, C. familiaris
ctggggctgcccccag

SEQ ID NO: 316740 - DNA, 16 bp, C. familiaris
ctggggctgcccccct

SEQ ID NO: 316741 - DNA, 16 bp, C. familiaris
ctggggctgccctcct

SEQ ID NO: 316742 - DNA, 16 bp, C. familiaris
ctggggctgccctgga

SEQ ID NO: 316743 - DNA, 16 bp, C. familiaris
ctggggctgccctggc

SEQ ID NO: 316744 - DNA, 16 bp, C. familiaris
ctggggctgcccttct

SEQ ID NO: 316745 - DNA, 16 bp, C. familiaris
ctggggctgcctgggg

SEQ ID NO: 316746 - DNA, 16 bp, C. familiaris
ctggggctgctcctcc

SEQ ID NO: 316747 - DNA, 16 bp, C. familiaris
ctggggctggagcagg

SEQ ID NO: 316748 - DNA, 16 bp, C. familiaris
ctggggctggagctgg

SEQ ID NO: 316749 - DNA, 16 bp, C. familiaris
ctggggctggaggaag

SEQ ID NO: 316750 - DNA, 16 bp, C. familiaris
ctggggctggggctgc

SEQ ID NO: 316751 - DNA, 16 bp, C. familiaris
ctggggctggtggtcc

SEQ ID NO: 316752 - DNA, 16 bp, C. familiaris
ctgggggaaggggaaa

SEQ ID NO: 316753 - DNA, 16 bp, C. familiaris
ctgggggaaggggcag

SEQ ID NO: 316754 - DNA, 16 bp, C. familiaris
ctgggggacgcctggg

SEQ ID NO: 316755 - DNA, 16 bp, C. familiaris
ctgggggagaggcaga

SEQ ID NO: 316756 - DNA, 16 bp, C. familiaris
ctgggggagctgcccc

SEQ ID NO: 316757 - DNA, 16 bp, C. familiaris
ctgggggagctgctca

SEQ ID NO: 316758 - DNA, 16 bp, C. familiaris
ctgggggaggagcctg

SEQ ID NO: 316759 - DNA, 16 bp, C. familiaris
ctgggggcagcccagg

SEQ ID NO: 316760 - DNA, 16 bp, C. familiaris
ctgggggcctggggag

SEQ ID NO: 316761 - DNA, 16 bp, C. familiaris
ctgggggctcctgggt

SEQ ID NO: 316762 - DNA, 16 bp, C. familiaris
ctgggggctggaggag

SEQ ID NO: 316763 - DNA, 16 bp, C. familiaris
ctggggtccctggatt

SEQ ID NO: 316764 - DNA, 16 bp, C. familiaris
ctggggtcctgggaag

SEQ ID NO: 316765 - DNA, 16 bp, C. familiaris
ctggggtcctgggctg

SEQ ID NO: 316766 - DNA, 16 bp, C. familiaris
ctggggtgcctggatg

SEQ ID NO: 316767 - DNA, 16 bp, C. familiaris
ctggggtggggtctga

SEQ ID NO: 316768 - DNA, 16 bp, C. familiaris
ctgggtcactcagttg

SEQ ID NO: 316769 - DNA, 16 bp, C. familiaris
ctgggtcagtcagtag

SEQ ID NO: 316770 - DNA, 16 bp, C. familiaris
ctgggtgaaataagtc

SEQ ID NO: 316771 - DNA, 16 bp, C. familiaris
ctgggtgactcagttt

SEQ ID NO: 316772 - DNA, 16 bp, C. familiaris
ctgggtgactttgggc

SEQ ID NO: 316773 - DNA, 16 bp, C. familiaris
ctgggtgaggagcctg

SEQ ID NO: 316774 - DNA, 16 bp, C. familiaris
ctgggtgcctcagagg

SEQ ID NO: 316775 - DNA, 16 bp, C. familiaris
ctgggtgcctggctgg

SEQ ID NO: 316776 - DNA, 16 bp, C. familiaris
ctgggtgctggggctg

SEQ ID NO: 316777 - DNA, 16 bp, C. familiaris
ctgggtgctgggtgct

SEQ ID NO: 316778 - DNA, 16 bp, C. familiaris
ctgggtggaaggcagg

SEQ ID NO: 316779 - DNA, 16 bp, C. familiaris
ctgggtggaaggcagt

SEQ ID NO: 316780 - DNA, 16 bp, C. familiaris
ctgggtggcacagtca

SEQ ID NO: 316781 - DNA, 16 bp, C. familiaris
ctgggtggcccagcag

SEQ ID NO: 316782 - DNA, 17 bp, C. familiaris
ctgggtggcccagcggt

SEQ ID NO: 316783 - DNA, 16 bp, C. familiaris
ctgggtggcccagggg

SEQ ID NO: 316784 - DNA, 16 bp, C. familiaris
ctgggtggctcagcag

SEQ ID NO: 316785 - DNA, 16 bp, C. familiaris
ctgggtggctcaggtc

SEQ ID NO: 316786 - DNA, 16 bp, C. familiaris
ctgggtggctcagtcg

SEQ ID NO: 316787 - DNA, 16 bp, C. familiaris
ctgggtggctcagttg

SEQ ID NO: 316788 - DNA, 16 bp, C. familiaris
ctgggtggctccgagg

SEQ ID NO: 316789 - DNA, 16 bp, C. familiaris
ctgggtggctgagcat

SEQ ID NO: 316790 - DNA, 16 bp, C. familiaris
ctgggtggtgcagctg

SEQ ID NO: 316791 - DNA, 16 bp, C. familiaris
ctgggtgtgaagcctg

SEQ ID NO: 316792 - DNA, 16 bp, C. familiaris
ctgggttcgagccctg

SEQ ID NO: 316793 - DNA, 16 bp, C. familiaris
ctgggtttgaatccca

SEQ ID NO: 316794 - DNA, 16 bp, C. familiaris
ctggtacagacactct

SEQ ID NO: 316795 - DNA, 16 bp, C. familiaris
ctggtacctggccctg

SEQ ID NO: 316796 - DNA, 16 bp, C. familiaris
ctggtagaaaaaaaaa

SEQ ID NO: 316797 - DNA, 16 bp, C. familiaris
ctggtcatgctctctc

SEQ ID NO: 316798 - DNA, 16 bp, C. familiaris
ctggtgacaggcactg

SEQ ID NO: 316799 - DNA, 16 bp, C. familiaris
ctggtgactctggtcc

SEQ ID NO: 316800 - DNA, 16 bp, C. familiaris
ctggtgcagccactgg

SEQ ID NO: 316801 - DNA, 16 bp, C. familiaris
ctggtgcagtgccagc

SEQ ID NO: 316802 - DNA, 16 bp, C. familiaris
ctggtgcctggtggcc

SEQ ID NO: 316803 - DNA, 16 bp, C. familiaris
ctggtgcgggactcga

SEQ ID NO: 316804 - DNA, 16 bp, C. familiaris
ctggtgctgctgctgg

SEQ ID NO: 316805 - DNA, 16 bp, C. familiaris
ctggtgctgctggtct

SEQ ID NO: 316806 - DNA, 16 bp, C. familiaris
ctggtggaggaggagg

SEQ ID NO: 316807 - DNA, 16 bp, C. familiaris
ctggtggcagagccag

SEQ ID NO: 316808 - DNA, 16 bp, C. familiaris
ctggtggccccgctcc

SEQ ID NO: 316809 - DNA, 16 bp, C. familiaris
ctggtggctcagcagg

SEQ ID NO: 316810 - DNA, 16 bp, C. familiaris
ctggtggctcagtcat

SEQ ID NO: 316811 - DNA, 16 bp, C. familiaris
ctggtggctcagtgct

SEQ ID NO: 316812 - DNA, 16 bp, C. familiaris
ctggtggctgccagag

SEQ ID NO: 316813 - DNA, 16 bp, C. familiaris
ctggtgggaattcaaa

SEQ ID NO: 316814 - DNA, 16 bp, C. familiaris
ctggtggtggtgatgg

SEQ ID NO: 316815 - DNA, 16 bp, C. familiaris
ctggtggtggtggcag

SEQ ID NO: 316816 - DNA, 16 bp, C. familiaris
ctggtgttggtatctc

SEQ ID NO: 316817 - DNA, 16 bp, C. familiaris
ctggttaagcatcaga

SEQ ID NO: 316818 - DNA, 16 bp, C. familiaris
ctggttcaacactggt

SEQ ID NO: 316819 - DNA, 16 bp, C. familiaris
ctggttctcaggcctt

SEQ ID NO: 316820 - DNA, 17 bp, C. familiaris
ctggtttggaggtcaca

SEQ ID NO: 316821 - DNA, 16 bp, C. familiaris
ctggttttccctctgc

SEQ ID NO: 316822 - DNA, 16 bp, C. familiaris
ctggttttgatatcaa

SEQ ID NO: 316823 - DNA, 16 bp, C. familiaris
ctgtaaaagaaagagg

SEQ ID NO: 316824 - DNA, 16 bp, C. familiaris
ctgtaagatcatgacc

SEQ ID NO: 316825 - DNA, 16 bp, C. familiaris
ctgtaattctgtggga

SEQ ID NO: 316826 - DNA, 16 bp, C. familiaris
ctgtacagaagctttt

SEQ ID NO: 316827 - DNA, 16 bp, C. familiaris
ctgtacagttaaaaat

SEQ ID NO: 316828 - DNA, 16 bp, C. familiaris
ctgtacagtttgaaat

SEQ ID NO: 316829 - DNA, 16 bp, C. familiaris
ctgtactgttttccag

SEQ ID NO: 316830 - DNA, 16 bp, C. familiaris
ctgtagaaatttaaaa

SEQ ID NO: 316831 - DNA, 16 bp, C. familiaris
ctgtagaatggggata

SEQ ID NO: 316832 - DNA, 16 bp, C. familiaris
ctgtagcattctggct

SEQ ID NO: 316833 - DNA, 16 bp, C. familiaris
ctgtagctttgtagta

SEQ ID NO: 316834 - DNA, 16 bp, C. familiaris
ctgtagttttgccttt

SEQ ID NO: 316835 - DNA, 16 bp, C. familiaris
ctgtatatttaaaata

SEQ ID NO: 316836 - DNA, 16 bp, C. familiaris
ctgtatctatgaactt

SEQ ID NO: 316837 - DNA, 16 bp, C. familiaris
ctgtatgagttctggc

SEQ ID NO: 316838 - DNA, 16 bp, C. familiaris
ctgtatgtctgcctct

SEQ ID NO: 316839 - DNA, 16 bp, C. familiaris
ctgtattatttcttaa

SEQ ID NO: 316840 - DNA, 16 bp, C. familiaris
ctgtcaccacacaaca

SEQ ID NO: 316841 - DNA, 16 bp, C. familiaris
ctgtcaccaccaccac

SEQ ID NO: 316842 - DNA, 16 bp, C. familiaris
ctgtcaccacctccac

SEQ ID NO: 316843 - DNA, 16 bp, C. familiaris
ctgtcagaatggcaaa

SEQ ID NO: 316844 - DNA, 16 bp, C. familiaris
ctgtccaacaagagga

SEQ ID NO: 316845 - DNA, 16 bp, C. familiaris
ctgtccaggttttcta

SEQ ID NO: 316846 - DNA, 16 bp, C. familiaris
ctgtccatggtgctga

SEQ ID NO: 316847 - DNA, 16 bp, C. familiaris
ctgtccattcaaaatt

SEQ ID NO: 316848 - DNA, 16 bp, C. familiaris
ctgtccccaccaactt

SEQ ID NO: 316849 - DNA, 16 bp, C. familiaris
ctgtccctcccacttg

SEQ ID NO: 316850 - DNA, 16 bp, C. familiaris
ctgtccctcccctcca

SEQ ID NO: 316851 - DNA, 16 bp, C. familiaris
ctgtccctccctccca

SEQ ID NO: 316852 - DNA, 16 bp, C. familiaris
ctgtccctcctccacc

SEQ ID NO: 316853 - DNA, 16 bp, C. familiaris
ctgtccctctgcctgt

SEQ ID NO: 316854 - DNA, 16 bp, C. familiaris
ctgtccctctgtccca

SEQ ID NO: 316855 - DNA, 16 bp, C. familiaris
ctgtccctgcccccac

SEQ ID NO: 316856 - DNA, 16 bp, C. familiaris
ctgtccgtggtgctga

SEQ ID NO: 316857 - DNA, 16 bp, C. familiaris
ctgtcctctcccagga

SEQ ID NO: 316858 - DNA, 16 bp, C. familiaris
ctgtcctgcctgctgc

SEQ ID NO: 316859 - DNA, 16 bp, C. familiaris
ctgtcctggggactct

SEQ ID NO: 316860 - DNA, 16 bp, C. familiaris
ctgtcctgtgcccttc

SEQ ID NO: 316861 - DNA, 16 bp, C. familiaris
ctgtcctgtgtcctcc

SEQ ID NO: 316862 - DNA, 16 bp, C. familiaris
ctgtccttaaaaaaaa

SEQ ID NO: 316863 - DNA, 16 bp, C. familiaris
ctgtccttccctctgc

SEQ ID NO: 316864 - DNA, 16 bp, C. familiaris
ctgtccttggctcagg

SEQ ID NO: 316865 - DNA, 16 bp, C. familiaris
ctgtcctttgctgaga

SEQ ID NO: 316866 - DNA, 16 bp, C. familiaris
ctgtctccttccccag

SEQ ID NO: 316867 - DNA, 16 bp, C. familiaris
ctgtctctccgtctct

SEQ ID NO: 316868 - DNA, 16 bp, C. familiaris
ctgtctctgccactta

SEQ ID NO: 316869 - DNA, 16 bp, C. familiaris
ctgtctctgcctgtgt

SEQ ID NO: 316870 - DNA, 16 bp, C. familiaris
ctgtctgagattctct

SEQ ID NO: 316871 - DNA, 16 bp, C. familiaris
ctgtctgcaagccaga

SEQ ID NO: 316872 - DNA, 16 bp, C. familiaris
ctgtctgtgtctctgt

SEQ ID NO: 316873 - DNA, 16 bp, C. familiaris
ctgtctgtgtctgcct

SEQ ID NO: 316874 - DNA, 16 bp, C. familiaris
ctgtcttcatctcagg

SEQ ID NO: 316875 - DNA, 16 bp, C. familiaris
ctgtcttctttccatt

SEQ ID NO: 316876 - DNA, 16 bp, C. familiaris
ctgtctttcttccaac

SEQ ID NO: 316877 - DNA, 16 bp, C. familiaris
ctgtctttggcctagg

SEQ ID NO: 316878 - DNA, 16 bp, C. familiaris
ctgtctttggctcagg

SEQ ID NO: 316879 - DNA, 16 bp, C. familiaris
ctgtcttttatattta

SEQ ID NO: 316880 - DNA, 16 bp, C. familiaris
ctgtcttttctccagt

SEQ ID NO: 316881 - DNA, 16 bp, C. familiaris
ctgtgaaaaacaatat

SEQ ID NO: 316882 - DNA, 16 bp, C. familiaris
ctgtgaaaaatacttt

SEQ ID NO: 316883 - DNA, 16 bp, C. familiaris
ctgtgaaaaatgccac

SEQ ID NO: 316884 - DNA, 16 bp, C. familiaris
ctgtgaaaaatgtcca

SEQ ID NO: 316885 - DNA, 16 bp, C. familiaris
ctgtgaacatttgtat

SEQ ID NO: 316886 - DNA, 16 bp, C. familiaris
ctgtgaagaaaataaa

SEQ ID NO: 316887 - DNA, 16 bp, C. familiaris
ctgtgaagaagctttt

SEQ ID NO: 316888 - DNA, 16 bp, C. familiaris
ctgtgaagattattga

SEQ ID NO: 316889 - DNA, 16 bp, C. familiaris
ctgtgaatatgttact

SEQ ID NO: 316890 - DNA, 16 bp, C. familiaris
ctgtgaatttgcctat

SEQ ID NO: 316891 - DNA, 16 bp, C. familiaris
ctgtgaccttgctgaa

SEQ ID NO: 316892 - DNA, 16 bp, C. familiaris
ctgtgactatcattaa

SEQ ID NO: 316893 - DNA, 16 bp, C. familiaris
ctgtgactatgatgaa

SEQ ID NO: 316894 - DNA, 16 bp, C. familiaris
ctgtgagcagcctgct

SEQ ID NO: 316895 - DNA, 16 bp, C. familiaris
ctgtgagctcctggag

SEQ ID NO: 316896 - DNA, 16 bp, C. familiaris
ctgtgaggagcctgct

SEQ ID NO: 316897 - DNA, 16 bp, C. familiaris
ctgtgatcacaacctg

SEQ ID NO: 316898 - DNA, 16 bp, C. familiaris
ctgtgcaaaagatttt

SEQ ID NO: 316899 - DNA, 16 bp, C. familiaris
ctgtgcagagcttttt

SEQ ID NO: 316900 - DNA, 16 bp, C. familiaris
ctgtgcagccatcacc

SEQ ID NO: 316901 - DNA, 16 bp, C. familiaris
ctgtgccaaaatcaag

SEQ ID NO: 316902 - DNA, 16 bp, C. familiaris
ctgtgccagatgctgg

SEQ ID NO: 316903 - DNA, 16 bp, C. familiaris
ctgtgcccagtgtggg

SEQ ID NO: 316904 - DNA, 16 bp, C. familiaris
ctgtgccccaccccca

SEQ ID NO: 316905 - DNA, 16 bp, C. familiaris
ctgtgcccctcacccc

SEQ ID NO: 316906 - DNA, 16 bp, C. familiaris
ctgtgcccctccccac

SEQ ID NO: 316907 - DNA, 16 bp, C. familiaris
ctgtgccctgctgcct

SEQ ID NO: 316908 - DNA, 16 bp, C. familiaris
ctgtgcctcagtttcc

SEQ ID NO: 316909 - DNA, 16 bp, C. familiaris
ctgtgcctccgtttcc

SEQ ID NO: 316910 - DNA, 16 bp, C. familiaris
ctgtgcctctcattaa

SEQ ID NO: 316911 - DNA, 16 bp, C. familiaris
ctgtgcctctctgcct

SEQ ID NO: 316912 - DNA, 16 bp, C. familiaris
ctgtgcctctgccttt

SEQ ID NO: 316913 - DNA, 16 bp, C. familiaris
ctgtgcctgggacgga

SEQ ID NO: 316914 - DNA, 16 bp, C. familiaris
ctgtgcctgtgcctct

SEQ ID NO: 316915 - DNA, 16 bp, C. familiaris
ctgtgccttctctctc

SEQ ID NO: 316916 - DNA, 16 bp, C. familiaris
ctgtgcgtgtgtctct

SEQ ID NO: 316917 - DNA, 16 bp, C. familiaris
ctgtgctcaccacagg

SEQ ID NO: 316918 - DNA, 16 bp, C. familiaris
ctgtgctcagcactga

SEQ ID NO: 316919 - DNA, 16 bp, C. familiaris
ctgtgctcagcagggc

SEQ ID NO: 316920 - DNA, 16 bp, C. familiaris
ctgtgctcagcctgga

SEQ ID NO: 316921 - DNA, 16 bp, C. familiaris
ctgtgctcagtacaga

SEQ ID NO: 316922 - DNA, 16 bp, C. familiaris
ctgtgctctctcttgc

SEQ ID NO: 316923 - DNA, 16 bp, C. familiaris
ctgtgctctcttccag

SEQ ID NO: 316924 - DNA, 16 bp, C. familiaris
ctgtgctctgcatgga

SEQ ID NO: 316925 - DNA, 16 bp, C. familiaris
ctgtgctctggggcct

SEQ ID NO: 316926 - DNA, 16 bp, C. familiaris
ctgtgctgaaggcagc

SEQ ID NO: 316927 - DNA, 16 bp, C. familiaris
ctgtgctgagcaagga

SEQ ID NO: 316928 - DNA, 16 bp, C. familiaris
ctgtgctgagcgtgga

SEQ ID NO: 316929 - DNA, 16 bp, C. familiaris
ctgtgctgctgctgct

SEQ ID NO: 316930 - DNA, 16 bp, C. familiaris
ctgtgctgggctctgg

SEQ ID NO: 316931 - DNA, 16 bp, C. familiaris
ctgtgctgggggtgga

SEQ ID NO: 316932 - DNA, 16 bp, C. familiaris
ctgtgctgggtgctgt

SEQ ID NO: 316933 - DNA, 16 bp, C. familiaris
ctgtggaaaacagcat

SEQ ID NO: 316934 - DNA, 16 bp, C. familiaris
ctgtggaaagagcctt

SEQ ID NO: 316935 - DNA, 18 bp, C. familiaris
ctgtggaacacatcaaca

SEQ ID NO: 316936 - DNA, 16 bp, C. familiaris
ctgtggaaggagcttc

SEQ ID NO: 316937 - DNA, 16 bp, C. familiaris
ctgtggacaagttcaa

SEQ ID NO: 316938 - DNA, 16 bp, C. familiaris
ctgtggagaagctttt

SEQ ID NO: 316939 - DNA, 16 bp, C. familiaris
ctgtggaggccaagaa

SEQ ID NO: 316940 - DNA, 16 bp, C. familiaris
ctgtggatttggacaa

SEQ ID NO: 316941 - DNA, 16 bp, C. familiaris
ctgtggccaggacttc

SEQ ID NO: 316942 - DNA, 16 bp, C. familiaris
ctgtggcccagccaag

SEQ ID NO: 316943 - DNA, 16 bp, C. familiaris
ctgtggctctgcctct

SEQ ID NO: 316944 - DNA, 16 bp, C. familiaris
ctgtggcttctcttct

SEQ ID NO: 316945 - DNA, 16 bp, C. familiaris
ctgtgggacacctggg

SEQ ID NO: 316946 - DNA, 16 bp, C. familiaris
ctgtgggaccctgggc

SEQ ID NO: 316947 - DNA, 16 bp, C. familiaris
ctgtgggcaggaagag

SEQ ID NO: 316948 - DNA, 16 bp, C. familiaris
ctgtgggcctcagttt

SEQ ID NO: 316949 - DNA, 16 bp, C. familiaris
ctgtgggcttatcata

SEQ ID NO: 316950 - DNA, 16 bp, C. familiaris
ctgtggggagcctgag

SEQ ID NO: 316951 - DNA, 16 bp, C. familiaris
ctgtggggcgcctggg

SEQ ID NO: 316952 - DNA, 16 bp, C. familiaris
ctgtggggctccctgc

SEQ ID NO: 316953 - DNA, 16 bp, C. familiaris
ctgtgggggcacctgg

SEQ ID NO: 316954 - DNA, 16 bp, C. familiaris
ctgtggggtgcctgat

SEQ ID NO: 316955 - DNA, 16 bp, C. familiaris
ctgtggtcagagaaca

SEQ ID NO: 316956 - DNA, 16 bp, C. familiaris
ctgtggtcttcctcct

SEQ ID NO: 316957 - DNA, 16 bp, C. familiaris
ctgtgtccagctctgt

SEQ ID NO: 316958 - DNA, 16 bp, C. familiaris
ctgtgtcccaggcttt

SEQ ID NO: 316959 - DNA, 16 bp, C. familiaris
ctgtgtccccaccccc

SEQ ID NO: 316960 - DNA, 16 bp, C. familiaris
ctgtgtccccagcacc

SEQ ID NO: 316961 - DNA, 16 bp, C. familiaris
ctgtgtccccagcact

SEQ ID NO: 316962 - DNA, 16 bp, C. familiaris
ctgtgtccccagcccc

SEQ ID NO: 316963 - DNA, 17 bp, C. familiaris
ctgtgtcccccagcgcc

SEQ ID NO: 316964 - DNA, 16 bp, C. familiaris
ctgtgtcccccccacc

SEQ ID NO: 316965 - DNA, 16 bp, C. familiaris
ctgtgtcccctcaaaa

SEQ ID NO: 316966 - DNA, 16 bp, C. familiaris
ctgtgtctagattcat

SEQ ID NO: 316967 - DNA, 16 bp, C. familiaris
ctgtgtctcagcttcc

SEQ ID NO: 316968 - DNA, 16 bp, C. familiaris
ctgtgtctctctgtcc

SEQ ID NO: 316969 - DNA, 16 bp, C. familiaris
ctgtgtctctgccacc

SEQ ID NO: 316970 - DNA, 16 bp, C. familiaris
ctgtgtctctgccctg

SEQ ID NO: 316971 - DNA, 16 bp, C. familiaris
ctgtgtctctgcctgt

SEQ ID NO: 316972 - DNA, 16 bp, C. familiaris
ctgtgtctctgctgcg

SEQ ID NO: 316973 - DNA, 16 bp, C. familiaris
ctgtgtctctgcttat

SEQ ID NO: 316974 - DNA, 16 bp, C. familiaris
ctgtgtctgcctccct

SEQ ID NO: 316975 - DNA, 16 bp, C. familiaris
ctgtgtctgtctgtcc

SEQ ID NO: 316976 - DNA, 16 bp, C. familiaris
ctgtgtctgtgcctct

SEQ ID NO: 316977 - DNA, 16 bp, C. familiaris
ctgtgtctgtgcttct

SEQ ID NO: 316978 - DNA, 16 bp, C. familiaris
ctgtgtctgtgtctct

SEQ ID NO: 316979 - DNA, 16 bp, C. familiaris
ctgtgtctgtttcctc

SEQ ID NO: 316980 - DNA, 16 bp, C. familiaris
ctgtgtctttatgaat

SEQ ID NO: 316981 - DNA, 16 bp, C. familiaris
ctgtgtctttcctgaa

SEQ ID NO: 316982 - DNA, 16 bp, C. familiaris
ctgtgtgactcagttg

SEQ ID NO: 316983 - DNA, 16 bp, C. familiaris
ctgtgtgacttgggca

SEQ ID NO: 316984 - DNA, 16 bp, C. familiaris
ctgtgtgactttggaa

SEQ ID NO: 316985 - DNA, 16 bp, C. familiaris
ctgtgtgactttggcc

SEQ ID NO: 316986 - DNA, 16 bp, C. familiaris
ctgtgtgattatcata

SEQ ID NO: 316987 - DNA, 16 bp, C. familiaris
ctgtgtgccaataaaa

SEQ ID NO: 316988 - DNA, 16 bp, C. familiaris
ctgtgtgccaggcatg

SEQ ID NO: 316989 - DNA, 16 bp, C. familiaris
ctgtgtgccaggccct

SEQ ID NO: 316990 - DNA, 16 bp, C. familiaris
ctgtgtgctgggcaca

SEQ ID NO: 316991 - DNA, 16 bp, C. familiaris
ctgtgtggctcagcag

SEQ ID NO: 316992 - DNA, 16 bp, C. familiaris
ctgtgtggctcagctg

SEQ ID NO: 316993 - DNA, 16 bp, C. familiaris
ctgtgtggctggagca

SEQ ID NO: 316994 - DNA, 16 bp, C. familiaris
ctgtgtgtcagacact

SEQ ID NO: 316995 - DNA, 16 bp, C. familiaris
ctgtgttctctctctc

SEQ ID NO: 316996 - DNA, 16 bp, C. familiaris
ctgtgttgattctcag

SEQ ID NO: 316997 - DNA, 16 bp, C. familiaris
ctgtgttgccataaac

SEQ ID NO: 316998 - DNA, 16 bp, C. familiaris
ctgtgtttctgtctct

SEQ ID NO: 316999 - DNA, 16 bp, C. familiaris
ctgttaaccagaagcc

SEQ ID NO: 317000 - DNA, 16 bp, C. familiaris
ctgttatgaataaagc

SEQ ID NO: 317001 - DNA, 16 bp, C. familiaris
ctgttcagtttttcca

SEQ ID NO: 317002 - DNA, 16 bp, C. familiaris
ctgttcatttatttct

SEQ ID NO: 317003 - DNA, 16 bp, C. familiaris
ctgttcctctgcctgg

SEQ ID NO: 317004 - DNA, 16 bp, C. familiaris
ctgttccttctgtctg

SEQ ID NO: 317005 - DNA, 16 bp, C. familiaris
ctgttccttttgctgt

SEQ ID NO: 317006 - DNA, 16 bp, C. familiaris
ctgttcgtttcccaga

SEQ ID NO: 317007 - DNA, 16 bp, C. familiaris
ctgttctctctgcctg

SEQ ID NO: 317008 - DNA, 16 bp, C. familiaris
ctgttctctctttatt

SEQ ID NO: 317009 - DNA, 16 bp, C. familiaris
ctgttgagcatggagc

SEQ ID NO: 317010 - DNA, 16 bp, C. familiaris
ctgttgatcagaagcc

SEQ ID NO: 317011 - DNA, 16 bp, C. familiaris
ctgttgccatggaaac

SEQ ID NO: 317012 - DNA, 17 bp, C. familiaris
ctgttgctcctggggcc

SEQ ID NO: 317013 - DNA, 16 bp, C. familiaris
ctgttggccatcttta

SEQ ID NO: 317014 - DNA, 59 bp, C. familiaris
ctgttggtgggaatgtgaactggtgcagccactctggaaaactgtgtggaggttcctca

SEQ ID NO: 317015 - DNA, 16 bp, C. familiaris
ctgttgttgttattat

SEQ ID NO: 317016 - DNA, 16 bp, C. familiaris
ctgttgttttaaaaaa

SEQ ID NO: 317017 - DNA, 16 bp, C. familiaris
ctgtttcacccatcct

SEQ ID NO: 317018 - DNA, 16 bp, C. familiaris
ctgtttcagattcttt

SEQ ID NO: 317019 - DNA, 16 bp, C. familiaris
ctgtttccctccccaa

SEQ ID NO: 317020 - DNA, 16 bp, C. familiaris
ctgtttcctttgcctg

SEQ ID NO: 317021 - DNA, 16 bp, C. familiaris
ctgtttctctgtgtgt

SEQ ID NO: 317022 - DNA, 16 bp, C. familiaris
ctgtttcttcatttgt

SEQ ID NO: 317023 - DNA, 16 bp, C. familiaris
ctgtttcttgtgctgt

SEQ ID NO: 317024 - DNA, 16 bp, C. familiaris
ctgtttctttccccag

SEQ ID NO: 317025 - DNA, 16 bp, C. familiaris
ctgtttgacagcattt

SEQ ID NO: 317026 - DNA, 16 bp, C. familiaris
ctgttttacattccca

SEQ ID NO: 317027 - DNA, 16 bp, C. familiaris
ctgttttagagatgag

SEQ ID NO: 317028 - DNA, 16 bp, C. familiaris
ctgttttataaatgag

SEQ ID NO: 317029 - DNA, 16 bp, C. familiaris
ctgttttccaaagtaa

SEQ ID NO: 317030 - DNA, 16 bp, C. familiaris
ctgttttccttagtgg

SEQ ID NO: 317031 - DNA, 16 bp, C. familiaris
ctgttttgattactac

SEQ ID NO: 317032 - DNA, 16 bp, C. familiaris
cttaaaaaaaattctt

SEQ ID NO: 317033 - DNA, 16 bp, C. familiaris
cttaaaaagaatgtat

SEQ ID NO: 317034 - DNA, 16 bp, C. familiaris
cttaaaacaacattta

SEQ ID NO: 317035 - DNA, 16 bp, C. familiaris
cttaaaacaatagaaa

SEQ ID NO: 317036 - DNA, 16 bp, C. familiaris
cttaaaacacaaattt

SEQ ID NO: 317037 - DNA, 16 bp, C. familiaris
cttaaaacagtgtctg

SEQ ID NO: 317038 - DNA, 16 bp, C. familiaris
cttaaaagaattttaa

SEQ ID NO: 317039 - DNA, 16 bp, C. familiaris
cttaaaagaatttttt

SEQ ID NO: 317040 - DNA, 16 bp, C. familiaris
cttaaaagtagaagag

SEQ ID NO: 317041 - DNA, 16 bp, C. familiaris
cttaaaataaatgaat

SEQ ID NO: 317042 - DNA, 16 bp, C. familiaris
cttaaacttatacagt

SEQ ID NO: 317043 - DNA, 16 bp, C. familiaris
cttaaagagagagaga

SEQ ID NO: 317044 - DNA, 16 bp, C. familiaris
cttaaagagatatttg

SEQ ID NO: 317045 - DNA, 16 bp, C. familiaris
cttaaatatatgaaaa

SEQ ID NO: 317046 - DNA, 16 bp, C. familiaris
cttaacagatgaggaa

SEQ ID NO: 317047 - DNA, 16 bp, C. familiaris
cttaacaggatgagca

SEQ ID NO: 317048 - DNA, 16 bp, C. familiaris
cttaacataatatttt

SEQ ID NO: 317049 - DNA, 16 bp, C. familiaris
cttaactacatagaag

SEQ ID NO: 317050 - DNA, 16 bp, C. familiaris
cttaacttctctgagc

SEQ ID NO: 317051 - DNA, 16 bp, C. familiaris
cttaacttctctgtgt

SEQ ID NO: 317052 - DNA, 16 bp, C. familiaris
cttaagaaagaagaac

SEQ ID NO: 317053 - DNA, 16 bp, C. familiaris
cttaagaaagaaggaa

SEQ ID NO: 317054 - DNA, 16 bp, C. familiaris
cttaagcaagctccac

SEQ ID NO: 317055 - DNA, 16 bp, C. familiaris
cttaaggaactagaaa

SEQ ID NO: 317056 - DNA, 16 bp, C. familiaris
cttaataaagctgaaa

SEQ ID NO: 317057 - DNA, 16 bp, C. familiaris
cttaatgccattgaac

SEQ ID NO: 317058 - DNA, 16 bp, C. familiaris
cttaattacttcttta

SEQ ID NO: 317059 - DNA, 16 bp, C. familiaris
cttacactgttgggaa

SEQ ID NO: 317060 - DNA, 16 bp, C. familiaris
cttaccagttgtgtga

SEQ ID NO: 317061 - DNA, 16 bp, C. familiaris
cttaccccactgagcc

SEQ ID NO: 317062 - DNA, 16 bp, C. familiaris
cttactaatgccatct

SEQ ID NO: 317063 - DNA, 16 bp, C. familiaris
cttactgaatatttta

SEQ ID NO: 317064 - DNA, 16 bp, C. familiaris
cttactgcccatcacc

SEQ ID NO: 317065 - DNA, 16 bp, C. familiaris
cttactgggatccctg

SEQ ID NO: 317066 - DNA, 16 bp, C. familiaris
cttactggtgtgaggt

SEQ ID NO: 317067 - DNA, 16 bp, C. familiaris
cttacttaaaagaaaa

SEQ ID NO: 317068 - DNA, 16 bp, C. familiaris
cttacttaagaaaaaa

SEQ ID NO: 317069 - DNA, 16 bp, C. familiaris
cttacttatatctgta

SEQ ID NO: 317070 - DNA, 16 bp, C. familiaris
cttagaacagagcctg

SEQ ID NO: 317071 - DNA, 16 bp, C. familiaris
cttagaacagtgtttg

SEQ ID NO: 317072 - DNA, 16 bp, C. familiaris
cttagaagaaagaaaa

SEQ ID NO: 317073 - DNA, 16 bp, C. familiaris
cttagagaaagaaaga

SEQ ID NO: 317074 - DNA, 16 bp, C. familiaris
cttagatgtggaatct

SEQ ID NO: 317075 - DNA, 16 bp, C. familiaris
cttagccagccaggca

SEQ ID NO: 317076 - DNA, 16 bp, C. familiaris
cttaggaaaaaaaaga

SEQ ID NO: 317077 - DNA, 16 bp, C. familiaris
cttatagatacagaga

SEQ ID NO: 317078 - DNA, 16 bp, C. familiaris
cttatatgtggaataa

SEQ ID NO: 317079 - DNA, 16 bp, C. familiaris
cttatccaaggtcaca

SEQ ID NO: 317080 - DNA, 16 bp, C. familiaris
cttatccttatcctta

SEQ ID NO: 317081 - DNA, 16 bp, C. familiaris
cttatgaatacataaa

SEQ ID NO: 317082 - DNA, 16 bp, C. familiaris
cttatgccaaagaggc

SEQ ID NO: 317083 - DNA, 16 bp, C. familiaris
cttatgccaataccac

SEQ ID NO: 317084 - DNA, 16 bp, C. familiaris
cttatgtcatgatccc

SEQ ID NO: 317085 - DNA, 16 bp, C. familiaris
cttattaaagaaaaaa

SEQ ID NO: 317086 - DNA, 16 bp, C. familiaris
cttattgtactgtact

SEQ ID NO: 317087 - DNA, 16 bp, C. familiaris
cttatttcattcagca

SEQ ID NO: 317088 - DNA, 16 bp, C. familiaris
cttatttccattttgt

SEQ ID NO: 317089 - DNA, 16 bp, C. familiaris
cttatttgccatctct

SEQ ID NO: 317090 - DNA, 16 bp, C. familiaris
cttattttacagaaaa

SEQ ID NO: 317091 - DNA, 16 bp, C. familiaris
cttcaaaaagttgaaa

SEQ ID NO: 317092 - DNA, 16 bp, C. familiaris
cttcaaaacaaagact

SEQ ID NO: 317093 - DNA, 16 bp, C. familiaris
cttcaaagaatgaaga

SEQ ID NO: 317094 - DNA, 16 bp, C. familiaris
cttcaaatatttgaaa

SEQ ID NO: 317095 - DNA, 16 bp, C. familiaris
cttcaacaacaacaac

SEQ ID NO: 317096 - DNA, 16 bp, C. familiaris
cttcaactttgttctt

SEQ ID NO: 317097 - DNA, 16 bp, C. familiaris
cttcaagacagaagtg

SEQ ID NO: 317098 - DNA, 16 bp, C. familiaris
cttcaagtttaggaga

SEQ ID NO: 317099 - DNA, 16 bp, C. familiaris
cttcaagtttttaaaa

SEQ ID NO: 317100 - DNA, 16 bp, C. familiaris
cttcaatccagggcat

SEQ ID NO: 317101 - DNA, 16 bp, C. familiaris
cttcaatctctgcctc

SEQ ID NO: 317102 - DNA, 16 bp, C. familiaris
cttcaatgtcaagaac

SEQ ID NO: 317103 - DNA, 16 bp, C. familiaris
cttcaatttaaaaagt

SEQ ID NO: 317104 - DNA, 16 bp, C. familiaris
cttcacacttgtcaga

SEQ ID NO: 317105 - DNA, 16 bp, C. familiaris
cttcacagaattggaa

SEQ ID NO: 317106 - DNA, 16 bp, C. familiaris
cttcacagatactgca

SEQ ID NO: 317107 - DNA, 16 bp, C. familiaris
cttcacagcaaaagaa

SEQ ID NO: 317108 - DNA, 16 bp, C. familiaris
cttcacatccttgcca

SEQ ID NO: 317109 - DNA, 16 bp, C. familiaris
cttcaccaccaccatc

SEQ ID NO: 317110 - DNA, 16 bp, C. familiaris
cttcaccttcaccttc

SEQ ID NO: 317111 - DNA, 16 bp, C. familiaris
cttcactctgcataat

SEQ ID NO: 317112 - DNA, 16 bp, C. familiaris
cttcactgtgcagagc

SEQ ID NO: 317113 - DNA, 16 bp, C. familiaris
cttcagaaaaataaaa

SEQ ID NO: 317114 - DNA, 16 bp, C. familiaris
cttcagaaaacagttt

SEQ ID NO: 317115 - DNA, 16 bp, C. familiaris
cttcagacagttggaa

SEQ ID NO: 317116 - DNA, 16 bp, C. familiaris
cttcagacattgccaa

SEQ ID NO: 317117 - DNA, 16 bp, C. familiaris
cttcagattttgtttt

SEQ ID NO: 317118 - DNA, 16 bp, C. familiaris
cttcagatttttttct

SEQ ID NO: 317119 - DNA, 16 bp, C. familiaris
cttcagcacaggtcat

SEQ ID NO: 317120 - DNA, 16 bp, C. familiaris
cttcagcccagggctt

SEQ ID NO: 317121 - DNA, 16 bp, C. familiaris
cttcagcccaggtgtg

SEQ ID NO: 317122 - DNA, 16 bp, C. familiaris
cttcagctcaagtcat

SEQ ID NO: 317123 - DNA, 16 bp, C. familiaris
cttcagctcagattgt

SEQ ID NO: 317124 - DNA, 16 bp, C. familiaris
cttcagctcagggagt

SEQ ID NO: 317125 - DNA, 16 bp, C. familiaris
cttcagcttcttcatc

SEQ ID NO: 317126 - DNA, 16 bp, C. familiaris
cttcaggaccacaccc

SEQ ID NO: 317127 - DNA, 16 bp, C. familiaris
cttcaggatccctggg

SEQ ID NO: 317128 - DNA, 16 bp, C. familiaris
cttcaggcagggagcc

SEQ ID NO: 317129 - DNA, 16 bp, C. familiaris
cttcagggaaaaaaat

SEQ ID NO: 317130 - DNA, 16 bp, C. familiaris
cttcaggtctttgctc

SEQ ID NO: 317131 - DNA, 16 bp, C. familiaris
cttcagtaaatatttt

SEQ ID NO: 317132 - DNA, 16 bp, C. familiaris
cttcagtggctcccca

SEQ ID NO: 317133 - DNA, 16 bp, C. familiaris
cttcagtggctccctg

SEQ ID NO: 317134 - DNA, 16 bp, C. familiaris
cttcagttccttgcca

SEQ ID NO: 317135 - DNA, 16 bp, C. familiaris
cttcagtttcctaatc

SEQ ID NO: 317136 - DNA, 16 bp, C. familiaris
cttcagttttctcacc

SEQ ID NO: 317137 - DNA, 16 bp, C. familiaris
cttcatacaaatggaa

SEQ ID NO: 317138 - DNA, 16 bp, C. familiaris
cttcatagggttgttg

SEQ ID NO: 317139 - DNA, 16 bp, C. familiaris
cttcatccagcaaggc

SEQ ID NO: 317140 - DNA, 16 bp, C. familiaris
cttcatcttcatcatc

SEQ ID NO: 317141 - DNA, 16 bp, C. familiaris
cttcatcttcttcatc

SEQ ID NO: 317142 - DNA, 16 bp, C. familiaris
cttcatctttgtcttc

SEQ ID NO: 317143 - DNA, 16 bp, C. familiaris
cttcatgcaccaggag

SEQ ID NO: 317144 - DNA, 16 bp, C. familiaris
cttcatggagcttaca

SEQ ID NO: 317145 - DNA, 16 bp, C. familiaris
cttcatggggcacctg

SEQ ID NO: 317146 - DNA, 16 bp, C. familiaris
cttcatgtattttaaa

SEQ ID NO: 317147 - DNA, 16 bp, C. familiaris
cttcatgtattttgaa

SEQ ID NO: 317148 - DNA, 16 bp, C. familiaris
cttcatttatttgaca

SEQ ID NO: 317149 - DNA, 16 bp, C. familiaris
cttcatttctgatttt

SEQ ID NO: 317150 - DNA, 16 bp, C. familiaris
cttccaaaaagaaaaa

SEQ ID NO: 317151 - DNA, 16 bp, C. familiaris
cttccaaaactgaaaa

SEQ ID NO: 317152 - DNA, 16 bp, C. familiaris
cttccaaaccatcctg

SEQ ID NO: 317153 - DNA, 16 bp, C. familiaris
cttccaatccatgggc

SEQ ID NO: 317154 - DNA, 16 bp, C. familiaris
cttccacaaccccttg

SEQ ID NO: 317155 - DNA, 16 bp, C. familiaris
cttccacagattggct

SEQ ID NO: 317156 - DNA, 16 bp, C. familiaris
cttccacatgcagaag

SEQ ID NO: 317157 - DNA, 16 bp, C. familiaris
cttccagaactgtgag

SEQ ID NO: 317158 - DNA, 16 bp, C. familiaris
cttccagaagcttcca

SEQ ID NO: 317159 - DNA, 16 bp, C. familiaris
cttccagaaggaacca

SEQ ID NO: 317160 - DNA, 16 bp, C. familiaris
cttccagggaagatgg

SEQ ID NO: 317161 - DNA, 16 bp, C. familiaris
cttccaggtatttatc

SEQ ID NO: 317162 - DNA, 16 bp, C. familiaris
cttccagttttattga

SEQ ID NO: 317163 - DNA, 16 bp, C. familiaris
cttccataatgttttc

SEQ ID NO: 317164 - DNA, 16 bp, C. familiaris
cttccatatctcagct

SEQ ID NO: 317165 - DNA, 16 bp, C. familiaris
cttccatcttccttgt

SEQ ID NO: 317166 - DNA, 16 bp, C. familiaris
cttcccacagggagcc

SEQ ID NO: 317167 - DNA, 16 bp, C. familiaris
cttcccagaaaccaaa

SEQ ID NO: 317168 - DNA, 16 bp, C. familiaris
cttcccagaggagggg

SEQ ID NO: 317169 - DNA, 16 bp, C. familiaris
cttcccagcttccaga

SEQ ID NO: 317170 - DNA, 16 bp, C. familiaris
cttcccccagaagacc

SEQ ID NO: 317171 - DNA, 16 bp, C. familiaris
cttccccctgcttgtg

SEQ ID NO: 317172 - DNA, 16 bp, C. familiaris
cttcccctataatccc

SEQ ID NO: 317173 - DNA, 16 bp, C. familiaris
cttcccctctccccag

SEQ ID NO: 317174 - DNA, 16 bp, C. familiaris
cttcccctctgcttgt

SEQ ID NO: 317175 - DNA, 16 bp, C. familiaris
cttcccctgctcgtgc

SEQ ID NO: 317176 - DNA, 16 bp, C. familiaris
cttcccctgtgatcct

SEQ ID NO: 317177 - DNA, 16 bp, C. familiaris
cttcccggaggaggtg

SEQ ID NO: 317178 - DNA, 16 bp, C. familiaris
cttccctgagattctt

SEQ ID NO: 317179 - DNA, 16 bp, C. familiaris
cttccctgagccccag

SEQ ID NO: 317180 - DNA, 16 bp, C. familiaris
cttccctgagtctcca

SEQ ID NO: 317181 - DNA, 16 bp, C. familiaris
cttccctgctcatgct

SEQ ID NO: 317182 - DNA, 16 bp, C. familiaris
cttccctgtgcagaag

SEQ ID NO: 317183 - DNA, 16 bp, C. familiaris
cttccctgtgtgtgtg

SEQ ID NO: 317184 - DNA, 16 bp, C. familiaris
cttcctaccttctttg

SEQ ID NO: 317185 - DNA, 16 bp, C. familiaris
cttcctagaggaggtg

SEQ ID NO: 317186 - DNA, 16 bp, C. familiaris
cttcctcaaaaaatta

SEQ ID NO: 317187 - DNA, 16 bp, C. familiaris
cttcctcaagaagtta

SEQ ID NO: 317188 - DNA, 16 bp, C. familiaris
cttcctcaagataaaa

SEQ ID NO: 317189 - DNA, 16 bp, C. familiaris
cttcctcaatgtcttt

SEQ ID NO: 317190 - DNA, 16 bp, C. familiaris
cttcctccacccctag

SEQ ID NO: 317191 - DNA, 16 bp, C. familiaris
cttcctccagaaagcc

SEQ ID NO: 317192 - DNA, 16 bp, C. familiaris
cttcctccaggcagcc

SEQ ID NO: 317193 - DNA, 16 bp, C. familiaris
cttcctcctctgcctg

SEQ ID NO: 317194 - DNA, 16 bp, C. familiaris
cttcctcctgtgtctc

SEQ ID NO: 317195 - DNA, 16 bp, C. familiaris
cttcctctgccactcc

SEQ ID NO: 317196 - DNA, 16 bp, C. familiaris
cttcctctgccccatc

SEQ ID NO: 317197 - DNA, 16 bp, C. familiaris
cttcctctgcctctgt

SEQ ID NO: 317198 - DNA, 16 bp, C. familiaris
cttcctctgcctgtgt

SEQ ID NO: 317199 - DNA, 16 bp, C. familiaris
cttcctctgtgaaatg

SEQ ID NO: 317200 - DNA, 17 bp, C. familiaris
cttcctctgtgagatct

SEQ ID NO: 317201 - DNA, 16 bp, C. familiaris
cttcctctgtgccagg

SEQ ID NO: 317202 - DNA, 16 bp, C. familiaris
cttcctctgtgtctct

SEQ ID NO: 317203 - DNA, 16 bp, C. familiaris
cttcctgaaagcagga

SEQ ID NO: 317204 - DNA, 16 bp, C. familiaris
cttcctgaaggaggtg

SEQ ID NO: 317205 - DNA, 16 bp, C. familiaris
cttcctgcaaggaacc

SEQ ID NO: 317206 - DNA, 16 bp, C. familiaris
cttcctgcagggaccc

SEQ ID NO: 317207 - DNA, 16 bp, C. familiaris
cttcctgcattttttt

SEQ ID NO: 317208 - DNA, 16 bp, C. familiaris
cttcctgcccacaggt

SEQ ID NO: 317209 - DNA, 16 bp, C. familiaris
cttcctgccccagccc

SEQ ID NO: 317210 - DNA, 16 bp, C. familiaris
cttcctgctcctgctc

SEQ ID NO: 317211 - DNA, 16 bp, C. familiaris
cttcctgctgagtgag

SEQ ID NO: 317212 - DNA, 16 bp, C. familiaris
cttcctgctgctgctg

SEQ ID NO: 317213 - DNA, 16 bp, C. familiaris
cttcctgctgggcagg

SEQ ID NO: 317214 - DNA, 16 bp, C. familiaris
cttcctgcttctgctc

SEQ ID NO: 317215 - DNA, 16 bp, C. familiaris
cttcctggaagaagtg

SEQ ID NO: 317216 - DNA, 16 bp, C. familiaris
cttcctggaagaggca

SEQ ID NO: 317217 - DNA, 16 bp, C. familiaris
cttcctggagaaagtg

SEQ ID NO: 317218 - DNA, 16 bp, C. familiaris
cttcctggagaaggtg

SEQ ID NO: 317219 - DNA, 16 bp, C. familiaris
cttcctggaggaaggg

SEQ ID NO: 317220 - DNA, 16 bp, C. familiaris
cttcctggaggagatg

SEQ ID NO: 317221 - DNA, 16 bp, C. familiaris
cttcctggaggaggaa

SEQ ID NO: 317222 - DNA, 16 bp, C. familiaris
cttcctggaggaggca

SEQ ID NO: 317223 - DNA, 16 bp, C. familiaris
cttcctggaggaggtg

SEQ ID NO: 317224 - DNA, 16 bp, C. familiaris
cttcctgggcctcagt

SEQ ID NO: 317225 - DNA, 16 bp, C. familiaris
cttcctggggctgctg

SEQ ID NO: 317226 - DNA, 16 bp, C. familiaris
cttcctgtctctctgt

SEQ ID NO: 317227 - DNA, 16 bp, C. familiaris
cttcctgtgtctgcct

SEQ ID NO: 317228 - DNA, 16 bp, C. familiaris
cttcctgtttctatga

SEQ ID NO: 317229 - DNA, 16 bp, C. familiaris
cttcctgttttttaaa

SEQ ID NO: 317230 - DNA, 16 bp, C. familiaris
cttccttaaaaaaaaa

SEQ ID NO: 317231 - DNA, 16 bp, C. familiaris
cttccttactgatttg

SEQ ID NO: 317232 - DNA, 16 bp, C. familiaris
cttccttccctccagc

SEQ ID NO: 317233 - DNA, 16 bp, C. familiaris
cttccttctgattttc

SEQ ID NO: 317234 - DNA, 16 bp, C. familiaris
cttccttctggtaacc

SEQ ID NO: 317235 - DNA, 16 bp, C. familiaris
cttcctttttaaagct

SEQ ID NO: 317236 - DNA, 16 bp, C. familiaris
cttcgactccatgaga

SEQ ID NO: 317237 - DNA, 16 bp, C. familiaris
cttcgggctccctgca

SEQ ID NO: 317238 - DNA, 16 bp, C. familiaris
cttctacaagtatttc

SEQ ID NO: 317239 - DNA, 16 bp, C. familiaris
cttctagaagaaaaaa

SEQ ID NO: 317240 - DNA, 16 bp, C. familiaris
cttctattcaacacag

SEQ ID NO: 317241 - DNA, 16 bp, C. familiaris
cttctcaaaattaaaa

SEQ ID NO: 317242 - DNA, 16 bp, C. familiaris
cttctcagaaaccatg

SEQ ID NO: 317243 - DNA, 16 bp, C. familiaris
cttctcagccttcaga

SEQ ID NO: 317244 - DNA, 16 bp, C. familiaris
cttctcagtcaagctt

SEQ ID NO: 317245 - DNA, 16 bp, C. familiaris
cttctcattcagtttt

SEQ ID NO: 317246 - DNA, 16 bp, C. familiaris
cttctccacattctca

SEQ ID NO: 317247 - DNA, 16 bp, C. familiaris
cttctccacctgcctg

SEQ ID NO: 317248 - DNA, 16 bp, C. familiaris
cttctccactctgcct

SEQ ID NO: 317249 - DNA, 16 bp, C. familiaris
cttctccagctccctc

SEQ ID NO: 317250 - DNA, 16 bp, C. familiaris
cttctccatctacctg

SEQ ID NO: 317251 - DNA, 16 bp, C. familiaris
cttctccatctgctcc

SEQ ID NO: 317252 - DNA, 16 bp, C. familiaris
cttctccccgaggccc

SEQ ID NO: 317253 - DNA, 16 bp, C. familiaris
cttctccctcagcctc

SEQ ID NO: 317254 - DNA, 16 bp, C. familiaris
cttctccctctccagc

SEQ ID NO: 317255 - DNA, 16 bp, C. familiaris
cttctccctctgccag

SEQ ID NO: 317256 - DNA, 16 bp, C. familiaris
cttctccctgctgctc

SEQ ID NO: 317257 - DNA, 16 bp, C. familiaris
cttctccctgggcctg

SEQ ID NO: 317258 - DNA, 16 bp, C. familiaris
cttctcctgctgcctg

SEQ ID NO: 317259 - DNA, 16 bp, C. familiaris
cttctcggggccatcc

SEQ ID NO: 317260 - DNA, 16 bp, C. familiaris
cttctctcactcagca

SEQ ID NO: 317261 - DNA, 16 bp, C. familiaris
cttctctccatctcca

SEQ ID NO: 317262 - DNA, 16 bp, C. familiaris
cttctctctgcctgtg

SEQ ID NO: 317263 - DNA, 16 bp, C. familiaris
cttctctctgcttctg

SEQ ID NO: 317264 - DNA, 16 bp, C. familiaris
cttctctgaggaggtg

SEQ ID NO: 317265 - DNA, 16 bp, C. familiaris
cttctctgtgcagaag

SEQ ID NO: 317266 - DNA, 16 bp, C. familiaris
cttctctttctgccca

SEQ ID NO: 317267 - DNA, 16 bp, C. familiaris
cttctgaaaatgaaaa

SEQ ID NO: 317268 - DNA, 16 bp, C. familiaris
cttctgaactggcttt

SEQ ID NO: 317269 - DNA, 16 bp, C. familiaris
cttctgaagctgttcc

SEQ ID NO: 317270 - DNA, 16 bp, C. familiaris
cttctgaattgccttt

SEQ ID NO: 317271 - DNA, 16 bp, C. familiaris
cttctgagagctttct

SEQ ID NO: 317272 - DNA, 16 bp, C. familiaris
cttctgagtctcagtt

SEQ ID NO: 317273 - DNA, 16 bp, C. familiaris
cttctgcagcttcttc

SEQ ID NO: 317274 - DNA, 16 bp, C. familiaris
cttctgcatgtggctc

SEQ ID NO: 317275 - DNA, 16 bp, C. familiaris
cttctgcccatgtctc

SEQ ID NO: 317276 - DNA, 16 bp, C. familiaris
cttctgcctctgctcc

SEQ ID NO: 317277 - DNA, 16 bp, C. familiaris
cttctgcctctggctc

SEQ ID NO: 317278 - DNA, 16 bp, C. familiaris
cttctgcctgaagaac

SEQ ID NO: 317279 - DNA, 16 bp, C. familiaris
cttctgcctgggtctc

SEQ ID NO: 317280 - DNA, 16 bp, C. familiaris
cttctgcctgtctctg

SEQ ID NO: 317281 - DNA, 16 bp, C. familiaris
cttctgcttattttta

SEQ ID NO: 317282 - DNA, 16 bp, C. familiaris
cttctgcttcttccag

SEQ ID NO: 317283 - DNA, 16 bp, C. familiaris
cttctggaatgttctt

SEQ ID NO: 317284 - DNA, 16 bp, C. familiaris
cttctggaatttttat

SEQ ID NO: 317285 - DNA, 16 bp, C. familiaris
cttctggctcagggca

SEQ ID NO: 317286 - DNA, 16 bp, C. familiaris
cttctgggaggaggtg

SEQ ID NO: 317287 - DNA, 16 bp, C. familiaris
cttctgggagttttat

SEQ ID NO: 317288 - DNA, 16 bp, C. familiaris
cttctggggacacctg

SEQ ID NO: 317289 - DNA, 16 bp, C. familiaris
cttctgggtgaggggc

SEQ ID NO: 317290 - DNA, 16 bp, C. familiaris
cttctgtcacttagca

SEQ ID NO: 317291 - DNA, 16 bp, C. familiaris
cttctgtgtgtatgtg

SEQ ID NO: 317292 - DNA, 16 bp, C. familiaris
cttcttcatcatcatc

SEQ ID NO: 317293 - DNA, 16 bp, C. familiaris
cttcttcatctcttac

SEQ ID NO: 317294 - DNA, 16 bp, C. familiaris
cttcttccacagtttg

SEQ ID NO: 317295 - DNA, 16 bp, C. familiaris
cttcttcctcagcctg

SEQ ID NO: 317296 - DNA, 16 bp, C. familiaris
cttcttcctctgcatg

SEQ ID NO: 317297 - DNA, 16 bp, C. familiaris
cttcttcctctgctgt

SEQ ID NO: 317298 - DNA, 16 bp, C. familiaris
cttcttcctgcctctg

SEQ ID NO: 317299 - DNA, 16 bp, C. familiaris
cttcttccttatcaat

SEQ ID NO: 317300 - DNA, 16 bp, C. familiaris
cttcttctgggactct

SEQ ID NO: 317301 - DNA, 16 bp, C. familiaris
cttcttcttcatcatc

SEQ ID NO: 317302 - DNA, 16 bp, C. familiaris
cttcttcttctgggtg

SEQ ID NO: 317303 - DNA, 16 bp, C. familiaris
cttcttcttctttaaa

SEQ ID NO: 317304 - DNA, 16 bp, C. familiaris
cttcttctttgtcaat

SEQ ID NO: 317305 - DNA, 16 bp, C. familiaris
cttcttgaggaccctc

SEQ ID NO: 317306 - DNA, 16 bp, C. familiaris
cttcttgcggggagcc

SEQ ID NO: 317307 - DNA, 16 bp, C. familiaris
cttcttgctctgcctg

SEQ ID NO: 317308 - DNA, 16 bp, C. familiaris
cttcttggaggaagtg

SEQ ID NO: 317309 - DNA, 16 bp, C. familiaris
cttcttggaggaggtg

SEQ ID NO: 317310 - DNA, 16 bp, C. familiaris
cttctttatggctgaa

SEQ ID NO: 317311 - DNA, 16 bp, C. familiaris
cttctttctcaaggtt

SEQ ID NO: 317312 - DNA, 16 bp, C. familiaris
cttctttcttttaaga

SEQ ID NO: 317313 - DNA, 16 bp, C. familiaris
cttctttgagaaatgt

SEQ ID NO: 317314 - DNA, 16 bp, C. familiaris
cttctttgcaaaaatg

SEQ ID NO: 317315 - DNA, 16 bp, C. familiaris
cttcttttaagattta

SEQ ID NO: 317316 - DNA, 16 bp, C. familiaris
cttcttttgaaaaatg

SEQ ID NO: 317317 - DNA, 16 bp, C. familiaris
cttcttttgtgaagtg

SEQ ID NO: 317318 - DNA, 16 bp, C. familiaris
cttcttttttaagatt

SEQ ID NO: 317319 - DNA, 16 bp, C. familiaris
cttgaaaaagaaagaa

SEQ ID NO: 317320 - DNA, 16 bp, C. familiaris
cttgaaaaagaacaaa

SEQ ID NO: 317321 - DNA, 16 bp, C. familiaris
cttgaaaacaatgtgt

SEQ ID NO: 317322 - DNA, 16 bp, C. familiaris
cttgaaaatattttct

SEQ ID NO: 317323 - DNA, 16 bp, C. familiaris
cttgaaacactttctt

SEQ ID NO: 317324 - DNA, 16 bp, C. familiaris
cttgaaagaagttact

SEQ ID NO: 317325 - DNA, 16 bp, C. familiaris
cttgaaagagaaaaaa

SEQ ID NO: 317326 - DNA, 16 bp, C. familiaris
cttgaaattaaaaaaa

SEQ ID NO: 317327 - DNA, 16 bp, C. familiaris
cttgaacaaatggaaa

SEQ ID NO: 317328 - DNA, 16 bp, C. familiaris
cttgaagattctcttt

SEQ ID NO: 317329 - DNA, 16 bp, C. familiaris
cttgaagcccagaatt

SEQ ID NO: 317330 - DNA, 16 bp, C. familiaris
cttgaaggatgagcag

SEQ ID NO: 317331 - DNA, 16 bp, C. familiaris
cttgaagttaaaaaaa

SEQ ID NO: 317332 - DNA, 16 bp, C. familiaris
cttgaatgagaaaaga

SEQ ID NO: 317333 - DNA, 16 bp, C. familiaris
cttgaattctttcttg

SEQ ID NO: 317334 - DNA, 16 bp, C. familiaris
cttgaatttcttttat

SEQ ID NO: 317335 - DNA, 16 bp, C. familiaris
cttgaccaaagtcaca

SEQ ID NO: 317336 - DNA, 16 bp, C. familiaris
cttgactccaggaccc

SEQ ID NO: 317337 - DNA, 16 bp, C. familiaris
cttgactgcatgttct

SEQ ID NO: 317338 - DNA, 16 bp, C. familiaris
cttgacttctctttct

SEQ ID NO: 317339 - DNA, 16 bp, C. familiaris
cttgagaaagaagaaa

SEQ ID NO: 317340 - DNA, 16 bp, C. familiaris
cttgagattctgtccc

SEQ ID NO: 317341 - DNA, 16 bp, C. familiaris
cttgaggaatctccat

SEQ ID NO: 317342 - DNA, 16 bp, C. familiaris
cttgatatattttgga

SEQ ID NO: 317343 - DNA, 16 bp, C. familiaris
cttgatcaagataaaa

SEQ ID NO: 317344 - DNA, 16 bp, C. familiaris
cttgatcccagaactc

SEQ ID NO: 317345 - DNA, 16 bp, C. familiaris
cttgatcttggggtcc

SEQ ID NO: 317346 - DNA, 16 bp, C. familiaris
cttgatggagtcactg

SEQ ID NO: 317347 - DNA, 16 bp, C. familiaris
cttgattgtggctcag

SEQ ID NO: 317348 - DNA, 16 bp, C. familiaris
cttgatttcagcccag

SEQ ID NO: 317349 - DNA, 16 bp, C. familiaris
cttgatttcagctctg

SEQ ID NO: 317350 - DNA, 16 bp, C. familiaris
cttgattttggcttgg

SEQ ID NO: 317351 - DNA, 16 bp, C. familiaris
cttgcagagctgattt

SEQ ID NO: 317352 - DNA, 16 bp, C. familiaris
cttgcagagctgcttt

SEQ ID NO: 317353 - DNA, 16 bp, C. familiaris
cttgcaggccagaaag

SEQ ID NO: 317354 - DNA, 16 bp, C. familiaris
cttgcccaacatcaca

SEQ ID NO: 317355 - DNA, 16 bp, C. familiaris
cttgcccaaggtcaca

SEQ ID NO: 317356 - DNA, 16 bp, C. familiaris
cttgcccaagttcaca

SEQ ID NO: 317357 - DNA, 16 bp, C. familiaris
cttgccccaagtcaca

SEQ ID NO: 317358 - DNA, 16 bp, C. familiaris
cttgccctcagggagc

SEQ ID NO: 317359 - DNA, 16 bp, C. familiaris
cttgccctctctgagc

SEQ ID NO: 317360 - DNA, 16 bp, C. familiaris
cttgcctaaggtcaca

SEQ ID NO: 317361 - DNA, 16 bp, C. familiaris
cttgcctcaggctccc

SEQ ID NO: 317362 - DNA, 16 bp, C. familiaris
cttgccttgttcctaa

SEQ ID NO: 317363 - DNA, 16 bp, C. familiaris
cttgcctttttcctga

SEQ ID NO: 317364 - DNA, 16 bp, C. familiaris
cttgctcagcggagag

SEQ ID NO: 317365 - DNA, 16 bp, C. familiaris
cttgctcctccctctg

SEQ ID NO: 317366 - DNA, 16 bp, C. familiaris
cttgctgctctcaggg

SEQ ID NO: 317367 - DNA, 16 bp, C. familiaris
cttggaaaagtcactt

SEQ ID NO: 317368 - DNA, 16 bp, C. familiaris
cttggaaacaaacaaa

SEQ ID NO: 317369 - DNA, 16 bp, C. familiaris
cttggaacctgtgaat

SEQ ID NO: 317370 - DNA, 16 bp, C. familiaris
cttggaagaaaaaaaa

SEQ ID NO: 317371 - DNA, 16 bp, C. familiaris
cttggaagaaagagaa

SEQ ID NO: 317372 - DNA, 16 bp, C. familiaris
cttggaagcagatcct

SEQ ID NO: 317373 - DNA, 16 bp, C. familiaris
cttggaagtggatcct

SEQ ID NO: 317374 - DNA, 16 bp, C. familiaris
cttggacttcagcctc

SEQ ID NO: 317375 - DNA, 16 bp, C. familiaris
cttggagaccctggat

SEQ ID NO: 317376 - DNA, 16 bp, C. familiaris
cttggagcttacattc

SEQ ID NO: 317377 - DNA, 16 bp, C. familiaris
cttggaggatgattgc

SEQ ID NO: 317378 - DNA, 16 bp, C. familiaris
cttggatgctttttat

SEQ ID NO: 317379 - DNA, 16 bp, C. familiaris
cttggattcctttctc

SEQ ID NO: 317380 - DNA, 16 bp, C. familiaris
cttggcaaccaccatt

SEQ ID NO: 317381 - DNA, 16 bp, C. familiaris
cttggccaaggtcaca

SEQ ID NO: 317382 - DNA, 16 bp, C. familiaris
cttggcctctctgagc

SEQ ID NO: 317383 - DNA, 16 bp, C. familiaris
cttggctaaatttatt

SEQ ID NO: 317384 - DNA, 16 bp, C. familiaris
cttggctcatgacccc

SEQ ID NO: 317385 - DNA, 16 bp, C. familiaris
cttggcttgcagacag

SEQ ID NO: 317386 - DNA, 16 bp, C. familiaris
cttgggactcaatccc

SEQ ID NO: 317387 - DNA, 16 bp, C. familiaris
cttgggactccgggat

SEQ ID NO: 317388 - DNA, 16 bp, C. familiaris
cttgggatccagtccc

SEQ ID NO: 317389 - DNA, 16 bp, C. familiaris
cttgggatcttgggat

SEQ ID NO: 317390 - DNA, 16 bp, C. familiaris
cttgggcaaatcactg

SEQ ID NO: 317391 - DNA, 16 bp, C. familiaris
cttggggcagccccgg

SEQ ID NO: 317392 - DNA, 16 bp, C. familiaris
cttggggctctatctc

SEQ ID NO: 317393 - DNA, 16 bp, C. familiaris
cttgggggcagcccag

SEQ ID NO: 317394 - DNA, 16 bp, C. familiaris
cttgggtggtgatccc

SEQ ID NO: 317395 - DNA, 16 bp, C. familiaris
cttgggtgtgatcctg

SEQ ID NO: 317396 - DNA, 16 bp, C. familiaris
cttgggttcatcttgt

SEQ ID NO: 317397 - DNA, 16 bp, C. familiaris
cttggtatttatttat

SEQ ID NO: 317398 - DNA, 16 bp, C. familiaris
cttggtcggttaagtg

SEQ ID NO: 317399 - DNA, 16 bp, C. familiaris
cttggtggctcagctg

SEQ ID NO: 317400 - DNA, 16 bp, C. familiaris
cttggttttgggtcag

SEQ ID NO: 317401 - DNA, 16 bp, C. familiaris
cttgtatttccctgat

SEQ ID NO: 317402 - DNA, 16 bp, C. familiaris
cttgtcaacatctgtt

SEQ ID NO: 317403 - DNA, 16 bp, C. familiaris
cttgtcattttgtcca

SEQ ID NO: 317404 - DNA, 16 bp, C. familiaris
cttgtctcacattttg

SEQ ID NO: 317405 - DNA, 16 bp, C. familiaris
cttgtctctctgcctt

SEQ ID NO: 317406 - DNA, 16 bp, C. familiaris
cttgtctttggagatg

SEQ ID NO: 317407 - DNA, 16 bp, C. familiaris
cttgtgaagagcctgc

SEQ ID NO: 317408 - DNA, 16 bp, C. familiaris
cttgtgaatatactaa

SEQ ID NO: 317409 - DNA, 16 bp, C. familiaris
cttgtgcgctctctct

SEQ ID NO: 317410 - DNA, 16 bp, C. familiaris
cttgtgctctctctgt

SEQ ID NO: 317411 - DNA, 16 bp, C. familiaris
cttgtgctgttggtgg

SEQ ID NO: 317412 - DNA, 16 bp, C. familiaris
cttgtggggagcctgt

SEQ ID NO: 317413 - DNA, 16 bp, C. familiaris
cttgtgtctgcctctc

SEQ ID NO: 317414 - DNA, 16 bp, C. familiaris
cttgtgtgtgcatgtg

SEQ ID NO: 317415 - DNA, 16 bp, C. familiaris
cttgtgttcttctcta

SEQ ID NO: 317416 - DNA, 16 bp, C. familiaris
cttgtgttgttaattt

SEQ ID NO: 317417 - DNA, 16 bp, C. familiaris
cttgtgttgttcctga

SEQ ID NO: 317418 - DNA, 16 bp, C. familiaris
cttgttaaaagaaact

SEQ ID NO: 317419 - DNA, 16 bp, C. familiaris
cttgttagaaatgcag

SEQ ID NO: 317420 - DNA, 16 bp, C. familiaris
cttgttagaaatgcat

SEQ ID NO: 317421 - DNA, 16 bp, C. familiaris
cttgttctctgtattt

SEQ ID NO: 317422 - DNA, 16 bp, C. familiaris
cttgttgatgtgatat

SEQ ID NO: 317423 - DNA, 16 bp, C. familiaris
ctttaaaaaaaaatag

SEQ ID NO: 317424 - DNA, 16 bp, C. familiaris
ctttaaaaaaagaaac

SEQ ID NO: 317425 - DNA, 16 bp, C. familiaris
ctttaaaaaaagaaga

SEQ ID NO: 317426 - DNA, 16 bp, C. familiaris
ctttaaaaaaatagaa

SEQ ID NO: 317427 - DNA, 16 bp, C. familiaris
ctttaaaaaatatatg

SEQ ID NO: 317428 - DNA, 16 bp, C. familiaris
ctttaaaaagaaaagt

SEQ ID NO: 317429 - DNA, 16 bp, C. familiaris
ctttaaaaaggaaaaa

SEQ ID NO: 317430 - DNA, 16 bp, C. familiaris
ctttaaaaatgaatga

SEQ ID NO: 317431 - DNA, 16 bp, C. familiaris
ctttaaaaatgctgat

SEQ ID NO: 317432 - DNA, 16 bp, C. familiaris
ctttaaaacaaagact

SEQ ID NO: 317433 - DNA, 16 bp, C. familiaris
ctttaaaacatttctt

SEQ ID NO: 317434 - DNA, 16 bp, C. familiaris
ctttaaaatattttca

SEQ ID NO: 317435 - DNA, 16 bp, C. familiaris
ctttaaaatttttcaa

SEQ ID NO: 317436 - DNA, 16 bp, C. familiaris
ctttaaagaaaaagat

SEQ ID NO: 317437 - DNA, 16 bp, C. familiaris
ctttaaagaaaatgaa

SEQ ID NO: 317438 - DNA, 16 bp, C. familiaris
ctttaaagaaaattct

SEQ ID NO: 317439 - DNA, 16 bp, C. familiaris
ctttaaataaatacat

SEQ ID NO: 317440 - DNA, 16 bp, C. familiaris
ctttaaatatttggta

SEQ ID NO: 317441 - DNA, 16 bp, C. familiaris
ctttaacataaaaatt

SEQ ID NO: 317442 - DNA, 16 bp, C. familiaris
ctttaagaaaaaaaag

SEQ ID NO: 317443 - DNA, 16 bp, C. familiaris
ctttaagaaatgaaaa

SEQ ID NO: 317444 - DNA, 16 bp, C. familiaris
ctttaagcttcagttt

SEQ ID NO: 317445 - DNA, 16 bp, C. familiaris
ctttaaggaaaaaaaa

SEQ ID NO: 317446 - DNA, 16 bp, C. familiaris
ctttagaaaattattt

SEQ ID NO: 317447 - DNA, 16 bp, C. familiaris
ctttaggggaaaaaaa

SEQ ID NO: 317448 - DNA, 16 bp, C. familiaris
ctttataatgtatttt

SEQ ID NO: 317449 - DNA, 16 bp, C. familiaris
ctttatagatgaagaa

SEQ ID NO: 317450 - DNA, 16 bp, C. familiaris
ctttatataaatgaaa

SEQ ID NO: 317451 - DNA, 16 bp, C. familiaris
ctttatatttaaagta

SEQ ID NO: 317452 - DNA, 16 bp, C. familiaris
ctttatcaaatgcttt

SEQ ID NO: 317453 - DNA, 16 bp, C. familiaris
ctttatcagatatatt

SEQ ID NO: 317454 - DNA, 16 bp, C. familiaris
ctttatccattcatat

SEQ ID NO: 317455 - DNA, 16 bp, C. familiaris
ctttatctctttggtt

SEQ ID NO: 317456 - DNA, 16 bp, C. familiaris
ctttattatgttaaga

SEQ ID NO: 317457 - DNA, 16 bp, C. familiaris
ctttatttcattttga

SEQ ID NO: 317458 - DNA, 16 bp, C. familiaris
ctttatttgaaaaata

SEQ ID NO: 317459 - DNA, 16 bp, C. familiaris
ctttatttgaaaatta

SEQ ID NO: 317460 - DNA, 16 bp, C. familiaris
ctttattttaccttca

SEQ ID NO: 317461 - DNA, 16 bp, C. familiaris
ctttcaaaaaagaaaa

SEQ ID NO: 317462 - DNA, 16 bp, C. familiaris
ctttcaaaagaaaaca

SEQ ID NO: 317463 - DNA, 16 bp, C. familiaris
ctttcaaaattctctt

SEQ ID NO: 317464 - DNA, 16 bp, C. familiaris
ctttcaagagcaagag

SEQ ID NO: 317465 - DNA, 16 bp, C. familiaris
ctttcaagattttgtt

SEQ ID NO: 317466 - DNA, 16 bp, C. familiaris
ctttcaccaatgtttt

SEQ ID NO: 317467 - DNA, 16 bp, C. familiaris
ctttcactgtaataaa

SEQ ID NO: 317468 - DNA, 16 bp, C. familiaris
ctttcagaggtgttct

SEQ ID NO: 317469 - DNA, 16 bp, C. familiaris
ctttcagatgtgttct

SEQ ID NO: 317470 - DNA, 16 bp, C. familiaris
ctttcagcctccagaa

SEQ ID NO: 317471 - DNA, 16 bp, C. familiaris
ctttcagcgccctcag

SEQ ID NO: 317472 - DNA, 16 bp, C. familiaris
ctttcagtaaatattt

SEQ ID NO: 317473 - DNA, 16 bp, C. familiaris
ctttcagtctccagaa

SEQ ID NO: 317474 - DNA, 16 bp, C. familiaris
ctttcatccattttca

SEQ ID NO: 317475 - DNA, 16 bp, C. familiaris
ctttcatctttagcag

SEQ ID NO: 317476 - DNA, 16 bp, C. familiaris
ctttcattcattttga

SEQ ID NO: 317477 - DNA, 16 bp, C. familiaris
ctttccagtttttgga

SEQ ID NO: 317478 - DNA, 16 bp, C. familiaris
ctttccccctaaggtc

SEQ ID NO: 317479 - DNA, 16 bp, C. familiaris
ctttccctgcctagcc

SEQ ID NO: 317480 - DNA, 16 bp, C. familiaris
ctttcctcatctggga

SEQ ID NO: 317481 - DNA, 16 bp, C. familiaris
ctttcctccacatctt

SEQ ID NO: 317482 - DNA, 16 bp, C. familiaris
ctttcctctgtgcatg

SEQ ID NO: 317483 - DNA, 16 bp, C. familiaris
ctttctaaaagaaaaa

SEQ ID NO: 317484 - DNA, 16 bp, C. familiaris
ctttctcacaaataaa

SEQ ID NO: 317485 - DNA, 16 bp, C. familiaris
ctttctcactggtgtg

SEQ ID NO: 317486 - DNA, 16 bp, C. familiaris
ctttctcagacaaaca

SEQ ID NO: 317487 - DNA, 16 bp, C. familiaris
ctttctcatggctgaa

SEQ ID NO: 317488 - DNA, 16 bp, C. familiaris
ctttctccaaattttt

SEQ ID NO: 317489 - DNA, 16 bp, C. familiaris
ctttctctctcagtct

SEQ ID NO: 317490 - DNA, 16 bp, C. familiaris
ctttctctctcccaaa

SEQ ID NO: 317491 - DNA, 16 bp, C. familiaris
ctttctctgtgtctgt

SEQ ID NO: 317492 - DNA, 16 bp, C. familiaris
ctttctgacatcaaat

SEQ ID NO: 317493 - DNA, 16 bp, C. familiaris
ctttctgatggctgat

SEQ ID NO: 317494 - DNA, 16 bp, C. familiaris
ctttctgcccctggac

SEQ ID NO: 317495 - DNA, 16 bp, C. familiaris
ctttctgctgagcaga

SEQ ID NO: 317496 - DNA, 16 bp, C. familiaris
ctttctgctgctttat

SEQ ID NO: 317497 - DNA, 16 bp, C. familiaris
ctttctggaaaaaaaa

SEQ ID NO: 317498 - DNA, 16 bp, C. familiaris
ctttctggaggaggtg

SEQ ID NO: 317499 - DNA, 16 bp, C. familiaris
ctttctggtgaccagc

SEQ ID NO: 317500 - DNA, 16 bp, C. familiaris
ctttctgtaaatgaca

SEQ ID NO: 317501 - DNA, 16 bp, C. familiaris
ctttctgtctatcata

SEQ ID NO: 317502 - DNA, 16 bp, C. familiaris
ctttctgtctgtctgt

SEQ ID NO: 317503 - DNA, 16 bp, C. familiaris
ctttctgtctgtgtct

SEQ ID NO: 317504 - DNA, 16 bp, C. familiaris
ctttcttattaaaaaa

SEQ ID NO: 317505 - DNA, 16 bp, C. familiaris
ctttcttgggatgcct

SEQ ID NO: 317506 - DNA, 16 bp, C. familiaris
ctttctttgacttatt

SEQ ID NO: 317507 - DNA, 16 bp, C. familiaris
ctttcttttgtagtga

SEQ ID NO: 317508 - DNA, 16 bp, C. familiaris
ctttcttttgttaatg

SEQ ID NO: 317509 - DNA, 16 bp, C. familiaris
ctttctttttaaagtt

SEQ ID NO: 317510 - DNA, 16 bp, C. familiaris
ctttgaaaaaaattac

SEQ ID NO: 317511 - DNA, 16 bp, C. familiaris
ctttgaaaaatgctgt

SEQ ID NO: 317512 - DNA, 16 bp, C. familiaris
ctttgaaaagaaaaat

SEQ ID NO: 317513 - DNA, 16 bp, C. familiaris
ctttgaaaataaattt

SEQ ID NO: 317514 - DNA, 16 bp, C. familiaris
ctttgaaaatacattt

SEQ ID NO: 317515 - DNA, 16 bp, C. familiaris
ctttgaaaatgaaaaa

SEQ ID NO: 317516 - DNA, 16 bp, C. familiaris
ctttgaaaatggaaaa

SEQ ID NO: 317517 - DNA, 16 bp, C. familiaris
ctttgaaatttaaaaa

SEQ ID NO: 317518 - DNA, 16 bp, C. familiaris
ctttgaaattttcttt

SEQ ID NO: 317519 - DNA, 16 bp, C. familiaris
ctttgaacaacatggg

SEQ ID NO: 317520 - DNA, 16 bp, C. familiaris
ctttgaagaaaaaaaa

SEQ ID NO: 317521 - DNA, 16 bp, C. familiaris
ctttgaagatgaagaa

SEQ ID NO: 317522 - DNA, 16 bp, C. familiaris
ctttgaagatgaagga

SEQ ID NO: 317523 - DNA, 16 bp, C. familiaris
ctttgaatgtaaatga

SEQ ID NO: 317524 - DNA, 16 bp, C. familiaris
ctttgaatgtaaatgt

SEQ ID NO: 317525 - DNA, 16 bp, C. familiaris
ctttgaattattttct

SEQ ID NO: 317526 - DNA, 16 bp, C. familiaris
ctttgacaaaggaaga

SEQ ID NO: 317527 - DNA, 16 bp, C. familiaris
ctttgacaatttgaat

SEQ ID NO: 317528 - DNA, 16 bp, C. familiaris
ctttgactattcaggg

SEQ ID NO: 317529 - DNA, 16 bp, C. familiaris
ctttgactcttggttt

SEQ ID NO: 317530 - DNA, 16 bp, C. familiaris
ctttgattttattcat

SEQ ID NO: 317531 - DNA, 16 bp, C. familiaris
ctttgcaagatgaaaa

SEQ ID NO: 317532 - DNA, 16 bp, C. familiaris
ctttgcacttgccatt

SEQ ID NO: 317533 - DNA, 16 bp, C. familiaris
ctttgcagaaatgact

SEQ ID NO: 317534 - DNA, 16 bp, C. familiaris
ctttgcaggaagcctg

SEQ ID NO: 317535 - DNA, 16 bp, C. familiaris
ctttgcattcacaact

SEQ ID NO: 317536 - DNA, 16 bp, C. familiaris
ctttgccaacatctgt

SEQ ID NO: 317537 - DNA, 16 bp, C. familiaris
ctttgccaattggaat

SEQ ID NO: 317538 - DNA, 16 bp, C. familiaris
ctttgcctctgtctct

SEQ ID NO: 317539 - DNA, 16 bp, C. familiaris
ctttgcctgccactcc

SEQ ID NO: 317540 - DNA, 16 bp, C. familiaris
ctttgcctgtgtctct

SEQ ID NO: 317541 - DNA, 16 bp, C. familiaris
ctttgcctttaaaaaa

SEQ ID NO: 317542 - DNA, 16 bp, C. familiaris
ctttgctgctagaaac

SEQ ID NO: 317543 - DNA, 16 bp, C. familiaris
ctttgctgctgcttct

SEQ ID NO: 317544 - DNA, 16 bp, C. familiaris
ctttgcttatgtctct

SEQ ID NO: 317545 - DNA, 16 bp, C. familiaris
ctttgctttcaaagaa

SEQ ID NO: 317546 - DNA, 16 bp, C. familiaris
ctttggaaaaacattt

SEQ ID NO: 317547 - DNA, 16 bp, C. familiaris
ctttggaaaaaggtct

SEQ ID NO: 317548 - DNA, 16 bp, C. familiaris
ctttggaaggcagttt

SEQ ID NO: 317549 - DNA, 16 bp, C. familiaris
ctttggaattttgcaa

SEQ ID NO: 317550 - DNA, 16 bp, C. familiaris
ctttggagaaaagtct

SEQ ID NO: 317551 - DNA, 16 bp, C. familiaris
ctttggagatgttgta

SEQ ID NO: 317552 - DNA, 16 bp, C. familiaris
ctttggagtcagaaag

SEQ ID NO: 317553 - DNA, 31 bp, C. familiaris
ctttggatgttgccaacaaaattgggatcat

SEQ ID NO: 317554 - DNA, 16 bp, C. familiaris
ctttggccaacagaat

SEQ ID NO: 317555 - DNA, 16 bp, C. familiaris
ctttggccagggtgtg

SEQ ID NO: 317556 - DNA, 16 bp, C. familiaris
ctttggcccagggccc

SEQ ID NO: 317557 - DNA, 16 bp, C. familiaris
ctttggctatttgggt

SEQ ID NO: 317558 - DNA, 16 bp, C. familiaris
ctttggctcaggtttt

SEQ ID NO: 317559 - DNA, 16 bp, C. familiaris
ctttgggaaacaaact

SEQ ID NO: 317560 - DNA, 16 bp, C. familiaris
ctttggggtgcctggg

SEQ ID NO: 317561 - DNA, 16 bp, C. familiaris
ctttgggtagaatgga

SEQ ID NO: 317562 - DNA, 16 bp, C. familiaris
ctttggtgttgagctt

SEQ ID NO: 317563 - DNA, 16 bp, C. familiaris
ctttggttttgggatc

SEQ ID NO: 317564 - DNA, 16 bp, C. familiaris
ctttgtaaaatataaa

SEQ ID NO: 317565 - DNA, 16 bp, C. familiaris
ctttgtaatagagttt

SEQ ID NO: 317566 - DNA, 16 bp, C. familiaris
ctttgtaatttttaaa

SEQ ID NO: 317567 - DNA, 16 bp, C. familiaris
ctttgtatattttgaa

SEQ ID NO: 317568 - DNA, 16 bp, C. familiaris
ctttgtgcactgctgg

SEQ ID NO: 317569 - DNA, 16 bp, C. familiaris
ctttgtgcctctcatg

SEQ ID NO: 317570 - DNA, 16 bp, C. familiaris
ctttgtgggatgcctg

SEQ ID NO: 317571 - DNA, 16 bp, C. familiaris
ctttgtgggggaaaaa

SEQ ID NO: 317572 - DNA, 16 bp, C. familiaris
ctttgttaaatgcttt

SEQ ID NO: 317573 - DNA, 16 bp, C. familiaris
ctttgttatccattca

SEQ ID NO: 317574 - DNA, 16 bp, C. familiaris
ctttgttgaagattaa

SEQ ID NO: 317575 - DNA, 16 bp, C. familiaris
ctttgttggtgggaat

SEQ ID NO: 317576 - DNA, 16 bp, C. familiaris
cttttaaaaatacttt

SEQ ID NO: 317577 - DNA, 16 bp, C. familiaris
cttttaaaagaagttt

SEQ ID NO: 317578 - DNA, 16 bp, C. familiaris
cttttaaaagaatttt

SEQ ID NO: 317579 - DNA, 16 bp, C. familiaris
cttttaaaagactttt

SEQ ID NO: 317580 - DNA, 16 bp, C. familiaris
cttttaaaaggaaaga

SEQ ID NO: 317581 - DNA, 16 bp, C. familiaris
cttttaaaatattcta

SEQ ID NO: 317582 - DNA, 16 bp, C. familiaris
cttttaacattttgtt

SEQ ID NO: 317583 - DNA, 16 bp, C. familiaris
cttttacattttaaaa

SEQ ID NO: 317584 - DNA, 16 bp, C. familiaris
cttttagaaaacatgg

SEQ ID NO: 317585 - DNA, 16 bp, C. familiaris
cttttagcaggatgtt

SEQ ID NO: 317586 - DNA, 16 bp, C. familiaris
cttttattttttggaa

SEQ ID NO: 317587 - DNA, 16 bp, C. familiaris
cttttcaaaaatgatt

SEQ ID NO: 317588 - DNA, 16 bp, C. familiaris
cttttcaattaaaaaa

SEQ ID NO: 317589 - DNA, 16 bp, C. familiaris
cttttcagcactttga

SEQ ID NO: 317590 - DNA, 16 bp, C. familiaris
cttttcatctctcact

SEQ ID NO: 317591 - DNA, 16 bp, C. familiaris
cttttcatctttgtga

SEQ ID NO: 317592 - DNA, 16 bp, C. familiaris
cttttcatgtctctgt

SEQ ID NO: 317593 - DNA, 16 bp, C. familiaris
cttttcatttgtctgt

SEQ ID NO: 317594 - DNA, 16 bp, C. familiaris
cttttccagaatatca

SEQ ID NO: 317595 - DNA, 16 bp, C. familiaris
cttttccagttttggt

SEQ ID NO: 317596 - DNA, 16 bp, C. familiaris
cttttcctctgagatc

SEQ ID NO: 317597 - DNA, 16 bp, C. familiaris
cttttctaacacagaa

SEQ ID NO: 317598 - DNA, 16 bp, C. familiaris
cttttctataaatttg

SEQ ID NO: 317599 - DNA, 16 bp, C. familiaris
cttttctatggctgag

SEQ ID NO: 317600 - DNA, 16 bp, C. familiaris
cttttctcctttaaaa

SEQ ID NO: 317601 - DNA, 16 bp, C. familiaris
cttttctgatgagatc

SEQ ID NO: 317602 - DNA, 16 bp, C. familiaris
cttttctggaatgtca

SEQ ID NO: 317603 - DNA, 16 bp, C. familiaris
cttttctgtgcaaaag

SEQ ID NO: 317604 - DNA, 16 bp, C. familiaris
cttttcttaaagattt

SEQ ID NO: 317605 - DNA, 16 bp, C. familiaris
cttttcttttaaagat

SEQ ID NO: 317606 - DNA, 16 bp, C. familiaris
cttttctttttaaaag

SEQ ID NO: 317607 - DNA, 16 bp, C. familiaris
cttttctttttaaaga

SEQ ID NO: 317608 - DNA, 16 bp, C. familiaris
cttttctttttcaaag

SEQ ID NO: 317609 - DNA, 16 bp, C. familiaris
cttttgaaatgaaaaa

SEQ ID NO: 317610 - DNA, 16 bp, C. familiaris
cttttgaagagtactg

SEQ ID NO: 317611 - DNA, 16 bp, C. familiaris
cttttgaattttatat

SEQ ID NO: 317612 - DNA, 16 bp, C. familiaris
cttttgactggagcat

SEQ ID NO: 317613 - DNA, 16 bp, C. familiaris
cttttgacttccccaa

SEQ ID NO: 317614 - DNA, 16 bp, C. familiaris
cttttgatttctgctc

SEQ ID NO: 317615 - DNA, 16 bp, C. familiaris
cttttgcacagcagag

SEQ ID NO: 317616 - DNA, 16 bp, C. familiaris
cttttgcacgtagctg

SEQ ID NO: 317617 - DNA, 16 bp, C. familiaris
cttttgcccatttctt

SEQ ID NO: 317618 - DNA, 16 bp, C. familiaris
cttttgggattggctt

SEQ ID NO: 317619 - DNA, 16 bp, C. familiaris
cttttgtagatggctt

SEQ ID NO: 317620 - DNA, 16 bp, C. familiaris
cttttgtatttggctt

SEQ ID NO: 317621 - DNA, 16 bp, C. familiaris
cttttgtgacctttga

SEQ ID NO: 317622 - DNA, 16 bp, C. familiaris
cttttgtggaaaaaaa

SEQ ID NO: 317623 - DNA, 16 bp, C. familiaris
cttttgtgtttcctgc

SEQ ID NO: 317624 - DNA, 16 bp, C. familiaris
cttttgttaaatgtat

SEQ ID NO: 317625 - DNA, 16 bp, C. familiaris
cttttgtttggaacat

SEQ ID NO: 317626 - DNA, 16 bp, C. familiaris
cttttgttttggaaaa

SEQ ID NO: 317627 - DNA, 16 bp, C. familiaris
ctttttaaaaaatgtt

SEQ ID NO: 317628 - DNA, 16 bp, C. familiaris
ctttttaaaaactctg

SEQ ID NO: 317629 - DNA, 16 bp, C. familiaris
ctttttaaaaagtaaa

SEQ ID NO: 317630 - DNA, 16 bp, C. familiaris
ctttttaaaaatgctt

SEQ ID NO: 317631 - DNA, 16 bp, C. familiaris
ctttttaaaaccattt

SEQ ID NO: 317632 - DNA, 16 bp, C. familiaris
ctttttaaaagtaatt

SEQ ID NO: 317633 - DNA, 16 bp, C. familiaris
ctttttaaaagtatat

SEQ ID NO: 317634 - DNA, 16 bp, C. familiaris
ctttttaaaagtgttt

SEQ ID NO: 317635 - DNA, 16 bp, C. familiaris
ctttttaaagtttaaa

SEQ ID NO: 317636 - DNA, 16 bp, C. familiaris
ctttttaagaaaaaaa

SEQ ID NO: 317637 - DNA, 16 bp, C. familiaris
ctttttaatgatttta

SEQ ID NO: 317638 - DNA, 16 bp, C. familiaris
ctttttagtggagtct

SEQ ID NO: 317639 - DNA, 16 bp, C. familiaris
ctttttcaacaaatgg

SEQ ID NO: 317640 - DNA, 16 bp, C. familiaris
ctttttccacagtttg

SEQ ID NO: 317641 - DNA, 16 bp, C. familiaris
ctttttcctttgctca

SEQ ID NO: 317642 - DNA, 16 bp, C. familiaris
ctttttctgtatctgt

SEQ ID NO: 317643 - DNA, 16 bp, C. familiaris
ctttttcttgtctaat

SEQ ID NO: 317644 - DNA, 16 bp, C. familiaris
ctttttgaaatgcaaa

SEQ ID NO: 317645 - DNA, 16 bp, C. familiaris
ctttttgaagaaccag

SEQ ID NO: 317646 - DNA, 16 bp, C. familiaris
ctttttgagaattttt

SEQ ID NO: 317647 - DNA, 16 bp, C. familiaris
ctttttgatgatagtc

SEQ ID NO: 317648 - DNA, 16 bp, C. familiaris
ctttttgctggtagag

SEQ ID NO: 317649 - DNA, 16 bp, C. familiaris
ctttttggggaaaaaa

SEQ ID NO: 317650 - DNA, 16 bp, C. familiaris
cttttttaaagatctt

SEQ ID NO: 317651 - DNA, 16 bp, C. familiaris
cttttttatccagtgt

SEQ ID NO: 317652 - DNA, 16 bp, C. familiaris
ctttttttaaaaaaag

SEQ ID NO: 317653 - DNA, 16 bp, C. familiaris
ctttttttccaagatt

SEQ ID NO: 317654 - DNA, 16 bp, C. familiaris
ctttttttccccaaga

SEQ ID NO: 317655 - DNA, 16 bp, C. familiaris
ctttttttgtgatgtc

SEQ ID NO: 317656 - DNA, 16 bp, C. familiaris
cttttttttaagactt

SEQ ID NO: 317657 - DNA, 16 bp, C. familiaris
gaaaaaaaatctggaa

SEQ ID NO: 317658 - DNA, 16 bp, C. familiaris
gaaaaaaatcagagag

SEQ ID NO: 317659 - DNA, 16 bp, C. familiaris
gaaaaaaatccaattt

SEQ ID NO: 317660 - DNA, 16 bp, C. familiaris
gaaaaaaatgaagtca

SEQ ID NO: 317661 - DNA, 16 bp, C. familiaris
gaaaaaaattcttgaa

SEQ ID NO: 317662 - DNA, 16 bp, C. familiaris
gaaaaaacaattttaa

SEQ ID NO: 317663 - DNA, 16 bp, C. familiaris
gaaaaaacagcagatt

SEQ ID NO: 317664 - DNA, 16 bp, C. familiaris
gaaaaaagccagtcac

SEQ ID NO: 317665 - DNA, 16 bp, C. familiaris
gaaaaaatgtttgcaa

SEQ ID NO: 317666 - DNA, 16 bp, C. familiaris
gaaaaacaaaatattt

SEQ ID NO: 317667 - DNA, 16 bp, C. familiaris
gaaaaacaaatggtta

SEQ ID NO: 317668 - DNA, 16 bp, C. familiaris
gaaaaactaaaattca

SEQ ID NO: 317669 - DNA, 16 bp, C. familiaris
gaaaaactatatatat

SEQ ID NO: 317670 - DNA, 16 bp, C. familiaris
gaaaaactgacatctt

SEQ ID NO: 317671 - DNA, 16 bp, C. familiaris
gaaaaactgagagcat

SEQ ID NO: 317672 - DNA, 16 bp, C. familiaris
gaaaaactgatgaaat

SEQ ID NO: 317673 - DNA, 16 bp, C. familiaris
gaaaaagaaaatctga

SEQ ID NO: 317674 - DNA, 16 bp, C. familiaris
gaaaaagaaaatgtgt

SEQ ID NO: 317675 - DNA, 16 bp, C. familiaris
gaaaaagaagaaactt

SEQ ID NO: 317676 - DNA, 16 bp, C. familiaris
gaaaaagaagatcaga

SEQ ID NO: 317677 - DNA, 16 bp, C. familiaris
gaaaaagacaaatgcc

SEQ ID NO: 317678 - DNA, 16 bp, C. familiaris
gaaaaagactttttaa

SEQ ID NO: 317679 - DNA, 16 bp, C. familiaris
gaaaaagatctgaaaa

SEQ ID NO: 317680 - DNA, 16 bp, C. familiaris
gaaaaagcattttaca

SEQ ID NO: 317681 - DNA, 16 bp, C. familiaris
gaaaaagctgaacaaa

SEQ ID NO: 317682 - DNA, 16 bp, C. familiaris
gaaaaaggaaccttca

SEQ ID NO: 317683 - DNA, 16 bp, C. familiaris
gaaaaaggacagcctc

SEQ ID NO: 317684 - DNA, 16 bp, C. familiaris
gaaaaagtatttgaca

SEQ ID NO: 317685 - DNA, 16 bp, C. familiaris
gaaaaagtcaaggaaa

SEQ ID NO: 317686 - DNA, 16 bp, C. familiaris
gaaaaagttctagaaa

SEQ ID NO: 317687 - DNA, 16 bp, C. familiaris
gaaaaataaagcagga

SEQ ID NO: 317688 - DNA, 16 bp, C. familiaris
gaaaaatatgtgcaaa

SEQ ID NO: 317689 - DNA, 16 bp, C. familiaris
gaaaaatattccacgc

SEQ ID NO: 317690 - DNA, 16 bp, C. familiaris
gaaaaatattggaaat

SEQ ID NO: 317691 - DNA, 16 bp, C. familiaris
gaaaaatatttctata

SEQ ID NO: 317692 - DNA, 16 bp, C. familiaris
gaaaaatatttgcaac

SEQ ID NO: 317693 - DNA, 16 bp, C. familiaris
gaaaaatcaactgata

SEQ ID NO: 317694 - DNA, 16 bp, C. familiaris
gaaaaatcaatatttt

SEQ ID NO: 317695 - DNA, 16 bp, C. familiaris
gaaaaatcagaaaatc

SEQ ID NO: 317696 - DNA, 16 bp, C. familiaris
gaaaaatctcaaatac

SEQ ID NO: 317697 - DNA, 16 bp, C. familiaris
gaaaaatctccagaaa

SEQ ID NO: 317698 - DNA, 16 bp, C. familiaris
gaaaaatctgattttt

SEQ ID NO: 317699 - DNA, 16 bp, C. familiaris
gaaaaatctgcagcca

SEQ ID NO: 317700 - DNA, 16 bp, C. familiaris
gaaaaatctgctgata

SEQ ID NO: 317701 - DNA, 16 bp, C. familiaris
gaaaaatggaaagaca

SEQ ID NO: 317702 - DNA, 16 bp, C. familiaris
gaaaaatggacaaaag

SEQ ID NO: 317703 - DNA, 16 bp, C. familiaris
gaaaaatgggtgaagg

SEQ ID NO: 317704 - DNA, 16 bp, C. familiaris
gaaaaattcttagaaa

SEQ ID NO: 317705 - DNA, 16 bp, C. familiaris
gaaaaattctttgaaa

SEQ ID NO: 317706 - DNA, 16 bp, C. familiaris
gaaaaattttaaagca

SEQ ID NO: 317707 - DNA, 16 bp, C. familiaris
gaaaacaacctaaatg

SEQ ID NO: 317708 - DNA, 16 bp, C. familiaris
gaaaacaatgtttaaa

SEQ ID NO: 317709 - DNA, 16 bp, C. familiaris
gaaaacaattccactt

SEQ ID NO: 317710 - DNA, 16 bp, C. familiaris
gaaaacacaaaagact

SEQ ID NO: 317711 - DNA, 16 bp, C. familiaris
gaaaacacaggcaaca

SEQ ID NO: 317712 - DNA, 16 bp, C. familiaris
gaaaacaccaatttga

SEQ ID NO: 317713 - DNA, 16 bp, C. familiaris
gaaaacactaatctga

SEQ ID NO: 317714 - DNA, 16 bp, C. familiaris
gaaaacactttgaaaa

SEQ ID NO: 317715 - DNA, 16 bp, C. familiaris
gaaaacactttttttt

SEQ ID NO: 317716 - DNA, 16 bp, C. familiaris
gaaaacagaaggaaat

SEQ ID NO: 317717 - DNA, 16 bp, C. familiaris
gaaaacagattggtgg

SEQ ID NO: 317718 - DNA, 16 bp, C. familiaris
gaaaacagtatgaaga

SEQ ID NO: 317719 - DNA, 16 bp, C. familiaris
gaaaacagtatgggga

SEQ ID NO: 317720 - DNA, 16 bp, C. familiaris
gaaaacagtctggtgg

SEQ ID NO: 317721 - DNA, 16 bp, C. familiaris
gaaaacagtttggcaa

SEQ ID NO: 317722 - DNA, 16 bp, C. familiaris
gaaaacattttctttt

SEQ ID NO: 317723 - DNA, 16 bp, C. familiaris
gaaaaccactgttcta

SEQ ID NO: 317724 - DNA, 16 bp, C. familiaris
gaaaacccaaaagagt

SEQ ID NO: 317725 - DNA, 16 bp, C. familiaris
gaaaacctgaacaagc

SEQ ID NO: 317726 - DNA, 16 bp, C. familiaris
gaaaaccttctggaaa

SEQ ID NO: 317727 - DNA, 16 bp, C. familiaris
gaaaactaggaataga

SEQ ID NO: 317728 - DNA, 16 bp, C. familiaris
gaaaactgaatgggaa

SEQ ID NO: 317729 - DNA, 16 bp, C. familiaris
gaaaactggaaaattt

SEQ ID NO: 317730 - DNA, 16 bp, C. familiaris
gaaaactggaaagcca

SEQ ID NO: 317731 - DNA, 16 bp, C. familiaris
gaaaactgtgtgaagg

SEQ ID NO: 317732 - DNA, 16 bp, C. familiaris
gaaaacttagaagaaa

SEQ ID NO: 317733 - DNA, 16 bp, C. familiaris
gaaaacttagatgaaa

SEQ ID NO: 317734 - DNA, 16 bp, C. familiaris
gaaaagaaaagctgaa

SEQ ID NO: 317735 - DNA, 16 bp, C. familiaris
gaaaagaaaatgtcac

SEQ ID NO: 317736 - DNA, 16 bp, C. familiaris
gaaaagaaagctgggg

SEQ ID NO: 317737 - DNA, 16 bp, C. familiaris
gaaaagaacatgtatt

SEQ ID NO: 317738 - DNA, 16 bp, C. familiaris
gaaaagaacatttaaa

SEQ ID NO: 317739 - DNA, 16 bp, C. familiaris
gaaaagaatgtgcatt

SEQ ID NO: 317740 - DNA, 16 bp, C. familiaris
gaaaagacattcaaca

SEQ ID NO: 317741 - DNA, 16 bp, C. familiaris
gaaaagactgtatttt

SEQ ID NO: 317742 - DNA, 16 bp, C. familiaris
gaaaagactgtctttt

SEQ ID NO: 317743 - DNA, 16 bp, C. familiaris
gaaaagactgttcttt

SEQ ID NO: 317744 - DNA, 16 bp, C. familiaris
gaaaagatcaaaattt

SEQ ID NO: 317745 - DNA, 16 bp, C. familiaris
gaaaagcagactctct

SEQ ID NO: 317746 - DNA, 16 bp, C. familiaris
gaaaagcatgtggaag

SEQ ID NO: 317747 - DNA, 16 bp, C. familiaris
gaaaagctcaggacca

SEQ ID NO: 317748 - DNA, 16 bp, C. familiaris
gaaaagctttcagttt

SEQ ID NO: 317749 - DNA, 16 bp, C. familiaris
gaaaagcttttagctt

SEQ ID NO: 317750 - DNA, 16 bp, C. familiaris
gaaaaggaaactgaga

SEQ ID NO: 317751 - DNA, 16 bp, C. familiaris
gaaaaggaagaaactt

SEQ ID NO: 317752 - DNA, 16 bp, C. familiaris
gaaaaggaaggacatt

SEQ ID NO: 317753 - DNA, 16 bp, C. familiaris
gaaaaggacaaacagt

SEQ ID NO: 317754 - DNA, 16 bp, C. familiaris
gaaaaggacaagcatt

SEQ ID NO: 317755 - DNA, 16 bp, C. familiaris
gaaaaggcaacctacc

SEQ ID NO: 317756 - DNA, 16 bp, C. familiaris
gaaaagggagatttca

SEQ ID NO: 317757 - DNA, 16 bp, C. familiaris
gaaaagtcacaaaaat

SEQ ID NO: 317758 - DNA, 16 bp, C. familiaris
gaaaataaaaatcacc

SEQ ID NO: 317759 - DNA, 16 bp, C. familiaris
gaaaataaaagtttgg

SEQ ID NO: 317760 - DNA, 16 bp, C. familiaris
gaaaataaaataccta

SEQ ID NO: 317761 - DNA, 16 bp, C. familiaris
gaaaataaattcattt

SEQ ID NO: 317762 - DNA, 16 bp, C. familiaris
gaaaataatgtgtgtt

SEQ ID NO: 317763 - DNA, 16 bp, C. familiaris
gaaaataattcaattt

SEQ ID NO: 317764 - DNA, 16 bp, C. familiaris
gaaaataattcttttt

SEQ ID NO: 317765 - DNA, 16 bp, C. familiaris
gaaaataatttcaaaa

SEQ ID NO: 317766 - DNA, 16 bp, C. familiaris
gaaaatacttgaaaat

SEQ ID NO: 317767 - DNA, 16 bp, C. familiaris
gaaaatactttgaaat

SEQ ID NO: 317768 - DNA, 16 bp, C. familiaris
gaaaatatcaatgagg

SEQ ID NO: 317769 - DNA, 16 bp, C. familiaris
gaaaatatcagtgaga

SEQ ID NO: 317770 - DNA, 16 bp, C. familiaris
gaaaatattcagggaa

SEQ ID NO: 317771 - DNA, 16 bp, C. familiaris
gaaaatatttgtgaat

SEQ ID NO: 317772 - DNA, 16 bp, C. familiaris
gaaaatattttacatt

SEQ ID NO: 317773 - DNA, 16 bp, C. familiaris
gaaaatcaagaaggaa

SEQ ID NO: 317774 - DNA, 16 bp, C. familiaris
gaaaatccaaataaag

SEQ ID NO: 317775 - DNA, 16 bp, C. familiaris
gaaaatctccagaaat

SEQ ID NO: 317776 - DNA, 16 bp, C. familiaris
gaaaatctgaataaaa

SEQ ID NO: 317777 - DNA, 16 bp, C. familiaris
gaaaatcttaagcaag

SEQ ID NO: 317778 - DNA, 16 bp, C. familiaris
gaaaatcttgaaagca

SEQ ID NO: 317779 - DNA, 16 bp, C. familiaris
gaaaatctttttattt

SEQ ID NO: 317780 - DNA, 16 bp, C. familiaris
gaaaatgaagaagaca

SEQ ID NO: 317781 - DNA, 16 bp, C. familiaris
gaaaatgaagcacaga

SEQ ID NO: 317782 - DNA, 16 bp, C. familiaris
gaaaatgacattttaa

SEQ ID NO: 317783 - DNA, 16 bp, C. familiaris
gaaaatgagtgggaaa

SEQ ID NO: 317784 - DNA, 16 bp, C. familiaris
gaaaatgcaaatcaaa

SEQ ID NO: 317785 - DNA, 16 bp, C. familiaris
gaaaatgcaaattaca

SEQ ID NO: 317786 - DNA, 16 bp, C. familiaris
gaaaatgcagagaaaa

SEQ ID NO: 317787 - DNA, 16 bp, C. familiaris
gaaaatggaaaattat

SEQ ID NO: 317788 - DNA, 16 bp, C. familiaris
gaaaatggaaagacaa

SEQ ID NO: 317789 - DNA, 16 bp, C. familiaris
gaaaatgttaaggaaa

SEQ ID NO: 317790 - DNA, 16 bp, C. familiaris
gaaaatgttaatgtta

SEQ ID NO: 317791 - DNA, 16 bp, C. familiaris
gaaaattacattttct

SEQ ID NO: 317792 - DNA, 16 bp, C. familiaris
gaaaattataagccaa

SEQ ID NO: 317793 - DNA, 16 bp, C. familiaris
gaaaattatttccaaa

SEQ ID NO: 317794 - DNA, 16 bp, C. familiaris
gaaaattcaaaagaat

SEQ ID NO: 317795 - DNA, 16 bp, C. familiaris
gaaaattctaagaaat

SEQ ID NO: 317796 - DNA, 16 bp, C. familiaris
gaaaatttggaaaaat

SEQ ID NO: 317797 - DNA, 16 bp, C. familiaris
gaaacaaaacagaatc

SEQ ID NO: 317798 - DNA, 16 bp, C. familiaris
gaaacaaaggcaaaat

SEQ ID NO: 317799 - DNA, 16 bp, C. familiaris
gaaacaacacagagga

SEQ ID NO: 317800 - DNA, 16 bp, C. familiaris
gaaacaagaaaagtct

SEQ ID NO: 317801 - DNA, 16 bp, C. familiaris
gaaacaatcaatgaaa

SEQ ID NO: 317802 - DNA, 16 bp, C. familiaris
gaaacactgggaacct

SEQ ID NO: 317803 - DNA, 16 bp, C. familiaris
gaaacagaaagtggaa

SEQ ID NO: 317804 - DNA, 16 bp, C. familiaris
gaaacagaagaaatat

SEQ ID NO: 317805 - DNA, 16 bp, C. familiaris
gaaacagaatggaaaa

SEQ ID NO: 317806 - DNA, 16 bp, C. familiaris
gaaacagacacagaga

SEQ ID NO: 317807 - DNA, 16 bp, C. familiaris
gaaacagatacagaga

SEQ ID NO: 317808 - DNA, 16 bp, C. familiaris
gaaacagatatccaga

SEQ ID NO: 317809 - DNA, 16 bp, C. familiaris
gaaacagatccagaaa

SEQ ID NO: 317810 - DNA, 16 bp, C. familiaris
gaaacagatgaatcca

SEQ ID NO: 317811 - DNA, 16 bp, C. familiaris
gaaacagatgcagaga

SEQ ID NO: 317812 - DNA, 16 bp, C. familiaris
gaaacagattttaaaa

SEQ ID NO: 317813 - DNA, 16 bp, C. familiaris
gaaacaggaagaaatg

SEQ ID NO: 317814 - DNA, 16 bp, C. familiaris
gaaacaggcagaggaa

SEQ ID NO: 317815 - DNA, 16 bp, C. familiaris
gaaacaggctccctac

SEQ ID NO: 317816 - DNA, 16 bp, C. familiaris
gaaacaggggatgtgg

SEQ ID NO: 317817 - DNA, 16 bp, C. familiaris
gaaacagtcctctctc

SEQ ID NO: 317818 - DNA, 16 bp, C. familiaris
gaaacatacaaccttc

SEQ ID NO: 317819 - DNA, 16 bp, C. familiaris
gaaacatgaaaatgaa

SEQ ID NO: 317820 - DNA, 16 bp, C. familiaris
gaaacattcaacaaaa

SEQ ID NO: 317821 - DNA, 16 bp, C. familiaris
gaaacatttttcattt

SEQ ID NO: 317822 - DNA, 16 bp, C. familiaris
gaaaccaaaagtctga

SEQ ID NO: 317823 - DNA, 16 bp, C. familiaris
gaaaccaactctgctg

SEQ ID NO: 317824 - DNA, 16 bp, C. familiaris
gaaaccaagagtctgg

SEQ ID NO: 317825 - DNA, 16 bp, C. familiaris
gaaaccacaaaagatc

SEQ ID NO: 317826 - DNA, 16 bp, C. familiaris
gaaaccatataatgat

SEQ ID NO: 317827 - DNA, 16 bp, C. familiaris
gaaaccatataattgt

SEQ ID NO: 317828 - DNA, 16 bp, C. familiaris
gaaaccatatgattgt

SEQ ID NO: 317829 - DNA, 16 bp, C. familiaris
gaaaccatcaccaaaa

SEQ ID NO: 317830 - DNA, 16 bp, C. familiaris
gaaacccaggcagagg

SEQ ID NO: 317831 - DNA, 16 bp, C. familiaris
gaaacccattttaaat

SEQ ID NO: 317832 - DNA, 16 bp, C. familiaris
gaaacgccaggacacc

SEQ ID NO: 317833 - DNA, 16 bp, C. familiaris
gaaactacccaaatgt

SEQ ID NO: 317834 - DNA, 16 bp, C. familiaris
gaaactactgtaacat

SEQ ID NO: 317835 - DNA, 16 bp, C. familiaris
gaaactagaagaggca

SEQ ID NO: 317836 - DNA, 16 bp, C. familiaris
gaaactgaggcaaaaa

SEQ ID NO: 317837 - DNA, 16 bp, C. familiaris
gaaactgaggcagagt

SEQ ID NO: 317838 - DNA, 16 bp, C. familiaris
gaaactgaggcccatg

SEQ ID NO: 317839 - DNA, 16 bp, C. familiaris
gaaactgaggccctga

SEQ ID NO: 317840 - DNA, 16 bp, C. familiaris
gaaactgaggctgaga

SEQ ID NO: 317841 - DNA, 16 bp, C. familiaris
gaaactgccacactgt

SEQ ID NO: 317842 - DNA, 16 bp, C. familiaris
gaaactggaccacctt

SEQ ID NO: 317843 - DNA, 16 bp, C. familiaris
gaaactggagaaagaa

SEQ ID NO: 317844 - DNA, 16 bp, C. familiaris
gaaactggagctcaga

SEQ ID NO: 317845 - DNA, 16 bp, C. familiaris
gaaactgtcaaactat

SEQ ID NO: 317846 - DNA, 16 bp, C. familiaris
gaaacttcaccaaaga

SEQ ID NO: 317847 - DNA, 16 bp, C. familiaris
gaaacttgttttgtgg

SEQ ID NO: 317848 - DNA, 16 bp, C. familiaris
gaaactttttaattct

SEQ ID NO: 317849 - DNA, 16 bp, C. familiaris
gaaagaaaaaaacctt

SEQ ID NO: 317850 - DNA, 16 bp, C. familiaris
gaaagaaaagactcaa

SEQ ID NO: 317851 - DNA, 16 bp, C. familiaris
gaaagaaaatgagtgg

SEQ ID NO: 317852 - DNA, 16 bp, C. familiaris
gaaagaaaatgcagaa

SEQ ID NO: 317853 - DNA, 16 bp, C. familiaris
gaaagaaaatgtgagc

SEQ ID NO: 317854 - DNA, 16 bp, C. familiaris
gaaagaaacttttttt

SEQ ID NO: 317855 - DNA, 16 bp, C. familiaris
gaaagaaagaaacatg

SEQ ID NO: 317856 - DNA, 16 bp, C. familiaris
gaaagaaagaaagctc

SEQ ID NO: 317857 - DNA, 16 bp, C. familiaris
gaaagaaagaaattct

SEQ ID NO: 317858 - DNA, 16 bp, C. familiaris
gaaagaaagcaagctg

SEQ ID NO: 317859 - DNA, 16 bp, C. familiaris
gaaagaaataatggat

SEQ ID NO: 317860 - DNA, 16 bp, C. familiaris
gaaagaaattcaagaa

SEQ ID NO: 317861 - DNA, 16 bp, C. familiaris
gaaagaactgaaaaca

SEQ ID NO: 317862 - DNA, 16 bp, C. familiaris
gaaagaagacagtctc

SEQ ID NO: 317863 - DNA, 16 bp, C. familiaris
gaaagaagccaacctg

SEQ ID NO: 317864 - DNA, 16 bp, C. familiaris
gaaagaagtaaaacta

SEQ ID NO: 317865 - DNA, 16 bp, C. familiaris
gaaagaatcctcaagc

SEQ ID NO: 317866 - DNA, 16 bp, C. familiaris
gaaagacaaaaatcat

SEQ ID NO: 317867 - DNA, 16 bp, C. familiaris
gaaagacaacagagct

SEQ ID NO: 317868 - DNA, 16 bp, C. familiaris
gaaagacatggaagaa

SEQ ID NO: 317869 - DNA, 16 bp, C. familiaris
gaaagagaaacccaag

SEQ ID NO: 317870 - DNA, 16 bp, C. familiaris
gaaagagaacatgagc

SEQ ID NO: 317871 - DNA, 16 bp, C. familiaris
gaaagagagacaggca

SEQ ID NO: 317872 - DNA, 16 bp, C. familiaris
gaaagagagagcaagc

SEQ ID NO: 317873 - DNA, 16 bp, C. familiaris
gaaagagatttttttt

SEQ ID NO: 317874 - DNA, 16 bp, C. familiaris
gaaagagcacaaatac

SEQ ID NO: 317875 - DNA, 16 bp, C. familiaris
gaaagagcactggact

SEQ ID NO: 317876 - DNA, 16 bp, C. familiaris
gaaagataaataccac

SEQ ID NO: 317877 - DNA, 16 bp, C. familiaris
gaaagataaataccgt

SEQ ID NO: 317878 - DNA, 16 bp, C. familiaris
gaaagatacacacaca

SEQ ID NO: 317879 - DNA, 16 bp, C. familiaris
gaaagatacagagaga

SEQ ID NO: 317880 - DNA, 16 bp, C. familiaris
gaaagatggatggata

SEQ ID NO: 317881 - DNA, 16 bp, C. familiaris
gaaagatttttctttt

SEQ ID NO: 317882 - DNA, 16 bp, C. familiaris
gaaagcaaacacttaa

SEQ ID NO: 317883 - DNA, 16 bp, C. familiaris
gaaagccaactcagaa

SEQ ID NO: 317884 - DNA, 16 bp, C. familiaris
gaaagccagcaaacca

SEQ ID NO: 317885 - DNA, 16 bp, C. familiaris
gaaagccagtggtgta

SEQ ID NO: 317886 - DNA, 16 bp, C. familiaris
gaaagccctgactttt

SEQ ID NO: 317887 - DNA, 16 bp, C. familiaris
gaaagcctgcttctcc

SEQ ID NO: 317888 - DNA, 16 bp, C. familiaris
gaaagccttcagggag

SEQ ID NO: 317889 - DNA, 16 bp, C. familiaris
gaaagcgtttgacaaa

SEQ ID NO: 317890 - DNA, 16 bp, C. familiaris
gaaagctccagggaaa

SEQ ID NO: 317891 - DNA, 16 bp, C. familiaris
gaaagctggcttcaag

SEQ ID NO: 317892 - DNA, 16 bp, C. familiaris
gaaaggaaaaaatttc

SEQ ID NO: 317893 - DNA, 16 bp, C. familiaris
gaaaggaaacagacat

SEQ ID NO: 317894 - DNA, 16 bp, C. familiaris
gaaaggaaataaacat

SEQ ID NO: 317895 - DNA, 16 bp, C. familiaris
gaaaggaacttcctca

SEQ ID NO: 317896 - DNA, 16 bp, C. familiaris
gaaaggaaggcaggca

SEQ ID NO: 317897 - DNA, 16 bp, C. familiaris
gaaaggaatccaaaaa

SEQ ID NO: 317898 - DNA, 16 bp, C. familiaris
gaaaggaatttttaaa

SEQ ID NO: 317899 - DNA, 16 bp, C. familiaris
gaaaggagagataatg

SEQ ID NO: 317900 - DNA, 32 bp, C. familiaris
gaaaggaggaaattttggaggcagaagctctg

SEQ ID NO: 317901 - DNA, 16 bp, C. familiaris
gaaaggatcagagaaa

SEQ ID NO: 317902 - DNA, 16 bp, C. familiaris
gaaaggcagagacatg

SEQ ID NO: 317903 - DNA, 16 bp, C. familiaris
gaaaggcagagatgca

SEQ ID NO: 317904 - DNA, 16 bp, C. familiaris
gaaaggccgggacacc

SEQ ID NO: 317905 - DNA, 16 bp, C. familiaris
gaaagggacaagcaga

SEQ ID NO: 317906 - DNA, 16 bp, C. familiaris
gaaagggagaagctga

SEQ ID NO: 317907 - DNA, 16 bp, C. familiaris
gaaagggaggcagaac

SEQ ID NO: 317908 - DNA, 16 bp, C. familiaris
gaaagggatgcctggg

SEQ ID NO: 317909 - DNA, 16 bp, C. familiaris
gaaaggggaaacctct

SEQ ID NO: 317910 - DNA, 16 bp, C. familiaris
gaaagtacagagaatt

SEQ ID NO: 317911 - DNA, 16 bp, C. familiaris
gaaagtagtggcctta

SEQ ID NO: 317912 - DNA, 16 bp, C. familiaris
gaaagtgctgtgttca

SEQ ID NO: 317913 - DNA, 16 bp, C. familiaris
gaaagtgcttttaaaa

SEQ ID NO: 317914 - DNA, 16 bp, C. familiaris
gaaagtggcagagctg

SEQ ID NO: 317915 - DNA, 16 bp, C. familiaris
gaaagttctatgtgca

SEQ ID NO: 317916 - DNA, 16 bp, C. familiaris
gaaagtttcttttttt

SEQ ID NO: 317917 - DNA, 16 bp, C. familiaris
gaaagttttacttttt

SEQ ID NO: 317918 - DNA, 16 bp, C. familiaris
gaaataaaattcagaa

SEQ ID NO: 317919 - DNA, 16 bp, C. familiaris
gaaataaatgcttgtt

SEQ ID NO: 317920 - DNA, 16 bp, C. familiaris
gaaataaatgtgattt

SEQ ID NO: 317921 - DNA, 16 bp, C. familiaris
gaaataagccaatcac

SEQ ID NO: 317922 - DNA, 16 bp, C. familiaris
gaaataatcagcaaaa

SEQ ID NO: 317923 - DNA, 16 bp, C. familiaris
gaaataatgaccaaaa

SEQ ID NO: 317924 - DNA, 16 bp, C. familiaris
gaaatacaaaggattt

SEQ ID NO: 317925 - DNA, 16 bp, C. familiaris
gaaatacagagagaaa

SEQ ID NO: 317926 - DNA, 16 bp, C. familiaris
gaaatactcatttttt

SEQ ID NO: 317927 - DNA, 16 bp, C. familiaris
gaaatagaaaaatctg

SEQ ID NO: 317928 - DNA, 16 bp, C. familiaris
gaaatagaaaatcacc

SEQ ID NO: 317929 - DNA, 16 bp, C. familiaris
gaaatagaaaatcaga

SEQ ID NO: 317930 - DNA, 16 bp, C. familiaris
gaaataggaaaatatt

SEQ ID NO: 317931 - DNA, 16 bp, C. familiaris
gaaatatcagaaaagg

SEQ ID NO: 317932 - DNA, 16 bp, C. familiaris
gaaatattgctatttg

SEQ ID NO: 317933 - DNA, 16 bp, C. familiaris
gaaatatttgaagaaa

SEQ ID NO: 317934 - DNA, 16 bp, C. familiaris
gaaatattttctcatt

SEQ ID NO: 317935 - DNA, 16 bp, C. familiaris
gaaatcaaagaagaca

SEQ ID NO: 317936 - DNA, 16 bp, C. familiaris
gaaatcaaagaagacc

SEQ ID NO: 317937 - DNA, 16 bp, C. familiaris
gaaatcaaatggaaat

SEQ ID NO: 317938 - DNA, 16 bp, C. familiaris
gaaatcaagagccagc

SEQ ID NO: 317939 - DNA, 16 bp, C. familiaris
gaaatcaagagttaaa

SEQ ID NO: 317940 - DNA, 16 bp, C. familiaris
gaaatcaagatcttga

SEQ ID NO: 317941 - DNA, 16 bp, C. familiaris
gaaatcaaggaggaaa

SEQ ID NO: 317942 - DNA, 16 bp, C. familiaris
gaaatcaagtgtcaga

SEQ ID NO: 317943 - DNA, 16 bp, C. familiaris
gaaatcaataacagga

SEQ ID NO: 317944 - DNA, 16 bp, C. familiaris
gaaatcacaaatattt

SEQ ID NO: 317945 - DNA, 16 bp, C. familiaris
gaaatcacatggcatt

SEQ ID NO: 317946 - DNA, 16 bp, C. familiaris
gaaatcagaaaatatt

SEQ ID NO: 317947 - DNA, 16 bp, C. familiaris
gaaatcagaaccctca

SEQ ID NO: 317948 - DNA, 16 bp, C. familiaris
gaaatcagagatggag

SEQ ID NO: 317949 - DNA, 16 bp, C. familiaris
gaaatcatatgtattt

SEQ ID NO: 317950 - DNA, 16 bp, C. familiaris
gaaatcatgacccaag

SEQ ID NO: 317951 - DNA, 16 bp, C. familiaris
gaaatcatgacccgag

SEQ ID NO: 317952 - DNA, 16 bp, C. familiaris
gaaatccagagttgga

SEQ ID NO: 317953 - DNA, 16 bp, C. familiaris
gaaatccatttttttt

SEQ ID NO: 317954 - DNA, 16 bp, C. familiaris
gaaatcctagccatag

SEQ ID NO: 317955 - DNA, 16 bp, C. familiaris
gaaatctagaagaaat

SEQ ID NO: 317956 - DNA, 16 bp, C. familiaris
gaaatctgaaaaacaa

SEQ ID NO: 317957 - DNA, 16 bp, C. familiaris
gaaatcttaaagaaaa

SEQ ID NO: 317958 - DNA, 16 bp, C. familiaris
gaaatcttgccctttg

SEQ ID NO: 317959 - DNA, 16 bp, C. familiaris
gaaatgaaagaatatg

SEQ ID NO: 317960 - DNA, 16 bp, C. familiaris
gaaatgaaagctaaaa

SEQ ID NO: 317961 - DNA, 16 bp, C. familiaris
gaaatgaaggcacaga

SEQ ID NO: 317962 - DNA, 16 bp, C. familiaris
gaaatgcaaagcaaaa

SEQ ID NO: 317963 - DNA, 16 bp, C. familiaris
gaaatgcaaatgaaaa

SEQ ID NO: 317964 - DNA, 16 bp, C. familiaris
gaaatgcaaattaaaa

SEQ ID NO: 317965 - DNA, 16 bp, C. familiaris
gaaatgcaagctggtg

SEQ ID NO: 317966 - DNA, 16 bp, C. familiaris
gaaatgcaagtcaaaa

SEQ ID NO: 317967 - DNA, 16 bp, C. familiaris
gaaatgcaagtgaaaa

SEQ ID NO: 317968 - DNA, 16 bp, C. familiaris
gaaatgcagattaaaa

SEQ ID NO: 317969 - DNA, 16 bp, C. familiaris
gaaatgccaattaaaa

SEQ ID NO: 317970 - DNA, 16 bp, C. familiaris
gaaatggaaaaaattc

SEQ ID NO: 317971 - DNA, 16 bp, C. familiaris
gaaatggaaaccaaaa

SEQ ID NO: 317972 - DNA, 16 bp, C. familiaris
gaaatggaagaagaca

SEQ ID NO: 317973 - DNA, 16 bp, C. familiaris
gaaatggatgcatttc

SEQ ID NO: 317974 - DNA, 16 bp, C. familiaris
gaaatgggtagaagac

SEQ ID NO: 317975 - DNA, 16 bp, C. familiaris
gaaatggttgattcca

SEQ ID NO: 317976 - DNA, 16 bp, C. familiaris
gaaatgtaaacatcaa

SEQ ID NO: 317977 - DNA, 16 bp, C. familiaris
gaaatgtaattttaaa

SEQ ID NO: 317978 - DNA, 16 bp, C. familiaris
gaaattaaaacatttt

SEQ ID NO: 317979 - DNA, 16 bp, C. familiaris
gaaattaaagaagaca

SEQ ID NO: 317980 - DNA, 16 bp, C. familiaris
gaaattaagaaagcaa

SEQ ID NO: 317981 - DNA, 16 bp, C. familiaris
gaaattaaggaaacaa

SEQ ID NO: 317982 - DNA, 16 bp, C. familiaris
gaaattcaaatcaaaa

SEQ ID NO: 317983 - DNA, 16 bp, C. familiaris
gaaattcaaatgaaaa

SEQ ID NO: 317984 - DNA, 16 bp, C. familiaris
gaaattcagaagaaaa

SEQ ID NO: 317985 - DNA, 16 bp, C. familiaris
gaaattcattttaaaa

SEQ ID NO: 317986 - DNA, 16 bp, C. familiaris
gaaattcctttggaaa

SEQ ID NO: 317987 - DNA, 16 bp, C. familiaris
gaaattcttaattttg

SEQ ID NO: 317988 - DNA, 16 bp, C. familiaris
gaaattcttcatttta

SEQ ID NO: 317989 - DNA, 16 bp, C. familiaris
gaaattgaagaaaaca

SEQ ID NO: 317990 - DNA, 16 bp, C. familiaris
gaaattgaagaagaca

SEQ ID NO: 317991 - DNA, 16 bp, C. familiaris
gaaattgaagatgaga

SEQ ID NO: 317992 - DNA, 16 bp, C. familiaris
gaaattgaagcccaga

SEQ ID NO: 317993 - DNA, 16 bp, C. familiaris
gaaattgacaagctaa

SEQ ID NO: 317994 - DNA, 16 bp, C. familiaris
gaaattgagagtcaga

SEQ ID NO: 317995 - DNA, 16 bp, C. familiaris
gaaatttaaaacataa

SEQ ID NO: 317996 - DNA, 16 bp, C. familiaris
gaaatttatttcttaa

SEQ ID NO: 317997 - DNA, 16 bp, C. familiaris
gaaatttccaaaggaa

SEQ ID NO: 317998 - DNA, 16 bp, C. familiaris
gaaatttgaaaatatt

SEQ ID NO: 317999 - DNA, 16 bp, C. familiaris
gaaatttttaaaaaca

SEQ ID NO: 318000 - DNA, 16 bp, C. familiaris
gaaatttttattgaga

SEQ ID NO: 318001 - DNA, 16 bp, C. familiaris
gaaatttttctttctt

SEQ ID NO: 318002 - DNA, 16 bp, C. familiaris
gaaatttttgtttaaa

SEQ ID NO: 318003 - DNA, 16 bp, C. familiaris
gaacaaagttgaagga

SEQ ID NO: 318004 - DNA, 16 bp, C. familiaris
gaacaaatatcattaa

SEQ ID NO: 318005 - DNA, 16 bp, C. familiaris
gaacaaatggaaaaat

SEQ ID NO: 318006 - DNA, 16 bp, C. familiaris
gaacaaattaataaat

SEQ ID NO: 318007 - DNA, 16 bp, C. familiaris
gaacaaggggtgatgg

SEQ ID NO: 318008 - DNA, 16 bp, C. familiaris
gaacaattattttaaa

SEQ ID NO: 318009 - DNA, 16 bp, C. familiaris
gaacacagtttgaaaa

SEQ ID NO: 318010 - DNA, 16 bp, C. familiaris
gaacacctggatggct

SEQ ID NO: 318011 - DNA, 16 bp, C. familiaris
gaacacctgggtgact

SEQ ID NO: 318012 - DNA, 16 bp, C. familiaris
gaacagaaagaaatag

SEQ ID NO: 318013 - DNA, 16 bp, C. familiaris
gaacagaagaaatatt

SEQ ID NO: 318014 - DNA, 16 bp, C. familiaris
gaacagaattgagaat

SEQ ID NO: 318015 - DNA, 16 bp, C. familiaris
gaacagagggccagaa

SEQ ID NO: 318016 - DNA, 16 bp, C. familiaris
gaacagatcaataaaa

SEQ ID NO: 318017 - DNA, 16 bp, C. familiaris
gaacagattaacaaaa

SEQ ID NO: 318018 - DNA, 16 bp, C. familiaris
gaacagattaatgaaa

SEQ ID NO: 318019 - DNA, 16 bp, C. familiaris
gaacagatttttattt

SEQ ID NO: 318020 - DNA, 16 bp, C. familiaris
gaacagcttcagaaga

SEQ ID NO: 318021 - DNA, 16 bp, C. familiaris
gaacaggccaacaacc

SEQ ID NO: 318022 - DNA, 16 bp, C. familiaris
gaacagggagcccaac

SEQ ID NO: 318023 - DNA, 16 bp, C. familiaris
gaacataaaaaatagt

SEQ ID NO: 318024 - DNA, 16 bp, C. familiaris
gaacatatatattttt

SEQ ID NO: 318025 - DNA, 16 bp, C. familiaris
gaacatatcaatgaaa

SEQ ID NO: 318026 - DNA, 16 bp, C. familiaris
gaacatctgactttgg

SEQ ID NO: 318027 - DNA, 16 bp, C. familiaris
gaacatggaggtgcag

SEQ ID NO: 318028 - DNA, 16 bp, C. familiaris
gaacattaacaaggca

SEQ ID NO: 318029 - DNA, 16 bp, C. familiaris
gaacatttatgaaaaa

SEQ ID NO: 318030 - DNA, 16 bp, C. familiaris
gaacatttcatcttaa

SEQ ID NO: 318031 - DNA, 16 bp, C. familiaris
gaacatttccattacc

SEQ ID NO: 318032 - DNA, 16 bp, C. familiaris
gaacattttcatcttc

SEQ ID NO: 318033 - DNA, 16 bp, C. familiaris
gaaccaatcagagatg

SEQ ID NO: 318034 - DNA, 16 bp, C. familiaris
gaaccaatggaaagga

SEQ ID NO: 318035 - DNA, 16 bp, C. familiaris
gaaccacccaggagcc

SEQ ID NO: 318036 - DNA, 16 bp, C. familiaris
gaaccacccagggacc

SEQ ID NO: 318037 - DNA, 16 bp, C. familiaris
gaaccactgctctaga

SEQ ID NO: 318038 - DNA, 16 bp, C. familiaris
gaaccagaagcaatac

SEQ ID NO: 318039 - DNA, 16 bp, C. familiaris
gaaccagagaagaccc

SEQ ID NO: 318040 - DNA, 16 bp, C. familiaris
gaaccagcttctccct

SEQ ID NO: 318041 - DNA, 16 bp, C. familiaris
gaacccagaaataaat

SEQ ID NO: 318042 - DNA, 16 bp, C. familiaris
gaacccaggcagcctg

SEQ ID NO: 318043 - DNA, 16 bp, C. familiaris
gaacccctgtgcactg

SEQ ID NO: 318044 - DNA, 16 bp, C. familiaris
gaacctctagtacaat

SEQ ID NO: 318045 - DNA, 16 bp, C. familiaris
gaacctgatgtggcac

SEQ ID NO: 318046 - DNA, 16 bp, C. familiaris
gaacctgcttctgcct

SEQ ID NO: 318047 - DNA, 16 bp, C. familiaris
gaacctggagaacatt

SEQ ID NO: 318048 - DNA, 16 bp, C. familiaris
gaacctgttagaaatg

SEQ ID NO: 318049 - DNA, 16 bp, C. familiaris
gaactacatttcccag

SEQ ID NO: 318050 - DNA, 16 bp, C. familiaris
gaactagaaaaagaag

SEQ ID NO: 318051 - DNA, 16 bp, C. familiaris
gaactagaagatatta

SEQ ID NO: 318052 - DNA, 16 bp, C. familiaris
gaactatcagaaagag

SEQ ID NO: 318053 - DNA, 16 bp, C. familiaris
gaactatggaacagat

SEQ ID NO: 318054 - DNA, 16 bp, C. familiaris
gaactcaaaaccccaa

SEQ ID NO: 318055 - DNA, 16 bp, C. familiaris
gaactcaatgaaatgg

SEQ ID NO: 318056 - DNA, 16 bp, C. familiaris
gaactcagaaacattt

SEQ ID NO: 318057 - DNA, 16 bp, C. familiaris
gaactcagctgcctca

SEQ ID NO: 318058 - DNA, 16 bp, C. familiaris
gaactctacacttaaa

SEQ ID NO: 318059 - DNA, 16 bp, C. familiaris
gaactgaaagaatatg

SEQ ID NO: 318060 - DNA, 16 bp, C. familiaris
gaactgaaatacaaaa

SEQ ID NO: 318061 - DNA, 16 bp, C. familiaris
gaactgaaatcaagaa

SEQ ID NO: 318062 - DNA, 16 bp, C. familiaris
gaactgaagctcagag

SEQ ID NO: 318063 - DNA, 16 bp, C. familiaris
gaactggagaaagaac

SEQ ID NO: 318064 - DNA, 16 bp, C. familiaris
gaactggcagaagaaa

SEQ ID NO: 318065 - DNA, 16 bp, C. familiaris
gaactgggatcatgcc

SEQ ID NO: 318066 - DNA, 16 bp, C. familiaris
gaactgtgggatcatg

SEQ ID NO: 318067 - DNA, 16 bp, C. familiaris
gaacttactagaaatg

SEQ ID NO: 318068 - DNA, 16 bp, C. familiaris
gaacttcaggatcatg

SEQ ID NO: 318069 - DNA, 16 bp, C. familiaris
gaacttgatcccagaa

SEQ ID NO: 318070 - DNA, 16 bp, C. familiaris
gaacttgatgatggca

SEQ ID NO: 318071 - DNA, 16 bp, C. familiaris
gaacttgttggaaatg

SEQ ID NO: 318072 - DNA, 16 bp, C. familiaris
gaactttacatctgaa

SEQ ID NO: 318073 - DNA, 16 bp, C. familiaris
gaactttcttcagaga

SEQ ID NO: 318074 - DNA, 16 bp, C. familiaris
gaactttttgtttgtt

SEQ ID NO: 318075 - DNA, 16 bp, C. familiaris
gaagaaaaaacatttg

SEQ ID NO: 318076 - DNA, 16 bp, C. familiaris
gaagaaaaacatttta

SEQ ID NO: 318077 - DNA, 16 bp, C. familiaris
gaagaaaaacctacat

SEQ ID NO: 318078 - DNA, 16 bp, C. familiaris
gaagaaaaatcccaaa

SEQ ID NO: 318079 - DNA, 16 bp, C. familiaris
gaagaaaacaaagatg

SEQ ID NO: 318080 - DNA, 16 bp, C. familiaris
gaagaaaacatagatg

SEQ ID NO: 318081 - DNA, 16 bp, C. familiaris
gaagaaaacatgggag

SEQ ID NO: 318082 - DNA, 16 bp, C. familiaris
gaagaaaactagagaa

SEQ ID NO: 318083 - DNA, 16 bp, C. familiaris
gaagaaaacttttaaa

SEQ ID NO: 318084 - DNA, 16 bp, C. familiaris
gaagaaaagggaaatc

SEQ ID NO: 318085 - DNA, 16 bp, C. familiaris
gaagaaaatacaggca

SEQ ID NO: 318086 - DNA, 16 bp, C. familiaris
gaagaaaatgaaacag

SEQ ID NO: 318087 - DNA, 16 bp, C. familiaris
gaagaaaatgaagaca

SEQ ID NO: 318088 - DNA, 16 bp, C. familiaris
gaagaaaattaaagca

SEQ ID NO: 318089 - DNA, 16 bp, C. familiaris
gaagaaaccaagatgt

SEQ ID NO: 318090 - DNA, 16 bp, C. familiaris
gaagaaaccaatcctg

SEQ ID NO: 318091 - DNA, 16 bp, C. familiaris
gaagaaaccagccctg

SEQ ID NO: 318092 - DNA, 16 bp, C. familiaris
gaagaaactcaaatac

SEQ ID NO: 318093 - DNA, 16 bp, C. familiaris
gaagaaactgaggcat

SEQ ID NO: 318094 - DNA, 16 bp, C. familiaris
gaagaaagaatctgaa

SEQ ID NO: 318095 - DNA, 16 bp, C. familiaris
gaagaaagcacaggca

SEQ ID NO: 318096 - DNA, 16 bp, C. familiaris
gaagaaaggcaggcag

SEQ ID NO: 318097 - DNA, 16 bp, C. familiaris
gaagaaagtgtttcaa

SEQ ID NO: 318098 - DNA, 16 bp, C. familiaris
gaagaaagttcagtgg

SEQ ID NO: 318099 - DNA, 16 bp, C. familiaris
gaagaaataatagatg

SEQ ID NO: 318100 - DNA, 16 bp, C. familiaris
gaagaaatagacaaat

SEQ ID NO: 318101 - DNA, 16 bp, C. familiaris
gaagaaatatcagaaa

SEQ ID NO: 318102 - DNA, 16 bp, C. familiaris
gaagaaatattaaagg

SEQ ID NO: 318103 - DNA, 16 bp, C. familiaris
gaagaaatcaaagagg

SEQ ID NO: 318104 - DNA, 16 bp, C. familiaris
gaagaaatcacagcca

SEQ ID NO: 318105 - DNA, 16 bp, C. familiaris
gaagaaatcagagagg

SEQ ID NO: 318106 - DNA, 16 bp, C. familiaris
gaagaaatgaacagac

SEQ ID NO: 318107 - DNA, 16 bp, C. familiaris
gaagaaatgaagaaca

SEQ ID NO: 318108 - DNA, 16 bp, C. familiaris
gaagaaatggataaat

SEQ ID NO: 318109 - DNA, 16 bp, C. familiaris
gaagaaattgaagcag

SEQ ID NO: 318110 - DNA, 16 bp, C. familiaris
gaagaaattttgaaga

SEQ ID NO: 318111 - DNA, 16 bp, C. familiaris
gaagaacagctggaag

SEQ ID NO: 318112 - DNA, 16 bp, C. familiaris
gaagaacatgcaacca

SEQ ID NO: 318113 - DNA, 16 bp, C. familiaris
gaagaactagaaaacc

SEQ ID NO: 318114 - DNA, 16 bp, C. familiaris
gaagaactgctggaag

SEQ ID NO: 318115 - DNA, 16 bp, C. familiaris
gaagaactgtggaaga

SEQ ID NO: 318116 - DNA, 16 bp, C. familiaris
gaagaactgtggatct

SEQ ID NO: 318117 - DNA, 16 bp, C. familiaris
gaagaagaaaatgttt

SEQ ID NO: 318118 - DNA, 16 bp, C. familiaris
gaagaagaagaagcat

SEQ ID NO: 318119 - DNA, 16 bp, C. familiaris
gaagaagaagaagctt

SEQ ID NO: 318120 - DNA, 16 bp, C. familiaris
gaagaagaagcagcag

SEQ ID NO: 318121 - DNA, 16 bp, C. familiaris
gaagaagaaggctccc

SEQ ID NO: 318122 - DNA, 16 bp, C. familiaris
gaagaagaattttttt

SEQ ID NO: 318123 - DNA, 16 bp, C. familiaris
gaagaagacagagacc

SEQ ID NO: 318124 - DNA, 16 bp, C. familiaris
gaagaagactccccac

SEQ ID NO: 318125 - DNA, 16 bp, C. familiaris
gaagaagatacaaata

SEQ ID NO: 318126 - DNA, 16 bp, C. familiaris
gaagaagcagaagcag

SEQ ID NO: 318127 - DNA, 16 bp, C. familiaris
gaagaagcagattcct

SEQ ID NO: 318128 - DNA, 16 bp, C. familiaris
gaagaagcaggctctg

SEQ ID NO: 318129 - DNA, 16 bp, C. familiaris
gaagaagcaggcttcc

SEQ ID NO: 318130 - DNA, 16 bp, C. familiaris
gaagaagctgactccc

SEQ ID NO: 318131 - DNA, 16 bp, C. familiaris
gaagaagctgcagaag

SEQ ID NO: 318132 - DNA, 16 bp, C. familiaris
gaagaagtaaaatttt

SEQ ID NO: 318133 - DNA, 16 bp, C. familiaris
gaagaataaagaattt

SEQ ID NO: 318134 - DNA, 16 bp, C. familiaris
gaagaatatacaatgg

SEQ ID NO: 318135 - DNA, 16 bp, C. familiaris
gaagaatatgtattca

SEQ ID NO: 318136 - DNA, 16 bp, C. familiaris
gaagaatatttaatga

SEQ ID NO: 318137 - DNA, 16 bp, C. familiaris
gaagaatctttttttt

SEQ ID NO: 318138 - DNA, 16 bp, C. familiaris
gaagaatggtctcaga

SEQ ID NO: 318139 - DNA, 16 bp, C. familiaris
gaagaatgtttattct

SEQ ID NO: 318140 - DNA, 16 bp, C. familiaris
gaagaattaatattct

SEQ ID NO: 318141 - DNA, 16 bp, C. familiaris
gaagaattagaaaacc

SEQ ID NO: 318142 - DNA, 16 bp, C. familiaris
gaagaattatttttta

SEQ ID NO: 318143 - DNA, 16 bp, C. familiaris
gaagaattttatttta

SEQ ID NO: 318144 - DNA, 16 bp, C. familiaris
gaagacaaaaatagga

SEQ ID NO: 318145 - DNA, 16 bp, C. familiaris
gaagacaaaccacaga

SEQ ID NO: 318146 - DNA, 16 bp, C. familiaris
gaagacaaaggcagag

SEQ ID NO: 318147 - DNA, 16 bp, C. familiaris
gaagacaaggtgatgg

SEQ ID NO: 318148 - DNA, 16 bp, C. familiaris
gaagacacacacagag

SEQ ID NO: 318149 - DNA, 16 bp, C. familiaris
gaagacagaagcagag

SEQ ID NO: 318150 - DNA, 16 bp, C. familiaris
gaagacagacacttaa

SEQ ID NO: 318151 - DNA, 16 bp, C. familiaris
gaagacagatgctcaa

SEQ ID NO: 318152 - DNA, 16 bp, C. familiaris
gaagacagtatggaga

SEQ ID NO: 318153 - DNA, 27 bp, C. familiaris
gaagacatagacatggccaacatgcac

SEQ ID NO: 318154 - DNA, 16 bp, C. familiaris
gaagacatgaacagag

SEQ ID NO: 318155 - DNA, 16 bp, C. familiaris
gaagacatgaacaggc

SEQ ID NO: 318156 - DNA, 16 bp, C. familiaris
gaagacattcaaatgg

SEQ ID NO: 318157 - DNA, 16 bp, C. familiaris
gaagaccagctggaaa

SEQ ID NO: 318158 - DNA, 16 bp, C. familiaris
gaagacctatcaagta

SEQ ID NO: 318159 - DNA, 16 bp, C. familiaris
gaagacctatcaagtg

SEQ ID NO: 318160 - DNA, 16 bp, C. familiaris
gaagagaaaatgcatt

SEQ ID NO: 318161 - DNA, 16 bp, C. familiaris
gaagagaaagaatctt

SEQ ID NO: 318162 - DNA, 16 bp, C. familiaris
gaagagaaattttaaa

SEQ ID NO: 318163 - DNA, 16 bp, C. familiaris
gaagagactatttttt

SEQ ID NO: 318164 - DNA, 16 bp, C. familiaris
gaagagactgtctctt

SEQ ID NO: 318165 - DNA, 16 bp, C. familiaris
gaagagactttctttt

SEQ ID NO: 318166 - DNA, 16 bp, C. familiaris
gaagagagaaatagac

SEQ ID NO: 318167 - DNA, 16 bp, C. familiaris
gaagagagtccagaaa

SEQ ID NO: 318168 - DNA, 18 bp, C. familiaris
gaagagagttaataaaga

SEQ ID NO: 318169 - DNA, 16 bp, C. familiaris
gaagagatgctcaaca

SEQ ID NO: 318170 - DNA, 16 bp, C. familiaris
gaagagattctttttt

SEQ ID NO: 318171 - DNA, 16 bp, C. familiaris
gaagagcaaagttgga

SEQ ID NO: 318172 - DNA, 16 bp, C. familiaris
gaagagcaggtgcaaa

SEQ ID NO: 318173 - DNA, 16 bp, C. familiaris
gaagagctaaataaat

SEQ ID NO: 318174 - DNA, 16 bp, C. familiaris
gaagagctgatgtttc

SEQ ID NO: 318175 - DNA, 16 bp, C. familiaris
gaagaggagggaacac

SEQ ID NO: 318176 - DNA, 16 bp, C. familiaris
gaagaggagggaacat

SEQ ID NO: 318177 - DNA, 16 bp, C. familiaris
gaagaggcaaggaaca

SEQ ID NO: 318178 - DNA, 16 bp, C. familiaris
gaagaggcagaggcag

SEQ ID NO: 318179 - DNA, 16 bp, C. familiaris
gaagagggagcagcag

SEQ ID NO: 318180 - DNA, 16 bp, C. familiaris
gaagagggccactggg

SEQ ID NO: 318181 - DNA, 16 bp, C. familiaris
gaagaggtagaagcag

SEQ ID NO: 318182 - DNA, 16 bp, C. familiaris
gaagagtgagaagcag

SEQ ID NO: 318183 - DNA, 16 bp, C. familiaris
gaagagtttgagaaga

SEQ ID NO: 318184 - DNA, 16 bp, C. familiaris
gaagataagccacaga

SEQ ID NO: 318185 - DNA, 16 bp, C. familiaris
gaagatatataaatga

SEQ ID NO: 318186 - DNA, 16 bp, C. familiaris
gaagatattgcaaatg

SEQ ID NO: 318187 - DNA, 16 bp, C. familiaris
gaagatatttacaaat

SEQ ID NO: 318188 - DNA, 16 bp, C. familiaris
gaagatcaggaacaag

SEQ ID NO: 318189 - DNA, 16 bp, C. familiaris
gaagatctaaataaat

SEQ ID NO: 318190 - DNA, 16 bp, C. familiaris
gaagatctaaatgtga

SEQ ID NO: 318191 - DNA, 16 bp, C. familiaris
gaagatctgtcattta

SEQ ID NO: 318192 - DNA, 16 bp, C. familiaris
gaagatctttttaaaa

SEQ ID NO: 318193 - DNA, 16 bp, C. familiaris
gaagatgacacaaatg

SEQ ID NO: 318194 - DNA, 16 bp, C. familiaris
gaagatgagaaagttc

SEQ ID NO: 318195 - DNA, 16 bp, C. familiaris
gaagatgaggaaactg

SEQ ID NO: 318196 - DNA, 16 bp, C. familiaris
gaagatgagtgggaaa

SEQ ID NO: 318197 - DNA, 16 bp, C. familiaris
gaagatgatgatggtg

SEQ ID NO: 318198 - DNA, 16 bp, C. familiaris
gaagatgctcaacatc

SEQ ID NO: 318199 - DNA, 16 bp, C. familiaris
gaagatgctgtgaaga

SEQ ID NO: 318200 - DNA, 16 bp, C. familiaris
gaagatggcagaggag

SEQ ID NO: 318201 - DNA, 16 bp, C. familiaris
gaagatggcggaagag

SEQ ID NO: 318202 - DNA, 16 bp, C. familiaris
gaagatggtgtgtgtg

SEQ ID NO: 318203 - DNA, 16 bp, C. familiaris
gaagcaaaatgtaaaa

SEQ ID NO: 318204 - DNA, 16 bp, C. familiaris
gaagcaacacaagtgt

SEQ ID NO: 318205 - DNA, 16 bp, C. familiaris
gaagcaaccaagatgt

SEQ ID NO: 318206 - DNA, 16 bp, C. familiaris
gaagcaactttggagg

SEQ ID NO: 318207 - DNA, 16 bp, C. familiaris
gaagcaaggtttctag

SEQ ID NO: 318208 - DNA, 16 bp, C. familiaris
gaagcaatcaacaaaa

SEQ ID NO: 318209 - DNA, 16 bp, C. familiaris
gaagcaatcaataaaa

SEQ ID NO: 318210 - DNA, 16 bp, C. familiaris
gaagcacaggcagagg

SEQ ID NO: 318211 - DNA, 16 bp, C. familiaris
gaagcagaaaaagcat

SEQ ID NO: 318212 - DNA, 16 bp, C. familiaris
gaagcagaaacacagg

SEQ ID NO: 318213 - DNA, 16 bp, C. familiaris
gaagcagagaaacagg

SEQ ID NO: 318214 - DNA, 16 bp, C. familiaris
gaagcagagatacagg

SEQ ID NO: 318215 - DNA, 16 bp, C. familiaris
gaagcagatggagagg

SEQ ID NO: 318216 - DNA, 16 bp, C. familiaris
gaagcagcagaaagag

SEQ ID NO: 318217 - DNA, 16 bp, C. familiaris
gaagcagcagagagag

SEQ ID NO: 318218 - DNA, 16 bp, C. familiaris
gaagcagcagagggag

SEQ ID NO: 318219 - DNA, 16 bp, C. familiaris
gaagcagcagcagcaa

SEQ ID NO: 318220 - DNA, 16 bp, C. familiaris
gaagcagcccaactgt

SEQ ID NO: 318221 - DNA, 16 bp, C. familiaris
gaagcagcccaagggt

SEQ ID NO: 318222 - DNA, 16 bp, C. familiaris
gaagcaggagaagcag

SEQ ID NO: 318223 - DNA, 16 bp, C. familiaris
gaagcaggcccccctc

SEQ ID NO: 318224 - DNA, 16 bp, C. familiaris
gaagcaggctcatgca

SEQ ID NO: 318225 - DNA, 16 bp, C. familiaris
gaagcaggctcccggc

SEQ ID NO: 318226 - DNA, 16 bp, C. familiaris
gaagcaggctcctgga

SEQ ID NO: 318227 - DNA, 16 bp, C. familiaris
gaagcaggctcctggg

SEQ ID NO: 318228 - DNA, 16 bp, C. familiaris
gaagcaggctctgcag

SEQ ID NO: 318229 - DNA, 16 bp, C. familiaris
gaagcattttttcatg

SEQ ID NO: 318230 - DNA, 16 bp, C. familiaris
gaagccaactccctgc

SEQ ID NO: 318231 - DNA, 16 bp, C. familiaris
gaagccactggagggt

SEQ ID NO: 318232 - DNA, 16 bp, C. familiaris
gaagccactgtggaaa

SEQ ID NO: 318233 - DNA, 16 bp, C. familiaris
gaagccagagatgctg

SEQ ID NO: 318234 - DNA, 16 bp, C. familiaris
gaagccagaggacaag

SEQ ID NO: 318235 - DNA, 16 bp, C. familiaris
gaagccagatgctcaa

SEQ ID NO: 318236 - DNA, 16 bp, C. familiaris
gaagccagatgtgggg

SEQ ID NO: 318237 - DNA, 16 bp, C. familiaris
gaagccagccaccatg

SEQ ID NO: 318238 - DNA, 16 bp, C. familiaris
gaagccattttttaaa

SEQ ID NO: 318239 - DNA, 16 bp, C. familiaris
gaagccctagcctcag

SEQ ID NO: 318240 - DNA, 16 bp, C. familiaris
gaagccctcacagaag

SEQ ID NO: 318241 - DNA, 16 bp, C. familiaris
gaagcctgactcaggg

SEQ ID NO: 318242 - DNA, 16 bp, C. familiaris
gaagctaatctgaaaa

SEQ ID NO: 318243 - DNA, 16 bp, C. familiaris
gaagctacagaagaaa

SEQ ID NO: 318244 - DNA, 16 bp, C. familiaris
gaagctagaagtctga

SEQ ID NO: 318245 - DNA, 16 bp, C. familiaris
gaagctcagagaagct

SEQ ID NO: 318246 - DNA, 16 bp, C. familiaris
gaagctgaaaaaggca

SEQ ID NO: 318247 - DNA, 16 bp, C. familiaris
gaagctgaggcccaga

SEQ ID NO: 318248 - DNA, 16 bp, C. familiaris
gaagctgagggaaaaa

SEQ ID NO: 318249 - DNA, 16 bp, C. familiaris
gaagctgcagaagaaa

SEQ ID NO: 318250 - DNA, 16 bp, C. familiaris
gaagctgcaggcagag

SEQ ID NO: 318251 - DNA, 16 bp, C. familiaris
gaagctggaaaaagaa

SEQ ID NO: 318252 - DNA, 16 bp, C. familiaris
gaagctggaagaggca

SEQ ID NO: 318253 - DNA, 16 bp, C. familiaris
gaagctggagaaagaa

SEQ ID NO: 318254 - DNA, 16 bp, C. familiaris
gaagctggagaaggca

SEQ ID NO: 318255 - DNA, 16 bp, C. familiaris
gaagctggatgtggga

SEQ ID NO: 318256 - DNA, 16 bp, C. familiaris
gaagctggggcacctg

SEQ ID NO: 318257 - DNA, 16 bp, C. familiaris
gaagcttttcttcctc

SEQ ID NO: 318258 - DNA, 16 bp, C. familiaris
gaaggaaataataatg

SEQ ID NO: 318259 - DNA, 16 bp, C. familiaris
gaaggaaatcatcaac

SEQ ID NO: 318260 - DNA, 16 bp, C. familiaris
gaaggaaattctgaca

SEQ ID NO: 318261 - DNA, 16 bp, C. familiaris
gaaggaaattttgcca

SEQ ID NO: 318262 - DNA, 16 bp, C. familiaris
gaaggaactggagaaa

SEQ ID NO: 318263 - DNA, 16 bp, C. familiaris
gaaggaagaccacaga

SEQ ID NO: 318264 - DNA, 16 bp, C. familiaris
gaaggaagcagagaca

SEQ ID NO: 318265 - DNA, 16 bp, C. familiaris
gaaggaagctgaggag

SEQ ID NO: 318266 - DNA, 16 bp, C. familiaris
gaaggaaggaaggcat

SEQ ID NO: 318267 - DNA, 16 bp, C. familiaris
gaaggaaggacagaca

SEQ ID NO: 318268 - DNA, 16 bp, C. familiaris
gaaggacaagttccag

SEQ ID NO: 318269 - DNA, 16 bp, C. familiaris
gaaggacagaaggaca

SEQ ID NO: 318270 - DNA, 16 bp, C. familiaris
gaaggacatctcagct

SEQ ID NO: 318271 - DNA, 16 bp, C. familiaris
gaaggagaaatcaaga

SEQ ID NO: 318272 - DNA, 16 bp, C. familiaris
gaaggagaagcagaca

SEQ ID NO: 318273 - DNA, 16 bp, C. familiaris
gaaggagaagcagcag

SEQ ID NO: 318274 - DNA, 16 bp, C. familiaris
gaaggagaagcaggcc

SEQ ID NO: 318275 - DNA, 16 bp, C. familiaris
gaaggagaagcaggtg

SEQ ID NO: 318276 - DNA, 16 bp, C. familiaris
gaaggagaagctgact

SEQ ID NO: 318277 - DNA, 16 bp, C. familiaris
gaaggagacagagaca

SEQ ID NO: 318278 - DNA, 16 bp, C. familiaris
gaaggagagatcaaga

SEQ ID NO: 318279 - DNA, 16 bp, C. familiaris
gaaggagaggcaggct

SEQ ID NO: 318280 - DNA, 16 bp, C. familiaris
gaaggagcaggagcag

SEQ ID NO: 318281 - DNA, 16 bp, C. familiaris
gaaggagccctccacc

SEQ ID NO: 318282 - DNA, 16 bp, C. familiaris
gaaggaggctccctac

SEQ ID NO: 318283 - DNA, 16 bp, C. familiaris
gaaggaggctgaggaa

SEQ ID NO: 318284 - DNA, 16 bp, C. familiaris
gaaggaggggcacctg

SEQ ID NO: 318285 - DNA, 16 bp, C. familiaris
gaaggagtacatgcac

SEQ ID NO: 318286 - DNA, 16 bp, C. familiaris
gaaggatccacttcca

SEQ ID NO: 318287 - DNA, 16 bp, C. familiaris
gaaggatgagtacagt

SEQ ID NO: 318288 - DNA, 16 bp, C. familiaris
gaaggattttattttt

SEQ ID NO: 318289 - DNA, 16 bp, C. familiaris
gaaggcaaaagaaata

SEQ ID NO: 318290 - DNA, 16 bp, C. familiaris
gaaggcagaaactcaa

SEQ ID NO: 318291 - DNA, 16 bp, C. familiaris
gaaggcagacactgaa

SEQ ID NO: 318292 - DNA, 16 bp, C. familiaris
gaaggcagaccctcaa

SEQ ID NO: 318293 - DNA, 16 bp, C. familiaris
gaaggcagacgctcaa

SEQ ID NO: 318294 - DNA, 16 bp, C. familiaris
gaaggcagagctcaac

SEQ ID NO: 318295 - DNA, 16 bp, C. familiaris
gaaggcagatattcaa

SEQ ID NO: 318296 - DNA, 16 bp, C. familiaris
gaaggcagcactgaac

SEQ ID NO: 318297 - DNA, 16 bp, C. familiaris
gaaggcagcattaaac

SEQ ID NO: 318298 - DNA, 16 bp, C. familiaris
gaaggcaggccagggt

SEQ ID NO: 318299 - DNA, 16 bp, C. familiaris
gaaggcaggcgctgaa

SEQ ID NO: 318300 - DNA, 16 bp, C. familiaris
gaaggccaagatcaag

SEQ ID NO: 318301 - DNA, 16 bp, C. familiaris
gaaggccacgtgaaga

SEQ ID NO: 318302 - DNA, 16 bp, C. familiaris
gaaggcccaggagcag

SEQ ID NO: 318303 - DNA, 16 bp, C. familiaris
gaaggcttcccggagg

SEQ ID NO: 318304 - DNA, 16 bp, C. familiaris
gaaggcttcctgcagg

SEQ ID NO: 318305 - DNA, 16 bp, C. familiaris
gaaggcttcctggagg

SEQ ID NO: 318306 - DNA, 16 bp, C. familiaris
gaagggaggcactaaa

SEQ ID NO: 318307 - DNA, 16 bp, C. familiaris
gaagggcaagagacag

SEQ ID NO: 318308 - DNA, 16 bp, C. familiaris
gaagggcactgaggag

SEQ ID NO: 318309 - DNA, 16 bp, C. familiaris
gaaggggcagcccggg

SEQ ID NO: 318310 - DNA, 16 bp, C. familiaris
gaagggggagctctca

SEQ ID NO: 318311 - DNA, 16 bp, C. familiaris
gaaggtattaacttct

SEQ ID NO: 318312 - DNA, 16 bp, C. familiaris
gaaggtcactggaggg

SEQ ID NO: 318313 - DNA, 16 bp, C. familiaris
gaaggtgaaggtgaag

SEQ ID NO: 318314 - DNA, 16 bp, C. familiaris
gaaggtgacatttgaa

SEQ ID NO: 318315 - DNA, 16 bp, C. familiaris
gaaggtggaggcagag

SEQ ID NO: 318316 - DNA, 16 bp, C. familiaris
gaagtaaatgaaaatg

SEQ ID NO: 318317 - DNA, 16 bp, C. familiaris
gaagtaatttttaaaa

SEQ ID NO: 318318 - DNA, 16 bp, C. familiaris
gaagtacaaattaaaa

SEQ ID NO: 318319 - DNA, 16 bp, C. familiaris
gaagtagagcctgaag

SEQ ID NO: 318320 - DNA, 16 bp, C. familiaris
gaagtcaatgcctggc

SEQ ID NO: 318321 - DNA, 16 bp, C. familiaris
gaagtcacagagctga

SEQ ID NO: 318322 - DNA, 16 bp, C. familiaris
gaagtcagaaatcaag

SEQ ID NO: 318323 - DNA, 16 bp, C. familiaris
gaagtcatcagagaga

SEQ ID NO: 318324 - DNA, 16 bp, C. familiaris
gaagtcccaaatcaag

SEQ ID NO: 318325 - DNA, 16 bp, C. familiaris
gaagtcctaatgatga

SEQ ID NO: 318326 - DNA, 16 bp, C. familiaris
gaagtcctcgcctcag

SEQ ID NO: 318327 - DNA, 16 bp, C. familiaris
gaagtgaacaaggggt

SEQ ID NO: 318328 - DNA, 16 bp, C. familiaris
gaagtgacctgcccaa

SEQ ID NO: 318329 - DNA, 16 bp, C. familiaris
gaagtgatgaaaatgt

SEQ ID NO: 318330 - DNA, 16 bp, C. familiaris
gaagtgatttgtccaa

SEQ ID NO: 318331 - DNA, 16 bp, C. familiaris
gaagtgcagagggaga

SEQ ID NO: 318332 - DNA, 16 bp, C. familiaris
gaagtgccaggccctg

SEQ ID NO: 318333 - DNA, 16 bp, C. familiaris
gaagtggaattgatgg

SEQ ID NO: 318334 - DNA, 16 bp, C. familiaris
gaagtgggctccccac

SEQ ID NO: 318335 - DNA, 16 bp, C. familiaris
gaagtgggctccctgc

SEQ ID NO: 318336 - DNA, 16 bp, C. familiaris
gaagttcaagatcaaa

SEQ ID NO: 318337 - DNA, 16 bp, C. familiaris
gaagttcctcaaaaac

SEQ ID NO: 318338 - DNA, 16 bp, C. familiaris
gaagttctttacagat

SEQ ID NO: 318339 - DNA, 16 bp, C. familiaris
gaagtttatagtaata

SEQ ID NO: 318340 - DNA, 16 bp, C. familiaris
gaagttttaaattttg

SEQ ID NO: 318341 - DNA, 16 bp, C. familiaris
gaagttttgccatttg

SEQ ID NO: 318342 - DNA, 16 bp, C. familiaris
gaataaaacagatgaa

SEQ ID NO: 318343 - DNA, 16 bp, C. familiaris
gaataaaataggaatc

SEQ ID NO: 318344 - DNA, 16 bp, C. familiaris
gaataaataaaaagtc

SEQ ID NO: 318345 - DNA, 16 bp, C. familiaris
gaataaatttttgttg

SEQ ID NO: 318346 - DNA, 16 bp, C. familiaris
gaataataatccattg

SEQ ID NO: 318347 - DNA, 16 bp, C. familiaris
gaataatattccagtg

SEQ ID NO: 318348 - DNA, 16 bp, C. familiaris
gaataatgaaactgga

SEQ ID NO: 318349 - DNA, 16 bp, C. familiaris
gaataccaataaaaat

SEQ ID NO: 318350 - DNA, 16 bp, C. familiaris
gaataccacagaagtg

SEQ ID NO: 318351 - DNA, 16 bp, C. familiaris
gaatagaaatctcaca

SEQ ID NO: 318352 - DNA, 16 bp, C. familiaris
gaatagaagagaactt

SEQ ID NO: 318353 - DNA, 16 bp, C. familiaris
gaatagagtccagaaa

SEQ ID NO: 318354 - DNA, 16 bp, C. familiaris
gaataggaaaagatat

SEQ ID NO: 318355 - DNA, 16 bp, C. familiaris
gaatataaatgcaaaa

SEQ ID NO: 318356 - DNA, 16 bp, C. familiaris
gaatataccacaattt

SEQ ID NO: 318357 - DNA, 16 bp, C. familiaris
gaatatattttcattt

SEQ ID NO: 318358 - DNA, 16 bp, C. familiaris
gaatatccaatggaaa

SEQ ID NO: 318359 - DNA, 16 bp, C. familiaris
gaatatccaattatcc

SEQ ID NO: 318360 - DNA, 16 bp, C. familiaris
gaatatcctttttttt

SEQ ID NO: 318361 - DNA, 16 bp, C. familiaris
gaatatgagaaaatat

SEQ ID NO: 318362 - DNA, 16 bp, C. familiaris
gaatatgatcttattt

SEQ ID NO: 318363 - DNA, 16 bp, C. familiaris
gaatattattcagtca

SEQ ID NO: 318364 - DNA, 16 bp, C. familiaris
gaatattttttaaaga

SEQ ID NO: 318365 - DNA, 16 bp, C. familiaris
gaatcacaattccaga

SEQ ID NO: 318366 - DNA, 16 bp, C. familiaris
gaatcagaaaataccc

SEQ ID NO: 318367 - DNA, 16 bp, C. familiaris
gaatccacacagacat

SEQ ID NO: 318368 - DNA, 16 bp, C. familiaris
gaatcccaagcaggat

SEQ ID NO: 318369 - DNA, 16 bp, C. familiaris
gaatcccagccctgcc

SEQ ID NO: 318370 - DNA, 16 bp, C. familiaris
gaatcctttatacttt

SEQ ID NO: 318371 - DNA, 16 bp, C. familiaris
gaatcgaatcaaaaag

SEQ ID NO: 318372 - DNA, 16 bp, C. familiaris
gaatctacttaaaaaa

SEQ ID NO: 318373 - DNA, 16 bp, C. familiaris
gaatctataaaacaaa

SEQ ID NO: 318374 - DNA, 16 bp, C. familiaris
gaatctcaagcagatg

SEQ ID NO: 318375 - DNA, 16 bp, C. familiaris
gaatctcaaggagact

SEQ ID NO: 318376 - DNA, 16 bp, C. familiaris
gaatctccaggagact

SEQ ID NO: 318377 - DNA, 16 bp, C. familiaris
gaatctcttgtctcaa

SEQ ID NO: 318378 - DNA, 16 bp, C. familiaris
gaatctgatgaaagct

SEQ ID NO: 318379 - DNA, 16 bp, C. familiaris
gaatctgctggtgcct

SEQ ID NO: 318380 - DNA, 16 bp, C. familiaris
gaatctgtagatggct

SEQ ID NO: 318381 - DNA, 16 bp, C. familiaris
gaatgaaaagtacagc

SEQ ID NO: 318382 - DNA, 16 bp, C. familiaris
gaatgaaaatgaaaac

SEQ ID NO: 318383 - DNA, 16 bp, C. familiaris
gaatgaaagaatgaat

SEQ ID NO: 318384 - DNA, 16 bp, C. familiaris
gaatgaagatacaatc

SEQ ID NO: 318385 - DNA, 16 bp, C. familiaris
gaatgaatgaagagat

SEQ ID NO: 318386 - DNA, 16 bp, C. familiaris
gaatgaatgaatcaat

SEQ ID NO: 318387 - DNA, 16 bp, C. familiaris
gaatgagaatgagaat

SEQ ID NO: 318388 - DNA, 16 bp, C. familiaris
gaatgagagagaacat

SEQ ID NO: 318389 - DNA, 16 bp, C. familiaris
gaatgagagagatcac

SEQ ID NO: 318390 - DNA, 16 bp, C. familiaris
gaatgagagtttctgt

SEQ ID NO: 318391 - DNA, 16 bp, C. familiaris
gaatgatttctctgta

SEQ ID NO: 318392 - DNA, 16 bp, C. familiaris
gaatgcagcaaaagca

SEQ ID NO: 318393 - DNA, 16 bp, C. familiaris
gaatgcaggcagcttc

SEQ ID NO: 318394 - DNA, 16 bp, C. familiaris
gaatgcctgtgtggct

SEQ ID NO: 318395 - DNA, 16 bp, C. familiaris
gaatgctggttgccag

SEQ ID NO: 318396 - DNA, 16 bp, C. familiaris
gaatgctttggctatt

SEQ ID NO: 318397 - DNA, 16 bp, C. familiaris
gaatggaacaaaaagg

SEQ ID NO: 318398 - DNA, 16 bp, C. familiaris
gaatggagaaacattt

SEQ ID NO: 318399 - DNA, 16 bp, C. familiaris
gaatggatgctgtgtt

SEQ ID NO: 318400 - DNA, 16 bp, C. familiaris
gaatggatggatgagt

SEQ ID NO: 318401 - DNA, 16 bp, C. familiaris
gaatgggagacaatat

SEQ ID NO: 318402 - DNA, 16 bp, C. familiaris
gaatgggagagatatt

SEQ ID NO: 318403 - DNA, 16 bp, C. familiaris
gaatggggatgcctgg

SEQ ID NO: 318404 - DNA, 16 bp, C. familiaris
gaatggggggatccct

SEQ ID NO: 318405 - DNA, 16 bp, C. familiaris
gaatgggtgaaacagg

SEQ ID NO: 318406 - DNA, 16 bp, C. familiaris
gaatgggtgaggggca

SEQ ID NO: 318407 - DNA, 16 bp, C. familiaris
gaatggttttacattt

SEQ ID NO: 318408 - DNA, 16 bp, C. familiaris
gaatggtttttattta

SEQ ID NO: 318409 - DNA, 16 bp, C. familiaris
gaatgtggtggaagtg

SEQ ID NO: 318410 - DNA, 16 bp, C. familiaris
gaatgttcacagcagc

SEQ ID NO: 318411 - DNA, 16 bp, C. familiaris
gaatgttcatagaagc

SEQ ID NO: 318412 - DNA, 16 bp, C. familiaris
gaatgttttcccatct

SEQ ID NO: 318413 - DNA, 16 bp, C. familiaris
gaattaaaaatagagc

SEQ ID NO: 318414 - DNA, 16 bp, C. familiaris
gaattaattaatgaat

SEQ ID NO: 318415 - DNA, 16 bp, C. familiaris
gaattagaagtagagc

SEQ ID NO: 318416 - DNA, 16 bp, C. familiaris
gaattcaacagcacat

SEQ ID NO: 318417 - DNA, 16 bp, C. familiaris
gaattcaagtcccaca

SEQ ID NO: 318418 - DNA, 16 bp, C. familiaris
gaattcacaaccctga

SEQ ID NO: 318419 - DNA, 16 bp, C. familiaris
gaattccagaaggaga

SEQ ID NO: 318420 - DNA, 16 bp, C. familiaris
gaattctccagtgaag

SEQ ID NO: 318421 - DNA, 16 bp, C. familiaris
gaattctttcttggtt

SEQ ID NO: 318422 - DNA, 16 bp, C. familiaris
gaattgaaagaattaa

SEQ ID NO: 318423 - DNA, 16 bp, C. familiaris
gaattgctggctcata

SEQ ID NO: 318424 - DNA, 16 bp, C. familiaris
gaattggagaaagaac

SEQ ID NO: 318425 - DNA, 16 bp, C. familiaris
gaattgtacatttaaa

SEQ ID NO: 318426 - DNA, 16 bp, C. familiaris
gaatttaaaacatttt

SEQ ID NO: 318427 - DNA, 16 bp, C. familiaris
gaatttaaatacaata

SEQ ID NO: 318428 - DNA, 16 bp, C. familiaris
gaatttatccattttt

SEQ ID NO: 318429 - DNA, 16 bp, C. familiaris
gaatttatcccaaaga

SEQ ID NO: 318430 - DNA, 16 bp, C. familiaris
gaatttatctatttct

SEQ ID NO: 318431 - DNA, 16 bp, C. familiaris
gaatttatttatcagt

SEQ ID NO: 318432 - DNA, 16 bp, C. familiaris
gaatttcaagctgact

SEQ ID NO: 318433 - DNA, 16 bp, C. familiaris
gaatttcacttttttt

SEQ ID NO: 318434 - DNA, 16 bp, C. familiaris
gaatttccatttttta

SEQ ID NO: 318435 - DNA, 16 bp, C. familiaris
gaatttgaaattattt

SEQ ID NO: 318436 - DNA, 16 bp, C. familiaris
gaatttgtaatttaaa

SEQ ID NO: 318437 - DNA, 16 bp, C. familiaris
gaatttgtcaccagca

SEQ ID NO: 318438 - DNA, 16 bp, C. familiaris
gaatttgtggacatat

SEQ ID NO: 318439 - DNA, 16 bp, C. familiaris
gaatttgttgaggttt

SEQ ID NO: 318440 - DNA, 16 bp, C. familiaris
gaattttaaagaagaa

SEQ ID NO: 318441 - DNA, 16 bp, C. familiaris
gaattttaccaaatat

SEQ ID NO: 318442 - DNA, 16 bp, C. familiaris
gaattttaggaggaca

SEQ ID NO: 318443 - DNA, 16 bp, C. familiaris
gaattttcatttctaa

SEQ ID NO: 318444 - DNA, 16 bp, C. familiaris
gaattttccaattttt

SEQ ID NO: 318445 - DNA, 16 bp, C. familiaris
gaattttggaaacaag

SEQ ID NO: 318446 - DNA, 16 bp, C. familiaris
gacaaaaatccctgcc

SEQ ID NO: 318447 - DNA, 16 bp, C. familiaris
gacaaaatcaagagtc

SEQ ID NO: 318448 - DNA, 16 bp, C. familiaris
gacaaaatcagagagg

SEQ ID NO: 318449 - DNA, 16 bp, C. familiaris
gacaaacaaaatgtgg

SEQ ID NO: 318450 - DNA, 16 bp, C. familiaris
gacaaaccatgaggga

SEQ ID NO: 318451 - DNA, 16 bp, C. familiaris
gacaaagaagaagtca

SEQ ID NO: 318452 - DNA, 16 bp, C. familiaris
gacaaagaattcagaa

SEQ ID NO: 318453 - DNA, 16 bp, C. familiaris
gacaaagacacaggca

SEQ ID NO: 318454 - DNA, 16 bp, C. familiaris
gacaaagctggaaaga

SEQ ID NO: 318455 - DNA, 16 bp, C. familiaris
gacaaaggcaggtgcc

SEQ ID NO: 318456 - DNA, 16 bp, C. familiaris
gacaaagtaatggaaa

SEQ ID NO: 318457 - DNA, 16 bp, C. familiaris
gacaaataccaaatga

SEQ ID NO: 318458 - DNA, 16 bp, C. familiaris
gacaaatactctatga

SEQ ID NO: 318459 - DNA, 16 bp, C. familiaris
gacaaatgaaaacaca

SEQ ID NO: 318460 - DNA, 16 bp, C. familiaris
gacaaatgcaatgaaa

SEQ ID NO: 318461 - DNA, 16 bp, C. familiaris
gacaacatggacagac

SEQ ID NO: 318462 - DNA, 16 bp, C. familiaris
gacaactccctcaaga

SEQ ID NO: 318463 - DNA, 16 bp, C. familiaris
gacaagatggaaaaac

SEQ ID NO: 318464 - DNA, 16 bp, C. familiaris
gacaagcagactctgt

SEQ ID NO: 318465 - DNA, 16 bp, C. familiaris
gacaagccacagactg

SEQ ID NO: 318466 - DNA, 16 bp, C. familiaris
gacaaggaagccaaga

SEQ ID NO: 318467 - DNA, 16 bp, C. familiaris
gacaagggtgcccact

SEQ ID NO: 318468 - DNA, 16 bp, C. familiaris
gacaagtgtgaggtgg

SEQ ID NO: 318469 - DNA, 16 bp, C. familiaris
gacaagttacttaaca

SEQ ID NO: 318470 - DNA, 16 bp, C. familiaris
gacaagttccaggaga

SEQ ID NO: 318471 - DNA, 16 bp, C. familiaris
gacaatttttttaaag

SEQ ID NO: 318472 - DNA, 16 bp, C. familiaris
gacacacaggaagagg

SEQ ID NO: 318473 - DNA, 16 bp, C. familiaris
gacacagaagcagagg

SEQ ID NO: 318474 - DNA, 16 bp, C. familiaris
gacacagagaagcagg

SEQ ID NO: 318475 - DNA, 16 bp, C. familiaris
gacacagagaaggaga

SEQ ID NO: 318476 - DNA, 16 bp, C. familiaris
gacacagagaaggagg

SEQ ID NO: 318477 - DNA, 16 bp, C. familiaris
gacacagagaatgaga

SEQ ID NO: 318478 - DNA, 16 bp, C. familiaris
gacacagagacagaag

SEQ ID NO: 318479 - DNA, 16 bp, C. familiaris
gacacagagacagaca

SEQ ID NO: 318480 - DNA, 16 bp, C. familiaris
gacacagagacccagg

SEQ ID NO: 318481 - DNA, 16 bp, C. familiaris
gacacagagagagggg

SEQ ID NO: 318482 - DNA, 16 bp, C. familiaris
gacacagagagcgagg

SEQ ID NO: 318483 - DNA, 16 bp, C. familiaris
gacacagaggagaggc

SEQ ID NO: 318484 - DNA, 16 bp, C. familiaris
gacacagaggagcagg

SEQ ID NO: 318485 - DNA, 16 bp, C. familiaris
gacacagagggagaga

SEQ ID NO: 318486 - DNA, 16 bp, C. familiaris
gacacagagggaggga

SEQ ID NO: 318487 - DNA, 16 bp, C. familiaris
gacacagcccaagatc

SEQ ID NO: 318488 - DNA, 16 bp, C. familiaris
gacacagccctgcccc

SEQ ID NO: 318489 - DNA, 16 bp, C. familiaris
gacacaggagggagaa

SEQ ID NO: 318490 - DNA, 16 bp, C. familiaris
gacacaggcaagaggg

SEQ ID NO: 318491 - DNA, 16 bp, C. familiaris
gacacaggcagtggaa

SEQ ID NO: 318492 - DNA, 16 bp, C. familiaris
gacacaggctgaggaa

SEQ ID NO: 318493 - DNA, 16 bp, C. familiaris
gacacatgaaaattat

SEQ ID NO: 318494 - DNA, 16 bp, C. familiaris
gacaccaaaagcacag

SEQ ID NO: 318495 - DNA, 16 bp, C. familiaris
gacaccaaatctgctg

SEQ ID NO: 318496 - DNA, 16 bp, C. familiaris
gacaccaagatcatga

SEQ ID NO: 318497 - DNA, 16 bp, C. familiaris
gacaccagcaccccaa

SEQ ID NO: 318498 - DNA, 16 bp, C. familiaris
gacaccagcagggtgt

SEQ ID NO: 318499 - DNA, 16 bp, C. familiaris
gacacccaactctggg

SEQ ID NO: 318500 - DNA, 16 bp, C. familiaris
gacaccctgcatggag

SEQ ID NO: 318501 - DNA, 16 bp, C. familiaris
gacacctccagattga

SEQ ID NO: 318502 - DNA, 16 bp, C. familiaris
gacacctgtgttctgg

SEQ ID NO: 318503 - DNA, 16 bp, C. familiaris
gacactcaaccaactg

SEQ ID NO: 318504 - DNA, 16 bp, C. familiaris
gacactcaacttctga

SEQ ID NO: 318505 - DNA, 17 bp, C. familiaris
gacactcgccccagcct

SEQ ID NO: 318506 - DNA, 16 bp, C. familiaris
gacactgagagagaaa

SEQ ID NO: 318507 - DNA, 16 bp, C. familiaris
gacactgagagagaga

SEQ ID NO: 318508 - DNA, 16 bp, C. familiaris
gacactgatgcaaaca

SEQ ID NO: 318509 - DNA, 16 bp, C. familiaris
gacactgtctacctgg

SEQ ID NO: 318510 - DNA, 16 bp, C. familiaris
gacacttccagcctga

SEQ ID NO: 318511 - DNA, 16 bp, C. familiaris
gacactttcatctttt

SEQ ID NO: 318512 - DNA, 16 bp, C. familiaris
gacagaacttgagaga

SEQ ID NO: 318513 - DNA, 16 bp, C. familiaris
gacagacaccaaacca

SEQ ID NO: 318514 - DNA, 16 bp, C. familiaris
gacagacaggcagaca

SEQ ID NO: 318515 - DNA, 16 bp, C. familiaris
gacagacatatagatc

SEQ ID NO: 318516 - DNA, 16 bp, C. familiaris
gacagagaatcccaag

SEQ ID NO: 318517 - DNA, 16 bp, C. familiaris
gacagagacacagcag

SEQ ID NO: 318518 - DNA, 16 bp, C. familiaris
gacagagacacaggtg

SEQ ID NO: 318519 - DNA, 16 bp, C. familiaris
gacagagagagaagca

SEQ ID NO: 318520 - DNA, 16 bp, C. familiaris
gacagagagagacaga

SEQ ID NO: 318521 - DNA, 16 bp, C. familiaris
gacagagagagagacc

SEQ ID NO: 318522 - DNA, 16 bp, C. familiaris
gacagagagagcacac

SEQ ID NO: 318523 - DNA, 16 bp, C. familiaris
gacagagagagcgcac

SEQ ID NO: 318524 - DNA, 16 bp, C. familiaris
gacagaggatctgaat

SEQ ID NO: 318525 - DNA, 16 bp, C. familiaris
gacagaggcacagaca

SEQ ID NO: 318526 - DNA, 16 bp, C. familiaris
gacagaggtagagaga

SEQ ID NO: 318527 - DNA, 16 bp, C. familiaris
gacagatatattcaga

SEQ ID NO: 318528 - DNA, 16 bp, C. familiaris
gacagatggatgggtg

SEQ ID NO: 318529 - DNA, 16 bp, C. familiaris
gacagatggcagctac

SEQ ID NO: 318530 - DNA, 16 bp, C. familiaris
gacagatgtgaggtga

SEQ ID NO: 318531 - DNA, 16 bp, C. familiaris
gacagcacagtcagcc

SEQ ID NO: 318532 - DNA, 16 bp, C. familiaris
gacagccacccaggca

SEQ ID NO: 318533 - DNA, 16 bp, C. familiaris
gacagccacccaggtg

SEQ ID NO: 318534 - DNA, 16 bp, C. familiaris
gacagccccagtggct

SEQ ID NO: 318535 - DNA, 16 bp, C. familiaris
gacagcctcttcaaca

SEQ ID NO: 318536 - DNA, 16 bp, C. familiaris
gacagcgaggacactc

SEQ ID NO: 318537 - DNA, 16 bp, C. familiaris
gacagggaagctacag

SEQ ID NO: 318538 - DNA, 16 bp, C. familiaris
gacagggcagccctgg

SEQ ID NO: 318539 - DNA, 16 bp, C. familiaris
gacaggtgctcaactg

SEQ ID NO: 318540 - DNA, 16 bp, C. familiaris
gacagtgtggttctgg

SEQ ID NO: 318541 - DNA, 16 bp, C. familiaris
gacagttcttttcttt

SEQ ID NO: 318542 - DNA, 16 bp, C. familiaris
gacagtttcttaaaaa

SEQ ID NO: 318543 - DNA, 16 bp, C. familiaris
gacagttttgctggat

SEQ ID NO: 318544 - DNA, 16 bp, C. familiaris
gacatacaaatggctg

SEQ ID NO: 318545 - DNA, 16 bp, C. familiaris
gacatatctaggaaaa

SEQ ID NO: 318546 - DNA, 16 bp, C. familiaris
gacatccacatgcagg

SEQ ID NO: 318547 - DNA, 16 bp, C. familiaris
gacatccagcctccag

SEQ ID NO: 318548 - DNA, 16 bp, C. familiaris
gacatctaggctcttt

SEQ ID NO: 318549 - DNA, 16 bp, C. familiaris
gacatctcattgtagt

SEQ ID NO: 318550 - DNA, 16 bp, C. familiaris
gacatcttggctgctt

SEQ ID NO: 318551 - DNA, 16 bp, C. familiaris
gacatgaacatctttg

SEQ ID NO: 318552 - DNA, 16 bp, C. familiaris
gacatggatagaacta

SEQ ID NO: 318553 - DNA, 16 bp, C. familiaris
gacatggatatctttg

SEQ ID NO: 318554 - DNA, 16 bp, C. familiaris
gacatgtctcctgagg

SEQ ID NO: 318555 - DNA, 16 bp, C. familiaris
gacattctggagaagg

SEQ ID NO: 318556 - DNA, 16 bp, C. familiaris
gacattgacagaggga

SEQ ID NO: 318557 - DNA, 16 bp, C. familiaris
gacatttcaaataaat

SEQ ID NO: 318558 - DNA, 16 bp, C. familiaris
gacatttctccagaga

SEQ ID NO: 318559 - DNA, 16 bp, C. familiaris
gacatttctccataga

SEQ ID NO: 318560 - DNA, 16 bp, C. familiaris
gacatttgcactgatg

SEQ ID NO: 318561 - DNA, 16 bp, C. familiaris
gacattttatttattt

SEQ ID NO: 318562 - DNA, 16 bp, C. familiaris
gaccaactgaatcaga

SEQ ID NO: 318563 - DNA, 16 bp, C. familiaris
gaccaagagtcacatg

SEQ ID NO: 318564 - DNA, 16 bp, C. familiaris
gaccacaatgaaatta

SEQ ID NO: 318565 - DNA, 16 bp, C. familiaris
gaccaccagggggtgc

SEQ ID NO: 318566 - DNA, 16 bp, C. familiaris
gaccactaaagtgaaa

SEQ ID NO: 318567 - DNA, 16 bp, C. familiaris
gaccagaagtgtcaga

SEQ ID NO: 318568 - DNA, 16 bp, C. familiaris
gaccagatgagcactg

SEQ ID NO: 318569 - DNA, 16 bp, C. familiaris
gaccagcagcagcagc

SEQ ID NO: 318570 - DNA, 16 bp, C. familiaris
gaccaggggcacctgg

SEQ ID NO: 318571 - DNA, 17 bp, C. familiaris
gaccagttccaggggaa

SEQ ID NO: 318572 - DNA, 16 bp, C. familiaris
gaccataaatgtaagg

SEQ ID NO: 318573 - DNA, 16 bp, C. familiaris
gaccatgatcccaggg

SEQ ID NO: 318574 - DNA, 16 bp, C. familiaris
gaccatttcatctttt

SEQ ID NO: 318575 - DNA, 16 bp, C. familiaris
gacccaagcccaaggc

SEQ ID NO: 318576 - DNA, 16 bp, C. familiaris
gacccacgagatcatg

SEQ ID NO: 318577 - DNA, 16 bp, C. familiaris
gacccagacccagacc

SEQ ID NO: 318578 - DNA, 16 bp, C. familiaris
gacccagagaaagaga

SEQ ID NO: 318579 - DNA, 16 bp, C. familiaris
gacccagagaaagagg

SEQ ID NO: 318580 - DNA, 16 bp, C. familiaris
gacccagccaggcacc

SEQ ID NO: 318581 - DNA, 16 bp, C. familiaris
gacccaggagcagctc

SEQ ID NO: 318582 - DNA, 16 bp, C. familiaris
gacccaggagggcgag

SEQ ID NO: 318583 - DNA, 16 bp, C. familiaris
gacccaggatgaagtc

SEQ ID NO: 318584 - DNA, 17 bp, C. familiaris
gacccaggccgagggag

SEQ ID NO: 318585 - DNA, 16 bp, C. familiaris
gacccaggctccagct

SEQ ID NO: 318586 - DNA, 16 bp, C. familiaris
gaccccacccaaaagg

SEQ ID NO: 318587 - DNA, 16 bp, C. familiaris
gaccccagaccccaga

SEQ ID NO: 318588 - DNA, 16 bp, C. familiaris
gaccccagagtcccag

SEQ ID NO: 318589 - DNA, 16 bp, C. familiaris
gaccccaggagggagg

SEQ ID NO: 318590 - DNA, 16 bp, C. familiaris
gaccccaggatgacac

SEQ ID NO: 318591 - DNA, 16 bp, C. familiaris
gaccccaggatgatga

SEQ ID NO: 318592 - DNA, 16 bp, C. familiaris
gaccccaggccccagg

SEQ ID NO: 318593 - DNA, 16 bp, C. familiaris
gaccccagggccccag

SEQ ID NO: 318594 - DNA, 16 bp, C. familiaris
gaccccagggccccgg

SEQ ID NO: 318595 - DNA, 16 bp, C. familiaris
gacccccaggaccctg

SEQ ID NO: 318596 - DNA, 16 bp, C. familiaris
gacccccaggagcctg

SEQ ID NO: 318597 - DNA, 16 bp, C. familiaris
gacccccaggatcacg

SEQ ID NO: 318598 - DNA, 16 bp, C. familiaris
gaccccgagaccaaga

SEQ ID NO: 318599 - DNA, 16 bp, C. familiaris
gaccccggaccccgga

SEQ ID NO: 318600 - DNA, 16 bp, C. familiaris
gacccctactcctctg

SEQ ID NO: 318601 - DNA, 16 bp, C. familiaris
gacccctgggtgactc

SEQ ID NO: 318602 - DNA, 16 bp, C. familiaris
gacccggacccggacc

SEQ ID NO: 318603 - DNA, 16 bp, C. familiaris
gacccggagaagcagg

SEQ ID NO: 318604 - DNA, 16 bp, C. familiaris
gacccgggagcagctc

SEQ ID NO: 318605 - DNA, 16 bp, C. familiaris
gaccctcccccagaag

SEQ ID NO: 318606 - DNA, 16 bp, C. familiaris
gaccctccttctccct

SEQ ID NO: 318607 - DNA, 16 bp, C. familiaris
gaccctgagaccaaga

SEQ ID NO: 318608 - DNA, 16 bp, C. familiaris
gaccctgagatcctga

SEQ ID NO: 318609 - DNA, 16 bp, C. familiaris
gaccctgagatggaga

SEQ ID NO: 318610 - DNA, 16 bp, C. familiaris
gaccctgagcaagtca

SEQ ID NO: 318611 - DNA, 16 bp, C. familiaris
gaccctgctcttctgc

SEQ ID NO: 318612 - DNA, 16 bp, C. familiaris
gaccctggagaccggg

SEQ ID NO: 318613 - DNA, 16 bp, C. familiaris
gaccctggagtcctgg

SEQ ID NO: 318614 - DNA, 16 bp, C. familiaris
gaccctgggaccctgg

SEQ ID NO: 318615 - DNA, 16 bp, C. familiaris
gaccctgggataatga

SEQ ID NO: 318616 - DNA, 16 bp, C. familiaris
gaccctgggatctggg

SEQ ID NO: 318617 - DNA, 16 bp, C. familiaris
gaccctggggtcctga

SEQ ID NO: 318618 - DNA, 16 bp, C. familiaris
gacccttgaacagcat

SEQ ID NO: 318619 - DNA, 16 bp, C. familiaris
gacccttgatttcagc

SEQ ID NO: 318620 - DNA, 16 bp, C. familiaris
gaccgggagcacaggg

SEQ ID NO: 318621 - DNA, 16 bp, C. familiaris
gacctactggatcaga

SEQ ID NO: 318622 - DNA, 16 bp, C. familiaris
gacctcaggaccctga

SEQ ID NO: 318623 - DNA, 16 bp, C. familiaris
gacctcagtttcccca

SEQ ID NO: 318624 - DNA, 16 bp, C. familiaris
gacctctcctttctca

SEQ ID NO: 318625 - DNA, 16 bp, C. familiaris
gacctctgggatcatg

SEQ ID NO: 318626 - DNA, 16 bp, C. familiaris
gacctgaaccaaaagc

SEQ ID NO: 318627 - DNA, 16 bp, C. familiaris
gacctgaacccaaacc

SEQ ID NO: 318628 - DNA, 17 bp, C. familiaris
gacctgaacctaaacca

SEQ ID NO: 318629 - DNA, 16 bp, C. familiaris
gacctgaaggaagtga

SEQ ID NO: 318630 - DNA, 16 bp, C. familiaris
gacctgaatggaaacc

SEQ ID NO: 318631 - DNA, 16 bp, C. familiaris
gacctgagccaagacc

SEQ ID NO: 318632 - DNA, 16 bp, C. familiaris
gacctgagccacaacc

SEQ ID NO: 318633 - DNA, 16 bp, C. familiaris
gacctgagccacaggt

SEQ ID NO: 318634 - DNA, 16 bp, C. familiaris
gacctgagccagaacc

SEQ ID NO: 318635 - DNA, 16 bp, C. familiaris
gacctgagctgcaggc

SEQ ID NO: 318636 - DNA, 16 bp, C. familiaris
gacctgagctgtaacc

SEQ ID NO: 318637 - DNA, 16 bp, C. familiaris
gacctgagtgaaaatc

SEQ ID NO: 318638 - DNA, 16 bp, C. familiaris
gacctgcccaaggcca

SEQ ID NO: 318639 - DNA, 16 bp, C. familiaris
gacctgctccaggaag

SEQ ID NO: 318640 - DNA, 16 bp, C. familiaris
gacctggcagaccaga

SEQ ID NO: 318641 - DNA, 16 bp, C. familiaris
gacctggcaggtcaga

SEQ ID NO: 318642 - DNA, 16 bp, C. familiaris
gaccttccaccagcaa

SEQ ID NO: 318643 - DNA, 16 bp, C. familiaris
gaccttcctccaggaa

SEQ ID NO: 318644 - DNA, 16 bp, C. familiaris
gaccttgagcaagtga

SEQ ID NO: 318645 - DNA, 16 bp, C. familiaris
gaccttttcttttctt

SEQ ID NO: 318646 - DNA, 16 bp, C. familiaris
gacgaggatgtggaga

SEQ ID NO: 318647 - DNA, 16 bp, C. familiaris
gacggacagacagaca

SEQ ID NO: 318648 - DNA, 16 bp, C. familiaris
gacgggcatgaaggag

SEQ ID NO: 318649 - DNA, 16 bp, C. familiaris
gacggggatccctggg

SEQ ID NO: 318650 - DNA, 16 bp, C. familiaris
gactacaccaaaataa

SEQ ID NO: 318651 - DNA, 16 bp, C. familiaris
gactacttaaaaataa

SEQ ID NO: 318652 - DNA, 16 bp, C. familiaris
gactcacaagaagttg

SEQ ID NO: 318653 - DNA, 16 bp, C. familiaris
gactcagattgtgatc

SEQ ID NO: 318654 - DNA, 16 bp, C. familiaris
gactcagccacccaga

SEQ ID NO: 318655 - DNA, 16 bp, C. familiaris
gactcagggtcctggg

SEQ ID NO: 318656 - DNA, 16 bp, C. familiaris
gactcagtctcacaac

SEQ ID NO: 318657 - DNA, 16 bp, C. familiaris
gactccaagatcaaga

SEQ ID NO: 318658 - DNA, 16 bp, C. familiaris
gactccaagatcatga

SEQ ID NO: 318659 - DNA, 16 bp, C. familiaris
gactccacgcccagca

SEQ ID NO: 318660 - DNA, 16 bp, C. familiaris
gactccagagagctcc

SEQ ID NO: 318661 - DNA, 16 bp, C. familiaris
gactccaggactccag

SEQ ID NO: 318662 - DNA, 16 bp, C. familiaris
gactccaggatagtgc

SEQ ID NO: 318663 - DNA, 16 bp, C. familiaris
gactccagggtcctgg

SEQ ID NO: 318664 - DNA, 16 bp, C. familiaris
gactccatccctgatc

SEQ ID NO: 318665 - DNA, 16 bp, C. familiaris
gactccccactgagca

SEQ ID NO: 318666 - DNA, 16 bp, C. familiaris
gactccccgctgggca

SEQ ID NO: 318667 - DNA, 16 bp, C. familiaris
gactcccctaaaactt

SEQ ID NO: 318668 - DNA, 16 bp, C. familiaris
gactccctctggggag

SEQ ID NO: 318669 - DNA, 16 bp, C. familiaris
gactccctgctcagtg

SEQ ID NO: 318670 - DNA, 16 bp, C. familiaris
gactccctggtgagca

SEQ ID NO: 318671 - DNA, 16 bp, C. familiaris
gactcctctctgagca

SEQ ID NO: 318672 - DNA, 16 bp, C. familiaris
gactcctgggtctgag

SEQ ID NO: 318673 - DNA, 16 bp, C. familiaris
gactctaggttttggc

SEQ ID NO: 318674 - DNA, 16 bp, C. familiaris
gactctctccctctcc

SEQ ID NO: 318675 - DNA, 16 bp, C. familiaris
gactctctgaagaaag

SEQ ID NO: 318676 - DNA, 16 bp, C. familiaris
gactctctgctgaatg

SEQ ID NO: 318677 - DNA, 16 bp, C. familiaris
gactctgagaccaaga

SEQ ID NO: 318678 - DNA, 16 bp, C. familiaris
gactctgagctgagca

SEQ ID NO: 318679 - DNA, 16 bp, C. familiaris
gactctgcacagagca

SEQ ID NO: 318680 - DNA, 16 bp, C. familiaris
gactctgcactgggca

SEQ ID NO: 318681 - DNA, 16 bp, C. familiaris
gactctgcttcttcct

SEQ ID NO: 318682 - DNA, 16 bp, C. familiaris
gactctggaaaaaagc

SEQ ID NO: 318683 - DNA, 16 bp, C. familiaris
gactctgggatcaagc

SEQ ID NO: 318684 - DNA, 31 bp, C. familiaris
gactctgtagacaagattgtcattcaaaaat

SEQ ID NO: 318685 - DNA, 16 bp, C. familiaris
gactcttggttccagc

SEQ ID NO: 318686 - DNA, 16 bp, C. familiaris
gactgaaaaagacaaa

SEQ ID NO: 318687 - DNA, 16 bp, C. familiaris
gactgaaagaattaat

SEQ ID NO: 318688 - DNA, 16 bp, C. familiaris
gactgaaagtgaaggg

SEQ ID NO: 318689 - DNA, 16 bp, C. familiaris
gactgaagaaagagga

SEQ ID NO: 318690 - DNA, 16 bp, C. familiaris
gactgagccccaagtc

SEQ ID NO: 318691 - DNA, 16 bp, C. familiaris
gactgagccctacatc

SEQ ID NO: 318692 - DNA, 16 bp, C. familiaris
gactgaggaagaaaaa

SEQ ID NO: 318693 - DNA, 16 bp, C. familiaris
gactgagtcacctagg

SEQ ID NO: 318694 - DNA, 16 bp, C. familiaris
gactgcaggatttaga

SEQ ID NO: 318695 - DNA, 16 bp, C. familiaris
gactggagctgaaacc

SEQ ID NO: 318696 - DNA, 16 bp, C. familiaris
gactggagttttagag

SEQ ID NO: 318697 - DNA, 16 bp, C. familiaris
gactggatcccaggcc

SEQ ID NO: 318698 - DNA, 16 bp, C. familiaris
gactggatcctggacc

SEQ ID NO: 318699 - DNA, 16 bp, C. familiaris
gactggcccaaggtca

SEQ ID NO: 318700 - DNA, 16 bp, C. familiaris
gactgggaggaaatat

SEQ ID NO: 318701 - DNA, 16 bp, C. familiaris
gactgtgacctgagct

SEQ ID NO: 318702 - DNA, 16 bp, C. familiaris
gactgtgagttcaagc

SEQ ID NO: 318703 - DNA, 16 bp, C. familiaris
gactgtgccacccagg

SEQ ID NO: 318704 - DNA, 16 bp, C. familiaris
gactgtgtgtgtatgt

SEQ ID NO: 318705 - DNA, 16 bp, C. familiaris
gactgtttctttgctg

SEQ ID NO: 318706 - DNA, 16 bp, C. familiaris
gacttaaaaaaatatt

SEQ ID NO: 318707 - DNA, 16 bp, C. familiaris
gacttacttcacccag

SEQ ID NO: 318708 - DNA, 16 bp, C. familiaris
gacttcaagctgtact

SEQ ID NO: 318709 - DNA, 16 bp, C. familiaris
gacttcaatatcccac

SEQ ID NO: 318710 - DNA, 16 bp, C. familiaris
gacttcagcccagggc

SEQ ID NO: 318711 - DNA, 16 bp, C. familiaris
gacttctcctttgcca

SEQ ID NO: 318712 - DNA, 16 bp, C. familiaris
gacttctcttcagaaa

SEQ ID NO: 318713 - DNA, 16 bp, C. familiaris
gacttcttgctgagtg

SEQ ID NO: 318714 - DNA, 16 bp, C. familiaris
gacttcttggaggagg

SEQ ID NO: 318715 - DNA, 16 bp, C. familiaris
gacttcttgtcagaaa

SEQ ID NO: 318716 - DNA, 16 bp, C. familiaris
gacttgaccccaggac

SEQ ID NO: 318717 - DNA, 16 bp, C. familiaris
gacttgatcccagtac

SEQ ID NO: 318718 - DNA, 16 bp, C. familiaris
gacttgctggataaag

SEQ ID NO: 318719 - DNA, 16 bp, C. familiaris
gacttgcttgacacag

SEQ ID NO: 318720 - DNA, 16 bp, C. familiaris
gacttggatttttttt

SEQ ID NO: 318721 - DNA, 16 bp, C. familiaris
gacttgggcagcctgg

SEQ ID NO: 318722 - DNA, 16 bp, C. familiaris
gacttggggactctac

SEQ ID NO: 318723 - DNA, 16 bp, C. familiaris
gacttgtatccagaat

SEQ ID NO: 318724 - DNA, 16 bp, C. familiaris
gactttaaaacaaaga

SEQ ID NO: 318725 - DNA, 16 bp, C. familiaris
gactttatgaagaaga

SEQ ID NO: 318726 - DNA, 16 bp, C. familiaris
gactttctttttcctt

SEQ ID NO: 318727 - DNA, 16 bp, C. familiaris
gactttgatgaaagaa

SEQ ID NO: 318728 - DNA, 16 bp, C. familiaris
gactttgcagatgtga

SEQ ID NO: 318729 - DNA, 16 bp, C. familiaris
gactttgcagatgtgg

SEQ ID NO: 318730 - DNA, 16 bp, C. familiaris
gacttttcttcttctt

SEQ ID NO: 318731 - DNA, 16 bp, C. familiaris
gagaaaaacaaatact

SEQ ID NO: 318732 - DNA, 16 bp, C. familiaris
gagaaaaaccatatga

SEQ ID NO: 318733 - DNA, 16 bp, C. familiaris
gagaaaaatcaatgaa

SEQ ID NO: 318734 - DNA, 16 bp, C. familiaris
gagaaaaatgtatatt

SEQ ID NO: 318735 - DNA, 16 bp, C. familiaris
gagaaaactgaaattc

SEQ ID NO: 318736 - DNA, 16 bp, C. familiaris
gagaaaagaatccaaa

SEQ ID NO: 318737 - DNA, 16 bp, C. familiaris
gagaaaagagagatca

SEQ ID NO: 318738 - DNA, 16 bp, C. familiaris
gagaaaagattcaaat

SEQ ID NO: 318739 - DNA, 16 bp, C. familiaris
gagaaaagcaatgaaa

SEQ ID NO: 318740 - DNA, 16 bp, C. familiaris
gagaaaagggaacttt

SEQ ID NO: 318741 - DNA, 16 bp, C. familiaris
gagaaaagggaattct

SEQ ID NO: 318742 - DNA, 16 bp, C. familiaris
gagaaaatatacagaa

SEQ ID NO: 318743 - DNA, 16 bp, C. familiaris
gagaaaatatcagaca

SEQ ID NO: 318744 - DNA, 16 bp, C. familiaris
gagaaaatatttgaaa

SEQ ID NO: 318745 - DNA, 16 bp, C. familiaris
gagaaaatgaagacaa

SEQ ID NO: 318746 - DNA, 16 bp, C. familiaris
gagaaaatggaagcaa

SEQ ID NO: 318747 - DNA, 16 bp, C. familiaris
gagaaacaggcagaga

SEQ ID NO: 318748 - DNA, 16 bp, C. familiaris
gagaaacaggctctct

SEQ ID NO: 318749 - DNA, 16 bp, C. familiaris
gagaaaccaccaagaa

SEQ ID NO: 318750 - DNA, 16 bp, C. familiaris
gagaaactcaagcaga

SEQ ID NO: 318751 - DNA, 16 bp, C. familiaris
gagaaactgaggcagc

SEQ ID NO: 318752 - DNA, 16 bp, C. familiaris
gagaaactgaggctgg

SEQ ID NO: 318753 - DNA, 16 bp, C. familiaris
gagaaactggaacctt

SEQ ID NO: 318754 - DNA, 16 bp, C. familiaris
gagaaactggatcatt

SEQ ID NO: 318755 - DNA, 16 bp, C. familiaris
gagaaacttcagcaga

SEQ ID NO: 318756 - DNA, 16 bp, C. familiaris
gagaaagaaaacatta

SEQ ID NO: 318757 - DNA, 16 bp, C. familiaris
gagaaagaaacccaag

SEQ ID NO: 318758 - DNA, 16 bp, C. familiaris
gagaaagaaatcaaga

SEQ ID NO: 318759 - DNA, 16 bp, C. familiaris
gagaaagaagaaaatc

SEQ ID NO: 318760 - DNA, 16 bp, C. familiaris
gagaaagaatctgaag

SEQ ID NO: 318761 - DNA, 16 bp, C. familiaris
gagaaagagaatctcc

SEQ ID NO: 318762 - DNA, 16 bp, C. familiaris
gagaaagagagaatgc

SEQ ID NO: 318763 - DNA, 16 bp, C. familiaris
gagaaagagagagatt

SEQ ID NO: 318764 - DNA, 16 bp, C. familiaris
gagaaagagcaagagc

SEQ ID NO: 318765 - DNA, 16 bp, C. familiaris
gagaaagagcacaagc

SEQ ID NO: 318766 - DNA, 16 bp, C. familiaris
gagaaagagcatgagc

SEQ ID NO: 318767 - DNA, 16 bp, C. familiaris
gagaaagagcgagagc

SEQ ID NO: 318768 - DNA, 16 bp, C. familiaris
gagaaagatacagaga

SEQ ID NO: 318769 - DNA, 16 bp, C. familiaris
gagaaagcatgtgaca

SEQ ID NO: 318770 - DNA, 16 bp, C. familiaris
gagaaagcatttgaga

SEQ ID NO: 318771 - DNA, 16 bp, C. familiaris
gagaaaggaaaatatt

SEQ ID NO: 318772 - DNA, 16 bp, C. familiaris
gagaaaggagaactct

SEQ ID NO: 318773 - DNA, 16 bp, C. familiaris
gagaaagggaaaccct

SEQ ID NO: 318774 - DNA, 16 bp, C. familiaris
gagaaaggggaacctt

SEQ ID NO: 318775 - DNA, 16 bp, C. familiaris
gagaaaggtgaaccct

SEQ ID NO: 318776 - DNA, 16 bp, C. familiaris
gagaaagtcaagaaaa

SEQ ID NO: 318777 - DNA, 16 bp, C. familiaris
gagaaatagacagcaa

SEQ ID NO: 318778 - DNA, 16 bp, C. familiaris
gagaaatcaagaaaac

SEQ ID NO: 318779 - DNA, 16 bp, C. familiaris
gagaaatgcagagaca

SEQ ID NO: 318780 - DNA, 16 bp, C. familiaris
gagaaatgtctatcca

SEQ ID NO: 318781 - DNA, 16 bp, C. familiaris
gagaaattatatatat

SEQ ID NO: 318782 - DNA, 16 bp, C. familiaris
gagaaattattgcctg

SEQ ID NO: 318783 - DNA, 16 bp, C. familiaris
gagaaatttctagaaa

SEQ ID NO: 318784 - DNA, 16 bp, C. familiaris
gagaacaaaatgatgg

SEQ ID NO: 318785 - DNA, 16 bp, C. familiaris
gagaacaagctggtgg

SEQ ID NO: 318786 - DNA, 16 bp, C. familiaris
gagaacacagggcaac

SEQ ID NO: 318787 - DNA, 16 bp, C. familiaris
gagaacaccaagcagg

SEQ ID NO: 318788 - DNA, 16 bp, C. familiaris
gagaacagagcccaag

SEQ ID NO: 318789 - DNA, 16 bp, C. familiaris
gagaacagcaggcaga

SEQ ID NO: 318790 - DNA, 16 bp, C. familiaris
gagaacagctggaaca

SEQ ID NO: 318791 - DNA, 16 bp, C. familiaris
gagaacatactttgta

SEQ ID NO: 318792 - DNA, 16 bp, C. familiaris
gagaacatgagcaggg

SEQ ID NO: 318793 - DNA, 16 bp, C. familiaris
gagaacatttttcttt

SEQ ID NO: 318794 - DNA, 16 bp, C. familiaris
gagaaccaggagagcc

SEQ ID NO: 318795 - DNA, 16 bp, C. familiaris
gagaacctcaagtaga

SEQ ID NO: 318796 - DNA, 16 bp, C. familiaris
gagaacgagaggcaga

SEQ ID NO: 318797 - DNA, 16 bp, C. familiaris
gagaacttcaagcaga

SEQ ID NO: 318798 - DNA, 16 bp, C. familiaris
gagaagaaaatcaaga

SEQ ID NO: 318799 - DNA, 16 bp, C. familiaris
gagaagaaatatttga

SEQ ID NO: 318800 - DNA, 16 bp, C. familiaris
gagaagaaatcagaga

SEQ ID NO: 318801 - DNA, 16 bp, C. familiaris
gagaagaacacagaca

SEQ ID NO: 318802 - DNA, 16 bp, C. familiaris
gagaagaacatacagc

SEQ ID NO: 318803 - DNA, 16 bp, C. familiaris
gagaagaagcagcaga

SEQ ID NO: 318804 - DNA, 16 bp, C. familiaris
gagaagaagcaggccc

SEQ ID NO: 318805 - DNA, 16 bp, C. familiaris
gagaagaaggctccac

SEQ ID NO: 318806 - DNA, 16 bp, C. familiaris
gagaagagaaaatgtt

SEQ ID NO: 318807 - DNA, 16 bp, C. familiaris
gagaagatattgcaaa

SEQ ID NO: 318808 - DNA, 16 bp, C. familiaris
gagaagatattttcaa

SEQ ID NO: 318809 - DNA, 16 bp, C. familiaris
gagaagatgttcaaca

SEQ ID NO: 318810 - DNA, 16 bp, C. familiaris
gagaagattttgcaaa

SEQ ID NO: 318811 - DNA, 16 bp, C. familiaris
gagaagcaaagacata

SEQ ID NO: 318812 - DNA, 16 bp, C. familiaris
gagaagcaagatccat

SEQ ID NO: 318813 - DNA, 16 bp, C. familiaris
gagaagcacactttgt

SEQ ID NO: 318814 - DNA, 16 bp, C. familiaris
gagaagcagaatccct

SEQ ID NO: 318815 - DNA, 16 bp, C. familiaris
gagaagcagactcctc

SEQ ID NO: 318816 - DNA, 16 bp, C. familiaris
gagaagcagacttctc

SEQ ID NO: 318817 - DNA, 16 bp, C. familiaris
gagaagcagacttctg

SEQ ID NO: 318818 - DNA, 16 bp, C. familiaris
gagaagcagagagaca

SEQ ID NO: 318819 - DNA, 16 bp, C. familiaris
gagaagcagaggcaca

SEQ ID NO: 318820 - DNA, 16 bp, C. familiaris
gagaagcagcagggag

SEQ ID NO: 318821 - DNA, 16 bp, C. familiaris
gagaagcagcctccct

SEQ ID NO: 318822 - DNA, 16 bp, C. familiaris
gagaagcaggagaagc

SEQ ID NO: 318823 - DNA, 17 bp, C. familiaris
gagaagcaggagctgca

SEQ ID NO: 318824 - DNA, 16 bp, C. familiaris
gagaagcaggcagagg

SEQ ID NO: 318825 - DNA, 16 bp, C. familiaris
gagaagcaggccccac

SEQ ID NO: 318826 - DNA, 16 bp, C. familiaris
gagaagcaggcccctg

SEQ ID NO: 318827 - DNA, 16 bp, C. familiaris
gagaagcaggctcttt

SEQ ID NO: 318828 - DNA, 16 bp, C. familiaris
gagaagcaggctgcac

SEQ ID NO: 318829 - DNA, 16 bp, C. familiaris
gagaagcaggcttcac

SEQ ID NO: 318830 - DNA, 16 bp, C. familiaris
gagaagcaggttccat

SEQ ID NO: 318831 - DNA, 16 bp, C. familiaris
gagaagccaagaaaca

SEQ ID NO: 318832 - DNA, 16 bp, C. familiaris
gagaagcctgatgtgg

SEQ ID NO: 318833 - DNA, 16 bp, C. familiaris
gagaagctgactctcc

SEQ ID NO: 318834 - DNA, 16 bp, C. familiaris
gagaagctgagcaggg

SEQ ID NO: 318835 - DNA, 16 bp, C. familiaris
gagaagctggcttccc

SEQ ID NO: 318836 - DNA, 16 bp, C. familiaris
gagaagcttccagaag

SEQ ID NO: 318837 - DNA, 16 bp, C. familiaris
gagaagcttttgttgg

SEQ ID NO: 318838 - DNA, 16 bp, C. familiaris
gagaaggaaacaaacc

SEQ ID NO: 318839 - DNA, 16 bp, C. familiaris
gagaaggaatctcaag

SEQ ID NO: 318840 - DNA, 16 bp, C. familiaris
gagaaggacaaacagt

SEQ ID NO: 318841 - DNA, 21 bp, C. familiaris
gagaaggacaaacattatatg

SEQ ID NO: 318842 - DNA, 16 bp, C. familiaris
gagaaggacagtcatc

SEQ ID NO: 318843 - DNA, 16 bp, C. familiaris
gagaaggagaagctga

SEQ ID NO: 318844 - DNA, 16 bp, C. familiaris
gagaaggaggctcccc

SEQ ID NO: 318845 - DNA, 16 bp, C. familiaris
gagaaggaggctgctg

SEQ ID NO: 318846 - DNA, 16 bp, C. familiaris
gagaaggaggcttcct

SEQ ID NO: 318847 - DNA, 16 bp, C. familiaris
gagaaggcagagacag

SEQ ID NO: 318848 - DNA, 16 bp, C. familiaris
gagaagggcaaacatt

SEQ ID NO: 318849 - DNA, 16 bp, C. familiaris
gagaagtccaaggtca

SEQ ID NO: 318850 - DNA, 16 bp, C. familiaris
gagaagtttttaattt

SEQ ID NO: 318851 - DNA, 16 bp, C. familiaris
gagaatatattttgta

SEQ ID NO: 318852 - DNA, 16 bp, C. familiaris
gagaatcccaagcagc

SEQ ID NO: 318853 - DNA, 16 bp, C. familiaris
gagaatcccaagctga

SEQ ID NO: 318854 - DNA, 16 bp, C. familiaris
gagaatctccagcaaa

SEQ ID NO: 318855 - DNA, 16 bp, C. familiaris
gagaatctgaagcaaa

SEQ ID NO: 318856 - DNA, 16 bp, C. familiaris
gagaatcttaagaaga

SEQ ID NO: 318857 - DNA, 16 bp, C. familiaris
gagaatgagaagcaga

SEQ ID NO: 318858 - DNA, 16 bp, C. familiaris
gagaatgagcaggagg

SEQ ID NO: 318859 - DNA, 16 bp, C. familiaris
gagaatgtggagaaaa

SEQ ID NO: 318860 - DNA, 16 bp, C. familiaris
gagaatgtgtgtgtgt

SEQ ID NO: 318861 - DNA, 16 bp, C. familiaris
gagaattaaatgaatt

SEQ ID NO: 318862 - DNA, 16 bp, C. familiaris
gagaattacagaacaa

SEQ ID NO: 318863 - DNA, 16 bp, C. familiaris
gagaattttgagcaga

SEQ ID NO: 318864 - DNA, 16 bp, C. familiaris
gagaatttttatttct

SEQ ID NO: 318865 - DNA, 16 bp, C. familiaris
gagacaaaagcagatg

SEQ ID NO: 318866 - DNA, 16 bp, C. familiaris
gagacaaagaaggtca

SEQ ID NO: 318867 - DNA, 16 bp, C. familiaris
gagacaaaggcagaca

SEQ ID NO: 318868 - DNA, 16 bp, C. familiaris
gagacaaaggcagatg

SEQ ID NO: 318869 - DNA, 18 bp, C. familiaris
gagacaagagtccatcaa

SEQ ID NO: 318870 - DNA, 16 bp, C. familiaris
gagacacaagaggagg

SEQ ID NO: 318871 - DNA, 16 bp, C. familiaris
gagacacacaggcaga

SEQ ID NO: 318872 - DNA, 16 bp, C. familiaris
gagacacagagaaagg

SEQ ID NO: 318873 - DNA, 16 bp, C. familiaris
gagacacagagccaga

SEQ ID NO: 318874 - DNA, 16 bp, C. familiaris
gagacacagaggcagg

SEQ ID NO: 318875 - DNA, 16 bp, C. familiaris
gagacacagataaaga

SEQ ID NO: 318876 - DNA, 16 bp, C. familiaris
gagacacagcagaagg

SEQ ID NO: 318877 - DNA, 16 bp, C. familiaris
gagacacaggaagaag

SEQ ID NO: 318878 - DNA, 16 bp, C. familiaris
gagacacatgcagagg

SEQ ID NO: 318879 - DNA, 16 bp, C. familiaris
gagacacccaggcatc

SEQ ID NO: 318880 - DNA, 16 bp, C. familiaris
gagacaccgagagagg

SEQ ID NO: 318881 - DNA, 16 bp, C. familiaris
gagacacttcctgaag

SEQ ID NO: 318882 - DNA, 16 bp, C. familiaris
gagacacttttttttt

SEQ ID NO: 318883 - DNA, 16 bp, C. familiaris
gagacagaagctcctg

SEQ ID NO: 318884 - DNA, 16 bp, C. familiaris
gagacagacacagaga

SEQ ID NO: 318885 - DNA, 16 bp, C. familiaris
gagacagacagagaca

SEQ ID NO: 318886 - DNA, 16 bp, C. familiaris
gagacagactgagaga

SEQ ID NO: 318887 - DNA, 16 bp, C. familiaris
gagacagagaaatagg

SEQ ID NO: 318888 - DNA, 16 bp, C. familiaris
gagacagagaagacag

SEQ ID NO: 318889 - DNA, 16 bp, C. familiaris
gagacagagaatgagt

SEQ ID NO: 318890 - DNA, 16 bp, C. familiaris
gagacagagacagcag

SEQ ID NO: 318891 - DNA, 16 bp, C. familiaris
gagacagagagagtgg

SEQ ID NO: 318892 - DNA, 16 bp, C. familiaris
gagacagagagcaagt

SEQ ID NO: 318893 - DNA, 16 bp, C. familiaris
gagacagagcgagagg

SEQ ID NO: 318894 - DNA, 16 bp, C. familiaris
gagacagatggtggtg

SEQ ID NO: 318895 - DNA, 16 bp, C. familiaris
gagacagccaggcacc

SEQ ID NO: 318896 - DNA, 16 bp, C. familiaris
gagacaggcagaggaa

SEQ ID NO: 318897 - DNA, 16 bp, C. familiaris
gagacaggcagaggag

SEQ ID NO: 318898 - DNA, 16 bp, C. familiaris
gagacagggaaactga

SEQ ID NO: 318899 - DNA, 16 bp, C. familiaris
gagacagggacagaga

SEQ ID NO: 318900 - DNA, 16 bp, C. familiaris
gagacatacacagagg

SEQ ID NO: 318901 - DNA, 16 bp, C. familiaris
gagacatggagaaaga

SEQ ID NO: 318902 - DNA, 16 bp, C. familiaris
gagaccaagccccaca

SEQ ID NO: 318903 - DNA, 16 bp, C. familiaris
gagaccaaggcagagg

SEQ ID NO: 318904 - DNA, 16 bp, C. familiaris
gagacccagacagagg

SEQ ID NO: 318905 - DNA, 16 bp, C. familiaris
gagacccaggagaccc

SEQ ID NO: 318906 - DNA, 16 bp, C. familiaris
gagacccaggcagagg

SEQ ID NO: 318907 - DNA, 16 bp, C. familiaris
gagacccagggatcga

SEQ ID NO: 318908 - DNA, 16 bp, C. familiaris
gagaccccaggatcac

SEQ ID NO: 318909 - DNA, 16 bp, C. familiaris
gagaccccggcagagg

SEQ ID NO: 318910 - DNA, 16 bp, C. familiaris
gagacccgggatgggg

SEQ ID NO: 318911 - DNA, 16 bp, C. familiaris
gagacctgaaaccaca

SEQ ID NO: 318912 - DNA, 16 bp, C. familiaris
gagacctgaaatcata

SEQ ID NO: 318913 - DNA, 16 bp, C. familiaris
gagacctgagctgaga

SEQ ID NO: 318914 - DNA, 16 bp, C. familiaris
gagaccttcaacaaag

SEQ ID NO: 318915 - DNA, 16 bp, C. familiaris
gagacgcagagacaga

SEQ ID NO: 318916 - DNA, 16 bp, C. familiaris
gagacgcagagagaca

SEQ ID NO: 318917 - DNA, 16 bp, C. familiaris
gagacgcaggagctgc

SEQ ID NO: 318918 - DNA, 16 bp, C. familiaris
gagacgcaggctcccc

SEQ ID NO: 318919 - DNA, 16 bp, C. familiaris
gagactcctcaagcag

SEQ ID NO: 318920 - DNA, 16 bp, C. familiaris
gagactccttccacag

SEQ ID NO: 318921 - DNA, 16 bp, C. familiaris
gagactcgggatccag

SEQ ID NO: 318922 - DNA, 16 bp, C. familiaris
gagactgaagaaagaa

SEQ ID NO: 318923 - DNA, 16 bp, C. familiaris
gagactgaagaaggag

SEQ ID NO: 318924 - DNA, 16 bp, C. familiaris
gagactgaggtccaga

SEQ ID NO: 318925 - DNA, 16 bp, C. familiaris
gagactggcagaggga

SEQ ID NO: 318926 - DNA, 16 bp, C. familiaris
gagagaaaagtgatca

SEQ ID NO: 318927 - DNA, 16 bp, C. familiaris
gagagaaaatatttgt

SEQ ID NO: 318928 - DNA, 16 bp, C. familiaris
gagagaaacttcagca

SEQ ID NO: 318929 - DNA, 16 bp, C. familiaris
gagagaaagaacctca

SEQ ID NO: 318930 - DNA, 16 bp, C. familiaris
gagagaaagagactga

SEQ ID NO: 318931 - DNA, 16 bp, C. familiaris
gagagaaagagtatgt

SEQ ID NO: 318932 - DNA, 16 bp, C. familiaris
gagagaaaggcacaga

SEQ ID NO: 318933 - DNA, 16 bp, C. familiaris
gagagaaaggcaggca

SEQ ID NO: 318934 - DNA, 16 bp, C. familiaris
gagagaaagtgtgagc

SEQ ID NO: 318935 - DNA, 16 bp, C. familiaris
gagagaaagtgtgtgc

SEQ ID NO: 318936 - DNA, 16 bp, C. familiaris
gagagaaatcttcaag

SEQ ID NO: 318937 - DNA, 16 bp, C. familiaris
gagagaaattaaagat

SEQ ID NO: 318938 - DNA, 16 bp, C. familiaris
gagagaagaagcaggc

SEQ ID NO: 318939 - DNA, 16 bp, C. familiaris
gagagaagagagaatc

SEQ ID NO: 318940 - DNA, 16 bp, C. familiaris
gagagaagagagcatg

SEQ ID NO: 318941 - DNA, 16 bp, C. familiaris
gagagaagcagctccc

SEQ ID NO: 318942 - DNA, 16 bp, C. familiaris
gagagaagcagggaca

SEQ ID NO: 318943 - DNA, 16 bp, C. familiaris
gagagaagcaggtccc

SEQ ID NO: 318944 - DNA, 16 bp, C. familiaris
gagagaagcaggttcc

SEQ ID NO: 318945 - DNA, 16 bp, C. familiaris
gagagaagtcaatgcc

SEQ ID NO: 318946 - DNA, 16 bp, C. familiaris
gagagaagtggatgga

SEQ ID NO: 318947 - DNA, 16 bp, C. familiaris
gagagaatcctcagca

SEQ ID NO: 318948 - DNA, 16 bp, C. familiaris
gagagaatcttaaaca

SEQ ID NO: 318949 - DNA, 16 bp, C. familiaris
gagagaatgaatgaga

SEQ ID NO: 318950 - DNA, 16 bp, C. familiaris
gagagaatgagtgagg

SEQ ID NO: 318951 - DNA, 16 bp, C. familiaris
gagagacacagagaga

SEQ ID NO: 318952 - DNA, 16 bp, C. familiaris
gagagacagacagaca

SEQ ID NO: 318953 - DNA, 16 bp, C. familiaris
gagagacagagacgga

SEQ ID NO: 318954 - DNA, 16 bp, C. familiaris
gagagacagagcacag

SEQ ID NO: 318955 - DNA, 16 bp, C. familiaris
gagagaccacatggag

SEQ ID NO: 318956 - DNA, 16 bp, C. familiaris
gagagaccagagagag

SEQ ID NO: 318957 - DNA, 16 bp, C. familiaris
gagagacccacacaga

SEQ ID NO: 318958 - DNA, 16 bp, C. familiaris
gagagacccagagaaa

SEQ ID NO: 318959 - DNA, 16 bp, C. familiaris
gagagacgcaaagaga

SEQ ID NO: 318960 - DNA, 16 bp, C. familiaris
gagagacgtagagaca

SEQ ID NO: 318961 - DNA, 16 bp, C. familiaris
gagagactcccaagca

SEQ ID NO: 318962 - DNA, 16 bp, C. familiaris
gagagactgaaagaga

SEQ ID NO: 318963 - DNA, 16 bp, C. familiaris
gagagactggcagagg

SEQ ID NO: 318964 - DNA, 16 bp, C. familiaris
gagagagaaacaaaat

SEQ ID NO: 318965 - DNA, 16 bp, C. familiaris
gagagagaaacagcac

SEQ ID NO: 318966 - DNA, 16 bp, C. familiaris
gagagagaaatacatt

SEQ ID NO: 318967 - DNA, 16 bp, C. familiaris
gagagagaaattgaga

SEQ ID NO: 318968 - DNA, 16 bp, C. familiaris
gagagagaacacaagc

SEQ ID NO: 318969 - DNA, 16 bp, C. familiaris
gagagagaacatgcag

SEQ ID NO: 318970 - DNA, 16 bp, C. familiaris
gagagagaactagaga

SEQ ID NO: 318971 - DNA, 16 bp, C. familiaris
gagagagaagcacaag

SEQ ID NO: 318972 - DNA, 16 bp, C. familiaris
gagagagaatccaagc

SEQ ID NO: 318973 - DNA, 16 bp, C. familiaris
gagagagaatgagctg

SEQ ID NO: 318974 - DNA, 16 bp, C. familiaris
gagagagacaaaccag

SEQ ID NO: 318975 - DNA, 16 bp, C. familiaris
gagagagacaacacaa

SEQ ID NO: 318976 - DNA, 16 bp, C. familiaris
gagagagacaagagac

SEQ ID NO: 318977 - DNA, 16 bp, C. familiaris
gagagagacccagaga

SEQ ID NO: 318978 - DNA, 16 bp, C. familiaris
gagagagactctgaag

SEQ ID NO: 318979 - DNA, 16 bp, C. familiaris
gagagagagaaactgg

SEQ ID NO: 318980 - DNA, 16 bp, C. familiaris
gagagagagaaagcca

SEQ ID NO: 318981 - DNA, 16 bp, C. familiaris
gagagagagaaagcgc

SEQ ID NO: 318982 - DNA, 16 bp, C. familiaris
gagagagagaaatcaa

SEQ ID NO: 318983 - DNA, 16 bp, C. familiaris
gagagagagaacgagc

SEQ ID NO: 318984 - DNA, 16 bp, C. familiaris
gagagagagaacgtga

SEQ ID NO: 318985 - DNA, 16 bp, C. familiaris
gagagagagaagagtt

SEQ ID NO: 318986 - DNA, 16 bp, C. familiaris
gagagagagaagcagc

SEQ ID NO: 318987 - DNA, 16 bp, C. familiaris
gagagagagaagctga

SEQ ID NO: 318988 - DNA, 16 bp, C. familiaris
gagagagagaatcaga

SEQ ID NO: 318989 - DNA, 16 bp, C. familiaris
gagagagagaattgta

SEQ ID NO: 318990 - DNA, 16 bp, C. familiaris
gagagagagaattttg

SEQ ID NO: 318991 - DNA, 16 bp, C. familiaris
gagagagagacccaga

SEQ ID NO: 318992 - DNA, 16 bp, C. familiaris
gagagagagactgaga

SEQ ID NO: 318993 - DNA, 16 bp, C. familiaris
gagagagagagatcgg

SEQ ID NO: 318994 - DNA, 16 bp, C. familiaris
gagagagagagattaa

SEQ ID NO: 318995 - DNA, 16 bp, C. familiaris
gagagagagaggccga

SEQ ID NO: 318996 - DNA, 16 bp, C. familiaris
gagagagagagtctca

SEQ ID NO: 318997 - DNA, 16 bp, C. familiaris
gagagagagagtggat

SEQ ID NO: 318998 - DNA, 16 bp, C. familiaris
gagagagagatccaga

SEQ ID NO: 318999 - DNA, 16 bp, C. familiaris
gagagagagattggaa

SEQ ID NO: 319000 - DNA, 16 bp, C. familiaris
gagagagagcctgagc

SEQ ID NO: 319001 - DNA, 16 bp, C. familiaris
gagagagagcgagcag

SEQ ID NO: 319002 - DNA, 16 bp, C. familiaris
gagagagagcgccaga

SEQ ID NO: 319003 - DNA, 16 bp, C. familiaris
gagagagagctgggag

SEQ ID NO: 319004 - DNA, 16 bp, C. familiaris
gagagagaggacacaa

SEQ ID NO: 319005 - DNA, 16 bp, C. familiaris
gagagagaggaccaga

SEQ ID NO: 319006 - DNA, 16 bp, C. familiaris
gagagagaggatgagt

SEQ ID NO: 319007 - DNA, 16 bp, C. familiaris
gagagagaggcaggat

SEQ ID NO: 319008 - DNA, 16 bp, C. familiaris
gagagagagtcaggga

SEQ ID NO: 319009 - DNA, 16 bp, C. familiaris
gagagagagtgcgcat

SEQ ID NO: 319010 - DNA, 16 bp, C. familiaris
gagagagatgcagagg

SEQ ID NO: 319011 - DNA, 16 bp, C. familiaris
gagagagattgagaaa

SEQ ID NO: 319012 - DNA, 16 bp, C. familiaris
gagagagcaagagcaa

SEQ ID NO: 319013 - DNA, 16 bp, C. familiaris
gagagagcacaagtgg

SEQ ID NO: 319014 - DNA, 16 bp, C. familiaris
gagagagcacacaggg

SEQ ID NO: 319015 - DNA, 16 bp, C. familiaris
gagagagcacagacag

SEQ ID NO: 319016 - DNA, 16 bp, C. familiaris
gagagagcaggggtgg

SEQ ID NO: 319017 - DNA, 16 bp, C. familiaris
gagagagcatggaggg

SEQ ID NO: 319018 - DNA, 16 bp, C. familiaris
gagagagcatgggcag

SEQ ID NO: 319019 - DNA, 16 bp, C. familiaris
gagagaggatctgaag

SEQ ID NO: 319020 - DNA, 16 bp, C. familiaris
gagagaggcaagacat

SEQ ID NO: 319021 - DNA, 16 bp, C. familiaris
gagagagtgagagtgc

SEQ ID NO: 319022 - DNA, 16 bp, C. familiaris
gagagagtgagtgcat

SEQ ID NO: 319023 - DNA, 16 bp, C. familiaris
gagagagtgcaagtga

SEQ ID NO: 319024 - DNA, 16 bp, C. familiaris
gagagagtgcgagaga

SEQ ID NO: 319025 - DNA, 16 bp, C. familiaris
gagagagtgcgcacaa

SEQ ID NO: 319026 - DNA, 16 bp, C. familiaris
gagagataaggagttt

SEQ ID NO: 319027 - DNA, 16 bp, C. familiaris
gagagatctgctgcta

SEQ ID NO: 319028 - DNA, 16 bp, C. familiaris
gagagatgcagaaaga

SEQ ID NO: 319029 - DNA, 16 bp, C. familiaris
gagagatggagaagca

SEQ ID NO: 319030 - DNA, 16 bp, C. familiaris
gagagatgggcagaga

SEQ ID NO: 319031 - DNA, 16 bp, C. familiaris
gagagatttctttttt

SEQ ID NO: 319032 - DNA, 16 bp, C. familiaris
gagagcaagaagcaga

SEQ ID NO: 319033 - DNA, 16 bp, C. familiaris
gagagcaagaatctca

SEQ ID NO: 319034 - DNA, 16 bp, C. familiaris
gagagcaagagtcaca

SEQ ID NO: 319035 - DNA, 16 bp, C. familiaris
gagagcaagcaagcag

SEQ ID NO: 319036 - DNA, 16 bp, C. familiaris
gagagcaagcacaagt

SEQ ID NO: 319037 - DNA, 16 bp, C. familiaris
gagagcaagcaggagc

SEQ ID NO: 319038 - DNA, 16 bp, C. familiaris
gagagcacaaagggag

SEQ ID NO: 319039 - DNA, 16 bp, C. familiaris
gagagcacagaggaag

SEQ ID NO: 319040 - DNA, 16 bp, C. familiaris
gagagcacagaggagg

SEQ ID NO: 319041 - DNA, 16 bp, C. familiaris
gagagcacagaggcag

SEQ ID NO: 319042 - DNA, 16 bp, C. familiaris
gagagcacgagccagg

SEQ ID NO: 319043 - DNA, 16 bp, C. familiaris
gagagcagcctgggtg

SEQ ID NO: 319044 - DNA, 16 bp, C. familiaris
gagagcagtggggagg

SEQ ID NO: 319045 - DNA, 16 bp, C. familiaris
gagagcatgagccagg

SEQ ID NO: 319046 - DNA, 16 bp, C. familiaris
gagagcatgagtgagt

SEQ ID NO: 319047 - DNA, 16 bp, C. familiaris
gagagccagagccaga

SEQ ID NO: 319048 - DNA, 16 bp, C. familiaris
gagagcccagtgcagg

SEQ ID NO: 319049 - DNA, 16 bp, C. familiaris
gagagcctgggtggct

SEQ ID NO: 319050 - DNA, 16 bp, C. familiaris
gagagcgagagagagc

SEQ ID NO: 319051 - DNA, 16 bp, C. familiaris
gagagcgagagaggca

SEQ ID NO: 319052 - DNA, 16 bp, C. familiaris
gagagcgagagcatgc

SEQ ID NO: 319053 - DNA, 16 bp, C. familiaris
gagagcgagagcgaga

SEQ ID NO: 319054 - DNA, 19 bp, C. familiaris
gagagctccggagttcctg

SEQ ID NO: 319055 - DNA, 16 bp, C. familiaris
gagagcttcctggagg

SEQ ID NO: 319056 - DNA, 16 bp, C. familiaris
gagaggaacagagggc

SEQ ID NO: 319057 - DNA, 16 bp, C. familiaris
gagaggaagaagctga

SEQ ID NO: 319058 - DNA, 16 bp, C. familiaris
gagaggagagccagag

SEQ ID NO: 319059 - DNA, 16 bp, C. familiaris
gagaggagcaggctcc

SEQ ID NO: 319060 - DNA, 16 bp, C. familiaris
gagaggcacaagcaga

SEQ ID NO: 319061 - DNA, 16 bp, C. familiaris
gagaggcacagagata

SEQ ID NO: 319062 - DNA, 16 bp, C. familiaris
gagaggcagagattta

SEQ ID NO: 319063 - DNA, 16 bp, C. familiaris
gagaggcagagccagg

SEQ ID NO: 319064 - DNA, 16 bp, C. familiaris
gagaggcagaggcaga

SEQ ID NO: 319065 - DNA, 16 bp, C. familiaris
gagaggcagatggaga

SEQ ID NO: 319066 - DNA, 16 bp, C. familiaris
gagaggcagggtcccc

SEQ ID NO: 319067 - DNA, 16 bp, C. familiaris
gagaggcgcagagaga

SEQ ID NO: 319068 - DNA, 16 bp, C. familiaris
gagaggctcagtggtt

SEQ ID NO: 319069 - DNA, 16 bp, C. familiaris
gagaggctgagacaga

SEQ ID NO: 319070 - DNA, 16 bp, C. familiaris
gagagggaagcaggct

SEQ ID NO: 319071 - DNA, 16 bp, C. familiaris
gagagggaccagcaga

SEQ ID NO: 319072 - DNA, 16 bp, C. familiaris
gagagggacgcctggg

SEQ ID NO: 319073 - DNA, 16 bp, C. familiaris
gagagggagaagctga

SEQ ID NO: 319074 - DNA, 16 bp, C. familiaris
gagagggagagcatgc

SEQ ID NO: 319075 - DNA, 16 bp, C. familiaris
gagagggagagtttga

SEQ ID NO: 319076 - DNA, 16 bp, C. familiaris
gagagggagcatgagc

SEQ ID NO: 319077 - DNA, 16 bp, C. familiaris
gagagggcagcctggg

SEQ ID NO: 319078 - DNA, 16 bp, C. familiaris
gagaggtagaggcata

SEQ ID NO: 319079 - DNA, 16 bp, C. familiaris
gagagtaagagagcat

SEQ ID NO: 319080 - DNA, 16 bp, C. familiaris
gagagtacaagcagga

SEQ ID NO: 319081 - DNA, 16 bp, C. familiaris
gagagtcacagagaca

SEQ ID NO: 319082 - DNA, 16 bp, C. familiaris
gagagtgagagcaggg

SEQ ID NO: 319083 - DNA, 16 bp, C. familiaris
gagagtgagcatgtgc

SEQ ID NO: 319084 - DNA, 33 bp, C. familiaris
gagagtgcgccgagctccctaagggctgcagcg

SEQ ID NO: 319085 - DNA, 16 bp, C. familiaris
gagagtgtgagtgagc

SEQ ID NO: 319086 - DNA, 16 bp, C. familiaris
gagagtgtgtgcatgc

SEQ ID NO: 319087 - DNA, 16 bp, C. familiaris
gagagttggaagaaat

SEQ ID NO: 319088 - DNA, 16 bp, C. familiaris
gagagtttgcttctcc

SEQ ID NO: 319089 - DNA, 16 bp, C. familiaris
gagataaagaaggaca

SEQ ID NO: 319090 - DNA, 16 bp, C. familiaris
gagataataaatggat

SEQ ID NO: 319091 - DNA, 16 bp, C. familiaris
gagataatgcatgtga

SEQ ID NO: 319092 - DNA, 16 bp, C. familiaris
gagatacagagaaaga

SEQ ID NO: 319093 - DNA, 16 bp, C. familiaris
gagataccacctcaaa

SEQ ID NO: 319094 - DNA, 16 bp, C. familiaris
gagataccattttaca

SEQ ID NO: 319095 - DNA, 16 bp, C. familiaris
gagatagaagcagact

SEQ ID NO: 319096 - DNA, 16 bp, C. familiaris
gagatagagaggcaaa

SEQ ID NO: 319097 - DNA, 16 bp, C. familiaris
gagatagagcaagaga

SEQ ID NO: 319098 - DNA, 16 bp, C. familiaris
gagatcaagaatctca

SEQ ID NO: 319099 - DNA, 16 bp, C. familiaris
gagatcaagaatggca

SEQ ID NO: 319100 - DNA, 16 bp, C. familiaris
gagatcaagagtttca

SEQ ID NO: 319101 - DNA, 16 bp, C. familiaris
gagatcaagcaccaca

SEQ ID NO: 319102 - DNA, 16 bp, C. familiaris
gagatcaagccctacg

SEQ ID NO: 319103 - DNA, 16 bp, C. familiaris
gagatcaccaccaaca

SEQ ID NO: 319104 - DNA, 16 bp, C. familiaris
gagatcaggaacaaga

SEQ ID NO: 319105 - DNA, 16 bp, C. familiaris
gagatcaggccctgca

SEQ ID NO: 319106 - DNA, 16 bp, C. familiaris
gagatcatgaccgaag

SEQ ID NO: 319107 - DNA, 16 bp, C. familiaris
gagatccagagagaaa

SEQ ID NO: 319108 - DNA, 16 bp, C. familiaris
gagatccaggatggag

SEQ ID NO: 319109 - DNA, 16 bp, C. familiaris
gagatccttaattaca

SEQ ID NO: 319110 - DNA, 16 bp, C. familiaris
gagatctgaaggatga

SEQ ID NO: 319111 - DNA, 16 bp, C. familiaris
gagatgaagaagggca

SEQ ID NO: 319112 - DNA, 16 bp, C. familiaris
gagatgaggaaaatga

SEQ ID NO: 319113 - DNA, 16 bp, C. familiaris
gagatgataaatttct

SEQ ID NO: 319114 - DNA, 16 bp, C. familiaris
gagatgcagaaggaga

SEQ ID NO: 319115 - DNA, 16 bp, C. familiaris
gagatggaaaactatt

SEQ ID NO: 319116 - DNA, 16 bp, C. familiaris
gagatggaaaatataa

SEQ ID NO: 319117 - DNA, 16 bp, C. familiaris
gagatggaaaatattc

SEQ ID NO: 319118 - DNA, 16 bp, C. familiaris
gagatggagaaactga

SEQ ID NO: 319119 - DNA, 16 bp, C. familiaris
gagatggagagaatct

SEQ ID NO: 319120 - DNA, 16 bp, C. familiaris
gagatggagatggaga

SEQ ID NO: 319121 - DNA, 16 bp, C. familiaris
gagatggagcccagag

SEQ ID NO: 319122 - DNA, 16 bp, C. familiaris
gagatgggacacctgg

SEQ ID NO: 319123 - DNA, 16 bp, C. familiaris
gagatgggatgcctgg

SEQ ID NO: 319124 - DNA, 16 bp, C. familiaris
gagatgggcagagaga

SEQ ID NO: 319125 - DNA, 16 bp, C. familiaris
gagattatattctctt

SEQ ID NO: 319126 - DNA, 16 bp, C. familiaris
gagattcagagagaga

SEQ ID NO: 319127 - DNA, 16 bp, C. familiaris
gagattgggacctgag

SEQ ID NO: 319128 - DNA, 16 bp, C. familiaris
gagattgtcccctgca

SEQ ID NO: 319129 - DNA, 16 bp, C. familiaris
gagatttaaagagaaa

SEQ ID NO: 319130 - DNA, 16 bp, C. familiaris
gagatttttctttatt

SEQ ID NO: 319131 - DNA, 16 bp, C. familiaris
gagatttttgatgact

SEQ ID NO: 319132 - DNA, 16 bp, C. familiaris
gagcaaaagatctgaa

SEQ ID NO: 319133 - DNA, 16 bp, C. familiaris
gagcaaaagcagaggg

SEQ ID NO: 319134 - DNA, 16 bp, C. familiaris
gagcaaaagcagggag

SEQ ID NO: 319135 - DNA, 16 bp, C. familiaris
gagcaaatgaatgaat

SEQ ID NO: 319136 - DNA, 16 bp, C. familiaris
gagcaacagagggaga

SEQ ID NO: 319137 - DNA, 16 bp, C. familiaris
gagcaacaggcagagg

SEQ ID NO: 319138 - DNA, 16 bp, C. familiaris
gagcaagagaaagagc

SEQ ID NO: 319139 - DNA, 16 bp, C. familiaris
gagcaagagagaaagc

SEQ ID NO: 319140 - DNA, 16 bp, C. familiaris
gagcaagagcgagagc

SEQ ID NO: 319141 - DNA, 16 bp, C. familiaris
gagcaagaggggcaga

SEQ ID NO: 319142 - DNA, 16 bp, C. familiaris
gagcaaggagctcaac

SEQ ID NO: 319143 - DNA, 16 bp, C. familiaris
gagcaaggcagagaca

SEQ ID NO: 319144 - DNA, 16 bp, C. familiaris
gagcaagtgagagaaa

SEQ ID NO: 319145 - DNA, 16 bp, C. familiaris
gagcacaagtggggca

SEQ ID NO: 319146 - DNA, 16 bp, C. familiaris
gagcacagagccctgt

SEQ ID NO: 319147 - DNA, 16 bp, C. familiaris
gagcaccgagtaatgt

SEQ ID NO: 319148 - DNA, 16 bp, C. familiaris
gagcacctgcccctgg

SEQ ID NO: 319149 - DNA, 16 bp, C. familiaris
gagcacctgcgtggct

SEQ ID NO: 319150 - DNA, 16 bp, C. familiaris
gagcacgagctggggg

SEQ ID NO: 319151 - DNA, 16 bp, C. familiaris
gagcagaaagagctgc

SEQ ID NO: 319152 - DNA, 16 bp, C. familiaris
gagcagaaatccagag

SEQ ID NO: 319153 - DNA, 16 bp, C. familiaris
gagcagaagaactgtg

SEQ ID NO: 319154 - DNA, 16 bp, C. familiaris
gagcagaaggcaagct

SEQ ID NO: 319155 - DNA, 16 bp, C. familiaris
gagcagaaggcagaag

SEQ ID NO: 319156 - DNA, 16 bp, C. familiaris
gagcagaagtcagatg

SEQ ID NO: 319157 - DNA, 16 bp, C. familiaris
gagcagagagacagag

SEQ ID NO: 319158 - DNA, 16 bp, C. familiaris
gagcagagagaggcag

SEQ ID NO: 319159 - DNA, 16 bp, C. familiaris
gagcagagagcccgac

SEQ ID NO: 319160 - DNA, 16 bp, C. familiaris
gagcagagagctcaat

SEQ ID NO: 319161 - DNA, 16 bp, C. familiaris
gagcagaggacccagc

SEQ ID NO: 319162 - DNA, 16 bp, C. familiaris
gagcagagggagaagt

SEQ ID NO: 319163 - DNA, 16 bp, C. familiaris
gagcagagtgaggagg

SEQ ID NO: 319164 - DNA, 16 bp, C. familiaris
gagcagagtggggagg

SEQ ID NO: 319165 - DNA, 16 bp, C. familiaris
gagcagatcagcgccc

SEQ ID NO: 319166 - DNA, 16 bp, C. familiaris
gagcagatggagaggg

SEQ ID NO: 319167 - DNA, 16 bp, C. familiaris
gagcagcagacagagg

SEQ ID NO: 319168 - DNA, 16 bp, C. familiaris
gagcagcagaggcaga

SEQ ID NO: 319169 - DNA, 16 bp, C. familiaris
gagcagcagagggaaa

SEQ ID NO: 319170 - DNA, 16 bp, C. familiaris
gagcagcaggaagagg

SEQ ID NO: 319171 - DNA, 16 bp, C. familiaris
gagcagcaggcagcag

SEQ ID NO: 319172 - DNA, 16 bp, C. familiaris
gagcagcaggtggagg

SEQ ID NO: 319173 - DNA, 16 bp, C. familiaris
gagcagctcaggcagc

SEQ ID NO: 319174 - DNA, 16 bp, C. familiaris
gagcagctccgagggg

SEQ ID NO: 319175 - DNA, 16 bp, C. familiaris
gagcagctccgggggg

SEQ ID NO: 319176 - DNA, 16 bp, C. familiaris
gagcagctggcagagg

SEQ ID NO: 319177 - DNA, 16 bp, C. familiaris
gagcagctgggagggg

SEQ ID NO: 319178 - DNA, 16 bp, C. familiaris
gagcaggaagccccat

SEQ ID NO: 319179 - DNA, 16 bp, C. familiaris
gagcaggaagctggat

SEQ ID NO: 319180 - DNA, 16 bp, C. familiaris
gagcaggacccaggag

SEQ ID NO: 319181 - DNA, 16 bp, C. familiaris
gagcaggagaagcaga

SEQ ID NO: 319182 - DNA, 16 bp, C. familiaris
gagcaggagcagaggc

SEQ ID NO: 319183 - DNA, 16 bp, C. familiaris
gagcaggagcagcagc

SEQ ID NO: 319184 - DNA, 16 bp, C. familiaris
gagcaggagcagggca

SEQ ID NO: 319185 - DNA, 16 bp, C. familiaris
gagcaggagcctgatg

SEQ ID NO: 319186 - DNA, 16 bp, C. familiaris
gagcaggatgtggggc

SEQ ID NO: 319187 - DNA, 17 bp, C. familiaris
gagcagggacttggacc

SEQ ID NO: 319188 - DNA, 16 bp, C. familiaris
gagcagggagggagcc

SEQ ID NO: 319189 - DNA, 16 bp, C. familiaris
gagcagggatcccagg

SEQ ID NO: 319190 - DNA, 16 bp, C. familiaris
gagcagggatgcctgg

SEQ ID NO: 319191 - DNA, 16 bp, C. familiaris
gagcagggcagccccg

SEQ ID NO: 319192 - DNA, 16 bp, C. familiaris
gagcaggggcaggagc

SEQ ID NO: 319193 - DNA, 16 bp, C. familiaris
gagcagggtgaggggc

SEQ ID NO: 319194 - DNA, 16 bp, C. familiaris
gagcaggtggccgtgg

SEQ ID NO: 319195 - DNA, 16 bp, C. familiaris
gagcaggtggggagga

SEQ ID NO: 319196 - DNA, 16 bp, C. familiaris
gagcagtggggagagg

SEQ ID NO: 319197 - DNA, 16 bp, C. familiaris
gagcatctgcccttgg

SEQ ID NO: 319198 - DNA, 16 bp, C. familiaris
gagcatgaagcctgct

SEQ ID NO: 319199 - DNA, 16 bp, C. familiaris
gagcatgagcacaagc

SEQ ID NO: 319200 - DNA, 16 bp, C. familiaris
gagcatgagcaggaga

SEQ ID NO: 319201 - DNA, 16 bp, C. familiaris
gagcatgagctgggag

SEQ ID NO: 319202 - DNA, 16 bp, C. familiaris
gagcatgaggaggggg

SEQ ID NO: 319203 - DNA, 16 bp, C. familiaris
gagcatgattccagca

SEQ ID NO: 319204 - DNA, 16 bp, C. familiaris
gagcatgcgacttttg

SEQ ID NO: 319205 - DNA, 16 bp, C. familiaris
gagcatggaatctgct

SEQ ID NO: 319206 - DNA, 16 bp, C. familiaris
gagcatggccctgctg

SEQ ID NO: 319207 - DNA, 16 bp, C. familiaris
gagcatgtggagaaag

SEQ ID NO: 319208 - DNA, 16 bp, C. familiaris
gagccaaaaacagatg

SEQ ID NO: 319209 - DNA, 16 bp, C. familiaris
gagccaaaacccaaga

SEQ ID NO: 319210 - DNA, 16 bp, C. familiaris
gagccaaaaggagatg

SEQ ID NO: 319211 - DNA, 16 bp, C. familiaris
gagccaaaatcagatg

SEQ ID NO: 319212 - DNA, 16 bp, C. familiaris
gagccaaaatccagag

SEQ ID NO: 319213 - DNA, 16 bp, C. familiaris
gagccaaaggcaagac

SEQ ID NO: 319214 - DNA, 16 bp, C. familiaris
gagccaaaggcagcca

SEQ ID NO: 319215 - DNA, 16 bp, C. familiaris
gagccaaaggtggatg

SEQ ID NO: 319216 - DNA, 16 bp, C. familiaris
gagccaaggagagagg

SEQ ID NO: 319217 - DNA, 16 bp, C. familiaris
gagccaagggcaggtg

SEQ ID NO: 319218 - DNA, 16 bp, C. familiaris
gagccacaagatggaa

SEQ ID NO: 319219 - DNA, 16 bp, C. familiaris
gagccaccacctgagc

SEQ ID NO: 319220 - DNA, 16 bp, C. familiaris
gagccacccagatgcc

SEQ ID NO: 319221 - DNA, 16 bp, C. familiaris
gagccacccaggcctc

SEQ ID NO: 319222 - DNA, 17 bp, C. familiaris
gagccacccagggatcc

SEQ ID NO: 319223 - DNA, 16 bp, C. familiaris
gagccacccagtgctc

SEQ ID NO: 319224 - DNA, 16 bp, C. familiaris
gagccaccccagtgcc

SEQ ID NO: 319225 - DNA, 16 bp, C. familiaris
gagccacccggggctg

SEQ ID NO: 319226 - DNA, 16 bp, C. familiaris
gagccacctaggagcc

SEQ ID NO: 319227 - DNA, 16 bp, C. familiaris
gagccactctggtgcc

SEQ ID NO: 319228 - DNA, 16 bp, C. familiaris
gagccagacatggggc

SEQ ID NO: 319229 - DNA, 16 bp, C. familiaris
gagccagacccagggc

SEQ ID NO: 319230 - DNA, 16 bp, C. familiaris
gagccagactcggggc

SEQ ID NO: 319231 - DNA, 16 bp, C. familiaris
gagccagagacagatg

SEQ ID NO: 319232 - DNA, 16 bp, C. familiaris
gagccagaggcagacc

SEQ ID NO: 319233 - DNA, 16 bp, C. familiaris
gagccagaggcagggc

SEQ ID NO: 319234 - DNA, 16 bp, C. familiaris
gagccagaggcaggtg

SEQ ID NO: 319235 - DNA, 16 bp, C. familiaris
gagccagagggagatg

SEQ ID NO: 319236 - DNA, 16 bp, C. familiaris
gagccagatgcagagc

SEQ ID NO: 319237 - DNA, 16 bp, C. familiaris
gagccagatgtgagac

SEQ ID NO: 319238 - DNA, 16 bp, C. familiaris
gagccagatgtggggt

SEQ ID NO: 319239 - DNA, 16 bp, C. familiaris
gagccagcaggaggtg

SEQ ID NO: 319240 - DNA, 16 bp, C. familiaris
gagccagccagatgtc

SEQ ID NO: 319241 - DNA, 16 bp, C. familiaris
gagccagccagctgcc

SEQ ID NO: 319242 - DNA, 16 bp, C. familiaris
gagccagccaggggtc

SEQ ID NO: 319243 - DNA, 16 bp, C. familiaris
gagccagcggggctgc

SEQ ID NO: 319244 - DNA, 16 bp, C. familiaris
gagccagctgggctgc

SEQ ID NO: 319245 - DNA, 16 bp, C. familiaris
gagccaggagcctggg

SEQ ID NO: 319246 - DNA, 16 bp, C. familiaris
gagccaggctgcctgg

SEQ ID NO: 319247 - DNA, 16 bp, C. familiaris
gagccaggggcagatg

SEQ ID NO: 319248 - DNA, 16 bp, C. familiaris
gagccaggggcctggg

SEQ ID NO: 319249 - DNA, 16 bp, C. familiaris
gagccatccaagagcc

SEQ ID NO: 319250 - DNA, 16 bp, C. familiaris
gagccatgcaggtgct

SEQ ID NO: 319251 - DNA, 16 bp, C. familiaris
gagcccaagatcaaga

SEQ ID NO: 319252 - DNA, 16 bp, C. familiaris
gagcccaagatcatga

SEQ ID NO: 319253 - DNA, 16 bp, C. familiaris
gagcccaagcaggagg

SEQ ID NO: 319254 - DNA, 16 bp, C. familiaris
gagcccaaggaagatg

SEQ ID NO: 319255 - DNA, 16 bp, C. familiaris
gagcccaaggcagagc

SEQ ID NO: 319256 - DNA, 16 bp, C. familiaris
gagcccaaggcagcca

SEQ ID NO: 319257 - DNA, 16 bp, C. familiaris
gagcccaaggtgaggc

SEQ ID NO: 319258 - DNA, 16 bp, C. familiaris
gagcccaatgtgagac

SEQ ID NO: 319259 - DNA, 16 bp, C. familiaris
gagcccagaaagaaac

SEQ ID NO: 319260 - DNA, 16 bp, C. familiaris
gagcccagagcccaag

SEQ ID NO: 319261 - DNA, 16 bp, C. familiaris
gagcccagcacccagc

SEQ ID NO: 319262 - DNA, 16 bp, C. familiaris
gagcccagcccagggc

SEQ ID NO: 319263 - DNA, 16 bp, C. familiaris
gagcccaggagcccag

SEQ ID NO: 319264 - DNA, 16 bp, C. familiaris
gagcccagtgccaggc

SEQ ID NO: 319265 - DNA, 16 bp, C. familiaris
gagcccatcacccagt

SEQ ID NO: 319266 - DNA, 16 bp, C. familiaris
gagcccatgaccctga

SEQ ID NO: 319267 - DNA, 16 bp, C. familiaris
gagccccacgtggagc

SEQ ID NO: 319268 - DNA, 16 bp, C. familiaris
gagccccagattgggc

SEQ ID NO: 319269 - DNA, 16 bp, C. familiaris
gagccccaggagcccc

SEQ ID NO: 319270 - DNA, 16 bp, C. familiaris
gagccccaggatcaag

SEQ ID NO: 319271 - DNA, 16 bp, C. familiaris
gagccccaggctcccc

SEQ ID NO: 319272 - DNA, 16 bp, C. familiaris
gagccccaggctgggg

SEQ ID NO: 319273 - DNA, 16 bp, C. familiaris
gagccccatgctcagc

SEQ ID NO: 319274 - DNA, 16 bp, C. familiaris
gagccccatggcaggc

SEQ ID NO: 319275 - DNA, 16 bp, C. familiaris
gagcccccagaaggaa

SEQ ID NO: 319276 - DNA, 16 bp, C. familiaris
gagccccccaggagcc

SEQ ID NO: 319277 - DNA, 16 bp, C. familiaris
gagccccccaggggcc

SEQ ID NO: 319278 - DNA, 16 bp, C. familiaris
gagccccccgggtgcc

SEQ ID NO: 319279 - DNA, 16 bp, C. familiaris
gagccccctgagctgc

SEQ ID NO: 319280 - DNA, 16 bp, C. familiaris
gagccccgggagcccc

SEQ ID NO: 319281 - DNA, 16 bp, C. familiaris
gagccccgggatccag

SEQ ID NO: 319282 - DNA, 16 bp, C. familiaris
gagcccctttcccccc

SEQ ID NO: 319283 - DNA, 16 bp, C. familiaris
gagcccgagcccgagc

SEQ ID NO: 319284 - DNA, 16 bp, C. familiaris
gagcccgagccggagc

SEQ ID NO: 319285 - DNA, 17 bp, C. familiaris
gagcccggccgagctgc

SEQ ID NO: 319286 - DNA, 16 bp, C. familiaris
gagccctgcaatgggc

SEQ ID NO: 319287 - DNA, 16 bp, C. familiaris
gagccctgcatcaagc

SEQ ID NO: 319288 - DNA, 16 bp, C. familiaris
gagccctgcgctgggc

SEQ ID NO: 319289 - DNA, 16 bp, C. familiaris
gagccctgcttggggc

SEQ ID NO: 319290 - DNA, 16 bp, C. familiaris
gagccctggagctggg

SEQ ID NO: 319291 - DNA, 16 bp, C. familiaris
gagccctgtgtcagac

SEQ ID NO: 319292 - DNA, 16 bp, C. familiaris
gagccctgtgtggggt

SEQ ID NO: 319293 - DNA, 16 bp, C. familiaris
gagccgaagccaagag

SEQ ID NO: 319294 - DNA, 16 bp, C. familiaris
gagccgccgccggagc

SEQ ID NO: 319295 - DNA, 16 bp, C. familiaris
gagccgccttcagccc

SEQ ID NO: 319296 - DNA, 16 bp, C. familiaris
gagccggagccgcagc

SEQ ID NO: 319297 - DNA, 16 bp, C. familiaris
gagccggagccggagc

SEQ ID NO: 319298 - DNA, 16 bp, C. familiaris
gagccgggagcctgac

SEQ ID NO: 319299 - DNA, 16 bp, C. familiaris
gagcctaaggcagaca

SEQ ID NO: 319300 - DNA, 16 bp, C. familiaris
gagcctcagagaggtt

SEQ ID NO: 319301 - DNA, 16 bp, C. familiaris
gagcctcagtgtcccc

SEQ ID NO: 319302 - DNA, 16 bp, C. familiaris
gagcctccaggacagg

SEQ ID NO: 319303 - DNA, 16 bp, C. familiaris
gagcctcccaggcacc

SEQ ID NO: 319304 - DNA, 16 bp, C. familiaris
gagcctcctgggctgc

SEQ ID NO: 319305 - DNA, 16 bp, C. familiaris
gagcctgacctggagc

SEQ ID NO: 319306 - DNA, 16 bp, C. familiaris
gagcctgacgtgggga

SEQ ID NO: 319307 - DNA, 16 bp, C. familiaris
gagcctgactgggggc

SEQ ID NO: 319308 - DNA, 16 bp, C. familiaris
gagcctgagctggggc

SEQ ID NO: 319309 - DNA, 16 bp, C. familiaris
gagcctgatcctggag

SEQ ID NO: 319310 - DNA, 16 bp, C. familiaris
gagcctgatgctgaac

SEQ ID NO: 319311 - DNA, 16 bp, C. familiaris
gagcctgatggggggc

SEQ ID NO: 319312 - DNA, 16 bp, C. familiaris
gagcctgcctgtccct

SEQ ID NO: 319313 - DNA, 16 bp, C. familiaris
gagcctgccttccgcc

SEQ ID NO: 319314 - DNA, 16 bp, C. familiaris
gagcctgctcctcctc

SEQ ID NO: 319315 - DNA, 16 bp, C. familiaris
gagcctgcttatctct

SEQ ID NO: 319316 - DNA, 16 bp, C. familiaris
gagcctgcttctgcct

SEQ ID NO: 319317 - DNA, 16 bp, C. familiaris
gagcctgcttttcact

SEQ ID NO: 319318 - DNA, 16 bp, C. familiaris
gagcctggagcctggg

SEQ ID NO: 319319 - DNA, 16 bp, C. familiaris
gagcctggagtcctgg

SEQ ID NO: 319320 - DNA, 16 bp, C. familiaris
gagcctgggctctgga

SEQ ID NO: 319321 - DNA, 16 bp, C. familiaris
gagcctggggaggggc

SEQ ID NO: 319322 - DNA, 16 bp, C. familiaris
gagcctggtgcaggac

SEQ ID NO: 319323 - DNA, 16 bp, C. familiaris
gagcctgtttctcact

SEQ ID NO: 319324 - DNA, 16 bp, C. familiaris
gagcgagcgagcgagc

SEQ ID NO: 319325 - DNA, 16 bp, C. familiaris
gagcgcgagcgcgagc

SEQ ID NO: 319326 - DNA, 16 bp, C. familiaris
gagcgcgatgcgggac

SEQ ID NO: 319327 - DNA, 16 bp, C. familiaris
gagcggggagcccgac

SEQ ID NO: 319328 - DNA, 16 bp, C. familiaris
gagcgtctaccttcag

SEQ ID NO: 319329 - DNA, 16 bp, C. familiaris
gagctaaaggcaggtg

SEQ ID NO: 319330 - DNA, 16 bp, C. familiaris
gagctaaataaatgga

SEQ ID NO: 319331 - DNA, 17 bp, C. familiaris
gagctacccaggctacc

SEQ ID NO: 319332 - DNA, 16 bp, C. familiaris
gagctactgcgggagc

SEQ ID NO: 319333 - DNA, 16 bp, C. familiaris
gagctagaaaaagaag

SEQ ID NO: 319334 - DNA, 16 bp, C. familiaris
gagctcaggaccctga

SEQ ID NO: 319335 - DNA, 16 bp, C. familiaris
gagctccacatcaggc

SEQ ID NO: 319336 - DNA, 16 bp, C. familiaris
gagctccctgaagggc

SEQ ID NO: 319337 - DNA, 16 bp, C. familiaris
gagctccggagctact

SEQ ID NO: 319338 - DNA, 16 bp, C. familiaris
gagctctccctgccac

SEQ ID NO: 319339 - DNA, 16 bp, C. familiaris
gagctctctgaggtct

SEQ ID NO: 319340 - DNA, 16 bp, C. familiaris
gagctgaaatcagaag

SEQ ID NO: 319341 - DNA, 16 bp, C. familiaris
gagctgaagacagaca

SEQ ID NO: 319342 - DNA, 16 bp, C. familiaris
gagctgaagacagact

SEQ ID NO: 319343 - DNA, 16 bp, C. familiaris
gagctgaagcagatgc

SEQ ID NO: 319344 - DNA, 17 bp, C. familiaris
gagctgaaggcactcaa

SEQ ID NO: 319345 - DNA, 16 bp, C. familiaris
gagctgaaggcagacg

SEQ ID NO: 319346 - DNA, 16 bp, C. familiaris
gagctgaaggcagccc

SEQ ID NO: 319347 - DNA, 16 bp, C. familiaris
gagctgaaggcggaca

SEQ ID NO: 319348 - DNA, 16 bp, C. familiaris
gagctgaaggtagacc

SEQ ID NO: 319349 - DNA, 16 bp, C. familiaris
gagctgacaaccaaga

SEQ ID NO: 319350 - DNA, 16 bp, C. familiaris
gagctgagatcaagag

SEQ ID NO: 319351 - DNA, 16 bp, C. familiaris
gagctgcaaccaagag

SEQ ID NO: 319352 - DNA, 17 bp, C. familiaris
gagctgcagagggagag

SEQ ID NO: 319353 - DNA, 16 bp, C. familiaris
gagctgcaggcggcgc

SEQ ID NO: 319354 - DNA, 16 bp, C. familiaris
gagctgcccaggctgc

SEQ ID NO: 319355 - DNA, 16 bp, C. familiaris
gagctgctcctgcccc

SEQ ID NO: 319356 - DNA, 16 bp, C. familiaris
gagctgctcctggagc

SEQ ID NO: 319357 - DNA, 16 bp, C. familiaris
gagctgctgccccggg

SEQ ID NO: 319358 - DNA, 16 bp, C. familiaris
gagctggaagcagatg

SEQ ID NO: 319359 - DNA, 16 bp, C. familiaris
gagctggaattcaaac

SEQ ID NO: 319360 - DNA, 16 bp, C. familiaris
gagctggaatttgaac

SEQ ID NO: 319361 - DNA, 16 bp, C. familiaris
gagctggacctggggc

SEQ ID NO: 319362 - DNA, 16 bp, C. familiaris
gagctggacgtggggc

SEQ ID NO: 319363 - DNA, 16 bp, C. familiaris
gagctggagaaagaat

SEQ ID NO: 319364 - DNA, 16 bp, C. familiaris
gagctggagcaggacc

SEQ ID NO: 319365 - DNA, 16 bp, C. familiaris
gagctggaggcagagg

SEQ ID NO: 319366 - DNA, 16 bp, C. familiaris
gagctggaggcagatg

SEQ ID NO: 319367 - DNA, 16 bp, C. familiaris
gagctggctgctgcca

SEQ ID NO: 319368 - DNA, 16 bp, C. familiaris
gagctgggagcccagt

SEQ ID NO: 319369 - DNA, 16 bp, C. familiaris
gagctgggctccctgc

SEQ ID NO: 319370 - DNA, 16 bp, C. familiaris
gagctggggaaggggc

SEQ ID NO: 319371 - DNA, 16 bp, C. familiaris
gagctggggatccctg

SEQ ID NO: 319372 - DNA, 16 bp, C. familiaris
gagctggggcagaggg

SEQ ID NO: 319373 - DNA, 16 bp, C. familiaris
gagctgggggaggagc

SEQ ID NO: 319374 - DNA, 16 bp, C. familiaris
gagcttattaaactca

SEQ ID NO: 319375 - DNA, 16 bp, C. familiaris
gagcttcagcttcctc

SEQ ID NO: 319376 - DNA, 16 bp, C. familiaris
gagcttcccaggtgcc

SEQ ID NO: 319377 - DNA, 16 bp, C. familiaris
gagcttcctgcaggga

SEQ ID NO: 319378 - DNA, 16 bp, C. familiaris
gagcttgggtccaagt

SEQ ID NO: 319379 - DNA, 16 bp, C. familiaris
gaggaaaaataaagca

SEQ ID NO: 319380 - DNA, 16 bp, C. familiaris
gaggaaaacataaaga

SEQ ID NO: 319381 - DNA, 16 bp, C. familiaris
gaggaaaactggaaaa

SEQ ID NO: 319382 - DNA, 16 bp, C. familiaris
gaggaaaatgaaaaca

SEQ ID NO: 319383 - DNA, 16 bp, C. familiaris
gaggaaacaaagaaat

SEQ ID NO: 319384 - DNA, 16 bp, C. familiaris
gaggaaacagagaaat

SEQ ID NO: 319385 - DNA, 16 bp, C. familiaris
gaggaaatatttaaga

SEQ ID NO: 319386 - DNA, 16 bp, C. familiaris
gaggaaatgctctgca

SEQ ID NO: 319387 - DNA, 16 bp, C. familiaris
gaggaacctgatgcag

SEQ ID NO: 319388 - DNA, 16 bp, C. familiaris
gaggaactgaggcaca

SEQ ID NO: 319389 - DNA, 16 bp, C. familiaris
gaggaagaaacacttc

SEQ ID NO: 319390 - DNA, 16 bp, C. familiaris
gaggaagaaccaggct

SEQ ID NO: 319391 - DNA, 16 bp, C. familiaris
gaggaagaagcagcag

SEQ ID NO: 319392 - DNA, 16 bp, C. familiaris
gaggaagaagctgact

SEQ ID NO: 319393 - DNA, 16 bp, C. familiaris
gaggaagaaggagact

SEQ ID NO: 319394 - DNA, 16 bp, C. familiaris
gaggaagagacacaag

SEQ ID NO: 319395 - DNA, 16 bp, C. familiaris
gaggaagaggaggctg

SEQ ID NO: 319396 - DNA, 16 bp, C. familiaris
gaggaagagtttgact

SEQ ID NO: 319397 - DNA, 16 bp, C. familiaris
gaggaagctgagactc

SEQ ID NO: 319398 - DNA, 16 bp, C. familiaris
gaggaagctgcagaag

SEQ ID NO: 319399 - DNA, 16 bp, C. familiaris
gaggaagctgcaggag

SEQ ID NO: 319400 - DNA, 16 bp, C. familiaris
gaggaaggcagagaca

SEQ ID NO: 319401 - DNA, 16 bp, C. familiaris
gaggaatgttccatct

SEQ ID NO: 319402 - DNA, 16 bp, C. familiaris
gaggacaaactggtgg

SEQ ID NO: 319403 - DNA, 16 bp, C. familiaris
gaggacacagggagaa

SEQ ID NO: 319404 - DNA, 16 bp, C. familiaris
gaggacatcagtgaga

SEQ ID NO: 319405 - DNA, 16 bp, C. familiaris
gaggacatccccgccc

SEQ ID NO: 319406 - DNA, 16 bp, C. familiaris
gaggaccctgctcctc

SEQ ID NO: 319407 - DNA, 16 bp, C. familiaris
gaggactgtttctggt

SEQ ID NO: 319408 - DNA, 16 bp, C. familiaris
gaggagaaaatatttg

SEQ ID NO: 319409 - DNA, 16 bp, C. familiaris
gaggagaacacagcca

SEQ ID NO: 319410 - DNA, 16 bp, C. familiaris
gaggagaagacaggca

SEQ ID NO: 319411 - DNA, 16 bp, C. familiaris
gaggagaagtcaatgc

SEQ ID NO: 319412 - DNA, 16 bp, C. familiaris
gaggagaatgtgtatt

SEQ ID NO: 319413 - DNA, 16 bp, C. familiaris
gaggagacagagaaat

SEQ ID NO: 319414 - DNA, 16 bp, C. familiaris
gaggagagaagcagac

SEQ ID NO: 319415 - DNA, 16 bp, C. familiaris
gaggagagattttttt

SEQ ID NO: 319416 - DNA, 16 bp, C. familiaris
gaggagcacctggctg

SEQ ID NO: 319417 - DNA, 16 bp, C. familiaris
gaggagcagagcagag

SEQ ID NO: 319418 - DNA, 16 bp, C. familiaris
gaggagcagaggcaga

SEQ ID NO: 319419 - DNA, 16 bp, C. familiaris
gaggagcagatggaga

SEQ ID NO: 319420 - DNA, 16 bp, C. familiaris
gaggagcagcaggcag

SEQ ID NO: 319421 - DNA, 16 bp, C. familiaris
gaggagcaggagctgc

SEQ ID NO: 319422 - DNA, 16 bp, C. familiaris
gaggagcaggctcctt

SEQ ID NO: 319423 - DNA, 16 bp, C. familiaris
gaggagcccacttctc

SEQ ID NO: 319424 - DNA, 18 bp, C. familiaris
gaggagccgggctgaggc

SEQ ID NO: 319425 - DNA, 16 bp, C. familiaris
gaggagcctgacacag

SEQ ID NO: 319426 - DNA, 16 bp, C. familiaris
gaggagcctgcttttc

SEQ ID NO: 319427 - DNA, 16 bp, C. familiaris
gaggagcttgatgtgg

SEQ ID NO: 319428 - DNA, 16 bp, C. familiaris
gaggaggaaactgagg

SEQ ID NO: 319429 - DNA, 16 bp, C. familiaris
gaggaggaaattgagg

SEQ ID NO: 319430 - DNA, 16 bp, C. familiaris
gaggaggaagaggctg

SEQ ID NO: 319431 - DNA, 16 bp, C. familiaris
gaggaggagaagcagc

SEQ ID NO: 319432 - DNA, 16 bp, C. familiaris
gaggaggagacacaga

SEQ ID NO: 319433 - DNA, 16 bp, C. familiaris
gaggaggagcagcagc

SEQ ID NO: 319434 - DNA, 16 bp, C. familiaris
gaggaggaggagagct

SEQ ID NO: 319435 - DNA, 16 bp, C. familiaris
gaggaggaggaggact

SEQ ID NO: 319436 - DNA, 16 bp, C. familiaris
gaggaggaggaggctg

SEQ ID NO: 319437 - DNA, 16 bp, C. familiaris
gaggaggaggctgtgg

SEQ ID NO: 319438 - DNA, 16 bp, C. familiaris
gaggaggcagaagcag

SEQ ID NO: 319439 - DNA, 16 bp, C. familiaris
gaggaggcagggctgg

SEQ ID NO: 319440 - DNA, 16 bp, C. familiaris
gaggaggctgaggagg

SEQ ID NO: 319441 - DNA, 16 bp, C. familiaris
gaggagggagaagctg

SEQ ID NO: 319442 - DNA, 16 bp, C. familiaris
gaggagggcagcctgg

SEQ ID NO: 319443 - DNA, 16 bp, C. familiaris
gaggaggggcaggatg

SEQ ID NO: 319444 - DNA, 16 bp, C. familiaris
gaggaggggctgctgg

SEQ ID NO: 319445 - DNA, 16 bp, C. familiaris
gaggaggtgcagaggg

SEQ ID NO: 319446 - DNA, 16 bp, C. familiaris
gaggagtgagaagcag

SEQ ID NO: 319447 - DNA, 16 bp, C. familiaris
gaggagtgcctgggtg

SEQ ID NO: 319448 - DNA, 16 bp, C. familiaris
gaggatgcaaagaaag

SEQ ID NO: 319449 - DNA, 16 bp, C. familiaris
gaggatgcagagaaag

SEQ ID NO: 319450 - DNA, 16 bp, C. familiaris
gaggatgcagagcaac

SEQ ID NO: 319451 - DNA, 16 bp, C. familiaris
gaggatgccctcgggc

SEQ ID NO: 319452 - DNA, 16 bp, C. familiaris
gaggatggggtcctca

SEQ ID NO: 319453 - DNA, 16 bp, C. familiaris
gaggatgtggagcagc

SEQ ID NO: 319454 - DNA, 16 bp, C. familiaris
gaggatgtggtgaaag

SEQ ID NO: 319455 - DNA, 16 bp, C. familiaris
gaggattattctgaat

SEQ ID NO: 319456 - DNA, 16 bp, C. familiaris
gaggattctctccttc

SEQ ID NO: 319457 - DNA, 16 bp, C. familiaris
gaggatttttgcatca

SEQ ID NO: 319458 - DNA, 16 bp, C. familiaris
gaggattttttaaaaa

SEQ ID NO: 319459 - DNA, 16 bp, C. familiaris
gaggcaaaggcagaag

SEQ ID NO: 319460 - DNA, 16 bp, C. familiaris
gaggcaagatggtgga

SEQ ID NO: 319461 - DNA, 16 bp, C. familiaris
gaggcacagacacaga

SEQ ID NO: 319462 - DNA, 16 bp, C. familiaris
gaggcacagagagatg

SEQ ID NO: 319463 - DNA, 16 bp, C. familiaris
gaggcacccaggggcc

SEQ ID NO: 319464 - DNA, 16 bp, C. familiaris
gaggcagaaacagaga

SEQ ID NO: 319465 - DNA, 16 bp, C. familiaris
gaggcagaaagtagat

SEQ ID NO: 319466 - DNA, 16 bp, C. familiaris
gaggcagaagcaggag

SEQ ID NO: 319467 - DNA, 16 bp, C. familiaris
gaggcagagaaaggca

SEQ ID NO: 319468 - DNA, 16 bp, C. familiaris
gaggcagagaaccagg

SEQ ID NO: 319469 - DNA, 16 bp, C. familiaris
gaggcagagacaaggg

SEQ ID NO: 319470 - DNA, 16 bp, C. familiaris
gaggcagagacagtgg

SEQ ID NO: 319471 - DNA, 16 bp, C. familiaris
gaggcagagaccagag

SEQ ID NO: 319472 - DNA, 16 bp, C. familiaris
gaggcagagactggag

SEQ ID NO: 319473 - DNA, 16 bp, C. familiaris
gaggcagagaggcaga

SEQ ID NO: 319474 - DNA, 16 bp, C. familiaris
gaggcagagcacaggc

SEQ ID NO: 319475 - DNA, 16 bp, C. familiaris
gaggcagaggcagaga

SEQ ID NO: 319476 - DNA, 16 bp, C. familiaris
gaggcagaggcaggaa

SEQ ID NO: 319477 - DNA, 16 bp, C. familiaris
gaggcagaggcaggct

SEQ ID NO: 319478 - DNA, 16 bp, C. familiaris
gaggcagaggcccagg

SEQ ID NO: 319479 - DNA, 16 bp, C. familiaris
gaggcagaggctggag

SEQ ID NO: 319480 - DNA, 16 bp, C. familiaris
gaggcagagggtggag

SEQ ID NO: 319481 - DNA, 16 bp, C. familiaris
gaggcagaggtagaga

SEQ ID NO: 319482 - DNA, 16 bp, C. familiaris
gaggcagaggtggagg

SEQ ID NO: 319483 - DNA, 16 bp, C. familiaris
gaggcagaggttggag

SEQ ID NO: 319484 - DNA, 16 bp, C. familiaris
gaggcagcagaaagag

SEQ ID NO: 319485 - DNA, 16 bp, C. familiaris
gaggcagctcccccag

SEQ ID NO: 319486 - DNA, 16 bp, C. familiaris
gaggcaggcagaggaa

SEQ ID NO: 319487 - DNA, 16 bp, C. familiaris
gaggcaggcaggcagg

SEQ ID NO: 319488 - DNA, 16 bp, C. familiaris
gaggcaggcagggcag

SEQ ID NO: 319489 - DNA, 16 bp, C. familiaris
gaggcaggccccatgc

SEQ ID NO: 319490 - DNA, 16 bp, C. familiaris
gaggcaggctccccac

SEQ ID NO: 319491 - DNA, 16 bp, C. familiaris
gaggcaggctccccag

SEQ ID NO: 319492 - DNA, 16 bp, C. familiaris
gaggcaggctccctga

SEQ ID NO: 319493 - DNA, 16 bp, C. familiaris
gaggcagggagaccag

SEQ ID NO: 319494 - DNA, 16 bp, C. familiaris
gaggcaggggcacagg

SEQ ID NO: 319495 - DNA, 16 bp, C. familiaris
gaggcataagcagagg

SEQ ID NO: 319496 - DNA, 16 bp, C. familiaris
gaggccaatgcagggc

SEQ ID NO: 319497 - DNA, 16 bp, C. familiaris
gaggccacaggaggaa

SEQ ID NO: 319498 - DNA, 16 bp, C. familiaris
gaggccagaagtccca

SEQ ID NO: 319499 - DNA, 16 bp, C. familiaris
gaggccagagacacag

SEQ ID NO: 319500 - DNA, 16 bp, C. familiaris
gaggccagaggccagg

SEQ ID NO: 319501 - DNA, 16 bp, C. familiaris
gaggccaggaggacac

SEQ ID NO: 319502 - DNA, 16 bp, C. familiaris
gaggccaggaggccag

SEQ ID NO: 319503 - DNA, 16 bp, C. familiaris
gaggccaggcctgggg

SEQ ID NO: 319504 - DNA, 16 bp, C. familiaris
gaggcccacatggggc

SEQ ID NO: 319505 - DNA, 16 bp, C. familiaris
gaggcccagagatggg

SEQ ID NO: 319506 - DNA, 16 bp, C. familiaris
gaggcccaggatcgag

SEQ ID NO: 319507 - DNA, 16 bp, C. familiaris
gaggcccaggccctgg

SEQ ID NO: 319508 - DNA, 16 bp, C. familiaris
gaggcccaggctgggg

SEQ ID NO: 319509 - DNA, 16 bp, C. familiaris
gaggcccagggaggcc

SEQ ID NO: 319510 - DNA, 16 bp, C. familiaris
gaggccccagagagct

SEQ ID NO: 319511 - DNA, 16 bp, C. familiaris
gaggccccaggaggca

SEQ ID NO: 319512 - DNA, 16 bp, C. familiaris
gaggcccccaggtgcc

SEQ ID NO: 319513 - DNA, 16 bp, C. familiaris
gaggccccgaggcccc

SEQ ID NO: 319514 - DNA, 16 bp, C. familiaris
gaggccccgcccctcc

SEQ ID NO: 319515 - DNA, 16 bp, C. familiaris
gaggccccgggatcaa

SEQ ID NO: 319516 - DNA, 16 bp, C. familiaris
gaggcccctgttccct

SEQ ID NO: 319517 - DNA, 16 bp, C. familiaris
gaggcccgggatggag

SEQ ID NO: 319518 - DNA, 16 bp, C. familiaris
gaggccctgagggagg

SEQ ID NO: 319519 - DNA, 16 bp, C. familiaris
gaggccctgcagaact

SEQ ID NO: 319520 - DNA, 16 bp, C. familiaris
gaggcctcagtttctc

SEQ ID NO: 319521 - DNA, 16 bp, C. familiaris
gaggcctcatggggta

SEQ ID NO: 319522 - DNA, 16 bp, C. familiaris
gaggcctgcttctcct

SEQ ID NO: 319523 - DNA, 16 bp, C. familiaris
gaggccttccctggcc

SEQ ID NO: 319524 - DNA, 16 bp, C. familiaris
gaggcgcagaaggaga

SEQ ID NO: 319525 - DNA, 16 bp, C. familiaris
gaggctcagagacagg

SEQ ID NO: 319526 - DNA, 16 bp, C. familiaris
gaggctcagagagagg

SEQ ID NO: 319527 - DNA, 16 bp, C. familiaris
gaggctcagagaggtg

SEQ ID NO: 319528 - DNA, 16 bp, C. familiaris
gaggctccatctcaca

SEQ ID NO: 319529 - DNA, 16 bp, C. familiaris
gaggctcccctgcccc

SEQ ID NO: 319530 - DNA, 16 bp, C. familiaris
gaggctccggggaggg

SEQ ID NO: 319531 - DNA, 16 bp, C. familiaris
gaggctcctgggtggc

SEQ ID NO: 319532 - DNA, 16 bp, C. familiaris
gaggctgacaagtccc

SEQ ID NO: 319533 - DNA, 16 bp, C. familiaris
gaggctgagagagaga

SEQ ID NO: 319534 - DNA, 16 bp, C. familiaris
gaggctgaggaaaaaa

SEQ ID NO: 319535 - DNA, 16 bp, C. familiaris
gaggctgaggaggagg

SEQ ID NO: 319536 - DNA, 16 bp, C. familiaris
gaggctgaggctgggg

SEQ ID NO: 319537 - DNA, 16 bp, C. familiaris
gaggctgcagaggctg

SEQ ID NO: 319538 - DNA, 16 bp, C. familiaris
gaggctgcccacattc

SEQ ID NO: 319539 - DNA, 16 bp, C. familiaris
gaggctggaagaggca

SEQ ID NO: 319540 - DNA, 16 bp, C. familiaris
gaggctggaagcctga

SEQ ID NO: 319541 - DNA, 16 bp, C. familiaris
gaggctggaagtcaga

SEQ ID NO: 319542 - DNA, 16 bp, C. familiaris
gaggctggagctgggg

SEQ ID NO: 319543 - DNA, 16 bp, C. familiaris
gaggctggaggctgag

SEQ ID NO: 319544 - DNA, 16 bp, C. familiaris
gaggctgggagggcag

SEQ ID NO: 319545 - DNA, 16 bp, C. familiaris
gaggcttgctggaggg

SEQ ID NO: 319546 - DNA, 16 bp, C. familiaris
gagggaaataaaccat

SEQ ID NO: 319547 - DNA, 16 bp, C. familiaris
gagggaagaccatgtg

SEQ ID NO: 319548 - DNA, 16 bp, C. familiaris
gagggaagcagagaca

SEQ ID NO: 319549 - DNA, 16 bp, C. familiaris
gagggaaggccatgtg

SEQ ID NO: 319550 - DNA, 16 bp, C. familiaris
gagggacagaagcaga

SEQ ID NO: 319551 - DNA, 16 bp, C. familiaris
gagggacctgctgtgc

SEQ ID NO: 319552 - DNA, 16 bp, C. familiaris
gagggactcgatccag

SEQ ID NO: 319553 - DNA, 16 bp, C. familiaris
gagggacttgatcctg

SEQ ID NO: 319554 - DNA, 16 bp, C. familiaris
gagggagaaactgact

SEQ ID NO: 319555 - DNA, 16 bp, C. familiaris
gagggagaagctgacc

SEQ ID NO: 319556 - DNA, 16 bp, C. familiaris
gagggagaagctgagc

SEQ ID NO: 319557 - DNA, 16 bp, C. familiaris
gagggagaaggagact

SEQ ID NO: 319558 - DNA, 16 bp, C. familiaris
gagggagaaggaggct

SEQ ID NO: 319559 - DNA, 16 bp, C. familiaris
gagggagagaacctca

SEQ ID NO: 319560 - DNA, 16 bp, C. familiaris
gagggagagaatttta

SEQ ID NO: 319561 - DNA, 16 bp, C. familiaris
gagggagagaattttc

SEQ ID NO: 319562 - DNA, 16 bp, C. familiaris
gagggagagagtgcac

SEQ ID NO: 319563 - DNA, 16 bp, C. familiaris
gagggagatgcagaga

SEQ ID NO: 319564 - DNA, 16 bp, C. familiaris
gagggagcagaagcag

SEQ ID NO: 319565 - DNA, 16 bp, C. familiaris
gagggagcagaaggct

SEQ ID NO: 319566 - DNA, 16 bp, C. familiaris
gagggagctgcagagg

SEQ ID NO: 319567 - DNA, 16 bp, C. familiaris
gagggaggagcaggcc

SEQ ID NO: 319568 - DNA, 16 bp, C. familiaris
gagggaggcacagaca

SEQ ID NO: 319569 - DNA, 16 bp, C. familiaris
gagggaggccctgagg

SEQ ID NO: 319570 - DNA, 16 bp, C. familiaris
gagggagtccctgtgc

SEQ ID NO: 319571 - DNA, 16 bp, C. familiaris
gagggcacaggacagg

SEQ ID NO: 319572 - DNA, 17 bp, C. familiaris
gagggcagccccggtgg

SEQ ID NO: 319573 - DNA, 16 bp, C. familiaris
gagggcagcctggatg

SEQ ID NO: 319574 - DNA, 16 bp, C. familiaris
gagggcaggaaccatg

SEQ ID NO: 319575 - DNA, 16 bp, C. familiaris
gagggcagggactgtg

SEQ ID NO: 319576 - DNA, 16 bp, C. familiaris
gagggcatccccaccc

SEQ ID NO: 319577 - DNA, 16 bp, C. familiaris
gagggccagagggaaa

SEQ ID NO: 319578 - DNA, 16 bp, C. familiaris
gagggcgcctgggtgg

SEQ ID NO: 319579 - DNA, 16 bp, C. familiaris
gagggctcaggacagc

SEQ ID NO: 319580 - DNA, 16 bp, C. familiaris
gagggctgcctggagg

SEQ ID NO: 319581 - DNA, 16 bp, C. familiaris
gagggcttcctggagg

SEQ ID NO: 319582 - DNA, 16 bp, C. familiaris
gaggggaagtgggcag

SEQ ID NO: 319583 - DNA, 16 bp, C. familiaris
gaggggcaaaggtaga

SEQ ID NO: 319584 - DNA, 16 bp, C. familiaris
gaggggcagagaccca

SEQ ID NO: 319585 - DNA, 16 bp, C. familiaris
gaggggcagagctggg

SEQ ID NO: 319586 - DNA, 16 bp, C. familiaris
gaggggcagagtaaga

SEQ ID NO: 319587 - DNA, 16 bp, C. familiaris
gaggggcagatggaga

SEQ ID NO: 319588 - DNA, 16 bp, C. familiaris
gaggggcggggcctcg

SEQ ID NO: 319589 - DNA, 16 bp, C. familiaris
gaggggctgaggaaga

SEQ ID NO: 319590 - DNA, 16 bp, C. familiaris
gaggggctgaggggct

SEQ ID NO: 319591 - DNA, 16 bp, C. familiaris
gaggggctgattttca

SEQ ID NO: 319592 - DNA, 16 bp, C. familiaris
gagggggaaactgagg

SEQ ID NO: 319593 - DNA, 16 bp, C. familiaris
gagggggctgcccggc

SEQ ID NO: 319594 - DNA, 16 bp, C. familiaris
gagggggctgcgggcc

SEQ ID NO: 319595 - DNA, 16 bp, C. familiaris
gagggggctgtgcggc

SEQ ID NO: 319596 - DNA, 16 bp, C. familiaris
gagggtgcagagagag

SEQ ID NO: 319597 - DNA, 16 bp, C. familiaris
gagggtgtttctggaa

SEQ ID NO: 319598 - DNA, 16 bp, C. familiaris
gagggttgctgcaggg

SEQ ID NO: 319599 - DNA, 16 bp, C. familiaris
gaggtcaaaaaggttg

SEQ ID NO: 319600 - DNA, 16 bp, C. familiaris
gaggtcaaaatggagg

SEQ ID NO: 319601 - DNA, 16 bp, C. familiaris
gaggtccataccaaga

SEQ ID NO: 319602 - DNA, 16 bp, C. familiaris
gaggtgatggatgtgt

SEQ ID NO: 319603 - DNA, 16 bp, C. familiaris
gaggtgcaggtgcccc

SEQ ID NO: 319604 - DNA, 16 bp, C. familiaris
gaggtgcttggctggc

SEQ ID NO: 319605 - DNA, 16 bp, C. familiaris
gaggtggaagaatgag

SEQ ID NO: 319606 - DNA, 16 bp, C. familiaris
gaggtggaggcttttg

SEQ ID NO: 319607 - DNA, 16 bp, C. familiaris
gaggtggcaggtgcag

SEQ ID NO: 319608 - DNA, 16 bp, C. familiaris
gaggtggggcacctgg

SEQ ID NO: 319609 - DNA, 16 bp, C. familiaris
gaggtggtggtggata

SEQ ID NO: 319610 - DNA, 16 bp, C. familiaris
gaggttattgcctgtg

SEQ ID NO: 319611 - DNA, 16 bp, C. familiaris
gaggttcatccatgtt

SEQ ID NO: 319612 - DNA, 16 bp, C. familiaris
gagtaaaaccatatga

SEQ ID NO: 319613 - DNA, 16 bp, C. familiaris
gagtacaagcaggtgg

SEQ ID NO: 319614 - DNA, 16 bp, C. familiaris
gagtaggatgtttaac

SEQ ID NO: 319615 - DNA, 16 bp, C. familiaris
gagtagtattccattt

SEQ ID NO: 319616 - DNA, 16 bp, C. familiaris
gagtatcatatggttc

SEQ ID NO: 319617 - DNA, 16 bp, C. familiaris
gagtcaaagaagaaat

SEQ ID NO: 319618 - DNA, 16 bp, C. familiaris
gagtcacccaggggtc

SEQ ID NO: 319619 - DNA, 16 bp, C. familiaris
gagtcagagacagagg

SEQ ID NO: 319620 - DNA, 16 bp, C. familiaris
gagtcagccaggcact

SEQ ID NO: 319621 - DNA, 16 bp, C. familiaris
gagtcaggctctgagc

SEQ ID NO: 319622 - DNA, 16 bp, C. familiaris
gagtcaggggaggggc

SEQ ID NO: 319623 - DNA, 16 bp, C. familiaris
gagtcatgccctgagc

SEQ ID NO: 319624 - DNA, 16 bp, C. familiaris
gagtccaagatcaagg

SEQ ID NO: 319625 - DNA, 16 bp, C. familiaris
gagtccagagccagat

SEQ ID NO: 319626 - DNA, 16 bp, C. familiaris
gagtccagtgtgggac

SEQ ID NO: 319627 - DNA, 16 bp, C. familiaris
gagtcccagaaagaga

SEQ ID NO: 319628 - DNA, 16 bp, C. familiaris
gagtcccagaagaaga

SEQ ID NO: 319629 - DNA, 16 bp, C. familiaris
gagtcccagaggaaga

SEQ ID NO: 319630 - DNA, 16 bp, C. familiaris
gagtcccaggatggag

SEQ ID NO: 319631 - DNA, 16 bp, C. familiaris
gagtcccatgcagggc

SEQ ID NO: 319632 - DNA, 16 bp, C. familiaris
gagtccccagagtccc

SEQ ID NO: 319633 - DNA, 16 bp, C. familiaris
gagtcccttatggttt

SEQ ID NO: 319634 - DNA, 16 bp, C. familiaris
gagtcctggaatccag

SEQ ID NO: 319635 - DNA, 16 bp, C. familiaris
gagtcctggggtcaag

SEQ ID NO: 319636 - DNA, 16 bp, C. familiaris
gagtctagaaatagac

SEQ ID NO: 319637 - DNA, 16 bp, C. familiaris
gagtctccagaaggaa

SEQ ID NO: 319638 - DNA, 16 bp, C. familiaris
gagtctcccttaatat

SEQ ID NO: 319639 - DNA, 16 bp, C. familiaris
gagtctcgggatggag

SEQ ID NO: 319640 - DNA, 16 bp, C. familiaris
gagtctctgcctttgg

SEQ ID NO: 319641 - DNA, 16 bp, C. familiaris
gagtctgaggcagggc

SEQ ID NO: 319642 - DNA, 16 bp, C. familiaris
gagtctgatgcagggc

SEQ ID NO: 319643 - DNA, 16 bp, C. familiaris
gagtctgcctgaagat

SEQ ID NO: 319644 - DNA, 16 bp, C. familiaris
gagtctgggattgagt

SEQ ID NO: 319645 - DNA, 16 bp, C. familiaris
gagtgaaaccatataa

SEQ ID NO: 319646 - DNA, 16 bp, C. familiaris
gagtgaaagcatatga

SEQ ID NO: 319647 - DNA, 16 bp, C. familiaris
gagtgaaatagatgaa

SEQ ID NO: 319648 - DNA, 16 bp, C. familiaris
gagtgaagaaagtcaa

SEQ ID NO: 319649 - DNA, 16 bp, C. familiaris
gagtgacccaggtgcc

SEQ ID NO: 319650 - DNA, 16 bp, C. familiaris
gagtgagcaagaaaga

SEQ ID NO: 319651 - DNA, 16 bp, C. familiaris
gagtgagcaaggggag

SEQ ID NO: 319652 - DNA, 16 bp, C. familiaris
gagtgaggggcagagg

SEQ ID NO: 319653 - DNA, 16 bp, C. familiaris
gagtgaggtagagaca

SEQ ID NO: 319654 - DNA, 16 bp, C. familiaris
gagtgatcctggagcc

SEQ ID NO: 319655 - DNA, 16 bp, C. familiaris
gagtgcagagcctgag

SEQ ID NO: 319656 - DNA, 16 bp, C. familiaris
gagtgcagagtctgat

SEQ ID NO: 319657 - DNA, 16 bp, C. familiaris
gagtggaaataaatga

SEQ ID NO: 319658 - DNA, 16 bp, C. familiaris
gagtggaatttctggg

SEQ ID NO: 319659 - DNA, 16 bp, C. familiaris
gagtggaggagggaca

SEQ ID NO: 319660 - DNA, 16 bp, C. familiaris
gagtggataaacaaaa

SEQ ID NO: 319661 - DNA, 16 bp, C. familiaris
gagtggccaaaaagaa

SEQ ID NO: 319662 - DNA, 16 bp, C. familiaris
gagtggctgccttcag

SEQ ID NO: 319663 - DNA, 16 bp, C. familiaris
gagtgggagaggcaga

SEQ ID NO: 319664 - DNA, 16 bp, C. familiaris
gagtgggaggagcaga

SEQ ID NO: 319665 - DNA, 16 bp, C. familiaris
gagtgggagtgaatgg

SEQ ID NO: 319666 - DNA, 16 bp, C. familiaris
gagtgtctgcctctgg

SEQ ID NO: 319667 - DNA, 16 bp, C. familiaris
gagtgtctgccttcat

SEQ ID NO: 319668 - DNA, 16 bp, C. familiaris
gagtgtgaccctggag

SEQ ID NO: 319669 - DNA, 16 bp, C. familiaris
gagtgtggtcctggag

SEQ ID NO: 319670 - DNA, 16 bp, C. familiaris
gagtgtgtgcacaagc

SEQ ID NO: 319671 - DNA, 16 bp, C. familiaris
gagtgtgtgcacatgt

SEQ ID NO: 319672 - DNA, 16 bp, C. familiaris
gagtgttattctgtat

SEQ ID NO: 319673 - DNA, 16 bp, C. familiaris
gagttagaagtcttta

SEQ ID NO: 319674 - DNA, 16 bp, C. familiaris
gagttcaagccctatg

SEQ ID NO: 319675 - DNA, 16 bp, C. familiaris
gagttcagtaattcat

SEQ ID NO: 319676 - DNA, 16 bp, C. familiaris
gagttcagtttgccaa

SEQ ID NO: 319677 - DNA, 16 bp, C. familiaris
gagttccagtttcaaa

SEQ ID NO: 319678 - DNA, 16 bp, C. familiaris
gagttcctgtgggggc

SEQ ID NO: 319679 - DNA, 16 bp, C. familiaris
gagttcgagccccacc

SEQ ID NO: 319680 - DNA, 16 bp, C. familiaris
gagttgaaaacatgtc

SEQ ID NO: 319681 - DNA, 16 bp, C. familiaris
gagttggaacaaatca

SEQ ID NO: 319682 - DNA, 16 bp, C. familiaris
gagttggttctttgga

SEQ ID NO: 319683 - DNA, 16 bp, C. familiaris
gagtttatttttgtga

SEQ ID NO: 319684 - DNA, 16 bp, C. familiaris
gagtttcccagacaag

SEQ ID NO: 319685 - DNA, 16 bp, C. familiaris
gagtttctcaaacaaa

SEQ ID NO: 319686 - DNA, 16 bp, C. familiaris
gagtttgacttttttt

SEQ ID NO: 319687 - DNA, 16 bp, C. familiaris
gagtttggcttcttct

SEQ ID NO: 319688 - DNA, 16 bp, C. familiaris
gagttttaaagttttt

SEQ ID NO: 319689 - DNA, 16 bp, C. familiaris
gagttttatggtttta

SEQ ID NO: 319690 - DNA, 16 bp, C. familiaris
gagtttttatcaggaa

SEQ ID NO: 319691 - DNA, 16 bp, C. familiaris
gagttttttggttact

SEQ ID NO: 319692 - DNA, 16 bp, C. familiaris
gataaaaaaggaagac

SEQ ID NO: 319693 - DNA, 16 bp, C. familiaris
gataaaaacaaaattt

SEQ ID NO: 319694 - DNA, 16 bp, C. familiaris
gataaaaaccacatga

SEQ ID NO: 319695 - DNA, 16 bp, C. familiaris
gataaaacatgagaga

SEQ ID NO: 319696 - DNA, 16 bp, C. familiaris
gataaacccaaagaaa

SEQ ID NO: 319697 - DNA, 16 bp, C. familiaris
gataaagaaaacatgg

SEQ ID NO: 319698 - DNA, 16 bp, C. familiaris
gataaagaaaatgcag

SEQ ID NO: 319699 - DNA, 16 bp, C. familiaris
gataaagaagaggtga

SEQ ID NO: 319700 - DNA, 16 bp, C. familiaris
gataaagaagatgagg

SEQ ID NO: 319701 - DNA, 16 bp, C. familiaris
gataaagaagatgggg

SEQ ID NO: 319702 - DNA, 16 bp, C. familiaris
gataaagaattcaaaa

SEQ ID NO: 319703 - DNA, 16 bp, C. familiaris
gataaagcagtggcag

SEQ ID NO: 319704 - DNA, 16 bp, C. familiaris
gataaatggaatagaa

SEQ ID NO: 319705 - DNA, 16 bp, C. familiaris
gataaattcaaagaga

SEQ ID NO: 319706 - DNA, 16 bp, C. familiaris
gataacaacaacaaca

SEQ ID NO: 319707 - DNA, 16 bp, C. familiaris
gataagaatgtgtatt

SEQ ID NO: 319708 - DNA, 16 bp, C. familiaris
gataaggaaactgaag

SEQ ID NO: 319709 - DNA, 16 bp, C. familiaris
gataaggaagatgtgg

SEQ ID NO: 319710 - DNA, 16 bp, C. familiaris
gataagtgatgttgaa

SEQ ID NO: 319711 - DNA, 16 bp, C. familiaris
gataataaagattcaa

SEQ ID NO: 319712 - DNA, 16 bp, C. familiaris
gataataacaaatgtt

SEQ ID NO: 319713 - DNA, 16 bp, C. familiaris
gataatccaaacagaa

SEQ ID NO: 319714 - DNA, 16 bp, C. familiaris
gataattggatattca

SEQ ID NO: 319715 - DNA, 16 bp, C. familiaris
gatacaacaccaaaaa

SEQ ID NO: 319716 - DNA, 16 bp, C. familiaris
gatacagatatagata

SEQ ID NO: 319717 - DNA, 16 bp, C. familiaris
gatacatgtaccctga

SEQ ID NO: 319718 - DNA, 16 bp, C. familiaris
gatacgaaatcaatgc

SEQ ID NO: 319719 - DNA, 16 bp, C. familiaris
gatactctatgtggaa

SEQ ID NO: 319720 - DNA, 16 bp, C. familiaris
gatactttttatttct

SEQ ID NO: 319721 - DNA, 16 bp, C. familiaris
gatagacacagagaaa

SEQ ID NO: 319722 - DNA, 16 bp, C. familiaris
gatagacagatggata

SEQ ID NO: 319723 - DNA, 16 bp, C. familiaris
gatagagaacaaattg

SEQ ID NO: 319724 - DNA, 16 bp, C. familiaris
gatagcaacatgcaaa

SEQ ID NO: 319725 - DNA, 16 bp, C. familiaris
gatagggaggcagaga

SEQ ID NO: 319726 - DNA, 16 bp, C. familiaris
gatagtctttttaaca

SEQ ID NO: 319727 - DNA, 16 bp, C. familiaris
gatagtgattttattt

SEQ ID NO: 319728 - DNA, 16 bp, C. familiaris
gatatacaaatggcca

SEQ ID NO: 319729 - DNA, 16 bp, C. familiaris
gatatagaaaacctga

SEQ ID NO: 319730 - DNA, 16 bp, C. familiaris
gatatatcattgtggt

SEQ ID NO: 319731 - DNA, 16 bp, C. familiaris
gatatatgggaactct

SEQ ID NO: 319732 - DNA, 16 bp, C. familiaris
gatatcattgtggttt

SEQ ID NO: 319733 - DNA, 17 bp, C. familiaris
gatatgatgaatcacat

SEQ ID NO: 319734 - DNA, 16 bp, C. familiaris
gatatgtccaagtcct

SEQ ID NO: 319735 - DNA, 16 bp, C. familiaris
gatattcttctttgat

SEQ ID NO: 319736 - DNA, 16 bp, C. familiaris
gatattgacattgata

SEQ ID NO: 319737 - DNA, 16 bp, C. familiaris
gatatttcttgcttct

SEQ ID NO: 319738 - DNA, 16 bp, C. familiaris
gatatttgagttattt

SEQ ID NO: 319739 - DNA, 16 bp, C. familiaris
gatatttgcaagtgat

SEQ ID NO: 319740 - DNA, 16 bp, C. familiaris
gatatttgggttcttt

SEQ ID NO: 319741 - DNA, 16 bp, C. familiaris
gatatttgtatgtatt

SEQ ID NO: 319742 - DNA, 16 bp, C. familiaris
gatattttctttaaaa

SEQ ID NO: 319743 - DNA, 16 bp, C. familiaris
gatatttttccaaaga

SEQ ID NO: 319744 - DNA, 16 bp, C. familiaris
gatcaacaaaactgat

SEQ ID NO: 319745 - DNA, 16 bp, C. familiaris
gatcaagacccacatc

SEQ ID NO: 319746 - DNA, 16 bp, C. familiaris
gatcaagagaacagaa

SEQ ID NO: 319747 - DNA, 16 bp, C. familiaris
gatcaagagtcagcca

SEQ ID NO: 319748 - DNA, 16 bp, C. familiaris
gatcaagagtctcctg

SEQ ID NO: 319749 - DNA, 16 bp, C. familiaris
gatcaagagttgtgtg

SEQ ID NO: 319750 - DNA, 16 bp, C. familiaris
gatcaagcccaacatc

SEQ ID NO: 319751 - DNA, 16 bp, C. familiaris
gatcaagccccacctc

SEQ ID NO: 319752 - DNA, 16 bp, C. familiaris
gatcaagtccaacatc

SEQ ID NO: 319753 - DNA, 16 bp, C. familiaris
gatcaagtcccaaatc

SEQ ID NO: 319754 - DNA, 16 bp, C. familiaris
gatcaagtccctcatt

SEQ ID NO: 319755 - DNA, 16 bp, C. familiaris
gatcaagtcctgtgtc

SEQ ID NO: 319756 - DNA, 16 bp, C. familiaris
gatcaagtgccacgtc

SEQ ID NO: 319757 - DNA, 16 bp, C. familiaris
gatcaatgaaaccaag

SEQ ID NO: 319758 - DNA, 16 bp, C. familiaris
gatcacaacctgagtc

SEQ ID NO: 319759 - DNA, 16 bp, C. familiaris
gatcacaacctggact

SEQ ID NO: 319760 - DNA, 16 bp, C. familiaris
gatcacgccttgagct

SEQ ID NO: 319761 - DNA, 16 bp, C. familiaris
gatcagaccctgggcc

SEQ ID NO: 319762 - DNA, 16 bp, C. familiaris
gatcaggccctggacc

SEQ ID NO: 319763 - DNA, 16 bp, C. familiaris
gatcataccccgggct

SEQ ID NO: 319764 - DNA, 16 bp, C. familiaris
gatcatcaagatagta

SEQ ID NO: 319765 - DNA, 16 bp, C. familiaris
gatcatgacctgagcc

SEQ ID NO: 319766 - DNA, 16 bp, C. familiaris
gatcatgatcctggag

SEQ ID NO: 319767 - DNA, 16 bp, C. familiaris
gatcatgatctcagag

SEQ ID NO: 319768 - DNA, 16 bp, C. familiaris
gatcatggggtcatga

SEQ ID NO: 319769 - DNA, 16 bp, C. familiaris
gatccagagactccag

SEQ ID NO: 319770 - DNA, 16 bp, C. familiaris
gatccagggatctggg

SEQ ID NO: 319771 - DNA, 16 bp, C. familiaris
gatccagtcccacatc

SEQ ID NO: 319772 - DNA, 16 bp, C. familiaris
gatcccaagactctgg

SEQ ID NO: 319773 - DNA, 16 bp, C. familiaris
gatcccagaatcctga

SEQ ID NO: 319774 - DNA, 16 bp, C. familiaris
gatcccagagccccag

SEQ ID NO: 319775 - DNA, 16 bp, C. familiaris
gatcccagagtcccag

SEQ ID NO: 319776 - DNA, 16 bp, C. familiaris
gatcccagagttccag

SEQ ID NO: 319777 - DNA, 16 bp, C. familiaris
gatcccagagttctgg

SEQ ID NO: 319778 - DNA, 16 bp, C. familiaris
gatcccagggtccgga

SEQ ID NO: 319779 - DNA, 16 bp, C. familiaris
gatcccagggttgtgg

SEQ ID NO: 319780 - DNA, 16 bp, C. familiaris
gatcccatcaaaagac

SEQ ID NO: 319781 - DNA, 16 bp, C. familiaris
gatcccatggtcctag

SEQ ID NO: 319782 - DNA, 16 bp, C. familiaris
gatccccaggatcagg

SEQ ID NO: 319783 - DNA, 16 bp, C. familiaris
gatccccaggtcctgg

SEQ ID NO: 319784 - DNA, 16 bp, C. familiaris
gatcccgaggtcccgg

SEQ ID NO: 319785 - DNA, 16 bp, C. familiaris
gatcccgggaccccag

SEQ ID NO: 319786 - DNA, 16 bp, C. familiaris
gatcccggggccccag

SEQ ID NO: 319787 - DNA, 16 bp, C. familiaris
gatcccggggttttgg

SEQ ID NO: 319788 - DNA, 16 bp, C. familiaris
gatccctgcatggagc

SEQ ID NO: 319789 - DNA, 16 bp, C. familiaris
gatccctggaccccag

SEQ ID NO: 319790 - DNA, 16 bp, C. familiaris
gatccctggccatgac

SEQ ID NO: 319791 - DNA, 16 bp, C. familiaris
gatccctgggccccag

SEQ ID NO: 319792 - DNA, 16 bp, C. familiaris
gatccgaggactccag

SEQ ID NO: 319793 - DNA, 16 bp, C. familiaris
gatccgggagaccctg

SEQ ID NO: 319794 - DNA, 16 bp, C. familiaris
gatcctaagatcatga

SEQ ID NO: 319795 - DNA, 16 bp, C. familiaris
gatcctcaaaagaaag

SEQ ID NO: 319796 - DNA, 16 bp, C. familiaris
gatcctcaggtcctgg

SEQ ID NO: 319797 - DNA, 16 bp, C. familiaris
gatcctgagaccccag

SEQ ID NO: 319798 - DNA, 16 bp, C. familiaris
gatcctgagactccgg

SEQ ID NO: 319799 - DNA, 16 bp, C. familiaris
gatcctgagactgcag

SEQ ID NO: 319800 - DNA, 16 bp, C. familiaris
gatcctggaattccag

SEQ ID NO: 319801 - DNA, 16 bp, C. familiaris
gatcctggaccccggg

SEQ ID NO: 319802 - DNA, 16 bp, C. familiaris
gatcctggactccagg

SEQ ID NO: 319803 - DNA, 16 bp, C. familiaris
gatcctggagaacctg

SEQ ID NO: 319804 - DNA, 16 bp, C. familiaris
gatcctggagaacggg

SEQ ID NO: 319805 - DNA, 19 bp, C. familiaris
gatcctggagaccagggat

SEQ ID NO: 319806 - DNA, 19 bp, C. familiaris
gatcctggagacccgggat

SEQ ID NO: 319807 - DNA, 18 bp, C. familiaris
gatcctggagaccctgga

SEQ ID NO: 319808 - DNA, 16 bp, C. familiaris
gatcctggagacgcgg

SEQ ID NO: 319809 - DNA, 16 bp, C. familiaris
gatcctggagatccag

SEQ ID NO: 319810 - DNA, 16 bp, C. familiaris
gatcctggagatgggg

SEQ ID NO: 319811 - DNA, 16 bp, C. familiaris
gatcctggagccccga

SEQ ID NO: 319812 - DNA, 16 bp, C. familiaris
gatcctggagctccag

SEQ ID NO: 319813 - DNA, 16 bp, C. familiaris
gatcctggagtcccag

SEQ ID NO: 319814 - DNA, 16 bp, C. familiaris
gatcctggagtcccat

SEQ ID NO: 319815 - DNA, 16 bp, C. familiaris
gatcctggagtccccg

SEQ ID NO: 319816 - DNA, 16 bp, C. familiaris
gatcctggagtcgcag

SEQ ID NO: 319817 - DNA, 16 bp, C. familiaris
gatcctggagtctgag

SEQ ID NO: 319818 - DNA, 16 bp, C. familiaris
gatcctggagttcctg

SEQ ID NO: 319819 - DNA, 16 bp, C. familiaris
gatcctggagttgcag

SEQ ID NO: 319820 - DNA, 16 bp, C. familiaris
gatcctggcatcctgg

SEQ ID NO: 319821 - DNA, 16 bp, C. familiaris
gatcctgggactccaa

SEQ ID NO: 319822 - DNA, 16 bp, C. familiaris
gatcctgggactccag

SEQ ID NO: 319823 - DNA, 16 bp, C. familiaris
gatcctgggactcctg

SEQ ID NO: 319824 - DNA, 16 bp, C. familiaris
gatcctgggatcttgg

SEQ ID NO: 319825 - DNA, 16 bp, C. familiaris
gatcctgggattccag

SEQ ID NO: 319826 - DNA, 16 bp, C. familiaris
gatcctgggctccctg

SEQ ID NO: 319827 - DNA, 17 bp, C. familiaris
gatcctgggctgtgtcc

SEQ ID NO: 319828 - DNA, 16 bp, C. familiaris
gatcctggggcccagg

SEQ ID NO: 319829 - DNA, 16 bp, C. familiaris
gatcctggggccccag

SEQ ID NO: 319830 - DNA, 16 bp, C. familiaris
gatcctggggcctggg

SEQ ID NO: 319831 - DNA, 16 bp, C. familiaris
gatcctgggggcctgg

SEQ ID NO: 319832 - DNA, 16 bp, C. familiaris
gatcctggggtcccac

SEQ ID NO: 319833 - DNA, 16 bp, C. familiaris
gatcctggttctccag

SEQ ID NO: 319834 - DNA, 16 bp, C. familiaris
gatcctgttttgtttc

SEQ ID NO: 319835 - DNA, 16 bp, C. familiaris
gatcgaggcccgcatc

SEQ ID NO: 319836 - DNA, 16 bp, C. familiaris
gatcgagttctgcgtt

SEQ ID NO: 319837 - DNA, 16 bp, C. familiaris
gatctatttattcatg

SEQ ID NO: 319838 - DNA, 16 bp, C. familiaris
gatctcaagaccccaa

SEQ ID NO: 319839 - DNA, 16 bp, C. familiaris
gatctcaagatggctg

SEQ ID NO: 319840 - DNA, 16 bp, C. familiaris
gatctcaaggtcttga

SEQ ID NO: 319841 - DNA, 16 bp, C. familiaris
gatctcacaatgctga

SEQ ID NO: 319842 - DNA, 16 bp, C. familiaris
gatctcaccctgggcc

SEQ ID NO: 319843 - DNA, 16 bp, C. familiaris
gatctccaggaccagc

SEQ ID NO: 319844 - DNA, 16 bp, C. familiaris
gatctcggggtgctgg

SEQ ID NO: 319845 - DNA, 16 bp, C. familiaris
gatctgaagagaaacc

SEQ ID NO: 319846 - DNA, 16 bp, C. familiaris
gatctgggcagcccgg

SEQ ID NO: 319847 - DNA, 16 bp, C. familiaris
gatctgtactctgaaa

SEQ ID NO: 319848 - DNA, 16 bp, C. familiaris
gatcttgagcaaatca

SEQ ID NO: 319849 - DNA, 16 bp, C. familiaris
gatcttggagaccagg

SEQ ID NO: 319850 - DNA, 16 bp, C. familiaris
gatcttggggccatga

SEQ ID NO: 319851 - DNA, 16 bp, C. familiaris
gatctttttaaagaac

SEQ ID NO: 319852 - DNA, 16 bp, C. familiaris
gatgaaagaactaaat

SEQ ID NO: 319853 - DNA, 16 bp, C. familiaris
gatgaaagacattgaa

SEQ ID NO: 319854 - DNA, 16 bp, C. familiaris
gatgaaattcacataa

SEQ ID NO: 319855 - DNA, 16 bp, C. familiaris
gatgaacaaggatgca

SEQ ID NO: 319856 - DNA, 16 bp, C. familiaris
gatgaacctcgaggac

SEQ ID NO: 319857 - DNA, 16 bp, C. familiaris
gatgaaccttgaggac

SEQ ID NO: 319858 - DNA, 16 bp, C. familiaris
gatgaactcaaagaga

SEQ ID NO: 319859 - DNA, 16 bp, C. familiaris
gatgaagaaaatgagg

SEQ ID NO: 319860 - DNA, 16 bp, C. familiaris
gatgaagaaagtgagg

SEQ ID NO: 319861 - DNA, 16 bp, C. familiaris
gatgaagaaatggaga

SEQ ID NO: 319862 - DNA, 16 bp, C. familiaris
gatgaagaagatgaag

SEQ ID NO: 319863 - DNA, 16 bp, C. familiaris
gatgaagaagatgtgg

SEQ ID NO: 319864 - DNA, 16 bp, C. familiaris
gatgaagagatatata

SEQ ID NO: 319865 - DNA, 16 bp, C. familiaris
gatgaagagtcagatg

SEQ ID NO: 319866 - DNA, 16 bp, C. familiaris
gatgaagatgaagatg

SEQ ID NO: 319867 - DNA, 16 bp, C. familiaris
gatgaagcagaagaaa

SEQ ID NO: 319868 - DNA, 16 bp, C. familiaris
gatgaaggcagagatg

SEQ ID NO: 319869 - DNA, 16 bp, C. familiaris
gatgaatctcacaaat

SEQ ID NO: 319870 - DNA, 16 bp, C. familiaris
gatgaatggataaaga

SEQ ID NO: 319871 - DNA, 16 bp, C. familiaris
gatgagaaaaccaagg

SEQ ID NO: 319872 - DNA, 16 bp, C. familiaris
gatgagaaaactgggg

SEQ ID NO: 319873 - DNA, 16 bp, C. familiaris
gatgagaaaagtgaga

SEQ ID NO: 319874 - DNA, 16 bp, C. familiaris
gatgagaaaattaaag

SEQ ID NO: 319875 - DNA, 16 bp, C. familiaris
gatgagaaaattgaag

SEQ ID NO: 319876 - DNA, 16 bp, C. familiaris
gatgagagtggacatc

SEQ ID NO: 319877 - DNA, 16 bp, C. familiaris
gatgaggaaaatgaag

SEQ ID NO: 319878 - DNA, 16 bp, C. familiaris
gatgaggaaaatgagg

SEQ ID NO: 319879 - DNA, 16 bp, C. familiaris
gatgaggaaacagagt

SEQ ID NO: 319880 - DNA, 16 bp, C. familiaris
gatgaggaaacaggcc

SEQ ID NO: 319881 - DNA, 16 bp, C. familiaris
gatgaggaaaccgaga

SEQ ID NO: 319882 - DNA, 16 bp, C. familiaris
gatgaggaaactgaag

SEQ ID NO: 319883 - DNA, 16 bp, C. familiaris
gatgaggaaatagagg

SEQ ID NO: 319884 - DNA, 16 bp, C. familiaris
gatgaggaaatggaag

SEQ ID NO: 319885 - DNA, 16 bp, C. familiaris
gatgaggaaattgaag

SEQ ID NO: 319886 - DNA, 16 bp, C. familiaris
gatgaggaaattgaga

SEQ ID NO: 319887 - DNA, 16 bp, C. familiaris
gatgaggaagccaagg

SEQ ID NO: 319888 - DNA, 16 bp, C. familiaris
gatgaggaatctgagg

SEQ ID NO: 319889 - DNA, 16 bp, C. familiaris
gatgaggaatttgatc

SEQ ID NO: 319890 - DNA, 16 bp, C. familiaris
gatgaggagactgagg

SEQ ID NO: 319891 - DNA, 16 bp, C. familiaris
gatgaggagcagaggg

SEQ ID NO: 319892 - DNA, 16 bp, C. familiaris
gatgaggatgaaggag

SEQ ID NO: 319893 - DNA, 16 bp, C. familiaris
gatgaggatgaggatg

SEQ ID NO: 319894 - DNA, 16 bp, C. familiaris
gatgaggatgctgagg

SEQ ID NO: 319895 - DNA, 16 bp, C. familiaris
gatgaggatggtgatg

SEQ ID NO: 319896 - DNA, 16 bp, C. familiaris
gatgaggatgtggaga

SEQ ID NO: 319897 - DNA, 16 bp, C. familiaris
gatgaggctggagaag

SEQ ID NO: 319898 - DNA, 16 bp, C. familiaris
gatgagtaaactgagg

SEQ ID NO: 319899 - DNA, 16 bp, C. familiaris
gatgataaaatgtcta

SEQ ID NO: 319900 - DNA, 16 bp, C. familiaris
gatgataatgataatg

SEQ ID NO: 319901 - DNA, 16 bp, C. familiaris
gatgataatgatgatg

SEQ ID NO: 319902 - DNA, 16 bp, C. familiaris
gatgatattaggaggt

SEQ ID NO: 319903 - DNA, 16 bp, C. familiaris
gatgatgaaactgaag

SEQ ID NO: 319904 - DNA, 16 bp, C. familiaris
gatgatgaagatgatg

SEQ ID NO: 319905 - DNA, 16 bp, C. familiaris
gatgatgacaatgaca

SEQ ID NO: 319906 - DNA, 16 bp, C. familiaris
gatgatgacgacgatg

SEQ ID NO: 319907 - DNA, 16 bp, C. familiaris
gatgatgacgatgatg

SEQ ID NO: 319908 - DNA, 16 bp, C. familiaris
gatgatgaggatgatg

SEQ ID NO: 319909 - DNA, 16 bp, C. familiaris
gatgatgatgacgacg

SEQ ID NO: 319910 - DNA, 16 bp, C. familiaris
gatgatgatgaggagg

SEQ ID NO: 319911 - DNA, 16 bp, C. familiaris
gatgatgatgaggatg

SEQ ID NO: 319912 - DNA, 16 bp, C. familiaris
gatgatgatgataaaa

SEQ ID NO: 319913 - DNA, 16 bp, C. familiaris
gatgatgatgatagca

SEQ ID NO: 319914 - DNA, 16 bp, C. familiaris
gatgatgatgatgaat

SEQ ID NO: 319915 - DNA, 16 bp, C. familiaris
gatgatgatgatgacg

SEQ ID NO: 319916 - DNA, 16 bp, C. familiaris
gatgatgatgatgact

SEQ ID NO: 319917 - DNA, 16 bp, C. familiaris
gatgatgatgatgata

SEQ ID NO: 319918 - DNA, 16 bp, C. familiaris
gatgatgatgatgtta

SEQ ID NO: 319919 - DNA, 16 bp, C. familiaris
gatgatgatgattttg

SEQ ID NO: 319920 - DNA, 16 bp, C. familiaris
gatgatgatggagatg

SEQ ID NO: 319921 - DNA, 16 bp, C. familiaris
gatgatgctgatgctg

SEQ ID NO: 319922 - DNA, 16 bp, C. familiaris
gatgatggaaatgttt

SEQ ID NO: 319923 - DNA, 16 bp, C. familiaris
gatgatggtagtgatg

SEQ ID NO: 319924 - DNA, 16 bp, C. familiaris
gatgatggtgatggta

SEQ ID NO: 319925 - DNA, 16 bp, C. familiaris
gatgatggtgatggtg

SEQ ID NO: 319926 - DNA, 16 bp, C. familiaris
gatgatgtccaagcag

SEQ ID NO: 319927 - DNA, 16 bp, C. familiaris
gatgcagaagaatgga

SEQ ID NO: 319928 - DNA, 38 bp, C. familiaris
gatgcagagaaagcatttgacaaaatacagcatccatt

SEQ ID NO: 319929 - DNA, 16 bp, C. familiaris
gatgcagatatctctt

SEQ ID NO: 319930 - DNA, 16 bp, C. familiaris
gatgcagcaaaagctg

SEQ ID NO: 319931 - DNA, 16 bp, C. familiaris
gatgcagcaaaggtgg

SEQ ID NO: 319932 - DNA, 16 bp, C. familiaris
gatgcagggaaagcat

SEQ ID NO: 319933 - DNA, 16 bp, C. familiaris
gatgcatttctggaaa

SEQ ID NO: 319934 - DNA, 16 bp, C. familiaris
gatgccctcaggttcc

SEQ ID NO: 319935 - DNA, 16 bp, C. familiaris
gatgccctggggctcc

SEQ ID NO: 319936 - DNA, 16 bp, C. familiaris
gatgcctgaaactgtg

SEQ ID NO: 319937 - DNA, 16 bp, C. familiaris
gatgcctggctggctt

SEQ ID NO: 319938 - DNA, 16 bp, C. familiaris
gatgccttttgtttat

SEQ ID NO: 319939 - DNA, 16 bp, C. familiaris
gatgcgggacttggtc

SEQ ID NO: 319940 - DNA, 16 bp, C. familiaris
gatgctcaacctcact

SEQ ID NO: 319941 - DNA, 16 bp, C. familiaris
gatgctcaatcccagg

SEQ ID NO: 319942 - DNA, 16 bp, C. familiaris
gatgctcaatgctgag

SEQ ID NO: 319943 - DNA, 16 bp, C. familiaris
gatgctgagaaatgtt

SEQ ID NO: 319944 - DNA, 16 bp, C. familiaris
gatgctgagatcaaga

SEQ ID NO: 319945 - DNA, 16 bp, C. familiaris
gatgctgatgctgatg

SEQ ID NO: 319946 - DNA, 16 bp, C. familiaris
gatgctgatgctgctg

SEQ ID NO: 319947 - DNA, 16 bp, C. familiaris
gatgctgctgatgctg

SEQ ID NO: 319948 - DNA, 16 bp, C. familiaris
gatgctgctgttgctg

SEQ ID NO: 319949 - DNA, 16 bp, C. familiaris
gatgctggcaaggatg

SEQ ID NO: 319950 - DNA, 16 bp, C. familiaris
gatgctggtgaggatg

SEQ ID NO: 319951 - DNA, 16 bp, C. familiaris
gatgctggtgctgctg

SEQ ID NO: 319952 - DNA, 16 bp, C. familiaris
gatgcttaacagattg

SEQ ID NO: 319953 - DNA, 16 bp, C. familiaris
gatgcttagccagctg

SEQ ID NO: 319954 - DNA, 16 bp, C. familiaris
gatggaaaaacattta

SEQ ID NO: 319955 - DNA, 16 bp, C. familiaris
gatggaaaagttctgg

SEQ ID NO: 319956 - DNA, 16 bp, C. familiaris
gatggaacaggagggt

SEQ ID NO: 319957 - DNA, 16 bp, C. familiaris
gatggaactgtagggt

SEQ ID NO: 319958 - DNA, 16 bp, C. familiaris
gatggaagaaattgaa

SEQ ID NO: 319959 - DNA, 16 bp, C. familiaris
gatggacagaggcatt

SEQ ID NO: 319960 - DNA, 16 bp, C. familiaris
gatggacagatggatg

SEQ ID NO: 319961 - DNA, 16 bp, C. familiaris
gatggagaaacagagg

SEQ ID NO: 319962 - DNA, 16 bp, C. familiaris
gatggagagagaggca

SEQ ID NO: 319963 - DNA, 16 bp, C. familiaris
gatggagagatggatg

SEQ ID NO: 319964 - DNA, 16 bp, C. familiaris
gatggagctccacatc

SEQ ID NO: 319965 - DNA, 16 bp, C. familiaris
gatggagctccacatt

SEQ ID NO: 319966 - DNA, 16 bp, C. familiaris
gatggagggctccatc

SEQ ID NO: 319967 - DNA, 16 bp, C. familiaris
gatggaggggcagagg

SEQ ID NO: 319968 - DNA, 16 bp, C. familiaris
gatggagtcactgaat

SEQ ID NO: 319969 - DNA, 16 bp, C. familiaris
gatggagtcccacatc

SEQ ID NO: 319970 - DNA, 16 bp, C. familiaris
gatggagtcccacttg

SEQ ID NO: 319971 - DNA, 16 bp, C. familiaris
gatggatcactgaatt

SEQ ID NO: 319972 - DNA, 16 bp, C. familiaris
gatggatggatgaaaa

SEQ ID NO: 319973 - DNA, 16 bp, C. familiaris
gatggatggatggatg

SEQ ID NO: 319974 - DNA, 16 bp, C. familiaris
gatggccaagaaagaa

SEQ ID NO: 319975 - DNA, 16 bp, C. familiaris
gatggctctgtcagtt

SEQ ID NO: 319976 - DNA, 16 bp, C. familiaris
gatggctgccttctct

SEQ ID NO: 319977 - DNA, 16 bp, C. familiaris
gatggcttccctgggg

SEQ ID NO: 319978 - DNA, 16 bp, C. familiaris
gatggctttgaagatg

SEQ ID NO: 319979 - DNA, 16 bp, C. familiaris
gatgggaaaattgagg

SEQ ID NO: 319980 - DNA, 16 bp, C. familiaris
gatgggaaggaaaaat

SEQ ID NO: 319981 - DNA, 16 bp, C. familiaris
gatgggatcctggaga

SEQ ID NO: 319982 - DNA, 16 bp, C. familiaris
gatgggcagatggatg

SEQ ID NO: 319983 - DNA, 16 bp, C. familiaris
gatgggcagggggatg

SEQ ID NO: 319984 - DNA, 16 bp, C. familiaris
gatgggcattaaagaa

SEQ ID NO: 319985 - DNA, 16 bp, C. familiaris
gatgggctccctgctc

SEQ ID NO: 319986 - DNA, 16 bp, C. familiaris
gatggggacttgatcc

SEQ ID NO: 319987 - DNA, 16 bp, C. familiaris
gatggggataaaggag

SEQ ID NO: 319988 - DNA, 16 bp, C. familiaris
gatgggggcacttggc

SEQ ID NO: 319989 - DNA, 16 bp, C. familiaris
gatggggtgactgagt

SEQ ID NO: 319990 - DNA, 16 bp, C. familiaris
gatggtgatgataatg

SEQ ID NO: 319991 - DNA, 16 bp, C. familiaris
gatggtgatgatgata

SEQ ID NO: 319992 - DNA, 16 bp, C. familiaris
gatggtgggacttgat

SEQ ID NO: 319993 - DNA, 16 bp, C. familiaris
gatggtggtgaggatg

SEQ ID NO: 319994 - DNA, 16 bp, C. familiaris
gatggttaccagaggt

SEQ ID NO: 319995 - DNA, 16 bp, C. familiaris
gatggttgccagagga

SEQ ID NO: 319996 - DNA, 16 bp, C. familiaris
gatggttgccagaggg

SEQ ID NO: 319997 - DNA, 16 bp, C. familiaris
gatggttttattaaag

SEQ ID NO: 319998 - DNA, 16 bp, C. familiaris
gatgtatcttgcaaga

SEQ ID NO: 319999 - DNA, 16 bp, C. familiaris
gatgtattctggagaa

SEQ ID NO: 320000 - DNA, 16 bp, C. familiaris
gatgtcacttccaaga

SEQ ID NO: 320001 - DNA, 16 bp, C. familiaris
gatgtcttttctttct

SEQ ID NO: 320002 - DNA, 16 bp, C. familiaris
gatgtgaagaaagggg

SEQ ID NO: 320003 - DNA, 16 bp, C. familiaris
gatgtgatcctagaga

SEQ ID NO: 320004 - DNA, 16 bp, C. familiaris
gatgtgccacagttta

SEQ ID NO: 320005 - DNA, 16 bp, C. familiaris
gatgtgctgtcatcca

SEQ ID NO: 320006 - DNA, 16 bp, C. familiaris
gatgtggaaaacaaag

SEQ ID NO: 320007 - DNA, 16 bp, C. familiaris
gatgtggagaaaatgg

SEQ ID NO: 320008 - DNA, 16 bp, C. familiaris
gatgtggagaaactga

SEQ ID NO: 320009 - DNA, 16 bp, C. familiaris
gatgtggagaaagcag

SEQ ID NO: 320010 - DNA, 16 bp, C. familiaris
gatgtggagaaaggag

SEQ ID NO: 320011 - DNA, 16 bp, C. familiaris
gatgtggagaacaaag

SEQ ID NO: 320012 - DNA, 16 bp, C. familiaris
gatgtggccaaggtca

SEQ ID NO: 320013 - DNA, 16 bp, C. familiaris
gatgtgggactggacc

SEQ ID NO: 320014 - DNA, 16 bp, C. familiaris
gatgtggtggaaagag

SEQ ID NO: 320015 - DNA, 16 bp, C. familiaris
gatgtgttttatttct

SEQ ID NO: 320016 - DNA, 16 bp, C. familiaris
gatgttacaaaatcat

SEQ ID NO: 320017 - DNA, 16 bp, C. familiaris
gatgttcatcaacaga

SEQ ID NO: 320018 - DNA, 16 bp, C. familiaris
gatgttgagcagtttt

SEQ ID NO: 320019 - DNA, 16 bp, C. familiaris
gatgttgatgaggatg

SEQ ID NO: 320020 - DNA, 16 bp, C. familiaris
gatgttgatgatgatg

SEQ ID NO: 320021 - DNA, 16 bp, C. familiaris
gatgttgatggtgatg

SEQ ID NO: 320022 - DNA, 16 bp, C. familiaris
gatgttggtgaggatg

SEQ ID NO: 320023 - DNA, 16 bp, C. familiaris
gatgttgtacacctga

SEQ ID NO: 320024 - DNA, 16 bp, C. familiaris
gatgtttgctgtgggt

SEQ ID NO: 320025 - DNA, 16 bp, C. familiaris
gatgtttggaaaacaa

SEQ ID NO: 320026 - DNA, 16 bp, C. familiaris
gattaaaagggaaagg

SEQ ID NO: 320027 - DNA, 16 bp, C. familiaris
gattaaatgagcaaat

SEQ ID NO: 320028 - DNA, 16 bp, C. familiaris
gattatgacttgagcc

SEQ ID NO: 320029 - DNA, 16 bp, C. familiaris
gattatggtgtatgat

SEQ ID NO: 320030 - DNA, 16 bp, C. familiaris
gattcagattcagatt

SEQ ID NO: 320031 - DNA, 16 bp, C. familiaris
gattcagctcccacag

SEQ ID NO: 320032 - DNA, 16 bp, C. familiaris
gattccaaaaccaaag

SEQ ID NO: 320033 - DNA, 16 bp, C. familiaris
gattccagacttcaag

SEQ ID NO: 320034 - DNA, 16 bp, C. familiaris
gattccctgctgagcg

SEQ ID NO: 320035 - DNA, 16 bp, C. familiaris
gattctacatacaagt

SEQ ID NO: 320036 - DNA, 16 bp, C. familiaris
gattctctctcctccc

SEQ ID NO: 320037 - DNA, 23 bp, C. familiaris
gattctctggtcattgagcacat

SEQ ID NO: 320038 - DNA, 16 bp, C. familiaris
gattctgatgcaggtg

SEQ ID NO: 320039 - DNA, 16 bp, C. familiaris
gattctggagtccctg

SEQ ID NO: 320040 - DNA, 16 bp, C. familiaris
gattctgggatgcctg

SEQ ID NO: 320041 - DNA, 16 bp, C. familiaris
gattgagaaagagaga

SEQ ID NO: 320042 - DNA, 16 bp, C. familiaris
gattgagcccctcatc

SEQ ID NO: 320043 - DNA, 16 bp, C. familiaris
gattgagctctgcatc

SEQ ID NO: 320044 - DNA, 16 bp, C. familiaris
gattgaggagtgcact

SEQ ID NO: 320045 - DNA, 16 bp, C. familiaris
gattgagtcctgcctc

SEQ ID NO: 320046 - DNA, 16 bp, C. familiaris
gattgatgaaatcatt

SEQ ID NO: 320047 - DNA, 16 bp, C. familiaris
gattgctagaactcac

SEQ ID NO: 320048 - DNA, 16 bp, C. familiaris
gattgcttcctttgct

SEQ ID NO: 320049 - DNA, 16 bp, C. familiaris
gattggaagaacagat

SEQ ID NO: 320050 - DNA, 16 bp, C. familiaris
gattggaagaatttat

SEQ ID NO: 320051 - DNA, 16 bp, C. familiaris
gattggattgtttgct

SEQ ID NO: 320052 - DNA, 16 bp, C. familiaris
gattggcttctctcac

SEQ ID NO: 320053 - DNA, 16 bp, C. familiaris
gattgggtcctgcatc

SEQ ID NO: 320054 - DNA, 16 bp, C. familiaris
gattgtctccctctgc

SEQ ID NO: 320055 - DNA, 16 bp, C. familiaris
gattgtgatctgagct

SEQ ID NO: 320056 - DNA, 16 bp, C. familiaris
gatttaacagatattt

SEQ ID NO: 320057 - DNA, 16 bp, C. familiaris
gatttactaatatttt

SEQ ID NO: 320058 - DNA, 16 bp, C. familiaris
gatttatgtatacaat

SEQ ID NO: 320059 - DNA, 16 bp, C. familiaris
gatttattataaagct

SEQ ID NO: 320060 - DNA, 16 bp, C. familiaris
gatttattcctgggct

SEQ ID NO: 320061 - DNA, 16 bp, C. familiaris
gatttatttcagagag

SEQ ID NO: 320062 - DNA, 16 bp, C. familiaris
gatttattttgaggaa

SEQ ID NO: 320063 - DNA, 16 bp, C. familiaris
gatttcaattcttttg

SEQ ID NO: 320064 - DNA, 16 bp, C. familiaris
gatttcagggttgtgg

SEQ ID NO: 320065 - DNA, 16 bp, C. familiaris
gatttcattcattttt

SEQ ID NO: 320066 - DNA, 16 bp, C. familiaris
gatttcattcttattt

SEQ ID NO: 320067 - DNA, 16 bp, C. familiaris
gatttcctttgctgtg

SEQ ID NO: 320068 - DNA, 16 bp, C. familiaris
gatttctcttatatgt

SEQ ID NO: 320069 - DNA, 16 bp, C. familiaris
gatttgacaccaaaaa

SEQ ID NO: 320070 - DNA, 16 bp, C. familiaris
gatttggagttttgaa

SEQ ID NO: 320071 - DNA, 16 bp, C. familiaris
gatttggggatccctg

SEQ ID NO: 320072 - DNA, 16 bp, C. familiaris
gatttgtccatttctt

SEQ ID NO: 320073 - DNA, 16 bp, C. familiaris
gattttacttattcat

SEQ ID NO: 320074 - DNA, 16 bp, C. familiaris
gattttagaaaaagaa

SEQ ID NO: 320075 - DNA, 16 bp, C. familiaris
gattttatttgagaca

SEQ ID NO: 320076 - DNA, 16 bp, C. familiaris
gattttcaacaaaagt

SEQ ID NO: 320077 - DNA, 16 bp, C. familiaris
gattttcagatgttaa

SEQ ID NO: 320078 - DNA, 16 bp, C. familiaris
gattttccctttatct

SEQ ID NO: 320079 - DNA, 16 bp, C. familiaris
gattttggatcattgt

SEQ ID NO: 320080 - DNA, 16 bp, C. familiaris
gattttggctccagtc

SEQ ID NO: 320081 - DNA, 16 bp, C. familiaris
gattttgtttacttga

SEQ ID NO: 320082 - DNA, 16 bp, C. familiaris
gatttttaaaaatgct

SEQ ID NO: 320083 - DNA, 16 bp, C. familiaris
gatttttacttattta

SEQ ID NO: 320084 - DNA, 16 bp, C. familiaris
gatttttatttccatt

SEQ ID NO: 320085 - DNA, 16 bp, C. familiaris
gatttttcttcttcag

SEQ ID NO: 320086 - DNA, 16 bp, C. familiaris
gcaaaaataatacaga

SEQ ID NO: 320087 - DNA, 16 bp, C. familiaris
gcaaaaatatttgcaa

SEQ ID NO: 320088 - DNA, 16 bp, C. familiaris
gcaaaatgagaataaa

SEQ ID NO: 320089 - DNA, 16 bp, C. familiaris
gcaaaatgggggaagg

SEQ ID NO: 320090 - DNA, 16 bp, C. familiaris
gcaaaattgaaactct

SEQ ID NO: 320091 - DNA, 16 bp, C. familiaris
gcaaaccactgagcca

SEQ ID NO: 320092 - DNA, 16 bp, C. familiaris
gcaaacttttctgtaa

SEQ ID NO: 320093 - DNA, 16 bp, C. familiaris
gcaaagaaattgaatt

SEQ ID NO: 320094 - DNA, 16 bp, C. familiaris
gcaaagacacaggcag

SEQ ID NO: 320095 - DNA, 16 bp, C. familiaris
gcaaagagaagaaaat

SEQ ID NO: 320096 - DNA, 16 bp, C. familiaris
gcaaagagtagagaga

SEQ ID NO: 320097 - DNA, 16 bp, C. familiaris
gcaaagatgtggagaa

SEQ ID NO: 320098 - DNA, 16 bp, C. familiaris
gcaaagcaaggaaatt

SEQ ID NO: 320099 - DNA, 16 bp, C. familiaris
gcaaaggaaacaacag

SEQ ID NO: 320100 - DNA, 16 bp, C. familiaris
gcaaaggaaaccaaca

SEQ ID NO: 320101 - DNA, 16 bp, C. familiaris
gcaaaggaagaagcag

SEQ ID NO: 320102 - DNA, 16 bp, C. familiaris
gcaaaggcagaagcag

SEQ ID NO: 320103 - DNA, 16 bp, C. familiaris
gcaaaggccctggggc

SEQ ID NO: 320104 - DNA, 16 bp, C. familiaris
gcaaagggaggagcag

SEQ ID NO: 320105 - DNA, 16 bp, C. familiaris
gcaaataaaaaccaca

SEQ ID NO: 320106 - DNA, 16 bp, C. familiaris
gcaaatacttaaccaa

SEQ ID NO: 320107 - DNA, 16 bp, C. familiaris
gcaaatataaactatt

SEQ ID NO: 320108 - DNA, 16 bp, C. familiaris
gcaaatatcttctctg

SEQ ID NO: 320109 - DNA, 16 bp, C. familiaris
gcaaatcacaaccaca

SEQ ID NO: 320110 - DNA, 16 bp, C. familiaris
gcaaatgaaaatgaaa

SEQ ID NO: 320111 - DNA, 16 bp, C. familiaris
gcaaatgacatatatg

SEQ ID NO: 320112 - DNA, 16 bp, C. familiaris
gcaaatggaaggattt

SEQ ID NO: 320113 - DNA, 16 bp, C. familiaris
gcaaatggcagagctg

SEQ ID NO: 320114 - DNA, 16 bp, C. familiaris
gcaaatgtgacaaaat

SEQ ID NO: 320115 - DNA, 16 bp, C. familiaris
gcaaattaaaacaaga

SEQ ID NO: 320116 - DNA, 16 bp, C. familiaris
gcaaattgaactccag

SEQ ID NO: 320117 - DNA, 16 bp, C. familiaris
gcaacagcagcagcaa

SEQ ID NO: 320118 - DNA, 16 bp, C. familiaris
gcaacatccaaagcat

SEQ ID NO: 320119 - DNA, 16 bp, C. familiaris
gcaacattattcacaa

SEQ ID NO: 320120 - DNA, 16 bp, C. familiaris
gcaaccctggtggctc

SEQ ID NO: 320121 - DNA, 16 bp, C. familiaris
gcaactttactgaatt

SEQ ID NO: 320122 - DNA, 16 bp, C. familiaris
gcaagaaaaagaagta

SEQ ID NO: 320123 - DNA, 16 bp, C. familiaris
gcaagaacagaagcag

SEQ ID NO: 320124 - DNA, 16 bp, C. familiaris
gcaagaactgaaagaa

SEQ ID NO: 320125 - DNA, 17 bp, C. familiaris
gcaagaagttcctgtgg

SEQ ID NO: 320126 - DNA, 16 bp, C. familiaris
gcaagaatatggagaa

SEQ ID NO: 320127 - DNA, 16 bp, C. familiaris
gcaagagaaaaaccca

SEQ ID NO: 320128 - DNA, 16 bp, C. familiaris
gcaagagaaaaatgac

SEQ ID NO: 320129 - DNA, 16 bp, C. familiaris
gcaagagaatctcaag

SEQ ID NO: 320130 - DNA, 16 bp, C. familiaris
gcaagagagcaagaga

SEQ ID NO: 320131 - DNA, 16 bp, C. familiaris
gcaagagcagagggag

SEQ ID NO: 320132 - DNA, 16 bp, C. familiaris
gcaagaggaggagcag

SEQ ID NO: 320133 - DNA, 16 bp, C. familiaris
gcaagattttattttt

SEQ ID NO: 320134 - DNA, 16 bp, C. familiaris
gcaagcagggggagca

SEQ ID NO: 320135 - DNA, 16 bp, C. familiaris
gcaagctccccactga

SEQ ID NO: 320136 - DNA, 16 bp, C. familiaris
gcaaggacacaggcag

SEQ ID NO: 320137 - DNA, 16 bp, C. familiaris
gcaaggagactgcttc

SEQ ID NO: 320138 - DNA, 16 bp, C. familiaris
gcaaggatacagaaaa

SEQ ID NO: 320139 - DNA, 16 bp, C. familiaris
gcaaggggagctgcag

SEQ ID NO: 320140 - DNA, 16 bp, C. familiaris
gcaagtcaggaagaga

SEQ ID NO: 320141 - DNA, 16 bp, C. familiaris
gcaagtgatgcagaac

SEQ ID NO: 320142 - DNA, 16 bp, C. familiaris
gcaagttactttacct

SEQ ID NO: 320143 - DNA, 16 bp, C. familiaris
gcaagttgaacaccaa

SEQ ID NO: 320144 - DNA, 16 bp, C. familiaris
gcaataaacatgggag

SEQ ID NO: 320145 - DNA, 16 bp, C. familiaris
gcaatatctcattctt

SEQ ID NO: 320146 - DNA, 16 bp, C. familiaris
gcaatcctcagtttgt

SEQ ID NO: 320147 - DNA, 16 bp, C. familiaris
gcaatcctgaaaaaga

SEQ ID NO: 320148 - DNA, 16 bp, C. familiaris
gcaatgaaaatgaaca

SEQ ID NO: 320149 - DNA, 16 bp, C. familiaris
gcaatgaacatgggag

SEQ ID NO: 320150 - DNA, 16 bp, C. familiaris
gcaatgcaagcatcca

SEQ ID NO: 320151 - DNA, 16 bp, C. familiaris
gcaatggtttcttaga

SEQ ID NO: 320152 - DNA, 16 bp, C. familiaris
gcaatgtcctcaatag

SEQ ID NO: 320153 - DNA, 16 bp, C. familiaris
gcaattactggattat

SEQ ID NO: 320154 - DNA, 16 bp, C. familiaris
gcaattcaatggagaa

SEQ ID NO: 320155 - DNA, 16 bp, C. familiaris
gcaattccctgatgat

SEQ ID NO: 320156 - DNA, 16 bp, C. familiaris
gcaattcctcaaaaag

SEQ ID NO: 320157 - DNA, 16 bp, C. familiaris
gcaattctatgtttaa

SEQ ID NO: 320158 - DNA, 16 bp, C. familiaris
gcaattgcactccttg

SEQ ID NO: 320159 - DNA, 16 bp, C. familiaris
gcacaaatgtttttaa

SEQ ID NO: 320160 - DNA, 16 bp, C. familiaris
gcacaagcagaggaag

SEQ ID NO: 320161 - DNA, 16 bp, C. familiaris
gcacaagcaggaggag

SEQ ID NO: 320162 - DNA, 16 bp, C. familiaris
gcacaagcaggaggtg

SEQ ID NO: 320163 - DNA, 16 bp, C. familiaris
gcacaagcaggcagag

SEQ ID NO: 320164 - DNA, 16 bp, C. familiaris
gcacaagcaggggcag

SEQ ID NO: 320165 - DNA, 16 bp, C. familiaris
gcacaaggagaagcag

SEQ ID NO: 320166 - DNA, 16 bp, C. familiaris
gcacaaggaggaggag

SEQ ID NO: 320167 - DNA, 16 bp, C. familiaris
gcacaattataaagtt

SEQ ID NO: 320168 - DNA, 16 bp, C. familiaris
gcacacacacacatgc

SEQ ID NO: 320169 - DNA, 16 bp, C. familiaris
gcacacacacgcacac

SEQ ID NO: 320170 - DNA, 16 bp, C. familiaris
gcacacagacacacac

SEQ ID NO: 320171 - DNA, 16 bp, C. familiaris
gcacacagctcctaaa

SEQ ID NO: 320172 - DNA, 16 bp, C. familiaris
gcacacatgcacacac

SEQ ID NO: 320173 - DNA, 16 bp, C. familiaris
gcacagacacagggag

SEQ ID NO: 320174 - DNA, 16 bp, C. familiaris
gcacagactctggagc

SEQ ID NO: 320175 - DNA, 16 bp, C. familiaris
gcacagagcctcttcc

SEQ ID NO: 320176 - DNA, 16 bp, C. familiaris
gcacagagcctggtgc

SEQ ID NO: 320177 - DNA, 16 bp, C. familiaris
gcacagaggaatttta

SEQ ID NO: 320178 - DNA, 16 bp, C. familiaris
gcacagcaaaggaaag

SEQ ID NO: 320179 - DNA, 16 bp, C. familiaris
gcacagcagaggaaat

SEQ ID NO: 320180 - DNA, 16 bp, C. familiaris
gcacagcagcagcagc

SEQ ID NO: 320181 - DNA, 16 bp, C. familiaris
gcacaggaagaagcag

SEQ ID NO: 320182 - DNA, 16 bp, C. familiaris
gcacaggacagcaagg

SEQ ID NO: 320183 - DNA, 16 bp, C. familiaris
gcacaggacagcccct

SEQ ID NO: 320184 - DNA, 16 bp, C. familiaris
gcacaggctctggggt

SEQ ID NO: 320185 - DNA, 16 bp, C. familiaris
gcacagggactccctc

SEQ ID NO: 320186 - DNA, 16 bp, C. familiaris
gcacagggcgctggga

SEQ ID NO: 320187 - DNA, 16 bp, C. familiaris
gcacagtcagcctgag

SEQ ID NO: 320188 - DNA, 16 bp, C. familiaris
gcacagtgaagaaaac

SEQ ID NO: 320189 - DNA, 16 bp, C. familiaris
gcacagtgcatggcac

SEQ ID NO: 320190 - DNA, 16 bp, C. familiaris
gcacagtgcctgggac

SEQ ID NO: 320191 - DNA, 16 bp, C. familiaris
gcacagtggggaggag

SEQ ID NO: 320192 - DNA, 16 bp, C. familiaris
gcacagtgtgtgtgtg

SEQ ID NO: 320193 - DNA, 16 bp, C. familiaris
gcacagttcaaaccca

SEQ ID NO: 320194 - DNA, 16 bp, C. familiaris
gcacatagtaagaact

SEQ ID NO: 320195 - DNA, 33 bp, C. familiaris
gcacatggaactttctccagaatagaccacata

SEQ ID NO: 320196 - DNA, 16 bp, C. familiaris
gcacattttggggcag

SEQ ID NO: 320197 - DNA, 16 bp, C. familiaris
gcaccaaaaccaataa

SEQ ID NO: 320198 - DNA, 16 bp, C. familiaris
gcaccaagagcccgac

SEQ ID NO: 320199 - DNA, 17 bp, C. familiaris
gcaccacccaaggatcc

SEQ ID NO: 320200 - DNA, 16 bp, C. familiaris
gcaccaccttcagcct

SEQ ID NO: 320201 - DNA, 16 bp, C. familiaris
gcaccaccttccaccc

SEQ ID NO: 320202 - DNA, 17 bp, C. familiaris
gcaccacgggggctgcc

SEQ ID NO: 320203 - DNA, 17 bp, C. familiaris
gcaccagcagcagcagc

SEQ ID NO: 320204 - DNA, 16 bp, C. familiaris
gcaccaggcactgttc

SEQ ID NO: 320205 - DNA, 16 bp, C. familiaris
gcaccaggcaggaggc

SEQ ID NO: 320206 - DNA, 16 bp, C. familiaris
gcaccaggccctggac

SEQ ID NO: 320207 - DNA, 16 bp, C. familiaris
gcaccagggacttgct

SEQ ID NO: 320208 - DNA, 16 bp, C. familiaris
gcacccagcatggagc

SEQ ID NO: 320209 - DNA, 16 bp, C. familiaris
gcacccagtaggtgct

SEQ ID NO: 320210 - DNA, 16 bp, C. familiaris
gcaccccaacatttat

SEQ ID NO: 320211 - DNA, 16 bp, C. familiaris
gcaccgcctgcagctc

SEQ ID NO: 320212 - DNA, 16 bp, C. familiaris
gcaccgggagcccggc

SEQ ID NO: 320213 - DNA, 16 bp, C. familiaris
gcacctccccctgctc

SEQ ID NO: 320214 - DNA, 16 bp, C. familiaris
gcacctcctaccttgc

SEQ ID NO: 320215 - DNA, 16 bp, C. familiaris
gcacctgcagggctca

SEQ ID NO: 320216 - DNA, 16 bp, C. familiaris
gcacctgccttccgcc

SEQ ID NO: 320217 - DNA, 16 bp, C. familiaris
gcacctggagcccgac

SEQ ID NO: 320218 - DNA, 16 bp, C. familiaris
gcacctggcgggctca

SEQ ID NO: 320219 - DNA, 16 bp, C. familiaris
gcacctggtggcccag

SEQ ID NO: 320220 - DNA, 16 bp, C. familiaris
gcaccttgatctcaga

SEQ ID NO: 320221 - DNA, 16 bp, C. familiaris
gcacggagcctcctcc

SEQ ID NO: 320222 - DNA, 16 bp, C. familiaris
gcacggggagcagcag

SEQ ID NO: 320223 - DNA, 16 bp, C. familiaris
gcacgtgcgcacacac

SEQ ID NO: 320224 - DNA, 16 bp, C. familiaris
gcacgtgtgtgtgtgc

SEQ ID NO: 320225 - DNA, 16 bp, C. familiaris
gcactactagttattt

SEQ ID NO: 320226 - DNA, 16 bp, C. familiaris
gcactcagatccagga

SEQ ID NO: 320227 - DNA, 16 bp, C. familiaris
gcactcagcacagagc

SEQ ID NO: 320228 - DNA, 16 bp, C. familiaris
gcactccctctgcctg

SEQ ID NO: 320229 - DNA, 16 bp, C. familiaris
gcactgccttcatccc

SEQ ID NO: 320230 - DNA, 16 bp, C. familiaris
gcactggacaaaatga

SEQ ID NO: 320231 - DNA, 16 bp, C. familiaris
gcactgggatcccgac

SEQ ID NO: 320232 - DNA, 16 bp, C. familiaris
gcactgggctccctgt

SEQ ID NO: 320233 - DNA, 17 bp, C. familiaris
gcactgggtattattct

SEQ ID NO: 320234 - DNA, 16 bp, C. familiaris
gcacttgaaaagaaca

SEQ ID NO: 320235 - DNA, 16 bp, C. familiaris
gcacttgaaatgtgcc

SEQ ID NO: 320236 - DNA, 16 bp, C. familiaris
gcagaaaatgaaagaa

SEQ ID NO: 320237 - DNA, 16 bp, C. familiaris
gcagaaacacaagcag

SEQ ID NO: 320238 - DNA, 16 bp, C. familiaris
gcagaaacagaagcag

SEQ ID NO: 320239 - DNA, 16 bp, C. familiaris
gcagaaactaagagtc

SEQ ID NO: 320240 - DNA, 16 bp, C. familiaris
gcagaaagaagcaggc

SEQ ID NO: 320241 - DNA, 16 bp, C. familiaris
gcagaaagagaagtta

SEQ ID NO: 320242 - DNA, 16 bp, C. familiaris
gcagaaagggacagag

SEQ ID NO: 320243 - DNA, 16 bp, C. familiaris
gcagaaatggaaagaa

SEQ ID NO: 320244 - DNA, 16 bp, C. familiaris
gcagaagaagaagcag

SEQ ID NO: 320245 - DNA, 16 bp, C. familiaris
gcagaagaagagaaat

SEQ ID NO: 320246 - DNA, 16 bp, C. familiaris
gcagaagaagagaatt

SEQ ID NO: 320247 - DNA, 16 bp, C. familiaris
gcagaagaagcagcag

SEQ ID NO: 320248 - DNA, 16 bp, C. familiaris
gcagaagaccagctgg

SEQ ID NO: 320249 - DNA, 16 bp, C. familiaris
gcagaagatcaacaag

SEQ ID NO: 320250 - DNA, 16 bp, C. familiaris
gcagaagcagaagcag

SEQ ID NO: 320251 - DNA, 16 bp, C. familiaris
gcagaagcagagggaa

SEQ ID NO: 320252 - DNA, 16 bp, C. familiaris
gcagaagcaggaggag

SEQ ID NO: 320253 - DNA, 16 bp, C. familiaris
gcagaagccttttatc

SEQ ID NO: 320254 - DNA, 16 bp, C. familiaris
gcagaaggaacagcag

SEQ ID NO: 320255 - DNA, 16 bp, C. familiaris
gcagaaggaaggaagt

SEQ ID NO: 320256 - DNA, 16 bp, C. familiaris
gcagaaggagaagcaa

SEQ ID NO: 320257 - DNA, 16 bp, C. familiaris
gcagaaggagaagctg

SEQ ID NO: 320258 - DNA, 16 bp, C. familiaris
gcagaaggagacgcag

SEQ ID NO: 320259 - DNA, 16 bp, C. familiaris
gcagaaggagcagaga

SEQ ID NO: 320260 - DNA, 16 bp, C. familiaris
gcagaaggaggagcag

SEQ ID NO: 320261 - DNA, 16 bp, C. familiaris
gcagaaggggaagcag

SEQ ID NO: 320262 - DNA, 16 bp, C. familiaris
gcagaaggtgaagcag

SEQ ID NO: 320263 - DNA, 16 bp, C. familiaris
gcagaagtggggaggg

SEQ ID NO: 320264 - DNA, 16 bp, C. familiaris
gcagaatataaaatca

SEQ ID NO: 320265 - DNA, 16 bp, C. familiaris
gcagaatccatgctga

SEQ ID NO: 320266 - DNA, 16 bp, C. familiaris
gcagaatgaaggaaat

SEQ ID NO: 320267 - DNA, 16 bp, C. familiaris
gcagaatgggagaaga

SEQ ID NO: 320268 - DNA, 16 bp, C. familiaris
gcagaattcatttcct

SEQ ID NO: 320269 - DNA, 16 bp, C. familiaris
gcagacaccatgctga

SEQ ID NO: 320270 - DNA, 16 bp, C. familiaris
gcagacactcaaacac

SEQ ID NO: 320271 - DNA, 16 bp, C. familiaris
gcagacactccaccgc

SEQ ID NO: 320272 - DNA, 16 bp, C. familiaris
gcagacacttcaccaa

SEQ ID NO: 320273 - DNA, 16 bp, C. familiaris
gcagacagaggagaag

SEQ ID NO: 320274 - DNA, 16 bp, C. familiaris
gcagacagccaccttc

SEQ ID NO: 320275 - DNA, 16 bp, C. familiaris
gcagaccctgctgagc

SEQ ID NO: 320276 - DNA, 16 bp, C. familiaris
gcagaccttcaaccac

SEQ ID NO: 320277 - DNA, 16 bp, C. familiaris
gcagacgctcgactgc

SEQ ID NO: 320278 - DNA, 16 bp, C. familiaris
gcagactccatgcaga

SEQ ID NO: 320279 - DNA, 16 bp, C. familiaris
gcagactccctgaggg

SEQ ID NO: 320280 - DNA, 16 bp, C. familiaris
gcagactctcccctga

SEQ ID NO: 320281 - DNA, 16 bp, C. familiaris
gcagactgggagctgc

SEQ ID NO: 320282 - DNA, 16 bp, C. familiaris
gcagagaaaccatttg

SEQ ID NO: 320283 - DNA, 16 bp, C. familiaris
gcagagaaaggggacc

SEQ ID NO: 320284 - DNA, 16 bp, C. familiaris
gcagagaaggaagcag

SEQ ID NO: 320285 - DNA, 16 bp, C. familiaris
gcagagacacagaagc

SEQ ID NO: 320286 - DNA, 16 bp, C. familiaris
gcagagacacagagga

SEQ ID NO: 320287 - DNA, 16 bp, C. familiaris
gcagagacagaagcaa

SEQ ID NO: 320288 - DNA, 16 bp, C. familiaris
gcagagacagaggaag

SEQ ID NO: 320289 - DNA, 16 bp, C. familiaris
gcagagacagagggag

SEQ ID NO: 320290 - DNA, 16 bp, C. familiaris
gcagagacaggaggag

SEQ ID NO: 320291 - DNA, 16 bp, C. familiaris
gcagagagaaagaggc

SEQ ID NO: 320292 - DNA, 16 bp, C. familiaris
gcagagagacagaggc

SEQ ID NO: 320293 - DNA, 16 bp, C. familiaris
gcagagagacagggag

SEQ ID NO: 320294 - DNA, 16 bp, C. familiaris
gcagagagagaaagca

SEQ ID NO: 320295 - DNA, 16 bp, C. familiaris
gcagagagagaaggac

SEQ ID NO: 320296 - DNA, 16 bp, C. familiaris
gcagagagcctgaggc

SEQ ID NO: 320297 - DNA, 16 bp, C. familiaris
gcagagagcgaagcag

SEQ ID NO: 320298 - DNA, 16 bp, C. familiaris
gcagagagggaagcag

SEQ ID NO: 320299 - DNA, 16 bp, C. familiaris
gcagagcacagaggat

SEQ ID NO: 320300 - DNA, 16 bp, C. familiaris
gcagagcagctcccca

SEQ ID NO: 320301 - DNA, 16 bp, C. familiaris
gcagagcaggaagccc

SEQ ID NO: 320302 - DNA, 16 bp, C. familiaris
gcagagccagagggag

SEQ ID NO: 320303 - DNA, 16 bp, C. familiaris
gcagagccaggcccag

SEQ ID NO: 320304 - DNA, 16 bp, C. familiaris
gcagagcccaaagtgg

SEQ ID NO: 320305 - DNA, 16 bp, C. familiaris
gcagagcccaacacaa

SEQ ID NO: 320306 - DNA, 16 bp, C. familiaris
gcagagcccaaggtgg

SEQ ID NO: 320307 - DNA, 16 bp, C. familiaris
gcagagcccagtgcag

SEQ ID NO: 320308 - DNA, 16 bp, C. familiaris
gcagagcctgaagcag

SEQ ID NO: 320309 - DNA, 16 bp, C. familiaris
gcagagcctgacaagg

SEQ ID NO: 320310 - DNA, 16 bp, C. familiaris
gcagagcctgatgcag

SEQ ID NO: 320311 - DNA, 16 bp, C. familiaris
gcagagctggggcagg

SEQ ID NO: 320312 - DNA, 16 bp, C. familiaris
gcagagcttgatgtgg

SEQ ID NO: 320313 - DNA, 16 bp, C. familiaris
gcagaggaagaaacag

SEQ ID NO: 320314 - DNA, 16 bp, C. familiaris
gcagaggaaggcagag

SEQ ID NO: 320315 - DNA, 16 bp, C. familiaris
gcagaggaagtgggag

SEQ ID NO: 320316 - DNA, 16 bp, C. familiaris
gcagaggaccataagg

SEQ ID NO: 320317 - DNA, 16 bp, C. familiaris
gcagaggacctgaaga

SEQ ID NO: 320318 - DNA, 16 bp, C. familiaris
gcagaggagaagcagg

SEQ ID NO: 320319 - DNA, 16 bp, C. familiaris
gcagaggaggaaactg

SEQ ID NO: 320320 - DNA, 16 bp, C. familiaris
gcagaggaggaagcag

SEQ ID NO: 320321 - DNA, 16 bp, C. familiaris
gcagaggcagaaggag

SEQ ID NO: 320322 - DNA, 16 bp, C. familiaris
gcagaggcagagagag

SEQ ID NO: 320323 - DNA, 16 bp, C. familiaris
gcagaggcagcagcag

SEQ ID NO: 320324 - DNA, 16 bp, C. familiaris
gcagaggctgaagcag

SEQ ID NO: 320325 - DNA, 16 bp, C. familiaris
gcagagggagaagaca

SEQ ID NO: 320326 - DNA, 16 bp, C. familiaris
gcagagggagatgcgg

SEQ ID NO: 320327 - DNA, 16 bp, C. familiaris
gcagagggagcagcag

SEQ ID NO: 320328 - DNA, 16 bp, C. familiaris
gcagagggagctgcag

SEQ ID NO: 320329 - DNA, 16 bp, C. familiaris
gcagagggagctggag

SEQ ID NO: 320330 - DNA, 16 bp, C. familiaris
gcagagggaggtgcag

SEQ ID NO: 320331 - DNA, 16 bp, C. familiaris
gcagagggagtagaag

SEQ ID NO: 320332 - DNA, 16 bp, C. familiaris
gcagagggcaaagcag

SEQ ID NO: 320333 - DNA, 16 bp, C. familiaris
gcagagggcagcccag

SEQ ID NO: 320334 - DNA, 16 bp, C. familiaris
gcagagggcagcccgg

SEQ ID NO: 320335 - DNA, 16 bp, C. familiaris
gcagaggggagaaaca

SEQ ID NO: 320336 - DNA, 16 bp, C. familiaris
gcagagggtgaagcag

SEQ ID NO: 320337 - DNA, 16 bp, C. familiaris
gcagaggtagaagcag

SEQ ID NO: 320338 - DNA, 16 bp, C. familiaris
gcagagtggccaaaag

SEQ ID NO: 320339 - DNA, 16 bp, C. familiaris
gcagagttggagaagc

SEQ ID NO: 320340 - DNA, 16 bp, C. familiaris
gcagatgaagaagcag

SEQ ID NO: 320341 - DNA, 16 bp, C. familiaris
gcagatgacatgatgc

SEQ ID NO: 320342 - DNA, 16 bp, C. familiaris
gcagatgagaaaaaaa

SEQ ID NO: 320343 - DNA, 16 bp, C. familiaris
gcagatgctcaaacca

SEQ ID NO: 320344 - DNA, 16 bp, C. familiaris
gcagatgctcatctgc

SEQ ID NO: 320345 - DNA, 16 bp, C. familiaris
gcagatggagaagaag

SEQ ID NO: 320346 - DNA, 16 bp, C. familiaris
gcagatggagaaggag

SEQ ID NO: 320347 - DNA, 16 bp, C. familiaris
gcagatggagagagaa

SEQ ID NO: 320348 - DNA, 16 bp, C. familiaris
gcagatggagagggag

SEQ ID NO: 320349 - DNA, 16 bp, C. familiaris
gcagattaaaagtgag

SEQ ID NO: 320350 - DNA, 16 bp, C. familiaris
gcagattcagtgtctg

SEQ ID NO: 320351 - DNA, 16 bp, C. familiaris
gcagcacaaaatggag

SEQ ID NO: 320352 - DNA, 16 bp, C. familiaris
gcagcagaaacagaaa

SEQ ID NO: 320353 - DNA, 16 bp, C. familiaris
gcagcagaagagggag

SEQ ID NO: 320354 - DNA, 16 bp, C. familiaris
gcagcagaaggagaaa

SEQ ID NO: 320355 - DNA, 16 bp, C. familiaris
gcagcagaggcagcag

SEQ ID NO: 320356 - DNA, 16 bp, C. familiaris
gcagcagcagaagaaa

SEQ ID NO: 320357 - DNA, 16 bp, C. familiaris
gcagcagcagaggcag

SEQ ID NO: 320358 - DNA, 16 bp, C. familiaris
gcagcagcagagggag

SEQ ID NO: 320359 - DNA, 16 bp, C. familiaris
gcagcagcagcaacaa

SEQ ID NO: 320360 - DNA, 16 bp, C. familiaris
gcagcagcagcagcca

SEQ ID NO: 320361 - DNA, 16 bp, C. familiaris
gcagcagcagcagcgc

SEQ ID NO: 320362 - DNA, 16 bp, C. familiaris
gcagcagcagcaggaa

SEQ ID NO: 320363 - DNA, 16 bp, C. familiaris
gcagcagcagcaggag

SEQ ID NO: 320364 - DNA, 16 bp, C. familiaris
gcagcagcagcaggca

SEQ ID NO: 320365 - DNA, 16 bp, C. familiaris
gcagcagcagccccag

SEQ ID NO: 320366 - DNA, 16 bp, C. familiaris
gcagcagcagcggcgg

SEQ ID NO: 320367 - DNA, 16 bp, C. familiaris
gcagcagcaggaggag

SEQ ID NO: 320368 - DNA, 16 bp, C. familiaris
gcagcagctgcagcag

SEQ ID NO: 320369 - DNA, 16 bp, C. familiaris
gcagcaggagaaggag

SEQ ID NO: 320370 - DNA, 16 bp, C. familiaris
gcagcaggagaggcag

SEQ ID NO: 320371 - DNA, 16 bp, C. familiaris
gcagcaggagcagcag

SEQ ID NO: 320372 - DNA, 16 bp, C. familiaris
gcagcaggagcaggag

SEQ ID NO: 320373 - DNA, 16 bp, C. familiaris
gcagcaggaggggcag

SEQ ID NO: 320374 - DNA, 16 bp, C. familiaris
gcagcaggagtgtcct

SEQ ID NO: 320375 - DNA, 16 bp, C. familiaris
gcagcaggcagagagg

SEQ ID NO: 320376 - DNA, 16 bp, C. familiaris
gcagcaggccccacag

SEQ ID NO: 320377 - DNA, 16 bp, C. familiaris
gcagcagggaggggca

SEQ ID NO: 320378 - DNA, 16 bp, C. familiaris
gcagcaggtgcagcag

SEQ ID NO: 320379 - DNA, 16 bp, C. familiaris
gcagcaggtgcagccc

SEQ ID NO: 320380 - DNA, 16 bp, C. familiaris
gcagcagtggcagcag

SEQ ID NO: 320381 - DNA, 16 bp, C. familiaris
gcagcagtggtggcag

SEQ ID NO: 320382 - DNA, 16 bp, C. familiaris
gcagcatccctagcct

SEQ ID NO: 320383 - DNA, 16 bp, C. familiaris
gcagcatgtgtcagaa

SEQ ID NO: 320384 - DNA, 16 bp, C. familiaris
gcagccacagacagta

SEQ ID NO: 320385 - DNA, 16 bp, C. familiaris
gcagccactgtggaag

SEQ ID NO: 320386 - DNA, 16 bp, C. familiaris
gcagcccaaatatcca

SEQ ID NO: 320387 - DNA, 16 bp, C. familiaris
gcagcccaagtgttca

SEQ ID NO: 320388 - DNA, 16 bp, C. familiaris
gcagccccagcccagg

SEQ ID NO: 320389 - DNA, 16 bp, C. familiaris
gcagccccagccccag

SEQ ID NO: 320390 - DNA, 16 bp, C. familiaris
gcagccccagccctgg

SEQ ID NO: 320391 - DNA, 16 bp, C. familiaris
gcagccccaggacact

SEQ ID NO: 320392 - DNA, 19 bp, C. familiaris
gcagccccctccgcggagc

SEQ ID NO: 320393 - DNA, 16 bp, C. familiaris
gcagcccctcccccag

SEQ ID NO: 320394 - DNA, 16 bp, C. familiaris
gcagcccctggtggct

SEQ ID NO: 320395 - DNA, 16 bp, C. familiaris
gcagcccctgtggaaa

SEQ ID NO: 320396 - DNA, 16 bp, C. familiaris
gcagcccctgtggccc

SEQ ID NO: 320397 - DNA, 16 bp, C. familiaris
gcagccctgggaaact

SEQ ID NO: 320398 - DNA, 16 bp, C. familiaris
gcagccgcagcagcag

SEQ ID NO: 320399 - DNA, 16 bp, C. familiaris
gcagcctcagtggccc

SEQ ID NO: 320400 - DNA, 16 bp, C. familiaris
gcagcctccctgcagg

SEQ ID NO: 320401 - DNA, 16 bp, C. familiaris
gcagcctccctggcct

SEQ ID NO: 320402 - DNA, 16 bp, C. familiaris
gcagcctcctcacagg

SEQ ID NO: 320403 - DNA, 16 bp, C. familiaris
gcagcctgcagcctgc

SEQ ID NO: 320404 - DNA, 16 bp, C. familiaris
gcagcctgcagcctgg

SEQ ID NO: 320405 - DNA, 16 bp, C. familiaris
gcagcctgggcggctc

SEQ ID NO: 320406 - DNA, 16 bp, C. familiaris
gcagccttcagcccag

SEQ ID NO: 320407 - DNA, 16 bp, C. familiaris
gcagccttggtggccc

SEQ ID NO: 320408 - DNA, 16 bp, C. familiaris
gcagcgagcctgatgt

SEQ ID NO: 320409 - DNA, 16 bp, C. familiaris
gcagcggcagcggcag

SEQ ID NO: 320410 - DNA, 16 bp, C. familiaris
gcagcgggagaggcag

SEQ ID NO: 320411 - DNA, 16 bp, C. familiaris
gcagcgggagcagcag

SEQ ID NO: 320412 - DNA, 16 bp, C. familiaris
gcagcgggaggagcag

SEQ ID NO: 320413 - DNA, 16 bp, C. familiaris
gcagctccccaagtgc

SEQ ID NO: 320414 - DNA, 16 bp, C. familiaris
gcagctcttcctgccc

SEQ ID NO: 320415 - DNA, 16 bp, C. familiaris
gcagctgcaccatttc

SEQ ID NO: 320416 - DNA, 16 bp, C. familiaris
gcagctgcccaaccac

SEQ ID NO: 320417 - DNA, 16 bp, C. familiaris
gcagctgctgctgctg

SEQ ID NO: 320418 - DNA, 16 bp, C. familiaris
gcagctgggcctgcag

SEQ ID NO: 320419 - DNA, 16 bp, C. familiaris
gcagcttgcttctccc

SEQ ID NO: 320420 - DNA, 16 bp, C. familiaris
gcaggaaataacaaat

SEQ ID NO: 320421 - DNA, 16 bp, C. familiaris
gcaggaaccaggaggg

SEQ ID NO: 320422 - DNA, 16 bp, C. familiaris
gcaggaagagcagctg

SEQ ID NO: 320423 - DNA, 16 bp, C. familiaris
gcaggaagagctgcac

SEQ ID NO: 320424 - DNA, 16 bp, C. familiaris
gcaggaagcccaaggt

SEQ ID NO: 320425 - DNA, 16 bp, C. familiaris
gcaggaagcccgacac

SEQ ID NO: 320426 - DNA, 16 bp, C. familiaris
gcaggaaggagcagag

SEQ ID NO: 320427 - DNA, 16 bp, C. familiaris
gcaggaatatatatat

SEQ ID NO: 320428 - DNA, 16 bp, C. familiaris
gcaggacacctgcacc

SEQ ID NO: 320429 - DNA, 16 bp, C. familiaris
gcaggaccacctgctg

SEQ ID NO: 320430 - DNA, 16 bp, C. familiaris
gcaggactccacccca

SEQ ID NO: 320431 - DNA, 16 bp, C. familiaris
gcaggactccatctca

SEQ ID NO: 320432 - DNA, 16 bp, C. familiaris
gcaggactctatccca

SEQ ID NO: 320433 - DNA, 16 bp, C. familiaris
gcaggactgggagcag

SEQ ID NO: 320434 - DNA, 16 bp, C. familiaris
gcaggagaagcaggag

SEQ ID NO: 320435 - DNA, 16 bp, C. familiaris
gcaggagaagcaggct

SEQ ID NO: 320436 - DNA, 16 bp, C. familiaris
gcaggagcagaaggag

SEQ ID NO: 320437 - DNA, 38 bp, C. familiaris
gcaggagctgcaccgaccttcccgggcggaaaggggcc

SEQ ID NO: 320438 - DNA, 16 bp, C. familiaris
gcaggagctggagcag

SEQ ID NO: 320439 - DNA, 16 bp, C. familiaris
gcaggaggaaaagcag

SEQ ID NO: 320440 - DNA, 16 bp, C. familiaris
gcaggaggaacagcag

SEQ ID NO: 320441 - DNA, 16 bp, C. familiaris
gcaggaggagcagcag

SEQ ID NO: 320442 - DNA, 16 bp, C. familiaris
gcaggaggagcggcag

SEQ ID NO: 320443 - DNA, 16 bp, C. familiaris
gcaggaggaggtgcag

SEQ ID NO: 320444 - DNA, 16 bp, C. familiaris
gcaggaggagtggcag

SEQ ID NO: 320445 - DNA, 16 bp, C. familiaris
gcaggaggagtgggag

SEQ ID NO: 320446 - DNA, 16 bp, C. familiaris
gcaggaggcagagcag

SEQ ID NO: 320447 - DNA, 16 bp, C. familiaris
gcaggaggcaggaggc

SEQ ID NO: 320448 - DNA, 16 bp, C. familiaris
gcaggaggcagggctg

SEQ ID NO: 320449 - DNA, 16 bp, C. familiaris
gcaggagtcagcaaac

SEQ ID NO: 320450 - DNA, 16 bp, C. familiaris
gcaggagtgggaggag

SEQ ID NO: 320451 - DNA, 16 bp, C. familiaris
gcaggatgggcagagg

SEQ ID NO: 320452 - DNA, 16 bp, C. familiaris
gcaggcagagatacag

SEQ ID NO: 320453 - DNA, 16 bp, C. familiaris
gcaggcagagcagcag

SEQ ID NO: 320454 - DNA, 16 bp, C. familiaris
gcaggcagcaggcagc

SEQ ID NO: 320455 - DNA, 16 bp, C. familiaris
gcaggcagccccggtg

SEQ ID NO: 320456 - DNA, 16 bp, C. familiaris
gcaggcagccctggtg

SEQ ID NO: 320457 - DNA, 16 bp, C. familiaris
gcaggcaggcagcagg

SEQ ID NO: 320458 - DNA, 16 bp, C. familiaris
gcaggcaggcaggcgg

SEQ ID NO: 320459 - DNA, 16 bp, C. familiaris
gcaggcagggagcagg

SEQ ID NO: 320460 - DNA, 16 bp, C. familiaris
gcaggcagggctggag

SEQ ID NO: 320461 - DNA, 16 bp, C. familiaris
gcaggcccatgccggg

SEQ ID NO: 320462 - DNA, 16 bp, C. familiaris
gcaggccccgtgcagg

SEQ ID NO: 320463 - DNA, 16 bp, C. familiaris
gcaggcctcctgcagg

SEQ ID NO: 320464 - DNA, 16 bp, C. familiaris
gcaggcgctcaacccc

SEQ ID NO: 320465 - DNA, 16 bp, C. familiaris
gcaggcggagcagcag

SEQ ID NO: 320466 - DNA, 16 bp, C. familiaris
gcaggctccacgtcca

SEQ ID NO: 320467 - DNA, 16 bp, C. familiaris
gcaggctccatcctgg

SEQ ID NO: 320468 - DNA, 16 bp, C. familiaris
gcaggctcccagtggg

SEQ ID NO: 320469 - DNA, 16 bp, C. familiaris
gcaggctcccccactg

SEQ ID NO: 320470 - DNA, 16 bp, C. familiaris
gcaggctccctgaaag

SEQ ID NO: 320471 - DNA, 16 bp, C. familiaris
gcaggctcctcaccag

SEQ ID NO: 320472 - DNA, 16 bp, C. familiaris
gcaggctctgtgctga

SEQ ID NO: 320473 - DNA, 16 bp, C. familiaris
gcaggcttcaggcagg

SEQ ID NO: 320474 - DNA, 16 bp, C. familiaris
gcagggaactggatgt

SEQ ID NO: 320475 - DNA, 16 bp, C. familiaris
gcagggactccccagc

SEQ ID NO: 320476 - DNA, 16 bp, C. familiaris
gcagggagaacagcag

SEQ ID NO: 320477 - DNA, 16 bp, C. familiaris
gcagggagagtagcag

SEQ ID NO: 320478 - DNA, 16 bp, C. familiaris
gcagggagcccaaaga

SEQ ID NO: 320479 - DNA, 16 bp, C. familiaris
gcagggagccctgggg

SEQ ID NO: 320480 - DNA, 16 bp, C. familiaris
gcagggagcctggctc

SEQ ID NO: 320481 - DNA, 16 bp, C. familiaris
gcagggagctgatgtg

SEQ ID NO: 320482 - DNA, 16 bp, C. familiaris
gcagggagctggaagt

SEQ ID NO: 320483 - DNA, 16 bp, C. familiaris
gcagggagctggatga

SEQ ID NO: 320484 - DNA, 16 bp, C. familiaris
gcagggagtggggcag

SEQ ID NO: 320485 - DNA, 16 bp, C. familiaris
gcagggcaggaggcag

SEQ ID NO: 320486 - DNA, 16 bp, C. familiaris
gcagggccagagggag

SEQ ID NO: 320487 - DNA, 16 bp, C. familiaris
gcagggccctccccca

SEQ ID NO: 320488 - DNA, 16 bp, C. familiaris
gcagggccctgggctg

SEQ ID NO: 320489 - DNA, 16 bp, C. familiaris
gcagggcctgggcagg

SEQ ID NO: 320490 - DNA, 16 bp, C. familiaris
gcagggcctgggctcc

SEQ ID NO: 320491 - DNA, 16 bp, C. familiaris
gcagggctcctgggtg

SEQ ID NO: 320492 - DNA, 16 bp, C. familiaris
gcagggctctgtccca

SEQ ID NO: 320493 - DNA, 16 bp, C. familiaris
gcagggctggggcagg

SEQ ID NO: 320494 - DNA, 16 bp, C. familiaris
gcaggggaagctgcag

SEQ ID NO: 320495 - DNA, 16 bp, C. familiaris
gcaggggaagggccag

SEQ ID NO: 320496 - DNA, 16 bp, C. familiaris
gcaggggcacctggct

SEQ ID NO: 320497 - DNA, 16 bp, C. familiaris
gcaggggctgcagggg

SEQ ID NO: 320498 - DNA, 16 bp, C. familiaris
gcaggggctggggctg

SEQ ID NO: 320499 - DNA, 16 bp, C. familiaris
gcagggggagaggctg

SEQ ID NO: 320500 - DNA, 16 bp, C. familiaris
gcagggggagcagctg

SEQ ID NO: 320501 - DNA, 16 bp, C. familiaris
gcagggggagctgcag

SEQ ID NO: 320502 - DNA, 16 bp, C. familiaris
gcagggggaggagctg

SEQ ID NO: 320503 - DNA, 16 bp, C. familiaris
gcagggtccatgctgg

SEQ ID NO: 320504 - DNA, 16 bp, C. familiaris
gcagggtcttgaagag

SEQ ID NO: 320505 - DNA, 16 bp, C. familiaris
gcagggtgagcagcag

SEQ ID NO: 320506 - DNA, 16 bp, C. familiaris
gcaggtctagtggtga

SEQ ID NO: 320507 - DNA, 16 bp, C. familiaris
gcaggtgcagatggag

SEQ ID NO: 320508 - DNA, 16 bp, C. familiaris
gcaggtgcaggagcag

SEQ ID NO: 320509 - DNA, 16 bp, C. familiaris
gcaggtgcaggtgcag

SEQ ID NO: 320510 - DNA, 16 bp, C. familiaris
gcaggtgccccttcga

SEQ ID NO: 320511 - DNA, 16 bp, C. familiaris
gcaggtgctcagccac

SEQ ID NO: 320512 - DNA, 16 bp, C. familiaris
gcaggtggagaagcag

SEQ ID NO: 320513 - DNA, 16 bp, C. familiaris
gcaggtggagcagcag

SEQ ID NO: 320514 - DNA, 16 bp, C. familiaris
gcaggtggaggaggag

SEQ ID NO: 320515 - DNA, 16 bp, C. familiaris
gcaggtggcagagctg

SEQ ID NO: 320516 - DNA, 16 bp, C. familiaris
gcaggtggcagaggga

SEQ ID NO: 320517 - DNA, 16 bp, C. familiaris
gcaggtggccgtgggc

SEQ ID NO: 320518 - DNA, 16 bp, C. familiaris
gcaggttccacacagg

SEQ ID NO: 320519 - DNA, 16 bp, C. familiaris
gcagtcctgagaagga

SEQ ID NO: 320520 - DNA, 16 bp, C. familiaris
gcagtgaaacaccaga

SEQ ID NO: 320521 - DNA, 16 bp, C. familiaris
gcagtgatttctttga

SEQ ID NO: 320522 - DNA, 16 bp, C. familiaris
gcagtgcctggcatgt

SEQ ID NO: 320523 - DNA, 16 bp, C. familiaris
gcagtggagatggaga

SEQ ID NO: 320524 - DNA, 16 bp, C. familiaris
gcagtgggagcagcag

SEQ ID NO: 320525 - DNA, 16 bp, C. familiaris
gcagtgggaggggaga

SEQ ID NO: 320526 - DNA, 16 bp, C. familiaris
gcagtgggcaggacag

SEQ ID NO: 320527 - DNA, 16 bp, C. familiaris
gcagtggggcagaggg

SEQ ID NO: 320528 - DNA, 16 bp, C. familiaris
gcagtggtgggagtgg

SEQ ID NO: 320529 - DNA, 16 bp, C. familiaris
gcagtgttggtgggaa

SEQ ID NO: 320530 - DNA, 16 bp, C. familiaris
gcagttcagcacctgc

SEQ ID NO: 320531 - DNA, 16 bp, C. familiaris
gcagttgagtttctgc

SEQ ID NO: 320532 - DNA, 16 bp, C. familiaris
gcagtttctcaaaatg

SEQ ID NO: 320533 - DNA, 16 bp, C. familiaris
gcataaatcccacttg

SEQ ID NO: 320534 - DNA, 16 bp, C. familiaris
gcataataccctccac

SEQ ID NO: 320535 - DNA, 16 bp, C. familiaris
gcataatgccttccag

SEQ ID NO: 320536 - DNA, 16 bp, C. familiaris
gcatagagcctgacac

SEQ ID NO: 320537 - DNA, 16 bp, C. familiaris
gcatatattgagatga

SEQ ID NO: 320538 - DNA, 16 bp, C. familiaris
gcatcacaattctgaa

SEQ ID NO: 320539 - DNA, 16 bp, C. familiaris
gcatcacattgattga

SEQ ID NO: 320540 - DNA, 16 bp, C. familiaris
gcatcagcatcaccag

SEQ ID NO: 320541 - DNA, 16 bp, C. familiaris
gcatcaggctccccca

SEQ ID NO: 320542 - DNA, 16 bp, C. familiaris
gcatcaggctgcctgc

SEQ ID NO: 320543 - DNA, 16 bp, C. familiaris
gcatcatcccagggtc

SEQ ID NO: 320544 - DNA, 16 bp, C. familiaris
gcatcatgcttcctga

SEQ ID NO: 320545 - DNA, 16 bp, C. familiaris
gcatcccagaaataaa

SEQ ID NO: 320546 - DNA, 16 bp, C. familiaris
gcatcgggctcctggc

SEQ ID NO: 320547 - DNA, 16 bp, C. familiaris
gcatcgggctgcctgc

SEQ ID NO: 320548 - DNA, 16 bp, C. familiaris
gcatctagctccctgc

SEQ ID NO: 320549 - DNA, 16 bp, C. familiaris
gcatctattaaaatga

SEQ ID NO: 320550 - DNA, 16 bp, C. familiaris
gcatctcactgtggtt

SEQ ID NO: 320551 - DNA, 16 bp, C. familiaris
gcatctcctgggagct

SEQ ID NO: 320552 - DNA, 16 bp, C. familiaris
gcatctccttctgcct

SEQ ID NO: 320553 - DNA, 16 bp, C. familiaris
gcatctgactttggtt

SEQ ID NO: 320554 - DNA, 16 bp, C. familiaris
gcatctgcctccagcc

SEQ ID NO: 320555 - DNA, 16 bp, C. familiaris
gcatctgctcttggct

SEQ ID NO: 320556 - DNA, 16 bp, C. familiaris
gcatcttctccaacat

SEQ ID NO: 320557 - DNA, 16 bp, C. familiaris
gcatcttctggtgcag

SEQ ID NO: 320558 - DNA, 16 bp, C. familiaris
gcatcttttcatatat

SEQ ID NO: 320559 - DNA, 16 bp, C. familiaris
gcatgaagcccaacac

SEQ ID NO: 320560 - DNA, 16 bp, C. familiaris
gcatgagctggaggag

SEQ ID NO: 320561 - DNA, 16 bp, C. familiaris
gcatgagggtttattt

SEQ ID NO: 320562 - DNA, 16 bp, C. familiaris
gcatgagtgggaagag

SEQ ID NO: 320563 - DNA, 16 bp, C. familiaris
gcatgagtggggggag

SEQ ID NO: 320564 - DNA, 16 bp, C. familiaris
gcatgatcctgagatc

SEQ ID NO: 320565 - DNA, 16 bp, C. familiaris
gcatgatcctggaggc

SEQ ID NO: 320566 - DNA, 16 bp, C. familiaris
gcatgcacatgcacac

SEQ ID NO: 320567 - DNA, 16 bp, C. familiaris
gcatggaactcttgat

SEQ ID NO: 320568 - DNA, 16 bp, C. familiaris
gcatggacctgcttct

SEQ ID NO: 320569 - DNA, 16 bp, C. familiaris
gcatggggaagggcag

SEQ ID NO: 320570 - DNA, 16 bp, C. familiaris
gcatggggtgcctggg

SEQ ID NO: 320571 - DNA, 16 bp, C. familiaris
gcatggtgcctgcttc

SEQ ID NO: 320572 - DNA, 16 bp, C. familiaris
gcatggttggtgggaa

SEQ ID NO: 320573 - DNA, 16 bp, C. familiaris
gcatgtactccttcaa

SEQ ID NO: 320574 - DNA, 16 bp, C. familiaris
gcatgtatccctttga

SEQ ID NO: 320575 - DNA, 16 bp, C. familiaris
gcatgtgatgctgttt

SEQ ID NO: 320576 - DNA, 16 bp, C. familiaris
gcatgtgtgtgcacat

SEQ ID NO: 320577 - DNA, 16 bp, C. familiaris
gcatgtgtgtgtctct

SEQ ID NO: 320578 - DNA, 16 bp, C. familiaris
gcattaaatgtgtcaa

SEQ ID NO: 320579 - DNA, 16 bp, C. familiaris
gcattcaataaatatt

SEQ ID NO: 320580 - DNA, 16 bp, C. familiaris
gcattctgctaagtga

SEQ ID NO: 320581 - DNA, 16 bp, C. familiaris
gcattctggaaaagac

SEQ ID NO: 320582 - DNA, 16 bp, C. familiaris
gcattgacttctctct

SEQ ID NO: 320583 - DNA, 16 bp, C. familiaris
gcattttaacaagatt

SEQ ID NO: 320584 - DNA, 16 bp, C. familiaris
gcattttcacagaaat

SEQ ID NO: 320585 - DNA, 16 bp, C. familiaris
gcattttcacatgtgc

SEQ ID NO: 320586 - DNA, 16 bp, C. familiaris
gcattttcaccaacag

SEQ ID NO: 320587 - DNA, 16 bp, C. familiaris
gcattttcattttcat

SEQ ID NO: 320588 - DNA, 16 bp, C. familiaris
gcattttcctggtgat

SEQ ID NO: 320589 - DNA, 16 bp, C. familiaris
gcattttcttgatgac

SEQ ID NO: 320590 - DNA, 16 bp, C. familiaris
gcatttttaaaaaaca

SEQ ID NO: 320591 - DNA, 16 bp, C. familiaris
gcatttttaacaagat

SEQ ID NO: 320592 - DNA, 16 bp, C. familiaris
gcatttttggcaagaa

SEQ ID NO: 320593 - DNA, 16 bp, C. familiaris
gccaaaacaatcttgg

SEQ ID NO: 320594 - DNA, 16 bp, C. familiaris
gccaaacaccacagaa

SEQ ID NO: 320595 - DNA, 16 bp, C. familiaris
gccaaaccaccaagcc

SEQ ID NO: 320596 - DNA, 16 bp, C. familiaris
gccaaacccaaggtca

SEQ ID NO: 320597 - DNA, 16 bp, C. familiaris
gccaaactgtctttca

SEQ ID NO: 320598 - DNA, 16 bp, C. familiaris
gccaaactgtgggaag

SEQ ID NO: 320599 - DNA, 16 bp, C. familiaris
gccaaagaaatcctga

SEQ ID NO: 320600 - DNA, 16 bp, C. familiaris
gccaaagacagatgct

SEQ ID NO: 320601 - DNA, 16 bp, C. familiaris
gccaaagccaagagtt

SEQ ID NO: 320602 - DNA, 16 bp, C. familiaris
gccaaagccaggcgct

SEQ ID NO: 320603 - DNA, 16 bp, C. familiaris
gccaaaggaagacgct

SEQ ID NO: 320604 - DNA, 16 bp, C. familiaris
gccaaaggcagacaga

SEQ ID NO: 320605 - DNA, 16 bp, C. familiaris
gccaaaggcagccatt

SEQ ID NO: 320606 - DNA, 16 bp, C. familiaris
gccaaattcaaaaagg

SEQ ID NO: 320607 - DNA, 16 bp, C. familiaris
gccaacaagcccatga

SEQ ID NO: 320608 - DNA, 16 bp, C. familiaris
gccaagaggtggaagc

SEQ ID NO: 320609 - DNA, 16 bp, C. familiaris
gccaagcagggagcct

SEQ ID NO: 320610 - DNA, 16 bp, C. familiaris
gccaaggccaaggcca

SEQ ID NO: 320611 - DNA, 16 bp, C. familiaris
gccaaggtcagagagg

SEQ ID NO: 320612 - DNA, 16 bp, C. familiaris
gccaagtgctcccctc

SEQ ID NO: 320613 - DNA, 17 bp, C. familiaris
gccaataggatccaaca

SEQ ID NO: 320614 - DNA, 16 bp, C. familiaris
gccaatttgaaatgcc

SEQ ID NO: 320615 - DNA, 16 bp, C. familiaris
gccacactggcctcct

SEQ ID NO: 320616 - DNA, 16 bp, C. familiaris
gccacagaattacaga

SEQ ID NO: 320617 - DNA, 16 bp, C. familiaris
gccacagactgggagg

SEQ ID NO: 320618 - DNA, 16 bp, C. familiaris
gccacagtccccacca

SEQ ID NO: 320619 - DNA, 16 bp, C. familiaris
gccacatgcagaaaaa

SEQ ID NO: 320620 - DNA, 16 bp, C. familiaris
gccacatgtagctact

SEQ ID NO: 320621 - DNA, 16 bp, C. familiaris
gccaccaccaccactg

SEQ ID NO: 320622 - DNA, 16 bp, C. familiaris
gccaccaccagaagct

SEQ ID NO: 320623 - DNA, 16 bp, C. familiaris
gccaccacggctgccc

SEQ ID NO: 320624 - DNA, 16 bp, C. familiaris
gccaccaggagctgga

SEQ ID NO: 320625 - DNA, 16 bp, C. familiaris
gccaccaggtggcagc

SEQ ID NO: 320626 - DNA, 16 bp, C. familiaris
gccaccatcaccacca

SEQ ID NO: 320627 - DNA, 16 bp, C. familiaris
gccaccatcagcccag

SEQ ID NO: 320628 - DNA, 16 bp, C. familiaris
gccaccatgctgtgag

SEQ ID NO: 320629 - DNA, 16 bp, C. familiaris
gccaccatggaaaaca

SEQ ID NO: 320630 - DNA, 16 bp, C. familiaris
gccacccaagcagccc

SEQ ID NO: 320631 - DNA, 16 bp, C. familiaris
gccacccaaggatccc

SEQ ID NO: 320632 - DNA, 16 bp, C. familiaris
gccacccaaggatctc

SEQ ID NO: 320633 - DNA, 16 bp, C. familiaris
gccacccaagtgctct

SEQ ID NO: 320634 - DNA, 16 bp, C. familiaris
gccacccagacatctc

SEQ ID NO: 320635 - DNA, 16 bp, C. familiaris
gccacccagactcccc

SEQ ID NO: 320636 - DNA, 16 bp, C. familiaris
gccacccagcacccct

SEQ ID NO: 320637 - DNA, 16 bp, C. familiaris
gccacccagctgtccc

SEQ ID NO: 320638 - DNA, 16 bp, C. familiaris
gccacccaggaaccct

SEQ ID NO: 320639 - DNA, 16 bp, C. familiaris
gccacccaggagcccg

SEQ ID NO: 320640 - DNA, 16 bp, C. familiaris
gccacccaggagcctc

SEQ ID NO: 320641 - DNA, 16 bp, C. familiaris
gccacccaggatcccc

SEQ ID NO: 320642 - DNA, 16 bp, C. familiaris
gccacccaggcagcca

SEQ ID NO: 320643 - DNA, 16 bp, C. familiaris
gccacccaggcatcct

SEQ ID NO: 320644 - DNA, 16 bp, C. familiaris
gccacccaggctccac

SEQ ID NO: 320645 - DNA, 16 bp, C. familiaris
gccacccaggctgccg

SEQ ID NO: 320646 - DNA, 16 bp, C. familiaris
gccacccaggctgctg

SEQ ID NO: 320647 - DNA, 16 bp, C. familiaris
gccacccaggcttcca

SEQ ID NO: 320648 - DNA, 16 bp, C. familiaris
gccacccaggcttccc

SEQ ID NO: 320649 - DNA, 16 bp, C. familiaris
gccacccagggaccct

SEQ ID NO: 320650 - DNA, 16 bp, C. familiaris
gccacccagggcccca

SEQ ID NO: 320651 - DNA, 16 bp, C. familiaris
gccacccagggcccct

SEQ ID NO: 320652 - DNA, 16 bp, C. familiaris
gccacccagggctccc

SEQ ID NO: 320653 - DNA, 16 bp, C. familiaris
gccacccaggggcctc

SEQ ID NO: 320654 - DNA, 16 bp, C. familiaris
gccacccaggggtccc

SEQ ID NO: 320655 - DNA, 16 bp, C. familiaris
gccacccaggtgcacc

SEQ ID NO: 320656 - DNA, 16 bp, C. familiaris
gccacccaggtgccca

SEQ ID NO: 320657 - DNA, 16 bp, C. familiaris
gccacccaggtggcca

SEQ ID NO: 320658 - DNA, 16 bp, C. familiaris
gccacccaggtgtacc

SEQ ID NO: 320659 - DNA, 16 bp, C. familiaris
gccacccaggtgtgct

SEQ ID NO: 320660 - DNA, 16 bp, C. familiaris
gccacccagtggcccc

SEQ ID NO: 320661 - DNA, 16 bp, C. familiaris
gccacccatgtgccca

SEQ ID NO: 320662 - DNA, 16 bp, C. familiaris
gccacccgcgctgccc

SEQ ID NO: 320663 - DNA, 16 bp, C. familiaris
gccacccggctgccct

SEQ ID NO: 320664 - DNA, 16 bp, C. familiaris
gccacccgggctgtcc

SEQ ID NO: 320665 - DNA, 16 bp, C. familiaris
gccaccctggctgccc

SEQ ID NO: 320666 - DNA, 16 bp, C. familiaris
gccaccctggctgtcc

SEQ ID NO: 320667 - DNA, 16 bp, C. familiaris
gccaccctggggcccc

SEQ ID NO: 320668 - DNA, 16 bp, C. familiaris
gccaccctggtgccct

SEQ ID NO: 320669 - DNA, 16 bp, C. familiaris
gccaccgggcctgccc

SEQ ID NO: 320670 - DNA, 16 bp, C. familiaris
gccaccgtggctgccc

SEQ ID NO: 320671 - DNA, 16 bp, C. familiaris
gccacctcctccagga

SEQ ID NO: 320672 - DNA, 16 bp, C. familiaris
gccacctcctcctcct

SEQ ID NO: 320673 - DNA, 16 bp, C. familiaris
gccacctgcagcccag

SEQ ID NO: 320674 - DNA, 16 bp, C. familiaris
gccacctgcagctcag

SEQ ID NO: 320675 - DNA, 16 bp, C. familiaris
gccacctgcaggaagc

SEQ ID NO: 320676 - DNA, 16 bp, C. familiaris
gccacctgccacctgc

SEQ ID NO: 320677 - DNA, 16 bp, C. familiaris
gccacctggactgccc

SEQ ID NO: 320678 - DNA, 16 bp, C. familiaris
gccacctgggtgcccc

SEQ ID NO: 320679 - DNA, 16 bp, C. familiaris
gccacctgggtgccct

SEQ ID NO: 320680 - DNA, 16 bp, C. familiaris
gccacctggtgcccct

SEQ ID NO: 320681 - DNA, 16 bp, C. familiaris
gccaccttcagccaag

SEQ ID NO: 320682 - DNA, 16 bp, C. familiaris
gccaccttccacccag

SEQ ID NO: 320683 - DNA, 16 bp, C. familiaris
gccactcacatgcccc

SEQ ID NO: 320684 - DNA, 16 bp, C. familiaris
gccactcaggcattcc

SEQ ID NO: 320685 - DNA, 16 bp, C. familiaris
gccactcaggcctccc

SEQ ID NO: 320686 - DNA, 16 bp, C. familiaris
gccactctgacaggtg

SEQ ID NO: 320687 - DNA, 16 bp, C. familiaris
gccactgaggctgccc

SEQ ID NO: 320688 - DNA, 16 bp, C. familiaris
gccactgatttctgag

SEQ ID NO: 320689 - DNA, 16 bp, C. familiaris
gccactgctttatcaa

SEQ ID NO: 320690 - DNA, 16 bp, C. familiaris
gccactggctttgctc

SEQ ID NO: 320691 - DNA, 16 bp, C. familiaris
gccactgggcctgccc

SEQ ID NO: 320692 - DNA, 16 bp, C. familiaris
gccactgggctgcccc

SEQ ID NO: 320693 - DNA, 16 bp, C. familiaris
gccactggggctgttg

SEQ ID NO: 320694 - DNA, 16 bp, C. familiaris
gccactggtgctgccc

SEQ ID NO: 320695 - DNA, 16 bp, C. familiaris
gccacttaaccagctg

SEQ ID NO: 320696 - DNA, 16 bp, C. familiaris
gccagaagaaagtggc

SEQ ID NO: 320697 - DNA, 16 bp, C. familiaris
gccagaagacagtgga

SEQ ID NO: 320698 - DNA, 16 bp, C. familiaris
gccagaagggcatgct

SEQ ID NO: 320699 - DNA, 16 bp, C. familiaris
gccagacaaagacccc

SEQ ID NO: 320700 - DNA, 16 bp, C. familiaris
gccagaggaagaggga

SEQ ID NO: 320701 - DNA, 16 bp, C. familiaris
gccagaggcagggggt

SEQ ID NO: 320702 - DNA, 16 bp, C. familiaris
gccagatctctgtgga

SEQ ID NO: 320703 - DNA, 16 bp, C. familiaris
gccagatgcaggactc

SEQ ID NO: 320704 - DNA, 16 bp, C. familiaris
gccagatgctgggctc

SEQ ID NO: 320705 - DNA, 16 bp, C. familiaris
gccagcaattgcactg

SEQ ID NO: 320706 - DNA, 17 bp, C. familiaris
gccagcagcagcagcag

SEQ ID NO: 320707 - DNA, 16 bp, C. familiaris
gccagcagccagcagc

SEQ ID NO: 320708 - DNA, 23 bp, C. familiaris
gccagcatcaccttaattccaaa

SEQ ID NO: 320709 - DNA, 16 bp, C. familiaris
gccagcatcaccttca

SEQ ID NO: 320710 - DNA, 16 bp, C. familiaris
gccagccaagtgccct

SEQ ID NO: 320711 - DNA, 16 bp, C. familiaris
gccagccacgtgcccc

SEQ ID NO: 320712 - DNA, 16 bp, C. familiaris
gccagccagccagcca

SEQ ID NO: 320713 - DNA, 16 bp, C. familiaris
gccagccagctgcccc

SEQ ID NO: 320714 - DNA, 16 bp, C. familiaris
gccagccaggagccct

SEQ ID NO: 320715 - DNA, 16 bp, C. familiaris
gccagccaggcaccca

SEQ ID NO: 320716 - DNA, 16 bp, C. familiaris
gccagccaggcacctc

SEQ ID NO: 320717 - DNA, 16 bp, C. familiaris
gccagccaggctccct

SEQ ID NO: 320718 - DNA, 16 bp, C. familiaris
gccagccaggcttccc

SEQ ID NO: 320719 - DNA, 16 bp, C. familiaris
gccagccagggacccc

SEQ ID NO: 320720 - DNA, 16 bp, C. familiaris
gccagccaggtgctcc

SEQ ID NO: 320721 - DNA, 16 bp, C. familiaris
gccagccaggtgcttc

SEQ ID NO: 320722 - DNA, 16 bp, C. familiaris
gccagcccagtgcccc

SEQ ID NO: 320723 - DNA, 16 bp, C. familiaris
gccagcccggtgcccc

SEQ ID NO: 320724 - DNA, 16 bp, C. familiaris
gccagcctggtgcccc

SEQ ID NO: 320725 - DNA, 16 bp, C. familiaris
gccagctccatgcagg

SEQ ID NO: 320726 - DNA, 16 bp, C. familiaris
gccagctccccagccc

SEQ ID NO: 320727 - DNA, 16 bp, C. familiaris
gccagctctggagccc

SEQ ID NO: 320728 - DNA, 16 bp, C. familiaris
gccagctgtgtgactt

SEQ ID NO: 320729 - DNA, 16 bp, C. familiaris
gccagcttcagcccag

SEQ ID NO: 320730 - DNA, 16 bp, C. familiaris
gccagcttcttcctct

SEQ ID NO: 320731 - DNA, 16 bp, C. familiaris
gccaggagctggggag

SEQ ID NO: 320732 - DNA, 16 bp, C. familiaris
gccaggagggcacagg

SEQ ID NO: 320733 - DNA, 16 bp, C. familiaris
gccaggatgcctgggt

SEQ ID NO: 320734 - DNA, 16 bp, C. familiaris
gccaggcactgtgctg

SEQ ID NO: 320735 - DNA, 16 bp, C. familiaris
gccaggcactgtttta

SEQ ID NO: 320736 - DNA, 16 bp, C. familiaris
gccaggccagcccagg

SEQ ID NO: 320737 - DNA, 16 bp, C. familiaris
gccaggccaggccagg

SEQ ID NO: 320738 - DNA, 16 bp, C. familiaris
gccaggccctgtgcca

SEQ ID NO: 320739 - DNA, 16 bp, C. familiaris
gccaggctggggtggg

SEQ ID NO: 320740 - DNA, 16 bp, C. familiaris
gccaggctgttttcca

SEQ ID NO: 320741 - DNA, 16 bp, C. familiaris
gccagggagcaggggc

SEQ ID NO: 320742 - DNA, 16 bp, C. familiaris
gccagggcagccccgg

SEQ ID NO: 320743 - DNA, 16 bp, C. familiaris
gccagggcagcctggg

SEQ ID NO: 320744 - DNA, 16 bp, C. familiaris
gccagggctgggggag

SEQ ID NO: 320745 - DNA, 16 bp, C. familiaris
gccaggggcagaggga

SEQ ID NO: 320746 - DNA, 16 bp, C. familiaris
gccaggggctggagga

SEQ ID NO: 320747 - DNA, 16 bp, C. familiaris
gccaggggctggggca

SEQ ID NO: 320748 - DNA, 16 bp, C. familiaris
gccaggtgcacggctc

SEQ ID NO: 320749 - DNA, 16 bp, C. familiaris
gccaggtgcccctcat

SEQ ID NO: 320750 - DNA, 16 bp, C. familiaris
gccaggtgctgtgcca

SEQ ID NO: 320751 - DNA, 16 bp, C. familiaris
gccagtgatgaggagc

SEQ ID NO: 320752 - DNA, 16 bp, C. familiaris
gccataaaaaaagatg

SEQ ID NO: 320753 - DNA, 16 bp, C. familiaris
gccatacccaaggtca

SEQ ID NO: 320754 - DNA, 16 bp, C. familiaris
gccatagaaagaatga

SEQ ID NO: 320755 - DNA, 16 bp, C. familiaris
gccatatatatttttt

SEQ ID NO: 320756 - DNA, 17 bp, C. familiaris
gccatcaaaatcctaga

SEQ ID NO: 320757 - DNA, 16 bp, C. familiaris
gccatcaagtttgtgg

SEQ ID NO: 320758 - DNA, 16 bp, C. familiaris
gccatcaccaccacca

SEQ ID NO: 320759 - DNA, 16 bp, C. familiaris
gccatcatcatcatca

SEQ ID NO: 320760 - DNA, 16 bp, C. familiaris
gccatccaggagtccc

SEQ ID NO: 320761 - DNA, 16 bp, C. familiaris
gccatccaggctcccc

SEQ ID NO: 320762 - DNA, 16 bp, C. familiaris
gccatccaggtgtccc

SEQ ID NO: 320763 - DNA, 16 bp, C. familiaris
gccatccagtttgtgg

SEQ ID NO: 320764 - DNA, 16 bp, C. familiaris
gccatctggtcctgaa

SEQ ID NO: 320765 - DNA, 16 bp, C. familiaris
gccatcttgctgatgt

SEQ ID NO: 320766 - DNA, 16 bp, C. familiaris
gccatgaaaagaatga

SEQ ID NO: 320767 - DNA, 16 bp, C. familiaris
gccatgaagaaaaata

SEQ ID NO: 320768 - DNA, 16 bp, C. familiaris
gccatggaaagacatg

SEQ ID NO: 320769 - DNA, 16 bp, C. familiaris
gccatggcaacttctt

SEQ ID NO: 320770 - DNA, 16 bp, C. familiaris
gccatgtgcagaagaa

SEQ ID NO: 320771 - DNA, 16 bp, C. familiaris
gccattactttcaaga

SEQ ID NO: 320772 - DNA, 16 bp, C. familiaris
gccattcaggtgcccc

SEQ ID NO: 320773 - DNA, 16 bp, C. familiaris
gccattcaggtgctcc

SEQ ID NO: 320774 - DNA, 16 bp, C. familiaris
gccatttacaacatgg

SEQ ID NO: 320775 - DNA, 16 bp, C. familiaris
gccatttagttttgtt

SEQ ID NO: 320776 - DNA, 16 bp, C. familiaris
gccattttaattacta

SEQ ID NO: 320777 - DNA, 16 bp, C. familiaris
gcccaaagtcacagag

SEQ ID NO: 320778 - DNA, 16 bp, C. familiaris
gcccaaagtgggactt

SEQ ID NO: 320779 - DNA, 16 bp, C. familiaris
gcccaacacggagctc

SEQ ID NO: 320780 - DNA, 16 bp, C. familiaris
gcccaacgtggggctc

SEQ ID NO: 320781 - DNA, 16 bp, C. familiaris
gcccaagctgaaggca

SEQ ID NO: 320782 - DNA, 16 bp, C. familiaris
gcccaaggcagccact

SEQ ID NO: 320783 - DNA, 16 bp, C. familiaris
gcccaaggcaggggct

SEQ ID NO: 320784 - DNA, 16 bp, C. familiaris
gcccaaggtcatgcag

SEQ ID NO: 320785 - DNA, 16 bp, C. familiaris
gcccaatgcaggcctc

SEQ ID NO: 320786 - DNA, 16 bp, C. familiaris
gcccaccacccagtca

SEQ ID NO: 320787 - DNA, 16 bp, C. familiaris
gcccacccagattatc

SEQ ID NO: 320788 - DNA, 16 bp, C. familiaris
gcccactgagccagcc

SEQ ID NO: 320789 - DNA, 16 bp, C. familiaris
gcccactgtgtgccag

SEQ ID NO: 320790 - DNA, 16 bp, C. familiaris
gcccagagagatgaag

SEQ ID NO: 320791 - DNA, 16 bp, C. familiaris
gcccagagcatgatcc

SEQ ID NO: 320792 - DNA, 16 bp, C. familiaris
gcccagagtgtgaccc

SEQ ID NO: 320793 - DNA, 16 bp, C. familiaris
gcccagcacagagcca

SEQ ID NO: 320794 - DNA, 16 bp, C. familiaris
gcccagcagagcccag

SEQ ID NO: 320795 - DNA, 16 bp, C. familiaris
gcccagcccagccctc

SEQ ID NO: 320796 - DNA, 16 bp, C. familiaris
gcccagcccaggccca

SEQ ID NO: 320797 - DNA, 16 bp, C. familiaris
gcccagccccggagaa

SEQ ID NO: 320798 - DNA, 16 bp, C. familiaris
gcccagcctggagccc

SEQ ID NO: 320799 - DNA, 16 bp, C. familiaris
gcccagctcctcgtgg

SEQ ID NO: 320800 - DNA, 16 bp, C. familiaris
gcccagctgctgagcc

SEQ ID NO: 320801 - DNA, 16 bp, C. familiaris
gcccagctggctcagc

SEQ ID NO: 320802 - DNA, 16 bp, C. familiaris
gcccagctggctcagt

SEQ ID NO: 320803 - DNA, 16 bp, C. familiaris
gcccagcttggagccc

SEQ ID NO: 320804 - DNA, 16 bp, C. familiaris
gcccaggccatgaccc

SEQ ID NO: 320805 - DNA, 16 bp, C. familiaris
gcccaggccctgccct

SEQ ID NO: 320806 - DNA, 16 bp, C. familiaris
gcccagggagaagcag

SEQ ID NO: 320807 - DNA, 16 bp, C. familiaris
gcccagggcaccatcc

SEQ ID NO: 320808 - DNA, 16 bp, C. familiaris
gcccagggcagagcct

SEQ ID NO: 320809 - DNA, 16 bp, C. familiaris
gcccagggcagccctg

SEQ ID NO: 320810 - DNA, 16 bp, C. familiaris
gcccagggccagggcc

SEQ ID NO: 320811 - DNA, 16 bp, C. familiaris
gcccagggccctgccc

SEQ ID NO: 320812 - DNA, 16 bp, C. familiaris
gcccagggccctggag

SEQ ID NO: 320813 - DNA, 16 bp, C. familiaris
gcccagggccggatcc

SEQ ID NO: 320814 - DNA, 16 bp, C. familiaris
gcccagggcctgcctg

SEQ ID NO: 320815 - DNA, 16 bp, C. familiaris
gcccagggcctgctcc

SEQ ID NO: 320816 - DNA, 16 bp, C. familiaris
gcccagggtgggggtg

SEQ ID NO: 320817 - DNA, 16 bp, C. familiaris
gcccagggtgtcatcc

SEQ ID NO: 320818 - DNA, 16 bp, C. familiaris
gcccagggtgtggtcc

SEQ ID NO: 320819 - DNA, 16 bp, C. familiaris
gcccagggtgtgttcc

SEQ ID NO: 320820 - DNA, 16 bp, C. familiaris
gcccaggtggggacca

SEQ ID NO: 320821 - DNA, 16 bp, C. familiaris
gcccaggttgctcagc

SEQ ID NO: 320822 - DNA, 16 bp, C. familiaris
gcccagtccagcccag

SEQ ID NO: 320823 - DNA, 16 bp, C. familiaris
gcccagtgcaaaatga

SEQ ID NO: 320824 - DNA, 16 bp, C. familiaris
gcccagtgtggagcca

SEQ ID NO: 320825 - DNA, 16 bp, C. familiaris
gcccagtgtggggcct

SEQ ID NO: 320826 - DNA, 16 bp, C. familiaris
gccccaaactggaaat

SEQ ID NO: 320827 - DNA, 16 bp, C. familiaris
gccccaaatgtcaaca

SEQ ID NO: 320828 - DNA, 16 bp, C. familiaris
gccccaagccaggctc

SEQ ID NO: 320829 - DNA, 16 bp, C. familiaris
gccccaagtcgggctc

SEQ ID NO: 320830 - DNA, 16 bp, C. familiaris
gccccacactgggctc

SEQ ID NO: 320831 - DNA, 16 bp, C. familiaris
gccccacatcgagctc

SEQ ID NO: 320832 - DNA, 16 bp, C. familiaris
gccccacctccagctc

SEQ ID NO: 320833 - DNA, 16 bp, C. familiaris
gccccacgcagggctc

SEQ ID NO: 320834 - DNA, 16 bp, C. familiaris
gccccagagccccagg

SEQ ID NO: 320835 - DNA, 16 bp, C. familiaris
gccccagccccagctc

SEQ ID NO: 320836 - DNA, 16 bp, C. familiaris
gccccagcccctgcct

SEQ ID NO: 320837 - DNA, 16 bp, C. familiaris
gccccagcctcagccc

SEQ ID NO: 320838 - DNA, 16 bp, C. familiaris
gccccagcctcctgcc

SEQ ID NO: 320839 - DNA, 16 bp, C. familiaris
gccccagctcaggctc

SEQ ID NO: 320840 - DNA, 16 bp, C. familiaris
gccccagctccagccc

SEQ ID NO: 320841 - DNA, 16 bp, C. familiaris
gccccaggacctttgc

SEQ ID NO: 320842 - DNA, 16 bp, C. familiaris
gccccaggctccccag

SEQ ID NO: 320843 - DNA, 16 bp, C. familiaris
gccccaggctgcaggc

SEQ ID NO: 320844 - DNA, 16 bp, C. familiaris
gccccaggctgcaggt

SEQ ID NO: 320845 - DNA, 16 bp, C. familiaris
gccccagggccctggg

SEQ ID NO: 320846 - DNA, 16 bp, C. familiaris
gccccaggggtggggg

SEQ ID NO: 320847 - DNA, 16 bp, C. familiaris
gccccaggtctggctc

SEQ ID NO: 320848 - DNA, 16 bp, C. familiaris
gccccagtggcccaga

SEQ ID NO: 320849 - DNA, 16 bp, C. familiaris
gccccatgctgggagc

SEQ ID NO: 320850 - DNA, 16 bp, C. familiaris
gcccccaaagatgtcc

SEQ ID NO: 320851 - DNA, 16 bp, C. familiaris
gcccccagccctgcct

SEQ ID NO: 320852 - DNA, 16 bp, C. familiaris
gcccccagcctctggc

SEQ ID NO: 320853 - DNA, 16 bp, C. familiaris
gcccccagcctggccc

SEQ ID NO: 320854 - DNA, 16 bp, C. familiaris
gcccccatcctgaagc

SEQ ID NO: 320855 - DNA, 16 bp, C. familiaris
gcccccatggcccagc

SEQ ID NO: 320856 - DNA, 16 bp, C. familiaris
gccccccactcatgct

SEQ ID NO: 320857 - DNA, 16 bp, C. familiaris
gccccccaggcccctg

SEQ ID NO: 320858 - DNA, 16 bp, C. familiaris
gccccccaggctgccc

SEQ ID NO: 320859 - DNA, 16 bp, C. familiaris
gccccccaggtgcccg

SEQ ID NO: 320860 - DNA, 16 bp, C. familiaris
gcccccctcagtgctg

SEQ ID NO: 320861 - DNA, 16 bp, C. familiaris
gcccccgcctggtgca

SEQ ID NO: 320862 - DNA, 16 bp, C. familiaris
gccccctgccaggtgt

SEQ ID NO: 320863 - DNA, 16 bp, C. familiaris
gccccgagcccaaggc

SEQ ID NO: 320864 - DNA, 16 bp, C. familiaris
gccccgaggccccgag

SEQ ID NO: 320865 - DNA, 16 bp, C. familiaris
gccccgcctgcagccc

SEQ ID NO: 320866 - DNA, 16 bp, C. familiaris
gccccggagcatccag

SEQ ID NO: 320867 - DNA, 16 bp, C. familiaris
gccccgggagcctgac

SEQ ID NO: 320868 - DNA, 16 bp, C. familiaris
gccccgggcggaaggc

SEQ ID NO: 320869 - DNA, 16 bp, C. familiaris
gccccggggggctcag

SEQ ID NO: 320870 - DNA, 16 bp, C. familiaris
gccccgggtggaaggc

SEQ ID NO: 320871 - DNA, 16 bp, C. familiaris
gccccgtgtccggctc

SEQ ID NO: 320872 - DNA, 16 bp, C. familiaris
gcccctcaaggtcctg

SEQ ID NO: 320873 - DNA, 16 bp, C. familiaris
gcccctcattgggctc

SEQ ID NO: 320874 - DNA, 16 bp, C. familiaris
gcccctcccacagaag

SEQ ID NO: 320875 - DNA, 16 bp, C. familiaris
gcccctccccacagct

SEQ ID NO: 320876 - DNA, 16 bp, C. familiaris
gcccctccccaccatt

SEQ ID NO: 320877 - DNA, 16 bp, C. familiaris
gcccctccccactcat

SEQ ID NO: 320878 - DNA, 16 bp, C. familiaris
gcccctcccctgctca

SEQ ID NO: 320879 - DNA, 16 bp, C. familiaris
gcccctcctcccattt

SEQ ID NO: 320880 - DNA, 16 bp, C. familiaris
gcccctcctgctcctg

SEQ ID NO: 320881 - DNA, 16 bp, C. familiaris
gcccctcgtcaggctc

SEQ ID NO: 320882 - DNA, 16 bp, C. familiaris
gcccctgagcagggag

SEQ ID NO: 320883 - DNA, 16 bp, C. familiaris
gcccctgcagcccagc

SEQ ID NO: 320884 - DNA, 16 bp, C. familiaris
gcccctgcagggagcc

SEQ ID NO: 320885 - DNA, 16 bp, C. familiaris
gcccctgcattgggct

SEQ ID NO: 320886 - DNA, 16 bp, C. familiaris
gcccctgccctcaggg

SEQ ID NO: 320887 - DNA, 16 bp, C. familiaris
gcccctgccctgccca

SEQ ID NO: 320888 - DNA, 16 bp, C. familiaris
gcccctgccttcagct

SEQ ID NO: 320889 - DNA, 16 bp, C. familiaris
gcccctggacgccgcc

SEQ ID NO: 320890 - DNA, 16 bp, C. familiaris
gcccctggcaactacc

SEQ ID NO: 320891 - DNA, 16 bp, C. familiaris
gcccctggccaccacc

SEQ ID NO: 320892 - DNA, 16 bp, C. familiaris
gcccctgggagcccag

SEQ ID NO: 320893 - DNA, 16 bp, C. familiaris
gcccctgggcccctgg

SEQ ID NO: 320894 - DNA, 16 bp, C. familiaris
gcccctgggcctggag

SEQ ID NO: 320895 - DNA, 16 bp, C. familiaris
gcccctggggctgccc

SEQ ID NO: 320896 - DNA, 16 bp, C. familiaris
gcccctgggggctcag

SEQ ID NO: 320897 - DNA, 16 bp, C. familiaris
gcccctgtggctcagc

SEQ ID NO: 320898 - DNA, 16 bp, C. familiaris
gcccctgtggctcagt

SEQ ID NO: 320899 - DNA, 16 bp, C. familiaris
gccccttccccagctc

SEQ ID NO: 320900 - DNA, 16 bp, C. familiaris
gcccctttccacccgg

SEQ ID NO: 320901 - DNA, 16 bp, C. familiaris
gcccgacgtggggctg

SEQ ID NO: 320902 - DNA, 16 bp, C. familiaris
gcccgagcccctccag

SEQ ID NO: 320903 - DNA, 16 bp, C. familiaris
gcccgctgtgggactc

SEQ ID NO: 320904 - DNA, 16 bp, C. familiaris
gcccggagcctccagg

SEQ ID NO: 320905 - DNA, 16 bp, C. familiaris
gcccgggctgaaggca

SEQ ID NO: 320906 - DNA, 16 bp, C. familiaris
gcccggggcagcagct

SEQ ID NO: 320907 - DNA, 16 bp, C. familiaris
gcccggggcatgatcc

SEQ ID NO: 320908 - DNA, 16 bp, C. familiaris
gcccgggtggcccaga

SEQ ID NO: 320909 - DNA, 16 bp, C. familiaris
gcccgggtggcccagc

SEQ ID NO: 320910 - DNA, 16 bp, C. familiaris
gcccggtggcccagcg

SEQ ID NO: 320911 - DNA, 16 bp, C. familiaris
gccctacacacacaca

SEQ ID NO: 320912 - DNA, 16 bp, C. familiaris
gccctattttacagat

SEQ ID NO: 320913 - DNA, 16 bp, C. familiaris
gccctcaaagtccatc

SEQ ID NO: 320914 - DNA, 16 bp, C. familiaris
gccctcaactccatgg

SEQ ID NO: 320915 - DNA, 16 bp, C. familiaris
gccctcagctcagatc

SEQ ID NO: 320916 - DNA, 16 bp, C. familiaris
gccctcaggctcccag

SEQ ID NO: 320917 - DNA, 16 bp, C. familiaris
gccctcccagcctctg

SEQ ID NO: 320918 - DNA, 16 bp, C. familiaris
gccctccccacctctg

SEQ ID NO: 320919 - DNA, 16 bp, C. familiaris
gccctccccagtgtgg

SEQ ID NO: 320920 - DNA, 16 bp, C. familiaris
gccctcccccccaaaa

SEQ ID NO: 320921 - DNA, 16 bp, C. familiaris
gccctcctcccattcc

SEQ ID NO: 320922 - DNA, 16 bp, C. familiaris
gccctcctggcttctg

SEQ ID NO: 320923 - DNA, 16 bp, C. familiaris
gccctcctggggtcct

SEQ ID NO: 320924 - DNA, 16 bp, C. familiaris
gccctcctgggtcctg

SEQ ID NO: 320925 - DNA, 16 bp, C. familiaris
gccctcggcccagggt

SEQ ID NO: 320926 - DNA, 21 bp, C. familiaris
gccctcgggctcccggggaca

SEQ ID NO: 320927 - DNA, 16 bp, C. familiaris
gccctcgggctccctg

SEQ ID NO: 320928 - DNA, 16 bp, C. familiaris
gccctgacccaaaggc

SEQ ID NO: 320929 - DNA, 16 bp, C. familiaris
gccctgagcagaaggc

SEQ ID NO: 320930 - DNA, 16 bp, C. familiaris
gccctgagccagaagg

SEQ ID NO: 320931 - DNA, 16 bp, C. familiaris
gccctgagccaggggc

SEQ ID NO: 320932 - DNA, 16 bp, C. familiaris
gccctgagccccaggc

SEQ ID NO: 320933 - DNA, 16 bp, C. familiaris
gccctgagctgcaggc

SEQ ID NO: 320934 - DNA, 16 bp, C. familiaris
gccctgagctggaggc

SEQ ID NO: 320935 - DNA, 16 bp, C. familiaris
gccctgagctgtgcag

SEQ ID NO: 320936 - DNA, 16 bp, C. familiaris
gccctgcagcaggctc

SEQ ID NO: 320937 - DNA, 16 bp, C. familiaris
gccctgcagccctgca

SEQ ID NO: 320938 - DNA, 16 bp, C. familiaris
gccctgcattaggctc

SEQ ID NO: 320939 - DNA, 16 bp, C. familiaris
gccctgccagcacctt

SEQ ID NO: 320940 - DNA, 16 bp, C. familiaris
gccctgcccagcccag

SEQ ID NO: 320941 - DNA, 16 bp, C. familiaris
gccctgcccagccctg

SEQ ID NO: 320942 - DNA, 16 bp, C. familiaris
gccctgccccaggccc

SEQ ID NO: 320943 - DNA, 16 bp, C. familiaris
gccctgcccctgccca

SEQ ID NO: 320944 - DNA, 16 bp, C. familiaris
gccctgccctcgggga

SEQ ID NO: 320945 - DNA, 16 bp, C. familiaris
gccctgccttcagccc

SEQ ID NO: 320946 - DNA, 16 bp, C. familiaris
gccctgcgtggggctc

SEQ ID NO: 320947 - DNA, 16 bp, C. familiaris
gccctgctctgccctg

SEQ ID NO: 320948 - DNA, 16 bp, C. familiaris
gccctggacctttgtg

SEQ ID NO: 320949 - DNA, 16 bp, C. familiaris
gccctggagaagcagg

SEQ ID NO: 320950 - DNA, 16 bp, C. familiaris
gccctggagacctggg

SEQ ID NO: 320951 - DNA, 16 bp, C. familiaris
gccctggagccagggg

SEQ ID NO: 320952 - DNA, 16 bp, C. familiaris
gccctggagtcagccc

SEQ ID NO: 320953 - DNA, 16 bp, C. familiaris
gccctggagtcccggg

SEQ ID NO: 320954 - DNA, 16 bp, C. familiaris
gccctggccctggcct

SEQ ID NO: 320955 - DNA, 16 bp, C. familiaris
gccctgggcatgaagg

SEQ ID NO: 320956 - DNA, 16 bp, C. familiaris
gccctgggcatggagc

SEQ ID NO: 320957 - DNA, 16 bp, C. familiaris
gccctgggccaggggc

SEQ ID NO: 320958 - DNA, 16 bp, C. familiaris
gccctgggccctgggc

SEQ ID NO: 320959 - DNA, 16 bp, C. familiaris
gccctgggcctcaggc

SEQ ID NO: 320960 - DNA, 16 bp, C. familiaris
gccctgggcctgggct

SEQ ID NO: 320961 - DNA, 16 bp, C. familiaris
gccctgggctcagggc

SEQ ID NO: 320962 - DNA, 16 bp, C. familiaris
gccctgggctcccggg

SEQ ID NO: 320963 - DNA, 16 bp, C. familiaris
gccctgggctgggctc

SEQ ID NO: 320964 - DNA, 16 bp, C. familiaris
gccctggggagagtgc

SEQ ID NO: 320965 - DNA, 16 bp, C. familiaris
gccctggggcacctgg

SEQ ID NO: 320966 - DNA, 16 bp, C. familiaris
gccctggggcagcagg

SEQ ID NO: 320967 - DNA, 16 bp, C. familiaris
gccctggggcaggagc

SEQ ID NO: 320968 - DNA, 16 bp, C. familiaris
gccctggggccctggg

SEQ ID NO: 320969 - DNA, 16 bp, C. familiaris
gccctggggctgcctg

SEQ ID NO: 320970 - DNA, 16 bp, C. familiaris
gccctgggtgaaaggc

SEQ ID NO: 320971 - DNA, 16 bp, C. familiaris
gccctggtagctcagc

SEQ ID NO: 320972 - DNA, 16 bp, C. familiaris
gccctggtggcccaga

SEQ ID NO: 320973 - DNA, 16 bp, C. familiaris
gccctggtggcccagg

SEQ ID NO: 320974 - DNA, 16 bp, C. familiaris
gccctggtggcccagt

SEQ ID NO: 320975 - DNA, 16 bp, C. familiaris
gccctggtggcgcagg

SEQ ID NO: 320976 - DNA, 16 bp, C. familiaris
gccctgtctcaggctc

SEQ ID NO: 320977 - DNA, 16 bp, C. familiaris
gccctgtgccaggtgc

SEQ ID NO: 320978 - DNA, 16 bp, C. familiaris
gccctgtgctccgggg

SEQ ID NO: 320979 - DNA, 16 bp, C. familiaris
gccctgtgctctggag

SEQ ID NO: 320980 - DNA, 16 bp, C. familiaris
gccctgtgtcaggccc

SEQ ID NO: 320981 - DNA, 16 bp, C. familiaris
gcccttcccccactca

SEQ ID NO: 320982 - DNA, 16 bp, C. familiaris
gcccttctccctgctt

SEQ ID NO: 320983 - DNA, 16 bp, C. familiaris
gccgaaggcaggcgct

SEQ ID NO: 320984 - DNA, 16 bp, C. familiaris
gccgactccatgcagg

SEQ ID NO: 320985 - DNA, 16 bp, C. familiaris
gccgaggccgaggccg

SEQ ID NO: 320986 - DNA, 16 bp, C. familiaris
gccgagggagcagcag

SEQ ID NO: 320987 - DNA, 16 bp, C. familiaris
gccgcagccccctccg

SEQ ID NO: 320988 - DNA, 17 bp, C. familiaris
gccgcaggaggaacaac

SEQ ID NO: 320989 - DNA, 16 bp, C. familiaris
gccgcccaggtgtccc

SEQ ID NO: 320990 - DNA, 17 bp, C. familiaris
gccgcccgagccccttc

SEQ ID NO: 320991 - DNA, 17 bp, C. familiaris
gccgccgcctgagctgc

SEQ ID NO: 320992 - DNA, 16 bp, C. familiaris
gccgccggagcccctc

SEQ ID NO: 320993 - DNA, 16 bp, C. familiaris
gccgcctgagcccctc

SEQ ID NO: 320994 - DNA, 16 bp, C. familiaris
gccgcctgcaacctgg

SEQ ID NO: 320995 - DNA, 16 bp, C. familiaris
gccgcctgcagccagg

SEQ ID NO: 320996 - DNA, 16 bp, C. familiaris
gccgcctgcagctcag

SEQ ID NO: 320997 - DNA, 16 bp, C. familiaris
gccgcctgcggcccag

SEQ ID NO: 320998 - DNA, 16 bp, C. familiaris
gccgccttcagccaag

SEQ ID NO: 320999 - DNA, 16 bp, C. familiaris
gccgcgcagccgcctc

SEQ ID NO: 321000 - DNA, 16 bp, C. familiaris
gccgctgagcacaccc

SEQ ID NO: 321001 - DNA, 16 bp, C. familiaris
gccggatcctggagac

SEQ ID NO: 321002 - DNA, 18 bp, C. familiaris
gccgggtcccgccgtgcg

SEQ ID NO: 321003 - DNA, 16 bp, C. familiaris
gcctaacacagggctc

SEQ ID NO: 321004 - DNA, 16 bp, C. familiaris
gcctacctcaagaagc

SEQ ID NO: 321005 - DNA, 16 bp, C. familiaris
gcctacttcttcctct

SEQ ID NO: 321006 - DNA, 16 bp, C. familiaris
gcctagtggctcagtc

SEQ ID NO: 321007 - DNA, 16 bp, C. familiaris
gcctatgtctccacct

SEQ ID NO: 321008 - DNA, 16 bp, C. familiaris
gcctcacctgggaact

SEQ ID NO: 321009 - DNA, 16 bp, C. familiaris
gcctcagaatgtgact

SEQ ID NO: 321010 - DNA, 16 bp, C. familiaris
gcctcagagcctttgc

SEQ ID NO: 321011 - DNA, 16 bp, C. familiaris
gcctcagcatcctcat

SEQ ID NO: 321012 - DNA, 16 bp, C. familiaris
gcctcagcttcctctt

SEQ ID NO: 321013 - DNA, 16 bp, C. familiaris
gcctcaggctccctgg

SEQ ID NO: 321014 - DNA, 16 bp, C. familiaris
gcctcagtttcccaat

SEQ ID NO: 321015 - DNA, 16 bp, C. familiaris
gcctcagtttccccag

SEQ ID NO: 321016 - DNA, 16 bp, C. familiaris
gcctcagtttccccat

SEQ ID NO: 321017 - DNA, 16 bp, C. familiaris
gcctcagtttcccctg

SEQ ID NO: 321018 - DNA, 16 bp, C. familiaris
gcctcagtttctccat

SEQ ID NO: 321019 - DNA, 16 bp, C. familiaris
gcctccaaaactatga

SEQ ID NO: 321020 - DNA, 18 bp, C. familiaris
gcctccaccccaagattg

SEQ ID NO: 321021 - DNA, 16 bp, C. familiaris
gcctccagaacagtga

SEQ ID NO: 321022 - DNA, 16 bp, C. familiaris
gcctccagagctggga

SEQ ID NO: 321023 - DNA, 16 bp, C. familiaris
gcctccagcccggggc

SEQ ID NO: 321024 - DNA, 16 bp, C. familiaris
gcctccatctctctct

SEQ ID NO: 321025 - DNA, 16 bp, C. familiaris
gcctccatgctcagca

SEQ ID NO: 321026 - DNA, 16 bp, C. familiaris
gcctcccaggcctccc

SEQ ID NO: 321027 - DNA, 16 bp, C. familiaris
gcctcccaggctcccc

SEQ ID NO: 321028 - DNA, 16 bp, C. familiaris
gcctccccagggcctg

SEQ ID NO: 321029 - DNA, 16 bp, C. familiaris
gcctccgcctgtccca

SEQ ID NO: 321030 - DNA, 16 bp, C. familiaris
gcctccgtctctctct

SEQ ID NO: 321031 - DNA, 16 bp, C. familiaris
gcctcctcatctgtaa

SEQ ID NO: 321032 - DNA, 16 bp, C. familiaris
gcctcctccaggaagc

SEQ ID NO: 321033 - DNA, 16 bp, C. familiaris
gcctcctccaggaagt

SEQ ID NO: 321034 - DNA, 16 bp, C. familiaris
gcctcctcctccagga

SEQ ID NO: 321035 - DNA, 16 bp, C. familiaris
gcctcctgcagcccgg

SEQ ID NO: 321036 - DNA, 16 bp, C. familiaris
gcctcctgcaggcccc

SEQ ID NO: 321037 - DNA, 16 bp, C. familiaris
gcctcctgccccagcc

SEQ ID NO: 321038 - DNA, 16 bp, C. familiaris
gcctcctgcctcctgc

SEQ ID NO: 321039 - DNA, 16 bp, C. familiaris
gcctcctgctttgctt

SEQ ID NO: 321040 - DNA, 16 bp, C. familiaris
gcctcctggatttgga

SEQ ID NO: 321041 - DNA, 16 bp, C. familiaris
gcctcctgggccctgg

SEQ ID NO: 321042 - DNA, 16 bp, C. familiaris
gcctcctgggctgccc

SEQ ID NO: 321043 - DNA, 16 bp, C. familiaris
gcctcggtttccccat

SEQ ID NO: 321044 - DNA, 16 bp, C. familiaris
gcctctcccccagctc

SEQ ID NO: 321045 - DNA, 16 bp, C. familiaris
gcctctcccccttgga

SEQ ID NO: 321046 - DNA, 16 bp, C. familiaris
gcctctcctccccact

SEQ ID NO: 321047 - DNA, 16 bp, C. familiaris
gcctctcctctctctg

SEQ ID NO: 321048 - DNA, 16 bp, C. familiaris
gcctctctcagtgtgt

SEQ ID NO: 321049 - DNA, 16 bp, C. familiaris
gcctctctccatgtct

SEQ ID NO: 321050 - DNA, 16 bp, C. familiaris
gcctctctctctgctc

SEQ ID NO: 321051 - DNA, 16 bp, C. familiaris
gcctctctctggctct

SEQ ID NO: 321052 - DNA, 16 bp, C. familiaris
gcctctctgggtctct

SEQ ID NO: 321053 - DNA, 16 bp, C. familiaris
gcctctctggttttca

SEQ ID NO: 321054 - DNA, 16 bp, C. familiaris
gcctctcttgctctgt

SEQ ID NO: 321055 - DNA, 16 bp, C. familiaris
gcctctgccccctgct

SEQ ID NO: 321056 - DNA, 16 bp, C. familiaris
gcctctgcctctgccc

SEQ ID NO: 321057 - DNA, 16 bp, C. familiaris
gcctctgcctctggct

SEQ ID NO: 321058 - DNA, 16 bp, C. familiaris
gcctctgcctgtggct

SEQ ID NO: 321059 - DNA, 16 bp, C. familiaris
gcctctgccttccgct

SEQ ID NO: 321060 - DNA, 16 bp, C. familiaris
gcctctggaagctgga

SEQ ID NO: 321061 - DNA, 16 bp, C. familiaris
gcctctggagacatgt

SEQ ID NO: 321062 - DNA, 16 bp, C. familiaris
gcctctgtctcctcat

SEQ ID NO: 321063 - DNA, 16 bp, C. familiaris
gcctcttctctacatt

SEQ ID NO: 321064 - DNA, 16 bp, C. familiaris
gcctctttctctatct

SEQ ID NO: 321065 - DNA, 16 bp, C. familiaris
gcctctttctctgcat

SEQ ID NO: 321066 - DNA, 16 bp, C. familiaris
gcctgaaattttcttt

SEQ ID NO: 321067 - DNA, 16 bp, C. familiaris
gcctgacacaggactt

SEQ ID NO: 321068 - DNA, 16 bp, C. familiaris
gcctgacccgggactc

SEQ ID NO: 321069 - DNA, 16 bp, C. familiaris
gcctgagccaaaacca

SEQ ID NO: 321070 - DNA, 16 bp, C. familiaris
gcctgagcccaaggca

SEQ ID NO: 321071 - DNA, 16 bp, C. familiaris
gcctgaggagacatat

SEQ ID NO: 321072 - DNA, 16 bp, C. familiaris
gcctgagtggctcagt

SEQ ID NO: 321073 - DNA, 16 bp, C. familiaris
gcctgatcctggagaa

SEQ ID NO: 321074 - DNA, 16 bp, C. familiaris
gcctgatgtggagctg

SEQ ID NO: 321075 - DNA, 16 bp, C. familiaris
gcctgatgtggggctg

SEQ ID NO: 321076 - DNA, 16 bp, C. familiaris
gcctgatgttggactt

SEQ ID NO: 321077 - DNA, 16 bp, C. familiaris
gcctgcactctctctc

SEQ ID NO: 321078 - DNA, 16 bp, C. familiaris
gcctgcagcccagagc

SEQ ID NO: 321079 - DNA, 16 bp, C. familiaris
gcctgcagcccggggc

SEQ ID NO: 321080 - DNA, 16 bp, C. familiaris
gcctgcagccctgggg

SEQ ID NO: 321081 - DNA, 16 bp, C. familiaris
gcctgcagccgggggt

SEQ ID NO: 321082 - DNA, 16 bp, C. familiaris
gcctgcagcctggagt

SEQ ID NO: 321083 - DNA, 16 bp, C. familiaris
gcctgcagcctggggg

SEQ ID NO: 321084 - DNA, 16 bp, C. familiaris
gcctgcagcctggggt

SEQ ID NO: 321085 - DNA, 16 bp, C. familiaris
gcctgcagctcctcct

SEQ ID NO: 321086 - DNA, 16 bp, C. familiaris
gcctgcctgcagccca

SEQ ID NO: 321087 - DNA, 16 bp, C. familiaris
gcctgcctgcccgcct

SEQ ID NO: 321088 - DNA, 16 bp, C. familiaris
gcctgcctgccttcag

SEQ ID NO: 321089 - DNA, 16 bp, C. familiaris
gcctgcctgccttcct

SEQ ID NO: 321090 - DNA, 16 bp, C. familiaris
gcctgcctggaggagg

SEQ ID NO: 321091 - DNA, 16 bp, C. familiaris
gcctgcctgggtggct

SEQ ID NO: 321092 - DNA, 16 bp, C. familiaris
gcctgccttcagctca

SEQ ID NO: 321093 - DNA, 16 bp, C. familiaris
gcctgccttcatgccc

SEQ ID NO: 321094 - DNA, 26 bp, C. familiaris
gcctgcgctggtggattcgcgctccc

SEQ ID NO: 321095 - DNA, 16 bp, C. familiaris
gcctgcggctcagggc

SEQ ID NO: 321096 - DNA, 16 bp, C. familiaris
gcctgctcctcctctg

SEQ ID NO: 321097 - DNA, 16 bp, C. familiaris
gcctgctccttcctct

SEQ ID NO: 321098 - DNA, 16 bp, C. familiaris
gcctgctgcccagggc

SEQ ID NO: 321099 - DNA, 16 bp, C. familiaris
gcctgctgctctgcct

SEQ ID NO: 321100 - DNA, 16 bp, C. familiaris
gcctgcttctcccact

SEQ ID NO: 321101 - DNA, 16 bp, C. familiaris
gcctggagcccaatgt

SEQ ID NO: 321102 - DNA, 16 bp, C. familiaris
gcctggagcccagagc

SEQ ID NO: 321103 - DNA, 16 bp, C. familiaris
gcctggagcctggggc

SEQ ID NO: 321104 - DNA, 16 bp, C. familiaris
gcctggaggctcccgg

SEQ ID NO: 321105 - DNA, 16 bp, C. familiaris
gcctggatggctcaac

SEQ ID NO: 321106 - DNA, 16 bp, C. familiaris
gcctggcacagggctc

SEQ ID NO: 321107 - DNA, 16 bp, C. familiaris
gcctggcccagagcag

SEQ ID NO: 321108 - DNA, 16 bp, C. familiaris
gcctggcctgggcccc

SEQ ID NO: 321109 - DNA, 16 bp, C. familiaris
gcctggctccctgctc

SEQ ID NO: 321110 - DNA, 16 bp, C. familiaris
gcctggctcctcgcgg

SEQ ID NO: 321111 - DNA, 16 bp, C. familiaris
gcctgggcagcctggg

SEQ ID NO: 321112 - DNA, 16 bp, C. familiaris
gcctgggcagctcagt

SEQ ID NO: 321113 - DNA, 16 bp, C. familiaris
gcctgggccccagccc

SEQ ID NO: 321114 - DNA, 16 bp, C. familiaris
gcctgggcctgggccc

SEQ ID NO: 321115 - DNA, 16 bp, C. familiaris
gcctgggcgtgatcct

SEQ ID NO: 321116 - DNA, 16 bp, C. familiaris
gcctggggaggctggg

SEQ ID NO: 321117 - DNA, 16 bp, C. familiaris
gcctggggcccctggg

SEQ ID NO: 321118 - DNA, 16 bp, C. familiaris
gcctggggcctggggt

SEQ ID NO: 321119 - DNA, 16 bp, C. familiaris
gcctggggctgctggg

SEQ ID NO: 321120 - DNA, 16 bp, C. familiaris
gcctgggggatccctg

SEQ ID NO: 321121 - DNA, 16 bp, C. familiaris
gcctggggggctcagt

SEQ ID NO: 321122 - DNA, 16 bp, C. familiaris
gcctgggtgctcagtg

SEQ ID NO: 321123 - DNA, 16 bp, C. familiaris
gcctgggtggcatggt

SEQ ID NO: 321124 - DNA, 16 bp, C. familiaris
gcctgggtggccagtg

SEQ ID NO: 321125 - DNA, 16 bp, C. familiaris
gcctgggtggcctcag

SEQ ID NO: 321126 - DNA, 16 bp, C. familiaris
gcctgggtgggggcag

SEQ ID NO: 321127 - DNA, 16 bp, C. familiaris
gcctgggtttaaatcc

SEQ ID NO: 321128 - DNA, 16 bp, C. familiaris
gcctggtcctatttcc

SEQ ID NO: 321129 - DNA, 16 bp, C. familiaris
gcctggtctctgtgga

SEQ ID NO: 321130 - DNA, 16 bp, C. familiaris
gcctggttcaacactc

SEQ ID NO: 321131 - DNA, 16 bp, C. familiaris
gcctgtcactccccct

SEQ ID NO: 321132 - DNA, 16 bp, C. familiaris
gcctgtctgtctctct

SEQ ID NO: 321133 - DNA, 16 bp, C. familiaris
gcctgtgctttctctc

SEQ ID NO: 321134 - DNA, 16 bp, C. familiaris
gcctgtgtccctgccc

SEQ ID NO: 321135 - DNA, 16 bp, C. familiaris
gcctgtgtctccatct

SEQ ID NO: 321136 - DNA, 16 bp, C. familiaris
gcctgtgtctcctcct

SEQ ID NO: 321137 - DNA, 16 bp, C. familiaris
gcctgtgtgcctctct

SEQ ID NO: 321138 - DNA, 16 bp, C. familiaris
gcctgtgtggctctgt

SEQ ID NO: 321139 - DNA, 17 bp, C. familiaris
gcctgtgttctcctcta

SEQ ID NO: 321140 - DNA, 16 bp, C. familiaris
gcctgtgtttccgcct

SEQ ID NO: 321141 - DNA, 16 bp, C. familiaris
gcctgttgcaggactt

SEQ ID NO: 321142 - DNA, 16 bp, C. familiaris
gcctgtttcctcttct

SEQ ID NO: 321143 - DNA, 16 bp, C. familiaris
gccttaatttttaaaa

SEQ ID NO: 321144 - DNA, 16 bp, C. familiaris
gccttcaacccagggc

SEQ ID NO: 321145 - DNA, 16 bp, C. familiaris
gccttcaacccaggtc

SEQ ID NO: 321146 - DNA, 16 bp, C. familiaris
gccttcaagatccatc

SEQ ID NO: 321147 - DNA, 16 bp, C. familiaris
gccttcagaactgtga

SEQ ID NO: 321148 - DNA, 16 bp, C. familiaris
gccttcagcccaagga

SEQ ID NO: 321149 - DNA, 16 bp, C. familiaris
gccttcagcccaggag

SEQ ID NO: 321150 - DNA, 16 bp, C. familiaris
gccttcagcctgggga

SEQ ID NO: 321151 - DNA, 16 bp, C. familiaris
gccttcagctcaagcc

SEQ ID NO: 321152 - DNA, 16 bp, C. familiaris
gccttcagctcacggc

SEQ ID NO: 321153 - DNA, 16 bp, C. familiaris
gccttcagctcatggc

SEQ ID NO: 321154 - DNA, 16 bp, C. familiaris
gccttccaggtctctg

SEQ ID NO: 321155 - DNA, 16 bp, C. familiaris
gccttcccaggggaat

SEQ ID NO: 321156 - DNA, 16 bp, C. familiaris
gccttccgcctggggt

SEQ ID NO: 321157 - DNA, 16 bp, C. familiaris
gccttccttgaccacc

SEQ ID NO: 321158 - DNA, 16 bp, C. familiaris
gccttcggctccgggc

SEQ ID NO: 321159 - DNA, 16 bp, C. familiaris
gccttgtgtcccagga

SEQ ID NO: 321160 - DNA, 16 bp, C. familiaris
gccttgtgtcccgggg

SEQ ID NO: 321161 - DNA, 16 bp, C. familiaris
gcctttaaaaaaaaaa

SEQ ID NO: 321162 - DNA, 16 bp, C. familiaris
gcctttaaaaggaagg

SEQ ID NO: 321163 - DNA, 16 bp, C. familiaris
gcctttagaaatgaca

SEQ ID NO: 321164 - DNA, 16 bp, C. familiaris
gcctttcatgaataaa

SEQ ID NO: 321165 - DNA, 16 bp, C. familiaris
gcctttctctcatgaa

SEQ ID NO: 321166 - DNA, 16 bp, C. familiaris
gcctttgctgtatccc

SEQ ID NO: 321167 - DNA, 16 bp, C. familiaris
gcctttgcttttggag

SEQ ID NO: 321168 - DNA, 16 bp, C. familiaris
gcctttggccagggcg

SEQ ID NO: 321169 - DNA, 16 bp, C. familiaris
gcctttggctcaagcc

SEQ ID NO: 321170 - DNA, 16 bp, C. familiaris
gcctttggctcagagc

SEQ ID NO: 321171 - DNA, 16 bp, C. familiaris
gcctttggctcagggc

SEQ ID NO: 321172 - DNA, 16 bp, C. familiaris
gcctttgggtcagggc

SEQ ID NO: 321173 - DNA, 16 bp, C. familiaris
gccttttccagaatgc

SEQ ID NO: 321174 - DNA, 16 bp, C. familiaris
gccttttgtggttcca

SEQ ID NO: 321175 - DNA, 16 bp, C. familiaris
gcgaccccaggatcac

SEQ ID NO: 321176 - DNA, 16 bp, C. familiaris
gcgactttactgaatt

SEQ ID NO: 321177 - DNA, 16 bp, C. familiaris
gcgatccaggagaccc

SEQ ID NO: 321178 - DNA, 16 bp, C. familiaris
gcgcactctccccggg

SEQ ID NO: 321179 - DNA, 16 bp, C. familiaris
gcgcaggcgcaggcgc

SEQ ID NO: 321180 - DNA, 16 bp, C. familiaris
gcgcaggcgccggagc

SEQ ID NO: 321181 - DNA, 22 bp, C. familiaris
gcgcagttgctgttactgtccc

SEQ ID NO: 321182 - DNA, 16 bp, C. familiaris
gcgccaccctgggatc

SEQ ID NO: 321183 - DNA, 16 bp, C. familiaris
gcgccctctgctggcc

SEQ ID NO: 321184 - DNA, 16 bp, C. familiaris
gcgccctgcgccaaag

SEQ ID NO: 321185 - DNA, 17 bp, C. familiaris
gcgccctgtgctccggg

SEQ ID NO: 321186 - DNA, 16 bp, C. familiaris
gcgccgcctgcagacc

SEQ ID NO: 321187 - DNA, 16 bp, C. familiaris
gcgccgcctgcagctc

SEQ ID NO: 321188 - DNA, 16 bp, C. familiaris
gcgccgccttccaccc

SEQ ID NO: 321189 - DNA, 16 bp, C. familiaris
gcgcctgcctctggcc

SEQ ID NO: 321190 - DNA, 16 bp, C. familiaris
gcgcctggctggctcc

SEQ ID NO: 321191 - DNA, 16 bp, C. familiaris
gcgcgcgcgctctctc

SEQ ID NO: 321192 - DNA, 16 bp, C. familiaris
gcgctgcctgcagccc

SEQ ID NO: 321193 - DNA, 16 bp, C. familiaris
gcgctgccttctgccc

SEQ ID NO: 321194 - DNA, 16 bp, C. familiaris
gcgctgggtgtggagc

SEQ ID NO: 321195 - DNA, 16 bp, C. familiaris
gcggaaggcaggcgcc

SEQ ID NO: 321196 - DNA, 16 bp, C. familiaris
gcggaggaagaagcag

SEQ ID NO: 321197 - DNA, 16 bp, C. familiaris
gcggagggagcagcag

SEQ ID NO: 321198 - DNA, 16 bp, C. familiaris
gcggagggggctgcag

SEQ ID NO: 321199 - DNA, 16 bp, C. familiaris
gcggcacctggctggc

SEQ ID NO: 321200 - DNA, 16 bp, C. familiaris
gcggcagcagcagcag

SEQ ID NO: 321201 - DNA, 16 bp, C. familiaris
gcggcggcagcagcag

SEQ ID NO: 321202 - DNA, 16 bp, C. familiaris
gcggcggcggctgcag

SEQ ID NO: 321203 - DNA, 16 bp, C. familiaris
gcggctccggctccgg

SEQ ID NO: 321204 - DNA, 16 bp, C. familiaris
gcgggaagcctgcttc

SEQ ID NO: 321205 - DNA, 16 bp, C. familiaris
gcgggaccaggagcag

SEQ ID NO: 321206 - DNA, 17 bp, C. familiaris
gcgggacctggagcagc

SEQ ID NO: 321207 - DNA, 16 bp, C. familiaris
gcgggactggatcctg

SEQ ID NO: 321208 - DNA, 16 bp, C. familiaris
gcgggagcagctcggg

SEQ ID NO: 321209 - DNA, 16 bp, C. familiaris
gcgggctccctgcggg

SEQ ID NO: 321210 - DNA, 16 bp, C. familiaris
gcggggctcgattcca

SEQ ID NO: 321211 - DNA, 16 bp, C. familiaris
gcggtggagcacctgc

SEQ ID NO: 321212 - DNA, 16 bp, C. familiaris
gcggtggcggcggcag

SEQ ID NO: 321213 - DNA, 16 bp, C. familiaris
gcgtcgggccccctgc

SEQ ID NO: 321214 - DNA, 16 bp, C. familiaris
gcgtgatcctggagtc

SEQ ID NO: 321215 - DNA, 16 bp, C. familiaris
gcgtgggtggctcagc

SEQ ID NO: 321216 - DNA, 16 bp, C. familiaris
gcgttgggctccccgc

SEQ ID NO: 321217 - DNA, 16 bp, C. familiaris
gctaaaatcaaaaaca

SEQ ID NO: 321218 - DNA, 16 bp, C. familiaris
gctaaaggcaggtgcc

SEQ ID NO: 321219 - DNA, 16 bp, C. familiaris
gctaagacttccagta

SEQ ID NO: 321220 - DNA, 16 bp, C. familiaris
gctaagggagagggag

SEQ ID NO: 321221 - DNA, 16 bp, C. familiaris
gctaattcagaagcac

SEQ ID NO: 321222 - DNA, 16 bp, C. familiaris
gctacaacctggatga

SEQ ID NO: 321223 - DNA, 16 bp, C. familiaris
gctacagatttttccc

SEQ ID NO: 321224 - DNA, 16 bp, C. familiaris
gctaccatattgggca

SEQ ID NO: 321225 - DNA, 16 bp, C. familiaris
gctacccaggcaccac

SEQ ID NO: 321226 - DNA, 16 bp, C. familiaris
gctactatttcttcaa

SEQ ID NO: 321227 - DNA, 16 bp, C. familiaris
gctactccctctccct

SEQ ID NO: 321228 - DNA, 16 bp, C. familiaris
gctactctgactttct

SEQ ID NO: 321229 - DNA, 16 bp, C. familiaris
gctagagaaaaaaaca

SEQ ID NO: 321230 - DNA, 16 bp, C. familiaris
gctagagaaaagaaat

SEQ ID NO: 321231 - DNA, 16 bp, C. familiaris
gctattgtgaatggaa

SEQ ID NO: 321232 - DNA, 16 bp, C. familiaris
gctatttggaatcttt

SEQ ID NO: 321233 - DNA, 16 bp, C. familiaris
gctcaaagaaataatc

SEQ ID NO: 321234 - DNA, 16 bp, C. familiaris
gctcaacctctgggcc

SEQ ID NO: 321235 - DNA, 16 bp, C. familiaris
gctcaagccatgatct

SEQ ID NO: 321236 - DNA, 16 bp, C. familiaris
gctcaaggcatgattc

SEQ ID NO: 321237 - DNA, 16 bp, C. familiaris
gctcaaggtcactcag

SEQ ID NO: 321238 - DNA, 16 bp, C. familiaris
gctcacagcagcatta

SEQ ID NO: 321239 - DNA, 16 bp, C. familiaris
gctcactgctcagcag

SEQ ID NO: 321240 - DNA, 16 bp, C. familiaris
gctcagagaagcagag

SEQ ID NO: 321241 - DNA, 16 bp, C. familiaris
gctcagagacattaag

SEQ ID NO: 321242 - DNA, 16 bp, C. familiaris
gctcagagaggccaag

SEQ ID NO: 321243 - DNA, 16 bp, C. familiaris
gctcagatcatgttcc

SEQ ID NO: 321244 - DNA, 16 bp, C. familiaris
gctcagatcctgatct

SEQ ID NO: 321245 - DNA, 16 bp, C. familiaris
gctcagcaagaagcct

SEQ ID NO: 321246 - DNA, 16 bp, C. familiaris
gctcagcagctgagca

SEQ ID NO: 321247 - DNA, 16 bp, C. familiaris
gctcagcaggaaatct

SEQ ID NO: 321248 - DNA, 16 bp, C. familiaris
gctcagcagtggagca

SEQ ID NO: 321249 - DNA, 16 bp, C. familiaris
gctcagcatcacttat

SEQ ID NO: 321250 - DNA, 16 bp, C. familiaris
gctcagcccctgcctg

SEQ ID NO: 321251 - DNA, 16 bp, C. familiaris
gctcagcggggaacct

SEQ ID NO: 321252 - DNA, 16 bp, C. familiaris
gctcagctggaagagc

SEQ ID NO: 321253 - DNA, 16 bp, C. familiaris
gctcagctggtgaagt

SEQ ID NO: 321254 - DNA, 16 bp, C. familiaris
gctcagcttggggcag

SEQ ID NO: 321255 - DNA, 16 bp, C. familiaris
gctcaggcagcggctc

SEQ ID NO: 321256 - DNA, 16 bp, C. familiaris
gctcaggccatgatct

SEQ ID NO: 321257 - DNA, 16 bp, C. familiaris
gctcagggcagcctgg

SEQ ID NO: 321258 - DNA, 16 bp, C. familiaris
gctcagggctcagggc

SEQ ID NO: 321259 - DNA, 16 bp, C. familiaris
gctcaggtcatgatct

SEQ ID NO: 321260 - DNA, 16 bp, C. familiaris
gctcaggtggcggctc

SEQ ID NO: 321261 - DNA, 16 bp, C. familiaris
gctcaggttgagatct

SEQ ID NO: 321262 - DNA, 16 bp, C. familiaris
gctcagtcagttgact

SEQ ID NO: 321263 - DNA, 16 bp, C. familiaris
gctcagtggccacatg

SEQ ID NO: 321264 - DNA, 16 bp, C. familiaris
gctcagtggctgagcg

SEQ ID NO: 321265 - DNA, 16 bp, C. familiaris
gctcagtgggaagctt

SEQ ID NO: 321266 - DNA, 16 bp, C. familiaris
gctcagtggtgagcct

SEQ ID NO: 321267 - DNA, 16 bp, C. familiaris
gctcagtgttttagca

SEQ ID NO: 321268 - DNA, 16 bp, C. familiaris
gctcagttggctaaac

SEQ ID NO: 321269 - DNA, 16 bp, C. familiaris
gctcatcagggagcct

SEQ ID NO: 321270 - DNA, 16 bp, C. familiaris
gctcatccaatcaagt

SEQ ID NO: 321271 - DNA, 16 bp, C. familiaris
gctcattcacattcag

SEQ ID NO: 321272 - DNA, 16 bp, C. familiaris
gctccacacccagcgc

SEQ ID NO: 321273 - DNA, 16 bp, C. familiaris
gctccaccctcagcac

SEQ ID NO: 321274 - DNA, 18 bp, C. familiaris
gctccacggagggggctg

SEQ ID NO: 321275 - DNA, 16 bp, C. familiaris
gctccactgcccctcc

SEQ ID NO: 321276 - DNA, 16 bp, C. familiaris
gctccagagctgcccc

SEQ ID NO: 321277 - DNA, 16 bp, C. familiaris
gctccagctccagctg

SEQ ID NO: 321278 - DNA, 16 bp, C. familiaris
gctccaggagcagctc

SEQ ID NO: 321279 - DNA, 16 bp, C. familiaris
gctccaggagggcagg

SEQ ID NO: 321280 - DNA, 16 bp, C. familiaris
gctccaggctccaggc

SEQ ID NO: 321281 - DNA, 16 bp, C. familiaris
gctccaggctgggcat

SEQ ID NO: 321282 - DNA, 16 bp, C. familiaris
gctccagggctggaga

SEQ ID NO: 321283 - DNA, 16 bp, C. familiaris
gctccatgagagcagg

SEQ ID NO: 321284 - DNA, 16 bp, C. familiaris
gctccatgcacctgga

SEQ ID NO: 321285 - DNA, 16 bp, C. familiaris
gctccatgcagggact

SEQ ID NO: 321286 - DNA, 16 bp, C. familiaris
gctccatgctgagtgc

SEQ ID NO: 321287 - DNA, 16 bp, C. familiaris
gctccatgctggccat

SEQ ID NO: 321288 - DNA, 16 bp, C. familiaris
gctccatgctgggcaa

SEQ ID NO: 321289 - DNA, 16 bp, C. familiaris
gctccatggaggaagc

SEQ ID NO: 321290 - DNA, 16 bp, C. familiaris
gctcccagccctgccc

SEQ ID NO: 321291 - DNA, 16 bp, C. familiaris
gctcccaggctcccag

SEQ ID NO: 321292 - DNA, 16 bp, C. familiaris
gctccccacacagagc

SEQ ID NO: 321293 - DNA, 16 bp, C. familiaris
gctccccacagggacc

SEQ ID NO: 321294 - DNA, 16 bp, C. familiaris
gctccccagaaggagc

SEQ ID NO: 321295 - DNA, 16 bp, C. familiaris
gctccccaggaggagc

SEQ ID NO: 321296 - DNA, 16 bp, C. familiaris
gctccccagggctccc

SEQ ID NO: 321297 - DNA, 16 bp, C. familiaris
gctccccgaggccccg

SEQ ID NO: 321298 - DNA, 16 bp, C. familiaris
gctcccggtggggagc

SEQ ID NO: 321299 - DNA, 16 bp, C. familiaris
gctccctccagaggct

SEQ ID NO: 321300 - DNA, 16 bp, C. familiaris
gctccctccgtggagc

SEQ ID NO: 321301 - DNA, 16 bp, C. familiaris
gctccctctatggagc

SEQ ID NO: 321302 - DNA, 16 bp, C. familiaris
gctccctgaaggagcc

SEQ ID NO: 321303 - DNA, 16 bp, C. familiaris
gctccctgaaggcagg

SEQ ID NO: 321304 - DNA, 16 bp, C. familiaris
gctccctgagcctgct

SEQ ID NO: 321305 - DNA, 16 bp, C. familiaris
gctccctgaggagcag

SEQ ID NO: 321306 - DNA, 16 bp, C. familiaris
gctccctgagggagcc

SEQ ID NO: 321307 - DNA, 16 bp, C. familiaris
gctccctgcagagagt

SEQ ID NO: 321308 - DNA, 16 bp, C. familiaris
gctccctgcagaggag

SEQ ID NO: 321309 - DNA, 16 bp, C. familiaris
gctccctgcaggaccc

SEQ ID NO: 321310 - DNA, 16 bp, C. familiaris
gctccctgcaggaggc

SEQ ID NO: 321311 - DNA, 16 bp, C. familiaris
gctccctgcggagagc

SEQ ID NO: 321312 - DNA, 16 bp, C. familiaris
gctccctgctcatcaa

SEQ ID NO: 321313 - DNA, 16 bp, C. familiaris
gctccctgctggagcc

SEQ ID NO: 321314 - DNA, 16 bp, C. familiaris
gctccctggagagagc

SEQ ID NO: 321315 - DNA, 16 bp, C. familiaris
gctccctgtggggagg

SEQ ID NO: 321316 - DNA, 16 bp, C. familiaris
gctccgcgcggagggg

SEQ ID NO: 321317 - DNA, 19 bp, C. familiaris
gctccgcggagggggctgc

SEQ ID NO: 321318 - DNA, 16 bp, C. familiaris
gctccggctccggctc

SEQ ID NO: 321319 - DNA, 16 bp, C. familiaris
gctccgggagcagctc

SEQ ID NO: 321320 - DNA, 18 bp, C. familiaris
gctccggggcctgcgctg

SEQ ID NO: 321321 - DNA, 16 bp, C. familiaris
gctccgtgcggggagc

SEQ ID NO: 321322 - DNA, 16 bp, C. familiaris
gctcctcctgcctgtg

SEQ ID NO: 321323 - DNA, 16 bp, C. familiaris
gctcctcgtggggccc

SEQ ID NO: 321324 - DNA, 16 bp, C. familiaris
gctcctgcagggagcc

SEQ ID NO: 321325 - DNA, 16 bp, C. familiaris
gctcctgccgctgggc

SEQ ID NO: 321326 - DNA, 16 bp, C. familiaris
gctcctgcttctcctg

SEQ ID NO: 321327 - DNA, 16 bp, C. familiaris
gctcctggagacctgg

SEQ ID NO: 321328 - DNA, 16 bp, C. familiaris
gctcctggctcagcag

SEQ ID NO: 321329 - DNA, 16 bp, C. familiaris
gctcctggctcagtgg

SEQ ID NO: 321330 - DNA, 16 bp, C. familiaris
gctcctgggcctgcgc

SEQ ID NO: 321331 - DNA, 16 bp, C. familiaris
gctcctgggtgtctca

SEQ ID NO: 321332 - DNA, 17 bp, C. familiaris
gctcctggtgcgtggag

SEQ ID NO: 321333 - DNA, 16 bp, C. familiaris
gctccttccagtttgg

SEQ ID NO: 321334 - DNA, 16 bp, C. familiaris
gctccttctggggagc

SEQ ID NO: 321335 - DNA, 16 bp, C. familiaris
gctccttgcgtggggc

SEQ ID NO: 321336 - DNA, 16 bp, C. familiaris
gctccttgctcagtgg

SEQ ID NO: 321337 - DNA, 16 bp, C. familiaris
gctccttgctgagcaa

SEQ ID NO: 321338 - DNA, 16 bp, C. familiaris
gctccttggtggctca

SEQ ID NO: 321339 - DNA, 16 bp, C. familiaris
gctcgctcgctcgctc

SEQ ID NO: 321340 - DNA, 16 bp, C. familiaris
gctcgggcagccccgg

SEQ ID NO: 321341 - DNA, 16 bp, C. familiaris
gctcgggctcgggctc

SEQ ID NO: 321342 - DNA, 16 bp, C. familiaris
gctcgttcccaggacc

SEQ ID NO: 321343 - DNA, 16 bp, C. familiaris
gctctaccagctgagc

SEQ ID NO: 321344 - DNA, 16 bp, C. familiaris
gctctatgctcagcag

SEQ ID NO: 321345 - DNA, 16 bp, C. familiaris
gctctcagcttttccc

SEQ ID NO: 321346 - DNA, 16 bp, C. familiaris
gctctcagtctgcagg

SEQ ID NO: 321347 - DNA, 16 bp, C. familiaris
gctctccaggatcaca

SEQ ID NO: 321348 - DNA, 16 bp, C. familiaris
gctctctgcagggagg

SEQ ID NO: 321349 - DNA, 16 bp, C. familiaris
gctctctgcccagtgg

SEQ ID NO: 321350 - DNA, 16 bp, C. familiaris
gctctctgcttggagc

SEQ ID NO: 321351 - DNA, 16 bp, C. familiaris
gctctctgtatggagc

SEQ ID NO: 321352 - DNA, 16 bp, C. familiaris
gctctcttcttggctt

SEQ ID NO: 321353 - DNA, 16 bp, C. familiaris
gctctgcacagggagc

SEQ ID NO: 321354 - DNA, 16 bp, C. familiaris
gctctgcacccagcac

SEQ ID NO: 321355 - DNA, 16 bp, C. familiaris
gctctgcactcagctc

SEQ ID NO: 321356 - DNA, 16 bp, C. familiaris
gctctgcactcagtgg

SEQ ID NO: 321357 - DNA, 16 bp, C. familiaris
gctctgcagaagcttt

SEQ ID NO: 321358 - DNA, 16 bp, C. familiaris
gctctgctgagcaggg

SEQ ID NO: 321359 - DNA, 24 bp, C. familiaris
gctctgcttgtccaggggtagggg

SEQ ID NO: 321360 - DNA, 16 bp, C. familiaris
gctctggagaaaagca

SEQ ID NO: 321361 - DNA, 16 bp, C. familiaris
gctctgggagcagctc

SEQ ID NO: 321362 - DNA, 16 bp, C. familiaris
gctctggggacacaga

SEQ ID NO: 321363 - DNA, 16 bp, C. familiaris
gctctgggtgtgatcc

SEQ ID NO: 321364 - DNA, 16 bp, C. familiaris
gctctggtggcccagc

SEQ ID NO: 321365 - DNA, 16 bp, C. familiaris
gctctgtgcagagagc

SEQ ID NO: 321366 - DNA, 16 bp, C. familiaris
gctctgtgcccagcag

SEQ ID NO: 321367 - DNA, 16 bp, C. familiaris
gctctgtgctcagtga

SEQ ID NO: 321368 - DNA, 16 bp, C. familiaris
gctctgtgggaagcct

SEQ ID NO: 321369 - DNA, 16 bp, C. familiaris
gctctgtgttcagtgt

SEQ ID NO: 321370 - DNA, 16 bp, C. familiaris
gctcttcatctctcct

SEQ ID NO: 321371 - DNA, 16 bp, C. familiaris
gctcttccctctgcct

SEQ ID NO: 321372 - DNA, 16 bp, C. familiaris
gctcttctttctccag

SEQ ID NO: 321373 - DNA, 16 bp, C. familiaris
gctcttggtctcaggg

SEQ ID NO: 321374 - DNA, 16 bp, C. familiaris
gctcttttcagagcca

SEQ ID NO: 321375 - DNA, 16 bp, C. familiaris
gctgaaaatttcccaa

SEQ ID NO: 321376 - DNA, 16 bp, C. familiaris
gctgaaaccaagggtc

SEQ ID NO: 321377 - DNA, 16 bp, C. familiaris
gctgaaagggccagag

SEQ ID NO: 321378 - DNA, 16 bp, C. familiaris
gctgaaatcaagagca

SEQ ID NO: 321379 - DNA, 16 bp, C. familiaris
gctgaaatcaagattc

SEQ ID NO: 321380 - DNA, 16 bp, C. familiaris
gctgaacaggaagccc

SEQ ID NO: 321381 - DNA, 16 bp, C. familiaris
gctgaaccaccggggc

SEQ ID NO: 321382 - DNA, 16 bp, C. familiaris
gctgaaggaagacact

SEQ ID NO: 321383 - DNA, 16 bp, C. familiaris
gctgaaggagttcatc

SEQ ID NO: 321384 - DNA, 16 bp, C. familiaris
gctgaaggcagagact

SEQ ID NO: 321385 - DNA, 16 bp, C. familiaris
gctgaaggcagccacc

SEQ ID NO: 321386 - DNA, 16 bp, C. familiaris
gctgaaggcaggcaca

SEQ ID NO: 321387 - DNA, 16 bp, C. familiaris
gctgaaggcaggcatc

SEQ ID NO: 321388 - DNA, 16 bp, C. familiaris
gctgaaggtagaggct

SEQ ID NO: 321389 - DNA, 16 bp, C. familiaris
gctgaaggtggctcta

SEQ ID NO: 321390 - DNA, 16 bp, C. familiaris
gctgaagtcagacact

SEQ ID NO: 321391 - DNA, 16 bp, C. familiaris
gctgacatggggctca

SEQ ID NO: 321392 - DNA, 16 bp, C. familiaris
gctgaccagttttccc

SEQ ID NO: 321393 - DNA, 16 bp, C. familiaris
gctgaccttgggcaag

SEQ ID NO: 321394 - DNA, 16 bp, C. familiaris
gctgactttggctcag

SEQ ID NO: 321395 - DNA, 16 bp, C. familiaris
gctgagattgagaaat

SEQ ID NO: 321396 - DNA, 16 bp, C. familiaris
gctgagcaagaagccc

SEQ ID NO: 321397 - DNA, 16 bp, C. familiaris
gctgagcaaggagtct

SEQ ID NO: 321398 - DNA, 16 bp, C. familiaris
gctgagcacacagccc

SEQ ID NO: 321399 - DNA, 16 bp, C. familiaris
gctgagcactgagccc

SEQ ID NO: 321400 - DNA, 16 bp, C. familiaris
gctgagcaggaagctg

SEQ ID NO: 321401 - DNA, 16 bp, C. familiaris
gctgagcaggggaccc

SEQ ID NO: 321402 - DNA, 16 bp, C. familiaris
gctgagccacccgggc

SEQ ID NO: 321403 - DNA, 16 bp, C. familiaris
gctgagccacgtgggc

SEQ ID NO: 321404 - DNA, 16 bp, C. familiaris
gctgagccactcaggg

SEQ ID NO: 321405 - DNA, 16 bp, C. familiaris
gctgagccccacccag

SEQ ID NO: 321406 - DNA, 16 bp, C. familiaris
gctgagccccccaggt

SEQ ID NO: 321407 - DNA, 16 bp, C. familiaris
gctgagccgccggggc

SEQ ID NO: 321408 - DNA, 16 bp, C. familiaris
gctgagcctggagccc

SEQ ID NO: 321409 - DNA, 16 bp, C. familiaris
gctgagcgacccgggc

SEQ ID NO: 321410 - DNA, 16 bp, C. familiaris
gctgagctgggagccc

SEQ ID NO: 321411 - DNA, 16 bp, C. familiaris
gctgaggaagaagcag

SEQ ID NO: 321412 - DNA, 16 bp, C. familiaris
gctgaggacacagcag

SEQ ID NO: 321413 - DNA, 16 bp, C. familiaris
gctgaggcacccgggc

SEQ ID NO: 321414 - DNA, 16 bp, C. familiaris
gctgaggcagagggag

SEQ ID NO: 321415 - DNA, 16 bp, C. familiaris
gctgaggctgaggctg

SEQ ID NO: 321416 - DNA, 16 bp, C. familiaris
gctgagggagaagcag

SEQ ID NO: 321417 - DNA, 16 bp, C. familiaris
gctgaggtcatgacct

SEQ ID NO: 321418 - DNA, 16 bp, C. familiaris
gctgaggttgagaaat

SEQ ID NO: 321419 - DNA, 16 bp, C. familiaris
gctgagtgcagagacc

SEQ ID NO: 321420 - DNA, 16 bp, C. familiaris
gctgagtgggaagccc

SEQ ID NO: 321421 - DNA, 16 bp, C. familiaris
gctgatctgcacagct

SEQ ID NO: 321422 - DNA, 16 bp, C. familiaris
gctgcaaatggcaaga

SEQ ID NO: 321423 - DNA, 16 bp, C. familiaris
gctgcacattggaatc

SEQ ID NO: 321424 - DNA, 16 bp, C. familiaris
gctgcaccacccgggc

SEQ ID NO: 321425 - DNA, 16 bp, C. familiaris
gctgcaccagttggca

SEQ ID NO: 321426 - DNA, 16 bp, C. familiaris
gctgcacccgccacct

SEQ ID NO: 321427 - DNA, 16 bp, C. familiaris
gctgcacctgctgcct

SEQ ID NO: 321428 - DNA, 16 bp, C. familiaris
gctgcagagataaaag

SEQ ID NO: 321429 - DNA, 16 bp, C. familiaris
gctgcagcaacttctt

SEQ ID NO: 321430 - DNA, 16 bp, C. familiaris
gctgcagcagcagcag

SEQ ID NO: 321431 - DNA, 16 bp, C. familiaris
gctgcagccacactgg

SEQ ID NO: 321432 - DNA, 16 bp, C. familiaris
gctgcaggacttgatc

SEQ ID NO: 321433 - DNA, 16 bp, C. familiaris
gctgcaggcaggtgct

SEQ ID NO: 321434 - DNA, 18 bp, C. familiaris
gctgcaggggctgcaggg

SEQ ID NO: 321435 - DNA, 16 bp, C. familiaris
gctgcaggtgtccttc

SEQ ID NO: 321436 - DNA, 16 bp, C. familiaris
gctgcagtgagaagag

SEQ ID NO: 321437 - DNA, 16 bp, C. familiaris
gctgcatactgtatga

SEQ ID NO: 321438 - DNA, 16 bp, C. familiaris
gctgcatgctctacca

SEQ ID NO: 321439 - DNA, 16 bp, C. familiaris
gctgccaccaccacca

SEQ ID NO: 321440 - DNA, 16 bp, C. familiaris
gctgccatgaacattc

SEQ ID NO: 321441 - DNA, 16 bp, C. familiaris
gctgcccagccccctg

SEQ ID NO: 321442 - DNA, 16 bp, C. familiaris
gctgcccaggagcccc

SEQ ID NO: 321443 - DNA, 16 bp, C. familiaris
gctgcccaggctgccc

SEQ ID NO: 321444 - DNA, 16 bp, C. familiaris
gctgcccaggtgccct

SEQ ID NO: 321445 - DNA, 16 bp, C. familiaris
gctgcccccaggcccc

SEQ ID NO: 321446 - DNA, 16 bp, C. familiaris
gctgcccctgcccagc

SEQ ID NO: 321447 - DNA, 16 bp, C. familiaris
gctgcccctgctgctg

SEQ ID NO: 321448 - DNA, 17 bp, C. familiaris
gctgcccgagcccctcc

SEQ ID NO: 321449 - DNA, 16 bp, C. familiaris
gctgcccgggctgccc

SEQ ID NO: 321450 - DNA, 16 bp, C. familiaris
gctgccctgggcctgg

SEQ ID NO: 321451 - DNA, 16 bp, C. familiaris
gctgccctggtggctc

SEQ ID NO: 321452 - DNA, 16 bp, C. familiaris
gctgccgcccgagccc

SEQ ID NO: 321453 - DNA, 16 bp, C. familiaris
gctgccgccgccactg

SEQ ID NO: 321454 - DNA, 16 bp, C. familiaris
gctgcctccagcccag

SEQ ID NO: 321455 - DNA, 16 bp, C. familiaris
gctgcctcctccagga

SEQ ID NO: 321456 - DNA, 16 bp, C. familiaris
gctgcctgcagcccag

SEQ ID NO: 321457 - DNA, 16 bp, C. familiaris
gctgcctgcagcctgg

SEQ ID NO: 321458 - DNA, 16 bp, C. familiaris
gctgcctgcgtggagc

SEQ ID NO: 321459 - DNA, 16 bp, C. familiaris
gctgcctgtgttctct

SEQ ID NO: 321460 - DNA, 16 bp, C. familiaris
gctgccttcagcccag

SEQ ID NO: 321461 - DNA, 16 bp, C. familiaris
gctgcgccaccagggc

SEQ ID NO: 321462 - DNA, 16 bp, C. familiaris
gctgcggaggctgcgg

SEQ ID NO: 321463 - DNA, 16 bp, C. familiaris
gctgcggctgcggctg

SEQ ID NO: 321464 - DNA, 16 bp, C. familiaris
gctgctcagcccctgc

SEQ ID NO: 321465 - DNA, 16 bp, C. familiaris
gctgctccaggtcccg

SEQ ID NO: 321466 - DNA, 16 bp, C. familiaris
gctgctcccagtcctg

SEQ ID NO: 321467 - DNA, 16 bp, C. familiaris
gctgctcccggagccg

SEQ ID NO: 321468 - DNA, 16 bp, C. familiaris
gctgctccctctgctg

SEQ ID NO: 321469 - DNA, 16 bp, C. familiaris
gctgctcctgctcctg

SEQ ID NO: 321470 - DNA, 16 bp, C. familiaris
gctgctcctgctgctc

SEQ ID NO: 321471 - DNA, 16 bp, C. familiaris
gctgctcctggggccc

SEQ ID NO: 321472 - DNA, 16 bp, C. familiaris
gctgctcttggagaga

SEQ ID NO: 321473 - DNA, 16 bp, C. familiaris
gctgctgaagctccag

SEQ ID NO: 321474 - DNA, 16 bp, C. familiaris
gctgctgccactgctg

SEQ ID NO: 321475 - DNA, 16 bp, C. familiaris
gctgctgccccgggcc

SEQ ID NO: 321476 - DNA, 16 bp, C. familiaris
gctgctgccctgggcc

SEQ ID NO: 321477 - DNA, 16 bp, C. familiaris
gctgctgccgccgccg

SEQ ID NO: 321478 - DNA, 16 bp, C. familiaris
gctgctgccgccgctg

SEQ ID NO: 321479 - DNA, 16 bp, C. familiaris
gctgctgccgctgctg

SEQ ID NO: 321480 - DNA, 16 bp, C. familiaris
gctgctgcggctgctg

SEQ ID NO: 321481 - DNA, 16 bp, C. familiaris
gctgctgctgcagctg

SEQ ID NO: 321482 - DNA, 16 bp, C. familiaris
gctgctgctgcccagc

SEQ ID NO: 321483 - DNA, 16 bp, C. familiaris
gctgctgctgccgctg

SEQ ID NO: 321484 - DNA, 16 bp, C. familiaris
gctgctgctgctctgc

SEQ ID NO: 321485 - DNA, 16 bp, C. familiaris
gctgctgctgctgcag

SEQ ID NO: 321486 - DNA, 16 bp, C. familiaris
gctgctgctgctgcat

SEQ ID NO: 321487 - DNA, 16 bp, C. familiaris
gctgctgctgctgcca

SEQ ID NO: 321488 - DNA, 16 bp, C. familiaris
gctgctgctgctgccg

SEQ ID NO: 321489 - DNA, 16 bp, C. familiaris
gctgctgctgctgcgg

SEQ ID NO: 321490 - DNA, 16 bp, C. familiaris
gctgctgctgctggag

SEQ ID NO: 321491 - DNA, 16 bp, C. familiaris
gctgctgctgctggga

SEQ ID NO: 321492 - DNA, 16 bp, C. familiaris
gctgctgctgctgggc

SEQ ID NO: 321493 - DNA, 16 bp, C. familiaris
gctgctgctgctggtt

SEQ ID NO: 321494 - DNA, 16 bp, C. familiaris
gctgctgctgctgttt

SEQ ID NO: 321495 - DNA, 16 bp, C. familiaris
gctgctgctgcttttt

SEQ ID NO: 321496 - DNA, 17 bp, C. familiaris
gctgctgctggaaccgc

SEQ ID NO: 321497 - DNA, 16 bp, C. familiaris
gctgctgctggggctg

SEQ ID NO: 321498 - DNA, 16 bp, C. familiaris
gctgctgctggtgctg

SEQ ID NO: 321499 - DNA, 16 bp, C. familiaris
gctgctgcttctgcct

SEQ ID NO: 321500 - DNA, 16 bp, C. familiaris
gctgctggagctccag

SEQ ID NO: 321501 - DNA, 16 bp, C. familiaris
gctgctggaggggaag

SEQ ID NO: 321502 - DNA, 16 bp, C. familiaris
gctgctggggaggctg

SEQ ID NO: 321503 - DNA, 16 bp, C. familiaris
gctgctggggctgctg

SEQ ID NO: 321504 - DNA, 16 bp, C. familiaris
gctgctggtccatgga

SEQ ID NO: 321505 - DNA, 16 bp, C. familiaris
gctgctggtggtgatg

SEQ ID NO: 321506 - DNA, 16 bp, C. familiaris
gctgctggtggtgctg

SEQ ID NO: 321507 - DNA, 16 bp, C. familiaris
gctgctgtaaaaaatt

SEQ ID NO: 321508 - DNA, 16 bp, C. familiaris
gctgctgtggaaaaca

SEQ ID NO: 321509 - DNA, 16 bp, C. familiaris
gctgcttctgtatctt

SEQ ID NO: 321510 - DNA, 16 bp, C. familiaris
gctgcttcttctgcct

SEQ ID NO: 321511 - DNA, 16 bp, C. familiaris
gctgctttgaagtctt

SEQ ID NO: 321512 - DNA, 16 bp, C. familiaris
gctggaaaaaagaaaa

SEQ ID NO: 321513 - DNA, 16 bp, C. familiaris
gctggaagaagcaaag

SEQ ID NO: 321514 - DNA, 16 bp, C. familiaris
gctggaagaggcagga

SEQ ID NO: 321515 - DNA, 16 bp, C. familiaris
gctggaaggacaggga

SEQ ID NO: 321516 - DNA, 16 bp, C. familiaris
gctggacacctggcag

SEQ ID NO: 321517 - DNA, 16 bp, C. familiaris
gctggacacggggctc

SEQ ID NO: 321518 - DNA, 16 bp, C. familiaris
gctggacatggaacct

SEQ ID NO: 321519 - DNA, 16 bp, C. familiaris
gctggagacccaggag

SEQ ID NO: 321520 - DNA, 16 bp, C. familiaris
gctggagagctggctg

SEQ ID NO: 321521 - DNA, 16 bp, C. familiaris
gctggaggagaggcag

SEQ ID NO: 321522 - DNA, 16 bp, C. familiaris
gctggaggagagggag

SEQ ID NO: 321523 - DNA, 16 bp, C. familiaris
gctggaggagcagagg

SEQ ID NO: 321524 - DNA, 16 bp, C. familiaris
gctggaggaggaggag

SEQ ID NO: 321525 - DNA, 16 bp, C. familiaris
gctggaggcagcgcta

SEQ ID NO: 321526 - DNA, 16 bp, C. familiaris
gctggagggaaggtgg

SEQ ID NO: 321527 - DNA, 16 bp, C. familiaris
gctggagggctggagg

SEQ ID NO: 321528 - DNA, 16 bp, C. familiaris
gctggaggggaaggtg

SEQ ID NO: 321529 - DNA, 16 bp, C. familiaris
gctggaggggaggaga

SEQ ID NO: 321530 - DNA, 16 bp, C. familiaris
gctggatttcaagttg

SEQ ID NO: 321531 - DNA, 16 bp, C. familiaris
gctggcaaggatgcag

SEQ ID NO: 321532 - DNA, 16 bp, C. familiaris
gctggcaagtccaaga

SEQ ID NO: 321533 - DNA, 16 bp, C. familiaris
gctggctcagtcggag

SEQ ID NO: 321534 - DNA, 16 bp, C. familiaris
gctggctggctggcag

SEQ ID NO: 321535 - DNA, 16 bp, C. familiaris
gctggctgggctgggc

SEQ ID NO: 321536 - DNA, 16 bp, C. familiaris
gctggctgtggagcct

SEQ ID NO: 321537 - DNA, 16 bp, C. familiaris
gctgggactggggctg

SEQ ID NO: 321538 - DNA, 16 bp, C. familiaris
gctgggagcctgacac

SEQ ID NO: 321539 - DNA, 16 bp, C. familiaris
gctgggagctgggctg

SEQ ID NO: 321540 - DNA, 16 bp, C. familiaris
gctgggaggagctggg

SEQ ID NO: 321541 - DNA, 16 bp, C. familiaris
gctgggaggaggagga

SEQ ID NO: 321542 - DNA, 16 bp, C. familiaris
gctgggagggagagag

SEQ ID NO: 321543 - DNA, 16 bp, C. familiaris
gctgggagtctgctgg

SEQ ID NO: 321544 - DNA, 16 bp, C. familiaris
gctgggcacctgggtg

SEQ ID NO: 321545 - DNA, 16 bp, C. familiaris
gctgggcactgttcta

SEQ ID NO: 321546 - DNA, 16 bp, C. familiaris
gctgggcagcagcagc

SEQ ID NO: 321547 - DNA, 16 bp, C. familiaris
gctgggcagggctggg

SEQ ID NO: 321548 - DNA, 16 bp, C. familiaris
gctgggccacctgggc

SEQ ID NO: 321549 - DNA, 16 bp, C. familiaris
gctgggccccccaccc

SEQ ID NO: 321550 - DNA, 16 bp, C. familiaris
gctgggcctggagctg

SEQ ID NO: 321551 - DNA, 16 bp, C. familiaris
gctgggcctggggctg

SEQ ID NO: 321552 - DNA, 16 bp, C. familiaris
gctgggcgtggagtct

SEQ ID NO: 321553 - DNA, 16 bp, C. familiaris
gctgggctccctgctc

SEQ ID NO: 321554 - DNA, 16 bp, C. familiaris
gctgggctctgtgctc

SEQ ID NO: 321555 - DNA, 16 bp, C. familiaris
gctgggctggatctca

SEQ ID NO: 321556 - DNA, 16 bp, C. familiaris
gctgggctgggccagg

SEQ ID NO: 321557 - DNA, 16 bp, C. familiaris
gctggggagcctgggg

SEQ ID NO: 321558 - DNA, 16 bp, C. familiaris
gctggggatgcctggg

SEQ ID NO: 321559 - DNA, 16 bp, C. familiaris
gctggggcaggggcag

SEQ ID NO: 321560 - DNA, 16 bp, C. familiaris
gctggggcccaggagg

SEQ ID NO: 321561 - DNA, 16 bp, C. familiaris
gctggggctgcggctg

SEQ ID NO: 321562 - DNA, 16 bp, C. familiaris
gctggggctggagctg

SEQ ID NO: 321563 - DNA, 16 bp, C. familiaris
gctggggctggggcag

SEQ ID NO: 321564 - DNA, 16 bp, C. familiaris
gctgggggagaggcag

SEQ ID NO: 321565 - DNA, 16 bp, C. familiaris
gctgggggaggagcag

SEQ ID NO: 321566 - DNA, 16 bp, C. familiaris
gctggggggcacctgg

SEQ ID NO: 321567 - DNA, 16 bp, C. familiaris
gctggggtccctgggg

SEQ ID NO: 321568 - DNA, 16 bp, C. familiaris
gctgggtgaccctggg

SEQ ID NO: 321569 - DNA, 16 bp, C. familiaris
gctgggtgtagagatt

SEQ ID NO: 321570 - DNA, 16 bp, C. familiaris
gctggtatcttgttga

SEQ ID NO: 321571 - DNA, 16 bp, C. familiaris
gctggtgctgctgctg

SEQ ID NO: 321572 - DNA, 16 bp, C. familiaris
gctggtggctggtggc

SEQ ID NO: 321573 - DNA, 16 bp, C. familiaris
gctggtgtcacagaga

SEQ ID NO: 321574 - DNA, 16 bp, C. familiaris
gctggttctctctctc

SEQ ID NO: 321575 - DNA, 16 bp, C. familiaris
gctgtagtaatcaaaa

SEQ ID NO: 321576 - DNA, 16 bp, C. familiaris
gctgtcattcagaatg

SEQ ID NO: 321577 - DNA, 16 bp, C. familiaris
gctgtccgcggtgctg

SEQ ID NO: 321578 - DNA, 16 bp, C. familiaris
gctgtccgtggtgctg

SEQ ID NO: 321579 - DNA, 16 bp, C. familiaris
gctgtcctgagccctc

SEQ ID NO: 321580 - DNA, 16 bp, C. familiaris
gctgtctacaagccag

SEQ ID NO: 321581 - DNA, 16 bp, C. familiaris
gctgtctgcaagccaa

SEQ ID NO: 321582 - DNA, 16 bp, C. familiaris
gctgtctgtatgtctt

SEQ ID NO: 321583 - DNA, 16 bp, C. familiaris
gctgtgattttgttct

SEQ ID NO: 321584 - DNA, 16 bp, C. familiaris
gctgtgcagatcagtg

SEQ ID NO: 321585 - DNA, 16 bp, C. familiaris
gctgtgcccctgcctg

SEQ ID NO: 321586 - DNA, 16 bp, C. familiaris
gctgtgctcaccacag

SEQ ID NO: 321587 - DNA, 16 bp, C. familiaris
gctgtggaaaacagta

SEQ ID NO: 321588 - DNA, 16 bp, C. familiaris
gctgtggagaaaaggg

SEQ ID NO: 321589 - DNA, 16 bp, C. familiaris
gctgtggcaacttctt

SEQ ID NO: 321590 - DNA, 16 bp, C. familiaris
gctgtggcagtttctt

SEQ ID NO: 321591 - DNA, 16 bp, C. familiaris
gctgtggccaaggtca

SEQ ID NO: 321592 - DNA, 16 bp, C. familiaris
gctgtggccaatgtca

SEQ ID NO: 321593 - DNA, 16 bp, C. familiaris
gctgtggccgaggtca

SEQ ID NO: 321594 - DNA, 16 bp, C. familiaris
gctgtggctccagctg

SEQ ID NO: 321595 - DNA, 16 bp, C. familiaris
gctgtggctgctgctg

SEQ ID NO: 321596 - DNA, 16 bp, C. familiaris
gctgtgtgacctttga

SEQ ID NO: 321597 - DNA, 16 bp, C. familiaris
gctgtgtgactctggg

SEQ ID NO: 321598 - DNA, 16 bp, C. familiaris
gctgtgtgtccagctg

SEQ ID NO: 321599 - DNA, 16 bp, C. familiaris
gctgtgttcatcaaga

SEQ ID NO: 321600 - DNA, 16 bp, C. familiaris
gctgttccctccacct

SEQ ID NO: 321601 - DNA, 16 bp, C. familiaris
gctgttcctgctgcct

SEQ ID NO: 321602 - DNA, 16 bp, C. familiaris
gctgttctgtctttaa

SEQ ID NO: 321603 - DNA, 16 bp, C. familiaris
gctgttggcattttga

SEQ ID NO: 321604 - DNA, 16 bp, C. familiaris
gctgttgtcatcaaga

SEQ ID NO: 321605 - DNA, 16 bp, C. familiaris
gctgtttatctgaaat

SEQ ID NO: 321606 - DNA, 16 bp, C. familiaris
gctgtttcttttgctg

SEQ ID NO: 321607 - DNA, 16 bp, C. familiaris
gcttaaaacaacacaa

SEQ ID NO: 321608 - DNA, 16 bp, C. familiaris
gcttaaacagcagaaa

SEQ ID NO: 321609 - DNA, 16 bp, C. familiaris
gcttaagccactgagc

SEQ ID NO: 321610 - DNA, 16 bp, C. familiaris
gcttacaaacaacaga

SEQ ID NO: 321611 - DNA, 16 bp, C. familiaris
gcttcaccctctgcct

SEQ ID NO: 321612 - DNA, 16 bp, C. familiaris
gcttcactggctgagc

SEQ ID NO: 321613 - DNA, 16 bp, C. familiaris
gcttcagtgtcctcat

SEQ ID NO: 321614 - DNA, 16 bp, C. familiaris
gcttccctctctgtgt

SEQ ID NO: 321615 - DNA, 16 bp, C. familiaris
gcttcctgcaggaagc

SEQ ID NO: 321616 - DNA, 16 bp, C. familiaris
gcttcctgcccttggc

SEQ ID NO: 321617 - DNA, 16 bp, C. familiaris
gcttcctgctcagctg

SEQ ID NO: 321618 - DNA, 16 bp, C. familiaris
gcttcctgctcaggag

SEQ ID NO: 321619 - DNA, 16 bp, C. familiaris
gcttcctggaggaatg

SEQ ID NO: 321620 - DNA, 16 bp, C. familiaris
gcttcctggaggaggt

SEQ ID NO: 321621 - DNA, 16 bp, C. familiaris
gcttcctggcagccaa

SEQ ID NO: 321622 - DNA, 16 bp, C. familiaris
gcttcctgtggggacc

SEQ ID NO: 321623 - DNA, 16 bp, C. familiaris
gcttcctttttctcca

SEQ ID NO: 321624 - DNA, 16 bp, C. familiaris
gcttcgccctctgcct

SEQ ID NO: 321625 - DNA, 16 bp, C. familiaris
gcttctcagccttttg

SEQ ID NO: 321626 - DNA, 16 bp, C. familiaris
gcttctccaggacggg

SEQ ID NO: 321627 - DNA, 16 bp, C. familiaris
gcttctccatcttcct

SEQ ID NO: 321628 - DNA, 16 bp, C. familiaris
gcttctccctcaccct

SEQ ID NO: 321629 - DNA, 16 bp, C. familiaris
gcttctccctccctgt

SEQ ID NO: 321630 - DNA, 16 bp, C. familiaris
gcttctccctcctgct

SEQ ID NO: 321631 - DNA, 16 bp, C. familiaris
gcttctccctctccca

SEQ ID NO: 321632 - DNA, 16 bp, C. familiaris
gcttctcctctgcctc

SEQ ID NO: 321633 - DNA, 16 bp, C. familiaris
gcttctccttccgcct

SEQ ID NO: 321634 - DNA, 16 bp, C. familiaris
gcttctccttctcact

SEQ ID NO: 321635 - DNA, 16 bp, C. familiaris
gcttctctccttggct

SEQ ID NO: 321636 - DNA, 16 bp, C. familiaris
gcttctctctctacct

SEQ ID NO: 321637 - DNA, 16 bp, C. familiaris
gcttctctctctcctg

SEQ ID NO: 321638 - DNA, 16 bp, C. familiaris
gcttctctctctgctg

SEQ ID NO: 321639 - DNA, 16 bp, C. familiaris
gcttctcttggctgtg

SEQ ID NO: 321640 - DNA, 16 bp, C. familiaris
gcttctgtatctttgg

SEQ ID NO: 321641 - DNA, 16 bp, C. familiaris
gcttcttcaaagccag

SEQ ID NO: 321642 - DNA, 16 bp, C. familiaris
gcttcttcctctaccc

SEQ ID NO: 321643 - DNA, 16 bp, C. familiaris
gcttcttcctctggct

SEQ ID NO: 321644 - DNA, 16 bp, C. familiaris
gcttctttgaaaagat

SEQ ID NO: 321645 - DNA, 16 bp, C. familiaris
gcttgaacaacagaaa

SEQ ID NO: 321646 - DNA, 16 bp, C. familiaris
gcttgatagatcattt

SEQ ID NO: 321647 - DNA, 16 bp, C. familiaris
gcttgctgcagggagc

SEQ ID NO: 321648 - DNA, 16 bp, C. familiaris
gcttgctgtgtgccag

SEQ ID NO: 321649 - DNA, 16 bp, C. familiaris
gcttgcttaaaaaaaa

SEQ ID NO: 321650 - DNA, 16 bp, C. familiaris
gcttggtctcatgacc

SEQ ID NO: 321651 - DNA, 16 bp, C. familiaris
gcttgtcttcctctct

SEQ ID NO: 321652 - DNA, 16 bp, C. familiaris
gcttgttctttgaaaa

SEQ ID NO: 321653 - DNA, 16 bp, C. familiaris
gctttaatttttttaa

SEQ ID NO: 321654 - DNA, 16 bp, C. familiaris
gctttagattctcttt

SEQ ID NO: 321655 - DNA, 16 bp, C. familiaris
gctttatttttaatag

SEQ ID NO: 321656 - DNA, 16 bp, C. familiaris
gctttcaaatatgcaa

SEQ ID NO: 321657 - DNA, 17 bp, C. familiaris
gctttccagttttccca

SEQ ID NO: 321658 - DNA, 16 bp, C. familiaris
gctttcttttgagggc

SEQ ID NO: 321659 - DNA, 16 bp, C. familiaris
gctttgatgtggatgg

SEQ ID NO: 321660 - DNA, 16 bp, C. familiaris
gctttggagtcagacc

SEQ ID NO: 321661 - DNA, 16 bp, C. familiaris
gctttggccaatgaga

SEQ ID NO: 321662 - DNA, 16 bp, C. familiaris
gctttgggtggtatgg

SEQ ID NO: 321663 - DNA, 16 bp, C. familiaris
gctttgtatcttgatg

SEQ ID NO: 321664 - DNA, 16 bp, C. familiaris
gcttttatcaaaaaga

SEQ ID NO: 321665 - DNA, 16 bp, C. familiaris
gcttttcagattggct

SEQ ID NO: 321666 - DNA, 16 bp, C. familiaris
gcttttgcttctcttg

SEQ ID NO: 321667 - DNA, 16 bp, C. familiaris
gcttttggctctggtc

SEQ ID NO: 321668 - DNA, 16 bp, C. familiaris
gcttttggtgtcttat

SEQ ID NO: 321669 - DNA, 16 bp, C. familiaris
gcttttgtttgccttg

SEQ ID NO: 321670 - DNA, 16 bp, C. familiaris
gctttttcatttctct

SEQ ID NO: 321671 - DNA, 16 bp, C. familiaris
gctttttggtgttgag

SEQ ID NO: 321672 - DNA, 16 bp, C. familiaris
ggaaaaaaagtttatt

SEQ ID NO: 321673 - DNA, 16 bp, C. familiaris
ggaaaaaaatacagat

SEQ ID NO: 321674 - DNA, 16 bp, C. familiaris
ggaaaaaatacagtct

SEQ ID NO: 321675 - DNA, 16 bp, C. familiaris
ggaaaaacacaaatta

SEQ ID NO: 321676 - DNA, 16 bp, C. familiaris
ggaaaaagaagatgtg

SEQ ID NO: 321677 - DNA, 16 bp, C. familiaris
ggaaaaagatatttca

SEQ ID NO: 321678 - DNA, 16 bp, C. familiaris
ggaaaaagcaaaactg

SEQ ID NO: 321679 - DNA, 16 bp, C. familiaris
ggaaaaaggggaaccc

SEQ ID NO: 321680 - DNA, 16 bp, C. familiaris
ggaaaaagtcaacaaa

SEQ ID NO: 321681 - DNA, 16 bp, C. familiaris
ggaaaaatatttcatg

SEQ ID NO: 321682 - DNA, 16 bp, C. familiaris
ggaaaaatcagaaagg

SEQ ID NO: 321683 - DNA, 16 bp, C. familiaris
ggaaaaatcccacttg

SEQ ID NO: 321684 - DNA, 16 bp, C. familiaris
ggaaaaattatttgca

SEQ ID NO: 321685 - DNA, 16 bp, C. familiaris
ggaaaaattggacatc

SEQ ID NO: 321686 - DNA, 16 bp, C. familiaris
ggaaaactgaatggga

SEQ ID NO: 321687 - DNA, 16 bp, C. familiaris
ggaaaacttccaaact

SEQ ID NO: 321688 - DNA, 16 bp, C. familiaris
ggaaaagaaatggcca

SEQ ID NO: 321689 - DNA, 16 bp, C. familiaris
ggaaaagaaatgtgtg

SEQ ID NO: 321690 - DNA, 16 bp, C. familiaris
ggaaaagcccacagca

SEQ ID NO: 321691 - DNA, 16 bp, C. familiaris
ggaaaagctctcaatt

SEQ ID NO: 321692 - DNA, 16 bp, C. familiaris
ggaaaagctgtttttc

SEQ ID NO: 321693 - DNA, 16 bp, C. familiaris
ggaaaagctttcagtc

SEQ ID NO: 321694 - DNA, 16 bp, C. familiaris
ggaaaagttctcagtt

SEQ ID NO: 321695 - DNA, 16 bp, C. familiaris
ggaaaataatgatttt

SEQ ID NO: 321696 - DNA, 16 bp, C. familiaris
ggaaaatgcaaataaa

SEQ ID NO: 321697 - DNA, 16 bp, C. familiaris
ggaaaattgaatggga

SEQ ID NO: 321698 - DNA, 16 bp, C. familiaris
ggaaacaaaggctttg

SEQ ID NO: 321699 - DNA, 16 bp, C. familiaris
ggaaacaaatgaaaat

SEQ ID NO: 321700 - DNA, 16 bp, C. familiaris
ggaaacaaatgttgga

SEQ ID NO: 321701 - DNA, 16 bp, C. familiaris
ggaaacaacaggtgtt

SEQ ID NO: 321702 - DNA, 16 bp, C. familiaris
ggaaacaatggctttg

SEQ ID NO: 321703 - DNA, 16 bp, C. familiaris
ggaaacactcaacaaa

SEQ ID NO: 321704 - DNA, 16 bp, C. familiaris
ggaaacagattctctc

SEQ ID NO: 321705 - DNA, 16 bp, C. familiaris
ggaaacagcaggtgca

SEQ ID NO: 321706 - DNA, 16 bp, C. familiaris
ggaaacattcctcagc

SEQ ID NO: 321707 - DNA, 16 bp, C. familiaris
ggaaaccgtcaacaaa

SEQ ID NO: 321708 - DNA, 16 bp, C. familiaris
ggaaacctgcttctcc

SEQ ID NO: 321709 - DNA, 16 bp, C. familiaris
ggaaaccttgtttcca

SEQ ID NO: 321710 - DNA, 16 bp, C. familiaris
ggaaacggaggcccag

SEQ ID NO: 321711 - DNA, 16 bp, C. familiaris
ggaaactgaagaaaaa

SEQ ID NO: 321712 - DNA, 16 bp, C. familiaris
ggaaactgaccaggga

SEQ ID NO: 321713 - DNA, 16 bp, C. familiaris
ggaaactgaggcaaag

SEQ ID NO: 321714 - DNA, 16 bp, C. familiaris
ggaaactgaggccgag

SEQ ID NO: 321715 - DNA, 16 bp, C. familiaris
ggaaacttcctcaact

SEQ ID NO: 321716 - DNA, 16 bp, C. familiaris
ggaaacttgtcatcaa

SEQ ID NO: 321717 - DNA, 16 bp, C. familiaris
ggaaagaaaaacattt

SEQ ID NO: 321718 - DNA, 16 bp, C. familiaris
ggaaagaaggcaggca

SEQ ID NO: 321719 - DNA, 16 bp, C. familiaris
ggaaagaatagccaat

SEQ ID NO: 321720 - DNA, 16 bp, C. familiaris
ggaaagaatccaaatg

SEQ ID NO: 321721 - DNA, 16 bp, C. familiaris
ggaaagaatcttcaag

SEQ ID NO: 321722 - DNA, 16 bp, C. familiaris
ggaaagaattaataag

SEQ ID NO: 321723 - DNA, 16 bp, C. familiaris
ggaaagaattcaaata

SEQ ID NO: 321724 - DNA, 16 bp, C. familiaris
ggaaagacatttaaaa

SEQ ID NO: 321725 - DNA, 16 bp, C. familiaris
ggaaagactatccagt

SEQ ID NO: 321726 - DNA, 16 bp, C. familiaris
ggaaagatcaatgaaa

SEQ ID NO: 321727 - DNA, 16 bp, C. familiaris
ggaaagattttaaaat

SEQ ID NO: 321728 - DNA, 16 bp, C. familiaris
ggaaagctttcagttt

SEQ ID NO: 321729 - DNA, 16 bp, C. familiaris
ggaaaggagaaaatgt

SEQ ID NO: 321730 - DNA, 16 bp, C. familiaris
ggaaaggcaaggcagg

SEQ ID NO: 321731 - DNA, 16 bp, C. familiaris
ggaaaggcttagggaa

SEQ ID NO: 321732 - DNA, 16 bp, C. familiaris
ggaaagggagatgcag

SEQ ID NO: 321733 - DNA, 16 bp, C. familiaris
ggaaagtctgcttgag

SEQ ID NO: 321734 - DNA, 16 bp, C. familiaris
ggaaagtgagaagcag

SEQ ID NO: 321735 - DNA, 16 bp, C. familiaris
ggaaataaacaacagc

SEQ ID NO: 321736 - DNA, 16 bp, C. familiaris
ggaaataataaagttt

SEQ ID NO: 321737 - DNA, 16 bp, C. familiaris
ggaaataattttttta

SEQ ID NO: 321738 - DNA, 16 bp, C. familiaris
ggaaatacaaactggt

SEQ ID NO: 321739 - DNA, 16 bp, C. familiaris
ggaaatacaatcaaaa

SEQ ID NO: 321740 - DNA, 16 bp, C. familiaris
ggaaatcaagaaaaca

SEQ ID NO: 321741 - DNA, 16 bp, C. familiaris
ggaaatgaagctcaga

SEQ ID NO: 321742 - DNA, 16 bp, C. familiaris
ggaaatgaggcccaga

SEQ ID NO: 321743 - DNA, 16 bp, C. familiaris
ggaaatgataaagatt

SEQ ID NO: 321744 - DNA, 16 bp, C. familiaris
ggaaatgcaaatgcaa

SEQ ID NO: 321745 - DNA, 16 bp, C. familiaris
ggaaatggcagaggga

SEQ ID NO: 321746 - DNA, 16 bp, C. familiaris
ggaaatgtggaggctg

SEQ ID NO: 321747 - DNA, 16 bp, C. familiaris
ggaaatgttccctcct

SEQ ID NO: 321748 - DNA, 16 bp, C. familiaris
ggaaattctagaactg

SEQ ID NO: 321749 - DNA, 16 bp, C. familiaris
ggaaattctctctctc

SEQ ID NO: 321750 - DNA, 16 bp, C. familiaris
ggaaatttaataattt

SEQ ID NO: 321751 - DNA, 16 bp, C. familiaris
ggaaatttggaaggaa

SEQ ID NO: 321752 - DNA, 16 bp, C. familiaris
ggaacaaattatctta

SEQ ID NO: 321753 - DNA, 16 bp, C. familiaris
ggaacaacaacactgg

SEQ ID NO: 321754 - DNA, 16 bp, C. familiaris
ggaacaagaaaaggat

SEQ ID NO: 321755 - DNA, 16 bp, C. familiaris
ggaacaagacagagat

SEQ ID NO: 321756 - DNA, 16 bp, C. familiaris
ggaacaatttgagaag

SEQ ID NO: 321757 - DNA, 16 bp, C. familiaris
ggaacacaccctgggc

SEQ ID NO: 321758 - DNA, 16 bp, C. familiaris
ggaacacgacctgagc

SEQ ID NO: 321759 - DNA, 16 bp, C. familiaris
ggaacagaatagagac

SEQ ID NO: 321760 - DNA, 16 bp, C. familiaris
ggaacagaatccagaa

SEQ ID NO: 321761 - DNA, 16 bp, C. familiaris
ggaacagcaagtacaa

SEQ ID NO: 321762 - DNA, 16 bp, C. familiaris
ggaacagcagaaggag

SEQ ID NO: 321763 - DNA, 16 bp, C. familiaris
ggaacagcagaggcag

SEQ ID NO: 321764 - DNA, 16 bp, C. familiaris
ggaacagccagtgcaa

SEQ ID NO: 321765 - DNA, 16 bp, C. familiaris
ggaacagggaagaaat

SEQ ID NO: 321766 - DNA, 17 bp, C. familiaris
ggaacattggacatcca

SEQ ID NO: 321767 - DNA, 16 bp, C. familiaris
ggaacattttccagaa

SEQ ID NO: 321768 - DNA, 16 bp, C. familiaris
ggaaccacactgcttg

SEQ ID NO: 321769 - DNA, 16 bp, C. familiaris
ggaaccagaaaagacc

SEQ ID NO: 321770 - DNA, 16 bp, C. familiaris
ggaaccaggaaagacc

SEQ ID NO: 321771 - DNA, 16 bp, C. familiaris
ggaaccccaggatcac

SEQ ID NO: 321772 - DNA, 16 bp, C. familiaris
ggaaccctgggtggca

SEQ ID NO: 321773 - DNA, 16 bp, C. familiaris
ggaacctgctgctccc

SEQ ID NO: 321774 - DNA, 16 bp, C. familiaris
ggaacctggaggctcc

SEQ ID NO: 321775 - DNA, 16 bp, C. familiaris
ggaacctgggatcaag

SEQ ID NO: 321776 - DNA, 16 bp, C. familiaris
ggaactacaaatcaaa

SEQ ID NO: 321777 - DNA, 16 bp, C. familiaris
ggaactcagtgactcc

SEQ ID NO: 321778 - DNA, 16 bp, C. familiaris
ggaactggaaaaagaa

SEQ ID NO: 321779 - DNA, 16 bp, C. familiaris
ggaactggagaaagag

SEQ ID NO: 321780 - DNA, 16 bp, C. familiaris
ggaagaaaataaattt

SEQ ID NO: 321781 - DNA, 16 bp, C. familiaris
ggaagaaagcaggctc

SEQ ID NO: 321782 - DNA, 16 bp, C. familiaris
ggaagaaagctgagga

SEQ ID NO: 321783 - DNA, 16 bp, C. familiaris
ggaagaaataaaactt

SEQ ID NO: 321784 - DNA, 16 bp, C. familiaris
ggaagaaataaaattg

SEQ ID NO: 321785 - DNA, 16 bp, C. familiaris
ggaagaagcagaagca

SEQ ID NO: 321786 - DNA, 16 bp, C. familiaris
ggaagaagcagcagca

SEQ ID NO: 321787 - DNA, 16 bp, C. familiaris
ggaagaagccaatctg

SEQ ID NO: 321788 - DNA, 16 bp, C. familiaris
ggaagaattaaaaaca

SEQ ID NO: 321789 - DNA, 16 bp, C. familiaris
ggaagaatttgagaag

SEQ ID NO: 321790 - DNA, 16 bp, C. familiaris
ggaagacacaaagaca

SEQ ID NO: 321791 - DNA, 16 bp, C. familiaris
ggaagacacaaggaga

SEQ ID NO: 321792 - DNA, 16 bp, C. familiaris
ggaagacagtatgaag

SEQ ID NO: 321793 - DNA, 16 bp, C. familiaris
ggaagagcagggtccc

SEQ ID NO: 321794 - DNA, 16 bp, C. familiaris
ggaagagctgctgccc

SEQ ID NO: 321795 - DNA, 16 bp, C. familiaris
ggaagagggacaagca

SEQ ID NO: 321796 - DNA, 16 bp, C. familiaris
ggaagagggacaagta

SEQ ID NO: 321797 - DNA, 16 bp, C. familiaris
ggaagaggggctggag

SEQ ID NO: 321798 - DNA, 16 bp, C. familiaris
ggaagagtggcagagg

SEQ ID NO: 321799 - DNA, 16 bp, C. familiaris
ggaagagtgtgtgtgt

SEQ ID NO: 321800 - DNA, 16 bp, C. familiaris
ggaagagtttaagaag

SEQ ID NO: 321801 - DNA, 16 bp, C. familiaris
ggaagagtttgaaaag

SEQ ID NO: 321802 - DNA, 16 bp, C. familiaris
ggaagagtttgtgaag

SEQ ID NO: 321803 - DNA, 16 bp, C. familiaris
ggaagatacaaagaaa

SEQ ID NO: 321804 - DNA, 16 bp, C. familiaris
ggaagatcctcaaaaa

SEQ ID NO: 321805 - DNA, 16 bp, C. familiaris
ggaagatgcaaagaaa

SEQ ID NO: 321806 - DNA, 16 bp, C. familiaris
ggaagcaaagcaagga

SEQ ID NO: 321807 - DNA, 16 bp, C. familiaris
ggaagcagagactgga

SEQ ID NO: 321808 - DNA, 16 bp, C. familiaris
ggaagcagaggctcag

SEQ ID NO: 321809 - DNA, 16 bp, C. familiaris
ggaagcagcagaagga

SEQ ID NO: 321810 - DNA, 16 bp, C. familiaris
ggaagccaaaaatgaa

SEQ ID NO: 321811 - DNA, 16 bp, C. familiaris
ggaagccaaggcccag

SEQ ID NO: 321812 - DNA, 16 bp, C. familiaris
ggaagccatgtggccc

SEQ ID NO: 321813 - DNA, 16 bp, C. familiaris
ggaagcccagtgtggg

SEQ ID NO: 321814 - DNA, 16 bp, C. familiaris
ggaagccctctctgac

SEQ ID NO: 321815 - DNA, 16 bp, C. familiaris
ggaagcctgaagtggg

SEQ ID NO: 321816 - DNA, 16 bp, C. familiaris
ggaagcctgtgtggct

SEQ ID NO: 321817 - DNA, 16 bp, C. familiaris
ggaagccttcttctcc

SEQ ID NO: 321818 - DNA, 16 bp, C. familiaris
ggaagctctgtgccct

SEQ ID NO: 321819 - DNA, 16 bp, C. familiaris
ggaagctgaagaaaaa

SEQ ID NO: 321820 - DNA, 16 bp, C. familiaris
ggaagctgaagctcag

SEQ ID NO: 321821 - DNA, 16 bp, C. familiaris
ggaagctgggtgaagg

SEQ ID NO: 321822 - DNA, 16 bp, C. familiaris
ggaagcttccagaagg

SEQ ID NO: 321823 - DNA, 16 bp, C. familiaris
ggaagctttaaaaaaa

SEQ ID NO: 321824 - DNA, 16 bp, C. familiaris
ggaaggaaaacttcca

SEQ ID NO: 321825 - DNA, 16 bp, C. familiaris
ggaaggaaggagccag

SEQ ID NO: 321826 - DNA, 16 bp, C. familiaris
ggaaggcaggtgctca

SEQ ID NO: 321827 - DNA, 16 bp, C. familiaris
ggaaggcttcacagag

SEQ ID NO: 321828 - DNA, 16 bp, C. familiaris
ggaaggggcagagaca

SEQ ID NO: 321829 - DNA, 16 bp, C. familiaris
ggaaggggcggggcct

SEQ ID NO: 321830 - DNA, 16 bp, C. familiaris
ggaagtcatcagagag

SEQ ID NO: 321831 - DNA, 16 bp, C. familiaris
ggaagtggaggctcag

SEQ ID NO: 321832 - DNA, 16 bp, C. familiaris
ggaagtggggcctttg

SEQ ID NO: 321833 - DNA, 16 bp, C. familiaris
ggaagttccaaaagga

SEQ ID NO: 321834 - DNA, 16 bp, C. familiaris
ggaatataaaatggca

SEQ ID NO: 321835 - DNA, 16 bp, C. familiaris
ggaatatacctcaaca

SEQ ID NO: 321836 - DNA, 16 bp, C. familiaris
ggaatattacacagtc

SEQ ID NO: 321837 - DNA, 16 bp, C. familiaris
ggaatcagcttcttcc

SEQ ID NO: 321838 - DNA, 16 bp, C. familiaris
ggaatcattttttaaa

SEQ ID NO: 321839 - DNA, 16 bp, C. familiaris
ggaatcccaagcaggc

SEQ ID NO: 321840 - DNA, 16 bp, C. familiaris
ggaatcctgggatcca

SEQ ID NO: 321841 - DNA, 16 bp, C. familiaris
ggaatctaagaaaaaa

SEQ ID NO: 321842 - DNA, 16 bp, C. familiaris
ggaatctgaaaaataa

SEQ ID NO: 321843 - DNA, 16 bp, C. familiaris
ggaatgaaaagtacag

SEQ ID NO: 321844 - DNA, 16 bp, C. familiaris
ggaatggctaaaatta

SEQ ID NO: 321845 - DNA, 16 bp, C. familiaris
ggaatgggagaagatg

SEQ ID NO: 321846 - DNA, 16 bp, C. familiaris
ggaatgttccttctat

SEQ ID NO: 321847 - DNA, 16 bp, C. familiaris
ggaattagaggatatt

SEQ ID NO: 321848 - DNA, 16 bp, C. familiaris
ggaattaggatttcaa

SEQ ID NO: 321849 - DNA, 16 bp, C. familiaris
ggaattattctttttt

SEQ ID NO: 321850 - DNA, 16 bp, C. familiaris
ggaattgctggatcaa

SEQ ID NO: 321851 - DNA, 16 bp, C. familiaris
ggaattgctgggtcag

SEQ ID NO: 321852 - DNA, 16 bp, C. familiaris
ggaattggagaaagaa

SEQ ID NO: 321853 - DNA, 16 bp, C. familiaris
ggaatttaagaagaaa

SEQ ID NO: 321854 - DNA, 16 bp, C. familiaris
ggaatttagaaacaaa

SEQ ID NO: 321855 - DNA, 16 bp, C. familiaris
ggacaaaatatttgca

SEQ ID NO: 321856 - DNA, 16 bp, C. familiaris
ggacaaaatgatgaga

SEQ ID NO: 321857 - DNA, 16 bp, C. familiaris
ggacaaacagactctg

SEQ ID NO: 321858 - DNA, 16 bp, C. familiaris
ggacaacagtatggag

SEQ ID NO: 321859 - DNA, 16 bp, C. familiaris
ggacaaggagactccc

SEQ ID NO: 321860 - DNA, 16 bp, C. familiaris
ggacacaaacattcag

SEQ ID NO: 321861 - DNA, 17 bp, C. familiaris
ggacacagcccaggatc

SEQ ID NO: 321862 - DNA, 16 bp, C. familiaris
ggacacatgcacacac

SEQ ID NO: 321863 - DNA, 16 bp, C. familiaris
ggacacctacaacctg

SEQ ID NO: 321864 - DNA, 22 bp, C. familiaris
ggacacctgcaccccgatgttt

SEQ ID NO: 321865 - DNA, 16 bp, C. familiaris
ggacacctggggggct

SEQ ID NO: 321866 - DNA, 16 bp, C. familiaris
ggacacctgtgtggtt

SEQ ID NO: 321867 - DNA, 16 bp, C. familiaris
ggacactgaggcccag

SEQ ID NO: 321868 - DNA, 16 bp, C. familiaris
ggacactttttttttt

SEQ ID NO: 321869 - DNA, 16 bp, C. familiaris
ggacagacggacggac

SEQ ID NO: 321870 - DNA, 16 bp, C. familiaris
ggacagagccacccag

SEQ ID NO: 321871 - DNA, 16 bp, C. familiaris
ggacagatcaatgaaa

SEQ ID NO: 321872 - DNA, 16 bp, C. familiaris
ggacagcagctcttcc

SEQ ID NO: 321873 - DNA, 16 bp, C. familiaris
ggacaggaaagtccag

SEQ ID NO: 321874 - DNA, 16 bp, C. familiaris
ggacaggcggaggcca

SEQ ID NO: 321875 - DNA, 16 bp, C. familiaris
ggacagtggtgatggt

SEQ ID NO: 321876 - DNA, 16 bp, C. familiaris
ggacatgattctggag

SEQ ID NO: 321877 - DNA, 16 bp, C. familiaris
ggacatggacatcttt

SEQ ID NO: 321878 - DNA, 16 bp, C. familiaris
ggacattgttgctata

SEQ ID NO: 321879 - DNA, 16 bp, C. familiaris
ggaccaccagccccag

SEQ ID NO: 321880 - DNA, 16 bp, C. familiaris
ggaccaccagggggtg

SEQ ID NO: 321881 - DNA, 16 bp, C. familiaris
ggaccagcagagggag

SEQ ID NO: 321882 - DNA, 16 bp, C. familiaris
ggaccagttccagggg

SEQ ID NO: 321883 - DNA, 16 bp, C. familiaris
ggacccagagatcacg

SEQ ID NO: 321884 - DNA, 16 bp, C. familiaris
ggaccccaagaccaca

SEQ ID NO: 321885 - DNA, 16 bp, C. familiaris
ggaccccaagatcaca

SEQ ID NO: 321886 - DNA, 16 bp, C. familiaris
ggaccccaatgtggga

SEQ ID NO: 321887 - DNA, 16 bp, C. familiaris
ggaccccagcatcatg

SEQ ID NO: 321888 - DNA, 16 bp, C. familiaris
ggaccccaggatcaca

SEQ ID NO: 321889 - DNA, 16 bp, C. familiaris
ggaccccaggatgaca

SEQ ID NO: 321890 - DNA, 16 bp, C. familiaris
ggaccccagggtcact

SEQ ID NO: 321891 - DNA, 16 bp, C. familiaris
ggaccccggcatcatg

SEQ ID NO: 321892 - DNA, 16 bp, C. familiaris
ggaccccggggtcaca

SEQ ID NO: 321893 - DNA, 16 bp, C. familiaris
ggacccctgggtggtt

SEQ ID NO: 321894 - DNA, 16 bp, C. familiaris
ggacccggcgggaccc

SEQ ID NO: 321895 - DNA, 16 bp, C. familiaris
ggaccctgacgtggga

SEQ ID NO: 321896 - DNA, 16 bp, C. familiaris
ggaccctgaggtgggt

SEQ ID NO: 321897 - DNA, 16 bp, C. familiaris
ggaccctgatgcagga

SEQ ID NO: 321898 - DNA, 16 bp, C. familiaris
ggaccctgggaccagg

SEQ ID NO: 321899 - DNA, 16 bp, C. familiaris
ggaccctgggagcatg

SEQ ID NO: 321900 - DNA, 16 bp, C. familiaris
ggaccctgggccaaag

SEQ ID NO: 321901 - DNA, 16 bp, C. familiaris
ggaccgggaccgggac

SEQ ID NO: 321902 - DNA, 16 bp, C. familiaris
ggacctccaggatcac

SEQ ID NO: 321903 - DNA, 16 bp, C. familiaris
ggacctgaataaacat

SEQ ID NO: 321904 - DNA, 16 bp, C. familiaris
ggacctggtcctggag

SEQ ID NO: 321905 - DNA, 16 bp, C. familiaris
ggacgctcaaccactg

SEQ ID NO: 321906 - DNA, 16 bp, C. familiaris
ggacggatggatggat

SEQ ID NO: 321907 - DNA, 16 bp, C. familiaris
ggacgtgaccctggag

SEQ ID NO: 321908 - DNA, 16 bp, C. familiaris
ggactacatttcccag

SEQ ID NO: 321909 - DNA, 16 bp, C. familiaris
ggactatgccctgggc

SEQ ID NO: 321910 - DNA, 16 bp, C. familiaris
ggactcagtcctggat

SEQ ID NO: 321911 - DNA, 16 bp, C. familiaris
ggactccaagatcatg

SEQ ID NO: 321912 - DNA, 16 bp, C. familiaris
ggactccagaactgtg

SEQ ID NO: 321913 - DNA, 16 bp, C. familiaris
ggactccaggacccca

SEQ ID NO: 321914 - DNA, 16 bp, C. familiaris
ggactccaggatcagg

SEQ ID NO: 321915 - DNA, 16 bp, C. familiaris
ggactccatccaggac

SEQ ID NO: 321916 - DNA, 16 bp, C. familiaris
ggactccatccctggg

SEQ ID NO: 321917 - DNA, 16 bp, C. familiaris
ggactccatcctggat

SEQ ID NO: 321918 - DNA, 16 bp, C. familiaris
ggactccatcctggga

SEQ ID NO: 321919 - DNA, 16 bp, C. familiaris
ggactccatcctgggg

SEQ ID NO: 321920 - DNA, 16 bp, C. familiaris
ggactccatctcagga

SEQ ID NO: 321921 - DNA, 16 bp, C. familiaris
ggactcggagatcatg

SEQ ID NO: 321922 - DNA, 16 bp, C. familiaris
ggactctgggatcgag

SEQ ID NO: 321923 - DNA, 16 bp, C. familiaris
ggactctgtcccagga

SEQ ID NO: 321924 - DNA, 16 bp, C. familiaris
ggactgaatcccacat

SEQ ID NO: 321925 - DNA, 16 bp, C. familiaris
ggactgggagctgcag

SEQ ID NO: 321926 - DNA, 16 bp, C. familiaris
ggacttcatcaatata

SEQ ID NO: 321927 - DNA, 16 bp, C. familiaris
ggacttcattaaaatt

SEQ ID NO: 321928 - DNA, 16 bp, C. familiaris
ggacttcctgcatgga

SEQ ID NO: 321929 - DNA, 16 bp, C. familiaris
ggacttgatcctgaat

SEQ ID NO: 321930 - DNA, 16 bp, C. familiaris
ggacttgatctccagg

SEQ ID NO: 321931 - DNA, 16 bp, C. familiaris
ggacttggagatcatg

SEQ ID NO: 321932 - DNA, 16 bp, C. familiaris
ggactttcttcagagt

SEQ ID NO: 321933 - DNA, 16 bp, C. familiaris
ggacttttattttatt

SEQ ID NO: 321934 - DNA, 16 bp, C. familiaris
ggagaaaaaggctcca

SEQ ID NO: 321935 - DNA, 16 bp, C. familiaris
ggagaaaagggaatcc

SEQ ID NO: 321936 - DNA, 16 bp, C. familiaris
ggagaaaagggaattc

SEQ ID NO: 321937 - DNA, 16 bp, C. familiaris
ggagaaaagtctgttc

SEQ ID NO: 321938 - DNA, 16 bp, C. familiaris
ggagaaaattaacaag

SEQ ID NO: 321939 - DNA, 16 bp, C. familiaris
ggagaaaccaaccctg

SEQ ID NO: 321940 - DNA, 16 bp, C. familiaris
ggagaaagaacagtct

SEQ ID NO: 321941 - DNA, 16 bp, C. familiaris
ggagaaagaagatgtg

SEQ ID NO: 321942 - DNA, 16 bp, C. familiaris
ggagaaagaagcaggc

SEQ ID NO: 321943 - DNA, 16 bp, C. familiaris
ggagaaagaatctgaa

SEQ ID NO: 321944 - DNA, 16 bp, C. familiaris
ggagaaagacaatcat

SEQ ID NO: 321945 - DNA, 16 bp, C. familiaris
ggagaaagaggctccc

SEQ ID NO: 321946 - DNA, 16 bp, C. familiaris
ggagaaagccctggcc

SEQ ID NO: 321947 - DNA, 16 bp, C. familiaris
ggagaaaggggacccc

SEQ ID NO: 321948 - DNA, 16 bp, C. familiaris
ggagaaaggggatccc

SEQ ID NO: 321949 - DNA, 16 bp, C. familiaris
ggagaaagtccatggt

SEQ ID NO: 321950 - DNA, 16 bp, C. familiaris
ggagaaatagatgaat

SEQ ID NO: 321951 - DNA, 16 bp, C. familiaris
ggagaaattaagatat

SEQ ID NO: 321952 - DNA, 16 bp, C. familiaris
ggagaacacagacagc

SEQ ID NO: 321953 - DNA, 16 bp, C. familiaris
ggagaagaacaagcag

SEQ ID NO: 321954 - DNA, 16 bp, C. familiaris
ggagaagaagcagcag

SEQ ID NO: 321955 - DNA, 16 bp, C. familiaris
ggagaagaatgaaact

SEQ ID NO: 321956 - DNA, 16 bp, C. familiaris
ggagaagacagccatc

SEQ ID NO: 321957 - DNA, 16 bp, C. familiaris
ggagaagaggctcccc

SEQ ID NO: 321958 - DNA, 16 bp, C. familiaris
ggagaagatggccatc

SEQ ID NO: 321959 - DNA, 16 bp, C. familiaris
ggagaagatgtggaga

SEQ ID NO: 321960 - DNA, 16 bp, C. familiaris
ggagaagcaagcaggc

SEQ ID NO: 321961 - DNA, 16 bp, C. familiaris
ggagaagcaagctgcc

SEQ ID NO: 321962 - DNA, 16 bp, C. familiaris
ggagaagcacactccc

SEQ ID NO: 321963 - DNA, 16 bp, C. familiaris
ggagaagcagaagcag

SEQ ID NO: 321964 - DNA, 16 bp, C. familiaris
ggagaagcagacagag

SEQ ID NO: 321965 - DNA, 16 bp, C. familiaris
ggagaagcagaggctc

SEQ ID NO: 321966 - DNA, 16 bp, C. familiaris
ggagaagcagatgctc

SEQ ID NO: 321967 - DNA, 16 bp, C. familiaris
ggagaagcagatggag

SEQ ID NO: 321968 - DNA, 16 bp, C. familiaris
ggagaagcagattgcc

SEQ ID NO: 321969 - DNA, 16 bp, C. familiaris
ggagaagcagcagaag

SEQ ID NO: 321970 - DNA, 16 bp, C. familiaris
ggagaagcagcagact

SEQ ID NO: 321971 - DNA, 16 bp, C. familiaris
ggagaagcagcagcag

SEQ ID NO: 321972 - DNA, 16 bp, C. familiaris
ggagaagcagcccccc

SEQ ID NO: 321973 - DNA, 16 bp, C. familiaris
ggagaagcagctccct

SEQ ID NO: 321974 - DNA, 16 bp, C. familiaris
ggagaagcagcttcct

SEQ ID NO: 321975 - DNA, 16 bp, C. familiaris
ggagaagcaggagcag

SEQ ID NO: 321976 - DNA, 17 bp, C. familiaris
ggagaagcaggagctgc

SEQ ID NO: 321977 - DNA, 16 bp, C. familiaris
ggagaagcaggcacag

SEQ ID NO: 321978 - DNA, 16 bp, C. familiaris
ggagaagcaggctctc

SEQ ID NO: 321979 - DNA, 16 bp, C. familiaris
ggagaagcaggctgac

SEQ ID NO: 321980 - DNA, 16 bp, C. familiaris
ggagaagcaggctgtg

SEQ ID NO: 321981 - DNA, 16 bp, C. familiaris
ggagaagcagggaacc

SEQ ID NO: 321982 - DNA, 16 bp, C. familiaris
ggagaagcagggagcc

SEQ ID NO: 321983 - DNA, 16 bp, C. familiaris
ggagaagcaggtgcag

SEQ ID NO: 321984 - DNA, 16 bp, C. familiaris
ggagaagccggctcca

SEQ ID NO: 321985 - DNA, 16 bp, C. familiaris
ggagaagctgacttcc

SEQ ID NO: 321986 - DNA, 16 bp, C. familiaris
ggagaagctgcagcaa

SEQ ID NO: 321987 - DNA, 16 bp, C. familiaris
ggagaaggaacagcaa

SEQ ID NO: 321988 - DNA, 16 bp, C. familiaris
ggagaaggagaaccag

SEQ ID NO: 321989 - DNA, 16 bp, C. familiaris
ggagaaggagaatcag

SEQ ID NO: 321990 - DNA, 16 bp, C. familiaris
ggagaaggagcagcag

SEQ ID NO: 321991 - DNA, 16 bp, C. familiaris
ggagaaggcagccatc

SEQ ID NO: 321992 - DNA, 16 bp, C. familiaris
ggagaaggctggggct

SEQ ID NO: 321993 - DNA, 16 bp, C. familiaris
ggagaagggggaaccc

SEQ ID NO: 321994 - DNA, 16 bp, C. familiaris
ggagaaggtggccatc

SEQ ID NO: 321995 - DNA, 16 bp, C. familiaris
ggagaataggtatggt

SEQ ID NO: 321996 - DNA, 16 bp, C. familiaris
ggagaatatatttgca

SEQ ID NO: 321997 - DNA, 16 bp, C. familiaris
ggagaatctcaagctg

SEQ ID NO: 321998 - DNA, 16 bp, C. familiaris
ggagacaaatgaaaat

SEQ ID NO: 321999 - DNA, 16 bp, C. familiaris
ggagacagaagcagag

SEQ ID NO: 322000 - DNA, 16 bp, C. familiaris
ggagacagagaatctt

SEQ ID NO: 322001 - DNA, 16 bp, C. familiaris
ggagaccaacatgggg

SEQ ID NO: 322002 - DNA, 16 bp, C. familiaris
ggagaccagtgaggag

SEQ ID NO: 322003 - DNA, 16 bp, C. familiaris
ggagacccaggcccag

SEQ ID NO: 322004 - DNA, 16 bp, C. familiaris
ggagacccggaattga

SEQ ID NO: 322005 - DNA, 16 bp, C. familiaris
ggagacctgtgatcga

SEQ ID NO: 322006 - DNA, 16 bp, C. familiaris
ggagactgctcctccc

SEQ ID NO: 322007 - DNA, 16 bp, C. familiaris
ggagagaaaatgaatg

SEQ ID NO: 322008 - DNA, 16 bp, C. familiaris
ggagagaataaatttc

SEQ ID NO: 322009 - DNA, 16 bp, C. familiaris
ggagagacagagaagc

SEQ ID NO: 322010 - DNA, 16 bp, C. familiaris
ggagagagaaactcta

SEQ ID NO: 322011 - DNA, 16 bp, C. familiaris
ggagagagacaagcag

SEQ ID NO: 322012 - DNA, 16 bp, C. familiaris
ggagagagacaggcag

SEQ ID NO: 322013 - DNA, 16 bp, C. familiaris
ggagagagagaaaccc

SEQ ID NO: 322014 - DNA, 16 bp, C. familiaris
ggagagagagaagctg

SEQ ID NO: 322015 - DNA, 16 bp, C. familiaris
ggagagagggaatctt

SEQ ID NO: 322016 - DNA, 16 bp, C. familiaris
ggagagcagcaggcag

SEQ ID NO: 322017 - DNA, 16 bp, C. familiaris
ggagagcctgatgcag

SEQ ID NO: 322018 - DNA, 16 bp, C. familiaris
ggagagcgagaagcag

SEQ ID NO: 322019 - DNA, 16 bp, C. familiaris
ggagagctggctgctg

SEQ ID NO: 322020 - DNA, 16 bp, C. familiaris
ggagaggaaggctccc

SEQ ID NO: 322021 - DNA, 16 bp, C. familiaris
ggagaggagctgggga

SEQ ID NO: 322022 - DNA, 16 bp, C. familiaris
ggagaggaggctggag

SEQ ID NO: 322023 - DNA, 16 bp, C. familiaris
ggagaggatgaagcag

SEQ ID NO: 322024 - DNA, 16 bp, C. familiaris
ggagaggcacagacac

SEQ ID NO: 322025 - DNA, 16 bp, C. familiaris
ggagaggcagaagcag

SEQ ID NO: 322026 - DNA, 16 bp, C. familiaris
ggagagggacaaccag

SEQ ID NO: 322027 - DNA, 16 bp, C. familiaris
ggagagggacaagcag

SEQ ID NO: 322028 - DNA, 16 bp, C. familiaris
ggagagggagagactg

SEQ ID NO: 322029 - DNA, 16 bp, C. familiaris
ggagaggtagaagcag

SEQ ID NO: 322030 - DNA, 16 bp, C. familiaris
ggagaggttgaaactg

SEQ ID NO: 322031 - DNA, 16 bp, C. familiaris
ggagagtctgctggag

SEQ ID NO: 322032 - DNA, 16 bp, C. familiaris
ggagagtgagaagcag

SEQ ID NO: 322033 - DNA, 16 bp, C. familiaris
ggagagtttgactact

SEQ ID NO: 322034 - DNA, 16 bp, C. familiaris
ggagatgaggacacag

SEQ ID NO: 322035 - DNA, 16 bp, C. familiaris
ggagatgctcaatcac

SEQ ID NO: 322036 - DNA, 16 bp, C. familiaris
ggagatggaaaagcag

SEQ ID NO: 322037 - DNA, 16 bp, C. familiaris
ggagatggagaagcag

SEQ ID NO: 322038 - DNA, 16 bp, C. familiaris
ggagatggagagaatc

SEQ ID NO: 322039 - DNA, 16 bp, C. familiaris
ggagatggaggacctg

SEQ ID NO: 322040 - DNA, 16 bp, C. familiaris
ggagatgggcactgag

SEQ ID NO: 322041 - DNA, 16 bp, C. familiaris
ggagcaaggggaaccc

SEQ ID NO: 322042 - DNA, 16 bp, C. familiaris
ggagcacagccctgct

SEQ ID NO: 322043 - DNA, 16 bp, C. familiaris
ggagcacagggcgccg

SEQ ID NO: 322044 - DNA, 16 bp, C. familiaris
ggagcacctgcatggc

SEQ ID NO: 322045 - DNA, 16 bp, C. familiaris
ggagcagaaggagcag

SEQ ID NO: 322046 - DNA, 16 bp, C. familiaris
ggagcagacagagagg

SEQ ID NO: 322047 - DNA, 16 bp, C. familiaris
ggagcagaggacagag

SEQ ID NO: 322048 - DNA, 16 bp, C. familiaris
ggagcagaggctggag

SEQ ID NO: 322049 - DNA, 16 bp, C. familiaris
ggagcagaggctggga

SEQ ID NO: 322050 - DNA, 16 bp, C. familiaris
ggagcagatggatttc

SEQ ID NO: 322051 - DNA, 16 bp, C. familiaris
ggagcagcagaaggag

SEQ ID NO: 322052 - DNA, 16 bp, C. familiaris
ggagcagcagaggaag

SEQ ID NO: 322053 - DNA, 16 bp, C. familiaris
ggagcagcagaggcag

SEQ ID NO: 322054 - DNA, 16 bp, C. familiaris
ggagcagcagagggaa

SEQ ID NO: 322055 - DNA, 16 bp, C. familiaris
ggagcagcagcaggag

SEQ ID NO: 322056 - DNA, 16 bp, C. familiaris
ggagcagcaggaagag

SEQ ID NO: 322057 - DNA, 16 bp, C. familiaris
ggagcagccaattata

SEQ ID NO: 322058 - DNA, 16 bp, C. familiaris
ggagcagctcaggcag

SEQ ID NO: 322059 - DNA, 23 bp, C. familiaris
ggagcagctcggaggggctcggg

SEQ ID NO: 322060 - DNA, 16 bp, C. familiaris
ggagcagctctgaggg

SEQ ID NO: 322061 - DNA, 16 bp, C. familiaris
ggagcagctggagggg

SEQ ID NO: 322062 - DNA, 16 bp, C. familiaris
ggagcaggagaagcag

SEQ ID NO: 322063 - DNA, 16 bp, C. familiaris
ggagcaggagcaggaa

SEQ ID NO: 322064 - DNA, 16 bp, C. familiaris
ggagcaggagctggag

SEQ ID NO: 322065 - DNA, 16 bp, C. familiaris
ggagcaggtgcaggag

SEQ ID NO: 322066 - DNA, 16 bp, C. familiaris
ggagcatctaggccag

SEQ ID NO: 322067 - DNA, 16 bp, C. familiaris
ggagcatctgcctttg

SEQ ID NO: 322068 - DNA, 16 bp, C. familiaris
ggagccaatgaccaag

SEQ ID NO: 322069 - DNA, 16 bp, C. familiaris
ggagccaccgcccgag

SEQ ID NO: 322070 - DNA, 16 bp, C. familiaris
ggagccagagccagag

SEQ ID NO: 322071 - DNA, 16 bp, C. familiaris
ggagccagatgcagga

SEQ ID NO: 322072 - DNA, 16 bp, C. familiaris
ggagccagcttttccc

SEQ ID NO: 322073 - DNA, 16 bp, C. familiaris
ggagccagggagccag

SEQ ID NO: 322074 - DNA, 16 bp, C. familiaris
ggagcccaatgcagag

SEQ ID NO: 322075 - DNA, 16 bp, C. familiaris
ggagcccaattcaggg

SEQ ID NO: 322076 - DNA, 16 bp, C. familiaris
ggagcccagcatggag

SEQ ID NO: 322077 - DNA, 16 bp, C. familiaris
ggagcccagcgtgggg

SEQ ID NO: 322078 - DNA, 16 bp, C. familiaris
ggagcccaggccccag

SEQ ID NO: 322079 - DNA, 16 bp, C. familiaris
ggagcccagggcccag

SEQ ID NO: 322080 - DNA, 16 bp, C. familiaris
ggagcccagggcgctg

SEQ ID NO: 322081 - DNA, 16 bp, C. familiaris
ggagcccaggggagcc

SEQ ID NO: 322082 - DNA, 16 bp, C. familiaris
ggagcccagtgagggg

SEQ ID NO: 322083 - DNA, 16 bp, C. familiaris
ggagcccagtggggga

SEQ ID NO: 322084 - DNA, 16 bp, C. familiaris
ggagccccacaccagg

SEQ ID NO: 322085 - DNA, 16 bp, C. familiaris
ggagccccacagcagg

SEQ ID NO: 322086 - DNA, 16 bp, C. familiaris
ggagccccgcgtcggg

SEQ ID NO: 322087 - DNA, 16 bp, C. familiaris
ggagccccggagcccc

SEQ ID NO: 322088 - DNA, 16 bp, C. familiaris
ggagcccgactgggac

SEQ ID NO: 322089 - DNA, 16 bp, C. familiaris
ggagcccgaggcggga

SEQ ID NO: 322090 - DNA, 18 bp, C. familiaris
ggagcccgagggcacccc

SEQ ID NO: 322091 - DNA, 16 bp, C. familiaris
ggagcccgatggggga

SEQ ID NO: 322092 - DNA, 16 bp, C. familiaris
ggagcccggagcccgg

SEQ ID NO: 322093 - DNA, 16 bp, C. familiaris
ggagcccggggagccc

SEQ ID NO: 322094 - DNA, 16 bp, C. familiaris
ggagccctgggatgga

SEQ ID NO: 322095 - DNA, 16 bp, C. familiaris
ggagcccttatgaatg

SEQ ID NO: 322096 - DNA, 16 bp, C. familiaris
ggagccgccgcctgag

SEQ ID NO: 322097 - DNA, 16 bp, C. familiaris
ggagccgctgcccgag

SEQ ID NO: 322098 - DNA, 16 bp, C. familiaris
ggagcctaaagtggga

SEQ ID NO: 322099 - DNA, 16 bp, C. familiaris
ggagcctcagtgccca

SEQ ID NO: 322100 - DNA, 16 bp, C. familiaris
ggagcctgacatgggg

SEQ ID NO: 322101 - DNA, 16 bp, C. familiaris
ggagcctgaccccagg

SEQ ID NO: 322102 - DNA, 16 bp, C. familiaris
ggagcctgacctaggg

SEQ ID NO: 322103 - DNA, 16 bp, C. familiaris
ggagcctgaggaggga

SEQ ID NO: 322104 - DNA, 16 bp, C. familiaris
ggagcctgcctccccc

SEQ ID NO: 322105 - DNA, 16 bp, C. familiaris
ggagcctgctcctctg

SEQ ID NO: 322106 - DNA, 16 bp, C. familiaris
ggagcctgctgcggga

SEQ ID NO: 322107 - DNA, 16 bp, C. familiaris
ggagcctgcttccttc

SEQ ID NO: 322108 - DNA, 23 bp, C. familiaris
ggagcctgcttctccctctgcct

SEQ ID NO: 322109 - DNA, 17 bp, C. familiaris
ggagcctgcttctctct

SEQ ID NO: 322110 - DNA, 16 bp, C. familiaris
ggagcctgcttctgcc

SEQ ID NO: 322111 - DNA, 16 bp, C. familiaris
ggagcctggcatgggg

SEQ ID NO: 322112 - DNA, 16 bp, C. familiaris
ggagcctgggagcctg

SEQ ID NO: 322113 - DNA, 16 bp, C. familiaris
ggagcctggggcctgg

SEQ ID NO: 322114 - DNA, 16 bp, C. familiaris
ggagcctggtgcagga

SEQ ID NO: 322115 - DNA, 16 bp, C. familiaris
ggagccttctcctccc

SEQ ID NO: 322116 - DNA, 25 bp, C. familiaris
ggagcgcgaatccaccagcgcaggc

SEQ ID NO: 322117 - DNA, 16 bp, C. familiaris
ggagcgcttgggtggc

SEQ ID NO: 322118 - DNA, 16 bp, C. familiaris
ggagctccatcccagg

SEQ ID NO: 322119 - DNA, 16 bp, C. familiaris
ggagctctgtgctcag

SEQ ID NO: 322120 - DNA, 16 bp, C. familiaris
ggagctgagggagaag

SEQ ID NO: 322121 - DNA, 16 bp, C. familiaris
ggagctgatgcaggac

SEQ ID NO: 322122 - DNA, 16 bp, C. familiaris
ggagctgcagaaggag

SEQ ID NO: 322123 - DNA, 16 bp, C. familiaris
ggagctgccctgcccc

SEQ ID NO: 322124 - DNA, 16 bp, C. familiaris
ggagctgccgcccaag

SEQ ID NO: 322125 - DNA, 16 bp, C. familiaris
ggagctgctcagcccc

SEQ ID NO: 322126 - DNA, 16 bp, C. familiaris
ggagctgcttcttcct

SEQ ID NO: 322127 - DNA, 16 bp, C. familiaris
ggagctggaaaaagaa

SEQ ID NO: 322128 - DNA, 16 bp, C. familiaris
ggagctggacatgggg

SEQ ID NO: 322129 - DNA, 16 bp, C. familiaris
ggagctggagaagcag

SEQ ID NO: 322130 - DNA, 16 bp, C. familiaris
ggagctggagaaggaa

SEQ ID NO: 322131 - DNA, 16 bp, C. familiaris
ggagctggagaggagg

SEQ ID NO: 322132 - DNA, 16 bp, C. familiaris
ggagctggagctggag

SEQ ID NO: 322133 - DNA, 16 bp, C. familiaris
ggagctggagctgggg

SEQ ID NO: 322134 - DNA, 16 bp, C. familiaris
ggagctggaggagctg

SEQ ID NO: 322135 - DNA, 16 bp, C. familiaris
ggagctggaggcaggg

SEQ ID NO: 322136 - DNA, 16 bp, C. familiaris
ggagctggcttctctc

SEQ ID NO: 322137 - DNA, 16 bp, C. familiaris
ggagctgggagcaggg

SEQ ID NO: 322138 - DNA, 16 bp, C. familiaris
ggagctgggagctggg

SEQ ID NO: 322139 - DNA, 16 bp, C. familiaris
ggagctgggatttgaa

SEQ ID NO: 322140 - DNA, 16 bp, C. familiaris
ggagctgggcctgggg

SEQ ID NO: 322141 - DNA, 16 bp, C. familiaris
ggagctggggagctgg

SEQ ID NO: 322142 - DNA, 16 bp, C. familiaris
ggagctggggaggcag

SEQ ID NO: 322143 - DNA, 16 bp, C. familiaris
ggagctggggcagagg

SEQ ID NO: 322144 - DNA, 16 bp, C. familiaris
ggagctggggcctggg

SEQ ID NO: 322145 - DNA, 16 bp, C. familiaris
ggagctggggctgggc

SEQ ID NO: 322146 - DNA, 16 bp, C. familiaris
ggagctgggggtgcag

SEQ ID NO: 322147 - DNA, 16 bp, C. familiaris
ggagcttgaactcagg

SEQ ID NO: 322148 - DNA, 16 bp, C. familiaris
ggaggaaatagaagca

SEQ ID NO: 322149 - DNA, 16 bp, C. familiaris
ggaggaaatggaagca

SEQ ID NO: 322150 - DNA, 16 bp, C. familiaris
ggaggaacaccaccac

SEQ ID NO: 322151 - DNA, 16 bp, C. familiaris
ggaggaacacctgggt

SEQ ID NO: 322152 - DNA, 16 bp, C. familiaris
ggaggaagaagcagac

SEQ ID NO: 322153 - DNA, 16 bp, C. familiaris
ggaggaagaagcaggc

SEQ ID NO: 322154 - DNA, 16 bp, C. familiaris
ggaggaagatcacaga

SEQ ID NO: 322155 - DNA, 16 bp, C. familiaris
ggaggaatgtcacaca

SEQ ID NO: 322156 - DNA, 16 bp, C. familiaris
ggaggacaatttggca

SEQ ID NO: 322157 - DNA, 16 bp, C. familiaris
ggaggacttcctggag

SEQ ID NO: 322158 - DNA, 16 bp, C. familiaris
ggaggagaagcagcag

SEQ ID NO: 322159 - DNA, 16 bp, C. familiaris
ggaggagaagcaggat

SEQ ID NO: 322160 - DNA, 16 bp, C. familiaris
ggaggagaaggaggct

SEQ ID NO: 322161 - DNA, 16 bp, C. familiaris
ggaggagcagccacag

SEQ ID NO: 322162 - DNA, 16 bp, C. familiaris
ggaggagcagccccag

SEQ ID NO: 322163 - DNA, 16 bp, C. familiaris
ggaggagcaggccccc

SEQ ID NO: 322164 - DNA, 16 bp, C. familiaris
ggaggagcaggctctg

SEQ ID NO: 322165 - DNA, 16 bp, C. familiaris
ggaggagcagggctgg

SEQ ID NO: 322166 - DNA, 16 bp, C. familiaris
ggaggagcagggtccc

SEQ ID NO: 322167 - DNA, 16 bp, C. familiaris
ggaggagcaggttcca

SEQ ID NO: 322168 - DNA, 16 bp, C. familiaris
ggaggagccacctgca

SEQ ID NO: 322169 - DNA, 16 bp, C. familiaris
ggaggagctgagggag

SEQ ID NO: 322170 - DNA, 16 bp, C. familiaris
ggaggagctggggcag

SEQ ID NO: 322171 - DNA, 16 bp, C. familiaris
ggaggaggagcaggtg

SEQ ID NO: 322172 - DNA, 16 bp, C. familiaris
ggaggaggagcctggg

SEQ ID NO: 322173 - DNA, 16 bp, C. familiaris
ggaggaggaggagccc

SEQ ID NO: 322174 - DNA, 16 bp, C. familiaris
ggaggaggaggcccag

SEQ ID NO: 322175 - DNA, 16 bp, C. familiaris
ggaggaggaggcctgg

SEQ ID NO: 322176 - DNA, 16 bp, C. familiaris
ggaggaggaggctcca

SEQ ID NO: 322177 - DNA, 16 bp, C. familiaris
ggaggaggaggctgag

SEQ ID NO: 322178 - DNA, 16 bp, C. familiaris
ggaggaggggcagagt

SEQ ID NO: 322179 - DNA, 16 bp, C. familiaris
ggaggaggtggatgca

SEQ ID NO: 322180 - DNA, 16 bp, C. familiaris
ggaggagtaggctcca

SEQ ID NO: 322181 - DNA, 16 bp, C. familiaris
ggaggatctcaagcag

SEQ ID NO: 322182 - DNA, 16 bp, C. familiaris
ggaggcagaagcagag

SEQ ID NO: 322183 - DNA, 16 bp, C. familiaris
ggaggcagagacccag

SEQ ID NO: 322184 - DNA, 16 bp, C. familiaris
ggaggcagaggctggg

SEQ ID NO: 322185 - DNA, 16 bp, C. familiaris
ggaggcagcccaagtg

SEQ ID NO: 322186 - DNA, 16 bp, C. familiaris
ggaggcagggaggctg

SEQ ID NO: 322187 - DNA, 16 bp, C. familiaris
ggaggccaacatgggg

SEQ ID NO: 322188 - DNA, 16 bp, C. familiaris
ggaggccaagaagtcc

SEQ ID NO: 322189 - DNA, 16 bp, C. familiaris
ggaggccagaagtcct

SEQ ID NO: 322190 - DNA, 16 bp, C. familiaris
ggaggccaggaggccc

SEQ ID NO: 322191 - DNA, 16 bp, C. familiaris
ggaggccaggaggctg

SEQ ID NO: 322192 - DNA, 16 bp, C. familiaris
ggaggccagtgtggct

SEQ ID NO: 322193 - DNA, 16 bp, C. familiaris
ggaggcccaatgtggg

SEQ ID NO: 322194 - DNA, 16 bp, C. familiaris
ggaggcccaggaggcc

SEQ ID NO: 322195 - DNA, 16 bp, C. familiaris
ggaggccgagaaaaat

SEQ ID NO: 322196 - DNA, 16 bp, C. familiaris
ggaggccggggatcga

SEQ ID NO: 322197 - DNA, 16 bp, C. familiaris
ggaggccttcctggag

SEQ ID NO: 322198 - DNA, 16 bp, C. familiaris
ggaggctccggggcag

SEQ ID NO: 322199 - DNA, 16 bp, C. familiaris
ggaggctccggggcgg

SEQ ID NO: 322200 - DNA, 16 bp, C. familiaris
ggaggctgagaagccc

SEQ ID NO: 322201 - DNA, 16 bp, C. familiaris
ggaggctgaggccagg

SEQ ID NO: 322202 - DNA, 16 bp, C. familiaris
ggaggctgctgctccc

SEQ ID NO: 322203 - DNA, 16 bp, C. familiaris
ggaggctggaggagag

SEQ ID NO: 322204 - DNA, 16 bp, C. familiaris
ggaggctgggaagtgt

SEQ ID NO: 322205 - DNA, 16 bp, C. familiaris
ggaggctgggccctgg

SEQ ID NO: 322206 - DNA, 16 bp, C. familiaris
ggaggctggggcagag

SEQ ID NO: 322207 - DNA, 16 bp, C. familiaris
ggaggcttcattgcat

SEQ ID NO: 322208 - DNA, 16 bp, C. familiaris
ggagggaaaacttcca

SEQ ID NO: 322209 - DNA, 16 bp, C. familiaris
ggagggacacagtgga

SEQ ID NO: 322210 - DNA, 16 bp, C. familiaris
ggagggagatttgttt

SEQ ID NO: 322211 - DNA, 16 bp, C. familiaris
ggagggagcctgatgc

SEQ ID NO: 322212 - DNA, 16 bp, C. familiaris
ggagggagcctggagg

SEQ ID NO: 322213 - DNA, 16 bp, C. familiaris
ggagggcacatgatgg

SEQ ID NO: 322214 - DNA, 16 bp, C. familiaris
ggagggccagaggcag

SEQ ID NO: 322215 - DNA, 17 bp, C. familiaris
ggagggcgaggatgccc

SEQ ID NO: 322216 - DNA, 16 bp, C. familiaris
ggagggctccctggag

SEQ ID NO: 322217 - DNA, 16 bp, C. familiaris
ggaggggcgcctgggt

SEQ ID NO: 322218 - DNA, 16 bp, C. familiaris
ggaggggggcacctgg

SEQ ID NO: 322219 - DNA, 16 bp, C. familiaris
ggagggtcctgctgtg

SEQ ID NO: 322220 - DNA, 16 bp, C. familiaris
ggagggtctgctgtgc

SEQ ID NO: 322221 - DNA, 16 bp, C. familiaris
ggaggtgacatttgaa

SEQ ID NO: 322222 - DNA, 16 bp, C. familiaris
ggaggtgatggatatg

SEQ ID NO: 322223 - DNA, 16 bp, C. familiaris
ggaggtgcctggctgg

SEQ ID NO: 322224 - DNA, 16 bp, C. familiaris
ggaggtggagaagcag

SEQ ID NO: 322225 - DNA, 16 bp, C. familiaris
ggaggtggctgtgccc

SEQ ID NO: 322226 - DNA, 16 bp, C. familiaris
ggaggtggggcctctg

SEQ ID NO: 322227 - DNA, 16 bp, C. familiaris
ggaggttttgatgact

SEQ ID NO: 322228 - DNA, 16 bp, C. familiaris
ggagtagaattactgg

SEQ ID NO: 322229 - DNA, 16 bp, C. familiaris
ggagtcatcaaaaacc

SEQ ID NO: 322230 - DNA, 16 bp, C. familiaris
ggagtcccacactggg

SEQ ID NO: 322231 - DNA, 16 bp, C. familiaris
ggagtcccacatcagc

SEQ ID NO: 322232 - DNA, 16 bp, C. familiaris
ggagtcccagatcaag

SEQ ID NO: 322233 - DNA, 16 bp, C. familiaris
ggagtcccaggtcggg

SEQ ID NO: 322234 - DNA, 16 bp, C. familiaris
ggagtcctgcctcagg

SEQ ID NO: 322235 - DNA, 16 bp, C. familiaris
ggagtcctggatcaag

SEQ ID NO: 322236 - DNA, 16 bp, C. familiaris
ggagtccttggatcga

SEQ ID NO: 322237 - DNA, 16 bp, C. familiaris
ggagtctgctcctccc

SEQ ID NO: 322238 - DNA, 16 bp, C. familiaris
ggagtctgggatcaag

SEQ ID NO: 322239 - DNA, 16 bp, C. familiaris
ggagtggcagatggag

SEQ ID NO: 322240 - DNA, 16 bp, C. familiaris
ggagtgggagtgaatg

SEQ ID NO: 322241 - DNA, 16 bp, C. familiaris
ggagttcatgaccatt

SEQ ID NO: 322242 - DNA, 53 bp, C. familiaris
ggagttcctgccggagctgaatccaggtttccagagctgccccgccactgggg

SEQ ID NO: 322243 - DNA, 16 bp, C. familiaris
ggagtttgaaagttgt

SEQ ID NO: 322244 - DNA, 16 bp, C. familiaris
ggataaagaagtggca

SEQ ID NO: 322245 - DNA, 16 bp, C. familiaris
ggataaatatctagaa

SEQ ID NO: 322246 - DNA, 16 bp, C. familiaris
ggataaattcctaaaa

SEQ ID NO: 322247 - DNA, 16 bp, C. familiaris
ggataaattccttgaa

SEQ ID NO: 322248 - DNA, 16 bp, C. familiaris
ggataaattctacttg

SEQ ID NO: 322249 - DNA, 16 bp, C. familiaris
ggataatgaaaatgtg

SEQ ID NO: 322250 - DNA, 16 bp, C. familiaris
ggatagacatttctcc

SEQ ID NO: 322251 - DNA, 16 bp, C. familiaris
ggatatatggatggat

SEQ ID NO: 322252 - DNA, 16 bp, C. familiaris
ggatatttattttctt

SEQ ID NO: 322253 - DNA, 16 bp, C. familiaris
ggatcaagccccacat

SEQ ID NO: 322254 - DNA, 16 bp, C. familiaris
ggatcaagtcccatgt

SEQ ID NO: 322255 - DNA, 16 bp, C. familiaris
ggatcacactctggac

SEQ ID NO: 322256 - DNA, 16 bp, C. familiaris
ggatcaggccctgcac

SEQ ID NO: 322257 - DNA, 16 bp, C. familiaris
ggatcaggctctgagc

SEQ ID NO: 322258 - DNA, 16 bp, C. familiaris
ggatcatacagtattt

SEQ ID NO: 322259 - DNA, 16 bp, C. familiaris
ggatcatgacctatgc

SEQ ID NO: 322260 - DNA, 16 bp, C. familiaris
ggatccaagaaacctc

SEQ ID NO: 322261 - DNA, 16 bp, C. familiaris
ggatccagacccacat

SEQ ID NO: 322262 - DNA, 16 bp, C. familiaris
ggatcccagaactcca

SEQ ID NO: 322263 - DNA, 16 bp, C. familiaris
ggatcccctgggtggc

SEQ ID NO: 322264 - DNA, 16 bp, C. familiaris
ggatccctgggggctc

SEQ ID NO: 322265 - DNA, 16 bp, C. familiaris
ggatcctgaaacagaa

SEQ ID NO: 322266 - DNA, 16 bp, C. familiaris
ggatcctgatgtggga

SEQ ID NO: 322267 - DNA, 16 bp, C. familiaris
ggatcctgggatctgg

SEQ ID NO: 322268 - DNA, 16 bp, C. familiaris
ggatcgagtccacatc

SEQ ID NO: 322269 - DNA, 16 bp, C. familiaris
ggatcgagtcccacgt

SEQ ID NO: 322270 - DNA, 16 bp, C. familiaris
ggatcgcaccccaggc

SEQ ID NO: 322271 - DNA, 16 bp, C. familiaris
ggatctcaaagagata

SEQ ID NO: 322272 - DNA, 16 bp, C. familiaris
ggatctgagccgaagg

SEQ ID NO: 322273 - DNA, 16 bp, C. familiaris
ggatctggccctgggc

SEQ ID NO: 322274 - DNA, 16 bp, C. familiaris
ggatctggggatccct

SEQ ID NO: 322275 - DNA, 16 bp, C. familiaris
ggatgaaatagataaa

SEQ ID NO: 322276 - DNA, 16 bp, C. familiaris
ggatgaaatagatgaa

SEQ ID NO: 322277 - DNA, 16 bp, C. familiaris
ggatgaaattgaagca

SEQ ID NO: 322278 - DNA, 16 bp, C. familiaris
ggatgaagaaacattt

SEQ ID NO: 322279 - DNA, 16 bp, C. familiaris
ggatgaagaagctgtg

SEQ ID NO: 322280 - DNA, 16 bp, C. familiaris
ggatgaagccctgcat

SEQ ID NO: 322281 - DNA, 16 bp, C. familiaris
ggatgagccctgggtg

SEQ ID NO: 322282 - DNA, 16 bp, C. familiaris
ggatgagctctgggtg

SEQ ID NO: 322283 - DNA, 16 bp, C. familiaris
ggatgaggaagctgag

SEQ ID NO: 322284 - DNA, 16 bp, C. familiaris
ggatgaggagcagagg

SEQ ID NO: 322285 - DNA, 16 bp, C. familiaris
ggatgaggggcagagg

SEQ ID NO: 322286 - DNA, 17 bp, C. familiaris
ggatgatgatgatgatg

SEQ ID NO: 322287 - DNA, 16 bp, C. familiaris
ggatgattatgatgtg

SEQ ID NO: 322288 - DNA, 16 bp, C. familiaris
ggatgattcttttttt

SEQ ID NO: 322289 - DNA, 16 bp, C. familiaris
ggatgctataacaaaa

SEQ ID NO: 322290 - DNA, 16 bp, C. familiaris
ggatgctgggatcaag

SEQ ID NO: 322291 - DNA, 16 bp, C. familiaris
ggatgcttttttattt

SEQ ID NO: 322292 - DNA, 16 bp, C. familiaris
ggatggaaccccatgt

SEQ ID NO: 322293 - DNA, 16 bp, C. familiaris
ggatggaactggagag

SEQ ID NO: 322294 - DNA, 16 bp, C. familiaris
ggatggaatcccacgt

SEQ ID NO: 322295 - DNA, 16 bp, C. familiaris
ggatggaccttgaaaa

SEQ ID NO: 322296 - DNA, 16 bp, C. familiaris
ggatggagaaacatct

SEQ ID NO: 322297 - DNA, 16 bp, C. familiaris
ggatggagaaagatat

SEQ ID NO: 322298 - DNA, 16 bp, C. familiaris
ggatggagccttgtgt

SEQ ID NO: 322299 - DNA, 16 bp, C. familiaris
ggatggagctctgtgt

SEQ ID NO: 322300 - DNA, 16 bp, C. familiaris
ggatggagctggagag

SEQ ID NO: 322301 - DNA, 16 bp, C. familiaris
ggatggagttccatgt

SEQ ID NO: 322302 - DNA, 16 bp, C. familiaris
ggatggctcattcagt

SEQ ID NO: 322303 - DNA, 16 bp, C. familiaris
ggatgggaagaacaaa

SEQ ID NO: 322304 - DNA, 16 bp, C. familiaris
ggatgggcactgggtg

SEQ ID NO: 322305 - DNA, 16 bp, C. familiaris
ggatgggcagaggaag

SEQ ID NO: 322306 - DNA, 16 bp, C. familiaris
ggatgggcagcctggg

SEQ ID NO: 322307 - DNA, 16 bp, C. familiaris
ggatggggagaggcag

SEQ ID NO: 322308 - DNA, 16 bp, C. familiaris
ggatggggtcctggag

SEQ ID NO: 322309 - DNA, 16 bp, C. familiaris
ggatggggtgcctggg

SEQ ID NO: 322310 - DNA, 16 bp, C. familiaris
ggatgtagagaaaaag

SEQ ID NO: 322311 - DNA, 16 bp, C. familiaris
ggatgtccactatcac

SEQ ID NO: 322312 - DNA, 16 bp, C. familiaris
ggatgtgaccctggag

SEQ ID NO: 322313 - DNA, 16 bp, C. familiaris
ggatgtgatcctggag

SEQ ID NO: 322314 - DNA, 16 bp, C. familiaris
ggatgtggaaactgag

SEQ ID NO: 322315 - DNA, 16 bp, C. familiaris
ggatgtggagaaagtg

SEQ ID NO: 322316 - DNA, 16 bp, C. familiaris
ggatgtggagaagaga

SEQ ID NO: 322317 - DNA, 16 bp, C. familiaris
ggatgtggagacaggg

SEQ ID NO: 322318 - DNA, 16 bp, C. familiaris
ggatgttggattttat

SEQ ID NO: 322319 - DNA, 16 bp, C. familiaris
ggattaaagaagaaat

SEQ ID NO: 322320 - DNA, 16 bp, C. familiaris
ggattcaccttcagta

SEQ ID NO: 322321 - DNA, 16 bp, C. familiaris
ggattcagaaaagacc

SEQ ID NO: 322322 - DNA, 16 bp, C. familiaris
ggattcagctcctgca

SEQ ID NO: 322323 - DNA, 16 bp, C. familiaris
ggattcagtcctgcat

SEQ ID NO: 322324 - DNA, 16 bp, C. familiaris
ggattcctttttttaa

SEQ ID NO: 322325 - DNA, 16 bp, C. familiaris
ggattcttgattttgg

SEQ ID NO: 322326 - DNA, 16 bp, C. familiaris
ggattgagctctgagt

SEQ ID NO: 322327 - DNA, 16 bp, C. familiaris
ggattgcacaagaaaa

SEQ ID NO: 322328 - DNA, 16 bp, C. familiaris
ggattgcttccacctt

SEQ ID NO: 322329 - DNA, 16 bp, C. familiaris
ggattggaagaagaaa

SEQ ID NO: 322330 - DNA, 16 bp, C. familiaris
ggattgtctcctgcat

SEQ ID NO: 322331 - DNA, 16 bp, C. familiaris
ggattgtcttttcact

SEQ ID NO: 322332 - DNA, 16 bp, C. familiaris
ggatttatccctggga

SEQ ID NO: 322333 - DNA, 16 bp, C. familiaris
ggatttctatggtttc

SEQ ID NO: 322334 - DNA, 16 bp, C. familiaris
ggatttctctccctct

SEQ ID NO: 322335 - DNA, 16 bp, C. familiaris
ggatttgcctgttctg

SEQ ID NO: 322336 - DNA, 16 bp, C. familiaris
ggatttggggattttt

SEQ ID NO: 322337 - DNA, 16 bp, C. familiaris
ggattttctctctccc

SEQ ID NO: 322338 - DNA, 16 bp, C. familiaris
ggattttctttctttc

SEQ ID NO: 322339 - DNA, 16 bp, C. familiaris
ggattttgattgggat

SEQ ID NO: 322340 - DNA, 16 bp, C. familiaris
ggatttttttcctctt

SEQ ID NO: 322341 - DNA, 16 bp, C. familiaris
ggcaaaatgtgtgaag

SEQ ID NO: 322342 - DNA, 16 bp, C. familiaris
ggcaaagccaggattc

SEQ ID NO: 322343 - DNA, 16 bp, C. familiaris
ggcaaagggagaagct

SEQ ID NO: 322344 - DNA, 16 bp, C. familiaris
ggcaaatggaactcca

SEQ ID NO: 322345 - DNA, 16 bp, C. familiaris
ggcaaccaccagtttg

SEQ ID NO: 322346 - DNA, 16 bp, C. familiaris
ggcaagaatgtggaga

SEQ ID NO: 322347 - DNA, 17 bp, C. familiaris
ggcaagcactaaaccac

SEQ ID NO: 322348 - DNA, 16 bp, C. familiaris
ggcaaggaggtggaga

SEQ ID NO: 322349 - DNA, 16 bp, C. familiaris
ggcaagggcaagggca

SEQ ID NO: 322350 - DNA, 16 bp, C. familiaris
ggcaaggtcaccttcc

SEQ ID NO: 322351 - DNA, 20 bp, C. familiaris
ggcaagtctaccactactgg

SEQ ID NO: 322352 - DNA, 16 bp, C. familiaris
ggcaagtgcccccctc

SEQ ID NO: 322353 - DNA, 16 bp, C. familiaris
ggcaatgaaaatactc

SEQ ID NO: 322354 - DNA, 16 bp, C. familiaris
ggcaatgatgatgatg

SEQ ID NO: 322355 - DNA, 16 bp, C. familiaris
ggcaatgccacctctc

SEQ ID NO: 322356 - DNA, 16 bp, C. familiaris
ggcaattcagtggaga

SEQ ID NO: 322357 - DNA, 16 bp, C. familiaris
ggcacaaatgctactg

SEQ ID NO: 322358 - DNA, 16 bp, C. familiaris
ggcacacagaaggtgc

SEQ ID NO: 322359 - DNA, 16 bp, C. familiaris
ggcacacttcctctat

SEQ ID NO: 322360 - DNA, 16 bp, C. familiaris
ggcacagagaaagagg

SEQ ID NO: 322361 - DNA, 16 bp, C. familiaris
ggcacagagaactcct

SEQ ID NO: 322362 - DNA, 16 bp, C. familiaris
ggcacagagacagaga

SEQ ID NO: 322363 - DNA, 16 bp, C. familiaris
ggcacagaggcagaga

SEQ ID NO: 322364 - DNA, 16 bp, C. familiaris
ggcacaggacagcgag

SEQ ID NO: 322365 - DNA, 16 bp, C. familiaris
ggcacatgcaccccaa

SEQ ID NO: 322366 - DNA, 16 bp, C. familiaris
ggcacccagcaggtgc

SEQ ID NO: 322367 - DNA, 16 bp, C. familiaris
ggcaccctgatctcag

SEQ ID NO: 322368 - DNA, 16 bp, C. familiaris
ggcaccgggatggctc

SEQ ID NO: 322369 - DNA, 16 bp, C. familiaris
ggcacctacctgggtg

SEQ ID NO: 322370 - DNA, 16 bp, C. familiaris
ggcacctgagcagctc

SEQ ID NO: 322371 - DNA, 16 bp, C. familiaris
ggcacctggcgggctc

SEQ ID NO: 322372 - DNA, 16 bp, C. familiaris
ggcacctgggtggcac

SEQ ID NO: 322373 - DNA, 16 bp, C. familiaris
ggcacctggtggccca

SEQ ID NO: 322374 - DNA, 16 bp, C. familiaris
ggcaccttgggtggct

SEQ ID NO: 322375 - DNA, 16 bp, C. familiaris
ggcactacaccgctga

SEQ ID NO: 322376 - DNA, 16 bp, C. familiaris
ggcactctctggaacc

SEQ ID NO: 322377 - DNA, 16 bp, C. familiaris
ggcagaaacacagaca

SEQ ID NO: 322378 - DNA, 16 bp, C. familiaris
ggcagaaacagaagca

SEQ ID NO: 322379 - DNA, 16 bp, C. familiaris
ggcagaaactaaaaga

SEQ ID NO: 322380 - DNA, 16 bp, C. familiaris
ggcagaagaagaagca

SEQ ID NO: 322381 - DNA, 16 bp, C. familiaris
ggcagaagatttattt

SEQ ID NO: 322382 - DNA, 16 bp, C. familiaris
ggcagaaggaaatgta

SEQ ID NO: 322383 - DNA, 16 bp, C. familiaris
ggcagaaggagatgca

SEQ ID NO: 322384 - DNA, 16 bp, C. familiaris
ggcagacacacaggca

SEQ ID NO: 322385 - DNA, 16 bp, C. familiaris
ggcagacactttacca

SEQ ID NO: 322386 - DNA, 16 bp, C. familiaris
ggcagacatcactaat

SEQ ID NO: 322387 - DNA, 16 bp, C. familiaris
ggcagacctggtggct

SEQ ID NO: 322388 - DNA, 16 bp, C. familiaris
ggcagacttcccactg

SEQ ID NO: 322389 - DNA, 16 bp, C. familiaris
ggcagagaaagataaa

SEQ ID NO: 322390 - DNA, 16 bp, C. familiaris
ggcagagaagaggcag

SEQ ID NO: 322391 - DNA, 16 bp, C. familiaris
ggcagagaagcaggcc

SEQ ID NO: 322392 - DNA, 16 bp, C. familiaris
ggcagagaaggcagag

SEQ ID NO: 322393 - DNA, 16 bp, C. familiaris
ggcagagacagccaga

SEQ ID NO: 322394 - DNA, 16 bp, C. familiaris
ggcagagacattggca

SEQ ID NO: 322395 - DNA, 16 bp, C. familiaris
ggcagagatggaggga

SEQ ID NO: 322396 - DNA, 16 bp, C. familiaris
ggcagagccagggctc

SEQ ID NO: 322397 - DNA, 16 bp, C. familiaris
ggcagagctggagaag

SEQ ID NO: 322398 - DNA, 16 bp, C. familiaris
ggcagaggaaaagcag

SEQ ID NO: 322399 - DNA, 16 bp, C. familiaris
ggcagaggaactaaat

SEQ ID NO: 322400 - DNA, 16 bp, C. familiaris
ggcagaggaagagact

SEQ ID NO: 322401 - DNA, 16 bp, C. familiaris
ggcagaggaagaggta

SEQ ID NO: 322402 - DNA, 16 bp, C. familiaris
ggcagaggaagatgga

SEQ ID NO: 322403 - DNA, 16 bp, C. familiaris
ggcagaggacctgaat

SEQ ID NO: 322404 - DNA, 16 bp, C. familiaris
ggcagaggagaagcag

SEQ ID NO: 322405 - DNA, 16 bp, C. familiaris
ggcagaggcctggagg

SEQ ID NO: 322406 - DNA, 16 bp, C. familiaris
ggcagagggacaagta

SEQ ID NO: 322407 - DNA, 16 bp, C. familiaris
ggcagagggagaatct

SEQ ID NO: 322408 - DNA, 16 bp, C. familiaris
ggcagagggagaggcc

SEQ ID NO: 322409 - DNA, 16 bp, C. familiaris
ggcagagggtgaagga

SEQ ID NO: 322410 - DNA, 16 bp, C. familiaris
ggcagaggtgggattt

SEQ ID NO: 322411 - DNA, 16 bp, C. familiaris
ggcagagtcagaggga

SEQ ID NO: 322412 - DNA, 16 bp, C. familiaris
ggcagagtgagaggaa

SEQ ID NO: 322413 - DNA, 16 bp, C. familiaris
ggcagagttggttcct

SEQ ID NO: 322414 - DNA, 16 bp, C. familiaris
ggcagcaggagaagca

SEQ ID NO: 322415 - DNA, 16 bp, C. familiaris
ggcagcaggagagaga

SEQ ID NO: 322416 - DNA, 16 bp, C. familiaris
ggcagcaggagcagca

SEQ ID NO: 322417 - DNA, 16 bp, C. familiaris
ggcagcaggcagcagg

SEQ ID NO: 322418 - DNA, 16 bp, C. familiaris
ggcagcaggcctgggg

SEQ ID NO: 322419 - DNA, 16 bp, C. familiaris
ggcagcatttccttct

SEQ ID NO: 322420 - DNA, 16 bp, C. familiaris
ggcagccaggtgcccc

SEQ ID NO: 322421 - DNA, 16 bp, C. familiaris
ggcagcccaggtagct

SEQ ID NO: 322422 - DNA, 16 bp, C. familiaris
ggcagccccggtggct

SEQ ID NO: 322423 - DNA, 16 bp, C. familiaris
ggcagcccggctggct

SEQ ID NO: 322424 - DNA, 16 bp, C. familiaris
ggcagcccgggtagct

SEQ ID NO: 322425 - DNA, 17 bp, C. familiaris
ggcagccctggtggcgc

SEQ ID NO: 322426 - DNA, 16 bp, C. familiaris
ggcagccctggtggct

SEQ ID NO: 322427 - DNA, 17 bp, C. familiaris
ggcagccctggtggtgc

SEQ ID NO: 322428 - DNA, 16 bp, C. familiaris
ggcagccctgttggct

SEQ ID NO: 322429 - DNA, 16 bp, C. familiaris
ggcagcctgactccag

SEQ ID NO: 322430 - DNA, 16 bp, C. familiaris
ggcagcctgagcaaac

SEQ ID NO: 322431 - DNA, 16 bp, C. familiaris
ggcagcctgcttttcc

SEQ ID NO: 322432 - DNA, 16 bp, C. familiaris
ggcagcctggaggagg

SEQ ID NO: 322433 - DNA, 16 bp, C. familiaris
ggcagcctggccctgg

SEQ ID NO: 322434 - DNA, 16 bp, C. familiaris
ggcagcctgggaggct

SEQ ID NO: 322435 - DNA, 16 bp, C. familiaris
ggcagcctggggggct

SEQ ID NO: 322436 - DNA, 17 bp, C. familiaris
ggcagcctgggtagctc

SEQ ID NO: 322437 - DNA, 16 bp, C. familiaris
ggcagcctgggtggat

SEQ ID NO: 322438 - DNA, 16 bp, C. familiaris
ggcagctcagtctgtt

SEQ ID NO: 322439 - DNA, 16 bp, C. familiaris
ggcagctctttctgcc

SEQ ID NO: 322440 - DNA, 16 bp, C. familiaris
ggcagctgggcctggg

SEQ ID NO: 322441 - DNA, 16 bp, C. familiaris
ggcagctggggctggg

SEQ ID NO: 322442 - DNA, 16 bp, C. familiaris
ggcagctggtggctca

SEQ ID NO: 322443 - DNA, 16 bp, C. familiaris
ggcagcttgccacaat

SEQ ID NO: 322444 - DNA, 16 bp, C. familiaris
ggcaggaagcccctat

SEQ ID NO: 322445 - DNA, 16 bp, C. familiaris
ggcaggaagcctgctt

SEQ ID NO: 322446 - DNA, 16 bp, C. familiaris
ggcaggaggagaagca

SEQ ID NO: 322447 - DNA, 16 bp, C. familiaris
ggcaggatcctggaga

SEQ ID NO: 322448 - DNA, 16 bp, C. familiaris
ggcaggcaggcaggaa

SEQ ID NO: 322449 - DNA, 16 bp, C. familiaris
ggcaggctccacgcag

SEQ ID NO: 322450 - DNA, 16 bp, C. familiaris
ggcaggctgccccaag

SEQ ID NO: 322451 - DNA, 16 bp, C. familiaris
ggcagggaggccagag

SEQ ID NO: 322452 - DNA, 16 bp, C. familiaris
ggcagggcaagatggc

SEQ ID NO: 322453 - DNA, 16 bp, C. familiaris
ggcagggcagcctggg

SEQ ID NO: 322454 - DNA, 16 bp, C. familiaris
ggcagggcctttggga

SEQ ID NO: 322455 - DNA, 16 bp, C. familiaris
ggcaggggctgagcag

SEQ ID NO: 322456 - DNA, 16 bp, C. familiaris
ggcaggggctggggcc

SEQ ID NO: 322457 - DNA, 16 bp, C. familiaris
ggcaggggtgcctggg

SEQ ID NO: 322458 - DNA, 16 bp, C. familiaris
ggcaggtggcaggagg

SEQ ID NO: 322459 - DNA, 16 bp, C. familiaris
ggcagtgaggacagag

SEQ ID NO: 322460 - DNA, 16 bp, C. familiaris
ggcagtggcaggcaga

SEQ ID NO: 322461 - DNA, 16 bp, C. familiaris
ggcagtggcagtgagc

SEQ ID NO: 322462 - DNA, 16 bp, C. familiaris
ggcagtgggagaagca

SEQ ID NO: 322463 - DNA, 16 bp, C. familiaris
ggcagtgggagaggca

SEQ ID NO: 322464 - DNA, 16 bp, C. familiaris
ggcagtttcttttttt

SEQ ID NO: 322465 - DNA, 16 bp, C. familiaris
ggcataaaaacagaaa

SEQ ID NO: 322466 - DNA, 16 bp, C. familiaris
ggcataaggacagaca

SEQ ID NO: 322467 - DNA, 16 bp, C. familiaris
ggcatagagattactt

SEQ ID NO: 322468 - DNA, 16 bp, C. familiaris
ggcatcacaatttcag

SEQ ID NO: 322469 - DNA, 16 bp, C. familiaris
ggcatcatcctggagt

SEQ ID NO: 322470 - DNA, 16 bp, C. familiaris
ggcatgaaacctgctt

SEQ ID NO: 322471 - DNA, 16 bp, C. familiaris
ggcatgaccccaggat

SEQ ID NO: 322472 - DNA, 16 bp, C. familiaris
ggcatgatccaggaga

SEQ ID NO: 322473 - DNA, 16 bp, C. familiaris
ggcatgatcccagtgt

SEQ ID NO: 322474 - DNA, 16 bp, C. familiaris
ggcatgatccctgggt

SEQ ID NO: 322475 - DNA, 16 bp, C. familiaris
ggcattaaggaagaca

SEQ ID NO: 322476 - DNA, 16 bp, C. familiaris
ggcattccttggctta

SEQ ID NO: 322477 - DNA, 16 bp, C. familiaris
ggcattgtgatgtccc

SEQ ID NO: 322478 - DNA, 16 bp, C. familiaris
ggcatttagtaaatat

SEQ ID NO: 322479 - DNA, 16 bp, C. familiaris
ggcatttgcaacaaca

SEQ ID NO: 322480 - DNA, 16 bp, C. familiaris
ggcatttgggctgttt

SEQ ID NO: 322481 - DNA, 16 bp, C. familiaris
ggccaaaggcaggtac

SEQ ID NO: 322482 - DNA, 16 bp, C. familiaris
ggccaaatccagccca

SEQ ID NO: 322483 - DNA, 16 bp, C. familiaris
ggccaacagagacatg

SEQ ID NO: 322484 - DNA, 16 bp, C. familiaris
ggccaacatcacctta

SEQ ID NO: 322485 - DNA, 16 bp, C. familiaris
ggccaaggcgctgacc

SEQ ID NO: 322486 - DNA, 20 bp, C. familiaris
ggccaatactttgccaaacc

SEQ ID NO: 322487 - DNA, 16 bp, C. familiaris
ggccaatgcagggctc

SEQ ID NO: 322488 - DNA, 16 bp, C. familiaris
ggccaatggcaggcac

SEQ ID NO: 322489 - DNA, 16 bp, C. familiaris
ggccacagcagcttct

SEQ ID NO: 322490 - DNA, 16 bp, C. familiaris
ggccacagccagagat

SEQ ID NO: 322491 - DNA, 16 bp, C. familiaris
ggccacattgaagaag

SEQ ID NO: 322492 - DNA, 16 bp, C. familiaris
ggccaccagagccagg

SEQ ID NO: 322493 - DNA, 16 bp, C. familiaris
ggccaccagggccacc

SEQ ID NO: 322494 - DNA, 16 bp, C. familiaris
ggccaccagggggcag

SEQ ID NO: 322495 - DNA, 16 bp, C. familiaris
ggccacctgcacccca

SEQ ID NO: 322496 - DNA, 16 bp, C. familiaris
ggccacctgccacctg

SEQ ID NO: 322497 - DNA, 16 bp, C. familiaris
ggccacctggctggct

SEQ ID NO: 322498 - DNA, 16 bp, C. familiaris
ggccacgccctgggcc

SEQ ID NO: 322499 - DNA, 16 bp, C. familiaris
ggccacggccacggcc

SEQ ID NO: 322500 - DNA, 16 bp, C. familiaris
ggccactcaaccaact

SEQ ID NO: 322501 - DNA, 16 bp, C. familiaris
ggccagatgtcttccc

SEQ ID NO: 322502 - DNA, 16 bp, C. familiaris
ggccagcccaggtccc

SEQ ID NO: 322503 - DNA, 16 bp, C. familiaris
ggccagccctggagcc

SEQ ID NO: 322504 - DNA, 16 bp, C. familiaris
ggccaggagcccaggg

SEQ ID NO: 322505 - DNA, 16 bp, C. familiaris
ggccaggagggccagg

SEQ ID NO: 322506 - DNA, 16 bp, C. familiaris
ggccaggccaggcagg

SEQ ID NO: 322507 - DNA, 16 bp, C. familiaris
ggccaggccaggccag

SEQ ID NO: 322508 - DNA, 16 bp, C. familiaris
ggccaggcctggggag

SEQ ID NO: 322509 - DNA, 16 bp, C. familiaris
ggccagggagctgggg

SEQ ID NO: 322510 - DNA, 16 bp, C. familiaris
ggccagggccctgggg

SEQ ID NO: 322511 - DNA, 16 bp, C. familiaris
ggccaggtaccagaca

SEQ ID NO: 322512 - DNA, 16 bp, C. familiaris
ggccagtgcaaaggcc

SEQ ID NO: 322513 - DNA, 16 bp, C. familiaris
ggccagtgtggctggg

SEQ ID NO: 322514 - DNA, 16 bp, C. familiaris
ggccatagtttgctga

SEQ ID NO: 322515 - DNA, 16 bp, C. familiaris
ggccatcagggctgcc

SEQ ID NO: 322516 - DNA, 16 bp, C. familiaris
ggccatctgcaaacca

SEQ ID NO: 322517 - DNA, 16 bp, C. familiaris
ggccatctgcaagcca

SEQ ID NO: 322518 - DNA, 16 bp, C. familiaris
ggccatctgtgtgtct

SEQ ID NO: 322519 - DNA, 16 bp, C. familiaris
ggccatgccctgggcc

SEQ ID NO: 322520 - DNA, 16 bp, C. familiaris
ggccattgtggacatt

SEQ ID NO: 322521 - DNA, 16 bp, C. familiaris
ggccatttgtgtgtct

SEQ ID NO: 322522 - DNA, 16 bp, C. familiaris
ggcccaactgctgagc

SEQ ID NO: 322523 - DNA, 16 bp, C. familiaris
ggcccaaggcggtgct

SEQ ID NO: 322524 - DNA, 16 bp, C. familiaris
ggcccagagaaggaag

SEQ ID NO: 322525 - DNA, 16 bp, C. familiaris
ggcccagagtgtggtc

SEQ ID NO: 322526 - DNA, 16 bp, C. familiaris
ggcccagatggcttca

SEQ ID NO: 322527 - DNA, 16 bp, C. familiaris
ggcccaggacagccag

SEQ ID NO: 322528 - DNA, 16 bp, C. familiaris
ggcccaggagcagctc

SEQ ID NO: 322529 - DNA, 16 bp, C. familiaris
ggcccaggaggccaca

SEQ ID NO: 322530 - DNA, 16 bp, C. familiaris
ggcccaggcccaggcc

SEQ ID NO: 322531 - DNA, 16 bp, C. familiaris
ggcccagggccaggcc

SEQ ID NO: 322532 - DNA, 16 bp, C. familiaris
ggcccagggcccagga

SEQ ID NO: 322533 - DNA, 16 bp, C. familiaris
ggcccagggcgtggtc

SEQ ID NO: 322534 - DNA, 16 bp, C. familiaris
ggcccagggctcaggc

SEQ ID NO: 322535 - DNA, 16 bp, C. familiaris
ggcccagggctggggc

SEQ ID NO: 322536 - DNA, 16 bp, C. familiaris
ggcccaggtggcccag

SEQ ID NO: 322537 - DNA, 16 bp, C. familiaris
ggcccagtggttaagc

SEQ ID NO: 322538 - DNA, 16 bp, C. familiaris
ggccccaggccccagg

SEQ ID NO: 322539 - DNA, 16 bp, C. familiaris
ggccccagggccccag

SEQ ID NO: 322540 - DNA, 16 bp, C. familiaris
ggccccatgctgggtg

SEQ ID NO: 322541 - DNA, 16 bp, C. familiaris
ggcccccgggatcatg

SEQ ID NO: 322542 - DNA, 16 bp, C. familiaris
ggccccctgcaggaag

SEQ ID NO: 322543 - DNA, 16 bp, C. familiaris
ggccccgcgaggagcc

SEQ ID NO: 322544 - DNA, 16 bp, C. familiaris
ggccccggagcccagg

SEQ ID NO: 322545 - DNA, 16 bp, C. familiaris
ggccccggggtcacgc

SEQ ID NO: 322546 - DNA, 16 bp, C. familiaris
ggcccctccccagaag

SEQ ID NO: 322547 - DNA, 16 bp, C. familiaris
ggcccctgctcagcag

SEQ ID NO: 322548 - DNA, 16 bp, C. familiaris
ggcccgggagcagctc

SEQ ID NO: 322549 - DNA, 16 bp, C. familiaris
ggcccgggagcccagg

SEQ ID NO: 322550 - DNA, 17 bp, C. familiaris
ggccctcatattataaa

SEQ ID NO: 322551 - DNA, 16 bp, C. familiaris
ggccctctggctgccc

SEQ ID NO: 322552 - DNA, 16 bp, C. familiaris
ggccctgagatcatga

SEQ ID NO: 322553 - DNA, 16 bp, C. familiaris
ggccctgagccctggg

SEQ ID NO: 322554 - DNA, 16 bp, C. familiaris
ggccctgcagagggag

SEQ ID NO: 322555 - DNA, 16 bp, C. familiaris
ggccctgcaggctgag

SEQ ID NO: 322556 - DNA, 16 bp, C. familiaris
ggccctgccactgggg

SEQ ID NO: 322557 - DNA, 16 bp, C. familiaris
ggccctgccccagacc

SEQ ID NO: 322558 - DNA, 16 bp, C. familiaris
ggccctgccctgggcc

SEQ ID NO: 322559 - DNA, 16 bp, C. familiaris
ggccctgccctggggg

SEQ ID NO: 322560 - DNA, 16 bp, C. familiaris
ggccctgggatcagga

SEQ ID NO: 322561 - DNA, 16 bp, C. familiaris
ggccctgggcagcccc

SEQ ID NO: 322562 - DNA, 16 bp, C. familiaris
ggccctgggccagagg

SEQ ID NO: 322563 - DNA, 16 bp, C. familiaris
ggccctgggccctggc

SEQ ID NO: 322564 - DNA, 16 bp, C. familiaris
ggccctgggcctggcc

SEQ ID NO: 322565 - DNA, 16 bp, C. familiaris
ggccctggggacagag

SEQ ID NO: 322566 - DNA, 16 bp, C. familiaris
ggccctggggctgcag

SEQ ID NO: 322567 - DNA, 16 bp, C. familiaris
ggccctggggtcctgg

SEQ ID NO: 322568 - DNA, 16 bp, C. familiaris
ggccctgtgctgagca

SEQ ID NO: 322569 - DNA, 16 bp, C. familiaris
ggccctgtggcaggag

SEQ ID NO: 322570 - DNA, 16 bp, C. familiaris
ggccgagcaggtggcc

SEQ ID NO: 322571 - DNA, 16 bp, C. familiaris
ggccgcccaggtggct

SEQ ID NO: 322572 - DNA, 16 bp, C. familiaris
ggccgggagcagctcg

SEQ ID NO: 322573 - DNA, 16 bp, C. familiaris
ggccgtggccgtggcc

SEQ ID NO: 322574 - DNA, 16 bp, C. familiaris
ggcctaaatgctccaa

SEQ ID NO: 322575 - DNA, 16 bp, C. familiaris
ggcctacctcaagaag

SEQ ID NO: 322576 - DNA, 16 bp, C. familiaris
ggcctcaccccagacc

SEQ ID NO: 322577 - DNA, 16 bp, C. familiaris
ggcctcagtttctccc

SEQ ID NO: 322578 - DNA, 16 bp, C. familiaris
ggcctcatgcagggag

SEQ ID NO: 322579 - DNA, 16 bp, C. familiaris
ggcctccacctgtccc

SEQ ID NO: 322580 - DNA, 16 bp, C. familiaris
ggcctccagggggagg

SEQ ID NO: 322581 - DNA, 16 bp, C. familiaris
ggcctccagtatcctg

SEQ ID NO: 322582 - DNA, 16 bp, C. familiaris
ggcctcccccgggaca

SEQ ID NO: 322583 - DNA, 16 bp, C. familiaris
ggcctccctgaggagg

SEQ ID NO: 322584 - DNA, 16 bp, C. familiaris
ggcctccctgcatgga

SEQ ID NO: 322585 - DNA, 16 bp, C. familiaris
ggcctccctggcctcc

SEQ ID NO: 322586 - DNA, 16 bp, C. familiaris
ggcctccctgggcctc

SEQ ID NO: 322587 - DNA, 16 bp, C. familiaris
ggcctcctggaggagg

SEQ ID NO: 322588 - DNA, 16 bp, C. familiaris
ggcctcctggcctccc

SEQ ID NO: 322589 - DNA, 16 bp, C. familiaris
ggcctcctggcctctg

SEQ ID NO: 322590 - DNA, 16 bp, C. familiaris
ggcctcctgggccctg

SEQ ID NO: 322591 - DNA, 16 bp, C. familiaris
ggcctcgggcctcggg

SEQ ID NO: 322592 - DNA, 16 bp, C. familiaris
ggcctctccctcagaa

SEQ ID NO: 322593 - DNA, 16 bp, C. familiaris
ggcctctctgggcctc

SEQ ID NO: 322594 - DNA, 16 bp, C. familiaris
ggcctctggcctccag

SEQ ID NO: 322595 - DNA, 16 bp, C. familiaris
ggcctgaatgtggtga

SEQ ID NO: 322596 - DNA, 16 bp, C. familiaris
ggcctgagttcaaatc

SEQ ID NO: 322597 - DNA, 16 bp, C. familiaris
ggcctggagcccaggg

SEQ ID NO: 322598 - DNA, 16 bp, C. familiaris
ggcctggagggcccag

SEQ ID NO: 322599 - DNA, 16 bp, C. familiaris
ggcctggccaatcaga

SEQ ID NO: 322600 - DNA, 16 bp, C. familiaris
ggcctggccagggccc

SEQ ID NO: 322601 - DNA, 16 bp, C. familiaris
ggcctggccctgggcc

SEQ ID NO: 322602 - DNA, 16 bp, C. familiaris
ggcctggccctgggct

SEQ ID NO: 322603 - DNA, 16 bp, C. familiaris
ggcctggcctggcccc

SEQ ID NO: 322604 - DNA, 16 bp, C. familiaris
ggcctgggcctgggcc

SEQ ID NO: 322605 - DNA, 16 bp, C. familiaris
ggcctgggcctgggct

SEQ ID NO: 322606 - DNA, 16 bp, C. familiaris
ggcctggggaggctgg

SEQ ID NO: 322607 - DNA, 16 bp, C. familiaris
ggcctggggcagcagc

SEQ ID NO: 322608 - DNA, 16 bp, C. familiaris
ggcctggggcccaggg

SEQ ID NO: 322609 - DNA, 16 bp, C. familiaris
ggcctggggctgcagg

SEQ ID NO: 322610 - DNA, 16 bp, C. familiaris
ggcctgtgtgtgtgtg

SEQ ID NO: 322611 - DNA, 16 bp, C. familiaris
ggccttccaggtctct

SEQ ID NO: 322612 - DNA, 16 bp, C. familiaris
ggccttgaatgccaag

SEQ ID NO: 322613 - DNA, 16 bp, C. familiaris
ggcctttgcacaggct

SEQ ID NO: 322614 - DNA, 16 bp, C. familiaris
ggcctttgcaccagct

SEQ ID NO: 322615 - DNA, 16 bp, C. familiaris
ggcctttgcatctgct

SEQ ID NO: 322616 - DNA, 16 bp, C. familiaris
ggcctttgctcttgct

SEQ ID NO: 322617 - DNA, 16 bp, C. familiaris
ggcgcaggccccggag

SEQ ID NO: 322618 - DNA, 16 bp, C. familiaris
ggcgccgcctgcagcc

SEQ ID NO: 322619 - DNA, 16 bp, C. familiaris
ggcgccgcctgcagct

SEQ ID NO: 322620 - DNA, 16 bp, C. familiaris
ggcgcctggatggctc

SEQ ID NO: 322621 - DNA, 17 bp, C. familiaris
ggcggaggaagaggctc

SEQ ID NO: 322622 - DNA, 16 bp, C. familiaris
ggcggccagctctcca

SEQ ID NO: 322623 - DNA, 16 bp, C. familiaris
ggcggcggcggctcct

SEQ ID NO: 322624 - DNA, 16 bp, C. familiaris
ggcggcggcggctgca

SEQ ID NO: 322625 - DNA, 16 bp, C. familiaris
ggcggctcagctggtt

SEQ ID NO: 322626 - DNA, 16 bp, C. familiaris
ggcggggagcctgatg

SEQ ID NO: 322627 - DNA, 16 bp, C. familiaris
ggcggggccagctctg

SEQ ID NO: 322628 - DNA, 16 bp, C. familiaris
ggcgtgagcctggagt

SEQ ID NO: 322629 - DNA, 16 bp, C. familiaris
ggcgtgattctggaga

SEQ ID NO: 322630 - DNA, 16 bp, C. familiaris
ggctaaaaccattttt

SEQ ID NO: 322631 - DNA, 16 bp, C. familiaris
ggctaaaattgccttt

SEQ ID NO: 322632 - DNA, 16 bp, C. familiaris
ggctagctattgttag

SEQ ID NO: 322633 - DNA, 16 bp, C. familiaris
ggctaggcagggaaag

SEQ ID NO: 322634 - DNA, 16 bp, C. familiaris
ggctatagtttgccaa

SEQ ID NO: 322635 - DNA, 16 bp, C. familiaris
ggctatcatcaagaag

SEQ ID NO: 322636 - DNA, 16 bp, C. familiaris
ggctatctgcaagcca

SEQ ID NO: 322637 - DNA, 16 bp, C. familiaris
ggctcaaatccaggac

SEQ ID NO: 322638 - DNA, 16 bp, C. familiaris
ggctcaccatggggag

SEQ ID NO: 322639 - DNA, 16 bp, C. familiaris
ggctcagagaacttaa

SEQ ID NO: 322640 - DNA, 16 bp, C. familiaris
ggctcagagagggtga

SEQ ID NO: 322641 - DNA, 16 bp, C. familiaris
ggctcagagcctgatc

SEQ ID NO: 322642 - DNA, 16 bp, C. familiaris
ggctcagcagctgaac

SEQ ID NO: 322643 - DNA, 16 bp, C. familiaris
ggctcagccagttggg

SEQ ID NO: 322644 - DNA, 16 bp, C. familiaris
ggctcaggctcagggc

SEQ ID NO: 322645 - DNA, 16 bp, C. familiaris
ggctcagggagcctga

SEQ ID NO: 322646 - DNA, 16 bp, C. familiaris
ggctcagggcctgacc

SEQ ID NO: 322647 - DNA, 16 bp, C. familiaris
ggctcaggggtggagc

SEQ ID NO: 322648 - DNA, 17 bp, C. familiaris
ggctcaggggtttggtg

SEQ ID NO: 322649 - DNA, 16 bp, C. familiaris
ggctcaggtcatgatc

SEQ ID NO: 322650 - DNA, 16 bp, C. familiaris
ggctcaggtccagatc

SEQ ID NO: 322651 - DNA, 16 bp, C. familiaris
ggctcagtcagaggag

SEQ ID NO: 322652 - DNA, 16 bp, C. familiaris
ggctcagtctatagag

SEQ ID NO: 322653 - DNA, 16 bp, C. familiaris
ggctcagtggagagtc

SEQ ID NO: 322654 - DNA, 16 bp, C. familiaris
ggctcagtggcttaag

SEQ ID NO: 322655 - DNA, 16 bp, C. familiaris
ggctcagtgtggacaa

SEQ ID NO: 322656 - DNA, 16 bp, C. familiaris
ggctcagttggaggaa

SEQ ID NO: 322657 - DNA, 16 bp, C. familiaris
ggctcatttggtgaag

SEQ ID NO: 322658 - DNA, 16 bp, C. familiaris
ggctccacactcagca

SEQ ID NO: 322659 - DNA, 16 bp, C. familiaris
ggctccaggagcagct

SEQ ID NO: 322660 - DNA, 16 bp, C. familiaris
ggctccaggaggaaca

SEQ ID NO: 322661 - DNA, 16 bp, C. familiaris
ggctccaggctcaggg

SEQ ID NO: 322662 - DNA, 16 bp, C. familiaris
ggctccagggcctgca

SEQ ID NO: 322663 - DNA, 16 bp, C. familiaris
ggctccatacaccagg

SEQ ID NO: 322664 - DNA, 16 bp, C. familiaris
ggctccatcccagacc

SEQ ID NO: 322665 - DNA, 16 bp, C. familiaris
ggctccatcccaggcc

SEQ ID NO: 322666 - DNA, 16 bp, C. familiaris
ggctccatgaggggag

SEQ ID NO: 322667 - DNA, 16 bp, C. familiaris
ggctccatgatgggca

SEQ ID NO: 322668 - DNA, 16 bp, C. familiaris
ggctccatgccagaag

SEQ ID NO: 322669 - DNA, 16 bp, C. familiaris
ggctccatgcccgatg

SEQ ID NO: 322670 - DNA, 16 bp, C. familiaris
ggctccatgctcagcc

SEQ ID NO: 322671 - DNA, 16 bp, C. familiaris
ggctccatgctgagcg

SEQ ID NO: 322672 - DNA, 16 bp, C. familiaris
ggctccatgctgggga

SEQ ID NO: 322673 - DNA, 16 bp, C. familiaris
ggctcccacaaggagc

SEQ ID NO: 322674 - DNA, 16 bp, C. familiaris
ggctcccagcaaggag

SEQ ID NO: 322675 - DNA, 16 bp, C. familiaris
ggctcccagtgaggag

SEQ ID NO: 322676 - DNA, 16 bp, C. familiaris
ggctccccacctggag

SEQ ID NO: 322677 - DNA, 16 bp, C. familiaris
ggctccccactcagtg

SEQ ID NO: 322678 - DNA, 16 bp, C. familiaris
ggctccccactgagcc

SEQ ID NO: 322679 - DNA, 16 bp, C. familiaris
ggctccccagggagca

SEQ ID NO: 322680 - DNA, 16 bp, C. familiaris
ggctccccaggggagc

SEQ ID NO: 322681 - DNA, 16 bp, C. familiaris
ggctccccggagggag

SEQ ID NO: 322682 - DNA, 16 bp, C. familiaris
ggctccccggggggag

SEQ ID NO: 322683 - DNA, 16 bp, C. familiaris
ggctcccctgctgagc

SEQ ID NO: 322684 - DNA, 16 bp, C. familiaris
ggctcccctggaggag

SEQ ID NO: 322685 - DNA, 16 bp, C. familiaris
ggctcccctttctcca

SEQ ID NO: 322686 - DNA, 16 bp, C. familiaris
ggctcccggcatagag

SEQ ID NO: 322687 - DNA, 16 bp, C. familiaris
ggctcccggtgcatcg

SEQ ID NO: 322688 - DNA, 16 bp, C. familiaris
ggctccctgaagagag

SEQ ID NO: 322689 - DNA, 16 bp, C. familiaris
ggctccctgcactggg

SEQ ID NO: 322690 - DNA, 16 bp, C. familiaris
ggctccctgcaggaag

SEQ ID NO: 322691 - DNA, 16 bp, C. familiaris
ggctccctgcaggagc

SEQ ID NO: 322692 - DNA, 16 bp, C. familiaris
ggctccctgcatgggg

SEQ ID NO: 322693 - DNA, 16 bp, C. familiaris
ggctccctgcccagca

SEQ ID NO: 322694 - DNA, 16 bp, C. familiaris
ggctccctgcccagcg

SEQ ID NO: 322695 - DNA, 16 bp, C. familiaris
ggctccctgcctctcc

SEQ ID NO: 322696 - DNA, 16 bp, C. familiaris
ggctccctgcctgggg

SEQ ID NO: 322697 - DNA, 16 bp, C. familiaris
ggctccctgctcaagg

SEQ ID NO: 322698 - DNA, 16 bp, C. familiaris
ggctccctgctcagcc

SEQ ID NO: 322699 - DNA, 16 bp, C. familiaris
ggctccctgctccaca

SEQ ID NO: 322700 - DNA, 16 bp, C. familiaris
ggctccctgctcccca

SEQ ID NO: 322701 - DNA, 16 bp, C. familiaris
ggctccctgctcctca

SEQ ID NO: 322702 - DNA, 16 bp, C. familiaris
ggctccctgctcgatg

SEQ ID NO: 322703 - DNA, 16 bp, C. familiaris
ggctccctgctcggtg

SEQ ID NO: 322704 - DNA, 16 bp, C. familiaris
ggctccctgctgacca

SEQ ID NO: 322705 - DNA, 16 bp, C. familiaris
ggctccctgctgagtg

SEQ ID NO: 322706 - DNA, 16 bp, C. familiaris
ggctccctgctgatca

SEQ ID NO: 322707 - DNA, 16 bp, C. familiaris
ggctccctgcttagca

SEQ ID NO: 322708 - DNA, 16 bp, C. familiaris
ggctccctggagagag

SEQ ID NO: 322709 - DNA, 16 bp, C. familiaris
ggctccctgggagaag

SEQ ID NO: 322710 - DNA, 16 bp, C. familiaris
ggctccctgtgggcag

SEQ ID NO: 322711 - DNA, 16 bp, C. familiaris
ggctccctgtggggac

SEQ ID NO: 322712 - DNA, 16 bp, C. familiaris
ggctccctgttcaatg

SEQ ID NO: 322713 - DNA, 16 bp, C. familiaris
ggctccctgttcagca

SEQ ID NO: 322714 - DNA, 16 bp, C. familiaris
ggctccctgttgagca

SEQ ID NO: 322715 - DNA, 16 bp, C. familiaris
ggctcccttgctcagc

SEQ ID NO: 322716 - DNA, 16 bp, C. familiaris
ggctccgggagcagct

SEQ ID NO: 322717 - DNA, 16 bp, C. familiaris
ggctccgggctcccgg

SEQ ID NO: 322718 - DNA, 16 bp, C. familiaris
ggctccggggcagggc

SEQ ID NO: 322719 - DNA, 16 bp, C. familiaris
ggctccggggctccgg

SEQ ID NO: 322720 - DNA, 16 bp, C. familiaris
ggctccgtgctgagtg

SEQ ID NO: 322721 - DNA, 16 bp, C. familiaris
ggctcctcaccccctc

SEQ ID NO: 322722 - DNA, 16 bp, C. familiaris
ggctcctccctctgcc

SEQ ID NO: 322723 - DNA, 16 bp, C. familiaris
ggctcctcctggggcc

SEQ ID NO: 322724 - DNA, 16 bp, C. familiaris
ggctcctgaatggctc

SEQ ID NO: 322725 - DNA, 18 bp, C. familiaris
ggctcctggcatggggcc

SEQ ID NO: 322726 - DNA, 16 bp, C. familiaris
ggctcctggccccagg

SEQ ID NO: 322727 - DNA, 16 bp, C. familiaris
ggctcctggctcctgg

SEQ ID NO: 322728 - DNA, 16 bp, C. familiaris
ggctcctggggacccc

SEQ ID NO: 322729 - DNA, 16 bp, C. familiaris
ggctcctgggtggtgc

SEQ ID NO: 322730 - DNA, 16 bp, C. familiaris
ggctcctgggtggttc

SEQ ID NO: 322731 - DNA, 16 bp, C. familiaris
ggctcctggtgtatgg

SEQ ID NO: 322732 - DNA, 16 bp, C. familiaris
ggctccttctccctct

SEQ ID NO: 322733 - DNA, 16 bp, C. familiaris
ggctccttgcagggcc

SEQ ID NO: 322734 - DNA, 16 bp, C. familiaris
ggctccttgtatggag

SEQ ID NO: 322735 - DNA, 16 bp, C. familiaris
ggctccttgttcaaaa

SEQ ID NO: 322736 - DNA, 16 bp, C. familiaris
ggctcgaccccaggac

SEQ ID NO: 322737 - DNA, 16 bp, C. familiaris
ggctcgagtcctgcat

SEQ ID NO: 322738 - DNA, 16 bp, C. familiaris
ggctcgctgcatggag

SEQ ID NO: 322739 - DNA, 16 bp, C. familiaris
ggctcggtcagtggag

SEQ ID NO: 322740 - DNA, 16 bp, C. familiaris
ggctctcaggctgttc

SEQ ID NO: 322741 - DNA, 16 bp, C. familiaris
ggctctccacaggaag

SEQ ID NO: 322742 - DNA, 16 bp, C. familiaris
ggctctccatagggag

SEQ ID NO: 322743 - DNA, 16 bp, C. familiaris
ggctctctgtgtggtg

SEQ ID NO: 322744 - DNA, 16 bp, C. familiaris
ggctctgcactcacca

SEQ ID NO: 322745 - DNA, 16 bp, C. familiaris
ggctctgccctcagca

SEQ ID NO: 322746 - DNA, 16 bp, C. familiaris
ggctctgccctgggca

SEQ ID NO: 322747 - DNA, 16 bp, C. familiaris
ggctctgcgctgggca

SEQ ID NO: 322748 - DNA, 16 bp, C. familiaris
ggctctgcgcttagca

SEQ ID NO: 322749 - DNA, 16 bp, C. familiaris
ggctctgctctcagca

SEQ ID NO: 322750 - DNA, 16 bp, C. familiaris
ggctctgctctgggca

SEQ ID NO: 322751 - DNA, 16 bp, C. familiaris
ggctctggaaaaaaag

SEQ ID NO: 322752 - DNA, 16 bp, C. familiaris
ggctctggagccagac

SEQ ID NO: 322753 - DNA, 16 bp, C. familiaris
ggctctgggctcagtg

SEQ ID NO: 322754 - DNA, 16 bp, C. familiaris
ggctctggggaagaat

SEQ ID NO: 322755 - DNA, 16 bp, C. familiaris
ggctctggggacagag

SEQ ID NO: 322756 - DNA, 16 bp, C. familiaris
ggctctgtcagtggag

SEQ ID NO: 322757 - DNA, 16 bp, C. familiaris
ggctctgtgcccagca

SEQ ID NO: 322758 - DNA, 16 bp, C. familiaris
ggctctgtgctcaacg

SEQ ID NO: 322759 - DNA, 16 bp, C. familiaris
ggctctgtgctggggg

SEQ ID NO: 322760 - DNA, 16 bp, C. familiaris
ggctctgtgcttagca

SEQ ID NO: 322761 - DNA, 16 bp, C. familiaris
ggctctgtgcttagct

SEQ ID NO: 322762 - DNA, 16 bp, C. familiaris
ggctgaaagcagtgct

SEQ ID NO: 322763 - DNA, 16 bp, C. familiaris
ggctgaaatcaagagt

SEQ ID NO: 322764 - DNA, 16 bp, C. familiaris
ggctgaaggcaggcac

SEQ ID NO: 322765 - DNA, 16 bp, C. familiaris
ggctgaaggcggccct

SEQ ID NO: 322766 - DNA, 16 bp, C. familiaris
ggctgaaggcggtggt

SEQ ID NO: 322767 - DNA, 16 bp, C. familiaris
ggctgaaggtggcact

SEQ ID NO: 322768 - DNA, 16 bp, C. familiaris
ggctgacgctcaactg

SEQ ID NO: 322769 - DNA, 16 bp, C. familiaris
ggctgagctgggctga

SEQ ID NO: 322770 - DNA, 50 bp, C. familiaris
ggctgaggccggggcgagtgtccccaggacaggagagccccgtcccggag

SEQ ID NO: 322771 - DNA, 16 bp, C. familiaris
ggctgaggctgaggct

SEQ ID NO: 322772 - DNA, 16 bp, C. familiaris
ggctgcaccctgctgc

SEQ ID NO: 322773 - DNA, 16 bp, C. familiaris
ggctgcaggaggagga

SEQ ID NO: 322774 - DNA, 16 bp, C. familiaris
ggctgcaggaggcgct

SEQ ID NO: 322775 - DNA, 16 bp, C. familiaris
ggctgcaggaggtgct

SEQ ID NO: 322776 - DNA, 16 bp, C. familiaris
ggctgcaggcagagct

SEQ ID NO: 322777 - DNA, 16 bp, C. familiaris
ggctgcaggcggagct

SEQ ID NO: 322778 - DNA, 16 bp, C. familiaris
ggctgcaggcggcgct

SEQ ID NO: 322779 - DNA, 16 bp, C. familiaris
ggctgcagggcaggag

SEQ ID NO: 322780 - DNA, 16 bp, C. familiaris
ggctgcaggtggtgct

SEQ ID NO: 322781 - DNA, 16 bp, C. familiaris
ggctgcatgcagggaa

SEQ ID NO: 322782 - DNA, 16 bp, C. familiaris
ggctgccagaggcagg

SEQ ID NO: 322783 - DNA, 16 bp, C. familiaris
ggctgcccaagattta

SEQ ID NO: 322784 - DNA, 16 bp, C. familiaris
ggctgcccagtttttc

SEQ ID NO: 322785 - DNA, 16 bp, C. familiaris
ggctgccctgtatttt

SEQ ID NO: 322786 - DNA, 16 bp, C. familiaris
ggctgcccttcttttt

SEQ ID NO: 322787 - DNA, 16 bp, C. familiaris
ggctgcctcctccagg

SEQ ID NO: 322788 - DNA, 16 bp, C. familiaris
ggctgcctgcaggaag

SEQ ID NO: 322789 - DNA, 16 bp, C. familiaris
ggctgcctgcatggag

SEQ ID NO: 322790 - DNA, 16 bp, C. familiaris
ggctgcctggaggagg

SEQ ID NO: 322791 - DNA, 16 bp, C. familiaris
ggctgctataagaaaa

SEQ ID NO: 322792 - DNA, 16 bp, C. familiaris
ggctgctgcagctcca

SEQ ID NO: 322793 - DNA, 16 bp, C. familiaris
ggctgctgctgctcct

SEQ ID NO: 322794 - DNA, 16 bp, C. familiaris
ggctgctgtgacaaag

SEQ ID NO: 322795 - DNA, 16 bp, C. familiaris
ggctggaactggaggg

SEQ ID NO: 322796 - DNA, 16 bp, C. familiaris
ggctggaagaagcaga

SEQ ID NO: 322797 - DNA, 16 bp, C. familiaris
ggctggagacccaggg

SEQ ID NO: 322798 - DNA, 16 bp, C. familiaris
ggctggagacctggcc

SEQ ID NO: 322799 - DNA, 16 bp, C. familiaris
ggctggagcagaggga

SEQ ID NO: 322800 - DNA, 16 bp, C. familiaris
ggctggaggcaggagg

SEQ ID NO: 322801 - DNA, 16 bp, C. familiaris
ggctggatcacaggac

SEQ ID NO: 322802 - DNA, 16 bp, C. familiaris
ggctggatcccaccac

SEQ ID NO: 322803 - DNA, 16 bp, C. familiaris
ggctggatcccaggcc

SEQ ID NO: 322804 - DNA, 16 bp, C. familiaris
ggctggatggcttccc

SEQ ID NO: 322805 - DNA, 16 bp, C. familiaris
ggctggcaggagggag

SEQ ID NO: 322806 - DNA, 16 bp, C. familiaris
ggctggcaggctggag

SEQ ID NO: 322807 - DNA, 16 bp, C. familiaris
ggctggcagggctggg

SEQ ID NO: 322808 - DNA, 16 bp, C. familiaris
ggctggctcagatggt

SEQ ID NO: 322809 - DNA, 16 bp, C. familiaris
ggctggctcagtggtt

SEQ ID NO: 322810 - DNA, 16 bp, C. familiaris
ggctggctggctggcc

SEQ ID NO: 322811 - DNA, 16 bp, C. familiaris
ggctggctggctggct

SEQ ID NO: 322812 - DNA, 16 bp, C. familiaris
ggctggcttcctgggc

SEQ ID NO: 322813 - DNA, 16 bp, C. familiaris
ggctgggaagcccaag

SEQ ID NO: 322814 - DNA, 16 bp, C. familiaris
ggctgggagcagaggg

SEQ ID NO: 322815 - DNA, 16 bp, C. familiaris
ggctgggccaggccag

SEQ ID NO: 322816 - DNA, 16 bp, C. familiaris
ggctgggccagggcag

SEQ ID NO: 322817 - DNA, 16 bp, C. familiaris
ggctgggcccagggcc

SEQ ID NO: 322818 - DNA, 16 bp, C. familiaris
ggctggggagcctggg

SEQ ID NO: 322819 - DNA, 16 bp, C. familiaris
ggctgtctgactccag

SEQ ID NO: 322820 - DNA, 16 bp, C. familiaris
ggctgtctgcaaggag

SEQ ID NO: 322821 - DNA, 16 bp, C. familiaris
ggctgtgaccccgggg

SEQ ID NO: 322822 - DNA, 16 bp, C. familiaris
ggctgtgatcccaggg

SEQ ID NO: 322823 - DNA, 16 bp, C. familiaris
ggctgtggctgtggct

SEQ ID NO: 322824 - DNA, 16 bp, C. familiaris
ggctgtgggatcgagc

SEQ ID NO: 322825 - DNA, 16 bp, C. familiaris
ggctgtggtcctggag

SEQ ID NO: 322826 - DNA, 16 bp, C. familiaris
ggctgtgtcccccagc

SEQ ID NO: 322827 - DNA, 16 bp, C. familiaris
ggctgtgtccccggtg

SEQ ID NO: 322828 - DNA, 16 bp, C. familiaris
ggctgtgtggccctgg

SEQ ID NO: 322829 - DNA, 16 bp, C. familiaris
ggcttaaacaataaag

SEQ ID NO: 322830 - DNA, 49 bp, C. familiaris
ggcttaatgaccccatcaaaaggcgcagggtttcagactggataaaaaa

SEQ ID NO: 322831 - DNA, 16 bp, C. familiaris
ggcttattttgcttaa

SEQ ID NO: 322832 - DNA, 16 bp, C. familiaris
ggcttcacacagggag

SEQ ID NO: 322833 - DNA, 16 bp, C. familiaris
ggcttcacactcagtg

SEQ ID NO: 322834 - DNA, 16 bp, C. familiaris
ggcttcagaagaaacc

SEQ ID NO: 322835 - DNA, 16 bp, C. familiaris
ggcttcaggcacagct

SEQ ID NO: 322836 - DNA, 16 bp, C. familiaris
ggcttccagcaaggag

SEQ ID NO: 322837 - DNA, 16 bp, C. familiaris
ggcttccaggaggagg

SEQ ID NO: 322838 - DNA, 16 bp, C. familiaris
ggcttcccagaagagg

SEQ ID NO: 322839 - DNA, 16 bp, C. familiaris
ggcttccctgtgggga

SEQ ID NO: 322840 - DNA, 16 bp, C. familiaris
ggcttcctacaaggag

SEQ ID NO: 322841 - DNA, 16 bp, C. familiaris
ggcttcctgaaggagg

SEQ ID NO: 322842 - DNA, 16 bp, C. familiaris
ggcttcctgcggggag

SEQ ID NO: 322843 - DNA, 16 bp, C. familiaris
ggcttcctgctcagcg

SEQ ID NO: 322844 - DNA, 16 bp, C. familiaris
ggcttcctgctcagtg

SEQ ID NO: 322845 - DNA, 16 bp, C. familiaris
ggcttcctggagaagg

SEQ ID NO: 322846 - DNA, 16 bp, C. familiaris
ggcttcctggaggaga

SEQ ID NO: 322847 - DNA, 16 bp, C. familiaris
ggcttcctggaggagg

SEQ ID NO: 322848 - DNA, 16 bp, C. familiaris
ggcttcctggaggcag

SEQ ID NO: 322849 - DNA, 16 bp, C. familiaris
ggcttcctggaggcgg

SEQ ID NO: 322850 - DNA, 16 bp, C. familiaris
ggcttcctggaggggg

SEQ ID NO: 322851 - DNA, 16 bp, C. familiaris
ggcttcctggaggtgg

SEQ ID NO: 322852 - DNA, 16 bp, C. familiaris
ggcttcctgtgaggag

SEQ ID NO: 322853 - DNA, 16 bp, C. familiaris
ggcttctcacaaggag

SEQ ID NO: 322854 - DNA, 16 bp, C. familiaris
ggcttctcagaggagg

SEQ ID NO: 322855 - DNA, 16 bp, C. familiaris
ggcttctcggaggagg

SEQ ID NO: 322856 - DNA, 16 bp, C. familiaris
ggcttctctgaggagg

SEQ ID NO: 322857 - DNA, 16 bp, C. familiaris
ggcttctggtgcatgg

SEQ ID NO: 322858 - DNA, 16 bp, C. familiaris
ggcttgctgcatggag

SEQ ID NO: 322859 - DNA, 16 bp, C. familiaris
ggcttgtgtctctgcc

SEQ ID NO: 322860 - DNA, 16 bp, C. familiaris
ggctttaaggagggca

SEQ ID NO: 322861 - DNA, 16 bp, C. familiaris
ggctttatgaagaaga

SEQ ID NO: 322862 - DNA, 16 bp, C. familiaris
ggctttattttctgtt

SEQ ID NO: 322863 - DNA, 16 bp, C. familiaris
ggctttcaaattggca

SEQ ID NO: 322864 - DNA, 16 bp, C. familiaris
ggctttcctggttctc

SEQ ID NO: 322865 - DNA, 17 bp, C. familiaris
ggctttctgacattgaa

SEQ ID NO: 322866 - DNA, 16 bp, C. familiaris
ggctttgaagatgaag

SEQ ID NO: 322867 - DNA, 16 bp, C. familiaris
ggctttgcactcagca

SEQ ID NO: 322868 - DNA, 16 bp, C. familiaris
ggctttgcactcagtg

SEQ ID NO: 322869 - DNA, 16 bp, C. familiaris
ggctttgtgctcagca

SEQ ID NO: 322870 - DNA, 16 bp, C. familiaris
ggctttgtgctgagca

SEQ ID NO: 322871 - DNA, 16 bp, C. familiaris
gggaaaaaaatcagag

SEQ ID NO: 322872 - DNA, 16 bp, C. familiaris
gggaaaaactgcagaa

SEQ ID NO: 322873 - DNA, 16 bp, C. familiaris
gggaaaagcagtctcc

SEQ ID NO: 322874 - DNA, 16 bp, C. familiaris
gggaaaatcttttttt

SEQ ID NO: 322875 - DNA, 16 bp, C. familiaris
gggaaaccaaaaactt

SEQ ID NO: 322876 - DNA, 16 bp, C. familiaris
gggaaactgaagctca

SEQ ID NO: 322877 - DNA, 16 bp, C. familiaris
gggaaactgaggccca

SEQ ID NO: 322878 - DNA, 16 bp, C. familiaris
gggaaagaaacagata

SEQ ID NO: 322879 - DNA, 16 bp, C. familiaris
gggaaagaagcagact

SEQ ID NO: 322880 - DNA, 16 bp, C. familiaris
gggaaagacacaggca

SEQ ID NO: 322881 - DNA, 16 bp, C. familiaris
gggaaagactatccac

SEQ ID NO: 322882 - DNA, 16 bp, C. familiaris
gggaaagcattcagtc

SEQ ID NO: 322883 - DNA, 16 bp, C. familiaris
gggaaaggctcccagc

SEQ ID NO: 322884 - DNA, 16 bp, C. familiaris
gggaaagtctttattt

SEQ ID NO: 322885 - DNA, 16 bp, C. familiaris
gggaaatacaaatgaa

SEQ ID NO: 322886 - DNA, 16 bp, C. familiaris
gggaaatgagcaaggg

SEQ ID NO: 322887 - DNA, 16 bp, C. familiaris
gggaacagcaggcaga

SEQ ID NO: 322888 - DNA, 16 bp, C. familiaris
gggaacctggctggct

SEQ ID NO: 322889 - DNA, 16 bp, C. familiaris
gggaactgaggcccag

SEQ ID NO: 322890 - DNA, 16 bp, C. familiaris
gggaactggagaaaga

SEQ ID NO: 322891 - DNA, 16 bp, C. familiaris
gggaactggatgtggg

SEQ ID NO: 322892 - DNA, 16 bp, C. familiaris
gggaagaaaacaaata

SEQ ID NO: 322893 - DNA, 16 bp, C. familiaris
gggaagcacagaggga

SEQ ID NO: 322894 - DNA, 16 bp, C. familiaris
gggaagcactgggaac

SEQ ID NO: 322895 - DNA, 16 bp, C. familiaris
gggaagccagccacca

SEQ ID NO: 322896 - DNA, 16 bp, C. familiaris
gggaagccctggtggc

SEQ ID NO: 322897 - DNA, 16 bp, C. familiaris
gggaagctgcagaggg

SEQ ID NO: 322898 - DNA, 16 bp, C. familiaris
gggaagcttgtggcct

SEQ ID NO: 322899 - DNA, 16 bp, C. familiaris
gggaaggaaatagaca

SEQ ID NO: 322900 - DNA, 16 bp, C. familiaris
gggaaggctcccagtg

SEQ ID NO: 322901 - DNA, 16 bp, C. familiaris
gggaatatgaaaaata

SEQ ID NO: 322902 - DNA, 16 bp, C. familiaris
gggaatattgaaaagg

SEQ ID NO: 322903 - DNA, 16 bp, C. familiaris
gggaatctgcttctcc

SEQ ID NO: 322904 - DNA, 16 bp, C. familiaris
gggaatgtgaactgtg

SEQ ID NO: 322905 - DNA, 16 bp, C. familiaris
gggacaagcagagtcc

SEQ ID NO: 322906 - DNA, 16 bp, C. familiaris
gggacaagcagattct

SEQ ID NO: 322907 - DNA, 16 bp, C. familiaris
gggacacctggctggc

SEQ ID NO: 322908 - DNA, 20 bp, C. familiaris
gggacactaacagacacctg

SEQ ID NO: 322909 - DNA, 16 bp, C. familiaris
gggacacttggcagga

SEQ ID NO: 322910 - DNA, 16 bp, C. familiaris
gggacagagacagaga

SEQ ID NO: 322911 - DNA, 16 bp, C. familiaris
gggacagagcccacag

SEQ ID NO: 322912 - DNA, 16 bp, C. familiaris
gggacagaggcctggg

SEQ ID NO: 322913 - DNA, 16 bp, C. familiaris
gggacaggcagggcta

SEQ ID NO: 322914 - DNA, 16 bp, C. familiaris
gggacaggtgacttgg

SEQ ID NO: 322915 - DNA, 16 bp, C. familiaris
gggacatcatcaagat

SEQ ID NO: 322916 - DNA, 16 bp, C. familiaris
gggaccagatggattt

SEQ ID NO: 322917 - DNA, 16 bp, C. familiaris
gggaccatgacctgaa

SEQ ID NO: 322918 - DNA, 16 bp, C. familiaris
gggaccccaacatggg

SEQ ID NO: 322919 - DNA, 16 bp, C. familiaris
gggaccccaatgcagg

SEQ ID NO: 322920 - DNA, 16 bp, C. familiaris
gggaccccaggaccac

SEQ ID NO: 322921 - DNA, 16 bp, C. familiaris
gggaccccagggtcac

SEQ ID NO: 322922 - DNA, 16 bp, C. familiaris
gggaccccgggtcacg

SEQ ID NO: 322923 - DNA, 16 bp, C. familiaris
gggacccggagcagct

SEQ ID NO: 322924 - DNA, 16 bp, C. familiaris
gggacccggggtcgag

SEQ ID NO: 322925 - DNA, 16 bp, C. familiaris
gggaccctcctgcact

SEQ ID NO: 322926 - DNA, 16 bp, C. familiaris
gggacctcctgggagt

SEQ ID NO: 322927 - DNA, 16 bp, C. familiaris
gggacctggagcagct

SEQ ID NO: 322928 - DNA, 16 bp, C. familiaris
gggacctggctggctc

SEQ ID NO: 322929 - DNA, 16 bp, C. familiaris
gggacctggggtcgag

SEQ ID NO: 322930 - DNA, 16 bp, C. familiaris
gggactcaatcccgtg

SEQ ID NO: 322931 - DNA, 16 bp, C. familiaris
gggactccaagatcac

SEQ ID NO: 322932 - DNA, 16 bp, C. familiaris
gggactcgatgctggg

SEQ ID NO: 322933 - DNA, 16 bp, C. familiaris
gggactgagccccatg

SEQ ID NO: 322934 - DNA, 16 bp, C. familiaris
gggactgagggagagg

SEQ ID NO: 322935 - DNA, 16 bp, C. familiaris
gggactggatccccgg

SEQ ID NO: 322936 - DNA, 16 bp, C. familiaris
gggactggatctcagg

SEQ ID NO: 322937 - DNA, 16 bp, C. familiaris
gggactgggagatggt

SEQ ID NO: 322938 - DNA, 16 bp, C. familiaris
gggacttcagaggaaa

SEQ ID NO: 322939 - DNA, 16 bp, C. familiaris
gggacttggaccccaa

SEQ ID NO: 322940 - DNA, 16 bp, C. familiaris
gggactttaatatccc

SEQ ID NO: 322941 - DNA, 16 bp, C. familiaris
gggagaaagagaaact

SEQ ID NO: 322942 - DNA, 16 bp, C. familiaris
gggagaagcagaggca

SEQ ID NO: 322943 - DNA, 16 bp, C. familiaris
gggagaagcagcagag

SEQ ID NO: 322944 - DNA, 16 bp, C. familiaris
gggagaagcagcctgc

SEQ ID NO: 322945 - DNA, 16 bp, C. familiaris
gggagaagcaggatac

SEQ ID NO: 322946 - DNA, 16 bp, C. familiaris
gggagaagcaggggcc

SEQ ID NO: 322947 - DNA, 16 bp, C. familiaris
gggagaagcaggtccc

SEQ ID NO: 322948 - DNA, 16 bp, C. familiaris
gggagaagcatattcc

SEQ ID NO: 322949 - DNA, 16 bp, C. familiaris
gggagaagcatgctct

SEQ ID NO: 322950 - DNA, 16 bp, C. familiaris
gggagaagccagtggg

SEQ ID NO: 322951 - DNA, 16 bp, C. familiaris
gggagaagcctgctcc

SEQ ID NO: 322952 - DNA, 16 bp, C. familiaris
gggagaagctgactcc

SEQ ID NO: 322953 - DNA, 16 bp, C. familiaris
gggagaaggacaagca

SEQ ID NO: 322954 - DNA, 16 bp, C. familiaris
gggagaatcagacttc

SEQ ID NO: 322955 - DNA, 16 bp, C. familiaris
gggagaatcttcaagc

SEQ ID NO: 322956 - DNA, 16 bp, C. familiaris
gggagacacacagaga

SEQ ID NO: 322957 - DNA, 16 bp, C. familiaris
gggagacccatgtggg

SEQ ID NO: 322958 - DNA, 16 bp, C. familiaris
gggagagaagctcaag

SEQ ID NO: 322959 - DNA, 16 bp, C. familiaris
gggagagacacaggca

SEQ ID NO: 322960 - DNA, 16 bp, C. familiaris
gggagagagaaattca

SEQ ID NO: 322961 - DNA, 16 bp, C. familiaris
gggagagaggaaatct

SEQ ID NO: 322962 - DNA, 16 bp, C. familiaris
gggagaggatgcggag

SEQ ID NO: 322963 - DNA, 16 bp, C. familiaris
gggagaggctgggaga

SEQ ID NO: 322964 - DNA, 16 bp, C. familiaris
gggagagggaggagct

SEQ ID NO: 322965 - DNA, 16 bp, C. familiaris
gggagatgaagaagca

SEQ ID NO: 322966 - DNA, 16 bp, C. familiaris
gggagatgcagactct

SEQ ID NO: 322967 - DNA, 16 bp, C. familiaris
gggagatggagaaaca

SEQ ID NO: 322968 - DNA, 16 bp, C. familiaris
gggagcacagccctgc

SEQ ID NO: 322969 - DNA, 16 bp, C. familiaris
gggagcagagcccagg

SEQ ID NO: 322970 - DNA, 16 bp, C. familiaris
gggagcagcagactct

SEQ ID NO: 322971 - DNA, 16 bp, C. familiaris
gggagcagcaggctct

SEQ ID NO: 322972 - DNA, 16 bp, C. familiaris
gggagcagcaggtaga

SEQ ID NO: 322973 - DNA, 16 bp, C. familiaris
gggagcagcaggtgca

SEQ ID NO: 322974 - DNA, 16 bp, C. familiaris
gggagcagctcagagg

SEQ ID NO: 322975 - DNA, 16 bp, C. familiaris
gggagcagctgggagg

SEQ ID NO: 322976 - DNA, 16 bp, C. familiaris
gggagcagggagcctg

SEQ ID NO: 322977 - DNA, 16 bp, C. familiaris
gggagcatcaggcaga

SEQ ID NO: 322978 - DNA, 16 bp, C. familiaris
gggagcatccaggcca

SEQ ID NO: 322979 - DNA, 16 bp, C. familiaris
gggagccagacctggg

SEQ ID NO: 322980 - DNA, 16 bp, C. familiaris
gggagccagatgctgg

SEQ ID NO: 322981 - DNA, 16 bp, C. familiaris
gggagccagatggggg

SEQ ID NO: 322982 - DNA, 16 bp, C. familiaris
gggagccagcttcttc

SEQ ID NO: 322983 - DNA, 16 bp, C. familiaris
gggagccagggccagg

SEQ ID NO: 322984 - DNA, 16 bp, C. familiaris
gggagccaggggagcc

SEQ ID NO: 322985 - DNA, 16 bp, C. familiaris
gggagccaggggctgg

SEQ ID NO: 322986 - DNA, 16 bp, C. familiaris
gggagccaggtgtggg

SEQ ID NO: 322987 - DNA, 16 bp, C. familiaris
gggagcccaacatgga

SEQ ID NO: 322988 - DNA, 16 bp, C. familiaris
gggagcccaacatgtg

SEQ ID NO: 322989 - DNA, 16 bp, C. familiaris
gggagcccaaggtggg

SEQ ID NO: 322990 - DNA, 16 bp, C. familiaris
gggagcccacgtggga

SEQ ID NO: 322991 - DNA, 16 bp, C. familiaris
gggagccccagggagc

SEQ ID NO: 322992 - DNA, 16 bp, C. familiaris
gggagccccatttggg

SEQ ID NO: 322993 - DNA, 16 bp, C. familiaris
gggagccccgtgcagg

SEQ ID NO: 322994 - DNA, 16 bp, C. familiaris
gggagcccgacgccgg

SEQ ID NO: 322995 - DNA, 16 bp, C. familiaris
gggagcccgggagccc

SEQ ID NO: 322996 - DNA, 16 bp, C. familiaris
gggagccctatgcagg

SEQ ID NO: 322997 - DNA, 16 bp, C. familiaris
gggagccctggaggcc

SEQ ID NO: 322998 - DNA, 16 bp, C. familiaris
gggagccctggggctg

SEQ ID NO: 322999 - DNA, 16 bp, C. familiaris
gggagccctggtggct

SEQ ID NO: 323000 - DNA, 16 bp, C. familiaris
gggagccggacgcagg

SEQ ID NO: 323001 - DNA, 16 bp, C. familiaris
gggagccggatgcaga

SEQ ID NO: 323002 - DNA, 16 bp, C. familiaris
gggagcctacttctcc

SEQ ID NO: 323003 - DNA, 16 bp, C. familiaris
gggagcctgatccggg

SEQ ID NO: 323004 - DNA, 16 bp, C. familiaris
gggagcctgcctctgc

SEQ ID NO: 323005 - DNA, 16 bp, C. familiaris
gggagcctggagggag

SEQ ID NO: 323006 - DNA, 16 bp, C. familiaris
gggagcctggctggct

SEQ ID NO: 323007 - DNA, 16 bp, C. familiaris
gggagcctggggagcc

SEQ ID NO: 323008 - DNA, 16 bp, C. familiaris
gggagcctggtgcaga

SEQ ID NO: 323009 - DNA, 16 bp, C. familiaris
gggagctacagaggga

SEQ ID NO: 323010 - DNA, 16 bp, C. familiaris
gggagctcagtgtggg

SEQ ID NO: 323011 - DNA, 16 bp, C. familiaris
gggagctgaggcagag

SEQ ID NO: 323012 - DNA, 16 bp, C. familiaris
gggagctgcagaggga

SEQ ID NO: 323013 - DNA, 16 bp, C. familiaris
gggagctgctcagccc

SEQ ID NO: 323014 - DNA, 16 bp, C. familiaris
gggagctggagcagga

SEQ ID NO: 323015 - DNA, 16 bp, C. familiaris
gggagctgggaggcag

SEQ ID NO: 323016 - DNA, 16 bp, C. familiaris
gggagctgggcctggg

SEQ ID NO: 323017 - DNA, 16 bp, C. familiaris
gggagctggggagctg

SEQ ID NO: 323018 - DNA, 16 bp, C. familiaris
gggaggacacctgggt

SEQ ID NO: 323019 - DNA, 16 bp, C. familiaris
gggaggagcacagaga

SEQ ID NO: 323020 - DNA, 16 bp, C. familiaris
gggaggaggagctgag

SEQ ID NO: 323021 - DNA, 16 bp, C. familiaris
gggaggaggtgcagag

SEQ ID NO: 323022 - DNA, 16 bp, C. familiaris
gggaggcacagaagga

SEQ ID NO: 323023 - DNA, 16 bp, C. familiaris
gggaggcagaagcaga

SEQ ID NO: 323024 - DNA, 16 bp, C. familiaris
gggaggcaggaggctg

SEQ ID NO: 323025 - DNA, 16 bp, C. familiaris
gggaggccaacgtggg

SEQ ID NO: 323026 - DNA, 16 bp, C. familiaris
gggaggccagatcctg

SEQ ID NO: 323027 - DNA, 16 bp, C. familiaris
gggaggccaggaggcc

SEQ ID NO: 323028 - DNA, 16 bp, C. familiaris
gggaggcccatgtggg

SEQ ID NO: 323029 - DNA, 16 bp, C. familiaris
gggaggcccgggtggc

SEQ ID NO: 323030 - DNA, 16 bp, C. familiaris
gggaggctgcttttcc

SEQ ID NO: 323031 - DNA, 16 bp, C. familiaris
gggaggctgggaaatg

SEQ ID NO: 323032 - DNA, 16 bp, C. familiaris
gggagggagccctggt

SEQ ID NO: 323033 - DNA, 16 bp, C. familiaris
gggagggcagcccagg

SEQ ID NO: 323034 - DNA, 16 bp, C. familiaris
gggagggcagccccag

SEQ ID NO: 323035 - DNA, 16 bp, C. familiaris
gggagggcttcctgga

SEQ ID NO: 323036 - DNA, 16 bp, C. familiaris
gggaggggcacctggg

SEQ ID NO: 323037 - DNA, 18 bp, C. familiaris
gggaggtggagcaggacc

SEQ ID NO: 323038 - DNA, 16 bp, C. familiaris
gggaggttttggatga

SEQ ID NO: 323039 - DNA, 16 bp, C. familiaris
gggagtctatttctcc

SEQ ID NO: 323040 - DNA, 16 bp, C. familiaris
gggagtctgatgaggg

SEQ ID NO: 323041 - DNA, 16 bp, C. familiaris
gggagtctgcctggga

SEQ ID NO: 323042 - DNA, 16 bp, C. familiaris
gggagtctgctgggga

SEQ ID NO: 323043 - DNA, 16 bp, C. familiaris
gggagtctgcttctcc

SEQ ID NO: 323044 - DNA, 16 bp, C. familiaris
gggagtggcagaggga

SEQ ID NO: 323045 - DNA, 16 bp, C. familiaris
gggagtggtcctgggg

SEQ ID NO: 323046 - DNA, 16 bp, C. familiaris
gggagttagagcagga

SEQ ID NO: 323047 - DNA, 16 bp, C. familiaris
gggatagagattactt

SEQ ID NO: 323048 - DNA, 16 bp, C. familiaris
gggatcaagataatgc

SEQ ID NO: 323049 - DNA, 16 bp, C. familiaris
gggatcaagccctgaa

SEQ ID NO: 323050 - DNA, 16 bp, C. familiaris
gggatcaggccctggg

SEQ ID NO: 323051 - DNA, 16 bp, C. familiaris
gggatcatgctctgaa

SEQ ID NO: 323052 - DNA, 16 bp, C. familiaris
gggatccagatgtggg

SEQ ID NO: 323053 - DNA, 16 bp, C. familiaris
gggatccagccctaca

SEQ ID NO: 323054 - DNA, 16 bp, C. familiaris
gggatccaggatggag

SEQ ID NO: 323055 - DNA, 16 bp, C. familiaris
gggatccagtcctgca

SEQ ID NO: 323056 - DNA, 16 bp, C. familiaris
gggatccctctcttct

SEQ ID NO: 323057 - DNA, 16 bp, C. familiaris
gggatccctggatggc

SEQ ID NO: 323058 - DNA, 16 bp, C. familiaris
gggatccctgggtggc

SEQ ID NO: 323059 - DNA, 16 bp, C. familiaris
gggatcctgacctgaa

SEQ ID NO: 323060 - DNA, 16 bp, C. familiaris
gggatctgggatctgg

SEQ ID NO: 323061 - DNA, 16 bp, C. familiaris
gggatgaggactgggt

SEQ ID NO: 323062 - DNA, 16 bp, C. familiaris
gggatgcagagacaca

SEQ ID NO: 323063 - DNA, 16 bp, C. familiaris
gggatgccggggtggc

SEQ ID NO: 323064 - DNA, 16 bp, C. familiaris
gggatgcctggctggt

SEQ ID NO: 323065 - DNA, 16 bp, C. familiaris
gggatgcctgtgtggc

SEQ ID NO: 323066 - DNA, 16 bp, C. familiaris
gggatggagcccagtg

SEQ ID NO: 323067 - DNA, 16 bp, C. familiaris
gggatggagccccctg

SEQ ID NO: 323068 - DNA, 16 bp, C. familiaris
gggatggagcctggtg

SEQ ID NO: 323069 - DNA, 16 bp, C. familiaris
gggatggagtcctggg

SEQ ID NO: 323070 - DNA, 16 bp, C. familiaris
gggatggagtcctgta

SEQ ID NO: 323071 - DNA, 16 bp, C. familiaris
gggatggccccgagaa

SEQ ID NO: 323072 - DNA, 16 bp, C. familiaris
gggatgggagaaaata

SEQ ID NO: 323073 - DNA, 16 bp, C. familiaris
gggatgggggtgactg

SEQ ID NO: 323074 - DNA, 16 bp, C. familiaris
gggatggggtagctgg

SEQ ID NO: 323075 - DNA, 16 bp, C. familiaris
gggatggggtgcctgg

SEQ ID NO: 323076 - DNA, 16 bp, C. familiaris
gggattcgaccccagg

SEQ ID NO: 323077 - DNA, 16 bp, C. familiaris
gggattctccctccct

SEQ ID NO: 323078 - DNA, 16 bp, C. familiaris
gggattgagccccttg

SEQ ID NO: 323079 - DNA, 16 bp, C. familiaris
gggattttgcagatgt

SEQ ID NO: 323080 - DNA, 17 bp, C. familiaris
gggcaagacggcggaag

SEQ ID NO: 323081 - DNA, 16 bp, C. familiaris
gggcaagatcctgggg

SEQ ID NO: 323082 - DNA, 16 bp, C. familiaris
gggcaagatggcagag

SEQ ID NO: 323083 - DNA, 16 bp, C. familiaris
gggcaaggagtctgct

SEQ ID NO: 323084 - DNA, 16 bp, C. familiaris
gggcaccaaggtggct

SEQ ID NO: 323085 - DNA, 16 bp, C. familiaris
gggcacccaggcccca

SEQ ID NO: 323086 - DNA, 16 bp, C. familiaris
gggcaccctggtggct

SEQ ID NO: 323087 - DNA, 16 bp, C. familiaris
gggcaccgaggctcct

SEQ ID NO: 323088 - DNA, 16 bp, C. familiaris
gggcacctgggcggct

SEQ ID NO: 323089 - DNA, 16 bp, C. familiaris
gggcactgagatgggc

SEQ ID NO: 323090 - DNA, 16 bp, C. familiaris
gggcactgaggagggc

SEQ ID NO: 323091 - DNA, 16 bp, C. familiaris
gggcactgagggggca

SEQ ID NO: 323092 - DNA, 16 bp, C. familiaris
gggcactgagtggggc

SEQ ID NO: 323093 - DNA, 16 bp, C. familiaris
gggcagaggcagaggc

SEQ ID NO: 323094 - DNA, 16 bp, C. familiaris
gggcagcagcagcagc

SEQ ID NO: 323095 - DNA, 16 bp, C. familiaris
gggcagccacatgcag

SEQ ID NO: 323096 - DNA, 16 bp, C. familiaris
gggcagcccaggtggc

SEQ ID NO: 323097 - DNA, 16 bp, C. familiaris
gggcagcccagttggc

SEQ ID NO: 323098 - DNA, 16 bp, C. familiaris
gggcagccccaggtgg

SEQ ID NO: 323099 - DNA, 16 bp, C. familiaris
gggcagccccggtgac

SEQ ID NO: 323100 - DNA, 16 bp, C. familiaris
gggcagccccggtggc

SEQ ID NO: 323101 - DNA, 16 bp, C. familiaris
gggcagccccgtggct

SEQ ID NO: 323102 - DNA, 16 bp, C. familiaris
gggcagcccgatgtgg

SEQ ID NO: 323103 - DNA, 16 bp, C. familiaris
gggcagcccggatggc

SEQ ID NO: 323104 - DNA, 16 bp, C. familiaris
gggcagcccggtggct

SEQ ID NO: 323105 - DNA, 16 bp, C. familiaris
gggcagccgggatggc

SEQ ID NO: 323106 - DNA, 16 bp, C. familiaris
gggcagcctcagtggc

SEQ ID NO: 323107 - DNA, 16 bp, C. familiaris
gggcagcctgatgtgg

SEQ ID NO: 323108 - DNA, 16 bp, C. familiaris
gggcagcctgggcagc

SEQ ID NO: 323109 - DNA, 16 bp, C. familiaris
gggcagcctgggtggc

SEQ ID NO: 323110 - DNA, 16 bp, C. familiaris
gggcagcctggtggct

SEQ ID NO: 323111 - DNA, 16 bp, C. familiaris
gggcagctcagctggt

SEQ ID NO: 323112 - DNA, 16 bp, C. familiaris
gggcagctccagtggc

SEQ ID NO: 323113 - DNA, 16 bp, C. familiaris
gggcagctcctccagg

SEQ ID NO: 323114 - DNA, 16 bp, C. familiaris
gggcagctctggtggc

SEQ ID NO: 323115 - DNA, 16 bp, C. familiaris
gggcaggagctggggc

SEQ ID NO: 323116 - DNA, 16 bp, C. familiaris
gggcaggcctgggggc

SEQ ID NO: 323117 - DNA, 16 bp, C. familiaris
gggcaggctggcaggc

SEQ ID NO: 323118 - DNA, 16 bp, C. familiaris
gggcagggactcccca

SEQ ID NO: 323119 - DNA, 16 bp, C. familiaris
gggcagggcagggctg

SEQ ID NO: 323120 - DNA, 16 bp, C. familiaris
gggcagggccaggctg

SEQ ID NO: 323121 - DNA, 16 bp, C. familiaris
gggcagggccctgggc

SEQ ID NO: 323122 - DNA, 16 bp, C. familiaris
gggcagggcctgggag

SEQ ID NO: 323123 - DNA, 16 bp, C. familiaris
gggcagggctgtgtct

SEQ ID NO: 323124 - DNA, 16 bp, C. familiaris
gggcaggggcagcccc

SEQ ID NO: 323125 - DNA, 16 bp, C. familiaris
gggcaggggcaggtgc

SEQ ID NO: 323126 - DNA, 16 bp, C. familiaris
gggcaggtgcaggtgc

SEQ ID NO: 323127 - DNA, 16 bp, C. familiaris
gggcaggtgggcaggc

SEQ ID NO: 323128 - DNA, 16 bp, C. familiaris
gggcagtcccagtggc

SEQ ID NO: 323129 - DNA, 16 bp, C. familiaris
gggcagtggagccccc

SEQ ID NO: 323130 - DNA, 16 bp, C. familiaris
gggcagtggcagaggg

SEQ ID NO: 323131 - DNA, 16 bp, C. familiaris
gggcatcaaggagggc

SEQ ID NO: 323132 - DNA, 16 bp, C. familiaris
gggcatcatcctggag

SEQ ID NO: 323133 - DNA, 16 bp, C. familiaris
gggcatccctgtcgtg

SEQ ID NO: 323134 - DNA, 16 bp, C. familiaris
gggcatctgcttctcc

SEQ ID NO: 323135 - DNA, 16 bp, C. familiaris
gggcatctggatgact

SEQ ID NO: 323136 - DNA, 16 bp, C. familiaris
gggcatgagcctggag

SEQ ID NO: 323137 - DNA, 16 bp, C. familiaris
gggcatggtgcctgct

SEQ ID NO: 323138 - DNA, 16 bp, C. familiaris
gggccaaagaagaaat

SEQ ID NO: 323139 - DNA, 16 bp, C. familiaris
gggccaccggggctgc

SEQ ID NO: 323140 - DNA, 16 bp, C. familiaris
gggccacctggggggc

SEQ ID NO: 323141 - DNA, 16 bp, C. familiaris
gggccacgggggctgc

SEQ ID NO: 323142 - DNA, 16 bp, C. familiaris
gggccagaggcagagg

SEQ ID NO: 323143 - DNA, 16 bp, C. familiaris
gggccagagggcagag

SEQ ID NO: 323144 - DNA, 16 bp, C. familiaris
gggccagatggcttca

SEQ ID NO: 323145 - DNA, 16 bp, C. familiaris
gggccagatttggccc

SEQ ID NO: 323146 - DNA, 16 bp, C. familiaris
gggccaggagccaagg

SEQ ID NO: 323147 - DNA, 16 bp, C. familiaris
gggccaggcccagggc

SEQ ID NO: 323148 - DNA, 16 bp, C. familiaris
gggccaggccctgggg

SEQ ID NO: 323149 - DNA, 16 bp, C. familiaris
gggccagggatgctgc

SEQ ID NO: 323150 - DNA, 16 bp, C. familiaris
gggccagggccaggcc

SEQ ID NO: 323151 - DNA, 16 bp, C. familiaris
gggccagggcctgggc

SEQ ID NO: 323152 - DNA, 16 bp, C. familiaris
gggccatgggattgag

SEQ ID NO: 323153 - DNA, 16 bp, C. familiaris
gggcccaaggcaggtg

SEQ ID NO: 323154 - DNA, 16 bp, C. familiaris
gggcccagagcagagg

SEQ ID NO: 323155 - DNA, 16 bp, C. familiaris
gggcccaggaggccac

SEQ ID NO: 323156 - DNA, 16 bp, C. familiaris
gggcccagggctgggc

SEQ ID NO: 323157 - DNA, 16 bp, C. familiaris
gggcccatcccaggac

SEQ ID NO: 323158 - DNA, 16 bp, C. familiaris
gggccccaacattgac

SEQ ID NO: 323159 - DNA, 16 bp, C. familiaris
gggccccacactcagc

SEQ ID NO: 323160 - DNA, 16 bp, C. familiaris
gggccccaggagcagc

SEQ ID NO: 323161 - DNA, 16 bp, C. familiaris
gggccccaggagcccc

SEQ ID NO: 323162 - DNA, 16 bp, C. familiaris
gggccccaggatggag

SEQ ID NO: 323163 - DNA, 16 bp, C. familiaris
gggccccagggtggct

SEQ ID NO: 323164 - DNA, 16 bp, C. familiaris
gggcccctgggggctc

SEQ ID NO: 323165 - DNA, 16 bp, C. familiaris
gggccctcctggcttc

SEQ ID NO: 323166 - DNA, 16 bp, C. familiaris
gggccctgaatatatc

SEQ ID NO: 323167 - DNA, 16 bp, C. familiaris
gggccctgtgctgctg

SEQ ID NO: 323168 - DNA, 17 bp, C. familiaris
gggccggctgccagccc

SEQ ID NO: 323169 - DNA, 16 bp, C. familiaris
gggcctcacctggatc

SEQ ID NO: 323170 - DNA, 16 bp, C. familiaris
gggcctcagttttctt

SEQ ID NO: 323171 - DNA, 16 bp, C. familiaris
gggcctccaggaccac

SEQ ID NO: 323172 - DNA, 16 bp, C. familiaris
gggcctcctcctcctc

SEQ ID NO: 323173 - DNA, 16 bp, C. familiaris
gggcctcctggaggag

SEQ ID NO: 323174 - DNA, 16 bp, C. familiaris
gggcctgatcctggcg

SEQ ID NO: 323175 - DNA, 16 bp, C. familiaris
gggcctgctgctccct

SEQ ID NO: 323176 - DNA, 16 bp, C. familiaris
gggcctgctgtgctgg

SEQ ID NO: 323177 - DNA, 16 bp, C. familiaris
gggcctgcttgggatt

SEQ ID NO: 323178 - DNA, 16 bp, C. familiaris
gggcctggactcctgg

SEQ ID NO: 323179 - DNA, 16 bp, C. familiaris
gggcctggatcccagg

SEQ ID NO: 323180 - DNA, 16 bp, C. familiaris
gggcctggatgctccg

SEQ ID NO: 323181 - DNA, 16 bp, C. familiaris
gggcctggcctggcct

SEQ ID NO: 323182 - DNA, 16 bp, C. familiaris
gggcctgggagctggg

SEQ ID NO: 323183 - DNA, 16 bp, C. familiaris
gggcctgggccagggc

SEQ ID NO: 323184 - DNA, 16 bp, C. familiaris
gggcctgggcctggcc

SEQ ID NO: 323185 - DNA, 16 bp, C. familiaris
gggcctgggctttcct

SEQ ID NO: 323186 - DNA, 16 bp, C. familiaris
gggcctggggcagagg

SEQ ID NO: 323187 - DNA, 16 bp, C. familiaris
gggcctggggctgctg

SEQ ID NO: 323188 - DNA, 16 bp, C. familiaris
gggcctggtcctggag

SEQ ID NO: 323189 - DNA, 16 bp, C. familiaris
gggccttgatcctggg

SEQ ID NO: 323190 - DNA, 16 bp, C. familiaris
gggcgagatcctggag

SEQ ID NO: 323191 - DNA, 18 bp, C. familiaris
gggcgcaggtgtctgtta

SEQ ID NO: 323192 - DNA, 16 bp, C. familiaris
gggcgcctaggtggct

SEQ ID NO: 323193 - DNA, 16 bp, C. familiaris
gggcgcctgatgtggg

SEQ ID NO: 323194 - DNA, 16 bp, C. familiaris
gggcgggatccctggg

SEQ ID NO: 323195 - DNA, 16 bp, C. familiaris
gggcgtggagcctgct

SEQ ID NO: 323196 - DNA, 16 bp, C. familiaris
gggctcaaccccagga

SEQ ID NO: 323197 - DNA, 16 bp, C. familiaris
gggctcaatcctgaga

SEQ ID NO: 323198 - DNA, 16 bp, C. familiaris
gggctcagggcagccc

SEQ ID NO: 323199 - DNA, 16 bp, C. familiaris
gggctccacgttcagc

SEQ ID NO: 323200 - DNA, 16 bp, C. familiaris
gggctccaggctcagc

SEQ ID NO: 323201 - DNA, 16 bp, C. familiaris
gggctccatccaggac

SEQ ID NO: 323202 - DNA, 16 bp, C. familiaris
gggctcccagcctgga

SEQ ID NO: 323203 - DNA, 16 bp, C. familiaris
gggctccccacaagaa

SEQ ID NO: 323204 - DNA, 16 bp, C. familiaris
gggctccccaccccca

SEQ ID NO: 323205 - DNA, 16 bp, C. familiaris
gggctccccaccggga

SEQ ID NO: 323206 - DNA, 16 bp, C. familiaris
gggctccccactcagc

SEQ ID NO: 323207 - DNA, 16 bp, C. familiaris
gggctccccattggga

SEQ ID NO: 323208 - DNA, 16 bp, C. familiaris
gggctccccctgggga

SEQ ID NO: 323209 - DNA, 16 bp, C. familiaris
gggctccccgtgagga

SEQ ID NO: 323210 - DNA, 16 bp, C. familiaris
gggctcccggcctgga

SEQ ID NO: 323211 - DNA, 16 bp, C. familiaris
gggctccctccctgca

SEQ ID NO: 323212 - DNA, 16 bp, C. familiaris
gggctccctgcctgtg

SEQ ID NO: 323213 - DNA, 16 bp, C. familiaris
gggctccctgctgagg

SEQ ID NO: 323214 - DNA, 16 bp, C. familiaris
gggctccctgcttctc

SEQ ID NO: 323215 - DNA, 16 bp, C. familiaris
gggctccctggtcagc

SEQ ID NO: 323216 - DNA, 16 bp, C. familiaris
gggctccggggctccg

SEQ ID NO: 323217 - DNA, 16 bp, C. familiaris
gggctcctcacagaga

SEQ ID NO: 323218 - DNA, 16 bp, C. familiaris
gggctcctgcctggct

SEQ ID NO: 323219 - DNA, 16 bp, C. familiaris
gggctcctgggaggct

SEQ ID NO: 323220 - DNA, 16 bp, C. familiaris
gggctcgggcggcagc

SEQ ID NO: 323221 - DNA, 16 bp, C. familiaris
gggctctctgctctgc

SEQ ID NO: 323222 - DNA, 16 bp, C. familiaris
gggctctgcacccagc

SEQ ID NO: 323223 - DNA, 16 bp, C. familiaris
gggctctggctcccag

SEQ ID NO: 323224 - DNA, 16 bp, C. familiaris
gggctctgtgctgggc

SEQ ID NO: 323225 - DNA, 16 bp, C. familiaris
gggctctttgtgggga

SEQ ID NO: 323226 - DNA, 16 bp, C. familiaris
gggctgaaggcagggc

SEQ ID NO: 323227 - DNA, 16 bp, C. familiaris
gggctgaaggtggtgc

SEQ ID NO: 323228 - DNA, 16 bp, C. familiaris
gggctgaatctcatga

SEQ ID NO: 323229 - DNA, 16 bp, C. familiaris
gggctgaggaagaggg

SEQ ID NO: 323230 - DNA, 16 bp, C. familiaris
gggctgaggaggagga

SEQ ID NO: 323231 - DNA, 16 bp, C. familiaris
gggctgaggcagaggg

SEQ ID NO: 323232 - DNA, 16 bp, C. familiaris
gggctgaggccagggc

SEQ ID NO: 323233 - DNA, 16 bp, C. familiaris
gggctgcagagctgcc

SEQ ID NO: 323234 - DNA, 16 bp, C. familiaris
gggctgcagcctgggg

SEQ ID NO: 323235 - DNA, 16 bp, C. familiaris
gggctgcagcgcgggc

SEQ ID NO: 323236 - DNA, 16 bp, C. familiaris
gggctgcagctgcagg

SEQ ID NO: 323237 - DNA, 16 bp, C. familiaris
gggctgcaggcagccc

SEQ ID NO: 323238 - DNA, 16 bp, C. familiaris
gggctgcaggcaggca

SEQ ID NO: 323239 - DNA, 16 bp, C. familiaris
gggctgcaggtggtgc

SEQ ID NO: 323240 - DNA, 16 bp, C. familiaris
gggctgcccaagaatt

SEQ ID NO: 323241 - DNA, 16 bp, C. familiaris
gggctgcccaagagag

SEQ ID NO: 323242 - DNA, 16 bp, C. familiaris
gggctgcccagcactg

SEQ ID NO: 323243 - DNA, 16 bp, C. familiaris
gggctgcccaggactt

SEQ ID NO: 323244 - DNA, 16 bp, C. familiaris
gggctgccccccaccc

SEQ ID NO: 323245 - DNA, 16 bp, C. familiaris
gggctgccctcctgcc

SEQ ID NO: 323246 - DNA, 16 bp, C. familiaris
gggctgccctgagcca

SEQ ID NO: 323247 - DNA, 16 bp, C. familiaris
gggctgccctggtggc

SEQ ID NO: 323248 - DNA, 16 bp, C. familiaris
gggctgccctgttttt

SEQ ID NO: 323249 - DNA, 16 bp, C. familiaris
gggctgcccttttctt

SEQ ID NO: 323250 - DNA, 16 bp, C. familiaris
gggctgcctggaggag

SEQ ID NO: 323251 - DNA, 16 bp, C. familiaris
gggctgcctggctggc

SEQ ID NO: 323252 - DNA, 16 bp, C. familiaris
gggctgctggagggga

SEQ ID NO: 323253 - DNA, 16 bp, C. familiaris
gggctgctgggtggct

SEQ ID NO: 323254 - DNA, 16 bp, C. familiaris
gggctgcttctccctc

SEQ ID NO: 323255 - DNA, 16 bp, C. familiaris
gggctggagcccagga

SEQ ID NO: 323256 - DNA, 16 bp, C. familiaris
gggctggaggcagatg

SEQ ID NO: 323257 - DNA, 16 bp, C. familiaris
gggctggaggcggcgc

SEQ ID NO: 323258 - DNA, 16 bp, C. familiaris
gggctgggcagggctg

SEQ ID NO: 323259 - DNA, 16 bp, C. familiaris
gggctgggcatggagc

SEQ ID NO: 323260 - DNA, 16 bp, C. familiaris
gggctgggctccctgc

SEQ ID NO: 323261 - DNA, 16 bp, C. familiaris
gggctggggagcagag

SEQ ID NO: 323262 - DNA, 16 bp, C. familiaris
gggctggggcccaggc

SEQ ID NO: 323263 - DNA, 16 bp, C. familiaris
gggctgggggcagaca

SEQ ID NO: 323264 - DNA, 16 bp, C. familiaris
gggctgtgatctcagg

SEQ ID NO: 323265 - DNA, 16 bp, C. familiaris
gggcttcatcccatga

SEQ ID NO: 323266 - DNA, 16 bp, C. familiaris
gggcttccagctcagc

SEQ ID NO: 323267 - DNA, 16 bp, C. familiaris
gggcttcccagaggag

SEQ ID NO: 323268 - DNA, 16 bp, C. familiaris
gggcttcctgcttctc

SEQ ID NO: 323269 - DNA, 16 bp, C. familiaris
gggcttcctggaggaa

SEQ ID NO: 323270 - DNA, 16 bp, C. familiaris
ggggaaacacaaacat

SEQ ID NO: 323271 - DNA, 16 bp, C. familiaris
ggggaaactgaggctg

SEQ ID NO: 323272 - DNA, 16 bp, C. familiaris
ggggaacctgatgtgg

SEQ ID NO: 323273 - DNA, 16 bp, C. familiaris
ggggaagatggcagag

SEQ ID NO: 323274 - DNA, 16 bp, C. familiaris
ggggacactgggtggc

SEQ ID NO: 323275 - DNA, 16 bp, C. familiaris
ggggacctccaggagg

SEQ ID NO: 323276 - DNA, 16 bp, C. familiaris
ggggacctggatggct

SEQ ID NO: 323277 - DNA, 16 bp, C. familiaris
ggggactccaagatca

SEQ ID NO: 323278 - DNA, 16 bp, C. familiaris
ggggagaagcagggtc

SEQ ID NO: 323279 - DNA, 16 bp, C. familiaris
ggggagaagccggtgg

SEQ ID NO: 323280 - DNA, 16 bp, C. familiaris
ggggagcagagccagg

SEQ ID NO: 323281 - DNA, 16 bp, C. familiaris
ggggagcccaacctgg

SEQ ID NO: 323282 - DNA, 16 bp, C. familiaris
ggggagcccaatgtgg

SEQ ID NO: 323283 - DNA, 16 bp, C. familiaris
ggggagccccacatgg

SEQ ID NO: 323284 - DNA, 16 bp, C. familiaris
ggggagccccatgtgg

SEQ ID NO: 323285 - DNA, 19 bp, C. familiaris
ggggagcccgagggcatcc

SEQ ID NO: 323286 - DNA, 16 bp, C. familiaris
ggggagcctgaggtgg

SEQ ID NO: 323287 - DNA, 16 bp, C. familiaris
ggggagcctgatgcag

SEQ ID NO: 323288 - DNA, 16 bp, C. familiaris
ggggagctggagcagg

SEQ ID NO: 323289 - DNA, 16 bp, C. familiaris
ggggaggcaggctccc

SEQ ID NO: 323290 - DNA, 16 bp, C. familiaris
ggggagggagccctga

SEQ ID NO: 323291 - DNA, 16 bp, C. familiaris
ggggagtggcagaagg

SEQ ID NO: 323292 - DNA, 16 bp, C. familiaris
ggggatgagcactggg

SEQ ID NO: 323293 - DNA, 16 bp, C. familiaris
ggggattcccaggtgg

SEQ ID NO: 323294 - DNA, 16 bp, C. familiaris
ggggattttctttttt

SEQ ID NO: 323295 - DNA, 16 bp, C. familiaris
ggggcacacagtgggg

SEQ ID NO: 323296 - DNA, 16 bp, C. familiaris
ggggcacatgggtggc

SEQ ID NO: 323297 - DNA, 16 bp, C. familiaris
ggggcaccaaggtggc

SEQ ID NO: 323298 - DNA, 16 bp, C. familiaris
ggggcaccctggtggc

SEQ ID NO: 323299 - DNA, 16 bp, C. familiaris
ggggcacctcggtggc

SEQ ID NO: 323300 - DNA, 16 bp, C. familiaris
ggggcacctgcatccc

SEQ ID NO: 323301 - DNA, 16 bp, C. familiaris
ggggcacctggctcag

SEQ ID NO: 323302 - DNA, 16 bp, C. familiaris
ggggcacctgggggct

SEQ ID NO: 323303 - DNA, 16 bp, C. familiaris
ggggcacctggggtgg

SEQ ID NO: 323304 - DNA, 16 bp, C. familiaris
ggggcagagacactgg

SEQ ID NO: 323305 - DNA, 16 bp, C. familiaris
ggggcagagccaggcc

SEQ ID NO: 323306 - DNA, 16 bp, C. familiaris
ggggcagcagcagagg

SEQ ID NO: 323307 - DNA, 16 bp, C. familiaris
ggggcagcccgtgtgg

SEQ ID NO: 323308 - DNA, 16 bp, C. familiaris
ggggcagccctgatgg

SEQ ID NO: 323309 - DNA, 16 bp, C. familiaris
ggggcagctggatggc

SEQ ID NO: 323310 - DNA, 16 bp, C. familiaris
ggggcagctggtggct

SEQ ID NO: 323311 - DNA, 16 bp, C. familiaris
ggggcaggagcgtcct

SEQ ID NO: 323312 - DNA, 16 bp, C. familiaris
ggggcaggcagagaca

SEQ ID NO: 323313 - DNA, 16 bp, C. familiaris
ggggcagggctctggg

SEQ ID NO: 323314 - DNA, 16 bp, C. familiaris
ggggcaggggcttcct

SEQ ID NO: 323315 - DNA, 16 bp, C. familiaris
ggggcaggtggcagag

SEQ ID NO: 323316 - DNA, 16 bp, C. familiaris
ggggcagtctgggtgg

SEQ ID NO: 323317 - DNA, 16 bp, C. familiaris
ggggcagtggagcccc

SEQ ID NO: 323318 - DNA, 16 bp, C. familiaris
ggggcagtggggagca

SEQ ID NO: 323319 - DNA, 16 bp, C. familiaris
ggggcatccgggtggc

SEQ ID NO: 323320 - DNA, 16 bp, C. familiaris
ggggcatctggctggc

SEQ ID NO: 323321 - DNA, 16 bp, C. familiaris
ggggcatgaccctgga

SEQ ID NO: 323322 - DNA, 16 bp, C. familiaris
ggggccagcttctccc

SEQ ID NO: 323323 - DNA, 16 bp, C. familiaris
ggggccagggatgctg

SEQ ID NO: 323324 - DNA, 16 bp, C. familiaris
ggggccaggtggggcc

SEQ ID NO: 323325 - DNA, 16 bp, C. familiaris
ggggcccagcagtctg

SEQ ID NO: 323326 - DNA, 16 bp, C. familiaris
ggggcccagcctgggg

SEQ ID NO: 323327 - DNA, 16 bp, C. familiaris
ggggcccagggcagcc

SEQ ID NO: 323328 - DNA, 16 bp, C. familiaris
ggggcccagggcccag

SEQ ID NO: 323329 - DNA, 16 bp, C. familiaris
ggggccctgcttctcc

SEQ ID NO: 323330 - DNA, 16 bp, C. familiaris
ggggccctggctggct

SEQ ID NO: 323331 - DNA, 16 bp, C. familiaris
ggggccctgggcagcc

SEQ ID NO: 323332 - DNA, 16 bp, C. familiaris
ggggccctgggtggct

SEQ ID NO: 323333 - DNA, 16 bp, C. familiaris
ggggcccttgggtggc

SEQ ID NO: 323334 - DNA, 16 bp, C. familiaris
ggggcctcccccactg

SEQ ID NO: 323335 - DNA, 16 bp, C. familiaris
ggggcctcggggagaa

SEQ ID NO: 323336 - DNA, 16 bp, C. familiaris
ggggcctgcaggaggc

SEQ ID NO: 323337 - DNA, 16 bp, C. familiaris
ggggcctgcgaggagc

SEQ ID NO: 323338 - DNA, 16 bp, C. familiaris
ggggcctgctgggctg

SEQ ID NO: 323339 - DNA, 16 bp, C. familiaris
ggggcctggctctggg

SEQ ID NO: 323340 - DNA, 16 bp, C. familiaris
ggggcctggggcctga

SEQ ID NO: 323341 - DNA, 16 bp, C. familiaris
ggggccttcttctccc

SEQ ID NO: 323342 - DNA, 16 bp, C. familiaris
ggggcgccagggtggc

SEQ ID NO: 323343 - DNA, 16 bp, C. familiaris
ggggcgcctggggagc

SEQ ID NO: 323344 - DNA, 16 bp, C. familiaris
ggggcgtctgcttctc

SEQ ID NO: 323345 - DNA, 16 bp, C. familiaris
ggggctcaaaatcaca

SEQ ID NO: 323346 - DNA, 16 bp, C. familiaris
ggggctcagcagggag

SEQ ID NO: 323347 - DNA, 16 bp, C. familiaris
ggggctcagccccagg

SEQ ID NO: 323348 - DNA, 16 bp, C. familiaris
ggggctcagggcaggg

SEQ ID NO: 323349 - DNA, 16 bp, C. familiaris
ggggctcagggcctgg

SEQ ID NO: 323350 - DNA, 16 bp, C. familiaris
ggggctcccactggcc

SEQ ID NO: 323351 - DNA, 16 bp, C. familiaris
ggggctcccagggagg

SEQ ID NO: 323352 - DNA, 16 bp, C. familiaris
ggggctccctcctcag

SEQ ID NO: 323353 - DNA, 16 bp, C. familiaris
ggggctccctgagggc

SEQ ID NO: 323354 - DNA, 16 bp, C. familiaris
ggggctccctgctctg

SEQ ID NO: 323355 - DNA, 16 bp, C. familiaris
ggggctcctccccctt

SEQ ID NO: 323356 - DNA, 16 bp, C. familiaris
ggggctcctgctcagc

SEQ ID NO: 323357 - DNA, 16 bp, C. familiaris
ggggctcctgggggct

SEQ ID NO: 323358 - DNA, 16 bp, C. familiaris
ggggctcgatttcatg

SEQ ID NO: 323359 - DNA, 16 bp, C. familiaris
ggggctgagcagctcc

SEQ ID NO: 323360 - DNA, 16 bp, C. familiaris
ggggctgaggaagagg

SEQ ID NO: 323361 - DNA, 16 bp, C. familiaris
ggggctgcaggcggcg

SEQ ID NO: 323362 - DNA, 16 bp, C. familiaris
ggggctgcccagaaac

SEQ ID NO: 323363 - DNA, 16 bp, C. familiaris
ggggctgcccagaaca

SEQ ID NO: 323364 - DNA, 16 bp, C. familiaris
ggggctgcccagggcc

SEQ ID NO: 323365 - DNA, 16 bp, C. familiaris
ggggctgccctcccct

SEQ ID NO: 323366 - DNA, 16 bp, C. familiaris
ggggctgccctcctcc

SEQ ID NO: 323367 - DNA, 16 bp, C. familiaris
ggggctgccctctcct

SEQ ID NO: 323368 - DNA, 16 bp, C. familiaris
ggggctgccctgggga

SEQ ID NO: 323369 - DNA, 16 bp, C. familiaris
ggggctgccttcagct

SEQ ID NO: 323370 - DNA, 16 bp, C. familiaris
ggggctggacacaggg

SEQ ID NO: 323371 - DNA, 16 bp, C. familiaris
ggggctggagcaggtg

SEQ ID NO: 323372 - DNA, 16 bp, C. familiaris
ggggctggagcccagg

SEQ ID NO: 323373 - DNA, 16 bp, C. familiaris
ggggctggagctggag

SEQ ID NO: 323374 - DNA, 16 bp, C. familiaris
ggggctgggcctggga

SEQ ID NO: 323375 - DNA, 16 bp, C. familiaris
ggggctggggacccgg

SEQ ID NO: 323376 - DNA, 16 bp, C. familiaris
ggggctggggcagaga

SEQ ID NO: 323377 - DNA, 16 bp, C. familiaris
ggggctgggggtgact

SEQ ID NO: 323378 - DNA, 16 bp, C. familiaris
ggggctttggggaggt

SEQ ID NO: 323379 - DNA, 16 bp, C. familiaris
gggggaaaaaaacctt

SEQ ID NO: 323380 - DNA, 16 bp, C. familiaris
gggggaaaaaagccaa

SEQ ID NO: 323381 - DNA, 16 bp, C. familiaris
gggggaaccctgggtg

SEQ ID NO: 323382 - DNA, 16 bp, C. familiaris
gggggaacttgatggg

SEQ ID NO: 323383 - DNA, 16 bp, C. familiaris
gggggacacagcccag

SEQ ID NO: 323384 - DNA, 16 bp, C. familiaris
gggggaccctgggtgg

SEQ ID NO: 323385 - DNA, 16 bp, C. familiaris
gggggagaaggaggct

SEQ ID NO: 323386 - DNA, 16 bp, C. familiaris
gggggagatttttttt

SEQ ID NO: 323387 - DNA, 16 bp, C. familiaris
gggggaggggcccctg

SEQ ID NO: 323388 - DNA, 16 bp, C. familiaris
gggggatcccctgggt

SEQ ID NO: 323389 - DNA, 16 bp, C. familiaris
gggggcacctgcgtgg

SEQ ID NO: 323390 - DNA, 16 bp, C. familiaris
gggggcacctgggtgg

SEQ ID NO: 323391 - DNA, 16 bp, C. familiaris
gggggcacctgtgtgg

SEQ ID NO: 323392 - DNA, 16 bp, C. familiaris
gggggcagctccggtg

SEQ ID NO: 323393 - DNA, 16 bp, C. familiaris
gggggcctgagtggct

SEQ ID NO: 323394 - DNA, 16 bp, C. familiaris
gggggcctgcttctcc

SEQ ID NO: 323395 - DNA, 16 bp, C. familiaris
gggggcctgggtagct

SEQ ID NO: 323396 - DNA, 16 bp, C. familiaris
gggggctccaaggggg

SEQ ID NO: 323397 - DNA, 16 bp, C. familiaris
gggggctcctgagtgg

SEQ ID NO: 323398 - DNA, 16 bp, C. familiaris
gggggctgagcagctc

SEQ ID NO: 323399 - DNA, 16 bp, C. familiaris
gggggctgcgccctgc

SEQ ID NO: 323400 - DNA, 16 bp, C. familiaris
ggggggcccgatgtgg

SEQ ID NO: 323401 - DNA, 16 bp, C. familiaris
ggggggcctggatggc

SEQ ID NO: 323402 - DNA, 16 bp, C. familiaris
gggggtcctggggtcc

SEQ ID NO: 323403 - DNA, 16 bp, C. familiaris
gggggtctgcttctcc

SEQ ID NO: 323404 - DNA, 16 bp, C. familiaris
gggggtgggggacaca

SEQ ID NO: 323405 - DNA, 16 bp, C. familiaris
gggggtggtgcagaga

SEQ ID NO: 323406 - DNA, 16 bp, C. familiaris
ggggtacatgtacccc

SEQ ID NO: 323407 - DNA, 16 bp, C. familiaris
ggggtacctgggcagc

SEQ ID NO: 323408 - DNA, 16 bp, C. familiaris
ggggtacctggggggc

SEQ ID NO: 323409 - DNA, 16 bp, C. familiaris
ggggtcagagggagaa

SEQ ID NO: 323410 - DNA, 16 bp, C. familiaris
ggggtcatgacctggg

SEQ ID NO: 323411 - DNA, 16 bp, C. familiaris
ggggtcatgagattga

SEQ ID NO: 323412 - DNA, 16 bp, C. familiaris
ggggtccccaggagcc

SEQ ID NO: 323413 - DNA, 16 bp, C. familiaris
ggggtccctgcgggga

SEQ ID NO: 323414 - DNA, 16 bp, C. familiaris
ggggtcctgagatcca

SEQ ID NO: 323415 - DNA, 16 bp, C. familiaris
ggggtcctgcaggagg

SEQ ID NO: 323416 - DNA, 16 bp, C. familiaris
ggggtcctgggaccaa

SEQ ID NO: 323417 - DNA, 16 bp, C. familiaris
ggggtctatttctggg

SEQ ID NO: 323418 - DNA, 16 bp, C. familiaris
ggggtctgcttcttcc

SEQ ID NO: 323419 - DNA, 16 bp, C. familiaris
ggggtgactgggtgac

SEQ ID NO: 323420 - DNA, 16 bp, C. familiaris
ggggtgcaggggtccc

SEQ ID NO: 323421 - DNA, 16 bp, C. familiaris
ggggtgcaggtggccc

SEQ ID NO: 323422 - DNA, 16 bp, C. familiaris
ggggtgcagttgtccc

SEQ ID NO: 323423 - DNA, 16 bp, C. familiaris
ggggtgcctggaaggc

SEQ ID NO: 323424 - DNA, 16 bp, C. familiaris
ggggtgctggtgtccc

SEQ ID NO: 323425 - DNA, 16 bp, C. familiaris
ggggtggaatcttttg

SEQ ID NO: 323426 - DNA, 16 bp, C. familiaris
ggggtggagcctactt

SEQ ID NO: 323427 - DNA, 16 bp, C. familiaris
ggggtggggcccaggc

SEQ ID NO: 323428 - DNA, 16 bp, C. familiaris
ggggtggggggcacct

SEQ ID NO: 323429 - DNA, 16 bp, C. familiaris
ggggtgtgatcctgga

SEQ ID NO: 323430 - DNA, 16 bp, C. familiaris
ggggtgtggtcctgga

SEQ ID NO: 323431 - DNA, 16 bp, C. familiaris
ggggttcagagagctt

SEQ ID NO: 323432 - DNA, 16 bp, C. familiaris
gggtaaactgaggcag

SEQ ID NO: 323433 - DNA, 16 bp, C. familiaris
gggtcaccaggatcac

SEQ ID NO: 323434 - DNA, 16 bp, C. familiaris
gggtcagaggaagaag

SEQ ID NO: 323435 - DNA, 16 bp, C. familiaris
gggtcagaggaagaga

SEQ ID NO: 323436 - DNA, 16 bp, C. familiaris
gggtcaggggatcaag

SEQ ID NO: 323437 - DNA, 16 bp, C. familiaris
gggtcatgccttgggc

SEQ ID NO: 323438 - DNA, 16 bp, C. familiaris
gggtccagggatcgag

SEQ ID NO: 323439 - DNA, 16 bp, C. familiaris
gggtcccctccctcct

SEQ ID NO: 323440 - DNA, 16 bp, C. familiaris
gggtcccgagattgag

SEQ ID NO: 323441 - DNA, 16 bp, C. familiaris
gggtcccgggaccgag

SEQ ID NO: 323442 - DNA, 16 bp, C. familiaris
gggtccctgagactct

SEQ ID NO: 323443 - DNA, 16 bp, C. familiaris
gggtccctgcctctct

SEQ ID NO: 323444 - DNA, 16 bp, C. familiaris
gggtccctgctcagca

SEQ ID NO: 323445 - DNA, 16 bp, C. familiaris
gggtccctggatcgag

SEQ ID NO: 323446 - DNA, 16 bp, C. familiaris
gggtccctggatggct

SEQ ID NO: 323447 - DNA, 17 bp, C. familiaris
gggtccctgggtggcgc

SEQ ID NO: 323448 - DNA, 16 bp, C. familiaris
gggtccctgtgtggct

SEQ ID NO: 323449 - DNA, 16 bp, C. familiaris
gggtcctacatgagaa

SEQ ID NO: 323450 - DNA, 16 bp, C. familiaris
gggtcctctgctcagg

SEQ ID NO: 323451 - DNA, 16 bp, C. familiaris
gggtcctgagaccaag

SEQ ID NO: 323452 - DNA, 16 bp, C. familiaris
gggtcctgagatcagg

SEQ ID NO: 323453 - DNA, 16 bp, C. familiaris
gggtcctgggctcgag

SEQ ID NO: 323454 - DNA, 16 bp, C. familiaris
gggtcctggggctgag

SEQ ID NO: 323455 - DNA, 16 bp, C. familiaris
gggtcctgtccccgtg

SEQ ID NO: 323456 - DNA, 16 bp, C. familiaris
gggtctccaggatcag

SEQ ID NO: 323457 - DNA, 16 bp, C. familiaris
gggtctccaggatgag

SEQ ID NO: 323458 - DNA, 16 bp, C. familiaris
gggtctccaggttcgc

SEQ ID NO: 323459 - DNA, 16 bp, C. familiaris
gggtctcccggatcgc

SEQ ID NO: 323460 - DNA, 16 bp, C. familiaris
gggtctcctggatcgc

SEQ ID NO: 323461 - DNA, 16 bp, C. familiaris
gggtctggggatccag

SEQ ID NO: 323462 - DNA, 16 bp, C. familiaris
gggtctgttcaagttt

SEQ ID NO: 323463 - DNA, 16 bp, C. familiaris
gggtctgtttctgctt

SEQ ID NO: 323464 - DNA, 16 bp, C. familiaris
gggtcttgctttttca

SEQ ID NO: 323465 - DNA, 16 bp, C. familiaris
gggtcttgggatagag

SEQ ID NO: 323466 - DNA, 16 bp, C. familiaris
gggtcttttgcttctc

SEQ ID NO: 323467 - DNA, 16 bp, C. familiaris
gggtgaaacagataaa

SEQ ID NO: 323468 - DNA, 16 bp, C. familiaris
gggtgaagagcagagg

SEQ ID NO: 323469 - DNA, 16 bp, C. familiaris
gggtgaaggagaagca

SEQ ID NO: 323470 - DNA, 16 bp, C. familiaris
gggtgaaggtggtcaa

SEQ ID NO: 323471 - DNA, 16 bp, C. familiaris
gggtgactcagctggt

SEQ ID NO: 323472 - DNA, 16 bp, C. familiaris
gggtgcagagctgggg

SEQ ID NO: 323473 - DNA, 16 bp, C. familiaris
gggtgccaggctggct

SEQ ID NO: 323474 - DNA, 16 bp, C. familiaris
gggtgcctgcttctcc

SEQ ID NO: 323475 - DNA, 16 bp, C. familiaris
gggtgcctgggtatct

SEQ ID NO: 323476 - DNA, 16 bp, C. familiaris
gggtgctgagattgag

SEQ ID NO: 323477 - DNA, 16 bp, C. familiaris
gggtggaagaatttct

SEQ ID NO: 323478 - DNA, 16 bp, C. familiaris
gggtggcagagagaga

SEQ ID NO: 323479 - DNA, 16 bp, C. familiaris
gggtggctcagaagtt

SEQ ID NO: 323480 - DNA, 16 bp, C. familiaris
gggtggctcagcagtt

SEQ ID NO: 323481 - DNA, 16 bp, C. familiaris
gggtggctcagcgatt

SEQ ID NO: 323482 - DNA, 16 bp, C. familiaris
gggtggctcagtggtt

SEQ ID NO: 323483 - DNA, 16 bp, C. familiaris
gggtggctcagttgct

SEQ ID NO: 323484 - DNA, 16 bp, C. familiaris
gggtggcttactggtt

SEQ ID NO: 323485 - DNA, 16 bp, C. familiaris
gggtgggcagagacac

SEQ ID NO: 323486 - DNA, 16 bp, C. familiaris
gggtggggagaagcag

SEQ ID NO: 323487 - DNA, 16 bp, C. familiaris
gggtgggggtcactgg

SEQ ID NO: 323488 - DNA, 16 bp, C. familiaris
gggtggtgcagtcggt

SEQ ID NO: 323489 - DNA, 16 bp, C. familiaris
gggtgtccaggtggct

SEQ ID NO: 323490 - DNA, 16 bp, C. familiaris
gggtgtgatcctgagt

SEQ ID NO: 323491 - DNA, 16 bp, C. familiaris
gggtgtgatcctgcag

SEQ ID NO: 323492 - DNA, 16 bp, C. familiaris
gggtgtgatcctggag

SEQ ID NO: 323493 - DNA, 16 bp, C. familiaris
gggtgtgggggtgact

SEQ ID NO: 323494 - DNA, 16 bp, C. familiaris
gggtgtggtcctagag

SEQ ID NO: 323495 - DNA, 16 bp, C. familiaris
gggttaggggcactga

SEQ ID NO: 323496 - DNA, 16 bp, C. familiaris
gggttccccttcctcc

SEQ ID NO: 323497 - DNA, 16 bp, C. familiaris
gggttccctgtgggga

SEQ ID NO: 323498 - DNA, 16 bp, C. familiaris
gggttccctttctcca

SEQ ID NO: 323499 - DNA, 16 bp, C. familiaris
gggttcctggctggct

SEQ ID NO: 323500 - DNA, 16 bp, C. familiaris
gggttctgctttttta

SEQ ID NO: 323501 - DNA, 16 bp, C. familiaris
gggttctgggatcgag

SEQ ID NO: 323502 - DNA, 16 bp, C. familiaris
gggttgggatgactgg

SEQ ID NO: 323503 - DNA, 16 bp, C. familiaris
gggttgggctctgtgc

SEQ ID NO: 323504 - DNA, 16 bp, C. familiaris
gggtttcgatcccagg

SEQ ID NO: 323505 - DNA, 16 bp, C. familiaris
gggttttctatataaa

SEQ ID NO: 323506 - DNA, 16 bp, C. familiaris
ggtaaagcatccaact

SEQ ID NO: 323507 - DNA, 16 bp, C. familiaris
ggtaaatacccagaag

SEQ ID NO: 323508 - DNA, 16 bp, C. familiaris
ggtacctggggggctc

SEQ ID NO: 323509 - DNA, 16 bp, C. familiaris
ggtacttcattccttt

SEQ ID NO: 323510 - DNA, 16 bp, C. familiaris
ggtagctcagccagtt

SEQ ID NO: 323511 - DNA, 16 bp, C. familiaris
ggtagggcagccctgg

SEQ ID NO: 323512 - DNA, 16 bp, C. familiaris
ggtagtgaaaagggag

SEQ ID NO: 323513 - DNA, 16 bp, C. familiaris
ggtatatagaaatgca

SEQ ID NO: 323514 - DNA, 16 bp, C. familiaris
ggtatcacctcacact

SEQ ID NO: 323515 - DNA, 16 bp, C. familiaris
ggtatggtgtaagaaa

SEQ ID NO: 323516 - DNA, 16 bp, C. familiaris
ggtattggtctttctc

SEQ ID NO: 323517 - DNA, 16 bp, C. familiaris
ggtatttctattttta

SEQ ID NO: 323518 - DNA, 16 bp, C. familiaris
ggtatttgtcacttct

SEQ ID NO: 323519 - DNA, 16 bp, C. familiaris
ggtcaagaatcacatg

SEQ ID NO: 323520 - DNA, 16 bp, C. familiaris
ggtcaagggatccctg

SEQ ID NO: 323521 - DNA, 16 bp, C. familiaris
ggtcaatttctggggt

SEQ ID NO: 323522 - DNA, 16 bp, C. familiaris
ggtcacaaatcaggcc

SEQ ID NO: 323523 - DNA, 16 bp, C. familiaris
ggtcacacagctggga

SEQ ID NO: 323524 - DNA, 16 bp, C. familiaris
ggtcacagcctgggcc

SEQ ID NO: 323525 - DNA, 16 bp, C. familiaris
ggtcaccagaaagacc

SEQ ID NO: 323526 - DNA, 16 bp, C. familiaris
ggtcagagggagagag

SEQ ID NO: 323527 - DNA, 16 bp, C. familiaris
ggtcatgacctcaggc

SEQ ID NO: 323528 - DNA, 16 bp, C. familiaris
ggtcatgatccaggag

SEQ ID NO: 323529 - DNA, 16 bp, C. familiaris
ggtcatgatccaggat

SEQ ID NO: 323530 - DNA, 16 bp, C. familiaris
ggtcatgatcttgcag

SEQ ID NO: 323531 - DNA, 16 bp, C. familiaris
ggtcatgatcttgcgg

SEQ ID NO: 323532 - DNA, 16 bp, C. familiaris
ggtcatgctctcagag

SEQ ID NO: 323533 - DNA, 16 bp, C. familiaris
ggtcatggtcctggag

SEQ ID NO: 323534 - DNA, 16 bp, C. familiaris
ggtccagaacttgctc

SEQ ID NO: 323535 - DNA, 16 bp, C. familiaris
ggtccagccgtgcgcg

SEQ ID NO: 323536 - DNA, 16 bp, C. familiaris
ggtccaggttcattct

SEQ ID NO: 323537 - DNA, 16 bp, C. familiaris
ggtcccaggactccgg

SEQ ID NO: 323538 - DNA, 16 bp, C. familiaris
ggtcccagggccccag

SEQ ID NO: 323539 - DNA, 16 bp, C. familiaris
ggtcccagtgtcctgg

SEQ ID NO: 323540 - DNA, 16 bp, C. familiaris
ggtccccacagggagc

SEQ ID NO: 323541 - DNA, 16 bp, C. familiaris
ggtcctcaaaacaaag

SEQ ID NO: 323542 - DNA, 16 bp, C. familiaris
ggtcctctgttttgtt

SEQ ID NO: 323543 - DNA, 16 bp, C. familiaris
ggtcctgagatcatga

SEQ ID NO: 323544 - DNA, 16 bp, C. familiaris
ggtcctgcataggatc

SEQ ID NO: 323545 - DNA, 16 bp, C. familiaris
ggtcctggaatcccag

SEQ ID NO: 323546 - DNA, 16 bp, C. familiaris
ggtcctggaggcccgg

SEQ ID NO: 323547 - DNA, 16 bp, C. familiaris
ggtcctggagtccctg

SEQ ID NO: 323548 - DNA, 16 bp, C. familiaris
ggtcctggatccagcc

SEQ ID NO: 323549 - DNA, 16 bp, C. familiaris
ggtcctgggggtcctg

SEQ ID NO: 323550 - DNA, 16 bp, C. familiaris
ggtccttgctcagcag

SEQ ID NO: 323551 - DNA, 16 bp, C. familiaris
ggtcgtgatcctggtg

SEQ ID NO: 323552 - DNA, 16 bp, C. familiaris
ggtctatcctggagaa

SEQ ID NO: 323553 - DNA, 16 bp, C. familiaris
ggtctccagaaccaca

SEQ ID NO: 323554 - DNA, 16 bp, C. familiaris
ggtctccagatcacac

SEQ ID NO: 323555 - DNA, 16 bp, C. familiaris
ggtctcccaggatcgc

SEQ ID NO: 323556 - DNA, 16 bp, C. familiaris
ggtctctgcctctctc

SEQ ID NO: 323557 - DNA, 16 bp, C. familiaris
ggtctctgggatcatg

SEQ ID NO: 323558 - DNA, 16 bp, C. familiaris
ggtctctgtggagatg

SEQ ID NO: 323559 - DNA, 16 bp, C. familiaris
ggtctgaaaatatgga

SEQ ID NO: 323560 - DNA, 16 bp, C. familiaris
ggtctgctcttgataa

SEQ ID NO: 323561 - DNA, 16 bp, C. familiaris
ggtctgtttcctcatc

SEQ ID NO: 323562 - DNA, 16 bp, C. familiaris
ggtcttgaaggatgag

SEQ ID NO: 323563 - DNA, 16 bp, C. familiaris
ggtcttggggttgtga

SEQ ID NO: 323564 - DNA, 16 bp, C. familiaris
ggtgaagaaactgaag

SEQ ID NO: 323565 - DNA, 16 bp, C. familiaris
ggtgaagatggtcaaa

SEQ ID NO: 323566 - DNA, 16 bp, C. familiaris
ggtgaaggatctcaag

SEQ ID NO: 323567 - DNA, 16 bp, C. familiaris
ggtgaaggtgaaggtg

SEQ ID NO: 323568 - DNA, 16 bp, C. familiaris
ggtgacaccaggagga

SEQ ID NO: 323569 - DNA, 16 bp, C. familiaris
ggtgacagaacaggag

SEQ ID NO: 323570 - DNA, 16 bp, C. familiaris
ggtgacaggcactgaa

SEQ ID NO: 323571 - DNA, 16 bp, C. familiaris
ggtgacaggcactgag

SEQ ID NO: 323572 - DNA, 16 bp, C. familiaris
ggtgaccagcactgag

SEQ ID NO: 323573 - DNA, 16 bp, C. familiaris
ggtgagaaaactgagg

SEQ ID NO: 323574 - DNA, 16 bp, C. familiaris
ggtgagaatgggcatc

SEQ ID NO: 323575 - DNA, 16 bp, C. familiaris
ggtgagatggagcctc

SEQ ID NO: 323576 - DNA, 16 bp, C. familiaris
ggtgagcatcttttca

SEQ ID NO: 323577 - DNA, 16 bp, C. familiaris
ggtgagccacccgggc

SEQ ID NO: 323578 - DNA, 16 bp, C. familiaris
ggtgaggaaatggaga

SEQ ID NO: 323579 - DNA, 16 bp, C. familiaris
ggtgaggagactgagg

SEQ ID NO: 323580 - DNA, 16 bp, C. familiaris
ggtgaggagcagagag

SEQ ID NO: 323581 - DNA, 16 bp, C. familiaris
ggtgaggcccaggagg

SEQ ID NO: 323582 - DNA, 16 bp, C. familiaris
ggtgagggacacctgg

SEQ ID NO: 323583 - DNA, 16 bp, C. familiaris
ggtgagggcagaggga

SEQ ID NO: 323584 - DNA, 16 bp, C. familiaris
ggtgagggcagcctgg

SEQ ID NO: 323585 - DNA, 16 bp, C. familiaris
ggtgagtttttccatc

SEQ ID NO: 323586 - DNA, 16 bp, C. familiaris
ggtgatgaactccttt

SEQ ID NO: 323587 - DNA, 16 bp, C. familiaris
ggtgatgctgatgcta

SEQ ID NO: 323588 - DNA, 16 bp, C. familiaris
ggtgatgctggtgctg

SEQ ID NO: 323589 - DNA, 16 bp, C. familiaris
ggtgatgggaatgttc

SEQ ID NO: 323590 - DNA, 16 bp, C. familiaris
ggtgatgggcactgtg

SEQ ID NO: 323591 - DNA, 16 bp, C. familiaris
ggtgatgggcatgaag

SEQ ID NO: 323592 - DNA, 16 bp, C. familiaris
ggtgatgttgatgctg

SEQ ID NO: 323593 - DNA, 16 bp, C. familiaris
ggtgcagagtttcagt

SEQ ID NO: 323594 - DNA, 16 bp, C. familiaris
ggtgcagatgtcctgc

SEQ ID NO: 323595 - DNA, 16 bp, C. familiaris
ggtgcagatgtcctgg

SEQ ID NO: 323596 - DNA, 16 bp, C. familiaris
ggtgcagggtgcaggg

SEQ ID NO: 323597 - DNA, 16 bp, C. familiaris
ggtgcaggtgcgggtg

SEQ ID NO: 323598 - DNA, 16 bp, C. familiaris
ggtgcatatatctttt

SEQ ID NO: 323599 - DNA, 30 bp, C. familiaris
ggtgcccacttaactgtgaaaaagattttt

SEQ ID NO: 323600 - DNA, 16 bp, C. familiaris
ggtgccccaagaattt

SEQ ID NO: 323601 - DNA, 16 bp, C. familiaris
ggtgcccctcattgtg

SEQ ID NO: 323602 - DNA, 16 bp, C. familiaris
ggtgcccctggaattt

SEQ ID NO: 323603 - DNA, 16 bp, C. familiaris
ggtgccctctggaacc

SEQ ID NO: 323604 - DNA, 16 bp, C. familiaris
ggtgcctgaatggctc

SEQ ID NO: 323605 - DNA, 16 bp, C. familiaris
ggtgctacaccactga

SEQ ID NO: 323606 - DNA, 16 bp, C. familiaris
ggtgctcgatcccagg

SEQ ID NO: 323607 - DNA, 16 bp, C. familiaris
ggtgctgctgctgctg

SEQ ID NO: 323608 - DNA, 16 bp, C. familiaris
ggtgctggaacaattg

SEQ ID NO: 323609 - DNA, 16 bp, C. familiaris
ggtgctgggcactgag

SEQ ID NO: 323610 - DNA, 16 bp, C. familiaris
ggtgctggggctgcag

SEQ ID NO: 323611 - DNA, 16 bp, C. familiaris
ggtgctgggggacaca

SEQ ID NO: 323612 - DNA, 16 bp, C. familiaris
ggtgctggtgctgctg

SEQ ID NO: 323613 - DNA, 16 bp, C. familiaris
ggtggaggaagaccga

SEQ ID NO: 323614 - DNA, 16 bp, C. familiaris
ggtggaggagcagagg

SEQ ID NO: 323615 - DNA, 16 bp, C. familiaris
ggtggcagcagcagca

SEQ ID NO: 323616 - DNA, 16 bp, C. familiaris
ggtggcagtggtggca

SEQ ID NO: 323617 - DNA, 16 bp, C. familiaris
ggtggccatctacaag

SEQ ID NO: 323618 - DNA, 16 bp, C. familiaris
ggtggcccagctggtt

SEQ ID NO: 323619 - DNA, 16 bp, C. familiaris
ggtggctcactcggtt

SEQ ID NO: 323620 - DNA, 16 bp, C. familiaris
ggtggctcagaagttg

SEQ ID NO: 323621 - DNA, 16 bp, C. familiaris
ggtggctcagcagatt

SEQ ID NO: 323622 - DNA, 16 bp, C. familiaris
ggtggctcagcagctg

SEQ ID NO: 323623 - DNA, 16 bp, C. familiaris
ggtggctcagccagtg

SEQ ID NO: 323624 - DNA, 16 bp, C. familiaris
ggtggctcaggaggtt

SEQ ID NO: 323625 - DNA, 16 bp, C. familiaris
ggtggctcagggcatg

SEQ ID NO: 323626 - DNA, 16 bp, C. familiaris
ggtggctcaggtcgtg

SEQ ID NO: 323627 - DNA, 16 bp, C. familiaris
ggtggctcaggttgag

SEQ ID NO: 323628 - DNA, 16 bp, C. familiaris
ggtggctcagtggtag

SEQ ID NO: 323629 - DNA, 16 bp, C. familiaris
ggtggctcagtggtga

SEQ ID NO: 323630 - DNA, 16 bp, C. familiaris
ggtggctctgcagttg

SEQ ID NO: 323631 - DNA, 16 bp, C. familiaris
ggtggctctgttagtt

SEQ ID NO: 323632 - DNA, 16 bp, C. familiaris
ggtggctgtggttgag

SEQ ID NO: 323633 - DNA, 17 bp, C. familiaris
ggtgggatctcatcgtg

SEQ ID NO: 323634 - DNA, 16 bp, C. familiaris
ggtgggcagcccaggt

SEQ ID NO: 323635 - DNA, 16 bp, C. familiaris
ggtggggaccaggagg

SEQ ID NO: 323636 - DNA, 16 bp, C. familiaris
ggtggggccaccaggg

SEQ ID NO: 323637 - DNA, 16 bp, C. familiaris
ggtgggggagcagcag

SEQ ID NO: 323638 - DNA, 16 bp, C. familiaris
ggtgggtggatgaatg

SEQ ID NO: 323639 - DNA, 16 bp, C. familiaris
ggtggtgatcctgggg

SEQ ID NO: 323640 - DNA, 16 bp, C. familiaris
ggtggtgatctcatgg

SEQ ID NO: 323641 - DNA, 16 bp, C. familiaris
ggtggtgatgctggtg

SEQ ID NO: 323642 - DNA, 16 bp, C. familiaris
ggtggtgcaggaggca

SEQ ID NO: 323643 - DNA, 16 bp, C. familiaris
ggtggtgctgatgctg

SEQ ID NO: 323644 - DNA, 16 bp, C. familiaris
ggtggtgctgctgctg

SEQ ID NO: 323645 - DNA, 16 bp, C. familiaris
ggtggtgctggcctca

SEQ ID NO: 323646 - DNA, 16 bp, C. familiaris
ggtggtggtgactggg

SEQ ID NO: 323647 - DNA, 16 bp, C. familiaris
ggtggtggtgatgctg

SEQ ID NO: 323648 - DNA, 16 bp, C. familiaris
ggtggtggtggcagtg

SEQ ID NO: 323649 - DNA, 16 bp, C. familiaris
ggtggtggtggtcagg

SEQ ID NO: 323650 - DNA, 16 bp, C. familiaris
ggtggtggtggtgaca

SEQ ID NO: 323651 - DNA, 16 bp, C. familiaris
ggtggtggtggtggca

SEQ ID NO: 323652 - DNA, 16 bp, C. familiaris
ggtggttcagtgggtt

SEQ ID NO: 323653 - DNA, 16 bp, C. familiaris
ggtggttctggctcag

SEQ ID NO: 323654 - DNA, 16 bp, C. familiaris
ggtggtttggcacctg

SEQ ID NO: 323655 - DNA, 16 bp, C. familiaris
ggtgtacaacatggtg

SEQ ID NO: 323656 - DNA, 16 bp, C. familiaris
ggtgtcaccctgtacc

SEQ ID NO: 323657 - DNA, 16 bp, C. familiaris
ggtgtcagcaaggctg

SEQ ID NO: 323658 - DNA, 16 bp, C. familiaris
ggtgtctgactttggc

SEQ ID NO: 323659 - DNA, 16 bp, C. familiaris
ggtgtctgctggagat

SEQ ID NO: 323660 - DNA, 16 bp, C. familiaris
ggtgtctgggtggccc

SEQ ID NO: 323661 - DNA, 16 bp, C. familiaris
ggtgtctgtgcctggg

SEQ ID NO: 323662 - DNA, 16 bp, C. familiaris
ggtgtgatcctgagat

SEQ ID NO: 323663 - DNA, 16 bp, C. familiaris
ggtgtgtccatgggag

SEQ ID NO: 323664 - DNA, 16 bp, C. familiaris
ggtgttaaactatatg

SEQ ID NO: 323665 - DNA, 16 bp, C. familiaris
ggtgttaagtacattc

SEQ ID NO: 323666 - DNA, 16 bp, C. familiaris
ggtgttgccctgtgtt

SEQ ID NO: 323667 - DNA, 16 bp, C. familiaris
ggtgttggcaagaatg

SEQ ID NO: 323668 - DNA, 16 bp, C. familiaris
ggtgttgggaagactg

SEQ ID NO: 323669 - DNA, 16 bp, C. familiaris
ggtgttgggctccatg

SEQ ID NO: 323670 - DNA, 16 bp, C. familiaris
ggtgttggtgaggctg

SEQ ID NO: 323671 - DNA, 16 bp, C. familiaris
ggtgtttctggaagag

SEQ ID NO: 323672 - DNA, 16 bp, C. familiaris
ggtgttttcattttct

SEQ ID NO: 323673 - DNA, 16 bp, C. familiaris
ggttaagggaaataaa

SEQ ID NO: 323674 - DNA, 16 bp, C. familiaris
ggttaatttccaaaat

SEQ ID NO: 323675 - DNA, 16 bp, C. familiaris
ggttaccagaggagaa

SEQ ID NO: 323676 - DNA, 16 bp, C. familiaris
ggttcagatcgtgatc

SEQ ID NO: 323677 - DNA, 16 bp, C. familiaris
ggttcagtgccacctt

SEQ ID NO: 323678 - DNA, 16 bp, C. familiaris
ggttcagtggttgggc

SEQ ID NO: 323679 - DNA, 16 bp, C. familiaris
ggttcatggagcctgc

SEQ ID NO: 323680 - DNA, 16 bp, C. familiaris
ggttccccacaggaag

SEQ ID NO: 323681 - DNA, 16 bp, C. familiaris
ggttcccctgtctcca

SEQ ID NO: 323682 - DNA, 16 bp, C. familiaris
ggttccctactgagca

SEQ ID NO: 323683 - DNA, 16 bp, C. familiaris
ggttccctgcacagag

SEQ ID NO: 323684 - DNA, 16 bp, C. familiaris
ggttccctgcaggaag

SEQ ID NO: 323685 - DNA, 16 bp, C. familiaris
ggttccctggagggag

SEQ ID NO: 323686 - DNA, 16 bp, C. familiaris
ggttcctcaaacaatt

SEQ ID NO: 323687 - DNA, 16 bp, C. familiaris
ggttcctcagaaaatt

SEQ ID NO: 323688 - DNA, 16 bp, C. familiaris
ggttctccagaagcag

SEQ ID NO: 323689 - DNA, 16 bp, C. familiaris
ggttctccaggatcac

SEQ ID NO: 323690 - DNA, 16 bp, C. familiaris
ggttctctccctctcc

SEQ ID NO: 323691 - DNA, 16 bp, C. familiaris
ggttctggaatggagc

SEQ ID NO: 323692 - DNA, 16 bp, C. familiaris
ggttcttggaaagaat

SEQ ID NO: 323693 - DNA, 16 bp, C. familiaris
ggttctttgaaaaaag

SEQ ID NO: 323694 - DNA, 16 bp, C. familiaris
ggttgaactgtgtccc

SEQ ID NO: 323695 - DNA, 16 bp, C. familiaris
ggttgccatggaaaca

SEQ ID NO: 323696 - DNA, 16 bp, C. familiaris
ggttgcctgggtggct

SEQ ID NO: 323697 - DNA, 16 bp, C. familiaris
ggttgcctttccattt

SEQ ID NO: 323698 - DNA, 16 bp, C. familiaris
ggttgtgaggttgagc

SEQ ID NO: 323699 - DNA, 16 bp, C. familiaris
ggttgttttcatcttt

SEQ ID NO: 323700 - DNA, 16 bp, C. familiaris
ggtttagcgtggcctt

SEQ ID NO: 323701 - DNA, 16 bp, C. familiaris
ggtttatcaatttttt

SEQ ID NO: 323702 - DNA, 16 bp, C. familiaris
ggtttatttacaagct

SEQ ID NO: 323703 - DNA, 16 bp, C. familiaris
ggtttcacacctgcct

SEQ ID NO: 323704 - DNA, 16 bp, C. familiaris
ggtttcctgagttctg

SEQ ID NO: 323705 - DNA, 16 bp, C. familiaris
ggtttcttttggggat

SEQ ID NO: 323706 - DNA, 16 bp, C. familiaris
ggtttggtgatgactt

SEQ ID NO: 323707 - DNA, 16 bp, C. familiaris
ggttttaaaaataatt

SEQ ID NO: 323708 - DNA, 16 bp, C. familiaris
ggttttatggaggctt

SEQ ID NO: 323709 - DNA, 16 bp, C. familiaris
ggttttccagaaatac

SEQ ID NO: 323710 - DNA, 16 bp, C. familiaris
ggttttcttttttaaa

SEQ ID NO: 323711 - DNA, 16 bp, C. familiaris
ggttttgatgactgct

SEQ ID NO: 323712 - DNA, 16 bp, C. familiaris
ggttttggctcaggcc

SEQ ID NO: 323713 - DNA, 16 bp, C. familiaris
ggttttggctggggtc

SEQ ID NO: 323714 - DNA, 16 bp, C. familiaris
ggttttgggatcaaga

SEQ ID NO: 323715 - DNA, 16 bp, C. familiaris
ggtttttaaaaatgtt

SEQ ID NO: 323716 - DNA, 16 bp, C. familiaris
ggtttttacattttaa

SEQ ID NO: 323717 - DNA, 16 bp, C. familiaris
gtaaaagtgaaaatcc

SEQ ID NO: 323718 - DNA, 16 bp, C. familiaris
gtaaaatattttagtt

SEQ ID NO: 323719 - DNA, 16 bp, C. familiaris
gtaaaatcttttttta

SEQ ID NO: 323720 - DNA, 16 bp, C. familiaris
gtaaaatgggaatcat

SEQ ID NO: 323721 - DNA, 16 bp, C. familiaris
gtaaacagcaaataga

SEQ ID NO: 323722 - DNA, 16 bp, C. familiaris
gtaaaccatatatctg

SEQ ID NO: 323723 - DNA, 16 bp, C. familiaris
gtaaagacatacttaa

SEQ ID NO: 323724 - DNA, 18 bp, C. familiaris
gtaaaggatctataccct

SEQ ID NO: 323725 - DNA, 16 bp, C. familiaris
gtaaataatgccacag

SEQ ID NO: 323726 - DNA, 16 bp, C. familiaris
gtaaatatttgtcaaa

SEQ ID NO: 323727 - DNA, 16 bp, C. familiaris
gtaaatggaattgact

SEQ ID NO: 323728 - DNA, 16 bp, C. familiaris
gtaaatgggaataata

SEQ ID NO: 323729 - DNA, 16 bp, C. familiaris
gtaacaacatttttct

SEQ ID NO: 323730 - DNA, 16 bp, C. familiaris
gtaacaattgtaaata

SEQ ID NO: 323731 - DNA, 16 bp, C. familiaris
gtaaccacaaataaaa

SEQ ID NO: 323732 - DNA, 16 bp, C. familiaris
gtaagaagttgctgca

SEQ ID NO: 323733 - DNA, 16 bp, C. familiaris
gtaagagcctcctgga

SEQ ID NO: 323734 - DNA, 16 bp, C. familiaris
gtaagaggattccctt

SEQ ID NO: 323735 - DNA, 16 bp, C. familiaris
gtaaggatgtagagaa

SEQ ID NO: 323736 - DNA, 16 bp, C. familiaris
gtaagtattcaataaa

SEQ ID NO: 323737 - DNA, 16 bp, C. familiaris
gtaagtttgagctcca

SEQ ID NO: 323738 - DNA, 16 bp, C. familiaris
gtaatattctactgta

SEQ ID NO: 323739 - DNA, 16 bp, C. familiaris
gtaatgtacaacatga

SEQ ID NO: 323740 - DNA, 16 bp, C. familiaris
gtaattctacttttaa

SEQ ID NO: 323741 - DNA, 16 bp, C. familiaris
gtacaaaattcaaaag

SEQ ID NO: 323742 - DNA, 16 bp, C. familiaris
gtacacagaatcagag

SEQ ID NO: 323743 - DNA, 16 bp, C. familiaris
gtacagaagcttttta

SEQ ID NO: 323744 - DNA, 16 bp, C. familiaris
gtacagacactctgga

SEQ ID NO: 323745 - DNA, 16 bp, C. familiaris
gtacagagagagaggc

SEQ ID NO: 323746 - DNA, 16 bp, C. familiaris
gtacaggtctttcact

SEQ ID NO: 323747 - DNA, 16 bp, C. familiaris
gtacagtattgtaaat

SEQ ID NO: 323748 - DNA, 16 bp, C. familiaris
gtaccaccaccaccac

SEQ ID NO: 323749 - DNA, 16 bp, C. familiaris
gtacctggcacacagc

SEQ ID NO: 323750 - DNA, 16 bp, C. familiaris
gtactgtatgatctca

SEQ ID NO: 323751 - DNA, 16 bp, C. familiaris
gtacttggacccaagc

SEQ ID NO: 323752 - DNA, 16 bp, C. familiaris
gtacttgtctttctct

SEQ ID NO: 323753 - DNA, 16 bp, C. familiaris
gtagaatttaccagta

SEQ ID NO: 323754 - DNA, 16 bp, C. familiaris
gtagacattttaacaa

SEQ ID NO: 323755 - DNA, 16 bp, C. familiaris
gtagagaaattggaac

SEQ ID NO: 323756 - DNA, 16 bp, C. familiaris
gtagaggagaagcagg

SEQ ID NO: 323757 - DNA, 16 bp, C. familiaris
gtagagggaggagcag

SEQ ID NO: 323758 - DNA, 16 bp, C. familiaris
gtagagtttatttaaa

SEQ ID NO: 323759 - DNA, 16 bp, C. familiaris
gtagatggctttgaag

SEQ ID NO: 323760 - DNA, 16 bp, C. familiaris
gtaggcagaggaagag

SEQ ID NO: 323761 - DNA, 16 bp, C. familiaris
gtagggagaggggcag

SEQ ID NO: 323762 - DNA, 16 bp, C. familiaris
gtagggggagaggcag

SEQ ID NO: 323763 - DNA, 16 bp, C. familiaris
gtaggtgctcaataaa

SEQ ID NO: 323764 - DNA, 16 bp, C. familiaris
gtagtagagacatttt

SEQ ID NO: 323765 - DNA, 16 bp, C. familiaris
gtagtagtaataataa

SEQ ID NO: 323766 - DNA, 16 bp, C. familiaris
gtagtataattgctgg

SEQ ID NO: 323767 - DNA, 16 bp, C. familiaris
gtataattccaactat

SEQ ID NO: 323768 - DNA, 16 bp, C. familiaris
gtataatttcttcctt

SEQ ID NO: 323769 - DNA, 16 bp, C. familiaris
gtatacaatagaatat

SEQ ID NO: 323770 - DNA, 16 bp, C. familiaris
gtatacatttatcaaa

SEQ ID NO: 323771 - DNA, 16 bp, C. familiaris
gtatatccattcaatg

SEQ ID NO: 323772 - DNA, 16 bp, C. familiaris
gtatatcttctttgaa

SEQ ID NO: 323773 - DNA, 16 bp, C. familiaris
gtatcagggcaatgct

SEQ ID NO: 323774 - DNA, 16 bp, C. familiaris
gtatccaagatctatg

SEQ ID NO: 323775 - DNA, 16 bp, C. familiaris
gtatgaaggtttctca

SEQ ID NO: 323776 - DNA, 16 bp, C. familiaris
gtatgatgcctccagc

SEQ ID NO: 323777 - DNA, 16 bp, C. familiaris
gtatgcctttgaatta

SEQ ID NO: 323778 - DNA, 16 bp, C. familiaris
gtatggaatttcctca

SEQ ID NO: 323779 - DNA, 16 bp, C. familiaris
gtatggtgtcagagaa

SEQ ID NO: 323780 - DNA, 16 bp, C. familiaris
gtatgtctgtgtgtgt

SEQ ID NO: 323781 - DNA, 16 bp, C. familiaris
gtatgtgcattttttt

SEQ ID NO: 323782 - DNA, 16 bp, C. familiaris
gtatgttaattgaatt

SEQ ID NO: 323783 - DNA, 16 bp, C. familiaris
gtattatttaaagctc

SEQ ID NO: 323784 - DNA, 16 bp, C. familiaris
gtattcaatttgccaa

SEQ ID NO: 323785 - DNA, 16 bp, C. familiaris
gtattctgctgctttt

SEQ ID NO: 323786 - DNA, 16 bp, C. familiaris
gtattgggctccccac

SEQ ID NO: 323787 - DNA, 16 bp, C. familiaris
gtatttaagtaatctc

SEQ ID NO: 323788 - DNA, 16 bp, C. familiaris
gtatttacccaaagaa

SEQ ID NO: 323789 - DNA, 16 bp, C. familiaris
gtatttattatcattt

SEQ ID NO: 323790 - DNA, 16 bp, C. familiaris
gtatttctttggtatt

SEQ ID NO: 323791 - DNA, 16 bp, C. familiaris
gtatttgaggtttttc

SEQ ID NO: 323792 - DNA, 16 bp, C. familiaris
gtatttgttgtttctg

SEQ ID NO: 323793 - DNA, 16 bp, C. familiaris
gtattttgaaggtaga

SEQ ID NO: 323794 - DNA, 16 bp, C. familiaris
gtattttgacagagat

SEQ ID NO: 323795 - DNA, 16 bp, C. familiaris
gtattttgtcaaatgg

SEQ ID NO: 323796 - DNA, 16 bp, C. familiaris
gtattttgttgaggat

SEQ ID NO: 323797 - DNA, 16 bp, C. familiaris
gtatttttgtatcctt

SEQ ID NO: 323798 - DNA, 16 bp, C. familiaris
gtcaaaatcatagaaa

SEQ ID NO: 323799 - DNA, 16 bp, C. familiaris
gtcaaagaagaaatta

SEQ ID NO: 323800 - DNA, 16 bp, C. familiaris
gtcaaagaggctgctg

SEQ ID NO: 323801 - DNA, 16 bp, C. familiaris
gtcaagagcccccctc

SEQ ID NO: 323802 - DNA, 16 bp, C. familiaris
gtcaagatcccaggat

SEQ ID NO: 323803 - DNA, 16 bp, C. familiaris
gtcaaggtgtcagcag

SEQ ID NO: 323804 - DNA, 16 bp, C. familiaris
gtcaaggtgttgaaca

SEQ ID NO: 323805 - DNA, 16 bp, C. familiaris
gtcaattgaagaagga

SEQ ID NO: 323806 - DNA, 16 bp, C. familiaris
gtcaatttgactgggc

SEQ ID NO: 323807 - DNA, 16 bp, C. familiaris
gtcacaaatcaggact

SEQ ID NO: 323808 - DNA, 16 bp, C. familiaris
gtcacacagctgctaa

SEQ ID NO: 323809 - DNA, 16 bp, C. familiaris
gtcacagaccagagga

SEQ ID NO: 323810 - DNA, 16 bp, C. familiaris
gtcacaggacacaaaa

SEQ ID NO: 323811 - DNA, 16 bp, C. familiaris
gtcacatgccctactg

SEQ ID NO: 323812 - DNA, 16 bp, C. familiaris
gtcaccatcaccacca

SEQ ID NO: 323813 - DNA, 16 bp, C. familiaris
gtcacccaggtgcctg

SEQ ID NO: 323814 - DNA, 16 bp, C. familiaris
gtcacccagtcacccc

SEQ ID NO: 323815 - DNA, 16 bp, C. familiaris
gtcacccccacctcct

SEQ ID NO: 323816 - DNA, 16 bp, C. familiaris
gtcacccccatcccct

SEQ ID NO: 323817 - DNA, 16 bp, C. familiaris
gtcacctcctccagga

SEQ ID NO: 323818 - DNA, 16 bp, C. familiaris
gtcagaaggagaagca

SEQ ID NO: 323819 - DNA, 16 bp, C. familiaris
gtcagagacaaaggac

SEQ ID NO: 323820 - DNA, 16 bp, C. familiaris
gtcagatgctcaacag

SEQ ID NO: 323821 - DNA, 16 bp, C. familiaris
gtcagatggagaaaga

SEQ ID NO: 323822 - DNA, 16 bp, C. familiaris
gtcagcaagctggaga

SEQ ID NO: 323823 - DNA, 16 bp, C. familiaris
gtcagcaatgcctcct

SEQ ID NO: 323824 - DNA, 16 bp, C. familiaris
gtcagcagcagcagca

SEQ ID NO: 323825 - DNA, 16 bp, C. familiaris
gtcagccaggaaatta

SEQ ID NO: 323826 - DNA, 16 bp, C. familiaris
gtcagccaggtgctcc

SEQ ID NO: 323827 - DNA, 16 bp, C. familiaris
gtcagcggggagtctg

SEQ ID NO: 323828 - DNA, 16 bp, C. familiaris
gtcaggaatctgggca

SEQ ID NO: 323829 - DNA, 16 bp, C. familiaris
gtcaggctcccggctc

SEQ ID NO: 323830 - DNA, 16 bp, C. familiaris
gtcaggctccctgcgt

SEQ ID NO: 323831 - DNA, 16 bp, C. familiaris
gtcaggcttcttgctc

SEQ ID NO: 323832 - DNA, 16 bp, C. familiaris
gtcaggggaggagcag

SEQ ID NO: 323833 - DNA, 16 bp, C. familiaris
gtcaggttcccagcat

SEQ ID NO: 323834 - DNA, 16 bp, C. familiaris
gtcagtggatggaaaa

SEQ ID NO: 323835 - DNA, 16 bp, C. familiaris
gtcagtggtattttgt

SEQ ID NO: 323836 - DNA, 16 bp, C. familiaris
gtcagtgtggctggag

SEQ ID NO: 323837 - DNA, 16 bp, C. familiaris
gtcagtttcctggttt

SEQ ID NO: 323838 - DNA, 16 bp, C. familiaris
gtcataaaagacattg

SEQ ID NO: 323839 - DNA, 16 bp, C. familiaris
gtcatcaaaagcctcc

SEQ ID NO: 323840 - DNA, 38 bp, C. familiaris
gtcatcaaagcagtggacaagaaggcagctggagctgg

SEQ ID NO: 323841 - DNA, 16 bp, C. familiaris
gtcatcaacaacctcc

SEQ ID NO: 323842 - DNA, 16 bp, C. familiaris
gtcatcaagactgtgt

SEQ ID NO: 323843 - DNA, 16 bp, C. familiaris
gtcatcatctcagggt

SEQ ID NO: 323844 - DNA, 16 bp, C. familiaris
gtcatccagtcacccc

SEQ ID NO: 323845 - DNA, 16 bp, C. familiaris
gtcatctctgcaccca

SEQ ID NO: 323846 - DNA, 16 bp, C. familiaris
gtcatctgcaaagagt

SEQ ID NO: 323847 - DNA, 16 bp, C. familiaris
gtcatctttggaaaat

SEQ ID NO: 323848 - DNA, 16 bp, C. familiaris
gtcatgatcctggggt

SEQ ID NO: 323849 - DNA, 16 bp, C. familiaris
gtcatgatctcggggt

SEQ ID NO: 323850 - DNA, 16 bp, C. familiaris
gtcatgatcttggggt

SEQ ID NO: 323851 - DNA, 16 bp, C. familiaris
gtcatgattccagtgt

SEQ ID NO: 323852 - DNA, 16 bp, C. familiaris
gtcatgattcctgggt

SEQ ID NO: 323853 - DNA, 16 bp, C. familiaris
gtcatgattctggagt

SEQ ID NO: 323854 - DNA, 16 bp, C. familiaris
gtcatggtcctggaga

SEQ ID NO: 323855 - DNA, 16 bp, C. familiaris
gtcattgaaaatggca

SEQ ID NO: 323856 - DNA, 16 bp, C. familiaris
gtcattgcaaatgaca

SEQ ID NO: 323857 - DNA, 16 bp, C. familiaris
gtcattggtgaccttg

SEQ ID NO: 323858 - DNA, 16 bp, C. familiaris
gtcattgtttctggag

SEQ ID NO: 323859 - DNA, 16 bp, C. familiaris
gtcatttttgcttttg

SEQ ID NO: 323860 - DNA, 16 bp, C. familiaris
gtccaaatctcctctt

SEQ ID NO: 323861 - DNA, 16 bp, C. familiaris
gtccaagcccctgctc

SEQ ID NO: 323862 - DNA, 16 bp, C. familiaris
gtccaagtgtccatca

SEQ ID NO: 323863 - DNA, 16 bp, C. familiaris
gtccagaagcagatga

SEQ ID NO: 323864 - DNA, 16 bp, C. familiaris
gtccaggggcagaaag

SEQ ID NO: 323865 - DNA, 16 bp, C. familiaris
gtccagtttcagtctt

SEQ ID NO: 323866 - DNA, 16 bp, C. familiaris
gtccatctatgttgtt

SEQ ID NO: 323867 - DNA, 16 bp, C. familiaris
gtcccaatttctccac

SEQ ID NO: 323868 - DNA, 16 bp, C. familiaris
gtcccagaagaagaag

SEQ ID NO: 323869 - DNA, 16 bp, C. familiaris
gtcccagaaggagaag

SEQ ID NO: 323870 - DNA, 16 bp, C. familiaris
gtcccagccccagccc

SEQ ID NO: 323871 - DNA, 16 bp, C. familiaris
gtcccaggactctgag

SEQ ID NO: 323872 - DNA, 16 bp, C. familiaris
gtcccagggtcccggg

SEQ ID NO: 323873 - DNA, 16 bp, C. familiaris
gtccccagcccccagc

SEQ ID NO: 323874 - DNA, 16 bp, C. familiaris
gtccccagccctggag

SEQ ID NO: 323875 - DNA, 16 bp, C. familiaris
gtccccaggatcacgt

SEQ ID NO: 323876 - DNA, 16 bp, C. familiaris
gtccccagggcccagc

SEQ ID NO: 323877 - DNA, 16 bp, C. familiaris
gtcccccggcaccctg

SEQ ID NO: 323878 - DNA, 16 bp, C. familiaris
gtccccggagcccgag

SEQ ID NO: 323879 - DNA, 16 bp, C. familiaris
gtcccctggcgccctg

SEQ ID NO: 323880 - DNA, 16 bp, C. familiaris
gtcccgcatcaagctc

SEQ ID NO: 323881 - DNA, 16 bp, C. familiaris
gtcccggggtcctggg

SEQ ID NO: 323882 - DNA, 16 bp, C. familiaris
gtccctcattgggctc

SEQ ID NO: 323883 - DNA, 16 bp, C. familiaris
gtccctgccctcctgg

SEQ ID NO: 323884 - DNA, 16 bp, C. familiaris
gtccctgccttcagcc

SEQ ID NO: 323885 - DNA, 16 bp, C. familiaris
gtccctgctcagaggg

SEQ ID NO: 323886 - DNA, 16 bp, C. familiaris
gtccctgctctgctgc

SEQ ID NO: 323887 - DNA, 16 bp, C. familiaris
gtccggctccctgcgt

SEQ ID NO: 323888 - DNA, 16 bp, C. familiaris
gtcctcaaaagaaaag

SEQ ID NO: 323889 - DNA, 16 bp, C. familiaris
gtcctcaaaagaaagg

SEQ ID NO: 323890 - DNA, 16 bp, C. familiaris
gtcctccaggcagggg

SEQ ID NO: 323891 - DNA, 16 bp, C. familiaris
gtcctccatttccaag

SEQ ID NO: 323892 - DNA, 16 bp, C. familiaris
gtcctctctcccagag

SEQ ID NO: 323893 - DNA, 16 bp, C. familiaris
gtcctctgtccatttt

SEQ ID NO: 323894 - DNA, 16 bp, C. familiaris
gtcctctttctgttcc

SEQ ID NO: 323895 - DNA, 16 bp, C. familiaris
gtcctgagccagaggc

SEQ ID NO: 323896 - DNA, 16 bp, C. familiaris
gtcctgagcccaaggc

SEQ ID NO: 323897 - DNA, 16 bp, C. familiaris
gtcctgcagcaggtgg

SEQ ID NO: 323898 - DNA, 16 bp, C. familiaris
gtcctgcatcgtgctc

SEQ ID NO: 323899 - DNA, 16 bp, C. familiaris
gtcctgctccagctcc

SEQ ID NO: 323900 - DNA, 16 bp, C. familiaris
gtcctggaggcctggg

SEQ ID NO: 323901 - DNA, 16 bp, C. familiaris
gtcctggaggctggga

SEQ ID NO: 323902 - DNA, 16 bp, C. familiaris
gtcctggatcctggga

SEQ ID NO: 323903 - DNA, 16 bp, C. familiaris
gtcctggctctaccac

SEQ ID NO: 323904 - DNA, 16 bp, C. familiaris
gtcctgggacgcctgg

SEQ ID NO: 323905 - DNA, 16 bp, C. familiaris
gtcctgggactgagtc

SEQ ID NO: 323906 - DNA, 16 bp, C. familiaris
gtcctgggagaggaca

SEQ ID NO: 323907 - DNA, 16 bp, C. familiaris
gtcctgggccctccca

SEQ ID NO: 323908 - DNA, 16 bp, C. familiaris
gtcctggggacccagg

SEQ ID NO: 323909 - DNA, 16 bp, C. familiaris
gtcctggggaggcctg

SEQ ID NO: 323910 - DNA, 16 bp, C. familiaris
gtcctggggtcactcg

SEQ ID NO: 323911 - DNA, 16 bp, C. familiaris
gtcctgggttcgagcc

SEQ ID NO: 323912 - DNA, 16 bp, C. familiaris
gtcctggtggcccagc

SEQ ID NO: 323913 - DNA, 16 bp, C. familiaris
gtcctgtccccgggct

SEQ ID NO: 323914 - DNA, 16 bp, C. familiaris
gtcctgtccctgtgct

SEQ ID NO: 323915 - DNA, 16 bp, C. familiaris
gtcctttgacagatga

SEQ ID NO: 323916 - DNA, 16 bp, C. familiaris
gtcctttgctgtgcaa

SEQ ID NO: 323917 - DNA, 16 bp, C. familiaris
gtccttttttcagtgg

SEQ ID NO: 323918 - DNA, 16 bp, C. familiaris
gtcgggctccgggcat

SEQ ID NO: 323919 - DNA, 16 bp, C. familiaris
gtcggtgaaggacaaa

SEQ ID NO: 323920 - DNA, 16 bp, C. familiaris
gtcgtgagatcaagcc

SEQ ID NO: 323921 - DNA, 16 bp, C. familiaris
gtcgtggtcctgggat

SEQ ID NO: 323922 - DNA, 16 bp, C. familiaris
gtctaaaattatttca

SEQ ID NO: 323923 - DNA, 16 bp, C. familiaris
gtctaaggaaaaaaaa

SEQ ID NO: 323924 - DNA, 16 bp, C. familiaris
gtctaagtcagagtct

SEQ ID NO: 323925 - DNA, 16 bp, C. familiaris
gtctacctcaagaaac

SEQ ID NO: 323926 - DNA, 16 bp, C. familiaris
gtctacttccccctct

SEQ ID NO: 323927 - DNA, 16 bp, C. familiaris
gtctatagaaatgcaa

SEQ ID NO: 323928 - DNA, 16 bp, C. familiaris
gtctatgcctctgtgt

SEQ ID NO: 323929 - DNA, 16 bp, C. familiaris
gtctcaaagagatatt

SEQ ID NO: 323930 - DNA, 16 bp, C. familiaris
gtctcagagtcctggg

SEQ ID NO: 323931 - DNA, 16 bp, C. familiaris
gtctcagctcaaatgt

SEQ ID NO: 323932 - DNA, 16 bp, C. familiaris
gtctcaggccatgatc

SEQ ID NO: 323933 - DNA, 16 bp, C. familiaris
gtctccaaggatcaca

SEQ ID NO: 323934 - DNA, 16 bp, C. familiaris
gtctccagcctgctgg

SEQ ID NO: 323935 - DNA, 16 bp, C. familiaris
gtctccaggagcaggc

SEQ ID NO: 323936 - DNA, 16 bp, C. familiaris
gtctccagtgaaaact

SEQ ID NO: 323937 - DNA, 16 bp, C. familiaris
gtctccatttcttcat

SEQ ID NO: 323938 - DNA, 16 bp, C. familiaris
gtctcccggtgcatgg

SEQ ID NO: 323939 - DNA, 16 bp, C. familiaris
gtctccctccctgatt

SEQ ID NO: 323940 - DNA, 16 bp, C. familiaris
gtctcctcatttgtaa

SEQ ID NO: 323941 - DNA, 16 bp, C. familiaris
gtctcctgctcttgaa

SEQ ID NO: 323942 - DNA, 16 bp, C. familiaris
gtctctatgattttga

SEQ ID NO: 323943 - DNA, 16 bp, C. familiaris
gtctctctgtctctca

SEQ ID NO: 323944 - DNA, 16 bp, C. familiaris
gtctctgcccctctct

SEQ ID NO: 323945 - DNA, 16 bp, C. familiaris
gtctctgccgatctct

SEQ ID NO: 323946 - DNA, 16 bp, C. familiaris
gtctctgcctcagtct

SEQ ID NO: 323947 - DNA, 16 bp, C. familiaris
gtctctgcctcctctc

SEQ ID NO: 323948 - DNA, 16 bp, C. familiaris
gtctctgcctccttct

SEQ ID NO: 323949 - DNA, 16 bp, C. familiaris
gtctctgcctctgcct

SEQ ID NO: 323950 - DNA, 16 bp, C. familiaris
gtctctgcctgccccc

SEQ ID NO: 323951 - DNA, 16 bp, C. familiaris
gtctctgtgctcagtg

SEQ ID NO: 323952 - DNA, 16 bp, C. familiaris
gtctctgttcaaatgt

SEQ ID NO: 323953 - DNA, 16 bp, C. familiaris
gtctcttctctgcctc

SEQ ID NO: 323954 - DNA, 16 bp, C. familiaris
gtctgacttcaaagcc

SEQ ID NO: 323955 - DNA, 16 bp, C. familiaris
gtctgagccaaaggca

SEQ ID NO: 323956 - DNA, 16 bp, C. familiaris
gtctgcagcccagggc

SEQ ID NO: 323957 - DNA, 16 bp, C. familiaris
gtctgccttcggctta

SEQ ID NO: 323958 - DNA, 16 bp, C. familiaris
gtctgctcttccctct

SEQ ID NO: 323959 - DNA, 16 bp, C. familiaris
gtctgctgccagcctt

SEQ ID NO: 323960 - DNA, 16 bp, C. familiaris
gtctgctggagagtct

SEQ ID NO: 323961 - DNA, 16 bp, C. familiaris
gtctgctggaggattc

SEQ ID NO: 323962 - DNA, 16 bp, C. familiaris
gtctgcttctcctctt

SEQ ID NO: 323963 - DNA, 16 bp, C. familiaris
gtctgcttgcccctct

SEQ ID NO: 323964 - DNA, 16 bp, C. familiaris
gtctggagacattttt

SEQ ID NO: 323965 - DNA, 16 bp, C. familiaris
gtctgggacacctggg

SEQ ID NO: 323966 - DNA, 16 bp, C. familiaris
gtctgtctatctgtct

SEQ ID NO: 323967 - DNA, 16 bp, C. familiaris
gtctgtctgtctgtct

SEQ ID NO: 323968 - DNA, 16 bp, C. familiaris
gtctgtgagattcatt

SEQ ID NO: 323969 - DNA, 16 bp, C. familiaris
gtctgtgccctgctgc

SEQ ID NO: 323970 - DNA, 16 bp, C. familiaris
gtctgtgctcagcagg

SEQ ID NO: 323971 - DNA, 16 bp, C. familiaris
gtctgtttctactttt

SEQ ID NO: 323972 - DNA, 16 bp, C. familiaris
gtcttaaaaaggaagg

SEQ ID NO: 323973 - DNA, 16 bp, C. familiaris
gtcttagaagctcttt

SEQ ID NO: 323974 - DNA, 16 bp, C. familiaris
gtcttattaattcttt

SEQ ID NO: 323975 - DNA, 16 bp, C. familiaris
gtcttcacatggtctt

SEQ ID NO: 323976 - DNA, 16 bp, C. familiaris
gtcttcttccatttct

SEQ ID NO: 323977 - DNA, 16 bp, C. familiaris
gtcttctttggaagaa

SEQ ID NO: 323978 - DNA, 16 bp, C. familiaris
gtcttctttggagaag

SEQ ID NO: 323979 - DNA, 16 bp, C. familiaris
gtctttcatctctttg

SEQ ID NO: 323980 - DNA, 16 bp, C. familiaris
gtctttccagattttt

SEQ ID NO: 323981 - DNA, 16 bp, C. familiaris
gtctttccagctggtc

SEQ ID NO: 323982 - DNA, 16 bp, C. familiaris
gtctttctctgatttt

SEQ ID NO: 323983 - DNA, 16 bp, C. familiaris
gtctttcttcatctct

SEQ ID NO: 323984 - DNA, 16 bp, C. familiaris
gtctttgatccatttg

SEQ ID NO: 323985 - DNA, 16 bp, C. familiaris
gtctttgcctgcctct

SEQ ID NO: 323986 - DNA, 16 bp, C. familiaris
gtctttgtgtggacat

SEQ ID NO: 323987 - DNA, 16 bp, C. familiaris
gtcttttcattattga

SEQ ID NO: 323988 - DNA, 16 bp, C. familiaris
gtcttttctgcttcca

SEQ ID NO: 323989 - DNA, 16 bp, C. familiaris
gtcttttgtgcctggc

SEQ ID NO: 323990 - DNA, 16 bp, C. familiaris
gtgaaaaaacatgaga

SEQ ID NO: 323991 - DNA, 16 bp, C. familiaris
gtgaaaaatgctattg

SEQ ID NO: 323992 - DNA, 16 bp, C. familiaris
gtgaaaattaataaga

SEQ ID NO: 323993 - DNA, 16 bp, C. familiaris
gtgaaagagaatggtc

SEQ ID NO: 323994 - DNA, 16 bp, C. familiaris
gtgaaaggaagagtca

SEQ ID NO: 323995 - DNA, 16 bp, C. familiaris
gtgaaaggaattataa

SEQ ID NO: 323996 - DNA, 16 bp, C. familiaris
gtgaaatagatgatga

SEQ ID NO: 323997 - DNA, 16 bp, C. familiaris
gtgaaatctaaaaaca

SEQ ID NO: 323998 - DNA, 16 bp, C. familiaris
gtgaaatgggtgaaga

SEQ ID NO: 323999 - DNA, 16 bp, C. familiaris
gtgaacaagacagaca

SEQ ID NO: 324000 - DNA, 16 bp, C. familiaris
gtgaagaaaatgaata

SEQ ID NO: 324001 - DNA, 16 bp, C. familiaris
gtgaagacagaggcag

SEQ ID NO: 324002 - DNA, 16 bp, C. familiaris
gtgaagatggaagcag

SEQ ID NO: 324003 - DNA, 16 bp, C. familiaris
gtgaagatgtagagaa

SEQ ID NO: 324004 - DNA, 16 bp, C. familiaris
gtgaagcatctgcttt

SEQ ID NO: 324005 - DNA, 16 bp, C. familiaris
gtgaaggaaaccatca

SEQ ID NO: 324006 - DNA, 16 bp, C. familiaris
gtgaaggggattaagg

SEQ ID NO: 324007 - DNA, 16 bp, C. familiaris
gtgaagtgcctgttca

SEQ ID NO: 324008 - DNA, 16 bp, C. familiaris
gtgaataatgctacag

SEQ ID NO: 324009 - DNA, 16 bp, C. familiaris
gtgaataatgctgaaa

SEQ ID NO: 324010 - DNA, 16 bp, C. familiaris
gtgaatatccagtttt

SEQ ID NO: 324011 - DNA, 16 bp, C. familiaris
gtgaatgatcctttta

SEQ ID NO: 324012 - DNA, 16 bp, C. familiaris
gtgaatgattttctta

SEQ ID NO: 324013 - DNA, 16 bp, C. familiaris
gtgaatttctccatct

SEQ ID NO: 324014 - DNA, 16 bp, C. familiaris
gtgaatttgaagatag

SEQ ID NO: 324015 - DNA, 16 bp, C. familiaris
gtgaatttgactatga

SEQ ID NO: 324016 - DNA, 16 bp, C. familiaris
gtgacaagatttcctt

SEQ ID NO: 324017 - DNA, 16 bp, C. familiaris
gtgacaggcaccgagg

SEQ ID NO: 324018 - DNA, 16 bp, C. familiaris
gtgacaggcactgggt

SEQ ID NO: 324019 - DNA, 16 bp, C. familiaris
gtgacagtggacatcc

SEQ ID NO: 324020 - DNA, 16 bp, C. familiaris
gtgacatcaagcccca

SEQ ID NO: 324021 - DNA, 16 bp, C. familiaris
gtgacattgacatttt

SEQ ID NO: 324022 - DNA, 16 bp, C. familiaris
gtgaccaggatcaggg

SEQ ID NO: 324023 - DNA, 16 bp, C. familiaris
gtgaccatggacaagt

SEQ ID NO: 324024 - DNA, 16 bp, C. familiaris
gtgaccctgagatcaa

SEQ ID NO: 324025 - DNA, 16 bp, C. familiaris
gtgacctgcccaaggt

SEQ ID NO: 324026 - DNA, 16 bp, C. familiaris
gtgacctggaagacag

SEQ ID NO: 324027 - DNA, 16 bp, C. familiaris
gtgacgggaactgagg

SEQ ID NO: 324028 - DNA, 16 bp, C. familiaris
gtgactcagtttcccc

SEQ ID NO: 324029 - DNA, 16 bp, C. familiaris
gtgactgagaaactga

SEQ ID NO: 324030 - DNA, 16 bp, C. familiaris
gtgactgtgtgtgtgt

SEQ ID NO: 324031 - DNA, 16 bp, C. familiaris
gtgacttgttttggcc

SEQ ID NO: 324032 - DNA, 16 bp, C. familiaris
gtgagaagcctgatgc

SEQ ID NO: 324033 - DNA, 16 bp, C. familiaris
gtgagaatggagaaaa

SEQ ID NO: 324034 - DNA, 16 bp, C. familiaris
gtgagaatttgacttc

SEQ ID NO: 324035 - DNA, 16 bp, C. familiaris
gtgagaatttttacat

SEQ ID NO: 324036 - DNA, 16 bp, C. familiaris
gtgagagacacaggga

SEQ ID NO: 324037 - DNA, 16 bp, C. familiaris
gtgagagagagaagca

SEQ ID NO: 324038 - DNA, 16 bp, C. familiaris
gtgagaggggacatcc

SEQ ID NO: 324039 - DNA, 16 bp, C. familiaris
gtgagagtggggaaaa

SEQ ID NO: 324040 - DNA, 16 bp, C. familiaris
gtgagatggagccttg

SEQ ID NO: 324041 - DNA, 16 bp, C. familiaris
gtgagcaataaatttc

SEQ ID NO: 324042 - DNA, 16 bp, C. familiaris
gtgagcagcaggcaga

SEQ ID NO: 324043 - DNA, 16 bp, C. familiaris
gtgagcctgatgcggg

SEQ ID NO: 324044 - DNA, 16 bp, C. familiaris
gtgagcctgattctgt

SEQ ID NO: 324045 - DNA, 16 bp, C. familiaris
gtgaggaagtggagaa

SEQ ID NO: 324046 - DNA, 16 bp, C. familiaris
gtgaggatgtggaaga

SEQ ID NO: 324047 - DNA, 16 bp, C. familiaris
gtgaggcccagagggg

SEQ ID NO: 324048 - DNA, 16 bp, C. familiaris
gtgaggccccaggaag

SEQ ID NO: 324049 - DNA, 16 bp, C. familiaris
gtgaggctccatccca

SEQ ID NO: 324050 - DNA, 16 bp, C. familiaris
gtgaggctggatctca

SEQ ID NO: 324051 - DNA, 16 bp, C. familiaris
gtgagggaggggcaga

SEQ ID NO: 324052 - DNA, 16 bp, C. familiaris
gtgaggggaagggcag

SEQ ID NO: 324053 - DNA, 16 bp, C. familiaris
gtgaggtggagccctg

SEQ ID NO: 324054 - DNA, 16 bp, C. familiaris
gtgaggtggtatttca

SEQ ID NO: 324055 - DNA, 16 bp, C. familiaris
gtgagtgagacagaga

SEQ ID NO: 324056 - DNA, 16 bp, C. familiaris
gtgagtgctcaataaa

SEQ ID NO: 324057 - DNA, 16 bp, C. familiaris
gtgagtttttccttct

SEQ ID NO: 324058 - DNA, 16 bp, C. familiaris
gtgatactgagcatct

SEQ ID NO: 324059 - DNA, 16 bp, C. familiaris
gtgatattgagcatct

SEQ ID NO: 324060 - DNA, 16 bp, C. familiaris
gtgatcacaccctgag

SEQ ID NO: 324061 - DNA, 16 bp, C. familiaris
gtgatcatggtatctc

SEQ ID NO: 324062 - DNA, 16 bp, C. familiaris
gtgatcccagagaccc

SEQ ID NO: 324063 - DNA, 16 bp, C. familiaris
gtgatcccagggtcac

SEQ ID NO: 324064 - DNA, 16 bp, C. familiaris
gtgatcccaggtctgg

SEQ ID NO: 324065 - DNA, 16 bp, C. familiaris
gtgatcctggaatctc

SEQ ID NO: 324066 - DNA, 16 bp, C. familiaris
gtgatcctggagagcc

SEQ ID NO: 324067 - DNA, 16 bp, C. familiaris
gtgatcctggaggccc

SEQ ID NO: 324068 - DNA, 16 bp, C. familiaris
gtgatcctgggaaccc

SEQ ID NO: 324069 - DNA, 16 bp, C. familiaris
gtgatctacagattca

SEQ ID NO: 324070 - DNA, 16 bp, C. familiaris
gtgatctattctggaa

SEQ ID NO: 324071 - DNA, 16 bp, C. familiaris
gtgatgatgatagtga

SEQ ID NO: 324072 - DNA, 17 bp, C. familiaris
gtgatgatgatgatggt

SEQ ID NO: 324073 - DNA, 16 bp, C. familiaris
gtgatgctgctgctgg

SEQ ID NO: 324074 - DNA, 16 bp, C. familiaris
gtgatggagatgttct

SEQ ID NO: 324075 - DNA, 16 bp, C. familiaris
gtgatggagcctgctt

SEQ ID NO: 324076 - DNA, 16 bp, C. familiaris
gtgatgggaaaattgg

SEQ ID NO: 324077 - DNA, 16 bp, C. familiaris
gtgatgggatgcctgg

SEQ ID NO: 324078 - DNA, 16 bp, C. familiaris
gtgatggtatctggag

SEQ ID NO: 324079 - DNA, 16 bp, C. familiaris
gtgatggtgatgatga

SEQ ID NO: 324080 - DNA, 16 bp, C. familiaris
gtgatggtggcagtgg

SEQ ID NO: 324081 - DNA, 16 bp, C. familiaris
gtgatggtggctgact

SEQ ID NO: 324082 - DNA, 16 bp, C. familiaris
gtgatggtggtggcag

SEQ ID NO: 324083 - DNA, 16 bp, C. familiaris
gtgatgtccccagcta

SEQ ID NO: 324084 - DNA, 16 bp, C. familiaris
gtgattatcataaaaa

SEQ ID NO: 324085 - DNA, 16 bp, C. familiaris
gtgattcagtggttga

SEQ ID NO: 324086 - DNA, 16 bp, C. familiaris
gtgattctcaaacttt

SEQ ID NO: 324087 - DNA, 16 bp, C. familiaris
gtgattctcatgtgca

SEQ ID NO: 324088 - DNA, 16 bp, C. familiaris
gtgattctggaatccc

SEQ ID NO: 324089 - DNA, 16 bp, C. familiaris
gtgattctggagtccc

SEQ ID NO: 324090 - DNA, 16 bp, C. familiaris
gtgatttttaaatata

SEQ ID NO: 324091 - DNA, 16 bp, C. familiaris
gtgcaacaggcccctc

SEQ ID NO: 324092 - DNA, 16 bp, C. familiaris
gtgcacagtctgcttg

SEQ ID NO: 324093 - DNA, 16 bp, C. familiaris
gtgcacatggaacttt

SEQ ID NO: 324094 - DNA, 16 bp, C. familiaris
gtgcacctgtgatgag

SEQ ID NO: 324095 - DNA, 16 bp, C. familiaris
gtgcactcacacacac

SEQ ID NO: 324096 - DNA, 16 bp, C. familiaris
gtgcagagcctgacaa

SEQ ID NO: 324097 - DNA, 16 bp, C. familiaris
gtgcagaggggcagag

SEQ ID NO: 324098 - DNA, 16 bp, C. familiaris
gtgcagagtagccaaa

SEQ ID NO: 324099 - DNA, 16 bp, C. familiaris
gtgcagccatcccagg

SEQ ID NO: 324100 - DNA, 16 bp, C. familiaris
gtgcagcctgcagccc

SEQ ID NO: 324101 - DNA, 16 bp, C. familiaris
gtgcaggagcaggggg

SEQ ID NO: 324102 - DNA, 16 bp, C. familiaris
gtgcagggaggggcag

SEQ ID NO: 324103 - DNA, 16 bp, C. familiaris
gtgcagggcagcctgg

SEQ ID NO: 324104 - DNA, 16 bp, C. familiaris
gtgcagggccagatgg

SEQ ID NO: 324105 - DNA, 16 bp, C. familiaris
gtgcagggcctgatcc

SEQ ID NO: 324106 - DNA, 16 bp, C. familiaris
gtgcaggtgtcctggg

SEQ ID NO: 324107 - DNA, 16 bp, C. familiaris
gtgcagtcactgtgaa

SEQ ID NO: 324108 - DNA, 16 bp, C. familiaris
gtgcatatatatgtgt

SEQ ID NO: 324109 - DNA, 23 bp, C. familiaris
gtgcatggagcctgcttctccct

SEQ ID NO: 324110 - DNA, 16 bp, C. familiaris
gtgcatgtgcacacac

SEQ ID NO: 324111 - DNA, 16 bp, C. familiaris
gtgcatgtgcatgcat

SEQ ID NO: 324112 - DNA, 16 bp, C. familiaris
gtgcatttatttttat

SEQ ID NO: 324113 - DNA, 23 bp, C. familiaris
gtgccaatttctggttggaatgg

SEQ ID NO: 324114 - DNA, 16 bp, C. familiaris
gtgccacaggggctgc

SEQ ID NO: 324115 - DNA, 16 bp, C. familiaris
gtgccacccaagtgcc

SEQ ID NO: 324116 - DNA, 16 bp, C. familiaris
gtgccagcatggtcag

SEQ ID NO: 324117 - DNA, 16 bp, C. familiaris
gtgccaggcaccatgt

SEQ ID NO: 324118 - DNA, 16 bp, C. familiaris
gtgccaggccctggag

SEQ ID NO: 324119 - DNA, 16 bp, C. familiaris
gtgccaggccctgtgc

SEQ ID NO: 324120 - DNA, 16 bp, C. familiaris
gtgccaggcgctgtgc

SEQ ID NO: 324121 - DNA, 16 bp, C. familiaris
gtgccaggctccatgc

SEQ ID NO: 324122 - DNA, 16 bp, C. familiaris
gtgccaggtgctgggc

SEQ ID NO: 324123 - DNA, 16 bp, C. familiaris
gtgccagtaccatatt

SEQ ID NO: 324124 - DNA, 16 bp, C. familiaris
gtgccagtcacccagt

SEQ ID NO: 324125 - DNA, 16 bp, C. familiaris
gtgcccagatatttgg

SEQ ID NO: 324126 - DNA, 16 bp, C. familiaris
gtgcccagcacagtgc

SEQ ID NO: 324127 - DNA, 16 bp, C. familiaris
gtgcccccccagtgcc

SEQ ID NO: 324128 - DNA, 16 bp, C. familiaris
gtgcccctgtctctca

SEQ ID NO: 324129 - DNA, 16 bp, C. familiaris
gtgcccgcctttggcc

SEQ ID NO: 324130 - DNA, 16 bp, C. familiaris
gtgccgacttcagccc

SEQ ID NO: 324131 - DNA, 17 bp, C. familiaris
gtgccgccctcagtgcc

SEQ ID NO: 324132 - DNA, 16 bp, C. familiaris
gtgccgccttcagcct

SEQ ID NO: 324133 - DNA, 16 bp, C. familiaris
gtgcctgacacccagt

SEQ ID NO: 324134 - DNA, 16 bp, C. familiaris
gtgcctgccttcagcc

SEQ ID NO: 324135 - DNA, 16 bp, C. familiaris
gtgcctgccttccgcc

SEQ ID NO: 324136 - DNA, 16 bp, C. familiaris
gtgcctggcacatcat

SEQ ID NO: 324137 - DNA, 16 bp, C. familiaris
gtgcctggctggttca

SEQ ID NO: 324138 - DNA, 16 bp, C. familiaris
gtgcctgggtggttga

SEQ ID NO: 324139 - DNA, 16 bp, C. familiaris
gtgcgcatgcacacac

SEQ ID NO: 324140 - DNA, 16 bp, C. familiaris
gtgcgcgtgcgcgcgc

SEQ ID NO: 324141 - DNA, 16 bp, C. familiaris
gtgcgtgcgtgcgtgt

SEQ ID NO: 324142 - DNA, 16 bp, C. familiaris
gtgctcacttgctctc

SEQ ID NO: 324143 - DNA, 16 bp, C. familiaris
gtgctcagcgtggagc

SEQ ID NO: 324144 - DNA, 19 bp, C. familiaris
gtgctcagctggggcagga

SEQ ID NO: 324145 - DNA, 16 bp, C. familiaris
gtgctcatcacaggtg

SEQ ID NO: 324146 - DNA, 16 bp, C. familiaris
gtgctccagggcctgc

SEQ ID NO: 324147 - DNA, 16 bp, C. familiaris
gtgctccctctctcaa

SEQ ID NO: 324148 - DNA, 16 bp, C. familiaris
gtgctcctggagaccc

SEQ ID NO: 324149 - DNA, 16 bp, C. familiaris
gtgctcctgggcctgc

SEQ ID NO: 324150 - DNA, 16 bp, C. familiaris
gtgctgagagggacag

SEQ ID NO: 324151 - DNA, 16 bp, C. familiaris
gtgctgagcatggagc

SEQ ID NO: 324152 - DNA, 16 bp, C. familiaris
gtgctgagcctggagc

SEQ ID NO: 324153 - DNA, 16 bp, C. familiaris
gtgctgcctccagccc

SEQ ID NO: 324154 - DNA, 16 bp, C. familiaris
gtgctgccttctgccc

SEQ ID NO: 324155 - DNA, 16 bp, C. familiaris
gtgctgctgctggtgg

SEQ ID NO: 324156 - DNA, 16 bp, C. familiaris
gtgctgggaacactgg

SEQ ID NO: 324157 - DNA, 16 bp, C. familiaris
gtgctgggcacggagc

SEQ ID NO: 324158 - DNA, 16 bp, C. familiaris
gtgctgggcatggaga

SEQ ID NO: 324159 - DNA, 16 bp, C. familiaris
gtgctgggtcctgggg

SEQ ID NO: 324160 - DNA, 16 bp, C. familiaris
gtgctggtgctggtgc

SEQ ID NO: 324161 - DNA, 16 bp, C. familiaris
gtgcttgattccagga

SEQ ID NO: 324162 - DNA, 16 bp, C. familiaris
gtgcttgccttcggcc

SEQ ID NO: 324163 - DNA, 16 bp, C. familiaris
gtgctttatatattct

SEQ ID NO: 324164 - DNA, 16 bp, C. familiaris
gtgctttctctgtctc

SEQ ID NO: 324165 - DNA, 16 bp, C. familiaris
gtgcttttaatttgca

SEQ ID NO: 324166 - DNA, 16 bp, C. familiaris
gtggaaaaaagagaac

SEQ ID NO: 324167 - DNA, 16 bp, C. familiaris
gtggaaaaaaggaaac

SEQ ID NO: 324168 - DNA, 16 bp, C. familiaris
gtggaaaacagtgtgg

SEQ ID NO: 324169 - DNA, 17 bp, C. familiaris
gtggaaactaatgagaa

SEQ ID NO: 324170 - DNA, 16 bp, C. familiaris
gtggaaaggaaagacc

SEQ ID NO: 324171 - DNA, 16 bp, C. familiaris
gtggaacaggaagaaa

SEQ ID NO: 324172 - DNA, 16 bp, C. familiaris
gtggaaccagaaaaga

SEQ ID NO: 324173 - DNA, 16 bp, C. familiaris
gtggaagaatgaaact

SEQ ID NO: 324174 - DNA, 16 bp, C. familiaris
gtggaagacacaaaga

SEQ ID NO: 324175 - DNA, 16 bp, C. familiaris
gtggaagagagagtga

SEQ ID NO: 324176 - DNA, 16 bp, C. familiaris
gtggaagatttttttt

SEQ ID NO: 324177 - DNA, 16 bp, C. familiaris
gtggaaggagcctcag

SEQ ID NO: 324178 - DNA, 16 bp, C. familiaris
gtggaaggaggggcag

SEQ ID NO: 324179 - DNA, 16 bp, C. familiaris
gtggaagggcaggagg

SEQ ID NO: 324180 - DNA, 16 bp, C. familiaris
gtggaaggggacgtgg

SEQ ID NO: 324181 - DNA, 16 bp, C. familiaris
gtggaaggggagcagg

SEQ ID NO: 324182 - DNA, 16 bp, C. familiaris
gtggaaggggcaaggg

SEQ ID NO: 324183 - DNA, 16 bp, C. familiaris
gtggaatccattttgt

SEQ ID NO: 324184 - DNA, 16 bp, C. familiaris
gtggaatctgaaaaaa

SEQ ID NO: 324185 - DNA, 16 bp, C. familiaris
gtggaatgactggatc

SEQ ID NO: 324186 - DNA, 16 bp, C. familiaris
gtggaattgctggatc

SEQ ID NO: 324187 - DNA, 16 bp, C. familiaris
gtggaatttgaaatta

SEQ ID NO: 324188 - DNA, 16 bp, C. familiaris
gtggacactgctgctg

SEQ ID NO: 324189 - DNA, 16 bp, C. familiaris
gtggacatcctgtctt

SEQ ID NO: 324190 - DNA, 16 bp, C. familiaris
gtggacatgaattttg

SEQ ID NO: 324191 - DNA, 16 bp, C. familiaris
gtggaccctcaacttc

SEQ ID NO: 324192 - DNA, 16 bp, C. familiaris
gtggacttcactgagg

SEQ ID NO: 324193 - DNA, 16 bp, C. familiaris
gtggagaaaagagaac

SEQ ID NO: 324194 - DNA, 16 bp, C. familiaris
gtggagaaacctggca

SEQ ID NO: 324195 - DNA, 16 bp, C. familiaris
gtggagaaactggaat

SEQ ID NO: 324196 - DNA, 16 bp, C. familiaris
gtggagaaattgaaat

SEQ ID NO: 324197 - DNA, 16 bp, C. familiaris
gtggagagagtggaca

SEQ ID NO: 324198 - DNA, 16 bp, C. familiaris
gtggagattgcttaaa

SEQ ID NO: 324199 - DNA, 16 bp, C. familiaris
gtggagcacctggctg

SEQ ID NO: 324200 - DNA, 16 bp, C. familiaris
gtggagcatctgccct

SEQ ID NO: 324201 - DNA, 16 bp, C. familiaris
gtggaggagacagaca

SEQ ID NO: 324202 - DNA, 16 bp, C. familiaris
gtggaggagaggcaga

SEQ ID NO: 324203 - DNA, 16 bp, C. familiaris
gtggaggaggaggcag

SEQ ID NO: 324204 - DNA, 16 bp, C. familiaris
gtggaggctgcttctc

SEQ ID NO: 324205 - DNA, 16 bp, C. familiaris
gtggagggagcctcag

SEQ ID NO: 324206 - DNA, 16 bp, C. familiaris
gtggaggtgaaggacc

SEQ ID NO: 324207 - DNA, 16 bp, C. familiaris
gtggaggtggtgacag

SEQ ID NO: 324208 - DNA, 16 bp, C. familiaris
gtggaggttaaagacc

SEQ ID NO: 324209 - DNA, 17 bp, C. familiaris
gtggagtccactggggt

SEQ ID NO: 324210 - DNA, 16 bp, C. familiaris
gtggagtgtgcgactc

SEQ ID NO: 324211 - DNA, 16 bp, C. familiaris
gtggagtgtgtgactc

SEQ ID NO: 324212 - DNA, 16 bp, C. familiaris
gtggataaagaagatg

SEQ ID NO: 324213 - DNA, 16 bp, C. familiaris
gtggatgagtgtctgc

SEQ ID NO: 324214 - DNA, 16 bp, C. familiaris
gtggatgatgtccaag

SEQ ID NO: 324215 - DNA, 16 bp, C. familiaris
gtggatgcaactggag

SEQ ID NO: 324216 - DNA, 16 bp, C. familiaris
gtggatggaactgagg

SEQ ID NO: 324217 - DNA, 16 bp, C. familiaris
gtggatggatggatgg

SEQ ID NO: 324218 - DNA, 16 bp, C. familiaris
gtggatgtaccacagt

SEQ ID NO: 324219 - DNA, 16 bp, C. familiaris
gtggcacagtggttga

SEQ ID NO: 324220 - DNA, 16 bp, C. familiaris
gtggcacctggctggc

SEQ ID NO: 324221 - DNA, 16 bp, C. familiaris
gtggcagaaggagaag

SEQ ID NO: 324222 - DNA, 16 bp, C. familiaris
gtggcagagctgggac

SEQ ID NO: 324223 - DNA, 16 bp, C. familiaris
gtggcagagggaaagg

SEQ ID NO: 324224 - DNA, 16 bp, C. familiaris
gtggcagcctgggtgg

SEQ ID NO: 324225 - DNA, 16 bp, C. familiaris
gtggcagggaggggca

SEQ ID NO: 324226 - DNA, 29 bp, C. familiaris
gtggcagggcctagctgctacaaagaaga

SEQ ID NO: 324227 - DNA, 23 bp, C. familiaris
gtggcagtcgaggtggtggtgga

SEQ ID NO: 324228 - DNA, 16 bp, C. familiaris
gtggcagtggcagtgg

SEQ ID NO: 324229 - DNA, 16 bp, C. familiaris
gtggcagtggggatgg

SEQ ID NO: 324230 - DNA, 16 bp, C. familiaris
gtggcatctcattgtt

SEQ ID NO: 324231 - DNA, 28 bp, C. familiaris
gtggcattaaagaagacactgaagaaca

SEQ ID NO: 324232 - DNA, 16 bp, C. familiaris
gtggccaaagctggaa

SEQ ID NO: 324233 - DNA, 16 bp, C. familiaris
gtggccaacaggcaca

SEQ ID NO: 324234 - DNA, 16 bp, C. familiaris
gtggccaagttcaaga

SEQ ID NO: 324235 - DNA, 16 bp, C. familiaris
gtggccaggcctgggg

SEQ ID NO: 324236 - DNA, 16 bp, C. familiaris
gtggcccagcagtttg

SEQ ID NO: 324237 - DNA, 16 bp, C. familiaris
gtggccccagggctcc

SEQ ID NO: 324238 - DNA, 16 bp, C. familiaris
gtggccttggacaaat

SEQ ID NO: 324239 - DNA, 16 bp, C. familiaris
gtggccttgggcaaat

SEQ ID NO: 324240 - DNA, 16 bp, C. familiaris
gtggcctttgtgtctg

SEQ ID NO: 324241 - DNA, 16 bp, C. familiaris
gtggctaccatattgg

SEQ ID NO: 324242 - DNA, 16 bp, C. familiaris
gtggctactgagcact

SEQ ID NO: 324243 - DNA, 16 bp, C. familiaris
gtggctagtggctacc

SEQ ID NO: 324244 - DNA, 16 bp, C. familiaris
gtggctcagctggctg

SEQ ID NO: 324245 - DNA, 16 bp, C. familiaris
gtggctctgtggttta

SEQ ID NO: 324246 - DNA, 16 bp, C. familiaris
gtggctgcacagtttg

SEQ ID NO: 324247 - DNA, 16 bp, C. familiaris
gtggctgcaccagttg

SEQ ID NO: 324248 - DNA, 16 bp, C. familiaris
gtggctgctgctgctg

SEQ ID NO: 324249 - DNA, 16 bp, C. familiaris
gtggctggctcagtgg

SEQ ID NO: 324250 - DNA, 16 bp, C. familiaris
gtggctggctggctgg

SEQ ID NO: 324251 - DNA, 16 bp, C. familiaris
gtggctggtcctggag

SEQ ID NO: 324252 - DNA, 16 bp, C. familiaris
gtggctgtgtgccaat

SEQ ID NO: 324253 - DNA, 16 bp, C. familiaris
gtggcttaatggttta

SEQ ID NO: 324254 - DNA, 16 bp, C. familiaris
gtggcttacaaacaac

SEQ ID NO: 324255 - DNA, 16 bp, C. familiaris
gtggcttagtgtttga

SEQ ID NO: 324256 - DNA, 16 bp, C. familiaris
gtgggaagaggcagag

SEQ ID NO: 324257 - DNA, 16 bp, C. familiaris
gtgggaatgcaaacag

SEQ ID NO: 324258 - DNA, 16 bp, C. familiaris
gtgggaattcaaactg

SEQ ID NO: 324259 - DNA, 16 bp, C. familiaris
gtgggacactatccca

SEQ ID NO: 324260 - DNA, 16 bp, C. familiaris
gtgggactcgatgctg

SEQ ID NO: 324261 - DNA, 16 bp, C. familiaris
gtgggactgagccctg

SEQ ID NO: 324262 - DNA, 16 bp, C. familiaris
gtgggagaagaggcag

SEQ ID NO: 324263 - DNA, 16 bp, C. familiaris
gtgggagaaggagcag

SEQ ID NO: 324264 - DNA, 16 bp, C. familiaris
gtgggaggtacaggct

SEQ ID NO: 324265 - DNA, 16 bp, C. familiaris
gtgggcaaggatgtgg

SEQ ID NO: 324266 - DNA, 16 bp, C. familiaris
gtgggctccacactca

SEQ ID NO: 324267 - DNA, 16 bp, C. familiaris
gtgggctccctgcagg

SEQ ID NO: 324268 - DNA, 16 bp, C. familiaris
gtggggaaattggaac

SEQ ID NO: 324269 - DNA, 16 bp, C. familiaris
gtggggagcagaggga

SEQ ID NO: 324270 - DNA, 16 bp, C. familiaris
gtggggagcctgacat

SEQ ID NO: 324271 - DNA, 16 bp, C. familiaris
gtggggaggctgatgc

SEQ ID NO: 324272 - DNA, 16 bp, C. familiaris
gtggggagggagaagc

SEQ ID NO: 324273 - DNA, 16 bp, C. familiaris
gtggggcacctggtgg

SEQ ID NO: 324274 - DNA, 16 bp, C. familiaris
gtggggccagctctgg

SEQ ID NO: 324275 - DNA, 16 bp, C. familiaris
gtggggcccctgggtg

SEQ ID NO: 324276 - DNA, 16 bp, C. familiaris
gtggggcctgatctca

SEQ ID NO: 324277 - DNA, 16 bp, C. familiaris
gtggggctcctggctg

SEQ ID NO: 324278 - DNA, 16 bp, C. familiaris
gtggggctcgagccca

SEQ ID NO: 324279 - DNA, 16 bp, C. familiaris
gtggggctgatcccag

SEQ ID NO: 324280 - DNA, 16 bp, C. familiaris
gtggggctggaactca

SEQ ID NO: 324281 - DNA, 16 bp, C. familiaris
gtgggggaggggccct

SEQ ID NO: 324282 - DNA, 16 bp, C. familiaris
gtgggggcagccccgg

SEQ ID NO: 324283 - DNA, 16 bp, C. familiaris
gtggggggcagaggaa

SEQ ID NO: 324284 - DNA, 16 bp, C. familiaris
gtggggggcagcctgg

SEQ ID NO: 324285 - DNA, 16 bp, C. familiaris
gtgggggtgacgggca

SEQ ID NO: 324286 - DNA, 16 bp, C. familiaris
gtggtaaatacccagt

SEQ ID NO: 324287 - DNA, 16 bp, C. familiaris
gtggtaagaatactta

SEQ ID NO: 324288 - DNA, 16 bp, C. familiaris
gtggtacctgggtggc

SEQ ID NO: 324289 - DNA, 16 bp, C. familiaris
gtggtagggcaggtct

SEQ ID NO: 324290 - DNA, 16 bp, C. familiaris
gtggtattggcaaaag

SEQ ID NO: 324291 - DNA, 16 bp, C. familiaris
gtggtattgtaatagc

SEQ ID NO: 324292 - DNA, 16 bp, C. familiaris
gtggtcatggtggtgg

SEQ ID NO: 324293 - DNA, 16 bp, C. familiaris
gtggtcctggagaccc

SEQ ID NO: 324294 - DNA, 16 bp, C. familiaris
gtggtcctggagttcc

SEQ ID NO: 324295 - DNA, 16 bp, C. familiaris
gtggtcctggggaccc

SEQ ID NO: 324296 - DNA, 16 bp, C. familiaris
gtggtcttgggcaagt

SEQ ID NO: 324297 - DNA, 16 bp, C. familiaris
gtggtgaaagaattca

SEQ ID NO: 324298 - DNA, 16 bp, C. familiaris
gtggtgagcctgatgt

SEQ ID NO: 324299 - DNA, 16 bp, C. familiaris
gtggtgaggaagtggt

SEQ ID NO: 324300 - DNA, 16 bp, C. familiaris
gtggtgaggggcagag

SEQ ID NO: 324301 - DNA, 16 bp, C. familiaris
gtggtgatggttgtac

SEQ ID NO: 324302 - DNA, 16 bp, C. familiaris
gtggtgcagagggaga

SEQ ID NO: 324303 - DNA, 16 bp, C. familiaris
gtggtgcaggtgtccc

SEQ ID NO: 324304 - DNA, 16 bp, C. familiaris
gtggtggcagcagcag

SEQ ID NO: 324305 - DNA, 16 bp, C. familiaris
gtggtggcagcagtgg

SEQ ID NO: 324306 - DNA, 16 bp, C. familiaris
gtggtggcagtggcag

SEQ ID NO: 324307 - DNA, 16 bp, C. familiaris
gtggtggcagtgggga

SEQ ID NO: 324308 - DNA, 16 bp, C. familiaris
gtggtggtctggaacc

SEQ ID NO: 324309 - DNA, 16 bp, C. familiaris
gtggtggtggaggcag

SEQ ID NO: 324310 - DNA, 17 bp, C. familiaris
gtggtggtggatacggt

SEQ ID NO: 324311 - DNA, 16 bp, C. familiaris
gtggtggtggcagagg

SEQ ID NO: 324312 - DNA, 16 bp, C. familiaris
gtggtggtggcaggga

SEQ ID NO: 324313 - DNA, 16 bp, C. familiaris
gtggtggtggtaatga

SEQ ID NO: 324314 - DNA, 16 bp, C. familiaris
gtggtggtggtgacaa

SEQ ID NO: 324315 - DNA, 16 bp, C. familiaris
gtggtggtggtggaaa

SEQ ID NO: 324316 - DNA, 16 bp, C. familiaris
gtggtgtctttatctg

SEQ ID NO: 324317 - DNA, 16 bp, C. familiaris
gtggttcagtgtctgc

SEQ ID NO: 324318 - DNA, 16 bp, C. familiaris
gtggttcattggttga

SEQ ID NO: 324319 - DNA, 16 bp, C. familiaris
gtggttgaacttctgc

SEQ ID NO: 324320 - DNA, 16 bp, C. familiaris
gtggttgccagaggag

SEQ ID NO: 324321 - DNA, 16 bp, C. familiaris
gtggttgccagaggga

SEQ ID NO: 324322 - DNA, 16 bp, C. familiaris
gtggttggcaggggct

SEQ ID NO: 324323 - DNA, 16 bp, C. familiaris
gtggttgggcatttgc

SEQ ID NO: 324324 - DNA, 16 bp, C. familiaris
gtggtttccagaggct

SEQ ID NO: 324325 - DNA, 16 bp, C. familiaris
gtggtttggtgcctgt

SEQ ID NO: 324326 - DNA, 16 bp, C. familiaris
gtggtttgttacacag

SEQ ID NO: 324327 - DNA, 16 bp, C. familiaris
gtggttttattaaagc

SEQ ID NO: 324328 - DNA, 16 bp, C. familiaris
gtggttttccaggaat

SEQ ID NO: 324329 - DNA, 16 bp, C. familiaris
gtggttttgatttgca

SEQ ID NO: 324330 - DNA, 16 bp, C. familiaris
gtggtttttgatgact

SEQ ID NO: 324331 - DNA, 16 bp, C. familiaris
gtgtaaaattcagtgg

SEQ ID NO: 324332 - DNA, 16 bp, C. familiaris
gtgtacaatatggtga

SEQ ID NO: 324333 - DNA, 16 bp, C. familiaris
gtgtacaatgtgttga

SEQ ID NO: 324334 - DNA, 16 bp, C. familiaris
gtgtacagttctgtgg

SEQ ID NO: 324335 - DNA, 16 bp, C. familiaris
gtgtacatttcagtgg

SEQ ID NO: 324336 - DNA, 16 bp, C. familiaris
gtgtagggctcaaact

SEQ ID NO: 324337 - DNA, 16 bp, C. familiaris
gtgtataattgttcat

SEQ ID NO: 324338 - DNA, 16 bp, C. familiaris
gtgtatgacatagtga

SEQ ID NO: 324339 - DNA, 16 bp, C. familiaris
gtgtattcttggcacc

SEQ ID NO: 324340 - DNA, 16 bp, C. familiaris
gtgtcaggctcccggc

SEQ ID NO: 324341 - DNA, 16 bp, C. familiaris
gtgtcatatcaaaaaa

SEQ ID NO: 324342 - DNA, 16 bp, C. familiaris
gtgtcatatgcaactg

SEQ ID NO: 324343 - DNA, 16 bp, C. familiaris
gtgtcccccagtgccc

SEQ ID NO: 324344 - DNA, 16 bp, C. familiaris
gtgtcccctggcgccc

SEQ ID NO: 324345 - DNA, 16 bp, C. familiaris
gtgtcctcctcagtgc

SEQ ID NO: 324346 - DNA, 16 bp, C. familiaris
gtgtcgggctcccggc

SEQ ID NO: 324347 - DNA, 16 bp, C. familiaris
gtgtctatcaatggat

SEQ ID NO: 324348 - DNA, 16 bp, C. familiaris
gtgtctctcaggaaaa

SEQ ID NO: 324349 - DNA, 16 bp, C. familiaris
gtgtctctcatggatg

SEQ ID NO: 324350 - DNA, 16 bp, C. familiaris
gtgtctctgcaccccc

SEQ ID NO: 324351 - DNA, 16 bp, C. familiaris
gtgtctctgcccccca

SEQ ID NO: 324352 - DNA, 16 bp, C. familiaris
gtgtctctgcccttct

SEQ ID NO: 324353 - DNA, 16 bp, C. familiaris
gtgtctgccctcggct

SEQ ID NO: 324354 - DNA, 16 bp, C. familiaris
gtgtctgccttcacct

SEQ ID NO: 324355 - DNA, 16 bp, C. familiaris
gtgtctgccttcggct

SEQ ID NO: 324356 - DNA, 16 bp, C. familiaris
gtgtctgcttctctct

SEQ ID NO: 324357 - DNA, 16 bp, C. familiaris
gtgtctgtctttatgc

SEQ ID NO: 324358 - DNA, 16 bp, C. familiaris
gtgtctgtgagagtgt

SEQ ID NO: 324359 - DNA, 16 bp, C. familiaris
gtgtctgtgagtgtgt

SEQ ID NO: 324360 - DNA, 16 bp, C. familiaris
gtgtctgtgtgtatgc

SEQ ID NO: 324361 - DNA, 16 bp, C. familiaris
gtgtcttgggaagttt

SEQ ID NO: 324362 - DNA, 16 bp, C. familiaris
gtgtgaactggtgcag

SEQ ID NO: 324363 - DNA, 16 bp, C. familiaris
gtgtgaccttgagcag

SEQ ID NO: 324364 - DNA, 16 bp, C. familiaris
gtgtgatgttagctgt

SEQ ID NO: 324365 - DNA, 16 bp, C. familiaris
gtgtgattgctgggtc

SEQ ID NO: 324366 - DNA, 16 bp, C. familiaris
gtgtgcatgtatacat

SEQ ID NO: 324367 - DNA, 16 bp, C. familiaris
gtgtgcatgtgagcag

SEQ ID NO: 324368 - DNA, 16 bp, C. familiaris
gtgtgcctatgtgtgt

SEQ ID NO: 324369 - DNA, 16 bp, C. familiaris
gtgtggagcctgatgc

SEQ ID NO: 324370 - DNA, 16 bp, C. familiaris
gtgtggagggtcctca

SEQ ID NO: 324371 - DNA, 16 bp, C. familiaris
gtgtggagtctgcctg

SEQ ID NO: 324372 - DNA, 16 bp, C. familiaris
gtgtggccttcagccc

SEQ ID NO: 324373 - DNA, 16 bp, C. familiaris
gtgtggctactgtgga

SEQ ID NO: 324374 - DNA, 16 bp, C. familiaris
gtgtggctgtgttcca

SEQ ID NO: 324375 - DNA, 16 bp, C. familiaris
gtgtggctgtgttcta

SEQ ID NO: 324376 - DNA, 16 bp, C. familiaris
gtgtggggcctgaact

SEQ ID NO: 324377 - DNA, 16 bp, C. familiaris
gtgtgtctcttctgaa

SEQ ID NO: 324378 - DNA, 16 bp, C. familiaris
gtgtgtctgtgtgtac

SEQ ID NO: 324379 - DNA, 16 bp, C. familiaris
gtgtgtctgtgtgtgc

SEQ ID NO: 324380 - DNA, 16 bp, C. familiaris
gtgtgtgacattcctc

SEQ ID NO: 324381 - DNA, 16 bp, C. familiaris
gtgtgtgagagggaga

SEQ ID NO: 324382 - DNA, 16 bp, C. familiaris
gtgtgtgcacgtgtgt

SEQ ID NO: 324383 - DNA, 16 bp, C. familiaris
gtgtgtgcagggggag

SEQ ID NO: 324384 - DNA, 16 bp, C. familiaris
gtgtgtgcaggtgtgt

SEQ ID NO: 324385 - DNA, 16 bp, C. familiaris
gtgtgtgcatctgtgc

SEQ ID NO: 324386 - DNA, 16 bp, C. familiaris
gtgtgtgtatgtacat

SEQ ID NO: 324387 - DNA, 16 bp, C. familiaris
gtgtgtgtatgtatat

SEQ ID NO: 324388 - DNA, 16 bp, C. familiaris
gtgtgtgtcagagaga

SEQ ID NO: 324389 - DNA, 16 bp, C. familiaris
gtgtgtgtgatcctgg

SEQ ID NO: 324390 - DNA, 16 bp, C. familiaris
gtgtgtgtggcagggg

SEQ ID NO: 324391 - DNA, 16 bp, C. familiaris
gtgtgtgtgtacatca

SEQ ID NO: 324392 - DNA, 16 bp, C. familiaris
gtgtgtgtgtatcatt

SEQ ID NO: 324393 - DNA, 16 bp, C. familiaris
gtgtgtgtgtatgaca

SEQ ID NO: 324394 - DNA, 16 bp, C. familiaris
gtgtgtgtgtatgtgc

SEQ ID NO: 324395 - DNA, 16 bp, C. familiaris
gtgtgtgtgtcatgag

SEQ ID NO: 324396 - DNA, 16 bp, C. familiaris
gtgtgtgtgtccctct

SEQ ID NO: 324397 - DNA, 16 bp, C. familiaris
gtgtgtgtgtccgtgt

SEQ ID NO: 324398 - DNA, 16 bp, C. familiaris
gtgtgtgtgtctcttg

SEQ ID NO: 324399 - DNA, 16 bp, C. familiaris
gtgtgtgtgtgacctg

SEQ ID NO: 324400 - DNA, 16 bp, C. familiaris
gtgtgtgtgtgagcac

SEQ ID NO: 324401 - DNA, 16 bp, C. familiaris
gtgtgtgtgtgatgag

SEQ ID NO: 324402 - DNA, 16 bp, C. familiaris
gtgtgtgtgtgatgtc

SEQ ID NO: 324403 - DNA, 16 bp, C. familiaris
gtgtgtgtgtgcacgc

SEQ ID NO: 324404 - DNA, 16 bp, C. familiaris
gtgtgtgtgtgcaggc

SEQ ID NO: 324405 - DNA, 16 bp, C. familiaris
gtgtgtgtgtggcttc

SEQ ID NO: 324406 - DNA, 16 bp, C. familiaris
gtgtgtgtgtgtctgc

SEQ ID NO: 324407 - DNA, 16 bp, C. familiaris
gtgtgtgtgtgtgcac

SEQ ID NO: 324408 - DNA, 16 bp, C. familiaris
gtgtgtgtgtgtgcag

SEQ ID NO: 324409 - DNA, 16 bp, C. familiaris
gtgtgtgtgtgtgcgc

SEQ ID NO: 324410 - DNA, 16 bp, C. familiaris
gtgtgtgtgtgtgcta

SEQ ID NO: 324411 - DNA, 16 bp, C. familiaris
gtgtgtgtttttaaaa

SEQ ID NO: 324412 - DNA, 16 bp, C. familiaris
gtgttcagcacagagt

SEQ ID NO: 324413 - DNA, 16 bp, C. familiaris
gtgttccaggcagaag

SEQ ID NO: 324414 - DNA, 16 bp, C. familiaris
gtgttcttataagaga

SEQ ID NO: 324415 - DNA, 16 bp, C. familiaris
gttaaaaatagatttg

SEQ ID NO: 324416 - DNA, 16 bp, C. familiaris
gttaaaatggctaaaa

SEQ ID NO: 324417 - DNA, 16 bp, C. familiaris
gttaagggtctgcctt

SEQ ID NO: 324418 - DNA, 16 bp, C. familiaris
gttaataaagttcttt

SEQ ID NO: 324419 - DNA, 16 bp, C. familiaris
gttaatatcaaaatat

SEQ ID NO: 324420 - DNA, 16 bp, C. familiaris
gttacaaatatggaaa

SEQ ID NO: 324421 - DNA, 54 bp, C. familiaris
gttacaacagatttgtgaactcagccaagcacagtggtggcagggcctagctgc

SEQ ID NO: 324422 - DNA, 16 bp, C. familiaris
gttacagaaagacaaa

SEQ ID NO: 324423 - DNA, 16 bp, C. familiaris
gttacagtgagaagag

SEQ ID NO: 324424 - DNA, 16 bp, C. familiaris
gttacattctgaggta

SEQ ID NO: 324425 - DNA, 16 bp, C. familiaris
gttaccagaaaggagg

SEQ ID NO: 324426 - DNA, 16 bp, C. familiaris
gttaccagaaggaagg

SEQ ID NO: 324427 - DNA, 16 bp, C. familiaris
gttaccatctgtcacc

SEQ ID NO: 324428 - DNA, 16 bp, C. familiaris
gttactctgaatgtga

SEQ ID NO: 324429 - DNA, 16 bp, C. familiaris
gttagaaaagatgctt

SEQ ID NO: 324430 - DNA, 16 bp, C. familiaris
gttagaagaaactaca

SEQ ID NO: 324431 - DNA, 16 bp, C. familiaris
gttagatccccagaac

SEQ ID NO: 324432 - DNA, 16 bp, C. familiaris
gttatgaataaaactg

SEQ ID NO: 324433 - DNA, 16 bp, C. familiaris
gttatgatcccaggat

SEQ ID NO: 324434 - DNA, 16 bp, C. familiaris
gttatgcaagatgaat

SEQ ID NO: 324435 - DNA, 16 bp, C. familiaris
gttatggactaaatgt

SEQ ID NO: 324436 - DNA, 16 bp, C. familiaris
gttattgcaaatgaca

SEQ ID NO: 324437 - DNA, 16 bp, C. familiaris
gttcaaatcccagctc

SEQ ID NO: 324438 - DNA, 16 bp, C. familiaris
gttcaagggatggaaa

SEQ ID NO: 324439 - DNA, 16 bp, C. familiaris
gttcactgaagcatta

SEQ ID NO: 324440 - DNA, 16 bp, C. familiaris
gttcactttaagaaca

SEQ ID NO: 324441 - DNA, 16 bp, C. familiaris
gttcagaaaaggcaaa

SEQ ID NO: 324442 - DNA, 16 bp, C. familiaris
gttcagcatcactcat

SEQ ID NO: 324443 - DNA, 16 bp, C. familiaris
gttcaggacatgatcc

SEQ ID NO: 324444 - DNA, 16 bp, C. familiaris
gttcaggccctgggct

SEQ ID NO: 324445 - DNA, 16 bp, C. familiaris
gttcagggtgtggtcc

SEQ ID NO: 324446 - DNA, 16 bp, C. familiaris
gttcagtgccgccttc

SEQ ID NO: 324447 - DNA, 16 bp, C. familiaris
gttcatagcagtaatg

SEQ ID NO: 324448 - DNA, 16 bp, C. familiaris
gttcatcagagatact

SEQ ID NO: 324449 - DNA, 16 bp, C. familiaris
gttcattgattgtaac

SEQ ID NO: 324450 - DNA, 16 bp, C. familiaris
gttcattggggatatt

SEQ ID NO: 324451 - DNA, 16 bp, C. familiaris
gttccagggcacctgg

SEQ ID NO: 324452 - DNA, 16 bp, C. familiaris
gttcccaggaccctgg

SEQ ID NO: 324453 - DNA, 16 bp, C. familiaris
gttccccagaagcaga

SEQ ID NO: 324454 - DNA, 16 bp, C. familiaris
gttccctgctgaacag

SEQ ID NO: 324455 - DNA, 16 bp, C. familiaris
gttcccttatctctgg

SEQ ID NO: 324456 - DNA, 16 bp, C. familiaris
gttcctcaagaagcta

SEQ ID NO: 324457 - DNA, 16 bp, C. familiaris
gttcctgcaggtggcc

SEQ ID NO: 324458 - DNA, 16 bp, C. familiaris
gttcctgcctatcttg

SEQ ID NO: 324459 - DNA, 16 bp, C. familiaris
gttcctgctggtcttc

SEQ ID NO: 324460 - DNA, 18 bp, C. familiaris
gttcctggcaaacctatg

SEQ ID NO: 324461 - DNA, 16 bp, C. familiaris
gttccttacatatttt

SEQ ID NO: 324462 - DNA, 16 bp, C. familiaris
gttcgttaagtgtctg

SEQ ID NO: 324463 - DNA, 16 bp, C. familiaris
gttctcattttccttt

SEQ ID NO: 324464 - DNA, 16 bp, C. familiaris
gttctcctttctctgc

SEQ ID NO: 324465 - DNA, 16 bp, C. familiaris
gttctgcaagaaatat

SEQ ID NO: 324466 - DNA, 17 bp, C. familiaris
gttctgcatcgggctcc

SEQ ID NO: 324467 - DNA, 20 bp, C. familiaris
gttctggaaactttggtggt

SEQ ID NO: 324468 - DNA, 23 bp, C. familiaris
gttctggaaactttggtggtggt

SEQ ID NO: 324469 - DNA, 16 bp, C. familiaris
gttctggagcctggga

SEQ ID NO: 324470 - DNA, 16 bp, C. familiaris
gttctggaggctggaa

SEQ ID NO: 324471 - DNA, 16 bp, C. familiaris
gttctgtgaggccagc

SEQ ID NO: 324472 - DNA, 16 bp, C. familiaris
gttctgtggaaagtgt

SEQ ID NO: 324473 - DNA, 16 bp, C. familiaris
gttcttctggtctcca

SEQ ID NO: 324474 - DNA, 16 bp, C. familiaris
gttcttctttctcaga

SEQ ID NO: 324475 - DNA, 16 bp, C. familiaris
gttcttgctgtcctgt

SEQ ID NO: 324476 - DNA, 16 bp, C. familiaris
gttctttatacatttt

SEQ ID NO: 324477 - DNA, 16 bp, C. familiaris
gttgaaaatattgtaa

SEQ ID NO: 324478 - DNA, 16 bp, C. familiaris
gttgaaaatcttttca

SEQ ID NO: 324479 - DNA, 16 bp, C. familiaris
gttgaaaatgcattta

SEQ ID NO: 324480 - DNA, 16 bp, C. familiaris
gttgaaagaaattgaa

SEQ ID NO: 324481 - DNA, 16 bp, C. familiaris
gttgaaagtaaaagga

SEQ ID NO: 324482 - DNA, 16 bp, C. familiaris
gttgaaataaaaaagg

SEQ ID NO: 324483 - DNA, 16 bp, C. familiaris
gttgaagcagatggtg

SEQ ID NO: 324484 - DNA, 16 bp, C. familiaris
gttgaatatcttttta

SEQ ID NO: 324485 - DNA, 16 bp, C. familiaris
gttgagaatcttttca

SEQ ID NO: 324486 - DNA, 16 bp, C. familiaris
gttgatcatctgcctt

SEQ ID NO: 324487 - DNA, 16 bp, C. familiaris
gttgatggcaaggaag

SEQ ID NO: 324488 - DNA, 16 bp, C. familiaris
gttgatgggcattaag

SEQ ID NO: 324489 - DNA, 16 bp, C. familiaris
gttgcagagggagaag

SEQ ID NO: 324490 - DNA, 16 bp, C. familiaris
gttgccaggggctgga

SEQ ID NO: 324491 - DNA, 16 bp, C. familiaris
gttgccatggaaacag

SEQ ID NO: 324492 - DNA, 16 bp, C. familiaris
gttgccttcagcccag

SEQ ID NO: 324493 - DNA, 16 bp, C. familiaris
gttgccttcagctcag

SEQ ID NO: 324494 - DNA, 16 bp, C. familiaris
gttgctaaactgctga

SEQ ID NO: 324495 - DNA, 16 bp, C. familiaris
gttgctaaggctgatg

SEQ ID NO: 324496 - DNA, 16 bp, C. familiaris
gttgctgctgctgcta

SEQ ID NO: 324497 - DNA, 16 bp, C. familiaris
gttgctggagaggaga

SEQ ID NO: 324498 - DNA, 16 bp, C. familiaris
gttgctttcaagtttt

SEQ ID NO: 324499 - DNA, 16 bp, C. familiaris
gttggaaaaactggac

SEQ ID NO: 324500 - DNA, 16 bp, C. familiaris
gttggaaaagatgctt

SEQ ID NO: 324501 - DNA, 16 bp, C. familiaris
gttggaatcccagctc

SEQ ID NO: 324502 - DNA, 16 bp, C. familiaris
gttggatagatggatg

SEQ ID NO: 324503 - DNA, 16 bp, C. familiaris
gttggatgccttttat

SEQ ID NO: 324504 - DNA, 16 bp, C. familiaris
gttggattttatcaaa

SEQ ID NO: 324505 - DNA, 16 bp, C. familiaris
gttggcagtcatccca

SEQ ID NO: 324506 - DNA, 16 bp, C. familiaris
gttgggaaaagtggac

SEQ ID NO: 324507 - DNA, 16 bp, C. familiaris
gttgggctccacattc

SEQ ID NO: 324508 - DNA, 16 bp, C. familiaris
gttggggcagcctggg

SEQ ID NO: 324509 - DNA, 16 bp, C. familiaris
gttggtgatgatgtgg

SEQ ID NO: 324510 - DNA, 16 bp, C. familiaris
gttgtcacaaaaggca

SEQ ID NO: 324511 - DNA, 16 bp, C. familiaris
gttgtggaagaggagg

SEQ ID NO: 324512 - DNA, 16 bp, C. familiaris
gttgtggccaagttca

SEQ ID NO: 324513 - DNA, 16 bp, C. familiaris
gttgttaattttagct

SEQ ID NO: 324514 - DNA, 16 bp, C. familiaris
gttgtttaagatttta

SEQ ID NO: 324515 - DNA, 16 bp, C. familiaris
gtttaaaaacaacaac

SEQ ID NO: 324516 - DNA, 16 bp, C. familiaris
gtttaagaaattcttt

SEQ ID NO: 324517 - DNA, 16 bp, C. familiaris
gtttacatttccacca

SEQ ID NO: 324518 - DNA, 16 bp, C. familiaris
gtttagcaaataaaaa

SEQ ID NO: 324519 - DNA, 16 bp, C. familiaris
gtttagcacctgcctt

SEQ ID NO: 324520 - DNA, 16 bp, C. familiaris
gtttagtgcctgcctt

SEQ ID NO: 324521 - DNA, 16 bp, C. familiaris
gtttagtggtgatgaa

SEQ ID NO: 324522 - DNA, 16 bp, C. familiaris
gtttatcataaataaa

SEQ ID NO: 324523 - DNA, 16 bp, C. familiaris
gtttattgccaccttc

SEQ ID NO: 324524 - DNA, 16 bp, C. familiaris
gtttatttgaagaaat

SEQ ID NO: 324525 - DNA, 16 bp, C. familiaris
gtttcaaaaaacagaa

SEQ ID NO: 324526 - DNA, 16 bp, C. familiaris
gtttcaagtttttatt

SEQ ID NO: 324527 - DNA, 16 bp, C. familiaris
gtttcactgtatctgt

SEQ ID NO: 324528 - DNA, 16 bp, C. familiaris
gtttcagatgagaaat

SEQ ID NO: 324529 - DNA, 16 bp, C. familiaris
gtttcagctcaggcca

SEQ ID NO: 324530 - DNA, 16 bp, C. familiaris
gtttcatagcattgtg

SEQ ID NO: 324531 - DNA, 16 bp, C. familiaris
gtttcatccttttgca

SEQ ID NO: 324532 - DNA, 16 bp, C. familiaris
gtttcattcttgtgca

SEQ ID NO: 324533 - DNA, 16 bp, C. familiaris
gtttccaaaattcctt

SEQ ID NO: 324534 - DNA, 16 bp, C. familiaris
gtttccaggatcatgc

SEQ ID NO: 324535 - DNA, 16 bp, C. familiaris
gtttccatggaaacag

SEQ ID NO: 324536 - DNA, 16 bp, C. familiaris
gtttccctgttgattt

SEQ ID NO: 324537 - DNA, 16 bp, C. familiaris
gtttcctctgtgtctt

SEQ ID NO: 324538 - DNA, 16 bp, C. familiaris
gtttcctgagttctgt

SEQ ID NO: 324539 - DNA, 16 bp, C. familiaris
gtttctgaaaaaggaa

SEQ ID NO: 324540 - DNA, 16 bp, C. familiaris
gtttctgattcttttg

SEQ ID NO: 324541 - DNA, 16 bp, C. familiaris
gtttctggaaaaaaaa

SEQ ID NO: 324542 - DNA, 16 bp, C. familiaris
gtttcttccttaaacg

SEQ ID NO: 324543 - DNA, 16 bp, C. familiaris
gtttcttctctatagt

SEQ ID NO: 324544 - DNA, 16 bp, C. familiaris
gtttcttggtctctct

SEQ ID NO: 324545 - DNA, 16 bp, C. familiaris
gtttgacttcttcatt

SEQ ID NO: 324546 - DNA, 16 bp, C. familiaris
gtttgagattctccct

SEQ ID NO: 324547 - DNA, 16 bp, C. familiaris
gtttgagctttgaaac

SEQ ID NO: 324548 - DNA, 16 bp, C. familiaris
gtttgcagatgacatg

SEQ ID NO: 324549 - DNA, 16 bp, C. familiaris
gtttgctgacctctgt

SEQ ID NO: 324550 - DNA, 16 bp, C. familiaris
gtttgctggggctgct

SEQ ID NO: 324551 - DNA, 16 bp, C. familiaris
gtttgctttttaaaga

SEQ ID NO: 324552 - DNA, 16 bp, C. familiaris
gtttgggcagcccggg

SEQ ID NO: 324553 - DNA, 16 bp, C. familiaris
gtttggtgtctgtcat

SEQ ID NO: 324554 - DNA, 16 bp, C. familiaris
gtttgtctttgtgtat

SEQ ID NO: 324555 - DNA, 16 bp, C. familiaris
gtttgtgatctctcct

SEQ ID NO: 324556 - DNA, 16 bp, C. familiaris
gtttgtggctttccaa

SEQ ID NO: 324557 - DNA, 16 bp, C. familiaris
gttttaaagcctattt

SEQ ID NO: 324558 - DNA, 16 bp, C. familiaris
gttttatagcattgtg

SEQ ID NO: 324559 - DNA, 16 bp, C. familiaris
gttttatggtccagaa

SEQ ID NO: 324560 - DNA, 16 bp, C. familiaris
gttttatttctcaatt

SEQ ID NO: 324561 - DNA, 16 bp, C. familiaris
gttttcagcttttcac

SEQ ID NO: 324562 - DNA, 16 bp, C. familiaris
gttttcataataaaat

SEQ ID NO: 324563 - DNA, 16 bp, C. familiaris
gttttcatctgcattt

SEQ ID NO: 324564 - DNA, 16 bp, C. familiaris
gttttccagaaatgca

SEQ ID NO: 324565 - DNA, 16 bp, C. familiaris
gttttccctgacagaa

SEQ ID NO: 324566 - DNA, 16 bp, C. familiaris
gttttcctgggtctct

SEQ ID NO: 324567 - DNA, 16 bp, C. familiaris
gttttccttttcaata

SEQ ID NO: 324568 - DNA, 16 bp, C. familiaris
gttttctaatttctct

SEQ ID NO: 324569 - DNA, 16 bp, C. familiaris
gttttctcatcaataa

SEQ ID NO: 324570 - DNA, 16 bp, C. familiaris
gttttcttttaaaagt

SEQ ID NO: 324571 - DNA, 16 bp, C. familiaris
gttttcttttgaggac

SEQ ID NO: 324572 - DNA, 16 bp, C. familiaris
gttttcttttttaaaa

SEQ ID NO: 324573 - DNA, 16 bp, C. familiaris
gttttgagaattcttt

SEQ ID NO: 324574 - DNA, 16 bp, C. familiaris
gttttgaggagtactg

SEQ ID NO: 324575 - DNA, 16 bp, C. familiaris
gttttgataaggaatg

SEQ ID NO: 324576 - DNA, 16 bp, C. familiaris
gttttgatttccattt

SEQ ID NO: 324577 - DNA, 16 bp, C. familiaris
gttttgcagagtggct

SEQ ID NO: 324578 - DNA, 16 bp, C. familiaris
gttttgcagatgagaa

SEQ ID NO: 324579 - DNA, 16 bp, C. familiaris
gttttggaaattatga

SEQ ID NO: 324580 - DNA, 16 bp, C. familiaris
gttttggacatgttga

SEQ ID NO: 324581 - DNA, 16 bp, C. familiaris
gttttggaggtcacat

SEQ ID NO: 324582 - DNA, 16 bp, C. familiaris
gttttggcagtttgtg

SEQ ID NO: 324583 - DNA, 16 bp, C. familiaris
gttttgggatcaaggt

SEQ ID NO: 324584 - DNA, 16 bp, C. familiaris
gttttgggggaatcaa

SEQ ID NO: 324585 - DNA, 16 bp, C. familiaris
gttttggtggtcaatg

SEQ ID NO: 324586 - DNA, 16 bp, C. familiaris
gttttgttttcagatt

SEQ ID NO: 324587 - DNA, 16 bp, C. familiaris
gtttttacatttaaat

SEQ ID NO: 324588 - DNA, 16 bp, C. familiaris
gtttttatcaagaaag

SEQ ID NO: 324589 - DNA, 16 bp, C. familiaris
gtttttatgccagtac

SEQ ID NO: 324590 - DNA, 16 bp, C. familiaris
gtttttcattttcagt

SEQ ID NO: 324591 - DNA, 16 bp, C. familiaris
gtttttccccactgag

SEQ ID NO: 324592 - DNA, 16 bp, C. familiaris
gttttttggtggaatc

SEQ ID NO: 324593 - DNA, 16 bp, C. familiaris
taaaaaaaatctcaga

SEQ ID NO: 324594 - DNA, 16 bp, C. familiaris
taaaaaaatttcagaa

SEQ ID NO: 324595 - DNA, 16 bp, C. familiaris
taaaaaacagtatttt

SEQ ID NO: 324596 - DNA, 16 bp, C. familiaris
taaaaaagaaagcatt

SEQ ID NO: 324597 - DNA, 16 bp, C. familiaris
taaaaaagatgtgata

SEQ ID NO: 324598 - DNA, 16 bp, C. familiaris
taaaaaatactatgaa

SEQ ID NO: 324599 - DNA, 16 bp, C. familiaris
taaaaaatcctaagga

SEQ ID NO: 324600 - DNA, 16 bp, C. familiaris
taaaaaatgatgtttt

SEQ ID NO: 324601 - DNA, 16 bp, C. familiaris
taaaaaatgttctttt

SEQ ID NO: 324602 - DNA, 16 bp, C. familiaris
taaaaaatttgaacag

SEQ ID NO: 324603 - DNA, 16 bp, C. familiaris
taaaaacaatttcttt

SEQ ID NO: 324604 - DNA, 16 bp, C. familiaris
taaaaacattcacatt

SEQ ID NO: 324605 - DNA, 16 bp, C. familiaris
taaaaacatttccttt

SEQ ID NO: 324606 - DNA, 16 bp, C. familiaris
taaaaactatggaaca

SEQ ID NO: 324607 - DNA, 16 bp, C. familiaris
taaaaacttctatttt

SEQ ID NO: 324608 - DNA, 16 bp, C. familiaris
taaaaacttgaaatat

SEQ ID NO: 324609 - DNA, 16 bp, C. familiaris
taaaaacttgtttttt

SEQ ID NO: 324610 - DNA, 16 bp, C. familiaris
taaaaagaagacagag

SEQ ID NO: 324611 - DNA, 16 bp, C. familiaris
taaaaagaatgaggta

SEQ ID NO: 324612 - DNA, 16 bp, C. familiaris
taaaaagacaatccaa

SEQ ID NO: 324613 - DNA, 16 bp, C. familiaris
taaaaagattcataga

SEQ ID NO: 324614 - DNA, 16 bp, C. familiaris
taaaaagccaaaaacc

SEQ ID NO: 324615 - DNA, 16 bp, C. familiaris
taaaaagggtgaattt

SEQ ID NO: 324616 - DNA, 16 bp, C. familiaris
taaaaagtacattaaa

SEQ ID NO: 324617 - DNA, 16 bp, C. familiaris
taaaaagtatagaaca

SEQ ID NO: 324618 - DNA, 16 bp, C. familiaris
taaaaataaatgcaat

SEQ ID NO: 324619 - DNA, 16 bp, C. familiaris
taaaaataagatttct

SEQ ID NO: 324620 - DNA, 16 bp, C. familiaris
taaaaatcaatgaatt

SEQ ID NO: 324621 - DNA, 16 bp, C. familiaris
taaaaatcagattatt

SEQ ID NO: 324622 - DNA, 16 bp, C. familiaris
taaaaatcctttgtgc

SEQ ID NO: 324623 - DNA, 16 bp, C. familiaris
taaaaatctatttgaa

SEQ ID NO: 324624 - DNA, 16 bp, C. familiaris
taaaaatcttaagaaa

SEQ ID NO: 324625 - DNA, 16 bp, C. familiaris
taaaaatcttcccaca

SEQ ID NO: 324626 - DNA, 16 bp, C. familiaris
taaaaatgaaaaactt

SEQ ID NO: 324627 - DNA, 16 bp, C. familiaris
taaaaatgaacatatt

SEQ ID NO: 324628 - DNA, 16 bp, C. familiaris
taaaaatgaactcaaa

SEQ ID NO: 324629 - DNA, 16 bp, C. familiaris
taaaaatgaacttaaa

SEQ ID NO: 324630 - DNA, 16 bp, C. familiaris
taaaaatgacttattt

SEQ ID NO: 324631 - DNA, 16 bp, C. familiaris
taaaaatgagtatttt

SEQ ID NO: 324632 - DNA, 16 bp, C. familiaris
taaaaatgcttttaaa

SEQ ID NO: 324633 - DNA, 16 bp, C. familiaris
taaaaatggcaaaaga

SEQ ID NO: 324634 - DNA, 16 bp, C. familiaris
taaaaatgtaaatgtt

SEQ ID NO: 324635 - DNA, 16 bp, C. familiaris
taaaaatgtacacatt

SEQ ID NO: 324636 - DNA, 16 bp, C. familiaris
taaaaatgtgttttgt

SEQ ID NO: 324637 - DNA, 16 bp, C. familiaris
taaaaatgttaactat

SEQ ID NO: 324638 - DNA, 16 bp, C. familiaris
taaaaattacatttgt

SEQ ID NO: 324639 - DNA, 16 bp, C. familiaris
taaaaattactgaaaa

SEQ ID NO: 324640 - DNA, 16 bp, C. familiaris
taaaaattatgtgaat

SEQ ID NO: 324641 - DNA, 16 bp, C. familiaris
taaaaattccatttca

SEQ ID NO: 324642 - DNA, 16 bp, C. familiaris
taaaaattctaaaaga

SEQ ID NO: 324643 - DNA, 16 bp, C. familiaris
taaaaattggattatt

SEQ ID NO: 324644 - DNA, 16 bp, C. familiaris
taaaaatttttgaaga

SEQ ID NO: 324645 - DNA, 16 bp, C. familiaris
taaaacaaatttgttt

SEQ ID NO: 324646 - DNA, 16 bp, C. familiaris
taaaacaacacagatt

SEQ ID NO: 324647 - DNA, 16 bp, C. familiaris
taaaacaagtctcaaa

SEQ ID NO: 324648 - DNA, 16 bp, C. familiaris
taaaacacttagaaat

SEQ ID NO: 324649 - DNA, 16 bp, C. familiaris
taaaacagcaaaatac

SEQ ID NO: 324650 - DNA, 16 bp, C. familiaris
taaaacagcaagagaa

SEQ ID NO: 324651 - DNA, 16 bp, C. familiaris
taaaacatttagaaga

SEQ ID NO: 324652 - DNA, 16 bp, C. familiaris
taaaaccatataatgt

SEQ ID NO: 324653 - DNA, 16 bp, C. familiaris
taaaaccttcacccag

SEQ ID NO: 324654 - DNA, 16 bp, C. familiaris
taaaactgaggaaaaa

SEQ ID NO: 324655 - DNA, 16 bp, C. familiaris
taaaactttttaaaag

SEQ ID NO: 324656 - DNA, 16 bp, C. familiaris
taaaagaaattgagga

SEQ ID NO: 324657 - DNA, 16 bp, C. familiaris
taaaagaagccagtca

SEQ ID NO: 324658 - DNA, 16 bp, C. familiaris
taaaagaagttatttt

SEQ ID NO: 324659 - DNA, 16 bp, C. familiaris
taaaagaattcagaaa

SEQ ID NO: 324660 - DNA, 16 bp, C. familiaris
taaaagaatttctttt

SEQ ID NO: 324661 - DNA, 16 bp, C. familiaris
taaaagacatgaagag

SEQ ID NO: 324662 - DNA, 16 bp, C. familiaris
taaaagaccatgaaga

SEQ ID NO: 324663 - DNA, 16 bp, C. familiaris
taaaagcaaaggcaac

SEQ ID NO: 324664 - DNA, 16 bp, C. familiaris
taaaagcaggaaataa

SEQ ID NO: 324665 - DNA, 16 bp, C. familiaris
taaaagcattttaaaa

SEQ ID NO: 324666 - DNA, 16 bp, C. familiaris
taaaagctcagatgat

SEQ ID NO: 324667 - DNA, 16 bp, C. familiaris
taaaaggaagaaattt

SEQ ID NO: 324668 - DNA, 16 bp, C. familiaris
taaaaggaattatttt

SEQ ID NO: 324669 - DNA, 16 bp, C. familiaris
taaaaggatatttatt

SEQ ID NO: 324670 - DNA, 16 bp, C. familiaris
taaaaggcaaatttta

SEQ ID NO: 324671 - DNA, 16 bp, C. familiaris
taaaaggcaacctgtg

SEQ ID NO: 324672 - DNA, 16 bp, C. familiaris
taaaaggttttctttt

SEQ ID NO: 324673 - DNA, 16 bp, C. familiaris
taaaagtacttttaaa

SEQ ID NO: 324674 - DNA, 16 bp, C. familiaris
taaaagtttctttaaa

SEQ ID NO: 324675 - DNA, 16 bp, C. familiaris
taaaataaaaggtttt

SEQ ID NO: 324676 - DNA, 16 bp, C. familiaris
taaaataacttgccca

SEQ ID NO: 324677 - DNA, 16 bp, C. familiaris
taaaatactcagtaaa

SEQ ID NO: 324678 - DNA, 16 bp, C. familiaris
taaaatacttgaaaat

SEQ ID NO: 324679 - DNA, 16 bp, C. familiaris
taaaatagaattttac

SEQ ID NO: 324680 - DNA, 16 bp, C. familiaris
taaaatagactttttt

SEQ ID NO: 324681 - DNA, 16 bp, C. familiaris
taaaatagtttttctt

SEQ ID NO: 324682 - DNA, 16 bp, C. familiaris
taaaatatacatgtat

SEQ ID NO: 324683 - DNA, 16 bp, C. familiaris
taaaatattgctaaaa

SEQ ID NO: 324684 - DNA, 16 bp, C. familiaris
taaaatatttaggaat

SEQ ID NO: 324685 - DNA, 16 bp, C. familiaris
taaaatcagattattt

SEQ ID NO: 324686 - DNA, 16 bp, C. familiaris
taaaatcatcatcatc

SEQ ID NO: 324687 - DNA, 16 bp, C. familiaris
taaaatcatcctgaaa

SEQ ID NO: 324688 - DNA, 16 bp, C. familiaris
taaaatccctagaaga

SEQ ID NO: 324689 - DNA, 16 bp, C. familiaris
taaaatccctttttaa

SEQ ID NO: 324690 - DNA, 16 bp, C. familiaris
taaaatctactctctt

SEQ ID NO: 324691 - DNA, 16 bp, C. familiaris
taaaatctcattttct

SEQ ID NO: 324692 - DNA, 16 bp, C. familiaris
taaaatctcttaaaat

SEQ ID NO: 324693 - DNA, 16 bp, C. familiaris
taaaatctgttaaaaa

SEQ ID NO: 324694 - DNA, 16 bp, C. familiaris
taaaatcttaaaactt

SEQ ID NO: 324695 - DNA, 16 bp, C. familiaris
taaaatcttaaataga

SEQ ID NO: 324696 - DNA, 16 bp, C. familiaris
taaaatcttaagagaa

SEQ ID NO: 324697 - DNA, 16 bp, C. familiaris
taaaatctttaaagtt

SEQ ID NO: 324698 - DNA, 16 bp, C. familiaris
taaaatctttagaaag

SEQ ID NO: 324699 - DNA, 16 bp, C. familiaris
taaaatctttagaaat

SEQ ID NO: 324700 - DNA, 16 bp, C. familiaris
taaaatgaacaactca

SEQ ID NO: 324701 - DNA, 16 bp, C. familiaris
taaaatgaattttgaa

SEQ ID NO: 324702 - DNA, 16 bp, C. familiaris
taaaatgagaaaatgt

SEQ ID NO: 324703 - DNA, 16 bp, C. familiaris
taaaatgagtttggag

SEQ ID NO: 324704 - DNA, 16 bp, C. familiaris
taaaatgcaaattctg

SEQ ID NO: 324705 - DNA, 16 bp, C. familiaris
taaaatgcatgttttt

SEQ ID NO: 324706 - DNA, 16 bp, C. familiaris
taaaatgcttttcaaa

SEQ ID NO: 324707 - DNA, 16 bp, C. familiaris
taaaatggacaaaaga

SEQ ID NO: 324708 - DNA, 16 bp, C. familiaris
taaaatggggaaataa

SEQ ID NO: 324709 - DNA, 16 bp, C. familiaris
taaaatgtaaatgtca

SEQ ID NO: 324710 - DNA, 16 bp, C. familiaris
taaaatgtatgcattt

SEQ ID NO: 324711 - DNA, 16 bp, C. familiaris
taaaatgtgacacaga

SEQ ID NO: 324712 - DNA, 16 bp, C. familiaris
taaaatgttgaaagaa

SEQ ID NO: 324713 - DNA, 16 bp, C. familiaris
taaaatgtttctcttt

SEQ ID NO: 324714 - DNA, 16 bp, C. familiaris
taaaattaagcatttt

SEQ ID NO: 324715 - DNA, 16 bp, C. familiaris
taaaattagaattacc

SEQ ID NO: 324716 - DNA, 16 bp, C. familiaris
taaaattagtattttc

SEQ ID NO: 324717 - DNA, 16 bp, C. familiaris
taaaattataaaagca

SEQ ID NO: 324718 - DNA, 16 bp, C. familiaris
taaaattatctccatt

SEQ ID NO: 324719 - DNA, 16 bp, C. familiaris
taaaattattttcatg

SEQ ID NO: 324720 - DNA, 16 bp, C. familiaris
taaaattcaagcagaa

SEQ ID NO: 324721 - DNA, 16 bp, C. familiaris
taaaattcagaaaata

SEQ ID NO: 324722 - DNA, 16 bp, C. familiaris
taaaattctgaaaaat

SEQ ID NO: 324723 - DNA, 16 bp, C. familiaris
taaaattctgttgttt

SEQ ID NO: 324724 - DNA, 16 bp, C. familiaris
taaaattcttctaaaa

SEQ ID NO: 324725 - DNA, 16 bp, C. familiaris
taaaatttaaaaagca

SEQ ID NO: 324726 - DNA, 16 bp, C. familiaris
taaaatttatacagaa

SEQ ID NO: 324727 - DNA, 16 bp, C. familiaris
taaaatttatgtggaa

SEQ ID NO: 324728 - DNA, 16 bp, C. familiaris
taaaatttccaatatt

SEQ ID NO: 324729 - DNA, 16 bp, C. familiaris
taaaatttccagaaaa

SEQ ID NO: 324730 - DNA, 16 bp, C. familiaris
taaaatttgtttcttt

SEQ ID NO: 324731 - DNA, 16 bp, C. familiaris
taaaatttgtttgaaa

SEQ ID NO: 324732 - DNA, 16 bp, C. familiaris
taaaattttcacattt

SEQ ID NO: 324733 - DNA, 16 bp, C. familiaris
taaaattttggtttaa

SEQ ID NO: 324734 - DNA, 16 bp, C. familiaris
taaacaaaatctttca

SEQ ID NO: 324735 - DNA, 16 bp, C. familiaris
taaacaaactatggta

SEQ ID NO: 324736 - DNA, 16 bp, C. familiaris
taaacaacatttattt

SEQ ID NO: 324737 - DNA, 16 bp, C. familiaris
taaacaagtaaaatct

SEQ ID NO: 324738 - DNA, 16 bp, C. familiaris
taaacaatagacattt

SEQ ID NO: 324739 - DNA, 16 bp, C. familiaris
taaacatttgaaagaa

SEQ ID NO: 324740 - DNA, 16 bp, C. familiaris
taaacatttggaaaaa

SEQ ID NO: 324741 - DNA, 16 bp, C. familiaris
taaacatttgtgtaca

SEQ ID NO: 324742 - DNA, 16 bp, C. familiaris
taaaccagaaatactt

SEQ ID NO: 324743 - DNA, 16 bp, C. familiaris
taaactgctgatccac

SEQ ID NO: 324744 - DNA, 16 bp, C. familiaris
taaactggattttttt

SEQ ID NO: 324745 - DNA, 16 bp, C. familiaris
taaagaaaaactttaa

SEQ ID NO: 324746 - DNA, 16 bp, C. familiaris
taaagaaaaaggaact

SEQ ID NO: 324747 - DNA, 16 bp, C. familiaris
taaagaaaataattct

SEQ ID NO: 324748 - DNA, 16 bp, C. familiaris
taaagaaacaagagct

SEQ ID NO: 324749 - DNA, 16 bp, C. familiaris
taaagaaactgaggca

SEQ ID NO: 324750 - DNA, 16 bp, C. familiaris
taaagaaagatgtggt

SEQ ID NO: 324751 - DNA, 16 bp, C. familiaris
taaagaaagattttat

SEQ ID NO: 324752 - DNA, 16 bp, C. familiaris
taaagaaataacattt

SEQ ID NO: 324753 - DNA, 16 bp, C. familiaris
taaagaaatgaaatct

SEQ ID NO: 324754 - DNA, 16 bp, C. familiaris
taaagaaatttctttt

SEQ ID NO: 324755 - DNA, 16 bp, C. familiaris
taaagaacacttaaaa

SEQ ID NO: 324756 - DNA, 16 bp, C. familiaris
taaagaactcctacaa

SEQ ID NO: 324757 - DNA, 16 bp, C. familiaris
taaagaactcttgcaa

SEQ ID NO: 324758 - DNA, 16 bp, C. familiaris
taaagaacttccagga

SEQ ID NO: 324759 - DNA, 16 bp, C. familiaris
taaagaactttcaaaa

SEQ ID NO: 324760 - DNA, 16 bp, C. familiaris
taaagaagaagtggtg

SEQ ID NO: 324761 - DNA, 16 bp, C. familiaris
taaagaagatacagaa

SEQ ID NO: 324762 - DNA, 16 bp, C. familiaris
taaagaagatgtgata

SEQ ID NO: 324763 - DNA, 16 bp, C. familiaris
taaagaagatgtgatc

SEQ ID NO: 324764 - DNA, 16 bp, C. familiaris
taaagaatgtatttat

SEQ ID NO: 324765 - DNA, 16 bp, C. familiaris
taaagacttgaacata

SEQ ID NO: 324766 - DNA, 16 bp, C. familiaris
taaagactttttaaat

SEQ ID NO: 324767 - DNA, 16 bp, C. familiaris
taaagagcttataaaa

SEQ ID NO: 324768 - DNA, 16 bp, C. familiaris
taaagaggtaattaaa

SEQ ID NO: 324769 - DNA, 16 bp, C. familiaris
taaagagtacatttat

SEQ ID NO: 324770 - DNA, 16 bp, C. familiaris
taaagagtttggattt

SEQ ID NO: 324771 - DNA, 16 bp, C. familiaris
taaagatgatttattt

SEQ ID NO: 324772 - DNA, 16 bp, C. familiaris
taaagatgggaatgcc

SEQ ID NO: 324773 - DNA, 16 bp, C. familiaris
taaagatgttatcact

SEQ ID NO: 324774 - DNA, 16 bp, C. familiaris
taaagatgttttaaat

SEQ ID NO: 324775 - DNA, 16 bp, C. familiaris
taaagattttatttca

SEQ ID NO: 324776 - DNA, 16 bp, C. familiaris
taaagatttttcttat

SEQ ID NO: 324777 - DNA, 16 bp, C. familiaris
taaagcaaattatttt

SEQ ID NO: 324778 - DNA, 16 bp, C. familiaris
taaagcagctaataac

SEQ ID NO: 324779 - DNA, 16 bp, C. familiaris
taaagcagctattata

SEQ ID NO: 324780 - DNA, 16 bp, C. familiaris
taaagctgttaaaata

SEQ ID NO: 324781 - DNA, 16 bp, C. familiaris
taaagctgttttgaaa

SEQ ID NO: 324782 - DNA, 16 bp, C. familiaris
taaaggaaattctaaa

SEQ ID NO: 324783 - DNA, 16 bp, C. familiaris
taaaggacttattaaa

SEQ ID NO: 324784 - DNA, 16 bp, C. familiaris
taaaggagacagaaaa

SEQ ID NO: 324785 - DNA, 16 bp, C. familiaris
taaaggagctaaagaa

SEQ ID NO: 324786 - DNA, 16 bp, C. familiaris
taaaggcagaagctca

SEQ ID NO: 324787 - DNA, 16 bp, C. familiaris
taaaggccatgtatga

SEQ ID NO: 324788 - DNA, 16 bp, C. familiaris
taaagtcaatggaaaa

SEQ ID NO: 324789 - DNA, 16 bp, C. familiaris
taaagtctgttgaaat

SEQ ID NO: 324790 - DNA, 16 bp, C. familiaris
taaagtcttaaaagaa

SEQ ID NO: 324791 - DNA, 16 bp, C. familiaris
taaagtcttaagaaaa

SEQ ID NO: 324792 - DNA, 16 bp, C. familiaris
taaagtctttaatcca

SEQ ID NO: 324793 - DNA, 16 bp, C. familiaris
taaagttttgtttttc

SEQ ID NO: 324794 - DNA, 16 bp, C. familiaris
taaataaaactgcttt

SEQ ID NO: 324795 - DNA, 16 bp, C. familiaris
taaataaaatcagcaa

SEQ ID NO: 324796 - DNA, 16 bp, C. familiaris
taaataaagcttttaa

SEQ ID NO: 324797 - DNA, 16 bp, C. familiaris
taaataactttgaaaa

SEQ ID NO: 324798 - DNA, 16 bp, C. familiaris
taaataataaagtctt

SEQ ID NO: 324799 - DNA, 16 bp, C. familiaris
taaataatatgcctga

SEQ ID NO: 324800 - DNA, 16 bp, C. familiaris
taaatacacatatatt

SEQ ID NO: 324801 - DNA, 16 bp, C. familiaris
taaatacccagaagca

SEQ ID NO: 324802 - DNA, 16 bp, C. familiaris
taaatacttgaaaaaa

SEQ ID NO: 324803 - DNA, 16 bp, C. familiaris
taaatagtaatggtga

SEQ ID NO: 324804 - DNA, 16 bp, C. familiaris
taaatatacagataaa

SEQ ID NO: 324805 - DNA, 16 bp, C. familiaris
taaatatatctctaaa

SEQ ID NO: 324806 - DNA, 16 bp, C. familiaris
taaatatgttttctct

SEQ ID NO: 324807 - DNA, 16 bp, C. familiaris
taaatattcattcaat

SEQ ID NO: 324808 - DNA, 16 bp, C. familiaris
taaatatttaccagca

SEQ ID NO: 324809 - DNA, 16 bp, C. familiaris
taaatatttatggaat

SEQ ID NO: 324810 - DNA, 16 bp, C. familiaris
taaatatttattggct

SEQ ID NO: 324811 - DNA, 16 bp, C. familiaris
taaatatttcactcca

SEQ ID NO: 324812 - DNA, 16 bp, C. familiaris
taaatattttcccaaa

SEQ ID NO: 324813 - DNA, 16 bp, C. familiaris
taaatattttctgctt

SEQ ID NO: 324814 - DNA, 16 bp, C. familiaris
taaatattttcttaga

SEQ ID NO: 324815 - DNA, 16 bp, C. familiaris
taaatcagattttatt

SEQ ID NO: 324816 - DNA, 16 bp, C. familiaris
taaatcatatagtatt

SEQ ID NO: 324817 - DNA, 16 bp, C. familiaris
taaatctatagagaca

SEQ ID NO: 324818 - DNA, 16 bp, C. familiaris
taaatctgggaaacaa

SEQ ID NO: 324819 - DNA, 16 bp, C. familiaris
taaatctttaaaagga

SEQ ID NO: 324820 - DNA, 16 bp, C. familiaris
taaatctttaaagaaa

SEQ ID NO: 324821 - DNA, 16 bp, C. familiaris
taaatctttctttaaa

SEQ ID NO: 324822 - DNA, 16 bp, C. familiaris
taaatgaaagatattt

SEQ ID NO: 324823 - DNA, 16 bp, C. familiaris
taaatgaagaaaatct

SEQ ID NO: 324824 - DNA, 16 bp, C. familiaris
taaatgaattagtgaa

SEQ ID NO: 324825 - DNA, 16 bp, C. familiaris
taaatgagattatttt

SEQ ID NO: 324826 - DNA, 16 bp, C. familiaris
taaatgcattcaaatt

SEQ ID NO: 324827 - DNA, 16 bp, C. familiaris
taaatggaattatttt

SEQ ID NO: 324828 - DNA, 16 bp, C. familiaris
taaatggaattgtaca

SEQ ID NO: 324829 - DNA, 16 bp, C. familiaris
taaatggattcataca

SEQ ID NO: 324830 - DNA, 16 bp, C. familiaris
taaatgggagcgagaa

SEQ ID NO: 324831 - DNA, 16 bp, C. familiaris
taaatgggtcaaccag

SEQ ID NO: 324832 - DNA, 16 bp, C. familiaris
taaatgtgtatatgta

SEQ ID NO: 324833 - DNA, 16 bp, C. familiaris
taaatgtttgatgaat

SEQ ID NO: 324834 - DNA, 16 bp, C. familiaris
taaattaactgaccat

SEQ ID NO: 324835 - DNA, 16 bp, C. familiaris
taaattacatgaaata

SEQ ID NO: 324836 - DNA, 16 bp, C. familiaris
taaattctttaaagaa

SEQ ID NO: 324837 - DNA, 16 bp, C. familiaris
taaattctttgacatt

SEQ ID NO: 324838 - DNA, 16 bp, C. familiaris
taaattgtcttttctt

SEQ ID NO: 324839 - DNA, 16 bp, C. familiaris
taaatttaaaacaaag

SEQ ID NO: 324840 - DNA, 16 bp, C. familiaris
taaatttcaaaagaaa

SEQ ID NO: 324841 - DNA, 16 bp, C. familiaris
taaatttctagaaaca

SEQ ID NO: 324842 - DNA, 16 bp, C. familiaris
taaatttctgcttttt

SEQ ID NO: 324843 - DNA, 16 bp, C. familiaris
taaatttcttgaaaaa

SEQ ID NO: 324844 - DNA, 16 bp, C. familiaris
taaatttctttcatca

SEQ ID NO: 324845 - DNA, 16 bp, C. familiaris
taaatttgattttctt

SEQ ID NO: 324846 - DNA, 16 bp, C. familiaris
taaatttgccttttct

SEQ ID NO: 324847 - DNA, 16 bp, C. familiaris
taaattttgaaaaatc

SEQ ID NO: 324848 - DNA, 16 bp, C. familiaris
taaattttgaaaatca

SEQ ID NO: 324849 - DNA, 16 bp, C. familiaris
taacaaaagacatctt

SEQ ID NO: 324850 - DNA, 16 bp, C. familiaris
taacaaagtaggaagg

SEQ ID NO: 324851 - DNA, 16 bp, C. familiaris
taacaactcaggaaat

SEQ ID NO: 324852 - DNA, 16 bp, C. familiaris
taacaagcacatgaaa

SEQ ID NO: 324853 - DNA, 16 bp, C. familiaris
taacaatgagatacca

SEQ ID NO: 324854 - DNA, 16 bp, C. familiaris
taacaattatgaatat

SEQ ID NO: 324855 - DNA, 16 bp, C. familiaris
taacacagagaaacag

SEQ ID NO: 324856 - DNA, 16 bp, C. familiaris
taacacttctttaaat

SEQ ID NO: 324857 - DNA, 16 bp, C. familiaris
taacatccaaaaatca

SEQ ID NO: 324858 - DNA, 16 bp, C. familiaris
taacatctctgaaatc

SEQ ID NO: 324859 - DNA, 16 bp, C. familiaris
taacatgtttttattt

SEQ ID NO: 324860 - DNA, 16 bp, C. familiaris
taacatttctttctct

SEQ ID NO: 324861 - DNA, 16 bp, C. familiaris
taacattttcctttct

SEQ ID NO: 324862 - DNA, 16 bp, C. familiaris
taacattttgaagaac

SEQ ID NO: 324863 - DNA, 16 bp, C. familiaris
taacatttttaatgtt

SEQ ID NO: 324864 - DNA, 16 bp, C. familiaris
taacatttttttctgt

SEQ ID NO: 324865 - DNA, 16 bp, C. familiaris
taaccaaagaagcaaa

SEQ ID NO: 324866 - DNA, 69 bp, C. familiaris
taaccaaagtgaagaaatacttagataataatacacttatacttggtgacttcaatctagctctttcta

SEQ ID NO: 324867 - DNA, 16 bp, C. familiaris
taaccaaattatggaa

SEQ ID NO: 324868 - DNA, 16 bp, C. familiaris
taaccaatgagccacc

SEQ ID NO: 324869 - DNA, 16 bp, C. familiaris
taaccacatttcaagt

SEQ ID NO: 324870 - DNA, 16 bp, C. familiaris
taaccatcagtttgtt

SEQ ID NO: 324871 - DNA, 16 bp, C. familiaris
taaccctgagatcaca

SEQ ID NO: 324872 - DNA, 16 bp, C. familiaris
taacctggagaaggaa

SEQ ID NO: 324873 - DNA, 16 bp, C. familiaris
taactacaaagcaaaa

SEQ ID NO: 324874 - DNA, 16 bp, C. familiaris
taactacctagaattt

SEQ ID NO: 324875 - DNA, 16 bp, C. familiaris
taactcatctttaaat

SEQ ID NO: 324876 - DNA, 16 bp, C. familiaris
taactctgtgacagag

SEQ ID NO: 324877 - DNA, 16 bp, C. familiaris
taactgaaatgaaaat

SEQ ID NO: 324878 - DNA, 16 bp, C. familiaris
taactgaacttaaaaa

SEQ ID NO: 324879 - DNA, 16 bp, C. familiaris
taactggaaataaaat

SEQ ID NO: 324880 - DNA, 16 bp, C. familiaris
taactggaagcctgga

SEQ ID NO: 324881 - DNA, 16 bp, C. familiaris
taactggtgatgggca

SEQ ID NO: 324882 - DNA, 16 bp, C. familiaris
taactgtttggtagaa

SEQ ID NO: 324883 - DNA, 16 bp, C. familiaris
taacttcatttaaaaa

SEQ ID NO: 324884 - DNA, 16 bp, C. familiaris
taacttccaccattgt

SEQ ID NO: 324885 - DNA, 16 bp, C. familiaris
taactttatacctcaa

SEQ ID NO: 324886 - DNA, 16 bp, C. familiaris
taactttctgaggaaa

SEQ ID NO: 324887 - DNA, 16 bp, C. familiaris
taactttgggttttgt

SEQ ID NO: 324888 - DNA, 16 bp, C. familiaris
taactttgttcttctt

SEQ ID NO: 324889 - DNA, 16 bp, C. familiaris
taacttttgatatttt

SEQ ID NO: 324890 - DNA, 16 bp, C. familiaris
taactttttgtggaac

SEQ ID NO: 324891 - DNA, 16 bp, C. familiaris
taacttttttttaaga

SEQ ID NO: 324892 - DNA, 16 bp, C. familiaris
taagaaaaactttaaa

SEQ ID NO: 324893 - DNA, 16 bp, C. familiaris
taagaaaactgaaaat

SEQ ID NO: 324894 - DNA, 16 bp, C. familiaris
taagaaaactgaagcc

SEQ ID NO: 324895 - DNA, 16 bp, C. familiaris
taagaaaatattttgt

SEQ ID NO: 324896 - DNA, 16 bp, C. familiaris
taagaaaattgaattt

SEQ ID NO: 324897 - DNA, 16 bp, C. familiaris
taagaaatgagcagaa

SEQ ID NO: 324898 - DNA, 16 bp, C. familiaris
taagaagaaatgagct

SEQ ID NO: 324899 - DNA, 16 bp, C. familiaris
taagaaggaagtttat

SEQ ID NO: 324900 - DNA, 16 bp, C. familiaris
taagaaggattctgag

SEQ ID NO: 324901 - DNA, 16 bp, C. familiaris
taagaatctttttttt

SEQ ID NO: 324902 - DNA, 16 bp, C. familiaris
taagactgccttttgc

SEQ ID NO: 324903 - DNA, 16 bp, C. familiaris
taagagaatataatga

SEQ ID NO: 324904 - DNA, 16 bp, C. familiaris
taagagaatattatga

SEQ ID NO: 324905 - DNA, 16 bp, C. familiaris
taagagacacagaaag

SEQ ID NO: 324906 - DNA, 16 bp, C. familiaris
taagagcctcctggac

SEQ ID NO: 324907 - DNA, 16 bp, C. familiaris
taagagtcttttatgg

SEQ ID NO: 324908 - DNA, 16 bp, C. familiaris
taagatcaagagtcag

SEQ ID NO: 324909 - DNA, 16 bp, C. familiaris
taagatcaggaaaaaa

SEQ ID NO: 324910 - DNA, 16 bp, C. familiaris
taagatgattattttg

SEQ ID NO: 324911 - DNA, 16 bp, C. familiaris
taagatgattttttcc

SEQ ID NO: 324912 - DNA, 16 bp, C. familiaris
taagcaagaaaatgaa

SEQ ID NO: 324913 - DNA, 16 bp, C. familiaris
taagcagattccccac

SEQ ID NO: 324914 - DNA, 16 bp, C. familiaris
taagcagctgccttct

SEQ ID NO: 324915 - DNA, 16 bp, C. familiaris
taagcctgcttctccc

SEQ ID NO: 324916 - DNA, 16 bp, C. familiaris
taagcgtctgattctt

SEQ ID NO: 324917 - DNA, 16 bp, C. familiaris
taagcttttctttctt

SEQ ID NO: 324918 - DNA, 16 bp, C. familiaris
taaggaaaatgaggct

SEQ ID NO: 324919 - DNA, 16 bp, C. familiaris
taaggaaacagaagct

SEQ ID NO: 324920 - DNA, 16 bp, C. familiaris
taaggaaatgaagacc

SEQ ID NO: 324921 - DNA, 16 bp, C. familiaris
taaggaactcagtgac

SEQ ID NO: 324922 - DNA, 16 bp, C. familiaris
taaggaactgaatttt

SEQ ID NO: 324923 - DNA, 16 bp, C. familiaris
taaggaagaagttaaa

SEQ ID NO: 324924 - DNA, 16 bp, C. familiaris
taaggaagagaaaaca

SEQ ID NO: 324925 - DNA, 16 bp, C. familiaris
taaggaatctacaaaa

SEQ ID NO: 324926 - DNA, 16 bp, C. familiaris
taaggactttgacttt

SEQ ID NO: 324927 - DNA, 16 bp, C. familiaris
taaggatagagggaac

SEQ ID NO: 324928 - DNA, 16 bp, C. familiaris
taaggctttcagtcaa

SEQ ID NO: 324929 - DNA, 16 bp, C. familiaris
taagggggaaaaaaac

SEQ ID NO: 324930 - DNA, 16 bp, C. familiaris
taaggtgaaaaacaaa

SEQ ID NO: 324931 - DNA, 16 bp, C. familiaris
taagtatttttaaaag

SEQ ID NO: 324932 - DNA, 16 bp, C. familiaris
taagtcaattggagaa

SEQ ID NO: 324933 - DNA, 16 bp, C. familiaris
taagtctctgaagaaa

SEQ ID NO: 324934 - DNA, 16 bp, C. familiaris
taagtgacttactcaa

SEQ ID NO: 324935 - DNA, 16 bp, C. familiaris
taagtgatgaattgct

SEQ ID NO: 324936 - DNA, 16 bp, C. familiaris
taagtggcagagctgg

SEQ ID NO: 324937 - DNA, 16 bp, C. familiaris
taagtgggatgcctgg

SEQ ID NO: 324938 - DNA, 16 bp, C. familiaris
taagttgaaccatcat

SEQ ID NO: 324939 - DNA, 16 bp, C. familiaris
taagttgcctttttgt

SEQ ID NO: 324940 - DNA, 16 bp, C. familiaris
taataaaaccatcatt

SEQ ID NO: 324941 - DNA, 16 bp, C. familiaris
taataaaatcatgaat

SEQ ID NO: 324942 - DNA, 16 bp, C. familiaris
taataaacttctctat

SEQ ID NO: 324943 - DNA, 16 bp, C. familiaris
taataaagattccagc

SEQ ID NO: 324944 - DNA, 25 bp, C. familiaris
taataaagattcgagcagaactcaa

SEQ ID NO: 324945 - DNA, 16 bp, C. familiaris
taataaatgtgatttt

SEQ ID NO: 324946 - DNA, 16 bp, C. familiaris
taataaccaaaaactg

SEQ ID NO: 324947 - DNA, 16 bp, C. familiaris
taataataaacatgaa

SEQ ID NO: 324948 - DNA, 16 bp, C. familiaris
taataatagtgataat

SEQ ID NO: 324949 - DNA, 16 bp, C. familiaris
taatactgcattgcat

SEQ ID NO: 324950 - DNA, 16 bp, C. familiaris
taatactgtttttctt

SEQ ID NO: 324951 - DNA, 16 bp, C. familiaris
taatagacacagagag

SEQ ID NO: 324952 - DNA, 16 bp, C. familiaris
taatatgctatatttt

SEQ ID NO: 324953 - DNA, 16 bp, C. familiaris
taatattattttcagg

SEQ ID NO: 324954 - DNA, 16 bp, C. familiaris
taatatttcttatagg

SEQ ID NO: 324955 - DNA, 16 bp, C. familiaris
taatcacagaaaatga

SEQ ID NO: 324956 - DNA, 16 bp, C. familiaris
taatcacaggaaacaa

SEQ ID NO: 324957 - DNA, 16 bp, C. familiaris
taatcagatatatgat

SEQ ID NO: 324958 - DNA, 16 bp, C. familiaris
taatcagatttttaaa

SEQ ID NO: 324959 - DNA, 16 bp, C. familiaris
taatcatggatttatt

SEQ ID NO: 324960 - DNA, 16 bp, C. familiaris
taatcccattcatgat

SEQ ID NO: 324961 - DNA, 16 bp, C. familiaris
taatcctgaagtcctg

SEQ ID NO: 324962 - DNA, 16 bp, C. familiaris
taatcctggagtccca

SEQ ID NO: 324963 - DNA, 16 bp, C. familiaris
taatctacagatttaa

SEQ ID NO: 324964 - DNA, 16 bp, C. familiaris
taatctcattgtacat

SEQ ID NO: 324965 - DNA, 16 bp, C. familiaris
taatctctattcccaa

SEQ ID NO: 324966 - DNA, 16 bp, C. familiaris
taatctgggaagggaa

SEQ ID NO: 324967 - DNA, 16 bp, C. familiaris
taatctttacaacaat

SEQ ID NO: 324968 - DNA, 16 bp, C. familiaris
taatcttttcaataaa

SEQ ID NO: 324969 - DNA, 16 bp, C. familiaris
taatgaaagtttgact

SEQ ID NO: 324970 - DNA, 16 bp, C. familiaris
taatgaaataatggat

SEQ ID NO: 324971 - DNA, 16 bp, C. familiaris
taatgaaatttcaaaa

SEQ ID NO: 324972 - DNA, 16 bp, C. familiaris
taatgaaatttcattt

SEQ ID NO: 324973 - DNA, 16 bp, C. familiaris
taatgaagctgaacaa

SEQ ID NO: 324974 - DNA, 16 bp, C. familiaris
taatgaatcactgacc

SEQ ID NO: 324975 - DNA, 16 bp, C. familiaris
taatgaatggataaac

SEQ ID NO: 324976 - DNA, 16 bp, C. familiaris
taatgagaaagaagat

SEQ ID NO: 324977 - DNA, 16 bp, C. familiaris
taatgaggatgaagat

SEQ ID NO: 324978 - DNA, 16 bp, C. familiaris
taatgagtttttaaaa

SEQ ID NO: 324979 - DNA, 16 bp, C. familiaris
taatgcattattggtt

SEQ ID NO: 324980 - DNA, 16 bp, C. familiaris
taatgctgaacttaag

SEQ ID NO: 324981 - DNA, 16 bp, C. familiaris
taatggaaaaaaatca

SEQ ID NO: 324982 - DNA, 16 bp, C. familiaris
taatggaagaaaatat

SEQ ID NO: 324983 - DNA, 16 bp, C. familiaris
taatggggatccctgg

SEQ ID NO: 324984 - DNA, 16 bp, C. familiaris
taatgggtttattatt

SEQ ID NO: 324985 - DNA, 16 bp, C. familiaris
taatggttgaaaactt

SEQ ID NO: 324986 - DNA, 16 bp, C. familiaris
taatgtacagaattgc

SEQ ID NO: 324987 - DNA, 16 bp, C. familiaris
taatgtatgtccttct

SEQ ID NO: 324988 - DNA, 16 bp, C. familiaris
taatgttaaaaggatt

SEQ ID NO: 324989 - DNA, 16 bp, C. familiaris
taatgttcatcaccca

SEQ ID NO: 324990 - DNA, 16 bp, C. familiaris
taatgtttgtcctctg

SEQ ID NO: 324991 - DNA, 16 bp, C. familiaris
taatgttttaccagct

SEQ ID NO: 324992 - DNA, 16 bp, C. familiaris
taatgttttagaaaat

SEQ ID NO: 324993 - DNA, 16 bp, C. familiaris
taattaagaatctgtt

SEQ ID NO: 324994 - DNA, 16 bp, C. familiaris
taattacactggaatt

SEQ ID NO: 324995 - DNA, 16 bp, C. familiaris
taattacctttttaaa

SEQ ID NO: 324996 - DNA, 16 bp, C. familiaris
taattatgtgtcttgg

SEQ ID NO: 324997 - DNA, 16 bp, C. familiaris
taattcaacattttaa

SEQ ID NO: 324998 - DNA, 16 bp, C. familiaris
taattcattgtggttt

SEQ ID NO: 324999 - DNA, 16 bp, C. familiaris
taattccaaaagcaga

SEQ ID NO: 325000 - DNA, 16 bp, C. familiaris
taattcccattttaca

SEQ ID NO: 325001 - DNA, 16 bp, C. familiaris
taattctaacatctct

SEQ ID NO: 325002 - DNA, 16 bp, C. familiaris
taattctcacaacaat

SEQ ID NO: 325003 - DNA, 16 bp, C. familiaris
taattcttttaaaatg

SEQ ID NO: 325004 - DNA, 16 bp, C. familiaris
taattggcttaaagaa

SEQ ID NO: 325005 - DNA, 16 bp, C. familiaris
taattgggattccaga

SEQ ID NO: 325006 - DNA, 16 bp, C. familiaris
taattgtgaaatattt

SEQ ID NO: 325007 - DNA, 16 bp, C. familiaris
taatttaatcacattt

SEQ ID NO: 325008 - DNA, 16 bp, C. familiaris
taatttcctttgtgat

SEQ ID NO: 325009 - DNA, 16 bp, C. familiaris
taatttctctacatcc

SEQ ID NO: 325010 - DNA, 16 bp, C. familiaris
taatttgaaaatgata

SEQ ID NO: 325011 - DNA, 16 bp, C. familiaris
taatttgcatttcttt

SEQ ID NO: 325012 - DNA, 16 bp, C. familiaris
taatttgcttttctct

SEQ ID NO: 325013 - DNA, 16 bp, C. familiaris
taatttggaaaagaaa

SEQ ID NO: 325014 - DNA, 16 bp, C. familiaris
taatttgggaaaaaaa

SEQ ID NO: 325015 - DNA, 16 bp, C. familiaris
taattttcttaaaaca

SEQ ID NO: 325016 - DNA, 16 bp, C. familiaris
taattttgcctttttc

SEQ ID NO: 325017 - DNA, 16 bp, C. familiaris
taattttgctcatttt

SEQ ID NO: 325018 - DNA, 16 bp, C. familiaris
taattttgtatgtcaa

SEQ ID NO: 325019 - DNA, 16 bp, C. familiaris
taattttgttgaaaat

SEQ ID NO: 325020 - DNA, 16 bp, C. familiaris
taatttttttgcatat

SEQ ID NO: 325021 - DNA, 16 bp, C. familiaris
tacaaaacattgatga

SEQ ID NO: 325022 - DNA, 16 bp, C. familiaris
tacaaaagttttaaaa

SEQ ID NO: 325023 - DNA, 16 bp, C. familiaris
tacaaaatatgcatta

SEQ ID NO: 325024 - DNA, 16 bp, C. familiaris
tacaaaatcaatggcc

SEQ ID NO: 325025 - DNA, 16 bp, C. familiaris
tacaaaatggaaagaa

SEQ ID NO: 325026 - DNA, 16 bp, C. familiaris
tacaaaattctgatga

SEQ ID NO: 325027 - DNA, 16 bp, C. familiaris
tacaaagaaaaattta

SEQ ID NO: 325028 - DNA, 16 bp, C. familiaris
tacaaagattttttta

SEQ ID NO: 325029 - DNA, 16 bp, C. familiaris
tacaaataaagctgct

SEQ ID NO: 325030 - DNA, 16 bp, C. familiaris
tacaaatatgtatata

SEQ ID NO: 325031 - DNA, 16 bp, C. familiaris
tacaaatggccaacag

SEQ ID NO: 325032 - DNA, 16 bp, C. familiaris
tacaaattattttcaa

SEQ ID NO: 325033 - DNA, 16 bp, C. familiaris
tacaacaacatgaatg

SEQ ID NO: 325034 - DNA, 16 bp, C. familiaris
tacaacagcagagctg

SEQ ID NO: 325035 - DNA, 16 bp, C. familiaris
tacaacatggatggat

SEQ ID NO: 325036 - DNA, 16 bp, C. familiaris
tacaacatggtgattc

SEQ ID NO: 325037 - DNA, 16 bp, C. familiaris
tacaaccctttgtttg

SEQ ID NO: 325038 - DNA, 16 bp, C. familiaris
tacaacctggagatca

SEQ ID NO: 325039 - DNA, 16 bp, C. familiaris
tacaactcagctgaag

SEQ ID NO: 325040 - DNA, 16 bp, C. familiaris
tacaacttgatttttt

SEQ ID NO: 325041 - DNA, 16 bp, C. familiaris
tacaagaaatatttat

SEQ ID NO: 325042 - DNA, 16 bp, C. familiaris
tacaagaattaaatga

SEQ ID NO: 325043 - DNA, 16 bp, C. familiaris
tacaagactgatgaat

SEQ ID NO: 325044 - DNA, 16 bp, C. familiaris
tacaagagacttattt

SEQ ID NO: 325045 - DNA, 16 bp, C. familiaris
tacaagatgaaaaagt

SEQ ID NO: 325046 - DNA, 16 bp, C. familiaris
tacaatatgtactctt

SEQ ID NO: 325047 - DNA, 16 bp, C. familiaris
tacaatccaaaattac

SEQ ID NO: 325048 - DNA, 16 bp, C. familiaris
tacaattcagtggcat

SEQ ID NO: 325049 - DNA, 16 bp, C. familiaris
tacaattgttatatct

SEQ ID NO: 325050 - DNA, 16 bp, C. familiaris
tacacaaagagaaact

SEQ ID NO: 325051 - DNA, 16 bp, C. familiaris
tacacaaataatgaag

SEQ ID NO: 325052 - DNA, 16 bp, C. familiaris
tacacagaaatagaaa

SEQ ID NO: 325053 - DNA, 16 bp, C. familiaris
tacacagagagaagca

SEQ ID NO: 325054 - DNA, 16 bp, C. familiaris
tacacagatggcaaat

SEQ ID NO: 325055 - DNA, 16 bp, C. familiaris
tacacatatacatatg

SEQ ID NO: 325056 - DNA, 16 bp, C. familiaris
tacacatccaagaagc

SEQ ID NO: 325057 - DNA, 16 bp, C. familiaris
tacacatggaatattc

SEQ ID NO: 325058 - DNA, 16 bp, C. familiaris
tacaccaacaatgaga

SEQ ID NO: 325059 - DNA, 16 bp, C. familiaris
tacaccatagtgattc

SEQ ID NO: 325060 - DNA, 16 bp, C. familiaris
tacaccctgagccaaa

SEQ ID NO: 325061 - DNA, 16 bp, C. familiaris
tacacctaaaagaact

SEQ ID NO: 325062 - DNA, 16 bp, C. familiaris
tacactgtgaaatgat

SEQ ID NO: 325063 - DNA, 16 bp, C. familiaris
tacacttatcataatg

SEQ ID NO: 325064 - DNA, 16 bp, C. familiaris
tacagaaaaagaaact

SEQ ID NO: 325065 - DNA, 16 bp, C. familiaris
tacagaaaacacattt

SEQ ID NO: 325066 - DNA, 16 bp, C. familiaris
tacagaaatgcaaaat

SEQ ID NO: 325067 - DNA, 16 bp, C. familiaris
tacagaatacttctga

SEQ ID NO: 325068 - DNA, 16 bp, C. familiaris
tacagaatattccatc

SEQ ID NO: 325069 - DNA, 16 bp, C. familiaris
tacagaatcagaggat

SEQ ID NO: 325070 - DNA, 16 bp, C. familiaris
tacagacaaggaaacc

SEQ ID NO: 325071 - DNA, 16 bp, C. familiaris
tacagagaaaataaat

SEQ ID NO: 325072 - DNA, 16 bp, C. familiaris
tacagagaatgaactg

SEQ ID NO: 325073 - DNA, 16 bp, C. familiaris
tacagagagaggcaga

SEQ ID NO: 325074 - DNA, 16 bp, C. familiaris
tacagagagttcccat

SEQ ID NO: 325075 - DNA, 16 bp, C. familiaris
tacagagctctcagtc

SEQ ID NO: 325076 - DNA, 16 bp, C. familiaris
tacagaggaggaaaca

SEQ ID NO: 325077 - DNA, 16 bp, C. familiaris
tacagaggcagtgaaa

SEQ ID NO: 325078 - DNA, 16 bp, C. familiaris
tacagagtgagagaga

SEQ ID NO: 325079 - DNA, 16 bp, C. familiaris
tacagagtgggagaag

SEQ ID NO: 325080 - DNA, 16 bp, C. familiaris
tacagataagaaaacc

SEQ ID NO: 325081 - DNA, 16 bp, C. familiaris
tacagataaggaaaaa

SEQ ID NO: 325082 - DNA, 16 bp, C. familiaris
tacagatattaaaata

SEQ ID NO: 325083 - DNA, 16 bp, C. familiaris
tacagatcttccttga

SEQ ID NO: 325084 - DNA, 16 bp, C. familiaris
tacagatgaaaaagct

SEQ ID NO: 325085 - DNA, 16 bp, C. familiaris
tacagatgagaaaact

SEQ ID NO: 325086 - DNA, 16 bp, C. familiaris
tacagattttggactt

SEQ ID NO: 325087 - DNA, 16 bp, C. familiaris
tacagcaaaagaaaca

SEQ ID NO: 325088 - DNA, 16 bp, C. familiaris
tacagcaaaagcagcc

SEQ ID NO: 325089 - DNA, 16 bp, C. familiaris
tacagcagccccagga

SEQ ID NO: 325090 - DNA, 16 bp, C. familiaris
tacagcaggtgctcaa

SEQ ID NO: 325091 - DNA, 16 bp, C. familiaris
tacagcatggatgaat

SEQ ID NO: 325092 - DNA, 16 bp, C. familiaris
tacaggaagcccaatg

SEQ ID NO: 325093 - DNA, 16 bp, C. familiaris
tacaggggaaaaaaaa

SEQ ID NO: 325094 - DNA, 16 bp, C. familiaris
tacagtactatactgt

SEQ ID NO: 325095 - DNA, 16 bp, C. familiaris
tacagtatttttttta

SEQ ID NO: 325096 - DNA, 16 bp, C. familiaris
tacataaaatggaata

SEQ ID NO: 325097 - DNA, 16 bp, C. familiaris
tacataaagtttaaaa

SEQ ID NO: 325098 - DNA, 16 bp, C. familiaris
tacatacacacacaca

SEQ ID NO: 325099 - DNA, 16 bp, C. familiaris
tacatacacacataca

SEQ ID NO: 325100 - DNA, 16 bp, C. familiaris
tacatacatcttttca

SEQ ID NO: 325101 - DNA, 19 bp, C. familiaris
tacatagaaaacccaaaag

SEQ ID NO: 325102 - DNA, 16 bp, C. familiaris
tacatataaatatgca

SEQ ID NO: 325103 - DNA, 16 bp, C. familiaris
tacatatataaagata

SEQ ID NO: 325104 - DNA, 16 bp, C. familiaris
tacatatatatgcata

SEQ ID NO: 325105 - DNA, 16 bp, C. familiaris
tacatatatatgtatg

SEQ ID NO: 325106 - DNA, 16 bp, C. familiaris
tacatatgaaattaaa

SEQ ID NO: 325107 - DNA, 16 bp, C. familiaris
tacatatgtatttttt

SEQ ID NO: 325108 - DNA, 16 bp, C. familiaris
tacatattcaataaat

SEQ ID NO: 325109 - DNA, 16 bp, C. familiaris
tacatcattagtttta

SEQ ID NO: 325110 - DNA, 16 bp, C. familiaris
tacatgaatattcata

SEQ ID NO: 325111 - DNA, 16 bp, C. familiaris
tacatgcatatgtata

SEQ ID NO: 325112 - DNA, 16 bp, C. familiaris
tacatggaatattact

SEQ ID NO: 325113 - DNA, 16 bp, C. familiaris
tacatgtatatattca

SEQ ID NO: 325114 - DNA, 16 bp, C. familiaris
tacattaagaagatga

SEQ ID NO: 325115 - DNA, 16 bp, C. familiaris
tacattatgaaatgct

SEQ ID NO: 325116 - DNA, 16 bp, C. familiaris
tacattatttgcaaat

SEQ ID NO: 325117 - DNA, 16 bp, C. familiaris
tacattcccagcaaca

SEQ ID NO: 325118 - DNA, 16 bp, C. familiaris
tacattgattttgtgt

SEQ ID NO: 325119 - DNA, 16 bp, C. familiaris
tacattgctcagtgct

SEQ ID NO: 325120 - DNA, 16 bp, C. familiaris
tacattgttgcaaatg

SEQ ID NO: 325121 - DNA, 16 bp, C. familiaris
tacatttatgataaaa

SEQ ID NO: 325122 - DNA, 16 bp, C. familiaris
tacatttgtctaaacc

SEQ ID NO: 325123 - DNA, 16 bp, C. familiaris
tacattttaaaaatga

SEQ ID NO: 325124 - DNA, 16 bp, C. familiaris
tacattttaatagttt

SEQ ID NO: 325125 - DNA, 16 bp, C. familiaris
tacattttgaaaagaa

SEQ ID NO: 325126 - DNA, 16 bp, C. familiaris
tacattttttaaaatg

SEQ ID NO: 325127 - DNA, 16 bp, C. familiaris
tacatttttttaaaga

SEQ ID NO: 325128 - DNA, 16 bp, C. familiaris
taccaaaactgaaaga

SEQ ID NO: 325129 - DNA, 16 bp, C. familiaris
taccaacatacagaat

SEQ ID NO: 325130 - DNA, 16 bp, C. familiaris
taccacaaccaagtgg

SEQ ID NO: 325131 - DNA, 16 bp, C. familiaris
taccacacccagtgct

SEQ ID NO: 325132 - DNA, 16 bp, C. familiaris
taccacaccttcttta

SEQ ID NO: 325133 - DNA, 16 bp, C. familiaris
taccacatttctttat

SEQ ID NO: 325134 - DNA, 16 bp, C. familiaris
taccaccttcagccca

SEQ ID NO: 325135 - DNA, 16 bp, C. familiaris
taccactgactgtatt

SEQ ID NO: 325136 - DNA, 16 bp, C. familiaris
taccactgcacaccta

SEQ ID NO: 325137 - DNA, 16 bp, C. familiaris
taccagatgatccagc

SEQ ID NO: 325138 - DNA, 16 bp, C. familiaris
taccagggcacctggg

SEQ ID NO: 325139 - DNA, 16 bp, C. familiaris
taccaggggcacctgg

SEQ ID NO: 325140 - DNA, 16 bp, C. familiaris
taccatattttaaaaa

SEQ ID NO: 325141 - DNA, 16 bp, C. familiaris
taccatttttattaaa

SEQ ID NO: 325142 - DNA, 16 bp, C. familiaris
tacccaaattatggaa

SEQ ID NO: 325143 - DNA, 16 bp, C. familiaris
tacccagggcaattca

SEQ ID NO: 325144 - DNA, 16 bp, C. familiaris
taccctccagttccag

SEQ ID NO: 325145 - DNA, 16 bp, C. familiaris
taccctccagttccct

SEQ ID NO: 325146 - DNA, 16 bp, C. familiaris
tacccttgctttcttt

SEQ ID NO: 325147 - DNA, 16 bp, C. familiaris
tacctcctgcccccac

SEQ ID NO: 325148 - DNA, 16 bp, C. familiaris
tacctcggtaagatgt

SEQ ID NO: 325149 - DNA, 16 bp, C. familiaris
tacctctgccccttcc

SEQ ID NO: 325150 - DNA, 16 bp, C. familiaris
tacctgattttattac

SEQ ID NO: 325151 - DNA, 16 bp, C. familiaris
taccttatatggcaaa

SEQ ID NO: 325152 - DNA, 16 bp, C. familiaris
taccttcagctgagtt

SEQ ID NO: 325153 - DNA, 16 bp, C. familiaris
taccttgtaatttttt

SEQ ID NO: 325154 - DNA, 16 bp, C. familiaris
tacctttctgatattt

SEQ ID NO: 325155 - DNA, 16 bp, C. familiaris
tacgccctgggctgca

SEQ ID NO: 325156 - DNA, 16 bp, C. familiaris
tactacagtctttgga

SEQ ID NO: 325157 - DNA, 16 bp, C. familiaris
tactacctgagccaaa

SEQ ID NO: 325158 - DNA, 16 bp, C. familiaris
tactactaccaccacc

SEQ ID NO: 325159 - DNA, 16 bp, C. familiaris
tactactgaccttctg

SEQ ID NO: 325160 - DNA, 16 bp, C. familiaris
tactatatatagtata

SEQ ID NO: 325161 - DNA, 16 bp, C. familiaris
tactatgttggataaa

SEQ ID NO: 325162 - DNA, 16 bp, C. familiaris
tactatgttttattta

SEQ ID NO: 325163 - DNA, 16 bp, C. familiaris
tactcaaataaaaaga

SEQ ID NO: 325164 - DNA, 16 bp, C. familiaris
tactcacacagagaga

SEQ ID NO: 325165 - DNA, 16 bp, C. familiaris
tactcactcactctct

SEQ ID NO: 325166 - DNA, 16 bp, C. familiaris
tactcagaaaacaaaa

SEQ ID NO: 325167 - DNA, 16 bp, C. familiaris
tactcagcaatcaaaa

SEQ ID NO: 325168 - DNA, 16 bp, C. familiaris
tactcagccaacaaaa

SEQ ID NO: 325169 - DNA, 16 bp, C. familiaris
tactccagtgtgtgtg

SEQ ID NO: 325170 - DNA, 16 bp, C. familiaris
tactccttgttcattt

SEQ ID NO: 325171 - DNA, 16 bp, C. familiaris
tactctgaaaattata

SEQ ID NO: 325172 - DNA, 16 bp, C. familiaris
tactctgaagactata

SEQ ID NO: 325173 - DNA, 16 bp, C. familiaris
tactctgctgccatct

SEQ ID NO: 325174 - DNA, 16 bp, C. familiaris
tactctgtaccaggca

SEQ ID NO: 325175 - DNA, 16 bp, C. familiaris
tactgaaagatatgaa

SEQ ID NO: 325176 - DNA, 16 bp, C. familiaris
tactgaaatatttatg

SEQ ID NO: 325177 - DNA, 16 bp, C. familiaris
tactgaaattttattt

SEQ ID NO: 325178 - DNA, 16 bp, C. familiaris
tactgaatgtgagaag

SEQ ID NO: 325179 - DNA, 16 bp, C. familiaris
tactgaggaaaaaaaa

SEQ ID NO: 325180 - DNA, 16 bp, C. familiaris
tactgatgaatggata

SEQ ID NO: 325181 - DNA, 16 bp, C. familiaris
tactgcctgccttcag

SEQ ID NO: 325182 - DNA, 16 bp, C. familiaris
tactgctgctgctgct

SEQ ID NO: 325183 - DNA, 16 bp, C. familiaris
tactggaacttcatca

SEQ ID NO: 325184 - DNA, 16 bp, C. familiaris
tactggagacccagga

SEQ ID NO: 325185 - DNA, 16 bp, C. familiaris
tactgggagacttgaa

SEQ ID NO: 325186 - DNA, 16 bp, C. familiaris
tactggggtgcctggg

SEQ ID NO: 325187 - DNA, 16 bp, C. familiaris
tactgggttttgtttt

SEQ ID NO: 325188 - DNA, 16 bp, C. familiaris
tactgtaaaaaatcca

SEQ ID NO: 325189 - DNA, 16 bp, C. familiaris
tactgtattttaaaaa

SEQ ID NO: 325190 - DNA, 16 bp, C. familiaris
tactgttctaggtgct

SEQ ID NO: 325191 - DNA, 16 bp, C. familiaris
tacttacctgactgag

SEQ ID NO: 325192 - DNA, 16 bp, C. familiaris
tacttatatatggaat

SEQ ID NO: 325193 - DNA, 16 bp, C. familiaris
tacttcatttttaaaa

SEQ ID NO: 325194 - DNA, 16 bp, C. familiaris
tacttctacctctgcc

SEQ ID NO: 325195 - DNA, 16 bp, C. familiaris
tacttctgtctctgcc

SEQ ID NO: 325196 - DNA, 16 bp, C. familiaris
tacttcttcctctcca

SEQ ID NO: 325197 - DNA, 16 bp, C. familiaris
tacttcttcctctgcc

SEQ ID NO: 325198 - DNA, 16 bp, C. familiaris
tacttcttcctgttcc

SEQ ID NO: 325199 - DNA, 16 bp, C. familiaris
tacttcttccttacta

SEQ ID NO: 325200 - DNA, 16 bp, C. familiaris
tacttcttttaaaaaa

SEQ ID NO: 325201 - DNA, 16 bp, C. familiaris
tactttaaaaaagttt

SEQ ID NO: 325202 - DNA, 16 bp, C. familiaris
tactttcctgtttctt

SEQ ID NO: 325203 - DNA, 16 bp, C. familiaris
tactttctctgcatct

SEQ ID NO: 325204 - DNA, 16 bp, C. familiaris
tactttgcagagggtt

SEQ ID NO: 325205 - DNA, 16 bp, C. familiaris
tactttgcccagatcc

SEQ ID NO: 325206 - DNA, 16 bp, C. familiaris
tactttggaaaataat

SEQ ID NO: 325207 - DNA, 16 bp, C. familiaris
tactttgtataatttt

SEQ ID NO: 325208 - DNA, 16 bp, C. familiaris
tacttttgaaatattt

SEQ ID NO: 325209 - DNA, 16 bp, C. familiaris
tacttttgaattttta

SEQ ID NO: 325210 - DNA, 16 bp, C. familiaris
tactttttaaaaagat

SEQ ID NO: 325211 - DNA, 16 bp, C. familiaris
tactttttcctttctg

SEQ ID NO: 325212 - DNA, 16 bp, C. familiaris
tactttttggctattg

SEQ ID NO: 325213 - DNA, 16 bp, C. familiaris
tagaaaaaatggacaa

SEQ ID NO: 325214 - DNA, 16 bp, C. familiaris
tagaaaacaaactgat

SEQ ID NO: 325215 - DNA, 16 bp, C. familiaris
tagaaaacccaaagga

SEQ ID NO: 325216 - DNA, 16 bp, C. familiaris
tagaaaacctgaaaga

SEQ ID NO: 325217 - DNA, 16 bp, C. familiaris
tagaaaaggaaactga

SEQ ID NO: 325218 - DNA, 16 bp, C. familiaris
tagaaaataatgaagc

SEQ ID NO: 325219 - DNA, 16 bp, C. familiaris
tagaaaatacaaacta

SEQ ID NO: 325220 - DNA, 16 bp, C. familiaris
tagaaaatatttattg

SEQ ID NO: 325221 - DNA, 16 bp, C. familiaris
tagaaaatcaccattt

SEQ ID NO: 325222 - DNA, 16 bp, C. familiaris
tagaaaatgaagaaca

SEQ ID NO: 325223 - DNA, 16 bp, C. familiaris
tagaaacaacaaatat

SEQ ID NO: 325224 - DNA, 16 bp, C. familiaris
tagaaactaatgaaaa

SEQ ID NO: 325225 - DNA, 16 bp, C. familiaris
tagaaacttttttttt

SEQ ID NO: 325226 - DNA, 16 bp, C. familiaris
tagaaaggaatgaaat

SEQ ID NO: 325227 - DNA, 16 bp, C. familiaris
tagaaataaaagaact

SEQ ID NO: 325228 - DNA, 16 bp, C. familiaris
tagaaataccatacaa

SEQ ID NO: 325229 - DNA, 16 bp, C. familiaris
tagaaataccctatga

SEQ ID NO: 325230 - DNA, 16 bp, C. familiaris
tagaaatactgaaaaa

SEQ ID NO: 325231 - DNA, 16 bp, C. familiaris
tagaaatatttctttt

SEQ ID NO: 325232 - DNA, 16 bp, C. familiaris
tagaaatcctagaaga

SEQ ID NO: 325233 - DNA, 16 bp, C. familiaris
tagaaatcttaaaaaa

SEQ ID NO: 325234 - DNA, 16 bp, C. familiaris
tagaaatgacaaatat

SEQ ID NO: 325235 - DNA, 16 bp, C. familiaris
tagaaatgattaagct

SEQ ID NO: 325236 - DNA, 16 bp, C. familiaris
tagaaatgcaaaggac

SEQ ID NO: 325237 - DNA, 16 bp, C. familiaris
tagaaatgcagaatct

SEQ ID NO: 325238 - DNA, 16 bp, C. familiaris
tagaaatggaagggaa

SEQ ID NO: 325239 - DNA, 16 bp, C. familiaris
tagaaatgtatccatt

SEQ ID NO: 325240 - DNA, 16 bp, C. familiaris
tagaaattcttaattt

SEQ ID NO: 325241 - DNA, 16 bp, C. familiaris
tagaacacattttttt

SEQ ID NO: 325242 - DNA, 16 bp, C. familiaris
tagaactaatcaacaa

SEQ ID NO: 325243 - DNA, 16 bp, C. familiaris
tagaactcatacagga

SEQ ID NO: 325244 - DNA, 16 bp, C. familiaris
tagaactggaaaaaaa

SEQ ID NO: 325245 - DNA, 16 bp, C. familiaris
tagaagaaaacagaag

SEQ ID NO: 325246 - DNA, 16 bp, C. familiaris
tagaagaaatggataa

SEQ ID NO: 325247 - DNA, 16 bp, C. familiaris
tagaagagaaaacagg

SEQ ID NO: 325248 - DNA, 16 bp, C. familiaris
tagaagcagaattgct

SEQ ID NO: 325249 - DNA, 16 bp, C. familiaris
tagaaggaaaacctca

SEQ ID NO: 325250 - DNA, 16 bp, C. familiaris
tagaagtggaatttct

SEQ ID NO: 325251 - DNA, 16 bp, C. familiaris
tagaatcacttgggga

SEQ ID NO: 325252 - DNA, 16 bp, C. familiaris
tagaatctttgaaaaa

SEQ ID NO: 325253 - DNA, 16 bp, C. familiaris
tagaatctttttttaa

SEQ ID NO: 325254 - DNA, 16 bp, C. familiaris
tagaattcaaacccag

SEQ ID NO: 325255 - DNA, 16 bp, C. familiaris
tagaattcatacagga

SEQ ID NO: 325256 - DNA, 16 bp, C. familiaris
tagaattgagtcctgc

SEQ ID NO: 325257 - DNA, 16 bp, C. familiaris
tagaattgttttttct

SEQ ID NO: 325258 - DNA, 16 bp, C. familiaris
tagacaaatccaaaga

SEQ ID NO: 325259 - DNA, 16 bp, C. familiaris
tagacaacaaactgat

SEQ ID NO: 325260 - DNA, 16 bp, C. familiaris
tagacaatctagaaga

SEQ ID NO: 325261 - DNA, 16 bp, C. familiaris
tagacaatggaatatt

SEQ ID NO: 325262 - DNA, 16 bp, C. familiaris
tagacacatatatcaa

SEQ ID NO: 325263 - DNA, 16 bp, C. familiaris
tagacatttctctaaa

SEQ ID NO: 325264 - DNA, 16 bp, C. familiaris
tagacatttgggctgt

SEQ ID NO: 325265 - DNA, 16 bp, C. familiaris
tagacccagcaattgc

SEQ ID NO: 325266 - DNA, 16 bp, C. familiaris
tagacctgggttcaaa

SEQ ID NO: 325267 - DNA, 16 bp, C. familiaris
tagactaaagaagaaa

SEQ ID NO: 325268 - DNA, 16 bp, C. familiaris
tagagaaaagagaacc

SEQ ID NO: 325269 - DNA, 16 bp, C. familiaris
tagagaaaggagaacc

SEQ ID NO: 325270 - DNA, 16 bp, C. familiaris
tagagaacacaggcaa

SEQ ID NO: 325271 - DNA, 16 bp, C. familiaris
tagagaagaaactgag

SEQ ID NO: 325272 - DNA, 16 bp, C. familiaris
tagagaagaagccaca

SEQ ID NO: 325273 - DNA, 16 bp, C. familiaris
tagagaatgtgactct

SEQ ID NO: 325274 - DNA, 16 bp, C. familiaris
tagagagagagcaagc

SEQ ID NO: 325275 - DNA, 16 bp, C. familiaris
tagagataaatgaaat

SEQ ID NO: 325276 - DNA, 16 bp, C. familiaris
tagagatacagagaga

SEQ ID NO: 325277 - DNA, 16 bp, C. familiaris
tagagatgaagaaatt

SEQ ID NO: 325278 - DNA, 16 bp, C. familiaris
tagagatgcagagaga

SEQ ID NO: 325279 - DNA, 16 bp, C. familiaris
tagagcagaacacagg

SEQ ID NO: 325280 - DNA, 16 bp, C. familiaris
tagagcagctcacaga

SEQ ID NO: 325281 - DNA, 16 bp, C. familiaris
tagaggaagcagagga

SEQ ID NO: 325282 - DNA, 16 bp, C. familiaris
tagaggatgtggagaa

SEQ ID NO: 325283 - DNA, 16 bp, C. familiaris
tagagggcagccccag

SEQ ID NO: 325284 - DNA, 16 bp, C. familiaris
tagagggcagcctggg

SEQ ID NO: 325285 - DNA, 16 bp, C. familiaris
tagagtggaaataaat

SEQ ID NO: 325286 - DNA, 16 bp, C. familiaris
tagataaagaagctgt

SEQ ID NO: 325287 - DNA, 16 bp, C. familiaris
tagatagtggtgatag

SEQ ID NO: 325288 - DNA, 16 bp, C. familiaris
tagatattttactttt

SEQ ID NO: 325289 - DNA, 16 bp, C. familiaris
tagatcctgcttctcc

SEQ ID NO: 325290 - DNA, 16 bp, C. familiaris
tagatgaaatagacca

SEQ ID NO: 325291 - DNA, 16 bp, C. familiaris
tagatgagaacttccc

SEQ ID NO: 325292 - DNA, 16 bp, C. familiaris
tagatgatatagatat

SEQ ID NO: 325293 - DNA, 16 bp, C. familiaris
tagatgatgatgatga

SEQ ID NO: 325294 - DNA, 16 bp, C. familiaris
tagatgattctgatga

SEQ ID NO: 325295 - DNA, 16 bp, C. familiaris
tagatgtggccatgtg

SEQ ID NO: 325296 - DNA, 16 bp, C. familiaris
tagattaacacatatt

SEQ ID NO: 325297 - DNA, 16 bp, C. familiaris
tagattcacagcaaaa

SEQ ID NO: 325298 - DNA, 16 bp, C. familiaris
tagattgggagaaaat

SEQ ID NO: 325299 - DNA, 16 bp, C. familiaris
tagattgtgtatttga

SEQ ID NO: 325300 - DNA, 16 bp, C. familiaris
tagatttttcatccat

SEQ ID NO: 325301 - DNA, 16 bp, C. familiaris
tagcaaaatggcagaa

SEQ ID NO: 325302 - DNA, 16 bp, C. familiaris
tagcaacatccctggc

SEQ ID NO: 325303 - DNA, 16 bp, C. familiaris
tagcaactttattcat

SEQ ID NO: 325304 - DNA, 16 bp, C. familiaris
tagcaatgtttttcta

SEQ ID NO: 325305 - DNA, 16 bp, C. familiaris
tagcacatctgtttac

SEQ ID NO: 325306 - DNA, 16 bp, C. familiaris
tagcaccgccttcagc

SEQ ID NO: 325307 - DNA, 16 bp, C. familiaris
tagcagaattactgga

SEQ ID NO: 325308 - DNA, 16 bp, C. familiaris
tagcagcaatggccac

SEQ ID NO: 325309 - DNA, 16 bp, C. familiaris
tagcagtgaacaaaac

SEQ ID NO: 325310 - DNA, 16 bp, C. familiaris
tagccaaagaggtgaa

SEQ ID NO: 325311 - DNA, 16 bp, C. familiaris
tagccaaagcaacctt

SEQ ID NO: 325312 - DNA, 16 bp, C. familiaris
tagccaagaaagaatt

SEQ ID NO: 325313 - DNA, 16 bp, C. familiaris
tagccactgtggaaaa

SEQ ID NO: 325314 - DNA, 16 bp, C. familiaris
tagccactgtggaaga

SEQ ID NO: 325315 - DNA, 16 bp, C. familiaris
tagccagggaggaaat

SEQ ID NO: 325316 - DNA, 16 bp, C. familiaris
tagccatttctttttt

SEQ ID NO: 325317 - DNA, 16 bp, C. familiaris
tagcccaggaaaagat

SEQ ID NO: 325318 - DNA, 16 bp, C. familiaris
tagcccatctcccacc

SEQ ID NO: 325319 - DNA, 16 bp, C. familiaris
tagctattacaaataa

SEQ ID NO: 325320 - DNA, 16 bp, C. familiaris
tagctcattccttttt

SEQ ID NO: 325321 - DNA, 16 bp, C. familiaris
tagcttcatccatgtc

SEQ ID NO: 325322 - DNA, 16 bp, C. familiaris
tagctttgtaagtgat

SEQ ID NO: 325323 - DNA, 16 bp, C. familiaris
taggaaaagaaaattt

SEQ ID NO: 325324 - DNA, 16 bp, C. familiaris
taggaaacaaaatgaa

SEQ ID NO: 325325 - DNA, 16 bp, C. familiaris
taggaaacattaaaaa

SEQ ID NO: 325326 - DNA, 16 bp, C. familiaris
taggaaataaaacaga

SEQ ID NO: 325327 - DNA, 16 bp, C. familiaris
taggaataaatttaat

SEQ ID NO: 325328 - DNA, 16 bp, C. familiaris
taggaattattattat

SEQ ID NO: 325329 - DNA, 16 bp, C. familiaris
taggagaaaacctaga

SEQ ID NO: 325330 - DNA, 16 bp, C. familiaris
taggatttatttgctg

SEQ ID NO: 325331 - DNA, 16 bp, C. familiaris
taggattttgatggaa

SEQ ID NO: 325332 - DNA, 16 bp, C. familiaris
taggattttgatggct

SEQ ID NO: 325333 - DNA, 16 bp, C. familiaris
taggcaaaggacctga

SEQ ID NO: 325334 - DNA, 16 bp, C. familiaris
taggcaaaggatttga

SEQ ID NO: 325335 - DNA, 16 bp, C. familiaris
taggcaatgatttctt

SEQ ID NO: 325336 - DNA, 16 bp, C. familiaris
taggcagagacagaag

SEQ ID NO: 325337 - DNA, 16 bp, C. familiaris
taggcgctcaataaat

SEQ ID NO: 325338 - DNA, 16 bp, C. familiaris
taggctccaagcaggg

SEQ ID NO: 325339 - DNA, 16 bp, C. familiaris
taggctgaaggcagcg

SEQ ID NO: 325340 - DNA, 16 bp, C. familiaris
taggcttcacacccag

SEQ ID NO: 325341 - DNA, 16 bp, C. familiaris
tagggattactttaaa

SEQ ID NO: 325342 - DNA, 16 bp, C. familiaris
tagggatttcattgaa

SEQ ID NO: 325343 - DNA, 16 bp, C. familiaris
taggggtgcagatatc

SEQ ID NO: 325344 - DNA, 16 bp, C. familiaris
taggtctttggaaaaa

SEQ ID NO: 325345 - DNA, 16 bp, C. familiaris
taggtgttctttatat

SEQ ID NO: 325346 - DNA, 16 bp, C. familiaris
tagtaattcatcagtt

SEQ ID NO: 325347 - DNA, 16 bp, C. familiaris
tagtagaacagatcaa

SEQ ID NO: 325348 - DNA, 16 bp, C. familiaris
tagtatccaaaatcca

SEQ ID NO: 325349 - DNA, 16 bp, C. familiaris
tagtatgtgtgtatat

SEQ ID NO: 325350 - DNA, 16 bp, C. familiaris
tagtattttattgaga

SEQ ID NO: 325351 - DNA, 16 bp, C. familiaris
tagtcacagagagaaa

SEQ ID NO: 325352 - DNA, 16 bp, C. familiaris
tagtcattttgttcag

SEQ ID NO: 325353 - DNA, 16 bp, C. familiaris
tagtctctttaacaaa

SEQ ID NO: 325354 - DNA, 16 bp, C. familiaris
tagtgaaaatgaagat

SEQ ID NO: 325355 - DNA, 16 bp, C. familiaris
tagtgaacaaaacaga

SEQ ID NO: 325356 - DNA, 16 bp, C. familiaris
tagtgccgcctgcagc

SEQ ID NO: 325357 - DNA, 16 bp, C. familiaris
tagtggcataaaacaa

SEQ ID NO: 325358 - DNA, 16 bp, C. familiaris
tagtgggaatgcaaat

SEQ ID NO: 325359 - DNA, 16 bp, C. familiaris
tagtggtgataaattc

SEQ ID NO: 325360 - DNA, 16 bp, C. familiaris
tagtggtgatgatggt

SEQ ID NO: 325361 - DNA, 16 bp, C. familiaris
tagtgtccttataaaa

SEQ ID NO: 325362 - DNA, 16 bp, C. familiaris
tagttaataatagtgt

SEQ ID NO: 325363 - DNA, 16 bp, C. familiaris
tagttattcattcatt

SEQ ID NO: 325364 - DNA, 16 bp, C. familiaris
tagttcccagggaagg

SEQ ID NO: 325365 - DNA, 16 bp, C. familiaris
tagttctgtaaaaaaa

SEQ ID NO: 325366 - DNA, 16 bp, C. familiaris
tagttctgtgaaaaat

SEQ ID NO: 325367 - DNA, 16 bp, C. familiaris
tagttcttccaatcca

SEQ ID NO: 325368 - DNA, 16 bp, C. familiaris
tagttgctcttttaaa

SEQ ID NO: 325369 - DNA, 16 bp, C. familiaris
tagttgtggaatttgt

SEQ ID NO: 325370 - DNA, 16 bp, C. familiaris
tagttttgataaatgt

SEQ ID NO: 325371 - DNA, 16 bp, C. familiaris
tagttttgccttttca

SEQ ID NO: 325372 - DNA, 16 bp, C. familiaris
tagtttttggctatta

SEQ ID NO: 325373 - DNA, 16 bp, C. familiaris
tataaaaagttccagc

SEQ ID NO: 325374 - DNA, 16 bp, C. familiaris
tataaaactcaatacc

SEQ ID NO: 325375 - DNA, 16 bp, C. familiaris
tataaaactgatgaat

SEQ ID NO: 325376 - DNA, 16 bp, C. familiaris
tataaaatacatcttt

SEQ ID NO: 325377 - DNA, 16 bp, C. familiaris
tataaaatggaatatt

SEQ ID NO: 325378 - DNA, 16 bp, C. familiaris
tataaaatgtacaaaa

SEQ ID NO: 325379 - DNA, 16 bp, C. familiaris
tataaaccacccagtc

SEQ ID NO: 325380 - DNA, 16 bp, C. familiaris
tataaacttcaaagtt

SEQ ID NO: 325381 - DNA, 16 bp, C. familiaris
tataaagagaaacttc

SEQ ID NO: 325382 - DNA, 16 bp, C. familiaris
tataaatatatatgca

SEQ ID NO: 325383 - DNA, 16 bp, C. familiaris
tataaatgaagaaact

SEQ ID NO: 325384 - DNA, 16 bp, C. familiaris
tataaatgcttttaaa

SEQ ID NO: 325385 - DNA, 16 bp, C. familiaris
tataaatgtgtgtgtg

SEQ ID NO: 325386 - DNA, 16 bp, C. familiaris
tataaatttgcctatt

SEQ ID NO: 325387 - DNA, 16 bp, C. familiaris
tataacattctcaaaa

SEQ ID NO: 325388 - DNA, 16 bp, C. familiaris
tataactatatataca

SEQ ID NO: 325389 - DNA, 16 bp, C. familiaris
tataagaactaaaact

SEQ ID NO: 325390 - DNA, 16 bp, C. familiaris
tataagcaactgatga

SEQ ID NO: 325391 - DNA, 16 bp, C. familiaris
tataagtcctttgtca

SEQ ID NO: 325392 - DNA, 16 bp, C. familiaris
tataatacctttcact

SEQ ID NO: 325393 - DNA, 16 bp, C. familiaris
tataatggactactac

SEQ ID NO: 325394 - DNA, 16 bp, C. familiaris
tataatgtttgttctt

SEQ ID NO: 325395 - DNA, 16 bp, C. familiaris
tataattgatgaacct

SEQ ID NO: 325396 - DNA, 16 bp, C. familiaris
tataattttgcttctg

SEQ ID NO: 325397 - DNA, 16 bp, C. familiaris
tatacaaagaacttct

SEQ ID NO: 325398 - DNA, 16 bp, C. familiaris
tatacaacattttgtt

SEQ ID NO: 325399 - DNA, 16 bp, C. familiaris
tatacaagtgatgaat

SEQ ID NO: 325400 - DNA, 16 bp, C. familiaris
tatacaatggaatatt

SEQ ID NO: 325401 - DNA, 16 bp, C. familiaris
tatacacatctatata

SEQ ID NO: 325402 - DNA, 16 bp, C. familiaris
tatacagattgggaag

SEQ ID NO: 325403 - DNA, 16 bp, C. familiaris
tatacagcaataaaaa

SEQ ID NO: 325404 - DNA, 16 bp, C. familiaris
tatacaggggatccct

SEQ ID NO: 325405 - DNA, 16 bp, C. familiaris
tatacatatatataca

SEQ ID NO: 325406 - DNA, 16 bp, C. familiaris
tatacattatgtatat

SEQ ID NO: 325407 - DNA, 16 bp, C. familiaris
tatactgtatgtatat

SEQ ID NO: 325408 - DNA, 16 bp, C. familiaris
tatactgtctacaaga

SEQ ID NO: 325409 - DNA, 16 bp, C. familiaris
tatactgttttccaga

SEQ ID NO: 325410 - DNA, 16 bp, C. familiaris
tatagaaaatacagaa

SEQ ID NO: 325411 - DNA, 16 bp, C. familiaris
tatagaaatgccagtg

SEQ ID NO: 325412 - DNA, 16 bp, C. familiaris
tatagaccttggaaac

SEQ ID NO: 325413 - DNA, 16 bp, C. familiaris
tatagataaggaaatt

SEQ ID NO: 325414 - DNA, 16 bp, C. familiaris
tatagatgaaaaaact

SEQ ID NO: 325415 - DNA, 16 bp, C. familiaris
tatagctttgcagtat

SEQ ID NO: 325416 - DNA, 16 bp, C. familiaris
tataggaattcagcaa

SEQ ID NO: 325417 - DNA, 16 bp, C. familiaris
tatataaacacataca

SEQ ID NO: 325418 - DNA, 16 bp, C. familiaris
tatataaagaagatgt

SEQ ID NO: 325419 - DNA, 16 bp, C. familiaris
tatatacacaaacata

SEQ ID NO: 325420 - DNA, 16 bp, C. familiaris
tatatacatatgtcaa

SEQ ID NO: 325421 - DNA, 16 bp, C. familiaris
tatatagagagaaaga

SEQ ID NO: 325422 - DNA, 16 bp, C. familiaris
tatatatatacacaac

SEQ ID NO: 325423 - DNA, 16 bp, C. familiaris
tatatatatatagtac

SEQ ID NO: 325424 - DNA, 16 bp, C. familiaris
tatatatatatcatgg

SEQ ID NO: 325425 - DNA, 16 bp, C. familiaris
tatatatattctcata

SEQ ID NO: 325426 - DNA, 16 bp, C. familiaris
tatatatccaatatat

SEQ ID NO: 325427 - DNA, 16 bp, C. familiaris
tatatatgaaatatgt

SEQ ID NO: 325428 - DNA, 16 bp, C. familiaris
tatatatgaaatggaa

SEQ ID NO: 325429 - DNA, 16 bp, C. familiaris
tatatatgaatattac

SEQ ID NO: 325430 - DNA, 16 bp, C. familiaris
tatatatgacatatat

SEQ ID NO: 325431 - DNA, 16 bp, C. familiaris
tatatatgcatatata

SEQ ID NO: 325432 - DNA, 16 bp, C. familiaris
tatatatggtgtatat

SEQ ID NO: 325433 - DNA, 16 bp, C. familiaris
tatatatgtatataca

SEQ ID NO: 325434 - DNA, 16 bp, C. familiaris
tatatatgtgtatata

SEQ ID NO: 325435 - DNA, 16 bp, C. familiaris
tatatattgctgaatt

SEQ ID NO: 325436 - DNA, 16 bp, C. familiaris
tatatattgtgaaatg

SEQ ID NO: 325437 - DNA, 16 bp, C. familiaris
tatatcacattttctt

SEQ ID NO: 325438 - DNA, 16 bp, C. familiaris
tatatgaaaaggcaaa

SEQ ID NO: 325439 - DNA, 16 bp, C. familiaris
tatatgaaaatgcaaa

SEQ ID NO: 325440 - DNA, 16 bp, C. familiaris
tatatgaagaaaatga

SEQ ID NO: 325441 - DNA, 16 bp, C. familiaris
tatatgaagaatatat

SEQ ID NO: 325442 - DNA, 16 bp, C. familiaris
tatatgaagttttaaa

SEQ ID NO: 325443 - DNA, 16 bp, C. familiaris
tatatgacttttaaaa

SEQ ID NO: 325444 - DNA, 16 bp, C. familiaris
tatatgcacacacata

SEQ ID NO: 325445 - DNA, 16 bp, C. familiaris
tatatgcttatatatt

SEQ ID NO: 325446 - DNA, 16 bp, C. familiaris
tatatggaaaatctct

SEQ ID NO: 325447 - DNA, 16 bp, C. familiaris
tatatggagcctgctt

SEQ ID NO: 325448 - DNA, 16 bp, C. familiaris
tatatggggagaaata

SEQ ID NO: 325449 - DNA, 16 bp, C. familiaris
tatatgtacagtggaa

SEQ ID NO: 325450 - DNA, 16 bp, C. familiaris
tatatgtacgtgtgtg

SEQ ID NO: 325451 - DNA, 16 bp, C. familiaris
tatatgtatacttttt

SEQ ID NO: 325452 - DNA, 16 bp, C. familiaris
tatatgtattttacca

SEQ ID NO: 325453 - DNA, 16 bp, C. familiaris
tatatgtcacatcttc

SEQ ID NO: 325454 - DNA, 16 bp, C. familiaris
tatatgtctttggaga

SEQ ID NO: 325455 - DNA, 16 bp, C. familiaris
tatatgtggaacttaa

SEQ ID NO: 325456 - DNA, 16 bp, C. familiaris
tatatgttctttatat

SEQ ID NO: 325457 - DNA, 16 bp, C. familiaris
tatatgttttgaaaat

SEQ ID NO: 325458 - DNA, 16 bp, C. familiaris
tatattacaaagccat

SEQ ID NO: 325459 - DNA, 16 bp, C. familiaris
tatattacatgtatat

SEQ ID NO: 325460 - DNA, 16 bp, C. familiaris
tatattcaagagaaat

SEQ ID NO: 325461 - DNA, 16 bp, C. familiaris
tatattcacagaattg

SEQ ID NO: 325462 - DNA, 16 bp, C. familiaris
tatattcacatacaca

SEQ ID NO: 325463 - DNA, 16 bp, C. familiaris
tatattcacatttata

SEQ ID NO: 325464 - DNA, 16 bp, C. familiaris
tatattcatatataca

SEQ ID NO: 325465 - DNA, 16 bp, C. familiaris
tatattcatgagaaac

SEQ ID NO: 325466 - DNA, 16 bp, C. familiaris
tatattccccatataa

SEQ ID NO: 325467 - DNA, 16 bp, C. familiaris
tatattctagataaaa

SEQ ID NO: 325468 - DNA, 16 bp, C. familiaris
tatattctgctgttgt

SEQ ID NO: 325469 - DNA, 16 bp, C. familiaris
tatattgcaaaatggt

SEQ ID NO: 325470 - DNA, 16 bp, C. familiaris
tatattgttgaatttg

SEQ ID NO: 325471 - DNA, 16 bp, C. familiaris
tatatttaactttttg

SEQ ID NO: 325472 - DNA, 16 bp, C. familiaris
tatatttaagagagag

SEQ ID NO: 325473 - DNA, 16 bp, C. familiaris
tatatttatacataca

SEQ ID NO: 325474 - DNA, 16 bp, C. familiaris
tatatttgcaatattt

SEQ ID NO: 325475 - DNA, 16 bp, C. familiaris
tatattttaaaagcat

SEQ ID NO: 325476 - DNA, 16 bp, C. familiaris
tatattttcagtttta

SEQ ID NO: 325477 - DNA, 16 bp, C. familiaris
tatattttctatgtct

SEQ ID NO: 325478 - DNA, 16 bp, C. familiaris
tatattttctttgaaa

SEQ ID NO: 325479 - DNA, 16 bp, C. familiaris
tatattttgcaaaatt

SEQ ID NO: 325480 - DNA, 16 bp, C. familiaris
tatatttttccatccc

SEQ ID NO: 325481 - DNA, 16 bp, C. familiaris
tatatttttggaaaat

SEQ ID NO: 325482 - DNA, 16 bp, C. familiaris
tatcaaaaacatgatt

SEQ ID NO: 325483 - DNA, 16 bp, C. familiaris
tatcaaaaagaatgaa

SEQ ID NO: 325484 - DNA, 16 bp, C. familiaris
tatcaaaataccaaca

SEQ ID NO: 325485 - DNA, 16 bp, C. familiaris
tatcaaaatattttct

SEQ ID NO: 325486 - DNA, 16 bp, C. familiaris
tatcaaaatgtatttt

SEQ ID NO: 325487 - DNA, 16 bp, C. familiaris
tatcaaacatcttttc

SEQ ID NO: 325488 - DNA, 22 bp, C. familiaris
tatcaaacgtttaaagaagaaa

SEQ ID NO: 325489 - DNA, 16 bp, C. familiaris
tatcaaatgatttttt

SEQ ID NO: 325490 - DNA, 16 bp, C. familiaris
tatcaacagaataaag

SEQ ID NO: 325491 - DNA, 16 bp, C. familiaris
tatcaacaggagaaaa

SEQ ID NO: 325492 - DNA, 16 bp, C. familiaris
tatcaagaaaatgaaa

SEQ ID NO: 325493 - DNA, 16 bp, C. familiaris
tatcaatgatttcttt

SEQ ID NO: 325494 - DNA, 16 bp, C. familiaris
tatcacattttgtttt

SEQ ID NO: 325495 - DNA, 16 bp, C. familiaris
tatcacccccatttta

SEQ ID NO: 325496 - DNA, 16 bp, C. familiaris
tatcagaaaaattaaa

SEQ ID NO: 325497 - DNA, 16 bp, C. familiaris
tatcagaattttaaaa

SEQ ID NO: 325498 - DNA, 16 bp, C. familiaris
tatcagacaaaacaga

SEQ ID NO: 325499 - DNA, 41 bp, C. familiaris
tatcagataaagggctagtttccaagatctataaagaactt

SEQ ID NO: 325500 - DNA, 16 bp, C. familiaris
tatcaggaatgagaga

SEQ ID NO: 325501 - DNA, 16 bp, C. familiaris
tatcaggctccctgaa

SEQ ID NO: 325502 - DNA, 16 bp, C. familiaris
tatcagttctttatat

SEQ ID NO: 325503 - DNA, 16 bp, C. familiaris
tatcatcatcatctat

SEQ ID NO: 325504 - DNA, 16 bp, C. familiaris
tatcattgacattttc

SEQ ID NO: 325505 - DNA, 16 bp, C. familiaris
tatcattttcaaatat

SEQ ID NO: 325506 - DNA, 16 bp, C. familiaris
tatccaaaggataaaa

SEQ ID NO: 325507 - DNA, 16 bp, C. familiaris
tatccaatggaaaaaa

SEQ ID NO: 325508 - DNA, 16 bp, C. familiaris
tatccactagaaaaag

SEQ ID NO: 325509 - DNA, 16 bp, C. familiaris
tatccattctttcatt

SEQ ID NO: 325510 - DNA, 16 bp, C. familiaris
tatccatttatcaatt

SEQ ID NO: 325511 - DNA, 16 bp, C. familiaris
tatcccaggtctccag

SEQ ID NO: 325512 - DNA, 16 bp, C. familiaris
tatcctgggactccag

SEQ ID NO: 325513 - DNA, 16 bp, C. familiaris
tatccttaccaacact

SEQ ID NO: 325514 - DNA, 16 bp, C. familiaris
tatccttttaaaaaaa

SEQ ID NO: 325515 - DNA, 16 bp, C. familiaris
tatctagttttcccaa

SEQ ID NO: 325516 - DNA, 16 bp, C. familiaris
tatctatctatttgag

SEQ ID NO: 325517 - DNA, 16 bp, C. familiaris
tatctatgtctctgcc

SEQ ID NO: 325518 - DNA, 16 bp, C. familiaris
tatctctcctcctatt

SEQ ID NO: 325519 - DNA, 16 bp, C. familiaris
tatctctgcctttctc

SEQ ID NO: 325520 - DNA, 16 bp, C. familiaris
tatctctgcttctctg

SEQ ID NO: 325521 - DNA, 16 bp, C. familiaris
tatctgaacaagaatt

SEQ ID NO: 325522 - DNA, 16 bp, C. familiaris
tatctgatgaaggact

SEQ ID NO: 325523 - DNA, 16 bp, C. familiaris
tatctgcctccagctc

SEQ ID NO: 325524 - DNA, 16 bp, C. familiaris
tatctggccttttaca

SEQ ID NO: 325525 - DNA, 16 bp, C. familiaris
tatctggtatgtcatt

SEQ ID NO: 325526 - DNA, 16 bp, C. familiaris
tatctggttttggaat

SEQ ID NO: 325527 - DNA, 16 bp, C. familiaris
tatctgtaaaatggag

SEQ ID NO: 325528 - DNA, 16 bp, C. familiaris
tatctgtcaaagatgt

SEQ ID NO: 325529 - DNA, 16 bp, C. familiaris
tatctgtgaaatctgt

SEQ ID NO: 325530 - DNA, 16 bp, C. familiaris
tatctgtgtatgtgtg

SEQ ID NO: 325531 - DNA, 16 bp, C. familiaris
tatctgttgagacctg

SEQ ID NO: 325532 - DNA, 16 bp, C. familiaris
tatcttacagttctgg

SEQ ID NO: 325533 - DNA, 16 bp, C. familiaris
tatcttactgtttttg

SEQ ID NO: 325534 - DNA, 16 bp, C. familiaris
tatcttcaaatattta

SEQ ID NO: 325535 - DNA, 16 bp, C. familiaris
tatcttctgcttctgt

SEQ ID NO: 325536 - DNA, 16 bp, C. familiaris
tatcttggaaaaaaaa

SEQ ID NO: 325537 - DNA, 16 bp, C. familiaris
tatcttggaagaagtt

SEQ ID NO: 325538 - DNA, 16 bp, C. familiaris
tatctttggagaaatg

SEQ ID NO: 325539 - DNA, 16 bp, C. familiaris
tatcttttcaacaaat

SEQ ID NO: 325540 - DNA, 16 bp, C. familiaris
tatcttttgtgtgtgt

SEQ ID NO: 325541 - DNA, 16 bp, C. familiaris
tatgaaaactttcaaa

SEQ ID NO: 325542 - DNA, 16 bp, C. familiaris
tatgaaaagttatatg

SEQ ID NO: 325543 - DNA, 16 bp, C. familiaris
tatgaaacatttaaag

SEQ ID NO: 325544 - DNA, 16 bp, C. familiaris
tatgaaaccagcatta

SEQ ID NO: 325545 - DNA, 16 bp, C. familiaris
tatgaaagtgttgaat

SEQ ID NO: 325546 - DNA, 16 bp, C. familiaris
tatgaagaaactgaag

SEQ ID NO: 325547 - DNA, 16 bp, C. familiaris
tatgaagaaattggaa

SEQ ID NO: 325548 - DNA, 16 bp, C. familiaris
tatgaagatgaaatga

SEQ ID NO: 325549 - DNA, 16 bp, C. familiaris
tatgaagatgataaaa

SEQ ID NO: 325550 - DNA, 16 bp, C. familiaris
tatgaagctagtatta

SEQ ID NO: 325551 - DNA, 16 bp, C. familiaris
tatgaaggaaaacaaa

SEQ ID NO: 325552 - DNA, 16 bp, C. familiaris
tatgaagtattcttgc

SEQ ID NO: 325553 - DNA, 16 bp, C. familiaris
tatgaatataaatatg

SEQ ID NO: 325554 - DNA, 16 bp, C. familiaris
tatgaatatccagttt

SEQ ID NO: 325555 - DNA, 16 bp, C. familiaris
tatgaatggaatcata

SEQ ID NO: 325556 - DNA, 16 bp, C. familiaris
tatgaattgcaaatat

SEQ ID NO: 325557 - DNA, 16 bp, C. familiaris
tatgaatttgcctatt

SEQ ID NO: 325558 - DNA, 16 bp, C. familiaris
tatgacattctggaag

SEQ ID NO: 325559 - DNA, 16 bp, C. familiaris
tatgacccagcaactg

SEQ ID NO: 325560 - DNA, 16 bp, C. familiaris
tatgacccagcaattg

SEQ ID NO: 325561 - DNA, 16 bp, C. familiaris
tatgagaagaggaaga

SEQ ID NO: 325562 - DNA, 16 bp, C. familiaris
tatgaggaaactgaag

SEQ ID NO: 325563 - DNA, 16 bp, C. familiaris
tatgaggccaccatca

SEQ ID NO: 325564 - DNA, 16 bp, C. familiaris
tatgaggccagcaata

SEQ ID NO: 325565 - DNA, 16 bp, C. familiaris
tatgagtgaaatcaaa

SEQ ID NO: 325566 - DNA, 16 bp, C. familiaris
tatgatgacagatggt

SEQ ID NO: 325567 - DNA, 16 bp, C. familiaris
tatgatgatgatgatg

SEQ ID NO: 325568 - DNA, 16 bp, C. familiaris
tatgatgttgaagtat

SEQ ID NO: 325569 - DNA, 16 bp, C. familiaris
tatgattccactcata

SEQ ID NO: 325570 - DNA, 16 bp, C. familiaris
tatgcagccttaaaaa

SEQ ID NO: 325571 - DNA, 16 bp, C. familiaris
tatgcatacatgtata

SEQ ID NO: 325572 - DNA, 16 bp, C. familiaris
tatgcatctcttccac

SEQ ID NO: 325573 - DNA, 16 bp, C. familiaris
tatgcatgcatgcaca

SEQ ID NO: 325574 - DNA, 16 bp, C. familiaris
tatgccacattttctt

SEQ ID NO: 325575 - DNA, 16 bp, C. familiaris
tatgcccagtgtggag

SEQ ID NO: 325576 - DNA, 16 bp, C. familiaris
tatgctaagtaaaaaa

SEQ ID NO: 325577 - DNA, 16 bp, C. familiaris
tatgctaagtgaatta

SEQ ID NO: 325578 - DNA, 16 bp, C. familiaris
tatgctcaacatcatt

SEQ ID NO: 325579 - DNA, 16 bp, C. familiaris
tatgcttgggattctc

SEQ ID NO: 325580 - DNA, 16 bp, C. familiaris
tatggaaaatatttat

SEQ ID NO: 325581 - DNA, 16 bp, C. familiaris
tatggaaatctgttgc

SEQ ID NO: 325582 - DNA, 16 bp, C. familiaris
tatggaactgatgaat

SEQ ID NO: 325583 - DNA, 16 bp, C. familiaris
tatggactttggatga

SEQ ID NO: 325584 - DNA, 16 bp, C. familiaris
tatggaggaaaaggaa

SEQ ID NO: 325585 - DNA, 16 bp, C. familiaris
tatggatatgtgtgtg

SEQ ID NO: 325586 - DNA, 16 bp, C. familiaris
tatggatggacatttg

SEQ ID NO: 325587 - DNA, 21 bp, C. familiaris
tatggcagtggcagaaggttt

SEQ ID NO: 325588 - DNA, 16 bp, C. familiaris
tatgggactcaatcca

SEQ ID NO: 325589 - DNA, 16 bp, C. familiaris
tatgggagagaggact

SEQ ID NO: 325590 - DNA, 16 bp, C. familiaris
tatgggctgaactgtg

SEQ ID NO: 325591 - DNA, 16 bp, C. familiaris
tatggggcagcccagg

SEQ ID NO: 325592 - DNA, 16 bp, C. familiaris
tatgggggtgcctggg

SEQ ID NO: 325593 - DNA, 16 bp, C. familiaris
tatggtagtcacagag

SEQ ID NO: 325594 - DNA, 16 bp, C. familiaris
tatggtatttgttttc

SEQ ID NO: 325595 - DNA, 16 bp, C. familiaris
tatggtcaccatgctg

SEQ ID NO: 325596 - DNA, 16 bp, C. familiaris
tatggtgtaagataag

SEQ ID NO: 325597 - DNA, 16 bp, C. familiaris
tatggtttcattcttt

SEQ ID NO: 325598 - DNA, 16 bp, C. familiaris
tatgtaaagaattctt

SEQ ID NO: 325599 - DNA, 16 bp, C. familiaris
tatgtaaataatgaat

SEQ ID NO: 325600 - DNA, 16 bp, C. familiaris
tatgtacaggaaaaaa

SEQ ID NO: 325601 - DNA, 16 bp, C. familiaris
tatgtacataaacata

SEQ ID NO: 325602 - DNA, 16 bp, C. familiaris
tatgtatattaaatca

SEQ ID NO: 325603 - DNA, 16 bp, C. familiaris
tatgtatattacatat

SEQ ID NO: 325604 - DNA, 16 bp, C. familiaris
tatgtatattttaaca

SEQ ID NO: 325605 - DNA, 16 bp, C. familiaris
tatgtatctgtgtgtg

SEQ ID NO: 325606 - DNA, 16 bp, C. familiaris
tatgtatgtaaaaata

SEQ ID NO: 325607 - DNA, 16 bp, C. familiaris
tatgtattgtgtatat

SEQ ID NO: 325608 - DNA, 16 bp, C. familiaris
tatgtattgttggatt

SEQ ID NO: 325609 - DNA, 16 bp, C. familiaris
tatgtattttatcaca

SEQ ID NO: 325610 - DNA, 16 bp, C. familiaris
tatgtcaattacatct

SEQ ID NO: 325611 - DNA, 16 bp, C. familiaris
tatgtctatgtgtgtg

SEQ ID NO: 325612 - DNA, 16 bp, C. familiaris
tatgtctcctgctctt

SEQ ID NO: 325613 - DNA, 16 bp, C. familiaris
tatgtctctgcttctc

SEQ ID NO: 325614 - DNA, 16 bp, C. familiaris
tatgtcttcctctgaa

SEQ ID NO: 325615 - DNA, 16 bp, C. familiaris
tatgtgaaatttaaaa

SEQ ID NO: 325616 - DNA, 16 bp, C. familiaris
tatgtgaccaccaacc

SEQ ID NO: 325617 - DNA, 16 bp, C. familiaris
tatgtgctctctttct

SEQ ID NO: 325618 - DNA, 16 bp, C. familiaris
tatgtggaatcagaaa

SEQ ID NO: 325619 - DNA, 16 bp, C. familiaris
tatgtgtatatacaca

SEQ ID NO: 325620 - DNA, 16 bp, C. familiaris
tatgtgtatttataaa

SEQ ID NO: 325621 - DNA, 16 bp, C. familiaris
tatgtgtgtatctata

SEQ ID NO: 325622 - DNA, 16 bp, C. familiaris
tatgtgttaaatgaat

SEQ ID NO: 325623 - DNA, 16 bp, C. familiaris
tatgtgttatatatgt

SEQ ID NO: 325624 - DNA, 16 bp, C. familiaris
tatgtgtttgtatata

SEQ ID NO: 325625 - DNA, 16 bp, C. familiaris
tatgttaattatcttg

SEQ ID NO: 325626 - DNA, 16 bp, C. familiaris
tatgttattggtaagg

SEQ ID NO: 325627 - DNA, 16 bp, C. familiaris
tatgttgaatggcagt

SEQ ID NO: 325628 - DNA, 16 bp, C. familiaris
tatgtttatgtacata

SEQ ID NO: 325629 - DNA, 16 bp, C. familiaris
tatgtttatttctaaa

SEQ ID NO: 325630 - DNA, 16 bp, C. familiaris
tatgtttgtgcatgtg

SEQ ID NO: 325631 - DNA, 16 bp, C. familiaris
tatgttttatacattt

SEQ ID NO: 325632 - DNA, 16 bp, C. familiaris
tatgttttcttctagt

SEQ ID NO: 325633 - DNA, 16 bp, C. familiaris
tatgtttttaaaagta

SEQ ID NO: 325634 - DNA, 16 bp, C. familiaris
tattaaaatacagatt

SEQ ID NO: 325635 - DNA, 16 bp, C. familiaris
tattaaaattccaatg

SEQ ID NO: 325636 - DNA, 16 bp, C. familiaris
tattaaagaaatcaaa

SEQ ID NO: 325637 - DNA, 16 bp, C. familiaris
tattaacaatgaaaaa

SEQ ID NO: 325638 - DNA, 16 bp, C. familiaris
tattaagctgagtgaa

SEQ ID NO: 325639 - DNA, 16 bp, C. familiaris
tattacagataaggaa

SEQ ID NO: 325640 - DNA, 16 bp, C. familiaris
tattacagatgaagaa

SEQ ID NO: 325641 - DNA, 16 bp, C. familiaris
tattaccaaggctttg

SEQ ID NO: 325642 - DNA, 16 bp, C. familiaris
tattagagagagagaa

SEQ ID NO: 325643 - DNA, 16 bp, C. familiaris
tattataaataatgct

SEQ ID NO: 325644 - DNA, 16 bp, C. familiaris
tattatacatatacat

SEQ ID NO: 325645 - DNA, 16 bp, C. familiaris
tattatcatccctatt

SEQ ID NO: 325646 - DNA, 16 bp, C. familiaris
tattatccccatgtta

SEQ ID NO: 325647 - DNA, 16 bp, C. familiaris
tattatcctcatttta

SEQ ID NO: 325648 - DNA, 16 bp, C. familiaris
tattatgtatttgaaa

SEQ ID NO: 325649 - DNA, 16 bp, C. familiaris
tattattacatttgtt

SEQ ID NO: 325650 - DNA, 16 bp, C. familiaris
tattattatcaatgtg

SEQ ID NO: 325651 - DNA, 16 bp, C. familiaris
tattattatccttact

SEQ ID NO: 325652 - DNA, 16 bp, C. familiaris
tattattcagtcttta

SEQ ID NO: 325653 - DNA, 16 bp, C. familiaris
tattatttaaaaatgg

SEQ ID NO: 325654 - DNA, 16 bp, C. familiaris
tattatttactgtatt

SEQ ID NO: 325655 - DNA, 16 bp, C. familiaris
tattatttagccatga

SEQ ID NO: 325656 - DNA, 16 bp, C. familiaris
tattatttcccttctg

SEQ ID NO: 325657 - DNA, 16 bp, C. familiaris
tattattttgaatgaa

SEQ ID NO: 325658 - DNA, 16 bp, C. familiaris
tattcaaaatgtattt

SEQ ID NO: 325659 - DNA, 16 bp, C. familiaris
tattcaaagaaaacaa

SEQ ID NO: 325660 - DNA, 16 bp, C. familiaris
tattcaaatatgcttt

SEQ ID NO: 325661 - DNA, 16 bp, C. familiaris
tattcaacaaataatt

SEQ ID NO: 325662 - DNA, 16 bp, C. familiaris
tattcaacagaatatt

SEQ ID NO: 325663 - DNA, 16 bp, C. familiaris
tattcaagaaatcatt

SEQ ID NO: 325664 - DNA, 16 bp, C. familiaris
tattcagaaaagaaaa

SEQ ID NO: 325665 - DNA, 16 bp, C. familiaris
tattcagattgtctat

SEQ ID NO: 325666 - DNA, 16 bp, C. familiaris
tattcagattttacca

SEQ ID NO: 325667 - DNA, 16 bp, C. familiaris
tattcatatttcaaaa

SEQ ID NO: 325668 - DNA, 16 bp, C. familiaris
tattcattcagtcatt

SEQ ID NO: 325669 - DNA, 16 bp, C. familiaris
tattcattcatccagt

SEQ ID NO: 325670 - DNA, 16 bp, C. familiaris
tattcattcctgcttt

SEQ ID NO: 325671 - DNA, 16 bp, C. familiaris
tattcatttgtcaaaa

SEQ ID NO: 325672 - DNA, 16 bp, C. familiaris
tattccatcacatata

SEQ ID NO: 325673 - DNA, 16 bp, C. familiaris
tattccattgatatat

SEQ ID NO: 325674 - DNA, 16 bp, C. familiaris
tattccattgtctaga

SEQ ID NO: 325675 - DNA, 16 bp, C. familiaris
tattccatttttaaaa

SEQ ID NO: 325676 - DNA, 16 bp, C. familiaris
tattccccatataagt

SEQ ID NO: 325677 - DNA, 16 bp, C. familiaris
tattcccctggatatt

SEQ ID NO: 325678 - DNA, 16 bp, C. familiaris
tattcctaagaatttt

SEQ ID NO: 325679 - DNA, 16 bp, C. familiaris
tattcctggtttgcaa

SEQ ID NO: 325680 - DNA, 16 bp, C. familiaris
tattcgtttgagagag

SEQ ID NO: 325681 - DNA, 16 bp, C. familiaris
tattctagtttctttg

SEQ ID NO: 325682 - DNA, 16 bp, C. familiaris
tattctctgtatttat

SEQ ID NO: 325683 - DNA, 16 bp, C. familiaris
tattctgaacatttca

SEQ ID NO: 325684 - DNA, 16 bp, C. familiaris
tattctgctcttgttg

SEQ ID NO: 325685 - DNA, 16 bp, C. familiaris
tattctggaaaaggca

SEQ ID NO: 325686 - DNA, 16 bp, C. familiaris
tattctggaaaatgtt

SEQ ID NO: 325687 - DNA, 16 bp, C. familiaris
tattcttctcaaactt

SEQ ID NO: 325688 - DNA, 16 bp, C. familiaris
tattcttgaaaataaa

SEQ ID NO: 325689 - DNA, 16 bp, C. familiaris
tattctttaaaagaaa

SEQ ID NO: 325690 - DNA, 16 bp, C. familiaris
tattctttcaacaaat

SEQ ID NO: 325691 - DNA, 16 bp, C. familiaris
tattctttcagcttct

SEQ ID NO: 325692 - DNA, 16 bp, C. familiaris
tattctttcatttgaa

SEQ ID NO: 325693 - DNA, 16 bp, C. familiaris
tattctttgaagaaaa

SEQ ID NO: 325694 - DNA, 16 bp, C. familiaris
tattcttttaaaagat

SEQ ID NO: 325695 - DNA, 16 bp, C. familiaris
tattctttttgatgaa

SEQ ID NO: 325696 - DNA, 16 bp, C. familiaris
tattgaaaaaatacat

SEQ ID NO: 325697 - DNA, 16 bp, C. familiaris
tattgaaagaatgaat

SEQ ID NO: 325698 - DNA, 16 bp, C. familiaris
tattgaagaaaatatt

SEQ ID NO: 325699 - DNA, 16 bp, C. familiaris
tattgaagtacagttg

SEQ ID NO: 325700 - DNA, 16 bp, C. familiaris
tattgaattgtatgag

SEQ ID NO: 325701 - DNA, 16 bp, C. familiaris
tattgaccatctgtat

SEQ ID NO: 325702 - DNA, 16 bp, C. familiaris
tattgagtcttctaat

SEQ ID NO: 325703 - DNA, 16 bp, C. familiaris
tattgagtttaagaag

SEQ ID NO: 325704 - DNA, 16 bp, C. familiaris
tattgcagcattatta

SEQ ID NO: 325705 - DNA, 16 bp, C. familiaris
tattgccatttgcaac

SEQ ID NO: 325706 - DNA, 16 bp, C. familiaris
tattgctgaaagaaat

SEQ ID NO: 325707 - DNA, 16 bp, C. familiaris
tattgctgctataaat

SEQ ID NO: 325708 - DNA, 16 bp, C. familiaris
tattgctgttgttatt

SEQ ID NO: 325709 - DNA, 16 bp, C. familiaris
tattgtcagaaaaaaa

SEQ ID NO: 325710 - DNA, 16 bp, C. familiaris
tattgtcagtgttttg

SEQ ID NO: 325711 - DNA, 16 bp, C. familiaris
tattgtgaaaaatgtc

SEQ ID NO: 325712 - DNA, 16 bp, C. familiaris
tattgtggtaaaatac

SEQ ID NO: 325713 - DNA, 16 bp, C. familiaris
tattgttaggaaaagg

SEQ ID NO: 325714 - DNA, 16 bp, C. familiaris
tattgttgttgctgtt

SEQ ID NO: 325715 - DNA, 16 bp, C. familiaris
tatttaaaaactgttt

SEQ ID NO: 325716 - DNA, 16 bp, C. familiaris
tatttaaaatatgctt

SEQ ID NO: 325717 - DNA, 16 bp, C. familiaris
tatttaaatatgtgat

SEQ ID NO: 325718 - DNA, 16 bp, C. familiaris
tatttaaattcaatgt

SEQ ID NO: 325719 - DNA, 16 bp, C. familiaris
tatttaagaaacattt

SEQ ID NO: 325720 - DNA, 16 bp, C. familiaris
tatttacaaaatgttt

SEQ ID NO: 325721 - DNA, 16 bp, C. familiaris
tatttacaatggaata

SEQ ID NO: 325722 - DNA, 16 bp, C. familiaris
tatttacacataaata

SEQ ID NO: 325723 - DNA, 16 bp, C. familiaris
tatttacatgtaaata

SEQ ID NO: 325724 - DNA, 16 bp, C. familiaris
tatttaccccccaaat

SEQ ID NO: 325725 - DNA, 16 bp, C. familiaris
tatttactcatttgtt

SEQ ID NO: 325726 - DNA, 16 bp, C. familiaris
tatttagaaaccaaaa

SEQ ID NO: 325727 - DNA, 16 bp, C. familiaris
tatttagaaatgaaga

SEQ ID NO: 325728 - DNA, 16 bp, C. familiaris
tatttagaaatgtatt

SEQ ID NO: 325729 - DNA, 16 bp, C. familiaris
tatttataacagcaat

SEQ ID NO: 325730 - DNA, 16 bp, C. familiaris
tatttatatgacagag

SEQ ID NO: 325731 - DNA, 16 bp, C. familiaris
tatttatcaagtacct

SEQ ID NO: 325732 - DNA, 16 bp, C. familiaris
tatttatccttctctg

SEQ ID NO: 325733 - DNA, 16 bp, C. familiaris
tatttatctgagaaag

SEQ ID NO: 325734 - DNA, 16 bp, C. familiaris
tatttatctttgaaaa

SEQ ID NO: 325735 - DNA, 16 bp, C. familiaris
tatttattcaggagag

SEQ ID NO: 325736 - DNA, 16 bp, C. familiaris
tatttattcatagaaa

SEQ ID NO: 325737 - DNA, 16 bp, C. familiaris
tatttattgactacct

SEQ ID NO: 325738 - DNA, 16 bp, C. familiaris
tatttattgagaaaaa

SEQ ID NO: 325739 - DNA, 16 bp, C. familiaris
tatttattgagtacct

SEQ ID NO: 325740 - DNA, 16 bp, C. familiaris
tatttatttactcctg

SEQ ID NO: 325741 - DNA, 16 bp, C. familiaris
tatttatttagaagag

SEQ ID NO: 325742 - DNA, 16 bp, C. familiaris
tatttatttcagggag

SEQ ID NO: 325743 - DNA, 16 bp, C. familiaris
tatttatttctctgag

SEQ ID NO: 325744 - DNA, 16 bp, C. familiaris
tatttattttagaggg

SEQ ID NO: 325745 - DNA, 16 bp, C. familiaris
tatttatttttaagca

SEQ ID NO: 325746 - DNA, 16 bp, C. familiaris
tatttattttttcagg

SEQ ID NO: 325747 - DNA, 16 bp, C. familiaris
tatttattttttggcc

SEQ ID NO: 325748 - DNA, 16 bp, C. familiaris
tatttcaaaagaaaaa

SEQ ID NO: 325749 - DNA, 16 bp, C. familiaris
tatttcaaaagaaaat

SEQ ID NO: 325750 - DNA, 16 bp, C. familiaris
tatttcaaagctgtag

SEQ ID NO: 325751 - DNA, 16 bp, C. familiaris
tatttcaaggaattgg

SEQ ID NO: 325752 - DNA, 16 bp, C. familiaris
tatttcagaaaaaaaa

SEQ ID NO: 325753 - DNA, 16 bp, C. familiaris
tatttcagaaaatgtt

SEQ ID NO: 325754 - DNA, 16 bp, C. familiaris
tatttcagtatatttt

SEQ ID NO: 325755 - DNA, 16 bp, C. familiaris
tatttcatcagttttt

SEQ ID NO: 325756 - DNA, 16 bp, C. familiaris
tatttcatttaatcct

SEQ ID NO: 325757 - DNA, 16 bp, C. familiaris
tatttcattttatgga

SEQ ID NO: 325758 - DNA, 16 bp, C. familiaris
tatttccaaagaaagt

SEQ ID NO: 325759 - DNA, 16 bp, C. familiaris
tatttccagatgacat

SEQ ID NO: 325760 - DNA, 16 bp, C. familiaris
tatttccccctcattt

SEQ ID NO: 325761 - DNA, 16 bp, C. familiaris
tatttcccctgatggc

SEQ ID NO: 325762 - DNA, 16 bp, C. familiaris
tatttccctcttagaa

SEQ ID NO: 325763 - DNA, 16 bp, C. familiaris
tatttcctagttctgt

SEQ ID NO: 325764 - DNA, 16 bp, C. familiaris
tatttcctttgctgtg

SEQ ID NO: 325765 - DNA, 16 bp, C. familiaris
tatttcctttgttctg

SEQ ID NO: 325766 - DNA, 16 bp, C. familiaris
tatttctaaaagaaat

SEQ ID NO: 325767 - DNA, 16 bp, C. familiaris
tatttctaatgaaaat

SEQ ID NO: 325768 - DNA, 16 bp, C. familiaris
tatttctctccatata

SEQ ID NO: 325769 - DNA, 16 bp, C. familiaris
tatttctctttctctg

SEQ ID NO: 325770 - DNA, 16 bp, C. familiaris
tatttctgaagaaaat

SEQ ID NO: 325771 - DNA, 16 bp, C. familiaris
tatttctggaaggata

SEQ ID NO: 325772 - DNA, 16 bp, C. familiaris
tatttctgtgatgttt

SEQ ID NO: 325773 - DNA, 16 bp, C. familiaris
tatttcttcaagtatt

SEQ ID NO: 325774 - DNA, 16 bp, C. familiaris
tatttcttcctgattc

SEQ ID NO: 325775 - DNA, 16 bp, C. familiaris
tatttcttcttgtgtg

SEQ ID NO: 325776 - DNA, 16 bp, C. familiaris
tatttcttgatttaaa

SEQ ID NO: 325777 - DNA, 16 bp, C. familiaris
tatttctttaagattt

SEQ ID NO: 325778 - DNA, 16 bp, C. familiaris
tatttctttgaaattt

SEQ ID NO: 325779 - DNA, 16 bp, C. familiaris
tatttcttttaaagat

SEQ ID NO: 325780 - DNA, 16 bp, C. familiaris
tatttgaaaagatttt

SEQ ID NO: 325781 - DNA, 16 bp, C. familiaris
tatttgaaagtaaatt

SEQ ID NO: 325782 - DNA, 16 bp, C. familiaris
tatttgaacattttaa

SEQ ID NO: 325783 - DNA, 16 bp, C. familiaris
tatttgaagaatattt

SEQ ID NO: 325784 - DNA, 16 bp, C. familiaris
tatttgaagagaaaaa

SEQ ID NO: 325785 - DNA, 16 bp, C. familiaris
tatttgagaaagagtg

SEQ ID NO: 325786 - DNA, 16 bp, C. familiaris
tatttgagacagaaaa

SEQ ID NO: 325787 - DNA, 16 bp, C. familiaris
tatttgattactgatt

SEQ ID NO: 325788 - DNA, 16 bp, C. familiaris
tatttgcaaaacacat

SEQ ID NO: 325789 - DNA, 16 bp, C. familiaris
tatttgcaatgacata

SEQ ID NO: 325790 - DNA, 16 bp, C. familiaris
tatttgcagatgaaat

SEQ ID NO: 325791 - DNA, 16 bp, C. familiaris
tatttgcctttttcac

SEQ ID NO: 325792 - DNA, 16 bp, C. familiaris
tatttggaaaaataat

SEQ ID NO: 325793 - DNA, 16 bp, C. familiaris
tatttggaaataagat

SEQ ID NO: 325794 - DNA, 16 bp, C. familiaris
tatttggaataaaaat

SEQ ID NO: 325795 - DNA, 16 bp, C. familiaris
tatttggaattttaaa

SEQ ID NO: 325796 - DNA, 16 bp, C. familiaris
tatttggagaaaaata

SEQ ID NO: 325797 - DNA, 16 bp, C. familiaris
tatttgggaaaaaaaa

SEQ ID NO: 325798 - DNA, 16 bp, C. familiaris
tatttggggaaaatat

SEQ ID NO: 325799 - DNA, 16 bp, C. familiaris
tatttggtccagtgta

SEQ ID NO: 325800 - DNA, 16 bp, C. familiaris
tatttggttttggaat

SEQ ID NO: 325801 - DNA, 16 bp, C. familiaris
tatttgtatatactgt

SEQ ID NO: 325802 - DNA, 16 bp, C. familiaris
tatttgtatatgtgtg

SEQ ID NO: 325803 - DNA, 16 bp, C. familiaris
tatttgtatctttggg

SEQ ID NO: 325804 - DNA, 16 bp, C. familiaris
tatttgtcaaaactca

SEQ ID NO: 325805 - DNA, 16 bp, C. familiaris
tatttgtcaagtgaat

SEQ ID NO: 325806 - DNA, 16 bp, C. familiaris
tatttgtgaaataaat

SEQ ID NO: 325807 - DNA, 16 bp, C. familiaris
tatttgtgacagtcac

SEQ ID NO: 325808 - DNA, 16 bp, C. familiaris
tatttgtgtggatcta

SEQ ID NO: 325809 - DNA, 16 bp, C. familiaris
tatttgtgttaataaa

SEQ ID NO: 325810 - DNA, 16 bp, C. familiaris
tatttgtgtttctgtg

SEQ ID NO: 325811 - DNA, 16 bp, C. familiaris
tattttaaaaagagag

SEQ ID NO: 325812 - DNA, 16 bp, C. familiaris
tattttaaaaagtgga

SEQ ID NO: 325813 - DNA, 16 bp, C. familiaris
tattttaaaagaacca

SEQ ID NO: 325814 - DNA, 16 bp, C. familiaris
tattttaaaagacttt

SEQ ID NO: 325815 - DNA, 16 bp, C. familiaris
tattttaaaaggattt

SEQ ID NO: 325816 - DNA, 16 bp, C. familiaris
tattttaaaaggttat

SEQ ID NO: 325817 - DNA, 16 bp, C. familiaris
tattttaaaagtctgt

SEQ ID NO: 325818 - DNA, 16 bp, C. familiaris
tattttaaacatgttt

SEQ ID NO: 325819 - DNA, 16 bp, C. familiaris
tattttaaagaggaaa

SEQ ID NO: 325820 - DNA, 16 bp, C. familiaris
tattttaaagtacatt

SEQ ID NO: 325821 - DNA, 16 bp, C. familiaris
tattttaaatgaaatg

SEQ ID NO: 325822 - DNA, 16 bp, C. familiaris
tattttaagaaattga

SEQ ID NO: 325823 - DNA, 16 bp, C. familiaris
tattttacaatgaaaa

SEQ ID NO: 325824 - DNA, 16 bp, C. familiaris
tattttagaaaatgaa

SEQ ID NO: 325825 - DNA, 16 bp, C. familiaris
tattttagaaaatgtt

SEQ ID NO: 325826 - DNA, 16 bp, C. familiaris
tattttagagaagaaa

SEQ ID NO: 325827 - DNA, 16 bp, C. familiaris
tattttagagaaggag

SEQ ID NO: 325828 - DNA, 16 bp, C. familiaris
tattttagtcattcta

SEQ ID NO: 325829 - DNA, 16 bp, C. familiaris
tattttataaaatgtg

SEQ ID NO: 325830 - DNA, 16 bp, C. familiaris
tattttatacttgaaa

SEQ ID NO: 325831 - DNA, 16 bp, C. familiaris
tattttatatgcatta

SEQ ID NO: 325832 - DNA, 16 bp, C. familiaris
tattttatctgaaaat

SEQ ID NO: 325833 - DNA, 16 bp, C. familiaris
tattttatgatgcttt

SEQ ID NO: 325834 - DNA, 16 bp, C. familiaris
tattttatttactgta

SEQ ID NO: 325835 - DNA, 16 bp, C. familiaris
tattttatttttcagc

SEQ ID NO: 325836 - DNA, 16 bp, C. familiaris
tattttcaaaatgaaa

SEQ ID NO: 325837 - DNA, 16 bp, C. familiaris
tattttcaaaatgaat

SEQ ID NO: 325838 - DNA, 16 bp, C. familiaris
tattttcaaagcaaaa

SEQ ID NO: 325839 - DNA, 16 bp, C. familiaris
tattttcaaataaggt

SEQ ID NO: 325840 - DNA, 16 bp, C. familiaris
tattttcaaattgaat

SEQ ID NO: 325841 - DNA, 16 bp, C. familiaris
tattttcaactttttg

SEQ ID NO: 325842 - DNA, 16 bp, C. familiaris
tattttcactgatttt

SEQ ID NO: 325843 - DNA, 16 bp, C. familiaris
tattttcagaccacag

SEQ ID NO: 325844 - DNA, 16 bp, C. familiaris
tattttcagatgatat

SEQ ID NO: 325845 - DNA, 16 bp, C. familiaris
tattttcatgcatttt

SEQ ID NO: 325846 - DNA, 16 bp, C. familiaris
tattttcattttgaat

SEQ ID NO: 325847 - DNA, 16 bp, C. familiaris
tattttccaaagaaaa

SEQ ID NO: 325848 - DNA, 16 bp, C. familiaris
tattttccaaagaaga

SEQ ID NO: 325849 - DNA, 16 bp, C. familiaris
tattttccaaatgacc

SEQ ID NO: 325850 - DNA, 16 bp, C. familiaris
tattttccagagtggt

SEQ ID NO: 325851 - DNA, 16 bp, C. familiaris
tattttccttaatcta

SEQ ID NO: 325852 - DNA, 16 bp, C. familiaris
tattttcttaagaaaa

SEQ ID NO: 325853 - DNA, 16 bp, C. familiaris
tattttcttctttaag

SEQ ID NO: 325854 - DNA, 16 bp, C. familiaris
tattttctttttagaa

SEQ ID NO: 325855 - DNA, 16 bp, C. familiaris
tattttgaaaaggaaa

SEQ ID NO: 325856 - DNA, 16 bp, C. familiaris
tattttgaaacaaaaa

SEQ ID NO: 325857 - DNA, 16 bp, C. familiaris
tattttgacaattttt

SEQ ID NO: 325858 - DNA, 16 bp, C. familiaris
tattttgagtctattt

SEQ ID NO: 325859 - DNA, 16 bp, C. familiaris
tattttgatggagatt

SEQ ID NO: 325860 - DNA, 16 bp, C. familiaris
tattttgcaagaagtt

SEQ ID NO: 325861 - DNA, 16 bp, C. familiaris
tattttgcagatgagg

SEQ ID NO: 325862 - DNA, 16 bp, C. familiaris
tattttgctgtgcaga

SEQ ID NO: 325863 - DNA, 16 bp, C. familiaris
tattttggaagctctt

SEQ ID NO: 325864 - DNA, 16 bp, C. familiaris
tattttggaattttga

SEQ ID NO: 325865 - DNA, 16 bp, C. familiaris
tattttggagaaaaaa

SEQ ID NO: 325866 - DNA, 16 bp, C. familiaris
tattttggattttctg

SEQ ID NO: 325867 - DNA, 16 bp, C. familiaris
tattttggggagaaaa

SEQ ID NO: 325868 - DNA, 16 bp, C. familiaris
tattttgtaaataaag

SEQ ID NO: 325869 - DNA, 16 bp, C. familiaris
tattttgtcaccctca

SEQ ID NO: 325870 - DNA, 16 bp, C. familiaris
tattttgtcttaaaaa

SEQ ID NO: 325871 - DNA, 16 bp, C. familiaris
tattttgttatgacag

SEQ ID NO: 325872 - DNA, 16 bp, C. familiaris
tattttgttcctttga

SEQ ID NO: 325873 - DNA, 16 bp, C. familiaris
tatttttaaaaagaac

SEQ ID NO: 325874 - DNA, 16 bp, C. familiaris
tatttttaaagcaatt

SEQ ID NO: 325875 - DNA, 16 bp, C. familiaris
tatttttaagtacaca

SEQ ID NO: 325876 - DNA, 16 bp, C. familiaris
tatttttaatgtcatt

SEQ ID NO: 325877 - DNA, 16 bp, C. familiaris
tatttttaattttgca

SEQ ID NO: 325878 - DNA, 16 bp, C. familiaris
tatttttagagaaaga

SEQ ID NO: 325879 - DNA, 16 bp, C. familiaris
tatttttatgtatgct

SEQ ID NO: 325880 - DNA, 16 bp, C. familiaris
tatttttattgctgaa

SEQ ID NO: 325881 - DNA, 16 bp, C. familiaris
tatttttatttacatg

SEQ ID NO: 325882 - DNA, 16 bp, C. familiaris
tatttttcaaaattgt

SEQ ID NO: 325883 - DNA, 16 bp, C. familiaris
tatttttcaaagtttt

SEQ ID NO: 325884 - DNA, 16 bp, C. familiaris
tatttttcaaatgtat

SEQ ID NO: 325885 - DNA, 16 bp, C. familiaris
tatttttcacagaaat

SEQ ID NO: 325886 - DNA, 16 bp, C. familiaris
tatttttcataaatgt

SEQ ID NO: 325887 - DNA, 16 bp, C. familiaris
tatttttcatttctag

SEQ ID NO: 325888 - DNA, 16 bp, C. familiaris
tatttttcccttcagt

SEQ ID NO: 325889 - DNA, 16 bp, C. familiaris
tatttttcctgaaatt

SEQ ID NO: 325890 - DNA, 16 bp, C. familiaris
tatttttctaatgaaa

SEQ ID NO: 325891 - DNA, 16 bp, C. familiaris
tatttttctgaaattt

SEQ ID NO: 325892 - DNA, 16 bp, C. familiaris
tatttttctgaagatt

SEQ ID NO: 325893 - DNA, 16 bp, C. familiaris
tatttttcttctgaaa

SEQ ID NO: 325894 - DNA, 16 bp, C. familiaris
tatttttgcatatgga

SEQ ID NO: 325895 - DNA, 16 bp, C. familiaris
tatttttggaaatgtt

SEQ ID NO: 325896 - DNA, 16 bp, C. familiaris
tatttttgtacccttt

SEQ ID NO: 325897 - DNA, 16 bp, C. familiaris
tattttttaaaaactg

SEQ ID NO: 325898 - DNA, 16 bp, C. familiaris
tattttttaagatctt

SEQ ID NO: 325899 - DNA, 16 bp, C. familiaris
tattttttatggaaaa

SEQ ID NO: 325900 - DNA, 16 bp, C. familiaris
tattttttattgctga

SEQ ID NO: 325901 - DNA, 16 bp, C. familiaris
tattttttcacagttt

SEQ ID NO: 325902 - DNA, 16 bp, C. familiaris
tattttttccagattt

SEQ ID NO: 325903 - DNA, 16 bp, C. familiaris
tattttttccataaaa

SEQ ID NO: 325904 - DNA, 16 bp, C. familiaris
tattttttcccagttt

SEQ ID NO: 325905 - DNA, 16 bp, C. familiaris
tattttttcctctctg

SEQ ID NO: 325906 - DNA, 16 bp, C. familiaris
tattttttcctgagag

SEQ ID NO: 325907 - DNA, 16 bp, C. familiaris
tattttttgaagaaaa

SEQ ID NO: 325908 - DNA, 16 bp, C. familiaris
tattttttgatggctg

SEQ ID NO: 325909 - DNA, 16 bp, C. familiaris
tatttttttctgaata

SEQ ID NO: 325910 - DNA, 16 bp, C. familiaris
tcaaaaacctctcaac

SEQ ID NO: 325911 - DNA, 16 bp, C. familiaris
tcaaaaacttaaaact

SEQ ID NO: 325912 - DNA, 16 bp, C. familiaris
tcaaaaaggcaagaaa

SEQ ID NO: 325913 - DNA, 16 bp, C. familiaris
tcaaaaatgaaggaaa

SEQ ID NO: 325914 - DNA, 16 bp, C. familiaris
tcaaaaattactttaa

SEQ ID NO: 325915 - DNA, 16 bp, C. familiaris
tcaaaagacacagaaa

SEQ ID NO: 325916 - DNA, 16 bp, C. familiaris
tcaaaagcaaaggcaa

SEQ ID NO: 325917 - DNA, 16 bp, C. familiaris
tcaaaaggacaagaaa

SEQ ID NO: 325918 - DNA, 16 bp, C. familiaris
tcaaaagttatatatg

SEQ ID NO: 325919 - DNA, 16 bp, C. familiaris
tcaaaataaaaaggtt

SEQ ID NO: 325920 - DNA, 16 bp, C. familiaris
tcaaaataatcttcat

SEQ ID NO: 325921 - DNA, 16 bp, C. familiaris
tcaaaataccaccagt

SEQ ID NO: 325922 - DNA, 16 bp, C. familiaris
tcaaaatagaaagctt

SEQ ID NO: 325923 - DNA, 16 bp, C. familiaris
tcaaaatatttttcat

SEQ ID NO: 325924 - DNA, 16 bp, C. familiaris
tcaaaatcacaatgaa

SEQ ID NO: 325925 - DNA, 16 bp, C. familiaris
tcaaaatgaatcaaaa

SEQ ID NO: 325926 - DNA, 16 bp, C. familiaris
tcaaaatggaaagaga

SEQ ID NO: 325927 - DNA, 16 bp, C. familiaris
tcaaaatggaagaaga

SEQ ID NO: 325928 - DNA, 16 bp, C. familiaris
tcaaaatgtgactgta

SEQ ID NO: 325929 - DNA, 16 bp, C. familiaris
tcaaaatgtttgtttt

SEQ ID NO: 325930 - DNA, 16 bp, C. familiaris
tcaaaattctttcttt

SEQ ID NO: 325931 - DNA, 16 bp, C. familiaris
tcaaaatttattttga

SEQ ID NO: 325932 - DNA, 16 bp, C. familiaris
tcaaacaaatcttaaa

SEQ ID NO: 325933 - DNA, 16 bp, C. familiaris
tcaaacatttgaagaa

SEQ ID NO: 325934 - DNA, 16 bp, C. familiaris
tcaaactcacagcccc

SEQ ID NO: 325935 - DNA, 16 bp, C. familiaris
tcaaactgcagaaaat

SEQ ID NO: 325936 - DNA, 16 bp, C. familiaris
tcaaagaaaacagaag

SEQ ID NO: 325937 - DNA, 16 bp, C. familiaris
tcaaagaaagacaaat

SEQ ID NO: 325938 - DNA, 16 bp, C. familiaris
tcaaagaaatgcaaat

SEQ ID NO: 325939 - DNA, 16 bp, C. familiaris
tcaaagaatttaaata

SEQ ID NO: 325940 - DNA, 16 bp, C. familiaris
tcaaagacaaagagaa

SEQ ID NO: 325941 - DNA, 16 bp, C. familiaris
tcaaagagaaaagaga

SEQ ID NO: 325942 - DNA, 16 bp, C. familiaris
tcaaagagagagagag

SEQ ID NO: 325943 - DNA, 16 bp, C. familiaris
tcaaagaggaagacat

SEQ ID NO: 325944 - DNA, 16 bp, C. familiaris
tcaaagaggttactac

SEQ ID NO: 325945 - DNA, 16 bp, C. familiaris
tcaaagagtttttttt

SEQ ID NO: 325946 - DNA, 16 bp, C. familiaris
tcaaagatatttattt

SEQ ID NO: 325947 - DNA, 16 bp, C. familiaris
tcaaagatttttttaa

SEQ ID NO: 325948 - DNA, 16 bp, C. familiaris
tcaaagattttttttt

SEQ ID NO: 325949 - DNA, 16 bp, C. familiaris
tcaaagccagcaagag

SEQ ID NO: 325950 - DNA, 16 bp, C. familiaris
tcaaagcttcaaaaga

SEQ ID NO: 325951 - DNA, 16 bp, C. familiaris
tcaaaggaaagcaggg

SEQ ID NO: 325952 - DNA, 16 bp, C. familiaris
tcaaaggcaaacactc

SEQ ID NO: 325953 - DNA, 16 bp, C. familiaris
tcaaagtaattattga

SEQ ID NO: 325954 - DNA, 16 bp, C. familiaris
tcaaagttgctaagaa

SEQ ID NO: 325955 - DNA, 16 bp, C. familiaris
tcaaataaaacctttt

SEQ ID NO: 325956 - DNA, 17 bp, C. familiaris
tcaaatacaaaaggtaa

SEQ ID NO: 325957 - DNA, 16 bp, C. familiaris
tcaaatacacatggaa

SEQ ID NO: 325958 - DNA, 16 bp, C. familiaris
tcaaatagttaaaaat

SEQ ID NO: 325959 - DNA, 16 bp, C. familiaris
tcaaatatacaatatg

SEQ ID NO: 325960 - DNA, 16 bp, C. familiaris
tcaaatatttgctgaa

SEQ ID NO: 325961 - DNA, 16 bp, C. familiaris
tcaaatgcttttctct

SEQ ID NO: 325962 - DNA, 16 bp, C. familiaris
tcaaatgtcacatttt

SEQ ID NO: 325963 - DNA, 16 bp, C. familiaris
tcaaatgttctttttt

SEQ ID NO: 325964 - DNA, 16 bp, C. familiaris
tcaaattaatgaaatc

SEQ ID NO: 325965 - DNA, 16 bp, C. familiaris
tcaaattcaggaaatt

SEQ ID NO: 325966 - DNA, 16 bp, C. familiaris
tcaacaaaacattagc

SEQ ID NO: 325967 - DNA, 16 bp, C. familiaris
tcaacaaaatgaaaga

SEQ ID NO: 325968 - DNA, 16 bp, C. familiaris
tcaacaaactggacaa

SEQ ID NO: 325969 - DNA, 16 bp, C. familiaris
tcaacaaagaaaatat

SEQ ID NO: 325970 - DNA, 16 bp, C. familiaris
tcaacaaagaagatat

SEQ ID NO: 325971 - DNA, 16 bp, C. familiaris
tcaacaaagagatgga

SEQ ID NO: 325972 - DNA, 16 bp, C. familiaris
tcaacaaagcaagaaa

SEQ ID NO: 325973 - DNA, 16 bp, C. familiaris
tcaacaaagcagaaaa

SEQ ID NO: 325974 - DNA, 16 bp, C. familiaris
tcaacaaagcaggttt

SEQ ID NO: 325975 - DNA, 16 bp, C. familiaris
tcaacaaaggaagaaa

SEQ ID NO: 325976 - DNA, 16 bp, C. familiaris
tcaacaagaagatata

SEQ ID NO: 325977 - DNA, 16 bp, C. familiaris
tcaacaagaagatcta

SEQ ID NO: 325978 - DNA, 16 bp, C. familiaris
tcaacaatggcagcat

SEQ ID NO: 325979 - DNA, 16 bp, C. familiaris
tcaacagaactaaaag

SEQ ID NO: 325980 - DNA, 16 bp, C. familiaris
tcaacagatgaatttt

SEQ ID NO: 325981 - DNA, 16 bp, C. familiaris
tcaacagatgagtgga

SEQ ID NO: 325982 - DNA, 16 bp, C. familiaris
tcaacatcatcatcat

SEQ ID NO: 325983 - DNA, 16 bp, C. familiaris
tcaacatcattagaca

SEQ ID NO: 325984 - DNA, 16 bp, C. familiaris
tcaacattcctttgac

SEQ ID NO: 325985 - DNA, 16 bp, C. familiaris
tcaaccaagaattcta

SEQ ID NO: 325986 - DNA, 16 bp, C. familiaris
tcaaccacaaaaaaga

SEQ ID NO: 325987 - DNA, 16 bp, C. familiaris
tcaaccagaagaaaaa

SEQ ID NO: 325988 - DNA, 16 bp, C. familiaris
tcaacctctccctctt

SEQ ID NO: 325989 - DNA, 16 bp, C. familiaris
tcaacctgataaagaa

SEQ ID NO: 325990 - DNA, 16 bp, C. familiaris
tcaacgctgagccacc

SEQ ID NO: 325991 - DNA, 20 bp, C. familiaris
tcaactacatggtgtacatg

SEQ ID NO: 325992 - DNA, 16 bp, C. familiaris
tcaactattgagccac

SEQ ID NO: 325993 - DNA, 16 bp, C. familiaris
tcaactctagagaaca

SEQ ID NO: 325994 - DNA, 16 bp, C. familiaris
tcaacttctgaagaag

SEQ ID NO: 325995 - DNA, 16 bp, C. familiaris
tcaactttttgaggaa

SEQ ID NO: 325996 - DNA, 16 bp, C. familiaris
tcaagaaaaactttta

SEQ ID NO: 325997 - DNA, 16 bp, C. familiaris
tcaagaaaaatgaaga

SEQ ID NO: 325998 - DNA, 16 bp, C. familiaris
tcaagaaaatattagc

SEQ ID NO: 325999 - DNA, 16 bp, C. familiaris
tcaagaaaattttaaa

SEQ ID NO: 326000 - DNA, 16 bp, C. familiaris
tcaagaaaccagaaaa

SEQ ID NO: 326001 - DNA, 16 bp, C. familiaris
tcaagaaagtgaaaat

SEQ ID NO: 326002 - DNA, 16 bp, C. familiaris
tcaagaaatgagaaga

SEQ ID NO: 326003 - DNA, 16 bp, C. familiaris
tcaagaaatgatgctg

SEQ ID NO: 326004 - DNA, 16 bp, C. familiaris
tcaagaaattttggca

SEQ ID NO: 326005 - DNA, 16 bp, C. familiaris
tcaagaagaaaaatct

SEQ ID NO: 326006 - DNA, 16 bp, C. familiaris
tcaagaagaaacagaa

SEQ ID NO: 326007 - DNA, 16 bp, C. familiaris
tcaagaagaaggaaaa

SEQ ID NO: 326008 - DNA, 16 bp, C. familiaris
tcaagaagcaagagaa

SEQ ID NO: 326009 - DNA, 16 bp, C. familiaris
tcaagagaattaaaaa

SEQ ID NO: 326010 - DNA, 16 bp, C. familiaris
tcaagagctgtatgct

SEQ ID NO: 326011 - DNA, 16 bp, C. familiaris
tcaagagtgagacact

SEQ ID NO: 326012 - DNA, 16 bp, C. familiaris
tcaagagttggctgcc

SEQ ID NO: 326013 - DNA, 16 bp, C. familiaris
tcaagagttgtacact

SEQ ID NO: 326014 - DNA, 16 bp, C. familiaris
tcaagataaaaacttt

SEQ ID NO: 326015 - DNA, 16 bp, C. familiaris
tcaagataaagaacat

SEQ ID NO: 326016 - DNA, 16 bp, C. familiaris
tcaagatcctagagga

SEQ ID NO: 326017 - DNA, 16 bp, C. familiaris
tcaagatgagaagctt

SEQ ID NO: 326018 - DNA, 16 bp, C. familiaris
tcaagatttgtgtgga

SEQ ID NO: 326019 - DNA, 16 bp, C. familiaris
tcaagattttacttat

SEQ ID NO: 326020 - DNA, 16 bp, C. familiaris
tcaagcaaaatgaaga

SEQ ID NO: 326021 - DNA, 16 bp, C. familiaris
tcaagcagaaattaaa

SEQ ID NO: 326022 - DNA, 16 bp, C. familiaris
tcaagcagaaggaaaa

SEQ ID NO: 326023 - DNA, 16 bp, C. familiaris
tcaagcagattccacg

SEQ ID NO: 326024 - DNA, 16 bp, C. familiaris
tcaagccacccagtct

SEQ ID NO: 326025 - DNA, 16 bp, C. familiaris
tcaagccccacatgga

SEQ ID NO: 326026 - DNA, 16 bp, C. familiaris
tcaagccccaggttgg

SEQ ID NO: 326027 - DNA, 16 bp, C. familiaris
tcaagccctacattag

SEQ ID NO: 326028 - DNA, 16 bp, C. familiaris
tcaagctccctgttca

SEQ ID NO: 326029 - DNA, 16 bp, C. familiaris
tcaagctctgcactgg

SEQ ID NO: 326030 - DNA, 16 bp, C. familiaris
tcaaggaatttgtcca

SEQ ID NO: 326031 - DNA, 16 bp, C. familiaris
tcaaggcagtgtggta

SEQ ID NO: 326032 - DNA, 16 bp, C. familiaris
tcaaggcccgcatcag

SEQ ID NO: 326033 - DNA, 16 bp, C. familiaris
tcaaggtaagaagctt

SEQ ID NO: 326034 - DNA, 16 bp, C. familiaris
tcaaggtcacagaact

SEQ ID NO: 326035 - DNA, 16 bp, C. familiaris
tcaaggtccatctgtg

SEQ ID NO: 326036 - DNA, 16 bp, C. familiaris
tcaaggtgtcagccag

SEQ ID NO: 326037 - DNA, 16 bp, C. familiaris
tcaaggttgagaacca

SEQ ID NO: 326038 - DNA, 16 bp, C. familiaris
tcaaggtttttttctt

SEQ ID NO: 326039 - DNA, 16 bp, C. familiaris
tcaagtaaataaatct

SEQ ID NO: 326040 - DNA, 16 bp, C. familiaris
tcaagtcatgatgtca

SEQ ID NO: 326041 - DNA, 16 bp, C. familiaris
tcaagtcccatgtcag

SEQ ID NO: 326042 - DNA, 16 bp, C. familiaris
tcaagtccctcatcag

SEQ ID NO: 326043 - DNA, 16 bp, C. familiaris
tcaagtcctatatcag

SEQ ID NO: 326044 - DNA, 16 bp, C. familiaris
tcaagtcctgcctctg

SEQ ID NO: 326045 - DNA, 16 bp, C. familiaris
tcaagtcttttgctca

SEQ ID NO: 326046 - DNA, 16 bp, C. familiaris
tcaagtgaaaattaga

SEQ ID NO: 326047 - DNA, 16 bp, C. familiaris
tcaagtgttctcacca

SEQ ID NO: 326048 - DNA, 16 bp, C. familiaris
tcaagttcctcatcag

SEQ ID NO: 326049 - DNA, 16 bp, C. familiaris
tcaagttctttcagaa

SEQ ID NO: 326050 - DNA, 16 bp, C. familiaris
tcaataaaagactgcc

SEQ ID NO: 326051 - DNA, 16 bp, C. familiaris
tcaataaaccttgctt

SEQ ID NO: 326052 - DNA, 16 bp, C. familiaris
tcaataaagctgaaaa

SEQ ID NO: 326053 - DNA, 16 bp, C. familiaris
tcaataaatactagct

SEQ ID NO: 326054 - DNA, 16 bp, C. familiaris
tcaataaatattgaat

SEQ ID NO: 326055 - DNA, 16 bp, C. familiaris
tcaataaatatttgtg

SEQ ID NO: 326056 - DNA, 16 bp, C. familiaris
tcaataaatgatagtt

SEQ ID NO: 326057 - DNA, 16 bp, C. familiaris
tcaataaatgatattg

SEQ ID NO: 326058 - DNA, 16 bp, C. familiaris
tcaataaatgtcagtt

SEQ ID NO: 326059 - DNA, 16 bp, C. familiaris
tcaataagagaaagga

SEQ ID NO: 326060 - DNA, 16 bp, C. familiaris
tcaataccaggaccct

SEQ ID NO: 326061 - DNA, 16 bp, C. familiaris
tcaatagaaaaatgga

SEQ ID NO: 326062 - DNA, 16 bp, C. familiaris
tcaatagatgcaggaa

SEQ ID NO: 326063 - DNA, 17 bp, C. familiaris
tcaatagtaactctgaa

SEQ ID NO: 326064 - DNA, 16 bp, C. familiaris
tcaatatatggtgctg

SEQ ID NO: 326065 - DNA, 16 bp, C. familiaris
tcaatatcagggtgga

SEQ ID NO: 326066 - DNA, 16 bp, C. familiaris
tcaatcaaaatcccag

SEQ ID NO: 326067 - DNA, 16 bp, C. familiaris
tcaatcagagatgaag

SEQ ID NO: 326068 - DNA, 16 bp, C. familiaris
tcaatccctggacccc

SEQ ID NO: 326069 - DNA, 16 bp, C. familiaris
tcaatctcatgaacct

SEQ ID NO: 326070 - DNA, 16 bp, C. familiaris
tcaatctggaggtatc

SEQ ID NO: 326071 - DNA, 16 bp, C. familiaris
tcaatgaaattgaaaa

SEQ ID NO: 326072 - DNA, 16 bp, C. familiaris
tcaatgaactgagcca

SEQ ID NO: 326073 - DNA, 16 bp, C. familiaris
tcaatggaacaggaca

SEQ ID NO: 326074 - DNA, 16 bp, C. familiaris
tcaatggactgaacca

SEQ ID NO: 326075 - DNA, 16 bp, C. familiaris
tcaatggggaaaactg

SEQ ID NO: 326076 - DNA, 16 bp, C. familiaris
tcaatgtggagctcaa

SEQ ID NO: 326077 - DNA, 16 bp, C. familiaris
tcaatgttgttgcaaa

SEQ ID NO: 326078 - DNA, 16 bp, C. familiaris
tcaattatgtctcaat

SEQ ID NO: 326079 - DNA, 16 bp, C. familiaris
tcaattctgcagtaat

SEQ ID NO: 326080 - DNA, 16 bp, C. familiaris
tcaatttcttcatctt

SEQ ID NO: 326081 - DNA, 16 bp, C. familiaris
tcaatttgaggagaat

SEQ ID NO: 326082 - DNA, 16 bp, C. familiaris
tcaatttgcaaatatt

SEQ ID NO: 326083 - DNA, 16 bp, C. familiaris
tcaatttttccccatt

SEQ ID NO: 326084 - DNA, 16 bp, C. familiaris
tcacaaaactcagaaa

SEQ ID NO: 326085 - DNA, 16 bp, C. familiaris
tcacaaaagaccacac

SEQ ID NO: 326086 - DNA, 16 bp, C. familiaris
tcacaaaccttctaca

SEQ ID NO: 326087 - DNA, 16 bp, C. familiaris
tcacaaagaataaaat

SEQ ID NO: 326088 - DNA, 16 bp, C. familiaris
tcacaaaggaaaatat

SEQ ID NO: 326089 - DNA, 16 bp, C. familiaris
tcacaaatggaaaaat

SEQ ID NO: 326090 - DNA, 16 bp, C. familiaris
tcacaacccagagatt

SEQ ID NO: 326091 - DNA, 16 bp, C. familiaris
tcacaacctgagcgaa

SEQ ID NO: 326092 - DNA, 16 bp, C. familiaris
tcacaagaagaaattc

SEQ ID NO: 326093 - DNA, 16 bp, C. familiaris
tcacaaggaaaaaatt

SEQ ID NO: 326094 - DNA, 16 bp, C. familiaris
tcacaattccagaatt

SEQ ID NO: 326095 - DNA, 16 bp, C. familiaris
tcacaccatatgcaaa

SEQ ID NO: 326096 - DNA, 16 bp, C. familiaris
tcacaccctgagcaga

SEQ ID NO: 326097 - DNA, 17 bp, C. familiaris
tcacaccgtgggctgca

SEQ ID NO: 326098 - DNA, 16 bp, C. familiaris
tcacactggcctcctt

SEQ ID NO: 326099 - DNA, 16 bp, C. familiaris
tcacactgggctccct

SEQ ID NO: 326100 - DNA, 16 bp, C. familiaris
tcacagaaaaggaaaa

SEQ ID NO: 326101 - DNA, 16 bp, C. familiaris
tcacagaaaaggaaac

SEQ ID NO: 326102 - DNA, 16 bp, C. familiaris
tcacagaaacagaaca

SEQ ID NO: 326103 - DNA, 16 bp, C. familiaris
tcacagaaatcccaga

SEQ ID NO: 326104 - DNA, 16 bp, C. familiaris
tcacagaagagaaaaa

SEQ ID NO: 326105 - DNA, 16 bp, C. familiaris
tcacagagatgaaaag

SEQ ID NO: 326106 - DNA, 16 bp, C. familiaris
tcacagagctgggaaa

SEQ ID NO: 326107 - DNA, 16 bp, C. familiaris
tcacagaggaagaaat

SEQ ID NO: 326108 - DNA, 16 bp, C. familiaris
tcacagaggaagacct

SEQ ID NO: 326109 - DNA, 16 bp, C. familiaris
tcacagaggaagatat

SEQ ID NO: 326110 - DNA, 16 bp, C. familiaris
tcacagagttacagaa

SEQ ID NO: 326111 - DNA, 16 bp, C. familiaris
tcacagatcaccataa

SEQ ID NO: 326112 - DNA, 16 bp, C. familiaris
tcacagatgaagaaat

SEQ ID NO: 326113 - DNA, 16 bp, C. familiaris
tcacagatgaagacat

SEQ ID NO: 326114 - DNA, 16 bp, C. familiaris
tcacagatgacatggt

SEQ ID NO: 326115 - DNA, 16 bp, C. familiaris
tcacagatggggaaat

SEQ ID NO: 326116 - DNA, 16 bp, C. familiaris
tcacagccaagaggag

SEQ ID NO: 326117 - DNA, 16 bp, C. familiaris
tcacagccctcagaag

SEQ ID NO: 326118 - DNA, 16 bp, C. familiaris
tcacagggcagcctgg

SEQ ID NO: 326119 - DNA, 16 bp, C. familiaris
tcacaggttccagaga

SEQ ID NO: 326120 - DNA, 16 bp, C. familiaris
tcacagtatttatttt

SEQ ID NO: 326121 - DNA, 16 bp, C. familiaris
tcacagttctagagac

SEQ ID NO: 326122 - DNA, 16 bp, C. familiaris
tcacagttctggagat

SEQ ID NO: 326123 - DNA, 16 bp, C. familiaris
tcacatactatatgat

SEQ ID NO: 326124 - DNA, 16 bp, C. familiaris
tcacatcaataaaaga

SEQ ID NO: 326125 - DNA, 16 bp, C. familiaris
tcacatcacctctctg

SEQ ID NO: 326126 - DNA, 16 bp, C. familiaris
tcacatcaggtgccct

SEQ ID NO: 326127 - DNA, 16 bp, C. familiaris
tcacatcccagctctg

SEQ ID NO: 326128 - DNA, 16 bp, C. familiaris
tcacatgttgaagtcc

SEQ ID NO: 326129 - DNA, 16 bp, C. familiaris
tcaccaaaaagaccaa

SEQ ID NO: 326130 - DNA, 16 bp, C. familiaris
tcaccaaagaagatat

SEQ ID NO: 326131 - DNA, 16 bp, C. familiaris
tcaccaaagaaggcat

SEQ ID NO: 326132 - DNA, 16 bp, C. familiaris
tcaccaaagaggatat

SEQ ID NO: 326133 - DNA, 38 bp, C. familiaris
tcaccaagtctgcccagaaagctcagaaggctaaatga

SEQ ID NO: 326134 - DNA, 16 bp, C. familiaris
tcaccacacacaaaga

SEQ ID NO: 326135 - DNA, 16 bp, C. familiaris
tcaccacagtcaagat

SEQ ID NO: 326136 - DNA, 16 bp, C. familiaris
tcaccacatctgtatc

SEQ ID NO: 326137 - DNA, 16 bp, C. familiaris
tcaccaccatctatct

SEQ ID NO: 326138 - DNA, 16 bp, C. familiaris
tcaccaccctgagatt

SEQ ID NO: 326139 - DNA, 16 bp, C. familiaris
tcaccacctgagccaa

SEQ ID NO: 326140 - DNA, 16 bp, C. familiaris
tcaccactgctatcca

SEQ ID NO: 326141 - DNA, 16 bp, C. familiaris
tcaccagctgtgtgat

SEQ ID NO: 326142 - DNA, 16 bp, C. familiaris
tcaccagtgaagtcat

SEQ ID NO: 326143 - DNA, 16 bp, C. familiaris
tcaccatacaatatta

SEQ ID NO: 326144 - DNA, 16 bp, C. familiaris
tcaccatcatcactgt

SEQ ID NO: 326145 - DNA, 16 bp, C. familiaris
tcaccatcatcatcaa

SEQ ID NO: 326146 - DNA, 16 bp, C. familiaris
tcaccatctccagaga

SEQ ID NO: 326147 - DNA, 16 bp, C. familiaris
tcaccatgtgaggaca

SEQ ID NO: 326148 - DNA, 16 bp, C. familiaris
tcacccctgggccaaa

SEQ ID NO: 326149 - DNA, 16 bp, C. familiaris
tcaccctatgtatctc

SEQ ID NO: 326150 - DNA, 16 bp, C. familiaris
tcaccctctccctttg

SEQ ID NO: 326151 - DNA, 16 bp, C. familiaris
tcaccctctccttctg

SEQ ID NO: 326152 - DNA, 16 bp, C. familiaris
tcaccctgctcgtgct

SEQ ID NO: 326153 - DNA, 16 bp, C. familiaris
tcaccctgtgcctggg

SEQ ID NO: 326154 - DNA, 16 bp, C. familiaris
tcacctcacaccagtg

SEQ ID NO: 326155 - DNA, 16 bp, C. familiaris
tcacctccaccccctg

SEQ ID NO: 326156 - DNA, 16 bp, C. familiaris
tcacctcctgctggct

SEQ ID NO: 326157 - DNA, 16 bp, C. familiaris
tcacctgagccaccca

SEQ ID NO: 326158 - DNA, 16 bp, C. familiaris
tcacctgtaaaatggg

SEQ ID NO: 326159 - DNA, 17 bp, C. familiaris
tcacctgtccccaccaa

SEQ ID NO: 326160 - DNA, 16 bp, C. familiaris
tcacctgtgaagccat

SEQ ID NO: 326161 - DNA, 16 bp, C. familiaris
tcaccttctcagagag

SEQ ID NO: 326162 - DNA, 16 bp, C. familiaris
tcacctttagcccaga

SEQ ID NO: 326163 - DNA, 17 bp, C. familiaris
tcacgacctgagccaaa

SEQ ID NO: 326164 - DNA, 16 bp, C. familiaris
tcacgatcttggggtc

SEQ ID NO: 326165 - DNA, 16 bp, C. familiaris
tcacgggtctccagga

SEQ ID NO: 326166 - DNA, 16 bp, C. familiaris
tcacgtcctgggctga

SEQ ID NO: 326167 - DNA, 16 bp, C. familiaris
tcactcacatgcctgg

SEQ ID NO: 326168 - DNA, 16 bp, C. familiaris
tcactcaccagaatgg

SEQ ID NO: 326169 - DNA, 16 bp, C. familiaris
tcactcagccatcaga

SEQ ID NO: 326170 - DNA, 16 bp, C. familiaris
tcactcagtgctcatc

SEQ ID NO: 326171 - DNA, 16 bp, C. familiaris
tcactccaacctctgc

SEQ ID NO: 326172 - DNA, 16 bp, C. familiaris
tcactccagaaagaaa

SEQ ID NO: 326173 - DNA, 16 bp, C. familiaris
tcactctgaaaaaaaa

SEQ ID NO: 326174 - DNA, 16 bp, C. familiaris
tcactctgggggaagc

SEQ ID NO: 326175 - DNA, 16 bp, C. familiaris
tcactcttgattttgg

SEQ ID NO: 326176 - DNA, 16 bp, C. familiaris
tcactgagatcctcca

SEQ ID NO: 326177 - DNA, 16 bp, C. familiaris
tcactgagcagggaga

SEQ ID NO: 326178 - DNA, 16 bp, C. familiaris
tcactgagccactcag

SEQ ID NO: 326179 - DNA, 16 bp, C. familiaris
tcactgattcattcat

SEQ ID NO: 326180 - DNA, 16 bp, C. familiaris
tcactgcagcattact

SEQ ID NO: 326181 - DNA, 16 bp, C. familiaris
tcactgcagggagcct

SEQ ID NO: 326182 - DNA, 16 bp, C. familiaris
tcactgcttctccctc

SEQ ID NO: 326183 - DNA, 16 bp, C. familiaris
tcactggtggagaatg

SEQ ID NO: 326184 - DNA, 16 bp, C. familiaris
tcacttggcctctctg

SEQ ID NO: 326185 - DNA, 16 bp, C. familiaris
tcactttaaaatggtt

SEQ ID NO: 326186 - DNA, 16 bp, C. familiaris
tcactttcttggttaa

SEQ ID NO: 326187 - DNA, 16 bp, C. familiaris
tcactttgcataatgt

SEQ ID NO: 326188 - DNA, 16 bp, C. familiaris
tcacttttctatttgt

SEQ ID NO: 326189 - DNA, 16 bp, C. familiaris
tcactttttgcagatg

SEQ ID NO: 326190 - DNA, 16 bp, C. familiaris
tcagaaaaagaagaga

SEQ ID NO: 326191 - DNA, 16 bp, C. familiaris
tcagaaaaagacaatt

SEQ ID NO: 326192 - DNA, 16 bp, C. familiaris
tcagaaaacacacaca

SEQ ID NO: 326193 - DNA, 16 bp, C. familiaris
tcagaaaagaccccaa

SEQ ID NO: 326194 - DNA, 16 bp, C. familiaris
tcagaaaagatcctga

SEQ ID NO: 326195 - DNA, 16 bp, C. familiaris
tcagaaaagatgcata

SEQ ID NO: 326196 - DNA, 16 bp, C. familiaris
tcagaaaatagaagca

SEQ ID NO: 326197 - DNA, 16 bp, C. familiaris
tcagaaaatttaacat

SEQ ID NO: 326198 - DNA, 16 bp, C. familiaris
tcagaaacaagacaaa

SEQ ID NO: 326199 - DNA, 16 bp, C. familiaris
tcagaaacaatgcaag

SEQ ID NO: 326200 - DNA, 16 bp, C. familiaris
tcagaaaccatggagg

SEQ ID NO: 326201 - DNA, 16 bp, C. familiaris
tcagaaactctggagg

SEQ ID NO: 326202 - DNA, 16 bp, C. familiaris
tcagaaagaaacagaa

SEQ ID NO: 326203 - DNA, 16 bp, C. familiaris
tcagaaagagaagaaa

SEQ ID NO: 326204 - DNA, 16 bp, C. familiaris
tcagaaagagaggcag

SEQ ID NO: 326205 - DNA, 16 bp, C. familiaris
tcagaaagatttttct

SEQ ID NO: 326206 - DNA, 16 bp, C. familiaris
tcagaaagcaagaaaa

SEQ ID NO: 326207 - DNA, 16 bp, C. familiaris
tcagaaaggaaagaag

SEQ ID NO: 326208 - DNA, 16 bp, C. familiaris
tcagaaaggggagaca

SEQ ID NO: 326209 - DNA, 16 bp, C. familiaris
tcagaaataaagagaa

SEQ ID NO: 326210 - DNA, 16 bp, C. familiaris
tcagaaatacaaaaat

SEQ ID NO: 326211 - DNA, 16 bp, C. familiaris
tcagaaatcttttttt

SEQ ID NO: 326212 - DNA, 16 bp, C. familiaris
tcagaaatgtctccag

SEQ ID NO: 326213 - DNA, 16 bp, C. familiaris
tcagaaattgaaattt

SEQ ID NO: 326214 - DNA, 16 bp, C. familiaris
tcagaaattttaaaaa

SEQ ID NO: 326215 - DNA, 16 bp, C. familiaris
tcagaaattttatttt

SEQ ID NO: 326216 - DNA, 16 bp, C. familiaris
tcagaacctgcatttt

SEQ ID NO: 326217 - DNA, 16 bp, C. familiaris
tcagaactgtgagaaa

SEQ ID NO: 326218 - DNA, 16 bp, C. familiaris
tcagaacttattcatc

SEQ ID NO: 326219 - DNA, 16 bp, C. familiaris
tcagaagatttttttt

SEQ ID NO: 326220 - DNA, 16 bp, C. familiaris
tcagaaggaaaagaaa

SEQ ID NO: 326221 - DNA, 16 bp, C. familiaris
tcagaagttaaaaaaa

SEQ ID NO: 326222 - DNA, 16 bp, C. familiaris
tcagaatagaaggaaa

SEQ ID NO: 326223 - DNA, 16 bp, C. familiaris
tcagaatagattaaaa

SEQ ID NO: 326224 - DNA, 16 bp, C. familiaris
tcagaatcagaaaaaa

SEQ ID NO: 326225 - DNA, 16 bp, C. familiaris
tcagaatctctggggg

SEQ ID NO: 326226 - DNA, 16 bp, C. familiaris
tcagaatgtgaccata

SEQ ID NO: 326227 - DNA, 16 bp, C. familiaris
tcagaattaaatgaga

SEQ ID NO: 326228 - DNA, 16 bp, C. familiaris
tcagaattcagaattt

SEQ ID NO: 326229 - DNA, 16 bp, C. familiaris
tcagaattttattcct

SEQ ID NO: 326230 - DNA, 16 bp, C. familiaris
tcagacaacaaaatga

SEQ ID NO: 326231 - DNA, 16 bp, C. familiaris
tcagacaacaaagaga

SEQ ID NO: 326232 - DNA, 16 bp, C. familiaris
tcagacagaaagacaa

SEQ ID NO: 326233 - DNA, 16 bp, C. familiaris
tcagacatttaaagaa

SEQ ID NO: 326234 - DNA, 16 bp, C. familiaris
tcagactcagactcag

SEQ ID NO: 326235 - DNA, 16 bp, C. familiaris
tcagactgaattatac

SEQ ID NO: 326236 - DNA, 16 bp, C. familiaris
tcagacttttttttaa

SEQ ID NO: 326237 - DNA, 16 bp, C. familiaris
tcagagaaaaaaatga

SEQ ID NO: 326238 - DNA, 16 bp, C. familiaris
tcagagaaacagaaag

SEQ ID NO: 326239 - DNA, 16 bp, C. familiaris
tcagagaaaggaaaat

SEQ ID NO: 326240 - DNA, 16 bp, C. familiaris
tcagagaaattattgc

SEQ ID NO: 326241 - DNA, 16 bp, C. familiaris
tcagagaagacaaata

SEQ ID NO: 326242 - DNA, 16 bp, C. familiaris
tcagagaagtgaaata

SEQ ID NO: 326243 - DNA, 16 bp, C. familiaris
tcagagaagttaagta

SEQ ID NO: 326244 - DNA, 16 bp, C. familiaris
tcagagaattaaaaaa

SEQ ID NO: 326245 - DNA, 16 bp, C. familiaris
tcagagacaaaggact

SEQ ID NO: 326246 - DNA, 16 bp, C. familiaris
tcagagacacagaaag

SEQ ID NO: 326247 - DNA, 16 bp, C. familiaris
tcagagagagtgaaag

SEQ ID NO: 326248 - DNA, 16 bp, C. familiaris
tcagagaggaggtggg

SEQ ID NO: 326249 - DNA, 16 bp, C. familiaris
tcagagatgaagaact

SEQ ID NO: 326250 - DNA, 16 bp, C. familiaris
tcagagcctgatcctg

SEQ ID NO: 326251 - DNA, 16 bp, C. familiaris
tcagagctgaagaata

SEQ ID NO: 326252 - DNA, 16 bp, C. familiaris
tcagaggaagataaat

SEQ ID NO: 326253 - DNA, 16 bp, C. familiaris
tcagaggctcctcacc

SEQ ID NO: 326254 - DNA, 16 bp, C. familiaris
tcagaggttcccacaa

SEQ ID NO: 326255 - DNA, 16 bp, C. familiaris
tcagagtcccgggatc

SEQ ID NO: 326256 - DNA, 16 bp, C. familiaris
tcagataaacccaaat

SEQ ID NO: 326257 - DNA, 16 bp, C. familiaris
tcagatatatagtttg

SEQ ID NO: 326258 - DNA, 16 bp, C. familiaris
tcagatcctgatcctg

SEQ ID NO: 326259 - DNA, 16 bp, C. familiaris
tcagatgatttttttt

SEQ ID NO: 326260 - DNA, 16 bp, C. familiaris
tcagatgcagtgttca

SEQ ID NO: 326261 - DNA, 16 bp, C. familiaris
tcagatggaaagttct

SEQ ID NO: 326262 - DNA, 16 bp, C. familiaris
tcagatggatttcaca

SEQ ID NO: 326263 - DNA, 16 bp, C. familiaris
tcagatggccaacaga

SEQ ID NO: 326264 - DNA, 16 bp, C. familiaris
tcagattatttgtttt

SEQ ID NO: 326265 - DNA, 16 bp, C. familiaris
tcagattccttttttt

SEQ ID NO: 326266 - DNA, 16 bp, C. familiaris
tcagattgacttattt

SEQ ID NO: 326267 - DNA, 16 bp, C. familiaris
tcagattggattaaaa

SEQ ID NO: 326268 - DNA, 16 bp, C. familiaris
tcagatttctccagtt

SEQ ID NO: 326269 - DNA, 16 bp, C. familiaris
tcagatttctttaaaa

SEQ ID NO: 326270 - DNA, 16 bp, C. familiaris
tcagattttctttctt

SEQ ID NO: 326271 - DNA, 16 bp, C. familiaris
tcagatttttttaaaa

SEQ ID NO: 326272 - DNA, 16 bp, C. familiaris
tcagcaaaaccaggag

SEQ ID NO: 326273 - DNA, 16 bp, C. familiaris
tcagcaaacatttttt

SEQ ID NO: 326274 - DNA, 16 bp, C. familiaris
tcagcaacaaaaagaa

SEQ ID NO: 326275 - DNA, 16 bp, C. familiaris
tcagcaaggaagaagt

SEQ ID NO: 326276 - DNA, 16 bp, C. familiaris
tcagcaaggagcctga

SEQ ID NO: 326277 - DNA, 16 bp, C. familiaris
tcagcaataaaaaaga

SEQ ID NO: 326278 - DNA, 16 bp, C. familiaris
tcagcaatgtggcagg

SEQ ID NO: 326279 - DNA, 16 bp, C. familiaris
tcagcaccaaggacag

SEQ ID NO: 326280 - DNA, 16 bp, C. familiaris
tcagcaccatggacag

SEQ ID NO: 326281 - DNA, 16 bp, C. familiaris
tcagcaccgcggacag

SEQ ID NO: 326282 - DNA, 17 bp, C. familiaris
tcagcacttgggggagc

SEQ ID NO: 326283 - DNA, 16 bp, C. familiaris
tcagcagaaagtctgc

SEQ ID NO: 326284 - DNA, 16 bp, C. familiaris
tcagcagagtctgcct

SEQ ID NO: 326285 - DNA, 16 bp, C. familiaris
tcagcagctgagcatc

SEQ ID NO: 326286 - DNA, 16 bp, C. familiaris
tcagcagcttagtgcc

SEQ ID NO: 326287 - DNA, 16 bp, C. familiaris
tcagcaggggagcctg

SEQ ID NO: 326288 - DNA, 16 bp, C. familiaris
tcagcaggtgtctctg

SEQ ID NO: 326289 - DNA, 16 bp, C. familiaris
tcagcagttgggtggc

SEQ ID NO: 326290 - DNA, 16 bp, C. familiaris
tcagcataaacacaga

SEQ ID NO: 326291 - DNA, 16 bp, C. familiaris
tcagcatcacctggga

SEQ ID NO: 326292 - DNA, 16 bp, C. familiaris
tcagcatctcagcatc

SEQ ID NO: 326293 - DNA, 16 bp, C. familiaris
tcagcatctcctggga

SEQ ID NO: 326294 - DNA, 16 bp, C. familiaris
tcagcatttcattcct

SEQ ID NO: 326295 - DNA, 16 bp, C. familiaris
tcagccacaagaaaaa

SEQ ID NO: 326296 - DNA, 16 bp, C. familiaris
tcagccaggtgccccc

SEQ ID NO: 326297 - DNA, 16 bp, C. familiaris
tcagccagtggagcat

SEQ ID NO: 326298 - DNA, 16 bp, C. familiaris
tcagccattttgaccc

SEQ ID NO: 326299 - DNA, 16 bp, C. familiaris
tcagcccagggcgcaa

SEQ ID NO: 326300 - DNA, 16 bp, C. familiaris
tcagcccaggtcatgg

SEQ ID NO: 326301 - DNA, 16 bp, C. familiaris
tcagcctctctctgtc

SEQ ID NO: 326302 - DNA, 16 bp, C. familiaris
tcagcctggagtctgc

SEQ ID NO: 326303 - DNA, 16 bp, C. familiaris
tcagccttcagctcag

SEQ ID NO: 326304 - DNA, 16 bp, C. familiaris
tcagctcagctcagct

SEQ ID NO: 326305 - DNA, 16 bp, C. familiaris
tcagctcgggtcctga

SEQ ID NO: 326306 - DNA, 16 bp, C. familiaris
tcagctctgggagagc

SEQ ID NO: 326307 - DNA, 16 bp, C. familiaris
tcagctctggggctgg

SEQ ID NO: 326308 - DNA, 16 bp, C. familiaris
tcagcttcctcatctt

SEQ ID NO: 326309 - DNA, 16 bp, C. familiaris
tcagcttgggttatga

SEQ ID NO: 326310 - DNA, 16 bp, C. familiaris
tcagcttttctctctc

SEQ ID NO: 326311 - DNA, 16 bp, C. familiaris
tcaggaaaacagttta

SEQ ID NO: 326312 - DNA, 16 bp, C. familiaris
tcaggaaaagacaaat

SEQ ID NO: 326313 - DNA, 16 bp, C. familiaris
tcaggaaacaaaaaga

SEQ ID NO: 326314 - DNA, 16 bp, C. familiaris
tcaggaaactttgaaa

SEQ ID NO: 326315 - DNA, 16 bp, C. familiaris
tcaggaaagacacaga

SEQ ID NO: 326316 - DNA, 16 bp, C. familiaris
tcaggaagaaaaagaa

SEQ ID NO: 326317 - DNA, 16 bp, C. familiaris
tcaggaagaaaaggaa

SEQ ID NO: 326318 - DNA, 16 bp, C. familiaris
tcaggaagaagaaaaa

SEQ ID NO: 326319 - DNA, 16 bp, C. familiaris
tcaggaagaagacagg

SEQ ID NO: 326320 - DNA, 16 bp, C. familiaris
tcaggaatattggtct

SEQ ID NO: 326321 - DNA, 16 bp, C. familiaris
tcaggaccccaggacc

SEQ ID NO: 326322 - DNA, 16 bp, C. familiaris
tcaggacctgaaccaa

SEQ ID NO: 326323 - DNA, 16 bp, C. familiaris
tcaggagaaatgaaaa

SEQ ID NO: 326324 - DNA, 16 bp, C. familiaris
tcaggagacctatcta

SEQ ID NO: 326325 - DNA, 16 bp, C. familiaris
tcaggagcaagacaag

SEQ ID NO: 326326 - DNA, 16 bp, C. familiaris
tcaggatcatgagttt

SEQ ID NO: 326327 - DNA, 16 bp, C. familiaris
tcaggatcatgggatc

SEQ ID NO: 326328 - DNA, 16 bp, C. familiaris
tcaggatgctgggatc

SEQ ID NO: 326329 - DNA, 16 bp, C. familiaris
tcaggcaaggaaaaca

SEQ ID NO: 326330 - DNA, 16 bp, C. familiaris
tcaggcaagttactta

SEQ ID NO: 326331 - DNA, 16 bp, C. familiaris
tcaggcatcaaaaaga

SEQ ID NO: 326332 - DNA, 16 bp, C. familiaris
tcaggccaaaaacctt

SEQ ID NO: 326333 - DNA, 16 bp, C. familiaris
tcaggccccaggcccc

SEQ ID NO: 326334 - DNA, 19 bp, C. familiaris
tcaggccctggacccaagg

SEQ ID NO: 326335 - DNA, 16 bp, C. familiaris
tcaggccctggcctga

SEQ ID NO: 326336 - DNA, 16 bp, C. familiaris
tcaggccctgggctgc

SEQ ID NO: 326337 - DNA, 16 bp, C. familiaris
tcaggctcaggctcag

SEQ ID NO: 326338 - DNA, 16 bp, C. familiaris
tcaggctccactctca

SEQ ID NO: 326339 - DNA, 16 bp, C. familiaris
tcaggctcccaggagg

SEQ ID NO: 326340 - DNA, 16 bp, C. familiaris
tcaggctccccattgg

SEQ ID NO: 326341 - DNA, 16 bp, C. familiaris
tcaggctcccctcggg

SEQ ID NO: 326342 - DNA, 16 bp, C. familiaris
tcaggctcctcacagg

SEQ ID NO: 326343 - DNA, 16 bp, C. familiaris
tcaggctcctgacatg

SEQ ID NO: 326344 - DNA, 16 bp, C. familiaris
tcaggctcctgcgtgg

SEQ ID NO: 326345 - DNA, 16 bp, C. familiaris
tcaggctccttggagg

SEQ ID NO: 326346 - DNA, 16 bp, C. familiaris
tcaggctctcctcagg

SEQ ID NO: 326347 - DNA, 16 bp, C. familiaris
tcaggctctctgaatg

SEQ ID NO: 326348 - DNA, 16 bp, C. familiaris
tcaggctctgagctca

SEQ ID NO: 326349 - DNA, 16 bp, C. familiaris
tcaggctctgtgctca

SEQ ID NO: 326350 - DNA, 16 bp, C. familiaris
tcaggctctgtgctcc

SEQ ID NO: 326351 - DNA, 16 bp, C. familiaris
tcaggctgctatgaca

SEQ ID NO: 326352 - DNA, 16 bp, C. familiaris
tcaggcttcctacatg

SEQ ID NO: 326353 - DNA, 16 bp, C. familiaris
tcaggcttcctgcaag

SEQ ID NO: 326354 - DNA, 16 bp, C. familiaris
tcagggaaaagaaaat

SEQ ID NO: 326355 - DNA, 16 bp, C. familiaris
tcagggaaagcttcct

SEQ ID NO: 326356 - DNA, 16 bp, C. familiaris
tcagggaagacttcct

SEQ ID NO: 326357 - DNA, 16 bp, C. familiaris
tcagggaaggcctcac

SEQ ID NO: 326358 - DNA, 16 bp, C. familiaris
tcagggacccaggctc

SEQ ID NO: 326359 - DNA, 16 bp, C. familiaris
tcagggaggccttccc

SEQ ID NO: 326360 - DNA, 16 bp, C. familiaris
tcagggcagaaattaa

SEQ ID NO: 326361 - DNA, 16 bp, C. familiaris
tcagggcaggggcagc

SEQ ID NO: 326362 - DNA, 16 bp, C. familiaris
tcagggcatgaccctg

SEQ ID NO: 326363 - DNA, 16 bp, C. familiaris
tcagggggcacctggg

SEQ ID NO: 326364 - DNA, 16 bp, C. familiaris
tcagggtcatgaaatg

SEQ ID NO: 326365 - DNA, 16 bp, C. familiaris
tcagggtccccgcagg

SEQ ID NO: 326366 - DNA, 16 bp, C. familiaris
tcagggttctccaggg

SEQ ID NO: 326367 - DNA, 16 bp, C. familiaris
tcagggttctgagttc

SEQ ID NO: 326368 - DNA, 16 bp, C. familiaris
tcaggtcaggatctcc

SEQ ID NO: 326369 - DNA, 16 bp, C. familiaris
tcaggtcatgattgtg

SEQ ID NO: 326370 - DNA, 16 bp, C. familiaris
tcaggtcttgatatca

SEQ ID NO: 326371 - DNA, 16 bp, C. familiaris
tcaggtcttggtctca

SEQ ID NO: 326372 - DNA, 16 bp, C. familiaris
tcaggtgtgagcactt

SEQ ID NO: 326373 - DNA, 16 bp, C. familiaris
tcaggttgtcatctca

SEQ ID NO: 326374 - DNA, 16 bp, C. familiaris
tcaggttttaaaaaaa

SEQ ID NO: 326375 - DNA, 16 bp, C. familiaris
tcagtaccatttattg

SEQ ID NO: 326376 - DNA, 16 bp, C. familiaris
tcagtagatgaagaaa

SEQ ID NO: 326377 - DNA, 16 bp, C. familiaris
tcagtcagttaagctt

SEQ ID NO: 326378 - DNA, 16 bp, C. familiaris
tcagtcatttggggaa

SEQ ID NO: 326379 - DNA, 17 bp, C. familiaris
tcagtccagggagtgat

SEQ ID NO: 326380 - DNA, 16 bp, C. familiaris
tcagtccctggaccct

SEQ ID NO: 326381 - DNA, 16 bp, C. familiaris
tcagtccgtagagcat

SEQ ID NO: 326382 - DNA, 16 bp, C. familiaris
tcagtctcctttgctg

SEQ ID NO: 326383 - DNA, 16 bp, C. familiaris
tcagtctgtggtattt

SEQ ID NO: 326384 - DNA, 16 bp, C. familiaris
tcagtgaaaccaggag

SEQ ID NO: 326385 - DNA, 16 bp, C. familiaris
tcagtgagaatgggga

SEQ ID NO: 326386 - DNA, 16 bp, C. familiaris
tcagtgatccatcagt

SEQ ID NO: 326387 - DNA, 16 bp, C. familiaris
tcagtgatgctgagca

SEQ ID NO: 326388 - DNA, 16 bp, C. familiaris
tcagtgattcaccagt

SEQ ID NO: 326389 - DNA, 16 bp, C. familiaris
tcagtgcaaaatgaaa

SEQ ID NO: 326390 - DNA, 16 bp, C. familiaris
tcagtgcacagaaatc

SEQ ID NO: 326391 - DNA, 16 bp, C. familiaris
tcagtgcggagcctgc

SEQ ID NO: 326392 - DNA, 16 bp, C. familiaris
tcagtgctgccttcag

SEQ ID NO: 326393 - DNA, 16 bp, C. familiaris
tcagtggaatagaata

SEQ ID NO: 326394 - DNA, 16 bp, C. familiaris
tcagtggagggcctgc

SEQ ID NO: 326395 - DNA, 16 bp, C. familiaris
tcagtggcatttagtg

SEQ ID NO: 326396 - DNA, 16 bp, C. familiaris
tcagtggctgagcacc

SEQ ID NO: 326397 - DNA, 16 bp, C. familiaris
tcagtggctgagtatc

SEQ ID NO: 326398 - DNA, 16 bp, C. familiaris
tcagtggcttcccatt

SEQ ID NO: 326399 - DNA, 16 bp, C. familiaris
tcagtggggggcctgc

SEQ ID NO: 326400 - DNA, 16 bp, C. familiaris
tcagtggttgagcaac

SEQ ID NO: 326401 - DNA, 16 bp, C. familiaris
tcagtggtttagcatc

SEQ ID NO: 326402 - DNA, 16 bp, C. familiaris
tcagtgtattttattt

SEQ ID NO: 326403 - DNA, 16 bp, C. familiaris
tcagttaaaaaaatat

SEQ ID NO: 326404 - DNA, 16 bp, C. familiaris
tcagttaagcacctgt

SEQ ID NO: 326405 - DNA, 16 bp, C. familiaris
tcagttatttctttca

SEQ ID NO: 326406 - DNA, 16 bp, C. familiaris
tcagttcaggtggtga

SEQ ID NO: 326407 - DNA, 16 bp, C. familiaris
tcagttgagcaaccaa

SEQ ID NO: 326408 - DNA, 16 bp, C. familiaris
tcagttgtggatctga

SEQ ID NO: 326409 - DNA, 16 bp, C. familiaris
tcagtttcagatgtac

SEQ ID NO: 326410 - DNA, 16 bp, C. familiaris
tcagtttccccatttt

SEQ ID NO: 326411 - DNA, 16 bp, C. familiaris
tcagtttccccttctg

SEQ ID NO: 326412 - DNA, 16 bp, C. familiaris
tcagtttcctcttttg

SEQ ID NO: 326413 - DNA, 16 bp, C. familiaris
tcagtttctccatcca

SEQ ID NO: 326414 - DNA, 16 bp, C. familiaris
tcagtttcttcatcaa

SEQ ID NO: 326415 - DNA, 16 bp, C. familiaris
tcagtttcttctggga

SEQ ID NO: 326416 - DNA, 16 bp, C. familiaris
tcagtttctttctctg

SEQ ID NO: 326417 - DNA, 16 bp, C. familiaris
tcagtttgttttctgt

SEQ ID NO: 326418 - DNA, 16 bp, C. familiaris
tcagttttcaaaattt

SEQ ID NO: 326419 - DNA, 16 bp, C. familiaris
tcagttttcccacctg

SEQ ID NO: 326420 - DNA, 16 bp, C. familiaris
tcagttttcctccttt

SEQ ID NO: 326421 - DNA, 16 bp, C. familiaris
tcagttttggaagatg

SEQ ID NO: 326422 - DNA, 16 bp, C. familiaris
tcagtttttaaaaaat

SEQ ID NO: 326423 - DNA, 16 bp, C. familiaris
tcagtttttcccccat

SEQ ID NO: 326424 - DNA, 16 bp, C. familiaris
tcagttttttttaaag

SEQ ID NO: 326425 - DNA, 16 bp, C. familiaris
tcataaatggatgttg

SEQ ID NO: 326426 - DNA, 16 bp, C. familiaris
tcatacaggaattcag

SEQ ID NO: 326427 - DNA, 16 bp, C. familiaris
tcatacctgtcaaaat

SEQ ID NO: 326428 - DNA, 16 bp, C. familiaris
tcatagagacagaggg

SEQ ID NO: 326429 - DNA, 16 bp, C. familiaris
tcatagatgagaactt

SEQ ID NO: 326430 - DNA, 16 bp, C. familiaris
tcataggatcaagtcc

SEQ ID NO: 326431 - DNA, 16 bp, C. familiaris
tcatatattgctggtg

SEQ ID NO: 326432 - DNA, 16 bp, C. familiaris
tcatatcatgtgccct

SEQ ID NO: 326433 - DNA, 16 bp, C. familiaris
tcatatgagagagaga

SEQ ID NO: 326434 - DNA, 16 bp, C. familiaris
tcatatgcttggagga

SEQ ID NO: 326435 - DNA, 16 bp, C. familiaris
tcatatgtaaaatggg

SEQ ID NO: 326436 - DNA, 16 bp, C. familiaris
tcatatgtatttgtct

SEQ ID NO: 326437 - DNA, 16 bp, C. familiaris
tcatatttaaaaatga

SEQ ID NO: 326438 - DNA, 16 bp, C. familiaris
tcatcaacatcatcat

SEQ ID NO: 326439 - DNA, 16 bp, C. familiaris
tcatcaagataagtgc

SEQ ID NO: 326440 - DNA, 16 bp, C. familiaris
tcatcacaagtgcatt

SEQ ID NO: 326441 - DNA, 16 bp, C. familiaris
tcatcacatcatgtgc

SEQ ID NO: 326442 - DNA, 16 bp, C. familiaris
tcatcacccagagtcc

SEQ ID NO: 326443 - DNA, 16 bp, C. familiaris
tcatcacttacgtaca

SEQ ID NO: 326444 - DNA, 16 bp, C. familiaris
tcatcagaaagggaga

SEQ ID NO: 326445 - DNA, 16 bp, C. familiaris
tcatcagagaaatgca

SEQ ID NO: 326446 - DNA, 16 bp, C. familiaris
tcatcagagacataga

SEQ ID NO: 326447 - DNA, 16 bp, C. familiaris
tcatcagagagtctgc

SEQ ID NO: 326448 - DNA, 16 bp, C. familiaris
tcatcagatatttatt

SEQ ID NO: 326449 - DNA, 16 bp, C. familiaris
tcatcagattctcaaa

SEQ ID NO: 326450 - DNA, 16 bp, C. familiaris
tcatcaggaaaaaaaa

SEQ ID NO: 326451 - DNA, 16 bp, C. familiaris
tcatcaggaatattga

SEQ ID NO: 326452 - DNA, 16 bp, C. familiaris
tcatcagtgctttata

SEQ ID NO: 326453 - DNA, 16 bp, C. familiaris
tcatcagtttgttttc

SEQ ID NO: 326454 - DNA, 16 bp, C. familiaris
tcatcatagttttgat

SEQ ID NO: 326455 - DNA, 16 bp, C. familiaris
tcatcatcaccaccac

SEQ ID NO: 326456 - DNA, 16 bp, C. familiaris
tcatcatcaccaccat

SEQ ID NO: 326457 - DNA, 16 bp, C. familiaris
tcatcatcaccatctt

SEQ ID NO: 326458 - DNA, 16 bp, C. familiaris
tcatcatcatcacctt

SEQ ID NO: 326459 - DNA, 16 bp, C. familiaris
tcatcatcatcatcct

SEQ ID NO: 326460 - DNA, 16 bp, C. familiaris
tcatcatcatcatctg

SEQ ID NO: 326461 - DNA, 16 bp, C. familiaris
tcatcatcatcatctt

SEQ ID NO: 326462 - DNA, 16 bp, C. familiaris
tcatcatcatcattgt

SEQ ID NO: 326463 - DNA, 16 bp, C. familiaris
tcatcatcctcatcct

SEQ ID NO: 326464 - DNA, 16 bp, C. familiaris
tcatcatcctcatttt

SEQ ID NO: 326465 - DNA, 16 bp, C. familiaris
tcatcatcttcatctt

SEQ ID NO: 326466 - DNA, 16 bp, C. familiaris
tcatcatcttggggtc

SEQ ID NO: 326467 - DNA, 16 bp, C. familiaris
tcatcatgaatggatg

SEQ ID NO: 326468 - DNA, 16 bp, C. familiaris
tcatccagagagaaaa

SEQ ID NO: 326469 - DNA, 16 bp, C. familiaris
tcatccatttttagtt

SEQ ID NO: 326470 - DNA, 16 bp, C. familiaris
tcatcccaccaaatgc

SEQ ID NO: 326471 - DNA, 16 bp, C. familiaris
tcatccctgagctgaa

SEQ ID NO: 326472 - DNA, 16 bp, C. familiaris
tcatcctcatcctcct

SEQ ID NO: 326473 - DNA, 16 bp, C. familiaris
tcatcctctgcctgtg

SEQ ID NO: 326474 - DNA, 16 bp, C. familiaris
tcatccttaaaatggg

SEQ ID NO: 326475 - DNA, 16 bp, C. familiaris
tcatcgtcatcatcat

SEQ ID NO: 326476 - DNA, 16 bp, C. familiaris
tcatctactgatggac

SEQ ID NO: 326477 - DNA, 16 bp, C. familiaris
tcatctatgtgtctgt

SEQ ID NO: 326478 - DNA, 16 bp, C. familiaris
tcatctatgttgttgc

SEQ ID NO: 326479 - DNA, 16 bp, C. familiaris
tcatctcatgaccctg

SEQ ID NO: 326480 - DNA, 16 bp, C. familiaris
tcatctgcaaaacaga

SEQ ID NO: 326481 - DNA, 16 bp, C. familiaris
tcatctgcaaaatgtg

SEQ ID NO: 326482 - DNA, 16 bp, C. familiaris
tcatctgcaaagaatg

SEQ ID NO: 326483 - DNA, 16 bp, C. familiaris
tcatctgcaaagtgaa

SEQ ID NO: 326484 - DNA, 16 bp, C. familiaris
tcatctgtaaaactgg

SEQ ID NO: 326485 - DNA, 16 bp, C. familiaris
tcatctgtaaatagtg

SEQ ID NO: 326486 - DNA, 16 bp, C. familiaris
tcatctgtataatggg

SEQ ID NO: 326487 - DNA, 16 bp, C. familiaris
tcatctgtgaaagggg

SEQ ID NO: 326488 - DNA, 16 bp, C. familiaris
tcatctgtgaagccat

SEQ ID NO: 326489 - DNA, 16 bp, C. familiaris
tcatcttaagattttt

SEQ ID NO: 326490 - DNA, 16 bp, C. familiaris
tcatcttacaaaactg

SEQ ID NO: 326491 - DNA, 16 bp, C. familiaris
tcatctttagaaaaat

SEQ ID NO: 326492 - DNA, 16 bp, C. familiaris
tcatctttgagcagga

SEQ ID NO: 326493 - DNA, 16 bp, C. familiaris
tcatcttttgaaggac

SEQ ID NO: 326494 - DNA, 16 bp, C. familiaris
tcatgaaaaaataatt

SEQ ID NO: 326495 - DNA, 16 bp, C. familiaris
tcatgaaaaacaaaga

SEQ ID NO: 326496 - DNA, 16 bp, C. familiaris
tcatgaaagacaaaga

SEQ ID NO: 326497 - DNA, 16 bp, C. familiaris
tcatgaaatttcagaa

SEQ ID NO: 326498 - DNA, 16 bp, C. familiaris
tcatgaagaaataaaa

SEQ ID NO: 326499 - DNA, 16 bp, C. familiaris
tcatgaagaaatagga

SEQ ID NO: 326500 - DNA, 16 bp, C. familiaris
tcatgaagacagtgtg

SEQ ID NO: 326501 - DNA, 16 bp, C. familiaris
tcatgaagcttatatt

SEQ ID NO: 326502 - DNA, 16 bp, C. familiaris
tcatgaataaaatttt

SEQ ID NO: 326503 - DNA, 16 bp, C. familiaris
tcatgaataagttttt

SEQ ID NO: 326504 - DNA, 16 bp, C. familiaris
tcatgaatatataaaa

SEQ ID NO: 326505 - DNA, 16 bp, C. familiaris
tcatgaatgagaaaga

SEQ ID NO: 326506 - DNA, 16 bp, C. familiaris
tcatgaatggatagat

SEQ ID NO: 326507 - DNA, 16 bp, C. familiaris
tcatgaattggaagaa

SEQ ID NO: 326508 - DNA, 16 bp, C. familiaris
tcatgacagtcacaga

SEQ ID NO: 326509 - DNA, 16 bp, C. familiaris
tcatgaccctgagctc

SEQ ID NO: 326510 - DNA, 16 bp, C. familiaris
tcatgacctgggccta

SEQ ID NO: 326511 - DNA, 16 bp, C. familiaris
tcatgactggagccaa

SEQ ID NO: 326512 - DNA, 16 bp, C. familiaris
tcatgacttttgccca

SEQ ID NO: 326513 - DNA, 16 bp, C. familiaris
tcatgagaaagagagg

SEQ ID NO: 326514 - DNA, 16 bp, C. familiaris
tcatgagacacagaga

SEQ ID NO: 326515 - DNA, 16 bp, C. familiaris
tcatgagagacacagg

SEQ ID NO: 326516 - DNA, 16 bp, C. familiaris
tcatgagagacaggca

SEQ ID NO: 326517 - DNA, 16 bp, C. familiaris
tcatgagaggcaaaga

SEQ ID NO: 326518 - DNA, 16 bp, C. familiaris
tcatgagatccttcag

SEQ ID NO: 326519 - DNA, 16 bp, C. familiaris
tcatgatcccaaggtt

SEQ ID NO: 326520 - DNA, 16 bp, C. familiaris
tcatgctgcttgctgt

SEQ ID NO: 326521 - DNA, 16 bp, C. familiaris
tcatggaaaataatga

SEQ ID NO: 326522 - DNA, 16 bp, C. familiaris
tcatggattggaggaa

SEQ ID NO: 326523 - DNA, 16 bp, C. familiaris
tcatggccaacaagca

SEQ ID NO: 326524 - DNA, 16 bp, C. familiaris
tcatggctattgtaaa

SEQ ID NO: 326525 - DNA, 16 bp, C. familiaris
tcatggcttggaagaa

SEQ ID NO: 326526 - DNA, 16 bp, C. familiaris
tcatgggaaacacaga

SEQ ID NO: 326527 - DNA, 16 bp, C. familiaris
tcatgggactgagccc

SEQ ID NO: 326528 - DNA, 16 bp, C. familiaris
tcatgggatcaagcct

SEQ ID NO: 326529 - DNA, 16 bp, C. familiaris
tcatgggcagccccgg

SEQ ID NO: 326530 - DNA, 16 bp, C. familiaris
tcatgtcatgatcttg

SEQ ID NO: 326531 - DNA, 16 bp, C. familiaris
tcatgtgccctccttt

SEQ ID NO: 326532 - DNA, 16 bp, C. familiaris
tcatgtggtttttctt

SEQ ID NO: 326533 - DNA, 16 bp, C. familiaris
tcatgtgtctgctggc

SEQ ID NO: 326534 - DNA, 16 bp, C. familiaris
tcatgttaaaaaaaaa

SEQ ID NO: 326535 - DNA, 16 bp, C. familiaris
tcatgttcatcagaga

SEQ ID NO: 326536 - DNA, 16 bp, C. familiaris
tcatgttgggtgtgga

SEQ ID NO: 326537 - DNA, 16 bp, C. familiaris
tcatgttttcattttc

SEQ ID NO: 326538 - DNA, 16 bp, C. familiaris
tcattaaaaagaaaga

SEQ ID NO: 326539 - DNA, 16 bp, C. familiaris
tcattaaagaaaataa

SEQ ID NO: 326540 - DNA, 16 bp, C. familiaris
tcattaaatggtgctg

SEQ ID NO: 326541 - DNA, 16 bp, C. familiaris
tcattagaaaaataaa

SEQ ID NO: 326542 - DNA, 16 bp, C. familiaris
tcattataagaaaaaa

SEQ ID NO: 326543 - DNA, 16 bp, C. familiaris
tcattatcctcatttt

SEQ ID NO: 326544 - DNA, 16 bp, C. familiaris
tcattatttaagaaat

SEQ ID NO: 326545 - DNA, 16 bp, C. familiaris
tcattattttgaaaac

SEQ ID NO: 326546 - DNA, 16 bp, C. familiaris
tcattcaacaattatt

SEQ ID NO: 326547 - DNA, 16 bp, C. familiaris
tcattcaacatttatt

SEQ ID NO: 326548 - DNA, 16 bp, C. familiaris
tcattcaagattttat

SEQ ID NO: 326549 - DNA, 16 bp, C. familiaris
tcattcactcaacaga

SEQ ID NO: 326550 - DNA, 16 bp, C. familiaris
tcattcactcactcat

SEQ ID NO: 326551 - DNA, 16 bp, C. familiaris
tcattcagcactttga

SEQ ID NO: 326552 - DNA, 16 bp, C. familiaris
tcattcagcatcaggg

SEQ ID NO: 326553 - DNA, 16 bp, C. familiaris
tcattcagttcaaaat

SEQ ID NO: 326554 - DNA, 16 bp, C. familiaris
tcattcatcatcagag

SEQ ID NO: 326555 - DNA, 16 bp, C. familiaris
tcattcatttatttca

SEQ ID NO: 326556 - DNA, 16 bp, C. familiaris
tcattctaaaaatatt

SEQ ID NO: 326557 - DNA, 16 bp, C. familiaris
tcattctcaatggaga

SEQ ID NO: 326558 - DNA, 16 bp, C. familiaris
tcattctccctctgcc

SEQ ID NO: 326559 - DNA, 16 bp, C. familiaris
tcattctcttgatagt

SEQ ID NO: 326560 - DNA, 16 bp, C. familiaris
tcattctcttttatgg

SEQ ID NO: 326561 - DNA, 17 bp, C. familiaris
tcattcttcagtaggat

SEQ ID NO: 326562 - DNA, 16 bp, C. familiaris
tcattcttttgaatat

SEQ ID NO: 326563 - DNA, 16 bp, C. familiaris
tcattcttttttatgg

SEQ ID NO: 326564 - DNA, 16 bp, C. familiaris
tcattgaaaatggcaa

SEQ ID NO: 326565 - DNA, 16 bp, C. familiaris
tcattgactctattcc

SEQ ID NO: 326566 - DNA, 16 bp, C. familiaris
tcattgagcttcttgg

SEQ ID NO: 326567 - DNA, 16 bp, C. familiaris
tcattgatttctgctg

SEQ ID NO: 326568 - DNA, 16 bp, C. familiaris
tcattgccaagatcaa

SEQ ID NO: 326569 - DNA, 16 bp, C. familiaris
tcattggaattttgat

SEQ ID NO: 326570 - DNA, 16 bp, C. familiaris
tcattgggatccctgg

SEQ ID NO: 326571 - DNA, 16 bp, C. familiaris
tcattgtcatcatcat

SEQ ID NO: 326572 - DNA, 16 bp, C. familiaris
tcattgttaatgtata

SEQ ID NO: 326573 - DNA, 16 bp, C. familiaris
tcattgtttttaaaga

SEQ ID NO: 326574 - DNA, 16 bp, C. familiaris
tcatttaaaacatttt

SEQ ID NO: 326575 - DNA, 16 bp, C. familiaris
tcatttaaaactcttg

SEQ ID NO: 326576 - DNA, 16 bp, C. familiaris
tcatttaacccattca

SEQ ID NO: 326577 - DNA, 16 bp, C. familiaris
tcatttacaaagaaaa

SEQ ID NO: 326578 - DNA, 16 bp, C. familiaris
tcatttatccattgat

SEQ ID NO: 326579 - DNA, 16 bp, C. familiaris
tcatttattcagcaaa

SEQ ID NO: 326580 - DNA, 16 bp, C. familiaris
tcatttatttgaaaat

SEQ ID NO: 326581 - DNA, 16 bp, C. familiaris
tcatttcatcaagtgc

SEQ ID NO: 326582 - DNA, 16 bp, C. familiaris
tcatttcatcttcaca

SEQ ID NO: 326583 - DNA, 16 bp, C. familiaris
tcatttccaccttttg

SEQ ID NO: 326584 - DNA, 16 bp, C. familiaris
tcatttctgattttga

SEQ ID NO: 326585 - DNA, 16 bp, C. familiaris
tcatttctgcttttgt

SEQ ID NO: 326586 - DNA, 16 bp, C. familiaris
tcatttgaaaaaataa

SEQ ID NO: 326587 - DNA, 16 bp, C. familiaris
tcatttgaagaaataa

SEQ ID NO: 326588 - DNA, 16 bp, C. familiaris
tcatttgattcacttt

SEQ ID NO: 326589 - DNA, 16 bp, C. familiaris
tcatttgcaatatctt

SEQ ID NO: 326590 - DNA, 16 bp, C. familiaris
tcatttgcagatattt

SEQ ID NO: 326591 - DNA, 16 bp, C. familiaris
tcatttgcatatcttc

SEQ ID NO: 326592 - DNA, 16 bp, C. familiaris
tcatttgcatttattt

SEQ ID NO: 326593 - DNA, 16 bp, C. familiaris
tcatttgcttcaatgt

SEQ ID NO: 326594 - DNA, 16 bp, C. familiaris
tcatttggaaaatgaa

SEQ ID NO: 326595 - DNA, 16 bp, C. familiaris
tcatttggggaatatt

SEQ ID NO: 326596 - DNA, 16 bp, C. familiaris
tcatttgtatttctct

SEQ ID NO: 326597 - DNA, 16 bp, C. familiaris
tcatttgtcttcatgt

SEQ ID NO: 326598 - DNA, 16 bp, C. familiaris
tcatttgtttcccttt

SEQ ID NO: 326599 - DNA, 16 bp, C. familiaris
tcattttaaaagaaaa

SEQ ID NO: 326600 - DNA, 16 bp, C. familiaris
tcattttaaaatggga

SEQ ID NO: 326601 - DNA, 16 bp, C. familiaris
tcattttaaagaagaa

SEQ ID NO: 326602 - DNA, 16 bp, C. familiaris
tcattttaatttcagt

SEQ ID NO: 326603 - DNA, 16 bp, C. familiaris
tcattttacaaagaaa

SEQ ID NO: 326604 - DNA, 16 bp, C. familiaris
tcattttacacacaca

SEQ ID NO: 326605 - DNA, 16 bp, C. familiaris
tcattttacaggtgag

SEQ ID NO: 326606 - DNA, 16 bp, C. familiaris
tcattttatagaaaag

SEQ ID NO: 326607 - DNA, 16 bp, C. familiaris
tcattttcaaaagaaa

SEQ ID NO: 326608 - DNA, 16 bp, C. familiaris
tcattttcaaaggaaa

SEQ ID NO: 326609 - DNA, 16 bp, C. familiaris
tcattttcaatgggga

SEQ ID NO: 326610 - DNA, 16 bp, C. familiaris
tcattttccagatgaa

SEQ ID NO: 326611 - DNA, 16 bp, C. familiaris
tcattttgcaatttat

SEQ ID NO: 326612 - DNA, 16 bp, C. familiaris
tcattttggaaaacag

SEQ ID NO: 326613 - DNA, 16 bp, C. familiaris
tcattttggaaaataa

SEQ ID NO: 326614 - DNA, 16 bp, C. familiaris
tcattttggaaaatat

SEQ ID NO: 326615 - DNA, 16 bp, C. familiaris
tcattttggaaaattt

SEQ ID NO: 326616 - DNA, 16 bp, C. familiaris
tcattttgttttaaag

SEQ ID NO: 326617 - DNA, 16 bp, C. familiaris
tcatttttaaaatgca

SEQ ID NO: 326618 - DNA, 16 bp, C. familiaris
tcatttttaaaatgta

SEQ ID NO: 326619 - DNA, 16 bp, C. familiaris
tcatttttaatgactg

SEQ ID NO: 326620 - DNA, 16 bp, C. familiaris
tcatttttaatttgta

SEQ ID NO: 326621 - DNA, 16 bp, C. familiaris
tcatttttatagatga

SEQ ID NO: 326622 - DNA, 16 bp, C. familiaris
tcatttttcaaataaa

SEQ ID NO: 326623 - DNA, 16 bp, C. familiaris
tcatttttgatggctg

SEQ ID NO: 326624 - DNA, 16 bp, C. familiaris
tcatttttgccatttt

SEQ ID NO: 326625 - DNA, 16 bp, C. familiaris
tcatttttgtgtgtgt

SEQ ID NO: 326626 - DNA, 16 bp, C. familiaris
tcatttttttcctgat

SEQ ID NO: 326627 - DNA, 16 bp, C. familiaris
tccaaaaaaatcattg

SEQ ID NO: 326628 - DNA, 16 bp, C. familiaris
tccaaaaaattgaaaa

SEQ ID NO: 326629 - DNA, 16 bp, C. familiaris
tccaaaagaattttta

SEQ ID NO: 326630 - DNA, 16 bp, C. familiaris
tccaaaagatacaaaa

SEQ ID NO: 326631 - DNA, 16 bp, C. familiaris
tccaaacacttggaaa

SEQ ID NO: 326632 - DNA, 16 bp, C. familiaris
tccaaacttcttgttg

SEQ ID NO: 326633 - DNA, 16 bp, C. familiaris
tccaaagaaaatacac

SEQ ID NO: 326634 - DNA, 16 bp, C. familiaris
tccaaagaagacacaa

SEQ ID NO: 326635 - DNA, 16 bp, C. familiaris
tccaaagaagatacag

SEQ ID NO: 326636 - DNA, 16 bp, C. familiaris
tccaaagcaagcagaa

SEQ ID NO: 326637 - DNA, 16 bp, C. familiaris
tccaaagcattttttt

SEQ ID NO: 326638 - DNA, 16 bp, C. familiaris
tccaaaggaattgaaa

SEQ ID NO: 326639 - DNA, 16 bp, C. familiaris
tccaaagggattttta

SEQ ID NO: 326640 - DNA, 16 bp, C. familiaris
tccaaagtgactcttg

SEQ ID NO: 326641 - DNA, 16 bp, C. familiaris
tccaaataaaatcaca

SEQ ID NO: 326642 - DNA, 16 bp, C. familiaris
tccaaatattttgaaa

SEQ ID NO: 326643 - DNA, 16 bp, C. familiaris
tccaaatcctctccaa

SEQ ID NO: 326644 - DNA, 16 bp, C. familiaris
tccaaattggaaagaa

SEQ ID NO: 326645 - DNA, 16 bp, C. familiaris
tccaacaaacatttat

SEQ ID NO: 326646 - DNA, 16 bp, C. familiaris
tccaacaatatattaa

SEQ ID NO: 326647 - DNA, 16 bp, C. familiaris
tccaacatccattcct

SEQ ID NO: 326648 - DNA, 16 bp, C. familiaris
tccaacatggagctca

SEQ ID NO: 326649 - DNA, 16 bp, C. familiaris
tccaactattccaaaa

SEQ ID NO: 326650 - DNA, 16 bp, C. familiaris
tccaactccctgctca

SEQ ID NO: 326651 - DNA, 16 bp, C. familiaris
tccaactcctgatctc

SEQ ID NO: 326652 - DNA, 16 bp, C. familiaris
tccaagaaaaatgaaa

SEQ ID NO: 326653 - DNA, 16 bp, C. familiaris
tccaagaaatagagag

SEQ ID NO: 326654 - DNA, 16 bp, C. familiaris
tccaagaccctgagat

SEQ ID NO: 326655 - DNA, 16 bp, C. familiaris
tccaagatcatgaccc

SEQ ID NO: 326656 - DNA, 16 bp, C. familiaris
tccaagatctctaaag

SEQ ID NO: 326657 - DNA, 16 bp, C. familiaris
tccaagcagtgccagc

SEQ ID NO: 326658 - DNA, 16 bp, C. familiaris
tccaagcccagtgcag

SEQ ID NO: 326659 - DNA, 16 bp, C. familiaris
tccaagcttctaatca

SEQ ID NO: 326660 - DNA, 16 bp, C. familiaris
tccaaggagctgtaca

SEQ ID NO: 326661 - DNA, 16 bp, C. familiaris
tccaagggcaggagaa

SEQ ID NO: 326662 - DNA, 16 bp, C. familiaris
tccaagggtcctggaa

SEQ ID NO: 326663 - DNA, 16 bp, C. familiaris
tccaagtccaaaggcc

SEQ ID NO: 326664 - DNA, 16 bp, C. familiaris
tccaagtccaggaggc

SEQ ID NO: 326665 - DNA, 16 bp, C. familiaris
tccaagttggaaagga

SEQ ID NO: 326666 - DNA, 16 bp, C. familiaris
tccaataagaagatat

SEQ ID NO: 326667 - DNA, 16 bp, C. familiaris
tccaatagaaataaaa

SEQ ID NO: 326668 - DNA, 16 bp, C. familiaris
tccaatcaagaaatga

SEQ ID NO: 326669 - DNA, 16 bp, C. familiaris
tccaatgatagatgaa

SEQ ID NO: 326670 - DNA, 16 bp, C. familiaris
tccaatgtaaatttag

SEQ ID NO: 326671 - DNA, 16 bp, C. familiaris
tccaatgtggggctgg

SEQ ID NO: 326672 - DNA, 16 bp, C. familiaris
tccaattatgaaatgg

SEQ ID NO: 326673 - DNA, 16 bp, C. familiaris
tccacaaagacctggc

SEQ ID NO: 326674 - DNA, 16 bp, C. familiaris
tccacaaatttgataa

SEQ ID NO: 326675 - DNA, 16 bp, C. familiaris
tccacacccatcatgg

SEQ ID NO: 326676 - DNA, 16 bp, C. familiaris
tccacagaaacctggc

SEQ ID NO: 326677 - DNA, 16 bp, C. familiaris
tccacagagacctggc

SEQ ID NO: 326678 - DNA, 16 bp, C. familiaris
tccacagagacttggc

SEQ ID NO: 326679 - DNA, 16 bp, C. familiaris
tccacagagatctggc

SEQ ID NO: 326680 - DNA, 16 bp, C. familiaris
tccacagttttccaga

SEQ ID NO: 326681 - DNA, 16 bp, C. familiaris
tccacatccaacatgg

SEQ ID NO: 326682 - DNA, 16 bp, C. familiaris
tccacatcctcatcca

SEQ ID NO: 326683 - DNA, 16 bp, C. familiaris
tccacatcctctccaa

SEQ ID NO: 326684 - DNA, 16 bp, C. familiaris
tccacatccttgacaa

SEQ ID NO: 326685 - DNA, 16 bp, C. familiaris
tccacatgcaaaaaag

SEQ ID NO: 326686 - DNA, 16 bp, C. familiaris
tccacattgagcacag

SEQ ID NO: 326687 - DNA, 16 bp, C. familiaris
tccaccaacagagcca

SEQ ID NO: 326688 - DNA, 16 bp, C. familiaris
tccaccccaggactct

SEQ ID NO: 326689 - DNA, 16 bp, C. familiaris
tccacctctgggtatt

SEQ ID NO: 326690 - DNA, 16 bp, C. familiaris
tccacctgtccatcca

SEQ ID NO: 326691 - DNA, 16 bp, C. familiaris
tccaccttcagctcag

SEQ ID NO: 326692 - DNA, 16 bp, C. familiaris
tccactacaacttctt

SEQ ID NO: 326693 - DNA, 17 bp, C. familiaris
tccactcatcttttgat

SEQ ID NO: 326694 - DNA, 16 bp, C. familiaris
tccactgacagagcca

SEQ ID NO: 326695 - DNA, 16 bp, C. familiaris
tccactgatccatgtg

SEQ ID NO: 326696 - DNA, 16 bp, C. familiaris
tccacttttggattct

SEQ ID NO: 326697 - DNA, 16 bp, C. familiaris
tccagaaaaaaatgaa

SEQ ID NO: 326698 - DNA, 16 bp, C. familiaris
tccagaaaaagagaaa

SEQ ID NO: 326699 - DNA, 16 bp, C. familiaris
tccagaaaaaggaaaa

SEQ ID NO: 326700 - DNA, 16 bp, C. familiaris
tccagaaaagatcaca

SEQ ID NO: 326701 - DNA, 16 bp, C. familiaris
tccagaaactggaaaa

SEQ ID NO: 326702 - DNA, 16 bp, C. familiaris
tccagaaaggctctca

SEQ ID NO: 326703 - DNA, 16 bp, C. familiaris
tccagaaataccctca

SEQ ID NO: 326704 - DNA, 16 bp, C. familiaris
tccagaaatggaattg

SEQ ID NO: 326705 - DNA, 16 bp, C. familiaris
tccagaactgaaaaat

SEQ ID NO: 326706 - DNA, 16 bp, C. familiaris
tccagaagaaaaagaa

SEQ ID NO: 326707 - DNA, 16 bp, C. familiaris
tccagaaggagaaaag

SEQ ID NO: 326708 - DNA, 16 bp, C. familiaris
tccagaatcatgcccc

SEQ ID NO: 326709 - DNA, 16 bp, C. familiaris
tccagaatggtgagaa

SEQ ID NO: 326710 - DNA, 16 bp, C. familiaris
tccagaatgtataaag

SEQ ID NO: 326711 - DNA, 16 bp, C. familiaris
tccagaattatgagaa

SEQ ID NO: 326712 - DNA, 16 bp, C. familiaris
tccagaccctgagatc

SEQ ID NO: 326713 - DNA, 16 bp, C. familiaris
tccagactgtgggaaa

SEQ ID NO: 326714 - DNA, 16 bp, C. familiaris
tccagagaaaatgaaa

SEQ ID NO: 326715 - DNA, 16 bp, C. familiaris
tccagagaaacagacc

SEQ ID NO: 326716 - DNA, 16 bp, C. familiaris
tccagagactccagga

SEQ ID NO: 326717 - DNA, 16 bp, C. familiaris
tccagagagacctggc

SEQ ID NO: 326718 - DNA, 16 bp, C. familiaris
tccagagccaccagta

SEQ ID NO: 326719 - DNA, 16 bp, C. familiaris
tccagagcctggcaca

SEQ ID NO: 326720 - DNA, 16 bp, C. familiaris
tccagagctggctgcc

SEQ ID NO: 326721 - DNA, 16 bp, C. familiaris
tccagaggcacctggg

SEQ ID NO: 326722 - DNA, 16 bp, C. familiaris
tccagaggggcacctg

SEQ ID NO: 326723 - DNA, 16 bp, C. familiaris
tccagagtcagatgct

SEQ ID NO: 326724 - DNA, 16 bp, C. familiaris
tccagagtttggctat

SEQ ID NO: 326725 - DNA, 16 bp, C. familiaris
tccagatgaggaaact

SEQ ID NO: 326726 - DNA, 16 bp, C. familiaris
tccagatggccaccag

SEQ ID NO: 326727 - DNA, 16 bp, C. familiaris
tccagattaaaggaga

SEQ ID NO: 326728 - DNA, 16 bp, C. familiaris
tccagattggaaaaga

SEQ ID NO: 326729 - DNA, 16 bp, C. familiaris
tccagcaacctcagtt

SEQ ID NO: 326730 - DNA, 16 bp, C. familiaris
tccagcagaggaagag

SEQ ID NO: 326731 - DNA, 16 bp, C. familiaris
tccagcagggagcctg

SEQ ID NO: 326732 - DNA, 16 bp, C. familiaris
tccagcagtcccactt

SEQ ID NO: 326733 - DNA, 16 bp, C. familiaris
tccagccatcccaggc

SEQ ID NO: 326734 - DNA, 16 bp, C. familiaris
tccagcccagcccagc

SEQ ID NO: 326735 - DNA, 16 bp, C. familiaris
tccagcccaggacccc

SEQ ID NO: 326736 - DNA, 16 bp, C. familiaris
tccagccccatatcag

SEQ ID NO: 326737 - DNA, 16 bp, C. familiaris
tccagccctgcatggg

SEQ ID NO: 326738 - DNA, 16 bp, C. familiaris
tccagctccagctccc

SEQ ID NO: 326739 - DNA, 16 bp, C. familiaris
tccagctccctgctca

SEQ ID NO: 326740 - DNA, 16 bp, C. familiaris
tccagctccttgctca

SEQ ID NO: 326741 - DNA, 16 bp, C. familiaris
tccagctctggagtca

SEQ ID NO: 326742 - DNA, 16 bp, C. familiaris
tccagctgaaggcaga

SEQ ID NO: 326743 - DNA, 16 bp, C. familiaris
tccagctgttgtctct

SEQ ID NO: 326744 - DNA, 16 bp, C. familiaris
tccagcttccagagct

SEQ ID NO: 326745 - DNA, 16 bp, C. familiaris
tccagcttcctgctca

SEQ ID NO: 326746 - DNA, 16 bp, C. familiaris
tccagcttctagaact

SEQ ID NO: 326747 - DNA, 16 bp, C. familiaris
tccaggaaaaaacaaa

SEQ ID NO: 326748 - DNA, 16 bp, C. familiaris
tccaggaaagaaaaaa

SEQ ID NO: 326749 - DNA, 16 bp, C. familiaris
tccaggaagcccagag

SEQ ID NO: 326750 - DNA, 16 bp, C. familiaris
tccaggacatgatcct

SEQ ID NO: 326751 - DNA, 16 bp, C. familiaris
tccaggaccccgagat

SEQ ID NO: 326752 - DNA, 16 bp, C. familiaris
tccaggaccctgggac

SEQ ID NO: 326753 - DNA, 16 bp, C. familiaris
tccaggactccagaat

SEQ ID NO: 326754 - DNA, 16 bp, C. familiaris
tccaggactctgagat

SEQ ID NO: 326755 - DNA, 16 bp, C. familiaris
tccaggactgagagaa

SEQ ID NO: 326756 - DNA, 16 bp, C. familiaris
tccaggagcacctggg

SEQ ID NO: 326757 - DNA, 16 bp, C. familiaris
tccaggagcagctggg

SEQ ID NO: 326758 - DNA, 16 bp, C. familiaris
tccaggagcccaccaa

SEQ ID NO: 326759 - DNA, 16 bp, C. familiaris
tccaggaggcacagaa

SEQ ID NO: 326760 - DNA, 16 bp, C. familiaris
tccaggaggcagagag

SEQ ID NO: 326761 - DNA, 16 bp, C. familiaris
tccaggagtcccagga

SEQ ID NO: 326762 - DNA, 16 bp, C. familiaris
tccaggattccaggat

SEQ ID NO: 326763 - DNA, 16 bp, C. familiaris
tccaggcagcctgggt

SEQ ID NO: 326764 - DNA, 16 bp, C. familiaris
tccaggcagccttccc

SEQ ID NO: 326765 - DNA, 16 bp, C. familiaris
tccaggcccagatggt

SEQ ID NO: 326766 - DNA, 16 bp, C. familiaris
tccaggcccagcacag

SEQ ID NO: 326767 - DNA, 16 bp, C. familiaris
tccaggcccagtgtgg

SEQ ID NO: 326768 - DNA, 17 bp, C. familiaris
tccaggccctgcagacc

SEQ ID NO: 326769 - DNA, 16 bp, C. familiaris
tccaggccctgggctg

SEQ ID NO: 326770 - DNA, 16 bp, C. familiaris
tccaggctgagcacag

SEQ ID NO: 326771 - DNA, 16 bp, C. familiaris
tccagggaaccctggg

SEQ ID NO: 326772 - DNA, 16 bp, C. familiaris
tccagggaccccagga

SEQ ID NO: 326773 - DNA, 16 bp, C. familiaris
tccagggaccccaggg

SEQ ID NO: 326774 - DNA, 16 bp, C. familiaris
tccagggaccctctgg

SEQ ID NO: 326775 - DNA, 16 bp, C. familiaris
tccagggactccagaa

SEQ ID NO: 326776 - DNA, 16 bp, C. familiaris
tccagggactccagga

SEQ ID NO: 326777 - DNA, 16 bp, C. familiaris
tccagggcagccccag

SEQ ID NO: 326778 - DNA, 16 bp, C. familiaris
tccagggcagcctggg

SEQ ID NO: 326779 - DNA, 16 bp, C. familiaris
tccagggccaggtggc

SEQ ID NO: 326780 - DNA, 16 bp, C. familiaris
tccagggccctgtgct

SEQ ID NO: 326781 - DNA, 16 bp, C. familiaris
tccagggcggggccgc

SEQ ID NO: 326782 - DNA, 16 bp, C. familiaris
tccaggggctccagga

SEQ ID NO: 326783 - DNA, 16 bp, C. familiaris
tccagggtgcctgggt

SEQ ID NO: 326784 - DNA, 16 bp, C. familiaris
tccaggtaattctgat

SEQ ID NO: 326785 - DNA, 16 bp, C. familiaris
tccaggtcaggctccc

SEQ ID NO: 326786 - DNA, 16 bp, C. familiaris
tccaggtgggcccagt

SEQ ID NO: 326787 - DNA, 16 bp, C. familiaris
tccaggtgtccctgga

SEQ ID NO: 326788 - DNA, 16 bp, C. familiaris
tccagtcaaaagacat

SEQ ID NO: 326789 - DNA, 16 bp, C. familiaris
tccagtcccacatccg

SEQ ID NO: 326790 - DNA, 16 bp, C. familiaris
tccagtcccatgtctg

SEQ ID NO: 326791 - DNA, 16 bp, C. familiaris
tccagtcccccatcag

SEQ ID NO: 326792 - DNA, 16 bp, C. familiaris
tccagtgaagaaatgg

SEQ ID NO: 326793 - DNA, 16 bp, C. familiaris
tccagtgaagccatct

SEQ ID NO: 326794 - DNA, 16 bp, C. familiaris
tccagtgaatatcttt

SEQ ID NO: 326795 - DNA, 16 bp, C. familiaris
tccagtgatttttttt

SEQ ID NO: 326796 - DNA, 16 bp, C. familiaris
tccagtgctctttcca

SEQ ID NO: 326797 - DNA, 16 bp, C. familiaris
tccagttatagaataa

SEQ ID NO: 326798 - DNA, 16 bp, C. familiaris
tccagttccttttttt

SEQ ID NO: 326799 - DNA, 16 bp, C. familiaris
tccagtttcattattc

SEQ ID NO: 326800 - DNA, 16 bp, C. familiaris
tccagtttcattctgc

SEQ ID NO: 326801 - DNA, 16 bp, C. familiaris
tccagtttggggctat

SEQ ID NO: 326802 - DNA, 16 bp, C. familiaris
tccagttttccaacac

SEQ ID NO: 326803 - DNA, 16 bp, C. familiaris
tccataacttggctat

SEQ ID NO: 326804 - DNA, 16 bp, C. familiaris
tccataccattttcca

SEQ ID NO: 326805 - DNA, 16 bp, C. familiaris
tccatactgtttccag

SEQ ID NO: 326806 - DNA, 16 bp, C. familiaris
tccatactgtttccat

SEQ ID NO: 326807 - DNA, 16 bp, C. familiaris
tccatagaaacaaaca

SEQ ID NO: 326808 - DNA, 16 bp, C. familiaris
tccatatatccatcca

SEQ ID NO: 326809 - DNA, 16 bp, C. familiaris
tccatatattttaaaa

SEQ ID NO: 326810 - DNA, 16 bp, C. familiaris
tccatatcctcaccag

SEQ ID NO: 326811 - DNA, 16 bp, C. familiaris
tccatcagtggataaa

SEQ ID NO: 326812 - DNA, 16 bp, C. familiaris
tccatcatcacagaaa

SEQ ID NO: 326813 - DNA, 16 bp, C. familiaris
tccatcattccagaaa

SEQ ID NO: 326814 - DNA, 16 bp, C. familiaris
tccatccacttatcca

SEQ ID NO: 326815 - DNA, 16 bp, C. familiaris
tccatcccaggaacct

SEQ ID NO: 326816 - DNA, 16 bp, C. familiaris
tccatcccaggacacc

SEQ ID NO: 326817 - DNA, 16 bp, C. familiaris
tccatccctgttgtca

SEQ ID NO: 326818 - DNA, 16 bp, C. familiaris
tccatccgtgtcattg

SEQ ID NO: 326819 - DNA, 16 bp, C. familiaris
tccatctacccatcca

SEQ ID NO: 326820 - DNA, 16 bp, C. familiaris
tccatgagagacatag

SEQ ID NO: 326821 - DNA, 16 bp, C. familiaris
tccatgagcatggcat

SEQ ID NO: 326822 - DNA, 16 bp, C. familiaris
tccatgcaccggagcc

SEQ ID NO: 326823 - DNA, 16 bp, C. familiaris
tccatgcagagagctt

SEQ ID NO: 326824 - DNA, 16 bp, C. familiaris
tccatgcagtgagcct

SEQ ID NO: 326825 - DNA, 16 bp, C. familiaris
tccatgcatttttttt

SEQ ID NO: 326826 - DNA, 16 bp, C. familiaris
tccatgcccagtatgg

SEQ ID NO: 326827 - DNA, 16 bp, C. familiaris
tccatgcccagtgtga

SEQ ID NO: 326828 - DNA, 16 bp, C. familiaris
tccatgcctgatgtgg

SEQ ID NO: 326829 - DNA, 16 bp, C. familiaris
tccatgctcagcatgg

SEQ ID NO: 326830 - DNA, 16 bp, C. familiaris
tccatgctgagcaagg

SEQ ID NO: 326831 - DNA, 16 bp, C. familiaris
tccatgctgagcctgg

SEQ ID NO: 326832 - DNA, 17 bp, C. familiaris
tccatgctgggaacctg

SEQ ID NO: 326833 - DNA, 16 bp, C. familiaris
tccatggagggagccc

SEQ ID NO: 326834 - DNA, 16 bp, C. familiaris
tccatgtattattttt

SEQ ID NO: 326835 - DNA, 16 bp, C. familiaris
tccatgtattttcatg

SEQ ID NO: 326836 - DNA, 16 bp, C. familiaris
tccatgtggggctcca

SEQ ID NO: 326837 - DNA, 16 bp, C. familiaris
tccatgtggggctccc

SEQ ID NO: 326838 - DNA, 16 bp, C. familiaris
tccatgttgggtgcat

SEQ ID NO: 326839 - DNA, 16 bp, C. familiaris
tccatgttttcttcta

SEQ ID NO: 326840 - DNA, 16 bp, C. familiaris
tccattaattgatgaa

SEQ ID NO: 326841 - DNA, 16 bp, C. familiaris
tccattcatgttaaaa

SEQ ID NO: 326842 - DNA, 16 bp, C. familiaris
tccattcatgttgtca

SEQ ID NO: 326843 - DNA, 16 bp, C. familiaris
tccattctacccaaag

SEQ ID NO: 326844 - DNA, 16 bp, C. familiaris
tccattctcatggatt

SEQ ID NO: 326845 - DNA, 16 bp, C. familiaris
tccattcttctcccaa

SEQ ID NO: 326846 - DNA, 16 bp, C. familiaris
tccattgatgaatgga

SEQ ID NO: 326847 - DNA, 16 bp, C. familiaris
tccatttcctccctgg

SEQ ID NO: 326848 - DNA, 16 bp, C. familiaris
tccatttctctgatgg

SEQ ID NO: 326849 - DNA, 16 bp, C. familiaris
tccatttctggattct

SEQ ID NO: 326850 - DNA, 16 bp, C. familiaris
tccatttctttgtgtc

SEQ ID NO: 326851 - DNA, 16 bp, C. familiaris
tccattttcttatctg

SEQ ID NO: 326852 - DNA, 16 bp, C. familiaris
tccattttgaattaac

SEQ ID NO: 326853 - DNA, 16 bp, C. familiaris
tccattttgacttaat

SEQ ID NO: 326854 - DNA, 16 bp, C. familiaris
tccattttgttgatct

SEQ ID NO: 326855 - DNA, 16 bp, C. familiaris
tcccaaagagtttgaa

SEQ ID NO: 326856 - DNA, 16 bp, C. familiaris
tcccaaaggttctgaa

SEQ ID NO: 326857 - DNA, 16 bp, C. familiaris
tcccaaagtcctggga

SEQ ID NO: 326858 - DNA, 16 bp, C. familiaris
tcccaacaaaccaaag

SEQ ID NO: 326859 - DNA, 16 bp, C. familiaris
tcccaaccctgagatc

SEQ ID NO: 326860 - DNA, 16 bp, C. familiaris
tcccaagactctggga

SEQ ID NO: 326861 - DNA, 16 bp, C. familiaris
tcccaagcagactgca

SEQ ID NO: 326862 - DNA, 16 bp, C. familiaris
tcccaagtatataatc

SEQ ID NO: 326863 - DNA, 16 bp, C. familiaris
tcccaattcattttat

SEQ ID NO: 326864 - DNA, 16 bp, C. familiaris
tcccacagggaccctg

SEQ ID NO: 326865 - DNA, 16 bp, C. familiaris
tcccacaggtctctga

SEQ ID NO: 326866 - DNA, 16 bp, C. familiaris
tcccacatcgggctcc

SEQ ID NO: 326867 - DNA, 16 bp, C. familiaris
tcccaccaagtgctcc

SEQ ID NO: 326868 - DNA, 16 bp, C. familiaris
tcccaccagcagtgca

SEQ ID NO: 326869 - DNA, 16 bp, C. familiaris
tcccaccctcatgacc

SEQ ID NO: 326870 - DNA, 16 bp, C. familiaris
tcccaccctgagctga

SEQ ID NO: 326871 - DNA, 16 bp, C. familiaris
tcccacctctgggcct

SEQ ID NO: 326872 - DNA, 16 bp, C. familiaris
tcccacgtcgggctcc

SEQ ID NO: 326873 - DNA, 16 bp, C. familiaris
tcccactcagcaggga

SEQ ID NO: 326874 - DNA, 16 bp, C. familiaris
tcccactcgggctccc

SEQ ID NO: 326875 - DNA, 16 bp, C. familiaris
tcccacttattttctc

SEQ ID NO: 326876 - DNA, 16 bp, C. familiaris
tcccagaaaaagaaaa

SEQ ID NO: 326877 - DNA, 16 bp, C. familiaris
tcccagaaagagaaga

SEQ ID NO: 326878 - DNA, 16 bp, C. familiaris
tcccagaacccagaga

SEQ ID NO: 326879 - DNA, 16 bp, C. familiaris
tcccagaaccccagga

SEQ ID NO: 326880 - DNA, 16 bp, C. familiaris
tcccagaaccctggaa

SEQ ID NO: 326881 - DNA, 16 bp, C. familiaris
tcccagaagaaaaaaa

SEQ ID NO: 326882 - DNA, 16 bp, C. familiaris
tcccagaagaaaaaga

SEQ ID NO: 326883 - DNA, 16 bp, C. familiaris
tcccagaaggaaaaga

SEQ ID NO: 326884 - DNA, 16 bp, C. familiaris
tcccagaaggaaagca

SEQ ID NO: 326885 - DNA, 16 bp, C. familiaris
tcccagaaggagaagg

SEQ ID NO: 326886 - DNA, 16 bp, C. familiaris
tcccagagaagcagga

SEQ ID NO: 326887 - DNA, 16 bp, C. familiaris
tcccagagctgagcct

SEQ ID NO: 326888 - DNA, 16 bp, C. familiaris
tcccagagtccttgga

SEQ ID NO: 326889 - DNA, 16 bp, C. familiaris
tcccagagttacaaaa

SEQ ID NO: 326890 - DNA, 16 bp, C. familiaris
tcccagagttagggag

SEQ ID NO: 326891 - DNA, 16 bp, C. familiaris
tcccagagttctgaga

SEQ ID NO: 326892 - DNA, 16 bp, C. familiaris
tcccagatgattctaa

SEQ ID NO: 326893 - DNA, 16 bp, C. familiaris
tcccagatttcaaact

SEQ ID NO: 326894 - DNA, 16 bp, C. familiaris
tcccagcaccatgtgt

SEQ ID NO: 326895 - DNA, 16 bp, C. familiaris
tcccagcaccccggga

SEQ ID NO: 326896 - DNA, 16 bp, C. familiaris
tcccagcagcagcagc

SEQ ID NO: 326897 - DNA, 16 bp, C. familiaris
tcccagcagccctggg

SEQ ID NO: 326898 - DNA, 16 bp, C. familiaris
tcccagccaagcctgc

SEQ ID NO: 326899 - DNA, 16 bp, C. familiaris
tcccagccccaggcaa

SEQ ID NO: 326900 - DNA, 16 bp, C. familiaris
tcccagccctcagccc

SEQ ID NO: 326901 - DNA, 16 bp, C. familiaris
tcccagccctgccacc

SEQ ID NO: 326902 - DNA, 16 bp, C. familiaris
tcccagccctgcctct

SEQ ID NO: 326903 - DNA, 16 bp, C. familiaris
tcccagcctccagagc

SEQ ID NO: 326904 - DNA, 16 bp, C. familiaris
tcccagcgccatttat

SEQ ID NO: 326905 - DNA, 16 bp, C. familiaris
tcccagctcccagccc

SEQ ID NO: 326906 - DNA, 16 bp, C. familiaris
tcccagctcccagctc

SEQ ID NO: 326907 - DNA, 16 bp, C. familiaris
tcccagctctgctgct

SEQ ID NO: 326908 - DNA, 16 bp, C. familiaris
tcccaggaaccccagg

SEQ ID NO: 326909 - DNA, 16 bp, C. familiaris
tcccaggaacctagga

SEQ ID NO: 326910 - DNA, 16 bp, C. familiaris
tcccaggacccaaaga

SEQ ID NO: 326911 - DNA, 16 bp, C. familiaris
tcccaggacccagggg

SEQ ID NO: 326912 - DNA, 16 bp, C. familiaris
tcccaggacccccagg

SEQ ID NO: 326913 - DNA, 16 bp, C. familiaris
tcccaggaccccgagg

SEQ ID NO: 326914 - DNA, 16 bp, C. familiaris
tcccaggacccggaga

SEQ ID NO: 326915 - DNA, 16 bp, C. familiaris
tcccaggaccctcagg

SEQ ID NO: 326916 - DNA, 16 bp, C. familiaris
tcccaggacctaggga

SEQ ID NO: 326917 - DNA, 16 bp, C. familiaris
tcccaggacctggaga

SEQ ID NO: 326918 - DNA, 16 bp, C. familiaris
tcccaggactccagaa

SEQ ID NO: 326919 - DNA, 16 bp, C. familiaris
tcccaggactcctgga

SEQ ID NO: 326920 - DNA, 16 bp, C. familiaris
tcccaggactctgaca

SEQ ID NO: 326921 - DNA, 16 bp, C. familiaris
tcccaggactctgtga

SEQ ID NO: 326922 - DNA, 16 bp, C. familiaris
tcccaggactttggga

SEQ ID NO: 326923 - DNA, 16 bp, C. familiaris
tcccaggaggggcagg

SEQ ID NO: 326924 - DNA, 16 bp, C. familiaris
tcccaggagtggaatt

SEQ ID NO: 326925 - DNA, 16 bp, C. familiaris
tcccaggatcaaggcc

SEQ ID NO: 326926 - DNA, 16 bp, C. familiaris
tcccaggatccagccc

SEQ ID NO: 326927 - DNA, 16 bp, C. familiaris
tcccaggatcctcaga

SEQ ID NO: 326928 - DNA, 16 bp, C. familiaris
tcccaggatcctgagg

SEQ ID NO: 326929 - DNA, 16 bp, C. familiaris
tcccaggatccttgga

SEQ ID NO: 326930 - DNA, 16 bp, C. familiaris
tcccaggatggagccc

SEQ ID NO: 326931 - DNA, 16 bp, C. familiaris
tcccaggatggggtcc

SEQ ID NO: 326932 - DNA, 16 bp, C. familiaris
tcccaggccctgcccc

SEQ ID NO: 326933 - DNA, 16 bp, C. familiaris
tcccagggcaccaggg

SEQ ID NO: 326934 - DNA, 16 bp, C. familiaris
tcccagggcatgatcc

SEQ ID NO: 326935 - DNA, 16 bp, C. familiaris
tcccagggccccgggg

SEQ ID NO: 326936 - DNA, 16 bp, C. familiaris
tcccaggggcctggaa

SEQ ID NO: 326937 - DNA, 16 bp, C. familiaris
tcccagggtcctgata

SEQ ID NO: 326938 - DNA, 16 bp, C. familiaris
tcccagggtgctggga

SEQ ID NO: 326939 - DNA, 16 bp, C. familiaris
tcccagggtggtggga

SEQ ID NO: 326940 - DNA, 16 bp, C. familiaris
tcccaggtcaccagga

SEQ ID NO: 326941 - DNA, 16 bp, C. familiaris
tcccaggtcccaggat

SEQ ID NO: 326942 - DNA, 16 bp, C. familiaris
tcccagtaccccaaga

SEQ ID NO: 326943 - DNA, 16 bp, C. familiaris
tcccagtaccccggga

SEQ ID NO: 326944 - DNA, 16 bp, C. familiaris
tcccagtatcccagga

SEQ ID NO: 326945 - DNA, 16 bp, C. familiaris
tcccagtctccaggat

SEQ ID NO: 326946 - DNA, 16 bp, C. familiaris
tcccatcaagtgccca

SEQ ID NO: 326947 - DNA, 16 bp, C. familiaris
tcccatcaccagcaga

SEQ ID NO: 326948 - DNA, 16 bp, C. familiaris
tcccatgacctggaga

SEQ ID NO: 326949 - DNA, 16 bp, C. familiaris
tcccatggtcctggga

SEQ ID NO: 326950 - DNA, 16 bp, C. familiaris
tcccattctgcctccc

SEQ ID NO: 326951 - DNA, 16 bp, C. familiaris
tcccatttttttaaaa

SEQ ID NO: 326952 - DNA, 16 bp, C. familiaris
tccccaaggagcaggg

SEQ ID NO: 326953 - DNA, 16 bp, C. familiaris
tccccaaggccacaca

SEQ ID NO: 326954 - DNA, 16 bp, C. familiaris
tccccaaggggagcct

SEQ ID NO: 326955 - DNA, 16 bp, C. familiaris
tccccacaaagagccc

SEQ ID NO: 326956 - DNA, 16 bp, C. familiaris
tccccacaaggagcct

SEQ ID NO: 326957 - DNA, 16 bp, C. familiaris
tccccacagggaaccc

SEQ ID NO: 326958 - DNA, 16 bp, C. familiaris
tccccacagggagctc

SEQ ID NO: 326959 - DNA, 16 bp, C. familiaris
tccccaccaagcagga

SEQ ID NO: 326960 - DNA, 16 bp, C. familiaris
tccccactgagcacag

SEQ ID NO: 326961 - DNA, 16 bp, C. familiaris
tccccactggcaacca

SEQ ID NO: 326962 - DNA, 16 bp, C. familiaris
tccccagaaagcagag

SEQ ID NO: 326963 - DNA, 16 bp, C. familiaris
tccccagagccctggg

SEQ ID NO: 326964 - DNA, 16 bp, C. familiaris
tccccagatcctggga

SEQ ID NO: 326965 - DNA, 16 bp, C. familiaris
tccccagcacccagca

SEQ ID NO: 326966 - DNA, 16 bp, C. familiaris
tccccagcccttggca

SEQ ID NO: 326967 - DNA, 16 bp, C. familiaris
tccccagctcctggca

SEQ ID NO: 326968 - DNA, 16 bp, C. familiaris
tccccaggacacaagg

SEQ ID NO: 326969 - DNA, 57 bp, C. familiaris
tccccaggacaggagagccccgtcccggaggagcaggagctgcaccgaccttcccgg

SEQ ID NO: 326970 - DNA, 16 bp, C. familiaris
tccccaggccctgccc

SEQ ID NO: 326971 - DNA, 16 bp, C. familiaris
tccccaggctgaaggc

SEQ ID NO: 326972 - DNA, 16 bp, C. familiaris
tccccagggagcaggg

SEQ ID NO: 326973 - DNA, 16 bp, C. familiaris
tccccagggcctggca

SEQ ID NO: 326974 - DNA, 16 bp, C. familiaris
tccccagggtcctgga

SEQ ID NO: 326975 - DNA, 16 bp, C. familiaris
tccccaggtctccagg

SEQ ID NO: 326976 - DNA, 16 bp, C. familiaris
tccccagtgcccatca

SEQ ID NO: 326977 - DNA, 16 bp, C. familiaris
tccccatcacctactt

SEQ ID NO: 326978 - DNA, 16 bp, C. familiaris
tccccattgagcagag

SEQ ID NO: 326979 - DNA, 16 bp, C. familiaris
tccccatttcccccag

SEQ ID NO: 326980 - DNA, 16 bp, C. familiaris
tcccccactgagcagg

SEQ ID NO: 326981 - DNA, 16 bp, C. familiaris
tcccccagagcctcca

SEQ ID NO: 326982 - DNA, 16 bp, C. familiaris
tcccccagccccaggc

SEQ ID NO: 326983 - DNA, 16 bp, C. familiaris
tcccccagtccctggc

SEQ ID NO: 326984 - DNA, 16 bp, C. familiaris
tcccccatccggctcc

SEQ ID NO: 326985 - DNA, 16 bp, C. familiaris
tccccccagggagcct

SEQ ID NO: 326986 - DNA, 16 bp, C. familiaris
tccccctcaggactgt

SEQ ID NO: 326987 - DNA, 16 bp, C. familiaris
tccccctctgcctttg

SEQ ID NO: 326988 - DNA, 16 bp, C. familiaris
tccccctgtccttcca

SEQ ID NO: 326989 - DNA, 16 bp, C. familiaris
tccccctgtctgtgtc

SEQ ID NO: 326990 - DNA, 16 bp, C. familiaris
tcccccttaaaatttt

SEQ ID NO: 326991 - DNA, 16 bp, C. familiaris
tccccgccctcctggt

SEQ ID NO: 326992 - DNA, 16 bp, C. familiaris
tccccgcctggagcct

SEQ ID NO: 326993 - DNA, 16 bp, C. familiaris
tccccgctgaccaggg

SEQ ID NO: 326994 - DNA, 16 bp, C. familiaris
tccccggagggagcct

SEQ ID NO: 326995 - DNA, 16 bp, C. familiaris
tccccgggagcccagg

SEQ ID NO: 326996 - DNA, 16 bp, C. familiaris
tccccgggtcccagga

SEQ ID NO: 326997 - DNA, 16 bp, C. familiaris
tccccgggtcctggga

SEQ ID NO: 326998 - DNA, 16 bp, C. familiaris
tcccctcagctcctgg

SEQ ID NO: 326999 - DNA, 16 bp, C. familiaris
tcccctcaggaagcct

SEQ ID NO: 327000 - DNA, 16 bp, C. familiaris
tcccctccacctgctg

SEQ ID NO: 327001 - DNA, 16 bp, C. familiaris
tcccctccagcagccc

SEQ ID NO: 327002 - DNA, 16 bp, C. familiaris
tcccctcccagccctg

SEQ ID NO: 327003 - DNA, 16 bp, C. familiaris
tcccctctgctgtgtc

SEQ ID NO: 327004 - DNA, 16 bp, C. familiaris
tcccctgcatattctc

SEQ ID NO: 327005 - DNA, 16 bp, C. familiaris
tcccctgcatattctt

SEQ ID NO: 327006 - DNA, 16 bp, C. familiaris
tcccctggagcttcca

SEQ ID NO: 327007 - DNA, 16 bp, C. familiaris
tcccctgtctccacat

SEQ ID NO: 327008 - DNA, 16 bp, C. familiaris
tcccctgtctttccag

SEQ ID NO: 327009 - DNA, 16 bp, C. familiaris
tccccttccagcaccc

SEQ ID NO: 327010 - DNA, 16 bp, C. familiaris
tccccttccctgccca

SEQ ID NO: 327011 - DNA, 16 bp, C. familiaris
tccccttcttgtgctc

SEQ ID NO: 327012 - DNA, 16 bp, C. familiaris
tcccgagtggctgcac

SEQ ID NO: 327013 - DNA, 16 bp, C. familiaris
tcccgcatctggctcc

SEQ ID NO: 327014 - DNA, 16 bp, C. familiaris
tcccggaccccaggat

SEQ ID NO: 327015 - DNA, 17 bp, C. familiaris
tcccggagaccctggat

SEQ ID NO: 327016 - DNA, 16 bp, C. familiaris
tcccggagctccagga

SEQ ID NO: 327017 - DNA, 16 bp, C. familiaris
tcccggagtcctggaa

SEQ ID NO: 327018 - DNA, 16 bp, C. familiaris
tcccggatcctgagat

SEQ ID NO: 327019 - DNA, 16 bp, C. familiaris
tcccggatcctggaat

SEQ ID NO: 327020 - DNA, 16 bp, C. familiaris
tcccgggaccccggga

SEQ ID NO: 327021 - DNA, 16 bp, C. familiaris
tcccgggaccccgggt

SEQ ID NO: 327022 - DNA, 16 bp, C. familiaris
tcccgggaccctgggg

SEQ ID NO: 327023 - DNA, 16 bp, C. familiaris
tcccgggcctccagga

SEQ ID NO: 327024 - DNA, 16 bp, C. familiaris
tcccgggcctgtgctg

SEQ ID NO: 327025 - DNA, 16 bp, C. familiaris
tcccgggctcctggga

SEQ ID NO: 327026 - DNA, 16 bp, C. familiaris
tcccggggccccagga

SEQ ID NO: 327027 - DNA, 16 bp, C. familiaris
tcccgggggcctggga

SEQ ID NO: 327028 - DNA, 16 bp, C. familiaris
tcccgggtctccaggg

SEQ ID NO: 327029 - DNA, 16 bp, C. familiaris
tcccgtaaagttcagc

SEQ ID NO: 327030 - DNA, 17 bp, C. familiaris
tccctacactctgaaga

SEQ ID NO: 327031 - DNA, 16 bp, C. familiaris
tccctatgctgtgctt

SEQ ID NO: 327032 - DNA, 16 bp, C. familiaris
tccctcagcccctcct

SEQ ID NO: 327033 - DNA, 16 bp, C. familiaris
tccctcagcctctgcc

SEQ ID NO: 327034 - DNA, 16 bp, C. familiaris
tccctcaggactgctt

SEQ ID NO: 327035 - DNA, 16 bp, C. familiaris
tccctccaggaagcct

SEQ ID NO: 327036 - DNA, 16 bp, C. familiaris
tccctccagtctctgc

SEQ ID NO: 327037 - DNA, 16 bp, C. familiaris
tccctcccaccccagg

SEQ ID NO: 327038 - DNA, 16 bp, C. familiaris
tccctcccctctggca

SEQ ID NO: 327039 - DNA, 18 bp, C. familiaris
tccctcctcctatgtctc

SEQ ID NO: 327040 - DNA, 16 bp, C. familiaris
tccctcctcctcccag

SEQ ID NO: 327041 - DNA, 16 bp, C. familiaris
tccctcctgggagccc

SEQ ID NO: 327042 - DNA, 16 bp, C. familiaris
tccctcctgtgtctct

SEQ ID NO: 327043 - DNA, 16 bp, C. familiaris
tccctcggcctatgtc

SEQ ID NO: 327044 - DNA, 16 bp, C. familiaris
tccctctccacctgcc

SEQ ID NO: 327045 - DNA, 16 bp, C. familiaris
tccctctcctgctgca

SEQ ID NO: 327046 - DNA, 16 bp, C. familiaris
tccctctccttctgtg

SEQ ID NO: 327047 - DNA, 16 bp, C. familiaris
tccctctctccatctg

SEQ ID NO: 327048 - DNA, 16 bp, C. familiaris
tccctctctctccatg

SEQ ID NO: 327049 - DNA, 16 bp, C. familiaris
tccctctctgtgtgtg

SEQ ID NO: 327050 - DNA, 16 bp, C. familiaris
tccctctgccactccc

SEQ ID NO: 327051 - DNA, 16 bp, C. familiaris
tccctctgccaggaat

SEQ ID NO: 327052 - DNA, 16 bp, C. familiaris
tccctctgccctcacc

SEQ ID NO: 327053 - DNA, 16 bp, C. familiaris
tccctctgcctctgtg

SEQ ID NO: 327054 - DNA, 16 bp, C. familiaris
tccctctgcctgcacc

SEQ ID NO: 327055 - DNA, 16 bp, C. familiaris
tccctctgcctgcatc

SEQ ID NO: 327056 - DNA, 16 bp, C. familiaris
tccctctgcctgcctt

SEQ ID NO: 327057 - DNA, 16 bp, C. familiaris
tccctctgctgtttcc

SEQ ID NO: 327058 - DNA, 16 bp, C. familiaris
tccctctgcttctcca

SEQ ID NO: 327059 - DNA, 16 bp, C. familiaris
tccctctgcttgttct

SEQ ID NO: 327060 - DNA, 16 bp, C. familiaris
tccctctgtgtctgtc

SEQ ID NO: 327061 - DNA, 16 bp, C. familiaris
tccctctgtttgtgct

SEQ ID NO: 327062 - DNA, 16 bp, C. familiaris
tccctcttcctcagcc

SEQ ID NO: 327063 - DNA, 16 bp, C. familiaris
tccctcttctcagatg

SEQ ID NO: 327064 - DNA, 16 bp, C. familiaris
tccctctttgttttta

SEQ ID NO: 327065 - DNA, 16 bp, C. familiaris
tccctgagctgaaggc

SEQ ID NO: 327066 - DNA, 16 bp, C. familiaris
tccctgaggaacacag

SEQ ID NO: 327067 - DNA, 16 bp, C. familiaris
tccctgaggagagccc

SEQ ID NO: 327068 - DNA, 16 bp, C. familiaris
tccctgaggtcacaca

SEQ ID NO: 327069 - DNA, 16 bp, C. familiaris
tccctgatgaaaatgg

SEQ ID NO: 327070 - DNA, 16 bp, C. familiaris
tccctgcagagcctga

SEQ ID NO: 327071 - DNA, 16 bp, C. familiaris
tccctgcagccccagc

SEQ ID NO: 327072 - DNA, 16 bp, C. familiaris
tccctgcagcccctgg

SEQ ID NO: 327073 - DNA, 16 bp, C. familiaris
tccctgcaggaccctg

SEQ ID NO: 327074 - DNA, 16 bp, C. familiaris
tccctgcaggagcctg

SEQ ID NO: 327075 - DNA, 16 bp, C. familiaris
tccctgcagggacctt

SEQ ID NO: 327076 - DNA, 16 bp, C. familiaris
tccctgcagggaggcc

SEQ ID NO: 327077 - DNA, 16 bp, C. familiaris
tccctgccagaagcct

SEQ ID NO: 327078 - DNA, 16 bp, C. familiaris
tccctgccccttccca

SEQ ID NO: 327079 - DNA, 16 bp, C. familiaris
tccctgccctcaagga

SEQ ID NO: 327080 - DNA, 16 bp, C. familiaris
tccctgccctgcaggg

SEQ ID NO: 327081 - DNA, 16 bp, C. familiaris
tccctgcctctgcctg

SEQ ID NO: 327082 - DNA, 16 bp, C. familiaris
tccctgccttgagcct

SEQ ID NO: 327083 - DNA, 16 bp, C. familiaris
tccctgctcagcagga

SEQ ID NO: 327084 - DNA, 16 bp, C. familiaris
tccctgctcagcctgg

SEQ ID NO: 327085 - DNA, 16 bp, C. familiaris
tccctgctcatcaagg

SEQ ID NO: 327086 - DNA, 16 bp, C. familiaris
tccctgctcatcgggg

SEQ ID NO: 327087 - DNA, 16 bp, C. familiaris
tccctgctcatgctgt

SEQ ID NO: 327088 - DNA, 16 bp, C. familiaris
tccctgctccaagggg

SEQ ID NO: 327089 - DNA, 16 bp, C. familiaris
tccctgctccacgggg

SEQ ID NO: 327090 - DNA, 16 bp, C. familiaris
tccctgctctccagga

SEQ ID NO: 327091 - DNA, 16 bp, C. familiaris
tccctgctgggagccc

SEQ ID NO: 327092 - DNA, 16 bp, C. familiaris
tccctgcttccattct

SEQ ID NO: 327093 - DNA, 16 bp, C. familiaris
tccctgcttctgcctg

SEQ ID NO: 327094 - DNA, 16 bp, C. familiaris
tccctgcttggggcct

SEQ ID NO: 327095 - DNA, 16 bp, C. familiaris
tccctggaatctgtga

SEQ ID NO: 327096 - DNA, 16 bp, C. familiaris
tccctggagagagaga

SEQ ID NO: 327097 - DNA, 16 bp, C. familiaris
tccctggagattctga

SEQ ID NO: 327098 - DNA, 16 bp, C. familiaris
tccctggaggaggtga

SEQ ID NO: 327099 - DNA, 16 bp, C. familiaris
tccctggatcatgacc

SEQ ID NO: 327100 - DNA, 16 bp, C. familiaris
tccctggcagccctgc

SEQ ID NO: 327101 - DNA, 16 bp, C. familiaris
tccctgggaactacac

SEQ ID NO: 327102 - DNA, 16 bp, C. familiaris
tccctgggccctggga

SEQ ID NO: 327103 - DNA, 16 bp, C. familiaris
tccctgggtcctgaga

SEQ ID NO: 327104 - DNA, 16 bp, C. familiaris
tccctgggtcttggga

SEQ ID NO: 327105 - DNA, 16 bp, C. familiaris
tccctgggtggttcag

SEQ ID NO: 327106 - DNA, 16 bp, C. familiaris
tccctgtgcctgctgc

SEQ ID NO: 327107 - DNA, 16 bp, C. familiaris
tccctgtggagaacct

SEQ ID NO: 327108 - DNA, 16 bp, C. familiaris
tccctgtggggagctt

SEQ ID NO: 327109 - DNA, 16 bp, C. familiaris
tccctgtgtccccagc

SEQ ID NO: 327110 - DNA, 16 bp, C. familiaris
tccctgtttggagcct

SEQ ID NO: 327111 - DNA, 16 bp, C. familiaris
tcccttataacccctt

SEQ ID NO: 327112 - DNA, 16 bp, C. familiaris
tcccttcagagagcct

SEQ ID NO: 327113 - DNA, 16 bp, C. familiaris
tcccttctgctcaggt

SEQ ID NO: 327114 - DNA, 16 bp, C. familiaris
tcccttctggaggctc

SEQ ID NO: 327115 - DNA, 17 bp, C. familiaris
tcccttcttctcttggg

SEQ ID NO: 327116 - DNA, 16 bp, C. familiaris
tccgcctttggctcag

SEQ ID NO: 327117 - DNA, 16 bp, C. familiaris
tccggctcccggtgca

SEQ ID NO: 327118 - DNA, 16 bp, C. familiaris
tccgggagacccggga

SEQ ID NO: 327119 - DNA, 16 bp, C. familiaris
tccgggagtcccggga

SEQ ID NO: 327120 - DNA, 16 bp, C. familiaris
tccgggatcaggacct

SEQ ID NO: 327121 - DNA, 16 bp, C. familiaris
tccggggcctgcactg

SEQ ID NO: 327122 - DNA, 16 bp, C. familiaris
tccggggtctccaggg

SEQ ID NO: 327123 - DNA, 16 bp, C. familiaris
tccgtctgtccatcca

SEQ ID NO: 327124 - DNA, 16 bp, C. familiaris
tcctaaatgagaaaaa

SEQ ID NO: 327125 - DNA, 16 bp, C. familiaris
tcctaatgtgggagct

SEQ ID NO: 327126 - DNA, 16 bp, C. familiaris
tcctagaggaatgtca

SEQ ID NO: 327127 - DNA, 16 bp, C. familiaris
tcctatatgagttcta

SEQ ID NO: 327128 - DNA, 16 bp, C. familiaris
tcctatatttattgca

SEQ ID NO: 327129 - DNA, 16 bp, C. familiaris
tcctatgcctgtgtct

SEQ ID NO: 327130 - DNA, 16 bp, C. familiaris
tcctatgttgggtgca

SEQ ID NO: 327131 - DNA, 16 bp, C. familiaris
tcctattgctgctgta

SEQ ID NO: 327132 - DNA, 16 bp, C. familiaris
tcctcaaaaaagttaa

SEQ ID NO: 327133 - DNA, 16 bp, C. familiaris
tcctcaaaagaaaaca

SEQ ID NO: 327134 - DNA, 16 bp, C. familiaris
tcctcaaactcttcca

SEQ ID NO: 327135 - DNA, 16 bp, C. familiaris
tcctcaaatttgtatg

SEQ ID NO: 327136 - DNA, 16 bp, C. familiaris
tcctcaaggagactcc

SEQ ID NO: 327137 - DNA, 16 bp, C. familiaris
tcctcaaggggagccc

SEQ ID NO: 327138 - DNA, 16 bp, C. familiaris
tcctcaagttctttca

SEQ ID NO: 327139 - DNA, 16 bp, C. familiaris
tcctcaatagggaaaa

SEQ ID NO: 327140 - DNA, 16 bp, C. familiaris
tcctcaatgagaagaa

SEQ ID NO: 327141 - DNA, 16 bp, C. familiaris
tcctcaccaacacctg

SEQ ID NO: 327142 - DNA, 16 bp, C. familiaris
tcctcaccaacatctc

SEQ ID NO: 327143 - DNA, 16 bp, C. familiaris
tcctcaccaacatgtg

SEQ ID NO: 327144 - DNA, 16 bp, C. familiaris
tcctcacggagcaggg

SEQ ID NO: 327145 - DNA, 16 bp, C. familiaris
tcctcactgagcgtgg

SEQ ID NO: 327146 - DNA, 16 bp, C. familiaris
tcctcagagaagccct

SEQ ID NO: 327147 - DNA, 16 bp, C. familiaris
tcctcagatcatgacc

SEQ ID NO: 327148 - DNA, 16 bp, C. familiaris
tcctcagtgcttgtca

SEQ ID NO: 327149 - DNA, 16 bp, C. familiaris
tcctcagtttccttcc

SEQ ID NO: 327150 - DNA, 16 bp, C. familiaris
tcctcatataagtgaa

SEQ ID NO: 327151 - DNA, 16 bp, C. familiaris
tcctcatctgcagaat

SEQ ID NO: 327152 - DNA, 16 bp, C. familiaris
tcctcatgtggcagaa

SEQ ID NO: 327153 - DNA, 16 bp, C. familiaris
tcctcatttaaaaaat

SEQ ID NO: 327154 - DNA, 16 bp, C. familiaris
tcctccagccccagtc

SEQ ID NO: 327155 - DNA, 16 bp, C. familiaris
tcctcccactcatgtt

SEQ ID NO: 327156 - DNA, 16 bp, C. familiaris
tcctcccagcctctgc

SEQ ID NO: 327157 - DNA, 16 bp, C. familiaris
tcctccccacctgctc

SEQ ID NO: 327158 - DNA, 16 bp, C. familiaris
tcctccccagcccctg

SEQ ID NO: 327159 - DNA, 16 bp, C. familiaris
tcctccctcccacctg

SEQ ID NO: 327160 - DNA, 16 bp, C. familiaris
tcctccctctgctcat

SEQ ID NO: 327161 - DNA, 16 bp, C. familiaris
tcctccgagctgctcc

SEQ ID NO: 327162 - DNA, 16 bp, C. familiaris
tcctcctactccacca

SEQ ID NO: 327163 - DNA, 16 bp, C. familiaris
tcctcctccagctcct

SEQ ID NO: 327164 - DNA, 16 bp, C. familiaris
tcctcctccctccagg

SEQ ID NO: 327165 - DNA, 16 bp, C. familiaris
tcctcctcctcagcct

SEQ ID NO: 327166 - DNA, 16 bp, C. familiaris
tcctcctcctcctcag

SEQ ID NO: 327167 - DNA, 16 bp, C. familiaris
tcctcctcctcctggg

SEQ ID NO: 327168 - DNA, 16 bp, C. familiaris
tcctcctcctctccag

SEQ ID NO: 327169 - DNA, 16 bp, C. familiaris
tcctcctgcctcaggg

SEQ ID NO: 327170 - DNA, 16 bp, C. familiaris
tcctcctgctcacaca

SEQ ID NO: 327171 - DNA, 16 bp, C. familiaris
tcctcctgctgctcct

SEQ ID NO: 327172 - DNA, 16 bp, C. familiaris
tcctcctgctgctgct

SEQ ID NO: 327173 - DNA, 16 bp, C. familiaris
tcctcctgggagccaa

SEQ ID NO: 327174 - DNA, 16 bp, C. familiaris
tcctcctggtgtcacc

SEQ ID NO: 327175 - DNA, 16 bp, C. familiaris
tcctcggactccagga

SEQ ID NO: 327176 - DNA, 16 bp, C. familiaris
tcctctccttcctcag

SEQ ID NO: 327177 - DNA, 16 bp, C. familiaris
tcctctgcatgtggct

SEQ ID NO: 327178 - DNA, 16 bp, C. familiaris
tcctctgccactcccc

SEQ ID NO: 327179 - DNA, 16 bp, C. familiaris
tcctctgcttgtgtct

SEQ ID NO: 327180 - DNA, 16 bp, C. familiaris
tcctctgtaagatggg

SEQ ID NO: 327181 - DNA, 16 bp, C. familiaris
tcctctgtctccccat

SEQ ID NO: 327182 - DNA, 16 bp, C. familiaris
tcctctgtgctctgct

SEQ ID NO: 327183 - DNA, 16 bp, C. familiaris
tcctctgttagtgacc

SEQ ID NO: 327184 - DNA, 16 bp, C. familiaris
tcctcttatagtgact

SEQ ID NO: 327185 - DNA, 16 bp, C. familiaris
tcctcttcacctattt

SEQ ID NO: 327186 - DNA, 16 bp, C. familiaris
tcctcttccaggaagc

SEQ ID NO: 327187 - DNA, 16 bp, C. familiaris
tcctcttctacaaaat

SEQ ID NO: 327188 - DNA, 16 bp, C. familiaris
tcctcttctagttttt

SEQ ID NO: 327189 - DNA, 16 bp, C. familiaris
tcctcttctgtaaatt

SEQ ID NO: 327190 - DNA, 16 bp, C. familiaris
tcctcttggctgtgat

SEQ ID NO: 327191 - DNA, 16 bp, C. familiaris
tcctcttttgtgaagt

SEQ ID NO: 327192 - DNA, 16 bp, C. familiaris
tcctctttttaaaaaa

SEQ ID NO: 327193 - DNA, 16 bp, C. familiaris
tcctgaaaaagttaaa

SEQ ID NO: 327194 - DNA, 16 bp, C. familiaris
tcctgaaaccaacatt

SEQ ID NO: 327195 - DNA, 16 bp, C. familiaris
tcctgaagtcccagga

SEQ ID NO: 327196 - DNA, 16 bp, C. familiaris
tcctgaagttccagga

SEQ ID NO: 327197 - DNA, 16 bp, C. familiaris
tcctgacacacagaaa

SEQ ID NO: 327198 - DNA, 16 bp, C. familiaris
tcctgagatcatcacc

SEQ ID NO: 327199 - DNA, 16 bp, C. familiaris
tcctgagggctccacc

SEQ ID NO: 327200 - DNA, 16 bp, C. familiaris
tcctgaggtccaggat

SEQ ID NO: 327201 - DNA, 16 bp, C. familiaris
tcctgaggttcctgca

SEQ ID NO: 327202 - DNA, 16 bp, C. familiaris
tcctgatgaccacagc

SEQ ID NO: 327203 - DNA, 16 bp, C. familiaris
tcctgcagacccagga

SEQ ID NO: 327204 - DNA, 16 bp, C. familiaris
tcctgcagtaaagaaa

SEQ ID NO: 327205 - DNA, 16 bp, C. familiaris
tcctgcatggagctcc

SEQ ID NO: 327206 - DNA, 16 bp, C. familiaris
tcctgcatggatcctg

SEQ ID NO: 327207 - DNA, 16 bp, C. familiaris
tcctgcatgtggatgt

SEQ ID NO: 327208 - DNA, 16 bp, C. familiaris
tcctgcattgggttcc

SEQ ID NO: 327209 - DNA, 16 bp, C. familiaris
tcctgccacactgcag

SEQ ID NO: 327210 - DNA, 16 bp, C. familiaris
tcctgccacactgctg

SEQ ID NO: 327211 - DNA, 16 bp, C. familiaris
tcctgcccactgctcc

SEQ ID NO: 327212 - DNA, 16 bp, C. familiaris
tcctgccccagaggct

SEQ ID NO: 327213 - DNA, 16 bp, C. familiaris
tcctgccccagctccc

SEQ ID NO: 327214 - DNA, 16 bp, C. familiaris
tcctgcccctgggcct

SEQ ID NO: 327215 - DNA, 16 bp, C. familiaris
tcctgccctcagacat

SEQ ID NO: 327216 - DNA, 16 bp, C. familiaris
tcctgccctgagctga

SEQ ID NO: 327217 - DNA, 16 bp, C. familiaris
tcctgccctgccctgc

SEQ ID NO: 327218 - DNA, 16 bp, C. familiaris
tcctgcctcgggctcc

SEQ ID NO: 327219 - DNA, 16 bp, C. familiaris
tcctgctcagcatgga

SEQ ID NO: 327220 - DNA, 16 bp, C. familiaris
tcctgctcagctggga

SEQ ID NO: 327221 - DNA, 16 bp, C. familiaris
tcctgctcatgatctc

SEQ ID NO: 327222 - DNA, 16 bp, C. familiaris
tcctgctcctcctgct

SEQ ID NO: 327223 - DNA, 16 bp, C. familiaris
tcctgctcctctcctg

SEQ ID NO: 327224 - DNA, 16 bp, C. familiaris
tcctgctctccctgct

SEQ ID NO: 327225 - DNA, 16 bp, C. familiaris
tcctgctctgcaggga

SEQ ID NO: 327226 - DNA, 16 bp, C. familiaris
tcctgctctgtgccag

SEQ ID NO: 327227 - DNA, 16 bp, C. familiaris
tcctgctgagccagga

SEQ ID NO: 327228 - DNA, 16 bp, C. familiaris
tcctgctgctgctcct

SEQ ID NO: 327229 - DNA, 16 bp, C. familiaris
tcctgctggtcttctg

SEQ ID NO: 327230 - DNA, 16 bp, C. familiaris
tcctgcttggtgttct

SEQ ID NO: 327231 - DNA, 16 bp, C. familiaris
tcctggaacagaaaga

SEQ ID NO: 327232 - DNA, 16 bp, C. familiaris
tcctggaactttccag

SEQ ID NO: 327233 - DNA, 16 bp, C. familiaris
tcctggaagagaaaaa

SEQ ID NO: 327234 - DNA, 16 bp, C. familiaris
tcctggaatcaagtcc

SEQ ID NO: 327235 - DNA, 16 bp, C. familiaris
tcctggaattaagtcc

SEQ ID NO: 327236 - DNA, 16 bp, C. familiaris
tcctggacacctggga

SEQ ID NO: 327237 - DNA, 16 bp, C. familiaris
tcctggaccaccagcc

SEQ ID NO: 327238 - DNA, 16 bp, C. familiaris
tcctggactcccagga

SEQ ID NO: 327239 - DNA, 16 bp, C. familiaris
tcctggagacacagga

SEQ ID NO: 327240 - DNA, 16 bp, C. familiaris
tcctggagacccatga

SEQ ID NO: 327241 - DNA, 16 bp, C. familiaris
tcctggagaccctgaa

SEQ ID NO: 327242 - DNA, 16 bp, C. familiaris
tcctggagactgagga

SEQ ID NO: 327243 - DNA, 16 bp, C. familiaris
tcctggagagccagga

SEQ ID NO: 327244 - DNA, 16 bp, C. familiaris
tcctggagatctggaa

SEQ ID NO: 327245 - DNA, 16 bp, C. familiaris
tcctggagatgcagga

SEQ ID NO: 327246 - DNA, 16 bp, C. familiaris
tcctggagcaggtcct

SEQ ID NO: 327247 - DNA, 16 bp, C. familiaris
tcctggagcccctgga

SEQ ID NO: 327248 - DNA, 16 bp, C. familiaris
tcctggagccctggga

SEQ ID NO: 327249 - DNA, 16 bp, C. familiaris
tcctggagctccggga

SEQ ID NO: 327250 - DNA, 16 bp, C. familiaris
tcctggagctctggga

SEQ ID NO: 327251 - DNA, 16 bp, C. familiaris
tcctggaggaagtggc

SEQ ID NO: 327252 - DNA, 16 bp, C. familiaris
tcctggaggagaacac

SEQ ID NO: 327253 - DNA, 16 bp, C. familiaris
tcctggaggaggaggc

SEQ ID NO: 327254 - DNA, 16 bp, C. familiaris
tcctggaggaggggag

SEQ ID NO: 327255 - DNA, 16 bp, C. familiaris
tcctggaggagggggc

SEQ ID NO: 327256 - DNA, 16 bp, C. familiaris
tcctggaggccaggga

SEQ ID NO: 327257 - DNA, 16 bp, C. familiaris
tcctggaggcccagga

SEQ ID NO: 327258 - DNA, 16 bp, C. familiaris
tcctggaggcccgaga

SEQ ID NO: 327259 - DNA, 16 bp, C. familiaris
tcctggaggccctgga

SEQ ID NO: 327260 - DNA, 16 bp, C. familiaris
tcctggaggccctggg

SEQ ID NO: 327261 - DNA, 16 bp, C. familiaris
tcctggaggcctggga

SEQ ID NO: 327262 - DNA, 16 bp, C. familiaris
tcctggaggctgggga

SEQ ID NO: 327263 - DNA, 16 bp, C. familiaris
tcctggagtcccagat

SEQ ID NO: 327264 - DNA, 16 bp, C. familiaris
tcctggagtccctgga

SEQ ID NO: 327265 - DNA, 16 bp, C. familiaris
tcctggagtcctggga

SEQ ID NO: 327266 - DNA, 17 bp, C. familiaris
tcctggagtcctgtgat

SEQ ID NO: 327267 - DNA, 17 bp, C. familiaris
tcctggagttccaggat

SEQ ID NO: 327268 - DNA, 16 bp, C. familiaris
tcctggagttccaggg

SEQ ID NO: 327269 - DNA, 16 bp, C. familiaris
tcctggagttctggaa

SEQ ID NO: 327270 - DNA, 16 bp, C. familiaris
tcctggatacccagga

SEQ ID NO: 327271 - DNA, 16 bp, C. familiaris
tcctggatcatgacct

SEQ ID NO: 327272 - DNA, 16 bp, C. familiaris
tcctggatctccagga

SEQ ID NO: 327273 - DNA, 16 bp, C. familiaris
tcctggattccaggat

SEQ ID NO: 327274 - DNA, 16 bp, C. familiaris
tcctggatttccagga

SEQ ID NO: 327275 - DNA, 16 bp, C. familiaris
tcctggcagggagccc

SEQ ID NO: 327276 - DNA, 16 bp, C. familiaris
tcctggcatctagtgg

SEQ ID NO: 327277 - DNA, 16 bp, C. familiaris
tcctggccttttattt

SEQ ID NO: 327278 - DNA, 16 bp, C. familiaris
tcctggctctgtcatt

SEQ ID NO: 327279 - DNA, 16 bp, C. familiaris
tcctggctctgtccct

SEQ ID NO: 327280 - DNA, 16 bp, C. familiaris
tcctggctgccctaaa

SEQ ID NO: 327281 - DNA, 16 bp, C. familiaris
tcctggctgtcctgtg

SEQ ID NO: 327282 - DNA, 16 bp, C. familiaris
tcctggctgtgtcccc

SEQ ID NO: 327283 - DNA, 16 bp, C. familiaris
tcctgggaaaactgga

SEQ ID NO: 327284 - DNA, 18 bp, C. familiaris
tcctgggacacaaggctg

SEQ ID NO: 327285 - DNA, 16 bp, C. familiaris
tcctgggaccccagaa

SEQ ID NO: 327286 - DNA, 16 bp, C. familiaris
tcctgggaccccgggg

SEQ ID NO: 327287 - DNA, 16 bp, C. familiaris
tcctgggacggagccc

SEQ ID NO: 327288 - DNA, 16 bp, C. familiaris
tcctgggactccagat

SEQ ID NO: 327289 - DNA, 16 bp, C. familiaris
tcctgggactccaggg

SEQ ID NO: 327290 - DNA, 16 bp, C. familiaris
tcctgggactgagccc

SEQ ID NO: 327291 - DNA, 16 bp, C. familiaris
tcctgggactgcagga

SEQ ID NO: 327292 - DNA, 17 bp, C. familiaris
tcctgggacttcaggat

SEQ ID NO: 327293 - DNA, 16 bp, C. familiaris
tcctgggagacctggg

SEQ ID NO: 327294 - DNA, 16 bp, C. familiaris
tcctgggataaatctc

SEQ ID NO: 327295 - DNA, 16 bp, C. familiaris
tcctgggatcatgagc

SEQ ID NO: 327296 - DNA, 16 bp, C. familiaris
tcctgggatcctgtcc

SEQ ID NO: 327297 - DNA, 16 bp, C. familiaris
tcctgggatcgagtcc

SEQ ID NO: 327298 - DNA, 16 bp, C. familiaris
tcctgggatgaagccc

SEQ ID NO: 327299 - DNA, 16 bp, C. familiaris
tcctgggatgcagtcc

SEQ ID NO: 327300 - DNA, 16 bp, C. familiaris
tcctgggatggaactc

SEQ ID NO: 327301 - DNA, 16 bp, C. familiaris
tcctgggattccagga

SEQ ID NO: 327302 - DNA, 16 bp, C. familiaris
tcctgggattcttttt

SEQ ID NO: 327303 - DNA, 16 bp, C. familiaris
tcctgggattgagtcc

SEQ ID NO: 327304 - DNA, 16 bp, C. familiaris
tcctgggcagcccggg

SEQ ID NO: 327305 - DNA, 16 bp, C. familiaris
tcctgggcatggagcc

SEQ ID NO: 327306 - DNA, 16 bp, C. familiaris
tcctgggcccccagga

SEQ ID NO: 327307 - DNA, 16 bp, C. familiaris
tcctgggccgaaggcg

SEQ ID NO: 327308 - DNA, 16 bp, C. familiaris
tcctgggccttcctgg

SEQ ID NO: 327309 - DNA, 16 bp, C. familiaris
tcctggggaccccaga

SEQ ID NO: 327310 - DNA, 16 bp, C. familiaris
tcctggggaccccggg

SEQ ID NO: 327311 - DNA, 16 bp, C. familiaris
tcctggggacccgggg

SEQ ID NO: 327312 - DNA, 16 bp, C. familiaris
tcctggggcagctggg

SEQ ID NO: 327313 - DNA, 16 bp, C. familiaris
tcctggggccccgggg

SEQ ID NO: 327314 - DNA, 16 bp, C. familiaris
tcctggggctcctggg

SEQ ID NO: 327315 - DNA, 16 bp, C. familiaris
tcctggggctctggga

SEQ ID NO: 327316 - DNA, 16 bp, C. familiaris
tcctgggggtcccggg

SEQ ID NO: 327317 - DNA, 16 bp, C. familiaris
tcctgggggtcctggg

SEQ ID NO: 327318 - DNA, 16 bp, C. familiaris
tcctggggtactggga

SEQ ID NO: 327319 - DNA, 16 bp, C. familiaris
tcctggggtccctgga

SEQ ID NO: 327320 - DNA, 16 bp, C. familiaris
tcctggggtccctggg

SEQ ID NO: 327321 - DNA, 16 bp, C. familiaris
tcctggggtcctggga

SEQ ID NO: 327322 - DNA, 16 bp, C. familiaris
tcctggggttccggga

SEQ ID NO: 327323 - DNA, 16 bp, C. familiaris
tcctgggtcaccctgc

SEQ ID NO: 327324 - DNA, 16 bp, C. familiaris
tcctgggttggagtcc

SEQ ID NO: 327325 - DNA, 16 bp, C. familiaris
tcctggttcatagaca

SEQ ID NO: 327326 - DNA, 16 bp, C. familiaris
tcctgtagtcccagga

SEQ ID NO: 327327 - DNA, 16 bp, C. familiaris
tcctgtctctctgtct

SEQ ID NO: 327328 - DNA, 16 bp, C. familiaris
tcctgtgaggtccctg

SEQ ID NO: 327329 - DNA, 16 bp, C. familiaris
tcctgtgccctcccag

SEQ ID NO: 327330 - DNA, 16 bp, C. familiaris
tcctgtgccctcccca

SEQ ID NO: 327331 - DNA, 16 bp, C. familiaris
tcctgtgccctcctgg

SEQ ID NO: 327332 - DNA, 16 bp, C. familiaris
tcctgttgctctacat

SEQ ID NO: 327333 - DNA, 16 bp, C. familiaris
tcctgttttacagatg

SEQ ID NO: 327334 - DNA, 16 bp, C. familiaris
tccttaacctctctga

SEQ ID NO: 327335 - DNA, 16 bp, C. familiaris
tccttaatgcccatga

SEQ ID NO: 327336 - DNA, 16 bp, C. familiaris
tccttaatttcctggt

SEQ ID NO: 327337 - DNA, 16 bp, C. familiaris
tccttacagatgagga

SEQ ID NO: 327338 - DNA, 16 bp, C. familiaris
tccttagcatcttaaa

SEQ ID NO: 327339 - DNA, 16 bp, C. familiaris
tccttataaaaaggag

SEQ ID NO: 327340 - DNA, 16 bp, C. familiaris
tccttatctctgaaga

SEQ ID NO: 327341 - DNA, 16 bp, C. familiaris
tccttcaaaacccagc

SEQ ID NO: 327342 - DNA, 16 bp, C. familiaris
tccttcaagaattttt

SEQ ID NO: 327343 - DNA, 16 bp, C. familiaris
tccttcacctctttgg

SEQ ID NO: 327344 - DNA, 16 bp, C. familiaris
tccttcagaaatgaaa

SEQ ID NO: 327345 - DNA, 16 bp, C. familiaris
tccttcagatctttgc

SEQ ID NO: 327346 - DNA, 16 bp, C. familiaris
tccttcatcagtgttt

SEQ ID NO: 327347 - DNA, 16 bp, C. familiaris
tccttcatgtccatca

SEQ ID NO: 327348 - DNA, 16 bp, C. familiaris
tccttcattttattaa

SEQ ID NO: 327349 - DNA, 16 bp, C. familiaris
tccttccacactttgg

SEQ ID NO: 327350 - DNA, 16 bp, C. familiaris
tccttccatccatcca

SEQ ID NO: 327351 - DNA, 16 bp, C. familiaris
tccttccctgtgcaga

SEQ ID NO: 327352 - DNA, 16 bp, C. familiaris
tccttcctcagtttgg

SEQ ID NO: 327353 - DNA, 16 bp, C. familiaris
tccttctaaacctact

SEQ ID NO: 327354 - DNA, 16 bp, C. familiaris
tccttctccctctgca

SEQ ID NO: 327355 - DNA, 16 bp, C. familiaris
tccttctctctaaaat

SEQ ID NO: 327356 - DNA, 16 bp, C. familiaris
tccttctcttctgaat

SEQ ID NO: 327357 - DNA, 16 bp, C. familiaris
tccttctgaggctatc

SEQ ID NO: 327358 - DNA, 16 bp, C. familiaris
tccttctgcaaccctt

SEQ ID NO: 327359 - DNA, 16 bp, C. familiaris
tccttctgcccacccc

SEQ ID NO: 327360 - DNA, 16 bp, C. familiaris
tccttctgcctggaat

SEQ ID NO: 327361 - DNA, 16 bp, C. familiaris
tccttctgcctgtttc

SEQ ID NO: 327362 - DNA, 16 bp, C. familiaris
tccttctgtgtaaaat

SEQ ID NO: 327363 - DNA, 16 bp, C. familiaris
tccttcttctccacat

SEQ ID NO: 327364 - DNA, 16 bp, C. familiaris
tccttcttgtcatttt

SEQ ID NO: 327365 - DNA, 16 bp, C. familiaris
tccttcttttttaaga

SEQ ID NO: 327366 - DNA, 16 bp, C. familiaris
tccttgacctctttgg

SEQ ID NO: 327367 - DNA, 16 bp, C. familiaris
tccttgatggcaagtg

SEQ ID NO: 327368 - DNA, 16 bp, C. familiaris
tccttgcatgaagcct

SEQ ID NO: 327369 - DNA, 16 bp, C. familiaris
tccttgctgtgtgacc

SEQ ID NO: 327370 - DNA, 16 bp, C. familiaris
tccttggatcaagtcc

SEQ ID NO: 327371 - DNA, 16 bp, C. familiaris
tccttggcattctttg

SEQ ID NO: 327372 - DNA, 16 bp, C. familiaris
tccttggctcattttt

SEQ ID NO: 327373 - DNA, 16 bp, C. familiaris
tccttgtggagagcct

SEQ ID NO: 327374 - DNA, 16 bp, C. familiaris
tccttgtggttttaat

SEQ ID NO: 327375 - DNA, 16 bp, C. familiaris
tcctttaatatttcct

SEQ ID NO: 327376 - DNA, 16 bp, C. familiaris
tcctttatgctttctt

SEQ ID NO: 327377 - DNA, 16 bp, C. familiaris
tcctttcactcagcat

SEQ ID NO: 327378 - DNA, 16 bp, C. familiaris
tcctttcactttcagt

SEQ ID NO: 327379 - DNA, 16 bp, C. familiaris
tcctttctctaaaata

SEQ ID NO: 327380 - DNA, 16 bp, C. familiaris
tcctttctgatgactg

SEQ ID NO: 327381 - DNA, 16 bp, C. familiaris
tcctttctttaaaaaa

SEQ ID NO: 327382 - DNA, 16 bp, C. familiaris
tcctttctttccacat

SEQ ID NO: 327383 - DNA, 16 bp, C. familiaris
tcctttgaaagatgaa

SEQ ID NO: 327384 - DNA, 16 bp, C. familiaris
tcctttgatgtgcaga

SEQ ID NO: 327385 - DNA, 16 bp, C. familiaris
tcctttgttaaagatt

SEQ ID NO: 327386 - DNA, 16 bp, C. familiaris
tcctttgttgtgcaga

SEQ ID NO: 327387 - DNA, 16 bp, C. familiaris
tccttttctcatttgt

SEQ ID NO: 327388 - DNA, 16 bp, C. familiaris
tccttttctgtgaaat

SEQ ID NO: 327389 - DNA, 16 bp, C. familiaris
tccttttgctgatttt

SEQ ID NO: 327390 - DNA, 16 bp, C. familiaris
tccttttggaggatct

SEQ ID NO: 327391 - DNA, 16 bp, C. familiaris
tcctttttattattga

SEQ ID NO: 327392 - DNA, 16 bp, C. familiaris
tcctttttattgatga

SEQ ID NO: 327393 - DNA, 16 bp, C. familiaris
tcctttttttaaagat

SEQ ID NO: 327394 - DNA, 16 bp, C. familiaris
tcgagcagaaactcaa

SEQ ID NO: 327395 - DNA, 16 bp, C. familiaris
tcgagccaaaggcaga

SEQ ID NO: 327396 - DNA, 16 bp, C. familiaris
tcgagccccaccttgg

SEQ ID NO: 327397 - DNA, 16 bp, C. familiaris
tcgagtcccacctggg

SEQ ID NO: 327398 - DNA, 16 bp, C. familiaris
tcgagtccctgcaggg

SEQ ID NO: 327399 - DNA, 17 bp, C. familiaris
tcgatcccagactccag

SEQ ID NO: 327400 - DNA, 16 bp, C. familiaris
tcgctgatgacatgat

SEQ ID NO: 327401 - DNA, 16 bp, C. familiaris
tcggattcacaatctt

SEQ ID NO: 327402 - DNA, 16 bp, C. familiaris
tcggcatggagtctgc

SEQ ID NO: 327403 - DNA, 16 bp, C. familiaris
tcggcccagggcacaa

SEQ ID NO: 327404 - DNA, 16 bp, C. familiaris
tcggcccagggcatca

SEQ ID NO: 327405 - DNA, 16 bp, C. familiaris
tcggcctccctgcagg

SEQ ID NO: 327406 - DNA, 16 bp, C. familiaris
tcgggctccctggatg

SEQ ID NO: 327407 - DNA, 16 bp, C. familiaris
tcgggctcctgcaagg

SEQ ID NO: 327408 - DNA, 16 bp, C. familiaris
tcgggctcctgctcag

SEQ ID NO: 327409 - DNA, 16 bp, C. familiaris
tcgggggcagctccgc

SEQ ID NO: 327410 - DNA, 16 bp, C. familiaris
tcgtcgtcctcctcct

SEQ ID NO: 327411 - DNA, 16 bp, C. familiaris
tcgtcgtcgtcgtcat

SEQ ID NO: 327412 - DNA, 16 bp, C. familiaris
tcgtcgtcgtcgtcgt

SEQ ID NO: 327413 - DNA, 16 bp, C. familiaris
tctaaaagtgaaaaat

SEQ ID NO: 327414 - DNA, 16 bp, C. familiaris
tctaaaatcatttcaa

SEQ ID NO: 327415 - DNA, 16 bp, C. familiaris
tctaaaattagaaaat

SEQ ID NO: 327416 - DNA, 16 bp, C. familiaris
tctaaagaagacatat

SEQ ID NO: 327417 - DNA, 16 bp, C. familiaris
tctaaaggaaatgaaa

SEQ ID NO: 327418 - DNA, 16 bp, C. familiaris
tctaaaggaactggag

SEQ ID NO: 327419 - DNA, 16 bp, C. familiaris
tctaaattctgtagtc

SEQ ID NO: 327420 - DNA, 16 bp, C. familiaris
tctaaatttgatgaaa

SEQ ID NO: 327421 - DNA, 16 bp, C. familiaris
tctaacatctgctttt

SEQ ID NO: 327422 - DNA, 16 bp, C. familiaris
tctaagaagaaagaaa

SEQ ID NO: 327423 - DNA, 16 bp, C. familiaris
tctaagaattttatag

SEQ ID NO: 327424 - DNA, 26 bp, C. familiaris
tctaagtcagagtctcccaaagagcc

SEQ ID NO: 327425 - DNA, 16 bp, C. familiaris
tctaattaaaaagaaa

SEQ ID NO: 327426 - DNA, 16 bp, C. familiaris
tctacaaatgaagaaa

SEQ ID NO: 327427 - DNA, 16 bp, C. familiaris
tctacaagccaggaag

SEQ ID NO: 327428 - DNA, 16 bp, C. familiaris
tctacaatgagtctct

SEQ ID NO: 327429 - DNA, 16 bp, C. familiaris
tctacacaaaaacttg

SEQ ID NO: 327430 - DNA, 16 bp, C. familiaris
tctacacagcaaagaa

SEQ ID NO: 327431 - DNA, 16 bp, C. familiaris
tctacacccaatgtga

SEQ ID NO: 327432 - DNA, 16 bp, C. familiaris
tctacagaaacaggga

SEQ ID NO: 327433 - DNA, 16 bp, C. familiaris
tctacagaggaggaaa

SEQ ID NO: 327434 - DNA, 16 bp, C. familiaris
tctacagcctgaaaat

SEQ ID NO: 327435 - DNA, 16 bp, C. familiaris
tctacagcctgaggaa

SEQ ID NO: 327436 - DNA, 16 bp, C. familiaris
tctacatcctctccaa

SEQ ID NO: 327437 - DNA, 16 bp, C. familiaris
tctacatcttcaccaa

SEQ ID NO: 327438 - DNA, 16 bp, C. familiaris
tctacatgttggcaaa

SEQ ID NO: 327439 - DNA, 16 bp, C. familiaris
tctacatttctaacaa

SEQ ID NO: 327440 - DNA, 16 bp, C. familiaris
tctaccaactaagcca

SEQ ID NO: 327441 - DNA, 16 bp, C. familiaris
tctaccagctgagcca

SEQ ID NO: 327442 - DNA, 16 bp, C. familiaris
tctacctccagctcag

SEQ ID NO: 327443 - DNA, 16 bp, C. familiaris
tctacctctacctctc

SEQ ID NO: 327444 - DNA, 16 bp, C. familiaris
tctacctctgaaacca

SEQ ID NO: 327445 - DNA, 16 bp, C. familiaris
tctacctctgcccctg

SEQ ID NO: 327446 - DNA, 16 bp, C. familiaris
tctacctgaggggtcc

SEQ ID NO: 327447 - DNA, 16 bp, C. familiaris
tctacgtctctgcctc

SEQ ID NO: 327448 - DNA, 16 bp, C. familiaris
tctactgatgagccca

SEQ ID NO: 327449 - DNA, 16 bp, C. familiaris
tctactggaaaaagga

SEQ ID NO: 327450 - DNA, 16 bp, C. familiaris
tctacttctaattcta

SEQ ID NO: 327451 - DNA, 16 bp, C. familiaris
tctactttctgcttct

SEQ ID NO: 327452 - DNA, 16 bp, C. familiaris
tctagaaaaggaaaat

SEQ ID NO: 327453 - DNA, 16 bp, C. familiaris
tctagaaatgaaaaaa

SEQ ID NO: 327454 - DNA, 16 bp, C. familiaris
tctagaaatggaaaat

SEQ ID NO: 327455 - DNA, 16 bp, C. familiaris
tctagagatctgctat

SEQ ID NO: 327456 - DNA, 16 bp, C. familiaris
tctagatgtcattaag

SEQ ID NO: 327457 - DNA, 16 bp, C. familiaris
tctagtttctttcttc

SEQ ID NO: 327458 - DNA, 16 bp, C. familiaris
tctagttttagaacat

SEQ ID NO: 327459 - DNA, 16 bp, C. familiaris
tctataaaaaacttat

SEQ ID NO: 327460 - DNA, 16 bp, C. familiaris
tctataccacccaaag

SEQ ID NO: 327461 - DNA, 16 bp, C. familiaris
tctatcaaaattccaa

SEQ ID NO: 327462 - DNA, 16 bp, C. familiaris
tctatcaacaggtgaa

SEQ ID NO: 327463 - DNA, 16 bp, C. familiaris
tctatcaatggacact

SEQ ID NO: 327464 - DNA, 16 bp, C. familiaris
tctatctctgtctctc

SEQ ID NO: 327465 - DNA, 16 bp, C. familiaris
tctatctgactccaaa

SEQ ID NO: 327466 - DNA, 16 bp, C. familiaris
tctatctgacttattt

SEQ ID NO: 327467 - DNA, 16 bp, C. familiaris
tctatcttctggatct

SEQ ID NO: 327468 - DNA, 16 bp, C. familiaris
tctatgaatttggaca

SEQ ID NO: 327469 - DNA, 16 bp, C. familiaris
tctatgagcctcagtt

SEQ ID NO: 327470 - DNA, 16 bp, C. familiaris
tctatgagtctatttt

SEQ ID NO: 327471 - DNA, 16 bp, C. familiaris
tctatgctgggagccc

SEQ ID NO: 327472 - DNA, 16 bp, C. familiaris
tctatggattgtcttt

SEQ ID NO: 327473 - DNA, 17 bp, C. familiaris
tctatggcaaaagtcag

SEQ ID NO: 327474 - DNA, 16 bp, C. familiaris
tctatgtctctccctc

SEQ ID NO: 327475 - DNA, 16 bp, C. familiaris
tctatgtctctgcctc

SEQ ID NO: 327476 - DNA, 16 bp, C. familiaris
tctatgtcttcctctg

SEQ ID NO: 327477 - DNA, 16 bp, C. familiaris
tctatgtggaaaaccc

SEQ ID NO: 327478 - DNA, 16 bp, C. familiaris
tctatgtgtctgtcat

SEQ ID NO: 327479 - DNA, 16 bp, C. familiaris
tctattcagatatttt

SEQ ID NO: 327480 - DNA, 16 bp, C. familiaris
tctattcatctgttga

SEQ ID NO: 327481 - DNA, 16 bp, C. familiaris
tctattctgaatgaca

SEQ ID NO: 327482 - DNA, 16 bp, C. familiaris
tctattctggacattt

SEQ ID NO: 327483 - DNA, 16 bp, C. familiaris
tctattctgttggtct

SEQ ID NO: 327484 - DNA, 16 bp, C. familiaris
tctattcttctctgga

SEQ ID NO: 327485 - DNA, 16 bp, C. familiaris
tctatttaaagaaaaa

SEQ ID NO: 327486 - DNA, 16 bp, C. familiaris
tctatttacataaaat

SEQ ID NO: 327487 - DNA, 16 bp, C. familiaris
tctatttctataaaat

SEQ ID NO: 327488 - DNA, 16 bp, C. familiaris
tctatttctctcaaat

SEQ ID NO: 327489 - DNA, 16 bp, C. familiaris
tctatttctctgcctc

SEQ ID NO: 327490 - DNA, 16 bp, C. familiaris
tctatttctgcctctc

SEQ ID NO: 327491 - DNA, 16 bp, C. familiaris
tctatttcttcctgat

SEQ ID NO: 327492 - DNA, 16 bp, C. familiaris
tctatttgtctattct

SEQ ID NO: 327493 - DNA, 16 bp, C. familiaris
tctattttaagttaat

SEQ ID NO: 327494 - DNA, 16 bp, C. familiaris
tctattttcttcatgg

SEQ ID NO: 327495 - DNA, 16 bp, C. familiaris
tctatttttgtgaaaa

SEQ ID NO: 327496 - DNA, 16 bp, C. familiaris
tctcaaaaaggcaaaa

SEQ ID NO: 327497 - DNA, 16 bp, C. familiaris
tctcaaaagatttttt

SEQ ID NO: 327498 - DNA, 16 bp, C. familiaris
tctcaaacaaacaaat

SEQ ID NO: 327499 - DNA, 16 bp, C. familiaris
tctcaaactttatttt

SEQ ID NO: 327500 - DNA, 16 bp, C. familiaris
tctcaaaggagaaaaa

SEQ ID NO: 327501 - DNA, 16 bp, C. familiaris
tctcaaataaaaaagt

SEQ ID NO: 327502 - DNA, 16 bp, C. familiaris
tctcaaattaaaatat

SEQ ID NO: 327503 - DNA, 16 bp, C. familiaris
tctcaaattttagcat

SEQ ID NO: 327504 - DNA, 16 bp, C. familiaris
tctcaagaagcaagaa

SEQ ID NO: 327505 - DNA, 16 bp, C. familiaris
tctcaagaatgaataa

SEQ ID NO: 327506 - DNA, 16 bp, C. familiaris
tctcaagcagattctg

SEQ ID NO: 327507 - DNA, 16 bp, C. familiaris
tctcaagcaggctctg

SEQ ID NO: 327508 - DNA, 16 bp, C. familiaris
tctcaagtggactctg

SEQ ID NO: 327509 - DNA, 16 bp, C. familiaris
tctcaatggagaaaca

SEQ ID NO: 327510 - DNA, 16 bp, C. familiaris
tctcacagaggaaaac

SEQ ID NO: 327511 - DNA, 16 bp, C. familiaris
tctcaccactgccatt

SEQ ID NO: 327512 - DNA, 16 bp, C. familiaris
tctcactctgtgtgtg

SEQ ID NO: 327513 - DNA, 16 bp, C. familiaris
tctcagaaaaacaaaa

SEQ ID NO: 327514 - DNA, 16 bp, C. familiaris
tctcagaaccctgaga

SEQ ID NO: 327515 - DNA, 46 bp, C. familiaris
tctcagaactgtttgtgtcaattggccatttaagtttaatagtaaa

SEQ ID NO: 327516 - DNA, 16 bp, C. familiaris
tctcagaaggagaaaa

SEQ ID NO: 327517 - DNA, 16 bp, C. familiaris
tctcagaaggagagga

SEQ ID NO: 327518 - DNA, 16 bp, C. familiaris
tctcagactccccact

SEQ ID NO: 327519 - DNA, 16 bp, C. familiaris
tctcagaggaagacat

SEQ ID NO: 327520 - DNA, 16 bp, C. familiaris
tctcagatattttttt

SEQ ID NO: 327521 - DNA, 16 bp, C. familiaris
tctcagcaataaaaag

SEQ ID NO: 327522 - DNA, 16 bp, C. familiaris
tctcagcaccctgaga

SEQ ID NO: 327523 - DNA, 16 bp, C. familiaris
tctcagcatctgcttc

SEQ ID NO: 327524 - DNA, 16 bp, C. familiaris
tctcagcttctagagg

SEQ ID NO: 327525 - DNA, 16 bp, C. familiaris
tctcaggaataagtaa

SEQ ID NO: 327526 - DNA, 16 bp, C. familiaris
tctcaggaatagataa

SEQ ID NO: 327527 - DNA, 16 bp, C. familiaris
tctcaggaccctcaga

SEQ ID NO: 327528 - DNA, 16 bp, C. familiaris
tctcaggatcatgaaa

SEQ ID NO: 327529 - DNA, 16 bp, C. familiaris
tctcaggattccagga

SEQ ID NO: 327530 - DNA, 16 bp, C. familiaris
tctcaggcagactctg

SEQ ID NO: 327531 - DNA, 16 bp, C. familiaris
tctcagggctcctggg

SEQ ID NO: 327532 - DNA, 16 bp, C. familiaris
tctcaggggaaaggct

SEQ ID NO: 327533 - DNA, 16 bp, C. familiaris
tctcagggtctggaga

SEQ ID NO: 327534 - DNA, 16 bp, C. familiaris
tctcagggtgtgagat

SEQ ID NO: 327535 - DNA, 16 bp, C. familiaris
tctcagttctgttcca

SEQ ID NO: 327536 - DNA, 16 bp, C. familiaris
tctcagttttgtcatc

SEQ ID NO: 327537 - DNA, 16 bp, C. familiaris
tctcatcagaaataat

SEQ ID NO: 327538 - DNA, 17 bp, C. familiaris
tctcatgaataaataaa

SEQ ID NO: 327539 - DNA, 16 bp, C. familiaris
tctcatgtgattgttg

SEQ ID NO: 327540 - DNA, 16 bp, C. familiaris
tctcattcactctctc

SEQ ID NO: 327541 - DNA, 16 bp, C. familiaris
tctcattcagaacaga

SEQ ID NO: 327542 - DNA, 23 bp, C. familiaris
tctcattcatttggggaatataa

SEQ ID NO: 327543 - DNA, 16 bp, C. familiaris
tctcatttactcctca

SEQ ID NO: 327544 - DNA, 16 bp, C. familiaris
tctcatttagtgccct

SEQ ID NO: 327545 - DNA, 16 bp, C. familiaris
tctcatttttaaataa

SEQ ID NO: 327546 - DNA, 16 bp, C. familiaris
tctccaaactcatcaa

SEQ ID NO: 327547 - DNA, 16 bp, C. familiaris
tctccaaacttttttt

SEQ ID NO: 327548 - DNA, 16 bp, C. familiaris
tctccaagatcatacc

SEQ ID NO: 327549 - DNA, 16 bp, C. familiaris
tctccaagatcgtgcc

SEQ ID NO: 327550 - DNA, 16 bp, C. familiaris
tctccacaaggagccc

SEQ ID NO: 327551 - DNA, 16 bp, C. familiaris
tctccaccctgcctcc

SEQ ID NO: 327552 - DNA, 16 bp, C. familiaris
tctccacctatgtctc

SEQ ID NO: 327553 - DNA, 16 bp, C. familiaris
tctccacctgtgtctc

SEQ ID NO: 327554 - DNA, 16 bp, C. familiaris
tctccagaatggacca

SEQ ID NO: 327555 - DNA, 16 bp, C. familiaris
tctccagagccaccag

SEQ ID NO: 327556 - DNA, 16 bp, C. familiaris
tctccagaggaaaaaa

SEQ ID NO: 327557 - DNA, 16 bp, C. familiaris
tctccagcccagacct

SEQ ID NO: 327558 - DNA, 16 bp, C. familiaris
tctccagccctggagt

SEQ ID NO: 327559 - DNA, 16 bp, C. familiaris
tctccagcctccagaa

SEQ ID NO: 327560 - DNA, 16 bp, C. familiaris
tctccagcctgccagc

SEQ ID NO: 327561 - DNA, 16 bp, C. familiaris
tctccagcctttcatt

SEQ ID NO: 327562 - DNA, 16 bp, C. familiaris
tctccagcttacagat

SEQ ID NO: 327563 - DNA, 16 bp, C. familiaris
tctccaggatcctgcc

SEQ ID NO: 327564 - DNA, 16 bp, C. familiaris
tctccaggctcacacc

SEQ ID NO: 327565 - DNA, 16 bp, C. familiaris
tctccagggcacctgg

SEQ ID NO: 327566 - DNA, 16 bp, C. familiaris
tctccatctctgtctc

SEQ ID NO: 327567 - DNA, 16 bp, C. familiaris
tctccatctgcctgtg

SEQ ID NO: 327568 - DNA, 16 bp, C. familiaris
tctccatctgcttctc

SEQ ID NO: 327569 - DNA, 16 bp, C. familiaris
tctccatttctttgtg

SEQ ID NO: 327570 - DNA, 16 bp, C. familiaris
tctcccaaaaaagaaa

SEQ ID NO: 327571 - DNA, 16 bp, C. familiaris
tctcccatgaacaaat

SEQ ID NO: 327572 - DNA, 16 bp, C. familiaris
tctcccattctgtggc

SEQ ID NO: 327573 - DNA, 16 bp, C. familiaris
tctcccatttttaaaa

SEQ ID NO: 327574 - DNA, 16 bp, C. familiaris
tctccccatctctctg

SEQ ID NO: 327575 - DNA, 16 bp, C. familiaris
tctcccggatcacacc

SEQ ID NO: 327576 - DNA, 16 bp, C. familiaris
tctccctcagcccctc

SEQ ID NO: 327577 - DNA, 16 bp, C. familiaris
tctccctcaggactgc

SEQ ID NO: 327578 - DNA, 16 bp, C. familiaris
tctccctccacttgtg

SEQ ID NO: 327579 - DNA, 16 bp, C. familiaris
tctccctcctctgtgt

SEQ ID NO: 327580 - DNA, 16 bp, C. familiaris
tctccctctacctgca

SEQ ID NO: 327581 - DNA, 16 bp, C. familiaris
tctccctctacgtctc

SEQ ID NO: 327582 - DNA, 16 bp, C. familiaris
tctccctctccctgca

SEQ ID NO: 327583 - DNA, 16 bp, C. familiaris
tctccctctcctgctg

SEQ ID NO: 327584 - DNA, 16 bp, C. familiaris
tctccctctctgccca

SEQ ID NO: 327585 - DNA, 16 bp, C. familiaris
tctccctctgcttatt

SEQ ID NO: 327586 - DNA, 16 bp, C. familiaris
tctccctcttcaccaa

SEQ ID NO: 327587 - DNA, 16 bp, C. familiaris
tctccctcttcatctg

SEQ ID NO: 327588 - DNA, 16 bp, C. familiaris
tctccctgtcctgggg

SEQ ID NO: 327589 - DNA, 16 bp, C. familiaris
tctccctgtccttctg

SEQ ID NO: 327590 - DNA, 16 bp, C. familiaris
tctccctgtgactctc

SEQ ID NO: 327591 - DNA, 16 bp, C. familiaris
tctcccttcatcttca

SEQ ID NO: 327592 - DNA, 27 bp, C. familiaris
tctccgggacggggctctcctgtcctg

SEQ ID NO: 327593 - DNA, 16 bp, C. familiaris
tctcctatgttttctt

SEQ ID NO: 327594 - DNA, 16 bp, C. familiaris
tctcctcagtgcccat

SEQ ID NO: 327595 - DNA, 16 bp, C. familiaris
tctcctccctgctctg

SEQ ID NO: 327596 - DNA, 16 bp, C. familiaris
tctcctcctgctcctg

SEQ ID NO: 327597 - DNA, 16 bp, C. familiaris
tctcctctccttctgg

SEQ ID NO: 327598 - DNA, 16 bp, C. familiaris
tctcctctgtctctgt

SEQ ID NO: 327599 - DNA, 16 bp, C. familiaris
tctcctcttggatttt

SEQ ID NO: 327600 - DNA, 16 bp, C. familiaris
tctcctctttcatttg

SEQ ID NO: 327601 - DNA, 16 bp, C. familiaris
tctcctgcagcttcct

SEQ ID NO: 327602 - DNA, 16 bp, C. familiaris
tctcctgcagggagcc

SEQ ID NO: 327603 - DNA, 16 bp, C. familiaris
tctccttcctgctcat

SEQ ID NO: 327604 - DNA, 16 bp, C. familiaris
tctccttcttcctgtg

SEQ ID NO: 327605 - DNA, 16 bp, C. familiaris
tctccttgaagatgaa

SEQ ID NO: 327606 - DNA, 16 bp, C. familiaris
tctccttgacttgtag

SEQ ID NO: 327607 - DNA, 16 bp, C. familiaris
tctcgctctctcgctc

SEQ ID NO: 327608 - DNA, 16 bp, C. familiaris
tctcgctctgcctatg

SEQ ID NO: 327609 - DNA, 16 bp, C. familiaris
tctcgctgagcaggga

SEQ ID NO: 327610 - DNA, 16 bp, C. familiaris
tctcggcctctgtgtg

SEQ ID NO: 327611 - DNA, 16 bp, C. familiaris
tctcgggacacctggg

SEQ ID NO: 327612 - DNA, 16 bp, C. familiaris
tctctaaatacataca

SEQ ID NO: 327613 - DNA, 16 bp, C. familiaris
tctctacactcagtgt

SEQ ID NO: 327614 - DNA, 16 bp, C. familiaris
tctctagggacacctg

SEQ ID NO: 327615 - DNA, 16 bp, C. familiaris
tctctagtttcctggt

SEQ ID NO: 327616 - DNA, 16 bp, C. familiaris
tctctatttctataat

SEQ ID NO: 327617 - DNA, 16 bp, C. familiaris
tctctatttctctgtg

SEQ ID NO: 327618 - DNA, 16 bp, C. familiaris
tctctcaccctctgct

SEQ ID NO: 327619 - DNA, 16 bp, C. familiaris
tctctcactctctcac

SEQ ID NO: 327620 - DNA, 16 bp, C. familiaris
tctctcatgaatacat

SEQ ID NO: 327621 - DNA, 16 bp, C. familiaris
tctctcatgagtggat

SEQ ID NO: 327622 - DNA, 16 bp, C. familiaris
tctctcatggtttatc

SEQ ID NO: 327623 - DNA, 16 bp, C. familiaris
tctctcatgtataaat

SEQ ID NO: 327624 - DNA, 16 bp, C. familiaris
tctctccatctgtccc

SEQ ID NO: 327625 - DNA, 16 bp, C. familiaris
tctctcccactgcccc

SEQ ID NO: 327626 - DNA, 16 bp, C. familiaris
tctctcccactgccct

SEQ ID NO: 327627 - DNA, 16 bp, C. familiaris
tctctccctctgtgtg

SEQ ID NO: 327628 - DNA, 16 bp, C. familiaris
tctctccctctttgtg

SEQ ID NO: 327629 - DNA, 16 bp, C. familiaris
tctctcctcctctgtg

SEQ ID NO: 327630 - DNA, 16 bp, C. familiaris
tctctcctctctgtgc

SEQ ID NO: 327631 - DNA, 16 bp, C. familiaris
tctctcctggagaatg

SEQ ID NO: 327632 - DNA, 16 bp, C. familiaris
tctctcgatggacacc

SEQ ID NO: 327633 - DNA, 16 bp, C. familiaris
tctctctatatacaca

SEQ ID NO: 327634 - DNA, 16 bp, C. familiaris
tctctctatatcctgg

SEQ ID NO: 327635 - DNA, 16 bp, C. familiaris
tctctctcaaaataga

SEQ ID NO: 327636 - DNA, 16 bp, C. familiaris
tctctctcccccagcc

SEQ ID NO: 327637 - DNA, 16 bp, C. familiaris
tctctctccgtctgtc

SEQ ID NO: 327638 - DNA, 16 bp, C. familiaris
tctctctctccatctg

SEQ ID NO: 327639 - DNA, 16 bp, C. familiaris
tctctctctcctgctg

SEQ ID NO: 327640 - DNA, 16 bp, C. familiaris
tctctctctctcctgg

SEQ ID NO: 327641 - DNA, 16 bp, C. familiaris
tctctctctgccccca

SEQ ID NO: 327642 - DNA, 16 bp, C. familiaris
tctctctctggccctc

SEQ ID NO: 327643 - DNA, 16 bp, C. familiaris
tctctctctgtgtgtt

SEQ ID NO: 327644 - DNA, 16 bp, C. familiaris
tctctctcttctccaa

SEQ ID NO: 327645 - DNA, 16 bp, C. familiaris
tctctctcttgcttgc

SEQ ID NO: 327646 - DNA, 16 bp, C. familiaris
tctctctgaaaaacaa

SEQ ID NO: 327647 - DNA, 16 bp, C. familiaris
tctctctgaaaacaaa

SEQ ID NO: 327648 - DNA, 16 bp, C. familiaris
tctctctgacatcagc

SEQ ID NO: 327649 - DNA, 16 bp, C. familiaris
tctctctgactctgac

SEQ ID NO: 327650 - DNA, 16 bp, C. familiaris
tctctctgagccttgg

SEQ ID NO: 327651 - DNA, 16 bp, C. familiaris
tctctctgagtctctt

SEQ ID NO: 327652 - DNA, 16 bp, C. familiaris
tctctctgatgacttc

SEQ ID NO: 327653 - DNA, 16 bp, C. familiaris
tctctctgcatctcat

SEQ ID NO: 327654 - DNA, 16 bp, C. familiaris
tctctctgcctacctc

SEQ ID NO: 327655 - DNA, 16 bp, C. familiaris
tctctctgcctacgtc

SEQ ID NO: 327656 - DNA, 16 bp, C. familiaris
tctctctgcctgtccc

SEQ ID NO: 327657 - DNA, 16 bp, C. familiaris
tctctctggcttctct

SEQ ID NO: 327658 - DNA, 16 bp, C. familiaris
tctctctgggtttctc

SEQ ID NO: 327659 - DNA, 16 bp, C. familiaris
tctctctgtatcctca

SEQ ID NO: 327660 - DNA, 16 bp, C. familiaris
tctctctgtcatgaat

SEQ ID NO: 327661 - DNA, 16 bp, C. familiaris
tctctctgtctgtcat

SEQ ID NO: 327662 - DNA, 16 bp, C. familiaris
tctctctttctgtatg

SEQ ID NO: 327663 - DNA, 16 bp, C. familiaris
tctctctttctgtgac

SEQ ID NO: 327664 - DNA, 16 bp, C. familiaris
tctctgaaaaatgctg

SEQ ID NO: 327665 - DNA, 16 bp, C. familiaris
tctctgaaaatgtctt

SEQ ID NO: 327666 - DNA, 16 bp, C. familiaris
tctctgaagaaatgtc

SEQ ID NO: 327667 - DNA, 16 bp, C. familiaris
tctctgaattaaaaaa

SEQ ID NO: 327668 - DNA, 16 bp, C. familiaris
tctctgaccttcagtt

SEQ ID NO: 327669 - DNA, 16 bp, C. familiaris
tctctgagcctctctc

SEQ ID NO: 327670 - DNA, 16 bp, C. familiaris
tctctgatggccagtg

SEQ ID NO: 327671 - DNA, 16 bp, C. familiaris
tctctgattatgtctt

SEQ ID NO: 327672 - DNA, 16 bp, C. familiaris
tctctgattctctctc

SEQ ID NO: 327673 - DNA, 16 bp, C. familiaris
tctctgattttgtctt

SEQ ID NO: 327674 - DNA, 16 bp, C. familiaris
tctctgcaggagccca

SEQ ID NO: 327675 - DNA, 16 bp, C. familiaris
tctctgcctatgtgtc

SEQ ID NO: 327676 - DNA, 16 bp, C. familiaris
tctctgcctcccaccc

SEQ ID NO: 327677 - DNA, 16 bp, C. familiaris
tctctgcctctatgtg

SEQ ID NO: 327678 - DNA, 17 bp, C. familiaris
tctctgcctctctctgt

SEQ ID NO: 327679 - DNA, 16 bp, C. familiaris
tctctgcctctgcttt

SEQ ID NO: 327680 - DNA, 16 bp, C. familiaris
tctctgcctctgtctg

SEQ ID NO: 327681 - DNA, 16 bp, C. familiaris
tctctgcctcttctgt

SEQ ID NO: 327682 - DNA, 16 bp, C. familiaris
tctctgcctgctgctc

SEQ ID NO: 327683 - DNA, 16 bp, C. familiaris
tctctgcctttctgtc

SEQ ID NO: 327684 - DNA, 16 bp, C. familiaris
tctctgcctttgtgtg

SEQ ID NO: 327685 - DNA, 16 bp, C. familiaris
tctctgctgagcagga

SEQ ID NO: 327686 - DNA, 16 bp, C. familiaris
tctctgctgcttcccc

SEQ ID NO: 327687 - DNA, 16 bp, C. familiaris
tctctgctttcatctt

SEQ ID NO: 327688 - DNA, 16 bp, C. familiaris
tctctggagaaccctg

SEQ ID NO: 327689 - DNA, 16 bp, C. familiaris
tctctgggctttggtt

SEQ ID NO: 327690 - DNA, 16 bp, C. familiaris
tctctggggaaaaaaa

SEQ ID NO: 327691 - DNA, 16 bp, C. familiaris
tctctgggtggctcag

SEQ ID NO: 327692 - DNA, 16 bp, C. familiaris
tctctggttcctggga

SEQ ID NO: 327693 - DNA, 16 bp, C. familiaris
tctctgtatttgtgag

SEQ ID NO: 327694 - DNA, 16 bp, C. familiaris
tctctgtccctctcat

SEQ ID NO: 327695 - DNA, 16 bp, C. familiaris
tctctgtctaataaat

SEQ ID NO: 327696 - DNA, 16 bp, C. familiaris
tctctgtctctctctg

SEQ ID NO: 327697 - DNA, 16 bp, C. familiaris
tctctgtctctgcctc

SEQ ID NO: 327698 - DNA, 16 bp, C. familiaris
tctctgtctgcctgtc

SEQ ID NO: 327699 - DNA, 16 bp, C. familiaris
tctctgtctgtcaaat

SEQ ID NO: 327700 - DNA, 16 bp, C. familiaris
tctctgtcttcagtct

SEQ ID NO: 327701 - DNA, 16 bp, C. familiaris
tctctgtgcctctgat

SEQ ID NO: 327702 - DNA, 16 bp, C. familiaris
tctctgtggctcagtt

SEQ ID NO: 327703 - DNA, 16 bp, C. familiaris
tctctgtgtctaccat

SEQ ID NO: 327704 - DNA, 16 bp, C. familiaris
tctctgtgtctcttag

SEQ ID NO: 327705 - DNA, 16 bp, C. familiaris
tctctgtgtgtgtctt

SEQ ID NO: 327706 - DNA, 16 bp, C. familiaris
tctcttaaaaacaaaa

SEQ ID NO: 327707 - DNA, 16 bp, C. familiaris
tctcttaaaattcttt

SEQ ID NO: 327708 - DNA, 16 bp, C. familiaris
tctcttatctcttgct

SEQ ID NO: 327709 - DNA, 16 bp, C. familiaris
tctcttcaaattagtg

SEQ ID NO: 327710 - DNA, 16 bp, C. familiaris
tctcttcccttatgat

SEQ ID NO: 327711 - DNA, 16 bp, C. familiaris
tctcttcctctgaccc

SEQ ID NO: 327712 - DNA, 16 bp, C. familiaris
tctcttctttctcaaa

SEQ ID NO: 327713 - DNA, 16 bp, C. familiaris
tctcttggcttctgtg

SEQ ID NO: 327714 - DNA, 16 bp, C. familiaris
tctcttgtagacagaa

SEQ ID NO: 327715 - DNA, 16 bp, C. familiaris
tctcttgtgatgagaa

SEQ ID NO: 327716 - DNA, 16 bp, C. familiaris
tctcttgtgtgctctc

SEQ ID NO: 327717 - DNA, 16 bp, C. familiaris
tctctttacatcttcc

SEQ ID NO: 327718 - DNA, 16 bp, C. familiaris
tctctttatatataaa

SEQ ID NO: 327719 - DNA, 16 bp, C. familiaris
tctctttatttaaaaa

SEQ ID NO: 327720 - DNA, 16 bp, C. familiaris
tctctttcaaatgaat

SEQ ID NO: 327721 - DNA, 16 bp, C. familiaris
tctctttcatgttttg

SEQ ID NO: 327722 - DNA, 16 bp, C. familiaris
tctctttcattcatga

SEQ ID NO: 327723 - DNA, 16 bp, C. familiaris
tctctttctctaaaag

SEQ ID NO: 327724 - DNA, 16 bp, C. familiaris
tctctttctgccactt

SEQ ID NO: 327725 - DNA, 16 bp, C. familiaris
tctctttctgcctgtg

SEQ ID NO: 327726 - DNA, 16 bp, C. familiaris
tctctttctttccaaa

SEQ ID NO: 327727 - DNA, 16 bp, C. familiaris
tctctttgtgtctcta

SEQ ID NO: 327728 - DNA, 16 bp, C. familiaris
tctgaaaaagaaaaac

SEQ ID NO: 327729 - DNA, 16 bp, C. familiaris
tctgaaaaagaaataa

SEQ ID NO: 327730 - DNA, 16 bp, C. familiaris
tctgaaaaagaaattt

SEQ ID NO: 327731 - DNA, 16 bp, C. familiaris
tctgaaaaatgaaaat

SEQ ID NO: 327732 - DNA, 16 bp, C. familiaris
tctgaaaacaaagaaa

SEQ ID NO: 327733 - DNA, 16 bp, C. familiaris
tctgaaaaccagaaaa

SEQ ID NO: 327734 - DNA, 16 bp, C. familiaris
tctgaaaatatctttt

SEQ ID NO: 327735 - DNA, 16 bp, C. familiaris
tctgaaaatcaatcaa

SEQ ID NO: 327736 - DNA, 16 bp, C. familiaris
tctgaaaatgaaaata

SEQ ID NO: 327737 - DNA, 16 bp, C. familiaris
tctgaaaccaaaaata

SEQ ID NO: 327738 - DNA, 16 bp, C. familiaris
tctgaaattcagattt

SEQ ID NO: 327739 - DNA, 16 bp, C. familiaris
tctgaagaaaacaaaa

SEQ ID NO: 327740 - DNA, 16 bp, C. familiaris
tctgaagaaaataaaa

SEQ ID NO: 327741 - DNA, 16 bp, C. familiaris
tctgaagaaaatgaaa

SEQ ID NO: 327742 - DNA, 16 bp, C. familiaris
tctgaagaaactccat

SEQ ID NO: 327743 - DNA, 16 bp, C. familiaris
tctgaagaacagaaaa

SEQ ID NO: 327744 - DNA, 16 bp, C. familiaris
tctgaagaagaaaaaa

SEQ ID NO: 327745 - DNA, 16 bp, C. familiaris
tctgaagaattttttt

SEQ ID NO: 327746 - DNA, 16 bp, C. familiaris
tctgaagagcacctgg

SEQ ID NO: 327747 - DNA, 16 bp, C. familiaris
tctgaagcagattctg

SEQ ID NO: 327748 - DNA, 16 bp, C. familiaris
tctgaaggaaaagaaa

SEQ ID NO: 327749 - DNA, 16 bp, C. familiaris
tctgaaggaaatgaaa

SEQ ID NO: 327750 - DNA, 16 bp, C. familiaris
tctgaaggataatttt

SEQ ID NO: 327751 - DNA, 16 bp, C. familiaris
tctgaagtttacctca

SEQ ID NO: 327752 - DNA, 16 bp, C. familiaris
tctgaattcctttttt

SEQ ID NO: 327753 - DNA, 16 bp, C. familiaris
tctgacctgtgtgagg

SEQ ID NO: 327754 - DNA, 16 bp, C. familiaris
tctgactcagtgggtc

SEQ ID NO: 327755 - DNA, 16 bp, C. familiaris
tctgactctctcatga

SEQ ID NO: 327756 - DNA, 16 bp, C. familiaris
tctgactctctctgtc

SEQ ID NO: 327757 - DNA, 16 bp, C. familiaris
tctgactctgtgtctc

SEQ ID NO: 327758 - DNA, 16 bp, C. familiaris
tctgactttctctctg

SEQ ID NO: 327759 - DNA, 16 bp, C. familiaris
tctgactttggcttgg

SEQ ID NO: 327760 - DNA, 16 bp, C. familiaris
tctgagaacatgacct

SEQ ID NO: 327761 - DNA, 16 bp, C. familiaris
tctgagaactataaaa

SEQ ID NO: 327762 - DNA, 16 bp, C. familiaris
tctgagatggagccct

SEQ ID NO: 327763 - DNA, 16 bp, C. familiaris
tctgagccactcaggc

SEQ ID NO: 327764 - DNA, 16 bp, C. familiaris
tctgagctcagcagag

SEQ ID NO: 327765 - DNA, 16 bp, C. familiaris
tctgagctcagtgtgg

SEQ ID NO: 327766 - DNA, 16 bp, C. familiaris
tctgagcttcatttcc

SEQ ID NO: 327767 - DNA, 17 bp, C. familiaris
tctgagctttctgggca

SEQ ID NO: 327768 - DNA, 16 bp, C. familiaris
tctgagggaaaaaaaa

SEQ ID NO: 327769 - DNA, 16 bp, C. familiaris
tctgagtctatgcatg

SEQ ID NO: 327770 - DNA, 16 bp, C. familiaris
tctgagtggaaaggag

SEQ ID NO: 327771 - DNA, 16 bp, C. familiaris
tctgagtttcagtttt

SEQ ID NO: 327772 - DNA, 16 bp, C. familiaris
tctgataagacatttg

SEQ ID NO: 327773 - DNA, 16 bp, C. familiaris
tctgataagggatttg

SEQ ID NO: 327774 - DNA, 16 bp, C. familiaris
tctgatatttccaccc

SEQ ID NO: 327775 - DNA, 16 bp, C. familiaris
tctgatatttcttccc

SEQ ID NO: 327776 - DNA, 16 bp, C. familiaris
tctgatgccatctcca

SEQ ID NO: 327777 - DNA, 16 bp, C. familiaris
tctgattcagaaggtc

SEQ ID NO: 327778 - DNA, 16 bp, C. familiaris
tctgattctgctttct

SEQ ID NO: 327779 - DNA, 16 bp, C. familiaris
tctgattctgcttttt

SEQ ID NO: 327780 - DNA, 16 bp, C. familiaris
tctgcaaaaagggaga

SEQ ID NO: 327781 - DNA, 16 bp, C. familiaris
tctgcaaaaagtgaaa

SEQ ID NO: 327782 - DNA, 16 bp, C. familiaris
tctgcaaaatgaggaa

SEQ ID NO: 327783 - DNA, 16 bp, C. familiaris
tctgcaaactttttct

SEQ ID NO: 327784 - DNA, 16 bp, C. familiaris
tctgcaaatagtggaa

SEQ ID NO: 327785 - DNA, 16 bp, C. familiaris
tctgcaaatcagtcaa

SEQ ID NO: 327786 - DNA, 16 bp, C. familiaris
tctgcaaatgatatat

SEQ ID NO: 327787 - DNA, 16 bp, C. familiaris
tctgcacagcaaagaa

SEQ ID NO: 327788 - DNA, 16 bp, C. familiaris
tctgcacagcaaagga

SEQ ID NO: 327789 - DNA, 16 bp, C. familiaris
tctgcactaagtgtgg

SEQ ID NO: 327790 - DNA, 16 bp, C. familiaris
tctgcactgagcactg

SEQ ID NO: 327791 - DNA, 16 bp, C. familiaris
tctgcactgagcgtgg

SEQ ID NO: 327792 - DNA, 16 bp, C. familiaris
tctgcagctcctcctg

SEQ ID NO: 327793 - DNA, 16 bp, C. familiaris
tctgcaggaaaaaaaa

SEQ ID NO: 327794 - DNA, 24 bp, C. familiaris
tctgcagggcctggaggctccggg

SEQ ID NO: 327795 - DNA, 16 bp, C. familiaris
tctgcatctaatgaga

SEQ ID NO: 327796 - DNA, 16 bp, C. familiaris
tctgcatgtggctgcc

SEQ ID NO: 327797 - DNA, 16 bp, C. familiaris
tctgcattcagctcag

SEQ ID NO: 327798 - DNA, 16 bp, C. familiaris
tctgcattccaggcag

SEQ ID NO: 327799 - DNA, 16 bp, C. familiaris
tctgcatttctgacaa

SEQ ID NO: 327800 - DNA, 16 bp, C. familiaris
tctgcattttcatttt

SEQ ID NO: 327801 - DNA, 16 bp, C. familiaris
tctgccaactgagcca

SEQ ID NO: 327802 - DNA, 16 bp, C. familiaris
tctgccactgtctctg

SEQ ID NO: 327803 - DNA, 16 bp, C. familiaris
tctgccacttagtagc

SEQ ID NO: 327804 - DNA, 16 bp, C. familiaris
tctgcccaagtctctg

SEQ ID NO: 327805 - DNA, 16 bp, C. familiaris
tctgcccctcacctcc

SEQ ID NO: 327806 - DNA, 16 bp, C. familiaris
tctgcccctccatccc

SEQ ID NO: 327807 - DNA, 16 bp, C. familiaris
tctgcccctccttcac

SEQ ID NO: 327808 - DNA, 16 bp, C. familiaris
tctgcccctggctcag

SEQ ID NO: 327809 - DNA, 16 bp, C. familiaris
tctgcccctgtgtgtg

SEQ ID NO: 327810 - DNA, 16 bp, C. familiaris
tctgccccttcccacc

SEQ ID NO: 327811 - DNA, 16 bp, C. familiaris
tctgccctcagcaggg

SEQ ID NO: 327812 - DNA, 16 bp, C. familiaris
tctgccctcctcccac

SEQ ID NO: 327813 - DNA, 16 bp, C. familiaris
tctgccctgagtgtgg

SEQ ID NO: 327814 - DNA, 16 bp, C. familiaris
tctgcccttcctctca

SEQ ID NO: 327815 - DNA, 16 bp, C. familiaris
tctgcccttgcccctg

SEQ ID NO: 327816 - DNA, 16 bp, C. familiaris
tctgccctttccccca

SEQ ID NO: 327817 - DNA, 16 bp, C. familiaris
tctgcctatgtcgctg

SEQ ID NO: 327818 - DNA, 16 bp, C. familiaris
tctgcctccctgtgtc

SEQ ID NO: 327819 - DNA, 16 bp, C. familiaris
tctgcctctctgctct

SEQ ID NO: 327820 - DNA, 16 bp, C. familiaris
tctgcctctgcctgcc

SEQ ID NO: 327821 - DNA, 16 bp, C. familiaris
tctgcctctgtgctct

SEQ ID NO: 327822 - DNA, 16 bp, C. familiaris
tctgcctcttgatctc

SEQ ID NO: 327823 - DNA, 16 bp, C. familiaris
tctgcctgagattccc

SEQ ID NO: 327824 - DNA, 16 bp, C. familiaris
tctgcctgcctctgcc

SEQ ID NO: 327825 - DNA, 16 bp, C. familiaris
tctgcctgctgctccc

SEQ ID NO: 327826 - DNA, 16 bp, C. familiaris
tctgcctggagtgctc

SEQ ID NO: 327827 - DNA, 16 bp, C. familiaris
tctgcctggggctctg

SEQ ID NO: 327828 - DNA, 16 bp, C. familiaris
tctgcctgtctgcctc

SEQ ID NO: 327829 - DNA, 16 bp, C. familiaris
tctgcctgtgcctcta

SEQ ID NO: 327830 - DNA, 16 bp, C. familiaris
tctgcctgtgtctcca

SEQ ID NO: 327831 - DNA, 16 bp, C. familiaris
tctgcctgtttctgtg

SEQ ID NO: 327832 - DNA, 16 bp, C. familiaris
tctgccttcaccccag

SEQ ID NO: 327833 - DNA, 16 bp, C. familiaris
tctgccttcagccagg

SEQ ID NO: 327834 - DNA, 16 bp, C. familiaris
tctgccttctgtgtct

SEQ ID NO: 327835 - DNA, 16 bp, C. familiaris
tctgccttggcccagg

SEQ ID NO: 327836 - DNA, 16 bp, C. familiaris
tctgcgtgtggctgtc

SEQ ID NO: 327837 - DNA, 16 bp, C. familiaris
tctgcgtgtgtctctc

SEQ ID NO: 327838 - DNA, 16 bp, C. familiaris
tctgctacttaccagc

SEQ ID NO: 327839 - DNA, 16 bp, C. familiaris
tctgctacttactagt

SEQ ID NO: 327840 - DNA, 16 bp, C. familiaris
tctgctcaatttttct

SEQ ID NO: 327841 - DNA, 16 bp, C. familiaris
tctgctcagcgaggag

SEQ ID NO: 327842 - DNA, 16 bp, C. familiaris
tctgctcagcgggaag

SEQ ID NO: 327843 - DNA, 16 bp, C. familiaris
tctgctcaggccatga

SEQ ID NO: 327844 - DNA, 16 bp, C. familiaris
tctgctcaggctgctg

SEQ ID NO: 327845 - DNA, 16 bp, C. familiaris
tctgctcagggagtga

SEQ ID NO: 327846 - DNA, 16 bp, C. familiaris
tctgctcatgcttgct

SEQ ID NO: 327847 - DNA, 16 bp, C. familiaris
tctgctccttcctcca

SEQ ID NO: 327848 - DNA, 16 bp, C. familiaris
tctgctctgtggggag

SEQ ID NO: 327849 - DNA, 16 bp, C. familiaris
tctgctgaaaaatctg

SEQ ID NO: 327850 - DNA, 16 bp, C. familiaris
tctgctgagcaaggag

SEQ ID NO: 327851 - DNA, 16 bp, C. familiaris
tctgctgagctcagag

SEQ ID NO: 327852 - DNA, 16 bp, C. familiaris
tctgctgatggacatc

SEQ ID NO: 327853 - DNA, 16 bp, C. familiaris
tctgctgctcaccctg

SEQ ID NO: 327854 - DNA, 16 bp, C. familiaris
tctgctgctccccttg

SEQ ID NO: 327855 - DNA, 16 bp, C. familiaris
tctgctgctccctgtg

SEQ ID NO: 327856 - DNA, 16 bp, C. familiaris
tctgctgctccttctg

SEQ ID NO: 327857 - DNA, 16 bp, C. familiaris
tctgctgctgctcccc

SEQ ID NO: 327858 - DNA, 16 bp, C. familiaris
tctgctgctgctgctg

SEQ ID NO: 327859 - DNA, 16 bp, C. familiaris
tctgctgctgctgctt

SEQ ID NO: 327860 - DNA, 16 bp, C. familiaris
tctgctgctgcttctg

SEQ ID NO: 327861 - DNA, 16 bp, C. familiaris
tctgctgggagcctgc

SEQ ID NO: 327862 - DNA, 18 bp, C. familiaris
tctgctgggtgtagggtc

SEQ ID NO: 327863 - DNA, 16 bp, C. familiaris
tctgctgtgggtaaaa

SEQ ID NO: 327864 - DNA, 16 bp, C. familiaris
tctgcttaagattctg

SEQ ID NO: 327865 - DNA, 16 bp, C. familiaris
tctgcttcaggattct

SEQ ID NO: 327866 - DNA, 16 bp, C. familiaris
tctgcttcaggttctc

SEQ ID NO: 327867 - DNA, 16 bp, C. familiaris
tctgcttccaagatgg

SEQ ID NO: 327868 - DNA, 16 bp, C. familiaris
tctgcttctcccactt

SEQ ID NO: 327869 - DNA, 16 bp, C. familiaris
tctgcttctcctctgt

SEQ ID NO: 327870 - DNA, 16 bp, C. familiaris
tctgcttctctccctg

SEQ ID NO: 327871 - DNA, 16 bp, C. familiaris
tctgcttctggggaaa

SEQ ID NO: 327872 - DNA, 16 bp, C. familiaris
tctgcttgaaattttc

SEQ ID NO: 327873 - DNA, 16 bp, C. familiaris
tctgcttttggctcag

SEQ ID NO: 327874 - DNA, 16 bp, C. familiaris
tctggaaaaacagtat

SEQ ID NO: 327875 - DNA, 16 bp, C. familiaris
tctggaaaagagaaaa

SEQ ID NO: 327876 - DNA, 16 bp, C. familiaris
tctggaaaatgcaaat

SEQ ID NO: 327877 - DNA, 16 bp, C. familiaris
tctggaaagaaaaaga

SEQ ID NO: 327878 - DNA, 16 bp, C. familiaris
tctggaaagaacacaa

SEQ ID NO: 327879 - DNA, 16 bp, C. familiaris
tctggaaagagaaaag

SEQ ID NO: 327880 - DNA, 16 bp, C. familiaris
tctggaaatcagtatg

SEQ ID NO: 327881 - DNA, 16 bp, C. familiaris
tctggaaattaaaaaa

SEQ ID NO: 327882 - DNA, 16 bp, C. familiaris
tctggaaccaaaccca

SEQ ID NO: 327883 - DNA, 16 bp, C. familiaris
tctggaagagattgtg

SEQ ID NO: 327884 - DNA, 16 bp, C. familiaris
tctggacattgccaaa

SEQ ID NO: 327885 - DNA, 16 bp, C. familiaris
tctggaccccaggatc

SEQ ID NO: 327886 - DNA, 18 bp, C. familiaris
tctggacctctgtccctt

SEQ ID NO: 327887 - DNA, 16 bp, C. familiaris
tctggagactgagaag

SEQ ID NO: 327888 - DNA, 16 bp, C. familiaris
tctggagctgaagaat

SEQ ID NO: 327889 - DNA, 16 bp, C. familiaris
tctggaggacagaagt

SEQ ID NO: 327890 - DNA, 16 bp, C. familiaris
tctggaggccagaagt

SEQ ID NO: 327891 - DNA, 16 bp, C. familiaris
tctggaggctccaggg

SEQ ID NO: 327892 - DNA, 16 bp, C. familiaris
tctggaggctggagtc

SEQ ID NO: 327893 - DNA, 16 bp, C. familiaris
tctggaggcttcttca

SEQ ID NO: 327894 - DNA, 16 bp, C. familiaris
tctggagtgatggaaa

SEQ ID NO: 327895 - DNA, 16 bp, C. familiaris
tctggatatattttga

SEQ ID NO: 327896 - DNA, 16 bp, C. familiaris
tctggatcatgacctg

SEQ ID NO: 327897 - DNA, 16 bp, C. familiaris
tctggattttatttat

SEQ ID NO: 327898 - DNA, 16 bp, C. familiaris
tctggcacagagcttc

SEQ ID NO: 327899 - DNA, 16 bp, C. familiaris
tctggcagcctgggtg

SEQ ID NO: 327900 - DNA, 17 bp, C. familiaris
tctggcattgggatgcc

SEQ ID NO: 327901 - DNA, 16 bp, C. familiaris
tctggccccagctctg

SEQ ID NO: 327902 - DNA, 16 bp, C. familiaris
tctggccctctctctc

SEQ ID NO: 327903 - DNA, 17 bp, C. familiaris
tctggccttccaggtct

SEQ ID NO: 327904 - DNA, 16 bp, C. familiaris
tctggctccagaatct

SEQ ID NO: 327905 - DNA, 16 bp, C. familiaris
tctggctcctggtgca

SEQ ID NO: 327906 - DNA, 16 bp, C. familiaris
tctggctctctccctc

SEQ ID NO: 327907 - DNA, 16 bp, C. familiaris
tctggctgctgtgtag

SEQ ID NO: 327908 - DNA, 16 bp, C. familiaris
tctggcttcttccact

SEQ ID NO: 327909 - DNA, 16 bp, C. familiaris
tctggctttatttatt

SEQ ID NO: 327910 - DNA, 16 bp, C. familiaris
tctgggaaacaaacta

SEQ ID NO: 327911 - DNA, 16 bp, C. familiaris
tctgggaaatgatcaa

SEQ ID NO: 327912 - DNA, 16 bp, C. familiaris
tctgggaaattttctt

SEQ ID NO: 327913 - DNA, 16 bp, C. familiaris
tctgggaagaatccag

SEQ ID NO: 327914 - DNA, 16 bp, C. familiaris
tctgggacaatttgag

SEQ ID NO: 327915 - DNA, 16 bp, C. familiaris
tctgggacacctaggt

SEQ ID NO: 327916 - DNA, 16 bp, C. familiaris
tctgggagaaaatatt

SEQ ID NO: 327917 - DNA, 16 bp, C. familiaris
tctgggaggaaaaaaa

SEQ ID NO: 327918 - DNA, 16 bp, C. familiaris
tctgggaggctcagtg

SEQ ID NO: 327919 - DNA, 16 bp, C. familiaris
tctgggaggctcagtt

SEQ ID NO: 327920 - DNA, 16 bp, C. familiaris
tctgggatcaagcccc

SEQ ID NO: 327921 - DNA, 16 bp, C. familiaris
tctgggattccaggat

SEQ ID NO: 327922 - DNA, 16 bp, C. familiaris
tctgggccaggccctg

SEQ ID NO: 327923 - DNA, 16 bp, C. familiaris
tctgggctgggcatgg

SEQ ID NO: 327924 - DNA, 16 bp, C. familiaris
tctggggaaggggcct

SEQ ID NO: 327925 - DNA, 16 bp, C. familiaris
tctgggggcagccccg

SEQ ID NO: 327926 - DNA, 16 bp, C. familiaris
tctgggggcgcctggc

SEQ ID NO: 327927 - DNA, 16 bp, C. familiaris
tctgggggctctgggg

SEQ ID NO: 327928 - DNA, 16 bp, C. familiaris
tctggggggaaaaaaa

SEQ ID NO: 327929 - DNA, 16 bp, C. familiaris
tctggggggcacctgg

SEQ ID NO: 327930 - DNA, 16 bp, C. familiaris
tctggttgagaaccac

SEQ ID NO: 327931 - DNA, 16 bp, C. familiaris
tctggttttgttatta

SEQ ID NO: 327932 - DNA, 16 bp, C. familiaris
tctgtaaaaaatgttg

SEQ ID NO: 327933 - DNA, 16 bp, C. familiaris
tctgtaaatgacaaaa

SEQ ID NO: 327934 - DNA, 16 bp, C. familiaris
tctgtaaatttaaaat

SEQ ID NO: 327935 - DNA, 16 bp, C. familiaris
tctgtaaggaggatgg

SEQ ID NO: 327936 - DNA, 16 bp, C. familiaris
tctgtactcagtgtgg

SEQ ID NO: 327937 - DNA, 16 bp, C. familiaris
tctgtattttttaaaa

SEQ ID NO: 327938 - DNA, 16 bp, C. familiaris
tctgtcagataaataa

SEQ ID NO: 327939 - DNA, 16 bp, C. familiaris
tctgtcatgaaaaaat

SEQ ID NO: 327940 - DNA, 16 bp, C. familiaris
tctgtcatttgctgaa

SEQ ID NO: 327941 - DNA, 16 bp, C. familiaris
tctgtccctccacccc

SEQ ID NO: 327942 - DNA, 16 bp, C. familiaris
tctgtccctccccatc

SEQ ID NO: 327943 - DNA, 16 bp, C. familiaris
tctgtccctcccccag

SEQ ID NO: 327944 - DNA, 16 bp, C. familiaris
tctgtcctcaaggagc

SEQ ID NO: 327945 - DNA, 16 bp, C. familiaris
tctgtctcagtttcct

SEQ ID NO: 327946 - DNA, 16 bp, C. familiaris
tctgtctccctcactg

SEQ ID NO: 327947 - DNA, 16 bp, C. familiaris
tctgtctccctctgcc

SEQ ID NO: 327948 - DNA, 16 bp, C. familiaris
tctgtctctctccaaa

SEQ ID NO: 327949 - DNA, 16 bp, C. familiaris
tctgtctctgtgtcca

SEQ ID NO: 327950 - DNA, 16 bp, C. familiaris
tctgtctgcccctcct

SEQ ID NO: 327951 - DNA, 16 bp, C. familiaris
tctgtctgcctttggt

SEQ ID NO: 327952 - DNA, 16 bp, C. familiaris
tctgtctgtccatcca

SEQ ID NO: 327953 - DNA, 16 bp, C. familiaris
tctgtctgtctctccc

SEQ ID NO: 327954 - DNA, 16 bp, C. familiaris
tctgtcttcaggtcag

SEQ ID NO: 327955 - DNA, 16 bp, C. familiaris
tctgtctttatgattt

SEQ ID NO: 327956 - DNA, 16 bp, C. familiaris
tctgtctttcatggat

SEQ ID NO: 327957 - DNA, 16 bp, C. familiaris
tctgtgaaaaatgatg

SEQ ID NO: 327958 - DNA, 16 bp, C. familiaris
tctgtgaacatttgtg

SEQ ID NO: 327959 - DNA, 16 bp, C. familiaris
tctgtgaagaggtctg

SEQ ID NO: 327960 - DNA, 16 bp, C. familiaris
tctgtgaagtttctgt

SEQ ID NO: 327961 - DNA, 16 bp, C. familiaris
tctgtgactatcaaaa

SEQ ID NO: 327962 - DNA, 16 bp, C. familiaris
tctgtgactgtcacaa

SEQ ID NO: 327963 - DNA, 16 bp, C. familiaris
tctgtgacttacttat

SEQ ID NO: 327964 - DNA, 16 bp, C. familiaris
tctgtgagaaatgctg

SEQ ID NO: 327965 - DNA, 16 bp, C. familiaris
tctgtgcaaggagccc

SEQ ID NO: 327966 - DNA, 16 bp, C. familiaris
tctgtgccaggcactg

SEQ ID NO: 327967 - DNA, 16 bp, C. familiaris
tctgtgcccagcatgg

SEQ ID NO: 327968 - DNA, 16 bp, C. familiaris
tctgtgcctcttatga

SEQ ID NO: 327969 - DNA, 16 bp, C. familiaris
tctgtgcctttgctca

SEQ ID NO: 327970 - DNA, 16 bp, C. familiaris
tctgtgctcagcatgg

SEQ ID NO: 327971 - DNA, 16 bp, C. familiaris
tctgtgctcagctggg

SEQ ID NO: 327972 - DNA, 16 bp, C. familiaris
tctgtgctcagtgaga

SEQ ID NO: 327973 - DNA, 16 bp, C. familiaris
tctgtgctcagtggga

SEQ ID NO: 327974 - DNA, 16 bp, C. familiaris
tctgtgctgagcgcag

SEQ ID NO: 327975 - DNA, 16 bp, C. familiaris
tctgtgctgagtgtgg

SEQ ID NO: 327976 - DNA, 16 bp, C. familiaris
tctgtgctgtccaata

SEQ ID NO: 327977 - DNA, 16 bp, C. familiaris
tctgtgcttctcatga

SEQ ID NO: 327978 - DNA, 16 bp, C. familiaris
tctgtggaaggagcct

SEQ ID NO: 327979 - DNA, 16 bp, C. familiaris
tctgtggattttattt

SEQ ID NO: 327980 - DNA, 16 bp, C. familiaris
tctgtggctgcttttg

SEQ ID NO: 327981 - DNA, 16 bp, C. familiaris
tctgtgggttggctgg

SEQ ID NO: 327982 - DNA, 16 bp, C. familiaris
tctgtgtcactgcctc

SEQ ID NO: 327983 - DNA, 16 bp, C. familiaris
tctgtgtctcaagaat

SEQ ID NO: 327984 - DNA, 16 bp, C. familiaris
tctgtgtctgtgtgtg

SEQ ID NO: 327985 - DNA, 16 bp, C. familiaris
tctgtgtctttgtgtc

SEQ ID NO: 327986 - DNA, 16 bp, C. familiaris
tctgtgtcttttgtga

SEQ ID NO: 327987 - DNA, 16 bp, C. familiaris
tctgtgttgtgtctct

SEQ ID NO: 327988 - DNA, 16 bp, C. familiaris
tctgtgtttctcaaga

SEQ ID NO: 327989 - DNA, 16 bp, C. familiaris
tctgttacattaaaat

SEQ ID NO: 327990 - DNA, 16 bp, C. familiaris
tctgttcatttaaaaa

SEQ ID NO: 327991 - DNA, 16 bp, C. familiaris
tctgttccaggatcct

SEQ ID NO: 327992 - DNA, 16 bp, C. familiaris
tctgttccagttttgg

SEQ ID NO: 327993 - DNA, 16 bp, C. familiaris
tctgttcgtgtcttct

SEQ ID NO: 327994 - DNA, 16 bp, C. familiaris
tctgttctgaatgaca

SEQ ID NO: 327995 - DNA, 16 bp, C. familiaris
tctgttgaaaaatctg

SEQ ID NO: 327996 - DNA, 16 bp, C. familiaris
tctgttgatggacacc

SEQ ID NO: 327997 - DNA, 16 bp, C. familiaris
tctgttggttgagtgt

SEQ ID NO: 327998 - DNA, 16 bp, C. familiaris
tctgttgtgcccaaga

SEQ ID NO: 327999 - DNA, 16 bp, C. familiaris
tctgtttaaaaaaaaa

SEQ ID NO: 328000 - DNA, 16 bp, C. familiaris
tctgtttaggttttct

SEQ ID NO: 328001 - DNA, 16 bp, C. familiaris
tctgtttcaaggactt

SEQ ID NO: 328002 - DNA, 16 bp, C. familiaris
tctgtttcatttctct

SEQ ID NO: 328003 - DNA, 16 bp, C. familiaris
tctgtttcttaaaaat

SEQ ID NO: 328004 - DNA, 16 bp, C. familiaris
tctgtttgagtccctg

SEQ ID NO: 328005 - DNA, 16 bp, C. familiaris
tctgttttactgttct

SEQ ID NO: 328006 - DNA, 16 bp, C. familiaris
tctgttttcatcttct

SEQ ID NO: 328007 - DNA, 16 bp, C. familiaris
tctgttttgtgccagt

SEQ ID NO: 328008 - DNA, 16 bp, C. familiaris
tctgttttgtgtctta

SEQ ID NO: 328009 - DNA, 16 bp, C. familiaris
tctgttttgttcatta

SEQ ID NO: 328010 - DNA, 16 bp, C. familiaris
tcttaaaaaagaacaa

SEQ ID NO: 328011 - DNA, 16 bp, C. familiaris
tcttaaaaagaagaaa

SEQ ID NO: 328012 - DNA, 16 bp, C. familiaris
tcttaaaagaaaaaca

SEQ ID NO: 328013 - DNA, 16 bp, C. familiaris
tcttaaaagagaaaaa

SEQ ID NO: 328014 - DNA, 16 bp, C. familiaris
tcttaaaaggaaaaag

SEQ ID NO: 328015 - DNA, 16 bp, C. familiaris
tcttaaacttttaaaa

SEQ ID NO: 328016 - DNA, 16 bp, C. familiaris
tcttaaagaagaaaaa

SEQ ID NO: 328017 - DNA, 16 bp, C. familiaris
tcttaaagatttcatt

SEQ ID NO: 328018 - DNA, 16 bp, C. familiaris
tcttaaaggattttat

SEQ ID NO: 328019 - DNA, 16 bp, C. familiaris
tcttaaatcctttatg

SEQ ID NO: 328020 - DNA, 16 bp, C. familiaris
tcttaactctgggaaa

SEQ ID NO: 328021 - DNA, 16 bp, C. familiaris
tcttaagaaagaaaaa

SEQ ID NO: 328022 - DNA, 16 bp, C. familiaris
tcttaagatttttatt

SEQ ID NO: 328023 - DNA, 16 bp, C. familiaris
tcttacaccatacaga

SEQ ID NO: 328024 - DNA, 16 bp, C. familiaris
tcttacagttttattt

SEQ ID NO: 328025 - DNA, 16 bp, C. familiaris
tcttactgatttattt

SEQ ID NO: 328026 - DNA, 16 bp, C. familiaris
tcttagaagaaaaata

SEQ ID NO: 328027 - DNA, 16 bp, C. familiaris
tcttagcagctttcaa

SEQ ID NO: 328028 - DNA, 16 bp, C. familiaris
tcttaggagaaaaaaa

SEQ ID NO: 328029 - DNA, 16 bp, C. familiaris
tcttatgaacatagat

SEQ ID NO: 328030 - DNA, 16 bp, C. familiaris
tcttatgaccctgaga

SEQ ID NO: 328031 - DNA, 16 bp, C. familiaris
tcttatgggactgagc

SEQ ID NO: 328032 - DNA, 16 bp, C. familiaris
tcttcaaaaaaaattt

SEQ ID NO: 328033 - DNA, 16 bp, C. familiaris
tcttcaaaaagaaaag

SEQ ID NO: 328034 - DNA, 16 bp, C. familiaris
tcttcaaagaaaaaaa

SEQ ID NO: 328035 - DNA, 16 bp, C. familiaris
tcttcaatcaatggtg

SEQ ID NO: 328036 - DNA, 16 bp, C. familiaris
tcttcactgagcagga

SEQ ID NO: 328037 - DNA, 16 bp, C. familiaris
tcttcagaatcatcta

SEQ ID NO: 328038 - DNA, 16 bp, C. familiaris
tcttcaggatcatacc

SEQ ID NO: 328039 - DNA, 16 bp, C. familiaris
tcttcaggctcattgt

SEQ ID NO: 328040 - DNA, 16 bp, C. familiaris
tcttcatcaccatcat

SEQ ID NO: 328041 - DNA, 16 bp, C. familiaris
tcttcatcatcatcac

SEQ ID NO: 328042 - DNA, 16 bp, C. familiaris
tcttcatcatcatcat

SEQ ID NO: 328043 - DNA, 16 bp, C. familiaris
tcttcatcatcatctt

SEQ ID NO: 328044 - DNA, 16 bp, C. familiaris
tcttcatcatcttcat

SEQ ID NO: 328045 - DNA, 16 bp, C. familiaris
tcttcatctttgtctt

SEQ ID NO: 328046 - DNA, 16 bp, C. familiaris
tcttcattaaatgttt

SEQ ID NO: 328047 - DNA, 16 bp, C. familiaris
tcttcatttctgaaat

SEQ ID NO: 328048 - DNA, 16 bp, C. familiaris
tcttcattttcaagat

SEQ ID NO: 328049 - DNA, 16 bp, C. familiaris
tcttcatttttcagtt

SEQ ID NO: 328050 - DNA, 16 bp, C. familiaris
tcttccacaaatattt

SEQ ID NO: 328051 - DNA, 16 bp, C. familiaris
tcttccacatcctcac

SEQ ID NO: 328052 - DNA, 16 bp, C. familiaris
tcttccagaaaataaa

SEQ ID NO: 328053 - DNA, 16 bp, C. familiaris
tcttccagaaagcctt

SEQ ID NO: 328054 - DNA, 16 bp, C. familiaris
tcttccagttctggag

SEQ ID NO: 328055 - DNA, 16 bp, C. familiaris
tcttccagtttcttct

SEQ ID NO: 328056 - DNA, 16 bp, C. familiaris
tcttcccatccatgaa

SEQ ID NO: 328057 - DNA, 16 bp, C. familiaris
tcttccccccaaaaaa

SEQ ID NO: 328058 - DNA, 16 bp, C. familiaris
tcttcccctgcttgtg

SEQ ID NO: 328059 - DNA, 16 bp, C. familiaris
tcttccctttttaaaa

SEQ ID NO: 328060 - DNA, 16 bp, C. familiaris
tcttcctctacctgtg

SEQ ID NO: 328061 - DNA, 16 bp, C. familiaris
tcttcctctccctgtg

SEQ ID NO: 328062 - DNA, 16 bp, C. familiaris
tcttcctctgccattc

SEQ ID NO: 328063 - DNA, 16 bp, C. familiaris
tcttcctctgtctgtg

SEQ ID NO: 328064 - DNA, 16 bp, C. familiaris
tcttcctgctcatgct

SEQ ID NO: 328065 - DNA, 16 bp, C. familiaris
tcttcctgcttgtgct

SEQ ID NO: 328066 - DNA, 16 bp, C. familiaris
tcttccttcagttcag

SEQ ID NO: 328067 - DNA, 16 bp, C. familiaris
tcttccttgaagaaat

SEQ ID NO: 328068 - DNA, 16 bp, C. familiaris
tcttccttttcccagt

SEQ ID NO: 328069 - DNA, 16 bp, C. familiaris
tcttccttttgtggtg

SEQ ID NO: 328070 - DNA, 16 bp, C. familiaris
tcttctcaagtataca

SEQ ID NO: 328071 - DNA, 16 bp, C. familiaris
tcttctcccactctgt

SEQ ID NO: 328072 - DNA, 16 bp, C. familiaris
tcttctccctcattta

SEQ ID NO: 328073 - DNA, 16 bp, C. familiaris
tcttctcctgcttggt

SEQ ID NO: 328074 - DNA, 16 bp, C. familiaris
tcttctctgatcttta

SEQ ID NO: 328075 - DNA, 16 bp, C. familiaris
tcttctctttcaatat

SEQ ID NO: 328076 - DNA, 16 bp, C. familiaris
tcttctgcagcttctt

SEQ ID NO: 328077 - DNA, 16 bp, C. familiaris
tcttctgcatctattg

SEQ ID NO: 328078 - DNA, 16 bp, C. familiaris
tcttctgcttcattgt

SEQ ID NO: 328079 - DNA, 16 bp, C. familiaris
tcttctgggactccca

SEQ ID NO: 328080 - DNA, 16 bp, C. familiaris
tcttctggtctgtatt

SEQ ID NO: 328081 - DNA, 16 bp, C. familiaris
tcttctgtccattttt

SEQ ID NO: 328082 - DNA, 16 bp, C. familiaris
tcttctgttccaggat

SEQ ID NO: 328083 - DNA, 16 bp, C. familiaris
tcttctgttctattga

SEQ ID NO: 328084 - DNA, 16 bp, C. familiaris
tcttcttcatttctga

SEQ ID NO: 328085 - DNA, 16 bp, C. familiaris
tcttcttctgggactc

SEQ ID NO: 328086 - DNA, 16 bp, C. familiaris
tcttcttctgggactt

SEQ ID NO: 328087 - DNA, 16 bp, C. familiaris
tcttctttaaaccttt

SEQ ID NO: 328088 - DNA, 16 bp, C. familiaris
tcttctttagaaaaat

SEQ ID NO: 328089 - DNA, 16 bp, C. familiaris
tcttctttgatccatg

SEQ ID NO: 328090 - DNA, 16 bp, C. familiaris
tcttctttgatgaaat

SEQ ID NO: 328091 - DNA, 16 bp, C. familiaris
tcttctttggaagaat

SEQ ID NO: 328092 - DNA, 16 bp, C. familiaris
tcttctttggtgaaat

SEQ ID NO: 328093 - DNA, 16 bp, C. familiaris
tcttgaaaaaggacaa

SEQ ID NO: 328094 - DNA, 16 bp, C. familiaris
tcttgaaaatgaagaa

SEQ ID NO: 328095 - DNA, 16 bp, C. familiaris
tcttgaagaaatattt

SEQ ID NO: 328096 - DNA, 16 bp, C. familiaris
tcttgaagaagaagaa

SEQ ID NO: 328097 - DNA, 16 bp, C. familiaris
tcttgaccaagcagcg

SEQ ID NO: 328098 - DNA, 16 bp, C. familiaris
tcttgaggaacctcca

SEQ ID NO: 328099 - DNA, 16 bp, C. familiaris
tcttgatctcagaatt

SEQ ID NO: 328100 - DNA, 16 bp, C. familiaris
tcttgatctcagctca

SEQ ID NO: 328101 - DNA, 16 bp, C. familiaris
tcttgatgaccatagc

SEQ ID NO: 328102 - DNA, 16 bp, C. familiaris
tcttgatggacacttg

SEQ ID NO: 328103 - DNA, 16 bp, C. familiaris
tcttgattgtgatgat

SEQ ID NO: 328104 - DNA, 16 bp, C. familiaris
tcttgattttgacttg

SEQ ID NO: 328105 - DNA, 16 bp, C. familiaris
tcttgattttgattca

SEQ ID NO: 328106 - DNA, 17 bp, C. familiaris
tcttgcaagaagctact

SEQ ID NO: 328107 - DNA, 16 bp, C. familiaris
tcttgcattttcattt

SEQ ID NO: 328108 - DNA, 16 bp, C. familiaris
tcttgccaagagaatt

SEQ ID NO: 328109 - DNA, 16 bp, C. familiaris
tcttgcccatttcatg

SEQ ID NO: 328110 - DNA, 16 bp, C. familiaris
tcttgcctccagaact

SEQ ID NO: 328111 - DNA, 16 bp, C. familiaris
tcttgcctcttgctgc

SEQ ID NO: 328112 - DNA, 16 bp, C. familiaris
tcttgctctgcccctc

SEQ ID NO: 328113 - DNA, 16 bp, C. familiaris
tcttggaaattaaaaa

SEQ ID NO: 328114 - DNA, 16 bp, C. familiaris
tcttggacttcccaac

SEQ ID NO: 328115 - DNA, 16 bp, C. familiaris
tcttggactttcagcc

SEQ ID NO: 328116 - DNA, 16 bp, C. familiaris
tcttggagatggagga

SEQ ID NO: 328117 - DNA, 16 bp, C. familiaris
tcttggaggaaaaaaa

SEQ ID NO: 328118 - DNA, 16 bp, C. familiaris
tcttggccatcagctt

SEQ ID NO: 328119 - DNA, 16 bp, C. familiaris
tcttggctgctgtaaa

SEQ ID NO: 328120 - DNA, 16 bp, C. familiaris
tcttggcttttgtgaa

SEQ ID NO: 328121 - DNA, 16 bp, C. familiaris
tcttgggagttttttg

SEQ ID NO: 328122 - DNA, 16 bp, C. familiaris
tcttgggatccaggat

SEQ ID NO: 328123 - DNA, 16 bp, C. familiaris
tcttggggcccctggg

SEQ ID NO: 328124 - DNA, 16 bp, C. familiaris
tcttggggtgctggga

SEQ ID NO: 328125 - DNA, 16 bp, C. familiaris
tcttggtaatgatttt

SEQ ID NO: 328126 - DNA, 16 bp, C. familiaris
tcttggtcttggtctt

SEQ ID NO: 328127 - DNA, 16 bp, C. familiaris
tcttggtgtcttcctc

SEQ ID NO: 328128 - DNA, 16 bp, C. familiaris
tcttggttcaggtcat

SEQ ID NO: 328129 - DNA, 16 bp, C. familiaris
tcttgtctcatggagt

SEQ ID NO: 328130 - DNA, 16 bp, C. familiaris
tcttgtggagaatttt

SEQ ID NO: 328131 - DNA, 16 bp, C. familiaris
tcttgtgtgccaggca

SEQ ID NO: 328132 - DNA, 16 bp, C. familiaris
tctttaaaaaaaaagg

SEQ ID NO: 328133 - DNA, 16 bp, C. familiaris
tctttaaaaaacaaga

SEQ ID NO: 328134 - DNA, 16 bp, C. familiaris
tctttaaaaaacacaa

SEQ ID NO: 328135 - DNA, 16 bp, C. familiaris
tctttaaaaaagaaat

SEQ ID NO: 328136 - DNA, 16 bp, C. familiaris
tctttaaaaaaggttt

SEQ ID NO: 328137 - DNA, 16 bp, C. familiaris
tctttaaaaaatatca

SEQ ID NO: 328138 - DNA, 16 bp, C. familiaris
tctttaaaaaggaaag

SEQ ID NO: 328139 - DNA, 16 bp, C. familiaris
tctttaaaaatagaag

SEQ ID NO: 328140 - DNA, 16 bp, C. familiaris
tctttaaaacacaaaa

SEQ ID NO: 328141 - DNA, 16 bp, C. familiaris
tctttaaaagaaaaca

SEQ ID NO: 328142 - DNA, 16 bp, C. familiaris
tctttaaagaaaagaa

SEQ ID NO: 328143 - DNA, 16 bp, C. familiaris
tctttaaagaaatttt

SEQ ID NO: 328144 - DNA, 16 bp, C. familiaris
tctttaacaaaacaaa

SEQ ID NO: 328145 - DNA, 16 bp, C. familiaris
tctttaatgcattttg

SEQ ID NO: 328146 - DNA, 16 bp, C. familiaris
tctttactcaaatgtc

SEQ ID NO: 328147 - DNA, 16 bp, C. familiaris
tctttactgatatttt

SEQ ID NO: 328148 - DNA, 16 bp, C. familiaris
tctttagagatcttgg

SEQ ID NO: 328149 - DNA, 16 bp, C. familiaris
tctttaggtctaaaat

SEQ ID NO: 328150 - DNA, 16 bp, C. familiaris
tctttatacccaacat

SEQ ID NO: 328151 - DNA, 16 bp, C. familiaris
tctttatcaattcatc

SEQ ID NO: 328152 - DNA, 16 bp, C. familiaris
tctttatctctcacta

SEQ ID NO: 328153 - DNA, 16 bp, C. familiaris
tctttatctttggctt

SEQ ID NO: 328154 - DNA, 16 bp, C. familiaris
tctttattgatattct

SEQ ID NO: 328155 - DNA, 16 bp, C. familiaris
tctttattggtgaatt

SEQ ID NO: 328156 - DNA, 16 bp, C. familiaris
tctttcaaaaaaacaa

SEQ ID NO: 328157 - DNA, 16 bp, C. familiaris
tctttcaaaaaattga

SEQ ID NO: 328158 - DNA, 16 bp, C. familiaris
tctttcaaaagatttt

SEQ ID NO: 328159 - DNA, 16 bp, C. familiaris
tctttcaacaaataat

SEQ ID NO: 328160 - DNA, 16 bp, C. familiaris
tctttcaacagatgaa

SEQ ID NO: 328161 - DNA, 16 bp, C. familiaris
tctttcacctccttag

SEQ ID NO: 328162 - DNA, 16 bp, C. familiaris
tctttcatcagaattt

SEQ ID NO: 328163 - DNA, 16 bp, C. familiaris
tctttcatctctttgg

SEQ ID NO: 328164 - DNA, 16 bp, C. familiaris
tctttcattctttctg

SEQ ID NO: 328165 - DNA, 16 bp, C. familiaris
tctttcatttccttgg

SEQ ID NO: 328166 - DNA, 16 bp, C. familiaris
tctttccaaagaacca

SEQ ID NO: 328167 - DNA, 16 bp, C. familiaris
tctttccaaagagctt

SEQ ID NO: 328168 - DNA, 16 bp, C. familiaris
tctttccatggacacc

SEQ ID NO: 328169 - DNA, 16 bp, C. familiaris
tctttcctttctttga

SEQ ID NO: 328170 - DNA, 16 bp, C. familiaris
tctttctcaaaagaaa

SEQ ID NO: 328171 - DNA, 16 bp, C. familiaris
tctttctcaaacaaat

SEQ ID NO: 328172 - DNA, 16 bp, C. familiaris
tctttctccaaaaaaa

SEQ ID NO: 328173 - DNA, 16 bp, C. familiaris
tctttctccagcttct

SEQ ID NO: 328174 - DNA, 16 bp, C. familiaris
tctttctccatcttca

SEQ ID NO: 328175 - DNA, 16 bp, C. familiaris
tctttctctcaaaaga

SEQ ID NO: 328176 - DNA, 16 bp, C. familiaris
tctttctctctccaaa

SEQ ID NO: 328177 - DNA, 16 bp, C. familiaris
tctttctctctctcag

SEQ ID NO: 328178 - DNA, 16 bp, C. familiaris
tctttctctgaatttt

SEQ ID NO: 328179 - DNA, 16 bp, C. familiaris
tctttctctgtcatga

SEQ ID NO: 328180 - DNA, 16 bp, C. familiaris
tctttctctgtgtgtg

SEQ ID NO: 328181 - DNA, 16 bp, C. familiaris
tctttctgactccaaa

SEQ ID NO: 328182 - DNA, 16 bp, C. familiaris
tctttctgttaaaaaa

SEQ ID NO: 328183 - DNA, 16 bp, C. familiaris
tctttcttcaaatatt

SEQ ID NO: 328184 - DNA, 16 bp, C. familiaris
tctttctttaaagaaa

SEQ ID NO: 328185 - DNA, 16 bp, C. familiaris
tctttctttctcatgg

SEQ ID NO: 328186 - DNA, 16 bp, C. familiaris
tctttctttcttcaaa

SEQ ID NO: 328187 - DNA, 16 bp, C. familiaris
tctttctttcttggat

SEQ ID NO: 328188 - DNA, 16 bp, C. familiaris
tctttctttttagaaa

SEQ ID NO: 328189 - DNA, 16 bp, C. familiaris
tctttctttttgaaaa

SEQ ID NO: 328190 - DNA, 16 bp, C. familiaris
tctttcttttttaaga

SEQ ID NO: 328191 - DNA, 16 bp, C. familiaris
tctttgaaaaaataat

SEQ ID NO: 328192 - DNA, 16 bp, C. familiaris
tctttgaaaacaaaat

SEQ ID NO: 328193 - DNA, 16 bp, C. familiaris
tctttgaaaacatcaa

SEQ ID NO: 328194 - DNA, 16 bp, C. familiaris
tctttgaaaagaccaa

SEQ ID NO: 328195 - DNA, 16 bp, C. familiaris
tctttgaaaataaaat

SEQ ID NO: 328196 - DNA, 16 bp, C. familiaris
tctttgaaaatacaaa

SEQ ID NO: 328197 - DNA, 16 bp, C. familiaris
tctttgaaagaaatta

SEQ ID NO: 328198 - DNA, 16 bp, C. familiaris
tctttgaaatttgcaa

SEQ ID NO: 328199 - DNA, 16 bp, C. familiaris
tctttgaagaaaatat

SEQ ID NO: 328200 - DNA, 16 bp, C. familiaris
tctttgagaaaaaaaa

SEQ ID NO: 328201 - DNA, 16 bp, C. familiaris
tctttgagggcaagga

SEQ ID NO: 328202 - DNA, 16 bp, C. familiaris
tctttgagtctctcat

SEQ ID NO: 328203 - DNA, 16 bp, C. familiaris
tctttgatttcttcat

SEQ ID NO: 328204 - DNA, 16 bp, C. familiaris
tctttgatttcttggt

SEQ ID NO: 328205 - DNA, 16 bp, C. familiaris
tctttgcccatttctt

SEQ ID NO: 328206 - DNA, 16 bp, C. familiaris
tctttgcctctgtgtc

SEQ ID NO: 328207 - DNA, 16 bp, C. familiaris
tctttgcctgcctctc

SEQ ID NO: 328208 - DNA, 16 bp, C. familiaris
tctttgccttttccag

SEQ ID NO: 328209 - DNA, 16 bp, C. familiaris
tctttggaaaaaatat

SEQ ID NO: 328210 - DNA, 16 bp, C. familiaris
tctttggaagaattaa

SEQ ID NO: 328211 - DNA, 17 bp, C. familiaris
tctttggagaaaggtct

SEQ ID NO: 328212 - DNA, 16 bp, C. familiaris
tctttggagaaatctc

SEQ ID NO: 328213 - DNA, 16 bp, C. familiaris
tctttggagaatgtct

SEQ ID NO: 328214 - DNA, 16 bp, C. familiaris
tctttggagaattgtc

SEQ ID NO: 328215 - DNA, 16 bp, C. familiaris
tctttgggctccctct

SEQ ID NO: 328216 - DNA, 16 bp, C. familiaris
tctttggggaaaatac

SEQ ID NO: 328217 - DNA, 16 bp, C. familiaris
tctttggggagccatt

SEQ ID NO: 328218 - DNA, 16 bp, C. familiaris
tctttgtggttttaaa

SEQ ID NO: 328219 - DNA, 16 bp, C. familiaris
tctttgtggttttaat

SEQ ID NO: 328220 - DNA, 16 bp, C. familiaris
tctttgtggttttgat

SEQ ID NO: 328221 - DNA, 16 bp, C. familiaris
tctttgtgtatgctgt

SEQ ID NO: 328222 - DNA, 16 bp, C. familiaris
tctttgtgtctgtcat

SEQ ID NO: 328223 - DNA, 16 bp, C. familiaris
tcttttaaaaatacaa

SEQ ID NO: 328224 - DNA, 16 bp, C. familiaris
tcttttaaaaatgctg

SEQ ID NO: 328225 - DNA, 16 bp, C. familiaris
tcttttaaaagattaa

SEQ ID NO: 328226 - DNA, 16 bp, C. familiaris
tcttttaccaatacca

SEQ ID NO: 328227 - DNA, 16 bp, C. familiaris
tcttttagaaaaaaaa

SEQ ID NO: 328228 - DNA, 16 bp, C. familiaris
tcttttcatgtacctg

SEQ ID NO: 328229 - DNA, 16 bp, C. familiaris
tcttttccaaaattgt

SEQ ID NO: 328230 - DNA, 16 bp, C. familiaris
tcttttccaattagtg

SEQ ID NO: 328231 - DNA, 16 bp, C. familiaris
tcttttccagaatgtc

SEQ ID NO: 328232 - DNA, 16 bp, C. familiaris
tcttttccttctggga

SEQ ID NO: 328233 - DNA, 16 bp, C. familiaris
tcttttctgaccacat

SEQ ID NO: 328234 - DNA, 16 bp, C. familiaris
tcttttctttctcaaa

SEQ ID NO: 328235 - DNA, 16 bp, C. familiaris
tcttttgctgggcaga

SEQ ID NO: 328236 - DNA, 16 bp, C. familiaris
tcttttggaaaaaaaa

SEQ ID NO: 328237 - DNA, 16 bp, C. familiaris
tcttttggaaaaaata

SEQ ID NO: 328238 - DNA, 16 bp, C. familiaris
tcttttggtctctatt

SEQ ID NO: 328239 - DNA, 16 bp, C. familiaris
tcttttgtatttccat

SEQ ID NO: 328240 - DNA, 16 bp, C. familiaris
tcttttgtttggagca

SEQ ID NO: 328241 - DNA, 16 bp, C. familiaris
tctttttaaaaaaaga

SEQ ID NO: 328242 - DNA, 16 bp, C. familiaris
tctttttaaaaaatca

SEQ ID NO: 328243 - DNA, 16 bp, C. familiaris
tctttttaaaaacaaa

SEQ ID NO: 328244 - DNA, 16 bp, C. familiaris
tctttttaaagaatca

SEQ ID NO: 328245 - DNA, 16 bp, C. familiaris
tctttttaacttaaaa

SEQ ID NO: 328246 - DNA, 16 bp, C. familiaris
tctttttattgaagta

SEQ ID NO: 328247 - DNA, 16 bp, C. familiaris
tctttttcaaaaatgt

SEQ ID NO: 328248 - DNA, 16 bp, C. familiaris
tctttttcaacaaatg

SEQ ID NO: 328249 - DNA, 16 bp, C. familiaris
tctttttcattcatga

SEQ ID NO: 328250 - DNA, 16 bp, C. familiaris
tctttttctgctactt

SEQ ID NO: 328251 - DNA, 16 bp, C. familiaris
tctttttctttggaat

SEQ ID NO: 328252 - DNA, 16 bp, C. familiaris
tctttttgaacttggc

SEQ ID NO: 328253 - DNA, 16 bp, C. familiaris
tctttttgagagagaa

SEQ ID NO: 328254 - DNA, 16 bp, C. familiaris
tctttttgataatagc

SEQ ID NO: 328255 - DNA, 16 bp, C. familiaris
tctttttgatgctgtt

SEQ ID NO: 328256 - DNA, 16 bp, C. familiaris
tctttttgttttaaag

SEQ ID NO: 328257 - DNA, 16 bp, C. familiaris
tcttttttaaaatgtg

SEQ ID NO: 328258 - DNA, 16 bp, C. familiaris
tcttttttcctttgga

SEQ ID NO: 328259 - DNA, 16 bp, C. familiaris
tctttttttaaagaat

SEQ ID NO: 328260 - DNA, 16 bp, C. familiaris
tctttttttaagaaaa

SEQ ID NO: 328261 - DNA, 16 bp, C. familiaris
tctttttttccagtgt

SEQ ID NO: 328262 - DNA, 16 bp, C. familiaris
tcttttttttctgaaa

SEQ ID NO: 328263 - DNA, 16 bp, C. familiaris
tgaaaaaaatcaaatt

SEQ ID NO: 328264 - DNA, 16 bp, C. familiaris
tgaaaaaacaaaatct

SEQ ID NO: 328265 - DNA, 16 bp, C. familiaris
tgaaaaaataaaatct

SEQ ID NO: 328266 - DNA, 16 bp, C. familiaris
tgaaaaaattcaacat

SEQ ID NO: 328267 - DNA, 16 bp, C. familiaris
tgaaaaacagaatttt

SEQ ID NO: 328268 - DNA, 16 bp, C. familiaris
tgaaaaacagcaacaa

SEQ ID NO: 328269 - DNA, 16 bp, C. familiaris
tgaaaaacattttgaa

SEQ ID NO: 328270 - DNA, 16 bp, C. familiaris
tgaaaaactaaaagct

SEQ ID NO: 328271 - DNA, 16 bp, C. familiaris
tgaaaaactgaaagct

SEQ ID NO: 328272 - DNA, 16 bp, C. familiaris
tgaaaaagaaaatgca

SEQ ID NO: 328273 - DNA, 16 bp, C. familiaris
tgaaaaagaaatgcaa

SEQ ID NO: 328274 - DNA, 16 bp, C. familiaris
tgaaaaagatatattt

SEQ ID NO: 328275 - DNA, 16 bp, C. familiaris
tgaaaaaggatttttt

SEQ ID NO: 328276 - DNA, 16 bp, C. familiaris
tgaaaaagtttgaaaa

SEQ ID NO: 328277 - DNA, 16 bp, C. familiaris
tgaaaaataaaacttt

SEQ ID NO: 328278 - DNA, 16 bp, C. familiaris
tgaaaaataaatgtct

SEQ ID NO: 328279 - DNA, 16 bp, C. familiaris
tgaaaaataactttaa

SEQ ID NO: 328280 - DNA, 16 bp, C. familiaris
tgaaaaatacagagaa

SEQ ID NO: 328281 - DNA, 16 bp, C. familiaris
tgaaaaatacaggaaa

SEQ ID NO: 328282 - DNA, 16 bp, C. familiaris
tgaaaaatacatgaaa

SEQ ID NO: 328283 - DNA, 16 bp, C. familiaris
tgaaaaatccacagct

SEQ ID NO: 328284 - DNA, 16 bp, C. familiaris
tgaaaaatgaaaatgt

SEQ ID NO: 328285 - DNA, 16 bp, C. familiaris
tgaaaaatgaactttt

SEQ ID NO: 328286 - DNA, 16 bp, C. familiaris
tgaaaaatgaagcaaa

SEQ ID NO: 328287 - DNA, 16 bp, C. familiaris
tgaaaaatgcaataat

SEQ ID NO: 328288 - DNA, 16 bp, C. familiaris
tgaaaaatgctattag

SEQ ID NO: 328289 - DNA, 16 bp, C. familiaris
tgaaaaattaaaacat

SEQ ID NO: 328290 - DNA, 16 bp, C. familiaris
tgaaaaatttcaaaaa

SEQ ID NO: 328291 - DNA, 16 bp, C. familiaris
tgaaaaattttaaaca

SEQ ID NO: 328292 - DNA, 16 bp, C. familiaris
tgaaaaattttaaatg

SEQ ID NO: 328293 - DNA, 16 bp, C. familiaris
tgaaaacaaatatttt

SEQ ID NO: 328294 - DNA, 16 bp, C. familiaris
tgaaaacactaattag

SEQ ID NO: 328295 - DNA, 16 bp, C. familiaris
tgaaaacagagaaaag

SEQ ID NO: 328296 - DNA, 16 bp, C. familiaris
tgaaaacatgtctaca

SEQ ID NO: 328297 - DNA, 16 bp, C. familiaris
tgaaaacatttaaaat

SEQ ID NO: 328298 - DNA, 16 bp, C. familiaris
tgaaaaccaaaaatat

SEQ ID NO: 328299 - DNA, 16 bp, C. familiaris
tgaaaaccaaatttta

SEQ ID NO: 328300 - DNA, 16 bp, C. familiaris
tgaaaactgaaagaaa

SEQ ID NO: 328301 - DNA, 16 bp, C. familiaris
tgaaaacttctggaaa

SEQ ID NO: 328302 - DNA, 16 bp, C. familiaris
tgaaaactttaaaaca

SEQ ID NO: 328303 - DNA, 16 bp, C. familiaris
tgaaaagaatttgtat

SEQ ID NO: 328304 - DNA, 16 bp, C. familiaris
tgaaaagacaatccac

SEQ ID NO: 328305 - DNA, 16 bp, C. familiaris
tgaaaagataaaactg

SEQ ID NO: 328306 - DNA, 16 bp, C. familiaris
tgaaaagataagcaaa

SEQ ID NO: 328307 - DNA, 16 bp, C. familiaris
tgaaaagatactcaaa

SEQ ID NO: 328308 - DNA, 16 bp, C. familiaris
tgaaaagatatatgca

SEQ ID NO: 328309 - DNA, 16 bp, C. familiaris
tgaaaagatcctcaac

SEQ ID NO: 328310 - DNA, 16 bp, C. familiaris
tgaaaagatgtttgac

SEQ ID NO: 328311 - DNA, 16 bp, C. familiaris
tgaaaagcaaagcaaa

SEQ ID NO: 328312 - DNA, 16 bp, C. familiaris
tgaaaagctaaaagct

SEQ ID NO: 328313 - DNA, 16 bp, C. familiaris
tgaaaagctgaaagct

SEQ ID NO: 328314 - DNA, 16 bp, C. familiaris
tgaaaagctgaaagtt

SEQ ID NO: 328315 - DNA, 16 bp, C. familiaris
tgaaaagctttatttt

SEQ ID NO: 328316 - DNA, 16 bp, C. familiaris
tgaaaagctttttaaa

SEQ ID NO: 328317 - DNA, 16 bp, C. familiaris
tgaaaaggaacaaagt

SEQ ID NO: 328318 - DNA, 16 bp, C. familiaris
tgaaaaggcaagccac

SEQ ID NO: 328319 - DNA, 16 bp, C. familiaris
tgaaaataaaaatctc

SEQ ID NO: 328320 - DNA, 16 bp, C. familiaris
tgaaaataaatacata

SEQ ID NO: 328321 - DNA, 16 bp, C. familiaris
tgaaaatacaaatttt

SEQ ID NO: 328322 - DNA, 16 bp, C. familiaris
tgaaaatatttccaaa

SEQ ID NO: 328323 - DNA, 16 bp, C. familiaris
tgaaaatattttcaaa

SEQ ID NO: 328324 - DNA, 16 bp, C. familiaris
tgaaaatattttctcc

SEQ ID NO: 328325 - DNA, 16 bp, C. familiaris
tgaaaatcaaatgaaa

SEQ ID NO: 328326 - DNA, 16 bp, C. familiaris
tgaaaatcctcaacaa

SEQ ID NO: 328327 - DNA, 16 bp, C. familiaris
tgaaaatctacaaatt

SEQ ID NO: 328328 - DNA, 16 bp, C. familiaris
tgaaaatctattttta

SEQ ID NO: 328329 - DNA, 16 bp, C. familiaris
tgaaaatctgtttttt

SEQ ID NO: 328330 - DNA, 16 bp, C. familiaris
tgaaaatgaaaacaca

SEQ ID NO: 328331 - DNA, 16 bp, C. familiaris
tgaaaatgaaagtttg

SEQ ID NO: 328332 - DNA, 16 bp, C. familiaris
tgaaaatgaaatcaca

SEQ ID NO: 328333 - DNA, 16 bp, C. familiaris
tgaaaatgaagaacaa

SEQ ID NO: 328334 - DNA, 16 bp, C. familiaris
tgaaaatgaatgaatg

SEQ ID NO: 328335 - DNA, 16 bp, C. familiaris
tgaaaatgagaaatga

SEQ ID NO: 328336 - DNA, 16 bp, C. familiaris
tgaaaatgaggaaaat

SEQ ID NO: 328337 - DNA, 16 bp, C. familiaris
tgaaaatgataaattt

SEQ ID NO: 328338 - DNA, 16 bp, C. familiaris
tgaaaatgctttgaaa

SEQ ID NO: 328339 - DNA, 16 bp, C. familiaris
tgaaaatgctttggaa

SEQ ID NO: 328340 - DNA, 16 bp, C. familiaris
tgaaaatggaaacaca

SEQ ID NO: 328341 - DNA, 16 bp, C. familiaris
tgaaaatggatgaaag

SEQ ID NO: 328342 - DNA, 16 bp, C. familiaris
tgaaaatggtgaaaat

SEQ ID NO: 328343 - DNA, 16 bp, C. familiaris
tgaaaatgtattttct

SEQ ID NO: 328344 - DNA, 16 bp, C. familiaris
tgaaaatgttctattt

SEQ ID NO: 328345 - DNA, 16 bp, C. familiaris
tgaaaatgttttggaa

SEQ ID NO: 328346 - DNA, 16 bp, C. familiaris
tgaaaattataaaaca

SEQ ID NO: 328347 - DNA, 16 bp, C. familiaris
tgaaaatttacaaaaa

SEQ ID NO: 328348 - DNA, 16 bp, C. familiaris
tgaaaatttggaaaat

SEQ ID NO: 328349 - DNA, 16 bp, C. familiaris
tgaaaattttcaaaca

SEQ ID NO: 328350 - DNA, 16 bp, C. familiaris
tgaaaattttctttta

SEQ ID NO: 328351 - DNA, 16 bp, C. familiaris
tgaaacaaatattaaa

SEQ ID NO: 328352 - DNA, 16 bp, C. familiaris
tgaaacaagaagaaat

SEQ ID NO: 328353 - DNA, 16 bp, C. familiaris
tgaaacaatattagaa

SEQ ID NO: 328354 - DNA, 16 bp, C. familiaris
tgaaacagcagaaaga

SEQ ID NO: 328355 - DNA, 16 bp, C. familiaris
tgaaacatttcttttt

SEQ ID NO: 328356 - DNA, 16 bp, C. familiaris
tgaaaccaaaaattgg

SEQ ID NO: 328357 - DNA, 16 bp, C. familiaris
tgaaaccaaaagctgg

SEQ ID NO: 328358 - DNA, 16 bp, C. familiaris
tgaaaccaaaagtctg

SEQ ID NO: 328359 - DNA, 16 bp, C. familiaris
tgaaaccaacagttgg

SEQ ID NO: 328360 - DNA, 16 bp, C. familiaris
tgaaaccacaaaagac

SEQ ID NO: 328361 - DNA, 16 bp, C. familiaris
tgaaaccataaaaata

SEQ ID NO: 328362 - DNA, 16 bp, C. familiaris
tgaaaccataaaaatt

SEQ ID NO: 328363 - DNA, 16 bp, C. familiaris
tgaaaccatcaacaaa

SEQ ID NO: 328364 - DNA, 16 bp, C. familiaris
tgaaactaagaactgg

SEQ ID NO: 328365 - DNA, 16 bp, C. familiaris
tgaaactataaaacat

SEQ ID NO: 328366 - DNA, 16 bp, C. familiaris
tgaaactgaagaaaga

SEQ ID NO: 328367 - DNA, 16 bp, C. familiaris
tgaaactggaccccta

SEQ ID NO: 328368 - DNA, 16 bp, C. familiaris
tgaaacttgaaaattc

SEQ ID NO: 328369 - DNA, 16 bp, C. familiaris
tgaaagaaaacagaca

SEQ ID NO: 328370 - DNA, 16 bp, C. familiaris
tgaaagaaaattattt

SEQ ID NO: 328371 - DNA, 16 bp, C. familiaris
tgaaagaaacaaaact

SEQ ID NO: 328372 - DNA, 16 bp, C. familiaris
tgaaagaaactgaaga

SEQ ID NO: 328373 - DNA, 16 bp, C. familiaris
tgaaagaaatcaagaa

SEQ ID NO: 328374 - DNA, 16 bp, C. familiaris
tgaaagaaatcattga

SEQ ID NO: 328375 - DNA, 16 bp, C. familiaris
tgaaagaaattaaaca

SEQ ID NO: 328376 - DNA, 16 bp, C. familiaris
tgaaagaaattaagga

SEQ ID NO: 328377 - DNA, 16 bp, C. familiaris
tgaaagaaattatttt

SEQ ID NO: 328378 - DNA, 16 bp, C. familiaris
tgaaagaaattgaaga

SEQ ID NO: 328379 - DNA, 16 bp, C. familiaris
tgaaagaaattgaata

SEQ ID NO: 328380 - DNA, 16 bp, C. familiaris
tgaaagaagccaatca

SEQ ID NO: 328381 - DNA, 16 bp, C. familiaris
tgaaagaagtcaggca

SEQ ID NO: 328382 - DNA, 16 bp, C. familiaris
tgaaagaatttgaaga

SEQ ID NO: 328383 - DNA, 16 bp, C. familiaris
tgaaagacaaggaaag

SEQ ID NO: 328384 - DNA, 16 bp, C. familiaris
tgaaagacacagagag

SEQ ID NO: 328385 - DNA, 16 bp, C. familiaris
tgaaagactccaccaa

SEQ ID NO: 328386 - DNA, 16 bp, C. familiaris
tgaaagagaaattaag

SEQ ID NO: 328387 - DNA, 16 bp, C. familiaris
tgaaagagaagacatt

SEQ ID NO: 328388 - DNA, 16 bp, C. familiaris
tgaaagagattgcatt

SEQ ID NO: 328389 - DNA, 16 bp, C. familiaris
tgaaagagctaaatgt

SEQ ID NO: 328390 - DNA, 16 bp, C. familiaris
tgaaagaggagagatt

SEQ ID NO: 328391 - DNA, 16 bp, C. familiaris
tgaaagatgaagaggg

SEQ ID NO: 328392 - DNA, 16 bp, C. familiaris
tgaaagatgtaaatgt

SEQ ID NO: 328393 - DNA, 16 bp, C. familiaris
tgaaagatgtgaattt

SEQ ID NO: 328394 - DNA, 16 bp, C. familiaris
tgaaagattttatttg

SEQ ID NO: 328395 - DNA, 16 bp, C. familiaris
tgaaagattttcctct

SEQ ID NO: 328396 - DNA, 16 bp, C. familiaris
tgaaagcagctaggga

SEQ ID NO: 328397 - DNA, 16 bp, C. familiaris
tgaaagcagcttggga

SEQ ID NO: 328398 - DNA, 16 bp, C. familiaris
tgaaaggaagaaacaa

SEQ ID NO: 328399 - DNA, 16 bp, C. familiaris
tgaaaggaattgaaga

SEQ ID NO: 328400 - DNA, 16 bp, C. familiaris
tgaaaggatgggaaaa

SEQ ID NO: 328401 - DNA, 16 bp, C. familiaris
tgaaaggatttttaaa

SEQ ID NO: 328402 - DNA, 16 bp, C. familiaris
tgaaagggaatacagg

SEQ ID NO: 328403 - DNA, 16 bp, C. familiaris
tgaaagggatgcctgg

SEQ ID NO: 328404 - DNA, 16 bp, C. familiaris
tgaaaggggcaaaaga

SEQ ID NO: 328405 - DNA, 16 bp, C. familiaris
tgaaagtgaaggggtg

SEQ ID NO: 328406 - DNA, 16 bp, C. familiaris
tgaaagtgagggggtg

SEQ ID NO: 328407 - DNA, 16 bp, C. familiaris
tgaaagtgatgaatca

SEQ ID NO: 328408 - DNA, 16 bp, C. familiaris
tgaaagtttctttttt

SEQ ID NO: 328409 - DNA, 16 bp, C. familiaris
tgaaataaaatatact

SEQ ID NO: 328410 - DNA, 16 bp, C. familiaris
tgaaatacaaagagaa

SEQ ID NO: 328411 - DNA, 16 bp, C. familiaris
tgaaatacacataaca

SEQ ID NO: 328412 - DNA, 16 bp, C. familiaris
tgaaatacattaaaaa

SEQ ID NO: 328413 - DNA, 16 bp, C. familiaris
tgaaatagataaaggg

SEQ ID NO: 328414 - DNA, 16 bp, C. familiaris
tgaaatagtttttaaa

SEQ ID NO: 328415 - DNA, 16 bp, C. familiaris
tgaaatatctgttcat

SEQ ID NO: 328416 - DNA, 16 bp, C. familiaris
tgaaatattgcaagaa

SEQ ID NO: 328417 - DNA, 16 bp, C. familiaris
tgaaatatttgaattt

SEQ ID NO: 328418 - DNA, 16 bp, C. familiaris
tgaaatatttttcttt

SEQ ID NO: 328419 - DNA, 16 bp, C. familiaris
tgaaatcaagccccat

SEQ ID NO: 328420 - DNA, 16 bp, C. familiaris
tgaaatcatacaatat

SEQ ID NO: 328421 - DNA, 16 bp, C. familiaris
tgaaatcatctggtat

SEQ ID NO: 328422 - DNA, 16 bp, C. familiaris
tgaaatcatgacctta

SEQ ID NO: 328423 - DNA, 16 bp, C. familiaris
tgaaatcattggccat

SEQ ID NO: 328424 - DNA, 16 bp, C. familiaris
tgaaatcatttttatt

SEQ ID NO: 328425 - DNA, 16 bp, C. familiaris
tgaaatcctatggtat

SEQ ID NO: 328426 - DNA, 16 bp, C. familiaris
tgaaatctaaaaaagc

SEQ ID NO: 328427 - DNA, 16 bp, C. familiaris
tgaaatcttaccatct

SEQ ID NO: 328428 - DNA, 16 bp, C. familiaris
tgaaatcttgcatttg

SEQ ID NO: 328429 - DNA, 16 bp, C. familiaris
tgaaatcttttatttt

SEQ ID NO: 328430 - DNA, 16 bp, C. familiaris
tgaaatgaaaaattcc

SEQ ID NO: 328431 - DNA, 16 bp, C. familiaris
tgaaatgaaggtgttg

SEQ ID NO: 328432 - DNA, 16 bp, C. familiaris
tgaaatgaatgaataa

SEQ ID NO: 328433 - DNA, 16 bp, C. familiaris
tgaaatgatgaccaca

SEQ ID NO: 328434 - DNA, 16 bp, C. familiaris
tgaaatgattgccaca

SEQ ID NO: 328435 - DNA, 16 bp, C. familiaris
tgaaatggaaaccaaa

SEQ ID NO: 328436 - DNA, 16 bp, C. familiaris
tgaaatggaaatgaaa

SEQ ID NO: 328437 - DNA, 16 bp, C. familiaris
tgaaatgtctggaata

SEQ ID NO: 328438 - DNA, 16 bp, C. familiaris
tgaaatgtgaaaataa

SEQ ID NO: 328439 - DNA, 16 bp, C. familiaris
tgaaatgtgtgtgtgt

SEQ ID NO: 328440 - DNA, 16 bp, C. familiaris
tgaaattaaaaattca

SEQ ID NO: 328441 - DNA, 16 bp, C. familiaris
tgaaattaaatgaatt

SEQ ID NO: 328442 - DNA, 16 bp, C. familiaris
tgaaattaacatttga

SEQ ID NO: 328443 - DNA, 16 bp, C. familiaris
tgaaattaatattaca

SEQ ID NO: 328444 - DNA, 16 bp, C. familiaris
tgaaattatttttcaa

SEQ ID NO: 328445 - DNA, 16 bp, C. familiaris
tgaaattctggaaaag

SEQ ID NO: 328446 - DNA, 16 bp, C. familiaris
tgaaattcttaataat

SEQ ID NO: 328447 - DNA, 16 bp, C. familiaris
tgaaattctttccctc

SEQ ID NO: 328448 - DNA, 16 bp, C. familiaris
tgaaattctttttctt

SEQ ID NO: 328449 - DNA, 16 bp, C. familiaris
tgaaattgaaaacaca

SEQ ID NO: 328450 - DNA, 16 bp, C. familiaris
tgaaattgaaattgaa

SEQ ID NO: 328451 - DNA, 16 bp, C. familiaris
tgaaattgaattagta

SEQ ID NO: 328452 - DNA, 16 bp, C. familiaris
tgaaattggatcactt

SEQ ID NO: 328453 - DNA, 16 bp, C. familiaris
tgaaattttatttcat

SEQ ID NO: 328454 - DNA, 16 bp, C. familiaris
tgaaatttttccaaat

SEQ ID NO: 328455 - DNA, 16 bp, C. familiaris
tgaaatttttgaaatt

SEQ ID NO: 328456 - DNA, 16 bp, C. familiaris
tgaacaaataaaatta

SEQ ID NO: 328457 - DNA, 16 bp, C. familiaris
tgaacaaataagcaaa

SEQ ID NO: 328458 - DNA, 16 bp, C. familiaris
tgaacaaatggaaaaa

SEQ ID NO: 328459 - DNA, 16 bp, C. familiaris
tgaacaagtaaataaa

SEQ ID NO: 328460 - DNA, 16 bp, C. familiaris
tgaacacagacacaaa

SEQ ID NO: 328461 - DNA, 16 bp, C. familiaris
tgaacacagaggcaaa

SEQ ID NO: 328462 - DNA, 16 bp, C. familiaris
tgaacagaaagtacag

SEQ ID NO: 328463 - DNA, 16 bp, C. familiaris
tgaacagattaaaaaa

SEQ ID NO: 328464 - DNA, 16 bp, C. familiaris
tgaacagcaaaggaaa

SEQ ID NO: 328465 - DNA, 16 bp, C. familiaris
tgaacatcaaaagaaa

SEQ ID NO: 328466 - DNA, 16 bp, C. familiaris
tgaacatggagccaga

SEQ ID NO: 328467 - DNA, 16 bp, C. familiaris
tgaacatggagcccaa

SEQ ID NO: 328468 - DNA, 16 bp, C. familiaris
tgaacatgggagtgta

SEQ ID NO: 328469 - DNA, 16 bp, C. familiaris
tgaacatgtggagatt

SEQ ID NO: 328470 - DNA, 16 bp, C. familiaris
tgaacattttaacagt

SEQ ID NO: 328471 - DNA, 16 bp, C. familiaris
tgaaccaaaaccaaga

SEQ ID NO: 328472 - DNA, 16 bp, C. familiaris
tgaaccaatcactgtg

SEQ ID NO: 328473 - DNA, 16 bp, C. familiaris
tgaacccgggactcca

SEQ ID NO: 328474 - DNA, 16 bp, C. familiaris
tgaacctaaaccaaga

SEQ ID NO: 328475 - DNA, 16 bp, C. familiaris
tgaacctggaggatat

SEQ ID NO: 328476 - DNA, 16 bp, C. familiaris
tgaactactgggactt

SEQ ID NO: 328477 - DNA, 16 bp, C. familiaris
tgaactagggatggtg

SEQ ID NO: 328478 - DNA, 16 bp, C. familiaris
tgaactatcagaaaaa

SEQ ID NO: 328479 - DNA, 16 bp, C. familiaris
tgaactcagggtcctg

SEQ ID NO: 328480 - DNA, 16 bp, C. familiaris
tgaactcatgaccatg

SEQ ID NO: 328481 - DNA, 16 bp, C. familiaris
tgaactcatttattag

SEQ ID NO: 328482 - DNA, 16 bp, C. familiaris
tgaactccttcagctt

SEQ ID NO: 328483 - DNA, 16 bp, C. familiaris
tgaactgaaggcagat

SEQ ID NO: 328484 - DNA, 16 bp, C. familiaris
tgaactgatttttttt

SEQ ID NO: 328485 - DNA, 16 bp, C. familiaris
tgaactgctacagcca

SEQ ID NO: 328486 - DNA, 16 bp, C. familiaris
tgaactgtcatgtttt

SEQ ID NO: 328487 - DNA, 16 bp, C. familiaris
tgaacttcaatttaaa

SEQ ID NO: 328488 - DNA, 16 bp, C. familiaris
tgaacttggaagtgga

SEQ ID NO: 328489 - DNA, 16 bp, C. familiaris
tgaactttttcttaaa

SEQ ID NO: 328490 - DNA, 16 bp, C. familiaris
tgaagaaaaattattt

SEQ ID NO: 328491 - DNA, 16 bp, C. familiaris
tgaagaaaatgcaaat

SEQ ID NO: 328492 - DNA, 16 bp, C. familiaris
tgaagaaaattatttt

SEQ ID NO: 328493 - DNA, 16 bp, C. familiaris
tgaagaaacagaggca

SEQ ID NO: 328494 - DNA, 16 bp, C. familiaris
tgaagaaactaaggca

SEQ ID NO: 328495 - DNA, 16 bp, C. familiaris
tgaagaaactgaagtt

SEQ ID NO: 328496 - DNA, 16 bp, C. familiaris
tgaagaaactgagatc

SEQ ID NO: 328497 - DNA, 16 bp, C. familiaris
tgaagaaactttaaaa

SEQ ID NO: 328498 - DNA, 16 bp, C. familiaris
tgaagaaagaaattga

SEQ ID NO: 328499 - DNA, 16 bp, C. familiaris
tgaagaaagagatgag

SEQ ID NO: 328500 - DNA, 16 bp, C. familiaris
tgaagaaagtgaaatt

SEQ ID NO: 328501 - DNA, 16 bp, C. familiaris
tgaagaaataaaagct

SEQ ID NO: 328502 - DNA, 16 bp, C. familiaris
tgaagaaataaaggct

SEQ ID NO: 328503 - DNA, 16 bp, C. familiaris
tgaagaaataaatctt

SEQ ID NO: 328504 - DNA, 16 bp, C. familiaris
tgaagaaatacagaaa

SEQ ID NO: 328505 - DNA, 16 bp, C. familiaris
tgaagaaatcaaagag

SEQ ID NO: 328506 - DNA, 16 bp, C. familiaris
tgaagaaattggaatc

SEQ ID NO: 328507 - DNA, 16 bp, C. familiaris
tgaagaacttccttta

SEQ ID NO: 328508 - DNA, 16 bp, C. familiaris
tgaagaacttctacaa

SEQ ID NO: 328509 - DNA, 16 bp, C. familiaris
tgaagaagaaaaccaa

SEQ ID NO: 328510 - DNA, 16 bp, C. familiaris
tgaagaagaaaagcaa

SEQ ID NO: 328511 - DNA, 16 bp, C. familiaris
tgaagaagaaaataca

SEQ ID NO: 328512 - DNA, 16 bp, C. familiaris
tgaagaagaaacaaat

SEQ ID NO: 328513 - DNA, 16 bp, C. familiaris
tgaagaagaaagccaa

SEQ ID NO: 328514 - DNA, 16 bp, C. familiaris
tgaagaagaagaaatt

SEQ ID NO: 328515 - DNA, 16 bp, C. familiaris
tgaagaagataaaact

SEQ ID NO: 328516 - DNA, 16 bp, C. familiaris
tgaagaagatgatgat

SEQ ID NO: 328517 - DNA, 16 bp, C. familiaris
tgaagaagatgtggta

SEQ ID NO: 328518 - DNA, 16 bp, C. familiaris
tgaagaatacagtaac

SEQ ID NO: 328519 - DNA, 16 bp, C. familiaris
tgaagaatattttatt

SEQ ID NO: 328520 - DNA, 16 bp, C. familiaris
tgaagacacagagaca

SEQ ID NO: 328521 - DNA, 16 bp, C. familiaris
tgaagacagaagaaaa

SEQ ID NO: 328522 - DNA, 16 bp, C. familiaris
tgaagaccccagtgga

SEQ ID NO: 328523 - DNA, 16 bp, C. familiaris
tgaagagaaaatattt

SEQ ID NO: 328524 - DNA, 16 bp, C. familiaris
tgaagagaaagcattt

SEQ ID NO: 328525 - DNA, 16 bp, C. familiaris
tgaagagacaaagcaa

SEQ ID NO: 328526 - DNA, 16 bp, C. familiaris
tgaagagacagaaaaa

SEQ ID NO: 328527 - DNA, 16 bp, C. familiaris
tgaagagactattctt

SEQ ID NO: 328528 - DNA, 16 bp, C. familiaris
tgaagagactgtcttt

SEQ ID NO: 328529 - DNA, 16 bp, C. familiaris
tgaagagactgtttct

SEQ ID NO: 328530 - DNA, 16 bp, C. familiaris
tgaagagactgttttt

SEQ ID NO: 328531 - DNA, 16 bp, C. familiaris
tgaagagattatcttt

SEQ ID NO: 328532 - DNA, 16 bp, C. familiaris
tgaagagctttgatca

SEQ ID NO: 328533 - DNA, 16 bp, C. familiaris
tgaagagggaggcaga

SEQ ID NO: 328534 - DNA, 16 bp, C. familiaris
tgaagagttttgtttt

SEQ ID NO: 328535 - DNA, 16 bp, C. familiaris
tgaagatatggagaaa

SEQ ID NO: 328536 - DNA, 16 bp, C. familiaris
tgaagatctaaataaa

SEQ ID NO: 328537 - DNA, 16 bp, C. familiaris
tgaagatgaaatgaga

SEQ ID NO: 328538 - DNA, 16 bp, C. familiaris
tgaagatgctgtgaaa

SEQ ID NO: 328539 - DNA, 16 bp, C. familiaris
tgaagatgtggaaaaa

SEQ ID NO: 328540 - DNA, 16 bp, C. familiaris
tgaagatgttatttat

SEQ ID NO: 328541 - DNA, 16 bp, C. familiaris
tgaagattattttaaa

SEQ ID NO: 328542 - DNA, 16 bp, C. familiaris
tgaagatttttctctt

SEQ ID NO: 328543 - DNA, 16 bp, C. familiaris
tgaagcaaaatggtgg

SEQ ID NO: 328544 - DNA, 16 bp, C. familiaris
tgaagcaaatggtagg

SEQ ID NO: 328545 - DNA, 16 bp, C. familiaris
tgaagcaacaggaact

SEQ ID NO: 328546 - DNA, 16 bp, C. familiaris
tgaagcagaaaaagaa

SEQ ID NO: 328547 - DNA, 16 bp, C. familiaris
tgaagcagactccttg

SEQ ID NO: 328548 - DNA, 16 bp, C. familiaris
tgaagcagaggaatga

SEQ ID NO: 328549 - DNA, 16 bp, C. familiaris
tgaagcagcagcagca

SEQ ID NO: 328550 - DNA, 16 bp, C. familiaris
tgaagcaggaagaaat

SEQ ID NO: 328551 - DNA, 16 bp, C. familiaris
tgaagcatttttatga

SEQ ID NO: 328552 - DNA, 16 bp, C. familiaris
tgaagccaggcactga

SEQ ID NO: 328553 - DNA, 16 bp, C. familiaris
tgaagccataaaattc

SEQ ID NO: 328554 - DNA, 16 bp, C. familiaris
tgaagctaatgaagct

SEQ ID NO: 328555 - DNA, 16 bp, C. familiaris
tgaagctgaaggcaga

SEQ ID NO: 328556 - DNA, 16 bp, C. familiaris
tgaaggaatgaatgaa

SEQ ID NO: 328557 - DNA, 16 bp, C. familiaris
tgaaggagaaaacaaa

SEQ ID NO: 328558 - DNA, 16 bp, C. familiaris
tgaaggagaagaacaa

SEQ ID NO: 328559 - DNA, 16 bp, C. familiaris
tgaaggagattaagaa

SEQ ID NO: 328560 - DNA, 16 bp, C. familiaris
tgaaggaggtcaaaag

SEQ ID NO: 328561 - DNA, 16 bp, C. familiaris
tgaaggagtttgagaa

SEQ ID NO: 328562 - DNA, 16 bp, C. familiaris
tgaaggatctcaagat

SEQ ID NO: 328563 - DNA, 16 bp, C. familiaris
tgaaggatgaggagga

SEQ ID NO: 328564 - DNA, 16 bp, C. familiaris
tgaaggatgcctgggt

SEQ ID NO: 328565 - DNA, 16 bp, C. familiaris
tgaaggcaaaggaaaa

SEQ ID NO: 328566 - DNA, 16 bp, C. familiaris
tgaaggcagacgttta

SEQ ID NO: 328567 - DNA, 16 bp, C. familiaris
tgaaggcggtgctcaa

SEQ ID NO: 328568 - DNA, 16 bp, C. familiaris
tgaagggactgtcctt

SEQ ID NO: 328569 - DNA, 16 bp, C. familiaris
tgaaggggagcagaat

SEQ ID NO: 328570 - DNA, 16 bp, C. familiaris
tgaaggggatgaagag

SEQ ID NO: 328571 - DNA, 16 bp, C. familiaris
tgaaggtgaaggtgaa

SEQ ID NO: 328572 - DNA, 16 bp, C. familiaris
tgaagtatatgaagaa

SEQ ID NO: 328573 - DNA, 16 bp, C. familiaris
tgaagtcaagagttgg

SEQ ID NO: 328574 - DNA, 16 bp, C. familiaris
tgaagtctaccaaaca

SEQ ID NO: 328575 - DNA, 16 bp, C. familiaris
tgaagtctactttgtc

SEQ ID NO: 328576 - DNA, 16 bp, C. familiaris
tgaagtctttgttttt

SEQ ID NO: 328577 - DNA, 16 bp, C. familiaris
tgaagtggcagaaaga

SEQ ID NO: 328578 - DNA, 16 bp, C. familiaris
tgaagtgggatttatt

SEQ ID NO: 328579 - DNA, 16 bp, C. familiaris
tgaagttaaaaacaaa

SEQ ID NO: 328580 - DNA, 16 bp, C. familiaris
tgaagttgcaggatac

SEQ ID NO: 328581 - DNA, 16 bp, C. familiaris
tgaagttttaaaattt

SEQ ID NO: 328582 - DNA, 16 bp, C. familiaris
tgaataaaagtgacaa

SEQ ID NO: 328583 - DNA, 16 bp, C. familiaris
tgaataaaatgtttaa

SEQ ID NO: 328584 - DNA, 16 bp, C. familiaris
tgaataaacaaatgaa

SEQ ID NO: 328585 - DNA, 16 bp, C. familiaris
tgaataaataaaaact

SEQ ID NO: 328586 - DNA, 16 bp, C. familiaris
tgaataaatgtgtctt

SEQ ID NO: 328587 - DNA, 16 bp, C. familiaris
tgaataatgctgcaat

SEQ ID NO: 328588 - DNA, 16 bp, C. familiaris
tgaatacagtgaaagg

SEQ ID NO: 328589 - DNA, 16 bp, C. familiaris
tgaatatggagcctga

SEQ ID NO: 328590 - DNA, 16 bp, C. familiaris
tgaatatttatgtaaa

SEQ ID NO: 328591 - DNA, 16 bp, C. familiaris
tgaatatttattaagc

SEQ ID NO: 328592 - DNA, 16 bp, C. familiaris
tgaatattttgaatat

SEQ ID NO: 328593 - DNA, 16 bp, C. familiaris
tgaatcacattgtttt

SEQ ID NO: 328594 - DNA, 16 bp, C. familiaris
tgaatcagaagctctg

SEQ ID NO: 328595 - DNA, 16 bp, C. familiaris
tgaatcagtaaccaaa

SEQ ID NO: 328596 - DNA, 16 bp, C. familiaris
tgaatcagtatttttt

SEQ ID NO: 328597 - DNA, 16 bp, C. familiaris
tgaatccataaataaa

SEQ ID NO: 328598 - DNA, 16 bp, C. familiaris
tgaatcccgcatcggg

SEQ ID NO: 328599 - DNA, 16 bp, C. familiaris
tgaatcctttccagaa

SEQ ID NO: 328600 - DNA, 16 bp, C. familiaris
tgaatctcaaaataat

SEQ ID NO: 328601 - DNA, 16 bp, C. familiaris
tgaatctgaatctctg

SEQ ID NO: 328602 - DNA, 16 bp, C. familiaris
tgaatcttttctctct

SEQ ID NO: 328603 - DNA, 16 bp, C. familiaris
tgaatgaaagtgaaaa

SEQ ID NO: 328604 - DNA, 16 bp, C. familiaris
tgaatgaaatcttgtc

SEQ ID NO: 328605 - DNA, 16 bp, C. familiaris
tgaatgaaattgaaga

SEQ ID NO: 328606 - DNA, 16 bp, C. familiaris
tgaatgaatattttta

SEQ ID NO: 328607 - DNA, 16 bp, C. familiaris
tgaatgaatgcatgga

SEQ ID NO: 328608 - DNA, 16 bp, C. familiaris
tgaatgacacactgga

SEQ ID NO: 328609 - DNA, 16 bp, C. familiaris
tgaatgagaaaagaca

SEQ ID NO: 328610 - DNA, 16 bp, C. familiaris
tgaatgagcaaatgaa

SEQ ID NO: 328611 - DNA, 16 bp, C. familiaris
tgaatgataaagaaga

SEQ ID NO: 328612 - DNA, 16 bp, C. familiaris
tgaatgctatttattt

SEQ ID NO: 328613 - DNA, 16 bp, C. familiaris
tgaatggaaggcagat

SEQ ID NO: 328614 - DNA, 16 bp, C. familiaris
tgaatggaatgaatga

SEQ ID NO: 328615 - DNA, 16 bp, C. familiaris
tgaatggattaagaaa

SEQ ID NO: 328616 - DNA, 16 bp, C. familiaris
tgaatgggaaaaatct

SEQ ID NO: 328617 - DNA, 16 bp, C. familiaris
tgaatgggggcacctg

SEQ ID NO: 328618 - DNA, 16 bp, C. familiaris
tgaatgtggagccaga

SEQ ID NO: 328619 - DNA, 16 bp, C. familiaris
tgaatgtggcactaaa

SEQ ID NO: 328620 - DNA, 16 bp, C. familiaris
tgaattaaagtttatc

SEQ ID NO: 328621 - DNA, 16 bp, C. familiaris
tgaattaatgaacaaa

SEQ ID NO: 328622 - DNA, 16 bp, C. familiaris
tgaattaatgagtgaa

SEQ ID NO: 328623 - DNA, 16 bp, C. familiaris
tgaattatttgctttt

SEQ ID NO: 328624 - DNA, 16 bp, C. familiaris
tgaattcaagtcccac

SEQ ID NO: 328625 - DNA, 16 bp, C. familiaris
tgaattcagtttgcca

SEQ ID NO: 328626 - DNA, 16 bp, C. familiaris
tgaattctttatgtat

SEQ ID NO: 328627 - DNA, 16 bp, C. familiaris
tgaattctttctttct

SEQ ID NO: 328628 - DNA, 16 bp, C. familiaris
tgaattgttttcttct

SEQ ID NO: 328629 - DNA, 16 bp, C. familiaris
tgaatttaaatacatt

SEQ ID NO: 328630 - DNA, 16 bp, C. familiaris
tgaatttagctagata

SEQ ID NO: 328631 - DNA, 16 bp, C. familiaris
tgaatttagtgtcatt

SEQ ID NO: 328632 - DNA, 16 bp, C. familiaris
tgaatttatcagtttt

SEQ ID NO: 328633 - DNA, 16 bp, C. familiaris
tgaatttcaaataaac

SEQ ID NO: 328634 - DNA, 16 bp, C. familiaris
tgaatttcacctcaat

SEQ ID NO: 328635 - DNA, 16 bp, C. familiaris
tgaatttgattactct

SEQ ID NO: 328636 - DNA, 16 bp, C. familiaris
tgaatttggaaacttt

SEQ ID NO: 328637 - DNA, 16 bp, C. familiaris
tgaatttgttgagact

SEQ ID NO: 328638 - DNA, 16 bp, C. familiaris
tgaattttaagagttt

SEQ ID NO: 328639 - DNA, 16 bp, C. familiaris
tgaattttatctttta

SEQ ID NO: 328640 - DNA, 16 bp, C. familiaris
tgaattttctgtacat

SEQ ID NO: 328641 - DNA, 16 bp, C. familiaris
tgacaaaaattttaaa

SEQ ID NO: 328642 - DNA, 16 bp, C. familiaris
tgacaaaataccacag

SEQ ID NO: 328643 - DNA, 16 bp, C. familiaris
tgacaaaatgcaacat

SEQ ID NO: 328644 - DNA, 16 bp, C. familiaris
tgacaaagaagacaag

SEQ ID NO: 328645 - DNA, 16 bp, C. familiaris
tgacaaagcaggaaac

SEQ ID NO: 328646 - DNA, 16 bp, C. familiaris
tgacaaggggctcaat

SEQ ID NO: 328647 - DNA, 16 bp, C. familiaris
tgacaatagagttgag

SEQ ID NO: 328648 - DNA, 16 bp, C. familiaris
tgacaatcaaaaatat

SEQ ID NO: 328649 - DNA, 16 bp, C. familiaris
tgacaatgtggagaaa

SEQ ID NO: 328650 - DNA, 16 bp, C. familiaris
tgacacaagattccat

SEQ ID NO: 328651 - DNA, 16 bp, C. familiaris
tgacacactctgcctc

SEQ ID NO: 328652 - DNA, 16 bp, C. familiaris
tgacactaaattaata

SEQ ID NO: 328653 - DNA, 16 bp, C. familiaris
tgacagaaagagaaag

SEQ ID NO: 328654 - DNA, 16 bp, C. familiaris
tgacagaaataaaata

SEQ ID NO: 328655 - DNA, 16 bp, C. familiaris
tgacagacagagagac

SEQ ID NO: 328656 - DNA, 16 bp, C. familiaris
tgacagacgcagagag

SEQ ID NO: 328657 - DNA, 16 bp, C. familiaris
tgacagagagaagaga

SEQ ID NO: 328658 - DNA, 16 bp, C. familiaris
tgacagagagacagca

SEQ ID NO: 328659 - DNA, 16 bp, C. familiaris
tgacagaggaagagaa

SEQ ID NO: 328660 - DNA, 16 bp, C. familiaris
tgacagatatattcag

SEQ ID NO: 328661 - DNA, 16 bp, C. familiaris
tgacagatgaggaaaa

SEQ ID NO: 328662 - DNA, 16 bp, C. familiaris
tgacagatgaggaaac

SEQ ID NO: 328663 - DNA, 16 bp, C. familiaris
tgacagattaaaaaaa

SEQ ID NO: 328664 - DNA, 16 bp, C. familiaris
tgacaggctccctgca

SEQ ID NO: 328665 - DNA, 16 bp, C. familiaris
tgacaggtgggaggtg

SEQ ID NO: 328666 - DNA, 16 bp, C. familiaris
tgacaggtgtggggtg

SEQ ID NO: 328667 - DNA, 16 bp, C. familiaris
tgacagttttgaagag

SEQ ID NO: 328668 - DNA, 16 bp, C. familiaris
tgacatctttaaaata

SEQ ID NO: 328669 - DNA, 16 bp, C. familiaris
tgacatgagacagatg

SEQ ID NO: 328670 - DNA, 16 bp, C. familiaris
tgacatgatactctat

SEQ ID NO: 328671 - DNA, 16 bp, C. familiaris
tgacatgatgctatat

SEQ ID NO: 328672 - DNA, 16 bp, C. familiaris
tgacattggctcaggg

SEQ ID NO: 328673 - DNA, 16 bp, C. familiaris
tgacattttaaaatgt

SEQ ID NO: 328674 - DNA, 16 bp, C. familiaris
tgacattttaagaaaa

SEQ ID NO: 328675 - DNA, 16 bp, C. familiaris
tgacattttctttctt

SEQ ID NO: 328676 - DNA, 16 bp, C. familiaris
tgaccaaaatcaagag

SEQ ID NO: 328677 - DNA, 16 bp, C. familiaris
tgaccaagcaacactg

SEQ ID NO: 328678 - DNA, 16 bp, C. familiaris
tgaccagatggatttc

SEQ ID NO: 328679 - DNA, 16 bp, C. familiaris
tgaccatacagttgtg

SEQ ID NO: 328680 - DNA, 16 bp, C. familiaris
tgaccatggaggcaga

SEQ ID NO: 328681 - DNA, 16 bp, C. familiaris
tgaccatggctccctc

SEQ ID NO: 328682 - DNA, 16 bp, C. familiaris
tgaccatttgtatgtc

SEQ ID NO: 328683 - DNA, 16 bp, C. familiaris
tgacccagatgttgga

SEQ ID NO: 328684 - DNA, 16 bp, C. familiaris
tgaccccaacatcaag

SEQ ID NO: 328685 - DNA, 16 bp, C. familiaris
tgaccccaagatccag

SEQ ID NO: 328686 - DNA, 16 bp, C. familiaris
tgaccccagagtcctg

SEQ ID NO: 328687 - DNA, 16 bp, C. familiaris
tgaccccctcagtgcc

SEQ ID NO: 328688 - DNA, 16 bp, C. familiaris
tgaccccgaggtcctg

SEQ ID NO: 328689 - DNA, 19 bp, C. familiaris
tgaccccgggaacctgggg

SEQ ID NO: 328690 - DNA, 17 bp, C. familiaris
tgaccccgggggtcctg

SEQ ID NO: 328691 - DNA, 16 bp, C. familiaris
tgaccctgagaccaag

SEQ ID NO: 328692 - DNA, 16 bp, C. familiaris
tgaccctgaggtcatg

SEQ ID NO: 328693 - DNA, 16 bp, C. familiaris
tgaccctgaggtcctg

SEQ ID NO: 328694 - DNA, 16 bp, C. familiaris
tgaccctgggcaagct

SEQ ID NO: 328695 - DNA, 16 bp, C. familiaris
tgacctaagcagaagg

SEQ ID NO: 328696 - DNA, 16 bp, C. familiaris
tgacctatttttgttg

SEQ ID NO: 328697 - DNA, 16 bp, C. familiaris
tgacctcaaggtcctg

SEQ ID NO: 328698 - DNA, 16 bp, C. familiaris
tgacctctctgagcct

SEQ ID NO: 328699 - DNA, 16 bp, C. familiaris
tgacctcttcttcata

SEQ ID NO: 328700 - DNA, 16 bp, C. familiaris
tgacctgaaccgaaat

SEQ ID NO: 328701 - DNA, 16 bp, C. familiaris
tgacctgagccacaac

SEQ ID NO: 328702 - DNA, 16 bp, C. familiaris
tgacctgagcccaaag

SEQ ID NO: 328703 - DNA, 16 bp, C. familiaris
tgacctgagtgaaggc

SEQ ID NO: 328704 - DNA, 16 bp, C. familiaris
tgacctggagatcatg

SEQ ID NO: 328705 - DNA, 16 bp, C. familiaris
tgacctggagcaagtc

SEQ ID NO: 328706 - DNA, 16 bp, C. familiaris
tgacctggatggagct

SEQ ID NO: 328707 - DNA, 16 bp, C. familiaris
tgaccttcctctggga

SEQ ID NO: 328708 - DNA, 16 bp, C. familiaris
tgaccttgagaaagtt

SEQ ID NO: 328709 - DNA, 16 bp, C. familiaris
tgaccttgagcaggtt

SEQ ID NO: 328710 - DNA, 16 bp, C. familiaris
tgaccttggacaactt

SEQ ID NO: 328711 - DNA, 16 bp, C. familiaris
tgaccttggacaagtc

SEQ ID NO: 328712 - DNA, 16 bp, C. familiaris
tgacctttactgccca

SEQ ID NO: 328713 - DNA, 17 bp, C. familiaris
tgacgggcaccgagggg

SEQ ID NO: 328714 - DNA, 16 bp, C. familiaris
tgactacaccagtttg

SEQ ID NO: 328715 - DNA, 16 bp, C. familiaris
tgactatgttccctat

SEQ ID NO: 328716 - DNA, 16 bp, C. familiaris
tgactcagcaactcca

SEQ ID NO: 328717 - DNA, 16 bp, C. familiaris
tgactcagtctgttaa

SEQ ID NO: 328718 - DNA, 16 bp, C. familiaris
tgactcagtttccctc

SEQ ID NO: 328719 - DNA, 16 bp, C. familiaris
tgactcatttcattta

SEQ ID NO: 328720 - DNA, 16 bp, C. familiaris
tgactccaaaacccat

SEQ ID NO: 328721 - DNA, 16 bp, C. familiaris
tgactccttcatttct

SEQ ID NO: 328722 - DNA, 16 bp, C. familiaris
tgactctggaaaacaa

SEQ ID NO: 328723 - DNA, 16 bp, C. familiaris
tgactctggatctcag

SEQ ID NO: 328724 - DNA, 16 bp, C. familiaris
tgactgaaccaaccag

SEQ ID NO: 328725 - DNA, 16 bp, C. familiaris
tgactgagccacacaa

SEQ ID NO: 328726 - DNA, 16 bp, C. familiaris
tgactgatgtcaaaga

SEQ ID NO: 328727 - DNA, 16 bp, C. familiaris
tgactggatgaggccc

SEQ ID NO: 328728 - DNA, 16 bp, C. familiaris
tgactggattctttgt

SEQ ID NO: 328729 - DNA, 16 bp, C. familiaris
tgactgggagctgtgg

SEQ ID NO: 328730 - DNA, 16 bp, C. familiaris
tgacttcctcctctgg

SEQ ID NO: 328731 - DNA, 16 bp, C. familiaris
tgacttcttccttgca

SEQ ID NO: 328732 - DNA, 16 bp, C. familiaris
tgacttcttcttcttc

SEQ ID NO: 328733 - DNA, 16 bp, C. familiaris
tgacttgaccaaggtc

SEQ ID NO: 328734 - DNA, 16 bp, C. familiaris
tgacttgctttgacca

SEQ ID NO: 328735 - DNA, 16 bp, C. familiaris
tgacttgttcctgatc

SEQ ID NO: 328736 - DNA, 16 bp, C. familiaris
tgactttatttccttt

SEQ ID NO: 328737 - DNA, 16 bp, C. familiaris
tgactttcaggaaatg

SEQ ID NO: 328738 - DNA, 16 bp, C. familiaris
tgactttcttaataac

SEQ ID NO: 328739 - DNA, 16 bp, C. familiaris
tgactttgataagttc

SEQ ID NO: 328740 - DNA, 16 bp, C. familiaris
tgactttgctgaattt

SEQ ID NO: 328741 - DNA, 16 bp, C. familiaris
tgactttggacaaatt

SEQ ID NO: 328742 - DNA, 16 bp, C. familiaris
tgactttggcccaggg

SEQ ID NO: 328743 - DNA, 16 bp, C. familiaris
tgacttttgacaaagg

SEQ ID NO: 328744 - DNA, 16 bp, C. familiaris
tgacttttgattttga

SEQ ID NO: 328745 - DNA, 16 bp, C. familiaris
tgactttttaaaaaat

SEQ ID NO: 328746 - DNA, 16 bp, C. familiaris
tgactttttaagaaat

SEQ ID NO: 328747 - DNA, 16 bp, C. familiaris
tgagaaaaaaattttt

SEQ ID NO: 328748 - DNA, 16 bp, C. familiaris
tgagaaaaatgcaaat

SEQ ID NO: 328749 - DNA, 16 bp, C. familiaris
tgagaaaacacacaca

SEQ ID NO: 328750 - DNA, 16 bp, C. familiaris
tgagaaaaccaaggca

SEQ ID NO: 328751 - DNA, 16 bp, C. familiaris
tgagaaaactgaggaa

SEQ ID NO: 328752 - DNA, 16 bp, C. familiaris
tgagaaaagagtggag

SEQ ID NO: 328753 - DNA, 16 bp, C. familiaris
tgagaaaagcatggaa

SEQ ID NO: 328754 - DNA, 16 bp, C. familiaris
tgagaaaatatttgca

SEQ ID NO: 328755 - DNA, 16 bp, C. familiaris
tgagaaacacagagac

SEQ ID NO: 328756 - DNA, 16 bp, C. familiaris
tgagaaacacaggaga

SEQ ID NO: 328757 - DNA, 16 bp, C. familiaris
tgagaaacagagaggc

SEQ ID NO: 328758 - DNA, 16 bp, C. familiaris
tgagaaactagaaaaa

SEQ ID NO: 328759 - DNA, 16 bp, C. familiaris
tgagaaagagaaaagc

SEQ ID NO: 328760 - DNA, 16 bp, C. familiaris
tgagaaagagaaacaa

SEQ ID NO: 328761 - DNA, 16 bp, C. familiaris
tgagaaaggagaaatc

SEQ ID NO: 328762 - DNA, 16 bp, C. familiaris
tgagaaagtggtccag

SEQ ID NO: 328763 - DNA, 16 bp, C. familiaris
tgagaagaatgtggat

SEQ ID NO: 328764 - DNA, 16 bp, C. familiaris
tgagaagactgaggct

SEQ ID NO: 328765 - DNA, 16 bp, C. familiaris
tgagaagagttcatgc

SEQ ID NO: 328766 - DNA, 16 bp, C. familiaris
tgagaagatgctcagc

SEQ ID NO: 328767 - DNA, 16 bp, C. familiaris
tgagaagatttttaaa

SEQ ID NO: 328768 - DNA, 16 bp, C. familiaris
tgagaagccactggag

SEQ ID NO: 328769 - DNA, 16 bp, C. familiaris
tgagaaggaaatttat

SEQ ID NO: 328770 - DNA, 16 bp, C. familiaris
tgagaaggcagctgtc

SEQ ID NO: 328771 - DNA, 16 bp, C. familiaris
tgagaagttcaacaaa

SEQ ID NO: 328772 - DNA, 16 bp, C. familiaris
tgagaatattttaaaa

SEQ ID NO: 328773 - DNA, 16 bp, C. familiaris
tgagaatcagcacagc

SEQ ID NO: 328774 - DNA, 16 bp, C. familiaris
tgagaatctaatgaaa

SEQ ID NO: 328775 - DNA, 16 bp, C. familiaris
tgagaatctgatgaaa

SEQ ID NO: 328776 - DNA, 16 bp, C. familiaris
tgagaatgcagagaaa

SEQ ID NO: 328777 - DNA, 16 bp, C. familiaris
tgagaatggagaaaat

SEQ ID NO: 328778 - DNA, 16 bp, C. familiaris
tgagaattaaatgaga

SEQ ID NO: 328779 - DNA, 16 bp, C. familiaris
tgagacaaattaaaat

SEQ ID NO: 328780 - DNA, 16 bp, C. familiaris
tgagacaagatttcca

SEQ ID NO: 328781 - DNA, 16 bp, C. familiaris
tgagacacagagacag

SEQ ID NO: 328782 - DNA, 16 bp, C. familiaris
tgagacagagaaagac

SEQ ID NO: 328783 - DNA, 16 bp, C. familiaris
tgagacagggaaggga

SEQ ID NO: 328784 - DNA, 16 bp, C. familiaris
tgagacccttaccaca

SEQ ID NO: 328785 - DNA, 16 bp, C. familiaris
tgagaccgaagaaaga

SEQ ID NO: 328786 - DNA, 16 bp, C. familiaris
tgagactctcctgtgt

SEQ ID NO: 328787 - DNA, 16 bp, C. familiaris
tgagactgagccccca

SEQ ID NO: 328788 - DNA, 16 bp, C. familiaris
tgagactgagtcccac

SEQ ID NO: 328789 - DNA, 16 bp, C. familiaris
tgagagaaaatacttg

SEQ ID NO: 328790 - DNA, 16 bp, C. familiaris
tgagagaaagacaaat

SEQ ID NO: 328791 - DNA, 16 bp, C. familiaris
tgagagaaagcgagag

SEQ ID NO: 328792 - DNA, 16 bp, C. familiaris
tgagagacaaacacag

SEQ ID NO: 328793 - DNA, 16 bp, C. familiaris
tgagagacagcaagca

SEQ ID NO: 328794 - DNA, 16 bp, C. familiaris
tgagagacagcgagag

SEQ ID NO: 328795 - DNA, 16 bp, C. familiaris
tgagagactcagagaa

SEQ ID NO: 328796 - DNA, 16 bp, C. familiaris
tgagagactcttaatt

SEQ ID NO: 328797 - DNA, 16 bp, C. familiaris
tgagagagagaatgca

SEQ ID NO: 328798 - DNA, 16 bp, C. familiaris
tgagagagatagtgag

SEQ ID NO: 328799 - DNA, 16 bp, C. familiaris
tgagagagatcacaga

SEQ ID NO: 328800 - DNA, 16 bp, C. familiaris
tgagagatacagaaag

SEQ ID NO: 328801 - DNA, 16 bp, C. familiaris
tgagagatacagagac

SEQ ID NO: 328802 - DNA, 16 bp, C. familiaris
tgagagatgcaaagag

SEQ ID NO: 328803 - DNA, 16 bp, C. familiaris
tgagagatttttgatt

SEQ ID NO: 328804 - DNA, 16 bp, C. familiaris
tgagagcccagaaata

SEQ ID NO: 328805 - DNA, 16 bp, C. familiaris
tgagagctttttccct

SEQ ID NO: 328806 - DNA, 16 bp, C. familiaris
tgagaggattaaatga

SEQ ID NO: 328807 - DNA, 16 bp, C. familiaris
tgagagggaggggcag

SEQ ID NO: 328808 - DNA, 16 bp, C. familiaris
tgagagtgagagtgag

SEQ ID NO: 328809 - DNA, 16 bp, C. familiaris
tgagagttttacttct

SEQ ID NO: 328810 - DNA, 16 bp, C. familiaris
tgagatacacacacac

SEQ ID NO: 328811 - DNA, 16 bp, C. familiaris
tgagataccatgtcac

SEQ ID NO: 328812 - DNA, 16 bp, C. familiaris
tgagataccatttcac

SEQ ID NO: 328813 - DNA, 16 bp, C. familiaris
tgagatagagggagag

SEQ ID NO: 328814 - DNA, 16 bp, C. familiaris
tgagatcaagagtcac

SEQ ID NO: 328815 - DNA, 16 bp, C. familiaris
tgagatcaagatttgg

SEQ ID NO: 328816 - DNA, 16 bp, C. familiaris
tgagatcaagccctcc

SEQ ID NO: 328817 - DNA, 16 bp, C. familiaris
tgagatcaagctccac

SEQ ID NO: 328818 - DNA, 16 bp, C. familiaris
tgagatcaagtcagat

SEQ ID NO: 328819 - DNA, 16 bp, C. familiaris
tgagatcatactggag

SEQ ID NO: 328820 - DNA, 16 bp, C. familiaris
tgagatgaatgtgtat

SEQ ID NO: 328821 - DNA, 16 bp, C. familiaris
tgagattaatgttgtt

SEQ ID NO: 328822 - DNA, 16 bp, C. familiaris
tgagattacaacctga

SEQ ID NO: 328823 - DNA, 16 bp, C. familiaris
tgagattcaaacccaa

SEQ ID NO: 328824 - DNA, 17 bp, C. familiaris
tgagatttaaagagaga

SEQ ID NO: 328825 - DNA, 16 bp, C. familiaris
tgagatttctttcttt

SEQ ID NO: 328826 - DNA, 16 bp, C. familiaris
tgagcaaaaatcaaga

SEQ ID NO: 328827 - DNA, 16 bp, C. familiaris
tgagcaaagaggaaaa

SEQ ID NO: 328828 - DNA, 16 bp, C. familiaris
tgagcaaagatttgaa

SEQ ID NO: 328829 - DNA, 16 bp, C. familiaris
tgagcaaaggacctga

SEQ ID NO: 328830 - DNA, 16 bp, C. familiaris
tgagcaaataaataaa

SEQ ID NO: 328831 - DNA, 16 bp, C. familiaris
tgagcaaatgctgttg

SEQ ID NO: 328832 - DNA, 16 bp, C. familiaris
tgagcaactggaagga

SEQ ID NO: 328833 - DNA, 16 bp, C. familiaris
tgagcaaggagctgga

SEQ ID NO: 328834 - DNA, 16 bp, C. familiaris
tgagcacagagcacag

SEQ ID NO: 328835 - DNA, 16 bp, C. familiaris
tgagcacagagtccaa

SEQ ID NO: 328836 - DNA, 16 bp, C. familiaris
tgagcaccaagcctga

SEQ ID NO: 328837 - DNA, 16 bp, C. familiaris
tgagcacccaggcacc

SEQ ID NO: 328838 - DNA, 16 bp, C. familiaris
tgagcacctgctgtat

SEQ ID NO: 328839 - DNA, 16 bp, C. familiaris
tgagcacctgctgtgt

SEQ ID NO: 328840 - DNA, 16 bp, C. familiaris
tgagcactgggtgctg

SEQ ID NO: 328841 - DNA, 16 bp, C. familiaris
tgagcagaagacagac

SEQ ID NO: 328842 - DNA, 16 bp, C. familiaris
tgagcagaagggagat

SEQ ID NO: 328843 - DNA, 16 bp, C. familiaris
tgagcagagagcctgg

SEQ ID NO: 328844 - DNA, 16 bp, C. familiaris
tgagcagagggaggag

SEQ ID NO: 328845 - DNA, 16 bp, C. familiaris
tgagcagatgctcaac

SEQ ID NO: 328846 - DNA, 16 bp, C. familiaris
tgagcagctgactctt

SEQ ID NO: 328847 - DNA, 16 bp, C. familiaris
tgagcaggaaagagag

SEQ ID NO: 328848 - DNA, 16 bp, C. familiaris
tgagcaggaaggaggg

SEQ ID NO: 328849 - DNA, 16 bp, C. familiaris
tgagcaggaggaaggg

SEQ ID NO: 328850 - DNA, 16 bp, C. familiaris
tgagcagggagcacca

SEQ ID NO: 328851 - DNA, 16 bp, C. familiaris
tgagcagggagcggga

SEQ ID NO: 328852 - DNA, 16 bp, C. familiaris
tgagcagggagctggg

SEQ ID NO: 328853 - DNA, 16 bp, C. familiaris
tgagcagggagttcaa

SEQ ID NO: 328854 - DNA, 16 bp, C. familiaris
tgagcaggggagaggc

SEQ ID NO: 328855 - DNA, 16 bp, C. familiaris
tgagcagtgggtgtta

SEQ ID NO: 328856 - DNA, 16 bp, C. familiaris
tgagccaaaaggagat

SEQ ID NO: 328857 - DNA, 16 bp, C. familiaris
tgagccaaatgcagat

SEQ ID NO: 328858 - DNA, 16 bp, C. familiaris
tgagccacacaggctg

SEQ ID NO: 328859 - DNA, 16 bp, C. familiaris
tgagccaccacccagg

SEQ ID NO: 328860 - DNA, 16 bp, C. familiaris
tgagccaccaggtctg

SEQ ID NO: 328861 - DNA, 16 bp, C. familiaris
tgagccacccaaggca

SEQ ID NO: 328862 - DNA, 16 bp, C. familiaris
tgagccacccagtttt

SEQ ID NO: 328863 - DNA, 16 bp, C. familiaris
tgagccaccccaggtg

SEQ ID NO: 328864 - DNA, 16 bp, C. familiaris
tgagccaccttggtgc

SEQ ID NO: 328865 - DNA, 16 bp, C. familiaris
tgagccagaggcagat

SEQ ID NO: 328866 - DNA, 16 bp, C. familiaris
tgagcccagcacccag

SEQ ID NO: 328867 - DNA, 16 bp, C. familiaris
tgagcccaggaccctg

SEQ ID NO: 328868 - DNA, 16 bp, C. familiaris
tgagcccccaggtgcc

SEQ ID NO: 328869 - DNA, 16 bp, C. familiaris
tgagccccccacccca

SEQ ID NO: 328870 - DNA, 16 bp, C. familiaris
tgagccctgagttggg

SEQ ID NO: 328871 - DNA, 16 bp, C. familiaris
tgagccctgggtcagg

SEQ ID NO: 328872 - DNA, 16 bp, C. familiaris
tgagcccttaaaagca

SEQ ID NO: 328873 - DNA, 16 bp, C. familiaris
tgagccgaaggccgac

SEQ ID NO: 328874 - DNA, 16 bp, C. familiaris
tgagcctcagttcctt

SEQ ID NO: 328875 - DNA, 16 bp, C. familiaris
tgagcctgattctgtg

SEQ ID NO: 328876 - DNA, 16 bp, C. familiaris
tgagcctggagcccaa

SEQ ID NO: 328877 - DNA, 16 bp, C. familiaris
tgagcctggagcctga

SEQ ID NO: 328878 - DNA, 16 bp, C. familiaris
tgagcctggcacctgg

SEQ ID NO: 328879 - DNA, 16 bp, C. familiaris
tgagcctgtttcttca

SEQ ID NO: 328880 - DNA, 16 bp, C. familiaris
tgagcgacacagagaa

SEQ ID NO: 328881 - DNA, 16 bp, C. familiaris
tgagcgccaccttcag

SEQ ID NO: 328882 - DNA, 16 bp, C. familiaris
tgagctacccaggcta

SEQ ID NO: 328883 - DNA, 16 bp, C. familiaris
tgagctagagaaaaga

SEQ ID NO: 328884 - DNA, 16 bp, C. familiaris
tgagctcaaaccaaga

SEQ ID NO: 328885 - DNA, 16 bp, C. familiaris
tgagctcagggtggtg

SEQ ID NO: 328886 - DNA, 16 bp, C. familiaris
tgagctccctgcttgg

SEQ ID NO: 328887 - DNA, 16 bp, C. familiaris
tgagctctgcatcagg

SEQ ID NO: 328888 - DNA, 16 bp, C. familiaris
tgagctctgtgctcag

SEQ ID NO: 328889 - DNA, 16 bp, C. familiaris
tgagctgaaagcagag

SEQ ID NO: 328890 - DNA, 16 bp, C. familiaris
tgagctgaaagcagcc

SEQ ID NO: 328891 - DNA, 16 bp, C. familiaris
tgagctgaaatcaaag

SEQ ID NO: 328892 - DNA, 16 bp, C. familiaris
tgagctgaaatctaga

SEQ ID NO: 328893 - DNA, 16 bp, C. familiaris
tgagctgaagtcaaga

SEQ ID NO: 328894 - DNA, 16 bp, C. familiaris
tgagctgaatcttgaa

SEQ ID NO: 328895 - DNA, 16 bp, C. familiaris
tgagctgagatcagga

SEQ ID NO: 328896 - DNA, 16 bp, C. familiaris
tgagctggaggagggg

SEQ ID NO: 328897 - DNA, 16 bp, C. familiaris
tgagctgggggaaggg

SEQ ID NO: 328898 - DNA, 16 bp, C. familiaris
tgagctgtgtggcctt

SEQ ID NO: 328899 - DNA, 16 bp, C. familiaris
tgagcttcctgctcag

SEQ ID NO: 328900 - DNA, 16 bp, C. familiaris
tgaggaaaaagagaca

SEQ ID NO: 328901 - DNA, 16 bp, C. familiaris
tgaggaaactgaagcc

SEQ ID NO: 328902 - DNA, 16 bp, C. familiaris
tgaggaaactgaggca

SEQ ID NO: 328903 - DNA, 16 bp, C. familiaris
tgaggaaatgaaggct

SEQ ID NO: 328904 - DNA, 16 bp, C. familiaris
tgaggaaatggagaaa

SEQ ID NO: 328905 - DNA, 16 bp, C. familiaris
tgaggaaattgaagca

SEQ ID NO: 328906 - DNA, 16 bp, C. familiaris
tgaggaacagaaggaa

SEQ ID NO: 328907 - DNA, 16 bp, C. familiaris
tgaggaagacacagag

SEQ ID NO: 328908 - DNA, 16 bp, C. familiaris
tgaggaagcagagaaa

SEQ ID NO: 328909 - DNA, 16 bp, C. familiaris
tgaggaagcagaggcc

SEQ ID NO: 328910 - DNA, 16 bp, C. familiaris
tgaggaaggaaacagg

SEQ ID NO: 328911 - DNA, 16 bp, C. familiaris
tgaggacacagaggaa

SEQ ID NO: 328912 - DNA, 16 bp, C. familiaris
tgaggacacaggaaga

SEQ ID NO: 328913 - DNA, 16 bp, C. familiaris
tgaggacatggagaaa

SEQ ID NO: 328914 - DNA, 16 bp, C. familiaris
tgaggacattctgcag

SEQ ID NO: 328915 - DNA, 16 bp, C. familiaris
tgaggactctgcttct

SEQ ID NO: 328916 - DNA, 16 bp, C. familiaris
tgaggagacagaaaaa

SEQ ID NO: 328917 - DNA, 16 bp, C. familiaris
tgaggagcaactgatt

SEQ ID NO: 328918 - DNA, 16 bp, C. familiaris
tgaggagcccgatgca

SEQ ID NO: 328919 - DNA, 16 bp, C. familiaris
tgaggagcccgatgtg

SEQ ID NO: 328920 - DNA, 16 bp, C. familiaris
tgaggagcctgcttat

SEQ ID NO: 328921 - DNA, 16 bp, C. familiaris
tgaggaggagcagagg

SEQ ID NO: 328922 - DNA, 16 bp, C. familiaris
tgaggaggatgtggag

SEQ ID NO: 328923 - DNA, 16 bp, C. familiaris
tgaggatgaaatgaga

SEQ ID NO: 328924 - DNA, 16 bp, C. familiaris
tgaggatgaggagaaa

SEQ ID NO: 328925 - DNA, 16 bp, C. familiaris
tgaggatgcagagaga

SEQ ID NO: 328926 - DNA, 16 bp, C. familiaris
tgaggatggagagaag

SEQ ID NO: 328927 - DNA, 16 bp, C. familiaris
tgaggatgtgaagcaa

SEQ ID NO: 328928 - DNA, 16 bp, C. familiaris
tgaggatgtggtgaaa

SEQ ID NO: 328929 - DNA, 16 bp, C. familiaris
tgaggcaaaagaaaaa

SEQ ID NO: 328930 - DNA, 16 bp, C. familiaris
tgaggcaaaggcagat

SEQ ID NO: 328931 - DNA, 16 bp, C. familiaris
tgaggcagaagaaaaa

SEQ ID NO: 328932 - DNA, 16 bp, C. familiaris
tgaggccagcatcgcc

SEQ ID NO: 328933 - DNA, 16 bp, C. familiaris
tgaggcccagagacag

SEQ ID NO: 328934 - DNA, 16 bp, C. familiaris
tgaggcccagggaggg

SEQ ID NO: 328935 - DNA, 16 bp, C. familiaris
tgaggcccctgctccc

SEQ ID NO: 328936 - DNA, 16 bp, C. familiaris
tgaggcctgaggcctg

SEQ ID NO: 328937 - DNA, 16 bp, C. familiaris
tgaggcctgttttgtg

SEQ ID NO: 328938 - DNA, 16 bp, C. familiaris
tgaggctcagagaagc

SEQ ID NO: 328939 - DNA, 16 bp, C. familiaris
tgaggctcagtttctt

SEQ ID NO: 328940 - DNA, 16 bp, C. familiaris
tgaggctgcaggagga

SEQ ID NO: 328941 - DNA, 16 bp, C. familiaris
tgaggctggggcaggg

SEQ ID NO: 328942 - DNA, 16 bp, C. familiaris
tgaggctgtgtgtgtg

SEQ ID NO: 328943 - DNA, 16 bp, C. familiaris
tgaggcttgttttgtg

SEQ ID NO: 328944 - DNA, 16 bp, C. familiaris
tgagggaagacacaaa

SEQ ID NO: 328945 - DNA, 16 bp, C. familiaris
tgagggaagcctgctt

SEQ ID NO: 328946 - DNA, 16 bp, C. familiaris
tgagggaatgggtgaa

SEQ ID NO: 328947 - DNA, 16 bp, C. familiaris
tgagggagacagagag

SEQ ID NO: 328948 - DNA, 16 bp, C. familiaris
tgagggaggagcagag

SEQ ID NO: 328949 - DNA, 16 bp, C. familiaris
tgagggattaaaaaaa

SEQ ID NO: 328950 - DNA, 16 bp, C. familiaris
tgagggcagagctggg

SEQ ID NO: 328951 - DNA, 16 bp, C. familiaris
tgagggcagccagggt

SEQ ID NO: 328952 - DNA, 16 bp, C. familiaris
tgagggccctcttcct

SEQ ID NO: 328953 - DNA, 16 bp, C. familiaris
tgaggggcagaaggag

SEQ ID NO: 328954 - DNA, 16 bp, C. familiaris
tgaggggcttctgggt

SEQ ID NO: 328955 - DNA, 16 bp, C. familiaris
tgaggggggcacctgg

SEQ ID NO: 328956 - DNA, 16 bp, C. familiaris
tgaggggtgctggagg

SEQ ID NO: 328957 - DNA, 16 bp, C. familiaris
tgagggtgcagagaaa

SEQ ID NO: 328958 - DNA, 16 bp, C. familiaris
tgagggtggagcccca

SEQ ID NO: 328959 - DNA, 16 bp, C. familiaris
tgagggtggagccccc

SEQ ID NO: 328960 - DNA, 16 bp, C. familiaris
tgagggttgctggagg

SEQ ID NO: 328961 - DNA, 16 bp, C. familiaris
tgaggtgaaggcagat

SEQ ID NO: 328962 - DNA, 16 bp, C. familiaris
tgaggtgcttgctgaa

SEQ ID NO: 328963 - DNA, 16 bp, C. familiaris
tgaggtggctcagttg

SEQ ID NO: 328964 - DNA, 16 bp, C. familiaris
tgaggttgtggagaaa

SEQ ID NO: 328965 - DNA, 16 bp, C. familiaris
tgagtaaagaaaatgt

SEQ ID NO: 328966 - DNA, 16 bp, C. familiaris
tgagtaatatttcatc

SEQ ID NO: 328967 - DNA, 16 bp, C. familiaris
tgagtatatgtgtgtg

SEQ ID NO: 328968 - DNA, 16 bp, C. familiaris
tgagtatggagcccca

SEQ ID NO: 328969 - DNA, 16 bp, C. familiaris
tgagtcaatgaatgaa

SEQ ID NO: 328970 - DNA, 16 bp, C. familiaris
tgagtcacagagagag

SEQ ID NO: 328971 - DNA, 16 bp, C. familiaris
tgagtcaggctctctg

SEQ ID NO: 328972 - DNA, 16 bp, C. familiaris
tgagtcccacatggag

SEQ ID NO: 328973 - DNA, 16 bp, C. familiaris
tgagtcctacatcagg

SEQ ID NO: 328974 - DNA, 16 bp, C. familiaris
tgagtcctgctttggg

SEQ ID NO: 328975 - DNA, 16 bp, C. familiaris
tgagtcgaaaccaaga

SEQ ID NO: 328976 - DNA, 16 bp, C. familiaris
tgagtgaagtcagtca

SEQ ID NO: 328977 - DNA, 16 bp, C. familiaris
tgagtgaataaaatct

SEQ ID NO: 328978 - DNA, 16 bp, C. familiaris
tgagtgatgttgagga

SEQ ID NO: 328979 - DNA, 16 bp, C. familiaris
tgagtgcctgccttcc

SEQ ID NO: 328980 - DNA, 16 bp, C. familiaris
tgagtggaaaggaaaa

SEQ ID NO: 328981 - DNA, 16 bp, C. familiaris
tgagtggaaaggaaag

SEQ ID NO: 328982 - DNA, 16 bp, C. familiaris
tgagtggcaggcagag

SEQ ID NO: 328983 - DNA, 16 bp, C. familiaris
tgagtggggagctgga

SEQ ID NO: 328984 - DNA, 16 bp, C. familiaris
tgagtggggctccctg

SEQ ID NO: 328985 - DNA, 16 bp, C. familiaris
tgagtgtctgccttcc

SEQ ID NO: 328986 - DNA, 16 bp, C. familiaris
tgagtgtgcatgtgtg

SEQ ID NO: 328987 - DNA, 16 bp, C. familiaris
tgagtgtggagcctgc

SEQ ID NO: 328988 - DNA, 16 bp, C. familiaris
tgagtgtggagcttgc

SEQ ID NO: 328989 - DNA, 16 bp, C. familiaris
tgagtgtgtgtgagtg

SEQ ID NO: 328990 - DNA, 16 bp, C. familiaris
tgagttatcaagccat

SEQ ID NO: 328991 - DNA, 16 bp, C. familiaris
tgagttccagccccac

SEQ ID NO: 328992 - DNA, 16 bp, C. familiaris
tgagttccagccccag

SEQ ID NO: 328993 - DNA, 16 bp, C. familiaris
tgagttctatgagcca

SEQ ID NO: 328994 - DNA, 16 bp, C. familiaris
tgagttgaggagaaag

SEQ ID NO: 328995 - DNA, 16 bp, C. familiaris
tgagtttaagaagttc

SEQ ID NO: 328996 - DNA, 16 bp, C. familiaris
tgagtttgagccacat

SEQ ID NO: 328997 - DNA, 16 bp, C. familiaris
tgagtttgagccccac

SEQ ID NO: 328998 - DNA, 16 bp, C. familiaris
tgagtttggtaagttc

SEQ ID NO: 328999 - DNA, 16 bp, C. familiaris
tgagttttgaaggatg

SEQ ID NO: 329000 - DNA, 16 bp, C. familiaris
tgataaaatatttgaa

SEQ ID NO: 329001 - DNA, 16 bp, C. familiaris
tgataaagaaaatgtg

SEQ ID NO: 329002 - DNA, 16 bp, C. familiaris
tgataaagaatattta

SEQ ID NO: 329003 - DNA, 16 bp, C. familiaris
tgataaagtattttaa

SEQ ID NO: 329004 - DNA, 16 bp, C. familiaris
tgataaatgctatgaa

SEQ ID NO: 329005 - DNA, 16 bp, C. familiaris
tgataattcatttctt

SEQ ID NO: 329006 - DNA, 16 bp, C. familiaris
tgataattcccactca

SEQ ID NO: 329007 - DNA, 16 bp, C. familiaris
tgatacaatgagcact

SEQ ID NO: 329008 - DNA, 16 bp, C. familiaris
tgatacctccaacttt

SEQ ID NO: 329009 - DNA, 16 bp, C. familiaris
tgatacctctggcttt

SEQ ID NO: 329010 - DNA, 16 bp, C. familiaris
tgatactccattgtat

SEQ ID NO: 329011 - DNA, 16 bp, C. familiaris
tgatactctacataga

SEQ ID NO: 329012 - DNA, 16 bp, C. familiaris
tgatagaaattgaaga

SEQ ID NO: 329013 - DNA, 16 bp, C. familiaris
tgatagacacagaggg

SEQ ID NO: 329014 - DNA, 16 bp, C. familiaris
tgatagagaattcaaa

SEQ ID NO: 329015 - DNA, 16 bp, C. familiaris
tgataggggacttgat

SEQ ID NO: 329016 - DNA, 16 bp, C. familiaris
tgatatatttaaagtg

SEQ ID NO: 329017 - DNA, 16 bp, C. familiaris
tgatatccatttgcat

SEQ ID NO: 329018 - DNA, 16 bp, C. familiaris
tgatatctccctgtgg

SEQ ID NO: 329019 - DNA, 16 bp, C. familiaris
tgatatctccttgtgg

SEQ ID NO: 329020 - DNA, 16 bp, C. familiaris
tgatatggaacatctt

SEQ ID NO: 329021 - DNA, 16 bp, C. familiaris
tgatatttgtctttcc

SEQ ID NO: 329022 - DNA, 16 bp, C. familiaris
tgatcacagctttgca

SEQ ID NO: 329023 - DNA, 16 bp, C. familiaris
tgatcacatgaccctg

SEQ ID NO: 329024 - DNA, 16 bp, C. familiaris
tgatcatcttttcatg

SEQ ID NO: 329025 - DNA, 16 bp, C. familiaris
tgatccactttgagtt

SEQ ID NO: 329026 - DNA, 16 bp, C. familiaris
tgatccagaaattcta

SEQ ID NO: 329027 - DNA, 16 bp, C. familiaris
tgatccaggtctccag

SEQ ID NO: 329028 - DNA, 16 bp, C. familiaris
tgatcccaggacctgg

SEQ ID NO: 329029 - DNA, 16 bp, C. familiaris
tgatcccagggacctg

SEQ ID NO: 329030 - DNA, 16 bp, C. familiaris
tgatcccagggtcatg

SEQ ID NO: 329031 - DNA, 16 bp, C. familiaris
tgatcccagtatcctg

SEQ ID NO: 329032 - DNA, 16 bp, C. familiaris
tgatcccggggtccct

SEQ ID NO: 329033 - DNA, 16 bp, C. familiaris
tgatccctgggttctg

SEQ ID NO: 329034 - DNA, 16 bp, C. familiaris
tgatcctcagggtcct

SEQ ID NO: 329035 - DNA, 16 bp, C. familiaris
tgatcctgagacctgg

SEQ ID NO: 329036 - DNA, 16 bp, C. familiaris
tgatcctgaggccctg

SEQ ID NO: 329037 - DNA, 16 bp, C. familiaris
tgatcctgaggtcctg

SEQ ID NO: 329038 - DNA, 16 bp, C. familiaris
tgatcctgcggtcccg

SEQ ID NO: 329039 - DNA, 16 bp, C. familiaris
tgatcctggaatccag

SEQ ID NO: 329040 - DNA, 16 bp, C. familiaris
tgatcctggagaacca

SEQ ID NO: 329041 - DNA, 16 bp, C. familiaris
tgatcctggagaactg

SEQ ID NO: 329042 - DNA, 16 bp, C. familiaris
tgatcctggatcctgg

SEQ ID NO: 329043 - DNA, 16 bp, C. familiaris
tgatcctgggagtcct

SEQ ID NO: 329044 - DNA, 16 bp, C. familiaris
tgatcctggggtccta

SEQ ID NO: 329045 - DNA, 16 bp, C. familiaris
tgatcctgggtccagg

SEQ ID NO: 329046 - DNA, 16 bp, C. familiaris
tgatcctttgttttgt

SEQ ID NO: 329047 - DNA, 16 bp, C. familiaris
tgatctagtaattcca

SEQ ID NO: 329048 - DNA, 16 bp, C. familiaris
tgatctatgtgtctgg

SEQ ID NO: 329049 - DNA, 16 bp, C. familiaris
tgatctcaaggtcaag

SEQ ID NO: 329050 - DNA, 16 bp, C. familiaris
tgatctcacagtcatg

SEQ ID NO: 329051 - DNA, 16 bp, C. familiaris
tgatctcaccaccctg

SEQ ID NO: 329052 - DNA, 16 bp, C. familiaris
tgatctcatgacactg

SEQ ID NO: 329053 - DNA, 16 bp, C. familiaris
tgatctccagatcctg

SEQ ID NO: 329054 - DNA, 16 bp, C. familiaris
tgatctgagccaaaag

SEQ ID NO: 329055 - DNA, 16 bp, C. familiaris
tgatctgctttttgtc

SEQ ID NO: 329056 - DNA, 16 bp, C. familiaris
tgatctggagacccag

SEQ ID NO: 329057 - DNA, 17 bp, C. familiaris
tgatctggagaccctgg

SEQ ID NO: 329058 - DNA, 16 bp, C. familiaris
tgatctggcccctgcc

SEQ ID NO: 329059 - DNA, 16 bp, C. familiaris
tgatcttggggcacct

SEQ ID NO: 329060 - DNA, 16 bp, C. familiaris
tgatcttttcaaggaa

SEQ ID NO: 329061 - DNA, 16 bp, C. familiaris
tgatgaaaaagtttga

SEQ ID NO: 329062 - DNA, 16 bp, C. familiaris
tgatgaaaatattcca

SEQ ID NO: 329063 - DNA, 16 bp, C. familiaris
tgatgaaaatattcta

SEQ ID NO: 329064 - DNA, 16 bp, C. familiaris
tgatgaaagatattga

SEQ ID NO: 329065 - DNA, 16 bp, C. familiaris
tgatgaaattttggaa

SEQ ID NO: 329066 - DNA, 16 bp, C. familiaris
tgatgaacatctttgt

SEQ ID NO: 329067 - DNA, 16 bp, C. familiaris
tgatgaagaaattgaa

SEQ ID NO: 329068 - DNA, 16 bp, C. familiaris
tgatgaagatgataat

SEQ ID NO: 329069 - DNA, 16 bp, C. familiaris
tgatgaagatgatggt

SEQ ID NO: 329070 - DNA, 16 bp, C. familiaris
tgatgaagatgtggag

SEQ ID NO: 329071 - DNA, 16 bp, C. familiaris
tgatgaatgatattga

SEQ ID NO: 329072 - DNA, 16 bp, C. familiaris
tgatgaatggattaaa

SEQ ID NO: 329073 - DNA, 16 bp, C. familiaris
tgatgaatttttacaa

SEQ ID NO: 329074 - DNA, 16 bp, C. familiaris
tgatgacaatggtgat

SEQ ID NO: 329075 - DNA, 16 bp, C. familiaris
tgatgagaatgtaaaa

SEQ ID NO: 329076 - DNA, 16 bp, C. familiaris
tgatgagaatttttaa

SEQ ID NO: 329077 - DNA, 16 bp, C. familiaris
tgatgagagacagaga

SEQ ID NO: 329078 - DNA, 16 bp, C. familiaris
tgatgagatggagaaa

SEQ ID NO: 329079 - DNA, 16 bp, C. familiaris
tgatgagcaatgggtg

SEQ ID NO: 329080 - DNA, 16 bp, C. familiaris
tgatgagcacctggtg

SEQ ID NO: 329081 - DNA, 16 bp, C. familiaris
tgatgaggatgaagga

SEQ ID NO: 329082 - DNA, 16 bp, C. familiaris
tgatgaggatgtgaag

SEQ ID NO: 329083 - DNA, 16 bp, C. familiaris
tgatgagggagcagaa

SEQ ID NO: 329084 - DNA, 16 bp, C. familiaris
tgatgatgaagatgat

SEQ ID NO: 329085 - DNA, 16 bp, C. familiaris
tgatgatgacaatgat

SEQ ID NO: 329086 - DNA, 16 bp, C. familiaris
tgatgatgacagtgat

SEQ ID NO: 329087 - DNA, 16 bp, C. familiaris
tgatgatgatgaaaat

SEQ ID NO: 329088 - DNA, 16 bp, C. familiaris
tgatgatgatgaagat

SEQ ID NO: 329089 - DNA, 16 bp, C. familiaris
tgatgatgatgacaac

SEQ ID NO: 329090 - DNA, 16 bp, C. familiaris
tgatgatgatgacgat

SEQ ID NO: 329091 - DNA, 16 bp, C. familiaris
tgatgatgatgataac

SEQ ID NO: 329092 - DNA, 16 bp, C. familiaris
tgatgatgatgataca

SEQ ID NO: 329093 - DNA, 16 bp, C. familiaris
tgatgatgatgatata

SEQ ID NO: 329094 - DNA, 16 bp, C. familiaris
tgatgatgatgatgaa

SEQ ID NO: 329095 - DNA, 17 bp, C. familiaris
tgatgatgatgatgaga

SEQ ID NO: 329096 - DNA, 16 bp, C. familiaris
tgatgatgatgatgat

SEQ ID NO: 329097 - DNA, 16 bp, C. familiaris
tgatgatgatgatgtg

SEQ ID NO: 329098 - DNA, 16 bp, C. familiaris
tgatgatgatgattca

SEQ ID NO: 329099 - DNA, 16 bp, C. familiaris
tgatgatgattttgat

SEQ ID NO: 329100 - DNA, 16 bp, C. familiaris
tgatgatggaaatatt

SEQ ID NO: 329101 - DNA, 16 bp, C. familiaris
tgatgatggaaatgtt

SEQ ID NO: 329102 - DNA, 16 bp, C. familiaris
tgatgatggtgatgat

SEQ ID NO: 329103 - DNA, 16 bp, C. familiaris
tgatgatggtggtggt

SEQ ID NO: 329104 - DNA, 16 bp, C. familiaris
tgatgatgtcactgag

SEQ ID NO: 329105 - DNA, 16 bp, C. familiaris
tgatgattttttggat

SEQ ID NO: 329106 - DNA, 16 bp, C. familiaris
tgatgcagggctcagt

SEQ ID NO: 329107 - DNA, 16 bp, C. familiaris
tgatgcagggctctat

SEQ ID NO: 329108 - DNA, 16 bp, C. familiaris
tgatgcaggtctcaat

SEQ ID NO: 329109 - DNA, 16 bp, C. familiaris
tgatgccaaagccaga

SEQ ID NO: 329110 - DNA, 16 bp, C. familiaris
tgatgcctgcttctcc

SEQ ID NO: 329111 - DNA, 16 bp, C. familiaris
tgatgctgctgctgct

SEQ ID NO: 329112 - DNA, 16 bp, C. familiaris
tgatggacacttggtt

SEQ ID NO: 329113 - DNA, 16 bp, C. familiaris
tgatggagaagctgca

SEQ ID NO: 329114 - DNA, 16 bp, C. familiaris
tgatggagagaagaaa

SEQ ID NO: 329115 - DNA, 16 bp, C. familiaris
tgatggatctgggcaa

SEQ ID NO: 329116 - DNA, 17 bp, C. familiaris
tgatgggaatgcaagct

SEQ ID NO: 329117 - DNA, 16 bp, C. familiaris
tgatgggcactggggg

SEQ ID NO: 329118 - DNA, 16 bp, C. familiaris
tgatgggcagcctggg

SEQ ID NO: 329119 - DNA, 16 bp, C. familiaris
tgatgggccctgaggg

SEQ ID NO: 329120 - DNA, 16 bp, C. familiaris
tgatggtgaggatgtg

SEQ ID NO: 329121 - DNA, 16 bp, C. familiaris
tgatggtggtgatggt

SEQ ID NO: 329122 - DNA, 16 bp, C. familiaris
tgatggtgtttggagg

SEQ ID NO: 329123 - DNA, 16 bp, C. familiaris
tgatgtaaataaatga

SEQ ID NO: 329124 - DNA, 16 bp, C. familiaris
tgatgtatctgataaa

SEQ ID NO: 329125 - DNA, 16 bp, C. familiaris
tgatgtcaaggagctt

SEQ ID NO: 329126 - DNA, 16 bp, C. familiaris
tgatgtctccaacttt

SEQ ID NO: 329127 - DNA, 16 bp, C. familiaris
tgatgtggaaaaaaaa

SEQ ID NO: 329128 - DNA, 16 bp, C. familiaris
tgatgtggaactggat

SEQ ID NO: 329129 - DNA, 16 bp, C. familiaris
tgatgtggagtatttt

SEQ ID NO: 329130 - DNA, 16 bp, C. familiaris
tgatgtgggactccca

SEQ ID NO: 329131 - DNA, 16 bp, C. familiaris
tgatgtggggctctat

SEQ ID NO: 329132 - DNA, 16 bp, C. familiaris
tgatgtggtgcttgat

SEQ ID NO: 329133 - DNA, 16 bp, C. familiaris
tgattaaaactcttca

SEQ ID NO: 329134 - DNA, 16 bp, C. familiaris
tgattaatgatgctga

SEQ ID NO: 329135 - DNA, 16 bp, C. familiaris
tgattacagattcaat

SEQ ID NO: 329136 - DNA, 16 bp, C. familiaris
tgattatgattatgat

SEQ ID NO: 329137 - DNA, 16 bp, C. familiaris
tgattatttgaaaaga

SEQ ID NO: 329138 - DNA, 16 bp, C. familiaris
tgattattttaaagaa

SEQ ID NO: 329139 - DNA, 16 bp, C. familiaris
tgattcaatttttaaa

SEQ ID NO: 329140 - DNA, 16 bp, C. familiaris
tgattcagaaattctg

SEQ ID NO: 329141 - DNA, 16 bp, C. familiaris
tgattcagcaactcta

SEQ ID NO: 329142 - DNA, 16 bp, C. familiaris
tgattcagcaatctca

SEQ ID NO: 329143 - DNA, 16 bp, C. familiaris
tgattcatcagtttca

SEQ ID NO: 329144 - DNA, 16 bp, C. familiaris
tgattcatttaaaata

SEQ ID NO: 329145 - DNA, 16 bp, C. familiaris
tgattccaactatgtg

SEQ ID NO: 329146 - DNA, 16 bp, C. familiaris
tgattccagagtcccg

SEQ ID NO: 329147 - DNA, 16 bp, C. familiaris
tgattctcaaactttt

SEQ ID NO: 329148 - DNA, 16 bp, C. familiaris
tgattctcaagtgtct

SEQ ID NO: 329149 - DNA, 16 bp, C. familiaris
tgattctgttttctct

SEQ ID NO: 329150 - DNA, 16 bp, C. familiaris
tgattctttcctctgt

SEQ ID NO: 329151 - DNA, 16 bp, C. familiaris
tgattgaataaatgaa

SEQ ID NO: 329152 - DNA, 16 bp, C. familiaris
tgattgctgtggccag

SEQ ID NO: 329153 - DNA, 16 bp, C. familiaris
tgattggcttatttca

SEQ ID NO: 329154 - DNA, 16 bp, C. familiaris
tgattgtggtggtagt

SEQ ID NO: 329155 - DNA, 16 bp, C. familiaris
tgatttaaaaaatgta

SEQ ID NO: 329156 - DNA, 16 bp, C. familiaris
tgatttaaaaacaaaa

SEQ ID NO: 329157 - DNA, 16 bp, C. familiaris
tgatttattctggaga

SEQ ID NO: 329158 - DNA, 16 bp, C. familiaris
tgatttcaaaaataaa

SEQ ID NO: 329159 - DNA, 16 bp, C. familiaris
tgatttcaaaccatat

SEQ ID NO: 329160 - DNA, 16 bp, C. familiaris
tgatttccagagtggc

SEQ ID NO: 329161 - DNA, 16 bp, C. familiaris
tgatttcctggttgac

SEQ ID NO: 329162 - DNA, 16 bp, C. familiaris
tgatttctattttcat

SEQ ID NO: 329163 - DNA, 16 bp, C. familiaris
tgatttctgtatgttg

SEQ ID NO: 329164 - DNA, 16 bp, C. familiaris
tgatttctttgccaat

SEQ ID NO: 329165 - DNA, 16 bp, C. familiaris
tgatttcttttaaatt

SEQ ID NO: 329166 - DNA, 16 bp, C. familiaris
tgatttgtgtggaatc

SEQ ID NO: 329167 - DNA, 16 bp, C. familiaris
tgattttaaaaacaca

SEQ ID NO: 329168 - DNA, 16 bp, C. familiaris
tgattttaaattttct

SEQ ID NO: 329169 - DNA, 16 bp, C. familiaris
tgattttagcaattct

SEQ ID NO: 329170 - DNA, 16 bp, C. familiaris
tgattttatattctgt

SEQ ID NO: 329171 - DNA, 16 bp, C. familiaris
tgattttcaaagccaa

SEQ ID NO: 329172 - DNA, 16 bp, C. familiaris
tgattttcaagtgtta

SEQ ID NO: 329173 - DNA, 16 bp, C. familiaris
tgattttcaccattct

SEQ ID NO: 329174 - DNA, 16 bp, C. familiaris
tgattttctctattga

SEQ ID NO: 329175 - DNA, 16 bp, C. familiaris
tgattttctgtctgaa

SEQ ID NO: 329176 - DNA, 16 bp, C. familiaris
tgattttctttgaatt

SEQ ID NO: 329177 - DNA, 16 bp, C. familiaris
tgattttgaagaaaaa

SEQ ID NO: 329178 - DNA, 16 bp, C. familiaris
tgattttggatttcta

SEQ ID NO: 329179 - DNA, 16 bp, C. familiaris
tgatttttcaagaaaa

SEQ ID NO: 329180 - DNA, 16 bp, C. familiaris
tgatttttttccctct

SEQ ID NO: 329181 - DNA, 16 bp, C. familiaris
tgatttttttctcccc

SEQ ID NO: 329182 - DNA, 16 bp, C. familiaris
tgcaaaaatctcaaca

SEQ ID NO: 329183 - DNA, 16 bp, C. familiaris
tgcaaaaatggttcaa

SEQ ID NO: 329184 - DNA, 16 bp, C. familiaris
tgcaaaacaagaatag

SEQ ID NO: 329185 - DNA, 16 bp, C. familiaris
tgcaaaactgaagctc

SEQ ID NO: 329186 - DNA, 16 bp, C. familiaris
tgcaaaagaaagaaac

SEQ ID NO: 329187 - DNA, 16 bp, C. familiaris
tgcaaaaggcaaaact

SEQ ID NO: 329188 - DNA, 16 bp, C. familiaris
tgcaaaaggcaagatt

SEQ ID NO: 329189 - DNA, 16 bp, C. familiaris
tgcaaaatatgtgaag

SEQ ID NO: 329190 - DNA, 16 bp, C. familiaris
tgcaaaatgatgattt

SEQ ID NO: 329191 - DNA, 16 bp, C. familiaris
tgcaaactcttctcac

SEQ ID NO: 329192 - DNA, 16 bp, C. familiaris
tgcaaagaaaaaggaa

SEQ ID NO: 329193 - DNA, 16 bp, C. familiaris
tgcaaagaaaaatgaa

SEQ ID NO: 329194 - DNA, 16 bp, C. familiaris
tgcaaagaagaaaata

SEQ ID NO: 329195 - DNA, 16 bp, C. familiaris
tgcaaagaggaagagt

SEQ ID NO: 329196 - DNA, 16 bp, C. familiaris
tgcaaagatcttctcc

SEQ ID NO: 329197 - DNA, 16 bp, C. familiaris
tgcaaagatgtggatg

SEQ ID NO: 329198 - DNA, 16 bp, C. familiaris
tgcaaagcttcagttc

SEQ ID NO: 329199 - DNA, 16 bp, C. familiaris
tgcaaaggagagacca

SEQ ID NO: 329200 - DNA, 16 bp, C. familiaris
tgcaaaggcctggagg

SEQ ID NO: 329201 - DNA, 16 bp, C. familiaris
tgcaaagggagaagca

SEQ ID NO: 329202 - DNA, 16 bp, C. familiaris
tgcaaatagtggcagt

SEQ ID NO: 329203 - DNA, 16 bp, C. familiaris
tgcaaatagtttctcc

SEQ ID NO: 329204 - DNA, 16 bp, C. familiaris
tgcaaatattaaacca

SEQ ID NO: 329205 - DNA, 16 bp, C. familiaris
tgcaaatattttcacc

SEQ ID NO: 329206 - DNA, 16 bp, C. familiaris
tgcaaatatttttcct

SEQ ID NO: 329207 - DNA, 16 bp, C. familiaris
tgcaaatgaaaaccaa

SEQ ID NO: 329208 - DNA, 16 bp, C. familiaris
tgcaaatgtgattaag

SEQ ID NO: 329209 - DNA, 16 bp, C. familiaris
tgcaaccactatggaa

SEQ ID NO: 329210 - DNA, 16 bp, C. familiaris
tgcaaccatgtggatg

SEQ ID NO: 329211 - DNA, 16 bp, C. familiaris
tgcaactgatttttat

SEQ ID NO: 329212 - DNA, 16 bp, C. familiaris
tgcaactttactaaat

SEQ ID NO: 329213 - DNA, 16 bp, C. familiaris
tgcaagatgaaaaaaa

SEQ ID NO: 329214 - DNA, 16 bp, C. familiaris
tgcaagcaacagaaat

SEQ ID NO: 329215 - DNA, 16 bp, C. familiaris
tgcaagccaggaagaa

SEQ ID NO: 329216 - DNA, 16 bp, C. familiaris
tgcaaggaaatgaatt

SEQ ID NO: 329217 - DNA, 16 bp, C. familiaris
tgcaaggagcatgatg

SEQ ID NO: 329218 - DNA, 16 bp, C. familiaris
tgcaaggagcccaacg

SEQ ID NO: 329219 - DNA, 16 bp, C. familiaris
tgcaaggagccccatg

SEQ ID NO: 329220 - DNA, 16 bp, C. familiaris
tgcaaggatagttcaa

SEQ ID NO: 329221 - DNA, 16 bp, C. familiaris
tgcaaggatgtggatg

SEQ ID NO: 329222 - DNA, 16 bp, C. familiaris
tgcaaggctgcttcaa

SEQ ID NO: 329223 - DNA, 16 bp, C. familiaris
tgcaatattttaaaaa

SEQ ID NO: 329224 - DNA, 16 bp, C. familiaris
tgcaatggatttctgt

SEQ ID NO: 329225 - DNA, 16 bp, C. familiaris
tgcaattcctatcaaa

SEQ ID NO: 329226 - DNA, 16 bp, C. familiaris
tgcaattcttgatctt

SEQ ID NO: 329227 - DNA, 16 bp, C. familiaris
tgcacaaagatgttca

SEQ ID NO: 329228 - DNA, 16 bp, C. familiaris
tgcacaacatagtgat

SEQ ID NO: 329229 - DNA, 16 bp, C. familiaris
tgcacaagggctcctt

SEQ ID NO: 329230 - DNA, 16 bp, C. familiaris
tgcacacacacatcca

SEQ ID NO: 329231 - DNA, 16 bp, C. familiaris
tgcacacacaccccca

SEQ ID NO: 329232 - DNA, 16 bp, C. familiaris
tgcacacactctctct

SEQ ID NO: 329233 - DNA, 16 bp, C. familiaris
tgcacacagcatacac

SEQ ID NO: 329234 - DNA, 16 bp, C. familiaris
tgcacacaggtgcaca

SEQ ID NO: 329235 - DNA, 16 bp, C. familiaris
tgcacacatacacata

SEQ ID NO: 329236 - DNA, 16 bp, C. familiaris
tgcacactgatgttta

SEQ ID NO: 329237 - DNA, 16 bp, C. familiaris
tgcacactttctctct

SEQ ID NO: 329238 - DNA, 16 bp, C. familiaris
tgcacagaagcttttt

SEQ ID NO: 329239 - DNA, 16 bp, C. familiaris
tgcacagcaaagaaaa

SEQ ID NO: 329240 - DNA, 16 bp, C. familiaris
tgcacagtggggagtc

SEQ ID NO: 329241 - DNA, 16 bp, C. familiaris
tgcacatatacacata

SEQ ID NO: 329242 - DNA, 16 bp, C. familiaris
tgcacatgtgtgtgtt

SEQ ID NO: 329243 - DNA, 16 bp, C. familiaris
tgcacatttcatgatt

SEQ ID NO: 329244 - DNA, 17 bp, C. familiaris
tgcacccaaaggcataa

SEQ ID NO: 329245 - DNA, 16 bp, C. familiaris
tgcacccactctggaa

SEQ ID NO: 329246 - DNA, 16 bp, C. familiaris
tgcacctcagttttct

SEQ ID NO: 329247 - DNA, 16 bp, C. familiaris
tgcacctgcacctgca

SEQ ID NO: 329248 - DNA, 16 bp, C. familiaris
tgcacctgctctctct

SEQ ID NO: 329249 - DNA, 16 bp, C. familiaris
tgcactaatttacatt

SEQ ID NO: 329250 - DNA, 16 bp, C. familiaris
tgcactcagcctggag

SEQ ID NO: 329251 - DNA, 16 bp, C. familiaris
tgcactcagtgtggaa

SEQ ID NO: 329252 - DNA, 16 bp, C. familiaris
tgcactccttaattcc

SEQ ID NO: 329253 - DNA, 16 bp, C. familiaris
tgcactgagcccagag

SEQ ID NO: 329254 - DNA, 16 bp, C. familiaris
tgcactgagtgtggaa

SEQ ID NO: 329255 - DNA, 16 bp, C. familiaris
tgcactgcaaaagaaa

SEQ ID NO: 329256 - DNA, 16 bp, C. familiaris
tgcactggaaaagaat

SEQ ID NO: 329257 - DNA, 16 bp, C. familiaris
tgcactggaccagatg

SEQ ID NO: 329258 - DNA, 16 bp, C. familiaris
tgcactgtccaatatg

SEQ ID NO: 329259 - DNA, 16 bp, C. familiaris
tgcagaaaaaaagcat

SEQ ID NO: 329260 - DNA, 16 bp, C. familiaris
tgcagaaaaatgaaac

SEQ ID NO: 329261 - DNA, 16 bp, C. familiaris
tgcagaaaacacattt

SEQ ID NO: 329262 - DNA, 16 bp, C. familiaris
tgcagaaatggaaaag

SEQ ID NO: 329263 - DNA, 16 bp, C. familiaris
tgcagaaatgtctatt

SEQ ID NO: 329264 - DNA, 16 bp, C. familiaris
tgcagaagaatgatac

SEQ ID NO: 329265 - DNA, 16 bp, C. familiaris
tgcagaatataagaaa

SEQ ID NO: 329266 - DNA, 16 bp, C. familiaris
tgcagactgggagctg

SEQ ID NO: 329267 - DNA, 16 bp, C. familiaris
tgcagagacacaagca

SEQ ID NO: 329268 - DNA, 16 bp, C. familiaris
tgcagagacacctgct

SEQ ID NO: 329269 - DNA, 16 bp, C. familiaris
tgcagagagagagaga

SEQ ID NO: 329270 - DNA, 16 bp, C. familiaris
tgcagagagccccacg

SEQ ID NO: 329271 - DNA, 16 bp, C. familiaris
tgcagagcatggagcc

SEQ ID NO: 329272 - DNA, 16 bp, C. familiaris
tgcagagcccaacatg

SEQ ID NO: 329273 - DNA, 16 bp, C. familiaris
tgcagagcctgatggg

SEQ ID NO: 329274 - DNA, 16 bp, C. familiaris
tgcagaggccctgagg

SEQ ID NO: 329275 - DNA, 16 bp, C. familiaris
tgcagaggctctcctt

SEQ ID NO: 329276 - DNA, 16 bp, C. familiaris
tgcagagtctgcttca

SEQ ID NO: 329277 - DNA, 16 bp, C. familiaris
tgcagatgactggcct

SEQ ID NO: 329278 - DNA, 16 bp, C. familiaris
tgcagatggcaagatc

SEQ ID NO: 329279 - DNA, 16 bp, C. familiaris
tgcagatggccacctt

SEQ ID NO: 329280 - DNA, 16 bp, C. familiaris
tgcagatgtcattaag

SEQ ID NO: 329281 - DNA, 16 bp, C. familiaris
tgcagattcagtgcaa

SEQ ID NO: 329282 - DNA, 16 bp, C. familiaris
tgcagattttatttta

SEQ ID NO: 329283 - DNA, 16 bp, C. familiaris
tgcagattttttccat

SEQ ID NO: 329284 - DNA, 16 bp, C. familiaris
tgcagcaaggctctca

SEQ ID NO: 329285 - DNA, 16 bp, C. familiaris
tgcagcattacttaca

SEQ ID NO: 329286 - DNA, 16 bp, C. familiaris
tgcagccactgtggag

SEQ ID NO: 329287 - DNA, 16 bp, C. familiaris
tgcagccactgtggga

SEQ ID NO: 329288 - DNA, 16 bp, C. familiaris
tgcagcccagggcctg

SEQ ID NO: 329289 - DNA, 16 bp, C. familiaris
tgcagcccagggcgcg

SEQ ID NO: 329290 - DNA, 16 bp, C. familiaris
tgcagcccctgtggaa

SEQ ID NO: 329291 - DNA, 16 bp, C. familiaris
tgcagccctgcagccc

SEQ ID NO: 329292 - DNA, 16 bp, C. familiaris
tgcagccgccgccgcc

SEQ ID NO: 329293 - DNA, 16 bp, C. familiaris
tgcagctcctgctcct

SEQ ID NO: 329294 - DNA, 16 bp, C. familiaris
tgcagcttcccctgct

SEQ ID NO: 329295 - DNA, 16 bp, C. familiaris
tgcagcttggggtgtg

SEQ ID NO: 329296 - DNA, 16 bp, C. familiaris
tgcaggaagccagaca

SEQ ID NO: 329297 - DNA, 16 bp, C. familiaris
tgcaggacctgatcct

SEQ ID NO: 329298 - DNA, 16 bp, C. familiaris
tgcaggactccatcct

SEQ ID NO: 329299 - DNA, 16 bp, C. familiaris
tgcaggacttctcaga

SEQ ID NO: 329300 - DNA, 16 bp, C. familiaris
tgcaggaggggcagag

SEQ ID NO: 329301 - DNA, 16 bp, C. familiaris
tgcaggagtggttcaa

SEQ ID NO: 329302 - DNA, 16 bp, C. familiaris
tgcaggattatttaca

SEQ ID NO: 329303 - DNA, 16 bp, C. familiaris
tgcagggagcccaaca

SEQ ID NO: 329304 - DNA, 16 bp, C. familiaris
tgcagggagcccagag

SEQ ID NO: 329305 - DNA, 16 bp, C. familiaris
tgcagggagcctggtg

SEQ ID NO: 329306 - DNA, 16 bp, C. familiaris
tgcagggagcgtgctt

SEQ ID NO: 329307 - DNA, 16 bp, C. familiaris
tgcagggagctgactc

SEQ ID NO: 329308 - DNA, 16 bp, C. familiaris
tgcagggatgcaggga

SEQ ID NO: 329309 - DNA, 16 bp, C. familiaris
tgcaggggctgggctg

SEQ ID NO: 329310 - DNA, 16 bp, C. familiaris
tgcaggggtgcctggg

SEQ ID NO: 329311 - DNA, 16 bp, C. familiaris
tgcaggtgtcccagca

SEQ ID NO: 329312 - DNA, 16 bp, C. familiaris
tgcaggtgtcccaggg

SEQ ID NO: 329313 - DNA, 16 bp, C. familiaris
tgcaggtgtcctggag

SEQ ID NO: 329314 - DNA, 16 bp, C. familiaris
tgcaggttcctgggcc

SEQ ID NO: 329315 - DNA, 16 bp, C. familiaris
tgcaggttcttctcat

SEQ ID NO: 329316 - DNA, 16 bp, C. familiaris
tgcagtatttgccttt

SEQ ID NO: 329317 - DNA, 16 bp, C. familiaris
tgcagtcatctgaagg

SEQ ID NO: 329318 - DNA, 16 bp, C. familiaris
tgcagtgaatgtggga

SEQ ID NO: 329319 - DNA, 16 bp, C. familiaris
tgcagtgggctccctg

SEQ ID NO: 329320 - DNA, 16 bp, C. familiaris
tgcagtggggaggggc

SEQ ID NO: 329321 - DNA, 16 bp, C. familiaris
tgcagttttgttttgt

SEQ ID NO: 329322 - DNA, 16 bp, C. familiaris
tgcataacaaaccatc

SEQ ID NO: 329323 - DNA, 16 bp, C. familiaris
tgcatatatcttttca

SEQ ID NO: 329324 - DNA, 16 bp, C. familiaris
tgcatatatcttttgg

SEQ ID NO: 329325 - DNA, 16 bp, C. familiaris
tgcatcaaaaaagaat

SEQ ID NO: 329326 - DNA, 16 bp, C. familiaris
tgcatcaagctctctg

SEQ ID NO: 329327 - DNA, 16 bp, C. familiaris
tgcatccagcttcctg

SEQ ID NO: 329328 - DNA, 16 bp, C. familiaris
tgcatccccaccagca

SEQ ID NO: 329329 - DNA, 16 bp, C. familiaris
tgcatcctcaccaaca

SEQ ID NO: 329330 - DNA, 16 bp, C. familiaris
tgcatcctccccaaca

SEQ ID NO: 329331 - DNA, 16 bp, C. familiaris
tgcatctcaaagattt

SEQ ID NO: 329332 - DNA, 16 bp, C. familiaris
tgcatctggctcccca

SEQ ID NO: 329333 - DNA, 16 bp, C. familiaris
tgcatctttgccaaca

SEQ ID NO: 329334 - DNA, 16 bp, C. familiaris
tgcatgagggctcctt

SEQ ID NO: 329335 - DNA, 16 bp, C. familiaris
tgcatgagtgggagga

SEQ ID NO: 329336 - DNA, 16 bp, C. familiaris
tgcatgcaggaagccc

SEQ ID NO: 329337 - DNA, 16 bp, C. familiaris
tgcatggaacatgctt

SEQ ID NO: 329338 - DNA, 16 bp, C. familiaris
tgcatggtaaatattt

SEQ ID NO: 329339 - DNA, 16 bp, C. familiaris
tgcatgtatgtgtatt

SEQ ID NO: 329340 - DNA, 16 bp, C. familiaris
tgcatgtgtatgcaca

SEQ ID NO: 329341 - DNA, 16 bp, C. familiaris
tgcatgtgtatgtgtg

SEQ ID NO: 329342 - DNA, 16 bp, C. familiaris
tgcatgtgttctctct

SEQ ID NO: 329343 - DNA, 16 bp, C. familiaris
tgcattaaaatattta

SEQ ID NO: 329344 - DNA, 16 bp, C. familiaris
tgcattaaatgtgtat

SEQ ID NO: 329345 - DNA, 16 bp, C. familiaris
tgcattctgctgttgt

SEQ ID NO: 329346 - DNA, 16 bp, C. familiaris
tgcattgggcatggag

SEQ ID NO: 329347 - DNA, 16 bp, C. familiaris
tgcattgtagaatgtt

SEQ ID NO: 329348 - DNA, 16 bp, C. familiaris
tgcatttaaatttaaa

SEQ ID NO: 329349 - DNA, 16 bp, C. familiaris
tgcatttaattaaaaa

SEQ ID NO: 329350 - DNA, 16 bp, C. familiaris
tgcatttcaaagtaaa

SEQ ID NO: 329351 - DNA, 16 bp, C. familiaris
tgcatttctgacaagt

SEQ ID NO: 329352 - DNA, 16 bp, C. familiaris
tgcatttgaaagaaaa

SEQ ID NO: 329353 - DNA, 16 bp, C. familiaris
tgcatttgaatttttt

SEQ ID NO: 329354 - DNA, 16 bp, C. familiaris
tgcatttggctccctg

SEQ ID NO: 329355 - DNA, 16 bp, C. familiaris
tgcatttttgataact

SEQ ID NO: 329356 - DNA, 16 bp, C. familiaris
tgccaaaacaaaacaa

SEQ ID NO: 329357 - DNA, 16 bp, C. familiaris
tgccaaaatgttttct

SEQ ID NO: 329358 - DNA, 16 bp, C. familiaris
tgccaaactgctgtat

SEQ ID NO: 329359 - DNA, 16 bp, C. familiaris
tgccaacctctgctct

SEQ ID NO: 329360 - DNA, 16 bp, C. familiaris
tgccaacttacagaat

SEQ ID NO: 329361 - DNA, 16 bp, C. familiaris
tgccaagtgatattga

SEQ ID NO: 329362 - DNA, 16 bp, C. familiaris
tgccaatagacttgct

SEQ ID NO: 329363 - DNA, 16 bp, C. familiaris
tgccacagtaacttct

SEQ ID NO: 329364 - DNA, 16 bp, C. familiaris
tgccacagttacagaa

SEQ ID NO: 329365 - DNA, 16 bp, C. familiaris
tgccaccaccaccacc

SEQ ID NO: 329366 - DNA, 16 bp, C. familiaris
tgccaccagaacacag

SEQ ID NO: 329367 - DNA, 16 bp, C. familiaris
tgccacctctcccaga

SEQ ID NO: 329368 - DNA, 16 bp, C. familiaris
tgccactaatttctgg

SEQ ID NO: 329369 - DNA, 16 bp, C. familiaris
tgccactccccctcct

SEQ ID NO: 329370 - DNA, 16 bp, C. familiaris
tgccactccccctgcc

SEQ ID NO: 329371 - DNA, 16 bp, C. familiaris
tgccactccccctgct

SEQ ID NO: 329372 - DNA, 16 bp, C. familiaris
tgccactcctcctgct

SEQ ID NO: 329373 - DNA, 16 bp, C. familiaris
tgccagagaggaggtg

SEQ ID NO: 329374 - DNA, 16 bp, C. familiaris
tgccagaggctggggg

SEQ ID NO: 329375 - DNA, 16 bp, C. familiaris
tgccagaggggagaag

SEQ ID NO: 329376 - DNA, 16 bp, C. familiaris
tgccagatactgtgct

SEQ ID NO: 329377 - DNA, 16 bp, C. familiaris
tgccagcagccaccag

SEQ ID NO: 329378 - DNA, 16 bp, C. familiaris
tgccagcatggttggg

SEQ ID NO: 329379 - DNA, 16 bp, C. familiaris
tgccagcccttcctgg

SEQ ID NO: 329380 - DNA, 16 bp, C. familiaris
tgccagctccagctgc

SEQ ID NO: 329381 - DNA, 16 bp, C. familiaris
tgccaggaccatactg

SEQ ID NO: 329382 - DNA, 16 bp, C. familiaris
tgccaggaccctggga

SEQ ID NO: 329383 - DNA, 16 bp, C. familiaris
tgccaggagcccaacg

SEQ ID NO: 329384 - DNA, 16 bp, C. familiaris
tgccaggcactgggcc

SEQ ID NO: 329385 - DNA, 16 bp, C. familiaris
tgccaggccctgccct

SEQ ID NO: 329386 - DNA, 16 bp, C. familiaris
tgccaggccctggaca

SEQ ID NO: 329387 - DNA, 16 bp, C. familiaris
tgccaggccctgggga

SEQ ID NO: 329388 - DNA, 16 bp, C. familiaris
tgccaggccctggggg

SEQ ID NO: 329389 - DNA, 16 bp, C. familiaris
tgccaggccctgtgct

SEQ ID NO: 329390 - DNA, 16 bp, C. familiaris
tgccaggctctgggga

SEQ ID NO: 329391 - DNA, 16 bp, C. familiaris
tgccagggcctggagg

SEQ ID NO: 329392 - DNA, 16 bp, C. familiaris
tgccaggggacacagc

SEQ ID NO: 329393 - DNA, 16 bp, C. familiaris
tgccaggggctgcagg

SEQ ID NO: 329394 - DNA, 16 bp, C. familiaris
tgccaggggctgggaa

SEQ ID NO: 329395 - DNA, 16 bp, C. familiaris
tgccaggggctggggg

SEQ ID NO: 329396 - DNA, 16 bp, C. familiaris
tgccaggggtgcctgg

SEQ ID NO: 329397 - DNA, 16 bp, C. familiaris
tgccagggtgactcag

SEQ ID NO: 329398 - DNA, 16 bp, C. familiaris
tgccaggtccctgtgg

SEQ ID NO: 329399 - DNA, 16 bp, C. familiaris
tgccatcaaggaaata

SEQ ID NO: 329400 - DNA, 16 bp, C. familiaris
tgccatctgcaaagag

SEQ ID NO: 329401 - DNA, 16 bp, C. familiaris
tgccattctcactggt

SEQ ID NO: 329402 - DNA, 16 bp, C. familiaris
tgccattgtattactt

SEQ ID NO: 329403 - DNA, 16 bp, C. familiaris
tgccatttgtgacaaa

SEQ ID NO: 329404 - DNA, 16 bp, C. familiaris
tgccattttattcatt

SEQ ID NO: 329405 - DNA, 16 bp, C. familiaris
tgcccaacatggagct

SEQ ID NO: 329406 - DNA, 16 bp, C. familiaris
tgcccaaccagctgag

SEQ ID NO: 329407 - DNA, 16 bp, C. familiaris
tgcccacaatagccaa

SEQ ID NO: 329408 - DNA, 16 bp, C. familiaris
tgcccagatcttggtt

SEQ ID NO: 329409 - DNA, 16 bp, C. familiaris
tgcccagcaaaggaaa

SEQ ID NO: 329410 - DNA, 16 bp, C. familiaris
tgcccagcaaggagcc

SEQ ID NO: 329411 - DNA, 16 bp, C. familiaris
tgcccagcacagagcc

SEQ ID NO: 329412 - DNA, 16 bp, C. familiaris
tgcccagcacccagca

SEQ ID NO: 329413 - DNA, 16 bp, C. familiaris
tgcccagcactgtgcc

SEQ ID NO: 329414 - DNA, 16 bp, C. familiaris
tgcccagcccagccca

SEQ ID NO: 329415 - DNA, 16 bp, C. familiaris
tgcccagccctgtgct

SEQ ID NO: 329416 - DNA, 16 bp, C. familiaris
tgcccaggacagcccc

SEQ ID NO: 329417 - DNA, 16 bp, C. familiaris
tgcccaggccatcaag

SEQ ID NO: 329418 - DNA, 16 bp, C. familiaris
tgcccagggagtgatc

SEQ ID NO: 329419 - DNA, 16 bp, C. familiaris
tgcccagggcctggca

SEQ ID NO: 329420 - DNA, 16 bp, C. familiaris
tgcccagggtggagcc

SEQ ID NO: 329421 - DNA, 16 bp, C. familiaris
tgcccaggtgccccag

SEQ ID NO: 329422 - DNA, 16 bp, C. familiaris
tgcccagtggagagcc

SEQ ID NO: 329423 - DNA, 16 bp, C. familiaris
tgcccagttttcccag

SEQ ID NO: 329424 - DNA, 16 bp, C. familiaris
tgcccatttcatgagt

SEQ ID NO: 329425 - DNA, 16 bp, C. familiaris
tgcccatttttctttt

SEQ ID NO: 329426 - DNA, 16 bp, C. familiaris
tgccccaagatgggcc

SEQ ID NO: 329427 - DNA, 16 bp, C. familiaris
tgccccacccctggct

SEQ ID NO: 329428 - DNA, 16 bp, C. familiaris
tgccccaggacacaga

SEQ ID NO: 329429 - DNA, 16 bp, C. familiaris
tgcccccacccctggg

SEQ ID NO: 329430 - DNA, 16 bp, C. familiaris
tgcccccagcccccag

SEQ ID NO: 329431 - DNA, 16 bp, C. familiaris
tgcccccaggacagga

SEQ ID NO: 329432 - DNA, 16 bp, C. familiaris
tgcccccctcggtgcc

SEQ ID NO: 329433 - DNA, 16 bp, C. familiaris
tgcccccgcctggtgc

SEQ ID NO: 329434 - DNA, 16 bp, C. familiaris
tgccccctgccctgct

SEQ ID NO: 329435 - DNA, 16 bp, C. familiaris
tgccccctgctcccca

SEQ ID NO: 329436 - DNA, 16 bp, C. familiaris
tgcccccttcagccca

SEQ ID NO: 329437 - DNA, 16 bp, C. familiaris
tgcccctccccacctg

SEQ ID NO: 329438 - DNA, 16 bp, C. familiaris
tgcccctccccatcct

SEQ ID NO: 329439 - DNA, 16 bp, C. familiaris
tgcccctcccccaatt

SEQ ID NO: 329440 - DNA, 16 bp, C. familiaris
tgcccctcccccatct

SEQ ID NO: 329441 - DNA, 16 bp, C. familiaris
tgcccctcccccgact

SEQ ID NO: 329442 - DNA, 16 bp, C. familiaris
tgcccctcccctgact

SEQ ID NO: 329443 - DNA, 16 bp, C. familiaris
tgcccctcctcctact

SEQ ID NO: 329444 - DNA, 16 bp, C. familiaris
tgcccctctcccacct

SEQ ID NO: 329445 - DNA, 16 bp, C. familiaris
tgcccctctctctgtg

SEQ ID NO: 329446 - DNA, 16 bp, C. familiaris
tgcccctcttccccac

SEQ ID NO: 329447 - DNA, 16 bp, C. familiaris
tgcccctgcccctggc

SEQ ID NO: 329448 - DNA, 16 bp, C. familiaris
tgcccctgcctccctg

SEQ ID NO: 329449 - DNA, 16 bp, C. familiaris
tgcccctggccctgcc

SEQ ID NO: 329450 - DNA, 16 bp, C. familiaris
tgcccctggctcaggg

SEQ ID NO: 329451 - DNA, 16 bp, C. familiaris
tgccccttcccccagc

SEQ ID NO: 329452 - DNA, 16 bp, C. familiaris
tgcccggatggctcag

SEQ ID NO: 329453 - DNA, 16 bp, C. familiaris
tgccctaggtgtgggt

SEQ ID NO: 329454 - DNA, 16 bp, C. familiaris
tgccctcagtgtggag

SEQ ID NO: 329455 - DNA, 16 bp, C. familiaris
tgccctcatggagctg

SEQ ID NO: 329456 - DNA, 16 bp, C. familiaris
tgccctcccagcctct

SEQ ID NO: 329457 - DNA, 16 bp, C. familiaris
tgccctctgccctctg

SEQ ID NO: 329458 - DNA, 16 bp, C. familiaris
tgccctctggcttctg

SEQ ID NO: 329459 - DNA, 16 bp, C. familiaris
tgccctgaatgtggga

SEQ ID NO: 329460 - DNA, 16 bp, C. familiaris
tgccctgagtgtggag

SEQ ID NO: 329461 - DNA, 16 bp, C. familiaris
tgccctgccctgccct

SEQ ID NO: 329462 - DNA, 16 bp, C. familiaris
tgccctgctcctgctc

SEQ ID NO: 329463 - DNA, 16 bp, C. familiaris
tgccctggccccagcc

SEQ ID NO: 329464 - DNA, 16 bp, C. familiaris
tgccctggctgtgccc

SEQ ID NO: 329465 - DNA, 16 bp, C. familiaris
tgccctgggcctgtga

SEQ ID NO: 329466 - DNA, 16 bp, C. familiaris
tgccctgttctctctc

SEQ ID NO: 329467 - DNA, 16 bp, C. familiaris
tgccctgttggtagga

SEQ ID NO: 329468 - DNA, 16 bp, C. familiaris
tgccctgtttttattt

SEQ ID NO: 329469 - DNA, 16 bp, C. familiaris
tgcccttatttttatt

SEQ ID NO: 329470 - DNA, 16 bp, C. familiaris
tgcccttccccttgct

SEQ ID NO: 329471 - DNA, 16 bp, C. familiaris
tgcccttccctcccac

SEQ ID NO: 329472 - DNA, 16 bp, C. familiaris
tgcccttcctctgcct

SEQ ID NO: 329473 - DNA, 16 bp, C. familiaris
tgcccttcctgctgct

SEQ ID NO: 329474 - DNA, 16 bp, C. familiaris
tgcccttctccctgct

SEQ ID NO: 329475 - DNA, 25 bp, C. familiaris
tgcccttctggcttacacactgggt

SEQ ID NO: 329476 - DNA, 16 bp, C. familiaris
tgccgccttgggccca

SEQ ID NO: 329477 - DNA, 16 bp, C. familiaris
tgccgctctgcctact

SEQ ID NO: 329478 - DNA, 16 bp, C. familiaris
tgcctcagtcagaaga

SEQ ID NO: 329479 - DNA, 16 bp, C. familiaris
tgcctcagtctccctg

SEQ ID NO: 329480 - DNA, 16 bp, C. familiaris
tgcctcagtgtccctg

SEQ ID NO: 329481 - DNA, 16 bp, C. familiaris
tgcctcagtttcccaa

SEQ ID NO: 329482 - DNA, 16 bp, C. familiaris
tgcctccagctcaagt

SEQ ID NO: 329483 - DNA, 16 bp, C. familiaris
tgcctccataatttgg

SEQ ID NO: 329484 - DNA, 16 bp, C. familiaris
tgcctcctcctccagg

SEQ ID NO: 329485 - DNA, 16 bp, C. familiaris
tgcctccttcagccca

SEQ ID NO: 329486 - DNA, 16 bp, C. familiaris
tgcctctcagctccaa

SEQ ID NO: 329487 - DNA, 16 bp, C. familiaris
tgcctctcatgaaaaa

SEQ ID NO: 329488 - DNA, 16 bp, C. familiaris
tgcctctcctcctgct

SEQ ID NO: 329489 - DNA, 16 bp, C. familiaris
tgcctctccttctgtc

SEQ ID NO: 329490 - DNA, 16 bp, C. familiaris
tgcctctctatgtgtc

SEQ ID NO: 329491 - DNA, 16 bp, C. familiaris
tgcctctctccccact

SEQ ID NO: 329492 - DNA, 16 bp, C. familiaris
tgcctctctctgtctc

SEQ ID NO: 329493 - DNA, 16 bp, C. familiaris
tgcctctctctgtgac

SEQ ID NO: 329494 - DNA, 16 bp, C. familiaris
tgcctctctctgtggc

SEQ ID NO: 329495 - DNA, 16 bp, C. familiaris
tgcctctctgtctctg

SEQ ID NO: 329496 - DNA, 16 bp, C. familiaris
tgcctctctgtgtgac

SEQ ID NO: 329497 - DNA, 16 bp, C. familiaris
tgcctctctgtttgtg

SEQ ID NO: 329498 - DNA, 16 bp, C. familiaris
tgcctctgccccctgc

SEQ ID NO: 329499 - DNA, 16 bp, C. familiaris
tgcctctgcctctgtc

SEQ ID NO: 329500 - DNA, 16 bp, C. familiaris
tgcctctggctcaggc

SEQ ID NO: 329501 - DNA, 16 bp, C. familiaris
tgcctctgtgtctgcc

SEQ ID NO: 329502 - DNA, 16 bp, C. familiaris
tgcctctgtgttcatc

SEQ ID NO: 329503 - DNA, 16 bp, C. familiaris
tgcctcttccctggct

SEQ ID NO: 329504 - DNA, 16 bp, C. familiaris
tgcctcttctggacat

SEQ ID NO: 329505 - DNA, 16 bp, C. familiaris
tgcctctttgtgtgtc

SEQ ID NO: 329506 - DNA, 16 bp, C. familiaris
tgcctcttttgttgta

SEQ ID NO: 329507 - DNA, 16 bp, C. familiaris
tgcctgaagattctct

SEQ ID NO: 329508 - DNA, 16 bp, C. familiaris
tgcctgacacagagca

SEQ ID NO: 329509 - DNA, 16 bp, C. familiaris
tgcctgagcagctcag

SEQ ID NO: 329510 - DNA, 16 bp, C. familiaris
tgcctgaggagacaga

SEQ ID NO: 329511 - DNA, 16 bp, C. familiaris
tgcctgagggtctggc

SEQ ID NO: 329512 - DNA, 16 bp, C. familiaris
tgcctgcagcccagga

SEQ ID NO: 329513 - DNA, 16 bp, C. familiaris
tgcctgcagcctggag

SEQ ID NO: 329514 - DNA, 16 bp, C. familiaris
tgcctgcccctctgcc

SEQ ID NO: 329515 - DNA, 16 bp, C. familiaris
tgcctgcctccggccc

SEQ ID NO: 329516 - DNA, 16 bp, C. familiaris
tgcctgcctgcagccc

SEQ ID NO: 329517 - DNA, 16 bp, C. familiaris
tgcctgcctgcctgcc

SEQ ID NO: 329518 - DNA, 16 bp, C. familiaris
tgcctgcctggctcag

SEQ ID NO: 329519 - DNA, 16 bp, C. familiaris
tgcctgccttcagctc

SEQ ID NO: 329520 - DNA, 16 bp, C. familiaris
tgcctgccttgggctc

SEQ ID NO: 329521 - DNA, 16 bp, C. familiaris
tgcctgctgcctgctg

SEQ ID NO: 329522 - DNA, 16 bp, C. familiaris
tgcctgctgctccccc

SEQ ID NO: 329523 - DNA, 16 bp, C. familiaris
tgcctgctgctgctgc

SEQ ID NO: 329524 - DNA, 16 bp, C. familiaris
tgcctgctgcttcccc

SEQ ID NO: 329525 - DNA, 16 bp, C. familiaris
tgcctggagggctcag

SEQ ID NO: 329526 - DNA, 16 bp, C. familiaris
tgcctggatggcccag

SEQ ID NO: 329527 - DNA, 16 bp, C. familiaris
tgcctggatggctcca

SEQ ID NO: 329528 - DNA, 16 bp, C. familiaris
tgcctggatggctctg

SEQ ID NO: 329529 - DNA, 16 bp, C. familiaris
tgcctggctggcccag

SEQ ID NO: 329530 - DNA, 16 bp, C. familiaris
tgcctggggctgggag

SEQ ID NO: 329531 - DNA, 16 bp, C. familiaris
tgcctgggggactcag

SEQ ID NO: 329532 - DNA, 16 bp, C. familiaris
tgcctgggtagctcag

SEQ ID NO: 329533 - DNA, 16 bp, C. familiaris
tgcctgggtctctgca

SEQ ID NO: 329534 - DNA, 16 bp, C. familiaris
tgcctgggtggctgtt

SEQ ID NO: 329535 - DNA, 16 bp, C. familiaris
tgcctggtggctcagt

SEQ ID NO: 329536 - DNA, 16 bp, C. familiaris
tgcctggtgggctcag

SEQ ID NO: 329537 - DNA, 16 bp, C. familiaris
tgcctgtcacccagcc

SEQ ID NO: 329538 - DNA, 16 bp, C. familiaris
tgcctgtctctctctg

SEQ ID NO: 329539 - DNA, 16 bp, C. familiaris
tgcctgtctgtctgtc

SEQ ID NO: 329540 - DNA, 16 bp, C. familiaris
tgcctgtggcccaggg

SEQ ID NO: 329541 - DNA, 16 bp, C. familiaris
tgcctgtgtcctcctc

SEQ ID NO: 329542 - DNA, 16 bp, C. familiaris
tgcctgtgtctctgct

SEQ ID NO: 329543 - DNA, 16 bp, C. familiaris
tgcctgtgtctttgtc

SEQ ID NO: 329544 - DNA, 16 bp, C. familiaris
tgcctgtgtgcctgtg

SEQ ID NO: 329545 - DNA, 16 bp, C. familiaris
tgcctgtgtgtctgct

SEQ ID NO: 329546 - DNA, 16 bp, C. familiaris
tgcctgttcctctgcc

SEQ ID NO: 329547 - DNA, 16 bp, C. familiaris
tgcctgttggccatgt

SEQ ID NO: 329548 - DNA, 16 bp, C. familiaris
tgccttcagcctgggg

SEQ ID NO: 329549 - DNA, 16 bp, C. familiaris
tgccttcatctcagat

SEQ ID NO: 329550 - DNA, 16 bp, C. familiaris
tgccttccacccaagg

SEQ ID NO: 329551 - DNA, 16 bp, C. familiaris
tgccttcccaggggaa

SEQ ID NO: 329552 - DNA, 16 bp, C. familiaris
tgccttccgcccagag

SEQ ID NO: 329553 - DNA, 16 bp, C. familiaris
tgccttcctcagtgcc

SEQ ID NO: 329554 - DNA, 16 bp, C. familiaris
tgccttcggctcacgg

SEQ ID NO: 329555 - DNA, 16 bp, C. familiaris
tgccttctctgtgcca

SEQ ID NO: 329556 - DNA, 16 bp, C. familiaris
tgccttcttctctgtg

SEQ ID NO: 329557 - DNA, 16 bp, C. familiaris
tgccttgggctccctg

SEQ ID NO: 329558 - DNA, 16 bp, C. familiaris
tgcctttccctctgct

SEQ ID NO: 329559 - DNA, 16 bp, C. familiaris
tgcctttcctcctgct

SEQ ID NO: 329560 - DNA, 16 bp, C. familiaris
tgcctttctctctctg

SEQ ID NO: 329561 - DNA, 16 bp, C. familiaris
tgcctttctctgtatc

SEQ ID NO: 329562 - DNA, 16 bp, C. familiaris
tgcctttctctgtgta

SEQ ID NO: 329563 - DNA, 16 bp, C. familiaris
tgcctttgctcaggtc

SEQ ID NO: 329564 - DNA, 16 bp, C. familiaris
tgcctttgcttttgat

SEQ ID NO: 329565 - DNA, 16 bp, C. familiaris
tgcctttggcacaggg

SEQ ID NO: 329566 - DNA, 16 bp, C. familiaris
tgcctttggtccgggg

SEQ ID NO: 329567 - DNA, 16 bp, C. familiaris
tgcctttggttcaagg

SEQ ID NO: 329568 - DNA, 16 bp, C. familiaris
tgcctttggttcagtt

SEQ ID NO: 329569 - DNA, 16 bp, C. familiaris
tgcctttggttctggt

SEQ ID NO: 329570 - DNA, 16 bp, C. familiaris
tgccttttgcaacaac

SEQ ID NO: 329571 - DNA, 16 bp, C. familiaris
tgcctttttcttattg

SEQ ID NO: 329572 - DNA, 16 bp, C. familiaris
tgcgctgagtgcagag

SEQ ID NO: 329573 - DNA, 16 bp, C. familiaris
tgcgggactcggtccc

SEQ ID NO: 329574 - DNA, 17 bp, C. familiaris
tgcgggagggcgtgctg

SEQ ID NO: 329575 - DNA, 16 bp, C. familiaris
tgcggggctccatcct

SEQ ID NO: 329576 - DNA, 16 bp, C. familiaris
tgcgtgtgagtgtgtg

SEQ ID NO: 329577 - DNA, 16 bp, C. familiaris
tgcgtgtgtgtgagtg

SEQ ID NO: 329578 - DNA, 16 bp, C. familiaris
tgctaaaacatgaaag

SEQ ID NO: 329579 - DNA, 16 bp, C. familiaris
tgctaaaagaaaataa

SEQ ID NO: 329580 - DNA, 16 bp, C. familiaris
tgctaaaatattttat

SEQ ID NO: 329581 - DNA, 16 bp, C. familiaris
tgctaagaaagtaaat

SEQ ID NO: 329582 - DNA, 16 bp, C. familiaris
tgctactcaaagtgta

SEQ ID NO: 329583 - DNA, 16 bp, C. familiaris
tgctactgctgctgct

SEQ ID NO: 329584 - DNA, 16 bp, C. familiaris
tgctactggcatctgg

SEQ ID NO: 329585 - DNA, 16 bp, C. familiaris
tgctagaactgataaa

SEQ ID NO: 329586 - DNA, 16 bp, C. familiaris
tgctagggaaaaaaaa

SEQ ID NO: 329587 - DNA, 16 bp, C. familiaris
tgctaggggctggggg

SEQ ID NO: 329588 - DNA, 16 bp, C. familiaris
tgctatattttggcaa

SEQ ID NO: 329589 - DNA, 16 bp, C. familiaris
tgctatctctctcttt

SEQ ID NO: 329590 - DNA, 16 bp, C. familiaris
tgctatgaaactagaa

SEQ ID NO: 329591 - DNA, 16 bp, C. familiaris
tgctattcctgaataa

SEQ ID NO: 329592 - DNA, 16 bp, C. familiaris
tgctattgatattttg

SEQ ID NO: 329593 - DNA, 16 bp, C. familiaris
tgctatttaaattttt

SEQ ID NO: 329594 - DNA, 16 bp, C. familiaris
tgctattttatattat

SEQ ID NO: 329595 - DNA, 16 bp, C. familiaris
tgctcaaagccacaca

SEQ ID NO: 329596 - DNA, 16 bp, C. familiaris
tgctcaaagtcacaaa

SEQ ID NO: 329597 - DNA, 16 bp, C. familiaris
tgctcaacatcacaaa

SEQ ID NO: 329598 - DNA, 16 bp, C. familiaris
tgctcaaccagctgag

SEQ ID NO: 329599 - DNA, 16 bp, C. familiaris
tgctcaagatcacaga

SEQ ID NO: 329600 - DNA, 16 bp, C. familiaris
tgctcacatgtgtgtg

SEQ ID NO: 329601 - DNA, 16 bp, C. familiaris
tgctcactcactctct

SEQ ID NO: 329602 - DNA, 16 bp, C. familiaris
tgctcagcaaaggaaa

SEQ ID NO: 329603 - DNA, 16 bp, C. familiaris
tgctcagcaggagagt

SEQ ID NO: 329604 - DNA, 16 bp, C. familiaris
tgctcagcaggggagc

SEQ ID NO: 329605 - DNA, 16 bp, C. familiaris
tgctcagcctggagcc

SEQ ID NO: 329606 - DNA, 16 bp, C. familiaris
tgctcaggggggagcc

SEQ ID NO: 329607 - DNA, 16 bp, C. familiaris
tgctcaggtcctggga

SEQ ID NO: 329608 - DNA, 16 bp, C. familiaris
tgctcagtgagagaag

SEQ ID NO: 329609 - DNA, 16 bp, C. familiaris
tgctcagtgaggagcc

SEQ ID NO: 329610 - DNA, 16 bp, C. familiaris
tgctcagtgaggtgtc

SEQ ID NO: 329611 - DNA, 16 bp, C. familiaris
tgctcagtggggagac

SEQ ID NO: 329612 - DNA, 16 bp, C. familiaris
tgctcatcagagagtc

SEQ ID NO: 329613 - DNA, 16 bp, C. familiaris
tgctcatgttttctct

SEQ ID NO: 329614 - DNA, 16 bp, C. familiaris
tgctcattctccctct

SEQ ID NO: 329615 - DNA, 16 bp, C. familiaris
tgctcatttcttttgt

SEQ ID NO: 329616 - DNA, 16 bp, C. familiaris
tgctcatttttctatt

SEQ ID NO: 329617 - DNA, 16 bp, C. familiaris
tgctccacagggagcc

SEQ ID NO: 329618 - DNA, 16 bp, C. familiaris
tgctccacatcctcac

SEQ ID NO: 329619 - DNA, 16 bp, C. familiaris
tgctccacatctttgc

SEQ ID NO: 329620 - DNA, 16 bp, C. familiaris
tgctccccctgctggt

SEQ ID NO: 329621 - DNA, 16 bp, C. familiaris
tgctcccggcctgcgc

SEQ ID NO: 329622 - DNA, 16 bp, C. familiaris
tgctcccgggcctgcg

SEQ ID NO: 329623 - DNA, 16 bp, C. familiaris
tgctcctcccccagct

SEQ ID NO: 329624 - DNA, 16 bp, C. familiaris
tgctcctcctgctgct

SEQ ID NO: 329625 - DNA, 16 bp, C. familiaris
tgctcctgctcttgct

SEQ ID NO: 329626 - DNA, 16 bp, C. familiaris
tgctcctgctgctgct

SEQ ID NO: 329627 - DNA, 16 bp, C. familiaris
tgctcctggagacccg

SEQ ID NO: 329628 - DNA, 16 bp, C. familiaris
tgctcctggagagaag

SEQ ID NO: 329629 - DNA, 16 bp, C. familiaris
tgctcctgggcctgtg

SEQ ID NO: 329630 - DNA, 16 bp, C. familiaris
tgctcctgggtccagc

SEQ ID NO: 329631 - DNA, 16 bp, C. familiaris
tgctccttctggaggc

SEQ ID NO: 329632 - DNA, 16 bp, C. familiaris
tgctccttttcctgct

SEQ ID NO: 329633 - DNA, 16 bp, C. familiaris
tgctctacatcacttg

SEQ ID NO: 329634 - DNA, 16 bp, C. familiaris
tgctctctcttgctct

SEQ ID NO: 329635 - DNA, 16 bp, C. familiaris
tgctctctcttgtgct

SEQ ID NO: 329636 - DNA, 16 bp, C. familiaris
tgctctcttcaaggat

SEQ ID NO: 329637 - DNA, 16 bp, C. familiaris
tgctctcttcccttgt

SEQ ID NO: 329638 - DNA, 16 bp, C. familiaris
tgctctgaaaactata

SEQ ID NO: 329639 - DNA, 16 bp, C. familiaris
tgctctgcccaccccc

SEQ ID NO: 329640 - DNA, 16 bp, C. familiaris
tgctctgcctattcat

SEQ ID NO: 329641 - DNA, 16 bp, C. familiaris
tgctctggctctctct

SEQ ID NO: 329642 - DNA, 16 bp, C. familiaris
tgctctgggagcccga

SEQ ID NO: 329643 - DNA, 16 bp, C. familiaris
tgctctgtctctcatg

SEQ ID NO: 329644 - DNA, 16 bp, C. familiaris
tgctctgtgcagagtc

SEQ ID NO: 329645 - DNA, 16 bp, C. familiaris
tgctcttccagctgag

SEQ ID NO: 329646 - DNA, 16 bp, C. familiaris
tgctcttccctctgcc

SEQ ID NO: 329647 - DNA, 16 bp, C. familiaris
tgctcttcctctgcct

SEQ ID NO: 329648 - DNA, 16 bp, C. familiaris
tgctcttctgattgag

SEQ ID NO: 329649 - DNA, 16 bp, C. familiaris
tgctgaaaaatctgct

SEQ ID NO: 329650 - DNA, 16 bp, C. familiaris
tgctgaaagaaaagaa

SEQ ID NO: 329651 - DNA, 16 bp, C. familiaris
tgctgaaaggaaaaaa

SEQ ID NO: 329652 - DNA, 16 bp, C. familiaris
tgctgaaaggaaagaa

SEQ ID NO: 329653 - DNA, 16 bp, C. familiaris
tgctgaaagggaaaaa

SEQ ID NO: 329654 - DNA, 16 bp, C. familiaris
tgctgaaagggacaga

SEQ ID NO: 329655 - DNA, 16 bp, C. familiaris
tgctgaatgggagaag

SEQ ID NO: 329656 - DNA, 16 bp, C. familiaris
tgctgagcaaggagcc

SEQ ID NO: 329657 - DNA, 16 bp, C. familiaris
tgctgagcacaaagcc

SEQ ID NO: 329658 - DNA, 16 bp, C. familiaris
tgctgagcagagcctg

SEQ ID NO: 329659 - DNA, 16 bp, C. familiaris
tgctgagcaggaagcc

SEQ ID NO: 329660 - DNA, 16 bp, C. familiaris
tgctgagcatcttctc

SEQ ID NO: 329661 - DNA, 16 bp, C. familiaris
tgctgagcatgaagcc

SEQ ID NO: 329662 - DNA, 16 bp, C. familiaris
tgctgagccaccaggt

SEQ ID NO: 329663 - DNA, 16 bp, C. familiaris
tgctgagcccagagcc

SEQ ID NO: 329664 - DNA, 16 bp, C. familiaris
tgctgagcctcccggg

SEQ ID NO: 329665 - DNA, 16 bp, C. familiaris
tgctgagcgcggagcc

SEQ ID NO: 329666 - DNA, 16 bp, C. familiaris
tgctgagcgtggagcc

SEQ ID NO: 329667 - DNA, 16 bp, C. familiaris
tgctgagcttggagcc

SEQ ID NO: 329668 - DNA, 16 bp, C. familiaris
tgctgagggttttttt

SEQ ID NO: 329669 - DNA, 16 bp, C. familiaris
tgctgagtgaaagaaa

SEQ ID NO: 329670 - DNA, 16 bp, C. familiaris
tgctgagtgaaatcag

SEQ ID NO: 329671 - DNA, 16 bp, C. familiaris
tgctgagtgtggggcc

SEQ ID NO: 329672 - DNA, 16 bp, C. familiaris
tgctgatactgctggt

SEQ ID NO: 329673 - DNA, 16 bp, C. familiaris
tgctgatagacttgct

SEQ ID NO: 329674 - DNA, 16 bp, C. familiaris
tgctgatgaggatgtg

SEQ ID NO: 329675 - DNA, 16 bp, C. familiaris
tgctgatggctgctga

SEQ ID NO: 329676 - DNA, 16 bp, C. familiaris
tgctgattttctgttt

SEQ ID NO: 329677 - DNA, 27 bp, C. familiaris
tgctgcaaaccctgctgctcccagtcc

SEQ ID NO: 329678 - DNA, 16 bp, C. familiaris
tgctgcataacaaaca

SEQ ID NO: 329679 - DNA, 16 bp, C. familiaris
tgctgcatcccaagga

SEQ ID NO: 329680 - DNA, 16 bp, C. familiaris
tgctgccaaagcaagc

SEQ ID NO: 329681 - DNA, 16 bp, C. familiaris
tgctgcccaagacaag

SEQ ID NO: 329682 - DNA, 16 bp, C. familiaris
tgctgcccacccccac

SEQ ID NO: 329683 - DNA, 16 bp, C. familiaris
tgctgcccagggcctg

SEQ ID NO: 329684 - DNA, 16 bp, C. familiaris
tgctgccccctgctgg

SEQ ID NO: 329685 - DNA, 16 bp, C. familiaris
tgctgccctgggcctg

SEQ ID NO: 329686 - DNA, 16 bp, C. familiaris
tgctgcctctgttctc

SEQ ID NO: 329687 - DNA, 16 bp, C. familiaris
tgctgcctgtgctctc

SEQ ID NO: 329688 - DNA, 16 bp, C. familiaris
tgctgcctgtgttctt

SEQ ID NO: 329689 - DNA, 16 bp, C. familiaris
tgctgctaagcatcct

SEQ ID NO: 329690 - DNA, 16 bp, C. familiaris
tgctgctagagacatc

SEQ ID NO: 329691 - DNA, 16 bp, C. familiaris
tgctgctatgaacatc

SEQ ID NO: 329692 - DNA, 16 bp, C. familiaris
tgctgctatgaacttt

SEQ ID NO: 329693 - DNA, 16 bp, C. familiaris
tgctgctatgaatgtg

SEQ ID NO: 329694 - DNA, 16 bp, C. familiaris
tgctgctcaacatcct

SEQ ID NO: 329695 - DNA, 16 bp, C. familiaris
tgctgctccacatcct

SEQ ID NO: 329696 - DNA, 16 bp, C. familiaris
tgctgctccacctgct

SEQ ID NO: 329697 - DNA, 16 bp, C. familiaris
tgctgctcctcctcct

SEQ ID NO: 329698 - DNA, 16 bp, C. familiaris
tgctgctctccctgct

SEQ ID NO: 329699 - DNA, 16 bp, C. familiaris
tgctgctctgcctgct

SEQ ID NO: 329700 - DNA, 16 bp, C. familiaris
tgctgctcttcctgct

SEQ ID NO: 329701 - DNA, 16 bp, C. familiaris
tgctgctctttctcca

SEQ ID NO: 329702 - DNA, 16 bp, C. familiaris
tgctgctgcctttttt

SEQ ID NO: 329703 - DNA, 16 bp, C. familiaris
tgctgctgctactgct

SEQ ID NO: 329704 - DNA, 16 bp, C. familiaris
tgctgctgctcctcct

SEQ ID NO: 329705 - DNA, 16 bp, C. familiaris
tgctgctgctgatggt

SEQ ID NO: 329706 - DNA, 16 bp, C. familiaris
tgctgctgctgccgcc

SEQ ID NO: 329707 - DNA, 16 bp, C. familiaris
tgctgctgctgctgct

SEQ ID NO: 329708 - DNA, 16 bp, C. familiaris
tgctgctgctgctggt

SEQ ID NO: 329709 - DNA, 16 bp, C. familiaris
tgctgctgctgctgtt

SEQ ID NO: 329710 - DNA, 16 bp, C. familiaris
tgctgctgctgcttct

SEQ ID NO: 329711 - DNA, 16 bp, C. familiaris
tgctgctgctggtctg

SEQ ID NO: 329712 - DNA, 17 bp, C. familiaris
tgctgctgctgttgctg

SEQ ID NO: 329713 - DNA, 16 bp, C. familiaris
tgctgctgcttctgct

SEQ ID NO: 329714 - DNA, 16 bp, C. familiaris
tgctgctggaaacatc

SEQ ID NO: 329715 - DNA, 30 bp, C. familiaris
tgctgctggtgttggtgaatttgaagcagg

SEQ ID NO: 329716 - DNA, 16 bp, C. familiaris
tgctgctgtgaatatg

SEQ ID NO: 329717 - DNA, 16 bp, C. familiaris
tgctgctgtgtgtgtg

SEQ ID NO: 329718 - DNA, 16 bp, C. familiaris
tgctgctgttgctgtt

SEQ ID NO: 329719 - DNA, 16 bp, C. familiaris
tgctgctgttgttgct

SEQ ID NO: 329720 - DNA, 16 bp, C. familiaris
tgctgcttcccctgct

SEQ ID NO: 329721 - DNA, 16 bp, C. familiaris
tgctgctttcaaaatt

SEQ ID NO: 329722 - DNA, 16 bp, C. familiaris
tgctgcttttaatatt

SEQ ID NO: 329723 - DNA, 16 bp, C. familiaris
tgctggaattaaaata

SEQ ID NO: 329724 - DNA, 16 bp, C. familiaris
tgctggactggatccc

SEQ ID NO: 329725 - DNA, 16 bp, C. familiaris
tgctggaggaggagga

SEQ ID NO: 329726 - DNA, 16 bp, C. familiaris
tgctggaggggagatg

SEQ ID NO: 329727 - DNA, 16 bp, C. familiaris
tgctggcagccaccag

SEQ ID NO: 329728 - DNA, 16 bp, C. familiaris
tgctggccatggagcc

SEQ ID NO: 329729 - DNA, 16 bp, C. familiaris
tgctggctgctggctg

SEQ ID NO: 329730 - DNA, 16 bp, C. familiaris
tgctggctgtggagcc

SEQ ID NO: 329731 - DNA, 16 bp, C. familiaris
tgctgggcacagagcc

SEQ ID NO: 329732 - DNA, 16 bp, C. familiaris
tgctgggcagccccag

SEQ ID NO: 329733 - DNA, 16 bp, C. familiaris
tgctgggcatggagca

SEQ ID NO: 329734 - DNA, 16 bp, C. familiaris
tgctgggcatggagcc

SEQ ID NO: 329735 - DNA, 16 bp, C. familiaris
tgctgggcatggagct

SEQ ID NO: 329736 - DNA, 16 bp, C. familiaris
tgctgggccccacccc

SEQ ID NO: 329737 - DNA, 16 bp, C. familiaris
tgctgggctccatctc

SEQ ID NO: 329738 - DNA, 16 bp, C. familiaris
tgctgggctccctgca

SEQ ID NO: 329739 - DNA, 16 bp, C. familiaris
tgctgggctccctgct

SEQ ID NO: 329740 - DNA, 16 bp, C. familiaris
tgctggggctgcaggg

SEQ ID NO: 329741 - DNA, 16 bp, C. familiaris
tgctggggctggggct

SEQ ID NO: 329742 - DNA, 16 bp, C. familiaris
tgctggtgacaaattc

SEQ ID NO: 329743 - DNA, 16 bp, C. familiaris
tgctggtgctgctgct

SEQ ID NO: 329744 - DNA, 16 bp, C. familiaris
tgctggtgctgctggt

SEQ ID NO: 329745 - DNA, 16 bp, C. familiaris
tgctggtgctggtgct

SEQ ID NO: 329746 - DNA, 16 bp, C. familiaris
tgctggtgctggtggt

SEQ ID NO: 329747 - DNA, 16 bp, C. familiaris
tgctggtgggaataca

SEQ ID NO: 329748 - DNA, 16 bp, C. familiaris
tgctggtgttggtgaa

SEQ ID NO: 329749 - DNA, 16 bp, C. familiaris
tgctgtgaaaattaaa

SEQ ID NO: 329750 - DNA, 16 bp, C. familiaris
tgctgtgcaggagctt

SEQ ID NO: 329751 - DNA, 16 bp, C. familiaris
tgctgtgctcactgca

SEQ ID NO: 329752 - DNA, 16 bp, C. familiaris
tgctgtggccaagttt

SEQ ID NO: 329753 - DNA, 16 bp, C. familiaris
tgctgtggccaggact

SEQ ID NO: 329754 - DNA, 16 bp, C. familiaris
tgctgtgtgctgggca

SEQ ID NO: 329755 - DNA, 16 bp, C. familiaris
tgctgtgtgtggagcc

SEQ ID NO: 329756 - DNA, 16 bp, C. familiaris
tgctgttcagttttcc

SEQ ID NO: 329757 - DNA, 16 bp, C. familiaris
tgctgttgctgctgct

SEQ ID NO: 329758 - DNA, 16 bp, C. familiaris
tgctgttgctgctggt

SEQ ID NO: 329759 - DNA, 16 bp, C. familiaris
tgctgttgggaatgta

SEQ ID NO: 329760 - DNA, 16 bp, C. familiaris
tgctgtttcccctgct

SEQ ID NO: 329761 - DNA, 16 bp, C. familiaris
tgctgtttcctgtgtt

SEQ ID NO: 329762 - DNA, 16 bp, C. familiaris
tgcttaaaaatgcaga

SEQ ID NO: 329763 - DNA, 16 bp, C. familiaris
tgcttatcttttcaaa

SEQ ID NO: 329764 - DNA, 16 bp, C. familiaris
tgcttattctctctct

SEQ ID NO: 329765 - DNA, 16 bp, C. familiaris
tgcttattttatttaa

SEQ ID NO: 329766 - DNA, 16 bp, C. familiaris
tgcttcaaagaatgaa

SEQ ID NO: 329767 - DNA, 16 bp, C. familiaris
tgcttcaagattctct

SEQ ID NO: 329768 - DNA, 16 bp, C. familiaris
tgcttcagattctttc

SEQ ID NO: 329769 - DNA, 16 bp, C. familiaris
tgcttcagcagcacat

SEQ ID NO: 329770 - DNA, 16 bp, C. familiaris
tgcttcagccacactg

SEQ ID NO: 329771 - DNA, 16 bp, C. familiaris
tgcttccctctctgcc

SEQ ID NO: 329772 - DNA, 16 bp, C. familiaris
tgcttcctgctcagca

SEQ ID NO: 329773 - DNA, 16 bp, C. familiaris
tgcttctccaggatgg

SEQ ID NO: 329774 - DNA, 16 bp, C. familiaris
tgcttctccccctgct

SEQ ID NO: 329775 - DNA, 16 bp, C. familiaris
tgcttctccctcagct

SEQ ID NO: 329776 - DNA, 16 bp, C. familiaris
tgcttctccctcccca

SEQ ID NO: 329777 - DNA, 16 bp, C. familiaris
tgcttctccctccgct

SEQ ID NO: 329778 - DNA, 16 bp, C. familiaris
tgcttctcctcctgcc

SEQ ID NO: 329779 - DNA, 16 bp, C. familiaris
tgcttctcctgcctat

SEQ ID NO: 329780 - DNA, 16 bp, C. familiaris
tgcttctcctgtctct

SEQ ID NO: 329781 - DNA, 16 bp, C. familiaris
tgcttctccttctcca

SEQ ID NO: 329782 - DNA, 16 bp, C. familiaris
tgcttctcgctctgct

SEQ ID NO: 329783 - DNA, 16 bp, C. familiaris
tgcttctgaaagaaat

SEQ ID NO: 329784 - DNA, 16 bp, C. familiaris
tgcttctgcctctgct

SEQ ID NO: 329785 - DNA, 16 bp, C. familiaris
tgcttcttatggatga

SEQ ID NO: 329786 - DNA, 16 bp, C. familiaris
tgcttcttccagcttc

SEQ ID NO: 329787 - DNA, 16 bp, C. familiaris
tgcttcttccatcctg

SEQ ID NO: 329788 - DNA, 16 bp, C. familiaris
tgcttcttcctctgca

SEQ ID NO: 329789 - DNA, 16 bp, C. familiaris
tgcttcttcctctgtg

SEQ ID NO: 329790 - DNA, 16 bp, C. familiaris
tgcttcttctgcatct

SEQ ID NO: 329791 - DNA, 16 bp, C. familiaris
tgcttgacctctctga

SEQ ID NO: 329792 - DNA, 16 bp, C. familiaris
tgcttgagtttctctc

SEQ ID NO: 329793 - DNA, 16 bp, C. familiaris
tgcttgcttgctttct

SEQ ID NO: 329794 - DNA, 16 bp, C. familiaris
tgcttggcatggagcc

SEQ ID NO: 329795 - DNA, 16 bp, C. familiaris
tgcttggcggggagtc

SEQ ID NO: 329796 - DNA, 16 bp, C. familiaris
tgcttgggattctgtc

SEQ ID NO: 329797 - DNA, 16 bp, C. familiaris
tgcttggtttaatgct

SEQ ID NO: 329798 - DNA, 16 bp, C. familiaris
tgcttgtgcgtgtgtg

SEQ ID NO: 329799 - DNA, 16 bp, C. familiaris
tgcttgtggattggaa

SEQ ID NO: 329800 - DNA, 16 bp, C. familiaris
tgcttgtgtctctctg

SEQ ID NO: 329801 - DNA, 16 bp, C. familiaris
tgcttgtgtgtgtgct

SEQ ID NO: 329802 - DNA, 16 bp, C. familiaris
tgctttaaaatatttt

SEQ ID NO: 329803 - DNA, 16 bp, C. familiaris
tgctttaaaattaatt

SEQ ID NO: 329804 - DNA, 16 bp, C. familiaris
tgctttacttaaagtc

SEQ ID NO: 329805 - DNA, 16 bp, C. familiaris
tgctttagctgcatcc

SEQ ID NO: 329806 - DNA, 16 bp, C. familiaris
tgctttccaaagtggt

SEQ ID NO: 329807 - DNA, 16 bp, C. familiaris
tgctttctttggagga

SEQ ID NO: 329808 - DNA, 16 bp, C. familiaris
tgctttgcagaagctt

SEQ ID NO: 329809 - DNA, 16 bp, C. familiaris
tgctttgctgactgag

SEQ ID NO: 329810 - DNA, 16 bp, C. familiaris
tgctttggattctttc

SEQ ID NO: 329811 - DNA, 16 bp, C. familiaris
tgctttggctatgtgg

SEQ ID NO: 329812 - DNA, 16 bp, C. familiaris
tgctttgtgcttgcta

SEQ ID NO: 329813 - DNA, 16 bp, C. familiaris
tgcttttaaaaagatt

SEQ ID NO: 329814 - DNA, 16 bp, C. familiaris
tgcttttaaaatttaa

SEQ ID NO: 329815 - DNA, 16 bp, C. familiaris
tgcttttaaaatttat

SEQ ID NO: 329816 - DNA, 16 bp, C. familiaris
tgcttttaagattttc

SEQ ID NO: 329817 - DNA, 16 bp, C. familiaris
tgcttttaatttttaa

SEQ ID NO: 329818 - DNA, 16 bp, C. familiaris
tgcttttataaataat

SEQ ID NO: 329819 - DNA, 16 bp, C. familiaris
tgcttttcaaactgct

SEQ ID NO: 329820 - DNA, 16 bp, C. familiaris
tgcttttgaaaaataa

SEQ ID NO: 329821 - DNA, 16 bp, C. familiaris
tgcttttgatgtatcc

SEQ ID NO: 329822 - DNA, 16 bp, C. familiaris
tgcttttgctgatttt

SEQ ID NO: 329823 - DNA, 16 bp, C. familiaris
tgcttttgtttcccat

SEQ ID NO: 329824 - DNA, 16 bp, C. familiaris
tgctttttaaaagaca

SEQ ID NO: 329825 - DNA, 16 bp, C. familiaris
tgctttttaaaatata

SEQ ID NO: 329826 - DNA, 16 bp, C. familiaris
tgcttttttaaaaaga

SEQ ID NO: 329827 - DNA, 16 bp, C. familiaris
tggaaaaaaagcaaga

SEQ ID NO: 329828 - DNA, 16 bp, C. familiaris
tggaaaaaaatatgga

SEQ ID NO: 329829 - DNA, 16 bp, C. familiaris
tggaaaaaagcataaa

SEQ ID NO: 329830 - DNA, 16 bp, C. familiaris
tggaaaaaagtttctt

SEQ ID NO: 329831 - DNA, 16 bp, C. familiaris
tggaaaaaattatttt

SEQ ID NO: 329832 - DNA, 16 bp, C. familiaris
tggaaaaacatttatt

SEQ ID NO: 329833 - DNA, 16 bp, C. familiaris
tggaaaaaccacaaat

SEQ ID NO: 329834 - DNA, 16 bp, C. familiaris
tggaaaaactgaacag

SEQ ID NO: 329835 - DNA, 16 bp, C. familiaris
tggaaaaagcatttga

SEQ ID NO: 329836 - DNA, 16 bp, C. familiaris
tggaaaaatatttgaa

SEQ ID NO: 329837 - DNA, 16 bp, C. familiaris
tggaaaaatattttct

SEQ ID NO: 329838 - DNA, 16 bp, C. familiaris
tggaaaaatcacaaat

SEQ ID NO: 329839 - DNA, 16 bp, C. familiaris
tggaaaaatcagaaaa

SEQ ID NO: 329840 - DNA, 16 bp, C. familiaris
tggaaaaatgaaatat

SEQ ID NO: 329841 - DNA, 16 bp, C. familiaris
tggaaaaatggataaa

SEQ ID NO: 329842 - DNA, 16 bp, C. familiaris
tggaaaaatgtttatt

SEQ ID NO: 329843 - DNA, 16 bp, C. familiaris
tggaaaaattctcaac

SEQ ID NO: 329844 - DNA, 16 bp, C. familiaris
tggaaaacacagaaga

SEQ ID NO: 329845 - DNA, 16 bp, C. familiaris
tggaaaacagaatgaa

SEQ ID NO: 329846 - DNA, 16 bp, C. familiaris
tggaaaacagagtgga

SEQ ID NO: 329847 - DNA, 16 bp, C. familiaris
tggaaaacagtttgaa

SEQ ID NO: 329848 - DNA, 16 bp, C. familiaris
tggaaaaccacaaaca

SEQ ID NO: 329849 - DNA, 16 bp, C. familiaris
tggaaaacctaaaaga

SEQ ID NO: 329850 - DNA, 16 bp, C. familiaris
tggaaaactgtatgga

SEQ ID NO: 329851 - DNA, 16 bp, C. familiaris
tggaaaagaaaacaga

SEQ ID NO: 329852 - DNA, 16 bp, C. familiaris
tggaaaagaacaaagt

SEQ ID NO: 329853 - DNA, 16 bp, C. familiaris
tggaaaagacaagaaa

SEQ ID NO: 329854 - DNA, 16 bp, C. familiaris
tggaaaagagtgtgga

SEQ ID NO: 329855 - DNA, 16 bp, C. familiaris
tggaaaaggcaaagaa

SEQ ID NO: 329856 - DNA, 16 bp, C. familiaris
tggaaaaggcaagact

SEQ ID NO: 329857 - DNA, 16 bp, C. familiaris
tggaaaaggcagaact

SEQ ID NO: 329858 - DNA, 16 bp, C. familiaris
tggaaaatcccaaaat

SEQ ID NO: 329859 - DNA, 16 bp, C. familiaris
tggaaaatctgaacag

SEQ ID NO: 329860 - DNA, 16 bp, C. familiaris
tggaaaatgaacaaag

SEQ ID NO: 329861 - DNA, 16 bp, C. familiaris
tggaaaatgaagataa

SEQ ID NO: 329862 - DNA, 16 bp, C. familiaris
tggaaaattaaaaaca

SEQ ID NO: 329863 - DNA, 16 bp, C. familiaris
tggaaaattattttct

SEQ ID NO: 329864 - DNA, 16 bp, C. familiaris
tggaaacaaaaatgaa

SEQ ID NO: 329865 - DNA, 16 bp, C. familiaris
tggaaacaaacagaaa

SEQ ID NO: 329866 - DNA, 16 bp, C. familiaris
tggaaacaatctaaat

SEQ ID NO: 329867 - DNA, 16 bp, C. familiaris
tggaaacaccccaaat

SEQ ID NO: 329868 - DNA, 16 bp, C. familiaris
tggaaacatttttatt

SEQ ID NO: 329869 - DNA, 16 bp, C. familiaris
tggaaactaatgaaaa

SEQ ID NO: 329870 - DNA, 16 bp, C. familiaris
tggaaacttttaagat

SEQ ID NO: 329871 - DNA, 16 bp, C. familiaris
tggaaagaaacagaaa

SEQ ID NO: 329872 - DNA, 16 bp, C. familiaris
tggaaagaacccagat

SEQ ID NO: 329873 - DNA, 17 bp, C. familiaris
tggaaagaactcaaatg

SEQ ID NO: 329874 - DNA, 16 bp, C. familiaris
tggaaagaatgtgtat

SEQ ID NO: 329875 - DNA, 16 bp, C. familiaris
tggaaagacataccat

SEQ ID NO: 329876 - DNA, 16 bp, C. familiaris
tggaaagagcactgga

SEQ ID NO: 329877 - DNA, 16 bp, C. familiaris
tggaaagatatttcat

SEQ ID NO: 329878 - DNA, 16 bp, C. familiaris
tggaaaggaaaaacaa

SEQ ID NO: 329879 - DNA, 16 bp, C. familiaris
tggaaaggaagaagtt

SEQ ID NO: 329880 - DNA, 16 bp, C. familiaris
tggaaaggatgtggag

SEQ ID NO: 329881 - DNA, 16 bp, C. familiaris
tggaaagtgatgcaga

SEQ ID NO: 329882 - DNA, 16 bp, C. familiaris
tggaaagttctggaaa

SEQ ID NO: 329883 - DNA, 16 bp, C. familiaris
tggaaataaatgaaga

SEQ ID NO: 329884 - DNA, 16 bp, C. familiaris
tggaaatagagtcttt

SEQ ID NO: 329885 - DNA, 16 bp, C. familiaris
tggaaatatcagtgag

SEQ ID NO: 329886 - DNA, 16 bp, C. familiaris
tggaaatatttaaaat

SEQ ID NO: 329887 - DNA, 16 bp, C. familiaris
tggaaatattttttcc

SEQ ID NO: 329888 - DNA, 16 bp, C. familiaris
tggaaatgcaaaagac

SEQ ID NO: 329889 - DNA, 16 bp, C. familiaris
tggaaatggatagtgg

SEQ ID NO: 329890 - DNA, 16 bp, C. familiaris
tggaaatgttttattt

SEQ ID NO: 329891 - DNA, 16 bp, C. familiaris
tggaaattaaagaaca

SEQ ID NO: 329892 - DNA, 16 bp, C. familiaris
tggaaattagcccttt

SEQ ID NO: 329893 - DNA, 16 bp, C. familiaris
tggaaatttacagtct

SEQ ID NO: 329894 - DNA, 16 bp, C. familiaris
tggaaatttctccaga

SEQ ID NO: 329895 - DNA, 16 bp, C. familiaris
tggaacaaatagaaaa

SEQ ID NO: 329896 - DNA, 16 bp, C. familiaris
tggaacactgacaaca

SEQ ID NO: 329897 - DNA, 16 bp, C. familiaris
tggaacagaaagagga

SEQ ID NO: 329898 - DNA, 16 bp, C. familiaris
tggaacagaacagaaa

SEQ ID NO: 329899 - DNA, 16 bp, C. familiaris
tggaacagaagagaaa

SEQ ID NO: 329900 - DNA, 16 bp, C. familiaris
tggaacagaatacaaa

SEQ ID NO: 329901 - DNA, 16 bp, C. familiaris
tggaacagaatagaaa

SEQ ID NO: 329902 - DNA, 16 bp, C. familiaris
tggaacagaatagaga

SEQ ID NO: 329903 - DNA, 16 bp, C. familiaris
tggaacagaatggaaa

SEQ ID NO: 329904 - DNA, 16 bp, C. familiaris
tggaacagatgaacaa

SEQ ID NO: 329905 - DNA, 16 bp, C. familiaris
tggaacagtttgagaa

SEQ ID NO: 329906 - DNA, 16 bp, C. familiaris
tggaacatgaagaaat

SEQ ID NO: 329907 - DNA, 16 bp, C. familiaris
tggaacattaaaaaaa

SEQ ID NO: 329908 - DNA, 22 bp, C. familiaris
tggaaccaaagagggctgtctc

SEQ ID NO: 329909 - DNA, 16 bp, C. familiaris
tggaaccacaaaagag

SEQ ID NO: 329910 - DNA, 16 bp, C. familiaris
tggaaccacaaaagat

SEQ ID NO: 329911 - DNA, 16 bp, C. familiaris
tggaaccaccaaagac

SEQ ID NO: 329912 - DNA, 17 bp, C. familiaris
tggaaccagaaaagatc

SEQ ID NO: 329913 - DNA, 16 bp, C. familiaris
tggaaccccaggatca

SEQ ID NO: 329914 - DNA, 16 bp, C. familiaris
tggaacctgattctcc

SEQ ID NO: 329915 - DNA, 16 bp, C. familiaris
tggaactacaaaagac

SEQ ID NO: 329916 - DNA, 16 bp, C. familiaris
tggaactagaaaaaga

SEQ ID NO: 329917 - DNA, 16 bp, C. familiaris
tggaactttaaaaaat

SEQ ID NO: 329918 - DNA, 16 bp, C. familiaris
tggaactttccccaga

SEQ ID NO: 329919 - DNA, 16 bp, C. familiaris
tggaagaaacagaaaa

SEQ ID NO: 329920 - DNA, 16 bp, C. familiaris
tggaagaaactcaaaa

SEQ ID NO: 329921 - DNA, 16 bp, C. familiaris
tggaagaacaaaggaa

SEQ ID NO: 329922 - DNA, 16 bp, C. familiaris
tggaagaagcaaagaa

SEQ ID NO: 329923 - DNA, 16 bp, C. familiaris
tggaagaagcagagaa

SEQ ID NO: 329924 - DNA, 16 bp, C. familiaris
tggaagaagcagagga

SEQ ID NO: 329925 - DNA, 16 bp, C. familiaris
tggaagaattaatagt

SEQ ID NO: 329926 - DNA, 16 bp, C. familiaris
tggaagaatttatatt

SEQ ID NO: 329927 - DNA, 16 bp, C. familiaris
tggaagaattttaaat

SEQ ID NO: 329928 - DNA, 16 bp, C. familiaris
tggaagacatcagtga

SEQ ID NO: 329929 - DNA, 16 bp, C. familiaris
tggaagagattgtgta

SEQ ID NO: 329930 - DNA, 16 bp, C. familiaris
tggaagaggcagagga

SEQ ID NO: 329931 - DNA, 16 bp, C. familiaris
tggaagagtttaagaa

SEQ ID NO: 329932 - DNA, 16 bp, C. familiaris
tggaagagtttgagaa

SEQ ID NO: 329933 - DNA, 16 bp, C. familiaris
tggaagagtttgagga

SEQ ID NO: 329934 - DNA, 16 bp, C. familiaris
tggaagagtttgtgaa

SEQ ID NO: 329935 - DNA, 16 bp, C. familiaris
tggaagatttatttat

SEQ ID NO: 329936 - DNA, 16 bp, C. familiaris
tggaagcaaaaagaaa

SEQ ID NO: 329937 - DNA, 16 bp, C. familiaris
tggaagcaacctacat

SEQ ID NO: 329938 - DNA, 16 bp, C. familiaris
tggaagcagatccttc

SEQ ID NO: 329939 - DNA, 16 bp, C. familiaris
tggaagcagcccagtg

SEQ ID NO: 329940 - DNA, 16 bp, C. familiaris
tggaagcaggaaaaaa

SEQ ID NO: 329941 - DNA, 16 bp, C. familiaris
tggaagcctgtacttc

SEQ ID NO: 329942 - DNA, 16 bp, C. familiaris
tggaagctgagaagtc

SEQ ID NO: 329943 - DNA, 16 bp, C. familiaris
tggaaggaaggaaata

SEQ ID NO: 329944 - DNA, 16 bp, C. familiaris
tggaaggacaggggaa

SEQ ID NO: 329945 - DNA, 16 bp, C. familiaris
tggaaggagcctcggg

SEQ ID NO: 329946 - DNA, 16 bp, C. familiaris
tggaaggagcctgggt

SEQ ID NO: 329947 - DNA, 16 bp, C. familiaris
tggaaggaggggcaga

SEQ ID NO: 329948 - DNA, 16 bp, C. familiaris
tggaaggttttaagca

SEQ ID NO: 329949 - DNA, 16 bp, C. familiaris
tggaagtagcccaagt

SEQ ID NO: 329950 - DNA, 16 bp, C. familiaris
tggaagttccttaaaa

SEQ ID NO: 329951 - DNA, 16 bp, C. familiaris
tggaagttttcttttc

SEQ ID NO: 329952 - DNA, 16 bp, C. familiaris
tggaagtttttcttcc

SEQ ID NO: 329953 - DNA, 16 bp, C. familiaris
tggaataagtcagaca

SEQ ID NO: 329954 - DNA, 16 bp, C. familiaris
tggaatacctgggtgg

SEQ ID NO: 329955 - DNA, 16 bp, C. familiaris
tggaatattttgagaa

SEQ ID NO: 329956 - DNA, 16 bp, C. familiaris
tggaatcaaacaatat

SEQ ID NO: 329957 - DNA, 16 bp, C. familiaris
tggaatcaaggtgatg

SEQ ID NO: 329958 - DNA, 16 bp, C. familiaris
tggaatcagaagagac

SEQ ID NO: 329959 - DNA, 16 bp, C. familiaris
tggaatcatgcaatat

SEQ ID NO: 329960 - DNA, 16 bp, C. familiaris
tggaatcccagaagaa

SEQ ID NO: 329961 - DNA, 17 bp, C. familiaris
tggaatcgtgctcctgg

SEQ ID NO: 329962 - DNA, 16 bp, C. familiaris
tggaatctaaaataca

SEQ ID NO: 329963 - DNA, 16 bp, C. familiaris
tggaatcttaccattt

SEQ ID NO: 329964 - DNA, 16 bp, C. familiaris
tggaatgaaaatgaaa

SEQ ID NO: 329965 - DNA, 16 bp, C. familiaris
tggaatgaaactagaa

SEQ ID NO: 329966 - DNA, 16 bp, C. familiaris
tggaatgcagatgtga

SEQ ID NO: 329967 - DNA, 16 bp, C. familiaris
tggaatggaatggaat

SEQ ID NO: 329968 - DNA, 16 bp, C. familiaris
tggaattagaaaatca

SEQ ID NO: 329969 - DNA, 16 bp, C. familiaris
tggaattagaggatat

SEQ ID NO: 329970 - DNA, 16 bp, C. familiaris
tggaattgctggattg

SEQ ID NO: 329971 - DNA, 16 bp, C. familiaris
tggaattgtacagtat

SEQ ID NO: 329972 - DNA, 16 bp, C. familiaris
tggaatttgaaattaa

SEQ ID NO: 329973 - DNA, 16 bp, C. familiaris
tggaatttgaacccaa

SEQ ID NO: 329974 - DNA, 16 bp, C. familiaris
tggaattttagaaaca

SEQ ID NO: 329975 - DNA, 16 bp, C. familiaris
tggaattttctccaga

SEQ ID NO: 329976 - DNA, 16 bp, C. familiaris
tggaatttttcacaga

SEQ ID NO: 329977 - DNA, 16 bp, C. familiaris
tggacaaaacagactt

SEQ ID NO: 329978 - DNA, 16 bp, C. familiaris
tggacaacaacatgca

SEQ ID NO: 329979 - DNA, 16 bp, C. familiaris
tggacacagacatgca

SEQ ID NO: 329980 - DNA, 16 bp, C. familiaris
tggacacagcccagga

SEQ ID NO: 329981 - DNA, 16 bp, C. familiaris
tggacaccaaggctcc

SEQ ID NO: 329982 - DNA, 16 bp, C. familiaris
tggacacccttgtctt

SEQ ID NO: 329983 - DNA, 16 bp, C. familiaris
tggacaccgaggcccc

SEQ ID NO: 329984 - DNA, 16 bp, C. familiaris
tggacagatgaatgga

SEQ ID NO: 329985 - DNA, 16 bp, C. familiaris
tggacagatggatgga

SEQ ID NO: 329986 - DNA, 16 bp, C. familiaris
tggacagccacaagca

SEQ ID NO: 329987 - DNA, 16 bp, C. familiaris
tggacagccacctgca

SEQ ID NO: 329988 - DNA, 16 bp, C. familiaris
tggacataagttttca

SEQ ID NO: 329989 - DNA, 16 bp, C. familiaris
tggacatatttttaaa

SEQ ID NO: 329990 - DNA, 16 bp, C. familiaris
tggacatcactgctat

SEQ ID NO: 329991 - DNA, 16 bp, C. familiaris
tggacatccctgtctt

SEQ ID NO: 329992 - DNA, 16 bp, C. familiaris
tggacatctgggccct

SEQ ID NO: 329993 - DNA, 16 bp, C. familiaris
tggacatctggtctct

SEQ ID NO: 329994 - DNA, 16 bp, C. familiaris
tggacatgaattttgg

SEQ ID NO: 329995 - DNA, 16 bp, C. familiaris
tggacatgcacatgca

SEQ ID NO: 329996 - DNA, 16 bp, C. familiaris
tggacatgtgggctct

SEQ ID NO: 329997 - DNA, 16 bp, C. familiaris
tggacattgctgctgg

SEQ ID NO: 329998 - DNA, 16 bp, C. familiaris
tggacatttgggtttc

SEQ ID NO: 329999 - DNA, 16 bp, C. familiaris
tggacatttttttaaa

SEQ ID NO: 330000 - DNA, 16 bp, C. familiaris
tggaccaaatggactt

SEQ ID NO: 330001 - DNA, 16 bp, C. familiaris
tggaccagcagcagca

SEQ ID NO: 330002 - DNA, 16 bp, C. familiaris
tggaccctgagatcat

SEQ ID NO: 330003 - DNA, 16 bp, C. familiaris
tggacctaagttttca

SEQ ID NO: 330004 - DNA, 16 bp, C. familiaris
tggactccctgcaggg

SEQ ID NO: 330005 - DNA, 16 bp, C. familiaris
tggactgaaggcaaat

SEQ ID NO: 330006 - DNA, 16 bp, C. familiaris
tggactgagctaccca

SEQ ID NO: 330007 - DNA, 16 bp, C. familiaris
tggactgtttcctttg

SEQ ID NO: 330008 - DNA, 16 bp, C. familiaris
tggacttgatcccaag

SEQ ID NO: 330009 - DNA, 16 bp, C. familiaris
tggacttgtgattggc

SEQ ID NO: 330010 - DNA, 16 bp, C. familiaris
tggactttggtgtctt

SEQ ID NO: 330011 - DNA, 16 bp, C. familiaris
tggacttttttcagag

SEQ ID NO: 330012 - DNA, 16 bp, C. familiaris
tggagaaaaattttaa

SEQ ID NO: 330013 - DNA, 16 bp, C. familiaris
tggagaaaagggaacc

SEQ ID NO: 330014 - DNA, 16 bp, C. familiaris
tggagaaactgaggaa

SEQ ID NO: 330015 - DNA, 16 bp, C. familiaris
tggagaaactgaggta

SEQ ID NO: 330016 - DNA, 16 bp, C. familiaris
tggagaaagaagaacc

SEQ ID NO: 330017 - DNA, 16 bp, C. familiaris
tggagaaagacaaaca

SEQ ID NO: 330018 - DNA, 16 bp, C. familiaris
tggagaaagaggaact

SEQ ID NO: 330019 - DNA, 16 bp, C. familiaris
tggagaaaggagaacc

SEQ ID NO: 330020 - DNA, 16 bp, C. familiaris
tggagaaaggggaccc

SEQ ID NO: 330021 - DNA, 16 bp, C. familiaris
tggagaaatatctttt

SEQ ID NO: 330022 - DNA, 16 bp, C. familiaris
tggagaaatggagaaa

SEQ ID NO: 330023 - DNA, 16 bp, C. familiaris
tggagaaatgtctgta

SEQ ID NO: 330024 - DNA, 16 bp, C. familiaris
tggagaaattcttcca

SEQ ID NO: 330025 - DNA, 16 bp, C. familiaris
tggagaacagtgtgga

SEQ ID NO: 330026 - DNA, 16 bp, C. familiaris
tggagaacattatgct

SEQ ID NO: 330027 - DNA, 16 bp, C. familiaris
tggagaacctgcttct

SEQ ID NO: 330028 - DNA, 16 bp, C. familiaris
tggagaagatgcagag

SEQ ID NO: 330029 - DNA, 16 bp, C. familiaris
tggagaagcaggagct

SEQ ID NO: 330030 - DNA, 16 bp, C. familiaris
tggagaagctgcagca

SEQ ID NO: 330031 - DNA, 16 bp, C. familiaris
tggagaaggacaaaaa

SEQ ID NO: 330032 - DNA, 16 bp, C. familiaris
tggagaaggagaagca

SEQ ID NO: 330033 - DNA, 16 bp, C. familiaris
tggagaaggaggcagg

SEQ ID NO: 330034 - DNA, 16 bp, C. familiaris
tggagaaggggcagag

SEQ ID NO: 330035 - DNA, 16 bp, C. familiaris
tggagaatccagaaat

SEQ ID NO: 330036 - DNA, 16 bp, C. familiaris
tggagaatctgcttga

SEQ ID NO: 330037 - DNA, 16 bp, C. familiaris
tggagaatgttccttg

SEQ ID NO: 330038 - DNA, 16 bp, C. familiaris
tggagaattctaccaa

SEQ ID NO: 330039 - DNA, 16 bp, C. familiaris
tggagacagatggtgg

SEQ ID NO: 330040 - DNA, 16 bp, C. familiaris
tggagacattttttgg

SEQ ID NO: 330041 - DNA, 16 bp, C. familiaris
tggagacccagatcaa

SEQ ID NO: 330042 - DNA, 16 bp, C. familiaris
tggagaccccagatcg

SEQ ID NO: 330043 - DNA, 16 bp, C. familiaris
tggagaccctggagac

SEQ ID NO: 330044 - DNA, 16 bp, C. familiaris
tggagaccctggatga

SEQ ID NO: 330045 - DNA, 16 bp, C. familiaris
tggagaccctggattg

SEQ ID NO: 330046 - DNA, 16 bp, C. familiaris
tggagacctgggatga

SEQ ID NO: 330047 - DNA, 16 bp, C. familiaris
tggagagaagtggatg

SEQ ID NO: 330048 - DNA, 16 bp, C. familiaris
tggagagagtaaaaag

SEQ ID NO: 330049 - DNA, 16 bp, C. familiaris
tggagagccacatgca

SEQ ID NO: 330050 - DNA, 16 bp, C. familiaris
tggagagcctgatgtg

SEQ ID NO: 330051 - DNA, 16 bp, C. familiaris
tggagagcctgggtgg

SEQ ID NO: 330052 - DNA, 16 bp, C. familiaris
tggagagcttgttaaa

SEQ ID NO: 330053 - DNA, 16 bp, C. familiaris
tggagatagtaaaaag

SEQ ID NO: 330054 - DNA, 16 bp, C. familiaris
tggagatcatgaccca

SEQ ID NO: 330055 - DNA, 16 bp, C. familiaris
tggagatggaggacct

SEQ ID NO: 330056 - DNA, 16 bp, C. familiaris
tggagatgtctgctgt

SEQ ID NO: 330057 - DNA, 16 bp, C. familiaris
tggagatgtggagaaa

SEQ ID NO: 330058 - DNA, 16 bp, C. familiaris
tggagattgagttcaa

SEQ ID NO: 330059 - DNA, 16 bp, C. familiaris
tggagcaacatcttta

SEQ ID NO: 330060 - DNA, 16 bp, C. familiaris
tggagcacctggtggc

SEQ ID NO: 330061 - DNA, 16 bp, C. familiaris
tggagcagaaggcaga

SEQ ID NO: 330062 - DNA, 16 bp, C. familiaris
tggagcagaggaagag

SEQ ID NO: 330063 - DNA, 16 bp, C. familiaris
tggagcatctttccat

SEQ ID NO: 330064 - DNA, 16 bp, C. familiaris
tggagcatgtggctct

SEQ ID NO: 330065 - DNA, 16 bp, C. familiaris
tggagcccaacaccag

SEQ ID NO: 330066 - DNA, 16 bp, C. familiaris
tggagcccacatcagg

SEQ ID NO: 330067 - DNA, 16 bp, C. familiaris
tggagccccatgaggg

SEQ ID NO: 330068 - DNA, 16 bp, C. familiaris
tggagcccgacacagg

SEQ ID NO: 330069 - DNA, 16 bp, C. familiaris
tggagcccgaggtggg

SEQ ID NO: 330070 - DNA, 16 bp, C. familiaris
tggagccctacatggg

SEQ ID NO: 330071 - DNA, 16 bp, C. familiaris
tggagccctctgcctg

SEQ ID NO: 330072 - DNA, 16 bp, C. familiaris
tggagccctgcatccg

SEQ ID NO: 330073 - DNA, 16 bp, C. familiaris
tggagcctactaaaaa

SEQ ID NO: 330074 - DNA, 16 bp, C. familiaris
tggagcctccagaaag

SEQ ID NO: 330075 - DNA, 16 bp, C. familiaris
tggagcctgaagatgt

SEQ ID NO: 330076 - DNA, 16 bp, C. familiaris
tggagcctgacaaggg

SEQ ID NO: 330077 - DNA, 16 bp, C. familiaris
tggagcctgaggcaaa

SEQ ID NO: 330078 - DNA, 16 bp, C. familiaris
tggagcctgcctggga

SEQ ID NO: 330079 - DNA, 16 bp, C. familiaris
tggagcctgcttagga

SEQ ID NO: 330080 - DNA, 16 bp, C. familiaris
tggagcctgcttattc

SEQ ID NO: 330081 - DNA, 16 bp, C. familiaris
tggagcctgctttccc

SEQ ID NO: 330082 - DNA, 16 bp, C. familiaris
tggagcctggagcctg

SEQ ID NO: 330083 - DNA, 16 bp, C. familiaris
tggagcctgtgtctcc

SEQ ID NO: 330084 - DNA, 16 bp, C. familiaris
tggagccttcttcttc

SEQ ID NO: 330085 - DNA, 16 bp, C. familiaris
tggagctactgcgggg

SEQ ID NO: 330086 - DNA, 16 bp, C. familiaris
tggagctagaatgtat

SEQ ID NO: 330087 - DNA, 16 bp, C. familiaris
tggagctagagagtat

SEQ ID NO: 330088 - DNA, 16 bp, C. familiaris
tggagctccagcagcc

SEQ ID NO: 330089 - DNA, 16 bp, C. familiaris
tggagctctatcccag

SEQ ID NO: 330090 - DNA, 16 bp, C. familiaris
tggagctgctgcagcc

SEQ ID NO: 330091 - DNA, 16 bp, C. familiaris
tggagctgcttctccc

SEQ ID NO: 330092 - DNA, 16 bp, C. familiaris
tggagctggagctgga

SEQ ID NO: 330093 - DNA, 16 bp, C. familiaris
tggagctggagctggg

SEQ ID NO: 330094 - DNA, 16 bp, C. familiaris
tggagctggagggtat

SEQ ID NO: 330095 - DNA, 16 bp, C. familiaris
tggagctggatgcagg

SEQ ID NO: 330096 - DNA, 16 bp, C. familiaris
tggagctggatgtggg

SEQ ID NO: 330097 - DNA, 16 bp, C. familiaris
tggagctgtccagttt

SEQ ID NO: 330098 - DNA, 16 bp, C. familiaris
tggagcttcctcaaga

SEQ ID NO: 330099 - DNA, 16 bp, C. familiaris
tggaggaagagcagag

SEQ ID NO: 330100 - DNA, 16 bp, C. familiaris
tggaggactcacattt

SEQ ID NO: 330101 - DNA, 16 bp, C. familiaris
tggaggagcacctggg

SEQ ID NO: 330102 - DNA, 16 bp, C. familiaris
tggaggagcagaagga

SEQ ID NO: 330103 - DNA, 16 bp, C. familiaris
tggaggagctgggatt

SEQ ID NO: 330104 - DNA, 16 bp, C. familiaris
tggaggaggaggcatt

SEQ ID NO: 330105 - DNA, 16 bp, C. familiaris
tggaggaggcagaggg

SEQ ID NO: 330106 - DNA, 16 bp, C. familiaris
tggaggagggaggcag

SEQ ID NO: 330107 - DNA, 16 bp, C. familiaris
tggaggagtgcctggg

SEQ ID NO: 330108 - DNA, 16 bp, C. familiaris
tggaggatgtggagaa

SEQ ID NO: 330109 - DNA, 16 bp, C. familiaris
tggaggcagagccagg

SEQ ID NO: 330110 - DNA, 16 bp, C. familiaris
tggaggcagagctggg

SEQ ID NO: 330111 - DNA, 16 bp, C. familiaris
tggaggcagaggtggg

SEQ ID NO: 330112 - DNA, 16 bp, C. familiaris
tggaggccagaaatct

SEQ ID NO: 330113 - DNA, 16 bp, C. familiaris
tggaggccatgtggac

SEQ ID NO: 330114 - DNA, 16 bp, C. familiaris
tggaggccctgctcac

SEQ ID NO: 330115 - DNA, 16 bp, C. familiaris
tggaggctgaaagtct

SEQ ID NO: 330116 - DNA, 16 bp, C. familiaris
tggaggctgagaaaat

SEQ ID NO: 330117 - DNA, 16 bp, C. familiaris
tggaggctggaagttc

SEQ ID NO: 330118 - DNA, 16 bp, C. familiaris
tggaggctttgggttt

SEQ ID NO: 330119 - DNA, 18 bp, C. familiaris
tggagggaacttcagtgg

SEQ ID NO: 330120 - DNA, 16 bp, C. familiaris
tggagggacacctggg

SEQ ID NO: 330121 - DNA, 16 bp, C. familiaris
tggagggacacttggg

SEQ ID NO: 330122 - DNA, 16 bp, C. familiaris
tggagggaggcctggg

SEQ ID NO: 330123 - DNA, 16 bp, C. familiaris
tggagggagggccaga

SEQ ID NO: 330124 - DNA, 16 bp, C. familiaris
tggagggcccaggaca

SEQ ID NO: 330125 - DNA, 30 bp, C. familiaris
tggaggttaaggaccatcctgctaaaagat

SEQ ID NO: 330126 - DNA, 16 bp, C. familiaris
tggagtaatgaaaatg

SEQ ID NO: 330127 - DNA, 16 bp, C. familiaris
tggagtacctgggtgg

SEQ ID NO: 330128 - DNA, 16 bp, C. familiaris
tggagtcagctcccca

SEQ ID NO: 330129 - DNA, 16 bp, C. familiaris
tggagtcccagaagga

SEQ ID NO: 330130 - DNA, 16 bp, C. familiaris
tggagtcccaggactg

SEQ ID NO: 330131 - DNA, 16 bp, C. familiaris
tggagtcccccatcag

SEQ ID NO: 330132 - DNA, 16 bp, C. familiaris
tggagtccctgctcag

SEQ ID NO: 330133 - DNA, 16 bp, C. familiaris
tggagtctacttcaga

SEQ ID NO: 330134 - DNA, 16 bp, C. familiaris
tggagtctgggggaga

SEQ ID NO: 330135 - DNA, 16 bp, C. familiaris
tggagtttacattcca

SEQ ID NO: 330136 - DNA, 16 bp, C. familiaris
tggagtttcttcagag

SEQ ID NO: 330137 - DNA, 16 bp, C. familiaris
tggagtttgcaagttt

SEQ ID NO: 330138 - DNA, 16 bp, C. familiaris
tggataaaaaggcaag

SEQ ID NO: 330139 - DNA, 16 bp, C. familiaris
tggataaaagaagatg

SEQ ID NO: 330140 - DNA, 16 bp, C. familiaris
tggataaacaaaatat

SEQ ID NO: 330141 - DNA, 16 bp, C. familiaris
tggataaagaaaatat

SEQ ID NO: 330142 - DNA, 16 bp, C. familiaris
tggataaagaacatgt

SEQ ID NO: 330143 - DNA, 16 bp, C. familiaris
tggataaagaagatgc

SEQ ID NO: 330144 - DNA, 17 bp, C. familiaris
tggataaagaagatgta

SEQ ID NO: 330145 - DNA, 16 bp, C. familiaris
tggataccttttattt

SEQ ID NO: 330146 - DNA, 16 bp, C. familiaris
tggatagtaacccttt

SEQ ID NO: 330147 - DNA, 16 bp, C. familiaris
tggatattctctccct

SEQ ID NO: 330148 - DNA, 16 bp, C. familiaris
tggatatttaggttat

SEQ ID NO: 330149 - DNA, 16 bp, C. familiaris
tggatcaaaaaagaaa

SEQ ID NO: 330150 - DNA, 16 bp, C. familiaris
tggatcacagacttaa

SEQ ID NO: 330151 - DNA, 16 bp, C. familiaris
tggatcactatgtttg

SEQ ID NO: 330152 - DNA, 16 bp, C. familiaris
tggatcagagacctaa

SEQ ID NO: 330153 - DNA, 16 bp, C. familiaris
tggatccagccatgcc

SEQ ID NO: 330154 - DNA, 16 bp, C. familiaris
tggatcccaggagcct

SEQ ID NO: 330155 - DNA, 16 bp, C. familiaris
tggatcctgcttctct

SEQ ID NO: 330156 - DNA, 16 bp, C. familiaris
tggatctaagaagagt

SEQ ID NO: 330157 - DNA, 16 bp, C. familiaris
tggatctcacaaccct

SEQ ID NO: 330158 - DNA, 16 bp, C. familiaris
tggatctcatgatcct

SEQ ID NO: 330159 - DNA, 16 bp, C. familiaris
tggatcttattggcta

SEQ ID NO: 330160 - DNA, 16 bp, C. familiaris
tggatgaaaatgaaaa

SEQ ID NO: 330161 - DNA, 16 bp, C. familiaris
tggatgaagaagctgt

SEQ ID NO: 330162 - DNA, 16 bp, C. familiaris
tggatgaatgaataca

SEQ ID NO: 330163 - DNA, 16 bp, C. familiaris
tggatgaatggaagga

SEQ ID NO: 330164 - DNA, 16 bp, C. familiaris
tggatgaatggatcaa

SEQ ID NO: 330165 - DNA, 16 bp, C. familiaris
tggatgactggatgga

SEQ ID NO: 330166 - DNA, 16 bp, C. familiaris
tggatgagacccaccc

SEQ ID NO: 330167 - DNA, 16 bp, C. familiaris
tggatgagatcctgga

SEQ ID NO: 330168 - DNA, 16 bp, C. familiaris
tggatgaggcccacca

SEQ ID NO: 330169 - DNA, 16 bp, C. familiaris
tggatgaggcccaccc

SEQ ID NO: 330170 - DNA, 16 bp, C. familiaris
tggatgcaaaacttct

SEQ ID NO: 330171 - DNA, 16 bp, C. familiaris
tggatgccatttattt

SEQ ID NO: 330172 - DNA, 16 bp, C. familiaris
tggatgcctcagttgg

SEQ ID NO: 330173 - DNA, 16 bp, C. familiaris
tggatggaactaaagg

SEQ ID NO: 330174 - DNA, 33 bp, C. familiaris
tggatggaactggagggtattatgctgagtgaa

SEQ ID NO: 330175 - DNA, 17 bp, C. familiaris
tggatggacaccgaggc

SEQ ID NO: 330176 - DNA, 16 bp, C. familiaris
tggatggacctgaagg

SEQ ID NO: 330177 - DNA, 16 bp, C. familiaris
tggatggactggaggg

SEQ ID NO: 330178 - DNA, 16 bp, C. familiaris
tggatggatagaagga

SEQ ID NO: 330179 - DNA, 16 bp, C. familiaris
tggatggatggaagga

SEQ ID NO: 330180 - DNA, 16 bp, C. familiaris
tggatggcacagtcag

SEQ ID NO: 330181 - DNA, 16 bp, C. familiaris
tggatgggattctgga

SEQ ID NO: 330182 - DNA, 16 bp, C. familiaris
tggatgtatcttgaaa

SEQ ID NO: 330183 - DNA, 16 bp, C. familiaris
tggatgtgctcaatga

SEQ ID NO: 330184 - DNA, 16 bp, C. familiaris
tggatgtggagaaagg

SEQ ID NO: 330185 - DNA, 16 bp, C. familiaris
tggatgttgaattttg

SEQ ID NO: 330186 - DNA, 16 bp, C. familiaris
tggatgttgagtttga

SEQ ID NO: 330187 - DNA, 16 bp, C. familiaris
tggattaaagaagaaa

SEQ ID NO: 330188 - DNA, 40 bp, C. familiaris
tggattacaattcaatgtcagaaagccaattcagaagcac

SEQ ID NO: 330189 - DNA, 16 bp, C. familiaris
tggattagaagaaaaa

SEQ ID NO: 330190 - DNA, 16 bp, C. familiaris
tggattatctggatgg

SEQ ID NO: 330191 - DNA, 16 bp, C. familiaris
tggattcctattttat

SEQ ID NO: 330192 - DNA, 16 bp, C. familiaris
tggattcgcgctcccg

SEQ ID NO: 330193 - DNA, 26 bp, C. familiaris
tggattgtcacacagctcacattgct

SEQ ID NO: 330194 - DNA, 16 bp, C. familiaris
tggatttatttctagg

SEQ ID NO: 330195 - DNA, 16 bp, C. familiaris
tggatttggcaatgat

SEQ ID NO: 330196 - DNA, 16 bp, C. familiaris
tggatttggcccacag

SEQ ID NO: 330197 - DNA, 16 bp, C. familiaris
tggatttggtaatgat

SEQ ID NO: 330198 - DNA, 16 bp, C. familiaris
tggattttccacatag

SEQ ID NO: 330199 - DNA, 16 bp, C. familiaris
tggattttgaagactt

SEQ ID NO: 330200 - DNA, 16 bp, C. familiaris
tggattttgttaaatg

SEQ ID NO: 330201 - DNA, 16 bp, C. familiaris
tggatttttaaaagaa

SEQ ID NO: 330202 - DNA, 16 bp, C. familiaris
tggcaaaacaaaaaca

SEQ ID NO: 330203 - DNA, 16 bp, C. familiaris
tggcaaagaagaaagt

SEQ ID NO: 330204 - DNA, 16 bp, C. familiaris
tggcaaagaagaagtt

SEQ ID NO: 330205 - DNA, 16 bp, C. familiaris
tggcaaatttataaat

SEQ ID NO: 330206 - DNA, 16 bp, C. familiaris
tggcaacagcccagcc

SEQ ID NO: 330207 - DNA, 16 bp, C. familiaris
tggcaactaccagttt

SEQ ID NO: 330208 - DNA, 16 bp, C. familiaris
tggcaaggacgtggag

SEQ ID NO: 330209 - DNA, 16 bp, C. familiaris
tggcaagtgatgcaaa

SEQ ID NO: 330210 - DNA, 16 bp, C. familiaris
tggcaataaaaaggaa

SEQ ID NO: 330211 - DNA, 16 bp, C. familiaris
tggcaattctattttt

SEQ ID NO: 330212 - DNA, 16 bp, C. familiaris
tggcacaaaaacacac

SEQ ID NO: 330213 - DNA, 16 bp, C. familiaris
tggcacaagaatctca

SEQ ID NO: 330214 - DNA, 16 bp, C. familiaris
tggcacagagctcctg

SEQ ID NO: 330215 - DNA, 16 bp, C. familiaris
tggcaccacctgcagc

SEQ ID NO: 330216 - DNA, 16 bp, C. familiaris
tggcacctgtgtggct

SEQ ID NO: 330217 - DNA, 16 bp, C. familiaris
tggcagagacaggcag

SEQ ID NO: 330218 - DNA, 16 bp, C. familiaris
tggcagagatgggatt

SEQ ID NO: 330219 - DNA, 16 bp, C. familiaris
tggcagattgtgtctt

SEQ ID NO: 330220 - DNA, 16 bp, C. familiaris
tggcagccctggtggc

SEQ ID NO: 330221 - DNA, 16 bp, C. familiaris
tggcagctggcttccc

SEQ ID NO: 330222 - DNA, 16 bp, C. familiaris
tggcagctggcttcct

SEQ ID NO: 330223 - DNA, 28 bp, C. familiaris
tggcaggatacaaaatcaatgcccagaa

SEQ ID NO: 330224 - DNA, 16 bp, C. familiaris
tggcaggcaaagggag

SEQ ID NO: 330225 - DNA, 16 bp, C. familiaris
tggcagggaaggaaaa

SEQ ID NO: 330226 - DNA, 16 bp, C. familiaris
tggcagggcacctggg

SEQ ID NO: 330227 - DNA, 16 bp, C. familiaris
tggcagggccagctct

SEQ ID NO: 330228 - DNA, 16 bp, C. familiaris
tggcagggccatgctc

SEQ ID NO: 330229 - DNA, 16 bp, C. familiaris
tggcaggtgatgtgga

SEQ ID NO: 330230 - DNA, 16 bp, C. familiaris
tggcagtgatggcatg

SEQ ID NO: 330231 - DNA, 16 bp, C. familiaris
tggcagtggccagctc

SEQ ID NO: 330232 - DNA, 16 bp, C. familiaris
tggcagttcctcaaaa

SEQ ID NO: 330233 - DNA, 16 bp, C. familiaris
tggcatcaagtcctgc

SEQ ID NO: 330234 - DNA, 16 bp, C. familiaris
tggcatctgcttctca

SEQ ID NO: 330235 - DNA, 16 bp, C. familiaris
tggcatgatatattta

SEQ ID NO: 330236 - DNA, 16 bp, C. familiaris
tggcatggagtctgct

SEQ ID NO: 330237 - DNA, 16 bp, C. familiaris
tggcattcccaccaac

SEQ ID NO: 330238 - DNA, 16 bp, C. familiaris
tggcatttatagaaca

SEQ ID NO: 330239 - DNA, 16 bp, C. familiaris
tggcatttctttcttt

SEQ ID NO: 330240 - DNA, 16 bp, C. familiaris
tggccaacaagcgcat

SEQ ID NO: 330241 - DNA, 16 bp, C. familiaris
tggccaacaccttgat

SEQ ID NO: 330242 - DNA, 16 bp, C. familiaris
tggccaacagacacac

SEQ ID NO: 330243 - DNA, 16 bp, C. familiaris
tggccaagaggtacat

SEQ ID NO: 330244 - DNA, 16 bp, C. familiaris
tggccaatagaatgtg

SEQ ID NO: 330245 - DNA, 16 bp, C. familiaris
tggccacagcaactcc

SEQ ID NO: 330246 - DNA, 16 bp, C. familiaris
tggccaccagggaaat

SEQ ID NO: 330247 - DNA, 16 bp, C. familiaris
tggccaccatattgga

SEQ ID NO: 330248 - DNA, 16 bp, C. familiaris
tggccagaaaaaaaaa

SEQ ID NO: 330249 - DNA, 16 bp, C. familiaris
tggccagctcttggtt

SEQ ID NO: 330250 - DNA, 16 bp, C. familiaris
tggccagtgatttaat

SEQ ID NO: 330251 - DNA, 16 bp, C. familiaris
tggccatcaagacagt

SEQ ID NO: 330252 - DNA, 16 bp, C. familiaris
tggccatctgcaaccc

SEQ ID NO: 330253 - DNA, 16 bp, C. familiaris
tggccatctggatgtt

SEQ ID NO: 330254 - DNA, 16 bp, C. familiaris
tggccatctgtaagcc

SEQ ID NO: 330255 - DNA, 16 bp, C. familiaris
tggccatgtgactgag

SEQ ID NO: 330256 - DNA, 16 bp, C. familiaris
tggccattaaaaaaaa

SEQ ID NO: 330257 - DNA, 16 bp, C. familiaris
tggccatttgtatgcc

SEQ ID NO: 330258 - DNA, 16 bp, C. familiaris
tggcccaaggcctgat

SEQ ID NO: 330259 - DNA, 16 bp, C. familiaris
tggcccagccctgccc

SEQ ID NO: 330260 - DNA, 16 bp, C. familiaris
tggcccaggacctgat

SEQ ID NO: 330261 - DNA, 16 bp, C. familiaris
tggcccagggcccaat

SEQ ID NO: 330262 - DNA, 16 bp, C. familiaris
tggcccagggcctggt

SEQ ID NO: 330263 - DNA, 16 bp, C. familiaris
tggcccagggtgccat

SEQ ID NO: 330264 - DNA, 16 bp, C. familiaris
tggcccagtatgtggt

SEQ ID NO: 330265 - DNA, 16 bp, C. familiaris
tggcccagtggctgag

SEQ ID NO: 330266 - DNA, 16 bp, C. familiaris
tggcccagtggtttaa

SEQ ID NO: 330267 - DNA, 16 bp, C. familiaris
tggccccagccctgcc

SEQ ID NO: 330268 - DNA, 16 bp, C. familiaris
tggcccggggcgtggt

SEQ ID NO: 330269 - DNA, 16 bp, C. familiaris
tggccctgccaacacc

SEQ ID NO: 330270 - DNA, 16 bp, C. familiaris
tggccctgcccctgcc

SEQ ID NO: 330271 - DNA, 16 bp, C. familiaris
tggccctgccctgccc

SEQ ID NO: 330272 - DNA, 16 bp, C. familiaris
tggccctggacttctg

SEQ ID NO: 330273 - DNA, 16 bp, C. familiaris
tggccctggactttag

SEQ ID NO: 330274 - DNA, 16 bp, C. familiaris
tggccgctgccagtgg

SEQ ID NO: 330275 - DNA, 16 bp, C. familiaris
tggcctcagggtcctg

SEQ ID NO: 330276 - DNA, 16 bp, C. familiaris
tggcctcagtttcccc

SEQ ID NO: 330277 - DNA, 16 bp, C. familiaris
tggcctccaggtcaga

SEQ ID NO: 330278 - DNA, 16 bp, C. familiaris
tggcctccctgcaggg

SEQ ID NO: 330279 - DNA, 16 bp, C. familiaris
tggcctccctgggcct

SEQ ID NO: 330280 - DNA, 16 bp, C. familiaris
tggcctctgtccccag

SEQ ID NO: 330281 - DNA, 16 bp, C. familiaris
tggcctcttctctccc

SEQ ID NO: 330282 - DNA, 16 bp, C. familiaris
tggcctcttctctctc

SEQ ID NO: 330283 - DNA, 16 bp, C. familiaris
tggcctgaaggcaggc

SEQ ID NO: 330284 - DNA, 16 bp, C. familiaris
tggcctggcctggcct

SEQ ID NO: 330285 - DNA, 16 bp, C. familiaris
tggcctgggcctgggc

SEQ ID NO: 330286 - DNA, 16 bp, C. familiaris
tggcctgtgggccata

SEQ ID NO: 330287 - DNA, 16 bp, C. familiaris
tggcctttcctcagtg

SEQ ID NO: 330288 - DNA, 16 bp, C. familiaris
tggcctttggcccagg

SEQ ID NO: 330289 - DNA, 16 bp, C. familiaris
tggcgagtctgcttct

SEQ ID NO: 330290 - DNA, 16 bp, C. familiaris
tggcgcagggtgtgat

SEQ ID NO: 330291 - DNA, 16 bp, C. familiaris
tggcgcagtcggttaa

SEQ ID NO: 330292 - DNA, 16 bp, C. familiaris
tggcgccacctgcagc

SEQ ID NO: 330293 - DNA, 16 bp, C. familiaris
tggcgccaccttcggc

SEQ ID NO: 330294 - DNA, 16 bp, C. familiaris
tggctaatggttcatc

SEQ ID NO: 330295 - DNA, 16 bp, C. familiaris
tggctagctcagtcag

SEQ ID NO: 330296 - DNA, 17 bp, C. familiaris
tggctatagtggacatt

SEQ ID NO: 330297 - DNA, 16 bp, C. familiaris
tggctattgaaaataa

SEQ ID NO: 330298 - DNA, 16 bp, C. familiaris
tggctattggcctgtt

SEQ ID NO: 330299 - DNA, 16 bp, C. familiaris
tggctattgtgaacag

SEQ ID NO: 330300 - DNA, 16 bp, C. familiaris
tggctattgtggatat

SEQ ID NO: 330301 - DNA, 16 bp, C. familiaris
tggctattgtggtcat

SEQ ID NO: 330302 - DNA, 16 bp, C. familiaris
tggctcaaaatgtcaa

SEQ ID NO: 330303 - DNA, 16 bp, C. familiaris
tggctcaaggcatgat

SEQ ID NO: 330304 - DNA, 16 bp, C. familiaris
tggctcagaggtggag

SEQ ID NO: 330305 - DNA, 16 bp, C. familiaris
tggctcagagtgtggt

SEQ ID NO: 330306 - DNA, 16 bp, C. familiaris
tggctcagatggtaga

SEQ ID NO: 330307 - DNA, 16 bp, C. familiaris
tggctcagccatttgg

SEQ ID NO: 330308 - DNA, 16 bp, C. familiaris
tggctcagcccattaa

SEQ ID NO: 330309 - DNA, 16 bp, C. familiaris
tggctcagcgcttgag

SEQ ID NO: 330310 - DNA, 16 bp, C. familiaris
tggctcagctggaaga

SEQ ID NO: 330311 - DNA, 16 bp, C. familiaris
tggctcagctggtaaa

SEQ ID NO: 330312 - DNA, 16 bp, C. familiaris
tggctcagctggtgga

SEQ ID NO: 330313 - DNA, 16 bp, C. familiaris
tggctcaggagttgag

SEQ ID NO: 330314 - DNA, 16 bp, C. familiaris
tggctcaggcaattaa

SEQ ID NO: 330315 - DNA, 16 bp, C. familiaris
tggctcaggccatggt

SEQ ID NO: 330316 - DNA, 16 bp, C. familiaris
tggctcaggccctgat

SEQ ID NO: 330317 - DNA, 16 bp, C. familiaris
tggctcagggcatcat

SEQ ID NO: 330318 - DNA, 16 bp, C. familiaris
tggctcagggcctgat

SEQ ID NO: 330319 - DNA, 16 bp, C. familiaris
tggctcaggtggttgg

SEQ ID NO: 330320 - DNA, 16 bp, C. familiaris
tggctcagtacattaa

SEQ ID NO: 330321 - DNA, 16 bp, C. familiaris
tggctcagtcaagtaa

SEQ ID NO: 330322 - DNA, 16 bp, C. familiaris
tggctcagtcagttgg

SEQ ID NO: 330323 - DNA, 16 bp, C. familiaris
tggctcagtctgtcaa

SEQ ID NO: 330324 - DNA, 16 bp, C. familiaris
tggctcagtctgttaa

SEQ ID NO: 330325 - DNA, 16 bp, C. familiaris
tggctcagtggattga

SEQ ID NO: 330326 - DNA, 16 bp, C. familiaris
tggctcagtggctgaa

SEQ ID NO: 330327 - DNA, 16 bp, C. familiaris
tggctcagtggggagc

SEQ ID NO: 330328 - DNA, 16 bp, C. familiaris
tggctcagttagtgga

SEQ ID NO: 330329 - DNA, 16 bp, C. familiaris
tggctcagttggctca

SEQ ID NO: 330330 - DNA, 16 bp, C. familiaris
tggctccagagtccat

SEQ ID NO: 330331 - DNA, 16 bp, C. familiaris
tggctccccagtgcct

SEQ ID NO: 330332 - DNA, 18 bp, C. familiaris
tggctcctgactatgatg

SEQ ID NO: 330333 - DNA, 16 bp, C. familiaris
tggctccttgctcagc

SEQ ID NO: 330334 - DNA, 16 bp, C. familiaris
tggctcgtggcccctt

SEQ ID NO: 330335 - DNA, 16 bp, C. familiaris
tggctctctctctctt

SEQ ID NO: 330336 - DNA, 16 bp, C. familiaris
tggctctgcagtttgg

SEQ ID NO: 330337 - DNA, 16 bp, C. familiaris
tggctctgcctctttc

SEQ ID NO: 330338 - DNA, 16 bp, C. familiaris
tggctctggaaaaagc

SEQ ID NO: 330339 - DNA, 16 bp, C. familiaris
tggctctggggctgga

SEQ ID NO: 330340 - DNA, 16 bp, C. familiaris
tggctctgtggccttg

SEQ ID NO: 330341 - DNA, 16 bp, C. familiaris
tggctgagccacctgg

SEQ ID NO: 330342 - DNA, 16 bp, C. familiaris
tggctgagccatccag

SEQ ID NO: 330343 - DNA, 16 bp, C. familiaris
tggctgagcgtctgcc

SEQ ID NO: 330344 - DNA, 16 bp, C. familiaris
tggctgcaccattttt

SEQ ID NO: 330345 - DNA, 16 bp, C. familiaris
tggctgcatcagcttg

SEQ ID NO: 330346 - DNA, 16 bp, C. familiaris
tggctgccccagcttg

SEQ ID NO: 330347 - DNA, 16 bp, C. familiaris
tggctgccttctgctc

SEQ ID NO: 330348 - DNA, 16 bp, C. familiaris
tggctgcctttgactc

SEQ ID NO: 330349 - DNA, 18 bp, C. familiaris
tggctgctgctgctgctg

SEQ ID NO: 330350 - DNA, 16 bp, C. familiaris
tggctgctttcctgct

SEQ ID NO: 330351 - DNA, 16 bp, C. familiaris
tggctggagctgtggc

SEQ ID NO: 330352 - DNA, 16 bp, C. familiaris
tggctggctcagagga

SEQ ID NO: 330353 - DNA, 16 bp, C. familiaris
tggctggctcaggggt

SEQ ID NO: 330354 - DNA, 16 bp, C. familiaris
tggctggctcagtcct

SEQ ID NO: 330355 - DNA, 16 bp, C. familiaris
tggctggctccctgct

SEQ ID NO: 330356 - DNA, 16 bp, C. familiaris
tggctgggacacaggc

SEQ ID NO: 330357 - DNA, 16 bp, C. familiaris
tggctggtcctgcagg

SEQ ID NO: 330358 - DNA, 16 bp, C. familiaris
tggctgtctgcaagcc

SEQ ID NO: 330359 - DNA, 16 bp, C. familiaris
tggctgtgcagaagct

SEQ ID NO: 330360 - DNA, 16 bp, C. familiaris
tggctgtgtgtccttg

SEQ ID NO: 330361 - DNA, 16 bp, C. familiaris
tggctgttgtgaatag

SEQ ID NO: 330362 - DNA, 17 bp, C. familiaris
tggctgtttcttttgct

SEQ ID NO: 330363 - DNA, 16 bp, C. familiaris
tggcttagttggaaga

SEQ ID NO: 330364 - DNA, 16 bp, C. familiaris
tggcttatttcactga

SEQ ID NO: 330365 - DNA, 16 bp, C. familiaris
tggcttcccaggggga

SEQ ID NO: 330366 - DNA, 16 bp, C. familiaris
tggcttccctggggaa

SEQ ID NO: 330367 - DNA, 16 bp, C. familiaris
tggcttcctggaggag

SEQ ID NO: 330368 - DNA, 16 bp, C. familiaris
tggcttctaggcatgc

SEQ ID NO: 330369 - DNA, 16 bp, C. familiaris
tggcttcttctctccc

SEQ ID NO: 330370 - DNA, 16 bp, C. familiaris
tggcttgaaaaaaaaa

SEQ ID NO: 330371 - DNA, 16 bp, C. familiaris
tggcttgggctctgtt

SEQ ID NO: 330372 - DNA, 16 bp, C. familiaris
tggcttgtcttcctct

SEQ ID NO: 330373 - DNA, 16 bp, C. familiaris
tggctttatgaagaag

SEQ ID NO: 330374 - DNA, 16 bp, C. familiaris
tggctttctctctcct

SEQ ID NO: 330375 - DNA, 16 bp, C. familiaris
tggctttctgattttg

SEQ ID NO: 330376 - DNA, 16 bp, C. familiaris
tggcttttcttaaaaa

SEQ ID NO: 330377 - DNA, 16 bp, C. familiaris
tggctttttgtgactg

SEQ ID NO: 330378 - DNA, 16 bp, C. familiaris
tgggaaaaaaaatttt

SEQ ID NO: 330379 - DNA, 16 bp, C. familiaris
tgggaaaaaagacagt

SEQ ID NO: 330380 - DNA, 16 bp, C. familiaris
tgggaaaaactcaaat

SEQ ID NO: 330381 - DNA, 16 bp, C. familiaris
tgggaaaagtggacag

SEQ ID NO: 330382 - DNA, 16 bp, C. familiaris
tgggaaagaggcagag

SEQ ID NO: 330383 - DNA, 16 bp, C. familiaris
tgggaaagcaagctgg

SEQ ID NO: 330384 - DNA, 16 bp, C. familiaris
tgggaaaggaaacaga

SEQ ID NO: 330385 - DNA, 16 bp, C. familiaris
tgggaaagtctttatc

SEQ ID NO: 330386 - DNA, 16 bp, C. familiaris
tgggaaataaacaaag

SEQ ID NO: 330387 - DNA, 16 bp, C. familiaris
tgggaaatattagaaa

SEQ ID NO: 330388 - DNA, 16 bp, C. familiaris
tgggaaatctcagaaa

SEQ ID NO: 330389 - DNA, 16 bp, C. familiaris
tgggaaatgaacaaaa

SEQ ID NO: 330390 - DNA, 16 bp, C. familiaris
tgggaaatgaacaaga

SEQ ID NO: 330391 - DNA, 16 bp, C. familiaris
tgggaaatgtgggaaa

SEQ ID NO: 330392 - DNA, 16 bp, C. familiaris
tgggaaatttggacag

SEQ ID NO: 330393 - DNA, 16 bp, C. familiaris
tgggaactaatgagaa

SEQ ID NO: 330394 - DNA, 16 bp, C. familiaris
tgggaactgccaagta

SEQ ID NO: 330395 - DNA, 16 bp, C. familiaris
tgggaagactgaggct

SEQ ID NO: 330396 - DNA, 16 bp, C. familiaris
tgggaagcagagaaaa

SEQ ID NO: 330397 - DNA, 16 bp, C. familiaris
tgggaataaacctaac

SEQ ID NO: 330398 - DNA, 16 bp, C. familiaris
tgggaatatatttttg

SEQ ID NO: 330399 - DNA, 16 bp, C. familiaris
tgggaatattggacag

SEQ ID NO: 330400 - DNA, 16 bp, C. familiaris
tgggacaccccccccc

SEQ ID NO: 330401 - DNA, 16 bp, C. familiaris
tgggacaggaaagccc

SEQ ID NO: 330402 - DNA, 16 bp, C. familiaris
tgggaccacgccctga

SEQ ID NO: 330403 - DNA, 16 bp, C. familiaris
tgggacccccaggatc

SEQ ID NO: 330404 - DNA, 16 bp, C. familiaris
tgggaccctgaggtca

SEQ ID NO: 330405 - DNA, 16 bp, C. familiaris
tgggaccgtgggatca

SEQ ID NO: 330406 - DNA, 16 bp, C. familiaris
tgggactcaatctcag

SEQ ID NO: 330407 - DNA, 16 bp, C. familiaris
tgggactccagggtca

SEQ ID NO: 330408 - DNA, 16 bp, C. familiaris
tgggactccatcctgg

SEQ ID NO: 330409 - DNA, 16 bp, C. familiaris
tgggactcgatgcagg

SEQ ID NO: 330410 - DNA, 16 bp, C. familiaris
tgggactctgggactc

SEQ ID NO: 330411 - DNA, 16 bp, C. familiaris
tgggactgagccctga

SEQ ID NO: 330412 - DNA, 16 bp, C. familiaris
tgggactggatcccga

SEQ ID NO: 330413 - DNA, 16 bp, C. familiaris
tgggacttcatcaata

SEQ ID NO: 330414 - DNA, 16 bp, C. familiaris
tgggacttcatgaaga

SEQ ID NO: 330415 - DNA, 16 bp, C. familiaris
tgggagaaaaaaattt

SEQ ID NO: 330416 - DNA, 16 bp, C. familiaris
tgggagacagagaggc

SEQ ID NO: 330417 - DNA, 16 bp, C. familiaris
tgggagagaggacttt

SEQ ID NO: 330418 - DNA, 16 bp, C. familiaris
tgggagaggatgtgga

SEQ ID NO: 330419 - DNA, 16 bp, C. familiaris
tgggagaggtggggcc

SEQ ID NO: 330420 - DNA, 16 bp, C. familiaris
tgggagcaggagcagg

SEQ ID NO: 330421 - DNA, 16 bp, C. familiaris
tgggagcatccaaata

SEQ ID NO: 330422 - DNA, 16 bp, C. familiaris
tgggagccaggggctg

SEQ ID NO: 330423 - DNA, 16 bp, C. familiaris
tgggaggaaactgagg

SEQ ID NO: 330424 - DNA, 16 bp, C. familiaris
tgggaggaggcagagg

SEQ ID NO: 330425 - DNA, 16 bp, C. familiaris
tgggagggcagcctgg

SEQ ID NO: 330426 - DNA, 16 bp, C. familiaris
tgggaggtttttgatg

SEQ ID NO: 330427 - DNA, 16 bp, C. familiaris
tgggagtggggagcag

SEQ ID NO: 330428 - DNA, 16 bp, C. familiaris
tgggagttcatcaaga

SEQ ID NO: 330429 - DNA, 16 bp, C. familiaris
tgggatataattcaca

SEQ ID NO: 330430 - DNA, 16 bp, C. familiaris
tgggatcacatcctgg

SEQ ID NO: 330431 - DNA, 16 bp, C. familiaris
tgggatcatgatccga

SEQ ID NO: 330432 - DNA, 16 bp, C. familiaris
tgggatcatgatttga

SEQ ID NO: 330433 - DNA, 16 bp, C. familiaris
tgggatccagcccctg

SEQ ID NO: 330434 - DNA, 16 bp, C. familiaris
tgggatccagtccagc

SEQ ID NO: 330435 - DNA, 16 bp, C. familiaris
tgggatctgatgctgt

SEQ ID NO: 330436 - DNA, 16 bp, C. familiaris
tgggatgaggcctgag

SEQ ID NO: 330437 - DNA, 16 bp, C. familiaris
tgggatgcctgcatgg

SEQ ID NO: 330438 - DNA, 16 bp, C. familiaris
tgggatgcctgtgtgg

SEQ ID NO: 330439 - DNA, 16 bp, C. familiaris
tgggatgctgggtggc

SEQ ID NO: 330440 - DNA, 16 bp, C. familiaris
tgggatgtctgcttct

SEQ ID NO: 330441 - DNA, 16 bp, C. familiaris
tgggattaatgtcctt

SEQ ID NO: 330442 - DNA, 16 bp, C. familiaris
tgggattcagcaaaag

SEQ ID NO: 330443 - DNA, 16 bp, C. familiaris
tgggattgacttctta

SEQ ID NO: 330444 - DNA, 16 bp, C. familiaris
tgggattgagccctga

SEQ ID NO: 330445 - DNA, 16 bp, C. familiaris
tgggattgctgagtca

SEQ ID NO: 330446 - DNA, 16 bp, C. familiaris
tgggatttattcctgg

SEQ ID NO: 330447 - DNA, 16 bp, C. familiaris
tgggatttgaacccca

SEQ ID NO: 330448 - DNA, 16 bp, C. familiaris
tgggatttgaattcag

SEQ ID NO: 330449 - DNA, 16 bp, C. familiaris
tgggcaaaatgggcaa

SEQ ID NO: 330450 - DNA, 16 bp, C. familiaris
tgggcaagtcacttac

SEQ ID NO: 330451 - DNA, 16 bp, C. familiaris
tgggcaagtcactttc

SEQ ID NO: 330452 - DNA, 16 bp, C. familiaris
tgggcaatgtctggag

SEQ ID NO: 330453 - DNA, 16 bp, C. familiaris
tgggcacctggaagct

SEQ ID NO: 330454 - DNA, 16 bp, C. familiaris
tgggcacctgtgtggc

SEQ ID NO: 330455 - DNA, 16 bp, C. familiaris
tgggcactgaggaagg

SEQ ID NO: 330456 - DNA, 16 bp, C. familiaris
tgggcactgagggtgg

SEQ ID NO: 330457 - DNA, 16 bp, C. familiaris
tgggcagaaactgggg

SEQ ID NO: 330458 - DNA, 16 bp, C. familiaris
tgggcagaagacctga

SEQ ID NO: 330459 - DNA, 16 bp, C. familiaris
tgggcagaagggaggc

SEQ ID NO: 330460 - DNA, 16 bp, C. familiaris
tgggcagccccgtggc

SEQ ID NO: 330461 - DNA, 16 bp, C. familiaris
tgggcagccctggtgg

SEQ ID NO: 330462 - DNA, 16 bp, C. familiaris
tgggcagccgggtggc

SEQ ID NO: 330463 - DNA, 16 bp, C. familiaris
tgggcagctgggtggc

SEQ ID NO: 330464 - DNA, 16 bp, C. familiaris
tgggcaggaggaggag

SEQ ID NO: 330465 - DNA, 16 bp, C. familiaris
tgggcagggcctgcag

SEQ ID NO: 330466 - DNA, 16 bp, C. familiaris
tgggcagtggcagtga

SEQ ID NO: 330467 - DNA, 16 bp, C. familiaris
tgggcatcaaaagaaa

SEQ ID NO: 330468 - DNA, 16 bp, C. familiaris
tgggcatctgggctct

SEQ ID NO: 330469 - DNA, 16 bp, C. familiaris
tgggcatctgggtggc

SEQ ID NO: 330470 - DNA, 16 bp, C. familiaris
tgggcatggaggctgc

SEQ ID NO: 330471 - DNA, 16 bp, C. familiaris
tgggccaccgaggctg

SEQ ID NO: 330472 - DNA, 16 bp, C. familiaris
tgggccaggccctggg

SEQ ID NO: 330473 - DNA, 16 bp, C. familiaris
tgggccagggccaggg

SEQ ID NO: 330474 - DNA, 16 bp, C. familiaris
tgggccatgggggctg

SEQ ID NO: 330475 - DNA, 16 bp, C. familiaris
tgggcccctgggtggc

SEQ ID NO: 330476 - DNA, 16 bp, C. familiaris
tgggccctctgctcag

SEQ ID NO: 330477 - DNA, 16 bp, C. familiaris
tgggccctgggctgaa

SEQ ID NO: 330478 - DNA, 16 bp, C. familiaris
tgggcgcctggctggc

SEQ ID NO: 330479 - DNA, 16 bp, C. familiaris
tgggcggaaggcaggc

SEQ ID NO: 330480 - DNA, 16 bp, C. familiaris
tgggcggcagctccgc

SEQ ID NO: 330481 - DNA, 16 bp, C. familiaris
tgggcggcggctccgc

SEQ ID NO: 330482 - DNA, 16 bp, C. familiaris
tgggctaaaggcagcg

SEQ ID NO: 330483 - DNA, 16 bp, C. familiaris
tgggctcaatctcaca

SEQ ID NO: 330484 - DNA, 16 bp, C. familiaris
tgggctcagcggggag

SEQ ID NO: 330485 - DNA, 16 bp, C. familiaris
tgggctcagggctcag

SEQ ID NO: 330486 - DNA, 16 bp, C. familiaris
tgggctcaggtagtga

SEQ ID NO: 330487 - DNA, 16 bp, C. familiaris
tgggctccacacaggg

SEQ ID NO: 330488 - DNA, 16 bp, C. familiaris
tgggctccaccctgag

SEQ ID NO: 330489 - DNA, 16 bp, C. familiaris
tgggctccaggctcag

SEQ ID NO: 330490 - DNA, 16 bp, C. familiaris
tgggctccagggcctg

SEQ ID NO: 330491 - DNA, 16 bp, C. familiaris
tgggctccatgctgga

SEQ ID NO: 330492 - DNA, 16 bp, C. familiaris
tgggctccattctggg

SEQ ID NO: 330493 - DNA, 16 bp, C. familiaris
tgggctccccacaagg

SEQ ID NO: 330494 - DNA, 16 bp, C. familiaris
tgggctccccccaggg

SEQ ID NO: 330495 - DNA, 16 bp, C. familiaris
tgggctccccgctcag

SEQ ID NO: 330496 - DNA, 16 bp, C. familiaris
tgggctcccgggcctg

SEQ ID NO: 330497 - DNA, 16 bp, C. familiaris
tgggctccctgctcct

SEQ ID NO: 330498 - DNA, 16 bp, C. familiaris
tgggctccctgggtgg

SEQ ID NO: 330499 - DNA, 16 bp, C. familiaris
tgggctccctgtgcag

SEQ ID NO: 330500 - DNA, 16 bp, C. familiaris
tgggctcctcactggg

SEQ ID NO: 330501 - DNA, 16 bp, C. familiaris
tgggctccttgcccag

SEQ ID NO: 330502 - DNA, 16 bp, C. familiaris
tgggctccttgcggga

SEQ ID NO: 330503 - DNA, 16 bp, C. familiaris
tgggctctcagttctg

SEQ ID NO: 330504 - DNA, 16 bp, C. familiaris
tgggctctgagctgag

SEQ ID NO: 330505 - DNA, 16 bp, C. familiaris
tgggctctgggctctg

SEQ ID NO: 330506 - DNA, 16 bp, C. familiaris
tgggctctgggctggg

SEQ ID NO: 330507 - DNA, 16 bp, C. familiaris
tgggctctgtcctggg

SEQ ID NO: 330508 - DNA, 16 bp, C. familiaris
tgggctctgtgcccag

SEQ ID NO: 330509 - DNA, 16 bp, C. familiaris
tgggctctgtgctgag

SEQ ID NO: 330510 - DNA, 16 bp, C. familiaris
tgggctgaaggcagtc

SEQ ID NO: 330511 - DNA, 16 bp, C. familiaris
tgggctgaagtcagca

SEQ ID NO: 330512 - DNA, 16 bp, C. familiaris
tgggctgcaggctgca

SEQ ID NO: 330513 - DNA, 16 bp, C. familiaris
tgggctgcaggctgtg

SEQ ID NO: 330514 - DNA, 16 bp, C. familiaris
tgggctgcaggtggtg

SEQ ID NO: 330515 - DNA, 16 bp, C. familiaris
tgggctgcccctgttt

SEQ ID NO: 330516 - DNA, 16 bp, C. familiaris
tgggctgcttctccct

SEQ ID NO: 330517 - DNA, 16 bp, C. familiaris
tgggctgggctctggg

SEQ ID NO: 330518 - DNA, 16 bp, C. familiaris
tgggctggggccctgg

SEQ ID NO: 330519 - DNA, 16 bp, C. familiaris
tgggcttcacactggg

SEQ ID NO: 330520 - DNA, 16 bp, C. familiaris
tgggcttcatcaaaat

SEQ ID NO: 330521 - DNA, 16 bp, C. familiaris
tgggcttcctgcatga

SEQ ID NO: 330522 - DNA, 16 bp, C. familiaris
tgggcttcctgcatgg

SEQ ID NO: 330523 - DNA, 16 bp, C. familiaris
tgggcttcctgctcag

SEQ ID NO: 330524 - DNA, 16 bp, C. familiaris
tggggaaaaattagaa

SEQ ID NO: 330525 - DNA, 16 bp, C. familiaris
tggggaaaagacaatc

SEQ ID NO: 330526 - DNA, 16 bp, C. familiaris
tggggaaaccaaggcc

SEQ ID NO: 330527 - DNA, 16 bp, C. familiaris
tggggaaactgaggca

SEQ ID NO: 330528 - DNA, 16 bp, C. familiaris
tggggaagacagacaa

SEQ ID NO: 330529 - DNA, 16 bp, C. familiaris
tggggaagagcagaga

SEQ ID NO: 330530 - DNA, 16 bp, C. familiaris
tggggaagagcagagg

SEQ ID NO: 330531 - DNA, 16 bp, C. familiaris
tggggaagccagctgc

SEQ ID NO: 330532 - DNA, 16 bp, C. familiaris
tggggaagctgaggca

SEQ ID NO: 330533 - DNA, 16 bp, C. familiaris
tggggaagctgaggcc

SEQ ID NO: 330534 - DNA, 16 bp, C. familiaris
tggggacaactgggtg

SEQ ID NO: 330535 - DNA, 16 bp, C. familiaris
tggggacagaggaggg

SEQ ID NO: 330536 - DNA, 16 bp, C. familiaris
tggggacagggacagg

SEQ ID NO: 330537 - DNA, 16 bp, C. familiaris
tggggacccccccccc

SEQ ID NO: 330538 - DNA, 16 bp, C. familiaris
tggggacccggggtcg

SEQ ID NO: 330539 - DNA, 16 bp, C. familiaris
tggggagaagcagagg

SEQ ID NO: 330540 - DNA, 16 bp, C. familiaris
tggggagaaggcagag

SEQ ID NO: 330541 - DNA, 16 bp, C. familiaris
tggggagacacaattc

SEQ ID NO: 330542 - DNA, 16 bp, C. familiaris
tggggagactgtttct

SEQ ID NO: 330543 - DNA, 16 bp, C. familiaris
tggggagagacagagg

SEQ ID NO: 330544 - DNA, 16 bp, C. familiaris
tggggagcagaggagg

SEQ ID NO: 330545 - DNA, 16 bp, C. familiaris
tggggagcagctgggg

SEQ ID NO: 330546 - DNA, 16 bp, C. familiaris
tggggagcattttctc

SEQ ID NO: 330547 - DNA, 16 bp, C. familiaris
tggggagcccaatggg

SEQ ID NO: 330548 - DNA, 16 bp, C. familiaris
tggggagcccgacaca

SEQ ID NO: 330549 - DNA, 16 bp, C. familiaris
tggggagcctgcttct

SEQ ID NO: 330550 - DNA, 16 bp, C. familiaris
tggggagcctggctgg

SEQ ID NO: 330551 - DNA, 16 bp, C. familiaris
tggggagctcagtggt

SEQ ID NO: 330552 - DNA, 16 bp, C. familiaris
tggggagctgctcagc

SEQ ID NO: 330553 - DNA, 16 bp, C. familiaris
tggggagcttctccct

SEQ ID NO: 330554 - DNA, 16 bp, C. familiaris
tggggaggaaggcagg

SEQ ID NO: 330555 - DNA, 16 bp, C. familiaris
tggggaggagaagcag

SEQ ID NO: 330556 - DNA, 16 bp, C. familiaris
tggggaggagcagaag

SEQ ID NO: 330557 - DNA, 16 bp, C. familiaris
tggggaggaggaggca

SEQ ID NO: 330558 - DNA, 16 bp, C. familiaris
tggggaggatatggag

SEQ ID NO: 330559 - DNA, 16 bp, C. familiaris
tggggagggagaagca

SEQ ID NO: 330560 - DNA, 16 bp, C. familiaris
tggggagtccaatgtg

SEQ ID NO: 330561 - DNA, 16 bp, C. familiaris
tggggagttggagcag

SEQ ID NO: 330562 - DNA, 16 bp, C. familiaris
tggggagtttttaaaa

SEQ ID NO: 330563 - DNA, 16 bp, C. familiaris
tggggattaaggagca

SEQ ID NO: 330564 - DNA, 20 bp, C. familiaris
tggggatttaccccaaagat

SEQ ID NO: 330565 - DNA, 16 bp, C. familiaris
tggggcaaagggagag

SEQ ID NO: 330566 - DNA, 16 bp, C. familiaris
tggggcaccggggtgg

SEQ ID NO: 330567 - DNA, 16 bp, C. familiaris
tggggcagccccagtg

SEQ ID NO: 330568 - DNA, 16 bp, C. familiaris
tggggcagcccctgtg

SEQ ID NO: 330569 - DNA, 16 bp, C. familiaris
tggggcagcttctggg

SEQ ID NO: 330570 - DNA, 16 bp, C. familiaris
tggggcagggcagagg

SEQ ID NO: 330571 - DNA, 16 bp, C. familiaris
tggggcaggggctgct

SEQ ID NO: 330572 - DNA, 16 bp, C. familiaris
tggggccagggccagg

SEQ ID NO: 330573 - DNA, 16 bp, C. familiaris
tggggcccctgctcag

SEQ ID NO: 330574 - DNA, 16 bp, C. familiaris
tggggcccctggctgg

SEQ ID NO: 330575 - DNA, 16 bp, C. familiaris
tggggccgcgcagccc

SEQ ID NO: 330576 - DNA, 16 bp, C. familiaris
tggggcctccagcctc

SEQ ID NO: 330577 - DNA, 16 bp, C. familiaris
tggggcctccaggatc

SEQ ID NO: 330578 - DNA, 16 bp, C. familiaris
tggggcctgggtggct

SEQ ID NO: 330579 - DNA, 16 bp, C. familiaris
tggggcctttgggaag

SEQ ID NO: 330580 - DNA, 16 bp, C. familiaris
tggggctcaatctcag

SEQ ID NO: 330581 - DNA, 16 bp, C. familiaris
tggggctcccagcagg

SEQ ID NO: 330582 - DNA, 16 bp, C. familiaris
tggggctccccagagg

SEQ ID NO: 330583 - DNA, 16 bp, C. familiaris
tggggctcccggtgca

SEQ ID NO: 330584 - DNA, 16 bp, C. familiaris
tggggctcctggttgg

SEQ ID NO: 330585 - DNA, 16 bp, C. familiaris
tggggctccttgtggg

SEQ ID NO: 330586 - DNA, 16 bp, C. familiaris
tggggctgaaggcagg

SEQ ID NO: 330587 - DNA, 16 bp, C. familiaris
tggggctgcccaagag

SEQ ID NO: 330588 - DNA, 16 bp, C. familiaris
tggggctgccctcttt

SEQ ID NO: 330589 - DNA, 16 bp, C. familiaris
tggggctgccctgggg

SEQ ID NO: 330590 - DNA, 16 bp, C. familiaris
tggggctgcctgggtg

SEQ ID NO: 330591 - DNA, 16 bp, C. familiaris
tggggctggagcccag

SEQ ID NO: 330592 - DNA, 16 bp, C. familiaris
tggggctggatcccag

SEQ ID NO: 330593 - DNA, 16 bp, C. familiaris
tggggctggattccag

SEQ ID NO: 330594 - DNA, 16 bp, C. familiaris
tggggctgggactggg

SEQ ID NO: 330595 - DNA, 16 bp, C. familiaris
tggggctggggctgcc

SEQ ID NO: 330596 - DNA, 16 bp, C. familiaris
tggggcttggactcat

SEQ ID NO: 330597 - DNA, 16 bp, C. familiaris
tgggggaaaaaatcca

SEQ ID NO: 330598 - DNA, 16 bp, C. familiaris
tgggggaaaggcagag

SEQ ID NO: 330599 - DNA, 16 bp, C. familiaris
tgggggaagccagctg

SEQ ID NO: 330600 - DNA, 16 bp, C. familiaris
tgggggaagggacaga

SEQ ID NO: 330601 - DNA, 16 bp, C. familiaris
tgggggacttgatccc

SEQ ID NO: 330602 - DNA, 16 bp, C. familiaris
tgggggagcctggctg

SEQ ID NO: 330603 - DNA, 16 bp, C. familiaris
tgggggagctgcccag

SEQ ID NO: 330604 - DNA, 16 bp, C. familiaris
tgggggcagaggaagg

SEQ ID NO: 330605 - DNA, 16 bp, C. familiaris
tgggggcaggaggcag

SEQ ID NO: 330606 - DNA, 16 bp, C. familiaris
tgggggcagggccagg

SEQ ID NO: 330607 - DNA, 16 bp, C. familiaris
tgggggccctgggagg

SEQ ID NO: 330608 - DNA, 16 bp, C. familiaris
tgggggctcagagagg

SEQ ID NO: 330609 - DNA, 16 bp, C. familiaris
tgggggctgccctgtg

SEQ ID NO: 330610 - DNA, 16 bp, C. familiaris
tggggggatccctgag

SEQ ID NO: 330611 - DNA, 16 bp, C. familiaris
tggggggatgcctggg

SEQ ID NO: 330612 - DNA, 16 bp, C. familiaris
tggggggcagccccgg

SEQ ID NO: 330613 - DNA, 16 bp, C. familiaris
tggggggcagcccggg

SEQ ID NO: 330614 - DNA, 16 bp, C. familiaris
tggggggcagcctggg

SEQ ID NO: 330615 - DNA, 16 bp, C. familiaris
tggggggctcagtggt

SEQ ID NO: 330616 - DNA, 16 bp, C. familiaris
tggggggctccatccc

SEQ ID NO: 330617 - DNA, 16 bp, C. familiaris
tgggggtgcagatatc

SEQ ID NO: 330618 - DNA, 16 bp, C. familiaris
tggggtatccctgggt

SEQ ID NO: 330619 - DNA, 16 bp, C. familiaris
tggggtcatgacctga

SEQ ID NO: 330620 - DNA, 16 bp, C. familiaris
tggggtccagccccac

SEQ ID NO: 330621 - DNA, 16 bp, C. familiaris
tggggtttttttcccc

SEQ ID NO: 330622 - DNA, 16 bp, C. familiaris
tgggtatggagattac

SEQ ID NO: 330623 - DNA, 23 bp, C. familiaris
tgggtcacaaatcgggtctgaac

SEQ ID NO: 330624 - DNA, 16 bp, C. familiaris
tgggtcagaaattcag

SEQ ID NO: 330625 - DNA, 16 bp, C. familiaris
tgggtcagagaagaaa

SEQ ID NO: 330626 - DNA, 16 bp, C. familiaris
tgggtccatttctggg

SEQ ID NO: 330627 - DNA, 16 bp, C. familiaris
tgggtctctctctctc

SEQ ID NO: 330628 - DNA, 16 bp, C. familiaris
tgggtgactcaggggt

SEQ ID NO: 330629 - DNA, 16 bp, C. familiaris
tgggtgcctggtggct

SEQ ID NO: 330630 - DNA, 16 bp, C. familiaris
tgggtgccttaaacaa

SEQ ID NO: 330631 - DNA, 16 bp, C. familiaris
tgggtgctcaaccaac

SEQ ID NO: 330632 - DNA, 16 bp, C. familiaris
tgggtggaaggcggtg

SEQ ID NO: 330633 - DNA, 16 bp, C. familiaris
tgggtggcacagtagg

SEQ ID NO: 330634 - DNA, 16 bp, C. familiaris
tgggtggcacagtcaa

SEQ ID NO: 330635 - DNA, 16 bp, C. familiaris
tgggtggctcagatgg

SEQ ID NO: 330636 - DNA, 16 bp, C. familiaris
tgggtggctcagctgc

SEQ ID NO: 330637 - DNA, 16 bp, C. familiaris
tgggtggctcagctgg

SEQ ID NO: 330638 - DNA, 16 bp, C. familiaris
tgggtggctccagtgg

SEQ ID NO: 330639 - DNA, 16 bp, C. familiaris
tgggtggtcagtggtt

SEQ ID NO: 330640 - DNA, 16 bp, C. familiaris
tgggtggtgagatcaa

SEQ ID NO: 330641 - DNA, 16 bp, C. familiaris
tgggtgtagagattat

SEQ ID NO: 330642 - DNA, 16 bp, C. familiaris
tgggttcaagccctgc

SEQ ID NO: 330643 - DNA, 16 bp, C. familiaris
tgggttcaagtcccat

SEQ ID NO: 330644 - DNA, 16 bp, C. familiaris
tgggttcatttttctt

SEQ ID NO: 330645 - DNA, 16 bp, C. familiaris
tgggttccctgcgggg

SEQ ID NO: 330646 - DNA, 16 bp, C. familiaris
tgggtttggggaagga

SEQ ID NO: 330647 - DNA, 16 bp, C. familiaris
tgggttttgtttttca

SEQ ID NO: 330648 - DNA, 16 bp, C. familiaris
tggtaaaaagctgaaa

SEQ ID NO: 330649 - DNA, 16 bp, C. familiaris
tggtaaacattttgca

SEQ ID NO: 330650 - DNA, 16 bp, C. familiaris
tggtaaccacaaaaca

SEQ ID NO: 330651 - DNA, 16 bp, C. familiaris
tggtaatcattccaca

SEQ ID NO: 330652 - DNA, 16 bp, C. familiaris
tggtaatggtggtggt

SEQ ID NO: 330653 - DNA, 16 bp, C. familiaris
tggtactggcagaaaa

SEQ ID NO: 330654 - DNA, 16 bp, C. familiaris
tggtactttgtgatgg

SEQ ID NO: 330655 - DNA, 16 bp, C. familiaris
tggtagaatttacctg

SEQ ID NO: 330656 - DNA, 16 bp, C. familiaris
tggtaggtattcatct

SEQ ID NO: 330657 - DNA, 16 bp, C. familiaris
tggtatagtcactgtg

SEQ ID NO: 330658 - DNA, 16 bp, C. familiaris
tggtatataaatataa

SEQ ID NO: 330659 - DNA, 16 bp, C. familiaris
tggtatttacccaaga

SEQ ID NO: 330660 - DNA, 16 bp, C. familiaris
tggtatttgactttct

SEQ ID NO: 330661 - DNA, 16 bp, C. familiaris
tggtcaaaaacaagtt

SEQ ID NO: 330662 - DNA, 16 bp, C. familiaris
tggtcaatggtggggc

SEQ ID NO: 330663 - DNA, 16 bp, C. familiaris
tggtcaccagagagga

SEQ ID NO: 330664 - DNA, 16 bp, C. familiaris
tggtcaccagggctgc

SEQ ID NO: 330665 - DNA, 16 bp, C. familiaris
tggtcatggtgtatga

SEQ ID NO: 330666 - DNA, 16 bp, C. familiaris
tggtcatttctttagg

SEQ ID NO: 330667 - DNA, 16 bp, C. familiaris
tggtccacagaccagc

SEQ ID NO: 330668 - DNA, 16 bp, C. familiaris
tggtccccaggtcctg

SEQ ID NO: 330669 - DNA, 16 bp, C. familiaris
tggtcccggggtcctg

SEQ ID NO: 330670 - DNA, 16 bp, C. familiaris
tggtcctctctctctc

SEQ ID NO: 330671 - DNA, 16 bp, C. familiaris
tggtcctggggtccta

SEQ ID NO: 330672 - DNA, 16 bp, C. familiaris
tggtctgttcatattt

SEQ ID NO: 330673 - DNA, 16 bp, C. familiaris
tggtcttcctgcttct

SEQ ID NO: 330674 - DNA, 16 bp, C. familiaris
tggtcttctctctctc

SEQ ID NO: 330675 - DNA, 16 bp, C. familiaris
tggtgaagatgtagaa

SEQ ID NO: 330676 - DNA, 16 bp, C. familiaris
tggtgaagccactgtg

SEQ ID NO: 330677 - DNA, 16 bp, C. familiaris
tggtgacagatggcaa

SEQ ID NO: 330678 - DNA, 16 bp, C. familiaris
tggtgacctgtgatca

SEQ ID NO: 330679 - DNA, 16 bp, C. familiaris
tggtgagaatatttaa

SEQ ID NO: 330680 - DNA, 16 bp, C. familiaris
tggtgagaatgtgaaa

SEQ ID NO: 330681 - DNA, 16 bp, C. familiaris
tggtgagagagagtgg

SEQ ID NO: 330682 - DNA, 16 bp, C. familiaris
tggtgagcacagagcc

SEQ ID NO: 330683 - DNA, 16 bp, C. familiaris
tggtgaggtgtctgtt

SEQ ID NO: 330684 - DNA, 16 bp, C. familiaris
tggtgatcccagagtc

SEQ ID NO: 330685 - DNA, 16 bp, C. familiaris
tggtgatgatgatgat

SEQ ID NO: 330686 - DNA, 16 bp, C. familiaris
tggtgatgatgatgtt

SEQ ID NO: 330687 - DNA, 16 bp, C. familiaris
tggtgatgatggtgat

SEQ ID NO: 330688 - DNA, 16 bp, C. familiaris
tggtgatggtgatggt

SEQ ID NO: 330689 - DNA, 16 bp, C. familiaris
tggtgatggtgctggt

SEQ ID NO: 330690 - DNA, 16 bp, C. familiaris
tggtgatggtggcagt

SEQ ID NO: 330691 - DNA, 16 bp, C. familiaris
tggtgatggttgcaca

SEQ ID NO: 330692 - DNA, 16 bp, C. familiaris
tggtgcagccaccctg

SEQ ID NO: 330693 - DNA, 16 bp, C. familiaris
tggtgcagccactgag

SEQ ID NO: 330694 - DNA, 16 bp, C. familiaris
tggtgcagctcctgct

SEQ ID NO: 330695 - DNA, 16 bp, C. familiaris
tggtgcagctgctgtg

SEQ ID NO: 330696 - DNA, 16 bp, C. familiaris
tggtgcagttggttaa

SEQ ID NO: 330697 - DNA, 16 bp, C. familiaris
tggtgcctgcctttga

SEQ ID NO: 330698 - DNA, 16 bp, C. familiaris
tggtgctaatgtaaat

SEQ ID NO: 330699 - DNA, 16 bp, C. familiaris
tggtgctccatcccag

SEQ ID NO: 330700 - DNA, 16 bp, C. familiaris
tggtgctgctgctgct

SEQ ID NO: 330701 - DNA, 16 bp, C. familiaris
tggtgctgctggtgct

SEQ ID NO: 330702 - DNA, 16 bp, C. familiaris
tggtgctggaaaaact

SEQ ID NO: 330703 - DNA, 16 bp, C. familiaris
tggtgctgggaaaaca

SEQ ID NO: 330704 - DNA, 16 bp, C. familiaris
tggtggaaaacagtat

SEQ ID NO: 330705 - DNA, 16 bp, C. familiaris
tggtggaaagggaagt

SEQ ID NO: 330706 - DNA, 16 bp, C. familiaris
tggtggaaatgtaaaa

SEQ ID NO: 330707 - DNA, 16 bp, C. familiaris
tggtggagagcctgct

SEQ ID NO: 330708 - DNA, 16 bp, C. familiaris
tggtggagcacctgcc

SEQ ID NO: 330709 - DNA, 16 bp, C. familiaris
tggtggagcctgcttc

SEQ ID NO: 330710 - DNA, 16 bp, C. familiaris
tggtggaggaggggca

SEQ ID NO: 330711 - DNA, 16 bp, C. familiaris
tggtggcagtggtggc

SEQ ID NO: 330712 - DNA, 16 bp, C. familiaris
tggtgggaatatgaaa

SEQ ID NO: 330713 - DNA, 16 bp, C. familiaris
tggtgggagggacaga

SEQ ID NO: 330714 - DNA, 16 bp, C. familiaris
tggtgggagtgtaaat

SEQ ID NO: 330715 - DNA, 16 bp, C. familiaris
tggtggggagaagcag

SEQ ID NO: 330716 - DNA, 16 bp, C. familiaris
tggtggggcacctggg

SEQ ID NO: 330717 - DNA, 16 bp, C. familiaris
tggtggtaatggtgat

SEQ ID NO: 330718 - DNA, 16 bp, C. familiaris
tggtggtccaggaggc

SEQ ID NO: 330719 - DNA, 16 bp, C. familiaris
tggtggtgatgatgac

SEQ ID NO: 330720 - DNA, 16 bp, C. familiaris
tggtggtgatgatggt

SEQ ID NO: 330721 - DNA, 16 bp, C. familiaris
tggtggtgatggctgc

SEQ ID NO: 330722 - DNA, 16 bp, C. familiaris
tggtggtgatggtttc

SEQ ID NO: 330723 - DNA, 16 bp, C. familiaris
tggtggtgctgctggt

SEQ ID NO: 330724 - DNA, 16 bp, C. familiaris
tggtggtggcagtggc

SEQ ID NO: 330725 - DNA, 16 bp, C. familiaris
tggtggtggcagtggg

SEQ ID NO: 330726 - DNA, 16 bp, C. familiaris
tggtggtgggaatgta

SEQ ID NO: 330727 - DNA, 16 bp, C. familiaris
tggtggtggtgaagaa

SEQ ID NO: 330728 - DNA, 16 bp, C. familiaris
tggtggtggtggttac

SEQ ID NO: 330729 - DNA, 16 bp, C. familiaris
tggtggtgtcagtgtt

SEQ ID NO: 330730 - DNA, 16 bp, C. familiaris
tggtggttaccaaagg

SEQ ID NO: 330731 - DNA, 16 bp, C. familiaris
tggtggttctattttt

SEQ ID NO: 330732 - DNA, 16 bp, C. familiaris
tggtggttctggaaaa

SEQ ID NO: 330733 - DNA, 16 bp, C. familiaris
tggtgtaagttccagt

SEQ ID NO: 330734 - DNA, 16 bp, C. familiaris
tggtgtagccattgtg

SEQ ID NO: 330735 - DNA, 16 bp, C. familiaris
tggtgtccttgtctgg

SEQ ID NO: 330736 - DNA, 16 bp, C. familiaris
tggtgtctcttcttct

SEQ ID NO: 330737 - DNA, 16 bp, C. familiaris
tggtgtggccactctg

SEQ ID NO: 330738 - DNA, 16 bp, C. familiaris
tggtgttgatagtgat

SEQ ID NO: 330739 - DNA, 16 bp, C. familiaris
tggtgttggggaaatt

SEQ ID NO: 330740 - DNA, 16 bp, C. familiaris
tggttaaccatctgcc

SEQ ID NO: 330741 - DNA, 16 bp, C. familiaris
tggttaaggtggtgtc

SEQ ID NO: 330742 - DNA, 16 bp, C. familiaris
tggttagtgatattga

SEQ ID NO: 330743 - DNA, 16 bp, C. familiaris
tggttcaaagaagaaa

SEQ ID NO: 330744 - DNA, 16 bp, C. familiaris
tggttcagtgcctgcc

SEQ ID NO: 330745 - DNA, 16 bp, C. familiaris
tggttcagtttcattc

SEQ ID NO: 330746 - DNA, 16 bp, C. familiaris
tggttctcaaagtgtg

SEQ ID NO: 330747 - DNA, 16 bp, C. familiaris
tggttctccatccctt

SEQ ID NO: 330748 - DNA, 16 bp, C. familiaris
tggttctgggaaaact

SEQ ID NO: 330749 - DNA, 16 bp, C. familiaris
tggttcttggtatgac

SEQ ID NO: 330750 - DNA, 16 bp, C. familiaris
tggttgtgtctgactc

SEQ ID NO: 330751 - DNA, 16 bp, C. familiaris
tggttgttcctcctgg

SEQ ID NO: 330752 - DNA, 16 bp, C. familiaris
tggttgtttcctgcct

SEQ ID NO: 330753 - DNA, 16 bp, C. familiaris
tggtttaaaaaaatat

SEQ ID NO: 330754 - DNA, 16 bp, C. familiaris
tggtttaaaagaaaaa

SEQ ID NO: 330755 - DNA, 16 bp, C. familiaris
tggtttacccattcat

SEQ ID NO: 330756 - DNA, 16 bp, C. familiaris
tggtttcatcttattt

SEQ ID NO: 330757 - DNA, 16 bp, C. familiaris
tggtttccttggctgt

SEQ ID NO: 330758 - DNA, 16 bp, C. familiaris
tggtttctacattttt

SEQ ID NO: 330759 - DNA, 16 bp, C. familiaris
tggtttctcctgaggc

SEQ ID NO: 330760 - DNA, 16 bp, C. familiaris
tggtttgcttcccttt

SEQ ID NO: 330761 - DNA, 16 bp, C. familiaris
tggtttggtgccacct

SEQ ID NO: 330762 - DNA, 16 bp, C. familiaris
tggttttaaaacaaaa

SEQ ID NO: 330763 - DNA, 16 bp, C. familiaris
tggttttaatgtgcat

SEQ ID NO: 330764 - DNA, 16 bp, C. familiaris
tggttttagctcagat

SEQ ID NO: 330765 - DNA, 16 bp, C. familiaris
tggttttattaaaaaa

SEQ ID NO: 330766 - DNA, 16 bp, C. familiaris
tggttttctttttcag

SEQ ID NO: 330767 - DNA, 16 bp, C. familiaris
tggttttgatatgtat

SEQ ID NO: 330768 - DNA, 16 bp, C. familiaris
tggttttgattgcatt

SEQ ID NO: 330769 - DNA, 16 bp, C. familiaris
tgtaaaaacaaaatga

SEQ ID NO: 330770 - DNA, 16 bp, C. familiaris
tgtaaaagaaagaggg

SEQ ID NO: 330771 - DNA, 16 bp, C. familiaris
tgtaaaatgggggaaa

SEQ ID NO: 330772 - DNA, 16 bp, C. familiaris
tgtaaataaaattttg

SEQ ID NO: 330773 - DNA, 16 bp, C. familiaris
tgtaaataaagttgta

SEQ ID NO: 330774 - DNA, 16 bp, C. familiaris
tgtaaatatttgtgaa

SEQ ID NO: 330775 - DNA, 16 bp, C. familiaris
tgtaaatgaactaaat

SEQ ID NO: 330776 - DNA, 16 bp, C. familiaris
tgtaaatggaattata

SEQ ID NO: 330777 - DNA, 16 bp, C. familiaris
tgtaaatggattaaat

SEQ ID NO: 330778 - DNA, 16 bp, C. familiaris
tgtaaatggtagatat

SEQ ID NO: 330779 - DNA, 16 bp, C. familiaris
tgtaaattttacctca

SEQ ID NO: 330780 - DNA, 16 bp, C. familiaris
tgtaacaaaatactac

SEQ ID NO: 330781 - DNA, 16 bp, C. familiaris
tgtaacattaaaaaaa

SEQ ID NO: 330782 - DNA, 16 bp, C. familiaris
tgtaactctgtggaag

SEQ ID NO: 330783 - DNA, 16 bp, C. familiaris
tgtaacttttaaaatt

SEQ ID NO: 330784 - DNA, 16 bp, C. familiaris
tgtaagtctaaaatta

SEQ ID NO: 330785 - DNA, 16 bp, C. familiaris
tgtaataaaacttgaa

SEQ ID NO: 330786 - DNA, 16 bp, C. familiaris
tgtaatattgttttca

SEQ ID NO: 330787 - DNA, 16 bp, C. familiaris
tgtaatcatgtttttg

SEQ ID NO: 330788 - DNA, 16 bp, C. familiaris
tgtaattcctatcaaa

SEQ ID NO: 330789 - DNA, 16 bp, C. familiaris
tgtaattgttgaatca

SEQ ID NO: 330790 - DNA, 16 bp, C. familiaris
tgtaatttatttccct

SEQ ID NO: 330791 - DNA, 16 bp, C. familiaris
tgtacaaaatgaaaga

SEQ ID NO: 330792 - DNA, 16 bp, C. familiaris
tgtacaacagtgtgaa

SEQ ID NO: 330793 - DNA, 16 bp, C. familiaris
tgtacacagcaaatag

SEQ ID NO: 330794 - DNA, 16 bp, C. familiaris
tgtacacatacacatt

SEQ ID NO: 330795 - DNA, 16 bp, C. familiaris
tgtacacatgtgcaca

SEQ ID NO: 330796 - DNA, 16 bp, C. familiaris
tgtacactgaaaactg

SEQ ID NO: 330797 - DNA, 16 bp, C. familiaris
tgtacacttaaaatgg

SEQ ID NO: 330798 - DNA, 16 bp, C. familiaris
tgtacagaaaattcaa

SEQ ID NO: 330799 - DNA, 16 bp, C. familiaris
tgtacagaaatctatt

SEQ ID NO: 330800 - DNA, 16 bp, C. familiaris
tgtacagaaccacaaa

SEQ ID NO: 330801 - DNA, 16 bp, C. familiaris
tgtacagaagtttttt

SEQ ID NO: 330802 - DNA, 16 bp, C. familiaris
tgtacagcaaagaaaa

SEQ ID NO: 330803 - DNA, 16 bp, C. familiaris
tgtacatatatacaca

SEQ ID NO: 330804 - DNA, 16 bp, C. familiaris
tgtacatatattttat

SEQ ID NO: 330805 - DNA, 16 bp, C. familiaris
tgtacatatgtatttt

SEQ ID NO: 330806 - DNA, 16 bp, C. familiaris
tgtacatatttttctt

SEQ ID NO: 330807 - DNA, 16 bp, C. familiaris
tgtacatgtgtacata

SEQ ID NO: 330808 - DNA, 16 bp, C. familiaris
tgtacattttaatttt

SEQ ID NO: 330809 - DNA, 16 bp, C. familiaris
tgtaccattttacagt

SEQ ID NO: 330810 - DNA, 16 bp, C. familiaris
tgtacctcttgatccc

SEQ ID NO: 330811 - DNA, 16 bp, C. familiaris
tgtacctgggggagat

SEQ ID NO: 330812 - DNA, 16 bp, C. familiaris
tgtacctgggggagct

SEQ ID NO: 330813 - DNA, 16 bp, C. familiaris
tgtactcttcatcccc

SEQ ID NO: 330814 - DNA, 16 bp, C. familiaris
tgtactggaaaaaagg

SEQ ID NO: 330815 - DNA, 16 bp, C. familiaris
tgtactgtaaaaaaaa

SEQ ID NO: 330816 - DNA, 16 bp, C. familiaris
tgtactttctgctcag

SEQ ID NO: 330817 - DNA, 16 bp, C. familiaris
tgtactttttggccat

SEQ ID NO: 330818 - DNA, 16 bp, C. familiaris
tgtagaaaatatattt

SEQ ID NO: 330819 - DNA, 16 bp, C. familiaris
tgtagaagctgcagca

SEQ ID NO: 330820 - DNA, 16 bp, C. familiaris
tgtagactgctttggg

SEQ ID NO: 330821 - DNA, 16 bp, C. familiaris
tgtagagaaactggaa

SEQ ID NO: 330822 - DNA, 16 bp, C. familiaris
tgtagatgacatgatt

SEQ ID NO: 330823 - DNA, 16 bp, C. familiaris
tgtagccattctggaa

SEQ ID NO: 330824 - DNA, 16 bp, C. familiaris
tgtaggaagcctgatg

SEQ ID NO: 330825 - DNA, 16 bp, C. familiaris
tgtagggagcctgatg

SEQ ID NO: 330826 - DNA, 16 bp, C. familiaris
tgtaggttttacttgc

SEQ ID NO: 330827 - DNA, 16 bp, C. familiaris
tgtataatgacatata

SEQ ID NO: 330828 - DNA, 16 bp, C. familiaris
tgtatactttttaaaa

SEQ ID NO: 330829 - DNA, 16 bp, C. familiaris
tgtatagaaatgcaag

SEQ ID NO: 330830 - DNA, 16 bp, C. familiaris
tgtatatatatgtgaa

SEQ ID NO: 330831 - DNA, 16 bp, C. familiaris
tgtatatatttatgca

SEQ ID NO: 330832 - DNA, 16 bp, C. familiaris
tgtatatctcctttgg

SEQ ID NO: 330833 - DNA, 16 bp, C. familiaris
tgtatatgtatatata

SEQ ID NO: 330834 - DNA, 16 bp, C. familiaris
tgtatatgtgtatata

SEQ ID NO: 330835 - DNA, 16 bp, C. familiaris
tgtatattgtgtatat

SEQ ID NO: 330836 - DNA, 16 bp, C. familiaris
tgtatattttacattt

SEQ ID NO: 330837 - DNA, 16 bp, C. familiaris
tgtatatttttacata

SEQ ID NO: 330838 - DNA, 16 bp, C. familiaris
tgtatcacattgattg

SEQ ID NO: 330839 - DNA, 16 bp, C. familiaris
tgtatcagaatttctt

SEQ ID NO: 330840 - DNA, 16 bp, C. familiaris
tgtatcatatatacat

SEQ ID NO: 330841 - DNA, 16 bp, C. familiaris
tgtatcctgcaaattt

SEQ ID NO: 330842 - DNA, 16 bp, C. familiaris
tgtatcctgcagcttt

SEQ ID NO: 330843 - DNA, 16 bp, C. familiaris
tgtatgaatgaaacca

SEQ ID NO: 330844 - DNA, 16 bp, C. familiaris
tgtatggaactagaaa

SEQ ID NO: 330845 - DNA, 16 bp, C. familiaris
tgtatgtatatgtgtg

SEQ ID NO: 330846 - DNA, 16 bp, C. familiaris
tgtatgtatgagtgtg

SEQ ID NO: 330847 - DNA, 16 bp, C. familiaris
tgtatgtatgtgtgtg

SEQ ID NO: 330848 - DNA, 16 bp, C. familiaris
tgtatgtgatgaatca

SEQ ID NO: 330849 - DNA, 16 bp, C. familiaris
tgtatgtgtatatata

SEQ ID NO: 330850 - DNA, 16 bp, C. familiaris
tgtatgtgtgtttctt

SEQ ID NO: 330851 - DNA, 16 bp, C. familiaris
tgtatgttaactatgc

SEQ ID NO: 330852 - DNA, 16 bp, C. familiaris
tgtatgttaactggaa

SEQ ID NO: 330853 - DNA, 16 bp, C. familiaris
tgtatgttggcagatt

SEQ ID NO: 330854 - DNA, 16 bp, C. familiaris
tgtattaaaaataact

SEQ ID NO: 330855 - DNA, 16 bp, C. familiaris
tgtattatgagcagct

SEQ ID NO: 330856 - DNA, 16 bp, C. familiaris
tgtattctctctcttt

SEQ ID NO: 330857 - DNA, 16 bp, C. familiaris
tgtatttatatgaaaa

SEQ ID NO: 330858 - DNA, 16 bp, C. familiaris
tgtatttatttctgta

SEQ ID NO: 330859 - DNA, 16 bp, C. familiaris
tgtatttatttctgtg

SEQ ID NO: 330860 - DNA, 16 bp, C. familiaris
tgtatttctgtgatgt

SEQ ID NO: 330861 - DNA, 16 bp, C. familiaris
tgtatttcttctttgg

SEQ ID NO: 330862 - DNA, 16 bp, C. familiaris
tgtatttggagttgag

SEQ ID NO: 330863 - DNA, 16 bp, C. familiaris
tgtattttaaatttca

SEQ ID NO: 330864 - DNA, 16 bp, C. familiaris
tgtattttctacattt

SEQ ID NO: 330865 - DNA, 16 bp, C. familiaris
tgtcaaatgcttttgc

SEQ ID NO: 330866 - DNA, 16 bp, C. familiaris
tgtcaacaaaatgaaa

SEQ ID NO: 330867 - DNA, 16 bp, C. familiaris
tgtcaacaccttgatc

SEQ ID NO: 330868 - DNA, 16 bp, C. familiaris
tgtcaagatttccttc

SEQ ID NO: 330869 - DNA, 16 bp, C. familiaris
tgtcaatgttctggat

SEQ ID NO: 330870 - DNA, 16 bp, C. familiaris
tgtcaattatatccca

SEQ ID NO: 330871 - DNA, 16 bp, C. familiaris
tgtcaattttccccat

SEQ ID NO: 330872 - DNA, 16 bp, C. familiaris
tgtcaccaccatcacc

SEQ ID NO: 330873 - DNA, 16 bp, C. familiaris
tgtcaccatcaccatc

SEQ ID NO: 330874 - DNA, 16 bp, C. familiaris
tgtcaccctcactgat

SEQ ID NO: 330875 - DNA, 16 bp, C. familiaris
tgtcactcatcatcag

SEQ ID NO: 330876 - DNA, 16 bp, C. familiaris
tgtcacttctctggct

SEQ ID NO: 330877 - DNA, 16 bp, C. familiaris
tgtcagaagaaaaaaa

SEQ ID NO: 330878 - DNA, 16 bp, C. familiaris
tgtcaggctctgagct

SEQ ID NO: 330879 - DNA, 16 bp, C. familiaris
tgtcaggtctctgtgg

SEQ ID NO: 330880 - DNA, 16 bp, C. familiaris
tgtcagtggaggccca

SEQ ID NO: 330881 - DNA, 16 bp, C. familiaris
tgtcatcatcatcatc

SEQ ID NO: 330882 - DNA, 16 bp, C. familiaris
tgtcatccaggctttg

SEQ ID NO: 330883 - DNA, 16 bp, C. familiaris
tgtcatctgaaaataa

SEQ ID NO: 330884 - DNA, 16 bp, C. familiaris
tgtcatctgtgaacaa

SEQ ID NO: 330885 - DNA, 16 bp, C. familiaris
tgtcattcaaagacat

SEQ ID NO: 330886 - DNA, 16 bp, C. familiaris
tgtcattttcaaatat

SEQ ID NO: 330887 - DNA, 16 bp, C. familiaris
tgtcatttttaaaaag

SEQ ID NO: 330888 - DNA, 16 bp, C. familiaris
tgtccaaggtcacatg

SEQ ID NO: 330889 - DNA, 16 bp, C. familiaris
tgtccaaggtcaccca

SEQ ID NO: 330890 - DNA, 16 bp, C. familiaris
tgtccaatctcaccac

SEQ ID NO: 330891 - DNA, 16 bp, C. familiaris
tgtccagaacagacaa

SEQ ID NO: 330892 - DNA, 16 bp, C. familiaris
tgtccagaatagacaa

SEQ ID NO: 330893 - DNA, 16 bp, C. familiaris
tgtcccagaagggcag

SEQ ID NO: 330894 - DNA, 16 bp, C. familiaris
tgtcccagtgtttcac

SEQ ID NO: 330895 - DNA, 16 bp, C. familiaris
tgtccccagacattgc

SEQ ID NO: 330896 - DNA, 16 bp, C. familiaris
tgtccccaggacaggg

SEQ ID NO: 330897 - DNA, 16 bp, C. familiaris
tgtccccatccccacc

SEQ ID NO: 330898 - DNA, 16 bp, C. familiaris
tgtcccccagcaccct

SEQ ID NO: 330899 - DNA, 16 bp, C. familiaris
tgtcccccaggggaca

SEQ ID NO: 330900 - DNA, 16 bp, C. familiaris
tgtccccgggagccca

SEQ ID NO: 330901 - DNA, 16 bp, C. familiaris
tgtcccctctcaccac

SEQ ID NO: 330902 - DNA, 16 bp, C. familiaris
tgtccctctcatgaat

SEQ ID NO: 330903 - DNA, 16 bp, C. familiaris
tgtccctctccctcag

SEQ ID NO: 330904 - DNA, 16 bp, C. familiaris
tgtccctgcccctgct

SEQ ID NO: 330905 - DNA, 16 bp, C. familiaris
tgtccctgcctctctg

SEQ ID NO: 330906 - DNA, 16 bp, C. familiaris
tgtccctgtccctgtc

SEQ ID NO: 330907 - DNA, 16 bp, C. familiaris
tgtccctttgaatcag

SEQ ID NO: 330908 - DNA, 16 bp, C. familiaris
tgtcctcaaggagctc

SEQ ID NO: 330909 - DNA, 16 bp, C. familiaris
tgtcctcaaggtccat

SEQ ID NO: 330910 - DNA, 16 bp, C. familiaris
tgtcctcaatgtcctc

SEQ ID NO: 330911 - DNA, 16 bp, C. familiaris
tgtcctcatctcctct

SEQ ID NO: 330912 - DNA, 16 bp, C. familiaris
tgtcctcccagcctcc

SEQ ID NO: 330913 - DNA, 16 bp, C. familiaris
tgtcctcccagcctct

SEQ ID NO: 330914 - DNA, 16 bp, C. familiaris
tgtcctccccaaattc

SEQ ID NO: 330915 - DNA, 16 bp, C. familiaris
tgtcctgcctctctct

SEQ ID NO: 330916 - DNA, 16 bp, C. familiaris
tgtcctggggctgctg

SEQ ID NO: 330917 - DNA, 16 bp, C. familiaris
tgtccttccccctact

SEQ ID NO: 330918 - DNA, 16 bp, C. familiaris
tgtccttgatgaagca

SEQ ID NO: 330919 - DNA, 16 bp, C. familiaris
tgtctagttttcccaa

SEQ ID NO: 330920 - DNA, 16 bp, C. familiaris
tgtctatgaatttgac

SEQ ID NO: 330921 - DNA, 16 bp, C. familiaris
tgtctatgctcagaat

SEQ ID NO: 330922 - DNA, 16 bp, C. familiaris
tgtctattgtgaataa

SEQ ID NO: 330923 - DNA, 16 bp, C. familiaris
tgtctatttctgtgct

SEQ ID NO: 330924 - DNA, 16 bp, C. familiaris
tgtctcaataaaactt

SEQ ID NO: 330925 - DNA, 16 bp, C. familiaris
tgtctcagtttcctca

SEQ ID NO: 330926 - DNA, 16 bp, C. familiaris
tgtctccgtgtctctc

SEQ ID NO: 330927 - DNA, 16 bp, C. familiaris
tgtctcctttttcatt

SEQ ID NO: 330928 - DNA, 16 bp, C. familiaris
tgtctctatgaacaaa

SEQ ID NO: 330929 - DNA, 16 bp, C. familiaris
tgtctctcaaaataaa

SEQ ID NO: 330930 - DNA, 16 bp, C. familiaris
tgtctctcatcctcct

SEQ ID NO: 330931 - DNA, 16 bp, C. familiaris
tgtctctctgcctttc

SEQ ID NO: 330932 - DNA, 16 bp, C. familiaris
tgtctctctgtctctc

SEQ ID NO: 330933 - DNA, 16 bp, C. familiaris
tgtctctctgtttctg

SEQ ID NO: 330934 - DNA, 16 bp, C. familiaris
tgtctctcttcctctg

SEQ ID NO: 330935 - DNA, 16 bp, C. familiaris
tgtctctgcacccctc

SEQ ID NO: 330936 - DNA, 16 bp, C. familiaris
tgtctctgcccccacc

SEQ ID NO: 330937 - DNA, 16 bp, C. familiaris
tgtctctgccctttct

SEQ ID NO: 330938 - DNA, 16 bp, C. familiaris
tgtctctgccttctgt

SEQ ID NO: 330939 - DNA, 16 bp, C. familiaris
tgtctctgcttttctg

SEQ ID NO: 330940 - DNA, 16 bp, C. familiaris
tgtctctgggcctcag

SEQ ID NO: 330941 - DNA, 16 bp, C. familiaris
tgtctctgtatgtctc

SEQ ID NO: 330942 - DNA, 16 bp, C. familiaris
tgtctctgtctccctc

SEQ ID NO: 330943 - DNA, 16 bp, C. familiaris
tgtctctgtctctgcc

SEQ ID NO: 330944 - DNA, 16 bp, C. familiaris
tgtctcttgctgctct

SEQ ID NO: 330945 - DNA, 16 bp, C. familiaris
tgtctctttctgtgtg

SEQ ID NO: 330946 - DNA, 16 bp, C. familiaris
tgtctcttttccagtg

SEQ ID NO: 330947 - DNA, 16 bp, C. familiaris
tgtctgaactagaatt

SEQ ID NO: 330948 - DNA, 16 bp, C. familiaris
tgtctgatgtaactat

SEQ ID NO: 330949 - DNA, 16 bp, C. familiaris
tgtctgcaagccagga

SEQ ID NO: 330950 - DNA, 16 bp, C. familiaris
tgtctggatttggaat

SEQ ID NO: 330951 - DNA, 16 bp, C. familiaris
tgtctgggtggctcca

SEQ ID NO: 330952 - DNA, 16 bp, C. familiaris
tgtctggttgctgtgg

SEQ ID NO: 330953 - DNA, 16 bp, C. familiaris
tgtctgtctctctgtg

SEQ ID NO: 330954 - DNA, 16 bp, C. familiaris
tgtctgtctgtctgct

SEQ ID NO: 330955 - DNA, 16 bp, C. familiaris
tgtctgtgcctctccc

SEQ ID NO: 330956 - DNA, 16 bp, C. familiaris
tgtctgtgctcagatt

SEQ ID NO: 330957 - DNA, 16 bp, C. familiaris
tgtctgtgtctctcct

SEQ ID NO: 330958 - DNA, 16 bp, C. familiaris
tgtctgtgtgcctgtg

SEQ ID NO: 330959 - DNA, 16 bp, C. familiaris
tgtctgtgtgtctgtc

SEQ ID NO: 330960 - DNA, 16 bp, C. familiaris
tgtctgttcaggtttt

SEQ ID NO: 330961 - DNA, 16 bp, C. familiaris
tgtctgtttctgtgtc

SEQ ID NO: 330962 - DNA, 16 bp, C. familiaris
tgtcttaatttctcct

SEQ ID NO: 330963 - DNA, 16 bp, C. familiaris
tgtcttaggaggtttt

SEQ ID NO: 330964 - DNA, 16 bp, C. familiaris
tgtcttatgcttttgg

SEQ ID NO: 330965 - DNA, 16 bp, C. familiaris
tgtcttcaaattcatt

SEQ ID NO: 330966 - DNA, 16 bp, C. familiaris
tgtcttctctggaaaa

SEQ ID NO: 330967 - DNA, 16 bp, C. familiaris
tgtcttgatgacaaca

SEQ ID NO: 330968 - DNA, 16 bp, C. familiaris
tgtcttggaagctttt

SEQ ID NO: 330969 - DNA, 16 bp, C. familiaris
tgtcttggcctctctc

SEQ ID NO: 330970 - DNA, 16 bp, C. familiaris
tgtctttcagttttgt

SEQ ID NO: 330971 - DNA, 16 bp, C. familiaris
tgtctttctcggactg

SEQ ID NO: 330972 - DNA, 16 bp, C. familiaris
tgtctttctctgatgg

SEQ ID NO: 330973 - DNA, 16 bp, C. familiaris
tgtctttgatgaataa

SEQ ID NO: 330974 - DNA, 16 bp, C. familiaris
tgtctttgcccatttc

SEQ ID NO: 330975 - DNA, 16 bp, C. familiaris
tgtctttggaaaatgt

SEQ ID NO: 330976 - DNA, 16 bp, C. familiaris
tgtctttgttttaaag

SEQ ID NO: 330977 - DNA, 16 bp, C. familiaris
tgtcttttaaaaagaa

SEQ ID NO: 330978 - DNA, 16 bp, C. familiaris
tgtcttttggccatct

SEQ ID NO: 330979 - DNA, 16 bp, C. familiaris
tgtgaaaaatgaaaat

SEQ ID NO: 330980 - DNA, 16 bp, C. familiaris
tgtgaaaaatgctgat

SEQ ID NO: 330981 - DNA, 16 bp, C. familiaris
tgtgaaaaatgttggt

SEQ ID NO: 330982 - DNA, 16 bp, C. familiaris
tgtgaaaatatctatg

SEQ ID NO: 330983 - DNA, 16 bp, C. familiaris
tgtgaaaatgaataaa

SEQ ID NO: 330984 - DNA, 16 bp, C. familiaris
tgtgaaatcagaaaag

SEQ ID NO: 330985 - DNA, 16 bp, C. familiaris
tgtgaaatggggacaa

SEQ ID NO: 330986 - DNA, 16 bp, C. familiaris
tgtgaaatgtgaaaat

SEQ ID NO: 330987 - DNA, 16 bp, C. familiaris
tgtgaacatgttttca

SEQ ID NO: 330988 - DNA, 16 bp, C. familiaris
tgtgaactatatctca

SEQ ID NO: 330989 - DNA, 16 bp, C. familiaris
tgtgaagaaatcagaa

SEQ ID NO: 330990 - DNA, 16 bp, C. familiaris
tgtgaagacagaggca

SEQ ID NO: 330991 - DNA, 16 bp, C. familiaris
tgtgaagagtctgctt

SEQ ID NO: 330992 - DNA, 16 bp, C. familiaris
tgtgaagatgtcaatg

SEQ ID NO: 330993 - DNA, 16 bp, C. familiaris
tgtgaagattaaaaga

SEQ ID NO: 330994 - DNA, 16 bp, C. familiaris
tgtgaaggaaaatgat

SEQ ID NO: 330995 - DNA, 16 bp, C. familiaris
tgtgaatacaaaggaa

SEQ ID NO: 330996 - DNA, 16 bp, C. familiaris
tgtgaatatatttaat

SEQ ID NO: 330997 - DNA, 16 bp, C. familiaris
tgtgaatctgagaaac

SEQ ID NO: 330998 - DNA, 31 bp, C. familiaris
tgtgaatggccacaactgtgaagtaaggaaa

SEQ ID NO: 330999 - DNA, 16 bp, C. familiaris
tgtgaatgtacttcat

SEQ ID NO: 331000 - DNA, 16 bp, C. familiaris
tgtgacaaccagaaat

SEQ ID NO: 331001 - DNA, 16 bp, C. familiaris
tgtgacagtcacagag

SEQ ID NO: 331002 - DNA, 16 bp, C. familiaris
tgtgacatggatggac

SEQ ID NO: 331003 - DNA, 16 bp, C. familiaris
tgtgacattcctcagg

SEQ ID NO: 331004 - DNA, 16 bp, C. familiaris
tgtgacccaggatgtg

SEQ ID NO: 331005 - DNA, 16 bp, C. familiaris
tgtgaccctgagcaag

SEQ ID NO: 331006 - DNA, 16 bp, C. familiaris
tgtgaccctggacaag

SEQ ID NO: 331007 - DNA, 16 bp, C. familiaris
tgtgacctattctgga

SEQ ID NO: 331008 - DNA, 16 bp, C. familiaris
tgtgaccttgagccag

SEQ ID NO: 331009 - DNA, 16 bp, C. familiaris
tgtgaccttgctgaac

SEQ ID NO: 331010 - DNA, 16 bp, C. familiaris
tgtgaccttgggaaag

SEQ ID NO: 331011 - DNA, 16 bp, C. familiaris
tgtgacgatcataaat

SEQ ID NO: 331012 - DNA, 16 bp, C. familiaris
tgtgacttgagccaaa

SEQ ID NO: 331013 - DNA, 16 bp, C. familiaris
tgtgactttttaaaat

SEQ ID NO: 331014 - DNA, 16 bp, C. familiaris
tgtgagaaaataaatt

SEQ ID NO: 331015 - DNA, 16 bp, C. familiaris
tgtgagaacacagtga

SEQ ID NO: 331016 - DNA, 16 bp, C. familiaris
tgtgagattcatccat

SEQ ID NO: 331017 - DNA, 16 bp, C. familiaris
tgtgagatttctcttt

SEQ ID NO: 331018 - DNA, 16 bp, C. familiaris
tgtgagctcctggagg

SEQ ID NO: 331019 - DNA, 16 bp, C. familiaris
tgtgagctccttgagg

SEQ ID NO: 331020 - DNA, 16 bp, C. familiaris
tgtgaggacacagcaa

SEQ ID NO: 331021 - DNA, 16 bp, C. familiaris
tgtgagtgtgagagag

SEQ ID NO: 331022 - DNA, 16 bp, C. familiaris
tgtgataagaacattt

SEQ ID NO: 331023 - DNA, 16 bp, C. familiaris
tgtgatgaacactggg

SEQ ID NO: 331024 - DNA, 16 bp, C. familiaris
tgtgatgaccactggg

SEQ ID NO: 331025 - DNA, 16 bp, C. familiaris
tgtgatgagcacagca

SEQ ID NO: 331026 - DNA, 16 bp, C. familiaris
tgtgatgagcacaggg

SEQ ID NO: 331027 - DNA, 16 bp, C. familiaris
tgtgatgctggagacc

SEQ ID NO: 331028 - DNA, 16 bp, C. familiaris
tgtgattttccagaaa

SEQ ID NO: 331029 - DNA, 16 bp, C. familiaris
tgtgatttttatcctt

SEQ ID NO: 331030 - DNA, 16 bp, C. familiaris
tgtgatttttctcttc

SEQ ID NO: 331031 - DNA, 16 bp, C. familiaris
tgtgatttttttccaa

SEQ ID NO: 331032 - DNA, 16 bp, C. familiaris
tgtgcaagtttttgtg

SEQ ID NO: 331033 - DNA, 16 bp, C. familiaris
tgtgcacatgtgtgag

SEQ ID NO: 331034 - DNA, 16 bp, C. familiaris
tgtgcacttcagaaga

SEQ ID NO: 331035 - DNA, 16 bp, C. familiaris
tgtgcagagcctgctt

SEQ ID NO: 331036 - DNA, 16 bp, C. familiaris
tgtgcagcagcttttt

SEQ ID NO: 331037 - DNA, 16 bp, C. familiaris
tgtgcagctgtgtgtg

SEQ ID NO: 331038 - DNA, 16 bp, C. familiaris
tgtgcaggtcagcacc

SEQ ID NO: 331039 - DNA, 16 bp, C. familiaris
tgtgcaggtgtgtgtg

SEQ ID NO: 331040 - DNA, 16 bp, C. familiaris
tgtgcatgcatgtgca

SEQ ID NO: 331041 - DNA, 16 bp, C. familiaris
tgtgcatttttctggg

SEQ ID NO: 331042 - DNA, 16 bp, C. familiaris
tgtgccaaaggcaggt

SEQ ID NO: 331043 - DNA, 16 bp, C. familiaris
tgtgccaccggagctg

SEQ ID NO: 331044 - DNA, 16 bp, C. familiaris
tgtgccagatgctgtt

SEQ ID NO: 331045 - DNA, 16 bp, C. familiaris
tgtgccagccactgtg

SEQ ID NO: 331046 - DNA, 16 bp, C. familiaris
tgtgccaggcactttg

SEQ ID NO: 331047 - DNA, 16 bp, C. familiaris
tgtgccaggccctggg

SEQ ID NO: 331048 - DNA, 16 bp, C. familiaris
tgtgccaggccctgtt

SEQ ID NO: 331049 - DNA, 16 bp, C. familiaris
tgtgccaggcgctgtt

SEQ ID NO: 331050 - DNA, 16 bp, C. familiaris
tgtgccattcaaagcc

SEQ ID NO: 331051 - DNA, 16 bp, C. familiaris
tgtgcctcagtctcct

SEQ ID NO: 331052 - DNA, 16 bp, C. familiaris
tgtgcctcctggatct

SEQ ID NO: 331053 - DNA, 16 bp, C. familiaris
tgtgcctctgcccctc

SEQ ID NO: 331054 - DNA, 16 bp, C. familiaris
tgtgcctggcttattt

SEQ ID NO: 331055 - DNA, 16 bp, C. familiaris
tgtgcctgtcacccag

SEQ ID NO: 331056 - DNA, 16 bp, C. familiaris
tgtgcctgtgcctgtg

SEQ ID NO: 331057 - DNA, 16 bp, C. familiaris
tgtgcctgtgtgtatg

SEQ ID NO: 331058 - DNA, 16 bp, C. familiaris
tgtgcgtgtgtgtctc

SEQ ID NO: 331059 - DNA, 16 bp, C. familiaris
tgtgctcaatgtggag

SEQ ID NO: 331060 - DNA, 16 bp, C. familiaris
tgtgctcactggggag

SEQ ID NO: 331061 - DNA, 16 bp, C. familiaris
tgtgctcagcatgaag

SEQ ID NO: 331062 - DNA, 16 bp, C. familiaris
tgtgctcctgggcctg

SEQ ID NO: 331063 - DNA, 16 bp, C. familiaris
tgtgctctcctgctct

SEQ ID NO: 331064 - DNA, 16 bp, C. familiaris
tgtgctctctctcact

SEQ ID NO: 331065 - DNA, 16 bp, C. familiaris
tgtgctctctctggct

SEQ ID NO: 331066 - DNA, 16 bp, C. familiaris
tgtgctctctctgtca

SEQ ID NO: 331067 - DNA, 16 bp, C. familiaris
tgtgctctgtctctct

SEQ ID NO: 331068 - DNA, 16 bp, C. familiaris
tgtgctctttgtctct

SEQ ID NO: 331069 - DNA, 16 bp, C. familiaris
tgtgctgaaggcaggc

SEQ ID NO: 331070 - DNA, 16 bp, C. familiaris
tgtgctgaatgtggag

SEQ ID NO: 331071 - DNA, 16 bp, C. familiaris
tgtgctgagagtggag

SEQ ID NO: 331072 - DNA, 16 bp, C. familiaris
tgtgctgagcaaggag

SEQ ID NO: 331073 - DNA, 16 bp, C. familiaris
tgtgctgagtgtggaa

SEQ ID NO: 331074 - DNA, 16 bp, C. familiaris
tgtgctgattcttagg

SEQ ID NO: 331075 - DNA, 16 bp, C. familiaris
tgtgctgctcctggag

SEQ ID NO: 331076 - DNA, 16 bp, C. familiaris
tgtgctgggcactgtg

SEQ ID NO: 331077 - DNA, 16 bp, C. familiaris
tgtgctgggcatggaa

SEQ ID NO: 331078 - DNA, 16 bp, C. familiaris
tgtgctgtgctgtgct

SEQ ID NO: 331079 - DNA, 16 bp, C. familiaris
tgtgctgtgtgctgtg

SEQ ID NO: 331080 - DNA, 16 bp, C. familiaris
tgtgcttcttggccat

SEQ ID NO: 331081 - DNA, 16 bp, C. familiaris
tgtgcttgagaagaat

SEQ ID NO: 331082 - DNA, 16 bp, C. familiaris
tgtgcttgtttgccat

SEQ ID NO: 331083 - DNA, 16 bp, C. familiaris
tgtgctttcttgctct

SEQ ID NO: 331084 - DNA, 16 bp, C. familiaris
tgtggaaaaaacaaaa

SEQ ID NO: 331085 - DNA, 16 bp, C. familiaris
tgtggaaaaactggaa

SEQ ID NO: 331086 - DNA, 16 bp, C. familiaris
tgtggaaaacaatttg

SEQ ID NO: 331087 - DNA, 16 bp, C. familiaris
tgtggaaaacagaatg

SEQ ID NO: 331088 - DNA, 16 bp, C. familiaris
tgtggaaaacagtagg

SEQ ID NO: 331089 - DNA, 16 bp, C. familiaris
tgtggaaaagcttttt

SEQ ID NO: 331090 - DNA, 16 bp, C. familiaris
tgtggaaactgaggca

SEQ ID NO: 331091 - DNA, 16 bp, C. familiaris
tgtggaaatttgtttt

SEQ ID NO: 331092 - DNA, 16 bp, C. familiaris
tgtggaacctgatgca

SEQ ID NO: 331093 - DNA, 16 bp, C. familiaris
tgtggaaggagaggtg

SEQ ID NO: 331094 - DNA, 16 bp, C. familiaris
tgtggaaggagcctca

SEQ ID NO: 331095 - DNA, 16 bp, C. familiaris
tgtggaatatcttttc

SEQ ID NO: 331096 - DNA, 16 bp, C. familiaris
tgtggaatttttaaaa

SEQ ID NO: 331097 - DNA, 16 bp, C. familiaris
tgtggacataaatttt

SEQ ID NO: 331098 - DNA, 16 bp, C. familiaris
tgtggacatacatttt

SEQ ID NO: 331099 - DNA, 16 bp, C. familiaris
tgtggacattgctgct

SEQ ID NO: 331100 - DNA, 16 bp, C. familiaris
tgtggacattgttgct

SEQ ID NO: 331101 - DNA, 16 bp, C. familiaris
tgtggagaaaggggaa

SEQ ID NO: 331102 - DNA, 16 bp, C. familiaris
tgtggagcaaagggaa

SEQ ID NO: 331103 - DNA, 16 bp, C. familiaris
tgtggagcaaccagaa

SEQ ID NO: 331104 - DNA, 16 bp, C. familiaris
tgtggagcaactggaa

SEQ ID NO: 331105 - DNA, 16 bp, C. familiaris
tgtggaggctcctcaa

SEQ ID NO: 331106 - DNA, 16 bp, C. familiaris
tgtggaggctgagaaa

SEQ ID NO: 331107 - DNA, 16 bp, C. familiaris
tgtggagtcagaaaag

SEQ ID NO: 331108 - DNA, 16 bp, C. familiaris
tgtggatatgtgtgtg

SEQ ID NO: 331109 - DNA, 16 bp, C. familiaris
tgtggatatgttttca

SEQ ID NO: 331110 - DNA, 16 bp, C. familiaris
tgtggatggacctaga

SEQ ID NO: 331111 - DNA, 17 bp, C. familiaris
tgtggatgtcaaggcca

SEQ ID NO: 331112 - DNA, 16 bp, C. familiaris
tgtggatgtccagttg

SEQ ID NO: 331113 - DNA, 16 bp, C. familiaris
tgtggatgtggatgtg

SEQ ID NO: 331114 - DNA, 16 bp, C. familiaris
tgtggatgttgaacca

SEQ ID NO: 331115 - DNA, 16 bp, C. familiaris
tgtggattatcttttc

SEQ ID NO: 331116 - DNA, 16 bp, C. familiaris
tgtggattcagaaaag

SEQ ID NO: 331117 - DNA, 16 bp, C. familiaris
tgtggatttctttggg

SEQ ID NO: 331118 - DNA, 16 bp, C. familiaris
tgtggcagccatcttg

SEQ ID NO: 331119 - DNA, 16 bp, C. familiaris
tgtggcaggcactgtg

SEQ ID NO: 331120 - DNA, 16 bp, C. familiaris
tgtggcaggctccctg

SEQ ID NO: 331121 - DNA, 16 bp, C. familiaris
tgtggcctcttctctg

SEQ ID NO: 331122 - DNA, 16 bp, C. familiaris
tgtggccttttcagat

SEQ ID NO: 331123 - DNA, 16 bp, C. familiaris
tgtggctgctagaaaa

SEQ ID NO: 331124 - DNA, 16 bp, C. familiaris
tgtggctggagctgag

SEQ ID NO: 331125 - DNA, 16 bp, C. familiaris
tgtggctgtggctgtg

SEQ ID NO: 331126 - DNA, 16 bp, C. familiaris
tgtgggaccccaggat

SEQ ID NO: 331127 - DNA, 16 bp, C. familiaris
tgtgggactgaatcct

SEQ ID NO: 331128 - DNA, 16 bp, C. familiaris
tgtgggcctccatccc

SEQ ID NO: 331129 - DNA, 16 bp, C. familiaris
tgtgggcttttcatat

SEQ ID NO: 331130 - DNA, 16 bp, C. familiaris
tgtggggaaaagagaa

SEQ ID NO: 331131 - DNA, 16 bp, C. familiaris
tgtggggaacctgata

SEQ ID NO: 331132 - DNA, 16 bp, C. familiaris
tgtggggaacctgctt

SEQ ID NO: 331133 - DNA, 16 bp, C. familiaris
tgtggggagctggatg

SEQ ID NO: 331134 - DNA, 16 bp, C. familiaris
tgtggggaggggcaga

SEQ ID NO: 331135 - DNA, 16 bp, C. familiaris
tgtggggcagcctggg

SEQ ID NO: 331136 - DNA, 16 bp, C. familiaris
tgtgggtgactgggtg

SEQ ID NO: 331137 - DNA, 16 bp, C. familiaris
tgtgggtgtagagatt

SEQ ID NO: 331138 - DNA, 16 bp, C. familiaris
tgtggtatttgtcttt

SEQ ID NO: 331139 - DNA, 16 bp, C. familiaris
tgtggtcaccatgctg

SEQ ID NO: 331140 - DNA, 16 bp, C. familiaris
tgtggtccagtgtatc

SEQ ID NO: 331141 - DNA, 16 bp, C. familiaris
tgtggtccagtgtgtc

SEQ ID NO: 331142 - DNA, 16 bp, C. familiaris
tgtggtccctggacca

SEQ ID NO: 331143 - DNA, 16 bp, C. familiaris
tgtggtcctgggatgg

SEQ ID NO: 331144 - DNA, 16 bp, C. familiaris
tgtggtctatatacaa

SEQ ID NO: 331145 - DNA, 16 bp, C. familiaris
tgtggtcttgggcaag

SEQ ID NO: 331146 - DNA, 16 bp, C. familiaris
tgtggtgaccattttg

SEQ ID NO: 331147 - DNA, 16 bp, C. familiaris
tgtggtgatgatttca

SEQ ID NO: 331148 - DNA, 16 bp, C. familiaris
tgtggtgtgtatgtat

SEQ ID NO: 331149 - DNA, 16 bp, C. familiaris
tgtggttggagaagat

SEQ ID NO: 331150 - DNA, 16 bp, C. familiaris
tgtgtaaatatgtgtg

SEQ ID NO: 331151 - DNA, 16 bp, C. familiaris
tgtgtaacacccagtg

SEQ ID NO: 331152 - DNA, 16 bp, C. familiaris
tgtgtaagagagagag

SEQ ID NO: 331153 - DNA, 16 bp, C. familiaris
tgtgtacacatgtgta

SEQ ID NO: 331154 - DNA, 16 bp, C. familiaris
tgtgtataaatggaat

SEQ ID NO: 331155 - DNA, 16 bp, C. familiaris
tgtgtatacacatgca

SEQ ID NO: 331156 - DNA, 16 bp, C. familiaris
tgtgtatatatatata

SEQ ID NO: 331157 - DNA, 16 bp, C. familiaris
tgtgtatatatgtata

SEQ ID NO: 331158 - DNA, 16 bp, C. familiaris
tgtgtatatgtgtgtg

SEQ ID NO: 331159 - DNA, 16 bp, C. familiaris
tgtgtatcatttaaag

SEQ ID NO: 331160 - DNA, 16 bp, C. familiaris
tgtgtatctgtgtgtg

SEQ ID NO: 331161 - DNA, 16 bp, C. familiaris
tgtgtatgcatgcatg

SEQ ID NO: 331162 - DNA, 16 bp, C. familiaris
tgtgtatgcgtgtgtg

SEQ ID NO: 331163 - DNA, 16 bp, C. familiaris
tgtgtatgtataaata

SEQ ID NO: 331164 - DNA, 16 bp, C. familiaris
tgtgtatgtgagagag

SEQ ID NO: 331165 - DNA, 16 bp, C. familiaris
tgtgtatgtttctcat

SEQ ID NO: 331166 - DNA, 16 bp, C. familiaris
tgtgtcaaagaagaaa

SEQ ID NO: 331167 - DNA, 16 bp, C. familiaris
tgtgtcctggtctttg

SEQ ID NO: 331168 - DNA, 16 bp, C. familiaris
tgtgtccttccccaga

SEQ ID NO: 331169 - DNA, 16 bp, C. familiaris
tgtgtctatacacaca

SEQ ID NO: 331170 - DNA, 16 bp, C. familiaris
tgtgtctccatttcct

SEQ ID NO: 331171 - DNA, 16 bp, C. familiaris
tgtgtctcccaggaat

SEQ ID NO: 331172 - DNA, 16 bp, C. familiaris
tgtgtctctcatgtat

SEQ ID NO: 331173 - DNA, 16 bp, C. familiaris
tgtgtctctggtgaat

SEQ ID NO: 331174 - DNA, 16 bp, C. familiaris
tgtgtctcttggccat

SEQ ID NO: 331175 - DNA, 16 bp, C. familiaris
tgtgtctgactccaaa

SEQ ID NO: 331176 - DNA, 16 bp, C. familiaris
tgtgtctggcttcctt

SEQ ID NO: 331177 - DNA, 16 bp, C. familiaris
tgtgtctggtgcaaga

SEQ ID NO: 331178 - DNA, 16 bp, C. familiaris
tgtgtctggtggccat

SEQ ID NO: 331179 - DNA, 16 bp, C. familiaris
tgtgtctgtctctctt

SEQ ID NO: 331180 - DNA, 16 bp, C. familiaris
tgtgtctgtgcacaca

SEQ ID NO: 331181 - DNA, 16 bp, C. familiaris
tgtgtctgtgcctctc

SEQ ID NO: 331182 - DNA, 16 bp, C. familiaris
tgtgtctgttggcctt

SEQ ID NO: 331183 - DNA, 16 bp, C. familiaris
tgtgtctttcgtgaat

SEQ ID NO: 331184 - DNA, 16 bp, C. familiaris
tgtgtgaccacaggca

SEQ ID NO: 331185 - DNA, 16 bp, C. familiaris
tgtgtgaccctgggca

SEQ ID NO: 331186 - DNA, 16 bp, C. familiaris
tgtgtgaccttgggaa

SEQ ID NO: 331187 - DNA, 16 bp, C. familiaris
tgtgtgactctgagca

SEQ ID NO: 331188 - DNA, 16 bp, C. familiaris
tgtgtgagtgagtgag

SEQ ID NO: 331189 - DNA, 16 bp, C. familiaris
tgtgtgagtgtgcgtg

SEQ ID NO: 331190 - DNA, 16 bp, C. familiaris
tgtgtgcaagtgtgca

SEQ ID NO: 331191 - DNA, 16 bp, C. familiaris
tgtgtgcaattgtaaa

SEQ ID NO: 331192 - DNA, 16 bp, C. familiaris
tgtgtgcacacatgca

SEQ ID NO: 331193 - DNA, 16 bp, C. familiaris
tgtgtgcacacatgtg

SEQ ID NO: 331194 - DNA, 16 bp, C. familiaris
tgtgtgcacctggagg

SEQ ID NO: 331195 - DNA, 16 bp, C. familiaris
tgtgtgcactctgctg

SEQ ID NO: 331196 - DNA, 16 bp, C. familiaris
tgtgtgcacttgtgtg

SEQ ID NO: 331197 - DNA, 16 bp, C. familiaris
tgtgtgcagagggaga

SEQ ID NO: 331198 - DNA, 16 bp, C. familiaris
tgtgtgcatatatatg

SEQ ID NO: 331199 - DNA, 16 bp, C. familiaris
tgtgtgcatgagtgca

SEQ ID NO: 331200 - DNA, 16 bp, C. familiaris
tgtgtgcatgtgtaca

SEQ ID NO: 331201 - DNA, 16 bp, C. familiaris
tgtgtgcatgtgtgtg

SEQ ID NO: 331202 - DNA, 16 bp, C. familiaris
tgtgtggaagtgctga

SEQ ID NO: 331203 - DNA, 16 bp, C. familiaris
tgtgtggcagttttaa

SEQ ID NO: 331204 - DNA, 16 bp, C. familiaris
tgtgtggccttgagca

SEQ ID NO: 331205 - DNA, 16 bp, C. familiaris
tgtgtggctcagtggc

SEQ ID NO: 331206 - DNA, 16 bp, C. familiaris
tgtgtggtaatgagag

SEQ ID NO: 331207 - DNA, 16 bp, C. familiaris
tgtgtgtacacacgtg

SEQ ID NO: 331208 - DNA, 16 bp, C. familiaris
tgtgtgtacatatgtg

SEQ ID NO: 331209 - DNA, 16 bp, C. familiaris
tgtgtgtataaatgtg

SEQ ID NO: 331210 - DNA, 16 bp, C. familiaris
tgtgtgtatgagtgtg

SEQ ID NO: 331211 - DNA, 16 bp, C. familiaris
tgtgtgtatgtaaatt

SEQ ID NO: 331212 - DNA, 16 bp, C. familiaris
tgtgtgtatgtatata

SEQ ID NO: 331213 - DNA, 16 bp, C. familiaris
tgtgtgtatgtgcgtg

SEQ ID NO: 331214 - DNA, 16 bp, C. familiaris
tgtgtgtatgtgtata

SEQ ID NO: 331215 - DNA, 16 bp, C. familiaris
tgtgtgtcaggctctg

SEQ ID NO: 331216 - DNA, 16 bp, C. familiaris
tgtgtgtctctagtga

SEQ ID NO: 331217 - DNA, 16 bp, C. familiaris
tgtgtgtgagagagac

SEQ ID NO: 331218 - DNA, 16 bp, C. familiaris
tgtgtgtgcacatgtt

SEQ ID NO: 331219 - DNA, 16 bp, C. familiaris
tgtgtgtgcattttaa

SEQ ID NO: 331220 - DNA, 16 bp, C. familiaris
tgtgtgtggaatcaga

SEQ ID NO: 331221 - DNA, 16 bp, C. familiaris
tgtgtgtgggagagag

SEQ ID NO: 331222 - DNA, 16 bp, C. familiaris
tgtgtgtgtacatgaa

SEQ ID NO: 331223 - DNA, 16 bp, C. familiaris
tgtgtgtgtatacaat

SEQ ID NO: 331224 - DNA, 16 bp, C. familiaris
tgtgtgtgtatatata

SEQ ID NO: 331225 - DNA, 16 bp, C. familiaris
tgtgtgtgtatcttct

SEQ ID NO: 331226 - DNA, 16 bp, C. familiaris
tgtgtgtgtctttctc

SEQ ID NO: 331227 - DNA, 17 bp, C. familiaris
tgtgtgtgtgagagaga

SEQ ID NO: 331228 - DNA, 16 bp, C. familiaris
tgtgtgtgtgcaccca

SEQ ID NO: 331229 - DNA, 16 bp, C. familiaris
tgtgtgtgtgcaggca

SEQ ID NO: 331230 - DNA, 16 bp, C. familiaris
tgtgtgtgtggcagag

SEQ ID NO: 331231 - DNA, 16 bp, C. familiaris
tgtgtgtgtgtctcct

SEQ ID NO: 331232 - DNA, 17 bp, C. familiaris
tgtgtgtgtgtctctct

SEQ ID NO: 331233 - DNA, 16 bp, C. familiaris
tgtgtgtgtgtgaagg

SEQ ID NO: 331234 - DNA, 16 bp, C. familiaris
tgtgtgtgtgtgagga

SEQ ID NO: 331235 - DNA, 16 bp, C. familiaris
tgtgtgtgtgtttaca

SEQ ID NO: 331236 - DNA, 16 bp, C. familiaris
tgtgtgtttatatatg

SEQ ID NO: 331237 - DNA, 17 bp, C. familiaris
tgtgttatcctctagga

SEQ ID NO: 331238 - DNA, 16 bp, C. familiaris
tgtgttcagtgcagag

SEQ ID NO: 331239 - DNA, 16 bp, C. familiaris
tgtgttcagtggggag

SEQ ID NO: 331240 - DNA, 16 bp, C. familiaris
tgtgttcatagcagca

SEQ ID NO: 331241 - DNA, 16 bp, C. familiaris
tgtgttcatctatttt

SEQ ID NO: 331242 - DNA, 16 bp, C. familiaris
tgtgttctctctgtct

SEQ ID NO: 331243 - DNA, 16 bp, C. familiaris
tgtgttgctgatttta

SEQ ID NO: 331244 - DNA, 16 bp, C. familiaris
tgtgtttatagcagca

SEQ ID NO: 331245 - DNA, 16 bp, C. familiaris
tgtgtttatgaataaa

SEQ ID NO: 331246 - DNA, 16 bp, C. familiaris
tgtgttttcattttaa

SEQ ID NO: 331247 - DNA, 16 bp, C. familiaris
tgtgtttttaaaagct

SEQ ID NO: 331248 - DNA, 16 bp, C. familiaris
tgtgtttttaaaatca

SEQ ID NO: 331249 - DNA, 16 bp, C. familiaris
tgttaaaaaacaacaa

SEQ ID NO: 331250 - DNA, 16 bp, C. familiaris
tgttaaaaacaagaca

SEQ ID NO: 331251 - DNA, 16 bp, C. familiaris
tgttaaaaatgcagaa

SEQ ID NO: 331252 - DNA, 16 bp, C. familiaris
tgttaaaatgtctaca

SEQ ID NO: 331253 - DNA, 16 bp, C. familiaris
tgttaaaatgtttatg

SEQ ID NO: 331254 - DNA, 16 bp, C. familiaris
tgttaataatgctgct

SEQ ID NO: 331255 - DNA, 16 bp, C. familiaris
tgttaatgtggtatat

SEQ ID NO: 331256 - DNA, 16 bp, C. familiaris
tgttacagatgaggaa

SEQ ID NO: 331257 - DNA, 16 bp, C. familiaris
tgttacaggatttctt

SEQ ID NO: 331258 - DNA, 16 bp, C. familiaris
tgttacagtttttgtt

SEQ ID NO: 331259 - DNA, 16 bp, C. familiaris
tgttactatcataaat

SEQ ID NO: 331260 - DNA, 16 bp, C. familiaris
tgttagaaatgcaaaa

SEQ ID NO: 331261 - DNA, 16 bp, C. familiaris
tgttagaattagcaga

SEQ ID NO: 331262 - DNA, 16 bp, C. familiaris
tgttatatattcttgt

SEQ ID NO: 331263 - DNA, 17 bp, C. familiaris
tgttatatgttggcaaa

SEQ ID NO: 331264 - DNA, 16 bp, C. familiaris
tgttatcaacttaaaa

SEQ ID NO: 331265 - DNA, 16 bp, C. familiaris
tgttattaagaaaata

SEQ ID NO: 331266 - DNA, 16 bp, C. familiaris
tgttattcaagggtca

SEQ ID NO: 331267 - DNA, 16 bp, C. familiaris
tgttatttaatcttca

SEQ ID NO: 331268 - DNA, 16 bp, C. familiaris
tgttatttttaaggaa

SEQ ID NO: 331269 - DNA, 16 bp, C. familiaris
tgttcaaacaaaaact

SEQ ID NO: 331270 - DNA, 16 bp, C. familiaris
tgttcaaagatcaact

SEQ ID NO: 331271 - DNA, 16 bp, C. familiaris
tgttcaagaaatattt

SEQ ID NO: 331272 - DNA, 16 bp, C. familiaris
tgttcaagagtcaact

SEQ ID NO: 331273 - DNA, 16 bp, C. familiaris
tgttcaagggtcagct

SEQ ID NO: 331274 - DNA, 16 bp, C. familiaris
tgttcaagttttctgt

SEQ ID NO: 331275 - DNA, 16 bp, C. familiaris
tgttcacagcagcagt

SEQ ID NO: 331276 - DNA, 16 bp, C. familiaris
tgttcaccaaccagga

SEQ ID NO: 331277 - DNA, 16 bp, C. familiaris
tgttcacctgttttgt

SEQ ID NO: 331278 - DNA, 16 bp, C. familiaris
tgttcactctcaccac

SEQ ID NO: 331279 - DNA, 16 bp, C. familiaris
tgttcactgctgtatt

SEQ ID NO: 331280 - DNA, 17 bp, C. familiaris
tgttcagcagcatccct

SEQ ID NO: 331281 - DNA, 16 bp, C. familiaris
tgttcaggctgctgta

SEQ ID NO: 331282 - DNA, 16 bp, C. familiaris
tgttcatcagagattt

SEQ ID NO: 331283 - DNA, 16 bp, C. familiaris
tgttcatcagggaaat

SEQ ID NO: 331284 - DNA, 16 bp, C. familiaris
tgttcatgctctcttt

SEQ ID NO: 331285 - DNA, 16 bp, C. familiaris
tgttcatggatcaaaa

SEQ ID NO: 331286 - DNA, 16 bp, C. familiaris
tgttcatgtcttctga

SEQ ID NO: 331287 - DNA, 16 bp, C. familiaris
tgttcattctctttct

SEQ ID NO: 331288 - DNA, 16 bp, C. familiaris
tgttcattgaagcatt

SEQ ID NO: 331289 - DNA, 16 bp, C. familiaris
tgttcatttgtttcta

SEQ ID NO: 331290 - DNA, 16 bp, C. familiaris
tgttccattaaaaaaa

SEQ ID NO: 331291 - DNA, 16 bp, C. familiaris
tgttccctccatccct

SEQ ID NO: 331292 - DNA, 16 bp, C. familiaris
tgttcctccaactgag

SEQ ID NO: 331293 - DNA, 16 bp, C. familiaris
tgttcctccccctgct

SEQ ID NO: 331294 - DNA, 16 bp, C. familiaris
tgttcctcctcctgct

SEQ ID NO: 331295 - DNA, 19 bp, C. familiaris
tgttcctcctggggcctca

SEQ ID NO: 331296 - DNA, 16 bp, C. familiaris
tgttcctgcctcaggg

SEQ ID NO: 331297 - DNA, 16 bp, C. familiaris
tgttcctttggccaca

SEQ ID NO: 331298 - DNA, 16 bp, C. familiaris
tgttctagttctgtgg

SEQ ID NO: 331299 - DNA, 16 bp, C. familiaris
tgttctataattttca

SEQ ID NO: 331300 - DNA, 16 bp, C. familiaris
tgttctatagttttca

SEQ ID NO: 331301 - DNA, 16 bp, C. familiaris
tgttctccaggttcat

SEQ ID NO: 331302 - DNA, 16 bp, C. familiaris
tgttctgatgctcttg

SEQ ID NO: 331303 - DNA, 16 bp, C. familiaris
tgttctgcaaaagaca

SEQ ID NO: 331304 - DNA, 16 bp, C. familiaris
tgttctggattttagc

SEQ ID NO: 331305 - DNA, 16 bp, C. familiaris
tgttctgtctctcaaa

SEQ ID NO: 331306 - DNA, 16 bp, C. familiaris
tgttctgtttcttcat

SEQ ID NO: 331307 - DNA, 16 bp, C. familiaris
tgttcttaaatttatt

SEQ ID NO: 331308 - DNA, 16 bp, C. familiaris
tgttcttccaccactg

SEQ ID NO: 331309 - DNA, 16 bp, C. familiaris
tgttcttccagctggt

SEQ ID NO: 331310 - DNA, 16 bp, C. familiaris
tgttcttccatttctt

SEQ ID NO: 331311 - DNA, 16 bp, C. familiaris
tgttcttctgtgtctg

SEQ ID NO: 331312 - DNA, 16 bp, C. familiaris
tgttctttagattcca

SEQ ID NO: 331313 - DNA, 16 bp, C. familiaris
tgttctttttatagct

SEQ ID NO: 331314 - DNA, 16 bp, C. familiaris
tgttgaaaaagaaaat

SEQ ID NO: 331315 - DNA, 16 bp, C. familiaris
tgttgaaaaagaagaa

SEQ ID NO: 331316 - DNA, 16 bp, C. familiaris
tgttgaaaagaaaacc

SEQ ID NO: 331317 - DNA, 16 bp, C. familiaris
tgttgaaaatgaaaac

SEQ ID NO: 331318 - DNA, 16 bp, C. familiaris
tgttgaaccaaccttg

SEQ ID NO: 331319 - DNA, 16 bp, C. familiaris
tgttgaactgttttta

SEQ ID NO: 331320 - DNA, 16 bp, C. familiaris
tgttgaacttctcatt

SEQ ID NO: 331321 - DNA, 16 bp, C. familiaris
tgttgaagatttttat

SEQ ID NO: 331322 - DNA, 16 bp, C. familiaris
tgttgaaggtctcact

SEQ ID NO: 331323 - DNA, 16 bp, C. familiaris
tgttgaatggatgaat

SEQ ID NO: 331324 - DNA, 16 bp, C. familiaris
tgttgaccagaagact

SEQ ID NO: 331325 - DNA, 26 bp, C. familiaris
tgttgagagcttctctgactatcctc

SEQ ID NO: 331326 - DNA, 16 bp, C. familiaris
tgttgagatttgcttt

SEQ ID NO: 331327 - DNA, 16 bp, C. familiaris
tgttgagggacacctg

SEQ ID NO: 331328 - DNA, 16 bp, C. familiaris
tgttgagtttgaaaag

SEQ ID NO: 331329 - DNA, 16 bp, C. familiaris
tgttgagtttgatatg

SEQ ID NO: 331330 - DNA, 16 bp, C. familiaris
tgttgatgaacattta

SEQ ID NO: 331331 - DNA, 16 bp, C. familiaris
tgttgatgctgctggt

SEQ ID NO: 331332 - DNA, 16 bp, C. familiaris
tgttgatggcttcctt

SEQ ID NO: 331333 - DNA, 16 bp, C. familiaris
tgttgatttgcatttc

SEQ ID NO: 331334 - DNA, 16 bp, C. familiaris
tgttgcagaggatgtg

SEQ ID NO: 331335 - DNA, 16 bp, C. familiaris
tgttgcctatgttctt

SEQ ID NO: 331336 - DNA, 16 bp, C. familiaris
tgttgctgctgctgtt

SEQ ID NO: 331337 - DNA, 16 bp, C. familiaris
tgttgctgctggtgtt

SEQ ID NO: 331338 - DNA, 16 bp, C. familiaris
tgttgctgctgttgct

SEQ ID NO: 331339 - DNA, 16 bp, C. familiaris
tgttgcttctttactg

SEQ ID NO: 331340 - DNA, 16 bp, C. familiaris
tgttggaaaaatgaca

SEQ ID NO: 331341 - DNA, 16 bp, C. familiaris
tgttggcaaggacatg

SEQ ID NO: 331342 - DNA, 16 bp, C. familiaris
tgttggcagaatttag

SEQ ID NO: 331343 - DNA, 16 bp, C. familiaris
tgttggccacctgtat

SEQ ID NO: 331344 - DNA, 16 bp, C. familiaris
tgttggcctccctgct

SEQ ID NO: 331345 - DNA, 16 bp, C. familiaris
tgttgggaaaactggt

SEQ ID NO: 331346 - DNA, 16 bp, C. familiaris
tgttgggctccctgtg

SEQ ID NO: 331347 - DNA, 16 bp, C. familiaris
tgttggggctcctggg

SEQ ID NO: 331348 - DNA, 16 bp, C. familiaris
tgttggggtccctgct

SEQ ID NO: 331349 - DNA, 16 bp, C. familiaris
tgttgggtgtggagat

SEQ ID NO: 331350 - DNA, 16 bp, C. familiaris
tgttgtagaggatgtg

SEQ ID NO: 331351 - DNA, 16 bp, C. familiaris
tgttgtatgtattata

SEQ ID NO: 331352 - DNA, 16 bp, C. familiaris
tgttgtcattgttgct

SEQ ID NO: 331353 - DNA, 16 bp, C. familiaris
tgttgtgattgagttc

SEQ ID NO: 331354 - DNA, 16 bp, C. familiaris
tgttgtgtctcaggga

SEQ ID NO: 331355 - DNA, 16 bp, C. familiaris
tgttgttggatgaagt

SEQ ID NO: 331356 - DNA, 16 bp, C. familiaris
tgttgttggattcagt

SEQ ID NO: 331357 - DNA, 16 bp, C. familiaris
tgttgtttttaaagat

SEQ ID NO: 331358 - DNA, 16 bp, C. familiaris
tgtttaaaaatggaaa

SEQ ID NO: 331359 - DNA, 16 bp, C. familiaris
tgtttaatattttgag

SEQ ID NO: 331360 - DNA, 16 bp, C. familiaris
tgtttactgtgctttt

SEQ ID NO: 331361 - DNA, 16 bp, C. familiaris
tgtttataataacaaa

SEQ ID NO: 331362 - DNA, 16 bp, C. familiaris
tgtttatccattaatc

SEQ ID NO: 331363 - DNA, 16 bp, C. familiaris
tgtttatggcatagat

SEQ ID NO: 331364 - DNA, 16 bp, C. familiaris
tgtttattaaattcta

SEQ ID NO: 331365 - DNA, 16 bp, C. familiaris
tgtttattgctgcatt

SEQ ID NO: 331366 - DNA, 16 bp, C. familiaris
tgtttcaaaagaaaaa

SEQ ID NO: 331367 - DNA, 16 bp, C. familiaris
tgtttcaatttcctcc

SEQ ID NO: 331368 - DNA, 16 bp, C. familiaris
tgtttcatattttaaa

SEQ ID NO: 331369 - DNA, 16 bp, C. familiaris
tgtttcatatttttaa

SEQ ID NO: 331370 - DNA, 16 bp, C. familiaris
tgtttccaaaaaaaaa

SEQ ID NO: 331371 - DNA, 16 bp, C. familiaris
tgtttccacatctgta

SEQ ID NO: 331372 - DNA, 16 bp, C. familiaris
tgtttccagtttgggt

SEQ ID NO: 331373 - DNA, 16 bp, C. familiaris
tgtttccagttttggg

SEQ ID NO: 331374 - DNA, 16 bp, C. familiaris
tgtttccatacaaatt

SEQ ID NO: 331375 - DNA, 16 bp, C. familiaris
tgtttccatattttga

SEQ ID NO: 331376 - DNA, 16 bp, C. familiaris
tgtttcccttcccaaa

SEQ ID NO: 331377 - DNA, 16 bp, C. familiaris
tgtttcctgtattgtt

SEQ ID NO: 331378 - DNA, 16 bp, C. familiaris
tgtttccttcactctg

SEQ ID NO: 331379 - DNA, 16 bp, C. familiaris
tgtttccttccacaga

SEQ ID NO: 331380 - DNA, 16 bp, C. familiaris
tgtttccttctccagg

SEQ ID NO: 331381 - DNA, 16 bp, C. familiaris
tgtttcctttatttaa

SEQ ID NO: 331382 - DNA, 16 bp, C. familiaris
tgtttcctttgctatg

SEQ ID NO: 331383 - DNA, 16 bp, C. familiaris
tgtttcctttgctgtg

SEQ ID NO: 331384 - DNA, 16 bp, C. familiaris
tgtttctagagatttt

SEQ ID NO: 331385 - DNA, 16 bp, C. familiaris
tgtttctccccctgcc

SEQ ID NO: 331386 - DNA, 16 bp, C. familiaris
tgtttctctgaagaac

SEQ ID NO: 331387 - DNA, 16 bp, C. familiaris
tgtttctctgcctccc

SEQ ID NO: 331388 - DNA, 16 bp, C. familiaris
tgtttctgattctctc

SEQ ID NO: 331389 - DNA, 16 bp, C. familiaris
tgtttctgcctctgcc

SEQ ID NO: 331390 - DNA, 16 bp, C. familiaris
tgtttctggagatttc

SEQ ID NO: 331391 - DNA, 16 bp, C. familiaris
tgtttctgggaattta

SEQ ID NO: 331392 - DNA, 16 bp, C. familiaris
tgtttctgtctccctc

SEQ ID NO: 331393 - DNA, 16 bp, C. familiaris
tgtttcttaaagattt

SEQ ID NO: 331394 - DNA, 16 bp, C. familiaris
tgtttcttcatctgtt

SEQ ID NO: 331395 - DNA, 16 bp, C. familiaris
tgtttctttatttgaa

SEQ ID NO: 331396 - DNA, 16 bp, C. familiaris
tgtttctttggagaac

SEQ ID NO: 331397 - DNA, 16 bp, C. familiaris
tgtttgagcctctgcc

SEQ ID NO: 331398 - DNA, 16 bp, C. familiaris
tgtttgctgggagttt

SEQ ID NO: 331399 - DNA, 16 bp, C. familiaris
tgtttgctgttttaaa

SEQ ID NO: 331400 - DNA, 16 bp, C. familiaris
tgtttgcttctccctc

SEQ ID NO: 331401 - DNA, 16 bp, C. familiaris
tgtttgcttttaaaat

SEQ ID NO: 331402 - DNA, 16 bp, C. familiaris
tgtttggaaaactgga

SEQ ID NO: 331403 - DNA, 16 bp, C. familiaris
tgtttggacctttaac

SEQ ID NO: 331404 - DNA, 16 bp, C. familiaris
tgtttggagacatttt

SEQ ID NO: 331405 - DNA, 16 bp, C. familiaris
tgtttggggaaaaaaa

SEQ ID NO: 331406 - DNA, 16 bp, C. familiaris
tgtttgtgtcctccca

SEQ ID NO: 331407 - DNA, 16 bp, C. familiaris
tgtttgttttaaagag

SEQ ID NO: 331408 - DNA, 16 bp, C. familiaris
tgtttgtttttaaaag

SEQ ID NO: 331409 - DNA, 16 bp, C. familiaris
tgttttaaaaggtttt

SEQ ID NO: 331410 - DNA, 16 bp, C. familiaris
tgttttaaagataatt

SEQ ID NO: 331411 - DNA, 16 bp, C. familiaris
tgttttaaagattgat

SEQ ID NO: 331412 - DNA, 16 bp, C. familiaris
tgttttaaattccaca

SEQ ID NO: 331413 - DNA, 16 bp, C. familiaris
tgttttacagttttca

SEQ ID NO: 331414 - DNA, 16 bp, C. familiaris
tgttttacttttataa

SEQ ID NO: 331415 - DNA, 16 bp, C. familiaris
tgttttagaaagatta

SEQ ID NO: 331416 - DNA, 34 bp, C. familiaris
tgttttagacaatactcatgtgtatgggcaaaaa

SEQ ID NO: 331417 - DNA, 35 bp, C. familiaris
tgttttagacaatactcatgtgtatgggcaaaaaa

SEQ ID NO: 331418 - DNA, 16 bp, C. familiaris
tgttttatttcttcaa

SEQ ID NO: 331419 - DNA, 16 bp, C. familiaris
tgttttcaaatgaaaa

SEQ ID NO: 331420 - DNA, 16 bp, C. familiaris
tgttttcaagatccat

SEQ ID NO: 331421 - DNA, 16 bp, C. familiaris
tgttttcaattctttg

SEQ ID NO: 331422 - DNA, 16 bp, C. familiaris
tgttttcatctctctt

SEQ ID NO: 331423 - DNA, 16 bp, C. familiaris
tgttttcatcttcatt

SEQ ID NO: 331424 - DNA, 16 bp, C. familiaris
tgttttcattcctctt

SEQ ID NO: 331425 - DNA, 16 bp, C. familiaris
tgttttcattctgata

SEQ ID NO: 331426 - DNA, 16 bp, C. familiaris
tgttttccacagcagc

SEQ ID NO: 331427 - DNA, 16 bp, C. familiaris
tgttttccttttgaaa

SEQ ID NO: 331428 - DNA, 16 bp, C. familiaris
tgttttctaaatattt

SEQ ID NO: 331429 - DNA, 16 bp, C. familiaris
tgttttctctttcaaa

SEQ ID NO: 331430 - DNA, 16 bp, C. familiaris
tgttttctgtagtggc

SEQ ID NO: 331431 - DNA, 16 bp, C. familiaris
tgttttcttaagattt

SEQ ID NO: 331432 - DNA, 16 bp, C. familiaris
tgttttcttctagaat

SEQ ID NO: 331433 - DNA, 16 bp, C. familiaris
tgttttgaaaaatata

SEQ ID NO: 331434 - DNA, 16 bp, C. familiaris
tgttttgaaaatgttt

SEQ ID NO: 331435 - DNA, 16 bp, C. familiaris
tgttttgaagaaaaaa

SEQ ID NO: 331436 - DNA, 16 bp, C. familiaris
tgttttgaattctagt

SEQ ID NO: 331437 - DNA, 16 bp, C. familiaris
tgttttgggggaaaaa

SEQ ID NO: 331438 - DNA, 16 bp, C. familiaris
tgttttgtatatatct

SEQ ID NO: 331439 - DNA, 17 bp, C. familiaris
tgttttgtggaccattt

SEQ ID NO: 331440 - DNA, 16 bp, C. familiaris
tgttttgttgatctgt

SEQ ID NO: 331441 - DNA, 16 bp, C. familiaris
tgttttgttgcttaaa

SEQ ID NO: 331442 - DNA, 16 bp, C. familiaris
tgttttgtttctaaat

SEQ ID NO: 331443 - DNA, 16 bp, C. familiaris
tgttttgttttcctaa

SEQ ID NO: 331444 - DNA, 16 bp, C. familiaris
tgttttgttttgcaga

SEQ ID NO: 331445 - DNA, 16 bp, C. familiaris
tgttttgtttttccag

SEQ ID NO: 331446 - DNA, 16 bp, C. familiaris
tgtttttaaaaaaaca

SEQ ID NO: 331447 - DNA, 16 bp, C. familiaris
tgtttttaaacagaaa

SEQ ID NO: 331448 - DNA, 16 bp, C. familiaris
tgtttttaagattcca

SEQ ID NO: 331449 - DNA, 16 bp, C. familiaris
tgtttttaataaactt

SEQ ID NO: 331450 - DNA, 16 bp, C. familiaris
tgtttttaatgagaaa

SEQ ID NO: 331451 - DNA, 16 bp, C. familiaris
tgtttttaattttcag

SEQ ID NO: 331452 - DNA, 16 bp, C. familiaris
tgtttttacagatttt

SEQ ID NO: 331453 - DNA, 16 bp, C. familiaris
tgtttttatcataaat

SEQ ID NO: 331454 - DNA, 16 bp, C. familiaris
tgtttttatcattaaa

SEQ ID NO: 331455 - DNA, 16 bp, C. familiaris
tgtttttcagagtgac

SEQ ID NO: 331456 - DNA, 16 bp, C. familiaris
tgtttttcataataaa

SEQ ID NO: 331457 - DNA, 16 bp, C. familiaris
tgtttttccttttaaa

SEQ ID NO: 331458 - DNA, 16 bp, C. familiaris
tgtttttctattaaaa

SEQ ID NO: 331459 - DNA, 16 bp, C. familiaris
tgtttttctctttcag

SEQ ID NO: 331460 - DNA, 16 bp, C. familiaris
tgtttttctttggaaa

SEQ ID NO: 331461 - DNA, 16 bp, C. familiaris
tgtttttgatgctgtt

SEQ ID NO: 331462 - DNA, 16 bp, C. familiaris
tgtttttggatgagat

SEQ ID NO: 331463 - DNA, 16 bp, C. familiaris
tgtttttggggaaaaa

SEQ ID NO: 331464 - DNA, 16 bp, C. familiaris
tgtttttgtgccagga

SEQ ID NO: 331465 - DNA, 16 bp, C. familiaris
tgttttttcaagattt

SEQ ID NO: 331466 - DNA, 16 bp, C. familiaris
ttaaaaaaaatgctaa

SEQ ID NO: 331467 - DNA, 16 bp, C. familiaris
ttaaaaaaaatgcttt

SEQ ID NO: 331468 - DNA, 16 bp, C. familiaris
ttaaaaaaacagttaa

SEQ ID NO: 331469 - DNA, 16 bp, C. familiaris
ttaaaaaaagattttg

SEQ ID NO: 331470 - DNA, 16 bp, C. familiaris
ttaaaaaaatagcttt

SEQ ID NO: 331471 - DNA, 16 bp, C. familiaris
ttaaaaaaatctgaag

SEQ ID NO: 331472 - DNA, 16 bp, C. familiaris
ttaaaaaaatgttact

SEQ ID NO: 331473 - DNA, 16 bp, C. familiaris
ttaaaaaaattccagt

SEQ ID NO: 331474 - DNA, 16 bp, C. familiaris
ttaaaaaactgtatta

SEQ ID NO: 331475 - DNA, 16 bp, C. familiaris
ttaaaaaagaagacat

SEQ ID NO: 331476 - DNA, 16 bp, C. familiaris
ttaaaaaagaattaca

SEQ ID NO: 331477 - DNA, 16 bp, C. familiaris
ttaaaaaagatcattc

SEQ ID NO: 331478 - DNA, 16 bp, C. familiaris
ttaaaaaagattttgg

SEQ ID NO: 331479 - DNA, 16 bp, C. familiaris
ttaaaaaagcaatttt

SEQ ID NO: 331480 - DNA, 16 bp, C. familiaris
ttaaaaaagtttttgt

SEQ ID NO: 331481 - DNA, 16 bp, C. familiaris
ttaaaaaatacagatg

SEQ ID NO: 331482 - DNA, 16 bp, C. familiaris
ttaaaaaatactgttt

SEQ ID NO: 331483 - DNA, 16 bp, C. familiaris
ttaaaaaatacttcat

SEQ ID NO: 331484 - DNA, 16 bp, C. familiaris
ttaaaaaatcagcttt

SEQ ID NO: 331485 - DNA, 16 bp, C. familiaris
ttaaaaaatcttttga

SEQ ID NO: 331486 - DNA, 16 bp, C. familiaris
ttaaaaaatgaaaacc

SEQ ID NO: 331487 - DNA, 16 bp, C. familiaris
ttaaaaaatgctttat

SEQ ID NO: 331488 - DNA, 16 bp, C. familiaris
ttaaaaaatgcttttg

SEQ ID NO: 331489 - DNA, 16 bp, C. familiaris
ttaaaaaatggatttt

SEQ ID NO: 331490 - DNA, 16 bp, C. familiaris
ttaaaaaatggcaaaa

SEQ ID NO: 331491 - DNA, 16 bp, C. familiaris
ttaaaaaatgtatctt

SEQ ID NO: 331492 - DNA, 16 bp, C. familiaris
ttaaaaaatgttcact

SEQ ID NO: 331493 - DNA, 16 bp, C. familiaris
ttaaaaaatttgttct

SEQ ID NO: 331494 - DNA, 16 bp, C. familiaris
ttaaaaaattttctct

SEQ ID NO: 331495 - DNA, 16 bp, C. familiaris
ttaaaaacacagattt

SEQ ID NO: 331496 - DNA, 16 bp, C. familiaris
ttaaaaacctattttt

SEQ ID NO: 331497 - DNA, 16 bp, C. familiaris
ttaaaaactgaaaatg

SEQ ID NO: 331498 - DNA, 16 bp, C. familiaris
ttaaaaagaaaacatt

SEQ ID NO: 331499 - DNA, 16 bp, C. familiaris
ttaaaaagaaacaact

SEQ ID NO: 331500 - DNA, 16 bp, C. familiaris
ttaaaaagaaatctct

SEQ ID NO: 331501 - DNA, 16 bp, C. familiaris
ttaaaaagctatattt

SEQ ID NO: 331502 - DNA, 16 bp, C. familiaris
ttaaaaaggaaatgat

SEQ ID NO: 331503 - DNA, 16 bp, C. familiaris
ttaaaaagtcaaagaa

SEQ ID NO: 331504 - DNA, 16 bp, C. familiaris
ttaaaaagttgctttt

SEQ ID NO: 331505 - DNA, 16 bp, C. familiaris
ttaaaaataaacctgc

SEQ ID NO: 331506 - DNA, 16 bp, C. familiaris
ttaaaaatacatttct

SEQ ID NO: 331507 - DNA, 16 bp, C. familiaris
ttaaaaatatggtttt

SEQ ID NO: 331508 - DNA, 16 bp, C. familiaris
ttaaaaatattcatgg

SEQ ID NO: 331509 - DNA, 16 bp, C. familiaris
ttaaaaatcatggaaa

SEQ ID NO: 331510 - DNA, 16 bp, C. familiaris
ttaaaaatccatttca

SEQ ID NO: 331511 - DNA, 16 bp, C. familiaris
ttaaaaatctcaactt

SEQ ID NO: 331512 - DNA, 16 bp, C. familiaris
ttaaaaatctgaaaat

SEQ ID NO: 331513 - DNA, 16 bp, C. familiaris
ttaaaaatcttacttt

SEQ ID NO: 331514 - DNA, 16 bp, C. familiaris
ttaaaaatgaaagcaa

SEQ ID NO: 331515 - DNA, 16 bp, C. familiaris
ttaaaaatgacaaata

SEQ ID NO: 331516 - DNA, 16 bp, C. familiaris
ttaaaaatgacaataa

SEQ ID NO: 331517 - DNA, 16 bp, C. familiaris
ttaaaaatgacacaaa

SEQ ID NO: 331518 - DNA, 16 bp, C. familiaris
ttaaaaatgagtgaaa

SEQ ID NO: 331519 - DNA, 16 bp, C. familiaris
ttaaaaatgatttctt

SEQ ID NO: 331520 - DNA, 16 bp, C. familiaris
ttaaaaatgattttgt

SEQ ID NO: 331521 - DNA, 16 bp, C. familiaris
ttaaaaatgcagaaaa

SEQ ID NO: 331522 - DNA, 16 bp, C. familiaris
ttaaaaatgccaaaaa

SEQ ID NO: 331523 - DNA, 16 bp, C. familiaris
ttaaaaatggaaagag

SEQ ID NO: 331524 - DNA, 16 bp, C. familiaris
ttaaaaatggagattt

SEQ ID NO: 331525 - DNA, 16 bp, C. familiaris
ttaaaaatggtatttt

SEQ ID NO: 331526 - DNA, 16 bp, C. familiaris
ttaaaaatgtatacat

SEQ ID NO: 331527 - DNA, 16 bp, C. familiaris
ttaaaaatgtattcaa

SEQ ID NO: 331528 - DNA, 16 bp, C. familiaris
ttaaaaatgtattttc

SEQ ID NO: 331529 - DNA, 16 bp, C. familiaris
ttaaaaatgtcacaaa

SEQ ID NO: 331530 - DNA, 16 bp, C. familiaris
ttaaaaatgttccttt

SEQ ID NO: 331531 - DNA, 16 bp, C. familiaris
ttaaaaattcaataga

SEQ ID NO: 331532 - DNA, 16 bp, C. familiaris
ttaaaaattcactttt

SEQ ID NO: 331533 - DNA, 16 bp, C. familiaris
ttaaaaattctctaaa

SEQ ID NO: 331534 - DNA, 16 bp, C. familiaris
ttaaaaattctcttta

SEQ ID NO: 331535 - DNA, 16 bp, C. familiaris
ttaaaaattgtatttg

SEQ ID NO: 331536 - DNA, 16 bp, C. familiaris
ttaaaacaaaatcttt

SEQ ID NO: 331537 - DNA, 16 bp, C. familiaris
ttaaaacaaagaccat

SEQ ID NO: 331538 - DNA, 16 bp, C. familiaris
ttaaaacaatttcttt

SEQ ID NO: 331539 - DNA, 16 bp, C. familiaris
ttaaaacaggaagaaa

SEQ ID NO: 331540 - DNA, 16 bp, C. familiaris
ttaaaacagtttttaa

SEQ ID NO: 331541 - DNA, 16 bp, C. familiaris
ttaaaacatgtaaaaa

SEQ ID NO: 331542 - DNA, 16 bp, C. familiaris
ttaaaacattttctgg

SEQ ID NO: 331543 - DNA, 16 bp, C. familiaris
ttaaaagaaaaacatt

SEQ ID NO: 331544 - DNA, 16 bp, C. familiaris
ttaaaagaaaaactga

SEQ ID NO: 331545 - DNA, 16 bp, C. familiaris
ttaaaagagtttattt

SEQ ID NO: 331546 - DNA, 16 bp, C. familiaris
ttaaaagatgaatgaa

SEQ ID NO: 331547 - DNA, 16 bp, C. familiaris
ttaaaagattatttct

SEQ ID NO: 331548 - DNA, 16 bp, C. familiaris
ttaaaagcagaagaga

SEQ ID NO: 331549 - DNA, 16 bp, C. familiaris
ttaaaaggaaacattt

SEQ ID NO: 331550 - DNA, 16 bp, C. familiaris
ttaaaaggatcacaca

SEQ ID NO: 331551 - DNA, 16 bp, C. familiaris
ttaaaatatatttgca

SEQ ID NO: 331552 - DNA, 16 bp, C. familiaris
ttaaaatatttgagaa

SEQ ID NO: 331553 - DNA, 16 bp, C. familiaris
ttaaaatattttgaca

SEQ ID NO: 331554 - DNA, 16 bp, C. familiaris
ttaaaatcagaaaatg

SEQ ID NO: 331555 - DNA, 16 bp, C. familiaris
ttaaaatctactttct

SEQ ID NO: 331556 - DNA, 16 bp, C. familiaris
ttaaaatctgaaaaaa

SEQ ID NO: 331557 - DNA, 16 bp, C. familiaris
ttaaaatgaaaaatct

SEQ ID NO: 331558 - DNA, 16 bp, C. familiaris
ttaaaatgagtaaatt

SEQ ID NO: 331559 - DNA, 16 bp, C. familiaris
ttaaaatgcaaattct

SEQ ID NO: 331560 - DNA, 16 bp, C. familiaris
ttaaaatggttaattt

SEQ ID NO: 331561 - DNA, 16 bp, C. familiaris
ttaaaatgtcatttaa

SEQ ID NO: 331562 - DNA, 16 bp, C. familiaris
ttaaaatgtccatatt

SEQ ID NO: 331563 - DNA, 16 bp, C. familiaris
ttaaaatgtgaagaaa

SEQ ID NO: 331564 - DNA, 16 bp, C. familiaris
ttaaaatgttatttct

SEQ ID NO: 331565 - DNA, 16 bp, C. familiaris
ttaaaattcaacagta

SEQ ID NO: 331566 - DNA, 16 bp, C. familiaris
ttaaaattgaaagact

SEQ ID NO: 331567 - DNA, 16 bp, C. familiaris
ttaaaatttaaaacag

SEQ ID NO: 331568 - DNA, 16 bp, C. familiaris
ttaaaatttcagaaaa

SEQ ID NO: 331569 - DNA, 16 bp, C. familiaris
ttaaaatttcttttga

SEQ ID NO: 331570 - DNA, 16 bp, C. familiaris
ttaaaatttgttgaga

SEQ ID NO: 331571 - DNA, 16 bp, C. familiaris
ttaaacaacagaaatg

SEQ ID NO: 331572 - DNA, 16 bp, C. familiaris
ttaaacattatttctg

SEQ ID NO: 331573 - DNA, 16 bp, C. familiaris
ttaaacatttaaagaa

SEQ ID NO: 331574 - DNA, 16 bp, C. familiaris
ttaaactgtaaaaaaa

SEQ ID NO: 331575 - DNA, 16 bp, C. familiaris
ttaaagaaaaacttga

SEQ ID NO: 331576 - DNA, 16 bp, C. familiaris
ttaaagaaacaaatga

SEQ ID NO: 331577 - DNA, 16 bp, C. familiaris
ttaaagaaacatttaa

SEQ ID NO: 331578 - DNA, 16 bp, C. familiaris
ttaaagaaacatttat

SEQ ID NO: 331579 - DNA, 16 bp, C. familiaris
ttaaagaaactgccaa

SEQ ID NO: 331580 - DNA, 16 bp, C. familiaris
ttaaagaaagattttt

SEQ ID NO: 331581 - DNA, 16 bp, C. familiaris
ttaaagaaataaacat

SEQ ID NO: 331582 - DNA, 16 bp, C. familiaris
ttaaagaaataaatca

SEQ ID NO: 331583 - DNA, 16 bp, C. familiaris
ttaaagaacaaaaatt

SEQ ID NO: 331584 - DNA, 16 bp, C. familiaris
ttaaagaacatgctac

SEQ ID NO: 331585 - DNA, 16 bp, C. familiaris
ttaaagaactaaagga

SEQ ID NO: 331586 - DNA, 16 bp, C. familiaris
ttaaagaagaaaatca

SEQ ID NO: 331587 - DNA, 16 bp, C. familiaris
ttaaagaagaaaatct

SEQ ID NO: 331588 - DNA, 16 bp, C. familiaris
ttaaagaagaaataac

SEQ ID NO: 331589 - DNA, 16 bp, C. familiaris
ttaaagaaggcacttg

SEQ ID NO: 331590 - DNA, 16 bp, C. familiaris
ttaaagacataaatgt

SEQ ID NO: 331591 - DNA, 16 bp, C. familiaris
ttaaagagactatctt

SEQ ID NO: 331592 - DNA, 16 bp, C. familiaris
ttaaagagagagtgtg

SEQ ID NO: 331593 - DNA, 16 bp, C. familiaris
ttaaagataaagagag

SEQ ID NO: 331594 - DNA, 16 bp, C. familiaris
ttaaagatgaggaaat

SEQ ID NO: 331595 - DNA, 16 bp, C. familiaris
ttaaagatggaggaag

SEQ ID NO: 331596 - DNA, 16 bp, C. familiaris
ttaaagatttacttgt

SEQ ID NO: 331597 - DNA, 16 bp, C. familiaris
ttaaagatttttctta

SEQ ID NO: 331598 - DNA, 16 bp, C. familiaris
ttaaagatttttttca

SEQ ID NO: 331599 - DNA, 16 bp, C. familiaris
ttaaagcaacaatgag

SEQ ID NO: 331600 - DNA, 16 bp, C. familiaris
ttaaagcaacacaaat

SEQ ID NO: 331601 - DNA, 16 bp, C. familiaris
ttaaagcagaaagaga

SEQ ID NO: 331602 - DNA, 16 bp, C. familiaris
ttaaagcagaaataaa

SEQ ID NO: 331603 - DNA, 16 bp, C. familiaris
ttaaagcatttaaaat

SEQ ID NO: 331604 - DNA, 16 bp, C. familiaris
ttaaagcttattttta

SEQ ID NO: 331605 - DNA, 16 bp, C. familiaris
ttaaaggaaaatatga

SEQ ID NO: 331606 - DNA, 16 bp, C. familiaris
ttaaaggaattttaaa

SEQ ID NO: 331607 - DNA, 16 bp, C. familiaris
ttaaaggagaaaaatt

SEQ ID NO: 331608 - DNA, 16 bp, C. familiaris
ttaaagtaaaaacttt

SEQ ID NO: 331609 - DNA, 16 bp, C. familiaris
ttaaagtccattttgt

SEQ ID NO: 331610 - DNA, 16 bp, C. familiaris
ttaaagtggatttttt

SEQ ID NO: 331611 - DNA, 16 bp, C. familiaris
ttaaagttttacttat

SEQ ID NO: 331612 - DNA, 16 bp, C. familiaris
ttaaataaagatttga

SEQ ID NO: 331613 - DNA, 16 bp, C. familiaris
ttaaatacagagaata

SEQ ID NO: 331614 - DNA, 16 bp, C. familiaris
ttaaatataaatggat

SEQ ID NO: 331615 - DNA, 16 bp, C. familiaris
ttaaatattcagtttt

SEQ ID NO: 331616 - DNA, 16 bp, C. familiaris
ttaaatatttcaaaga

SEQ ID NO: 331617 - DNA, 16 bp, C. familiaris
ttaaatatttttcaag

SEQ ID NO: 331618 - DNA, 16 bp, C. familiaris
ttaaatctgtttttct

SEQ ID NO: 331619 - DNA, 16 bp, C. familiaris
ttaaatcttctttgaa

SEQ ID NO: 331620 - DNA, 16 bp, C. familiaris
ttaaatgcttttaaat

SEQ ID NO: 331621 - DNA, 16 bp, C. familiaris
ttaaatggtctcattc

SEQ ID NO: 331622 - DNA, 16 bp, C. familiaris
ttaaatgtgaaaagca

SEQ ID NO: 331623 - DNA, 16 bp, C. familiaris
ttaaattaaaacttga

SEQ ID NO: 331624 - DNA, 16 bp, C. familiaris
ttaaattcaccaataa

SEQ ID NO: 331625 - DNA, 16 bp, C. familiaris
ttaaattcagttaatt

SEQ ID NO: 331626 - DNA, 16 bp, C. familiaris
ttaaatttattgagat

SEQ ID NO: 331627 - DNA, 16 bp, C. familiaris
ttaaattttaatgaag

SEQ ID NO: 331628 - DNA, 16 bp, C. familiaris
ttaaattttcaaaaga

SEQ ID NO: 331629 - DNA, 16 bp, C. familiaris
ttaaattttctagtaa

SEQ ID NO: 331630 - DNA, 16 bp, C. familiaris
ttaaattttgtcaaat

SEQ ID NO: 331631 - DNA, 16 bp, C. familiaris
ttaaattttttgaaga

SEQ ID NO: 331632 - DNA, 16 bp, C. familiaris
ttaacaaaatatgtat

SEQ ID NO: 331633 - DNA, 16 bp, C. familiaris
ttaacaataaaaagga

SEQ ID NO: 331634 - DNA, 16 bp, C. familiaris
ttaacacattttgtat

SEQ ID NO: 331635 - DNA, 16 bp, C. familiaris
ttaacagaagaggaaa

SEQ ID NO: 331636 - DNA, 16 bp, C. familiaris
ttaacagatgaagaaa

SEQ ID NO: 331637 - DNA, 16 bp, C. familiaris
ttaaccaacagaaatt

SEQ ID NO: 331638 - DNA, 16 bp, C. familiaris
ttaaccagcagagcca

SEQ ID NO: 331639 - DNA, 16 bp, C. familiaris
ttaaccatcagtttgt

SEQ ID NO: 331640 - DNA, 16 bp, C. familiaris
ttaacccactgcacca

SEQ ID NO: 331641 - DNA, 16 bp, C. familiaris
ttaactaaatttattg

SEQ ID NO: 331642 - DNA, 16 bp, C. familiaris
ttaactcaaaatgcat

SEQ ID NO: 331643 - DNA, 16 bp, C. familiaris
ttaactgacccagcca

SEQ ID NO: 331644 - DNA, 16 bp, C. familiaris
ttaactgtttgaagaa

SEQ ID NO: 331645 - DNA, 16 bp, C. familiaris
ttaactgtttttaaaa

SEQ ID NO: 331646 - DNA, 16 bp, C. familiaris
ttaacttaaattcaat

SEQ ID NO: 331647 - DNA, 16 bp, C. familiaris
ttaagaaaaaaatcag

SEQ ID NO: 331648 - DNA, 16 bp, C. familiaris
ttaagaaaaaataact

SEQ ID NO: 331649 - DNA, 16 bp, C. familiaris
ttaagaaaaactttta

SEQ ID NO: 331650 - DNA, 16 bp, C. familiaris
ttaagaaaacagatga

SEQ ID NO: 331651 - DNA, 16 bp, C. familiaris
ttaagaaaccagaaaa

SEQ ID NO: 331652 - DNA, 16 bp, C. familiaris
ttaagaagaaattcag

SEQ ID NO: 331653 - DNA, 16 bp, C. familiaris
ttaagaatgtatttat

SEQ ID NO: 331654 - DNA, 16 bp, C. familiaris
ttaagagagagacaga

SEQ ID NO: 331655 - DNA, 16 bp, C. familiaris
ttaagagggaaataca

SEQ ID NO: 331656 - DNA, 16 bp, C. familiaris
ttaagagtttgtttct

SEQ ID NO: 331657 - DNA, 16 bp, C. familiaris
ttaagattaaatgaga

SEQ ID NO: 331658 - DNA, 16 bp, C. familiaris
ttaagcaggctccacg

SEQ ID NO: 331659 - DNA, 16 bp, C. familiaris
ttaaggaaaaatgtgg

SEQ ID NO: 331660 - DNA, 16 bp, C. familiaris
ttaaggaagagaaaat

SEQ ID NO: 331661 - DNA, 16 bp, C. familiaris
ttaaggagttgatccc

SEQ ID NO: 331662 - DNA, 16 bp, C. familiaris
ttaaggttaaatgagg

SEQ ID NO: 331663 - DNA, 16 bp, C. familiaris
ttaagtattttcttta

SEQ ID NO: 331664 - DNA, 16 bp, C. familiaris
ttaagtctgccatttt

SEQ ID NO: 331665 - DNA, 16 bp, C. familiaris
ttaagtgaaataaacc

SEQ ID NO: 331666 - DNA, 16 bp, C. familiaris
ttaagtttttacattt

SEQ ID NO: 331667 - DNA, 16 bp, C. familiaris
ttaataaaatcaagaa

SEQ ID NO: 331668 - DNA, 16 bp, C. familiaris
ttaataaagttgattt

SEQ ID NO: 331669 - DNA, 16 bp, C. familiaris
ttaataaatgcagaaa

SEQ ID NO: 331670 - DNA, 16 bp, C. familiaris
ttaataacagtaataa

SEQ ID NO: 331671 - DNA, 16 bp, C. familiaris
ttaatatggtgaatta

SEQ ID NO: 331672 - DNA, 16 bp, C. familiaris
ttaatcaacagagcca

SEQ ID NO: 331673 - DNA, 16 bp, C. familiaris
ttaatcatgagaaaac

SEQ ID NO: 331674 - DNA, 16 bp, C. familiaris
ttaatctctctgagct

SEQ ID NO: 331675 - DNA, 16 bp, C. familiaris
ttaatctgaaaaaaaa

SEQ ID NO: 331676 - DNA, 16 bp, C. familiaris
ttaatgaaatagaaac

SEQ ID NO: 331677 - DNA, 16 bp, C. familiaris
ttaatgagagacacag

SEQ ID NO: 331678 - DNA, 16 bp, C. familiaris
ttaatgagatatttta

SEQ ID NO: 331679 - DNA, 16 bp, C. familiaris
ttaatgatgaaagact

SEQ ID NO: 331680 - DNA, 16 bp, C. familiaris
ttaatgcaaaaaataa

SEQ ID NO: 331681 - DNA, 16 bp, C. familiaris
ttaatgccgcctgcag

SEQ ID NO: 331682 - DNA, 16 bp, C. familiaris
ttaatggaatatttta

SEQ ID NO: 331683 - DNA, 16 bp, C. familiaris
ttaatgtgctgctgaa

SEQ ID NO: 331684 - DNA, 16 bp, C. familiaris
ttaatgttgttaaaat

SEQ ID NO: 331685 - DNA, 16 bp, C. familiaris
ttaattatttgagaga

SEQ ID NO: 331686 - DNA, 16 bp, C. familiaris
ttaattcttctaatcc

SEQ ID NO: 331687 - DNA, 16 bp, C. familiaris
ttaattgaattgtttg

SEQ ID NO: 331688 - DNA, 16 bp, C. familiaris
ttaattgagttctgct

SEQ ID NO: 331689 - DNA, 16 bp, C. familiaris
ttaatttcagaaaaat

SEQ ID NO: 331690 - DNA, 16 bp, C. familiaris
ttaatttcagagagag

SEQ ID NO: 331691 - DNA, 16 bp, C. familiaris
ttaatttcatattttg

SEQ ID NO: 331692 - DNA, 16 bp, C. familiaris
ttaatttcatgtgtca

SEQ ID NO: 331693 - DNA, 16 bp, C. familiaris
ttaatttcctgatttt

SEQ ID NO: 331694 - DNA, 16 bp, C. familiaris
ttaattttgggggaaa

SEQ ID NO: 331695 - DNA, 16 bp, C. familiaris
ttaattttgtaaaaga

SEQ ID NO: 331696 - DNA, 16 bp, C. familiaris
ttaattttgtgaaaat

SEQ ID NO: 331697 - DNA, 16 bp, C. familiaris
ttaatttttaaagtag

SEQ ID NO: 331698 - DNA, 16 bp, C. familiaris
ttaatttttgaagaac

SEQ ID NO: 331699 - DNA, 16 bp, C. familiaris
ttaattttttccccca

SEQ ID NO: 331700 - DNA, 16 bp, C. familiaris
ttacaaaaaatgttaa

SEQ ID NO: 331701 - DNA, 16 bp, C. familiaris
ttacaaaaattgtttt

SEQ ID NO: 331702 - DNA, 16 bp, C. familiaris
ttacaaaagaaaatat

SEQ ID NO: 331703 - DNA, 16 bp, C. familiaris
ttacaaagtgaaagaa

SEQ ID NO: 331704 - DNA, 16 bp, C. familiaris
ttacaacatggcagct

SEQ ID NO: 331705 - DNA, 16 bp, C. familiaris
ttacaagaaatgctga

SEQ ID NO: 331706 - DNA, 16 bp, C. familiaris
ttacaagagccaaatt

SEQ ID NO: 331707 - DNA, 16 bp, C. familiaris
ttacaagatgaaaaga

SEQ ID NO: 331708 - DNA, 16 bp, C. familiaris
ttacacacacatacac

SEQ ID NO: 331709 - DNA, 16 bp, C. familiaris
ttacacagcaaaagct

SEQ ID NO: 331710 - DNA, 16 bp, C. familiaris
ttacacatttaaaaat

SEQ ID NO: 331711 - DNA, 16 bp, C. familiaris
ttacagaaaaattttg

SEQ ID NO: 331712 - DNA, 16 bp, C. familiaris
ttacagaaaatataaa

SEQ ID NO: 331713 - DNA, 16 bp, C. familiaris
ttacagaaagaaagaa

SEQ ID NO: 331714 - DNA, 16 bp, C. familiaris
ttacagaaatagaaaa

SEQ ID NO: 331715 - DNA, 16 bp, C. familiaris
ttacagaaatagaaca

SEQ ID NO: 331716 - DNA, 16 bp, C. familiaris
ttacagaaatggagaa

SEQ ID NO: 331717 - DNA, 16 bp, C. familiaris
ttacagaagtaatcaa

SEQ ID NO: 331718 - DNA, 16 bp, C. familiaris
ttacagatgaagacac

SEQ ID NO: 331719 - DNA, 16 bp, C. familiaris
ttacagatgacataat

SEQ ID NO: 331720 - DNA, 16 bp, C. familiaris
ttacagatggagaaaa

SEQ ID NO: 331721 - DNA, 16 bp, C. familiaris
ttacagcagcccaagc

SEQ ID NO: 331722 - DNA, 16 bp, C. familiaris
ttacagcagccctaga

SEQ ID NO: 331723 - DNA, 16 bp, C. familiaris
ttacaggaaatacaga

SEQ ID NO: 331724 - DNA, 16 bp, C. familiaris
ttacagggtcctcctt

SEQ ID NO: 331725 - DNA, 16 bp, C. familiaris
ttacagttgatgaacc

SEQ ID NO: 331726 - DNA, 16 bp, C. familiaris
ttacagttttcagaat

SEQ ID NO: 331727 - DNA, 16 bp, C. familiaris
ttacagtttttaaaaa

SEQ ID NO: 331728 - DNA, 16 bp, C. familiaris
ttacataaatgaaaaa

SEQ ID NO: 331729 - DNA, 16 bp, C. familiaris
ttacatagtcatgatt

SEQ ID NO: 331730 - DNA, 16 bp, C. familiaris
ttacatatattgtgaa

SEQ ID NO: 331731 - DNA, 16 bp, C. familiaris
ttacatctgcaaaaac

SEQ ID NO: 331732 - DNA, 16 bp, C. familiaris
ttacatcttgttttat

SEQ ID NO: 331733 - DNA, 16 bp, C. familiaris
ttacatggcagaaggg

SEQ ID NO: 331734 - DNA, 16 bp, C. familiaris
ttacattgattttgta

SEQ ID NO: 331735 - DNA, 16 bp, C. familiaris
ttacatttcacatttt

SEQ ID NO: 331736 - DNA, 16 bp, C. familiaris
ttaccaaggatgaacc

SEQ ID NO: 331737 - DNA, 16 bp, C. familiaris
ttaccaatgtggatgc

SEQ ID NO: 331738 - DNA, 16 bp, C. familiaris
ttaccagggaaatgca

SEQ ID NO: 331739 - DNA, 16 bp, C. familiaris
ttacccaaagaagaca

SEQ ID NO: 331740 - DNA, 16 bp, C. familiaris
ttacctcaaaatggat

SEQ ID NO: 331741 - DNA, 16 bp, C. familiaris
ttacctctttggtgag

SEQ ID NO: 331742 - DNA, 16 bp, C. familiaris
ttacctggtcagcact

SEQ ID NO: 331743 - DNA, 16 bp, C. familiaris
ttaccttagagatgaa

SEQ ID NO: 331744 - DNA, 16 bp, C. familiaris
ttaccttttaaaaaat

SEQ ID NO: 331745 - DNA, 16 bp, C. familiaris
ttactatggctttgta

SEQ ID NO: 331746 - DNA, 16 bp, C. familiaris
ttactcaaagaaaatg

SEQ ID NO: 331747 - DNA, 16 bp, C. familiaris
ttactcaatgctcacc

SEQ ID NO: 331748 - DNA, 16 bp, C. familiaris
ttactcagagctcatc

SEQ ID NO: 331749 - DNA, 16 bp, C. familiaris
ttactctaaatgtaaa

SEQ ID NO: 331750 - DNA, 16 bp, C. familiaris
ttactgaaaaagagca

SEQ ID NO: 331751 - DNA, 16 bp, C. familiaris
ttactgatgaggaaat

SEQ ID NO: 331752 - DNA, 16 bp, C. familiaris
ttactgattctttctt

SEQ ID NO: 331753 - DNA, 19 bp, C. familiaris
ttactgccaggaaacaaag

SEQ ID NO: 331754 - DNA, 16 bp, C. familiaris
ttactgcctatgcttt

SEQ ID NO: 331755 - DNA, 16 bp, C. familiaris
ttactgctggagctga

SEQ ID NO: 331756 - DNA, 16 bp, C. familiaris
ttactgtatgtaaatt

SEQ ID NO: 331757 - DNA, 16 bp, C. familiaris
ttactgtgggagctga

SEQ ID NO: 331758 - DNA, 16 bp, C. familiaris
ttactgttattattat

SEQ ID NO: 331759 - DNA, 16 bp, C. familiaris
ttacttaagaataaaa

SEQ ID NO: 331760 - DNA, 16 bp, C. familiaris
ttacttaagattttat

SEQ ID NO: 331761 - DNA, 16 bp, C. familiaris
ttacttatttattcgt

SEQ ID NO: 331762 - DNA, 16 bp, C. familiaris
ttacttatttgggaga

SEQ ID NO: 331763 - DNA, 16 bp, C. familiaris
ttacttatttgttcat

SEQ ID NO: 331764 - DNA, 16 bp, C. familiaris
ttactttaaaaaatga

SEQ ID NO: 331765 - DNA, 16 bp, C. familiaris
ttactttaaaaatatg

SEQ ID NO: 331766 - DNA, 16 bp, C. familiaris
ttactttgaaatattt

SEQ ID NO: 331767 - DNA, 16 bp, C. familiaris
ttactttttgccattt

SEQ ID NO: 331768 - DNA, 16 bp, C. familiaris
ttagaaaaagaacaga

SEQ ID NO: 331769 - DNA, 16 bp, C. familiaris
ttagaaaaatattgct

SEQ ID NO: 331770 - DNA, 16 bp, C. familiaris
ttagaaaacttaaaat

SEQ ID NO: 331771 - DNA, 16 bp, C. familiaris
ttagaaaatatgtttt

SEQ ID NO: 331772 - DNA, 16 bp, C. familiaris
ttagaaaatgagcaaa

SEQ ID NO: 331773 - DNA, 16 bp, C. familiaris
ttagaaaatgcagaaa

SEQ ID NO: 331774 - DNA, 16 bp, C. familiaris
ttagaaaatgggcaga

SEQ ID NO: 331775 - DNA, 16 bp, C. familiaris
ttagaaaatgtttctt

SEQ ID NO: 331776 - DNA, 16 bp, C. familiaris
ttagaaacattgagaa

SEQ ID NO: 331777 - DNA, 16 bp, C. familiaris
ttagaaaggaagacaa

SEQ ID NO: 331778 - DNA, 16 bp, C. familiaris
ttagaaatgtccttta

SEQ ID NO: 331779 - DNA, 16 bp, C. familiaris
ttagaacattttttaa

SEQ ID NO: 331780 - DNA, 16 bp, C. familiaris
ttagaagaaaatgtag

SEQ ID NO: 331781 - DNA, 16 bp, C. familiaris
ttagaagaaatggaca

SEQ ID NO: 331782 - DNA, 16 bp, C. familiaris
ttagagaagaagacaa

SEQ ID NO: 331783 - DNA, 16 bp, C. familiaris
ttagagggaaagcatt

SEQ ID NO: 331784 - DNA, 16 bp, C. familiaris
ttagattttttaaaag

SEQ ID NO: 331785 - DNA, 16 bp, C. familiaris
ttagatttttttccta

SEQ ID NO: 331786 - DNA, 16 bp, C. familiaris
ttagcaaaatgtcctc

SEQ ID NO: 331787 - DNA, 16 bp, C. familiaris
ttagcaaggagcctgc

SEQ ID NO: 331788 - DNA, 16 bp, C. familiaris
ttagcagctgcctttg

SEQ ID NO: 331789 - DNA, 16 bp, C. familiaris
ttagcaggaaaaaaaa

SEQ ID NO: 331790 - DNA, 16 bp, C. familiaris
ttagcagtttttaaaa

SEQ ID NO: 331791 - DNA, 16 bp, C. familiaris
ttagcctcattttaca

SEQ ID NO: 331792 - DNA, 16 bp, C. familiaris
ttagctttgtatttga

SEQ ID NO: 331793 - DNA, 16 bp, C. familiaris
ttaggaaaaattattt

SEQ ID NO: 331794 - DNA, 16 bp, C. familiaris
ttaggaaacaacagat

SEQ ID NO: 331795 - DNA, 16 bp, C. familiaris
ttaggaataaagctgc

SEQ ID NO: 331796 - DNA, 16 bp, C. familiaris
ttaggaatctttatgt

SEQ ID NO: 331797 - DNA, 16 bp, C. familiaris
ttaggatggaatattc

SEQ ID NO: 331798 - DNA, 16 bp, C. familiaris
ttaggccataaaacaa

SEQ ID NO: 331799 - DNA, 23 bp, C. familiaris
ttagggagctcggtgcactctcc

SEQ ID NO: 331800 - DNA, 16 bp, C. familiaris
ttaggggctcctgggt

SEQ ID NO: 331801 - DNA, 16 bp, C. familiaris
ttagtattccatttta

SEQ ID NO: 331802 - DNA, 16 bp, C. familiaris
ttagtgaagatgtgga

SEQ ID NO: 331803 - DNA, 16 bp, C. familiaris
ttagtggcttaaaaga

SEQ ID NO: 331804 - DNA, 16 bp, C. familiaris
ttagtgtataaaaatg

SEQ ID NO: 331805 - DNA, 16 bp, C. familiaris
ttagttccaggagttt

SEQ ID NO: 331806 - DNA, 16 bp, C. familiaris
ttagttcttttaaaaa

SEQ ID NO: 331807 - DNA, 16 bp, C. familiaris
ttagtttcctcaccta

SEQ ID NO: 331808 - DNA, 16 bp, C. familiaris
ttagtttcctgttgct

SEQ ID NO: 331809 - DNA, 16 bp, C. familiaris
ttagttttgtaggaaa

SEQ ID NO: 331810 - DNA, 16 bp, C. familiaris
ttataaaagtgatttt

SEQ ID NO: 331811 - DNA, 16 bp, C. familiaris
ttataaaatattccaa

SEQ ID NO: 331812 - DNA, 16 bp, C. familiaris
ttataaacacacacac

SEQ ID NO: 331813 - DNA, 16 bp, C. familiaris
ttataaaggaaggaaa

SEQ ID NO: 331814 - DNA, 16 bp, C. familiaris
ttataaataaagttgt

SEQ ID NO: 331815 - DNA, 16 bp, C. familiaris
ttataaatgacatatc

SEQ ID NO: 331816 - DNA, 16 bp, C. familiaris
ttataaatgaggaaaa

SEQ ID NO: 331817 - DNA, 16 bp, C. familiaris
ttataaatgaggaaat

SEQ ID NO: 331818 - DNA, 16 bp, C. familiaris
ttataaatttgtcaaa

SEQ ID NO: 331819 - DNA, 16 bp, C. familiaris
ttataacagcattatc

SEQ ID NO: 331820 - DNA, 16 bp, C. familiaris
ttataagaaaactaca

SEQ ID NO: 331821 - DNA, 16 bp, C. familiaris
ttataagaaatgtcca

SEQ ID NO: 331822 - DNA, 16 bp, C. familiaris
ttataagaagagaaga

SEQ ID NO: 331823 - DNA, 16 bp, C. familiaris
ttataagcagattttt

SEQ ID NO: 331824 - DNA, 16 bp, C. familiaris
ttataaggactccagt

SEQ ID NO: 331825 - DNA, 16 bp, C. familiaris
ttataataaatctctt

SEQ ID NO: 331826 - DNA, 16 bp, C. familiaris
ttataataaccaagat

SEQ ID NO: 331827 - DNA, 16 bp, C. familiaris
ttataatcctttgtat

SEQ ID NO: 331828 - DNA, 16 bp, C. familiaris
ttatacaactgaaact

SEQ ID NO: 331829 - DNA, 16 bp, C. familiaris
ttatacagcaatagat

SEQ ID NO: 331830 - DNA, 16 bp, C. familiaris
ttatacatattttgtt

SEQ ID NO: 331831 - DNA, 16 bp, C. familiaris
ttatacattgttggtg

SEQ ID NO: 331832 - DNA, 16 bp, C. familiaris
ttatagaatgaatgaa

SEQ ID NO: 331833 - DNA, 16 bp, C. familiaris
ttatagatgtatcttg

SEQ ID NO: 331834 - DNA, 16 bp, C. familiaris
ttataggaagaggaaa

SEQ ID NO: 331835 - DNA, 16 bp, C. familiaris
ttatatatatagacca

SEQ ID NO: 331836 - DNA, 16 bp, C. familiaris
ttatatattgtagata

SEQ ID NO: 331837 - DNA, 16 bp, C. familiaris
ttatatattttccaaa

SEQ ID NO: 331838 - DNA, 16 bp, C. familiaris
ttatatgctatatttt

SEQ ID NO: 331839 - DNA, 16 bp, C. familiaris
ttatatggggagaaat

SEQ ID NO: 331840 - DNA, 16 bp, C. familiaris
ttatatgtatacatat

SEQ ID NO: 331841 - DNA, 16 bp, C. familiaris
ttatatgtatttattc

SEQ ID NO: 331842 - DNA, 16 bp, C. familiaris
ttatatgtgtatgtat

SEQ ID NO: 331843 - DNA, 16 bp, C. familiaris
ttatattcacataaaa

SEQ ID NO: 331844 - DNA, 16 bp, C. familiaris
ttatattccccagatg

SEQ ID NO: 331845 - DNA, 16 bp, C. familiaris
ttatatttcagaattt

SEQ ID NO: 331846 - DNA, 16 bp, C. familiaris
ttatattttcagaaaa

SEQ ID NO: 331847 - DNA, 16 bp, C. familiaris
ttatatttttctaaag

SEQ ID NO: 331848 - DNA, 16 bp, C. familiaris
ttatcaaaatcaggaa

SEQ ID NO: 331849 - DNA, 16 bp, C. familiaris
ttatcaaaatttgtga

SEQ ID NO: 331850 - DNA, 16 bp, C. familiaris
ttatcaaattcaggaa

SEQ ID NO: 331851 - DNA, 16 bp, C. familiaris
ttatcaggaaaacaaa

SEQ ID NO: 331852 - DNA, 16 bp, C. familiaris
ttatcaggtatgtcat

SEQ ID NO: 331853 - DNA, 16 bp, C. familiaris
ttatcagttctaacag

SEQ ID NO: 331854 - DNA, 16 bp, C. familiaris
ttatcagttttattga

SEQ ID NO: 331855 - DNA, 16 bp, C. familiaris
ttatcatttaggaaat

SEQ ID NO: 331856 - DNA, 16 bp, C. familiaris
ttatccattcagctac

SEQ ID NO: 331857 - DNA, 16 bp, C. familiaris
ttatccccattttaca

SEQ ID NO: 331858 - DNA, 16 bp, C. familiaris
ttatcctcattttaaa

SEQ ID NO: 331859 - DNA, 16 bp, C. familiaris
ttatcctgaaaaccta

SEQ ID NO: 331860 - DNA, 16 bp, C. familiaris
ttatccttcattctat

SEQ ID NO: 331861 - DNA, 16 bp, C. familiaris
ttatctatggtgatag

SEQ ID NO: 331862 - DNA, 16 bp, C. familiaris
ttatctcactcagcat

SEQ ID NO: 331863 - DNA, 16 bp, C. familiaris
ttatctctctcaaata

SEQ ID NO: 331864 - DNA, 16 bp, C. familiaris
ttatctgaaattcaag

SEQ ID NO: 331865 - DNA, 16 bp, C. familiaris
ttatctgaaggaaatg

SEQ ID NO: 331866 - DNA, 16 bp, C. familiaris
ttatctgacagagaaa

SEQ ID NO: 331867 - DNA, 16 bp, C. familiaris
ttatctgatatgtctt

SEQ ID NO: 331868 - DNA, 16 bp, C. familiaris
ttatctgcaaatagtg

SEQ ID NO: 331869 - DNA, 16 bp, C. familiaris
ttatctttatctttgg

SEQ ID NO: 331870 - DNA, 16 bp, C. familiaris
ttatctttgaatttgt

SEQ ID NO: 331871 - DNA, 16 bp, C. familiaris
ttatcttttagagata

SEQ ID NO: 331872 - DNA, 16 bp, C. familiaris
ttatgaaaaacaaaac

SEQ ID NO: 331873 - DNA, 16 bp, C. familiaris
ttatgaaacaaacaaa

SEQ ID NO: 331874 - DNA, 16 bp, C. familiaris
ttatgaagaaaataca

SEQ ID NO: 331875 - DNA, 16 bp, C. familiaris
ttatgacagatacaga

SEQ ID NO: 331876 - DNA, 16 bp, C. familiaris
ttatgactgcttttgc

SEQ ID NO: 331877 - DNA, 16 bp, C. familiaris
ttatgagagatacaga

SEQ ID NO: 331878 - DNA, 16 bp, C. familiaris
ttatgagatgcagcaa

SEQ ID NO: 331879 - DNA, 16 bp, C. familiaris
ttatgcaagaaaaaga

SEQ ID NO: 331880 - DNA, 16 bp, C. familiaris
ttatgcagaaaaaaaa

SEQ ID NO: 331881 - DNA, 16 bp, C. familiaris
ttatgcagctataaaa

SEQ ID NO: 331882 - DNA, 16 bp, C. familiaris
ttatgccagtactaca

SEQ ID NO: 331883 - DNA, 16 bp, C. familiaris
ttatgccctgaatgtg

SEQ ID NO: 331884 - DNA, 16 bp, C. familiaris
ttatgccctgggctga

SEQ ID NO: 331885 - DNA, 16 bp, C. familiaris
ttatgctaagcaaaaa

SEQ ID NO: 331886 - DNA, 16 bp, C. familiaris
ttatgctcagtgaagt

SEQ ID NO: 331887 - DNA, 16 bp, C. familiaris
ttatgctgtatgttgg

SEQ ID NO: 331888 - DNA, 16 bp, C. familiaris
ttatggaaattttaaa

SEQ ID NO: 331889 - DNA, 16 bp, C. familiaris
ttatggagaaaattat

SEQ ID NO: 331890 - DNA, 16 bp, C. familiaris
ttatggaggctgagaa

SEQ ID NO: 331891 - DNA, 16 bp, C. familiaris
ttatggaggctggcaa

SEQ ID NO: 331892 - DNA, 16 bp, C. familiaris
ttatggtctctctctc

SEQ ID NO: 331893 - DNA, 16 bp, C. familiaris
ttatgtcaaatatttt

SEQ ID NO: 331894 - DNA, 16 bp, C. familiaris
ttatgtcctttaaaaa

SEQ ID NO: 331895 - DNA, 16 bp, C. familiaris
ttatgtgccaaacact

SEQ ID NO: 331896 - DNA, 16 bp, C. familiaris
ttatgttaatgaggta

SEQ ID NO: 331897 - DNA, 16 bp, C. familiaris
ttatgtttcctcattt

SEQ ID NO: 331898 - DNA, 16 bp, C. familiaris
ttattaaaaacaagag

SEQ ID NO: 331899 - DNA, 16 bp, C. familiaris
ttattaagtaaactct

SEQ ID NO: 331900 - DNA, 16 bp, C. familiaris
ttattaagtatgatgt

SEQ ID NO: 331901 - DNA, 16 bp, C. familiaris
ttattataaaaggatg

SEQ ID NO: 331902 - DNA, 16 bp, C. familiaris
ttattatgagaattaa

SEQ ID NO: 331903 - DNA, 16 bp, C. familiaris
ttattattattacaga

SEQ ID NO: 331904 - DNA, 16 bp, C. familiaris
ttattcaaaagaaaaa

SEQ ID NO: 331905 - DNA, 16 bp, C. familiaris
ttattcaagaaaaaca

SEQ ID NO: 331906 - DNA, 16 bp, C. familiaris
ttattcagaaaaataa

SEQ ID NO: 331907 - DNA, 16 bp, C. familiaris
ttattcatgagaatga

SEQ ID NO: 331908 - DNA, 16 bp, C. familiaris
ttattcatgagagaga

SEQ ID NO: 331909 - DNA, 16 bp, C. familiaris
ttattcattaaagaca

SEQ ID NO: 331910 - DNA, 16 bp, C. familiaris
ttattcattcaaaaaa

SEQ ID NO: 331911 - DNA, 16 bp, C. familiaris
ttattcattcatcaga

SEQ ID NO: 331912 - DNA, 16 bp, C. familiaris
ttattcatttaaaaag

SEQ ID NO: 331913 - DNA, 16 bp, C. familiaris
ttattccaaaataaag

SEQ ID NO: 331914 - DNA, 16 bp, C. familiaris
ttattcctgagagaga

SEQ ID NO: 331915 - DNA, 16 bp, C. familiaris
ttattctaaaatgtat

SEQ ID NO: 331916 - DNA, 16 bp, C. familiaris
ttattctacatgttgg

SEQ ID NO: 331917 - DNA, 16 bp, C. familiaris
ttattctagttctgtg

SEQ ID NO: 331918 - DNA, 16 bp, C. familiaris
ttattctgaatgtaaa

SEQ ID NO: 331919 - DNA, 16 bp, C. familiaris
ttattctgttccattg

SEQ ID NO: 331920 - DNA, 16 bp, C. familiaris
ttattcttgacagaca

SEQ ID NO: 331921 - DNA, 16 bp, C. familiaris
ttattctttcaaaaat

SEQ ID NO: 331922 - DNA, 16 bp, C. familiaris
ttattgaacaaatgaa

SEQ ID NO: 331923 - DNA, 16 bp, C. familiaris
ttattgatttatttca

SEQ ID NO: 331924 - DNA, 16 bp, C. familiaris
ttattggaacatggcc

SEQ ID NO: 331925 - DNA, 16 bp, C. familiaris
ttattgtgaaataatt

SEQ ID NO: 331926 - DNA, 16 bp, C. familiaris
ttattgttgctattgt

SEQ ID NO: 331927 - DNA, 16 bp, C. familiaris
ttatttatgaaagaga

SEQ ID NO: 331928 - DNA, 16 bp, C. familiaris
ttatttattacagtca

SEQ ID NO: 331929 - DNA, 16 bp, C. familiaris
ttatttattagagata

SEQ ID NO: 331930 - DNA, 16 bp, C. familiaris
ttatttattcaaaaga

SEQ ID NO: 331931 - DNA, 16 bp, C. familiaris
ttatttattcagagaa

SEQ ID NO: 331932 - DNA, 16 bp, C. familiaris
ttatttattgggggga

SEQ ID NO: 331933 - DNA, 16 bp, C. familiaris
ttatttcactgagaaa

SEQ ID NO: 331934 - DNA, 16 bp, C. familiaris
ttatttccaacatttt

SEQ ID NO: 331935 - DNA, 16 bp, C. familiaris
ttatttccattataaa

SEQ ID NO: 331936 - DNA, 16 bp, C. familiaris
ttatttctcacacttc

SEQ ID NO: 331937 - DNA, 16 bp, C. familiaris
ttatttctctgtgtgt

SEQ ID NO: 331938 - DNA, 16 bp, C. familiaris
ttatttctgatgaaaa

SEQ ID NO: 331939 - DNA, 16 bp, C. familiaris
ttatttcttagaaaaa

SEQ ID NO: 331940 - DNA, 16 bp, C. familiaris
ttatttcttagagaaa

SEQ ID NO: 331941 - DNA, 16 bp, C. familiaris
ttatttcttcaagtat

SEQ ID NO: 331942 - DNA, 16 bp, C. familiaris
ttatttgacaatgctt

SEQ ID NO: 331943 - DNA, 16 bp, C. familiaris
ttatttgctgttctct

SEQ ID NO: 331944 - DNA, 16 bp, C. familiaris
ttatttgctttttaaa

SEQ ID NO: 331945 - DNA, 16 bp, C. familiaris
ttatttggaaaaagag

SEQ ID NO: 331946 - DNA, 16 bp, C. familiaris
ttatttggaaaataaa

SEQ ID NO: 331947 - DNA, 16 bp, C. familiaris
ttatttggaaataaat

SEQ ID NO: 331948 - DNA, 16 bp, C. familiaris
ttatttgtaaaacaaa

SEQ ID NO: 331949 - DNA, 16 bp, C. familiaris
ttattttaaaactgta

SEQ ID NO: 331950 - DNA, 16 bp, C. familiaris
ttattttaaaatgcaa

SEQ ID NO: 331951 - DNA, 16 bp, C. familiaris
ttattttaaatagcat

SEQ ID NO: 331952 - DNA, 16 bp, C. familiaris
ttattttaaatggaaa

SEQ ID NO: 331953 - DNA, 16 bp, C. familiaris
ttattttagagacaca

SEQ ID NO: 331954 - DNA, 16 bp, C. familiaris
ttattttatagatttc

SEQ ID NO: 331955 - DNA, 16 bp, C. familiaris
ttattttatggatatc

SEQ ID NO: 331956 - DNA, 16 bp, C. familiaris
ttattttccaagtttt

SEQ ID NO: 331957 - DNA, 16 bp, C. familiaris
ttattttcctcttaaa

SEQ ID NO: 331958 - DNA, 16 bp, C. familiaris
ttattttcttaaagat

SEQ ID NO: 331959 - DNA, 16 bp, C. familiaris
ttattttgaaaacatt

SEQ ID NO: 331960 - DNA, 16 bp, C. familiaris
ttattttgaaatgctt

SEQ ID NO: 331961 - DNA, 16 bp, C. familiaris
ttattttgaagatgaa

SEQ ID NO: 331962 - DNA, 16 bp, C. familiaris
ttattttgaagcaaat

SEQ ID NO: 331963 - DNA, 16 bp, C. familiaris
ttattttgaatcattt

SEQ ID NO: 331964 - DNA, 16 bp, C. familiaris
ttattttgatggagtc

SEQ ID NO: 331965 - DNA, 16 bp, C. familiaris
ttattttgccagcaaa

SEQ ID NO: 331966 - DNA, 16 bp, C. familiaris
ttattttgctacattt

SEQ ID NO: 331967 - DNA, 16 bp, C. familiaris
ttattttgcttcttaa

SEQ ID NO: 331968 - DNA, 16 bp, C. familiaris
ttattttgctttgcat

SEQ ID NO: 331969 - DNA, 16 bp, C. familiaris
ttattttggaaaaaaa

SEQ ID NO: 331970 - DNA, 16 bp, C. familiaris
ttatttttatatcaga

SEQ ID NO: 331971 - DNA, 16 bp, C. familiaris
ttatttttcaaaaaga

SEQ ID NO: 331972 - DNA, 16 bp, C. familiaris
ttatttttcaaaacaa

SEQ ID NO: 331973 - DNA, 16 bp, C. familiaris
ttatttttcacagttc

SEQ ID NO: 331974 - DNA, 16 bp, C. familiaris
ttatttttcagataat

SEQ ID NO: 331975 - DNA, 16 bp, C. familiaris
ttatttttccaggaaa

SEQ ID NO: 331976 - DNA, 16 bp, C. familiaris
ttatttttcctcaaaa

SEQ ID NO: 331977 - DNA, 16 bp, C. familiaris
ttatttttcctctaaa

SEQ ID NO: 331978 - DNA, 16 bp, C. familiaris
ttatttttcctttgga

SEQ ID NO: 331979 - DNA, 16 bp, C. familiaris
ttatttttcttccaaa

SEQ ID NO: 331980 - DNA, 16 bp, C. familiaris
ttatttttggaaaaaa

SEQ ID NO: 331981 - DNA, 16 bp, C. familiaris
ttattttttaaagaga

SEQ ID NO: 331982 - DNA, 16 bp, C. familiaris
ttattttttcccaaat

SEQ ID NO: 331983 - DNA, 16 bp, C. familiaris
ttattttttgccttcc

SEQ ID NO: 331984 - DNA, 16 bp, C. familiaris
ttatttttttctaaga

SEQ ID NO: 331985 - DNA, 16 bp, C. familiaris
ttcaaaaaagaaatta

SEQ ID NO: 331986 - DNA, 16 bp, C. familiaris
ttcaaaaagatcaaag

SEQ ID NO: 331987 - DNA, 16 bp, C. familiaris
ttcaaaaatattgttt

SEQ ID NO: 331988 - DNA, 16 bp, C. familiaris
ttcaaaaattatttca

SEQ ID NO: 331989 - DNA, 16 bp, C. familiaris
ttcaaaacaaagcaaa

SEQ ID NO: 331990 - DNA, 16 bp, C. familiaris
ttcaaaactttcaaaa

SEQ ID NO: 331991 - DNA, 16 bp, C. familiaris
ttcaaaagaaaatatt

SEQ ID NO: 331992 - DNA, 16 bp, C. familiaris
ttcaaaagaatttaaa

SEQ ID NO: 331993 - DNA, 16 bp, C. familiaris
ttcaaaagacatcatt

SEQ ID NO: 331994 - DNA, 16 bp, C. familiaris
ttcaaaaggaaaagaa

SEQ ID NO: 331995 - DNA, 16 bp, C. familiaris
ttcaaaagtatttgtt

SEQ ID NO: 331996 - DNA, 16 bp, C. familiaris
ttcaaaatatttcaaa

SEQ ID NO: 331997 - DNA, 16 bp, C. familiaris
ttcaaaatcaaaatca

SEQ ID NO: 331998 - DNA, 16 bp, C. familiaris
ttcaaaatgaaattaa

SEQ ID NO: 331999 - DNA, 16 bp, C. familiaris
ttcaaaatgagaaaaa

SEQ ID NO: 332000 - DNA, 16 bp, C. familiaris
ttcaaaatgtataaaa

SEQ ID NO: 332001 - DNA, 16 bp, C. familiaris
ttcaaaatgtttattt

SEQ ID NO: 332002 - DNA, 16 bp, C. familiaris
ttcaaacatacataaa

SEQ ID NO: 332003 - DNA, 16 bp, C. familiaris
ttcaaactgcagaaaa

SEQ ID NO: 332004 - DNA, 16 bp, C. familiaris
ttcaaagaaacaagag

SEQ ID NO: 332005 - DNA, 16 bp, C. familiaris
ttcaaagaaacagaaa

SEQ ID NO: 332006 - DNA, 16 bp, C. familiaris
ttcaaagaagaaaaat

SEQ ID NO: 332007 - DNA, 16 bp, C. familiaris
ttcaaagataaaatta

SEQ ID NO: 332008 - DNA, 16 bp, C. familiaris
ttcaaagcccagctct

SEQ ID NO: 332009 - DNA, 16 bp, C. familiaris
ttcaaagctcttgttt

SEQ ID NO: 332010 - DNA, 16 bp, C. familiaris
ttcaaaggaaaaaaat

SEQ ID NO: 332011 - DNA, 16 bp, C. familiaris
ttcaaaggagaaaaaa

SEQ ID NO: 332012 - DNA, 16 bp, C. familiaris
ttcaaagtatttttaa

SEQ ID NO: 332013 - DNA, 16 bp, C. familiaris
ttcaaataaagaaaat

SEQ ID NO: 332014 - DNA, 16 bp, C. familiaris
ttcaaataaagtaatt

SEQ ID NO: 332015 - DNA, 16 bp, C. familiaris
ttcaaataatgaaaaa

SEQ ID NO: 332016 - DNA, 16 bp, C. familiaris
ttcaaatacaaaagct

SEQ ID NO: 332017 - DNA, 16 bp, C. familiaris
ttcaaatacattctaa

SEQ ID NO: 332018 - DNA, 16 bp, C. familiaris
ttcaaatatacagaaa

SEQ ID NO: 332019 - DNA, 16 bp, C. familiaris
ttcaaatattcaaatt

SEQ ID NO: 332020 - DNA, 16 bp, C. familiaris
ttcaaatattgcctct

SEQ ID NO: 332021 - DNA, 18 bp, C. familiaris
ttcaaatcatcctgaaaa

SEQ ID NO: 332022 - DNA, 16 bp, C. familiaris
ttcaaatgaagaaaat

SEQ ID NO: 332023 - DNA, 16 bp, C. familiaris
ttcaaatggtcctgaa

SEQ ID NO: 332024 - DNA, 16 bp, C. familiaris
ttcaaatgtaaatgga

SEQ ID NO: 332025 - DNA, 16 bp, C. familiaris
ttcaaattactgtttt

SEQ ID NO: 332026 - DNA, 16 bp, C. familiaris
ttcaaattagaaaaaa

SEQ ID NO: 332027 - DNA, 16 bp, C. familiaris
ttcaaattcaaatttt

SEQ ID NO: 332028 - DNA, 16 bp, C. familiaris
ttcaaatttctgtttc

SEQ ID NO: 332029 - DNA, 16 bp, C. familiaris
ttcaacaaatagtatt

SEQ ID NO: 332030 - DNA, 16 bp, C. familiaris
ttcaacaaatattgtt

SEQ ID NO: 332031 - DNA, 16 bp, C. familiaris
ttcaacaaatggtgct

SEQ ID NO: 332032 - DNA, 16 bp, C. familiaris
ttcaacaattttttaa

SEQ ID NO: 332033 - DNA, 16 bp, C. familiaris
ttcaacctctctgagc

SEQ ID NO: 332034 - DNA, 16 bp, C. familiaris
ttcaacctgagatgta

SEQ ID NO: 332035 - DNA, 16 bp, C. familiaris
ttcaacttgataaaga

SEQ ID NO: 332036 - DNA, 16 bp, C. familiaris
ttcaacttgctttttt

SEQ ID NO: 332037 - DNA, 16 bp, C. familiaris
ttcaagaaaaaatatt

SEQ ID NO: 332038 - DNA, 16 bp, C. familiaris
ttcaagaaagaaaaga

SEQ ID NO: 332039 - DNA, 16 bp, C. familiaris
ttcaagaaattatttt

SEQ ID NO: 332040 - DNA, 16 bp, C. familiaris
ttcaagaagaaaaaga

SEQ ID NO: 332041 - DNA, 16 bp, C. familiaris
ttcaagaagaaaacat

SEQ ID NO: 332042 - DNA, 16 bp, C. familiaris
ttcaagaccctgcttt

SEQ ID NO: 332043 - DNA, 16 bp, C. familiaris
ttcaagactgctttgg

SEQ ID NO: 332044 - DNA, 16 bp, C. familiaris
ttcaagatcaaggtgc

SEQ ID NO: 332045 - DNA, 16 bp, C. familiaris
ttcaagattctttttt

SEQ ID NO: 332046 - DNA, 16 bp, C. familiaris
ttcaagcagaattcaa

SEQ ID NO: 332047 - DNA, 16 bp, C. familiaris
ttcaaggaaccagctc

SEQ ID NO: 332048 - DNA, 16 bp, C. familiaris
ttcaaggttgctttgg

SEQ ID NO: 332049 - DNA, 39 bp, C. familiaris
ttcaagtatgcctgggtcttggataaactgaaagctgaa

SEQ ID NO: 332050 - DNA, 16 bp, C. familiaris
ttcaagttaaaaataa

SEQ ID NO: 332051 - DNA, 16 bp, C. familiaris
ttcaagttccatgttg

SEQ ID NO: 332052 - DNA, 16 bp, C. familiaris
ttcaataaagaaagaa

SEQ ID NO: 332053 - DNA, 16 bp, C. familiaris
ttcaatatgtatttat

SEQ ID NO: 332054 - DNA, 16 bp, C. familiaris
ttcaatccctgttttt

SEQ ID NO: 332055 - DNA, 16 bp, C. familiaris
ttcaatggaatattat

SEQ ID NO: 332056 - DNA, 16 bp, C. familiaris
ttcaatgtgaatggaa

SEQ ID NO: 332057 - DNA, 16 bp, C. familiaris
ttcaatttcctcatct

SEQ ID NO: 332058 - DNA, 16 bp, C. familiaris
ttcaattttaagtttt

SEQ ID NO: 332059 - DNA, 16 bp, C. familiaris
ttcaattttcagtttt

SEQ ID NO: 332060 - DNA, 16 bp, C. familiaris
ttcacaaaagaggaaa

SEQ ID NO: 332061 - DNA, 16 bp, C. familiaris
ttcacaaatatataca

SEQ ID NO: 332062 - DNA, 16 bp, C. familiaris
ttcacaaatgaagaaa

SEQ ID NO: 332063 - DNA, 16 bp, C. familiaris
ttcacaacattaattc

SEQ ID NO: 332064 - DNA, 16 bp, C. familiaris
ttcacaagaaacacac

SEQ ID NO: 332065 - DNA, 16 bp, C. familiaris
ttcacaagagccaaga

SEQ ID NO: 332066 - DNA, 16 bp, C. familiaris
ttcacacactctctct

SEQ ID NO: 332067 - DNA, 16 bp, C. familiaris
ttcacacctgcctttg

SEQ ID NO: 332068 - DNA, 16 bp, C. familiaris
ttcacagaagaagaca

SEQ ID NO: 332069 - DNA, 16 bp, C. familiaris
ttcacagaagaggaaa

SEQ ID NO: 332070 - DNA, 16 bp, C. familiaris
ttcacagaattgaaga

SEQ ID NO: 332071 - DNA, 16 bp, C. familiaris
ttcacagacaaggaaa

SEQ ID NO: 332072 - DNA, 16 bp, C. familiaris
ttcacagagcagaaat

SEQ ID NO: 332073 - DNA, 16 bp, C. familiaris
ttcacagaggagaaaa

SEQ ID NO: 332074 - DNA, 16 bp, C. familiaris
ttcacagaggaggaaa

SEQ ID NO: 332075 - DNA, 16 bp, C. familiaris
ttcacagcaaagaaaa

SEQ ID NO: 332076 - DNA, 16 bp, C. familiaris
ttcacaggtgaagaaa

SEQ ID NO: 332077 - DNA, 16 bp, C. familiaris
ttcacagtcccaccaa

SEQ ID NO: 332078 - DNA, 16 bp, C. familiaris
ttcacagttctggaga

SEQ ID NO: 332079 - DNA, 16 bp, C. familiaris
ttcacataaatggaat

SEQ ID NO: 332080 - DNA, 16 bp, C. familiaris
ttcacatattataaaa

SEQ ID NO: 332081 - DNA, 16 bp, C. familiaris
ttcacattattgtgca

SEQ ID NO: 332082 - DNA, 16 bp, C. familiaris
ttcacatttaatgtaa

SEQ ID NO: 332083 - DNA, 16 bp, C. familiaris
ttcacatttcacattt

SEQ ID NO: 332084 - DNA, 16 bp, C. familiaris
ttcaccaacttggaag

SEQ ID NO: 332085 - DNA, 16 bp, C. familiaris
ttcaccaagaagatat

SEQ ID NO: 332086 - DNA, 16 bp, C. familiaris
ttcacccttttaaagt

SEQ ID NO: 332087 - DNA, 16 bp, C. familiaris
ttcaccttgtgcctgg

SEQ ID NO: 332088 - DNA, 16 bp, C. familiaris
ttcactaactgaaaga

SEQ ID NO: 332089 - DNA, 16 bp, C. familiaris
ttcactcattcattca

SEQ ID NO: 332090 - DNA, 16 bp, C. familiaris
ttcactcccacccccg

SEQ ID NO: 332091 - DNA, 16 bp, C. familiaris
ttcactgatgaatttt

SEQ ID NO: 332092 - DNA, 16 bp, C. familiaris
ttcactggggaaaaaa

SEQ ID NO: 332093 - DNA, 16 bp, C. familiaris
ttcacttcacttcact

SEQ ID NO: 332094 - DNA, 16 bp, C. familiaris
ttcactttaaaaatat

SEQ ID NO: 332095 - DNA, 16 bp, C. familiaris
ttcactttcctcatct

SEQ ID NO: 332096 - DNA, 16 bp, C. familiaris
ttcactttgcagatga

SEQ ID NO: 332097 - DNA, 16 bp, C. familiaris
ttcactttttaaagaa

SEQ ID NO: 332098 - DNA, 16 bp, C. familiaris
ttcagaaaaaaatgga

SEQ ID NO: 332099 - DNA, 16 bp, C. familiaris
ttcagaaaaggaaaat

SEQ ID NO: 332100 - DNA, 16 bp, C. familiaris
ttcagaaaatgaaaaa

SEQ ID NO: 332101 - DNA, 16 bp, C. familiaris
ttcagaaaattaaaga

SEQ ID NO: 332102 - DNA, 16 bp, C. familiaris
ttcagaaagaagaaca

SEQ ID NO: 332103 - DNA, 16 bp, C. familiaris
ttcagaaagaatgaaa

SEQ ID NO: 332104 - DNA, 16 bp, C. familiaris
ttcagaaagagaaaaa

SEQ ID NO: 332105 - DNA, 16 bp, C. familiaris
ttcagaaagagaaaga

SEQ ID NO: 332106 - DNA, 16 bp, C. familiaris
ttcagaaataatgaaa

SEQ ID NO: 332107 - DNA, 16 bp, C. familiaris
ttcagaacaaggaaaa

SEQ ID NO: 332108 - DNA, 17 bp, C. familiaris
ttcagaagaataggtat

SEQ ID NO: 332109 - DNA, 16 bp, C. familiaris
ttcagaagaggaagag

SEQ ID NO: 332110 - DNA, 16 bp, C. familiaris
ttcagaagtggaccct

SEQ ID NO: 332111 - DNA, 16 bp, C. familiaris
ttcagaatatttaaaa

SEQ ID NO: 332112 - DNA, 16 bp, C. familiaris
ttcagaatatttcatc

SEQ ID NO: 332113 - DNA, 16 bp, C. familiaris
ttcagaatttattttg

SEQ ID NO: 332114 - DNA, 16 bp, C. familiaris
ttcagaattttttctt

SEQ ID NO: 332115 - DNA, 16 bp, C. familiaris
ttcagacagaaggaaa

SEQ ID NO: 332116 - DNA, 16 bp, C. familiaris
ttcagactggatgaaa

SEQ ID NO: 332117 - DNA, 16 bp, C. familiaris
ttcagagaaaaaaatt

SEQ ID NO: 332118 - DNA, 16 bp, C. familiaris
ttcagagaaaaagaaa

SEQ ID NO: 332119 - DNA, 16 bp, C. familiaris
ttcagagaaacagaaa

SEQ ID NO: 332120 - DNA, 16 bp, C. familiaris
ttcagagaaacatttt

SEQ ID NO: 332121 - DNA, 16 bp, C. familiaris
ttcagagaaatgaaat

SEQ ID NO: 332122 - DNA, 16 bp, C. familiaris
ttcagagaaattaagt

SEQ ID NO: 332123 - DNA, 16 bp, C. familiaris
ttcagagacacacaca

SEQ ID NO: 332124 - DNA, 16 bp, C. familiaris
ttcagagacctctcca

SEQ ID NO: 332125 - DNA, 16 bp, C. familiaris
ttcagagagagcaaaa

SEQ ID NO: 332126 - DNA, 16 bp, C. familiaris
ttcagagatgaggaaa

SEQ ID NO: 332127 - DNA, 16 bp, C. familiaris
ttcagagcatgatcct

SEQ ID NO: 332128 - DNA, 16 bp, C. familiaris
ttcagaggaaaggaat

SEQ ID NO: 332129 - DNA, 16 bp, C. familiaris
ttcagaggaagaaaaa

SEQ ID NO: 332130 - DNA, 16 bp, C. familiaris
ttcagaggggagtctg

SEQ ID NO: 332131 - DNA, 16 bp, C. familiaris
ttcagataaattttct

SEQ ID NO: 332132 - DNA, 16 bp, C. familiaris
ttcagatgaagaaaca

SEQ ID NO: 332133 - DNA, 16 bp, C. familiaris
ttcagatgaagaaatt

SEQ ID NO: 332134 - DNA, 16 bp, C. familiaris
ttcagatgattttttt

SEQ ID NO: 332135 - DNA, 16 bp, C. familiaris
ttcagattctttttct

SEQ ID NO: 332136 - DNA, 16 bp, C. familiaris
ttcagattttactttt

SEQ ID NO: 332137 - DNA, 16 bp, C. familiaris
ttcagattttctgctt

SEQ ID NO: 332138 - DNA, 16 bp, C. familiaris
ttcagcaccaaggaca

SEQ ID NO: 332139 - DNA, 16 bp, C. familiaris
ttcagcagcatccctg

SEQ ID NO: 332140 - DNA, 16 bp, C. familiaris
ttcagcatttgttttg

SEQ ID NO: 332141 - DNA, 16 bp, C. familiaris
ttcagcccctctggtt

SEQ ID NO: 332142 - DNA, 16 bp, C. familiaris
ttcagcctgaaggact

SEQ ID NO: 332143 - DNA, 16 bp, C. familiaris
ttcagctcaggtcatt

SEQ ID NO: 332144 - DNA, 16 bp, C. familiaris
ttcagctcatgtcatg

SEQ ID NO: 332145 - DNA, 16 bp, C. familiaris
ttcagctccagaattt

SEQ ID NO: 332146 - DNA, 16 bp, C. familiaris
ttcagctctgccactt

SEQ ID NO: 332147 - DNA, 16 bp, C. familiaris
ttcagctgctgagcca

SEQ ID NO: 332148 - DNA, 16 bp, C. familiaris
ttcaggaaaaaaattt

SEQ ID NO: 332149 - DNA, 16 bp, C. familiaris
ttcaggaaaaaagaaa

SEQ ID NO: 332150 - DNA, 16 bp, C. familiaris
ttcaggaaaacaaaaa

SEQ ID NO: 332151 - DNA, 16 bp, C. familiaris
ttcaggaaataaatga

SEQ ID NO: 332152 - DNA, 16 bp, C. familiaris
ttcaggaaatgcaaat

SEQ ID NO: 332153 - DNA, 16 bp, C. familiaris
ttcaggaagaagaaaa

SEQ ID NO: 332154 - DNA, 16 bp, C. familiaris
ttcaggaagcacagag

SEQ ID NO: 332155 - DNA, 17 bp, C. familiaris
ttcaggagagacacaca

SEQ ID NO: 332156 - DNA, 16 bp, C. familiaris
ttcaggagagatacag

SEQ ID NO: 332157 - DNA, 16 bp, C. familiaris
ttcaggaggaagaaaa

SEQ ID NO: 332158 - DNA, 16 bp, C. familiaris
ttcaggatgctttgaa

SEQ ID NO: 332159 - DNA, 16 bp, C. familiaris
ttcaggcagaagaaat

SEQ ID NO: 332160 - DNA, 16 bp, C. familiaris
ttcaggccctcagtgg

SEQ ID NO: 332161 - DNA, 16 bp, C. familiaris
ttcagggaaaaaaaaa

SEQ ID NO: 332162 - DNA, 16 bp, C. familiaris
ttcagggaaggcttct

SEQ ID NO: 332163 - DNA, 16 bp, C. familiaris
ttcagggatgcctggg

SEQ ID NO: 332164 - DNA, 16 bp, C. familiaris
ttcaggggcacctagg

SEQ ID NO: 332165 - DNA, 16 bp, C. familiaris
ttcaggggtacaacat

SEQ ID NO: 332166 - DNA, 16 bp, C. familiaris
ttcaggtgtaaaatat

SEQ ID NO: 332167 - DNA, 16 bp, C. familiaris
ttcaggtgtatgacat

SEQ ID NO: 332168 - DNA, 16 bp, C. familiaris
ttcagtaaaagaaaaa

SEQ ID NO: 332169 - DNA, 16 bp, C. familiaris
ttcagtattatttata

SEQ ID NO: 332170 - DNA, 16 bp, C. familiaris
ttcagtccctgtttct

SEQ ID NO: 332171 - DNA, 16 bp, C. familiaris
ttcagtctgcaggtgt

SEQ ID NO: 332172 - DNA, 16 bp, C. familiaris
ttcagtctttctttct

SEQ ID NO: 332173 - DNA, 16 bp, C. familiaris
ttcagtgattttttaa

SEQ ID NO: 332174 - DNA, 16 bp, C. familiaris
ttcagtgctgccttca

SEQ ID NO: 332175 - DNA, 16 bp, C. familiaris
ttcagtggctccccat

SEQ ID NO: 332176 - DNA, 16 bp, C. familiaris
ttcagttctttgaaaa

SEQ ID NO: 332177 - DNA, 16 bp, C. familiaris
ttcagtttctttctct

SEQ ID NO: 332178 - DNA, 16 bp, C. familiaris
ttcagtttgcattttc

SEQ ID NO: 332179 - DNA, 16 bp, C. familiaris
ttcagtttgccaacat

SEQ ID NO: 332180 - DNA, 16 bp, C. familiaris
ttcagttttcattttg

SEQ ID NO: 332181 - DNA, 16 bp, C. familiaris
ttcagtttttaaaaag

SEQ ID NO: 332182 - DNA, 16 bp, C. familiaris
ttcagtttttctgtaa

SEQ ID NO: 332183 - DNA, 16 bp, C. familiaris
ttcagttttttaaaag

SEQ ID NO: 332184 - DNA, 16 bp, C. familiaris
ttcataaaacatttta

SEQ ID NO: 332185 - DNA, 16 bp, C. familiaris
ttcataatactgtatt

SEQ ID NO: 332186 - DNA, 17 bp, C. familiaris
ttcatactggtgagaaa

SEQ ID NO: 332187 - DNA, 16 bp, C. familiaris
ttcatacttttaaaaa

SEQ ID NO: 332188 - DNA, 16 bp, C. familiaris
ttcatagattggaaga

SEQ ID NO: 332189 - DNA, 16 bp, C. familiaris
ttcatagtggcattat

SEQ ID NO: 332190 - DNA, 16 bp, C. familiaris
ttcatagtttctgatg

SEQ ID NO: 332191 - DNA, 16 bp, C. familiaris
ttcatatatatgaata

SEQ ID NO: 332192 - DNA, 16 bp, C. familiaris
ttcatatatggaattt

SEQ ID NO: 332193 - DNA, 16 bp, C. familiaris
ttcatatccaagagat

SEQ ID NO: 332194 - DNA, 16 bp, C. familiaris
ttcatattttgaagcc

SEQ ID NO: 332195 - DNA, 16 bp, C. familiaris
ttcatcaaaatgaaaa

SEQ ID NO: 332196 - DNA, 16 bp, C. familiaris
ttcatcactccaaaaa

SEQ ID NO: 332197 - DNA, 16 bp, C. familiaris
ttcatcagaattaaaa

SEQ ID NO: 332198 - DNA, 16 bp, C. familiaris
ttcatcaggaatattg

SEQ ID NO: 332199 - DNA, 16 bp, C. familiaris
ttcatcagggatgttg

SEQ ID NO: 332200 - DNA, 16 bp, C. familiaris
ttcatcagtcaatgaa

SEQ ID NO: 332201 - DNA, 16 bp, C. familiaris
ttcatcagttgcgtat

SEQ ID NO: 332202 - DNA, 16 bp, C. familiaris
ttcatcatcaccatca

SEQ ID NO: 332203 - DNA, 16 bp, C. familiaris
ttcatcatgaccaagt

SEQ ID NO: 332204 - DNA, 16 bp, C. familiaris
ttcatcattttcatca

SEQ ID NO: 332205 - DNA, 16 bp, C. familiaris
ttcatccaaagaaaat

SEQ ID NO: 332206 - DNA, 16 bp, C. familiaris
ttcatccatcaacaga

SEQ ID NO: 332207 - DNA, 16 bp, C. familiaris
ttcatcccaaatgaaa

SEQ ID NO: 332208 - DNA, 16 bp, C. familiaris
ttcatccttccatcca

SEQ ID NO: 332209 - DNA, 16 bp, C. familiaris
ttcatccttcctgatg

SEQ ID NO: 332210 - DNA, 16 bp, C. familiaris
ttcatccttgtgactt

SEQ ID NO: 332211 - DNA, 16 bp, C. familiaris
ttcatctattttgaat

SEQ ID NO: 332212 - DNA, 16 bp, C. familiaris
ttcatctcttctgatg

SEQ ID NO: 332213 - DNA, 16 bp, C. familiaris
ttcatctgttgttgga

SEQ ID NO: 332214 - DNA, 16 bp, C. familiaris
ttcatcttttagcaag

SEQ ID NO: 332215 - DNA, 16 bp, C. familiaris
ttcatgaaagatgcag

SEQ ID NO: 332216 - DNA, 16 bp, C. familiaris
ttcatgaagataaaaa

SEQ ID NO: 332217 - DNA, 16 bp, C. familiaris
ttcatgaattagaaga

SEQ ID NO: 332218 - DNA, 16 bp, C. familiaris
ttcatgagaaacacgg

SEQ ID NO: 332219 - DNA, 16 bp, C. familiaris
ttcatgagacagagaa

SEQ ID NO: 332220 - DNA, 16 bp, C. familiaris
ttcatgagacaggcag

SEQ ID NO: 332221 - DNA, 16 bp, C. familiaris
ttcatgagagacaaag

SEQ ID NO: 332222 - DNA, 16 bp, C. familiaris
ttcatgagagagacag

SEQ ID NO: 332223 - DNA, 16 bp, C. familiaris
ttcatgatgatgatga

SEQ ID NO: 332224 - DNA, 17 bp, C. familiaris
ttcatgctacaacagca

SEQ ID NO: 332225 - DNA, 16 bp, C. familiaris
ttcatgctgttttcca

SEQ ID NO: 332226 - DNA, 16 bp, C. familiaris
ttcatggaggaggtga

SEQ ID NO: 332227 - DNA, 16 bp, C. familiaris
ttcatggatcaaaaga

SEQ ID NO: 332228 - DNA, 16 bp, C. familiaris
ttcatggattggaaga

SEQ ID NO: 332229 - DNA, 16 bp, C. familiaris
ttcatgggcagcctgg

SEQ ID NO: 332230 - DNA, 16 bp, C. familiaris
ttcatggggctccctg

SEQ ID NO: 332231 - DNA, 16 bp, C. familiaris
ttcatgtacaagtttt

SEQ ID NO: 332232 - DNA, 16 bp, C. familiaris
ttcatgtcatcttcaa

SEQ ID NO: 332233 - DNA, 16 bp, C. familiaris
ttcatgtcttcatttt

SEQ ID NO: 332234 - DNA, 16 bp, C. familiaris
ttcatgtctttttccc

SEQ ID NO: 332235 - DNA, 16 bp, C. familiaris
ttcatgtgtctgtggc

SEQ ID NO: 332236 - DNA, 16 bp, C. familiaris
ttcatgttctgtttcc

SEQ ID NO: 332237 - DNA, 16 bp, C. familiaris
ttcattaaaattgaaa

SEQ ID NO: 332238 - DNA, 16 bp, C. familiaris
ttcattaattgatgga

SEQ ID NO: 332239 - DNA, 16 bp, C. familiaris
ttcattaccccaaaaa

SEQ ID NO: 332240 - DNA, 16 bp, C. familiaris
ttcattatatgaatat

SEQ ID NO: 332241 - DNA, 16 bp, C. familiaris
ttcattatttcaaaaa

SEQ ID NO: 332242 - DNA, 16 bp, C. familiaris
ttcattcaacaattat

SEQ ID NO: 332243 - DNA, 16 bp, C. familiaris
ttcattcaacacacat

SEQ ID NO: 332244 - DNA, 16 bp, C. familiaris
ttcattcagaaatatt

SEQ ID NO: 332245 - DNA, 16 bp, C. familiaris
ttcattcagttctgct

SEQ ID NO: 332246 - DNA, 16 bp, C. familiaris
ttcattcataaaatga

SEQ ID NO: 332247 - DNA, 16 bp, C. familiaris
ttcattcatagagatg

SEQ ID NO: 332248 - DNA, 16 bp, C. familiaris
ttcattcatctatgga

SEQ ID NO: 332249 - DNA, 16 bp, C. familiaris
ttcattcattaaataa

SEQ ID NO: 332250 - DNA, 16 bp, C. familiaris
ttcattcattcatcag

SEQ ID NO: 332251 - DNA, 16 bp, C. familiaris
ttcattcatttaaaca

SEQ ID NO: 332252 - DNA, 16 bp, C. familiaris
ttcattcatttatcca

SEQ ID NO: 332253 - DNA, 16 bp, C. familiaris
ttcattccacaaatac

SEQ ID NO: 332254 - DNA, 16 bp, C. familiaris
ttcattccaggaccct

SEQ ID NO: 332255 - DNA, 16 bp, C. familiaris
ttcattccattgtggt

SEQ ID NO: 332256 - DNA, 16 bp, C. familiaris
ttcattcttctgtatg

SEQ ID NO: 332257 - DNA, 16 bp, C. familiaris
ttcattctttcaaaga

SEQ ID NO: 332258 - DNA, 16 bp, C. familiaris
ttcattctttcttatg

SEQ ID NO: 332259 - DNA, 16 bp, C. familiaris
ttcattgagttctact

SEQ ID NO: 332260 - DNA, 16 bp, C. familiaris
ttcattgattgtttcc

SEQ ID NO: 332261 - DNA, 16 bp, C. familiaris
ttcattgatttctgct

SEQ ID NO: 332262 - DNA, 16 bp, C. familiaris
ttcatttaaatgtttt

SEQ ID NO: 332263 - DNA, 16 bp, C. familiaris
ttcatttatttgaaag

SEQ ID NO: 332264 - DNA, 16 bp, C. familiaris
ttcatttatttgctca

SEQ ID NO: 332265 - DNA, 16 bp, C. familiaris
ttcatttcagatattg

SEQ ID NO: 332266 - DNA, 16 bp, C. familiaris
ttcatttcctggggct

SEQ ID NO: 332267 - DNA, 16 bp, C. familiaris
ttcatttcggctcagg

SEQ ID NO: 332268 - DNA, 16 bp, C. familiaris
ttcatttctgatattg

SEQ ID NO: 332269 - DNA, 16 bp, C. familiaris
ttcatttgaaaatgaa

SEQ ID NO: 332270 - DNA, 16 bp, C. familiaris
ttcatttgaattttta

SEQ ID NO: 332271 - DNA, 16 bp, C. familiaris
ttcatttgcttccata

SEQ ID NO: 332272 - DNA, 16 bp, C. familiaris
ttcatttgggaatata

SEQ ID NO: 332273 - DNA, 16 bp, C. familiaris
ttcatttgttcagcaa

SEQ ID NO: 332274 - DNA, 16 bp, C. familiaris
ttcatttgttccattt

SEQ ID NO: 332275 - DNA, 16 bp, C. familiaris
ttcatttgtttcaaaa

SEQ ID NO: 332276 - DNA, 16 bp, C. familiaris
ttcattttaatgaaaa

SEQ ID NO: 332277 - DNA, 16 bp, C. familiaris
ttcattttatgattat

SEQ ID NO: 332278 - DNA, 16 bp, C. familiaris
ttcattttattgcatt

SEQ ID NO: 332279 - DNA, 16 bp, C. familiaris
ttcattttcaagaaaa

SEQ ID NO: 332280 - DNA, 16 bp, C. familiaris
ttcattttctttaaag

SEQ ID NO: 332281 - DNA, 16 bp, C. familiaris
ttcattttctttagat

SEQ ID NO: 332282 - DNA, 16 bp, C. familiaris
ttcattttgatggctg

SEQ ID NO: 332283 - DNA, 16 bp, C. familiaris
ttcattttgttgatgg

SEQ ID NO: 332284 - DNA, 16 bp, C. familiaris
ttcatttttaaaaaag

SEQ ID NO: 332285 - DNA, 16 bp, C. familiaris
ttcatttttaatgaat

SEQ ID NO: 332286 - DNA, 16 bp, C. familiaris
ttcatttttcttgggt

SEQ ID NO: 332287 - DNA, 16 bp, C. familiaris
ttcatttttgaaagat

SEQ ID NO: 332288 - DNA, 16 bp, C. familiaris
ttcatttttgagaaaa

SEQ ID NO: 332289 - DNA, 16 bp, C. familiaris
ttccaaaaaattgaaa

SEQ ID NO: 332290 - DNA, 16 bp, C. familiaris
ttccaaaaagaaagaa

SEQ ID NO: 332291 - DNA, 16 bp, C. familiaris
ttccaaaacatttcca

SEQ ID NO: 332292 - DNA, 16 bp, C. familiaris
ttccaaaaccaaagat

SEQ ID NO: 332293 - DNA, 16 bp, C. familiaris
ttccaaaagatagaag

SEQ ID NO: 332294 - DNA, 16 bp, C. familiaris
ttccaaaagcatttgc

SEQ ID NO: 332295 - DNA, 16 bp, C. familiaris
ttccaaaaggattttc

SEQ ID NO: 332296 - DNA, 16 bp, C. familiaris
ttccaaaataaaaagg

SEQ ID NO: 332297 - DNA, 16 bp, C. familiaris
ttccaaagaaaacaaa

SEQ ID NO: 332298 - DNA, 16 bp, C. familiaris
ttccaaagaaaataaa

SEQ ID NO: 332299 - DNA, 16 bp, C. familiaris
ttccaaagaaaatgaa

SEQ ID NO: 332300 - DNA, 16 bp, C. familiaris
ttccaaagaaatattt

SEQ ID NO: 332301 - DNA, 16 bp, C. familiaris
ttccaaagaaccagct

SEQ ID NO: 332302 - DNA, 16 bp, C. familiaris
ttccaaagataaagat

SEQ ID NO: 332303 - DNA, 16 bp, C. familiaris
ttccaaatgttgacac

SEQ ID NO: 332304 - DNA, 16 bp, C. familiaris
ttccaaattcatttta

SEQ ID NO: 332305 - DNA, 16 bp, C. familiaris
ttccaaatttcctttt

SEQ ID NO: 332306 - DNA, 16 bp, C. familiaris
ttccaagaagaaaaat

SEQ ID NO: 332307 - DNA, 16 bp, C. familiaris
ttccaagcagaaggaa

SEQ ID NO: 332308 - DNA, 16 bp, C. familiaris
ttccaagctcattcag

SEQ ID NO: 332309 - DNA, 16 bp, C. familiaris
ttccaagtattttctc

SEQ ID NO: 332310 - DNA, 16 bp, C. familiaris
ttccaatcaatgaaca

SEQ ID NO: 332311 - DNA, 16 bp, C. familiaris
ttccaatttctctaca

SEQ ID NO: 332312 - DNA, 16 bp, C. familiaris
ttccacagtggcagca

SEQ ID NO: 332313 - DNA, 16 bp, C. familiaris
ttccacagtggctgcc

SEQ ID NO: 332314 - DNA, 16 bp, C. familiaris
ttccacagtttggcca

SEQ ID NO: 332315 - DNA, 16 bp, C. familiaris
ttccacatataactga

SEQ ID NO: 332316 - DNA, 16 bp, C. familiaris
ttccaccactccttgt

SEQ ID NO: 332317 - DNA, 16 bp, C. familiaris
ttccacgcaggaagcc

SEQ ID NO: 332318 - DNA, 16 bp, C. familiaris
ttccactgtggctgca

SEQ ID NO: 332319 - DNA, 16 bp, C. familiaris
ttccactgtgtgtgta

SEQ ID NO: 332320 - DNA, 16 bp, C. familiaris
ttccacttgttcattg

SEQ ID NO: 332321 - DNA, 16 bp, C. familiaris
ttccagaaaaaaacaa

SEQ ID NO: 332322 - DNA, 16 bp, C. familiaris
ttccagaaaaagaaga

SEQ ID NO: 332323 - DNA, 16 bp, C. familiaris
ttccagaaaacagaaa

SEQ ID NO: 332324 - DNA, 16 bp, C. familiaris
ttccagaaacagaaaa

SEQ ID NO: 332325 - DNA, 16 bp, C. familiaris
ttccagaaagaaagaa

SEQ ID NO: 332326 - DNA, 16 bp, C. familiaris
ttccagaaagttctct

SEQ ID NO: 332327 - DNA, 16 bp, C. familiaris
ttccagaaccctggga

SEQ ID NO: 332328 - DNA, 16 bp, C. familiaris
ttccagaactccagga

SEQ ID NO: 332329 - DNA, 16 bp, C. familiaris
ttccagaacttcatca

SEQ ID NO: 332330 - DNA, 16 bp, C. familiaris
ttccagaactttctca

SEQ ID NO: 332331 - DNA, 16 bp, C. familiaris
ttccagaagattttca

SEQ ID NO: 332332 - DNA, 16 bp, C. familiaris
ttccagaaggaaccag

SEQ ID NO: 332333 - DNA, 16 bp, C. familiaris
ttccagaatgtcacag

SEQ ID NO: 332334 - DNA, 16 bp, C. familiaris
ttccagagaaacaaaa

SEQ ID NO: 332335 - DNA, 16 bp, C. familiaris
ttccagagcagctgca

SEQ ID NO: 332336 - DNA, 16 bp, C. familiaris
ttccagaggaaaaaaa

SEQ ID NO: 332337 - DNA, 16 bp, C. familiaris
ttccagaggcacctgg

SEQ ID NO: 332338 - DNA, 16 bp, C. familiaris
ttccagatcctgggat

SEQ ID NO: 332339 - DNA, 16 bp, C. familiaris
ttccagatggggaaac

SEQ ID NO: 332340 - DNA, 16 bp, C. familiaris
ttccagattgcccagt

SEQ ID NO: 332341 - DNA, 16 bp, C. familiaris
ttccagcagaactcaa

SEQ ID NO: 332342 - DNA, 16 bp, C. familiaris
ttccagcagcagcagc

SEQ ID NO: 332343 - DNA, 16 bp, C. familiaris
ttccagcctccagaag

SEQ ID NO: 332344 - DNA, 16 bp, C. familiaris
ttccagcctccagcct

SEQ ID NO: 332345 - DNA, 16 bp, C. familiaris
ttccagctattatttc

SEQ ID NO: 332346 - DNA, 16 bp, C. familiaris
ttccagctctatgaaa

SEQ ID NO: 332347 - DNA, 16 bp, C. familiaris
ttccagctctgctgct

SEQ ID NO: 332348 - DNA, 16 bp, C. familiaris
ttccagctctgtgaaa

SEQ ID NO: 332349 - DNA, 16 bp, C. familiaris
ttccagctgtgtgacc

SEQ ID NO: 332350 - DNA, 16 bp, C. familiaris
ttccaggaagaaaaaa

SEQ ID NO: 332351 - DNA, 16 bp, C. familiaris
ttccaggaagagggaa

SEQ ID NO: 332352 - DNA, 16 bp, C. familiaris
ttccaggaccctgaca

SEQ ID NO: 332353 - DNA, 16 bp, C. familiaris
ttccaggactgtgaga

SEQ ID NO: 332354 - DNA, 16 bp, C. familiaris
ttccaggagcagctca

SEQ ID NO: 332355 - DNA, 16 bp, C. familiaris
ttccaggatcactccc

SEQ ID NO: 332356 - DNA, 16 bp, C. familiaris
ttccaggcaaaagaaa

SEQ ID NO: 332357 - DNA, 16 bp, C. familiaris
ttccagggattagaat

SEQ ID NO: 332358 - DNA, 16 bp, C. familiaris
ttccagggcacctggg

SEQ ID NO: 332359 - DNA, 16 bp, C. familiaris
ttccagtcctggctct

SEQ ID NO: 332360 - DNA, 16 bp, C. familiaris
ttccagtggagagtct

SEQ ID NO: 332361 - DNA, 16 bp, C. familiaris
ttccagttttcttctt

SEQ ID NO: 332362 - DNA, 16 bp, C. familiaris
ttccagttttgctttt

SEQ ID NO: 332363 - DNA, 16 bp, C. familiaris
ttccagtttttccaca

SEQ ID NO: 332364 - DNA, 16 bp, C. familiaris
ttccagttttttgatg

SEQ ID NO: 332365 - DNA, 16 bp, C. familiaris
ttccatagtgactgta

SEQ ID NO: 332366 - DNA, 16 bp, C. familiaris
ttccatataagtttta

SEQ ID NO: 332367 - DNA, 16 bp, C. familiaris
ttccatcagtgtttta

SEQ ID NO: 332368 - DNA, 16 bp, C. familiaris
ttccatccacatcagt

SEQ ID NO: 332369 - DNA, 16 bp, C. familiaris
ttccatgaaaaagaaa

SEQ ID NO: 332370 - DNA, 16 bp, C. familiaris
ttccatgaaccttttt

SEQ ID NO: 332371 - DNA, 16 bp, C. familiaris
ttccatgccaggagcc

SEQ ID NO: 332372 - DNA, 16 bp, C. familiaris
ttccatgcccaatgtg

SEQ ID NO: 332373 - DNA, 16 bp, C. familiaris
ttccatgtgtttattg

SEQ ID NO: 332374 - DNA, 16 bp, C. familiaris
ttccattaaaaaatat

SEQ ID NO: 332375 - DNA, 17 bp, C. familiaris
ttccattctgaatgaca

SEQ ID NO: 332376 - DNA, 16 bp, C. familiaris
ttccattctgtaggtt

SEQ ID NO: 332377 - DNA, 16 bp, C. familiaris
ttccattgtgtgaatg

SEQ ID NO: 332378 - DNA, 16 bp, C. familiaris
ttccatttattttcca

SEQ ID NO: 332379 - DNA, 16 bp, C. familiaris
ttccatttctgcaaaa

SEQ ID NO: 332380 - DNA, 16 bp, C. familiaris
ttccatttgggaaaaa

SEQ ID NO: 332381 - DNA, 16 bp, C. familiaris
ttccatttttctgtat

SEQ ID NO: 332382 - DNA, 16 bp, C. familiaris
ttcccaccaaaaccac

SEQ ID NO: 332383 - DNA, 16 bp, C. familiaris
ttcccaccaacagtat

SEQ ID NO: 332384 - DNA, 16 bp, C. familiaris
ttcccaccagcagtat

SEQ ID NO: 332385 - DNA, 16 bp, C. familiaris
ttcccactccctctgc

SEQ ID NO: 332386 - DNA, 16 bp, C. familiaris
ttcccagaaaacaaaa

SEQ ID NO: 332387 - DNA, 16 bp, C. familiaris
ttcccagagaaataaa

SEQ ID NO: 332388 - DNA, 16 bp, C. familiaris
ttcccagatggaaagg

SEQ ID NO: 332389 - DNA, 16 bp, C. familiaris
ttcccaggagaattct

SEQ ID NO: 332390 - DNA, 16 bp, C. familiaris
ttcccaggctccagaa

SEQ ID NO: 332391 - DNA, 16 bp, C. familiaris
ttcccaggtgatgcca

SEQ ID NO: 332392 - DNA, 16 bp, C. familiaris
ttcccagtctccagga

SEQ ID NO: 332393 - DNA, 16 bp, C. familiaris
ttccccaaaataaaaa

SEQ ID NO: 332394 - DNA, 16 bp, C. familiaris
ttccccaaagccactg

SEQ ID NO: 332395 - DNA, 16 bp, C. familiaris
ttccccaagagctgaa

SEQ ID NO: 332396 - DNA, 16 bp, C. familiaris
ttccccagagcctcca

SEQ ID NO: 332397 - DNA, 16 bp, C. familiaris
ttccccagctcatgct

SEQ ID NO: 332398 - DNA, 16 bp, C. familiaris
ttccccattgaggatg

SEQ ID NO: 332399 - DNA, 16 bp, C. familiaris
ttcccccagggagcct

SEQ ID NO: 332400 - DNA, 16 bp, C. familiaris
ttcccccgggacaggc

SEQ ID NO: 332401 - DNA, 16 bp, C. familiaris
ttcccctgatggcaag

SEQ ID NO: 332402 - DNA, 16 bp, C. familiaris
ttcccctgctgagcag

SEQ ID NO: 332403 - DNA, 16 bp, C. familiaris
ttcccctggagctttc

SEQ ID NO: 332404 - DNA, 16 bp, C. familiaris
ttcccctggctattct

SEQ ID NO: 332405 - DNA, 16 bp, C. familiaris
ttcccctgtgtgctcc

SEQ ID NO: 332406 - DNA, 16 bp, C. familiaris
ttccccttctactacc

SEQ ID NO: 332407 - DNA, 16 bp, C. familiaris
ttcccggatggaaagg

SEQ ID NO: 332408 - DNA, 16 bp, C. familiaris
ttccctatgctgtatt

SEQ ID NO: 332409 - DNA, 16 bp, C. familiaris
ttccctctgagcactg

SEQ ID NO: 332410 - DNA, 16 bp, C. familiaris
ttccctctgccaggaa

SEQ ID NO: 332411 - DNA, 16 bp, C. familiaris
ttccctctgctcctgc

SEQ ID NO: 332412 - DNA, 16 bp, C. familiaris
ttccctgatgatgagc

SEQ ID NO: 332413 - DNA, 16 bp, C. familiaris
ttccctgccaagcagg

SEQ ID NO: 332414 - DNA, 16 bp, C. familiaris
ttccctgcctggagcc

SEQ ID NO: 332415 - DNA, 16 bp, C. familiaris
ttccctggggaatttt

SEQ ID NO: 332416 - DNA, 16 bp, C. familiaris
ttccctgtgctgtacc

SEQ ID NO: 332417 - DNA, 16 bp, C. familiaris
ttccctgtgtcttcac

SEQ ID NO: 332418 - DNA, 16 bp, C. familiaris
ttcccttcccagatta

SEQ ID NO: 332419 - DNA, 16 bp, C. familiaris
ttcccttctctgagcc

SEQ ID NO: 332420 - DNA, 16 bp, C. familiaris
ttcccttgcttctgga

SEQ ID NO: 332421 - DNA, 16 bp, C. familiaris
ttcccttttagaactg

SEQ ID NO: 332422 - DNA, 16 bp, C. familiaris
ttccgggatctgggat

SEQ ID NO: 332423 - DNA, 16 bp, C. familiaris
ttcctaaatgataaga

SEQ ID NO: 332424 - DNA, 16 bp, C. familiaris
ttcctagaagaaaaaa

SEQ ID NO: 332425 - DNA, 16 bp, C. familiaris
ttcctagaattttttt

SEQ ID NO: 332426 - DNA, 16 bp, C. familiaris
ttcctaggtgatgctg

SEQ ID NO: 332427 - DNA, 16 bp, C. familiaris
ttcctatgttttcttc

SEQ ID NO: 332428 - DNA, 16 bp, C. familiaris
ttcctcaaaaagtgaa

SEQ ID NO: 332429 - DNA, 16 bp, C. familiaris
ttcctcaaagagctaa

SEQ ID NO: 332430 - DNA, 16 bp, C. familiaris
ttcctcacagctctgg

SEQ ID NO: 332431 - DNA, 16 bp, C. familiaris
ttcctcacagggagcc

SEQ ID NO: 332432 - DNA, 16 bp, C. familiaris
ttcctcagtgcctgtc

SEQ ID NO: 332433 - DNA, 16 bp, C. familiaris
ttcctcatatgagtga

SEQ ID NO: 332434 - DNA, 17 bp, C. familiaris
ttcctccaagagttaaa

SEQ ID NO: 332435 - DNA, 16 bp, C. familiaris
ttcctccacatcctca

SEQ ID NO: 332436 - DNA, 16 bp, C. familiaris
ttcctccctctgcctg

SEQ ID NO: 332437 - DNA, 16 bp, C. familiaris
ttcctcctctggggtt

SEQ ID NO: 332438 - DNA, 16 bp, C. familiaris
ttcctcctggagcctc

SEQ ID NO: 332439 - DNA, 16 bp, C. familiaris
ttcctctgctcaaaat

SEQ ID NO: 332440 - DNA, 16 bp, C. familiaris
ttcctctgtctcctta

SEQ ID NO: 332441 - DNA, 16 bp, C. familiaris
ttcctctgtcttgtca

SEQ ID NO: 332442 - DNA, 16 bp, C. familiaris
ttcctctgtgatattt

SEQ ID NO: 332443 - DNA, 16 bp, C. familiaris
ttcctcttcagttttt

SEQ ID NO: 332444 - DNA, 16 bp, C. familiaris
ttcctctttctctaca

SEQ ID NO: 332445 - DNA, 16 bp, C. familiaris
ttcctgaaaccaatat

SEQ ID NO: 332446 - DNA, 16 bp, C. familiaris
ttcctgactctcagaa

SEQ ID NO: 332447 - DNA, 16 bp, C. familiaris
ttcctgatgattttct

SEQ ID NO: 332448 - DNA, 16 bp, C. familiaris
ttcctgatgttagggg

SEQ ID NO: 332449 - DNA, 16 bp, C. familiaris
ttcctgcctcctttgt

SEQ ID NO: 332450 - DNA, 16 bp, C. familiaris
ttcctgccttcaagga

SEQ ID NO: 332451 - DNA, 16 bp, C. familiaris
ttcctgctgagcaagg

SEQ ID NO: 332452 - DNA, 17 bp, C. familiaris
ttcctgctgctgctgct

SEQ ID NO: 332453 - DNA, 16 bp, C. familiaris
ttcctgctggtcttct

SEQ ID NO: 332454 - DNA, 16 bp, C. familiaris
ttcctggaagaaaaca

SEQ ID NO: 332455 - DNA, 16 bp, C. familiaris
ttcctggaggagatga

SEQ ID NO: 332456 - DNA, 16 bp, C. familiaris
ttcctggaggaggaga

SEQ ID NO: 332457 - DNA, 16 bp, C. familiaris
ttcctggaggaggctg

SEQ ID NO: 332458 - DNA, 16 bp, C. familiaris
ttcctggctgaccctt

SEQ ID NO: 332459 - DNA, 16 bp, C. familiaris
ttcctgggatgcaagg

SEQ ID NO: 332460 - DNA, 16 bp, C. familiaris
ttcctgggcagccccg

SEQ ID NO: 332461 - DNA, 16 bp, C. familiaris
ttcctgggcagcctgg

SEQ ID NO: 332462 - DNA, 16 bp, C. familiaris
ttcctgggctacaagg

SEQ ID NO: 332463 - DNA, 16 bp, C. familiaris
ttcctgggctgcaaag

SEQ ID NO: 332464 - DNA, 16 bp, C. familiaris
ttcctgggctgcaagg

SEQ ID NO: 332465 - DNA, 16 bp, C. familiaris
ttcctggggctcctgg

SEQ ID NO: 332466 - DNA, 16 bp, C. familiaris
ttcctgggtcccacag

SEQ ID NO: 332467 - DNA, 16 bp, C. familiaris
ttcctgtcctcatgga

SEQ ID NO: 332468 - DNA, 16 bp, C. familiaris
ttcctgtgcctcagtt

SEQ ID NO: 332469 - DNA, 16 bp, C. familiaris
ttcctgttccagtttg

SEQ ID NO: 332470 - DNA, 16 bp, C. familiaris
ttcctgtttcagtttg

SEQ ID NO: 332471 - DNA, 16 bp, C. familiaris
ttccttaaaagttaaa

SEQ ID NO: 332472 - DNA, 16 bp, C. familiaris
ttccttaccttttcca

SEQ ID NO: 332473 - DNA, 16 bp, C. familiaris
ttccttattgattttg

SEQ ID NO: 332474 - DNA, 16 bp, C. familiaris
ttccttatttgaaaaa

SEQ ID NO: 332475 - DNA, 16 bp, C. familiaris
ttccttccaaatttcc

SEQ ID NO: 332476 - DNA, 16 bp, C. familiaris
ttccttccatttatat

SEQ ID NO: 332477 - DNA, 16 bp, C. familiaris
ttccttcccattctgc

SEQ ID NO: 332478 - DNA, 16 bp, C. familiaris
ttccttctgagtctgt

SEQ ID NO: 332479 - DNA, 16 bp, C. familiaris
ttccttctgcctggag

SEQ ID NO: 332480 - DNA, 16 bp, C. familiaris
ttccttctggaggctc

SEQ ID NO: 332481 - DNA, 16 bp, C. familiaris
ttccttctggcctcca

SEQ ID NO: 332482 - DNA, 16 bp, C. familiaris
ttccttctgttcattt

SEQ ID NO: 332483 - DNA, 16 bp, C. familiaris
ttccttctttcttgaa

SEQ ID NO: 332484 - DNA, 16 bp, C. familiaris
ttccttcttttctatg

SEQ ID NO: 332485 - DNA, 16 bp, C. familiaris
ttccttgcatttccat

SEQ ID NO: 332486 - DNA, 16 bp, C. familiaris
ttccttgccaacattt

SEQ ID NO: 332487 - DNA, 16 bp, C. familiaris
ttccttgtcatcaact

SEQ ID NO: 332488 - DNA, 16 bp, C. familiaris
ttccttgtgcacttga

SEQ ID NO: 332489 - DNA, 16 bp, C. familiaris
ttcctttctgatttga

SEQ ID NO: 332490 - DNA, 16 bp, C. familiaris
ttcctttcttctgcta

SEQ ID NO: 332491 - DNA, 16 bp, C. familiaris
ttcctttgatgtgcag

SEQ ID NO: 332492 - DNA, 16 bp, C. familiaris
ttcctttgcctgtgtc

SEQ ID NO: 332493 - DNA, 16 bp, C. familiaris
ttccttttaaaatctt

SEQ ID NO: 332494 - DNA, 16 bp, C. familiaris
ttccttttataaaaat

SEQ ID NO: 332495 - DNA, 16 bp, C. familiaris
ttccttttataataaa

SEQ ID NO: 332496 - DNA, 16 bp, C. familiaris
ttccttttcattgctg

SEQ ID NO: 332497 - DNA, 16 bp, C. familiaris
ttccttttgctccaca

SEQ ID NO: 332498 - DNA, 16 bp, C. familiaris
ttcgagccccatgtgg

SEQ ID NO: 332499 - DNA, 16 bp, C. familiaris
ttcggctcagggagtg

SEQ ID NO: 332500 - DNA, 16 bp, C. familiaris
ttcgggcggcggctcc

SEQ ID NO: 332501 - DNA, 16 bp, C. familiaris
ttcgtcctttctaatg

SEQ ID NO: 332502 - DNA, 16 bp, C. familiaris
ttcgtgcctgcctttg

SEQ ID NO: 332503 - DNA, 16 bp, C. familiaris
ttctaaaagaagaaaa

SEQ ID NO: 332504 - DNA, 16 bp, C. familiaris
ttctaaaagaaggaaa

SEQ ID NO: 332505 - DNA, 16 bp, C. familiaris
ttctaaaagagaaaaa

SEQ ID NO: 332506 - DNA, 16 bp, C. familiaris
ttctaaaatattagaa

SEQ ID NO: 332507 - DNA, 16 bp, C. familiaris
ttctaaagaaaacaaa

SEQ ID NO: 332508 - DNA, 16 bp, C. familiaris
ttctaaaggctgagga

SEQ ID NO: 332509 - DNA, 16 bp, C. familiaris
ttctaaatttcttcct

SEQ ID NO: 332510 - DNA, 16 bp, C. familiaris
ttctaagaaatattta

SEQ ID NO: 332511 - DNA, 26 bp, C. familiaris
ttctaagcacaacatctccaaagaaa

SEQ ID NO: 332512 - DNA, 16 bp, C. familiaris
ttctaagtctctgaag

SEQ ID NO: 332513 - DNA, 16 bp, C. familiaris
ttctaatatgataaat

SEQ ID NO: 332514 - DNA, 16 bp, C. familiaris
ttctacaagtattgct

SEQ ID NO: 332515 - DNA, 16 bp, C. familiaris
ttctacctcattaacc

SEQ ID NO: 332516 - DNA, 16 bp, C. familiaris
ttctacctctgaaaat

SEQ ID NO: 332517 - DNA, 16 bp, C. familiaris
ttctacttcttcctgt

SEQ ID NO: 332518 - DNA, 16 bp, C. familiaris
ttctagaaaataaaaa

SEQ ID NO: 332519 - DNA, 16 bp, C. familiaris
ttctagaaatagaatt

SEQ ID NO: 332520 - DNA, 16 bp, C. familiaris
ttctagaagctgaaaa

SEQ ID NO: 332521 - DNA, 16 bp, C. familiaris
ttctagagaaaaaaaa

SEQ ID NO: 332522 - DNA, 16 bp, C. familiaris
ttctagaggctgccca

SEQ ID NO: 332523 - DNA, 16 bp, C. familiaris
ttctagagtggctgca

SEQ ID NO: 332524 - DNA, 16 bp, C. familiaris
ttctagcaattttgag

SEQ ID NO: 332525 - DNA, 16 bp, C. familiaris
ttctagcagtaatgtc

SEQ ID NO: 332526 - DNA, 16 bp, C. familiaris
ttctaggaattcattt

SEQ ID NO: 332527 - DNA, 16 bp, C. familiaris
ttctagtttgttgagt

SEQ ID NO: 332528 - DNA, 16 bp, C. familiaris
ttctatacattattca

SEQ ID NO: 332529 - DNA, 16 bp, C. familiaris
ttctatatattgtaaa

SEQ ID NO: 332530 - DNA, 16 bp, C. familiaris
ttctatcaaaatattt

SEQ ID NO: 332531 - DNA, 16 bp, C. familiaris
ttctatcttctatatc

SEQ ID NO: 332532 - DNA, 16 bp, C. familiaris
ttctatgcatttttaa

SEQ ID NO: 332533 - DNA, 16 bp, C. familiaris
ttctatgggttttgat

SEQ ID NO: 332534 - DNA, 16 bp, C. familiaris
ttctattatttttaag

SEQ ID NO: 332535 - DNA, 16 bp, C. familiaris
ttctatttgaatttct

SEQ ID NO: 332536 - DNA, 16 bp, C. familiaris
ttctattttttaaaga

SEQ ID NO: 332537 - DNA, 16 bp, C. familiaris
ttctcactatgtcctc

SEQ ID NO: 332538 - DNA, 16 bp, C. familiaris
ttctcactctgcctct

SEQ ID NO: 332539 - DNA, 16 bp, C. familiaris
ttctcagaagaaaaca

SEQ ID NO: 332540 - DNA, 16 bp, C. familiaris
ttctcagaccataata

SEQ ID NO: 332541 - DNA, 16 bp, C. familiaris
ttctcagaccttcaga

SEQ ID NO: 332542 - DNA, 16 bp, C. familiaris
ttctcagatgaagaaa

SEQ ID NO: 332543 - DNA, 16 bp, C. familiaris
ttctcaggagaaaaaa

SEQ ID NO: 332544 - DNA, 16 bp, C. familiaris
ttctcaggatttcttt

SEQ ID NO: 332545 - DNA, 16 bp, C. familiaris
ttctcagggtcctggg

SEQ ID NO: 332546 - DNA, 16 bp, C. familiaris
ttctcagtgcccatca

SEQ ID NO: 332547 - DNA, 16 bp, C. familiaris
ttctcatggttctgaa

SEQ ID NO: 332548 - DNA, 16 bp, C. familiaris
ttctcattaaaaacaa

SEQ ID NO: 332549 - DNA, 16 bp, C. familiaris
ttctccaaagaaaaca

SEQ ID NO: 332550 - DNA, 16 bp, C. familiaris
ttctccaaagcagaca

SEQ ID NO: 332551 - DNA, 16 bp, C. familiaris
ttctccacatccttac

SEQ ID NO: 332552 - DNA, 16 bp, C. familiaris
ttctccacattctcac

SEQ ID NO: 332553 - DNA, 16 bp, C. familiaris
ttctccactgaattgc

SEQ ID NO: 332554 - DNA, 16 bp, C. familiaris
ttctccacttcctcac

SEQ ID NO: 332555 - DNA, 16 bp, C. familiaris
ttctccagattgcttt

SEQ ID NO: 332556 - DNA, 16 bp, C. familiaris
ttctccaggattttga

SEQ ID NO: 332557 - DNA, 16 bp, C. familiaris
ttctccaggcctcagt

SEQ ID NO: 332558 - DNA, 16 bp, C. familiaris
ttctccatattctctc

SEQ ID NO: 332559 - DNA, 16 bp, C. familiaris
ttctccatcaggcatg

SEQ ID NO: 332560 - DNA, 16 bp, C. familiaris
ttctcccaatctgtgg

SEQ ID NO: 332561 - DNA, 16 bp, C. familiaris
ttctcccagttctgga

SEQ ID NO: 332562 - DNA, 16 bp, C. familiaris
ttctccccaaactgat

SEQ ID NO: 332563 - DNA, 16 bp, C. familiaris
ttctccctcacagcct

SEQ ID NO: 332564 - DNA, 16 bp, C. familiaris
ttctccctcagagcct

SEQ ID NO: 332565 - DNA, 16 bp, C. familiaris
ttctccctctgctgat

SEQ ID NO: 332566 - DNA, 16 bp, C. familiaris
ttctccctctgtctat

SEQ ID NO: 332567 - DNA, 16 bp, C. familiaris
ttctcccttctctgtg

SEQ ID NO: 332568 - DNA, 16 bp, C. familiaris
ttctcctcaaattgat

SEQ ID NO: 332569 - DNA, 16 bp, C. familiaris
ttctcctcagcttcct

SEQ ID NO: 332570 - DNA, 16 bp, C. familiaris
ttctcctcccactgcc

SEQ ID NO: 332571 - DNA, 16 bp, C. familiaris
ttctcctgcctctgcc

SEQ ID NO: 332572 - DNA, 16 bp, C. familiaris
ttctcctgcctgtgtc

SEQ ID NO: 332573 - DNA, 16 bp, C. familiaris
ttctcctggttctcag

SEQ ID NO: 332574 - DNA, 16 bp, C. familiaris
ttctccttccattctg

SEQ ID NO: 332575 - DNA, 16 bp, C. familiaris
ttctccttctatgtct

SEQ ID NO: 332576 - DNA, 16 bp, C. familiaris
ttctccttctgggatt

SEQ ID NO: 332577 - DNA, 16 bp, C. familiaris
ttctctaaagaaaaaa

SEQ ID NO: 332578 - DNA, 16 bp, C. familiaris
ttctctacaattaaga

SEQ ID NO: 332579 - DNA, 16 bp, C. familiaris
ttctctacatcctccc

SEQ ID NO: 332580 - DNA, 16 bp, C. familiaris
ttctctagagaaacaa

SEQ ID NO: 332581 - DNA, 16 bp, C. familiaris
ttctctatctgcctat

SEQ ID NO: 332582 - DNA, 16 bp, C. familiaris
ttctctccatcctcac

SEQ ID NO: 332583 - DNA, 16 bp, C. familiaris
ttctctctatgtctgt

SEQ ID NO: 332584 - DNA, 16 bp, C. familiaris
ttctctctgcctgaaa

SEQ ID NO: 332585 - DNA, 16 bp, C. familiaris
ttctctctggcaacca

SEQ ID NO: 332586 - DNA, 16 bp, C. familiaris
ttctctcttcttaaaa

SEQ ID NO: 332587 - DNA, 16 bp, C. familiaris
ttctctgaaagaaaaa

SEQ ID NO: 332588 - DNA, 16 bp, C. familiaris
ttctctgaacttcagt

SEQ ID NO: 332589 - DNA, 16 bp, C. familiaris
ttctctgacttatttt

SEQ ID NO: 332590 - DNA, 16 bp, C. familiaris
ttctctgatgatgaat

SEQ ID NO: 332591 - DNA, 16 bp, C. familiaris
ttctctgcatcctcac

SEQ ID NO: 332592 - DNA, 16 bp, C. familiaris
ttctctggaataaatg

SEQ ID NO: 332593 - DNA, 16 bp, C. familiaris
ttctctggacaaaatg

SEQ ID NO: 332594 - DNA, 16 bp, C. familiaris
ttctctggagaacccc

SEQ ID NO: 332595 - DNA, 16 bp, C. familiaris
ttctctggttggtcct

SEQ ID NO: 332596 - DNA, 16 bp, C. familiaris
ttctctgtctgtaaaa

SEQ ID NO: 332597 - DNA, 16 bp, C. familiaris
ttctctgtgccttctg

SEQ ID NO: 332598 - DNA, 16 bp, C. familiaris
ttctctgtgtctccca

SEQ ID NO: 332599 - DNA, 16 bp, C. familiaris
ttctcttattgatgta

SEQ ID NO: 332600 - DNA, 16 bp, C. familiaris
ttctcttcagaaacca

SEQ ID NO: 332601 - DNA, 16 bp, C. familiaris
ttctcttcatgtattt

SEQ ID NO: 332602 - DNA, 16 bp, C. familiaris
ttctcttcatgtcctt

SEQ ID NO: 332603 - DNA, 16 bp, C. familiaris
ttctcttcctgctact

SEQ ID NO: 332604 - DNA, 16 bp, C. familiaris
ttctcttctgcctctg

SEQ ID NO: 332605 - DNA, 16 bp, C. familiaris
ttctcttctttaaaat

SEQ ID NO: 332606 - DNA, 16 bp, C. familiaris
ttctcttgctgtgcag

SEQ ID NO: 332607 - DNA, 16 bp, C. familiaris
ttctctttaaaaaaga

SEQ ID NO: 332608 - DNA, 16 bp, C. familiaris
ttctctttcatttctg

SEQ ID NO: 332609 - DNA, 16 bp, C. familiaris
ttctctttgcctcagt

SEQ ID NO: 332610 - DNA, 16 bp, C. familiaris
ttctcttttccccaaa

SEQ ID NO: 332611 - DNA, 16 bp, C. familiaris
ttctgaaaaaagaaaa

SEQ ID NO: 332612 - DNA, 16 bp, C. familiaris
ttctgaaaaaattaaa

SEQ ID NO: 332613 - DNA, 16 bp, C. familiaris
ttctgaaaaagaaaaa

SEQ ID NO: 332614 - DNA, 16 bp, C. familiaris
ttctgaaaagaaattg

SEQ ID NO: 332615 - DNA, 16 bp, C. familiaris
ttctgaaaattaaaga

SEQ ID NO: 332616 - DNA, 16 bp, C. familiaris
ttctgaaaccctttgt

SEQ ID NO: 332617 - DNA, 16 bp, C. familiaris
ttctgaaagatattga

SEQ ID NO: 332618 - DNA, 16 bp, C. familiaris
ttctgaaataatttat

SEQ ID NO: 332619 - DNA, 16 bp, C. familiaris
ttctgaaattaaaatt

SEQ ID NO: 332620 - DNA, 16 bp, C. familiaris
ttctgaaattattttg

SEQ ID NO: 332621 - DNA, 16 bp, C. familiaris
ttctgaagaaaaagaa

SEQ ID NO: 332622 - DNA, 16 bp, C. familiaris
ttctgaagctatttca

SEQ ID NO: 332623 - DNA, 16 bp, C. familiaris
ttctgacctccaggac

SEQ ID NO: 332624 - DNA, 16 bp, C. familiaris
ttctgagaaagaagaa

SEQ ID NO: 332625 - DNA, 16 bp, C. familiaris
ttctgagagaaaaaaa

SEQ ID NO: 332626 - DNA, 16 bp, C. familiaris
ttctgatgagaaatca

SEQ ID NO: 332627 - DNA, 16 bp, C. familiaris
ttctgcaagatgaaaa

SEQ ID NO: 332628 - DNA, 16 bp, C. familiaris
ttctgcacaacaaagg

SEQ ID NO: 332629 - DNA, 16 bp, C. familiaris
ttctgcacagaaaaag

SEQ ID NO: 332630 - DNA, 16 bp, C. familiaris
ttctgcacagcaaaag

SEQ ID NO: 332631 - DNA, 16 bp, C. familiaris
ttctgcaggtggctgt

SEQ ID NO: 332632 - DNA, 16 bp, C. familiaris
ttctgcattgggctcc

SEQ ID NO: 332633 - DNA, 16 bp, C. familiaris
ttctgcattttaaaaa

SEQ ID NO: 332634 - DNA, 16 bp, C. familiaris
ttctgcccagggcctg

SEQ ID NO: 332635 - DNA, 16 bp, C. familiaris
ttctgcctaccttgga

SEQ ID NO: 332636 - DNA, 16 bp, C. familiaris
ttctgcctggaatgct

SEQ ID NO: 332637 - DNA, 16 bp, C. familiaris
ttctgcgtgtggctgt

SEQ ID NO: 332638 - DNA, 16 bp, C. familiaris
ttctgctgaaaaattt

SEQ ID NO: 332639 - DNA, 16 bp, C. familiaris
ttctgctgagcaggga

SEQ ID NO: 332640 - DNA, 16 bp, C. familiaris
ttctgctgcttctcct

SEQ ID NO: 332641 - DNA, 16 bp, C. familiaris
ttctgctggggtcatg

SEQ ID NO: 332642 - DNA, 16 bp, C. familiaris
ttctgctgtgtgtgtg

SEQ ID NO: 332643 - DNA, 16 bp, C. familiaris
ttctgcttttttaaaa

SEQ ID NO: 332644 - DNA, 16 bp, C. familiaris
ttctggaaaacaaaaa

SEQ ID NO: 332645 - DNA, 16 bp, C. familiaris
ttctggaaaaccacaa

SEQ ID NO: 332646 - DNA, 16 bp, C. familiaris
ttctggaaaaccagaa

SEQ ID NO: 332647 - DNA, 16 bp, C. familiaris
ttctggaaaaggcaaa

SEQ ID NO: 332648 - DNA, 16 bp, C. familiaris
ttctggaaaaggccaa

SEQ ID NO: 332649 - DNA, 16 bp, C. familiaris
ttctggaaaatattcc

SEQ ID NO: 332650 - DNA, 16 bp, C. familiaris
ttctggaaaatatttt

SEQ ID NO: 332651 - DNA, 16 bp, C. familiaris
ttctggaaatattttg

SEQ ID NO: 332652 - DNA, 16 bp, C. familiaris
ttctggaactaataag

SEQ ID NO: 332653 - DNA, 16 bp, C. familiaris
ttctggaactctggga

SEQ ID NO: 332654 - DNA, 16 bp, C. familiaris
ttctggaagaggcaaa

SEQ ID NO: 332655 - DNA, 16 bp, C. familiaris
ttctggaagagtttga

SEQ ID NO: 332656 - DNA, 16 bp, C. familiaris
ttctggaagcttctgg

SEQ ID NO: 332657 - DNA, 16 bp, C. familiaris
ttctggaaggaaggaa

SEQ ID NO: 332658 - DNA, 16 bp, C. familiaris
ttctggacattttata

SEQ ID NO: 332659 - DNA, 16 bp, C. familiaris
ttctggacttttcttt

SEQ ID NO: 332660 - DNA, 16 bp, C. familiaris
ttctggaggaaagaaa

SEQ ID NO: 332661 - DNA, 16 bp, C. familiaris
ttctggaggccagaaa

SEQ ID NO: 332662 - DNA, 16 bp, C. familiaris
ttctggaggccagagg

SEQ ID NO: 332663 - DNA, 16 bp, C. familiaris
ttctggaggctccaag

SEQ ID NO: 332664 - DNA, 16 bp, C. familiaris
ttctggaggctccagg

SEQ ID NO: 332665 - DNA, 16 bp, C. familiaris
ttctggaggctggaca

SEQ ID NO: 332666 - DNA, 16 bp, C. familiaris
ttctggatattttctc

SEQ ID NO: 332667 - DNA, 16 bp, C. familiaris
ttctggattctggatt

SEQ ID NO: 332668 - DNA, 16 bp, C. familiaris
ttctggattttatatt

SEQ ID NO: 332669 - DNA, 16 bp, C. familiaris
ttctggatttttaaaa

SEQ ID NO: 332670 - DNA, 16 bp, C. familiaris
ttctggcctccagacc

SEQ ID NO: 332671 - DNA, 16 bp, C. familiaris
ttctggctattgtgaa

SEQ ID NO: 332672 - DNA, 16 bp, C. familiaris
ttctggctgtgtcctc

SEQ ID NO: 332673 - DNA, 16 bp, C. familiaris
ttctgggacccctggg

SEQ ID NO: 332674 - DNA, 16 bp, C. familiaris
ttctgggccctctatt

SEQ ID NO: 332675 - DNA, 16 bp, C. familiaris
ttctgggctctctctt

SEQ ID NO: 332676 - DNA, 16 bp, C. familiaris
ttctggggctccagga

SEQ ID NO: 332677 - DNA, 16 bp, C. familiaris
ttctgggtcttcagga

SEQ ID NO: 332678 - DNA, 16 bp, C. familiaris
ttctggtatttcccac

SEQ ID NO: 332679 - DNA, 16 bp, C. familiaris
ttctggtcaatagtag

SEQ ID NO: 332680 - DNA, 16 bp, C. familiaris
ttctgtacagtgaagg

SEQ ID NO: 332681 - DNA, 16 bp, C. familiaris
ttctgtccagagaaga

SEQ ID NO: 332682 - DNA, 16 bp, C. familiaris
ttctgtccaggaagaa

SEQ ID NO: 332683 - DNA, 16 bp, C. familiaris
ttctgtctccctctgt

SEQ ID NO: 332684 - DNA, 16 bp, C. familiaris
ttctgtcttcctcaat

SEQ ID NO: 332685 - DNA, 16 bp, C. familiaris
ttctgtgaacttaaaa

SEQ ID NO: 332686 - DNA, 16 bp, C. familiaris
ttctgtgagcctctct

SEQ ID NO: 332687 - DNA, 16 bp, C. familiaris
ttctgtgattttcctt

SEQ ID NO: 332688 - DNA, 16 bp, C. familiaris
ttctgtgatttttctc

SEQ ID NO: 332689 - DNA, 16 bp, C. familiaris
ttctgtgcagaagctt

SEQ ID NO: 332690 - DNA, 16 bp, C. familiaris
ttctgtggaaaatgtt

SEQ ID NO: 332691 - DNA, 16 bp, C. familiaris
ttctgtggtttcagtt

SEQ ID NO: 332692 - DNA, 16 bp, C. familiaris
ttctgtgtatatgtgt

SEQ ID NO: 332693 - DNA, 16 bp, C. familiaris
ttctgtgtcaaataaa

SEQ ID NO: 332694 - DNA, 16 bp, C. familiaris
ttctgtgtcctcacat

SEQ ID NO: 332695 - DNA, 16 bp, C. familiaris
ttctgtgttagaaaag

SEQ ID NO: 332696 - DNA, 16 bp, C. familiaris
ttctgttcaggtcatg

SEQ ID NO: 332697 - DNA, 16 bp, C. familiaris
ttctgttcaggttgtg

SEQ ID NO: 332698 - DNA, 16 bp, C. familiaris
ttctgttcatctcttt

SEQ ID NO: 332699 - DNA, 16 bp, C. familiaris
ttctgttcatgtattt

SEQ ID NO: 332700 - DNA, 16 bp, C. familiaris
ttctgttggatattct

SEQ ID NO: 332701 - DNA, 16 bp, C. familiaris
ttctgtttctgtgaaa

SEQ ID NO: 332702 - DNA, 16 bp, C. familiaris
ttctgttttattaaaa

SEQ ID NO: 332703 - DNA, 16 bp, C. familiaris
ttcttaaaaacaaaca

SEQ ID NO: 332704 - DNA, 16 bp, C. familiaris
ttcttaaaaataagaa

SEQ ID NO: 332705 - DNA, 16 bp, C. familiaris
ttcttaaaaataatga

SEQ ID NO: 332706 - DNA, 16 bp, C. familiaris
ttcttaaaaatcatat

SEQ ID NO: 332707 - DNA, 16 bp, C. familiaris
ttcttaaaaatgcaga

SEQ ID NO: 332708 - DNA, 16 bp, C. familiaris
ttcttaaaagaataaa

SEQ ID NO: 332709 - DNA, 16 bp, C. familiaris
ttcttaaaattgttta

SEQ ID NO: 332710 - DNA, 16 bp, C. familiaris
ttcttaaactcaacac

SEQ ID NO: 332711 - DNA, 16 bp, C. familiaris
ttcttaaagatttact

SEQ ID NO: 332712 - DNA, 16 bp, C. familiaris
ttcttaaattcttaaa

SEQ ID NO: 332713 - DNA, 16 bp, C. familiaris
ttcttaatgattttat

SEQ ID NO: 332714 - DNA, 16 bp, C. familiaris
ttcttaattttaatgt

SEQ ID NO: 332715 - DNA, 16 bp, C. familiaris
ttcttacaaaattaaa

SEQ ID NO: 332716 - DNA, 16 bp, C. familiaris
ttcttagaagaaaaaa

SEQ ID NO: 332717 - DNA, 16 bp, C. familiaris
ttcttataaaaagaaa

SEQ ID NO: 332718 - DNA, 16 bp, C. familiaris
ttcttatattccttgt

SEQ ID NO: 332719 - DNA, 16 bp, C. familiaris
ttcttcaaaaatattt

SEQ ID NO: 332720 - DNA, 16 bp, C. familiaris
ttcttcaactccatga

SEQ ID NO: 332721 - DNA, 16 bp, C. familiaris
ttcttcaccatgacca

SEQ ID NO: 332722 - DNA, 16 bp, C. familiaris
ttcttcacctgcaaaa

SEQ ID NO: 332723 - DNA, 16 bp, C. familiaris
ttcttcaggcagaagg

SEQ ID NO: 332724 - DNA, 16 bp, C. familiaris
ttcttcatccacaaaa

SEQ ID NO: 332725 - DNA, 16 bp, C. familiaris
ttcttcatctataaaa

SEQ ID NO: 332726 - DNA, 16 bp, C. familiaris
ttcttcatctattttg

SEQ ID NO: 332727 - DNA, 16 bp, C. familiaris
ttcttcattaaaaata

SEQ ID NO: 332728 - DNA, 16 bp, C. familiaris
ttcttcattctcattg

SEQ ID NO: 332729 - DNA, 16 bp, C. familiaris
ttcttccactccatga

SEQ ID NO: 332730 - DNA, 16 bp, C. familiaris
ttcttccagcagttct

SEQ ID NO: 332731 - DNA, 16 bp, C. familiaris
ttcttcctaaatattt

SEQ ID NO: 332732 - DNA, 16 bp, C. familiaris
ttcttcctcagtctgt

SEQ ID NO: 332733 - DNA, 16 bp, C. familiaris
ttcttcctctggctgt

SEQ ID NO: 332734 - DNA, 16 bp, C. familiaris
ttcttcctgatttagt

SEQ ID NO: 332735 - DNA, 16 bp, C. familiaris
ttcttccttcttcaaa

SEQ ID NO: 332736 - DNA, 16 bp, C. familiaris
ttcttcctttgaaaat

SEQ ID NO: 332737 - DNA, 16 bp, C. familiaris
ttcttctaagagattt

SEQ ID NO: 332738 - DNA, 16 bp, C. familiaris
ttcttctaagagtttt

SEQ ID NO: 332739 - DNA, 16 bp, C. familiaris
ttcttctcaaaatatt

SEQ ID NO: 332740 - DNA, 16 bp, C. familiaris
ttcttctgcaaaatga

SEQ ID NO: 332741 - DNA, 16 bp, C. familiaris
ttcttctgcatttatt

SEQ ID NO: 332742 - DNA, 16 bp, C. familiaris
ttcttcttaagatttt

SEQ ID NO: 332743 - DNA, 16 bp, C. familiaris
ttcttcttcaaaaaaa

SEQ ID NO: 332744 - DNA, 16 bp, C. familiaris
ttcttcttctgggatt

SEQ ID NO: 332745 - DNA, 16 bp, C. familiaris
ttcttcttgaaaaaaa

SEQ ID NO: 332746 - DNA, 16 bp, C. familiaris
ttcttcttgaaatttt

SEQ ID NO: 332747 - DNA, 16 bp, C. familiaris
ttcttcttggagtttt

SEQ ID NO: 332748 - DNA, 16 bp, C. familiaris
ttcttcttgtgattta

SEQ ID NO: 332749 - DNA, 16 bp, C. familiaris
ttcttctttaccaata

SEQ ID NO: 332750 - DNA, 16 bp, C. familiaris
ttcttctttgacccac

SEQ ID NO: 332751 - DNA, 16 bp, C. familiaris
ttcttctttgacttct

SEQ ID NO: 332752 - DNA, 32 bp, C. familiaris
ttcttgaaatctggggatgctgccattgttga

SEQ ID NO: 332753 - DNA, 16 bp, C. familiaris
ttcttgagtcagtttt

SEQ ID NO: 332754 - DNA, 16 bp, C. familiaris
ttcttgataagtctgg

SEQ ID NO: 332755 - DNA, 16 bp, C. familiaris
ttcttgatgagtctgg

SEQ ID NO: 332756 - DNA, 16 bp, C. familiaris
ttcttggctcctttat

SEQ ID NO: 332757 - DNA, 16 bp, C. familiaris
ttcttggttgcaggtt

SEQ ID NO: 332758 - DNA, 16 bp, C. familiaris
ttcttggtttttaaaa

SEQ ID NO: 332759 - DNA, 16 bp, C. familiaris
ttcttgtaaggacact

SEQ ID NO: 332760 - DNA, 16 bp, C. familiaris
ttcttgtctctatttc

SEQ ID NO: 332761 - DNA, 16 bp, C. familiaris
ttctttaaaagtttaa

SEQ ID NO: 332762 - DNA, 16 bp, C. familiaris
ttctttaagaagaaaa

SEQ ID NO: 332763 - DNA, 16 bp, C. familiaris
ttctttaagactttat

SEQ ID NO: 332764 - DNA, 16 bp, C. familiaris
ttctttaggaaaatgt

SEQ ID NO: 332765 - DNA, 16 bp, C. familiaris
ttctttatcaagattg

SEQ ID NO: 332766 - DNA, 16 bp, C. familiaris
ttctttatccattaat

SEQ ID NO: 332767 - DNA, 16 bp, C. familiaris
ttctttattcatcagt

SEQ ID NO: 332768 - DNA, 16 bp, C. familiaris
ttctttattctggata

SEQ ID NO: 332769 - DNA, 16 bp, C. familiaris
ttctttatttaaaaga

SEQ ID NO: 332770 - DNA, 16 bp, C. familiaris
ttctttatttgtgaaa

SEQ ID NO: 332771 - DNA, 16 bp, C. familiaris
ttctttcagcagtgtt

SEQ ID NO: 332772 - DNA, 16 bp, C. familiaris
ttctttcagtaatatt

SEQ ID NO: 332773 - DNA, 16 bp, C. familiaris
ttctttcataagaaaa

SEQ ID NO: 332774 - DNA, 16 bp, C. familiaris
ttctttcatcaaagtt

SEQ ID NO: 332775 - DNA, 16 bp, C. familiaris
ttctttccaagttttt

SEQ ID NO: 332776 - DNA, 16 bp, C. familiaris
ttctttccagattttg

SEQ ID NO: 332777 - DNA, 16 bp, C. familiaris
ttctttcctcttccag

SEQ ID NO: 332778 - DNA, 16 bp, C. familiaris
ttctttcctttcagca

SEQ ID NO: 332779 - DNA, 16 bp, C. familiaris
ttctttctaaaattct

SEQ ID NO: 332780 - DNA, 16 bp, C. familiaris
ttctttctctataaat

SEQ ID NO: 332781 - DNA, 16 bp, C. familiaris
ttctttcttttcaaga

SEQ ID NO: 332782 - DNA, 16 bp, C. familiaris
ttctttctttttaaag

SEQ ID NO: 332783 - DNA, 16 bp, C. familiaris
ttctttgaaatgtaaa

SEQ ID NO: 332784 - DNA, 16 bp, C. familiaris
ttctttgaataaatgt

SEQ ID NO: 332785 - DNA, 16 bp, C. familiaris
ttctttgagaagaaaa

SEQ ID NO: 332786 - DNA, 16 bp, C. familiaris
ttctttggaaaaagaa

SEQ ID NO: 332787 - DNA, 16 bp, C. familiaris
ttctttggaaaactgt

SEQ ID NO: 332788 - DNA, 16 bp, C. familiaris
ttctttggaaaatgtt

SEQ ID NO: 332789 - DNA, 16 bp, C. familiaris
ttctttggaaagaaaa

SEQ ID NO: 332790 - DNA, 16 bp, C. familiaris
ttctttggagaaaaaa

SEQ ID NO: 332791 - DNA, 16 bp, C. familiaris
ttctttggagattttg

SEQ ID NO: 332792 - DNA, 16 bp, C. familiaris
ttctttgtatgtgtgt

SEQ ID NO: 332793 - DNA, 16 bp, C. familiaris
ttctttgttttaaaga

SEQ ID NO: 332794 - DNA, 16 bp, C. familiaris
ttcttttaaaagaaga

SEQ ID NO: 332795 - DNA, 16 bp, C. familiaris
ttcttttaaaagttct

SEQ ID NO: 332796 - DNA, 16 bp, C. familiaris
ttcttttaaaattgaa

SEQ ID NO: 332797 - DNA, 16 bp, C. familiaris
ttcttttaaaatttga

SEQ ID NO: 332798 - DNA, 16 bp, C. familiaris
ttcttttaaagttctt

SEQ ID NO: 332799 - DNA, 16 bp, C. familiaris
ttcttttaagagaaaa

SEQ ID NO: 332800 - DNA, 16 bp, C. familiaris
ttcttttcagatattt

SEQ ID NO: 332801 - DNA, 16 bp, C. familiaris
ttcttttcagatttta

SEQ ID NO: 332802 - DNA, 16 bp, C. familiaris
ttcttttcagcttcat

SEQ ID NO: 332803 - DNA, 16 bp, C. familiaris
ttcttttccaagattg

SEQ ID NO: 332804 - DNA, 16 bp, C. familiaris
ttcttttctagctcct

SEQ ID NO: 332805 - DNA, 16 bp, C. familiaris
ttcttttctggaaaat

SEQ ID NO: 332806 - DNA, 16 bp, C. familiaris
ttcttttgagaaaaaa

SEQ ID NO: 332807 - DNA, 16 bp, C. familiaris
ttcttttgcattttgc

SEQ ID NO: 332808 - DNA, 16 bp, C. familiaris
ttcttttgttgctcat

SEQ ID NO: 332809 - DNA, 16 bp, C. familiaris
ttcttttgtttctgaa

SEQ ID NO: 332810 - DNA, 16 bp, C. familiaris
ttctttttcaacattc

SEQ ID NO: 332811 - DNA, 16 bp, C. familiaris
ttctttttctgaaaat

SEQ ID NO: 332812 - DNA, 16 bp, C. familiaris
ttctttttctgtaaaa

SEQ ID NO: 332813 - DNA, 16 bp, C. familiaris
ttctttttgaaaaaaa

SEQ ID NO: 332814 - DNA, 16 bp, C. familiaris
ttctttttgaaagaga

SEQ ID NO: 332815 - DNA, 16 bp, C. familiaris
ttctttttgaaatgtt

SEQ ID NO: 332816 - DNA, 16 bp, C. familiaris
ttctttttgataaata

SEQ ID NO: 332817 - DNA, 16 bp, C. familiaris
ttctttttgctattca

SEQ ID NO: 332818 - DNA, 16 bp, C. familiaris
ttcttttttaaaagat

SEQ ID NO: 332819 - DNA, 16 bp, C. familiaris
ttcttttttaattaag

SEQ ID NO: 332820 - DNA, 16 bp, C. familiaris
ttcttttttttaaaga

SEQ ID NO: 332821 - DNA, 16 bp, C. familiaris
ttgaaaaaaatatcaa

SEQ ID NO: 332822 - DNA, 16 bp, C. familiaris
ttgaaaaaagaaaagc

SEQ ID NO: 332823 - DNA, 16 bp, C. familiaris
ttgaaaaaatcaacaa

SEQ ID NO: 332824 - DNA, 16 bp, C. familiaris
ttgaaaaacagcaaat

SEQ ID NO: 332825 - DNA, 16 bp, C. familiaris
ttgaaaaagaaaatca

SEQ ID NO: 332826 - DNA, 16 bp, C. familiaris
ttgaaaaagaagacca

SEQ ID NO: 332827 - DNA, 16 bp, C. familiaris
ttgaaaaagaagagca

SEQ ID NO: 332828 - DNA, 16 bp, C. familiaris
ttgaaaaagagcaaag

SEQ ID NO: 332829 - DNA, 16 bp, C. familiaris
ttgaaaaaggaaacca

SEQ ID NO: 332830 - DNA, 16 bp, C. familiaris
ttgaaaaatattttct

SEQ ID NO: 332831 - DNA, 16 bp, C. familiaris
ttgaaaaatcagaaga

SEQ ID NO: 332832 - DNA, 16 bp, C. familiaris
ttgaaaacaaaatgaa

SEQ ID NO: 332833 - DNA, 16 bp, C. familiaris
ttgaaaacaaatgaaa

SEQ ID NO: 332834 - DNA, 16 bp, C. familiaris
ttgaaaacaattttaa

SEQ ID NO: 332835 - DNA, 16 bp, C. familiaris
ttgaaaacttttaaaa

SEQ ID NO: 332836 - DNA, 16 bp, C. familiaris
ttgaaaagaatgtgca

SEQ ID NO: 332837 - DNA, 16 bp, C. familiaris
ttgaaaagactgataa

SEQ ID NO: 332838 - DNA, 16 bp, C. familiaris
ttgaaaagatcagcaa

SEQ ID NO: 332839 - DNA, 16 bp, C. familiaris
ttgaaaaggaagaagt

SEQ ID NO: 332840 - DNA, 16 bp, C. familiaris
ttgaaaatatgtattt

SEQ ID NO: 332841 - DNA, 16 bp, C. familiaris
ttgaaaatgacaagat

SEQ ID NO: 332842 - DNA, 16 bp, C. familiaris
ttgaaaatgacatatc

SEQ ID NO: 332843 - DNA, 16 bp, C. familiaris
ttgaaaatgggattga

SEQ ID NO: 332844 - DNA, 16 bp, C. familiaris
ttgaaagaaattaaga

SEQ ID NO: 332845 - DNA, 16 bp, C. familiaris
ttgaaagaagaatgga

SEQ ID NO: 332846 - DNA, 16 bp, C. familiaris
ttgaaagaattatttt

SEQ ID NO: 332847 - DNA, 16 bp, C. familiaris
ttgaaagagaaaagca

SEQ ID NO: 332848 - DNA, 16 bp, C. familiaris
ttgaaagagaagaaca

SEQ ID NO: 332849 - DNA, 16 bp, C. familiaris
ttgaaagcaaagaaaa

SEQ ID NO: 332850 - DNA, 16 bp, C. familiaris
ttgaaagcaaccaaga

SEQ ID NO: 332851 - DNA, 16 bp, C. familiaris
ttgaaagctttccttc

SEQ ID NO: 332852 - DNA, 16 bp, C. familiaris
ttgaaatgaaaaggaa

SEQ ID NO: 332853 - DNA, 16 bp, C. familiaris
ttgaaattaaaaacat

SEQ ID NO: 332854 - DNA, 16 bp, C. familiaris
ttgaaattatttttct

SEQ ID NO: 332855 - DNA, 16 bp, C. familiaris
ttgaaattcttccaaa

SEQ ID NO: 332856 - DNA, 16 bp, C. familiaris
ttgaaatttgctgaga

SEQ ID NO: 332857 - DNA, 16 bp, C. familiaris
ttgaacaaagacttga

SEQ ID NO: 332858 - DNA, 16 bp, C. familiaris
ttgaacaattaaataa

SEQ ID NO: 332859 - DNA, 16 bp, C. familiaris
ttgaacaccaaaaaaa

SEQ ID NO: 332860 - DNA, 16 bp, C. familiaris
ttgaaccagccaggca

SEQ ID NO: 332861 - DNA, 16 bp, C. familiaris
ttgaacctggccacag

SEQ ID NO: 332862 - DNA, 16 bp, C. familiaris
ttgaactccaataaat

SEQ ID NO: 332863 - DNA, 16 bp, C. familiaris
ttgaagaaaatattta

SEQ ID NO: 332864 - DNA, 16 bp, C. familiaris
ttgaagaaaatgaaga

SEQ ID NO: 332865 - DNA, 16 bp, C. familiaris
ttgaagaaacaatggc

SEQ ID NO: 332866 - DNA, 16 bp, C. familiaris
ttgaagaaatgtctgt

SEQ ID NO: 332867 - DNA, 16 bp, C. familiaris
ttgaagaaattaattt

SEQ ID NO: 332868 - DNA, 16 bp, C. familiaris
ttgaagaaattatttt

SEQ ID NO: 332869 - DNA, 16 bp, C. familiaris
ttgaagaagatacaaa

SEQ ID NO: 332870 - DNA, 16 bp, C. familiaris
ttgaagagactatctt

SEQ ID NO: 332871 - DNA, 16 bp, C. familiaris
ttgaagatattttaaa

SEQ ID NO: 332872 - DNA, 16 bp, C. familiaris
ttgaagatgacacaag

SEQ ID NO: 332873 - DNA, 16 bp, C. familiaris
ttgaagatggaagagg

SEQ ID NO: 332874 - DNA, 16 bp, C. familiaris
ttgaagatggagaaag

SEQ ID NO: 332875 - DNA, 16 bp, C. familiaris
ttgaagatggaggaag

SEQ ID NO: 332876 - DNA, 16 bp, C. familiaris
ttgaagattttttaaa

SEQ ID NO: 332877 - DNA, 16 bp, C. familiaris
ttgaagcaaatggagg

SEQ ID NO: 332878 - DNA, 17 bp, C. familiaris
ttgaagcagtcatcaac

SEQ ID NO: 332879 - DNA, 16 bp, C. familiaris
ttgaaggaagaaagga

SEQ ID NO: 332880 - DNA, 16 bp, C. familiaris
ttgaagtcttaacccc

SEQ ID NO: 332881 - DNA, 16 bp, C. familiaris
ttgaatcaaaaagaat

SEQ ID NO: 332882 - DNA, 16 bp, C. familiaris
ttgaatcctacatcag

SEQ ID NO: 332883 - DNA, 16 bp, C. familiaris
ttgaatggaaagaaaa

SEQ ID NO: 332884 - DNA, 16 bp, C. familiaris
ttgaatggatgaataa

SEQ ID NO: 332885 - DNA, 16 bp, C. familiaris
ttgaatggattaaaaa

SEQ ID NO: 332886 - DNA, 16 bp, C. familiaris
ttgaatttaaactaaa

SEQ ID NO: 332887 - DNA, 16 bp, C. familiaris
ttgacaaagcagggaa

SEQ ID NO: 332888 - DNA, 16 bp, C. familiaris
ttgacaccacagaaat

SEQ ID NO: 332889 - DNA, 16 bp, C. familiaris
ttgacagaagaggaaa

SEQ ID NO: 332890 - DNA, 16 bp, C. familiaris
ttgacagaaggagaga

SEQ ID NO: 332891 - DNA, 16 bp, C. familiaris
ttgacagatgggaaaa

SEQ ID NO: 332892 - DNA, 16 bp, C. familiaris
ttgacatacattatat

SEQ ID NO: 332893 - DNA, 16 bp, C. familiaris
ttgaccatgaagttga

SEQ ID NO: 332894 - DNA, 16 bp, C. familiaris
ttgactcaagaagaaa

SEQ ID NO: 332895 - DNA, 16 bp, C. familiaris
ttgactgaaccaccca

SEQ ID NO: 332896 - DNA, 16 bp, C. familiaris
ttgactgacttatttc

SEQ ID NO: 332897 - DNA, 16 bp, C. familiaris
ttgacttatgatattt

SEQ ID NO: 332898 - DNA, 16 bp, C. familiaris
ttgacttctctgtgcc

SEQ ID NO: 332899 - DNA, 16 bp, C. familiaris
ttgagaaaagagtaga

SEQ ID NO: 332900 - DNA, 16 bp, C. familiaris
ttgagaaagaaaaagc

SEQ ID NO: 332901 - DNA, 16 bp, C. familiaris
ttgagaaagaacaaaa

SEQ ID NO: 332902 - DNA, 16 bp, C. familiaris
ttgagaaagaacagag

SEQ ID NO: 332903 - DNA, 16 bp, C. familiaris
ttgagaaattagaaaa

SEQ ID NO: 332904 - DNA, 16 bp, C. familiaris
ttgagaaccactgctc

SEQ ID NO: 332905 - DNA, 16 bp, C. familiaris
ttgagaacccagaaat

SEQ ID NO: 332906 - DNA, 16 bp, C. familiaris
ttgagaagcagagaga

SEQ ID NO: 332907 - DNA, 16 bp, C. familiaris
ttgagaaggatatttg

SEQ ID NO: 332908 - DNA, 16 bp, C. familiaris
ttgagaatttttgcct

SEQ ID NO: 332909 - DNA, 16 bp, C. familiaris
ttgagacaaatgaaaa

SEQ ID NO: 332910 - DNA, 16 bp, C. familiaris
ttgagaccctgctttc

SEQ ID NO: 332911 - DNA, 16 bp, C. familiaris
ttgagactttttcttt

SEQ ID NO: 332912 - DNA, 16 bp, C. familiaris
ttgagagagaacaagt

SEQ ID NO: 332913 - DNA, 16 bp, C. familiaris
ttgagagagaacagag

SEQ ID NO: 332914 - DNA, 16 bp, C. familiaris
ttgagagggagagaaa

SEQ ID NO: 332915 - DNA, 16 bp, C. familiaris
ttgagagtctctccct

SEQ ID NO: 332916 - DNA, 16 bp, C. familiaris
ttgagatcatgactga

SEQ ID NO: 332917 - DNA, 16 bp, C. familiaris
ttgagatctactctct

SEQ ID NO: 332918 - DNA, 16 bp, C. familiaris
ttgagcatctgcctca

SEQ ID NO: 332919 - DNA, 16 bp, C. familiaris
ttgagcatctttttat

SEQ ID NO: 332920 - DNA, 16 bp, C. familiaris
ttgagccaaagacaga

SEQ ID NO: 332921 - DNA, 16 bp, C. familiaris
ttgagccacacattgg

SEQ ID NO: 332922 - DNA, 16 bp, C. familiaris
ttgagcccaggaccct

SEQ ID NO: 332923 - DNA, 16 bp, C. familiaris
ttgagccctttatctc

SEQ ID NO: 332924 - DNA, 16 bp, C. familiaris
ttgagcctttgccttc

SEQ ID NO: 332925 - DNA, 16 bp, C. familiaris
ttgagcgcctgctttt

SEQ ID NO: 332926 - DNA, 16 bp, C. familiaris
ttgagcgtcttgcctt

SEQ ID NO: 332927 - DNA, 16 bp, C. familiaris
ttgagctccacattgg

SEQ ID NO: 332928 - DNA, 16 bp, C. familiaris
ttgaggaacatccaca

SEQ ID NO: 332929 - DNA, 16 bp, C. familiaris
ttgaggagcacctggg

SEQ ID NO: 332930 - DNA, 16 bp, C. familiaris
ttgaggatatttgcat

SEQ ID NO: 332931 - DNA, 16 bp, C. familiaris
ttgagtatctgtcttt

SEQ ID NO: 332932 - DNA, 16 bp, C. familiaris
ttgagtcacccaggga

SEQ ID NO: 332933 - DNA, 16 bp, C. familiaris
ttgagtcctgagttgg

SEQ ID NO: 332934 - DNA, 16 bp, C. familiaris
ttgagtcctgcattga

SEQ ID NO: 332935 - DNA, 16 bp, C. familiaris
ttgagtctctgccaaa

SEQ ID NO: 332936 - DNA, 16 bp, C. familiaris
ttgagttaatgttttc

SEQ ID NO: 332937 - DNA, 16 bp, C. familiaris
ttgagtttatcattgt

SEQ ID NO: 332938 - DNA, 16 bp, C. familiaris
ttgataaagtctctgt

SEQ ID NO: 332939 - DNA, 16 bp, C. familiaris
ttgataaatttgataa

SEQ ID NO: 332940 - DNA, 16 bp, C. familiaris
ttgataatgatgatga

SEQ ID NO: 332941 - DNA, 16 bp, C. familiaris
ttgatagacacttggg

SEQ ID NO: 332942 - DNA, 16 bp, C. familiaris
ttgatatttttgaaga

SEQ ID NO: 332943 - DNA, 16 bp, C. familiaris
ttgatcagttgatgaa

SEQ ID NO: 332944 - DNA, 16 bp, C. familiaris
ttgatcatgatgaatg

SEQ ID NO: 332945 - DNA, 16 bp, C. familiaris
ttgatcccaagtctcc

SEQ ID NO: 332946 - DNA, 16 bp, C. familiaris
ttgatcccagggtcat

SEQ ID NO: 332947 - DNA, 16 bp, C. familiaris
ttgatctcaagaccca

SEQ ID NO: 332948 - DNA, 16 bp, C. familiaris
ttgatcttttccaaga

SEQ ID NO: 332949 - DNA, 16 bp, C. familiaris
ttgatgaaaaaatatt

SEQ ID NO: 332950 - DNA, 16 bp, C. familiaris
ttgatgaaaataattt

SEQ ID NO: 332951 - DNA, 16 bp, C. familiaris
ttgatgaaagaaactg

SEQ ID NO: 332952 - DNA, 16 bp, C. familiaris
ttgatgaggatgcaga

SEQ ID NO: 332953 - DNA, 16 bp, C. familiaris
ttgatgatagccatcc

SEQ ID NO: 332954 - DNA, 16 bp, C. familiaris
ttgatgatgacagctt

SEQ ID NO: 332955 - DNA, 16 bp, C. familiaris
ttgatgatgatgatga

SEQ ID NO: 332956 - DNA, 16 bp, C. familiaris
ttgatgatggtgatga

SEQ ID NO: 332957 - DNA, 16 bp, C. familiaris
ttgatgcatttcaaag

SEQ ID NO: 332958 - DNA, 16 bp, C. familiaris
ttgatggcctgggcag

SEQ ID NO: 332959 - DNA, 16 bp, C. familiaris
ttgatggggtctttgg

SEQ ID NO: 332960 - DNA, 16 bp, C. familiaris
ttgatgtatgtgtctg

SEQ ID NO: 332961 - DNA, 16 bp, C. familiaris
ttgatgtgttccacag

SEQ ID NO: 332962 - DNA, 16 bp, C. familiaris
ttgattattacagctt

SEQ ID NO: 332963 - DNA, 16 bp, C. familiaris
ttgattccagctcagg

SEQ ID NO: 332964 - DNA, 16 bp, C. familiaris
ttgattcctttctctt

SEQ ID NO: 332965 - DNA, 16 bp, C. familiaris
ttgattgaagagactg

SEQ ID NO: 332966 - DNA, 16 bp, C. familiaris
ttgattggagcatttt

SEQ ID NO: 332967 - DNA, 16 bp, C. familiaris
ttgatttctatagctt

SEQ ID NO: 332968 - DNA, 16 bp, C. familiaris
ttgatttggggaatat

SEQ ID NO: 332969 - DNA, 16 bp, C. familiaris
ttgatttgtatttctg

SEQ ID NO: 332970 - DNA, 16 bp, C. familiaris
ttgattttaaaaatgt

SEQ ID NO: 332971 - DNA, 16 bp, C. familiaris
ttgatttttaaaatct

SEQ ID NO: 332972 - DNA, 16 bp, C. familiaris
ttgcaaatattatttt

SEQ ID NO: 332973 - DNA, 16 bp, C. familiaris
ttgcaaatgggaagat

SEQ ID NO: 332974 - DNA, 16 bp, C. familiaris
ttgcaaattccaaagg

SEQ ID NO: 332975 - DNA, 16 bp, C. familiaris
ttgcaacaacatgtat

SEQ ID NO: 332976 - DNA, 16 bp, C. familiaris
ttgcacagaagaaaaa

SEQ ID NO: 332977 - DNA, 16 bp, C. familiaris
ttgcactgaatctata

SEQ ID NO: 332978 - DNA, 16 bp, C. familiaris
ttgcactgtgggtggg

SEQ ID NO: 332979 - DNA, 16 bp, C. familiaris
ttgcagatgacaggat

SEQ ID NO: 332980 - DNA, 16 bp, C. familiaris
ttgcagccaagaatac

SEQ ID NO: 332981 - DNA, 16 bp, C. familiaris
ttgcagctgaaagcat

SEQ ID NO: 332982 - DNA, 16 bp, C. familiaris
ttgcaggtttggttcc

SEQ ID NO: 332983 - DNA, 16 bp, C. familiaris
ttgcatatttgaaaat

SEQ ID NO: 332984 - DNA, 16 bp, C. familiaris
ttgcatattttaaaat

SEQ ID NO: 332985 - DNA, 16 bp, C. familiaris
ttgcatccatgtttat

SEQ ID NO: 332986 - DNA, 16 bp, C. familiaris
ttgcatgagttcttta

SEQ ID NO: 332987 - DNA, 16 bp, C. familiaris
ttgcattaattgattt

SEQ ID NO: 332988 - DNA, 16 bp, C. familiaris
ttgcattttcaaaata

SEQ ID NO: 332989 - DNA, 16 bp, C. familiaris
ttgcattttttacaaa

SEQ ID NO: 332990 - DNA, 16 bp, C. familiaris
ttgccaaaaacaaaaa

SEQ ID NO: 332991 - DNA, 16 bp, C. familiaris
ttgccaacatacagag

SEQ ID NO: 332992 - DNA, 16 bp, C. familiaris
ttgccagaagggaagg

SEQ ID NO: 332993 - DNA, 16 bp, C. familiaris
ttgccaggaaaaaaaa

SEQ ID NO: 332994 - DNA, 16 bp, C. familiaris
ttgccagggactgggg

SEQ ID NO: 332995 - DNA, 16 bp, C. familiaris
ttgccagggggccagg

SEQ ID NO: 332996 - DNA, 16 bp, C. familiaris
ttgccagtattttatt

SEQ ID NO: 332997 - DNA, 16 bp, C. familiaris
ttgccataaactgtga

SEQ ID NO: 332998 - DNA, 16 bp, C. familiaris
ttgccatctgcaatga

SEQ ID NO: 332999 - DNA, 16 bp, C. familiaris
ttgccattagcaacaa

SEQ ID NO: 333000 - DNA, 16 bp, C. familiaris
ttgccattgtcaagtt

SEQ ID NO: 333001 - DNA, 16 bp, C. familiaris
ttgccatttgcagtga

SEQ ID NO: 333002 - DNA, 16 bp, C. familiaris
ttgccattttaattat

SEQ ID NO: 333003 - DNA, 16 bp, C. familiaris
ttgccattttattact

SEQ ID NO: 333004 - DNA, 16 bp, C. familiaris
ttgcccaaggtcatgt

SEQ ID NO: 333005 - DNA, 16 bp, C. familiaris
ttgcccatttttctct

SEQ ID NO: 333006 - DNA, 16 bp, C. familiaris
ttgccctcatgaagct

SEQ ID NO: 333007 - DNA, 16 bp, C. familiaris
ttgcctcaggagatat

SEQ ID NO: 333008 - DNA, 16 bp, C. familiaris
ttgcctggggctggag

SEQ ID NO: 333009 - DNA, 16 bp, C. familiaris
ttgcctgtgtctctgc

SEQ ID NO: 333010 - DNA, 16 bp, C. familiaris
ttgcctttgaagacat

SEQ ID NO: 333011 - DNA, 16 bp, C. familiaris
ttgcctttgagttttg

SEQ ID NO: 333012 - DNA, 16 bp, C. familiaris
ttgcctttgtctcagg

SEQ ID NO: 333013 - DNA, 16 bp, C. familiaris
ttgctaatcagctgac

SEQ ID NO: 333014 - DNA, 16 bp, C. familiaris
ttgctacaaaccttca

SEQ ID NO: 333015 - DNA, 16 bp, C. familiaris
ttgctactctggcttt

SEQ ID NO: 333016 - DNA, 17 bp, C. familiaris
ttgctagatctcataca

SEQ ID NO: 333017 - DNA, 16 bp, C. familiaris
ttgctatgcaaaagct

SEQ ID NO: 333018 - DNA, 16 bp, C. familiaris
ttgctcagtgcagaat

SEQ ID NO: 333019 - DNA, 16 bp, C. familiaris
ttgctctctctttcaa

SEQ ID NO: 333020 - DNA, 16 bp, C. familiaris
ttgctctgtctctcaa

SEQ ID NO: 333021 - DNA, 16 bp, C. familiaris
ttgctcttttcaaaga

SEQ ID NO: 333022 - DNA, 16 bp, C. familiaris
ttgctgaagagacttt

SEQ ID NO: 333023 - DNA, 16 bp, C. familiaris
ttgctgaatgaaagaa

SEQ ID NO: 333024 - DNA, 16 bp, C. familiaris
ttgctgagcagtattc

SEQ ID NO: 333025 - DNA, 16 bp, C. familiaris
ttgctgccagaaacat

SEQ ID NO: 333026 - DNA, 16 bp, C. familiaris
ttgctgcctgttttct

SEQ ID NO: 333027 - DNA, 16 bp, C. familiaris
ttgctgctctgaacat

SEQ ID NO: 333028 - DNA, 16 bp, C. familiaris
ttgctgctgagtttaa

SEQ ID NO: 333029 - DNA, 16 bp, C. familiaris
ttgctggctctgaaga

SEQ ID NO: 333030 - DNA, 16 bp, C. familiaris
ttgctggctttgaagg

SEQ ID NO: 333031 - DNA, 16 bp, C. familiaris
ttgctgggattttgat

SEQ ID NO: 333032 - DNA, 16 bp, C. familiaris
ttgctggttttgaaga

SEQ ID NO: 333033 - DNA, 16 bp, C. familiaris
ttgctgttagaaacat

SEQ ID NO: 333034 - DNA, 16 bp, C. familiaris
ttgctgttgctgctgc

SEQ ID NO: 333035 - DNA, 16 bp, C. familiaris
ttgcttatatgtggaa

SEQ ID NO: 333036 - DNA, 16 bp, C. familiaris
ttgcttatgcttttgg

SEQ ID NO: 333037 - DNA, 16 bp, C. familiaris
ttgcttcattaaaaaa

SEQ ID NO: 333038 - DNA, 16 bp, C. familiaris
ttgcttccacctttgg

SEQ ID NO: 333039 - DNA, 16 bp, C. familiaris
ttgcttccatgtcttg

SEQ ID NO: 333040 - DNA, 16 bp, C. familiaris
ttgcttccatgtggat

SEQ ID NO: 333041 - DNA, 16 bp, C. familiaris
ttgcttcctatgatta

SEQ ID NO: 333042 - DNA, 16 bp, C. familiaris
ttgcttgtgcttttga

SEQ ID NO: 333043 - DNA, 16 bp, C. familiaris
ttgctttataatttta

SEQ ID NO: 333044 - DNA, 16 bp, C. familiaris
ttgctttatttttaaa

SEQ ID NO: 333045 - DNA, 16 bp, C. familiaris
ttgctttccaaagtgg

SEQ ID NO: 333046 - DNA, 16 bp, C. familiaris
ttgctttggatggtat

SEQ ID NO: 333047 - DNA, 16 bp, C. familiaris
ttgcttttaagaaaat

SEQ ID NO: 333048 - DNA, 16 bp, C. familiaris
ttgcttttcacattta

SEQ ID NO: 333049 - DNA, 16 bp, C. familiaris
ttgcttttccttttca

SEQ ID NO: 333050 - DNA, 16 bp, C. familiaris
ttgcttttctaaaaat

SEQ ID NO: 333051 - DNA, 16 bp, C. familiaris
ttgcttttgcactttt

SEQ ID NO: 333052 - DNA, 16 bp, C. familiaris
ttgcttttgctatttg

SEQ ID NO: 333053 - DNA, 16 bp, C. familiaris
ttgcttttgttgccat

SEQ ID NO: 333054 - DNA, 16 bp, C. familiaris
ttggaaaaaatttttt

SEQ ID NO: 333055 - DNA, 16 bp, C. familiaris
ttggaaaagacctaga

SEQ ID NO: 333056 - DNA, 16 bp, C. familiaris
ttggaaaataagaaag

SEQ ID NO: 333057 - DNA, 16 bp, C. familiaris
ttggaaaatacagaaa

SEQ ID NO: 333058 - DNA, 16 bp, C. familiaris
ttggaaaattggacag

SEQ ID NO: 333059 - DNA, 16 bp, C. familiaris
ttggaaaattttaaat

SEQ ID NO: 333060 - DNA, 16 bp, C. familiaris
ttggaaacaatccaaa

SEQ ID NO: 333061 - DNA, 16 bp, C. familiaris
ttggaaagacagaaag

SEQ ID NO: 333062 - DNA, 16 bp, C. familiaris
ttggaaataaatttaa

SEQ ID NO: 333063 - DNA, 16 bp, C. familiaris
ttggaaataatccaaa

SEQ ID NO: 333064 - DNA, 16 bp, C. familiaris
ttggaaatattttctc

SEQ ID NO: 333065 - DNA, 16 bp, C. familiaris
ttggaaatatttttaa

SEQ ID NO: 333066 - DNA, 16 bp, C. familiaris
ttggaacttgatccca

SEQ ID NO: 333067 - DNA, 16 bp, C. familiaris
ttggaagaaatagaaa

SEQ ID NO: 333068 - DNA, 16 bp, C. familiaris
ttggaagaagatgcca

SEQ ID NO: 333069 - DNA, 16 bp, C. familiaris
ttggaagagtttggga

SEQ ID NO: 333070 - DNA, 16 bp, C. familiaris
ttggaagattcaatat

SEQ ID NO: 333071 - DNA, 16 bp, C. familiaris
ttggaaggaaatgaaa

SEQ ID NO: 333072 - DNA, 16 bp, C. familiaris
ttggaagtattctctc

SEQ ID NO: 333073 - DNA, 16 bp, C. familiaris
ttggaatagtttggga

SEQ ID NO: 333074 - DNA, 16 bp, C. familiaris
ttggaatttaaaaata

SEQ ID NO: 333075 - DNA, 16 bp, C. familiaris
ttggacaaatcattta

SEQ ID NO: 333076 - DNA, 16 bp, C. familiaris
ttggaccagggtgtga

SEQ ID NO: 333077 - DNA, 16 bp, C. familiaris
ttggacttctgacttc

SEQ ID NO: 333078 - DNA, 16 bp, C. familiaris
ttggagaaaaataaag

SEQ ID NO: 333079 - DNA, 16 bp, C. familiaris
ttggagaggaggtgga

SEQ ID NO: 333080 - DNA, 16 bp, C. familiaris
ttggagaggatgagga

SEQ ID NO: 333081 - DNA, 16 bp, C. familiaris
ttggagcacctggctg

SEQ ID NO: 333082 - DNA, 16 bp, C. familiaris
ttggagctgaagaagc

SEQ ID NO: 333083 - DNA, 16 bp, C. familiaris
ttggagggcagcctgg

SEQ ID NO: 333084 - DNA, 16 bp, C. familiaris
ttggaggtgttgtgct

SEQ ID NO: 333085 - DNA, 16 bp, C. familiaris
ttggaggttaggactt

SEQ ID NO: 333086 - DNA, 16 bp, C. familiaris
ttggagttttgaaacc

SEQ ID NO: 333087 - DNA, 16 bp, C. familiaris
ttggatatcctttcct

SEQ ID NO: 333088 - DNA, 16 bp, C. familiaris
ttggatatgccatttg

SEQ ID NO: 333089 - DNA, 16 bp, C. familiaris
ttggatattaaccttt

SEQ ID NO: 333090 - DNA, 16 bp, C. familiaris
ttggatattccttcct

SEQ ID NO: 333091 - DNA, 16 bp, C. familiaris
ttggatattcttgcct

SEQ ID NO: 333092 - DNA, 16 bp, C. familiaris
ttggatcatgatctca

SEQ ID NO: 333093 - DNA, 16 bp, C. familiaris
ttggatttgccaacat

SEQ ID NO: 333094 - DNA, 16 bp, C. familiaris
ttggcaaaaaagaagt

SEQ ID NO: 333095 - DNA, 16 bp, C. familiaris
ttggcaaaatatttaa

SEQ ID NO: 333096 - DNA, 16 bp, C. familiaris
ttggcaaatggaattt

SEQ ID NO: 333097 - DNA, 16 bp, C. familiaris
ttggcaaattgaacaa

SEQ ID NO: 333098 - DNA, 16 bp, C. familiaris
ttggcaataaaaagaa

SEQ ID NO: 333099 - DNA, 16 bp, C. familiaris
ttggcaatgacttttt

SEQ ID NO: 333100 - DNA, 16 bp, C. familiaris
ttggcataaagttttt

SEQ ID NO: 333101 - DNA, 16 bp, C. familiaris
ttggcatcagggaaat

SEQ ID NO: 333102 - DNA, 16 bp, C. familiaris
ttggccactggcccct

SEQ ID NO: 333103 - DNA, 16 bp, C. familiaris
ttggccataaagttga

SEQ ID NO: 333104 - DNA, 16 bp, C. familiaris
ttggccattggctctg

SEQ ID NO: 333105 - DNA, 16 bp, C. familiaris
ttggcccaggccatga

SEQ ID NO: 333106 - DNA, 16 bp, C. familiaris
ttggcccggggcatga

SEQ ID NO: 333107 - DNA, 16 bp, C. familiaris
ttggcgcctgccttct

SEQ ID NO: 333108 - DNA, 16 bp, C. familiaris
ttggctactatggaca

SEQ ID NO: 333109 - DNA, 16 bp, C. familiaris
ttggctatttggaatc

SEQ ID NO: 333110 - DNA, 16 bp, C. familiaris
ttggctcagatcgtga

SEQ ID NO: 333111 - DNA, 16 bp, C. familiaris
ttggctcagggggtga

SEQ ID NO: 333112 - DNA, 16 bp, C. familiaris
ttggctcagggtttga

SEQ ID NO: 333113 - DNA, 16 bp, C. familiaris
ttggctcagttggaag

SEQ ID NO: 333114 - DNA, 16 bp, C. familiaris
ttggctctggtggtga

SEQ ID NO: 333115 - DNA, 16 bp, C. familiaris
ttggctgaaggtggca

SEQ ID NO: 333116 - DNA, 16 bp, C. familiaris
ttggctgagatcatga

SEQ ID NO: 333117 - DNA, 16 bp, C. familiaris
ttggctgcaagtaaca

SEQ ID NO: 333118 - DNA, 16 bp, C. familiaris
ttggctggctcagctg

SEQ ID NO: 333119 - DNA, 16 bp, C. familiaris
ttggctggggctgcag

SEQ ID NO: 333120 - DNA, 16 bp, C. familiaris
ttggctttggtatcag

SEQ ID NO: 333121 - DNA, 16 bp, C. familiaris
ttgggaaaactgaaca

SEQ ID NO: 333122 - DNA, 16 bp, C. familiaris
ttgggaaggaaaaaat

SEQ ID NO: 333123 - DNA, 16 bp, C. familiaris
ttgggaaggaagaaat

SEQ ID NO: 333124 - DNA, 16 bp, C. familiaris
ttgggaagttttcctt

SEQ ID NO: 333125 - DNA, 16 bp, C. familiaris
ttgggagctttttgat

SEQ ID NO: 333126 - DNA, 16 bp, C. familiaris
ttgggatcttttctgg

SEQ ID NO: 333127 - DNA, 16 bp, C. familiaris
ttgggatgaattcttc

SEQ ID NO: 333128 - DNA, 16 bp, C. familiaris
ttgggattgtcctctg

SEQ ID NO: 333129 - DNA, 16 bp, C. familiaris
ttgggctcaaggcatg

SEQ ID NO: 333130 - DNA, 16 bp, C. familiaris
ttgggctccatgttgg

SEQ ID NO: 333131 - DNA, 16 bp, C. familiaris
ttgggctccccactgg

SEQ ID NO: 333132 - DNA, 16 bp, C. familiaris
ttgggctccttgctgg

SEQ ID NO: 333133 - DNA, 16 bp, C. familiaris
ttgggctctgctcagc

SEQ ID NO: 333134 - DNA, 16 bp, C. familiaris
ttgggcttcctgcagg

SEQ ID NO: 333135 - DNA, 16 bp, C. familiaris
ttgggcttggcactca

SEQ ID NO: 333136 - DNA, 16 bp, C. familiaris
ttggggaaaaggaaat

SEQ ID NO: 333137 - DNA, 16 bp, C. familiaris
ttggggaacctccaca

SEQ ID NO: 333138 - DNA, 16 bp, C. familiaris
ttggggggcagcctgg

SEQ ID NO: 333139 - DNA, 16 bp, C. familiaris
ttggggtgcaggtgac

SEQ ID NO: 333140 - DNA, 16 bp, C. familiaris
ttggggttttaaaaaa

SEQ ID NO: 333141 - DNA, 16 bp, C. familiaris
ttgggtggcacagtca

SEQ ID NO: 333142 - DNA, 16 bp, C. familiaris
ttgggtggctctgtgg

SEQ ID NO: 333143 - DNA, 16 bp, C. familiaris
ttgggttcaggtcgtg

SEQ ID NO: 333144 - DNA, 16 bp, C. familiaris
ttggtaaaaacaaaac

SEQ ID NO: 333145 - DNA, 16 bp, C. familiaris
ttggtcacttctttga

SEQ ID NO: 333146 - DNA, 16 bp, C. familiaris
ttggtgaaaatgtgaa

SEQ ID NO: 333147 - DNA, 16 bp, C. familiaris
ttggtgaaacatctgc

SEQ ID NO: 333148 - DNA, 16 bp, C. familiaris
ttggtgaggatgcaaa

SEQ ID NO: 333149 - DNA, 16 bp, C. familiaris
ttggtgaggatgcaga

SEQ ID NO: 333150 - DNA, 16 bp, C. familiaris
ttggtgatgatgatga

SEQ ID NO: 333151 - DNA, 16 bp, C. familiaris
ttggtgcctgtctttg

SEQ ID NO: 333152 - DNA, 16 bp, C. familiaris
ttggtggagcatgaga

SEQ ID NO: 333153 - DNA, 16 bp, C. familiaris
ttggtggagtatgtga

SEQ ID NO: 333154 - DNA, 16 bp, C. familiaris
ttggtggatatttggg

SEQ ID NO: 333155 - DNA, 16 bp, C. familiaris
ttggtggattcttgtc

SEQ ID NO: 333156 - DNA, 16 bp, C. familiaris
ttggtggctgccagag

SEQ ID NO: 333157 - DNA, 16 bp, C. familiaris
ttggtgtcctcatctg

SEQ ID NO: 333158 - DNA, 16 bp, C. familiaris
ttggtgttggcctgct

SEQ ID NO: 333159 - DNA, 16 bp, C. familiaris
ttggttgatagtgttg

SEQ ID NO: 333160 - DNA, 16 bp, C. familiaris
ttggtttgcattttct

SEQ ID NO: 333161 - DNA, 16 bp, C. familiaris
ttggttttctcatctt

SEQ ID NO: 333162 - DNA, 16 bp, C. familiaris
ttgtaaaaaagatttt

SEQ ID NO: 333163 - DNA, 16 bp, C. familiaris
ttgtaaaaatggaaaa

SEQ ID NO: 333164 - DNA, 16 bp, C. familiaris
ttgtaaaatatgaaag

SEQ ID NO: 333165 - DNA, 16 bp, C. familiaris
ttgtaaataaaatgtt

SEQ ID NO: 333166 - DNA, 16 bp, C. familiaris
ttgtaaatatttttct

SEQ ID NO: 333167 - DNA, 16 bp, C. familiaris
ttgtaaatgaaatttt

SEQ ID NO: 333168 - DNA, 16 bp, C. familiaris
ttgtaacaaccaaaaa

SEQ ID NO: 333169 - DNA, 16 bp, C. familiaris
ttgtaagttcaagcct

SEQ ID NO: 333170 - DNA, 16 bp, C. familiaris
ttgtacaacactgtga

SEQ ID NO: 333171 - DNA, 16 bp, C. familiaris
ttgtacatatatatat

SEQ ID NO: 333172 - DNA, 16 bp, C. familiaris
ttgtacatattttgtt

SEQ ID NO: 333173 - DNA, 16 bp, C. familiaris
ttgtacattctatgga

SEQ ID NO: 333174 - DNA, 16 bp, C. familiaris
ttgtacattgattttg

SEQ ID NO: 333175 - DNA, 16 bp, C. familiaris
ttgtaccttttgactc

SEQ ID NO: 333176 - DNA, 16 bp, C. familiaris
ttgtagatgagaaaat

SEQ ID NO: 333177 - DNA, 16 bp, C. familiaris
ttgtagatgaggaaat

SEQ ID NO: 333178 - DNA, 16 bp, C. familiaris
ttgtaggtctgattct

SEQ ID NO: 333179 - DNA, 16 bp, C. familiaris
ttgtagtgcaaaagca

SEQ ID NO: 333180 - DNA, 16 bp, C. familiaris
ttgtataaatggaatc

SEQ ID NO: 333181 - DNA, 16 bp, C. familiaris
ttgtatacaagttttt

SEQ ID NO: 333182 - DNA, 16 bp, C. familiaris
ttgtatatatgtgtgt

SEQ ID NO: 333183 - DNA, 16 bp, C. familiaris
ttgtatcatcttcagt

SEQ ID NO: 333184 - DNA, 16 bp, C. familiaris
ttgtatctatatttat

SEQ ID NO: 333185 - DNA, 16 bp, C. familiaris
ttgtatgatatatata

SEQ ID NO: 333186 - DNA, 16 bp, C. familiaris
ttgtatgtatagacca

SEQ ID NO: 333187 - DNA, 16 bp, C. familiaris
ttgtattccctttcac

SEQ ID NO: 333188 - DNA, 16 bp, C. familiaris
ttgtattttcttctaa

SEQ ID NO: 333189 - DNA, 16 bp, C. familiaris
ttgtcaaagaagaagt

SEQ ID NO: 333190 - DNA, 16 bp, C. familiaris
ttgtcaaataaataca

SEQ ID NO: 333191 - DNA, 16 bp, C. familiaris
ttgtcaaattgaattt

SEQ ID NO: 333192 - DNA, 16 bp, C. familiaris
ttgtcaccaccaccac

SEQ ID NO: 333193 - DNA, 16 bp, C. familiaris
ttgtcagatgcttttt

SEQ ID NO: 333194 - DNA, 16 bp, C. familiaris
ttgtcatctgtgaaat

SEQ ID NO: 333195 - DNA, 16 bp, C. familiaris
ttgtcatgaatggcaa

SEQ ID NO: 333196 - DNA, 16 bp, C. familiaris
ttgtcattggatttag

SEQ ID NO: 333197 - DNA, 16 bp, C. familiaris
ttgtcatttcaaaaat

SEQ ID NO: 333198 - DNA, 16 bp, C. familiaris
ttgtcattttaattac

SEQ ID NO: 333199 - DNA, 16 bp, C. familiaris
ttgtccaatttattgg

SEQ ID NO: 333200 - DNA, 16 bp, C. familiaris
ttgtccctgaagatca

SEQ ID NO: 333201 - DNA, 16 bp, C. familiaris
ttgtcccttgcatatt

SEQ ID NO: 333202 - DNA, 16 bp, C. familiaris
ttgtccttctgtgact

SEQ ID NO: 333203 - DNA, 16 bp, C. familiaris
ttgtccttctgtgatt

SEQ ID NO: 333204 - DNA, 16 bp, C. familiaris
ttgtctccctctctta

SEQ ID NO: 333205 - DNA, 16 bp, C. familiaris
ttgtctcccttgcctc

SEQ ID NO: 333206 - DNA, 16 bp, C. familiaris
ttgtctgatatgagta

SEQ ID NO: 333207 - DNA, 16 bp, C. familiaris
ttgtctgtctccctca

SEQ ID NO: 333208 - DNA, 16 bp, C. familiaris
ttgtctgtgactgctt

SEQ ID NO: 333209 - DNA, 16 bp, C. familiaris
ttgtcttcaatttctt

SEQ ID NO: 333210 - DNA, 16 bp, C. familiaris
ttgtcttctatgtcat

SEQ ID NO: 333211 - DNA, 16 bp, C. familiaris
ttgtctttctgtgact

SEQ ID NO: 333212 - DNA, 16 bp, C. familiaris
ttgtgaaaaccaaaaa

SEQ ID NO: 333213 - DNA, 16 bp, C. familiaris
ttgtgaaaatgtcagt

SEQ ID NO: 333214 - DNA, 16 bp, C. familiaris
ttgtgaaaatgtctgt

SEQ ID NO: 333215 - DNA, 16 bp, C. familiaris
ttgtgaaataaatatt

SEQ ID NO: 333216 - DNA, 16 bp, C. familiaris
ttgtgaaatttcagaa

SEQ ID NO: 333217 - DNA, 16 bp, C. familiaris
ttgtgaatggcaagat

SEQ ID NO: 333218 - DNA, 16 bp, C. familiaris
ttgtgagaatgaaatg

SEQ ID NO: 333219 - DNA, 16 bp, C. familiaris
ttgtgagatccagccc

SEQ ID NO: 333220 - DNA, 16 bp, C. familiaris
ttgtgagatggagacc

SEQ ID NO: 333221 - DNA, 16 bp, C. familiaris
ttgtgatgtcttggtt

SEQ ID NO: 333222 - DNA, 16 bp, C. familiaris
ttgtgatttgcatttt

SEQ ID NO: 333223 - DNA, 16 bp, C. familiaris
ttgtgatttttttcaa

SEQ ID NO: 333224 - DNA, 16 bp, C. familiaris
ttgtgcacctgaaact

SEQ ID NO: 333225 - DNA, 16 bp, C. familiaris
ttgtgccctctctctt

SEQ ID NO: 333226 - DNA, 16 bp, C. familiaris
ttgtggaaaaaaataa

SEQ ID NO: 333227 - DNA, 16 bp, C. familiaris
ttgtggaatataaata

SEQ ID NO: 333228 - DNA, 16 bp, C. familiaris
ttgtggaatttgttct

SEQ ID NO: 333229 - DNA, 16 bp, C. familiaris
ttgtggactgtttctt

SEQ ID NO: 333230 - DNA, 16 bp, C. familiaris
ttgtggaggctggcaa

SEQ ID NO: 333231 - DNA, 16 bp, C. familiaris
ttgtggatattgacaa

SEQ ID NO: 333232 - DNA, 16 bp, C. familiaris
ttgtggggagcctgct

SEQ ID NO: 333233 - DNA, 16 bp, C. familiaris
ttgtggggctcctggg

SEQ ID NO: 333234 - DNA, 16 bp, C. familiaris
ttgtggtgagcactgg

SEQ ID NO: 333235 - DNA, 16 bp, C. familiaris
ttgtgtaagaaaaaaa

SEQ ID NO: 333236 - DNA, 16 bp, C. familiaris
ttgtgtacattgctgc

SEQ ID NO: 333237 - DNA, 16 bp, C. familiaris
ttgtgtgctttctctc

SEQ ID NO: 333238 - DNA, 16 bp, C. familiaris
ttgttaaatttattca

SEQ ID NO: 333239 - DNA, 16 bp, C. familiaris
ttgttaactgttttat

SEQ ID NO: 333240 - DNA, 16 bp, C. familiaris
ttgttagaaaagcaaa

SEQ ID NO: 333241 - DNA, 16 bp, C. familiaris
ttgttagaaatacaga

SEQ ID NO: 333242 - DNA, 16 bp, C. familiaris
ttgttagaaatgaaaa

SEQ ID NO: 333243 - DNA, 16 bp, C. familiaris
ttgttagaaatgtaaa

SEQ ID NO: 333244 - DNA, 16 bp, C. familiaris
ttgttatggtgatctg

SEQ ID NO: 333245 - DNA, 16 bp, C. familiaris
ttgttcaaaagtcaac

SEQ ID NO: 333246 - DNA, 16 bp, C. familiaris
ttgttcaagtcttctg

SEQ ID NO: 333247 - DNA, 16 bp, C. familiaris
ttgttcatattttcta

SEQ ID NO: 333248 - DNA, 16 bp, C. familiaris
ttgttcatttccaaga

SEQ ID NO: 333249 - DNA, 18 bp, C. familiaris
ttgttccaattctctgaa

SEQ ID NO: 333250 - DNA, 16 bp, C. familiaris
ttgttcctcctgggac

SEQ ID NO: 333251 - DNA, 16 bp, C. familiaris
ttgttcgtttctcaga

SEQ ID NO: 333252 - DNA, 16 bp, C. familiaris
ttgttctggctctgtg

SEQ ID NO: 333253 - DNA, 16 bp, C. familiaris
ttgttctgtatgttgg

SEQ ID NO: 333254 - DNA, 16 bp, C. familiaris
ttgttcttttaaagat

SEQ ID NO: 333255 - DNA, 16 bp, C. familiaris
ttgttgaaaatactgt

SEQ ID NO: 333256 - DNA, 16 bp, C. familiaris
ttgttgaaacttgttt

SEQ ID NO: 333257 - DNA, 16 bp, C. familiaris
ttgttgactgcttctt

SEQ ID NO: 333258 - DNA, 16 bp, C. familiaris
ttgttgatattttcaa

SEQ ID NO: 333259 - DNA, 16 bp, C. familiaris
ttgttgatggacattt

SEQ ID NO: 333260 - DNA, 16 bp, C. familiaris
ttgttgcaaatgacaa

SEQ ID NO: 333261 - DNA, 16 bp, C. familiaris
ttgttgcaagtggcaa

SEQ ID NO: 333262 - DNA, 16 bp, C. familiaris
ttgttgcagcattatt

SEQ ID NO: 333263 - DNA, 16 bp, C. familiaris
ttgttgctttaatttg

SEQ ID NO: 333264 - DNA, 16 bp, C. familiaris
ttgttggaaatgcaaa

SEQ ID NO: 333265 - DNA, 16 bp, C. familiaris
ttgttggaaatgcaga

SEQ ID NO: 333266 - DNA, 16 bp, C. familiaris
ttgttgtaaacaaaca

SEQ ID NO: 333267 - DNA, 16 bp, C. familiaris
ttgtttatattttcaa

SEQ ID NO: 333268 - DNA, 16 bp, C. familiaris
ttgtttatgcatttat

SEQ ID NO: 333269 - DNA, 16 bp, C. familiaris
ttgtttattcacaaga

SEQ ID NO: 333270 - DNA, 16 bp, C. familiaris
ttgtttcagaaaaaaa

SEQ ID NO: 333271 - DNA, 16 bp, C. familiaris
ttgtttccctggcctc

SEQ ID NO: 333272 - DNA, 16 bp, C. familiaris
ttgtttcctcatctct

SEQ ID NO: 333273 - DNA, 16 bp, C. familiaris
ttgtttctcttttcca

SEQ ID NO: 333274 - DNA, 16 bp, C. familiaris
ttgtttgtttgggaaa

SEQ ID NO: 333275 - DNA, 16 bp, C. familiaris
ttgtttgttttcctca

SEQ ID NO: 333276 - DNA, 16 bp, C. familiaris
ttgttttaaattccac

SEQ ID NO: 333277 - DNA, 16 bp, C. familiaris
ttgttttaaattttca

SEQ ID NO: 333278 - DNA, 16 bp, C. familiaris
ttgttttcagttttca

SEQ ID NO: 333279 - DNA, 16 bp, C. familiaris
ttgttttctacagtgg

SEQ ID NO: 333280 - DNA, 16 bp, C. familiaris
ttgttttcttctaaaa

SEQ ID NO: 333281 - DNA, 16 bp, C. familiaris
ttgttttgctgtgcag

SEQ ID NO: 333282 - DNA, 16 bp, C. familiaris
ttgttttgtgtcttaa

SEQ ID NO: 333283 - DNA, 16 bp, C. familiaris
ttgttttgttaaaaaa

SEQ ID NO: 333284 - DNA, 16 bp, C. familiaris
ttgtttttaaaataag

SEQ ID NO: 333285 - DNA, 16 bp, C. familiaris
ttgtttttaattcaaa

SEQ ID NO: 333286 - DNA, 16 bp, C. familiaris
ttgtttttagagagaa

SEQ ID NO: 333287 - DNA, 16 bp, C. familiaris
ttgttttttcaaaatt

SEQ ID NO: 333288 - DNA, 16 bp, C. familiaris
ttgttttttccagaat

SEQ ID NO: 333289 - DNA, 16 bp, C. familiaris
ttgtttttttaagaag

SEQ ID NO: 333290 - DNA, 16 bp, C. familiaris
tttaaaaaaaaatgca

SEQ ID NO: 333291 - DNA, 16 bp, C. familiaris
tttaaaaaaaatgtac

SEQ ID NO: 333292 - DNA, 16 bp, C. familiaris
tttaaaaaaaattcct

SEQ ID NO: 333293 - DNA, 16 bp, C. familiaris
tttaaaaaaatccaca

SEQ ID NO: 333294 - DNA, 16 bp, C. familiaris
tttaaaaaacaaagca

SEQ ID NO: 333295 - DNA, 16 bp, C. familiaris
tttaaaaaacagataa

SEQ ID NO: 333296 - DNA, 16 bp, C. familiaris
tttaaaaaacctcaaa

SEQ ID NO: 333297 - DNA, 16 bp, C. familiaris
tttaaaaaagatattc

SEQ ID NO: 333298 - DNA, 16 bp, C. familiaris
tttaaaaaagcaaacc

SEQ ID NO: 333299 - DNA, 16 bp, C. familiaris
tttaaaaaaggaatag

SEQ ID NO: 333300 - DNA, 16 bp, C. familiaris
tttaaaaaaggagatt

SEQ ID NO: 333301 - DNA, 16 bp, C. familiaris
tttaaaaaaggcaaaa

SEQ ID NO: 333302 - DNA, 16 bp, C. familiaris
tttaaaaaatacatct

SEQ ID NO: 333303 - DNA, 16 bp, C. familiaris
tttaaaaaataccttc

SEQ ID NO: 333304 - DNA, 16 bp, C. familiaris
tttaaaaaatatctag

SEQ ID NO: 333305 - DNA, 16 bp, C. familiaris
tttaaaaaatcaaagg

SEQ ID NO: 333306 - DNA, 16 bp, C. familiaris
tttaaaaaatcaagat

SEQ ID NO: 333307 - DNA, 16 bp, C. familiaris
tttaaaaaatcagatt

SEQ ID NO: 333308 - DNA, 16 bp, C. familiaris
tttaaaaaatcatcat

SEQ ID NO: 333309 - DNA, 16 bp, C. familiaris
tttaaaaaatgaaatc

SEQ ID NO: 333310 - DNA, 16 bp, C. familiaris
tttaaaaaatgcacag

SEQ ID NO: 333311 - DNA, 16 bp, C. familiaris
tttaaaaaatgcatct

SEQ ID NO: 333312 - DNA, 16 bp, C. familiaris
tttaaaaaatggtatg

SEQ ID NO: 333313 - DNA, 16 bp, C. familiaris
tttaaaaaattcagtt

SEQ ID NO: 333314 - DNA, 16 bp, C. familiaris
tttaaaaaatttccat

SEQ ID NO: 333315 - DNA, 16 bp, C. familiaris
tttaaaaacaaagaga

SEQ ID NO: 333316 - DNA, 16 bp, C. familiaris
tttaaaaacaaatctt

SEQ ID NO: 333317 - DNA, 16 bp, C. familiaris
tttaaaaacacagaga

SEQ ID NO: 333318 - DNA, 16 bp, C. familiaris
tttaaaaacacattca

SEQ ID NO: 333319 - DNA, 16 bp, C. familiaris
tttaaaaacactgaat

SEQ ID NO: 333320 - DNA, 16 bp, C. familiaris
tttaaaaacaggaaaa

SEQ ID NO: 333321 - DNA, 16 bp, C. familiaris
tttaaaaacattcctt

SEQ ID NO: 333322 - DNA, 16 bp, C. familiaris
tttaaaaaccaagatc

SEQ ID NO: 333323 - DNA, 16 bp, C. familiaris
tttaaaaacctatttt

SEQ ID NO: 333324 - DNA, 16 bp, C. familiaris
tttaaaaactgaagaa

SEQ ID NO: 333325 - DNA, 16 bp, C. familiaris
tttaaaaagacacaaa

SEQ ID NO: 333326 - DNA, 16 bp, C. familiaris
tttaaaaagacagaaa

SEQ ID NO: 333327 - DNA, 16 bp, C. familiaris
tttaaaaagactgaaa

SEQ ID NO: 333328 - DNA, 16 bp, C. familiaris
tttaaaaagaggaaga

SEQ ID NO: 333329 - DNA, 16 bp, C. familiaris
tttaaaaagagtaaag

SEQ ID NO: 333330 - DNA, 16 bp, C. familiaris
tttaaaaagattttac

SEQ ID NO: 333331 - DNA, 16 bp, C. familiaris
tttaaaaagcagaaac

SEQ ID NO: 333332 - DNA, 16 bp, C. familiaris
tttaaaaagcagattt

SEQ ID NO: 333333 - DNA, 16 bp, C. familiaris
tttaaaaaggaagaca

SEQ ID NO: 333334 - DNA, 16 bp, C. familiaris
tttaaaaaggaaggaa

SEQ ID NO: 333335 - DNA, 16 bp, C. familiaris
tttaaaaaggaagttt

SEQ ID NO: 333336 - DNA, 16 bp, C. familiaris
tttaaaaaggaggaaa

SEQ ID NO: 333337 - DNA, 16 bp, C. familiaris
tttaaaaaggtttatt

SEQ ID NO: 333338 - DNA, 16 bp, C. familiaris
tttaaaaagtcaacat

SEQ ID NO: 333339 - DNA, 16 bp, C. familiaris
tttaaaaagtgaaaca

SEQ ID NO: 333340 - DNA, 16 bp, C. familiaris
tttaaaaagtgaacag

SEQ ID NO: 333341 - DNA, 16 bp, C. familiaris
tttaaaaagtgaatat

SEQ ID NO: 333342 - DNA, 16 bp, C. familiaris
tttaaaaagttcttca

SEQ ID NO: 333343 - DNA, 16 bp, C. familiaris
tttaaaaagttcttta

SEQ ID NO: 333344 - DNA, 16 bp, C. familiaris
tttaaaaataacttct

SEQ ID NO: 333345 - DNA, 16 bp, C. familiaris
tttaaaaatacacatg

SEQ ID NO: 333346 - DNA, 16 bp, C. familiaris
tttaaaaatacagaga

SEQ ID NO: 333347 - DNA, 16 bp, C. familiaris
tttaaaaatcaagttg

SEQ ID NO: 333348 - DNA, 16 bp, C. familiaris
tttaaaaatcagaaaa

SEQ ID NO: 333349 - DNA, 16 bp, C. familiaris
tttaaaaatcaggttt

SEQ ID NO: 333350 - DNA, 16 bp, C. familiaris
tttaaaaatccacttt

SEQ ID NO: 333351 - DNA, 16 bp, C. familiaris
tttaaaaatctgaaga

SEQ ID NO: 333352 - DNA, 16 bp, C. familiaris
tttaaaaatctgtcat

SEQ ID NO: 333353 - DNA, 16 bp, C. familiaris
tttaaaaatctgttta

SEQ ID NO: 333354 - DNA, 16 bp, C. familiaris
tttaaaaatgaaatgt

SEQ ID NO: 333355 - DNA, 16 bp, C. familiaris
tttaaaaatgaactaa

SEQ ID NO: 333356 - DNA, 16 bp, C. familiaris
tttaaaaatgaagatg

SEQ ID NO: 333357 - DNA, 16 bp, C. familiaris
tttaaaaatgaatttc

SEQ ID NO: 333358 - DNA, 16 bp, C. familiaris
tttaaaaatgagcatt

SEQ ID NO: 333359 - DNA, 16 bp, C. familiaris
tttaaaaatgcatgca

SEQ ID NO: 333360 - DNA, 16 bp, C. familiaris
tttaaaaatgcattaa

SEQ ID NO: 333361 - DNA, 16 bp, C. familiaris
tttaaaaatggagaga

SEQ ID NO: 333362 - DNA, 16 bp, C. familiaris
tttaaaaatgtcaaga

SEQ ID NO: 333363 - DNA, 16 bp, C. familiaris
tttaaaaatgtggaaa

SEQ ID NO: 333364 - DNA, 16 bp, C. familiaris
tttaaaaatgttatct

SEQ ID NO: 333365 - DNA, 16 bp, C. familiaris
tttaaaaatgtttctt

SEQ ID NO: 333366 - DNA, 16 bp, C. familiaris
tttaaaaattacacat

SEQ ID NO: 333367 - DNA, 16 bp, C. familiaris
tttaaaaattagaact

SEQ ID NO: 333368 - DNA, 16 bp, C. familiaris
tttaaaaattctgatt

SEQ ID NO: 333369 - DNA, 16 bp, C. familiaris
tttaaaaattgacctt

SEQ ID NO: 333370 - DNA, 16 bp, C. familiaris
tttaaaaattgatgta

SEQ ID NO: 333371 - DNA, 16 bp, C. familiaris
tttaaaaatttcattg

SEQ ID NO: 333372 - DNA, 16 bp, C. familiaris
tttaaaaatttggaat

SEQ ID NO: 333373 - DNA, 16 bp, C. familiaris
tttaaaaattttgtgc

SEQ ID NO: 333374 - DNA, 16 bp, C. familiaris
tttaaaacaaatagaa

SEQ ID NO: 333375 - DNA, 16 bp, C. familiaris
tttaaaacaagttttt

SEQ ID NO: 333376 - DNA, 16 bp, C. familiaris
tttaaaacatgaaatt

SEQ ID NO: 333377 - DNA, 16 bp, C. familiaris
tttaaaacatttagaa

SEQ ID NO: 333378 - DNA, 16 bp, C. familiaris
tttaaaacatttccat

SEQ ID NO: 333379 - DNA, 16 bp, C. familiaris
tttaaaacattttttg

SEQ ID NO: 333380 - DNA, 16 bp, C. familiaris
tttaaaaccaaagaaa

SEQ ID NO: 333381 - DNA, 16 bp, C. familiaris
tttaaaaccattattt

SEQ ID NO: 333382 - DNA, 16 bp, C. familiaris
tttaaaacctcaaaaa

SEQ ID NO: 333383 - DNA, 16 bp, C. familiaris
tttaaaacctgaaaaa

SEQ ID NO: 333384 - DNA, 16 bp, C. familiaris
tttaaaactagaaaaa

SEQ ID NO: 333385 - DNA, 16 bp, C. familiaris
tttaaaactcaaaatt

SEQ ID NO: 333386 - DNA, 16 bp, C. familiaris
tttaaaactgaaatca

SEQ ID NO: 333387 - DNA, 16 bp, C. familiaris
tttaaaactgtattta

SEQ ID NO: 333388 - DNA, 16 bp, C. familiaris
tttaaaagaactaaaa

SEQ ID NO: 333389 - DNA, 16 bp, C. familiaris
tttaaaagaagatatt

SEQ ID NO: 333390 - DNA, 16 bp, C. familiaris
tttaaaagaagatttt

SEQ ID NO: 333391 - DNA, 16 bp, C. familiaris
tttaaaagacttcatt

SEQ ID NO: 333392 - DNA, 16 bp, C. familiaris
tttaaaagagaaagca

SEQ ID NO: 333393 - DNA, 16 bp, C. familiaris
tttaaaagagaaggaa

SEQ ID NO: 333394 - DNA, 16 bp, C. familiaris
tttaaaagagcattta

SEQ ID NO: 333395 - DNA, 16 bp, C. familiaris
tttaaaagatttattg

SEQ ID NO: 333396 - DNA, 16 bp, C. familiaris
tttaaaagcagagttt

SEQ ID NO: 333397 - DNA, 16 bp, C. familiaris
tttaaaagcattcttt

SEQ ID NO: 333398 - DNA, 16 bp, C. familiaris
tttaaaagctattttt

SEQ ID NO: 333399 - DNA, 16 bp, C. familiaris
tttaaaagcttttgtt

SEQ ID NO: 333400 - DNA, 16 bp, C. familiaris
tttaaaaggaaatttt

SEQ ID NO: 333401 - DNA, 16 bp, C. familiaris
tttaaaagggaaagaa

SEQ ID NO: 333402 - DNA, 16 bp, C. familiaris
tttaaaagtaactttt

SEQ ID NO: 333403 - DNA, 16 bp, C. familiaris
tttaaaagtcattttg

SEQ ID NO: 333404 - DNA, 16 bp, C. familiaris
tttaaaataagtgaat

SEQ ID NO: 333405 - DNA, 16 bp, C. familiaris
tttaaaatacaaagaa

SEQ ID NO: 333406 - DNA, 16 bp, C. familiaris
tttaaaatacatgaag

SEQ ID NO: 333407 - DNA, 16 bp, C. familiaris
tttaaaataggatttt

SEQ ID NO: 333408 - DNA, 16 bp, C. familiaris
tttaaaatatgttctt

SEQ ID NO: 333409 - DNA, 16 bp, C. familiaris
tttaaaatattcttca

SEQ ID NO: 333410 - DNA, 16 bp, C. familiaris
tttaaaatgaaagaca

SEQ ID NO: 333411 - DNA, 16 bp, C. familiaris
tttaaaatgcatattt

SEQ ID NO: 333412 - DNA, 16 bp, C. familiaris
tttaaaatgcttaaaa

SEQ ID NO: 333413 - DNA, 16 bp, C. familiaris
tttaaaatggagtcag

SEQ ID NO: 333414 - DNA, 16 bp, C. familiaris
tttaaaatggtgaatt

SEQ ID NO: 333415 - DNA, 16 bp, C. familiaris
tttaaaatgtaacttt

SEQ ID NO: 333416 - DNA, 16 bp, C. familiaris
tttaaaattacatgtg

SEQ ID NO: 333417 - DNA, 16 bp, C. familiaris
tttaaaattctctttg

SEQ ID NO: 333418 - DNA, 16 bp, C. familiaris
tttaaaattgcatttt

SEQ ID NO: 333419 - DNA, 16 bp, C. familiaris
tttaaaatttgttttc

SEQ ID NO: 333420 - DNA, 16 bp, C. familiaris
tttaaaattttctaca

SEQ ID NO: 333421 - DNA, 16 bp, C. familiaris
tttaaaattttctagt

SEQ ID NO: 333422 - DNA, 16 bp, C. familiaris
tttaaacaaaagttta

SEQ ID NO: 333423 - DNA, 16 bp, C. familiaris
tttaaacaagatttta

SEQ ID NO: 333424 - DNA, 16 bp, C. familiaris
tttaaacattttcata

SEQ ID NO: 333425 - DNA, 16 bp, C. familiaris
tttaaaccaattaata

SEQ ID NO: 333426 - DNA, 16 bp, C. familiaris
tttaaactcaacacca

SEQ ID NO: 333427 - DNA, 16 bp, C. familiaris
tttaaactgtattttt

SEQ ID NO: 333428 - DNA, 16 bp, C. familiaris
tttaaagaaaaattgt

SEQ ID NO: 333429 - DNA, 16 bp, C. familiaris
tttaaagaaacaaaat

SEQ ID NO: 333430 - DNA, 16 bp, C. familiaris
tttaaagaaacaatac

SEQ ID NO: 333431 - DNA, 16 bp, C. familiaris
tttaaagaaacaattt

SEQ ID NO: 333432 - DNA, 16 bp, C. familiaris
tttaaagaaacagaaa

SEQ ID NO: 333433 - DNA, 16 bp, C. familiaris
tttaaagaaacatttt

SEQ ID NO: 333434 - DNA, 16 bp, C. familiaris
tttaaagaaacttttt

SEQ ID NO: 333435 - DNA, 16 bp, C. familiaris
tttaaagaaagaaacc

SEQ ID NO: 333436 - DNA, 16 bp, C. familiaris
tttaaagaaagaagta

SEQ ID NO: 333437 - DNA, 16 bp, C. familiaris
tttaaagaacagaaaa

SEQ ID NO: 333438 - DNA, 16 bp, C. familiaris
tttaaagaacagttaa

SEQ ID NO: 333439 - DNA, 16 bp, C. familiaris
tttaaagaagaagaag

SEQ ID NO: 333440 - DNA, 16 bp, C. familiaris
tttaaagaagaggaaa

SEQ ID NO: 333441 - DNA, 16 bp, C. familiaris
tttaaagaaggaaatt

SEQ ID NO: 333442 - DNA, 16 bp, C. familiaris
tttaaagaagttttta

SEQ ID NO: 333443 - DNA, 16 bp, C. familiaris
tttaaagaataaacaa

SEQ ID NO: 333444 - DNA, 16 bp, C. familiaris
tttaaagagaaggaaa

SEQ ID NO: 333445 - DNA, 16 bp, C. familiaris
tttaaagatgagaaaa

SEQ ID NO: 333446 - DNA, 16 bp, C. familiaris
tttaaagatggagaaa

SEQ ID NO: 333447 - DNA, 16 bp, C. familiaris
tttaaagattctgttt

SEQ ID NO: 333448 - DNA, 16 bp, C. familiaris
tttaaagatttcttct

SEQ ID NO: 333449 - DNA, 16 bp, C. familiaris
tttaaagattttacat

SEQ ID NO: 333450 - DNA, 16 bp, C. familiaris
tttaaagcaaaaatta

SEQ ID NO: 333451 - DNA, 16 bp, C. familiaris
tttaaaggaaaatgtt

SEQ ID NO: 333452 - DNA, 16 bp, C. familiaris
tttaaaggaagaaaat

SEQ ID NO: 333453 - DNA, 16 bp, C. familiaris
tttaaaggatatttaa

SEQ ID NO: 333454 - DNA, 16 bp, C. familiaris
tttaaaggtttttaaa

SEQ ID NO: 333455 - DNA, 16 bp, C. familiaris
tttaaagtatttattc

SEQ ID NO: 333456 - DNA, 16 bp, C. familiaris
tttaaagtattttctt

SEQ ID NO: 333457 - DNA, 16 bp, C. familiaris
tttaaagtttctttaa

SEQ ID NO: 333458 - DNA, 16 bp, C. familiaris
tttaaataaacttctt

SEQ ID NO: 333459 - DNA, 16 bp, C. familiaris
tttaaatcagaaaaat

SEQ ID NO: 333460 - DNA, 16 bp, C. familiaris
tttaaatcaggaagtg

SEQ ID NO: 333461 - DNA, 16 bp, C. familiaris
tttaaatgaaaaggaa

SEQ ID NO: 333462 - DNA, 16 bp, C. familiaris
tttaaatgaaaatttc

SEQ ID NO: 333463 - DNA, 16 bp, C. familiaris
tttaaatgaagagaga

SEQ ID NO: 333464 - DNA, 16 bp, C. familiaris
tttaaatgaagatttt

SEQ ID NO: 333465 - DNA, 16 bp, C. familiaris
tttaaatgcagattct

SEQ ID NO: 333466 - DNA, 16 bp, C. familiaris
tttaaatggtgaattt

SEQ ID NO: 333467 - DNA, 16 bp, C. familiaris
tttaaatgtaaggaaa

SEQ ID NO: 333468 - DNA, 16 bp, C. familiaris
tttaaatgtatacata

SEQ ID NO: 333469 - DNA, 16 bp, C. familiaris
tttaaattcagaaaat

SEQ ID NO: 333470 - DNA, 16 bp, C. familiaris
tttaaatttgcatttc

SEQ ID NO: 333471 - DNA, 16 bp, C. familiaris
tttaaattttctgatt

SEQ ID NO: 333472 - DNA, 16 bp, C. familiaris
tttaacaaaagatttt

SEQ ID NO: 333473 - DNA, 16 bp, C. familiaris
tttaacaaaatgtttt

SEQ ID NO: 333474 - DNA, 16 bp, C. familiaris
tttaacaaatgatgct

SEQ ID NO: 333475 - DNA, 16 bp, C. familiaris
tttaacaagatcctca

SEQ ID NO: 333476 - DNA, 16 bp, C. familiaris
tttaacatcttttaaa

SEQ ID NO: 333477 - DNA, 16 bp, C. familiaris
tttaacatgaaaaaaa

SEQ ID NO: 333478 - DNA, 16 bp, C. familiaris
tttaacatttctcata

SEQ ID NO: 333479 - DNA, 16 bp, C. familiaris
tttaacccatcctccc

SEQ ID NO: 333480 - DNA, 16 bp, C. familiaris
tttaacctctctgagt

SEQ ID NO: 333481 - DNA, 16 bp, C. familiaris
tttaactctgaggaac

SEQ ID NO: 333482 - DNA, 16 bp, C. familiaris
tttaactttcaaaaaa

SEQ ID NO: 333483 - DNA, 16 bp, C. familiaris
tttaactttgatgaag

SEQ ID NO: 333484 - DNA, 16 bp, C. familiaris
tttaagaaaaaaacat

SEQ ID NO: 333485 - DNA, 16 bp, C. familiaris
tttaagaaaactattt

SEQ ID NO: 333486 - DNA, 16 bp, C. familiaris
tttaagaaaatgtttg

SEQ ID NO: 333487 - DNA, 16 bp, C. familiaris
tttaagaaacaaagaa

SEQ ID NO: 333488 - DNA, 16 bp, C. familiaris
tttaagaaacaaatta

SEQ ID NO: 333489 - DNA, 16 bp, C. familiaris
tttaagaaagaaaaca

SEQ ID NO: 333490 - DNA, 16 bp, C. familiaris
tttaagaaaggaaaca

SEQ ID NO: 333491 - DNA, 16 bp, C. familiaris
tttaagaacagtttta

SEQ ID NO: 333492 - DNA, 16 bp, C. familiaris
tttaagaatatttctt

SEQ ID NO: 333493 - DNA, 16 bp, C. familiaris
tttaagaatgatttta

SEQ ID NO: 333494 - DNA, 16 bp, C. familiaris
tttaagaatttttctt

SEQ ID NO: 333495 - DNA, 16 bp, C. familiaris
tttaagacaaaaattg

SEQ ID NO: 333496 - DNA, 16 bp, C. familiaris
tttaagagagaaagca

SEQ ID NO: 333497 - DNA, 16 bp, C. familiaris
tttaagatttcctttt

SEQ ID NO: 333498 - DNA, 16 bp, C. familiaris
tttaagatttcttttc

SEQ ID NO: 333499 - DNA, 16 bp, C. familiaris
tttaaggagaaaagaa

SEQ ID NO: 333500 - DNA, 16 bp, C. familiaris
tttaaggagaagaaaa

SEQ ID NO: 333501 - DNA, 16 bp, C. familiaris
tttaaggatgaagaaa

SEQ ID NO: 333502 - DNA, 16 bp, C. familiaris
tttaaggatttttatg

SEQ ID NO: 333503 - DNA, 16 bp, C. familiaris
tttaagtgaaagaaaa

SEQ ID NO: 333504 - DNA, 16 bp, C. familiaris
tttaagtggaaaaaaa

SEQ ID NO: 333505 - DNA, 16 bp, C. familiaris
tttaagttgctaaatt

SEQ ID NO: 333506 - DNA, 16 bp, C. familiaris
tttaagtttcttaaaa

SEQ ID NO: 333507 - DNA, 16 bp, C. familiaris
tttaagtttgatgtag

SEQ ID NO: 333508 - DNA, 16 bp, C. familiaris
tttaagttttaaaaag

SEQ ID NO: 333509 - DNA, 16 bp, C. familiaris
tttaatagatacagaa

SEQ ID NO: 333510 - DNA, 16 bp, C. familiaris
tttaatattcatgaaa

SEQ ID NO: 333511 - DNA, 16 bp, C. familiaris
tttaatatttattgca

SEQ ID NO: 333512 - DNA, 16 bp, C. familiaris
tttaatcatgaagaaa

SEQ ID NO: 333513 - DNA, 16 bp, C. familiaris
tttaatcctcatgaca

SEQ ID NO: 333514 - DNA, 16 bp, C. familiaris
tttaatcttcaaaata

SEQ ID NO: 333515 - DNA, 16 bp, C. familiaris
tttaatgaattcattt

SEQ ID NO: 333516 - DNA, 16 bp, C. familiaris
tttaatgagttcttta

SEQ ID NO: 333517 - DNA, 16 bp, C. familiaris
tttaatgccttttatt

SEQ ID NO: 333518 - DNA, 16 bp, C. familiaris
tttaatgggaaaaaaa

SEQ ID NO: 333519 - DNA, 16 bp, C. familiaris
tttaatgtcattttta

SEQ ID NO: 333520 - DNA, 16 bp, C. familiaris
tttaatgtctttgtct

SEQ ID NO: 333521 - DNA, 16 bp, C. familiaris
tttaattaaatggaaa

SEQ ID NO: 333522 - DNA, 17 bp, C. familiaris
tttaattctcaggccga

SEQ ID NO: 333523 - DNA, 16 bp, C. familiaris
tttaattcttcaaaat

SEQ ID NO: 333524 - DNA, 16 bp, C. familiaris
tttaattgaacatttt

SEQ ID NO: 333525 - DNA, 16 bp, C. familiaris
tttaattggagcattt

SEQ ID NO: 333526 - DNA, 16 bp, C. familiaris
tttaattgtggcaaaa

SEQ ID NO: 333527 - DNA, 16 bp, C. familiaris
tttaattttgaagaaa

SEQ ID NO: 333528 - DNA, 16 bp, C. familiaris
tttaatttttaaagct

SEQ ID NO: 333529 - DNA, 16 bp, C. familiaris
tttaatttttcccact

SEQ ID NO: 333530 - DNA, 16 bp, C. familiaris
tttacaaaaatgggat

SEQ ID NO: 333531 - DNA, 16 bp, C. familiaris
tttacaaaacactttt

SEQ ID NO: 333532 - DNA, 16 bp, C. familiaris
tttacaaaagaataaa

SEQ ID NO: 333533 - DNA, 16 bp, C. familiaris
tttacaaaatgctttc

SEQ ID NO: 333534 - DNA, 16 bp, C. familiaris
tttacaaagaaaatga

SEQ ID NO: 333535 - DNA, 16 bp, C. familiaris
tttacaaagggaaaaa

SEQ ID NO: 333536 - DNA, 16 bp, C. familiaris
tttacaaatgaagaga

SEQ ID NO: 333537 - DNA, 16 bp, C. familiaris
tttacaaatgacatga

SEQ ID NO: 333538 - DNA, 16 bp, C. familiaris
tttacaaatgagaaaa

SEQ ID NO: 333539 - DNA, 16 bp, C. familiaris
tttacaaatgagagaa

SEQ ID NO: 333540 - DNA, 16 bp, C. familiaris
tttacaaatgatgaaa

SEQ ID NO: 333541 - DNA, 16 bp, C. familiaris
tttacaacagccaaaa

SEQ ID NO: 333542 - DNA, 16 bp, C. familiaris
tttacaagaaaaagaa

SEQ ID NO: 333543 - DNA, 16 bp, C. familiaris
tttacaatggcaccca

SEQ ID NO: 333544 - DNA, 16 bp, C. familiaris
tttacaatttacaaag

SEQ ID NO: 333545 - DNA, 16 bp, C. familiaris
tttacagaaaaaaaat

SEQ ID NO: 333546 - DNA, 16 bp, C. familiaris
tttacagaaaaattaa

SEQ ID NO: 333547 - DNA, 16 bp, C. familiaris
tttacagaagagaaaa

SEQ ID NO: 333548 - DNA, 16 bp, C. familiaris
tttacagaaggaaaaa

SEQ ID NO: 333549 - DNA, 16 bp, C. familiaris
tttacagaagggaaaa

SEQ ID NO: 333550 - DNA, 16 bp, C. familiaris
tttacagagaaggaaa

SEQ ID NO: 333551 - DNA, 16 bp, C. familiaris
tttacagataaaaaaa

SEQ ID NO: 333552 - DNA, 16 bp, C. familiaris
tttacagatatggaaa

SEQ ID NO: 333553 - DNA, 16 bp, C. familiaris
tttacagatcaagaaa

SEQ ID NO: 333554 - DNA, 16 bp, C. familiaris
tttacagatgaagaaa

SEQ ID NO: 333555 - DNA, 16 bp, C. familiaris
tttacagatgaatgga

SEQ ID NO: 333556 - DNA, 16 bp, C. familiaris
tttacagatgagcaga

SEQ ID NO: 333557 - DNA, 16 bp, C. familiaris
tttacagatgaggaaa

SEQ ID NO: 333558 - DNA, 16 bp, C. familiaris
tttacagatgaggaga

SEQ ID NO: 333559 - DNA, 16 bp, C. familiaris
tttacagatgaggagg

SEQ ID NO: 333560 - DNA, 16 bp, C. familiaris
tttacagattataaaa

SEQ ID NO: 333561 - DNA, 16 bp, C. familiaris
tttacagggttttttt

SEQ ID NO: 333562 - DNA, 16 bp, C. familiaris
tttacagtctttgttt

SEQ ID NO: 333563 - DNA, 16 bp, C. familiaris
tttacagttgaagaaa

SEQ ID NO: 333564 - DNA, 16 bp, C. familiaris
tttacagttgttatat

SEQ ID NO: 333565 - DNA, 16 bp, C. familiaris
tttacatacagtgaaa

SEQ ID NO: 333566 - DNA, 16 bp, C. familiaris
tttacatatgtatttt

SEQ ID NO: 333567 - DNA, 16 bp, C. familiaris
tttacatccccaccag

SEQ ID NO: 333568 - DNA, 16 bp, C. familiaris
tttacatctttggtga

SEQ ID NO: 333569 - DNA, 16 bp, C. familiaris
tttacatgaaaaaaaa

SEQ ID NO: 333570 - DNA, 16 bp, C. familiaris
tttacatgcattattt

SEQ ID NO: 333571 - DNA, 16 bp, C. familiaris
tttacattatggttca

SEQ ID NO: 333572 - DNA, 16 bp, C. familiaris
tttacattctcaccaa

SEQ ID NO: 333573 - DNA, 16 bp, C. familiaris
tttacatttaaagatt

SEQ ID NO: 333574 - DNA, 16 bp, C. familiaris
tttacatttagaaaaa

SEQ ID NO: 333575 - DNA, 16 bp, C. familiaris
tttaccaaagaagata

SEQ ID NO: 333576 - DNA, 16 bp, C. familiaris
tttaccacaagaaaaa

SEQ ID NO: 333577 - DNA, 16 bp, C. familiaris
tttaccactttttaaa

SEQ ID NO: 333578 - DNA, 16 bp, C. familiaris
tttaccagtgaggaaa

SEQ ID NO: 333579 - DNA, 16 bp, C. familiaris
tttaccattctgaaaa

SEQ ID NO: 333580 - DNA, 16 bp, C. familiaris
tttacccaaaagagtt

SEQ ID NO: 333581 - DNA, 16 bp, C. familiaris
tttaccccctgaggcc

SEQ ID NO: 333582 - DNA, 16 bp, C. familiaris
tttacctaagaaactt

SEQ ID NO: 333583 - DNA, 16 bp, C. familiaris
tttactgaaagaaaat

SEQ ID NO: 333584 - DNA, 16 bp, C. familiaris
tttactgattttttaa

SEQ ID NO: 333585 - DNA, 16 bp, C. familiaris
tttactgtgggttttt

SEQ ID NO: 333586 - DNA, 16 bp, C. familiaris
tttacttaaaatactt

SEQ ID NO: 333587 - DNA, 16 bp, C. familiaris
tttacttagcataatg

SEQ ID NO: 333588 - DNA, 16 bp, C. familiaris
tttacttgaaaaaaaa

SEQ ID NO: 333589 - DNA, 16 bp, C. familiaris
tttacttggaattttt

SEQ ID NO: 333590 - DNA, 16 bp, C. familiaris
tttactttgacatgga

SEQ ID NO: 333591 - DNA, 16 bp, C. familiaris
tttagaaaaaagattt

SEQ ID NO: 333592 - DNA, 16 bp, C. familiaris
tttagaaaaagaaagg

SEQ ID NO: 333593 - DNA, 16 bp, C. familiaris
tttagaaaaagcattt

SEQ ID NO: 333594 - DNA, 16 bp, C. familiaris
tttagaaaaatgttca

SEQ ID NO: 333595 - DNA, 16 bp, C. familiaris
tttagaaaacagaaat

SEQ ID NO: 333596 - DNA, 16 bp, C. familiaris
tttagaaacaaaatat

SEQ ID NO: 333597 - DNA, 16 bp, C. familiaris
tttagaaacttccttt

SEQ ID NO: 333598 - DNA, 16 bp, C. familiaris
tttagaaacttttata

SEQ ID NO: 333599 - DNA, 16 bp, C. familiaris
tttagaaataaagttt

SEQ ID NO: 333600 - DNA, 16 bp, C. familiaris
tttagaaatacatatt

SEQ ID NO: 333601 - DNA, 16 bp, C. familiaris
tttagaaatacttttt

SEQ ID NO: 333602 - DNA, 16 bp, C. familiaris
tttagaaatagatttt

SEQ ID NO: 333603 - DNA, 16 bp, C. familiaris
tttagaaatagtattt

SEQ ID NO: 333604 - DNA, 16 bp, C. familiaris
tttagaaatgaggaaa

SEQ ID NO: 333605 - DNA, 16 bp, C. familiaris
tttagaaattctaaaa

SEQ ID NO: 333606 - DNA, 16 bp, C. familiaris
tttagaagaaaaacaa

SEQ ID NO: 333607 - DNA, 16 bp, C. familiaris
tttagaagaaattcaa

SEQ ID NO: 333608 - DNA, 16 bp, C. familiaris
tttagaaggaaattta

SEQ ID NO: 333609 - DNA, 16 bp, C. familiaris
tttagaaggaagaaaa

SEQ ID NO: 333610 - DNA, 16 bp, C. familiaris
tttagaatctttaaaa

SEQ ID NO: 333611 - DNA, 16 bp, C. familiaris
tttagagaaaatgaaa

SEQ ID NO: 333612 - DNA, 16 bp, C. familiaris
tttagagaaagacaaa

SEQ ID NO: 333613 - DNA, 16 bp, C. familiaris
tttagaggtagaattt

SEQ ID NO: 333614 - DNA, 16 bp, C. familiaris
tttagcacctaccttt

SEQ ID NO: 333615 - DNA, 16 bp, C. familiaris
tttagcactttaaata

SEQ ID NO: 333616 - DNA, 16 bp, C. familiaris
tttagcaggaaaaaaa

SEQ ID NO: 333617 - DNA, 16 bp, C. familiaris
tttagcattttcattt

SEQ ID NO: 333618 - DNA, 16 bp, C. familiaris
tttagccaatctgaca

SEQ ID NO: 333619 - DNA, 16 bp, C. familiaris
tttaggaagaaagaaa

SEQ ID NO: 333620 - DNA, 16 bp, C. familiaris
tttagggaaaaaaatg

SEQ ID NO: 333621 - DNA, 16 bp, C. familiaris
tttagggaatataaat

SEQ ID NO: 333622 - DNA, 16 bp, C. familiaris
tttagtgccagccttc

SEQ ID NO: 333623 - DNA, 16 bp, C. familiaris
tttataaaaatgcaga

SEQ ID NO: 333624 - DNA, 16 bp, C. familiaris
tttataaaaatggttt

SEQ ID NO: 333625 - DNA, 16 bp, C. familiaris
tttataaaatagagat

SEQ ID NO: 333626 - DNA, 16 bp, C. familiaris
tttataaaatgggaat

SEQ ID NO: 333627 - DNA, 16 bp, C. familiaris
tttataaatgagaaga

SEQ ID NO: 333628 - DNA, 16 bp, C. familiaris
tttataaatgatgaaa

SEQ ID NO: 333629 - DNA, 16 bp, C. familiaris
tttataaattaaggaa

SEQ ID NO: 333630 - DNA, 16 bp, C. familiaris
tttataactgaaaaaa

SEQ ID NO: 333631 - DNA, 16 bp, C. familiaris
tttataataacatcaa

SEQ ID NO: 333632 - DNA, 16 bp, C. familiaris
tttatacaaagaaaat

SEQ ID NO: 333633 - DNA, 16 bp, C. familiaris
tttatacattcatctt

SEQ ID NO: 333634 - DNA, 16 bp, C. familiaris
tttatactttgaaaaa

SEQ ID NO: 333635 - DNA, 16 bp, C. familiaris
tttatagaaatgaaat

SEQ ID NO: 333636 - DNA, 16 bp, C. familiaris
tttatagaacattcca

SEQ ID NO: 333637 - DNA, 16 bp, C. familiaris
tttatagataagaaag

SEQ ID NO: 333638 - DNA, 16 bp, C. familiaris
tttatagataatgaaa

SEQ ID NO: 333639 - DNA, 16 bp, C. familiaris
tttatagatgacatga

SEQ ID NO: 333640 - DNA, 16 bp, C. familiaris
tttatagatggagaaa

SEQ ID NO: 333641 - DNA, 16 bp, C. familiaris
tttatagcaaaagaaa

SEQ ID NO: 333642 - DNA, 16 bp, C. familiaris
tttatagcagcaattt

SEQ ID NO: 333643 - DNA, 16 bp, C. familiaris
tttatagctgcaatgt

SEQ ID NO: 333644 - DNA, 16 bp, C. familiaris
tttataggaaatttta

SEQ ID NO: 333645 - DNA, 16 bp, C. familiaris
tttatatacagaaata

SEQ ID NO: 333646 - DNA, 16 bp, C. familiaris
tttatatagcattctt

SEQ ID NO: 333647 - DNA, 16 bp, C. familiaris
tttatatagtttggat

SEQ ID NO: 333648 - DNA, 16 bp, C. familiaris
tttatatatacatgta

SEQ ID NO: 333649 - DNA, 16 bp, C. familiaris
tttatatatccattca

SEQ ID NO: 333650 - DNA, 16 bp, C. familiaris
tttatatgaaaataca

SEQ ID NO: 333651 - DNA, 16 bp, C. familiaris
tttatatgtctgtctt

SEQ ID NO: 333652 - DNA, 16 bp, C. familiaris
tttatattctgttcca

SEQ ID NO: 333653 - DNA, 16 bp, C. familiaris
tttatcatctcacagt

SEQ ID NO: 333654 - DNA, 16 bp, C. familiaris
tttatcattggcaaca

SEQ ID NO: 333655 - DNA, 16 bp, C. familiaris
tttatccatttaaaaa

SEQ ID NO: 333656 - DNA, 16 bp, C. familiaris
tttatcccctttcact

SEQ ID NO: 333657 - DNA, 16 bp, C. familiaris
tttatccctgagagac

SEQ ID NO: 333658 - DNA, 16 bp, C. familiaris
tttatcctaaagaaat

SEQ ID NO: 333659 - DNA, 16 bp, C. familiaris
tttatcctacttggag

SEQ ID NO: 333660 - DNA, 16 bp, C. familiaris
tttatctattcatggg

SEQ ID NO: 333661 - DNA, 16 bp, C. familiaris
tttatctattcattca

SEQ ID NO: 333662 - DNA, 16 bp, C. familiaris
tttatctcctaaatat

SEQ ID NO: 333663 - DNA, 16 bp, C. familiaris
tttatctctccttcca

SEQ ID NO: 333664 - DNA, 16 bp, C. familiaris
tttatctgatatgtaa

SEQ ID NO: 333665 - DNA, 16 bp, C. familiaris
tttatcttttcaaaaa

SEQ ID NO: 333666 - DNA, 16 bp, C. familiaris
tttatcttttgtgaat

SEQ ID NO: 333667 - DNA, 16 bp, C. familiaris
tttatgaaacagttaa

SEQ ID NO: 333668 - DNA, 16 bp, C. familiaris
tttatgaaatgttttc

SEQ ID NO: 333669 - DNA, 16 bp, C. familiaris
tttatgaagaaaatat

SEQ ID NO: 333670 - DNA, 16 bp, C. familiaris
tttatgagagagagag

SEQ ID NO: 333671 - DNA, 16 bp, C. familiaris
tttatgattatgaaat

SEQ ID NO: 333672 - DNA, 16 bp, C. familiaris
tttatgccaatactat

SEQ ID NO: 333673 - DNA, 16 bp, C. familiaris
tttatgctttttccta

SEQ ID NO: 333674 - DNA, 16 bp, C. familiaris
tttatgcttttttcca

SEQ ID NO: 333675 - DNA, 16 bp, C. familiaris
tttatggaaaacattt

SEQ ID NO: 333676 - DNA, 16 bp, C. familiaris
tttatggatgaggaag

SEQ ID NO: 333677 - DNA, 16 bp, C. familiaris
tttatgggagcccaca

SEQ ID NO: 333678 - DNA, 16 bp, C. familiaris
tttatgtatacatttt

SEQ ID NO: 333679 - DNA, 16 bp, C. familiaris
tttatgtattagaaaa

SEQ ID NO: 333680 - DNA, 16 bp, C. familiaris
tttatgtcagtaccat

SEQ ID NO: 333681 - DNA, 16 bp, C. familiaris
tttattaaatgagaaa

SEQ ID NO: 333682 - DNA, 16 bp, C. familiaris
tttattaatgtgatct

SEQ ID NO: 333683 - DNA, 16 bp, C. familiaris
tttattaattctagta

SEQ ID NO: 333684 - DNA, 16 bp, C. familiaris
tttattacagtctttg

SEQ ID NO: 333685 - DNA, 16 bp, C. familiaris
tttattagaaacaaaa

SEQ ID NO: 333686 - DNA, 16 bp, C. familiaris
tttattatgcatttta

SEQ ID NO: 333687 - DNA, 16 bp, C. familiaris
tttattcaagaaaatc

SEQ ID NO: 333688 - DNA, 16 bp, C. familiaris
tttattcaagacagag

SEQ ID NO: 333689 - DNA, 16 bp, C. familiaris
tttattcacgagggac

SEQ ID NO: 333690 - DNA, 16 bp, C. familiaris
tttattcatagagata

SEQ ID NO: 333691 - DNA, 16 bp, C. familiaris
tttattcatcaattca

SEQ ID NO: 333692 - DNA, 16 bp, C. familiaris
tttattcatcttgcat

SEQ ID NO: 333693 - DNA, 16 bp, C. familiaris
tttattcatgaaatat

SEQ ID NO: 333694 - DNA, 16 bp, C. familiaris
tttattcatgagatgc

SEQ ID NO: 333695 - DNA, 16 bp, C. familiaris
tttattcattcactca

SEQ ID NO: 333696 - DNA, 16 bp, C. familiaris
tttattcctgagctgc

SEQ ID NO: 333697 - DNA, 16 bp, C. familiaris
tttattcctggactgc

SEQ ID NO: 333698 - DNA, 16 bp, C. familiaris
tttattcttcaaaaat

SEQ ID NO: 333699 - DNA, 16 bp, C. familiaris
tttattcttgtgactt

SEQ ID NO: 333700 - DNA, 16 bp, C. familiaris
tttattctttcaccaa

SEQ ID NO: 333701 - DNA, 16 bp, C. familiaris
tttattgaaaagactg

SEQ ID NO: 333702 - DNA, 16 bp, C. familiaris
tttattgacaaaaaca

SEQ ID NO: 333703 - DNA, 16 bp, C. familiaris
tttattggttaaaaaa

SEQ ID NO: 333704 - DNA, 16 bp, C. familiaris
tttattgtagaaaatt

SEQ ID NO: 333705 - DNA, 16 bp, C. familiaris
tttattgtctatcttc

SEQ ID NO: 333706 - DNA, 16 bp, C. familiaris
tttatttaaagagaga

SEQ ID NO: 333707 - DNA, 16 bp, C. familiaris
tttatttaaatgtgaa

SEQ ID NO: 333708 - DNA, 16 bp, C. familiaris
tttatttataagacac

SEQ ID NO: 333709 - DNA, 16 bp, C. familiaris
tttatttatatcagca

SEQ ID NO: 333710 - DNA, 16 bp, C. familiaris
tttatttatgaaacag

SEQ ID NO: 333711 - DNA, 16 bp, C. familiaris
tttatttatgagacag

SEQ ID NO: 333712 - DNA, 16 bp, C. familiaris
tttatttatgcattta

SEQ ID NO: 333713 - DNA, 16 bp, C. familiaris
tttatttatgggcagc

SEQ ID NO: 333714 - DNA, 16 bp, C. familiaris
tttatttattcatctg

SEQ ID NO: 333715 - DNA, 16 bp, C. familiaris
tttatttattgagaaa

SEQ ID NO: 333716 - DNA, 16 bp, C. familiaris
tttatttattgggcag

SEQ ID NO: 333717 - DNA, 16 bp, C. familiaris
tttatttcagacttct

SEQ ID NO: 333718 - DNA, 16 bp, C. familiaris
tttatttcagagagac

SEQ ID NO: 333719 - DNA, 16 bp, C. familiaris
tttatttccagaaaaa

SEQ ID NO: 333720 - DNA, 16 bp, C. familiaris
tttatttccccaaatt

SEQ ID NO: 333721 - DNA, 16 bp, C. familiaris
tttatttcctttggat

SEQ ID NO: 333722 - DNA, 16 bp, C. familiaris
tttatttctcagaaaa

SEQ ID NO: 333723 - DNA, 16 bp, C. familiaris
tttatttctcatggtt

SEQ ID NO: 333724 - DNA, 16 bp, C. familiaris
tttatttctcccagtt

SEQ ID NO: 333725 - DNA, 16 bp, C. familiaris
tttatttctgataaaa

SEQ ID NO: 333726 - DNA, 16 bp, C. familiaris
tttatttctttcagat

SEQ ID NO: 333727 - DNA, 16 bp, C. familiaris
tttatttcttttggaa

SEQ ID NO: 333728 - DNA, 16 bp, C. familiaris
tttatttgaaaatgtc

SEQ ID NO: 333729 - DNA, 16 bp, C. familiaris
tttatttgaaatcttt

SEQ ID NO: 333730 - DNA, 16 bp, C. familiaris
tttatttgaagaaata

SEQ ID NO: 333731 - DNA, 16 bp, C. familiaris
tttatttgacaaagaa

SEQ ID NO: 333732 - DNA, 16 bp, C. familiaris
tttatttgacagaaga

SEQ ID NO: 333733 - DNA, 16 bp, C. familiaris
tttatttgacagaatg

SEQ ID NO: 333734 - DNA, 16 bp, C. familiaris
tttatttgccttttcc

SEQ ID NO: 333735 - DNA, 16 bp, C. familiaris
tttatttggataaaat

SEQ ID NO: 333736 - DNA, 16 bp, C. familiaris
tttatttgtgagaaac

SEQ ID NO: 333737 - DNA, 16 bp, C. familiaris
tttatttgttcatcca

SEQ ID NO: 333738 - DNA, 16 bp, C. familiaris
tttattttccagaaat

SEQ ID NO: 333739 - DNA, 16 bp, C. familiaris
tttattttctcatagt

SEQ ID NO: 333740 - DNA, 16 bp, C. familiaris
tttattttctctgcct

SEQ ID NO: 333741 - DNA, 16 bp, C. familiaris
tttattttgagaaaat

SEQ ID NO: 333742 - DNA, 16 bp, C. familiaris
tttatttttaaggaaa

SEQ ID NO: 333743 - DNA, 16 bp, C. familiaris
tttatttttacaaagt

SEQ ID NO: 333744 - DNA, 16 bp, C. familiaris
tttatttttcagaaat

SEQ ID NO: 333745 - DNA, 16 bp, C. familiaris
tttatttttccagaaa

SEQ ID NO: 333746 - DNA, 16 bp, C. familiaris
tttatttttccagaat

SEQ ID NO: 333747 - DNA, 16 bp, C. familiaris
tttatttttctgaaaa

SEQ ID NO: 333748 - DNA, 16 bp, C. familiaris
tttatttttgatagac

SEQ ID NO: 333749 - DNA, 16 bp, C. familiaris
tttcaaaaaaagtaaa

SEQ ID NO: 333750 - DNA, 16 bp, C. familiaris
tttcaaaaaagtattt

SEQ ID NO: 333751 - DNA, 16 bp, C. familiaris
tttcaaaaacactttt

SEQ ID NO: 333752 - DNA, 16 bp, C. familiaris
tttcaaaaacttttaa

SEQ ID NO: 333753 - DNA, 16 bp, C. familiaris
tttcaaaaagaaattt

SEQ ID NO: 333754 - DNA, 16 bp, C. familiaris
tttcaaaaattccttt

SEQ ID NO: 333755 - DNA, 16 bp, C. familiaris
tttcaaaaccagacaa

SEQ ID NO: 333756 - DNA, 16 bp, C. familiaris
tttcaaaagagaaaaa

SEQ ID NO: 333757 - DNA, 16 bp, C. familiaris
tttcaaaatgtaaaaa

SEQ ID NO: 333758 - DNA, 16 bp, C. familiaris
tttcaaaattaagttt

SEQ ID NO: 333759 - DNA, 16 bp, C. familiaris
tttcaaactgttgctt

SEQ ID NO: 333760 - DNA, 16 bp, C. familiaris
tttcaaacttagagaa

SEQ ID NO: 333761 - DNA, 16 bp, C. familiaris
tttcaaagaaaagttt

SEQ ID NO: 333762 - DNA, 16 bp, C. familiaris
tttcaaagaaaataaa

SEQ ID NO: 333763 - DNA, 16 bp, C. familiaris
tttcaaagaaaataat

SEQ ID NO: 333764 - DNA, 16 bp, C. familiaris
tttcaaagaaacaaaa

SEQ ID NO: 333765 - DNA, 16 bp, C. familiaris
tttcaaagaaacaact

SEQ ID NO: 333766 - DNA, 16 bp, C. familiaris
tttcaaagaaataaaa

SEQ ID NO: 333767 - DNA, 16 bp, C. familiaris
tttcaaagaaataaat

SEQ ID NO: 333768 - DNA, 16 bp, C. familiaris
tttcaaagaactagaa

SEQ ID NO: 333769 - DNA, 16 bp, C. familiaris
tttcaaagaagcagct

SEQ ID NO: 333770 - DNA, 16 bp, C. familiaris
tttcaaagacattttt

SEQ ID NO: 333771 - DNA, 16 bp, C. familiaris
tttcaaagagaaaaaa

SEQ ID NO: 333772 - DNA, 16 bp, C. familiaris
tttcaaagatttaatt

SEQ ID NO: 333773 - DNA, 16 bp, C. familiaris
tttcaaagatttcttt

SEQ ID NO: 333774 - DNA, 16 bp, C. familiaris
tttcaaaggaaaatat

SEQ ID NO: 333775 - DNA, 16 bp, C. familiaris
tttcaaaggaaggaaa

SEQ ID NO: 333776 - DNA, 16 bp, C. familiaris
tttcaaatacagaaaa

SEQ ID NO: 333777 - DNA, 16 bp, C. familiaris
tttcaaatattttgaa

SEQ ID NO: 333778 - DNA, 16 bp, C. familiaris
tttcaaatgaagaaat

SEQ ID NO: 333779 - DNA, 16 bp, C. familiaris
tttcaaatgccatttt

SEQ ID NO: 333780 - DNA, 16 bp, C. familiaris
tttcaaatgctttttt

SEQ ID NO: 333781 - DNA, 16 bp, C. familiaris
tttcaaatgtgaattt

SEQ ID NO: 333782 - DNA, 16 bp, C. familiaris
tttcaaattactgttt

SEQ ID NO: 333783 - DNA, 16 bp, C. familiaris
tttcaaattctgtttt

SEQ ID NO: 333784 - DNA, 16 bp, C. familiaris
tttcaaatttgtgttt

SEQ ID NO: 333785 - DNA, 16 bp, C. familiaris
tttcaacaaaaagtta

SEQ ID NO: 333786 - DNA, 16 bp, C. familiaris
tttcaacaaatatatt

SEQ ID NO: 333787 - DNA, 16 bp, C. familiaris
tttcaacttctttggg

SEQ ID NO: 333788 - DNA, 16 bp, C. familiaris
tttcaagaaaacaaaa

SEQ ID NO: 333789 - DNA, 16 bp, C. familiaris
tttcaagaaatggtgc

SEQ ID NO: 333790 - DNA, 16 bp, C. familiaris
tttcaagaatattata

SEQ ID NO: 333791 - DNA, 16 bp, C. familiaris
tttcaagaatgtcata

SEQ ID NO: 333792 - DNA, 16 bp, C. familiaris
tttcaagatccatcca

SEQ ID NO: 333793 - DNA, 16 bp, C. familiaris
tttcaagtttatttaa

SEQ ID NO: 333794 - DNA, 16 bp, C. familiaris
tttcaatctgcagatg

SEQ ID NO: 333795 - DNA, 16 bp, C. familiaris
tttcaattttaaaatg

SEQ ID NO: 333796 - DNA, 16 bp, C. familiaris
tttcacaaaagtagaa

SEQ ID NO: 333797 - DNA, 16 bp, C. familiaris
tttcacaaatgaagaa

SEQ ID NO: 333798 - DNA, 16 bp, C. familiaris
tttcacagagaagaaa

SEQ ID NO: 333799 - DNA, 16 bp, C. familiaris
tttcacagagaaggaa

SEQ ID NO: 333800 - DNA, 16 bp, C. familiaris
tttcacagagctgaaa

SEQ ID NO: 333801 - DNA, 16 bp, C. familiaris
tttcacattttcacat

SEQ ID NO: 333802 - DNA, 16 bp, C. familiaris
tttcaccatttagtat

SEQ ID NO: 333803 - DNA, 16 bp, C. familiaris
tttcactctttttgat

SEQ ID NO: 333804 - DNA, 16 bp, C. familiaris
tttcactggaaaaaaa

SEQ ID NO: 333805 - DNA, 16 bp, C. familiaris
tttcactgtcttaaaa

SEQ ID NO: 333806 - DNA, 16 bp, C. familiaris
tttcactgtgtcttca

SEQ ID NO: 333807 - DNA, 16 bp, C. familiaris
tttcacttcttaaaaa

SEQ ID NO: 333808 - DNA, 16 bp, C. familiaris
tttcacttgcatttcc

SEQ ID NO: 333809 - DNA, 16 bp, C. familiaris
tttcacttttaaaatg

SEQ ID NO: 333810 - DNA, 16 bp, C. familiaris
tttcagaaaaacagaa

SEQ ID NO: 333811 - DNA, 16 bp, C. familiaris
tttcagaaaaagcaaa

SEQ ID NO: 333812 - DNA, 16 bp, C. familiaris
tttcagaaaagaaaca

SEQ ID NO: 333813 - DNA, 16 bp, C. familiaris
tttcagaaaaggaaat

SEQ ID NO: 333814 - DNA, 16 bp, C. familiaris
tttcagaaaatattca

SEQ ID NO: 333815 - DNA, 16 bp, C. familiaris
tttcagaaaatgtttt

SEQ ID NO: 333816 - DNA, 16 bp, C. familiaris
tttcagaaaattcttt

SEQ ID NO: 333817 - DNA, 16 bp, C. familiaris
tttcagaaacattaaa

SEQ ID NO: 333818 - DNA, 16 bp, C. familiaris
tttcagaaataaaaca

SEQ ID NO: 333819 - DNA, 16 bp, C. familiaris
tttcagaaatgtaaaa

SEQ ID NO: 333820 - DNA, 16 bp, C. familiaris
tttcagaactttttca

SEQ ID NO: 333821 - DNA, 16 bp, C. familiaris
tttcagaagggttctg

SEQ ID NO: 333822 - DNA, 16 bp, C. familiaris
tttcagaattttgaaa

SEQ ID NO: 333823 - DNA, 16 bp, C. familiaris
tttcagacttaaaaaa

SEQ ID NO: 333824 - DNA, 16 bp, C. familiaris
tttcagactttttcat

SEQ ID NO: 333825 - DNA, 16 bp, C. familiaris
tttcagagagagaaag

SEQ ID NO: 333826 - DNA, 16 bp, C. familiaris
tttcagaggaaaaaaa

SEQ ID NO: 333827 - DNA, 16 bp, C. familiaris
tttcagaggaagaaaa

SEQ ID NO: 333828 - DNA, 16 bp, C. familiaris
tttcagaggtgttctg

SEQ ID NO: 333829 - DNA, 16 bp, C. familiaris
tttcagagtacaaatc

SEQ ID NO: 333830 - DNA, 16 bp, C. familiaris
tttcagagtacaagtc

SEQ ID NO: 333831 - DNA, 16 bp, C. familiaris
tttcagataaaaataa

SEQ ID NO: 333832 - DNA, 16 bp, C. familiaris
tttcagatatatgatt

SEQ ID NO: 333833 - DNA, 16 bp, C. familiaris
tttcagatgtgcaaca

SEQ ID NO: 333834 - DNA, 16 bp, C. familiaris
tttcagcaaatggtgt

SEQ ID NO: 333835 - DNA, 16 bp, C. familiaris
tttcagcagaaactct

SEQ ID NO: 333836 - DNA, 16 bp, C. familiaris
tttcagcaggaacttt

SEQ ID NO: 333837 - DNA, 16 bp, C. familiaris
tttcagcctccagaac

SEQ ID NO: 333838 - DNA, 16 bp, C. familiaris
tttcagctcatgtcat

SEQ ID NO: 333839 - DNA, 16 bp, C. familiaris
tttcaggagaaatttt

SEQ ID NO: 333840 - DNA, 16 bp, C. familiaris
tttcaggattattttg

SEQ ID NO: 333841 - DNA, 16 bp, C. familiaris
tttcaggcatcccctg

SEQ ID NO: 333842 - DNA, 16 bp, C. familiaris
tttcaggggaaaaaaa

SEQ ID NO: 333843 - DNA, 16 bp, C. familiaris
tttcaggttcacagca

SEQ ID NO: 333844 - DNA, 16 bp, C. familiaris
tttcagtagaaaaaaa

SEQ ID NO: 333845 - DNA, 16 bp, C. familiaris
tttcagtctttttaaa

SEQ ID NO: 333846 - DNA, 16 bp, C. familiaris
tttcagtgaaataaaa

SEQ ID NO: 333847 - DNA, 16 bp, C. familiaris
tttcagttcagggcat

SEQ ID NO: 333848 - DNA, 16 bp, C. familiaris
tttcagttctttccag

SEQ ID NO: 333849 - DNA, 16 bp, C. familiaris
tttcagtttcctcttt

SEQ ID NO: 333850 - DNA, 16 bp, C. familiaris
tttcagtttctccatc

SEQ ID NO: 333851 - DNA, 16 bp, C. familiaris
tttcagttttatatat

SEQ ID NO: 333852 - DNA, 16 bp, C. familiaris
tttcagttttgaaaaa

SEQ ID NO: 333853 - DNA, 16 bp, C. familiaris
tttcagtttttcaaaa

SEQ ID NO: 333854 - DNA, 16 bp, C. familiaris
tttcagtttttcagtt

SEQ ID NO: 333855 - DNA, 16 bp, C. familiaris
tttcataaaagaaaag

SEQ ID NO: 333856 - DNA, 16 bp, C. familiaris
tttcataaggaaaaaa

SEQ ID NO: 333857 - DNA, 16 bp, C. familiaris
tttcataatcagaaaa

SEQ ID NO: 333858 - DNA, 16 bp, C. familiaris
tttcatagaaaaagaa

SEQ ID NO: 333859 - DNA, 16 bp, C. familiaris
tttcatagtttaaaaa

SEQ ID NO: 333860 - DNA, 16 bp, C. familiaris
tttcatatgttttcat

SEQ ID NO: 333861 - DNA, 16 bp, C. familiaris
tttcatcttcaatttc

SEQ ID NO: 333862 - DNA, 16 bp, C. familiaris
tttcatctttttgatg

SEQ ID NO: 333863 - DNA, 16 bp, C. familiaris
tttcatgaaaaaaatt

SEQ ID NO: 333864 - DNA, 16 bp, C. familiaris
tttcatgatcctgaga

SEQ ID NO: 333865 - DNA, 16 bp, C. familiaris
tttcatgtaatttttg

SEQ ID NO: 333866 - DNA, 16 bp, C. familiaris
tttcatgtgttttaaa

SEQ ID NO: 333867 - DNA, 16 bp, C. familiaris
tttcattaaagaaaat

SEQ ID NO: 333868 - DNA, 16 bp, C. familiaris
tttcattacatatata

SEQ ID NO: 333869 - DNA, 16 bp, C. familiaris
tttcattacattttca

SEQ ID NO: 333870 - DNA, 16 bp, C. familiaris
tttcattatttgcaga

SEQ ID NO: 333871 - DNA, 16 bp, C. familiaris
tttcattcagcaaaat

SEQ ID NO: 333872 - DNA, 16 bp, C. familiaris
tttcattcagcaaata

SEQ ID NO: 333873 - DNA, 16 bp, C. familiaris
tttcattcatctcaaa

SEQ ID NO: 333874 - DNA, 16 bp, C. familiaris
tttcattcattcattc

SEQ ID NO: 333875 - DNA, 16 bp, C. familiaris
tttcattcctgatttt

SEQ ID NO: 333876 - DNA, 16 bp, C. familiaris
tttcattcttgatatt

SEQ ID NO: 333877 - DNA, 16 bp, C. familiaris
tttcattgtatatgta

SEQ ID NO: 333878 - DNA, 16 bp, C. familiaris
tttcattgtattttaa

SEQ ID NO: 333879 - DNA, 16 bp, C. familiaris
tttcattgtgattttg

SEQ ID NO: 333880 - DNA, 16 bp, C. familiaris
tttcattgtttaaaat

SEQ ID NO: 333881 - DNA, 16 bp, C. familiaris
tttcatttacaaatat

SEQ ID NO: 333882 - DNA, 16 bp, C. familiaris
tttcatttacttaaaa

SEQ ID NO: 333883 - DNA, 16 bp, C. familiaris
tttcatttatgaaatt

SEQ ID NO: 333884 - DNA, 16 bp, C. familiaris
tttcatttcagatttt

SEQ ID NO: 333885 - DNA, 16 bp, C. familiaris
tttcatttctgccttt

SEQ ID NO: 333886 - DNA, 16 bp, C. familiaris
tttcatttctgggtat

SEQ ID NO: 333887 - DNA, 16 bp, C. familiaris
tttcatttcttcattg

SEQ ID NO: 333888 - DNA, 16 bp, C. familiaris
tttcatttgcttttcc

SEQ ID NO: 333889 - DNA, 16 bp, C. familiaris
tttcatttggaaaata

SEQ ID NO: 333890 - DNA, 16 bp, C. familiaris
tttcatttgtgacttt

SEQ ID NO: 333891 - DNA, 16 bp, C. familiaris
tttcattttaataaag

SEQ ID NO: 333892 - DNA, 16 bp, C. familiaris
tttcattttcttaaca

SEQ ID NO: 333893 - DNA, 16 bp, C. familiaris
tttcattttgaagaaa

SEQ ID NO: 333894 - DNA, 16 bp, C. familiaris
tttcattttgtaaatg

SEQ ID NO: 333895 - DNA, 16 bp, C. familiaris
tttcattttgtttgga

SEQ ID NO: 333896 - DNA, 16 bp, C. familiaris
tttcatttttaaaatg

SEQ ID NO: 333897 - DNA, 16 bp, C. familiaris
tttcatttttgaaaag

SEQ ID NO: 333898 - DNA, 16 bp, C. familiaris
tttcatttttgtaaat

SEQ ID NO: 333899 - DNA, 16 bp, C. familiaris
tttcattttttgagga

SEQ ID NO: 333900 - DNA, 16 bp, C. familiaris
tttccaaaagaaattt

SEQ ID NO: 333901 - DNA, 16 bp, C. familiaris
tttccaaaatagaaaa

SEQ ID NO: 333902 - DNA, 16 bp, C. familiaris
tttccaaagaaacaga

SEQ ID NO: 333903 - DNA, 16 bp, C. familiaris
tttccaaagaaccagc

SEQ ID NO: 333904 - DNA, 16 bp, C. familiaris
tttccaaagaagagat

SEQ ID NO: 333905 - DNA, 16 bp, C. familiaris
tttccaaagaattttt

SEQ ID NO: 333906 - DNA, 16 bp, C. familiaris
tttccaaagacaacat

SEQ ID NO: 333907 - DNA, 16 bp, C. familiaris
tttccaaagagaaaaa

SEQ ID NO: 333908 - DNA, 16 bp, C. familiaris
tttccaaagataaaat

SEQ ID NO: 333909 - DNA, 16 bp, C. familiaris
tttccaaaggaaaaaa

SEQ ID NO: 333910 - DNA, 16 bp, C. familiaris
tttccaaaggaatttc

SEQ ID NO: 333911 - DNA, 16 bp, C. familiaris
tttccaaatgagaaaa

SEQ ID NO: 333912 - DNA, 16 bp, C. familiaris
tttccaaattcagatt

SEQ ID NO: 333913 - DNA, 16 bp, C. familiaris
tttccaagaaataaaa

SEQ ID NO: 333914 - DNA, 16 bp, C. familiaris
tttccaagatttattt

SEQ ID NO: 333915 - DNA, 16 bp, C. familiaris
tttccaagattttttt

SEQ ID NO: 333916 - DNA, 16 bp, C. familiaris
tttccaaggaagatat

SEQ ID NO: 333917 - DNA, 16 bp, C. familiaris
tttccacattttgttt

SEQ ID NO: 333918 - DNA, 16 bp, C. familiaris
tttccagaaagaaata

SEQ ID NO: 333919 - DNA, 16 bp, C. familiaris
tttccagaaatggaaa

SEQ ID NO: 333920 - DNA, 16 bp, C. familiaris
tttccagaaccttgag

SEQ ID NO: 333921 - DNA, 16 bp, C. familiaris
tttccagaagaggaaa

SEQ ID NO: 333922 - DNA, 16 bp, C. familiaris
tttccagagccatcag

SEQ ID NO: 333923 - DNA, 16 bp, C. familiaris
tttccagattttaaat

SEQ ID NO: 333924 - DNA, 16 bp, C. familiaris
tttccagcttccagaa

SEQ ID NO: 333925 - DNA, 16 bp, C. familiaris
tttccagctttgttct

SEQ ID NO: 333926 - DNA, 16 bp, C. familiaris
tttccaggaaaaataa

SEQ ID NO: 333927 - DNA, 16 bp, C. familiaris
tttccaggaccttgag

SEQ ID NO: 333928 - DNA, 16 bp, C. familiaris
tttccaggatcaggcc

SEQ ID NO: 333929 - DNA, 16 bp, C. familiaris
tttccaggttcatcca

SEQ ID NO: 333930 - DNA, 16 bp, C. familiaris
tttccagtttggctat

SEQ ID NO: 333931 - DNA, 16 bp, C. familiaris
tttccagttttcccaa

SEQ ID NO: 333932 - DNA, 16 bp, C. familiaris
tttccagttttcttcc

SEQ ID NO: 333933 - DNA, 16 bp, C. familiaris
tttccagtttttgcct

SEQ ID NO: 333934 - DNA, 16 bp, C. familiaris
tttccatataaaattt

SEQ ID NO: 333935 - DNA, 16 bp, C. familiaris
tttccatatgtaaaat

SEQ ID NO: 333936 - DNA, 16 bp, C. familiaris
tttccatccaaacaca

SEQ ID NO: 333937 - DNA, 16 bp, C. familiaris
tttccatggtttggct

SEQ ID NO: 333938 - DNA, 16 bp, C. familiaris
tttccattcaggtcat

SEQ ID NO: 333939 - DNA, 16 bp, C. familiaris
tttccattctggaaaa

SEQ ID NO: 333940 - DNA, 16 bp, C. familiaris
tttccatttctcttag

SEQ ID NO: 333941 - DNA, 16 bp, C. familiaris
tttccatttgcaataa

SEQ ID NO: 333942 - DNA, 16 bp, C. familiaris
tttccatttgcaatga

SEQ ID NO: 333943 - DNA, 16 bp, C. familiaris
tttccatttgtaaaat

SEQ ID NO: 333944 - DNA, 16 bp, C. familiaris
tttccattttcatgga

SEQ ID NO: 333945 - DNA, 16 bp, C. familiaris
tttccattttcatttg

SEQ ID NO: 333946 - DNA, 16 bp, C. familiaris
tttcccaaagatttta

SEQ ID NO: 333947 - DNA, 16 bp, C. familiaris
tttcccaacaccatct

SEQ ID NO: 333948 - DNA, 17 bp, C. familiaris
tttcccataaagttcag

SEQ ID NO: 333949 - DNA, 16 bp, C. familiaris
tttcccattttaaaaa

SEQ ID NO: 333950 - DNA, 16 bp, C. familiaris
tttccccagtggctgc

SEQ ID NO: 333951 - DNA, 16 bp, C. familiaris
tttccccatcctcact

SEQ ID NO: 333952 - DNA, 16 bp, C. familiaris
tttccccattgaaaat

SEQ ID NO: 333953 - DNA, 16 bp, C. familiaris
tttcccctgtctgtct

SEQ ID NO: 333954 - DNA, 16 bp, C. familiaris
tttccctctggccctc

SEQ ID NO: 333955 - DNA, 16 bp, C. familiaris
tttccctgcagggagc

SEQ ID NO: 333956 - DNA, 16 bp, C. familiaris
tttcccttcccaagtt

SEQ ID NO: 333957 - DNA, 16 bp, C. familiaris
tttcccttgcctcaga

SEQ ID NO: 333958 - DNA, 16 bp, C. familiaris
tttccctttctgtaaa

SEQ ID NO: 333959 - DNA, 16 bp, C. familiaris
tttcctaatttaaaaa

SEQ ID NO: 333960 - DNA, 16 bp, C. familiaris
tttcctcaaaaactta

SEQ ID NO: 333961 - DNA, 16 bp, C. familiaris
tttcctcaaatatttt

SEQ ID NO: 333962 - DNA, 16 bp, C. familiaris
tttcctcacctgtaaa

SEQ ID NO: 333963 - DNA, 16 bp, C. familiaris
tttcctcagtttctct

SEQ ID NO: 333964 - DNA, 16 bp, C. familiaris
tttcctcatctatcaa

SEQ ID NO: 333965 - DNA, 16 bp, C. familiaris
tttcctcctctgaaaa

SEQ ID NO: 333966 - DNA, 16 bp, C. familiaris
tttcctctaaaatttt

SEQ ID NO: 333967 - DNA, 16 bp, C. familiaris
tttcctctctgacctc

SEQ ID NO: 333968 - DNA, 16 bp, C. familiaris
tttcctctctgagcct

SEQ ID NO: 333969 - DNA, 16 bp, C. familiaris
tttcctctgtgcatgt

SEQ ID NO: 333970 - DNA, 16 bp, C. familiaris
tttcctgaaaataaaa

SEQ ID NO: 333971 - DNA, 16 bp, C. familiaris
tttcctgaaagaaaag

SEQ ID NO: 333972 - DNA, 16 bp, C. familiaris
tttcctgaaatatttt

SEQ ID NO: 333973 - DNA, 16 bp, C. familiaris
tttcctgcatctgctg

SEQ ID NO: 333974 - DNA, 16 bp, C. familiaris
tttcctgcctttttaa

SEQ ID NO: 333975 - DNA, 16 bp, C. familiaris
tttcctgggcctcagt

SEQ ID NO: 333976 - DNA, 16 bp, C. familiaris
tttcctgtgggctttt

SEQ ID NO: 333977 - DNA, 16 bp, C. familiaris
tttcctgttctctatt

SEQ ID NO: 333978 - DNA, 16 bp, C. familiaris
tttccttatctggaaa

SEQ ID NO: 333979 - DNA, 16 bp, C. familiaris
tttccttatgattttc

SEQ ID NO: 333980 - DNA, 16 bp, C. familiaris
tttccttatttcaaaa

SEQ ID NO: 333981 - DNA, 16 bp, C. familiaris
tttccttcagcctgaa

SEQ ID NO: 333982 - DNA, 16 bp, C. familiaris
tttccttccttttaaa

SEQ ID NO: 333983 - DNA, 16 bp, C. familiaris
tttccttctagatttt

SEQ ID NO: 333984 - DNA, 16 bp, C. familiaris
tttccttctcttaaaa

SEQ ID NO: 333985 - DNA, 16 bp, C. familiaris
tttccttctctttgca

SEQ ID NO: 333986 - DNA, 16 bp, C. familiaris
tttccttgaatatttt

SEQ ID NO: 333987 - DNA, 16 bp, C. familiaris
tttcctttaaatatgt

SEQ ID NO: 333988 - DNA, 16 bp, C. familiaris
tttcctttaggaaaaa

SEQ ID NO: 333989 - DNA, 16 bp, C. familiaris
tttcctttcaaatata

SEQ ID NO: 333990 - DNA, 16 bp, C. familiaris
tttcctttcagcattt

SEQ ID NO: 333991 - DNA, 16 bp, C. familiaris
tttcctttctctgaat

SEQ ID NO: 333992 - DNA, 16 bp, C. familiaris
tttcctttgctgtgga

SEQ ID NO: 333993 - DNA, 16 bp, C. familiaris
tttcctttggatatat

SEQ ID NO: 333994 - DNA, 16 bp, C. familiaris
tttccttttgaaaatg

SEQ ID NO: 333995 - DNA, 16 bp, C. familiaris
tttccttttttaaaga

SEQ ID NO: 333996 - DNA, 16 bp, C. familiaris
tttcgttttgttgatg

SEQ ID NO: 333997 - DNA, 16 bp, C. familiaris
tttctaaaaagaaaaa

SEQ ID NO: 333998 - DNA, 16 bp, C. familiaris
tttctaaaaagtaaaa

SEQ ID NO: 333999 - DNA, 16 bp, C. familiaris
tttctaaaacacagaa

SEQ ID NO: 334000 - DNA, 16 bp, C. familiaris
tttctaaaatcaaaat

SEQ ID NO: 334001 - DNA, 16 bp, C. familiaris
tttctaaaatgtgttt

SEQ ID NO: 334002 - DNA, 16 bp, C. familiaris
tttctaaagaaatttt

SEQ ID NO: 334003 - DNA, 16 bp, C. familiaris
tttctaagaaaatatt

SEQ ID NO: 334004 - DNA, 16 bp, C. familiaris
tttctaagtataaaat

SEQ ID NO: 334005 - DNA, 16 bp, C. familiaris
tttctaattctaaaat

SEQ ID NO: 334006 - DNA, 16 bp, C. familiaris
tttctacagttttctt

SEQ ID NO: 334007 - DNA, 16 bp, C. familiaris
tttctacttctttctg

SEQ ID NO: 334008 - DNA, 16 bp, C. familiaris
tttctagatatgtctc

SEQ ID NO: 334009 - DNA, 16 bp, C. familiaris
tttctagatgtttcct

SEQ ID NO: 334010 - DNA, 16 bp, C. familiaris
tttctagatttccttt

SEQ ID NO: 334011 - DNA, 16 bp, C. familiaris
tttctagatttgtctc

SEQ ID NO: 334012 - DNA, 16 bp, C. familiaris
tttctaggaatatttt

SEQ ID NO: 334013 - DNA, 16 bp, C. familiaris
tttctatataaaatgt

SEQ ID NO: 334014 - DNA, 16 bp, C. familiaris
tttctatgaaaaataa

SEQ ID NO: 334015 - DNA, 18 bp, C. familiaris
tttctatgtacaatatca

SEQ ID NO: 334016 - DNA, 16 bp, C. familiaris
tttctatttcttcatg

SEQ ID NO: 334017 - DNA, 16 bp, C. familiaris
tttctcaaaaatatat

SEQ ID NO: 334018 - DNA, 16 bp, C. familiaris
tttctcaaaaggttaa

SEQ ID NO: 334019 - DNA, 16 bp, C. familiaris
tttctcaaaataaaat

SEQ ID NO: 334020 - DNA, 16 bp, C. familiaris
tttctcaaagaagaaa

SEQ ID NO: 334021 - DNA, 16 bp, C. familiaris
tttctcaagaataaat

SEQ ID NO: 334022 - DNA, 16 bp, C. familiaris
tttctcagacttttct

SEQ ID NO: 334023 - DNA, 16 bp, C. familiaris
tttctcagcatcctct

SEQ ID NO: 334024 - DNA, 16 bp, C. familiaris
tttctcagcttccttc

SEQ ID NO: 334025 - DNA, 16 bp, C. familiaris
tttctcagttaaaaaa

SEQ ID NO: 334026 - DNA, 16 bp, C. familiaris
tttctcatcagaaaca

SEQ ID NO: 334027 - DNA, 16 bp, C. familiaris
tttctcatccataaaa

SEQ ID NO: 334028 - DNA, 16 bp, C. familiaris
tttctcatgaaaaaat

SEQ ID NO: 334029 - DNA, 16 bp, C. familiaris
tttctcatgattctgt

SEQ ID NO: 334030 - DNA, 16 bp, C. familiaris
tttctccaaagaaatg

SEQ ID NO: 334031 - DNA, 16 bp, C. familiaris
tttctccacaccctca

SEQ ID NO: 334032 - DNA, 16 bp, C. familiaris
tttctccagagaagac

SEQ ID NO: 334033 - DNA, 16 bp, C. familiaris
tttctccatttctcca

SEQ ID NO: 334034 - DNA, 16 bp, C. familiaris
tttctccctctgactg

SEQ ID NO: 334035 - DNA, 16 bp, C. familiaris
tttctcctttcagttc

SEQ ID NO: 334036 - DNA, 16 bp, C. familiaris
tttctctaaatatata

SEQ ID NO: 334037 - DNA, 16 bp, C. familiaris
tttctctacatccttg

SEQ ID NO: 334038 - DNA, 16 bp, C. familiaris
tttctctcagtctctc

SEQ ID NO: 334039 - DNA, 16 bp, C. familiaris
tttctctccttaaaaa

SEQ ID NO: 334040 - DNA, 16 bp, C. familiaris
tttctctctcaaaaaa

SEQ ID NO: 334041 - DNA, 16 bp, C. familiaris
tttctctctctaataa

SEQ ID NO: 334042 - DNA, 16 bp, C. familiaris
tttctctctttgccat

SEQ ID NO: 334043 - DNA, 16 bp, C. familiaris
tttctctgatcctttc

SEQ ID NO: 334044 - DNA, 16 bp, C. familiaris
tttctctgcatcctca

SEQ ID NO: 334045 - DNA, 16 bp, C. familiaris
tttctctgcctgtgtc

SEQ ID NO: 334046 - DNA, 16 bp, C. familiaris
tttctctgcttcattt

SEQ ID NO: 334047 - DNA, 16 bp, C. familiaris
tttctctgcttcctca

SEQ ID NO: 334048 - DNA, 16 bp, C. familiaris
tttctctgggaaaaaa

SEQ ID NO: 334049 - DNA, 16 bp, C. familiaris
tttctctgtatctctg

SEQ ID NO: 334050 - DNA, 16 bp, C. familiaris
tttctctgtcatgaat

SEQ ID NO: 334051 - DNA, 16 bp, C. familiaris
tttctctgtgtttcat

SEQ ID NO: 334052 - DNA, 16 bp, C. familiaris
tttctcttaaaataat

SEQ ID NO: 334053 - DNA, 16 bp, C. familiaris
tttctcttactgatat

SEQ ID NO: 334054 - DNA, 16 bp, C. familiaris
tttctcttagcattat

SEQ ID NO: 334055 - DNA, 16 bp, C. familiaris
tttctcttcagaaaaa

SEQ ID NO: 334056 - DNA, 16 bp, C. familiaris
tttctcttcctcctgg

SEQ ID NO: 334057 - DNA, 16 bp, C. familiaris
tttctcttctccaaat

SEQ ID NO: 334058 - DNA, 16 bp, C. familiaris
tttctcttgagatttt

SEQ ID NO: 334059 - DNA, 16 bp, C. familiaris
tttctcttgcctccag

SEQ ID NO: 334060 - DNA, 16 bp, C. familiaris
tttctcttgtggatat

SEQ ID NO: 334061 - DNA, 16 bp, C. familiaris
tttctctttaataaaa

SEQ ID NO: 334062 - DNA, 16 bp, C. familiaris
tttctctttcctaaat

SEQ ID NO: 334063 - DNA, 16 bp, C. familiaris
tttctctttcttcagt

SEQ ID NO: 334064 - DNA, 16 bp, C. familiaris
tttctctttgttgaaa

SEQ ID NO: 334065 - DNA, 16 bp, C. familiaris
tttctcttttctggaa

SEQ ID NO: 334066 - DNA, 16 bp, C. familiaris
tttctgaaaacaaaaa

SEQ ID NO: 334067 - DNA, 16 bp, C. familiaris
tttctgaaaaccagaa

SEQ ID NO: 334068 - DNA, 16 bp, C. familiaris
tttctgaaaagaaaag

SEQ ID NO: 334069 - DNA, 16 bp, C. familiaris
tttctgaaaatgtttt

SEQ ID NO: 334070 - DNA, 16 bp, C. familiaris
tttctgaaaattattt

SEQ ID NO: 334071 - DNA, 16 bp, C. familiaris
tttctgaaataaaaat

SEQ ID NO: 334072 - DNA, 16 bp, C. familiaris
tttctgaaatatttat

SEQ ID NO: 334073 - DNA, 16 bp, C. familiaris
tttctgaaattttata

SEQ ID NO: 334074 - DNA, 16 bp, C. familiaris
tttctgaagaagaaaa

SEQ ID NO: 334075 - DNA, 16 bp, C. familiaris
tttctgaagatttttt

SEQ ID NO: 334076 - DNA, 16 bp, C. familiaris
tttctgaatgagatta

SEQ ID NO: 334077 - DNA, 16 bp, C. familiaris
tttctgaattaaaaaa

SEQ ID NO: 334078 - DNA, 16 bp, C. familiaris
tttctgaatttctgaa

SEQ ID NO: 334079 - DNA, 16 bp, C. familiaris
tttctgaccttcctaa

SEQ ID NO: 334080 - DNA, 16 bp, C. familiaris
tttctgagatttttct

SEQ ID NO: 334081 - DNA, 16 bp, C. familiaris
tttctgagggtcagga

SEQ ID NO: 334082 - DNA, 16 bp, C. familiaris
tttctgagtgtatttt

SEQ ID NO: 334083 - DNA, 16 bp, C. familiaris
tttctgatgagatcag

SEQ ID NO: 334084 - DNA, 16 bp, C. familiaris
tttctgattccataca

SEQ ID NO: 334085 - DNA, 16 bp, C. familiaris
tttctgatttatataa

SEQ ID NO: 334086 - DNA, 16 bp, C. familiaris
tttctgatttttcaaa

SEQ ID NO: 334087 - DNA, 16 bp, C. familiaris
tttctgatttttctcc

SEQ ID NO: 334088 - DNA, 16 bp, C. familiaris
tttctgcacagtgaag

SEQ ID NO: 334089 - DNA, 16 bp, C. familiaris
tttctgcattttccaa

SEQ ID NO: 334090 - DNA, 16 bp, C. familiaris
tttctgccctgattgg

SEQ ID NO: 334091 - DNA, 16 bp, C. familiaris
tttctgctaactttgg

SEQ ID NO: 334092 - DNA, 16 bp, C. familiaris
tttctggaaaaacaca

SEQ ID NO: 334093 - DNA, 16 bp, C. familiaris
tttctggaaatgaaaa

SEQ ID NO: 334094 - DNA, 16 bp, C. familiaris
tttctgggatgatgga

SEQ ID NO: 334095 - DNA, 16 bp, C. familiaris
tttctgggcagccccg

SEQ ID NO: 334096 - DNA, 16 bp, C. familiaris
tttctggggtacctgg

SEQ ID NO: 334097 - DNA, 16 bp, C. familiaris
tttctgtatctggctt

SEQ ID NO: 334098 - DNA, 16 bp, C. familiaris
tttctgtcatttttaa

SEQ ID NO: 334099 - DNA, 16 bp, C. familiaris
tttctgtccattttta

SEQ ID NO: 334100 - DNA, 16 bp, C. familiaris
tttctgtgaaagaggc

SEQ ID NO: 334101 - DNA, 16 bp, C. familiaris
tttctgtgcctcagtt

SEQ ID NO: 334102 - DNA, 16 bp, C. familiaris
tttctgtggaatcaga

SEQ ID NO: 334103 - DNA, 16 bp, C. familiaris
tttctgtggtgtaaat

SEQ ID NO: 334104 - DNA, 16 bp, C. familiaris
tttctgtgtatatata

SEQ ID NO: 334105 - DNA, 16 bp, C. familiaris
tttctgtgtttataaa

SEQ ID NO: 334106 - DNA, 16 bp, C. familiaris
tttctgttcatctctt

SEQ ID NO: 334107 - DNA, 16 bp, C. familiaris
tttctgttgtttacaa

SEQ ID NO: 334108 - DNA, 16 bp, C. familiaris
tttctgtttcagaaaa

SEQ ID NO: 334109 - DNA, 16 bp, C. familiaris
tttctgtttccatttg

SEQ ID NO: 334110 - DNA, 16 bp, C. familiaris
tttctgtttcttctca

SEQ ID NO: 334111 - DNA, 16 bp, C. familiaris
tttctgttttctgaaa

SEQ ID NO: 334112 - DNA, 16 bp, C. familiaris
tttcttaaaaagataa

SEQ ID NO: 334113 - DNA, 16 bp, C. familiaris
tttcttaaaaatagaa

SEQ ID NO: 334114 - DNA, 16 bp, C. familiaris
tttcttaaaagacttt

SEQ ID NO: 334115 - DNA, 16 bp, C. familiaris
tttcttaaaatgttta

SEQ ID NO: 334116 - DNA, 16 bp, C. familiaris
tttcttaaagaagaaa

SEQ ID NO: 334117 - DNA, 16 bp, C. familiaris
tttcttaaagttaaaa

SEQ ID NO: 334118 - DNA, 16 bp, C. familiaris
tttcttaaatgaaaaa

SEQ ID NO: 334119 - DNA, 16 bp, C. familiaris
tttcttaaatgtgaaa

SEQ ID NO: 334120 - DNA, 16 bp, C. familiaris
tttcttaaattcctca

SEQ ID NO: 334121 - DNA, 16 bp, C. familiaris
tttcttaatgatttta

SEQ ID NO: 334122 - DNA, 16 bp, C. familiaris
tttcttacaacataca

SEQ ID NO: 334123 - DNA, 16 bp, C. familiaris
tttcttatcagaaacc

SEQ ID NO: 334124 - DNA, 16 bp, C. familiaris
tttcttatgccataca

SEQ ID NO: 334125 - DNA, 16 bp, C. familiaris
tttcttattgttgaat

SEQ ID NO: 334126 - DNA, 16 bp, C. familiaris
tttcttcaaaaatctt

SEQ ID NO: 334127 - DNA, 16 bp, C. familiaris
tttcttcaaaagattt

SEQ ID NO: 334128 - DNA, 16 bp, C. familiaris
tttcttcaaagaagat

SEQ ID NO: 334129 - DNA, 16 bp, C. familiaris
tttcttcaaagaatat

SEQ ID NO: 334130 - DNA, 16 bp, C. familiaris
tttcttcaaagaattt

SEQ ID NO: 334131 - DNA, 16 bp, C. familiaris
tttcttcaacgtggat

SEQ ID NO: 334132 - DNA, 16 bp, C. familiaris
tttcttcaagaagttt

SEQ ID NO: 334133 - DNA, 16 bp, C. familiaris
tttcttcagcctcatt

SEQ ID NO: 334134 - DNA, 16 bp, C. familiaris
tttcttcagcttcctt

SEQ ID NO: 334135 - DNA, 16 bp, C. familiaris
tttcttcagtctcctt

SEQ ID NO: 334136 - DNA, 16 bp, C. familiaris
tttcttcattaaaaaa

SEQ ID NO: 334137 - DNA, 16 bp, C. familiaris
tttcttcattgaattt

SEQ ID NO: 334138 - DNA, 16 bp, C. familiaris
tttcttccaagagttt

SEQ ID NO: 334139 - DNA, 16 bp, C. familiaris
tttcttccagattgct

SEQ ID NO: 334140 - DNA, 16 bp, C. familiaris
tttcttccagctttat

SEQ ID NO: 334141 - DNA, 16 bp, C. familiaris
tttcttcctccaaaat

SEQ ID NO: 334142 - DNA, 16 bp, C. familiaris
tttcttcctcttctga

SEQ ID NO: 334143 - DNA, 16 bp, C. familiaris
tttcttcctgtttcca

SEQ ID NO: 334144 - DNA, 16 bp, C. familiaris
tttcttcctttggaaa

SEQ ID NO: 334145 - DNA, 16 bp, C. familiaris
tttcttccttttctag

SEQ ID NO: 334146 - DNA, 16 bp, C. familiaris
tttcttctaaaataaa

SEQ ID NO: 334147 - DNA, 16 bp, C. familiaris
tttcttctcaggtcat

SEQ ID NO: 334148 - DNA, 16 bp, C. familiaris
tttcttctctttctga

SEQ ID NO: 334149 - DNA, 16 bp, C. familiaris
tttcttctgaaagttt

SEQ ID NO: 334150 - DNA, 16 bp, C. familiaris
tttcttcttcagaaaa

SEQ ID NO: 334151 - DNA, 16 bp, C. familiaris
tttcttcttgaaattt

SEQ ID NO: 334152 - DNA, 16 bp, C. familiaris
tttcttcttgttccag

SEQ ID NO: 334153 - DNA, 16 bp, C. familiaris
tttcttctttaaaggt

SEQ ID NO: 334154 - DNA, 16 bp, C. familiaris
tttcttctttctcaag

SEQ ID NO: 334155 - DNA, 16 bp, C. familiaris
tttcttctttgatcta

SEQ ID NO: 334156 - DNA, 16 bp, C. familiaris
tttcttcttttcagaa

SEQ ID NO: 334157 - DNA, 16 bp, C. familiaris
tttcttcttttcagct

SEQ ID NO: 334158 - DNA, 16 bp, C. familiaris
tttcttgaaaaaaaaa

SEQ ID NO: 334159 - DNA, 16 bp, C. familiaris
tttcttgaaaatattt

SEQ ID NO: 334160 - DNA, 16 bp, C. familiaris
tttcttgaaaatttta

SEQ ID NO: 334161 - DNA, 16 bp, C. familiaris
tttcttgaaaattttt

SEQ ID NO: 334162 - DNA, 16 bp, C. familiaris
tttcttgaagaaaaaa

SEQ ID NO: 334163 - DNA, 16 bp, C. familiaris
tttcttgattggattt

SEQ ID NO: 334164 - DNA, 16 bp, C. familiaris
tttcttgcctaatttc

SEQ ID NO: 334165 - DNA, 16 bp, C. familiaris
tttcttgctattgagt

SEQ ID NO: 334166 - DNA, 16 bp, C. familiaris
tttcttgctgatatga

SEQ ID NO: 334167 - DNA, 16 bp, C. familiaris
tttcttggaaaaatgt

SEQ ID NO: 334168 - DNA, 16 bp, C. familiaris
tttcttggattcacaa

SEQ ID NO: 334169 - DNA, 16 bp, C. familiaris
tttcttgtggttttga

SEQ ID NO: 334170 - DNA, 16 bp, C. familiaris
tttctttaaagaatta

SEQ ID NO: 334171 - DNA, 16 bp, C. familiaris
tttctttaagaataaa

SEQ ID NO: 334172 - DNA, 16 bp, C. familiaris
tttctttaaggaaaaa

SEQ ID NO: 334173 - DNA, 16 bp, C. familiaris
tttctttaatagattt

SEQ ID NO: 334174 - DNA, 16 bp, C. familiaris
tttctttaatcagttt

SEQ ID NO: 334175 - DNA, 16 bp, C. familiaris
tttctttataaaaatg

SEQ ID NO: 334176 - DNA, 16 bp, C. familiaris
tttctttattagagag

SEQ ID NO: 334177 - DNA, 16 bp, C. familiaris
tttctttatttcagag

SEQ ID NO: 334178 - DNA, 16 bp, C. familiaris
tttctttcaaagaaaa

SEQ ID NO: 334179 - DNA, 16 bp, C. familiaris
tttctttcagcatttt

SEQ ID NO: 334180 - DNA, 16 bp, C. familiaris
tttctttcagcctttt

SEQ ID NO: 334181 - DNA, 16 bp, C. familiaris
tttctttcctccagaa

SEQ ID NO: 334182 - DNA, 16 bp, C. familiaris
tttctttctaaaaaga

SEQ ID NO: 334183 - DNA, 16 bp, C. familiaris
tttctttgaaaaattt

SEQ ID NO: 334184 - DNA, 16 bp, C. familiaris
tttctttgaaatgtaa

SEQ ID NO: 334185 - DNA, 16 bp, C. familiaris
tttctttgagaaaaat

SEQ ID NO: 334186 - DNA, 16 bp, C. familiaris
tttctttgagcctcag

SEQ ID NO: 334187 - DNA, 16 bp, C. familiaris
tttctttgagttctgt

SEQ ID NO: 334188 - DNA, 16 bp, C. familiaris
tttctttgcttttaaa

SEQ ID NO: 334189 - DNA, 16 bp, C. familiaris
tttctttggaaaaatg

SEQ ID NO: 334190 - DNA, 16 bp, C. familiaris
tttctttggggaaatg

SEQ ID NO: 334191 - DNA, 16 bp, C. familiaris
tttctttgggggatga

SEQ ID NO: 334192 - DNA, 16 bp, C. familiaris
tttctttgttggaaga

SEQ ID NO: 334193 - DNA, 16 bp, C. familiaris
tttctttgttttaaaa

SEQ ID NO: 334194 - DNA, 16 bp, C. familiaris
tttcttttaaatatgt

SEQ ID NO: 334195 - DNA, 16 bp, C. familiaris
tttcttttaagaaaaa

SEQ ID NO: 334196 - DNA, 16 bp, C. familiaris
tttcttttaagaattt

SEQ ID NO: 334197 - DNA, 16 bp, C. familiaris
tttcttttagaaatgt

SEQ ID NO: 334198 - DNA, 16 bp, C. familiaris
tttcttttcaaatgta

SEQ ID NO: 334199 - DNA, 16 bp, C. familiaris
tttcttttcctaaaaa

SEQ ID NO: 334200 - DNA, 16 bp, C. familiaris
tttcttttcctgaaat

SEQ ID NO: 334201 - DNA, 16 bp, C. familiaris
tttcttttctaaatgt

SEQ ID NO: 334202 - DNA, 16 bp, C. familiaris
tttcttttctgtaaat

SEQ ID NO: 334203 - DNA, 16 bp, C. familiaris
tttcttttcttaagat

SEQ ID NO: 334204 - DNA, 16 bp, C. familiaris
tttcttttcttgagaa

SEQ ID NO: 334205 - DNA, 16 bp, C. familiaris
tttcttttgtatgtaa

SEQ ID NO: 334206 - DNA, 16 bp, C. familiaris
tttcttttgttataaa

SEQ ID NO: 334207 - DNA, 16 bp, C. familiaris
tttctttttcctgaac

SEQ ID NO: 334208 - DNA, 16 bp, C. familiaris
tttctttttgaaaaat

SEQ ID NO: 334209 - DNA, 16 bp, C. familiaris
tttctttttgaaaatg

SEQ ID NO: 334210 - DNA, 16 bp, C. familiaris
tttctttttgcttcca

SEQ ID NO: 334211 - DNA, 16 bp, C. familiaris
tttctttttggaaaaa

SEQ ID NO: 334212 - DNA, 16 bp, C. familiaris
tttcttttttctgcaa

SEQ ID NO: 334213 - DNA, 16 bp, C. familiaris
tttgaaaaaaatgttt

SEQ ID NO: 334214 - DNA, 16 bp, C. familiaris
tttgaaaaaagaaaac

SEQ ID NO: 334215 - DNA, 16 bp, C. familiaris
tttgaaaaaatgtttt

SEQ ID NO: 334216 - DNA, 16 bp, C. familiaris
tttgaaaaacaaatta

SEQ ID NO: 334217 - DNA, 16 bp, C. familiaris
tttgaaaaacaagaat

SEQ ID NO: 334218 - DNA, 16 bp, C. familiaris
tttgaaaaacagtttg

SEQ ID NO: 334219 - DNA, 16 bp, C. familiaris
tttgaaaaagaaatga

SEQ ID NO: 334220 - DNA, 16 bp, C. familiaris
tttgaaaaagaacaat

SEQ ID NO: 334221 - DNA, 16 bp, C. familiaris
tttgaaaaagaagaac

SEQ ID NO: 334222 - DNA, 16 bp, C. familiaris
tttgaaaaagatattt

SEQ ID NO: 334223 - DNA, 16 bp, C. familiaris
tttgaaaaaggagaaa

SEQ ID NO: 334224 - DNA, 16 bp, C. familiaris
tttgaaaaataaggat

SEQ ID NO: 334225 - DNA, 16 bp, C. familiaris
tttgaaaaataatctg

SEQ ID NO: 334226 - DNA, 16 bp, C. familiaris
tttgaaaaatacaaat

SEQ ID NO: 334227 - DNA, 16 bp, C. familiaris
tttgaaaaatatttca

SEQ ID NO: 334228 - DNA, 16 bp, C. familiaris
tttgaaaaatgtagaa

SEQ ID NO: 334229 - DNA, 16 bp, C. familiaris
tttgaaaaattagaat

SEQ ID NO: 334230 - DNA, 16 bp, C. familiaris
tttgaaaacaaaaatt

SEQ ID NO: 334231 - DNA, 16 bp, C. familiaris
tttgaaaagaagaaag

SEQ ID NO: 334232 - DNA, 16 bp, C. familiaris
tttgaaaagaatatgt

SEQ ID NO: 334233 - DNA, 16 bp, C. familiaris
tttgaaaagacatttc

SEQ ID NO: 334234 - DNA, 16 bp, C. familiaris
tttgaaaagataagca

SEQ ID NO: 334235 - DNA, 16 bp, C. familiaris
tttgaaaagatcaaca

SEQ ID NO: 334236 - DNA, 16 bp, C. familiaris
tttgaaaagcacctgg

SEQ ID NO: 334237 - DNA, 16 bp, C. familiaris
tttgaaaaggaaacaa

SEQ ID NO: 334238 - DNA, 16 bp, C. familiaris
tttgaaaaggaagaag

SEQ ID NO: 334239 - DNA, 16 bp, C. familiaris
tttgaaaatataatca

SEQ ID NO: 334240 - DNA, 16 bp, C. familiaris
tttgaaaatatataca

SEQ ID NO: 334241 - DNA, 16 bp, C. familiaris
tttgaaaatgagaaaa

SEQ ID NO: 334242 - DNA, 16 bp, C. familiaris
tttgaaaatgatatgc

SEQ ID NO: 334243 - DNA, 16 bp, C. familiaris
tttgaaaatgctttct

SEQ ID NO: 334244 - DNA, 16 bp, C. familiaris
tttgaaaatggagaaa

SEQ ID NO: 334245 - DNA, 16 bp, C. familiaris
tttgaaaatgtttctt

SEQ ID NO: 334246 - DNA, 16 bp, C. familiaris
tttgaaaattttttca

SEQ ID NO: 334247 - DNA, 16 bp, C. familiaris
tttgaaacagtttcag

SEQ ID NO: 334248 - DNA, 16 bp, C. familiaris
tttgaaactaataata

SEQ ID NO: 334249 - DNA, 16 bp, C. familiaris
tttgaaagaaagagag

SEQ ID NO: 334250 - DNA, 16 bp, C. familiaris
tttgaaagaaccagct

SEQ ID NO: 334251 - DNA, 16 bp, C. familiaris
tttgaaagaatgaata

SEQ ID NO: 334252 - DNA, 16 bp, C. familiaris
tttgaaagacaaaaaa

SEQ ID NO: 334253 - DNA, 16 bp, C. familiaris
tttgaaagagaaagaa

SEQ ID NO: 334254 - DNA, 16 bp, C. familiaris
tttgaaagagagagac

SEQ ID NO: 334255 - DNA, 16 bp, C. familiaris
tttgaaagagagaggg

SEQ ID NO: 334256 - DNA, 16 bp, C. familiaris
tttgaaagatttcttt

SEQ ID NO: 334257 - DNA, 16 bp, C. familiaris
tttgaaaggatttcaa

SEQ ID NO: 334258 - DNA, 16 bp, C. familiaris
tttgaaagttcttttt

SEQ ID NO: 334259 - DNA, 16 bp, C. familiaris
tttgaaatacttttta

SEQ ID NO: 334260 - DNA, 16 bp, C. familiaris
tttgaaatatttgaaa

SEQ ID NO: 334261 - DNA, 16 bp, C. familiaris
tttgaaatgaaaagaa

SEQ ID NO: 334262 - DNA, 16 bp, C. familiaris
tttgaaatgttttctt

SEQ ID NO: 334263 - DNA, 16 bp, C. familiaris
tttgaaattaagaaat

SEQ ID NO: 334264 - DNA, 16 bp, C. familiaris
tttgaaattagaacta

SEQ ID NO: 334265 - DNA, 16 bp, C. familiaris
tttgaaattcttaata

SEQ ID NO: 334266 - DNA, 16 bp, C. familiaris
tttgaaatttctttat

SEQ ID NO: 334267 - DNA, 16 bp, C. familiaris
tttgaaatttgaaaat

SEQ ID NO: 334268 - DNA, 16 bp, C. familiaris
tttgaaattttctgta

SEQ ID NO: 334269 - DNA, 16 bp, C. familiaris
tttgaaatttttcttg

SEQ ID NO: 334270 - DNA, 16 bp, C. familiaris
tttgaacagcaaagga

SEQ ID NO: 334271 - DNA, 16 bp, C. familiaris
tttgaacattttcttt

SEQ ID NO: 334272 - DNA, 16 bp, C. familiaris
tttgaagaaaaatttt

SEQ ID NO: 334273 - DNA, 16 bp, C. familiaris
tttgaagaaatttaaa

SEQ ID NO: 334274 - DNA, 16 bp, C. familiaris
tttgaagaagaattaa

SEQ ID NO: 334275 - DNA, 16 bp, C. familiaris
tttgaagaagaggaaa

SEQ ID NO: 334276 - DNA, 16 bp, C. familiaris
tttgaagaatatattt

SEQ ID NO: 334277 - DNA, 16 bp, C. familiaris
tttgaagatgaaggaa

SEQ ID NO: 334278 - DNA, 16 bp, C. familiaris
tttgaagatgacatga

SEQ ID NO: 334279 - DNA, 16 bp, C. familiaris
tttgaagatgagaaaa

SEQ ID NO: 334280 - DNA, 16 bp, C. familiaris
tttgaagatggaagaa

SEQ ID NO: 334281 - DNA, 16 bp, C. familiaris
tttgaagatggaagag

SEQ ID NO: 334282 - DNA, 16 bp, C. familiaris
tttgaagatggagaaa

SEQ ID NO: 334283 - DNA, 16 bp, C. familiaris
tttgaagatttatttg

SEQ ID NO: 334284 - DNA, 16 bp, C. familiaris
tttgaaggaaataaaa

SEQ ID NO: 334285 - DNA, 16 bp, C. familiaris
tttgaaggaagaaaaa

SEQ ID NO: 334286 - DNA, 16 bp, C. familiaris
tttgaatcagaatcca

SEQ ID NO: 334287 - DNA, 16 bp, C. familiaris
tttgaatctcagtttt

SEQ ID NO: 334288 - DNA, 16 bp, C. familiaris
tttgaatttacttttg

SEQ ID NO: 334289 - DNA, 16 bp, C. familiaris
tttgaattttgatgaa

SEQ ID NO: 334290 - DNA, 16 bp, C. familiaris
tttgacaaaatgcaac

SEQ ID NO: 334291 - DNA, 16 bp, C. familiaris
tttgacaaagagaaag

SEQ ID NO: 334292 - DNA, 16 bp, C. familiaris
tttgacaaagatgcaa

SEQ ID NO: 334293 - DNA, 16 bp, C. familiaris
tttgacaaatgtaaaa

SEQ ID NO: 334294 - DNA, 16 bp, C. familiaris
tttgacagagagaagg

SEQ ID NO: 334295 - DNA, 16 bp, C. familiaris
tttgacagatgaaaaa

SEQ ID NO: 334296 - DNA, 16 bp, C. familiaris
tttgacttatttcact

SEQ ID NO: 334297 - DNA, 16 bp, C. familiaris
tttgacttttaaatat

SEQ ID NO: 334298 - DNA, 16 bp, C. familiaris
tttgagaaaaagaaag

SEQ ID NO: 334299 - DNA, 16 bp, C. familiaris
tttgagaaactgccag

SEQ ID NO: 334300 - DNA, 16 bp, C. familiaris
tttgagaaagaaaata

SEQ ID NO: 334301 - DNA, 16 bp, C. familiaris
tttgagaaagaaagtg

SEQ ID NO: 334302 - DNA, 16 bp, C. familiaris
tttgagaaagagaaat

SEQ ID NO: 334303 - DNA, 16 bp, C. familiaris
tttgagaaaggaaaaa

SEQ ID NO: 334304 - DNA, 16 bp, C. familiaris
tttgagaaggataggt

SEQ ID NO: 334305 - DNA, 16 bp, C. familiaris
tttgagaatttgagaa

SEQ ID NO: 334306 - DNA, 16 bp, C. familiaris
tttgagacacagagag

SEQ ID NO: 334307 - DNA, 16 bp, C. familiaris
tttgagacagagcatg

SEQ ID NO: 334308 - DNA, 16 bp, C. familiaris
tttgagacgcctgggt

SEQ ID NO: 334309 - DNA, 16 bp, C. familiaris
tttgagagaaagaggg

SEQ ID NO: 334310 - DNA, 16 bp, C. familiaris
tttgagagagatagca

SEQ ID NO: 334311 - DNA, 16 bp, C. familiaris
tttgagagagcaggag

SEQ ID NO: 334312 - DNA, 16 bp, C. familiaris
tttgagccaaaatcaa

SEQ ID NO: 334313 - DNA, 16 bp, C. familiaris
tttgagctctttccag

SEQ ID NO: 334314 - DNA, 16 bp, C. familiaris
tttgaggaaaaggaaa

SEQ ID NO: 334315 - DNA, 16 bp, C. familiaris
tttgaggaccctccac

SEQ ID NO: 334316 - DNA, 16 bp, C. familiaris
tttgaggctgtcattt

SEQ ID NO: 334317 - DNA, 16 bp, C. familiaris
tttgagtaaagcagat

SEQ ID NO: 334318 - DNA, 16 bp, C. familiaris
tttgagtcttccctct

SEQ ID NO: 334319 - DNA, 16 bp, C. familiaris
tttgataagtccttta

SEQ ID NO: 334320 - DNA, 16 bp, C. familiaris
tttgatattaagaaat

SEQ ID NO: 334321 - DNA, 16 bp, C. familiaris
tttgatcaggaatgga

SEQ ID NO: 334322 - DNA, 16 bp, C. familiaris
tttgatgaaaatgaaa

SEQ ID NO: 334323 - DNA, 16 bp, C. familiaris
tttgatgaagtccaaa

SEQ ID NO: 334324 - DNA, 16 bp, C. familiaris
tttgatgaagtctaat

SEQ ID NO: 334325 - DNA, 16 bp, C. familiaris
tttgatgaattcttta

SEQ ID NO: 334326 - DNA, 16 bp, C. familiaris
tttgatgagaaaaaaa

SEQ ID NO: 334327 - DNA, 16 bp, C. familiaris
tttgatgctattatga

SEQ ID NO: 334328 - DNA, 16 bp, C. familiaris
tttgatggaaaaaaaa

SEQ ID NO: 334329 - DNA, 16 bp, C. familiaris
tttgatggaatcattt

SEQ ID NO: 334330 - DNA, 16 bp, C. familiaris
tttgatggggtcattt

SEQ ID NO: 334331 - DNA, 16 bp, C. familiaris
tttgatttaaaatcta

SEQ ID NO: 334332 - DNA, 16 bp, C. familiaris
tttgatttgtgaatat

SEQ ID NO: 334333 - DNA, 16 bp, C. familiaris
tttgcaaaagaaaaga

SEQ ID NO: 334334 - DNA, 16 bp, C. familiaris
tttgcaaaccatatat

SEQ ID NO: 334335 - DNA, 16 bp, C. familiaris
tttgcaaagaaaaaaa

SEQ ID NO: 334336 - DNA, 16 bp, C. familiaris
tttgcaaagacatgga

SEQ ID NO: 334337 - DNA, 16 bp, C. familiaris
tttgcaaatagtgaca

SEQ ID NO: 334338 - DNA, 16 bp, C. familiaris
tttgcaaatcatttat

SEQ ID NO: 334339 - DNA, 16 bp, C. familiaris
tttgcaagaaactgcc

SEQ ID NO: 334340 - DNA, 16 bp, C. familiaris
tttgcaatataacttg

SEQ ID NO: 334341 - DNA, 16 bp, C. familiaris
tttgcaccaaagatgt

SEQ ID NO: 334342 - DNA, 16 bp, C. familiaris
tttgcagaaataaaaa

SEQ ID NO: 334343 - DNA, 16 bp, C. familiaris
tttgcagaagagaaaa

SEQ ID NO: 334344 - DNA, 16 bp, C. familiaris
tttgcagatcacatga

SEQ ID NO: 334345 - DNA, 16 bp, C. familiaris
tttgcagatgagaaga

SEQ ID NO: 334346 - DNA, 16 bp, C. familiaris
tttgcagatggggaaa

SEQ ID NO: 334347 - DNA, 16 bp, C. familiaris
tttgcagcagcaggac

SEQ ID NO: 334348 - DNA, 16 bp, C. familiaris
tttgcagggcccagtg

SEQ ID NO: 334349 - DNA, 16 bp, C. familiaris
tttgcatcggtgtcag

SEQ ID NO: 334350 - DNA, 16 bp, C. familiaris
tttgcatcttggttat

SEQ ID NO: 334351 - DNA, 16 bp, C. familiaris
tttgcatgtgaatatc

SEQ ID NO: 334352 - DNA, 16 bp, C. familiaris
tttgcatgtggctgcc

SEQ ID NO: 334353 - DNA, 16 bp, C. familiaris
tttgcattcacaactt

SEQ ID NO: 334354 - DNA, 16 bp, C. familiaris
tttgcatttaatttat

SEQ ID NO: 334355 - DNA, 16 bp, C. familiaris
tttgcatttcccttat

SEQ ID NO: 334356 - DNA, 16 bp, C. familiaris
tttgcatttccttttc

SEQ ID NO: 334357 - DNA, 16 bp, C. familiaris
tttgcattttggaaag

SEQ ID NO: 334358 - DNA, 16 bp, C. familiaris
tttgcatttttaaata

SEQ ID NO: 334359 - DNA, 16 bp, C. familiaris
tttgccaaattgaatg

SEQ ID NO: 334360 - DNA, 16 bp, C. familiaris
tttgccagtttctttt

SEQ ID NO: 334361 - DNA, 16 bp, C. familiaris
tttgccccatttgctt

SEQ ID NO: 334362 - DNA, 16 bp, C. familiaris
tttgccctcagcaaag

SEQ ID NO: 334363 - DNA, 16 bp, C. familiaris
tttgcctatttttcaa

SEQ ID NO: 334364 - DNA, 16 bp, C. familiaris
tttgcctttggttcag

SEQ ID NO: 334365 - DNA, 16 bp, C. familiaris
tttgccttttaaagaa

SEQ ID NO: 334366 - DNA, 16 bp, C. familiaris
tttgctcactgcagag

SEQ ID NO: 334367 - DNA, 16 bp, C. familiaris
tttgctcattttttaa

SEQ ID NO: 334368 - DNA, 16 bp, C. familiaris
tttgctcctcctcctg

SEQ ID NO: 334369 - DNA, 16 bp, C. familiaris
tttgctctgtgccagg

SEQ ID NO: 334370 - DNA, 16 bp, C. familiaris
tttgctgacaccttga

SEQ ID NO: 334371 - DNA, 16 bp, C. familiaris
tttgctgagagatttt

SEQ ID NO: 334372 - DNA, 16 bp, C. familiaris
tttgctgagcagaagc

SEQ ID NO: 334373 - DNA, 16 bp, C. familiaris
tttgctgagtgaaaga

SEQ ID NO: 334374 - DNA, 16 bp, C. familiaris
tttgctgatattttgt

SEQ ID NO: 334375 - DNA, 16 bp, C. familiaris
tttgctgatgggaatg

SEQ ID NO: 334376 - DNA, 16 bp, C. familiaris
tttgctgattctttct

SEQ ID NO: 334377 - DNA, 16 bp, C. familiaris
tttgctggggctgcca

SEQ ID NO: 334378 - DNA, 16 bp, C. familiaris
tttgctggggctgctg

SEQ ID NO: 334379 - DNA, 16 bp, C. familiaris
tttgctgtgaagaagc

SEQ ID NO: 334380 - DNA, 16 bp, C. familiaris
tttgcttatccattca

SEQ ID NO: 334381 - DNA, 16 bp, C. familiaris
tttgcttatgtctctg

SEQ ID NO: 334382 - DNA, 16 bp, C. familiaris
tttgcttcgatgtgga

SEQ ID NO: 334383 - DNA, 16 bp, C. familiaris
tttgcttgggctgcca

SEQ ID NO: 334384 - DNA, 16 bp, C. familiaris
tttgcttgtctggaaa

SEQ ID NO: 334385 - DNA, 16 bp, C. familiaris
tttgcttttattaaaa

SEQ ID NO: 334386 - DNA, 16 bp, C. familiaris
tttgcttttctcactt

SEQ ID NO: 334387 - DNA, 16 bp, C. familiaris
tttgcttttctggaaa

SEQ ID NO: 334388 - DNA, 16 bp, C. familiaris
tttgcttttgaaaata

SEQ ID NO: 334389 - DNA, 16 bp, C. familiaris
tttgctttttaaaaaa

SEQ ID NO: 334390 - DNA, 16 bp, C. familiaris
tttgctttttaaaaat

SEQ ID NO: 334391 - DNA, 16 bp, C. familiaris
tttgctttttaaatca

SEQ ID NO: 334392 - DNA, 16 bp, C. familiaris
tttggaaaaaagaaag

SEQ ID NO: 334393 - DNA, 16 bp, C. familiaris
tttggaaaaagaaaga

SEQ ID NO: 334394 - DNA, 16 bp, C. familiaris
tttggaaaaatgaaaa

SEQ ID NO: 334395 - DNA, 16 bp, C. familiaris
tttggaaaaatggaaa

SEQ ID NO: 334396 - DNA, 16 bp, C. familiaris
tttggaaaactataaa

SEQ ID NO: 334397 - DNA, 16 bp, C. familiaris
tttggaaaagatagaa

SEQ ID NO: 334398 - DNA, 16 bp, C. familiaris
tttggaaaagtttgaa

SEQ ID NO: 334399 - DNA, 16 bp, C. familiaris
tttggaaaataaaaag

SEQ ID NO: 334400 - DNA, 16 bp, C. familiaris
tttggaaaataaacat

SEQ ID NO: 334401 - DNA, 16 bp, C. familiaris
tttggaaaataaagtt

SEQ ID NO: 334402 - DNA, 16 bp, C. familiaris
tttggaaaataatctg

SEQ ID NO: 334403 - DNA, 16 bp, C. familiaris
tttggaaaataatttc

SEQ ID NO: 334404 - DNA, 16 bp, C. familiaris
tttggaaaatatagtt

SEQ ID NO: 334405 - DNA, 16 bp, C. familiaris
tttggaaaatgaattt

SEQ ID NO: 334406 - DNA, 16 bp, C. familiaris
tttggaaaattcttgg

SEQ ID NO: 334407 - DNA, 16 bp, C. familiaris
tttggaaaatttcaaa

SEQ ID NO: 334408 - DNA, 16 bp, C. familiaris
tttggaaaattttaaa

SEQ ID NO: 334409 - DNA, 16 bp, C. familiaris
tttggaaagaaaacaa

SEQ ID NO: 334410 - DNA, 16 bp, C. familiaris
tttggaaagataaaaa

SEQ ID NO: 334411 - DNA, 16 bp, C. familiaris
tttggaaataatttat

SEQ ID NO: 334412 - DNA, 16 bp, C. familiaris
tttggaaatgttttca

SEQ ID NO: 334413 - DNA, 16 bp, C. familiaris
tttggaaattaaaata

SEQ ID NO: 334414 - DNA, 16 bp, C. familiaris
tttggaagaaaatatt

SEQ ID NO: 334415 - DNA, 16 bp, C. familiaris
tttggaagaaattttt

SEQ ID NO: 334416 - DNA, 16 bp, C. familiaris
tttggaagaagaaaaa

SEQ ID NO: 334417 - DNA, 16 bp, C. familiaris
tttggaagacagcttg

SEQ ID NO: 334418 - DNA, 16 bp, C. familiaris
tttggaagagaaaaat

SEQ ID NO: 334419 - DNA, 16 bp, C. familiaris
tttggaagagagagag

SEQ ID NO: 334420 - DNA, 16 bp, C. familiaris
tttggaagagtttaag

SEQ ID NO: 334421 - DNA, 16 bp, C. familiaris
tttggaagcaaggttt

SEQ ID NO: 334422 - DNA, 16 bp, C. familiaris
tttggaagttttaaaa

SEQ ID NO: 334423 - DNA, 16 bp, C. familiaris
tttggaatcagaaaga

SEQ ID NO: 334424 - DNA, 16 bp, C. familiaris
tttggaattaaggtaa

SEQ ID NO: 334425 - DNA, 16 bp, C. familiaris
tttggaatttgtaagt

SEQ ID NO: 334426 - DNA, 16 bp, C. familiaris
tttggacaagttattt

SEQ ID NO: 334427 - DNA, 16 bp, C. familiaris
tttggagaaaaagaaa

SEQ ID NO: 334428 - DNA, 16 bp, C. familiaris
tttggagaaagaaaaa

SEQ ID NO: 334429 - DNA, 16 bp, C. familiaris
tttggagaaataccta

SEQ ID NO: 334430 - DNA, 16 bp, C. familiaris
tttggagaaatataaa

SEQ ID NO: 334431 - DNA, 16 bp, C. familiaris
tttggagaggatgtgg

SEQ ID NO: 334432 - DNA, 16 bp, C. familiaris
tttggagatgaggaaa

SEQ ID NO: 334433 - DNA, 16 bp, C. familiaris
tttggagatggagcct

SEQ ID NO: 334434 - DNA, 16 bp, C. familiaris
tttggaggaaaaaata

SEQ ID NO: 334435 - DNA, 16 bp, C. familiaris
tttggagggggaaaaa

SEQ ID NO: 334436 - DNA, 16 bp, C. familiaris
tttggatatatcattt

SEQ ID NO: 334437 - DNA, 16 bp, C. familiaris
tttggatattttggat

SEQ ID NO: 334438 - DNA, 16 bp, C. familiaris
tttggatcactatgtt

SEQ ID NO: 334439 - DNA, 16 bp, C. familiaris
tttggatcagggcatg

SEQ ID NO: 334440 - DNA, 16 bp, C. familiaris
tttggatcagggcgtg

SEQ ID NO: 334441 - DNA, 16 bp, C. familiaris
tttggatgctttttat

SEQ ID NO: 334442 - DNA, 16 bp, C. familiaris
tttggatttttttccc

SEQ ID NO: 334443 - DNA, 16 bp, C. familiaris
tttggcagtttctttt

SEQ ID NO: 334444 - DNA, 16 bp, C. familiaris
tttggcatgaacatta

SEQ ID NO: 334445 - DNA, 16 bp, C. familiaris
tttggccaatgaaatg

SEQ ID NO: 334446 - DNA, 16 bp, C. familiaris
tttggccattaaaaaa

SEQ ID NO: 334447 - DNA, 16 bp, C. familiaris
tttggccatttgtata

SEQ ID NO: 334448 - DNA, 16 bp, C. familiaris
tttggcccagggcacc

SEQ ID NO: 334449 - DNA, 16 bp, C. familiaris
tttggcccaggtcatg

SEQ ID NO: 334450 - DNA, 16 bp, C. familiaris
tttggctactgtggat

SEQ ID NO: 334451 - DNA, 16 bp, C. familiaris
tttggctattatggac

SEQ ID NO: 334452 - DNA, 16 bp, C. familiaris
tttggctcaggtttga

SEQ ID NO: 334453 - DNA, 16 bp, C. familiaris
tttggcttaaggcatg

SEQ ID NO: 334454 - DNA, 16 bp, C. familiaris
tttggcttatgtcatg

SEQ ID NO: 334455 - DNA, 16 bp, C. familiaris
tttggcttttaaaaat

SEQ ID NO: 334456 - DNA, 16 bp, C. familiaris
tttgggaaaacaaaaa

SEQ ID NO: 334457 - DNA, 16 bp, C. familiaris
tttgggaaagttattt

SEQ ID NO: 334458 - DNA, 16 bp, C. familiaris
tttgggaaattctcag

SEQ ID NO: 334459 - DNA, 16 bp, C. familiaris
tttgggaagcagcaaa

SEQ ID NO: 334460 - DNA, 16 bp, C. familiaris
tttgggaagtttttag

SEQ ID NO: 334461 - DNA, 16 bp, C. familiaris
tttgggagctttgtac

SEQ ID NO: 334462 - DNA, 16 bp, C. familiaris
tttgggaggtgatcag

SEQ ID NO: 334463 - DNA, 16 bp, C. familiaris
tttgggatgcagccaa

SEQ ID NO: 334464 - DNA, 16 bp, C. familiaris
tttgggcacctgggtg

SEQ ID NO: 334465 - DNA, 16 bp, C. familiaris
tttgggctccctcttt

SEQ ID NO: 334466 - DNA, 16 bp, C. familiaris
tttggggaagagtttt

SEQ ID NO: 334467 - DNA, 16 bp, C. familiaris
tttggggacccctggg

SEQ ID NO: 334468 - DNA, 16 bp, C. familiaris
tttggggagggaaata

SEQ ID NO: 334469 - DNA, 16 bp, C. familiaris
tttggggatgatgaaa

SEQ ID NO: 334470 - DNA, 16 bp, C. familiaris
tttggggcacctgggt

SEQ ID NO: 334471 - DNA, 16 bp, C. familiaris
tttggggcagccctgg

SEQ ID NO: 334472 - DNA, 16 bp, C. familiaris
tttgggggaaaaaaga

SEQ ID NO: 334473 - DNA, 16 bp, C. familiaris
tttgggggaaaatatt

SEQ ID NO: 334474 - DNA, 16 bp, C. familiaris
tttgggggagtcagaa

SEQ ID NO: 334475 - DNA, 16 bp, C. familiaris
tttgggggcagccctg

SEQ ID NO: 334476 - DNA, 16 bp, C. familiaris
tttgggggcatctggg

SEQ ID NO: 334477 - DNA, 16 bp, C. familiaris
tttggggtcacctggg

SEQ ID NO: 334478 - DNA, 16 bp, C. familiaris
tttgggtgataatgac

SEQ ID NO: 334479 - DNA, 16 bp, C. familiaris
tttgggttcatttctg

SEQ ID NO: 334480 - DNA, 16 bp, C. familiaris
tttggtatcatatcca

SEQ ID NO: 334481 - DNA, 16 bp, C. familiaris
tttggtcatttttgtg

SEQ ID NO: 334482 - DNA, 16 bp, C. familiaris
tttggtcccaggaccc

SEQ ID NO: 334483 - DNA, 16 bp, C. familiaris
tttggtgtcatagcta

SEQ ID NO: 334484 - DNA, 16 bp, C. familiaris
tttggtgttccttggc

SEQ ID NO: 334485 - DNA, 16 bp, C. familiaris
tttggttcagagtgtg

SEQ ID NO: 334486 - DNA, 16 bp, C. familiaris
tttgtaaaaagatttt

SEQ ID NO: 334487 - DNA, 16 bp, C. familiaris
tttgtaaaacaaaaca

SEQ ID NO: 334488 - DNA, 16 bp, C. familiaris
tttgtaaaatgtaaaa

SEQ ID NO: 334489 - DNA, 16 bp, C. familiaris
tttgtaaaggaaattt

SEQ ID NO: 334490 - DNA, 16 bp, C. familiaris
tttgtaaatattttct

SEQ ID NO: 334491 - DNA, 16 bp, C. familiaris
tttgtaactctgtggc

SEQ ID NO: 334492 - DNA, 16 bp, C. familiaris
tttgtaactttaaaaa

SEQ ID NO: 334493 - DNA, 16 bp, C. familiaris
tttgtacctttggggt

SEQ ID NO: 334494 - DNA, 16 bp, C. familiaris
tttgtagaaaatattt

SEQ ID NO: 334495 - DNA, 16 bp, C. familiaris
tttgtagaaatagaaa

SEQ ID NO: 334496 - DNA, 16 bp, C. familiaris
tttgtagatacttttt

SEQ ID NO: 334497 - DNA, 16 bp, C. familiaris
tttgtagatggcatga

SEQ ID NO: 334498 - DNA, 16 bp, C. familiaris
tttgtagttcttctct

SEQ ID NO: 334499 - DNA, 16 bp, C. familiaris
tttgtatccttccaca

SEQ ID NO: 334500 - DNA, 16 bp, C. familiaris
tttgtatttcagttct

SEQ ID NO: 334501 - DNA, 16 bp, C. familiaris
tttgtcaaatatgttt

SEQ ID NO: 334502 - DNA, 17 bp, C. familiaris
tttgtcatcctcactga

SEQ ID NO: 334503 - DNA, 16 bp, C. familiaris
tttgtcattgttgttg

SEQ ID NO: 334504 - DNA, 16 bp, C. familiaris
tttgtcatttttaatg

SEQ ID NO: 334505 - DNA, 16 bp, C. familiaris
tttgtccaaagaagac

SEQ ID NO: 334506 - DNA, 16 bp, C. familiaris
tttgtctattatgaat

SEQ ID NO: 334507 - DNA, 16 bp, C. familiaris
tttgtctccctctgtg

SEQ ID NO: 334508 - DNA, 16 bp, C. familiaris
tttgtgaaaatgaaaa

SEQ ID NO: 334509 - DNA, 16 bp, C. familiaris
tttgtgaaaatgaaat

SEQ ID NO: 334510 - DNA, 16 bp, C. familiaris
tttgtgaaagaaaaaa

SEQ ID NO: 334511 - DNA, 16 bp, C. familiaris
tttgtgaaatgtctgt

SEQ ID NO: 334512 - DNA, 16 bp, C. familiaris
tttgtgaacttggcca

SEQ ID NO: 334513 - DNA, 16 bp, C. familiaris
tttgtgaatgatgtaa

SEQ ID NO: 334514 - DNA, 16 bp, C. familiaris
tttgtgaccttggatt

SEQ ID NO: 334515 - DNA, 16 bp, C. familiaris
tttgtgagagaaagag

SEQ ID NO: 334516 - DNA, 16 bp, C. familiaris
tttgtgatctttccag

SEQ ID NO: 334517 - DNA, 16 bp, C. familiaris
tttgtgattaccatta

SEQ ID NO: 334518 - DNA, 16 bp, C. familiaris
tttgtgcatcaaagga

SEQ ID NO: 334519 - DNA, 16 bp, C. familiaris
tttgtgctcagtgggg

SEQ ID NO: 334520 - DNA, 16 bp, C. familiaris
tttgtggaagattttt

SEQ ID NO: 334521 - DNA, 16 bp, C. familiaris
tttgtggacattgctg

SEQ ID NO: 334522 - DNA, 16 bp, C. familiaris
tttgtggatattgaaa

SEQ ID NO: 334523 - DNA, 16 bp, C. familiaris
tttgtggttttctaga

SEQ ID NO: 334524 - DNA, 16 bp, C. familiaris
tttgtgtcatttttaa

SEQ ID NO: 334525 - DNA, 16 bp, C. familiaris
tttgtgtggaattaga

SEQ ID NO: 334526 - DNA, 16 bp, C. familiaris
tttgtgtgtgtatgca

SEQ ID NO: 334527 - DNA, 16 bp, C. familiaris
tttgtgttttagaaag

SEQ ID NO: 334528 - DNA, 16 bp, C. familiaris
tttgttacagcaacca

SEQ ID NO: 334529 - DNA, 16 bp, C. familiaris
tttgttcatccatcca

SEQ ID NO: 334530 - DNA, 16 bp, C. familiaris
tttgttcattcagcaa

SEQ ID NO: 334531 - DNA, 16 bp, C. familiaris
tttgttccagctctgt

SEQ ID NO: 334532 - DNA, 16 bp, C. familiaris
tttgttctctctgaag

SEQ ID NO: 334533 - DNA, 16 bp, C. familiaris
tttgttctctgattgc

SEQ ID NO: 334534 - DNA, 16 bp, C. familiaris
tttgttgaaaaaatga

SEQ ID NO: 334535 - DNA, 16 bp, C. familiaris
tttgttgaaaagaata

SEQ ID NO: 334536 - DNA, 16 bp, C. familiaris
tttgttgaagaaactg

SEQ ID NO: 334537 - DNA, 16 bp, C. familiaris
tttgttgaagaaactt

SEQ ID NO: 334538 - DNA, 16 bp, C. familiaris
tttgttgaagatcaat

SEQ ID NO: 334539 - DNA, 16 bp, C. familiaris
tttgttgatctgttca

SEQ ID NO: 334540 - DNA, 16 bp, C. familiaris
tttgttgatggtttca

SEQ ID NO: 334541 - DNA, 16 bp, C. familiaris
tttgttgctgctgctg

SEQ ID NO: 334542 - DNA, 16 bp, C. familiaris
tttgttgctgttattg

SEQ ID NO: 334543 - DNA, 16 bp, C. familiaris
tttgttggctgtttcc

SEQ ID NO: 334544 - DNA, 16 bp, C. familiaris
tttgttgggaaaaaaa

SEQ ID NO: 334545 - DNA, 16 bp, C. familiaris
tttgttgtctgtctcc

SEQ ID NO: 334546 - DNA, 16 bp, C. familiaris
tttgtttaaaaattct

SEQ ID NO: 334547 - DNA, 16 bp, C. familiaris
tttgtttaatgaatga

SEQ ID NO: 334548 - DNA, 16 bp, C. familiaris
tttgtttcccctgcct

SEQ ID NO: 334549 - DNA, 16 bp, C. familiaris
tttgtttcctggagtt

SEQ ID NO: 334550 - DNA, 16 bp, C. familiaris
tttgtttcctgtgatt

SEQ ID NO: 334551 - DNA, 16 bp, C. familiaris
tttgtttctttgcatg

SEQ ID NO: 334552 - DNA, 16 bp, C. familiaris
tttgtttggaatcaga

SEQ ID NO: 334553 - DNA, 16 bp, C. familiaris
tttgttttatggccca

SEQ ID NO: 334554 - DNA, 16 bp, C. familiaris
tttgttttattcctga

SEQ ID NO: 334555 - DNA, 16 bp, C. familiaris
tttgttttccttcata

SEQ ID NO: 334556 - DNA, 16 bp, C. familiaris
tttgttttcttctcaa

SEQ ID NO: 334557 - DNA, 16 bp, C. familiaris
tttgttttgcttccta

SEQ ID NO: 334558 - DNA, 16 bp, C. familiaris
tttgtttttaaaaaga

SEQ ID NO: 334559 - DNA, 16 bp, C. familiaris
tttgtttttaaagaaa

SEQ ID NO: 334560 - DNA, 16 bp, C. familiaris
tttgtttttcctaaaa

SEQ ID NO: 334561 - DNA, 16 bp, C. familiaris
tttgttttttaatcaa

SEQ ID NO: 334562 - DNA, 16 bp, C. familiaris
tttgttttttacaaat

SEQ ID NO: 334563 - DNA, 16 bp, C. familiaris
ttttaaaaaaaagtgt

SEQ ID NO: 334564 - DNA, 16 bp, C. familiaris
ttttaaaaaaagcaac

SEQ ID NO: 334565 - DNA, 16 bp, C. familiaris
ttttaaaaaaaggaga

SEQ ID NO: 334566 - DNA, 16 bp, C. familiaris
ttttaaaaaaagtctc

SEQ ID NO: 334567 - DNA, 16 bp, C. familiaris
ttttaaaaaaattcca

SEQ ID NO: 334568 - DNA, 16 bp, C. familiaris
ttttaaaaaaattggg

SEQ ID NO: 334569 - DNA, 16 bp, C. familiaris
ttttaaaaaacagctt

SEQ ID NO: 334570 - DNA, 16 bp, C. familiaris
ttttaaaaaacccttt

SEQ ID NO: 334571 - DNA, 16 bp, C. familiaris
ttttaaaaaactatca

SEQ ID NO: 334572 - DNA, 16 bp, C. familiaris
ttttaaaaaagaaact

SEQ ID NO: 334573 - DNA, 16 bp, C. familiaris
ttttaaaaaagaaagc

SEQ ID NO: 334574 - DNA, 16 bp, C. familiaris
ttttaaaaaagaacaa

SEQ ID NO: 334575 - DNA, 16 bp, C. familiaris
ttttaaaaaagaagtg

SEQ ID NO: 334576 - DNA, 16 bp, C. familiaris
ttttaaaaaagacaac

SEQ ID NO: 334577 - DNA, 16 bp, C. familiaris
ttttaaaaaagacaag

SEQ ID NO: 334578 - DNA, 16 bp, C. familiaris
ttttaaaaaagacaat

SEQ ID NO: 334579 - DNA, 16 bp, C. familiaris
ttttaaaaaagatgga

SEQ ID NO: 334580 - DNA, 16 bp, C. familiaris
ttttaaaaaaggagtt

SEQ ID NO: 334581 - DNA, 16 bp, C. familiaris
ttttaaaaaagggaga

SEQ ID NO: 334582 - DNA, 16 bp, C. familiaris
ttttaaaaaatcacct

SEQ ID NO: 334583 - DNA, 16 bp, C. familiaris
ttttaaaaaatgacat

SEQ ID NO: 334584 - DNA, 16 bp, C. familiaris
ttttaaaaaatgctct

SEQ ID NO: 334585 - DNA, 16 bp, C. familiaris
ttttaaaaaatgtatc

SEQ ID NO: 334586 - DNA, 16 bp, C. familiaris
ttttaaaaacaagtaa

SEQ ID NO: 334587 - DNA, 16 bp, C. familiaris
ttttaaaaacaagttt

SEQ ID NO: 334588 - DNA, 16 bp, C. familiaris
ttttaaaaacacaaca

SEQ ID NO: 334589 - DNA, 16 bp, C. familiaris
ttttaaaaacagtttg

SEQ ID NO: 334590 - DNA, 16 bp, C. familiaris
ttttaaaaaccaaact

SEQ ID NO: 334591 - DNA, 16 bp, C. familiaris
ttttaaaaaccaagaa

SEQ ID NO: 334592 - DNA, 16 bp, C. familiaris
ttttaaaaacctacaa

SEQ ID NO: 334593 - DNA, 16 bp, C. familiaris
ttttaaaaactaactt

SEQ ID NO: 334594 - DNA, 16 bp, C. familiaris
ttttaaaaactacatt

SEQ ID NO: 334595 - DNA, 16 bp, C. familiaris
ttttaaaaactcttca

SEQ ID NO: 334596 - DNA, 16 bp, C. familiaris
ttttaaaaactgaatg

SEQ ID NO: 334597 - DNA, 16 bp, C. familiaris
ttttaaaaactggaat

SEQ ID NO: 334598 - DNA, 16 bp, C. familiaris
ttttaaaaactgtctt

SEQ ID NO: 334599 - DNA, 16 bp, C. familiaris
ttttaaaaacttttgt

SEQ ID NO: 334600 - DNA, 16 bp, C. familiaris
ttttaaaaagaaacaa

SEQ ID NO: 334601 - DNA, 16 bp, C. familiaris
ttttaaaaagaagcat

SEQ ID NO: 334602 - DNA, 16 bp, C. familiaris
ttttaaaaagaccaaa

SEQ ID NO: 334603 - DNA, 16 bp, C. familiaris
ttttaaaaagactaat

SEQ ID NO: 334604 - DNA, 16 bp, C. familiaris
ttttaaaaagacttta

SEQ ID NO: 334605 - DNA, 16 bp, C. familiaris
ttttaaaaagaggaat

SEQ ID NO: 334606 - DNA, 16 bp, C. familiaris
ttttaaaaagatcaca

SEQ ID NO: 334607 - DNA, 16 bp, C. familiaris
ttttaaaaagattcaa

SEQ ID NO: 334608 - DNA, 16 bp, C. familiaris
ttttaaaaagattgct

SEQ ID NO: 334609 - DNA, 16 bp, C. familiaris
ttttaaaaagcaagtt

SEQ ID NO: 334610 - DNA, 16 bp, C. familiaris
ttttaaaaagcaggtt

SEQ ID NO: 334611 - DNA, 16 bp, C. familiaris
ttttaaaaagcagttg

SEQ ID NO: 334612 - DNA, 16 bp, C. familiaris
ttttaaaaagctaatt

SEQ ID NO: 334613 - DNA, 16 bp, C. familiaris
ttttaaaaaggcaaaa

SEQ ID NO: 334614 - DNA, 16 bp, C. familiaris
ttttaaaaagtcaact

SEQ ID NO: 334615 - DNA, 16 bp, C. familiaris
ttttaaaaagtcttaa

SEQ ID NO: 334616 - DNA, 16 bp, C. familiaris
ttttaaaaagtgattt

SEQ ID NO: 334617 - DNA, 16 bp, C. familiaris
ttttaaaaagtgcctt

SEQ ID NO: 334618 - DNA, 16 bp, C. familiaris
ttttaaaaatcaaaag

SEQ ID NO: 334619 - DNA, 16 bp, C. familiaris
ttttaaaaatcaaatg

SEQ ID NO: 334620 - DNA, 16 bp, C. familiaris
ttttaaaaatcaagaa

SEQ ID NO: 334621 - DNA, 16 bp, C. familiaris
ttttaaaaatcagaac

SEQ ID NO: 334622 - DNA, 16 bp, C. familiaris
ttttaaaaatcatgta

SEQ ID NO: 334623 - DNA, 16 bp, C. familiaris
ttttaaaaatctgaca

SEQ ID NO: 334624 - DNA, 16 bp, C. familiaris
ttttaaaaatctgtga

SEQ ID NO: 334625 - DNA, 16 bp, C. familiaris
ttttaaaaatctgttg

SEQ ID NO: 334626 - DNA, 16 bp, C. familiaris
ttttaaaaatcttgat

SEQ ID NO: 334627 - DNA, 16 bp, C. familiaris
ttttaaaaatgaaact

SEQ ID NO: 334628 - DNA, 16 bp, C. familiaris
ttttaaaaatgaaggt

SEQ ID NO: 334629 - DNA, 16 bp, C. familiaris
ttttaaaaatgccaaa

SEQ ID NO: 334630 - DNA, 16 bp, C. familiaris
ttttaaaaatgcttat

SEQ ID NO: 334631 - DNA, 16 bp, C. familiaris
ttttaaaaatgtggat

SEQ ID NO: 334632 - DNA, 16 bp, C. familiaris
ttttaaaaattatcca

SEQ ID NO: 334633 - DNA, 16 bp, C. familiaris
ttttaaaaattatgtg

SEQ ID NO: 334634 - DNA, 16 bp, C. familiaris
ttttaaaaattcaaca

SEQ ID NO: 334635 - DNA, 16 bp, C. familiaris
ttttaaaaattcacag

SEQ ID NO: 334636 - DNA, 16 bp, C. familiaris
ttttaaaaattcccaa

SEQ ID NO: 334637 - DNA, 16 bp, C. familiaris
ttttaaaaattgactt

SEQ ID NO: 334638 - DNA, 16 bp, C. familiaris
ttttaaaaatttagca

SEQ ID NO: 334639 - DNA, 16 bp, C. familiaris
ttttaaaacaagacaa

SEQ ID NO: 334640 - DNA, 16 bp, C. familiaris
ttttaaaacacacaca

SEQ ID NO: 334641 - DNA, 16 bp, C. familiaris
ttttaaaactagaaaa

SEQ ID NO: 334642 - DNA, 16 bp, C. familiaris
ttttaaaactgcaaaa

SEQ ID NO: 334643 - DNA, 16 bp, C. familiaris
ttttaaaactgtattt

SEQ ID NO: 334644 - DNA, 16 bp, C. familiaris
ttttaaaactttctct

SEQ ID NO: 334645 - DNA, 16 bp, C. familiaris
ttttaaaactttgaaa

SEQ ID NO: 334646 - DNA, 16 bp, C. familiaris
ttttaaaagaaagtta

SEQ ID NO: 334647 - DNA, 16 bp, C. familiaris
ttttaaaagaaattcc

SEQ ID NO: 334648 - DNA, 16 bp, C. familiaris
ttttaaaagaaattct

SEQ ID NO: 334649 - DNA, 16 bp, C. familiaris
ttttaaaagaaccaaa

SEQ ID NO: 334650 - DNA, 16 bp, C. familiaris
ttttaaaagaagaaac

SEQ ID NO: 334651 - DNA, 16 bp, C. familiaris
ttttaaaagaagcatt

SEQ ID NO: 334652 - DNA, 16 bp, C. familiaris
ttttaaaagacaaaag

SEQ ID NO: 334653 - DNA, 16 bp, C. familiaris
ttttaaaagacataca

SEQ ID NO: 334654 - DNA, 16 bp, C. familiaris
ttttaaaagactttta

SEQ ID NO: 334655 - DNA, 16 bp, C. familiaris
ttttaaaagataaaca

SEQ ID NO: 334656 - DNA, 16 bp, C. familiaris
ttttaaaagatggtat

SEQ ID NO: 334657 - DNA, 16 bp, C. familiaris
ttttaaaagatgttca

SEQ ID NO: 334658 - DNA, 16 bp, C. familiaris
ttttaaaagcaaaaag

SEQ ID NO: 334659 - DNA, 16 bp, C. familiaris
ttttaaaagcagcaat

SEQ ID NO: 334660 - DNA, 16 bp, C. familiaris
ttttaaaagcattttg

SEQ ID NO: 334661 - DNA, 16 bp, C. familiaris
ttttaaaagctatttt

SEQ ID NO: 334662 - DNA, 16 bp, C. familiaris
ttttaaaagctcattt

SEQ ID NO: 334663 - DNA, 16 bp, C. familiaris
ttttaaaagctcttta

SEQ ID NO: 334664 - DNA, 16 bp, C. familiaris
ttttaaaagctgcttt

SEQ ID NO: 334665 - DNA, 16 bp, C. familiaris
ttttaaaaggaaaagg

SEQ ID NO: 334666 - DNA, 16 bp, C. familiaris
ttttaaaaggaattct

SEQ ID NO: 334667 - DNA, 16 bp, C. familiaris
ttttaaaaggagaatg

SEQ ID NO: 334668 - DNA, 16 bp, C. familiaris
ttttaaaaggcaaaaa

SEQ ID NO: 334669 - DNA, 16 bp, C. familiaris
ttttaaaagttaaatg

SEQ ID NO: 334670 - DNA, 16 bp, C. familiaris
ttttaaaagttgcttt

SEQ ID NO: 334671 - DNA, 16 bp, C. familiaris
ttttaaaatacaagta

SEQ ID NO: 334672 - DNA, 16 bp, C. familiaris
ttttaaaatatggatt

SEQ ID NO: 334673 - DNA, 16 bp, C. familiaris
ttttaaaatcaaagaa

SEQ ID NO: 334674 - DNA, 16 bp, C. familiaris
ttttaaaatcaaagat

SEQ ID NO: 334675 - DNA, 16 bp, C. familiaris
ttttaaaatcatgttt

SEQ ID NO: 334676 - DNA, 16 bp, C. familiaris
ttttaaaatccagatt

SEQ ID NO: 334677 - DNA, 16 bp, C. familiaris
ttttaaaatctctctt

SEQ ID NO: 334678 - DNA, 16 bp, C. familiaris
ttttaaaatctgagtt

SEQ ID NO: 334679 - DNA, 16 bp, C. familiaris
ttttaaaatctgtaat

SEQ ID NO: 334680 - DNA, 16 bp, C. familiaris
ttttaaaatctgtttc

SEQ ID NO: 334681 - DNA, 16 bp, C. familiaris
ttttaaaatctgtttt

SEQ ID NO: 334682 - DNA, 16 bp, C. familiaris
ttttaaaatgaaaatg

SEQ ID NO: 334683 - DNA, 16 bp, C. familiaris
ttttaaaatgcagatt

SEQ ID NO: 334684 - DNA, 16 bp, C. familiaris
ttttaaaatgcatttt

SEQ ID NO: 334685 - DNA, 16 bp, C. familiaris
ttttaaaatgctttgt

SEQ ID NO: 334686 - DNA, 16 bp, C. familiaris
ttttaaaatgggaaat

SEQ ID NO: 334687 - DNA, 16 bp, C. familiaris
ttttaaaatgtacata

SEQ ID NO: 334688 - DNA, 16 bp, C. familiaris
ttttaaaatgtattct

SEQ ID NO: 334689 - DNA, 16 bp, C. familiaris
ttttaaaattcttcct

SEQ ID NO: 334690 - DNA, 16 bp, C. familiaris
ttttaaacaaaaatgg

SEQ ID NO: 334691 - DNA, 16 bp, C. familiaris
ttttaaacagttaaaa

SEQ ID NO: 334692 - DNA, 16 bp, C. familiaris
ttttaaacttattttg

SEQ ID NO: 334693 - DNA, 16 bp, C. familiaris
ttttaaactttgattt

SEQ ID NO: 334694 - DNA, 16 bp, C. familiaris
ttttaaactttggttt

SEQ ID NO: 334695 - DNA, 16 bp, C. familiaris
ttttaaacttttcaaa

SEQ ID NO: 334696 - DNA, 16 bp, C. familiaris
ttttaaagaaaaaaca

SEQ ID NO: 334697 - DNA, 16 bp, C. familiaris
ttttaaagaaaagttc

SEQ ID NO: 334698 - DNA, 16 bp, C. familiaris
ttttaaagaaaatttg

SEQ ID NO: 334699 - DNA, 16 bp, C. familiaris
ttttaaagaaactaaa

SEQ ID NO: 334700 - DNA, 16 bp, C. familiaris
ttttaaagaaaggaaa

SEQ ID NO: 334701 - DNA, 16 bp, C. familiaris
ttttaaagaacttaaa

SEQ ID NO: 334702 - DNA, 16 bp, C. familiaris
ttttaaagaagtattt

SEQ ID NO: 334703 - DNA, 16 bp, C. familiaris
ttttaaagaatcattt

SEQ ID NO: 334704 - DNA, 16 bp, C. familiaris
ttttaaagaattcatt

SEQ ID NO: 334705 - DNA, 16 bp, C. familiaris
ttttaaagactgtatt

SEQ ID NO: 334706 - DNA, 16 bp, C. familiaris
ttttaaagagaagttt

SEQ ID NO: 334707 - DNA, 16 bp, C. familiaris
ttttaaagagggagag

SEQ ID NO: 334708 - DNA, 16 bp, C. familiaris
ttttaaagatgtgatt

SEQ ID NO: 334709 - DNA, 16 bp, C. familiaris
ttttaaagattcattc

SEQ ID NO: 334710 - DNA, 16 bp, C. familiaris
ttttaaagcaaaatat

SEQ ID NO: 334711 - DNA, 16 bp, C. familiaris
ttttaaagcacaaaat

SEQ ID NO: 334712 - DNA, 16 bp, C. familiaris
ttttaaagcatttttt

SEQ ID NO: 334713 - DNA, 16 bp, C. familiaris
ttttaaagccttttta

SEQ ID NO: 334714 - DNA, 16 bp, C. familiaris
ttttaaaggaaaaatt

SEQ ID NO: 334715 - DNA, 16 bp, C. familiaris
ttttaaaggaaaatat

SEQ ID NO: 334716 - DNA, 16 bp, C. familiaris
ttttaaagtaaattac

SEQ ID NO: 334717 - DNA, 16 bp, C. familiaris
ttttaaagtaaccttt

SEQ ID NO: 334718 - DNA, 16 bp, C. familiaris
ttttaaagtattcatt

SEQ ID NO: 334719 - DNA, 16 bp, C. familiaris
ttttaaagtctatttt

SEQ ID NO: 334720 - DNA, 16 bp, C. familiaris
ttttaaagttacattt

SEQ ID NO: 334721 - DNA, 16 bp, C. familiaris
ttttaaagttccttta

SEQ ID NO: 334722 - DNA, 16 bp, C. familiaris
ttttaaagttcttatt

SEQ ID NO: 334723 - DNA, 16 bp, C. familiaris
ttttaaataatctgta

SEQ ID NO: 334724 - DNA, 16 bp, C. familiaris
ttttaaatatacagtt

SEQ ID NO: 334725 - DNA, 16 bp, C. familiaris
ttttaaatattgcaaa

SEQ ID NO: 334726 - DNA, 16 bp, C. familiaris
ttttaaatctgctttg

SEQ ID NO: 334727 - DNA, 16 bp, C. familiaris
ttttaaatgaaaatga

SEQ ID NO: 334728 - DNA, 16 bp, C. familiaris
ttttaaatgaatacaa

SEQ ID NO: 334729 - DNA, 16 bp, C. familiaris
ttttaaatgaatactt

SEQ ID NO: 334730 - DNA, 16 bp, C. familiaris
ttttaaatgattcatt

SEQ ID NO: 334731 - DNA, 16 bp, C. familiaris
ttttaaatgcaaattt

SEQ ID NO: 334732 - DNA, 16 bp, C. familiaris
ttttaaatggaataaa

SEQ ID NO: 334733 - DNA, 16 bp, C. familiaris
ttttaaatgggagaaa

SEQ ID NO: 334734 - DNA, 16 bp, C. familiaris
ttttaaatgtaaagaa

SEQ ID NO: 334735 - DNA, 16 bp, C. familiaris
ttttaaatgtgtaaat

SEQ ID NO: 334736 - DNA, 16 bp, C. familiaris
ttttaaatgttctcac

SEQ ID NO: 334737 - DNA, 16 bp, C. familiaris
ttttaaattaaaggaa

SEQ ID NO: 334738 - DNA, 16 bp, C. familiaris
ttttaaattagaaaga

SEQ ID NO: 334739 - DNA, 16 bp, C. familiaris
ttttaaatttcagatt

SEQ ID NO: 334740 - DNA, 16 bp, C. familiaris
ttttaacaaaggaaaa

SEQ ID NO: 334741 - DNA, 16 bp, C. familiaris
ttttaacagagagaaa

SEQ ID NO: 334742 - DNA, 16 bp, C. familiaris
ttttaacagctttatt

SEQ ID NO: 334743 - DNA, 16 bp, C. familiaris
ttttaactctggcaaa

SEQ ID NO: 334744 - DNA, 16 bp, C. familiaris
ttttaactttctgagg

SEQ ID NO: 334745 - DNA, 16 bp, C. familiaris
ttttaagaaaatcatt

SEQ ID NO: 334746 - DNA, 16 bp, C. familiaris
ttttaagaaaggaata

SEQ ID NO: 334747 - DNA, 16 bp, C. familiaris
ttttaagaagaaaaca

SEQ ID NO: 334748 - DNA, 16 bp, C. familiaris
ttttaagaagaaagaa

SEQ ID NO: 334749 - DNA, 16 bp, C. familiaris
ttttaagaagaatttt

SEQ ID NO: 334750 - DNA, 16 bp, C. familiaris
ttttaagaagcatttt

SEQ ID NO: 334751 - DNA, 16 bp, C. familiaris
ttttaagactttattt

SEQ ID NO: 334752 - DNA, 16 bp, C. familiaris
ttttaagactttttaa

SEQ ID NO: 334753 - DNA, 16 bp, C. familiaris
ttttaagagaaaattt

SEQ ID NO: 334754 - DNA, 16 bp, C. familiaris
ttttaagattaagaaa

SEQ ID NO: 334755 - DNA, 16 bp, C. familiaris
ttttaaggaaacaaaa

SEQ ID NO: 334756 - DNA, 16 bp, C. familiaris
ttttaaggaagatttt

SEQ ID NO: 334757 - DNA, 16 bp, C. familiaris
ttttaaggatgttatt

SEQ ID NO: 334758 - DNA, 16 bp, C. familiaris
ttttaaggtttcaggt

SEQ ID NO: 334759 - DNA, 16 bp, C. familiaris
ttttaataaagacttt

SEQ ID NO: 334760 - DNA, 16 bp, C. familiaris
ttttaataaatggtgc

SEQ ID NO: 334761 - DNA, 17 bp, C. familiaris
ttttaataaggttggct

SEQ ID NO: 334762 - DNA, 16 bp, C. familiaris
ttttaatagatacaga

SEQ ID NO: 334763 - DNA, 16 bp, C. familiaris
ttttaatagtttctct

SEQ ID NO: 334764 - DNA, 16 bp, C. familiaris
ttttaatattctgtgt

SEQ ID NO: 334765 - DNA, 16 bp, C. familiaris
ttttaatgaaaattct

SEQ ID NO: 334766 - DNA, 16 bp, C. familiaris
ttttaatgaaacaaat

SEQ ID NO: 334767 - DNA, 16 bp, C. familiaris
ttttaatgcattaaaa

SEQ ID NO: 334768 - DNA, 16 bp, C. familiaris
ttttaatgccattttt

SEQ ID NO: 334769 - DNA, 16 bp, C. familiaris
ttttaatgctttaaaa

SEQ ID NO: 334770 - DNA, 16 bp, C. familiaris
ttttaatgcttttaaa

SEQ ID NO: 334771 - DNA, 16 bp, C. familiaris
ttttaatgtatctatt

SEQ ID NO: 334772 - DNA, 16 bp, C. familiaris
ttttaattgctctaaa

SEQ ID NO: 334773 - DNA, 16 bp, C. familiaris
ttttacaaaaatagaa

SEQ ID NO: 334774 - DNA, 16 bp, C. familiaris
ttttacaaaacattta

SEQ ID NO: 334775 - DNA, 16 bp, C. familiaris
ttttacaaaagaggaa

SEQ ID NO: 334776 - DNA, 16 bp, C. familiaris
ttttacaaaaggaaaa

SEQ ID NO: 334777 - DNA, 16 bp, C. familiaris
ttttacaaacaagaaa

SEQ ID NO: 334778 - DNA, 16 bp, C. familiaris
ttttacaaagaaaaat

SEQ ID NO: 334779 - DNA, 16 bp, C. familiaris
ttttacaaagaaaata

SEQ ID NO: 334780 - DNA, 16 bp, C. familiaris
ttttacaaagaggaaa

SEQ ID NO: 334781 - DNA, 16 bp, C. familiaris
ttttacaaagtatttt

SEQ ID NO: 334782 - DNA, 16 bp, C. familiaris
ttttacaaagtgaaca

SEQ ID NO: 334783 - DNA, 16 bp, C. familiaris
ttttacaaatgaagaa

SEQ ID NO: 334784 - DNA, 16 bp, C. familiaris
ttttacaaatgatgaa

SEQ ID NO: 334785 - DNA, 16 bp, C. familiaris
ttttacacatgaggaa

SEQ ID NO: 334786 - DNA, 16 bp, C. familiaris
ttttacagaaatagaa

SEQ ID NO: 334787 - DNA, 16 bp, C. familiaris
ttttacagaagaaatt

SEQ ID NO: 334788 - DNA, 16 bp, C. familiaris
ttttacagaggaaaaa

SEQ ID NO: 334789 - DNA, 16 bp, C. familiaris
ttttacagatagaaaa

SEQ ID NO: 334790 - DNA, 16 bp, C. familiaris
ttttacagatgaagag

SEQ ID NO: 334791 - DNA, 16 bp, C. familiaris
ttttacataaatgttt

SEQ ID NO: 334792 - DNA, 16 bp, C. familiaris
ttttacatatttgtaa

SEQ ID NO: 334793 - DNA, 16 bp, C. familiaris
ttttactgaattaatt

SEQ ID NO: 334794 - DNA, 16 bp, C. familiaris
ttttactgcttttatg

SEQ ID NO: 334795 - DNA, 16 bp, C. familiaris
ttttacttaaaaatct

SEQ ID NO: 334796 - DNA, 16 bp, C. familiaris
ttttacttacttgaga

SEQ ID NO: 334797 - DNA, 16 bp, C. familiaris
ttttacttcttaaaaa

SEQ ID NO: 334798 - DNA, 16 bp, C. familiaris
ttttacttcttccttg

SEQ ID NO: 334799 - DNA, 16 bp, C. familiaris
ttttacttggattatt

SEQ ID NO: 334800 - DNA, 16 bp, C. familiaris
ttttagaaaagaattt

SEQ ID NO: 334801 - DNA, 16 bp, C. familiaris
ttttagaaaatctttt

SEQ ID NO: 334802 - DNA, 16 bp, C. familiaris
ttttagaaagaacaaa

SEQ ID NO: 334803 - DNA, 16 bp, C. familiaris
ttttagaaaggaaaaa

SEQ ID NO: 334804 - DNA, 16 bp, C. familiaris
ttttagaaagtaaaat

SEQ ID NO: 334805 - DNA, 16 bp, C. familiaris
ttttagaacactttta

SEQ ID NO: 334806 - DNA, 16 bp, C. familiaris
ttttagaagagagaga

SEQ ID NO: 334807 - DNA, 16 bp, C. familiaris
ttttagagaaaatatt

SEQ ID NO: 334808 - DNA, 16 bp, C. familiaris
ttttagagaaagcatg

SEQ ID NO: 334809 - DNA, 16 bp, C. familiaris
ttttagatattaatct

SEQ ID NO: 334810 - DNA, 16 bp, C. familiaris
ttttagatgaagaaat

SEQ ID NO: 334811 - DNA, 16 bp, C. familiaris
ttttagatttacaaaa

SEQ ID NO: 334812 - DNA, 16 bp, C. familiaris
ttttagcagttttatt

SEQ ID NO: 334813 - DNA, 16 bp, C. familiaris
ttttagctattatttc

SEQ ID NO: 334814 - DNA, 16 bp, C. familiaris
ttttagctttttgaga

SEQ ID NO: 334815 - DNA, 16 bp, C. familiaris
ttttaggaaaatattt

SEQ ID NO: 334816 - DNA, 16 bp, C. familiaris
ttttaggagagagaga

SEQ ID NO: 334817 - DNA, 16 bp, C. familiaris
ttttaggagctctgtg

SEQ ID NO: 334818 - DNA, 16 bp, C. familiaris
ttttaggatcttctct

SEQ ID NO: 334819 - DNA, 16 bp, C. familiaris
ttttagggagaaaaaa

SEQ ID NO: 334820 - DNA, 16 bp, C. familiaris
ttttagtcattttgct

SEQ ID NO: 334821 - DNA, 16 bp, C. familiaris
ttttagtggagaatgg

SEQ ID NO: 334822 - DNA, 16 bp, C. familiaris
ttttataaaagaggaa

SEQ ID NO: 334823 - DNA, 16 bp, C. familiaris
ttttataatccccaaa

SEQ ID NO: 334824 - DNA, 16 bp, C. familiaris
ttttatattcccaaat

SEQ ID NO: 334825 - DNA, 16 bp, C. familiaris
ttttatattctgaaaa

SEQ ID NO: 334826 - DNA, 16 bp, C. familiaris
ttttatatttctgaaa

SEQ ID NO: 334827 - DNA, 16 bp, C. familiaris
ttttatcaaaagaaaa

SEQ ID NO: 334828 - DNA, 16 bp, C. familiaris
ttttatcaatgaggaa

SEQ ID NO: 334829 - DNA, 16 bp, C. familiaris
ttttatccaaataaaa

SEQ ID NO: 334830 - DNA, 16 bp, C. familiaris
ttttatcctgccacac

SEQ ID NO: 334831 - DNA, 16 bp, C. familiaris
ttttatcttcctaaat

SEQ ID NO: 334832 - DNA, 16 bp, C. familiaris
ttttatgactggaagt

SEQ ID NO: 334833 - DNA, 16 bp, C. familiaris
ttttatgagaaaaata

SEQ ID NO: 334834 - DNA, 16 bp, C. familiaris
ttttatgagaaactgc

SEQ ID NO: 334835 - DNA, 16 bp, C. familiaris
ttttatggagacttca

SEQ ID NO: 334836 - DNA, 16 bp, C. familiaris
ttttatggctgaaaaa

SEQ ID NO: 334837 - DNA, 16 bp, C. familiaris
ttttatggctgaataa

SEQ ID NO: 334838 - DNA, 16 bp, C. familiaris
ttttatggggagaagc

SEQ ID NO: 334839 - DNA, 16 bp, C. familiaris
ttttatgtaagtgatg

SEQ ID NO: 334840 - DNA, 16 bp, C. familiaris
ttttatgtattacatt

SEQ ID NO: 334841 - DNA, 16 bp, C. familiaris
ttttatgtatttcaga

SEQ ID NO: 334842 - DNA, 16 bp, C. familiaris
ttttatgtgaaatttc

SEQ ID NO: 334843 - DNA, 16 bp, C. familiaris
ttttatgttttccaaa

SEQ ID NO: 334844 - DNA, 16 bp, C. familiaris
ttttattaagagagct

SEQ ID NO: 334845 - DNA, 16 bp, C. familiaris
ttttattatgaatgaa

SEQ ID NO: 334846 - DNA, 16 bp, C. familiaris
ttttattatggaaaac

SEQ ID NO: 334847 - DNA, 16 bp, C. familiaris
ttttattattcttaga

SEQ ID NO: 334848 - DNA, 16 bp, C. familiaris
ttttattgaagaataa

SEQ ID NO: 334849 - DNA, 16 bp, C. familiaris
ttttattgctgttcaa

SEQ ID NO: 334850 - DNA, 16 bp, C. familiaris
ttttatttacgatagt

SEQ ID NO: 334851 - DNA, 16 bp, C. familiaris
ttttatttagaaaatg

SEQ ID NO: 334852 - DNA, 16 bp, C. familiaris
ttttatttatctgaaa

SEQ ID NO: 334853 - DNA, 16 bp, C. familiaris
ttttatttcaaagatt

SEQ ID NO: 334854 - DNA, 16 bp, C. familiaris
ttttatttccaagtaa

SEQ ID NO: 334855 - DNA, 16 bp, C. familiaris
ttttatttccttggtg

SEQ ID NO: 334856 - DNA, 16 bp, C. familiaris
ttttatttctctggga

SEQ ID NO: 334857 - DNA, 16 bp, C. familiaris
ttttatttctgcaaaa

SEQ ID NO: 334858 - DNA, 16 bp, C. familiaris
ttttatttgaaaaaca

SEQ ID NO: 334859 - DNA, 16 bp, C. familiaris
ttttattttaccaaaa

SEQ ID NO: 334860 - DNA, 16 bp, C. familiaris
ttttattttactgaat

SEQ ID NO: 334861 - DNA, 16 bp, C. familiaris
ttttattttcaagtat

SEQ ID NO: 334862 - DNA, 16 bp, C. familiaris
ttttattttcagaaat

SEQ ID NO: 334863 - DNA, 16 bp, C. familiaris
ttttattttcatgaag

SEQ ID NO: 334864 - DNA, 16 bp, C. familiaris
ttttattttgaaaaca

SEQ ID NO: 334865 - DNA, 16 bp, C. familiaris
ttttattttgaacaaa

SEQ ID NO: 334866 - DNA, 16 bp, C. familiaris
ttttattttgctaaaa

SEQ ID NO: 334867 - DNA, 16 bp, C. familiaris
ttttattttggaagaa

SEQ ID NO: 334868 - DNA, 16 bp, C. familiaris
ttttatttttctaaag

SEQ ID NO: 334869 - DNA, 16 bp, C. familiaris
ttttcaaaaaaggaaa

SEQ ID NO: 334870 - DNA, 16 bp, C. familiaris
ttttcaaaaaatgaaa

SEQ ID NO: 334871 - DNA, 16 bp, C. familiaris
ttttcaaaaacatatt

SEQ ID NO: 334872 - DNA, 16 bp, C. familiaris
ttttcaaaaagcaaaa

SEQ ID NO: 334873 - DNA, 16 bp, C. familiaris
ttttcaaaaagcaaat

SEQ ID NO: 334874 - DNA, 16 bp, C. familiaris
ttttcaaaaatgaaat

SEQ ID NO: 334875 - DNA, 16 bp, C. familiaris
ttttcaaaaatgaata

SEQ ID NO: 334876 - DNA, 16 bp, C. familiaris
ttttcaaaaccagaaa

SEQ ID NO: 334877 - DNA, 16 bp, C. familiaris
ttttcaaaaccatttt

SEQ ID NO: 334878 - DNA, 16 bp, C. familiaris
ttttcaaaagaaataa

SEQ ID NO: 334879 - DNA, 16 bp, C. familiaris
ttttcaaaagagaaat

SEQ ID NO: 334880 - DNA, 16 bp, C. familiaris
ttttcaaaaggagaaa

SEQ ID NO: 334881 - DNA, 16 bp, C. familiaris
ttttcaaactcatttt

SEQ ID NO: 334882 - DNA, 16 bp, C. familiaris
ttttcaaactgatttt

SEQ ID NO: 334883 - DNA, 16 bp, C. familiaris
ttttcaaagaaaactt

SEQ ID NO: 334884 - DNA, 16 bp, C. familiaris
ttttcaaagaaaattt

SEQ ID NO: 334885 - DNA, 16 bp, C. familiaris
ttttcaaagaaataga

SEQ ID NO: 334886 - DNA, 16 bp, C. familiaris
ttttcaaagaacattt

SEQ ID NO: 334887 - DNA, 16 bp, C. familiaris
ttttcaaagaactttt

SEQ ID NO: 334888 - DNA, 16 bp, C. familiaris
ttttcaaagagatttt

SEQ ID NO: 334889 - DNA, 16 bp, C. familiaris
ttttcaaagatcttat

SEQ ID NO: 334890 - DNA, 16 bp, C. familiaris
ttttcaaagattctat

SEQ ID NO: 334891 - DNA, 16 bp, C. familiaris
ttttcaaaggaaaaaa

SEQ ID NO: 334892 - DNA, 16 bp, C. familiaris
ttttcaaagtatattt

SEQ ID NO: 334893 - DNA, 16 bp, C. familiaris
ttttcaaagtgctttc

SEQ ID NO: 334894 - DNA, 16 bp, C. familiaris
ttttcaaataacatat

SEQ ID NO: 334895 - DNA, 16 bp, C. familiaris
ttttcaaatatatgtt

SEQ ID NO: 334896 - DNA, 16 bp, C. familiaris
ttttcaaatatgtaat

SEQ ID NO: 334897 - DNA, 16 bp, C. familiaris
ttttcaaatattgaat

SEQ ID NO: 334898 - DNA, 16 bp, C. familiaris
ttttcaaatatttgaa

SEQ ID NO: 334899 - DNA, 16 bp, C. familiaris
ttttcaaatgcaaaaa

SEQ ID NO: 334900 - DNA, 16 bp, C. familiaris
ttttcaaatgtcattt

SEQ ID NO: 334901 - DNA, 16 bp, C. familiaris
ttttcaaatgtgaaaa

SEQ ID NO: 334902 - DNA, 16 bp, C. familiaris
ttttcaaatttttgag

SEQ ID NO: 334903 - DNA, 16 bp, C. familiaris
ttttcaacattgtttt

SEQ ID NO: 334904 - DNA, 16 bp, C. familiaris
ttttcaacttcattat

SEQ ID NO: 334905 - DNA, 16 bp, C. familiaris
ttttcaagaaataaaa

SEQ ID NO: 334906 - DNA, 16 bp, C. familiaris
ttttcaagataatttt

SEQ ID NO: 334907 - DNA, 16 bp, C. familiaris
ttttcaagatcacttt

SEQ ID NO: 334908 - DNA, 16 bp, C. familiaris
ttttcaagatttattt

SEQ ID NO: 334909 - DNA, 16 bp, C. familiaris
ttttcaaggaaaaaaa

SEQ ID NO: 334910 - DNA, 16 bp, C. familiaris
ttttcaaggaagaaaa

SEQ ID NO: 334911 - DNA, 16 bp, C. familiaris
ttttcaagtctctgct

SEQ ID NO: 334912 - DNA, 16 bp, C. familiaris
ttttcaagttaaattt

SEQ ID NO: 334913 - DNA, 16 bp, C. familiaris
ttttcaattagaaaaa

SEQ ID NO: 334914 - DNA, 16 bp, C. familiaris
ttttcaattttaaaga

SEQ ID NO: 334915 - DNA, 16 bp, C. familiaris
ttttcacaatatttaa

SEQ ID NO: 334916 - DNA, 16 bp, C. familiaris
ttttcacagaactgga

SEQ ID NO: 334917 - DNA, 16 bp, C. familiaris
ttttcacatacatttt

SEQ ID NO: 334918 - DNA, 16 bp, C. familiaris
ttttcacatgcttatt

SEQ ID NO: 334919 - DNA, 16 bp, C. familiaris
ttttcactgaaaatat

SEQ ID NO: 334920 - DNA, 16 bp, C. familiaris
ttttcactttttgaaa

SEQ ID NO: 334921 - DNA, 16 bp, C. familiaris
ttttcagaaaaaggaa

SEQ ID NO: 334922 - DNA, 16 bp, C. familiaris
ttttcagaaagaaaaa

SEQ ID NO: 334923 - DNA, 16 bp, C. familiaris
ttttcagaaagatttt

SEQ ID NO: 334924 - DNA, 16 bp, C. familiaris
ttttcagaataatgag

SEQ ID NO: 334925 - DNA, 16 bp, C. familiaris
ttttcagaatataaat

SEQ ID NO: 334926 - DNA, 16 bp, C. familiaris
ttttcagaattatttt

SEQ ID NO: 334927 - DNA, 16 bp, C. familiaris
ttttcagaggaggaaa

SEQ ID NO: 334928 - DNA, 16 bp, C. familiaris
ttttcagatattttta

SEQ ID NO: 334929 - DNA, 16 bp, C. familiaris
ttttcagatgaagaaa

SEQ ID NO: 334930 - DNA, 16 bp, C. familiaris
ttttcagatggagaaa

SEQ ID NO: 334931 - DNA, 16 bp, C. familiaris
ttttcagatgtgaaaa

SEQ ID NO: 334932 - DNA, 16 bp, C. familiaris
ttttcagattataaaa

SEQ ID NO: 334933 - DNA, 16 bp, C. familiaris
ttttcagattgttcat

SEQ ID NO: 334934 - DNA, 16 bp, C. familiaris
ttttcagatttcagaa

SEQ ID NO: 334935 - DNA, 16 bp, C. familiaris
ttttcaggtaaggaaa

SEQ ID NO: 334936 - DNA, 16 bp, C. familiaris
ttttcagtgaaagaaa

SEQ ID NO: 334937 - DNA, 16 bp, C. familiaris
ttttcagttctagaaa

SEQ ID NO: 334938 - DNA, 16 bp, C. familiaris
ttttcagtttttagaa

SEQ ID NO: 334939 - DNA, 16 bp, C. familiaris
ttttcataaggaatct

SEQ ID NO: 334940 - DNA, 16 bp, C. familiaris
ttttcatccctgtgac

SEQ ID NO: 334941 - DNA, 16 bp, C. familiaris
ttttcatctacaaaat

SEQ ID NO: 334942 - DNA, 16 bp, C. familiaris
ttttcatctctgattg

SEQ ID NO: 334943 - DNA, 16 bp, C. familiaris
ttttcatcttgcaaaa

SEQ ID NO: 334944 - DNA, 16 bp, C. familiaris
ttttcatcttgtgaaa

SEQ ID NO: 334945 - DNA, 16 bp, C. familiaris
ttttcatgaacatttt

SEQ ID NO: 334946 - DNA, 16 bp, C. familiaris
ttttcatgactgagta

SEQ ID NO: 334947 - DNA, 16 bp, C. familiaris
ttttcatgattcagtc

SEQ ID NO: 334948 - DNA, 16 bp, C. familiaris
ttttcatggcttaata

SEQ ID NO: 334949 - DNA, 16 bp, C. familiaris
ttttcatgtatttaat

SEQ ID NO: 334950 - DNA, 16 bp, C. familiaris
ttttcatgtgcctctt

SEQ ID NO: 334951 - DNA, 16 bp, C. familiaris
ttttcatttatcttgg

SEQ ID NO: 334952 - DNA, 16 bp, C. familiaris
ttttcatttcaaaata

SEQ ID NO: 334953 - DNA, 16 bp, C. familiaris
ttttcatttctcaaaa

SEQ ID NO: 334954 - DNA, 16 bp, C. familiaris
ttttcatttgaaatat

SEQ ID NO: 334955 - DNA, 16 bp, C. familiaris
ttttcattttgatata

SEQ ID NO: 334956 - DNA, 16 bp, C. familiaris
ttttcatttttcagaa

SEQ ID NO: 334957 - DNA, 16 bp, C. familiaris
ttttcatttttgaaaa

SEQ ID NO: 334958 - DNA, 16 bp, C. familiaris
ttttccaaaaaatttt

SEQ ID NO: 334959 - DNA, 16 bp, C. familiaris
ttttccaaaaattaaa

SEQ ID NO: 334960 - DNA, 16 bp, C. familiaris
ttttccaaaacaaaga

SEQ ID NO: 334961 - DNA, 16 bp, C. familiaris
ttttccaaaccaaaaa

SEQ ID NO: 334962 - DNA, 16 bp, C. familiaris
ttttccaaagaaaaca

SEQ ID NO: 334963 - DNA, 16 bp, C. familiaris
ttttccaaagaaaata

SEQ ID NO: 334964 - DNA, 16 bp, C. familiaris
ttttccaaatgaccaa

SEQ ID NO: 334965 - DNA, 16 bp, C. familiaris
ttttccaaattttctg

SEQ ID NO: 334966 - DNA, 16 bp, C. familiaris
ttttccaagatttatt

SEQ ID NO: 334967 - DNA, 16 bp, C. familiaris
ttttccaatgagaaaa

SEQ ID NO: 334968 - DNA, 16 bp, C. familiaris
ttttccagaaaaaaaa

SEQ ID NO: 334969 - DNA, 16 bp, C. familiaris
ttttccagaaagaaaa

SEQ ID NO: 334970 - DNA, 16 bp, C. familiaris
ttttccagaatgccat

SEQ ID NO: 334971 - DNA, 16 bp, C. familiaris
ttttccagaatgttct

SEQ ID NO: 334972 - DNA, 16 bp, C. familiaris
ttttccagaattattt

SEQ ID NO: 334973 - DNA, 16 bp, C. familiaris
ttttccagatatattt

SEQ ID NO: 334974 - DNA, 16 bp, C. familiaris
ttttccagatttttct

SEQ ID NO: 334975 - DNA, 16 bp, C. familiaris
ttttccagcaccattt

SEQ ID NO: 334976 - DNA, 16 bp, C. familiaris
ttttccaggaaaaata

SEQ ID NO: 334977 - DNA, 16 bp, C. familiaris
ttttccaggaagaaaa

SEQ ID NO: 334978 - DNA, 16 bp, C. familiaris
ttttccagtgaatagt

SEQ ID NO: 334979 - DNA, 16 bp, C. familiaris
ttttccagtggacagt

SEQ ID NO: 334980 - DNA, 16 bp, C. familiaris
ttttccattcagtttt

SEQ ID NO: 334981 - DNA, 16 bp, C. familiaris
ttttccatttctggaa

SEQ ID NO: 334982 - DNA, 16 bp, C. familiaris
ttttcccaagatttta

SEQ ID NO: 334983 - DNA, 16 bp, C. familiaris
ttttcccagtttttct

SEQ ID NO: 334984 - DNA, 16 bp, C. familiaris
ttttccccaaaataaa

SEQ ID NO: 334985 - DNA, 16 bp, C. familiaris
ttttccccaaagaaga

SEQ ID NO: 334986 - DNA, 16 bp, C. familiaris
ttttccccacttagtt

SEQ ID NO: 334987 - DNA, 16 bp, C. familiaris
ttttccctctatgtct

SEQ ID NO: 334988 - DNA, 16 bp, C. familiaris
ttttcctaaaaatgaa

SEQ ID NO: 334989 - DNA, 16 bp, C. familiaris
ttttcctatacacaca

SEQ ID NO: 334990 - DNA, 16 bp, C. familiaris
ttttcctattggatat

SEQ ID NO: 334991 - DNA, 16 bp, C. familiaris
ttttcctcaaaattat

SEQ ID NO: 334992 - DNA, 16 bp, C. familiaris
ttttcctcaaataaat

SEQ ID NO: 334993 - DNA, 16 bp, C. familiaris
ttttcctcctgatttt

SEQ ID NO: 334994 - DNA, 16 bp, C. familiaris
ttttcctctgtatttc

SEQ ID NO: 334995 - DNA, 16 bp, C. familiaris
ttttcctcttgctgat

SEQ ID NO: 334996 - DNA, 16 bp, C. familiaris
ttttcctgaaataaaa

SEQ ID NO: 334997 - DNA, 16 bp, C. familiaris
ttttcctgatgccaag

SEQ ID NO: 334998 - DNA, 16 bp, C. familiaris
ttttccttaatgattt

SEQ ID NO: 334999 - DNA, 16 bp, C. familiaris
ttttccttagcttcct

SEQ ID NO: 335000 - DNA, 16 bp, C. familiaris
ttttccttcagagaaa

SEQ ID NO: 335001 - DNA, 16 bp, C. familiaris
ttttccttcttggaaa

SEQ ID NO: 335002 - DNA, 16 bp, C. familiaris
ttttccttggaaaaat

SEQ ID NO: 335003 - DNA, 16 bp, C. familiaris
ttttcctttccactca

SEQ ID NO: 335004 - DNA, 16 bp, C. familiaris
ttttcctttgacattt

SEQ ID NO: 335005 - DNA, 16 bp, C. familiaris
ttttcctttgctgtgc

SEQ ID NO: 335006 - DNA, 16 bp, C. familiaris
ttttccttttaagatt

SEQ ID NO: 335007 - DNA, 16 bp, C. familiaris
ttttcctttttgagat

SEQ ID NO: 335008 - DNA, 16 bp, C. familiaris
ttttctaaaaaagaaa

SEQ ID NO: 335009 - DNA, 16 bp, C. familiaris
ttttctaaaaatcaaa

SEQ ID NO: 335010 - DNA, 16 bp, C. familiaris
ttttctaaaagaaaaa

SEQ ID NO: 335011 - DNA, 16 bp, C. familiaris
ttttctaaaatgaaag

SEQ ID NO: 335012 - DNA, 16 bp, C. familiaris
ttttctaaatttgaaa

SEQ ID NO: 335013 - DNA, 16 bp, C. familiaris
ttttctaataaaaaca

SEQ ID NO: 335014 - DNA, 16 bp, C. familiaris
ttttctaatttgcaca

SEQ ID NO: 335015 - DNA, 16 bp, C. familiaris
ttttctaattttgtga

SEQ ID NO: 335016 - DNA, 17 bp, C. familiaris
ttttctacgtacagtat

SEQ ID NO: 335017 - DNA, 16 bp, C. familiaris
ttttctactttaaaaa

SEQ ID NO: 335018 - DNA, 16 bp, C. familiaris
ttttctagaagagaaa

SEQ ID NO: 335019 - DNA, 16 bp, C. familiaris
ttttctagaaggaaaa

SEQ ID NO: 335020 - DNA, 16 bp, C. familiaris
ttttctatatatgaaa

SEQ ID NO: 335021 - DNA, 16 bp, C. familiaris
ttttctatttcaagaa

SEQ ID NO: 335022 - DNA, 16 bp, C. familiaris
ttttctcaactgtaaa

SEQ ID NO: 335023 - DNA, 16 bp, C. familiaris
ttttctcaagtatttt

SEQ ID NO: 335024 - DNA, 16 bp, C. familiaris
ttttctcagaatattt

SEQ ID NO: 335025 - DNA, 16 bp, C. familiaris
ttttctcatctttaaa

SEQ ID NO: 335026 - DNA, 16 bp, C. familiaris
ttttctcatgtgtttg

SEQ ID NO: 335027 - DNA, 16 bp, C. familiaris
ttttctcatttcagtt

SEQ ID NO: 335028 - DNA, 16 bp, C. familiaris
ttttctcattttctga

SEQ ID NO: 335029 - DNA, 16 bp, C. familiaris
ttttctccaaaatttt

SEQ ID NO: 335030 - DNA, 16 bp, C. familiaris
ttttctccaaagattt

SEQ ID NO: 335031 - DNA, 16 bp, C. familiaris
ttttctcctgtgttat

SEQ ID NO: 335032 - DNA, 16 bp, C. familiaris
ttttctctcattgtct

SEQ ID NO: 335033 - DNA, 16 bp, C. familiaris
ttttctctgatattta

SEQ ID NO: 335034 - DNA, 16 bp, C. familiaris
ttttctctgccttatt

SEQ ID NO: 335035 - DNA, 16 bp, C. familiaris
ttttctctttggaaaa

SEQ ID NO: 335036 - DNA, 16 bp, C. familiaris
ttttctgaaaaaaaaa

SEQ ID NO: 335037 - DNA, 16 bp, C. familiaris
ttttctgaaaaagttt

SEQ ID NO: 335038 - DNA, 16 bp, C. familiaris
ttttctgaaaattttt

SEQ ID NO: 335039 - DNA, 16 bp, C. familiaris
ttttctgaaacttttt

SEQ ID NO: 335040 - DNA, 16 bp, C. familiaris
ttttctgaccacaaca

SEQ ID NO: 335041 - DNA, 16 bp, C. familiaris
ttttctgattttaaaa

SEQ ID NO: 335042 - DNA, 16 bp, C. familiaris
ttttctggaaaatatt

SEQ ID NO: 335043 - DNA, 16 bp, C. familiaris
ttttctggaagatttt

SEQ ID NO: 335044 - DNA, 16 bp, C. familiaris
ttttctggaggaaaaa

SEQ ID NO: 335045 - DNA, 16 bp, C. familiaris
ttttctggtttcaggt

SEQ ID NO: 335046 - DNA, 16 bp, C. familiaris
ttttctgtaaaatggg

SEQ ID NO: 335047 - DNA, 16 bp, C. familiaris
ttttctgtaaatattt

SEQ ID NO: 335048 - DNA, 16 bp, C. familiaris
ttttctgtaatctcta

SEQ ID NO: 335049 - DNA, 16 bp, C. familiaris
ttttctgtgaacttaa

SEQ ID NO: 335050 - DNA, 16 bp, C. familiaris
ttttctgtgtctggct

SEQ ID NO: 335051 - DNA, 16 bp, C. familiaris
ttttctgttccactga

SEQ ID NO: 335052 - DNA, 16 bp, C. familiaris
ttttctgtttcaaaat

SEQ ID NO: 335053 - DNA, 16 bp, C. familiaris
ttttctgtttctgcaa

SEQ ID NO: 335054 - DNA, 16 bp, C. familiaris
ttttctgttttaaaag

SEQ ID NO: 335055 - DNA, 16 bp, C. familiaris
ttttctgttttaaaat

SEQ ID NO: 335056 - DNA, 16 bp, C. familiaris
ttttctgttttggaaa

SEQ ID NO: 335057 - DNA, 16 bp, C. familiaris
ttttcttaaagaaaaa

SEQ ID NO: 335058 - DNA, 16 bp, C. familiaris
ttttcttaaagattct

SEQ ID NO: 335059 - DNA, 16 bp, C. familiaris
ttttcttaaatttcac

SEQ ID NO: 335060 - DNA, 16 bp, C. familiaris
ttttcttaagaaattt

SEQ ID NO: 335061 - DNA, 16 bp, C. familiaris
ttttcttaagagaaaa

SEQ ID NO: 335062 - DNA, 16 bp, C. familiaris
ttttcttacaattctg

SEQ ID NO: 335063 - DNA, 16 bp, C. familiaris
ttttcttacataaaaa

SEQ ID NO: 335064 - DNA, 16 bp, C. familiaris
ttttcttacctttaaa

SEQ ID NO: 335065 - DNA, 16 bp, C. familiaris
ttttcttagcattttc

SEQ ID NO: 335066 - DNA, 16 bp, C. familiaris
ttttcttatacataca

SEQ ID NO: 335067 - DNA, 16 bp, C. familiaris
ttttcttattttgggg

SEQ ID NO: 335068 - DNA, 16 bp, C. familiaris
ttttcttcaaaaacat

SEQ ID NO: 335069 - DNA, 16 bp, C. familiaris
ttttcttcaaaattct

SEQ ID NO: 335070 - DNA, 16 bp, C. familiaris
ttttcttcagatttta

SEQ ID NO: 335071 - DNA, 16 bp, C. familiaris
ttttcttcatgaaatt

SEQ ID NO: 335072 - DNA, 16 bp, C. familiaris
ttttcttccagtcttt

SEQ ID NO: 335073 - DNA, 16 bp, C. familiaris
ttttcttccccccaaa

SEQ ID NO: 335074 - DNA, 16 bp, C. familiaris
ttttcttcctctgaaa

SEQ ID NO: 335075 - DNA, 16 bp, C. familiaris
ttttcttctaaaatca

SEQ ID NO: 335076 - DNA, 16 bp, C. familiaris
ttttcttctaaaggtt

SEQ ID NO: 335077 - DNA, 16 bp, C. familiaris
ttttcttctctgaaat

SEQ ID NO: 335078 - DNA, 16 bp, C. familiaris
ttttcttctctgaatt

SEQ ID NO: 335079 - DNA, 16 bp, C. familiaris
ttttcttctctttgca

SEQ ID NO: 335080 - DNA, 16 bp, C. familiaris
ttttcttctgaaataa

SEQ ID NO: 335081 - DNA, 16 bp, C. familiaris
ttttcttctgaagaaa

SEQ ID NO: 335082 - DNA, 16 bp, C. familiaris
ttttcttctggaaaat

SEQ ID NO: 335083 - DNA, 16 bp, C. familiaris
ttttcttctgggattt

SEQ ID NO: 335084 - DNA, 16 bp, C. familiaris
ttttcttcttcttcag

SEQ ID NO: 335085 - DNA, 16 bp, C. familiaris
ttttcttcttgaaatt

SEQ ID NO: 335086 - DNA, 16 bp, C. familiaris
ttttcttggataaata

SEQ ID NO: 335087 - DNA, 16 bp, C. familiaris
ttttctttaaaaaaga

SEQ ID NO: 335088 - DNA, 16 bp, C. familiaris
ttttctttaaagaaaa

SEQ ID NO: 335089 - DNA, 16 bp, C. familiaris
ttttctttaaatgtct

SEQ ID NO: 335090 - DNA, 16 bp, C. familiaris
ttttctttatggcttc

SEQ ID NO: 335091 - DNA, 16 bp, C. familiaris
ttttctttcagaaaat

SEQ ID NO: 335092 - DNA, 16 bp, C. familiaris
ttttctttccattaaa

SEQ ID NO: 335093 - DNA, 16 bp, C. familiaris
ttttctttctcagaat

SEQ ID NO: 335094 - DNA, 16 bp, C. familiaris
ttttctttctgaaaat

SEQ ID NO: 335095 - DNA, 16 bp, C. familiaris
ttttctttctgaaact

SEQ ID NO: 335096 - DNA, 16 bp, C. familiaris
ttttctttctgaaaga

SEQ ID NO: 335097 - DNA, 16 bp, C. familiaris
ttttctttgaaattat

SEQ ID NO: 335098 - DNA, 16 bp, C. familiaris
ttttctttggaaaact

SEQ ID NO: 335099 - DNA, 16 bp, C. familiaris
ttttcttttaagaatt

SEQ ID NO: 335100 - DNA, 16 bp, C. familiaris
ttttcttttagagaaa

SEQ ID NO: 335101 - DNA, 16 bp, C. familiaris
ttttcttttcctctga

SEQ ID NO: 335102 - DNA, 16 bp, C. familiaris
ttttcttttggagaaa

SEQ ID NO: 335103 - DNA, 16 bp, C. familiaris
ttttctttttaaaaga

SEQ ID NO: 335104 - DNA, 16 bp, C. familiaris
ttttctttttccaaaa

SEQ ID NO: 335105 - DNA, 16 bp, C. familiaris
ttttctttttgagaca

SEQ ID NO: 335106 - DNA, 16 bp, C. familiaris
ttttcttttttgaaag

SEQ ID NO: 335107 - DNA, 16 bp, C. familiaris
ttttgaaaaaaatgtt

SEQ ID NO: 335108 - DNA, 16 bp, C. familiaris
ttttgaaaaacctcca

SEQ ID NO: 335109 - DNA, 16 bp, C. familiaris
ttttgaaaaactgttt

SEQ ID NO: 335110 - DNA, 16 bp, C. familiaris
ttttgaaaaagaaaga

SEQ ID NO: 335111 - DNA, 16 bp, C. familiaris
ttttgaaaaaggaaag

SEQ ID NO: 335112 - DNA, 16 bp, C. familiaris
ttttgaaaaagtttta

SEQ ID NO: 335113 - DNA, 16 bp, C. familiaris
ttttgaaaaataaatg

SEQ ID NO: 335114 - DNA, 16 bp, C. familiaris
ttttgaaaaatcaaaa

SEQ ID NO: 335115 - DNA, 16 bp, C. familiaris
ttttgaaaaatcattt

SEQ ID NO: 335116 - DNA, 16 bp, C. familiaris
ttttgaaaaatgtcaa

SEQ ID NO: 335117 - DNA, 16 bp, C. familiaris
ttttgaaaaatttctt

SEQ ID NO: 335118 - DNA, 16 bp, C. familiaris
ttttgaaaacagaaaa

SEQ ID NO: 335119 - DNA, 16 bp, C. familiaris
ttttgaaaagaagaaa

SEQ ID NO: 335120 - DNA, 16 bp, C. familiaris
ttttgaaaagaatctt

SEQ ID NO: 335121 - DNA, 16 bp, C. familiaris
ttttgaaaagattaaa

SEQ ID NO: 335122 - DNA, 16 bp, C. familiaris
ttttgaaaataaaaca

SEQ ID NO: 335123 - DNA, 16 bp, C. familiaris
ttttgaaaataaagta

SEQ ID NO: 335124 - DNA, 16 bp, C. familiaris
ttttgaaaatacaaat

SEQ ID NO: 335125 - DNA, 16 bp, C. familiaris
ttttgaaaatagcttt

SEQ ID NO: 335126 - DNA, 16 bp, C. familiaris
ttttgaaaatgaagaa

SEQ ID NO: 335127 - DNA, 16 bp, C. familiaris
ttttgaaaatgctttt

SEQ ID NO: 335128 - DNA, 16 bp, C. familiaris
ttttgaaaatgtcttt

SEQ ID NO: 335129 - DNA, 16 bp, C. familiaris
ttttgaaaattatgaa

SEQ ID NO: 335130 - DNA, 16 bp, C. familiaris
ttttgaaagagaaaga

SEQ ID NO: 335131 - DNA, 16 bp, C. familiaris
ttttgaaatgaagaaa

SEQ ID NO: 335132 - DNA, 16 bp, C. familiaris
ttttgaaatgcatttt

SEQ ID NO: 335133 - DNA, 16 bp, C. familiaris
ttttgaaatgtaatca

SEQ ID NO: 335134 - DNA, 16 bp, C. familiaris
ttttgaaattactttt

SEQ ID NO: 335135 - DNA, 16 bp, C. familiaris
ttttgaaatttttctc

SEQ ID NO: 335136 - DNA, 16 bp, C. familiaris
ttttgaagaaaaacaa

SEQ ID NO: 335137 - DNA, 16 bp, C. familiaris
ttttgaagaaaaattt

SEQ ID NO: 335138 - DNA, 16 bp, C. familiaris
ttttgaagaaaagaaa

SEQ ID NO: 335139 - DNA, 16 bp, C. familiaris
ttttgaagaattaaaa

SEQ ID NO: 335140 - DNA, 16 bp, C. familiaris
ttttgaagagtactgg

SEQ ID NO: 335141 - DNA, 16 bp, C. familiaris
ttttgaagagtttatt

SEQ ID NO: 335142 - DNA, 16 bp, C. familiaris
ttttgaagatgaagaa

SEQ ID NO: 335143 - DNA, 16 bp, C. familiaris
ttttgaagatgaggaa

SEQ ID NO: 335144 - DNA, 16 bp, C. familiaris
ttttgaaggaaaaaaa

SEQ ID NO: 335145 - DNA, 16 bp, C. familiaris
ttttgaaggattttat

SEQ ID NO: 335146 - DNA, 16 bp, C. familiaris
ttttgaatcctttatg

SEQ ID NO: 335147 - DNA, 16 bp, C. familiaris
ttttgaatggaaaaaa

SEQ ID NO: 335148 - DNA, 16 bp, C. familiaris
ttttgaatggaatgtt

SEQ ID NO: 335149 - DNA, 16 bp, C. familiaris
ttttgaattaaaagaa

SEQ ID NO: 335150 - DNA, 16 bp, C. familiaris
ttttgaatttctgatt

SEQ ID NO: 335151 - DNA, 16 bp, C. familiaris
ttttgacaaaaataaa

SEQ ID NO: 335152 - DNA, 16 bp, C. familiaris
ttttgacaattatgaa

SEQ ID NO: 335153 - DNA, 16 bp, C. familiaris
ttttgactgttatgaa

SEQ ID NO: 335154 - DNA, 16 bp, C. familiaris
ttttgagaaaaagaga

SEQ ID NO: 335155 - DNA, 16 bp, C. familiaris
ttttgagaaaacttca

SEQ ID NO: 335156 - DNA, 16 bp, C. familiaris
ttttgagaaacttcca

SEQ ID NO: 335157 - DNA, 16 bp, C. familiaris
ttttgagaaagaagaa

SEQ ID NO: 335158 - DNA, 16 bp, C. familiaris
ttttgagaatgaaatg

SEQ ID NO: 335159 - DNA, 16 bp, C. familiaris
ttttgagacttgtttt

SEQ ID NO: 335160 - DNA, 16 bp, C. familiaris
ttttgagagagaatga

SEQ ID NO: 335161 - DNA, 16 bp, C. familiaris
ttttgagcagttttag

SEQ ID NO: 335162 - DNA, 16 bp, C. familiaris
ttttgaggaaaacaaa

SEQ ID NO: 335163 - DNA, 16 bp, C. familiaris
ttttgataggaattga

SEQ ID NO: 335164 - DNA, 16 bp, C. familiaris
ttttgatattaaaact

SEQ ID NO: 335165 - DNA, 16 bp, C. familiaris
ttttgatgaacagaag

SEQ ID NO: 335166 - DNA, 16 bp, C. familiaris
ttttgatgaagcccaa

SEQ ID NO: 335167 - DNA, 16 bp, C. familiaris
ttttgatgaccttgac

SEQ ID NO: 335168 - DNA, 17 bp, C. familiaris
ttttgatggaatcctgt

SEQ ID NO: 335169 - DNA, 16 bp, C. familiaris
ttttgattaactcaaa

SEQ ID NO: 335170 - DNA, 16 bp, C. familiaris
ttttgatttgtatctc

SEQ ID NO: 335171 - DNA, 16 bp, C. familiaris
ttttgcaaaaacattt

SEQ ID NO: 335172 - DNA, 16 bp, C. familiaris
ttttgcaaaatgaaaa

SEQ ID NO: 335173 - DNA, 16 bp, C. familiaris
ttttgcaaaatgttac

SEQ ID NO: 335174 - DNA, 16 bp, C. familiaris
ttttgcaaaatgtttt

SEQ ID NO: 335175 - DNA, 16 bp, C. familiaris
ttttgcaaaattaaaa

SEQ ID NO: 335176 - DNA, 16 bp, C. familiaris
ttttgcaaatattaaa

SEQ ID NO: 335177 - DNA, 16 bp, C. familiaris
ttttgcaaatgaaaaa

SEQ ID NO: 335178 - DNA, 16 bp, C. familiaris
ttttgcaaattttact

SEQ ID NO: 335179 - DNA, 16 bp, C. familiaris
ttttgcacagtaaagg

SEQ ID NO: 335180 - DNA, 16 bp, C. familiaris
ttttgcacattttatt

SEQ ID NO: 335181 - DNA, 16 bp, C. familiaris
ttttgcagatgaagaa

SEQ ID NO: 335182 - DNA, 16 bp, C. familiaris
ttttgcagatgatgaa

SEQ ID NO: 335183 - DNA, 16 bp, C. familiaris
ttttgcatatttatta

SEQ ID NO: 335184 - DNA, 16 bp, C. familiaris
ttttgcatgtacctgt

SEQ ID NO: 335185 - DNA, 16 bp, C. familiaris
ttttgcatgttactgt

SEQ ID NO: 335186 - DNA, 16 bp, C. familiaris
ttttgcatttaaattt

SEQ ID NO: 335187 - DNA, 16 bp, C. familiaris
ttttgcatttttaaaa

SEQ ID NO: 335188 - DNA, 16 bp, C. familiaris
ttttgccatatttgct

SEQ ID NO: 335189 - DNA, 16 bp, C. familiaris
ttttgccattttcatt

SEQ ID NO: 335190 - DNA, 16 bp, C. familiaris
ttttgcccatctcccc

SEQ ID NO: 335191 - DNA, 16 bp, C. familiaris
ttttgctattgatttg

SEQ ID NO: 335192 - DNA, 16 bp, C. familiaris
ttttgctcactgctgt

SEQ ID NO: 335193 - DNA, 16 bp, C. familiaris
ttttgctcattaaaaa

SEQ ID NO: 335194 - DNA, 16 bp, C. familiaris
ttttgctgatctgttc

SEQ ID NO: 335195 - DNA, 16 bp, C. familiaris
ttttgctgcgcagaag

SEQ ID NO: 335196 - DNA, 16 bp, C. familiaris
ttttgctgttacaaat

SEQ ID NO: 335197 - DNA, 16 bp, C. familiaris
ttttgcttcattttaa

SEQ ID NO: 335198 - DNA, 16 bp, C. familiaris
ttttgcttcctaaatt

SEQ ID NO: 335199 - DNA, 16 bp, C. familiaris
ttttgcttttattgcc

SEQ ID NO: 335200 - DNA, 16 bp, C. familiaris
ttttggaaaagaacaa

SEQ ID NO: 335201 - DNA, 16 bp, C. familiaris
ttttggaaaagaagaa

SEQ ID NO: 335202 - DNA, 16 bp, C. familiaris
ttttggaaaatgaaaa

SEQ ID NO: 335203 - DNA, 16 bp, C. familiaris
ttttggaaataaagtt

SEQ ID NO: 335204 - DNA, 16 bp, C. familiaris
ttttggaaatgaaaaa

SEQ ID NO: 335205 - DNA, 16 bp, C. familiaris
ttttggaacagtttca

SEQ ID NO: 335206 - DNA, 16 bp, C. familiaris
ttttggaacagtttga

SEQ ID NO: 335207 - DNA, 16 bp, C. familiaris
ttttggaacattttca

SEQ ID NO: 335208 - DNA, 16 bp, C. familiaris
ttttggaagaagaaaa

SEQ ID NO: 335209 - DNA, 16 bp, C. familiaris
ttttggaagagtttaa

SEQ ID NO: 335210 - DNA, 16 bp, C. familiaris
ttttggaagcaaagtt

SEQ ID NO: 335211 - DNA, 16 bp, C. familiaris
ttttggaagctggaaa

SEQ ID NO: 335212 - DNA, 16 bp, C. familiaris
ttttggaataaataaa

SEQ ID NO: 335213 - DNA, 16 bp, C. familiaris
ttttggaatcaaagta

SEQ ID NO: 335214 - DNA, 16 bp, C. familiaris
ttttggagaaaaataa

SEQ ID NO: 335215 - DNA, 16 bp, C. familiaris
ttttggagaaaaatat

SEQ ID NO: 335216 - DNA, 16 bp, C. familiaris
ttttggagaaagaaat

SEQ ID NO: 335217 - DNA, 16 bp, C. familiaris
ttttggagaaagagaa

SEQ ID NO: 335218 - DNA, 16 bp, C. familiaris
ttttggagaaagagag

SEQ ID NO: 335219 - DNA, 16 bp, C. familiaris
ttttggaggaacttcc

SEQ ID NO: 335220 - DNA, 16 bp, C. familiaris
ttttggaggtgatgaa

SEQ ID NO: 335221 - DNA, 16 bp, C. familiaris
ttttggatgaaattaa

SEQ ID NO: 335222 - DNA, 20 bp, C. familiaris
ttttggccactctgcactga

SEQ ID NO: 335223 - DNA, 16 bp, C. familiaris
ttttggctattacaaa

SEQ ID NO: 335224 - DNA, 16 bp, C. familiaris
ttttggctgttgagtt

SEQ ID NO: 335225 - DNA, 16 bp, C. familiaris
ttttggctttttaaaa

SEQ ID NO: 335226 - DNA, 16 bp, C. familiaris
ttttgggatgcctggg

SEQ ID NO: 335227 - DNA, 16 bp, C. familiaris
ttttgggatgttgagt

SEQ ID NO: 335228 - DNA, 16 bp, C. familiaris
ttttggggatgatgga

SEQ ID NO: 335229 - DNA, 16 bp, C. familiaris
ttttggggatgcctgg

SEQ ID NO: 335230 - DNA, 16 bp, C. familiaris
ttttgggggaaataaa

SEQ ID NO: 335231 - DNA, 16 bp, C. familiaris
ttttggtagaaattga

SEQ ID NO: 335232 - DNA, 16 bp, C. familiaris
ttttggtatcaaggtt

SEQ ID NO: 335233 - DNA, 16 bp, C. familiaris
ttttggtggagacttt

SEQ ID NO: 335234 - DNA, 16 bp, C. familiaris
ttttggtggaggcttt

SEQ ID NO: 335235 - DNA, 16 bp, C. familiaris
ttttgtaaaagtaaaa

SEQ ID NO: 335236 - DNA, 16 bp, C. familiaris
ttttgtaaacatttta

SEQ ID NO: 335237 - DNA, 16 bp, C. familiaris
ttttgtcaaattttct

SEQ ID NO: 335238 - DNA, 16 bp, C. familiaris
ttttgtccagtgcaga

SEQ ID NO: 335239 - DNA, 16 bp, C. familiaris
ttttgtctatggtgta

SEQ ID NO: 335240 - DNA, 16 bp, C. familiaris
ttttgtctcagatcat

SEQ ID NO: 335241 - DNA, 16 bp, C. familiaris
ttttgtcttctttaaa

SEQ ID NO: 335242 - DNA, 16 bp, C. familiaris
ttttgtcttttgaaaa

SEQ ID NO: 335243 - DNA, 16 bp, C. familiaris
ttttgtgagagagaga

SEQ ID NO: 335244 - DNA, 16 bp, C. familiaris
ttttgtgaggaaaaaa

SEQ ID NO: 335245 - DNA, 16 bp, C. familiaris
ttttgtgccaggacca

SEQ ID NO: 335246 - DNA, 16 bp, C. familiaris
ttttgtggatgaagaa

SEQ ID NO: 335247 - DNA, 16 bp, C. familiaris
ttttgtggattctttg

SEQ ID NO: 335248 - DNA, 16 bp, C. familiaris
ttttgtggtgagaaca

SEQ ID NO: 335249 - DNA, 16 bp, C. familiaris
ttttgtgtctggcttc

SEQ ID NO: 335250 - DNA, 16 bp, C. familiaris
ttttgttctttctcag

SEQ ID NO: 335251 - DNA, 16 bp, C. familiaris
ttttgttgaaaataat

SEQ ID NO: 335252 - DNA, 16 bp, C. familiaris
ttttgttgatgctttc

SEQ ID NO: 335253 - DNA, 16 bp, C. familiaris
ttttgttgttgaaaat

SEQ ID NO: 335254 - DNA, 16 bp, C. familiaris
ttttgtttctcttgga

SEQ ID NO: 335255 - DNA, 16 bp, C. familiaris
ttttgtttcttaaact

SEQ ID NO: 335256 - DNA, 16 bp, C. familiaris
ttttgttttaatctaa

SEQ ID NO: 335257 - DNA, 16 bp, C. familiaris
ttttgttttccacatt

SEQ ID NO: 335258 - DNA, 16 bp, C. familiaris
ttttgttttctgagaa

SEQ ID NO: 335259 - DNA, 16 bp, C. familiaris
ttttgtttttctccaa

SEQ ID NO: 335260 - DNA, 16 bp, C. familiaris
ttttgtttttgaagaa

SEQ ID NO: 335261 - DNA, 16 bp, C. familiaris
tttttaaaaaactgtt

SEQ ID NO: 335262 - DNA, 16 bp, C. familiaris
tttttaaaaaaggaat

SEQ ID NO: 335263 - DNA, 16 bp, C. familiaris
tttttaaaaaatatgg

SEQ ID NO: 335264 - DNA, 16 bp, C. familiaris
tttttaaaaaatctga

SEQ ID NO: 335265 - DNA, 16 bp, C. familiaris
tttttaaaaaatggaa

SEQ ID NO: 335266 - DNA, 16 bp, C. familiaris
tttttaaaaactcatt

SEQ ID NO: 335267 - DNA, 16 bp, C. familiaris
tttttaaaaagcaaat

SEQ ID NO: 335268 - DNA, 16 bp, C. familiaris
tttttaaaaagccaat

SEQ ID NO: 335269 - DNA, 16 bp, C. familiaris
tttttaaaaagctttt

SEQ ID NO: 335270 - DNA, 16 bp, C. familiaris
tttttaaaaaggtgtt

SEQ ID NO: 335271 - DNA, 16 bp, C. familiaris
tttttaaaaatcagga

SEQ ID NO: 335272 - DNA, 16 bp, C. familiaris
tttttaaaaatccaga

SEQ ID NO: 335273 - DNA, 16 bp, C. familiaris
tttttaaaaatgcaga

SEQ ID NO: 335274 - DNA, 16 bp, C. familiaris
tttttaaaaattcagt

SEQ ID NO: 335275 - DNA, 16 bp, C. familiaris
tttttaaaacttttga

SEQ ID NO: 335276 - DNA, 16 bp, C. familiaris
tttttaaaagaaaact

SEQ ID NO: 335277 - DNA, 16 bp, C. familiaris
tttttaaaagaaacat

SEQ ID NO: 335278 - DNA, 16 bp, C. familiaris
tttttaaaagatagaa

SEQ ID NO: 335279 - DNA, 16 bp, C. familiaris
tttttaaaagatatca

SEQ ID NO: 335280 - DNA, 16 bp, C. familiaris
tttttaaaagcaaaaa

SEQ ID NO: 335281 - DNA, 16 bp, C. familiaris
tttttaaaagcaattc

SEQ ID NO: 335282 - DNA, 16 bp, C. familiaris
tttttaaaagctgttt

SEQ ID NO: 335283 - DNA, 16 bp, C. familiaris
tttttaaaaggagata

SEQ ID NO: 335284 - DNA, 16 bp, C. familiaris
tttttaaaaggtaaaa

SEQ ID NO: 335285 - DNA, 16 bp, C. familiaris
tttttaaaagtaaagt

SEQ ID NO: 335286 - DNA, 16 bp, C. familiaris
tttttaaaagtcagat

SEQ ID NO: 335287 - DNA, 16 bp, C. familiaris
tttttaaaagttaaac

SEQ ID NO: 335288 - DNA, 16 bp, C. familiaris
tttttaaaatgaagaa

SEQ ID NO: 335289 - DNA, 16 bp, C. familiaris
tttttaaaatgatact

SEQ ID NO: 335290 - DNA, 16 bp, C. familiaris
tttttaaaatggaaaa

SEQ ID NO: 335291 - DNA, 16 bp, C. familiaris
tttttaaaattcagtt

SEQ ID NO: 335292 - DNA, 16 bp, C. familiaris
tttttaaacaaaatga

SEQ ID NO: 335293 - DNA, 16 bp, C. familiaris
tttttaaacagaaaat

SEQ ID NO: 335294 - DNA, 16 bp, C. familiaris
tttttaaacagctttt

SEQ ID NO: 335295 - DNA, 16 bp, C. familiaris
tttttaaactacagaa

SEQ ID NO: 335296 - DNA, 16 bp, C. familiaris
tttttaaactatgaaa

SEQ ID NO: 335297 - DNA, 16 bp, C. familiaris
tttttaaagaaaaact

SEQ ID NO: 335298 - DNA, 16 bp, C. familiaris
tttttaaagaaaacat

SEQ ID NO: 335299 - DNA, 16 bp, C. familiaris
tttttaaagaaacaca

SEQ ID NO: 335300 - DNA, 16 bp, C. familiaris
tttttaaagaaatcta

SEQ ID NO: 335301 - DNA, 16 bp, C. familiaris
tttttaaagaaatgat

SEQ ID NO: 335302 - DNA, 16 bp, C. familiaris
tttttaaagaaatgtt

SEQ ID NO: 335303 - DNA, 16 bp, C. familiaris
tttttaaagaaattga

SEQ ID NO: 335304 - DNA, 16 bp, C. familiaris
tttttaaagaagtaaa

SEQ ID NO: 335305 - DNA, 16 bp, C. familiaris
tttttaaagaattcat

SEQ ID NO: 335306 - DNA, 16 bp, C. familiaris
tttttaaagacagaaa

SEQ ID NO: 335307 - DNA, 16 bp, C. familiaris
tttttaaagaggaaaa

SEQ ID NO: 335308 - DNA, 16 bp, C. familiaris
tttttaaagatgatat

SEQ ID NO: 335309 - DNA, 16 bp, C. familiaris
tttttaaagattcttt

SEQ ID NO: 335310 - DNA, 16 bp, C. familiaris
tttttaaagcaaaata

SEQ ID NO: 335311 - DNA, 16 bp, C. familiaris
tttttaaaggaaatct

SEQ ID NO: 335312 - DNA, 16 bp, C. familiaris
tttttaaaggaataaa

SEQ ID NO: 335313 - DNA, 16 bp, C. familiaris
tttttaaaggataaaa

SEQ ID NO: 335314 - DNA, 16 bp, C. familiaris
tttttaaagtctttaa

SEQ ID NO: 335315 - DNA, 16 bp, C. familiaris
tttttaaagtgacttt

SEQ ID NO: 335316 - DNA, 16 bp, C. familiaris
tttttaaagtgttgaa

SEQ ID NO: 335317 - DNA, 16 bp, C. familiaris
tttttaaagttaactt

SEQ ID NO: 335318 - DNA, 16 bp, C. familiaris
tttttaaagttctcca

SEQ ID NO: 335319 - DNA, 16 bp, C. familiaris
tttttaaagtttcaag

SEQ ID NO: 335320 - DNA, 16 bp, C. familiaris
tttttaaataagcatt

SEQ ID NO: 335321 - DNA, 16 bp, C. familiaris
tttttaaataatggaa

SEQ ID NO: 335322 - DNA, 16 bp, C. familiaris
tttttaaatagcttta

SEQ ID NO: 335323 - DNA, 16 bp, C. familiaris
tttttaaatattgctt

SEQ ID NO: 335324 - DNA, 16 bp, C. familiaris
tttttaaatcaaggaa

SEQ ID NO: 335325 - DNA, 16 bp, C. familiaris
tttttaaatctgaatt

SEQ ID NO: 335326 - DNA, 16 bp, C. familiaris
tttttaaatctgagaa

SEQ ID NO: 335327 - DNA, 16 bp, C. familiaris
tttttaaatcttagaa

SEQ ID NO: 335328 - DNA, 16 bp, C. familiaris
tttttaaatgaaagtt

SEQ ID NO: 335329 - DNA, 16 bp, C. familiaris
tttttaaatgaatgga

SEQ ID NO: 335330 - DNA, 16 bp, C. familiaris
tttttaaatgaattct

SEQ ID NO: 335331 - DNA, 16 bp, C. familiaris
tttttaaatgtcttta

SEQ ID NO: 335332 - DNA, 16 bp, C. familiaris
tttttaaatgtgctgt

SEQ ID NO: 335333 - DNA, 16 bp, C. familiaris
tttttaaatttacaga

SEQ ID NO: 335334 - DNA, 16 bp, C. familiaris
tttttaaatttcctgt

SEQ ID NO: 335335 - DNA, 16 bp, C. familiaris
tttttaacaaagaaaa

SEQ ID NO: 335336 - DNA, 16 bp, C. familiaris
tttttaactcttgagg

SEQ ID NO: 335337 - DNA, 16 bp, C. familiaris
tttttaagaaaacaca

SEQ ID NO: 335338 - DNA, 16 bp, C. familiaris
tttttaagaaagattt

SEQ ID NO: 335339 - DNA, 16 bp, C. familiaris
tttttaagaatacttt

SEQ ID NO: 335340 - DNA, 16 bp, C. familiaris
tttttaagactttact

SEQ ID NO: 335341 - DNA, 16 bp, C. familiaris
tttttaagcaatttct

SEQ ID NO: 335342 - DNA, 16 bp, C. familiaris
tttttaagcattttat

SEQ ID NO: 335343 - DNA, 16 bp, C. familiaris
tttttaaggaaacatt

SEQ ID NO: 335344 - DNA, 16 bp, C. familiaris
tttttaaggaatctct

SEQ ID NO: 335345 - DNA, 16 bp, C. familiaris
tttttaagggagaaaa

SEQ ID NO: 335346 - DNA, 16 bp, C. familiaris
tttttaataagtctgg

SEQ ID NO: 335347 - DNA, 16 bp, C. familiaris
tttttaatacagaaaa

SEQ ID NO: 335348 - DNA, 16 bp, C. familiaris
tttttaatcagaaaat

SEQ ID NO: 335349 - DNA, 16 bp, C. familiaris
tttttaatgaaatgat

SEQ ID NO: 335350 - DNA, 16 bp, C. familiaris
tttttaatgaagtgtt

SEQ ID NO: 335351 - DNA, 16 bp, C. familiaris
tttttaatgacatttt

SEQ ID NO: 335352 - DNA, 57 bp, C. familiaris
tttttaatggaaacaacttgaccaaaaatctgtcacagaattttgagacccattaaa

SEQ ID NO: 335353 - DNA, 16 bp, C. familiaris
tttttaatggagattt

SEQ ID NO: 335354 - DNA, 16 bp, C. familiaris
tttttaatgttcaaaa

SEQ ID NO: 335355 - DNA, 16 bp, C. familiaris
tttttaatgtttcaag

SEQ ID NO: 335356 - DNA, 16 bp, C. familiaris
tttttaatgttttcag

SEQ ID NO: 335357 - DNA, 16 bp, C. familiaris
tttttaattttgacaa

SEQ ID NO: 335358 - DNA, 16 bp, C. familiaris
tttttacaaaaagaaa

SEQ ID NO: 335359 - DNA, 16 bp, C. familiaris
tttttacaaaggtgca

SEQ ID NO: 335360 - DNA, 16 bp, C. familiaris
tttttacaaataaaga

SEQ ID NO: 335361 - DNA, 16 bp, C. familiaris
tttttacagaaatgga

SEQ ID NO: 335362 - DNA, 16 bp, C. familiaris
tttttacatatatgtt

SEQ ID NO: 335363 - DNA, 16 bp, C. familiaris
tttttagaaaacagaa

SEQ ID NO: 335364 - DNA, 16 bp, C. familiaris
tttttagaaacataca

SEQ ID NO: 335365 - DNA, 16 bp, C. familiaris
tttttagaagaaaaat

SEQ ID NO: 335366 - DNA, 16 bp, C. familiaris
tttttagaagtaaaat

SEQ ID NO: 335367 - DNA, 16 bp, C. familiaris
tttttagacaaagaga

SEQ ID NO: 335368 - DNA, 16 bp, C. familiaris
tttttagattccacat

SEQ ID NO: 335369 - DNA, 16 bp, C. familiaris
tttttagtaaatttac

SEQ ID NO: 335370 - DNA, 16 bp, C. familiaris
tttttataaatgtctt

SEQ ID NO: 335371 - DNA, 16 bp, C. familiaris
tttttataatgaatgg

SEQ ID NO: 335372 - DNA, 16 bp, C. familiaris
tttttatagaaaagaa

SEQ ID NO: 335373 - DNA, 16 bp, C. familiaris
tttttatattccccaa

SEQ ID NO: 335374 - DNA, 16 bp, C. familiaris
tttttatcaggaaagg

SEQ ID NO: 335375 - DNA, 16 bp, C. familiaris
tttttatcttgaaatt

SEQ ID NO: 335376 - DNA, 16 bp, C. familiaris
tttttatgaagaaaaa

SEQ ID NO: 335377 - DNA, 16 bp, C. familiaris
tttttatggaaaaaaa

SEQ ID NO: 335378 - DNA, 16 bp, C. familiaris
tttttatggaaaaaat

SEQ ID NO: 335379 - DNA, 16 bp, C. familiaris
tttttattaaaagaag

SEQ ID NO: 335380 - DNA, 16 bp, C. familiaris
tttttattcagcattt

SEQ ID NO: 335381 - DNA, 16 bp, C. familiaris
tttttattgagcactt

SEQ ID NO: 335382 - DNA, 16 bp, C. familiaris
tttttattggaaaaat

SEQ ID NO: 335383 - DNA, 16 bp, C. familiaris
tttttattggatgcca

SEQ ID NO: 335384 - DNA, 16 bp, C. familiaris
tttttattttgacata

SEQ ID NO: 335385 - DNA, 16 bp, C. familiaris
tttttcaaaaaatggt

SEQ ID NO: 335386 - DNA, 16 bp, C. familiaris
tttttcaaaaaggatt

SEQ ID NO: 335387 - DNA, 16 bp, C. familiaris
tttttcaaaaggaaaa

SEQ ID NO: 335388 - DNA, 16 bp, C. familiaris
tttttcaaagcttttt

SEQ ID NO: 335389 - DNA, 16 bp, C. familiaris
tttttcaaagtatttg

SEQ ID NO: 335390 - DNA, 16 bp, C. familiaris
tttttcaaataagttt

SEQ ID NO: 335391 - DNA, 16 bp, C. familiaris
tttttcaaatgccttt

SEQ ID NO: 335392 - DNA, 16 bp, C. familiaris
tttttcaaattcagaa

SEQ ID NO: 335393 - DNA, 16 bp, C. familiaris
tttttcaagattgctt

SEQ ID NO: 335394 - DNA, 16 bp, C. familiaris
tttttcaaggaatttt

SEQ ID NO: 335395 - DNA, 16 bp, C. familiaris
tttttcaagtgtctgt

SEQ ID NO: 335396 - DNA, 16 bp, C. familiaris
tttttcaagttcacat

SEQ ID NO: 335397 - DNA, 16 bp, C. familiaris
tttttcaataatgttt

SEQ ID NO: 335398 - DNA, 16 bp, C. familiaris
tttttcacagcaaaag

SEQ ID NO: 335399 - DNA, 16 bp, C. familiaris
tttttcacattttaca

SEQ ID NO: 335400 - DNA, 16 bp, C. familiaris
tttttcacttaacatt

SEQ ID NO: 335401 - DNA, 16 bp, C. familiaris
tttttcagaaaaaaaa

SEQ ID NO: 335402 - DNA, 16 bp, C. familiaris
tttttcagaaaaaaat

SEQ ID NO: 335403 - DNA, 16 bp, C. familiaris
tttttcagaaaaagaa

SEQ ID NO: 335404 - DNA, 16 bp, C. familiaris
tttttcagaaaataaa

SEQ ID NO: 335405 - DNA, 16 bp, C. familiaris
tttttcagaaaatttg

SEQ ID NO: 335406 - DNA, 16 bp, C. familiaris
tttttcagaatattct

SEQ ID NO: 335407 - DNA, 16 bp, C. familiaris
tttttcagaatcattt

SEQ ID NO: 335408 - DNA, 16 bp, C. familiaris
tttttcagactttctt

SEQ ID NO: 335409 - DNA, 16 bp, C. familiaris
tttttcagagaagaaa

SEQ ID NO: 335410 - DNA, 16 bp, C. familiaris
tttttcagatttcctt

SEQ ID NO: 335411 - DNA, 16 bp, C. familiaris
tttttcagtttattca

SEQ ID NO: 335412 - DNA, 16 bp, C. familiaris
tttttcatatgaaaaa

SEQ ID NO: 335413 - DNA, 16 bp, C. familiaris
tttttcatcagtgttt

SEQ ID NO: 335414 - DNA, 16 bp, C. familiaris
tttttcatgattttaa

SEQ ID NO: 335415 - DNA, 16 bp, C. familiaris
tttttcatgtgtctgt

SEQ ID NO: 335416 - DNA, 16 bp, C. familiaris
tttttcattaaaatgt

SEQ ID NO: 335417 - DNA, 16 bp, C. familiaris
tttttcattttatgaa

SEQ ID NO: 335418 - DNA, 16 bp, C. familiaris
tttttccaaaaagaaa

SEQ ID NO: 335419 - DNA, 16 bp, C. familiaris
tttttccaaacaagac

SEQ ID NO: 335420 - DNA, 16 bp, C. familiaris
tttttccaaagttttt

SEQ ID NO: 335421 - DNA, 16 bp, C. familiaris
tttttccagatttatt

SEQ ID NO: 335422 - DNA, 16 bp, C. familiaris
tttttccagtaccatt

SEQ ID NO: 335423 - DNA, 16 bp, C. familiaris
tttttccagtttttga

SEQ ID NO: 335424 - DNA, 16 bp, C. familiaris
tttttcccagaaaaaa

SEQ ID NO: 335425 - DNA, 16 bp, C. familiaris
tttttcccagcaccat

SEQ ID NO: 335426 - DNA, 16 bp, C. familiaris
tttttccccaaagaaa

SEQ ID NO: 335427 - DNA, 16 bp, C. familiaris
tttttccccctttgga

SEQ ID NO: 335428 - DNA, 16 bp, C. familiaris
tttttcccctttgaaa

SEQ ID NO: 335429 - DNA, 16 bp, C. familiaris
tttttccctttctgat

SEQ ID NO: 335430 - DNA, 16 bp, C. familiaris
tttttccttagaattt

SEQ ID NO: 335431 - DNA, 16 bp, C. familiaris
tttttccttcagtttc

SEQ ID NO: 335432 - DNA, 16 bp, C. familiaris
tttttccttccaaatt

SEQ ID NO: 335433 - DNA, 16 bp, C. familiaris
tttttccttctgagtt

SEQ ID NO: 335434 - DNA, 16 bp, C. familiaris
tttttcctttaaaaca

SEQ ID NO: 335435 - DNA, 16 bp, C. familiaris
tttttcctttatggat

SEQ ID NO: 335436 - DNA, 16 bp, C. familiaris
tttttcctttttggaa

SEQ ID NO: 335437 - DNA, 16 bp, C. familiaris
tttttctaaagaagat

SEQ ID NO: 335438 - DNA, 16 bp, C. familiaris
tttttctaaagatgtt

SEQ ID NO: 335439 - DNA, 16 bp, C. familiaris
tttttctattcctgtg

SEQ ID NO: 335440 - DNA, 16 bp, C. familiaris
tttttctcccattctg

SEQ ID NO: 335441 - DNA, 16 bp, C. familiaris
tttttctcctgagttt

SEQ ID NO: 335442 - DNA, 16 bp, C. familiaris
tttttctcttccagaa

SEQ ID NO: 335443 - DNA, 16 bp, C. familiaris
tttttctgaagatttt

SEQ ID NO: 335444 - DNA, 16 bp, C. familiaris
tttttctgacatattt

SEQ ID NO: 335445 - DNA, 16 bp, C. familiaris
tttttctgagaaaaaa

SEQ ID NO: 335446 - DNA, 16 bp, C. familiaris
tttttctgatgaaatt

SEQ ID NO: 335447 - DNA, 16 bp, C. familiaris
tttttctgattccaaa

SEQ ID NO: 335448 - DNA, 16 bp, C. familiaris
tttttctggaataaat

SEQ ID NO: 335449 - DNA, 16 bp, C. familiaris
tttttctggagatttt

SEQ ID NO: 335450 - DNA, 16 bp, C. familiaris
tttttctgttaaaaat

SEQ ID NO: 335451 - DNA, 16 bp, C. familiaris
tttttctgtttataaa

SEQ ID NO: 335452 - DNA, 16 bp, C. familiaris
tttttcttaaagaagg

SEQ ID NO: 335453 - DNA, 16 bp, C. familiaris
tttttcttaaagcatt

SEQ ID NO: 335454 - DNA, 16 bp, C. familiaris
tttttcttaagaaata

SEQ ID NO: 335455 - DNA, 16 bp, C. familiaris
tttttcttacacaaaa

SEQ ID NO: 335456 - DNA, 16 bp, C. familiaris
tttttcttcagaaaaa

SEQ ID NO: 335457 - DNA, 16 bp, C. familiaris
tttttcttctttgaaa

SEQ ID NO: 335458 - DNA, 16 bp, C. familiaris
tttttctttaataaag

SEQ ID NO: 335459 - DNA, 16 bp, C. familiaris
tttttctttatagaaa

SEQ ID NO: 335460 - DNA, 16 bp, C. familiaris
tttttctttcaaaaaa

SEQ ID NO: 335461 - DNA, 16 bp, C. familiaris
tttttctttcaaagat

SEQ ID NO: 335462 - DNA, 20 bp, C. familiaris
tttttctttctcaggctgtc

SEQ ID NO: 335463 - DNA, 16 bp, C. familiaris
tttttctttgagaggg

SEQ ID NO: 335464 - DNA, 16 bp, C. familiaris
tttttctttgataaaa

SEQ ID NO: 335465 - DNA, 16 bp, C. familiaris
tttttctttttgagga

SEQ ID NO: 335466 - DNA, 16 bp, C. familiaris
tttttgaaaatatcaa

SEQ ID NO: 335467 - DNA, 16 bp, C. familiaris
tttttgaaaatctgtt

SEQ ID NO: 335468 - DNA, 16 bp, C. familiaris
tttttgaaagaaagaa

SEQ ID NO: 335469 - DNA, 16 bp, C. familiaris
tttttgaaagaaatta

SEQ ID NO: 335470 - DNA, 16 bp, C. familiaris
tttttgaaagaaattt

SEQ ID NO: 335471 - DNA, 16 bp, C. familiaris
tttttgaaagatgaaa

SEQ ID NO: 335472 - DNA, 16 bp, C. familiaris
tttttgaagaagaaga

SEQ ID NO: 335473 - DNA, 16 bp, C. familiaris
tttttgaagagaaaaa

SEQ ID NO: 335474 - DNA, 16 bp, C. familiaris
tttttgaatttcatat

SEQ ID NO: 335475 - DNA, 16 bp, C. familiaris
tttttgacaaggatgc

SEQ ID NO: 335476 - DNA, 16 bp, C. familiaris
tttttgactcagccca

SEQ ID NO: 335477 - DNA, 16 bp, C. familiaris
tttttgaggaagcttc

SEQ ID NO: 335478 - DNA, 16 bp, C. familiaris
tttttgagttaaaaat

SEQ ID NO: 335479 - DNA, 16 bp, C. familiaris
tttttgatgacttctt

SEQ ID NO: 335480 - DNA, 16 bp, C. familiaris
tttttgatgattgctt

SEQ ID NO: 335481 - DNA, 16 bp, C. familiaris
tttttgcaaaaaaaaa

SEQ ID NO: 335482 - DNA, 16 bp, C. familiaris
tttttgcaagatgaaa

SEQ ID NO: 335483 - DNA, 16 bp, C. familiaris
tttttgcaattataaa

SEQ ID NO: 335484 - DNA, 16 bp, C. familiaris
tttttgcagaaattga

SEQ ID NO: 335485 - DNA, 16 bp, C. familiaris
tttttgcatatgatgt

SEQ ID NO: 335486 - DNA, 16 bp, C. familiaris
tttttgccattctgat

SEQ ID NO: 335487 - DNA, 16 bp, C. familiaris
tttttgccatttttaa

SEQ ID NO: 335488 - DNA, 16 bp, C. familiaris
tttttgctactgagtt

SEQ ID NO: 335489 - DNA, 16 bp, C. familiaris
tttttgctggtggaga

SEQ ID NO: 335490 - DNA, 16 bp, C. familiaris
tttttggaaaagaaat

SEQ ID NO: 335491 - DNA, 16 bp, C. familiaris
tttttggaaaagattt

SEQ ID NO: 335492 - DNA, 16 bp, C. familiaris
tttttggaaagaattt

SEQ ID NO: 335493 - DNA, 16 bp, C. familiaris
tttttggaagaaaaat

SEQ ID NO: 335494 - DNA, 16 bp, C. familiaris
tttttgggaagtcaaa

SEQ ID NO: 335495 - DNA, 16 bp, C. familiaris
tttttggggggatccc

SEQ ID NO: 335496 - DNA, 16 bp, C. familiaris
tttttggtggattctt

SEQ ID NO: 335497 - DNA, 16 bp, C. familiaris
tttttgtacattttga

SEQ ID NO: 335498 - DNA, 16 bp, C. familiaris
tttttgtataaagtgt

SEQ ID NO: 335499 - DNA, 16 bp, C. familiaris
tttttgtctgggaaac

SEQ ID NO: 335500 - DNA, 16 bp, C. familiaris
tttttgtgaataaagt

SEQ ID NO: 335501 - DNA, 16 bp, C. familiaris
tttttgttgaaattct

SEQ ID NO: 335502 - DNA, 16 bp, C. familiaris
ttttttaaaaaagcat

SEQ ID NO: 335503 - DNA, 16 bp, C. familiaris
ttttttaaaaacagct

SEQ ID NO: 335504 - DNA, 16 bp, C. familiaris
ttttttaaaacacaaa

SEQ ID NO: 335505 - DNA, 16 bp, C. familiaris
ttttttaaaagccata

SEQ ID NO: 335506 - DNA, 16 bp, C. familiaris
ttttttaaaagtaaga

SEQ ID NO: 335507 - DNA, 16 bp, C. familiaris
ttttttaaaatggaaa

SEQ ID NO: 335508 - DNA, 16 bp, C. familiaris
ttttttaaacaaaatg

SEQ ID NO: 335509 - DNA, 16 bp, C. familiaris
ttttttaaacatgaaa

SEQ ID NO: 335510 - DNA, 16 bp, C. familiaris
ttttttaaagaaaaga

SEQ ID NO: 335511 - DNA, 16 bp, C. familiaris
ttttttaaagaccaaa

SEQ ID NO: 335512 - DNA, 16 bp, C. familiaris
ttttttaaagagaaaa

SEQ ID NO: 335513 - DNA, 16 bp, C. familiaris
ttttttaaagattgag

SEQ ID NO: 335514 - DNA, 16 bp, C. familiaris
ttttttaaagcaggaa

SEQ ID NO: 335515 - DNA, 16 bp, C. familiaris
ttttttaaagggagaa

SEQ ID NO: 335516 - DNA, 16 bp, C. familiaris
ttttttaaagtgaaga

SEQ ID NO: 335517 - DNA, 16 bp, C. familiaris
ttttttaaatattctg

SEQ ID NO: 335518 - DNA, 16 bp, C. familiaris
ttttttaaatgacctt

SEQ ID NO: 335519 - DNA, 16 bp, C. familiaris
ttttttaaattaaagg

SEQ ID NO: 335520 - DNA, 16 bp, C. familiaris
ttttttaaattccaca

SEQ ID NO: 335521 - DNA, 16 bp, C. familiaris
ttttttaacagaaata

SEQ ID NO: 335522 - DNA, 16 bp, C. familiaris
ttttttaagaaaaaga

SEQ ID NO: 335523 - DNA, 16 bp, C. familiaris
ttttttaagaaagaaa

SEQ ID NO: 335524 - DNA, 16 bp, C. familiaris
ttttttaagaaagatt

SEQ ID NO: 335525 - DNA, 16 bp, C. familiaris
ttttttaaggaaactt

SEQ ID NO: 335526 - DNA, 16 bp, C. familiaris
ttttttaaggacttta

SEQ ID NO: 335527 - DNA, 16 bp, C. familiaris
ttttttaaggataaaa

SEQ ID NO: 335528 - DNA, 16 bp, C. familiaris
ttttttaagggaaaga

SEQ ID NO: 335529 - DNA, 16 bp, C. familiaris
ttttttaagtgaggaa

SEQ ID NO: 335530 - DNA, 16 bp, C. familiaris
ttttttaataaagctt

SEQ ID NO: 335531 - DNA, 16 bp, C. familiaris
ttttttaatcatgaaa

SEQ ID NO: 335532 - DNA, 16 bp, C. familiaris
ttttttaattagaaga

SEQ ID NO: 335533 - DNA, 16 bp, C. familiaris
ttttttaattctatga

SEQ ID NO: 335534 - DNA, 16 bp, C. familiaris
ttttttacaaaagaaa

SEQ ID NO: 335535 - DNA, 16 bp, C. familiaris
ttttttaccttttgaa

SEQ ID NO: 335536 - DNA, 16 bp, C. familiaris
ttttttagaaattgaa

SEQ ID NO: 335537 - DNA, 16 bp, C. familiaris
ttttttagaagtaaaa

SEQ ID NO: 335538 - DNA, 16 bp, C. familiaris
ttttttagatgagatt

SEQ ID NO: 335539 - DNA, 16 bp, C. familiaris
ttttttaggaaaaaaa

SEQ ID NO: 335540 - DNA, 16 bp, C. familiaris
ttttttatattccaca

SEQ ID NO: 335541 - DNA, 16 bp, C. familiaris
ttttttatccagtttg

SEQ ID NO: 335542 - DNA, 16 bp, C. familiaris
ttttttatctgaaatt

SEQ ID NO: 335543 - DNA, 16 bp, C. familiaris
ttttttatggaaaaaa

SEQ ID NO: 335544 - DNA, 16 bp, C. familiaris
ttttttattccaaaaa

SEQ ID NO: 335545 - DNA, 16 bp, C. familiaris
ttttttcaaaaagttt

SEQ ID NO: 335546 - DNA, 16 bp, C. familiaris
ttttttcaaacaaaat

SEQ ID NO: 335547 - DNA, 16 bp, C. familiaris
ttttttcaaagatttt

SEQ ID NO: 335548 - DNA, 16 bp, C. familiaris
ttttttcaagtaaaaa

SEQ ID NO: 335549 - DNA, 16 bp, C. familiaris
ttttttcagtctttaa

SEQ ID NO: 335550 - DNA, 16 bp, C. familiaris
ttttttccaaagattt

SEQ ID NO: 335551 - DNA, 16 bp, C. familiaris
ttttttccaagatttt

SEQ ID NO: 335552 - DNA, 16 bp, C. familiaris
ttttttccactttaaa

SEQ ID NO: 335553 - DNA, 16 bp, C. familiaris
ttttttccagagtggc

SEQ ID NO: 335554 - DNA, 16 bp, C. familiaris
ttttttccagataatt

SEQ ID NO: 335555 - DNA, 16 bp, C. familiaris
ttttttccagatttta

SEQ ID NO: 335556 - DNA, 16 bp, C. familiaris
ttttttccccaaatat

SEQ ID NO: 335557 - DNA, 16 bp, C. familiaris
ttttttccccagtgaa

SEQ ID NO: 335558 - DNA, 16 bp, C. familiaris
ttttttccccccataa

SEQ ID NO: 335559 - DNA, 16 bp, C. familiaris
ttttttcccctaataa

SEQ ID NO: 335560 - DNA, 16 bp, C. familiaris
ttttttcccttaaata

SEQ ID NO: 335561 - DNA, 16 bp, C. familiaris
ttttttcccttgaatt

SEQ ID NO: 335562 - DNA, 16 bp, C. familiaris
ttttttccctttaaaa

SEQ ID NO: 335563 - DNA, 16 bp, C. familiaris
ttttttccctttgaaa

SEQ ID NO: 335564 - DNA, 16 bp, C. familiaris
ttttttcctacaaaaa

SEQ ID NO: 335565 - DNA, 16 bp, C. familiaris
ttttttcctatggaaa

SEQ ID NO: 335566 - DNA, 16 bp, C. familiaris
ttttttcctcctcaaa

SEQ ID NO: 335567 - DNA, 16 bp, C. familiaris
ttttttcctgtgaaat

SEQ ID NO: 335568 - DNA, 16 bp, C. familiaris
ttttttccttgaagaa

SEQ ID NO: 335569 - DNA, 16 bp, C. familiaris
ttttttcctttggtaa

SEQ ID NO: 335570 - DNA, 16 bp, C. familiaris
ttttttctaaagaatt

SEQ ID NO: 335571 - DNA, 16 bp, C. familiaris
ttttttctcatgatta

SEQ ID NO: 335572 - DNA, 16 bp, C. familiaris
ttttttctccagctcc

SEQ ID NO: 335573 - DNA, 16 bp, C. familiaris
ttttttctcctcaaaa

SEQ ID NO: 335574 - DNA, 16 bp, C. familiaris
ttttttctgaaagaaa

SEQ ID NO: 335575 - DNA, 16 bp, C. familiaris
ttttttctgacaaaaa

SEQ ID NO: 335576 - DNA, 16 bp, C. familiaris
ttttttctgagaaata

SEQ ID NO: 335577 - DNA, 16 bp, C. familiaris
ttttttctgatttaaa

SEQ ID NO: 335578 - DNA, 16 bp, C. familiaris
ttttttctgggaaaaa

SEQ ID NO: 335579 - DNA, 16 bp, C. familiaris
ttttttcttaatggaa

SEQ ID NO: 335580 - DNA, 16 bp, C. familiaris
ttttttcttattgaaa

SEQ ID NO: 335581 - DNA, 16 bp, C. familiaris
ttttttcttcaaatac

SEQ ID NO: 335582 - DNA, 16 bp, C. familiaris
ttttttcttccctgat

SEQ ID NO: 335583 - DNA, 16 bp, C. familiaris
ttttttcttctaagag

SEQ ID NO: 335584 - DNA, 16 bp, C. familiaris
ttttttcttgaaaaaa

SEQ ID NO: 335585 - DNA, 16 bp, C. familiaris
ttttttgaaaatcagt

SEQ ID NO: 335586 - DNA, 16 bp, C. familiaris
ttttttgaagaacctc

SEQ ID NO: 335587 - DNA, 16 bp, C. familiaris
ttttttgaagagtttg

SEQ ID NO: 335588 - DNA, 16 bp, C. familiaris
ttttttgaagattctt

SEQ ID NO: 335589 - DNA, 16 bp, C. familiaris
ttttttgagaaaaatg

SEQ ID NO: 335590 - DNA, 16 bp, C. familiaris
ttttttgagaaatgaa

SEQ ID NO: 335591 - DNA, 16 bp, C. familiaris
ttttttgagagacaga

SEQ ID NO: 335592 - DNA, 16 bp, C. familiaris
ttttttgagcatctac

SEQ ID NO: 335593 - DNA, 16 bp, C. familiaris
ttttttgaggaatctc

SEQ ID NO: 335594 - DNA, 16 bp, C. familiaris
ttttttgaggtaaaat

SEQ ID NO: 335595 - DNA, 16 bp, C. familiaris
ttttttgcagatttta

SEQ ID NO: 335596 - DNA, 16 bp, C. familiaris
ttttttggaggaaaaa

SEQ ID NO: 335597 - DNA, 16 bp, C. familiaris
ttttttgggaagattt

SEQ ID NO: 335598 - DNA, 16 bp, C. familiaris
ttttttgggaggggga

SEQ ID NO: 335599 - DNA, 16 bp, C. familiaris
ttttttggtaaaatgt

SEQ ID NO: 335600 - DNA, 16 bp, C. familiaris
ttttttgtaaaagaaa

SEQ ID NO: 335601 - DNA, 16 bp, C. familiaris
ttttttgtcatttaaa

SEQ ID NO: 335602 - DNA, 16 bp, C. familiaris
ttttttgtgataagaa

SEQ ID NO: 335603 - DNA, 16 bp, C. familiaris
tttttttaaaaaagac

SEQ ID NO: 335604 - DNA, 16 bp, C. familiaris
tttttttaaaaaagga

SEQ ID NO: 335605 - DNA, 16 bp, C. familiaris
tttttttaaacatgat

SEQ ID NO: 335606 - DNA, 16 bp, C. familiaris
tttttttaaactgaaa

SEQ ID NO: 335607 - DNA, 16 bp, C. familiaris
tttttttaaagaagaa

SEQ ID NO: 335608 - DNA, 16 bp, C. familiaris
tttttttaaagaggaa

SEQ ID NO: 335609 - DNA, 16 bp, C. familiaris
tttttttaaagcactt

SEQ ID NO: 335610 - DNA, 16 bp, C. familiaris
tttttttaaagctctg

SEQ ID NO: 335611 - DNA, 16 bp, C. familiaris
tttttttaaatacatg

SEQ ID NO: 335612 - DNA, 16 bp, C. familiaris
tttttttaaatgagca

SEQ ID NO: 335613 - DNA, 16 bp, C. familiaris
tttttttaacaaaaca

SEQ ID NO: 335614 - DNA, 16 bp, C. familiaris
tttttttaagaacatt

SEQ ID NO: 335615 - DNA, 16 bp, C. familiaris
tttttttaagaatctt

SEQ ID NO: 335616 - DNA, 16 bp, C. familiaris
tttttttaagcaaata

SEQ ID NO: 335617 - DNA, 16 bp, C. familiaris
tttttttaagcaggaa

SEQ ID NO: 335618 - DNA, 16 bp, C. familiaris
tttttttaaggaaaaa

SEQ ID NO: 335619 - DNA, 16 bp, C. familiaris
tttttttaagtaaaga

SEQ ID NO: 335620 - DNA, 16 bp, C. familiaris
tttttttaagtcttaa

SEQ ID NO: 335621 - DNA, 16 bp, C. familiaris
tttttttaatcaggtt

SEQ ID NO: 335622 - DNA, 16 bp, C. familiaris
tttttttaatctactg

SEQ ID NO: 335623 - DNA, 16 bp, C. familiaris
tttttttaatggaatg

SEQ ID NO: 335624 - DNA, 16 bp, C. familiaris
tttttttacaaaagat

SEQ ID NO: 335625 - DNA, 16 bp, C. familiaris
tttttttacaagaaaa

SEQ ID NO: 335626 - DNA, 16 bp, C. familiaris
tttttttagaaaacta

SEQ ID NO: 335627 - DNA, 16 bp, C. familiaris
tttttttcaaaagcag

SEQ ID NO: 335628 - DNA, 16 bp, C. familiaris
tttttttcaaaggaaa

SEQ ID NO: 335629 - DNA, 16 bp, C. familiaris
tttttttcagatacat

SEQ ID NO: 335630 - DNA, 16 bp, C. familiaris
tttttttcaggtaaat

SEQ ID NO: 335631 - DNA, 16 bp, C. familiaris
tttttttcagtaatct

SEQ ID NO: 335632 - DNA, 16 bp, C. familiaris
tttttttcagtttcag

SEQ ID NO: 335633 - DNA, 16 bp, C. familiaris
tttttttcatttgaga

SEQ ID NO: 335634 - DNA, 16 bp, C. familiaris
tttttttccaatttgg

SEQ ID NO: 335635 - DNA, 16 bp, C. familiaris
tttttttccacttcag

SEQ ID NO: 335636 - DNA, 16 bp, C. familiaris
tttttttccagaaact

SEQ ID NO: 335637 - DNA, 16 bp, C. familiaris
tttttttccccaaact

SEQ ID NO: 335638 - DNA, 16 bp, C. familiaris
tttttttccccacact

SEQ ID NO: 335639 - DNA, 16 bp, C. familiaris
tttttttccccaggaa

SEQ ID NO: 335640 - DNA, 16 bp, C. familiaris
tttttttcccccagaa

SEQ ID NO: 335641 - DNA, 16 bp, C. familiaris
tttttttcccccattg

SEQ ID NO: 335642 - DNA, 16 bp, C. familiaris
tttttttccccctaaa

SEQ ID NO: 335643 - DNA, 16 bp, C. familiaris
tttttttcccccttag

SEQ ID NO: 335644 - DNA, 16 bp, C. familiaris
tttttttcccccttga

SEQ ID NO: 335645 - DNA, 16 bp, C. familiaris
tttttttcccctccaa

SEQ ID NO: 335646 - DNA, 16 bp, C. familiaris
tttttttcctcctggg

SEQ ID NO: 335647 - DNA, 16 bp, C. familiaris
tttttttcctgaaatt

SEQ ID NO: 335648 - DNA, 16 bp, C. familiaris
tttttttcctgaattg

SEQ ID NO: 335649 - DNA, 16 bp, C. familiaris
tttttttcctggagca

SEQ ID NO: 335650 - DNA, 16 bp, C. familiaris
tttttttccttccagt

SEQ ID NO: 335651 - DNA, 16 bp, C. familiaris
tttttttctcagaatg

SEQ ID NO: 335652 - DNA, 16 bp, C. familiaris
tttttttctctccaaa

SEQ ID NO: 335653 - DNA, 16 bp, C. familiaris
tttttttctctgaaag

SEQ ID NO: 335654 - DNA, 16 bp, C. familiaris
tttttttctcttgcca

SEQ ID NO: 335655 - DNA, 16 bp, C. familiaris
tttttttctgaaaaaa

SEQ ID NO: 335656 - DNA, 16 bp, C. familiaris
tttttttctggaaaat

SEQ ID NO: 335657 - DNA, 16 bp, C. familiaris
tttttttctggaaaca

SEQ ID NO: 335658 - DNA, 16 bp, C. familiaris
tttttttctggagaat

SEQ ID NO: 335659 - DNA, 16 bp, C. familiaris
tttttttcttaaaagt

SEQ ID NO: 335660 - DNA, 16 bp, C. familiaris
tttttttcttacagaa

SEQ ID NO: 335661 - DNA, 16 bp, C. familiaris
tttttttcttcacatg

SEQ ID NO: 335662 - DNA, 16 bp, C. familiaris
tttttttcttccagaa

SEQ ID NO: 335663 - DNA, 16 bp, C. familiaris
tttttttcttctcaga

SEQ ID NO: 335664 - DNA, 16 bp, C. familiaris
tttttttctttaaaga

SEQ ID NO: 335665 - DNA, 16 bp, C. familiaris
tttttttgaaaatgaa

SEQ ID NO: 335666 - DNA, 16 bp, C. familiaris
tttttttgaagagaaa

SEQ ID NO: 335667 - DNA, 16 bp, C. familiaris
tttttttgagaaagtg

SEQ ID NO: 335668 - DNA, 16 bp, C. familiaris
tttttttgcaaaaatt

SEQ ID NO: 335669 - DNA, 16 bp, C. familiaris
tttttttgccttcaaa

SEQ ID NO: 335670 - DNA, 16 bp, C. familiaris
tttttttgctgttgaa

SEQ ID NO: 335671 - DNA, 16 bp, C. familiaris
tttttttggaggggga

SEQ ID NO: 335672 - DNA, 16 bp, C. familiaris
tttttttggggaaaaa

SEQ ID NO: 335673 - DNA, 16 bp, C. familiaris
tttttttggttgagtc

SEQ ID NO: 335674 - DNA, 16 bp, C. familiaris
tttttttgtcaaataa

SEQ ID NO: 335675 - DNA, 16 bp, C. familiaris
tttttttgtggagtct

SEQ ID NO: 335676 - DNA, 16 bp, C. familiaris
ttttttttaaagaatc

SEQ ID NO: 335677 - DNA, 16 bp, C. familiaris
ttttttttaaagagtg

SEQ ID NO: 335678 - DNA, 16 bp, C. familiaris
ttttttttaaaggaaa

SEQ ID NO: 335679 - DNA, 16 bp, C. familiaris
ttttttttaaatgcca

SEQ ID NO: 335680 - DNA, 16 bp, C. familiaris
ttttttttaaatgctg

SEQ ID NO: 335681 - DNA, 16 bp, C. familiaris
ttttttttaagaaaag

SEQ ID NO: 335682 - DNA, 16 bp, C. familiaris
ttttttttaagaaggc

SEQ ID NO: 335683 - DNA, 16 bp, C. familiaris
ttttttttaagactca

SEQ ID NO: 335684 - DNA, 16 bp, C. familiaris
ttttttttaaggcagt

SEQ ID NO: 335685 - DNA, 16 bp, C. familiaris
ttttttttaatcaaga

SEQ ID NO: 335686 - DNA, 16 bp, C. familiaris
ttttttttaatctaga

SEQ ID NO: 335687 - DNA, 16 bp, C. familiaris
ttttttttacccccaa

SEQ ID NO: 335688 - DNA, 16 bp, C. familiaris
ttttttttcaagaaaa

SEQ ID NO: 335689 - DNA, 16 bp, C. familiaris
ttttttttcagagaat

SEQ ID NO: 335690 - DNA, 16 bp, C. familiaris
ttttttttcagataca

SEQ ID NO: 335691 - DNA, 16 bp, C. familiaris
ttttttttcatgacat

SEQ ID NO: 335692 - DNA, 16 bp, C. familiaris
ttttttttccaaaaga

SEQ ID NO: 335693 - DNA, 16 bp, C. familiaris
ttttttttccaaagtg

SEQ ID NO: 335694 - DNA, 16 bp, C. familiaris
ttttttttccaggaga

SEQ ID NO: 335695 - DNA, 16 bp, C. familiaris
ttttttttccccccag

SEQ ID NO: 335696 - DNA, 16 bp, C. familiaris
ttttttttcctaagaa

SEQ ID NO: 335697 - DNA, 16 bp, C. familiaris
ttttttttctaggaag

SEQ ID NO: 335698 - DNA, 16 bp, C. familiaris
ttttttttctgaaaat

SEQ ID NO: 335699 - DNA, 16 bp, C. familiaris
ttttttttctgactgc

SEQ ID NO: 335700 - DNA, 16 bp, C. familiaris
ttttttttgaaaacta

SEQ ID NO: 335701 - DNA, 16 bp, C. familiaris
tttttttttaagggaa

SEQ ID NO: 335702 - DNA, 16 bp, C. familiaris
tttttttttccagaaa

SEQ ID NO: 335703 - DNA, 16 bp, C. familiaris
tttttttttccagcaa

SEQ ID NO: 335704 - DNA, 16 bp, C. familiaris
tttttttttctgaaaa

SEQ ID NO: 335705 - DNA, 16 bp, C. familiaris
tttttttttctggaaa

SEQ ID NO: 335706 - DNA, 16 bp, C. familiaris
tttttttttgacacca

SEQ ID NO: 335707 - DNA, 16 bp, C. familiaris
tttttttttgagagac

SEQ ID NO: 335708 - DNA, 16 bp, C. familiaris
tttttttttgcctgag

SEQ ID NO: 335709 - DNA, 16 bp, C. familiaris
ttttttttttaaggca

SEQ ID NO: 335710 - DNA, 16 bp, M. musculus
aaaaaaaaaactggct

SEQ ID NO: 335711 - DNA, 16 bp, M. musculus
aaaaaaaaaacttttg

SEQ ID NO: 335712 - DNA, 16 bp, M. musculus
aaaaaaaaaagccctg

SEQ ID NO: 335713 - DNA, 16 bp, M. musculus
aaaaaaaaaagccttt

SEQ ID NO: 335714 - DNA, 16 bp, M. musculus
aaaaaaaaaagctctg

SEQ ID NO: 335715 - DNA, 16 bp, M. musculus
aaaaaaaaaagctgcc

SEQ ID NO: 335716 - DNA, 16 bp, M. musculus
aaaaaaaaaagggtgc

SEQ ID NO: 335717 - DNA, 16 bp, M. musculus
aaaaaaaaaagtcctg

SEQ ID NO: 335718 - DNA, 16 bp, M. musculus
aaaaaaaaaatctgtg

SEQ ID NO: 335719 - DNA, 16 bp, M. musculus
aaaaaaaaaatgttct

SEQ ID NO: 335720 - DNA, 16 bp, M. musculus
aaaaaaaaaccagctg

SEQ ID NO: 335721 - DNA, 16 bp, M. musculus
aaaaaaaaaccatgtt

SEQ ID NO: 335722 - DNA, 16 bp, M. musculus
aaaaaaaaaccctctg

SEQ ID NO: 335723 - DNA, 16 bp, M. musculus
aaaaaaaaaccctgtc

SEQ ID NO: 335724 - DNA, 16 bp, M. musculus
aaaaaaaaacctaggg

SEQ ID NO: 335725 - DNA, 16 bp, M. musculus
aaaaaaaaacctgagg

SEQ ID NO: 335726 - DNA, 16 bp, M. musculus
aaaaaaaaacctttgc

SEQ ID NO: 335727 - DNA, 16 bp, M. musculus
aaaaaaaaactctttc

SEQ ID NO: 335728 - DNA, 16 bp, M. musculus
aaaaaaaaactgtgta

SEQ ID NO: 335729 - DNA, 16 bp, M. musculus
aaaaaaaaactgtttt

SEQ ID NO: 335730 - DNA, 16 bp, M. musculus
aaaaaaaaacttgctt

SEQ ID NO: 335731 - DNA, 16 bp, M. musculus
aaaaaaaaagactttc

SEQ ID NO: 335732 - DNA, 16 bp, M. musculus
aaaaaaaaagaggctg

SEQ ID NO: 335733 - DNA, 16 bp, M. musculus
aaaaaaaaagatttct

SEQ ID NO: 335734 - DNA, 16 bp, M. musculus
aaaaaaaaagcagtct

SEQ ID NO: 335735 - DNA, 16 bp, M. musculus
aaaaaaaaagcccagt

SEQ ID NO: 335736 - DNA, 16 bp, M. musculus
aaaaaaaaagctgatg

SEQ ID NO: 335737 - DNA, 16 bp, M. musculus
aaaaaaaaagcttcct

SEQ ID NO: 335738 - DNA, 16 bp, M. musculus
aaaaaaaaaggtctgt

SEQ ID NO: 335739 - DNA, 16 bp, M. musculus
aaaaaaaaaggtttct

SEQ ID NO: 335740 - DNA, 16 bp, M. musculus
aaaaaaaaagtctatg

SEQ ID NO: 335741 - DNA, 16 bp, M. musculus
aaaaaaaaagtctcac

SEQ ID NO: 335742 - DNA, 16 bp, M. musculus
aaaaaaaaagtctcta

SEQ ID NO: 335743 - DNA, 16 bp, M. musculus
aaaaaaaaagtggcat

SEQ ID NO: 335744 - DNA, 16 bp, M. musculus
aaaaaaaaagttatct

SEQ ID NO: 335745 - DNA, 16 bp, M. musculus
aaaaaaaaagttccta

SEQ ID NO: 335746 - DNA, 16 bp, M. musculus
aaaaaaaaagttctag

SEQ ID NO: 335747 - DNA, 16 bp, M. musculus
aaaaaaaaagttcttt

SEQ ID NO: 335748 - DNA, 16 bp, M. musculus
aaaaaaaaatcagttt

SEQ ID NO: 335749 - DNA, 16 bp, M. musculus
aaaaaaaaatcccagg

SEQ ID NO: 335750 - DNA, 16 bp, M. musculus
aaaaaaaaatcccttt

SEQ ID NO: 335751 - DNA, 16 bp, M. musculus
aaaaaaaaatcctctt

SEQ ID NO: 335752 - DNA, 16 bp, M. musculus
aaaaaaaaatcctgtc

SEQ ID NO: 335753 - DNA, 16 bp, M. musculus
aaaaaaaaatctcatg

SEQ ID NO: 335754 - DNA, 16 bp, M. musculus
aaaaaaaaatctctcc

SEQ ID NO: 335755 - DNA, 16 bp, M. musculus
aaaaaaaaatctctga

SEQ ID NO: 335756 - DNA, 16 bp, M. musculus
aaaaaaaaatctgacc

SEQ ID NO: 335757 - DNA, 16 bp, M. musculus
aaaaaaaaatctgcct

SEQ ID NO: 335758 - DNA, 16 bp, M. musculus
aaaaaaaaatctgtgg

SEQ ID NO: 335759 - DNA, 16 bp, M. musculus
aaaaaaaaatctgtgt

SEQ ID NO: 335760 - DNA, 16 bp, M. musculus
aaaaaaaaatctgttt

SEQ ID NO: 335761 - DNA, 16 bp, M. musculus
aaaaaaaaatgacttg

SEQ ID NO: 335762 - DNA, 16 bp, M. musculus
aaaaaaaaatgacttt

SEQ ID NO: 335763 - DNA, 16 bp, M. musculus
aaaaaaaaatgcactt

SEQ ID NO: 335764 - DNA, 16 bp, M. musculus
aaaaaaaaatgcctga

SEQ ID NO: 335765 - DNA, 16 bp, M. musculus
aaaaaaaaatgctgag

SEQ ID NO: 335766 - DNA, 16 bp, M. musculus
aaaaaaaaatgctgga

SEQ ID NO: 335767 - DNA, 16 bp, M. musculus
aaaaaaaaatgctgtt

SEQ ID NO: 335768 - DNA, 16 bp, M. musculus
aaaaaaaaatgcttga

SEQ ID NO: 335769 - DNA, 16 bp, M. musculus
aaaaaaaaatgtgtct

SEQ ID NO: 335770 - DNA, 16 bp, M. musculus
aaaaaaaacccaagtc

SEQ ID NO: 335771 - DNA, 16 bp, M. musculus
aaaaaaaacccacttt

SEQ ID NO: 335772 - DNA, 16 bp, M. musculus
aaaaaaaaccctcaga

SEQ ID NO: 335773 - DNA, 16 bp, M. musculus
aaaaaaaaccctgcag

SEQ ID NO: 335774 - DNA, 16 bp, M. musculus
aaaaaaaaccctgtgt

SEQ ID NO: 335775 - DNA, 16 bp, M. musculus
aaaaaaaacctgtgtg

SEQ ID NO: 335776 - DNA, 16 bp, M. musculus
aaaaaaaacctttcta

SEQ ID NO: 335777 - DNA, 16 bp, M. musculus
aaaaaaaactgtattt

SEQ ID NO: 335778 - DNA, 16 bp, M. musculus
aaaaaaaacttcagga

SEQ ID NO: 335779 - DNA, 16 bp, M. musculus
aaaaaaaacttttaag

SEQ ID NO: 335780 - DNA, 16 bp, M. musculus
aaaaaaaacttttctg

SEQ ID NO: 335781 - DNA, 16 bp, M. musculus
aaaaaaaacttttttg

SEQ ID NO: 335782 - DNA, 16 bp, M. musculus
aaaaaaaagaagcctt

SEQ ID NO: 335783 - DNA, 16 bp, M. musculus
aaaaaaaagaaggctg

SEQ ID NO: 335784 - DNA, 16 bp, M. musculus
aaaaaaaagacatttc

SEQ ID NO: 335785 - DNA, 16 bp, M. musculus
aaaaaaaagactcttt

SEQ ID NO: 335786 - DNA, 16 bp, M. musculus
aaaaaaaagacttcca

SEQ ID NO: 335787 - DNA, 16 bp, M. musculus
aaaaaaaagagtactt

SEQ ID NO: 335788 - DNA, 16 bp, M. musculus
aaaaaaaagagttcac

SEQ ID NO: 335789 - DNA, 16 bp, M. musculus
aaaaaaaagagttcag

SEQ ID NO: 335790 - DNA, 16 bp, M. musculus
aaaaaaaagagttcta

SEQ ID NO: 335791 - DNA, 16 bp, M. musculus
aaaaaaaagcacattt

SEQ ID NO: 335792 - DNA, 16 bp, M. musculus
aaaaaaaagcagtttc

SEQ ID NO: 335793 - DNA, 16 bp, M. musculus
aaaaaaaagcatattt

SEQ ID NO: 335794 - DNA, 16 bp, M. musculus
aaaaaaaagcctagga

SEQ ID NO: 335795 - DNA, 16 bp, M. musculus
aaaaaaaagtaattct

SEQ ID NO: 335796 - DNA, 16 bp, M. musculus
aaaaaaaagtatgact

SEQ ID NO: 335797 - DNA, 16 bp, M. musculus
aaaaaaaagtccttca

SEQ ID NO: 335798 - DNA, 16 bp, M. musculus
aaaaaaaagtccttct

SEQ ID NO: 335799 - DNA, 16 bp, M. musculus
aaaaaaaagtcttaca

SEQ ID NO: 335800 - DNA, 16 bp, M. musculus
aaaaaaaagtcttcct

SEQ ID NO: 335801 - DNA, 16 bp, M. musculus
aaaaaaaagttcaagg

SEQ ID NO: 335802 - DNA, 16 bp, M. musculus
aaaaaaaagttgacat

SEQ ID NO: 335803 - DNA, 16 bp, M. musculus
aaaaaaaagtttcttt

SEQ ID NO: 335804 - DNA, 16 bp, M. musculus
aaaaaaaagttttctt

SEQ ID NO: 335805 - DNA, 16 bp, M. musculus
aaaaaaaagtttttcc

SEQ ID NO: 335806 - DNA, 16 bp, M. musculus
aaaaaaaataagtctt

SEQ ID NO: 335807 - DNA, 16 bp, M. musculus
aaaaaaaatagctgag

SEQ ID NO: 335808 - DNA, 16 bp, M. musculus
aaaaaaaatagtcatt

SEQ ID NO: 335809 - DNA, 16 bp, M. musculus
aaaaaaaatatttccc

SEQ ID NO: 335810 - DNA, 16 bp, M. musculus
aaaaaaaatcacagtg

SEQ ID NO: 335811 - DNA, 16 bp, M. musculus
aaaaaaaatcactcag

SEQ ID NO: 335812 - DNA, 16 bp, M. musculus
aaaaaaaatcagtgta

SEQ ID NO: 335813 - DNA, 16 bp, M. musculus
aaaaaaaatcagtgtt

SEQ ID NO: 335814 - DNA, 16 bp, M. musculus
aaaaaaaatcagtttt

SEQ ID NO: 335815 - DNA, 16 bp, M. musculus
aaaaaaaatcatgtct

SEQ ID NO: 335816 - DNA, 16 bp, M. musculus
aaaaaaaatccagatg

SEQ ID NO: 335817 - DNA, 16 bp, M. musculus
aaaaaaaatccaggat

SEQ ID NO: 335818 - DNA, 16 bp, M. musculus
aaaaaaaatccatttc

SEQ ID NO: 335819 - DNA, 16 bp, M. musculus
aaaaaaaatcccaagg

SEQ ID NO: 335820 - DNA, 16 bp, M. musculus
aaaaaaaatcccactg

SEQ ID NO: 335821 - DNA, 16 bp, M. musculus
aaaaaaaatcccagcc

SEQ ID NO: 335822 - DNA, 16 bp, M. musculus
aaaaaaaatcccagtg

SEQ ID NO: 335823 - DNA, 16 bp, M. musculus
aaaaaaaatcctccat

SEQ ID NO: 335824 - DNA, 16 bp, M. musculus
aaaaaaaatcctctgt

SEQ ID NO: 335825 - DNA, 16 bp, M. musculus
aaaaaaaatcctgtat

SEQ ID NO: 335826 - DNA, 16 bp, M. musculus
aaaaaaaatctccaga

SEQ ID NO: 335827 - DNA, 16 bp, M. musculus
aaaaaaaatctcttct

SEQ ID NO: 335828 - DNA, 16 bp, M. musculus
aaaaaaaatcttgtgg

SEQ ID NO: 335829 - DNA, 16 bp, M. musculus
aaaaaaaatctttctt

SEQ ID NO: 335830 - DNA, 16 bp, M. musculus
aaaaaaaatctttgta

SEQ ID NO: 335831 - DNA, 16 bp, M. musculus
aaaaaaaatgacattt

SEQ ID NO: 335832 - DNA, 16 bp, M. musculus
aaaaaaaatgcaattt

SEQ ID NO: 335833 - DNA, 16 bp, M. musculus
aaaaaaaatgccattt

SEQ ID NO: 335834 - DNA, 16 bp, M. musculus
aaaaaaaatgccttca

SEQ ID NO: 335835 - DNA, 16 bp, M. musculus
aaaaaaaatgtatctt

SEQ ID NO: 335836 - DNA, 16 bp, M. musculus
aaaaaaaatgtctttc

SEQ ID NO: 335837 - DNA, 16 bp, M. musculus
aaaaaaaatgtgtttt

SEQ ID NO: 335838 - DNA, 16 bp, M. musculus
aaaaaaaatgttgctt

SEQ ID NO: 335839 - DNA, 16 bp, M. musculus
aaaaaaaatgtttcat

SEQ ID NO: 335840 - DNA, 16 bp, M. musculus
aaaaaaaatgtttgct

SEQ ID NO: 335841 - DNA, 16 bp, M. musculus
aaaaaaaattattcag

SEQ ID NO: 335842 - DNA, 16 bp, M. musculus
aaaaaaaattcatgtt

SEQ ID NO: 335843 - DNA, 16 bp, M. musculus
aaaaaaaattctgtaa

SEQ ID NO: 335844 - DNA, 16 bp, M. musculus
aaaaaaaattcttaga

SEQ ID NO: 335845 - DNA, 16 bp, M. musculus
aaaaaaaattgcattt

SEQ ID NO: 335846 - DNA, 16 bp, M. musculus
aaaaaaaattgtatct

SEQ ID NO: 335847 - DNA, 16 bp, M. musculus
aaaaaaacagttttat

SEQ ID NO: 335848 - DNA, 16 bp, M. musculus
aaaaaaacattttctt

SEQ ID NO: 335849 - DNA, 16 bp, M. musculus
aaaaaaacccacagta

SEQ ID NO: 335850 - DNA, 16 bp, M. musculus
aaaaaaaccctgagat

SEQ ID NO: 335851 - DNA, 16 bp, M. musculus
aaaaaaaccctgcatg

SEQ ID NO: 335852 - DNA, 16 bp, M. musculus
aaaaaaacctgaaatt

SEQ ID NO: 335853 - DNA, 16 bp, M. musculus
aaaaaaacttttaaga

SEQ ID NO: 335854 - DNA, 16 bp, M. musculus
aaaaaaagaacatttt

SEQ ID NO: 335855 - DNA, 16 bp, M. musculus
aaaaaaagaacttttt

SEQ ID NO: 335856 - DNA, 16 bp, M. musculus
aaaaaaagaagacttt

SEQ ID NO: 335857 - DNA, 16 bp, M. musculus
aaaaaaagaagcattt

SEQ ID NO: 335858 - DNA, 16 bp, M. musculus
aaaaaaagaagtcatg

SEQ ID NO: 335859 - DNA, 16 bp, M. musculus
aaaaaaagaatattct

SEQ ID NO: 335860 - DNA, 16 bp, M. musculus
aaaaaaagaatcattt

SEQ ID NO: 335861 - DNA, 16 bp, M. musculus
aaaaaaagaatgctgt

SEQ ID NO: 335862 - DNA, 16 bp, M. musculus
aaaaaaagaattctct

SEQ ID NO: 335863 - DNA, 16 bp, M. musculus
aaaaaaagaattttca

SEQ ID NO: 335864 - DNA, 16 bp, M. musculus
aaaaaaagacattttt

SEQ ID NO: 335865 - DNA, 16 bp, M. musculus
aaaaaaagactttttt

SEQ ID NO: 335866 - DNA, 16 bp, M. musculus
aaaaaaagagagagct

SEQ ID NO: 335867 - DNA, 16 bp, M. musculus
aaaaaaagagcactga

SEQ ID NO: 335868 - DNA, 16 bp, M. musculus
aaaaaaagagtactga

SEQ ID NO: 335869 - DNA, 16 bp, M. musculus
aaaaaaagtaactttt

SEQ ID NO: 335870 - DNA, 16 bp, M. musculus
aaaaaaagtcttttta

SEQ ID NO: 335871 - DNA, 16 bp, M. musculus
aaaaaaagttaaactt

SEQ ID NO: 335872 - DNA, 16 bp, M. musculus
aaaaaaagtttgtttt

SEQ ID NO: 335873 - DNA, 16 bp, M. musculus
aaaaaaataatttctg

SEQ ID NO: 335874 - DNA, 16 bp, M. musculus
aaaaaaataccacatg

SEQ ID NO: 335875 - DNA, 16 bp, M. musculus
aaaaaaatactgtttc

SEQ ID NO: 335876 - DNA, 16 bp, M. musculus
aaaaaaatatgttcaa

SEQ ID NO: 335877 - DNA, 16 bp, M. musculus
aaaaaaatatgttgct

SEQ ID NO: 335878 - DNA, 16 bp, M. musculus
aaaaaaatattttcag

SEQ ID NO: 335879 - DNA, 16 bp, M. musculus
aaaaaaatcaagaggt

SEQ ID NO: 335880 - DNA, 16 bp, M. musculus
aaaaaaatcaagattt

SEQ ID NO: 335881 - DNA, 16 bp, M. musculus
aaaaaaatcaagcagg

SEQ ID NO: 335882 - DNA, 16 bp, M. musculus
aaaaaaatcaaggagg

SEQ ID NO: 335883 - DNA, 16 bp, M. musculus
aaaaaaatcaagtttt

SEQ ID NO: 335884 - DNA, 16 bp, M. musculus
aaaaaaatcaatagtt

SEQ ID NO: 335885 - DNA, 16 bp, M. musculus
aaaaaaatcacagatg

SEQ ID NO: 335886 - DNA, 16 bp, M. musculus
aaaaaaatcactgtga

SEQ ID NO: 335887 - DNA, 16 bp, M. musculus
aaaaaaatcaggtgtc

SEQ ID NO: 335888 - DNA, 16 bp, M. musculus
aaaaaaatcagtatct

SEQ ID NO: 335889 - DNA, 16 bp, M. musculus
aaaaaaatcagtggcc

SEQ ID NO: 335890 - DNA, 16 bp, M. musculus
aaaaaaatcatgtaat

SEQ ID NO: 335891 - DNA, 16 bp, M. musculus
aaaaaaatccaagatg

SEQ ID NO: 335892 - DNA, 16 bp, M. musculus
aaaaaaatccttcata

SEQ ID NO: 335893 - DNA, 16 bp, M. musculus
aaaaaaatccttcatt

SEQ ID NO: 335894 - DNA, 16 bp, M. musculus
aaaaaaatcctttcaa

SEQ ID NO: 335895 - DNA, 16 bp, M. musculus
aaaaaaatctaccaag

SEQ ID NO: 335896 - DNA, 16 bp, M. musculus
aaaaaaatctcaagtg

SEQ ID NO: 335897 - DNA, 16 bp, M. musculus
aaaaaaatctcagaat

SEQ ID NO: 335898 - DNA, 16 bp, M. musculus
aaaaaaatctcatttt

SEQ ID NO: 335899 - DNA, 16 bp, M. musculus
aaaaaaatctccagaa

SEQ ID NO: 335900 - DNA, 16 bp, M. musculus
aaaaaaatctcttcta

SEQ ID NO: 335901 - DNA, 16 bp, M. musculus
aaaaaaatcttaatgt

SEQ ID NO: 335902 - DNA, 16 bp, M. musculus
aaaaaaatcttagttt

SEQ ID NO: 335903 - DNA, 16 bp, M. musculus
aaaaaaatctttcaag

SEQ ID NO: 335904 - DNA, 16 bp, M. musculus
aaaaaaatctttctgt

SEQ ID NO: 335905 - DNA, 16 bp, M. musculus
aaaaaaatctttgcaa

SEQ ID NO: 335906 - DNA, 16 bp, M. musculus
aaaaaaatcttttgtt

SEQ ID NO: 335907 - DNA, 16 bp, M. musculus
aaaaaaatgacttcat

SEQ ID NO: 335908 - DNA, 16 bp, M. musculus
aaaaaaatgacttttt

SEQ ID NO: 335909 - DNA, 16 bp, M. musculus
aaaaaaatgcatggta

SEQ ID NO: 335910 - DNA, 16 bp, M. musculus
aaaaaaatgccaggca

SEQ ID NO: 335911 - DNA, 16 bp, M. musculus
aaaaaaatgtacattt

SEQ ID NO: 335912 - DNA, 16 bp, M. musculus
aaaaaaatgtatcttc

SEQ ID NO: 335913 - DNA, 16 bp, M. musculus
aaaaaaatgtatttct

SEQ ID NO: 335914 - DNA, 16 bp, M. musculus
aaaaaaatgtcattta

SEQ ID NO: 335915 - DNA, 16 bp, M. musculus
aaaaaaatgtctttaa

SEQ ID NO: 335916 - DNA, 16 bp, M. musculus
aaaaaaatgtggtata

SEQ ID NO: 335917 - DNA, 16 bp, M. musculus
aaaaaaatgtgtttat

SEQ ID NO: 335918 - DNA, 16 bp, M. musculus
aaaaaaatgttcagta

SEQ ID NO: 335919 - DNA, 16 bp, M. musculus
aaaaaaatgttctgta

SEQ ID NO: 335920 - DNA, 16 bp, M. musculus
aaaaaaatgttcttta

SEQ ID NO: 335921 - DNA, 16 bp, M. musculus
aaaaaaatgttctttt

SEQ ID NO: 335922 - DNA, 16 bp, M. musculus
aaaaaaatgtttactt

SEQ ID NO: 335923 - DNA, 16 bp, M. musculus
aaaaaaatgtttccaa

SEQ ID NO: 335924 - DNA, 16 bp, M. musculus
aaaaaaatgttttgag

SEQ ID NO: 335925 - DNA, 16 bp, M. musculus
aaaaaaattaaacctg

SEQ ID NO: 335926 - DNA, 16 bp, M. musculus
aaaaaaattattcctt

SEQ ID NO: 335927 - DNA, 16 bp, M. musculus
aaaaaaattcaagttt

SEQ ID NO: 335928 - DNA, 16 bp, M. musculus
aaaaaaattctcattt

SEQ ID NO: 335929 - DNA, 16 bp, M. musculus
aaaaaaattctgaaat

SEQ ID NO: 335930 - DNA, 16 bp, M. musculus
aaaaaaattctgagtt

SEQ ID NO: 335931 - DNA, 16 bp, M. musculus
aaaaaacaaaactgtg

SEQ ID NO: 335932 - DNA, 16 bp, M. musculus
aaaaaacaagatattc

SEQ ID NO: 335933 - DNA, 16 bp, M. musculus
aaaaaacaagctggag

SEQ ID NO: 335934 - DNA, 16 bp, M. musculus
aaaaaacattactgag

SEQ ID NO: 335935 - DNA, 16 bp, M. musculus
aaaaaaccaaacagct

SEQ ID NO: 335936 - DNA, 16 bp, M. musculus
aaaaaaccaatacagg

SEQ ID NO: 335937 - DNA, 16 bp, M. musculus
aaaaaaccatttattt

SEQ ID NO: 335938 - DNA, 16 bp, M. musculus
aaaaaaccctctggtg

SEQ ID NO: 335939 - DNA, 42 bp, M. musculus
aaaaaactttactgcatatgtacacattggttgtttgtccaa

SEQ ID NO: 335940 - DNA, 16 bp, M. musculus
aaaaaagaaaatggct

SEQ ID NO: 335941 - DNA, 16 bp, M. musculus
aaaaaagaaaattctt

SEQ ID NO: 335942 - DNA, 16 bp, M. musculus
aaaaaagaaagcagtt

SEQ ID NO: 335943 - DNA, 16 bp, M. musculus
aaaaaagaatgtgttt

SEQ ID NO: 335944 - DNA, 16 bp, M. musculus
aaaaaagaattacagg

SEQ ID NO: 335945 - DNA, 16 bp, M. musculus
aaaaaagacaacatct

SEQ ID NO: 335946 - DNA, 16 bp, M. musculus
aaaaaagacattttca

SEQ ID NO: 335947 - DNA, 16 bp, M. musculus
aaaaaagacctcagaa

SEQ ID NO: 335948 - DNA, 16 bp, M. musculus
aaaaaagacttgcctt

SEQ ID NO: 335949 - DNA, 16 bp, M. musculus
aaaaaagagaacttca

SEQ ID NO: 335950 - DNA, 16 bp, M. musculus
aaaaaagagcccagga

SEQ ID NO: 335951 - DNA, 16 bp, M. musculus
aaaaaagagggctgga

SEQ ID NO: 335952 - DNA, 16 bp, M. musculus
aaaaaagatgtatttt

SEQ ID NO: 335953 - DNA, 16 bp, M. musculus
aaaaaagatgtcagaa

SEQ ID NO: 335954 - DNA, 16 bp, M. musculus
aaaaaagattttattg

SEQ ID NO: 335955 - DNA, 16 bp, M. musculus
aaaaaagatttttctt

SEQ ID NO: 335956 - DNA, 16 bp, M. musculus
aaaaaagcagcagcag

SEQ ID NO: 335957 - DNA, 16 bp, M. musculus
aaaaaagcaggctgag

SEQ ID NO: 335958 - DNA, 16 bp, M. musculus
aaaaaagcatcttcaa

SEQ ID NO: 335959 - DNA, 16 bp, M. musculus
aaaaaagctccctgga

SEQ ID NO: 335960 - DNA, 16 bp, M. musculus
aaaaaaggaacatttt

SEQ ID NO: 335961 - DNA, 22 bp, M. musculus
aaaaaaggtgtcaaaagtttgt

SEQ ID NO: 335962 - DNA, 16 bp, M. musculus
aaaaaagtattcattt

SEQ ID NO: 335963 - DNA, 16 bp, M. musculus
aaaaaagtcagctgtg

SEQ ID NO: 335964 - DNA, 16 bp, M. musculus
aaaaaagtcttatttt

SEQ ID NO: 335965 - DNA, 16 bp, M. musculus
aaaaaagttttcaaaa

SEQ ID NO: 335966 - DNA, 16 bp, M. musculus
aaaaaataaagtcatt

SEQ ID NO: 335967 - DNA, 16 bp, M. musculus
aaaaaataatgatgca

SEQ ID NO: 335968 - DNA, 16 bp, M. musculus
aaaaaatactttgaaa

SEQ ID NO: 335969 - DNA, 16 bp, M. musculus
aaaaaatagacatttt

SEQ ID NO: 335970 - DNA, 16 bp, M. musculus
aaaaaatatgtctttt

SEQ ID NO: 335971 - DNA, 16 bp, M. musculus
aaaaaatattcagtat

SEQ ID NO: 335972 - DNA, 16 bp, M. musculus
aaaaaatattgtcaaa

SEQ ID NO: 335973 - DNA, 16 bp, M. musculus
aaaaaatattttctct

SEQ ID NO: 335974 - DNA, 16 bp, M. musculus
aaaaaatatttttgtg

SEQ ID NO: 335975 - DNA, 16 bp, M. musculus
aaaaaatcaatgaagt

SEQ ID NO: 335976 - DNA, 16 bp, M. musculus
aaaaaatcaatgtttt

SEQ ID NO: 335977 - DNA, 16 bp, M. musculus
aaaaaatcacagattt

SEQ ID NO: 335978 - DNA, 16 bp, M. musculus
aaaaaatcaggcatta

SEQ ID NO: 335979 - DNA, 16 bp, M. musculus
aaaaaatcattctttt

SEQ ID NO: 335980 - DNA, 16 bp, M. musculus
aaaaaatcctcttgca

SEQ ID NO: 335981 - DNA, 16 bp, M. musculus
aaaaaatcctgaacag

SEQ ID NO: 335982 - DNA, 16 bp, M. musculus
aaaaaatcctttccca

SEQ ID NO: 335983 - DNA, 16 bp, M. musculus
aaaaaatctcagaaga

SEQ ID NO: 335984 - DNA, 16 bp, M. musculus
aaaaaatcttgaaaat

SEQ ID NO: 335985 - DNA, 16 bp, M. musculus
aaaaaatcttgcattt

SEQ ID NO: 335986 - DNA, 16 bp, M. musculus
aaaaaatctttcattt

SEQ ID NO: 335987 - DNA, 16 bp, M. musculus
aaaaaatgaacccacc

SEQ ID NO: 335988 - DNA, 16 bp, M. musculus
aaaaaatgcaaaatgt

SEQ ID NO: 335989 - DNA, 16 bp, M. musculus
aaaaaatgcatatttt

SEQ ID NO: 335990 - DNA, 16 bp, M. musculus
aaaaaatgctgtcctt

SEQ ID NO: 335991 - DNA, 16 bp, M. musculus
aaaaaatggagaacag

SEQ ID NO: 335992 - DNA, 16 bp, M. musculus
aaaaaatggtcaacat

SEQ ID NO: 335993 - DNA, 16 bp, M. musculus
aaaaaatgtaacattt

SEQ ID NO: 335994 - DNA, 16 bp, M. musculus
aaaaaatgtagttttt

SEQ ID NO: 335995 - DNA, 16 bp, M. musculus
aaaaaatgtggatttt

SEQ ID NO: 335996 - DNA, 16 bp, M. musculus
aaaaaatgtgtgtgtg

SEQ ID NO: 335997 - DNA, 16 bp, M. musculus
aaaaaatgtttttagt

SEQ ID NO: 335998 - DNA, 16 bp, M. musculus
aaaaaattactgaact

SEQ ID NO: 335999 - DNA, 16 bp, M. musculus
aaaaaattatcagatc

SEQ ID NO: 336000 - DNA, 16 bp, M. musculus
aaaaaattatttcatg

SEQ ID NO: 336001 - DNA, 16 bp, M. musculus
aaaaaattcaaggcca

SEQ ID NO: 336002 - DNA, 16 bp, M. musculus
aaaaaattgcaggaaa

SEQ ID NO: 336003 - DNA, 16 bp, M. musculus
aaaaaatttaattggg

SEQ ID NO: 336004 - DNA, 16 bp, M. musculus
aaaaaattttcaactg

SEQ ID NO: 336005 - DNA, 16 bp, M. musculus
aaaaaatttttttctc

SEQ ID NO: 336006 - DNA, 16 bp, M. musculus
aaaaaatttttttgca

SEQ ID NO: 336007 - DNA, 16 bp, M. musculus
aaaaaattttttttgc

SEQ ID NO: 336008 - DNA, 16 bp, M. musculus
aaaaaattttttttgg

SEQ ID NO: 336009 - DNA, 16 bp, M. musculus
aaaaacaaaaaccctg

SEQ ID NO: 336010 - DNA, 16 bp, M. musculus
aaaaacaaaaccctgt

SEQ ID NO: 336011 - DNA, 16 bp, M. musculus
aaaaacaaaagccttt

SEQ ID NO: 336012 - DNA, 16 bp, M. musculus
aaaaacaaactggaga

SEQ ID NO: 336013 - DNA, 16 bp, M. musculus
aaaaacaaagcatttt

SEQ ID NO: 336014 - DNA, 18 bp, M. musculus
aaaaacaaaggctaggta

SEQ ID NO: 336015 - DNA, 16 bp, M. musculus
aaaaacaacgacttca

SEQ ID NO: 336016 - DNA, 16 bp, M. musculus
aaaaacaactgaaagc

SEQ ID NO: 336017 - DNA, 16 bp, M. musculus
aaaaacaagactcaga

SEQ ID NO: 336018 - DNA, 16 bp, M. musculus
aaaaacaagatggaca

SEQ ID NO: 336019 - DNA, 16 bp, M. musculus
aaaaacaaggacatca

SEQ ID NO: 336020 - DNA, 16 bp, M. musculus
aaaaacaaggtggaca

SEQ ID NO: 336021 - DNA, 16 bp, M. musculus
aaaaacaatgacttct

SEQ ID NO: 336022 - DNA, 16 bp, M. musculus
aaaaacaattcaagga

SEQ ID NO: 336023 - DNA, 16 bp, M. musculus
aaaaacacatgattat

SEQ ID NO: 336024 - DNA, 16 bp, M. musculus
aaaaacagatgcagag

SEQ ID NO: 336025 - DNA, 16 bp, M. musculus
aaaaacagatttgaaa

SEQ ID NO: 336026 - DNA, 16 bp, M. musculus
aaaaacagctataaca

SEQ ID NO: 336027 - DNA, 16 bp, M. musculus
aaaaacaggaaaatgc

SEQ ID NO: 336028 - DNA, 16 bp, M. musculus
aaaaacagtgtgtgtg

SEQ ID NO: 336029 - DNA, 16 bp, M. musculus
aaaaacatagatattt

SEQ ID NO: 336030 - DNA, 16 bp, M. musculus
aaaaacatatgtattt

SEQ ID NO: 336031 - DNA, 16 bp, M. musculus
aaaaacatatttctgt

SEQ ID NO: 336032 - DNA, 16 bp, M. musculus
aaaaacatatttttca

SEQ ID NO: 336033 - DNA, 16 bp, M. musculus
aaaaacatcatgaaat

SEQ ID NO: 336034 - DNA, 16 bp, M. musculus
aaaaacatgctttttt

SEQ ID NO: 336035 - DNA, 16 bp, M. musculus
aaaaacatggaaaatt

SEQ ID NO: 336036 - DNA, 16 bp, M. musculus
aaaaacatgtttttgt

SEQ ID NO: 336037 - DNA, 16 bp, M. musculus
aaaaacattaaaatgt

SEQ ID NO: 336038 - DNA, 16 bp, M. musculus
aaaaacattatttctt

SEQ ID NO: 336039 - DNA, 16 bp, M. musculus
aaaaacattttgtttt

SEQ ID NO: 336040 - DNA, 16 bp, M. musculus
aaaaacatttttctct

SEQ ID NO: 336041 - DNA, 16 bp, M. musculus
aaaaacatttttcttt

SEQ ID NO: 336042 - DNA, 16 bp, M. musculus
aaaaacatttttttct

SEQ ID NO: 336043 - DNA, 16 bp, M. musculus
aaaaaccacatgttca

SEQ ID NO: 336044 - DNA, 16 bp, M. musculus
aaaaacccagaccctg

SEQ ID NO: 336045 - DNA, 16 bp, M. musculus
aaaaacccagagggtc

SEQ ID NO: 336046 - DNA, 16 bp, M. musculus
aaaaaccccttaaaga

SEQ ID NO: 336047 - DNA, 16 bp, M. musculus
aaaaaccctgtcttaa

SEQ ID NO: 336048 - DNA, 16 bp, M. musculus
aaaaacctcaaagaca

SEQ ID NO: 336049 - DNA, 16 bp, M. musculus
aaaaacctgtctctgt

SEQ ID NO: 336050 - DNA, 16 bp, M. musculus
aaaaactaacatttca

SEQ ID NO: 336051 - DNA, 16 bp, M. musculus
aaaaactagagagagc

SEQ ID NO: 336052 - DNA, 16 bp, M. musculus
aaaaactcaaaggaca

SEQ ID NO: 336053 - DNA, 16 bp, M. musculus
aaaaactctgtcttga

SEQ ID NO: 336054 - DNA, 16 bp, M. musculus
aaaaactgaagcagag

SEQ ID NO: 336055 - DNA, 16 bp, M. musculus
aaaaactgatttttaa

SEQ ID NO: 336056 - DNA, 16 bp, M. musculus
aaaaactgcacagtta

SEQ ID NO: 336057 - DNA, 16 bp, M. musculus
aaaaactgccaaattg

SEQ ID NO: 336058 - DNA, 16 bp, M. musculus
aaaaactggaaagaac

SEQ ID NO: 336059 - DNA, 16 bp, M. musculus
aaaaactggatgaaat

SEQ ID NO: 336060 - DNA, 16 bp, M. musculus
aaaaactgtctctttg

SEQ ID NO: 336061 - DNA, 16 bp, M. musculus
aaaaactgtttaaaaa

SEQ ID NO: 336062 - DNA, 16 bp, M. musculus
aaaaactgttttaaaa

SEQ ID NO: 336063 - DNA, 16 bp, M. musculus
aaaaacttaagtaaat

SEQ ID NO: 336064 - DNA, 16 bp, M. musculus
aaaaacttcagcaaag

SEQ ID NO: 336065 - DNA, 16 bp, M. musculus
aaaaactttaaatgat

SEQ ID NO: 336066 - DNA, 16 bp, M. musculus
aaaaactttctgaaca

SEQ ID NO: 336067 - DNA, 16 bp, M. musculus
aaaaagaaaaagcctg

SEQ ID NO: 336068 - DNA, 16 bp, M. musculus
aaaaagaaaaagtctg

SEQ ID NO: 336069 - DNA, 16 bp, M. musculus
aaaaagaaaaattctt

SEQ ID NO: 336070 - DNA, 16 bp, M. musculus
aaaaagaaaacatttt

SEQ ID NO: 336071 - DNA, 16 bp, M. musculus
aaaaagaaaaggctgg

SEQ ID NO: 336072 - DNA, 16 bp, M. musculus
aaaaagaaaatggttt

SEQ ID NO: 336073 - DNA, 16 bp, M. musculus
aaaaagaaaattccat

SEQ ID NO: 336074 - DNA, 16 bp, M. musculus
aaaaagaaaattctag

SEQ ID NO: 336075 - DNA, 16 bp, M. musculus
aaaaagaaaattgtca

SEQ ID NO: 336076 - DNA, 16 bp, M. musculus
aaaaagaaactagtga

SEQ ID NO: 336077 - DNA, 16 bp, M. musculus
aaaaagaaactgcaga

SEQ ID NO: 336078 - DNA, 16 bp, M. musculus
aaaaagaaactggagc

SEQ ID NO: 336079 - DNA, 16 bp, M. musculus
aaaaagaaagacttgc

SEQ ID NO: 336080 - DNA, 16 bp, M. musculus
aaaaagaaaggaagct

SEQ ID NO: 336081 - DNA, 16 bp, M. musculus
aaaaagaaatcatctt

SEQ ID NO: 336082 - DNA, 16 bp, M. musculus
aaaaagaaatgctttc

SEQ ID NO: 336083 - DNA, 16 bp, M. musculus
aaaaagaaatgctttt

SEQ ID NO: 336084 - DNA, 16 bp, M. musculus
aaaaagaaatgtgttt

SEQ ID NO: 336085 - DNA, 16 bp, M. musculus
aaaaagaaatgtttct

SEQ ID NO: 336086 - DNA, 16 bp, M. musculus
aaaaagaaatgttttt

SEQ ID NO: 336087 - DNA, 16 bp, M. musculus
aaaaagaaattctttt

SEQ ID NO: 336088 - DNA, 16 bp, M. musculus
aaaaagaaattttctt

SEQ ID NO: 336089 - DNA, 16 bp, M. musculus
aaaaagaacttcagac

SEQ ID NO: 336090 - DNA, 16 bp, M. musculus
aaaaagaagaaagctg

SEQ ID NO: 336091 - DNA, 16 bp, M. musculus
aaaaagaagatggagc

SEQ ID NO: 336092 - DNA, 16 bp, M. musculus
aaaaagaagcaaattt

SEQ ID NO: 336093 - DNA, 16 bp, M. musculus
aaaaagaagcagcagc

SEQ ID NO: 336094 - DNA, 16 bp, M. musculus
aaaaagaagcagtcat

SEQ ID NO: 336095 - DNA, 16 bp, M. musculus
aaaaagaagctagaga

SEQ ID NO: 336096 - DNA, 16 bp, M. musculus
aaaaagaagctatgaa

SEQ ID NO: 336097 - DNA, 16 bp, M. musculus
aaaaagaagtcacttg

SEQ ID NO: 336098 - DNA, 16 bp, M. musculus
aaaaagaagtttcctt

SEQ ID NO: 336099 - DNA, 16 bp, M. musculus
aaaaagaatctggaga

SEQ ID NO: 336100 - DNA, 16 bp, M. musculus
aaaaagaatgaagacc

SEQ ID NO: 336101 - DNA, 16 bp, M. musculus
aaaaagaatgaggaca

SEQ ID NO: 336102 - DNA, 16 bp, M. musculus
aaaaagaattcacaga

SEQ ID NO: 336103 - DNA, 16 bp, M. musculus
aaaaagacaacatttt

SEQ ID NO: 336104 - DNA, 16 bp, M. musculus
aaaaagacaccatcaa

SEQ ID NO: 336105 - DNA, 16 bp, M. musculus
aaaaagacatgtctaa

SEQ ID NO: 336106 - DNA, 16 bp, M. musculus
aaaaagacatttttaa

SEQ ID NO: 336107 - DNA, 16 bp, M. musculus
aaaaagactttcaaaa

SEQ ID NO: 336108 - DNA, 16 bp, M. musculus
aaaaagactttctgaa

SEQ ID NO: 336109 - DNA, 16 bp, M. musculus
aaaaagagagcatttt

SEQ ID NO: 336110 - DNA, 16 bp, M. musculus
aaaaagagcccatgaa

SEQ ID NO: 336111 - DNA, 16 bp, M. musculus
aaaaagaggcaatgaa

SEQ ID NO: 336112 - DNA, 16 bp, M. musculus
aaaaagaggctgtgaa

SEQ ID NO: 336113 - DNA, 16 bp, M. musculus
aaaaagagtttatttt

SEQ ID NO: 336114 - DNA, 16 bp, M. musculus
aaaaagatagcatttt

SEQ ID NO: 336115 - DNA, 16 bp, M. musculus
aaaaagatatcagaag

SEQ ID NO: 336116 - DNA, 16 bp, M. musculus
aaaaagatatttcaag

SEQ ID NO: 336117 - DNA, 16 bp, M. musculus
aaaaagatcaggagtt

SEQ ID NO: 336118 - DNA, 16 bp, M. musculus
aaaaagatgtatttat

SEQ ID NO: 336119 - DNA, 16 bp, M. musculus
aaaaagatgtttttaa

SEQ ID NO: 336120 - DNA, 16 bp, M. musculus
aaaaagattatttcaa

SEQ ID NO: 336121 - DNA, 16 bp, M. musculus
aaaaagatttatttct

SEQ ID NO: 336122 - DNA, 16 bp, M. musculus
aaaaagatttattttc

SEQ ID NO: 336123 - DNA, 16 bp, M. musculus
aaaaagattttccaag

SEQ ID NO: 336124 - DNA, 16 bp, M. musculus
aaaaagatttttttca

SEQ ID NO: 336125 - DNA, 16 bp, M. musculus
aaaaagcaaaaggctc

SEQ ID NO: 336126 - DNA, 16 bp, M. musculus
aaaaagcaagcctgag

SEQ ID NO: 336127 - DNA, 16 bp, M. musculus
aaaaagcaagttgagg

SEQ ID NO: 336128 - DNA, 16 bp, M. musculus
aaaaagcactttatca

SEQ ID NO: 336129 - DNA, 16 bp, M. musculus
aaaaagcagctgaaag

SEQ ID NO: 336130 - DNA, 16 bp, M. musculus
aaaaagcatcttcaac

SEQ ID NO: 336131 - DNA, 16 bp, M. musculus
aaaaagcatgtgtgtg

SEQ ID NO: 336132 - DNA, 16 bp, M. musculus
aaaaagcatttgtcaa

SEQ ID NO: 336133 - DNA, 16 bp, M. musculus
aaaaagcattttaaaa

SEQ ID NO: 336134 - DNA, 16 bp, M. musculus
aaaaagccagcatttt

SEQ ID NO: 336135 - DNA, 16 bp, M. musculus
aaaaagcctatggcct

SEQ ID NO: 336136 - DNA, 16 bp, M. musculus
aaaaagccttttcttt

SEQ ID NO: 336137 - DNA, 16 bp, M. musculus
aaaaagctaaaactga

SEQ ID NO: 336138 - DNA, 16 bp, M. musculus
aaaaagctattgaaga

SEQ ID NO: 336139 - DNA, 16 bp, M. musculus
aaaaagctcaagaaac

SEQ ID NO: 336140 - DNA, 16 bp, M. musculus
aaaaagctctgataat

SEQ ID NO: 336141 - DNA, 16 bp, M. musculus
aaaaagctggaaaaca

SEQ ID NO: 336142 - DNA, 16 bp, M. musculus
aaaaagctgtgtgtgt

SEQ ID NO: 336143 - DNA, 16 bp, M. musculus
aaaaagcttctgcaca

SEQ ID NO: 336144 - DNA, 16 bp, M. musculus
aaaaaggaaaacattt

SEQ ID NO: 336145 - DNA, 16 bp, M. musculus
aaaaaggaacctagca

SEQ ID NO: 336146 - DNA, 16 bp, M. musculus
aaaaaggaactggaga

SEQ ID NO: 336147 - DNA, 16 bp, M. musculus
aaaaaggaatgcccca

SEQ ID NO: 336148 - DNA, 16 bp, M. musculus
aaaaaggagctggaga

SEQ ID NO: 336149 - DNA, 16 bp, M. musculus
aaaaaggagttggaga

SEQ ID NO: 336150 - DNA, 16 bp, M. musculus
aaaaaggcaagaagat

SEQ ID NO: 336151 - DNA, 17 bp, M. musculus
aaaaaggctttaacaga

SEQ ID NO: 336152 - DNA, 16 bp, M. musculus
aaaaagggaagtaaac

SEQ ID NO: 336153 - DNA, 16 bp, M. musculus
aaaaagggatgaagca

SEQ ID NO: 336154 - DNA, 16 bp, M. musculus
aaaaaggtcaaggaac

SEQ ID NO: 336155 - DNA, 16 bp, M. musculus
aaaaaggtcaagttac

SEQ ID NO: 336156 - DNA, 16 bp, M. musculus
aaaaaggtggtggtgg

SEQ ID NO: 336157 - DNA, 16 bp, M. musculus
aaaaagtaaaattctt

SEQ ID NO: 336158 - DNA, 16 bp, M. musculus
aaaaagtaatattttg

SEQ ID NO: 336159 - DNA, 16 bp, M. musculus
aaaaagtattttaaac

SEQ ID NO: 336160 - DNA, 16 bp, M. musculus
aaaaagtcattatttt

SEQ ID NO: 336161 - DNA, 16 bp, M. musculus
aaaaagtccaccaaca

SEQ ID NO: 336162 - DNA, 16 bp, M. musculus
aaaaagtcccacctca

SEQ ID NO: 336163 - DNA, 16 bp, M. musculus
aaaaagtctttaactt

SEQ ID NO: 336164 - DNA, 16 bp, M. musculus
aaaaagtctttaatgt

SEQ ID NO: 336165 - DNA, 16 bp, M. musculus
aaaaagtgatatttga

SEQ ID NO: 336166 - DNA, 16 bp, M. musculus
aaaaagtggaaaaggc

SEQ ID NO: 336167 - DNA, 16 bp, M. musculus
aaaaagtgtgtcactg

SEQ ID NO: 336168 - DNA, 16 bp, M. musculus
aaaaagtgtgttcttt

SEQ ID NO: 336169 - DNA, 16 bp, M. musculus
aaaaagtgttttattt

SEQ ID NO: 336170 - DNA, 16 bp, M. musculus
aaaaagtgtttttaaa

SEQ ID NO: 336171 - DNA, 16 bp, M. musculus
aaaaagttaaagtttt

SEQ ID NO: 336172 - DNA, 16 bp, M. musculus
aaaaagttatattttg

SEQ ID NO: 336173 - DNA, 16 bp, M. musculus
aaaaagtttatttcat

SEQ ID NO: 336174 - DNA, 16 bp, M. musculus
aaaaagtttttctttt

SEQ ID NO: 336175 - DNA, 16 bp, M. musculus
aaaaataaaaatgtct

SEQ ID NO: 336176 - DNA, 16 bp, M. musculus
aaaaataaaagtgctt

SEQ ID NO: 336177 - DNA, 16 bp, M. musculus
aaaaataaaatcactg

SEQ ID NO: 336178 - DNA, 16 bp, M. musculus
aaaaataaaatgtgtg

SEQ ID NO: 336179 - DNA, 16 bp, M. musculus
aaaaataaaatgtttc

SEQ ID NO: 336180 - DNA, 16 bp, M. musculus
aaaaataaaccagttt

SEQ ID NO: 336181 - DNA, 16 bp, M. musculus
aaaaataaagactttt

SEQ ID NO: 336182 - DNA, 16 bp, M. musculus
aaaaataaagtcactt

SEQ ID NO: 336183 - DNA, 16 bp, M. musculus
aaaaataaagtgtttt

SEQ ID NO: 336184 - DNA, 16 bp, M. musculus
aaaaataaatgcttat

SEQ ID NO: 336185 - DNA, 16 bp, M. musculus
aaaaataaatgtctgt

SEQ ID NO: 336186 - DNA, 16 bp, M. musculus
aaaaataacatggaga

SEQ ID NO: 336187 - DNA, 16 bp, M. musculus
aaaaataagctagtgt

SEQ ID NO: 336188 - DNA, 29 bp, M. musculus
aaaaataataacccttccttttctgaaga

SEQ ID NO: 336189 - DNA, 16 bp, M. musculus
aaaaataatttcttct

SEQ ID NO: 336190 - DNA, 16 bp, M. musculus
aaaaataattttcagt

SEQ ID NO: 336191 - DNA, 16 bp, M. musculus
aaaaataattttcttg

SEQ ID NO: 336192 - DNA, 16 bp, M. musculus
aaaaataattttgtgg

SEQ ID NO: 336193 - DNA, 16 bp, M. musculus
aaaaatacattttctt

SEQ ID NO: 336194 - DNA, 16 bp, M. musculus
aaaaatacattttgaa

SEQ ID NO: 336195 - DNA, 16 bp, M. musculus
aaaaataccctgacaa

SEQ ID NO: 336196 - DNA, 16 bp, M. musculus
aaaaatactcatacac

SEQ ID NO: 336197 - DNA, 16 bp, M. musculus
aaaaatactgttttca

SEQ ID NO: 336198 - DNA, 16 bp, M. musculus
aaaaatacttttccca

SEQ ID NO: 336199 - DNA, 16 bp, M. musculus
aaaaatatcatcctga

SEQ ID NO: 336200 - DNA, 16 bp, M. musculus
aaaaatatccagtaaa

SEQ ID NO: 336201 - DNA, 16 bp, M. musculus
aaaaatatgaagacat

SEQ ID NO: 336202 - DNA, 16 bp, M. musculus
aaaaatatgtgtatat

SEQ ID NO: 336203 - DNA, 16 bp, M. musculus
aaaaatatgttctttt

SEQ ID NO: 336204 - DNA, 16 bp, M. musculus
aaaaatattcaaaagt

SEQ ID NO: 336205 - DNA, 16 bp, M. musculus
aaaaatattcaatgaa

SEQ ID NO: 336206 - DNA, 16 bp, M. musculus
aaaaatatttgcaaga

SEQ ID NO: 336207 - DNA, 16 bp, M. musculus
aaaaatatttgttttg

SEQ ID NO: 336208 - DNA, 16 bp, M. musculus
aaaaatattttacctt

SEQ ID NO: 336209 - DNA, 16 bp, M. musculus
aaaaatattttcaact

SEQ ID NO: 336210 - DNA, 16 bp, M. musculus
aaaaatattttcagtt

SEQ ID NO: 336211 - DNA, 16 bp, M. musculus
aaaaatatttttcctt

SEQ ID NO: 336212 - DNA, 16 bp, M. musculus
aaaaatatttttgtca

SEQ ID NO: 336213 - DNA, 16 bp, M. musculus
aaaaatatttttgtgt

SEQ ID NO: 336214 - DNA, 16 bp, M. musculus
aaaaatattttttctc

SEQ ID NO: 336215 - DNA, 16 bp, M. musculus
aaaaatcagaatattt

SEQ ID NO: 336216 - DNA, 16 bp, M. musculus
aaaaatcaggaaaatg

SEQ ID NO: 336217 - DNA, 16 bp, M. musculus
aaaaatcagtctccaa

SEQ ID NO: 336218 - DNA, 16 bp, M. musculus
aaaaatcatatctcat

SEQ ID NO: 336219 - DNA, 16 bp, M. musculus
aaaaatcatatttctg

SEQ ID NO: 336220 - DNA, 16 bp, M. musculus
aaaaatcatttctttt

SEQ ID NO: 336221 - DNA, 16 bp, M. musculus
aaaaatcattttgaaa

SEQ ID NO: 336222 - DNA, 16 bp, M. musculus
aaaaatccctcaaaga

SEQ ID NO: 336223 - DNA, 16 bp, M. musculus
aaaaatcccttaaaga

SEQ ID NO: 336224 - DNA, 16 bp, M. musculus
aaaaatcccttacaga

SEQ ID NO: 336225 - DNA, 16 bp, M. musculus
aaaaatcctcaattaa

SEQ ID NO: 336226 - DNA, 16 bp, M. musculus
aaaaatcctttcccaa

SEQ ID NO: 336227 - DNA, 16 bp, M. musculus
aaaaatcctttgacaa

SEQ ID NO: 336228 - DNA, 16 bp, M. musculus
aaaaatctctttattt

SEQ ID NO: 336229 - DNA, 16 bp, M. musculus
aaaaatctgagttcaa

SEQ ID NO: 336230 - DNA, 16 bp, M. musculus
aaaaatctgtatgaaa

SEQ ID NO: 336231 - DNA, 16 bp, M. musculus
aaaaatctgttttctt

SEQ ID NO: 336232 - DNA, 16 bp, M. musculus
aaaaatcttacatttt

SEQ ID NO: 336233 - DNA, 16 bp, M. musculus
aaaaatcttggaaaaa

SEQ ID NO: 336234 - DNA, 16 bp, M. musculus
aaaaatcttttgaaaa

SEQ ID NO: 336235 - DNA, 16 bp, M. musculus
aaaaatcttttgtttt

SEQ ID NO: 336236 - DNA, 16 bp, M. musculus
aaaaatgaaaacattt

SEQ ID NO: 336237 - DNA, 16 bp, M. musculus
aaaaatgaaagcattt

SEQ ID NO: 336238 - DNA, 16 bp, M. musculus
aaaaatgaaaggtatt

SEQ ID NO: 336239 - DNA, 16 bp, M. musculus
aaaaatgaaattgtga

SEQ ID NO: 336240 - DNA, 16 bp, M. musculus
aaaaatgaagactgaa

SEQ ID NO: 336241 - DNA, 16 bp, M. musculus
aaaaatgaaggctgaa

SEQ ID NO: 336242 - DNA, 16 bp, M. musculus
aaaaatgaattcttta

SEQ ID NO: 336243 - DNA, 16 bp, M. musculus
aaaaatgaattgtttt

SEQ ID NO: 336244 - DNA, 16 bp, M. musculus
aaaaatgaccctgaga

SEQ ID NO: 336245 - DNA, 17 bp, M. musculus
aaaaatgagaatgggtg

SEQ ID NO: 336246 - DNA, 16 bp, M. musculus
aaaaatgatgatgatg

SEQ ID NO: 336247 - DNA, 16 bp, M. musculus
aaaaatgatgtctttt

SEQ ID NO: 336248 - DNA, 16 bp, M. musculus
aaaaatgattgttact

SEQ ID NO: 336249 - DNA, 16 bp, M. musculus
aaaaatgatttctttt

SEQ ID NO: 336250 - DNA, 16 bp, M. musculus
aaaaatgcaaattcat

SEQ ID NO: 336251 - DNA, 16 bp, M. musculus
aaaaatgcagctagag

SEQ ID NO: 336252 - DNA, 16 bp, M. musculus
aaaaatgcattaaaat

SEQ ID NO: 336253 - DNA, 16 bp, M. musculus
aaaaatgcatttaaaa

SEQ ID NO: 336254 - DNA, 16 bp, M. musculus
aaaaatgcatttttaa

SEQ ID NO: 336255 - DNA, 16 bp, M. musculus
aaaaatgccttaataa

SEQ ID NO: 336256 - DNA, 16 bp, M. musculus
aaaaatgccttacagc

SEQ ID NO: 336257 - DNA, 16 bp, M. musculus
aaaaatgctttaaaga

SEQ ID NO: 336258 - DNA, 16 bp, M. musculus
aaaaatgcttttaaat

SEQ ID NO: 336259 - DNA, 16 bp, M. musculus
aaaaatggggatggtg

SEQ ID NO: 336260 - DNA, 16 bp, M. musculus
aaaaatggtcatttta

SEQ ID NO: 336261 - DNA, 16 bp, M. musculus
aaaaatgtataatttc

SEQ ID NO: 336262 - DNA, 16 bp, M. musculus
aaaaatgtatgcttta

SEQ ID NO: 336263 - DNA, 16 bp, M. musculus
aaaaatgtattcattt

SEQ ID NO: 336264 - DNA, 16 bp, M. musculus
aaaaatgtatttgtgt

SEQ ID NO: 336265 - DNA, 16 bp, M. musculus
aaaaatgtattttatg

SEQ ID NO: 336266 - DNA, 16 bp, M. musculus
aaaaatgtattttctg

SEQ ID NO: 336267 - DNA, 16 bp, M. musculus
aaaaatgtattttctt

SEQ ID NO: 336268 - DNA, 16 bp, M. musculus
aaaaatgtattttgat

SEQ ID NO: 336269 - DNA, 16 bp, M. musculus
aaaaatgtatttttga

SEQ ID NO: 336270 - DNA, 16 bp, M. musculus
aaaaatgtatttttgt

SEQ ID NO: 336271 - DNA, 16 bp, M. musculus
aaaaatgtcattaaaa

SEQ ID NO: 336272 - DNA, 16 bp, M. musculus
aaaaatgtcattttct

SEQ ID NO: 336273 - DNA, 16 bp, M. musculus
aaaaatgtcttcattt

SEQ ID NO: 336274 - DNA, 16 bp, M. musculus
aaaaatgtgaatattt

SEQ ID NO: 336275 - DNA, 16 bp, M. musculus
aaaaatgtgattttta

SEQ ID NO: 336276 - DNA, 20 bp, M. musculus
aaaaatgtggtacatttaca

SEQ ID NO: 336277 - DNA, 23 bp, M. musculus
aaaaatgtggtacatttacacaa

SEQ ID NO: 336278 - DNA, 16 bp, M. musculus
aaaaatgtgtgtgttt

SEQ ID NO: 336279 - DNA, 16 bp, M. musculus
aaaaatgtgttatttt

SEQ ID NO: 336280 - DNA, 16 bp, M. musculus
aaaaatgtgttgaaat

SEQ ID NO: 336281 - DNA, 16 bp, M. musculus
aaaaatgttaaaagca

SEQ ID NO: 336282 - DNA, 16 bp, M. musculus
aaaaatgttcaacagc

SEQ ID NO: 336283 - DNA, 16 bp, M. musculus
aaaaatgttcagaatt

SEQ ID NO: 336284 - DNA, 16 bp, M. musculus
aaaaatgtttatttca

SEQ ID NO: 336285 - DNA, 16 bp, M. musculus
aaaaatgtttctaatt

SEQ ID NO: 336286 - DNA, 16 bp, M. musculus
aaaaatgtttctattt

SEQ ID NO: 336287 - DNA, 16 bp, M. musculus
aaaaatgttttatgaa

SEQ ID NO: 336288 - DNA, 16 bp, M. musculus
aaaaatgttttctttt

SEQ ID NO: 336289 - DNA, 16 bp, M. musculus
aaaaatgtttttagtt

SEQ ID NO: 336290 - DNA, 16 bp, M. musculus
aaaaattaaagacttc

SEQ ID NO: 336291 - DNA, 16 bp, M. musculus
aaaaattaaagttaca

SEQ ID NO: 336292 - DNA, 16 bp, M. musculus
aaaaattaaattccca

SEQ ID NO: 336293 - DNA, 16 bp, M. musculus
aaaaattaatattctc

SEQ ID NO: 336294 - DNA, 16 bp, M. musculus
aaaaattacaattatg

SEQ ID NO: 336295 - DNA, 16 bp, M. musculus
aaaaattacagatttt

SEQ ID NO: 336296 - DNA, 16 bp, M. musculus
aaaaattacagttttt

SEQ ID NO: 336297 - DNA, 16 bp, M. musculus
aaaaattcaacatcct

SEQ ID NO: 336298 - DNA, 16 bp, M. musculus
aaaaattcatcagatc

SEQ ID NO: 336299 - DNA, 16 bp, M. musculus
aaaaattcattttcaa

SEQ ID NO: 336300 - DNA, 16 bp, M. musculus
aaaaattcctcaagga

SEQ ID NO: 336301 - DNA, 16 bp, M. musculus
aaaaattccttaattt

SEQ ID NO: 336302 - DNA, 16 bp, M. musculus
aaaaattctacctgag

SEQ ID NO: 336303 - DNA, 16 bp, M. musculus
aaaaattcttccagag

SEQ ID NO: 336304 - DNA, 16 bp, M. musculus
aaaaattcttgaaaaa

SEQ ID NO: 336305 - DNA, 16 bp, M. musculus
aaaaattctttcctaa

SEQ ID NO: 336306 - DNA, 16 bp, M. musculus
aaaaattgcatttaaa

SEQ ID NO: 336307 - DNA, 16 bp, M. musculus
aaaaattgggctcaga

SEQ ID NO: 336308 - DNA, 16 bp, M. musculus
aaaaattgtgattttt

SEQ ID NO: 336309 - DNA, 16 bp, M. musculus
aaaaatttaaagcata

SEQ ID NO: 336310 - DNA, 16 bp, M. musculus
aaaaattttaaatgac

SEQ ID NO: 336311 - DNA, 16 bp, M. musculus
aaaacaaaaaacctgc

SEQ ID NO: 336312 - DNA, 16 bp, M. musculus
aaaacaaaaaaccttg

SEQ ID NO: 336313 - DNA, 16 bp, M. musculus
aaaacaaaaaacttgt

SEQ ID NO: 336314 - DNA, 16 bp, M. musculus
aaaacaaaaaccagtt

SEQ ID NO: 336315 - DNA, 16 bp, M. musculus
aaaacaaaaacccagt

SEQ ID NO: 336316 - DNA, 16 bp, M. musculus
aaaacaaaacactgga

SEQ ID NO: 336317 - DNA, 16 bp, M. musculus
aaaacaaaaccatttt

SEQ ID NO: 336318 - DNA, 16 bp, M. musculus
aaaacaaaactctgag

SEQ ID NO: 336319 - DNA, 16 bp, M. musculus
aaaacaaaagacactg

SEQ ID NO: 336320 - DNA, 16 bp, M. musculus
aaaacaaaagcaagct

SEQ ID NO: 336321 - DNA, 16 bp, M. musculus
aaaacaaaaggttata

SEQ ID NO: 336322 - DNA, 16 bp, M. musculus
aaaacaaaatatgtat

SEQ ID NO: 336323 - DNA, 16 bp, M. musculus
aaaacaaaatccagac

SEQ ID NO: 336324 - DNA, 16 bp, M. musculus
aaaacaaaatgttttt

SEQ ID NO: 336325 - DNA, 16 bp, M. musculus
aaaacaaaattttagt

SEQ ID NO: 336326 - DNA, 16 bp, M. musculus
aaaacaaacctttcct

SEQ ID NO: 336327 - DNA, 16 bp, M. musculus
aaaacaaagagcattt

SEQ ID NO: 336328 - DNA, 16 bp, M. musculus
aaaacaaaggaatttt

SEQ ID NO: 336329 - DNA, 16 bp, M. musculus
aaaacaaagtatttca

SEQ ID NO: 336330 - DNA, 16 bp, M. musculus
aaaacaaataaatgtt

SEQ ID NO: 336331 - DNA, 16 bp, M. musculus
aaaacaaatctttctt

SEQ ID NO: 336332 - DNA, 16 bp, M. musculus
aaaacaaatgctttta

SEQ ID NO: 336333 - DNA, 16 bp, M. musculus
aaaacaaatggatgga

SEQ ID NO: 336334 - DNA, 16 bp, M. musculus
aaaacaaatgttttat

SEQ ID NO: 336335 - DNA, 16 bp, M. musculus
aaaacaaattcctttt

SEQ ID NO: 336336 - DNA, 16 bp, M. musculus
aaaacaaattcttcct

SEQ ID NO: 336337 - DNA, 16 bp, M. musculus
aaaacaacagaaactg

SEQ ID NO: 336338 - DNA, 16 bp, M. musculus
aaaacaaccaagtaga

SEQ ID NO: 336339 - DNA, 16 bp, M. musculus
aaaacaaccctgagat

SEQ ID NO: 336340 - DNA, 16 bp, M. musculus
aaaacaacttaaagga

SEQ ID NO: 336341 - DNA, 16 bp, M. musculus
aaaacaagaagctgta

SEQ ID NO: 336342 - DNA, 16 bp, M. musculus
aaaacaagaggagcat

SEQ ID NO: 336343 - DNA, 16 bp, M. musculus
aaaacaagatggaagg

SEQ ID NO: 336344 - DNA, 16 bp, M. musculus
aaaacaagctgaacaa

SEQ ID NO: 336345 - DNA, 16 bp, M. musculus
aaaacaagctttaaaa

SEQ ID NO: 336346 - DNA, 16 bp, M. musculus
aaaacaagggctggtg

SEQ ID NO: 336347 - DNA, 16 bp, M. musculus
aaaacaagtaaatctt

SEQ ID NO: 336348 - DNA, 16 bp, M. musculus
aaaacaagtgacattt

SEQ ID NO: 336349 - DNA, 16 bp, M. musculus
aaaacaagtttatttt

SEQ ID NO: 336350 - DNA, 16 bp, M. musculus
aaaacaagttttaaaa

SEQ ID NO: 336351 - DNA, 16 bp, M. musculus
aaaacaagtttttaaa

SEQ ID NO: 336352 - DNA, 16 bp, M. musculus
aaaacaagtttttcag

SEQ ID NO: 336353 - DNA, 16 bp, M. musculus
aaaacaataaatgcac

SEQ ID NO: 336354 - DNA, 16 bp, M. musculus
aaaacaataacttcat

SEQ ID NO: 336355 - DNA, 16 bp, M. musculus
aaaacaatactgagat

SEQ ID NO: 336356 - DNA, 16 bp, M. musculus
aaaacaatatttgaaa

SEQ ID NO: 336357 - DNA, 16 bp, M. musculus
aaaacaatgaatttgt

SEQ ID NO: 336358 - DNA, 16 bp, M. musculus
aaaacaatgtatttta

SEQ ID NO: 336359 - DNA, 16 bp, M. musculus
aaaacaattatccaag

SEQ ID NO: 336360 - DNA, 16 bp, M. musculus
aaaacaattttctttt

SEQ ID NO: 336361 - DNA, 16 bp, M. musculus
aaaacacaaacaggtg

SEQ ID NO: 336362 - DNA, 16 bp, M. musculus
aaaacacagattttta

SEQ ID NO: 336363 - DNA, 16 bp, M. musculus
aaaacacagggaggga

SEQ ID NO: 336364 - DNA, 16 bp, M. musculus
aaaacacatgaaattg

SEQ ID NO: 336365 - DNA, 16 bp, M. musculus
aaaacacatgatatgc

SEQ ID NO: 336366 - DNA, 16 bp, M. musculus
aaaacacatggaagga

SEQ ID NO: 336367 - DNA, 16 bp, M. musculus
aaaacacattcatttt

SEQ ID NO: 336368 - DNA, 16 bp, M. musculus
aaaacacatttctttt

SEQ ID NO: 336369 - DNA, 16 bp, M. musculus
aaaacacattttattt

SEQ ID NO: 336370 - DNA, 16 bp, M. musculus
aaaacaccaatgcaca

SEQ ID NO: 336371 - DNA, 16 bp, M. musculus
aaaacaccatagccaa

SEQ ID NO: 336372 - DNA, 16 bp, M. musculus
aaaacacggatattta

SEQ ID NO: 336373 - DNA, 16 bp, M. musculus
aaaacactatgaccaa

SEQ ID NO: 336374 - DNA, 16 bp, M. musculus
aaaacactatttttaa

SEQ ID NO: 336375 - DNA, 16 bp, M. musculus
aaaacactcatgcaca

SEQ ID NO: 336376 - DNA, 16 bp, M. musculus
aaaacactggccaaaa

SEQ ID NO: 336377 - DNA, 16 bp, M. musculus
aaaacactgggactct

SEQ ID NO: 336378 - DNA, 16 bp, M. musculus
aaaacactgtttcctt

SEQ ID NO: 336379 - DNA, 16 bp, M. musculus
aaaacacttcatggat

SEQ ID NO: 336380 - DNA, 16 bp, M. musculus
aaaacactttcttctc

SEQ ID NO: 336381 - DNA, 16 bp, M. musculus
aaaacacttttttaaa

SEQ ID NO: 336382 - DNA, 16 bp, M. musculus
aaaacagaaaagcact

SEQ ID NO: 336383 - DNA, 16 bp, M. musculus
aaaacagaaaatgttt

SEQ ID NO: 336384 - DNA, 16 bp, M. musculus
aaaacagaaatatttt

SEQ ID NO: 336385 - DNA, 16 bp, M. musculus
aaaacagacatttaca

SEQ ID NO: 336386 - DNA, 16 bp, M. musculus
aaaacagagacacagt

SEQ ID NO: 336387 - DNA, 16 bp, M. musculus
aaaacagagttctcca

SEQ ID NO: 336388 - DNA, 16 bp, M. musculus
aaaacagatacagaga

SEQ ID NO: 336389 - DNA, 16 bp, M. musculus
aaaacagatgcagaaa

SEQ ID NO: 336390 - DNA, 16 bp, M. musculus
aaaacagattttaaaa

SEQ ID NO: 336391 - DNA, 16 bp, M. musculus
aaaacagatttttttt

SEQ ID NO: 336392 - DNA, 16 bp, M. musculus
aaaacagcaatggcct

SEQ ID NO: 336393 - DNA, 16 bp, M. musculus
aaaacagcagtgtttt

SEQ ID NO: 336394 - DNA, 16 bp, M. musculus
aaaacagcttcaggaa

SEQ ID NO: 336395 - DNA, 16 bp, M. musculus
aaaacaggaaggtaat

SEQ ID NO: 336396 - DNA, 16 bp, M. musculus
aaaacaggggcagtta

SEQ ID NO: 336397 - DNA, 16 bp, M. musculus
aaaacagtaaaatatt

SEQ ID NO: 336398 - DNA, 16 bp, M. musculus
aaaacagtcctgaaca

SEQ ID NO: 336399 - DNA, 16 bp, M. musculus
aaaacagtgacatcat

SEQ ID NO: 336400 - DNA, 16 bp, M. musculus
aaaacagtgaccaaaa

SEQ ID NO: 336401 - DNA, 16 bp, M. musculus
aaaacagtgagctcca

SEQ ID NO: 336402 - DNA, 16 bp, M. musculus
aaaacagtggctacag

SEQ ID NO: 336403 - DNA, 16 bp, M. musculus
aaaacagtggttttca

SEQ ID NO: 336404 - DNA, 16 bp, M. musculus
aaaacagtgttttctg

SEQ ID NO: 336405 - DNA, 16 bp, M. musculus
aaaacagttttccaag

SEQ ID NO: 336406 - DNA, 16 bp, M. musculus
aaaacatacaggaaat

SEQ ID NO: 336407 - DNA, 16 bp, M. musculus
aaaacatacattgaac

SEQ ID NO: 336408 - DNA, 16 bp, M. musculus
aaaacatatatttgaa

SEQ ID NO: 336409 - DNA, 16 bp, M. musculus
aaaacatattcttata

SEQ ID NO: 336410 - DNA, 16 bp, M. musculus
aaaacatcaggaccaa

SEQ ID NO: 336411 - DNA, 16 bp, M. musculus
aaaacatcatgaccaa

SEQ ID NO: 336412 - DNA, 16 bp, M. musculus
aaaacatcattttcaa

SEQ ID NO: 336413 - DNA, 16 bp, M. musculus
aaaacatccagaaaat

SEQ ID NO: 336414 - DNA, 16 bp, M. musculus
aaaacatccaggaaat

SEQ ID NO: 336415 - DNA, 16 bp, M. musculus
aaaacatccaggatat

SEQ ID NO: 336416 - DNA, 16 bp, M. musculus
aaaacatccttttacc

SEQ ID NO: 336417 - DNA, 16 bp, M. musculus
aaaacatctgacagag

SEQ ID NO: 336418 - DNA, 16 bp, M. musculus
aaaacatcttcaccaa

SEQ ID NO: 336419 - DNA, 16 bp, M. musculus
aaaacatcttcatttt

SEQ ID NO: 336420 - DNA, 16 bp, M. musculus
aaaacatcttttggag

SEQ ID NO: 336421 - DNA, 16 bp, M. musculus
aaaacatgaaagaatt

SEQ ID NO: 336422 - DNA, 16 bp, M. musculus
aaaacatgaatgaaat

SEQ ID NO: 336423 - DNA, 16 bp, M. musculus
aaaacatgcagaaaat

SEQ ID NO: 336424 - DNA, 16 bp, M. musculus
aaaacatgggcacagg

SEQ ID NO: 336425 - DNA, 16 bp, M. musculus
aaaacatgtattttca

SEQ ID NO: 336426 - DNA, 16 bp, M. musculus
aaaacatgttcagcat

SEQ ID NO: 336427 - DNA, 16 bp, M. musculus
aaaacatgtttttgtt

SEQ ID NO: 336428 - DNA, 16 bp, M. musculus
aaaacattatgaccaa

SEQ ID NO: 336429 - DNA, 16 bp, M. musculus
aaaacattattgaaaa

SEQ ID NO: 336430 - DNA, 16 bp, M. musculus
aaaacattcattctag

SEQ ID NO: 336431 - DNA, 16 bp, M. musculus
aaaacattctttcatg

SEQ ID NO: 336432 - DNA, 16 bp, M. musculus
aaaacattcttttaaa

SEQ ID NO: 336433 - DNA, 16 bp, M. musculus
aaaacattgaattggg

SEQ ID NO: 336434 - DNA, 16 bp, M. musculus
aaaacatttaaaagga

SEQ ID NO: 336435 - DNA, 16 bp, M. musculus
aaaacatttattttca

SEQ ID NO: 336436 - DNA, 16 bp, M. musculus
aaaacatttattttga

SEQ ID NO: 336437 - DNA, 16 bp, M. musculus
aaaacatttcaagaca

SEQ ID NO: 336438 - DNA, 16 bp, M. musculus
aaaacatttcattgga

SEQ ID NO: 336439 - DNA, 16 bp, M. musculus
aaaacatttcatttaa

SEQ ID NO: 336440 - DNA, 16 bp, M. musculus
aaaacatttctctttt

SEQ ID NO: 336441 - DNA, 16 bp, M. musculus
aaaacatttcttttta

SEQ ID NO: 336442 - DNA, 16 bp, M. musculus
aaaacatttgacaaaa

SEQ ID NO: 336443 - DNA, 16 bp, M. musculus
aaaacattttaaaaga

SEQ ID NO: 336444 - DNA, 16 bp, M. musculus
aaaacattttaagaaa

SEQ ID NO: 336445 - DNA, 16 bp, M. musculus
aaaacattttaccatg

SEQ ID NO: 336446 - DNA, 16 bp, M. musculus
aaaacattttcagaaa

SEQ ID NO: 336447 - DNA, 16 bp, M. musculus
aaaacatttttaaaga

SEQ ID NO: 336448 - DNA, 16 bp, M. musculus
aaaacattttttaaag

SEQ ID NO: 336449 - DNA, 16 bp, M. musculus
aaaacattttttcatt

SEQ ID NO: 336450 - DNA, 16 bp, M. musculus
aaaacatttttttcct

SEQ ID NO: 336451 - DNA, 16 bp, M. musculus
aaaaccaaaccaaagt

SEQ ID NO: 336452 - DNA, 16 bp, M. musculus
aaaaccaaagacagtg

SEQ ID NO: 336453 - DNA, 17 bp, M. musculus
aaaaccaaagtattcca

SEQ ID NO: 336454 - DNA, 16 bp, M. musculus
aaaaccaaatattact

SEQ ID NO: 336455 - DNA, 16 bp, M. musculus
aaaaccaaatgtacac

SEQ ID NO: 336456 - DNA, 16 bp, M. musculus
aaaaccaaatttacac

SEQ ID NO: 336457 - DNA, 16 bp, M. musculus
aaaaccaacttggaga

SEQ ID NO: 336458 - DNA, 16 bp, M. musculus
aaaaccaaggcacgag

SEQ ID NO: 336459 - DNA, 16 bp, M. musculus
aaaaccaatttttttt

SEQ ID NO: 336460 - DNA, 16 bp, M. musculus
aaaaccacacatttat

SEQ ID NO: 336461 - DNA, 16 bp, M. musculus
aaaaccacacctctgc

SEQ ID NO: 336462 - DNA, 16 bp, M. musculus
aaaaccagagactctg

SEQ ID NO: 336463 - DNA, 16 bp, M. musculus
aaaaccagagagagtg

SEQ ID NO: 336464 - DNA, 16 bp, M. musculus
aaaaccagagccacat

SEQ ID NO: 336465 - DNA, 16 bp, M. musculus
aaaaccagatacaatg

SEQ ID NO: 336466 - DNA, 16 bp, M. musculus
aaaaccagccagtaca

SEQ ID NO: 336467 - DNA, 16 bp, M. musculus
aaaaccagccggtaca

SEQ ID NO: 336468 - DNA, 16 bp, M. musculus
aaaaccaggagctagt

SEQ ID NO: 336469 - DNA, 16 bp, M. musculus
aaaaccaggcagtaca

SEQ ID NO: 336470 - DNA, 16 bp, M. musculus
aaaaccatctataact

SEQ ID NO: 336471 - DNA, 16 bp, M. musculus
aaaaccattttatttt

SEQ ID NO: 336472 - DNA, 16 bp, M. musculus
aaaaccattttttaaa

SEQ ID NO: 336473 - DNA, 16 bp, M. musculus
aaaacccaaagtcttt

SEQ ID NO: 336474 - DNA, 16 bp, M. musculus
aaaacccagaaggtaa

SEQ ID NO: 336475 - DNA, 16 bp, M. musculus
aaaacccagaccctgt

SEQ ID NO: 336476 - DNA, 16 bp, M. musculus
aaaaccccttcagctc

SEQ ID NO: 336477 - DNA, 16 bp, M. musculus
aaaacccgggaggaaa

SEQ ID NO: 336478 - DNA, 16 bp, M. musculus
aaaaccctgcctcaaa

SEQ ID NO: 336479 - DNA, 16 bp, M. musculus
aaaaccctgtctcaga

SEQ ID NO: 336480 - DNA, 16 bp, M. musculus
aaaaccctgtctgaaa

SEQ ID NO: 336481 - DNA, 16 bp, M. musculus
aaaaccctgtcttgaa

SEQ ID NO: 336482 - DNA, 16 bp, M. musculus
aaaacccttaaagaat

SEQ ID NO: 336483 - DNA, 16 bp, M. musculus
aaaacccttactaaga

SEQ ID NO: 336484 - DNA, 16 bp, M. musculus
aaaacccttattaaaa

SEQ ID NO: 336485 - DNA, 16 bp, M. musculus
aaaacccttccctttt

SEQ ID NO: 336486 - DNA, 26 bp, M. musculus
aaaacctaaacagcttagacaacaaa

SEQ ID NO: 336487 - DNA, 16 bp, M. musculus
aaaacctaagaataat

SEQ ID NO: 336488 - DNA, 16 bp, M. musculus
aaaacctacttgttca

SEQ ID NO: 336489 - DNA, 16 bp, M. musculus
aaaacctagcaaagag

SEQ ID NO: 336490 - DNA, 16 bp, M. musculus
aaaacctaggaaagag

SEQ ID NO: 336491 - DNA, 16 bp, M. musculus
aaaacctagggaagaa

SEQ ID NO: 336492 - DNA, 16 bp, M. musculus
aaaacctccagcccca

SEQ ID NO: 336493 - DNA, 16 bp, M. musculus
aaaacctgaatgaaat

SEQ ID NO: 336494 - DNA, 16 bp, M. musculus
aaaacctgaggaaatc

SEQ ID NO: 336495 - DNA, 16 bp, M. musculus
aaaacctggaagaact

SEQ ID NO: 336496 - DNA, 16 bp, M. musculus
aaaacctggaagatat

SEQ ID NO: 336497 - DNA, 16 bp, M. musculus
aaaacctggatgaaaa

SEQ ID NO: 336498 - DNA, 16 bp, M. musculus
aaaacctgggaaaaga

SEQ ID NO: 336499 - DNA, 16 bp, M. musculus
aaaacctgtattccat

SEQ ID NO: 336500 - DNA, 16 bp, M. musculus
aaaaccttcattctca

SEQ ID NO: 336501 - DNA, 16 bp, M. musculus
aaaaccttgaagatat

SEQ ID NO: 336502 - DNA, 16 bp, M. musculus
aaaaccttgtctcaaa

SEQ ID NO: 336503 - DNA, 17 bp, M. musculus
aaaaccttgtcttgaaa

SEQ ID NO: 336504 - DNA, 19 bp, M. musculus
aaaacgaaaccccgtccct

SEQ ID NO: 336505 - DNA, 16 bp, M. musculus
aaaacgaaaggatgga

SEQ ID NO: 336506 - DNA, 16 bp, M. musculus
aaaacgacacgggagc

SEQ ID NO: 336507 - DNA, 16 bp, M. musculus
aaaactaaaatgtaat

SEQ ID NO: 336508 - DNA, 16 bp, M. musculus
aaaactaaataaaggg

SEQ ID NO: 336509 - DNA, 16 bp, M. musculus
aaaactaaatcaggta

SEQ ID NO: 336510 - DNA, 16 bp, M. musculus
aaaactaaccagaaca

SEQ ID NO: 336511 - DNA, 16 bp, M. musculus
aaaactaaccagcaca

SEQ ID NO: 336512 - DNA, 16 bp, M. musculus
aaaactaagatggaga

SEQ ID NO: 336513 - DNA, 16 bp, M. musculus
aaaactaatcagcaca

SEQ ID NO: 336514 - DNA, 16 bp, M. musculus
aaaactacagaaagcc

SEQ ID NO: 336515 - DNA, 16 bp, M. musculus
aaaactacagaatacc

SEQ ID NO: 336516 - DNA, 16 bp, M. musculus
aaaactagccagcaca

SEQ ID NO: 336517 - DNA, 16 bp, M. musculus
aaaactatggataata

SEQ ID NO: 336518 - DNA, 16 bp, M. musculus
aaaactattttcaaca

SEQ ID NO: 336519 - DNA, 16 bp, M. musculus
aaaactatttttatct

SEQ ID NO: 336520 - DNA, 16 bp, M. musculus
aaaactattttttgtt

SEQ ID NO: 336521 - DNA, 18 bp, M. musculus
aaaactcaaggggggaga

SEQ ID NO: 336522 - DNA, 16 bp, M. musculus
aaaactcaagtccaaa

SEQ ID NO: 336523 - DNA, 16 bp, M. musculus
aaaactcacagctctg

SEQ ID NO: 336524 - DNA, 16 bp, M. musculus
aaaactcattttcttt

SEQ ID NO: 336525 - DNA, 16 bp, M. musculus
aaaactccctatccca

SEQ ID NO: 336526 - DNA, 16 bp, M. musculus
aaaactctaccagaga

SEQ ID NO: 336527 - DNA, 16 bp, M. musculus
aaaactctcaaagaat

SEQ ID NO: 336528 - DNA, 16 bp, M. musculus
aaaactctcaatcacc

SEQ ID NO: 336529 - DNA, 19 bp, M. musculus
aaaactctcaattaccata

SEQ ID NO: 336530 - DNA, 16 bp, M. musculus
aaaactctcctcaagg

SEQ ID NO: 336531 - DNA, 16 bp, M. musculus
aaaactcttcaattta

SEQ ID NO: 336532 - DNA, 16 bp, M. musculus
aaaactgaaaatttaa

SEQ ID NO: 336533 - DNA, 16 bp, M. musculus
aaaactgaaagtagca

SEQ ID NO: 336534 - DNA, 16 bp, M. musculus
aaaactgaagaaagtg

SEQ ID NO: 336535 - DNA, 16 bp, M. musculus
aaaactgaccctgact

SEQ ID NO: 336536 - DNA, 16 bp, M. musculus
aaaactgactcctgaa

SEQ ID NO: 336537 - DNA, 16 bp, M. musculus
aaaactgacttttaaa

SEQ ID NO: 336538 - DNA, 16 bp, M. musculus
aaaactgacttttttt

SEQ ID NO: 336539 - DNA, 16 bp, M. musculus
aaaactgagactgccc

SEQ ID NO: 336540 - DNA, 16 bp, M. musculus
aaaactgaggcagaga

SEQ ID NO: 336541 - DNA, 16 bp, M. musculus
aaaactgatttttaaa

SEQ ID NO: 336542 - DNA, 16 bp, M. musculus
aaaactgcaacagaaa

SEQ ID NO: 336543 - DNA, 16 bp, M. musculus
aaaactgccagtgttc

SEQ ID NO: 336544 - DNA, 16 bp, M. musculus
aaaactggaaaaactg

SEQ ID NO: 336545 - DNA, 16 bp, M. musculus
aaaactggaaaaatct

SEQ ID NO: 336546 - DNA, 16 bp, M. musculus
aaaactggaaaagctg

SEQ ID NO: 336547 - DNA, 16 bp, M. musculus
aaaactggaaaggaaa

SEQ ID NO: 336548 - DNA, 16 bp, M. musculus
aaaactggaaagtcta

SEQ ID NO: 336549 - DNA, 16 bp, M. musculus
aaaactggaagaaaat

SEQ ID NO: 336550 - DNA, 16 bp, M. musculus
aaaactggacatggta

SEQ ID NO: 336551 - DNA, 16 bp, M. musculus
aaaactggagaagaga

SEQ ID NO: 336552 - DNA, 16 bp, M. musculus
aaaactggagagatgg

SEQ ID NO: 336553 - DNA, 16 bp, M. musculus
aaaactggcttccagg

SEQ ID NO: 336554 - DNA, 16 bp, M. musculus
aaaactgggaaaggga

SEQ ID NO: 336555 - DNA, 16 bp, M. musculus
aaaactgtaactaaga

SEQ ID NO: 336556 - DNA, 16 bp, M. musculus
aaaactgtatttttaa

SEQ ID NO: 336557 - DNA, 16 bp, M. musculus
aaaactgtccaggatc

SEQ ID NO: 336558 - DNA, 16 bp, M. musculus
aaaactgtctagagga

SEQ ID NO: 336559 - DNA, 16 bp, M. musculus
aaaactgtcttttaaa

SEQ ID NO: 336560 - DNA, 16 bp, M. musculus
aaaactgtgataaaga

SEQ ID NO: 336561 - DNA, 16 bp, M. musculus
aaaactgtggcaaatg

SEQ ID NO: 336562 - DNA, 16 bp, M. musculus
aaaactgttgcctgta

SEQ ID NO: 336563 - DNA, 16 bp, M. musculus
aaaactgtttcaaaaa

SEQ ID NO: 336564 - DNA, 16 bp, M. musculus
aaaactgttttttaaa

SEQ ID NO: 336565 - DNA, 16 bp, M. musculus
aaaacttaaccaattt

SEQ ID NO: 336566 - DNA, 16 bp, M. musculus
aaaacttcaaaatgaa

SEQ ID NO: 336567 - DNA, 16 bp, M. musculus
aaaacttcaagtatta

SEQ ID NO: 336568 - DNA, 16 bp, M. musculus
aaaacttccctaaact

SEQ ID NO: 336569 - DNA, 16 bp, M. musculus
aaaacttctaaaacca

SEQ ID NO: 336570 - DNA, 16 bp, M. musculus
aaaacttctgtaagtc

SEQ ID NO: 336571 - DNA, 16 bp, M. musculus
aaaacttgaaaaatga

SEQ ID NO: 336572 - DNA, 16 bp, M. musculus
aaaactttaagacact

SEQ ID NO: 336573 - DNA, 16 bp, M. musculus
aaaactttaatcccag

SEQ ID NO: 336574 - DNA, 16 bp, M. musculus
aaaactttaatgaaaa

SEQ ID NO: 336575 - DNA, 16 bp, M. musculus
aaaactttatttcatt

SEQ ID NO: 336576 - DNA, 16 bp, M. musculus
aaaactttcagtcacc

SEQ ID NO: 336577 - DNA, 16 bp, M. musculus
aaaactttgaaaatat

SEQ ID NO: 336578 - DNA, 16 bp, M. musculus
aaaactttgttttaaa

SEQ ID NO: 336579 - DNA, 16 bp, M. musculus
aaaacttttaaaagag

SEQ ID NO: 336580 - DNA, 16 bp, M. musculus
aaaacttttcctgggg

SEQ ID NO: 336581 - DNA, 16 bp, M. musculus
aaaacttttcttaaaa

SEQ ID NO: 336582 - DNA, 16 bp, M. musculus
aaaacttttttgtttt

SEQ ID NO: 336583 - DNA, 16 bp, M. musculus
aaaagaaaaaatcttt

SEQ ID NO: 336584 - DNA, 16 bp, M. musculus
aaaagaaaaaattcct

SEQ ID NO: 336585 - DNA, 16 bp, M. musculus
aaaagaaaaatctacc

SEQ ID NO: 336586 - DNA, 16 bp, M. musculus
aaaagaaaactgtttt

SEQ ID NO: 336587 - DNA, 16 bp, M. musculus
aaaagaaaactttccc

SEQ ID NO: 336588 - DNA, 16 bp, M. musculus
aaaagaaaagaatctt

SEQ ID NO: 336589 - DNA, 16 bp, M. musculus
aaaagaaaagtctaca

SEQ ID NO: 336590 - DNA, 16 bp, M. musculus
aaaagaaaagtgattt

SEQ ID NO: 336591 - DNA, 16 bp, M. musculus
aaaagaaaatattcat

SEQ ID NO: 336592 - DNA, 16 bp, M. musculus
aaaagaaaatattttc

SEQ ID NO: 336593 - DNA, 16 bp, M. musculus
aaaagaaaatggattt

SEQ ID NO: 336594 - DNA, 16 bp, M. musculus
aaaagaaaatgtcatt

SEQ ID NO: 336595 - DNA, 16 bp, M. musculus
aaaagaaaatgtccta

SEQ ID NO: 336596 - DNA, 16 bp, M. musculus
aaaagaaaatgtcttc

SEQ ID NO: 336597 - DNA, 16 bp, M. musculus
aaaagaaaatgtgtgc

SEQ ID NO: 336598 - DNA, 16 bp, M. musculus
aaaagaaaattcattt

SEQ ID NO: 336599 - DNA, 16 bp, M. musculus
aaaagaaaattctctt

SEQ ID NO: 336600 - DNA, 16 bp, M. musculus
aaaagaaaatttacta

SEQ ID NO: 336601 - DNA, 16 bp, M. musculus
aaaagaaacaaatttt

SEQ ID NO: 336602 - DNA, 16 bp, M. musculus
aaaagaaacaagattt

SEQ ID NO: 336603 - DNA, 16 bp, M. musculus
aaaagaaacacatttc

SEQ ID NO: 336604 - DNA, 16 bp, M. musculus
aaaagaaacacatttt

SEQ ID NO: 336605 - DNA, 16 bp, M. musculus
aaaagaaacattttaa

SEQ ID NO: 336606 - DNA, 16 bp, M. musculus
aaaagaaaccagatgt

SEQ ID NO: 336607 - DNA, 16 bp, M. musculus
aaaagaaactgaagag

SEQ ID NO: 336608 - DNA, 16 bp, M. musculus
aaaagaaagagaactt

SEQ ID NO: 336609 - DNA, 16 bp, M. musculus
aaaagaaagattcaga

SEQ ID NO: 336610 - DNA, 16 bp, M. musculus
aaaagaaagcatttaa

SEQ ID NO: 336611 - DNA, 16 bp, M. musculus
aaaagaaagcatttga

SEQ ID NO: 336612 - DNA, 16 bp, M. musculus
aaaagaaagcatttta

SEQ ID NO: 336613 - DNA, 16 bp, M. musculus
aaaagaaaggatttat

SEQ ID NO: 336614 - DNA, 16 bp, M. musculus
aaaagaaaggattttt

SEQ ID NO: 336615 - DNA, 16 bp, M. musculus
aaaagaaaggttttat

SEQ ID NO: 336616 - DNA, 16 bp, M. musculus
aaaagaaataaatctt

SEQ ID NO: 336617 - DNA, 16 bp, M. musculus
aaaagaaatacaggag

SEQ ID NO: 336618 - DNA, 16 bp, M. musculus
aaaagaaatccacaag

SEQ ID NO: 336619 - DNA, 16 bp, M. musculus
aaaagaaatctttctt

SEQ ID NO: 336620 - DNA, 16 bp, M. musculus
aaaagaaatgtaaact

SEQ ID NO: 336621 - DNA, 16 bp, M. musculus
aaaagaaatgtatttt

SEQ ID NO: 336622 - DNA, 16 bp, M. musculus
aaaagaaattcaggaa

SEQ ID NO: 336623 - DNA, 16 bp, M. musculus
aaaagaaattcctcct

SEQ ID NO: 336624 - DNA, 16 bp, M. musculus
aaaagaaattcttcct

SEQ ID NO: 336625 - DNA, 19 bp, M. musculus
aaaagaacacacatgatat

SEQ ID NO: 336626 - DNA, 16 bp, M. musculus
aaaagaacacacatgg

SEQ ID NO: 336627 - DNA, 16 bp, M. musculus
aaaagaacacccatgg

SEQ ID NO: 336628 - DNA, 16 bp, M. musculus
aaaagaacactgagat

SEQ ID NO: 336629 - DNA, 16 bp, M. musculus
aaaagaacagcaatgg

SEQ ID NO: 336630 - DNA, 16 bp, M. musculus
aaaagaacatgaagtt

SEQ ID NO: 336631 - DNA, 16 bp, M. musculus
aaaagaacatttcttt

SEQ ID NO: 336632 - DNA, 16 bp, M. musculus
aaaagaactcacagga

SEQ ID NO: 336633 - DNA, 16 bp, M. musculus
aaaagaactcacatgt

SEQ ID NO: 336634 - DNA, 16 bp, M. musculus
aaaagaactgtgggga

SEQ ID NO: 336635 - DNA, 16 bp, M. musculus
aaaagaacttctggaa

SEQ ID NO: 336636 - DNA, 16 bp, M. musculus
aaaagaacttttaaat

SEQ ID NO: 336637 - DNA, 16 bp, M. musculus
aaaagaacttttcaaa

SEQ ID NO: 336638 - DNA, 16 bp, M. musculus
aaaagaactttttttt

SEQ ID NO: 336639 - DNA, 16 bp, M. musculus
aaaagaagaaatagct

SEQ ID NO: 336640 - DNA, 16 bp, M. musculus
aaaagaagaatgttgt

SEQ ID NO: 336641 - DNA, 16 bp, M. musculus
aaaagaagacagccac

SEQ ID NO: 336642 - DNA, 16 bp, M. musculus
aaaagaagataacatt

SEQ ID NO: 336643 - DNA, 16 bp, M. musculus
aaaagaagcaaattca

SEQ ID NO: 336644 - DNA, 16 bp, M. musculus
aaaagaagctttgtga

SEQ ID NO: 336645 - DNA, 16 bp, M. musculus
aaaagaagggagccag

SEQ ID NO: 336646 - DNA, 16 bp, M. musculus
aaaagaagtcaaagta

SEQ ID NO: 336647 - DNA, 16 bp, M. musculus
aaaagaagttcctcct

SEQ ID NO: 336648 - DNA, 16 bp, M. musculus
aaaagaatattttcaa

SEQ ID NO: 336649 - DNA, 16 bp, M. musculus
aaaagaatatttttct

SEQ ID NO: 336650 - DNA, 16 bp, M. musculus
aaaagaatgagaattg

SEQ ID NO: 336651 - DNA, 16 bp, M. musculus
aaaagaatgtattttt

SEQ ID NO: 336652 - DNA, 16 bp, M. musculus
aaaagaattatttgtt

SEQ ID NO: 336653 - DNA, 16 bp, M. musculus
aaaagaattcaaagat

SEQ ID NO: 336654 - DNA, 16 bp, M. musculus
aaaagaattttctttc

SEQ ID NO: 336655 - DNA, 16 bp, M. musculus
aaaagaatttttacca

SEQ ID NO: 336656 - DNA, 16 bp, M. musculus
aaaagacaaaatattt

SEQ ID NO: 336657 - DNA, 16 bp, M. musculus
aaaagacacaaaacct

SEQ ID NO: 336658 - DNA, 16 bp, M. musculus
aaaagacatttgaaaa

SEQ ID NO: 336659 - DNA, 16 bp, M. musculus
aaaagacattttaaat

SEQ ID NO: 336660 - DNA, 16 bp, M. musculus
aaaagacattttcaaa

SEQ ID NO: 336661 - DNA, 16 bp, M. musculus
aaaagaccaaatgtaa

SEQ ID NO: 336662 - DNA, 16 bp, M. musculus
aaaagaccaccaatag

SEQ ID NO: 336663 - DNA, 16 bp, M. musculus
aaaagacctgggtttg

SEQ ID NO: 336664 - DNA, 16 bp, M. musculus
aaaagactatagttct

SEQ ID NO: 336665 - DNA, 16 bp, M. musculus
aaaagactcagagaca

SEQ ID NO: 336666 - DNA, 16 bp, M. musculus
aaaagactgaggaaaa

SEQ ID NO: 336667 - DNA, 16 bp, M. musculus
aaaagactttaaaatt

SEQ ID NO: 336668 - DNA, 16 bp, M. musculus
aaaagagaaaattcat

SEQ ID NO: 336669 - DNA, 16 bp, M. musculus
aaaagagaacatgaag

SEQ ID NO: 336670 - DNA, 16 bp, M. musculus
aaaagagaattttttt

SEQ ID NO: 336671 - DNA, 16 bp, M. musculus
aaaagagaccatgaat

SEQ ID NO: 336672 - DNA, 16 bp, M. musculus
aaaagagaccttaact

SEQ ID NO: 336673 - DNA, 16 bp, M. musculus
aaaagagactgaggaa

SEQ ID NO: 336674 - DNA, 16 bp, M. musculus
aaaagagagagagact

SEQ ID NO: 336675 - DNA, 16 bp, M. musculus
aaaagagagattttgg

SEQ ID NO: 336676 - DNA, 16 bp, M. musculus
aaaagagagcatcaga

SEQ ID NO: 336677 - DNA, 16 bp, M. musculus
aaaagagatagacaga

SEQ ID NO: 336678 - DNA, 16 bp, M. musculus
aaaagagcaagcctcc

SEQ ID NO: 336679 - DNA, 16 bp, M. musculus
aaaagagcatcagatc

SEQ ID NO: 336680 - DNA, 16 bp, M. musculus
aaaagagcctcccttg

SEQ ID NO: 336681 - DNA, 16 bp, M. musculus
aaaagagcctgaggaa

SEQ ID NO: 336682 - DNA, 16 bp, M. musculus
aaaagaggatgtcaga

SEQ ID NO: 336683 - DNA, 16 bp, M. musculus
aaaagaggttcaaatt

SEQ ID NO: 336684 - DNA, 16 bp, M. musculus
aaaagagttccaagag

SEQ ID NO: 336685 - DNA, 16 bp, M. musculus
aaaagatacaatttgc

SEQ ID NO: 336686 - DNA, 16 bp, M. musculus
aaaagatagacctgga

SEQ ID NO: 336687 - DNA, 16 bp, M. musculus
aaaagatagctatatc

SEQ ID NO: 336688 - DNA, 30 bp, M. musculus
aaaagatcaagtggaatcccagacactgaa

SEQ ID NO: 336689 - DNA, 16 bp, M. musculus
aaaagatcaccaacag

SEQ ID NO: 336690 - DNA, 16 bp, M. musculus
aaaagatcatattgag

SEQ ID NO: 336691 - DNA, 16 bp, M. musculus
aaaagatcctgaagaa

SEQ ID NO: 336692 - DNA, 16 bp, M. musculus
aaaagatctcagaaga

SEQ ID NO: 336693 - DNA, 16 bp, M. musculus
aaaagatcttcattca

SEQ ID NO: 336694 - DNA, 16 bp, M. musculus
aaaagatctttaccaa

SEQ ID NO: 336695 - DNA, 16 bp, M. musculus
aaaagatgaattttat

SEQ ID NO: 336696 - DNA, 16 bp, M. musculus
aaaagatggaccatct

SEQ ID NO: 336697 - DNA, 16 bp, M. musculus
aaaagatggcctactc

SEQ ID NO: 336698 - DNA, 16 bp, M. musculus
aaaagatgttctgcta

SEQ ID NO: 336699 - DNA, 16 bp, M. musculus
aaaagatgtttatttt

SEQ ID NO: 336700 - DNA, 16 bp, M. musculus
aaaagattctccacca

SEQ ID NO: 336701 - DNA, 16 bp, M. musculus
aaaagatttatttctt

SEQ ID NO: 336702 - DNA, 16 bp, M. musculus
aaaagattttccaagc

SEQ ID NO: 336703 - DNA, 16 bp, M. musculus
aaaagatttttttctt

SEQ ID NO: 336704 - DNA, 16 bp, M. musculus
aaaagcaaaatatttt

SEQ ID NO: 336705 - DNA, 16 bp, M. musculus
aaaagcaacagtataa

SEQ ID NO: 336706 - DNA, 16 bp, M. musculus
aaaagcaacttgaaaa

SEQ ID NO: 336707 - DNA, 16 bp, M. musculus
aaaagcaagaaatgga

SEQ ID NO: 336708 - DNA, 16 bp, M. musculus
aaaagcaagaatcaga

SEQ ID NO: 336709 - DNA, 16 bp, M. musculus
aaaagcaagagagtaa

SEQ ID NO: 336710 - DNA, 17 bp, M. musculus
aaaagcaagaggaattt

SEQ ID NO: 336711 - DNA, 16 bp, M. musculus
aaaagcaagattcaga

SEQ ID NO: 336712 - DNA, 16 bp, M. musculus
aaaagcaagcctgaga

SEQ ID NO: 336713 - DNA, 16 bp, M. musculus
aaaagcaagctgagca

SEQ ID NO: 336714 - DNA, 16 bp, M. musculus
aaaagcaagttgaaga

SEQ ID NO: 336715 - DNA, 16 bp, M. musculus
aaaagcaagttggaaa

SEQ ID NO: 336716 - DNA, 16 bp, M. musculus
aaaagcaatccatgtg

SEQ ID NO: 336717 - DNA, 16 bp, M. musculus
aaaagcacctgctgct

SEQ ID NO: 336718 - DNA, 16 bp, M. musculus
aaaagcactgattgct

SEQ ID NO: 336719 - DNA, 16 bp, M. musculus
aaaagcacttactgct

SEQ ID NO: 336720 - DNA, 16 bp, M. musculus
aaaagcacttgatgct

SEQ ID NO: 336721 - DNA, 16 bp, M. musculus
aaaagcacttgccaca

SEQ ID NO: 336722 - DNA, 16 bp, M. musculus
aaaagcacttgccacc

SEQ ID NO: 336723 - DNA, 16 bp, M. musculus
aaaagcagacagtgct

SEQ ID NO: 336724 - DNA, 16 bp, M. musculus
aaaagcagcaagctct

SEQ ID NO: 336725 - DNA, 16 bp, M. musculus
aaaagcagccagtact

SEQ ID NO: 336726 - DNA, 16 bp, M. musculus
aaaagcagccatgttc

SEQ ID NO: 336727 - DNA, 16 bp, M. musculus
aaaagcagctggtgct

SEQ ID NO: 336728 - DNA, 16 bp, M. musculus
aaaagcaggagctgat

SEQ ID NO: 336729 - DNA, 16 bp, M. musculus
aaaagcaggggtgggg

SEQ ID NO: 336730 - DNA, 16 bp, M. musculus
aaaagcagtaagagga

SEQ ID NO: 336731 - DNA, 16 bp, M. musculus
aaaagcagtaaggaaa

SEQ ID NO: 336732 - DNA, 16 bp, M. musculus
aaaagcagtactctcc

SEQ ID NO: 336733 - DNA, 16 bp, M. musculus
aaaagcagtctgagaa

SEQ ID NO: 336734 - DNA, 20 bp, M. musculus
aaaagcagttatcccctgtt

SEQ ID NO: 336735 - DNA, 16 bp, M. musculus
aaaagcagttttaaaa

SEQ ID NO: 336736 - DNA, 16 bp, M. musculus
aaaagcatatctcata

SEQ ID NO: 336737 - DNA, 16 bp, M. musculus
aaaagcatttgaaaag

SEQ ID NO: 336738 - DNA, 16 bp, M. musculus
aaaagcattttcaaaa

SEQ ID NO: 336739 - DNA, 16 bp, M. musculus
aaaagcattttgtttt

SEQ ID NO: 336740 - DNA, 16 bp, M. musculus
aaaagccaagtaacat

SEQ ID NO: 336741 - DNA, 16 bp, M. musculus
aaaagccaatttttta

SEQ ID NO: 336742 - DNA, 16 bp, M. musculus
aaaagccagaagagcc

SEQ ID NO: 336743 - DNA, 16 bp, M. musculus
aaaagccagatatggt

SEQ ID NO: 336744 - DNA, 16 bp, M. musculus
aaaagccagatgtgat

SEQ ID NO: 336745 - DNA, 16 bp, M. musculus
aaaagccaggcttggt

SEQ ID NO: 336746 - DNA, 16 bp, M. musculus
aaaagccaggtatggt

SEQ ID NO: 336747 - DNA, 16 bp, M. musculus
aaaagccatagtcaca

SEQ ID NO: 336748 - DNA, 16 bp, M. musculus
aaaagccatctacaga

SEQ ID NO: 336749 - DNA, 16 bp, M. musculus
aaaagccatgcttctc

SEQ ID NO: 336750 - DNA, 16 bp, M. musculus
aaaagcccagggccaa

SEQ ID NO: 336751 - DNA, 16 bp, M. musculus
aaaagcccagtgccag

SEQ ID NO: 336752 - DNA, 16 bp, M. musculus
aaaagccctaagcagt

SEQ ID NO: 336753 - DNA, 16 bp, M. musculus
aaaagccctgctgagg

SEQ ID NO: 336754 - DNA, 16 bp, M. musculus
aaaagcctacgctacc

SEQ ID NO: 336755 - DNA, 16 bp, M. musculus
aaaagcctatgttcaa

SEQ ID NO: 336756 - DNA, 16 bp, M. musculus
aaaagcctcgaagatg

SEQ ID NO: 336757 - DNA, 16 bp, M. musculus
aaaagcctgagaactt

SEQ ID NO: 336758 - DNA, 16 bp, M. musculus
aaaagccttgaagaaa

SEQ ID NO: 336759 - DNA, 16 bp, M. musculus
aaaagctatttttaaa

SEQ ID NO: 336760 - DNA, 16 bp, M. musculus
aaaagctcaagccaga

SEQ ID NO: 336761 - DNA, 16 bp, M. musculus
aaaagctccaaatacc

SEQ ID NO: 336762 - DNA, 16 bp, M. musculus
aaaagctccctggact

SEQ ID NO: 336763 - DNA, 16 bp, M. musculus
aaaagctgagagaagc

SEQ ID NO: 336764 - DNA, 16 bp, M. musculus
aaaagctgagcatggt

SEQ ID NO: 336765 - DNA, 16 bp, M. musculus
aaaagctgatgcagag

SEQ ID NO: 336766 - DNA, 16 bp, M. musculus
aaaagctgcaagagaa

SEQ ID NO: 336767 - DNA, 16 bp, M. musculus
aaaagctggaaacaac

SEQ ID NO: 336768 - DNA, 16 bp, M. musculus
aaaagctgggcatggc

SEQ ID NO: 336769 - DNA, 16 bp, M. musculus
aaaagctgggcatggt

SEQ ID NO: 336770 - DNA, 16 bp, M. musculus
aaaagctgtcctctga

SEQ ID NO: 336771 - DNA, 16 bp, M. musculus
aaaagctgttgcctat

SEQ ID NO: 336772 - DNA, 16 bp, M. musculus
aaaagctgttgtctgt

SEQ ID NO: 336773 - DNA, 17 bp, M. musculus
aaaagcttccaggagat

SEQ ID NO: 336774 - DNA, 16 bp, M. musculus
aaaagcttctataaag

SEQ ID NO: 336775 - DNA, 16 bp, M. musculus
aaaagcttgtgaaaaa

SEQ ID NO: 336776 - DNA, 16 bp, M. musculus
aaaagctttgaagata

SEQ ID NO: 336777 - DNA, 16 bp, M. musculus
aaaaggaaaacaattt

SEQ ID NO: 336778 - DNA, 16 bp, M. musculus
aaaaggaaaacattta

SEQ ID NO: 336779 - DNA, 16 bp, M. musculus
aaaaggaaaacctgga

SEQ ID NO: 336780 - DNA, 16 bp, M. musculus
aaaaggaaaagtattt

SEQ ID NO: 336781 - DNA, 16 bp, M. musculus
aaaaggaaaagtctga

SEQ ID NO: 336782 - DNA, 16 bp, M. musculus
aaaaggaaatcaaagg

SEQ ID NO: 336783 - DNA, 16 bp, M. musculus
aaaaggaacatcaggg

SEQ ID NO: 336784 - DNA, 16 bp, M. musculus
aaaaggaactatacaa

SEQ ID NO: 336785 - DNA, 16 bp, M. musculus
aaaaggaagcaaatac

SEQ ID NO: 336786 - DNA, 16 bp, M. musculus
aaaaggaaggtggagc

SEQ ID NO: 336787 - DNA, 16 bp, M. musculus
aaaaggaatatataca

SEQ ID NO: 336788 - DNA, 16 bp, M. musculus
aaaaggacatggatgg

SEQ ID NO: 336789 - DNA, 16 bp, M. musculus
aaaaggacatttaaaa

SEQ ID NO: 336790 - DNA, 16 bp, M. musculus
aaaaggagacagccac

SEQ ID NO: 336791 - DNA, 16 bp, M. musculus
aaaaggagatcagggg

SEQ ID NO: 336792 - DNA, 16 bp, M. musculus
aaaaggagctggagag

SEQ ID NO: 336793 - DNA, 16 bp, M. musculus
aaaaggaggtcaatgg

SEQ ID NO: 336794 - DNA, 16 bp, M. musculus
aaaaggagtttttttt

SEQ ID NO: 336795 - DNA, 16 bp, M. musculus
aaaaggatgcaaattc

SEQ ID NO: 336796 - DNA, 16 bp, M. musculus
aaaaggcaaacatcag

SEQ ID NO: 336797 - DNA, 16 bp, M. musculus
aaaaggcatttaaaaa

SEQ ID NO: 336798 - DNA, 16 bp, M. musculus
aaaaggccacacccac

SEQ ID NO: 336799 - DNA, 16 bp, M. musculus
aaaaggctattgaaga

SEQ ID NO: 336800 - DNA, 16 bp, M. musculus
aaaaggctgaaagaag

SEQ ID NO: 336801 - DNA, 16 bp, M. musculus
aaaaggctgagggaga

SEQ ID NO: 336802 - DNA, 16 bp, M. musculus
aaaaggctggaaaaat

SEQ ID NO: 336803 - DNA, 16 bp, M. musculus
aaaaggctggcctctg

SEQ ID NO: 336804 - DNA, 16 bp, M. musculus
aaaaggctgtgtgtgt

SEQ ID NO: 336805 - DNA, 16 bp, M. musculus
aaaaggcttgaaaaca

SEQ ID NO: 336806 - DNA, 16 bp, M. musculus
aaaaggctttttaaaa

SEQ ID NO: 336807 - DNA, 16 bp, M. musculus
aaaagggaacctggaa

SEQ ID NO: 336808 - DNA, 16 bp, M. musculus
aaaagggaacctggag

SEQ ID NO: 336809 - DNA, 16 bp, M. musculus
aaaagggaagtaaaca

SEQ ID NO: 336810 - DNA, 16 bp, M. musculus
aaaagggacaacattt

SEQ ID NO: 336811 - DNA, 16 bp, M. musculus
aaaagggagaaataac

SEQ ID NO: 336812 - DNA, 16 bp, M. musculus
aaaagggatttttttt

SEQ ID NO: 336813 - DNA, 16 bp, M. musculus
aaaagggcatcagatc

SEQ ID NO: 336814 - DNA, 16 bp, M. musculus
aaaagggggctggaga

SEQ ID NO: 336815 - DNA, 16 bp, M. musculus
aaaagggtttatttca

SEQ ID NO: 336816 - DNA, 16 bp, M. musculus
aaaaggtgaaggaatt

SEQ ID NO: 336817 - DNA, 16 bp, M. musculus
aaaaggtgatggaaat

SEQ ID NO: 336818 - DNA, 16 bp, M. musculus
aaaaggtggttcattt

SEQ ID NO: 336819 - DNA, 16 bp, M. musculus
aaaaggtgtagcccag

SEQ ID NO: 336820 - DNA, 16 bp, M. musculus
aaaaggtgtggcccag

SEQ ID NO: 336821 - DNA, 16 bp, M. musculus
aaaaggtttatttgac

SEQ ID NO: 336822 - DNA, 16 bp, M. musculus
aaaaggtttctgaaca

SEQ ID NO: 336823 - DNA, 16 bp, M. musculus
aaaaggttttccaagc

SEQ ID NO: 336824 - DNA, 16 bp, M. musculus
aaaaggttttgttttt

SEQ ID NO: 336825 - DNA, 16 bp, M. musculus
aaaagtaaacattttt

SEQ ID NO: 336826 - DNA, 16 bp, M. musculus
aaaagtaactaataca

SEQ ID NO: 336827 - DNA, 16 bp, M. musculus
aaaagtaagaatccta

SEQ ID NO: 336828 - DNA, 16 bp, M. musculus
aaaagtaagttgggga

SEQ ID NO: 336829 - DNA, 16 bp, M. musculus
aaaagtaatttttttc

SEQ ID NO: 336830 - DNA, 16 bp, M. musculus
aaaagtagttttcatt

SEQ ID NO: 336831 - DNA, 16 bp, M. musculus
aaaagtatgctataaa

SEQ ID NO: 336832 - DNA, 16 bp, M. musculus
aaaagtatttcttttt

SEQ ID NO: 336833 - DNA, 16 bp, M. musculus
aaaagtattttctttt

SEQ ID NO: 336834 - DNA, 16 bp, M. musculus
aaaagtcaagaaatgt

SEQ ID NO: 336835 - DNA, 16 bp, M. musculus
aaaagtcaatgaaatg

SEQ ID NO: 336836 - DNA, 16 bp, M. musculus
aaaagtcactctgggg

SEQ ID NO: 336837 - DNA, 16 bp, M. musculus
aaaagtcatttaaaaa

SEQ ID NO: 336838 - DNA, 16 bp, M. musculus
aaaagtccaaagttta

SEQ ID NO: 336839 - DNA, 16 bp, M. musculus
aaaagtcccacagcct

SEQ ID NO: 336840 - DNA, 17 bp, M. musculus
aaaagtccccaatacac

SEQ ID NO: 336841 - DNA, 16 bp, M. musculus
aaaagtcccccacatg

SEQ ID NO: 336842 - DNA, 16 bp, M. musculus
aaaagtcccctaaacc

SEQ ID NO: 336843 - DNA, 16 bp, M. musculus
aaaagtcccctacacc

SEQ ID NO: 336844 - DNA, 16 bp, M. musculus
aaaagtctccagaatt

SEQ ID NO: 336845 - DNA, 16 bp, M. musculus
aaaagtctctcaacca

SEQ ID NO: 336846 - DNA, 46 bp, M. musculus
aaaagtctctgacctcgttgtctgaggtggtcctacagaaccggag

SEQ ID NO: 336847 - DNA, 16 bp, M. musculus
aaaagtctggaaaaat

SEQ ID NO: 336848 - DNA, 16 bp, M. musculus
aaaagtcttaagcttt

SEQ ID NO: 336849 - DNA, 16 bp, M. musculus
aaaagtgacaaacaga

SEQ ID NO: 336850 - DNA, 16 bp, M. musculus
aaaagtgtatgtgtgt

SEQ ID NO: 336851 - DNA, 16 bp, M. musculus
aaaagtgtctgtgttt

SEQ ID NO: 336852 - DNA, 16 bp, M. musculus
aaaagtgttattttga

SEQ ID NO: 336853 - DNA, 16 bp, M. musculus
aaaagttatcaaaata

SEQ ID NO: 336854 - DNA, 16 bp, M. musculus
aaaagttctttaaaat

SEQ ID NO: 336855 - DNA, 16 bp, M. musculus
aaaagttgtcttctga

SEQ ID NO: 336856 - DNA, 16 bp, M. musculus
aaaagttgttttaaat

SEQ ID NO: 336857 - DNA, 16 bp, M. musculus
aaaagtttatttttct

SEQ ID NO: 336858 - DNA, 16 bp, M. musculus
aaaagtttcatatttt

SEQ ID NO: 336859 - DNA, 16 bp, M. musculus
aaaagtttccttcttc

SEQ ID NO: 336860 - DNA, 16 bp, M. musculus
aaaagtttctgggatt

SEQ ID NO: 336861 - DNA, 17 bp, M. musculus
aaaagtttgatgctcga

SEQ ID NO: 336862 - DNA, 16 bp, M. musculus
aaaagttttgtgtctt

SEQ ID NO: 336863 - DNA, 16 bp, M. musculus
aaaagtttttaaaatg

SEQ ID NO: 336864 - DNA, 16 bp, M. musculus
aaaataaaaatggcta

SEQ ID NO: 336865 - DNA, 16 bp, M. musculus
aaaataaaaatttgcc

SEQ ID NO: 336866 - DNA, 16 bp, M. musculus
aaaataaaagaacttc

SEQ ID NO: 336867 - DNA, 16 bp, M. musculus
aaaataaaagcatttt

SEQ ID NO: 336868 - DNA, 16 bp, M. musculus
aaaataaaagtcattt

SEQ ID NO: 336869 - DNA, 16 bp, M. musculus
aaaataaaatcagtca

SEQ ID NO: 336870 - DNA, 16 bp, M. musculus
aaaataaaatcttcct

SEQ ID NO: 336871 - DNA, 16 bp, M. musculus
aaaataaaatcttgat

SEQ ID NO: 336872 - DNA, 16 bp, M. musculus
aaaataaaatcttgtt

SEQ ID NO: 336873 - DNA, 16 bp, M. musculus
aaaataaaatgatttc

SEQ ID NO: 336874 - DNA, 16 bp, M. musculus
aaaataaaatgtatca

SEQ ID NO: 336875 - DNA, 16 bp, M. musculus
aaaataaaatgtgttt

SEQ ID NO: 336876 - DNA, 16 bp, M. musculus
aaaataaaatgtttct

SEQ ID NO: 336877 - DNA, 16 bp, M. musculus
aaaataaaatgttttc

SEQ ID NO: 336878 - DNA, 16 bp, M. musculus
aaaataaacatctttt

SEQ ID NO: 336879 - DNA, 16 bp, M. musculus
aaaataaacatgtttt

SEQ ID NO: 336880 - DNA, 16 bp, M. musculus
aaaataaaccaactgg

SEQ ID NO: 336881 - DNA, 16 bp, M. musculus
aaaataaaccatttct

SEQ ID NO: 336882 - DNA, 16 bp, M. musculus
aaaataaacctttttc

SEQ ID NO: 336883 - DNA, 16 bp, M. musculus
aaaataaactgtaatt

SEQ ID NO: 336884 - DNA, 16 bp, M. musculus
aaaataaactgttaaa

SEQ ID NO: 336885 - DNA, 16 bp, M. musculus
aaaataaactttcttc

SEQ ID NO: 336886 - DNA, 16 bp, M. musculus
aaaataaagacatttt

SEQ ID NO: 336887 - DNA, 16 bp, M. musculus
aaaataaagatacttt

SEQ ID NO: 336888 - DNA, 16 bp, M. musculus
aaaataaagcatattt

SEQ ID NO: 336889 - DNA, 16 bp, M. musculus
aaaataaagctctaaa

SEQ ID NO: 336890 - DNA, 16 bp, M. musculus
aaaataaaggtatttt

SEQ ID NO: 336891 - DNA, 16 bp, M. musculus
aaaataaagtctttaa

SEQ ID NO: 336892 - DNA, 16 bp, M. musculus
aaaataaagtcttttt

SEQ ID NO: 336893 - DNA, 16 bp, M. musculus
aaaataaataagtctt

SEQ ID NO: 336894 - DNA, 16 bp, M. musculus
aaaataaatacatttg

SEQ ID NO: 336895 - DNA, 16 bp, M. musculus
aaaataaatattcatg

SEQ ID NO: 336896 - DNA, 16 bp, M. musculus
aaaataaatctttcct

SEQ ID NO: 336897 - DNA, 16 bp, M. musculus
aaaataaatcttttct

SEQ ID NO: 336898 - DNA, 16 bp, M. musculus
aaaataaatgtatttc

SEQ ID NO: 336899 - DNA, 16 bp, M. musculus
aaaataaatgtgtgtt

SEQ ID NO: 336900 - DNA, 16 bp, M. musculus
aaaataaatgtttcca

SEQ ID NO: 336901 - DNA, 16 bp, M. musculus
aaaataaatttcagaa

SEQ ID NO: 336902 - DNA, 16 bp, M. musculus
aaaataaatttccatt

SEQ ID NO: 336903 - DNA, 16 bp, M. musculus
aaaataacacacattt

SEQ ID NO: 336904 - DNA, 16 bp, M. musculus
aaaataacacttttat

SEQ ID NO: 336905 - DNA, 16 bp, M. musculus
aaaataacattctttt

SEQ ID NO: 336906 - DNA, 16 bp, M. musculus
aaaataagaacagttt

SEQ ID NO: 336907 - DNA, 16 bp, M. musculus
aaaataagcaataatt

SEQ ID NO: 336908 - DNA, 16 bp, M. musculus
aaaataagttgttttt

SEQ ID NO: 336909 - DNA, 16 bp, M. musculus
aaaataataaaatctg

SEQ ID NO: 336910 - DNA, 16 bp, M. musculus
aaaataataaatgcta

SEQ ID NO: 336911 - DNA, 16 bp, M. musculus
aaaataataatttggt

SEQ ID NO: 336912 - DNA, 16 bp, M. musculus
aaaataatacattttg

SEQ ID NO: 336913 - DNA, 16 bp, M. musculus
aaaataatcatgagag

SEQ ID NO: 336914 - DNA, 16 bp, M. musculus
aaaataatccagggac

SEQ ID NO: 336915 - DNA, 16 bp, M. musculus
aaaataatcctgtaca

SEQ ID NO: 336916 - DNA, 16 bp, M. musculus
aaaataatgaattcat

SEQ ID NO: 336917 - DNA, 16 bp, M. musculus
aaaataatgactctga

SEQ ID NO: 336918 - DNA, 16 bp, M. musculus
aaaataatgtttcaaa

SEQ ID NO: 336919 - DNA, 16 bp, M. musculus
aaaataatttcaaaag

SEQ ID NO: 336920 - DNA, 16 bp, M. musculus
aaaataatttcttcct

SEQ ID NO: 336921 - DNA, 16 bp, M. musculus
aaaataattttcaaag

SEQ ID NO: 336922 - DNA, 16 bp, M. musculus
aaaataattttcttct

SEQ ID NO: 336923 - DNA, 16 bp, M. musculus
aaaatacaagcaacac

SEQ ID NO: 336924 - DNA, 16 bp, M. musculus
aaaatacaaggacaga

SEQ ID NO: 336925 - DNA, 16 bp, M. musculus
aaaatacaatttgcaa

SEQ ID NO: 336926 - DNA, 16 bp, M. musculus
aaaatacagaaatatt

SEQ ID NO: 336927 - DNA, 16 bp, M. musculus
aaaatacagagttgtg

SEQ ID NO: 336928 - DNA, 16 bp, M. musculus
aaaatacagggacaaa

SEQ ID NO: 336929 - DNA, 16 bp, M. musculus
aaaatacatatgtttt

SEQ ID NO: 336930 - DNA, 16 bp, M. musculus
aaaatacatgaatata

SEQ ID NO: 336931 - DNA, 16 bp, M. musculus
aaaatacatgtaaaat

SEQ ID NO: 336932 - DNA, 16 bp, M. musculus
aaaatacatgttaaaa

SEQ ID NO: 336933 - DNA, 16 bp, M. musculus
aaaatacattttatga

SEQ ID NO: 336934 - DNA, 16 bp, M. musculus
aaaataccagtgaaaa

SEQ ID NO: 336935 - DNA, 16 bp, M. musculus
aaaatacccaaggagt

SEQ ID NO: 336936 - DNA, 16 bp, M. musculus
aaaatacccatggatg

SEQ ID NO: 336937 - DNA, 16 bp, M. musculus
aaaataccttgctgtg

SEQ ID NO: 336938 - DNA, 16 bp, M. musculus
aaaatactcaacaaag

SEQ ID NO: 336939 - DNA, 21 bp, M. musculus
aaaatactcacaggagcaaat

SEQ ID NO: 336940 - DNA, 16 bp, M. musculus
aaaatactgaaaatat

SEQ ID NO: 336941 - DNA, 16 bp, M. musculus
aaaatactgaaataat

SEQ ID NO: 336942 - DNA, 16 bp, M. musculus
aaaatactgaagaaca

SEQ ID NO: 336943 - DNA, 16 bp, M. musculus
aaaatactgttttttt

SEQ ID NO: 336944 - DNA, 16 bp, M. musculus
aaaatacttgaaaaca

SEQ ID NO: 336945 - DNA, 16 bp, M. musculus
aaaatacttgaaataa

SEQ ID NO: 336946 - DNA, 16 bp, M. musculus
aaaatacttgattttt

SEQ ID NO: 336947 - DNA, 16 bp, M. musculus
aaaatacttgttttta

SEQ ID NO: 336948 - DNA, 16 bp, M. musculus
aaaatactttaaaatg

SEQ ID NO: 336949 - DNA, 16 bp, M. musculus
aaaatactttcaaact

SEQ ID NO: 336950 - DNA, 16 bp, M. musculus
aaaatagaaaacattt

SEQ ID NO: 336951 - DNA, 16 bp, M. musculus
aaaatagaagcagtca

SEQ ID NO: 336952 - DNA, 16 bp, M. musculus
aaaatagaagtagatg

SEQ ID NO: 336953 - DNA, 16 bp, M. musculus
aaaatagactttaaaa

SEQ ID NO: 336954 - DNA, 16 bp, M. musculus
aaaatagatctatatt

SEQ ID NO: 336955 - DNA, 16 bp, M. musculus
aaaatagatttctttt

SEQ ID NO: 336956 - DNA, 16 bp, M. musculus
aaaatagcaaatattt

SEQ ID NO: 336957 - DNA, 16 bp, M. musculus
aaaatagcacagaggg

SEQ ID NO: 336958 - DNA, 16 bp, M. musculus
aaaatagcattttcaa

SEQ ID NO: 336959 - DNA, 16 bp, M. musculus
aaaatagctaattaaa

SEQ ID NO: 336960 - DNA, 16 bp, M. musculus
aaaatagcttttattt

SEQ ID NO: 336961 - DNA, 16 bp, M. musculus
aaaataggaagcaaca

SEQ ID NO: 336962 - DNA, 16 bp, M. musculus
aaaatagggctggaga

SEQ ID NO: 336963 - DNA, 16 bp, M. musculus
aaaataggtatagaag

SEQ ID NO: 336964 - DNA, 16 bp, M. musculus
aaaatagtcataaaat

SEQ ID NO: 336965 - DNA, 29 bp, M. musculus
aaaatagtgtcctatttaggagcaaggat

SEQ ID NO: 336966 - DNA, 16 bp, M. musculus
aaaatatactgggaaa

SEQ ID NO: 336967 - DNA, 16 bp, M. musculus
aaaatatatatgcaaa

SEQ ID NO: 336968 - DNA, 16 bp, M. musculus
aaaatatatgaagaac

SEQ ID NO: 336969 - DNA, 16 bp, M. musculus
aaaatatatttcaagt

SEQ ID NO: 336970 - DNA, 16 bp, M. musculus
aaaatatcaccatgag

SEQ ID NO: 336971 - DNA, 16 bp, M. musculus
aaaatatcacttttgg

SEQ ID NO: 336972 - DNA, 16 bp, M. musculus
aaaatatcatcctgaa

SEQ ID NO: 336973 - DNA, 16 bp, M. musculus
aaaatatcatttcttt

SEQ ID NO: 336974 - DNA, 16 bp, M. musculus
aaaatatctattttca

SEQ ID NO: 336975 - DNA, 16 bp, M. musculus
aaaatatctcagaaga

SEQ ID NO: 336976 - DNA, 18 bp, M. musculus
aaaatatctcagtaacat

SEQ ID NO: 336977 - DNA, 16 bp, M. musculus
aaaatatctgaaaaca

SEQ ID NO: 336978 - DNA, 16 bp, M. musculus
aaaatatcttcaccaa

SEQ ID NO: 336979 - DNA, 16 bp, M. musculus
aaaatatcttcattaa

SEQ ID NO: 336980 - DNA, 16 bp, M. musculus
aaaatatcttgatgta

SEQ ID NO: 336981 - DNA, 16 bp, M. musculus
aaaatatctttactaa

SEQ ID NO: 336982 - DNA, 16 bp, M. musculus
aaaatatggttacaaa

SEQ ID NO: 336983 - DNA, 16 bp, M. musculus
aaaatatgtatatgta

SEQ ID NO: 336984 - DNA, 16 bp, M. musculus
aaaatatgtcaggctt

SEQ ID NO: 336985 - DNA, 16 bp, M. musculus
aaaatatgtgtatgta

SEQ ID NO: 336986 - DNA, 16 bp, M. musculus
aaaatatgttcatttt

SEQ ID NO: 336987 - DNA, 16 bp, M. musculus
aaaatattatctcaat

SEQ ID NO: 336988 - DNA, 16 bp, M. musculus
aaaatattattttgag

SEQ ID NO: 336989 - DNA, 16 bp, M. musculus
aaaatattcacacaca

SEQ ID NO: 336990 - DNA, 16 bp, M. musculus
aaaatattcagaataa

SEQ ID NO: 336991 - DNA, 16 bp, M. musculus
aaaatattcagaatat

SEQ ID NO: 336992 - DNA, 16 bp, M. musculus
aaaatattcatattca

SEQ ID NO: 336993 - DNA, 16 bp, M. musculus
aaaatattccaggaca

SEQ ID NO: 336994 - DNA, 16 bp, M. musculus
aaaatattcctgaata

SEQ ID NO: 336995 - DNA, 16 bp, M. musculus
aaaatattcctttaaa

SEQ ID NO: 336996 - DNA, 16 bp, M. musculus
aaaatattctcatttt

SEQ ID NO: 336997 - DNA, 16 bp, M. musculus
aaaatattctttgaaa

SEQ ID NO: 336998 - DNA, 16 bp, M. musculus
aaaatattctttggga

SEQ ID NO: 336999 - DNA, 16 bp, M. musculus
aaaatattgaaatact

SEQ ID NO: 337000 - DNA, 16 bp, M. musculus
aaaatattgaaattgt

SEQ ID NO: 337001 - DNA, 16 bp, M. musculus
aaaatattgggtcctg

SEQ ID NO: 337002 - DNA, 16 bp, M. musculus
aaaatatttacaatga

SEQ ID NO: 337003 - DNA, 16 bp, M. musculus
aaaatatttactgaaa

SEQ ID NO: 337004 - DNA, 16 bp, M. musculus
aaaatatttactgtct

SEQ ID NO: 337005 - DNA, 16 bp, M. musculus
aaaatatttatttctg

SEQ ID NO: 337006 - DNA, 16 bp, M. musculus
aaaatatttcaaatga

SEQ ID NO: 337007 - DNA, 16 bp, M. musculus
aaaatatttcatgtat

SEQ ID NO: 337008 - DNA, 16 bp, M. musculus
aaaatatttcccacaa

SEQ ID NO: 337009 - DNA, 16 bp, M. musculus
aaaatatttctacata

SEQ ID NO: 337010 - DNA, 16 bp, M. musculus
aaaatatttctttaca

SEQ ID NO: 337011 - DNA, 16 bp, M. musculus
aaaatatttgaaaact

SEQ ID NO: 337012 - DNA, 16 bp, M. musculus
aaaatatttgctggcc

SEQ ID NO: 337013 - DNA, 16 bp, M. musculus
aaaatatttggtttta

SEQ ID NO: 337014 - DNA, 16 bp, M. musculus
aaaatattttagtgaa

SEQ ID NO: 337015 - DNA, 16 bp, M. musculus
aaaatattttatgtga

SEQ ID NO: 337016 - DNA, 16 bp, M. musculus
aaaatattttcaaatg

SEQ ID NO: 337017 - DNA, 16 bp, M. musculus
aaaatattttcaacat

SEQ ID NO: 337018 - DNA, 16 bp, M. musculus
aaaatattttcagaag

SEQ ID NO: 337019 - DNA, 16 bp, M. musculus
aaaatattttcagttg

SEQ ID NO: 337020 - DNA, 16 bp, M. musculus
aaaatattttccactt

SEQ ID NO: 337021 - DNA, 16 bp, M. musculus
aaaatattttctacaa

SEQ ID NO: 337022 - DNA, 16 bp, M. musculus
aaaatattttctactt

SEQ ID NO: 337023 - DNA, 16 bp, M. musculus
aaaatattttctagaa

SEQ ID NO: 337024 - DNA, 16 bp, M. musculus
aaaatattttctagtt

SEQ ID NO: 337025 - DNA, 16 bp, M. musculus
aaaatattttctcaga

SEQ ID NO: 337026 - DNA, 16 bp, M. musculus
aaaatattttctccct

SEQ ID NO: 337027 - DNA, 16 bp, M. musculus
aaaatattttctgatt

SEQ ID NO: 337028 - DNA, 16 bp, M. musculus
aaaatattttctggtc

SEQ ID NO: 337029 - DNA, 16 bp, M. musculus
aaaatattttctgtgt

SEQ ID NO: 337030 - DNA, 16 bp, M. musculus
aaaatattttgaaagt

SEQ ID NO: 337031 - DNA, 16 bp, M. musculus
aaaatattttgacaaa

SEQ ID NO: 337032 - DNA, 16 bp, M. musculus
aaaatattttgttctt

SEQ ID NO: 337033 - DNA, 16 bp, M. musculus
aaaatatttttccaat

SEQ ID NO: 337034 - DNA, 16 bp, M. musculus
aaaatatttttcttcc

SEQ ID NO: 337035 - DNA, 16 bp, M. musculus
aaaatatttttgaaga

SEQ ID NO: 337036 - DNA, 16 bp, M. musculus
aaaatatttttgtaca

SEQ ID NO: 337037 - DNA, 16 bp, M. musculus
aaaatattttttgaga

SEQ ID NO: 337038 - DNA, 16 bp, M. musculus
aaaatcaaaaattcag

SEQ ID NO: 337039 - DNA, 16 bp, M. musculus
aaaatcaaaatattga

SEQ ID NO: 337040 - DNA, 16 bp, M. musculus
aaaatcaaacatttga

SEQ ID NO: 337041 - DNA, 16 bp, M. musculus
aaaatcaaacttggac

SEQ ID NO: 337042 - DNA, 17 bp, M. musculus
aaaatcaacaagacaga

SEQ ID NO: 337043 - DNA, 16 bp, M. musculus
aaaatcaacagaggaa

SEQ ID NO: 337044 - DNA, 16 bp, M. musculus
aaaatcaagaaggtaa

SEQ ID NO: 337045 - DNA, 16 bp, M. musculus
aaaatcaagactctga

SEQ ID NO: 337046 - DNA, 16 bp, M. musculus
aaaatcaagatgaaat

SEQ ID NO: 337047 - DNA, 16 bp, M. musculus
aaaatcaatctgattt

SEQ ID NO: 337048 - DNA, 16 bp, M. musculus
aaaatcaatgagatag

SEQ ID NO: 337049 - DNA, 16 bp, M. musculus
aaaatcacaagttcaa

SEQ ID NO: 337050 - DNA, 16 bp, M. musculus
aaaatcacacccctgc

SEQ ID NO: 337051 - DNA, 16 bp, M. musculus
aaaatcacatgattat

SEQ ID NO: 337052 - DNA, 16 bp, M. musculus
aaaatcacatttattt

SEQ ID NO: 337053 - DNA, 16 bp, M. musculus
aaaatcactttggaaa

SEQ ID NO: 337054 - DNA, 16 bp, M. musculus
aaaatcagaaaccata

SEQ ID NO: 337055 - DNA, 16 bp, M. musculus
aaaatcagaaattcaa

SEQ ID NO: 337056 - DNA, 16 bp, M. musculus
aaaatcagaagttaaa

SEQ ID NO: 337057 - DNA, 16 bp, M. musculus
aaaatcagagctgaaa

SEQ ID NO: 337058 - DNA, 16 bp, M. musculus
aaaatcagaggagaga

SEQ ID NO: 337059 - DNA, 16 bp, M. musculus
aaaatcaggagcaaga

SEQ ID NO: 337060 - DNA, 16 bp, M. musculus
aaaatcagggactaga

SEQ ID NO: 337061 - DNA, 16 bp, M. musculus
aaaatcagggactagg

SEQ ID NO: 337062 - DNA, 16 bp, M. musculus
aaaatcaggtgacagc

SEQ ID NO: 337063 - DNA, 16 bp, M. musculus
aaaatcagtccctggt

SEQ ID NO: 337064 - DNA, 16 bp, M. musculus
aaaatcagtgaagaaa

SEQ ID NO: 337065 - DNA, 16 bp, M. musculus
aaaatcagtgtttaca

SEQ ID NO: 337066 - DNA, 16 bp, M. musculus
aaaatcatagctctga

SEQ ID NO: 337067 - DNA, 16 bp, M. musculus
aaaatcatatgcccca

SEQ ID NO: 337068 - DNA, 16 bp, M. musculus
aaaatcatatttttct

SEQ ID NO: 337069 - DNA, 16 bp, M. musculus
aaaatcatccatcatg

SEQ ID NO: 337070 - DNA, 16 bp, M. musculus
aaaatcatcccaagta

SEQ ID NO: 337071 - DNA, 16 bp, M. musculus
aaaatcattcagaaaa

SEQ ID NO: 337072 - DNA, 16 bp, M. musculus
aaaatcattttgaaaa

SEQ ID NO: 337073 - DNA, 16 bp, M. musculus
aaaatcatttttaaag

SEQ ID NO: 337074 - DNA, 16 bp, M. musculus
aaaatccaaagtcctt

SEQ ID NO: 337075 - DNA, 16 bp, M. musculus
aaaatccaaagtcttt

SEQ ID NO: 337076 - DNA, 16 bp, M. musculus
aaaatccaacacaatt

SEQ ID NO: 337077 - DNA, 16 bp, M. musculus
aaaatccaacaccatt

SEQ ID NO: 337078 - DNA, 16 bp, M. musculus
aaaatccacagaatca

SEQ ID NO: 337079 - DNA, 16 bp, M. musculus
aaaatccacctgcttc

SEQ ID NO: 337080 - DNA, 16 bp, M. musculus
aaaatccattctattt

SEQ ID NO: 337081 - DNA, 16 bp, M. musculus
aaaatccattttattt

SEQ ID NO: 337082 - DNA, 16 bp, M. musculus
aaaatccctgaatcta

SEQ ID NO: 337083 - DNA, 16 bp, M. musculus
aaaatcccttgaagaa

SEQ ID NO: 337084 - DNA, 16 bp, M. musculus
aaaatcctcctgcctc

SEQ ID NO: 337085 - DNA, 16 bp, M. musculus
aaaatcctttttaaaa

SEQ ID NO: 337086 - DNA, 16 bp, M. musculus
aaaatccttttttaaa

SEQ ID NO: 337087 - DNA, 16 bp, M. musculus
aaaatctaacactcat

SEQ ID NO: 337088 - DNA, 16 bp, M. musculus
aaaatctaagcctaca

SEQ ID NO: 337089 - DNA, 16 bp, M. musculus
aaaatctagatgaaat

SEQ ID NO: 337090 - DNA, 16 bp, M. musculus
aaaatctattttctct

SEQ ID NO: 337091 - DNA, 16 bp, M. musculus
aaaatctcaagcaaca

SEQ ID NO: 337092 - DNA, 16 bp, M. musculus
aaaatctcagaaaatg

SEQ ID NO: 337093 - DNA, 16 bp, M. musculus
aaaatctcttttttgt

SEQ ID NO: 337094 - DNA, 16 bp, M. musculus
aaaatctgaagtgtaa

SEQ ID NO: 337095 - DNA, 16 bp, M. musculus
aaaatctgagaaagat

SEQ ID NO: 337096 - DNA, 16 bp, M. musculus
aaaatctgattttttt

SEQ ID NO: 337097 - DNA, 16 bp, M. musculus
aaaatctgggaatgca

SEQ ID NO: 337098 - DNA, 16 bp, M. musculus
aaaatctgtatataaa

SEQ ID NO: 337099 - DNA, 16 bp, M. musculus
aaaatctgtatgaaat

SEQ ID NO: 337100 - DNA, 16 bp, M. musculus
aaaatctgtcacagaa

SEQ ID NO: 337101 - DNA, 16 bp, M. musculus
aaaatctgtgttttct

SEQ ID NO: 337102 - DNA, 16 bp, M. musculus
aaaatcttcattccca

SEQ ID NO: 337103 - DNA, 16 bp, M. musculus
aaaatcttcattttca

SEQ ID NO: 337104 - DNA, 20 bp, M. musculus
aaaatcttccaagaggaact

SEQ ID NO: 337105 - DNA, 16 bp, M. musculus
aaaatcttggagagat

SEQ ID NO: 337106 - DNA, 16 bp, M. musculus
aaaatcttgttggtgt

SEQ ID NO: 337107 - DNA, 16 bp, M. musculus
aaaatctttccacaaa

SEQ ID NO: 337108 - DNA, 16 bp, M. musculus
aaaatctttgggccag

SEQ ID NO: 337109 - DNA, 16 bp, M. musculus
aaaatcttttaaaaga

SEQ ID NO: 337110 - DNA, 16 bp, M. musculus
aaaatcttttgaagct

SEQ ID NO: 337111 - DNA, 16 bp, M. musculus
aaaatgaaaactttaa

SEQ ID NO: 337112 - DNA, 16 bp, M. musculus
aaaatgaaaactttta

SEQ ID NO: 337113 - DNA, 16 bp, M. musculus
aaaatgaaaataagct

SEQ ID NO: 337114 - DNA, 16 bp, M. musculus
aaaatgaaaatattct

SEQ ID NO: 337115 - DNA, 16 bp, M. musculus
aaaatgaaaatatttc

SEQ ID NO: 337116 - DNA, 16 bp, M. musculus
aaaatgaaaattcatt

SEQ ID NO: 337117 - DNA, 16 bp, M. musculus
aaaatgaaaatttcag

SEQ ID NO: 337118 - DNA, 16 bp, M. musculus
aaaatgaaagaaactt

SEQ ID NO: 337119 - DNA, 16 bp, M. musculus
aaaatgaaagtatttt

SEQ ID NO: 337120 - DNA, 16 bp, M. musculus
aaaatgaaatacattt

SEQ ID NO: 337121 - DNA, 16 bp, M. musculus
aaaatgaaatactact

SEQ ID NO: 337122 - DNA, 16 bp, M. musculus
aaaatgaaatcatgaa

SEQ ID NO: 337123 - DNA, 16 bp, M. musculus
aaaatgaaattatgag

SEQ ID NO: 337124 - DNA, 16 bp, M. musculus
aaaatgaaatttcaaa

SEQ ID NO: 337125 - DNA, 16 bp, M. musculus
aaaatgaaatttctaa

SEQ ID NO: 337126 - DNA, 16 bp, M. musculus
aaaatgaacagaattg

SEQ ID NO: 337127 - DNA, 16 bp, M. musculus
aaaatgaaccctttct

SEQ ID NO: 337128 - DNA, 16 bp, M. musculus
aaaatgaagaagctga

SEQ ID NO: 337129 - DNA, 16 bp, M. musculus
aaaatgaagacacaac

SEQ ID NO: 337130 - DNA, 16 bp, M. musculus
aaaatgaagacattat

SEQ ID NO: 337131 - DNA, 16 bp, M. musculus
aaaatgaagacatttt

SEQ ID NO: 337132 - DNA, 16 bp, M. musculus
aaaatgaagcaaaatt

SEQ ID NO: 337133 - DNA, 16 bp, M. musculus
aaaatgaagctgaaag

SEQ ID NO: 337134 - DNA, 16 bp, M. musculus
aaaatgaagtcataaa

SEQ ID NO: 337135 - DNA, 16 bp, M. musculus
aaaatgaagtcatgaa

SEQ ID NO: 337136 - DNA, 16 bp, M. musculus
aaaatgaattcaagaa

SEQ ID NO: 337137 - DNA, 16 bp, M. musculus
aaaatgaattcttttt

SEQ ID NO: 337138 - DNA, 16 bp, M. musculus
aaaatgacaaatttta

SEQ ID NO: 337139 - DNA, 16 bp, M. musculus
aaaatgacatgaaatt

SEQ ID NO: 337140 - DNA, 16 bp, M. musculus
aaaatgacatgtctcc

SEQ ID NO: 337141 - DNA, 16 bp, M. musculus
aaaatgacatttcaaa

SEQ ID NO: 337142 - DNA, 16 bp, M. musculus
aaaatgacattttaaa

SEQ ID NO: 337143 - DNA, 16 bp, M. musculus
aaaatgacatttttat

SEQ ID NO: 337144 - DNA, 16 bp, M. musculus
aaaatgaccccaagat

SEQ ID NO: 337145 - DNA, 16 bp, M. musculus
aaaatgactaagaaat

SEQ ID NO: 337146 - DNA, 16 bp, M. musculus
aaaatgacttaaatat

SEQ ID NO: 337147 - DNA, 16 bp, M. musculus
aaaatgagaacatcat

SEQ ID NO: 337148 - DNA, 16 bp, M. musculus
aaaatgagattatgaa

SEQ ID NO: 337149 - DNA, 16 bp, M. musculus
aaaatgagattttgta

SEQ ID NO: 337150 - DNA, 16 bp, M. musculus
aaaatgaggaaattca

SEQ ID NO: 337151 - DNA, 16 bp, M. musculus
aaaatgaggatatcat

SEQ ID NO: 337152 - DNA, 16 bp, M. musculus
aaaatgagtttggcaa

SEQ ID NO: 337153 - DNA, 16 bp, M. musculus
aaaatgagttttcttt

SEQ ID NO: 337154 - DNA, 16 bp, M. musculus
aaaatgagtttttatt

SEQ ID NO: 337155 - DNA, 16 bp, M. musculus
aaaatgataatattgt

SEQ ID NO: 337156 - DNA, 16 bp, M. musculus
aaaatgatagatagat

SEQ ID NO: 337157 - DNA, 16 bp, M. musculus
aaaatgatattttcta

SEQ ID NO: 337158 - DNA, 16 bp, M. musculus
aaaatgatcattttaa

SEQ ID NO: 337159 - DNA, 16 bp, M. musculus
aaaatgatcctaactc

SEQ ID NO: 337160 - DNA, 16 bp, M. musculus
aaaatgatgttttaaa

SEQ ID NO: 337161 - DNA, 16 bp, M. musculus
aaaatgatttcttttt

SEQ ID NO: 337162 - DNA, 16 bp, M. musculus
aaaatgattttactgg

SEQ ID NO: 337163 - DNA, 16 bp, M. musculus
aaaatgcaaaaagctc

SEQ ID NO: 337164 - DNA, 16 bp, M. musculus
aaaatgcaaaatattt

SEQ ID NO: 337165 - DNA, 16 bp, M. musculus
aaaatgcaaaatgtat

SEQ ID NO: 337166 - DNA, 16 bp, M. musculus
aaaatgcaaaattcaa

SEQ ID NO: 337167 - DNA, 16 bp, M. musculus
aaaatgcaaagcttct

SEQ ID NO: 337168 - DNA, 16 bp, M. musculus
aaaatgcaaatagatc

SEQ ID NO: 337169 - DNA, 16 bp, M. musculus
aaaatgcaaatataat

SEQ ID NO: 337170 - DNA, 16 bp, M. musculus
aaaatgcacataaaat

SEQ ID NO: 337171 - DNA, 16 bp, M. musculus
aaaatgcagagagaaa

SEQ ID NO: 337172 - DNA, 16 bp, M. musculus
aaaatgcagagagtaa

SEQ ID NO: 337173 - DNA, 16 bp, M. musculus
aaaatgcagtacattt

SEQ ID NO: 337174 - DNA, 16 bp, M. musculus
aaaatgcataaaatat

SEQ ID NO: 337175 - DNA, 16 bp, M. musculus
aaaatgcattttcttt

SEQ ID NO: 337176 - DNA, 16 bp, M. musculus
aaaatgcatttttaaa

SEQ ID NO: 337177 - DNA, 16 bp, M. musculus
aaaatgccaacagcca

SEQ ID NO: 337178 - DNA, 16 bp, M. musculus
aaaatgccaactttaa

SEQ ID NO: 337179 - DNA, 16 bp, M. musculus
aaaatgccctacagat

SEQ ID NO: 337180 - DNA, 16 bp, M. musculus
aaaatgccttacagca

SEQ ID NO: 337181 - DNA, 16 bp, M. musculus
aaaatgccttgattta

SEQ ID NO: 337182 - DNA, 16 bp, M. musculus
aaaatgcctttcagct

SEQ ID NO: 337183 - DNA, 16 bp, M. musculus
aaaatgctcaacatcc

SEQ ID NO: 337184 - DNA, 16 bp, M. musculus
aaaatgctcccacaga

SEQ ID NO: 337185 - DNA, 16 bp, M. musculus
aaaatgctgccttttc

SEQ ID NO: 337186 - DNA, 16 bp, M. musculus
aaaatgctgtattttt

SEQ ID NO: 337187 - DNA, 16 bp, M. musculus
aaaatgctgtctttta

SEQ ID NO: 337188 - DNA, 16 bp, M. musculus
aaaatgctgtttcttt

SEQ ID NO: 337189 - DNA, 16 bp, M. musculus
aaaatgcttgccttgc

SEQ ID NO: 337190 - DNA, 16 bp, M. musculus
aaaatgctttcatttt

SEQ ID NO: 337191 - DNA, 16 bp, M. musculus
aaaatggaaaacagag

SEQ ID NO: 337192 - DNA, 16 bp, M. musculus
aaaatggaaaacctgg

SEQ ID NO: 337193 - DNA, 16 bp, M. musculus
aaaatggaaaattcaa

SEQ ID NO: 337194 - DNA, 16 bp, M. musculus
aaaatggaaacatttg

SEQ ID NO: 337195 - DNA, 16 bp, M. musculus
aaaatggaaaccaaca

SEQ ID NO: 337196 - DNA, 16 bp, M. musculus
aaaatggaagtacaaa

SEQ ID NO: 337197 - DNA, 16 bp, M. musculus
aaaatggaagttgaaa

SEQ ID NO: 337198 - DNA, 16 bp, M. musculus
aaaatggaatctcaga

SEQ ID NO: 337199 - DNA, 16 bp, M. musculus
aaaatggaattatttt

SEQ ID NO: 337200 - DNA, 16 bp, M. musculus
aaaatggactccagaa

SEQ ID NO: 337201 - DNA, 16 bp, M. musculus
aaaatggagaagaaac

SEQ ID NO: 337202 - DNA, 16 bp, M. musculus
aaaatggagaagagac

SEQ ID NO: 337203 - DNA, 16 bp, M. musculus
aaaatggagagagcat

SEQ ID NO: 337204 - DNA, 16 bp, M. musculus
aaaatggagcagagtc

SEQ ID NO: 337205 - DNA, 16 bp, M. musculus
aaaatggagctgctta

SEQ ID NO: 337206 - DNA, 16 bp, M. musculus
aaaatggagtttcttc

SEQ ID NO: 337207 - DNA, 16 bp, M. musculus
aaaatggatatttttt

SEQ ID NO: 337208 - DNA, 16 bp, M. musculus
aaaatggcaacaaaca

SEQ ID NO: 337209 - DNA, 16 bp, M. musculus
aaaatggcagcatcca

SEQ ID NO: 337210 - DNA, 16 bp, M. musculus
aaaatggcccccatag

SEQ ID NO: 337211 - DNA, 16 bp, M. musculus
aaaatggctatcttgt

SEQ ID NO: 337212 - DNA, 16 bp, M. musculus
aaaatgggacacagag

SEQ ID NO: 337213 - DNA, 16 bp, M. musculus
aaaatggttactgttt

SEQ ID NO: 337214 - DNA, 16 bp, M. musculus
aaaatggtttgttttt

SEQ ID NO: 337215 - DNA, 16 bp, M. musculus
aaaatgtaaaatttct

SEQ ID NO: 337216 - DNA, 16 bp, M. musculus
aaaatgtaaacattta

SEQ ID NO: 337217 - DNA, 16 bp, M. musculus
aaaatgtaaacatttt

SEQ ID NO: 337218 - DNA, 16 bp, M. musculus
aaaatgtaaatgagct

SEQ ID NO: 337219 - DNA, 16 bp, M. musculus
aaaatgtaaatgtgaa

SEQ ID NO: 337220 - DNA, 16 bp, M. musculus
aaaatgtacaatattt

SEQ ID NO: 337221 - DNA, 16 bp, M. musculus
aaaatgtacataaaat

SEQ ID NO: 337222 - DNA, 16 bp, M. musculus
aaaatgtacttgctgt

SEQ ID NO: 337223 - DNA, 16 bp, M. musculus
aaaatgtactttaaaa

SEQ ID NO: 337224 - DNA, 16 bp, M. musculus
aaaatgtatattttct

SEQ ID NO: 337225 - DNA, 16 bp, M. musculus
aaaatgtatctttaaa

SEQ ID NO: 337226 - DNA, 16 bp, M. musculus
aaaatgtatttacatt

SEQ ID NO: 337227 - DNA, 16 bp, M. musculus
aaaatgtatttctgaa

SEQ ID NO: 337228 - DNA, 16 bp, M. musculus
aaaatgtatttgaaca

SEQ ID NO: 337229 - DNA, 16 bp, M. musculus
aaaatgtattttaatg

SEQ ID NO: 337230 - DNA, 16 bp, M. musculus
aaaatgtattttatgt

SEQ ID NO: 337231 - DNA, 16 bp, M. musculus
aaaatgtattttctat

SEQ ID NO: 337232 - DNA, 16 bp, M. musculus
aaaatgtatttttctc

SEQ ID NO: 337233 - DNA, 16 bp, M. musculus
aaaatgtcaaaatata

SEQ ID NO: 337234 - DNA, 16 bp, M. musculus
aaaatgtcaaagaata

SEQ ID NO: 337235 - DNA, 16 bp, M. musculus
aaaatgtcaatgaaat

SEQ ID NO: 337236 - DNA, 16 bp, M. musculus
aaaatgtcactttttg

SEQ ID NO: 337237 - DNA, 16 bp, M. musculus
aaaatgtcataaggaa

SEQ ID NO: 337238 - DNA, 16 bp, M. musculus
aaaatgtcattttgaa

SEQ ID NO: 337239 - DNA, 16 bp, M. musculus
aaaatgtccaataaaa

SEQ ID NO: 337240 - DNA, 16 bp, M. musculus
aaaatgtctaataaaa

SEQ ID NO: 337241 - DNA, 16 bp, M. musculus
aaaatgtctatgttat

SEQ ID NO: 337242 - DNA, 16 bp, M. musculus
aaaatgtctcaaaaaa

SEQ ID NO: 337243 - DNA, 16 bp, M. musculus
aaaatgtctccataaa

SEQ ID NO: 337244 - DNA, 16 bp, M. musculus
aaaatgtcttcaaaaa

SEQ ID NO: 337245 - DNA, 16 bp, M. musculus
aaaatgtcttcaacaa

SEQ ID NO: 337246 - DNA, 16 bp, M. musculus
aaaatgtctttaaaaa

SEQ ID NO: 337247 - DNA, 16 bp, M. musculus
aaaatgtcttttaaaa

SEQ ID NO: 337248 - DNA, 16 bp, M. musculus
aaaatgtcttttattt

SEQ ID NO: 337249 - DNA, 16 bp, M. musculus
aaaatgtctttttaaa

SEQ ID NO: 337250 - DNA, 16 bp, M. musculus
aaaatgtgaagcagag

SEQ ID NO: 337251 - DNA, 16 bp, M. musculus
aaaatgtgatgtattt

SEQ ID NO: 337252 - DNA, 16 bp, M. musculus
aaaatgtgcatgtcaa

SEQ ID NO: 337253 - DNA, 16 bp, M. musculus
aaaatgtgcttttaaa

SEQ ID NO: 337254 - DNA, 16 bp, M. musculus
aaaatgtggaacattt

SEQ ID NO: 337255 - DNA, 16 bp, M. musculus
aaaatgtggatgaaat

SEQ ID NO: 337256 - DNA, 16 bp, M. musculus
aaaatgtgggagtggg

SEQ ID NO: 337257 - DNA, 16 bp, M. musculus
aaaatgtggtaaatct

SEQ ID NO: 337258 - DNA, 16 bp, M. musculus
aaaatgtggtaaattt

SEQ ID NO: 337259 - DNA, 26 bp, M. musculus
aaaatgtggtacatttacacaatgga

SEQ ID NO: 337260 - DNA, 16 bp, M. musculus
aaaatgtggtatattt

SEQ ID NO: 337261 - DNA, 16 bp, M. musculus
aaaatgtggtttgttt

SEQ ID NO: 337262 - DNA, 16 bp, M. musculus
aaaatgtgtcactgtg

SEQ ID NO: 337263 - DNA, 16 bp, M. musculus
aaaatgtgtgtgtctg

SEQ ID NO: 337264 - DNA, 16 bp, M. musculus
aaaatgtgtttataat

SEQ ID NO: 337265 - DNA, 16 bp, M. musculus
aaaatgtgtttgcatt

SEQ ID NO: 337266 - DNA, 16 bp, M. musculus
aaaatgtgtttgtttt

SEQ ID NO: 337267 - DNA, 16 bp, M. musculus
aaaatgtgttttaaaa

SEQ ID NO: 337268 - DNA, 16 bp, M. musculus
aaaatgtgttttgtgt

SEQ ID NO: 337269 - DNA, 16 bp, M. musculus
aaaatgtgttttttaa

SEQ ID NO: 337270 - DNA, 16 bp, M. musculus
aaaatgttaaaatgtt

SEQ ID NO: 337271 - DNA, 16 bp, M. musculus
aaaatgttaacaaatt

SEQ ID NO: 337272 - DNA, 16 bp, M. musculus
aaaatgttactatttt

SEQ ID NO: 337273 - DNA, 16 bp, M. musculus
aaaatgttattttgaa

SEQ ID NO: 337274 - DNA, 16 bp, M. musculus
aaaatgttcaacaaaa

SEQ ID NO: 337275 - DNA, 16 bp, M. musculus
aaaatgttcagtatcc

SEQ ID NO: 337276 - DNA, 16 bp, M. musculus
aaaatgttctaggaga

SEQ ID NO: 337277 - DNA, 16 bp, M. musculus
aaaatgttctatagtt

SEQ ID NO: 337278 - DNA, 16 bp, M. musculus
aaaatgttctatgata

SEQ ID NO: 337279 - DNA, 16 bp, M. musculus
aaaatgttctttattt

SEQ ID NO: 337280 - DNA, 16 bp, M. musculus
aaaatgttgtgtcttg

SEQ ID NO: 337281 - DNA, 16 bp, M. musculus
aaaatgtttaaaaact

SEQ ID NO: 337282 - DNA, 16 bp, M. musculus
aaaatgtttacatttt

SEQ ID NO: 337283 - DNA, 16 bp, M. musculus
aaaatgtttcattttc

SEQ ID NO: 337284 - DNA, 16 bp, M. musculus
aaaatgtttctttctt

SEQ ID NO: 337285 - DNA, 16 bp, M. musculus
aaaatgtttgaaagaa

SEQ ID NO: 337286 - DNA, 16 bp, M. musculus
aaaatgtttgaaatgt

SEQ ID NO: 337287 - DNA, 16 bp, M. musculus
aaaatgttttcaattt

SEQ ID NO: 337288 - DNA, 16 bp, M. musculus
aaaatgttttcctgaa

SEQ ID NO: 337289 - DNA, 16 bp, M. musculus
aaaatgttttcttttt

SEQ ID NO: 337290 - DNA, 16 bp, M. musculus
aaaatgttttgtcttt

SEQ ID NO: 337291 - DNA, 16 bp, M. musculus
aaaatgtttttaaact

SEQ ID NO: 337292 - DNA, 16 bp, M. musculus
aaaatgtttttaaagt

SEQ ID NO: 337293 - DNA, 16 bp, M. musculus
aaaatgtttttacatt

SEQ ID NO: 337294 - DNA, 16 bp, M. musculus
aaaatgtttttttcca

SEQ ID NO: 337295 - DNA, 16 bp, M. musculus
aaaattaaaactgtca

SEQ ID NO: 337296 - DNA, 16 bp, M. musculus
aaaattaaaatctgaa

SEQ ID NO: 337297 - DNA, 16 bp, M. musculus
aaaattaaaattcaga

SEQ ID NO: 337298 - DNA, 16 bp, M. musculus
aaaattaaagactttt

SEQ ID NO: 337299 - DNA, 16 bp, M. musculus
aaaattaaataacccc

SEQ ID NO: 337300 - DNA, 16 bp, M. musculus
aaaattaaatgtgtgt

SEQ ID NO: 337301 - DNA, 16 bp, M. musculus
aaaattaaatgtttct

SEQ ID NO: 337302 - DNA, 16 bp, M. musculus
aaaattaactgaaaca

SEQ ID NO: 337303 - DNA, 16 bp, M. musculus
aaaattaagccaggca

SEQ ID NO: 337304 - DNA, 16 bp, M. musculus
aaaattaagctttaaa

SEQ ID NO: 337305 - DNA, 16 bp, M. musculus
aaaattaaggtgacag

SEQ ID NO: 337306 - DNA, 16 bp, M. musculus
aaaattaagtgtgaag

SEQ ID NO: 337307 - DNA, 16 bp, M. musculus
aaaattaatttccttt

SEQ ID NO: 337308 - DNA, 16 bp, M. musculus
aaaattacaaaacttc

SEQ ID NO: 337309 - DNA, 16 bp, M. musculus
aaaattacagttaaaa

SEQ ID NO: 337310 - DNA, 16 bp, M. musculus
aaaattacagttctga

SEQ ID NO: 337311 - DNA, 16 bp, M. musculus
aaaattacattcagat

SEQ ID NO: 337312 - DNA, 16 bp, M. musculus
aaaattacattgtttt

SEQ ID NO: 337313 - DNA, 16 bp, M. musculus
aaaattacatttgaaa

SEQ ID NO: 337314 - DNA, 16 bp, M. musculus
aaaattacattttctt

SEQ ID NO: 337315 - DNA, 16 bp, M. musculus
aaaattactgttatga

SEQ ID NO: 337316 - DNA, 16 bp, M. musculus
aaaattacttttgttg

SEQ ID NO: 337317 - DNA, 16 bp, M. musculus
aaaattagcatataaa

SEQ ID NO: 337318 - DNA, 16 bp, M. musculus
aaaattatgtatttgt

SEQ ID NO: 337319 - DNA, 16 bp, M. musculus
aaaattattctgaaaa

SEQ ID NO: 337320 - DNA, 16 bp, M. musculus
aaaattatttgtgttg

SEQ ID NO: 337321 - DNA, 16 bp, M. musculus
aaaattattttccaac

SEQ ID NO: 337322 - DNA, 16 bp, M. musculus
aaaattattttctcca

SEQ ID NO: 337323 - DNA, 16 bp, M. musculus
aaaattattttgtgtg

SEQ ID NO: 337324 - DNA, 16 bp, M. musculus
aaaattcaaagaatca

SEQ ID NO: 337325 - DNA, 16 bp, M. musculus
aaaattcaaagtattt

SEQ ID NO: 337326 - DNA, 16 bp, M. musculus
aaaattcaaatgcaaa

SEQ ID NO: 337327 - DNA, 16 bp, M. musculus
aaaattcacatggaaa

SEQ ID NO: 337328 - DNA, 16 bp, M. musculus
aaaattcaccaagaga

SEQ ID NO: 337329 - DNA, 16 bp, M. musculus
aaaattcaccagagaa

SEQ ID NO: 337330 - DNA, 16 bp, M. musculus
aaaattcactaatctt

SEQ ID NO: 337331 - DNA, 16 bp, M. musculus
aaaattcagaaagaac

SEQ ID NO: 337332 - DNA, 16 bp, M. musculus
aaaattcaggcagaac

SEQ ID NO: 337333 - DNA, 16 bp, M. musculus
aaaattcagtgtctct

SEQ ID NO: 337334 - DNA, 16 bp, M. musculus
aaaattcagtttaaaa

SEQ ID NO: 337335 - DNA, 16 bp, M. musculus
aaaattcatgttgaaa

SEQ ID NO: 337336 - DNA, 16 bp, M. musculus
aaaattcattaccatt

SEQ ID NO: 337337 - DNA, 16 bp, M. musculus
aaaattcatttagtcc

SEQ ID NO: 337338 - DNA, 22 bp, M. musculus
aaaattccaactcaattcttca

SEQ ID NO: 337339 - DNA, 16 bp, M. musculus
aaaattccaccacaga

SEQ ID NO: 337340 - DNA, 16 bp, M. musculus
aaaattccagaattct

SEQ ID NO: 337341 - DNA, 16 bp, M. musculus
aaaattccagaattgt

SEQ ID NO: 337342 - DNA, 16 bp, M. musculus
aaaattccatttcttt

SEQ ID NO: 337343 - DNA, 16 bp, M. musculus
aaaattcctcaataaa

SEQ ID NO: 337344 - DNA, 16 bp, M. musculus
aaaattccttttaaaa

SEQ ID NO: 337345 - DNA, 16 bp, M. musculus
aaaattctaaaattct

SEQ ID NO: 337346 - DNA, 16 bp, M. musculus
aaaattctagaagaaa

SEQ ID NO: 337347 - DNA, 16 bp, M. musculus
aaaattctagaggaaa

SEQ ID NO: 337348 - DNA, 16 bp, M. musculus
aaaattctcagcttca

SEQ ID NO: 337349 - DNA, 16 bp, M. musculus
aaaattctctgaaaaa

SEQ ID NO: 337350 - DNA, 16 bp, M. musculus
aaaattctgttttctt

SEQ ID NO: 337351 - DNA, 16 bp, M. musculus
aaaattctttgtttta

SEQ ID NO: 337352 - DNA, 16 bp, M. musculus
aaaattgaagcagaag

SEQ ID NO: 337353 - DNA, 16 bp, M. musculus
aaaattgaagtgtaca

SEQ ID NO: 337354 - DNA, 16 bp, M. musculus
aaaattgattacttga

SEQ ID NO: 337355 - DNA, 16 bp, M. musculus
aaaattgcaaagcctc

SEQ ID NO: 337356 - DNA, 17 bp, M. musculus
aaaattgcaaagcttct

SEQ ID NO: 337357 - DNA, 16 bp, M. musculus
aaaattggaaaatctt

SEQ ID NO: 337358 - DNA, 16 bp, M. musculus
aaaattggaaacaatc

SEQ ID NO: 337359 - DNA, 16 bp, M. musculus
aaaattggaaatactt

SEQ ID NO: 337360 - DNA, 16 bp, M. musculus
aaaattggttgtgccc

SEQ ID NO: 337361 - DNA, 16 bp, M. musculus
aaaattggtttgaagt

SEQ ID NO: 337362 - DNA, 22 bp, M. musculus
aaaattggttttctacttctcc

SEQ ID NO: 337363 - DNA, 16 bp, M. musculus
aaaattgtaccagaga

SEQ ID NO: 337364 - DNA, 16 bp, M. musculus
aaaattgtctttaaaa

SEQ ID NO: 337365 - DNA, 16 bp, M. musculus
aaaattgttttccaga

SEQ ID NO: 337366 - DNA, 16 bp, M. musculus
aaaattgttttctaac

SEQ ID NO: 337367 - DNA, 16 bp, M. musculus
aaaattgttttctttt

SEQ ID NO: 337368 - DNA, 16 bp, M. musculus
aaaattgtttttaaag

SEQ ID NO: 337369 - DNA, 16 bp, M. musculus
aaaatttaaaaacatg

SEQ ID NO: 337370 - DNA, 16 bp, M. musculus
aaaatttaaaagcaag

SEQ ID NO: 337371 - DNA, 16 bp, M. musculus
aaaatttaaaagtaca

SEQ ID NO: 337372 - DNA, 16 bp, M. musculus
aaaatttcaaaatgat

SEQ ID NO: 337373 - DNA, 16 bp, M. musculus
aaaatttcattttgtt

SEQ ID NO: 337374 - DNA, 16 bp, M. musculus
aaaatttccaaataag

SEQ ID NO: 337375 - DNA, 16 bp, M. musculus
aaaatttctaagaaaa

SEQ ID NO: 337376 - DNA, 16 bp, M. musculus
aaaatttctgaaattt

SEQ ID NO: 337377 - DNA, 16 bp, M. musculus
aaaatttcttacatat

SEQ ID NO: 337378 - DNA, 16 bp, M. musculus
aaaatttgaaactaaa

SEQ ID NO: 337379 - DNA, 16 bp, M. musculus
aaaatttggaactgtg

SEQ ID NO: 337380 - DNA, 16 bp, M. musculus
aaaatttgggacacta

SEQ ID NO: 337381 - DNA, 17 bp, M. musculus
aaaatttgtcttggctt

SEQ ID NO: 337382 - DNA, 16 bp, M. musculus
aaaatttgttgaaaat

SEQ ID NO: 337383 - DNA, 16 bp, M. musculus
aaaattttaaaatgtc

SEQ ID NO: 337384 - DNA, 16 bp, M. musculus
aaaattttaaagcatt

SEQ ID NO: 337385 - DNA, 16 bp, M. musculus
aaaattttaaccaaga

SEQ ID NO: 337386 - DNA, 16 bp, M. musculus
aaaattttaagtcatt

SEQ ID NO: 337387 - DNA, 16 bp, M. musculus
aaaattttattgtttc

SEQ ID NO: 337388 - DNA, 16 bp, M. musculus
aaaattttcaactcaa

SEQ ID NO: 337389 - DNA, 16 bp, M. musculus
aaaattttcaagaaaa

SEQ ID NO: 337390 - DNA, 16 bp, M. musculus
aaaattttccatttta

SEQ ID NO: 337391 - DNA, 16 bp, M. musculus
aaaattttcctttctt

SEQ ID NO: 337392 - DNA, 16 bp, M. musculus
aaaattttgaaattgt

SEQ ID NO: 337393 - DNA, 17 bp, M. musculus
aaaattttgaagcaaat

SEQ ID NO: 337394 - DNA, 16 bp, M. musculus
aaaattttgcattact

SEQ ID NO: 337395 - DNA, 16 bp, M. musculus
aaacaaaaaacctttg

SEQ ID NO: 337396 - DNA, 16 bp, M. musculus
aaacaaaaaagatttc

SEQ ID NO: 337397 - DNA, 16 bp, M. musculus
aaacaaaaacattttg

SEQ ID NO: 337398 - DNA, 16 bp, M. musculus
aaacaaaaaccatttt

SEQ ID NO: 337399 - DNA, 16 bp, M. musculus
aaacaaaaacctgttt

SEQ ID NO: 337400 - DNA, 16 bp, M. musculus
aaacaaaaatatatgt

SEQ ID NO: 337401 - DNA, 16 bp, M. musculus
aaacaaaaatgcctct

SEQ ID NO: 337402 - DNA, 16 bp, M. musculus
aaacaaaacaagccat

SEQ ID NO: 337403 - DNA, 16 bp, M. musculus
aaacaaaacagaactg

SEQ ID NO: 337404 - DNA, 16 bp, M. musculus
aaacaaaacatcattt

SEQ ID NO: 337405 - DNA, 16 bp, M. musculus
aaacaaaaccagaatg

SEQ ID NO: 337406 - DNA, 16 bp, M. musculus
aaacaaaactattttc

SEQ ID NO: 337407 - DNA, 16 bp, M. musculus
aaacaaaactctagaa

SEQ ID NO: 337408 - DNA, 16 bp, M. musculus
aaacaaaactgagatt

SEQ ID NO: 337409 - DNA, 16 bp, M. musculus
aaacaaaagcaaaggt

SEQ ID NO: 337410 - DNA, 16 bp, M. musculus
aaacaaaagcagaggc

SEQ ID NO: 337411 - DNA, 16 bp, M. musculus
aaacaaaaggtggaag

SEQ ID NO: 337412 - DNA, 16 bp, M. musculus
aaacaaaataaatttg

SEQ ID NO: 337413 - DNA, 16 bp, M. musculus
aaacaaaataatcatg

SEQ ID NO: 337414 - DNA, 16 bp, M. musculus
aaacaaaatgttcaaa

SEQ ID NO: 337415 - DNA, 16 bp, M. musculus
aaacaaaattcttttt

SEQ ID NO: 337416 - DNA, 16 bp, M. musculus
aaacaaacaaacactg

SEQ ID NO: 337417 - DNA, 16 bp, M. musculus
aaacaaacaaacagct

SEQ ID NO: 337418 - DNA, 16 bp, M. musculus
aaacaaacaagccaat

SEQ ID NO: 337419 - DNA, 16 bp, M. musculus
aaacaaacacttatct

SEQ ID NO: 337420 - DNA, 16 bp, M. musculus
aaacaaacagaaatcc

SEQ ID NO: 337421 - DNA, 16 bp, M. musculus
aaacaaacagatgaag

SEQ ID NO: 337422 - DNA, 16 bp, M. musculus
aaacaaaccctctcct

SEQ ID NO: 337423 - DNA, 16 bp, M. musculus
aaacaaaccctttctc

SEQ ID NO: 337424 - DNA, 16 bp, M. musculus
aaacaaaccctttctt

SEQ ID NO: 337425 - DNA, 16 bp, M. musculus
aaacaaactgaaagga

SEQ ID NO: 337426 - DNA, 16 bp, M. musculus
aaacaaagaaatgttt

SEQ ID NO: 337427 - DNA, 16 bp, M. musculus
aaacaaagaatatttt

SEQ ID NO: 337428 - DNA, 16 bp, M. musculus
aaacaaagaattatca

SEQ ID NO: 337429 - DNA, 16 bp, M. musculus
aaacaaagacaccatg

SEQ ID NO: 337430 - DNA, 16 bp, M. musculus
aaacaaagacatggtt

SEQ ID NO: 337431 - DNA, 16 bp, M. musculus
aaacaaagagttgttt

SEQ ID NO: 337432 - DNA, 16 bp, M. musculus
aaacaaagattttttt

SEQ ID NO: 337433 - DNA, 16 bp, M. musculus
aaacaaagcatttatt

SEQ ID NO: 337434 - DNA, 16 bp, M. musculus
aaacaaagctgtgtgt

SEQ ID NO: 337435 - DNA, 16 bp, M. musculus
aaacaaaggcttctgt

SEQ ID NO: 337436 - DNA, 16 bp, M. musculus
aaacaaaggtaattct

SEQ ID NO: 337437 - DNA, 16 bp, M. musculus
aaacaaaggttttact

SEQ ID NO: 337438 - DNA, 16 bp, M. musculus
aaacaaagtctctgct

SEQ ID NO: 337439 - DNA, 16 bp, M. musculus
aaacaaagttttaaaa

SEQ ID NO: 337440 - DNA, 16 bp, M. musculus
aaacaaatatgtattt

SEQ ID NO: 337441 - DNA, 16 bp, M. musculus
aaacaaatatttcttt

SEQ ID NO: 337442 - DNA, 16 bp, M. musculus
aaacaaatattttaag

SEQ ID NO: 337443 - DNA, 16 bp, M. musculus
aaacaaatctcttaaa

SEQ ID NO: 337444 - DNA, 16 bp, M. musculus
aaacaaatgaagcagc

SEQ ID NO: 337445 - DNA, 16 bp, M. musculus
aaacaaatggaaagag

SEQ ID NO: 337446 - DNA, 16 bp, M. musculus
aaacaaatgtattttt

SEQ ID NO: 337447 - DNA, 16 bp, M. musculus
aaacaaattattttca

SEQ ID NO: 337448 - DNA, 16 bp, M. musculus
aaacaaatttatcttt

SEQ ID NO: 337449 - DNA, 16 bp, M. musculus
aaacaacaaattcatg

SEQ ID NO: 337450 - DNA, 16 bp, M. musculus
aaacaacaatatgaac

SEQ ID NO: 337451 - DNA, 16 bp, M. musculus
aaacaacacaggctat

SEQ ID NO: 337452 - DNA, 17 bp, M. musculus
aaacaacaccccttctc

SEQ ID NO: 337453 - DNA, 16 bp, M. musculus
aaacaacagaaatgta

SEQ ID NO: 337454 - DNA, 25 bp, M. musculus
aaacaaccaatgtgtacatatgcag

SEQ ID NO: 337455 - DNA, 16 bp, M. musculus
aaacaaccacaaaatg

SEQ ID NO: 337456 - DNA, 16 bp, M. musculus
aaacaacccagatgcc

SEQ ID NO: 337457 - DNA, 16 bp, M. musculus
aaacaacctaaatgtt

SEQ ID NO: 337458 - DNA, 16 bp, M. musculus
aaacaactggagcaga

SEQ ID NO: 337459 - DNA, 16 bp, M. musculus
aaacaacttcaggaaa

SEQ ID NO: 337460 - DNA, 16 bp, M. musculus
aaacaacttgaggaag

SEQ ID NO: 337461 - DNA, 16 bp, M. musculus
aaacaactttagcaaa

SEQ ID NO: 337462 - DNA, 16 bp, M. musculus
aaacaagaccaaaatt

SEQ ID NO: 337463 - DNA, 16 bp, M. musculus
aaacaagacttgaaca

SEQ ID NO: 337464 - DNA, 16 bp, M. musculus
aaacaagagatggaag

SEQ ID NO: 337465 - DNA, 16 bp, M. musculus
aaacaagcaagtgaaa

SEQ ID NO: 337466 - DNA, 16 bp, M. musculus
aaacaagcatgtgaaa

SEQ ID NO: 337467 - DNA, 16 bp, M. musculus
aaacaagcctcaacat

SEQ ID NO: 337468 - DNA, 16 bp, M. musculus
aaacaagcctcaactg

SEQ ID NO: 337469 - DNA, 16 bp, M. musculus
aaacaagctgaagttg

SEQ ID NO: 337470 - DNA, 16 bp, M. musculus
aaacaagcttggggaa

SEQ ID NO: 337471 - DNA, 16 bp, M. musculus
aaacaaggacaccatg

SEQ ID NO: 337472 - DNA, 16 bp, M. musculus
aaacaaggagaaagtg

SEQ ID NO: 337473 - DNA, 16 bp, M. musculus
aaacaaggagaagatg

SEQ ID NO: 337474 - DNA, 16 bp, M. musculus
aaacaaggagctgatt

SEQ ID NO: 337475 - DNA, 16 bp, M. musculus
aaacaaggcacctcag

SEQ ID NO: 337476 - DNA, 16 bp, M. musculus
aaacaaggctggcctc

SEQ ID NO: 337477 - DNA, 16 bp, M. musculus
aaacaagggagatata

SEQ ID NO: 337478 - DNA, 16 bp, M. musculus
aaacaagggcctctcc

SEQ ID NO: 337479 - DNA, 16 bp, M. musculus
aaacaagggctggaga

SEQ ID NO: 337480 - DNA, 16 bp, M. musculus
aaacaaggtcttgcta

SEQ ID NO: 337481 - DNA, 16 bp, M. musculus
aaacaaggtggaagat

SEQ ID NO: 337482 - DNA, 16 bp, M. musculus
aaacaaggttggttgc

SEQ ID NO: 337483 - DNA, 16 bp, M. musculus
aaacaagtcaatgccc

SEQ ID NO: 337484 - DNA, 16 bp, M. musculus
aaacaagtcttttaaa

SEQ ID NO: 337485 - DNA, 16 bp, M. musculus
aaacaagtgatggaag

SEQ ID NO: 337486 - DNA, 16 bp, M. musculus
aaacaagtgtgtgtgt

SEQ ID NO: 337487 - DNA, 16 bp, M. musculus
aaacaataaagctttt

SEQ ID NO: 337488 - DNA, 16 bp, M. musculus
aaacaatattttcttt

SEQ ID NO: 337489 - DNA, 16 bp, M. musculus
aaacaatccataatga

SEQ ID NO: 337490 - DNA, 16 bp, M. musculus
aaacaatccatactgc

SEQ ID NO: 337491 - DNA, 16 bp, M. musculus
aaacaatgaaggcaaa

SEQ ID NO: 337492 - DNA, 16 bp, M. musculus
aaacaatgttttaaaa

SEQ ID NO: 337493 - DNA, 16 bp, M. musculus
aaacaatgttttattt

SEQ ID NO: 337494 - DNA, 16 bp, M. musculus
aaacaattgcattttg

SEQ ID NO: 337495 - DNA, 16 bp, M. musculus
aaacaatttacagatt

SEQ ID NO: 337496 - DNA, 16 bp, M. musculus
aaacaattttaaagat

SEQ ID NO: 337497 - DNA, 16 bp, M. musculus
aaacaattttatagtt

SEQ ID NO: 337498 - DNA, 16 bp, M. musculus
aaacaattttccaaag

SEQ ID NO: 337499 - DNA, 17 bp, M. musculus
aaacaattttccaagaa

SEQ ID NO: 337500 - DNA, 16 bp, M. musculus
aaacaattttgaaaat

SEQ ID NO: 337501 - DNA, 16 bp, M. musculus
aaacacaaaacatttt

SEQ ID NO: 337502 - DNA, 16 bp, M. musculus
aaacacaaaagtccct

SEQ ID NO: 337503 - DNA, 16 bp, M. musculus
aaacacaaagactggc

SEQ ID NO: 337504 - DNA, 16 bp, M. musculus
aaacacaaatggaggc

SEQ ID NO: 337505 - DNA, 16 bp, M. musculus
aaacacaactggaaaa

SEQ ID NO: 337506 - DNA, 16 bp, M. musculus
aaacacaagaacctga

SEQ ID NO: 337507 - DNA, 16 bp, M. musculus
aaacacaaggacctga

SEQ ID NO: 337508 - DNA, 16 bp, M. musculus
aaacacacacatattt

SEQ ID NO: 337509 - DNA, 16 bp, M. musculus
aaacacacacgcacat

SEQ ID NO: 337510 - DNA, 16 bp, M. musculus
aaacacacacgtgcac

SEQ ID NO: 337511 - DNA, 16 bp, M. musculus
aaacacacattcatac

SEQ ID NO: 337512 - DNA, 16 bp, M. musculus
aaacacacctcagaaa

SEQ ID NO: 337513 - DNA, 16 bp, M. musculus
aaacacacggagagac

SEQ ID NO: 337514 - DNA, 16 bp, M. musculus
aaacacagaaacatta

SEQ ID NO: 337515 - DNA, 16 bp, M. musculus
aaacacagaactggat

SEQ ID NO: 337516 - DNA, 16 bp, M. musculus
aaacacagaagtgcat

SEQ ID NO: 337517 - DNA, 16 bp, M. musculus
aaacacagacatgtat

SEQ ID NO: 337518 - DNA, 16 bp, M. musculus
aaacacagagacacat

SEQ ID NO: 337519 - DNA, 16 bp, M. musculus
aaacacagagatttac

SEQ ID NO: 337520 - DNA, 16 bp, M. musculus
aaacacaggaaatttt

SEQ ID NO: 337521 - DNA, 16 bp, M. musculus
aaacacagtgtgtgtg

SEQ ID NO: 337522 - DNA, 16 bp, M. musculus
aaacacatacagatga

SEQ ID NO: 337523 - DNA, 16 bp, M. musculus
aaacacatacagtaga

SEQ ID NO: 337524 - DNA, 16 bp, M. musculus
aaacacatctttaaaa

SEQ ID NO: 337525 - DNA, 20 bp, M. musculus
aaacacatgaaactcaagaa

SEQ ID NO: 337526 - DNA, 17 bp, M. musculus
aaacacatgaaattcaa

SEQ ID NO: 337527 - DNA, 16 bp, M. musculus
aaacacatgaacataa

SEQ ID NO: 337528 - DNA, 16 bp, M. musculus
aaacacatgaacctca

SEQ ID NO: 337529 - DNA, 16 bp, M. musculus
aaacacatggacacag

SEQ ID NO: 337530 - DNA, 16 bp, M. musculus
aaacacattaaagcaa

SEQ ID NO: 337531 - DNA, 16 bp, M. musculus
aaacacatttgtaaat

SEQ ID NO: 337532 - DNA, 16 bp, M. musculus
aaacacattttaagaa

SEQ ID NO: 337533 - DNA, 16 bp, M. musculus
aaacacattttttaaa

SEQ ID NO: 337534 - DNA, 16 bp, M. musculus
aaacaccaaatgtaca

SEQ ID NO: 337535 - DNA, 16 bp, M. musculus
aaacaccagtgcacat

SEQ ID NO: 337536 - DNA, 16 bp, M. musculus
aaacaccatctaacac

SEQ ID NO: 337537 - DNA, 16 bp, M. musculus
aaacaccatgaacaaa

SEQ ID NO: 337538 - DNA, 16 bp, M. musculus
aaacaccatgaccaaa

SEQ ID NO: 337539 - DNA, 16 bp, M. musculus
aaacaccatgaccgaa

SEQ ID NO: 337540 - DNA, 16 bp, M. musculus
aaacaccattttaaaa

SEQ ID NO: 337541 - DNA, 16 bp, M. musculus
aaacacccaggcagat

SEQ ID NO: 337542 - DNA, 16 bp, M. musculus
aaacacccatacatat

SEQ ID NO: 337543 - DNA, 16 bp, M. musculus
aaacacccatgtacat

SEQ ID NO: 337544 - DNA, 16 bp, M. musculus
aaacacccattgaagg

SEQ ID NO: 337545 - DNA, 16 bp, M. musculus
aaacacctatacatat

SEQ ID NO: 337546 - DNA, 16 bp, M. musculus
aaacacctcccagaag

SEQ ID NO: 337547 - DNA, 16 bp, M. musculus
aaacaccttcaactcc

SEQ ID NO: 337548 - DNA, 16 bp, M. musculus
aaacactaaacttgtt

SEQ ID NO: 337549 - DNA, 16 bp, M. musculus
aaacactaaattcaca

SEQ ID NO: 337550 - DNA, 16 bp, M. musculus
aaacactacttttgaa

SEQ ID NO: 337551 - DNA, 16 bp, M. musculus
aaacactatacacata

SEQ ID NO: 337552 - DNA, 16 bp, M. musculus
aaacactcagacacat

SEQ ID NO: 337553 - DNA, 16 bp, M. musculus
aaacactcatgtacat

SEQ ID NO: 337554 - DNA, 17 bp, M. musculus
aaacactcttctcaatg

SEQ ID NO: 337555 - DNA, 16 bp, M. musculus
aaacactgaagaaaga

SEQ ID NO: 337556 - DNA, 16 bp, M. musculus
aaacactgctttgaat

SEQ ID NO: 337557 - DNA, 16 bp, M. musculus
aaacactggagagaaa

SEQ ID NO: 337558 - DNA, 16 bp, M. musculus
aaacactgtactcttt

SEQ ID NO: 337559 - DNA, 16 bp, M. musculus
aaacactgtctcaaaa

SEQ ID NO: 337560 - DNA, 16 bp, M. musculus
aaacactgtgaccaaa

SEQ ID NO: 337561 - DNA, 16 bp, M. musculus
aaacacttcccaggag

SEQ ID NO: 337562 - DNA, 16 bp, M. musculus
aaacactttattataa

SEQ ID NO: 337563 - DNA, 16 bp, M. musculus
aaacactttttagagt

SEQ ID NO: 337564 - DNA, 16 bp, M. musculus
aaacagaaaaatatct

SEQ ID NO: 337565 - DNA, 16 bp, M. musculus
aaacagaaaaatccct

SEQ ID NO: 337566 - DNA, 16 bp, M. musculus
aaacagaaaacatttt

SEQ ID NO: 337567 - DNA, 16 bp, M. musculus
aaacagaaaatatatt

SEQ ID NO: 337568 - DNA, 16 bp, M. musculus
aaacagaaagaatatt

SEQ ID NO: 337569 - DNA, 16 bp, M. musculus
aaacagaaagttgact

SEQ ID NO: 337570 - DNA, 16 bp, M. musculus
aaacagaaatggaagg

SEQ ID NO: 337571 - DNA, 16 bp, M. musculus
aaacagaacaacactc

SEQ ID NO: 337572 - DNA, 16 bp, M. musculus
aaacagaacctttccc

SEQ ID NO: 337573 - DNA, 16 bp, M. musculus
aaacagaagagagaat

SEQ ID NO: 337574 - DNA, 16 bp, M. musculus
aaacagaagcaaagat

SEQ ID NO: 337575 - DNA, 16 bp, M. musculus
aaacagaagcagatac

SEQ ID NO: 337576 - DNA, 16 bp, M. musculus
aaacagaagcagtcat

SEQ ID NO: 337577 - DNA, 16 bp, M. musculus
aaacagaaggaatact

SEQ ID NO: 337578 - DNA, 16 bp, M. musculus
aaacagaaggtagtct

SEQ ID NO: 337579 - DNA, 16 bp, M. musculus
aaacagaagtggatgc

SEQ ID NO: 337580 - DNA, 16 bp, M. musculus
aaacagaatatttaaa

SEQ ID NO: 337581 - DNA, 16 bp, M. musculus
aaacagaattcaagaa

SEQ ID NO: 337582 - DNA, 16 bp, M. musculus
aaacagaattttaaag

SEQ ID NO: 337583 - DNA, 16 bp, M. musculus
aaacagaatttttttt

SEQ ID NO: 337584 - DNA, 16 bp, M. musculus
aaacagacacacagat

SEQ ID NO: 337585 - DNA, 16 bp, M. musculus
aaacagacacaggaga

SEQ ID NO: 337586 - DNA, 16 bp, M. musculus
aaacagacatacacat

SEQ ID NO: 337587 - DNA, 16 bp, M. musculus
aaacagacatgtagac

SEQ ID NO: 337588 - DNA, 16 bp, M. musculus
aaacagactagaacct

SEQ ID NO: 337589 - DNA, 17 bp, M. musculus
aaacagactgggagaaa

SEQ ID NO: 337590 - DNA, 16 bp, M. musculus
aaacagactttttttt

SEQ ID NO: 337591 - DNA, 16 bp, M. musculus
aaacagagacagagac

SEQ ID NO: 337592 - DNA, 16 bp, M. musculus
aaacagagagaccctg

SEQ ID NO: 337593 - DNA, 16 bp, M. musculus
aaacagaggcacagaa

SEQ ID NO: 337594 - DNA, 16 bp, M. musculus
aaacagatatgcagta

SEQ ID NO: 337595 - DNA, 16 bp, M. musculus
aaacagatcatggaaa

SEQ ID NO: 337596 - DNA, 16 bp, M. musculus
aaacagatctttaaaa

SEQ ID NO: 337597 - DNA, 16 bp, M. musculus
aaacagatgaagaaat

SEQ ID NO: 337598 - DNA, 16 bp, M. musculus
aaacagatgaagagac

SEQ ID NO: 337599 - DNA, 16 bp, M. musculus
aaacagatgcagagac

SEQ ID NO: 337600 - DNA, 16 bp, M. musculus
aaacagatttaaatat

SEQ ID NO: 337601 - DNA, 16 bp, M. musculus
aaacagatttttttca

SEQ ID NO: 337602 - DNA, 16 bp, M. musculus
aaacagatttttttct

SEQ ID NO: 337603 - DNA, 16 bp, M. musculus
aaacagcaacagtgta

SEQ ID NO: 337604 - DNA, 16 bp, M. musculus
aaacagcaagtgctct

SEQ ID NO: 337605 - DNA, 16 bp, M. musculus
aaacagcaattctcaa

SEQ ID NO: 337606 - DNA, 16 bp, M. musculus
aaacagcacttcataa

SEQ ID NO: 337607 - DNA, 18 bp, M. musculus
aaacagcagcagcagcaa

SEQ ID NO: 337608 - DNA, 16 bp, M. musculus
aaacagcagcagcagt

SEQ ID NO: 337609 - DNA, 16 bp, M. musculus
aaacagccaaatgaaa

SEQ ID NO: 337610 - DNA, 16 bp, M. musculus
aaacagctgaaagaat

SEQ ID NO: 337611 - DNA, 16 bp, M. musculus
aaacagctgactgaga

SEQ ID NO: 337612 - DNA, 16 bp, M. musculus
aaacagctggtcacat

SEQ ID NO: 337613 - DNA, 16 bp, M. musculus
aaacagcttttaaaaa

SEQ ID NO: 337614 - DNA, 16 bp, M. musculus
aaacagcttttaaaag

SEQ ID NO: 337615 - DNA, 16 bp, M. musculus
aaacagctttttaaaa

SEQ ID NO: 337616 - DNA, 16 bp, M. musculus
aaacaggaaaatattt

SEQ ID NO: 337617 - DNA, 16 bp, M. musculus
aaacaggaaaggggat

SEQ ID NO: 337618 - DNA, 16 bp, M. musculus
aaacaggaacacagtg

SEQ ID NO: 337619 - DNA, 16 bp, M. musculus
aaacaggaacctggag

SEQ ID NO: 337620 - DNA, 16 bp, M. musculus
aaacaggaaggaaggc

SEQ ID NO: 337621 - DNA, 16 bp, M. musculus
aaacaggaagtgggga

SEQ ID NO: 337622 - DNA, 17 bp, M. musculus
aaacaggacccaacttt

SEQ ID NO: 337623 - DNA, 16 bp, M. musculus
aaacaggacccagcat

SEQ ID NO: 337624 - DNA, 16 bp, M. musculus
aaacaggagatggaaa

SEQ ID NO: 337625 - DNA, 16 bp, M. musculus
aaacaggataaaagca

SEQ ID NO: 337626 - DNA, 16 bp, M. musculus
aaacaggatccaacat

SEQ ID NO: 337627 - DNA, 16 bp, M. musculus
aaacaggccacagcca

SEQ ID NO: 337628 - DNA, 17 bp, M. musculus
aaacaggctgagaatga

SEQ ID NO: 337629 - DNA, 16 bp, M. musculus
aaacaggctggagaga

SEQ ID NO: 337630 - DNA, 16 bp, M. musculus
aaacagggaaccttaa

SEQ ID NO: 337631 - DNA, 16 bp, M. musculus
aaacagggcaggagcc

SEQ ID NO: 337632 - DNA, 20 bp, M. musculus
aaacagggcctgtcccagaa

SEQ ID NO: 337633 - DNA, 16 bp, M. musculus
aaacaggggagatata

SEQ ID NO: 337634 - DNA, 16 bp, M. musculus
aaacagggtctctcta

SEQ ID NO: 337635 - DNA, 16 bp, M. musculus
aaacagggtctctctg

SEQ ID NO: 337636 - DNA, 16 bp, M. musculus
aaacagggtctttctc

SEQ ID NO: 337637 - DNA, 17 bp, M. musculus
aaacaggtcaggaagca

SEQ ID NO: 337638 - DNA, 16 bp, M. musculus
aaacaggtctacatcc

SEQ ID NO: 337639 - DNA, 16 bp, M. musculus
aaacaggtgaagaaaa

SEQ ID NO: 337640 - DNA, 20 bp, M. musculus
aaacaggtgatggaattgaa

SEQ ID NO: 337641 - DNA, 16 bp, M. musculus
aaacaggttctctcca

SEQ ID NO: 337642 - DNA, 16 bp, M. musculus
aaacagtaactaagac

SEQ ID NO: 337643 - DNA, 17 bp, M. musculus
aaacagtagcaaaatta

SEQ ID NO: 337644 - DNA, 16 bp, M. musculus
aaacagtcatccatca

SEQ ID NO: 337645 - DNA, 16 bp, M. musculus
aaacagtgagaccctg

SEQ ID NO: 337646 - DNA, 16 bp, M. musculus
aaacagtgctaccaac

SEQ ID NO: 337647 - DNA, 16 bp, M. musculus
aaacagtggaagaaaa

SEQ ID NO: 337648 - DNA, 16 bp, M. musculus
aaacagtggaaggaaa

SEQ ID NO: 337649 - DNA, 16 bp, M. musculus
aaacagtgtgtgtgtg

SEQ ID NO: 337650 - DNA, 16 bp, M. musculus
aaacagttattttttt

SEQ ID NO: 337651 - DNA, 16 bp, M. musculus
aaacagttcagctgtt

SEQ ID NO: 337652 - DNA, 16 bp, M. musculus
aaacagttccatgtga

SEQ ID NO: 337653 - DNA, 16 bp, M. musculus
aaacagttgaagaaaa

SEQ ID NO: 337654 - DNA, 16 bp, M. musculus
aaacagtttgtaatag

SEQ ID NO: 337655 - DNA, 16 bp, M. musculus
aaacataaatattcag

SEQ ID NO: 337656 - DNA, 16 bp, M. musculus
aaacatacaagaagac

SEQ ID NO: 337657 - DNA, 16 bp, M. musculus
aaacatacaagtaaca

SEQ ID NO: 337658 - DNA, 16 bp, M. musculus
aaacatacatttattt

SEQ ID NO: 337659 - DNA, 16 bp, M. musculus
aaacatacccaagagg

SEQ ID NO: 337660 - DNA, 16 bp, M. musculus
aaacatacttggtcag

SEQ ID NO: 337661 - DNA, 16 bp, M. musculus
aaacatatttctaaat

SEQ ID NO: 337662 - DNA, 17 bp, M. musculus
aaacatattttgagtaa

SEQ ID NO: 337663 - DNA, 16 bp, M. musculus
aaacatcacacatcct

SEQ ID NO: 337664 - DNA, 16 bp, M. musculus
aaacatcacatgtcct

SEQ ID NO: 337665 - DNA, 16 bp, M. musculus
aaacatcagcaaactg

SEQ ID NO: 337666 - DNA, 16 bp, M. musculus
aaacatcagcaaattg

SEQ ID NO: 337667 - DNA, 17 bp, M. musculus
aaacatcagcagcctgt

SEQ ID NO: 337668 - DNA, 16 bp, M. musculus
aaacatcatgaccaag

SEQ ID NO: 337669 - DNA, 18 bp, M. musculus
aaacatcatgaccaagaa

SEQ ID NO: 337670 - DNA, 16 bp, M. musculus
aaacatcatgagcaag

SEQ ID NO: 337671 - DNA, 16 bp, M. musculus
aaacatcatggccaag

SEQ ID NO: 337672 - DNA, 16 bp, M. musculus
aaacatccacatacat

SEQ ID NO: 337673 - DNA, 18 bp, M. musculus
aaacatcgtgaccaagaa

SEQ ID NO: 337674 - DNA, 16 bp, M. musculus
aaacatctcaaatgct

SEQ ID NO: 337675 - DNA, 16 bp, M. musculus
aaacatctgcatctga

SEQ ID NO: 337676 - DNA, 16 bp, M. musculus
aaacatctgtgccaag

SEQ ID NO: 337677 - DNA, 16 bp, M. musculus
aaacatcttcagtgca

SEQ ID NO: 337678 - DNA, 16 bp, M. musculus
aaacatgaagaaaatg

SEQ ID NO: 337679 - DNA, 16 bp, M. musculus
aaacatgaagacctaa

SEQ ID NO: 337680 - DNA, 16 bp, M. musculus
aaacatgacccaacat

SEQ ID NO: 337681 - DNA, 16 bp, M. musculus
aaacatgatctgaaca

SEQ ID NO: 337682 - DNA, 16 bp, M. musculus
aaacatgcaaacaaac

SEQ ID NO: 337683 - DNA, 16 bp, M. musculus
aaacatgcacatacac

SEQ ID NO: 337684 - DNA, 16 bp, M. musculus
aaacatgcttgtttta

SEQ ID NO: 337685 - DNA, 16 bp, M. musculus
aaacatgcttttattt

SEQ ID NO: 337686 - DNA, 16 bp, M. musculus
aaacatggcaaattat

SEQ ID NO: 337687 - DNA, 16 bp, M. musculus
aaacatggcagcacac

SEQ ID NO: 337688 - DNA, 16 bp, M. musculus
aaacatggtcaaaata

SEQ ID NO: 337689 - DNA, 16 bp, M. musculus
aaacatgtaaaatatt

SEQ ID NO: 337690 - DNA, 16 bp, M. musculus
aaacatgtaaatatat

SEQ ID NO: 337691 - DNA, 16 bp, M. musculus
aaacatgtatatattt

SEQ ID NO: 337692 - DNA, 16 bp, M. musculus
aaacatgttcagcatc

SEQ ID NO: 337693 - DNA, 16 bp, M. musculus
aaacatgtttattttt

SEQ ID NO: 337694 - DNA, 16 bp, M. musculus
aaacattaaatgattt

SEQ ID NO: 337695 - DNA, 16 bp, M. musculus
aaacattattttgaaa

SEQ ID NO: 337696 - DNA, 16 bp, M. musculus
aaacattatttttgtt

SEQ ID NO: 337697 - DNA, 16 bp, M. musculus
aaacattcagaaaaca

SEQ ID NO: 337698 - DNA, 16 bp, M. musculus
aaacattccattctgc

SEQ ID NO: 337699 - DNA, 16 bp, M. musculus
aaacattccttcaaaa

SEQ ID NO: 337700 - DNA, 16 bp, M. musculus
aaacattccttcacga

SEQ ID NO: 337701 - DNA, 16 bp, M. musculus
aaacattctcaataaa

SEQ ID NO: 337702 - DNA, 16 bp, M. musculus
aaacattctttaaaat

SEQ ID NO: 337703 - DNA, 16 bp, M. musculus
aaacattcttttgtct

SEQ ID NO: 337704 - DNA, 16 bp, M. musculus
aaacattgaaacaaca

SEQ ID NO: 337705 - DNA, 16 bp, M. musculus
aaacattgttttcttt

SEQ ID NO: 337706 - DNA, 16 bp, M. musculus
aaacatttaaaaagga

SEQ ID NO: 337707 - DNA, 16 bp, M. musculus
aaacatttaaagaaat

SEQ ID NO: 337708 - DNA, 16 bp, M. musculus
aaacatttaattagag

SEQ ID NO: 337709 - DNA, 16 bp, M. musculus
aaacatttacttattt

SEQ ID NO: 337710 - DNA, 16 bp, M. musculus
aaacatttacttttta

SEQ ID NO: 337711 - DNA, 16 bp, M. musculus
aaacatttatgaaaat

SEQ ID NO: 337712 - DNA, 16 bp, M. musculus
aaacatttcaaatgta

SEQ ID NO: 337713 - DNA, 16 bp, M. musculus
aaacatttcactgaag

SEQ ID NO: 337714 - DNA, 16 bp, M. musculus
aaacatttctttaaaa

SEQ ID NO: 337715 - DNA, 16 bp, M. musculus
aaacatttgaaaacaa

SEQ ID NO: 337716 - DNA, 16 bp, M. musculus
aaacatttgaaataaa

SEQ ID NO: 337717 - DNA, 16 bp, M. musculus
aaacatttgttaaatg

SEQ ID NO: 337718 - DNA, 16 bp, M. musculus
aaacatttgttgaaaa

SEQ ID NO: 337719 - DNA, 16 bp, M. musculus
aaacattttaaaatga

SEQ ID NO: 337720 - DNA, 16 bp, M. musculus
aaacattttaaagaaa

SEQ ID NO: 337721 - DNA, 16 bp, M. musculus
aaacattttaaatact

SEQ ID NO: 337722 - DNA, 16 bp, M. musculus
aaacattttaaattgt

SEQ ID NO: 337723 - DNA, 16 bp, M. musculus
aaacattttacacaga

SEQ ID NO: 337724 - DNA, 16 bp, M. musculus
aaacattttaccactt

SEQ ID NO: 337725 - DNA, 16 bp, M. musculus
aaacattttatgccat

SEQ ID NO: 337726 - DNA, 16 bp, M. musculus
aaacattttatgtttt

SEQ ID NO: 337727 - DNA, 16 bp, M. musculus
aaacattttcaaaatt

SEQ ID NO: 337728 - DNA, 16 bp, M. musculus
aaacattttcacattt

SEQ ID NO: 337729 - DNA, 16 bp, M. musculus
aaacattttctctttt

SEQ ID NO: 337730 - DNA, 16 bp, M. musculus
aaacattttcttttca

SEQ ID NO: 337731 - DNA, 16 bp, M. musculus
aaacattttcttttgt

SEQ ID NO: 337732 - DNA, 16 bp, M. musculus
aaacatttttaaagta

SEQ ID NO: 337733 - DNA, 16 bp, M. musculus
aaacatttttataaag

SEQ ID NO: 337734 - DNA, 16 bp, M. musculus
aaacatttttctcttt

SEQ ID NO: 337735 - DNA, 16 bp, M. musculus
aaaccaaaccaaagta

SEQ ID NO: 337736 - DNA, 16 bp, M. musculus
aaaccaaagaaagatc

SEQ ID NO: 337737 - DNA, 16 bp, M. musculus
aaaccaaagccaaaat

SEQ ID NO: 337738 - DNA, 16 bp, M. musculus
aaaccaaatcaaagca

SEQ ID NO: 337739 - DNA, 16 bp, M. musculus
aaaccaaatgaagcag

SEQ ID NO: 337740 - DNA, 28 bp, M. musculus
aaaccaacactgagccccagatatggca

SEQ ID NO: 337741 - DNA, 16 bp, M. musculus
aaaccaagaaggggga

SEQ ID NO: 337742 - DNA, 16 bp, M. musculus
aaaccaagataatcag

SEQ ID NO: 337743 - DNA, 16 bp, M. musculus
aaaccaagcaagtgaa

SEQ ID NO: 337744 - DNA, 16 bp, M. musculus
aaaccaagctggcctc

SEQ ID NO: 337745 - DNA, 16 bp, M. musculus
aaaccaagggcctctc

SEQ ID NO: 337746 - DNA, 16 bp, M. musculus
aaaccaagggctggag

SEQ ID NO: 337747 - DNA, 16 bp, M. musculus
aaaccaaggtatacca

SEQ ID NO: 337748 - DNA, 16 bp, M. musculus
aaaccaagtattcaaa

SEQ ID NO: 337749 - DNA, 24 bp, M. musculus
aaaccaatacaagaacgggaacaa

SEQ ID NO: 337750 - DNA, 16 bp, M. musculus
aaaccaatagctaaca

SEQ ID NO: 337751 - DNA, 16 bp, M. musculus
aaaccaatttccctta

SEQ ID NO: 337752 - DNA, 16 bp, M. musculus
aaaccaatttctttta

SEQ ID NO: 337753 - DNA, 16 bp, M. musculus
aaaccacagatgccaa

SEQ ID NO: 337754 - DNA, 16 bp, M. musculus
aaaccacagcctcttg

SEQ ID NO: 337755 - DNA, 20 bp, M. musculus
aaaccacatggtggctcaca

SEQ ID NO: 337756 - DNA, 16 bp, M. musculus
aaaccaccacattcca

SEQ ID NO: 337757 - DNA, 16 bp, M. musculus
aaaccacccaggatct

SEQ ID NO: 337758 - DNA, 16 bp, M. musculus
aaaccactcaaggtct

SEQ ID NO: 337759 - DNA, 16 bp, M. musculus
aaaccactttcatcaa

SEQ ID NO: 337760 - DNA, 16 bp, M. musculus
aaaccactttggctcc

SEQ ID NO: 337761 - DNA, 16 bp, M. musculus
aaaccagaaaatatca

SEQ ID NO: 337762 - DNA, 16 bp, M. musculus
aaaccagaaacttcca

SEQ ID NO: 337763 - DNA, 16 bp, M. musculus
aaaccagagacagtga

SEQ ID NO: 337764 - DNA, 16 bp, M. musculus
aaaccagatgtggtgg

SEQ ID NO: 337765 - DNA, 16 bp, M. musculus
aaaccagcaatcaaag

SEQ ID NO: 337766 - DNA, 16 bp, M. musculus
aaaccagcagctgcag

SEQ ID NO: 337767 - DNA, 16 bp, M. musculus
aaaccagccaggacaa

SEQ ID NO: 337768 - DNA, 16 bp, M. musculus
aaaccaggaaccttaa

SEQ ID NO: 337769 - DNA, 16 bp, M. musculus
aaaccaggaatgttaa

SEQ ID NO: 337770 - DNA, 16 bp, M. musculus
aaaccaggatcaagtt

SEQ ID NO: 337771 - DNA, 16 bp, M. musculus
aaaccaggcatggtga

SEQ ID NO: 337772 - DNA, 16 bp, M. musculus
aaaccaggcctggtgg

SEQ ID NO: 337773 - DNA, 16 bp, M. musculus
aaaccagtagcaaaca

SEQ ID NO: 337774 - DNA, 16 bp, M. musculus
aaaccagtgtttctca

SEQ ID NO: 337775 - DNA, 16 bp, M. musculus
aaaccataagccaaaa

SEQ ID NO: 337776 - DNA, 16 bp, M. musculus
aaaccatcacagtgac

SEQ ID NO: 337777 - DNA, 16 bp, M. musculus
aaaccatcatgaccaa

SEQ ID NO: 337778 - DNA, 16 bp, M. musculus
aaaccatccactggaa

SEQ ID NO: 337779 - DNA, 16 bp, M. musculus
aaaccatccagagact

SEQ ID NO: 337780 - DNA, 16 bp, M. musculus
aaaccatccagcagaa

SEQ ID NO: 337781 - DNA, 16 bp, M. musculus
aaaccatccatttcat

SEQ ID NO: 337782 - DNA, 16 bp, M. musculus
aaaccatgagccaaaa

SEQ ID NO: 337783 - DNA, 16 bp, M. musculus
aaaccatgagtcaaaa

SEQ ID NO: 337784 - DNA, 16 bp, M. musculus
aaaccatggagggatg

SEQ ID NO: 337785 - DNA, 16 bp, M. musculus
aaaccatgggaagcaa

SEQ ID NO: 337786 - DNA, 16 bp, M. musculus
aaaccatgtcttaaaa

SEQ ID NO: 337787 - DNA, 16 bp, M. musculus
aaaccattttaaaatt

SEQ ID NO: 337788 - DNA, 16 bp, M. musculus
aaacccaaactaagac

SEQ ID NO: 337789 - DNA, 16 bp, M. musculus
aaacccaaagtcatca

SEQ ID NO: 337790 - DNA, 16 bp, M. musculus
aaacccaagtccaagt

SEQ ID NO: 337791 - DNA, 16 bp, M. musculus
aaacccacaatctcag

SEQ ID NO: 337792 - DNA, 16 bp, M. musculus
aaacccacttcaggga

SEQ ID NO: 337793 - DNA, 16 bp, M. musculus
aaacccagaaatcagc

SEQ ID NO: 337794 - DNA, 16 bp, M. musculus
aaacccagacatgaga

SEQ ID NO: 337795 - DNA, 16 bp, M. musculus
aaacccagcactcaga

SEQ ID NO: 337796 - DNA, 16 bp, M. musculus
aaacccagggccttga

SEQ ID NO: 337797 - DNA, 16 bp, M. musculus
aaacccagtctcaaaa

SEQ ID NO: 337798 - DNA, 16 bp, M. musculus
aaacccagtctcagaa

SEQ ID NO: 337799 - DNA, 16 bp, M. musculus
aaacccattattatgt

SEQ ID NO: 337800 - DNA, 16 bp, M. musculus
aaaccccagagaccca

SEQ ID NO: 337801 - DNA, 16 bp, M. musculus
aaaccccatcagatcc

SEQ ID NO: 337802 - DNA, 17 bp, M. musculus
aaaccccatcagctcct

SEQ ID NO: 337803 - DNA, 16 bp, M. musculus
aaaccccctatcccat

SEQ ID NO: 337804 - DNA, 18 bp, M. musculus
aaaccccgtccctcttaa

SEQ ID NO: 337805 - DNA, 47 bp, M. musculus
aaaccccgtccctcttaaggagcattctccttcgcctcggacgtgtc

SEQ ID NO: 337806 - DNA, 16 bp, M. musculus
aaacccctatcctatc

SEQ ID NO: 337807 - DNA, 16 bp, M. musculus
aaacccctcagctcct

SEQ ID NO: 337808 - DNA, 16 bp, M. musculus
aaaccccttcagcacc

SEQ ID NO: 337809 - DNA, 17 bp, M. musculus
aaaccccttcagctccc

SEQ ID NO: 337810 - DNA, 16 bp, M. musculus
aaaccctaagacagaa

SEQ ID NO: 337811 - DNA, 16 bp, M. musculus
aaaccctaagacattg

SEQ ID NO: 337812 - DNA, 16 bp, M. musculus
aaaccctacaaatgta

SEQ ID NO: 337813 - DNA, 18 bp, M. musculus
aaaccctatctcaaaaaa

SEQ ID NO: 337814 - DNA, 16 bp, M. musculus
aaaccctatctcaaag

SEQ ID NO: 337815 - DNA, 17 bp, M. musculus
aaaccctatgaatgtaa

SEQ ID NO: 337816 - DNA, 16 bp, M. musculus
aaaccctatgtcaaaa

SEQ ID NO: 337817 - DNA, 16 bp, M. musculus
aaaccctattttgaaa

SEQ ID NO: 337818 - DNA, 16 bp, M. musculus
aaaccctcaggtgaca

SEQ ID NO: 337819 - DNA, 16 bp, M. musculus
aaaccctctatcccat

SEQ ID NO: 337820 - DNA, 16 bp, M. musculus
aaaccctgacactatt

SEQ ID NO: 337821 - DNA, 16 bp, M. musculus
aaaccctgacactgtt

SEQ ID NO: 337822 - DNA, 16 bp, M. musculus
aaaccctgactcaaaa

SEQ ID NO: 337823 - DNA, 16 bp, M. musculus
aaaccctggagataga

SEQ ID NO: 337824 - DNA, 16 bp, M. musculus
aaaccctggctcaaaa

SEQ ID NO: 337825 - DNA, 16 bp, M. musculus
aaaccctgtcataaaa

SEQ ID NO: 337826 - DNA, 16 bp, M. musculus
aaaccctgtccctttt

SEQ ID NO: 337827 - DNA, 19 bp, M. musculus
aaaccctgtctcaaaaaag

SEQ ID NO: 337828 - DNA, 18 bp, M. musculus
aaaccctgtctcaaaaag

SEQ ID NO: 337829 - DNA, 16 bp, M. musculus
aaaccctgtctggaaa

SEQ ID NO: 337830 - DNA, 20 bp, M. musculus
aaaccctgtctggaaaaacc

SEQ ID NO: 337831 - DNA, 16 bp, M. musculus
aaaccctgtctgggaa

SEQ ID NO: 337832 - DNA, 18 bp, M. musculus
aaaccctgtcttaaaaaa

SEQ ID NO: 337833 - DNA, 16 bp, M. musculus
aaaccctgtcttgaaa

SEQ ID NO: 337834 - DNA, 16 bp, M. musculus
aaaccctgtcttgaga

SEQ ID NO: 337835 - DNA, 16 bp, M. musculus
aaacccttaagaaaaa

SEQ ID NO: 337836 - DNA, 16 bp, M. musculus
aaacccttcaaatgtg

SEQ ID NO: 337837 - DNA, 16 bp, M. musculus
aaaccctttcctccca

SEQ ID NO: 337838 - DNA, 16 bp, M. musculus
aaaccctttcctgccc

SEQ ID NO: 337839 - DNA, 16 bp, M. musculus
aaaccctttccttctc

SEQ ID NO: 337840 - DNA, 16 bp, M. musculus
aaaccctttctcttta

SEQ ID NO: 337841 - DNA, 16 bp, M. musculus
aaaccgaatcaaagaa

SEQ ID NO: 337842 - DNA, 19 bp, M. musculus
aaaccgatgtccttctcaa

SEQ ID NO: 337843 - DNA, 16 bp, M. musculus
aaacctaaaagaagag

SEQ ID NO: 337844 - DNA, 16 bp, M. musculus
aaacctaaggaaaata

SEQ ID NO: 337845 - DNA, 16 bp, M. musculus
aaacctacccaaacag

SEQ ID NO: 337846 - DNA, 16 bp, M. musculus
aaacctacctgcctct

SEQ ID NO: 337847 - DNA, 16 bp, M. musculus
aaacctactccatctt

SEQ ID NO: 337848 - DNA, 16 bp, M. musculus
aaacctaggaaagagg

SEQ ID NO: 337849 - DNA, 16 bp, M. musculus
aaacctaggacagcaa

SEQ ID NO: 337850 - DNA, 16 bp, M. musculus
aaacctatgaatgcat

SEQ ID NO: 337851 - DNA, 16 bp, M. musculus
aaacctcaaagcctgc

SEQ ID NO: 337852 - DNA, 16 bp, M. musculus
aaacctcagagcccat

SEQ ID NO: 337853 - DNA, 17 bp, M. musculus
aaacctctatctccaaa

SEQ ID NO: 337854 - DNA, 16 bp, M. musculus
aaacctctctggaaac

SEQ ID NO: 337855 - DNA, 16 bp, M. musculus
aaacctcttgggctgg

SEQ ID NO: 337856 - DNA, 16 bp, M. musculus
aaacctgaagacctga

SEQ ID NO: 337857 - DNA, 16 bp, M. musculus
aaacctgaagagaaat

SEQ ID NO: 337858 - DNA, 16 bp, M. musculus
aaacctgacaaccaga

SEQ ID NO: 337859 - DNA, 16 bp, M. musculus
aaacctgagtttggat

SEQ ID NO: 337860 - DNA, 16 bp, M. musculus
aaacctgatagaagag

SEQ ID NO: 337861 - DNA, 16 bp, M. musculus
aaacctgcctgcctct

SEQ ID NO: 337862 - DNA, 17 bp, M. musculus
aaacctggaggcaggaa

SEQ ID NO: 337863 - DNA, 16 bp, M. musculus
aaacctggcatggtgg

SEQ ID NO: 337864 - DNA, 16 bp, M. musculus
aaacctggggcctctg

SEQ ID NO: 337865 - DNA, 16 bp, M. musculus
aaacctgtggctttct

SEQ ID NO: 337866 - DNA, 24 bp, M. musculus
aaaccttacaaatgcagtgaatgt

SEQ ID NO: 337867 - DNA, 16 bp, M. musculus
aaaccttatttataat

SEQ ID NO: 337868 - DNA, 16 bp, M. musculus
aaaccttctatcccat

SEQ ID NO: 337869 - DNA, 16 bp, M. musculus
aaaccttgacactatt

SEQ ID NO: 337870 - DNA, 16 bp, M. musculus
aaaccttgccttgaaa

SEQ ID NO: 337871 - DNA, 16 bp, M. musculus
aaaccttgtctggaaa

SEQ ID NO: 337872 - DNA, 16 bp, M. musculus
aaacctttaaaatatt

SEQ ID NO: 337873 - DNA, 16 bp, M. musculus
aaacctttaaagaaaa

SEQ ID NO: 337874 - DNA, 16 bp, M. musculus
aaacctttaatcccag

SEQ ID NO: 337875 - DNA, 16 bp, M. musculus
aaacctttctctcaaa

SEQ ID NO: 337876 - DNA, 16 bp, M. musculus
aaacctttgctttgct

SEQ ID NO: 337877 - DNA, 16 bp, M. musculus
aaaccttttctcaaaa

SEQ ID NO: 337878 - DNA, 16 bp, M. musculus
aaacctttttaaaaac

SEQ ID NO: 337879 - DNA, 16 bp, M. musculus
aaaccttttttaaaaa

SEQ ID NO: 337880 - DNA, 16 bp, M. musculus
aaacgaggaaaattcc

SEQ ID NO: 337881 - DNA, 16 bp, M. musculus
aaacgcatgaaactca

SEQ ID NO: 337882 - DNA, 16 bp, M. musculus
aaactaaacagagaga

SEQ ID NO: 337883 - DNA, 16 bp, M. musculus
aaactaaatctttttt

SEQ ID NO: 337884 - DNA, 16 bp, M. musculus
aaactaaatgaagaga

SEQ ID NO: 337885 - DNA, 16 bp, M. musculus
aaactaaattcaaggt

SEQ ID NO: 337886 - DNA, 16 bp, M. musculus
aaactaaattttcatt

SEQ ID NO: 337887 - DNA, 16 bp, M. musculus
aaactaacagaagaga

SEQ ID NO: 337888 - DNA, 16 bp, M. musculus
aaactaacagaagtaa

SEQ ID NO: 337889 - DNA, 16 bp, M. musculus
aaactaaggaagacaa

SEQ ID NO: 337890 - DNA, 16 bp, M. musculus
aaactaatatttctta

SEQ ID NO: 337891 - DNA, 16 bp, M. musculus
aaactacagcctagaa

SEQ ID NO: 337892 - DNA, 17 bp, M. musculus
aaactacattgtgctta

SEQ ID NO: 337893 - DNA, 16 bp, M. musculus
aaactacatttcagaa

SEQ ID NO: 337894 - DNA, 16 bp, M. musculus
aaactacatttcccag

SEQ ID NO: 337895 - DNA, 16 bp, M. musculus
aaactactttgggatt

SEQ ID NO: 337896 - DNA, 16 bp, M. musculus
aaactactttttaaaa

SEQ ID NO: 337897 - DNA, 16 bp, M. musculus
aaactagagagatcac

SEQ ID NO: 337898 - DNA, 16 bp, M. musculus
aaactagatatcaaca

SEQ ID NO: 337899 - DNA, 16 bp, M. musculus
aaactagccagtacac

SEQ ID NO: 337900 - DNA, 16 bp, M. musculus
aaactagccagtacag

SEQ ID NO: 337901 - DNA, 16 bp, M. musculus
aaactaggaaagcaga

SEQ ID NO: 337902 - DNA, 18 bp, M. musculus
aaactaggaaaggggata

SEQ ID NO: 337903 - DNA, 16 bp, M. musculus
aaactaggaaaggggg

SEQ ID NO: 337904 - DNA, 16 bp, M. musculus
aaactatatatgtata

SEQ ID NO: 337905 - DNA, 16 bp, M. musculus
aaactatctgcagctg

SEQ ID NO: 337906 - DNA, 16 bp, M. musculus
aaactattcctcaaaa

SEQ ID NO: 337907 - DNA, 16 bp, M. musculus
aaactatttctaaaca

SEQ ID NO: 337908 - DNA, 16 bp, M. musculus
aaactattttaattct

SEQ ID NO: 337909 - DNA, 16 bp, M. musculus
aaactattttagtgga

SEQ ID NO: 337910 - DNA, 16 bp, M. musculus
aaactcaaagatctgc

SEQ ID NO: 337911 - DNA, 16 bp, M. musculus
aaactcaaagcaattt

SEQ ID NO: 337912 - DNA, 16 bp, M. musculus
aaactcaaagggctga

SEQ ID NO: 337913 - DNA, 16 bp, M. musculus
aaactcaacaagaagg

SEQ ID NO: 337914 - DNA, 16 bp, M. musculus
aaactcaagaaagaag

SEQ ID NO: 337915 - DNA, 16 bp, M. musculus
aaactcaagaacaaag

SEQ ID NO: 337916 - DNA, 16 bp, M. musculus
aaactcaagaagaaat

SEQ ID NO: 337917 - DNA, 16 bp, M. musculus
aaactcaagaagaaga

SEQ ID NO: 337918 - DNA, 16 bp, M. musculus
aaactcaagaagctgg

SEQ ID NO: 337919 - DNA, 16 bp, M. musculus
aaactcaagatgtcct

SEQ ID NO: 337920 - DNA, 16 bp, M. musculus
aaactcaaggagaagg

SEQ ID NO: 337921 - DNA, 16 bp, M. musculus
aaactcaagtcagcaa

SEQ ID NO: 337922 - DNA, 16 bp, M. musculus
aaactcacaaagaacc

SEQ ID NO: 337923 - DNA, 16 bp, M. musculus
aaactcacaaagatct

SEQ ID NO: 337924 - DNA, 16 bp, M. musculus
aaactcacagagaccc

SEQ ID NO: 337925 - DNA, 16 bp, M. musculus
aaactcacagagatca

SEQ ID NO: 337926 - DNA, 16 bp, M. musculus
aaactcacattttaaa

SEQ ID NO: 337927 - DNA, 16 bp, M. musculus
aaactcactacatagc

SEQ ID NO: 337928 - DNA, 16 bp, M. musculus
aaactcactctgtgga

SEQ ID NO: 337929 - DNA, 16 bp, M. musculus
aaactcactgtgcagc

SEQ ID NO: 337930 - DNA, 28 bp, M. musculus
aaactcagaaatccacctgcctctgcct

SEQ ID NO: 337931 - DNA, 16 bp, M. musculus
aaactcagacaccatt

SEQ ID NO: 337932 - DNA, 18 bp, M. musculus
aaactcagagatccgcct

SEQ ID NO: 337933 - DNA, 19 bp, M. musculus
aaactcagagatctgcctg

SEQ ID NO: 337934 - DNA, 16 bp, M. musculus
aaactcagatatctgc

SEQ ID NO: 337935 - DNA, 16 bp, M. musculus
aaactcagatgtccct

SEQ ID NO: 337936 - DNA, 16 bp, M. musculus
aaactcaggtcctctg

SEQ ID NO: 337937 - DNA, 16 bp, M. musculus
aaactcaggtgactgc

SEQ ID NO: 337938 - DNA, 16 bp, M. musculus
aaactcaggttgccag

SEQ ID NO: 337939 - DNA, 16 bp, M. musculus
aaactcatagagatct

SEQ ID NO: 337940 - DNA, 16 bp, M. musculus
aaactcatagttctga

SEQ ID NO: 337941 - DNA, 16 bp, M. musculus
aaactcatcaaaaaag

SEQ ID NO: 337942 - DNA, 16 bp, M. musculus
aaactcatcaaaggaa

SEQ ID NO: 337943 - DNA, 16 bp, M. musculus
aaactcattggcacag

SEQ ID NO: 337944 - DNA, 16 bp, M. musculus
aaactcattggttccc

SEQ ID NO: 337945 - DNA, 16 bp, M. musculus
aaactcattgttttta

SEQ ID NO: 337946 - DNA, 16 bp, M. musculus
aaactccaaagcaaaa

SEQ ID NO: 337947 - DNA, 16 bp, M. musculus
aaactccaaagttttt

SEQ ID NO: 337948 - DNA, 16 bp, M. musculus
aaactccacaggaaga

SEQ ID NO: 337949 - DNA, 16 bp, M. musculus
aaactccagccagaga

SEQ ID NO: 337950 - DNA, 16 bp, M. musculus
aaactccagttccagg

SEQ ID NO: 337951 - DNA, 16 bp, M. musculus
aaactcccaggaatct

SEQ ID NO: 337952 - DNA, 16 bp, M. musculus
aaactctacatctcca

SEQ ID NO: 337953 - DNA, 16 bp, M. musculus
aaactctatcttctta

SEQ ID NO: 337954 - DNA, 41 bp, M. musculus
aaactctcaattaccatagatggagaaaccaaagtattcca

SEQ ID NO: 337955 - DNA, 16 bp, M. musculus
aaactctcagagatct

SEQ ID NO: 337956 - DNA, 16 bp, M. musculus
aaactctgaaatccgc

SEQ ID NO: 337957 - DNA, 16 bp, M. musculus
aaactctgagccatct

SEQ ID NO: 337958 - DNA, 16 bp, M. musculus
aaactctgtctcaaaa

SEQ ID NO: 337959 - DNA, 16 bp, M. musculus
aaactctgtctcagaa

SEQ ID NO: 337960 - DNA, 16 bp, M. musculus
aaactctgtctccaaa

SEQ ID NO: 337961 - DNA, 16 bp, M. musculus
aaactctgttttaaaa

SEQ ID NO: 337962 - DNA, 16 bp, M. musculus
aaactcttagctctga

SEQ ID NO: 337963 - DNA, 16 bp, M. musculus
aaactcttccacattc

SEQ ID NO: 337964 - DNA, 16 bp, M. musculus
aaactcttctgcctca

SEQ ID NO: 337965 - DNA, 16 bp, M. musculus
aaactctttcttccat

SEQ ID NO: 337966 - DNA, 16 bp, M. musculus
aaactgaaaataaatg

SEQ ID NO: 337967 - DNA, 16 bp, M. musculus
aaactgaaagcatttc

SEQ ID NO: 337968 - DNA, 16 bp, M. musculus
aaactgaaaggcaaaa

SEQ ID NO: 337969 - DNA, 16 bp, M. musculus
aaactgaacaaagaat

SEQ ID NO: 337970 - DNA, 16 bp, M. musculus
aaactgaagaagaaca

SEQ ID NO: 337971 - DNA, 16 bp, M. musculus
aaactgaagaagaacg

SEQ ID NO: 337972 - DNA, 17 bp, M. musculus
aaactgaagaagaagga

SEQ ID NO: 337973 - DNA, 16 bp, M. musculus
aaactgaagcaggagg

SEQ ID NO: 337974 - DNA, 16 bp, M. musculus
aaactgaaggaatcct

SEQ ID NO: 337975 - DNA, 16 bp, M. musculus
aaactgaatctgagga

SEQ ID NO: 337976 - DNA, 16 bp, M. musculus
aaactgaccacatagt

SEQ ID NO: 337977 - DNA, 16 bp, M. musculus
aaactgaccttgaact

SEQ ID NO: 337978 - DNA, 16 bp, M. musculus
aaactgagaaagggga

SEQ ID NO: 337979 - DNA, 16 bp, M. musculus
aaactgagactgaatc

SEQ ID NO: 337980 - DNA, 16 bp, M. musculus
aaactgagactgccca

SEQ ID NO: 337981 - DNA, 16 bp, M. musculus
aaactgagagagagag

SEQ ID NO: 337982 - DNA, 16 bp, M. musculus
aaactgaggaagaaag

SEQ ID NO: 337983 - DNA, 16 bp, M. musculus
aaactgaggcagagag

SEQ ID NO: 337984 - DNA, 16 bp, M. musculus
aaactgaggcagcagt

SEQ ID NO: 337985 - DNA, 16 bp, M. musculus
aaactgaggctcaaag

SEQ ID NO: 337986 - DNA, 16 bp, M. musculus
aaactgatagaaaaga

SEQ ID NO: 337987 - DNA, 16 bp, M. musculus
aaactgattttaaaat

SEQ ID NO: 337988 - DNA, 16 bp, M. musculus
aaactgatttttttct

SEQ ID NO: 337989 - DNA, 16 bp, M. musculus
aaactgattttttttc

SEQ ID NO: 337990 - DNA, 17 bp, M. musculus
aaactgcaaagcttctg

SEQ ID NO: 337991 - DNA, 16 bp, M. musculus
aaactgcaagaggatt

SEQ ID NO: 337992 - DNA, 16 bp, M. musculus
aaactgcaagaggttt

SEQ ID NO: 337993 - DNA, 16 bp, M. musculus
aaactgcagaagcaga

SEQ ID NO: 337994 - DNA, 16 bp, M. musculus
aaactgcagaatgttt

SEQ ID NO: 337995 - DNA, 16 bp, M. musculus
aaactgcagggacaaa

SEQ ID NO: 337996 - DNA, 16 bp, M. musculus
aaactgcagtgtgtca

SEQ ID NO: 337997 - DNA, 16 bp, M. musculus
aaactgcatggtattt

SEQ ID NO: 337998 - DNA, 18 bp, M. musculus
aaactgcattaagaagaa

SEQ ID NO: 337999 - DNA, 16 bp, M. musculus
aaactgctgaggaagg

SEQ ID NO: 338000 - DNA, 16 bp, M. musculus
aaactgctggtcctcc

SEQ ID NO: 338001 - DNA, 16 bp, M. musculus
aaactgctgttcatca

SEQ ID NO: 338002 - DNA, 16 bp, M. musculus
aaactgcttttaaaaa

SEQ ID NO: 338003 - DNA, 16 bp, M. musculus
aaactgcttttatttt

SEQ ID NO: 338004 - DNA, 16 bp, M. musculus
aaactggaaaccacct

SEQ ID NO: 338005 - DNA, 16 bp, M. musculus
aaactggaaagcttct

SEQ ID NO: 338006 - DNA, 16 bp, M. musculus
aaactggaaagctttt

SEQ ID NO: 338007 - DNA, 16 bp, M. musculus
aaactggaagccagcc

SEQ ID NO: 338008 - DNA, 16 bp, M. musculus
aaactggacatggtgg

SEQ ID NO: 338009 - DNA, 16 bp, M. musculus
aaactggacccagcat

SEQ ID NO: 338010 - DNA, 16 bp, M. musculus
aaactggagaaagaaa

SEQ ID NO: 338011 - DNA, 16 bp, M. musculus
aaactggagctaggct

SEQ ID NO: 338012 - DNA, 16 bp, M. musculus
aaactggaggcaatcc

SEQ ID NO: 338013 - DNA, 16 bp, M. musculus
aaactggagtgggtgg

SEQ ID NO: 338014 - DNA, 16 bp, M. musculus
aaactggcagtttggg

SEQ ID NO: 338015 - DNA, 16 bp, M. musculus
aaactggccttgaact

SEQ ID NO: 338016 - DNA, 16 bp, M. musculus
aaactgggaaggaaga

SEQ ID NO: 338017 - DNA, 16 bp, M. musculus
aaactgggaggagtag

SEQ ID NO: 338018 - DNA, 16 bp, M. musculus
aaactgggtgtgtgtc

SEQ ID NO: 338019 - DNA, 16 bp, M. musculus
aaactggtacaagcac

SEQ ID NO: 338020 - DNA, 16 bp, M. musculus
aaactgtaaacaagct

SEQ ID NO: 338021 - DNA, 21 bp, M. musculus
aaactgtactttgacttgtgc

SEQ ID NO: 338022 - DNA, 16 bp, M. musculus
aaactgtatattttgt

SEQ ID NO: 338023 - DNA, 16 bp, M. musculus
aaactgtattttaaaa

SEQ ID NO: 338024 - DNA, 16 bp, M. musculus
aaactgtcaataagac

SEQ ID NO: 338025 - DNA, 16 bp, M. musculus
aaactgtcttataaga

SEQ ID NO: 338026 - DNA, 16 bp, M. musculus
aaactgtcttctaaat

SEQ ID NO: 338027 - DNA, 16 bp, M. musculus
aaactgtgagccagcc

SEQ ID NO: 338028 - DNA, 16 bp, M. musculus
aaactgtgagcccaaa

SEQ ID NO: 338029 - DNA, 16 bp, M. musculus
aaactgtggtctctgg

SEQ ID NO: 338030 - DNA, 16 bp, M. musculus
aaactgtgtttttaaa

SEQ ID NO: 338031 - DNA, 16 bp, M. musculus
aaactgttgctttgaa

SEQ ID NO: 338032 - DNA, 16 bp, M. musculus
aaactgttttccagac

SEQ ID NO: 338033 - DNA, 16 bp, M. musculus
aaactgttttctaaat

SEQ ID NO: 338034 - DNA, 16 bp, M. musculus
aaacttaaaagaagat

SEQ ID NO: 338035 - DNA, 16 bp, M. musculus
aaacttaaatcaaagg

SEQ ID NO: 338036 - DNA, 16 bp, M. musculus
aaacttactctgtaga

SEQ ID NO: 338037 - DNA, 16 bp, M. musculus
aaacttacttaaaaca

SEQ ID NO: 338038 - DNA, 16 bp, M. musculus
aaacttagaatattca

SEQ ID NO: 338039 - DNA, 16 bp, M. musculus
aaacttagagaggaga

SEQ ID NO: 338040 - DNA, 16 bp, M. musculus
aaacttaggtcctcat

SEQ ID NO: 338041 - DNA, 16 bp, M. musculus
aaacttatatcaaaga

SEQ ID NO: 338042 - DNA, 16 bp, M. musculus
aaacttcaaaagaaat

SEQ ID NO: 338043 - DNA, 16 bp, M. musculus
aaacttcaagaagcat

SEQ ID NO: 338044 - DNA, 16 bp, M. musculus
aaacttcaggtgacaa

SEQ ID NO: 338045 - DNA, 16 bp, M. musculus
aaacttcatcaaagaa

SEQ ID NO: 338046 - DNA, 17 bp, M. musculus
aaacttccaccagagaa

SEQ ID NO: 338047 - DNA, 16 bp, M. musculus
aaacttcctggaattt

SEQ ID NO: 338048 - DNA, 16 bp, M. musculus
aaacttcctggggcct

SEQ ID NO: 338049 - DNA, 16 bp, M. musculus
aaacttctagaagaaa

SEQ ID NO: 338050 - DNA, 16 bp, M. musculus
aaacttctatttcagt

SEQ ID NO: 338051 - DNA, 16 bp, M. musculus
aaacttctccagccca

SEQ ID NO: 338052 - DNA, 16 bp, M. musculus
aaacttctctttgaaa

SEQ ID NO: 338053 - DNA, 16 bp, M. musculus
aaacttctctttgtga

SEQ ID NO: 338054 - DNA, 16 bp, M. musculus
aaacttctgctcacac

SEQ ID NO: 338055 - DNA, 16 bp, M. musculus
aaacttcttttaaaaa

SEQ ID NO: 338056 - DNA, 17 bp, M. musculus
aaacttcttttgtcaat

SEQ ID NO: 338057 - DNA, 16 bp, M. musculus
aaacttctttttgcaa

SEQ ID NO: 338058 - DNA, 16 bp, M. musculus
aaacttgaggccagcc

SEQ ID NO: 338059 - DNA, 16 bp, M. musculus
aaacttgctatgtagc

SEQ ID NO: 338060 - DNA, 16 bp, M. musculus
aaacttgtgatcctcc

SEQ ID NO: 338061 - DNA, 16 bp, M. musculus
aaactttaaacatcct

SEQ ID NO: 338062 - DNA, 16 bp, M. musculus
aaactttataaaagtt

SEQ ID NO: 338063 - DNA, 16 bp, M. musculus
aaactttatttgtaaa

SEQ ID NO: 338064 - DNA, 16 bp, M. musculus
aaactttctagaattc

SEQ ID NO: 338065 - DNA, 16 bp, M. musculus
aaactttcttttatga

SEQ ID NO: 338066 - DNA, 16 bp, M. musculus
aaactttgaaagccag

SEQ ID NO: 338067 - DNA, 16 bp, M. musculus
aaactttgaaatattt

SEQ ID NO: 338068 - DNA, 16 bp, M. musculus
aaactttgaattttaa

SEQ ID NO: 338069 - DNA, 16 bp, M. musculus
aaactttgcttcctgg

SEQ ID NO: 338070 - DNA, 16 bp, M. musculus
aaactttgggttggaa

SEQ ID NO: 338071 - DNA, 16 bp, M. musculus
aaactttgtgtgtgtg

SEQ ID NO: 338072 - DNA, 16 bp, M. musculus
aaactttgtttaaaaa

SEQ ID NO: 338073 - DNA, 16 bp, M. musculus
aaacttttaaaatgtg

SEQ ID NO: 338074 - DNA, 16 bp, M. musculus
aaacttttctatggtt

SEQ ID NO: 338075 - DNA, 16 bp, M. musculus
aaacttttgtagtaaa

SEQ ID NO: 338076 - DNA, 16 bp, M. musculus
aaactttttaaaaaga

SEQ ID NO: 338077 - DNA, 16 bp, M. musculus
aaactttttaaagaaa

SEQ ID NO: 338078 - DNA, 16 bp, M. musculus
aaactttttcacaaaa

SEQ ID NO: 338079 - DNA, 16 bp, M. musculus
aaacttttttaaaaga

SEQ ID NO: 338080 - DNA, 16 bp, M. musculus
aaagaaaaaaaccctt

SEQ ID NO: 338081 - DNA, 16 bp, M. musculus
aaagaaaaacaatttc

SEQ ID NO: 338082 - DNA, 16 bp, M. musculus
aaagaaaaacatctca

SEQ ID NO: 338083 - DNA, 16 bp, M. musculus
aaagaaaaacattcat

SEQ ID NO: 338084 - DNA, 16 bp, M. musculus
aaagaaaaagaacttc

SEQ ID NO: 338085 - DNA, 16 bp, M. musculus
aaagaaaaagaggcta

SEQ ID NO: 338086 - DNA, 16 bp, M. musculus
aaagaaaaagcaagct

SEQ ID NO: 338087 - DNA, 16 bp, M. musculus
aaagaaaaatattctt

SEQ ID NO: 338088 - DNA, 16 bp, M. musculus
aaagaaaaatatttca

SEQ ID NO: 338089 - DNA, 16 bp, M. musculus
aaagaaaaatcatatt

SEQ ID NO: 338090 - DNA, 16 bp, M. musculus
aaagaaaaatcatttt

SEQ ID NO: 338091 - DNA, 16 bp, M. musculus
aaagaaaaatgcaatt

SEQ ID NO: 338092 - DNA, 16 bp, M. musculus
aaagaaaaatgtcaga

SEQ ID NO: 338093 - DNA, 16 bp, M. musculus
aaagaaaaatgtgtgt

SEQ ID NO: 338094 - DNA, 16 bp, M. musculus
aaagaaaacaaatctt

SEQ ID NO: 338095 - DNA, 16 bp, M. musculus
aaagaaaacaaatttt

SEQ ID NO: 338096 - DNA, 16 bp, M. musculus
aaagaaaacacattat

SEQ ID NO: 338097 - DNA, 16 bp, M. musculus
aaagaaaacaggctga

SEQ ID NO: 338098 - DNA, 16 bp, M. musculus
aaagaaaacatatttt

SEQ ID NO: 338099 - DNA, 16 bp, M. musculus
aaagaaaacattcttt

SEQ ID NO: 338100 - DNA, 16 bp, M. musculus
aaagaaaacatttatt

SEQ ID NO: 338101 - DNA, 16 bp, M. musculus
aaagaaaactatgttg

SEQ ID NO: 338102 - DNA, 16 bp, M. musculus
aaagaaaactcaaact

SEQ ID NO: 338103 - DNA, 16 bp, M. musculus
aaagaaaactcaaagc

SEQ ID NO: 338104 - DNA, 16 bp, M. musculus
aaagaaaactgagtcc

SEQ ID NO: 338105 - DNA, 16 bp, M. musculus
aaagaaaacttcagac

SEQ ID NO: 338106 - DNA, 16 bp, M. musculus
aaagaaaagaaacctt

SEQ ID NO: 338107 - DNA, 16 bp, M. musculus
aaagaaaagaaacttg

SEQ ID NO: 338108 - DNA, 16 bp, M. musculus
aaagaaaagaaacttt

SEQ ID NO: 338109 - DNA, 16 bp, M. musculus
aaagaaaagaaagctg

SEQ ID NO: 338110 - DNA, 16 bp, M. musculus
aaagaaaagaaaggct

SEQ ID NO: 338111 - DNA, 16 bp, M. musculus
aaagaaaagaatgctt

SEQ ID NO: 338112 - DNA, 16 bp, M. musculus
aaagaaaagacatttt

SEQ ID NO: 338113 - DNA, 16 bp, M. musculus
aaagaaaagaggccat

SEQ ID NO: 338114 - DNA, 16 bp, M. musculus
aaagaaaagcatttaa

SEQ ID NO: 338115 - DNA, 16 bp, M. musculus
aaagaaaagtagttgt

SEQ ID NO: 338116 - DNA, 16 bp, M. musculus
aaagaaaagtgacttt

SEQ ID NO: 338117 - DNA, 16 bp, M. musculus
aaagaaaagtttcttt

SEQ ID NO: 338118 - DNA, 16 bp, M. musculus
aaagaaaataaacctt

SEQ ID NO: 338119 - DNA, 16 bp, M. musculus
aaagaaaatacaattt

SEQ ID NO: 338120 - DNA, 16 bp, M. musculus
aaagaaaatatctaat

SEQ ID NO: 338121 - DNA, 16 bp, M. musculus
aaagaaaatatctact

SEQ ID NO: 338122 - DNA, 16 bp, M. musculus
aaagaaaatcagatgg

SEQ ID NO: 338123 - DNA, 16 bp, M. musculus
aaagaaaatcagttct

SEQ ID NO: 338124 - DNA, 16 bp, M. musculus
aaagaaaatccaaagt

SEQ ID NO: 338125 - DNA, 16 bp, M. musculus
aaagaaaatcctgcca

SEQ ID NO: 338126 - DNA, 16 bp, M. musculus
aaagaaaatcctttca

SEQ ID NO: 338127 - DNA, 16 bp, M. musculus
aaagaaaatctcaaca

SEQ ID NO: 338128 - DNA, 16 bp, M. musculus
aaagaaaatgaagcca

SEQ ID NO: 338129 - DNA, 16 bp, M. musculus
aaagaaaatgacttat

SEQ ID NO: 338130 - DNA, 16 bp, M. musculus
aaagaaaatgcataca

SEQ ID NO: 338131 - DNA, 16 bp, M. musculus
aaagaaaatgtggctc

SEQ ID NO: 338132 - DNA, 16 bp, M. musculus
aaagaaaattaacttt

SEQ ID NO: 338133 - DNA, 16 bp, M. musculus
aaagaaaattctagaa

SEQ ID NO: 338134 - DNA, 16 bp, M. musculus
aaagaaaattgactct

SEQ ID NO: 338135 - DNA, 16 bp, M. musculus
aaagaaaatttctaat

SEQ ID NO: 338136 - DNA, 16 bp, M. musculus
aaagaaaatttgtttt

SEQ ID NO: 338137 - DNA, 16 bp, M. musculus
aaagaaacaaactttt

SEQ ID NO: 338138 - DNA, 16 bp, M. musculus
aaagaaacaatatttt

SEQ ID NO: 338139 - DNA, 16 bp, M. musculus
aaagaaacaccatgac

SEQ ID NO: 338140 - DNA, 16 bp, M. musculus
aaagaaacactgtctt

SEQ ID NO: 338141 - DNA, 16 bp, M. musculus
aaagaaacagctcttg

SEQ ID NO: 338142 - DNA, 16 bp, M. musculus
aaagaaacatgagaat

SEQ ID NO: 338143 - DNA, 16 bp, M. musculus
aaagaaacatttcatt

SEQ ID NO: 338144 - DNA, 16 bp, M. musculus
aaagaaacattttctt

SEQ ID NO: 338145 - DNA, 16 bp, M. musculus
aaagaaacatttttct

SEQ ID NO: 338146 - DNA, 16 bp, M. musculus
aaagaaaccaaaactc

SEQ ID NO: 338147 - DNA, 16 bp, M. musculus
aaagaaaccaaaattc

SEQ ID NO: 338148 - DNA, 16 bp, M. musculus
aaagaaaccagaagtt

SEQ ID NO: 338149 - DNA, 16 bp, M. musculus
aaagaaaccctgtctt

SEQ ID NO: 338150 - DNA, 16 bp, M. musculus
aaagaaaccctttcct

SEQ ID NO: 338151 - DNA, 16 bp, M. musculus
aaagaaacctttcttt

SEQ ID NO: 338152 - DNA, 16 bp, M. musculus
aaagaaactacagaga

SEQ ID NO: 338153 - DNA, 16 bp, M. musculus
aaagaaactatccaat

SEQ ID NO: 338154 - DNA, 16 bp, M. musculus
aaagaaactcctccca

SEQ ID NO: 338155 - DNA, 16 bp, M. musculus
aaagaaactctgtctt

SEQ ID NO: 338156 - DNA, 16 bp, M. musculus
aaagaaactctttctt

SEQ ID NO: 338157 - DNA, 16 bp, M. musculus
aaagaaactgaaggaa

SEQ ID NO: 338158 - DNA, 16 bp, M. musculus
aaagaaactgagaaag

SEQ ID NO: 338159 - DNA, 16 bp, M. musculus
aaagaaactttacaaa

SEQ ID NO: 338160 - DNA, 16 bp, M. musculus
aaagaaactttactga

SEQ ID NO: 338161 - DNA, 16 bp, M. musculus
aaagaaacttttctaa

SEQ ID NO: 338162 - DNA, 16 bp, M. musculus
aaagaaagaaaattcc

SEQ ID NO: 338163 - DNA, 16 bp, M. musculus
aaagaaagaaacctca

SEQ ID NO: 338164 - DNA, 16 bp, M. musculus
aaagaaagaaacttct

SEQ ID NO: 338165 - DNA, 16 bp, M. musculus
aaagaaagaaagtcag

SEQ ID NO: 338166 - DNA, 16 bp, M. musculus
aaagaaagaaatgatc

SEQ ID NO: 338167 - DNA, 16 bp, M. musculus
aaagaaagaaatggca

SEQ ID NO: 338168 - DNA, 16 bp, M. musculus
aaagaaagaacacact

SEQ ID NO: 338169 - DNA, 16 bp, M. musculus
aaagaaagaactgaag

SEQ ID NO: 338170 - DNA, 16 bp, M. musculus
aaagaaagaagagttt

SEQ ID NO: 338171 - DNA, 16 bp, M. musculus
aaagaaagaattctaa

SEQ ID NO: 338172 - DNA, 16 bp, M. musculus
aaagaaagaatttcaa

SEQ ID NO: 338173 - DNA, 16 bp, M. musculus
aaagaaagacatttta

SEQ ID NO: 338174 - DNA, 16 bp, M. musculus
aaagaaagacttttta

SEQ ID NO: 338175 - DNA, 16 bp, M. musculus
aaagaaagagaacgtc

SEQ ID NO: 338176 - DNA, 16 bp, M. musculus
aaagaaagagatgctg

SEQ ID NO: 338177 - DNA, 16 bp, M. musculus
aaagaaagagtacttc

SEQ ID NO: 338178 - DNA, 16 bp, M. musculus
aaagaaagatattttt

SEQ ID NO: 338179 - DNA, 16 bp, M. musculus
aaagaaagattatttt

SEQ ID NO: 338180 - DNA, 16 bp, M. musculus
aaagaaagatttattt

SEQ ID NO: 338181 - DNA, 16 bp, M. musculus
aaagaaagatttgata

SEQ ID NO: 338182 - DNA, 16 bp, M. musculus
aaagaaagattttatt

SEQ ID NO: 338183 - DNA, 16 bp, M. musculus
aaagaaagcaaaattt

SEQ ID NO: 338184 - DNA, 16 bp, M. musculus
aaagaaagcaaagatg

SEQ ID NO: 338185 - DNA, 16 bp, M. musculus
aaagaaagcatattaa

SEQ ID NO: 338186 - DNA, 16 bp, M. musculus
aaagaaagcattaaat

SEQ ID NO: 338187 - DNA, 16 bp, M. musculus
aaagaaagccaacatt

SEQ ID NO: 338188 - DNA, 16 bp, M. musculus
aaagaaagccatgggc

SEQ ID NO: 338189 - DNA, 16 bp, M. musculus
aaagaaagcccaggac

SEQ ID NO: 338190 - DNA, 16 bp, M. musculus
aaagaaaggatacagg

SEQ ID NO: 338191 - DNA, 16 bp, M. musculus
aaagaaaggctggaaa

SEQ ID NO: 338192 - DNA, 16 bp, M. musculus
aaagaaagtcaccctg

SEQ ID NO: 338193 - DNA, 16 bp, M. musculus
aaagaaagtgtttatt

SEQ ID NO: 338194 - DNA, 16 bp, M. musculus
aaagaaataaaatctt

SEQ ID NO: 338195 - DNA, 16 bp, M. musculus
aaagaaataaagttgt

SEQ ID NO: 338196 - DNA, 16 bp, M. musculus
aaagaaataattctga

SEQ ID NO: 338197 - DNA, 16 bp, M. musculus
aaagaaatacagagac

SEQ ID NO: 338198 - DNA, 23 bp, M. musculus
aaagaaatacaggagaacactgg

SEQ ID NO: 338199 - DNA, 16 bp, M. musculus
aaagaaatatccaata

SEQ ID NO: 338200 - DNA, 16 bp, M. musculus
aaagaaatatgatttt

SEQ ID NO: 338201 - DNA, 17 bp, M. musculus
aaagaaatcaaagatct

SEQ ID NO: 338202 - DNA, 16 bp, M. musculus
aaagaaatcaaagatg

SEQ ID NO: 338203 - DNA, 16 bp, M. musculus
aaagaaatcaagaagc

SEQ ID NO: 338204 - DNA, 16 bp, M. musculus
aaagaaatcaagaagt

SEQ ID NO: 338205 - DNA, 16 bp, M. musculus
aaagaaatcacagagg

SEQ ID NO: 338206 - DNA, 16 bp, M. musculus
aaagaaatcacaggag

SEQ ID NO: 338207 - DNA, 16 bp, M. musculus
aaagaaatcagaaatg

SEQ ID NO: 338208 - DNA, 16 bp, M. musculus
aaagaaatcagaagcc

SEQ ID NO: 338209 - DNA, 16 bp, M. musculus
aaagaaatcaggagcc

SEQ ID NO: 338210 - DNA, 16 bp, M. musculus
aaagaaatcgaagcag

SEQ ID NO: 338211 - DNA, 16 bp, M. musculus
aaagaaatctagaacc

SEQ ID NO: 338212 - DNA, 16 bp, M. musculus
aaagaaatctttgaaa

SEQ ID NO: 338213 - DNA, 16 bp, M. musculus
aaagaaatgaaaactt

SEQ ID NO: 338214 - DNA, 16 bp, M. musculus
aaagaaatgaaagact

SEQ ID NO: 338215 - DNA, 16 bp, M. musculus
aaagaaatgaaagcag

SEQ ID NO: 338216 - DNA, 21 bp, M. musculus
aaagaaatgcagctaagacag

SEQ ID NO: 338217 - DNA, 16 bp, M. musculus
aaagaaatgtatttta

SEQ ID NO: 338218 - DNA, 16 bp, M. musculus
aaagaaatgtcagaaa

SEQ ID NO: 338219 - DNA, 16 bp, M. musculus
aaagaaatgtcttttt

SEQ ID NO: 338220 - DNA, 16 bp, M. musculus
aaagaaatgtgatttt

SEQ ID NO: 338221 - DNA, 16 bp, M. musculus
aaagaaatgttcaaaa

SEQ ID NO: 338222 - DNA, 16 bp, M. musculus
aaagaaatgtttaatg

SEQ ID NO: 338223 - DNA, 16 bp, M. musculus
aaagaaattaaagatc

SEQ ID NO: 338224 - DNA, 16 bp, M. musculus
aaagaaattaaaggct

SEQ ID NO: 338225 - DNA, 16 bp, M. musculus
aaagaaattagattca

SEQ ID NO: 338226 - DNA, 16 bp, M. musculus
aaagaaattcctccag

SEQ ID NO: 338227 - DNA, 16 bp, M. musculus
aaagaaattcctcctt

SEQ ID NO: 338228 - DNA, 16 bp, M. musculus
aaagaaattccttctg

SEQ ID NO: 338229 - DNA, 16 bp, M. musculus
aaagaaattgaagaac

SEQ ID NO: 338230 - DNA, 16 bp, M. musculus
aaagaaattgaagatt

SEQ ID NO: 338231 - DNA, 16 bp, M. musculus
aaagaaattgcagaag

SEQ ID NO: 338232 - DNA, 16 bp, M. musculus
aaagaaattgttaaga

SEQ ID NO: 338233 - DNA, 16 bp, M. musculus
aaagaaatttctcttt

SEQ ID NO: 338234 - DNA, 16 bp, M. musculus
aaagaacaatttccaa

SEQ ID NO: 338235 - DNA, 16 bp, M. musculus
aaagaacacaaatgat

SEQ ID NO: 338236 - DNA, 16 bp, M. musculus
aaagaacacacatgga

SEQ ID NO: 338237 - DNA, 16 bp, M. musculus
aaagaacacattgcac

SEQ ID NO: 338238 - DNA, 16 bp, M. musculus
aaagaacatacatgat

SEQ ID NO: 338239 - DNA, 16 bp, M. musculus
aaagaacattaaaagc

SEQ ID NO: 338240 - DNA, 16 bp, M. musculus
aaagaacatttgcaag

SEQ ID NO: 338241 - DNA, 16 bp, M. musculus
aaagaacattttaaaa

SEQ ID NO: 338242 - DNA, 17 bp, M. musculus
aaagaaccaaatgaagc

SEQ ID NO: 338243 - DNA, 16 bp, M. musculus
aaagaaccacctcctg

SEQ ID NO: 338244 - DNA, 16 bp, M. musculus
aaagaaccagctccta

SEQ ID NO: 338245 - DNA, 16 bp, M. musculus
aaagaacccagaggtc

SEQ ID NO: 338246 - DNA, 16 bp, M. musculus
aaagaacctttttaaa

SEQ ID NO: 338247 - DNA, 16 bp, M. musculus
aaagaactcaagaaag

SEQ ID NO: 338248 - DNA, 16 bp, M. musculus
aaagaactcaagaatg

SEQ ID NO: 338249 - DNA, 16 bp, M. musculus
aaagaactcaagatgg

SEQ ID NO: 338250 - DNA, 16 bp, M. musculus
aaagaactcaaggaat

SEQ ID NO: 338251 - DNA, 16 bp, M. musculus
aaagaactccatgctg

SEQ ID NO: 338252 - DNA, 16 bp, M. musculus
aaagaactctcagctc

SEQ ID NO: 338253 - DNA, 16 bp, M. musculus
aaagaactgaagggga

SEQ ID NO: 338254 - DNA, 16 bp, M. musculus
aaagaactgcaggaac

SEQ ID NO: 338255 - DNA, 16 bp, M. musculus
aaagaacttcagggac

SEQ ID NO: 338256 - DNA, 16 bp, M. musculus
aaagaacttttctaaa

SEQ ID NO: 338257 - DNA, 16 bp, M. musculus
aaagaagaaaatgtca

SEQ ID NO: 338258 - DNA, 16 bp, M. musculus
aaagaagaaacattta

SEQ ID NO: 338259 - DNA, 16 bp, M. musculus
aaagaagaaactgagg

SEQ ID NO: 338260 - DNA, 16 bp, M. musculus
aaagaagaaagcaagt

SEQ ID NO: 338261 - DNA, 16 bp, M. musculus
aaagaagaaagcatct

SEQ ID NO: 338262 - DNA, 16 bp, M. musculus
aaagaagaaaggattt

SEQ ID NO: 338263 - DNA, 16 bp, M. musculus
aaagaagaaatcaagg

SEQ ID NO: 338264 - DNA, 16 bp, M. musculus
aaagaagaagctgtaa

SEQ ID NO: 338265 - DNA, 16 bp, M. musculus
aaagaagaaggcccaa

SEQ ID NO: 338266 - DNA, 16 bp, M. musculus
aaagaagaagtcaaag

SEQ ID NO: 338267 - DNA, 16 bp, M. musculus
aaagaagaagtcaagg

SEQ ID NO: 338268 - DNA, 16 bp, M. musculus
aaagaagaatgaaatc

SEQ ID NO: 338269 - DNA, 16 bp, M. musculus
aaagaagaattaatgc

SEQ ID NO: 338270 - DNA, 16 bp, M. musculus
aaagaagacagcagca

SEQ ID NO: 338271 - DNA, 16 bp, M. musculus
aaagaagacagccaga

SEQ ID NO: 338272 - DNA, 16 bp, M. musculus
aaagaagacatggaaa

SEQ ID NO: 338273 - DNA, 16 bp, M. musculus
aaagaagaccaaagtg

SEQ ID NO: 338274 - DNA, 16 bp, M. musculus
aaagaagactcagaga

SEQ ID NO: 338275 - DNA, 16 bp, M. musculus
aaagaagactctcaga

SEQ ID NO: 338276 - DNA, 16 bp, M. musculus
aaagaagacttctctg

SEQ ID NO: 338277 - DNA, 16 bp, M. musculus
aaagaagagctcagaa

SEQ ID NO: 338278 - DNA, 16 bp, M. musculus
aaagaagagtgagtct

SEQ ID NO: 338279 - DNA, 16 bp, M. musculus
aaagaagataacattt

SEQ ID NO: 338280 - DNA, 16 bp, M. musculus
aaagaagataactaca

SEQ ID NO: 338281 - DNA, 16 bp, M. musculus
aaagaagatagtcaca

SEQ ID NO: 338282 - DNA, 16 bp, M. musculus
aaagaagatcaaagtg

SEQ ID NO: 338283 - DNA, 16 bp, M. musculus
aaagaagatcaaattc

SEQ ID NO: 338284 - DNA, 16 bp, M. musculus
aaagaagatcacagaa

SEQ ID NO: 338285 - DNA, 16 bp, M. musculus
aaagaagatctcagga

SEQ ID NO: 338286 - DNA, 16 bp, M. musculus
aaagaagatcttagaa

SEQ ID NO: 338287 - DNA, 16 bp, M. musculus
aaagaagattgctttc

SEQ ID NO: 338288 - DNA, 16 bp, M. musculus
aaagaagattttattt

SEQ ID NO: 338289 - DNA, 16 bp, M. musculus
aaagaagcaaatttac

SEQ ID NO: 338290 - DNA, 16 bp, M. musculus
aaagaagcagaggcag

SEQ ID NO: 338291 - DNA, 16 bp, M. musculus
aaagaagcagcagagg

SEQ ID NO: 338292 - DNA, 16 bp, M. musculus
aaagaagcagcagcag

SEQ ID NO: 338293 - DNA, 16 bp, M. musculus
aaagaagccaaaagta

SEQ ID NO: 338294 - DNA, 16 bp, M. musculus
aaagaagccaaaatca

SEQ ID NO: 338295 - DNA, 16 bp, M. musculus
aaagaagccataaata

SEQ ID NO: 338296 - DNA, 17 bp, M. musculus
aaagaagcccaggacca

SEQ ID NO: 338297 - DNA, 16 bp, M. musculus
aaagaagccctgaggg

SEQ ID NO: 338298 - DNA, 16 bp, M. musculus
aaagaagctggagaga

SEQ ID NO: 338299 - DNA, 16 bp, M. musculus
aaagaagctgtgttct

SEQ ID NO: 338300 - DNA, 16 bp, M. musculus
aaagaagcttcctcct

SEQ ID NO: 338301 - DNA, 16 bp, M. musculus
aaagaagctttgcagt

SEQ ID NO: 338302 - DNA, 16 bp, M. musculus
aaagaagctttttttt

SEQ ID NO: 338303 - DNA, 16 bp, M. musculus
aaagaaggaaatacac

SEQ ID NO: 338304 - DNA, 16 bp, M. musculus
aaagaaggaggggttt

SEQ ID NO: 338305 - DNA, 16 bp, M. musculus
aaagaaggccaaagtg

SEQ ID NO: 338306 - DNA, 19 bp, M. musculus
aaagaagggcagtgaaact

SEQ ID NO: 338307 - DNA, 16 bp, M. musculus
aaagaagtacaggaga

SEQ ID NO: 338308 - DNA, 16 bp, M. musculus
aaagaagtatggacaa

SEQ ID NO: 338309 - DNA, 16 bp, M. musculus
aaagaagtcaaagaag

SEQ ID NO: 338310 - DNA, 16 bp, M. musculus
aaagaagtgttcaaag

SEQ ID NO: 338311 - DNA, 16 bp, M. musculus
aaagaagttggagatc

SEQ ID NO: 338312 - DNA, 16 bp, M. musculus
aaagaagttttaatac

SEQ ID NO: 338313 - DNA, 16 bp, M. musculus
aaagaataaagaggct

SEQ ID NO: 338314 - DNA, 16 bp, M. musculus
aaagaataaatttcat

SEQ ID NO: 338315 - DNA, 16 bp, M. musculus
aaagaataattttcaa

SEQ ID NO: 338316 - DNA, 16 bp, M. musculus
aaagaatacagccaca

SEQ ID NO: 338317 - DNA, 16 bp, M. musculus
aaagaatagatacaga

SEQ ID NO: 338318 - DNA, 16 bp, M. musculus
aaagaatagctgtgga

SEQ ID NO: 338319 - DNA, 16 bp, M. musculus
aaagaatataaacagg

SEQ ID NO: 338320 - DNA, 16 bp, M. musculus
aaagaatatacattct

SEQ ID NO: 338321 - DNA, 16 bp, M. musculus
aaagaatatactttct

SEQ ID NO: 338322 - DNA, 16 bp, M. musculus
aaagaatatccaaatt

SEQ ID NO: 338323 - DNA, 16 bp, M. musculus
aaagaatatgatcaaa

SEQ ID NO: 338324 - DNA, 16 bp, M. musculus
aaagaatcacaaatct

SEQ ID NO: 338325 - DNA, 16 bp, M. musculus
aaagaatcacaggaaa

SEQ ID NO: 338326 - DNA, 16 bp, M. musculus
aaagaatcagagacac

SEQ ID NO: 338327 - DNA, 16 bp, M. musculus
aaagaatcctcacctg

SEQ ID NO: 338328 - DNA, 16 bp, M. musculus
aaagaatctaaagaat

SEQ ID NO: 338329 - DNA, 16 bp, M. musculus
aaagaatctggagaga

SEQ ID NO: 338330 - DNA, 16 bp, M. musculus
aaagaatctttactaa

SEQ ID NO: 338331 - DNA, 16 bp, M. musculus
aaagaatcttttaaaa

SEQ ID NO: 338332 - DNA, 19 bp, M. musculus
aaagaatgaacagaccaaa

SEQ ID NO: 338333 - DNA, 16 bp, M. musculus
aaagaatgaagatcaa

SEQ ID NO: 338334 - DNA, 16 bp, M. musculus
aaagaatgaagccaag

SEQ ID NO: 338335 - DNA, 16 bp, M. musculus
aaagaatgaatttatt

SEQ ID NO: 338336 - DNA, 16 bp, M. musculus
aaagaatgactttatg

SEQ ID NO: 338337 - DNA, 16 bp, M. musculus
aaagaatgcaatgaaa

SEQ ID NO: 338338 - DNA, 16 bp, M. musculus
aaagaatggatttttt

SEQ ID NO: 338339 - DNA, 16 bp, M. musculus
aaagaatgggctggga

SEQ ID NO: 338340 - DNA, 16 bp, M. musculus
aaagaatgttctagag

SEQ ID NO: 338341 - DNA, 16 bp, M. musculus
aaagaatgttgtttca

SEQ ID NO: 338342 - DNA, 16 bp, M. musculus
aaagaatgttttgcta

SEQ ID NO: 338343 - DNA, 16 bp, M. musculus
aaagaatgttttgttt

SEQ ID NO: 338344 - DNA, 16 bp, M. musculus
aaagaattaaaaggca

SEQ ID NO: 338345 - DNA, 16 bp, M. musculus
aaagaattacatattt

SEQ ID NO: 338346 - DNA, 16 bp, M. musculus
aaagaattacatggat

SEQ ID NO: 338347 - DNA, 16 bp, M. musculus
aaagaattactggaaa

SEQ ID NO: 338348 - DNA, 16 bp, M. musculus
aaagaattatttttct

SEQ ID NO: 338349 - DNA, 16 bp, M. musculus
aaagaattcagagaaa

SEQ ID NO: 338350 - DNA, 16 bp, M. musculus
aaagaattccaggaaa

SEQ ID NO: 338351 - DNA, 16 bp, M. musculus
aaagaattgctcaact

SEQ ID NO: 338352 - DNA, 16 bp, M. musculus
aaagaattggcttttt

SEQ ID NO: 338353 - DNA, 16 bp, M. musculus
aaagaattgttaatat

SEQ ID NO: 338354 - DNA, 16 bp, M. musculus
aaagaatttcaaaaat

SEQ ID NO: 338355 - DNA, 16 bp, M. musculus
aaagaatttcaggaaa

SEQ ID NO: 338356 - DNA, 16 bp, M. musculus
aaagaatttgaagaag

SEQ ID NO: 338357 - DNA, 16 bp, M. musculus
aaagaatttggatttt

SEQ ID NO: 338358 - DNA, 16 bp, M. musculus
aaagaattttcttttt

SEQ ID NO: 338359 - DNA, 16 bp, M. musculus
aaagaattttggaaaa

SEQ ID NO: 338360 - DNA, 16 bp, M. musculus
aaagaatttttttctt

SEQ ID NO: 338361 - DNA, 16 bp, M. musculus
aaagacaaatatatat

SEQ ID NO: 338362 - DNA, 16 bp, M. musculus
aaagacaaatatgata

SEQ ID NO: 338363 - DNA, 16 bp, M. musculus
aaagacaaatgaaatt

SEQ ID NO: 338364 - DNA, 16 bp, M. musculus
aaagacaagcatggta

SEQ ID NO: 338365 - DNA, 16 bp, M. musculus
aaagacaaggagggca

SEQ ID NO: 338366 - DNA, 17 bp, M. musculus
aaagacaaggaggtaca

SEQ ID NO: 338367 - DNA, 16 bp, M. musculus
aaagacaaggtattgt

SEQ ID NO: 338368 - DNA, 16 bp, M. musculus
aaagacaagtaggggc

SEQ ID NO: 338369 - DNA, 16 bp, M. musculus
aaagacaagttaaaat

SEQ ID NO: 338370 - DNA, 16 bp, M. musculus
aaagacaatctacaga

SEQ ID NO: 338371 - DNA, 16 bp, M. musculus
aaagacaatctcagaa

SEQ ID NO: 338372 - DNA, 16 bp, M. musculus
aaagacacacagagag

SEQ ID NO: 338373 - DNA, 16 bp, M. musculus
aaagacacagagagac

SEQ ID NO: 338374 - DNA, 16 bp, M. musculus
aaagacacagagagat

SEQ ID NO: 338375 - DNA, 16 bp, M. musculus
aaagacaccctgtctc

SEQ ID NO: 338376 - DNA, 16 bp, M. musculus
aaagacactgagaaaa

SEQ ID NO: 338377 - DNA, 16 bp, M. musculus
aaagacactgtctcaa

SEQ ID NO: 338378 - DNA, 16 bp, M. musculus
aaagacacttgctgtc

SEQ ID NO: 338379 - DNA, 16 bp, M. musculus
aaagacagaaatcaca

SEQ ID NO: 338380 - DNA, 16 bp, M. musculus
aaagacagaaccaggt

SEQ ID NO: 338381 - DNA, 16 bp, M. musculus
aaagacagactgacag

SEQ ID NO: 338382 - DNA, 16 bp, M. musculus
aaagacagagagatga

SEQ ID NO: 338383 - DNA, 16 bp, M. musculus
aaagacagcattttta

SEQ ID NO: 338384 - DNA, 16 bp, M. musculus
aaagacagcatttttc

SEQ ID NO: 338385 - DNA, 16 bp, M. musculus
aaagacagttgtgagc

SEQ ID NO: 338386 - DNA, 16 bp, M. musculus
aaagacatcattcaaa

SEQ ID NO: 338387 - DNA, 16 bp, M. musculus
aaagacatgaacaaat

SEQ ID NO: 338388 - DNA, 16 bp, M. musculus
aaagacatgcaccact

SEQ ID NO: 338389 - DNA, 16 bp, M. musculus
aaagacatggaagaaa

SEQ ID NO: 338390 - DNA, 16 bp, M. musculus
aaagacattaaagaag

SEQ ID NO: 338391 - DNA, 16 bp, M. musculus
aaagacattgaacatt

SEQ ID NO: 338392 - DNA, 16 bp, M. musculus
aaagacatttgaaaat

SEQ ID NO: 338393 - DNA, 16 bp, M. musculus
aaagacattttaaaat

SEQ ID NO: 338394 - DNA, 16 bp, M. musculus
aaagacattttaaata

SEQ ID NO: 338395 - DNA, 16 bp, M. musculus
aaagacattttattat

SEQ ID NO: 338396 - DNA, 16 bp, M. musculus
aaagacattttggaaa

SEQ ID NO: 338397 - DNA, 16 bp, M. musculus
aaagacatttttaaaa

SEQ ID NO: 338398 - DNA, 16 bp, M. musculus
aaagacattttttctt

SEQ ID NO: 338399 - DNA, 16 bp, M. musculus
aaagaccagcaaagag

SEQ ID NO: 338400 - DNA, 16 bp, M. musculus
aaagaccaggaattca

SEQ ID NO: 338401 - DNA, 16 bp, M. musculus
aaagaccatccagaga

SEQ ID NO: 338402 - DNA, 16 bp, M. musculus
aaagaccatgaccaaa

SEQ ID NO: 338403 - DNA, 16 bp, M. musculus
aaagacccagaaaata

SEQ ID NO: 338404 - DNA, 16 bp, M. musculus
aaagaccccaccatca

SEQ ID NO: 338405 - DNA, 16 bp, M. musculus
aaagaccctgctgtga

SEQ ID NO: 338406 - DNA, 16 bp, M. musculus
aaagacctaacaagca

SEQ ID NO: 338407 - DNA, 16 bp, M. musculus
aaagaccttaaaacca

SEQ ID NO: 338408 - DNA, 16 bp, M. musculus
aaagaccttaaagagg

SEQ ID NO: 338409 - DNA, 16 bp, M. musculus
aaagaccttgtctcaa

SEQ ID NO: 338410 - DNA, 16 bp, M. musculus
aaagactaaaattcct

SEQ ID NO: 338411 - DNA, 16 bp, M. musculus
aaagactcagatgaag

SEQ ID NO: 338412 - DNA, 16 bp, M. musculus
aaagactcagatgcag

SEQ ID NO: 338413 - DNA, 16 bp, M. musculus
aaagactctgagagga

SEQ ID NO: 338414 - DNA, 16 bp, M. musculus
aaagactgaaggaact

SEQ ID NO: 338415 - DNA, 16 bp, M. musculus
aaagactggataaaaa

SEQ ID NO: 338416 - DNA, 16 bp, M. musculus
aaagactggcagaaac

SEQ ID NO: 338417 - DNA, 16 bp, M. musculus
aaagactgtgagactt

SEQ ID NO: 338418 - DNA, 16 bp, M. musculus
aaagactgtgtctcaa

SEQ ID NO: 338419 - DNA, 16 bp, M. musculus
aaagacttccaatgga

SEQ ID NO: 338420 - DNA, 16 bp, M. musculus
aaagacttgaaatttt

SEQ ID NO: 338421 - DNA, 16 bp, M. musculus
aaagactttattttta

SEQ ID NO: 338422 - DNA, 16 bp, M. musculus
aaagactttggatttt

SEQ ID NO: 338423 - DNA, 16 bp, M. musculus
aaagactttttaaaaa

SEQ ID NO: 338424 - DNA, 16 bp, M. musculus
aaagactttttaaagt

SEQ ID NO: 338425 - DNA, 16 bp, M. musculus
aaagagaaaatcaatt

SEQ ID NO: 338426 - DNA, 16 bp, M. musculus
aaagagaaacatggaa

SEQ ID NO: 338427 - DNA, 16 bp, M. musculus
aaagagaaactagaga

SEQ ID NO: 338428 - DNA, 16 bp, M. musculus
aaagagaaaggctgct

SEQ ID NO: 338429 - DNA, 16 bp, M. musculus
aaagagaacaagaact

SEQ ID NO: 338430 - DNA, 16 bp, M. musculus
aaagagaactgactct

SEQ ID NO: 338431 - DNA, 16 bp, M. musculus
aaagagaacttcagac

SEQ ID NO: 338432 - DNA, 16 bp, M. musculus
aaagagaagaaattca

SEQ ID NO: 338433 - DNA, 16 bp, M. musculus
aaagagaagcttctct

SEQ ID NO: 338434 - DNA, 16 bp, M. musculus
aaagagaagtttcctt

SEQ ID NO: 338435 - DNA, 16 bp, M. musculus
aaagagaatatatttt

SEQ ID NO: 338436 - DNA, 16 bp, M. musculus
aaagagacaaaatttg

SEQ ID NO: 338437 - DNA, 16 bp, M. musculus
aaagagacaggcagag

SEQ ID NO: 338438 - DNA, 16 bp, M. musculus
aaagagactggagaga

SEQ ID NO: 338439 - DNA, 16 bp, M. musculus
aaagagagaagagact

SEQ ID NO: 338440 - DNA, 16 bp, M. musculus
aaagagagacatagaa

SEQ ID NO: 338441 - DNA, 16 bp, M. musculus
aaagagagcacgtgga

SEQ ID NO: 338442 - DNA, 16 bp, M. musculus
aaagagagcttcagac

SEQ ID NO: 338443 - DNA, 16 bp, M. musculus
aaagagaggcccactg

SEQ ID NO: 338444 - DNA, 16 bp, M. musculus
aaagagaggctggaga

SEQ ID NO: 338445 - DNA, 16 bp, M. musculus
aaagagaggggaacta

SEQ ID NO: 338446 - DNA, 16 bp, M. musculus
aaagagatacagagag

SEQ ID NO: 338447 - DNA, 16 bp, M. musculus
aaagagatcaggagta

SEQ ID NO: 338448 - DNA, 16 bp, M. musculus
aaagagatctacaacc

SEQ ID NO: 338449 - DNA, 16 bp, M. musculus
aaagagatctgcctgc

SEQ ID NO: 338450 - DNA, 16 bp, M. musculus
aaagagatcttgtctc

SEQ ID NO: 338451 - DNA, 16 bp, M. musculus
aaagagatgaccataa

SEQ ID NO: 338452 - DNA, 16 bp, M. musculus
aaagagatgatcatgt

SEQ ID NO: 338453 - DNA, 16 bp, M. musculus
aaagagatgcagagat

SEQ ID NO: 338454 - DNA, 29 bp, M. musculus
aaagagatgcccatgatcatacaagaagc

SEQ ID NO: 338455 - DNA, 16 bp, M. musculus
aaagagattttatttt

SEQ ID NO: 338456 - DNA, 16 bp, M. musculus
aaagagattttgtttt

SEQ ID NO: 338457 - DNA, 16 bp, M. musculus
aaagagcaatttgaaa

SEQ ID NO: 338458 - DNA, 17 bp, M. musculus
aaagagcactgactgct

SEQ ID NO: 338459 - DNA, 16 bp, M. musculus
aaagagcagctgaggc

SEQ ID NO: 338460 - DNA, 16 bp, M. musculus
aaagagcaggcctcca

SEQ ID NO: 338461 - DNA, 16 bp, M. musculus
aaagagcaggcttcca

SEQ ID NO: 338462 - DNA, 16 bp, M. musculus
aaagagcaggtctcca

SEQ ID NO: 338463 - DNA, 16 bp, M. musculus
aaagagcatcagatct

SEQ ID NO: 338464 - DNA, 16 bp, M. musculus
aaagagccagatgcag

SEQ ID NO: 338465 - DNA, 16 bp, M. musculus
aaagagccaggcagtg

SEQ ID NO: 338466 - DNA, 16 bp, M. musculus
aaagagctacagacaa

SEQ ID NO: 338467 - DNA, 16 bp, M. musculus
aaagagctacaggcaa

SEQ ID NO: 338468 - DNA, 40 bp, M. musculus
aaagagctagcagagtcagtaaggacctatggagttaatg

SEQ ID NO: 338469 - DNA, 16 bp, M. musculus
aaagagctgtgtctaa

SEQ ID NO: 338470 - DNA, 16 bp, M. musculus
aaagagcttcctgaag

SEQ ID NO: 338471 - DNA, 16 bp, M. musculus
aaagagctttttgtat

SEQ ID NO: 338472 - DNA, 16 bp, M. musculus
aaagaggaaaacattt

SEQ ID NO: 338473 - DNA, 16 bp, M. musculus
aaagaggaaactgagg

SEQ ID NO: 338474 - DNA, 16 bp, M. musculus
aaagaggaaatgaatt

SEQ ID NO: 338475 - DNA, 16 bp, M. musculus
aaagaggaagcaaata

SEQ ID NO: 338476 - DNA, 16 bp, M. musculus
aaagaggaatcaggga

SEQ ID NO: 338477 - DNA, 16 bp, M. musculus
aaagaggagctggaga

SEQ ID NO: 338478 - DNA, 16 bp, M. musculus
aaagaggagttagaga

SEQ ID NO: 338479 - DNA, 16 bp, M. musculus
aaagaggcaacctcag

SEQ ID NO: 338480 - DNA, 16 bp, M. musculus
aaagaggcagactcca

SEQ ID NO: 338481 - DNA, 16 bp, M. musculus
aaagagggacatggaa

SEQ ID NO: 338482 - DNA, 16 bp, M. musculus
aaagagggagtcagat

SEQ ID NO: 338483 - DNA, 16 bp, M. musculus
aaagagggcatcagat

SEQ ID NO: 338484 - DNA, 16 bp, M. musculus
aaagaggtcaggagtt

SEQ ID NO: 338485 - DNA, 16 bp, M. musculus
aaagaggtccagtgac

SEQ ID NO: 338486 - DNA, 16 bp, M. musculus
aaagaggtggatgctc

SEQ ID NO: 338487 - DNA, 16 bp, M. musculus
aaagaggtttttaaaa

SEQ ID NO: 338488 - DNA, 16 bp, M. musculus
aaagagtcaaagacag

SEQ ID NO: 338489 - DNA, 24 bp, M. musculus
aaagagtcaagaatttctgatgat

SEQ ID NO: 338490 - DNA, 16 bp, M. musculus
aaagagtcagatgcaa

SEQ ID NO: 338491 - DNA, 16 bp, M. musculus
aaagagtcagatggag

SEQ ID NO: 338492 - DNA, 16 bp, M. musculus
aaagagtcccaaaagc

SEQ ID NO: 338493 - DNA, 16 bp, M. musculus
aaagagtctttaattt

SEQ ID NO: 338494 - DNA, 16 bp, M. musculus
aaagagttacaggaaa

SEQ ID NO: 338495 - DNA, 16 bp, M. musculus
aaagagtttattttta

SEQ ID NO: 338496 - DNA, 16 bp, M. musculus
aaagagtttcaaggaa

SEQ ID NO: 338497 - DNA, 16 bp, M. musculus
aaagagtttcatggaa

SEQ ID NO: 338498 - DNA, 16 bp, M. musculus
aaagagttttgatgta

SEQ ID NO: 338499 - DNA, 16 bp, M. musculus
aaagataaagcagaga

SEQ ID NO: 338500 - DNA, 16 bp, M. musculus
aaagataaatctttaa

SEQ ID NO: 338501 - DNA, 16 bp, M. musculus
aaagatacaaaggcag

SEQ ID NO: 338502 - DNA, 16 bp, M. musculus
aaagatacttcaaaat

SEQ ID NO: 338503 - DNA, 16 bp, M. musculus
aaagatactttaaaat

SEQ ID NO: 338504 - DNA, 16 bp, M. musculus
aaagatactttttttt

SEQ ID NO: 338505 - DNA, 16 bp, M. musculus
aaagatatatttcttt

SEQ ID NO: 338506 - DNA, 70 bp, M. musculus
aaagatatgggaaccggtttgtcaggacccaggaagcagtcagagaggcgacccaggaagacccacaagg

SEQ ID NO: 338507 - DNA, 16 bp, M. musculus
aaagatattgaaattg

SEQ ID NO: 338508 - DNA, 16 bp, M. musculus
aaagatcaagagttca

SEQ ID NO: 338509 - DNA, 16 bp, M. musculus
aaagatcaagtgtcca

SEQ ID NO: 338510 - DNA, 16 bp, M. musculus
aaagatcatttaaaaa

SEQ ID NO: 338511 - DNA, 16 bp, M. musculus
aaagatccatctgcct

SEQ ID NO: 338512 - DNA, 16 bp, M. musculus
aaagatcctttcccat

SEQ ID NO: 338513 - DNA, 16 bp, M. musculus
aaagatcctttctcaa

SEQ ID NO: 338514 - DNA, 16 bp, M. musculus
aaagatctattttcaa

SEQ ID NO: 338515 - DNA, 16 bp, M. musculus
aaagatctcagaaaat

SEQ ID NO: 338516 - DNA, 16 bp, M. musculus
aaagatctgtttgata

SEQ ID NO: 338517 - DNA, 16 bp, M. musculus
aaagatcttcaacaaa

SEQ ID NO: 338518 - DNA, 16 bp, M. musculus
aaagatcttcattaac

SEQ ID NO: 338519 - DNA, 16 bp, M. musculus
aaagatcttcctgcct

SEQ ID NO: 338520 - DNA, 16 bp, M. musculus
aaagatgaagacaaag

SEQ ID NO: 338521 - DNA, 16 bp, M. musculus
aaagatgacaagaagc

SEQ ID NO: 338522 - DNA, 16 bp, M. musculus
aaagatgaccttgaac

SEQ ID NO: 338523 - DNA, 16 bp, M. musculus
aaagatgagaaacaca

SEQ ID NO: 338524 - DNA, 16 bp, M. musculus
aaagatgagggagaca

SEQ ID NO: 338525 - DNA, 16 bp, M. musculus
aaagatgatgaacatg

SEQ ID NO: 338526 - DNA, 16 bp, M. musculus
aaagatgattttacat

SEQ ID NO: 338527 - DNA, 16 bp, M. musculus
aaagatgccaacaacc

SEQ ID NO: 338528 - DNA, 16 bp, M. musculus
aaagatgccatgaatt

SEQ ID NO: 338529 - DNA, 16 bp, M. musculus
aaagatgcccacaccc

SEQ ID NO: 338530 - DNA, 16 bp, M. musculus
aaagatggagcaaaga

SEQ ID NO: 338531 - DNA, 16 bp, M. musculus
aaagatggagcagaaa

SEQ ID NO: 338532 - DNA, 16 bp, M. musculus
aaagatggagcagaca

SEQ ID NO: 338533 - DNA, 16 bp, M. musculus
aaagatggattttttt

SEQ ID NO: 338534 - DNA, 16 bp, M. musculus
aaagatggcattttca

SEQ ID NO: 338535 - DNA, 16 bp, M. musculus
aaagatggctcagaag

SEQ ID NO: 338536 - DNA, 16 bp, M. musculus
aaagatggctcaggag

SEQ ID NO: 338537 - DNA, 16 bp, M. musculus
aaagatggcttggtgg

SEQ ID NO: 338538 - DNA, 16 bp, M. musculus
aaagatgtattttaaa

SEQ ID NO: 338539 - DNA, 16 bp, M. musculus
aaagatgtattttatt

SEQ ID NO: 338540 - DNA, 16 bp, M. musculus
aaagatgtctacagcc

SEQ ID NO: 338541 - DNA, 16 bp, M. musculus
aaagatgtgcaccaca

SEQ ID NO: 338542 - DNA, 16 bp, M. musculus
aaagatgtgcactacc

SEQ ID NO: 338543 - DNA, 16 bp, M. musculus
aaagatgtggcacaga

SEQ ID NO: 338544 - DNA, 16 bp, M. musculus
aaagatgtgtaccatc

SEQ ID NO: 338545 - DNA, 16 bp, M. musculus
aaagatgtgtgtgtgt

SEQ ID NO: 338546 - DNA, 16 bp, M. musculus
aaagatgttttagagt

SEQ ID NO: 338547 - DNA, 16 bp, M. musculus
aaagatgtttttaaaa

SEQ ID NO: 338548 - DNA, 16 bp, M. musculus
aaagattcaaaggcaa

SEQ ID NO: 338549 - DNA, 16 bp, M. musculus
aaagattcacttattt

SEQ ID NO: 338550 - DNA, 17 bp, M. musculus
aaagattctatggccaa

SEQ ID NO: 338551 - DNA, 18 bp, M. musculus
aaagattctatggctaaa

SEQ ID NO: 338552 - DNA, 16 bp, M. musculus
aaagattgtaagagcc

SEQ ID NO: 338553 - DNA, 16 bp, M. musculus
aaagattgttttaaaa

SEQ ID NO: 338554 - DNA, 16 bp, M. musculus
aaagatttacttattt

SEQ ID NO: 338555 - DNA, 16 bp, M. musculus
aaagatttatcttttt

SEQ ID NO: 338556 - DNA, 16 bp, M. musculus
aaagatttattcattt

SEQ ID NO: 338557 - DNA, 16 bp, M. musculus
aaagatttatttatgt

SEQ ID NO: 338558 - DNA, 16 bp, M. musculus
aaagatttatttcttt

SEQ ID NO: 338559 - DNA, 16 bp, M. musculus
aaagatttctttaaaa

SEQ ID NO: 338560 - DNA, 16 bp, M. musculus
aaagatttctttcttt

SEQ ID NO: 338561 - DNA, 16 bp, M. musculus
aaagatttcttttaaa

SEQ ID NO: 338562 - DNA, 16 bp, M. musculus
aaagatttgaagtttt

SEQ ID NO: 338563 - DNA, 16 bp, M. musculus
aaagatttgatggaga

SEQ ID NO: 338564 - DNA, 16 bp, M. musculus
aaagatttggcctctc

SEQ ID NO: 338565 - DNA, 16 bp, M. musculus
aaagattttaaaagtt

SEQ ID NO: 338566 - DNA, 16 bp, M. musculus
aaagattttacacaga

SEQ ID NO: 338567 - DNA, 16 bp, M. musculus
aaagattttcttccat

SEQ ID NO: 338568 - DNA, 16 bp, M. musculus
aaagatttttagctat

SEQ ID NO: 338569 - DNA, 16 bp, M. musculus
aaagattttttttcct

SEQ ID NO: 338570 - DNA, 16 bp, M. musculus
aaagcaaaacaaagct

SEQ ID NO: 338571 - DNA, 16 bp, M. musculus
aaagcaaatattttaa

SEQ ID NO: 338572 - DNA, 16 bp, M. musculus
aaagcaacacagctcc

SEQ ID NO: 338573 - DNA, 16 bp, M. musculus
aaagcaacagcagcag

SEQ ID NO: 338574 - DNA, 16 bp, M. musculus
aaagcaacatgggaag

SEQ ID NO: 338575 - DNA, 16 bp, M. musculus
aaagcaactgaaggaa

SEQ ID NO: 338576 - DNA, 16 bp, M. musculus
aaagcaacttacagaa

SEQ ID NO: 338577 - DNA, 16 bp, M. musculus
aaagcaacttagaaaa

SEQ ID NO: 338578 - DNA, 16 bp, M. musculus
aaagcaacttatagaa

SEQ ID NO: 338579 - DNA, 16 bp, M. musculus
aaagcaacttggggag

SEQ ID NO: 338580 - DNA, 16 bp, M. musculus
aaagcaagcaagccag

SEQ ID NO: 338581 - DNA, 16 bp, M. musculus
aaagcaagccaggaag

SEQ ID NO: 338582 - DNA, 16 bp, M. musculus
aaagcaagcctgagat

SEQ ID NO: 338583 - DNA, 16 bp, M. musculus
aaagcaagctggagag

SEQ ID NO: 338584 - DNA, 16 bp, M. musculus
aaagcaagctgggcaa

SEQ ID NO: 338585 - DNA, 16 bp, M. musculus
aaagcaagcttccttc

SEQ ID NO: 338586 - DNA, 16 bp, M. musculus
aaagcaagtttaaaat

SEQ ID NO: 338587 - DNA, 16 bp, M. musculus
aaagcaatatttaaat

SEQ ID NO: 338588 - DNA, 16 bp, M. musculus
aaagcaatcattaaaa

SEQ ID NO: 338589 - DNA, 16 bp, M. musculus
aaagcaatgaattcat

SEQ ID NO: 338590 - DNA, 16 bp, M. musculus
aaagcaatgaatttat

SEQ ID NO: 338591 - DNA, 16 bp, M. musculus
aaagcacaaccaatca

SEQ ID NO: 338592 - DNA, 16 bp, M. musculus
aaagcacactgagcaa

SEQ ID NO: 338593 - DNA, 16 bp, M. musculus
aaagcacagaaagatc

SEQ ID NO: 338594 - DNA, 16 bp, M. musculus
aaagcacccaagaagc

SEQ ID NO: 338595 - DNA, 16 bp, M. musculus
aaagcactagagctgg

SEQ ID NO: 338596 - DNA, 16 bp, M. musculus
aaagcacttgctgcca

SEQ ID NO: 338597 - DNA, 16 bp, M. musculus
aaagcagaaaacctgg

SEQ ID NO: 338598 - DNA, 16 bp, M. musculus
aaagcagaaaatattt

SEQ ID NO: 338599 - DNA, 16 bp, M. musculus
aaagcagaacacagag

SEQ ID NO: 338600 - DNA, 16 bp, M. musculus
aaagcagaacagacag

SEQ ID NO: 338601 - DNA, 16 bp, M. musculus
aaagcagaagagaaat

SEQ ID NO: 338602 - DNA, 16 bp, M. musculus
aaagcagaagcaaaat

SEQ ID NO: 338603 - DNA, 16 bp, M. musculus
aaagcagacaccattg

SEQ ID NO: 338604 - DNA, 16 bp, M. musculus
aaagcagacagacaga

SEQ ID NO: 338605 - DNA, 16 bp, M. musculus
aaagcagactgggaaa

SEQ ID NO: 338606 - DNA, 16 bp, M. musculus
aaagcagagagaaata

SEQ ID NO: 338607 - DNA, 16 bp, M. musculus
aaagcagagagaatta

SEQ ID NO: 338608 - DNA, 16 bp, M. musculus
aaagcagagagcacaa

SEQ ID NO: 338609 - DNA, 16 bp, M. musculus
aaagcagagagcagag

SEQ ID NO: 338610 - DNA, 16 bp, M. musculus
aaagcagagctggaga

SEQ ID NO: 338611 - DNA, 16 bp, M. musculus
aaagcagaggcaggaa

SEQ ID NO: 338612 - DNA, 16 bp, M. musculus
aaagcagaggcaggtg

SEQ ID NO: 338613 - DNA, 16 bp, M. musculus
aaagcagaggccacag

SEQ ID NO: 338614 - DNA, 16 bp, M. musculus
aaagcagatcagagag

SEQ ID NO: 338615 - DNA, 16 bp, M. musculus
aaagcagccatgttgc

SEQ ID NO: 338616 - DNA, 16 bp, M. musculus
aaagcagctgaaagag

SEQ ID NO: 338617 - DNA, 16 bp, M. musculus
aaagcagctgcgtttg

SEQ ID NO: 338618 - DNA, 16 bp, M. musculus
aaagcagctttctgta

SEQ ID NO: 338619 - DNA, 16 bp, M. musculus
aaagcaggaagaaact

SEQ ID NO: 338620 - DNA, 16 bp, M. musculus
aaagcaggacagggag

SEQ ID NO: 338621 - DNA, 16 bp, M. musculus
aaagcaggagcagatg

SEQ ID NO: 338622 - DNA, 16 bp, M. musculus
aaagcaggagctgaag

SEQ ID NO: 338623 - DNA, 16 bp, M. musculus
aaagcaggagctgatg

SEQ ID NO: 338624 - DNA, 17 bp, M. musculus
aaagcaggatattggct

SEQ ID NO: 338625 - DNA, 16 bp, M. musculus
aaagcaggatgaacaa

SEQ ID NO: 338626 - DNA, 16 bp, M. musculus
aaagcaggttaagcaa

SEQ ID NO: 338627 - DNA, 16 bp, M. musculus
aaagcaggttgagaaa

SEQ ID NO: 338628 - DNA, 16 bp, M. musculus
aaagcagtaaaggaaa

SEQ ID NO: 338629 - DNA, 16 bp, M. musculus
aaagcagtaagggaca

SEQ ID NO: 338630 - DNA, 16 bp, M. musculus
aaagcagtatatggaa

SEQ ID NO: 338631 - DNA, 16 bp, M. musculus
aaagcagtcatcaaca

SEQ ID NO: 338632 - DNA, 16 bp, M. musculus
aaagcagtgattctca

SEQ ID NO: 338633 - DNA, 16 bp, M. musculus
aaagcagtgtttctca

SEQ ID NO: 338634 - DNA, 16 bp, M. musculus
aaagcagtttattcag

SEQ ID NO: 338635 - DNA, 39 bp, M. musculus
aaagcatagtctaagggaataaaaagctgtcagaaaaca

SEQ ID NO: 338636 - DNA, 16 bp, M. musculus
aaagcatatatatata

SEQ ID NO: 338637 - DNA, 16 bp, M. musculus
aaagcatatttaaaat

SEQ ID NO: 338638 - DNA, 16 bp, M. musculus
aaagcatattttaaaa

SEQ ID NO: 338639 - DNA, 16 bp, M. musculus
aaagcatctttaaaaa

SEQ ID NO: 338640 - DNA, 16 bp, M. musculus
aaagcatctttaccaa

SEQ ID NO: 338641 - DNA, 16 bp, M. musculus
aaagcatgatgggaaa

SEQ ID NO: 338642 - DNA, 16 bp, M. musculus
aaagcatggcagaaag

SEQ ID NO: 338643 - DNA, 16 bp, M. musculus
aaagcatgtgccacca

SEQ ID NO: 338644 - DNA, 16 bp, M. musculus
aaagcatgtgccacta

SEQ ID NO: 338645 - DNA, 16 bp, M. musculus
aaagcattaatatctt

SEQ ID NO: 338646 - DNA, 20 bp, M. musculus
aaagcattaatgcaagcaaa

SEQ ID NO: 338647 - DNA, 16 bp, M. musculus
aaagcattctgggaaa

SEQ ID NO: 338648 - DNA, 16 bp, M. musculus
aaagcattcttacttt

SEQ ID NO: 338649 - DNA, 16 bp, M. musculus
aaagcatttattttat

SEQ ID NO: 338650 - DNA, 16 bp, M. musculus
aaagcatttgccaaaa

SEQ ID NO: 338651 - DNA, 16 bp, M. musculus
aaagcattttcaacaa

SEQ ID NO: 338652 - DNA, 16 bp, M. musculus
aaagcatttttatttt

SEQ ID NO: 338653 - DNA, 16 bp, M. musculus
aaagccaaacagatct

SEQ ID NO: 338654 - DNA, 16 bp, M. musculus
aaagccaacactcatg

SEQ ID NO: 338655 - DNA, 16 bp, M. musculus
aaagccaaccagcaca

SEQ ID NO: 338656 - DNA, 16 bp, M. musculus
aaagccaaccagccat

SEQ ID NO: 338657 - DNA, 16 bp, M. musculus
aaagccaaggcaggaa

SEQ ID NO: 338658 - DNA, 17 bp, M. musculus
aaagccaaggccaagaa

SEQ ID NO: 338659 - DNA, 16 bp, M. musculus
aaagccacagagcttc

SEQ ID NO: 338660 - DNA, 16 bp, M. musculus
aaagccagaaccatgt

SEQ ID NO: 338661 - DNA, 16 bp, M. musculus
aaagccagagacagtg

SEQ ID NO: 338662 - DNA, 16 bp, M. musculus
aaagccagatgcagtg

SEQ ID NO: 338663 - DNA, 16 bp, M. musculus
aaagccagcatgctgt

SEQ ID NO: 338664 - DNA, 16 bp, M. musculus
aaagccagcctggcct

SEQ ID NO: 338665 - DNA, 16 bp, M. musculus
aaagccagcctgggat

SEQ ID NO: 338666 - DNA, 17 bp, M. musculus
aaagccagcctggtctg

SEQ ID NO: 338667 - DNA, 16 bp, M. musculus
aaagccagctgggggc

SEQ ID NO: 338668 - DNA, 16 bp, M. musculus
aaagccaggcatgaca

SEQ ID NO: 338669 - DNA, 16 bp, M. musculus
aaagccaggcatggct

SEQ ID NO: 338670 - DNA, 16 bp, M. musculus
aaagccaggtggtggt

SEQ ID NO: 338671 - DNA, 16 bp, M. musculus
aaagccataaatcaag

SEQ ID NO: 338672 - DNA, 16 bp, M. musculus
aaagccatagtcacag

SEQ ID NO: 338673 - DNA, 16 bp, M. musculus
aaagccatcaatgtaa

SEQ ID NO: 338674 - DNA, 16 bp, M. musculus
aaagccatccagagat

SEQ ID NO: 338675 - DNA, 16 bp, M. musculus
aaagccatccagatgg

SEQ ID NO: 338676 - DNA, 16 bp, M. musculus
aaagccattctctgct

SEQ ID NO: 338677 - DNA, 17 bp, M. musculus
aaagccattgacttgtt

SEQ ID NO: 338678 - DNA, 16 bp, M. musculus
aaagccattgagtgtt

SEQ ID NO: 338679 - DNA, 16 bp, M. musculus
aaagccattggtgaag

SEQ ID NO: 338680 - DNA, 16 bp, M. musculus
aaagccattttaaaaa

SEQ ID NO: 338681 - DNA, 16 bp, M. musculus
aaagcccagcccagcc

SEQ ID NO: 338682 - DNA, 16 bp, M. musculus
aaagcccaggaccagg

SEQ ID NO: 338683 - DNA, 16 bp, M. musculus
aaagcccaggaccata

SEQ ID NO: 338684 - DNA, 16 bp, M. musculus
aaagcccatctccaca

SEQ ID NO: 338685 - DNA, 16 bp, M. musculus
aaagccccagggttgt

SEQ ID NO: 338686 - DNA, 16 bp, M. musculus
aaagccctctccatgt

SEQ ID NO: 338687 - DNA, 16 bp, M. musculus
aaagccctgaggatga

SEQ ID NO: 338688 - DNA, 16 bp, M. musculus
aaagccctgggtttga

SEQ ID NO: 338689 - DNA, 16 bp, M. musculus
aaagcctaggaaagaa

SEQ ID NO: 338690 - DNA, 16 bp, M. musculus
aaagcctatcccatct

SEQ ID NO: 338691 - DNA, 16 bp, M. musculus
aaagcctatgctacca

SEQ ID NO: 338692 - DNA, 16 bp, M. musculus
aaagcctcaaagatgt

SEQ ID NO: 338693 - DNA, 16 bp, M. musculus
aaagcctcacagaaga

SEQ ID NO: 338694 - DNA, 16 bp, M. musculus
aaagcctcagttctct

SEQ ID NO: 338695 - DNA, 16 bp, M. musculus
aaagcctcccaggaga

SEQ ID NO: 338696 - DNA, 16 bp, M. musculus
aaagcctctcagagga

SEQ ID NO: 338697 - DNA, 16 bp, M. musculus
aaagcctgagaacttg

SEQ ID NO: 338698 - DNA, 16 bp, M. musculus
aaagccttcagtctca

SEQ ID NO: 338699 - DNA, 16 bp, M. musculus
aaagccttgggttcaa

SEQ ID NO: 338700 - DNA, 54 bp, M. musculus
aaagccttgtggcaggactcctgccagacgcaggcaagggccaatgccaccatg

SEQ ID NO: 338701 - DNA, 16 bp, M. musculus
aaagcctttgcatgtc

SEQ ID NO: 338702 - DNA, 16 bp, M. musculus
aaagcctttggcaaaa

SEQ ID NO: 338703 - DNA, 16 bp, M. musculus
aaagccttttcttctt

SEQ ID NO: 338704 - DNA, 17 bp, M. musculus
aaagcgtgtgccaccat

SEQ ID NO: 338705 - DNA, 16 bp, M. musculus
aaagctaaaaatatct

SEQ ID NO: 338706 - DNA, 16 bp, M. musculus
aaagctaaaagctaaa

SEQ ID NO: 338707 - DNA, 16 bp, M. musculus
aaagctaagagaaagg

SEQ ID NO: 338708 - DNA, 16 bp, M. musculus
aaagctaattgttttt

SEQ ID NO: 338709 - DNA, 16 bp, M. musculus
aaagctaatttttttt

SEQ ID NO: 338710 - DNA, 16 bp, M. musculus
aaagctacagagaaac

SEQ ID NO: 338711 - DNA, 16 bp, M. musculus
aaagctactatgaaca

SEQ ID NO: 338712 - DNA, 16 bp, M. musculus
aaagctagaagatctt

SEQ ID NO: 338713 - DNA, 16 bp, M. musculus
aaagctagctaagcat

SEQ ID NO: 338714 - DNA, 16 bp, M. musculus
aaagctataccaaaag

SEQ ID NO: 338715 - DNA, 16 bp, M. musculus
aaagctcaaagcaaac

SEQ ID NO: 338716 - DNA, 16 bp, M. musculus
aaagctcaaagcatgc

SEQ ID NO: 338717 - DNA, 16 bp, M. musculus
aaagctcacatcttga

SEQ ID NO: 338718 - DNA, 17 bp, M. musculus
aaagctctagaacaaaa

SEQ ID NO: 338719 - DNA, 16 bp, M. musculus
aaagctctagaacgaa

SEQ ID NO: 338720 - DNA, 16 bp, M. musculus
aaagctctagaagaaa

SEQ ID NO: 338721 - DNA, 16 bp, M. musculus
aaagctgaaagaagtt

SEQ ID NO: 338722 - DNA, 16 bp, M. musculus
aaagctgagagctcac

SEQ ID NO: 338723 - DNA, 16 bp, M. musculus
aaagctgcagggtctc

SEQ ID NO: 338724 - DNA, 16 bp, M. musculus
aaagctgccatgaaca

SEQ ID NO: 338725 - DNA, 16 bp, M. musculus
aaagctgcttttaaag

SEQ ID NO: 338726 - DNA, 16 bp, M. musculus
aaagctggaaaacctg

SEQ ID NO: 338727 - DNA, 16 bp, M. musculus
aaagctggaagaagct

SEQ ID NO: 338728 - DNA, 16 bp, M. musculus
aaagctggggagatgg

SEQ ID NO: 338729 - DNA, 16 bp, M. musculus
aaagctggggctggag

SEQ ID NO: 338730 - DNA, 16 bp, M. musculus
aaagctgtcctctggc

SEQ ID NO: 338731 - DNA, 16 bp, M. musculus
aaagcttatactcaac

SEQ ID NO: 338732 - DNA, 16 bp, M. musculus
aaagcttattttaaaa

SEQ ID NO: 338733 - DNA, 16 bp, M. musculus
aaagcttcagtaaggc

SEQ ID NO: 338734 - DNA, 17 bp, M. musculus
aaagcttctgtaaggca

SEQ ID NO: 338735 - DNA, 16 bp, M. musculus
aaagcttctgtcaggc

SEQ ID NO: 338736 - DNA, 16 bp, M. musculus
aaagcttgattttttt

SEQ ID NO: 338737 - DNA, 16 bp, M. musculus
aaagctttaaaataaa

SEQ ID NO: 338738 - DNA, 16 bp, M. musculus
aaagctttaaagaaaa

SEQ ID NO: 338739 - DNA, 16 bp, M. musculus
aaagctttatttaaaa

SEQ ID NO: 338740 - DNA, 16 bp, M. musculus
aaagctttatttatta

SEQ ID NO: 338741 - DNA, 16 bp, M. musculus
aaagctttatttttat

SEQ ID NO: 338742 - DNA, 16 bp, M. musculus
aaagctttattttttt

SEQ ID NO: 338743 - DNA, 16 bp, M. musculus
aaagctttcagacttt

SEQ ID NO: 338744 - DNA, 16 bp, M. musculus
aaagctttctcatgag

SEQ ID NO: 338745 - DNA, 16 bp, M. musculus
aaagctttcttttctt

SEQ ID NO: 338746 - DNA, 16 bp, M. musculus
aaagctttgttccttt

SEQ ID NO: 338747 - DNA, 16 bp, M. musculus
aaagctttgttttgtt

SEQ ID NO: 338748 - DNA, 16 bp, M. musculus
aaagcttttaaaatgt

SEQ ID NO: 338749 - DNA, 16 bp, M. musculus
aaagcttttattgctt

SEQ ID NO: 338750 - DNA, 16 bp, M. musculus
aaagctttttaaaaga

SEQ ID NO: 338751 - DNA, 16 bp, M. musculus
aaaggaaaaaatccac

SEQ ID NO: 338752 - DNA, 16 bp, M. musculus
aaaggaaaaatgtttt

SEQ ID NO: 338753 - DNA, 16 bp, M. musculus
aaaggaaaacattcca

SEQ ID NO: 338754 - DNA, 16 bp, M. musculus
aaaggaaaacatttca

SEQ ID NO: 338755 - DNA, 16 bp, M. musculus
aaaggaaaacctgatg

SEQ ID NO: 338756 - DNA, 16 bp, M. musculus
aaaggaaaatgcaaca

SEQ ID NO: 338757 - DNA, 16 bp, M. musculus
aaaggaaaatggattt

SEQ ID NO: 338758 - DNA, 16 bp, M. musculus
aaaggaaacagaaatg

SEQ ID NO: 338759 - DNA, 16 bp, M. musculus
aaaggaaacattacta

SEQ ID NO: 338760 - DNA, 16 bp, M. musculus
aaaggaaaccacagag

SEQ ID NO: 338761 - DNA, 16 bp, M. musculus
aaaggaaactatttaa

SEQ ID NO: 338762 - DNA, 16 bp, M. musculus
aaaggaaacttaaaat

SEQ ID NO: 338763 - DNA, 16 bp, M. musculus
aaaggaaacttcagac

SEQ ID NO: 338764 - DNA, 16 bp, M. musculus
aaaggaaagaaaactc

SEQ ID NO: 338765 - DNA, 16 bp, M. musculus
aaaggaaagaaacatg

SEQ ID NO: 338766 - DNA, 16 bp, M. musculus
aaaggaaaggaaattt

SEQ ID NO: 338767 - DNA, 16 bp, M. musculus
aaaggaaaggccatcc

SEQ ID NO: 338768 - DNA, 16 bp, M. musculus
aaaggaaagggttaat

SEQ ID NO: 338769 - DNA, 16 bp, M. musculus
aaaggaaaggttaata

SEQ ID NO: 338770 - DNA, 16 bp, M. musculus
aaaggaaatatgggga

SEQ ID NO: 338771 - DNA, 16 bp, M. musculus
aaaggaaatatttttt

SEQ ID NO: 338772 - DNA, 16 bp, M. musculus
aaaggaaatcaggaaa

SEQ ID NO: 338773 - DNA, 16 bp, M. musculus
aaaggaaatcattggg

SEQ ID NO: 338774 - DNA, 16 bp, M. musculus
aaaggaaatgttaaat

SEQ ID NO: 338775 - DNA, 16 bp, M. musculus
aaaggaaattgatcct

SEQ ID NO: 338776 - DNA, 16 bp, M. musculus
aaaggaacacacatgg

SEQ ID NO: 338777 - DNA, 16 bp, M. musculus
aaaggaacagtatttt

SEQ ID NO: 338778 - DNA, 16 bp, M. musculus
aaaggaacccacacac

SEQ ID NO: 338779 - DNA, 16 bp, M. musculus
aaaggaactctgggaa

SEQ ID NO: 338780 - DNA, 16 bp, M. musculus
aaaggaagaaaaatct

SEQ ID NO: 338781 - DNA, 16 bp, M. musculus
aaaggaagaaaattca

SEQ ID NO: 338782 - DNA, 16 bp, M. musculus
aaaggaagaaagagct

SEQ ID NO: 338783 - DNA, 16 bp, M. musculus
aaaggaagaagtcaaa

SEQ ID NO: 338784 - DNA, 16 bp, M. musculus
aaaggaagaagtcaag

SEQ ID NO: 338785 - DNA, 16 bp, M. musculus
aaaggaagaagtcaga

SEQ ID NO: 338786 - DNA, 16 bp, M. musculus
aaaggaagaagtcatg

SEQ ID NO: 338787 - DNA, 16 bp, M. musculus
aaaggaagaatttatt

SEQ ID NO: 338788 - DNA, 16 bp, M. musculus
aaaggaagagatcaaa

SEQ ID NO: 338789 - DNA, 16 bp, M. musculus
aaaggaagcaagccag

SEQ ID NO: 338790 - DNA, 16 bp, M. musculus
aaaggaaggaaactga

SEQ ID NO: 338791 - DNA, 16 bp, M. musculus
aaaggaaggccactga

SEQ ID NO: 338792 - DNA, 16 bp, M. musculus
aaaggaagggggctgg

SEQ ID NO: 338793 - DNA, 16 bp, M. musculus
aaaggaagttttaaaa

SEQ ID NO: 338794 - DNA, 16 bp, M. musculus
aaaggaatgaagccct

SEQ ID NO: 338795 - DNA, 16 bp, M. musculus
aaaggaatgcaccacc

SEQ ID NO: 338796 - DNA, 16 bp, M. musculus
aaaggaatttttttaa

SEQ ID NO: 338797 - DNA, 16 bp, M. musculus
aaaggacaaaggcagg

SEQ ID NO: 338798 - DNA, 16 bp, M. musculus
aaaggacaattttcag

SEQ ID NO: 338799 - DNA, 16 bp, M. musculus
aaaggacacatgataa

SEQ ID NO: 338800 - DNA, 16 bp, M. musculus
aaaggacaccaacaga

SEQ ID NO: 338801 - DNA, 16 bp, M. musculus
aaaggacactgggcta

SEQ ID NO: 338802 - DNA, 16 bp, M. musculus
aaaggacactgtcaag

SEQ ID NO: 338803 - DNA, 16 bp, M. musculus
aaaggacagcaccagg

SEQ ID NO: 338804 - DNA, 16 bp, M. musculus
aaaggacagcattttc

SEQ ID NO: 338805 - DNA, 16 bp, M. musculus
aaaggacatggaagaa

SEQ ID NO: 338806 - DNA, 16 bp, M. musculus
aaaggaccaagatata

SEQ ID NO: 338807 - DNA, 16 bp, M. musculus
aaaggaccctgataga

SEQ ID NO: 338808 - DNA, 16 bp, M. musculus
aaaggacctgagttca

SEQ ID NO: 338809 - DNA, 16 bp, M. musculus
aaaggaccttggcaga

SEQ ID NO: 338810 - DNA, 16 bp, M. musculus
aaaggactgaaggagc

SEQ ID NO: 338811 - DNA, 16 bp, M. musculus
aaaggactgcagagcc

SEQ ID NO: 338812 - DNA, 16 bp, M. musculus
aaaggactttcataag

SEQ ID NO: 338813 - DNA, 16 bp, M. musculus
aaaggagaaagtaagc

SEQ ID NO: 338814 - DNA, 16 bp, M. musculus
aaaggagaacactcct

SEQ ID NO: 338815 - DNA, 16 bp, M. musculus
aaaggagaagaaaccc

SEQ ID NO: 338816 - DNA, 16 bp, M. musculus
aaaggagacaacattt

SEQ ID NO: 338817 - DNA, 16 bp, M. musculus
aaaggagaccatgaat

SEQ ID NO: 338818 - DNA, 16 bp, M. musculus
aaaggagaccctggag

SEQ ID NO: 338819 - DNA, 16 bp, M. musculus
aaaggagactctgact

SEQ ID NO: 338820 - DNA, 16 bp, M. musculus
aaaggagactgagaaa

SEQ ID NO: 338821 - DNA, 16 bp, M. musculus
aaaggagataacagca

SEQ ID NO: 338822 - DNA, 16 bp, M. musculus
aaaggagataacattt

SEQ ID NO: 338823 - DNA, 16 bp, M. musculus
aaaggagataggaatg

SEQ ID NO: 338824 - DNA, 22 bp, M. musculus
aaaggagatcaaggggatacaa

SEQ ID NO: 338825 - DNA, 16 bp, M. musculus
aaaggagatcgagggg

SEQ ID NO: 338826 - DNA, 16 bp, M. musculus
aaaggagatttttttt

SEQ ID NO: 338827 - DNA, 16 bp, M. musculus
aaaggagccaagagtt

SEQ ID NO: 338828 - DNA, 16 bp, M. musculus
aaaggagctaaagaga

SEQ ID NO: 338829 - DNA, 17 bp, M. musculus
aaaggagctgaaggagc

SEQ ID NO: 338830 - DNA, 16 bp, M. musculus
aaaggagctgaaggga

SEQ ID NO: 338831 - DNA, 16 bp, M. musculus
aaaggagctggagatc

SEQ ID NO: 338832 - DNA, 16 bp, M. musculus
aaaggagctggttctt

SEQ ID NO: 338833 - DNA, 16 bp, M. musculus
aaaggaggaaaggttt

SEQ ID NO: 338834 - DNA, 16 bp, M. musculus
aaaggagggaacttca

SEQ ID NO: 338835 - DNA, 16 bp, M. musculus
aaaggagggaatctca

SEQ ID NO: 338836 - DNA, 16 bp, M. musculus
aaaggagttacagaga

SEQ ID NO: 338837 - DNA, 16 bp, M. musculus
aaaggagttttgattt

SEQ ID NO: 338838 - DNA, 16 bp, M. musculus
aaaggataaagaggct

SEQ ID NO: 338839 - DNA, 16 bp, M. musculus
aaaggatataccatct

SEQ ID NO: 338840 - DNA, 16 bp, M. musculus
aaaggatatttttaaa

SEQ ID NO: 338841 - DNA, 16 bp, M. musculus
aaaggatcaagtgtgt

SEQ ID NO: 338842 - DNA, 16 bp, M. musculus
aaaggatcatagacag

SEQ ID NO: 338843 - DNA, 16 bp, M. musculus
aaaggatggaaaacaa

SEQ ID NO: 338844 - DNA, 16 bp, M. musculus
aaaggatgggtctttg

SEQ ID NO: 338845 - DNA, 16 bp, M. musculus
aaaggatgtcaggact

SEQ ID NO: 338846 - DNA, 16 bp, M. musculus
aaaggatgttgaattt

SEQ ID NO: 338847 - DNA, 17 bp, M. musculus
aaaggattgaactttta

SEQ ID NO: 338848 - DNA, 16 bp, M. musculus
aaaggattgagacaat

SEQ ID NO: 338849 - DNA, 16 bp, M. musculus
aaaggattgcagcatt

SEQ ID NO: 338850 - DNA, 16 bp, M. musculus
aaaggatttaaattta

SEQ ID NO: 338851 - DNA, 16 bp, M. musculus
aaaggatttgacaaaa

SEQ ID NO: 338852 - DNA, 16 bp, M. musculus
aaaggatttttaccaa

SEQ ID NO: 338853 - DNA, 16 bp, M. musculus
aaaggcaaaaacccag

SEQ ID NO: 338854 - DNA, 16 bp, M. musculus
aaaggcaaaatgcaaa

SEQ ID NO: 338855 - DNA, 16 bp, M. musculus
aaaggcaaacatttaa

SEQ ID NO: 338856 - DNA, 41 bp, M. musculus
aaaggcaaacgtaagaatcctactaacagaaatcaagacca

SEQ ID NO: 338857 - DNA, 20 bp, M. musculus
aaaggcaaacgtaagaatct

SEQ ID NO: 338858 - DNA, 18 bp, M. musculus
aaaggcaaatgtaagaat

SEQ ID NO: 338859 - DNA, 16 bp, M. musculus
aaaggcaaggaggggc

SEQ ID NO: 338860 - DNA, 16 bp, M. musculus
aaaggcaatctacaga

SEQ ID NO: 338861 - DNA, 16 bp, M. musculus
aaaggcaatctagaga

SEQ ID NO: 338862 - DNA, 16 bp, M. musculus
aaaggcacagctgaga

SEQ ID NO: 338863 - DNA, 16 bp, M. musculus
aaaggcaccagggact

SEQ ID NO: 338864 - DNA, 16 bp, M. musculus
aaaggcactgactgct

SEQ ID NO: 338865 - DNA, 16 bp, M. musculus
aaaggcagaagcaggc

SEQ ID NO: 338866 - DNA, 16 bp, M. musculus
aaaggcagagagacag

SEQ ID NO: 338867 - DNA, 16 bp, M. musculus
aaaggcagaggcaagt

SEQ ID NO: 338868 - DNA, 16 bp, M. musculus
aaaggcagaggcagaa

SEQ ID NO: 338869 - DNA, 16 bp, M. musculus
aaaggcagcctgtttt

SEQ ID NO: 338870 - DNA, 16 bp, M. musculus
aaaggcaggaaataat

SEQ ID NO: 338871 - DNA, 16 bp, M. musculus
aaaggcaggtaccacc

SEQ ID NO: 338872 - DNA, 16 bp, M. musculus
aaaggcagtctgtgtt

SEQ ID NO: 338873 - DNA, 16 bp, M. musculus
aaaggcatgagccacc

SEQ ID NO: 338874 - DNA, 19 bp, M. musculus
aaaggcatgcaccaccacc

SEQ ID NO: 338875 - DNA, 16 bp, M. musculus
aaaggcatgcaccact

SEQ ID NO: 338876 - DNA, 16 bp, M. musculus
aaaggcatgcaccatc

SEQ ID NO: 338877 - DNA, 16 bp, M. musculus
aaaggcatgcatcact

SEQ ID NO: 338878 - DNA, 16 bp, M. musculus
aaaggcatgggccaca

SEQ ID NO: 338879 - DNA, 16 bp, M. musculus
aaaggcatgtaccact

SEQ ID NO: 338880 - DNA, 19 bp, M. musculus
aaaggcatgtgccaccacc

SEQ ID NO: 338881 - DNA, 19 bp, M. musculus
aaaggcatgtgccaccact

SEQ ID NO: 338882 - DNA, 16 bp, M. musculus
aaaggcatgtggcacc

SEQ ID NO: 338883 - DNA, 16 bp, M. musculus
aaaggcatttataata

SEQ ID NO: 338884 - DNA, 16 bp, M. musculus
aaaggcattttcttaa

SEQ ID NO: 338885 - DNA, 16 bp, M. musculus
aaaggcattttttttt

SEQ ID NO: 338886 - DNA, 16 bp, M. musculus
aaaggccaaatataaa

SEQ ID NO: 338887 - DNA, 16 bp, M. musculus
aaaggccacccacaga

SEQ ID NO: 338888 - DNA, 16 bp, M. musculus
aaaggccatccagaaa

SEQ ID NO: 338889 - DNA, 16 bp, M. musculus
aaaggccatggaggaa

SEQ ID NO: 338890 - DNA, 16 bp, M. musculus
aaaggccgagaagcaa

SEQ ID NO: 338891 - DNA, 16 bp, M. musculus
aaaggcctgaaggagc

SEQ ID NO: 338892 - DNA, 19 bp, M. musculus
aaaggcgtgagccaccacc

SEQ ID NO: 338893 - DNA, 20 bp, M. musculus
aaaggcgtgcgccaccacac

SEQ ID NO: 338894 - DNA, 21 bp, M. musculus
aaaggcgtgcgccaccactgt

SEQ ID NO: 338895 - DNA, 19 bp, M. musculus
aaaggcgtgtgctaccact

SEQ ID NO: 338896 - DNA, 16 bp, M. musculus
aaaggctaaagaactc

SEQ ID NO: 338897 - DNA, 16 bp, M. musculus
aaaggctacccagaga

SEQ ID NO: 338898 - DNA, 16 bp, M. musculus
aaaggctactgatttg

SEQ ID NO: 338899 - DNA, 16 bp, M. musculus
aaaggctagaagctag

SEQ ID NO: 338900 - DNA, 16 bp, M. musculus
aaaggctcagaaaata

SEQ ID NO: 338901 - DNA, 16 bp, M. musculus
aaaggctgaaaaacaa

SEQ ID NO: 338902 - DNA, 16 bp, M. musculus
aaaggctgaaaagaaa

SEQ ID NO: 338903 - DNA, 24 bp, M. musculus
aaaggctggaaaacaattttccaa

SEQ ID NO: 338904 - DNA, 16 bp, M. musculus
aaaggctggaaaacta

SEQ ID NO: 338905 - DNA, 16 bp, M. musculus
aaaggctggaaagatg

SEQ ID NO: 338906 - DNA, 16 bp, M. musculus
aaaggctggaagaagc

SEQ ID NO: 338907 - DNA, 16 bp, M. musculus
aaaggcttacagcttc

SEQ ID NO: 338908 - DNA, 16 bp, M. musculus
aaaggcttggaaagat

SEQ ID NO: 338909 - DNA, 16 bp, M. musculus
aaaggctttctcagca

SEQ ID NO: 338910 - DNA, 16 bp, M. musculus
aaaggctttggatttt

SEQ ID NO: 338911 - DNA, 16 bp, M. musculus
aaaggcttttccacat

SEQ ID NO: 338912 - DNA, 16 bp, M. musculus
aaaggctttttcagta

SEQ ID NO: 338913 - DNA, 16 bp, M. musculus
aaagggaaaaaaatct

SEQ ID NO: 338914 - DNA, 16 bp, M. musculus
aaagggaaaatatttt

SEQ ID NO: 338915 - DNA, 16 bp, M. musculus
aaagggaaacatgatc

SEQ ID NO: 338916 - DNA, 16 bp, M. musculus
aaagggaaacatttaa

SEQ ID NO: 338917 - DNA, 16 bp, M. musculus
aaagggaaacctggaa

SEQ ID NO: 338918 - DNA, 16 bp, M. musculus
aaagggaactgcatcc

SEQ ID NO: 338919 - DNA, 16 bp, M. musculus
aaagggaacttcaacc

SEQ ID NO: 338920 - DNA, 16 bp, M. musculus
aaagggaaggagggct

SEQ ID NO: 338921 - DNA, 16 bp, M. musculus
aaagggaagtttaaag

SEQ ID NO: 338922 - DNA, 16 bp, M. musculus
aaagggacatgcatgg

SEQ ID NO: 338923 - DNA, 16 bp, M. musculus
aaagggagacctaaca

SEQ ID NO: 338924 - DNA, 16 bp, M. musculus
aaagggaggcctccca

SEQ ID NO: 338925 - DNA, 16 bp, M. musculus
aaagggaggctggaaa

SEQ ID NO: 338926 - DNA, 16 bp, M. musculus
aaagggatttaacaga

SEQ ID NO: 338927 - DNA, 16 bp, M. musculus
aaagggcaacaaaatt

SEQ ID NO: 338928 - DNA, 16 bp, M. musculus
aaagggcacagggaca

SEQ ID NO: 338929 - DNA, 16 bp, M. musculus
aaagggcagaattctt

SEQ ID NO: 338930 - DNA, 16 bp, M. musculus
aaagggctggaaaaca

SEQ ID NO: 338931 - DNA, 16 bp, M. musculus
aaagggctggagaaat

SEQ ID NO: 338932 - DNA, 16 bp, M. musculus
aaaggggatatttgaa

SEQ ID NO: 338933 - DNA, 16 bp, M. musculus
aaaggggctggagaga

SEQ ID NO: 338934 - DNA, 16 bp, M. musculus
aaaggggctggggaga

SEQ ID NO: 338935 - DNA, 16 bp, M. musculus
aaagggggaaatgtaa

SEQ ID NO: 338936 - DNA, 16 bp, M. musculus
aaaggggggccctggg

SEQ ID NO: 338937 - DNA, 16 bp, M. musculus
aaagggggtacagagc

SEQ ID NO: 338938 - DNA, 16 bp, M. musculus
aaaggggtctcgaccc

SEQ ID NO: 338939 - DNA, 16 bp, M. musculus
aaaggggtctgcaact

SEQ ID NO: 338940 - DNA, 16 bp, M. musculus
aaaggggtgtgtgtgt

SEQ ID NO: 338941 - DNA, 16 bp, M. musculus
aaagggtcacaaccca

SEQ ID NO: 338942 - DNA, 16 bp, M. musculus
aaagggtcacagaatt

SEQ ID NO: 338943 - DNA, 16 bp, M. musculus
aaagggtcacagcata

SEQ ID NO: 338944 - DNA, 16 bp, M. musculus
aaagggtcacagcatc

SEQ ID NO: 338945 - DNA, 16 bp, M. musculus
aaagggtctggagaga

SEQ ID NO: 338946 - DNA, 16 bp, M. musculus
aaagggttatttggtt

SEQ ID NO: 338947 - DNA, 16 bp, M. musculus
aaagggtttattccat

SEQ ID NO: 338948 - DNA, 16 bp, M. musculus
aaagggtttatttagt

SEQ ID NO: 338949 - DNA, 16 bp, M. musculus
aaagggtttattttgc

SEQ ID NO: 338950 - DNA, 16 bp, M. musculus
aaagggtttattttgt

SEQ ID NO: 338951 - DNA, 16 bp, M. musculus
aaagggtttctctgta

SEQ ID NO: 338952 - DNA, 16 bp, M. musculus
aaagggtttctttgtg

SEQ ID NO: 338953 - DNA, 20 bp, M. musculus
aaaggtacctaagtatatga

SEQ ID NO: 338954 - DNA, 16 bp, M. musculus
aaaggtatcctggcag

SEQ ID NO: 338955 - DNA, 19 bp, M. musculus
aaaggtatgcgccaccaca

SEQ ID NO: 338956 - DNA, 16 bp, M. musculus
aaaggtcaaataacat

SEQ ID NO: 338957 - DNA, 17 bp, M. musculus
aaaggtcaagtaacatg

SEQ ID NO: 338958 - DNA, 16 bp, M. musculus
aaaggtcaagtagcat

SEQ ID NO: 338959 - DNA, 16 bp, M. musculus
aaaggtcaggagttca

SEQ ID NO: 338960 - DNA, 16 bp, M. musculus
aaaggtcctgagttcc

SEQ ID NO: 338961 - DNA, 16 bp, M. musculus
aaaggtgcccaggccc

SEQ ID NO: 338962 - DNA, 16 bp, M. musculus
aaaggtgctgagggtg

SEQ ID NO: 338963 - DNA, 16 bp, M. musculus
aaaggtgggactggag

SEQ ID NO: 338964 - DNA, 16 bp, M. musculus
aaaggtgtgcaccact

SEQ ID NO: 338965 - DNA, 17 bp, M. musculus
aaaggtgtgtgccacca

SEQ ID NO: 338966 - DNA, 16 bp, M. musculus
aaaggtgtgtgctgct

SEQ ID NO: 338967 - DNA, 16 bp, M. musculus
aaaggtgtgtttcacc

SEQ ID NO: 338968 - DNA, 16 bp, M. musculus
aaaggttaataacaga

SEQ ID NO: 338969 - DNA, 16 bp, M. musculus
aaaggttccacaacct

SEQ ID NO: 338970 - DNA, 16 bp, M. musculus
aaaggttctttggaaa

SEQ ID NO: 338971 - DNA, 16 bp, M. musculus
aaaggttgagaatcac

SEQ ID NO: 338972 - DNA, 16 bp, M. musculus
aaaggtttaaatagcc

SEQ ID NO: 338973 - DNA, 16 bp, M. musculus
aaaggtttactttggc

SEQ ID NO: 338974 - DNA, 16 bp, M. musculus
aaaggttttgggtttt

SEQ ID NO: 338975 - DNA, 16 bp, M. musculus
aaaggttttgtctttg

SEQ ID NO: 338976 - DNA, 16 bp, M. musculus
aaagtaaagaaattct

SEQ ID NO: 338977 - DNA, 16 bp, M. musculus
aaagtaaagcaaagca

SEQ ID NO: 338978 - DNA, 16 bp, M. musculus
aaagtaaagcatttaa

SEQ ID NO: 338979 - DNA, 16 bp, M. musculus
aaagtaaataaatctt

SEQ ID NO: 338980 - DNA, 16 bp, M. musculus
aaagtaaattctaata

SEQ ID NO: 338981 - DNA, 16 bp, M. musculus
aaagtaaatttcaaaa

SEQ ID NO: 338982 - DNA, 16 bp, M. musculus
aaagtaactaacacag

SEQ ID NO: 338983 - DNA, 16 bp, M. musculus
aaagtaacttaaggga

SEQ ID NO: 338984 - DNA, 16 bp, M. musculus
aaagtaagtgtgtgtg

SEQ ID NO: 338985 - DNA, 16 bp, M. musculus
aaagtaatccttcacc

SEQ ID NO: 338986 - DNA, 16 bp, M. musculus
aaagtaatgtctaatt

SEQ ID NO: 338987 - DNA, 16 bp, M. musculus
aaagtaattattttct

SEQ ID NO: 338988 - DNA, 16 bp, M. musculus
aaagtaatttttactt

SEQ ID NO: 338989 - DNA, 16 bp, M. musculus
aaagtaatttttttct

SEQ ID NO: 338990 - DNA, 16 bp, M. musculus
aaagtacacaagaagc

SEQ ID NO: 338991 - DNA, 16 bp, M. musculus
aaagtacagagaataa

SEQ ID NO: 338992 - DNA, 16 bp, M. musculus
aaagtacccaaggaac

SEQ ID NO: 338993 - DNA, 16 bp, M. musculus
aaagtacttgccatgc

SEQ ID NO: 338994 - DNA, 16 bp, M. musculus
aaagtactttaaaaat

SEQ ID NO: 338995 - DNA, 16 bp, M. musculus
aaagtactttttattt

SEQ ID NO: 338996 - DNA, 16 bp, M. musculus
aaagtagattttattt

SEQ ID NO: 338997 - DNA, 16 bp, M. musculus
aaagtagcaaagacca

SEQ ID NO: 338998 - DNA, 16 bp, M. musculus
aaagtaggtcactggg

SEQ ID NO: 338999 - DNA, 16 bp, M. musculus
aaagtaggttgtaaaa

SEQ ID NO: 339000 - DNA, 16 bp, M. musculus
aaagtaggttttgaaa

SEQ ID NO: 339001 - DNA, 16 bp, M. musculus
aaagtatattggcttc

SEQ ID NO: 339002 - DNA, 16 bp, M. musculus
aaagtatatttacaaa

SEQ ID NO: 339003 - DNA, 16 bp, M. musculus
aaagtatcaataaaat

SEQ ID NO: 339004 - DNA, 17 bp, M. musculus
aaagtatccaaggagct

SEQ ID NO: 339005 - DNA, 16 bp, M. musculus
aaagtatctaataaaa

SEQ ID NO: 339006 - DNA, 16 bp, M. musculus
aaagtatctttaataa

SEQ ID NO: 339007 - DNA, 16 bp, M. musculus
aaagtatggatacttt

SEQ ID NO: 339008 - DNA, 16 bp, M. musculus
aaagtattttacattt

SEQ ID NO: 339009 - DNA, 16 bp, M. musculus
aaagtattttcagtag

SEQ ID NO: 339010 - DNA, 16 bp, M. musculus
aaagtatttttatgtc

SEQ ID NO: 339011 - DNA, 16 bp, M. musculus
aaagtattttttgaaa

SEQ ID NO: 339012 - DNA, 16 bp, M. musculus
aaagtcaaagaaaatg

SEQ ID NO: 339013 - DNA, 17 bp, M. musculus
aaagtcaatgggaaact

SEQ ID NO: 339014 - DNA, 16 bp, M. musculus
aaagtcaattttcttt

SEQ ID NO: 339015 - DNA, 16 bp, M. musculus
aaagtcacaccacaca

SEQ ID NO: 339016 - DNA, 16 bp, M. musculus
aaagtcagagatctgc

SEQ ID NO: 339017 - DNA, 16 bp, M. musculus
aaagtcagatataata

SEQ ID NO: 339018 - DNA, 16 bp, M. musculus
aaagtcagctggatgg

SEQ ID NO: 339019 - DNA, 16 bp, M. musculus
aaagtcagcttgagga

SEQ ID NO: 339020 - DNA, 16 bp, M. musculus
aaagtcaggacaggaa

SEQ ID NO: 339021 - DNA, 16 bp, M. musculus
aaagtcaggcatggtg

SEQ ID NO: 339022 - DNA, 21 bp, M. musculus
aaagtcatacatcaactggtt

SEQ ID NO: 339023 - DNA, 16 bp, M. musculus
aaagtcatcaaaagag

SEQ ID NO: 339024 - DNA, 16 bp, M. musculus
aaagtcatcagaaaag

SEQ ID NO: 339025 - DNA, 16 bp, M. musculus
aaagtccaagaattca

SEQ ID NO: 339026 - DNA, 16 bp, M. musculus
aaagtcccagactcca

SEQ ID NO: 339027 - DNA, 16 bp, M. musculus
aaagtcccccccccca

SEQ ID NO: 339028 - DNA, 16 bp, M. musculus
aaagtcccccttaccc

SEQ ID NO: 339029 - DNA, 16 bp, M. musculus
aaagtcccctataccc

SEQ ID NO: 339030 - DNA, 16 bp, M. musculus
aaagtccgaagttcaa

SEQ ID NO: 339031 - DNA, 16 bp, M. musculus
aaagtcctctaccagc

SEQ ID NO: 339032 - DNA, 16 bp, M. musculus
aaagtcctgagttcaa

SEQ ID NO: 339033 - DNA, 16 bp, M. musculus
aaagtccttctttatg

SEQ ID NO: 339034 - DNA, 16 bp, M. musculus
aaagtctagaagaaaa

SEQ ID NO: 339035 - DNA, 16 bp, M. musculus
aaagtctattgtcctg

SEQ ID NO: 339036 - DNA, 16 bp, M. musculus
aaagtctattttatta

SEQ ID NO: 339037 - DNA, 16 bp, M. musculus
aaagtctcttaactat

SEQ ID NO: 339038 - DNA, 16 bp, M. musculus
aaagtctgggaaagat

SEQ ID NO: 339039 - DNA, 16 bp, M. musculus
aaagtcttagaaaaat

SEQ ID NO: 339040 - DNA, 16 bp, M. musculus
aaagtcttcaacaaaa

SEQ ID NO: 339041 - DNA, 16 bp, M. musculus
aaagtcttgctagtgt

SEQ ID NO: 339042 - DNA, 16 bp, M. musculus
aaagtcttggaaatga

SEQ ID NO: 339043 - DNA, 16 bp, M. musculus
aaagtcttttaaaaat

SEQ ID NO: 339044 - DNA, 16 bp, M. musculus
aaagtgaaacctttgc

SEQ ID NO: 339045 - DNA, 16 bp, M. musculus
aaagtgaaagacctgt

SEQ ID NO: 339046 - DNA, 16 bp, M. musculus
aaagtgaagaaaaagc

SEQ ID NO: 339047 - DNA, 16 bp, M. musculus
aaagtgaagaaattca

SEQ ID NO: 339048 - DNA, 16 bp, M. musculus
aaagtgaagagattta

SEQ ID NO: 339049 - DNA, 16 bp, M. musculus
aaagtgaagcctggat

SEQ ID NO: 339050 - DNA, 16 bp, M. musculus
aaagtgaattccaaga

SEQ ID NO: 339051 - DNA, 16 bp, M. musculus
aaagtgacaagtcaga

SEQ ID NO: 339052 - DNA, 16 bp, M. musculus
aaagtgacagagaaag

SEQ ID NO: 339053 - DNA, 16 bp, M. musculus
aaagtgagatccagga

SEQ ID NO: 339054 - DNA, 16 bp, M. musculus
aaagtgagatcctgtc

SEQ ID NO: 339055 - DNA, 16 bp, M. musculus
aaagtgagctccagaa

SEQ ID NO: 339056 - DNA, 16 bp, M. musculus
aaagtgaggagcagag

SEQ ID NO: 339057 - DNA, 16 bp, M. musculus
aaagtgagtaagtaaa

SEQ ID NO: 339058 - DNA, 16 bp, M. musculus
aaagtgagtccaggac

SEQ ID NO: 339059 - DNA, 16 bp, M. musculus
aaagtgagtgattgaa

SEQ ID NO: 339060 - DNA, 16 bp, M. musculus
aaagtgagttccaggc

SEQ ID NO: 339061 - DNA, 16 bp, M. musculus
aaagtgatgaatcaga

SEQ ID NO: 339062 - DNA, 16 bp, M. musculus
aaagtgatttttaaaa

SEQ ID NO: 339063 - DNA, 16 bp, M. musculus
aaagtgcaaaaagctc

SEQ ID NO: 339064 - DNA, 16 bp, M. musculus
aaagtgcttgctgagc

SEQ ID NO: 339065 - DNA, 16 bp, M. musculus
aaagtgcttgctgtgt

SEQ ID NO: 339066 - DNA, 16 bp, M. musculus
aaagtgctttttatct

SEQ ID NO: 339067 - DNA, 18 bp, M. musculus
aaagtggaaaaagcctta

SEQ ID NO: 339068 - DNA, 17 bp, M. musculus
aaagtggaaaaggcctt

SEQ ID NO: 339069 - DNA, 16 bp, M. musculus
aaagtggaatatgttt

SEQ ID NO: 339070 - DNA, 16 bp, M. musculus
aaagtggacagggaaa

SEQ ID NO: 339071 - DNA, 16 bp, M. musculus
aaagtggcagcctaca

SEQ ID NO: 339072 - DNA, 16 bp, M. musculus
aaagtgggaaagagcc

SEQ ID NO: 339073 - DNA, 16 bp, M. musculus
aaagtgtccacacttc

SEQ ID NO: 339074 - DNA, 16 bp, M. musculus
aaagtgtctgggtttg

SEQ ID NO: 339075 - DNA, 16 bp, M. musculus
aaagtgtctttaataa

SEQ ID NO: 339076 - DNA, 16 bp, M. musculus
aaagtgtgaagcagag

SEQ ID NO: 339077 - DNA, 16 bp, M. musculus
aaagtgtgcagaagga

SEQ ID NO: 339078 - DNA, 16 bp, M. musculus
aaagtgtggaacagag

SEQ ID NO: 339079 - DNA, 16 bp, M. musculus
aaagtgtggatgcctc

SEQ ID NO: 339080 - DNA, 16 bp, M. musculus
aaagtgtgtatgcttc

SEQ ID NO: 339081 - DNA, 16 bp, M. musculus
aaagtgtgtgccacca

SEQ ID NO: 339082 - DNA, 16 bp, M. musculus
aaagtgtgtgccatca

SEQ ID NO: 339083 - DNA, 16 bp, M. musculus
aaagtgtgtgtatgtg

SEQ ID NO: 339084 - DNA, 16 bp, M. musculus
aaagtgtttgctgtgt

SEQ ID NO: 339085 - DNA, 16 bp, M. musculus
aaagtgtttgctttgc

SEQ ID NO: 339086 - DNA, 16 bp, M. musculus
aaagtgtttttaaaat

SEQ ID NO: 339087 - DNA, 16 bp, M. musculus
aaagtgttttttaaaa

SEQ ID NO: 339088 - DNA, 16 bp, M. musculus
aaagttaaaaaccata

SEQ ID NO: 339089 - DNA, 16 bp, M. musculus
aaagttaaaatgtttt

SEQ ID NO: 339090 - DNA, 16 bp, M. musculus
aaagttaagtcaagat

SEQ ID NO: 339091 - DNA, 16 bp, M. musculus
aaagttacatttaaaa

SEQ ID NO: 339092 - DNA, 16 bp, M. musculus
aaagttacatttacat

SEQ ID NO: 339093 - DNA, 16 bp, M. musculus
aaagttagaattaaga

SEQ ID NO: 339094 - DNA, 16 bp, M. musculus
aaagttaggggttttt

SEQ ID NO: 339095 - DNA, 17 bp, M. musculus
aaagttatcaaaaaaga

SEQ ID NO: 339096 - DNA, 16 bp, M. musculus
aaagttatgaaccaaa

SEQ ID NO: 339097 - DNA, 16 bp, M. musculus
aaagttattttaaatg

SEQ ID NO: 339098 - DNA, 16 bp, M. musculus
aaagttatttttcttt

SEQ ID NO: 339099 - DNA, 16 bp, M. musculus
aaagttcaaagcacac

SEQ ID NO: 339100 - DNA, 16 bp, M. musculus
aaagttcaaggtcagc

SEQ ID NO: 339101 - DNA, 16 bp, M. musculus
aaagttctagaagaaa

SEQ ID NO: 339102 - DNA, 16 bp, M. musculus
aaagttctagctaacc

SEQ ID NO: 339103 - DNA, 16 bp, M. musculus
aaagttctctgtgtgt

SEQ ID NO: 339104 - DNA, 16 bp, M. musculus
aaagttctgagttcaa

SEQ ID NO: 339105 - DNA, 16 bp, M. musculus
aaagttctggaaagat

SEQ ID NO: 339106 - DNA, 16 bp, M. musculus
aaagttctgtatgaca

SEQ ID NO: 339107 - DNA, 16 bp, M. musculus
aaagttctgtttcaga

SEQ ID NO: 339108 - DNA, 16 bp, M. musculus
aaagttgcaagggaaa

SEQ ID NO: 339109 - DNA, 16 bp, M. musculus
aaagttggactaaatg

SEQ ID NO: 339110 - DNA, 16 bp, M. musculus
aaagttgtgtgtcttt

SEQ ID NO: 339111 - DNA, 17 bp, M. musculus
aaagttgtttgatataa

SEQ ID NO: 339112 - DNA, 16 bp, M. musculus
aaagtttaagctcaca

SEQ ID NO: 339113 - DNA, 16 bp, M. musculus
aaagtttaaggagatg

SEQ ID NO: 339114 - DNA, 16 bp, M. musculus
aaagtttactttaaaa

SEQ ID NO: 339115 - DNA, 16 bp, M. musculus
aaagtttctttaacaa

SEQ ID NO: 339116 - DNA, 16 bp, M. musculus
aaagtttctttatgaa

SEQ ID NO: 339117 - DNA, 16 bp, M. musculus
aaagtttgaaatgtaa

SEQ ID NO: 339118 - DNA, 16 bp, M. musculus
aaagtttgggggagaa

SEQ ID NO: 339119 - DNA, 17 bp, M. musculus
aaagtttgtgtgtccaa

SEQ ID NO: 339120 - DNA, 16 bp, M. musculus
aaagttttattgaaac

SEQ ID NO: 339121 - DNA, 16 bp, M. musculus
aaagttttattttggc

SEQ ID NO: 339122 - DNA, 16 bp, M. musculus
aaagttttctcttttt

SEQ ID NO: 339123 - DNA, 16 bp, M. musculus
aaagttttggaaaaat

SEQ ID NO: 339124 - DNA, 16 bp, M. musculus
aaagttttgtggatgg

SEQ ID NO: 339125 - DNA, 16 bp, M. musculus
aaagttttgtgtcttt

SEQ ID NO: 339126 - DNA, 16 bp, M. musculus
aaagtttttaaaaagg

SEQ ID NO: 339127 - DNA, 16 bp, M. musculus
aaagtttttaatttct

SEQ ID NO: 339128 - DNA, 16 bp, M. musculus
aaagttttttgcaaaa

SEQ ID NO: 339129 - DNA, 16 bp, M. musculus
aaagtttttttaaaag

SEQ ID NO: 339130 - DNA, 16 bp, M. musculus
aaataaaaaagcccag

SEQ ID NO: 339131 - DNA, 16 bp, M. musculus
aaataaaaacattccc

SEQ ID NO: 339132 - DNA, 16 bp, M. musculus
aaataaaaagcattta

SEQ ID NO: 339133 - DNA, 16 bp, M. musculus
aaataaaaatcaatgt

SEQ ID NO: 339134 - DNA, 16 bp, M. musculus
aaataaaaatgatcct

SEQ ID NO: 339135 - DNA, 16 bp, M. musculus
aaataaaaatgatttc

SEQ ID NO: 339136 - DNA, 16 bp, M. musculus
aaataaaaatgtacat

SEQ ID NO: 339137 - DNA, 16 bp, M. musculus
aaataaaacacatctt

SEQ ID NO: 339138 - DNA, 16 bp, M. musculus
aaataaaacacttttt

SEQ ID NO: 339139 - DNA, 16 bp, M. musculus
aaataaaacagtattt

SEQ ID NO: 339140 - DNA, 16 bp, M. musculus
aaataaaacatgtttt

SEQ ID NO: 339141 - DNA, 16 bp, M. musculus
aaataaaacattttct

SEQ ID NO: 339142 - DNA, 16 bp, M. musculus
aaataaaaccttttta

SEQ ID NO: 339143 - DNA, 16 bp, M. musculus
aaataaaactgatttt

SEQ ID NO: 339144 - DNA, 16 bp, M. musculus
aaataaaactgtttta

SEQ ID NO: 339145 - DNA, 16 bp, M. musculus
aaataaaactttgaag

SEQ ID NO: 339146 - DNA, 16 bp, M. musculus
aaataaaagacatttt

SEQ ID NO: 339147 - DNA, 16 bp, M. musculus
aaataaaagactgggc

SEQ ID NO: 339148 - DNA, 16 bp, M. musculus
aaataaaagacttttt

SEQ ID NO: 339149 - DNA, 17 bp, M. musculus
aaataaaagagccgagg

SEQ ID NO: 339150 - DNA, 16 bp, M. musculus
aaataaaagatgtttt

SEQ ID NO: 339151 - DNA, 16 bp, M. musculus
aaataaaagcttattt

SEQ ID NO: 339152 - DNA, 16 bp, M. musculus
aaataaaaggcagaga

SEQ ID NO: 339153 - DNA, 16 bp, M. musculus
aaataaaagtgatttt

SEQ ID NO: 339154 - DNA, 16 bp, M. musculus
aaataaaagtgtgtgt

SEQ ID NO: 339155 - DNA, 16 bp, M. musculus
aaataaaagtgtttgt

SEQ ID NO: 339156 - DNA, 16 bp, M. musculus
aaataaaataattgct

SEQ ID NO: 339157 - DNA, 16 bp, M. musculus
aaataaaataggcttt

SEQ ID NO: 339158 - DNA, 16 bp, M. musculus
aaataaaatagtcatt

SEQ ID NO: 339159 - DNA, 16 bp, M. musculus
aaataaaatatccaag

SEQ ID NO: 339160 - DNA, 16 bp, M. musculus
aaataaaatatgaact

SEQ ID NO: 339161 - DNA, 16 bp, M. musculus
aaataaaatcttgaga

SEQ ID NO: 339162 - DNA, 16 bp, M. musculus
aaataaaatctttcct

SEQ ID NO: 339163 - DNA, 16 bp, M. musculus
aaataaaatgaaatct

SEQ ID NO: 339164 - DNA, 16 bp, M. musculus
aaataaaatgaatctt

SEQ ID NO: 339165 - DNA, 16 bp, M. musculus
aaataaaatgacttta

SEQ ID NO: 339166 - DNA, 16 bp, M. musculus
aaataaaatgatacat

SEQ ID NO: 339167 - DNA, 16 bp, M. musculus
aaataaaatgcaaatt

SEQ ID NO: 339168 - DNA, 16 bp, M. musculus
aaataaaatggatttt

SEQ ID NO: 339169 - DNA, 16 bp, M. musculus
aaataaaatgtatcat

SEQ ID NO: 339170 - DNA, 16 bp, M. musculus
aaataaaatgtcttca

SEQ ID NO: 339171 - DNA, 16 bp, M. musculus
aaataaaatgtctttt

SEQ ID NO: 339172 - DNA, 16 bp, M. musculus
aaataaaatgtttact

SEQ ID NO: 339173 - DNA, 16 bp, M. musculus
aaataaaatgtttcca

SEQ ID NO: 339174 - DNA, 16 bp, M. musculus
aaataaaatgttttca

SEQ ID NO: 339175 - DNA, 16 bp, M. musculus
aaataaaattctgaat

SEQ ID NO: 339176 - DNA, 16 bp, M. musculus
aaataaaatttgcaca

SEQ ID NO: 339177 - DNA, 16 bp, M. musculus
aaataaacaattcttt

SEQ ID NO: 339178 - DNA, 16 bp, M. musculus
aaataaacatgtattt

SEQ ID NO: 339179 - DNA, 16 bp, M. musculus
aaataaacatgtttaa

SEQ ID NO: 339180 - DNA, 16 bp, M. musculus
aaataaacattaatgt

SEQ ID NO: 339181 - DNA, 16 bp, M. musculus
aaataaacatttcctt

SEQ ID NO: 339182 - DNA, 16 bp, M. musculus
aaataaacattttctt

SEQ ID NO: 339183 - DNA, 16 bp, M. musculus
aaataaaccattttct

SEQ ID NO: 339184 - DNA, 16 bp, M. musculus
aaataaaccatttttt

SEQ ID NO: 339185 - DNA, 16 bp, M. musculus
aaataaacccctttct

SEQ ID NO: 339186 - DNA, 16 bp, M. musculus
aaataaacccttcctt

SEQ ID NO: 339187 - DNA, 16 bp, M. musculus
aaataaacctttcttt

SEQ ID NO: 339188 - DNA, 16 bp, M. musculus
aaataaacctttttct

SEQ ID NO: 339189 - DNA, 16 bp, M. musculus
aaataaactcttcctt

SEQ ID NO: 339190 - DNA, 16 bp, M. musculus
aaataaactctttcct

SEQ ID NO: 339191 - DNA, 16 bp, M. musculus
aaataaactgtttcct

SEQ ID NO: 339192 - DNA, 16 bp, M. musculus
aaataaacttcatttt

SEQ ID NO: 339193 - DNA, 16 bp, M. musculus
aaataaacttcttttt

SEQ ID NO: 339194 - DNA, 16 bp, M. musculus
aaataaactttaaaag

SEQ ID NO: 339195 - DNA, 16 bp, M. musculus
aaataaagaaatcttt

SEQ ID NO: 339196 - DNA, 16 bp, M. musculus
aaataaagaaattatc

SEQ ID NO: 339197 - DNA, 16 bp, M. musculus
aaataaagaagatatc

SEQ ID NO: 339198 - DNA, 16 bp, M. musculus
aaataaagaattttca

SEQ ID NO: 339199 - DNA, 16 bp, M. musculus
aaataaagacagaatg

SEQ ID NO: 339200 - DNA, 16 bp, M. musculus
aaataaagacatttaa

SEQ ID NO: 339201 - DNA, 16 bp, M. musculus
aaataaagacatttta

SEQ ID NO: 339202 - DNA, 16 bp, M. musculus
aaataaagacttttta

SEQ ID NO: 339203 - DNA, 16 bp, M. musculus
aaataaagaggcagat

SEQ ID NO: 339204 - DNA, 16 bp, M. musculus
aaataaagatcttgct

SEQ ID NO: 339205 - DNA, 16 bp, M. musculus
aaataaagatttattg

SEQ ID NO: 339206 - DNA, 16 bp, M. musculus
aaataaagcatttaaa

SEQ ID NO: 339207 - DNA, 16 bp, M. musculus
aaataaaggcatgtgc

SEQ ID NO: 339208 - DNA, 16 bp, M. musculus
aaataaaggtgtgtgt

SEQ ID NO: 339209 - DNA, 16 bp, M. musculus
aaataaaggtttcaat

SEQ ID NO: 339210 - DNA, 16 bp, M. musculus
aaataaaggttttttt

SEQ ID NO: 339211 - DNA, 16 bp, M. musculus
aaataaagtatctaat

SEQ ID NO: 339212 - DNA, 16 bp, M. musculus
aaataaagtcaaccat

SEQ ID NO: 339213 - DNA, 16 bp, M. musculus
aaataaagtcttttta

SEQ ID NO: 339214 - DNA, 16 bp, M. musculus
aaataaagtgaaatct

SEQ ID NO: 339215 - DNA, 16 bp, M. musculus
aaataaagtgattttt

SEQ ID NO: 339216 - DNA, 16 bp, M. musculus
aaataaagttattttc

SEQ ID NO: 339217 - DNA, 16 bp, M. musculus
aaataaagttgccagc

SEQ ID NO: 339218 - DNA, 16 bp, M. musculus
aaataaagtttgcaag

SEQ ID NO: 339219 - DNA, 16 bp, M. musculus
aaataaataatgcatt

SEQ ID NO: 339220 - DNA, 16 bp, M. musculus
aaataaataattcctt

SEQ ID NO: 339221 - DNA, 16 bp, M. musculus
aaataaatacatgtgt

SEQ ID NO: 339222 - DNA, 16 bp, M. musculus
aaataaatacatgttt

SEQ ID NO: 339223 - DNA, 16 bp, M. musculus
aaataaatacattgaa

SEQ ID NO: 339224 - DNA, 16 bp, M. musculus
aaataaatacttttct

SEQ ID NO: 339225 - DNA, 16 bp, M. musculus
aaataaatactttttc

SEQ ID NO: 339226 - DNA, 16 bp, M. musculus
aaataaatagctaata

SEQ ID NO: 339227 - DNA, 16 bp, M. musculus
aaataaatagcttttt

SEQ ID NO: 339228 - DNA, 16 bp, M. musculus
aaataaatcacaaagg

SEQ ID NO: 339229 - DNA, 16 bp, M. musculus
aaataaatccttcctc

SEQ ID NO: 339230 - DNA, 16 bp, M. musculus
aaataaatccttcctt

SEQ ID NO: 339231 - DNA, 16 bp, M. musculus
aaataaatcctttctt

SEQ ID NO: 339232 - DNA, 16 bp, M. musculus
aaataaatctctctct

SEQ ID NO: 339233 - DNA, 16 bp, M. musculus
aaataaatctctttaa

SEQ ID NO: 339234 - DNA, 16 bp, M. musculus
aaataaatctcttttt

SEQ ID NO: 339235 - DNA, 16 bp, M. musculus
aaataaatcttaaaga

SEQ ID NO: 339236 - DNA, 16 bp, M. musculus
aaataaatcttagaaa

SEQ ID NO: 339237 - DNA, 16 bp, M. musculus
aaataaatcttgtaaa

SEQ ID NO: 339238 - DNA, 16 bp, M. musculus
aaataaatctttcttt

SEQ ID NO: 339239 - DNA, 16 bp, M. musculus
aaataaatctttttgt

SEQ ID NO: 339240 - DNA, 16 bp, M. musculus
aaataaatgaaatatc

SEQ ID NO: 339241 - DNA, 16 bp, M. musculus
aaataaatgaatacat

SEQ ID NO: 339242 - DNA, 16 bp, M. musculus
aaataaatgaatgcat

SEQ ID NO: 339243 - DNA, 16 bp, M. musculus
aaataaatgaatgttt

SEQ ID NO: 339244 - DNA, 16 bp, M. musculus
aaataaatgacatttt

SEQ ID NO: 339245 - DNA, 16 bp, M. musculus
aaataaatgcaatttt

SEQ ID NO: 339246 - DNA, 16 bp, M. musculus
aaataaatgcttcctt

SEQ ID NO: 339247 - DNA, 16 bp, M. musculus
aaataaatgtaaacat

SEQ ID NO: 339248 - DNA, 16 bp, M. musculus
aaataaatgtaacaga

SEQ ID NO: 339249 - DNA, 16 bp, M. musculus
aaataaatgtaataac

SEQ ID NO: 339250 - DNA, 16 bp, M. musculus
aaataaatgtaataca

SEQ ID NO: 339251 - DNA, 16 bp, M. musculus
aaataaatgtaatctt

SEQ ID NO: 339252 - DNA, 16 bp, M. musculus
aaataaatgtacaatt

SEQ ID NO: 339253 - DNA, 16 bp, M. musculus
aaataaatgtatacat

SEQ ID NO: 339254 - DNA, 16 bp, M. musculus
aaataaatgtctttaa

SEQ ID NO: 339255 - DNA, 16 bp, M. musculus
aaataaatgtcttttt

SEQ ID NO: 339256 - DNA, 16 bp, M. musculus
aaataaatgtgatttt

SEQ ID NO: 339257 - DNA, 16 bp, M. musculus
aaataaatgtgttttt

SEQ ID NO: 339258 - DNA, 16 bp, M. musculus
aaataaatgttcaaaa

SEQ ID NO: 339259 - DNA, 16 bp, M. musculus
aaataaatgtttacaa

SEQ ID NO: 339260 - DNA, 16 bp, M. musculus
aaataaatgtttcaaa

SEQ ID NO: 339261 - DNA, 16 bp, M. musculus
aaataaatgtttcctt

SEQ ID NO: 339262 - DNA, 16 bp, M. musculus
aaataaatgtttcttt

SEQ ID NO: 339263 - DNA, 16 bp, M. musculus
aaataaatgtttgcct

SEQ ID NO: 339264 - DNA, 16 bp, M. musculus
aaataaatgtttttgt

SEQ ID NO: 339265 - DNA, 16 bp, M. musculus
aaataaattaatgcaa

SEQ ID NO: 339266 - DNA, 16 bp, M. musculus
aaataaattccaaatg

SEQ ID NO: 339267 - DNA, 16 bp, M. musculus
aaataaattcttttca

SEQ ID NO: 339268 - DNA, 16 bp, M. musculus
aaataaattcttttct

SEQ ID NO: 339269 - DNA, 16 bp, M. musculus
aaataacagtaattaa

SEQ ID NO: 339270 - DNA, 16 bp, M. musculus
aaataacagttatgaa

SEQ ID NO: 339271 - DNA, 16 bp, M. musculus
aaataacagttctcag

SEQ ID NO: 339272 - DNA, 16 bp, M. musculus
aaataacatttttctg

SEQ ID NO: 339273 - DNA, 17 bp, M. musculus
aaataaccctattaaaa

SEQ ID NO: 339274 - DNA, 16 bp, M. musculus
aaataaccctttcctc

SEQ ID NO: 339275 - DNA, 16 bp, M. musculus
aaataacgctgctatg

SEQ ID NO: 339276 - DNA, 16 bp, M. musculus
aaataactatttctaa

SEQ ID NO: 339277 - DNA, 16 bp, M. musculus
aaataactctgtcttt

SEQ ID NO: 339278 - DNA, 16 bp, M. musculus
aaataactgagacaga

SEQ ID NO: 339279 - DNA, 16 bp, M. musculus
aaataagacattttaa

SEQ ID NO: 339280 - DNA, 16 bp, M. musculus
aaataagactttaaaa

SEQ ID NO: 339281 - DNA, 16 bp, M. musculus
aaataagcaagtgaaa

SEQ ID NO: 339282 - DNA, 16 bp, M. musculus
aaataagccaattcaa

SEQ ID NO: 339283 - DNA, 16 bp, M. musculus
aaataagccaggcgtg

SEQ ID NO: 339284 - DNA, 16 bp, M. musculus
aaataagccctctcct

SEQ ID NO: 339285 - DNA, 16 bp, M. musculus
aaataagcctcaacag

SEQ ID NO: 339286 - DNA, 16 bp, M. musculus
aaataaggagacaaag

SEQ ID NO: 339287 - DNA, 16 bp, M. musculus
aaataaggccatcctc

SEQ ID NO: 339288 - DNA, 27 bp, M. musculus
aaataaggctgctatgaacatagtgga

SEQ ID NO: 339289 - DNA, 16 bp, M. musculus
aaataagtcagactca

SEQ ID NO: 339290 - DNA, 16 bp, M. musculus
aaataagtcctttcct

SEQ ID NO: 339291 - DNA, 16 bp, M. musculus
aaataagtctgaagtt

SEQ ID NO: 339292 - DNA, 16 bp, M. musculus
aaataagtctttaaaa

SEQ ID NO: 339293 - DNA, 16 bp, M. musculus
aaataataaaagcagt

SEQ ID NO: 339294 - DNA, 16 bp, M. musculus
aaataatagaatgcca

SEQ ID NO: 339295 - DNA, 16 bp, M. musculus
aaataatatctttcca

SEQ ID NO: 339296 - DNA, 16 bp, M. musculus
aaataatattatggtt

SEQ ID NO: 339297 - DNA, 16 bp, M. musculus
aaataatcaaatacag

SEQ ID NO: 339298 - DNA, 16 bp, M. musculus
aaataatcaagggagg

SEQ ID NO: 339299 - DNA, 16 bp, M. musculus
aaataatcacactcag

SEQ ID NO: 339300 - DNA, 16 bp, M. musculus
aaataatcagaacata

SEQ ID NO: 339301 - DNA, 17 bp, M. musculus
aaataatcagaggacat

SEQ ID NO: 339302 - DNA, 16 bp, M. musculus
aaataatgaaaacatt

SEQ ID NO: 339303 - DNA, 16 bp, M. musculus
aaataatgcaattaaa

SEQ ID NO: 339304 - DNA, 16 bp, M. musculus
aaataatgtacatatt

SEQ ID NO: 339305 - DNA, 16 bp, M. musculus
aaataatgtgattttt

SEQ ID NO: 339306 - DNA, 16 bp, M. musculus
aaataatgtgtgtgtg

SEQ ID NO: 339307 - DNA, 16 bp, M. musculus
aaataatgttatggtt

SEQ ID NO: 339308 - DNA, 16 bp, M. musculus
aaataattattttcct

SEQ ID NO: 339309 - DNA, 16 bp, M. musculus
aaataattcaggttca

SEQ ID NO: 339310 - DNA, 16 bp, M. musculus
aaataattcctttaaa

SEQ ID NO: 339311 - DNA, 16 bp, M. musculus
aaataatttcaaatgt

SEQ ID NO: 339312 - DNA, 16 bp, M. musculus
aaataatttcagagcc

SEQ ID NO: 339313 - DNA, 16 bp, M. musculus
aaataatttctcattt

SEQ ID NO: 339314 - DNA, 16 bp, M. musculus
aaataatttctcttct

SEQ ID NO: 339315 - DNA, 16 bp, M. musculus
aaataattttatggtg

SEQ ID NO: 339316 - DNA, 16 bp, M. musculus
aaataattttatggtt

SEQ ID NO: 339317 - DNA, 16 bp, M. musculus
aaataattttccaaga

SEQ ID NO: 339318 - DNA, 16 bp, M. musculus
aaatacaaaaatattg

SEQ ID NO: 339319 - DNA, 16 bp, M. musculus
aaatacaaaatgtaca

SEQ ID NO: 339320 - DNA, 16 bp, M. musculus
aaatacaaatgtaaat

SEQ ID NO: 339321 - DNA, 16 bp, M. musculus
aaatacaaattgatgt

SEQ ID NO: 339322 - DNA, 16 bp, M. musculus
aaatacaaatttaaag

SEQ ID NO: 339323 - DNA, 16 bp, M. musculus
aaatacaagagatgga

SEQ ID NO: 339324 - DNA, 16 bp, M. musculus
aaatacaatgaaatat

SEQ ID NO: 339325 - DNA, 16 bp, M. musculus
aaatacaatttgctaa

SEQ ID NO: 339326 - DNA, 16 bp, M. musculus
aaatacaatttgtttt

SEQ ID NO: 339327 - DNA, 16 bp, M. musculus
aaatacaattttgttt

SEQ ID NO: 339328 - DNA, 16 bp, M. musculus
aaatacaatttttttc

SEQ ID NO: 339329 - DNA, 16 bp, M. musculus
aaatacacatgcacat

SEQ ID NO: 339330 - DNA, 16 bp, M. musculus
aaatacactttttaaa

SEQ ID NO: 339331 - DNA, 16 bp, M. musculus
aaatacagaagtggat

SEQ ID NO: 339332 - DNA, 16 bp, M. musculus
aaatacagagaaaatt

SEQ ID NO: 339333 - DNA, 16 bp, M. musculus
aaatacagagacaaag

SEQ ID NO: 339334 - DNA, 16 bp, M. musculus
aaatacagagttggat

SEQ ID NO: 339335 - DNA, 16 bp, M. musculus
aaatacagatgtgaat

SEQ ID NO: 339336 - DNA, 16 bp, M. musculus
aaatacagcattttca

SEQ ID NO: 339337 - DNA, 16 bp, M. musculus
aaatacaggagaaaac

SEQ ID NO: 339338 - DNA, 16 bp, M. musculus
aaatacaggcgaacac

SEQ ID NO: 339339 - DNA, 16 bp, M. musculus
aaatacagtatgtatt

SEQ ID NO: 339340 - DNA, 16 bp, M. musculus
aaatacagtttttaaa

SEQ ID NO: 339341 - DNA, 16 bp, M. musculus
aaatacatacatgcat

SEQ ID NO: 339342 - DNA, 16 bp, M. musculus
aaatacatacatgtaa

SEQ ID NO: 339343 - DNA, 16 bp, M. musculus
aaatacatatgtattt

SEQ ID NO: 339344 - DNA, 16 bp, M. musculus
aaatacatatgtgtat

SEQ ID NO: 339345 - DNA, 16 bp, M. musculus
aaatacatatttatgt

SEQ ID NO: 339346 - DNA, 16 bp, M. musculus
aaatacatccttaaaa

SEQ ID NO: 339347 - DNA, 16 bp, M. musculus
aaatacatcttagaaa

SEQ ID NO: 339348 - DNA, 16 bp, M. musculus
aaatacatgaaactca

SEQ ID NO: 339349 - DNA, 16 bp, M. musculus
aaatacatgcatatat

SEQ ID NO: 339350 - DNA, 16 bp, M. musculus
aaatacatgttttaaa

SEQ ID NO: 339351 - DNA, 16 bp, M. musculus
aaatacattatacaca

SEQ ID NO: 339352 - DNA, 16 bp, M. musculus
aaatacattcaaacag

SEQ ID NO: 339353 - DNA, 16 bp, M. musculus
aaatacattcttttct

SEQ ID NO: 339354 - DNA, 16 bp, M. musculus
aaatacatttatgaaa

SEQ ID NO: 339355 - DNA, 16 bp, M. musculus
aaatacatttctgttg

SEQ ID NO: 339356 - DNA, 16 bp, M. musculus
aaatacatttcttaaa

SEQ ID NO: 339357 - DNA, 16 bp, M. musculus
aaatacattttactta

SEQ ID NO: 339358 - DNA, 16 bp, M. musculus
aaatacattttcttct

SEQ ID NO: 339359 - DNA, 16 bp, M. musculus
aaatacattttgtttt

SEQ ID NO: 339360 - DNA, 16 bp, M. musculus
aaatacatttttctta

SEQ ID NO: 339361 - DNA, 16 bp, M. musculus
aaatacattttttcat

SEQ ID NO: 339362 - DNA, 16 bp, M. musculus
aaataccacatgttct

SEQ ID NO: 339363 - DNA, 16 bp, M. musculus
aaataccatgacaaaa

SEQ ID NO: 339364 - DNA, 16 bp, M. musculus
aaataccatgaccaaa

SEQ ID NO: 339365 - DNA, 16 bp, M. musculus
aaatacccaacagaag

SEQ ID NO: 339366 - DNA, 16 bp, M. musculus
aaatacctaagagaaa

SEQ ID NO: 339367 - DNA, 16 bp, M. musculus
aaatacctccaggaga

SEQ ID NO: 339368 - DNA, 16 bp, M. musculus
aaatacctttttttaa

SEQ ID NO: 339369 - DNA, 16 bp, M. musculus
aaatactaaatgtaca

SEQ ID NO: 339370 - DNA, 16 bp, M. musculus
aaatactatcatgaaa

SEQ ID NO: 339371 - DNA, 16 bp, M. musculus
aaatactctaccaact

SEQ ID NO: 339372 - DNA, 16 bp, M. musculus
aaatactgaaaataat

SEQ ID NO: 339373 - DNA, 16 bp, M. musculus
aaatactgaaaataca

SEQ ID NO: 339374 - DNA, 16 bp, M. musculus
aaatactgaaattaaa

SEQ ID NO: 339375 - DNA, 16 bp, M. musculus
aaatactgatattttg

SEQ ID NO: 339376 - DNA, 16 bp, M. musculus
aaatactggcagaaga

SEQ ID NO: 339377 - DNA, 16 bp, M. musculus
aaatactgggtcctgt

SEQ ID NO: 339378 - DNA, 16 bp, M. musculus
aaatactgttttattt

SEQ ID NO: 339379 - DNA, 16 bp, M. musculus
aaatacttgagaaaat

SEQ ID NO: 339380 - DNA, 16 bp, M. musculus
aaatacttgcaaacca

SEQ ID NO: 339381 - DNA, 16 bp, M. musculus
aaatacttgtatatgg

SEQ ID NO: 339382 - DNA, 16 bp, M. musculus
aaatacttgtttaaaa

SEQ ID NO: 339383 - DNA, 16 bp, M. musculus
aaatactttaaaaaga

SEQ ID NO: 339384 - DNA, 16 bp, M. musculus
aaatactttaaaaagt

SEQ ID NO: 339385 - DNA, 16 bp, M. musculus
aaatactttacatttt

SEQ ID NO: 339386 - DNA, 16 bp, M. musculus
aaatactttagaaaat

SEQ ID NO: 339387 - DNA, 16 bp, M. musculus
aaatactttgaaaaaa

SEQ ID NO: 339388 - DNA, 16 bp, M. musculus
aaatactttgaaaata

SEQ ID NO: 339389 - DNA, 16 bp, M. musculus
aaatactttgttttaa

SEQ ID NO: 339390 - DNA, 16 bp, M. musculus
aaatacttttaaaaag

SEQ ID NO: 339391 - DNA, 16 bp, M. musculus
aaatactttttgaaaa

SEQ ID NO: 339392 - DNA, 16 bp, M. musculus
aaatagaaaacatttt

SEQ ID NO: 339393 - DNA, 16 bp, M. musculus
aaatagaaacagaatg

SEQ ID NO: 339394 - DNA, 16 bp, M. musculus
aaatagaagcaatcat

SEQ ID NO: 339395 - DNA, 16 bp, M. musculus
aaatagacattttatt

SEQ ID NO: 339396 - DNA, 16 bp, M. musculus
aaatagaccttaagtg

SEQ ID NO: 339397 - DNA, 16 bp, M. musculus
aaatagacttaacaga

SEQ ID NO: 339398 - DNA, 16 bp, M. musculus
aaatagagagaaactt

SEQ ID NO: 339399 - DNA, 31 bp, M. musculus
aaatagataaccattatccaaaacatccaat

SEQ ID NO: 339400 - DNA, 17 bp, M. musculus
aaatagatctacctgaa

SEQ ID NO: 339401 - DNA, 16 bp, M. musculus
aaatagatgattgata

SEQ ID NO: 339402 - DNA, 16 bp, M. musculus
aaatagatgattttct

SEQ ID NO: 339403 - DNA, 16 bp, M. musculus
aaatagattctttttt

SEQ ID NO: 339404 - DNA, 16 bp, M. musculus
aaatagcaatgaaaat

SEQ ID NO: 339405 - DNA, 16 bp, M. musculus
aaatagcaccaggaga

SEQ ID NO: 339406 - DNA, 16 bp, M. musculus
aaatagcattttaata

SEQ ID NO: 339407 - DNA, 16 bp, M. musculus
aaatagctttgtgtgt

SEQ ID NO: 339408 - DNA, 16 bp, M. musculus
aaatagcttttaaaaa

SEQ ID NO: 339409 - DNA, 16 bp, M. musculus
aaataggaaatatttt

SEQ ID NO: 339410 - DNA, 16 bp, M. musculus
aaataggaagcagaga

SEQ ID NO: 339411 - DNA, 16 bp, M. musculus
aaataggcccagatta

SEQ ID NO: 339412 - DNA, 16 bp, M. musculus
aaataggctaaaatgt

SEQ ID NO: 339413 - DNA, 16 bp, M. musculus
aaataggcttgggaca

SEQ ID NO: 339414 - DNA, 16 bp, M. musculus
aaataggttttgaaaa

SEQ ID NO: 339415 - DNA, 16 bp, M. musculus
aaataggtttttaaaa

SEQ ID NO: 339416 - DNA, 16 bp, M. musculus
aaatagtagaaagcca

SEQ ID NO: 339417 - DNA, 16 bp, M. musculus
aaatagtcattttaaa

SEQ ID NO: 339418 - DNA, 16 bp, M. musculus
aaatagtctcccagcc

SEQ ID NO: 339419 - DNA, 16 bp, M. musculus
aaatagtgtgtgtgtg

SEQ ID NO: 339420 - DNA, 16 bp, M. musculus
aaatagttctttaaaa

SEQ ID NO: 339421 - DNA, 16 bp, M. musculus
aaatagtttctatttt

SEQ ID NO: 339422 - DNA, 16 bp, M. musculus
aaatagtttcttggtt

SEQ ID NO: 339423 - DNA, 16 bp, M. musculus
aaatagtttgtacaga

SEQ ID NO: 339424 - DNA, 16 bp, M. musculus
aaatagttttaaagta

SEQ ID NO: 339425 - DNA, 16 bp, M. musculus
aaatagttttatggtt

SEQ ID NO: 339426 - DNA, 16 bp, M. musculus
aaatataaaaagcagt

SEQ ID NO: 339427 - DNA, 16 bp, M. musculus
aaatataaactgaaat

SEQ ID NO: 339428 - DNA, 16 bp, M. musculus
aaatataaagaactca

SEQ ID NO: 339429 - DNA, 16 bp, M. musculus
aaatataaaggttttg

SEQ ID NO: 339430 - DNA, 16 bp, M. musculus
aaatataaatatgcat

SEQ ID NO: 339431 - DNA, 16 bp, M. musculus
aaatataaatgtacat

SEQ ID NO: 339432 - DNA, 16 bp, M. musculus
aaatataactcatttt

SEQ ID NO: 339433 - DNA, 16 bp, M. musculus
aaatataacttcaatt

SEQ ID NO: 339434 - DNA, 16 bp, M. musculus
aaatataagatacaat

SEQ ID NO: 339435 - DNA, 16 bp, M. musculus
aaatataatactcaga

SEQ ID NO: 339436 - DNA, 16 bp, M. musculus
aaatatacatgtattt

SEQ ID NO: 339437 - DNA, 16 bp, M. musculus
aaatataccacaattt

SEQ ID NO: 339438 - DNA, 16 bp, M. musculus
aaatatacccaagagg

SEQ ID NO: 339439 - DNA, 16 bp, M. musculus
aaatatataaggaaca

SEQ ID NO: 339440 - DNA, 16 bp, M. musculus
aaatatatacatgcag

SEQ ID NO: 339441 - DNA, 16 bp, M. musculus
aaatatatacttacat

SEQ ID NO: 339442 - DNA, 40 bp, M. musculus
aaatatataggagacgtgggttgctcacctcagaaggcaa

SEQ ID NO: 339443 - DNA, 16 bp, M. musculus
aaatatatatccatat

SEQ ID NO: 339444 - DNA, 16 bp, M. musculus
aaatatatcatcctga

SEQ ID NO: 339445 - DNA, 16 bp, M. musculus
aaatatatctgtatat

SEQ ID NO: 339446 - DNA, 16 bp, M. musculus
aaatatatgaaatgga

SEQ ID NO: 339447 - DNA, 16 bp, M. musculus
aaatatatgagactat

SEQ ID NO: 339448 - DNA, 16 bp, M. musculus
aaatatatgtatatgt

SEQ ID NO: 339449 - DNA, 16 bp, M. musculus
aaatatatgtatctat

SEQ ID NO: 339450 - DNA, 16 bp, M. musculus
aaatatatgtatgtat

SEQ ID NO: 339451 - DNA, 16 bp, M. musculus
aaatatattcaaagaa

SEQ ID NO: 339452 - DNA, 16 bp, M. musculus
aaatatattctctctc

SEQ ID NO: 339453 - DNA, 16 bp, M. musculus
aaatatattgaaattg

SEQ ID NO: 339454 - DNA, 16 bp, M. musculus
aaatatattgtgtgaa

SEQ ID NO: 339455 - DNA, 16 bp, M. musculus
aaatatatttctgaaa

SEQ ID NO: 339456 - DNA, 16 bp, M. musculus
aaatatattttcatct

SEQ ID NO: 339457 - DNA, 16 bp, M. musculus
aaatatattttgaatc

SEQ ID NO: 339458 - DNA, 16 bp, M. musculus
aaatatcaaagttaaa

SEQ ID NO: 339459 - DNA, 16 bp, M. musculus
aaatatcagggcatag

SEQ ID NO: 339460 - DNA, 16 bp, M. musculus
aaatatcatcttgagt

SEQ ID NO: 339461 - DNA, 16 bp, M. musculus
aaatatcatgtgtcct

SEQ ID NO: 339462 - DNA, 16 bp, M. musculus
aaatatccaacaaagg

SEQ ID NO: 339463 - DNA, 16 bp, M. musculus
aaatatcctgcaacaa

SEQ ID NO: 339464 - DNA, 16 bp, M. musculus
aaatatccttttaaaa

SEQ ID NO: 339465 - DNA, 16 bp, M. musculus
aaatatctagacagat

SEQ ID NO: 339466 - DNA, 16 bp, M. musculus
aaatatctcagtaaca

SEQ ID NO: 339467 - DNA, 16 bp, M. musculus
aaatatctgataaaag

SEQ ID NO: 339468 - DNA, 16 bp, M. musculus
aaatatctgatataca

SEQ ID NO: 339469 - DNA, 16 bp, M. musculus
aaatatctgatatgta

SEQ ID NO: 339470 - DNA, 16 bp, M. musculus
aaatatctgcctctga

SEQ ID NO: 339471 - DNA, 16 bp, M. musculus
aaatatctgtgttttc

SEQ ID NO: 339472 - DNA, 16 bp, M. musculus
aaatatcttccatgct

SEQ ID NO: 339473 - DNA, 16 bp, M. musculus
aaatatcttggtataa

SEQ ID NO: 339474 - DNA, 16 bp, M. musculus
aaatatctttgtgtga

SEQ ID NO: 339475 - DNA, 16 bp, M. musculus
aaatatgaaacatttt

SEQ ID NO: 339476 - DNA, 16 bp, M. musculus
aaatatgaacatttta

SEQ ID NO: 339477 - DNA, 16 bp, M. musculus
aaatatgacattttaa

SEQ ID NO: 339478 - DNA, 16 bp, M. musculus
aaatatgcaattaaaa

SEQ ID NO: 339479 - DNA, 16 bp, M. musculus
aaatatgcatacatat

SEQ ID NO: 339480 - DNA, 16 bp, M. musculus
aaatatgcattttaaa

SEQ ID NO: 339481 - DNA, 16 bp, M. musculus
aaatatgctttaaaaa

SEQ ID NO: 339482 - DNA, 16 bp, M. musculus
aaatatgctttctttt

SEQ ID NO: 339483 - DNA, 16 bp, M. musculus
aaatatggaacattta

SEQ ID NO: 339484 - DNA, 16 bp, M. musculus
aaatatggatccattt

SEQ ID NO: 339485 - DNA, 16 bp, M. musculus
aaatatgggaatgtat

SEQ ID NO: 339486 - DNA, 16 bp, M. musculus
aaatatggtttattta

SEQ ID NO: 339487 - DNA, 16 bp, M. musculus
aaatatgtaaatatgt

SEQ ID NO: 339488 - DNA, 16 bp, M. musculus
aaatatgtatatgtat

SEQ ID NO: 339489 - DNA, 16 bp, M. musculus
aaatatgtatgtgtat

SEQ ID NO: 339490 - DNA, 16 bp, M. musculus
aaatatgtatttacat

SEQ ID NO: 339491 - DNA, 16 bp, M. musculus
aaatatgtattttctt

SEQ ID NO: 339492 - DNA, 17 bp, M. musculus
aaatatgtcaggctttt

SEQ ID NO: 339493 - DNA, 16 bp, M. musculus
aaatatgtgtatttat

SEQ ID NO: 339494 - DNA, 16 bp, M. musculus
aaatatgtgtgtgtgt

SEQ ID NO: 339495 - DNA, 16 bp, M. musculus
aaatatgttagatcca

SEQ ID NO: 339496 - DNA, 16 bp, M. musculus
aaatatgttcatattt

SEQ ID NO: 339497 - DNA, 16 bp, M. musculus
aaatatgtttttttct

SEQ ID NO: 339498 - DNA, 16 bp, M. musculus
aaatattaaaacttga

SEQ ID NO: 339499 - DNA, 16 bp, M. musculus
aaatattaaaatggct

SEQ ID NO: 339500 - DNA, 16 bp, M. musculus
aaatattaaaatgtgt

SEQ ID NO: 339501 - DNA, 16 bp, M. musculus
aaatattaattcagaa

SEQ ID NO: 339502 - DNA, 16 bp, M. musculus
aaatattatatgtatg

SEQ ID NO: 339503 - DNA, 16 bp, M. musculus
aaatattcaatggaaa

SEQ ID NO: 339504 - DNA, 16 bp, M. musculus
aaatattcacatattt

SEQ ID NO: 339505 - DNA, 16 bp, M. musculus
aaatattcagccaaga

SEQ ID NO: 339506 - DNA, 16 bp, M. musculus
aaatattcaggaaaaa

SEQ ID NO: 339507 - DNA, 16 bp, M. musculus
aaatattcaggtgaca

SEQ ID NO: 339508 - DNA, 16 bp, M. musculus
aaatattcatgtttat

SEQ ID NO: 339509 - DNA, 16 bp, M. musculus
aaatattcattttcta

SEQ ID NO: 339510 - DNA, 16 bp, M. musculus
aaatattccagttatt

SEQ ID NO: 339511 - DNA, 16 bp, M. musculus
aaatattcctctgttg

SEQ ID NO: 339512 - DNA, 16 bp, M. musculus
aaatattctgtagata

SEQ ID NO: 339513 - DNA, 16 bp, M. musculus
aaatattgaaattatc

SEQ ID NO: 339514 - DNA, 16 bp, M. musculus
aaatattgatattttg

SEQ ID NO: 339515 - DNA, 16 bp, M. musculus
aaatattgtcttcttt

SEQ ID NO: 339516 - DNA, 16 bp, M. musculus
aaatattgtgtgtgtg

SEQ ID NO: 339517 - DNA, 16 bp, M. musculus
aaatatttaaaaacag

SEQ ID NO: 339518 - DNA, 16 bp, M. musculus
aaatatttacattaca

SEQ ID NO: 339519 - DNA, 16 bp, M. musculus
aaatatttacatttga

SEQ ID NO: 339520 - DNA, 16 bp, M. musculus
aaatatttacattttg

SEQ ID NO: 339521 - DNA, 16 bp, M. musculus
aaatatttactcattt

SEQ ID NO: 339522 - DNA, 16 bp, M. musculus
aaatatttagaggaag

SEQ ID NO: 339523 - DNA, 16 bp, M. musculus
aaatatttatcaagca

SEQ ID NO: 339524 - DNA, 16 bp, M. musculus
aaatatttatttctga

SEQ ID NO: 339525 - DNA, 16 bp, M. musculus
aaatatttcaaaagaa

SEQ ID NO: 339526 - DNA, 16 bp, M. musculus
aaatatttcctttctt

SEQ ID NO: 339527 - DNA, 16 bp, M. musculus
aaatatttctacctga

SEQ ID NO: 339528 - DNA, 16 bp, M. musculus
aaatatttctgaaata

SEQ ID NO: 339529 - DNA, 16 bp, M. musculus
aaatatttctgtgagc

SEQ ID NO: 339530 - DNA, 16 bp, M. musculus
aaatatttcttcttct

SEQ ID NO: 339531 - DNA, 16 bp, M. musculus
aaatatttctttgaaa

SEQ ID NO: 339532 - DNA, 16 bp, M. musculus
aaatatttctttgatt

SEQ ID NO: 339533 - DNA, 16 bp, M. musculus
aaatatttgaaggaaa

SEQ ID NO: 339534 - DNA, 16 bp, M. musculus
aaatatttgaattctt

SEQ ID NO: 339535 - DNA, 16 bp, M. musculus
aaatatttgagcctat

SEQ ID NO: 339536 - DNA, 16 bp, M. musculus
aaatatttgaggaaaa

SEQ ID NO: 339537 - DNA, 16 bp, M. musculus
aaatatttgatatgta

SEQ ID NO: 339538 - DNA, 16 bp, M. musculus
aaatatttgattttct

SEQ ID NO: 339539 - DNA, 16 bp, M. musculus
aaatatttgctgagtg

SEQ ID NO: 339540 - DNA, 16 bp, M. musculus
aaatatttggaatgga

SEQ ID NO: 339541 - DNA, 16 bp, M. musculus
aaatatttgtaaaagt

SEQ ID NO: 339542 - DNA, 16 bp, M. musculus
aaatatttgtacatat

SEQ ID NO: 339543 - DNA, 16 bp, M. musculus
aaatattttaaaggta

SEQ ID NO: 339544 - DNA, 16 bp, M. musculus
aaatattttaagcaaa

SEQ ID NO: 339545 - DNA, 16 bp, M. musculus
aaatattttacaaatg

SEQ ID NO: 339546 - DNA, 16 bp, M. musculus
aaatattttactttca

SEQ ID NO: 339547 - DNA, 16 bp, M. musculus
aaatattttattgagt

SEQ ID NO: 339548 - DNA, 16 bp, M. musculus
aaatattttcagaaat

SEQ ID NO: 339549 - DNA, 16 bp, M. musculus
aaatattttcagttct

SEQ ID NO: 339550 - DNA, 16 bp, M. musculus
aaatattttcatgatt

SEQ ID NO: 339551 - DNA, 16 bp, M. musculus
aaatattttcatgtct

SEQ ID NO: 339552 - DNA, 16 bp, M. musculus
aaatattttccagttt

SEQ ID NO: 339553 - DNA, 16 bp, M. musculus
aaatattttccttcat

SEQ ID NO: 339554 - DNA, 16 bp, M. musculus
aaatattttctactta

SEQ ID NO: 339555 - DNA, 16 bp, M. musculus
aaatattttctgtatt

SEQ ID NO: 339556 - DNA, 16 bp, M. musculus
aaatattttctgtttt

SEQ ID NO: 339557 - DNA, 16 bp, M. musculus
aaatattttcttcctt

SEQ ID NO: 339558 - DNA, 16 bp, M. musculus
aaatattttcttctct

SEQ ID NO: 339559 - DNA, 16 bp, M. musculus
aaatattttcttttcc

SEQ ID NO: 339560 - DNA, 16 bp, M. musculus
aaatattttgaatcat

SEQ ID NO: 339561 - DNA, 16 bp, M. musculus
aaatattttgatttct

SEQ ID NO: 339562 - DNA, 16 bp, M. musculus
aaatatttttcacaaa

SEQ ID NO: 339563 - DNA, 16 bp, M. musculus
aaatatttttctgaaa

SEQ ID NO: 339564 - DNA, 16 bp, M. musculus
aaatatttttcttgta

SEQ ID NO: 339565 - DNA, 16 bp, M. musculus
aaatatttttgaatga

SEQ ID NO: 339566 - DNA, 16 bp, M. musculus
aaatcaaaaagaggga

SEQ ID NO: 339567 - DNA, 16 bp, M. musculus
aaatcaaaaggaccct

SEQ ID NO: 339568 - DNA, 16 bp, M. musculus
aaatcaaaaggactct

SEQ ID NO: 339569 - DNA, 16 bp, M. musculus
aaatcaaaatgtattt

SEQ ID NO: 339570 - DNA, 16 bp, M. musculus
aaatcaaagaacacat

SEQ ID NO: 339571 - DNA, 16 bp, M. musculus
aaatcaaagaacccca

SEQ ID NO: 339572 - DNA, 16 bp, M. musculus
aaatcaaagaatatct

SEQ ID NO: 339573 - DNA, 16 bp, M. musculus
aaatcaaagatgatct

SEQ ID NO: 339574 - DNA, 16 bp, M. musculus
aaatcaaagcaaaacc

SEQ ID NO: 339575 - DNA, 16 bp, M. musculus
aaatcaaatgatatgt

SEQ ID NO: 339576 - DNA, 16 bp, M. musculus
aaatcaaccaggtgga

SEQ ID NO: 339577 - DNA, 16 bp, M. musculus
aaatcaaccttttcct

SEQ ID NO: 339578 - DNA, 16 bp, M. musculus
aaatcaacttccaact

SEQ ID NO: 339579 - DNA, 16 bp, M. musculus
aaatcaagaaccaatt

SEQ ID NO: 339580 - DNA, 16 bp, M. musculus
aaatcaagaagaagga

SEQ ID NO: 339581 - DNA, 16 bp, M. musculus
aaatcaataaaatgat

SEQ ID NO: 339582 - DNA, 16 bp, M. musculus
aaatcaatcaagtgga

SEQ ID NO: 339583 - DNA, 16 bp, M. musculus
aaatcaatctacagat

SEQ ID NO: 339584 - DNA, 16 bp, M. musculus
aaatcaatttggcaat

SEQ ID NO: 339585 - DNA, 16 bp, M. musculus
aaatcacaggaggaac

SEQ ID NO: 339586 - DNA, 16 bp, M. musculus
aaatcacattttctgt

SEQ ID NO: 339587 - DNA, 20 bp, M. musculus
aaatcacctgagtgctgact

SEQ ID NO: 339588 - DNA, 18 bp, M. musculus
aaatcacttaaagaaata

SEQ ID NO: 339589 - DNA, 16 bp, M. musculus
aaatcacttacagtca

SEQ ID NO: 339590 - DNA, 16 bp, M. musculus
aaatcacttttcctta

SEQ ID NO: 339591 - DNA, 16 bp, M. musculus
aaatcagaagttcaag

SEQ ID NO: 339592 - DNA, 17 bp, M. musculus
aaatcagactggtggtt

SEQ ID NO: 339593 - DNA, 16 bp, M. musculus
aaatcagagaagaaat

SEQ ID NO: 339594 - DNA, 16 bp, M. musculus
aaatcagcaacagaat

SEQ ID NO: 339595 - DNA, 16 bp, M. musculus
aaatcagcatatcctt

SEQ ID NO: 339596 - DNA, 16 bp, M. musculus
aaatcaggacctttgg

SEQ ID NO: 339597 - DNA, 16 bp, M. musculus
aaatcaggagctgtca

SEQ ID NO: 339598 - DNA, 16 bp, M. musculus
aaatcaggatcaaatt

SEQ ID NO: 339599 - DNA, 16 bp, M. musculus
aaatcaggctgaacaa

SEQ ID NO: 339600 - DNA, 16 bp, M. musculus
aaatcagggacaagat

SEQ ID NO: 339601 - DNA, 16 bp, M. musculus
aaatcagggcaggaac

SEQ ID NO: 339602 - DNA, 16 bp, M. musculus
aaatcagggctggaga

SEQ ID NO: 339603 - DNA, 16 bp, M. musculus
aaatcagtaaggaaaa

SEQ ID NO: 339604 - DNA, 16 bp, M. musculus
aaatcagtcattaaaa

SEQ ID NO: 339605 - DNA, 16 bp, M. musculus
aaatcagtctggaagt

SEQ ID NO: 339606 - DNA, 16 bp, M. musculus
aaatcagtggctttcc

SEQ ID NO: 339607 - DNA, 16 bp, M. musculus
aaatcagtggcttttc

SEQ ID NO: 339608 - DNA, 16 bp, M. musculus
aaatcagtgtggagat

SEQ ID NO: 339609 - DNA, 16 bp, M. musculus
aaatcagtttgatggt

SEQ ID NO: 339610 - DNA, 16 bp, M. musculus
aaatcagttttatttt

SEQ ID NO: 339611 - DNA, 16 bp, M. musculus
aaatcatacctttatt

SEQ ID NO: 339612 - DNA, 16 bp, M. musculus
aaatcatcagggaaat

SEQ ID NO: 339613 - DNA, 16 bp, M. musculus
aaatcatgacatttgc

SEQ ID NO: 339614 - DNA, 16 bp, M. musculus
aaatcatgttcttttt

SEQ ID NO: 339615 - DNA, 16 bp, M. musculus
aaatcatgttttcttt

SEQ ID NO: 339616 - DNA, 16 bp, M. musculus
aaatcattggcctttc

SEQ ID NO: 339617 - DNA, 16 bp, M. musculus
aaatcatttaaaaatg

SEQ ID NO: 339618 - DNA, 16 bp, M. musculus
aaatcatttaactggg

SEQ ID NO: 339619 - DNA, 16 bp, M. musculus
aaatcattttcctttt

SEQ ID NO: 339620 - DNA, 16 bp, M. musculus
aaatcatttttctcca

SEQ ID NO: 339621 - DNA, 16 bp, M. musculus
aaatccaaaaatcatc

SEQ ID NO: 339622 - DNA, 16 bp, M. musculus
aaatccaaaacccatt

SEQ ID NO: 339623 - DNA, 16 bp, M. musculus
aaatccaaagactttt

SEQ ID NO: 339624 - DNA, 16 bp, M. musculus
aaatccaaatgaaaac

SEQ ID NO: 339625 - DNA, 16 bp, M. musculus
aaatccaacaaccctt

SEQ ID NO: 339626 - DNA, 16 bp, M. musculus
aaatccaacattcaca

SEQ ID NO: 339627 - DNA, 16 bp, M. musculus
aaatccaactgtaagg

SEQ ID NO: 339628 - DNA, 16 bp, M. musculus
aaatccaagaaaacat

SEQ ID NO: 339629 - DNA, 16 bp, M. musculus
aaatccaagaagatct

SEQ ID NO: 339630 - DNA, 16 bp, M. musculus
aaatccaagaatgact

SEQ ID NO: 339631 - DNA, 16 bp, M. musculus
aaatccaagacccatt

SEQ ID NO: 339632 - DNA, 16 bp, M. musculus
aaatccaatcagatat

SEQ ID NO: 339633 - DNA, 16 bp, M. musculus
aaatccagaaaatcat

SEQ ID NO: 339634 - DNA, 16 bp, M. musculus
aaatccagacactatt

SEQ ID NO: 339635 - DNA, 16 bp, M. musculus
aaatccagagtccttt

SEQ ID NO: 339636 - DNA, 16 bp, M. musculus
aaatccagctgtaagg

SEQ ID NO: 339637 - DNA, 16 bp, M. musculus
aaatccagctgtgtca

SEQ ID NO: 339638 - DNA, 16 bp, M. musculus
aaatccaggacacagt

SEQ ID NO: 339639 - DNA, 16 bp, M. musculus
aaatccaggatgcaat

SEQ ID NO: 339640 - DNA, 16 bp, M. musculus
aaatccaggcatggtg

SEQ ID NO: 339641 - DNA, 16 bp, M. musculus
aaatccagtccttcaa

SEQ ID NO: 339642 - DNA, 16 bp, M. musculus
aaatccagtctcaaaa

SEQ ID NO: 339643 - DNA, 16 bp, M. musculus
aaatccataaagaaca

SEQ ID NO: 339644 - DNA, 16 bp, M. musculus
aaatccatcaacctaa

SEQ ID NO: 339645 - DNA, 16 bp, M. musculus
aaatccatccattctt

SEQ ID NO: 339646 - DNA, 16 bp, M. musculus
aaatccatctacctct

SEQ ID NO: 339647 - DNA, 16 bp, M. musculus
aaatccatctgcctct

SEQ ID NO: 339648 - DNA, 16 bp, M. musculus
aaatccatttctttca

SEQ ID NO: 339649 - DNA, 16 bp, M. musculus
aaatccatttgattca

SEQ ID NO: 339650 - DNA, 16 bp, M. musculus
aaatccatttgtatca

SEQ ID NO: 339651 - DNA, 16 bp, M. musculus
aaatcccagaaataaa

SEQ ID NO: 339652 - DNA, 16 bp, M. musculus
aaatcccagcactgaa

SEQ ID NO: 339653 - DNA, 16 bp, M. musculus
aaatcccagcatccac

SEQ ID NO: 339654 - DNA, 16 bp, M. musculus
aaatcccagcattcag

SEQ ID NO: 339655 - DNA, 16 bp, M. musculus
aaatcccagtacttgg

SEQ ID NO: 339656 - DNA, 16 bp, M. musculus
aaatcccccatcccct

SEQ ID NO: 339657 - DNA, 16 bp, M. musculus
aaatcccctgcctctg

SEQ ID NO: 339658 - DNA, 16 bp, M. musculus
aaatccctaaaagaat

SEQ ID NO: 339659 - DNA, 16 bp, M. musculus
aaatccctgaatagaa

SEQ ID NO: 339660 - DNA, 16 bp, M. musculus
aaatcctaagttccag

SEQ ID NO: 339661 - DNA, 16 bp, M. musculus
aaatcctatcctgaaa

SEQ ID NO: 339662 - DNA, 16 bp, M. musculus
aaatcctatttcaaaa

SEQ ID NO: 339663 - DNA, 17 bp, M. musculus
aaatcctccaagaagaa

SEQ ID NO: 339664 - DNA, 16 bp, M. musculus
aaatcctgccttgaaa

SEQ ID NO: 339665 - DNA, 16 bp, M. musculus
aaatcctggagatgga

SEQ ID NO: 339666 - DNA, 16 bp, M. musculus
aaatcctgggatgaga

SEQ ID NO: 339667 - DNA, 16 bp, M. musculus
aaatcctgggtcctgt

SEQ ID NO: 339668 - DNA, 16 bp, M. musculus
aaatcctgtctcagga

SEQ ID NO: 339669 - DNA, 16 bp, M. musculus
aaatcctgtcttcaaa

SEQ ID NO: 339670 - DNA, 16 bp, M. musculus
aaatcctgttttaaaa

SEQ ID NO: 339671 - DNA, 16 bp, M. musculus
aaatccttagctgtca

SEQ ID NO: 339672 - DNA, 16 bp, M. musculus
aaatccttgccagcat

SEQ ID NO: 339673 - DNA, 16 bp, M. musculus
aaatcctttaaagaaa

SEQ ID NO: 339674 - DNA, 16 bp, M. musculus
aaatcctttcttttat

SEQ ID NO: 339675 - DNA, 16 bp, M. musculus
aaatcctttgccgttt

SEQ ID NO: 339676 - DNA, 16 bp, M. musculus
aaatccttttctcccc

SEQ ID NO: 339677 - DNA, 16 bp, M. musculus
aaatctaaacagaatt

SEQ ID NO: 339678 - DNA, 16 bp, M. musculus
aaatctaaagaatcat

SEQ ID NO: 339679 - DNA, 16 bp, M. musculus
aaatctaaatcttaga

SEQ ID NO: 339680 - DNA, 16 bp, M. musculus
aaatctacattcttcc

SEQ ID NO: 339681 - DNA, 16 bp, M. musculus
aaatctaccacatttt

SEQ ID NO: 339682 - DNA, 16 bp, M. musculus
aaatctaccatgatga

SEQ ID NO: 339683 - DNA, 16 bp, M. musculus
aaatctattcaaacca

SEQ ID NO: 339684 - DNA, 16 bp, M. musculus
aaatctcaaatacaca

SEQ ID NO: 339685 - DNA, 16 bp, M. musculus
aaatctcatctgactg

SEQ ID NO: 339686 - DNA, 16 bp, M. musculus
aaatctctaaaactgt

SEQ ID NO: 339687 - DNA, 16 bp, M. musculus
aaatctctctttaatt

SEQ ID NO: 339688 - DNA, 16 bp, M. musculus
aaatctgaaataaaat

SEQ ID NO: 339689 - DNA, 26 bp, M. musculus
aaatctgcaggacctgagataaagaa

SEQ ID NO: 339690 - DNA, 17 bp, M. musculus
aaatctgccccttacaa

SEQ ID NO: 339691 - DNA, 16 bp, M. musculus
aaatctgcctgctctg

SEQ ID NO: 339692 - DNA, 16 bp, M. musculus
aaatctggaacactat

SEQ ID NO: 339693 - DNA, 16 bp, M. musculus
aaatctggcaaatgga

SEQ ID NO: 339694 - DNA, 16 bp, M. musculus
aaatctgggcaacaga

SEQ ID NO: 339695 - DNA, 16 bp, M. musculus
aaatctggtgtgattc

SEQ ID NO: 339696 - DNA, 16 bp, M. musculus
aaatctgtatgaaatg

SEQ ID NO: 339697 - DNA, 16 bp, M. musculus
aaatctgtatttttaa

SEQ ID NO: 339698 - DNA, 16 bp, M. musculus
aaatctgtgaagaatt

SEQ ID NO: 339699 - DNA, 16 bp, M. musculus
aaatctgttaaaaaaa

SEQ ID NO: 339700 - DNA, 16 bp, M. musculus
aaatctgttggtggtc

SEQ ID NO: 339701 - DNA, 16 bp, M. musculus
aaatctgttttaaaat

SEQ ID NO: 339702 - DNA, 16 bp, M. musculus
aaatctgttttctttt

SEQ ID NO: 339703 - DNA, 16 bp, M. musculus
aaatcttaaagaaaga

SEQ ID NO: 339704 - DNA, 16 bp, M. musculus
aaatcttcacaggacc

SEQ ID NO: 339705 - DNA, 19 bp, M. musculus
aaatcttcatcattatgaa

SEQ ID NO: 339706 - DNA, 16 bp, M. musculus
aaatcttcattcacat

SEQ ID NO: 339707 - DNA, 17 bp, M. musculus
aaatcttccaagatgaa

SEQ ID NO: 339708 - DNA, 16 bp, M. musculus
aaatcttcctctgatt

SEQ ID NO: 339709 - DNA, 16 bp, M. musculus
aaatcttcctgcctct

SEQ ID NO: 339710 - DNA, 16 bp, M. musculus
aaatcttctcatcaca

SEQ ID NO: 339711 - DNA, 16 bp, M. musculus
aaatcttctttctcat

SEQ ID NO: 339712 - DNA, 16 bp, M. musculus
aaatcttgaaaaagaa

SEQ ID NO: 339713 - DNA, 16 bp, M. musculus
aaatctttaaaaacca

SEQ ID NO: 339714 - DNA, 16 bp, M. musculus
aaatctttaaaaatga

SEQ ID NO: 339715 - DNA, 16 bp, M. musculus
aaatctttaaaagaaa

SEQ ID NO: 339716 - DNA, 16 bp, M. musculus
aaatctttaaaaggaa

SEQ ID NO: 339717 - DNA, 16 bp, M. musculus
aaatctttaaggaaaa

SEQ ID NO: 339718 - DNA, 16 bp, M. musculus
aaatctttccattttt

SEQ ID NO: 339719 - DNA, 16 bp, M. musculus
aaatctttctggaata

SEQ ID NO: 339720 - DNA, 16 bp, M. musculus
aaatctttctggtata

SEQ ID NO: 339721 - DNA, 16 bp, M. musculus
aaatctttgaaataaa

SEQ ID NO: 339722 - DNA, 18 bp, M. musculus
aaatctttgggctggagc

SEQ ID NO: 339723 - DNA, 16 bp, M. musculus
aaatctttgttctcat

SEQ ID NO: 339724 - DNA, 16 bp, M. musculus
aaatcttttaaagact

SEQ ID NO: 339725 - DNA, 16 bp, M. musculus
aaatcttttaagaaaa

SEQ ID NO: 339726 - DNA, 16 bp, M. musculus
aaatctttttacaatt

SEQ ID NO: 339727 - DNA, 16 bp, M. musculus
aaatcttttttaaaag

SEQ ID NO: 339728 - DNA, 16 bp, M. musculus
aaatgaaaacaatttt

SEQ ID NO: 339729 - DNA, 16 bp, M. musculus
aaatgaaaacatctaa

SEQ ID NO: 339730 - DNA, 16 bp, M. musculus
aaatgaaaacatttaa

SEQ ID NO: 339731 - DNA, 16 bp, M. musculus
aaatgaaaactacttt

SEQ ID NO: 339732 - DNA, 16 bp, M. musculus
aaatgaaaataatttc

SEQ ID NO: 339733 - DNA, 16 bp, M. musculus
aaatgaaaatattcaa

SEQ ID NO: 339734 - DNA, 16 bp, M. musculus
aaatgaaaatatttct

SEQ ID NO: 339735 - DNA, 16 bp, M. musculus
aaatgaaaatgatttt

SEQ ID NO: 339736 - DNA, 16 bp, M. musculus
aaatgaaaatgcattt

SEQ ID NO: 339737 - DNA, 16 bp, M. musculus
aaatgaaaatgtttct

SEQ ID NO: 339738 - DNA, 16 bp, M. musculus
aaatgaaacacatttt

SEQ ID NO: 339739 - DNA, 16 bp, M. musculus
aaatgaaactttaaaa

SEQ ID NO: 339740 - DNA, 16 bp, M. musculus
aaatgaaagaaagcag

SEQ ID NO: 339741 - DNA, 16 bp, M. musculus
aaatgaaagcagtcct

SEQ ID NO: 339742 - DNA, 16 bp, M. musculus
aaatgaaatatctgta

SEQ ID NO: 339743 - DNA, 16 bp, M. musculus
aaatgaaatattttgt

SEQ ID NO: 339744 - DNA, 16 bp, M. musculus
aaatgaaatcattttt

SEQ ID NO: 339745 - DNA, 16 bp, M. musculus
aaatgaaatcttgaaa

SEQ ID NO: 339746 - DNA, 16 bp, M. musculus
aaatgaaatggcaaat

SEQ ID NO: 339747 - DNA, 16 bp, M. musculus
aaatgaaattatttct

SEQ ID NO: 339748 - DNA, 16 bp, M. musculus
aaatgaaatttacttt

SEQ ID NO: 339749 - DNA, 16 bp, M. musculus
aaatgaacacacaaac

SEQ ID NO: 339750 - DNA, 16 bp, M. musculus
aaatgaacacatggat

SEQ ID NO: 339751 - DNA, 16 bp, M. musculus
aaatgaacatttgaaa

SEQ ID NO: 339752 - DNA, 16 bp, M. musculus
aaatgaaccatatttt

SEQ ID NO: 339753 - DNA, 16 bp, M. musculus
aaatgaacccaaacac

SEQ ID NO: 339754 - DNA, 16 bp, M. musculus
aaatgaacccaggtcc

SEQ ID NO: 339755 - DNA, 16 bp, M. musculus
aaatgaagaaaatact

SEQ ID NO: 339756 - DNA, 16 bp, M. musculus
aaatgaagaaaatatc

SEQ ID NO: 339757 - DNA, 17 bp, M. musculus
aaatgaagaaaatatcc

SEQ ID NO: 339758 - DNA, 16 bp, M. musculus
aaatgaagaattcaaa

SEQ ID NO: 339759 - DNA, 16 bp, M. musculus
aaatgaagacccagaa

SEQ ID NO: 339760 - DNA, 16 bp, M. musculus
aaatgaagatgcagaa

SEQ ID NO: 339761 - DNA, 16 bp, M. musculus
aaatgaagatggaatt

SEQ ID NO: 339762 - DNA, 16 bp, M. musculus
aaatgaagccaagaca

SEQ ID NO: 339763 - DNA, 16 bp, M. musculus
aaatgaagctcaagaa

SEQ ID NO: 339764 - DNA, 16 bp, M. musculus
aaatgaagcttccaat

SEQ ID NO: 339765 - DNA, 16 bp, M. musculus
aaatgaagctttcagt

SEQ ID NO: 339766 - DNA, 16 bp, M. musculus
aaatgaagggacaaag

SEQ ID NO: 339767 - DNA, 16 bp, M. musculus
aaatgaataaaaccat

SEQ ID NO: 339768 - DNA, 16 bp, M. musculus
aaatgaataaaagtgt

SEQ ID NO: 339769 - DNA, 16 bp, M. musculus
aaatgaataaattctt

SEQ ID NO: 339770 - DNA, 16 bp, M. musculus
aaatgaatacataaat

SEQ ID NO: 339771 - DNA, 16 bp, M. musculus
aaatgaatacatttaa

SEQ ID NO: 339772 - DNA, 16 bp, M. musculus
aaatgaatatgcaaat

SEQ ID NO: 339773 - DNA, 16 bp, M. musculus
aaatgaatgaaaatgt

SEQ ID NO: 339774 - DNA, 16 bp, M. musculus
aaatgaatgaatattt

SEQ ID NO: 339775 - DNA, 16 bp, M. musculus
aaatgaatgaatgaat

SEQ ID NO: 339776 - DNA, 16 bp, M. musculus
aaatgaatgcatttta

SEQ ID NO: 339777 - DNA, 16 bp, M. musculus
aaatgaatggaaatag

SEQ ID NO: 339778 - DNA, 16 bp, M. musculus
aaatgaatggaaatct

SEQ ID NO: 339779 - DNA, 16 bp, M. musculus
aaatgaatgttttcat

SEQ ID NO: 339780 - DNA, 16 bp, M. musculus
aaatgaattacatttt

SEQ ID NO: 339781 - DNA, 16 bp, M. musculus
aaatgaatttcaaaat

SEQ ID NO: 339782 - DNA, 16 bp, M. musculus
aaatgaattttgaaat

SEQ ID NO: 339783 - DNA, 16 bp, M. musculus
aaatgacaaaatattg

SEQ ID NO: 339784 - DNA, 16 bp, M. musculus
aaatgacaaccaacag

SEQ ID NO: 339785 - DNA, 16 bp, M. musculus
aaatgacagatgtttt

SEQ ID NO: 339786 - DNA, 16 bp, M. musculus
aaatgacatttaaaaa

SEQ ID NO: 339787 - DNA, 16 bp, M. musculus
aaatgacattttaaaa

SEQ ID NO: 339788 - DNA, 16 bp, M. musculus
aaatgaccaaaatata

SEQ ID NO: 339789 - DNA, 16 bp, M. musculus
aaatgactcagcaggt

SEQ ID NO: 339790 - DNA, 16 bp, M. musculus
aaatgactcagtggct

SEQ ID NO: 339791 - DNA, 16 bp, M. musculus
aaatgactgaaactgt

SEQ ID NO: 339792 - DNA, 16 bp, M. musculus
aaatgagaaactcaca

SEQ ID NO: 339793 - DNA, 16 bp, M. musculus
aaatgagaaatgcaca

SEQ ID NO: 339794 - DNA, 16 bp, M. musculus
aaatgagatacactga

SEQ ID NO: 339795 - DNA, 16 bp, M. musculus
aaatgagatgtctcca

SEQ ID NO: 339796 - DNA, 16 bp, M. musculus
aaatgagatttctttt

SEQ ID NO: 339797 - DNA, 16 bp, M. musculus
aaatgagcaaaaccat

SEQ ID NO: 339798 - DNA, 16 bp, M. musculus
aaatgagccagagaat

SEQ ID NO: 339799 - DNA, 16 bp, M. musculus
aaatgagcttttaaaa

SEQ ID NO: 339800 - DNA, 16 bp, M. musculus
aaatgaggaaaataca

SEQ ID NO: 339801 - DNA, 16 bp, M. musculus
aaatgaggaaaatccc

SEQ ID NO: 339802 - DNA, 16 bp, M. musculus
aaatgaggaaaatgcc

SEQ ID NO: 339803 - DNA, 16 bp, M. musculus
aaatgaggacacatca

SEQ ID NO: 339804 - DNA, 16 bp, M. musculus
aaatgaggagatggtt

SEQ ID NO: 339805 - DNA, 16 bp, M. musculus
aaatgaggagctggtt

SEQ ID NO: 339806 - DNA, 16 bp, M. musculus
aaatgaggcagaaaaa

SEQ ID NO: 339807 - DNA, 16 bp, M. musculus
aaatgaggtgtgtgtg

SEQ ID NO: 339808 - DNA, 16 bp, M. musculus
aaatgagttcaaggcc

SEQ ID NO: 339809 - DNA, 16 bp, M. musculus
aaatgagttcaaggct

SEQ ID NO: 339810 - DNA, 16 bp, M. musculus
aaatgagttccagaac

SEQ ID NO: 339811 - DNA, 16 bp, M. musculus
aaatgatacattttaa

SEQ ID NO: 339812 - DNA, 16 bp, M. musculus
aaatgatcaaaggcag

SEQ ID NO: 339813 - DNA, 16 bp, M. musculus
aaatgatcaacatcct

SEQ ID NO: 339814 - DNA, 16 bp, M. musculus
aaatgatcactcacca

SEQ ID NO: 339815 - DNA, 16 bp, M. musculus
aaatgatcatatgttt

SEQ ID NO: 339816 - DNA, 16 bp, M. musculus
aaatgatcatgtggtt

SEQ ID NO: 339817 - DNA, 16 bp, M. musculus
aaatgatctaaaagtt

SEQ ID NO: 339818 - DNA, 16 bp, M. musculus
aaatgatcttttaaaa

SEQ ID NO: 339819 - DNA, 16 bp, M. musculus
aaatgatgccacaaca

SEQ ID NO: 339820 - DNA, 16 bp, M. musculus
aaatgatggtttgctg

SEQ ID NO: 339821 - DNA, 16 bp, M. musculus
aaatgatgtaaataca

SEQ ID NO: 339822 - DNA, 16 bp, M. musculus
aaatgatgttgaagaa

SEQ ID NO: 339823 - DNA, 16 bp, M. musculus
aaatgattcatttgaa

SEQ ID NO: 339824 - DNA, 16 bp, M. musculus
aaatgatttcattgtg

SEQ ID NO: 339825 - DNA, 16 bp, M. musculus
aaatgatttcctttat

SEQ ID NO: 339826 - DNA, 16 bp, M. musculus
aaatgattttcttttc

SEQ ID NO: 339827 - DNA, 16 bp, M. musculus
aaatgatttttcttaa

SEQ ID NO: 339828 - DNA, 16 bp, M. musculus
aaatgcaaaagaagat

SEQ ID NO: 339829 - DNA, 16 bp, M. musculus
aaatgcaaaatctaaa

SEQ ID NO: 339830 - DNA, 16 bp, M. musculus
aaatgcaaaatgcaga

SEQ ID NO: 339831 - DNA, 16 bp, M. musculus
aaatgcaaatattgtg

SEQ ID NO: 339832 - DNA, 16 bp, M. musculus
aaatgcaaatctaggt

SEQ ID NO: 339833 - DNA, 16 bp, M. musculus
aaatgcaaattcaaac

SEQ ID NO: 339834 - DNA, 16 bp, M. musculus
aaatgcaaattcattt

SEQ ID NO: 339835 - DNA, 16 bp, M. musculus
aaatgcaatttaaaaa

SEQ ID NO: 339836 - DNA, 16 bp, M. musculus
aaatgcacaaaacaag

SEQ ID NO: 339837 - DNA, 16 bp, M. musculus
aaatgcacaattttct

SEQ ID NO: 339838 - DNA, 16 bp, M. musculus
aaatgcacagaataaa

SEQ ID NO: 339839 - DNA, 16 bp, M. musculus
aaatgcacccaagagg

SEQ ID NO: 339840 - DNA, 16 bp, M. musculus
aaatgcacctcagcag

SEQ ID NO: 339841 - DNA, 16 bp, M. musculus
aaatgcactaaacaaa

SEQ ID NO: 339842 - DNA, 17 bp, M. musculus
aaatgcagaagtggatg

SEQ ID NO: 339843 - DNA, 16 bp, M. musculus
aaatgcagagactcac

SEQ ID NO: 339844 - DNA, 16 bp, M. musculus
aaatgcagagctgaaa

SEQ ID NO: 339845 - DNA, 18 bp, M. musculus
aaatgcagatgaaatcca

SEQ ID NO: 339846 - DNA, 16 bp, M. musculus
aaatgcagatttcctg

SEQ ID NO: 339847 - DNA, 16 bp, M. musculus
aaatgcaggcatgggg

SEQ ID NO: 339848 - DNA, 16 bp, M. musculus
aaatgcagggacagag

SEQ ID NO: 339849 - DNA, 16 bp, M. musculus
aaatgcataaataaat

SEQ ID NO: 339850 - DNA, 16 bp, M. musculus
aaatgcatatgaaata

SEQ ID NO: 339851 - DNA, 16 bp, M. musculus
aaatgcatatgtatat

SEQ ID NO: 339852 - DNA, 17 bp, M. musculus
aaatgcatggacctgga

SEQ ID NO: 339853 - DNA, 16 bp, M. musculus
aaatgcatttcttttt

SEQ ID NO: 339854 - DNA, 16 bp, M. musculus
aaatgcatttgtaaat

SEQ ID NO: 339855 - DNA, 16 bp, M. musculus
aaatgcattttataca

SEQ ID NO: 339856 - DNA, 16 bp, M. musculus
aaatgccaccaacaga

SEQ ID NO: 339857 - DNA, 16 bp, M. musculus
aaatgccaggaccagg

SEQ ID NO: 339858 - DNA, 16 bp, M. musculus
aaatgccagggccagg

SEQ ID NO: 339859 - DNA, 16 bp, M. musculus
aaatgccccagtacag

SEQ ID NO: 339860 - DNA, 16 bp, M. musculus
aaatgccctgcagtgg

SEQ ID NO: 339861 - DNA, 16 bp, M. musculus
aaatgcctactgtgtg

SEQ ID NO: 339862 - DNA, 16 bp, M. musculus
aaatgcctatgaagaa

SEQ ID NO: 339863 - DNA, 16 bp, M. musculus
aaatgcctccaccaga

SEQ ID NO: 339864 - DNA, 16 bp, M. musculus
aaatgcctccatgagg

SEQ ID NO: 339865 - DNA, 20 bp, M. musculus
aaatgcctccgtgagatcca

SEQ ID NO: 339866 - DNA, 17 bp, M. musculus
aaatgcctgttgtattt

SEQ ID NO: 339867 - DNA, 16 bp, M. musculus
aaatgccttacagtgg

SEQ ID NO: 339868 - DNA, 17 bp, M. musculus
aaatgccttacagttgg

SEQ ID NO: 339869 - DNA, 16 bp, M. musculus
aaatgccttcaacaaa

SEQ ID NO: 339870 - DNA, 17 bp, M. musculus
aaatgccttcatgagat

SEQ ID NO: 339871 - DNA, 16 bp, M. musculus
aaatgcctttactcac

SEQ ID NO: 339872 - DNA, 16 bp, M. musculus
aaatgctaataaaata

SEQ ID NO: 339873 - DNA, 16 bp, M. musculus
aaatgctagagccctg

SEQ ID NO: 339874 - DNA, 16 bp, M. musculus
aaatgctataatgaaa

SEQ ID NO: 339875 - DNA, 16 bp, M. musculus
aaatgctatgctgaaa

SEQ ID NO: 339876 - DNA, 16 bp, M. musculus
aaatgctatgtaaata

SEQ ID NO: 339877 - DNA, 16 bp, M. musculus
aaatgctattccaaaa

SEQ ID NO: 339878 - DNA, 16 bp, M. musculus
aaatgctattttaaaa

SEQ ID NO: 339879 - DNA, 16 bp, M. musculus
aaatgctcatacacat

SEQ ID NO: 339880 - DNA, 16 bp, M. musculus
aaatgctctgtaaata

SEQ ID NO: 339881 - DNA, 16 bp, M. musculus
aaatgctcttaaccac

SEQ ID NO: 339882 - DNA, 16 bp, M. musculus
aaatgctctttgcttt

SEQ ID NO: 339883 - DNA, 16 bp, M. musculus
aaatgctctttgtttt

SEQ ID NO: 339884 - DNA, 16 bp, M. musculus
aaatgctgaaaaagca

SEQ ID NO: 339885 - DNA, 16 bp, M. musculus
aaatgctgaaagaaaa

SEQ ID NO: 339886 - DNA, 16 bp, M. musculus
aaatgctgagattata

SEQ ID NO: 339887 - DNA, 34 bp, M. musculus
aaatgctgaggagatccaattgggtaatcctttg

SEQ ID NO: 339888 - DNA, 16 bp, M. musculus
aaatgctgatacacaa

SEQ ID NO: 339889 - DNA, 16 bp, M. musculus
aaatgctgcataatat

SEQ ID NO: 339890 - DNA, 18 bp, M. musculus
aaatgctgctgctgctgc

SEQ ID NO: 339891 - DNA, 16 bp, M. musculus
aaatgctggaaaacaa

SEQ ID NO: 339892 - DNA, 16 bp, M. musculus
aaatgctgggataaaa

SEQ ID NO: 339893 - DNA, 16 bp, M. musculus
aaatgctgtcttttcc

SEQ ID NO: 339894 - DNA, 16 bp, M. musculus
aaatgctgtcttttct

SEQ ID NO: 339895 - DNA, 16 bp, M. musculus
aaatgctgtggttatt

SEQ ID NO: 339896 - DNA, 16 bp, M. musculus
aaatgctgtgtgtgtg

SEQ ID NO: 339897 - DNA, 16 bp, M. musculus
aaatgctgttttaaaa

SEQ ID NO: 339898 - DNA, 16 bp, M. musculus
aaatgctgttttgttt

SEQ ID NO: 339899 - DNA, 16 bp, M. musculus
aaatgctgtttttata

SEQ ID NO: 339900 - DNA, 16 bp, M. musculus
aaatgcttaataaata

SEQ ID NO: 339901 - DNA, 16 bp, M. musculus
aaatgcttctttaaaa

SEQ ID NO: 339902 - DNA, 16 bp, M. musculus
aaatgcttcttttaaa

SEQ ID NO: 339903 - DNA, 16 bp, M. musculus
aaatgcttgccatgca

SEQ ID NO: 339904 - DNA, 16 bp, M. musculus
aaatgcttgttttttt

SEQ ID NO: 339905 - DNA, 16 bp, M. musculus
aaatgctttaaaaaat

SEQ ID NO: 339906 - DNA, 16 bp, M. musculus
aaatgctttattaaaa

SEQ ID NO: 339907 - DNA, 16 bp, M. musculus
aaatgctttcctgaaa

SEQ ID NO: 339908 - DNA, 16 bp, M. musculus
aaatgctttcctttct

SEQ ID NO: 339909 - DNA, 16 bp, M. musculus
aaatgctttcttctat

SEQ ID NO: 339910 - DNA, 16 bp, M. musculus
aaatgctttctttatt

SEQ ID NO: 339911 - DNA, 16 bp, M. musculus
aaatgcttttaaatct

SEQ ID NO: 339912 - DNA, 16 bp, M. musculus
aaatgcttttaaccac

SEQ ID NO: 339913 - DNA, 16 bp, M. musculus
aaatgcttttatttat

SEQ ID NO: 339914 - DNA, 16 bp, M. musculus
aaatgcttttattttt

SEQ ID NO: 339915 - DNA, 16 bp, M. musculus
aaatgctttttatttt

SEQ ID NO: 339916 - DNA, 16 bp, M. musculus
aaatgctttttgtttt

SEQ ID NO: 339917 - DNA, 16 bp, M. musculus
aaatggaaaaacattt

SEQ ID NO: 339918 - DNA, 16 bp, M. musculus
aaatggaaaatatttt

SEQ ID NO: 339919 - DNA, 16 bp, M. musculus
aaatggaaacaagaac

SEQ ID NO: 339920 - DNA, 16 bp, M. musculus
aaatggaaagcagaaa

SEQ ID NO: 339921 - DNA, 16 bp, M. musculus
aaatggaaatagaagc

SEQ ID NO: 339922 - DNA, 16 bp, M. musculus
aaatggaaatgggtgg

SEQ ID NO: 339923 - DNA, 17 bp, M. musculus
aaatggaacctcacaaa

SEQ ID NO: 339924 - DNA, 16 bp, M. musculus
aaatggaagcaataaa

SEQ ID NO: 339925 - DNA, 16 bp, M. musculus
aaatggaataaatacc

SEQ ID NO: 339926 - DNA, 16 bp, M. musculus
aaatggaatccaagaa

SEQ ID NO: 339927 - DNA, 16 bp, M. musculus
aaatggaatctcaaag

SEQ ID NO: 339928 - DNA, 16 bp, M. musculus
aaatggaattttaaat

SEQ ID NO: 339929 - DNA, 16 bp, M. musculus
aaatggacagaaactt

SEQ ID NO: 339930 - DNA, 16 bp, M. musculus
aaatggacagtctcca

SEQ ID NO: 339931 - DNA, 16 bp, M. musculus
aaatggacagttttct

SEQ ID NO: 339932 - DNA, 16 bp, M. musculus
aaatggaccaatcatg

SEQ ID NO: 339933 - DNA, 16 bp, M. musculus
aaatggactgaacctc

SEQ ID NO: 339934 - DNA, 16 bp, M. musculus
aaatggagaaatattt

SEQ ID NO: 339935 - DNA, 16 bp, M. musculus
aaatggagaattttct

SEQ ID NO: 339936 - DNA, 16 bp, M. musculus
aaatggagacataaaa

SEQ ID NO: 339937 - DNA, 16 bp, M. musculus
aaatggagagaagcct

SEQ ID NO: 339938 - DNA, 16 bp, M. musculus
aaatggagagaatctg

SEQ ID NO: 339939 - DNA, 16 bp, M. musculus
aaatggagattttttt

SEQ ID NO: 339940 - DNA, 16 bp, M. musculus
aaatggagcagagaat

SEQ ID NO: 339941 - DNA, 16 bp, M. musculus
aaatggaggagagact

SEQ ID NO: 339942 - DNA, 16 bp, M. musculus
aaatggaggagcagtg

SEQ ID NO: 339943 - DNA, 16 bp, M. musculus
aaatggaggagctaga

SEQ ID NO: 339944 - DNA, 16 bp, M. musculus
aaatggagtcaagact

SEQ ID NO: 339945 - DNA, 16 bp, M. musculus
aaatggatatttattt

SEQ ID NO: 339946 - DNA, 16 bp, M. musculus
aaatggatctgtgtgc

SEQ ID NO: 339947 - DNA, 16 bp, M. musculus
aaatggatgaaattag

SEQ ID NO: 339948 - DNA, 16 bp, M. musculus
aaatggatgagaaaca

SEQ ID NO: 339949 - DNA, 19 bp, M. musculus
aaatggatggaactagaaa

SEQ ID NO: 339950 - DNA, 17 bp, M. musculus
aaatggatggaacttga

SEQ ID NO: 339951 - DNA, 16 bp, M. musculus
aaatggatggagctgg

SEQ ID NO: 339952 - DNA, 17 bp, M. musculus
aaatggatggatctgga

SEQ ID NO: 339953 - DNA, 16 bp, M. musculus
aaatggatgggtggat

SEQ ID NO: 339954 - DNA, 16 bp, M. musculus
aaatggattattttct

SEQ ID NO: 339955 - DNA, 16 bp, M. musculus
aaatggattttaataa

SEQ ID NO: 339956 - DNA, 16 bp, M. musculus
aaatggcaagaggcaa

SEQ ID NO: 339957 - DNA, 16 bp, M. musculus
aaatggcagccaacag

SEQ ID NO: 339958 - DNA, 16 bp, M. musculus
aaatggcagcttacag

SEQ ID NO: 339959 - DNA, 16 bp, M. musculus
aaatggcagctttgct

SEQ ID NO: 339960 - DNA, 16 bp, M. musculus
aaatggcaggaaataa

SEQ ID NO: 339961 - DNA, 16 bp, M. musculus
aaatggcagtctacag

SEQ ID NO: 339962 - DNA, 16 bp, M. musculus
aaatggcatcaagaaa

SEQ ID NO: 339963 - DNA, 16 bp, M. musculus
aaatggcatcatgaaa

SEQ ID NO: 339964 - DNA, 16 bp, M. musculus
aaatggcatttaaaat

SEQ ID NO: 339965 - DNA, 16 bp, M. musculus
aaatggccacttaatg

SEQ ID NO: 339966 - DNA, 16 bp, M. musculus
aaatggcctcagcaag

SEQ ID NO: 339967 - DNA, 16 bp, M. musculus
aaatggctaataaata

SEQ ID NO: 339968 - DNA, 16 bp, M. musculus
aaatggctcagcaggg

SEQ ID NO: 339969 - DNA, 16 bp, M. musculus
aaatggctcagcagtt

SEQ ID NO: 339970 - DNA, 16 bp, M. musculus
aaatggctcagtgggg

SEQ ID NO: 339971 - DNA, 16 bp, M. musculus
aaatggctcagtgggt

SEQ ID NO: 339972 - DNA, 16 bp, M. musculus
aaatggctgagaagca

SEQ ID NO: 339973 - DNA, 16 bp, M. musculus
aaatggcttagcaggt

SEQ ID NO: 339974 - DNA, 16 bp, M. musculus
aaatggcttgagaaaa

SEQ ID NO: 339975 - DNA, 16 bp, M. musculus
aaatggcttgtgctgt

SEQ ID NO: 339976 - DNA, 16 bp, M. musculus
aaatggcttttaaaaa

SEQ ID NO: 339977 - DNA, 16 bp, M. musculus
aaatggcttttctttt

SEQ ID NO: 339978 - DNA, 16 bp, M. musculus
aaatgggaacaaacac

SEQ ID NO: 339979 - DNA, 17 bp, M. musculus
aaatgggacctcataaa

SEQ ID NO: 339980 - DNA, 16 bp, M. musculus
aaatgggattttaaaa

SEQ ID NO: 339981 - DNA, 16 bp, M. musculus
aaatgggcagagaaag

SEQ ID NO: 339982 - DNA, 16 bp, M. musculus
aaatggggagaaactc

SEQ ID NO: 339983 - DNA, 16 bp, M. musculus
aaatggggagaagctg

SEQ ID NO: 339984 - DNA, 16 bp, M. musculus
aaatgggggctggtga

SEQ ID NO: 339985 - DNA, 16 bp, M. musculus
aaatgggtgagaagca

SEQ ID NO: 339986 - DNA, 16 bp, M. musculus
aaatggtataattata

SEQ ID NO: 339987 - DNA, 16 bp, M. musculus
aaatggtcaaccctga

SEQ ID NO: 339988 - DNA, 16 bp, M. musculus
aaatggtcaagaagca

SEQ ID NO: 339989 - DNA, 16 bp, M. musculus
aaatggtgaaatggaa

SEQ ID NO: 339990 - DNA, 16 bp, M. musculus
aaatggtgctgcccac

SEQ ID NO: 339991 - DNA, 18 bp, M. musculus
aaatggtgctggcacaag

SEQ ID NO: 339992 - DNA, 16 bp, M. musculus
aaatggtgctggccca

SEQ ID NO: 339993 - DNA, 16 bp, M. musculus
aaatggtggtttataa

SEQ ID NO: 339994 - DNA, 16 bp, M. musculus
aaatggttaaaacttt

SEQ ID NO: 339995 - DNA, 16 bp, M. musculus
aaatggtttattttag

SEQ ID NO: 339996 - DNA, 16 bp, M. musculus
aaatggttttgttttg

SEQ ID NO: 339997 - DNA, 16 bp, M. musculus
aaatgtaaacaatatc

SEQ ID NO: 339998 - DNA, 16 bp, M. musculus
aaatgtaaatgaaaca

SEQ ID NO: 339999 - DNA, 16 bp, M. musculus
aaatgtaaatgagata

SEQ ID NO: 340000 - DNA, 16 bp, M. musculus
aaatgtaactgaaata

SEQ ID NO: 340001 - DNA, 16 bp, M. musculus
aaatgtaactttaaaa

SEQ ID NO: 340002 - DNA, 16 bp, M. musculus
aaatgtaagatgaaat

SEQ ID NO: 340003 - DNA, 16 bp, M. musculus
aaatgtaaggctgtgt

SEQ ID NO: 340004 - DNA, 16 bp, M. musculus
aaatgtaatcaatgtg

SEQ ID NO: 340005 - DNA, 20 bp, M. musculus
aaatgtaattgaggaaaata

SEQ ID NO: 340006 - DNA, 17 bp, M. musculus
aaatgtaattgatcatt

SEQ ID NO: 340007 - DNA, 16 bp, M. musculus
aaatgtaattgttgct

SEQ ID NO: 340008 - DNA, 16 bp, M. musculus
aaatgtaatttcaaaa

SEQ ID NO: 340009 - DNA, 16 bp, M. musculus
aaatgtacataaagaa

SEQ ID NO: 340010 - DNA, 16 bp, M. musculus
aaatgtacattatttt

SEQ ID NO: 340011 - DNA, 16 bp, M. musculus
aaatgtactttttaaa

SEQ ID NO: 340012 - DNA, 16 bp, M. musculus
aaatgtagagaaaatt

SEQ ID NO: 340013 - DNA, 16 bp, M. musculus
aaatgtaggaaacaaa

SEQ ID NO: 340014 - DNA, 16 bp, M. musculus
aaatgtagtgtgtgtg

SEQ ID NO: 340015 - DNA, 16 bp, M. musculus
aaatgtagttttaaaa

SEQ ID NO: 340016 - DNA, 16 bp, M. musculus
aaatgtatatagatat

SEQ ID NO: 340017 - DNA, 16 bp, M. musculus
aaatgtatatatacat

SEQ ID NO: 340018 - DNA, 16 bp, M. musculus
aaatgtatatatgtat

SEQ ID NO: 340019 - DNA, 16 bp, M. musculus
aaatgtatatgaagaa

SEQ ID NO: 340020 - DNA, 16 bp, M. musculus
aaatgtatattctttt

SEQ ID NO: 340021 - DNA, 16 bp, M. musculus
aaatgtatgtaaagaa

SEQ ID NO: 340022 - DNA, 16 bp, M. musculus
aaatgtatgtatgtat

SEQ ID NO: 340023 - DNA, 16 bp, M. musculus
aaatgtatgttttaaa

SEQ ID NO: 340024 - DNA, 16 bp, M. musculus
aaatgtattacatttt

SEQ ID NO: 340025 - DNA, 16 bp, M. musculus
aaatgtattctctgtt

SEQ ID NO: 340026 - DNA, 16 bp, M. musculus
aaatgtattcttctct

SEQ ID NO: 340027 - DNA, 16 bp, M. musculus
aaatgtatttatatgt

SEQ ID NO: 340028 - DNA, 16 bp, M. musculus
aaatgtatttattctg

SEQ ID NO: 340029 - DNA, 16 bp, M. musculus
aaatgtatttgaacaa

SEQ ID NO: 340030 - DNA, 16 bp, M. musculus
aaatgtatttgtcttt

SEQ ID NO: 340031 - DNA, 16 bp, M. musculus
aaatgtattttgaaaa

SEQ ID NO: 340032 - DNA, 16 bp, M. musculus
aaatgtatttttcatt

SEQ ID NO: 340033 - DNA, 16 bp, M. musculus
aaatgtattttttcat

SEQ ID NO: 340034 - DNA, 16 bp, M. musculus
aaatgtatttttttct

SEQ ID NO: 340035 - DNA, 16 bp, M. musculus
aaatgtcaaaataaat

SEQ ID NO: 340036 - DNA, 16 bp, M. musculus
aaatgtcataatgaaa

SEQ ID NO: 340037 - DNA, 16 bp, M. musculus
aaatgtcatattctgt

SEQ ID NO: 340038 - DNA, 16 bp, M. musculus
aaatgtcatgaagaaa

SEQ ID NO: 340039 - DNA, 16 bp, M. musculus
aaatgtcattcttttt

SEQ ID NO: 340040 - DNA, 16 bp, M. musculus
aaatgtcatttaaaaa

SEQ ID NO: 340041 - DNA, 16 bp, M. musculus
aaatgtcattttaaaa

SEQ ID NO: 340042 - DNA, 16 bp, M. musculus
aaatgtcattttcttt

SEQ ID NO: 340043 - DNA, 16 bp, M. musculus
aaatgtccaattaaaa

SEQ ID NO: 340044 - DNA, 16 bp, M. musculus
aaatgtccttataaaa

SEQ ID NO: 340045 - DNA, 16 bp, M. musculus
aaatgtccttataaga

SEQ ID NO: 340046 - DNA, 16 bp, M. musculus
aaatgtccttttaaaa

SEQ ID NO: 340047 - DNA, 16 bp, M. musculus
aaatgtctagaagaaa

SEQ ID NO: 340048 - DNA, 16 bp, M. musculus
aaatgtctccatcaaa

SEQ ID NO: 340049 - DNA, 17 bp, M. musculus
aaatgtctccatgagat

SEQ ID NO: 340050 - DNA, 16 bp, M. musculus
aaatgtctgaaactgt

SEQ ID NO: 340051 - DNA, 16 bp, M. musculus
aaatgtctggattata

SEQ ID NO: 340052 - DNA, 16 bp, M. musculus
aaatgtcttatttatt

SEQ ID NO: 340053 - DNA, 16 bp, M. musculus
aaatgtcttcatttat

SEQ ID NO: 340054 - DNA, 16 bp, M. musculus
aaatgtcttctgagag

SEQ ID NO: 340055 - DNA, 16 bp, M. musculus
aaatgtctttattttt

SEQ ID NO: 340056 - DNA, 16 bp, M. musculus
aaatgtctttctttta

SEQ ID NO: 340057 - DNA, 16 bp, M. musculus
aaatgtgaaatacaaa

SEQ ID NO: 340058 - DNA, 16 bp, M. musculus
aaatgtgaatatttta

SEQ ID NO: 340059 - DNA, 16 bp, M. musculus
aaatgtgccaaagaac

SEQ ID NO: 340060 - DNA, 16 bp, M. musculus
aaatgtgctacatttt

SEQ ID NO: 340061 - DNA, 16 bp, M. musculus
aaatgtggaacagaga

SEQ ID NO: 340062 - DNA, 16 bp, M. musculus
aaatgtggagacaaag

SEQ ID NO: 340063 - DNA, 16 bp, M. musculus
aaatgtggatttgggg

SEQ ID NO: 340064 - DNA, 16 bp, M. musculus
aaatgtggcactggag

SEQ ID NO: 340065 - DNA, 16 bp, M. musculus
aaatgtggttcatttt

SEQ ID NO: 340066 - DNA, 16 bp, M. musculus
aaatgtggttttaaaa

SEQ ID NO: 340067 - DNA, 16 bp, M. musculus
aaatgtgtagaatttg

SEQ ID NO: 340068 - DNA, 16 bp, M. musculus
aaatgtgtatatttaa

SEQ ID NO: 340069 - DNA, 16 bp, M. musculus
aaatgtgtctttaaaa

SEQ ID NO: 340070 - DNA, 16 bp, M. musculus
aaatgtgtgtggtttt

SEQ ID NO: 340071 - DNA, 16 bp, M. musculus
aaatgtgtgttattgt

SEQ ID NO: 340072 - DNA, 16 bp, M. musculus
aaatgtgtgttttaaa

SEQ ID NO: 340073 - DNA, 16 bp, M. musculus
aaatgtgtgttttctg

SEQ ID NO: 340074 - DNA, 16 bp, M. musculus
aaatgtgtgtttttaa

SEQ ID NO: 340075 - DNA, 16 bp, M. musculus
aaatgtgttctttctt

SEQ ID NO: 340076 - DNA, 16 bp, M. musculus
aaatgtgtttaaaata

SEQ ID NO: 340077 - DNA, 16 bp, M. musculus
aaatgtgtttatgtgt

SEQ ID NO: 340078 - DNA, 16 bp, M. musculus
aaatgtgtttcatttt

SEQ ID NO: 340079 - DNA, 16 bp, M. musculus
aaatgtgtttgctttg

SEQ ID NO: 340080 - DNA, 16 bp, M. musculus
aaatgtgtttgtttat

SEQ ID NO: 340081 - DNA, 16 bp, M. musculus
aaatgtgttttgcatt

SEQ ID NO: 340082 - DNA, 16 bp, M. musculus
aaatgttaaaatgtta

SEQ ID NO: 340083 - DNA, 16 bp, M. musculus
aaatgttaacaaaaat

SEQ ID NO: 340084 - DNA, 16 bp, M. musculus
aaatgttagtttaaaa

SEQ ID NO: 340085 - DNA, 16 bp, M. musculus
aaatgttatccacctt

SEQ ID NO: 340086 - DNA, 16 bp, M. musculus
aaatgttcaacatcat

SEQ ID NO: 340087 - DNA, 18 bp, M. musculus
aaatgttcaacatcctta

SEQ ID NO: 340088 - DNA, 16 bp, M. musculus
aaatgttcatatacat

SEQ ID NO: 340089 - DNA, 16 bp, M. musculus
aaatgttctgtaaata

SEQ ID NO: 340090 - DNA, 20 bp, M. musculus
aaatgttctgtagatatctg

SEQ ID NO: 340091 - DNA, 21 bp, M. musculus
aaatgttctgtagatatctgt

SEQ ID NO: 340092 - DNA, 16 bp, M. musculus
aaatgttgaaaaatca

SEQ ID NO: 340093 - DNA, 16 bp, M. musculus
aaatgttgtaattaaa

SEQ ID NO: 340094 - DNA, 16 bp, M. musculus
aaatgttgtcctcttt

SEQ ID NO: 340095 - DNA, 16 bp, M. musculus
aaatgttgtctccttt

SEQ ID NO: 340096 - DNA, 16 bp, M. musculus
aaatgttgtcttttat

SEQ ID NO: 340097 - DNA, 16 bp, M. musculus
aaatgttgtgttttat

SEQ ID NO: 340098 - DNA, 16 bp, M. musculus
aaatgttgttttctat

SEQ ID NO: 340099 - DNA, 16 bp, M. musculus
aaatgtttaaaaacat

SEQ ID NO: 340100 - DNA, 16 bp, M. musculus
aaatgtttacatttta

SEQ ID NO: 340101 - DNA, 16 bp, M. musculus
aaatgtttacattttt

SEQ ID NO: 340102 - DNA, 16 bp, M. musculus
aaatgtttacttttat

SEQ ID NO: 340103 - DNA, 16 bp, M. musculus
aaatgtttcttaaaaa

SEQ ID NO: 340104 - DNA, 16 bp, M. musculus
aaatgtttcttaaaat

SEQ ID NO: 340105 - DNA, 16 bp, M. musculus
aaatgtttcttctttt

SEQ ID NO: 340106 - DNA, 16 bp, M. musculus
aaatgtttcttgtttt

SEQ ID NO: 340107 - DNA, 16 bp, M. musculus
aaatgtttctttttaa

SEQ ID NO: 340108 - DNA, 16 bp, M. musculus
aaatgtttgcttttat

SEQ ID NO: 340109 - DNA, 16 bp, M. musculus
aaatgtttggaaaaaa

SEQ ID NO: 340110 - DNA, 16 bp, M. musculus
aaatgtttgtgttttc

SEQ ID NO: 340111 - DNA, 16 bp, M. musculus
aaatgtttgttttaaa

SEQ ID NO: 340112 - DNA, 16 bp, M. musculus
aaatgttttaaaacca

SEQ ID NO: 340113 - DNA, 16 bp, M. musculus
aaatgttttaaaatca

SEQ ID NO: 340114 - DNA, 16 bp, M. musculus
aaatgttttaaagaat

SEQ ID NO: 340115 - DNA, 16 bp, M. musculus
aaatgttttaaatgtt

SEQ ID NO: 340116 - DNA, 16 bp, M. musculus
aaatgttttataaaag

SEQ ID NO: 340117 - DNA, 16 bp, M. musculus
aaatgttttatttact

SEQ ID NO: 340118 - DNA, 16 bp, M. musculus
aaatgttttcaataaa

SEQ ID NO: 340119 - DNA, 16 bp, M. musculus
aaatgttttcatttat

SEQ ID NO: 340120 - DNA, 16 bp, M. musculus
aaatgttttccttttt

SEQ ID NO: 340121 - DNA, 16 bp, M. musculus
aaatgttttctgaaag

SEQ ID NO: 340122 - DNA, 16 bp, M. musculus
aaatgttttctttaaa

SEQ ID NO: 340123 - DNA, 16 bp, M. musculus
aaatgttttctttcat

SEQ ID NO: 340124 - DNA, 16 bp, M. musculus
aaatgttttctttcct

SEQ ID NO: 340125 - DNA, 16 bp, M. musculus
aaatgttttcttttaa

SEQ ID NO: 340126 - DNA, 16 bp, M. musculus
aaatgttttgcctaca

SEQ ID NO: 340127 - DNA, 16 bp, M. musculus
aaatgttttgtcaaca

SEQ ID NO: 340128 - DNA, 16 bp, M. musculus
aaatgtttttaaaatg

SEQ ID NO: 340129 - DNA, 16 bp, M. musculus
aaatgtttttatttca

SEQ ID NO: 340130 - DNA, 16 bp, M. musculus
aaatgtttttcatttt

SEQ ID NO: 340131 - DNA, 16 bp, M. musculus
aaatgtttttcctttt

SEQ ID NO: 340132 - DNA, 16 bp, M. musculus
aaatgtttttctttaa

SEQ ID NO: 340133 - DNA, 16 bp, M. musculus
aaatgtttttctttga

SEQ ID NO: 340134 - DNA, 16 bp, M. musculus
aaatgtttttgaaaaa

SEQ ID NO: 340135 - DNA, 16 bp, M. musculus
aaatgtttttgagaaa

SEQ ID NO: 340136 - DNA, 16 bp, M. musculus
aaattaaaaacctttt

SEQ ID NO: 340137 - DNA, 16 bp, M. musculus
aaattaaaaagcagat

SEQ ID NO: 340138 - DNA, 16 bp, M. musculus
aaattaaaaatgcttt

SEQ ID NO: 340139 - DNA, 16 bp, M. musculus
aaattaaaaatgtatc

SEQ ID NO: 340140 - DNA, 16 bp, M. musculus
aaattaaaatgacttt

SEQ ID NO: 340141 - DNA, 16 bp, M. musculus
aaattaaaatgctttt

SEQ ID NO: 340142 - DNA, 16 bp, M. musculus
aaattaaaattgcaag

SEQ ID NO: 340143 - DNA, 16 bp, M. musculus
aaattaaaatttcagt

SEQ ID NO: 340144 - DNA, 16 bp, M. musculus
aaattaaacacttttt

SEQ ID NO: 340145 - DNA, 16 bp, M. musculus
aaattaaactgaaaat

SEQ ID NO: 340146 - DNA, 16 bp, M. musculus
aaattaaagaagatgt

SEQ ID NO: 340147 - DNA, 16 bp, M. musculus
aaattaaagaagtttt

SEQ ID NO: 340148 - DNA, 16 bp, M. musculus
aaattaaagtagatct

SEQ ID NO: 340149 - DNA, 16 bp, M. musculus
aaattaaagttacagg

SEQ ID NO: 340150 - DNA, 16 bp, M. musculus
aaattaaccatcacac

SEQ ID NO: 340151 - DNA, 16 bp, M. musculus
aaattaactcaagcaa

SEQ ID NO: 340152 - DNA, 16 bp, M. musculus
aaattaaggaattttt

SEQ ID NO: 340153 - DNA, 16 bp, M. musculus
aaattaagtcaattta

SEQ ID NO: 340154 - DNA, 25 bp, M. musculus
aaattaagtcaatttaccctcctct

SEQ ID NO: 340155 - DNA, 16 bp, M. musculus
aaattaataaaactgt

SEQ ID NO: 340156 - DNA, 16 bp, M. musculus
aaattaataaaatcag

SEQ ID NO: 340157 - DNA, 16 bp, M. musculus
aaattaataaatctct

SEQ ID NO: 340158 - DNA, 16 bp, M. musculus
aaattaatgaacaaag

SEQ ID NO: 340159 - DNA, 16 bp, M. musculus
aaattaatggaccagg

SEQ ID NO: 340160 - DNA, 16 bp, M. musculus
aaattaatgttttctt

SEQ ID NO: 340161 - DNA, 17 bp, M. musculus
aaattacactgtgctta

SEQ ID NO: 340162 - DNA, 16 bp, M. musculus
aaattacagttatgag

SEQ ID NO: 340163 - DNA, 16 bp, M. musculus
aaattacatatttttg

SEQ ID NO: 340164 - DNA, 16 bp, M. musculus
aaattacatgtatgtg

SEQ ID NO: 340165 - DNA, 16 bp, M. musculus
aaattacattcagatc

SEQ ID NO: 340166 - DNA, 16 bp, M. musculus
aaattacatttgttta

SEQ ID NO: 340167 - DNA, 16 bp, M. musculus
aaattaccttttaaaa

SEQ ID NO: 340168 - DNA, 16 bp, M. musculus
aaattactccacaaaa

SEQ ID NO: 340169 - DNA, 16 bp, M. musculus
aaattactgtattttt

SEQ ID NO: 340170 - DNA, 16 bp, M. musculus
aaattactgtgcttaa

SEQ ID NO: 340171 - DNA, 16 bp, M. musculus
aaattacttttaaaac

SEQ ID NO: 340172 - DNA, 16 bp, M. musculus
aaattagaaaatttgg

SEQ ID NO: 340173 - DNA, 16 bp, M. musculus
aaattagaagaatctt

SEQ ID NO: 340174 - DNA, 16 bp, M. musculus
aaattagaagttttgg

SEQ ID NO: 340175 - DNA, 16 bp, M. musculus
aaattagagtttgaaa

SEQ ID NO: 340176 - DNA, 16 bp, M. musculus
aaattagattcaggga

SEQ ID NO: 340177 - DNA, 16 bp, M. musculus
aaattagcatgtcctt

SEQ ID NO: 340178 - DNA, 16 bp, M. musculus
aaattagcatttaaaa

SEQ ID NO: 340179 - DNA, 16 bp, M. musculus
aaattagcttttaaaa

SEQ ID NO: 340180 - DNA, 16 bp, M. musculus
aaattaggaaagcaac

SEQ ID NO: 340181 - DNA, 17 bp, M. musculus
aaattaggtattttctt

SEQ ID NO: 340182 - DNA, 16 bp, M. musculus
aaattatacacataca

SEQ ID NO: 340183 - DNA, 16 bp, M. musculus
aaattatacacatttt

SEQ ID NO: 340184 - DNA, 16 bp, M. musculus
aaattatagcagaaaa

SEQ ID NO: 340185 - DNA, 16 bp, M. musculus
aaattatatacatgta

SEQ ID NO: 340186 - DNA, 16 bp, M. musculus
aaattatatttcagtt

SEQ ID NO: 340187 - DNA, 17 bp, M. musculus
aaattatgcacatgtga

SEQ ID NO: 340188 - DNA, 16 bp, M. musculus
aaattatggggttaat

SEQ ID NO: 340189 - DNA, 16 bp, M. musculus
aaattatgtaaataca

SEQ ID NO: 340190 - DNA, 16 bp, M. musculus
aaattattagacaaat

SEQ ID NO: 340191 - DNA, 16 bp, M. musculus
aaattattctgcaaaa

SEQ ID NO: 340192 - DNA, 16 bp, M. musculus
aaattattgaggaaaa

SEQ ID NO: 340193 - DNA, 16 bp, M. musculus
aaattatttcatgtat

SEQ ID NO: 340194 - DNA, 16 bp, M. musculus
aaattatttccaaata

SEQ ID NO: 340195 - DNA, 16 bp, M. musculus
aaattatttctgtatt

SEQ ID NO: 340196 - DNA, 16 bp, M. musculus
aaattattttaaaagg

SEQ ID NO: 340197 - DNA, 16 bp, M. musculus
aaattattttcaattg

SEQ ID NO: 340198 - DNA, 16 bp, M. musculus
aaattattttcttgtt

SEQ ID NO: 340199 - DNA, 16 bp, M. musculus
aaattattttgaaaac

SEQ ID NO: 340200 - DNA, 16 bp, M. musculus
aaattcaaaatgtaaa

SEQ ID NO: 340201 - DNA, 16 bp, M. musculus
aaattcaaagaaaatg

SEQ ID NO: 340202 - DNA, 16 bp, M. musculus
aaattcaaagtcagcc

SEQ ID NO: 340203 - DNA, 16 bp, M. musculus
aaattcaaatgtaaaa

SEQ ID NO: 340204 - DNA, 16 bp, M. musculus
aaattcaaattaaagc

SEQ ID NO: 340205 - DNA, 16 bp, M. musculus
aaattcaagaaaaatg

SEQ ID NO: 340206 - DNA, 16 bp, M. musculus
aaattcacagttcaat

SEQ ID NO: 340207 - DNA, 16 bp, M. musculus
aaattcagaaaaatta

SEQ ID NO: 340208 - DNA, 16 bp, M. musculus
aaattcagagctgaga

SEQ ID NO: 340209 - DNA, 16 bp, M. musculus
aaattcagggaaaaaa

SEQ ID NO: 340210 - DNA, 16 bp, M. musculus
aaattcagttttattt

SEQ ID NO: 340211 - DNA, 16 bp, M. musculus
aaattcatacaggaga

SEQ ID NO: 340212 - DNA, 16 bp, M. musculus
aaattcataccagaga

SEQ ID NO: 340213 - DNA, 16 bp, M. musculus
aaattcataccggaga

SEQ ID NO: 340214 - DNA, 17 bp, M. musculus
aaattcatactggagaa

SEQ ID NO: 340215 - DNA, 16 bp, M. musculus
aaattcatgaaagaaa

SEQ ID NO: 340216 - DNA, 16 bp, M. musculus
aaattcatgatctctt

SEQ ID NO: 340217 - DNA, 16 bp, M. musculus
aaattcatggcctctt

SEQ ID NO: 340218 - DNA, 16 bp, M. musculus
aaattcatggctctga

SEQ ID NO: 340219 - DNA, 16 bp, M. musculus
aaattcatgtttttaa

SEQ ID NO: 340220 - DNA, 16 bp, M. musculus
aaattcattaaaatgt

SEQ ID NO: 340221 - DNA, 16 bp, M. musculus
aaattcattcttgtta

SEQ ID NO: 340222 - DNA, 16 bp, M. musculus
aaattcattctttgta

SEQ ID NO: 340223 - DNA, 16 bp, M. musculus
aaattcattgattttt

SEQ ID NO: 340224 - DNA, 16 bp, M. musculus
aaattcattgttgtta

SEQ ID NO: 340225 - DNA, 16 bp, M. musculus
aaattcatttctgttt

SEQ ID NO: 340226 - DNA, 16 bp, M. musculus
aaattcatttggaaaa

SEQ ID NO: 340227 - DNA, 16 bp, M. musculus
aaattcatttggaata

SEQ ID NO: 340228 - DNA, 16 bp, M. musculus
aaattcatttgtgttt

SEQ ID NO: 340229 - DNA, 16 bp, M. musculus
aaattcatttttcaaa

SEQ ID NO: 340230 - DNA, 16 bp, M. musculus
aaattccaaagtcctt

SEQ ID NO: 340231 - DNA, 16 bp, M. musculus
aaattccaaatcaatt

SEQ ID NO: 340232 - DNA, 16 bp, M. musculus
aaattccaccaaagaa

SEQ ID NO: 340233 - DNA, 16 bp, M. musculus
aaattccaccagggaa

SEQ ID NO: 340234 - DNA, 16 bp, M. musculus
aaattccagaagaaaa

SEQ ID NO: 340235 - DNA, 16 bp, M. musculus
aaattccagcaaccat

SEQ ID NO: 340236 - DNA, 16 bp, M. musculus
aaattcctagaagcag

SEQ ID NO: 340237 - DNA, 16 bp, M. musculus
aaattcctcctggaga

SEQ ID NO: 340238 - DNA, 16 bp, M. musculus
aaattcctcctgtcac

SEQ ID NO: 340239 - DNA, 16 bp, M. musculus
aaattcctgaaaagaa

SEQ ID NO: 340240 - DNA, 16 bp, M. musculus
aaattcctgaatagga

SEQ ID NO: 340241 - DNA, 16 bp, M. musculus
aaattcctgaattgaa

SEQ ID NO: 340242 - DNA, 17 bp, M. musculus
aaattccttccgacaca

SEQ ID NO: 340243 - DNA, 16 bp, M. musculus
aaattcctttactatt

SEQ ID NO: 340244 - DNA, 16 bp, M. musculus
aaattctaacagagaa

SEQ ID NO: 340245 - DNA, 16 bp, M. musculus
aaattctaagccagcc

SEQ ID NO: 340246 - DNA, 16 bp, M. musculus
aaattctacctgagaa

SEQ ID NO: 340247 - DNA, 16 bp, M. musculus
aaattctaccttgtaa

SEQ ID NO: 340248 - DNA, 16 bp, M. musculus
aaattctagaaaaata

SEQ ID NO: 340249 - DNA, 16 bp, M. musculus
aaattctagttaaaat

SEQ ID NO: 340250 - DNA, 16 bp, M. musculus
aaattctcaaaaagtt

SEQ ID NO: 340251 - DNA, 16 bp, M. musculus
aaattctcaaacaaat

SEQ ID NO: 340252 - DNA, 16 bp, M. musculus
aaattctcaacaataa

SEQ ID NO: 340253 - DNA, 18 bp, M. musculus
aaattctcaacccacaaa

SEQ ID NO: 340254 - DNA, 16 bp, M. musculus
aaattctgaaaacaaa

SEQ ID NO: 340255 - DNA, 16 bp, M. musculus
aaattctgaataatga

SEQ ID NO: 340256 - DNA, 16 bp, M. musculus
aaattctgtctcaaaa

SEQ ID NO: 340257 - DNA, 16 bp, M. musculus
aaattctgtcttaaaa

SEQ ID NO: 340258 - DNA, 16 bp, M. musculus
aaattctgtgactcta

SEQ ID NO: 340259 - DNA, 16 bp, M. musculus
aaattctgttttgttt

SEQ ID NO: 340260 - DNA, 16 bp, M. musculus
aaattcttagaagaaa

SEQ ID NO: 340261 - DNA, 16 bp, M. musculus
aaattcttggaaagat

SEQ ID NO: 340262 - DNA, 16 bp, M. musculus
aaattcttgtcatata

SEQ ID NO: 340263 - DNA, 16 bp, M. musculus
aaattctttggaaaat

SEQ ID NO: 340264 - DNA, 16 bp, M. musculus
aaattcttttctaaaa

SEQ ID NO: 340265 - DNA, 16 bp, M. musculus
aaattcttttgtgttt

SEQ ID NO: 340266 - DNA, 16 bp, M. musculus
aaattgacaattttct

SEQ ID NO: 340267 - DNA, 16 bp, M. musculus
aaattgagttttgctt

SEQ ID NO: 340268 - DNA, 16 bp, M. musculus
aaattgatacatcagt

SEQ ID NO: 340269 - DNA, 16 bp, M. musculus
aaattgatgatgatga

SEQ ID NO: 340270 - DNA, 16 bp, M. musculus
aaattgattttctcct

SEQ ID NO: 340271 - DNA, 16 bp, M. musculus
aaattgcaattatgaa

SEQ ID NO: 340272 - DNA, 16 bp, M. musculus
aaattgcatatattta

SEQ ID NO: 340273 - DNA, 16 bp, M. musculus
aaattgccaaagaata

SEQ ID NO: 340274 - DNA, 16 bp, M. musculus
aaattgcttcaagttt

SEQ ID NO: 340275 - DNA, 16 bp, M. musculus
aaattgcttttaaaaa

SEQ ID NO: 340276 - DNA, 16 bp, M. musculus
aaattgcttttatttt

SEQ ID NO: 340277 - DNA, 16 bp, M. musculus
aaattggaaacccaag

SEQ ID NO: 340278 - DNA, 16 bp, M. musculus
aaattggaaatgaaga

SEQ ID NO: 340279 - DNA, 16 bp, M. musculus
aaattggaacttgaag

SEQ ID NO: 340280 - DNA, 16 bp, M. musculus
aaattggacttttttt

SEQ ID NO: 340281 - DNA, 16 bp, M. musculus
aaattggctaagtttt

SEQ ID NO: 340282 - DNA, 16 bp, M. musculus
aaattgggaacaaaac

SEQ ID NO: 340283 - DNA, 16 bp, M. musculus
aaattggtatgaaatt

SEQ ID NO: 340284 - DNA, 16 bp, M. musculus
aaattgtatattgtat

SEQ ID NO: 340285 - DNA, 16 bp, M. musculus
aaattgtatcttgtat

SEQ ID NO: 340286 - DNA, 16 bp, M. musculus
aaattgtattttgatg

SEQ ID NO: 340287 - DNA, 16 bp, M. musculus
aaattgtattttggat

SEQ ID NO: 340288 - DNA, 16 bp, M. musculus
aaattgtcttttaaaa

SEQ ID NO: 340289 - DNA, 16 bp, M. musculus
aaattgtggtagtggt

SEQ ID NO: 340290 - DNA, 16 bp, M. musculus
aaattgttcctctaga

SEQ ID NO: 340291 - DNA, 16 bp, M. musculus
aaattgttcctttttt

SEQ ID NO: 340292 - DNA, 16 bp, M. musculus
aaattgttcttttaaa

SEQ ID NO: 340293 - DNA, 16 bp, M. musculus
aaattgttttagaaaa

SEQ ID NO: 340294 - DNA, 16 bp, M. musculus
aaattgttttatttct

SEQ ID NO: 340295 - DNA, 16 bp, M. musculus
aaattgtttttccttt

SEQ ID NO: 340296 - DNA, 16 bp, M. musculus
aaattgtttttggaaa

SEQ ID NO: 340297 - DNA, 16 bp, M. musculus
aaatttaaatcagaat

SEQ ID NO: 340298 - DNA, 16 bp, M. musculus
aaatttaacattttca

SEQ ID NO: 340299 - DNA, 16 bp, M. musculus
aaatttaatgttttct

SEQ ID NO: 340300 - DNA, 16 bp, M. musculus
aaatttactaaagctc

SEQ ID NO: 340301 - DNA, 16 bp, M. musculus
aaatttagggttgctg

SEQ ID NO: 340302 - DNA, 16 bp, M. musculus
aaatttatctgaaata

SEQ ID NO: 340303 - DNA, 16 bp, M. musculus
aaatttatctggaaaa

SEQ ID NO: 340304 - DNA, 16 bp, M. musculus
aaatttcaaaattcta

SEQ ID NO: 340305 - DNA, 16 bp, M. musculus
aaatttcaaaattgaa

SEQ ID NO: 340306 - DNA, 16 bp, M. musculus
aaatttcaactttaaa

SEQ ID NO: 340307 - DNA, 16 bp, M. musculus
aaatttcaatgaaaat

SEQ ID NO: 340308 - DNA, 16 bp, M. musculus
aaatttcagaagaaaa

SEQ ID NO: 340309 - DNA, 16 bp, M. musculus
aaatttcagagggaaa

SEQ ID NO: 340310 - DNA, 16 bp, M. musculus
aaatttcaggggagga

SEQ ID NO: 340311 - DNA, 16 bp, M. musculus
aaatttcagtgtctct

SEQ ID NO: 340312 - DNA, 16 bp, M. musculus
aaatttcatctctcta

SEQ ID NO: 340313 - DNA, 16 bp, M. musculus
aaatttcatcttaaaa

SEQ ID NO: 340314 - DNA, 16 bp, M. musculus
aaatttcatgatgcca

SEQ ID NO: 340315 - DNA, 16 bp, M. musculus
aaatttcatttttgta

SEQ ID NO: 340316 - DNA, 16 bp, M. musculus
aaatttccaaagaaaa

SEQ ID NO: 340317 - DNA, 16 bp, M. musculus
aaatttccacttcaca

SEQ ID NO: 340318 - DNA, 16 bp, M. musculus
aaatttccacttcacc

SEQ ID NO: 340319 - DNA, 16 bp, M. musculus
aaatttccagaacaga

SEQ ID NO: 340320 - DNA, 16 bp, M. musculus
aaatttccagacagat

SEQ ID NO: 340321 - DNA, 16 bp, M. musculus
aaatttccaggcaaat

SEQ ID NO: 340322 - DNA, 16 bp, M. musculus
aaatttccattcattt

SEQ ID NO: 340323 - DNA, 16 bp, M. musculus
aaatttcctcctagaa

SEQ ID NO: 340324 - DNA, 16 bp, M. musculus
aaatttcctgaagaga

SEQ ID NO: 340325 - DNA, 16 bp, M. musculus
aaatttctgaacagaa

SEQ ID NO: 340326 - DNA, 16 bp, M. musculus
aaatttctggttttgt

SEQ ID NO: 340327 - DNA, 16 bp, M. musculus
aaatttctgttttaaa

SEQ ID NO: 340328 - DNA, 16 bp, M. musculus
aaatttcttacatatt

SEQ ID NO: 340329 - DNA, 16 bp, M. musculus
aaatttcttgtttctt

SEQ ID NO: 340330 - DNA, 16 bp, M. musculus
aaatttctttcctgac

SEQ ID NO: 340331 - DNA, 16 bp, M. musculus
aaatttgaaaatgttt

SEQ ID NO: 340332 - DNA, 16 bp, M. musculus
aaatttgaatgaaatt

SEQ ID NO: 340333 - DNA, 16 bp, M. musculus
aaatttgaatgttact

SEQ ID NO: 340334 - DNA, 16 bp, M. musculus
aaatttgataactcaa

SEQ ID NO: 340335 - DNA, 16 bp, M. musculus
aaatttgattcccagc

SEQ ID NO: 340336 - DNA, 16 bp, M. musculus
aaatttgcaaagcttc

SEQ ID NO: 340337 - DNA, 16 bp, M. musculus
aaatttgcaggcaaat

SEQ ID NO: 340338 - DNA, 16 bp, M. musculus
aaatttgctcagtttc

SEQ ID NO: 340339 - DNA, 16 bp, M. musculus
aaatttgctttaaaat

SEQ ID NO: 340340 - DNA, 16 bp, M. musculus
aaatttgcttttattt

SEQ ID NO: 340341 - DNA, 16 bp, M. musculus
aaatttggaaccatag

SEQ ID NO: 340342 - DNA, 16 bp, M. musculus
aaatttggttttgtta

SEQ ID NO: 340343 - DNA, 16 bp, M. musculus
aaatttgtcagctgtc

SEQ ID NO: 340344 - DNA, 16 bp, M. musculus
aaatttgtcattatat

SEQ ID NO: 340345 - DNA, 16 bp, M. musculus
aaatttgtccatttca

SEQ ID NO: 340346 - DNA, 16 bp, M. musculus
aaatttgtgtgtgtgt

SEQ ID NO: 340347 - DNA, 16 bp, M. musculus
aaattttaaaaactga

SEQ ID NO: 340348 - DNA, 16 bp, M. musculus
aaattttaaaaagtca

SEQ ID NO: 340349 - DNA, 16 bp, M. musculus
aaattttaaaaagtct

SEQ ID NO: 340350 - DNA, 21 bp, M. musculus
aaattttaccctgctttcaga

SEQ ID NO: 340351 - DNA, 16 bp, M. musculus
aaattttacttttgat

SEQ ID NO: 340352 - DNA, 16 bp, M. musculus
aaattttatccctttt

SEQ ID NO: 340353 - DNA, 16 bp, M. musculus
aaattttatctactca

SEQ ID NO: 340354 - DNA, 16 bp, M. musculus
aaattttattgttgtg

SEQ ID NO: 340355 - DNA, 16 bp, M. musculus
aaattttattttcatg

SEQ ID NO: 340356 - DNA, 16 bp, M. musculus
aaattttcaaaagaaa

SEQ ID NO: 340357 - DNA, 16 bp, M. musculus
aaattttcaaagaaat

SEQ ID NO: 340358 - DNA, 16 bp, M. musculus
aaattttcaaagaact

SEQ ID NO: 340359 - DNA, 16 bp, M. musculus
aaattttcaagttttt

SEQ ID NO: 340360 - DNA, 16 bp, M. musculus
aaattttcactaaaat

SEQ ID NO: 340361 - DNA, 16 bp, M. musculus
aaattttcatttcaaa

SEQ ID NO: 340362 - DNA, 16 bp, M. musculus
aaattttcatttgaaa

SEQ ID NO: 340363 - DNA, 16 bp, M. musculus
aaattttccagccttt

SEQ ID NO: 340364 - DNA, 16 bp, M. musculus
aaattttctaaaatgt

SEQ ID NO: 340365 - DNA, 16 bp, M. musculus
aaattttctcaaaagc

SEQ ID NO: 340366 - DNA, 16 bp, M. musculus
aaattttcttctgtga

SEQ ID NO: 340367 - DNA, 16 bp, M. musculus
aaattttgaaaaactc

SEQ ID NO: 340368 - DNA, 16 bp, M. musculus
aaattttgaagtacag

SEQ ID NO: 340369 - DNA, 16 bp, M. musculus
aaattttgatgaggat

SEQ ID NO: 340370 - DNA, 16 bp, M. musculus
aaattttgatttttct

SEQ ID NO: 340371 - DNA, 16 bp, M. musculus
aaattttggaaggaaa

SEQ ID NO: 340372 - DNA, 16 bp, M. musculus
aaattttgggtcaaag

SEQ ID NO: 340373 - DNA, 16 bp, M. musculus
aaattttgggtcctgt

SEQ ID NO: 340374 - DNA, 16 bp, M. musculus
aaatttttaatccaga

SEQ ID NO: 340375 - DNA, 20 bp, M. musculus
aaatttttcacaggcttata

SEQ ID NO: 340376 - DNA, 16 bp, M. musculus
aaatttttcacttaac

SEQ ID NO: 340377 - DNA, 16 bp, M. musculus
aaatttttccttaaaa

SEQ ID NO: 340378 - DNA, 16 bp, M. musculus
aaatttttgaagatgg

SEQ ID NO: 340379 - DNA, 16 bp, M. musculus
aaatttttttttccag

SEQ ID NO: 340380 - DNA, 16 bp, M. musculus
aacaaaaaaaccctgc

SEQ ID NO: 340381 - DNA, 16 bp, M. musculus
aacaaaaaacaacctg

SEQ ID NO: 340382 - DNA, 16 bp, M. musculus
aacaaaaaacccaggg

SEQ ID NO: 340383 - DNA, 16 bp, M. musculus
aacaaaaaacgtagga

SEQ ID NO: 340384 - DNA, 16 bp, M. musculus
aacaaaaacagccagg

SEQ ID NO: 340385 - DNA, 16 bp, M. musculus
aacaaaaagcaactta

SEQ ID NO: 340386 - DNA, 16 bp, M. musculus
aacaaaaaggaaacct

SEQ ID NO: 340387 - DNA, 16 bp, M. musculus
aacaaaaataaatgtt

SEQ ID NO: 340388 - DNA, 17 bp, M. musculus
aacaaaaatcaagacca

SEQ ID NO: 340389 - DNA, 16 bp, M. musculus
aacaaaaatcacatga

SEQ ID NO: 340390 - DNA, 16 bp, M. musculus
aacaaaaatttttgat

SEQ ID NO: 340391 - DNA, 16 bp, M. musculus
aacaaaacaaaactgt

SEQ ID NO: 340392 - DNA, 16 bp, M. musculus
aacaaaacaaaatgcc

SEQ ID NO: 340393 - DNA, 17 bp, M. musculus
aacaaaacacccgtgga

SEQ ID NO: 340394 - DNA, 16 bp, M. musculus
aacaaaaccaaaattg

SEQ ID NO: 340395 - DNA, 16 bp, M. musculus
aacaaaaccaagagct

SEQ ID NO: 340396 - DNA, 16 bp, M. musculus
aacaaaaccagaagtg

SEQ ID NO: 340397 - DNA, 16 bp, M. musculus
aacaaaaccaggagct

SEQ ID NO: 340398 - DNA, 16 bp, M. musculus
aacaaaaccatccaag

SEQ ID NO: 340399 - DNA, 16 bp, M. musculus
aacaaaaccatccaga

SEQ ID NO: 340400 - DNA, 16 bp, M. musculus
aacaaaactggatgaa

SEQ ID NO: 340401 - DNA, 16 bp, M. musculus
aacaaaactgtaaaat

SEQ ID NO: 340402 - DNA, 16 bp, M. musculus
aacaaaagcagaaatg

SEQ ID NO: 340403 - DNA, 16 bp, M. musculus
aacaaaataaagttta

SEQ ID NO: 340404 - DNA, 16 bp, M. musculus
aacaaaataatcaagg

SEQ ID NO: 340405 - DNA, 16 bp, M. musculus
aacaaaataattgtat

SEQ ID NO: 340406 - DNA, 16 bp, M. musculus
aacaaaataccatgga

SEQ ID NO: 340407 - DNA, 16 bp, M. musculus
aacaaaatactcacag

SEQ ID NO: 340408 - DNA, 16 bp, M. musculus
aacaaaatactcactg

SEQ ID NO: 340409 - DNA, 16 bp, M. musculus
aacaaaatactcatga

SEQ ID NO: 340410 - DNA, 16 bp, M. musculus
aacaaaatattcatgg

SEQ ID NO: 340411 - DNA, 16 bp, M. musculus
aacaaaatattccaag

SEQ ID NO: 340412 - DNA, 16 bp, M. musculus
aacaaaatcagaagtg

SEQ ID NO: 340413 - DNA, 30 bp, M. musculus
aacaaaatctcttaagcatgtcagagtcct

SEQ ID NO: 340414 - DNA, 16 bp, M. musculus
aacaaaatctgaggaa

SEQ ID NO: 340415 - DNA, 16 bp, M. musculus
aacaaaatggcagcct

SEQ ID NO: 340416 - DNA, 16 bp, M. musculus
aacaaaatgtagaact

SEQ ID NO: 340417 - DNA, 16 bp, M. musculus
aacaaaatgtatttat

SEQ ID NO: 340418 - DNA, 17 bp, M. musculus
aacaaaattatagaaga

SEQ ID NO: 340419 - DNA, 16 bp, M. musculus
aacaaaattatagatg

SEQ ID NO: 340420 - DNA, 16 bp, M. musculus
aacaaacaaaaatttg

SEQ ID NO: 340421 - DNA, 16 bp, M. musculus
aacaaacaaaactttt

SEQ ID NO: 340422 - DNA, 16 bp, M. musculus
aacaaacaaaatcatg

SEQ ID NO: 340423 - DNA, 16 bp, M. musculus
aacaaacaaatgagca

SEQ ID NO: 340424 - DNA, 16 bp, M. musculus
aacaaacaagcaaatc

SEQ ID NO: 340425 - DNA, 16 bp, M. musculus
aacaaacacagacact

SEQ ID NO: 340426 - DNA, 16 bp, M. musculus
aacaaacaggctgaga

SEQ ID NO: 340427 - DNA, 16 bp, M. musculus
aacaaacatttcattg

SEQ ID NO: 340428 - DNA, 16 bp, M. musculus
aacaaaccctttcctc

SEQ ID NO: 340429 - DNA, 16 bp, M. musculus
aacaaacctcagaaca

SEQ ID NO: 340430 - DNA, 16 bp, M. musculus
aacaaactatagaaat

SEQ ID NO: 340431 - DNA, 16 bp, M. musculus
aacaaactcaaagtaa

SEQ ID NO: 340432 - DNA, 16 bp, M. musculus
aacaaactcaaggaaa

SEQ ID NO: 340433 - DNA, 16 bp, M. musculus
aacaaactgcagcaca

SEQ ID NO: 340434 - DNA, 16 bp, M. musculus
aacaaagaaataattt

SEQ ID NO: 340435 - DNA, 16 bp, M. musculus
aacaaagaactccatg

SEQ ID NO: 340436 - DNA, 16 bp, M. musculus
aacaaagaagtacaca

SEQ ID NO: 340437 - DNA, 16 bp, M. musculus
aacaaagacaaaagtg

SEQ ID NO: 340438 - DNA, 16 bp, M. musculus
aacaaagacacaatga

SEQ ID NO: 340439 - DNA, 16 bp, M. musculus
aacaaagaggatctcc

SEQ ID NO: 340440 - DNA, 16 bp, M. musculus
aacaaagatatcatga

SEQ ID NO: 340441 - DNA, 16 bp, M. musculus
aacaaagatggagaaa

SEQ ID NO: 340442 - DNA, 16 bp, M. musculus
aacaaagccacaccta

SEQ ID NO: 340443 - DNA, 16 bp, M. musculus
aacaaaggaggagctg

SEQ ID NO: 340444 - DNA, 16 bp, M. musculus
aacaaagttttaaaaa

SEQ ID NO: 340445 - DNA, 16 bp, M. musculus
aacaaataaataagtg

SEQ ID NO: 340446 - DNA, 16 bp, M. musculus
aacaaataaatgtttt

SEQ ID NO: 340447 - DNA, 16 bp, M. musculus
aacaaatacacactga

SEQ ID NO: 340448 - DNA, 16 bp, M. musculus
aacaaatacagaagtg

SEQ ID NO: 340449 - DNA, 16 bp, M. musculus
aacaaatacagacaca

SEQ ID NO: 340450 - DNA, 16 bp, M. musculus
aacaaatacttttcct

SEQ ID NO: 340451 - DNA, 16 bp, M. musculus
aacaaatatggagata

SEQ ID NO: 340452 - DNA, 17 bp, M. musculus
aacaaatcagtggcctt

SEQ ID NO: 340453 - DNA, 16 bp, M. musculus
aacaaatgaacagaag

SEQ ID NO: 340454 - DNA, 16 bp, M. musculus
aacaaatgccagccca

SEQ ID NO: 340455 - DNA, 16 bp, M. musculus
aacaaatgctcttaac

SEQ ID NO: 340456 - DNA, 16 bp, M. musculus
aacaaatgctggtgag

SEQ ID NO: 340457 - DNA, 16 bp, M. musculus
aacaaatggagctggt

SEQ ID NO: 340458 - DNA, 16 bp, M. musculus
aacaaatggtgctgat

SEQ ID NO: 340459 - DNA, 16 bp, M. musculus
aacaaatggtgctgct

SEQ ID NO: 340460 - DNA, 16 bp, M. musculus
aacaaattttaaaagg

SEQ ID NO: 340461 - DNA, 16 bp, M. musculus
aacaaattttaaatgt

SEQ ID NO: 340462 - DNA, 16 bp, M. musculus
aacaacaaaaaagcct

SEQ ID NO: 340463 - DNA, 16 bp, M. musculus
aacaacaaaaagtttt

SEQ ID NO: 340464 - DNA, 16 bp, M. musculus
aacaacaacaaaagct

SEQ ID NO: 340465 - DNA, 16 bp, M. musculus
aacaacaacaaatttt

SEQ ID NO: 340466 - DNA, 16 bp, M. musculus
aacaacaacagcatca

SEQ ID NO: 340467 - DNA, 16 bp, M. musculus
aacaacaaccttctca

SEQ ID NO: 340468 - DNA, 19 bp, M. musculus
aacaacaagagtcatggta

SEQ ID NO: 340469 - DNA, 17 bp, M. musculus
aacaacaatatgaacca

SEQ ID NO: 340470 - DNA, 16 bp, M. musculus
aacaacacaatctcag

SEQ ID NO: 340471 - DNA, 16 bp, M. musculus
aacaacagaaaccgag

SEQ ID NO: 340472 - DNA, 16 bp, M. musculus
aacaacagaaactgaa

SEQ ID NO: 340473 - DNA, 16 bp, M. musculus
aacaacagaaatcaag

SEQ ID NO: 340474 - DNA, 16 bp, M. musculus
aacaacagaacctgag

SEQ ID NO: 340475 - DNA, 16 bp, M. musculus
aacaacagattggaaa

SEQ ID NO: 340476 - DNA, 16 bp, M. musculus
aacaacagcagcagca

SEQ ID NO: 340477 - DNA, 16 bp, M. musculus
aacaacagcttctgtg

SEQ ID NO: 340478 - DNA, 16 bp, M. musculus
aacaacaggatgttct

SEQ ID NO: 340479 - DNA, 16 bp, M. musculus
aacaacagtagcagca

SEQ ID NO: 340480 - DNA, 16 bp, M. musculus
aacaacataaatgatg

SEQ ID NO: 340481 - DNA, 16 bp, M. musculus
aacaacatcatgaact

SEQ ID NO: 340482 - DNA, 16 bp, M. musculus
aacaacatgaccaagg

SEQ ID NO: 340483 - DNA, 16 bp, M. musculus
aacaacatttttttaa

SEQ ID NO: 340484 - DNA, 16 bp, M. musculus
aacaaccaagtagaaa

SEQ ID NO: 340485 - DNA, 16 bp, M. musculus
aacaaccacaatactc

SEQ ID NO: 340486 - DNA, 16 bp, M. musculus
aacaaccatctgtaat

SEQ ID NO: 340487 - DNA, 17 bp, M. musculus
aacaaccatggaaggag

SEQ ID NO: 340488 - DNA, 16 bp, M. musculus
aacaacccagaagtcc

SEQ ID NO: 340489 - DNA, 16 bp, M. musculus
aacaacccataatgag

SEQ ID NO: 340490 - DNA, 16 bp, M. musculus
aacaaccctgagatac

SEQ ID NO: 340491 - DNA, 16 bp, M. musculus
aacaactaagaaagta

SEQ ID NO: 340492 - DNA, 16 bp, M. musculus
aacaactcaattagat

SEQ ID NO: 340493 - DNA, 16 bp, M. musculus
aacaactcactactga

SEQ ID NO: 340494 - DNA, 17 bp, M. musculus
aacaactcctgaaaact

SEQ ID NO: 340495 - DNA, 16 bp, M. musculus
aacaactctctactga

SEQ ID NO: 340496 - DNA, 16 bp, M. musculus
aacaactgaagcagag

SEQ ID NO: 340497 - DNA, 16 bp, M. musculus
aacaactggaatgtaa

SEQ ID NO: 340498 - DNA, 16 bp, M. musculus
aacaactggagcagaa

SEQ ID NO: 340499 - DNA, 16 bp, M. musculus
aacaactggagcaggg

SEQ ID NO: 340500 - DNA, 16 bp, M. musculus
aacaactggagccagg

SEQ ID NO: 340501 - DNA, 16 bp, M. musculus
aacaactggagcgggg

SEQ ID NO: 340502 - DNA, 16 bp, M. musculus
aacaactggagctggg

SEQ ID NO: 340503 - DNA, 16 bp, M. musculus
aacaacttcctgaaca

SEQ ID NO: 340504 - DNA, 16 bp, M. musculus
aacaagaaacactgaa

SEQ ID NO: 340505 - DNA, 16 bp, M. musculus
aacaagaacaatggca

SEQ ID NO: 340506 - DNA, 16 bp, M. musculus
aacaagaagaaattag

SEQ ID NO: 340507 - DNA, 16 bp, M. musculus
aacaagagatagaaga

SEQ ID NO: 340508 - DNA, 16 bp, M. musculus
aacaagagcttgctgt

SEQ ID NO: 340509 - DNA, 16 bp, M. musculus
aacaagagtcatggta

SEQ ID NO: 340510 - DNA, 17 bp, M. musculus
aacaagataccagaact

SEQ ID NO: 340511 - DNA, 16 bp, M. musculus
aacaagatatctgaga

SEQ ID NO: 340512 - DNA, 16 bp, M. musculus
aacaagatcagaaatg

SEQ ID NO: 340513 - DNA, 16 bp, M. musculus
aacaagatgaagaaac

SEQ ID NO: 340514 - DNA, 16 bp, M. musculus
aacaagatggaaggcc

SEQ ID NO: 340515 - DNA, 16 bp, M. musculus
aacaagattatgaact

SEQ ID NO: 340516 - DNA, 16 bp, M. musculus
aacaagccagttagca

SEQ ID NO: 340517 - DNA, 16 bp, M. musculus
aacaagcctccacagg

SEQ ID NO: 340518 - DNA, 16 bp, M. musculus
aacaagcctgaagcag

SEQ ID NO: 340519 - DNA, 16 bp, M. musculus
aacaagctcagctgct

SEQ ID NO: 340520 - DNA, 17 bp, M. musculus
aacaagctggagaagcc

SEQ ID NO: 340521 - DNA, 16 bp, M. musculus
aacaagctggaggagc

SEQ ID NO: 340522 - DNA, 16 bp, M. musculus
aacaagctggagtacc

SEQ ID NO: 340523 - DNA, 16 bp, M. musculus
aacaagctgggcagtg

SEQ ID NO: 340524 - DNA, 16 bp, M. musculus
aacaaggaaaatgatg

SEQ ID NO: 340525 - DNA, 16 bp, M. musculus
aacaaggaaagggaat

SEQ ID NO: 340526 - DNA, 16 bp, M. musculus
aacaaggagctgaaag

SEQ ID NO: 340527 - DNA, 16 bp, M. musculus
aacaaggccacacctc

SEQ ID NO: 340528 - DNA, 16 bp, M. musculus
aacaaggccacactta

SEQ ID NO: 340529 - DNA, 16 bp, M. musculus
aacaaggccacagctt

SEQ ID NO: 340530 - DNA, 16 bp, M. musculus
aacaaggccatcatct

SEQ ID NO: 340531 - DNA, 16 bp, M. musculus
aacaaggccatcctct

SEQ ID NO: 340532 - DNA, 16 bp, M. musculus
aacaaggccctgggtt

SEQ ID NO: 340533 - DNA, 16 bp, M. musculus
aacaaggctctctaaa

SEQ ID NO: 340534 - DNA, 16 bp, M. musculus
aacaagggagagatat

SEQ ID NO: 340535 - DNA, 16 bp, M. musculus
aacaaggtagcccagc

SEQ ID NO: 340536 - DNA, 16 bp, M. musculus
aacaaggtcatcctct

SEQ ID NO: 340537 - DNA, 16 bp, M. musculus
aacaaggtggaaggca

SEQ ID NO: 340538 - DNA, 16 bp, M. musculus
aacaaggttacttggc

SEQ ID NO: 340539 - DNA, 16 bp, M. musculus
aacaaggtttctctgt

SEQ ID NO: 340540 - DNA, 16 bp, M. musculus
aacaagtagaccaatg

SEQ ID NO: 340541 - DNA, 16 bp, M. musculus
aacaagtatttattga

SEQ ID NO: 340542 - DNA, 16 bp, M. musculus
aacaagtcctggatac

SEQ ID NO: 340543 - DNA, 16 bp, M. musculus
aacaagtgctgttaac

SEQ ID NO: 340544 - DNA, 16 bp, M. musculus
aacaagtgcttgctta

SEQ ID NO: 340545 - DNA, 16 bp, M. musculus
aacaataaaaatgtat

SEQ ID NO: 340546 - DNA, 16 bp, M. musculus
aacaataaaagatcct

SEQ ID NO: 340547 - DNA, 16 bp, M. musculus
aacaataaattcttct

SEQ ID NO: 340548 - DNA, 16 bp, M. musculus
aacaataactaagaca

SEQ ID NO: 340549 - DNA, 16 bp, M. musculus
aacaatacagaaatca

SEQ ID NO: 340550 - DNA, 16 bp, M. musculus
aacaatacaggctatt

SEQ ID NO: 340551 - DNA, 16 bp, M. musculus
aacaatatcaaccaag

SEQ ID NO: 340552 - DNA, 16 bp, M. musculus
aacaatatcaaccagc

SEQ ID NO: 340553 - DNA, 16 bp, M. musculus
aacaatcaaagaaact

SEQ ID NO: 340554 - DNA, 16 bp, M. musculus
aacaatcaattgaaca

SEQ ID NO: 340555 - DNA, 16 bp, M. musculus
aacaatcactattctt

SEQ ID NO: 340556 - DNA, 16 bp, M. musculus
aacaatcctaaaagaa

SEQ ID NO: 340557 - DNA, 16 bp, M. musculus
aacaatcctcctgcct

SEQ ID NO: 340558 - DNA, 16 bp, M. musculus
aacaatctattttcaa

SEQ ID NO: 340559 - DNA, 16 bp, M. musculus
aacaatctcaaagaca

SEQ ID NO: 340560 - DNA, 16 bp, M. musculus
aacaatctccactttg

SEQ ID NO: 340561 - DNA, 16 bp, M. musculus
aacaatgaagataaag

SEQ ID NO: 340562 - DNA, 16 bp, M. musculus
aacaatgaagccatcg

SEQ ID NO: 340563 - DNA, 16 bp, M. musculus
aacaatgaatttaaga

SEQ ID NO: 340564 - DNA, 16 bp, M. musculus
aacaatggagaagtgt

SEQ ID NO: 340565 - DNA, 16 bp, M. musculus
aacaatggaggaatat

SEQ ID NO: 340566 - DNA, 16 bp, M. musculus
aacaatggcctatgat

SEQ ID NO: 340567 - DNA, 16 bp, M. musculus
aacaatggctgtctac

SEQ ID NO: 340568 - DNA, 16 bp, M. musculus
aacaatggttcagtca

SEQ ID NO: 340569 - DNA, 16 bp, M. musculus
aacaatgtattcaata

SEQ ID NO: 340570 - DNA, 16 bp, M. musculus
aacaatgtatttatga

SEQ ID NO: 340571 - DNA, 16 bp, M. musculus
aacaattactttttct

SEQ ID NO: 340572 - DNA, 16 bp, M. musculus
aacaattcattttaaa

SEQ ID NO: 340573 - DNA, 16 bp, M. musculus
aacaattctgagattc

SEQ ID NO: 340574 - DNA, 16 bp, M. musculus
aacaattctgttcatt

SEQ ID NO: 340575 - DNA, 16 bp, M. musculus
aacaattgaaaatatt

SEQ ID NO: 340576 - DNA, 16 bp, M. musculus
aacaattgaagtaata

SEQ ID NO: 340577 - DNA, 16 bp, M. musculus
aacaattgttgagaag

SEQ ID NO: 340578 - DNA, 16 bp, M. musculus
aacaatttaaacagtc

SEQ ID NO: 340579 - DNA, 16 bp, M. musculus
aacaatttattttcat

SEQ ID NO: 340580 - DNA, 16 bp, M. musculus
aacaatttcccttatg

SEQ ID NO: 340581 - DNA, 16 bp, M. musculus
aacacaaaactggaaa

SEQ ID NO: 340582 - DNA, 16 bp, M. musculus
aacacaaaatgaactt

SEQ ID NO: 340583 - DNA, 16 bp, M. musculus
aacacaaaattgtaaa

SEQ ID NO: 340584 - DNA, 16 bp, M. musculus
aacacaaactagagtc

SEQ ID NO: 340585 - DNA, 16 bp, M. musculus
aacacaaatagctccc

SEQ ID NO: 340586 - DNA, 19 bp, M. musculus
aacacaaatgccagcccag

SEQ ID NO: 340587 - DNA, 16 bp, M. musculus
aacacaaattccatcc

SEQ ID NO: 340588 - DNA, 17 bp, M. musculus
aacacaacttctgccag

SEQ ID NO: 340589 - DNA, 16 bp, M. musculus
aacacaagaaaatgac

SEQ ID NO: 340590 - DNA, 16 bp, M. musculus
aacacaagcccacagc

SEQ ID NO: 340591 - DNA, 16 bp, M. musculus
aacacaattatttaca

SEQ ID NO: 340592 - DNA, 16 bp, M. musculus
aacacaatttttcaaa

SEQ ID NO: 340593 - DNA, 16 bp, M. musculus
aacacacaacagagtt

SEQ ID NO: 340594 - DNA, 16 bp, M. musculus
aacacacacacacatg

SEQ ID NO: 340595 - DNA, 16 bp, M. musculus
aacacacacacatgta

SEQ ID NO: 340596 - DNA, 16 bp, M. musculus
aacacacacttttaat

SEQ ID NO: 340597 - DNA, 16 bp, M. musculus
aacacacatgcacgca

SEQ ID NO: 340598 - DNA, 16 bp, M. musculus
aacacacccagagaca

SEQ ID NO: 340599 - DNA, 16 bp, M. musculus
aacacacctcagcaat

SEQ ID NO: 340600 - DNA, 16 bp, M. musculus
aacacagaaatccctt

SEQ ID NO: 340601 - DNA, 16 bp, M. musculus
aacacagaagaggatg

SEQ ID NO: 340602 - DNA, 16 bp, M. musculus
aacacagacatggaag

SEQ ID NO: 340603 - DNA, 16 bp, M. musculus
aacacagacatttaca

SEQ ID NO: 340604 - DNA, 16 bp, M. musculus
aacacagaccaggaag

SEQ ID NO: 340605 - DNA, 16 bp, M. musculus
aacacagagagcagca

SEQ ID NO: 340606 - DNA, 16 bp, M. musculus
aacacagatatttatt

SEQ ID NO: 340607 - DNA, 16 bp, M. musculus
aacacagcagcatcca

SEQ ID NO: 340608 - DNA, 16 bp, M. musculus
aacacagctctcacct

SEQ ID NO: 340609 - DNA, 16 bp, M. musculus
aacacagcttcaggga

SEQ ID NO: 340610 - DNA, 16 bp, M. musculus
aacacaggctgccttt

SEQ ID NO: 340611 - DNA, 16 bp, M. musculus
aacacagggctggaga

SEQ ID NO: 340612 - DNA, 16 bp, M. musculus
aacacaggtaaaggtg

SEQ ID NO: 340613 - DNA, 16 bp, M. musculus
aacacaggtgacaaca

SEQ ID NO: 340614 - DNA, 16 bp, M. musculus
aacacagtacacagga

SEQ ID NO: 340615 - DNA, 16 bp, M. musculus
aacacagtgagttcca

SEQ ID NO: 340616 - DNA, 16 bp, M. musculus
aacacagttcttcaca

SEQ ID NO: 340617 - DNA, 16 bp, M. musculus
aacacataaaaatgat

SEQ ID NO: 340618 - DNA, 16 bp, M. musculus
aacacataaacacatg

SEQ ID NO: 340619 - DNA, 16 bp, M. musculus
aacacatacacaagaa

SEQ ID NO: 340620 - DNA, 16 bp, M. musculus
aacacatcaaaagaat

SEQ ID NO: 340621 - DNA, 16 bp, M. musculus
aacacatccaatcagg

SEQ ID NO: 340622 - DNA, 16 bp, M. musculus
aacacatctaaacagg

SEQ ID NO: 340623 - DNA, 16 bp, M. musculus
aacacatcttttaaaa

SEQ ID NO: 340624 - DNA, 16 bp, M. musculus
aacacatgcacacatg

SEQ ID NO: 340625 - DNA, 16 bp, M. musculus
aacacatgctcctgtg

SEQ ID NO: 340626 - DNA, 16 bp, M. musculus
aacacatgctggcaag

SEQ ID NO: 340627 - DNA, 16 bp, M. musculus
aacacattaaaaccat

SEQ ID NO: 340628 - DNA, 16 bp, M. musculus
aacacatttctttctc

SEQ ID NO: 340629 - DNA, 16 bp, M. musculus
aacacattttagaaaa

SEQ ID NO: 340630 - DNA, 16 bp, M. musculus
aacacattttttaaat

SEQ ID NO: 340631 - DNA, 16 bp, M. musculus
aacaccaaacagattg

SEQ ID NO: 340632 - DNA, 16 bp, M. musculus
aacaccaagctactca

SEQ ID NO: 340633 - DNA, 16 bp, M. musculus
aacaccaatgcacatt

SEQ ID NO: 340634 - DNA, 16 bp, M. musculus
aacaccaggagaagtt

SEQ ID NO: 340635 - DNA, 16 bp, M. musculus
aacaccatcaccatca

SEQ ID NO: 340636 - DNA, 16 bp, M. musculus
aacaccatggtgttga

SEQ ID NO: 340637 - DNA, 16 bp, M. musculus
aacacccagaggaagc

SEQ ID NO: 340638 - DNA, 16 bp, M. musculus
aacacccaggaaatct

SEQ ID NO: 340639 - DNA, 16 bp, M. musculus
aacacccaggaccacc

SEQ ID NO: 340640 - DNA, 16 bp, M. musculus
aacacccatatacaca

SEQ ID NO: 340641 - DNA, 16 bp, M. musculus
aacacccatttatgat

SEQ ID NO: 340642 - DNA, 16 bp, M. musculus
aacaccctcacagaca

SEQ ID NO: 340643 - DNA, 17 bp, M. musculus
aacaccctcctctggcc

SEQ ID NO: 340644 - DNA, 16 bp, M. musculus
aacacccttctcaatg

SEQ ID NO: 340645 - DNA, 16 bp, M. musculus
aacacctactgtgtgc

SEQ ID NO: 340646 - DNA, 16 bp, M. musculus
aacacctgagaaactt

SEQ ID NO: 340647 - DNA, 16 bp, M. musculus
aacacctgcaagggcc

SEQ ID NO: 340648 - DNA, 16 bp, M. musculus
aacacctgtaatccca

SEQ ID NO: 340649 - DNA, 16 bp, M. musculus
aacaccttctgtccca

SEQ ID NO: 340650 - DNA, 16 bp, M. musculus
aacacgtgcccctgtg

SEQ ID NO: 340651 - DNA, 16 bp, M. musculus
aacactaactaagaca

SEQ ID NO: 340652 - DNA, 36 bp, M. musculus
aacactaatccacagcaaagtgtatctccaaataat

SEQ ID NO: 340653 - DNA, 16 bp, M. musculus
aacactactgaactgg

SEQ ID NO: 340654 - DNA, 16 bp, M. musculus
aacactagataagaga

SEQ ID NO: 340655 - DNA, 16 bp, M. musculus
aacactatgactaaaa

SEQ ID NO: 340656 - DNA, 16 bp, M. musculus
aacactcaggagacag

SEQ ID NO: 340657 - DNA, 16 bp, M. musculus
aacactcaggtgattt

SEQ ID NO: 340658 - DNA, 16 bp, M. musculus
aacactcagtcctaag

SEQ ID NO: 340659 - DNA, 16 bp, M. musculus
aacactcatacatatt

SEQ ID NO: 340660 - DNA, 16 bp, M. musculus
aacactcctccatggc

SEQ ID NO: 340661 - DNA, 16 bp, M. musculus
aacactccttcattgc

SEQ ID NO: 340662 - DNA, 16 bp, M. musculus
aacactgaccaaagca

SEQ ID NO: 340663 - DNA, 16 bp, M. musculus
aacactgacttccagg

SEQ ID NO: 340664 - DNA, 16 bp, M. musculus
aacactgagattccat

SEQ ID NO: 340665 - DNA, 16 bp, M. musculus
aacactgcaacaggat

SEQ ID NO: 340666 - DNA, 16 bp, M. musculus
aacactgcctggctcc

SEQ ID NO: 340667 - DNA, 16 bp, M. musculus
aacactgctaaagagg

SEQ ID NO: 340668 - DNA, 16 bp, M. musculus
aacactggaaagaaaa

SEQ ID NO: 340669 - DNA, 16 bp, M. musculus
aacactggagaaagaa

SEQ ID NO: 340670 - DNA, 17 bp, M. musculus
aacactggagatagaaa

SEQ ID NO: 340671 - DNA, 16 bp, M. musculus
aacactggcagtttaa

SEQ ID NO: 340672 - DNA, 16 bp, M. musculus
aacactgtcaatagga

SEQ ID NO: 340673 - DNA, 16 bp, M. musculus
aacactgtcagttgaa

SEQ ID NO: 340674 - DNA, 19 bp, M. musculus
aacactgtctatagaataa

SEQ ID NO: 340675 - DNA, 16 bp, M. musculus
aacacttacatagata

SEQ ID NO: 340676 - DNA, 16 bp, M. musculus
aacacttcaaaacaat

SEQ ID NO: 340677 - DNA, 16 bp, M. musculus
aacacttcccaaaaga

SEQ ID NO: 340678 - DNA, 16 bp, M. musculus
aacacttcctggcaca

SEQ ID NO: 340679 - DNA, 16 bp, M. musculus
aacacttgcccctgtg

SEQ ID NO: 340680 - DNA, 16 bp, M. musculus
aacacttggaggcaga

SEQ ID NO: 340681 - DNA, 16 bp, M. musculus
aacacttgttggcatc

SEQ ID NO: 340682 - DNA, 16 bp, M. musculus
aacagaaaaaaattgt

SEQ ID NO: 340683 - DNA, 16 bp, M. musculus
aacagaaaaatattta

SEQ ID NO: 340684 - DNA, 16 bp, M. musculus
aacagaaaacaagatt

SEQ ID NO: 340685 - DNA, 16 bp, M. musculus
aacagaaaacaaggct

SEQ ID NO: 340686 - DNA, 16 bp, M. musculus
aacagaaaacaaggtt

SEQ ID NO: 340687 - DNA, 16 bp, M. musculus
aacagaaaagcaatgg

SEQ ID NO: 340688 - DNA, 16 bp, M. musculus
aacagaaaccaagact

SEQ ID NO: 340689 - DNA, 16 bp, M. musculus
aacagaaaccaaggtc

SEQ ID NO: 340690 - DNA, 17 bp, M. musculus
aacagaaaccaaggtta

SEQ ID NO: 340691 - DNA, 16 bp, M. musculus
aacagaaaccaggacc

SEQ ID NO: 340692 - DNA, 16 bp, M. musculus
aacagaaactgaagga

SEQ ID NO: 340693 - DNA, 16 bp, M. musculus
aacagaaactgaggga

SEQ ID NO: 340694 - DNA, 16 bp, M. musculus
aacagaaagaacactg

SEQ ID NO: 340695 - DNA, 16 bp, M. musculus
aacagaaagcaagtga

SEQ ID NO: 340696 - DNA, 16 bp, M. musculus
aacagaaagccagtga

SEQ ID NO: 340697 - DNA, 16 bp, M. musculus
aacagaaataaatttt

SEQ ID NO: 340698 - DNA, 16 bp, M. musculus
aacagaaataatttaa

SEQ ID NO: 340699 - DNA, 16 bp, M. musculus
aacagaaatcaagact

SEQ ID NO: 340700 - DNA, 16 bp, M. musculus
aacagaaatcctaact

SEQ ID NO: 340701 - DNA, 16 bp, M. musculus
aacagaacagaaatgg

SEQ ID NO: 340702 - DNA, 16 bp, M. musculus
aacagaacagcaaagg

SEQ ID NO: 340703 - DNA, 16 bp, M. musculus
aacagaacctgtccca

SEQ ID NO: 340704 - DNA, 16 bp, M. musculus
aacagaagaaaatgtt

SEQ ID NO: 340705 - DNA, 16 bp, M. musculus
aacagaagaaatacta

SEQ ID NO: 340706 - DNA, 16 bp, M. musculus
aacagaagagaaagta

SEQ ID NO: 340707 - DNA, 16 bp, M. musculus
aacagaagaggacatc

SEQ ID NO: 340708 - DNA, 16 bp, M. musculus
aacagaagagtaacta

SEQ ID NO: 340709 - DNA, 16 bp, M. musculus
aacagaagatggccta

SEQ ID NO: 340710 - DNA, 16 bp, M. musculus
aacagaagcaaataca

SEQ ID NO: 340711 - DNA, 16 bp, M. musculus
aacagaagcagaaggt

SEQ ID NO: 340712 - DNA, 16 bp, M. musculus
aacagaagccaagacc

SEQ ID NO: 340713 - DNA, 16 bp, M. musculus
aacagaagctgaggaa

SEQ ID NO: 340714 - DNA, 16 bp, M. musculus
aacagaagttctgaaa

SEQ ID NO: 340715 - DNA, 16 bp, M. musculus
aacagaatacaacaga

SEQ ID NO: 340716 - DNA, 16 bp, M. musculus
aacagaatactagaga

SEQ ID NO: 340717 - DNA, 16 bp, M. musculus
aacagaatcaccagag

SEQ ID NO: 340718 - DNA, 16 bp, M. musculus
aacagaatcatgaaag

SEQ ID NO: 340719 - DNA, 17 bp, M. musculus
aacagaatccaagaaca

SEQ ID NO: 340720 - DNA, 16 bp, M. musculus
aacagaatccatcatt

SEQ ID NO: 340721 - DNA, 16 bp, M. musculus
aacagaatctgaagaa

SEQ ID NO: 340722 - DNA, 16 bp, M. musculus
aacagaatgccaactc

SEQ ID NO: 340723 - DNA, 16 bp, M. musculus
aacagaattccaatgg

SEQ ID NO: 340724 - DNA, 16 bp, M. musculus
aacagaccaaagaaat

SEQ ID NO: 340725 - DNA, 16 bp, M. musculus
aacagactgaaggaaa

SEQ ID NO: 340726 - DNA, 16 bp, M. musculus
aacagacttcactgga

SEQ ID NO: 340727 - DNA, 16 bp, M. musculus
aacagagaaaagtgca

SEQ ID NO: 340728 - DNA, 16 bp, M. musculus
aacagagaaatgcaaa

SEQ ID NO: 340729 - DNA, 16 bp, M. musculus
aacagagaattcacaa

SEQ ID NO: 340730 - DNA, 16 bp, M. musculus
aacagagaattctcca

SEQ ID NO: 340731 - DNA, 16 bp, M. musculus
aacagagactaaagga

SEQ ID NO: 340732 - DNA, 16 bp, M. musculus
aacagagactttaaaa

SEQ ID NO: 340733 - DNA, 16 bp, M. musculus
aacagagagactgaga

SEQ ID NO: 340734 - DNA, 16 bp, M. musculus
aacagagatggcaaag

SEQ ID NO: 340735 - DNA, 16 bp, M. musculus
aacagagcaccaatgg

SEQ ID NO: 340736 - DNA, 16 bp, M. musculus
aacagaggaaaatgaa

SEQ ID NO: 340737 - DNA, 16 bp, M. musculus
aacagaggaatcaata

SEQ ID NO: 340738 - DNA, 16 bp, M. musculus
aacagaggcaggaaga

SEQ ID NO: 340739 - DNA, 16 bp, M. musculus
aacagagtcacagtga

SEQ ID NO: 340740 - DNA, 16 bp, M. musculus
aacagagtcacctgag

SEQ ID NO: 340741 - DNA, 16 bp, M. musculus
aacagagttttacaag

SEQ ID NO: 340742 - DNA, 16 bp, M. musculus
aacagatatgtacaga

SEQ ID NO: 340743 - DNA, 16 bp, M. musculus
aacagatatttacaaa

SEQ ID NO: 340744 - DNA, 16 bp, M. musculus
aacagatatttacaga

SEQ ID NO: 340745 - DNA, 16 bp, M. musculus
aacagatccagaagaa

SEQ ID NO: 340746 - DNA, 16 bp, M. musculus
aacagatccagacaca

SEQ ID NO: 340747 - DNA, 16 bp, M. musculus
aacagatcctgaagga

SEQ ID NO: 340748 - DNA, 16 bp, M. musculus
aacagatctctgtgag

SEQ ID NO: 340749 - DNA, 16 bp, M. musculus
aacagatgaagaaaat

SEQ ID NO: 340750 - DNA, 16 bp, M. musculus
aacagatgagccatct

SEQ ID NO: 340751 - DNA, 16 bp, M. musculus
aacagatgcagagaca

SEQ ID NO: 340752 - DNA, 16 bp, M. musculus
aacagatggacagaca

SEQ ID NO: 340753 - DNA, 16 bp, M. musculus
aacagatgggaaagga

SEQ ID NO: 340754 - DNA, 16 bp, M. musculus
aacagatggttgtgag

SEQ ID NO: 340755 - DNA, 16 bp, M. musculus
aacagatgttgcgttc

SEQ ID NO: 340756 - DNA, 16 bp, M. musculus
aacagattcaaaaata

SEQ ID NO: 340757 - DNA, 16 bp, M. musculus
aacagattcttctctc

SEQ ID NO: 340758 - DNA, 16 bp, M. musculus
aacagattgggaagga

SEQ ID NO: 340759 - DNA, 16 bp, M. musculus
aacagatttttttttt

SEQ ID NO: 340760 - DNA, 16 bp, M. musculus
aacagcaaaagcagca

SEQ ID NO: 340761 - DNA, 16 bp, M. musculus
aacagcaaatgttctt

SEQ ID NO: 340762 - DNA, 16 bp, M. musculus
aacagcaaattcctta

SEQ ID NO: 340763 - DNA, 23 bp, M. musculus
aacagcaacagcagcagcagcaa

SEQ ID NO: 340764 - DNA, 16 bp, M. musculus
aacagcaaccaacata

SEQ ID NO: 340765 - DNA, 16 bp, M. musculus
aacagcaacctacaga

SEQ ID NO: 340766 - DNA, 18 bp, M. musculus
aacagcaagaaagcacat

SEQ ID NO: 340767 - DNA, 16 bp, M. musculus
aacagcaagattttgc

SEQ ID NO: 340768 - DNA, 16 bp, M. musculus
aacagcaaggctctgc

SEQ ID NO: 340769 - DNA, 16 bp, M. musculus
aacagcaataataata

SEQ ID NO: 340770 - DNA, 16 bp, M. musculus
aacagcaatagcaaca

SEQ ID NO: 340771 - DNA, 16 bp, M. musculus
aacagcaatctacaga

SEQ ID NO: 340772 - DNA, 16 bp, M. musculus
aacagcaatggagaag

SEQ ID NO: 340773 - DNA, 16 bp, M. musculus
aacagcaatgtgaaag

SEQ ID NO: 340774 - DNA, 16 bp, M. musculus
aacagcaatgtggaag

SEQ ID NO: 340775 - DNA, 16 bp, M. musculus
aacagcacaaaatggc

SEQ ID NO: 340776 - DNA, 16 bp, M. musculus
aacagcacaatagctg

SEQ ID NO: 340777 - DNA, 16 bp, M. musculus
aacagcaccacctgct

SEQ ID NO: 340778 - DNA, 18 bp, M. musculus
aacagcagatcctgaaga

SEQ ID NO: 340779 - DNA, 16 bp, M. musculus
aacagcagatgctgga

SEQ ID NO: 340780 - DNA, 16 bp, M. musculus
aacagcagcaaaatca

SEQ ID NO: 340781 - DNA, 16 bp, M. musculus
aacagcagcaacagca

SEQ ID NO: 340782 - DNA, 16 bp, M. musculus
aacagcagcagcaaaa

SEQ ID NO: 340783 - DNA, 16 bp, M. musculus
aacagcagcagcagaa

SEQ ID NO: 340784 - DNA, 16 bp, M. musculus
aacagcagcagcagag

SEQ ID NO: 340785 - DNA, 16 bp, M. musculus
aacagcagcagcagct

SEQ ID NO: 340786 - DNA, 16 bp, M. musculus
aacagcagcagcagga

SEQ ID NO: 340787 - DNA, 16 bp, M. musculus
aacagcagcagcagta

SEQ ID NO: 340788 - DNA, 16 bp, M. musculus
aacagcagcagtaaca

SEQ ID NO: 340789 - DNA, 16 bp, M. musculus
aacagcagcagtggag

SEQ ID NO: 340790 - DNA, 16 bp, M. musculus
aacagcagctcctcca

SEQ ID NO: 340791 - DNA, 16 bp, M. musculus
aacagcagctgagaga

SEQ ID NO: 340792 - DNA, 16 bp, M. musculus
aacagcaggagcagga

SEQ ID NO: 340793 - DNA, 16 bp, M. musculus
aacagcagtgtggaag

SEQ ID NO: 340794 - DNA, 16 bp, M. musculus
aacagcatgctggcct

SEQ ID NO: 340795 - DNA, 16 bp, M. musculus
aacagcattcttcttt

SEQ ID NO: 340796 - DNA, 16 bp, M. musculus
aacagcattggcttgt

SEQ ID NO: 340797 - DNA, 16 bp, M. musculus
aacagccaaagaaaat

SEQ ID NO: 340798 - DNA, 16 bp, M. musculus
aacagccagaagctgg

SEQ ID NO: 340799 - DNA, 16 bp, M. musculus
aacagccagagctaca

SEQ ID NO: 340800 - DNA, 16 bp, M. musculus
aacagccaggcagtgg

SEQ ID NO: 340801 - DNA, 19 bp, M. musculus
aacagccagggctacatag

SEQ ID NO: 340802 - DNA, 16 bp, M. musculus
aacagccagtgctctt

SEQ ID NO: 340803 - DNA, 16 bp, M. musculus
aacagccagttctctt

SEQ ID NO: 340804 - DNA, 16 bp, M. musculus
aacagccattgctctt

SEQ ID NO: 340805 - DNA, 16 bp, M. musculus
aacagcccagatgtcc

SEQ ID NO: 340806 - DNA, 16 bp, M. musculus
aacagcgccaccagct

SEQ ID NO: 340807 - DNA, 16 bp, M. musculus
aacagcggcagctgag

SEQ ID NO: 340808 - DNA, 40 bp, M. musculus
aacagctaatctatgagcaagccacaaaggagtgccgagc

SEQ ID NO: 340809 - DNA, 17 bp, M. musculus
aacagctacagtgtact

SEQ ID NO: 340810 - DNA, 16 bp, M. musculus
aacagctagggctaca

SEQ ID NO: 340811 - DNA, 16 bp, M. musculus
aacagctatatctggg

SEQ ID NO: 340812 - DNA, 16 bp, M. musculus
aacagctatccaaaag

SEQ ID NO: 340813 - DNA, 16 bp, M. musculus
aacagctccaccaact

SEQ ID NO: 340814 - DNA, 16 bp, M. musculus
aacagctcctctgacc

SEQ ID NO: 340815 - DNA, 16 bp, M. musculus
aacagctgagtaataa

SEQ ID NO: 340816 - DNA, 16 bp, M. musculus
aacagctggagcaggg

SEQ ID NO: 340817 - DNA, 16 bp, M. musculus
aacagctgggcaaact

SEQ ID NO: 340818 - DNA, 16 bp, M. musculus
aacagctgtatggaag

SEQ ID NO: 340819 - DNA, 16 bp, M. musculus
aacagcttcaatgaaa

SEQ ID NO: 340820 - DNA, 16 bp, M. musculus
aacagcttcagagaag

SEQ ID NO: 340821 - DNA, 16 bp, M. musculus
aacagcttctgggaga

SEQ ID NO: 340822 - DNA, 16 bp, M. musculus
aacaggaaaacaaatc

SEQ ID NO: 340823 - DNA, 16 bp, M. musculus
aacaggaaaagaaact

SEQ ID NO: 340824 - DNA, 16 bp, M. musculus
aacaggaaatattttc

SEQ ID NO: 340825 - DNA, 16 bp, M. musculus
aacaggaaattcaaaa

SEQ ID NO: 340826 - DNA, 16 bp, M. musculus
aacaggaacactaaca

SEQ ID NO: 340827 - DNA, 16 bp, M. musculus
aacaggaacctggagg

SEQ ID NO: 340828 - DNA, 16 bp, M. musculus
aacaggaagaaaatga

SEQ ID NO: 340829 - DNA, 16 bp, M. musculus
aacaggaagcaaaaat

SEQ ID NO: 340830 - DNA, 16 bp, M. musculus
aacaggaagtttgctg

SEQ ID NO: 340831 - DNA, 16 bp, M. musculus
aacaggacacagcatt

SEQ ID NO: 340832 - DNA, 16 bp, M. musculus
aacaggacacagtgaa

SEQ ID NO: 340833 - DNA, 16 bp, M. musculus
aacaggaccacaccta

SEQ ID NO: 340834 - DNA, 16 bp, M. musculus
aacaggaccactcacc

SEQ ID NO: 340835 - DNA, 16 bp, M. musculus
aacaggagaatgatgt

SEQ ID NO: 340836 - DNA, 16 bp, M. musculus
aacaggagacagtgga

SEQ ID NO: 340837 - DNA, 16 bp, M. musculus
aacaggcagctgctaa

SEQ ID NO: 340838 - DNA, 16 bp, M. musculus
aacaggcatttccagt

SEQ ID NO: 340839 - DNA, 16 bp, M. musculus
aacaggccaagaaaga

SEQ ID NO: 340840 - DNA, 16 bp, M. musculus
aacaggccagaacccc

SEQ ID NO: 340841 - DNA, 16 bp, M. musculus
aacaggctgagacaga

SEQ ID NO: 340842 - DNA, 16 bp, M. musculus
aacaggctgatccaga

SEQ ID NO: 340843 - DNA, 16 bp, M. musculus
aacagggagaaggagt

SEQ ID NO: 340844 - DNA, 16 bp, M. musculus
aacagggatggcatta

SEQ ID NO: 340845 - DNA, 16 bp, M. musculus
aacagggtcacacctt

SEQ ID NO: 340846 - DNA, 16 bp, M. musculus
aacagggtctcactgt

SEQ ID NO: 340847 - DNA, 16 bp, M. musculus
aacagggtttctctgt

SEQ ID NO: 340848 - DNA, 16 bp, M. musculus
aacaggtaaagaaatt

SEQ ID NO: 340849 - DNA, 16 bp, M. musculus
aacaggtagaagtcca

SEQ ID NO: 340850 - DNA, 16 bp, M. musculus
aacaggtagtagtcct

SEQ ID NO: 340851 - DNA, 16 bp, M. musculus
aacaggtcagggcctt

SEQ ID NO: 340852 - DNA, 16 bp, M. musculus
aacagtaacagcaaca

SEQ ID NO: 340853 - DNA, 16 bp, M. musculus
aacagtaccactccct

SEQ ID NO: 340854 - DNA, 16 bp, M. musculus
aacagtactccattgt

SEQ ID NO: 340855 - DNA, 16 bp, M. musculus
aacagtagcaaaattg

SEQ ID NO: 340856 - DNA, 16 bp, M. musculus
aacagtagcagcagtg

SEQ ID NO: 340857 - DNA, 16 bp, M. musculus
aacagtataaataata

SEQ ID NO: 340858 - DNA, 16 bp, M. musculus
aacagtctctaggcca

SEQ ID NO: 340859 - DNA, 16 bp, M. musculus
aacagtctgaaaggct

SEQ ID NO: 340860 - DNA, 16 bp, M. musculus
aacagtgacaactata

SEQ ID NO: 340861 - DNA, 16 bp, M. musculus
aacagtgatgtggaaa

SEQ ID NO: 340862 - DNA, 16 bp, M. musculus
aacagtgatttttttt

SEQ ID NO: 340863 - DNA, 16 bp, M. musculus
aacagtgccaccaact

SEQ ID NO: 340864 - DNA, 16 bp, M. musculus
aacagtggctaagaca

SEQ ID NO: 340865 - DNA, 19 bp, M. musculus
aacagtgtactcacataca

SEQ ID NO: 340866 - DNA, 16 bp, M. musculus
aacagtgtactcatat

SEQ ID NO: 340867 - DNA, 16 bp, M. musculus
aacagtgtcaacaggc

SEQ ID NO: 340868 - DNA, 16 bp, M. musculus
aacagtgtcaccaact

SEQ ID NO: 340869 - DNA, 16 bp, M. musculus
aacagttatttttaaa

SEQ ID NO: 340870 - DNA, 16 bp, M. musculus
aacagttctttttttt

SEQ ID NO: 340871 - DNA, 16 bp, M. musculus
aacagtttcttcttct

SEQ ID NO: 340872 - DNA, 16 bp, M. musculus
aacagttttaaaataa

SEQ ID NO: 340873 - DNA, 16 bp, M. musculus
aacagttttattcatt

SEQ ID NO: 340874 - DNA, 16 bp, M. musculus
aacagtttttaaaaag

SEQ ID NO: 340875 - DNA, 16 bp, M. musculus
aacagtttttaaaagt

SEQ ID NO: 340876 - DNA, 16 bp, M. musculus
aacagtttttgctatc

SEQ ID NO: 340877 - DNA, 16 bp, M. musculus
aacagtttttttttaa

SEQ ID NO: 340878 - DNA, 16 bp, M. musculus
aacataaaaccagaca

SEQ ID NO: 340879 - DNA, 22 bp, M. musculus
aacataaaactggaattcctta

SEQ ID NO: 340880 - DNA, 17 bp, M. musculus
aacataaagaaccctgt

SEQ ID NO: 340881 - DNA, 16 bp, M. musculus
aacataaagaactata

SEQ ID NO: 340882 - DNA, 16 bp, M. musculus
aacataaatgtgtgtg

SEQ ID NO: 340883 - DNA, 16 bp, M. musculus
aacataaggaactcca

SEQ ID NO: 340884 - DNA, 16 bp, M. musculus
aacataatctattata

SEQ ID NO: 340885 - DNA, 17 bp, M. musculus
aacataatggaacatgt

SEQ ID NO: 340886 - DNA, 16 bp, M. musculus
aacatacaaaggcaga

SEQ ID NO: 340887 - DNA, 16 bp, M. musculus
aacatacaagaagtct

SEQ ID NO: 340888 - DNA, 16 bp, M. musculus
aacatacacagaaaca

SEQ ID NO: 340889 - DNA, 16 bp, M. musculus
aacatacaccagctga

SEQ ID NO: 340890 - DNA, 16 bp, M. musculus
aacatagtgagaccct

SEQ ID NO: 340891 - DNA, 16 bp, M. musculus
aacatatatatgtata

SEQ ID NO: 340892 - DNA, 16 bp, M. musculus
aacatatgaaactgaa

SEQ ID NO: 340893 - DNA, 16 bp, M. musculus
aacatatgcatataca

SEQ ID NO: 340894 - DNA, 16 bp, M. musculus
aacatattaaaaatag

SEQ ID NO: 340895 - DNA, 16 bp, M. musculus
aacatcaacatcatca

SEQ ID NO: 340896 - DNA, 16 bp, M. musculus
aacatcaatatgaact

SEQ ID NO: 340897 - DNA, 16 bp, M. musculus
aacatcaatgtaaatg

SEQ ID NO: 340898 - DNA, 16 bp, M. musculus
aacatcacagaagaag

SEQ ID NO: 340899 - DNA, 16 bp, M. musculus
aacatcagaccaattt

SEQ ID NO: 340900 - DNA, 16 bp, M. musculus
aacatcagatccttct

SEQ ID NO: 340901 - DNA, 16 bp, M. musculus
aacatcatcagatact

SEQ ID NO: 340902 - DNA, 16 bp, M. musculus
aacatcatgaacaaga

SEQ ID NO: 340903 - DNA, 16 bp, M. musculus
aacatcatgaccaagg

SEQ ID NO: 340904 - DNA, 16 bp, M. musculus
aacatcatggaagaga

SEQ ID NO: 340905 - DNA, 17 bp, M. musculus
aacatcatgtccaagaa

SEQ ID NO: 340906 - DNA, 16 bp, M. musculus
aacatcattttctcag

SEQ ID NO: 340907 - DNA, 16 bp, M. musculus
aacatccacattccaa

SEQ ID NO: 340908 - DNA, 16 bp, M. musculus
aacatccacgtggaaa

SEQ ID NO: 340909 - DNA, 16 bp, M. musculus
aacatccactctttgg

SEQ ID NO: 340910 - DNA, 16 bp, M. musculus
aacatccactgagaaa

SEQ ID NO: 340911 - DNA, 16 bp, M. musculus
aacatccagttgtgcc

SEQ ID NO: 340912 - DNA, 16 bp, M. musculus
aacatccctccatggc

SEQ ID NO: 340913 - DNA, 16 bp, M. musculus
aacatcctagggattc

SEQ ID NO: 340914 - DNA, 19 bp, M. musculus
aacatcctggccttttgat

SEQ ID NO: 340915 - DNA, 16 bp, M. musculus
aacatccttaaccatc

SEQ ID NO: 340916 - DNA, 16 bp, M. musculus
aacatcctttgtcatc

SEQ ID NO: 340917 - DNA, 16 bp, M. musculus
aacatctaccccatct

SEQ ID NO: 340918 - DNA, 16 bp, M. musculus
aacatctaggaaatct

SEQ ID NO: 340919 - DNA, 16 bp, M. musculus
aacatctatgtcccaa

SEQ ID NO: 340920 - DNA, 16 bp, M. musculus
aacatctgtccagtat

SEQ ID NO: 340921 - DNA, 16 bp, M. musculus
aacatcttcaacaaga

SEQ ID NO: 340922 - DNA, 16 bp, M. musculus
aacatcttcaagaaaa

SEQ ID NO: 340923 - DNA, 16 bp, M. musculus
aacatcttcagcaaag

SEQ ID NO: 340924 - DNA, 16 bp, M. musculus
aacatctttaaaaaca

SEQ ID NO: 340925 - DNA, 16 bp, M. musculus
aacatcttttaaaata

SEQ ID NO: 340926 - DNA, 16 bp, M. musculus
aacatcttttttaaaa

SEQ ID NO: 340927 - DNA, 16 bp, M. musculus
aacatgaaaaaaattt

SEQ ID NO: 340928 - DNA, 16 bp, M. musculus
aacatgaaaatatttt

SEQ ID NO: 340929 - DNA, 16 bp, M. musculus
aacatgaaatataatt

SEQ ID NO: 340930 - DNA, 16 bp, M. musculus
aacatgaactgaacaa

SEQ ID NO: 340931 - DNA, 16 bp, M. musculus
aacatgaagaggaaga

SEQ ID NO: 340932 - DNA, 16 bp, M. musculus
aacatgaatggactca

SEQ ID NO: 340933 - DNA, 16 bp, M. musculus
aacatgaggaactgag

SEQ ID NO: 340934 - DNA, 16 bp, M. musculus
aacatgaggacttgag

SEQ ID NO: 340935 - DNA, 16 bp, M. musculus
aacatgataaaagcta

SEQ ID NO: 340936 - DNA, 16 bp, M. musculus
aacatgattttttttt

SEQ ID NO: 340937 - DNA, 16 bp, M. musculus
aacatgcacaagacct

SEQ ID NO: 340938 - DNA, 16 bp, M. musculus
aacatgcacacacaca

SEQ ID NO: 340939 - DNA, 16 bp, M. musculus
aacatgcaccagggga

SEQ ID NO: 340940 - DNA, 16 bp, M. musculus
aacatgcatatgtata

SEQ ID NO: 340941 - DNA, 16 bp, M. musculus
aacatggagaagaaag

SEQ ID NO: 340942 - DNA, 38 bp, M. musculus
aacatggagaccaacaactacgatatgctttttgatgt

SEQ ID NO: 340943 - DNA, 16 bp, M. musculus
aacatggagaggaagg

SEQ ID NO: 340944 - DNA, 16 bp, M. musculus
aacatggagataaagt

SEQ ID NO: 340945 - DNA, 16 bp, M. musculus
aacatggcacagacca

SEQ ID NO: 340946 - DNA, 16 bp, M. musculus
aacatggcataacaag

SEQ ID NO: 340947 - DNA, 16 bp, M. musculus
aacatggctgctctgg

SEQ ID NO: 340948 - DNA, 16 bp, M. musculus
aacatgtaatatataa

SEQ ID NO: 340949 - DNA, 16 bp, M. musculus
aacatgtatatatgta

SEQ ID NO: 340950 - DNA, 16 bp, M. musculus
aacatgtatgcacaac

SEQ ID NO: 340951 - DNA, 16 bp, M. musculus
aacatgtatttttaaa

SEQ ID NO: 340952 - DNA, 16 bp, M. musculus
aacatgtctgtctgtc

SEQ ID NO: 340953 - DNA, 16 bp, M. musculus
aacatgtgtctttctt

SEQ ID NO: 340954 - DNA, 16 bp, M. musculus
aacatgttttcatttt

SEQ ID NO: 340955 - DNA, 16 bp, M. musculus
aacattacagactatt

SEQ ID NO: 340956 - DNA, 16 bp, M. musculus
aacattaccaaaccag

SEQ ID NO: 340957 - DNA, 16 bp, M. musculus
aacattagaaatgaaa

SEQ ID NO: 340958 - DNA, 16 bp, M. musculus
aacattattttaagtt

SEQ ID NO: 340959 - DNA, 16 bp, M. musculus
aacattcaaagaaaat

SEQ ID NO: 340960 - DNA, 17 bp, M. musculus
aacattcaggaaatcca

SEQ ID NO: 340961 - DNA, 16 bp, M. musculus
aacattctaaatgtaa

SEQ ID NO: 340962 - DNA, 16 bp, M. musculus
aacattctagcatgga

SEQ ID NO: 340963 - DNA, 17 bp, M. musculus
aacattctgtggttgtt

SEQ ID NO: 340964 - DNA, 16 bp, M. musculus
aacattcttgagataa

SEQ ID NO: 340965 - DNA, 16 bp, M. musculus
aacattgaaataatcc

SEQ ID NO: 340966 - DNA, 16 bp, M. musculus
aacattgaaattgtcc

SEQ ID NO: 340967 - DNA, 16 bp, M. musculus
aacattgacataacag

SEQ ID NO: 340968 - DNA, 16 bp, M. musculus
aacattgatttaaaaa

SEQ ID NO: 340969 - DNA, 16 bp, M. musculus
aacattgatttatttt

SEQ ID NO: 340970 - DNA, 16 bp, M. musculus
aacattgcaaaagaaa

SEQ ID NO: 340971 - DNA, 16 bp, M. musculus
aacattgcagaagaga

SEQ ID NO: 340972 - DNA, 16 bp, M. musculus
aacattgggccttgat

SEQ ID NO: 340973 - DNA, 16 bp, M. musculus
aacattgtaaaagcaa

SEQ ID NO: 340974 - DNA, 16 bp, M. musculus
aacattgttccttcca

SEQ ID NO: 340975 - DNA, 16 bp, M. musculus
aacattgttgagactg

SEQ ID NO: 340976 - DNA, 16 bp, M. musculus
aacattgttttgtcta

SEQ ID NO: 340977 - DNA, 16 bp, M. musculus
aacattgtttttaaat

SEQ ID NO: 340978 - DNA, 16 bp, M. musculus
aacatttaaaaatctt

SEQ ID NO: 340979 - DNA, 16 bp, M. musculus
aacatttaaaaatgaa

SEQ ID NO: 340980 - DNA, 16 bp, M. musculus
aacatttaaaggcagg

SEQ ID NO: 340981 - DNA, 16 bp, M. musculus
aacatttaagaaccat

SEQ ID NO: 340982 - DNA, 16 bp, M. musculus
aacatttaattggaga

SEQ ID NO: 340983 - DNA, 16 bp, M. musculus
aacatttacactgaca

SEQ ID NO: 340984 - DNA, 16 bp, M. musculus
aacatttatcatttta

SEQ ID NO: 340985 - DNA, 16 bp, M. musculus
aacatttattttatga

SEQ ID NO: 340986 - DNA, 16 bp, M. musculus
aacatttattttgtgt

SEQ ID NO: 340987 - DNA, 16 bp, M. musculus
aacatttcaaaattat

SEQ ID NO: 340988 - DNA, 16 bp, M. musculus
aacatttcatcctaaa

SEQ ID NO: 340989 - DNA, 16 bp, M. musculus
aacatttccaaataaa

SEQ ID NO: 340990 - DNA, 16 bp, M. musculus
aacatttccccccttt

SEQ ID NO: 340991 - DNA, 16 bp, M. musculus
aacatttcctcttctg

SEQ ID NO: 340992 - DNA, 16 bp, M. musculus
aacatttcctttaaaa

SEQ ID NO: 340993 - DNA, 16 bp, M. musculus
aacatttctgtgtttt

SEQ ID NO: 340994 - DNA, 16 bp, M. musculus
aacatttcttttaaaa

SEQ ID NO: 340995 - DNA, 16 bp, M. musculus
aacatttctttttaaa

SEQ ID NO: 340996 - DNA, 49 bp, M. musculus
aacatttgacttctatgtttgccccgggcatactgtaccaacagggtgt

SEQ ID NO: 340997 - DNA, 16 bp, M. musculus
aacatttgcaagaaaa

SEQ ID NO: 340998 - DNA, 16 bp, M. musculus
aacatttgcaagtaaa

SEQ ID NO: 340999 - DNA, 16 bp, M. musculus
aacatttgctgtcacc

SEQ ID NO: 341000 - DNA, 16 bp, M. musculus
aacatttgtaagcaaa

SEQ ID NO: 341001 - DNA, 16 bp, M. musculus
aacatttgtgtgtgtg

SEQ ID NO: 341002 - DNA, 16 bp, M. musculus
aacatttgtttttgtt

SEQ ID NO: 341003 - DNA, 16 bp, M. musculus
aacattttaaaatgca

SEQ ID NO: 341004 - DNA, 16 bp, M. musculus
aacattttaaaggaaa

SEQ ID NO: 341005 - DNA, 16 bp, M. musculus
aacattttaaatcttt

SEQ ID NO: 341006 - DNA, 16 bp, M. musculus
aacattttaagtattt

SEQ ID NO: 341007 - DNA, 16 bp, M. musculus
aacattttacacacac

SEQ ID NO: 341008 - DNA, 16 bp, M. musculus
aacattttagaaaaat

SEQ ID NO: 341009 - DNA, 16 bp, M. musculus
aacattttcaataaat

SEQ ID NO: 341010 - DNA, 16 bp, M. musculus
aacattttcttctatg

SEQ ID NO: 341011 - DNA, 16 bp, M. musculus
aacattttgctgaata

SEQ ID NO: 341012 - DNA, 16 bp, M. musculus
aacatttttaaaaagt

SEQ ID NO: 341013 - DNA, 16 bp, M. musculus
aacatttttaaaaatg

SEQ ID NO: 341014 - DNA, 16 bp, M. musculus
aacatttttaaaagct

SEQ ID NO: 341015 - DNA, 16 bp, M. musculus
aacatttttctttctg

SEQ ID NO: 341016 - DNA, 16 bp, M. musculus
aacatttttgttattt

SEQ ID NO: 341017 - DNA, 16 bp, M. musculus
aacatttttttcttgt

SEQ ID NO: 341018 - DNA, 16 bp, M. musculus
aacattttttttaaca

SEQ ID NO: 341019 - DNA, 16 bp, M. musculus
aaccaaaatggaggaa

SEQ ID NO: 341020 - DNA, 16 bp, M. musculus
aaccaaacagatagaa

SEQ ID NO: 341021 - DNA, 16 bp, M. musculus
aaccaaacattcaaat

SEQ ID NO: 341022 - DNA, 16 bp, M. musculus
aaccaaaccaggggct

SEQ ID NO: 341023 - DNA, 16 bp, M. musculus
aaccaaactcagggct

SEQ ID NO: 341024 - DNA, 16 bp, M. musculus
aaccaaactctggtcc

SEQ ID NO: 341025 - DNA, 16 bp, M. musculus
aaccaaagaacatata

SEQ ID NO: 341026 - DNA, 16 bp, M. musculus
aaccaaagaagtgaaa

SEQ ID NO: 341027 - DNA, 16 bp, M. musculus
aaccaaagaattccat

SEQ ID NO: 341028 - DNA, 16 bp, M. musculus
aaccaaagaggagctg

SEQ ID NO: 341029 - DNA, 16 bp, M. musculus
aaccaaagagtatgca

SEQ ID NO: 341030 - DNA, 16 bp, M. musculus
aaccaaagagtattca

SEQ ID NO: 341031 - DNA, 16 bp, M. musculus
aaccaaagctgcagga

SEQ ID NO: 341032 - DNA, 16 bp, M. musculus
aaccaaagtatttcat

SEQ ID NO: 341033 - DNA, 16 bp, M. musculus
aaccaaataaaccctc

SEQ ID NO: 341034 - DNA, 16 bp, M. musculus
aaccaaatagcccaat

SEQ ID NO: 341035 - DNA, 16 bp, M. musculus
aaccaaatatgacaaa

SEQ ID NO: 341036 - DNA, 16 bp, M. musculus
aaccaaatgaggagct

SEQ ID NO: 341037 - DNA, 16 bp, M. musculus
aaccaaatgggtctaa

SEQ ID NO: 341038 - DNA, 16 bp, M. musculus
aaccaacagttttaaa

SEQ ID NO: 341039 - DNA, 16 bp, M. musculus
aaccaaccaaaatgca

SEQ ID NO: 341040 - DNA, 16 bp, M. musculus
aaccaaccaaaccagg

SEQ ID NO: 341041 - DNA, 16 bp, M. musculus
aaccaaccaatgtctg

SEQ ID NO: 341042 - DNA, 16 bp, M. musculus
aaccaaccactctctg

SEQ ID NO: 341043 - DNA, 16 bp, M. musculus
aaccaaccagaccctt

SEQ ID NO: 341044 - DNA, 16 bp, M. musculus
aaccaacccactcctg

SEQ ID NO: 341045 - DNA, 16 bp, M. musculus
aaccaactaactaact

SEQ ID NO: 341046 - DNA, 16 bp, M. musculus
aaccaactcccacaag

SEQ ID NO: 341047 - DNA, 16 bp, M. musculus
aaccaactcctcattt

SEQ ID NO: 341048 - DNA, 16 bp, M. musculus
aaccaactttgcatcc

SEQ ID NO: 341049 - DNA, 16 bp, M. musculus
aaccaagaaagggaat

SEQ ID NO: 341050 - DNA, 16 bp, M. musculus
aaccaagaaagtgaaa

SEQ ID NO: 341051 - DNA, 16 bp, M. musculus
aaccaagaacacatca

SEQ ID NO: 341052 - DNA, 16 bp, M. musculus
aaccaagaagggggat

SEQ ID NO: 341053 - DNA, 16 bp, M. musculus
aaccaagacagtcatt

SEQ ID NO: 341054 - DNA, 16 bp, M. musculus
aaccaagatgaactct

SEQ ID NO: 341055 - DNA, 16 bp, M. musculus
aaccaagatggcttcc

SEQ ID NO: 341056 - DNA, 16 bp, M. musculus
aaccaagatggcttct

SEQ ID NO: 341057 - DNA, 16 bp, M. musculus
aaccaagccaatgaaa

SEQ ID NO: 341058 - DNA, 16 bp, M. musculus
aaccaaggagccatct

SEQ ID NO: 341059 - DNA, 16 bp, M. musculus
aaccaaggagtacaca

SEQ ID NO: 341060 - DNA, 16 bp, M. musculus
aaccaaggggctggag

SEQ ID NO: 341061 - DNA, 16 bp, M. musculus
aaccaagtcctagaaa

SEQ ID NO: 341062 - DNA, 16 bp, M. musculus
aaccaatatctgattt

SEQ ID NO: 341063 - DNA, 16 bp, M. musculus
aaccaatcagaagaga

SEQ ID NO: 341064 - DNA, 16 bp, M. musculus
aaccaatggacagaag

SEQ ID NO: 341065 - DNA, 16 bp, M. musculus
aaccaatgtggtaaaa

SEQ ID NO: 341066 - DNA, 16 bp, M. musculus
aaccacaaaattattt

SEQ ID NO: 341067 - DNA, 16 bp, M. musculus
aaccacaaaattgttt

SEQ ID NO: 341068 - DNA, 16 bp, M. musculus
aaccacacagctctga

SEQ ID NO: 341069 - DNA, 16 bp, M. musculus
aaccacacggtggctt

SEQ ID NO: 341070 - DNA, 16 bp, M. musculus
aaccacagaatgtttc

SEQ ID NO: 341071 - DNA, 16 bp, M. musculus
aaccacagctgctgtg

SEQ ID NO: 341072 - DNA, 16 bp, M. musculus
aaccacagctggatct

SEQ ID NO: 341073 - DNA, 16 bp, M. musculus
aaccacataggaagac

SEQ ID NO: 341074 - DNA, 16 bp, M. musculus
aaccacatgatggccc

SEQ ID NO: 341075 - DNA, 16 bp, M. musculus
aaccacatgattatct

SEQ ID NO: 341076 - DNA, 16 bp, M. musculus
aaccacattttattta

SEQ ID NO: 341077 - DNA, 16 bp, M. musculus
aaccaccaactgaaga

SEQ ID NO: 341078 - DNA, 16 bp, M. musculus
aaccaccagccaagga

SEQ ID NO: 341079 - DNA, 16 bp, M. musculus
aaccacccacagtggg

SEQ ID NO: 341080 - DNA, 16 bp, M. musculus
aaccacccagcagcac

SEQ ID NO: 341081 - DNA, 16 bp, M. musculus
aaccacctcctggttt

SEQ ID NO: 341082 - DNA, 16 bp, M. musculus
aaccacctgtaactct

SEQ ID NO: 341083 - DNA, 17 bp, M. musculus
aaccacgccctagaaaa

SEQ ID NO: 341084 - DNA, 16 bp, M. musculus
aaccactctggaaaat

SEQ ID NO: 341085 - DNA, 16 bp, M. musculus
aaccactgagcaatct

SEQ ID NO: 341086 - DNA, 16 bp, M. musculus
aaccactgagccatct

SEQ ID NO: 341087 - DNA, 16 bp, M. musculus
aaccactggttcttct

SEQ ID NO: 341088 - DNA, 16 bp, M. musculus
aaccactgtggaaatc

SEQ ID NO: 341089 - DNA, 17 bp, M. musculus
aaccacttgtaactcca

SEQ ID NO: 341090 - DNA, 16 bp, M. musculus
aaccagaaaaaccttt

SEQ ID NO: 341091 - DNA, 16 bp, M. musculus
aaccagaaactgaaaa

SEQ ID NO: 341092 - DNA, 16 bp, M. musculus
aaccagaaactggaag

SEQ ID NO: 341093 - DNA, 16 bp, M. musculus
aaccagaaatttccac

SEQ ID NO: 341094 - DNA, 16 bp, M. musculus
aaccagaaggatcctg

SEQ ID NO: 341095 - DNA, 16 bp, M. musculus
aaccagacccaccaga

SEQ ID NO: 341096 - DNA, 16 bp, M. musculus
aaccagacccctcaaa

SEQ ID NO: 341097 - DNA, 16 bp, M. musculus
aaccagaccctccaga

SEQ ID NO: 341098 - DNA, 16 bp, M. musculus
aaccagacttcccaga

SEQ ID NO: 341099 - DNA, 16 bp, M. musculus
aaccagagaaagattt

SEQ ID NO: 341100 - DNA, 78 bp, M. musculus
aaccagagacaaaaattgttcgaatcaggacaagggtggtttgagggactgtttaacaggtccccatggttcacgacc

SEQ ID NO: 341101 - DNA, 16 bp, M. musculus
aaccagagacaccata

SEQ ID NO: 341102 - DNA, 16 bp, M. musculus
aaccagagagatggct

SEQ ID NO: 341103 - DNA, 16 bp, M. musculus
aaccagagcatgacca

SEQ ID NO: 341104 - DNA, 16 bp, M. musculus
aaccagagccacatgg

SEQ ID NO: 341105 - DNA, 16 bp, M. musculus
aaccagagcccccaga

SEQ ID NO: 341106 - DNA, 16 bp, M. musculus
aaccagagttcagaaa

SEQ ID NO: 341107 - DNA, 16 bp, M. musculus
aaccagatgctctgct

SEQ ID NO: 341108 - DNA, 16 bp, M. musculus
aaccagcaagcagcat

SEQ ID NO: 341109 - DNA, 16 bp, M. musculus
aaccagcaccaatagt

SEQ ID NO: 341110 - DNA, 16 bp, M. musculus
aaccagcagcagcagc

SEQ ID NO: 341111 - DNA, 17 bp, M. musculus
aaccagcatggagcttt

SEQ ID NO: 341112 - DNA, 16 bp, M. musculus
aaccagccagtggaaa

SEQ ID NO: 341113 - DNA, 16 bp, M. musculus
aaccagcctgcctcca

SEQ ID NO: 341114 - DNA, 16 bp, M. musculus
aaccagctataccact

SEQ ID NO: 341115 - DNA, 16 bp, M. musculus
aaccagctcctgattt

SEQ ID NO: 341116 - DNA, 16 bp, M. musculus
aaccagctgagcaaac

SEQ ID NO: 341117 - DNA, 16 bp, M. musculus
aaccaggaagcaacaa

SEQ ID NO: 341118 - DNA, 16 bp, M. musculus
aaccaggaagcagaga

SEQ ID NO: 341119 - DNA, 16 bp, M. musculus
aaccaggaagcagagg

SEQ ID NO: 341120 - DNA, 16 bp, M. musculus
aaccaggaagcaggag

SEQ ID NO: 341121 - DNA, 16 bp, M. musculus
aaccaggaagtgggat

SEQ ID NO: 341122 - DNA, 16 bp, M. musculus
aaccaggagctgcttc

SEQ ID NO: 341123 - DNA, 16 bp, M. musculus
aaccaggctggccctg

SEQ ID NO: 341124 - DNA, 16 bp, M. musculus
aaccaggctggcctcc

SEQ ID NO: 341125 - DNA, 17 bp, M. musculus
aaccaggctggccttga

SEQ ID NO: 341126 - DNA, 16 bp, M. musculus
aaccaggtcctctgga

SEQ ID NO: 341127 - DNA, 16 bp, M. musculus
aaccagtaccacagag

SEQ ID NO: 341128 - DNA, 16 bp, M. musculus
aaccagtaccaccaga

SEQ ID NO: 341129 - DNA, 16 bp, M. musculus
aaccagtacccccaca

SEQ ID NO: 341130 - DNA, 16 bp, M. musculus
aaccagtacccccagt

SEQ ID NO: 341131 - DNA, 16 bp, M. musculus
aaccagtacccggagc

SEQ ID NO: 341132 - DNA, 16 bp, M. musculus
aaccagtacctcccag

SEQ ID NO: 341133 - DNA, 16 bp, M. musculus
aaccagtactccctgg

SEQ ID NO: 341134 - DNA, 16 bp, M. musculus
aaccagtcacagagag

SEQ ID NO: 341135 - DNA, 16 bp, M. musculus
aaccagtcccccaaga

SEQ ID NO: 341136 - DNA, 16 bp, M. musculus
aaccagtctagctgaa

SEQ ID NO: 341137 - DNA, 16 bp, M. musculus
aaccagtgagtttatt

SEQ ID NO: 341138 - DNA, 16 bp, M. musculus
aaccagttcccccaga

SEQ ID NO: 341139 - DNA, 16 bp, M. musculus
aaccataaaagtattt

SEQ ID NO: 341140 - DNA, 16 bp, M. musculus
aaccataaaatcattt

SEQ ID NO: 341141 - DNA, 16 bp, M. musculus
aaccataaaattactt

SEQ ID NO: 341142 - DNA, 16 bp, M. musculus
aaccataaaattattt

SEQ ID NO: 341143 - DNA, 16 bp, M. musculus
aaccataaagttattt

SEQ ID NO: 341144 - DNA, 16 bp, M. musculus
aaccataacattattt

SEQ ID NO: 341145 - DNA, 16 bp, M. musculus
aaccataactaagaca

SEQ ID NO: 341146 - DNA, 16 bp, M. musculus
aaccataatattattt

SEQ ID NO: 341147 - DNA, 16 bp, M. musculus
aaccatacaattattt

SEQ ID NO: 341148 - DNA, 16 bp, M. musculus
aaccatacagaataca

SEQ ID NO: 341149 - DNA, 16 bp, M. musculus
aaccatagaattattt

SEQ ID NO: 341150 - DNA, 16 bp, M. musculus
aaccataggaaagaaa

SEQ ID NO: 341151 - DNA, 16 bp, M. musculus
aaccatcaatgtaatc

SEQ ID NO: 341152 - DNA, 16 bp, M. musculus
aaccatcagaatttac

SEQ ID NO: 341153 - DNA, 16 bp, M. musculus
aaccatcagcccctcc

SEQ ID NO: 341154 - DNA, 16 bp, M. musculus
aaccatcattcaccac

SEQ ID NO: 341155 - DNA, 16 bp, M. musculus
aaccatccagtgaaag

SEQ ID NO: 341156 - DNA, 16 bp, M. musculus
aaccatctacctcacc

SEQ ID NO: 341157 - DNA, 16 bp, M. musculus
aaccatctcaggaaga

SEQ ID NO: 341158 - DNA, 16 bp, M. musculus
aaccatctccccagcc

SEQ ID NO: 341159 - DNA, 16 bp, M. musculus
aaccatctcctggttt

SEQ ID NO: 341160 - DNA, 16 bp, M. musculus
aaccatctctccagcc

SEQ ID NO: 341161 - DNA, 16 bp, M. musculus
aaccatctctccatct

SEQ ID NO: 341162 - DNA, 16 bp, M. musculus
aaccatctctgcagcc

SEQ ID NO: 341163 - DNA, 16 bp, M. musculus
aaccatctcttcagtc

SEQ ID NO: 341164 - DNA, 16 bp, M. musculus
aaccatctgcaactcc

SEQ ID NO: 341165 - DNA, 16 bp, M. musculus
aaccatctgtaactct

SEQ ID NO: 341166 - DNA, 16 bp, M. musculus
aaccatctttccagcc

SEQ ID NO: 341167 - DNA, 16 bp, M. musculus
aaccatgaccaaggca

SEQ ID NO: 341168 - DNA, 16 bp, M. musculus
aaccatgagcccaaat

SEQ ID NO: 341169 - DNA, 16 bp, M. musculus
aaccatgagtcccacc

SEQ ID NO: 341170 - DNA, 17 bp, M. musculus
aaccatgagtgatttat

SEQ ID NO: 341171 - DNA, 16 bp, M. musculus
aaccatggagccacct

SEQ ID NO: 341172 - DNA, 16 bp, M. musculus
aaccatggaggagtgt

SEQ ID NO: 341173 - DNA, 16 bp, M. musculus
aaccatgtggtggctc

SEQ ID NO: 341174 - DNA, 19 bp, M. musculus
aaccatgtggttgctggga

SEQ ID NO: 341175 - DNA, 22 bp, M. musculus
aaccattgcatacactagcaag

SEQ ID NO: 341176 - DNA, 16 bp, M. musculus
aaccatttatttaaaa

SEQ ID NO: 341177 - DNA, 16 bp, M. musculus
aaccatttccccagcc

SEQ ID NO: 341178 - DNA, 16 bp, M. musculus
aaccatttgacaaaat

SEQ ID NO: 341179 - DNA, 16 bp, M. musculus
aaccatttgagattcc

SEQ ID NO: 341180 - DNA, 16 bp, M. musculus
aaccattttttaaaaa

SEQ ID NO: 341181 - DNA, 16 bp, M. musculus
aacccaaacactattg

SEQ ID NO: 341182 - DNA, 16 bp, M. musculus
aacccaaagaacttca

SEQ ID NO: 341183 - DNA, 16 bp, M. musculus
aacccaaagggagaga

SEQ ID NO: 341184 - DNA, 16 bp, M. musculus
aacccaaagtaaggca

SEQ ID NO: 341185 - DNA, 17 bp, M. musculus
aacccaaatgcaaactt

SEQ ID NO: 341186 - DNA, 16 bp, M. musculus
aacccaacagacagtg

SEQ ID NO: 341187 - DNA, 16 bp, M. musculus
aacccaagcctggctc

SEQ ID NO: 341188 - DNA, 19 bp, M. musculus
aacccaaggtcatcaaaaa

SEQ ID NO: 341189 - DNA, 16 bp, M. musculus
aacccaataaaaaatg

SEQ ID NO: 341190 - DNA, 16 bp, M. musculus
aacccacactggctct

SEQ ID NO: 341191 - DNA, 16 bp, M. musculus
aacccacatagtggaa

SEQ ID NO: 341192 - DNA, 16 bp, M. musculus
aacccacatcctctgg

SEQ ID NO: 341193 - DNA, 16 bp, M. musculus
aacccacccactgctg

SEQ ID NO: 341194 - DNA, 16 bp, M. musculus
aacccagaacactggg

SEQ ID NO: 341195 - DNA, 16 bp, M. musculus
aacccagaagatgttc

SEQ ID NO: 341196 - DNA, 16 bp, M. musculus
aacccagaattgttct

SEQ ID NO: 341197 - DNA, 16 bp, M. musculus
aacccagacacctatg

SEQ ID NO: 341198 - DNA, 16 bp, M. musculus
aacccagaccctgcag

SEQ ID NO: 341199 - DNA, 16 bp, M. musculus
aacccagacctggaag

SEQ ID NO: 341200 - DNA, 17 bp, M. musculus
aacccagacctggcagt

SEQ ID NO: 341201 - DNA, 16 bp, M. musculus
aacccagagccagaaa

SEQ ID NO: 341202 - DNA, 16 bp, M. musculus
aacccagagccttgtg

SEQ ID NO: 341203 - DNA, 16 bp, M. musculus
aacccagagctcacca

SEQ ID NO: 341204 - DNA, 16 bp, M. musculus
aacccagagctctgtg

SEQ ID NO: 341205 - DNA, 16 bp, M. musculus
aacccagagcttcaca

SEQ ID NO: 341206 - DNA, 16 bp, M. musculus
aacccagatacaaaag

SEQ ID NO: 341207 - DNA, 16 bp, M. musculus
aacccagatccagaaa

SEQ ID NO: 341208 - DNA, 16 bp, M. musculus
aacccagatgaccctc

SEQ ID NO: 341209 - DNA, 16 bp, M. musculus
aacccagatgtcctgc

SEQ ID NO: 341210 - DNA, 16 bp, M. musculus
aacccagatgttcctt

SEQ ID NO: 341211 - DNA, 16 bp, M. musculus
aacccagcatttggga

SEQ ID NO: 341212 - DNA, 16 bp, M. musculus
aacccagctgggcctc

SEQ ID NO: 341213 - DNA, 16 bp, M. musculus
aacccaggaaacatga

SEQ ID NO: 341214 - DNA, 16 bp, M. musculus
aacccaggaaagggga

SEQ ID NO: 341215 - DNA, 16 bp, M. musculus
aacccaggactttgtg

SEQ ID NO: 341216 - DNA, 16 bp, M. musculus
aacccaggatctctgg

SEQ ID NO: 341217 - DNA, 16 bp, M. musculus
aacccaggcccaaaag

SEQ ID NO: 341218 - DNA, 16 bp, M. musculus
aacccagggcctcctg

SEQ ID NO: 341219 - DNA, 16 bp, M. musculus
aacccagggcctcgtg

SEQ ID NO: 341220 - DNA, 16 bp, M. musculus
aacccagggcttcctg

SEQ ID NO: 341221 - DNA, 16 bp, M. musculus
aacccagggctttgta

SEQ ID NO: 341222 - DNA, 16 bp, M. musculus
aacccagggctttgtg

SEQ ID NO: 341223 - DNA, 16 bp, M. musculus
aacccaggtcatcagg

SEQ ID NO: 341224 - DNA, 16 bp, M. musculus
aacccaggtcctctgc

SEQ ID NO: 341225 - DNA, 16 bp, M. musculus
aacccaggtcttcagg

SEQ ID NO: 341226 - DNA, 16 bp, M. musculus
aacccaggttcaattc

SEQ ID NO: 341227 - DNA, 16 bp, M. musculus
aacccagtcacagaag

SEQ ID NO: 341228 - DNA, 16 bp, M. musculus
aacccagtctcaaaaa

SEQ ID NO: 341229 - DNA, 16 bp, M. musculus
aacccatcacaaaaga

SEQ ID NO: 341230 - DNA, 16 bp, M. musculus
aacccatgtttaaaaa

SEQ ID NO: 341231 - DNA, 16 bp, M. musculus
aacccattcctcccca

SEQ ID NO: 341232 - DNA, 16 bp, M. musculus
aacccattctgttctg

SEQ ID NO: 341233 - DNA, 16 bp, M. musculus
aacccatttattttaa

SEQ ID NO: 341234 - DNA, 16 bp, M. musculus
aacccatttcacttcc

SEQ ID NO: 341235 - DNA, 16 bp, M. musculus
aaccccaaagaagact

SEQ ID NO: 341236 - DNA, 16 bp, M. musculus
aaccccacaaacagtg

SEQ ID NO: 341237 - DNA, 16 bp, M. musculus
aaccccagcacctggg

SEQ ID NO: 341238 - DNA, 16 bp, M. musculus
aaccccagcactgtgg

SEQ ID NO: 341239 - DNA, 16 bp, M. musculus
aaccccagcctgtgtc

SEQ ID NO: 341240 - DNA, 16 bp, M. musculus
aaccccagctccaggg

SEQ ID NO: 341241 - DNA, 16 bp, M. musculus
aaccccagctctgggg

SEQ ID NO: 341242 - DNA, 16 bp, M. musculus
aaccccaggcctctca

SEQ ID NO: 341243 - DNA, 16 bp, M. musculus
aaccccagggctgggg

SEQ ID NO: 341244 - DNA, 16 bp, M. musculus
aaccccaggtgtggga

SEQ ID NO: 341245 - DNA, 16 bp, M. musculus
aaccccattagaaaat

SEQ ID NO: 341246 - DNA, 16 bp, M. musculus
aacccccacagtgaca

SEQ ID NO: 341247 - DNA, 16 bp, M. musculus
aacccccagagctgtg

SEQ ID NO: 341248 - DNA, 16 bp, M. musculus
aacccctacagctcct

SEQ ID NO: 341249 - DNA, 16 bp, M. musculus
aacccctgagccatca

SEQ ID NO: 341250 - DNA, 16 bp, M. musculus
aacccctgagccatct

SEQ ID NO: 341251 - DNA, 16 bp, M. musculus
aacccctgtctcaaaa

SEQ ID NO: 341252 - DNA, 16 bp, M. musculus
aacccctgtggttgaa

SEQ ID NO: 341253 - DNA, 16 bp, M. musculus
aaccccttccgctcca

SEQ ID NO: 341254 - DNA, 16 bp, M. musculus
aaccctaaaattattt

SEQ ID NO: 341255 - DNA, 16 bp, M. musculus
aaccctaaccctaacc

SEQ ID NO: 341256 - DNA, 16 bp, M. musculus
aaccctacaggaggaa

SEQ ID NO: 341257 - DNA, 16 bp, M. musculus
aaccctaggagagaaa

SEQ ID NO: 341258 - DNA, 16 bp, M. musculus
aaccctcaagagactt

SEQ ID NO: 341259 - DNA, 16 bp, M. musculus
aaccctcagagctccc

SEQ ID NO: 341260 - DNA, 16 bp, M. musculus
aaccctcagctcctcc

SEQ ID NO: 341261 - DNA, 16 bp, M. musculus
aaccctcctgcctctg

SEQ ID NO: 341262 - DNA, 16 bp, M. musculus
aaccctcgcaccaggc

SEQ ID NO: 341263 - DNA, 16 bp, M. musculus
aaccctgaagaaatcc

SEQ ID NO: 341264 - DNA, 16 bp, M. musculus
aaccctgacaaagaca

SEQ ID NO: 341265 - DNA, 16 bp, M. musculus
aaccctgactgtcctg

SEQ ID NO: 341266 - DNA, 16 bp, M. musculus
aaccctgagcttggaa

SEQ ID NO: 341267 - DNA, 16 bp, M. musculus
aaccctgcctcaaaca

SEQ ID NO: 341268 - DNA, 16 bp, M. musculus
aaccctggaccaccaa

SEQ ID NO: 341269 - DNA, 16 bp, M. musculus
aaccctggcagcaaca

SEQ ID NO: 341270 - DNA, 16 bp, M. musculus
aaccctggctagcctg

SEQ ID NO: 341271 - DNA, 16 bp, M. musculus
aaccctggctttcctg

SEQ ID NO: 341272 - DNA, 16 bp, M. musculus
aaccctgggacccagt

SEQ ID NO: 341273 - DNA, 16 bp, M. musculus
aaccctgggctggtgg

SEQ ID NO: 341274 - DNA, 16 bp, M. musculus
aaccctgtctgtcctg

SEQ ID NO: 341275 - DNA, 16 bp, M. musculus
aaccctgtgtgtttaa

SEQ ID NO: 341276 - DNA, 16 bp, M. musculus
aaccctgtttcaaaac

SEQ ID NO: 341277 - DNA, 16 bp, M. musculus
aaccctgttttcagtg

SEQ ID NO: 341278 - DNA, 16 bp, M. musculus
aacccttcaactcctt

SEQ ID NO: 341279 - DNA, 16 bp, M. musculus
aacccttgatcctcct

SEQ ID NO: 341280 - DNA, 16 bp, M. musculus
aacccttggaggagcc

SEQ ID NO: 341281 - DNA, 16 bp, M. musculus
aacccttggggctctc

SEQ ID NO: 341282 - DNA, 16 bp, M. musculus
aaccctttaatacagt

SEQ ID NO: 341283 - DNA, 16 bp, M. musculus
aaccctttcatcccca

SEQ ID NO: 341284 - DNA, 16 bp, M. musculus
aaccctttcctcctca

SEQ ID NO: 341285 - DNA, 16 bp, M. musculus
aaccctttgatctaca

SEQ ID NO: 341286 - DNA, 16 bp, M. musculus
aaccctttgctatttc

SEQ ID NO: 341287 - DNA, 16 bp, M. musculus
aacccttttttcccca

SEQ ID NO: 341288 - DNA, 16 bp, M. musculus
aaccgagaacttgaat

SEQ ID NO: 341289 - DNA, 45 bp, M. musculus
aaccggtaagaaggacacatgctccactatgttcatagcagcctt

SEQ ID NO: 341290 - DNA, 16 bp, M. musculus
aaccgtaaaattattt

SEQ ID NO: 341291 - DNA, 16 bp, M. musculus
aaccgtccctgcatcc

SEQ ID NO: 341292 - DNA, 16 bp, M. musculus
aacctaaagaaagaga

SEQ ID NO: 341293 - DNA, 16 bp, M. musculus
aacctaaagttatcaa

SEQ ID NO: 341294 - DNA, 16 bp, M. musculus
aacctaagcataatag

SEQ ID NO: 341295 - DNA, 16 bp, M. musculus
aacctaagggagaaag

SEQ ID NO: 341296 - DNA, 16 bp, M. musculus
aacctacagcaaacca

SEQ ID NO: 341297 - DNA, 16 bp, M. musculus
aacctagctcgaccag

SEQ ID NO: 341298 - DNA, 16 bp, M. musculus
aacctatgagtctatg

SEQ ID NO: 341299 - DNA, 16 bp, M. musculus
aacctcaaagcctgct

SEQ ID NO: 341300 - DNA, 16 bp, M. musculus
aacctcaactgaaaaa

SEQ ID NO: 341301 - DNA, 16 bp, M. musculus
aacctcaaggtccaca

SEQ ID NO: 341302 - DNA, 16 bp, M. musculus
aacctcaattgagaaa

SEQ ID NO: 341303 - DNA, 22 bp, M. musculus
aacctcactctaacacaagagg

SEQ ID NO: 341304 - DNA, 16 bp, M. musculus
aacctcagaagatgga

SEQ ID NO: 341305 - DNA, 16 bp, M. musculus
aacctcagagttgttt

SEQ ID NO: 341306 - DNA, 16 bp, M. musculus
aacctcagcactgggg

SEQ ID NO: 341307 - DNA, 16 bp, M. musculus
aacctcagttgaagaa

SEQ ID NO: 341308 - DNA, 16 bp, M. musculus
aacctccagaagagca

SEQ ID NO: 341309 - DNA, 16 bp, M. musculus
aacctccagcaggaag

SEQ ID NO: 341310 - DNA, 16 bp, M. musculus
aacctcccctccccag

SEQ ID NO: 341311 - DNA, 16 bp, M. musculus
aacctcccttctagcc

SEQ ID NO: 341312 - DNA, 16 bp, M. musculus
aacctcctgcctcagc

SEQ ID NO: 341313 - DNA, 16 bp, M. musculus
aacctctaaaactata

SEQ ID NO: 341314 - DNA, 16 bp, M. musculus
aacctctcagaagaca

SEQ ID NO: 341315 - DNA, 16 bp, M. musculus
aacctctctgatgaca

SEQ ID NO: 341316 - DNA, 16 bp, M. musculus
aacctctgaaacttta

SEQ ID NO: 341317 - DNA, 16 bp, M. musculus
aacctctgaaccatct

SEQ ID NO: 341318 - DNA, 16 bp, M. musculus
aacctctgaacccata

SEQ ID NO: 341319 - DNA, 16 bp, M. musculus
aacctctgagctacct

SEQ ID NO: 341320 - DNA, 16 bp, M. musculus
aacctctggcctctac

SEQ ID NO: 341321 - DNA, 16 bp, M. musculus
aacctctgtcatctat

SEQ ID NO: 341322 - DNA, 16 bp, M. musculus
aacctctttgtacctt

SEQ ID NO: 341323 - DNA, 16 bp, M. musculus
aacctgaaaatacctt

SEQ ID NO: 341324 - DNA, 16 bp, M. musculus
aacctgaaaatggaaa

SEQ ID NO: 341325 - DNA, 16 bp, M. musculus
aacctgaacctgaacc

SEQ ID NO: 341326 - DNA, 16 bp, M. musculus
aacctgaagaaatcca

SEQ ID NO: 341327 - DNA, 16 bp, M. musculus
aacctgaagacccagc

SEQ ID NO: 341328 - DNA, 16 bp, M. musculus
aacctgaagtaaatga

SEQ ID NO: 341329 - DNA, 16 bp, M. musculus
aacctgaatttgaatc

SEQ ID NO: 341330 - DNA, 16 bp, M. musculus
aacctgaggaaatcca

SEQ ID NO: 341331 - DNA, 16 bp, M. musculus
aacctgagtctgatcc

SEQ ID NO: 341332 - DNA, 16 bp, M. musculus
aacctgagttccattc

SEQ ID NO: 341333 - DNA, 16 bp, M. musculus
aacctgagttggatcc

SEQ ID NO: 341334 - DNA, 16 bp, M. musculus
aacctgatgacctgaa

SEQ ID NO: 341335 - DNA, 16 bp, M. musculus
aacctgatgacctgag

SEQ ID NO: 341336 - DNA, 16 bp, M. musculus
aacctgatgccctctt

SEQ ID NO: 341337 - DNA, 16 bp, M. musculus
aacctgcctcctgaca

SEQ ID NO: 341338 - DNA, 16 bp, M. musculus
aacctgcttctcacct

SEQ ID NO: 341339 - DNA, 16 bp, M. musculus
aacctggaagaaatgg

SEQ ID NO: 341340 - DNA, 16 bp, M. musculus
aacctggaagagaaat

SEQ ID NO: 341341 - DNA, 16 bp, M. musculus
aacctggaagccagcc

SEQ ID NO: 341342 - DNA, 16 bp, M. musculus
aacctggacccccagg

SEQ ID NO: 341343 - DNA, 16 bp, M. musculus
aacctggacccttagg

SEQ ID NO: 341344 - DNA, 16 bp, M. musculus
aacctggagaaagaaa

SEQ ID NO: 341345 - DNA, 16 bp, M. musculus
aacctggagacactgg

SEQ ID NO: 341346 - DNA, 16 bp, M. musculus
aacctggagagatggc

SEQ ID NO: 341347 - DNA, 16 bp, M. musculus
aacctggagctggttc

SEQ ID NO: 341348 - DNA, 16 bp, M. musculus
aacctggaggccaggt

SEQ ID NO: 341349 - DNA, 16 bp, M. musculus
aacctggatcccctgg

SEQ ID NO: 341350 - DNA, 16 bp, M. musculus
aacctggatgagatgg

SEQ ID NO: 341351 - DNA, 16 bp, M. musculus
aacctggcctacagag

SEQ ID NO: 341352 - DNA, 16 bp, M. musculus
aacctggctggcctca

SEQ ID NO: 341353 - DNA, 16 bp, M. musculus
aacctgggatacatga

SEQ ID NO: 341354 - DNA, 16 bp, M. musculus
aacctgggctacatga

SEQ ID NO: 341355 - DNA, 16 bp, M. musculus
aacctgggctcacagg

SEQ ID NO: 341356 - DNA, 16 bp, M. musculus
aacctgggctggcatt

SEQ ID NO: 341357 - DNA, 16 bp, M. musculus
aacctgggtcctttga

SEQ ID NO: 341358 - DNA, 16 bp, M. musculus
aacctgggtgctctgg

SEQ ID NO: 341359 - DNA, 16 bp, M. musculus
aacctggtaaaatcaa

SEQ ID NO: 341360 - DNA, 16 bp, M. musculus
aacctggtctacaaaa

SEQ ID NO: 341361 - DNA, 16 bp, M. musculus
aacctggtggccaggt

SEQ ID NO: 341362 - DNA, 16 bp, M. musculus
aacctgtaagatgaaa

SEQ ID NO: 341363 - DNA, 16 bp, M. musculus
aacctgtaatcccagc

SEQ ID NO: 341364 - DNA, 16 bp, M. musculus
aacctgtctcaaaacc

SEQ ID NO: 341365 - DNA, 16 bp, M. musculus
aacctgtctcaacaaa

SEQ ID NO: 341366 - DNA, 16 bp, M. musculus
aacctgtgggccacaa

SEQ ID NO: 341367 - DNA, 16 bp, M. musculus
aacctgtttgttttct

SEQ ID NO: 341368 - DNA, 16 bp, M. musculus
aacctgttttttcctt

SEQ ID NO: 341369 - DNA, 16 bp, M. musculus
aaccttaaatctgtat

SEQ ID NO: 341370 - DNA, 16 bp, M. musculus
aaccttacaaatacag

SEQ ID NO: 341371 - DNA, 16 bp, M. musculus
aaccttactccaagat

SEQ ID NO: 341372 - DNA, 16 bp, M. musculus
aaccttcacagaacct

SEQ ID NO: 341373 - DNA, 16 bp, M. musculus
aaccttcacaggacaa

SEQ ID NO: 341374 - DNA, 18 bp, M. musculus
aaccttcacaggaccaaa

SEQ ID NO: 341375 - DNA, 16 bp, M. musculus
aaccttcatgaaagat

SEQ ID NO: 341376 - DNA, 16 bp, M. musculus
aaccttccatcttgga

SEQ ID NO: 341377 - DNA, 16 bp, M. musculus
aaccttcccaggacca

SEQ ID NO: 341378 - DNA, 16 bp, M. musculus
aaccttcccagtgctg

SEQ ID NO: 341379 - DNA, 16 bp, M. musculus
aaccttcctaatgctc

SEQ ID NO: 341380 - DNA, 16 bp, M. musculus
aaccttctgaaaccat

SEQ ID NO: 341381 - DNA, 16 bp, M. musculus
aaccttctgagtgctg

SEQ ID NO: 341382 - DNA, 16 bp, M. musculus
aaccttgaaaacattt

SEQ ID NO: 341383 - DNA, 16 bp, M. musculus
aaccttgaactcagag

SEQ ID NO: 341384 - DNA, 16 bp, M. musculus
aaccttgatttcagtg

SEQ ID NO: 341385 - DNA, 16 bp, M. musculus
aacctttatatttata

SEQ ID NO: 341386 - DNA, 16 bp, M. musculus
aacctttattaaaagt

SEQ ID NO: 341387 - DNA, 16 bp, M. musculus
aacctttattttgacc

SEQ ID NO: 341388 - DNA, 16 bp, M. musculus
aacctttcttagatct

SEQ ID NO: 341389 - DNA, 16 bp, M. musculus
aacctttggaaaagca

SEQ ID NO: 341390 - DNA, 16 bp, M. musculus
aacctttgtctctgta

SEQ ID NO: 341391 - DNA, 16 bp, M. musculus
aaccttttaaatgtaa

SEQ ID NO: 341392 - DNA, 16 bp, M. musculus
aaccttttacaccctg

SEQ ID NO: 341393 - DNA, 16 bp, M. musculus
aaccttttctctttat

SEQ ID NO: 341394 - DNA, 16 bp, M. musculus
aaccttttcttcccca

SEQ ID NO: 341395 - DNA, 16 bp, M. musculus
aacgaaatctgatgcc

SEQ ID NO: 341396 - DNA, 17 bp, M. musculus
aacgaatttatgaaatt

SEQ ID NO: 341397 - DNA, 18 bp, M. musculus
aacgacacagacaccaag

SEQ ID NO: 341398 - DNA, 16 bp, M. musculus
aacgacatggtggctc

SEQ ID NO: 341399 - DNA, 16 bp, M. musculus
aacgacttcatgaaat

SEQ ID NO: 341400 - DNA, 16 bp, M. musculus
aacgagatgatcatgt

SEQ ID NO: 341401 - DNA, 16 bp, M. musculus
aacgatgatgatgatg

SEQ ID NO: 341402 - DNA, 16 bp, M. musculus
aacgcaggtgacagca

SEQ ID NO: 341403 - DNA, 17 bp, M. musculus
aacgcccatattcagct

SEQ ID NO: 341404 - DNA, 16 bp, M. musculus
aacgctgctctctctt

SEQ ID NO: 341405 - DNA, 16 bp, M. musculus
aacgctgtcctttcca

SEQ ID NO: 341406 - DNA, 16 bp, M. musculus
aacgtccctaacctaa

SEQ ID NO: 341407 - DNA, 17 bp, M. musculus
aacgtgcttttgcatgt

SEQ ID NO: 341408 - DNA, 16 bp, M. musculus
aacgtggctgcccttg

SEQ ID NO: 341409 - DNA, 17 bp, M. musculus
aacgtggttcatttaca

SEQ ID NO: 341410 - DNA, 16 bp, M. musculus
aactaaaagaagttat

SEQ ID NO: 341411 - DNA, 16 bp, M. musculus
aactaaaaggcagaaa

SEQ ID NO: 341412 - DNA, 16 bp, M. musculus
aactaaagaagtgaaa

SEQ ID NO: 341413 - DNA, 16 bp, M. musculus
aactaaataaaatgta

SEQ ID NO: 341414 - DNA, 16 bp, M. musculus
aactaaatggtcaaag

SEQ ID NO: 341415 - DNA, 16 bp, M. musculus
aactaaattcttcaca

SEQ ID NO: 341416 - DNA, 16 bp, M. musculus
aactaaccaaaagaca

SEQ ID NO: 341417 - DNA, 16 bp, M. musculus
aactaacctggacccc

SEQ ID NO: 341418 - DNA, 16 bp, M. musculus
aactaacctggaccct

SEQ ID NO: 341419 - DNA, 16 bp, M. musculus
aactaactaactaaat

SEQ ID NO: 341420 - DNA, 16 bp, M. musculus
aactaactatatatat

SEQ ID NO: 341421 - DNA, 16 bp, M. musculus
aactaactttccaaag

SEQ ID NO: 341422 - DNA, 16 bp, M. musculus
aactaagaaaatgtct

SEQ ID NO: 341423 - DNA, 16 bp, M. musculus
aactaagacagaagct

SEQ ID NO: 341424 - DNA, 16 bp, M. musculus
aactaagcaggactca

SEQ ID NO: 341425 - DNA, 16 bp, M. musculus
aactaagcagtaccca

SEQ ID NO: 341426 - DNA, 16 bp, M. musculus
aactaaggaactgaaa

SEQ ID NO: 341427 - DNA, 17 bp, M. musculus
aactaataaagattaca

SEQ ID NO: 341428 - DNA, 16 bp, M. musculus
aactaataccagagat

SEQ ID NO: 341429 - DNA, 16 bp, M. musculus
aactacaaaccaaaga

SEQ ID NO: 341430 - DNA, 16 bp, M. musculus
aactacaacacaagga

SEQ ID NO: 341431 - DNA, 16 bp, M. musculus
aactacaatccagaat

SEQ ID NO: 341432 - DNA, 16 bp, M. musculus
aactacaattcccaga

SEQ ID NO: 341433 - DNA, 16 bp, M. musculus
aactacaccaaagaaa

SEQ ID NO: 341434 - DNA, 16 bp, M. musculus
aactacagaagccaaa

SEQ ID NO: 341435 - DNA, 16 bp, M. musculus
aactacatgatcatct

SEQ ID NO: 341436 - DNA, 16 bp, M. musculus
aactacatgatcattt

SEQ ID NO: 341437 - DNA, 16 bp, M. musculus
aactacatttcccaga

SEQ ID NO: 341438 - DNA, 16 bp, M. musculus
aactaccagattgatt

SEQ ID NO: 341439 - DNA, 16 bp, M. musculus
aactaccatcacactg

SEQ ID NO: 341440 - DNA, 16 bp, M. musculus
aactaccccaacaatg

SEQ ID NO: 341441 - DNA, 16 bp, M. musculus
aactactaagccatct

SEQ ID NO: 341442 - DNA, 16 bp, M. musculus
aactactgacccatct

SEQ ID NO: 341443 - DNA, 16 bp, M. musculus
aactacttcctgctga

SEQ ID NO: 341444 - DNA, 16 bp, M. musculus
aactacttctaaacag

SEQ ID NO: 341445 - DNA, 16 bp, M. musculus
aactacttttaaaatt

SEQ ID NO: 341446 - DNA, 16 bp, M. musculus
aactagaaaatatcat

SEQ ID NO: 341447 - DNA, 16 bp, M. musculus
aactagaaactatcat

SEQ ID NO: 341448 - DNA, 16 bp, M. musculus
aactagaaagcctgaa

SEQ ID NO: 341449 - DNA, 16 bp, M. musculus
aactagaaataaaatt

SEQ ID NO: 341450 - DNA, 16 bp, M. musculus
aactagaatatatcat

SEQ ID NO: 341451 - DNA, 16 bp, M. musculus
aactagagagaacaca

SEQ ID NO: 341452 - DNA, 16 bp, M. musculus
aactagagtcacctgg

SEQ ID NO: 341453 - DNA, 16 bp, M. musculus
aactagatgtctgcat

SEQ ID NO: 341454 - DNA, 17 bp, M. musculus
aactagctgctgtgggg

SEQ ID NO: 341455 - DNA, 16 bp, M. musculus
aactaggagatattta

SEQ ID NO: 341456 - DNA, 16 bp, M. musculus
aactaggccatctcct

SEQ ID NO: 341457 - DNA, 16 bp, M. musculus
aactagggggaaaaaa

SEQ ID NO: 341458 - DNA, 16 bp, M. musculus
aactagttcatatttt

SEQ ID NO: 341459 - DNA, 16 bp, M. musculus
aactatacaaaacagt

SEQ ID NO: 341460 - DNA, 16 bp, M. musculus
aactataccaccaatc

SEQ ID NO: 341461 - DNA, 16 bp, M. musculus
aactatataacccttg

SEQ ID NO: 341462 - DNA, 16 bp, M. musculus
aactatatatgtatat

SEQ ID NO: 341463 - DNA, 16 bp, M. musculus
aactatattaaagggt

SEQ ID NO: 341464 - DNA, 16 bp, M. musculus
aactatcagacctacc

SEQ ID NO: 341465 - DNA, 16 bp, M. musculus
aactattccatgaaat

SEQ ID NO: 341466 - DNA, 17 bp, M. musculus
aactattcctttttcca

SEQ ID NO: 341467 - DNA, 16 bp, M. musculus
aactattctgtttgtt

SEQ ID NO: 341468 - DNA, 16 bp, M. musculus
aactatttccattttt

SEQ ID NO: 341469 - DNA, 16 bp, M. musculus
aactatttctaaacat

SEQ ID NO: 341470 - DNA, 16 bp, M. musculus
aactatttgagaagga

SEQ ID NO: 341471 - DNA, 16 bp, M. musculus
aactatttttaaaaga

SEQ ID NO: 341472 - DNA, 16 bp, M. musculus
aactcaaaaagaagga

SEQ ID NO: 341473 - DNA, 16 bp, M. musculus
aactcaaaaagggcag

SEQ ID NO: 341474 - DNA, 16 bp, M. musculus
aactcaaaaagttgga

SEQ ID NO: 341475 - DNA, 16 bp, M. musculus
aactcaaaatcctcct

SEQ ID NO: 341476 - DNA, 16 bp, M. musculus
aactcaaacaaatgag

SEQ ID NO: 341477 - DNA, 16 bp, M. musculus
aactcaaacagggcag

SEQ ID NO: 341478 - DNA, 16 bp, M. musculus
aactcaaagacaagaa

SEQ ID NO: 341479 - DNA, 16 bp, M. musculus
aactcaaagggaaaaa

SEQ ID NO: 341480 - DNA, 16 bp, M. musculus
aactcaaagtgagaca

SEQ ID NO: 341481 - DNA, 16 bp, M. musculus
aactcaagaagaagga

SEQ ID NO: 341482 - DNA, 16 bp, M. musculus
aactcaagaagatcaa

SEQ ID NO: 341483 - DNA, 16 bp, M. musculus
aactcaagaagattaa

SEQ ID NO: 341484 - DNA, 16 bp, M. musculus
aactcaagaagcagga

SEQ ID NO: 341485 - DNA, 16 bp, M. musculus
aactcaagaagctgga

SEQ ID NO: 341486 - DNA, 16 bp, M. musculus
aactcaagaaggaaga

SEQ ID NO: 341487 - DNA, 16 bp, M. musculus
aactcaagaagttaga

SEQ ID NO: 341488 - DNA, 16 bp, M. musculus
aactcaagagatccat

SEQ ID NO: 341489 - DNA, 16 bp, M. musculus
aactcaagatggtgga

SEQ ID NO: 341490 - DNA, 16 bp, M. musculus
aactcaagatgttaga

SEQ ID NO: 341491 - DNA, 16 bp, M. musculus
aactcaaggcaatcct

SEQ ID NO: 341492 - DNA, 16 bp, M. musculus
aactcaaggccagcct

SEQ ID NO: 341493 - DNA, 16 bp, M. musculus
aactcaatatatatat

SEQ ID NO: 341494 - DNA, 16 bp, M. musculus
aactcaatctatagac

SEQ ID NO: 341495 - DNA, 16 bp, M. musculus
aactcaattcttcagt

SEQ ID NO: 341496 - DNA, 16 bp, M. musculus
aactcacaaagacctg

SEQ ID NO: 341497 - DNA, 16 bp, M. musculus
aactcacaacagctgt

SEQ ID NO: 341498 - DNA, 16 bp, M. musculus
aactcacacaaaatgt

SEQ ID NO: 341499 - DNA, 17 bp, M. musculus
aactcacacgatatgta

SEQ ID NO: 341500 - DNA, 16 bp, M. musculus
aactcacagaaatcca

SEQ ID NO: 341501 - DNA, 16 bp, M. musculus
aactcacagaaatttg

SEQ ID NO: 341502 - DNA, 16 bp, M. musculus
aactcacagacatcca

SEQ ID NO: 341503 - DNA, 16 bp, M. musculus
aactcacagagagcct

SEQ ID NO: 341504 - DNA, 16 bp, M. musculus
aactcacagagatcag

SEQ ID NO: 341505 - DNA, 16 bp, M. musculus
aactcacagagatcca

SEQ ID NO: 341506 - DNA, 16 bp, M. musculus
aactcacagagatctg

SEQ ID NO: 341507 - DNA, 17 bp, M. musculus
aactcacagagatctgt

SEQ ID NO: 341508 - DNA, 16 bp, M. musculus
aactcacagagattta

SEQ ID NO: 341509 - DNA, 16 bp, M. musculus
aactcacagggatcca

SEQ ID NO: 341510 - DNA, 16 bp, M. musculus
aactcacatggtggct

SEQ ID NO: 341511 - DNA, 16 bp, M. musculus
aactcaccagtacccc

SEQ ID NO: 341512 - DNA, 18 bp, M. musculus
aactcaccctgtagacca

SEQ ID NO: 341513 - DNA, 16 bp, M. musculus
aactcacctcctggag

SEQ ID NO: 341514 - DNA, 16 bp, M. musculus
aactcactatgtagct

SEQ ID NO: 341515 - DNA, 16 bp, M. musculus
aactcactctgtactc

SEQ ID NO: 341516 - DNA, 18 bp, M. musculus
aactcactctgtagaccc

SEQ ID NO: 341517 - DNA, 16 bp, M. musculus
aactcactctgtatac

SEQ ID NO: 341518 - DNA, 16 bp, M. musculus
aactcactctttagac

SEQ ID NO: 341519 - DNA, 16 bp, M. musculus
aactcactttgtagaa

SEQ ID NO: 341520 - DNA, 24 bp, M. musculus
aactcagaaatccccctgcctctg

SEQ ID NO: 341521 - DNA, 27 bp, M. musculus
aactcagaaatctgcctgcctctgcct

SEQ ID NO: 341522 - DNA, 17 bp, M. musculus
aactcagaaatggtcaa

SEQ ID NO: 341523 - DNA, 16 bp, M. musculus
aactcagaacctccag

SEQ ID NO: 341524 - DNA, 20 bp, M. musculus
aactcagaacctctggaaga

SEQ ID NO: 341525 - DNA, 16 bp, M. musculus
aactcagaagagatct

SEQ ID NO: 341526 - DNA, 16 bp, M. musculus
aactcagaatctgcct

SEQ ID NO: 341527 - DNA, 16 bp, M. musculus
aactcagacccaacct

SEQ ID NO: 341528 - DNA, 16 bp, M. musculus
aactcagagacccacc

SEQ ID NO: 341529 - DNA, 16 bp, M. musculus
aactcagagatccgct

SEQ ID NO: 341530 - DNA, 16 bp, M. musculus
aactcagagatctaca

SEQ ID NO: 341531 - DNA, 16 bp, M. musculus
aactcagagatcttca

SEQ ID NO: 341532 - DNA, 16 bp, M. musculus
aactcagagatttacc

SEQ ID NO: 341533 - DNA, 19 bp, M. musculus
aactcagagccatgaattt

SEQ ID NO: 341534 - DNA, 16 bp, M. musculus
aactcagagctgaaat

SEQ ID NO: 341535 - DNA, 16 bp, M. musculus
aactcagatcctctgg

SEQ ID NO: 341536 - DNA, 16 bp, M. musculus
aactcagatctgcctg

SEQ ID NO: 341537 - DNA, 16 bp, M. musculus
aactcagatgtccttc

SEQ ID NO: 341538 - DNA, 16 bp, M. musculus
aactcagattgtcagg

SEQ ID NO: 341539 - DNA, 16 bp, M. musculus
aactcagcagttaaga

SEQ ID NO: 341540 - DNA, 16 bp, M. musculus
aactcagccagtcctg

SEQ ID NO: 341541 - DNA, 16 bp, M. musculus
aactcaggaactctgg

SEQ ID NO: 341542 - DNA, 16 bp, M. musculus
aactcaggaacttcag

SEQ ID NO: 341543 - DNA, 16 bp, M. musculus
aactcaggacatctgg

SEQ ID NO: 341544 - DNA, 16 bp, M. musculus
aactcaggacgtttgg

SEQ ID NO: 341545 - DNA, 16 bp, M. musculus
aactcaggactgaaat

SEQ ID NO: 341546 - DNA, 16 bp, M. musculus
aactcaggaggctgag

SEQ ID NO: 341547 - DNA, 16 bp, M. musculus
aactcaggatctcatg

SEQ ID NO: 341548 - DNA, 16 bp, M. musculus
aactcaggctgtcagg

SEQ ID NO: 341549 - DNA, 16 bp, M. musculus
aactcagggccttgca

SEQ ID NO: 341550 - DNA, 16 bp, M. musculus
aactcagggctgatat

SEQ ID NO: 341551 - DNA, 16 bp, M. musculus
aactcagggcttcctg

SEQ ID NO: 341552 - DNA, 16 bp, M. musculus
aactcaggggaaaaaa

SEQ ID NO: 341553 - DNA, 16 bp, M. musculus
aactcagggtttcatg

SEQ ID NO: 341554 - DNA, 16 bp, M. musculus
aactcaggtcaccagg

SEQ ID NO: 341555 - DNA, 16 bp, M. musculus
aactcaggtcagcagg

SEQ ID NO: 341556 - DNA, 16 bp, M. musculus
aactcaggtcatcaga

SEQ ID NO: 341557 - DNA, 16 bp, M. musculus
aactcaggtcatcagg

SEQ ID NO: 341558 - DNA, 16 bp, M. musculus
aactcaggtggcagca

SEQ ID NO: 341559 - DNA, 16 bp, M. musculus
aactcaggtggtcagg

SEQ ID NO: 341560 - DNA, 16 bp, M. musculus
aactcaggttaccagg

SEQ ID NO: 341561 - DNA, 16 bp, M. musculus
aactcaggttctcatg

SEQ ID NO: 341562 - DNA, 16 bp, M. musculus
aactcaggttgtcagg

SEQ ID NO: 341563 - DNA, 16 bp, M. musculus
aactcagtatgtagac

SEQ ID NO: 341564 - DNA, 16 bp, M. musculus
aactcagtcacaaaat

SEQ ID NO: 341565 - DNA, 16 bp, M. musculus
aactcagtggttaaga

SEQ ID NO: 341566 - DNA, 16 bp, M. musculus
aactcatagaaactga

SEQ ID NO: 341567 - DNA, 16 bp, M. musculus
aactcatagaaatcca

SEQ ID NO: 341568 - DNA, 16 bp, M. musculus
aactcatagagatctg

SEQ ID NO: 341569 - DNA, 16 bp, M. musculus
aactcatatatatata

SEQ ID NO: 341570 - DNA, 17 bp, M. musculus
aactcatatgatatgta

SEQ ID NO: 341571 - DNA, 16 bp, M. musculus
aactcatcatgactgt

SEQ ID NO: 341572 - DNA, 16 bp, M. musculus
aactcatgaaactgaa

SEQ ID NO: 341573 - DNA, 16 bp, M. musculus
aactcatgttctcatg

SEQ ID NO: 341574 - DNA, 16 bp, M. musculus
aactcattaaagaaat

SEQ ID NO: 341575 - DNA, 16 bp, M. musculus
aactcattctttttaa

SEQ ID NO: 341576 - DNA, 16 bp, M. musculus
aactcattttgtagat

SEQ ID NO: 341577 - DNA, 16 bp, M. musculus
aactcattttttggct

SEQ ID NO: 341578 - DNA, 16 bp, M. musculus
aactccaactccaact

SEQ ID NO: 341579 - DNA, 16 bp, M. musculus
aactccaatcccagag

SEQ ID NO: 341580 - DNA, 16 bp, M. musculus
aactccaattctagga

SEQ ID NO: 341581 - DNA, 16 bp, M. musculus
aactccacaaagttgt

SEQ ID NO: 341582 - DNA, 16 bp, M. musculus
aactccactttcaggg

SEQ ID NO: 341583 - DNA, 16 bp, M. musculus
aactccagaaagttgt

SEQ ID NO: 341584 - DNA, 16 bp, M. musculus
aactccagcccaggct

SEQ ID NO: 341585 - DNA, 16 bp, M. musculus
aactccagccccagag

SEQ ID NO: 341586 - DNA, 16 bp, M. musculus
aactccagccccaggg

SEQ ID NO: 341587 - DNA, 16 bp, M. musculus
aactccagccctaggg

SEQ ID NO: 341588 - DNA, 16 bp, M. musculus
aactccagcctctgtc

SEQ ID NO: 341589 - DNA, 16 bp, M. musculus
aactccagctcccggg

SEQ ID NO: 341590 - DNA, 16 bp, M. musculus
aactccagctcctggg

SEQ ID NO: 341591 - DNA, 16 bp, M. musculus
aactccagctctgagg

SEQ ID NO: 341592 - DNA, 16 bp, M. musculus
aactccagcttcagaa

SEQ ID NO: 341593 - DNA, 16 bp, M. musculus
aactccaggcaggaac

SEQ ID NO: 341594 - DNA, 16 bp, M. musculus
aactccaggttcaggg

SEQ ID NO: 341595 - DNA, 16 bp, M. musculus
aactccagtaccagga

SEQ ID NO: 341596 - DNA, 16 bp, M. musculus
aactccagtgccagag

SEQ ID NO: 341597 - DNA, 16 bp, M. musculus
aactccagttctgagg

SEQ ID NO: 341598 - DNA, 16 bp, M. musculus
aactccagtttcaaag

SEQ ID NO: 341599 - DNA, 16 bp, M. musculus
aactccagtttcagat

SEQ ID NO: 341600 - DNA, 16 bp, M. musculus
aactccatatgtagac

SEQ ID NO: 341601 - DNA, 16 bp, M. musculus
aactccatccatttgc

SEQ ID NO: 341602 - DNA, 16 bp, M. musculus
aactccatgaactgaa

SEQ ID NO: 341603 - DNA, 16 bp, M. musculus
aactccatgctgggct

SEQ ID NO: 341604 - DNA, 16 bp, M. musculus
aactccattccatggg

SEQ ID NO: 341605 - DNA, 16 bp, M. musculus
aactcccaaacctgat

SEQ ID NO: 341606 - DNA, 16 bp, M. musculus
aactcccaggggcctc

SEQ ID NO: 341607 - DNA, 16 bp, M. musculus
aactcccatttctggg

SEQ ID NO: 341608 - DNA, 16 bp, M. musculus
aactcccctgccctgc

SEQ ID NO: 341609 - DNA, 18 bp, M. musculus
aactcccgtcccgagttt

SEQ ID NO: 341610 - DNA, 17 bp, M. musculus
aactcccttaaagaaat

SEQ ID NO: 341611 - DNA, 16 bp, M. musculus
aactccctttaaaaaa

SEQ ID NO: 341612 - DNA, 16 bp, M. musculus
aactcctccatagggg

SEQ ID NO: 341613 - DNA, 17 bp, M. musculus
aactcctccattgggga

SEQ ID NO: 341614 - DNA, 16 bp, M. musculus
aactcctcctcagctg

SEQ ID NO: 341615 - DNA, 16 bp, M. musculus
aactcctgactctcct

SEQ ID NO: 341616 - DNA, 16 bp, M. musculus
aactcctgcctctgcc

SEQ ID NO: 341617 - DNA, 16 bp, M. musculus
aactcctgggctcaag

SEQ ID NO: 341618 - DNA, 16 bp, M. musculus
aactcctgttttctta

SEQ ID NO: 341619 - DNA, 16 bp, M. musculus
aactcgcagagatcca

SEQ ID NO: 341620 - DNA, 16 bp, M. musculus
aactcgcagagatctg

SEQ ID NO: 341621 - DNA, 16 bp, M. musculus
aactcggagatccacc

SEQ ID NO: 341622 - DNA, 16 bp, M. musculus
aactcgggttgtcagg

SEQ ID NO: 341623 - DNA, 16 bp, M. musculus
aactctaaaacactgt

SEQ ID NO: 341624 - DNA, 16 bp, M. musculus
aactctaaccctctgg

SEQ ID NO: 341625 - DNA, 16 bp, M. musculus
aactctaatttctttt

SEQ ID NO: 341626 - DNA, 16 bp, M. musculus
aactctacaaagtctt

SEQ ID NO: 341627 - DNA, 16 bp, M. musculus
aactctactgaactgg

SEQ ID NO: 341628 - DNA, 16 bp, M. musculus
aactctagctccagga

SEQ ID NO: 341629 - DNA, 16 bp, M. musculus
aactctagctctaggg

SEQ ID NO: 341630 - DNA, 16 bp, M. musculus
aactctagctgcaggg

SEQ ID NO: 341631 - DNA, 16 bp, M. musculus
aactctatgaagaatt

SEQ ID NO: 341632 - DNA, 16 bp, M. musculus
aactctattgcttaca

SEQ ID NO: 341633 - DNA, 16 bp, M. musculus
aactctcaacttcata

SEQ ID NO: 341634 - DNA, 16 bp, M. musculus
aactctcaattctgaa

SEQ ID NO: 341635 - DNA, 16 bp, M. musculus
aactctcagctcctgc

SEQ ID NO: 341636 - DNA, 20 bp, M. musculus
aactctcagctctgcctgtg

SEQ ID NO: 341637 - DNA, 16 bp, M. musculus
aactctcagcttctcc

SEQ ID NO: 341638 - DNA, 16 bp, M. musculus
aactctcaggagaaca

SEQ ID NO: 341639 - DNA, 16 bp, M. musculus
aactctccctctccat

SEQ ID NO: 341640 - DNA, 16 bp, M. musculus
aactctcctccccatg

SEQ ID NO: 341641 - DNA, 16 bp, M. musculus
aactctcctgccctgt

SEQ ID NO: 341642 - DNA, 17 bp, M. musculus
aactctctatgtagacc

SEQ ID NO: 341643 - DNA, 16 bp, M. musculus
aactctcttgccaaag

SEQ ID NO: 341644 - DNA, 16 bp, M. musculus
aactctgaagccagtc

SEQ ID NO: 341645 - DNA, 17 bp, M. musculus
aactctgacaccctgca

SEQ ID NO: 341646 - DNA, 16 bp, M. musculus
aactctgactggctgg

SEQ ID NO: 341647 - DNA, 16 bp, M. musculus
aactctgagatccacc

SEQ ID NO: 341648 - DNA, 16 bp, M. musculus
aactctgatcctcatg

SEQ ID NO: 341649 - DNA, 16 bp, M. musculus
aactctgatttaaaat

SEQ ID NO: 341650 - DNA, 16 bp, M. musculus
aactctgcagaagagg

SEQ ID NO: 341651 - DNA, 16 bp, M. musculus
aactctgccagtctcc

SEQ ID NO: 341652 - DNA, 16 bp, M. musculus
aactctgccctaaacc

SEQ ID NO: 341653 - DNA, 16 bp, M. musculus
aactctgcctcaaaaa

SEQ ID NO: 341654 - DNA, 16 bp, M. musculus
aactctggaccttcgg

SEQ ID NO: 341655 - DNA, 17 bp, M. musculus
aactctggagatagaaa

SEQ ID NO: 341656 - DNA, 16 bp, M. musculus
aactctggctcctgtc

SEQ ID NO: 341657 - DNA, 16 bp, M. musculus
aactctggctggctgg

SEQ ID NO: 341658 - DNA, 16 bp, M. musculus
aactctggctggcttg

SEQ ID NO: 341659 - DNA, 16 bp, M. musculus
aactctggctgtgagg

SEQ ID NO: 341660 - DNA, 16 bp, M. musculus
aactctggtcatcagg

SEQ ID NO: 341661 - DNA, 16 bp, M. musculus
aactctggtcctcaca

SEQ ID NO: 341662 - DNA, 16 bp, M. musculus
aactctggtcctcagg

SEQ ID NO: 341663 - DNA, 16 bp, M. musculus
aactctgtagatcagg

SEQ ID NO: 341664 - DNA, 16 bp, M. musculus
aactcttaaaaactgt

SEQ ID NO: 341665 - DNA, 16 bp, M. musculus
aactcttaaaaattgt

SEQ ID NO: 341666 - DNA, 16 bp, M. musculus
aactcttaaaaggaaa

SEQ ID NO: 341667 - DNA, 16 bp, M. musculus
aactcttacaaggaca

SEQ ID NO: 341668 - DNA, 16 bp, M. musculus
aactcttagagatcca

SEQ ID NO: 341669 - DNA, 16 bp, M. musculus
aactcttataaaggaa

SEQ ID NO: 341670 - DNA, 16 bp, M. musculus
aactcttctataagtt

SEQ ID NO: 341671 - DNA, 16 bp, M. musculus
aactctttaatacagt

SEQ ID NO: 341672 - DNA, 16 bp, M. musculus
aactcttttcctcatg

SEQ ID NO: 341673 - DNA, 16 bp, M. musculus
aactgaaaatttaaaa

SEQ ID NO: 341674 - DNA, 16 bp, M. musculus
aactgaaactcagagg

SEQ ID NO: 341675 - DNA, 16 bp, M. musculus
aactgaaagagtcaga

SEQ ID NO: 341676 - DNA, 16 bp, M. musculus
aactgaaagtgaaaga

SEQ ID NO: 341677 - DNA, 17 bp, M. musculus
aactgaacagggacaca

SEQ ID NO: 341678 - DNA, 16 bp, M. musculus
aactgaagaaattaaa

SEQ ID NO: 341679 - DNA, 17 bp, M. musculus
aactgaagaagatctca

SEQ ID NO: 341680 - DNA, 16 bp, M. musculus
aactgaagaccaagaa

SEQ ID NO: 341681 - DNA, 16 bp, M. musculus
aactgaagagaaagca

SEQ ID NO: 341682 - DNA, 16 bp, M. musculus
aactgaagcagaggct

SEQ ID NO: 341683 - DNA, 16 bp, M. musculus
aactgaagcaggtcag

SEQ ID NO: 341684 - DNA, 16 bp, M. musculus
aactgaagcgcctttc

SEQ ID NO: 341685 - DNA, 16 bp, M. musculus
aactgaaggaaagacc

SEQ ID NO: 341686 - DNA, 16 bp, M. musculus
aactgaagttacagat

SEQ ID NO: 341687 - DNA, 16 bp, M. musculus
aactgacctgaaagcc

SEQ ID NO: 341688 - DNA, 16 bp, M. musculus
aactgactccacaaag

SEQ ID NO: 341689 - DNA, 16 bp, M. musculus
aactgagaaaagaaat

SEQ ID NO: 341690 - DNA, 16 bp, M. musculus
aactgagaaaatgcct

SEQ ID NO: 341691 - DNA, 16 bp, M. musculus
aactgagaagatgcct

SEQ ID NO: 341692 - DNA, 17 bp, M. musculus
aactgagacagagtcag

SEQ ID NO: 341693 - DNA, 16 bp, M. musculus
aactgagagagacaga

SEQ ID NO: 341694 - DNA, 16 bp, M. musculus
aactgagcaactgaag

SEQ ID NO: 341695 - DNA, 16 bp, M. musculus
aactgagccatctcct

SEQ ID NO: 341696 - DNA, 16 bp, M. musculus
aactgagccatctctt

SEQ ID NO: 341697 - DNA, 16 bp, M. musculus
aactgaggaaattcaa

SEQ ID NO: 341698 - DNA, 16 bp, M. musculus
aactgaggcacagaga

SEQ ID NO: 341699 - DNA, 16 bp, M. musculus
aactgaggcagaagcc

SEQ ID NO: 341700 - DNA, 16 bp, M. musculus
aactgaggcagagacc

SEQ ID NO: 341701 - DNA, 16 bp, M. musculus
aactgaggcaggaggc

SEQ ID NO: 341702 - DNA, 16 bp, M. musculus
aactgaggcaggcagc

SEQ ID NO: 341703 - DNA, 16 bp, M. musculus
aactgaggctccctcc

SEQ ID NO: 341704 - DNA, 16 bp, M. musculus
aactgaggtgggaagg

SEQ ID NO: 341705 - DNA, 16 bp, M. musculus
aactgagtggcagaca

SEQ ID NO: 341706 - DNA, 16 bp, M. musculus
aactgagttttgtttt

SEQ ID NO: 341707 - DNA, 16 bp, M. musculus
aactgatctcccagga

SEQ ID NO: 341708 - DNA, 16 bp, M. musculus
aactgatgcaggagga

SEQ ID NO: 341709 - DNA, 16 bp, M. musculus
aactgatggaaacaaa

SEQ ID NO: 341710 - DNA, 16 bp, M. musculus
aactgatggaaacaga

SEQ ID NO: 341711 - DNA, 16 bp, M. musculus
aactgattcctgaaag

SEQ ID NO: 341712 - DNA, 16 bp, M. musculus
aactgattgattgatt

SEQ ID NO: 341713 - DNA, 16 bp, M. musculus
aactgcaaggcatttt

SEQ ID NO: 341714 - DNA, 16 bp, M. musculus
aactgcagaagcagaa

SEQ ID NO: 341715 - DNA, 16 bp, M. musculus
aactgcagagtcatct

SEQ ID NO: 341716 - DNA, 16 bp, M. musculus
aactgcagggaaaaaa

SEQ ID NO: 341717 - DNA, 16 bp, M. musculus
aactgcagtcccaggg

SEQ ID NO: 341718 - DNA, 16 bp, M. musculus
aactgcagttccaagg

SEQ ID NO: 341719 - DNA, 16 bp, M. musculus
aactgcagtttcaggg

SEQ ID NO: 341720 - DNA, 16 bp, M. musculus
aactgcatggtgttgg

SEQ ID NO: 341721 - DNA, 16 bp, M. musculus
aactgccactctgtaa

SEQ ID NO: 341722 - DNA, 16 bp, M. musculus
aactgccatgtggatg

SEQ ID NO: 341723 - DNA, 17 bp, M. musculus
aactgcccagtggcttc

SEQ ID NO: 341724 - DNA, 16 bp, M. musculus
aactgccctttctaac

SEQ ID NO: 341725 - DNA, 19 bp, M. musculus
aactgcctgtaactccagc

SEQ ID NO: 341726 - DNA, 16 bp, M. musculus
aactgcctgtagctcc

SEQ ID NO: 341727 - DNA, 16 bp, M. musculus
aactgccttcctctcc

SEQ ID NO: 341728 - DNA, 16 bp, M. musculus
aactgctaagtcatct

SEQ ID NO: 341729 - DNA, 16 bp, M. musculus
aactgctaggattaca

SEQ ID NO: 341730 - DNA, 16 bp, M. musculus
aactgctctgagtgca

SEQ ID NO: 341731 - DNA, 16 bp, M. musculus
aactgctgagccacct

SEQ ID NO: 341732 - DNA, 16 bp, M. musculus
aactgctgagctacct

SEQ ID NO: 341733 - DNA, 16 bp, M. musculus
aactgctgagctatct

SEQ ID NO: 341734 - DNA, 16 bp, M. musculus
aactgctgagctgtct

SEQ ID NO: 341735 - DNA, 16 bp, M. musculus
aactgctgccgtccgt

SEQ ID NO: 341736 - DNA, 16 bp, M. musculus
aactgctgctgctgct

SEQ ID NO: 341737 - DNA, 16 bp, M. musculus
aactgctgtgtgtgtg

SEQ ID NO: 341738 - DNA, 16 bp, M. musculus
aactgcttagccatct

SEQ ID NO: 341739 - DNA, 16 bp, M. musculus
aactgcttccatgttg

SEQ ID NO: 341740 - DNA, 16 bp, M. musculus
aactgctttctcctgg

SEQ ID NO: 341741 - DNA, 16 bp, M. musculus
aactgctttctttttt

SEQ ID NO: 341742 - DNA, 16 bp, M. musculus
aactgcttttccagag

SEQ ID NO: 341743 - DNA, 16 bp, M. musculus
aactggaaaatctaaa

SEQ ID NO: 341744 - DNA, 16 bp, M. musculus
aactggaaaatctgta

SEQ ID NO: 341745 - DNA, 16 bp, M. musculus
aactggaaaatttaga

SEQ ID NO: 341746 - DNA, 16 bp, M. musculus
aactggaaagaacaca

SEQ ID NO: 341747 - DNA, 16 bp, M. musculus
aactggaaagatggct

SEQ ID NO: 341748 - DNA, 16 bp, M. musculus
aactggaaagcttttg

SEQ ID NO: 341749 - DNA, 16 bp, M. musculus
aactggaaagggggat

SEQ ID NO: 341750 - DNA, 16 bp, M. musculus
aactggaaatgaaaaa

SEQ ID NO: 341751 - DNA, 16 bp, M. musculus
aactggaactacagat

SEQ ID NO: 341752 - DNA, 16 bp, M. musculus
aactggaagtaactgg

SEQ ID NO: 341753 - DNA, 16 bp, M. musculus
aactggaattacaggt

SEQ ID NO: 341754 - DNA, 16 bp, M. musculus
aactggacagtgtgca

SEQ ID NO: 341755 - DNA, 16 bp, M. musculus
aactggacatcaagaa

SEQ ID NO: 341756 - DNA, 16 bp, M. musculus
aactggactcctggca

SEQ ID NO: 341757 - DNA, 16 bp, M. musculus
aactggactctgagga

SEQ ID NO: 341758 - DNA, 16 bp, M. musculus
aactggagaacctaga

SEQ ID NO: 341759 - DNA, 16 bp, M. musculus
aactggagaccagcct

SEQ ID NO: 341760 - DNA, 16 bp, M. musculus
aactggagagatggct

SEQ ID NO: 341761 - DNA, 16 bp, M. musculus
aactggagcaggagct

SEQ ID NO: 341762 - DNA, 16 bp, M. musculus
aactggagctggggct

SEQ ID NO: 341763 - DNA, 16 bp, M. musculus
aactggaggaaaaaaa

SEQ ID NO: 341764 - DNA, 16 bp, M. musculus
aactggagttacaaat

SEQ ID NO: 341765 - DNA, 16 bp, M. musculus
aactggagttacaggt

SEQ ID NO: 341766 - DNA, 16 bp, M. musculus
aactggatgaaatgga

SEQ ID NO: 341767 - DNA, 16 bp, M. musculus
aactggatgtcttcat

SEQ ID NO: 341768 - DNA, 16 bp, M. musculus
aactggcaaagcaaga

SEQ ID NO: 341769 - DNA, 16 bp, M. musculus
aactggccatcctacc

SEQ ID NO: 341770 - DNA, 16 bp, M. musculus
aactggccatcttctg

SEQ ID NO: 341771 - DNA, 16 bp, M. musculus
aactggctggtgctgg

SEQ ID NO: 341772 - DNA, 16 bp, M. musculus
aactggcttccaggca

SEQ ID NO: 341773 - DNA, 16 bp, M. musculus
aactggctttgaactt

SEQ ID NO: 341774 - DNA, 16 bp, M. musculus
aactgggaaaagggat

SEQ ID NO: 341775 - DNA, 16 bp, M. musculus
aactgggaaagggaat

SEQ ID NO: 341776 - DNA, 16 bp, M. musculus
aactgggaagtgggat

SEQ ID NO: 341777 - DNA, 16 bp, M. musculus
aactgggaataaaaca

SEQ ID NO: 341778 - DNA, 16 bp, M. musculus
aactgggatgccttgt

SEQ ID NO: 341779 - DNA, 16 bp, M. musculus
aactgggattaaaggt

SEQ ID NO: 341780 - DNA, 16 bp, M. musculus
aactgggatttttttt

SEQ ID NO: 341781 - DNA, 17 bp, M. musculus
aactgggcctcctaaga

SEQ ID NO: 341782 - DNA, 16 bp, M. musculus
aactgggcctgtccca

SEQ ID NO: 341783 - DNA, 16 bp, M. musculus
aactgggcgtggtggt

SEQ ID NO: 341784 - DNA, 16 bp, M. musculus
aactgggctgccttgc

SEQ ID NO: 341785 - DNA, 16 bp, M. musculus
aactggggtattgctg

SEQ ID NO: 341786 - DNA, 16 bp, M. musculus
aactgggtcctgctgg

SEQ ID NO: 341787 - DNA, 16 bp, M. musculus
aactggtacaaacact

SEQ ID NO: 341788 - DNA, 16 bp, M. musculus
aactggtcaaagtgct

SEQ ID NO: 341789 - DNA, 16 bp, M. musculus
aactggtctcccagaa

SEQ ID NO: 341790 - DNA, 16 bp, M. musculus
aactggtggttttcat

SEQ ID NO: 341791 - DNA, 16 bp, M. musculus
aactggttatgtggcc

SEQ ID NO: 341792 - DNA, 16 bp, M. musculus
aactgtaaaatgaaat

SEQ ID NO: 341793 - DNA, 16 bp, M. musculus
aactgtaaacattgcc

SEQ ID NO: 341794 - DNA, 16 bp, M. musculus
aactgtaacccagccc

SEQ ID NO: 341795 - DNA, 16 bp, M. musculus
aactgtaatccccaaa

SEQ ID NO: 341796 - DNA, 16 bp, M. musculus
aactgtaatttgctac

SEQ ID NO: 341797 - DNA, 16 bp, M. musculus
aactgtaattttgctg

SEQ ID NO: 341798 - DNA, 16 bp, M. musculus
aactgtaattttgtta

SEQ ID NO: 341799 - DNA, 19 bp, M. musculus
aactgtagctgtcttcaga

SEQ ID NO: 341800 - DNA, 16 bp, M. musculus
aactgtatatgggatg

SEQ ID NO: 341801 - DNA, 16 bp, M. musculus
aactgtattaaatggt

SEQ ID NO: 341802 - DNA, 16 bp, M. musculus
aactgtcaaaaataaa

SEQ ID NO: 341803 - DNA, 16 bp, M. musculus
aactgtcaacttgaca

SEQ ID NO: 341804 - DNA, 16 bp, M. musculus
aactgtcacccatgct

SEQ ID NO: 341805 - DNA, 16 bp, M. musculus
aactgtctatagctcc

SEQ ID NO: 341806 - DNA, 16 bp, M. musculus
aactgtctcctgaaag

SEQ ID NO: 341807 - DNA, 16 bp, M. musculus
aactgtctctgtaaaa

SEQ ID NO: 341808 - DNA, 16 bp, M. musculus
aactgtctgcagctgg

SEQ ID NO: 341809 - DNA, 16 bp, M. musculus
aactgtctgtaacttc

SEQ ID NO: 341810 - DNA, 16 bp, M. musculus
aactgtctgtaattct

SEQ ID NO: 341811 - DNA, 16 bp, M. musculus
aactgtcttatgagag

SEQ ID NO: 341812 - DNA, 16 bp, M. musculus
aactgtgaaaaataaa

SEQ ID NO: 341813 - DNA, 16 bp, M. musculus
aactgtgagagaggct

SEQ ID NO: 341814 - DNA, 16 bp, M. musculus
aactgtgagccaaaac

SEQ ID NO: 341815 - DNA, 16 bp, M. musculus
aactgtgagccaaaat

SEQ ID NO: 341816 - DNA, 16 bp, M. musculus
aactgtgagccaaagt

SEQ ID NO: 341817 - DNA, 16 bp, M. musculus
aactgtgagccccaaa

SEQ ID NO: 341818 - DNA, 16 bp, M. musculus
aactgtgagctaaaat

SEQ ID NO: 341819 - DNA, 16 bp, M. musculus
aactgtgagggtggag

SEQ ID NO: 341820 - DNA, 16 bp, M. musculus
aactgtgatggtttgt

SEQ ID NO: 341821 - DNA, 16 bp, M. musculus
aactgtgggaaggagc

SEQ ID NO: 341822 - DNA, 16 bp, M. musculus
aactgtgggttttttt

SEQ ID NO: 341823 - DNA, 16 bp, M. musculus
aactgtggttgggatg

SEQ ID NO: 341824 - DNA, 16 bp, M. musculus
aactgtgtcttgaaaa

SEQ ID NO: 341825 - DNA, 16 bp, M. musculus
aactgtgtgtgtatgt

SEQ ID NO: 341826 - DNA, 16 bp, M. musculus
aactgttaatattcaa

SEQ ID NO: 341827 - DNA, 16 bp, M. musculus
aactgttggaaattct

SEQ ID NO: 341828 - DNA, 16 bp, M. musculus
aactgttgtgtcaatg

SEQ ID NO: 341829 - DNA, 16 bp, M. musculus
aactgtttacacaaac

SEQ ID NO: 341830 - DNA, 16 bp, M. musculus
aactgtttggaaagga

SEQ ID NO: 341831 - DNA, 16 bp, M. musculus
aactgtttgggaagga

SEQ ID NO: 341832 - DNA, 16 bp, M. musculus
aactgttttctgtttt

SEQ ID NO: 341833 - DNA, 16 bp, M. musculus
aactgttttgtttgtt

SEQ ID NO: 341834 - DNA, 16 bp, M. musculus
aacttaaaggaagaaa

SEQ ID NO: 341835 - DNA, 16 bp, M. musculus
aacttaaggaagaaaa

SEQ ID NO: 341836 - DNA, 16 bp, M. musculus
aacttaagttttaaaa

SEQ ID NO: 341837 - DNA, 16 bp, M. musculus
aacttacaaagagaaa

SEQ ID NO: 341838 - DNA, 16 bp, M. musculus
aacttacagagaccca

SEQ ID NO: 341839 - DNA, 16 bp, M. musculus
aacttacgggacacaa

SEQ ID NO: 341840 - DNA, 16 bp, M. musculus
aacttagaaaagactt

SEQ ID NO: 341841 - DNA, 18 bp, M. musculus
aacttagaaatccgcctg

SEQ ID NO: 341842 - DNA, 16 bp, M. musculus
aacttaggagaggaaa

SEQ ID NO: 341843 - DNA, 16 bp, M. musculus
aacttagtaacaatta

SEQ ID NO: 341844 - DNA, 16 bp, M. musculus
aacttagtctcctgga

SEQ ID NO: 341845 - DNA, 16 bp, M. musculus
aacttatagaataaat

SEQ ID NO: 341846 - DNA, 16 bp, M. musculus
aacttatagagatcca

SEQ ID NO: 341847 - DNA, 16 bp, M. musculus
aacttatctcaaaaaa

SEQ ID NO: 341848 - DNA, 16 bp, M. musculus
aacttatggaagaaag

SEQ ID NO: 341849 - DNA, 16 bp, M. musculus
aacttattttggcaaa

SEQ ID NO: 341850 - DNA, 16 bp, M. musculus
aacttcaaagacacag

SEQ ID NO: 341851 - DNA, 16 bp, M. musculus
aacttcaaagtttctg

SEQ ID NO: 341852 - DNA, 16 bp, M. musculus
aacttcaacattacag

SEQ ID NO: 341853 - DNA, 16 bp, M. musculus
aacttcacataaaact

SEQ ID NO: 341854 - DNA, 17 bp, M. musculus
aacttcagcttaggaat

SEQ ID NO: 341855 - DNA, 16 bp, M. musculus
aacttcagttccaagg

SEQ ID NO: 341856 - DNA, 16 bp, M. musculus
aacttcatatgaaaac

SEQ ID NO: 341857 - DNA, 16 bp, M. musculus
aacttcatgagttctt

SEQ ID NO: 341858 - DNA, 16 bp, M. musculus
aacttcatgttctctt

SEQ ID NO: 341859 - DNA, 16 bp, M. musculus
aacttcattaaaacag

SEQ ID NO: 341860 - DNA, 16 bp, M. musculus
aacttccccaaagctc

SEQ ID NO: 341861 - DNA, 16 bp, M. musculus
aacttccctaacctga

SEQ ID NO: 341862 - DNA, 16 bp, M. musculus
aacttcctaaacagaa

SEQ ID NO: 341863 - DNA, 16 bp, M. musculus
aacttcctttgtcagt

SEQ ID NO: 341864 - DNA, 16 bp, M. musculus
aacttctaaaactgta

SEQ ID NO: 341865 - DNA, 16 bp, M. musculus
aacttctacctgttta

SEQ ID NO: 341866 - DNA, 16 bp, M. musculus
aacttctcagaaagat

SEQ ID NO: 341867 - DNA, 16 bp, M. musculus
aacttctcagaggaca

SEQ ID NO: 341868 - DNA, 16 bp, M. musculus
aacttctcagagttct

SEQ ID NO: 341869 - DNA, 16 bp, M. musculus
aacttctccagctgat

SEQ ID NO: 341870 - DNA, 16 bp, M. musculus
aacttctgaccctctt

SEQ ID NO: 341871 - DNA, 16 bp, M. musculus
aacttctgactctcct

SEQ ID NO: 341872 - DNA, 16 bp, M. musculus
aacttctgatcctcct

SEQ ID NO: 341873 - DNA, 16 bp, M. musculus
aacttctgatcttcct

SEQ ID NO: 341874 - DNA, 16 bp, M. musculus
aacttctggaggtatc

SEQ ID NO: 341875 - DNA, 16 bp, M. musculus
aacttctggatattat

SEQ ID NO: 341876 - DNA, 16 bp, M. musculus
aacttctgggtctgtg

SEQ ID NO: 341877 - DNA, 16 bp, M. musculus
aacttctggtgatgtt

SEQ ID NO: 341878 - DNA, 16 bp, M. musculus
aacttctggtgttcct

SEQ ID NO: 341879 - DNA, 16 bp, M. musculus
aacttcttccagcctt

SEQ ID NO: 341880 - DNA, 16 bp, M. musculus
aacttctttatgaagg

SEQ ID NO: 341881 - DNA, 16 bp, M. musculus
aacttcttttattgtt

SEQ ID NO: 341882 - DNA, 16 bp, M. musculus
aacttctttttaaaaa

SEQ ID NO: 341883 - DNA, 16 bp, M. musculus
aacttgaaatcaggga

SEQ ID NO: 341884 - DNA, 16 bp, M. musculus
aacttgaagcagaaac

SEQ ID NO: 341885 - DNA, 16 bp, M. musculus
aacttgacacaggcta

SEQ ID NO: 341886 - DNA, 16 bp, M. musculus
aacttgacccaggctg

SEQ ID NO: 341887 - DNA, 16 bp, M. musculus
aacttgagatcttcct

SEQ ID NO: 341888 - DNA, 16 bp, M. musculus
aacttgaggaaatcca

SEQ ID NO: 341889 - DNA, 16 bp, M. musculus
aacttgaggcaatcct

SEQ ID NO: 341890 - DNA, 16 bp, M. musculus
aacttgatatgtagcc

SEQ ID NO: 341891 - DNA, 16 bp, M. musculus
aacttgatgaaatatt

SEQ ID NO: 341892 - DNA, 16 bp, M. musculus
aacttgattttaaaaa

SEQ ID NO: 341893 - DNA, 16 bp, M. musculus
aacttgcacaatatgt

SEQ ID NO: 341894 - DNA, 16 bp, M. musculus
aacttgccaaagaact

SEQ ID NO: 341895 - DNA, 17 bp, M. musculus
aacttgctatgtagacc

SEQ ID NO: 341896 - DNA, 16 bp, M. musculus
aacttgctgtgtaaac

SEQ ID NO: 341897 - DNA, 16 bp, M. musculus
aacttggaaaatggaa

SEQ ID NO: 341898 - DNA, 16 bp, M. musculus
aacttggaatcctcct

SEQ ID NO: 341899 - DNA, 16 bp, M. musculus
aacttggagagaaaag

SEQ ID NO: 341900 - DNA, 16 bp, M. musculus
aacttggaggcaggaa

SEQ ID NO: 341901 - DNA, 16 bp, M. musculus
aacttggctggcctct

SEQ ID NO: 341902 - DNA, 16 bp, M. musculus
aacttgggatccattt

SEQ ID NO: 341903 - DNA, 16 bp, M. musculus
aacttgggattcatcc

SEQ ID NO: 341904 - DNA, 16 bp, M. musculus
aacttgggccctctgc

SEQ ID NO: 341905 - DNA, 16 bp, M. musculus
aacttggggaagaaaa

SEQ ID NO: 341906 - DNA, 16 bp, M. musculus
aacttggtcagggaaa

SEQ ID NO: 341907 - DNA, 16 bp, M. musculus
aacttggttcttggtc

SEQ ID NO: 341908 - DNA, 16 bp, M. musculus
aacttgtagagcccac

SEQ ID NO: 341909 - DNA, 16 bp, M. musculus
aacttgtagagtccat

SEQ ID NO: 341910 - DNA, 16 bp, M. musculus
aacttgtgatctttct

SEQ ID NO: 341911 - DNA, 16 bp, M. musculus
aacttgtttaaaaaaa

SEQ ID NO: 341912 - DNA, 16 bp, M. musculus
aactttaaaaaaaatg

SEQ ID NO: 341913 - DNA, 16 bp, M. musculus
aactttaaaaatgaaa

SEQ ID NO: 341914 - DNA, 16 bp, M. musculus
aactttaaaagaaaat

SEQ ID NO: 341915 - DNA, 16 bp, M. musculus
aactttaaattttcta

SEQ ID NO: 341916 - DNA, 16 bp, M. musculus
aactttaagaacaaaa

SEQ ID NO: 341917 - DNA, 16 bp, M. musculus
aactttataaagaaaa

SEQ ID NO: 341918 - DNA, 16 bp, M. musculus
aactttatctgcccca

SEQ ID NO: 341919 - DNA, 16 bp, M. musculus
aactttattttaaaga

SEQ ID NO: 341920 - DNA, 16 bp, M. musculus
aactttattttgaaca

SEQ ID NO: 341921 - DNA, 16 bp, M. musculus
aactttcagctcctct

SEQ ID NO: 341922 - DNA, 16 bp, M. musculus
aactttcagctcttcc

SEQ ID NO: 341923 - DNA, 16 bp, M. musculus
aactttccaaagaaac

SEQ ID NO: 341924 - DNA, 16 bp, M. musculus
aactttccaaatctaa

SEQ ID NO: 341925 - DNA, 16 bp, M. musculus
aactttctaaaatata

SEQ ID NO: 341926 - DNA, 17 bp, M. musculus
aactttcttgtaacttt

SEQ ID NO: 341927 - DNA, 16 bp, M. musculus
aactttgaggtgaaga

SEQ ID NO: 341928 - DNA, 16 bp, M. musculus
aactttgatgagtatg

SEQ ID NO: 341929 - DNA, 16 bp, M. musculus
aactttggacttctaa

SEQ ID NO: 341930 - DNA, 16 bp, M. musculus
aactttggttcctggt

SEQ ID NO: 341931 - DNA, 16 bp, M. musculus
aactttgtctcgaaaa

SEQ ID NO: 341932 - DNA, 16 bp, M. musculus
aactttgttttaaaat

SEQ ID NO: 341933 - DNA, 16 bp, M. musculus
aacttttaaaaaaagt

SEQ ID NO: 341934 - DNA, 16 bp, M. musculus
aacttttaaaaatgat

SEQ ID NO: 341935 - DNA, 16 bp, M. musculus
aacttttaaacatttt

SEQ ID NO: 341936 - DNA, 16 bp, M. musculus
aacttttataaaggca

SEQ ID NO: 341937 - DNA, 16 bp, M. musculus
aacttttatttgtgtg

SEQ ID NO: 341938 - DNA, 45 bp, M. musculus
aacttttcctcgggttcaagacccttggaaaggcctgtatactta

SEQ ID NO: 341939 - DNA, 16 bp, M. musculus
aacttttctcaatgat

SEQ ID NO: 341940 - DNA, 16 bp, M. musculus
aacttttcttccttaa

SEQ ID NO: 341941 - DNA, 16 bp, M. musculus
aacttttgaaacaaag

SEQ ID NO: 341942 - DNA, 16 bp, M. musculus
aacttttggaaagcaa

SEQ ID NO: 341943 - DNA, 16 bp, M. musculus
aacttttgggaatcag

SEQ ID NO: 341944 - DNA, 16 bp, M. musculus
aacttttggttgaaaa

SEQ ID NO: 341945 - DNA, 16 bp, M. musculus
aactttttattggttc

SEQ ID NO: 341946 - DNA, 16 bp, M. musculus
aactttttccatgggt

SEQ ID NO: 341947 - DNA, 16 bp, M. musculus
aactttttgagttttt

SEQ ID NO: 341948 - DNA, 16 bp, M. musculus
aacttttttttaaaga

SEQ ID NO: 341949 - DNA, 16 bp, M. musculus
aagaaaaaaaatctgt

SEQ ID NO: 341950 - DNA, 16 bp, M. musculus
aagaaaaaaaattgct

SEQ ID NO: 341951 - DNA, 16 bp, M. musculus
aagaaaaaaatcatgg

SEQ ID NO: 341952 - DNA, 16 bp, M. musculus
aagaaaaaaatgttct

SEQ ID NO: 341953 - DNA, 16 bp, M. musculus
aagaaaaaaattttca

SEQ ID NO: 341954 - DNA, 16 bp, M. musculus
aagaaaaacctacaga

SEQ ID NO: 341955 - DNA, 16 bp, M. musculus
aagaaaaacttttttt

SEQ ID NO: 341956 - DNA, 16 bp, M. musculus
aagaaaaagaaacctg

SEQ ID NO: 341957 - DNA, 16 bp, M. musculus
aagaaaaagaaactct

SEQ ID NO: 341958 - DNA, 16 bp, M. musculus
aagaaaaagaaatctc

SEQ ID NO: 341959 - DNA, 16 bp, M. musculus
aagaaaaagaagcagt

SEQ ID NO: 341960 - DNA, 16 bp, M. musculus
aagaaaaagagactat

SEQ ID NO: 341961 - DNA, 16 bp, M. musculus
aagaaaaagaggccat

SEQ ID NO: 341962 - DNA, 17 bp, M. musculus
aagaaaaagctgcaaag

SEQ ID NO: 341963 - DNA, 16 bp, M. musculus
aagaaaaagtttattt

SEQ ID NO: 341964 - DNA, 16 bp, M. musculus
aagaaaaatatcttaa

SEQ ID NO: 341965 - DNA, 16 bp, M. musculus
aagaaaaatctgcaaa

SEQ ID NO: 341966 - DNA, 16 bp, M. musculus
aagaaaaatgaagacc

SEQ ID NO: 341967 - DNA, 16 bp, M. musculus
aagaaaaatgaagact

SEQ ID NO: 341968 - DNA, 16 bp, M. musculus
aagaaaaatgactcct

SEQ ID NO: 341969 - DNA, 16 bp, M. musculus
aagaaaaatgttattt

SEQ ID NO: 341970 - DNA, 16 bp, M. musculus
aagaaaaatgtttatt

SEQ ID NO: 341971 - DNA, 16 bp, M. musculus
aagaaaaatgtttcct

SEQ ID NO: 341972 - DNA, 16 bp, M. musculus
aagaaaacaaaaccct

SEQ ID NO: 341973 - DNA, 16 bp, M. musculus
aagaaaacaaaagcct

SEQ ID NO: 341974 - DNA, 16 bp, M. musculus
aagaaaacaaagtatt

SEQ ID NO: 341975 - DNA, 16 bp, M. musculus
aagaaaacaagctgaa

SEQ ID NO: 341976 - DNA, 16 bp, M. musculus
aagaaaacaaggaagt

SEQ ID NO: 341977 - DNA, 16 bp, M. musculus
aagaaaacacatggtc

SEQ ID NO: 341978 - DNA, 16 bp, M. musculus
aagaaaacacattgtg

SEQ ID NO: 341979 - DNA, 16 bp, M. musculus
aagaaaacacttccca

SEQ ID NO: 341980 - DNA, 16 bp, M. musculus
aagaaaacagaaatgg

SEQ ID NO: 341981 - DNA, 16 bp, M. musculus
aagaaaacaggctgaa

SEQ ID NO: 341982 - DNA, 16 bp, M. musculus
aagaaaacagtgtctt

SEQ ID NO: 341983 - DNA, 16 bp, M. musculus
aagaaaacatgatttt

SEQ ID NO: 341984 - DNA, 16 bp, M. musculus
aagaaaacattaaagc

SEQ ID NO: 341985 - DNA, 16 bp, M. musculus
aagaaaacattgaatt

SEQ ID NO: 341986 - DNA, 16 bp, M. musculus
aagaaaacatttaact

SEQ ID NO: 341987 - DNA, 16 bp, M. musculus
aagaaaacatttcatt

SEQ ID NO: 341988 - DNA, 16 bp, M. musculus
aagaaaacatttgatt

SEQ ID NO: 341989 - DNA, 16 bp, M. musculus
aagaaaacattttact

SEQ ID NO: 341990 - DNA, 16 bp, M. musculus
aagaaaacatttttat

SEQ ID NO: 341991 - DNA, 16 bp, M. musculus
aagaaaacatttttta

SEQ ID NO: 341992 - DNA, 16 bp, M. musculus
aagaaaaccaaaactg

SEQ ID NO: 341993 - DNA, 16 bp, M. musculus
aagaaaaccaaagtgg

SEQ ID NO: 341994 - DNA, 16 bp, M. musculus
aagaaaaccaggagct

SEQ ID NO: 341995 - DNA, 16 bp, M. musculus
aagaaaacccaaagtg

SEQ ID NO: 341996 - DNA, 16 bp, M. musculus
aagaaaacctaaaggg

SEQ ID NO: 341997 - DNA, 16 bp, M. musculus
aagaaaacctacagaa

SEQ ID NO: 341998 - DNA, 16 bp, M. musculus
aagaaaactggaaaat

SEQ ID NO: 341999 - DNA, 16 bp, M. musculus
aagaaaacttcgcaaa

SEQ ID NO: 342000 - DNA, 16 bp, M. musculus
aagaaaacttctcttt

SEQ ID NO: 342001 - DNA, 16 bp, M. musculus
aagaaaacttctgtaa

SEQ ID NO: 342002 - DNA, 16 bp, M. musculus
aagaaaactttgaaaa

SEQ ID NO: 342003 - DNA, 16 bp, M. musculus
aagaaaactttttttt

SEQ ID NO: 342004 - DNA, 16 bp, M. musculus
aagaaaagaaaacttg

SEQ ID NO: 342005 - DNA, 16 bp, M. musculus
aagaaaagaaaaggtc

SEQ ID NO: 342006 - DNA, 16 bp, M. musculus
aagaaaagaaaatctg

SEQ ID NO: 342007 - DNA, 16 bp, M. musculus
aagaaaagaaaatggc

SEQ ID NO: 342008 - DNA, 16 bp, M. musculus
aagaaaagaaaattcc

SEQ ID NO: 342009 - DNA, 16 bp, M. musculus
aagaaaagaaacttag

SEQ ID NO: 342010 - DNA, 16 bp, M. musculus
aagaaaagaaacttct

SEQ ID NO: 342011 - DNA, 16 bp, M. musculus
aagaaaagaaagcatt

SEQ ID NO: 342012 - DNA, 16 bp, M. musculus
aagaaaagaaagttac

SEQ ID NO: 342013 - DNA, 16 bp, M. musculus
aagaaaagaaattcta

SEQ ID NO: 342014 - DNA, 16 bp, M. musculus
aagaaaagaaattctg

SEQ ID NO: 342015 - DNA, 16 bp, M. musculus
aagaaaagaagctgag

SEQ ID NO: 342016 - DNA, 16 bp, M. musculus
aagaaaagaatcaact

SEQ ID NO: 342017 - DNA, 16 bp, M. musculus
aagaaaagaatcacat

SEQ ID NO: 342018 - DNA, 16 bp, M. musculus
aagaaaagctttcttt

SEQ ID NO: 342019 - DNA, 16 bp, M. musculus
aagaaaaggaatttca

SEQ ID NO: 342020 - DNA, 16 bp, M. musculus
aagaaaaggctgccca

SEQ ID NO: 342021 - DNA, 16 bp, M. musculus
aagaaaaggtgtgtgt

SEQ ID NO: 342022 - DNA, 16 bp, M. musculus
aagaaaagtcttccaa

SEQ ID NO: 342023 - DNA, 16 bp, M. musculus
aagaaaagtgattttt

SEQ ID NO: 342024 - DNA, 16 bp, M. musculus
aagaaaagttaatgag

SEQ ID NO: 342025 - DNA, 16 bp, M. musculus
aagaaaagttttattt

SEQ ID NO: 342026 - DNA, 16 bp, M. musculus
aagaaaataaaacttt

SEQ ID NO: 342027 - DNA, 16 bp, M. musculus
aagaaaataacattta

SEQ ID NO: 342028 - DNA, 16 bp, M. musculus
aagaaaataatcacat

SEQ ID NO: 342029 - DNA, 16 bp, M. musculus
aagaaaataatctcag

SEQ ID NO: 342030 - DNA, 16 bp, M. musculus
aagaaaatacattctt

SEQ ID NO: 342031 - DNA, 17 bp, M. musculus
aagaaaatacctaattt

SEQ ID NO: 342032 - DNA, 17 bp, M. musculus
aagaaaatatctaataa

SEQ ID NO: 342033 - DNA, 16 bp, M. musculus
aagaaaatattctgaa

SEQ ID NO: 342034 - DNA, 16 bp, M. musculus
aagaaaatatttactt

SEQ ID NO: 342035 - DNA, 16 bp, M. musculus
aagaaaatattttagt

SEQ ID NO: 342036 - DNA, 16 bp, M. musculus
aagaaaatattttctt

SEQ ID NO: 342037 - DNA, 16 bp, M. musculus
aagaaaatcaagagga

SEQ ID NO: 342038 - DNA, 16 bp, M. musculus
aagaaaatcatgaaga

SEQ ID NO: 342039 - DNA, 16 bp, M. musculus
aagaaaatctcagaag

SEQ ID NO: 342040 - DNA, 16 bp, M. musculus
aagaaaatctgagtaa

SEQ ID NO: 342041 - DNA, 16 bp, M. musculus
aagaaaatgaagccag

SEQ ID NO: 342042 - DNA, 16 bp, M. musculus
aagaaaatgatatttt

SEQ ID NO: 342043 - DNA, 16 bp, M. musculus
aagaaaatgcaaagag

SEQ ID NO: 342044 - DNA, 16 bp, M. musculus
aagaaaatgctttctt

SEQ ID NO: 342045 - DNA, 16 bp, M. musculus
aagaaaatggagcaga

SEQ ID NO: 342046 - DNA, 16 bp, M. musculus
aagaaaatggcccaca

SEQ ID NO: 342047 - DNA, 16 bp, M. musculus
aagaaaatgtcccaca

SEQ ID NO: 342048 - DNA, 16 bp, M. musculus
aagaaaatgtcctaca

SEQ ID NO: 342049 - DNA, 16 bp, M. musculus
aagaaaatgtctcaaa

SEQ ID NO: 342050 - DNA, 16 bp, M. musculus
aagaaaatgtggcaca

SEQ ID NO: 342051 - DNA, 16 bp, M. musculus
aagaaaatgtgtgctt

SEQ ID NO: 342052 - DNA, 16 bp, M. musculus
aagaaaatgtgtgttt

SEQ ID NO: 342053 - DNA, 16 bp, M. musculus
aagaaaatgttatttt

SEQ ID NO: 342054 - DNA, 16 bp, M. musculus
aagaaaatgttcttaa

SEQ ID NO: 342055 - DNA, 16 bp, M. musculus
aagaaaatgtttattt

SEQ ID NO: 342056 - DNA, 16 bp, M. musculus
aagaaaatgtttgaaa

SEQ ID NO: 342057 - DNA, 16 bp, M. musculus
aagaaaattatccatt

SEQ ID NO: 342058 - DNA, 16 bp, M. musculus
aagaaaattcatttta

SEQ ID NO: 342059 - DNA, 16 bp, M. musculus
aagaaaattccctaca

SEQ ID NO: 342060 - DNA, 16 bp, M. musculus
aagaaaattgaaatca

SEQ ID NO: 342061 - DNA, 16 bp, M. musculus
aagaaaatttctcttt

SEQ ID NO: 342062 - DNA, 16 bp, M. musculus
aagaaaattttgtttt

SEQ ID NO: 342063 - DNA, 16 bp, M. musculus
aagaaacaaagctttt

SEQ ID NO: 342064 - DNA, 16 bp, M. musculus
aagaaacaagatgaag

SEQ ID NO: 342065 - DNA, 16 bp, M. musculus
aagaaacaagatggag

SEQ ID NO: 342066 - DNA, 16 bp, M. musculus
aagaaacaagctgaag

SEQ ID NO: 342067 - DNA, 16 bp, M. musculus
aagaaacaattaggga

SEQ ID NO: 342068 - DNA, 16 bp, M. musculus
aagaaacacaaaagtc

SEQ ID NO: 342069 - DNA, 16 bp, M. musculus
aagaaacacatgcaca

SEQ ID NO: 342070 - DNA, 16 bp, M. musculus
aagaaacacttttttt

SEQ ID NO: 342071 - DNA, 16 bp, M. musculus
aagaaacagaaaatct

SEQ ID NO: 342072 - DNA, 16 bp, M. musculus
aagaaacaggaagcca

SEQ ID NO: 342073 - DNA, 16 bp, M. musculus
aagaaacaggagtggg

SEQ ID NO: 342074 - DNA, 16 bp, M. musculus
aagaaacatcttcagg

SEQ ID NO: 342075 - DNA, 16 bp, M. musculus
aagaaacatttaattg

SEQ ID NO: 342076 - DNA, 16 bp, M. musculus
aagaaacatttataaa

SEQ ID NO: 342077 - DNA, 16 bp, M. musculus
aagaaacatttgaaaa

SEQ ID NO: 342078 - DNA, 16 bp, M. musculus
aagaaacatttttatt

SEQ ID NO: 342079 - DNA, 16 bp, M. musculus
aagaaacatttttttt

SEQ ID NO: 342080 - DNA, 16 bp, M. musculus
aagaaacccaggacaa

SEQ ID NO: 342081 - DNA, 16 bp, M. musculus
aagaaacccaggtcaa

SEQ ID NO: 342082 - DNA, 16 bp, M. musculus
aagaaaccctatcttg

SEQ ID NO: 342083 - DNA, 16 bp, M. musculus
aagaaaccctgtctta

SEQ ID NO: 342084 - DNA, 16 bp, M. musculus
aagaaactacagcaca

SEQ ID NO: 342085 - DNA, 16 bp, M. musculus
aagaaactagatatca

SEQ ID NO: 342086 - DNA, 16 bp, M. musculus
aagaaactaggaaaga

SEQ ID NO: 342087 - DNA, 16 bp, M. musculus
aagaaactgaagaaga

SEQ ID NO: 342088 - DNA, 16 bp, M. musculus
aagaaactgaagagaa

SEQ ID NO: 342089 - DNA, 16 bp, M. musculus
aagaaactgaaggaga

SEQ ID NO: 342090 - DNA, 16 bp, M. musculus
aagaaactgagcatct

SEQ ID NO: 342091 - DNA, 16 bp, M. musculus
aagaaactgaggaaga

SEQ ID NO: 342092 - DNA, 16 bp, M. musculus
aagaaactgaggagaa

SEQ ID NO: 342093 - DNA, 16 bp, M. musculus
aagaaactgaggagga

SEQ ID NO: 342094 - DNA, 16 bp, M. musculus
aagaaactgaggcaga

SEQ ID NO: 342095 - DNA, 16 bp, M. musculus
aagaaactgcagcata

SEQ ID NO: 342096 - DNA, 16 bp, M. musculus
aagaaactgcatgttt

SEQ ID NO: 342097 - DNA, 16 bp, M. musculus
aagaaactggaagaaa

SEQ ID NO: 342098 - DNA, 16 bp, M. musculus
aagaaacttctagaaa

SEQ ID NO: 342099 - DNA, 16 bp, M. musculus
aagaaactttaaaata

SEQ ID NO: 342100 - DNA, 16 bp, M. musculus
aagaaacttttgtaaa

SEQ ID NO: 342101 - DNA, 16 bp, M. musculus
aagaaagaaaaacttg

SEQ ID NO: 342102 - DNA, 16 bp, M. musculus
aagaaagaaaaccctg

SEQ ID NO: 342103 - DNA, 16 bp, M. musculus
aagaaagaaaactcag

SEQ ID NO: 342104 - DNA, 16 bp, M. musculus
aagaaagaaaactgag

SEQ ID NO: 342105 - DNA, 16 bp, M. musculus
aagaaagaaaagtctt

SEQ ID NO: 342106 - DNA, 16 bp, M. musculus
aagaaagaaaatctgt

SEQ ID NO: 342107 - DNA, 16 bp, M. musculus
aagaaagaaaattttc

SEQ ID NO: 342108 - DNA, 16 bp, M. musculus
aagaaagaaagagcat

SEQ ID NO: 342109 - DNA, 16 bp, M. musculus
aagaaagaaagatgtt

SEQ ID NO: 342110 - DNA, 16 bp, M. musculus
aagaaagaaaggacat

SEQ ID NO: 342111 - DNA, 16 bp, M. musculus
aagaaagaaagtaatc

SEQ ID NO: 342112 - DNA, 16 bp, M. musculus
aagaaagaaatcaatg

SEQ ID NO: 342113 - DNA, 16 bp, M. musculus
aagaaagaaatccttc

SEQ ID NO: 342114 - DNA, 16 bp, M. musculus
aagaaagaaatcttct

SEQ ID NO: 342115 - DNA, 16 bp, M. musculus
aagaaagaaatgacca

SEQ ID NO: 342116 - DNA, 16 bp, M. musculus
aagaaagaaatgccaa

SEQ ID NO: 342117 - DNA, 16 bp, M. musculus
aagaaagaaattcaga

SEQ ID NO: 342118 - DNA, 16 bp, M. musculus
aagaaagaagaaagct

SEQ ID NO: 342119 - DNA, 16 bp, M. musculus
aagaaagaagaatcca

SEQ ID NO: 342120 - DNA, 16 bp, M. musculus
aagaaagaatctcaga

SEQ ID NO: 342121 - DNA, 16 bp, M. musculus
aagaaagaattcaaag

SEQ ID NO: 342122 - DNA, 16 bp, M. musculus
aagaaagaattctaaa

SEQ ID NO: 342123 - DNA, 16 bp, M. musculus
aagaaagaatttattt

SEQ ID NO: 342124 - DNA, 16 bp, M. musculus
aagaaagaatttcaga

SEQ ID NO: 342125 - DNA, 16 bp, M. musculus
aagaaagacagccttt

SEQ ID NO: 342126 - DNA, 16 bp, M. musculus
aagaaagagaaacact

SEQ ID NO: 342127 - DNA, 16 bp, M. musculus
aagaaagagaacatca

SEQ ID NO: 342128 - DNA, 16 bp, M. musculus
aagaaagagaagcagt

SEQ ID NO: 342129 - DNA, 16 bp, M. musculus
aagaaagagaagccca

SEQ ID NO: 342130 - DNA, 16 bp, M. musculus
aagaaagagaattgca

SEQ ID NO: 342131 - DNA, 16 bp, M. musculus
aagaaagagatctgga

SEQ ID NO: 342132 - DNA, 16 bp, M. musculus
aagaaagagatgccaa

SEQ ID NO: 342133 - DNA, 17 bp, M. musculus
aagaaagagatggctat

SEQ ID NO: 342134 - DNA, 16 bp, M. musculus
aagaaagagctagaga

SEQ ID NO: 342135 - DNA, 16 bp, M. musculus
aagaaagaggacttca

SEQ ID NO: 342136 - DNA, 16 bp, M. musculus
aagaaagagttcattt

SEQ ID NO: 342137 - DNA, 16 bp, M. musculus
aagaaagagtttattt

SEQ ID NO: 342138 - DNA, 16 bp, M. musculus
aagaaagatatcaaag

SEQ ID NO: 342139 - DNA, 16 bp, M. musculus
aagaaagatgattttt

SEQ ID NO: 342140 - DNA, 16 bp, M. musculus
aagaaagattttaaga

SEQ ID NO: 342141 - DNA, 16 bp, M. musculus
aagaaagcaaactgaa

SEQ ID NO: 342142 - DNA, 16 bp, M. musculus
aagaaagcaatcataa

SEQ ID NO: 342143 - DNA, 16 bp, M. musculus
aagaaagcagctgagc

SEQ ID NO: 342144 - DNA, 16 bp, M. musculus
aagaaagcaggagctg

SEQ ID NO: 342145 - DNA, 16 bp, M. musculus
aagaaagcagtcacaa

SEQ ID NO: 342146 - DNA, 16 bp, M. musculus
aagaaagcatcatcaa

SEQ ID NO: 342147 - DNA, 16 bp, M. musculus
aagaaagcatttcatt

SEQ ID NO: 342148 - DNA, 16 bp, M. musculus
aagaaagccaagcaga

SEQ ID NO: 342149 - DNA, 16 bp, M. musculus
aagaaagcctatgaga

SEQ ID NO: 342150 - DNA, 16 bp, M. musculus
aagaaagcttttaaaa

SEQ ID NO: 342151 - DNA, 16 bp, M. musculus
aagaaaggaagccagg

SEQ ID NO: 342152 - DNA, 16 bp, M. musculus
aagaaaggacatattt

SEQ ID NO: 342153 - DNA, 16 bp, M. musculus
aagaaaggacccaagg

SEQ ID NO: 342154 - DNA, 16 bp, M. musculus
aagaaaggagaaaact

SEQ ID NO: 342155 - DNA, 16 bp, M. musculus
aagaaaggaggctgag

SEQ ID NO: 342156 - DNA, 16 bp, M. musculus
aagaaaggattgagac

SEQ ID NO: 342157 - DNA, 16 bp, M. musculus
aagaaaggatttattt

SEQ ID NO: 342158 - DNA, 16 bp, M. musculus
aagaaaggcagctgag

SEQ ID NO: 342159 - DNA, 16 bp, M. musculus
aagaaaggccacaagc

SEQ ID NO: 342160 - DNA, 16 bp, M. musculus
aagaaagggaaactag

SEQ ID NO: 342161 - DNA, 16 bp, M. musculus
aagaaagggcaaagta

SEQ ID NO: 342162 - DNA, 16 bp, M. musculus
aagaaagtaacctttc

SEQ ID NO: 342163 - DNA, 16 bp, M. musculus
aagaaagtaattgaag

SEQ ID NO: 342164 - DNA, 16 bp, M. musculus
aagaaagtacagaata

SEQ ID NO: 342165 - DNA, 16 bp, M. musculus
aagaaagtatttattt

SEQ ID NO: 342166 - DNA, 16 bp, M. musculus
aagaaagtcaccctgg

SEQ ID NO: 342167 - DNA, 16 bp, M. musculus
aagaaagtgaagattc

SEQ ID NO: 342168 - DNA, 16 bp, M. musculus
aagaaagtgatccttc

SEQ ID NO: 342169 - DNA, 16 bp, M. musculus
aagaaagttggtgggc

SEQ ID NO: 342170 - DNA, 16 bp, M. musculus
aagaaagtttgaagaa

SEQ ID NO: 342171 - DNA, 16 bp, M. musculus
aagaaataaagttttt

SEQ ID NO: 342172 - DNA, 16 bp, M. musculus
aagaaataaataatcc

SEQ ID NO: 342173 - DNA, 16 bp, M. musculus
aagaaataatgttttt

SEQ ID NO: 342174 - DNA, 16 bp, M. musculus
aagaaatacaaatggc

SEQ ID NO: 342175 - DNA, 16 bp, M. musculus
aagaaatacagagaca

SEQ ID NO: 342176 - DNA, 16 bp, M. musculus
aagaaatacaggaaga

SEQ ID NO: 342177 - DNA, 16 bp, M. musculus
aagaaatacaggataa

SEQ ID NO: 342178 - DNA, 16 bp, M. musculus
aagaaatacattttaa

SEQ ID NO: 342179 - DNA, 16 bp, M. musculus
aagaaatactgaacca

SEQ ID NO: 342180 - DNA, 16 bp, M. musculus
aagaaatatctcaaaa

SEQ ID NO: 342181 - DNA, 16 bp, M. musculus
aagaaatatggagaca

SEQ ID NO: 342182 - DNA, 16 bp, M. musculus
aagaaatattttcata

SEQ ID NO: 342183 - DNA, 16 bp, M. musculus
aagaaatcaaaatatc

SEQ ID NO: 342184 - DNA, 16 bp, M. musculus
aagaaatcaaaatttt

SEQ ID NO: 342185 - DNA, 16 bp, M. musculus
aagaaatcaaggaaga

SEQ ID NO: 342186 - DNA, 16 bp, M. musculus
aagaaatcacagaaga

SEQ ID NO: 342187 - DNA, 16 bp, M. musculus
aagaaatcaggaaaat

SEQ ID NO: 342188 - DNA, 16 bp, M. musculus
aagaaatcatttaatt

SEQ ID NO: 342189 - DNA, 16 bp, M. musculus
aagaaatcatttttaa

SEQ ID NO: 342190 - DNA, 16 bp, M. musculus
aagaaatccaagaaca

SEQ ID NO: 342191 - DNA, 16 bp, M. musculus
aagaaatccaagaaga

SEQ ID NO: 342192 - DNA, 16 bp, M. musculus
aagaaatccaggacaa

SEQ ID NO: 342193 - DNA, 16 bp, M. musculus
aagaaatccaggacac

SEQ ID NO: 342194 - DNA, 16 bp, M. musculus
aagaaatgaaagactt

SEQ ID NO: 342195 - DNA, 17 bp, M. musculus
aagaaatgaactttgct

SEQ ID NO: 342196 - DNA, 16 bp, M. musculus
aagaaatgaaggactt

SEQ ID NO: 342197 - DNA, 16 bp, M. musculus
aagaaatgaaggagct

SEQ ID NO: 342198 - DNA, 16 bp, M. musculus
aagaaatgaataaatc

SEQ ID NO: 342199 - DNA, 16 bp, M. musculus
aagaaatgacaaattt

SEQ ID NO: 342200 - DNA, 16 bp, M. musculus
aagaaatgacatgtac

SEQ ID NO: 342201 - DNA, 16 bp, M. musculus
aagaaatgatcaacat

SEQ ID NO: 342202 - DNA, 16 bp, M. musculus
aagaaatgcaaagaca

SEQ ID NO: 342203 - DNA, 16 bp, M. musculus
aagaaatgcaaggaca

SEQ ID NO: 342204 - DNA, 16 bp, M. musculus
aagaaatgcagtgaca

SEQ ID NO: 342205 - DNA, 16 bp, M. musculus
aagaaatggaaagaca

SEQ ID NO: 342206 - DNA, 16 bp, M. musculus
aagaaatggaagacag

SEQ ID NO: 342207 - DNA, 16 bp, M. musculus
aagaaatggaagatct

SEQ ID NO: 342208 - DNA, 16 bp, M. musculus
aagaaatggaagcaaa

SEQ ID NO: 342209 - DNA, 16 bp, M. musculus
aagaaatggacaagtt

SEQ ID NO: 342210 - DNA, 16 bp, M. musculus
aagaaatgggcacagg

SEQ ID NO: 342211 - DNA, 16 bp, M. musculus
aagaaatgtaaaacat

SEQ ID NO: 342212 - DNA, 19 bp, M. musculus
aagaaatgtagccaagaca

SEQ ID NO: 342213 - DNA, 16 bp, M. musculus
aagaaatgttcaacaa

SEQ ID NO: 342214 - DNA, 16 bp, M. musculus
aagaaatgtttatttt

SEQ ID NO: 342215 - DNA, 16 bp, M. musculus
aagaaattaaaacttt

SEQ ID NO: 342216 - DNA, 16 bp, M. musculus
aagaaattaaagatca

SEQ ID NO: 342217 - DNA, 16 bp, M. musculus
aagaaattaaagcaga

SEQ ID NO: 342218 - DNA, 16 bp, M. musculus
aagaaattaaagtctt

SEQ ID NO: 342219 - DNA, 16 bp, M. musculus
aagaaattacagaaga

SEQ ID NO: 342220 - DNA, 16 bp, M. musculus
aagaaattacagactt

SEQ ID NO: 342221 - DNA, 16 bp, M. musculus
aagaaattattgaaac

SEQ ID NO: 342222 - DNA, 16 bp, M. musculus
aagaaattcagagaaa

SEQ ID NO: 342223 - DNA, 16 bp, M. musculus
aagaaattcaggaaga

SEQ ID NO: 342224 - DNA, 16 bp, M. musculus
aagaaattcaggagaa

SEQ ID NO: 342225 - DNA, 16 bp, M. musculus
aagaaattgaaatttt

SEQ ID NO: 342226 - DNA, 16 bp, M. musculus
aagaaattgttttaaa

SEQ ID NO: 342227 - DNA, 16 bp, M. musculus
aagaaatttgccacag

SEQ ID NO: 342228 - DNA, 16 bp, M. musculus
aagaacaaacaggctg

SEQ ID NO: 342229 - DNA, 16 bp, M. musculus
aagaacaaaggcagct

SEQ ID NO: 342230 - DNA, 16 bp, M. musculus
aagaacaaggacatca

SEQ ID NO: 342231 - DNA, 16 bp, M. musculus
aagaacaagtgctctt

SEQ ID NO: 342232 - DNA, 16 bp, M. musculus
aagaacaagtgctttt

SEQ ID NO: 342233 - DNA, 17 bp, M. musculus
aagaacaataatatcaa

SEQ ID NO: 342234 - DNA, 16 bp, M. musculus
aagaacaatgacttca

SEQ ID NO: 342235 - DNA, 16 bp, M. musculus
aagaacaatggcagcc

SEQ ID NO: 342236 - DNA, 16 bp, M. musculus
aagaacaatgtcaact

SEQ ID NO: 342237 - DNA, 16 bp, M. musculus
aagaacaattatgggt

SEQ ID NO: 342238 - DNA, 16 bp, M. musculus
aagaacaatttttttt

SEQ ID NO: 342239 - DNA, 16 bp, M. musculus
aagaacacatcaaacc

SEQ ID NO: 342240 - DNA, 16 bp, M. musculus
aagaacacatcaaaga

SEQ ID NO: 342241 - DNA, 16 bp, M. musculus
aagaacacatcagaat

SEQ ID NO: 342242 - DNA, 35 bp, M. musculus
aagaacacatgctccactatgttcatagcagcctt

SEQ ID NO: 342243 - DNA, 16 bp, M. musculus
aagaacacatgttcca

SEQ ID NO: 342244 - DNA, 16 bp, M. musculus
aagaacaccagctgct

SEQ ID NO: 342245 - DNA, 20 bp, M. musculus
aagaacacgctcaggacaac

SEQ ID NO: 342246 - DNA, 16 bp, M. musculus
aagaacactgctgctc

SEQ ID NO: 342247 - DNA, 16 bp, M. musculus
aagaacacttgctgct

SEQ ID NO: 342248 - DNA, 16 bp, M. musculus
aagaacagaaactaca

SEQ ID NO: 342249 - DNA, 16 bp, M. musculus
aagaacagaagcagca

SEQ ID NO: 342250 - DNA, 16 bp, M. musculus
aagaacagaatgtcaa

SEQ ID NO: 342251 - DNA, 16 bp, M. musculus
aagaacagagaacctg

SEQ ID NO: 342252 - DNA, 16 bp, M. musculus
aagaacagagagaaat

SEQ ID NO: 342253 - DNA, 16 bp, M. musculus
aagaacagatggctct

SEQ ID NO: 342254 - DNA, 16 bp, M. musculus
aagaacagattcccaa

SEQ ID NO: 342255 - DNA, 16 bp, M. musculus
aagaacagcaaatgct

SEQ ID NO: 342256 - DNA, 16 bp, M. musculus
aagaacagcaagcact

SEQ ID NO: 342257 - DNA, 16 bp, M. musculus
aagaacagcaagctct

SEQ ID NO: 342258 - DNA, 16 bp, M. musculus
aagaacagcaagtgct

SEQ ID NO: 342259 - DNA, 16 bp, M. musculus
aagaacagcaagtgtt

SEQ ID NO: 342260 - DNA, 16 bp, M. musculus
aagaacagcaatggct

SEQ ID NO: 342261 - DNA, 16 bp, M. musculus
aagaacagcagcaaca

SEQ ID NO: 342262 - DNA, 16 bp, M. musculus
aagaacagcagcagca

SEQ ID NO: 342263 - DNA, 16 bp, M. musculus
aagaacagcagcatca

SEQ ID NO: 342264 - DNA, 16 bp, M. musculus
aagaacagcagctgta

SEQ ID NO: 342265 - DNA, 16 bp, M. musculus
aagaacagccagtgct

SEQ ID NO: 342266 - DNA, 16 bp, M. musculus
aagaacagccagttct

SEQ ID NO: 342267 - DNA, 16 bp, M. musculus
aagaacagcctgggga

SEQ ID NO: 342268 - DNA, 16 bp, M. musculus
aagaacagctggggaa

SEQ ID NO: 342269 - DNA, 16 bp, M. musculus
aagaacagtcacatcc

SEQ ID NO: 342270 - DNA, 16 bp, M. musculus
aagaacagtctgtgct

SEQ ID NO: 342271 - DNA, 16 bp, M. musculus
aagaacagtgctctta

SEQ ID NO: 342272 - DNA, 16 bp, M. musculus
aagaacatcaagctac

SEQ ID NO: 342273 - DNA, 16 bp, M. musculus
aagaacatcaatatca

SEQ ID NO: 342274 - DNA, 16 bp, M. musculus
aagaacatcagtgcct

SEQ ID NO: 342275 - DNA, 16 bp, M. musculus
aagaacatccagtgct

SEQ ID NO: 342276 - DNA, 16 bp, M. musculus
aagaacatcggcacaa

SEQ ID NO: 342277 - DNA, 16 bp, M. musculus
aagaacatggaagaag

SEQ ID NO: 342278 - DNA, 16 bp, M. musculus
aagaacatggcagcat

SEQ ID NO: 342279 - DNA, 16 bp, M. musculus
aagaacattttgaaca

SEQ ID NO: 342280 - DNA, 16 bp, M. musculus
aagaacattttttaaa

SEQ ID NO: 342281 - DNA, 16 bp, M. musculus
aagaaccaactcctag

SEQ ID NO: 342282 - DNA, 16 bp, M. musculus
aagaaccagagactgg

SEQ ID NO: 342283 - DNA, 16 bp, M. musculus
aagaaccagctcctag

SEQ ID NO: 342284 - DNA, 16 bp, M. musculus
aagaaccagctcctgt

SEQ ID NO: 342285 - DNA, 16 bp, M. musculus
aagaaccagctccttc

SEQ ID NO: 342286 - DNA, 16 bp, M. musculus
aagaaccataattaaa

SEQ ID NO: 342287 - DNA, 16 bp, M. musculus
aagaaccatcattaaa

SEQ ID NO: 342288 - DNA, 16 bp, M. musculus
aagaaccatccagaga

SEQ ID NO: 342289 - DNA, 16 bp, M. musculus
aagaacccaaggaact

SEQ ID NO: 342290 - DNA, 16 bp, M. musculus
aagaacccacaaagta

SEQ ID NO: 342291 - DNA, 16 bp, M. musculus
aagaacccagaagccc

SEQ ID NO: 342292 - DNA, 16 bp, M. musculus
aagaacccagatgacc

SEQ ID NO: 342293 - DNA, 16 bp, M. musculus
aagaaccctaaataaa

SEQ ID NO: 342294 - DNA, 16 bp, M. musculus
aagaacctaaggagct

SEQ ID NO: 342295 - DNA, 16 bp, M. musculus
aagaacctatctcaaa

SEQ ID NO: 342296 - DNA, 16 bp, M. musculus
aagaacctgctcctgg

SEQ ID NO: 342297 - DNA, 16 bp, M. musculus
aagaacctggacagat

SEQ ID NO: 342298 - DNA, 16 bp, M. musculus
aagaacctggagagag

SEQ ID NO: 342299 - DNA, 16 bp, M. musculus
aagaacctggaggcaa

SEQ ID NO: 342300 - DNA, 16 bp, M. musculus
aagaacctgtctcaaa

SEQ ID NO: 342301 - DNA, 16 bp, M. musculus
aagaacgaagatgaaa

SEQ ID NO: 342302 - DNA, 16 bp, M. musculus
aagaactaaagaagtt

SEQ ID NO: 342303 - DNA, 16 bp, M. musculus
aagaactacagacaac

SEQ ID NO: 342304 - DNA, 16 bp, M. musculus
aagaactacaggcaat

SEQ ID NO: 342305 - DNA, 16 bp, M. musculus
aagaactattgaaaga

SEQ ID NO: 342306 - DNA, 17 bp, M. musculus
aagaactattgaaagaa

SEQ ID NO: 342307 - DNA, 16 bp, M. musculus
aagaactcaaatgaaa

SEQ ID NO: 342308 - DNA, 16 bp, M. musculus
aagaactcacaaaata

SEQ ID NO: 342309 - DNA, 16 bp, M. musculus
aagaactcacatgtta

SEQ ID NO: 342310 - DNA, 16 bp, M. musculus
aagaactccacaggaa

SEQ ID NO: 342311 - DNA, 16 bp, M. musculus
aagaactctgcactaa

SEQ ID NO: 342312 - DNA, 16 bp, M. musculus
aagaactctggtgagt

SEQ ID NO: 342313 - DNA, 16 bp, M. musculus
aagaactcttaaaaat

SEQ ID NO: 342314 - DNA, 16 bp, M. musculus
aagaactcttcaaaga

SEQ ID NO: 342315 - DNA, 16 bp, M. musculus
aagaactgaagaagct

SEQ ID NO: 342316 - DNA, 16 bp, M. musculus
aagaactgaagcaccc

SEQ ID NO: 342317 - DNA, 16 bp, M. musculus
aagaactgaaggagct

SEQ ID NO: 342318 - DNA, 16 bp, M. musculus
aagaactgaggcagag

SEQ ID NO: 342319 - DNA, 16 bp, M. musculus
aagaactgcaggaatg

SEQ ID NO: 342320 - DNA, 16 bp, M. musculus
aagaactgttttaaaa

SEQ ID NO: 342321 - DNA, 16 bp, M. musculus
aagaacttaggacaaa

SEQ ID NO: 342322 - DNA, 16 bp, M. musculus
aagaacttcaggagga

SEQ ID NO: 342323 - DNA, 17 bp, M. musculus
aagaacttcaggtctct

SEQ ID NO: 342324 - DNA, 16 bp, M. musculus
aagaacttctgaagga

SEQ ID NO: 342325 - DNA, 16 bp, M. musculus
aagaacttctggaaga

SEQ ID NO: 342326 - DNA, 16 bp, M. musculus
aagaacttctggaggt

SEQ ID NO: 342327 - DNA, 16 bp, M. musculus
aagaacttctggtgtt

SEQ ID NO: 342328 - DNA, 16 bp, M. musculus
aagaactttctagaaa

SEQ ID NO: 342329 - DNA, 16 bp, M. musculus
aagaactttctggaaa

SEQ ID NO: 342330 - DNA, 16 bp, M. musculus
aagaagaaaaagagct

SEQ ID NO: 342331 - DNA, 16 bp, M. musculus
aagaagaaaaatgtca

SEQ ID NO: 342332 - DNA, 16 bp, M. musculus
aagaagaaaacatttt

SEQ ID NO: 342333 - DNA, 16 bp, M. musculus
aagaagaaaagcaact

SEQ ID NO: 342334 - DNA, 16 bp, M. musculus
aagaagaaaatacacc

SEQ ID NO: 342335 - DNA, 16 bp, M. musculus
aagaagaaaatcatta

SEQ ID NO: 342336 - DNA, 17 bp, M. musculus
aagaagaaacaggactg

SEQ ID NO: 342337 - DNA, 16 bp, M. musculus
aagaagaaagaagatc

SEQ ID NO: 342338 - DNA, 16 bp, M. musculus
aagaagaaagatttat

SEQ ID NO: 342339 - DNA, 16 bp, M. musculus
aagaagaaagccaagc

SEQ ID NO: 342340 - DNA, 16 bp, M. musculus
aagaagaaaggattta

SEQ ID NO: 342341 - DNA, 16 bp, M. musculus
aagaagaaagtatttt

SEQ ID NO: 342342 - DNA, 16 bp, M. musculus
aagaagaaagttaaca

SEQ ID NO: 342343 - DNA, 16 bp, M. musculus
aagaagaaagttttaa

SEQ ID NO: 342344 - DNA, 16 bp, M. musculus
aagaagaaatattcaa

SEQ ID NO: 342345 - DNA, 16 bp, M. musculus
aagaagaaatggccag

SEQ ID NO: 342346 - DNA, 28 bp, M. musculus
aagaagaaatggccagatgtacgattat

SEQ ID NO: 342347 - DNA, 16 bp, M. musculus
aagaagaactcagaag

SEQ ID NO: 342348 - DNA, 16 bp, M. musculus
aagaagaactgaagca

SEQ ID NO: 342349 - DNA, 16 bp, M. musculus
aagaagaactgaagta

SEQ ID NO: 342350 - DNA, 16 bp, M. musculus
aagaagaagaagctgc

SEQ ID NO: 342351 - DNA, 16 bp, M. musculus
aagaagaagaagtcgt

SEQ ID NO: 342352 - DNA, 16 bp, M. musculus
aagaagaagaagtggt

SEQ ID NO: 342353 - DNA, 16 bp, M. musculus
aagaagaagctgcaga

SEQ ID NO: 342354 - DNA, 16 bp, M. musculus
aagaagaaggaagccc

SEQ ID NO: 342355 - DNA, 16 bp, M. musculus
aagaagaaggaggacc

SEQ ID NO: 342356 - DNA, 16 bp, M. musculus
aagaagaaggtagacc

SEQ ID NO: 342357 - DNA, 16 bp, M. musculus
aagaagaatgaagacc

SEQ ID NO: 342358 - DNA, 16 bp, M. musculus
aagaagaatgaagact

SEQ ID NO: 342359 - DNA, 16 bp, M. musculus
aagaagaatgatttta

SEQ ID NO: 342360 - DNA, 16 bp, M. musculus
aagaagaatgggatga

SEQ ID NO: 342361 - DNA, 16 bp, M. musculus
aagaagaatgttgttt

SEQ ID NO: 342362 - DNA, 16 bp, M. musculus
aagaagacacagtaaa

SEQ ID NO: 342363 - DNA, 16 bp, M. musculus
aagaagacagaaatac

SEQ ID NO: 342364 - DNA, 16 bp, M. musculus
aagaagacagcatctt

SEQ ID NO: 342365 - DNA, 16 bp, M. musculus
aagaagacagcatttt

SEQ ID NO: 342366 - DNA, 16 bp, M. musculus
aagaagacagctgcaa

SEQ ID NO: 342367 - DNA, 16 bp, M. musculus
aagaagacatcagaag

SEQ ID NO: 342368 - DNA, 16 bp, M. musculus
aagaagaccaacagag

SEQ ID NO: 342369 - DNA, 16 bp, M. musculus
aagaagacctcagaag

SEQ ID NO: 342370 - DNA, 16 bp, M. musculus
aagaagagaaaaatct

SEQ ID NO: 342371 - DNA, 16 bp, M. musculus
aagaagagagaatctt

SEQ ID NO: 342372 - DNA, 16 bp, M. musculus
aagaagagatcatgaa

SEQ ID NO: 342373 - DNA, 16 bp, M. musculus
aagaagagcaagtgct

SEQ ID NO: 342374 - DNA, 16 bp, M. musculus
aagaagagcctggaca

SEQ ID NO: 342375 - DNA, 16 bp, M. musculus
aagaagaggcaggtgg

SEQ ID NO: 342376 - DNA, 36 bp, M. musculus
aagaagaggcggccaccacctccgaggtttcccccc

SEQ ID NO: 342377 - DNA, 16 bp, M. musculus
aagaagataaccacat

SEQ ID NO: 342378 - DNA, 16 bp, M. musculus
aagaagatagagtttt

SEQ ID NO: 342379 - DNA, 16 bp, M. musculus
aagaagatctcaaaaa

SEQ ID NO: 342380 - DNA, 16 bp, M. musculus
aagaagatctgtccag

SEQ ID NO: 342381 - DNA, 16 bp, M. musculus
aagaagatgcaaaatg

SEQ ID NO: 342382 - DNA, 16 bp, M. musculus
aagaagatgcaagaga

SEQ ID NO: 342383 - DNA, 16 bp, M. musculus
aagaagattaatttct

SEQ ID NO: 342384 - DNA, 16 bp, M. musculus
aagaagcaaatagacc

SEQ ID NO: 342385 - DNA, 16 bp, M. musculus
aagaagcaacttaaag

SEQ ID NO: 342386 - DNA, 16 bp, M. musculus
aagaagcaagaaaatt

SEQ ID NO: 342387 - DNA, 16 bp, M. musculus
aagaagcaatgaagag

SEQ ID NO: 342388 - DNA, 16 bp, M. musculus
aagaagcacccatgtt

SEQ ID NO: 342389 - DNA, 16 bp, M. musculus
aagaagcagaaaccag

SEQ ID NO: 342390 - DNA, 16 bp, M. musculus
aagaagcagagagcag

SEQ ID NO: 342391 - DNA, 16 bp, M. musculus
aagaagcagcagcagc

SEQ ID NO: 342392 - DNA, 16 bp, M. musculus
aagaagcagcttctct

SEQ ID NO: 342393 - DNA, 16 bp, M. musculus
aagaagcaggcatctg

SEQ ID NO: 342394 - DNA, 16 bp, M. musculus
aagaagcaggttggga

SEQ ID NO: 342395 - DNA, 16 bp, M. musculus
aagaagcattgcaaag

SEQ ID NO: 342396 - DNA, 16 bp, M. musculus
aagaagccaaaaacat

SEQ ID NO: 342397 - DNA, 16 bp, M. musculus
aagaagccaaaaatat

SEQ ID NO: 342398 - DNA, 16 bp, M. musculus
aagaagccaaaaatgt

SEQ ID NO: 342399 - DNA, 16 bp, M. musculus
aagaagccaaaacaat

SEQ ID NO: 342400 - DNA, 16 bp, M. musculus
aagaagccaaaagcat

SEQ ID NO: 342401 - DNA, 16 bp, M. musculus
aagaagccagattgaa

SEQ ID NO: 342402 - DNA, 16 bp, M. musculus
aagaagccagtgctct

SEQ ID NO: 342403 - DNA, 16 bp, M. musculus
aagaagcctataaaac

SEQ ID NO: 342404 - DNA, 16 bp, M. musculus
aagaagcgggagtggg

SEQ ID NO: 342405 - DNA, 16 bp, M. musculus
aagaagcgggccacca

SEQ ID NO: 342406 - DNA, 16 bp, M. musculus
aagaagctaaagaaga

SEQ ID NO: 342407 - DNA, 16 bp, M. musculus
aagaagctaaggagaa

SEQ ID NO: 342408 - DNA, 16 bp, M. musculus
aagaagctaatgccct

SEQ ID NO: 342409 - DNA, 16 bp, M. musculus
aagaagctctgtttct

SEQ ID NO: 342410 - DNA, 16 bp, M. musculus
aagaagctgaaagaat

SEQ ID NO: 342411 - DNA, 16 bp, M. musculus
aagaagctgaaagagt

SEQ ID NO: 342412 - DNA, 16 bp, M. musculus
aagaagctgaagagaa

SEQ ID NO: 342413 - DNA, 16 bp, M. musculus
aagaagctgaaggaga

SEQ ID NO: 342414 - DNA, 16 bp, M. musculus
aagaagctgaaggtgt

SEQ ID NO: 342415 - DNA, 17 bp, M. musculus
aagaagctgagaagaag

SEQ ID NO: 342416 - DNA, 16 bp, M. musculus
aagaagctgaggaaaa

SEQ ID NO: 342417 - DNA, 16 bp, M. musculus
aagaagctgaggaaga

SEQ ID NO: 342418 - DNA, 16 bp, M. musculus
aagaagctgaggagga

SEQ ID NO: 342419 - DNA, 16 bp, M. musculus
aagaagctgaggaggt

SEQ ID NO: 342420 - DNA, 16 bp, M. musculus
aagaagctgcagagag

SEQ ID NO: 342421 - DNA, 16 bp, M. musculus
aagaagctggaccaca

SEQ ID NO: 342422 - DNA, 16 bp, M. musculus
aagaagctggacttca

SEQ ID NO: 342423 - DNA, 16 bp, M. musculus
aagaagctggagtagc

SEQ ID NO: 342424 - DNA, 16 bp, M. musculus
aagaagctggggagga

SEQ ID NO: 342425 - DNA, 19 bp, M. musculus
aagaagctgtaacattgaa

SEQ ID NO: 342426 - DNA, 16 bp, M. musculus
aagaagcttaaagaac

SEQ ID NO: 342427 - DNA, 16 bp, M. musculus
aagaaggaaaacattt

SEQ ID NO: 342428 - DNA, 16 bp, M. musculus
aagaaggaaaatatca

SEQ ID NO: 342429 - DNA, 16 bp, M. musculus
aagaaggaaactgaag

SEQ ID NO: 342430 - DNA, 16 bp, M. musculus
aagaaggaagattcac

SEQ ID NO: 342431 - DNA, 16 bp, M. musculus
aagaaggaagattcat

SEQ ID NO: 342432 - DNA, 16 bp, M. musculus
aagaaggaagttgggg

SEQ ID NO: 342433 - DNA, 16 bp, M. musculus
aagaaggacataaata

SEQ ID NO: 342434 - DNA, 16 bp, M. musculus
aagaaggaccaaaata

SEQ ID NO: 342435 - DNA, 16 bp, M. musculus
aagaaggagatgccca

SEQ ID NO: 342436 - DNA, 16 bp, M. musculus
aagaaggatcgaaata

SEQ ID NO: 342437 - DNA, 16 bp, M. musculus
aagaaggccacaccca

SEQ ID NO: 342438 - DNA, 16 bp, M. musculus
aagaaggctcagaaac

SEQ ID NO: 342439 - DNA, 16 bp, M. musculus
aagaaggctcagtggt

SEQ ID NO: 342440 - DNA, 16 bp, M. musculus
aagaaggctggtcaca

SEQ ID NO: 342441 - DNA, 16 bp, M. musculus
aagaagggcttaaaaa

SEQ ID NO: 342442 - DNA, 16 bp, M. musculus
aagaaggtccagctac

SEQ ID NO: 342443 - DNA, 16 bp, M. musculus
aagaaggtctcagaag

SEQ ID NO: 342444 - DNA, 16 bp, M. musculus
aagaaggtgtcagatt

SEQ ID NO: 342445 - DNA, 16 bp, M. musculus
aagaaggtgttggatc

SEQ ID NO: 342446 - DNA, 16 bp, M. musculus
aagaagtacatcactg

SEQ ID NO: 342447 - DNA, 17 bp, M. musculus
aagaagtaggcaacttc

SEQ ID NO: 342448 - DNA, 16 bp, M. musculus
aagaagtatccacact

SEQ ID NO: 342449 - DNA, 16 bp, M. musculus
aagaagtcaagaagtt

SEQ ID NO: 342450 - DNA, 16 bp, M. musculus
aagaagtcatcagatc

SEQ ID NO: 342451 - DNA, 16 bp, M. musculus
aagaagtgcctgctga

SEQ ID NO: 342452 - DNA, 16 bp, M. musculus
aagaagtgcttgctga

SEQ ID NO: 342453 - DNA, 16 bp, M. musculus
aagaagtgcttggtga

SEQ ID NO: 342454 - DNA, 16 bp, M. musculus
aagaagtgtgtgtgtg

SEQ ID NO: 342455 - DNA, 16 bp, M. musculus
aagaagttacaccctg

SEQ ID NO: 342456 - DNA, 16 bp, M. musculus
aagaagttaggctcca

SEQ ID NO: 342457 - DNA, 16 bp, M. musculus
aagaagttgaggagaa

SEQ ID NO: 342458 - DNA, 16 bp, M. musculus
aagaagttggactcca

SEQ ID NO: 342459 - DNA, 16 bp, M. musculus
aagaagttgtctcctg

SEQ ID NO: 342460 - DNA, 16 bp, M. musculus
aagaagttgttgttgt

SEQ ID NO: 342461 - DNA, 16 bp, M. musculus
aagaagttttaaattt

SEQ ID NO: 342462 - DNA, 16 bp, M. musculus
aagaataaagtgtgga

SEQ ID NO: 342463 - DNA, 16 bp, M. musculus
aagaataacaatatga

SEQ ID NO: 342464 - DNA, 16 bp, M. musculus
aagaataatcagaata

SEQ ID NO: 342465 - DNA, 22 bp, M. musculus
aagaatacctggggagagattg

SEQ ID NO: 342466 - DNA, 16 bp, M. musculus
aagaatagataaatgg

SEQ ID NO: 342467 - DNA, 16 bp, M. musculus
aagaatatacaagcca

SEQ ID NO: 342468 - DNA, 16 bp, M. musculus
aagaatatatcttttt

SEQ ID NO: 342469 - DNA, 16 bp, M. musculus
aagaatatgaaaagct

SEQ ID NO: 342470 - DNA, 16 bp, M. musculus
aagaatatgttttcat

SEQ ID NO: 342471 - DNA, 16 bp, M. musculus
aagaatattaaaaagc

SEQ ID NO: 342472 - DNA, 16 bp, M. musculus
aagaatattagaaaca

SEQ ID NO: 342473 - DNA, 16 bp, M. musculus
aagaatattctagaaa

SEQ ID NO: 342474 - DNA, 16 bp, M. musculus
aagaatattttctttt

SEQ ID NO: 342475 - DNA, 16 bp, M. musculus
aagaatatttttaagt

SEQ ID NO: 342476 - DNA, 16 bp, M. musculus
aagaatcaaaaaatgg

SEQ ID NO: 342477 - DNA, 16 bp, M. musculus
aagaatcaacaaaagg

SEQ ID NO: 342478 - DNA, 16 bp, M. musculus
aagaatcaataaaatt

SEQ ID NO: 342479 - DNA, 16 bp, M. musculus
aagaatccattttcaa

SEQ ID NO: 342480 - DNA, 17 bp, M. musculus
aagaatcctcacctgag

SEQ ID NO: 342481 - DNA, 16 bp, M. musculus
aagaatctcaggaaga

SEQ ID NO: 342482 - DNA, 16 bp, M. musculus
aagaatctctaatggc

SEQ ID NO: 342483 - DNA, 16 bp, M. musculus
aagaatctctctctct

SEQ ID NO: 342484 - DNA, 16 bp, M. musculus
aagaatctgtctcaaa

SEQ ID NO: 342485 - DNA, 16 bp, M. musculus
aagaatcttactaaga

SEQ ID NO: 342486 - DNA, 16 bp, M. musculus
aagaatgaagaccaaa

SEQ ID NO: 342487 - DNA, 16 bp, M. musculus
aagaatgaatgaaaca

SEQ ID NO: 342488 - DNA, 16 bp, M. musculus
aagaatgaggccaaga

SEQ ID NO: 342489 - DNA, 16 bp, M. musculus
aagaatgagtgtgtgt

SEQ ID NO: 342490 - DNA, 16 bp, M. musculus
aagaatgcaaaatgat

SEQ ID NO: 342491 - DNA, 16 bp, M. musculus
aagaatgcaaataaat

SEQ ID NO: 342492 - DNA, 16 bp, M. musculus
aagaatgcaaattcat

SEQ ID NO: 342493 - DNA, 16 bp, M. musculus
aagaatgctggctatg

SEQ ID NO: 342494 - DNA, 16 bp, M. musculus
aagaatgcttttcccc

SEQ ID NO: 342495 - DNA, 17 bp, M. musculus
aagaatggatacagaaa

SEQ ID NO: 342496 - DNA, 16 bp, M. musculus
aagaatggattaattt

SEQ ID NO: 342497 - DNA, 16 bp, M. musculus
aagaatgggtgttgga

SEQ ID NO: 342498 - DNA, 16 bp, M. musculus
aagaatggtgtgtgtg

SEQ ID NO: 342499 - DNA, 16 bp, M. musculus
aagaatgtgatgactg

SEQ ID NO: 342500 - DNA, 16 bp, M. musculus
aagaatgtggactttg

SEQ ID NO: 342501 - DNA, 16 bp, M. musculus
aagaatgttctagaaa

SEQ ID NO: 342502 - DNA, 16 bp, M. musculus
aagaatgttctgttga

SEQ ID NO: 342503 - DNA, 16 bp, M. musculus
aagaattacagaagaa

SEQ ID NO: 342504 - DNA, 16 bp, M. musculus
aagaattcaaagaaga

SEQ ID NO: 342505 - DNA, 16 bp, M. musculus
aagaattcaagaaact

SEQ ID NO: 342506 - DNA, 16 bp, M. musculus
aagaattcatactgga

SEQ ID NO: 342507 - DNA, 16 bp, M. musculus
aagaattcatttttcc

SEQ ID NO: 342508 - DNA, 16 bp, M. musculus
aagaattccttgttcc

SEQ ID NO: 342509 - DNA, 16 bp, M. musculus
aagaattctcaactga

SEQ ID NO: 342510 - DNA, 16 bp, M. musculus
aagaattctctctctc

SEQ ID NO: 342511 - DNA, 16 bp, M. musculus
aagaattctgaaaaca

SEQ ID NO: 342512 - DNA, 16 bp, M. musculus
aagaattcttttcttt

SEQ ID NO: 342513 - DNA, 16 bp, M. musculus
aagaattgaagaagct

SEQ ID NO: 342514 - DNA, 16 bp, M. musculus
aagaattgaagaccca

SEQ ID NO: 342515 - DNA, 16 bp, M. musculus
aagaattgatttggaa

SEQ ID NO: 342516 - DNA, 16 bp, M. musculus
aagaattgggacaata

SEQ ID NO: 342517 - DNA, 16 bp, M. musculus
aagaatttaagaagtt

SEQ ID NO: 342518 - DNA, 16 bp, M. musculus
aagaatttaggccttt

SEQ ID NO: 342519 - DNA, 16 bp, M. musculus
aagaatttattttcaa

SEQ ID NO: 342520 - DNA, 16 bp, M. musculus
aagaatttcacagaaa

SEQ ID NO: 342521 - DNA, 16 bp, M. musculus
aagaatttcagtatat

SEQ ID NO: 342522 - DNA, 16 bp, M. musculus
aagaatttcttttctg

SEQ ID NO: 342523 - DNA, 16 bp, M. musculus
aagaatttgctgaaag

SEQ ID NO: 342524 - DNA, 16 bp, M. musculus
aagaattttatgaagt

SEQ ID NO: 342525 - DNA, 16 bp, M. musculus
aagaattttattgaaa

SEQ ID NO: 342526 - DNA, 16 bp, M. musculus
aagaattttgttggaa

SEQ ID NO: 342527 - DNA, 16 bp, M. musculus
aagaattttgttggga

SEQ ID NO: 342528 - DNA, 16 bp, M. musculus
aagaatttttaaatgt

SEQ ID NO: 342529 - DNA, 16 bp, M. musculus
aagaatttttttctaa

SEQ ID NO: 342530 - DNA, 16 bp, M. musculus
aagaatttttttttct

SEQ ID NO: 342531 - DNA, 16 bp, M. musculus
aagacaaaaaccacct

SEQ ID NO: 342532 - DNA, 16 bp, M. musculus
aagacaaaaatcatat

SEQ ID NO: 342533 - DNA, 16 bp, M. musculus
aagacaaaacaggggc

SEQ ID NO: 342534 - DNA, 16 bp, M. musculus
aagacaaaatggccac

SEQ ID NO: 342535 - DNA, 16 bp, M. musculus
aagacaaagatgaaga

SEQ ID NO: 342536 - DNA, 16 bp, M. musculus
aagacaaagatgccca

SEQ ID NO: 342537 - DNA, 16 bp, M. musculus
aagacaacctataata

SEQ ID NO: 342538 - DNA, 16 bp, M. musculus
aagacaagcagatctc

SEQ ID NO: 342539 - DNA, 16 bp, M. musculus
aagacaaggagatctc

SEQ ID NO: 342540 - DNA, 16 bp, M. musculus
aagacaaggagggggc

SEQ ID NO: 342541 - DNA, 16 bp, M. musculus
aagacaaggcttccca

SEQ ID NO: 342542 - DNA, 16 bp, M. musculus
aagacaaggtctcatt

SEQ ID NO: 342543 - DNA, 16 bp, M. musculus
aagacaagttccctac

SEQ ID NO: 342544 - DNA, 16 bp, M. musculus
aagacaataggaaaag

SEQ ID NO: 342545 - DNA, 16 bp, M. musculus
aagacaatattttcaa

SEQ ID NO: 342546 - DNA, 16 bp, M. musculus
aagacaatgaggggca

SEQ ID NO: 342547 - DNA, 16 bp, M. musculus
aagacaattgcagaca

SEQ ID NO: 342548 - DNA, 16 bp, M. musculus
aagacaattttaaaaa

SEQ ID NO: 342549 - DNA, 16 bp, M. musculus
aagacacagaaaatat

SEQ ID NO: 342550 - DNA, 16 bp, M. musculus
aagacacagaaatgaa

SEQ ID NO: 342551 - DNA, 16 bp, M. musculus
aagacacagaagtaaa

SEQ ID NO: 342552 - DNA, 16 bp, M. musculus
aagacacagtgttatc

SEQ ID NO: 342553 - DNA, 16 bp, M. musculus
aagacacagtttctct

SEQ ID NO: 342554 - DNA, 16 bp, M. musculus
aagacaccagaaaatt

SEQ ID NO: 342555 - DNA, 16 bp, M. musculus
aagacacctgatgtca

SEQ ID NO: 342556 - DNA, 16 bp, M. musculus
aagacactgaagaaag

SEQ ID NO: 342557 - DNA, 16 bp, M. musculus
aagacactgagggacc

SEQ ID NO: 342558 - DNA, 16 bp, M. musculus
aagacacttgatgtca

SEQ ID NO: 342559 - DNA, 16 bp, M. musculus
aagacacttgccacca

SEQ ID NO: 342560 - DNA, 16 bp, M. musculus
aagacagaaaagatgg

SEQ ID NO: 342561 - DNA, 16 bp, M. musculus
aagacagaaaccagag

SEQ ID NO: 342562 - DNA, 16 bp, M. musculus
aagacagaaactgaag

SEQ ID NO: 342563 - DNA, 16 bp, M. musculus
aagacagaaattaaag

SEQ ID NO: 342564 - DNA, 16 bp, M. musculus
aagacagaagagggca

SEQ ID NO: 342565 - DNA, 16 bp, M. musculus
aagacagaagttgata

SEQ ID NO: 342566 - DNA, 16 bp, M. musculus
aagacagacacgacct

SEQ ID NO: 342567 - DNA, 16 bp, M. musculus
aagacagacagactga

SEQ ID NO: 342568 - DNA, 16 bp, M. musculus
aagacagacagcattt

SEQ ID NO: 342569 - DNA, 16 bp, M. musculus
aagacagacagggcta

SEQ ID NO: 342570 - DNA, 16 bp, M. musculus
aagacagacagtacct

SEQ ID NO: 342571 - DNA, 16 bp, M. musculus
aagacagacctgacat

SEQ ID NO: 342572 - DNA, 16 bp, M. musculus
aagacagagaacttca

SEQ ID NO: 342573 - DNA, 16 bp, M. musculus
aagacagagacagaca

SEQ ID NO: 342574 - DNA, 16 bp, M. musculus
aagacagagatggaag

SEQ ID NO: 342575 - DNA, 16 bp, M. musculus
aagacagaggcaagca

SEQ ID NO: 342576 - DNA, 16 bp, M. musculus
aagacagaggcaggca

SEQ ID NO: 342577 - DNA, 16 bp, M. musculus
aagacagaggcaggtg

SEQ ID NO: 342578 - DNA, 18 bp, M. musculus
aagacagataatgggcca

SEQ ID NO: 342579 - DNA, 16 bp, M. musculus
aagacagattctacat

SEQ ID NO: 342580 - DNA, 16 bp, M. musculus
aagacagcatctcaca

SEQ ID NO: 342581 - DNA, 16 bp, M. musculus
aagacagcatcttcag

SEQ ID NO: 342582 - DNA, 16 bp, M. musculus
aagacagcatttcaca

SEQ ID NO: 342583 - DNA, 16 bp, M. musculus
aagacagccaaggcta

SEQ ID NO: 342584 - DNA, 16 bp, M. musculus
aagacagccaaggctg

SEQ ID NO: 342585 - DNA, 16 bp, M. musculus
aagacagccacagtgt

SEQ ID NO: 342586 - DNA, 16 bp, M. musculus
aagacagccagagcca

SEQ ID NO: 342587 - DNA, 16 bp, M. musculus
aagacagccaggactg

SEQ ID NO: 342588 - DNA, 16 bp, M. musculus
aagacagcctcaagaa

SEQ ID NO: 342589 - DNA, 21 bp, M. musculus
aagacagcctcctggactgct

SEQ ID NO: 342590 - DNA, 16 bp, M. musculus
aagacagctaaaatta

SEQ ID NO: 342591 - DNA, 23 bp, M. musculus
aagacagctacagtgtacttatt

SEQ ID NO: 342592 - DNA, 101 bp, M. musculus
aagacagcttatggggctataaatctgctgcccagccaacaagatcagttcttgagcttgtcaggtcaaacccaggaaatgcaagactggacctctgttcc

SEQ ID NO: 342593 - DNA, 16 bp, M. musculus
aagacaggaagatctc

SEQ ID NO: 342594 - DNA, 16 bp, M. musculus
aagacaggagacagga

SEQ ID NO: 342595 - DNA, 16 bp, M. musculus
aagacaggagatagag

SEQ ID NO: 342596 - DNA, 16 bp, M. musculus
aagacaggagcatggc

SEQ ID NO: 342597 - DNA, 16 bp, M. musculus
aagacaggatctcatg

SEQ ID NO: 342598 - DNA, 16 bp, M. musculus
aagacaggatctctct

SEQ ID NO: 342599 - DNA, 16 bp, M. musculus
aagacaggcacaagaa

SEQ ID NO: 342600 - DNA, 16 bp, M. musculus
aagacaggcagacaga

SEQ ID NO: 342601 - DNA, 16 bp, M. musculus
aagacagggcttctct

SEQ ID NO: 342602 - DNA, 16 bp, M. musculus
aagacagggtctcatg

SEQ ID NO: 342603 - DNA, 16 bp, M. musculus
aagacagggtctcatt

SEQ ID NO: 342604 - DNA, 16 bp, M. musculus
aagacagggtttcctt

SEQ ID NO: 342605 - DNA, 16 bp, M. musculus
aagacagggtttcttc

SEQ ID NO: 342606 - DNA, 16 bp, M. musculus
aagacagtgacagtga

SEQ ID NO: 342607 - DNA, 16 bp, M. musculus
aagacagtggctacag

SEQ ID NO: 342608 - DNA, 16 bp, M. musculus
aagacagttcctcatg

SEQ ID NO: 342609 - DNA, 16 bp, M. musculus
aagacagtttccagga

SEQ ID NO: 342610 - DNA, 16 bp, M. musculus
aagacatatttaaaat

SEQ ID NO: 342611 - DNA, 16 bp, M. musculus
aagacatatttattta

SEQ ID NO: 342612 - DNA, 16 bp, M. musculus
aagacatcatccacca

SEQ ID NO: 342613 - DNA, 16 bp, M. musculus
aagacatccaggaaat

SEQ ID NO: 342614 - DNA, 16 bp, M. musculus
aagacatgaacaaata

SEQ ID NO: 342615 - DNA, 16 bp, M. musculus
aagacatggaaagaaa

SEQ ID NO: 342616 - DNA, 16 bp, M. musculus
aagacatgggtacagg

SEQ ID NO: 342617 - DNA, 16 bp, M. musculus
aagacatgtaccacta

SEQ ID NO: 342618 - DNA, 16 bp, M. musculus
aagacattaaaaagga

SEQ ID NO: 342619 - DNA, 16 bp, M. musculus
aagacattgtcaataa

SEQ ID NO: 342620 - DNA, 16 bp, M. musculus
aagacatttaattggg

SEQ ID NO: 342621 - DNA, 16 bp, M. musculus
aagacatttcttaaaa

SEQ ID NO: 342622 - DNA, 16 bp, M. musculus
aagacatttgccacca

SEQ ID NO: 342623 - DNA, 16 bp, M. musculus
aagacattttaataaa

SEQ ID NO: 342624 - DNA, 16 bp, M. musculus
aagacattttatttta

SEQ ID NO: 342625 - DNA, 16 bp, M. musculus
aagacattttcccaat

SEQ ID NO: 342626 - DNA, 16 bp, M. musculus
aagacatttttaaaat

SEQ ID NO: 342627 - DNA, 16 bp, M. musculus
aagacatttttcaaat

SEQ ID NO: 342628 - DNA, 16 bp, M. musculus
aagaccaaactacaca

SEQ ID NO: 342629 - DNA, 16 bp, M. musculus
aagaccaaagcatgga

SEQ ID NO: 342630 - DNA, 16 bp, M. musculus
aagaccaaagtgtgga

SEQ ID NO: 342631 - DNA, 16 bp, M. musculus
aagaccaaagtgtggc

SEQ ID NO: 342632 - DNA, 16 bp, M. musculus
aagaccaaagtgtgtg

SEQ ID NO: 342633 - DNA, 16 bp, M. musculus
aagaccaaatctaaga

SEQ ID NO: 342634 - DNA, 16 bp, M. musculus
aagaccaacagagtca

SEQ ID NO: 342635 - DNA, 16 bp, M. musculus
aagaccaagaaatgaa

SEQ ID NO: 342636 - DNA, 16 bp, M. musculus
aagaccaagaccaaga

SEQ ID NO: 342637 - DNA, 16 bp, M. musculus
aagaccaagagagtca

SEQ ID NO: 342638 - DNA, 16 bp, M. musculus
aagaccaaggacctct

SEQ ID NO: 342639 - DNA, 16 bp, M. musculus
aagaccaagggcctcc

SEQ ID NO: 342640 - DNA, 16 bp, M. musculus
aagaccaagggcctct

SEQ ID NO: 342641 - DNA, 16 bp, M. musculus
aagaccaaggggcctt

SEQ ID NO: 342642 - DNA, 16 bp, M. musculus
aagaccacaaagaatg

SEQ ID NO: 342643 - DNA, 16 bp, M. musculus
aagaccaccaacagag

SEQ ID NO: 342644 - DNA, 16 bp, M. musculus
aagaccaccaagaagc

SEQ ID NO: 342645 - DNA, 16 bp, M. musculus
aagaccactacttctg

SEQ ID NO: 342646 - DNA, 16 bp, M. musculus
aagaccagccagtgct

SEQ ID NO: 342647 - DNA, 16 bp, M. musculus
aagaccagcctcagct

SEQ ID NO: 342648 - DNA, 16 bp, M. musculus
aagaccagctgaaaca

SEQ ID NO: 342649 - DNA, 16 bp, M. musculus
aagaccagctgagaca

SEQ ID NO: 342650 - DNA, 16 bp, M. musculus
aagaccagtgtcagca

SEQ ID NO: 342651 - DNA, 16 bp, M. musculus
aagaccataaaagggg

SEQ ID NO: 342652 - DNA, 16 bp, M. musculus
aagaccatacctactc

SEQ ID NO: 342653 - DNA, 16 bp, M. musculus
aagaccatcagaaaca

SEQ ID NO: 342654 - DNA, 16 bp, M. musculus
aagaccatgagttcaa

SEQ ID NO: 342655 - DNA, 16 bp, M. musculus
aagacccaaccagcag

SEQ ID NO: 342656 - DNA, 16 bp, M. musculus
aagacccaagtgagga

SEQ ID NO: 342657 - DNA, 16 bp, M. musculus
aagacccaataaagaa

SEQ ID NO: 342658 - DNA, 16 bp, M. musculus
aagacccacacctgtg

SEQ ID NO: 342659 - DNA, 16 bp, M. musculus
aagacccaccctaaat

SEQ ID NO: 342660 - DNA, 16 bp, M. musculus
aagacccacctcacag

SEQ ID NO: 342661 - DNA, 16 bp, M. musculus
aagacccagaaaatat

SEQ ID NO: 342662 - DNA, 16 bp, M. musculus
aagacccagaactgaa

SEQ ID NO: 342663 - DNA, 16 bp, M. musculus
aagacccagcaagcag

SEQ ID NO: 342664 - DNA, 16 bp, M. musculus
aagacccatagccaaa

SEQ ID NO: 342665 - DNA, 16 bp, M. musculus
aagaccccattgctga

SEQ ID NO: 342666 - DNA, 16 bp, M. musculus
aagacccctgaagctg

SEQ ID NO: 342667 - DNA, 16 bp, M. musculus
aagacccgtggaaagg

SEQ ID NO: 342668 - DNA, 17 bp, M. musculus
aagacccgtggaaaggc

SEQ ID NO: 342669 - DNA, 16 bp, M. musculus
aagaccctctctcaaa

SEQ ID NO: 342670 - DNA, 16 bp, M. musculus
aagaccctggctcaaa

SEQ ID NO: 342671 - DNA, 16 bp, M. musculus
aagaccctgtatcaaa

SEQ ID NO: 342672 - DNA, 17 bp, M. musculus
aagaccctgtctcaaac

SEQ ID NO: 342673 - DNA, 16 bp, M. musculus
aagaccctgtctcaag

SEQ ID NO: 342674 - DNA, 16 bp, M. musculus
aagaccctgtctcaca

SEQ ID NO: 342675 - DNA, 16 bp, M. musculus
aagaccctgtctccaa

SEQ ID NO: 342676 - DNA, 16 bp, M. musculus
aagaccctgtcttaaa

SEQ ID NO: 342677 - DNA, 16 bp, M. musculus
aagaccctgtttcaaa

SEQ ID NO: 342678 - DNA, 16 bp, M. musculus
aagacctaataccaat

SEQ ID NO: 342679 - DNA, 16 bp, M. musculus
aagacctagagatgaa

SEQ ID NO: 342680 - DNA, 16 bp, M. musculus
aagacctcaaaagatg

SEQ ID NO: 342681 - DNA, 16 bp, M. musculus
aagacctcaaagccca

SEQ ID NO: 342682 - DNA, 16 bp, M. musculus
aagacctcaacataaa

SEQ ID NO: 342683 - DNA, 16 bp, M. musculus
aagacctcagaagttg

SEQ ID NO: 342684 - DNA, 16 bp, M. musculus
aagacctcagcttgac

SEQ ID NO: 342685 - DNA, 16 bp, M. musculus
aagacctcagtctaga

SEQ ID NO: 342686 - DNA, 16 bp, M. musculus
aagacctgagttcaaa

SEQ ID NO: 342687 - DNA, 16 bp, M. musculus
aagacctgctcaacaa

SEQ ID NO: 342688 - DNA, 16 bp, M. musculus
aagacctgtgggagga

SEQ ID NO: 342689 - DNA, 16 bp, M. musculus
aagaccttaaagaaaa

SEQ ID NO: 342690 - DNA, 16 bp, M. musculus
aagaccttccattgat

SEQ ID NO: 342691 - DNA, 16 bp, M. musculus
aagacgaaagaatgga

SEQ ID NO: 342692 - DNA, 16 bp, M. musculus
aagacgctgtctcaaa

SEQ ID NO: 342693 - DNA, 16 bp, M. musculus
aagactacacacacta

SEQ ID NO: 342694 - DNA, 16 bp, M. musculus
aagactatttttaaaa

SEQ ID NO: 342695 - DNA, 16 bp, M. musculus
aagactcaacaagcag

SEQ ID NO: 342696 - DNA, 16 bp, M. musculus
aagactcagagaccac

SEQ ID NO: 342697 - DNA, 16 bp, M. musculus
aagactcaggagccag

SEQ ID NO: 342698 - DNA, 16 bp, M. musculus
aagactcccagcccag

SEQ ID NO: 342699 - DNA, 16 bp, M. musculus
aagactctacctcaaa

SEQ ID NO: 342700 - DNA, 16 bp, M. musculus
aagactctccaagctc

SEQ ID NO: 342701 - DNA, 16 bp, M. musculus
aagactctgagaccac

SEQ ID NO: 342702 - DNA, 16 bp, M. musculus
aagactctgatttaaa

SEQ ID NO: 342703 - DNA, 16 bp, M. musculus
aagactctgccttaaa

SEQ ID NO: 342704 - DNA, 17 bp, M. musculus
aagactctttctaaggc

SEQ ID NO: 342705 - DNA, 18 bp, M. musculus
aagactgaaagaagctga

SEQ ID NO: 342706 - DNA, 16 bp, M. musculus
aagactgaattccagg

SEQ ID NO: 342707 - DNA, 16 bp, M. musculus
aagactgaattttaaa

SEQ ID NO: 342708 - DNA, 16 bp, M. musculus
aagactgagctgcctg

SEQ ID NO: 342709 - DNA, 16 bp, M. musculus
aagactgatttccagg

SEQ ID NO: 342710 - DNA, 20 bp, M. musculus
aagactggcttagttcaaga

SEQ ID NO: 342711 - DNA, 16 bp, M. musculus
aagactgggaggagag

SEQ ID NO: 342712 - DNA, 16 bp, M. musculus
aagactgtaggagtca

SEQ ID NO: 342713 - DNA, 16 bp, M. musculus
aagactgtccactctc

SEQ ID NO: 342714 - DNA, 16 bp, M. musculus
aagactgtcctttctt

SEQ ID NO: 342715 - DNA, 16 bp, M. musculus
aagactgtgagagcca

SEQ ID NO: 342716 - DNA, 16 bp, M. musculus
aagacttacagagtca

SEQ ID NO: 342717 - DNA, 16 bp, M. musculus
aagacttatttattat

SEQ ID NO: 342718 - DNA, 16 bp, M. musculus
aagacttcagaagatg

SEQ ID NO: 342719 - DNA, 16 bp, M. musculus
aagacttgttctcagt

SEQ ID NO: 342720 - DNA, 16 bp, M. musculus
aagactttatttttaa

SEQ ID NO: 342721 - DNA, 16 bp, M. musculus
aagactttcaaagaag

SEQ ID NO: 342722 - DNA, 16 bp, M. musculus
aagactttctggaatt

SEQ ID NO: 342723 - DNA, 16 bp, M. musculus
aagactttcttttctg

SEQ ID NO: 342724 - DNA, 16 bp, M. musculus
aagactttgatgtcag

SEQ ID NO: 342725 - DNA, 16 bp, M. musculus
aagactttgtctccaa

SEQ ID NO: 342726 - DNA, 16 bp, M. musculus
aagacttttaaaataa

SEQ ID NO: 342727 - DNA, 16 bp, M. musculus
aagacttttcaccaga

SEQ ID NO: 342728 - DNA, 16 bp, M. musculus
aagactttttaacaaa

SEQ ID NO: 342729 - DNA, 16 bp, M. musculus
aagactttttttttaa

SEQ ID NO: 342730 - DNA, 16 bp, M. musculus
aagagaaaaaaatctt

SEQ ID NO: 342731 - DNA, 16 bp, M. musculus
aagagaaaagaaagct

SEQ ID NO: 342732 - DNA, 16 bp, M. musculus
aagagaaacaagtgct

SEQ ID NO: 342733 - DNA, 16 bp, M. musculus
aagagaaacactcttc

SEQ ID NO: 342734 - DNA, 16 bp, M. musculus
aagagaaaccctgtct

SEQ ID NO: 342735 - DNA, 16 bp, M. musculus
aagagaaactggaaaa

SEQ ID NO: 342736 - DNA, 16 bp, M. musculus
aagagaaactggctga

SEQ ID NO: 342737 - DNA, 16 bp, M. musculus
aagagaaactgggaaa

SEQ ID NO: 342738 - DNA, 16 bp, M. musculus
aagagaaactttaaaa

SEQ ID NO: 342739 - DNA, 16 bp, M. musculus
aagagaaagaacatca

SEQ ID NO: 342740 - DNA, 16 bp, M. musculus
aagagaaagaacatga

SEQ ID NO: 342741 - DNA, 16 bp, M. musculus
aagagaaagagccttt

SEQ ID NO: 342742 - DNA, 16 bp, M. musculus
aagagaaaggtaaaca

SEQ ID NO: 342743 - DNA, 16 bp, M. musculus
aagagaaataggcttg

SEQ ID NO: 342744 - DNA, 16 bp, M. musculus
aagagaaatgaaagca

SEQ ID NO: 342745 - DNA, 16 bp, M. musculus
aagagaaatgtatgtt

SEQ ID NO: 342746 - DNA, 16 bp, M. musculus
aagagaacaaaatact

SEQ ID NO: 342747 - DNA, 16 bp, M. musculus
aagagaacaatgcaaa

SEQ ID NO: 342748 - DNA, 16 bp, M. musculus
aagagaacaatgtaac

SEQ ID NO: 342749 - DNA, 16 bp, M. musculus
aagagaacaggctgag

SEQ ID NO: 342750 - DNA, 16 bp, M. musculus
aagagaacatgaagtt

SEQ ID NO: 342751 - DNA, 16 bp, M. musculus
aagagaacattttttt

SEQ ID NO: 342752 - DNA, 16 bp, M. musculus
aagagaacctttctgt

SEQ ID NO: 342753 - DNA, 16 bp, M. musculus
aagagaagaaagacat

SEQ ID NO: 342754 - DNA, 16 bp, M. musculus
aagagaagaatctatt

SEQ ID NO: 342755 - DNA, 16 bp, M. musculus
aagagaagatcagaga

SEQ ID NO: 342756 - DNA, 16 bp, M. musculus
aagagaagcaaatgct

SEQ ID NO: 342757 - DNA, 16 bp, M. musculus
aagagaagccaaggca

SEQ ID NO: 342758 - DNA, 16 bp, M. musculus
aagagaagccagattg

SEQ ID NO: 342759 - DNA, 16 bp, M. musculus
aagagaagccagtgct

SEQ ID NO: 342760 - DNA, 17 bp, M. musculus
aagagaagccccttggt

SEQ ID NO: 342761 - DNA, 16 bp, M. musculus
aagagaagctatttaa

SEQ ID NO: 342762 - DNA, 16 bp, M. musculus
aagagaagctcattgg

SEQ ID NO: 342763 - DNA, 16 bp, M. musculus
aagagaagcttatttg

SEQ ID NO: 342764 - DNA, 16 bp, M. musculus
aagagaaggtacaaga

SEQ ID NO: 342765 - DNA, 16 bp, M. musculus
aagagaagtggaacag

SEQ ID NO: 342766 - DNA, 16 bp, M. musculus
aagagaatatctaata

SEQ ID NO: 342767 - DNA, 16 bp, M. musculus
aagagaatcacaagtt

SEQ ID NO: 342768 - DNA, 16 bp, M. musculus
aagagaatgaagattt

SEQ ID NO: 342769 - DNA, 16 bp, M. musculus
aagagaatgacatgct

SEQ ID NO: 342770 - DNA, 16 bp, M. musculus
aagagaatgtgggaaa

SEQ ID NO: 342771 - DNA, 16 bp, M. musculus
aagagaattccaggac

SEQ ID NO: 342772 - DNA, 16 bp, M. musculus
aagagaattcttgggc

SEQ ID NO: 342773 - DNA, 18 bp, M. musculus
aagagacaataaggctct

SEQ ID NO: 342774 - DNA, 16 bp, M. musculus
aagagacacagtctca

SEQ ID NO: 342775 - DNA, 16 bp, M. musculus
aagagacacatgacca

SEQ ID NO: 342776 - DNA, 16 bp, M. musculus
aagagacaccatgaac

SEQ ID NO: 342777 - DNA, 16 bp, M. musculus
aagagacactatgact

SEQ ID NO: 342778 - DNA, 16 bp, M. musculus
aagagacactgtcaat

SEQ ID NO: 342779 - DNA, 16 bp, M. musculus
aagagacagaaatgga

SEQ ID NO: 342780 - DNA, 16 bp, M. musculus
aagagacaggtcagag

SEQ ID NO: 342781 - DNA, 16 bp, M. musculus
aagagacatcatggcc

SEQ ID NO: 342782 - DNA, 16 bp, M. musculus
aagagacccacagcca

SEQ ID NO: 342783 - DNA, 16 bp, M. musculus
aagagaccctcttcct

SEQ ID NO: 342784 - DNA, 16 bp, M. musculus
aagagaccctgcctta

SEQ ID NO: 342785 - DNA, 16 bp, M. musculus
aagagaccctggctca

SEQ ID NO: 342786 - DNA, 16 bp, M. musculus
aagagaccctgtctca

SEQ ID NO: 342787 - DNA, 16 bp, M. musculus
aagagaccttatctca

SEQ ID NO: 342788 - DNA, 16 bp, M. musculus
aagagactatgaaagc

SEQ ID NO: 342789 - DNA, 16 bp, M. musculus
aagagactctcagaac

SEQ ID NO: 342790 - DNA, 16 bp, M. musculus
aagagactctcctccc

SEQ ID NO: 342791 - DNA, 16 bp, M. musculus
aagagactgaaatttt

SEQ ID NO: 342792 - DNA, 16 bp, M. musculus
aagagactgaaggccc

SEQ ID NO: 342793 - DNA, 16 bp, M. musculus
aagagactgagaaaga

SEQ ID NO: 342794 - DNA, 16 bp, M. musculus
aagagactgaggcaag

SEQ ID NO: 342795 - DNA, 16 bp, M. musculus
aagagactgagggaaa

SEQ ID NO: 342796 - DNA, 16 bp, M. musculus
aagagactgaggggaa

SEQ ID NO: 342797 - DNA, 16 bp, M. musculus
aagagactggaagccc

SEQ ID NO: 342798 - DNA, 16 bp, M. musculus
aagagactggaggtcc

SEQ ID NO: 342799 - DNA, 16 bp, M. musculus
aagagactttagtaaa

SEQ ID NO: 342800 - DNA, 16 bp, M. musculus
aagagagaacttcaga

SEQ ID NO: 342801 - DNA, 16 bp, M. musculus
aagagagaatctcaga

SEQ ID NO: 342802 - DNA, 16 bp, M. musculus
aagagagaccctgtct

SEQ ID NO: 342803 - DNA, 28 bp, M. musculus
aagagagagaatggtgaaaccccgtccc

SEQ ID NO: 342804 - DNA, 16 bp, M. musculus
aagagagagattgtca

SEQ ID NO: 342805 - DNA, 16 bp, M. musculus
aagagagagcaggggt

SEQ ID NO: 342806 - DNA, 16 bp, M. musculus
aagagagagctctatc

SEQ ID NO: 342807 - DNA, 17 bp, M. musculus
aagagagcatcagatct

SEQ ID NO: 342808 - DNA, 16 bp, M. musculus
aagagagcccaggaga

SEQ ID NO: 342809 - DNA, 16 bp, M. musculus
aagagagctggctgct

SEQ ID NO: 342810 - DNA, 16 bp, M. musculus
aagagagctttcagta

SEQ ID NO: 342811 - DNA, 16 bp, M. musculus
aagagaggacccttgg

SEQ ID NO: 342812 - DNA, 16 bp, M. musculus
aagagaggcccatcgg

SEQ ID NO: 342813 - DNA, 16 bp, M. musculus
aagagaggccctaggt

SEQ ID NO: 342814 - DNA, 16 bp, M. musculus
aagagaggccttttgg

SEQ ID NO: 342815 - DNA, 16 bp, M. musculus
aagagagtagccaatc

SEQ ID NO: 342816 - DNA, 16 bp, M. musculus
aagagagtatcagatt

SEQ ID NO: 342817 - DNA, 16 bp, M. musculus
aagagagtctcaatga

SEQ ID NO: 342818 - DNA, 16 bp, M. musculus
aagagagtgacagtgt

SEQ ID NO: 342819 - DNA, 16 bp, M. musculus
aagagagtgtcagatc

SEQ ID NO: 342820 - DNA, 16 bp, M. musculus
aagagagttccaggac

SEQ ID NO: 342821 - DNA, 16 bp, M. musculus
aagagataaagagatt

SEQ ID NO: 342822 - DNA, 16 bp, M. musculus
aagagatacaggaaaa

SEQ ID NO: 342823 - DNA, 16 bp, M. musculus
aagagatactaagaaa

SEQ ID NO: 342824 - DNA, 16 bp, M. musculus
aagagatatcaaggaa

SEQ ID NO: 342825 - DNA, 16 bp, M. musculus
aagagatattaacgaa

SEQ ID NO: 342826 - DNA, 16 bp, M. musculus
aagagatcagaagtca

SEQ ID NO: 342827 - DNA, 21 bp, M. musculus
aagagatctcttgtcacagat

SEQ ID NO: 342828 - DNA, 16 bp, M. musculus
aagagatctgcaactc

SEQ ID NO: 342829 - DNA, 16 bp, M. musculus
aagagatctgtctgcc

SEQ ID NO: 342830 - DNA, 16 bp, M. musculus
aagagatctgttcagt

SEQ ID NO: 342831 - DNA, 16 bp, M. musculus
aagagatcttaaggaa

SEQ ID NO: 342832 - DNA, 16 bp, M. musculus
aagagatctttccatc

SEQ ID NO: 342833 - DNA, 16 bp, M. musculus
aagagatgcccaagaa

SEQ ID NO: 342834 - DNA, 17 bp, M. musculus
aagagatgcccatgaaa

SEQ ID NO: 342835 - DNA, 16 bp, M. musculus
aagagatggaagatag

SEQ ID NO: 342836 - DNA, 16 bp, M. musculus
aagagatgtctcagtg

SEQ ID NO: 342837 - DNA, 16 bp, M. musculus
aagagatgttcaacat

SEQ ID NO: 342838 - DNA, 16 bp, M. musculus
aagagattcagagaca

SEQ ID NO: 342839 - DNA, 16 bp, M. musculus
aagagattgaaaattt

SEQ ID NO: 342840 - DNA, 16 bp, M. musculus
aagagatttattggga

SEQ ID NO: 342841 - DNA, 16 bp, M. musculus
aagagatttggcaata

SEQ ID NO: 342842 - DNA, 16 bp, M. musculus
aagagcaacaagtgct

SEQ ID NO: 342843 - DNA, 16 bp, M. musculus
aagagcaacagcagca

SEQ ID NO: 342844 - DNA, 16 bp, M. musculus
aagagcaacccagatg

SEQ ID NO: 342845 - DNA, 16 bp, M. musculus
aagagcaacgagtgct

SEQ ID NO: 342846 - DNA, 16 bp, M. musculus
aagagcaagaagtgct

SEQ ID NO: 342847 - DNA, 16 bp, M. musculus
aagagcaagcagtgct

SEQ ID NO: 342848 - DNA, 16 bp, M. musculus
aagagcaagcatgggc

SEQ ID NO: 342849 - DNA, 16 bp, M. musculus
aagagcaagcctccca

SEQ ID NO: 342850 - DNA, 16 bp, M. musculus
aagagcaagctgagca

SEQ ID NO: 342851 - DNA, 16 bp, M. musculus
aagagcacatcaaaac

SEQ ID NO: 342852 - DNA, 16 bp, M. musculus
aagagcacatcaaaat

SEQ ID NO: 342853 - DNA, 16 bp, M. musculus
aagagcactgactcct

SEQ ID NO: 342854 - DNA, 16 bp, M. musculus
aagagcactgagtgct

SEQ ID NO: 342855 - DNA, 16 bp, M. musculus
aagagcactggccact

SEQ ID NO: 342856 - DNA, 16 bp, M. musculus
aagagcactggtggct

SEQ ID NO: 342857 - DNA, 16 bp, M. musculus
aagagcactggttcct

SEQ ID NO: 342858 - DNA, 16 bp, M. musculus
aagagcacttcctgtt

SEQ ID NO: 342859 - DNA, 16 bp, M. musculus
aagagcacttgcagct

SEQ ID NO: 342860 - DNA, 16 bp, M. musculus
aagagcacttggtgct

SEQ ID NO: 342861 - DNA, 16 bp, M. musculus
aagagcagaaagtgct

SEQ ID NO: 342862 - DNA, 16 bp, M. musculus
aagagcagaatgccaa

SEQ ID NO: 342863 - DNA, 18 bp, M. musculus
aagagcagagaactcaga

SEQ ID NO: 342864 - DNA, 16 bp, M. musculus
aagagcagagacagct

SEQ ID NO: 342865 - DNA, 16 bp, M. musculus
aagagcagcaagcagt

SEQ ID NO: 342866 - DNA, 16 bp, M. musculus
aagagcagcaaggact

SEQ ID NO: 342867 - DNA, 16 bp, M. musculus
aagagcagcaagtgct

SEQ ID NO: 342868 - DNA, 16 bp, M. musculus
aagagcagcaattgct

SEQ ID NO: 342869 - DNA, 16 bp, M. musculus
aagagcagcagtctca

SEQ ID NO: 342870 - DNA, 16 bp, M. musculus
aagagcagcatgcact

SEQ ID NO: 342871 - DNA, 16 bp, M. musculus
aagagcagccactgct

SEQ ID NO: 342872 - DNA, 16 bp, M. musculus
aagagcagccagagct

SEQ ID NO: 342873 - DNA, 16 bp, M. musculus
aagagcagccagtgct

SEQ ID NO: 342874 - DNA, 16 bp, M. musculus
aagagcagccagtgtt

SEQ ID NO: 342875 - DNA, 16 bp, M. musculus
aagagcagcctgtgct

SEQ ID NO: 342876 - DNA, 16 bp, M. musculus
aagagcaggaagcact

SEQ ID NO: 342877 - DNA, 16 bp, M. musculus
aagagcaggaagctga

SEQ ID NO: 342878 - DNA, 16 bp, M. musculus
aagagcaggagcagga

SEQ ID NO: 342879 - DNA, 16 bp, M. musculus
aagagcaggagttcaa

SEQ ID NO: 342880 - DNA, 16 bp, M. musculus
aagagcaggcagtgct

SEQ ID NO: 342881 - DNA, 16 bp, M. musculus
aagagcaggtaaacta

SEQ ID NO: 342882 - DNA, 16 bp, M. musculus
aagagcagtaagtgct

SEQ ID NO: 342883 - DNA, 16 bp, M. musculus
aagagcagtatgtgtt

SEQ ID NO: 342884 - DNA, 16 bp, M. musculus
aagagcagtcaatgct

SEQ ID NO: 342885 - DNA, 16 bp, M. musculus
aagagcagtcagggct

SEQ ID NO: 342886 - DNA, 16 bp, M. musculus
aagagcagtcagtact

SEQ ID NO: 342887 - DNA, 19 bp, M. musculus
aagagcagtcagtgctctc

SEQ ID NO: 342888 - DNA, 20 bp, M. musculus
aagagcagtcagtgctctta

SEQ ID NO: 342889 - DNA, 19 bp, M. musculus
aagagcagtcggtactctt

SEQ ID NO: 342890 - DNA, 20 bp, M. musculus
aagagcagtcggtgctctta

SEQ ID NO: 342891 - DNA, 16 bp, M. musculus
aagagcagtctgtgct

SEQ ID NO: 342892 - DNA, 16 bp, M. musculus
aagagcagtcttaacc

SEQ ID NO: 342893 - DNA, 16 bp, M. musculus
aagagcagtgcacact

SEQ ID NO: 342894 - DNA, 16 bp, M. musculus
aagagcagtgctctta

SEQ ID NO: 342895 - DNA, 16 bp, M. musculus
aagagcagttactgct

SEQ ID NO: 342896 - DNA, 20 bp, M. musculus
aagagcagttggtgctctta

SEQ ID NO: 342897 - DNA, 16 bp, M. musculus
aagagcatacacagac

SEQ ID NO: 342898 - DNA, 16 bp, M. musculus
aagagcatttgcttct

SEQ ID NO: 342899 - DNA, 16 bp, M. musculus
aagagccaaaggacca

SEQ ID NO: 342900 - DNA, 16 bp, M. musculus
aagagccagaggatga

SEQ ID NO: 342901 - DNA, 16 bp, M. musculus
aagagccagaggatgg

SEQ ID NO: 342902 - DNA, 16 bp, M. musculus
aagagccagaggccag

SEQ ID NO: 342903 - DNA, 16 bp, M. musculus
aagagccagaggggac

SEQ ID NO: 342904 - DNA, 16 bp, M. musculus
aagagccagggaagag

SEQ ID NO: 342905 - DNA, 16 bp, M. musculus
aagagcccacctccag

SEQ ID NO: 342906 - DNA, 16 bp, M. musculus
aagagcccagatgtcc

SEQ ID NO: 342907 - DNA, 16 bp, M. musculus
aagagcctctggggga

SEQ ID NO: 342908 - DNA, 16 bp, M. musculus
aagagcctggagcaca

SEQ ID NO: 342909 - DNA, 16 bp, M. musculus
aagagcctggtatagc

SEQ ID NO: 342910 - DNA, 16 bp, M. musculus
aagagcgctggctgct

SEQ ID NO: 342911 - DNA, 16 bp, M. musculus
aagagctacaggcagt

SEQ ID NO: 342912 - DNA, 16 bp, M. musculus
aagagctagagaaaag

SEQ ID NO: 342913 - DNA, 16 bp, M. musculus
aagagctcaagaagat

SEQ ID NO: 342914 - DNA, 16 bp, M. musculus
aagagctcaagaagtt

SEQ ID NO: 342915 - DNA, 16 bp, M. musculus
aagagctcaagagaag

SEQ ID NO: 342916 - DNA, 16 bp, M. musculus
aagagctctacatctt

SEQ ID NO: 342917 - DNA, 16 bp, M. musculus
aagagctctggggtaa

SEQ ID NO: 342918 - DNA, 16 bp, M. musculus
aagagctcttgctgtt

SEQ ID NO: 342919 - DNA, 16 bp, M. musculus
aagagctgaatagtat

SEQ ID NO: 342920 - DNA, 16 bp, M. musculus
aagagctgaggatgga

SEQ ID NO: 342921 - DNA, 41 bp, M. musculus
aagagctgagtggccagcgacctattgcctaagcatagata

SEQ ID NO: 342922 - DNA, 16 bp, M. musculus
aagagctggagagatg

SEQ ID NO: 342923 - DNA, 16 bp, M. musculus
aagagctggagagctg

SEQ ID NO: 342924 - DNA, 16 bp, M. musculus
aagagctgggatcaca

SEQ ID NO: 342925 - DNA, 16 bp, M. musculus
aagagctggggaagag

SEQ ID NO: 342926 - DNA, 17 bp, M. musculus
aagagcttgctcttcag

SEQ ID NO: 342927 - DNA, 16 bp, M. musculus
aagagcttggtgatgt

SEQ ID NO: 342928 - DNA, 16 bp, M. musculus
aagagcttgttcttca

SEQ ID NO: 342929 - DNA, 16 bp, M. musculus
aagaggaaaactcaaa

SEQ ID NO: 342930 - DNA, 16 bp, M. musculus
aagaggaaaattcaaa

SEQ ID NO: 342931 - DNA, 16 bp, M. musculus
aagaggaaatatggtg

SEQ ID NO: 342932 - DNA, 16 bp, M. musculus
aagaggaaatcaaaat

SEQ ID NO: 342933 - DNA, 16 bp, M. musculus
aagaggaaatgaaaac

SEQ ID NO: 342934 - DNA, 16 bp, M. musculus
aagaggaaatgaaaca

SEQ ID NO: 342935 - DNA, 16 bp, M. musculus
aagaggaacaacaata

SEQ ID NO: 342936 - DNA, 16 bp, M. musculus
aagaggaagaagcagc

SEQ ID NO: 342937 - DNA, 16 bp, M. musculus
aagaggaagccctgct

SEQ ID NO: 342938 - DNA, 16 bp, M. musculus
aagaggaagttgaact

SEQ ID NO: 342939 - DNA, 16 bp, M. musculus
aagaggaatgctcctc

SEQ ID NO: 342940 - DNA, 16 bp, M. musculus
aagaggaatgtgaaga

SEQ ID NO: 342941 - DNA, 16 bp, M. musculus
aagaggacatctgatc

SEQ ID NO: 342942 - DNA, 16 bp, M. musculus
aagaggacccaacatt

SEQ ID NO: 342943 - DNA, 16 bp, M. musculus
aagaggacccagtttt

SEQ ID NO: 342944 - DNA, 16 bp, M. musculus
aagaggactggctgct

SEQ ID NO: 342945 - DNA, 16 bp, M. musculus
aagaggacttcagatc

SEQ ID NO: 342946 - DNA, 16 bp, M. musculus
aagaggacttttattt

SEQ ID NO: 342947 - DNA, 16 bp, M. musculus
aagaggagaagatggc

SEQ ID NO: 342948 - DNA, 16 bp, M. musculus
aagaggagcagatggc

SEQ ID NO: 342949 - DNA, 16 bp, M. musculus
aagaggagcagcagca

SEQ ID NO: 342950 - DNA, 16 bp, M. musculus
aagaggagcctgagga

SEQ ID NO: 342951 - DNA, 16 bp, M. musculus
aagaggagtagaaggt

SEQ ID NO: 342952 - DNA, 16 bp, M. musculus
aagaggatcaacaata

SEQ ID NO: 342953 - DNA, 16 bp, M. musculus
aagaggatcaaggaac

SEQ ID NO: 342954 - DNA, 16 bp, M. musculus
aagaggatcacaagtt

SEQ ID NO: 342955 - DNA, 16 bp, M. musculus
aagaggatgtcaaatc

SEQ ID NO: 342956 - DNA, 17 bp, M. musculus
aagaggattgtcagtgg

SEQ ID NO: 342957 - DNA, 16 bp, M. musculus
aagaggcagactccag

SEQ ID NO: 342958 - DNA, 16 bp, M. musculus
aagaggcagagaaagt

SEQ ID NO: 342959 - DNA, 16 bp, M. musculus
aagaggcagagaaggc

SEQ ID NO: 342960 - DNA, 16 bp, M. musculus
aagaggcagagacagg

SEQ ID NO: 342961 - DNA, 16 bp, M. musculus
aagaggcagaggcaag

SEQ ID NO: 342962 - DNA, 16 bp, M. musculus
aagaggcagaggcagg

SEQ ID NO: 342963 - DNA, 16 bp, M. musculus
aagaggcagcctacag

SEQ ID NO: 342964 - DNA, 16 bp, M. musculus
aagaggcaggaggcag

SEQ ID NO: 342965 - DNA, 16 bp, M. musculus
aagaggccaagaacct

SEQ ID NO: 342966 - DNA, 16 bp, M. musculus
aagaggccaccaacag

SEQ ID NO: 342967 - DNA, 16 bp, M. musculus
aagaggccatggagaa

SEQ ID NO: 342968 - DNA, 16 bp, M. musculus
aagaggctagagaaag

SEQ ID NO: 342969 - DNA, 16 bp, M. musculus
aagaggctgaggaaga

SEQ ID NO: 342970 - DNA, 16 bp, M. musculus
aagaggctgaggagga

SEQ ID NO: 342971 - DNA, 16 bp, M. musculus
aagaggctggaggccc

SEQ ID NO: 342972 - DNA, 16 bp, M. musculus
aagaggctggcctcaa

SEQ ID NO: 342973 - DNA, 16 bp, M. musculus
aagaggctgggcctct

SEQ ID NO: 342974 - DNA, 16 bp, M. musculus
aagaggctgtgcactc

SEQ ID NO: 342975 - DNA, 16 bp, M. musculus
aagaggcttgctgcca

SEQ ID NO: 342976 - DNA, 16 bp, M. musculus
aagagggaactgaaac

SEQ ID NO: 342977 - DNA, 16 bp, M. musculus
aagagggatatcattt

SEQ ID NO: 342978 - DNA, 16 bp, M. musculus
aagagggcaccagaac

SEQ ID NO: 342979 - DNA, 16 bp, M. musculus
aagagggcactgcatc

SEQ ID NO: 342980 - DNA, 16 bp, M. musculus
aagagggcaggactgg

SEQ ID NO: 342981 - DNA, 16 bp, M. musculus
aagagggcatcagatt

SEQ ID NO: 342982 - DNA, 16 bp, M. musculus
aagagggcatcatatt

SEQ ID NO: 342983 - DNA, 16 bp, M. musculus
aagagggcatcggatc

SEQ ID NO: 342984 - DNA, 16 bp, M. musculus
aagagggcgtcagatt

SEQ ID NO: 342985 - DNA, 16 bp, M. musculus
aagagggctcagcagg

SEQ ID NO: 342986 - DNA, 44 bp, M. musculus
aagaggggaattgaagagattttaccccgagcaccaagagtgtc

SEQ ID NO: 342987 - DNA, 16 bp, M. musculus
aagagggtattggatt

SEQ ID NO: 342988 - DNA, 16 bp, M. musculus
aagagggtgatgaagc

SEQ ID NO: 342989 - DNA, 16 bp, M. musculus
aagaggtagaactctc

SEQ ID NO: 342990 - DNA, 16 bp, M. musculus
aagaggtagaagcagg

SEQ ID NO: 342991 - DNA, 16 bp, M. musculus
aagaggtcaaagggat

SEQ ID NO: 342992 - DNA, 16 bp, M. musculus
aagaggtcatgaattt

SEQ ID NO: 342993 - DNA, 16 bp, M. musculus
aagaggtgtgttgaag

SEQ ID NO: 342994 - DNA, 16 bp, M. musculus
aagaggtgttgaattt

SEQ ID NO: 342995 - DNA, 34 bp, M. musculus
aagaggttcagaactttctgcagtcagggtctgt

SEQ ID NO: 342996 - DNA, 16 bp, M. musculus
aagaggtttatttggc

SEQ ID NO: 342997 - DNA, 16 bp, M. musculus
aagaggtttatttggg

SEQ ID NO: 342998 - DNA, 16 bp, M. musculus
aagaggtttctgcctc

SEQ ID NO: 342999 - DNA, 16 bp, M. musculus
aagagtaaccagtgct

SEQ ID NO: 343000 - DNA, 16 bp, M. musculus
aagagtacagactgct

SEQ ID NO: 343001 - DNA, 16 bp, M. musculus
aagagtacttgctgtg

SEQ ID NO: 343002 - DNA, 16 bp, M. musculus
aagagtagtattgctg

SEQ ID NO: 343003 - DNA, 16 bp, M. musculus
aagagtcaagaaaaca

SEQ ID NO: 343004 - DNA, 16 bp, M. musculus
aagagtcagagacacc

SEQ ID NO: 343005 - DNA, 16 bp, M. musculus
aagagtcagatgcagg

SEQ ID NO: 343006 - DNA, 16 bp, M. musculus
aagagtcagatggaga

SEQ ID NO: 343007 - DNA, 17 bp, M. musculus
aagagtcagctcctgtt

SEQ ID NO: 343008 - DNA, 16 bp, M. musculus
aagagtcatctcctaa

SEQ ID NO: 343009 - DNA, 16 bp, M. musculus
aagagtcctggctgct

SEQ ID NO: 343010 - DNA, 16 bp, M. musculus
aagagtctccagcaga

SEQ ID NO: 343011 - DNA, 16 bp, M. musculus
aagagtctctcaggag

SEQ ID NO: 343012 - DNA, 16 bp, M. musculus
aagagtcttgatttta

SEQ ID NO: 343013 - DNA, 16 bp, M. musculus
aagagtgaagcagaga

SEQ ID NO: 343014 - DNA, 16 bp, M. musculus
aagagtgacttccagg

SEQ ID NO: 343015 - DNA, 16 bp, M. musculus
aagagtgagatgcaga

SEQ ID NO: 343016 - DNA, 16 bp, M. musculus
aagagtgccatggaga

SEQ ID NO: 343017 - DNA, 16 bp, M. musculus
aagagtgctgcttcta

SEQ ID NO: 343018 - DNA, 16 bp, M. musculus
aagagtgcttactgct

SEQ ID NO: 343019 - DNA, 16 bp, M. musculus
aagagtggcaaggcaa

SEQ ID NO: 343020 - DNA, 16 bp, M. musculus
aagagtgggtcaaagg

SEQ ID NO: 343021 - DNA, 16 bp, M. musculus
aagagtgttttgaaca

SEQ ID NO: 343022 - DNA, 16 bp, M. musculus
aagagttcaagaagct

SEQ ID NO: 343023 - DNA, 16 bp, M. musculus
aagagttccaggacag

SEQ ID NO: 343024 - DNA, 16 bp, M. musculus
aagagttctgcctgcc

SEQ ID NO: 343025 - DNA, 16 bp, M. musculus
aagagttggaagagag

SEQ ID NO: 343026 - DNA, 16 bp, M. musculus
aagagttggttctctc

SEQ ID NO: 343027 - DNA, 16 bp, M. musculus
aagagtttcaaggaag

SEQ ID NO: 343028 - DNA, 16 bp, M. musculus
aagagtttgttttgtt

SEQ ID NO: 343029 - DNA, 16 bp, M. musculus
aagagttttaaatttt

SEQ ID NO: 343030 - DNA, 16 bp, M. musculus
aagagttttgcttcta

SEQ ID NO: 343031 - DNA, 16 bp, M. musculus
aagagttttggattaa

SEQ ID NO: 343032 - DNA, 16 bp, M. musculus
aagataaaaatctcaa

SEQ ID NO: 343033 - DNA, 16 bp, M. musculus
aagataaaatttcaaa

SEQ ID NO: 343034 - DNA, 16 bp, M. musculus
aagataaactttttgt

SEQ ID NO: 343035 - DNA, 16 bp, M. musculus
aagataaatatgttga

SEQ ID NO: 343036 - DNA, 16 bp, M. musculus
aagataagaatggatc

SEQ ID NO: 343037 - DNA, 16 bp, M. musculus
aagataatgtttaaat

SEQ ID NO: 343038 - DNA, 16 bp, M. musculus
aagataattataagag

SEQ ID NO: 343039 - DNA, 17 bp, M. musculus
aagataattcagactat

SEQ ID NO: 343040 - DNA, 16 bp, M. musculus
aagatacaattttcaa

SEQ ID NO: 343041 - DNA, 16 bp, M. musculus
aagataccactggaaa

SEQ ID NO: 343042 - DNA, 16 bp, M. musculus
aagataccagaaccac

SEQ ID NO: 343043 - DNA, 16 bp, M. musculus
aagatacccatggaag

SEQ ID NO: 343044 - DNA, 16 bp, M. musculus
aagatacccattttta

SEQ ID NO: 343045 - DNA, 16 bp, M. musculus
aagatactgaaggaaa

SEQ ID NO: 343046 - DNA, 16 bp, M. musculus
aagatagaaagatctt

SEQ ID NO: 343047 - DNA, 16 bp, M. musculus
aagatagaagatacaa

SEQ ID NO: 343048 - DNA, 16 bp, M. musculus
aagatagagaacttta

SEQ ID NO: 343049 - DNA, 16 bp, M. musculus
aagatagaggcaggag

SEQ ID NO: 343050 - DNA, 16 bp, M. musculus
aagatagtggccatta

SEQ ID NO: 343051 - DNA, 16 bp, M. musculus
aagatataaagaaagc

SEQ ID NO: 343052 - DNA, 16 bp, M. musculus
aagatatacaaagaac

SEQ ID NO: 343053 - DNA, 16 bp, M. musculus
aagatatggaaagagc

SEQ ID NO: 343054 - DNA, 16 bp, M. musculus
aagatattgaacattt

SEQ ID NO: 343055 - DNA, 16 bp, M. musculus
aagatattgctaatat

SEQ ID NO: 343056 - DNA, 16 bp, M. musculus
aagatattttttttct

SEQ ID NO: 343057 - DNA, 16 bp, M. musculus
aagatcaaaaccacaa

SEQ ID NO: 343058 - DNA, 16 bp, M. musculus
aagatcaaaatctcag

SEQ ID NO: 343059 - DNA, 16 bp, M. musculus
aagatcaaacttgccc

SEQ ID NO: 343060 - DNA, 16 bp, M. musculus
aagatcaaagcctcag

SEQ ID NO: 343061 - DNA, 16 bp, M. musculus
aagatcaagaattcat

SEQ ID NO: 343062 - DNA, 16 bp, M. musculus
aagatcaaggccagcc

SEQ ID NO: 343063 - DNA, 23 bp, M. musculus
aagatcaagtgaccataggtgtg

SEQ ID NO: 343064 - DNA, 24 bp, M. musculus
aagatcaagtgaccataggtgtgt

SEQ ID NO: 343065 - DNA, 16 bp, M. musculus
aagatcactggtgagt

SEQ ID NO: 343066 - DNA, 16 bp, M. musculus
aagatcagaaactcag

SEQ ID NO: 343067 - DNA, 16 bp, M. musculus
aagatcagaagttcaa

SEQ ID NO: 343068 - DNA, 16 bp, M. musculus
aagatcagaatttcaa

SEQ ID NO: 343069 - DNA, 16 bp, M. musculus
aagatcagagaacaac

SEQ ID NO: 343070 - DNA, 18 bp, M. musculus
aagatcaggaattcaagg

SEQ ID NO: 343071 - DNA, 16 bp, M. musculus
aagatcaggaatttga

SEQ ID NO: 343072 - DNA, 16 bp, M. musculus
aagatcaggagtttaa

SEQ ID NO: 343073 - DNA, 16 bp, M. musculus
aagatcaggctgtggg

SEQ ID NO: 343074 - DNA, 16 bp, M. musculus
aagatcatagaagaaa

SEQ ID NO: 343075 - DNA, 16 bp, M. musculus
aagatcatatgcccca

SEQ ID NO: 343076 - DNA, 16 bp, M. musculus
aagatcatccttggct

SEQ ID NO: 343077 - DNA, 16 bp, M. musculus
aagatcatctaagaga

SEQ ID NO: 343078 - DNA, 16 bp, M. musculus
aagatcatgagttcaa

SEQ ID NO: 343079 - DNA, 16 bp, M. musculus
aagatcatgtgaccat

SEQ ID NO: 343080 - DNA, 16 bp, M. musculus
aagatccaactgcctc

SEQ ID NO: 343081 - DNA, 16 bp, M. musculus
aagatccacctgcctt

SEQ ID NO: 343082 - DNA, 16 bp, M. musculus
aagatccagaacagcc

SEQ ID NO: 343083 - DNA, 16 bp, M. musculus
aagatccagctcctgg

SEQ ID NO: 343084 - DNA, 16 bp, M. musculus
aagatccagctgcaag

SEQ ID NO: 343085 - DNA, 16 bp, M. musculus
aagatccccagcttcc

SEQ ID NO: 343086 - DNA, 16 bp, M. musculus
aagatcctaaaagaaa

SEQ ID NO: 343087 - DNA, 16 bp, M. musculus
aagatcctctctcaaa

SEQ ID NO: 343088 - DNA, 17 bp, M. musculus
aagatcctggcagaatg

SEQ ID NO: 343089 - DNA, 16 bp, M. musculus
aagatcctgtctgaaa

SEQ ID NO: 343090 - DNA, 16 bp, M. musculus
aagatcctttccccaa

SEQ ID NO: 343091 - DNA, 16 bp, M. musculus
aagatccttttcccaa

SEQ ID NO: 343092 - DNA, 16 bp, M. musculus
aagatctatgacttca

SEQ ID NO: 343093 - DNA, 16 bp, M. musculus
aagatctcacaagatg

SEQ ID NO: 343094 - DNA, 16 bp, M. musculus
aagatctcagaaaata

SEQ ID NO: 343095 - DNA, 48 bp, M. musculus
aagatctcagaagatggaaagatctcccatgctcatggattggcagga

SEQ ID NO: 343096 - DNA, 16 bp, M. musculus
aagatctcagaggatg

SEQ ID NO: 343097 - DNA, 16 bp, M. musculus
aagatctctcaaacat

SEQ ID NO: 343098 - DNA, 16 bp, M. musculus
aagatctgatgtcctc

SEQ ID NO: 343099 - DNA, 16 bp, M. musculus
aagatctggccataga

SEQ ID NO: 343100 - DNA, 16 bp, M. musculus
aagatctgggggtact

SEQ ID NO: 343101 - DNA, 16 bp, M. musculus
aagatctgtattataa

SEQ ID NO: 343102 - DNA, 16 bp, M. musculus
aagatctgtctcaaaa

SEQ ID NO: 343103 - DNA, 17 bp, M. musculus
aagatcttaaagaggaa

SEQ ID NO: 343104 - DNA, 16 bp, M. musculus
aagatcttcaagtctc

SEQ ID NO: 343105 - DNA, 16 bp, M. musculus
aagatcttctatgctc

SEQ ID NO: 343106 - DNA, 16 bp, M. musculus
aagatcttctggcttt

SEQ ID NO: 343107 - DNA, 16 bp, M. musculus
aagatcttttcccatt

SEQ ID NO: 343108 - DNA, 16 bp, M. musculus
aagatgaaagcatttt

SEQ ID NO: 343109 - DNA, 16 bp, M. musculus
aagatgaaagtgtgga

SEQ ID NO: 343110 - DNA, 16 bp, M. musculus
aagatgaaatctcaaa

SEQ ID NO: 343111 - DNA, 16 bp, M. musculus
aagatgaacactcctc

SEQ ID NO: 343112 - DNA, 16 bp, M. musculus
aagatgaactctcact

SEQ ID NO: 343113 - DNA, 16 bp, M. musculus
aagatgaactttcaat

SEQ ID NO: 343114 - DNA, 16 bp, M. musculus
aagatgaagaattgac

SEQ ID NO: 343115 - DNA, 16 bp, M. musculus
aagatgaagatgagga

SEQ ID NO: 343116 - DNA, 16 bp, M. musculus
aagatgaagatgatga

SEQ ID NO: 343117 - DNA, 16 bp, M. musculus
aagatgaagcaaaaat

SEQ ID NO: 343118 - DNA, 16 bp, M. musculus
aagatgaagcaagaga

SEQ ID NO: 343119 - DNA, 16 bp, M. musculus
aagatgaaggcagaga

SEQ ID NO: 343120 - DNA, 16 bp, M. musculus
aagatgaagtcctgaa

SEQ ID NO: 343121 - DNA, 16 bp, M. musculus
aagatgaatggatgga

SEQ ID NO: 343122 - DNA, 16 bp, M. musculus
aagatgaatttgagaa

SEQ ID NO: 343123 - DNA, 16 bp, M. musculus
aagatgaccctgaact

SEQ ID NO: 343124 - DNA, 16 bp, M. musculus
aagatgaccttgaact

SEQ ID NO: 343125 - DNA, 16 bp, M. musculus
aagatgaccttgagtt

SEQ ID NO: 343126 - DNA, 17 bp, M. musculus
aagatgacttccttaca

SEQ ID NO: 343127 - DNA, 16 bp, M. musculus
aagatgactttttttt

SEQ ID NO: 343128 - DNA, 16 bp, M. musculus
aagatgaggaaggaca

SEQ ID NO: 343129 - DNA, 16 bp, M. musculus
aagatgaggaggatga

SEQ ID NO: 343130 - DNA, 16 bp, M. musculus
aagatgagtggggatg

SEQ ID NO: 343131 - DNA, 16 bp, M. musculus
aagatgatattttaaa

SEQ ID NO: 343132 - DNA, 16 bp, M. musculus
aagatgatcatgtggt

SEQ ID NO: 343133 - DNA, 16 bp, M. musculus
aagatgatccaacttg

SEQ ID NO: 343134 - DNA, 16 bp, M. musculus
aagatgatctcagaag

SEQ ID NO: 343135 - DNA, 16 bp, M. musculus
aagatgatgatgatga

SEQ ID NO: 343136 - DNA, 16 bp, M. musculus
aagatgatttcttttt

SEQ ID NO: 343137 - DNA, 16 bp, M. musculus
aagatgcaagaccaac

SEQ ID NO: 343138 - DNA, 16 bp, M. musculus
aagatgcaccaaaccc

SEQ ID NO: 343139 - DNA, 16 bp, M. musculus
aagatgcagaaatgaa

SEQ ID NO: 343140 - DNA, 16 bp, M. musculus
aagatgcagatatttg

SEQ ID NO: 343141 - DNA, 16 bp, M. musculus
aagatgccacatacct

SEQ ID NO: 343142 - DNA, 16 bp, M. musculus
aagatgccatagaaaa

SEQ ID NO: 343143 - DNA, 16 bp, M. musculus
aagatgccccaactga

SEQ ID NO: 343144 - DNA, 16 bp, M. musculus
aagatgccccaactgt

SEQ ID NO: 343145 - DNA, 16 bp, M. musculus
aagatgctgacaaatt

SEQ ID NO: 343146 - DNA, 16 bp, M. musculus
aagatgctgcagagag

SEQ ID NO: 343147 - DNA, 16 bp, M. musculus
aagatgcttgccacca

SEQ ID NO: 343148 - DNA, 16 bp, M. musculus
aagatgcttgctgcca

SEQ ID NO: 343149 - DNA, 16 bp, M. musculus
aagatgctttcctttt

SEQ ID NO: 343150 - DNA, 16 bp, M. musculus
aagatgctttcttttg

SEQ ID NO: 343151 - DNA, 16 bp, M. musculus
aagatgcttttctttt

SEQ ID NO: 343152 - DNA, 16 bp, M. musculus
aagatggaacaaaata

SEQ ID NO: 343153 - DNA, 16 bp, M. musculus
aagatggaacacaggt

SEQ ID NO: 343154 - DNA, 16 bp, M. musculus
aagatggaacagaaat

SEQ ID NO: 343155 - DNA, 16 bp, M. musculus
aagatggaatctcaag

SEQ ID NO: 343156 - DNA, 16 bp, M. musculus
aagatggacagacaga

SEQ ID NO: 343157 - DNA, 16 bp, M. musculus
aagatggacattttca

SEQ ID NO: 343158 - DNA, 16 bp, M. musculus
aagatggactagttgg

SEQ ID NO: 343159 - DNA, 16 bp, M. musculus
aagatggagagagaat

SEQ ID NO: 343160 - DNA, 16 bp, M. musculus
aagatggagcagaacc

SEQ ID NO: 343161 - DNA, 16 bp, M. musculus
aagatggagcagagaa

SEQ ID NO: 343162 - DNA, 16 bp, M. musculus
aagatggaggaacaga

SEQ ID NO: 343163 - DNA, 16 bp, M. musculus
aagatggaggcagaga

SEQ ID NO: 343164 - DNA, 16 bp, M. musculus
aagatggaggcagagg

SEQ ID NO: 343165 - DNA, 16 bp, M. musculus
aagatggcaggggtgg

SEQ ID NO: 343166 - DNA, 16 bp, M. musculus
aagatggcatagtcag

SEQ ID NO: 343167 - DNA, 16 bp, M. musculus
aagatggccacatgaa

SEQ ID NO: 343168 - DNA, 16 bp, M. musculus
aagatggccattttaa

SEQ ID NO: 343169 - DNA, 16 bp, M. musculus
aagatggcccagcagt

SEQ ID NO: 343170 - DNA, 16 bp, M. musculus
aagatggcctggtcag

SEQ ID NO: 343171 - DNA, 33 bp, M. musculus
aagatggcgccgcccagaagctctgcgactctc

SEQ ID NO: 343172 - DNA, 16 bp, M. musculus
aagatggcgctgacag

SEQ ID NO: 343173 - DNA, 16 bp, M. musculus
aagatggctcagcagg

SEQ ID NO: 343174 - DNA, 16 bp, M. musculus
aagatggctcagcagt

SEQ ID NO: 343175 - DNA, 16 bp, M. musculus
aagatggctcagcggg

SEQ ID NO: 343176 - DNA, 18 bp, M. musculus
aagatggctcagcggtta

SEQ ID NO: 343177 - DNA, 16 bp, M. musculus
aagatggctcagctgg

SEQ ID NO: 343178 - DNA, 16 bp, M. musculus
aagatggctcagctgt

SEQ ID NO: 343179 - DNA, 16 bp, M. musculus
aagatggctcagtgag

SEQ ID NO: 343180 - DNA, 19 bp, M. musculus
aagatggctcagtggttaa

SEQ ID NO: 343181 - DNA, 16 bp, M. musculus
aagatggctcccacag

SEQ ID NO: 343182 - DNA, 16 bp, M. musculus
aagatggctgcagaga

SEQ ID NO: 343183 - DNA, 16 bp, M. musculus
aagatggcttttaagc

SEQ ID NO: 343184 - DNA, 16 bp, M. musculus
aagatgggctcctcag

SEQ ID NO: 343185 - DNA, 16 bp, M. musculus
aagatggggaaggaca

SEQ ID NO: 343186 - DNA, 17 bp, M. musculus
aagatgggggtgcccta

SEQ ID NO: 343187 - DNA, 16 bp, M. musculus
aagatgggtcttccca

SEQ ID NO: 343188 - DNA, 16 bp, M. musculus
aagatggtgccgcctc

SEQ ID NO: 343189 - DNA, 16 bp, M. musculus
aagatggtgtgtgtgt

SEQ ID NO: 343190 - DNA, 16 bp, M. musculus
aagatggttcagtgga

SEQ ID NO: 343191 - DNA, 16 bp, M. musculus
aagatggttcagtggt

SEQ ID NO: 343192 - DNA, 16 bp, M. musculus
aagatgtaaaacaatc

SEQ ID NO: 343193 - DNA, 21 bp, M. musculus
aagatgtaaaacaatccataa

SEQ ID NO: 343194 - DNA, 16 bp, M. musculus
aagatgtaaaactctt

SEQ ID NO: 343195 - DNA, 16 bp, M. musculus
aagatgtactgtcttg

SEQ ID NO: 343196 - DNA, 17 bp, M. musculus
aagatgtactgtcttgt

SEQ ID NO: 343197 - DNA, 16 bp, M. musculus
aagatgtatggacaga

SEQ ID NO: 343198 - DNA, 16 bp, M. musculus
aagatgtctgcagctg

SEQ ID NO: 343199 - DNA, 16 bp, M. musculus
aagatgtcttagtcag

SEQ ID NO: 343200 - DNA, 16 bp, M. musculus
aagatgtgcagagaca

SEQ ID NO: 343201 - DNA, 16 bp, M. musculus
aagatgtggaagatgg

SEQ ID NO: 343202 - DNA, 16 bp, M. musculus
aagatgtgtgccacca

SEQ ID NO: 343203 - DNA, 16 bp, M. musculus
aagatgtgtggacaga

SEQ ID NO: 343204 - DNA, 16 bp, M. musculus
aagatgttaaagatgc

SEQ ID NO: 343205 - DNA, 16 bp, M. musculus
aagatgttagagatgc

SEQ ID NO: 343206 - DNA, 16 bp, M. musculus
aagatgttcagggata

SEQ ID NO: 343207 - DNA, 16 bp, M. musculus
aagatgttccagctgg

SEQ ID NO: 343208 - DNA, 16 bp, M. musculus
aagatgttgaatattt

SEQ ID NO: 343209 - DNA, 16 bp, M. musculus
aagatgtttatcaggt

SEQ ID NO: 343210 - DNA, 16 bp, M. musculus
aagatgttttaaattt

SEQ ID NO: 343211 - DNA, 16 bp, M. musculus
aagatgttttatgtaa

SEQ ID NO: 343212 - DNA, 16 bp, M. musculus
aagatgttttcttttt

SEQ ID NO: 343213 - DNA, 16 bp, M. musculus
aagattaccagtccag

SEQ ID NO: 343214 - DNA, 16 bp, M. musculus
aagattaggttttagt

SEQ ID NO: 343215 - DNA, 16 bp, M. musculus
aagattatagaggaaa

SEQ ID NO: 343216 - DNA, 16 bp, M. musculus
aagattatattaaagc

SEQ ID NO: 343217 - DNA, 16 bp, M. musculus
aagattattatgacat

SEQ ID NO: 343218 - DNA, 16 bp, M. musculus
aagattatttctccca

SEQ ID NO: 343219 - DNA, 16 bp, M. musculus
aagattattttcttac

SEQ ID NO: 343220 - DNA, 16 bp, M. musculus
aagattcagaatctgt

SEQ ID NO: 343221 - DNA, 16 bp, M. musculus
aagattccaaagagaa

SEQ ID NO: 343222 - DNA, 16 bp, M. musculus
aagattccacctcaca

SEQ ID NO: 343223 - DNA, 16 bp, M. musculus
aagattccatcttata

SEQ ID NO: 343224 - DNA, 16 bp, M. musculus
aagattccctggaact

SEQ ID NO: 343225 - DNA, 17 bp, M. musculus
aagattccttctgctga

SEQ ID NO: 343226 - DNA, 16 bp, M. musculus
aagattctctgatgat

SEQ ID NO: 343227 - DNA, 16 bp, M. musculus
aagattctgtggtttt

SEQ ID NO: 343228 - DNA, 16 bp, M. musculus
aagattcttctgctga

SEQ ID NO: 343229 - DNA, 16 bp, M. musculus
aagattcttttctttt

SEQ ID NO: 343230 - DNA, 16 bp, M. musculus
aagattgagggaccca

SEQ ID NO: 343231 - DNA, 19 bp, M. musculus
aagattgccacctgacctt

SEQ ID NO: 343232 - DNA, 16 bp, M. musculus
aagattggaatcaccc

SEQ ID NO: 343233 - DNA, 16 bp, M. musculus
aagattggacaaacaa

SEQ ID NO: 343234 - DNA, 16 bp, M. musculus
aagattggatttaagg

SEQ ID NO: 343235 - DNA, 16 bp, M. musculus
aagattgtaagaatca

SEQ ID NO: 343236 - DNA, 16 bp, M. musculus
aagattgtaagggcca

SEQ ID NO: 343237 - DNA, 16 bp, M. musculus
aagattgtctggtgtt

SEQ ID NO: 343238 - DNA, 16 bp, M. musculus
aagatttacttattat

SEQ ID NO: 343239 - DNA, 16 bp, M. musculus
aagatttagatttaaa

SEQ ID NO: 343240 - DNA, 16 bp, M. musculus
aagatttattatatgt

SEQ ID NO: 343241 - DNA, 16 bp, M. musculus
aagatttattttgact

SEQ ID NO: 343242 - DNA, 16 bp, M. musculus
aagatttcaaagaaaa

SEQ ID NO: 343243 - DNA, 16 bp, M. musculus
aagatttctgctatta

SEQ ID NO: 343244 - DNA, 16 bp, M. musculus
aagatttgtttttaaa

SEQ ID NO: 343245 - DNA, 16 bp, M. musculus
aagatttgtttttctt

SEQ ID NO: 343246 - DNA, 16 bp, M. musculus
aagattttaaaaacta

SEQ ID NO: 343247 - DNA, 16 bp, M. musculus
aagattttaaagctct

SEQ ID NO: 343248 - DNA, 16 bp, M. musculus
aagattttattgaaag

SEQ ID NO: 343249 - DNA, 16 bp, M. musculus
aagattttgctggaag

SEQ ID NO: 343250 - DNA, 16 bp, M. musculus
aagatttttacatttg

SEQ ID NO: 343251 - DNA, 16 bp, M. musculus
aagatttttacctttg

SEQ ID NO: 343252 - DNA, 16 bp, M. musculus
aagatttttttccttt

SEQ ID NO: 343253 - DNA, 16 bp, M. musculus
aagatttttttctcaa

SEQ ID NO: 343254 - DNA, 16 bp, M. musculus
aagattttttttccct

SEQ ID NO: 343255 - DNA, 16 bp, M. musculus
aagatttttttttact

SEQ ID NO: 343256 - DNA, 16 bp, M. musculus
aagatttttttttctc

SEQ ID NO: 343257 - DNA, 16 bp, M. musculus
aagcaaaaagaaatcc

SEQ ID NO: 343258 - DNA, 16 bp, M. musculus
aagcaaaaataaatct

SEQ ID NO: 343259 - DNA, 16 bp, M. musculus
aagcaaaagaccagta

SEQ ID NO: 343260 - DNA, 16 bp, M. musculus
aagcaaaagctttgca

SEQ ID NO: 343261 - DNA, 16 bp, M. musculus
aagcaaaatgtttcag

SEQ ID NO: 343262 - DNA, 16 bp, M. musculus
aagcaaacaagcaagc

SEQ ID NO: 343263 - DNA, 16 bp, M. musculus
aagcaaacatttaaaa

SEQ ID NO: 343264 - DNA, 16 bp, M. musculus
aagcaaaccaggagct

SEQ ID NO: 343265 - DNA, 16 bp, M. musculus
aagcaaacctccaatt

SEQ ID NO: 343266 - DNA, 16 bp, M. musculus
aagcaaactgtccgaa

SEQ ID NO: 343267 - DNA, 16 bp, M. musculus
aagcaaagatttgaag

SEQ ID NO: 343268 - DNA, 16 bp, M. musculus
aagcaaaggcaggagg

SEQ ID NO: 343269 - DNA, 16 bp, M. musculus
aagcaaagtcctgtga

SEQ ID NO: 343270 - DNA, 16 bp, M. musculus
aagcaaatacacccaa

SEQ ID NO: 343271 - DNA, 16 bp, M. musculus
aagcaaatagtccaaa

SEQ ID NO: 343272 - DNA, 16 bp, M. musculus
aagcaaatctctgagt

SEQ ID NO: 343273 - DNA, 16 bp, M. musculus
aagcaaatctttaaaa

SEQ ID NO: 343274 - DNA, 16 bp, M. musculus
aagcaaatgaatgaaa

SEQ ID NO: 343275 - DNA, 16 bp, M. musculus
aagcaaatgaatggaa

SEQ ID NO: 343276 - DNA, 16 bp, M. musculus
aagcaaattccaggac

SEQ ID NO: 343277 - DNA, 16 bp, M. musculus
aagcaaattttaaaat

SEQ ID NO: 343278 - DNA, 16 bp, M. musculus
aagcaacacagctttt

SEQ ID NO: 343279 - DNA, 16 bp, M. musculus
aagcaacagaaagccc

SEQ ID NO: 343280 - DNA, 16 bp, M. musculus
aagcaacagaagtcaa

SEQ ID NO: 343281 - DNA, 16 bp, M. musculus
aagcaacagaatccaa

SEQ ID NO: 343282 - DNA, 16 bp, M. musculus
aagcaacagaggaaca

SEQ ID NO: 343283 - DNA, 16 bp, M. musculus
aagcaacaggatctga

SEQ ID NO: 343284 - DNA, 16 bp, M. musculus
aagcaacatccctcca

SEQ ID NO: 343285 - DNA, 16 bp, M. musculus
aagcaaccaagcaagc

SEQ ID NO: 343286 - DNA, 16 bp, M. musculus
aagcaaccacattctt

SEQ ID NO: 343287 - DNA, 16 bp, M. musculus
aagcaaccccaaaatt

SEQ ID NO: 343288 - DNA, 16 bp, M. musculus
aagcaactcagggagg

SEQ ID NO: 343289 - DNA, 17 bp, M. musculus
aagcaactgaaaaaatg

SEQ ID NO: 343290 - DNA, 16 bp, M. musculus
aagcaacttaaggaaa

SEQ ID NO: 343291 - DNA, 16 bp, M. musculus
aagcaacttaaggaag

SEQ ID NO: 343292 - DNA, 16 bp, M. musculus
aagcaacttaagggag

SEQ ID NO: 343293 - DNA, 16 bp, M. musculus
aagcaacttgaggaag

SEQ ID NO: 343294 - DNA, 16 bp, M. musculus
aagcaacttggggagg

SEQ ID NO: 343295 - DNA, 16 bp, M. musculus
aagcaagaacctggag

SEQ ID NO: 343296 - DNA, 16 bp, M. musculus
aagcaagaagaaaatg

SEQ ID NO: 343297 - DNA, 16 bp, M. musculus
aagcaagacagtaaag

SEQ ID NO: 343298 - DNA, 16 bp, M. musculus
aagcaagagagagagc

SEQ ID NO: 343299 - DNA, 16 bp, M. musculus
aagcaagagctgattc

SEQ ID NO: 343300 - DNA, 16 bp, M. musculus
aagcaagaggacctga

SEQ ID NO: 343301 - DNA, 16 bp, M. musculus
aagcaagatttgaatt

SEQ ID NO: 343302 - DNA, 16 bp, M. musculus
aagcaagcaaaagagt

SEQ ID NO: 343303 - DNA, 17 bp, M. musculus
aagcaagcaagcaagca

SEQ ID NO: 343304 - DNA, 16 bp, M. musculus
aagcaagcaagcaagg

SEQ ID NO: 343305 - DNA, 16 bp, M. musculus
aagcaagcaagcagac

SEQ ID NO: 343306 - DNA, 16 bp, M. musculus
aagcaagcaagcaggc

SEQ ID NO: 343307 - DNA, 16 bp, M. musculus
aagcaagcaagctgag

SEQ ID NO: 343308 - DNA, 16 bp, M. musculus
aagcaagcaattaatt

SEQ ID NO: 343309 - DNA, 16 bp, M. musculus
aagcaagcagatttct

SEQ ID NO: 343310 - DNA, 16 bp, M. musculus
aagcaagccagtgagt

SEQ ID NO: 343311 - DNA, 16 bp, M. musculus
aagcaagccatgagga

SEQ ID NO: 343312 - DNA, 17 bp, M. musculus
aagcaaggaaatgatga

SEQ ID NO: 343313 - DNA, 16 bp, M. musculus
aagcaagtcagaaagc

SEQ ID NO: 343314 - DNA, 16 bp, M. musculus
aagcaagtgttctacc

SEQ ID NO: 343315 - DNA, 16 bp, M. musculus
aagcaagttacagaag

SEQ ID NO: 343316 - DNA, 18 bp, M. musculus
aagcaataaaagctttgc

SEQ ID NO: 343317 - DNA, 16 bp, M. musculus
aagcaataaagtaatc

SEQ ID NO: 343318 - DNA, 16 bp, M. musculus
aagcaataatttttat

SEQ ID NO: 343319 - DNA, 16 bp, M. musculus
aagcaatacaaggatg

SEQ ID NO: 343320 - DNA, 16 bp, M. musculus
aagcaataggttgctg

SEQ ID NO: 343321 - DNA, 16 bp, M. musculus
aagcaattgagaaaga

SEQ ID NO: 343322 - DNA, 16 bp, M. musculus
aagcaatttaattttt

SEQ ID NO: 343323 - DNA, 16 bp, M. musculus
aagcaatttgaagaaa

SEQ ID NO: 343324 - DNA, 16 bp, M. musculus
aagcaatttttaaaaa

SEQ ID NO: 343325 - DNA, 16 bp, M. musculus
aagcaatttttaactt

SEQ ID NO: 343326 - DNA, 16 bp, M. musculus
aagcacaaaaatccat

SEQ ID NO: 343327 - DNA, 16 bp, M. musculus
aagcacaaaaatcctt

SEQ ID NO: 343328 - DNA, 16 bp, M. musculus
aagcacaaaaatcgct

SEQ ID NO: 343329 - DNA, 16 bp, M. musculus
aagcacaaaaattcct

SEQ ID NO: 343330 - DNA, 16 bp, M. musculus
aagcacaaagacctga

SEQ ID NO: 343331 - DNA, 16 bp, M. musculus
aagcacaagaggaatt

SEQ ID NO: 343332 - DNA, 16 bp, M. musculus
aagcacaaggacctgg

SEQ ID NO: 343333 - DNA, 16 bp, M. musculus
aagcacaaggcctgga

SEQ ID NO: 343334 - DNA, 16 bp, M. musculus
aagcacacatacacat

SEQ ID NO: 343335 - DNA, 16 bp, M. musculus
aagcacactggctgct

SEQ ID NO: 343336 - DNA, 16 bp, M. musculus
aagcacagaaatatta

SEQ ID NO: 343337 - DNA, 16 bp, M. musculus
aagcacagagagatga

SEQ ID NO: 343338 - DNA, 16 bp, M. musculus
aagcacagcctccact

SEQ ID NO: 343339 - DNA, 16 bp, M. musculus
aagcacagggcctgca

SEQ ID NO: 343340 - DNA, 16 bp, M. musculus
aagcacagtaataaaa

SEQ ID NO: 343341 - DNA, 16 bp, M. musculus
aagcacatattttaaa

SEQ ID NO: 343342 - DNA, 16 bp, M. musculus
aagcacatcccctccc

SEQ ID NO: 343343 - DNA, 16 bp, M. musculus
aagcacatgctggcct

SEQ ID NO: 343344 - DNA, 16 bp, M. musculus
aagcacatgttgtctg

SEQ ID NO: 343345 - DNA, 16 bp, M. musculus
aagcaccagtccctaa

SEQ ID NO: 343346 - DNA, 16 bp, M. musculus
aagcaccagtgcagaa

SEQ ID NO: 343347 - DNA, 16 bp, M. musculus
aagcacccagctgacc

SEQ ID NO: 343348 - DNA, 16 bp, M. musculus
aagcacccaggaaaca

SEQ ID NO: 343349 - DNA, 16 bp, M. musculus
aagcacccttacctgc

SEQ ID NO: 343350 - DNA, 16 bp, M. musculus
aagcacctaaagcaat

SEQ ID NO: 343351 - DNA, 16 bp, M. musculus
aagcacctacactttg

SEQ ID NO: 343352 - DNA, 16 bp, M. musculus
aagcaccttcacctgc

SEQ ID NO: 343353 - DNA, 16 bp, M. musculus
aagcacgaggacctga

SEQ ID NO: 343354 - DNA, 16 bp, M. musculus
aagcactcttccactg

SEQ ID NO: 343355 - DNA, 16 bp, M. musculus
aagcactgactactct

SEQ ID NO: 343356 - DNA, 16 bp, M. musculus
aagcactggctattct

SEQ ID NO: 343357 - DNA, 16 bp, M. musculus
aagcactggcttctct

SEQ ID NO: 343358 - DNA, 16 bp, M. musculus
aagcacttaaagaaac

SEQ ID NO: 343359 - DNA, 16 bp, M. musculus
aagcacttacagaaat

SEQ ID NO: 343360 - DNA, 16 bp, M. musculus
aagcacttagtgctat

SEQ ID NO: 343361 - DNA, 16 bp, M. musculus
aagcacttcatcttcc

SEQ ID NO: 343362 - DNA, 16 bp, M. musculus
aagcacttcttactaa

SEQ ID NO: 343363 - DNA, 16 bp, M. musculus
aagcacttcttggcat

SEQ ID NO: 343364 - DNA, 16 bp, M. musculus
aagcacttgaagaaat

SEQ ID NO: 343365 - DNA, 16 bp, M. musculus
aagcacttttatccac

SEQ ID NO: 343366 - DNA, 16 bp, M. musculus
aagcacttttattttt

SEQ ID NO: 343367 - DNA, 16 bp, M. musculus
aagcactttttaaaaa

SEQ ID NO: 343368 - DNA, 16 bp, M. musculus
aagcagaaaacatgga

SEQ ID NO: 343369 - DNA, 16 bp, M. musculus
aagcagaaaactggcc

SEQ ID NO: 343370 - DNA, 16 bp, M. musculus
aagcagaaatagaata

SEQ ID NO: 343371 - DNA, 16 bp, M. musculus
aagcagaaattatgaa

SEQ ID NO: 343372 - DNA, 16 bp, M. musculus
aagcagaagaaaatga

SEQ ID NO: 343373 - DNA, 16 bp, M. musculus
aagcagaagaatgggg

SEQ ID NO: 343374 - DNA, 16 bp, M. musculus
aagcagaagcaagagg

SEQ ID NO: 343375 - DNA, 16 bp, M. musculus
aagcagaagcaagtgg

SEQ ID NO: 343376 - DNA, 16 bp, M. musculus
aagcagaagcagaggc

SEQ ID NO: 343377 - DNA, 16 bp, M. musculus
aagcagaagcagatgg

SEQ ID NO: 343378 - DNA, 16 bp, M. musculus
aagcagaagcaggagg

SEQ ID NO: 343379 - DNA, 16 bp, M. musculus
aagcagaagcaggcag

SEQ ID NO: 343380 - DNA, 16 bp, M. musculus
aagcagaagccacaga

SEQ ID NO: 343381 - DNA, 16 bp, M. musculus
aagcagaagccatgga

SEQ ID NO: 343382 - DNA, 16 bp, M. musculus
aagcagaagctgatgc

SEQ ID NO: 343383 - DNA, 16 bp, M. musculus
aagcagaagctggaaa

SEQ ID NO: 343384 - DNA, 16 bp, M. musculus
aagcagaaggcagaga

SEQ ID NO: 343385 - DNA, 16 bp, M. musculus
aagcagaattaacatc

SEQ ID NO: 343386 - DNA, 16 bp, M. musculus
aagcagacctccctgg

SEQ ID NO: 343387 - DNA, 16 bp, M. musculus
aagcagagaactgact

SEQ ID NO: 343388 - DNA, 16 bp, M. musculus
aagcagagaagcagag

SEQ ID NO: 343389 - DNA, 16 bp, M. musculus
aagcagagacaggtgg

SEQ ID NO: 343390 - DNA, 16 bp, M. musculus
aagcagagaccacaga

SEQ ID NO: 343391 - DNA, 16 bp, M. musculus
aagcagagactgaagg

SEQ ID NO: 343392 - DNA, 16 bp, M. musculus
aagcagagactgtgga

SEQ ID NO: 343393 - DNA, 16 bp, M. musculus
aagcagagagaaattt

SEQ ID NO: 343394 - DNA, 16 bp, M. musculus
aagcagagagagcagg

SEQ ID NO: 343395 - DNA, 16 bp, M. musculus
aagcagagagaggtga

SEQ ID NO: 343396 - DNA, 16 bp, M. musculus
aagcagagagagtgaa

SEQ ID NO: 343397 - DNA, 16 bp, M. musculus
aagcagagagcaatga

SEQ ID NO: 343398 - DNA, 16 bp, M. musculus
aagcagagagcacaga

SEQ ID NO: 343399 - DNA, 16 bp, M. musculus
aagcagagagctcaga

SEQ ID NO: 343400 - DNA, 16 bp, M. musculus
aagcagagagtgaaca

SEQ ID NO: 343401 - DNA, 16 bp, M. musculus
aagcagagagtgatga

SEQ ID NO: 343402 - DNA, 16 bp, M. musculus
aagcagagagttctca

SEQ ID NO: 343403 - DNA, 16 bp, M. musculus
aagcagagctgagagt

SEQ ID NO: 343404 - DNA, 16 bp, M. musculus
aagcagaggaaggcag

SEQ ID NO: 343405 - DNA, 16 bp, M. musculus
aagcagaggcaagtag

SEQ ID NO: 343406 - DNA, 16 bp, M. musculus
aagcagaggcagccac

SEQ ID NO: 343407 - DNA, 16 bp, M. musculus
aagcagaggcaggaga

SEQ ID NO: 343408 - DNA, 16 bp, M. musculus
aagcagaggcaggcag

SEQ ID NO: 343409 - DNA, 16 bp, M. musculus
aagcagaggccagaaa

SEQ ID NO: 343410 - DNA, 16 bp, M. musculus
aagcagaggctatgga

SEQ ID NO: 343411 - DNA, 16 bp, M. musculus
aagcagagggcagagg

SEQ ID NO: 343412 - DNA, 16 bp, M. musculus
aagcagatccctgggg

SEQ ID NO: 343413 - DNA, 16 bp, M. musculus
aagcagatgaaagagt

SEQ ID NO: 343414 - DNA, 16 bp, M. musculus
aagcagatgaagaatc

SEQ ID NO: 343415 - DNA, 16 bp, M. musculus
aagcagatttttaaaa

SEQ ID NO: 343416 - DNA, 16 bp, M. musculus
aagcagcaaatgttgg

SEQ ID NO: 343417 - DNA, 16 bp, M. musculus
aagcagcaacagcagc

SEQ ID NO: 343418 - DNA, 16 bp, M. musculus
aagcagcaagaagcag

SEQ ID NO: 343419 - DNA, 16 bp, M. musculus
aagcagcaagaagctg

SEQ ID NO: 343420 - DNA, 16 bp, M. musculus
aagcagcacccttcca

SEQ ID NO: 343421 - DNA, 16 bp, M. musculus
aagcagcactccccca

SEQ ID NO: 343422 - DNA, 16 bp, M. musculus
aagcagcactcctcca

SEQ ID NO: 343423 - DNA, 16 bp, M. musculus
aagcagcactccttca

SEQ ID NO: 343424 - DNA, 16 bp, M. musculus
aagcagcagaacttgg

SEQ ID NO: 343425 - DNA, 16 bp, M. musculus
aagcagcagcaacagc

SEQ ID NO: 343426 - DNA, 16 bp, M. musculus
aagcagcagcagaaga

SEQ ID NO: 343427 - DNA, 16 bp, M. musculus
aagcagcagcagcagt

SEQ ID NO: 343428 - DNA, 16 bp, M. musculus
aagcagcagcaggaga

SEQ ID NO: 343429 - DNA, 16 bp, M. musculus
aagcagcagtgtgcat

SEQ ID NO: 343430 - DNA, 16 bp, M. musculus
aagcagcataatgttg

SEQ ID NO: 343431 - DNA, 16 bp, M. musculus
aagcagcatcagacca

SEQ ID NO: 343432 - DNA, 16 bp, M. musculus
aagcagccaggaggag

SEQ ID NO: 343433 - DNA, 16 bp, M. musculus
aagcagccatgtttaa

SEQ ID NO: 343434 - DNA, 16 bp, M. musculus
aagcagccccatatcc

SEQ ID NO: 343435 - DNA, 16 bp, M. musculus
aagcagcccccctcca

SEQ ID NO: 343436 - DNA, 16 bp, M. musculus
aagcagccgggcgtgg

SEQ ID NO: 343437 - DNA, 16 bp, M. musculus
aagcagcctgggacag

SEQ ID NO: 343438 - DNA, 16 bp, M. musculus
aagcagctcttgaaga

SEQ ID NO: 343439 - DNA, 16 bp, M. musculus
aagcagctgaaagagc

SEQ ID NO: 343440 - DNA, 16 bp, M. musculus
aagcagctgaaagagt

SEQ ID NO: 343441 - DNA, 16 bp, M. musculus
aagcagctgaaggagt

SEQ ID NO: 343442 - DNA, 16 bp, M. musculus
aagcagctgaatgagt

SEQ ID NO: 343443 - DNA, 16 bp, M. musculus
aagcagctgacccctg

SEQ ID NO: 343444 - DNA, 16 bp, M. musculus
aagcagctgagccctg

SEQ ID NO: 343445 - DNA, 16 bp, M. musculus
aagcagcttctggaag

SEQ ID NO: 343446 - DNA, 16 bp, M. musculus
aagcagcttggggaga

SEQ ID NO: 343447 - DNA, 16 bp, M. musculus
aagcaggaactgaagc

SEQ ID NO: 343448 - DNA, 16 bp, M. musculus
aagcaggaagattgct

SEQ ID NO: 343449 - DNA, 16 bp, M. musculus
aagcaggaagcagaga

SEQ ID NO: 343450 - DNA, 16 bp, M. musculus
aagcaggagaacctga

SEQ ID NO: 343451 - DNA, 16 bp, M. musculus
aagcaggagaatcagg

SEQ ID NO: 343452 - DNA, 16 bp, M. musculus
aagcaggagacacatc

SEQ ID NO: 343453 - DNA, 16 bp, M. musculus
aagcaggagacagaga

SEQ ID NO: 343454 - DNA, 16 bp, M. musculus
aagcaggagagctggc

SEQ ID NO: 343455 - DNA, 16 bp, M. musculus
aagcaggagcctggag

SEQ ID NO: 343456 - DNA, 16 bp, M. musculus
aagcaggagctaatgc

SEQ ID NO: 343457 - DNA, 16 bp, M. musculus
aagcaggagctgatgc

SEQ ID NO: 343458 - DNA, 16 bp, M. musculus
aagcaggagctggtgc

SEQ ID NO: 343459 - DNA, 16 bp, M. musculus
aagcaggaggagcagg

SEQ ID NO: 343460 - DNA, 16 bp, M. musculus
aagcaggaggcagaag

SEQ ID NO: 343461 - DNA, 16 bp, M. musculus
aagcaggaggcagaga

SEQ ID NO: 343462 - DNA, 16 bp, M. musculus
aagcaggagggtcagg

SEQ ID NO: 343463 - DNA, 16 bp, M. musculus
aagcaggattttggcc

SEQ ID NO: 343464 - DNA, 16 bp, M. musculus
aagcaggcagatctct

SEQ ID NO: 343465 - DNA, 16 bp, M. musculus
aagcaggcaggtctct

SEQ ID NO: 343466 - DNA, 16 bp, M. musculus
aagcaggcatctgagg

SEQ ID NO: 343467 - DNA, 16 bp, M. musculus
aagcaggcatggtgct

SEQ ID NO: 343468 - DNA, 16 bp, M. musculus
aagcaggccagtaagt

SEQ ID NO: 343469 - DNA, 16 bp, M. musculus
aagcaggctcagcaag

SEQ ID NO: 343470 - DNA, 16 bp, M. musculus
aagcaggctgaccaag

SEQ ID NO: 343471 - DNA, 16 bp, M. musculus
aagcaggctgagcaag

SEQ ID NO: 343472 - DNA, 16 bp, M. musculus
aagcaggctgagcagg

SEQ ID NO: 343473 - DNA, 16 bp, M. musculus
aagcaggctgagccag

SEQ ID NO: 343474 - DNA, 16 bp, M. musculus
aagcagggactgaggg

SEQ ID NO: 343475 - DNA, 16 bp, M. musculus
aagcagggcagggagc

SEQ ID NO: 343476 - DNA, 16 bp, M. musculus
aagcaggggaatgggg

SEQ ID NO: 343477 - DNA, 16 bp, M. musculus
aagcaggggccatgga

SEQ ID NO: 343478 - DNA, 16 bp, M. musculus
aagcagggtgagcaag

SEQ ID NO: 343479 - DNA, 16 bp, M. musculus
aagcaggtagaaaaaa

SEQ ID NO: 343480 - DNA, 16 bp, M. musculus
aagcaggtagttttta

SEQ ID NO: 343481 - DNA, 16 bp, M. musculus
aagcaggtgaagaaga

SEQ ID NO: 343482 - DNA, 16 bp, M. musculus
aagcaggtgaaggaga

SEQ ID NO: 343483 - DNA, 16 bp, M. musculus
aagcagtatccctcca

SEQ ID NO: 343484 - DNA, 18 bp, M. musculus
aagcagtcagtgctctta

SEQ ID NO: 343485 - DNA, 16 bp, M. musculus
aagcagtgaaggaaac

SEQ ID NO: 343486 - DNA, 16 bp, M. musculus
aagcagtggtctccaa

SEQ ID NO: 343487 - DNA, 16 bp, M. musculus
aagcagtgtttctcca

SEQ ID NO: 343488 - DNA, 16 bp, M. musculus
aagcagttacagagac

SEQ ID NO: 343489 - DNA, 16 bp, M. musculus
aagcagttattaaaag

SEQ ID NO: 343490 - DNA, 16 bp, M. musculus
aagcagttcttggcat

SEQ ID NO: 343491 - DNA, 16 bp, M. musculus
aagcagttggagagga

SEQ ID NO: 343492 - DNA, 16 bp, M. musculus
aagcagtttctgctgt

SEQ ID NO: 343493 - DNA, 16 bp, M. musculus
aagcataacagggtat

SEQ ID NO: 343494 - DNA, 16 bp, M. musculus
aagcataagaaacaca

SEQ ID NO: 343495 - DNA, 16 bp, M. musculus
aagcatagcaagctta

SEQ ID NO: 343496 - DNA, 16 bp, M. musculus
aagcatagcagaatat

SEQ ID NO: 343497 - DNA, 16 bp, M. musculus
aagcatatgccaccat

SEQ ID NO: 343498 - DNA, 16 bp, M. musculus
aagcatattaaaatca

SEQ ID NO: 343499 - DNA, 16 bp, M. musculus
aagcatattcaaacca

SEQ ID NO: 343500 - DNA, 16 bp, M. musculus
aagcatatttatttat

SEQ ID NO: 343501 - DNA, 16 bp, M. musculus
aagcatcagacttata

SEQ ID NO: 343502 - DNA, 16 bp, M. musculus
aagcatcctcccttag

SEQ ID NO: 343503 - DNA, 16 bp, M. musculus
aagcatccttgcttgg

SEQ ID NO: 343504 - DNA, 16 bp, M. musculus
aagcatgaagactgga

SEQ ID NO: 343505 - DNA, 16 bp, M. musculus
aagcatgacaacctga

SEQ ID NO: 343506 - DNA, 16 bp, M. musculus
aagcatgagaaactga

SEQ ID NO: 343507 - DNA, 16 bp, M. musculus
aagcatgaggacccaa

SEQ ID NO: 343508 - DNA, 16 bp, M. musculus
aagcatgagggcctga

SEQ ID NO: 343509 - DNA, 16 bp, M. musculus
aagcatggagcagaga

SEQ ID NO: 343510 - DNA, 16 bp, M. musculus
aagcatggcagcttcc

SEQ ID NO: 343511 - DNA, 16 bp, M. musculus
aagcatggcagtgtgc

SEQ ID NO: 343512 - DNA, 16 bp, M. musculus
aagcatgggattattt

SEQ ID NO: 343513 - DNA, 16 bp, M. musculus
aagcatggggacctga

SEQ ID NO: 343514 - DNA, 16 bp, M. musculus
aagcatgtcactgtgg

SEQ ID NO: 343515 - DNA, 16 bp, M. musculus
aagcatgtgccaccac

SEQ ID NO: 343516 - DNA, 16 bp, M. musculus
aagcatgtgctctacc

SEQ ID NO: 343517 - DNA, 16 bp, M. musculus
aagcatgtggagaaag

SEQ ID NO: 343518 - DNA, 16 bp, M. musculus
aagcatgtgtcaccac

SEQ ID NO: 343519 - DNA, 16 bp, M. musculus
aagcattattttaaac

SEQ ID NO: 343520 - DNA, 16 bp, M. musculus
aagcattatttttaaa

SEQ ID NO: 343521 - DNA, 16 bp, M. musculus
aagcattcaaacatag

SEQ ID NO: 343522 - DNA, 16 bp, M. musculus
aagcattcaaatacat

SEQ ID NO: 343523 - DNA, 16 bp, M. musculus
aagcattcaaatatga

SEQ ID NO: 343524 - DNA, 16 bp, M. musculus
aagcattcacactggt

SEQ ID NO: 343525 - DNA, 16 bp, M. musculus
aagcattgctgctgga

SEQ ID NO: 343526 - DNA, 16 bp, M. musculus
aagcatttatttaaaa

SEQ ID NO: 343527 - DNA, 16 bp, M. musculus
aagcatttgacaaaac

SEQ ID NO: 343528 - DNA, 16 bp, M. musculus
aagcatttgccaaaat

SEQ ID NO: 343529 - DNA, 16 bp, M. musculus
aagcatttgttgcaag

SEQ ID NO: 343530 - DNA, 16 bp, M. musculus
aagcattttctcaatt

SEQ ID NO: 343531 - DNA, 16 bp, M. musculus
aagcattttgtcacag

SEQ ID NO: 343532 - DNA, 16 bp, M. musculus
aagcatttttttaaat

SEQ ID NO: 343533 - DNA, 16 bp, M. musculus
aagcattttttttcaa

SEQ ID NO: 343534 - DNA, 16 bp, M. musculus
aagcatttttttttaa

SEQ ID NO: 343535 - DNA, 103 bp, M. musculus
aagccaaaagcggctggcgaaggccagtttgctgattggcctcagggcagtcggcttcaaggtccgccctatgcggagtccccgccctgcgtagtgcgtcagc

SEQ ID NO: 343536 - DNA, 16 bp, M. musculus
aagccaaaagtggctg

SEQ ID NO: 343537 - DNA, 16 bp, M. musculus
aagccaaacaaactct

SEQ ID NO: 343538 - DNA, 16 bp, M. musculus
aagccaaaccattcaa

SEQ ID NO: 343539 - DNA, 16 bp, M. musculus
aagccaaagccaaagc

SEQ ID NO: 343540 - DNA, 16 bp, M. musculus
aagccaaagcttatgg

SEQ ID NO: 343541 - DNA, 17 bp, M. musculus
aagccaaataaaccctt

SEQ ID NO: 343542 - DNA, 16 bp, M. musculus
aagccaaataacccct

SEQ ID NO: 343543 - DNA, 16 bp, M. musculus
aagccaaatctgaggt

SEQ ID NO: 343544 - DNA, 17 bp, M. musculus
aagccaacattcatgtg

SEQ ID NO: 343545 - DNA, 16 bp, M. musculus
aagccaagcatggtgg

SEQ ID NO: 343546 - DNA, 16 bp, M. musculus
aagccaagccaagcca

SEQ ID NO: 343547 - DNA, 16 bp, M. musculus
aagccaaggaagaaat

SEQ ID NO: 343548 - DNA, 16 bp, M. musculus
aagccaaggcaggaac

SEQ ID NO: 343549 - DNA, 16 bp, M. musculus
aagccaaggcaggaga

SEQ ID NO: 343550 - DNA, 16 bp, M. musculus
aagccaataagcaaca

SEQ ID NO: 343551 - DNA, 16 bp, M. musculus
aagccaatctggtcta

SEQ ID NO: 343552 - DNA, 16 bp, M. musculus
aagccacaatcagaga

SEQ ID NO: 343553 - DNA, 16 bp, M. musculus
aagccacatccccagc

SEQ ID NO: 343554 - DNA, 23 bp, M. musculus
aagccaccatgtggttgctggga

SEQ ID NO: 343555 - DNA, 16 bp, M. musculus
aagccaccctgtggtt

SEQ ID NO: 343556 - DNA, 16 bp, M. musculus
aagccacctcctgtag

SEQ ID NO: 343557 - DNA, 16 bp, M. musculus
aagccactgactccac

SEQ ID NO: 343558 - DNA, 16 bp, M. musculus
aagccagaagaggagg

SEQ ID NO: 343559 - DNA, 16 bp, M. musculus
aagccagaagagggtg

SEQ ID NO: 343560 - DNA, 16 bp, M. musculus
aagccagaaggacctg

SEQ ID NO: 343561 - DNA, 16 bp, M. musculus
aagccagaaggcagca

SEQ ID NO: 343562 - DNA, 16 bp, M. musculus
aagccagaatcttctg

SEQ ID NO: 343563 - DNA, 16 bp, M. musculus
aagccagacaaagccc

SEQ ID NO: 343564 - DNA, 16 bp, M. musculus
aagccagagaataaga

SEQ ID NO: 343565 - DNA, 16 bp, M. musculus
aagccagagccacatg

SEQ ID NO: 343566 - DNA, 16 bp, M. musculus
aagccagaggagggca

SEQ ID NO: 343567 - DNA, 16 bp, M. musculus
aagccagatgatcctg

SEQ ID NO: 343568 - DNA, 16 bp, M. musculus
aagccagatgtggcag

SEQ ID NO: 343569 - DNA, 16 bp, M. musculus
aagccagatgtggtgg

SEQ ID NO: 343570 - DNA, 16 bp, M. musculus
aagccagcaagcaaca

SEQ ID NO: 343571 - DNA, 16 bp, M. musculus
aagccagcaagcagca

SEQ ID NO: 343572 - DNA, 16 bp, M. musculus
aagccagcagcttcaa

SEQ ID NO: 343573 - DNA, 16 bp, M. musculus
aagccagcaggcagca

SEQ ID NO: 343574 - DNA, 16 bp, M. musculus
aagccagccaacattc

SEQ ID NO: 343575 - DNA, 16 bp, M. musculus
aagccagccagtaagg

SEQ ID NO: 343576 - DNA, 16 bp, M. musculus
aagccagccatggtgg

SEQ ID NO: 343577 - DNA, 16 bp, M. musculus
aagccagccccagcta

SEQ ID NO: 343578 - DNA, 16 bp, M. musculus
aagccagcctcatcta

SEQ ID NO: 343579 - DNA, 16 bp, M. musculus
aagccagcctgagcta

SEQ ID NO: 343580 - DNA, 16 bp, M. musculus
aagccagcctggactt

SEQ ID NO: 343581 - DNA, 16 bp, M. musculus
aagccagcctgggata

SEQ ID NO: 343582 - DNA, 16 bp, M. musculus
aagccagcctgggcta

SEQ ID NO: 343583 - DNA, 16 bp, M. musculus
aagccagcctgggtta

SEQ ID NO: 343584 - DNA, 16 bp, M. musculus
aagccagctcagtcaa

SEQ ID NO: 343585 - DNA, 16 bp, M. musculus
aagccagctcccccac

SEQ ID NO: 343586 - DNA, 16 bp, M. musculus
aagccaggaaaggaga

SEQ ID NO: 343587 - DNA, 16 bp, M. musculus
aagccaggagcagact

SEQ ID NO: 343588 - DNA, 16 bp, M. musculus
aagccaggaggcagca

SEQ ID NO: 343589 - DNA, 16 bp, M. musculus
aagccaggcacagtgg

SEQ ID NO: 343590 - DNA, 16 bp, M. musculus
aagccaggcatggcag

SEQ ID NO: 343591 - DNA, 16 bp, M. musculus
aagccaggcatggcgg

SEQ ID NO: 343592 - DNA, 16 bp, M. musculus
aagccaggcatggtgg

SEQ ID NO: 343593 - DNA, 16 bp, M. musculus
aagccaggcattgtgg

SEQ ID NO: 343594 - DNA, 16 bp, M. musculus
aagccaggcctagtgg

SEQ ID NO: 343595 - DNA, 16 bp, M. musculus
aagccaggcctggtgg

SEQ ID NO: 343596 - DNA, 16 bp, M. musculus
aagccaggctggtcta

SEQ ID NO: 343597 - DNA, 16 bp, M. musculus
aagccagggaaagcaa

SEQ ID NO: 343598 - DNA, 16 bp, M. musculus
aagccaggtatggtgg

SEQ ID NO: 343599 - DNA, 16 bp, M. musculus
aagccaggtgaagcaa

SEQ ID NO: 343600 - DNA, 16 bp, M. musculus
aagccaggtgtgacag

SEQ ID NO: 343601 - DNA, 16 bp, M. musculus
aagccagtactctgct

SEQ ID NO: 343602 - DNA, 17 bp, M. musculus
aagccagtcccagttaa

SEQ ID NO: 343603 - DNA, 16 bp, M. musculus
aagccagtctcctcct

SEQ ID NO: 343604 - DNA, 16 bp, M. musculus
aagccagtctgagcta

SEQ ID NO: 343605 - DNA, 16 bp, M. musculus
aagccagtctggtcta

SEQ ID NO: 343606 - DNA, 16 bp, M. musculus
aagccatctcaccagc

SEQ ID NO: 343607 - DNA, 16 bp, M. musculus
aagccatctccagagt

SEQ ID NO: 343608 - DNA, 16 bp, M. musculus
aagccatctctccagc

SEQ ID NO: 343609 - DNA, 16 bp, M. musculus
aagccatctctctggc

SEQ ID NO: 343610 - DNA, 16 bp, M. musculus
aagccatgagaaacaa

SEQ ID NO: 343611 - DNA, 16 bp, M. musculus
aagccatgaggaacaa

SEQ ID NO: 343612 - DNA, 16 bp, M. musculus
aagccatgatgaacaa

SEQ ID NO: 343613 - DNA, 16 bp, M. musculus
aagccatgcttccaga

SEQ ID NO: 343614 - DNA, 16 bp, M. musculus
aagccatggaatgttt

SEQ ID NO: 343615 - DNA, 16 bp, M. musculus
aagccatggagaagtg

SEQ ID NO: 343616 - DNA, 16 bp, M. musculus
aagccatggagagatg

SEQ ID NO: 343617 - DNA, 16 bp, M. musculus
aagccatgggtccctc

SEQ ID NO: 343618 - DNA, 16 bp, M. musculus
aagccatggtggtctg

SEQ ID NO: 343619 - DNA, 17 bp, M. musculus
aagccatgtggtattgc

SEQ ID NO: 343620 - DNA, 16 bp, M. musculus
aagccattactgtttt

SEQ ID NO: 343621 - DNA, 16 bp, M. musculus
aagccattgcagttct

SEQ ID NO: 343622 - DNA, 16 bp, M. musculus
aagccattggtgaagg

SEQ ID NO: 343623 - DNA, 16 bp, M. musculus
aagccatttagcccca

SEQ ID NO: 343624 - DNA, 16 bp, M. musculus
aagccatttttctttt

SEQ ID NO: 343625 - DNA, 16 bp, M. musculus
aagcccaagaagaaag

SEQ ID NO: 343626 - DNA, 16 bp, M. musculus
aagcccaagcccacag

SEQ ID NO: 343627 - DNA, 16 bp, M. musculus
aagcccacagccacag

SEQ ID NO: 343628 - DNA, 16 bp, M. musculus
aagcccagagaagcca

SEQ ID NO: 343629 - DNA, 16 bp, M. musculus
aagcccagagggccaa

SEQ ID NO: 343630 - DNA, 16 bp, M. musculus
aagcccagcattcagg

SEQ ID NO: 343631 - DNA, 17 bp, M. musculus
aagcccagcccagccca

SEQ ID NO: 343632 - DNA, 16 bp, M. musculus
aagcccagcccctggg

SEQ ID NO: 343633 - DNA, 16 bp, M. musculus
aagcccaggaaccaaa

SEQ ID NO: 343634 - DNA, 16 bp, M. musculus
aagcccaggctggcct

SEQ ID NO: 343635 - DNA, 16 bp, M. musculus
aagcccatcccacacc

SEQ ID NO: 343636 - DNA, 16 bp, M. musculus
aagcccatcctctgct

SEQ ID NO: 343637 - DNA, 17 bp, M. musculus
aagcccatgcccacagt

SEQ ID NO: 343638 - DNA, 16 bp, M. musculus
aagcccattcccacag

SEQ ID NO: 343639 - DNA, 16 bp, M. musculus
aagccccagccccagc

SEQ ID NO: 343640 - DNA, 16 bp, M. musculus
aagcccctgtctcaaa

SEQ ID NO: 343641 - DNA, 16 bp, M. musculus
aagccccttaccccat

SEQ ID NO: 343642 - DNA, 17 bp, M. musculus
aagccccttccgctcca

SEQ ID NO: 343643 - DNA, 16 bp, M. musculus
aagcccctttctctgt

SEQ ID NO: 343644 - DNA, 16 bp, M. musculus
aagccctccctccctc

SEQ ID NO: 343645 - DNA, 16 bp, M. musculus
aagccctctcctcccc

SEQ ID NO: 343646 - DNA, 29 bp, M. musculus
aagccctgctgctgccagtccagctgctg

SEQ ID NO: 343647 - DNA, 16 bp, M. musculus
aagccctggaactgga

SEQ ID NO: 343648 - DNA, 16 bp, M. musculus
aagccctggagaccct

SEQ ID NO: 343649 - DNA, 16 bp, M. musculus
aagccctggatatcct

SEQ ID NO: 343650 - DNA, 16 bp, M. musculus
aagccctggctgctct

SEQ ID NO: 343651 - DNA, 16 bp, M. musculus
aagccctggctgtcct

SEQ ID NO: 343652 - DNA, 17 bp, M. musculus
aagccctggctgtcctg

SEQ ID NO: 343653 - DNA, 16 bp, M. musculus
aagccctgggttcaat

SEQ ID NO: 343654 - DNA, 16 bp, M. musculus
aagccctgggtttaat

SEQ ID NO: 343655 - DNA, 16 bp, M. musculus
aagcccttcatcctct

SEQ ID NO: 343656 - DNA, 16 bp, M. musculus
aagcccttctggcttt

SEQ ID NO: 343657 - DNA, 16 bp, M. musculus
aagcccttgccccagg

SEQ ID NO: 343658 - DNA, 16 bp, M. musculus
aagccgagcatggtgg

SEQ ID NO: 343659 - DNA, 16 bp, M. musculus
aagccgaggaccagat

SEQ ID NO: 343660 - DNA, 16 bp, M. musculus
aagcctaagatggagg

SEQ ID NO: 343661 - DNA, 16 bp, M. musculus
aagcctcacaagagac

SEQ ID NO: 343662 - DNA, 16 bp, M. musculus
aagcctcagtttcccc

SEQ ID NO: 343663 - DNA, 16 bp, M. musculus
aagcctccaaaggacc

SEQ ID NO: 343664 - DNA, 16 bp, M. musculus
aagcctccaggccttt

SEQ ID NO: 343665 - DNA, 23 bp, M. musculus
aagcctcctgagtggcctagtcc

SEQ ID NO: 343666 - DNA, 16 bp, M. musculus
aagcctctaattaaat

SEQ ID NO: 343667 - DNA, 16 bp, M. musculus
aagcctctggcttctg

SEQ ID NO: 343668 - DNA, 16 bp, M. musculus
aagcctgacgacctga

SEQ ID NO: 343669 - DNA, 16 bp, M. musculus
aagcctgactaagaca

SEQ ID NO: 343670 - DNA, 16 bp, M. musculus
aagcctgcattgctga

SEQ ID NO: 343671 - DNA, 16 bp, M. musculus
aagcctgcctgctcct

SEQ ID NO: 343672 - DNA, 16 bp, M. musculus
aagcctggagacctga

SEQ ID NO: 343673 - DNA, 16 bp, M. musculus
aagcctggcatggtgg

SEQ ID NO: 343674 - DNA, 16 bp, M. musculus
aagcctggtgtggtgg

SEQ ID NO: 343675 - DNA, 17 bp, M. musculus
aagccttatttataata

SEQ ID NO: 343676 - DNA, 16 bp, M. musculus
aagccttcaacacatg

SEQ ID NO: 343677 - DNA, 16 bp, M. musculus
aagccttcaaggtctg

SEQ ID NO: 343678 - DNA, 18 bp, M. musculus
aagccttcagaactccaa

SEQ ID NO: 343679 - DNA, 16 bp, M. musculus
aagccttcccaaccaa

SEQ ID NO: 343680 - DNA, 16 bp, M. musculus
aagccttgctgaggct

SEQ ID NO: 343681 - DNA, 16 bp, M. musculus
aagccttgggttcaat

SEQ ID NO: 343682 - DNA, 16 bp, M. musculus
aagcctttaattccag

SEQ ID NO: 343683 - DNA, 16 bp, M. musculus
aagcctttcactcttt

SEQ ID NO: 343684 - DNA, 16 bp, M. musculus
aagcctttcagtttca

SEQ ID NO: 343685 - DNA, 16 bp, M. musculus
aagcctttctgttcct

SEQ ID NO: 343686 - DNA, 16 bp, M. musculus
aagcgagcgagcgagc

SEQ ID NO: 343687 - DNA, 18 bp, M. musculus
aagcgctgggattaaagg

SEQ ID NO: 343688 - DNA, 16 bp, M. musculus
aagctaatagaagaga

SEQ ID NO: 343689 - DNA, 16 bp, M. musculus
aagctacacatttgct

SEQ ID NO: 343690 - DNA, 16 bp, M. musculus
aagctacagagtgaga

SEQ ID NO: 343691 - DNA, 16 bp, M. musculus
aagctacagtgtactc

SEQ ID NO: 343692 - DNA, 16 bp, M. musculus
aagctagacttcaaca

SEQ ID NO: 343693 - DNA, 16 bp, M. musculus
aagctagcccccaagg

SEQ ID NO: 343694 - DNA, 16 bp, M. musculus
aagctagcctcaaact

SEQ ID NO: 343695 - DNA, 16 bp, M. musculus
aagctaggatgaacaa

SEQ ID NO: 343696 - DNA, 16 bp, M. musculus
aagctaggcaagtgct

SEQ ID NO: 343697 - DNA, 16 bp, M. musculus
aagctagggtcatttg

SEQ ID NO: 343698 - DNA, 17 bp, M. musculus
aagctagtacttttcca

SEQ ID NO: 343699 - DNA, 16 bp, M. musculus
aagctatcaacaaagg

SEQ ID NO: 343700 - DNA, 16 bp, M. musculus
aagctatcctgggcta

SEQ ID NO: 343701 - DNA, 19 bp, M. musculus
aagctattaggaccaatta

SEQ ID NO: 343702 - DNA, 16 bp, M. musculus
aagctatttgcaattg

SEQ ID NO: 343703 - DNA, 16 bp, M. musculus
aagctcaagaagaaag

SEQ ID NO: 343704 - DNA, 16 bp, M. musculus
aagctcaagaagaaga

SEQ ID NO: 343705 - DNA, 16 bp, M. musculus
aagctcaagaagatgg

SEQ ID NO: 343706 - DNA, 16 bp, M. musculus
aagctcaagaaggagg

SEQ ID NO: 343707 - DNA, 16 bp, M. musculus
aagctcaagtctaaat

SEQ ID NO: 343708 - DNA, 16 bp, M. musculus
aagctcaatgccccag

SEQ ID NO: 343709 - DNA, 16 bp, M. musculus
aagctcaccctcagtg

SEQ ID NO: 343710 - DNA, 16 bp, M. musculus
aagctcaccctttctt

SEQ ID NO: 343711 - DNA, 16 bp, M. musculus
aagctcagcctccatc

SEQ ID NO: 343712 - DNA, 16 bp, M. musculus
aagctcagggattggt

SEQ ID NO: 343713 - DNA, 16 bp, M. musculus
aagctcagtgggcagt

SEQ ID NO: 343714 - DNA, 16 bp, M. musculus
aagctccaagacagcc

SEQ ID NO: 343715 - DNA, 16 bp, M. musculus
aagctccaggcagaga

SEQ ID NO: 343716 - DNA, 16 bp, M. musculus
aagctccaggctgctg

SEQ ID NO: 343717 - DNA, 16 bp, M. musculus
aagctccaggttcagt

SEQ ID NO: 343718 - DNA, 16 bp, M. musculus
aagctcccactgtctg

SEQ ID NO: 343719 - DNA, 16 bp, M. musculus
aagctccccaccccca

SEQ ID NO: 343720 - DNA, 16 bp, M. musculus
aagctcctccccacag

SEQ ID NO: 343721 - DNA, 16 bp, M. musculus
aagctcctgagttcaa

SEQ ID NO: 343722 - DNA, 16 bp, M. musculus
aagctccttaagcagg

SEQ ID NO: 343723 - DNA, 16 bp, M. musculus
aagctcctttctcagt

SEQ ID NO: 343724 - DNA, 16 bp, M. musculus
aagctcctttgtctgt

SEQ ID NO: 343725 - DNA, 16 bp, M. musculus
aagctctctggatagc

SEQ ID NO: 343726 - DNA, 16 bp, M. musculus
aagctctgaaaaactt

SEQ ID NO: 343727 - DNA, 16 bp, M. musculus
aagctctgccagagcc

SEQ ID NO: 343728 - DNA, 16 bp, M. musculus
aagctctgcctagtgt

SEQ ID NO: 343729 - DNA, 16 bp, M. musculus
aagctctgcctgcctc

SEQ ID NO: 343730 - DNA, 16 bp, M. musculus
aagctctggatctggg

SEQ ID NO: 343731 - DNA, 16 bp, M. musculus
aagctctgggttcaat

SEQ ID NO: 343732 - DNA, 16 bp, M. musculus
aagctctgtccagtgt

SEQ ID NO: 343733 - DNA, 16 bp, M. musculus
aagctcttgttagcat

SEQ ID NO: 343734 - DNA, 16 bp, M. musculus
aagctctttacccact

SEQ ID NO: 343735 - DNA, 16 bp, M. musculus
aagctgaaagctcaca

SEQ ID NO: 343736 - DNA, 16 bp, M. musculus
aagctgaacaagccag

SEQ ID NO: 343737 - DNA, 16 bp, M. musculus
aagctgaacaatgccc

SEQ ID NO: 343738 - DNA, 16 bp, M. musculus
aagctgaagaaaccct

SEQ ID NO: 343739 - DNA, 16 bp, M. musculus
aagctgaagagaaggg

SEQ ID NO: 343740 - DNA, 16 bp, M. musculus
aagctgaagcaagagg

SEQ ID NO: 343741 - DNA, 16 bp, M. musculus
aagctgaagcaggagg

SEQ ID NO: 343742 - DNA, 16 bp, M. musculus
aagctgaagccttcaa

SEQ ID NO: 343743 - DNA, 21 bp, M. musculus
aagctgaagccttggactttg

SEQ ID NO: 343744 - DNA, 16 bp, M. musculus
aagctgaaggagaagt

SEQ ID NO: 343745 - DNA, 16 bp, M. musculus
aagctgaaggagagag

SEQ ID NO: 343746 - DNA, 16 bp, M. musculus
aagctgaagttatcac

SEQ ID NO: 343747 - DNA, 16 bp, M. musculus
aagctgaataaacact

SEQ ID NO: 343748 - DNA, 16 bp, M. musculus
aagctgagaaagaaaa

SEQ ID NO: 343749 - DNA, 16 bp, M. musculus
aagctgagaatttctt

SEQ ID NO: 343750 - DNA, 16 bp, M. musculus
aagctgagcaccagca

SEQ ID NO: 343751 - DNA, 16 bp, M. musculus
aagctgaggaagagga

SEQ ID NO: 343752 - DNA, 16 bp, M. musculus
aagctgaggaggaagg

SEQ ID NO: 343753 - DNA, 16 bp, M. musculus
aagctgaggaggagag

SEQ ID NO: 343754 - DNA, 16 bp, M. musculus
aagctgaggcagaagg

SEQ ID NO: 343755 - DNA, 16 bp, M. musculus
aagctgaggcaggaac

SEQ ID NO: 343756 - DNA, 16 bp, M. musculus
aagctgaggctcagag

SEQ ID NO: 343757 - DNA, 16 bp, M. musculus
aagctgaggctgaggc

SEQ ID NO: 343758 - DNA, 16 bp, M. musculus
aagctgaggtctgaac

SEQ ID NO: 343759 - DNA, 16 bp, M. musculus
aagctgcaaaggctgg

SEQ ID NO: 343760 - DNA, 16 bp, M. musculus
aagctgcaacaggatc

SEQ ID NO: 343761 - DNA, 16 bp, M. musculus
aagctgcacatctgcc

SEQ ID NO: 343762 - DNA, 16 bp, M. musculus
aagctgcacatctgtt

SEQ ID NO: 343763 - DNA, 16 bp, M. musculus
aagctgcagagagagc

SEQ ID NO: 343764 - DNA, 16 bp, M. musculus
aagctgcagcacacca

SEQ ID NO: 343765 - DNA, 16 bp, M. musculus
aagctgccaagggagg

SEQ ID NO: 343766 - DNA, 16 bp, M. musculus
aagctgccaagttctg

SEQ ID NO: 343767 - DNA, 16 bp, M. musculus
aagctgctatggacat

SEQ ID NO: 343768 - DNA, 16 bp, M. musculus
aagctgctgaaccctg

SEQ ID NO: 343769 - DNA, 16 bp, M. musculus
aagctgctgacctctg

SEQ ID NO: 343770 - DNA, 16 bp, M. musculus
aagctgctgatctgtt

SEQ ID NO: 343771 - DNA, 16 bp, M. musculus
aagctgctgcaggaac

SEQ ID NO: 343772 - DNA, 16 bp, M. musculus
aagctgctgctgcctg

SEQ ID NO: 343773 - DNA, 16 bp, M. musculus
aagctgctgctgctgc

SEQ ID NO: 343774 - DNA, 16 bp, M. musculus
aagctgctggcccctg

SEQ ID NO: 343775 - DNA, 16 bp, M. musculus
aagctgcttttggtca

SEQ ID NO: 343776 - DNA, 16 bp, M. musculus
aagctggaaacaacca

SEQ ID NO: 343777 - DNA, 16 bp, M. musculus
aagctggaagaacctg

SEQ ID NO: 343778 - DNA, 17 bp, M. musculus
aagctggaccccagaaa

SEQ ID NO: 343779 - DNA, 16 bp, M. musculus
aagctggagaagccat

SEQ ID NO: 343780 - DNA, 16 bp, M. musculus
aagctggagttacagg

SEQ ID NO: 343781 - DNA, 16 bp, M. musculus
aagctggagttgcagg

SEQ ID NO: 343782 - DNA, 16 bp, M. musculus
aagctggccctgaact

SEQ ID NO: 343783 - DNA, 16 bp, M. musculus
aagctggcctcaaact

SEQ ID NO: 343784 - DNA, 16 bp, M. musculus
aagctggccttaaact

SEQ ID NO: 343785 - DNA, 16 bp, M. musculus
aagctggccttgaact

SEQ ID NO: 343786 - DNA, 16 bp, M. musculus
aagctggccttgaatt

SEQ ID NO: 343787 - DNA, 16 bp, M. musculus
aagctggctagccaga

SEQ ID NO: 343788 - DNA, 16 bp, M. musculus
aagctggctgagccag

SEQ ID NO: 343789 - DNA, 16 bp, M. musculus
aagctggctgtggtgg

SEQ ID NO: 343790 - DNA, 16 bp, M. musculus
aagctgggaagctggt

SEQ ID NO: 343791 - DNA, 16 bp, M. musculus
aagctgggagatgatg

SEQ ID NO: 343792 - DNA, 16 bp, M. musculus
aagctgggcacagtgg

SEQ ID NO: 343793 - DNA, 16 bp, M. musculus
aagctgggcagtgatg

SEQ ID NO: 343794 - DNA, 16 bp, M. musculus
aagctgggcatggtgg

SEQ ID NO: 343795 - DNA, 17 bp, M. musculus
aagctgggcatggtggt

SEQ ID NO: 343796 - DNA, 16 bp, M. musculus
aagctgggcttggtgg

SEQ ID NO: 343797 - DNA, 16 bp, M. musculus
aagctggggaaaagcc

SEQ ID NO: 343798 - DNA, 16 bp, M. musculus
aagctggggagaaaag

SEQ ID NO: 343799 - DNA, 16 bp, M. musculus
aagctggggctggaga

SEQ ID NO: 343800 - DNA, 16 bp, M. musculus
aagctggtctcaaact

SEQ ID NO: 343801 - DNA, 16 bp, M. musculus
aagctggtctggaact

SEQ ID NO: 343802 - DNA, 16 bp, M. musculus
aagctggtgcctacct

SEQ ID NO: 343803 - DNA, 16 bp, M. musculus
aagctggttttgaact

SEQ ID NO: 343804 - DNA, 16 bp, M. musculus
aagctgtagtagccat

SEQ ID NO: 343805 - DNA, 16 bp, M. musculus
aagctgtattacagag

SEQ ID NO: 343806 - DNA, 16 bp, M. musculus
aagctgtcaagttctg

SEQ ID NO: 343807 - DNA, 16 bp, M. musculus
aagctgtccagttctc

SEQ ID NO: 343808 - DNA, 18 bp, M. musculus
aagctgtcctaacctgta

SEQ ID NO: 343809 - DNA, 16 bp, M. musculus
aagctgtcctctgact

SEQ ID NO: 343810 - DNA, 16 bp, M. musculus
aagctgtccttgaact

SEQ ID NO: 343811 - DNA, 16 bp, M. musculus
aagctgtctctggctg

SEQ ID NO: 343812 - DNA, 16 bp, M. musculus
aagctgtctctgggac

SEQ ID NO: 343813 - DNA, 16 bp, M. musculus
aagctgtgaagctgaa

SEQ ID NO: 343814 - DNA, 16 bp, M. musculus
aagctgtgagccaaaa

SEQ ID NO: 343815 - DNA, 16 bp, M. musculus
aagctgtggcttgtgg

SEQ ID NO: 343816 - DNA, 16 bp, M. musculus
aagctgtgtgaataca

SEQ ID NO: 343817 - DNA, 16 bp, M. musculus
aagctgttctgaaaac

SEQ ID NO: 343818 - DNA, 16 bp, M. musculus
aagctgttgagaagaa

SEQ ID NO: 343819 - DNA, 30 bp, M. musculus
aagctgtttatcaggtttaggagttctctg

SEQ ID NO: 343820 - DNA, 16 bp, M. musculus
aagcttaacaagaagg

SEQ ID NO: 343821 - DNA, 16 bp, M. musculus
aagcttaaggcccaaa

SEQ ID NO: 343822 - DNA, 17 bp, M. musculus
aagcttatagaggagaa

SEQ ID NO: 343823 - DNA, 16 bp, M. musculus
aagcttatatatatat

SEQ ID NO: 343824 - DNA, 16 bp, M. musculus
aagcttcaagggaaaa

SEQ ID NO: 343825 - DNA, 16 bp, M. musculus
aagcttcagctgttct

SEQ ID NO: 343826 - DNA, 16 bp, M. musculus
aagcttccagaaaatg

SEQ ID NO: 343827 - DNA, 16 bp, M. musculus
aagcttccttcttcca

SEQ ID NO: 343828 - DNA, 16 bp, M. musculus
aagcttcctttatttt

SEQ ID NO: 343829 - DNA, 16 bp, M. musculus
aagcttctctttgcaa

SEQ ID NO: 343830 - DNA, 16 bp, M. musculus
aagcttctttgatgag

SEQ ID NO: 343831 - DNA, 16 bp, M. musculus
aagcttgaggccagcc

SEQ ID NO: 343832 - DNA, 16 bp, M. musculus
aagcttggatgcagtc

SEQ ID NO: 343833 - DNA, 16 bp, M. musculus
aagcttggcactgtga

SEQ ID NO: 343834 - DNA, 16 bp, M. musculus
aagcttggctgtcctg

SEQ ID NO: 343835 - DNA, 16 bp, M. musculus
aagcttgggacattgc

SEQ ID NO: 343836 - DNA, 16 bp, M. musculus
aagctttaaaaagaaa

SEQ ID NO: 343837 - DNA, 16 bp, M. musculus
aagctttaccacagag

SEQ ID NO: 343838 - DNA, 16 bp, M. musculus
aagctttgcattttat

SEQ ID NO: 343839 - DNA, 16 bp, M. musculus
aagctttgcttttttt

SEQ ID NO: 343840 - DNA, 16 bp, M. musculus
aagctttgttctttaa

SEQ ID NO: 343841 - DNA, 16 bp, M. musculus
aagctttgttgcttct

SEQ ID NO: 343842 - DNA, 16 bp, M. musculus
aagctttgttttattt

SEQ ID NO: 343843 - DNA, 16 bp, M. musculus
aagcttttaaaaatta

SEQ ID NO: 343844 - DNA, 16 bp, M. musculus
aagcttttaaaatata

SEQ ID NO: 343845 - DNA, 16 bp, M. musculus
aagcttttacctttct

SEQ ID NO: 343846 - DNA, 16 bp, M. musculus
aagcttttcatggcca

SEQ ID NO: 343847 - DNA, 16 bp, M. musculus
aagcttttcattttca

SEQ ID NO: 343848 - DNA, 16 bp, M. musculus
aagcttttccctgtaa

SEQ ID NO: 343849 - DNA, 16 bp, M. musculus
aagcttttctacagag

SEQ ID NO: 343850 - DNA, 16 bp, M. musculus
aagcttttctttttct

SEQ ID NO: 343851 - DNA, 16 bp, M. musculus
aagcttttttttaaaa

SEQ ID NO: 343852 - DNA, 16 bp, M. musculus
aaggaaaaaaatgtct

SEQ ID NO: 343853 - DNA, 16 bp, M. musculus
aaggaaaaaagaacct

SEQ ID NO: 343854 - DNA, 16 bp, M. musculus
aaggaaaaaatatttc

SEQ ID NO: 343855 - DNA, 16 bp, M. musculus
aaggaaaaaatttccc

SEQ ID NO: 343856 - DNA, 16 bp, M. musculus
aaggaaaaacatttca

SEQ ID NO: 343857 - DNA, 16 bp, M. musculus
aaggaaaaatgagact

SEQ ID NO: 343858 - DNA, 16 bp, M. musculus
aaggaaaacattaaat

SEQ ID NO: 343859 - DNA, 16 bp, M. musculus
aaggaaaacatttaac

SEQ ID NO: 343860 - DNA, 16 bp, M. musculus
aaggaaaacgcaacac

SEQ ID NO: 343861 - DNA, 16 bp, M. musculus
aaggaaaacttcaaca

SEQ ID NO: 343862 - DNA, 16 bp, M. musculus
aaggaaaagatttaat

SEQ ID NO: 343863 - DNA, 16 bp, M. musculus
aaggaaaagcagaagt

SEQ ID NO: 343864 - DNA, 16 bp, M. musculus
aaggaaaaggaggtcc

SEQ ID NO: 343865 - DNA, 16 bp, M. musculus
aaggaaaagtaatttt

SEQ ID NO: 343866 - DNA, 16 bp, M. musculus
aaggaaaagtgattat

SEQ ID NO: 343867 - DNA, 16 bp, M. musculus
aaggaaaataaaatct

SEQ ID NO: 343868 - DNA, 16 bp, M. musculus
aaggaaaataaattgt

SEQ ID NO: 343869 - DNA, 16 bp, M. musculus
aaggaaaataatacta

SEQ ID NO: 343870 - DNA, 16 bp, M. musculus
aaggaaaatattcttt

SEQ ID NO: 343871 - DNA, 16 bp, M. musculus
aaggaaaatatttgaa

SEQ ID NO: 343872 - DNA, 16 bp, M. musculus
aaggaaaatgaaatca

SEQ ID NO: 343873 - DNA, 16 bp, M. musculus
aaggaaaatgaagcca

SEQ ID NO: 343874 - DNA, 18 bp, M. musculus
aaggaaaatgatgctgct

SEQ ID NO: 343875 - DNA, 16 bp, M. musculus
aaggaaaatggtgctg

SEQ ID NO: 343876 - DNA, 16 bp, M. musculus
aaggaaaatgttttaa

SEQ ID NO: 343877 - DNA, 16 bp, M. musculus
aaggaaaatttgtctg

SEQ ID NO: 343878 - DNA, 16 bp, M. musculus
aaggaaacaaggcctt

SEQ ID NO: 343879 - DNA, 16 bp, M. musculus
aaggaaacaatgcctt

SEQ ID NO: 343880 - DNA, 16 bp, M. musculus
aaggaaacagccatgt

SEQ ID NO: 343881 - DNA, 16 bp, M. musculus
aaggaaaccatttaac

SEQ ID NO: 343882 - DNA, 16 bp, M. musculus
aaggaaactttttaaa

SEQ ID NO: 343883 - DNA, 16 bp, M. musculus
aaggaaagaaaaatct

SEQ ID NO: 343884 - DNA, 16 bp, M. musculus
aaggaaagaaaactca

SEQ ID NO: 343885 - DNA, 16 bp, M. musculus
aaggaaagaacagact

SEQ ID NO: 343886 - DNA, 16 bp, M. musculus
aaggaaagaaccaact

SEQ ID NO: 343887 - DNA, 16 bp, M. musculus
aaggaaagaagtcagg

SEQ ID NO: 343888 - DNA, 16 bp, M. musculus
aaggaaagatgtggag

SEQ ID NO: 343889 - DNA, 16 bp, M. musculus
aaggaaagccaaagtg

SEQ ID NO: 343890 - DNA, 16 bp, M. musculus
aaggaaaggactgaag

SEQ ID NO: 343891 - DNA, 16 bp, M. musculus
aaggaaaggctgtcca

SEQ ID NO: 343892 - DNA, 16 bp, M. musculus
aaggaaagtaaaagct

SEQ ID NO: 343893 - DNA, 16 bp, M. musculus
aaggaaagtatttatt

SEQ ID NO: 343894 - DNA, 16 bp, M. musculus
aaggaaataaaacatt

SEQ ID NO: 343895 - DNA, 16 bp, M. musculus
aaggaaataaattcaa

SEQ ID NO: 343896 - DNA, 16 bp, M. musculus
aaggaaatagaagtca

SEQ ID NO: 343897 - DNA, 16 bp, M. musculus
aaggaaatcacaaagg

SEQ ID NO: 343898 - DNA, 16 bp, M. musculus
aaggaaatggtcaaat

SEQ ID NO: 343899 - DNA, 16 bp, M. musculus
aaggaaatggtgagaa

SEQ ID NO: 343900 - DNA, 16 bp, M. musculus
aaggaaatgtgacctg

SEQ ID NO: 343901 - DNA, 16 bp, M. musculus
aaggaaattaaagact

SEQ ID NO: 343902 - DNA, 16 bp, M. musculus
aaggaaattattttaa

SEQ ID NO: 343903 - DNA, 16 bp, M. musculus
aaggaaattcaaagaa

SEQ ID NO: 343904 - DNA, 16 bp, M. musculus
aaggaaattttaattt

SEQ ID NO: 343905 - DNA, 16 bp, M. musculus
aaggaacaatttcaag

SEQ ID NO: 343906 - DNA, 16 bp, M. musculus
aaggaacacaggtctg

SEQ ID NO: 343907 - DNA, 16 bp, M. musculus
aaggaacactgacaaa

SEQ ID NO: 343908 - DNA, 16 bp, M. musculus
aaggaacagaggcagc

SEQ ID NO: 343909 - DNA, 16 bp, M. musculus
aaggaaccatgtacag

SEQ ID NO: 343910 - DNA, 16 bp, M. musculus
aaggaacctatcatga

SEQ ID NO: 343911 - DNA, 16 bp, M. musculus
aaggaacctcaattga

SEQ ID NO: 343912 - DNA, 16 bp, M. musculus
aaggaacctcccttga

SEQ ID NO: 343913 - DNA, 16 bp, M. musculus
aaggaactaaagaaag

SEQ ID NO: 343914 - DNA, 16 bp, M. musculus
aaggaactagcacaat

SEQ ID NO: 343915 - DNA, 16 bp, M. musculus
aaggaactcaagaaga

SEQ ID NO: 343916 - DNA, 16 bp, M. musculus
aaggaactcaagaagg

SEQ ID NO: 343917 - DNA, 16 bp, M. musculus
aaggaactctctgagt

SEQ ID NO: 343918 - DNA, 16 bp, M. musculus
aaggaactgaagaaaa

SEQ ID NO: 343919 - DNA, 16 bp, M. musculus
aaggaactgagttcag

SEQ ID NO: 343920 - DNA, 16 bp, M. musculus
aaggaactgtattaaa

SEQ ID NO: 343921 - DNA, 16 bp, M. musculus
aaggaacttgccacca

SEQ ID NO: 343922 - DNA, 16 bp, M. musculus
aaggaagaaaattaca

SEQ ID NO: 343923 - DNA, 16 bp, M. musculus
aaggaagaaactgaag

SEQ ID NO: 343924 - DNA, 16 bp, M. musculus
aaggaagaaagaagct

SEQ ID NO: 343925 - DNA, 16 bp, M. musculus
aaggaagaaatacaga

SEQ ID NO: 343926 - DNA, 16 bp, M. musculus
aaggaagaaatcaaga

SEQ ID NO: 343927 - DNA, 16 bp, M. musculus
aaggaagaacaaagtg

SEQ ID NO: 343928 - DNA, 16 bp, M. musculus
aaggaagaagacaaat

SEQ ID NO: 343929 - DNA, 16 bp, M. musculus
aaggaagaagtcaaat

SEQ ID NO: 343930 - DNA, 16 bp, M. musculus
aaggaagaatggatac

SEQ ID NO: 343931 - DNA, 16 bp, M. musculus
aaggaagaatgggatg

SEQ ID NO: 343932 - DNA, 16 bp, M. musculus
aaggaagacagcattt

SEQ ID NO: 343933 - DNA, 16 bp, M. musculus
aaggaagacctggaaa

SEQ ID NO: 343934 - DNA, 16 bp, M. musculus
aaggaagacgccacaa

SEQ ID NO: 343935 - DNA, 16 bp, M. musculus
aaggaagagatgccca

SEQ ID NO: 343936 - DNA, 16 bp, M. musculus
aaggaagagctgagaa

SEQ ID NO: 343937 - DNA, 16 bp, M. musculus
aaggaagagtttattt

SEQ ID NO: 343938 - DNA, 16 bp, M. musculus
aaggaagattctagaa

SEQ ID NO: 343939 - DNA, 16 bp, M. musculus
aaggaagcaaaatcac

SEQ ID NO: 343940 - DNA, 16 bp, M. musculus
aaggaagcataattac

SEQ ID NO: 343941 - DNA, 16 bp, M. musculus
aaggaagcccagttag

SEQ ID NO: 343942 - DNA, 16 bp, M. musculus
aaggaagcctggggct

SEQ ID NO: 343943 - DNA, 17 bp, M. musculus
aaggaagctctcctcct

SEQ ID NO: 343944 - DNA, 16 bp, M. musculus
aaggaagctggagaga

SEQ ID NO: 343945 - DNA, 16 bp, M. musculus
aaggaagcttctctga

SEQ ID NO: 343946 - DNA, 16 bp, M. musculus
aaggaagcttttgttc

SEQ ID NO: 343947 - DNA, 16 bp, M. musculus
aaggaaggaaaggttt

SEQ ID NO: 343948 - DNA, 16 bp, M. musculus
aaggaaggaaattaca

SEQ ID NO: 343949 - DNA, 16 bp, M. musculus
aaggaaggaagagttt

SEQ ID NO: 343950 - DNA, 16 bp, M. musculus
aaggaaggaagccagg

SEQ ID NO: 343951 - DNA, 16 bp, M. musculus
aaggaaggaaggaact

SEQ ID NO: 343952 - DNA, 16 bp, M. musculus
aaggaaggacatgact

SEQ ID NO: 343953 - DNA, 17 bp, M. musculus
aaggaaggactatccag

SEQ ID NO: 343954 - DNA, 16 bp, M. musculus
aaggaagggtttcttt

SEQ ID NO: 343955 - DNA, 16 bp, M. musculus
aaggaagtcaaagcag

SEQ ID NO: 343956 - DNA, 16 bp, M. musculus
aaggaagtcaggcagg

SEQ ID NO: 343957 - DNA, 16 bp, M. musculus
aaggaagtcatgactg

SEQ ID NO: 343958 - DNA, 26 bp, M. musculus
aaggaagtgaaagatctgtatgataa

SEQ ID NO: 343959 - DNA, 17 bp, M. musculus
aaggaagtgaaaggtct

SEQ ID NO: 343960 - DNA, 16 bp, M. musculus
aaggaagtggtcagca

SEQ ID NO: 343961 - DNA, 16 bp, M. musculus
aaggaagtgtgtcact

SEQ ID NO: 343962 - DNA, 16 bp, M. musculus
aaggaagtgttttcct

SEQ ID NO: 343963 - DNA, 16 bp, M. musculus
aaggaagtttgtgacc

SEQ ID NO: 343964 - DNA, 16 bp, M. musculus
aaggaagtttttaaaa

SEQ ID NO: 343965 - DNA, 16 bp, M. musculus
aaggaataatgattgt

SEQ ID NO: 343966 - DNA, 16 bp, M. musculus
aaggaatatccttttg

SEQ ID NO: 343967 - DNA, 17 bp, M. musculus
aaggaatcaaccctcaa

SEQ ID NO: 343968 - DNA, 16 bp, M. musculus
aaggaatcacaaaggg

SEQ ID NO: 343969 - DNA, 16 bp, M. musculus
aaggaatctactgtta

SEQ ID NO: 343970 - DNA, 16 bp, M. musculus
aaggaatcttcaaaaa

SEQ ID NO: 343971 - DNA, 16 bp, M. musculus
aaggaatgaccaacca

SEQ ID NO: 343972 - DNA, 16 bp, M. musculus
aaggaatgcccaggaa

SEQ ID NO: 343973 - DNA, 20 bp, M. musculus
aaggaatggatacagaaaat

SEQ ID NO: 343974 - DNA, 16 bp, M. musculus
aaggaatggccaacca

SEQ ID NO: 343975 - DNA, 16 bp, M. musculus
aaggaatgtagaaaca

SEQ ID NO: 343976 - DNA, 16 bp, M. musculus
aaggaatgttttaagt

SEQ ID NO: 343977 - DNA, 16 bp, M. musculus
aaggaattaaagaaca

SEQ ID NO: 343978 - DNA, 16 bp, M. musculus
aaggaattcttaattc

SEQ ID NO: 343979 - DNA, 16 bp, M. musculus
aaggaatttaaatgga

SEQ ID NO: 343980 - DNA, 16 bp, M. musculus
aaggaattttagtctt

SEQ ID NO: 343981 - DNA, 16 bp, M. musculus
aaggacaaaaataact

SEQ ID NO: 343982 - DNA, 16 bp, M. musculus
aaggacaaaatggcag

SEQ ID NO: 343983 - DNA, 16 bp, M. musculus
aaggacaaaattggag

SEQ ID NO: 343984 - DNA, 16 bp, M. musculus
aaggacaaagatggag

SEQ ID NO: 343985 - DNA, 16 bp, M. musculus
aaggacaacagcaata

SEQ ID NO: 343986 - DNA, 16 bp, M. musculus
aaggacaacttctcca

SEQ ID NO: 343987 - DNA, 16 bp, M. musculus
aaggacaagccacaca

SEQ ID NO: 343988 - DNA, 18 bp, M. musculus
aaggacaatgggtcagca

SEQ ID NO: 343989 - DNA, 16 bp, M. musculus
aaggacaatttagtta

SEQ ID NO: 343990 - DNA, 25 bp, M. musculus
aaggacacaaggacaagtcatctat

SEQ ID NO: 343991 - DNA, 16 bp, M. musculus
aaggacacacaggaag

SEQ ID NO: 343992 - DNA, 16 bp, M. musculus
aaggacacagacacac

SEQ ID NO: 343993 - DNA, 16 bp, M. musculus
aaggacacagagagag

SEQ ID NO: 343994 - DNA, 16 bp, M. musculus
aaggacaccataagaa

SEQ ID NO: 343995 - DNA, 16 bp, M. musculus
aaggacacgtgctcca

SEQ ID NO: 343996 - DNA, 16 bp, M. musculus
aaggacactgactgct

SEQ ID NO: 343997 - DNA, 16 bp, M. musculus
aaggacactgtagctg

SEQ ID NO: 343998 - DNA, 16 bp, M. musculus
aaggacagaaaccaca

SEQ ID NO: 343999 - DNA, 16 bp, M. musculus
aaggacagaaatcaca

SEQ ID NO: 344000 - DNA, 16 bp, M. musculus
aaggacagacacacag

SEQ ID NO: 344001 - DNA, 16 bp, M. musculus
aaggacagagggacag

SEQ ID NO: 344002 - DNA, 16 bp, M. musculus
aaggacagccagggct

SEQ ID NO: 344003 - DNA, 16 bp, M. musculus
aaggacagccaggtct

SEQ ID NO: 344004 - DNA, 16 bp, M. musculus
aaggacagcctggcct

SEQ ID NO: 344005 - DNA, 16 bp, M. musculus
aaggacagcctgggct

SEQ ID NO: 344006 - DNA, 16 bp, M. musculus
aaggacagcttgcagg

SEQ ID NO: 344007 - DNA, 16 bp, M. musculus
aaggacagggtaagtc

SEQ ID NO: 344008 - DNA, 16 bp, M. musculus
aaggacataacagaca

SEQ ID NO: 344009 - DNA, 16 bp, M. musculus
aaggacatgaaagaag

SEQ ID NO: 344010 - DNA, 16 bp, M. musculus
aaggacatgactgctc

SEQ ID NO: 344011 - DNA, 16 bp, M. musculus
aaggacatggaggaag

SEQ ID NO: 344012 - DNA, 16 bp, M. musculus
aaggacattagaagaa

SEQ ID NO: 344013 - DNA, 16 bp, M. musculus
aaggacattgtcaata

SEQ ID NO: 344014 - DNA, 16 bp, M. musculus
aaggacatttcttttt

SEQ ID NO: 344015 - DNA, 16 bp, M. musculus
aaggacattttctttt

SEQ ID NO: 344016 - DNA, 16 bp, M. musculus
aaggaccaagcattca

SEQ ID NO: 344017 - DNA, 16 bp, M. musculus
aaggaccagagtttgg

SEQ ID NO: 344018 - DNA, 16 bp, M. musculus
aaggaccagctcctgg

SEQ ID NO: 344019 - DNA, 16 bp, M. musculus
aaggaccaggcagaag

SEQ ID NO: 344020 - DNA, 16 bp, M. musculus
aaggacccagacatag

SEQ ID NO: 344021 - DNA, 16 bp, M. musculus
aaggaccgtgaaagat

SEQ ID NO: 344022 - DNA, 16 bp, M. musculus
aaggacctcagaggag

SEQ ID NO: 344023 - DNA, 16 bp, M. musculus
aaggacctgaattcag

SEQ ID NO: 344024 - DNA, 16 bp, M. musculus
aaggacctgagttcag

SEQ ID NO: 344025 - DNA, 16 bp, M. musculus
aaggacctgagtttga

SEQ ID NO: 344026 - DNA, 16 bp, M. musculus
aaggacctgggaggga

SEQ ID NO: 344027 - DNA, 16 bp, M. musculus
aaggacctggtgcaga

SEQ ID NO: 344028 - DNA, 16 bp, M. musculus
aaggacgtggagaaag

SEQ ID NO: 344029 - DNA, 16 bp, M. musculus
aaggactctaggagtc

SEQ ID NO: 344030 - DNA, 16 bp, M. musculus
aaggactctttcacag

SEQ ID NO: 344031 - DNA, 16 bp, M. musculus
aaggactgaaggatct

SEQ ID NO: 344032 - DNA, 16 bp, M. musculus
aaggactgaatccctg

SEQ ID NO: 344033 - DNA, 18 bp, M. musculus
aaggactgagtttcctgt

SEQ ID NO: 344034 - DNA, 16 bp, M. musculus
aaggactgccaggtct

SEQ ID NO: 344035 - DNA, 16 bp, M. musculus
aaggacttctcttgtc

SEQ ID NO: 344036 - DNA, 16 bp, M. musculus
aaggacttgggttcaa

SEQ ID NO: 344037 - DNA, 16 bp, M. musculus
aaggactttgaaattt

SEQ ID NO: 344038 - DNA, 18 bp, M. musculus
aaggactttggaactttg

SEQ ID NO: 344039 - DNA, 16 bp, M. musculus
aaggagaaaacaaact

SEQ ID NO: 344040 - DNA, 16 bp, M. musculus
aaggagaaaaccaact

SEQ ID NO: 344041 - DNA, 16 bp, M. musculus
aaggagaaaaccagct

SEQ ID NO: 344042 - DNA, 16 bp, M. musculus
aaggagaaaacttact

SEQ ID NO: 344043 - DNA, 16 bp, M. musculus
aaggagaaaattgact

SEQ ID NO: 344044 - DNA, 16 bp, M. musculus
aaggagaaaccaaaat

SEQ ID NO: 344045 - DNA, 16 bp, M. musculus
aaggagaacagcagca

SEQ ID NO: 344046 - DNA, 16 bp, M. musculus
aaggagaacagtgggg

SEQ ID NO: 344047 - DNA, 16 bp, M. musculus
aaggagaagaaaccca

SEQ ID NO: 344048 - DNA, 16 bp, M. musculus
aaggagaagatcatgt

SEQ ID NO: 344049 - DNA, 16 bp, M. musculus
aaggagaaggaagacc

SEQ ID NO: 344050 - DNA, 16 bp, M. musculus
aaggagacaaccctgg

SEQ ID NO: 344051 - DNA, 16 bp, M. musculus
aaggagaccagaagag

SEQ ID NO: 344052 - DNA, 16 bp, M. musculus
aaggagactgtcttcc

SEQ ID NO: 344053 - DNA, 16 bp, M. musculus
aaggagagaaccaact

SEQ ID NO: 344054 - DNA, 16 bp, M. musculus
aaggagagaactgacc

SEQ ID NO: 344055 - DNA, 16 bp, M. musculus
aaggagagcactgact

SEQ ID NO: 344056 - DNA, 16 bp, M. musculus
aaggagaggtgtctgc

SEQ ID NO: 344057 - DNA, 16 bp, M. musculus
aaggagataagaatgg

SEQ ID NO: 344058 - DNA, 16 bp, M. musculus
aaggagataggaatga

SEQ ID NO: 344059 - DNA, 16 bp, M. musculus
aaggagatcaaagaga

SEQ ID NO: 344060 - DNA, 17 bp, M. musculus
aaggagatcaagaggat

SEQ ID NO: 344061 - DNA, 16 bp, M. musculus
aaggagatcaaggaaa

SEQ ID NO: 344062 - DNA, 16 bp, M. musculus
aaggagatcaaggaga

SEQ ID NO: 344063 - DNA, 16 bp, M. musculus
aaggagatcacgggga

SEQ ID NO: 344064 - DNA, 16 bp, M. musculus
aaggagatctagggga

SEQ ID NO: 344065 - DNA, 16 bp, M. musculus
aaggagatgagcaaga

SEQ ID NO: 344066 - DNA, 16 bp, M. musculus
aaggagatgattatgt

SEQ ID NO: 344067 - DNA, 16 bp, M. musculus
aaggagatggctcaga

SEQ ID NO: 344068 - DNA, 16 bp, M. musculus
aaggagatggttttag

SEQ ID NO: 344069 - DNA, 17 bp, M. musculus
aaggagatgttcatgtg

SEQ ID NO: 344070 - DNA, 18 bp, M. musculus
aaggagattacctagggt

SEQ ID NO: 344071 - DNA, 16 bp, M. musculus
aaggagatttattaga

SEQ ID NO: 344072 - DNA, 16 bp, M. musculus
aaggagcaagagcaag

SEQ ID NO: 344073 - DNA, 18 bp, M. musculus
aaggagcacagtcaggct

SEQ ID NO: 344074 - DNA, 16 bp, M. musculus
aaggagcaggagctga

SEQ ID NO: 344075 - DNA, 16 bp, M. musculus
aaggagcatcagttgg

SEQ ID NO: 344076 - DNA, 16 bp, M. musculus
aaggagccagaagagt

SEQ ID NO: 344077 - DNA, 16 bp, M. musculus
aaggagccagagaaat

SEQ ID NO: 344078 - DNA, 16 bp, M. musculus
aaggagccagagaagt

SEQ ID NO: 344079 - DNA, 16 bp, M. musculus
aaggagccagagaatg

SEQ ID NO: 344080 - DNA, 16 bp, M. musculus
aaggagccaggcagtg

SEQ ID NO: 344081 - DNA, 16 bp, M. musculus
aaggagccagttctta

SEQ ID NO: 344082 - DNA, 46 bp, M. musculus
aaggagcctgtgctcatcgctggatgggctcggggagccagctctt

SEQ ID NO: 344083 - DNA, 16 bp, M. musculus
aaggagctaaaggaaa

SEQ ID NO: 344084 - DNA, 16 bp, M. musculus
aaggagctagaagatt

SEQ ID NO: 344085 - DNA, 16 bp, M. musculus
aaggagctagagaaag

SEQ ID NO: 344086 - DNA, 16 bp, M. musculus
aaggagctctgtgggt

SEQ ID NO: 344087 - DNA, 16 bp, M. musculus
aaggagctgaaggagt

SEQ ID NO: 344088 - DNA, 16 bp, M. musculus
aaggagctgaaggggt

SEQ ID NO: 344089 - DNA, 16 bp, M. musculus
aaggagctgaatgggt

SEQ ID NO: 344090 - DNA, 16 bp, M. musculus
aaggagctgagggagg

SEQ ID NO: 344091 - DNA, 16 bp, M. musculus
aaggagctgagggagt

SEQ ID NO: 344092 - DNA, 16 bp, M. musculus
aaggagctggagagat

SEQ ID NO: 344093 - DNA, 16 bp, M. musculus
aaggagctggagggat

SEQ ID NO: 344094 - DNA, 16 bp, M. musculus
aaggagctggaggggt

SEQ ID NO: 344095 - DNA, 16 bp, M. musculus
aaggagctgggtgtgg

SEQ ID NO: 344096 - DNA, 16 bp, M. musculus
aaggagcttaatgagt

SEQ ID NO: 344097 - DNA, 16 bp, M. musculus
aaggagcttcagatga

SEQ ID NO: 344098 - DNA, 16 bp, M. musculus
aaggagcttcagctgg

SEQ ID NO: 344099 - DNA, 16 bp, M. musculus
aaggagcttcaggtga

SEQ ID NO: 344100 - DNA, 16 bp, M. musculus
aaggaggaacatgaag

SEQ ID NO: 344101 - DNA, 16 bp, M. musculus
aaggaggaatgaagtg

SEQ ID NO: 344102 - DNA, 16 bp, M. musculus
aaggaggaattccagg

SEQ ID NO: 344103 - DNA, 16 bp, M. musculus
aaggaggacatcctga

SEQ ID NO: 344104 - DNA, 19 bp, M. musculus
aaggaggactgtgtgctgc

SEQ ID NO: 344105 - DNA, 16 bp, M. musculus
aaggaggagctgatgc

SEQ ID NO: 344106 - DNA, 16 bp, M. musculus
aaggaggagctgctgg

SEQ ID NO: 344107 - DNA, 16 bp, M. musculus
aaggaggagctggaga

SEQ ID NO: 344108 - DNA, 16 bp, M. musculus
aaggaggatgtggacc

SEQ ID NO: 344109 - DNA, 16 bp, M. musculus
aaggaggcagaggtag

SEQ ID NO: 344110 - DNA, 16 bp, M. musculus
aaggaggcaggagcag

SEQ ID NO: 344111 - DNA, 16 bp, M. musculus
aaggaggccaggagag

SEQ ID NO: 344112 - DNA, 16 bp, M. musculus
aaggaggccctgctga

SEQ ID NO: 344113 - DNA, 16 bp, M. musculus
aaggaggctcctttct

SEQ ID NO: 344114 - DNA, 16 bp, M. musculus
aaggagggatatatgg

SEQ ID NO: 344115 - DNA, 16 bp, M. musculus
aaggaggggcctagtg

SEQ ID NO: 344116 - DNA, 16 bp, M. musculus
aaggaggtcaaagaga

SEQ ID NO: 344117 - DNA, 16 bp, M. musculus
aaggaggttttttttt

SEQ ID NO: 344118 - DNA, 16 bp, M. musculus
aaggagtagaggcaga

SEQ ID NO: 344119 - DNA, 16 bp, M. musculus
aaggagtcagagaaat

SEQ ID NO: 344120 - DNA, 16 bp, M. musculus
aaggagtcatggagag

SEQ ID NO: 344121 - DNA, 16 bp, M. musculus
aaggagtgacactatt

SEQ ID NO: 344122 - DNA, 16 bp, M. musculus
aaggagtggaatgtga

SEQ ID NO: 344123 - DNA, 16 bp, M. musculus
aaggagtgtgtgtgtg

SEQ ID NO: 344124 - DNA, 16 bp, M. musculus
aaggagttaaaaccat

SEQ ID NO: 344125 - DNA, 19 bp, M. musculus
aaggagttacagagacaaa

SEQ ID NO: 344126 - DNA, 17 bp, M. musculus
aaggagttacagagtca

SEQ ID NO: 344127 - DNA, 16 bp, M. musculus
aaggagttgaagcttg

SEQ ID NO: 344128 - DNA, 16 bp, M. musculus
aaggagttggagaaca

SEQ ID NO: 344129 - DNA, 16 bp, M. musculus
aaggataaaagggctg

SEQ ID NO: 344130 - DNA, 17 bp, M. musculus
aaggataaacaagctga

SEQ ID NO: 344131 - DNA, 16 bp, M. musculus
aaggataacatttaat

SEQ ID NO: 344132 - DNA, 16 bp, M. musculus
aaggataaggacagca

SEQ ID NO: 344133 - DNA, 16 bp, M. musculus
aaggataataagtata

SEQ ID NO: 344134 - DNA, 16 bp, M. musculus
aaggatacagaaaata

SEQ ID NO: 344135 - DNA, 16 bp, M. musculus
aaggatacttggcatc

SEQ ID NO: 344136 - DNA, 16 bp, M. musculus
aaggatatggaggaag

SEQ ID NO: 344137 - DNA, 16 bp, M. musculus
aaggatatttatttat

SEQ ID NO: 344138 - DNA, 16 bp, M. musculus
aaggatcacaagttca

SEQ ID NO: 344139 - DNA, 16 bp, M. musculus
aaggatccagcatgga

SEQ ID NO: 344140 - DNA, 16 bp, M. musculus
aaggatctattgatca

SEQ ID NO: 344141 - DNA, 16 bp, M. musculus
aaggatctggagaaag

SEQ ID NO: 344142 - DNA, 16 bp, M. musculus
aaggatctggtgtgga

SEQ ID NO: 344143 - DNA, 16 bp, M. musculus
aaggatcttcaccaac

SEQ ID NO: 344144 - DNA, 16 bp, M. musculus
aaggatgaaatggaga

SEQ ID NO: 344145 - DNA, 16 bp, M. musculus
aaggatgaacaggctg

SEQ ID NO: 344146 - DNA, 16 bp, M. musculus
aaggatgaagcagagt

SEQ ID NO: 344147 - DNA, 16 bp, M. musculus
aaggatgaagccacag

SEQ ID NO: 344148 - DNA, 16 bp, M. musculus
aaggatgaattggcgg

SEQ ID NO: 344149 - DNA, 16 bp, M. musculus
aaggatgagaaaatca

SEQ ID NO: 344150 - DNA, 16 bp, M. musculus
aaggatgaggccacag

SEQ ID NO: 344151 - DNA, 16 bp, M. musculus
aaggatgcagagaaag

SEQ ID NO: 344152 - DNA, 16 bp, M. musculus
aaggatgcagggatgg

SEQ ID NO: 344153 - DNA, 16 bp, M. musculus
aaggatgctgggaaaa

SEQ ID NO: 344154 - DNA, 16 bp, M. musculus
aaggatgctgggaact

SEQ ID NO: 344155 - DNA, 16 bp, M. musculus
aaggatggacaggagg

SEQ ID NO: 344156 - DNA, 16 bp, M. musculus
aaggatggagagatga

SEQ ID NO: 344157 - DNA, 16 bp, M. musculus
aaggatggatggatgg

SEQ ID NO: 344158 - DNA, 16 bp, M. musculus
aaggatggatgggtgg

SEQ ID NO: 344159 - DNA, 16 bp, M. musculus
aaggatggggccaccc

SEQ ID NO: 344160 - DNA, 16 bp, M. musculus
aaggatggggctggag

SEQ ID NO: 344161 - DNA, 16 bp, M. musculus
aaggatgtcaaaggga

SEQ ID NO: 344162 - DNA, 16 bp, M. musculus
aaggatgtggaagaag

SEQ ID NO: 344163 - DNA, 16 bp, M. musculus
aaggatgtggaggaag

SEQ ID NO: 344164 - DNA, 16 bp, M. musculus
aaggatgttgagaaag

SEQ ID NO: 344165 - DNA, 16 bp, M. musculus
aaggatgttgttttcc

SEQ ID NO: 344166 - DNA, 16 bp, M. musculus
aaggattaatttcttg

SEQ ID NO: 344167 - DNA, 16 bp, M. musculus
aaggattactttcttt

SEQ ID NO: 344168 - DNA, 16 bp, M. musculus
aaggattgcattggaa

SEQ ID NO: 344169 - DNA, 16 bp, M. musculus
aaggattgctttcttg

SEQ ID NO: 344170 - DNA, 16 bp, M. musculus
aaggattgtgggaagg

SEQ ID NO: 344171 - DNA, 16 bp, M. musculus
aaggatttattcattt

SEQ ID NO: 344172 - DNA, 16 bp, M. musculus
aaggatttttaaaaat

SEQ ID NO: 344173 - DNA, 16 bp, M. musculus
aaggcaaaagaaactg

SEQ ID NO: 344174 - DNA, 16 bp, M. musculus
aaggcaaaagacaatg

SEQ ID NO: 344175 - DNA, 16 bp, M. musculus
aaggcaaaagacgctg

SEQ ID NO: 344176 - DNA, 16 bp, M. musculus
aaggcaaaatgacaag

SEQ ID NO: 344177 - DNA, 16 bp, M. musculus
aaggcaaagcaaagca

SEQ ID NO: 344178 - DNA, 16 bp, M. musculus
aaggcaaagcaaattt

SEQ ID NO: 344179 - DNA, 16 bp, M. musculus
aaggcaaagcaaggca

SEQ ID NO: 344180 - DNA, 16 bp, M. musculus
aaggcaaaggacaatg

SEQ ID NO: 344181 - DNA, 16 bp, M. musculus
aaggcaaaggacacag

SEQ ID NO: 344182 - DNA, 16 bp, M. musculus
aaggcaaaggacacca

SEQ ID NO: 344183 - DNA, 16 bp, M. musculus
aaggcaaatggaagaa

SEQ ID NO: 344184 - DNA, 16 bp, M. musculus
aaggcaaattttataa

SEQ ID NO: 344185 - DNA, 16 bp, M. musculus
aaggcaacaggcacca

SEQ ID NO: 344186 - DNA, 16 bp, M. musculus
aaggcaactcttagaa

SEQ ID NO: 344187 - DNA, 16 bp, M. musculus
aaggcaactcttataa

SEQ ID NO: 344188 - DNA, 16 bp, M. musculus
aaggcaacttatagaa

SEQ ID NO: 344189 - DNA, 16 bp, M. musculus
aaggcaagaggatcac

SEQ ID NO: 344190 - DNA, 16 bp, M. musculus
aaggcaagcctgagct

SEQ ID NO: 344191 - DNA, 16 bp, M. musculus
aaggcaagctgagcaa

SEQ ID NO: 344192 - DNA, 16 bp, M. musculus
aaggcaaggagaggca

SEQ ID NO: 344193 - DNA, 17 bp, M. musculus
aaggcaaggcaaggcaa

SEQ ID NO: 344194 - DNA, 16 bp, M. musculus
aaggcaagggccacca

SEQ ID NO: 344195 - DNA, 16 bp, M. musculus
aaggcaagtctttttt

SEQ ID NO: 344196 - DNA, 16 bp, M. musculus
aaggcaataaacaaag

SEQ ID NO: 344197 - DNA, 16 bp, M. musculus
aaggcaatcctctgct

SEQ ID NO: 344198 - DNA, 21 bp, M. musculus
aaggcaatttcgctgcagaca

SEQ ID NO: 344199 - DNA, 16 bp, M. musculus
aaggcaccctggtgct

SEQ ID NO: 344200 - DNA, 16 bp, M. musculus
aaggcactgctgcagg

SEQ ID NO: 344201 - DNA, 16 bp, M. musculus
aaggcagaaacctgaa

SEQ ID NO: 344202 - DNA, 16 bp, M. musculus
aaggcagaaatttcag

SEQ ID NO: 344203 - DNA, 16 bp, M. musculus
aaggcagaagagcctg

SEQ ID NO: 344204 - DNA, 16 bp, M. musculus
aaggcagaagagggca

SEQ ID NO: 344205 - DNA, 16 bp, M. musculus
aaggcagacatggtgg

SEQ ID NO: 344206 - DNA, 16 bp, M. musculus
aaggcagactccagaa

SEQ ID NO: 344207 - DNA, 16 bp, M. musculus
aaggcagagaagcagg

SEQ ID NO: 344208 - DNA, 16 bp, M. musculus
aaggcagagaatgata

SEQ ID NO: 344209 - DNA, 16 bp, M. musculus
aaggcagagctggaga

SEQ ID NO: 344210 - DNA, 16 bp, M. musculus
aaggcagaggacaact

SEQ ID NO: 344211 - DNA, 16 bp, M. musculus
aaggcagaggcaggag

SEQ ID NO: 344212 - DNA, 16 bp, M. musculus
aaggcagaggcaggtg

SEQ ID NO: 344213 - DNA, 16 bp, M. musculus
aaggcagagggaatgg

SEQ ID NO: 344214 - DNA, 16 bp, M. musculus
aaggcagatggaggga

SEQ ID NO: 344215 - DNA, 16 bp, M. musculus
aaggcagcagcagcag

SEQ ID NO: 344216 - DNA, 16 bp, M. musculus
aaggcagcagcaggag

SEQ ID NO: 344217 - DNA, 16 bp, M. musculus
aaggcagcaggaagag

SEQ ID NO: 344218 - DNA, 16 bp, M. musculus
aaggcagcaggaggag

SEQ ID NO: 344219 - DNA, 16 bp, M. musculus
aaggcagcagggacca

SEQ ID NO: 344220 - DNA, 16 bp, M. musculus
aaggcagcccaattag

SEQ ID NO: 344221 - DNA, 16 bp, M. musculus
aaggcagctaggagaa

SEQ ID NO: 344222 - DNA, 16 bp, M. musculus
aaggcagctcacaacc

SEQ ID NO: 344223 - DNA, 16 bp, M. musculus
aaggcagctcttataa

SEQ ID NO: 344224 - DNA, 16 bp, M. musculus
aaggcaggaacatggt

SEQ ID NO: 344225 - DNA, 16 bp, M. musculus
aaggcaggaagatctc

SEQ ID NO: 344226 - DNA, 16 bp, M. musculus
aaggcaggaagctgga

SEQ ID NO: 344227 - DNA, 16 bp, M. musculus
aaggcaggagtgggtg

SEQ ID NO: 344228 - DNA, 16 bp, M. musculus
aaggcaggcaggagga

SEQ ID NO: 344229 - DNA, 16 bp, M. musculus
aaggcagggacagcag

SEQ ID NO: 344230 - DNA, 16 bp, M. musculus
aaggcaggtgccacca

SEQ ID NO: 344231 - DNA, 17 bp, M. musculus
aaggcaggtggatttct

SEQ ID NO: 344232 - DNA, 16 bp, M. musculus
aaggcagtgaggcagg

SEQ ID NO: 344233 - DNA, 16 bp, M. musculus
aaggcatattaaaaat

SEQ ID NO: 344234 - DNA, 16 bp, M. musculus
aaggcatcaaaattaa

SEQ ID NO: 344235 - DNA, 16 bp, M. musculus
aaggcatcagatcccc

SEQ ID NO: 344236 - DNA, 16 bp, M. musculus
aaggcatccttaagaa

SEQ ID NO: 344237 - DNA, 16 bp, M. musculus
aaggcatgagagcagg

SEQ ID NO: 344238 - DNA, 16 bp, M. musculus
aaggcatgtactacca

SEQ ID NO: 344239 - DNA, 16 bp, M. musculus
aaggcatgtgccaccg

SEQ ID NO: 344240 - DNA, 16 bp, M. musculus
aaggcatgtgcctcca

SEQ ID NO: 344241 - DNA, 16 bp, M. musculus
aaggcatgtgttacca

SEQ ID NO: 344242 - DNA, 16 bp, M. musculus
aaggcattttaagatt

SEQ ID NO: 344243 - DNA, 16 bp, M. musculus
aaggcattttatatta

SEQ ID NO: 344244 - DNA, 16 bp, M. musculus
aaggcattttccactt

SEQ ID NO: 344245 - DNA, 16 bp, M. musculus
aaggcattttctgaat

SEQ ID NO: 344246 - DNA, 16 bp, M. musculus
aaggcattttcttgat

SEQ ID NO: 344247 - DNA, 16 bp, M. musculus
aaggccaaaagccatg

SEQ ID NO: 344248 - DNA, 16 bp, M. musculus
aaggccaacctgggct

SEQ ID NO: 344249 - DNA, 16 bp, M. musculus
aaggccaagcctggtc

SEQ ID NO: 344250 - DNA, 16 bp, M. musculus
aaggccaaggccaagg

SEQ ID NO: 344251 - DNA, 16 bp, M. musculus
aaggccacacagagaa

SEQ ID NO: 344252 - DNA, 16 bp, M. musculus
aaggccacacctactt

SEQ ID NO: 344253 - DNA, 16 bp, M. musculus
aaggccaccaacagaa

SEQ ID NO: 344254 - DNA, 16 bp, M. musculus
aaggccaccaacaggt

SEQ ID NO: 344255 - DNA, 16 bp, M. musculus
aaggccaccctgatct

SEQ ID NO: 344256 - DNA, 16 bp, M. musculus
aaggccacctttgatg

SEQ ID NO: 344257 - DNA, 16 bp, M. musculus
aaggccacgcctcctc

SEQ ID NO: 344258 - DNA, 16 bp, M. musculus
aaggccacgccttcta

SEQ ID NO: 344259 - DNA, 16 bp, M. musculus
aaggccactccctggg

SEQ ID NO: 344260 - DNA, 16 bp, M. musculus
aaggccagaagagggc

SEQ ID NO: 344261 - DNA, 16 bp, M. musculus
aaggccagaagcttgg

SEQ ID NO: 344262 - DNA, 16 bp, M. musculus
aaggccagaatgagct

SEQ ID NO: 344263 - DNA, 16 bp, M. musculus
aaggccagagaccatc

SEQ ID NO: 344264 - DNA, 16 bp, M. musculus
aaggccagcagtatac

SEQ ID NO: 344265 - DNA, 16 bp, M. musculus
aaggccagccaggact

SEQ ID NO: 344266 - DNA, 16 bp, M. musculus
aaggccagccaggtct

SEQ ID NO: 344267 - DNA, 16 bp, M. musculus
aaggccagcctaggct

SEQ ID NO: 344268 - DNA, 16 bp, M. musculus
aaggccagcctagttt

SEQ ID NO: 344269 - DNA, 16 bp, M. musculus
aaggccagcctcagct

SEQ ID NO: 344270 - DNA, 17 bp, M. musculus
aaggccagcctgggctc

SEQ ID NO: 344271 - DNA, 16 bp, M. musculus
aaggccagcctggggt

SEQ ID NO: 344272 - DNA, 16 bp, M. musculus
aaggccagcctgggta

SEQ ID NO: 344273 - DNA, 16 bp, M. musculus
aaggccagccttgtct

SEQ ID NO: 344274 - DNA, 17 bp, M. musculus
aaggccagcttgggctg

SEQ ID NO: 344275 - DNA, 16 bp, M. musculus
aaggccaggctgatct

SEQ ID NO: 344276 - DNA, 16 bp, M. musculus
aaggccatcctctgct

SEQ ID NO: 344277 - DNA, 16 bp, M. musculus
aaggccatccttgact

SEQ ID NO: 344278 - DNA, 16 bp, M. musculus
aaggccatccttgtct

SEQ ID NO: 344279 - DNA, 16 bp, M. musculus
aaggccatgagttcaa

SEQ ID NO: 344280 - DNA, 16 bp, M. musculus
aaggccatggaggagt

SEQ ID NO: 344281 - DNA, 16 bp, M. musculus
aaggccattccatctt

SEQ ID NO: 344282 - DNA, 16 bp, M. musculus
aaggccattgacttct

SEQ ID NO: 344283 - DNA, 17 bp, M. musculus
aaggccattgagttgtt

SEQ ID NO: 344284 - DNA, 16 bp, M. musculus
aaggccattgatttct

SEQ ID NO: 344285 - DNA, 18 bp, M. musculus
aaggccattggagaaggt

SEQ ID NO: 344286 - DNA, 16 bp, M. musculus
aaggccattttctgct

SEQ ID NO: 344287 - DNA, 16 bp, M. musculus
aaggcccaaagggacc

SEQ ID NO: 344288 - DNA, 16 bp, M. musculus
aaggcccaagggagga

SEQ ID NO: 344289 - DNA, 16 bp, M. musculus
aaggcccagagagaaa

SEQ ID NO: 344290 - DNA, 16 bp, M. musculus
aaggccctaggttcaa

SEQ ID NO: 344291 - DNA, 16 bp, M. musculus
aaggccctgaggcagg

SEQ ID NO: 344292 - DNA, 16 bp, M. musculus
aaggccctggatttga

SEQ ID NO: 344293 - DNA, 16 bp, M. musculus
aaggccctggcttcaa

SEQ ID NO: 344294 - DNA, 16 bp, M. musculus
aaggccctgggttcca

SEQ ID NO: 344295 - DNA, 16 bp, M. musculus
aaggccgggcggtggt

SEQ ID NO: 344296 - DNA, 16 bp, M. musculus
aaggcctactccatga

SEQ ID NO: 344297 - DNA, 16 bp, M. musculus
aaggcctaggaaatag

SEQ ID NO: 344298 - DNA, 16 bp, M. musculus
aaggcctcacctccta

SEQ ID NO: 344299 - DNA, 16 bp, M. musculus
aaggcctcctggaaca

SEQ ID NO: 344300 - DNA, 16 bp, M. musculus
aaggcctctacaagaa

SEQ ID NO: 344301 - DNA, 16 bp, M. musculus
aaggcctctggcttct

SEQ ID NO: 344302 - DNA, 23 bp, M. musculus
aaggcctgaagaagatgcaggcc

SEQ ID NO: 344303 - DNA, 16 bp, M. musculus
aaggcctgccatgctt

SEQ ID NO: 344304 - DNA, 16 bp, M. musculus
aaggcctgcctgggct

SEQ ID NO: 344305 - DNA, 16 bp, M. musculus
aaggcctggaggactt

SEQ ID NO: 344306 - DNA, 16 bp, M. musculus
aaggccttaaagaaaa

SEQ ID NO: 344307 - DNA, 16 bp, M. musculus
aaggccttcaacaaaa

SEQ ID NO: 344308 - DNA, 16 bp, M. musculus
aaggccttccatcagg

SEQ ID NO: 344309 - DNA, 16 bp, M. musculus
aaggccttcctacact

SEQ ID NO: 344310 - DNA, 16 bp, M. musculus
aaggccttcctgcact

SEQ ID NO: 344311 - DNA, 16 bp, M. musculus
aaggccttgagttcaa

SEQ ID NO: 344312 - DNA, 16 bp, M. musculus
aaggccttgtttcctt

SEQ ID NO: 344313 - DNA, 16 bp, M. musculus
aaggcctttaatttct

SEQ ID NO: 344314 - DNA, 16 bp, M. musculus
aaggcctttggcttct

SEQ ID NO: 344315 - DNA, 16 bp, M. musculus
aaggcctttgggattt

SEQ ID NO: 344316 - DNA, 16 bp, M. musculus
aaggccttttccactt

SEQ ID NO: 344317 - DNA, 16 bp, M. musculus
aaggcgggtgccacca

SEQ ID NO: 344318 - DNA, 16 bp, M. musculus
aaggctaagacagact

SEQ ID NO: 344319 - DNA, 16 bp, M. musculus
aaggctacataatgag

SEQ ID NO: 344320 - DNA, 16 bp, M. musculus
aaggctacatagtgag

SEQ ID NO: 344321 - DNA, 16 bp, M. musculus
aaggctacatggagaa

SEQ ID NO: 344322 - DNA, 35 bp, M. musculus
aaggctacttgatacccaatgaatggaataaagtt

SEQ ID NO: 344323 - DNA, 16 bp, M. musculus
aaggctatccagagat

SEQ ID NO: 344324 - DNA, 16 bp, M. musculus
aaggctatcttctgct

SEQ ID NO: 344325 - DNA, 16 bp, M. musculus
aaggctcaaagtttaa

SEQ ID NO: 344326 - DNA, 16 bp, M. musculus
aaggctcaaggaacat

SEQ ID NO: 344327 - DNA, 16 bp, M. musculus
aaggctcaattccatc

SEQ ID NO: 344328 - DNA, 16 bp, M. musculus
aaggctcagggaatat

SEQ ID NO: 344329 - DNA, 16 bp, M. musculus
aaggctcagggatcta

SEQ ID NO: 344330 - DNA, 16 bp, M. musculus
aaggctcagtagttaa

SEQ ID NO: 344331 - DNA, 16 bp, M. musculus
aaggctcctaacccaa

SEQ ID NO: 344332 - DNA, 16 bp, M. musculus
aaggctctaggttcaa

SEQ ID NO: 344333 - DNA, 16 bp, M. musculus
aaggctctgagtttga

SEQ ID NO: 344334 - DNA, 16 bp, M. musculus
aaggctctggcagggc

SEQ ID NO: 344335 - DNA, 16 bp, M. musculus
aaggctcttccctact

SEQ ID NO: 344336 - DNA, 16 bp, M. musculus
aaggctgaaaggagct

SEQ ID NO: 344337 - DNA, 16 bp, M. musculus
aaggctgaaatcaacc

SEQ ID NO: 344338 - DNA, 16 bp, M. musculus
aaggctgaacaaggca

SEQ ID NO: 344339 - DNA, 16 bp, M. musculus
aaggctgaagaagctg

SEQ ID NO: 344340 - DNA, 16 bp, M. musculus
aaggctgaaggagctg

SEQ ID NO: 344341 - DNA, 16 bp, M. musculus
aaggctgaccacacag

SEQ ID NO: 344342 - DNA, 16 bp, M. musculus
aaggctgactagttga

SEQ ID NO: 344343 - DNA, 16 bp, M. musculus
aaggctgagagaagct

SEQ ID NO: 344344 - DNA, 16 bp, M. musculus
aaggctgagccatctc

SEQ ID NO: 344345 - DNA, 16 bp, M. musculus
aaggctgaggagaagg

SEQ ID NO: 344346 - DNA, 16 bp, M. musculus
aaggctgatcttcagt

SEQ ID NO: 344347 - DNA, 16 bp, M. musculus
aaggctgcccaccctc

SEQ ID NO: 344348 - DNA, 20 bp, M. musculus
aaggctgctagtggaagact

SEQ ID NO: 344349 - DNA, 16 bp, M. musculus
aaggctgctggcagaa

SEQ ID NO: 344350 - DNA, 17 bp, M. musculus
aaggctggaaaaaattt

SEQ ID NO: 344351 - DNA, 16 bp, M. musculus
aaggctggaggaggca

SEQ ID NO: 344352 - DNA, 16 bp, M. musculus
aaggctggatgaagca

SEQ ID NO: 344353 - DNA, 16 bp, M. musculus
aaggctggcctcaaac

SEQ ID NO: 344354 - DNA, 17 bp, M. musculus
aaggctggcctcgaact

SEQ ID NO: 344355 - DNA, 16 bp, M. musculus
aaggctggcctggaac

SEQ ID NO: 344356 - DNA, 16 bp, M. musculus
aaggctggccttgaac

SEQ ID NO: 344357 - DNA, 16 bp, M. musculus
aaggctggctggctgg

SEQ ID NO: 344358 - DNA, 17 bp, M. musculus
aaggctggctgtgacca

SEQ ID NO: 344359 - DNA, 16 bp, M. musculus
aaggctggctttgaac

SEQ ID NO: 344360 - DNA, 16 bp, M. musculus
aaggctggggagatgg

SEQ ID NO: 344361 - DNA, 16 bp, M. musculus
aaggctgtcctctgag

SEQ ID NO: 344362 - DNA, 17 bp, M. musculus
aaggctgtcctggaact

SEQ ID NO: 344363 - DNA, 21 bp, M. musculus
aaggctgtgacattagaggaa

SEQ ID NO: 344364 - DNA, 39 bp, M. musculus
aaggctgtgacattagaggaacgacctaaaacaggagcc

SEQ ID NO: 344365 - DNA, 16 bp, M. musculus
aaggctgtggagaaag

SEQ ID NO: 344366 - DNA, 16 bp, M. musculus
aaggctgtgggacttt

SEQ ID NO: 344367 - DNA, 16 bp, M. musculus
aaggctgtgtgtgtgt

SEQ ID NO: 344368 - DNA, 16 bp, M. musculus
aaggcttaaatgcaca

SEQ ID NO: 344369 - DNA, 16 bp, M. musculus
aaggcttcctggagga

SEQ ID NO: 344370 - DNA, 16 bp, M. musculus
aaggcttgacccatgg

SEQ ID NO: 344371 - DNA, 17 bp, M. musculus
aaggcttggggtatttc

SEQ ID NO: 344372 - DNA, 16 bp, M. musculus
aaggcttgtttgtata

SEQ ID NO: 344373 - DNA, 16 bp, M. musculus
aaggctttttcaacat

SEQ ID NO: 344374 - DNA, 16 bp, M. musculus
aaggctttttccacct

SEQ ID NO: 344375 - DNA, 16 bp, M. musculus
aaggcttttttttttc

SEQ ID NO: 344376 - DNA, 16 bp, M. musculus
aagggaaaatatttaa

SEQ ID NO: 344377 - DNA, 16 bp, M. musculus
aagggaaacctggaaa

SEQ ID NO: 344378 - DNA, 16 bp, M. musculus
aagggaaagaggtcaa

SEQ ID NO: 344379 - DNA, 16 bp, M. musculus
aagggaaagtgattgt

SEQ ID NO: 344380 - DNA, 16 bp, M. musculus
aagggaagaaggtcaa

SEQ ID NO: 344381 - DNA, 16 bp, M. musculus
aagggaagtagacact

SEQ ID NO: 344382 - DNA, 16 bp, M. musculus
aagggaatgtggagag

SEQ ID NO: 344383 - DNA, 16 bp, M. musculus
aagggaatttcagcaa

SEQ ID NO: 344384 - DNA, 26 bp, M. musculus
aagggacaaggaattaagacttttga

SEQ ID NO: 344385 - DNA, 16 bp, M. musculus
aagggacagagacaga

SEQ ID NO: 344386 - DNA, 16 bp, M. musculus
aagggaccttagatga

SEQ ID NO: 344387 - DNA, 16 bp, M. musculus
aagggactctagccag

SEQ ID NO: 344388 - DNA, 16 bp, M. musculus
aagggagaaaggccaa

SEQ ID NO: 344389 - DNA, 16 bp, M. musculus
aagggagaatatgcag

SEQ ID NO: 344390 - DNA, 17 bp, M. musculus
aagggagaccctcactc

SEQ ID NO: 344391 - DNA, 16 bp, M. musculus
aagggagataaaacca

SEQ ID NO: 344392 - DNA, 16 bp, M. musculus
aagggagcaaaaacca

SEQ ID NO: 344393 - DNA, 16 bp, M. musculus
aagggaggcagagcaa

SEQ ID NO: 344394 - DNA, 16 bp, M. musculus
aagggaggctccaagg

SEQ ID NO: 344395 - DNA, 16 bp, M. musculus
aagggagtcatttatg

SEQ ID NO: 344396 - DNA, 16 bp, M. musculus
aagggagtctcactgg

SEQ ID NO: 344397 - DNA, 16 bp, M. musculus
aagggatacacagaga

SEQ ID NO: 344398 - DNA, 16 bp, M. musculus
aagggatagagccatc

SEQ ID NO: 344399 - DNA, 16 bp, M. musculus
aagggatagccaaggg

SEQ ID NO: 344400 - DNA, 16 bp, M. musculus
aagggatccagagggt

SEQ ID NO: 344401 - DNA, 16 bp, M. musculus
aagggatgctgggaaa

SEQ ID NO: 344402 - DNA, 17 bp, M. musculus
aagggatggtaaagaaa

SEQ ID NO: 344403 - DNA, 16 bp, M. musculus
aagggatttttttaaa

SEQ ID NO: 344404 - DNA, 16 bp, M. musculus
aagggcaaaagtgaca

SEQ ID NO: 344405 - DNA, 16 bp, M. musculus
aagggcacacacacac

SEQ ID NO: 344406 - DNA, 16 bp, M. musculus
aagggcagccacactc

SEQ ID NO: 344407 - DNA, 16 bp, M. musculus
aagggcagccagtgct

SEQ ID NO: 344408 - DNA, 16 bp, M. musculus
aagggcagcccagcct

SEQ ID NO: 344409 - DNA, 16 bp, M. musculus
aagggcagcctcattc

SEQ ID NO: 344410 - DNA, 16 bp, M. musculus
aagggcatcatcctga

SEQ ID NO: 344411 - DNA, 16 bp, M. musculus
aagggccagatagcaa

SEQ ID NO: 344412 - DNA, 16 bp, M. musculus
aagggccagcaaatac

SEQ ID NO: 344413 - DNA, 16 bp, M. musculus
aagggccagcagaatg

SEQ ID NO: 344414 - DNA, 16 bp, M. musculus
aagggcctttcctccc

SEQ ID NO: 344415 - DNA, 16 bp, M. musculus
aagggcgttttttcta

SEQ ID NO: 344416 - DNA, 16 bp, M. musculus
aagggctatcctgaag

SEQ ID NO: 344417 - DNA, 16 bp, M. musculus
aagggctgggccctcc

SEQ ID NO: 344418 - DNA, 16 bp, M. musculus
aagggctgtctctgac

SEQ ID NO: 344419 - DNA, 16 bp, M. musculus
aagggctgtgtgtgtg

SEQ ID NO: 344420 - DNA, 18 bp, M. musculus
aagggctttcacacccaa

SEQ ID NO: 344421 - DNA, 16 bp, M. musculus
aagggctttgtgccct

SEQ ID NO: 344422 - DNA, 19 bp, M. musculus
aaggggaaaacatttgaaa

SEQ ID NO: 344423 - DNA, 16 bp, M. musculus
aaggggaaactctcca

SEQ ID NO: 344424 - DNA, 16 bp, M. musculus
aaggggaaactgaggc

SEQ ID NO: 344425 - DNA, 16 bp, M. musculus
aaggggaagtcccaag

SEQ ID NO: 344426 - DNA, 16 bp, M. musculus
aaggggacaggatcag

SEQ ID NO: 344427 - DNA, 16 bp, M. musculus
aaggggacttttgatt

SEQ ID NO: 344428 - DNA, 16 bp, M. musculus
aaggggagaaaatctc

SEQ ID NO: 344429 - DNA, 16 bp, M. musculus
aaggggagacctggaa

SEQ ID NO: 344430 - DNA, 16 bp, M. musculus
aaggggagacctggga

SEQ ID NO: 344431 - DNA, 16 bp, M. musculus
aaggggcagagccagc

SEQ ID NO: 344432 - DNA, 16 bp, M. musculus
aaggggcctcttccca

SEQ ID NO: 344433 - DNA, 16 bp, M. musculus
aaggggcctttctccc

SEQ ID NO: 344434 - DNA, 16 bp, M. musculus
aaggggctcacagaga

SEQ ID NO: 344435 - DNA, 16 bp, M. musculus
aaggggctgagaaaga

SEQ ID NO: 344436 - DNA, 16 bp, M. musculus
aaggggcttcccctga

SEQ ID NO: 344437 - DNA, 16 bp, M. musculus
aagggggaaaaaatca

SEQ ID NO: 344438 - DNA, 16 bp, M. musculus
aagggggaaaaaatct

SEQ ID NO: 344439 - DNA, 16 bp, M. musculus
aagggggaaaacattt

SEQ ID NO: 344440 - DNA, 16 bp, M. musculus
aagggggaaatgctgt

SEQ ID NO: 344441 - DNA, 16 bp, M. musculus
aagggggaacaaaaat

SEQ ID NO: 344442 - DNA, 16 bp, M. musculus
aagggggaaggcccct

SEQ ID NO: 344443 - DNA, 16 bp, M. musculus
aagggggctgccttag

SEQ ID NO: 344444 - DNA, 16 bp, M. musculus
aaggggggccctgggg

SEQ ID NO: 344445 - DNA, 16 bp, M. musculus
aagggggtggtcaagg

SEQ ID NO: 344446 - DNA, 16 bp, M. musculus
aaggggtcatgaccca

SEQ ID NO: 344447 - DNA, 16 bp, M. musculus
aaggggtctgaaaccc

SEQ ID NO: 344448 - DNA, 16 bp, M. musculus
aaggggtctgcgaccc

SEQ ID NO: 344449 - DNA, 16 bp, M. musculus
aaggggtgtggccttg

SEQ ID NO: 344450 - DNA, 16 bp, M. musculus
aaggggttaagtgtga

SEQ ID NO: 344451 - DNA, 20 bp, M. musculus
aagggtatcttatgactact

SEQ ID NO: 344452 - DNA, 16 bp, M. musculus
aagggtcagcagcttc

SEQ ID NO: 344453 - DNA, 16 bp, M. musculus
aagggtccaggtttgt

SEQ ID NO: 344454 - DNA, 16 bp, M. musculus
aagggtctcactgtgt

SEQ ID NO: 344455 - DNA, 16 bp, M. musculus
aagggtctggggctgg

SEQ ID NO: 344456 - DNA, 16 bp, M. musculus
aagggtgaagtgtcca

SEQ ID NO: 344457 - DNA, 16 bp, M. musculus
aagggtgagcagtaca

SEQ ID NO: 344458 - DNA, 16 bp, M. musculus
aagggtgaggcaggag

SEQ ID NO: 344459 - DNA, 16 bp, M. musculus
aagggtgcactgttct

SEQ ID NO: 344460 - DNA, 16 bp, M. musculus
aagggtgctctgagga

SEQ ID NO: 344461 - DNA, 16 bp, M. musculus
aagggtgcttgctgct

SEQ ID NO: 344462 - DNA, 16 bp, M. musculus
aagggtggagggcaga

SEQ ID NO: 344463 - DNA, 16 bp, M. musculus
aagggtggagggcagg

SEQ ID NO: 344464 - DNA, 16 bp, M. musculus
aagggtgttcccccac

SEQ ID NO: 344465 - DNA, 16 bp, M. musculus
aagggttatttgaccc

SEQ ID NO: 344466 - DNA, 16 bp, M. musculus
aagggttcattcagct

SEQ ID NO: 344467 - DNA, 16 bp, M. musculus
aagggttctttgaaaa

SEQ ID NO: 344468 - DNA, 16 bp, M. musculus
aagggttctttgggaa

SEQ ID NO: 344469 - DNA, 16 bp, M. musculus
aagggtttattttggc

SEQ ID NO: 344470 - DNA, 16 bp, M. musculus
aagggtttctctgtgt

SEQ ID NO: 344471 - DNA, 16 bp, M. musculus
aagggtttcttgtttc

SEQ ID NO: 344472 - DNA, 16 bp, M. musculus
aagggtttctttggct

SEQ ID NO: 344473 - DNA, 16 bp, M. musculus
aaggtaaaataaaccc

SEQ ID NO: 344474 - DNA, 16 bp, M. musculus
aaggtaaaattttcca

SEQ ID NO: 344475 - DNA, 16 bp, M. musculus
aaggtaaagcccctgg

SEQ ID NO: 344476 - DNA, 16 bp, M. musculus
aaggtaaatgtaggaa

SEQ ID NO: 344477 - DNA, 16 bp, M. musculus
aaggtaaattggtctg

SEQ ID NO: 344478 - DNA, 16 bp, M. musculus
aaggtaacagtaagaa

SEQ ID NO: 344479 - DNA, 16 bp, M. musculus
aaggtaactcagaccc

SEQ ID NO: 344480 - DNA, 16 bp, M. musculus
aaggtaatctctcaac

SEQ ID NO: 344481 - DNA, 16 bp, M. musculus
aaggtacatgccacca

SEQ ID NO: 344482 - DNA, 16 bp, M. musculus
aaggtacctgctgcca

SEQ ID NO: 344483 - DNA, 16 bp, M. musculus
aaggtactgagttcaa

SEQ ID NO: 344484 - DNA, 16 bp, M. musculus
aaggtagagaagccag

SEQ ID NO: 344485 - DNA, 16 bp, M. musculus
aaggtagttatttatg

SEQ ID NO: 344486 - DNA, 16 bp, M. musculus
aaggtatgttccacca

SEQ ID NO: 344487 - DNA, 16 bp, M. musculus
aaggtcaaggccagcc

SEQ ID NO: 344488 - DNA, 16 bp, M. musculus
aaggtcacacatccta

SEQ ID NO: 344489 - DNA, 16 bp, M. musculus
aaggtcaccaaaagca

SEQ ID NO: 344490 - DNA, 16 bp, M. musculus
aaggtcagaggacagc

SEQ ID NO: 344491 - DNA, 16 bp, M. musculus
aaggtcagcctggtac

SEQ ID NO: 344492 - DNA, 16 bp, M. musculus
aaggtcaggagttcaa

SEQ ID NO: 344493 - DNA, 16 bp, M. musculus
aaggtcagtctgcagc

SEQ ID NO: 344494 - DNA, 26 bp, M. musculus
aaggtcatccatgacaactttggcat

SEQ ID NO: 344495 - DNA, 16 bp, M. musculus
aaggtcatcctcagct

SEQ ID NO: 344496 - DNA, 16 bp, M. musculus
aaggtcatcctgtgct

SEQ ID NO: 344497 - DNA, 16 bp, M. musculus
aaggtcatccttgact

SEQ ID NO: 344498 - DNA, 16 bp, M. musculus
aaggtcatgctgatca

SEQ ID NO: 344499 - DNA, 17 bp, M. musculus
aaggtccaaagttcaaa

SEQ ID NO: 344500 - DNA, 17 bp, M. musculus
aaggtccagagttcaaa

SEQ ID NO: 344501 - DNA, 37 bp, M. musculus
aaggtccagagttcaaatcccagcaaccacatggtgg

SEQ ID NO: 344502 - DNA, 16 bp, M. musculus
aaggtccccagaggac

SEQ ID NO: 344503 - DNA, 16 bp, M. musculus
aaggtccctccttttg

SEQ ID NO: 344504 - DNA, 17 bp, M. musculus
aaggtccgaagttcaaa

SEQ ID NO: 344505 - DNA, 17 bp, M. musculus
aaggtccggagttcaaa

SEQ ID NO: 344506 - DNA, 16 bp, M. musculus
aaggtcctgaattcaa

SEQ ID NO: 344507 - DNA, 16 bp, M. musculus
aaggtcctgagatcaa

SEQ ID NO: 344508 - DNA, 16 bp, M. musculus
aaggtcctgagttcaa

SEQ ID NO: 344509 - DNA, 16 bp, M. musculus
aaggtcctggagtggg

SEQ ID NO: 344510 - DNA, 16 bp, M. musculus
aaggtccttgtcccca

SEQ ID NO: 344511 - DNA, 16 bp, M. musculus
aaggtctcaagttcaa

SEQ ID NO: 344512 - DNA, 16 bp, M. musculus
aaggtctcactctgta

SEQ ID NO: 344513 - DNA, 16 bp, M. musculus
aaggtctcagaaaatg

SEQ ID NO: 344514 - DNA, 16 bp, M. musculus
aaggtctctctgtgta

SEQ ID NO: 344515 - DNA, 28 bp, M. musculus
aaggtctgaagttcaaatcccagcaacc

SEQ ID NO: 344516 - DNA, 16 bp, M. musculus
aaggtctgatagaatt

SEQ ID NO: 344517 - DNA, 19 bp, M. musculus
aaggtctgctagagcagaa

SEQ ID NO: 344518 - DNA, 17 bp, M. musculus
aaggtctggagttcaaa

SEQ ID NO: 344519 - DNA, 16 bp, M. musculus
aaggtctggattcagt

SEQ ID NO: 344520 - DNA, 16 bp, M. musculus
aaggtctttttaaaaa

SEQ ID NO: 344521 - DNA, 16 bp, M. musculus
aaggtgaagcctggat

SEQ ID NO: 344522 - DNA, 16 bp, M. musculus
aaggtgaccagccatg

SEQ ID NO: 344523 - DNA, 16 bp, M. musculus
aaggtgaccaggtgct

SEQ ID NO: 344524 - DNA, 16 bp, M. musculus
aaggtgacccagtgct

SEQ ID NO: 344525 - DNA, 16 bp, M. musculus
aaggtgacctctgacc

SEQ ID NO: 344526 - DNA, 16 bp, M. musculus
aaggtgagaaccaact

SEQ ID NO: 344527 - DNA, 16 bp, M. musculus
aaggtgagctctggag

SEQ ID NO: 344528 - DNA, 16 bp, M. musculus
aaggtgaggcaggagg

SEQ ID NO: 344529 - DNA, 16 bp, M. musculus
aaggtgcacgtgtgtg

SEQ ID NO: 344530 - DNA, 16 bp, M. musculus
aaggtgcactgaagaa

SEQ ID NO: 344531 - DNA, 16 bp, M. musculus
aaggtgctagtgtatg

SEQ ID NO: 344532 - DNA, 16 bp, M. musculus
aaggtgctggagaagg

SEQ ID NO: 344533 - DNA, 16 bp, M. musculus
aaggtgctggagagat

SEQ ID NO: 344534 - DNA, 16 bp, M. musculus
aaggtgcttgctgcca

SEQ ID NO: 344535 - DNA, 16 bp, M. musculus
aaggtggaagcagaga

SEQ ID NO: 344536 - DNA, 16 bp, M. musculus
aaggtggaggcagaag

SEQ ID NO: 344537 - DNA, 16 bp, M. musculus
aaggtggcacacacct

SEQ ID NO: 344538 - DNA, 16 bp, M. musculus
aaggtggcacagggct

SEQ ID NO: 344539 - DNA, 16 bp, M. musculus
aaggtggcctggagct

SEQ ID NO: 344540 - DNA, 16 bp, M. musculus
aaggtgggaacatggc

SEQ ID NO: 344541 - DNA, 16 bp, M. musculus
aaggtgggaagaccca

SEQ ID NO: 344542 - DNA, 16 bp, M. musculus
aaggtgggagtgctgg

SEQ ID NO: 344543 - DNA, 16 bp, M. musculus
aaggtgggcaccacca

SEQ ID NO: 344544 - DNA, 16 bp, M. musculus
aaggtgggtgagctgg

SEQ ID NO: 344545 - DNA, 16 bp, M. musculus
aaggtgggtttcctgt

SEQ ID NO: 344546 - DNA, 16 bp, M. musculus
aaggtggtggcagaaa

SEQ ID NO: 344547 - DNA, 16 bp, M. musculus
aaggtgtacaccatca

SEQ ID NO: 344548 - DNA, 16 bp, M. musculus
aaggtgtagcctcagt

SEQ ID NO: 344549 - DNA, 16 bp, M. musculus
aaggtgtcctctgacc

SEQ ID NO: 344550 - DNA, 16 bp, M. musculus
aaggtgtgcaccaccc

SEQ ID NO: 344551 - DNA, 16 bp, M. musculus
aaggtgtgcactacta

SEQ ID NO: 344552 - DNA, 16 bp, M. musculus
aaggtgtgcagcacca

SEQ ID NO: 344553 - DNA, 16 bp, M. musculus
aaggtgtgcgctgcca

SEQ ID NO: 344554 - DNA, 16 bp, M. musculus
aaggtgtgtgccacaa

SEQ ID NO: 344555 - DNA, 18 bp, M. musculus
aaggtgtgtgccaccacc

SEQ ID NO: 344556 - DNA, 16 bp, M. musculus
aaggtgttgtttccat

SEQ ID NO: 344557 - DNA, 16 bp, M. musculus
aaggttatttgtttct

SEQ ID NO: 344558 - DNA, 16 bp, M. musculus
aaggttcaagaatcca

SEQ ID NO: 344559 - DNA, 16 bp, M. musculus
aaggttgaaaatcact

SEQ ID NO: 344560 - DNA, 18 bp, M. musculus
aaggttgagaaccactac

SEQ ID NO: 344561 - DNA, 16 bp, M. musculus
aaggttgaggcaggag

SEQ ID NO: 344562 - DNA, 23 bp, M. musculus
aaggttgagtgccctagggtcct

SEQ ID NO: 344563 - DNA, 16 bp, M. musculus
aaggttggtcttgaac

SEQ ID NO: 344564 - DNA, 16 bp, M. musculus
aaggttgtacctcatg

SEQ ID NO: 344565 - DNA, 16 bp, M. musculus
aaggttgtctactctc

SEQ ID NO: 344566 - DNA, 16 bp, M. musculus
aaggttgtctttgtat

SEQ ID NO: 344567 - DNA, 16 bp, M. musculus
aaggttgttgttgttg

SEQ ID NO: 344568 - DNA, 16 bp, M. musculus
aaggtttattttaaat

SEQ ID NO: 344569 - DNA, 16 bp, M. musculus
aaggtttctttgtgta

SEQ ID NO: 344570 - DNA, 16 bp, M. musculus
aaggtttgaagttcaa

SEQ ID NO: 344571 - DNA, 16 bp, M. musculus
aaggtttgatagaatt

SEQ ID NO: 344572 - DNA, 16 bp, M. musculus
aaggttttgtgggttg

SEQ ID NO: 344573 - DNA, 18 bp, M. musculus
aagtaaaagatctgtatg

SEQ ID NO: 344574 - DNA, 16 bp, M. musculus
aagtaaaataaatctt

SEQ ID NO: 344575 - DNA, 16 bp, M. musculus
aagtaaacagaaagga

SEQ ID NO: 344576 - DNA, 16 bp, M. musculus
aagtaaagtgggaaat

SEQ ID NO: 344577 - DNA, 16 bp, M. musculus
aagtaaagttgatctg

SEQ ID NO: 344578 - DNA, 16 bp, M. musculus
aagtaaataaaacttt

SEQ ID NO: 344579 - DNA, 16 bp, M. musculus
aagtaaataaatcttt

SEQ ID NO: 344580 - DNA, 16 bp, M. musculus
aagtaaattatctttt

SEQ ID NO: 344581 - DNA, 16 bp, M. musculus
aagtaaatttcttatt

SEQ ID NO: 344582 - DNA, 16 bp, M. musculus
aagtaacacagcttct

SEQ ID NO: 344583 - DNA, 16 bp, M. musculus
aagtaacattttaaaa

SEQ ID NO: 344584 - DNA, 16 bp, M. musculus
aagtaaccccaataaa

SEQ ID NO: 344585 - DNA, 16 bp, M. musculus
aagtaactaatacaga

SEQ ID NO: 344586 - DNA, 16 bp, M. musculus
aagtaacttttatttt

SEQ ID NO: 344587 - DNA, 16 bp, M. musculus
aagtaagtaagtaaat

SEQ ID NO: 344588 - DNA, 16 bp, M. musculus
aagtaagttattaaag

SEQ ID NO: 344589 - DNA, 16 bp, M. musculus
aagtaatccttcaaga

SEQ ID NO: 344590 - DNA, 16 bp, M. musculus
aagtaatctggactgt

SEQ ID NO: 344591 - DNA, 16 bp, M. musculus
aagtaatgatggaaaa

SEQ ID NO: 344592 - DNA, 17 bp, M. musculus
aagtaattactatgcag

SEQ ID NO: 344593 - DNA, 16 bp, M. musculus
aagtaattttatggtt

SEQ ID NO: 344594 - DNA, 16 bp, M. musculus
aagtacaaggacctga

SEQ ID NO: 344595 - DNA, 16 bp, M. musculus
aagtacagagccagat

SEQ ID NO: 344596 - DNA, 16 bp, M. musculus
aagtacaggaaaacac

SEQ ID NO: 344597 - DNA, 16 bp, M. musculus
aagtacaggaaaatac

SEQ ID NO: 344598 - DNA, 18 bp, M. musculus
aagtacaggtacttatca

SEQ ID NO: 344599 - DNA, 16 bp, M. musculus
aagtacatcaaagaac

SEQ ID NO: 344600 - DNA, 16 bp, M. musculus
aagtacattttttaaa

SEQ ID NO: 344601 - DNA, 16 bp, M. musculus
aagtacccaaggaggt

SEQ ID NO: 344602 - DNA, 16 bp, M. musculus
aagtactctaccaact

SEQ ID NO: 344603 - DNA, 16 bp, M. musculus
aagtactgtgattaca

SEQ ID NO: 344604 - DNA, 16 bp, M. musculus
aagtacttacactgta

SEQ ID NO: 344605 - DNA, 16 bp, M. musculus
aagtagaaacccttaa

SEQ ID NO: 344606 - DNA, 29 bp, M. musculus
aagtagacatctgtgtcctcacattgggt

SEQ ID NO: 344607 - DNA, 16 bp, M. musculus
aagtagagcattgttc

SEQ ID NO: 344608 - DNA, 16 bp, M. musculus
aagtagataagaatgg

SEQ ID NO: 344609 - DNA, 16 bp, M. musculus
aagtagatctctgtga

SEQ ID NO: 344610 - DNA, 16 bp, M. musculus
aagtagcaaagaaata

SEQ ID NO: 344611 - DNA, 16 bp, M. musculus
aagtagcaacaaaata

SEQ ID NO: 344612 - DNA, 16 bp, M. musculus
aagtagcaacaaagta

SEQ ID NO: 344613 - DNA, 16 bp, M. musculus
aagtagcaaggaaaat

SEQ ID NO: 344614 - DNA, 16 bp, M. musculus
aagtagcaatgaaata

SEQ ID NO: 344615 - DNA, 16 bp, M. musculus
aagtagcactattagg

SEQ ID NO: 344616 - DNA, 16 bp, M. musculus
aagtagcagaagatgg

SEQ ID NO: 344617 - DNA, 16 bp, M. musculus
aagtagccaggcagtg

SEQ ID NO: 344618 - DNA, 16 bp, M. musculus
aagtagctgaatacaa

SEQ ID NO: 344619 - DNA, 16 bp, M. musculus
aagtaggatgtcagtt

SEQ ID NO: 344620 - DNA, 16 bp, M. musculus
aagtagtgtctgtctt

SEQ ID NO: 344621 - DNA, 16 bp, M. musculus
aagtataagatgaata

SEQ ID NO: 344622 - DNA, 16 bp, M. musculus
aagtatacaaggagct

SEQ ID NO: 344623 - DNA, 16 bp, M. musculus
aagtatatctatccca

SEQ ID NO: 344624 - DNA, 16 bp, M. musculus
aagtatcagaagaaaa

SEQ ID NO: 344625 - DNA, 16 bp, M. musculus
aagtatcagaagatgg

SEQ ID NO: 344626 - DNA, 16 bp, M. musculus
aagtatcattttaaaa

SEQ ID NO: 344627 - DNA, 16 bp, M. musculus
aagtatccaaatatat

SEQ ID NO: 344628 - DNA, 16 bp, M. musculus
aagtatctttttaaaa

SEQ ID NO: 344629 - DNA, 16 bp, M. musculus
aagtatgagccaaata

SEQ ID NO: 344630 - DNA, 16 bp, M. musculus
aagtatgatgacatca

SEQ ID NO: 344631 - DNA, 16 bp, M. musculus
aagtatggacactttg

SEQ ID NO: 344632 - DNA, 16 bp, M. musculus
aagtatgtatatatgt

SEQ ID NO: 344633 - DNA, 16 bp, M. musculus
aagtatgtatgtatgt

SEQ ID NO: 344634 - DNA, 16 bp, M. musculus
aagtatttaaaataca

SEQ ID NO: 344635 - DNA, 16 bp, M. musculus
aagtatttaagtattt

SEQ ID NO: 344636 - DNA, 16 bp, M. musculus
aagtatttactatgta

SEQ ID NO: 344637 - DNA, 16 bp, M. musculus
aagtatttatcagtgg

SEQ ID NO: 344638 - DNA, 16 bp, M. musculus
aagtatttattgaata

SEQ ID NO: 344639 - DNA, 16 bp, M. musculus
aagtattttattagct

SEQ ID NO: 344640 - DNA, 16 bp, M. musculus
aagtatttttaaagaa

SEQ ID NO: 344641 - DNA, 16 bp, M. musculus
aagtcaactcttataa

SEQ ID NO: 344642 - DNA, 16 bp, M. musculus
aagtcaagaaggaaga

SEQ ID NO: 344643 - DNA, 16 bp, M. musculus
aagtcaagattcctga

SEQ ID NO: 344644 - DNA, 16 bp, M. musculus
aagtcaaggaggggca

SEQ ID NO: 344645 - DNA, 16 bp, M. musculus
aagtcaaggcaggagc

SEQ ID NO: 344646 - DNA, 16 bp, M. musculus
aagtcacagaagaaaa

SEQ ID NO: 344647 - DNA, 16 bp, M. musculus
aagtcacccaagagga

SEQ ID NO: 344648 - DNA, 16 bp, M. musculus
aagtcacccagaacct

SEQ ID NO: 344649 - DNA, 16 bp, M. musculus
aagtcactatgtagac

SEQ ID NO: 344650 - DNA, 16 bp, M. musculus
aagtcactgaccccac

SEQ ID NO: 344651 - DNA, 16 bp, M. musculus
aagtcactgcagaact

SEQ ID NO: 344652 - DNA, 16 bp, M. musculus
aagtcagaagctgcag

SEQ ID NO: 344653 - DNA, 16 bp, M. musculus
aagtcagagcaggaac

SEQ ID NO: 344654 - DNA, 16 bp, M. musculus
aagtcagaggaaaact

SEQ ID NO: 344655 - DNA, 16 bp, M. musculus
aagtcagaggaggaaa

SEQ ID NO: 344656 - DNA, 16 bp, M. musculus
aagtcagaggctgaga

SEQ ID NO: 344657 - DNA, 17 bp, M. musculus
aagtcagagtttgtgga

SEQ ID NO: 344658 - DNA, 16 bp, M. musculus
aagtcagatgacaact

SEQ ID NO: 344659 - DNA, 16 bp, M. musculus
aagtcagcaagcagca

SEQ ID NO: 344660 - DNA, 16 bp, M. musculus
aagtcagcaggaggaa

SEQ ID NO: 344661 - DNA, 16 bp, M. musculus
aagtcagcaggaggga

SEQ ID NO: 344662 - DNA, 16 bp, M. musculus
aagtcagcctcagcta

SEQ ID NO: 344663 - DNA, 16 bp, M. musculus
aagtcagctacagtga

SEQ ID NO: 344664 - DNA, 16 bp, M. musculus
aagtcagctctctcct

SEQ ID NO: 344665 - DNA, 16 bp, M. musculus
aagtcaggcatggtga

SEQ ID NO: 344666 - DNA, 16 bp, M. musculus
aagtcagggaagaaac

SEQ ID NO: 344667 - DNA, 16 bp, M. musculus
aagtcagggaaggaac

SEQ ID NO: 344668 - DNA, 16 bp, M. musculus
aagtcagggcaggaac

SEQ ID NO: 344669 - DNA, 16 bp, M. musculus
aagtcagggcaggagc

SEQ ID NO: 344670 - DNA, 16 bp, M. musculus
aagtcagtaagcagca

SEQ ID NO: 344671 - DNA, 16 bp, M. musculus
aagtcagtctctctct

SEQ ID NO: 344672 - DNA, 16 bp, M. musculus
aagtcagtcttcctct

SEQ ID NO: 344673 - DNA, 16 bp, M. musculus
aagtcagtcttctgct

SEQ ID NO: 344674 - DNA, 16 bp, M. musculus
aagtcagtctttcact

SEQ ID NO: 344675 - DNA, 16 bp, M. musculus
aagtcagtgctcttaa

SEQ ID NO: 344676 - DNA, 24 bp, M. musculus
aagtcatatgacttagctgcagtc

SEQ ID NO: 344677 - DNA, 16 bp, M. musculus
aagtcatccatggctt

SEQ ID NO: 344678 - DNA, 16 bp, M. musculus
aagtcatcccaggaac

SEQ ID NO: 344679 - DNA, 16 bp, M. musculus
aagtcatccctactgt

SEQ ID NO: 344680 - DNA, 16 bp, M. musculus
aagtcatccttggcta

SEQ ID NO: 344681 - DNA, 16 bp, M. musculus
aagtcatggtggcagg

SEQ ID NO: 344682 - DNA, 16 bp, M. musculus
aagtcatttatttgtg

SEQ ID NO: 344683 - DNA, 16 bp, M. musculus
aagtcatttcaaaaga

SEQ ID NO: 344684 - DNA, 16 bp, M. musculus
aagtcattttaaaaag

SEQ ID NO: 344685 - DNA, 16 bp, M. musculus
aagtccaagatcaagg

SEQ ID NO: 344686 - DNA, 17 bp, M. musculus
aagtccaagtggatcaa

SEQ ID NO: 344687 - DNA, 16 bp, M. musculus
aagtccagcaatcaaa

SEQ ID NO: 344688 - DNA, 16 bp, M. musculus
aagtccagcctggtct

SEQ ID NO: 344689 - DNA, 16 bp, M. musculus
aagtccagtctggtct

SEQ ID NO: 344690 - DNA, 16 bp, M. musculus
aagtccagttccagga

SEQ ID NO: 344691 - DNA, 100 bp, M. musculus
aagtccatatcttttaattgtaccttataccgctgcacaggttcaaaccttggcagccacatctaatgattgggcagttttagttacctccttttcagga

SEQ ID NO: 344692 - DNA, 16 bp, M. musculus
aagtcccaaaacagga

SEQ ID NO: 344693 - DNA, 16 bp, M. musculus
aagtcccacctctttc

SEQ ID NO: 344694 - DNA, 16 bp, M. musculus
aagtcccagagatgaa

SEQ ID NO: 344695 - DNA, 16 bp, M. musculus
aagtcccagattccag

SEQ ID NO: 344696 - DNA, 16 bp, M. musculus
aagtcccccaaccccc

SEQ ID NO: 344697 - DNA, 16 bp, M. musculus
aagtcccccaagccct

SEQ ID NO: 344698 - DNA, 16 bp, M. musculus
aagtcccccaaggtga

SEQ ID NO: 344699 - DNA, 16 bp, M. musculus
aagtcccccacaggct

SEQ ID NO: 344700 - DNA, 16 bp, M. musculus
aagtcccccaccccct

SEQ ID NO: 344701 - DNA, 16 bp, M. musculus
aagtcccccatacgct

SEQ ID NO: 344702 - DNA, 16 bp, M. musculus
aagtcccctatacccc

SEQ ID NO: 344703 - DNA, 16 bp, M. musculus
aagtcccctttaccct

SEQ ID NO: 344704 - DNA, 17 bp, M. musculus
aagtccctgaagaaaga

SEQ ID NO: 344705 - DNA, 16 bp, M. musculus
aagtcctagatgccag

SEQ ID NO: 344706 - DNA, 16 bp, M. musculus
aagtcctctatcacca

SEQ ID NO: 344707 - DNA, 16 bp, M. musculus
aagtcctctgctgtgt

SEQ ID NO: 344708 - DNA, 16 bp, M. musculus
aagtcctggatatacc

SEQ ID NO: 344709 - DNA, 17 bp, M. musculus
aagtccttaaagaggaa

SEQ ID NO: 344710 - DNA, 22 bp, M. musculus
aagtccttcttgatgtcctcta

SEQ ID NO: 344711 - DNA, 16 bp, M. musculus
aagtccttgagctgac

SEQ ID NO: 344712 - DNA, 16 bp, M. musculus
aagtccttgctgacag

SEQ ID NO: 344713 - DNA, 16 bp, M. musculus
aagtctaagtggatct

SEQ ID NO: 344714 - DNA, 25 bp, M. musculus
aagtctactgggcacagaaaataac

SEQ ID NO: 344715 - DNA, 16 bp, M. musculus
aagtctattccttcac

SEQ ID NO: 344716 - DNA, 16 bp, M. musculus
aagtctcaaaaaataa

SEQ ID NO: 344717 - DNA, 16 bp, M. musculus
aagtctcaaaacagcc

SEQ ID NO: 344718 - DNA, 16 bp, M. musculus
aagtctcaactgagga

SEQ ID NO: 344719 - DNA, 17 bp, M. musculus
aagtctcacaaagagaa

SEQ ID NO: 344720 - DNA, 16 bp, M. musculus
aagtctcagcctcaga

SEQ ID NO: 344721 - DNA, 16 bp, M. musculus
aagtctcatgtaattc

SEQ ID NO: 344722 - DNA, 24 bp, M. musculus
aagtctctagatggtccatccttt

SEQ ID NO: 344723 - DNA, 16 bp, M. musculus
aagtctctcactctct

SEQ ID NO: 344724 - DNA, 16 bp, M. musculus
aagtctctcactggcc

SEQ ID NO: 344725 - DNA, 18 bp, M. musculus
aagtctctgaagaaagaa

SEQ ID NO: 344726 - DNA, 16 bp, M. musculus
aagtctctgaagacag

SEQ ID NO: 344727 - DNA, 16 bp, M. musculus
aagtctctgcaaagct

SEQ ID NO: 344728 - DNA, 16 bp, M. musculus
aagtctctgttgagaa

SEQ ID NO: 344729 - DNA, 16 bp, M. musculus
aagtctcttttaaaaa

SEQ ID NO: 344730 - DNA, 16 bp, M. musculus
aagtctgagcttccag

SEQ ID NO: 344731 - DNA, 16 bp, M. musculus
aagtctgatgatctga

SEQ ID NO: 344732 - DNA, 16 bp, M. musculus
aagtctgcaaccctat

SEQ ID NO: 344733 - DNA, 16 bp, M. musculus
aagtctgctgtgagat

SEQ ID NO: 344734 - DNA, 16 bp, M. musculus
aagtctgtagctccag

SEQ ID NO: 344735 - DNA, 16 bp, M. musculus
aagtctgtcactgtgg

SEQ ID NO: 344736 - DNA, 16 bp, M. musculus
aagtcttaagcatgga

SEQ ID NO: 344737 - DNA, 16 bp, M. musculus
aagtcttaattctgaa

SEQ ID NO: 344738 - DNA, 16 bp, M. musculus
aagtcttctactatta

SEQ ID NO: 344739 - DNA, 16 bp, M. musculus
aagtcttgagttcaaa

SEQ ID NO: 344740 - DNA, 16 bp, M. musculus
aagtcttgcctggtta

SEQ ID NO: 344741 - DNA, 16 bp, M. musculus
aagtcttgggttctat

SEQ ID NO: 344742 - DNA, 16 bp, M. musculus
aagtctttaaaaatat

SEQ ID NO: 344743 - DNA, 16 bp, M. musculus
aagtctttaaagagga

SEQ ID NO: 344744 - DNA, 16 bp, M. musculus
aagtctttgaagaaag

SEQ ID NO: 344745 - DNA, 16 bp, M. musculus
aagtctttttaaaaga

SEQ ID NO: 344746 - DNA, 16 bp, M. musculus
aagtcttttttaaaaa

SEQ ID NO: 344747 - DNA, 16 bp, M. musculus
aagtgaaacagaagag

SEQ ID NO: 344748 - DNA, 16 bp, M. musculus
aagtgaaagaccttta

SEQ ID NO: 344749 - DNA, 16 bp, M. musculus
aagtgaagatgcttca

SEQ ID NO: 344750 - DNA, 16 bp, M. musculus
aagtgaaggaattgaa

SEQ ID NO: 344751 - DNA, 16 bp, M. musculus
aagtgaatattaaccc

SEQ ID NO: 344752 - DNA, 16 bp, M. musculus
aagtgaattcttttgt

SEQ ID NO: 344753 - DNA, 16 bp, M. musculus
aagtgaatttgaaaaa

SEQ ID NO: 344754 - DNA, 16 bp, M. musculus
aagtgacaccagccct

SEQ ID NO: 344755 - DNA, 16 bp, M. musculus
aagtgactctagtttg

SEQ ID NO: 344756 - DNA, 16 bp, M. musculus
aagtgagctcacaggc

SEQ ID NO: 344757 - DNA, 16 bp, M. musculus
aagtgaggcaaggctg

SEQ ID NO: 344758 - DNA, 16 bp, M. musculus
aagtgaggcagaagcc

SEQ ID NO: 344759 - DNA, 16 bp, M. musculus
aagtgagttattaaaa

SEQ ID NO: 344760 - DNA, 16 bp, M. musculus
aagtgagttccagcac

SEQ ID NO: 344761 - DNA, 22 bp, M. musculus
aagtgagttccgggacagccag

SEQ ID NO: 344762 - DNA, 16 bp, M. musculus
aagtgatagccaagtg

SEQ ID NO: 344763 - DNA, 16 bp, M. musculus
aagtgatggtcatgaa

SEQ ID NO: 344764 - DNA, 16 bp, M. musculus
aagtgattgctgacag

SEQ ID NO: 344765 - DNA, 16 bp, M. musculus
aagtgatttctttctt

SEQ ID NO: 344766 - DNA, 16 bp, M. musculus
aagtgcaagcagttga

SEQ ID NO: 344767 - DNA, 16 bp, M. musculus
aagtgcagagcaagca

SEQ ID NO: 344768 - DNA, 16 bp, M. musculus
aagtgcagggacaaag

SEQ ID NO: 344769 - DNA, 16 bp, M. musculus
aagtgcctccataaag

SEQ ID NO: 344770 - DNA, 16 bp, M. musculus
aagtgcctttacctga

SEQ ID NO: 344771 - DNA, 16 bp, M. musculus
aagtgcctttatctgc

SEQ ID NO: 344772 - DNA, 16 bp, M. musculus
aagtgctaagattata

SEQ ID NO: 344773 - DNA, 16 bp, M. musculus
aagtgctctgccactg

SEQ ID NO: 344774 - DNA, 16 bp, M. musculus
aagtgctgagccacct

SEQ ID NO: 344775 - DNA, 16 bp, M. musculus
aagtgctgctgctgct

SEQ ID NO: 344776 - DNA, 16 bp, M. musculus
aagtgctggaattata

SEQ ID NO: 344777 - DNA, 16 bp, M. musculus
aagtgctgggaatcaa

SEQ ID NO: 344778 - DNA, 16 bp, M. musculus
aagtgctgggattacc

SEQ ID NO: 344779 - DNA, 19 bp, M. musculus
aagtgctgggtttaaaggt

SEQ ID NO: 344780 - DNA, 17 bp, M. musculus
aagtgcttccatgagat

SEQ ID NO: 344781 - DNA, 16 bp, M. musculus
aagtgcttgccacaca

SEQ ID NO: 344782 - DNA, 16 bp, M. musculus
aagtgcttgccgtgca

SEQ ID NO: 344783 - DNA, 16 bp, M. musculus
aagtgcttgctgcaaa

SEQ ID NO: 344784 - DNA, 16 bp, M. musculus
aagtgcttgctggcag

SEQ ID NO: 344785 - DNA, 16 bp, M. musculus
aagtgcttgctgtgca

SEQ ID NO: 344786 - DNA, 16 bp, M. musculus
aagtgcttgtcacaca

SEQ ID NO: 344787 - DNA, 16 bp, M. musculus
aagtgctttcctttat

SEQ ID NO: 344788 - DNA, 16 bp, M. musculus
aagtgctttgcccact

SEQ ID NO: 344789 - DNA, 16 bp, M. musculus
aagtgctttgttaact

SEQ ID NO: 344790 - DNA, 16 bp, M. musculus
aagtgcttttaaaaat

SEQ ID NO: 344791 - DNA, 16 bp, M. musculus
aagtggaaaatgaaca

SEQ ID NO: 344792 - DNA, 16 bp, M. musculus
aagtggaaaatgtttg

SEQ ID NO: 344793 - DNA, 16 bp, M. musculus
aagtggaaacaaagag

SEQ ID NO: 344794 - DNA, 16 bp, M. musculus
aagtggaaacaaccca

SEQ ID NO: 344795 - DNA, 16 bp, M. musculus
aagtggaaaccaaaag

SEQ ID NO: 344796 - DNA, 16 bp, M. musculus
aagtggaaagtgtctg

SEQ ID NO: 344797 - DNA, 16 bp, M. musculus
aagtggaaatgtctgg

SEQ ID NO: 344798 - DNA, 16 bp, M. musculus
aagtggaacactcctc

SEQ ID NO: 344799 - DNA, 16 bp, M. musculus
aagtggaagaaagaca

SEQ ID NO: 344800 - DNA, 16 bp, M. musculus
aagtggaccaaggaac

SEQ ID NO: 344801 - DNA, 16 bp, M. musculus
aagtggagaatttaga

SEQ ID NO: 344802 - DNA, 16 bp, M. musculus
aagtggagacaggaag

SEQ ID NO: 344803 - DNA, 16 bp, M. musculus
aagtggagcagaaact

SEQ ID NO: 344804 - DNA, 16 bp, M. musculus
aagtggagtgttgaag

SEQ ID NO: 344805 - DNA, 25 bp, M. musculus
aagtggatactccctttcataacac

SEQ ID NO: 344806 - DNA, 16 bp, M. musculus
aagtggatcaaagaac

SEQ ID NO: 344807 - DNA, 16 bp, M. musculus
aagtggatcaacctga

SEQ ID NO: 344808 - DNA, 16 bp, M. musculus
aagtggatgaaagacc

SEQ ID NO: 344809 - DNA, 16 bp, M. musculus
aagtggatgagaatga

SEQ ID NO: 344810 - DNA, 16 bp, M. musculus
aagtggatgctcagag

SEQ ID NO: 344811 - DNA, 16 bp, M. musculus
aagtggatgctcatag

SEQ ID NO: 344812 - DNA, 16 bp, M. musculus
aagtggatggaggaag

SEQ ID NO: 344813 - DNA, 16 bp, M. musculus
aagtggatggggaaag

SEQ ID NO: 344814 - DNA, 16 bp, M. musculus
aagtggcaacaaaata

SEQ ID NO: 344815 - DNA, 16 bp, M. musculus
aagtggcaagaagctg

SEQ ID NO: 344816 - DNA, 16 bp, M. musculus
aagtggccagatgtct

SEQ ID NO: 344817 - DNA, 16 bp, M. musculus
aagtggctcagtggtt

SEQ ID NO: 344818 - DNA, 16 bp, M. musculus
aagtggctgagaaaca

SEQ ID NO: 344819 - DNA, 17 bp, M. musculus
aagtgggaatgggtggt

SEQ ID NO: 344820 - DNA, 16 bp, M. musculus
aagtgggaatgtgtgg

SEQ ID NO: 344821 - DNA, 16 bp, M. musculus
aagtgggacccagctc

SEQ ID NO: 344822 - DNA, 16 bp, M. musculus
aagtgggagtagaaaa

SEQ ID NO: 344823 - DNA, 16 bp, M. musculus
aagtgggattgaggca

SEQ ID NO: 344824 - DNA, 16 bp, M. musculus
aagtgggcagatgtct

SEQ ID NO: 344825 - DNA, 16 bp, M. musculus
aagtgggctggagaga

SEQ ID NO: 344826 - DNA, 16 bp, M. musculus
aagtgggtattagcca

SEQ ID NO: 344827 - DNA, 16 bp, M. musculus
aagtgggttccaggac

SEQ ID NO: 344828 - DNA, 16 bp, M. musculus
aagtggtcttcagatc

SEQ ID NO: 344829 - DNA, 16 bp, M. musculus
aagtggtgaattattt

SEQ ID NO: 344830 - DNA, 16 bp, M. musculus
aagtggtggcacatgc

SEQ ID NO: 344831 - DNA, 16 bp, M. musculus
aagtggtggcctgctt

SEQ ID NO: 344832 - DNA, 16 bp, M. musculus
aagtggttatcaatta

SEQ ID NO: 344833 - DNA, 16 bp, M. musculus
aagtgtaaactgaata

SEQ ID NO: 344834 - DNA, 17 bp, M. musculus
aagtgtaagccaaataa

SEQ ID NO: 344835 - DNA, 16 bp, M. musculus
aagtgtattttaaaaa

SEQ ID NO: 344836 - DNA, 16 bp, M. musculus
aagtgtcaccagttaa

SEQ ID NO: 344837 - DNA, 16 bp, M. musculus
aagtgtccttctccat

SEQ ID NO: 344838 - DNA, 16 bp, M. musculus
aagtgtctggatttgg

SEQ ID NO: 344839 - DNA, 16 bp, M. musculus
aagtgtctttgtggaa

SEQ ID NO: 344840 - DNA, 16 bp, M. musculus
aagtgtgaagagtgtc

SEQ ID NO: 344841 - DNA, 16 bp, M. musculus
aagtgtgaggacctga

SEQ ID NO: 344842 - DNA, 16 bp, M. musculus
aagtgtgcagccttgt

SEQ ID NO: 344843 - DNA, 16 bp, M. musculus
aagtgtggacactctg

SEQ ID NO: 344844 - DNA, 16 bp, M. musculus
aagtgtggagctgaga

SEQ ID NO: 344845 - DNA, 16 bp, M. musculus
aagtgtggaggtcaga

SEQ ID NO: 344846 - DNA, 16 bp, M. musculus
aagtgtggattctttg

SEQ ID NO: 344847 - DNA, 16 bp, M. musculus
aagtgtggctttgttg

SEQ ID NO: 344848 - DNA, 16 bp, M. musculus
aagtgtgggatgtgga

SEQ ID NO: 344849 - DNA, 16 bp, M. musculus
aagtgtgtcaatgtgg

SEQ ID NO: 344850 - DNA, 16 bp, M. musculus
aagtgtgtcattgagg

SEQ ID NO: 344851 - DNA, 16 bp, M. musculus
aagtgtgtgtatgtgt

SEQ ID NO: 344852 - DNA, 16 bp, M. musculus
aagtgtgtgtgcgtgt

SEQ ID NO: 344853 - DNA, 16 bp, M. musculus
aagtgtgtgtgtgcgt

SEQ ID NO: 344854 - DNA, 16 bp, M. musculus
aagtgtgtgtgtgttt

SEQ ID NO: 344855 - DNA, 16 bp, M. musculus
aagtgttacagctctt

SEQ ID NO: 344856 - DNA, 16 bp, M. musculus
aagtgttcccctttct

SEQ ID NO: 344857 - DNA, 16 bp, M. musculus
aagtgttccttctgtt

SEQ ID NO: 344858 - DNA, 16 bp, M. musculus
aagtgttcttcaccac

SEQ ID NO: 344859 - DNA, 16 bp, M. musculus
aagtgttgagattata

SEQ ID NO: 344860 - DNA, 19 bp, M. musculus
aagtgttgggattaaaggt

SEQ ID NO: 344861 - DNA, 16 bp, M. musculus
aagtgttgggattaca

SEQ ID NO: 344862 - DNA, 16 bp, M. musculus
aagtgtttaatttctt

SEQ ID NO: 344863 - DNA, 16 bp, M. musculus
aagtgttttctgaaaa

SEQ ID NO: 344864 - DNA, 16 bp, M. musculus
aagtgttttctgagat

SEQ ID NO: 344865 - DNA, 16 bp, M. musculus
aagttaagactccaga

SEQ ID NO: 344866 - DNA, 16 bp, M. musculus
aagttaagtttatgat

SEQ ID NO: 344867 - DNA, 17 bp, M. musculus
aagttacaatatttcat

SEQ ID NO: 344868 - DNA, 16 bp, M. musculus
aagttacagtgtctct

SEQ ID NO: 344869 - DNA, 16 bp, M. musculus
aagttactttgctgct

SEQ ID NO: 344870 - DNA, 16 bp, M. musculus
aagttacttttatgaa

SEQ ID NO: 344871 - DNA, 16 bp, M. musculus
aagttagaaagagcaa

SEQ ID NO: 344872 - DNA, 16 bp, M. musculus
aagttaggaaggaagg

SEQ ID NO: 344873 - DNA, 16 bp, M. musculus
aagttagggaggaaag

SEQ ID NO: 344874 - DNA, 16 bp, M. musculus
aagttatcaataaaga

SEQ ID NO: 344875 - DNA, 16 bp, M. musculus
aagttatgaaaaaatg

SEQ ID NO: 344876 - DNA, 16 bp, M. musculus
aagttatgaaataagt

SEQ ID NO: 344877 - DNA, 16 bp, M. musculus
aagttatttcaaaaat

SEQ ID NO: 344878 - DNA, 16 bp, M. musculus
aagttatttctctgct

SEQ ID NO: 344879 - DNA, 16 bp, M. musculus
aagttatttttcaaaa

SEQ ID NO: 344880 - DNA, 16 bp, M. musculus
aagttcaaagccagcc

SEQ ID NO: 344881 - DNA, 16 bp, M. musculus
aagttcaaagtctcct

SEQ ID NO: 344882 - DNA, 16 bp, M. musculus
aagttcaagaacagcc

SEQ ID NO: 344883 - DNA, 16 bp, M. musculus
aagttcaagaccagac

SEQ ID NO: 344884 - DNA, 16 bp, M. musculus
aagttcaagaccagcc

SEQ ID NO: 344885 - DNA, 16 bp, M. musculus
aagttcaagatcagcc

SEQ ID NO: 344886 - DNA, 16 bp, M. musculus
aagttcaaggacagcc

SEQ ID NO: 344887 - DNA, 16 bp, M. musculus
aagttcaaggccaacc

SEQ ID NO: 344888 - DNA, 16 bp, M. musculus
aagttcaaggccagcc

SEQ ID NO: 344889 - DNA, 17 bp, M. musculus
aagttcaaggccagcca

SEQ ID NO: 344890 - DNA, 16 bp, M. musculus
aagttcaaggccagct

SEQ ID NO: 344891 - DNA, 16 bp, M. musculus
aagttcaaggccagtc

SEQ ID NO: 344892 - DNA, 16 bp, M. musculus
aagttcaaggccattc

SEQ ID NO: 344893 - DNA, 16 bp, M. musculus
aagttcaaggctggcc

SEQ ID NO: 344894 - DNA, 16 bp, M. musculus
aagttcaaggctggct

SEQ ID NO: 344895 - DNA, 16 bp, M. musculus
aagttcaaggtcatct

SEQ ID NO: 344896 - DNA, 16 bp, M. musculus
aagttcaagtgaatca

SEQ ID NO: 344897 - DNA, 16 bp, M. musculus
aagttcaattcccaga

SEQ ID NO: 344898 - DNA, 16 bp, M. musculus
aagttcagagtcatcc

SEQ ID NO: 344899 - DNA, 16 bp, M. musculus
aagttcagcctggtct

SEQ ID NO: 344900 - DNA, 16 bp, M. musculus
aagttcatgcccaagg

SEQ ID NO: 344901 - DNA, 16 bp, M. musculus
aagttccaaatccagg

SEQ ID NO: 344902 - DNA, 16 bp, M. musculus
aagttccagaatgtcc

SEQ ID NO: 344903 - DNA, 16 bp, M. musculus
aagttccagaccagcc

SEQ ID NO: 344904 - DNA, 17 bp, M. musculus
aagttccaggacagcca

SEQ ID NO: 344905 - DNA, 16 bp, M. musculus
aagttccaggacatcc

SEQ ID NO: 344906 - DNA, 16 bp, M. musculus
aagttccaggagagcc

SEQ ID NO: 344907 - DNA, 16 bp, M. musculus
aagttccaggccaatg

SEQ ID NO: 344908 - DNA, 16 bp, M. musculus
aagttccaggccagct

SEQ ID NO: 344909 - DNA, 18 bp, M. musculus
aagttccaggccagtcaa

SEQ ID NO: 344910 - DNA, 16 bp, M. musculus
aagttccatcatgtgt

SEQ ID NO: 344911 - DNA, 16 bp, M. musculus
aagttcctgaagaaag

SEQ ID NO: 344912 - DNA, 16 bp, M. musculus
aagttcgagaccagcc

SEQ ID NO: 344913 - DNA, 16 bp, M. musculus
aagttctagaccagcc

SEQ ID NO: 344914 - DNA, 16 bp, M. musculus
aagttctatttttatt

SEQ ID NO: 344915 - DNA, 16 bp, M. musculus
aagttctcagcttcaa

SEQ ID NO: 344916 - DNA, 16 bp, M. musculus
aagttctcctctgacc

SEQ ID NO: 344917 - DNA, 16 bp, M. musculus
aagttctcttccctct

SEQ ID NO: 344918 - DNA, 16 bp, M. musculus
aagttctctttttttg

SEQ ID NO: 344919 - DNA, 16 bp, M. musculus
aagttctgcctctgtc

SEQ ID NO: 344920 - DNA, 16 bp, M. musculus
aagttctgggatcaca

SEQ ID NO: 344921 - DNA, 16 bp, M. musculus
aagttcttaaagaaaa

SEQ ID NO: 344922 - DNA, 16 bp, M. musculus
aagttcttagaaaatt

SEQ ID NO: 344923 - DNA, 16 bp, M. musculus
aagttcttatattgtt

SEQ ID NO: 344924 - DNA, 16 bp, M. musculus
aagttctttataaaat

SEQ ID NO: 344925 - DNA, 16 bp, M. musculus
aagttctttattgttg

SEQ ID NO: 344926 - DNA, 16 bp, M. musculus
aagttcttttaaaatt

SEQ ID NO: 344927 - DNA, 16 bp, M. musculus
aagttgaaaaatcttc

SEQ ID NO: 344928 - DNA, 16 bp, M. musculus
aagttgaagaagatat

SEQ ID NO: 344929 - DNA, 16 bp, M. musculus
aagttgaagaagatct

SEQ ID NO: 344930 - DNA, 16 bp, M. musculus
aagttgaagtgtttat

SEQ ID NO: 344931 - DNA, 16 bp, M. musculus
aagttgacaaaaaaca

SEQ ID NO: 344932 - DNA, 16 bp, M. musculus
aagttgacaaaaacaa

SEQ ID NO: 344933 - DNA, 16 bp, M. musculus
aagttgacaactaaga

SEQ ID NO: 344934 - DNA, 16 bp, M. musculus
aagttgacaataaaga

SEQ ID NO: 344935 - DNA, 16 bp, M. musculus
aagttgacagtgaaga

SEQ ID NO: 344936 - DNA, 16 bp, M. musculus
aagttgagagagataa

SEQ ID NO: 344937 - DNA, 16 bp, M. musculus
aagttgagccttgatc

SEQ ID NO: 344938 - DNA, 16 bp, M. musculus
aagttgaggaggaaaa

SEQ ID NO: 344939 - DNA, 16 bp, M. musculus
aagttgccctctgact

SEQ ID NO: 344940 - DNA, 16 bp, M. musculus
aagttgcctggaaaag

SEQ ID NO: 344941 - DNA, 16 bp, M. musculus
aagttgcctttattat

SEQ ID NO: 344942 - DNA, 16 bp, M. musculus
aagttgctcttgtcag

SEQ ID NO: 344943 - DNA, 16 bp, M. musculus
aagttgcttagttatg

SEQ ID NO: 344944 - DNA, 16 bp, M. musculus
aagttgctttggtcat

SEQ ID NO: 344945 - DNA, 16 bp, M. musculus
aagttgcttttggtca

SEQ ID NO: 344946 - DNA, 16 bp, M. musculus
aagttgctttttgttt

SEQ ID NO: 344947 - DNA, 16 bp, M. musculus
aagttggaaagaaaat

SEQ ID NO: 344948 - DNA, 16 bp, M. musculus
aagttggaaagctgca

SEQ ID NO: 344949 - DNA, 16 bp, M. musculus
aagttggaaaggaaga

SEQ ID NO: 344950 - DNA, 20 bp, M. musculus
aagttggactaaatgcattt

SEQ ID NO: 344951 - DNA, 16 bp, M. musculus
aagttggagaggaaaa

SEQ ID NO: 344952 - DNA, 16 bp, M. musculus
aagttggcattctgtt

SEQ ID NO: 344953 - DNA, 16 bp, M. musculus
aagttggcctctgacc

SEQ ID NO: 344954 - DNA, 16 bp, M. musculus
aagttggccttgaact

SEQ ID NO: 344955 - DNA, 16 bp, M. musculus
aagttggctttgaact

SEQ ID NO: 344956 - DNA, 16 bp, M. musculus
aagttggggaaaaaag

SEQ ID NO: 344957 - DNA, 16 bp, M. musculus
aagttgggtgggtaag

SEQ ID NO: 344958 - DNA, 16 bp, M. musculus
aagttggttttgaaaa

SEQ ID NO: 344959 - DNA, 16 bp, M. musculus
aagttgtatttatgta

SEQ ID NO: 344960 - DNA, 16 bp, M. musculus
aagttgtcctctgatc

SEQ ID NO: 344961 - DNA, 16 bp, M. musculus
aagttgtcctttgatc

SEQ ID NO: 344962 - DNA, 16 bp, M. musculus
aagttgtgaaacaaat

SEQ ID NO: 344963 - DNA, 16 bp, M. musculus
aagttgtgctctgacc

SEQ ID NO: 344964 - DNA, 16 bp, M. musculus
aagttgttcaaggagc

SEQ ID NO: 344965 - DNA, 16 bp, M. musculus
aagttgttggccaaag

SEQ ID NO: 344966 - DNA, 16 bp, M. musculus
aagttgtttataaggt

SEQ ID NO: 344967 - DNA, 16 bp, M. musculus
aagttgtttgtcaggt

SEQ ID NO: 344968 - DNA, 16 bp, M. musculus
aagttgtttttagtca

SEQ ID NO: 344969 - DNA, 16 bp, M. musculus
aagtttaaagttctga

SEQ ID NO: 344970 - DNA, 16 bp, M. musculus
aagtttaagctgaata

SEQ ID NO: 344971 - DNA, 16 bp, M. musculus
aagtttaaggacagcc

SEQ ID NO: 344972 - DNA, 16 bp, M. musculus
aagtttacaaaagaga

SEQ ID NO: 344973 - DNA, 16 bp, M. musculus
aagtttactattttga

SEQ ID NO: 344974 - DNA, 16 bp, M. musculus
aagtttacttggcatc

SEQ ID NO: 344975 - DNA, 16 bp, M. musculus
aagtttatattttctt

SEQ ID NO: 344976 - DNA, 16 bp, M. musculus
aagtttattgggaagc

SEQ ID NO: 344977 - DNA, 16 bp, M. musculus
aagtttcaggccatcc

SEQ ID NO: 344978 - DNA, 16 bp, M. musculus
aagtttccatgtgttt

SEQ ID NO: 344979 - DNA, 16 bp, M. musculus
aagtttctaacacaaa

SEQ ID NO: 344980 - DNA, 16 bp, M. musculus
aagtttctagaagtgg

SEQ ID NO: 344981 - DNA, 16 bp, M. musculus
aagtttctgcaaagca

SEQ ID NO: 344982 - DNA, 16 bp, M. musculus
aagtttcttcaatgaa

SEQ ID NO: 344983 - DNA, 16 bp, M. musculus
aagtttgaaccaacac

SEQ ID NO: 344984 - DNA, 16 bp, M. musculus
aagtttgaagaaatta

SEQ ID NO: 344985 - DNA, 16 bp, M. musculus
aagtttgaagatgtgt

SEQ ID NO: 344986 - DNA, 16 bp, M. musculus
aagtttgagaccagcc

SEQ ID NO: 344987 - DNA, 16 bp, M. musculus
aagtttgagaccagct

SEQ ID NO: 344988 - DNA, 16 bp, M. musculus
aagtttgaggatagcc

SEQ ID NO: 344989 - DNA, 17 bp, M. musculus
aagtttgaggccagcca

SEQ ID NO: 344990 - DNA, 18 bp, M. musculus
aagtttgattcctagcac

SEQ ID NO: 344991 - DNA, 16 bp, M. musculus
aagtttgcaaggccaa

SEQ ID NO: 344992 - DNA, 16 bp, M. musculus
aagtttgcacaactaa

SEQ ID NO: 344993 - DNA, 16 bp, M. musculus
aagtttgcccagctgg

SEQ ID NO: 344994 - DNA, 16 bp, M. musculus
aagtttggagctaagt

SEQ ID NO: 344995 - DNA, 16 bp, M. musculus
aagtttggagctcaga

SEQ ID NO: 344996 - DNA, 16 bp, M. musculus
aagtttggagctgagt

SEQ ID NO: 344997 - DNA, 16 bp, M. musculus
aagtttgggcatgttg

SEQ ID NO: 344998 - DNA, 16 bp, M. musculus
aagtttgggtattttg

SEQ ID NO: 344999 - DNA, 16 bp, M. musculus
aagtttggttcccaga

SEQ ID NO: 345000 - DNA, 16 bp, M. musculus
aagtttgtagctgaga

SEQ ID NO: 345001 - DNA, 16 bp, M. musculus
aagtttgttttaaaat

SEQ ID NO: 345002 - DNA, 16 bp, M. musculus
aagttttaaaaatcta

SEQ ID NO: 345003 - DNA, 16 bp, M. musculus
aagttttaaaaggaaa

SEQ ID NO: 345004 - DNA, 16 bp, M. musculus
aagttttcatttctct

SEQ ID NO: 345005 - DNA, 16 bp, M. musculus
aagttttccagtttta

SEQ ID NO: 345006 - DNA, 16 bp, M. musculus
aagttttcctctgacc

SEQ ID NO: 345007 - DNA, 16 bp, M. musculus
aagttttctttttata

SEQ ID NO: 345008 - DNA, 16 bp, M. musculus
aagttttgaaatttta

SEQ ID NO: 345009 - DNA, 16 bp, M. musculus
aagttttgtggctggg

SEQ ID NO: 345010 - DNA, 16 bp, M. musculus
aagttttgtgggtgga

SEQ ID NO: 345011 - DNA, 16 bp, M. musculus
aagtttttaaaaatga

SEQ ID NO: 345012 - DNA, 16 bp, M. musculus
aagtttttaaaacatt

SEQ ID NO: 345013 - DNA, 16 bp, M. musculus
aagtttttcatttaaa

SEQ ID NO: 345014 - DNA, 16 bp, M. musculus
aagtttttctttaatt

SEQ ID NO: 345015 - DNA, 16 bp, M. musculus
aagtttttgacctgga

SEQ ID NO: 345016 - DNA, 16 bp, M. musculus
aagttttttctccttt

SEQ ID NO: 345017 - DNA, 16 bp, M. musculus
aataaaaaagcagtct

SEQ ID NO: 345018 - DNA, 16 bp, M. musculus
aataaaaaagctgatg

SEQ ID NO: 345019 - DNA, 16 bp, M. musculus
aataaaaaatgttcaa

SEQ ID NO: 345020 - DNA, 16 bp, M. musculus
aataaaaacagaattt

SEQ ID NO: 345021 - DNA, 16 bp, M. musculus
aataaaaacttgcatt

SEQ ID NO: 345022 - DNA, 16 bp, M. musculus
aataaaaagccataga

SEQ ID NO: 345023 - DNA, 16 bp, M. musculus
aataaaaatatcaagt

SEQ ID NO: 345024 - DNA, 16 bp, M. musculus
aataaaaatgacaatg

SEQ ID NO: 345025 - DNA, 16 bp, M. musculus
aataaaaatgacattt

SEQ ID NO: 345026 - DNA, 16 bp, M. musculus
aataaaaatgtcaaca

SEQ ID NO: 345027 - DNA, 16 bp, M. musculus
aataaaaatgttcttt

SEQ ID NO: 345028 - DNA, 16 bp, M. musculus
aataaaaattgcatgg

SEQ ID NO: 345029 - DNA, 16 bp, M. musculus
aataaaacaatactga

SEQ ID NO: 345030 - DNA, 16 bp, M. musculus
aataaaacagatggtg

SEQ ID NO: 345031 - DNA, 16 bp, M. musculus
aataaaacagtaacta

SEQ ID NO: 345032 - DNA, 16 bp, M. musculus
aataaaacatcttcat

SEQ ID NO: 345033 - DNA, 16 bp, M. musculus
aataaaacattttcca

SEQ ID NO: 345034 - DNA, 16 bp, M. musculus
aataaaacctcttcca

SEQ ID NO: 345035 - DNA, 16 bp, M. musculus
aataaaacctttctcc

SEQ ID NO: 345036 - DNA, 16 bp, M. musculus
aataaaactaccccca

SEQ ID NO: 345037 - DNA, 16 bp, M. musculus
aataaaactgaaatat

SEQ ID NO: 345038 - DNA, 16 bp, M. musculus
aataaaactgcatggt

SEQ ID NO: 345039 - DNA, 16 bp, M. musculus
aataaaactgttaaaa

SEQ ID NO: 345040 - DNA, 16 bp, M. musculus
aataaaacttactttt

SEQ ID NO: 345041 - DNA, 16 bp, M. musculus
aataaaagaacctgtg

SEQ ID NO: 345042 - DNA, 16 bp, M. musculus
aataaaagaactgcta

SEQ ID NO: 345043 - DNA, 16 bp, M. musculus
aataaaagaacttctg

SEQ ID NO: 345044 - DNA, 16 bp, M. musculus
aataaaagaatttcta

SEQ ID NO: 345045 - DNA, 16 bp, M. musculus
aataaaagagcctctg

SEQ ID NO: 345046 - DNA, 16 bp, M. musculus
aataaaagatacattt

SEQ ID NO: 345047 - DNA, 16 bp, M. musculus
aataaaagcaacatat

SEQ ID NO: 345048 - DNA, 16 bp, M. musculus
aataaaagcaattttc

SEQ ID NO: 345049 - DNA, 16 bp, M. musculus
aataaaagcatattta

SEQ ID NO: 345050 - DNA, 16 bp, M. musculus
aataaaagcatcattt

SEQ ID NO: 345051 - DNA, 16 bp, M. musculus
aataaaagcatttcta

SEQ ID NO: 345052 - DNA, 16 bp, M. musculus
aataaaagctacattt

SEQ ID NO: 345053 - DNA, 16 bp, M. musculus
aataaaaggacataga

SEQ ID NO: 345054 - DNA, 16 bp, M. musculus
aataaaaggctaaagc

SEQ ID NO: 345055 - DNA, 16 bp, M. musculus
aataaaagtgacattt

SEQ ID NO: 345056 - DNA, 16 bp, M. musculus
aataaaagtgatattt

SEQ ID NO: 345057 - DNA, 16 bp, M. musculus
aataaaagtttgtttt

SEQ ID NO: 345058 - DNA, 16 bp, M. musculus
aataaaataaacattg

SEQ ID NO: 345059 - DNA, 16 bp, M. musculus
aataaaataagtcttt

SEQ ID NO: 345060 - DNA, 16 bp, M. musculus
aataaaatactcagaa

SEQ ID NO: 345061 - DNA, 16 bp, M. musculus
aataaaatagatgttt

SEQ ID NO: 345062 - DNA, 16 bp, M. musculus
aataaaatatccatga

SEQ ID NO: 345063 - DNA, 16 bp, M. musculus
aataaaatattcatga

SEQ ID NO: 345064 - DNA, 16 bp, M. musculus
aataaaatatttctac

SEQ ID NO: 345065 - DNA, 16 bp, M. musculus
aataaaatattttcag

SEQ ID NO: 345066 - DNA, 16 bp, M. musculus
aataaaatcagtcatt

SEQ ID NO: 345067 - DNA, 16 bp, M. musculus
aataaaatccattcat

SEQ ID NO: 345068 - DNA, 16 bp, M. musculus
aataaaatctgaaaat

SEQ ID NO: 345069 - DNA, 16 bp, M. musculus
aataaaatcttgaaaa

SEQ ID NO: 345070 - DNA, 16 bp, M. musculus
aataaaatcttgctaa

SEQ ID NO: 345071 - DNA, 16 bp, M. musculus
aataaaatgaactttc

SEQ ID NO: 345072 - DNA, 16 bp, M. musculus
aataaaatgactccta

SEQ ID NO: 345073 - DNA, 16 bp, M. musculus
aataaaatgcattaaa

SEQ ID NO: 345074 - DNA, 16 bp, M. musculus
aataaaatgcttgaaa

SEQ ID NO: 345075 - DNA, 16 bp, M. musculus
aataaaatgcttttta

SEQ ID NO: 345076 - DNA, 16 bp, M. musculus
aataaaatgggggaga

SEQ ID NO: 345077 - DNA, 16 bp, M. musculus
aataaaatgtgttttt

SEQ ID NO: 345078 - DNA, 16 bp, M. musculus
aataaaatgtttcctt

SEQ ID NO: 345079 - DNA, 16 bp, M. musculus
aataaaatgtttctaa

SEQ ID NO: 345080 - DNA, 16 bp, M. musculus
aataaaatgttttaga

SEQ ID NO: 345081 - DNA, 16 bp, M. musculus
aataaaattctcacta

SEQ ID NO: 345082 - DNA, 16 bp, M. musculus
aataaaattctcatta

SEQ ID NO: 345083 - DNA, 16 bp, M. musculus
aataaaattgatttcc

SEQ ID NO: 345084 - DNA, 16 bp, M. musculus
aataaaattgtctttg

SEQ ID NO: 345085 - DNA, 16 bp, M. musculus
aataaaatttcattgt

SEQ ID NO: 345086 - DNA, 16 bp, M. musculus
aataaacaaatgaatg

SEQ ID NO: 345087 - DNA, 16 bp, M. musculus
aataaacagtctgaga

SEQ ID NO: 345088 - DNA, 16 bp, M. musculus
aataaacatatatatg

SEQ ID NO: 345089 - DNA, 16 bp, M. musculus
aataaacatgtttaaa

SEQ ID NO: 345090 - DNA, 16 bp, M. musculus
aataaacatttaaaag

SEQ ID NO: 345091 - DNA, 16 bp, M. musculus
aataaacattttaatg

SEQ ID NO: 345092 - DNA, 16 bp, M. musculus
aataaacccttccctc

SEQ ID NO: 345093 - DNA, 16 bp, M. musculus
aataaaccctttcctc

SEQ ID NO: 345094 - DNA, 16 bp, M. musculus
aataaaccctttcttc

SEQ ID NO: 345095 - DNA, 16 bp, M. musculus
aataaaccctttgttc

SEQ ID NO: 345096 - DNA, 16 bp, M. musculus
aataaacccttttccc

SEQ ID NO: 345097 - DNA, 16 bp, M. musculus
aataaacccttttctc

SEQ ID NO: 345098 - DNA, 16 bp, M. musculus
aataaacctcttttct

SEQ ID NO: 345099 - DNA, 16 bp, M. musculus
aataaacctgagattc

SEQ ID NO: 345100 - DNA, 16 bp, M. musculus
aataaacctgccttta

SEQ ID NO: 345101 - DNA, 16 bp, M. musculus
aataaaccttttcctc

SEQ ID NO: 345102 - DNA, 16 bp, M. musculus
aataaaccttttcttt

SEQ ID NO: 345103 - DNA, 17 bp, M. musculus
aataaacgtgtgcagaa

SEQ ID NO: 345104 - DNA, 24 bp, M. musculus
aataaacgtgtgcagaaggatcct

SEQ ID NO: 345105 - DNA, 16 bp, M. musculus
aataaactcacccttt

SEQ ID NO: 345106 - DNA, 16 bp, M. musculus
aataaactcactggtt

SEQ ID NO: 345107 - DNA, 16 bp, M. musculus
aataaactcattggtt

SEQ ID NO: 345108 - DNA, 16 bp, M. musculus
aataaactcttccctc

SEQ ID NO: 345109 - DNA, 16 bp, M. musculus
aataaactcttctttc

SEQ ID NO: 345110 - DNA, 16 bp, M. musculus
aataaactgaaaagag

SEQ ID NO: 345111 - DNA, 16 bp, M. musculus
aataaacttgaaattt

SEQ ID NO: 345112 - DNA, 16 bp, M. musculus
aataaagaaaacatct

SEQ ID NO: 345113 - DNA, 16 bp, M. musculus
aataaagaaaatgccc

SEQ ID NO: 345114 - DNA, 16 bp, M. musculus
aataaagaaaatgtcc

SEQ ID NO: 345115 - DNA, 16 bp, M. musculus
aataaagaaacatttt

SEQ ID NO: 345116 - DNA, 16 bp, M. musculus
aataaagaaatacatt

SEQ ID NO: 345117 - DNA, 16 bp, M. musculus
aataaagaaatcacag

SEQ ID NO: 345118 - DNA, 16 bp, M. musculus
aataaagaagagctga

SEQ ID NO: 345119 - DNA, 16 bp, M. musculus
aataaagacatttaaa

SEQ ID NO: 345120 - DNA, 16 bp, M. musculus
aataaagacattttta

SEQ ID NO: 345121 - DNA, 16 bp, M. musculus
aataaagaccaaagtg

SEQ ID NO: 345122 - DNA, 16 bp, M. musculus
aataaagactttcaat

SEQ ID NO: 345123 - DNA, 16 bp, M. musculus
aataaagatgccagca

SEQ ID NO: 345124 - DNA, 16 bp, M. musculus
aataaagatgtcaaca

SEQ ID NO: 345125 - DNA, 16 bp, M. musculus
aataaagatttattga

SEQ ID NO: 345126 - DNA, 16 bp, M. musculus
aataaagattttcaaa

SEQ ID NO: 345127 - DNA, 20 bp, M. musculus
aataaagcctcatgtggttt

SEQ ID NO: 345128 - DNA, 16 bp, M. musculus
aataaagccttttctc

SEQ ID NO: 345129 - DNA, 16 bp, M. musculus
aataaagccttttgcc

SEQ ID NO: 345130 - DNA, 18 bp, M. musculus
aataaagctctaaaacca

SEQ ID NO: 345131 - DNA, 16 bp, M. musculus
aataaagctgctatga

SEQ ID NO: 345132 - DNA, 16 bp, M. musculus
aataaagcttgctgca

SEQ ID NO: 345133 - DNA, 16 bp, M. musculus
aataaagcttgtgtaa

SEQ ID NO: 345134 - DNA, 16 bp, M. musculus
aataaagctttattta

SEQ ID NO: 345135 - DNA, 16 bp, M. musculus
aataaagctttatttg

SEQ ID NO: 345136 - DNA, 22 bp, M. musculus
aataaagctttgccgcagaaga

SEQ ID NO: 345137 - DNA, 16 bp, M. musculus
aataaaggaaaacacc

SEQ ID NO: 345138 - DNA, 16 bp, M. musculus
aataaaggagaactga

SEQ ID NO: 345139 - DNA, 16 bp, M. musculus
aataaaggcattttct

SEQ ID NO: 345140 - DNA, 16 bp, M. musculus
aataaaggggtgggag

SEQ ID NO: 345141 - DNA, 16 bp, M. musculus
aataaagtaggcaaag

SEQ ID NO: 345142 - DNA, 17 bp, M. musculus
aataaagtaggcaaaga

SEQ ID NO: 345143 - DNA, 16 bp, M. musculus
aataaagtctgtgtct

SEQ ID NO: 345144 - DNA, 16 bp, M. musculus
aataaagtgcatttca

SEQ ID NO: 345145 - DNA, 16 bp, M. musculus
aataaataaacccttt

SEQ ID NO: 345146 - DNA, 16 bp, M. musculus
aataaataaactaatg

SEQ ID NO: 345147 - DNA, 16 bp, M. musculus
aataaataaagacttt

SEQ ID NO: 345148 - DNA, 16 bp, M. musculus
aataaataaatacatg

SEQ ID NO: 345149 - DNA, 16 bp, M. musculus
aataaataaatcccag

SEQ ID NO: 345150 - DNA, 16 bp, M. musculus
aataaataaatctttc

SEQ ID NO: 345151 - DNA, 16 bp, M. musculus
aataaataaatgcaag

SEQ ID NO: 345152 - DNA, 16 bp, M. musculus
aataaataaatgcaat

SEQ ID NO: 345153 - DNA, 16 bp, M. musculus
aataaataaatgcttt

SEQ ID NO: 345154 - DNA, 16 bp, M. musculus
aataaataaatgtctg

SEQ ID NO: 345155 - DNA, 16 bp, M. musculus
aataaatacatctttt

SEQ ID NO: 345156 - DNA, 16 bp, M. musculus
aataaatactttaaag

SEQ ID NO: 345157 - DNA, 16 bp, M. musculus
aataaatagtgctggt

SEQ ID NO: 345158 - DNA, 16 bp, M. musculus
aataaatatatatgca

SEQ ID NO: 345159 - DNA, 16 bp, M. musculus
aataaatatgttcttt

SEQ ID NO: 345160 - DNA, 16 bp, M. musculus
aataaatattacctga

SEQ ID NO: 345161 - DNA, 16 bp, M. musculus
aataaatatttactga

SEQ ID NO: 345162 - DNA, 16 bp, M. musculus
aataaatatttctctt

SEQ ID NO: 345163 - DNA, 16 bp, M. musculus
aataaatatttgctga

SEQ ID NO: 345164 - DNA, 16 bp, M. musculus
aataaatatttgtaga

SEQ ID NO: 345165 - DNA, 16 bp, M. musculus
aataaatatttgttga

SEQ ID NO: 345166 - DNA, 16 bp, M. musculus
aataaatcaatgaaat

SEQ ID NO: 345167 - DNA, 16 bp, M. musculus
aataaatccttttaaa

SEQ ID NO: 345168 - DNA, 16 bp, M. musculus
aataaatctgccttta

SEQ ID NO: 345169 - DNA, 16 bp, M. musculus
aataaatctgtatttt

SEQ ID NO: 345170 - DNA, 16 bp, M. musculus
aataaatctttgtaaa

SEQ ID NO: 345171 - DNA, 16 bp, M. musculus
aataaatcttttctaa

SEQ ID NO: 345172 - DNA, 16 bp, M. musculus
aataaatcttttttga

SEQ ID NO: 345173 - DNA, 16 bp, M. musculus
aataaatctttttttg

SEQ ID NO: 345174 - DNA, 16 bp, M. musculus
aataaatgaaatgttt

SEQ ID NO: 345175 - DNA, 16 bp, M. musculus
aataaatgaatcttaa

SEQ ID NO: 345176 - DNA, 16 bp, M. musculus
aataaatgaatgcaaa

SEQ ID NO: 345177 - DNA, 16 bp, M. musculus
aataaatgactgaatt

SEQ ID NO: 345178 - DNA, 16 bp, M. musculus
aataaatgcatttaat

SEQ ID NO: 345179 - DNA, 16 bp, M. musculus
aataaatgctttgttt

SEQ ID NO: 345180 - DNA, 16 bp, M. musculus
aataaatggaaatatg

SEQ ID NO: 345181 - DNA, 16 bp, M. musculus
aataaatgtaacttta

SEQ ID NO: 345182 - DNA, 16 bp, M. musculus
aataaatgtaataaac

SEQ ID NO: 345183 - DNA, 16 bp, M. musculus
aataaatgtaatcaaa

SEQ ID NO: 345184 - DNA, 16 bp, M. musculus
aataaatgtatgtata

SEQ ID NO: 345185 - DNA, 16 bp, M. musculus
aataaatgttaaaaac

SEQ ID NO: 345186 - DNA, 16 bp, M. musculus
aataaatgttcaacat

SEQ ID NO: 345187 - DNA, 16 bp, M. musculus
aataaatgtttacaaa

SEQ ID NO: 345188 - DNA, 16 bp, M. musculus
aataaatgtttgctga

SEQ ID NO: 345189 - DNA, 16 bp, M. musculus
aataaatgttttcttt

SEQ ID NO: 345190 - DNA, 16 bp, M. musculus
aataaattattttctc

SEQ ID NO: 345191 - DNA, 16 bp, M. musculus
aataaattcatgaaaa

SEQ ID NO: 345192 - DNA, 16 bp, M. musculus
aataaattggagagag

SEQ ID NO: 345193 - DNA, 16 bp, M. musculus
aataacaacaacagca

SEQ ID NO: 345194 - DNA, 16 bp, M. musculus
aataacaacagcaata

SEQ ID NO: 345195 - DNA, 16 bp, M. musculus
aataacactccagagc

SEQ ID NO: 345196 - DNA, 16 bp, M. musculus
aataacactttttaaa

SEQ ID NO: 345197 - DNA, 16 bp, M. musculus
aataacagaaaaccca

SEQ ID NO: 345198 - DNA, 16 bp, M. musculus
aataacagcaacagca

SEQ ID NO: 345199 - DNA, 16 bp, M. musculus
aataacagtaataaca

SEQ ID NO: 345200 - DNA, 16 bp, M. musculus
aataacattttgaaaa

SEQ ID NO: 345201 - DNA, 16 bp, M. musculus
aataactggaatattt

SEQ ID NO: 345202 - DNA, 16 bp, M. musculus
aataactggacctgct

SEQ ID NO: 345203 - DNA, 19 bp, M. musculus
aataactggacctgctgga

SEQ ID NO: 345204 - DNA, 16 bp, M. musculus
aataacttggcacaga

SEQ ID NO: 345205 - DNA, 16 bp, M. musculus
aataactttgactcct

SEQ ID NO: 345206 - DNA, 16 bp, M. musculus
aataacttttgaaaat

SEQ ID NO: 345207 - DNA, 16 bp, M. musculus
aataagaacaattatg

SEQ ID NO: 345208 - DNA, 16 bp, M. musculus
aataagacaactgaag

SEQ ID NO: 345209 - DNA, 16 bp, M. musculus
aataagaccctgtctc

SEQ ID NO: 345210 - DNA, 16 bp, M. musculus
aataagcagatattag

SEQ ID NO: 345211 - DNA, 16 bp, M. musculus
aataagcatttaaaat

SEQ ID NO: 345212 - DNA, 16 bp, M. musculus
aataagccctttctct

SEQ ID NO: 345213 - DNA, 16 bp, M. musculus
aataaggccacaccca

SEQ ID NO: 345214 - DNA, 16 bp, M. musculus
aataagggttctcaaa

SEQ ID NO: 345215 - DNA, 16 bp, M. musculus
aataagtgtgtcactg

SEQ ID NO: 345216 - DNA, 16 bp, M. musculus
aataagtgtgtgtgtg

SEQ ID NO: 345217 - DNA, 16 bp, M. musculus
aataagttcagcaagt

SEQ ID NO: 345218 - DNA, 16 bp, M. musculus
aataagttcttttttt

SEQ ID NO: 345219 - DNA, 16 bp, M. musculus
aataagtttttaaaag

SEQ ID NO: 345220 - DNA, 16 bp, M. musculus
aataataaataaagct

SEQ ID NO: 345221 - DNA, 16 bp, M. musculus
aataataagtggatat

SEQ ID NO: 345222 - DNA, 16 bp, M. musculus
aataataatagtaggt

SEQ ID NO: 345223 - DNA, 16 bp, M. musculus
aataatacttgatttt

SEQ ID NO: 345224 - DNA, 16 bp, M. musculus
aataatatatatgtgt

SEQ ID NO: 345225 - DNA, 16 bp, M. musculus
aataatatttgaaatg

SEQ ID NO: 345226 - DNA, 17 bp, M. musculus
aataatcagaagaacaa

SEQ ID NO: 345227 - DNA, 16 bp, M. musculus
aataatcattcaaaca

SEQ ID NO: 345228 - DNA, 16 bp, M. musculus
aataatgaagactgaa

SEQ ID NO: 345229 - DNA, 16 bp, M. musculus
aataatgataaaaact

SEQ ID NO: 345230 - DNA, 16 bp, M. musculus
aataatgataacaaca

SEQ ID NO: 345231 - DNA, 16 bp, M. musculus
aataatgcaaatagat

SEQ ID NO: 345232 - DNA, 16 bp, M. musculus
aataatgcttttaaaa

SEQ ID NO: 345233 - DNA, 16 bp, M. musculus
aataatggactaaacc

SEQ ID NO: 345234 - DNA, 16 bp, M. musculus
aataatggatttcatt

SEQ ID NO: 345235 - DNA, 16 bp, M. musculus
aataatgtcaggcctt

SEQ ID NO: 345236 - DNA, 16 bp, M. musculus
aataatgtctttaaaa

SEQ ID NO: 345237 - DNA, 16 bp, M. musculus
aataatgttttctctt

SEQ ID NO: 345238 - DNA, 16 bp, M. musculus
aataattccatgcatt

SEQ ID NO: 345239 - DNA, 16 bp, M. musculus
aataattgtgttaaag

SEQ ID NO: 345240 - DNA, 16 bp, M. musculus
aataatttcagagcca

SEQ ID NO: 345241 - DNA, 16 bp, M. musculus
aataatttgtctttga

SEQ ID NO: 345242 - DNA, 16 bp, M. musculus
aataatttgtttttca

SEQ ID NO: 345243 - DNA, 16 bp, M. musculus
aataattttgccattg

SEQ ID NO: 345244 - DNA, 16 bp, M. musculus
aatacaaaatgcattt

SEQ ID NO: 345245 - DNA, 16 bp, M. musculus
aatacaaaatggctga

SEQ ID NO: 345246 - DNA, 16 bp, M. musculus
aatacaaagacaacct

SEQ ID NO: 345247 - DNA, 16 bp, M. musculus
aatacaaagagggaaa

SEQ ID NO: 345248 - DNA, 16 bp, M. musculus
aatacaaagtcaaaag

SEQ ID NO: 345249 - DNA, 16 bp, M. musculus
aatacaaatttgaaag

SEQ ID NO: 345250 - DNA, 16 bp, M. musculus
aatacaagagattgaa

SEQ ID NO: 345251 - DNA, 16 bp, M. musculus
aatacaagcagcatta

SEQ ID NO: 345252 - DNA, 16 bp, M. musculus
aatacaaggaaggaaa

SEQ ID NO: 345253 - DNA, 16 bp, M. musculus
aatacaaggccagcct

SEQ ID NO: 345254 - DNA, 16 bp, M. musculus
aatacaagttttaaaa

SEQ ID NO: 345255 - DNA, 16 bp, M. musculus
aatacacacacatata

SEQ ID NO: 345256 - DNA, 16 bp, M. musculus
aatacacagagaaacc

SEQ ID NO: 345257 - DNA, 16 bp, M. musculus
aatacacagagagaga

SEQ ID NO: 345258 - DNA, 16 bp, M. musculus
aatacacatatatatt

SEQ ID NO: 345259 - DNA, 16 bp, M. musculus
aatacacatttgaaaa

SEQ ID NO: 345260 - DNA, 16 bp, M. musculus
aatacactgtatgaaa

SEQ ID NO: 345261 - DNA, 16 bp, M. musculus
aatacagaaaatatgg

SEQ ID NO: 345262 - DNA, 16 bp, M. musculus
aatacagaaatagatg

SEQ ID NO: 345263 - DNA, 16 bp, M. musculus
aatacagaattttaaa

SEQ ID NO: 345264 - DNA, 16 bp, M. musculus
aatacagacatgtcct

SEQ ID NO: 345265 - DNA, 16 bp, M. musculus
aatacagatcctaaaa

SEQ ID NO: 345266 - DNA, 16 bp, M. musculus
aatacagattttaaaa

SEQ ID NO: 345267 - DNA, 16 bp, M. musculus
aatacaggaaaataca

SEQ ID NO: 345268 - DNA, 16 bp, M. musculus
aatacaggaaaatgca

SEQ ID NO: 345269 - DNA, 16 bp, M. musculus
aatacaggagaacatt

SEQ ID NO: 345270 - DNA, 16 bp, M. musculus
aatacaggagatgaaa

SEQ ID NO: 345271 - DNA, 16 bp, M. musculus
aatacaggggaaaaaa

SEQ ID NO: 345272 - DNA, 16 bp, M. musculus
aatacagtccacagaa

SEQ ID NO: 345273 - DNA, 16 bp, M. musculus
aatacagttgctcatg

SEQ ID NO: 345274 - DNA, 16 bp, M. musculus
aatacagtttctcatg

SEQ ID NO: 345275 - DNA, 16 bp, M. musculus
aatacatatgcacaca

SEQ ID NO: 345276 - DNA, 16 bp, M. musculus
aatacatatttgaaaa

SEQ ID NO: 345277 - DNA, 16 bp, M. musculus
aatacatgtaataaaa

SEQ ID NO: 345278 - DNA, 16 bp, M. musculus
aatacattaaaatgaa

SEQ ID NO: 345279 - DNA, 16 bp, M. musculus
aatacatttgttttat

SEQ ID NO: 345280 - DNA, 16 bp, M. musculus
aatacattttagaaat

SEQ ID NO: 345281 - DNA, 16 bp, M. musculus
aatacattttatgaaa

SEQ ID NO: 345282 - DNA, 16 bp, M. musculus
aataccaacagagtca

SEQ ID NO: 345283 - DNA, 16 bp, M. musculus
aataccaatactcttt

SEQ ID NO: 345284 - DNA, 16 bp, M. musculus
aataccaatgcaaaaa

SEQ ID NO: 345285 - DNA, 17 bp, M. musculus
aataccagggccaagaa

SEQ ID NO: 345286 - DNA, 17 bp, M. musculus
aataccagggccaggaa

SEQ ID NO: 345287 - DNA, 16 bp, M. musculus
aataccatgaaagagc

SEQ ID NO: 345288 - DNA, 16 bp, M. musculus
aataccatgtgatttt

SEQ ID NO: 345289 - DNA, 16 bp, M. musculus
aataccatgtggtttt

SEQ ID NO: 345290 - DNA, 16 bp, M. musculus
aataccatttgaaatg

SEQ ID NO: 345291 - DNA, 16 bp, M. musculus
aatacccaagatacaa

SEQ ID NO: 345292 - DNA, 16 bp, M. musculus
aatacccatgaaagaa

SEQ ID NO: 345293 - DNA, 16 bp, M. musculus
aataccctgtctcaaa

SEQ ID NO: 345294 - DNA, 16 bp, M. musculus
aatacctaagatataa

SEQ ID NO: 345295 - DNA, 16 bp, M. musculus
aatacctaattcaaaa

SEQ ID NO: 345296 - DNA, 16 bp, M. musculus
aatacctccagaagtt

SEQ ID NO: 345297 - DNA, 16 bp, M. musculus
aataccttggcatgat

SEQ ID NO: 345298 - DNA, 20 bp, M. musculus
aataccttgtctttgagaat

SEQ ID NO: 345299 - DNA, 16 bp, M. musculus
aatactactcacctat

SEQ ID NO: 345300 - DNA, 16 bp, M. musculus
aatactattcagctat

SEQ ID NO: 345301 - DNA, 16 bp, M. musculus
aatactcaacaaaggg

SEQ ID NO: 345302 - DNA, 16 bp, M. musculus
aatactcagtaaaatc

SEQ ID NO: 345303 - DNA, 16 bp, M. musculus
aatactctgaacactg

SEQ ID NO: 345304 - DNA, 16 bp, M. musculus
aatactctgtgtgtgt

SEQ ID NO: 345305 - DNA, 16 bp, M. musculus
aatactgaatgactga

SEQ ID NO: 345306 - DNA, 16 bp, M. musculus
aatactgaattgctga

SEQ ID NO: 345307 - DNA, 16 bp, M. musculus
aatactgctgggagag

SEQ ID NO: 345308 - DNA, 17 bp, M. musculus
aatactggtgtgaccca

SEQ ID NO: 345309 - DNA, 16 bp, M. musculus
aatactgtattttttt

SEQ ID NO: 345310 - DNA, 16 bp, M. musculus
aatactgtggtttctc

SEQ ID NO: 345311 - DNA, 16 bp, M. musculus
aatacttagaataaca

SEQ ID NO: 345312 - DNA, 16 bp, M. musculus
aatactttttaaaaag

SEQ ID NO: 345313 - DNA, 16 bp, M. musculus
aatagaaaacatttta

SEQ ID NO: 345314 - DNA, 16 bp, M. musculus
aatagaaacagaagct

SEQ ID NO: 345315 - DNA, 16 bp, M. musculus
aatagaaacagaatga

SEQ ID NO: 345316 - DNA, 16 bp, M. musculus
aatagaaacataagga

SEQ ID NO: 345317 - DNA, 16 bp, M. musculus
aatagaaaccaaggtt

SEQ ID NO: 345318 - DNA, 18 bp, M. musculus
aatagaaaccctgaataa

SEQ ID NO: 345319 - DNA, 19 bp, M. musculus
aatagaaactctgactaag

SEQ ID NO: 345320 - DNA, 16 bp, M. musculus
aatagaaactgaaggt

SEQ ID NO: 345321 - DNA, 16 bp, M. musculus
aatagaaagcaggaaa

SEQ ID NO: 345322 - DNA, 16 bp, M. musculus
aatagaacattttaaa

SEQ ID NO: 345323 - DNA, 16 bp, M. musculus
aatagaactgccaaag

SEQ ID NO: 345324 - DNA, 16 bp, M. musculus
aatagaagaaaacttt

SEQ ID NO: 345325 - DNA, 16 bp, M. musculus
aatagaagaaagttgg

SEQ ID NO: 345326 - DNA, 16 bp, M. musculus
aatagaaggacagaaa

SEQ ID NO: 345327 - DNA, 17 bp, M. musculus
aatagaaggggattaga

SEQ ID NO: 345328 - DNA, 16 bp, M. musculus
aatagacatttgttca

SEQ ID NO: 345329 - DNA, 16 bp, M. musculus
aatagaccctttcttc

SEQ ID NO: 345330 - DNA, 16 bp, M. musculus
aatagagaagtaacta

SEQ ID NO: 345331 - DNA, 16 bp, M. musculus
aatagaggtggatgct

SEQ ID NO: 345332 - DNA, 16 bp, M. musculus
aatagagtgatctagg

SEQ ID NO: 345333 - DNA, 16 bp, M. musculus
aatagagtttattcat

SEQ ID NO: 345334 - DNA, 16 bp, M. musculus
aatagagtttttaaaa

SEQ ID NO: 345335 - DNA, 16 bp, M. musculus
aatagatagatagata

SEQ ID NO: 345336 - DNA, 16 bp, M. musculus
aatagatctacatgaa

SEQ ID NO: 345337 - DNA, 16 bp, M. musculus
aatagatgcagaaaag

SEQ ID NO: 345338 - DNA, 16 bp, M. musculus
aatagatggatagata

SEQ ID NO: 345339 - DNA, 16 bp, M. musculus
aatagatgtgtgtgtg

SEQ ID NO: 345340 - DNA, 16 bp, M. musculus
aatagattttaaaact

SEQ ID NO: 345341 - DNA, 16 bp, M. musculus
aatagcaaaaactctt

SEQ ID NO: 345342 - DNA, 16 bp, M. musculus
aatagcaacagcaaca

SEQ ID NO: 345343 - DNA, 16 bp, M. musculus
aatagcaagagagaac

SEQ ID NO: 345344 - DNA, 16 bp, M. musculus
aatagcaatgaaataa

SEQ ID NO: 345345 - DNA, 16 bp, M. musculus
aatagcagagaagcac

SEQ ID NO: 345346 - DNA, 16 bp, M. musculus
aatagcatccaggttt

SEQ ID NO: 345347 - DNA, 16 bp, M. musculus
aatagccaactttatt

SEQ ID NO: 345348 - DNA, 16 bp, M. musculus
aatagccagagactgg

SEQ ID NO: 345349 - DNA, 16 bp, M. musculus
aatagccataggtgct

SEQ ID NO: 345350 - DNA, 29 bp, M. musculus
aatagcccaaagagttgtttgtgagcttt

SEQ ID NO: 345351 - DNA, 16 bp, M. musculus
aatagcctgggttgtt

SEQ ID NO: 345352 - DNA, 16 bp, M. musculus
aatagctaaagaaaac

SEQ ID NO: 345353 - DNA, 16 bp, M. musculus
aatagctaataaaaat

SEQ ID NO: 345354 - DNA, 16 bp, M. musculus
aatagctcccagaaaa

SEQ ID NO: 345355 - DNA, 16 bp, M. musculus
aatagctccttagcta

SEQ ID NO: 345356 - DNA, 16 bp, M. musculus
aatagctctttatttt

SEQ ID NO: 345357 - DNA, 16 bp, M. musculus
aatagctgagtcactc

SEQ ID NO: 345358 - DNA, 16 bp, M. musculus
aatagctggacagaag

SEQ ID NO: 345359 - DNA, 16 bp, M. musculus
aataggaaaactcata

SEQ ID NO: 345360 - DNA, 16 bp, M. musculus
aataggacaaaaaggc

SEQ ID NO: 345361 - DNA, 16 bp, M. musculus
aataggactccatgga

SEQ ID NO: 345362 - DNA, 16 bp, M. musculus
aataggtagatagata

SEQ ID NO: 345363 - DNA, 16 bp, M. musculus
aatagtaaaattgaac

SEQ ID NO: 345364 - DNA, 16 bp, M. musculus
aatagtaaccttaact

SEQ ID NO: 345365 - DNA, 16 bp, M. musculus
aatagtaataataatc

SEQ ID NO: 345366 - DNA, 16 bp, M. musculus
aatagtagcctgggct

SEQ ID NO: 345367 - DNA, 16 bp, M. musculus
aatagtattagaagga

SEQ ID NO: 345368 - DNA, 16 bp, M. musculus
aatagtcaaagaaaat

SEQ ID NO: 345369 - DNA, 16 bp, M. musculus
aatagtcaataaaatt

SEQ ID NO: 345370 - DNA, 17 bp, M. musculus
aatagtctctcagccaa

SEQ ID NO: 345371 - DNA, 16 bp, M. musculus
aatagtctctcatagg

SEQ ID NO: 345372 - DNA, 16 bp, M. musculus
aatagtgataaaaacc

SEQ ID NO: 345373 - DNA, 16 bp, M. musculus
aatagtgatatttgga

SEQ ID NO: 345374 - DNA, 16 bp, M. musculus
aatagtgatttttaaa

SEQ ID NO: 345375 - DNA, 16 bp, M. musculus
aatagtgccactcccc

SEQ ID NO: 345376 - DNA, 16 bp, M. musculus
aatagtgccactccct

SEQ ID NO: 345377 - DNA, 16 bp, M. musculus
aatagtgtcaggcctt

SEQ ID NO: 345378 - DNA, 16 bp, M. musculus
aatagtgtcagggatt

SEQ ID NO: 345379 - DNA, 16 bp, M. musculus
aatagtgtctgtgttt

SEQ ID NO: 345380 - DNA, 16 bp, M. musculus
aatagttcatctcctg

SEQ ID NO: 345381 - DNA, 16 bp, M. musculus
aatagtttgtgaaaaa

SEQ ID NO: 345382 - DNA, 16 bp, M. musculus
aatagttttgtaaatg

SEQ ID NO: 345383 - DNA, 16 bp, M. musculus
aatataaaacatcttg

SEQ ID NO: 345384 - DNA, 16 bp, M. musculus
aatataagaaactatt

SEQ ID NO: 345385 - DNA, 28 bp, M. musculus
aatataatatggtgaaaccttttcagat

SEQ ID NO: 345386 - DNA, 16 bp, M. musculus
aatataatcaaaggaa

SEQ ID NO: 345387 - DNA, 16 bp, M. musculus
aatataatccccatca

SEQ ID NO: 345388 - DNA, 16 bp, M. musculus
aatatacaagaagctt

SEQ ID NO: 345389 - DNA, 16 bp, M. musculus
aatatacagacaaaga

SEQ ID NO: 345390 - DNA, 16 bp, M. musculus
aatatacagatttata

SEQ ID NO: 345391 - DNA, 16 bp, M. musculus
aatatacagcaaaaca

SEQ ID NO: 345392 - DNA, 16 bp, M. musculus
aatatacagcaaacaa

SEQ ID NO: 345393 - DNA, 16 bp, M. musculus
aatatacagcattttc

SEQ ID NO: 345394 - DNA, 16 bp, M. musculus
aatatacatgaaatat

SEQ ID NO: 345395 - DNA, 16 bp, M. musculus
aatataccttcttttt

SEQ ID NO: 345396 - DNA, 16 bp, M. musculus
aatatagagagatatt

SEQ ID NO: 345397 - DNA, 16 bp, M. musculus
aatatagcttttattt

SEQ ID NO: 345398 - DNA, 16 bp, M. musculus
aatatagggttttttt

SEQ ID NO: 345399 - DNA, 16 bp, M. musculus
aatatagtagtatttt

SEQ ID NO: 345400 - DNA, 16 bp, M. musculus
aatatagttacatcat

SEQ ID NO: 345401 - DNA, 16 bp, M. musculus
aatatatacacataca

SEQ ID NO: 345402 - DNA, 16 bp, M. musculus
aatatatacatacaca

SEQ ID NO: 345403 - DNA, 16 bp, M. musculus
aatatatacatatatg

SEQ ID NO: 345404 - DNA, 16 bp, M. musculus
aatatatactcaatat

SEQ ID NO: 345405 - DNA, 16 bp, M. musculus
aatatatagatatagg

SEQ ID NO: 345406 - DNA, 16 bp, M. musculus
aatatataggaagcct

SEQ ID NO: 345407 - DNA, 16 bp, M. musculus
aatatatatagagaga

SEQ ID NO: 345408 - DNA, 18 bp, M. musculus
aatatatatatgtatgta

SEQ ID NO: 345409 - DNA, 19 bp, M. musculus
aatatatatgtgtgtgtgt

SEQ ID NO: 345410 - DNA, 16 bp, M. musculus
aatatatcatcctgag

SEQ ID NO: 345411 - DNA, 16 bp, M. musculus
aatatatgcaatatat

SEQ ID NO: 345412 - DNA, 16 bp, M. musculus
aatatatgctaataaa

SEQ ID NO: 345413 - DNA, 16 bp, M. musculus
aatatatggaaattca

SEQ ID NO: 345414 - DNA, 16 bp, M. musculus
aatatatggaatatat

SEQ ID NO: 345415 - DNA, 16 bp, M. musculus
aatatatgtacacaca

SEQ ID NO: 345416 - DNA, 16 bp, M. musculus
aatatatgtatatgtg

SEQ ID NO: 345417 - DNA, 16 bp, M. musculus
aatatattaactgtat

SEQ ID NO: 345418 - DNA, 16 bp, M. musculus
aatatattgtacaaaa

SEQ ID NO: 345419 - DNA, 16 bp, M. musculus
aatatattgtatgaaa

SEQ ID NO: 345420 - DNA, 16 bp, M. musculus
aatatatttctactaa

SEQ ID NO: 345421 - DNA, 16 bp, M. musculus
aatatatttctgaaaa

SEQ ID NO: 345422 - DNA, 16 bp, M. musculus
aatatattttatgcaa

SEQ ID NO: 345423 - DNA, 16 bp, M. musculus
aatatattttcattgt

SEQ ID NO: 345424 - DNA, 16 bp, M. musculus
aatatattttcttctc

SEQ ID NO: 345425 - DNA, 16 bp, M. musculus
aatatcaaattaaatg

SEQ ID NO: 345426 - DNA, 16 bp, M. musculus
aatatcaaccaacaag

SEQ ID NO: 345427 - DNA, 16 bp, M. musculus
aatatcaaccaaccag

SEQ ID NO: 345428 - DNA, 16 bp, M. musculus
aatatcaactgaaagg

SEQ ID NO: 345429 - DNA, 16 bp, M. musculus
aatatcaagggcctct

SEQ ID NO: 345430 - DNA, 16 bp, M. musculus
aatatcaatgtggaaa

SEQ ID NO: 345431 - DNA, 16 bp, M. musculus
aatatcacctcatgta

SEQ ID NO: 345432 - DNA, 16 bp, M. musculus
aatatcagaaattcaa

SEQ ID NO: 345433 - DNA, 16 bp, M. musculus
aatatcagaataccat

SEQ ID NO: 345434 - DNA, 16 bp, M. musculus
aatatcatgcaggttt

SEQ ID NO: 345435 - DNA, 16 bp, M. musculus
aatatccaagaaaata

SEQ ID NO: 345436 - DNA, 16 bp, M. musculus
aatatccacttatctg

SEQ ID NO: 345437 - DNA, 16 bp, M. musculus
aatatccagaaactgg

SEQ ID NO: 345438 - DNA, 16 bp, M. musculus
aatatccagaagatgt

SEQ ID NO: 345439 - DNA, 16 bp, M. musculus
aatatccagttataag

SEQ ID NO: 345440 - DNA, 16 bp, M. musculus
aatatccatgggagga

SEQ ID NO: 345441 - DNA, 16 bp, M. musculus
aatatccattttaaaa

SEQ ID NO: 345442 - DNA, 16 bp, M. musculus
aatatccctcaacaga

SEQ ID NO: 345443 - DNA, 16 bp, M. musculus
aatatccctgtggaat

SEQ ID NO: 345444 - DNA, 16 bp, M. musculus
aatatccttttaaaaa

SEQ ID NO: 345445 - DNA, 16 bp, M. musculus
aatatctacttataaa

SEQ ID NO: 345446 - DNA, 16 bp, M. musculus
aatatctacttattag

SEQ ID NO: 345447 - DNA, 16 bp, M. musculus
aatatctccataagat

SEQ ID NO: 345448 - DNA, 16 bp, M. musculus
aatatctgcatgtgac

SEQ ID NO: 345449 - DNA, 16 bp, M. musculus
aatatctgttttaatc

SEQ ID NO: 345450 - DNA, 17 bp, M. musculus
aatatcttcaacaaaat

SEQ ID NO: 345451 - DNA, 16 bp, M. musculus
aatatcttcaacaata

SEQ ID NO: 345452 - DNA, 16 bp, M. musculus
aatatcttgctgtgac

SEQ ID NO: 345453 - DNA, 16 bp, M. musculus
aatatgaaatttctct

SEQ ID NO: 345454 - DNA, 17 bp, M. musculus
aatatgaaccaaccaga

SEQ ID NO: 345455 - DNA, 16 bp, M. musculus
aatatgaaccttggaa

SEQ ID NO: 345456 - DNA, 16 bp, M. musculus
aatatgaagtgtaaaa

SEQ ID NO: 345457 - DNA, 16 bp, M. musculus
aatatgacatgcacat

SEQ ID NO: 345458 - DNA, 16 bp, M. musculus
aatatgaggaactgta

SEQ ID NO: 345459 - DNA, 16 bp, M. musculus
aatatgatcaaataca

SEQ ID NO: 345460 - DNA, 16 bp, M. musculus
aatatgatgatgatga

SEQ ID NO: 345461 - DNA, 16 bp, M. musculus
aatatgattacatatt

SEQ ID NO: 345462 - DNA, 16 bp, M. musculus
aatatgcaaatatgca

SEQ ID NO: 345463 - DNA, 16 bp, M. musculus
aatatgcaaatattta

SEQ ID NO: 345464 - DNA, 16 bp, M. musculus
aatatgcctgtctctg

SEQ ID NO: 345465 - DNA, 16 bp, M. musculus
aatatggacacaacaa

SEQ ID NO: 345466 - DNA, 16 bp, M. musculus
aatatggagaaatcaa

SEQ ID NO: 345467 - DNA, 16 bp, M. musculus
aatatggagataaaga

SEQ ID NO: 345468 - DNA, 16 bp, M. musculus
aatatggagtgtaaaa

SEQ ID NO: 345469 - DNA, 16 bp, M. musculus
aatatggatacaaagt

SEQ ID NO: 345470 - DNA, 16 bp, M. musculus
aatatggatatatttg

SEQ ID NO: 345471 - DNA, 16 bp, M. musculus
aatatggatcctgaag

SEQ ID NO: 345472 - DNA, 16 bp, M. musculus
aatatggatgcataag

SEQ ID NO: 345473 - DNA, 16 bp, M. musculus
aatatggcaggatatt

SEQ ID NO: 345474 - DNA, 16 bp, M. musculus
aatatggcctagtttt

SEQ ID NO: 345475 - DNA, 16 bp, M. musculus
aatatgggcagccccc

SEQ ID NO: 345476 - DNA, 34 bp, M. musculus
aatatggggaagcctttaaacatttctaattctt

SEQ ID NO: 345477 - DNA, 16 bp, M. musculus
aatatggttttgtcat

SEQ ID NO: 345478 - DNA, 16 bp, M. musculus
aatatgtaaaacattt

SEQ ID NO: 345479 - DNA, 16 bp, M. musculus
aatatgtaaacaaaca

SEQ ID NO: 345480 - DNA, 16 bp, M. musculus
aatatgtacatattat

SEQ ID NO: 345481 - DNA, 16 bp, M. musculus
aatatgtataaaatgt

SEQ ID NO: 345482 - DNA, 16 bp, M. musculus
aatatgtatatacata

SEQ ID NO: 345483 - DNA, 16 bp, M. musculus
aatatgtatatataca

SEQ ID NO: 345484 - DNA, 16 bp, M. musculus
aatatgtatatatgtg

SEQ ID NO: 345485 - DNA, 16 bp, M. musculus
aatatgtatgcacaca

SEQ ID NO: 345486 - DNA, 16 bp, M. musculus
aatatgtatgtacata

SEQ ID NO: 345487 - DNA, 16 bp, M. musculus
aatatgtgatatatat

SEQ ID NO: 345488 - DNA, 16 bp, M. musculus
aatatgtgtattttaa

SEQ ID NO: 345489 - DNA, 16 bp, M. musculus
aatatgtgtgtatata

SEQ ID NO: 345490 - DNA, 16 bp, M. musculus
aatatgtgtgtatgta

SEQ ID NO: 345491 - DNA, 16 bp, M. musculus
aatatgttcatatttt

SEQ ID NO: 345492 - DNA, 16 bp, M. musculus
aatatgttttaaaagt

SEQ ID NO: 345493 - DNA, 16 bp, M. musculus
aatatgttttcatttt

SEQ ID NO: 345494 - DNA, 16 bp, M. musculus
aatattaaaaacagca

SEQ ID NO: 345495 - DNA, 16 bp, M. musculus
aatattaaaagtcttt

SEQ ID NO: 345496 - DNA, 16 bp, M. musculus
aatattagaagcatta

SEQ ID NO: 345497 - DNA, 16 bp, M. musculus
aatattaggaaagtgt

SEQ ID NO: 345498 - DNA, 16 bp, M. musculus
aatattcaaagaaaat

SEQ ID NO: 345499 - DNA, 16 bp, M. musculus
aatattcataaggaaa

SEQ ID NO: 345500 - DNA, 16 bp, M. musculus
aatattcatacatgta

SEQ ID NO: 345501 - DNA, 16 bp, M. musculus
aatattcattttgaaa

SEQ ID NO: 345502 - DNA, 16 bp, M. musculus
aatattcatttttatg

SEQ ID NO: 345503 - DNA, 16 bp, M. musculus
aatattccaagaggaa

SEQ ID NO: 345504 - DNA, 16 bp, M. musculus
aatattcctttaaaat

SEQ ID NO: 345505 - DNA, 16 bp, M. musculus
aatattctctgagcct

SEQ ID NO: 345506 - DNA, 16 bp, M. musculus
aatattctgtcttcat

SEQ ID NO: 345507 - DNA, 16 bp, M. musculus
aatattctttttaaag

SEQ ID NO: 345508 - DNA, 16 bp, M. musculus
aatattgatgccaaaa

SEQ ID NO: 345509 - DNA, 16 bp, M. musculus
aatattgatgctcatg

SEQ ID NO: 345510 - DNA, 16 bp, M. musculus
aatatttaaaaagtca

SEQ ID NO: 345511 - DNA, 16 bp, M. musculus
aatatttacaaaatga

SEQ ID NO: 345512 - DNA, 16 bp, M. musculus
aatatttacatcattc

SEQ ID NO: 345513 - DNA, 16 bp, M. musculus
aatatttacattatgg

SEQ ID NO: 345514 - DNA, 16 bp, M. musculus
aatatttacttataag

SEQ ID NO: 345515 - DNA, 16 bp, M. musculus
aatatttattgaacat

SEQ ID NO: 345516 - DNA, 16 bp, M. musculus
aatatttcaaagaaaa

SEQ ID NO: 345517 - DNA, 16 bp, M. musculus
aatatttcatgataca

SEQ ID NO: 345518 - DNA, 16 bp, M. musculus
aatatttccaaggttt

SEQ ID NO: 345519 - DNA, 16 bp, M. musculus
aatatttccagaaaca

SEQ ID NO: 345520 - DNA, 16 bp, M. musculus
aatatttcccacaaca

SEQ ID NO: 345521 - DNA, 16 bp, M. musculus
aatatttctcaaatta

SEQ ID NO: 345522 - DNA, 16 bp, M. musculus
aatatttctgtatttt

SEQ ID NO: 345523 - DNA, 16 bp, M. musculus
aatatttctgtttata

SEQ ID NO: 345524 - DNA, 16 bp, M. musculus
aatatttgaaaatcaa

SEQ ID NO: 345525 - DNA, 16 bp, M. musculus
aatatttgaaaatcca

SEQ ID NO: 345526 - DNA, 16 bp, M. musculus
aatatttgaaatgtag

SEQ ID NO: 345527 - DNA, 16 bp, M. musculus
aatatttgatatgtaa

SEQ ID NO: 345528 - DNA, 16 bp, M. musculus
aatatttgcatttaaa

SEQ ID NO: 345529 - DNA, 16 bp, M. musculus
aatatttggggaaaaa

SEQ ID NO: 345530 - DNA, 16 bp, M. musculus
aatatttgtgtgtgtg

SEQ ID NO: 345531 - DNA, 16 bp, M. musculus
aatattttaaaactgt

SEQ ID NO: 345532 - DNA, 16 bp, M. musculus
aatattttaaaggaag

SEQ ID NO: 345533 - DNA, 16 bp, M. musculus
aatattttaacatttg

SEQ ID NO: 345534 - DNA, 16 bp, M. musculus
aatattttaagcaaaa

SEQ ID NO: 345535 - DNA, 16 bp, M. musculus
aatattttaatcagaa

SEQ ID NO: 345536 - DNA, 16 bp, M. musculus
aatattttacatatgt

SEQ ID NO: 345537 - DNA, 16 bp, M. musculus
aatattttacatgttt

SEQ ID NO: 345538 - DNA, 16 bp, M. musculus
aatattttacctttga

SEQ ID NO: 345539 - DNA, 16 bp, M. musculus
aatattttacgtttga

SEQ ID NO: 345540 - DNA, 16 bp, M. musculus
aatattttatgcatat

SEQ ID NO: 345541 - DNA, 16 bp, M. musculus
aatattttcaaacatt

SEQ ID NO: 345542 - DNA, 16 bp, M. musculus
aatattttcaacataa

SEQ ID NO: 345543 - DNA, 16 bp, M. musculus
aatattttcagtttca

SEQ ID NO: 345544 - DNA, 16 bp, M. musculus
aatattttgacttctt

SEQ ID NO: 345545 - DNA, 16 bp, M. musculus
aatatttttaaagcat

SEQ ID NO: 345546 - DNA, 16 bp, M. musculus
aatatttttaagactt

SEQ ID NO: 345547 - DNA, 16 bp, M. musculus
aatatttttaaggaaa

SEQ ID NO: 345548 - DNA, 16 bp, M. musculus
aatatttttcagaaat

SEQ ID NO: 345549 - DNA, 16 bp, M. musculus
aatatttttctaaagt

SEQ ID NO: 345550 - DNA, 16 bp, M. musculus
aatatttttcttagaa

SEQ ID NO: 345551 - DNA, 16 bp, M. musculus
aatatttttgtacctg

SEQ ID NO: 345552 - DNA, 16 bp, M. musculus
aatatttttgtatctc

SEQ ID NO: 345553 - DNA, 16 bp, M. musculus
aatatttttgtatctt

SEQ ID NO: 345554 - DNA, 16 bp, M. musculus
aatatttttgttttcc

SEQ ID NO: 345555 - DNA, 16 bp, M. musculus
aatattttttaaaggg

SEQ ID NO: 345556 - DNA, 16 bp, M. musculus
aatatttttttcaagt

SEQ ID NO: 345557 - DNA, 16 bp, M. musculus
aatcaaaacaatactg

SEQ ID NO: 345558 - DNA, 16 bp, M. musculus
aatcaaaacaatcctg

SEQ ID NO: 345559 - DNA, 16 bp, M. musculus
aatcaaaacagcaatg

SEQ ID NO: 345560 - DNA, 16 bp, M. musculus
aatcaaaacaggaatg

SEQ ID NO: 345561 - DNA, 16 bp, M. musculus
aatcaaaacattagaa

SEQ ID NO: 345562 - DNA, 16 bp, M. musculus
aatcaaaagttcaagg

SEQ ID NO: 345563 - DNA, 16 bp, M. musculus
aatcaaaatgattctg

SEQ ID NO: 345564 - DNA, 16 bp, M. musculus
aatcaaacaaaccagg

SEQ ID NO: 345565 - DNA, 16 bp, M. musculus
aatcaaacccagttcc

SEQ ID NO: 345566 - DNA, 16 bp, M. musculus
aatcaaacccatgtcc

SEQ ID NO: 345567 - DNA, 16 bp, M. musculus
aatcaaactcaaggct

SEQ ID NO: 345568 - DNA, 16 bp, M. musculus
aatcaaactctgggct

SEQ ID NO: 345569 - DNA, 16 bp, M. musculus
aatcaaactttaagtt

SEQ ID NO: 345570 - DNA, 16 bp, M. musculus
aatcaacaaagccagg

SEQ ID NO: 345571 - DNA, 18 bp, M. musculus
aatcaacaagatagacaa

SEQ ID NO: 345572 - DNA, 17 bp, M. musculus
aatcaacaagatagata

SEQ ID NO: 345573 - DNA, 16 bp, M. musculus
aatcaacagaaggaaa

SEQ ID NO: 345574 - DNA, 16 bp, M. musculus
aatcaaccaaagagaa

SEQ ID NO: 345575 - DNA, 16 bp, M. musculus
aatcaacttaaaaaga

SEQ ID NO: 345576 - DNA, 16 bp, M. musculus
aatcaacttgagattt

SEQ ID NO: 345577 - DNA, 16 bp, M. musculus
aatcaagaaaatgccc

SEQ ID NO: 345578 - DNA, 16 bp, M. musculus
aatcaagaaagaaatt

SEQ ID NO: 345579 - DNA, 16 bp, M. musculus
aatcaagaaatgggac

SEQ ID NO: 345580 - DNA, 16 bp, M. musculus
aatcaagaagaggaaa

SEQ ID NO: 345581 - DNA, 16 bp, M. musculus
aatcaagactcttaat

SEQ ID NO: 345582 - DNA, 16 bp, M. musculus
aatcaagatcaaataa

SEQ ID NO: 345583 - DNA, 16 bp, M. musculus
aatcaagattaaccat

SEQ ID NO: 345584 - DNA, 16 bp, M. musculus
aatcaagcaagcaagc

SEQ ID NO: 345585 - DNA, 16 bp, M. musculus
aatcaaggaaggaagg

SEQ ID NO: 345586 - DNA, 16 bp, M. musculus
aatcaatcaatcaatc

SEQ ID NO: 345587 - DNA, 16 bp, M. musculus
aatcaatctatctatc

SEQ ID NO: 345588 - DNA, 16 bp, M. musculus
aatcaatctcagggct

SEQ ID NO: 345589 - DNA, 16 bp, M. musculus
aatcaatgaaaatgaa

SEQ ID NO: 345590 - DNA, 16 bp, M. musculus
aatcaatgtgggaaag

SEQ ID NO: 345591 - DNA, 16 bp, M. musculus
aatcaattttccaagc

SEQ ID NO: 345592 - DNA, 16 bp, M. musculus
aatcacaagaggaaaa

SEQ ID NO: 345593 - DNA, 16 bp, M. musculus
aatcacacaatatgta

SEQ ID NO: 345594 - DNA, 16 bp, M. musculus
aatcacaccaacaatg

SEQ ID NO: 345595 - DNA, 16 bp, M. musculus
aatcacactcacttcc

SEQ ID NO: 345596 - DNA, 16 bp, M. musculus
aatcacagaaggaaca

SEQ ID NO: 345597 - DNA, 16 bp, M. musculus
aatcacagaaggcaga

SEQ ID NO: 345598 - DNA, 16 bp, M. musculus
aatcacagcccaggga

SEQ ID NO: 345599 - DNA, 16 bp, M. musculus
aatcacagcttctagt

SEQ ID NO: 345600 - DNA, 16 bp, M. musculus
aatcacaggaggaaaa

SEQ ID NO: 345601 - DNA, 16 bp, M. musculus
aatcacaggaggcaga

SEQ ID NO: 345602 - DNA, 16 bp, M. musculus
aatcacatgaccatct

SEQ ID NO: 345603 - DNA, 16 bp, M. musculus
aatcacatttatttat

SEQ ID NO: 345604 - DNA, 16 bp, M. musculus
aatcaccaaaggaagt

SEQ ID NO: 345605 - DNA, 16 bp, M. musculus
aatcaccaaggagaca

SEQ ID NO: 345606 - DNA, 16 bp, M. musculus
aatcaccaggagtcat

SEQ ID NO: 345607 - DNA, 16 bp, M. musculus
aatcaccatccccgac

SEQ ID NO: 345608 - DNA, 16 bp, M. musculus
aatcaccatcctgacc

SEQ ID NO: 345609 - DNA, 16 bp, M. musculus
aatcaccattcctgac

SEQ ID NO: 345610 - DNA, 16 bp, M. musculus
aatcacctaagagaca

SEQ ID NO: 345611 - DNA, 16 bp, M. musculus
aatcacctgaatgctg

SEQ ID NO: 345612 - DNA, 16 bp, M. musculus
aatcacctgagaagag

SEQ ID NO: 345613 - DNA, 16 bp, M. musculus
aatcactaagaaaata

SEQ ID NO: 345614 - DNA, 16 bp, M. musculus
aatcactaataaagaa

SEQ ID NO: 345615 - DNA, 16 bp, M. musculus
aatcactgacccatct

SEQ ID NO: 345616 - DNA, 16 bp, M. musculus
aatcactgttaatttc

SEQ ID NO: 345617 - DNA, 16 bp, M. musculus
aatcagaaaagaaatt

SEQ ID NO: 345618 - DNA, 16 bp, M. musculus
aatcagaaataatttg

SEQ ID NO: 345619 - DNA, 16 bp, M. musculus
aatcagaaatctgcct

SEQ ID NO: 345620 - DNA, 16 bp, M. musculus
aatcagaaattaaaag

SEQ ID NO: 345621 - DNA, 16 bp, M. musculus
aatcagaacaacaaag

SEQ ID NO: 345622 - DNA, 16 bp, M. musculus
aatcagaagaggaaaa

SEQ ID NO: 345623 - DNA, 16 bp, M. musculus
aatcagaatcagatag

SEQ ID NO: 345624 - DNA, 16 bp, M. musculus
aatcagagaaaatgca

SEQ ID NO: 345625 - DNA, 16 bp, M. musculus
aatcagagaaagactt

SEQ ID NO: 345626 - DNA, 16 bp, M. musculus
aatcagagaaaggttt

SEQ ID NO: 345627 - DNA, 16 bp, M. musculus
aatcagagaagatgca

SEQ ID NO: 345628 - DNA, 20 bp, M. musculus
aatcagagaataataatttt

SEQ ID NO: 345629 - DNA, 16 bp, M. musculus
aatcagagcatgaaca

SEQ ID NO: 345630 - DNA, 16 bp, M. musculus
aatcagaggacaattt

SEQ ID NO: 345631 - DNA, 16 bp, M. musculus
aatcagatcccattac

SEQ ID NO: 345632 - DNA, 16 bp, M. musculus
aatcagatgagagaca

SEQ ID NO: 345633 - DNA, 16 bp, M. musculus
aatcagatggcaggaa

SEQ ID NO: 345634 - DNA, 16 bp, M. musculus
aatcagattccaaatg

SEQ ID NO: 345635 - DNA, 16 bp, M. musculus
aatcagattcttgcct

SEQ ID NO: 345636 - DNA, 16 bp, M. musculus
aatcagcaacagaata

SEQ ID NO: 345637 - DNA, 16 bp, M. musculus
aatcagcaagctacag

SEQ ID NO: 345638 - DNA, 16 bp, M. musculus
aatcagcaccatttgt

SEQ ID NO: 345639 - DNA, 16 bp, M. musculus
aatcagcagcagcagc

SEQ ID NO: 345640 - DNA, 16 bp, M. musculus
aatcagcagtggtggc

SEQ ID NO: 345641 - DNA, 16 bp, M. musculus
aatcagccaccaaaag

SEQ ID NO: 345642 - DNA, 16 bp, M. musculus
aatcagcctccaaaca

SEQ ID NO: 345643 - DNA, 16 bp, M. musculus
aatcagcttccaaaca

SEQ ID NO: 345644 - DNA, 16 bp, M. musculus
aatcaggaacttgtca

SEQ ID NO: 345645 - DNA, 16 bp, M. musculus
aatcaggacactgagt

SEQ ID NO: 345646 - DNA, 16 bp, M. musculus
aatcagggtttggctt

SEQ ID NO: 345647 - DNA, 16 bp, M. musculus
aatcaggtcctctgga

SEQ ID NO: 345648 - DNA, 16 bp, M. musculus
aatcaggtgaaagaat

SEQ ID NO: 345649 - DNA, 19 bp, M. musculus
aatcagtaaagctttgcta

SEQ ID NO: 345650 - DNA, 16 bp, M. musculus
aatcagtatggaagtt

SEQ ID NO: 345651 - DNA, 16 bp, M. musculus
aatcagtggccattct

SEQ ID NO: 345652 - DNA, 16 bp, M. musculus
aatcagtttgtttgtt

SEQ ID NO: 345653 - DNA, 16 bp, M. musculus
aatcagttttcttttt

SEQ ID NO: 345654 - DNA, 16 bp, M. musculus
aatcataatgtaaata

SEQ ID NO: 345655 - DNA, 16 bp, M. musculus
aatcataatgtaaatg

SEQ ID NO: 345656 - DNA, 16 bp, M. musculus
aatcataatgtaagta

SEQ ID NO: 345657 - DNA, 16 bp, M. musculus
aatcatacacacataa

SEQ ID NO: 345658 - DNA, 16 bp, M. musculus
aatcatataaccctat

SEQ ID NO: 345659 - DNA, 16 bp, M. musculus
aatcatatcttatgat

SEQ ID NO: 345660 - DNA, 16 bp, M. musculus
aatcatcatatcctac

SEQ ID NO: 345661 - DNA, 16 bp, M. musculus
aatcatcattttaaaa

SEQ ID NO: 345662 - DNA, 16 bp, M. musculus
aatcatccatcctaac

SEQ ID NO: 345663 - DNA, 16 bp, M. musculus
aatcatccctgcatcc

SEQ ID NO: 345664 - DNA, 16 bp, M. musculus
aatcatccctgcattc

SEQ ID NO: 345665 - DNA, 16 bp, M. musculus
aatcatctgtgattaa

SEQ ID NO: 345666 - DNA, 16 bp, M. musculus
aatcattatttcatat

SEQ ID NO: 345667 - DNA, 16 bp, M. musculus
aatcattcttgcctgc

SEQ ID NO: 345668 - DNA, 16 bp, M. musculus
aatcatttaaacaaca

SEQ ID NO: 345669 - DNA, 17 bp, M. musculus
aatcatttatagattgc

SEQ ID NO: 345670 - DNA, 16 bp, M. musculus
aatcatttcattaaaa

SEQ ID NO: 345671 - DNA, 16 bp, M. musculus
aatcatttcattttct

SEQ ID NO: 345672 - DNA, 16 bp, M. musculus
aatcatttgttttaaa

SEQ ID NO: 345673 - DNA, 16 bp, M. musculus
aatccaaaccttcaaa

SEQ ID NO: 345674 - DNA, 16 bp, M. musculus
aatccaatcaagttga

SEQ ID NO: 345675 - DNA, 16 bp, M. musculus
aatccaatgtcctctt

SEQ ID NO: 345676 - DNA, 16 bp, M. musculus
aatccacattcattaa

SEQ ID NO: 345677 - DNA, 16 bp, M. musculus
aatccaccaagatgat

SEQ ID NO: 345678 - DNA, 16 bp, M. musculus
aatccacccactccta

SEQ ID NO: 345679 - DNA, 16 bp, M. musculus
aatccacctgcctctt

SEQ ID NO: 345680 - DNA, 16 bp, M. musculus
aatccaccttcctctg

SEQ ID NO: 345681 - DNA, 16 bp, M. musculus
aatccactgtctcctg

SEQ ID NO: 345682 - DNA, 16 bp, M. musculus
aatccagaagaaactg

SEQ ID NO: 345683 - DNA, 17 bp, M. musculus
aatccagagacactgaa

SEQ ID NO: 345684 - DNA, 16 bp, M. musculus
aatccagagcttcatg

SEQ ID NO: 345685 - DNA, 16 bp, M. musculus
aatccagatgtccttc

SEQ ID NO: 345686 - DNA, 16 bp, M. musculus
aatccagccctataga

SEQ ID NO: 345687 - DNA, 32 bp, M. musculus
aatccagcccttcaaaggataataacagaaaa

SEQ ID NO: 345688 - DNA, 16 bp, M. musculus
aatccagccctttaaa

SEQ ID NO: 345689 - DNA, 16 bp, M. musculus
aatccagctgaaacaa

SEQ ID NO: 345690 - DNA, 27 bp, M. musculus
aatccaggacacaatgagaagaccaaa

SEQ ID NO: 345691 - DNA, 31 bp, M. musculus
aatccaggacacaatgagaagaccaaaccta

SEQ ID NO: 345692 - DNA, 16 bp, M. musculus
aatccaggaccacctg

SEQ ID NO: 345693 - DNA, 16 bp, M. musculus
aatccagggccttgca

SEQ ID NO: 345694 - DNA, 16 bp, M. musculus
aatccagtttttaaaa

SEQ ID NO: 345695 - DNA, 16 bp, M. musculus
aatccataagagtcaa

SEQ ID NO: 345696 - DNA, 16 bp, M. musculus
aatccatcaaagccca

SEQ ID NO: 345697 - DNA, 16 bp, M. musculus
aatccatcaatttaat

SEQ ID NO: 345698 - DNA, 16 bp, M. musculus
aatccatctgcctctg

SEQ ID NO: 345699 - DNA, 16 bp, M. musculus
aatccatgagcagggg

SEQ ID NO: 345700 - DNA, 16 bp, M. musculus
aatccattgtttttaa

SEQ ID NO: 345701 - DNA, 16 bp, M. musculus
aatcccaacacttgtg

SEQ ID NO: 345702 - DNA, 16 bp, M. musculus
aatcccactaaaatga

SEQ ID NO: 345703 - DNA, 16 bp, M. musculus
aatcccagacactatt

SEQ ID NO: 345704 - DNA, 16 bp, M. musculus
aatcccagagctgagg

SEQ ID NO: 345705 - DNA, 16 bp, M. musculus
aatcccagcacacaag

SEQ ID NO: 345706 - DNA, 16 bp, M. musculus
aatcccagcaccagag

SEQ ID NO: 345707 - DNA, 16 bp, M. musculus
aatcccagcacccaag

SEQ ID NO: 345708 - DNA, 16 bp, M. musculus
aatcccagcacccaca

SEQ ID NO: 345709 - DNA, 16 bp, M. musculus
aatcccagcactagga

SEQ ID NO: 345710 - DNA, 20 bp, M. musculus
aatcccagcactcaggaggg

SEQ ID NO: 345711 - DNA, 16 bp, M. musculus
aatcccagcactcgga

SEQ ID NO: 345712 - DNA, 16 bp, M. musculus
aatcccagcactgaag

SEQ ID NO: 345713 - DNA, 16 bp, M. musculus
aatcccagcactggag

SEQ ID NO: 345714 - DNA, 16 bp, M. musculus
aatcccagcacttgga

SEQ ID NO: 345715 - DNA, 16 bp, M. musculus
aatcccagcactttga

SEQ ID NO: 345716 - DNA, 16 bp, M. musculus
aatcccagcaggaggc

SEQ ID NO: 345717 - DNA, 16 bp, M. musculus
aatcccagcagtgggg

SEQ ID NO: 345718 - DNA, 16 bp, M. musculus
aatcccagcagttgag

SEQ ID NO: 345719 - DNA, 16 bp, M. musculus
aatcccagccctcaga

SEQ ID NO: 345720 - DNA, 16 bp, M. musculus
aatcccagctctgcca

SEQ ID NO: 345721 - DNA, 16 bp, M. musculus
aatcccaggagacaaa

SEQ ID NO: 345722 - DNA, 16 bp, M. musculus
aatcccagggctggag

SEQ ID NO: 345723 - DNA, 16 bp, M. musculus
aatcccagttcttcac

SEQ ID NO: 345724 - DNA, 16 bp, M. musculus
aatcccataagaagaa

SEQ ID NO: 345725 - DNA, 16 bp, M. musculus
aatcccattacagatg

SEQ ID NO: 345726 - DNA, 16 bp, M. musculus
aatccccagaacccac

SEQ ID NO: 345727 - DNA, 16 bp, M. musculus
aatccccagcatccat

SEQ ID NO: 345728 - DNA, 16 bp, M. musculus
aatcccctgcccaccc

SEQ ID NO: 345729 - DNA, 16 bp, M. musculus
aatccccttcaactcc

SEQ ID NO: 345730 - DNA, 16 bp, M. musculus
aatccctcacagacat

SEQ ID NO: 345731 - DNA, 16 bp, M. musculus
aatccctccatgtgta

SEQ ID NO: 345732 - DNA, 16 bp, M. musculus
aatccctctgcctctg

SEQ ID NO: 345733 - DNA, 16 bp, M. musculus
aatccctgacactgtt

SEQ ID NO: 345734 - DNA, 16 bp, M. musculus
aatccctgagggccag

SEQ ID NO: 345735 - DNA, 17 bp, M. musculus
aatccgcaggcccctca

SEQ ID NO: 345736 - DNA, 16 bp, M. musculus
aatcctagcacttaga

SEQ ID NO: 345737 - DNA, 16 bp, M. musculus
aatcctagcacttgga

SEQ ID NO: 345738 - DNA, 16 bp, M. musculus
aatcctattaacagaa

SEQ ID NO: 345739 - DNA, 16 bp, M. musculus
aatcctccagcctcag

SEQ ID NO: 345740 - DNA, 16 bp, M. musculus
aatcctcctgcctctg

SEQ ID NO: 345741 - DNA, 16 bp, M. musculus
aatcctcctgtctcca

SEQ ID NO: 345742 - DNA, 16 bp, M. musculus
aatcctctggaactgg

SEQ ID NO: 345743 - DNA, 16 bp, M. musculus
aatcctctggagctgg

SEQ ID NO: 345744 - DNA, 16 bp, M. musculus
aatcctcttgcctcag

SEQ ID NO: 345745 - DNA, 16 bp, M. musculus
aatcctcttgtctcca

SEQ ID NO: 345746 - DNA, 16 bp, M. musculus
aatcctgaagaagcag

SEQ ID NO: 345747 - DNA, 16 bp, M. musculus
aatcctgaagaagtag

SEQ ID NO: 345748 - DNA, 16 bp, M. musculus
aatcctgagttcaatt

SEQ ID NO: 345749 - DNA, 16 bp, M. musculus
aatcctgataggtctg

SEQ ID NO: 345750 - DNA, 16 bp, M. musculus
aatcctgcccttcaaa

SEQ ID NO: 345751 - DNA, 16 bp, M. musculus
aatcctgcctcaaaaa

SEQ ID NO: 345752 - DNA, 16 bp, M. musculus
aatcctggagatagaa

SEQ ID NO: 345753 - DNA, 16 bp, M. musculus
aatcctggtactcagg

SEQ ID NO: 345754 - DNA, 16 bp, M. musculus
aatccttcctcctgtt

SEQ ID NO: 345755 - DNA, 16 bp, M. musculus
aatccttccttccctt

SEQ ID NO: 345756 - DNA, 16 bp, M. musculus
aatcctttcctccaca

SEQ ID NO: 345757 - DNA, 16 bp, M. musculus
aatcctttttaaaaaa

SEQ ID NO: 345758 - DNA, 16 bp, M. musculus
aatcgtaatgcaaata

SEQ ID NO: 345759 - DNA, 16 bp, M. musculus
aatctaaaatttcatt

SEQ ID NO: 345760 - DNA, 16 bp, M. musculus
aatctaaacttttata

SEQ ID NO: 345761 - DNA, 16 bp, M. musculus
aatctaaagaaagaga

SEQ ID NO: 345762 - DNA, 17 bp, M. musculus
aatctaaagaaagagat

SEQ ID NO: 345763 - DNA, 24 bp, M. musculus
aatctacaagaagggtgatattgt

SEQ ID NO: 345764 - DNA, 16 bp, M. musculus
aatctacagcaaagca

SEQ ID NO: 345765 - DNA, 16 bp, M. musculus
aatctacctgcctgtc

SEQ ID NO: 345766 - DNA, 16 bp, M. musculus
aatctatgagggtgac

SEQ ID NO: 345767 - DNA, 16 bp, M. musculus
aatctattccacaaaa

SEQ ID NO: 345768 - DNA, 16 bp, M. musculus
aatctcaactgagaaa

SEQ ID NO: 345769 - DNA, 16 bp, M. musculus
aatctcaagtacagaa

SEQ ID NO: 345770 - DNA, 16 bp, M. musculus
aatctcacccaaacaa

SEQ ID NO: 345771 - DNA, 16 bp, M. musculus
aatctcagaactcaag

SEQ ID NO: 345772 - DNA, 16 bp, M. musculus
aatctcagaactcaga

SEQ ID NO: 345773 - DNA, 16 bp, M. musculus
aatctcagaagaaact

SEQ ID NO: 345774 - DNA, 18 bp, M. musculus
aatctcagaagatggaaa

SEQ ID NO: 345775 - DNA, 16 bp, M. musculus
aatctcagagagtgag

SEQ ID NO: 345776 - DNA, 16 bp, M. musculus
aatctcagagtccttt

SEQ ID NO: 345777 - DNA, 16 bp, M. musculus
aatctcagagttcaag

SEQ ID NO: 345778 - DNA, 16 bp, M. musculus
aatctcagcacacagg

SEQ ID NO: 345779 - DNA, 16 bp, M. musculus
aatctcagcacgtggg

SEQ ID NO: 345780 - DNA, 16 bp, M. musculus
aatctcaggcactgaa

SEQ ID NO: 345781 - DNA, 26 bp, M. musculus
aatctcaggtgcagaagattccataa

SEQ ID NO: 345782 - DNA, 16 bp, M. musculus
aatctcaggttcacag

SEQ ID NO: 345783 - DNA, 16 bp, M. musculus
aatctcaggttgtttt

SEQ ID NO: 345784 - DNA, 16 bp, M. musculus
aatctcataggaagaa

SEQ ID NO: 345785 - DNA, 16 bp, M. musculus
aatctccagcatccat

SEQ ID NO: 345786 - DNA, 16 bp, M. musculus
aatctcctcaagtgtg

SEQ ID NO: 345787 - DNA, 16 bp, M. musculus
aatctcctgtcagaag

SEQ ID NO: 345788 - DNA, 16 bp, M. musculus
aatctctagaacaaaa

SEQ ID NO: 345789 - DNA, 16 bp, M. musculus
aatctctagcaagggc

SEQ ID NO: 345790 - DNA, 16 bp, M. musculus
aatctctcaagaaaga

SEQ ID NO: 345791 - DNA, 17 bp, M. musculus
aatctctccacccagct

SEQ ID NO: 345792 - DNA, 16 bp, M. musculus
aatctctctctccctc

SEQ ID NO: 345793 - DNA, 16 bp, M. musculus
aatctctctgagtttg

SEQ ID NO: 345794 - DNA, 16 bp, M. musculus
aatctctctggctgga

SEQ ID NO: 345795 - DNA, 16 bp, M. musculus
aatctctgaaactata

SEQ ID NO: 345796 - DNA, 16 bp, M. musculus
aatctctgaaagaaat

SEQ ID NO: 345797 - DNA, 16 bp, M. musculus
aatctctgaatttgag

SEQ ID NO: 345798 - DNA, 16 bp, M. musculus
aatctctgagttcaag

SEQ ID NO: 345799 - DNA, 16 bp, M. musculus
aatctctgagttccag

SEQ ID NO: 345800 - DNA, 16 bp, M. musculus
aatctctgagtttgag

SEQ ID NO: 345801 - DNA, 16 bp, M. musculus
aatctctggagttagt

SEQ ID NO: 345802 - DNA, 16 bp, M. musculus
aatctctggtccaccc

SEQ ID NO: 345803 - DNA, 16 bp, M. musculus
aatctctggttcaccc

SEQ ID NO: 345804 - DNA, 16 bp, M. musculus
aatctctgtgagttca

SEQ ID NO: 345805 - DNA, 16 bp, M. musculus
aatctctgtgagttcc

SEQ ID NO: 345806 - DNA, 16 bp, M. musculus
aatctctgtgcttgtg

SEQ ID NO: 345807 - DNA, 16 bp, M. musculus
aatctcttgccttctc

SEQ ID NO: 345808 - DNA, 16 bp, M. musculus
aatctctttaaaggct

SEQ ID NO: 345809 - DNA, 16 bp, M. musculus
aatctctttttatgat

SEQ ID NO: 345810 - DNA, 16 bp, M. musculus
aatctgaaaccttgtt

SEQ ID NO: 345811 - DNA, 16 bp, M. musculus
aatctgaaatctgaaa

SEQ ID NO: 345812 - DNA, 16 bp, M. musculus
aatctgaaattagatt

SEQ ID NO: 345813 - DNA, 16 bp, M. musculus
aatctgaagtttaaaa

SEQ ID NO: 345814 - DNA, 16 bp, M. musculus
aatctgaatcctctat

SEQ ID NO: 345815 - DNA, 16 bp, M. musculus
aatctgaattttattt

SEQ ID NO: 345816 - DNA, 16 bp, M. musculus
aatctgaggaaattca

SEQ ID NO: 345817 - DNA, 16 bp, M. musculus
aatctgaggaggaggg

SEQ ID NO: 345818 - DNA, 16 bp, M. musculus
aatctgagttcagttc

SEQ ID NO: 345819 - DNA, 16 bp, M. musculus
aatctgataccctctt

SEQ ID NO: 345820 - DNA, 16 bp, M. musculus
aatctgatgccttctt

SEQ ID NO: 345821 - DNA, 16 bp, M. musculus
aatctgctttttatac

SEQ ID NO: 345822 - DNA, 16 bp, M. musculus
aatctggaaaattaaa

SEQ ID NO: 345823 - DNA, 16 bp, M. musculus
aatctggaaccaaaga

SEQ ID NO: 345824 - DNA, 16 bp, M. musculus
aatctggacccctgag

SEQ ID NO: 345825 - DNA, 16 bp, M. musculus
aatctggaccctgaga

SEQ ID NO: 345826 - DNA, 16 bp, M. musculus
aatctggatccccaag

SEQ ID NO: 345827 - DNA, 16 bp, M. musculus
aatctggccaagaacc

SEQ ID NO: 345828 - DNA, 16 bp, M. musculus
aatctgtaaaaataaa

SEQ ID NO: 345829 - DNA, 16 bp, M. musculus
aatctgtaagcaagcc

SEQ ID NO: 345830 - DNA, 16 bp, M. musculus
aatctgtaagtcagcc

SEQ ID NO: 345831 - DNA, 16 bp, M. musculus
aatctgtagattgttt

SEQ ID NO: 345832 - DNA, 16 bp, M. musculus
aatctgtaggttgctt

SEQ ID NO: 345833 - DNA, 16 bp, M. musculus
aatctgtcctcatggc

SEQ ID NO: 345834 - DNA, 16 bp, M. musculus
aatctgtgggcctgag

SEQ ID NO: 345835 - DNA, 16 bp, M. musculus
aatctgtgtcttttta

SEQ ID NO: 345836 - DNA, 16 bp, M. musculus
aatctgttgctggcct

SEQ ID NO: 345837 - DNA, 16 bp, M. musculus
aatcttaagaaaaaga

SEQ ID NO: 345838 - DNA, 16 bp, M. musculus
aatcttacagaacaag

SEQ ID NO: 345839 - DNA, 23 bp, M. musculus
aatcttactaatagaaaccaaga

SEQ ID NO: 345840 - DNA, 16 bp, M. musculus
aatcttagctattctg

SEQ ID NO: 345841 - DNA, 16 bp, M. musculus
aatcttataaagaaaa

SEQ ID NO: 345842 - DNA, 16 bp, M. musculus
aatcttcaacatcctt

SEQ ID NO: 345843 - DNA, 16 bp, M. musculus
aatcttcagatgtgag

SEQ ID NO: 345844 - DNA, 16 bp, M. musculus
aatcttctatctccaa

SEQ ID NO: 345845 - DNA, 16 bp, M. musculus
aatcttctcatcacat

SEQ ID NO: 345846 - DNA, 27 bp, M. musculus
aatcttctggaatccatagccactatg

SEQ ID NO: 345847 - DNA, 16 bp, M. musculus
aatcttctggactcct

SEQ ID NO: 345848 - DNA, 16 bp, M. musculus
aatcttgagagagaga

SEQ ID NO: 345849 - DNA, 18 bp, M. musculus
aatcttgctagtgtatgc

SEQ ID NO: 345850 - DNA, 16 bp, M. musculus
aatcttgctggtgtat

SEQ ID NO: 345851 - DNA, 16 bp, M. musculus
aatcttggagtccagt

SEQ ID NO: 345852 - DNA, 16 bp, M. musculus
aatcttggctgtcaac

SEQ ID NO: 345853 - DNA, 16 bp, M. musculus
aatcttgggctggtga

SEQ ID NO: 345854 - DNA, 16 bp, M. musculus
aatcttgttttaaaaa

SEQ ID NO: 345855 - DNA, 16 bp, M. musculus
aatctttaaaaaaagt

SEQ ID NO: 345856 - DNA, 16 bp, M. musculus
aatctttaaaagaaac

SEQ ID NO: 345857 - DNA, 16 bp, M. musculus
aatctttaaacacaca

SEQ ID NO: 345858 - DNA, 16 bp, M. musculus
aatctttactctcttc

SEQ ID NO: 345859 - DNA, 16 bp, M. musculus
aatctttctggaataa

SEQ ID NO: 345860 - DNA, 16 bp, M. musculus
aatcttttaaaagaaa

SEQ ID NO: 345861 - DNA, 16 bp, M. musculus
aatcttttaaattcag

SEQ ID NO: 345862 - DNA, 16 bp, M. musculus
aatcttttgaaacatt

SEQ ID NO: 345863 - DNA, 16 bp, M. musculus
aatctttttaaaagat

SEQ ID NO: 345864 - DNA, 16 bp, M. musculus
aatgaaaaatatttct

SEQ ID NO: 345865 - DNA, 16 bp, M. musculus
aatgaaaaatgcattt

SEQ ID NO: 345866 - DNA, 16 bp, M. musculus
aatgaaaaattactgt

SEQ ID NO: 345867 - DNA, 16 bp, M. musculus
aatgaaaacaaagcca

SEQ ID NO: 345868 - DNA, 16 bp, M. musculus
aatgaaaacacacaca

SEQ ID NO: 345869 - DNA, 16 bp, M. musculus
aatgaaaacacagctc

SEQ ID NO: 345870 - DNA, 16 bp, M. musculus
aatgaaaacagtgcta

SEQ ID NO: 345871 - DNA, 16 bp, M. musculus
aatgaaaacattaaat

SEQ ID NO: 345872 - DNA, 16 bp, M. musculus
aatgaaaacatttaat

SEQ ID NO: 345873 - DNA, 16 bp, M. musculus
aatgaaaacatttcta

SEQ ID NO: 345874 - DNA, 16 bp, M. musculus
aatgaaaacattttct

SEQ ID NO: 345875 - DNA, 16 bp, M. musculus
aatgaaaaccttaaaa

SEQ ID NO: 345876 - DNA, 17 bp, M. musculus
aatgaaaagggaaacat

SEQ ID NO: 345877 - DNA, 16 bp, M. musculus
aatgaaaaggggacat

SEQ ID NO: 345878 - DNA, 16 bp, M. musculus
aatgaaaatgaaccca

SEQ ID NO: 345879 - DNA, 16 bp, M. musculus
aatgaaaatgagaaca

SEQ ID NO: 345880 - DNA, 16 bp, M. musculus
aatgaaaatttcattt

SEQ ID NO: 345881 - DNA, 16 bp, M. musculus
aatgaaaatttcttac

SEQ ID NO: 345882 - DNA, 16 bp, M. musculus
aatgaaacagatgcag

SEQ ID NO: 345883 - DNA, 16 bp, M. musculus
aatgaaacaggtgaag

SEQ ID NO: 345884 - DNA, 16 bp, M. musculus
aatgaaactcagagga

SEQ ID NO: 345885 - DNA, 16 bp, M. musculus
aatgaaactccaaaga

SEQ ID NO: 345886 - DNA, 16 bp, M. musculus
aatgaaactttttaaa

SEQ ID NO: 345887 - DNA, 16 bp, M. musculus
aatgaaagaactagag

SEQ ID NO: 345888 - DNA, 16 bp, M. musculus
aatgaaagacagaaag

SEQ ID NO: 345889 - DNA, 16 bp, M. musculus
aatgaaagaccatcca

SEQ ID NO: 345890 - DNA, 16 bp, M. musculus
aatgaaagaggagaca

SEQ ID NO: 345891 - DNA, 16 bp, M. musculus
aatgaaataaaactga

SEQ ID NO: 345892 - DNA, 16 bp, M. musculus
aatgaaataaatcttt

SEQ ID NO: 345893 - DNA, 16 bp, M. musculus
aatgaaatcaaagaca

SEQ ID NO: 345894 - DNA, 16 bp, M. musculus
aatgaaatctacttgg

SEQ ID NO: 345895 - DNA, 16 bp, M. musculus
aatgaaatctggtgcc

SEQ ID NO: 345896 - DNA, 16 bp, M. musculus
aatgaaatgttgtcct

SEQ ID NO: 345897 - DNA, 16 bp, M. musculus
aatgaaatgttttaaa

SEQ ID NO: 345898 - DNA, 16 bp, M. musculus
aatgaaatgttttctt

SEQ ID NO: 345899 - DNA, 16 bp, M. musculus
aatgaaattaaagcaa

SEQ ID NO: 345900 - DNA, 16 bp, M. musculus
aatgaaattacatttt

SEQ ID NO: 345901 - DNA, 16 bp, M. musculus
aatgaaattttcattt

SEQ ID NO: 345902 - DNA, 16 bp, M. musculus
aatgaacaaaaccatt

SEQ ID NO: 345903 - DNA, 16 bp, M. musculus
aatgaacaaaatattt

SEQ ID NO: 345904 - DNA, 16 bp, M. musculus
aatgaacatttttaaa

SEQ ID NO: 345905 - DNA, 16 bp, M. musculus
aatgaactgaacttct

SEQ ID NO: 345906 - DNA, 16 bp, M. musculus
aatgaagaaaacattt

SEQ ID NO: 345907 - DNA, 16 bp, M. musculus
aatgaagaaaactgaa

SEQ ID NO: 345908 - DNA, 16 bp, M. musculus
aatgaagaaaataact

SEQ ID NO: 345909 - DNA, 16 bp, M. musculus
aatgaagaaaatactt

SEQ ID NO: 345910 - DNA, 16 bp, M. musculus
aatgaagaaactgaag

SEQ ID NO: 345911 - DNA, 16 bp, M. musculus
aatgaagaaactgagg

SEQ ID NO: 345912 - DNA, 16 bp, M. musculus
aatgaagaaaggaaac

SEQ ID NO: 345913 - DNA, 16 bp, M. musculus
aatgaagaaatatcta

SEQ ID NO: 345914 - DNA, 16 bp, M. musculus
aatgaagaatcttcct

SEQ ID NO: 345915 - DNA, 16 bp, M. musculus
aatgaagaatgaagtg

SEQ ID NO: 345916 - DNA, 16 bp, M. musculus
aatgaagaggagcctg

SEQ ID NO: 345917 - DNA, 16 bp, M. musculus
aatgaagatcagcaaa

SEQ ID NO: 345918 - DNA, 16 bp, M. musculus
aatgaagatgaagcca

SEQ ID NO: 345919 - DNA, 16 bp, M. musculus
aatgaagatttttaaa

SEQ ID NO: 345920 - DNA, 17 bp, M. musculus
aatgaaggagccagaga

SEQ ID NO: 345921 - DNA, 16 bp, M. musculus
aatgaaggagctagag

SEQ ID NO: 345922 - DNA, 16 bp, M. musculus
aatgaagtactacaca

SEQ ID NO: 345923 - DNA, 16 bp, M. musculus
aatgaagtatctacat

SEQ ID NO: 345924 - DNA, 16 bp, M. musculus
aatgaagtatttttaa

SEQ ID NO: 345925 - DNA, 16 bp, M. musculus
aatgaagttttacaat

SEQ ID NO: 345926 - DNA, 16 bp, M. musculus
aatgaataaaactttt

SEQ ID NO: 345927 - DNA, 16 bp, M. musculus
aatgaataaaatatct

SEQ ID NO: 345928 - DNA, 16 bp, M. musculus
aatgaataaagaagcc

SEQ ID NO: 345929 - DNA, 16 bp, M. musculus
aatgaataaatgtttt

SEQ ID NO: 345930 - DNA, 16 bp, M. musculus
aatgaataagcaaata

SEQ ID NO: 345931 - DNA, 16 bp, M. musculus
aatgaatcagagaaag

SEQ ID NO: 345932 - DNA, 16 bp, M. musculus
aatgaatcataatgta

SEQ ID NO: 345933 - DNA, 16 bp, M. musculus
aatgaatcttaaaaat

SEQ ID NO: 345934 - DNA, 16 bp, M. musculus
aatgaatgaacaaaca

SEQ ID NO: 345935 - DNA, 16 bp, M. musculus
aatgaatgaatctgaa

SEQ ID NO: 345936 - DNA, 16 bp, M. musculus
aatgaatgaatggata

SEQ ID NO: 345937 - DNA, 16 bp, M. musculus
aatgaatgagagagag

SEQ ID NO: 345938 - DNA, 16 bp, M. musculus
aatgaatgagctagag

SEQ ID NO: 345939 - DNA, 16 bp, M. musculus
aatgaatgagtgaatg

SEQ ID NO: 345940 - DNA, 16 bp, M. musculus
aatgaatgcatgaatg

SEQ ID NO: 345941 - DNA, 16 bp, M. musculus
aatgaatgcatgcatg

SEQ ID NO: 345942 - DNA, 16 bp, M. musculus
aatgaatggaaggaag

SEQ ID NO: 345943 - DNA, 16 bp, M. musculus
aatgaatggataaaga

SEQ ID NO: 345944 - DNA, 16 bp, M. musculus
aatgaatggatggatg

SEQ ID NO: 345945 - DNA, 16 bp, M. musculus
aatgaatgtgaaaaca

SEQ ID NO: 345946 - DNA, 16 bp, M. musculus
aatgaatgttctgtgt

SEQ ID NO: 345947 - DNA, 16 bp, M. musculus
aatgaatgtttttctt

SEQ ID NO: 345948 - DNA, 16 bp, M. musculus
aatgaattcttttttt

SEQ ID NO: 345949 - DNA, 23 bp, M. musculus
aatgaatttatgaaattcctagg

SEQ ID NO: 345950 - DNA, 29 bp, M. musculus
aatgaatttatgaaattcctaggcaaatg

SEQ ID NO: 345951 - DNA, 20 bp, M. musculus
aatgaatttatgaaattctt

SEQ ID NO: 345952 - DNA, 16 bp, M. musculus
aatgaatttcaaaata

SEQ ID NO: 345953 - DNA, 16 bp, M. musculus
aatgaatttgaatttt

SEQ ID NO: 345954 - DNA, 16 bp, M. musculus
aatgacaaaaccaaat

SEQ ID NO: 345955 - DNA, 17 bp, M. musculus
aatgacaaggtggccaa

SEQ ID NO: 345956 - DNA, 16 bp, M. musculus
aatgacaataccagtt

SEQ ID NO: 345957 - DNA, 16 bp, M. musculus
aatgacacacacacac

SEQ ID NO: 345958 - DNA, 16 bp, M. musculus
aatgacacagactcca

SEQ ID NO: 345959 - DNA, 16 bp, M. musculus
aatgacagaaaagaag

SEQ ID NO: 345960 - DNA, 16 bp, M. musculus
aatgacagggccagga

SEQ ID NO: 345961 - DNA, 16 bp, M. musculus
aatgacagtttataaa

SEQ ID NO: 345962 - DNA, 16 bp, M. musculus
aatgacatatttttat

SEQ ID NO: 345963 - DNA, 16 bp, M. musculus
aatgacatttcatttt

SEQ ID NO: 345964 - DNA, 16 bp, M. musculus
aatgacattttaattt

SEQ ID NO: 345965 - DNA, 16 bp, M. musculus
aatgaccaaccaataa

SEQ ID NO: 345966 - DNA, 16 bp, M. musculus
aatgaccagcaaagaa

SEQ ID NO: 345967 - DNA, 16 bp, M. musculus
aatgaccatccagaaa

SEQ ID NO: 345968 - DNA, 16 bp, M. musculus
aatgaccatttttact

SEQ ID NO: 345969 - DNA, 16 bp, M. musculus
aatgaccctgagagtc

SEQ ID NO: 345970 - DNA, 16 bp, M. musculus
aatgacccttccacag

SEQ ID NO: 345971 - DNA, 16 bp, M. musculus
aatgaccctttcacag

SEQ ID NO: 345972 - DNA, 16 bp, M. musculus
aatgacctaacttcct

SEQ ID NO: 345973 - DNA, 16 bp, M. musculus
aatgacctaagttcaa

SEQ ID NO: 345974 - DNA, 16 bp, M. musculus
aatgaccttccatggc

SEQ ID NO: 345975 - DNA, 16 bp, M. musculus
aatgaccttgaactca

SEQ ID NO: 345976 - DNA, 17 bp, M. musculus
aatgaccttgaactcct

SEQ ID NO: 345977 - DNA, 16 bp, M. musculus
aatgaccttgaacttc

SEQ ID NO: 345978 - DNA, 16 bp, M. musculus
aatgacgatgatgatg

SEQ ID NO: 345979 - DNA, 16 bp, M. musculus
aatgacggagctccag

SEQ ID NO: 345980 - DNA, 16 bp, M. musculus
aatgactaaataaata

SEQ ID NO: 345981 - DNA, 16 bp, M. musculus
aatgactaagatgaaa

SEQ ID NO: 345982 - DNA, 16 bp, M. musculus
aatgactccaaggaaa

SEQ ID NO: 345983 - DNA, 16 bp, M. musculus
aatgactctagcttgt

SEQ ID NO: 345984 - DNA, 16 bp, M. musculus
aatgactctttcacag

SEQ ID NO: 345985 - DNA, 16 bp, M. musculus
aatgacttaaatatta

SEQ ID NO: 345986 - DNA, 16 bp, M. musculus
aatgacttcatggata

SEQ ID NO: 345987 - DNA, 16 bp, M. musculus
aatgacttccagagtg

SEQ ID NO: 345988 - DNA, 16 bp, M. musculus
aatgacttcttctatt

SEQ ID NO: 345989 - DNA, 16 bp, M. musculus
aatgactttgaatttc

SEQ ID NO: 345990 - DNA, 16 bp, M. musculus
aatgactttttaaaaa

SEQ ID NO: 345991 - DNA, 16 bp, M. musculus
aatgagaaagagccag

SEQ ID NO: 345992 - DNA, 16 bp, M. musculus
aatgagaacaaaacac

SEQ ID NO: 345993 - DNA, 16 bp, M. musculus
aatgagaacatcctga

SEQ ID NO: 345994 - DNA, 16 bp, M. musculus
aatgagaagaacaaac

SEQ ID NO: 345995 - DNA, 16 bp, M. musculus
aatgagaagctgagag

SEQ ID NO: 345996 - DNA, 16 bp, M. musculus
aatgagaatggccttc

SEQ ID NO: 345997 - DNA, 16 bp, M. musculus
aatgagaccacctggg

SEQ ID NO: 345998 - DNA, 16 bp, M. musculus
aatgagaccctgtctc

SEQ ID NO: 345999 - DNA, 16 bp, M. musculus
aatgagagaagatgca

SEQ ID NO: 346000 - DNA, 16 bp, M. musculus
aatgagagacactgtc

SEQ ID NO: 346001 - DNA, 16 bp, M. musculus
aatgagatcatcatgt

SEQ ID NO: 346002 - DNA, 16 bp, M. musculus
aatgagatctggcacc

SEQ ID NO: 346003 - DNA, 16 bp, M. musculus
aatgagattgaagcag

SEQ ID NO: 346004 - DNA, 16 bp, M. musculus
aatgagcaggagaaag

SEQ ID NO: 346005 - DNA, 16 bp, M. musculus
aatgagccaggatgtg

SEQ ID NO: 346006 - DNA, 16 bp, M. musculus
aatgagccaggcatgg

SEQ ID NO: 346007 - DNA, 16 bp, M. musculus
aatgagctgaggcaga

SEQ ID NO: 346008 - DNA, 16 bp, M. musculus
aatgaggaagaatatg

SEQ ID NO: 346009 - DNA, 16 bp, M. musculus
aatgaggatgacatta

SEQ ID NO: 346010 - DNA, 17 bp, M. musculus
aatgaggcatagtgcat

SEQ ID NO: 346011 - DNA, 17 bp, M. musculus
aatgaggctctgtgagg

SEQ ID NO: 346012 - DNA, 16 bp, M. musculus
aatgaggctgcccttg

SEQ ID NO: 346013 - DNA, 16 bp, M. musculus
aatgaggctgctatga

SEQ ID NO: 346014 - DNA, 16 bp, M. musculus
aatgaggctgtggaac

SEQ ID NO: 346015 - DNA, 16 bp, M. musculus
aatgaggggctggaga

SEQ ID NO: 346016 - DNA, 16 bp, M. musculus
aatgagggtttttttt

SEQ ID NO: 346017 - DNA, 16 bp, M. musculus
aatgaggtctggtgcc

SEQ ID NO: 346018 - DNA, 19 bp, M. musculus
aatgaggtgacaaggactt

SEQ ID NO: 346019 - DNA, 16 bp, M. musculus
aatgagtcagagatag

SEQ ID NO: 346020 - DNA, 16 bp, M. musculus
aatgagtcattggttt

SEQ ID NO: 346021 - DNA, 16 bp, M. musculus
aatgagtcttttaaaa

SEQ ID NO: 346022 - DNA, 16 bp, M. musculus
aatgagttcaaggcta

SEQ ID NO: 346023 - DNA, 16 bp, M. musculus
aatgataaaaatttct

SEQ ID NO: 346024 - DNA, 16 bp, M. musculus
aatgataatctgtttg

SEQ ID NO: 346025 - DNA, 16 bp, M. musculus
aatgatacttttgctg

SEQ ID NO: 346026 - DNA, 29 bp, M. musculus
aatgatagacctaagctccgccttaagat

SEQ ID NO: 346027 - DNA, 16 bp, M. musculus
aatgatatacttgtaa

SEQ ID NO: 346028 - DNA, 16 bp, M. musculus
aatgatctttattttt

SEQ ID NO: 346029 - DNA, 16 bp, M. musculus
aatgatgaagaaaatg

SEQ ID NO: 346030 - DNA, 17 bp, M. musculus
aatgatgagaagctgga

SEQ ID NO: 346031 - DNA, 16 bp, M. musculus
aatgatgatgaagatg

SEQ ID NO: 346032 - DNA, 16 bp, M. musculus
aatgatgatgatgatg

SEQ ID NO: 346033 - DNA, 16 bp, M. musculus
aatgatgatggtgatg

SEQ ID NO: 346034 - DNA, 16 bp, M. musculus
aatgatgatttttaaa

SEQ ID NO: 346035 - DNA, 16 bp, M. musculus
aatgatggagctctgg

SEQ ID NO: 346036 - DNA, 16 bp, M. musculus
aatgatggatgtggga

SEQ ID NO: 346037 - DNA, 16 bp, M. musculus
aatgatggcaagcctc

SEQ ID NO: 346038 - DNA, 16 bp, M. musculus
aatgatggccgtctag

SEQ ID NO: 346039 - DNA, 16 bp, M. musculus
aatgatgttttttaaa

SEQ ID NO: 346040 - DNA, 24 bp, M. musculus
aatgattaaggatgttgaacattt

SEQ ID NO: 346041 - DNA, 16 bp, M. musculus
aatgattcaatcacca

SEQ ID NO: 346042 - DNA, 16 bp, M. musculus
aatgattccacaaaat

SEQ ID NO: 346043 - DNA, 16 bp, M. musculus
aatgattcccccaaaa

SEQ ID NO: 346044 - DNA, 16 bp, M. musculus
aatgattctttgtatt

SEQ ID NO: 346045 - DNA, 16 bp, M. musculus
aatgattggctgtgag

SEQ ID NO: 346046 - DNA, 17 bp, M. musculus
aatgatttccatgccct

SEQ ID NO: 346047 - DNA, 16 bp, M. musculus
aatgatttttttttcc

SEQ ID NO: 346048 - DNA, 16 bp, M. musculus
aatgcaaaaatagtca

SEQ ID NO: 346049 - DNA, 16 bp, M. musculus
aatgcaaaaatattca

SEQ ID NO: 346050 - DNA, 16 bp, M. musculus
aatgcaaaccaaatta

SEQ ID NO: 346051 - DNA, 16 bp, M. musculus
aatgcaaatcaaaata

SEQ ID NO: 346052 - DNA, 16 bp, M. musculus
aatgcaaattgataca

SEQ ID NO: 346053 - DNA, 16 bp, M. musculus
aatgcaacttttaaaa

SEQ ID NO: 346054 - DNA, 16 bp, M. musculus
aatgcaagaataaagc

SEQ ID NO: 346055 - DNA, 16 bp, M. musculus
aatgcaaggacaggga

SEQ ID NO: 346056 - DNA, 16 bp, M. musculus
aatgcaagtttttatt

SEQ ID NO: 346057 - DNA, 16 bp, M. musculus
aatgcaatccccagca

SEQ ID NO: 346058 - DNA, 16 bp, M. musculus
aatgcaatctccatca

SEQ ID NO: 346059 - DNA, 16 bp, M. musculus
aatgcaatttttaaaa

SEQ ID NO: 346060 - DNA, 16 bp, M. musculus
aatgcacagacataca

SEQ ID NO: 346061 - DNA, 16 bp, M. musculus
aatgcactaaataagg

SEQ ID NO: 346062 - DNA, 16 bp, M. musculus
aatgcagaggcaggag

SEQ ID NO: 346063 - DNA, 28 bp, M. musculus
aatgcagcacatcctcactcccaatcag

SEQ ID NO: 346064 - DNA, 16 bp, M. musculus
aatgcaggaaaacaca

SEQ ID NO: 346065 - DNA, 16 bp, M. musculus
aatgcagtgacaaaga

SEQ ID NO: 346066 - DNA, 16 bp, M. musculus
aatgcagttatgaaaa

SEQ ID NO: 346067 - DNA, 16 bp, M. musculus
aatgcagtttttaaaa

SEQ ID NO: 346068 - DNA, 16 bp, M. musculus
aatgcatagaaacaaa

SEQ ID NO: 346069 - DNA, 16 bp, M. musculus
aatgcatgtaaaataa

SEQ ID NO: 346070 - DNA, 16 bp, M. musculus
aatgcattatatattt

SEQ ID NO: 346071 - DNA, 16 bp, M. musculus
aatgcattttgattat

SEQ ID NO: 346072 - DNA, 16 bp, M. musculus
aatgcatttttttaaa

SEQ ID NO: 346073 - DNA, 16 bp, M. musculus
aatgccagagtcagga

SEQ ID NO: 346074 - DNA, 16 bp, M. musculus
aatgccaggaagtggg

SEQ ID NO: 346075 - DNA, 16 bp, M. musculus
aatgccaggagttctc

SEQ ID NO: 346076 - DNA, 16 bp, M. musculus
aatgccaggccaggaa

SEQ ID NO: 346077 - DNA, 17 bp, M. musculus
aatgccagggacaaaaa

SEQ ID NO: 346078 - DNA, 16 bp, M. musculus
aatgccagggcagtga

SEQ ID NO: 346079 - DNA, 16 bp, M. musculus
aatgccagggccagaa

SEQ ID NO: 346080 - DNA, 16 bp, M. musculus
aatgccagggtcagga

SEQ ID NO: 346081 - DNA, 16 bp, M. musculus
aatgccatcctctgct

SEQ ID NO: 346082 - DNA, 16 bp, M. musculus
aatgccatcttctggc

SEQ ID NO: 346083 - DNA, 16 bp, M. musculus
aatgcccaggctttcc

SEQ ID NO: 346084 - DNA, 16 bp, M. musculus
aatgccccacagactt

SEQ ID NO: 346085 - DNA, 16 bp, M. musculus
aatgccccacaggctt

SEQ ID NO: 346086 - DNA, 43 bp, M. musculus
aatgcccctcaacagaggaatggatacagaaaatgtggtacat

SEQ ID NO: 346087 - DNA, 16 bp, M. musculus
aatgcccctgcctcag

SEQ ID NO: 346088 - DNA, 16 bp, M. musculus
aatgccctacagctgg

SEQ ID NO: 346089 - DNA, 16 bp, M. musculus
aatgccctcttctggt

SEQ ID NO: 346090 - DNA, 18 bp, M. musculus
aatgcctacaaaggactg

SEQ ID NO: 346091 - DNA, 16 bp, M. musculus
aatgcctctggcttcc

SEQ ID NO: 346092 - DNA, 16 bp, M. musculus
aatgcctgttttcttt

SEQ ID NO: 346093 - DNA, 16 bp, M. musculus
aatgccttcataagat

SEQ ID NO: 346094 - DNA, 16 bp, M. musculus
aatgccttcattctca

SEQ ID NO: 346095 - DNA, 16 bp, M. musculus
aatgccttctgtccca

SEQ ID NO: 346096 - DNA, 16 bp, M. musculus
aatgccttcttctcag

SEQ ID NO: 346097 - DNA, 16 bp, M. musculus
aatgcctttaaaaata

SEQ ID NO: 346098 - DNA, 16 bp, M. musculus
aatgccttttttaaaa

SEQ ID NO: 346099 - DNA, 16 bp, M. musculus
aatgctaaattctgta

SEQ ID NO: 346100 - DNA, 16 bp, M. musculus
aatgctaacccaaaag

SEQ ID NO: 346101 - DNA, 16 bp, M. musculus
aatgctaagaagaaaa

SEQ ID NO: 346102 - DNA, 16 bp, M. musculus
aatgctaagatcaaaa

SEQ ID NO: 346103 - DNA, 16 bp, M. musculus
aatgctagaattaaag

SEQ ID NO: 346104 - DNA, 16 bp, M. musculus
aatgctagtgaatcag

SEQ ID NO: 346105 - DNA, 17 bp, M. musculus
aatgctattccaaaagt

SEQ ID NO: 346106 - DNA, 16 bp, M. musculus
aatgctatttttaaaa

SEQ ID NO: 346107 - DNA, 16 bp, M. musculus
aatgctcagtcctaaa

SEQ ID NO: 346108 - DNA, 16 bp, M. musculus
aatgctcatggattgg

SEQ ID NO: 346109 - DNA, 16 bp, M. musculus
aatgctccaaacttgt

SEQ ID NO: 346110 - DNA, 16 bp, M. musculus
aatgctctactcagtg

SEQ ID NO: 346111 - DNA, 16 bp, M. musculus
aatgctctcttttggt

SEQ ID NO: 346112 - DNA, 16 bp, M. musculus
aatgctcttgcagagg

SEQ ID NO: 346113 - DNA, 16 bp, M. musculus
aatgctgagaaaaaaa

SEQ ID NO: 346114 - DNA, 16 bp, M. musculus
aatgctgagaatggga

SEQ ID NO: 346115 - DNA, 16 bp, M. musculus
aatgctgcaacccttt

SEQ ID NO: 346116 - DNA, 16 bp, M. musculus
aatgctgccacccttt

SEQ ID NO: 346117 - DNA, 16 bp, M. musculus
aatgctgctatgaaca

SEQ ID NO: 346118 - DNA, 16 bp, M. musculus
aatgctggaattaaag

SEQ ID NO: 346119 - DNA, 16 bp, M. musculus
aatgctggaattacag

SEQ ID NO: 346120 - DNA, 16 bp, M. musculus
aatgctggagaaggag

SEQ ID NO: 346121 - DNA, 16 bp, M. musculus
aatgctgggactaaag

SEQ ID NO: 346122 - DNA, 16 bp, M. musculus
aatgctgggattaaag

SEQ ID NO: 346123 - DNA, 16 bp, M. musculus
aatgctgggattacag

SEQ ID NO: 346124 - DNA, 16 bp, M. musculus
aatgctgggattgaag

SEQ ID NO: 346125 - DNA, 16 bp, M. musculus
aatgctggggttacag

SEQ ID NO: 346126 - DNA, 16 bp, M. musculus
aatgctgggtgtggtg

SEQ ID NO: 346127 - DNA, 16 bp, M. musculus
aatgctgtcttttata

SEQ ID NO: 346128 - DNA, 16 bp, M. musculus
aatgctgtgaccttca

SEQ ID NO: 346129 - DNA, 16 bp, M. musculus
aatgctgtttgtcttt

SEQ ID NO: 346130 - DNA, 16 bp, M. musculus
aatgcttattttaaaa

SEQ ID NO: 346131 - DNA, 16 bp, M. musculus
aatgcttccataaaat

SEQ ID NO: 346132 - DNA, 16 bp, M. musculus
aatgctttattttata

SEQ ID NO: 346133 - DNA, 16 bp, M. musculus
aatgctttatttttaa

SEQ ID NO: 346134 - DNA, 16 bp, M. musculus
aatgctttcattgtgt

SEQ ID NO: 346135 - DNA, 16 bp, M. musculus
aatgctttcctttcta

SEQ ID NO: 346136 - DNA, 16 bp, M. musculus
aatgctttccttttta

SEQ ID NO: 346137 - DNA, 16 bp, M. musculus
aatgctttcttctata

SEQ ID NO: 346138 - DNA, 16 bp, M. musculus
aatgctttcttctggc

SEQ ID NO: 346139 - DNA, 16 bp, M. musculus
aatgctttctttcata

SEQ ID NO: 346140 - DNA, 16 bp, M. musculus
aatgcttttatttatt

SEQ ID NO: 346141 - DNA, 16 bp, M. musculus
aatgctttttaaaaag

SEQ ID NO: 346142 - DNA, 16 bp, M. musculus
aatggaaaaaaaatct

SEQ ID NO: 346143 - DNA, 16 bp, M. musculus
aatggaaaaagatcct

SEQ ID NO: 346144 - DNA, 16 bp, M. musculus
aatggaaaaagcaaga

SEQ ID NO: 346145 - DNA, 16 bp, M. musculus
aatggaaaagaactga

SEQ ID NO: 346146 - DNA, 16 bp, M. musculus
aatggaaacaggcagc

SEQ ID NO: 346147 - DNA, 16 bp, M. musculus
aatggaaactgaggaa

SEQ ID NO: 346148 - DNA, 16 bp, M. musculus
aatggaaatagtttta

SEQ ID NO: 346149 - DNA, 16 bp, M. musculus
aatggaaatcaaaatg

SEQ ID NO: 346150 - DNA, 16 bp, M. musculus
aatggaaatgaagaca

SEQ ID NO: 346151 - DNA, 16 bp, M. musculus
aatggaaatggagagg

SEQ ID NO: 346152 - DNA, 17 bp, M. musculus
aatggaaattggtctga

SEQ ID NO: 346153 - DNA, 16 bp, M. musculus
aatggaacccagggct

SEQ ID NO: 346154 - DNA, 16 bp, M. musculus
aatggaacctgggtcc

SEQ ID NO: 346155 - DNA, 16 bp, M. musculus
aatggaactaatttct

SEQ ID NO: 346156 - DNA, 16 bp, M. musculus
aatggaactagaaaag

SEQ ID NO: 346157 - DNA, 16 bp, M. musculus
aatggaactgaagacc

SEQ ID NO: 346158 - DNA, 16 bp, M. musculus
aatggaagagctagaa

SEQ ID NO: 346159 - DNA, 16 bp, M. musculus
aatggaagcaaattca

SEQ ID NO: 346160 - DNA, 16 bp, M. musculus
aatggaaggatgtctt

SEQ ID NO: 346161 - DNA, 16 bp, M. musculus
aatggaagtaaaaaca

SEQ ID NO: 346162 - DNA, 16 bp, M. musculus
aatggaataaaatcaa

SEQ ID NO: 346163 - DNA, 17 bp, M. musculus
aatggaatagaagtgaa

SEQ ID NO: 346164 - DNA, 16 bp, M. musculus
aatggaatgctttaaa

SEQ ID NO: 346165 - DNA, 16 bp, M. musculus
aatggaatgtgatggt

SEQ ID NO: 346166 - DNA, 17 bp, M. musculus
aatggaatgtttgttgt

SEQ ID NO: 346167 - DNA, 16 bp, M. musculus
aatggaattgaataaa

SEQ ID NO: 346168 - DNA, 16 bp, M. musculus
aatggaatttttaaaa

SEQ ID NO: 346169 - DNA, 16 bp, M. musculus
aatggacaaagaaaat

SEQ ID NO: 346170 - DNA, 17 bp, M. musculus
aatggacacatggagat

SEQ ID NO: 346171 - DNA, 17 bp, M. musculus
aatggacagaaactgct

SEQ ID NO: 346172 - DNA, 16 bp, M. musculus
aatggacagaaacttg

SEQ ID NO: 346173 - DNA, 16 bp, M. musculus
aatggacagatggatg

SEQ ID NO: 346174 - DNA, 16 bp, M. musculus
aatggacatagaaaat

SEQ ID NO: 346175 - DNA, 16 bp, M. musculus
aatggactgggctctc

SEQ ID NO: 346176 - DNA, 16 bp, M. musculus
aatggactgtaaaaaa

SEQ ID NO: 346177 - DNA, 16 bp, M. musculus
aatggactgtgatgtg

SEQ ID NO: 346178 - DNA, 16 bp, M. musculus
aatggagaaaagcctg

SEQ ID NO: 346179 - DNA, 16 bp, M. musculus
aatggagaagtttcta

SEQ ID NO: 346180 - DNA, 16 bp, M. musculus
aatggagacaaatggg

SEQ ID NO: 346181 - DNA, 16 bp, M. musculus
aatggagagaaaatta

SEQ ID NO: 346182 - DNA, 17 bp, M. musculus
aatggagagaaactcga

SEQ ID NO: 346183 - DNA, 16 bp, M. musculus
aatggagagaagcctg

SEQ ID NO: 346184 - DNA, 16 bp, M. musculus
aatggagatgtggtgg

SEQ ID NO: 346185 - DNA, 16 bp, M. musculus
aatggagctaagtcaa

SEQ ID NO: 346186 - DNA, 16 bp, M. musculus
aatggagctagaaaat

SEQ ID NO: 346187 - DNA, 16 bp, M. musculus
aatggagctggagaga

SEQ ID NO: 346188 - DNA, 16 bp, M. musculus
aatggaggaagagtgg

SEQ ID NO: 346189 - DNA, 16 bp, M. musculus
aatggaggagctgaag

SEQ ID NO: 346190 - DNA, 16 bp, M. musculus
aatggaggagctggag

SEQ ID NO: 346191 - DNA, 23 bp, M. musculus
aatggaggagtgttcctctttcc

SEQ ID NO: 346192 - DNA, 31 bp, M. musculus
aatggaggagtgttcctctttctccacatcc

SEQ ID NO: 346193 - DNA, 16 bp, M. musculus
aatggaggcagaagga

SEQ ID NO: 346194 - DNA, 16 bp, M. musculus
aatggaggtcaaaggg

SEQ ID NO: 346195 - DNA, 16 bp, M. musculus
aatggaggtgtgtgtg

SEQ ID NO: 346196 - DNA, 16 bp, M. musculus
aatggataaagaaact

SEQ ID NO: 346197 - DNA, 16 bp, M. musculus
aatggataattttcta

SEQ ID NO: 346198 - DNA, 19 bp, M. musculus
aatggatacagaaaatgta

SEQ ID NO: 346199 - DNA, 21 bp, M. musculus
aatggatacagaaaatgtgat

SEQ ID NO: 346200 - DNA, 21 bp, M. musculus
aatggatacagaaaatgtggc

SEQ ID NO: 346201 - DNA, 19 bp, M. musculus
aatggatacagaaactgtg

SEQ ID NO: 346202 - DNA, 16 bp, M. musculus
aatggatagaacttga

SEQ ID NO: 346203 - DNA, 16 bp, M. musculus
aatggatcatttcaca

SEQ ID NO: 346204 - DNA, 17 bp, M. musculus
aatggatcccagcctct

SEQ ID NO: 346205 - DNA, 16 bp, M. musculus
aatggatgaaactgga

SEQ ID NO: 346206 - DNA, 16 bp, M. musculus
aatggatgaagaaaat

SEQ ID NO: 346207 - DNA, 16 bp, M. musculus
aatggatgactgtgaa

SEQ ID NO: 346208 - DNA, 16 bp, M. musculus
aatggatggaacttaa

SEQ ID NO: 346209 - DNA, 16 bp, M. musculus
aatggatggatgatgg

SEQ ID NO: 346210 - DNA, 16 bp, M. musculus
aatggatggatgggtg

SEQ ID NO: 346211 - DNA, 16 bp, M. musculus
aatggatggatgtgga

SEQ ID NO: 346212 - DNA, 16 bp, M. musculus
aatggatggctctgga

SEQ ID NO: 346213 - DNA, 16 bp, M. musculus
aatggatggttttcta

SEQ ID NO: 346214 - DNA, 16 bp, M. musculus
aatggatgtatctgga

SEQ ID NO: 346215 - DNA, 16 bp, M. musculus
aatggatgttgcattt

SEQ ID NO: 346216 - DNA, 16 bp, M. musculus
aatggattaaacttct

SEQ ID NO: 346217 - DNA, 16 bp, M. musculus
aatggatttttaaaag

SEQ ID NO: 346218 - DNA, 16 bp, M. musculus
aatggattttttaaaa

SEQ ID NO: 346219 - DNA, 21 bp, M. musculus
aatggcaaaaccccgtccctt

SEQ ID NO: 346220 - DNA, 16 bp, M. musculus
aatggcagacaaagtg

SEQ ID NO: 346221 - DNA, 16 bp, M. musculus
aatggcagatgcattc

SEQ ID NO: 346222 - DNA, 16 bp, M. musculus
aatggcagcactggct

SEQ ID NO: 346223 - DNA, 16 bp, M. musculus
aatggcagggaacaga

SEQ ID NO: 346224 - DNA, 16 bp, M. musculus
aatggccagaaactgg

SEQ ID NO: 346225 - DNA, 16 bp, M. musculus
aatggcctcttctccc

SEQ ID NO: 346226 - DNA, 16 bp, M. musculus
aatggcctgaccttta

SEQ ID NO: 346227 - DNA, 16 bp, M. musculus
aatggcctttttctac

SEQ ID NO: 346228 - DNA, 16 bp, M. musculus
aatggctaagaagcac

SEQ ID NO: 346229 - DNA, 16 bp, M. musculus
aatggctacaccagtt

SEQ ID NO: 346230 - DNA, 16 bp, M. musculus
aatggctacatcagct

SEQ ID NO: 346231 - DNA, 16 bp, M. musculus
aatggctcagtggata

SEQ ID NO: 346232 - DNA, 21 bp, M. musculus
aatggctcagtggttaagagt

SEQ ID NO: 346233 - DNA, 16 bp, M. musculus
aatggctgagaagaac

SEQ ID NO: 346234 - DNA, 16 bp, M. musculus
aatggctgctgcctgg

SEQ ID NO: 346235 - DNA, 16 bp, M. musculus
aatggctgctgctctg

SEQ ID NO: 346236 - DNA, 16 bp, M. musculus
aatggctgttggattt

SEQ ID NO: 346237 - DNA, 16 bp, M. musculus
aatggcttacaggctg

SEQ ID NO: 346238 - DNA, 17 bp, M. musculus
aatggcttatgctctaa

SEQ ID NO: 346239 - DNA, 30 bp, M. musculus
aatggcttccctttggttctggcctgaaag

SEQ ID NO: 346240 - DNA, 16 bp, M. musculus
aatgggaaaacatttg

SEQ ID NO: 346241 - DNA, 16 bp, M. musculus
aatgggaaacaaaatg

SEQ ID NO: 346242 - DNA, 16 bp, M. musculus
aatgggaagaggttat

SEQ ID NO: 346243 - DNA, 20 bp, M. musculus
aatgggaagcttgtcatcaa

SEQ ID NO: 346244 - DNA, 16 bp, M. musculus
aatgggaaggagccag

SEQ ID NO: 346245 - DNA, 16 bp, M. musculus
aatgggacctcatgga

SEQ ID NO: 346246 - DNA, 16 bp, M. musculus
aatgggagctgatgcc

SEQ ID NO: 346247 - DNA, 16 bp, M. musculus
aatgggatccaatgtc

SEQ ID NO: 346248 - DNA, 16 bp, M. musculus
aatgggatccacaggc

SEQ ID NO: 346249 - DNA, 16 bp, M. musculus
aatgggatccggtgcc

SEQ ID NO: 346250 - DNA, 16 bp, M. musculus
aatgggatgtgccctg

SEQ ID NO: 346251 - DNA, 16 bp, M. musculus
aatgggcaactgcttt

SEQ ID NO: 346252 - DNA, 17 bp, M. musculus
aatgggcaatttgcaaa

SEQ ID NO: 346253 - DNA, 16 bp, M. musculus
aatgggcagctcaagc

SEQ ID NO: 346254 - DNA, 19 bp, M. musculus
aatgggcataggtggcaaa

SEQ ID NO: 346255 - DNA, 82 bp, M. musculus
aatgggccattgttgtggatccatccaaacgtatccccagctaaaataatagattggtatcctgatgcaattgcacagcttg

SEQ ID NO: 346256 - DNA, 16 bp, M. musculus
aatgggctgcagccaa

SEQ ID NO: 346257 - DNA, 16 bp, M. musculus
aatggggaaaagcctt

SEQ ID NO: 346258 - DNA, 16 bp, M. musculus
aatggggaatggggaa

SEQ ID NO: 346259 - DNA, 16 bp, M. musculus
aatggggcacagagct

SEQ ID NO: 346260 - DNA, 16 bp, M. musculus
aatggggctcagagca

SEQ ID NO: 346261 - DNA, 16 bp, M. musculus
aatgggggagttggtt

SEQ ID NO: 346262 - DNA, 16 bp, M. musculus
aatgggggatgaggaa

SEQ ID NO: 346263 - DNA, 16 bp, M. musculus
aatgggtggaggagca

SEQ ID NO: 346264 - DNA, 16 bp, M. musculus
aatgggttggagagat

SEQ ID NO: 346265 - DNA, 16 bp, M. musculus
aatgggttttgagaaa

SEQ ID NO: 346266 - DNA, 16 bp, M. musculus
aatggtcatttttact

SEQ ID NO: 346267 - DNA, 16 bp, M. musculus
aatggtctgaagaaaa

SEQ ID NO: 346268 - DNA, 16 bp, M. musculus
aatggtgacacacacc

SEQ ID NO: 346269 - DNA, 17 bp, M. musculus
aatggtgagaaggtgga

SEQ ID NO: 346270 - DNA, 17 bp, M. musculus
aatggtgatgatggtga

SEQ ID NO: 346271 - DNA, 16 bp, M. musculus
aatggtggaaggaaag

SEQ ID NO: 346272 - DNA, 16 bp, M. musculus
aatggtggcacatgcc

SEQ ID NO: 346273 - DNA, 17 bp, M. musculus
aatggtggcatacacct

SEQ ID NO: 346274 - DNA, 16 bp, M. musculus
aatggtgtcactccct

SEQ ID NO: 346275 - DNA, 16 bp, M. musculus
aatggtgtcagctttg

SEQ ID NO: 346276 - DNA, 16 bp, M. musculus
aatggtgtgtgtgtgt

SEQ ID NO: 346277 - DNA, 16 bp, M. musculus
aatggttaagggcact

SEQ ID NO: 346278 - DNA, 16 bp, M. musculus
aatggttcattttctg

SEQ ID NO: 346279 - DNA, 16 bp, M. musculus
aatggttctaatgtgt

SEQ ID NO: 346280 - DNA, 16 bp, M. musculus
aatggttggctgaggt

SEQ ID NO: 346281 - DNA, 16 bp, M. musculus
aatggttgtgagccac

SEQ ID NO: 346282 - DNA, 16 bp, M. musculus
aatggtttcattgtgt

SEQ ID NO: 346283 - DNA, 16 bp, M. musculus
aatggtttcctttata

SEQ ID NO: 346284 - DNA, 16 bp, M. musculus
aatggtttgaagagta

SEQ ID NO: 346285 - DNA, 16 bp, M. musculus
aatggtttttcaagac

SEQ ID NO: 346286 - DNA, 16 bp, M. musculus
aatgtaaacaaaatga

SEQ ID NO: 346287 - DNA, 16 bp, M. musculus
aatgtaaacaaataat

SEQ ID NO: 346288 - DNA, 16 bp, M. musculus
aatgtaaacattttaa

SEQ ID NO: 346289 - DNA, 16 bp, M. musculus
aatgtaaacttgtaca

SEQ ID NO: 346290 - DNA, 16 bp, M. musculus
aatgtaaagttacatt

SEQ ID NO: 346291 - DNA, 16 bp, M. musculus
aatgtaaataaactat

SEQ ID NO: 346292 - DNA, 16 bp, M. musculus
aatgtaaatatctgtt

SEQ ID NO: 346293 - DNA, 16 bp, M. musculus
aatgtaaatatttgat

SEQ ID NO: 346294 - DNA, 16 bp, M. musculus
aatgtaaatgagcaaa

SEQ ID NO: 346295 - DNA, 16 bp, M. musculus
aatgtaaatgtttttg

SEQ ID NO: 346296 - DNA, 16 bp, M. musculus
aatgtaacaattattt

SEQ ID NO: 346297 - DNA, 16 bp, M. musculus
aatgtaagacctgaaa

SEQ ID NO: 346298 - DNA, 16 bp, M. musculus
aatgtaagtggattaa

SEQ ID NO: 346299 - DNA, 16 bp, M. musculus
aatgtaataaaaactt

SEQ ID NO: 346300 - DNA, 16 bp, M. musculus
aatgtaatgaatgtgg

SEQ ID NO: 346301 - DNA, 16 bp, M. musculus
aatgtaattttgaaaa

SEQ ID NO: 346302 - DNA, 18 bp, M. musculus
aatgtacacacacacaca

SEQ ID NO: 346303 - DNA, 16 bp, M. musculus
aatgtacagtcctgag

SEQ ID NO: 346304 - DNA, 16 bp, M. musculus
aatgtacatggttgtt

SEQ ID NO: 346305 - DNA, 16 bp, M. musculus
aatgtacattttaaaa

SEQ ID NO: 346306 - DNA, 16 bp, M. musculus
aatgtaccacatattc

SEQ ID NO: 346307 - DNA, 16 bp, M. musculus
aatgtacttttttatt

SEQ ID NO: 346308 - DNA, 16 bp, M. musculus
aatgtagcaaggaaat

SEQ ID NO: 346309 - DNA, 16 bp, M. musculus
aatgtagcaataaaat

SEQ ID NO: 346310 - DNA, 48 bp, M. musculus
aatgtagccaagacagttactctgatcaaggctcaaattttattgttg

SEQ ID NO: 346311 - DNA, 16 bp, M. musculus
aatgtagctgtctctt

SEQ ID NO: 346312 - DNA, 16 bp, M. musculus
aatgtataaaaataca

SEQ ID NO: 346313 - DNA, 16 bp, M. musculus
aatgtatataatgtat

SEQ ID NO: 346314 - DNA, 16 bp, M. musculus
aatgtatatatgcata

SEQ ID NO: 346315 - DNA, 16 bp, M. musculus
aatgtatatccttttg

SEQ ID NO: 346316 - DNA, 27 bp, M. musculus
aatgtatatgaaggcctctatctcaaa

SEQ ID NO: 346317 - DNA, 16 bp, M. musculus
aatgtatcttgatcat

SEQ ID NO: 346318 - DNA, 16 bp, M. musculus
aatgtatgtttgtatg

SEQ ID NO: 346319 - DNA, 16 bp, M. musculus
aatgtattcatatttt

SEQ ID NO: 346320 - DNA, 16 bp, M. musculus
aatgtattgtgtgtgt

SEQ ID NO: 346321 - DNA, 16 bp, M. musculus
aatgtatttaacagat

SEQ ID NO: 346322 - DNA, 16 bp, M. musculus
aatgtatttacttatt

SEQ ID NO: 346323 - DNA, 16 bp, M. musculus
aatgtatttatgaaat

SEQ ID NO: 346324 - DNA, 16 bp, M. musculus
aatgtatttctttctt

SEQ ID NO: 346325 - DNA, 16 bp, M. musculus
aatgtattttaaaaca

SEQ ID NO: 346326 - DNA, 16 bp, M. musculus
aatgtattttaaaatg

SEQ ID NO: 346327 - DNA, 16 bp, M. musculus
aatgtattttactttt

SEQ ID NO: 346328 - DNA, 16 bp, M. musculus
aatgtattttcatcat

SEQ ID NO: 346329 - DNA, 16 bp, M. musculus
aatgtattttgaaaat

SEQ ID NO: 346330 - DNA, 16 bp, M. musculus
aatgtattttgttcat

SEQ ID NO: 346331 - DNA, 16 bp, M. musculus
aatgtatttttctctt

SEQ ID NO: 346332 - DNA, 16 bp, M. musculus
aatgtatttttctttc

SEQ ID NO: 346333 - DNA, 16 bp, M. musculus
aatgtattttttaaag

SEQ ID NO: 346334 - DNA, 16 bp, M. musculus
aatgtatttttttctg

SEQ ID NO: 346335 - DNA, 16 bp, M. musculus
aatgtattttttttcc

SEQ ID NO: 346336 - DNA, 16 bp, M. musculus
aatgtcaacaaaacag

SEQ ID NO: 346337 - DNA, 16 bp, M. musculus
aatgtcaacttgacac

SEQ ID NO: 346338 - DNA, 16 bp, M. musculus
aatgtcaataaagaaa

SEQ ID NO: 346339 - DNA, 16 bp, M. musculus
aatgtcaatttttttt

SEQ ID NO: 346340 - DNA, 16 bp, M. musculus
aatgtcataaaaataa

SEQ ID NO: 346341 - DNA, 16 bp, M. musculus
aatgtcatcccagttg

SEQ ID NO: 346342 - DNA, 16 bp, M. musculus
aatgtcatccccattg

SEQ ID NO: 346343 - DNA, 16 bp, M. musculus
aatgtccaaagacagt

SEQ ID NO: 346344 - DNA, 21 bp, M. musculus
aatgtccaattttctgaggaa

SEQ ID NO: 346345 - DNA, 16 bp, M. musculus
aatgtcctataggctt

SEQ ID NO: 346346 - DNA, 16 bp, M. musculus
aatgtcctcttctgga

SEQ ID NO: 346347 - DNA, 16 bp, M. musculus
aatgtcctggaactca

SEQ ID NO: 346348 - DNA, 16 bp, M. musculus
aatgtcctgtagatat

SEQ ID NO: 346349 - DNA, 16 bp, M. musculus
aatgtccttcttaaag

SEQ ID NO: 346350 - DNA, 16 bp, M. musculus
aatgtccttgttctta

SEQ ID NO: 346351 - DNA, 16 bp, M. musculus
aatgtccttttaaaaa

SEQ ID NO: 346352 - DNA, 16 bp, M. musculus
aatgtcgatgcaaaaa

SEQ ID NO: 346353 - DNA, 16 bp, M. musculus
aatgtctaataaaata

SEQ ID NO: 346354 - DNA, 16 bp, M. musculus
aatgtctcccacaggc

SEQ ID NO: 346355 - DNA, 16 bp, M. musculus
aatgtctgtgttttcc

SEQ ID NO: 346356 - DNA, 16 bp, M. musculus
aatgtcttctttaaaa

SEQ ID NO: 346357 - DNA, 16 bp, M. musculus
aatgtctttaaatgat

SEQ ID NO: 346358 - DNA, 16 bp, M. musculus
aatgtctttttaaaaa

SEQ ID NO: 346359 - DNA, 16 bp, M. musculus
aatgtgaaatatatat

SEQ ID NO: 346360 - DNA, 16 bp, M. musculus
aatgtgaaatatgtac

SEQ ID NO: 346361 - DNA, 16 bp, M. musculus
aatgtgaaatattttt

SEQ ID NO: 346362 - DNA, 16 bp, M. musculus
aatgtgaattttaaaa

SEQ ID NO: 346363 - DNA, 16 bp, M. musculus
aatgtgagaaagattt

SEQ ID NO: 346364 - DNA, 16 bp, M. musculus
aatgtgaggagaggcc

SEQ ID NO: 346365 - DNA, 17 bp, M. musculus
aatgtgagggcagctcc

SEQ ID NO: 346366 - DNA, 17 bp, M. musculus
aatgtgagggcggctcc

SEQ ID NO: 346367 - DNA, 18 bp, M. musculus
aatgtgagggcggcttcc

SEQ ID NO: 346368 - DNA, 16 bp, M. musculus
aatgtgagtacactgt

SEQ ID NO: 346369 - DNA, 16 bp, M. musculus
aatgtgatgatcatgt

SEQ ID NO: 346370 - DNA, 16 bp, M. musculus
aatgtgatttaaataa

SEQ ID NO: 346371 - DNA, 16 bp, M. musculus
aatgtgcagaaagtga

SEQ ID NO: 346372 - DNA, 16 bp, M. musculus
aatgtgcagagaatga

SEQ ID NO: 346373 - DNA, 16 bp, M. musculus
aatgtgcatttttttt

SEQ ID NO: 346374 - DNA, 16 bp, M. musculus
aatgtgccacattttt

SEQ ID NO: 346375 - DNA, 16 bp, M. musculus
aatgtgcccacagcaa

SEQ ID NO: 346376 - DNA, 16 bp, M. musculus
aatgtgcctgaggtct

SEQ ID NO: 346377 - DNA, 16 bp, M. musculus
aatgtgctgtctccag

SEQ ID NO: 346378 - DNA, 16 bp, M. musculus
aatgtgctttcttttt

SEQ ID NO: 346379 - DNA, 16 bp, M. musculus
aatgtggatttggaaa

SEQ ID NO: 346380 - DNA, 16 bp, M. musculus
aatgtggccctgaggg

SEQ ID NO: 346381 - DNA, 16 bp, M. musculus
aatgtgggaaagcctt

SEQ ID NO: 346382 - DNA, 16 bp, M. musculus
aatgtggtaaagactt

SEQ ID NO: 346383 - DNA, 16 bp, M. musculus
aatgtggtaaagcttt

SEQ ID NO: 346384 - DNA, 16 bp, M. musculus
aatgtggtaaagtctt

SEQ ID NO: 346385 - DNA, 16 bp, M. musculus
aatgtggtaaatgttt

SEQ ID NO: 346386 - DNA, 16 bp, M. musculus
aatgtggtttttaaaa

SEQ ID NO: 346387 - DNA, 16 bp, M. musculus
aatgtgtaatttaaaa

SEQ ID NO: 346388 - DNA, 16 bp, M. musculus
aatgtgtacatatgta

SEQ ID NO: 346389 - DNA, 16 bp, M. musculus
aatgtgtatatatata

SEQ ID NO: 346390 - DNA, 16 bp, M. musculus
aatgtgtatccctttg

SEQ ID NO: 346391 - DNA, 16 bp, M. musculus
aatgtgtatgagtgtt

SEQ ID NO: 346392 - DNA, 16 bp, M. musculus
aatgtgtatgtatata

SEQ ID NO: 346393 - DNA, 16 bp, M. musculus
aatgtgtattttaaaa

SEQ ID NO: 346394 - DNA, 16 bp, M. musculus
aatgtgtatttttaaa

SEQ ID NO: 346395 - DNA, 16 bp, M. musculus
aatgtgtcactgtggg

SEQ ID NO: 346396 - DNA, 16 bp, M. musculus
aatgtgtcattttgaa

SEQ ID NO: 346397 - DNA, 16 bp, M. musculus
aatgtgtgaatgtgtg

SEQ ID NO: 346398 - DNA, 16 bp, M. musculus
aatgtgtgcacatgtg

SEQ ID NO: 346399 - DNA, 16 bp, M. musculus
aatgtgtgtctctgtg

SEQ ID NO: 346400 - DNA, 16 bp, M. musculus
aatgtgtgtgtctgtg

SEQ ID NO: 346401 - DNA, 16 bp, M. musculus
aatgtgtgtgtgtatg

SEQ ID NO: 346402 - DNA, 16 bp, M. musculus
aatgtgtgtgtgtgca

SEQ ID NO: 346403 - DNA, 16 bp, M. musculus
aatgtgtttctgttta

SEQ ID NO: 346404 - DNA, 16 bp, M. musculus
aatgtgtttcttgtat

SEQ ID NO: 346405 - DNA, 16 bp, M. musculus
aatgttaaaaatgttt

SEQ ID NO: 346406 - DNA, 16 bp, M. musculus
aatgttaaatctaaaa

SEQ ID NO: 346407 - DNA, 16 bp, M. musculus
aatgttaattgtatgt

SEQ ID NO: 346408 - DNA, 16 bp, M. musculus
aatgttagaatgttag

SEQ ID NO: 346409 - DNA, 16 bp, M. musculus
aatgttatttattcat

SEQ ID NO: 346410 - DNA, 16 bp, M. musculus
aatgttatttcttgta

SEQ ID NO: 346411 - DNA, 16 bp, M. musculus
aatgttcaaagacctt

SEQ ID NO: 346412 - DNA, 16 bp, M. musculus
aatgttcaaataaaat

SEQ ID NO: 346413 - DNA, 16 bp, M. musculus
aatgttcacagaaaag

SEQ ID NO: 346414 - DNA, 17 bp, M. musculus
aatgttcaccatcctta

SEQ ID NO: 346415 - DNA, 16 bp, M. musculus
aatgttcatagcagcc

SEQ ID NO: 346416 - DNA, 16 bp, M. musculus
aatgttcattgcaata

SEQ ID NO: 346417 - DNA, 16 bp, M. musculus
aatgttccttctattt

SEQ ID NO: 346418 - DNA, 16 bp, M. musculus
aatgttccttttaaaa

SEQ ID NO: 346419 - DNA, 16 bp, M. musculus
aatgttctgtagataa

SEQ ID NO: 346420 - DNA, 16 bp, M. musculus
aatgttcttcataaga

SEQ ID NO: 346421 - DNA, 16 bp, M. musculus
aatgttctttttaaat

SEQ ID NO: 346422 - DNA, 16 bp, M. musculus
aatgttgtccttaaaa

SEQ ID NO: 346423 - DNA, 16 bp, M. musculus
aatgttgtttctatgt

SEQ ID NO: 346424 - DNA, 16 bp, M. musculus
aatgtttaacattctt

SEQ ID NO: 346425 - DNA, 16 bp, M. musculus
aatgtttaatgaaaat

SEQ ID NO: 346426 - DNA, 16 bp, M. musculus
aatgtttacatttatt

SEQ ID NO: 346427 - DNA, 16 bp, M. musculus
aatgtttattttagct

SEQ ID NO: 346428 - DNA, 16 bp, M. musculus
aatgtttctatatatt

SEQ ID NO: 346429 - DNA, 16 bp, M. musculus
aatgtttgttgaataa

SEQ ID NO: 346430 - DNA, 16 bp, M. musculus
aatgtttgttgtagct

SEQ ID NO: 346431 - DNA, 16 bp, M. musculus
aatgttttattcattt

SEQ ID NO: 346432 - DNA, 16 bp, M. musculus
aatgttttccccttcc

SEQ ID NO: 346433 - DNA, 16 bp, M. musculus
aatgttttcctgtaat

SEQ ID NO: 346434 - DNA, 16 bp, M. musculus
aatgttttcctttgta

SEQ ID NO: 346435 - DNA, 16 bp, M. musculus
aatgttttcttttatg

SEQ ID NO: 346436 - DNA, 16 bp, M. musculus
aatgttttgcctgtat

SEQ ID NO: 346437 - DNA, 16 bp, M. musculus
aatgtttttaaaagat

SEQ ID NO: 346438 - DNA, 16 bp, M. musculus
aatgttttttccttct

SEQ ID NO: 346439 - DNA, 16 bp, M. musculus
aattaaaacaactctg

SEQ ID NO: 346440 - DNA, 16 bp, M. musculus
aattaaaacacatttt

SEQ ID NO: 346441 - DNA, 16 bp, M. musculus
aattaaaacattgaaa

SEQ ID NO: 346442 - DNA, 16 bp, M. musculus
aattaaaacatttttc

SEQ ID NO: 346443 - DNA, 16 bp, M. musculus
aattaaaagacataga

SEQ ID NO: 346444 - DNA, 16 bp, M. musculus
aattaaaagcaaaatt

SEQ ID NO: 346445 - DNA, 16 bp, M. musculus
aattaaaagcatgtgt

SEQ ID NO: 346446 - DNA, 16 bp, M. musculus
aattaaaagttttctt

SEQ ID NO: 346447 - DNA, 16 bp, M. musculus
aattaaaatgcaaatg

SEQ ID NO: 346448 - DNA, 16 bp, M. musculus
aattaaacccaagtcc

SEQ ID NO: 346449 - DNA, 16 bp, M. musculus
aattaaagaaaaactt

SEQ ID NO: 346450 - DNA, 16 bp, M. musculus
aattaaagaaaaatct

SEQ ID NO: 346451 - DNA, 16 bp, M. musculus
aattaaagacatgcat

SEQ ID NO: 346452 - DNA, 16 bp, M. musculus
aattaaagacccagaa

SEQ ID NO: 346453 - DNA, 16 bp, M. musculus
aattaaaggcacgtgc

SEQ ID NO: 346454 - DNA, 16 bp, M. musculus
aattaaatattgtctt

SEQ ID NO: 346455 - DNA, 16 bp, M. musculus
aattaaatgatttctt

SEQ ID NO: 346456 - DNA, 16 bp, M. musculus
aattaaatgcattctt

SEQ ID NO: 346457 - DNA, 16 bp, M. musculus
aattaacaaatcagaa

SEQ ID NO: 346458 - DNA, 16 bp, M. musculus
aattaacaattgaata

SEQ ID NO: 346459 - DNA, 16 bp, M. musculus
aattaacattttctta

SEQ ID NO: 346460 - DNA, 16 bp, M. musculus
aattaagaaaaatgcc

SEQ ID NO: 346461 - DNA, 16 bp, M. musculus
aattaagaaaacccaa

SEQ ID NO: 346462 - DNA, 16 bp, M. musculus
aattaagaaaatcaga

SEQ ID NO: 346463 - DNA, 16 bp, M. musculus
aattaagaaaatgcct

SEQ ID NO: 346464 - DNA, 16 bp, M. musculus
aattaagacaaagcat

SEQ ID NO: 346465 - DNA, 16 bp, M. musculus
aattaagacttttgaa

SEQ ID NO: 346466 - DNA, 16 bp, M. musculus
aattaagagcactggc

SEQ ID NO: 346467 - DNA, 16 bp, M. musculus
aattaagattttagct

SEQ ID NO: 346468 - DNA, 16 bp, M. musculus
aattaagcaagtgaaa

SEQ ID NO: 346469 - DNA, 16 bp, M. musculus
aattaagcattacaaa

SEQ ID NO: 346470 - DNA, 16 bp, M. musculus
aattaagtcaaacaag

SEQ ID NO: 346471 - DNA, 16 bp, M. musculus
aattaatagaggagaa

SEQ ID NO: 346472 - DNA, 16 bp, M. musculus
aattaatcctaaagaa

SEQ ID NO: 346473 - DNA, 16 bp, M. musculus
aattaatgaaaacaat

SEQ ID NO: 346474 - DNA, 16 bp, M. musculus
aattaatgcagtttca

SEQ ID NO: 346475 - DNA, 16 bp, M. musculus
aattaatgtaatcaag

SEQ ID NO: 346476 - DNA, 16 bp, M. musculus
aattaattaaagcaag

SEQ ID NO: 346477 - DNA, 16 bp, M. musculus
aattaatttccaaaat

SEQ ID NO: 346478 - DNA, 16 bp, M. musculus
aattacaaaagaattc

SEQ ID NO: 346479 - DNA, 16 bp, M. musculus
aattacaagaacaaat

SEQ ID NO: 346480 - DNA, 16 bp, M. musculus
aattacagagaaaaag

SEQ ID NO: 346481 - DNA, 16 bp, M. musculus
aattacagatgtgcac

SEQ ID NO: 346482 - DNA, 16 bp, M. musculus
aattacagatgtgtgc

SEQ ID NO: 346483 - DNA, 16 bp, M. musculus
aattacatagaatatt

SEQ ID NO: 346484 - DNA, 16 bp, M. musculus
aattacattattttcc

SEQ ID NO: 346485 - DNA, 27 bp, M. musculus
aattaccatctgctcaatgaggctatt

SEQ ID NO: 346486 - DNA, 34 bp, M. musculus
aattaccatctgctcaatgaggctattagccaag

SEQ ID NO: 346487 - DNA, 16 bp, M. musculus
aattactccaacccag

SEQ ID NO: 346488 - DNA, 16 bp, M. musculus
aattacttatttcctg

SEQ ID NO: 346489 - DNA, 16 bp, M. musculus
aattactttcttgttt

SEQ ID NO: 346490 - DNA, 16 bp, M. musculus
aattacttttgttgct

SEQ ID NO: 346491 - DNA, 16 bp, M. musculus
aattactttttaaatg

SEQ ID NO: 346492 - DNA, 16 bp, M. musculus
aattagaaacagcaat

SEQ ID NO: 346493 - DNA, 16 bp, M. musculus
aattagaaacagcaca

SEQ ID NO: 346494 - DNA, 16 bp, M. musculus
aattagaacaacaaat

SEQ ID NO: 346495 - DNA, 16 bp, M. musculus
aattagacattacttt

SEQ ID NO: 346496 - DNA, 16 bp, M. musculus
aattagagaaaagctg

SEQ ID NO: 346497 - DNA, 16 bp, M. musculus
aattagaggccagcct

SEQ ID NO: 346498 - DNA, 16 bp, M. musculus
aattagatattttctt

SEQ ID NO: 346499 - DNA, 16 bp, M. musculus
aattagattcctgcct

SEQ ID NO: 346500 - DNA, 16 bp, M. musculus
aattagcatacaaaat

SEQ ID NO: 346501 - DNA, 16 bp, M. musculus
aattagcatcaaaata

SEQ ID NO: 346502 - DNA, 16 bp, M. musculus
aattagcattttaaaa

SEQ ID NO: 346503 - DNA, 16 bp, M. musculus
aattagccccagggct

SEQ ID NO: 346504 - DNA, 16 bp, M. musculus
aattaggccatctggc

SEQ ID NO: 346505 - DNA, 21 bp, M. musculus
aattaggtatcatcctataaa

SEQ ID NO: 346506 - DNA, 19 bp, M. musculus
aattaggtattttcttcat

SEQ ID NO: 346507 - DNA, 16 bp, M. musculus
aattagtacaaaaaca

SEQ ID NO: 346508 - DNA, 16 bp, M. musculus
aattataaaacacttt

SEQ ID NO: 346509 - DNA, 16 bp, M. musculus
aattatatatgtgtgt

SEQ ID NO: 346510 - DNA, 16 bp, M. musculus
aattatatattcttga

SEQ ID NO: 346511 - DNA, 16 bp, M. musculus
aattatatgttcagtt

SEQ ID NO: 346512 - DNA, 16 bp, M. musculus
aattatatttatgtac

SEQ ID NO: 346513 - DNA, 20 bp, M. musculus
aattatctgaaggggaactg

SEQ ID NO: 346514 - DNA, 16 bp, M. musculus
aattatgaaacaaata

SEQ ID NO: 346515 - DNA, 16 bp, M. musculus
aattatgcctttttta

SEQ ID NO: 346516 - DNA, 27 bp, M. musculus
aattatggagtcagcgctaatttcact

SEQ ID NO: 346517 - DNA, 16 bp, M. musculus
aattatgtatattttc

SEQ ID NO: 346518 - DNA, 16 bp, M. musculus
aattatgtatgtatgt

SEQ ID NO: 346519 - DNA, 16 bp, M. musculus
aattatgtccatccac

SEQ ID NO: 346520 - DNA, 16 bp, M. musculus
aattatgtgtatgcat

SEQ ID NO: 346521 - DNA, 16 bp, M. musculus
aattatgtttatgtga

SEQ ID NO: 346522 - DNA, 66 bp, M. musculus
aattattagacttccttcaccagctcacccaccttagctatcagaagatgagggcacttctagaca

SEQ ID NO: 346523 - DNA, 16 bp, M. musculus
aattattatattggca

SEQ ID NO: 346524 - DNA, 16 bp, M. musculus
aattattccagacttc

SEQ ID NO: 346525 - DNA, 16 bp, M. musculus
aattatttcaaaatgt

SEQ ID NO: 346526 - DNA, 16 bp, M. musculus
aattatttctagaaaa

SEQ ID NO: 346527 - DNA, 16 bp, M. musculus
aattatttctgttgct

SEQ ID NO: 346528 - DNA, 16 bp, M. musculus
aattatttgaagattt

SEQ ID NO: 346529 - DNA, 16 bp, M. musculus
aattattttcagaaaa

SEQ ID NO: 346530 - DNA, 16 bp, M. musculus
aattattttcattgct

SEQ ID NO: 346531 - DNA, 16 bp, M. musculus
aattattttctaaaac

SEQ ID NO: 346532 - DNA, 16 bp, M. musculus
aattattttcttgatt

SEQ ID NO: 346533 - DNA, 16 bp, M. musculus
aattatttttctttga

SEQ ID NO: 346534 - DNA, 16 bp, M. musculus
aattatttttgctcac

SEQ ID NO: 346535 - DNA, 16 bp, M. musculus
aattcaaacacattaa

SEQ ID NO: 346536 - DNA, 16 bp, M. musculus
aattcaaagccagcct

SEQ ID NO: 346537 - DNA, 16 bp, M. musculus
aattcaaagtcatcct

SEQ ID NO: 346538 - DNA, 16 bp, M. musculus
aattcaaagtctttta

SEQ ID NO: 346539 - DNA, 17 bp, M. musculus
aattcaaagtttataaa

SEQ ID NO: 346540 - DNA, 16 bp, M. musculus
aattcaaatgaagaaa

SEQ ID NO: 346541 - DNA, 17 bp, M. musculus
aattcaacaacaggggc

SEQ ID NO: 346542 - DNA, 16 bp, M. musculus
aattcaagaagaaaga

SEQ ID NO: 346543 - DNA, 16 bp, M. musculus
aattcaagaaggaaga

SEQ ID NO: 346544 - DNA, 16 bp, M. musculus
aattcaagaccagcct

SEQ ID NO: 346545 - DNA, 16 bp, M. musculus
aattcaaggccagact

SEQ ID NO: 346546 - DNA, 16 bp, M. musculus
aattcaaggccagcct

SEQ ID NO: 346547 - DNA, 16 bp, M. musculus
aattcaaggccagtct

SEQ ID NO: 346548 - DNA, 16 bp, M. musculus
aattcaaggctagcct

SEQ ID NO: 346549 - DNA, 16 bp, M. musculus
aattcaaggtcatctg

SEQ ID NO: 346550 - DNA, 16 bp, M. musculus
aattcaatgaatatga

SEQ ID NO: 346551 - DNA, 16 bp, M. musculus
aattcaatgctttctt

SEQ ID NO: 346552 - DNA, 16 bp, M. musculus
aattcaatttctcttt

SEQ ID NO: 346553 - DNA, 16 bp, M. musculus
aattcacacaatatgt

SEQ ID NO: 346554 - DNA, 16 bp, M. musculus
aattcacagagatctt

SEQ ID NO: 346555 - DNA, 16 bp, M. musculus
aattcacattcttcta

SEQ ID NO: 346556 - DNA, 16 bp, M. musculus
aattcaccagagaact

SEQ ID NO: 346557 - DNA, 16 bp, M. musculus
aattcacctgtctctg

SEQ ID NO: 346558 - DNA, 16 bp, M. musculus
aattcactgtagctga

SEQ ID NO: 346559 - DNA, 17 bp, M. musculus
aattcagaaatccacct

SEQ ID NO: 346560 - DNA, 17 bp, M. musculus
aattcagaaatctgcct

SEQ ID NO: 346561 - DNA, 16 bp, M. musculus
aattcagaaatggagg

SEQ ID NO: 346562 - DNA, 17 bp, M. musculus
aattcagaacttagatt

SEQ ID NO: 346563 - DNA, 16 bp, M. musculus
aattcagaccacaaga

SEQ ID NO: 346564 - DNA, 16 bp, M. musculus
aattcagagccctgga

SEQ ID NO: 346565 - DNA, 16 bp, M. musculus
aattcagcagggaaaa

SEQ ID NO: 346566 - DNA, 16 bp, M. musculus
aattcagggccagcct

SEQ ID NO: 346567 - DNA, 16 bp, M. musculus
aattcaggtcctcatg

SEQ ID NO: 346568 - DNA, 16 bp, M. musculus
aattcaggtcttcatg

SEQ ID NO: 346569 - DNA, 16 bp, M. musculus
aattcaggttgtcagg

SEQ ID NO: 346570 - DNA, 16 bp, M. musculus
aattcagtgagaagct

SEQ ID NO: 346571 - DNA, 16 bp, M. musculus
aattcagtgccctctt

SEQ ID NO: 346572 - DNA, 16 bp, M. musculus
aattcagttcccaaca

SEQ ID NO: 346573 - DNA, 16 bp, M. musculus
aattcataactagcaa

SEQ ID NO: 346574 - DNA, 16 bp, M. musculus
aattcataccggagaa

SEQ ID NO: 346575 - DNA, 16 bp, M. musculus
aattcatactggagaa

SEQ ID NO: 346576 - DNA, 17 bp, M. musculus
aattcatactggagaag

SEQ ID NO: 346577 - DNA, 16 bp, M. musculus
aattcatagaggagaa

SEQ ID NO: 346578 - DNA, 16 bp, M. musculus
aattcatcaatatgaa

SEQ ID NO: 346579 - DNA, 16 bp, M. musculus
aattcatctggaaaga

SEQ ID NO: 346580 - DNA, 16 bp, M. musculus
aattcatctggaataa

SEQ ID NO: 346581 - DNA, 16 bp, M. musculus
aattcatgatttaaaa

SEQ ID NO: 346582 - DNA, 16 bp, M. musculus
aattcatgttttaaaa

SEQ ID NO: 346583 - DNA, 16 bp, M. musculus
aattcattctgtagac

SEQ ID NO: 346584 - DNA, 16 bp, M. musculus
aattcattgttttaaa

SEQ ID NO: 346585 - DNA, 16 bp, M. musculus
aattcattttgtcaat

SEQ ID NO: 346586 - DNA, 16 bp, M. musculus
aattccaaatcaattc

SEQ ID NO: 346587 - DNA, 16 bp, M. musculus
aattccaactctaaaa

SEQ ID NO: 346588 - DNA, 16 bp, M. musculus
aattccagaccaacct

SEQ ID NO: 346589 - DNA, 16 bp, M. musculus
aattccagcactcaga

SEQ ID NO: 346590 - DNA, 16 bp, M. musculus
aattccagcactctgg

SEQ ID NO: 346591 - DNA, 16 bp, M. musculus
aattccagcactggga

SEQ ID NO: 346592 - DNA, 16 bp, M. musculus
aattccagcagccaca

SEQ ID NO: 346593 - DNA, 16 bp, M. musculus
aattccagcgctcagg

SEQ ID NO: 346594 - DNA, 16 bp, M. musculus
aattccaggaaagcca

SEQ ID NO: 346595 - DNA, 16 bp, M. musculus
aattccaggacagcca

SEQ ID NO: 346596 - DNA, 16 bp, M. musculus
aattccaggagacaga

SEQ ID NO: 346597 - DNA, 16 bp, M. musculus
aattccaggccagcct

SEQ ID NO: 346598 - DNA, 16 bp, M. musculus
aattccagggatgcag

SEQ ID NO: 346599 - DNA, 16 bp, M. musculus
aattccaggtcagcct

SEQ ID NO: 346600 - DNA, 16 bp, M. musculus
aattccagtacttgga

SEQ ID NO: 346601 - DNA, 16 bp, M. musculus
aattccattacagatg

SEQ ID NO: 346602 - DNA, 16 bp, M. musculus
aattccatttgtttca

SEQ ID NO: 346603 - DNA, 16 bp, M. musculus
aattcccaagatataa

SEQ ID NO: 346604 - DNA, 16 bp, M. musculus
aattcccagcaccaaa

SEQ ID NO: 346605 - DNA, 16 bp, M. musculus
aattcccagcacctaa

SEQ ID NO: 346606 - DNA, 16 bp, M. musculus
aattcccctgcctcag

SEQ ID NO: 346607 - DNA, 16 bp, M. musculus
aattcccctgtctctg

SEQ ID NO: 346608 - DNA, 16 bp, M. musculus
aattcctactgattat

SEQ ID NO: 346609 - DNA, 16 bp, M. musculus
aattcctctcatcaca

SEQ ID NO: 346610 - DNA, 16 bp, M. musculus
aattcctgaatagaat

SEQ ID NO: 346611 - DNA, 16 bp, M. musculus
aattcctgaccctctg

SEQ ID NO: 346612 - DNA, 16 bp, M. musculus
aattcctgatcctctg

SEQ ID NO: 346613 - DNA, 16 bp, M. musculus
aattcctgggacccac

SEQ ID NO: 346614 - DNA, 16 bp, M. musculus
aattcctgggctcaag

SEQ ID NO: 346615 - DNA, 16 bp, M. musculus
aattccttctatgaag

SEQ ID NO: 346616 - DNA, 16 bp, M. musculus
aattccttctcctgtt

SEQ ID NO: 346617 - DNA, 16 bp, M. musculus
aattcctttttaaaaa

SEQ ID NO: 346618 - DNA, 20 bp, M. musculus
aattctaaacaggcatttgt

SEQ ID NO: 346619 - DNA, 16 bp, M. musculus
aattctaacacttggg

SEQ ID NO: 346620 - DNA, 16 bp, M. musculus
aattctaatttacatt

SEQ ID NO: 346621 - DNA, 16 bp, M. musculus
aattctacatactaaa

SEQ ID NO: 346622 - DNA, 16 bp, M. musculus
aattctaccagatatt

SEQ ID NO: 346623 - DNA, 16 bp, M. musculus
aattctagaaagtatt

SEQ ID NO: 346624 - DNA, 16 bp, M. musculus
aattctagaaattctt

SEQ ID NO: 346625 - DNA, 16 bp, M. musculus
aattctagcactggag

SEQ ID NO: 346626 - DNA, 16 bp, M. musculus
aattctaggacagcca

SEQ ID NO: 346627 - DNA, 16 bp, M. musculus
aattctagttccaggg

SEQ ID NO: 346628 - DNA, 16 bp, M. musculus
aattctagttttaaaa

SEQ ID NO: 346629 - DNA, 16 bp, M. musculus
aattctatcagacttt

SEQ ID NO: 346630 - DNA, 16 bp, M. musculus
aattctatcagatttt

SEQ ID NO: 346631 - DNA, 16 bp, M. musculus
aattctatctcctggg

SEQ ID NO: 346632 - DNA, 16 bp, M. musculus
aattctatgttctatc

SEQ ID NO: 346633 - DNA, 16 bp, M. musculus
aattctattcccagca

SEQ ID NO: 346634 - DNA, 16 bp, M. musculus
aattctattccttcat

SEQ ID NO: 346635 - DNA, 16 bp, M. musculus
aattctcaaaagaaaa

SEQ ID NO: 346636 - DNA, 16 bp, M. musculus
aattctcaaaagatga

SEQ ID NO: 346637 - DNA, 16 bp, M. musculus
aattctcaaagccagc

SEQ ID NO: 346638 - DNA, 17 bp, M. musculus
aattctcaactgaggaa

SEQ ID NO: 346639 - DNA, 16 bp, M. musculus
aattctcaagaataaa

SEQ ID NO: 346640 - DNA, 16 bp, M. musculus
aattctcaaggacaag

SEQ ID NO: 346641 - DNA, 16 bp, M. musculus
aattctcacatttaca

SEQ ID NO: 346642 - DNA, 16 bp, M. musculus
aattctcacccaagga

SEQ ID NO: 346643 - DNA, 16 bp, M. musculus
aattctcacctgtgga

SEQ ID NO: 346644 - DNA, 16 bp, M. musculus
aattctcattctctct

SEQ ID NO: 346645 - DNA, 16 bp, M. musculus
aattctcctgcctttg

SEQ ID NO: 346646 - DNA, 16 bp, M. musculus
aattctctctctgtgt

SEQ ID NO: 346647 - DNA, 16 bp, M. musculus
aattctctgagctccc

SEQ ID NO: 346648 - DNA, 16 bp, M. musculus
aattctctgcaatttt

SEQ ID NO: 346649 - DNA, 16 bp, M. musculus
aattctcttgtctctg

SEQ ID NO: 346650 - DNA, 16 bp, M. musculus
aattctcttttaaaat

SEQ ID NO: 346651 - DNA, 16 bp, M. musculus
aattctgatagttctg

SEQ ID NO: 346652 - DNA, 16 bp, M. musculus
aattctgctttcccag

SEQ ID NO: 346653 - DNA, 16 bp, M. musculus
aattctggaaactttt

SEQ ID NO: 346654 - DNA, 16 bp, M. musculus
aattctggatcaaaaa

SEQ ID NO: 346655 - DNA, 16 bp, M. musculus
aattctggattaaaat

SEQ ID NO: 346656 - DNA, 16 bp, M. musculus
aattctgggattaaag

SEQ ID NO: 346657 - DNA, 16 bp, M. musculus
aattctgggtcagaga

SEQ ID NO: 346658 - DNA, 16 bp, M. musculus
aattctgtacaataaa

SEQ ID NO: 346659 - DNA, 16 bp, M. musculus
aattctgtctctgcct

SEQ ID NO: 346660 - DNA, 16 bp, M. musculus
aattctgtgactcagt

SEQ ID NO: 346661 - DNA, 16 bp, M. musculus
aattctgtttatctct

SEQ ID NO: 346662 - DNA, 16 bp, M. musculus
aattctgtttttaatt

SEQ ID NO: 346663 - DNA, 16 bp, M. musculus
aattcttaaaagaaaa

SEQ ID NO: 346664 - DNA, 16 bp, M. musculus
aattcttaaaatgtat

SEQ ID NO: 346665 - DNA, 16 bp, M. musculus
aattcttataaagaaa

SEQ ID NO: 346666 - DNA, 16 bp, M. musculus
aattcttatgcaaatg

SEQ ID NO: 346667 - DNA, 16 bp, M. musculus
aattcttcacagagtt

SEQ ID NO: 346668 - DNA, 16 bp, M. musculus
aattcttcctctctca

SEQ ID NO: 346669 - DNA, 16 bp, M. musculus
aattcttgctagaata

SEQ ID NO: 346670 - DNA, 16 bp, M. musculus
aattcttggtttattt

SEQ ID NO: 346671 - DNA, 16 bp, M. musculus
aattctttaagggact

SEQ ID NO: 346672 - DNA, 16 bp, M. musculus
aattctttatttagct

SEQ ID NO: 346673 - DNA, 16 bp, M. musculus
aattctttccaaacag

SEQ ID NO: 346674 - DNA, 16 bp, M. musculus
aattctttccccaact

SEQ ID NO: 346675 - DNA, 17 bp, M. musculus
aattctttgagaatttt

SEQ ID NO: 346676 - DNA, 16 bp, M. musculus
aattctttgcatatta

SEQ ID NO: 346677 - DNA, 16 bp, M. musculus
aattctttgggaattt

SEQ ID NO: 346678 - DNA, 16 bp, M. musculus
aattctttgtgtgtgt

SEQ ID NO: 346679 - DNA, 16 bp, M. musculus
aattctttgtttcctt

SEQ ID NO: 346680 - DNA, 16 bp, M. musculus
aattctttgtttttaa

SEQ ID NO: 346681 - DNA, 16 bp, M. musculus
aattcttttattgttg

SEQ ID NO: 346682 - DNA, 16 bp, M. musculus
aattcttttcaaaata

SEQ ID NO: 346683 - DNA, 16 bp, M. musculus
aattgaaaagcttcta

SEQ ID NO: 346684 - DNA, 16 bp, M. musculus
aattgaaaagcttttg

SEQ ID NO: 346685 - DNA, 16 bp, M. musculus
aattgaaaatctcaaa

SEQ ID NO: 346686 - DNA, 16 bp, M. musculus
aattgaaaatttggct

SEQ ID NO: 346687 - DNA, 16 bp, M. musculus
aattgaaattttggct

SEQ ID NO: 346688 - DNA, 16 bp, M. musculus
aattgaacaaaaccat

SEQ ID NO: 346689 - DNA, 16 bp, M. musculus
aattgaacccagagcc

SEQ ID NO: 346690 - DNA, 16 bp, M. musculus
aattgaacccagggct

SEQ ID NO: 346691 - DNA, 16 bp, M. musculus
aattgaactcaggaca

SEQ ID NO: 346692 - DNA, 16 bp, M. musculus
aattgaactcaggact

SEQ ID NO: 346693 - DNA, 16 bp, M. musculus
aattgaacttttaaaa

SEQ ID NO: 346694 - DNA, 16 bp, M. musculus
aattgaagaagatacc

SEQ ID NO: 346695 - DNA, 16 bp, M. musculus
aattgaagacccagaa

SEQ ID NO: 346696 - DNA, 16 bp, M. musculus
aattgaagacccagca

SEQ ID NO: 346697 - DNA, 16 bp, M. musculus
aattgaagagaaagtg

SEQ ID NO: 346698 - DNA, 16 bp, M. musculus
aattgaataaaatcat

SEQ ID NO: 346699 - DNA, 31 bp, M. musculus
aattgacaaacctgcagctacttttctggga

SEQ ID NO: 346700 - DNA, 16 bp, M. musculus
aattgacaaattggac

SEQ ID NO: 346701 - DNA, 16 bp, M. musculus
aattgactaatgagct

SEQ ID NO: 346702 - DNA, 16 bp, M. musculus
aattgacttaattttc

SEQ ID NO: 346703 - DNA, 16 bp, M. musculus
aattgacttaattttt

SEQ ID NO: 346704 - DNA, 16 bp, M. musculus
aattgagaaaatatct

SEQ ID NO: 346705 - DNA, 16 bp, M. musculus
aattgagaaaatgcct

SEQ ID NO: 346706 - DNA, 16 bp, M. musculus
aattgagaaaatgtca

SEQ ID NO: 346707 - DNA, 16 bp, M. musculus
aattgagaaaatgtct

SEQ ID NO: 346708 - DNA, 16 bp, M. musculus
aattgagaaaattcct

SEQ ID NO: 346709 - DNA, 16 bp, M. musculus
aattgagactgctgct

SEQ ID NO: 346710 - DNA, 16 bp, M. musculus
aattgagataatattt

SEQ ID NO: 346711 - DNA, 16 bp, M. musculus
aattgagatttttctc

SEQ ID NO: 346712 - DNA, 16 bp, M. musculus
aattgagctatatttt

SEQ ID NO: 346713 - DNA, 16 bp, M. musculus
aattgaggaagacact

SEQ ID NO: 346714 - DNA, 16 bp, M. musculus
aattgagttacctcac

SEQ ID NO: 346715 - DNA, 16 bp, M. musculus
aattgatattttgact

SEQ ID NO: 346716 - DNA, 16 bp, M. musculus
aattgatccattctga

SEQ ID NO: 346717 - DNA, 18 bp, M. musculus
aattgatgctggttagct

SEQ ID NO: 346718 - DNA, 16 bp, M. musculus
aattgattctgttggt

SEQ ID NO: 346719 - DNA, 16 bp, M. musculus
aattgatttaaaagat

SEQ ID NO: 346720 - DNA, 16 bp, M. musculus
aattgatttttttcat

SEQ ID NO: 346721 - DNA, 16 bp, M. musculus
aattgcaaatagcttc

SEQ ID NO: 346722 - DNA, 16 bp, M. musculus
aattgcaatgtaaata

SEQ ID NO: 346723 - DNA, 16 bp, M. musculus
aattgcagctatgaag

SEQ ID NO: 346724 - DNA, 16 bp, M. musculus
aattgccagcacccac

SEQ ID NO: 346725 - DNA, 16 bp, M. musculus
aattgcctccatcaga

SEQ ID NO: 346726 - DNA, 16 bp, M. musculus
aattgcctgcctctgc

SEQ ID NO: 346727 - DNA, 16 bp, M. musculus
aattgcctttctctac

SEQ ID NO: 346728 - DNA, 16 bp, M. musculus
aattgctctgggtaat

SEQ ID NO: 346729 - DNA, 16 bp, M. musculus
aattgctgaaggaaga

SEQ ID NO: 346730 - DNA, 16 bp, M. musculus
aattgctgggtggaag

SEQ ID NO: 346731 - DNA, 16 bp, M. musculus
aattgctttatttatt

SEQ ID NO: 346732 - DNA, 16 bp, M. musculus
aattgctttgacaaag

SEQ ID NO: 346733 - DNA, 16 bp, M. musculus
aattgcttttccttaa

SEQ ID NO: 346734 - DNA, 16 bp, M. musculus
aattggaaaggaagat

SEQ ID NO: 346735 - DNA, 16 bp, M. musculus
aattggaaaggaagga

SEQ ID NO: 346736 - DNA, 16 bp, M. musculus
aattggaaagggagaa

SEQ ID NO: 346737 - DNA, 16 bp, M. musculus
aattggaaattgatct

SEQ ID NO: 346738 - DNA, 44 bp, M. musculus
aattggaaggctcaccagtgacccttatctggaggcttggagat

SEQ ID NO: 346739 - DNA, 16 bp, M. musculus
aattggaattttgata

SEQ ID NO: 346740 - DNA, 16 bp, M. musculus
aattggacaggaagaa

SEQ ID NO: 346741 - DNA, 16 bp, M. musculus
aattggactgcagact

SEQ ID NO: 346742 - DNA, 16 bp, M. musculus
aattggagaagagact

SEQ ID NO: 346743 - DNA, 16 bp, M. musculus
aattggagagagagag

SEQ ID NO: 346744 - DNA, 16 bp, M. musculus
aattggatgacaacag

SEQ ID NO: 346745 - DNA, 16 bp, M. musculus
aattggcactgtaact

SEQ ID NO: 346746 - DNA, 16 bp, M. musculus
aattggcatctgagtt

SEQ ID NO: 346747 - DNA, 16 bp, M. musculus
aattggctgtagccac

SEQ ID NO: 346748 - DNA, 16 bp, M. musculus
aattggctgtagccat

SEQ ID NO: 346749 - DNA, 16 bp, M. musculus
aattgggaccaaaaca

SEQ ID NO: 346750 - DNA, 16 bp, M. musculus
aattgggtaatgttcc

SEQ ID NO: 346751 - DNA, 16 bp, M. musculus
aattgggtattttctt

SEQ ID NO: 346752 - DNA, 16 bp, M. musculus
aattggtctgaagatc

SEQ ID NO: 346753 - DNA, 16 bp, M. musculus
aattggtggaactgtt

SEQ ID NO: 346754 - DNA, 16 bp, M. musculus
aattggtgtagccaat

SEQ ID NO: 346755 - DNA, 16 bp, M. musculus
aattggtgttctgttc

SEQ ID NO: 346756 - DNA, 16 bp, M. musculus
aattggttatccaata

SEQ ID NO: 346757 - DNA, 16 bp, M. musculus
aattggttatctaata

SEQ ID NO: 346758 - DNA, 16 bp, M. musculus
aattggttattacaga

SEQ ID NO: 346759 - DNA, 16 bp, M. musculus
aattggttctttcctt

SEQ ID NO: 346760 - DNA, 16 bp, M. musculus
aattgtaaaatctaaa

SEQ ID NO: 346761 - DNA, 16 bp, M. musculus
aattgtaatgtaaata

SEQ ID NO: 346762 - DNA, 16 bp, M. musculus
aattgtaccagagaac

SEQ ID NO: 346763 - DNA, 16 bp, M. musculus
aattgtaggatagaat

SEQ ID NO: 346764 - DNA, 16 bp, M. musculus
aattgtagttttcttt

SEQ ID NO: 346765 - DNA, 16 bp, M. musculus
aattgtatctgagata

SEQ ID NO: 346766 - DNA, 16 bp, M. musculus
aattgtatcttgggta

SEQ ID NO: 346767 - DNA, 16 bp, M. musculus
aattgtattggaattt

SEQ ID NO: 346768 - DNA, 16 bp, M. musculus
aattgtccatatgtct

SEQ ID NO: 346769 - DNA, 16 bp, M. musculus
aattgtctgaagaaac

SEQ ID NO: 346770 - DNA, 16 bp, M. musculus
aattgtgagttcatct

SEQ ID NO: 346771 - DNA, 17 bp, M. musculus
aattgtgcattctgtaa

SEQ ID NO: 346772 - DNA, 16 bp, M. musculus
aattgtgtccattgat

SEQ ID NO: 346773 - DNA, 16 bp, M. musculus
aattgtgtcctttctt

SEQ ID NO: 346774 - DNA, 16 bp, M. musculus
aattgtgtctgggttt

SEQ ID NO: 346775 - DNA, 16 bp, M. musculus
aattgtgttggatttt

SEQ ID NO: 346776 - DNA, 16 bp, M. musculus
aattgttcttattttg

SEQ ID NO: 346777 - DNA, 16 bp, M. musculus
aattgttgaaaattct

SEQ ID NO: 346778 - DNA, 16 bp, M. musculus
aattgttgattttcct

SEQ ID NO: 346779 - DNA, 16 bp, M. musculus
aattgttggctgtgag

SEQ ID NO: 346780 - DNA, 16 bp, M. musculus
aattgtttctcacctt

SEQ ID NO: 346781 - DNA, 17 bp, M. musculus
aattgtttctcttgaag

SEQ ID NO: 346782 - DNA, 16 bp, M. musculus
aattgttttccaaagt

SEQ ID NO: 346783 - DNA, 16 bp, M. musculus
aattgttttcctttat

SEQ ID NO: 346784 - DNA, 16 bp, M. musculus
aattgttttgatgtgt

SEQ ID NO: 346785 - DNA, 16 bp, M. musculus
aattgtttttaaaagc

SEQ ID NO: 346786 - DNA, 16 bp, M. musculus
aatttaaaaagccaaa

SEQ ID NO: 346787 - DNA, 16 bp, M. musculus
aatttaaaaatgcttt

SEQ ID NO: 346788 - DNA, 16 bp, M. musculus
aatttaaaagtacacc

SEQ ID NO: 346789 - DNA, 16 bp, M. musculus
aatttaaaagtcaaaa

SEQ ID NO: 346790 - DNA, 16 bp, M. musculus
aatttaaaatacagaa

SEQ ID NO: 346791 - DNA, 16 bp, M. musculus
aatttaaaatgttctt

SEQ ID NO: 346792 - DNA, 16 bp, M. musculus
aatttaaaggaggaaa

SEQ ID NO: 346793 - DNA, 16 bp, M. musculus
aatttaaatgaaacat

SEQ ID NO: 346794 - DNA, 16 bp, M. musculus
aatttaaatgaacaaa

SEQ ID NO: 346795 - DNA, 16 bp, M. musculus
aatttaattttgatga

SEQ ID NO: 346796 - DNA, 16 bp, M. musculus
aatttacagattcaat

SEQ ID NO: 346797 - DNA, 16 bp, M. musculus
aatttacagtggttta

SEQ ID NO: 346798 - DNA, 16 bp, M. musculus
aatttacatttccagt

SEQ ID NO: 346799 - DNA, 16 bp, M. musculus
aatttacttacttact

SEQ ID NO: 346800 - DNA, 16 bp, M. musculus
aatttagcatttattt

SEQ ID NO: 346801 - DNA, 16 bp, M. musculus
aatttataaaggcatt

SEQ ID NO: 346802 - DNA, 16 bp, M. musculus
aatttataaagtacaa

SEQ ID NO: 346803 - DNA, 16 bp, M. musculus
aatttatatctatgaa

SEQ ID NO: 346804 - DNA, 16 bp, M. musculus
aatttatatctcctaa

SEQ ID NO: 346805 - DNA, 16 bp, M. musculus
aatttatgaaatacct

SEQ ID NO: 346806 - DNA, 17 bp, M. musculus
aatttatgaaatttcta

SEQ ID NO: 346807 - DNA, 16 bp, M. musculus
aatttatgtccttctt

SEQ ID NO: 346808 - DNA, 16 bp, M. musculus
aatttatgtgtatata

SEQ ID NO: 346809 - DNA, 16 bp, M. musculus
aatttattttctgagt

SEQ ID NO: 346810 - DNA, 16 bp, M. musculus
aatttatttttgattc

SEQ ID NO: 346811 - DNA, 16 bp, M. musculus
aatttcaaaagagatt

SEQ ID NO: 346812 - DNA, 16 bp, M. musculus
aatttcaaaatgaaga

SEQ ID NO: 346813 - DNA, 16 bp, M. musculus
aatttcaaagaaagaa

SEQ ID NO: 346814 - DNA, 16 bp, M. musculus
aatttcaaatacattt

SEQ ID NO: 346815 - DNA, 16 bp, M. musculus
aatttcaagaagaaaa

SEQ ID NO: 346816 - DNA, 16 bp, M. musculus
aatttcaagaattcat

SEQ ID NO: 346817 - DNA, 16 bp, M. musculus
aatttcaattgagaat

SEQ ID NO: 346818 - DNA, 16 bp, M. musculus
aatttcacaaaccaaa

SEQ ID NO: 346819 - DNA, 16 bp, M. musculus
aatttcacatcataca

SEQ ID NO: 346820 - DNA, 16 bp, M. musculus
aatttcagaaaagaaa

SEQ ID NO: 346821 - DNA, 16 bp, M. musculus
aatttcagaaagaaaa

SEQ ID NO: 346822 - DNA, 16 bp, M. musculus
aatttcagaacatttt

SEQ ID NO: 346823 - DNA, 16 bp, M. musculus
aatttcagaagagact

SEQ ID NO: 346824 - DNA, 16 bp, M. musculus
aatttcagaggctgaa

SEQ ID NO: 346825 - DNA, 16 bp, M. musculus
aatttcagcatcctta

SEQ ID NO: 346826 - DNA, 16 bp, M. musculus
aatttcaggaaaaaaa

SEQ ID NO: 346827 - DNA, 16 bp, M. musculus
aatttcagtgactctg

SEQ ID NO: 346828 - DNA, 16 bp, M. musculus
aatttcagtgctcaga

SEQ ID NO: 346829 - DNA, 16 bp, M. musculus
aatttcataaaatcat

SEQ ID NO: 346830 - DNA, 16 bp, M. musculus
aatttcatatcatgta

SEQ ID NO: 346831 - DNA, 16 bp, M. musculus
aatttcatcatcagac

SEQ ID NO: 346832 - DNA, 16 bp, M. musculus
aatttcatgaaataat

SEQ ID NO: 346833 - DNA, 16 bp, M. musculus
aatttcatgaacagaa

SEQ ID NO: 346834 - DNA, 16 bp, M. musculus
aatttcatgcatgtat

SEQ ID NO: 346835 - DNA, 16 bp, M. musculus
aatttcatgtcatttt

SEQ ID NO: 346836 - DNA, 16 bp, M. musculus
aatttcattcttctat

SEQ ID NO: 346837 - DNA, 16 bp, M. musculus
aatttcatttttcaaa

SEQ ID NO: 346838 - DNA, 16 bp, M. musculus
aatttccaaatatttt

SEQ ID NO: 346839 - DNA, 16 bp, M. musculus
aatttccacttcagat

SEQ ID NO: 346840 - DNA, 16 bp, M. musculus
aatttccagaaaaaaa

SEQ ID NO: 346841 - DNA, 22 bp, M. musculus
aatttccatcccagacccccat

SEQ ID NO: 346842 - DNA, 16 bp, M. musculus
aatttcccttatgtat

SEQ ID NO: 346843 - DNA, 16 bp, M. musculus
aatttcctcaaagata

SEQ ID NO: 346844 - DNA, 16 bp, M. musculus
aatttcctcagattct

SEQ ID NO: 346845 - DNA, 16 bp, M. musculus
aatttcctgaaaagaa

SEQ ID NO: 346846 - DNA, 16 bp, M. musculus
aatttccttggtgtct

SEQ ID NO: 346847 - DNA, 16 bp, M. musculus
aatttcctttaaaaat

SEQ ID NO: 346848 - DNA, 16 bp, M. musculus
aatttcctttatgaat

SEQ ID NO: 346849 - DNA, 16 bp, M. musculus
aatttcctttcataga

SEQ ID NO: 346850 - DNA, 16 bp, M. musculus
aatttctagacagaca

SEQ ID NO: 346851 - DNA, 16 bp, M. musculus
aatttctattgccccc

SEQ ID NO: 346852 - DNA, 16 bp, M. musculus
aatttctgaaactgta

SEQ ID NO: 346853 - DNA, 16 bp, M. musculus
aatttctgagtacttt

SEQ ID NO: 346854 - DNA, 16 bp, M. musculus
aatttctggaaaaaaa

SEQ ID NO: 346855 - DNA, 16 bp, M. musculus
aatttctggagtacag

SEQ ID NO: 346856 - DNA, 17 bp, M. musculus
aatttctggtggaatca

SEQ ID NO: 346857 - DNA, 16 bp, M. musculus
aatttctggtttcttt

SEQ ID NO: 346858 - DNA, 16 bp, M. musculus
aatttctgttattttg

SEQ ID NO: 346859 - DNA, 16 bp, M. musculus
aatttctgttttaaat

SEQ ID NO: 346860 - DNA, 17 bp, M. musculus
aatttcttagctccagc

SEQ ID NO: 346861 - DNA, 16 bp, M. musculus
aatttcttattagata

SEQ ID NO: 346862 - DNA, 16 bp, M. musculus
aatttcttgtcatata

SEQ ID NO: 346863 - DNA, 16 bp, M. musculus
aatttctttcttctga

SEQ ID NO: 346864 - DNA, 16 bp, M. musculus
aatttgaaaacaaatg

SEQ ID NO: 346865 - DNA, 16 bp, M. musculus
aatttgaaaagcaaaa

SEQ ID NO: 346866 - DNA, 16 bp, M. musculus
aatttgaaaattgctt

SEQ ID NO: 346867 - DNA, 16 bp, M. musculus
aatttgaaaggaagaa

SEQ ID NO: 346868 - DNA, 16 bp, M. musculus
aatttgaacagaagtg

SEQ ID NO: 346869 - DNA, 16 bp, M. musculus
aatttgaagacaaatg

SEQ ID NO: 346870 - DNA, 16 bp, M. musculus
aatttgaagctagcct

SEQ ID NO: 346871 - DNA, 16 bp, M. musculus
aatttgaaggagaaca

SEQ ID NO: 346872 - DNA, 16 bp, M. musculus
aatttgaatttgaaat

SEQ ID NO: 346873 - DNA, 16 bp, M. musculus
aatttgaattttcagt

SEQ ID NO: 346874 - DNA, 16 bp, M. musculus
aatttgagaattaata

SEQ ID NO: 346875 - DNA, 16 bp, M. musculus
aatttgagatcctcct

SEQ ID NO: 346876 - DNA, 16 bp, M. musculus
aatttgagcagaagtg

SEQ ID NO: 346877 - DNA, 16 bp, M. musculus
aatttgaggaggaaag

SEQ ID NO: 346878 - DNA, 16 bp, M. musculus
aatttgaggccaacct

SEQ ID NO: 346879 - DNA, 16 bp, M. musculus
aatttgaggctagcct

SEQ ID NO: 346880 - DNA, 16 bp, M. musculus
aatttgaggtcatcct

SEQ ID NO: 346881 - DNA, 16 bp, M. musculus
aatttgagtaaaattt

SEQ ID NO: 346882 - DNA, 16 bp, M. musculus
aatttgatccccagca

SEQ ID NO: 346883 - DNA, 16 bp, M. musculus
aatttgatgccctctt

SEQ ID NO: 346884 - DNA, 16 bp, M. musculus
aatttgatggagattt

SEQ ID NO: 346885 - DNA, 16 bp, M. musculus
aatttgatgttgacta

SEQ ID NO: 346886 - DNA, 16 bp, M. musculus
aatttgatttgcattt

SEQ ID NO: 346887 - DNA, 16 bp, M. musculus
aatttgattttgaaaa

SEQ ID NO: 346888 - DNA, 16 bp, M. musculus
aatttgcaaatttttc

SEQ ID NO: 346889 - DNA, 18 bp, M. musculus
aatttgcaactgaatgga

SEQ ID NO: 346890 - DNA, 16 bp, M. musculus
aatttgcatatatata

SEQ ID NO: 346891 - DNA, 38 bp, M. musculus
aatttgcatgggatagagatatgctgcttgatcaaggt

SEQ ID NO: 346892 - DNA, 16 bp, M. musculus
aatttgcatttaaaat

SEQ ID NO: 346893 - DNA, 16 bp, M. musculus
aatttgcattttaaaa

SEQ ID NO: 346894 - DNA, 16 bp, M. musculus
aatttgcatttttatt

SEQ ID NO: 346895 - DNA, 16 bp, M. musculus
aatttgccttcctcct

SEQ ID NO: 346896 - DNA, 16 bp, M. musculus
aatttgccttggtcat

SEQ ID NO: 346897 - DNA, 16 bp, M. musculus
aatttgctactgttgt

SEQ ID NO: 346898 - DNA, 16 bp, M. musculus
aatttgcttacttttt

SEQ ID NO: 346899 - DNA, 16 bp, M. musculus
aatttgcttcctcttt

SEQ ID NO: 346900 - DNA, 16 bp, M. musculus
aatttgcttccttctg

SEQ ID NO: 346901 - DNA, 17 bp, M. musculus
aatttgctttcagttgg

SEQ ID NO: 346902 - DNA, 16 bp, M. musculus
aatttggaaaacacaa

SEQ ID NO: 346903 - DNA, 16 bp, M. musculus
aatttggactttttct

SEQ ID NO: 346904 - DNA, 16 bp, M. musculus
aatttggagaaggtac

SEQ ID NO: 346905 - DNA, 16 bp, M. musculus
aatttggtattttaaa

SEQ ID NO: 346906 - DNA, 16 bp, M. musculus
aatttggtatttttag

SEQ ID NO: 346907 - DNA, 16 bp, M. musculus
aatttgtaaaacaaaa

SEQ ID NO: 346908 - DNA, 16 bp, M. musculus
aatttgtaaaactcat

SEQ ID NO: 346909 - DNA, 16 bp, M. musculus
aatttgtaaactttat

SEQ ID NO: 346910 - DNA, 16 bp, M. musculus
aatttgtacattttat

SEQ ID NO: 346911 - DNA, 16 bp, M. musculus
aatttgtatcaattat

SEQ ID NO: 346912 - DNA, 16 bp, M. musculus
aatttgtatctccttg

SEQ ID NO: 346913 - DNA, 16 bp, M. musculus
aatttgtatttccttg

SEQ ID NO: 346914 - DNA, 16 bp, M. musculus
aatttgtcagcatcct

SEQ ID NO: 346915 - DNA, 16 bp, M. musculus
aatttgtcattttctt

SEQ ID NO: 346916 - DNA, 16 bp, M. musculus
aatttgtcctattggc

SEQ ID NO: 346917 - DNA, 16 bp, M. musculus
aatttgtgcatttcat

SEQ ID NO: 346918 - DNA, 16 bp, M. musculus
aatttgtgtcttggtt

SEQ ID NO: 346919 - DNA, 16 bp, M. musculus
aatttgtgtgtgtgtg

SEQ ID NO: 346920 - DNA, 16 bp, M. musculus
aatttgttcaactttt

SEQ ID NO: 346921 - DNA, 16 bp, M. musculus
aatttgttctttgata

SEQ ID NO: 346922 - DNA, 16 bp, M. musculus
aatttgttgttgctgt

SEQ ID NO: 346923 - DNA, 16 bp, M. musculus
aattttaaaaagagag

SEQ ID NO: 346924 - DNA, 16 bp, M. musculus
aattttaaaaagcact

SEQ ID NO: 346925 - DNA, 16 bp, M. musculus
aattttaaaaagtaac

SEQ ID NO: 346926 - DNA, 16 bp, M. musculus
aattttaaaaagtgag

SEQ ID NO: 346927 - DNA, 16 bp, M. musculus
aattttaaaaagtgat

SEQ ID NO: 346928 - DNA, 16 bp, M. musculus
aattttaaaaggcaaa

SEQ ID NO: 346929 - DNA, 16 bp, M. musculus
aattttaaaagtacaa

SEQ ID NO: 346930 - DNA, 16 bp, M. musculus
aattttaaaagtagtt

SEQ ID NO: 346931 - DNA, 16 bp, M. musculus
aattttaaaatatgca

SEQ ID NO: 346932 - DNA, 16 bp, M. musculus
aattttaaaatgttct

SEQ ID NO: 346933 - DNA, 16 bp, M. musculus
aattttaaagcaaaat

SEQ ID NO: 346934 - DNA, 16 bp, M. musculus
aattttaagaattctt

SEQ ID NO: 346935 - DNA, 16 bp, M. musculus
aattttaagaggaaaa

SEQ ID NO: 346936 - DNA, 16 bp, M. musculus
aattttacacatgtat

SEQ ID NO: 346937 - DNA, 16 bp, M. musculus
aattttaccaaggaca

SEQ ID NO: 346938 - DNA, 16 bp, M. musculus
aattttagtcattttc

SEQ ID NO: 346939 - DNA, 16 bp, M. musculus
aattttagtgagattg

SEQ ID NO: 346940 - DNA, 16 bp, M. musculus
aattttataaagaact

SEQ ID NO: 346941 - DNA, 16 bp, M. musculus
aattttatagttggag

SEQ ID NO: 346942 - DNA, 16 bp, M. musculus
aattttatatcaactt

SEQ ID NO: 346943 - DNA, 16 bp, M. musculus
aattttatctgaaaaa

SEQ ID NO: 346944 - DNA, 16 bp, M. musculus
aattttatgaaaatga

SEQ ID NO: 346945 - DNA, 16 bp, M. musculus
aattttattgaaagga

SEQ ID NO: 346946 - DNA, 16 bp, M. musculus
aattttattggaatgg

SEQ ID NO: 346947 - DNA, 16 bp, M. musculus
aattttatttcaaatg

SEQ ID NO: 346948 - DNA, 16 bp, M. musculus
aattttattttccaaa

SEQ ID NO: 346949 - DNA, 16 bp, M. musculus
aattttcaaaagagga

SEQ ID NO: 346950 - DNA, 16 bp, M. musculus
aattttcacttaaaaa

SEQ ID NO: 346951 - DNA, 16 bp, M. musculus
aattttccacaaggcc

SEQ ID NO: 346952 - DNA, 16 bp, M. musculus
aattttcctgtttctt

SEQ ID NO: 346953 - DNA, 16 bp, M. musculus
aattttcctttggaaa

SEQ ID NO: 346954 - DNA, 16 bp, M. musculus
aattttctaaatgttt

SEQ ID NO: 346955 - DNA, 16 bp, M. musculus
aattttctagatacat

SEQ ID NO: 346956 - DNA, 16 bp, M. musculus
aattttctccaaaatt

SEQ ID NO: 346957 - DNA, 16 bp, M. musculus
aattttctgaaaagaa

SEQ ID NO: 346958 - DNA, 16 bp, M. musculus
aattttctgaagaaac

SEQ ID NO: 346959 - DNA, 16 bp, M. musculus
aattttctgaagaata

SEQ ID NO: 346960 - DNA, 16 bp, M. musculus
aattttctgaggaact

SEQ ID NO: 346961 - DNA, 16 bp, M. musculus
aattttctgaggagcc

SEQ ID NO: 346962 - DNA, 16 bp, M. musculus
aattttctgaggcacc

SEQ ID NO: 346963 - DNA, 16 bp, M. musculus
aattttcttctgtttg

SEQ ID NO: 346964 - DNA, 16 bp, M. musculus
aattttcttttgaaaa

SEQ ID NO: 346965 - DNA, 16 bp, M. musculus
aattttgaagaatttt

SEQ ID NO: 346966 - DNA, 16 bp, M. musculus
aattttgacatatttt

SEQ ID NO: 346967 - DNA, 16 bp, M. musculus
aattttgacccagaat

SEQ ID NO: 346968 - DNA, 16 bp, M. musculus
aattttgactttaaaa

SEQ ID NO: 346969 - DNA, 16 bp, M. musculus
aattttgatatgcctt

SEQ ID NO: 346970 - DNA, 16 bp, M. musculus
aattttgatattttct

SEQ ID NO: 346971 - DNA, 16 bp, M. musculus
aattttgatgaagatt

SEQ ID NO: 346972 - DNA, 16 bp, M. musculus
aattttgcaattgttt

SEQ ID NO: 346973 - DNA, 16 bp, M. musculus
aattttgcattaatga

SEQ ID NO: 346974 - DNA, 16 bp, M. musculus
aattttgctactatta

SEQ ID NO: 346975 - DNA, 16 bp, M. musculus
aattttgctactgtga

SEQ ID NO: 346976 - DNA, 16 bp, M. musculus
aattttgcttttccag

SEQ ID NO: 346977 - DNA, 16 bp, M. musculus
aattttgcttttgaaa

SEQ ID NO: 346978 - DNA, 26 bp, M. musculus
aattttgcttttgcctagtcaccatg

SEQ ID NO: 346979 - DNA, 16 bp, M. musculus
aattttggagaatgtc

SEQ ID NO: 346980 - DNA, 16 bp, M. musculus
aattttggagttttgg

SEQ ID NO: 346981 - DNA, 33 bp, M. musculus
aattttgggacctgaggaaagtgagggtctgtt

SEQ ID NO: 346982 - DNA, 16 bp, M. musculus
aattttgtgattattg

SEQ ID NO: 346983 - DNA, 16 bp, M. musculus
aattttgttaaggaaa

SEQ ID NO: 346984 - DNA, 16 bp, M. musculus
aattttgttactttta

SEQ ID NO: 346985 - DNA, 16 bp, M. musculus
aattttgttctttaaa

SEQ ID NO: 346986 - DNA, 16 bp, M. musculus
aattttgtttttacat

SEQ ID NO: 346987 - DNA, 16 bp, M. musculus
aatttttaaaaacctt

SEQ ID NO: 346988 - DNA, 16 bp, M. musculus
aatttttaaaaagttg

SEQ ID NO: 346989 - DNA, 16 bp, M. musculus
aatttttaaaactgaa

SEQ ID NO: 346990 - DNA, 16 bp, M. musculus
aatttttaaaagactt

SEQ ID NO: 346991 - DNA, 16 bp, M. musculus
aatttttaaagacttt

SEQ ID NO: 346992 - DNA, 16 bp, M. musculus
aatttttaaatgtaca

SEQ ID NO: 346993 - DNA, 16 bp, M. musculus
aatttttaagtttctt

SEQ ID NO: 346994 - DNA, 16 bp, M. musculus
aatttttaccctgtgc

SEQ ID NO: 346995 - DNA, 16 bp, M. musculus
aatttttagggtcatt

SEQ ID NO: 346996 - DNA, 16 bp, M. musculus
aatttttagggttact

SEQ ID NO: 346997 - DNA, 18 bp, M. musculus
aatttttaggttcactta

SEQ ID NO: 346998 - DNA, 16 bp, M. musculus
aatttttatcaaccta

SEQ ID NO: 346999 - DNA, 16 bp, M. musculus
aatttttatcacaatt

SEQ ID NO: 347000 - DNA, 16 bp, M. musculus
aatttttattgtctct

SEQ ID NO: 347001 - DNA, 16 bp, M. musculus
aatttttatttcctca

SEQ ID NO: 347002 - DNA, 16 bp, M. musculus
aatttttcaaagaaaa

SEQ ID NO: 347003 - DNA, 16 bp, M. musculus
aatttttcacaaaaca

SEQ ID NO: 347004 - DNA, 16 bp, M. musculus
aatttttcatgtttct

SEQ ID NO: 347005 - DNA, 16 bp, M. musculus
aatttttcatttgtat

SEQ ID NO: 347006 - DNA, 16 bp, M. musculus
aatttttctaagtcag

SEQ ID NO: 347007 - DNA, 16 bp, M. musculus
aatttttcttacatga

SEQ ID NO: 347008 - DNA, 16 bp, M. musculus
aatttttgaagcaaat

SEQ ID NO: 347009 - DNA, 16 bp, M. musculus
aatttttgcattttta

SEQ ID NO: 347010 - DNA, 16 bp, M. musculus
aatttttgcttccttt

SEQ ID NO: 347011 - DNA, 16 bp, M. musculus
aattttttaaaagcta

SEQ ID NO: 347012 - DNA, 16 bp, M. musculus
aattttttaaagtgtg

SEQ ID NO: 347013 - DNA, 16 bp, M. musculus
aattttttaaatgtca

SEQ ID NO: 347014 - DNA, 16 bp, M. musculus
aattttttctctgtaa

SEQ ID NO: 347015 - DNA, 16 bp, M. musculus
aattttttttcagcct

SEQ ID NO: 347016 - DNA, 16 bp, M. musculus
aattttttttccagcc

SEQ ID NO: 347017 - DNA, 16 bp, M. musculus
aattttttttctagaa

SEQ ID NO: 347018 - DNA, 16 bp, M. musculus
acaaaaaaagattttt

SEQ ID NO: 347019 - DNA, 16 bp, M. musculus
acaaaaaagaatttta

SEQ ID NO: 347020 - DNA, 16 bp, M. musculus
acaaaaaagatttttt

SEQ ID NO: 347021 - DNA, 16 bp, M. musculus
acaaaaaagcccaggg

SEQ ID NO: 347022 - DNA, 16 bp, M. musculus
acaaaaaatggaagag

SEQ ID NO: 347023 - DNA, 16 bp, M. musculus
acaaaaacatttattt

SEQ ID NO: 347024 - DNA, 16 bp, M. musculus
acaaaaactgcatggt

SEQ ID NO: 347025 - DNA, 16 bp, M. musculus
acaaaaagaaatattc

SEQ ID NO: 347026 - DNA, 16 bp, M. musculus
acaaaaaggccattga

SEQ ID NO: 347027 - DNA, 16 bp, M. musculus
acaaaaaggcccccaa

SEQ ID NO: 347028 - DNA, 16 bp, M. musculus
acaaaaataaatgtat

SEQ ID NO: 347029 - DNA, 16 bp, M. musculus
acaaaaatatgaacta

SEQ ID NO: 347030 - DNA, 16 bp, M. musculus
acaaaaatcaaatgat

SEQ ID NO: 347031 - DNA, 16 bp, M. musculus
acaaaaatcatttggc

SEQ ID NO: 347032 - DNA, 16 bp, M. musculus
acaaaaatgtgaatgt

SEQ ID NO: 347033 - DNA, 16 bp, M. musculus
acaaaaattctcaact

SEQ ID NO: 347034 - DNA, 16 bp, M. musculus
acaaaacaaaattgta

SEQ ID NO: 347035 - DNA, 16 bp, M. musculus
acaaaacaaaatttct

SEQ ID NO: 347036 - DNA, 16 bp, M. musculus
acaaaacaaagaattt

SEQ ID NO: 347037 - DNA, 16 bp, M. musculus
acaaaacaagccaggc

SEQ ID NO: 347038 - DNA, 16 bp, M. musculus
acaaaacacccataga

SEQ ID NO: 347039 - DNA, 16 bp, M. musculus
acaaaacacccatgaa

SEQ ID NO: 347040 - DNA, 16 bp, M. musculus
acaaaacagtctttat

SEQ ID NO: 347041 - DNA, 16 bp, M. musculus
acaaaacatttacatt

SEQ ID NO: 347042 - DNA, 16 bp, M. musculus
acaaaaccagaagctg

SEQ ID NO: 347043 - DNA, 16 bp, M. musculus
acaaaacccttcagct

SEQ ID NO: 347044 - DNA, 16 bp, M. musculus
acaaaaccttccaaga

SEQ ID NO: 347045 - DNA, 16 bp, M. musculus
acaaaactcaagaaga

SEQ ID NO: 347046 - DNA, 16 bp, M. musculus
acaaaactgaagaacc

SEQ ID NO: 347047 - DNA, 16 bp, M. musculus
acaaaactggaaaaac

SEQ ID NO: 347048 - DNA, 16 bp, M. musculus
acaaaagaaaacattt

SEQ ID NO: 347049 - DNA, 16 bp, M. musculus
acaaaagaaaatttta

SEQ ID NO: 347050 - DNA, 16 bp, M. musculus
acaaaagaatacacat

SEQ ID NO: 347051 - DNA, 16 bp, M. musculus
acaaaagaatgtttat

SEQ ID NO: 347052 - DNA, 16 bp, M. musculus
acaaaagaattttaaa

SEQ ID NO: 347053 - DNA, 16 bp, M. musculus
acaaaagacagagcca

SEQ ID NO: 347054 - DNA, 16 bp, M. musculus
acaaaagaccttttcc

SEQ ID NO: 347055 - DNA, 16 bp, M. musculus
acaaaagagtatacat

SEQ ID NO: 347056 - DNA, 16 bp, M. musculus
acaaaagatttttttt

SEQ ID NO: 347057 - DNA, 16 bp, M. musculus
acaaaagcaaatattt

SEQ ID NO: 347058 - DNA, 16 bp, M. musculus
acaaaagcaagcaagc

SEQ ID NO: 347059 - DNA, 16 bp, M. musculus
acaaaagcttccttct

SEQ ID NO: 347060 - DNA, 16 bp, M. musculus
acaaaaggaaacattt

SEQ ID NO: 347061 - DNA, 16 bp, M. musculus
acaaaaggagatgaaa

SEQ ID NO: 347062 - DNA, 16 bp, M. musculus
acaaaaggatacacct

SEQ ID NO: 347063 - DNA, 16 bp, M. musculus
acaaaagggtcctgga

SEQ ID NO: 347064 - DNA, 16 bp, M. musculus
acaaaagtatacacac

SEQ ID NO: 347065 - DNA, 16 bp, M. musculus
acaaaagtattgaaat

SEQ ID NO: 347066 - DNA, 16 bp, M. musculus
acaaaagtttccagga

SEQ ID NO: 347067 - DNA, 16 bp, M. musculus
acaaaataagaacagt

SEQ ID NO: 347068 - DNA, 16 bp, M. musculus
acaaaataatcagaac

SEQ ID NO: 347069 - DNA, 16 bp, M. musculus
acaaaataattacagg

SEQ ID NO: 347070 - DNA, 16 bp, M. musculus
acaaaatacacatgat

SEQ ID NO: 347071 - DNA, 16 bp, M. musculus
acaaaatagaaactga

SEQ ID NO: 347072 - DNA, 16 bp, M. musculus
acaaaatagtcacagg

SEQ ID NO: 347073 - DNA, 16 bp, M. musculus
acaaaatattttgttt

SEQ ID NO: 347074 - DNA, 16 bp, M. musculus
acaaaatcagccagta

SEQ ID NO: 347075 - DNA, 17 bp, M. musculus
acaaaatcaggaatgaa

SEQ ID NO: 347076 - DNA, 16 bp, M. musculus
acaaaatcatagagga

SEQ ID NO: 347077 - DNA, 16 bp, M. musculus
acaaaatcccagcatg

SEQ ID NO: 347078 - DNA, 16 bp, M. musculus
acaaaatcgacttcca

SEQ ID NO: 347079 - DNA, 16 bp, M. musculus
acaaaatctgtatata

SEQ ID NO: 347080 - DNA, 16 bp, M. musculus
acaaaatcttagaaat

SEQ ID NO: 347081 - DNA, 16 bp, M. musculus
acaaaatgaacagcat

SEQ ID NO: 347082 - DNA, 16 bp, M. musculus
acaaaatgatttaaaa

SEQ ID NO: 347083 - DNA, 16 bp, M. musculus
acaaaatgccaacttt

SEQ ID NO: 347084 - DNA, 16 bp, M. musculus
acaaaatggaatttta

SEQ ID NO: 347085 - DNA, 16 bp, M. musculus
acaaaatggagtttct

SEQ ID NO: 347086 - DNA, 16 bp, M. musculus
acaaaatgtctggatt

SEQ ID NO: 347087 - DNA, 16 bp, M. musculus
acaaaatgtttatttt

SEQ ID NO: 347088 - DNA, 16 bp, M. musculus
acaaaattacagttat

SEQ ID NO: 347089 - DNA, 16 bp, M. musculus
acaaaatttaagatta

SEQ ID NO: 347090 - DNA, 16 bp, M. musculus
acaaaatttgaaataa

SEQ ID NO: 347091 - DNA, 16 bp, M. musculus
acaaacaaaaaaggct

SEQ ID NO: 347092 - DNA, 16 bp, M. musculus
acaaacaaaaatgttt

SEQ ID NO: 347093 - DNA, 16 bp, M. musculus
acaaacaaaaatttct

SEQ ID NO: 347094 - DNA, 16 bp, M. musculus
acaaacaaaaccagtg

SEQ ID NO: 347095 - DNA, 16 bp, M. musculus
acaaacaaacaaggct

SEQ ID NO: 347096 - DNA, 16 bp, M. musculus
acaaacaaacacatgg

SEQ ID NO: 347097 - DNA, 16 bp, M. musculus
acaaacaaacctgaaa

SEQ ID NO: 347098 - DNA, 16 bp, M. musculus
acaaacaagcaagtaa

SEQ ID NO: 347099 - DNA, 16 bp, M. musculus
acaaacaatgaattta

SEQ ID NO: 347100 - DNA, 16 bp, M. musculus
acaaacacacatgaac

SEQ ID NO: 347101 - DNA, 16 bp, M. musculus
acaaacacacccagag

SEQ ID NO: 347102 - DNA, 16 bp, M. musculus
acaaacacatgaacat

SEQ ID NO: 347103 - DNA, 16 bp, M. musculus
acaaacaccagcccag

SEQ ID NO: 347104 - DNA, 16 bp, M. musculus
acaaacacctggcagt

SEQ ID NO: 347105 - DNA, 16 bp, M. musculus
acaaacactatctcag

SEQ ID NO: 347106 - DNA, 16 bp, M. musculus
acaaacacttcacaga

SEQ ID NO: 347107 - DNA, 16 bp, M. musculus
acaaacagaatacaag

SEQ ID NO: 347108 - DNA, 16 bp, M. musculus
acaaacagacaggaca

SEQ ID NO: 347109 - DNA, 16 bp, M. musculus
acaaacagcagcagca

SEQ ID NO: 347110 - DNA, 16 bp, M. musculus
acaaacagcagtgact

SEQ ID NO: 347111 - DNA, 16 bp, M. musculus
acaaacagtggaagga

SEQ ID NO: 347112 - DNA, 16 bp, M. musculus
acaaacatatatacat

SEQ ID NO: 347113 - DNA, 16 bp, M. musculus
acaaacatatgcacat

SEQ ID NO: 347114 - DNA, 16 bp, M. musculus
acaaacatgcatacat

SEQ ID NO: 347115 - DNA, 16 bp, M. musculus
acaaacatggagaaga

SEQ ID NO: 347116 - DNA, 16 bp, M. musculus
acaaacattttaaagc

SEQ ID NO: 347117 - DNA, 16 bp, M. musculus
acaaaccacatgatca

SEQ ID NO: 347118 - DNA, 16 bp, M. musculus
acaaaccagaagaggg

SEQ ID NO: 347119 - DNA, 16 bp, M. musculus
acaaaccatcacactg

SEQ ID NO: 347120 - DNA, 16 bp, M. musculus
acaaaccatcacatac

SEQ ID NO: 347121 - DNA, 16 bp, M. musculus
acaaaccatcacatct

SEQ ID NO: 347122 - DNA, 16 bp, M. musculus
acaaaccatcacattt

SEQ ID NO: 347123 - DNA, 16 bp, M. musculus
acaaacccatccagga

SEQ ID NO: 347124 - DNA, 16 bp, M. musculus
acaaacctgcacccca

SEQ ID NO: 347125 - DNA, 16 bp, M. musculus
acaaaccttaaagaag

SEQ ID NO: 347126 - DNA, 29 bp, M. musculus
acaaactaccattggggagcttatgccca

SEQ ID NO: 347127 - DNA, 16 bp, M. musculus
acaaactagaaaggaa

SEQ ID NO: 347128 - DNA, 16 bp, M. musculus
acaaactcaaagaaag

SEQ ID NO: 347129 - DNA, 16 bp, M. musculus
acaaactgaaaagaag

SEQ ID NO: 347130 - DNA, 16 bp, M. musculus
acaaactggaaagaaa

SEQ ID NO: 347131 - DNA, 16 bp, M. musculus
acaaagaaaacattta

SEQ ID NO: 347132 - DNA, 17 bp, M. musculus
acaaagaaaccctgtct

SEQ ID NO: 347133 - DNA, 16 bp, M. musculus
acaaagaaagcctgtc

SEQ ID NO: 347134 - DNA, 16 bp, M. musculus
acaaagaaattgaaga

SEQ ID NO: 347135 - DNA, 16 bp, M. musculus
acaaagaactcacatg

SEQ ID NO: 347136 - DNA, 16 bp, M. musculus
acaaagaactgaagaa

SEQ ID NO: 347137 - DNA, 16 bp, M. musculus
acaaagaagtcaagaa

SEQ ID NO: 347138 - DNA, 16 bp, M. musculus
acaaagaataatagat

SEQ ID NO: 347139 - DNA, 16 bp, M. musculus
acaaagacacagagag

SEQ ID NO: 347140 - DNA, 16 bp, M. musculus
acaaagacatcatgaa

SEQ ID NO: 347141 - DNA, 16 bp, M. musculus
acaaagacatttttaa

SEQ ID NO: 347142 - DNA, 16 bp, M. musculus
acaaagacccaaatga

SEQ ID NO: 347143 - DNA, 16 bp, M. musculus
acaaagacctaatcca

SEQ ID NO: 347144 - DNA, 16 bp, M. musculus
acaaagacttctcacc

SEQ ID NO: 347145 - DNA, 16 bp, M. musculus
acaaagagacacagag

SEQ ID NO: 347146 - DNA, 16 bp, M. musculus
acaaagagagttccag

SEQ ID NO: 347147 - DNA, 16 bp, M. musculus
acaaagaggagataga

SEQ ID NO: 347148 - DNA, 16 bp, M. musculus
acaaagaggctatgtt

SEQ ID NO: 347149 - DNA, 16 bp, M. musculus
acaaagagttcaaagg

SEQ ID NO: 347150 - DNA, 16 bp, M. musculus
acaaagataaagaatt

SEQ ID NO: 347151 - DNA, 16 bp, M. musculus
acaaagatcatggatg

SEQ ID NO: 347152 - DNA, 16 bp, M. musculus
acaaagatccaagaaa

SEQ ID NO: 347153 - DNA, 16 bp, M. musculus
acaaagatgaatatat

SEQ ID NO: 347154 - DNA, 16 bp, M. musculus
acaaagatgccaaaaa

SEQ ID NO: 347155 - DNA, 16 bp, M. musculus
acaaagatggaatata

SEQ ID NO: 347156 - DNA, 16 bp, M. musculus
acaaagattatacaag

SEQ ID NO: 347157 - DNA, 16 bp, M. musculus
acaaagattcccagct

SEQ ID NO: 347158 - DNA, 16 bp, M. musculus
acaaagattggagctg

SEQ ID NO: 347159 - DNA, 16 bp, M. musculus
acaaagatttctcacc

SEQ ID NO: 347160 - DNA, 16 bp, M. musculus
acaaagcaaagctaaa

SEQ ID NO: 347161 - DNA, 16 bp, M. musculus
acaaagcaagttctag

SEQ ID NO: 347162 - DNA, 16 bp, M. musculus
acaaagcacattgaac

SEQ ID NO: 347163 - DNA, 16 bp, M. musculus
acaaagcagagagagc

SEQ ID NO: 347164 - DNA, 16 bp, M. musculus
acaaagcccaagtcca

SEQ ID NO: 347165 - DNA, 16 bp, M. musculus
acaaagctcaactcca

SEQ ID NO: 347166 - DNA, 16 bp, M. musculus
acaaagctcaagttca

SEQ ID NO: 347167 - DNA, 16 bp, M. musculus
acaaagctgaagtcca

SEQ ID NO: 347168 - DNA, 16 bp, M. musculus
acaaagctgcttccgt

SEQ ID NO: 347169 - DNA, 16 bp, M. musculus
acaaagctggcaaagg

SEQ ID NO: 347170 - DNA, 16 bp, M. musculus
acaaagctttctacaa

SEQ ID NO: 347171 - DNA, 16 bp, M. musculus
acaaaggaactcaaat

SEQ ID NO: 347172 - DNA, 16 bp, M. musculus
acaaaggaagagaact

SEQ ID NO: 347173 - DNA, 16 bp, M. musculus
acaaaggactcaagaa

SEQ ID NO: 347174 - DNA, 16 bp, M. musculus
acaaaggatagtagat

SEQ ID NO: 347175 - DNA, 16 bp, M. musculus
acaaaggcaaacattt

SEQ ID NO: 347176 - DNA, 16 bp, M. musculus
acaaaggcagacagat

SEQ ID NO: 347177 - DNA, 16 bp, M. musculus
acaaagggacccagag

SEQ ID NO: 347178 - DNA, 16 bp, M. musculus
acaaagggcctctctt

SEQ ID NO: 347179 - DNA, 16 bp, M. musculus
acaaaggtgccaagag

SEQ ID NO: 347180 - DNA, 16 bp, M. musculus
acaaagtactacctga

SEQ ID NO: 347181 - DNA, 16 bp, M. musculus
acaaagtattttttaa

SEQ ID NO: 347182 - DNA, 16 bp, M. musculus
acaaagtgaattccaa

SEQ ID NO: 347183 - DNA, 16 bp, M. musculus
acaaagtgagctccaa

SEQ ID NO: 347184 - DNA, 17 bp, M. musculus
acaaagtgtggagcaga

SEQ ID NO: 347185 - DNA, 16 bp, M. musculus
acaaagttccaggaca

SEQ ID NO: 347186 - DNA, 19 bp, M. musculus
acaaagtttgcagctgaga

SEQ ID NO: 347187 - DNA, 16 bp, M. musculus
acaaagtttggagctg

SEQ ID NO: 347188 - DNA, 16 bp, M. musculus
acaaataaatactttt

SEQ ID NO: 347189 - DNA, 16 bp, M. musculus
acaaataaatgactta

SEQ ID NO: 347190 - DNA, 16 bp, M. musculus
acaaataaatgtcaaa

SEQ ID NO: 347191 - DNA, 16 bp, M. musculus
acaaataagtaaatgt

SEQ ID NO: 347192 - DNA, 16 bp, M. musculus
acaaatacagaaaccc

SEQ ID NO: 347193 - DNA, 16 bp, M. musculus
acaaataccaaagtgt

SEQ ID NO: 347194 - DNA, 16 bp, M. musculus
acaaatagcttcttgg

SEQ ID NO: 347195 - DNA, 16 bp, M. musculus
acaaataggcaaccta

SEQ ID NO: 347196 - DNA, 16 bp, M. musculus
acaaatatatgtaaat

SEQ ID NO: 347197 - DNA, 16 bp, M. musculus
acaaatatatgtatat

SEQ ID NO: 347198 - DNA, 16 bp, M. musculus
acaaatatttacaatg

SEQ ID NO: 347199 - DNA, 16 bp, M. musculus
acaaatatttatagaa

SEQ ID NO: 347200 - DNA, 16 bp, M. musculus
acaaatatttgttgaa

SEQ ID NO: 347201 - DNA, 16 bp, M. musculus
acaaatcagtgacctt

SEQ ID NO: 347202 - DNA, 16 bp, M. musculus
acaaatccaaaagaag

SEQ ID NO: 347203 - DNA, 16 bp, M. musculus
acaaatccagcccttc

SEQ ID NO: 347204 - DNA, 16 bp, M. musculus
acaaatcccttcagct

SEQ ID NO: 347205 - DNA, 16 bp, M. musculus
acaaatgaatttgaat

SEQ ID NO: 347206 - DNA, 16 bp, M. musculus
acaaatgacaaatgaa

SEQ ID NO: 347207 - DNA, 16 bp, M. musculus
acaaatgacaaatggg

SEQ ID NO: 347208 - DNA, 16 bp, M. musculus
acaaatgcaagtaaaa

SEQ ID NO: 347209 - DNA, 16 bp, M. musculus
acaaatgcagatactt

SEQ ID NO: 347210 - DNA, 16 bp, M. musculus
acaaatggaacctaat

SEQ ID NO: 347211 - DNA, 16 bp, M. musculus
acaaatggatgtatct

SEQ ID NO: 347212 - DNA, 16 bp, M. musculus
acaaatggccaataaa

SEQ ID NO: 347213 - DNA, 16 bp, M. musculus
acaaatgtcagtccag

SEQ ID NO: 347214 - DNA, 16 bp, M. musculus
acaaatgtttaaaaat

SEQ ID NO: 347215 - DNA, 16 bp, M. musculus
acaaattaaggtttga

SEQ ID NO: 347216 - DNA, 16 bp, M. musculus
acaaattcattatttt

SEQ ID NO: 347217 - DNA, 16 bp, M. musculus
acaaattgaaaatgaa

SEQ ID NO: 347218 - DNA, 16 bp, M. musculus
acaaattgacaaccta

SEQ ID NO: 347219 - DNA, 16 bp, M. musculus
acaaattgcaaaggaa

SEQ ID NO: 347220 - DNA, 16 bp, M. musculus
acaaattgggaaagaa

SEQ ID NO: 347221 - DNA, 16 bp, M. musculus
acaaattgtaaaggaa

SEQ ID NO: 347222 - DNA, 16 bp, M. musculus
acaaattgtaatgtaa

SEQ ID NO: 347223 - DNA, 16 bp, M. musculus
acaaattgtagagaca

SEQ ID NO: 347224 - DNA, 16 bp, M. musculus
acaaatttcagagctg

SEQ ID NO: 347225 - DNA, 16 bp, M. musculus
acaaatttgaaaagaa

SEQ ID NO: 347226 - DNA, 16 bp, M. musculus
acaaatttgatttctg

SEQ ID NO: 347227 - DNA, 16 bp, M. musculus
acaaattttgaatttt

SEQ ID NO: 347228 - DNA, 16 bp, M. musculus
acaacaaaccctgaag

SEQ ID NO: 347229 - DNA, 16 bp, M. musculus
acaacaaattacattt

SEQ ID NO: 347230 - DNA, 16 bp, M. musculus
acaacaaattccctta

SEQ ID NO: 347231 - DNA, 16 bp, M. musculus
acaacaacaaaacttg

SEQ ID NO: 347232 - DNA, 16 bp, M. musculus
acaacaacaaaagatt

SEQ ID NO: 347233 - DNA, 16 bp, M. musculus
acaacaacaaaagtgt

SEQ ID NO: 347234 - DNA, 22 bp, M. musculus
acaacaacagcagcagcagcaa

SEQ ID NO: 347235 - DNA, 16 bp, M. musculus
acaacaacttcttctt

SEQ ID NO: 347236 - DNA, 16 bp, M. musculus
acaacaagcctacaga

SEQ ID NO: 347237 - DNA, 16 bp, M. musculus
acaacaatcaatgaaa

SEQ ID NO: 347238 - DNA, 16 bp, M. musculus
acaacaatggcctgtg

SEQ ID NO: 347239 - DNA, 16 bp, M. musculus
acaacacacctgaaag

SEQ ID NO: 347240 - DNA, 16 bp, M. musculus
acaacacagagagaga

SEQ ID NO: 347241 - DNA, 16 bp, M. musculus
acaacacatatacagc

SEQ ID NO: 347242 - DNA, 16 bp, M. musculus
acaacacccagaggaa

SEQ ID NO: 347243 - DNA, 16 bp, M. musculus
acaacacgaggaactg

SEQ ID NO: 347244 - DNA, 16 bp, M. musculus
acaacacgaggagctg

SEQ ID NO: 347245 - DNA, 16 bp, M. musculus
acaacactcaggaggc

SEQ ID NO: 347246 - DNA, 16 bp, M. musculus
acaacactggctgctc

SEQ ID NO: 347247 - DNA, 16 bp, M. musculus
acaacagaaacagcag

SEQ ID NO: 347248 - DNA, 16 bp, M. musculus
acaacagaaatgtatt

SEQ ID NO: 347249 - DNA, 16 bp, M. musculus
acaacagaagaatgga

SEQ ID NO: 347250 - DNA, 16 bp, M. musculus
acaacagaggaatctt

SEQ ID NO: 347251 - DNA, 16 bp, M. musculus
acaacagatccttaag

SEQ ID NO: 347252 - DNA, 16 bp, M. musculus
acaacagcaacaataa

SEQ ID NO: 347253 - DNA, 16 bp, M. musculus
acaacagcaataacaa

SEQ ID NO: 347254 - DNA, 16 bp, M. musculus
acaacagcctccaaaa

SEQ ID NO: 347255 - DNA, 16 bp, M. musculus
acaacagccttctcaa

SEQ ID NO: 347256 - DNA, 16 bp, M. musculus
acaacagctacagtgt

SEQ ID NO: 347257 - DNA, 16 bp, M. musculus
acaacagcttctcttc

SEQ ID NO: 347258 - DNA, 16 bp, M. musculus
acaacagggctcagct

SEQ ID NO: 347259 - DNA, 17 bp, M. musculus
acaacagtcaagcttgc

SEQ ID NO: 347260 - DNA, 16 bp, M. musculus
acaacagtgactgtga

SEQ ID NO: 347261 - DNA, 16 bp, M. musculus
acaacatctattccaa

SEQ ID NO: 347262 - DNA, 17 bp, M. musculus
acaacatggcatcagca

SEQ ID NO: 347263 - DNA, 16 bp, M. musculus
acaacattattacaga

SEQ ID NO: 347264 - DNA, 16 bp, M. musculus
acaacatttaattggg

SEQ ID NO: 347265 - DNA, 16 bp, M. musculus
acaacatttaattgtg

SEQ ID NO: 347266 - DNA, 16 bp, M. musculus
acaacatttggaatat

SEQ ID NO: 347267 - DNA, 16 bp, M. musculus
acaacattttttgtat

SEQ ID NO: 347268 - DNA, 16 bp, M. musculus
acaaccacaaggcaga

SEQ ID NO: 347269 - DNA, 16 bp, M. musculus
acaaccacctgtagct

SEQ ID NO: 347270 - DNA, 16 bp, M. musculus
acaaccagagtttgat

SEQ ID NO: 347271 - DNA, 16 bp, M. musculus
acaaccagggctatat

SEQ ID NO: 347272 - DNA, 16 bp, M. musculus
acaaccatctgaaact

SEQ ID NO: 347273 - DNA, 16 bp, M. musculus
acaaccatctgtatgg

SEQ ID NO: 347274 - DNA, 16 bp, M. musculus
acaaccatctttaact

SEQ ID NO: 347275 - DNA, 16 bp, M. musculus
acaaccatgcctggct

SEQ ID NO: 347276 - DNA, 16 bp, M. musculus
acaacccacaggttga

SEQ ID NO: 347277 - DNA, 16 bp, M. musculus
acaacccagatgtccc

SEQ ID NO: 347278 - DNA, 16 bp, M. musculus
acaacccagatgtcct

SEQ ID NO: 347279 - DNA, 16 bp, M. musculus
acaacccattttgggt

SEQ ID NO: 347280 - DNA, 34 bp, M. musculus
acaacccctccggccggaacagcatcaggaccga

SEQ ID NO: 347281 - DNA, 16 bp, M. musculus
acaaccctctgtaact

SEQ ID NO: 347282 - DNA, 16 bp, M. musculus
acaacctaaaagaaga

SEQ ID NO: 347283 - DNA, 16 bp, M. musculus
acaacctcctgtaact

SEQ ID NO: 347284 - DNA, 16 bp, M. musculus
acaacctgagttcaag

SEQ ID NO: 347285 - DNA, 16 bp, M. musculus
acaacctgagttcaat

SEQ ID NO: 347286 - DNA, 16 bp, M. musculus
acaacctgagtttgaa

SEQ ID NO: 347287 - DNA, 16 bp, M. musculus
acaacctgctgagtcc

SEQ ID NO: 347288 - DNA, 21 bp, M. musculus
acaacctgggacgggagacag

SEQ ID NO: 347289 - DNA, 16 bp, M. musculus
acaacctggtctacag

SEQ ID NO: 347290 - DNA, 16 bp, M. musculus
acaaccttatttataa

SEQ ID NO: 347291 - DNA, 16 bp, M. musculus
acaacgacgacgacga

SEQ ID NO: 347292 - DNA, 16 bp, M. musculus
acaacgatttactaat

SEQ ID NO: 347293 - DNA, 16 bp, M. musculus
acaactaaaatcctaa

SEQ ID NO: 347294 - DNA, 16 bp, M. musculus
acaactaactaactaa

SEQ ID NO: 347295 - DNA, 16 bp, M. musculus
acaactaactgcagag

SEQ ID NO: 347296 - DNA, 16 bp, M. musculus
acaactacagtgtact

SEQ ID NO: 347297 - DNA, 16 bp, M. musculus
acaactacctgcaact

SEQ ID NO: 347298 - DNA, 16 bp, M. musculus
acaactataactccag

SEQ ID NO: 347299 - DNA, 16 bp, M. musculus
acaactatctgtacag

SEQ ID NO: 347300 - DNA, 30 bp, M. musculus
acaactcactcaagattgtcagcaatgcat

SEQ ID NO: 347301 - DNA, 16 bp, M. musculus
acaactcactcctttt

SEQ ID NO: 347302 - DNA, 16 bp, M. musculus
acaactccagttccag

SEQ ID NO: 347303 - DNA, 16 bp, M. musculus
acaactgagtaatatt

SEQ ID NO: 347304 - DNA, 21 bp, M. musculus
acaactgcagacaacccccta

SEQ ID NO: 347305 - DNA, 16 bp, M. musculus
acaactgcctgcaatt

SEQ ID NO: 347306 - DNA, 16 bp, M. musculus
acaactgcctgtaact

SEQ ID NO: 347307 - DNA, 16 bp, M. musculus
acaactgggattggca

SEQ ID NO: 347308 - DNA, 16 bp, M. musculus
acaactgtctataact

SEQ ID NO: 347309 - DNA, 16 bp, M. musculus
acaactgtgagctgcc

SEQ ID NO: 347310 - DNA, 16 bp, M. musculus
acaactgtgtgtgtgt

SEQ ID NO: 347311 - DNA, 16 bp, M. musculus
acaacttagaaataaa

SEQ ID NO: 347312 - DNA, 16 bp, M. musculus
acaacttcagcaaaga

SEQ ID NO: 347313 - DNA, 16 bp, M. musculus
acaacttcagccaagt

SEQ ID NO: 347314 - DNA, 16 bp, M. musculus
acaacttcatcaaagt

SEQ ID NO: 347315 - DNA, 17 bp, M. musculus
acaacttctgccaagag

SEQ ID NO: 347316 - DNA, 16 bp, M. musculus
acaacttctgttccat

SEQ ID NO: 347317 - DNA, 16 bp, M. musculus
acaacttcttccagga

SEQ ID NO: 347318 - DNA, 16 bp, M. musculus
acaacttgagtttgat

SEQ ID NO: 347319 - DNA, 18 bp, M. musculus
acaacttgctcttgaaaa

SEQ ID NO: 347320 - DNA, 16 bp, M. musculus
acaactttcaaaacac

SEQ ID NO: 347321 - DNA, 16 bp, M. musculus
acaacttttcttttct

SEQ ID NO: 347322 - DNA, 16 bp, M. musculus
acaacttttgttaatt

SEQ ID NO: 347323 - DNA, 16 bp, M. musculus
acaagaaaacactgct

SEQ ID NO: 347324 - DNA, 16 bp, M. musculus
acaagaaaacccactg

SEQ ID NO: 347325 - DNA, 16 bp, M. musculus
acaagaaaacctacag

SEQ ID NO: 347326 - DNA, 16 bp, M. musculus
acaagaaaatcaagga

SEQ ID NO: 347327 - DNA, 16 bp, M. musculus
acaagaaaatgatctt

SEQ ID NO: 347328 - DNA, 16 bp, M. musculus
acaagaaacatacaga

SEQ ID NO: 347329 - DNA, 16 bp, M. musculus
acaagaaactgaaaag

SEQ ID NO: 347330 - DNA, 16 bp, M. musculus
acaagaaagagatcag

SEQ ID NO: 347331 - DNA, 16 bp, M. musculus
acaagaaagtatgtca

SEQ ID NO: 347332 - DNA, 16 bp, M. musculus
acaagaaatgcaagga

SEQ ID NO: 347333 - DNA, 16 bp, M. musculus
acaagaaatgcaggaa

SEQ ID NO: 347334 - DNA, 16 bp, M. musculus
acaagaaatggaagaa

SEQ ID NO: 347335 - DNA, 16 bp, M. musculus
acaagaacaaacctga

SEQ ID NO: 347336 - DNA, 16 bp, M. musculus
acaagaacacagccca

SEQ ID NO: 347337 - DNA, 16 bp, M. musculus
acaagaacagaatgcc

SEQ ID NO: 347338 - DNA, 16 bp, M. musculus
acaagaacagcagcag

SEQ ID NO: 347339 - DNA, 16 bp, M. musculus
acaagaacttcaagac

SEQ ID NO: 347340 - DNA, 16 bp, M. musculus
acaagaagcctacaca

SEQ ID NO: 347341 - DNA, 16 bp, M. musculus
acaagaagctggaaag

SEQ ID NO: 347342 - DNA, 16 bp, M. musculus
acaagaagcttataga

SEQ ID NO: 347343 - DNA, 16 bp, M. musculus
acaagaaggcatcaga

SEQ ID NO: 347344 - DNA, 16 bp, M. musculus
acaagaataattttat

SEQ ID NO: 347345 - DNA, 16 bp, M. musculus
acaagacaatcaagaa

SEQ ID NO: 347346 - DNA, 16 bp, M. musculus
acaagaccaaggacct

SEQ ID NO: 347347 - DNA, 16 bp, M. musculus
acaagaccaagggact

SEQ ID NO: 347348 - DNA, 16 bp, M. musculus
acaagacttcaaaata

SEQ ID NO: 347349 - DNA, 16 bp, M. musculus
acaagagaaagcattt

SEQ ID NO: 347350 - DNA, 16 bp, M. musculus
acaagagaaggaaata

SEQ ID NO: 347351 - DNA, 16 bp, M. musculus
acaagagaatcaagaa

SEQ ID NO: 347352 - DNA, 16 bp, M. musculus
acaagagatcctgtct

SEQ ID NO: 347353 - DNA, 16 bp, M. musculus
acaagagcctagcatg

SEQ ID NO: 347354 - DNA, 17 bp, M. musculus
acaagagctaggtcaca

SEQ ID NO: 347355 - DNA, 16 bp, M. musculus
acaagaggctggagag

SEQ ID NO: 347356 - DNA, 16 bp, M. musculus
acaagagtggttttta

SEQ ID NO: 347357 - DNA, 16 bp, M. musculus
acaagatcttgctgac

SEQ ID NO: 347358 - DNA, 16 bp, M. musculus
acaagatggaagagag

SEQ ID NO: 347359 - DNA, 16 bp, M. musculus
acaagatggaggaacc

SEQ ID NO: 347360 - DNA, 16 bp, M. musculus
acaagattacttttaa

SEQ ID NO: 347361 - DNA, 17 bp, M. musculus
acaagattggcaagccc

SEQ ID NO: 347362 - DNA, 16 bp, M. musculus
acaagatttctctgta

SEQ ID NO: 347363 - DNA, 16 bp, M. musculus
acaagattttttttaa

SEQ ID NO: 347364 - DNA, 16 bp, M. musculus
acaagcaagcaagcaa

SEQ ID NO: 347365 - DNA, 16 bp, M. musculus
acaagcaatggaggaa

SEQ ID NO: 347366 - DNA, 16 bp, M. musculus
acaagcagaaagcaga

SEQ ID NO: 347367 - DNA, 16 bp, M. musculus
acaagcagatgaaaga

SEQ ID NO: 347368 - DNA, 16 bp, M. musculus
acaagcaggcaaaaga

SEQ ID NO: 347369 - DNA, 16 bp, M. musculus
acaagccaaggactct

SEQ ID NO: 347370 - DNA, 16 bp, M. musculus
acaagccactgctgtt

SEQ ID NO: 347371 - DNA, 16 bp, M. musculus
acaagccaggcatggt

SEQ ID NO: 347372 - DNA, 16 bp, M. musculus
acaagcccaaagtggg

SEQ ID NO: 347373 - DNA, 16 bp, M. musculus
acaagcccctgccaca

SEQ ID NO: 347374 - DNA, 16 bp, M. musculus
acaagcctcaacagat

SEQ ID NO: 347375 - DNA, 16 bp, M. musculus
acaagcctgcaatctc

SEQ ID NO: 347376 - DNA, 16 bp, M. musculus
acaagctaataactag

SEQ ID NO: 347377 - DNA, 16 bp, M. musculus
acaagctcaagaactg

SEQ ID NO: 347378 - DNA, 16 bp, M. musculus
acaagctcaagtcaga

SEQ ID NO: 347379 - DNA, 16 bp, M. musculus
acaagctctatgaatg

SEQ ID NO: 347380 - DNA, 16 bp, M. musculus
acaagctctctcctga

SEQ ID NO: 347381 - DNA, 16 bp, M. musculus
acaagctctgaggggt

SEQ ID NO: 347382 - DNA, 16 bp, M. musculus
acaagctctggggagt

SEQ ID NO: 347383 - DNA, 16 bp, M. musculus
acaagctgaagccttg

SEQ ID NO: 347384 - DNA, 16 bp, M. musculus
acaagctgtcttctga

SEQ ID NO: 347385 - DNA, 16 bp, M. musculus
acaagctgtgtgtgct

SEQ ID NO: 347386 - DNA, 16 bp, M. musculus
acaagcttgcaatctc

SEQ ID NO: 347387 - DNA, 16 bp, M. musculus
acaagctttgtgccac

SEQ ID NO: 347388 - DNA, 16 bp, M. musculus
acaaggaaagagtcta

SEQ ID NO: 347389 - DNA, 16 bp, M. musculus
acaaggaaatcaagaa

SEQ ID NO: 347390 - DNA, 16 bp, M. musculus
acaaggaagaccaaag

SEQ ID NO: 347391 - DNA, 16 bp, M. musculus
acaaggacacaggctc

SEQ ID NO: 347392 - DNA, 16 bp, M. musculus
acaaggacagaaacta

SEQ ID NO: 347393 - DNA, 16 bp, M. musculus
acaaggacataagaat

SEQ ID NO: 347394 - DNA, 16 bp, M. musculus
acaaggacatcctgag

SEQ ID NO: 347395 - DNA, 16 bp, M. musculus
acaaggacctgaattt

SEQ ID NO: 347396 - DNA, 16 bp, M. musculus
acaaggacttcaaaat

SEQ ID NO: 347397 - DNA, 16 bp, M. musculus
acaaggagacaggaat

SEQ ID NO: 347398 - DNA, 16 bp, M. musculus
acaaggagatcacaca

SEQ ID NO: 347399 - DNA, 16 bp, M. musculus
acaaggagggactcat

SEQ ID NO: 347400 - DNA, 16 bp, M. musculus
acaaggaggggaactt

SEQ ID NO: 347401 - DNA, 16 bp, M. musculus
acaaggatagaaacca

SEQ ID NO: 347402 - DNA, 16 bp, M. musculus
acaaggatgcccactt

SEQ ID NO: 347403 - DNA, 16 bp, M. musculus
acaaggatgtggagaa

SEQ ID NO: 347404 - DNA, 16 bp, M. musculus
acaaggcagtcctctg

SEQ ID NO: 347405 - DNA, 16 bp, M. musculus
acaaggccctaggttt

SEQ ID NO: 347406 - DNA, 17 bp, M. musculus
acaaggccgttatggaa

SEQ ID NO: 347407 - DNA, 16 bp, M. musculus
acaaggcctgcacagg

SEQ ID NO: 347408 - DNA, 16 bp, M. musculus
acaaggccttgggttt

SEQ ID NO: 347409 - DNA, 16 bp, M. musculus
acaaggctgcccaccc

SEQ ID NO: 347410 - DNA, 16 bp, M. musculus
acaaggctgtccttga

SEQ ID NO: 347411 - DNA, 16 bp, M. musculus
acaagggaatgccagg

SEQ ID NO: 347412 - DNA, 16 bp, M. musculus
acaagggacagaaagg

SEQ ID NO: 347413 - DNA, 28 bp, M. musculus
acaagggagctaaaaccatccagtggaa

SEQ ID NO: 347414 - DNA, 16 bp, M. musculus
acaaggtagaaggaga

SEQ ID NO: 347415 - DNA, 16 bp, M. musculus
acaaggtcacacccac

SEQ ID NO: 347416 - DNA, 16 bp, M. musculus
acaaggtcatcctctg

SEQ ID NO: 347417 - DNA, 16 bp, M. musculus
acaaggtcctgggttc

SEQ ID NO: 347418 - DNA, 16 bp, M. musculus
acaaggtggaaggtga

SEQ ID NO: 347419 - DNA, 16 bp, M. musculus
acaaggtggctcacaa

SEQ ID NO: 347420 - DNA, 16 bp, M. musculus
acaaggtttctctctg

SEQ ID NO: 347421 - DNA, 16 bp, M. musculus
acaagtaacattatat

SEQ ID NO: 347422 - DNA, 16 bp, M. musculus
acaagtataacaacta

SEQ ID NO: 347423 - DNA, 16 bp, M. musculus
acaagtatagtgacag

SEQ ID NO: 347424 - DNA, 16 bp, M. musculus
acaagtatgtgtgtgt

SEQ ID NO: 347425 - DNA, 17 bp, M. musculus
acaagtatttacaatgg

SEQ ID NO: 347426 - DNA, 16 bp, M. musculus
acaagtccatcctctg

SEQ ID NO: 347427 - DNA, 16 bp, M. musculus
acaagtctctgaagaa

SEQ ID NO: 347428 - DNA, 16 bp, M. musculus
acaagtgaagacagaa

SEQ ID NO: 347429 - DNA, 16 bp, M. musculus
acaagtgctcttaact

SEQ ID NO: 347430 - DNA, 16 bp, M. musculus
acaagtgggacttcat

SEQ ID NO: 347431 - DNA, 16 bp, M. musculus
acaagttcaaagccaa

SEQ ID NO: 347432 - DNA, 16 bp, M. musculus
acaagttcaaggtcat

SEQ ID NO: 347433 - DNA, 16 bp, M. musculus
acaagttctaccatgt

SEQ ID NO: 347434 - DNA, 16 bp, M. musculus
acaagttctaggccag

SEQ ID NO: 347435 - DNA, 16 bp, M. musculus
acaagttgtcctctga

SEQ ID NO: 347436 - DNA, 16 bp, M. musculus
acaagtttaaggccag

SEQ ID NO: 347437 - DNA, 16 bp, M. musculus
acaagtttgaggctag

SEQ ID NO: 347438 - DNA, 16 bp, M. musculus
acaagtttggagcatt

SEQ ID NO: 347439 - DNA, 16 bp, M. musculus
acaagttttgttttgt

SEQ ID NO: 347440 - DNA, 16 bp, M. musculus
acaataaaaaccttcc

SEQ ID NO: 347441 - DNA, 16 bp, M. musculus
acaataaaaggacttc

SEQ ID NO: 347442 - DNA, 16 bp, M. musculus
acaataaacagaaagc

SEQ ID NO: 347443 - DNA, 16 bp, M. musculus
acaataaacaggctga

SEQ ID NO: 347444 - DNA, 16 bp, M. musculus
acaataaagaaaactc

SEQ ID NO: 347445 - DNA, 16 bp, M. musculus
acaataaagaaaagcc

SEQ ID NO: 347446 - DNA, 16 bp, M. musculus
acaataaatctctaaa

SEQ ID NO: 347447 - DNA, 16 bp, M. musculus
acaataacaacaacag

SEQ ID NO: 347448 - DNA, 16 bp, M. musculus
acaataagaccaggca

SEQ ID NO: 347449 - DNA, 16 bp, M. musculus
acaataagatcacaat

SEQ ID NO: 347450 - DNA, 16 bp, M. musculus
acaataataataatga

SEQ ID NO: 347451 - DNA, 16 bp, M. musculus
acaataatgacaacaa

SEQ ID NO: 347452 - DNA, 16 bp, M. musculus
acaataatggaataaa

SEQ ID NO: 347453 - DNA, 16 bp, M. musculus
acaatagacagagcca

SEQ ID NO: 347454 - DNA, 16 bp, M. musculus
acaatagactagagta

SEQ ID NO: 347455 - DNA, 16 bp, M. musculus
acaatagagtgatcta

SEQ ID NO: 347456 - DNA, 16 bp, M. musculus
acaatagcagcaacaa

SEQ ID NO: 347457 - DNA, 16 bp, M. musculus
acaatagtcacacata

SEQ ID NO: 347458 - DNA, 16 bp, M. musculus
acaatatacccaaacc

SEQ ID NO: 347459 - DNA, 16 bp, M. musculus
acaatatcaatgaacc

SEQ ID NO: 347460 - DNA, 16 bp, M. musculus
acaatatcatttcccc

SEQ ID NO: 347461 - DNA, 16 bp, M. musculus
acaatatctttccaag

SEQ ID NO: 347462 - DNA, 16 bp, M. musculus
acaatatctttccacg

SEQ ID NO: 347463 - DNA, 17 bp, M. musculus
acaatatgcaaaacaca

SEQ ID NO: 347464 - DNA, 16 bp, M. musculus
acaatatttaattgga

SEQ ID NO: 347465 - DNA, 16 bp, M. musculus
acaatatttggaatgt

SEQ ID NO: 347466 - DNA, 16 bp, M. musculus
acaatatttttgtttt

SEQ ID NO: 347467 - DNA, 17 bp, M. musculus
acaatcactcaagtcaa

SEQ ID NO: 347468 - DNA, 16 bp, M. musculus
acaatcagagacagca

SEQ ID NO: 347469 - DNA, 16 bp, M. musculus
acaatcagcctctctc

SEQ ID NO: 347470 - DNA, 16 bp, M. musculus
acaatcctcctgcctc

SEQ ID NO: 347471 - DNA, 16 bp, M. musculus
acaatcctctgtaact

SEQ ID NO: 347472 - DNA, 16 bp, M. musculus
acaatctcagggttca

SEQ ID NO: 347473 - DNA, 16 bp, M. musculus
acaatgaaaacagtaa

SEQ ID NO: 347474 - DNA, 16 bp, M. musculus
acaatgaaaactttaa

SEQ ID NO: 347475 - DNA, 16 bp, M. musculus
acaatgaaaataacag

SEQ ID NO: 347476 - DNA, 16 bp, M. musculus
acaatgaaaataattt

SEQ ID NO: 347477 - DNA, 16 bp, M. musculus
acaatgaaacaggtga

SEQ ID NO: 347478 - DNA, 16 bp, M. musculus
acaatgaaatattttt

SEQ ID NO: 347479 - DNA, 17 bp, M. musculus
acaatgaagccatcgct

SEQ ID NO: 347480 - DNA, 16 bp, M. musculus
acaatgaaggtaaatt

SEQ ID NO: 347481 - DNA, 16 bp, M. musculus
acaatgacaatgacaa

SEQ ID NO: 347482 - DNA, 16 bp, M. musculus
acaatgacctcatgaa

SEQ ID NO: 347483 - DNA, 16 bp, M. musculus
acaatgacttcatgaa

SEQ ID NO: 347484 - DNA, 16 bp, M. musculus
acaatgagaagaacaa

SEQ ID NO: 347485 - DNA, 17 bp, M. musculus
acaatgagaagaccaac

SEQ ID NO: 347486 - DNA, 16 bp, M. musculus
acaatggaagaaggaa

SEQ ID NO: 347487 - DNA, 24 bp, M. musculus
acaatggaatactactcagctatt

SEQ ID NO: 347488 - DNA, 16 bp, M. musculus
acaatggaatccatca

SEQ ID NO: 347489 - DNA, 16 bp, M. musculus
acaatggacagaagca

SEQ ID NO: 347490 - DNA, 16 bp, M. musculus
acaatggataaagaaa

SEQ ID NO: 347491 - DNA, 16 bp, M. musculus
acaatggcacagaata

SEQ ID NO: 347492 - DNA, 16 bp, M. musculus
acaatggcagctgtga

SEQ ID NO: 347493 - DNA, 16 bp, M. musculus
acaatggcttcccttt

SEQ ID NO: 347494 - DNA, 16 bp, M. musculus
acaatgtactcacata

SEQ ID NO: 347495 - DNA, 16 bp, M. musculus
acaatgtgaccagctg

SEQ ID NO: 347496 - DNA, 16 bp, M. musculus
acaatgtgatcaaata

SEQ ID NO: 347497 - DNA, 16 bp, M. musculus
acaatgtgattacatt

SEQ ID NO: 347498 - DNA, 16 bp, M. musculus
acaatgtgcaggaaaa

SEQ ID NO: 347499 - DNA, 18 bp, M. musculus
acaatgtggtaaagcttt

SEQ ID NO: 347500 - DNA, 16 bp, M. musculus
acaatgttaaaagttc

SEQ ID NO: 347501 - DNA, 16 bp, M. musculus
acaatgttctttgcct

SEQ ID NO: 347502 - DNA, 25 bp, M. musculus
acaattaccaggtattccttgtgac

SEQ ID NO: 347503 - DNA, 16 bp, M. musculus
acaattactctgataa

SEQ ID NO: 347504 - DNA, 16 bp, M. musculus
acaattcatcatcaaa

SEQ ID NO: 347505 - DNA, 16 bp, M. musculus
acaattctcctgcctc

SEQ ID NO: 347506 - DNA, 16 bp, M. musculus
acaattgctctgtact

SEQ ID NO: 347507 - DNA, 16 bp, M. musculus
acaattgctgggcact

SEQ ID NO: 347508 - DNA, 16 bp, M. musculus
acaatttaaatagacc

SEQ ID NO: 347509 - DNA, 16 bp, M. musculus
acaatttcccctccct

SEQ ID NO: 347510 - DNA, 16 bp, M. musculus
acaatttcttaactgt

SEQ ID NO: 347511 - DNA, 16 bp, M. musculus
acaatttgagaaacac

SEQ ID NO: 347512 - DNA, 16 bp, M. musculus
acaatttgcaaaacaa

SEQ ID NO: 347513 - DNA, 16 bp, M. musculus
acaatttgcagatgat

SEQ ID NO: 347514 - DNA, 16 bp, M. musculus
acaatttggaaaagag

SEQ ID NO: 347515 - DNA, 16 bp, M. musculus
acaattttctagaaag

SEQ ID NO: 347516 - DNA, 16 bp, M. musculus
acaattttgggaagca

SEQ ID NO: 347517 - DNA, 16 bp, M. musculus
acaatttttaaaaagg

SEQ ID NO: 347518 - DNA, 16 bp, M. musculus
acaattttttcaggtg

SEQ ID NO: 347519 - DNA, 16 bp, M. musculus
acaattttttgtttgt

SEQ ID NO: 347520 - DNA, 16 bp, M. musculus
acacaaaaccttctcc

SEQ ID NO: 347521 - DNA, 16 bp, M. musculus
acacaaaagaacacat

SEQ ID NO: 347522 - DNA, 16 bp, M. musculus
acacaaaagaagatag

SEQ ID NO: 347523 - DNA, 16 bp, M. musculus
acacaaaagaatacac

SEQ ID NO: 347524 - DNA, 16 bp, M. musculus
acacaaaagcacacat

SEQ ID NO: 347525 - DNA, 16 bp, M. musculus
acacaaaatgcacaaa

SEQ ID NO: 347526 - DNA, 16 bp, M. musculus
acacaaaattggaaac

SEQ ID NO: 347527 - DNA, 16 bp, M. musculus
acacaaacacagagag

SEQ ID NO: 347528 - DNA, 16 bp, M. musculus
acacaaacatatcact

SEQ ID NO: 347529 - DNA, 16 bp, M. musculus
acacaaactggacttg

SEQ ID NO: 347530 - DNA, 16 bp, M. musculus
acacaaagaaaccttg

SEQ ID NO: 347531 - DNA, 16 bp, M. musculus
acacaaagatccaaaa

SEQ ID NO: 347532 - DNA, 16 bp, M. musculus
acacaaagatgaagga

SEQ ID NO: 347533 - DNA, 16 bp, M. musculus
acacaaagttgaaggc

SEQ ID NO: 347534 - DNA, 16 bp, M. musculus
acacaaagttttaaaa

SEQ ID NO: 347535 - DNA, 16 bp, M. musculus
acacaaataattttat

SEQ ID NO: 347536 - DNA, 16 bp, M. musculus
acacaaatccagccag

SEQ ID NO: 347537 - DNA, 16 bp, M. musculus
acacaaatgccagacc

SEQ ID NO: 347538 - DNA, 17 bp, M. musculus
acacaaatgccagcaca

SEQ ID NO: 347539 - DNA, 16 bp, M. musculus
acacaaatgtatttta

SEQ ID NO: 347540 - DNA, 16 bp, M. musculus
acacaaatgtcagcct

SEQ ID NO: 347541 - DNA, 16 bp, M. musculus
acacaaatgtgtatat

SEQ ID NO: 347542 - DNA, 16 bp, M. musculus
acacaacagaatttat

SEQ ID NO: 347543 - DNA, 16 bp, M. musculus
acacaacagagagaga

SEQ ID NO: 347544 - DNA, 20 bp, M. musculus
acacaacagtcaaagaaaat

SEQ ID NO: 347545 - DNA, 16 bp, M. musculus
acacaacattttgctg

SEQ ID NO: 347546 - DNA, 17 bp, M. musculus
acacaacttcttacccc

SEQ ID NO: 347547 - DNA, 16 bp, M. musculus
acacaagaaaatcaag

SEQ ID NO: 347548 - DNA, 16 bp, M. musculus
acacaagagaaaccct

SEQ ID NO: 347549 - DNA, 16 bp, M. musculus
acacaagatacaagat

SEQ ID NO: 347550 - DNA, 16 bp, M. musculus
acacaagattaatgtc

SEQ ID NO: 347551 - DNA, 16 bp, M. musculus
acacaagcagtgtcct

SEQ ID NO: 347552 - DNA, 16 bp, M. musculus
acacaagctagaatca

SEQ ID NO: 347553 - DNA, 16 bp, M. musculus
acacaagctcgggggg

SEQ ID NO: 347554 - DNA, 16 bp, M. musculus
acacaaggaaggaaat

SEQ ID NO: 347555 - DNA, 16 bp, M. musculus
acacaaggagctaaag

SEQ ID NO: 347556 - DNA, 16 bp, M. musculus
acacaaggctctgcat

SEQ ID NO: 347557 - DNA, 16 bp, M. musculus
acacaaggctgcccac

SEQ ID NO: 347558 - DNA, 16 bp, M. musculus
acacaagtctcacagc

SEQ ID NO: 347559 - DNA, 16 bp, M. musculus
acacaagtggtgcaca

SEQ ID NO: 347560 - DNA, 16 bp, M. musculus
acacaagtggtgcata

SEQ ID NO: 347561 - DNA, 16 bp, M. musculus
acacaatagaatacta

SEQ ID NO: 347562 - DNA, 16 bp, M. musculus
acacaatcaaacagga

SEQ ID NO: 347563 - DNA, 16 bp, M. musculus
acacaatcacacacat

SEQ ID NO: 347564 - DNA, 16 bp, M. musculus
acacaatctcctgtgt

SEQ ID NO: 347565 - DNA, 16 bp, M. musculus
acacaatgaaaatagt

SEQ ID NO: 347566 - DNA, 23 bp, M. musculus
acacaatgagaagaccaaaccta

SEQ ID NO: 347567 - DNA, 16 bp, M. musculus
acacaatggagagaaa

SEQ ID NO: 347568 - DNA, 16 bp, M. musculus
acacaatgggaagacc

SEQ ID NO: 347569 - DNA, 16 bp, M. musculus
acacaattaaagcatt

SEQ ID NO: 347570 - DNA, 16 bp, M. musculus
acacaatttgtactca

SEQ ID NO: 347571 - DNA, 16 bp, M. musculus
acacacaaacaaatga

SEQ ID NO: 347572 - DNA, 16 bp, M. musculus
acacacaaacacagat

SEQ ID NO: 347573 - DNA, 16 bp, M. musculus
acacacaaagacataa

SEQ ID NO: 347574 - DNA, 16 bp, M. musculus
acacacaaatattaat

SEQ ID NO: 347575 - DNA, 16 bp, M. musculus
acacacaaatgaacat

SEQ ID NO: 347576 - DNA, 16 bp, M. musculus
acacacaaatgtaaat

SEQ ID NO: 347577 - DNA, 16 bp, M. musculus
acacacaagcaaaata

SEQ ID NO: 347578 - DNA, 16 bp, M. musculus
acacacaataaataag

SEQ ID NO: 347579 - DNA, 16 bp, M. musculus
acacacacaaagaagg

SEQ ID NO: 347580 - DNA, 16 bp, M. musculus
acacacacaaagagag

SEQ ID NO: 347581 - DNA, 16 bp, M. musculus
acacacacaaagctca

SEQ ID NO: 347582 - DNA, 16 bp, M. musculus
acacacacaaagctgt

SEQ ID NO: 347583 - DNA, 16 bp, M. musculus
acacacacaaagcttt

SEQ ID NO: 347584 - DNA, 16 bp, M. musculus
acacacacaaagtaaa

SEQ ID NO: 347585 - DNA, 16 bp, M. musculus
acacacacaaatctca

SEQ ID NO: 347586 - DNA, 16 bp, M. musculus
acacacacaaatcttt

SEQ ID NO: 347587 - DNA, 16 bp, M. musculus
acacacacaaatggaa

SEQ ID NO: 347588 - DNA, 16 bp, M. musculus
acacacacaaatgtga

SEQ ID NO: 347589 - DNA, 16 bp, M. musculus
acacacacaaatgttt

SEQ ID NO: 347590 - DNA, 16 bp, M. musculus
acacacacaaattatt

SEQ ID NO: 347591 - DNA, 16 bp, M. musculus
acacacacaagacatg

SEQ ID NO: 347592 - DNA, 16 bp, M. musculus
acacacacaagaggaa

SEQ ID NO: 347593 - DNA, 16 bp, M. musculus
acacacacaagcatga

SEQ ID NO: 347594 - DNA, 16 bp, M. musculus
acacacacaatgacac

SEQ ID NO: 347595 - DNA, 16 bp, M. musculus
acacacacaatgtata

SEQ ID NO: 347596 - DNA, 16 bp, M. musculus
acacacacacaaactg

SEQ ID NO: 347597 - DNA, 16 bp, M. musculus
acacacacacaaaggt

SEQ ID NO: 347598 - DNA, 16 bp, M. musculus
acacacacacaaattt

SEQ ID NO: 347599 - DNA, 16 bp, M. musculus
acacacacacaacttc

SEQ ID NO: 347600 - DNA, 16 bp, M. musculus
acacacacacaagttc

SEQ ID NO: 347601 - DNA, 16 bp, M. musculus
acacacacacaagttt

SEQ ID NO: 347602 - DNA, 16 bp, M. musculus
acacacacacaatcat

SEQ ID NO: 347603 - DNA, 16 bp, M. musculus
acacacacacaatgga

SEQ ID NO: 347604 - DNA, 16 bp, M. musculus
acacacacacaattgt

SEQ ID NO: 347605 - DNA, 16 bp, M. musculus
acacacacacaatttt

SEQ ID NO: 347606 - DNA, 16 bp, M. musculus
acacacacacacagat

SEQ ID NO: 347607 - DNA, 16 bp, M. musculus
acacacacacacatag

SEQ ID NO: 347608 - DNA, 16 bp, M. musculus
acacacacacacatat

SEQ ID NO: 347609 - DNA, 16 bp, M. musculus
acacacacacacatgc

SEQ ID NO: 347610 - DNA, 16 bp, M. musculus
acacacacacacatta

SEQ ID NO: 347611 - DNA, 16 bp, M. musculus
acacacacacaccatg

SEQ ID NO: 347612 - DNA, 16 bp, M. musculus
acacacacacaccttt

SEQ ID NO: 347613 - DNA, 16 bp, M. musculus
acacacacacactaat

SEQ ID NO: 347614 - DNA, 16 bp, M. musculus
acacacacacactatc

SEQ ID NO: 347615 - DNA, 16 bp, M. musculus
acacacacacactatt

SEQ ID NO: 347616 - DNA, 16 bp, M. musculus
acacacacacactgcc

SEQ ID NO: 347617 - DNA, 16 bp, M. musculus
acacacacacactgta

SEQ ID NO: 347618 - DNA, 16 bp, M. musculus
acacacacacacttca

SEQ ID NO: 347619 - DNA, 16 bp, M. musculus
acacacacacacttgc

SEQ ID NO: 347620 - DNA, 16 bp, M. musculus
acacacacacacttgt

SEQ ID NO: 347621 - DNA, 16 bp, M. musculus
acacacacacacttta

SEQ ID NO: 347622 - DNA, 16 bp, M. musculus
acacacacacagaggc

SEQ ID NO: 347623 - DNA, 16 bp, M. musculus
acacacacacagcagt

SEQ ID NO: 347624 - DNA, 16 bp, M. musculus
acacacacacagggac

SEQ ID NO: 347625 - DNA, 16 bp, M. musculus
acacacacacagggcc

SEQ ID NO: 347626 - DNA, 16 bp, M. musculus
acacacacacaggtac

SEQ ID NO: 347627 - DNA, 16 bp, M. musculus
acacacacacagtgcc

SEQ ID NO: 347628 - DNA, 16 bp, M. musculus
acacacacacagttat

SEQ ID NO: 347629 - DNA, 16 bp, M. musculus
acacacacacagttgt

SEQ ID NO: 347630 - DNA, 16 bp, M. musculus
acacacacacatacat

SEQ ID NO: 347631 - DNA, 20 bp, M. musculus
acacacacacatatatatat

SEQ ID NO: 347632 - DNA, 16 bp, M. musculus
acacacacacatatgt

SEQ ID NO: 347633 - DNA, 16 bp, M. musculus
acacacacacatcata

SEQ ID NO: 347634 - DNA, 16 bp, M. musculus
acacacacacatccta

SEQ ID NO: 347635 - DNA, 16 bp, M. musculus
acacacacacatctca

SEQ ID NO: 347636 - DNA, 16 bp, M. musculus
acacacacacatgacc

SEQ ID NO: 347637 - DNA, 16 bp, M. musculus
acacacacacatgttt

SEQ ID NO: 347638 - DNA, 16 bp, M. musculus
acacacacacattctc

SEQ ID NO: 347639 - DNA, 16 bp, M. musculus
acacacacacattttc

SEQ ID NO: 347640 - DNA, 16 bp, M. musculus
acacacacacattttt

SEQ ID NO: 347641 - DNA, 16 bp, M. musculus
acacacacaccaagag

SEQ ID NO: 347642 - DNA, 16 bp, M. musculus
acacacacaccaagat

SEQ ID NO: 347643 - DNA, 16 bp, M. musculus
acacacacaccacttt

SEQ ID NO: 347644 - DNA, 16 bp, M. musculus
acacacacaccatctc

SEQ ID NO: 347645 - DNA, 16 bp, M. musculus
acacacacacccctgc

SEQ ID NO: 347646 - DNA, 16 bp, M. musculus
acacacacaccctggc

SEQ ID NO: 347647 - DNA, 16 bp, M. musculus
acacacacacccttct

SEQ ID NO: 347648 - DNA, 16 bp, M. musculus
acacacacacccttgc

SEQ ID NO: 347649 - DNA, 16 bp, M. musculus
acacacacaccctttc

SEQ ID NO: 347650 - DNA, 16 bp, M. musculus
acacacacaccttgaa

SEQ ID NO: 347651 - DNA, 16 bp, M. musculus
acacacacacctttct

SEQ ID NO: 347652 - DNA, 16 bp, M. musculus
acacacacacgatcac

SEQ ID NO: 347653 - DNA, 16 bp, M. musculus
acacacacacgcacat

SEQ ID NO: 347654 - DNA, 16 bp, M. musculus
acacacacactaagtg

SEQ ID NO: 347655 - DNA, 16 bp, M. musculus
acacacacactcacat

SEQ ID NO: 347656 - DNA, 16 bp, M. musculus
acacacacactcactc

SEQ ID NO: 347657 - DNA, 16 bp, M. musculus
acacacacactcaggt

SEQ ID NO: 347658 - DNA, 16 bp, M. musculus
acacacacactcagta

SEQ ID NO: 347659 - DNA, 16 bp, M. musculus
acacacacactcatat

SEQ ID NO: 347660 - DNA, 16 bp, M. musculus
acacacacactcccag

SEQ ID NO: 347661 - DNA, 16 bp, M. musculus
acacacacactgaagt

SEQ ID NO: 347662 - DNA, 16 bp, M. musculus
acacacacactgcaca

SEQ ID NO: 347663 - DNA, 16 bp, M. musculus
acacacacactgctct

SEQ ID NO: 347664 - DNA, 16 bp, M. musculus
acacacacactgggta

SEQ ID NO: 347665 - DNA, 16 bp, M. musculus
acacacacactggttt

SEQ ID NO: 347666 - DNA, 16 bp, M. musculus
acacacacacttggaa

SEQ ID NO: 347667 - DNA, 16 bp, M. musculus
acacacacactttaaa

SEQ ID NO: 347668 - DNA, 16 bp, M. musculus
acacacacactttttc

SEQ ID NO: 347669 - DNA, 16 bp, M. musculus
acacacacagaagcag

SEQ ID NO: 347670 - DNA, 16 bp, M. musculus
acacacacagacacat

SEQ ID NO: 347671 - DNA, 16 bp, M. musculus
acacacacagacagag

SEQ ID NO: 347672 - DNA, 17 bp, M. musculus
acacacacagagagaga

SEQ ID NO: 347673 - DNA, 16 bp, M. musculus
acacacacagagcaga

SEQ ID NO: 347674 - DNA, 16 bp, M. musculus
acacacacagaggaag

SEQ ID NO: 347675 - DNA, 16 bp, M. musculus
acacacacagaggaga

SEQ ID NO: 347676 - DNA, 16 bp, M. musculus
acacacacagaggagt

SEQ ID NO: 347677 - DNA, 16 bp, M. musculus
acacacacagaggcac

SEQ ID NO: 347678 - DNA, 16 bp, M. musculus
acacacacagataaat

SEQ ID NO: 347679 - DNA, 16 bp, M. musculus
acacacacagatgaaa

SEQ ID NO: 347680 - DNA, 16 bp, M. musculus
acacacacagatgtgt

SEQ ID NO: 347681 - DNA, 16 bp, M. musculus
acacacacagcacagc

SEQ ID NO: 347682 - DNA, 16 bp, M. musculus
acacacacagctgaaa

SEQ ID NO: 347683 - DNA, 16 bp, M. musculus
acacacacaggagaat

SEQ ID NO: 347684 - DNA, 16 bp, M. musculus
acacacacagtatttt

SEQ ID NO: 347685 - DNA, 16 bp, M. musculus
acacacacagtgaaac

SEQ ID NO: 347686 - DNA, 16 bp, M. musculus
acacacacatacacag

SEQ ID NO: 347687 - DNA, 16 bp, M. musculus
acacacacatacacgt

SEQ ID NO: 347688 - DNA, 16 bp, M. musculus
acacacacatacatat

SEQ ID NO: 347689 - DNA, 16 bp, M. musculus
acacacacatacatcc

SEQ ID NO: 347690 - DNA, 16 bp, M. musculus
acacacacataccaga

SEQ ID NO: 347691 - DNA, 16 bp, M. musculus
acacacacatacccag

SEQ ID NO: 347692 - DNA, 16 bp, M. musculus
acacacacatagagga

SEQ ID NO: 347693 - DNA, 16 bp, M. musculus
acacacacatatacag

SEQ ID NO: 347694 - DNA, 16 bp, M. musculus
acacacacatatacat

SEQ ID NO: 347695 - DNA, 16 bp, M. musculus
acacacacatatataa

SEQ ID NO: 347696 - DNA, 16 bp, M. musculus
acacacacatatatac

SEQ ID NO: 347697 - DNA, 20 bp, M. musculus
acacacacatatatatatat

SEQ ID NO: 347698 - DNA, 16 bp, M. musculus
acacacacatatgtat

SEQ ID NO: 347699 - DNA, 16 bp, M. musculus
acacacacatatttgc

SEQ ID NO: 347700 - DNA, 16 bp, M. musculus
acacacacatattttc

SEQ ID NO: 347701 - DNA, 16 bp, M. musculus
acacacacatcattat

SEQ ID NO: 347702 - DNA, 16 bp, M. musculus
acacacacatctaaca

SEQ ID NO: 347703 - DNA, 16 bp, M. musculus
acacacacatctgtgc

SEQ ID NO: 347704 - DNA, 16 bp, M. musculus
acacacacatgcacat

SEQ ID NO: 347705 - DNA, 16 bp, M. musculus
acacacacatgctcaa

SEQ ID NO: 347706 - DNA, 16 bp, M. musculus
acacacacatgtgtat

SEQ ID NO: 347707 - DNA, 16 bp, M. musculus
acacacacattgtgca

SEQ ID NO: 347708 - DNA, 16 bp, M. musculus
acacacaccagagaca

SEQ ID NO: 347709 - DNA, 16 bp, M. musculus
acacacaccatacaga

SEQ ID NO: 347710 - DNA, 16 bp, M. musculus
acacacaccattttaa

SEQ ID NO: 347711 - DNA, 16 bp, M. musculus
acacacacccatgcat

SEQ ID NO: 347712 - DNA, 16 bp, M. musculus
acacacacccctatat

SEQ ID NO: 347713 - DNA, 16 bp, M. musculus
acacacaccctcagga

SEQ ID NO: 347714 - DNA, 16 bp, M. musculus
acacacacccttccct

SEQ ID NO: 347715 - DNA, 16 bp, M. musculus
acacacacctttaatc

SEQ ID NO: 347716 - DNA, 16 bp, M. musculus
acacacacgcacacgc

SEQ ID NO: 347717 - DNA, 16 bp, M. musculus
acacacacgcacgcac

SEQ ID NO: 347718 - DNA, 16 bp, M. musculus
acacacacgtacacac

SEQ ID NO: 347719 - DNA, 16 bp, M. musculus
acacacacgtacacat

SEQ ID NO: 347720 - DNA, 16 bp, M. musculus
acacacacgtacatat

SEQ ID NO: 347721 - DNA, 16 bp, M. musculus
acacacacgtatatac

SEQ ID NO: 347722 - DNA, 16 bp, M. musculus
acacacactcacacag

SEQ ID NO: 347723 - DNA, 16 bp, M. musculus
acacacactcacacat

SEQ ID NO: 347724 - DNA, 16 bp, M. musculus
acacacactcacacgc

SEQ ID NO: 347725 - DNA, 16 bp, M. musculus
acacacactcacactc

SEQ ID NO: 347726 - DNA, 16 bp, M. musculus
acacacactcactcac

SEQ ID NO: 347727 - DNA, 16 bp, M. musculus
acacacactcactcat

SEQ ID NO: 347728 - DNA, 16 bp, M. musculus
acacacactcactcca

SEQ ID NO: 347729 - DNA, 16 bp, M. musculus
acacacactcatatat

SEQ ID NO: 347730 - DNA, 16 bp, M. musculus
acacacactctcacat

SEQ ID NO: 347731 - DNA, 16 bp, M. musculus
acacacactctcactc

SEQ ID NO: 347732 - DNA, 16 bp, M. musculus
acacacactgccacac

SEQ ID NO: 347733 - DNA, 16 bp, M. musculus
acacacacttttaaaa

SEQ ID NO: 347734 - DNA, 16 bp, M. musculus
acacacagaaactctg

SEQ ID NO: 347735 - DNA, 16 bp, M. musculus
acacacagaagcacat

SEQ ID NO: 347736 - DNA, 16 bp, M. musculus
acacacagacacaggc

SEQ ID NO: 347737 - DNA, 16 bp, M. musculus
acacacagacacccag

SEQ ID NO: 347738 - DNA, 16 bp, M. musculus
acacacagacagaggg

SEQ ID NO: 347739 - DNA, 16 bp, M. musculus
acacacagacgcacac

SEQ ID NO: 347740 - DNA, 16 bp, M. musculus
acacacagagaaaccc

SEQ ID NO: 347741 - DNA, 16 bp, M. musculus
acacacagagacagat

SEQ ID NO: 347742 - DNA, 16 bp, M. musculus
acacacagagagaaac

SEQ ID NO: 347743 - DNA, 16 bp, M. musculus
acacacagagagatgc

SEQ ID NO: 347744 - DNA, 16 bp, M. musculus
acacacagaggagaaa

SEQ ID NO: 347745 - DNA, 16 bp, M. musculus
acacacagatacacat

SEQ ID NO: 347746 - DNA, 16 bp, M. musculus
acacacagatgggagc

SEQ ID NO: 347747 - DNA, 16 bp, M. musculus
acacacagccacacat

SEQ ID NO: 347748 - DNA, 16 bp, M. musculus
acacacagctgcacac

SEQ ID NO: 347749 - DNA, 16 bp, M. musculus
acacacaggacacaca

SEQ ID NO: 347750 - DNA, 16 bp, M. musculus
acacacaggacacaga

SEQ ID NO: 347751 - DNA, 16 bp, M. musculus
acacacaggcaggcac

SEQ ID NO: 347752 - DNA, 16 bp, M. musculus
acacacagtctttata

SEQ ID NO: 347753 - DNA, 16 bp, M. musculus
acacacatacacagaa

SEQ ID NO: 347754 - DNA, 16 bp, M. musculus
acacacatacacaggt

SEQ ID NO: 347755 - DNA, 16 bp, M. musculus
acacacatacacatct

SEQ ID NO: 347756 - DNA, 16 bp, M. musculus
acacacatacactgca

SEQ ID NO: 347757 - DNA, 17 bp, M. musculus
acacacatacatacatg

SEQ ID NO: 347758 - DNA, 16 bp, M. musculus
acacacatacatacgt

SEQ ID NO: 347759 - DNA, 16 bp, M. musculus
acacacatacatgtgt

SEQ ID NO: 347760 - DNA, 16 bp, M. musculus
acacacataccataca

SEQ ID NO: 347761 - DNA, 16 bp, M. musculus
acacacatacttttaa

SEQ ID NO: 347762 - DNA, 16 bp, M. musculus
acacacatagagaaac

SEQ ID NO: 347763 - DNA, 16 bp, M. musculus
acacacatagatatat

SEQ ID NO: 347764 - DNA, 16 bp, M. musculus
acacacatatacacat

SEQ ID NO: 347765 - DNA, 16 bp, M. musculus
acacacatatatatga

SEQ ID NO: 347766 - DNA, 16 bp, M. musculus
acacacatatatgcac

SEQ ID NO: 347767 - DNA, 16 bp, M. musculus
acacacatatattcct

SEQ ID NO: 347768 - DNA, 16 bp, M. musculus
acacacatatgcatat

SEQ ID NO: 347769 - DNA, 16 bp, M. musculus
acacacatattatata

SEQ ID NO: 347770 - DNA, 16 bp, M. musculus
acacacatcacagaca

SEQ ID NO: 347771 - DNA, 16 bp, M. musculus
acacacatcacataca

SEQ ID NO: 347772 - DNA, 16 bp, M. musculus
acacacatcactcaca

SEQ ID NO: 347773 - DNA, 16 bp, M. musculus
acacacatccacacag

SEQ ID NO: 347774 - DNA, 16 bp, M. musculus
acacacatgaacacat

SEQ ID NO: 347775 - DNA, 16 bp, M. musculus
acacacatgaacatat

SEQ ID NO: 347776 - DNA, 16 bp, M. musculus
acacacatgacacaca

SEQ ID NO: 347777 - DNA, 16 bp, M. musculus
acacacatgagaaaga

SEQ ID NO: 347778 - DNA, 16 bp, M. musculus
acacacatgcaagcac

SEQ ID NO: 347779 - DNA, 16 bp, M. musculus
acacacatgcacaaat

SEQ ID NO: 347780 - DNA, 16 bp, M. musculus
acacacatgcatacat

SEQ ID NO: 347781 - DNA, 16 bp, M. musculus
acacacatgctcacac

SEQ ID NO: 347782 - DNA, 16 bp, M. musculus
acacacatgctcatgt

SEQ ID NO: 347783 - DNA, 16 bp, M. musculus
acacacatggagggac

SEQ ID NO: 347784 - DNA, 16 bp, M. musculus
acacacatggcatgca

SEQ ID NO: 347785 - DNA, 16 bp, M. musculus
acacacatggtacata

SEQ ID NO: 347786 - DNA, 16 bp, M. musculus
acacacatgtaaatgt

SEQ ID NO: 347787 - DNA, 16 bp, M. musculus
acacacatgtacacac

SEQ ID NO: 347788 - DNA, 16 bp, M. musculus
acacacatgtacatac

SEQ ID NO: 347789 - DNA, 16 bp, M. musculus
acacacatgtgaaaat

SEQ ID NO: 347790 - DNA, 16 bp, M. musculus
acacacatgtgcacag

SEQ ID NO: 347791 - DNA, 16 bp, M. musculus
acacacatgtgcatgt

SEQ ID NO: 347792 - DNA, 16 bp, M. musculus
acacacatgtgtgcat

SEQ ID NO: 347793 - DNA, 16 bp, M. musculus
acacacattacacaca

SEQ ID NO: 347794 - DNA, 16 bp, M. musculus
acacacattatataca

SEQ ID NO: 347795 - DNA, 16 bp, M. musculus
acacacattcacagag

SEQ ID NO: 347796 - DNA, 16 bp, M. musculus
acacacattcattcat

SEQ ID NO: 347797 - DNA, 16 bp, M. musculus
acacacatttaaaata

SEQ ID NO: 347798 - DNA, 16 bp, M. musculus
acacacatttgcacat

SEQ ID NO: 347799 - DNA, 16 bp, M. musculus
acacacatttgtgtgt

SEQ ID NO: 347800 - DNA, 16 bp, M. musculus
acacacatttgtttgt

SEQ ID NO: 347801 - DNA, 16 bp, M. musculus
acacaccaaataaatg

SEQ ID NO: 347802 - DNA, 16 bp, M. musculus
acacaccaccatgccc

SEQ ID NO: 347803 - DNA, 16 bp, M. musculus
acacaccagaagatgg

SEQ ID NO: 347804 - DNA, 16 bp, M. musculus
acacaccagagctcca

SEQ ID NO: 347805 - DNA, 16 bp, M. musculus
acacaccagatgaggg

SEQ ID NO: 347806 - DNA, 16 bp, M. musculus
acacacccactcctgc

SEQ ID NO: 347807 - DNA, 16 bp, M. musculus
acacaccccacatgca

SEQ ID NO: 347808 - DNA, 16 bp, M. musculus
acacacctaaccccag

SEQ ID NO: 347809 - DNA, 16 bp, M. musculus
acacacctatagtccc

SEQ ID NO: 347810 - DNA, 16 bp, M. musculus
acacacctatgatcac

SEQ ID NO: 347811 - DNA, 16 bp, M. musculus
acacacctcctccatc

SEQ ID NO: 347812 - DNA, 16 bp, M. musculus
acacacctctctgcag

SEQ ID NO: 347813 - DNA, 17 bp, M. musculus
acacacctgaaaagcta

SEQ ID NO: 347814 - DNA, 16 bp, M. musculus
acacacctgcatacac

SEQ ID NO: 347815 - DNA, 16 bp, M. musculus
acacacctgtaatctc

SEQ ID NO: 347816 - DNA, 16 bp, M. musculus
acacaccttcacacac

SEQ ID NO: 347817 - DNA, 16 bp, M. musculus
acacacctttaatccc

SEQ ID NO: 347818 - DNA, 16 bp, M. musculus
acacacctttagtccc

SEQ ID NO: 347819 - DNA, 16 bp, M. musculus
acacacgcacacatgc

SEQ ID NO: 347820 - DNA, 16 bp, M. musculus
acacacgcacacgcac

SEQ ID NO: 347821 - DNA, 19 bp, M. musculus
acacacgcacacgcacaca

SEQ ID NO: 347822 - DNA, 16 bp, M. musculus
acacacgcatacacaa

SEQ ID NO: 347823 - DNA, 16 bp, M. musculus
acacacggacacacag

SEQ ID NO: 347824 - DNA, 16 bp, M. musculus
acacacggtggctcac

SEQ ID NO: 347825 - DNA, 16 bp, M. musculus
acacactcacacgcat

SEQ ID NO: 347826 - DNA, 16 bp, M. musculus
acacactcacactctc

SEQ ID NO: 347827 - DNA, 16 bp, M. musculus
acacactcacactttc

SEQ ID NO: 347828 - DNA, 16 bp, M. musculus
acacactcagacactc

SEQ ID NO: 347829 - DNA, 16 bp, M. musculus
acacactcatgtatgt

SEQ ID NO: 347830 - DNA, 16 bp, M. musculus
acacactgaaaagaaa

SEQ ID NO: 347831 - DNA, 16 bp, M. musculus
acacactgaaattaac

SEQ ID NO: 347832 - DNA, 16 bp, M. musculus
acacactgattttttt

SEQ ID NO: 347833 - DNA, 16 bp, M. musculus
acacactgcacacagg

SEQ ID NO: 347834 - DNA, 16 bp, M. musculus
acacacttacacactc

SEQ ID NO: 347835 - DNA, 16 bp, M. musculus
acacacttacatacac

SEQ ID NO: 347836 - DNA, 16 bp, M. musculus
acacacttatacacat

SEQ ID NO: 347837 - DNA, 16 bp, M. musculus
acacacttcagtgaca

SEQ ID NO: 347838 - DNA, 16 bp, M. musculus
acacagaaaaagcctg

SEQ ID NO: 347839 - DNA, 16 bp, M. musculus
acacagaaaaatattt

SEQ ID NO: 347840 - DNA, 16 bp, M. musculus
acacagaaaagccctg

SEQ ID NO: 347841 - DNA, 16 bp, M. musculus
acacagaaaatacaga

SEQ ID NO: 347842 - DNA, 16 bp, M. musculus
acacagaaaattaaat

SEQ ID NO: 347843 - DNA, 16 bp, M. musculus
acacagaaacagagag

SEQ ID NO: 347844 - DNA, 16 bp, M. musculus
acacagaaacatgcac

SEQ ID NO: 347845 - DNA, 17 bp, M. musculus
acacagaaaccctgtct

SEQ ID NO: 347846 - DNA, 16 bp, M. musculus
acacagaaagaatatt

SEQ ID NO: 347847 - DNA, 16 bp, M. musculus
acacagaacagaacag

SEQ ID NO: 347848 - DNA, 16 bp, M. musculus
acacagaagagaggat

SEQ ID NO: 347849 - DNA, 16 bp, M. musculus
acacagaagcagtctg

SEQ ID NO: 347850 - DNA, 16 bp, M. musculus
acacagaagccagaag

SEQ ID NO: 347851 - DNA, 16 bp, M. musculus
acacagaagccagaga

SEQ ID NO: 347852 - DNA, 17 bp, M. musculus
acacagaagtggatgat

SEQ ID NO: 347853 - DNA, 16 bp, M. musculus
acacagaattaaaata

SEQ ID NO: 347854 - DNA, 16 bp, M. musculus
acacagacacaaataa

SEQ ID NO: 347855 - DNA, 16 bp, M. musculus
acacagacacaaatgt

SEQ ID NO: 347856 - DNA, 17 bp, M. musculus
acacagacacagacaca

SEQ ID NO: 347857 - DNA, 16 bp, M. musculus
acacagacacagcaca

SEQ ID NO: 347858 - DNA, 16 bp, M. musculus
acacagacacatacag

SEQ ID NO: 347859 - DNA, 16 bp, M. musculus
acacagacacatacat

SEQ ID NO: 347860 - DNA, 16 bp, M. musculus
acacagacaccataca

SEQ ID NO: 347861 - DNA, 16 bp, M. musculus
acacagacagacagac

SEQ ID NO: 347862 - DNA, 16 bp, M. musculus
acacagacatactcac

SEQ ID NO: 347863 - DNA, 16 bp, M. musculus
acacagacattcacat

SEQ ID NO: 347864 - DNA, 16 bp, M. musculus
acacagacatttcttt

SEQ ID NO: 347865 - DNA, 16 bp, M. musculus
acacagacgacacaga

SEQ ID NO: 347866 - DNA, 16 bp, M. musculus
acacagactcagacac

SEQ ID NO: 347867 - DNA, 16 bp, M. musculus
acacagagaaacactg

SEQ ID NO: 347868 - DNA, 16 bp, M. musculus
acacagagaaaccaga

SEQ ID NO: 347869 - DNA, 16 bp, M. musculus
acacagagaaaccctc

SEQ ID NO: 347870 - DNA, 16 bp, M. musculus
acacagagaaaccttg

SEQ ID NO: 347871 - DNA, 16 bp, M. musculus
acacagagaaagacag

SEQ ID NO: 347872 - DNA, 16 bp, M. musculus
acacagagaaagcaga

SEQ ID NO: 347873 - DNA, 16 bp, M. musculus
acacagagaaagccag

SEQ ID NO: 347874 - DNA, 16 bp, M. musculus
acacagagaaagcctg

SEQ ID NO: 347875 - DNA, 16 bp, M. musculus
acacagagaaatcaaa

SEQ ID NO: 347876 - DNA, 16 bp, M. musculus
acacagagaaatgctg

SEQ ID NO: 347877 - DNA, 16 bp, M. musculus
acacagagaagaaacc

SEQ ID NO: 347878 - DNA, 16 bp, M. musculus
acacagagaagcacag

SEQ ID NO: 347879 - DNA, 16 bp, M. musculus
acacagagaatcctgt

SEQ ID NO: 347880 - DNA, 16 bp, M. musculus
acacagagacacagag

SEQ ID NO: 347881 - DNA, 16 bp, M. musculus
acacagagacagagag

SEQ ID NO: 347882 - DNA, 16 bp, M. musculus
acacagagacaggcac

SEQ ID NO: 347883 - DNA, 16 bp, M. musculus
acacagagacctacaa

SEQ ID NO: 347884 - DNA, 16 bp, M. musculus
acacagagagaaatac

SEQ ID NO: 347885 - DNA, 16 bp, M. musculus
acacagagagaaatgg

SEQ ID NO: 347886 - DNA, 16 bp, M. musculus
acacagagagaagaca

SEQ ID NO: 347887 - DNA, 16 bp, M. musculus
acacagagagacacac

SEQ ID NO: 347888 - DNA, 16 bp, M. musculus
acacagagagacactg

SEQ ID NO: 347889 - DNA, 16 bp, M. musculus
acacagagagacccag

SEQ ID NO: 347890 - DNA, 16 bp, M. musculus
acacagagagagcaag

SEQ ID NO: 347891 - DNA, 16 bp, M. musculus
acacagagagaggagg

SEQ ID NO: 347892 - DNA, 16 bp, M. musculus
acacagagagatacac

SEQ ID NO: 347893 - DNA, 16 bp, M. musculus
acacagagcagagaga

SEQ ID NO: 347894 - DNA, 16 bp, M. musculus
acacagagcaggagac

SEQ ID NO: 347895 - DNA, 16 bp, M. musculus
acacagaggaacacac

SEQ ID NO: 347896 - DNA, 16 bp, M. musculus
acacagaggcagggag

SEQ ID NO: 347897 - DNA, 16 bp, M. musculus
acacagaggccagaga

SEQ ID NO: 347898 - DNA, 16 bp, M. musculus
acacagaggccagcag

SEQ ID NO: 347899 - DNA, 16 bp, M. musculus
acacagaggccaggga

SEQ ID NO: 347900 - DNA, 16 bp, M. musculus
acacagaggggagaga

SEQ ID NO: 347901 - DNA, 16 bp, M. musculus
acacagaggtcacacc

SEQ ID NO: 347902 - DNA, 16 bp, M. musculus
acacagagtcacacag

SEQ ID NO: 347903 - DNA, 16 bp, M. musculus
acacagagttccaggc

SEQ ID NO: 347904 - DNA, 16 bp, M. musculus
acacagatacacacag

SEQ ID NO: 347905 - DNA, 16 bp, M. musculus
acacagatacacatac

SEQ ID NO: 347906 - DNA, 16 bp, M. musculus
acacagatatatagat

SEQ ID NO: 347907 - DNA, 16 bp, M. musculus
acacagatatttactt

SEQ ID NO: 347908 - DNA, 16 bp, M. musculus
acacagatgcagacac

SEQ ID NO: 347909 - DNA, 16 bp, M. musculus
acacagcaaattccag

SEQ ID NO: 347910 - DNA, 16 bp, M. musculus
acacagcaagcaggtg

SEQ ID NO: 347911 - DNA, 16 bp, M. musculus
acacagcaagttcaaa

SEQ ID NO: 347912 - DNA, 16 bp, M. musculus
acacagcacagcacag

SEQ ID NO: 347913 - DNA, 16 bp, M. musculus
acacagcacaggctgg

SEQ ID NO: 347914 - DNA, 16 bp, M. musculus
acacagcacctgcccc

SEQ ID NO: 347915 - DNA, 16 bp, M. musculus
acacagcagaagacag

SEQ ID NO: 347916 - DNA, 16 bp, M. musculus
acacagcaggaaggtg

SEQ ID NO: 347917 - DNA, 16 bp, M. musculus
acacagcaggacacag

SEQ ID NO: 347918 - DNA, 16 bp, M. musculus
acacagcatctgctcc

SEQ ID NO: 347919 - DNA, 16 bp, M. musculus
acacagccagttccag

SEQ ID NO: 347920 - DNA, 16 bp, M. musculus
acacagcccaggctgg

SEQ ID NO: 347921 - DNA, 16 bp, M. musculus
acacagcccctgcccc

SEQ ID NO: 347922 - DNA, 16 bp, M. musculus
acacagcctctctcct

SEQ ID NO: 347923 - DNA, 16 bp, M. musculus
acacagcctggcctga

SEQ ID NO: 347924 - DNA, 16 bp, M. musculus
acacagctataccact

SEQ ID NO: 347925 - DNA, 16 bp, M. musculus
acacagctcctgggaa

SEQ ID NO: 347926 - DNA, 16 bp, M. musculus
acacagctctggggag

SEQ ID NO: 347927 - DNA, 16 bp, M. musculus
acacagctggatttat

SEQ ID NO: 347928 - DNA, 16 bp, M. musculus
acacagctgggtgtgg

SEQ ID NO: 347929 - DNA, 16 bp, M. musculus
acacagcttctaggaa

SEQ ID NO: 347930 - DNA, 16 bp, M. musculus
acacaggaaaatacaa

SEQ ID NO: 347931 - DNA, 16 bp, M. musculus
acacaggaaagaatgt

SEQ ID NO: 347932 - DNA, 16 bp, M. musculus
acacaggaatttacca

SEQ ID NO: 347933 - DNA, 16 bp, M. musculus
acacaggagaagacag

SEQ ID NO: 347934 - DNA, 16 bp, M. musculus
acacaggagctggcca

SEQ ID NO: 347935 - DNA, 16 bp, M. musculus
acacaggcaaacacat

SEQ ID NO: 347936 - DNA, 16 bp, M. musculus
acacaggcacaggcac

SEQ ID NO: 347937 - DNA, 16 bp, M. musculus
acacaggcagagctgc

SEQ ID NO: 347938 - DNA, 16 bp, M. musculus
acacaggcctttaatc

SEQ ID NO: 347939 - DNA, 16 bp, M. musculus
acacaggctggtctga

SEQ ID NO: 347940 - DNA, 16 bp, M. musculus
acacaggcttgcagaa

SEQ ID NO: 347941 - DNA, 16 bp, M. musculus
acacaggcttgcagga

SEQ ID NO: 347942 - DNA, 16 bp, M. musculus
acacagggaaacagaa

SEQ ID NO: 347943 - DNA, 16 bp, M. musculus
acacagggacacagag

SEQ ID NO: 347944 - DNA, 16 bp, M. musculus
acacagggacccagag

SEQ ID NO: 347945 - DNA, 16 bp, M. musculus
acacagggagggagag

SEQ ID NO: 347946 - DNA, 16 bp, M. musculus
acacaggtatatacac

SEQ ID NO: 347947 - DNA, 16 bp, M. musculus
acacaggtgacaacac

SEQ ID NO: 347948 - DNA, 16 bp, M. musculus
acacaggtgcacatgc

SEQ ID NO: 347949 - DNA, 16 bp, M. musculus
acacaggtggctggcc

SEQ ID NO: 347950 - DNA, 16 bp, M. musculus
acacagtacacatgca

SEQ ID NO: 347951 - DNA, 16 bp, M. musculus
acacagtagaggactt

SEQ ID NO: 347952 - DNA, 16 bp, M. musculus
acacagtaggactgcc

SEQ ID NO: 347953 - DNA, 16 bp, M. musculus
acacagtcctgggagc

SEQ ID NO: 347954 - DNA, 16 bp, M. musculus
acacagtgaaaatggc

SEQ ID NO: 347955 - DNA, 16 bp, M. musculus
acacagtgaaattctg

SEQ ID NO: 347956 - DNA, 16 bp, M. musculus
acacagtgagctccag

SEQ ID NO: 347957 - DNA, 16 bp, M. musculus
acacagtgaggccttg

SEQ ID NO: 347958 - DNA, 16 bp, M. musculus
acacagtgagttccag

SEQ ID NO: 347959 - DNA, 16 bp, M. musculus
acacagtgcacagaca

SEQ ID NO: 347960 - DNA, 16 bp, M. musculus
acacagtgctggagaa

SEQ ID NO: 347961 - DNA, 16 bp, M. musculus
acacagtgctggggat

SEQ ID NO: 347962 - DNA, 16 bp, M. musculus
acacagtggaaaaaaa

SEQ ID NO: 347963 - DNA, 16 bp, M. musculus
acacagtggaagaaaa

SEQ ID NO: 347964 - DNA, 16 bp, M. musculus
acacagtggctcataa

SEQ ID NO: 347965 - DNA, 16 bp, M. musculus
acacagtgtgcacaca

SEQ ID NO: 347966 - DNA, 16 bp, M. musculus
acacagtttatagcca

SEQ ID NO: 347967 - DNA, 16 bp, M. musculus
acacagtttcaaacag

SEQ ID NO: 347968 - DNA, 16 bp, M. musculus
acacagttttattttt

SEQ ID NO: 347969 - DNA, 16 bp, M. musculus
acacataaaaatagat

SEQ ID NO: 347970 - DNA, 16 bp, M. musculus
acacataaaatgaaat

SEQ ID NO: 347971 - DNA, 16 bp, M. musculus
acacataaacactcac

SEQ ID NO: 347972 - DNA, 16 bp, M. musculus
acacataaacatatgt

SEQ ID NO: 347973 - DNA, 16 bp, M. musculus
acacataaactcacat

SEQ ID NO: 347974 - DNA, 16 bp, M. musculus
acacataagtaaaaat

SEQ ID NO: 347975 - DNA, 16 bp, M. musculus
acacataagtacacac

SEQ ID NO: 347976 - DNA, 16 bp, M. musculus
acacataataattaga

SEQ ID NO: 347977 - DNA, 16 bp, M. musculus
acacatacacacaaag

SEQ ID NO: 347978 - DNA, 16 bp, M. musculus
acacatacacacacag

SEQ ID NO: 347979 - DNA, 16 bp, M. musculus
acacatacacacacat

SEQ ID NO: 347980 - DNA, 16 bp, M. musculus
acacatacacacatat

SEQ ID NO: 347981 - DNA, 16 bp, M. musculus
acacatacacactcat

SEQ ID NO: 347982 - DNA, 16 bp, M. musculus
acacatacacagagac

SEQ ID NO: 347983 - DNA, 16 bp, M. musculus
acacatacacagtaca

SEQ ID NO: 347984 - DNA, 16 bp, M. musculus
acacatacacatagtt

SEQ ID NO: 347985 - DNA, 16 bp, M. musculus
acacatacacatatgt

SEQ ID NO: 347986 - DNA, 16 bp, M. musculus
acacatacacatctat

SEQ ID NO: 347987 - DNA, 16 bp, M. musculus
acacatacacatgtga

SEQ ID NO: 347988 - DNA, 16 bp, M. musculus
acacatacacctatac

SEQ ID NO: 347989 - DNA, 16 bp, M. musculus
acacatacatatacct

SEQ ID NO: 347990 - DNA, 16 bp, M. musculus
acacatacatatatat

SEQ ID NO: 347991 - DNA, 16 bp, M. musculus
acacatacatatgcac

SEQ ID NO: 347992 - DNA, 16 bp, M. musculus
acacatacatgaatgc

SEQ ID NO: 347993 - DNA, 16 bp, M. musculus
acacatacatgtaaaa

SEQ ID NO: 347994 - DNA, 16 bp, M. musculus
acacatactacacaca

SEQ ID NO: 347995 - DNA, 16 bp, M. musculus
acacatatacatatat

SEQ ID NO: 347996 - DNA, 16 bp, M. musculus
acacatatacatgcat

SEQ ID NO: 347997 - DNA, 16 bp, M. musculus
acacatatacgtatat

SEQ ID NO: 347998 - DNA, 16 bp, M. musculus
acacatatactacaca

SEQ ID NO: 347999 - DNA, 16 bp, M. musculus
acacatatatacataa

SEQ ID NO: 348000 - DNA, 16 bp, M. musculus
acacatatatataaag

SEQ ID NO: 348001 - DNA, 16 bp, M. musculus
acacatatatgaacac

SEQ ID NO: 348002 - DNA, 16 bp, M. musculus
acacatatatgctcac

SEQ ID NO: 348003 - DNA, 16 bp, M. musculus
acacatatatgtgtgt

SEQ ID NO: 348004 - DNA, 16 bp, M. musculus
acacatatatttgcat

SEQ ID NO: 348005 - DNA, 16 bp, M. musculus
acacatatcatacaca

SEQ ID NO: 348006 - DNA, 16 bp, M. musculus
acacatatgcacacat

SEQ ID NO: 348007 - DNA, 16 bp, M. musculus
acacatatgcatatat

SEQ ID NO: 348008 - DNA, 16 bp, M. musculus
acacatatgcatatgt

SEQ ID NO: 348009 - DNA, 16 bp, M. musculus
acacatatggtatata

SEQ ID NO: 348010 - DNA, 16 bp, M. musculus
acacatatgtagacac

SEQ ID NO: 348011 - DNA, 16 bp, M. musculus
acacatatgtagcata

SEQ ID NO: 348012 - DNA, 16 bp, M. musculus
acacatatgtatgtat

SEQ ID NO: 348013 - DNA, 16 bp, M. musculus
acacatatgtgcaggc

SEQ ID NO: 348014 - DNA, 16 bp, M. musculus
acacatattacacata

SEQ ID NO: 348015 - DNA, 16 bp, M. musculus
acacatatttatttat

SEQ ID NO: 348016 - DNA, 16 bp, M. musculus
acacatatttgtatat

SEQ ID NO: 348017 - DNA, 16 bp, M. musculus
acacatatttttttaa

SEQ ID NO: 348018 - DNA, 16 bp, M. musculus
acacatcaaaataatc

SEQ ID NO: 348019 - DNA, 16 bp, M. musculus
acacatcacacacata

SEQ ID NO: 348020 - DNA, 16 bp, M. musculus
acacatccatacatat

SEQ ID NO: 348021 - DNA, 16 bp, M. musculus
acacatctcctggcac

SEQ ID NO: 348022 - DNA, 16 bp, M. musculus
acacatgaaagcaaaa

SEQ ID NO: 348023 - DNA, 16 bp, M. musculus
acacatgaataaaaat

SEQ ID NO: 348024 - DNA, 16 bp, M. musculus
acacatgaatgtgtat

SEQ ID NO: 348025 - DNA, 16 bp, M. musculus
acacatgagcatgcac

SEQ ID NO: 348026 - DNA, 16 bp, M. musculus
acacatgatgcacaga

SEQ ID NO: 348027 - DNA, 16 bp, M. musculus
acacatgcaagcaaaa

SEQ ID NO: 348028 - DNA, 16 bp, M. musculus
acacatgcaatacaca

SEQ ID NO: 348029 - DNA, 16 bp, M. musculus
acacatgcacaaatgt

SEQ ID NO: 348030 - DNA, 16 bp, M. musculus
acacatgcacacacaa

SEQ ID NO: 348031 - DNA, 16 bp, M. musculus
acacatgcacacacag

SEQ ID NO: 348032 - DNA, 16 bp, M. musculus
acacatgcacacacat

SEQ ID NO: 348033 - DNA, 16 bp, M. musculus
acacatgcacacagag

SEQ ID NO: 348034 - DNA, 16 bp, M. musculus
acacatgcacacatat

SEQ ID NO: 348035 - DNA, 16 bp, M. musculus
acacatgcacatacat

SEQ ID NO: 348036 - DNA, 16 bp, M. musculus
acacatgcacatatac

SEQ ID NO: 348037 - DNA, 16 bp, M. musculus
acacatgcacatgcat

SEQ ID NO: 348038 - DNA, 16 bp, M. musculus
acacatgcagagagag

SEQ ID NO: 348039 - DNA, 16 bp, M. musculus
acacatgcaggtaaaa

SEQ ID NO: 348040 - DNA, 16 bp, M. musculus
acacatgctcacactc

SEQ ID NO: 348041 - DNA, 16 bp, M. musculus
acacatggaaggaccc

SEQ ID NO: 348042 - DNA, 19 bp, M. musculus
acacatggattccgagaac

SEQ ID NO: 348043 - DNA, 16 bp, M. musculus
acacatgggcacagag

SEQ ID NO: 348044 - DNA, 16 bp, M. musculus
acacatggtgctggag

SEQ ID NO: 348045 - DNA, 17 bp, M. musculus
acacatggtggctcaca

SEQ ID NO: 348046 - DNA, 16 bp, M. musculus
acacatgtagtgcaca

SEQ ID NO: 348047 - DNA, 16 bp, M. musculus
acacatgtataatata

SEQ ID NO: 348048 - DNA, 16 bp, M. musculus
acacatgtatatatgt

SEQ ID NO: 348049 - DNA, 16 bp, M. musculus
acacatgtatgtaaca

SEQ ID NO: 348050 - DNA, 16 bp, M. musculus
acacatgtatttatat

SEQ ID NO: 348051 - DNA, 16 bp, M. musculus
acacatgtgatgcaca

SEQ ID NO: 348052 - DNA, 16 bp, M. musculus
acacatgtgcacacat

SEQ ID NO: 348053 - DNA, 16 bp, M. musculus
acacatgtgcctgtgt

SEQ ID NO: 348054 - DNA, 16 bp, M. musculus
acacatgtgctcatgc

SEQ ID NO: 348055 - DNA, 16 bp, M. musculus
acacatgtggtatgta

SEQ ID NO: 348056 - DNA, 16 bp, M. musculus
acacatgtgtacctgt

SEQ ID NO: 348057 - DNA, 16 bp, M. musculus
acacatgtgtagcaga

SEQ ID NO: 348058 - DNA, 16 bp, M. musculus
acacatgtgtatatgt

SEQ ID NO: 348059 - DNA, 16 bp, M. musculus
acacatgtgtgcatgc

SEQ ID NO: 348060 - DNA, 16 bp, M. musculus
acacatgtgtgtgtaa

SEQ ID NO: 348061 - DNA, 16 bp, M. musculus
acacatgtgtgtgtgt

SEQ ID NO: 348062 - DNA, 16 bp, M. musculus
acacattaaaatattt

SEQ ID NO: 348063 - DNA, 16 bp, M. musculus
acacattaataatggg

SEQ ID NO: 348064 - DNA, 16 bp, M. musculus
acacattacagcttcc

SEQ ID NO: 348065 - DNA, 16 bp, M. musculus
acacattcaaacacat

SEQ ID NO: 348066 - DNA, 16 bp, M. musculus
acacattcagaaagga

SEQ ID NO: 348067 - DNA, 16 bp, M. musculus
acacattccaagaaca

SEQ ID NO: 348068 - DNA, 16 bp, M. musculus
acacattgagagagag

SEQ ID NO: 348069 - DNA, 16 bp, M. musculus
acacattgcttcttta

SEQ ID NO: 348070 - DNA, 16 bp, M. musculus
acacatttaaagtttt

SEQ ID NO: 348071 - DNA, 16 bp, M. musculus
acacatttgtaatcct

SEQ ID NO: 348072 - DNA, 16 bp, M. musculus
acacatttttaaagta

SEQ ID NO: 348073 - DNA, 16 bp, M. musculus
acacatttttatttct

SEQ ID NO: 348074 - DNA, 16 bp, M. musculus
acacattttttttcaa

SEQ ID NO: 348075 - DNA, 16 bp, M. musculus
acaccaaagccagaca

SEQ ID NO: 348076 - DNA, 16 bp, M. musculus
acaccaaagggctcaa

SEQ ID NO: 348077 - DNA, 16 bp, M. musculus
acaccaaatgtactaa

SEQ ID NO: 348078 - DNA, 16 bp, M. musculus
acaccaagatatatta

SEQ ID NO: 348079 - DNA, 16 bp, M. musculus
acaccacagcttccac

SEQ ID NO: 348080 - DNA, 16 bp, M. musculus
acaccacaggaaaacc

SEQ ID NO: 348081 - DNA, 16 bp, M. musculus
acaccaccaccacctg

SEQ ID NO: 348082 - DNA, 16 bp, M. musculus
acaccaccagaagttc

SEQ ID NO: 348083 - DNA, 16 bp, M. musculus
acaccaccagaagttt

SEQ ID NO: 348084 - DNA, 17 bp, M. musculus
acaccagaaaagcaaga

SEQ ID NO: 348085 - DNA, 16 bp, M. musculus
acaccagaagagagca

SEQ ID NO: 348086 - DNA, 16 bp, M. musculus
acaccagaagaggaca

SEQ ID NO: 348087 - DNA, 16 bp, M. musculus
acaccagaagagggaa

SEQ ID NO: 348088 - DNA, 16 bp, M. musculus
acaccagaattctcac

SEQ ID NO: 348089 - DNA, 17 bp, M. musculus
acaccagaccaagacag

SEQ ID NO: 348090 - DNA, 16 bp, M. musculus
acaccagatccttctc

SEQ ID NO: 348091 - DNA, 16 bp, M. musculus
acaccagcagcagcag

SEQ ID NO: 348092 - DNA, 16 bp, M. musculus
acaccagccctttgga

SEQ ID NO: 348093 - DNA, 16 bp, M. musculus
acaccagctccagggg

SEQ ID NO: 348094 - DNA, 16 bp, M. musculus
acaccagctctggggg

SEQ ID NO: 348095 - DNA, 16 bp, M. musculus
acaccagctgctcttc

SEQ ID NO: 348096 - DNA, 16 bp, M. musculus
acaccagctttgagga

SEQ ID NO: 348097 - DNA, 16 bp, M. musculus
acaccaggcacacatg

SEQ ID NO: 348098 - DNA, 16 bp, M. musculus
acaccaggcagctcac

SEQ ID NO: 348099 - DNA, 16 bp, M. musculus
acaccaggccaaagca

SEQ ID NO: 348100 - DNA, 16 bp, M. musculus
acaccaggctagctgg

SEQ ID NO: 348101 - DNA, 16 bp, M. musculus
acaccaggctggcttt

SEQ ID NO: 348102 - DNA, 16 bp, M. musculus
acaccagggccaggaa

SEQ ID NO: 348103 - DNA, 16 bp, M. musculus
acaccaggtacacaca

SEQ ID NO: 348104 - DNA, 16 bp, M. musculus
acaccatagcatacac

SEQ ID NO: 348105 - DNA, 16 bp, M. musculus
acaccatatatacata

SEQ ID NO: 348106 - DNA, 16 bp, M. musculus
acaccatcacatacac

SEQ ID NO: 348107 - DNA, 16 bp, M. musculus
acaccatcacatcaga

SEQ ID NO: 348108 - DNA, 16 bp, M. musculus
acaccatcatccacag

SEQ ID NO: 348109 - DNA, 16 bp, M. musculus
acaccatccaaccgac

SEQ ID NO: 348110 - DNA, 16 bp, M. musculus
acaccatccaactgac

SEQ ID NO: 348111 - DNA, 16 bp, M. musculus
acaccatctggccaga

SEQ ID NO: 348112 - DNA, 16 bp, M. musculus
acaccatgaccaaatg

SEQ ID NO: 348113 - DNA, 16 bp, M. musculus
acaccatgaccaaggc

SEQ ID NO: 348114 - DNA, 16 bp, M. musculus
acaccatgaggaactg

SEQ ID NO: 348115 - DNA, 16 bp, M. musculus
acaccatgatcaaaat

SEQ ID NO: 348116 - DNA, 16 bp, M. musculus
acaccattcctgctac

SEQ ID NO: 348117 - DNA, 16 bp, M. musculus
acacccaagataaaat

SEQ ID NO: 348118 - DNA, 16 bp, M. musculus
acacccacaagaacag

SEQ ID NO: 348119 - DNA, 16 bp, M. musculus
acacccacacacagat

SEQ ID NO: 348120 - DNA, 16 bp, M. musculus
acacccacatagcagc

SEQ ID NO: 348121 - DNA, 16 bp, M. musculus
acacccacatctgtac

SEQ ID NO: 348122 - DNA, 17 bp, M. musculus
acacccaggaacactgg

SEQ ID NO: 348123 - DNA, 16 bp, M. musculus
acacccaggacctcct

SEQ ID NO: 348124 - DNA, 16 bp, M. musculus
acacccaggatcccag

SEQ ID NO: 348125 - DNA, 16 bp, M. musculus
acacccaggatcttga

SEQ ID NO: 348126 - DNA, 16 bp, M. musculus
acacccataatctcag

SEQ ID NO: 348127 - DNA, 17 bp, M. musculus
acaccccaaatcactca

SEQ ID NO: 348128 - DNA, 16 bp, M. musculus
acaccccacacacatg

SEQ ID NO: 348129 - DNA, 16 bp, M. musculus
acaccccactctcatt

SEQ ID NO: 348130 - DNA, 16 bp, M. musculus
acaccccagaagagga

SEQ ID NO: 348131 - DNA, 16 bp, M. musculus
acacccccaagggccc

SEQ ID NO: 348132 - DNA, 16 bp, M. musculus
acaccccttcatgtta

SEQ ID NO: 348133 - DNA, 16 bp, M. musculus
acaccccttctctcag

SEQ ID NO: 348134 - DNA, 16 bp, M. musculus
acaccctcacacagat

SEQ ID NO: 348135 - DNA, 16 bp, M. musculus
acaccctgacctgcac

SEQ ID NO: 348136 - DNA, 16 bp, M. musculus
acaccctggaaaaagc

SEQ ID NO: 348137 - DNA, 16 bp, M. musculus
acaccctgggccaagc

SEQ ID NO: 348138 - DNA, 16 bp, M. musculus
acaccctgtgtatctg

SEQ ID NO: 348139 - DNA, 16 bp, M. musculus
acacccttaatcccag

SEQ ID NO: 348140 - DNA, 16 bp, M. musculus
acacccttagtacaca

SEQ ID NO: 348141 - DNA, 17 bp, M. musculus
acacctaaaaggtctag

SEQ ID NO: 348142 - DNA, 16 bp, M. musculus
acacctacatggcagc

SEQ ID NO: 348143 - DNA, 16 bp, M. musculus
acacctactttaacaa

SEQ ID NO: 348144 - DNA, 44 bp, M. musculus
acacctagaaagagtaaggggttacaggactggttaaaggtttg

SEQ ID NO: 348145 - DNA, 16 bp, M. musculus
acacctataatcccag

SEQ ID NO: 348146 - DNA, 16 bp, M. musculus
acacctataatctcag

SEQ ID NO: 348147 - DNA, 16 bp, M. musculus
acacctcagtgtacac

SEQ ID NO: 348148 - DNA, 16 bp, M. musculus
acacctcctccaacaa

SEQ ID NO: 348149 - DNA, 16 bp, M. musculus
acacctgaaaaatgtt

SEQ ID NO: 348150 - DNA, 16 bp, M. musculus
acacctgaaatcccag

SEQ ID NO: 348151 - DNA, 16 bp, M. musculus
acacctgacaagaagc

SEQ ID NO: 348152 - DNA, 16 bp, M. musculus
acacctgcaatcccag

SEQ ID NO: 348153 - DNA, 16 bp, M. musculus
acacctgccaccccag

SEQ ID NO: 348154 - DNA, 16 bp, M. musculus
acacctgctccaacaa

SEQ ID NO: 348155 - DNA, 16 bp, M. musculus
acacctggaaccccag

SEQ ID NO: 348156 - DNA, 16 bp, M. musculus
acacctggaatcccag

SEQ ID NO: 348157 - DNA, 16 bp, M. musculus
acacctggcatcctgg

SEQ ID NO: 348158 - DNA, 16 bp, M. musculus
acacctggctcccttc

SEQ ID NO: 348159 - DNA, 16 bp, M. musculus
acacctgggattaaaa

SEQ ID NO: 348160 - DNA, 16 bp, M. musculus
acacctgtaactccag

SEQ ID NO: 348161 - DNA, 16 bp, M. musculus
acacctgtaatcctag

SEQ ID NO: 348162 - DNA, 16 bp, M. musculus
acacctgtaatctctg

SEQ ID NO: 348163 - DNA, 16 bp, M. musculus
acacctgtgatcccag

SEQ ID NO: 348164 - DNA, 16 bp, M. musculus
acacctgtggtcccag

SEQ ID NO: 348165 - DNA, 16 bp, M. musculus
acaccttcaactcctt

SEQ ID NO: 348166 - DNA, 16 bp, M. musculus
acaccttcagcaaagt

SEQ ID NO: 348167 - DNA, 16 bp, M. musculus
acaccttccatcccat

SEQ ID NO: 348168 - DNA, 16 bp, M. musculus
acaccttccctgccag

SEQ ID NO: 348169 - DNA, 16 bp, M. musculus
acaccttcctctggcc

SEQ ID NO: 348170 - DNA, 16 bp, M. musculus
acaccttctccaacaa

SEQ ID NO: 348171 - DNA, 16 bp, M. musculus
acaccttctctgcctc

SEQ ID NO: 348172 - DNA, 16 bp, M. musculus
acaccttgatccaaag

SEQ ID NO: 348173 - DNA, 16 bp, M. musculus
acaccttgtctcaaaa

SEQ ID NO: 348174 - DNA, 16 bp, M. musculus
acacctttaatcccaa

SEQ ID NO: 348175 - DNA, 16 bp, M. musculus
acacctttaatgccag

SEQ ID NO: 348176 - DNA, 16 bp, M. musculus
acacctttaattccag

SEQ ID NO: 348177 - DNA, 16 bp, M. musculus
acacctttaattcctg

SEQ ID NO: 348178 - DNA, 16 bp, M. musculus
acacctttacctgctg

SEQ ID NO: 348179 - DNA, 16 bp, M. musculus
acacctttagtcctag

SEQ ID NO: 348180 - DNA, 16 bp, M. musculus
acacctttagtctcag

SEQ ID NO: 348181 - DNA, 16 bp, M. musculus
acacctttgatctcag

SEQ ID NO: 348182 - DNA, 16 bp, M. musculus
acacgaactctggggg

SEQ ID NO: 348183 - DNA, 16 bp, M. musculus
acacgagctctggggg

SEQ ID NO: 348184 - DNA, 16 bp, M. musculus
acacgcacacacacag

SEQ ID NO: 348185 - DNA, 16 bp, M. musculus
acacgcacacgcacat

SEQ ID NO: 348186 - DNA, 16 bp, M. musculus
acacgcacatgtgcat

SEQ ID NO: 348187 - DNA, 16 bp, M. musculus
acacgcacatgtgtgt

SEQ ID NO: 348188 - DNA, 16 bp, M. musculus
acacgcacgcacacgc

SEQ ID NO: 348189 - DNA, 16 bp, M. musculus
acacgcaggcaaaaca

SEQ ID NO: 348190 - DNA, 16 bp, M. musculus
acacgcatacacgcac

SEQ ID NO: 348191 - DNA, 20 bp, M. musculus
acacgcctttaatcccagca

SEQ ID NO: 348192 - DNA, 22 bp, M. musculus
acacgcgcgcacacacacacac

SEQ ID NO: 348193 - DNA, 16 bp, M. musculus
acacgctcccccacct

SEQ ID NO: 348194 - DNA, 18 bp, M. musculus
acacggacacggacacgg

SEQ ID NO: 348195 - DNA, 16 bp, M. musculus
acacggacatggacac

SEQ ID NO: 348196 - DNA, 16 bp, M. musculus
acacggagacagagca

SEQ ID NO: 348197 - DNA, 16 bp, M. musculus
acacggaggtcagagg

SEQ ID NO: 348198 - DNA, 16 bp, M. musculus
acacgggactccccac

SEQ ID NO: 348199 - DNA, 16 bp, M. musculus
acacgtacacacatgt

SEQ ID NO: 348200 - DNA, 16 bp, M. musculus
acacgtacatatacac

SEQ ID NO: 348201 - DNA, 16 bp, M. musculus
acacgtgcacacacag

SEQ ID NO: 348202 - DNA, 16 bp, M. musculus
acacgtgtatatatat

SEQ ID NO: 348203 - DNA, 16 bp, M. musculus
acacgtgtatgtgtgt

SEQ ID NO: 348204 - DNA, 16 bp, M. musculus
acactaagtaaataaa

SEQ ID NO: 348205 - DNA, 16 bp, M. musculus
acactaatttttttaa

SEQ ID NO: 348206 - DNA, 16 bp, M. musculus
acactacacaaccaag

SEQ ID NO: 348207 - DNA, 16 bp, M. musculus
acactacagtttccac

SEQ ID NO: 348208 - DNA, 16 bp, M. musculus
acactacctcagaggg

SEQ ID NO: 348209 - DNA, 17 bp, M. musculus
acactagcagcttgaca

SEQ ID NO: 348210 - DNA, 16 bp, M. musculus
acactataaccaaggc

SEQ ID NO: 348211 - DNA, 16 bp, M. musculus
acactatatgtatata

SEQ ID NO: 348212 - DNA, 16 bp, M. musculus
acactatgaccaaaac

SEQ ID NO: 348213 - DNA, 17 bp, M. musculus
acactatgttcatagca

SEQ ID NO: 348214 - DNA, 16 bp, M. musculus
acactattaaagatac

SEQ ID NO: 348215 - DNA, 16 bp, M. musculus
acactattatatccag

SEQ ID NO: 348216 - DNA, 16 bp, M. musculus
acactcaagtcttatt

SEQ ID NO: 348217 - DNA, 16 bp, M. musculus
acactcacacacacat

SEQ ID NO: 348218 - DNA, 16 bp, M. musculus
acactcacagtgacac

SEQ ID NO: 348219 - DNA, 16 bp, M. musculus
acactcacatatacat

SEQ ID NO: 348220 - DNA, 16 bp, M. musculus
acactcacatgtgtgc

SEQ ID NO: 348221 - DNA, 16 bp, M. musculus
acactcaggaggctga

SEQ ID NO: 348222 - DNA, 16 bp, M. musculus
acactcaggagtccca

SEQ ID NO: 348223 - DNA, 16 bp, M. musculus
acactcatacacacac

SEQ ID NO: 348224 - DNA, 16 bp, M. musculus
acactcatagacacac

SEQ ID NO: 348225 - DNA, 16 bp, M. musculus
acactcatgtgcatat

SEQ ID NO: 348226 - DNA, 16 bp, M. musculus
acactcctccatttct

SEQ ID NO: 348227 - DNA, 16 bp, M. musculus
acactcctgggagacc

SEQ ID NO: 348228 - DNA, 16 bp, M. musculus
acactcctgggagtcc

SEQ ID NO: 348229 - DNA, 16 bp, M. musculus
acactccttcctgcaa

SEQ ID NO: 348230 - DNA, 16 bp, M. musculus
acactctaccaactga

SEQ ID NO: 348231 - DNA, 16 bp, M. musculus
acactctcatacatac

SEQ ID NO: 348232 - DNA, 16 bp, M. musculus
acactctctctctctc

SEQ ID NO: 348233 - DNA, 16 bp, M. musculus
acactctctctctctt

SEQ ID NO: 348234 - DNA, 16 bp, M. musculus
acactctctctctttt

SEQ ID NO: 348235 - DNA, 16 bp, M. musculus
acactctcttctggct

SEQ ID NO: 348236 - DNA, 16 bp, M. musculus
acactctgccactgag

SEQ ID NO: 348237 - DNA, 16 bp, M. musculus
acactctggaggcaga

SEQ ID NO: 348238 - DNA, 16 bp, M. musculus
acactcttatcaatga

SEQ ID NO: 348239 - DNA, 16 bp, M. musculus
acactgaaattcacca

SEQ ID NO: 348240 - DNA, 16 bp, M. musculus
acactgaagctgttta

SEQ ID NO: 348241 - DNA, 16 bp, M. musculus
acactgactgatcttc

SEQ ID NO: 348242 - DNA, 16 bp, M. musculus
acactgactgctcttc

SEQ ID NO: 348243 - DNA, 16 bp, M. musculus
acactgagaaacccta

SEQ ID NO: 348244 - DNA, 16 bp, M. musculus
acactgagaaagaaat

SEQ ID NO: 348245 - DNA, 16 bp, M. musculus
acactgaggaaattca

SEQ ID NO: 348246 - DNA, 16 bp, M. musculus
acactgaggcaggagg

SEQ ID NO: 348247 - DNA, 16 bp, M. musculus
acactgagggaccctg

SEQ ID NO: 348248 - DNA, 16 bp, M. musculus
acactgattacattca

SEQ ID NO: 348249 - DNA, 16 bp, M. musculus
acactgattttttttt

SEQ ID NO: 348250 - DNA, 16 bp, M. musculus
acactgcaagaatgag

SEQ ID NO: 348251 - DNA, 16 bp, M. musculus
acactgcagctgtaca

SEQ ID NO: 348252 - DNA, 16 bp, M. musculus
acactgcagctgtctt

SEQ ID NO: 348253 - DNA, 16 bp, M. musculus
acactgcatctgcagt

SEQ ID NO: 348254 - DNA, 16 bp, M. musculus
acactgccatgcttcc

SEQ ID NO: 348255 - DNA, 16 bp, M. musculus
acactgctattcatca

SEQ ID NO: 348256 - DNA, 16 bp, M. musculus
acactggaaaaaaaga

SEQ ID NO: 348257 - DNA, 16 bp, M. musculus
acactggagagatggc

SEQ ID NO: 348258 - DNA, 16 bp, M. musculus
acactggagaggctga

SEQ ID NO: 348259 - DNA, 16 bp, M. musculus
acactggagatggaaa

SEQ ID NO: 348260 - DNA, 16 bp, M. musculus
acactggatcccctgt

SEQ ID NO: 348261 - DNA, 16 bp, M. musculus
acactggccagacttg

SEQ ID NO: 348262 - DNA, 16 bp, M. musculus
acactggctggccagc

SEQ ID NO: 348263 - DNA, 16 bp, M. musculus
acactgggaaaaggct

SEQ ID NO: 348264 - DNA, 16 bp, M. musculus
acactgggaagcagga

SEQ ID NO: 348265 - DNA, 16 bp, M. musculus
acactgggactggctt

SEQ ID NO: 348266 - DNA, 16 bp, M. musculus
acactgggcatcatca

SEQ ID NO: 348267 - DNA, 16 bp, M. musculus
acactggggagaggga

SEQ ID NO: 348268 - DNA, 16 bp, M. musculus
acactggttcttaaca

SEQ ID NO: 348269 - DNA, 16 bp, M. musculus
acactgtagctgtctc

SEQ ID NO: 348270 - DNA, 19 bp, M. musculus
acactgtagctgtcttcac

SEQ ID NO: 348271 - DNA, 16 bp, M. musculus
acactgtatgtgtgtg

SEQ ID NO: 348272 - DNA, 16 bp, M. musculus
acactgtctcaaaaaa

SEQ ID NO: 348273 - DNA, 16 bp, M. musculus
acactgtctcagaaaa

SEQ ID NO: 348274 - DNA, 16 bp, M. musculus
acactgtctgtctgtc

SEQ ID NO: 348275 - DNA, 16 bp, M. musculus
acactgtcttaaaaaa

SEQ ID NO: 348276 - DNA, 16 bp, M. musculus
acactgtgacagcaca

SEQ ID NO: 348277 - DNA, 16 bp, M. musculus
acactgtgccccttct

SEQ ID NO: 348278 - DNA, 16 bp, M. musculus
acactgtggcatgcat

SEQ ID NO: 348279 - DNA, 16 bp, M. musculus
acactgtggtcttcct

SEQ ID NO: 348280 - DNA, 16 bp, M. musculus
acactgtgtcccttct

SEQ ID NO: 348281 - DNA, 16 bp, M. musculus
acactgtgttctgcac

SEQ ID NO: 348282 - DNA, 16 bp, M. musculus
acactgttccatgcaa

SEQ ID NO: 348283 - DNA, 16 bp, M. musculus
acacttaatttttaaa

SEQ ID NO: 348284 - DNA, 16 bp, M. musculus
acacttacaaaggaaa

SEQ ID NO: 348285 - DNA, 16 bp, M. musculus
acacttacacacacac

SEQ ID NO: 348286 - DNA, 16 bp, M. musculus
acacttagacaacaga

SEQ ID NO: 348287 - DNA, 16 bp, M. musculus
acacttcatagtcatc

SEQ ID NO: 348288 - DNA, 16 bp, M. musculus
acacttcctccaccaa

SEQ ID NO: 348289 - DNA, 16 bp, M. musculus
acacttcctccagtaa

SEQ ID NO: 348290 - DNA, 16 bp, M. musculus
acacttccttcagcaa

SEQ ID NO: 348291 - DNA, 16 bp, M. musculus
acacttctgtaaggca

SEQ ID NO: 348292 - DNA, 16 bp, M. musculus
acacttcttcattgct

SEQ ID NO: 348293 - DNA, 16 bp, M. musculus
acacttgagaagcaga

SEQ ID NO: 348294 - DNA, 16 bp, M. musculus
acacttgctgctcttc

SEQ ID NO: 348295 - DNA, 16 bp, M. musculus
acacttgctgctcttg

SEQ ID NO: 348296 - DNA, 16 bp, M. musculus
acacttgggaggctga

SEQ ID NO: 348297 - DNA, 16 bp, M. musculus
acacttgggcatcaag

SEQ ID NO: 348298 - DNA, 16 bp, M. musculus
acacttgtaatcctag

SEQ ID NO: 348299 - DNA, 16 bp, M. musculus
acacttgtaattctag

SEQ ID NO: 348300 - DNA, 16 bp, M. musculus
acacttgtgcagcaag

SEQ ID NO: 348301 - DNA, 16 bp, M. musculus
acactttatttcttct

SEQ ID NO: 348302 - DNA, 16 bp, M. musculus
acactttcatcaatgg

SEQ ID NO: 348303 - DNA, 16 bp, M. musculus
acactttcttcaacaa

SEQ ID NO: 348304 - DNA, 16 bp, M. musculus
acactttgaaaaaaaa

SEQ ID NO: 348305 - DNA, 16 bp, M. musculus
acactttgctcattct

SEQ ID NO: 348306 - DNA, 16 bp, M. musculus
acactttggtcttcct

SEQ ID NO: 348307 - DNA, 16 bp, M. musculus
acactttggtcttggt

SEQ ID NO: 348308 - DNA, 16 bp, M. musculus
acacttttttgtttgt

SEQ ID NO: 348309 - DNA, 16 bp, M. musculus
acactttttttttcaa

SEQ ID NO: 348310 - DNA, 16 bp, M. musculus
acagaaaaaaattatg

SEQ ID NO: 348311 - DNA, 16 bp, M. musculus
acagaaaaaaattatt

SEQ ID NO: 348312 - DNA, 17 bp, M. musculus
acagaaaaaccctgtct

SEQ ID NO: 348313 - DNA, 16 bp, M. musculus
acagaaaaaccctgtt

SEQ ID NO: 348314 - DNA, 16 bp, M. musculus
acagaaaaatgcatac

SEQ ID NO: 348315 - DNA, 16 bp, M. musculus
acagaaaacagaaatg

SEQ ID NO: 348316 - DNA, 16 bp, M. musculus
acagaaaacagataat

SEQ ID NO: 348317 - DNA, 16 bp, M. musculus
acagaaaaccacagct

SEQ ID NO: 348318 - DNA, 16 bp, M. musculus
acagaaaaccctgtct

SEQ ID NO: 348319 - DNA, 16 bp, M. musculus
acagaaaacttacaaa

SEQ ID NO: 348320 - DNA, 16 bp, M. musculus
acagaaaagaaagtga

SEQ ID NO: 348321 - DNA, 16 bp, M. musculus
acagaaaagatagctg

SEQ ID NO: 348322 - DNA, 16 bp, M. musculus
acagaaaagcaaacta

SEQ ID NO: 348323 - DNA, 16 bp, M. musculus
acagaaaagctggggt

SEQ ID NO: 348324 - DNA, 16 bp, M. musculus
acagaaaagtaactac

SEQ ID NO: 348325 - DNA, 16 bp, M. musculus
acagaaaagtctgtca

SEQ ID NO: 348326 - DNA, 16 bp, M. musculus
acagaaaatattcaga

SEQ ID NO: 348327 - DNA, 16 bp, M. musculus
acagaaaatcaaggaa

SEQ ID NO: 348328 - DNA, 16 bp, M. musculus
acagaaaatctaagaa

SEQ ID NO: 348329 - DNA, 16 bp, M. musculus
acagaaaattttcagt

SEQ ID NO: 348330 - DNA, 18 bp, M. musculus
acagaaacaaagtatgga

SEQ ID NO: 348331 - DNA, 16 bp, M. musculus
acagaaacactggaaa

SEQ ID NO: 348332 - DNA, 16 bp, M. musculus
acagaaacagaaaatt

SEQ ID NO: 348333 - DNA, 16 bp, M. musculus
acagaaacagagacag

SEQ ID NO: 348334 - DNA, 16 bp, M. musculus
acagaaacagctgacc

SEQ ID NO: 348335 - DNA, 16 bp, M. musculus
acagaaaccctgtctt

SEQ ID NO: 348336 - DNA, 16 bp, M. musculus
acagaaactatgaaag

SEQ ID NO: 348337 - DNA, 16 bp, M. musculus
acagaaactggaaaca

SEQ ID NO: 348338 - DNA, 16 bp, M. musculus
acagaaactgtggcag

SEQ ID NO: 348339 - DNA, 16 bp, M. musculus
acagaaagacacagag

SEQ ID NO: 348340 - DNA, 16 bp, M. musculus
acagaaagatctccca

SEQ ID NO: 348341 - DNA, 16 bp, M. musculus
acagaaagcaagacca

SEQ ID NO: 348342 - DNA, 16 bp, M. musculus
acagaaagccacagag

SEQ ID NO: 348343 - DNA, 16 bp, M. musculus
acagaaagccattgaa

SEQ ID NO: 348344 - DNA, 16 bp, M. musculus
acagaaaggaagtgga

SEQ ID NO: 348345 - DNA, 16 bp, M. musculus
acagaaagggagtgga

SEQ ID NO: 348346 - DNA, 16 bp, M. musculus
acagaaaggggaaata

SEQ ID NO: 348347 - DNA, 16 bp, M. musculus
acagaaataaaaatgt

SEQ ID NO: 348348 - DNA, 16 bp, M. musculus
acagaaataatatttt

SEQ ID NO: 348349 - DNA, 16 bp, M. musculus
acagaaatacaggaga

SEQ ID NO: 348350 - DNA, 16 bp, M. musculus
acagaaatcaagaaca

SEQ ID NO: 348351 - DNA, 16 bp, M. musculus
acagaaatccatcaag

SEQ ID NO: 348352 - DNA, 16 bp, M. musculus
acagaaatttattttt

SEQ ID NO: 348353 - DNA, 16 bp, M. musculus
acagaacacaagagat

SEQ ID NO: 348354 - DNA, 16 bp, M. musculus
acagaacacagagcaa

SEQ ID NO: 348355 - DNA, 16 bp, M. musculus
acagaacacagagcac

SEQ ID NO: 348356 - DNA, 16 bp, M. musculus
acagaacagaacagca

SEQ ID NO: 348357 - DNA, 16 bp, M. musculus
acagaacagagtgggt

SEQ ID NO: 348358 - DNA, 16 bp, M. musculus
acagaacagtgagcca

SEQ ID NO: 348359 - DNA, 16 bp, M. musculus
acagaacccaggattt

SEQ ID NO: 348360 - DNA, 16 bp, M. musculus
acagaacccagggcca

SEQ ID NO: 348361 - DNA, 17 bp, M. musculus
acagaaccccaaataga

SEQ ID NO: 348362 - DNA, 16 bp, M. musculus
acagaacctaggtcct

SEQ ID NO: 348363 - DNA, 16 bp, M. musculus
acagaaccttccccat

SEQ ID NO: 348364 - DNA, 16 bp, M. musculus
acagaactaagcagag

SEQ ID NO: 348365 - DNA, 16 bp, M. musculus
acagaactcagatcct

SEQ ID NO: 348366 - DNA, 16 bp, M. musculus
acagaactccaaaata

SEQ ID NO: 348367 - DNA, 23 bp, M. musculus
acagaactccaaatagactggac

SEQ ID NO: 348368 - DNA, 16 bp, M. musculus
acagaactgactcctg

SEQ ID NO: 348369 - DNA, 16 bp, M. musculus
acagaactggaattag

SEQ ID NO: 348370 - DNA, 16 bp, M. musculus
acagaactttctccaa

SEQ ID NO: 348371 - DNA, 16 bp, M. musculus
acagaagaaaacattt

SEQ ID NO: 348372 - DNA, 16 bp, M. musculus
acagaagaaaaggcca

SEQ ID NO: 348373 - DNA, 16 bp, M. musculus
acagaagaaacagagc

SEQ ID NO: 348374 - DNA, 16 bp, M. musculus
acagaagaaattctgg

SEQ ID NO: 348375 - DNA, 16 bp, M. musculus
acagaagaagaaaatg

SEQ ID NO: 348376 - DNA, 16 bp, M. musculus
acagaagaagcaaagt

SEQ ID NO: 348377 - DNA, 16 bp, M. musculus
acagaagaatgaatac

SEQ ID NO: 348378 - DNA, 16 bp, M. musculus
acagaagacagacaga

SEQ ID NO: 348379 - DNA, 16 bp, M. musculus
acagaagacagccaca

SEQ ID NO: 348380 - DNA, 16 bp, M. musculus
acagaagaccagctga

SEQ ID NO: 348381 - DNA, 16 bp, M. musculus
acagaagacctgagtt

SEQ ID NO: 348382 - DNA, 16 bp, M. musculus
acagaagagaacacag

SEQ ID NO: 348383 - DNA, 16 bp, M. musculus
acagaagagcacagct

SEQ ID NO: 348384 - DNA, 16 bp, M. musculus
acagaagaggaggcag

SEQ ID NO: 348385 - DNA, 16 bp, M. musculus
acagaagaggatgctc

SEQ ID NO: 348386 - DNA, 16 bp, M. musculus
acagaagagggcattg

SEQ ID NO: 348387 - DNA, 16 bp, M. musculus
acagaagatgctggtg

SEQ ID NO: 348388 - DNA, 16 bp, M. musculus
acagaagcaacagagc

SEQ ID NO: 348389 - DNA, 16 bp, M. musculus
acagaagcacagagag

SEQ ID NO: 348390 - DNA, 16 bp, M. musculus
acagaagcagagagag

SEQ ID NO: 348391 - DNA, 16 bp, M. musculus
acagaagcagcagagc

SEQ ID NO: 348392 - DNA, 16 bp, M. musculus
acagaagcaggaggat

SEQ ID NO: 348393 - DNA, 16 bp, M. musculus
acagaagccagagaaa

SEQ ID NO: 348394 - DNA, 16 bp, M. musculus
acagaagccagagatg

SEQ ID NO: 348395 - DNA, 16 bp, M. musculus
acagaagccagaggaa

SEQ ID NO: 348396 - DNA, 16 bp, M. musculus
acagaagccagaggca

SEQ ID NO: 348397 - DNA, 17 bp, M. musculus
acagaagccaggaccac

SEQ ID NO: 348398 - DNA, 16 bp, M. musculus
acagaagccatggagg

SEQ ID NO: 348399 - DNA, 16 bp, M. musculus
acagaagccttctatg

SEQ ID NO: 348400 - DNA, 16 bp, M. musculus
acagaagctaaaagct

SEQ ID NO: 348401 - DNA, 20 bp, M. musculus
acagaagctaacagcttctg

SEQ ID NO: 348402 - DNA, 16 bp, M. musculus
acagaagctgctgaac

SEQ ID NO: 348403 - DNA, 16 bp, M. musculus
acagaagctgttgttt

SEQ ID NO: 348404 - DNA, 16 bp, M. musculus
acagaagctttccagt

SEQ ID NO: 348405 - DNA, 16 bp, M. musculus
acagaagctttgccat

SEQ ID NO: 348406 - DNA, 16 bp, M. musculus
acagaagctttgtgat

SEQ ID NO: 348407 - DNA, 16 bp, M. musculus
acagaaggaacaagct

SEQ ID NO: 348408 - DNA, 16 bp, M. musculus
acagaaggaaggacca

SEQ ID NO: 348409 - DNA, 16 bp, M. musculus
acagaagggtcaggaa

SEQ ID NO: 348410 - DNA, 16 bp, M. musculus
acagaaggtactttac

SEQ ID NO: 348411 - DNA, 16 bp, M. musculus
acagaaggttgtgagc

SEQ ID NO: 348412 - DNA, 16 bp, M. musculus
acagaagtcagaaaag

SEQ ID NO: 348413 - DNA, 16 bp, M. musculus
acagaagtcagggacc

SEQ ID NO: 348414 - DNA, 16 bp, M. musculus
acagaagtctggagtt

SEQ ID NO: 348415 - DNA, 23 bp, M. musculus
acagaagtggatgctcacagtca

SEQ ID NO: 348416 - DNA, 16 bp, M. musculus
acagaagtggatgttt

SEQ ID NO: 348417 - DNA, 16 bp, M. musculus
acagaataaattttgg

SEQ ID NO: 348418 - DNA, 16 bp, M. musculus
acagaatattttaccc

SEQ ID NO: 348419 - DNA, 16 bp, M. musculus
acagaatcaacagaaa

SEQ ID NO: 348420 - DNA, 16 bp, M. musculus
acagaatcatggagtt

SEQ ID NO: 348421 - DNA, 16 bp, M. musculus
acagaatctaacagct

SEQ ID NO: 348422 - DNA, 16 bp, M. musculus
acagaatcttcacaat

SEQ ID NO: 348423 - DNA, 16 bp, M. musculus
acagaatctttgtaat

SEQ ID NO: 348424 - DNA, 16 bp, M. musculus
acagaatgaatgcaaa

SEQ ID NO: 348425 - DNA, 16 bp, M. musculus
acagaatggatacaga

SEQ ID NO: 348426 - DNA, 16 bp, M. musculus
acagaatggcagagaa

SEQ ID NO: 348427 - DNA, 16 bp, M. musculus
acagaatgggaaagga

SEQ ID NO: 348428 - DNA, 16 bp, M. musculus
acagaatgggagaaaa

SEQ ID NO: 348429 - DNA, 16 bp, M. musculus
acagaatgttctagaa

SEQ ID NO: 348430 - DNA, 16 bp, M. musculus
acagaattacaggaaa

SEQ ID NO: 348431 - DNA, 16 bp, M. musculus
acagacaaaatttgga

SEQ ID NO: 348432 - DNA, 16 bp, M. musculus
acagacaaacaaaatg

SEQ ID NO: 348433 - DNA, 16 bp, M. musculus
acagacacacaaatgc

SEQ ID NO: 348434 - DNA, 16 bp, M. musculus
acagacacacacacag

SEQ ID NO: 348435 - DNA, 16 bp, M. musculus
acagacacacacgcac

SEQ ID NO: 348436 - DNA, 16 bp, M. musculus
acagacacacactcac

SEQ ID NO: 348437 - DNA, 17 bp, M. musculus
acagacacacagacaca

SEQ ID NO: 348438 - DNA, 16 bp, M. musculus
acagacacacagacag

SEQ ID NO: 348439 - DNA, 16 bp, M. musculus
acagacacacagatgc

SEQ ID NO: 348440 - DNA, 16 bp, M. musculus
acagacacacccttac

SEQ ID NO: 348441 - DNA, 16 bp, M. musculus
acagacacactacaca

SEQ ID NO: 348442 - DNA, 16 bp, M. musculus
acagacacactcatat

SEQ ID NO: 348443 - DNA, 16 bp, M. musculus
acagacacagaagcag

SEQ ID NO: 348444 - DNA, 17 bp, M. musculus
acagacacagacacaca

SEQ ID NO: 348445 - DNA, 16 bp, M. musculus
acagacacagaggaaa

SEQ ID NO: 348446 - DNA, 16 bp, M. musculus
acagacacagggacag

SEQ ID NO: 348447 - DNA, 16 bp, M. musculus
acagacacatacacat

SEQ ID NO: 348448 - DNA, 16 bp, M. musculus
acagacacatacagac

SEQ ID NO: 348449 - DNA, 16 bp, M. musculus
acagacaccaaggaaa

SEQ ID NO: 348450 - DNA, 16 bp, M. musculus
acagacaccatgacca

SEQ ID NO: 348451 - DNA, 16 bp, M. musculus
acagacaccttgacca

SEQ ID NO: 348452 - DNA, 16 bp, M. musculus
acagacactcagaaca

SEQ ID NO: 348453 - DNA, 16 bp, M. musculus
acagacactgagaaaa

SEQ ID NO: 348454 - DNA, 16 bp, M. musculus
acagacagaaacagag

SEQ ID NO: 348455 - DNA, 16 bp, M. musculus
acagacagaaaccaga

SEQ ID NO: 348456 - DNA, 16 bp, M. musculus
acagacagaaactgga

SEQ ID NO: 348457 - DNA, 16 bp, M. musculus
acagacagaaggagag

SEQ ID NO: 348458 - DNA, 16 bp, M. musculus
acagacagacaacagc

SEQ ID NO: 348459 - DNA, 16 bp, M. musculus
acagacagacaagaga

SEQ ID NO: 348460 - DNA, 16 bp, M. musculus
acagacagacaataga

SEQ ID NO: 348461 - DNA, 16 bp, M. musculus
acagacagacactcag

SEQ ID NO: 348462 - DNA, 16 bp, M. musculus
acagacagacagaaga

SEQ ID NO: 348463 - DNA, 16 bp, M. musculus
acagacagacagacag

SEQ ID NO: 348464 - DNA, 16 bp, M. musculus
acagacagacagagga

SEQ ID NO: 348465 - DNA, 16 bp, M. musculus
acagacagacagaggt

SEQ ID NO: 348466 - DNA, 16 bp, M. musculus
acagacagacagatat

SEQ ID NO: 348467 - DNA, 16 bp, M. musculus
acagacagacagatga

SEQ ID NO: 348468 - DNA, 16 bp, M. musculus
acagacagacagatgg

SEQ ID NO: 348469 - DNA, 16 bp, M. musculus
acagacagacatacac

SEQ ID NO: 348470 - DNA, 16 bp, M. musculus
acagacagacatgcag

SEQ ID NO: 348471 - DNA, 16 bp, M. musculus
acagacagacatggac

SEQ ID NO: 348472 - DNA, 16 bp, M. musculus
acagacagagagaaat

SEQ ID NO: 348473 - DNA, 16 bp, M. musculus
acagacagagagcaga

SEQ ID NO: 348474 - DNA, 16 bp, M. musculus
acagacagagctgaga

SEQ ID NO: 348475 - DNA, 16 bp, M. musculus
acagacagaggaagag

SEQ ID NO: 348476 - DNA, 16 bp, M. musculus
acagacagaggcagag

SEQ ID NO: 348477 - DNA, 16 bp, M. musculus
acagacagataaacag

SEQ ID NO: 348478 - DNA, 16 bp, M. musculus
acagacagatgggcag

SEQ ID NO: 348479 - DNA, 16 bp, M. musculus
acagacagcacacacc

SEQ ID NO: 348480 - DNA, 16 bp, M. musculus
acagacagctacagca

SEQ ID NO: 348481 - DNA, 16 bp, M. musculus
acagacagctcccctg

SEQ ID NO: 348482 - DNA, 16 bp, M. musculus
acagacaggaaacaga

SEQ ID NO: 348483 - DNA, 16 bp, M. musculus
acagacagggacacac

SEQ ID NO: 348484 - DNA, 16 bp, M. musculus
acagacagtagtgagc

SEQ ID NO: 348485 - DNA, 16 bp, M. musculus
acagacagtatccaaa

SEQ ID NO: 348486 - DNA, 16 bp, M. musculus
acagacagtcagacag

SEQ ID NO: 348487 - DNA, 16 bp, M. musculus
acagacagtgacagag

SEQ ID NO: 348488 - DNA, 16 bp, M. musculus
acagacataaatacat

SEQ ID NO: 348489 - DNA, 16 bp, M. musculus
acagacataagcatca

SEQ ID NO: 348490 - DNA, 16 bp, M. musculus
acagacatacacacat

SEQ ID NO: 348491 - DNA, 16 bp, M. musculus
acagacatacagacaa

SEQ ID NO: 348492 - DNA, 16 bp, M. musculus
acagacatacatgcaa

SEQ ID NO: 348493 - DNA, 16 bp, M. musculus
acagacatcagagact

SEQ ID NO: 348494 - DNA, 16 bp, M. musculus
acagacatctacaaaa

SEQ ID NO: 348495 - DNA, 16 bp, M. musculus
acagacatctaggttg

SEQ ID NO: 348496 - DNA, 16 bp, M. musculus
acagacatctgtaatg

SEQ ID NO: 348497 - DNA, 16 bp, M. musculus
acagacatgcccacag

SEQ ID NO: 348498 - DNA, 16 bp, M. musculus
acagacatggaagaaa

SEQ ID NO: 348499 - DNA, 16 bp, M. musculus
acagacatgtgtcacc

SEQ ID NO: 348500 - DNA, 16 bp, M. musculus
acagacatgttcacag

SEQ ID NO: 348501 - DNA, 16 bp, M. musculus
acagacccagaagtcc

SEQ ID NO: 348502 - DNA, 16 bp, M. musculus
acagacccagaagttc

SEQ ID NO: 348503 - DNA, 16 bp, M. musculus
acagaccccattttgg

SEQ ID NO: 348504 - DNA, 16 bp, M. musculus
acagaccctgtttcag

SEQ ID NO: 348505 - DNA, 16 bp, M. musculus
acagacccttcgggaa

SEQ ID NO: 348506 - DNA, 16 bp, M. musculus
acagacggctgtgagc

SEQ ID NO: 348507 - DNA, 16 bp, M. musculus
acagactcacatggag

SEQ ID NO: 348508 - DNA, 16 bp, M. musculus
acagactcagacacac

SEQ ID NO: 348509 - DNA, 16 bp, M. musculus
acagactgaaagaaaa

SEQ ID NO: 348510 - DNA, 16 bp, M. musculus
acagactgagaaaaga

SEQ ID NO: 348511 - DNA, 16 bp, M. musculus
acagactgcttggtct

SEQ ID NO: 348512 - DNA, 16 bp, M. musculus
acagactggaaggaac

SEQ ID NO: 348513 - DNA, 16 bp, M. musculus
acagacttctcaacag

SEQ ID NO: 348514 - DNA, 16 bp, M. musculus
acagacttttctgtga

SEQ ID NO: 348515 - DNA, 16 bp, M. musculus
acagagaaaaaaatct

SEQ ID NO: 348516 - DNA, 16 bp, M. musculus
acagagaaaaacctgt

SEQ ID NO: 348517 - DNA, 17 bp, M. musculus
acagagaaaacctgtct

SEQ ID NO: 348518 - DNA, 16 bp, M. musculus
acagagaaaaggaaat

SEQ ID NO: 348519 - DNA, 16 bp, M. musculus
acagagaaacacacag

SEQ ID NO: 348520 - DNA, 17 bp, M. musculus
acagagaaacactgtct

SEQ ID NO: 348521 - DNA, 16 bp, M. musculus
acagagaaacagtgaa

SEQ ID NO: 348522 - DNA, 16 bp, M. musculus
acagagaaaccaaagt

SEQ ID NO: 348523 - DNA, 17 bp, M. musculus
acagagaaaccatgtct

SEQ ID NO: 348524 - DNA, 16 bp, M. musculus
acagagaaaccatgtt

SEQ ID NO: 348525 - DNA, 17 bp, M. musculus
acagagaaaccctatct

SEQ ID NO: 348526 - DNA, 16 bp, M. musculus
acagagaaaccctgac

SEQ ID NO: 348527 - DNA, 16 bp, M. musculus
acagagaaaccctgcc

SEQ ID NO: 348528 - DNA, 16 bp, M. musculus
acagagaaaccctggc

SEQ ID NO: 348529 - DNA, 16 bp, M. musculus
acagagaaaccctgta

SEQ ID NO: 348530 - DNA, 17 bp, M. musculus
acagagaaaccctgtcc

SEQ ID NO: 348531 - DNA, 17 bp, M. musculus
acagagaaaccctgtct

SEQ ID NO: 348532 - DNA, 16 bp, M. musculus
acagagaaaccctgtg

SEQ ID NO: 348533 - DNA, 16 bp, M. musculus
acagagaaaccctgtt

SEQ ID NO: 348534 - DNA, 17 bp, M. musculus
acagagaaaccctttct

SEQ ID NO: 348535 - DNA, 17 bp, M. musculus
acagagaaaccgtgtct

SEQ ID NO: 348536 - DNA, 16 bp, M. musculus
acagagaaacctgtct

SEQ ID NO: 348537 - DNA, 16 bp, M. musculus
acagagaaaccttgcc

SEQ ID NO: 348538 - DNA, 17 bp, M. musculus
acagagaaaccttgtct

SEQ ID NO: 348539 - DNA, 16 bp, M. musculus
acagagaaactccgtc

SEQ ID NO: 348540 - DNA, 17 bp, M. musculus
acagagaaactctgtct

SEQ ID NO: 348541 - DNA, 16 bp, M. musculus
acagagaaactgtctt

SEQ ID NO: 348542 - DNA, 16 bp, M. musculus
acagagaaactttgtt

SEQ ID NO: 348543 - DNA, 16 bp, M. musculus
acagagaaagacagat

SEQ ID NO: 348544 - DNA, 16 bp, M. musculus
acagagaaaggaacct

SEQ ID NO: 348545 - DNA, 16 bp, M. musculus
acagagaaaggagact

SEQ ID NO: 348546 - DNA, 16 bp, M. musculus
acagagaaaggagctg

SEQ ID NO: 348547 - DNA, 16 bp, M. musculus
acagagaaaggcaggg

SEQ ID NO: 348548 - DNA, 17 bp, M. musculus
acagagaaatcctgtct

SEQ ID NO: 348549 - DNA, 16 bp, M. musculus
acagagaacatggaga

SEQ ID NO: 348550 - DNA, 16 bp, M. musculus
acagagaaccctgtct

SEQ ID NO: 348551 - DNA, 16 bp, M. musculus
acagagaactcaaatg

SEQ ID NO: 348552 - DNA, 16 bp, M. musculus
acagagaagaaaggct

SEQ ID NO: 348553 - DNA, 16 bp, M. musculus
acagagaagcagctgg

SEQ ID NO: 348554 - DNA, 17 bp, M. musculus
acagagaagccctgtct

SEQ ID NO: 348555 - DNA, 16 bp, M. musculus
acagagaaggaaaaat

SEQ ID NO: 348556 - DNA, 16 bp, M. musculus
acagagaaggaagcag

SEQ ID NO: 348557 - DNA, 16 bp, M. musculus
acagagaaggagaaat

SEQ ID NO: 348558 - DNA, 16 bp, M. musculus
acagagaaggatgctc

SEQ ID NO: 348559 - DNA, 16 bp, M. musculus
acagagaatctctgtc

SEQ ID NO: 348560 - DNA, 16 bp, M. musculus
acagagaatggccttg

SEQ ID NO: 348561 - DNA, 16 bp, M. musculus
acagagaatgtggttc

SEQ ID NO: 348562 - DNA, 16 bp, M. musculus
acagagacaaagtgtg

SEQ ID NO: 348563 - DNA, 16 bp, M. musculus
acagagacaaagttag

SEQ ID NO: 348564 - DNA, 16 bp, M. musculus
acagagacaacatcct

SEQ ID NO: 348565 - DNA, 16 bp, M. musculus
acagagacaagcagat

SEQ ID NO: 348566 - DNA, 16 bp, M. musculus
acagagacacacagac

SEQ ID NO: 348567 - DNA, 16 bp, M. musculus
acagagacacactgaa

SEQ ID NO: 348568 - DNA, 16 bp, M. musculus
acagagacacagaaga

SEQ ID NO: 348569 - DNA, 16 bp, M. musculus
acagagacacagagac

SEQ ID NO: 348570 - DNA, 16 bp, M. musculus
acagagacacagaggg

SEQ ID NO: 348571 - DNA, 16 bp, M. musculus
acagagacacagtttg

SEQ ID NO: 348572 - DNA, 16 bp, M. musculus
acagagacagaaatag

SEQ ID NO: 348573 - DNA, 16 bp, M. musculus
acagagacagaatgtg

SEQ ID NO: 348574 - DNA, 16 bp, M. musculus
acagagacagacagag

SEQ ID NO: 348575 - DNA, 16 bp, M. musculus
acagagacagagaaac

SEQ ID NO: 348576 - DNA, 17 bp, M. musculus
acagagacagagagaca

SEQ ID NO: 348577 - DNA, 16 bp, M. musculus
acagagacagagagcc

SEQ ID NO: 348578 - DNA, 16 bp, M. musculus
acagagacagcagaga

SEQ ID NO: 348579 - DNA, 16 bp, M. musculus
acagagacagccaggc

SEQ ID NO: 348580 - DNA, 16 bp, M. musculus
acagagacagcgacag

SEQ ID NO: 348581 - DNA, 16 bp, M. musculus
acagagacaggagagt

SEQ ID NO: 348582 - DNA, 16 bp, M. musculus
acagagaccaagaaca

SEQ ID NO: 348583 - DNA, 16 bp, M. musculus
acagagaccaagacag

SEQ ID NO: 348584 - DNA, 16 bp, M. musculus
acagagacccagagga

SEQ ID NO: 348585 - DNA, 16 bp, M. musculus
acagagacctacagcc

SEQ ID NO: 348586 - DNA, 16 bp, M. musculus
acagagactagaagag

SEQ ID NO: 348587 - DNA, 16 bp, M. musculus
acagagactgaaggaa

SEQ ID NO: 348588 - DNA, 16 bp, M. musculus
acagagactgtgacaa

SEQ ID NO: 348589 - DNA, 16 bp, M. musculus
acagagacttgatgca

SEQ ID NO: 348590 - DNA, 16 bp, M. musculus
acagagactttttttt

SEQ ID NO: 348591 - DNA, 16 bp, M. musculus
acagagagaaatcctg

SEQ ID NO: 348592 - DNA, 16 bp, M. musculus
acagagagaacaaact

SEQ ID NO: 348593 - DNA, 16 bp, M. musculus
acagagagaacaagct

SEQ ID NO: 348594 - DNA, 16 bp, M. musculus
acagagagacaaaggg

SEQ ID NO: 348595 - DNA, 16 bp, M. musculus
acagagagacagagag

SEQ ID NO: 348596 - DNA, 16 bp, M. musculus
acagagagacagagca

SEQ ID NO: 348597 - DNA, 16 bp, M. musculus
acagagagagaccttg

SEQ ID NO: 348598 - DNA, 16 bp, M. musculus
acagagagagagagac

SEQ ID NO: 348599 - DNA, 16 bp, M. musculus
acagagagaggagctt

SEQ ID NO: 348600 - DNA, 16 bp, M. musculus
acagagagatggacag

SEQ ID NO: 348601 - DNA, 16 bp, M. musculus
acagagaggagacaga

SEQ ID NO: 348602 - DNA, 16 bp, M. musculus
acagagataacagtaa

SEQ ID NO: 348603 - DNA, 16 bp, M. musculus
acagagatccacttgc

SEQ ID NO: 348604 - DNA, 22 bp, M. musculus
acagagatctgcctgcctctgc

SEQ ID NO: 348605 - DNA, 16 bp, M. musculus
acagagatgaggagga

SEQ ID NO: 348606 - DNA, 16 bp, M. musculus
acagagatgcagagag

SEQ ID NO: 348607 - DNA, 16 bp, M. musculus
acagagatggagaaag

SEQ ID NO: 348608 - DNA, 16 bp, M. musculus
acagagcaagccagag

SEQ ID NO: 348609 - DNA, 16 bp, M. musculus
acagagcaagttccaa

SEQ ID NO: 348610 - DNA, 16 bp, M. musculus
acagagcaagtttcag

SEQ ID NO: 348611 - DNA, 16 bp, M. musculus
acagagcaatttccag

SEQ ID NO: 348612 - DNA, 16 bp, M. musculus
acagagcacagaacag

SEQ ID NO: 348613 - DNA, 16 bp, M. musculus
acagagcacagcatcc

SEQ ID NO: 348614 - DNA, 16 bp, M. musculus
acagagcacagggtct

SEQ ID NO: 348615 - DNA, 16 bp, M. musculus
acagagcagagagcag

SEQ ID NO: 348616 - DNA, 16 bp, M. musculus
acagagcaggaacctg

SEQ ID NO: 348617 - DNA, 16 bp, M. musculus
acagagcaggagcaag

SEQ ID NO: 348618 - DNA, 16 bp, M. musculus
acagagcagtggttct

SEQ ID NO: 348619 - DNA, 16 bp, M. musculus
acagagcatcattaat

SEQ ID NO: 348620 - DNA, 16 bp, M. musculus
acagagcatgtatgag

SEQ ID NO: 348621 - DNA, 35 bp, M. musculus
acagagccagataggcccaatgagatggttaaatg

SEQ ID NO: 348622 - DNA, 16 bp, M. musculus
acagagccatctcctc

SEQ ID NO: 348623 - DNA, 16 bp, M. musculus
acagagcccgagccct

SEQ ID NO: 348624 - DNA, 16 bp, M. musculus
acagagcctaagagaa

SEQ ID NO: 348625 - DNA, 16 bp, M. musculus
acagagcctgagccct

SEQ ID NO: 348626 - DNA, 16 bp, M. musculus
acagagcctgcacagg

SEQ ID NO: 348627 - DNA, 16 bp, M. musculus
acagagctagagaaag

SEQ ID NO: 348628 - DNA, 16 bp, M. musculus
acagagctcaagtcca

SEQ ID NO: 348629 - DNA, 16 bp, M. musculus
acagagctccacctgc

SEQ ID NO: 348630 - DNA, 16 bp, M. musculus
acagagctccatctgc

SEQ ID NO: 348631 - DNA, 16 bp, M. musculus
acagagctcccaggaa

SEQ ID NO: 348632 - DNA, 16 bp, M. musculus
acagagctccttccca

SEQ ID NO: 348633 - DNA, 16 bp, M. musculus
acagagctctgcctgt

SEQ ID NO: 348634 - DNA, 16 bp, M. musculus
acagagctgcagaagt

SEQ ID NO: 348635 - DNA, 16 bp, M. musculus
acagagctggagaagt

SEQ ID NO: 348636 - DNA, 16 bp, M. musculus
acagagctgggcatgg

SEQ ID NO: 348637 - DNA, 16 bp, M. musculus
acagagcttctcagga

SEQ ID NO: 348638 - DNA, 16 bp, M. musculus
acagagcttctgaggt

SEQ ID NO: 348639 - DNA, 16 bp, M. musculus
acagaggaaagccagg

SEQ ID NO: 348640 - DNA, 17 bp, M. musculus
acagaggaaaggataca

SEQ ID NO: 348641 - DNA, 16 bp, M. musculus
acagaggaacactcct

SEQ ID NO: 348642 - DNA, 16 bp, M. musculus
acagaggaagacagag

SEQ ID NO: 348643 - DNA, 16 bp, M. musculus
acagaggaagaggcag

SEQ ID NO: 348644 - DNA, 16 bp, M. musculus
acagaggacacagaga

SEQ ID NO: 348645 - DNA, 16 bp, M. musculus
acagaggaccagagtt

SEQ ID NO: 348646 - DNA, 16 bp, M. musculus
acagaggacctggtgc

SEQ ID NO: 348647 - DNA, 16 bp, M. musculus
acagaggactgcctgg

SEQ ID NO: 348648 - DNA, 16 bp, M. musculus
acagaggagaaaatga

SEQ ID NO: 348649 - DNA, 16 bp, M. musculus
acagaggagacagagg

SEQ ID NO: 348650 - DNA, 16 bp, M. musculus
acagaggaggaagctc

SEQ ID NO: 348651 - DNA, 16 bp, M. musculus
acagaggaggaatgga

SEQ ID NO: 348652 - DNA, 16 bp, M. musculus
acagaggaggatgctc

SEQ ID NO: 348653 - DNA, 16 bp, M. musculus
acagaggaggcagcaa

SEQ ID NO: 348654 - DNA, 16 bp, M. musculus
acagaggaggcagcag

SEQ ID NO: 348655 - DNA, 16 bp, M. musculus
acagaggagttccagg

SEQ ID NO: 348656 - DNA, 16 bp, M. musculus
acagaggatccagcaa

SEQ ID NO: 348657 - DNA, 16 bp, M. musculus
acagaggatcctggaa

SEQ ID NO: 348658 - DNA, 16 bp, M. musculus
acagaggatgacctag

SEQ ID NO: 348659 - DNA, 16 bp, M. musculus
acagaggattctcaac

SEQ ID NO: 348660 - DNA, 16 bp, M. musculus
acagaggcagaaggag

SEQ ID NO: 348661 - DNA, 16 bp, M. musculus
acagaggcagatgctg

SEQ ID NO: 348662 - DNA, 16 bp, M. musculus
acagaggcagctgcac

SEQ ID NO: 348663 - DNA, 17 bp, M. musculus
acagaggcaggaggatt

SEQ ID NO: 348664 - DNA, 18 bp, M. musculus
acagaggcaggcagatct

SEQ ID NO: 348665 - DNA, 17 bp, M. musculus
acagaggcaggcggatc

SEQ ID NO: 348666 - DNA, 25 bp, M. musculus
acagaggcaggcggatttctgagtt

SEQ ID NO: 348667 - DNA, 16 bp, M. musculus
acagaggcagggagag

SEQ ID NO: 348668 - DNA, 16 bp, M. musculus
acagaggcaggtagat

SEQ ID NO: 348669 - DNA, 16 bp, M. musculus
acagaggcagtaagcc

SEQ ID NO: 348670 - DNA, 16 bp, M. musculus
acagaggcatggatac

SEQ ID NO: 348671 - DNA, 16 bp, M. musculus
acagaggccagagcag

SEQ ID NO: 348672 - DNA, 16 bp, M. musculus
acagaggccagaggag

SEQ ID NO: 348673 - DNA, 16 bp, M. musculus
acagaggccagagggg

SEQ ID NO: 348674 - DNA, 16 bp, M. musculus
acagaggccagatgag

SEQ ID NO: 348675 - DNA, 16 bp, M. musculus
acagaggctgcaacca

SEQ ID NO: 348676 - DNA, 16 bp, M. musculus
acagaggctggagtta

SEQ ID NO: 348677 - DNA, 16 bp, M. musculus
acagagggaagagctg

SEQ ID NO: 348678 - DNA, 16 bp, M. musculus
acagagggctctggaa

SEQ ID NO: 348679 - DNA, 16 bp, M. musculus
acagaggggacagagg

SEQ ID NO: 348680 - DNA, 16 bp, M. musculus
acagaggtgtgtgtgt

SEQ ID NO: 348681 - DNA, 16 bp, M. musculus
acagaggttgcctaag

SEQ ID NO: 348682 - DNA, 16 bp, M. musculus
acagagtaagtcccag

SEQ ID NO: 348683 - DNA, 16 bp, M. musculus
acagagtcaagtaacc

SEQ ID NO: 348684 - DNA, 16 bp, M. musculus
acagagtcagacacag

SEQ ID NO: 348685 - DNA, 16 bp, M. musculus
acagagtcagacagag

SEQ ID NO: 348686 - DNA, 16 bp, M. musculus
acagagtcccaggaca

SEQ ID NO: 348687 - DNA, 16 bp, M. musculus
acagagtcctttgcct

SEQ ID NO: 348688 - DNA, 16 bp, M. musculus
acagagtctcttactg

SEQ ID NO: 348689 - DNA, 16 bp, M. musculus
acagagtgacatggtt

SEQ ID NO: 348690 - DNA, 16 bp, M. musculus
acagagtgccagccat

SEQ ID NO: 348691 - DNA, 16 bp, M. musculus
acagagttccaggcca

SEQ ID NO: 348692 - DNA, 16 bp, M. musculus
acagagttctgcctgc

SEQ ID NO: 348693 - DNA, 16 bp, M. musculus
acagagtttctcactg

SEQ ID NO: 348694 - DNA, 17 bp, M. musculus
acagagtttggagctga

SEQ ID NO: 348695 - DNA, 16 bp, M. musculus
acagataaggaaactg

SEQ ID NO: 348696 - DNA, 16 bp, M. musculus
acagataatgaaaatg

SEQ ID NO: 348697 - DNA, 16 bp, M. musculus
acagatacaaagatat

SEQ ID NO: 348698 - DNA, 16 bp, M. musculus
acagatacaagaagac

SEQ ID NO: 348699 - DNA, 16 bp, M. musculus
acagatacacacaaat

SEQ ID NO: 348700 - DNA, 16 bp, M. musculus
acagatacacagacat

SEQ ID NO: 348701 - DNA, 16 bp, M. musculus
acagatacacagtgaa

SEQ ID NO: 348702 - DNA, 16 bp, M. musculus
acagatacagtgtact

SEQ ID NO: 348703 - DNA, 16 bp, M. musculus
acagatacataaaaat

SEQ ID NO: 348704 - DNA, 16 bp, M. musculus
acagataccaaaccca

SEQ ID NO: 348705 - DNA, 16 bp, M. musculus
acagatactgaggaaa

SEQ ID NO: 348706 - DNA, 16 bp, M. musculus
acagatacttaaaaga

SEQ ID NO: 348707 - DNA, 19 bp, M. musculus
acagatataaagaacctac

SEQ ID NO: 348708 - DNA, 16 bp, M. musculus
acagatatctacaaaa

SEQ ID NO: 348709 - DNA, 16 bp, M. musculus
acagatattatacaga

SEQ ID NO: 348710 - DNA, 17 bp, M. musculus
acagatatttacattat

SEQ ID NO: 348711 - DNA, 16 bp, M. musculus
acagatatttatagaa

SEQ ID NO: 348712 - DNA, 16 bp, M. musculus
acagatatttttattt

SEQ ID NO: 348713 - DNA, 16 bp, M. musculus
acagatcaagttccag

SEQ ID NO: 348714 - DNA, 16 bp, M. musculus
acagatcaagtttcag

SEQ ID NO: 348715 - DNA, 16 bp, M. musculus
acagatccacctgcct

SEQ ID NO: 348716 - DNA, 16 bp, M. musculus
acagatcctgaagaag

SEQ ID NO: 348717 - DNA, 16 bp, M. musculus
acagatcctgaaggaa

SEQ ID NO: 348718 - DNA, 17 bp, M. musculus
acagatcctgaggaaat

SEQ ID NO: 348719 - DNA, 16 bp, M. musculus
acagatcctgatgaaa

SEQ ID NO: 348720 - DNA, 16 bp, M. musculus
acagatcctggaaatg

SEQ ID NO: 348721 - DNA, 16 bp, M. musculus
acagatctctgaattc

SEQ ID NO: 348722 - DNA, 16 bp, M. musculus
acagatctgcctgcct

SEQ ID NO: 348723 - DNA, 16 bp, M. musculus
acagatctgcctgtct

SEQ ID NO: 348724 - DNA, 16 bp, M. musculus
acagatcttgcctgag

SEQ ID NO: 348725 - DNA, 16 bp, M. musculus
acagatgaagaaaatg

SEQ ID NO: 348726 - DNA, 16 bp, M. musculus
acagatgaagaaactg

SEQ ID NO: 348727 - DNA, 16 bp, M. musculus
acagatgaagacagaa

SEQ ID NO: 348728 - DNA, 16 bp, M. musculus
acagatgaatggatga

SEQ ID NO: 348729 - DNA, 16 bp, M. musculus
acagatgagagaaaac

SEQ ID NO: 348730 - DNA, 16 bp, M. musculus
acagatgaggaaacag

SEQ ID NO: 348731 - DNA, 16 bp, M. musculus
acagatgatggatgtc

SEQ ID NO: 348732 - DNA, 16 bp, M. musculus
acagatgcacacacat

SEQ ID NO: 348733 - DNA, 16 bp, M. musculus
acagatgcagagactt

SEQ ID NO: 348734 - DNA, 16 bp, M. musculus
acagatgcagatgctc

SEQ ID NO: 348735 - DNA, 16 bp, M. musculus
acagatgcatacatac

SEQ ID NO: 348736 - DNA, 16 bp, M. musculus
acagatgccaacaaga

SEQ ID NO: 348737 - DNA, 16 bp, M. musculus
acagatgctcacagcc

SEQ ID NO: 348738 - DNA, 16 bp, M. musculus
acagatgcttgtgaac

SEQ ID NO: 348739 - DNA, 16 bp, M. musculus
acagatgctttgcaat

SEQ ID NO: 348740 - DNA, 16 bp, M. musculus
acagatggacagaaag

SEQ ID NO: 348741 - DNA, 16 bp, M. musculus
acagatggagagagag

SEQ ID NO: 348742 - DNA, 16 bp, M. musculus
acagatggagggaggg

SEQ ID NO: 348743 - DNA, 16 bp, M. musculus
acagatgggacctcat

SEQ ID NO: 348744 - DNA, 16 bp, M. musculus
acagatggggaaaaaa

SEQ ID NO: 348745 - DNA, 16 bp, M. musculus
acagatggggaaagga

SEQ ID NO: 348746 - DNA, 16 bp, M. musculus
acagatgggggagggg

SEQ ID NO: 348747 - DNA, 16 bp, M. musculus
acagatggttctcaga

SEQ ID NO: 348748 - DNA, 16 bp, M. musculus
acagatggttgtgaga

SEQ ID NO: 348749 - DNA, 16 bp, M. musculus
acagatgtataaaagt

SEQ ID NO: 348750 - DNA, 16 bp, M. musculus
acagatgtgcactacc

SEQ ID NO: 348751 - DNA, 16 bp, M. musculus
acagatgtgcagcttg

SEQ ID NO: 348752 - DNA, 16 bp, M. musculus
acagatgtgcccacag

SEQ ID NO: 348753 - DNA, 16 bp, M. musculus
acagatgtgctgcaga

SEQ ID NO: 348754 - DNA, 16 bp, M. musculus
acagatgtggaaactg

SEQ ID NO: 348755 - DNA, 16 bp, M. musculus
acagatgtgtgctact

SEQ ID NO: 348756 - DNA, 16 bp, M. musculus
acagatgtgtgctgct

SEQ ID NO: 348757 - DNA, 16 bp, M. musculus
acagatgttagacaga

SEQ ID NO: 348758 - DNA, 16 bp, M. musculus
acagatgtttgtgagc

SEQ ID NO: 348759 - DNA, 16 bp, M. musculus
acagattcaatgcaac

SEQ ID NO: 348760 - DNA, 16 bp, M. musculus
acagattccacagaca

SEQ ID NO: 348761 - DNA, 16 bp, M. musculus
acagattgagaaacac

SEQ ID NO: 348762 - DNA, 16 bp, M. musculus
acagattgggaaaaga

SEQ ID NO: 348763 - DNA, 16 bp, M. musculus
acagattgggagaaga

SEQ ID NO: 348764 - DNA, 16 bp, M. musculus
acagattgggggaaaa

SEQ ID NO: 348765 - DNA, 16 bp, M. musculus
acagatttatttttct

SEQ ID NO: 348766 - DNA, 16 bp, M. musculus
acagatttctctgtgt

SEQ ID NO: 348767 - DNA, 16 bp, M. musculus
acagatttctgtgagt

SEQ ID NO: 348768 - DNA, 17 bp, M. musculus
acagatttgcagctctg

SEQ ID NO: 348769 - DNA, 16 bp, M. musculus
acagatttgcctacag

SEQ ID NO: 348770 - DNA, 16 bp, M. musculus
acagattttatttttt

SEQ ID NO: 348771 - DNA, 16 bp, M. musculus
acagcaaaaattcaag

SEQ ID NO: 348772 - DNA, 16 bp, M. musculus
acagcaaacactttac

SEQ ID NO: 348773 - DNA, 16 bp, M. musculus
acagcaaaccaacagc

SEQ ID NO: 348774 - DNA, 16 bp, M. musculus
acagcaaagcaaagca

SEQ ID NO: 348775 - DNA, 16 bp, M. musculus
acagcaaaggaaacag

SEQ ID NO: 348776 - DNA, 16 bp, M. musculus
acagcaacaagacaag

SEQ ID NO: 348777 - DNA, 16 bp, M. musculus
acagcaacagaaaagc

SEQ ID NO: 348778 - DNA, 16 bp, M. musculus
acagcaacagaaaagt

SEQ ID NO: 348779 - DNA, 16 bp, M. musculus
acagcaacagaaagcc

SEQ ID NO: 348780 - DNA, 16 bp, M. musculus
acagcaacagcagcaa

SEQ ID NO: 348781 - DNA, 16 bp, M. musculus
acagcaacagcagtgg

SEQ ID NO: 348782 - DNA, 16 bp, M. musculus
acagcaacagcttcat

SEQ ID NO: 348783 - DNA, 16 bp, M. musculus
acagcaacagtatact

SEQ ID NO: 348784 - DNA, 16 bp, M. musculus
acagcaagagctacat

SEQ ID NO: 348785 - DNA, 16 bp, M. musculus
acagcaagcaagcaag

SEQ ID NO: 348786 - DNA, 16 bp, M. musculus
acagcaagttcaaagc

SEQ ID NO: 348787 - DNA, 16 bp, M. musculus
acagcaagttccaggc

SEQ ID NO: 348788 - DNA, 16 bp, M. musculus
acagcaataaaacccc

SEQ ID NO: 348789 - DNA, 16 bp, M. musculus
acagcaataaaatcca

SEQ ID NO: 348790 - DNA, 16 bp, M. musculus
acagcaataagaaaag

SEQ ID NO: 348791 - DNA, 16 bp, M. musculus
acagcaatagaatagt

SEQ ID NO: 348792 - DNA, 16 bp, M. musculus
acagcaatcctcctgc

SEQ ID NO: 348793 - DNA, 16 bp, M. musculus
acagcaatgtgaaagt

SEQ ID NO: 348794 - DNA, 16 bp, M. musculus
acagcaatgtgaacta

SEQ ID NO: 348795 - DNA, 16 bp, M. musculus
acagcaatttttaaaa

SEQ ID NO: 348796 - DNA, 21 bp, M. musculus
acagcacaaattagttatata

SEQ ID NO: 348797 - DNA, 16 bp, M. musculus
acagcacaagccatgg

SEQ ID NO: 348798 - DNA, 16 bp, M. musculus
acagcacaaggcattg

SEQ ID NO: 348799 - DNA, 16 bp, M. musculus
acagcacacagcacag

SEQ ID NO: 348800 - DNA, 16 bp, M. musculus
acagcacagagaaacc

SEQ ID NO: 348801 - DNA, 16 bp, M. musculus
acagcacagcacacag

SEQ ID NO: 348802 - DNA, 16 bp, M. musculus
acagcacagcacagga

SEQ ID NO: 348803 - DNA, 16 bp, M. musculus
acagcacagtggagga

SEQ ID NO: 348804 - DNA, 16 bp, M. musculus
acagcactcaagaggc

SEQ ID NO: 348805 - DNA, 17 bp, M. musculus
acagcactgactgctct

SEQ ID NO: 348806 - DNA, 16 bp, M. musculus
acagcactttcaacaa

SEQ ID NO: 348807 - DNA, 16 bp, M. musculus
acagcagaagcagcag

SEQ ID NO: 348808 - DNA, 16 bp, M. musculus
acagcagaagctggca

SEQ ID NO: 348809 - DNA, 16 bp, M. musculus
acagcagaatgccagg

SEQ ID NO: 348810 - DNA, 16 bp, M. musculus
acagcagagactgaag

SEQ ID NO: 348811 - DNA, 16 bp, M. musculus
acagcagagcacagca

SEQ ID NO: 348812 - DNA, 16 bp, M. musculus
acagcagaggacagcc

SEQ ID NO: 348813 - DNA, 16 bp, M. musculus
acagcagaggactgcc

SEQ ID NO: 348814 - DNA, 16 bp, M. musculus
acagcagaggagctga

SEQ ID NO: 348815 - DNA, 16 bp, M. musculus
acagcagaggctggca

SEQ ID NO: 348816 - DNA, 16 bp, M. musculus
acagcagatgcaggca

SEQ ID NO: 348817 - DNA, 16 bp, M. musculus
acagcagatgctggag

SEQ ID NO: 348818 - DNA, 16 bp, M. musculus
acagcagatgggaaca

SEQ ID NO: 348819 - DNA, 16 bp, M. musculus
acagcagattctggtg

SEQ ID NO: 348820 - DNA, 16 bp, M. musculus
acagcagcaaaaccct

SEQ ID NO: 348821 - DNA, 23 bp, M. musculus
acagcagcaacagcagcaacagc

SEQ ID NO: 348822 - DNA, 16 bp, M. musculus
acagcagcaacagtgg

SEQ ID NO: 348823 - DNA, 16 bp, M. musculus
acagcagcacacaggc

SEQ ID NO: 348824 - DNA, 16 bp, M. musculus
acagcagcagaaagca

SEQ ID NO: 348825 - DNA, 16 bp, M. musculus
acagcagcagcaaaaa

SEQ ID NO: 348826 - DNA, 16 bp, M. musculus
acagcagcagcaacaa

SEQ ID NO: 348827 - DNA, 16 bp, M. musculus
acagcagcagcaatgg

SEQ ID NO: 348828 - DNA, 16 bp, M. musculus
acagcagcagcagaag

SEQ ID NO: 348829 - DNA, 17 bp, M. musculus
acagcagcagcagcaaa

SEQ ID NO: 348830 - DNA, 22 bp, M. musculus
acagcagcagcagcaacaacaa

SEQ ID NO: 348831 - DNA, 17 bp, M. musculus
acagcagcagcagcaga

SEQ ID NO: 348832 - DNA, 17 bp, M. musculus
acagcagcagcagcagt

SEQ ID NO: 348833 - DNA, 16 bp, M. musculus
acagcagcagcagtag

SEQ ID NO: 348834 - DNA, 16 bp, M. musculus
acagcagcagccacag

SEQ ID NO: 348835 - DNA, 16 bp, M. musculus
acagcagcagctgctg

SEQ ID NO: 348836 - DNA, 16 bp, M. musculus
acagcagcaggaagag

SEQ ID NO: 348837 - DNA, 16 bp, M. musculus
acagcagccacagcag

SEQ ID NO: 348838 - DNA, 16 bp, M. musculus
acagcagcctacagaa

SEQ ID NO: 348839 - DNA, 16 bp, M. musculus
acagcagcctgtaact

SEQ ID NO: 348840 - DNA, 16 bp, M. musculus
acagcagctcttataa

SEQ ID NO: 348841 - DNA, 16 bp, M. musculus
acagcagctcttctgt

SEQ ID NO: 348842 - DNA, 16 bp, M. musculus
acagcaggaaatactc

SEQ ID NO: 348843 - DNA, 16 bp, M. musculus
acagcaggagaggccc

SEQ ID NO: 348844 - DNA, 16 bp, M. musculus
acagcaggagcagggg

SEQ ID NO: 348845 - DNA, 16 bp, M. musculus
acagcagggacagcag

SEQ ID NO: 348846 - DNA, 16 bp, M. musculus
acagcagtcaaagaaa

SEQ ID NO: 348847 - DNA, 16 bp, M. musculus
acagcagtgagtgtaa

SEQ ID NO: 348848 - DNA, 16 bp, M. musculus
acagcagtgcagtgca

SEQ ID NO: 348849 - DNA, 16 bp, M. musculus
acagcagtggggatat

SEQ ID NO: 348850 - DNA, 16 bp, M. musculus
acagcagtgtatgctt

SEQ ID NO: 348851 - DNA, 16 bp, M. musculus
acagcatcagaaagca

SEQ ID NO: 348852 - DNA, 16 bp, M. musculus
acagcatcctttgcct

SEQ ID NO: 348853 - DNA, 16 bp, M. musculus
acagcatctaaaccca

SEQ ID NO: 348854 - DNA, 16 bp, M. musculus
acagcatctctcactg

SEQ ID NO: 348855 - DNA, 16 bp, M. musculus
acagcatgaagaactg

SEQ ID NO: 348856 - DNA, 16 bp, M. musculus
acagcatgagaaactg

SEQ ID NO: 348857 - DNA, 16 bp, M. musculus
acagcatgtcagaaac

SEQ ID NO: 348858 - DNA, 16 bp, M. musculus
acagcattcttctcaa

SEQ ID NO: 348859 - DNA, 16 bp, M. musculus
acagcattggtttgat

SEQ ID NO: 348860 - DNA, 16 bp, M. musculus
acagcatttgaaatat

SEQ ID NO: 348861 - DNA, 16 bp, M. musculus
acagcattttcaagaa

SEQ ID NO: 348862 - DNA, 16 bp, M. musculus
acagcattttcattaa

SEQ ID NO: 348863 - DNA, 16 bp, M. musculus
acagcattttccacaa

SEQ ID NO: 348864 - DNA, 16 bp, M. musculus
acagccaaaagaaatg

SEQ ID NO: 348865 - DNA, 16 bp, M. musculus
acagccaagactacag

SEQ ID NO: 348866 - DNA, 16 bp, M. musculus
acagccaagcattgga

SEQ ID NO: 348867 - DNA, 16 bp, M. musculus
acagccaagggctaca

SEQ ID NO: 348868 - DNA, 16 bp, M. musculus
acagccacaccaggct

SEQ ID NO: 348869 - DNA, 16 bp, M. musculus
acagccacagaacaga

SEQ ID NO: 348870 - DNA, 16 bp, M. musculus
acagccacattcttca

SEQ ID NO: 348871 - DNA, 16 bp, M. musculus
acagccagaaactgga

SEQ ID NO: 348872 - DNA, 16 bp, M. musculus
acagccagaagctgaa

SEQ ID NO: 348873 - DNA, 16 bp, M. musculus
acagccagacagacag

SEQ ID NO: 348874 - DNA, 16 bp, M. musculus
acagccagagctacag

SEQ ID NO: 348875 - DNA, 16 bp, M. musculus
acagccagagctacct

SEQ ID NO: 348876 - DNA, 16 bp, M. musculus
acagccagccagggct

SEQ ID NO: 348877 - DNA, 16 bp, M. musculus
acagccaggcctctgc

SEQ ID NO: 348878 - DNA, 16 bp, M. musculus
acagccagggccacag

SEQ ID NO: 348879 - DNA, 16 bp, M. musculus
acagccagtgatctta

SEQ ID NO: 348880 - DNA, 16 bp, M. musculus
acagccatagccacag

SEQ ID NO: 348881 - DNA, 16 bp, M. musculus
acagccatctgcaatg

SEQ ID NO: 348882 - DNA, 16 bp, M. musculus
acagccatctgtgatg

SEQ ID NO: 348883 - DNA, 16 bp, M. musculus
acagccattatggaaa

SEQ ID NO: 348884 - DNA, 16 bp, M. musculus
acagccattgcagtac

SEQ ID NO: 348885 - DNA, 16 bp, M. musculus
acagcccactgtgggt

SEQ ID NO: 348886 - DNA, 16 bp, M. musculus
acagccccagccccag

SEQ ID NO: 348887 - DNA, 16 bp, M. musculus
acagccccagctccag

SEQ ID NO: 348888 - DNA, 16 bp, M. musculus
acagccccagctcctg

SEQ ID NO: 348889 - DNA, 16 bp, M. musculus
acagcccctgccccaa

SEQ ID NO: 348890 - DNA, 16 bp, M. musculus
acagcccctgctccaa

SEQ ID NO: 348891 - DNA, 16 bp, M. musculus
acagccctcctcccca

SEQ ID NO: 348892 - DNA, 16 bp, M. musculus
acagccctgccctggc

SEQ ID NO: 348893 - DNA, 16 bp, M. musculus
acagccgatgctggcg

SEQ ID NO: 348894 - DNA, 16 bp, M. musculus
acagcctagagtcacc

SEQ ID NO: 348895 - DNA, 16 bp, M. musculus
acagcctcctcttctt

SEQ ID NO: 348896 - DNA, 16 bp, M. musculus
acagcctctgctcctg

SEQ ID NO: 348897 - DNA, 16 bp, M. musculus
acagcctctgctctca

SEQ ID NO: 348898 - DNA, 16 bp, M. musculus
acagcctcttctggtg

SEQ ID NO: 348899 - DNA, 16 bp, M. musculus
acagcctctttgtgct

SEQ ID NO: 348900 - DNA, 16 bp, M. musculus
acagcctctttttctt

SEQ ID NO: 348901 - DNA, 16 bp, M. musculus
acagcctgacaaatac

SEQ ID NO: 348902 - DNA, 16 bp, M. musculus
acagcctgagactgct

SEQ ID NO: 348903 - DNA, 16 bp, M. musculus
acagcctgatctacaa

SEQ ID NO: 348904 - DNA, 16 bp, M. musculus
acagcctgatctacag

SEQ ID NO: 348905 - DNA, 16 bp, M. musculus
acagcctggacagaga

SEQ ID NO: 348906 - DNA, 16 bp, M. musculus
acagcctggcagtggt

SEQ ID NO: 348907 - DNA, 16 bp, M. musculus
acagcctggtctacaa

SEQ ID NO: 348908 - DNA, 16 bp, M. musculus
acagcctggtctacac

SEQ ID NO: 348909 - DNA, 17 bp, M. musculus
acagcctggtctacaga

SEQ ID NO: 348910 - DNA, 16 bp, M. musculus
acagcctggtctccag

SEQ ID NO: 348911 - DNA, 16 bp, M. musculus
acagcctggtttacat

SEQ ID NO: 348912 - DNA, 16 bp, M. musculus
acagcctgtaactcca

SEQ ID NO: 348913 - DNA, 16 bp, M. musculus
acagccttctttattt

SEQ ID NO: 348914 - DNA, 16 bp, M. musculus
acagccttggctgtcc

SEQ ID NO: 348915 - DNA, 16 bp, M. musculus
acagcgagtcctggat

SEQ ID NO: 348916 - DNA, 16 bp, M. musculus
acagcgatatcaggct

SEQ ID NO: 348917 - DNA, 16 bp, M. musculus
acagcgatgtggaagt

SEQ ID NO: 348918 - DNA, 16 bp, M. musculus
acagcgccacctgctg

SEQ ID NO: 348919 - DNA, 16 bp, M. musculus
acagctaaatcagggt

SEQ ID NO: 348920 - DNA, 16 bp, M. musculus
acagctaaggtcatcc

SEQ ID NO: 348921 - DNA, 16 bp, M. musculus
acagctacactgtact

SEQ ID NO: 348922 - DNA, 16 bp, M. musculus
acagctacagcacagc

SEQ ID NO: 348923 - DNA, 16 bp, M. musculus
acagctacagctacag

SEQ ID NO: 348924 - DNA, 16 bp, M. musculus
acagctacatctgagt

SEQ ID NO: 348925 - DNA, 16 bp, M. musculus
acagctactgtgtact

SEQ ID NO: 348926 - DNA, 16 bp, M. musculus
acagctataacagagt

SEQ ID NO: 348927 - DNA, 16 bp, M. musculus
acagctataacaggct

SEQ ID NO: 348928 - DNA, 16 bp, M. musculus
acagctatatcaggcc

SEQ ID NO: 348929 - DNA, 16 bp, M. musculus
acagctatatttgtca

SEQ ID NO: 348930 - DNA, 16 bp, M. musculus
acagctatggcttgtg

SEQ ID NO: 348931 - DNA, 16 bp, M. musculus
acagctcacaaagctg

SEQ ID NO: 348932 - DNA, 16 bp, M. musculus
acagctcagaggttaa

SEQ ID NO: 348933 - DNA, 16 bp, M. musculus
acagctcagcagataa

SEQ ID NO: 348934 - DNA, 16 bp, M. musculus
acagctccacctgcct

SEQ ID NO: 348935 - DNA, 16 bp, M. musculus
acagctccagttccag

SEQ ID NO: 348936 - DNA, 16 bp, M. musculus
acagctcctgaggaac

SEQ ID NO: 348937 - DNA, 16 bp, M. musculus
acagctccttcgaggc

SEQ ID NO: 348938 - DNA, 16 bp, M. musculus
acagctctatcaggct

SEQ ID NO: 348939 - DNA, 16 bp, M. musculus
acagctctcctgctct

SEQ ID NO: 348940 - DNA, 16 bp, M. musculus
acagctctctctctct

SEQ ID NO: 348941 - DNA, 16 bp, M. musculus
acagctcttccaaagg

SEQ ID NO: 348942 - DNA, 16 bp, M. musculus
acagctcttggaacaa

SEQ ID NO: 348943 - DNA, 16 bp, M. musculus
acagctgaaaaaccct

SEQ ID NO: 348944 - DNA, 16 bp, M. musculus
acagctgcagtggctg

SEQ ID NO: 348945 - DNA, 16 bp, M. musculus
acagctgcagtgtatt

SEQ ID NO: 348946 - DNA, 16 bp, M. musculus
acagctgcagtgtgct

SEQ ID NO: 348947 - DNA, 16 bp, M. musculus
acagctgcatcatcaa

SEQ ID NO: 348948 - DNA, 16 bp, M. musculus
acagctgccacagctg

SEQ ID NO: 348949 - DNA, 16 bp, M. musculus
acagctgccattgtta

SEQ ID NO: 348950 - DNA, 16 bp, M. musculus
acagctgcccattgtt

SEQ ID NO: 348951 - DNA, 16 bp, M. musculus
acagctgcgactgaac

SEQ ID NO: 348952 - DNA, 17 bp, M. musculus
acagctgctgctgaatg

SEQ ID NO: 348953 - DNA, 16 bp, M. musculus
acagctgctgctgctg

SEQ ID NO: 348954 - DNA, 16 bp, M. musculus
acagctggaatgtaaa

SEQ ID NO: 348955 - DNA, 16 bp, M. musculus
acagctggagcaggaa

SEQ ID NO: 348956 - DNA, 16 bp, M. musculus
acagctggagcagggg

SEQ ID NO: 348957 - DNA, 16 bp, M. musculus
acagctggatctcatt

SEQ ID NO: 348958 - DNA, 16 bp, M. musculus
acagctggcttcttta

SEQ ID NO: 348959 - DNA, 16 bp, M. musculus
acagctgggcaaactc

SEQ ID NO: 348960 - DNA, 16 bp, M. musculus
acagctgggtcttcag

SEQ ID NO: 348961 - DNA, 16 bp, M. musculus
acagctgtcccctgag

SEQ ID NO: 348962 - DNA, 16 bp, M. musculus
acagctgtgaactgcc

SEQ ID NO: 348963 - DNA, 16 bp, M. musculus
acagcttacaaccatc

SEQ ID NO: 348964 - DNA, 16 bp, M. musculus
acagcttcagagaagt

SEQ ID NO: 348965 - DNA, 16 bp, M. musculus
acagcttcagggacag

SEQ ID NO: 348966 - DNA, 16 bp, M. musculus
acagcttcccaataaa

SEQ ID NO: 348967 - DNA, 16 bp, M. musculus
acagcttccccctcct

SEQ ID NO: 348968 - DNA, 16 bp, M. musculus
acagcttctctgtgct

SEQ ID NO: 348969 - DNA, 16 bp, M. musculus
acagcttctggaagag

SEQ ID NO: 348970 - DNA, 16 bp, M. musculus
acagcttcttgttcca

SEQ ID NO: 348971 - DNA, 16 bp, M. musculus
acagcttgaggtcaag

SEQ ID NO: 348972 - DNA, 16 bp, M. musculus
acagctttattgagat

SEQ ID NO: 348973 - DNA, 16 bp, M. musculus
acagctttccagcctg

SEQ ID NO: 348974 - DNA, 16 bp, M. musculus
acagctttgtggagtt

SEQ ID NO: 348975 - DNA, 16 bp, M. musculus
acaggaaaacagaacc

SEQ ID NO: 348976 - DNA, 16 bp, M. musculus
acaggaaaacccaacc

SEQ ID NO: 348977 - DNA, 16 bp, M. musculus
acaggaaaagaaagat

SEQ ID NO: 348978 - DNA, 16 bp, M. musculus
acaggaaaagcaagat

SEQ ID NO: 348979 - DNA, 17 bp, M. musculus
acaggaaaatactgcta

SEQ ID NO: 348980 - DNA, 16 bp, M. musculus
acaggaaaatcaagaa

SEQ ID NO: 348981 - DNA, 16 bp, M. musculus
acaggaaacccacttc

SEQ ID NO: 348982 - DNA, 16 bp, M. musculus
acaggaaagaagccca

SEQ ID NO: 348983 - DNA, 16 bp, M. musculus
acaggaaagaagccct

SEQ ID NO: 348984 - DNA, 16 bp, M. musculus
acaggaaagagaagct

SEQ ID NO: 348985 - DNA, 16 bp, M. musculus
acaggaaattgaacag

SEQ ID NO: 348986 - DNA, 16 bp, M. musculus
acaggaaccaaggatc

SEQ ID NO: 348987 - DNA, 16 bp, M. musculus
acaggaaccactgaat

SEQ ID NO: 348988 - DNA, 16 bp, M. musculus
acaggaacctggtgtg

SEQ ID NO: 348989 - DNA, 16 bp, M. musculus
acaggaagataagaat

SEQ ID NO: 348990 - DNA, 16 bp, M. musculus
acaggaagatcaacag

SEQ ID NO: 348991 - DNA, 16 bp, M. musculus
acaggaagcaacaata

SEQ ID NO: 348992 - DNA, 16 bp, M. musculus
acaggaagcaacaatg

SEQ ID NO: 348993 - DNA, 16 bp, M. musculus
acaggaagcaagccag

SEQ ID NO: 348994 - DNA, 16 bp, M. musculus
acaggaagcagaagga

SEQ ID NO: 348995 - DNA, 16 bp, M. musculus
acaggaagctgagaca

SEQ ID NO: 348996 - DNA, 16 bp, M. musculus
acaggaaggacaggat

SEQ ID NO: 348997 - DNA, 16 bp, M. musculus
acaggaagttctgttg

SEQ ID NO: 348998 - DNA, 16 bp, M. musculus
acaggaataaagatgg

SEQ ID NO: 348999 - DNA, 16 bp, M. musculus
acaggacagaaacctg

SEQ ID NO: 349000 - DNA, 16 bp, M. musculus
acaggacagacagaca

SEQ ID NO: 349001 - DNA, 17 bp, M. musculus
acaggacagccagagct

SEQ ID NO: 349002 - DNA, 16 bp, M. musculus
acaggacaggaacctg

SEQ ID NO: 349003 - DNA, 16 bp, M. musculus
acaggacaggaatctg

SEQ ID NO: 349004 - DNA, 16 bp, M. musculus
acaggacaggacagca

SEQ ID NO: 349005 - DNA, 16 bp, M. musculus
acaggacattttatcc

SEQ ID NO: 349006 - DNA, 16 bp, M. musculus
acaggagaagcatggt

SEQ ID NO: 349007 - DNA, 16 bp, M. musculus
acaggagaatcacaag

SEQ ID NO: 349008 - DNA, 16 bp, M. musculus
acaggagaatggatac

SEQ ID NO: 349009 - DNA, 16 bp, M. musculus
acaggagacaagttcc

SEQ ID NO: 349010 - DNA, 16 bp, M. musculus
acaggagacagaggac

SEQ ID NO: 349011 - DNA, 16 bp, M. musculus
acaggagactctgtct

SEQ ID NO: 349012 - DNA, 16 bp, M. musculus
acaggagagagaccca

SEQ ID NO: 349013 - DNA, 16 bp, M. musculus
acaggagagcacacag

SEQ ID NO: 349014 - DNA, 16 bp, M. musculus
acaggagagctggcag

SEQ ID NO: 349015 - DNA, 16 bp, M. musculus
acaggagagctggtgg

SEQ ID NO: 349016 - DNA, 16 bp, M. musculus
acaggagatcctgtct

SEQ ID NO: 349017 - DNA, 16 bp, M. musculus
acaggagatgctggca

SEQ ID NO: 349018 - DNA, 16 bp, M. musculus
acaggagcaggagcag

SEQ ID NO: 349019 - DNA, 18 bp, M. musculus
acaggagcaggtcagggt

SEQ ID NO: 349020 - DNA, 16 bp, M. musculus
acaggagcccagaatc

SEQ ID NO: 349021 - DNA, 16 bp, M. musculus
acaggagcctgagagg

SEQ ID NO: 349022 - DNA, 16 bp, M. musculus
acaggagccttctggt

SEQ ID NO: 349023 - DNA, 16 bp, M. musculus
acaggagctctgaggg

SEQ ID NO: 349024 - DNA, 16 bp, M. musculus
acaggagctgaagcag

SEQ ID NO: 349025 - DNA, 16 bp, M. musculus
acaggagctggccaag

SEQ ID NO: 349026 - DNA, 16 bp, M. musculus
acaggaggaacaagtt

SEQ ID NO: 349027 - DNA, 16 bp, M. musculus
acaggaggaattctga

SEQ ID NO: 349028 - DNA, 16 bp, M. musculus
acaggaggagctggga

SEQ ID NO: 349029 - DNA, 16 bp, M. musculus
acaggaggagttggag

SEQ ID NO: 349030 - DNA, 16 bp, M. musculus
acaggaggatcatggg

SEQ ID NO: 349031 - DNA, 16 bp, M. musculus
acaggaggatgtgtaa

SEQ ID NO: 349032 - DNA, 16 bp, M. musculus
acaggaggcagagctg

SEQ ID NO: 349033 - DNA, 16 bp, M. musculus
acaggaggctccctgg

SEQ ID NO: 349034 - DNA, 18 bp, M. musculus
acaggaggctgaggcagg

SEQ ID NO: 349035 - DNA, 16 bp, M. musculus
acaggagggtggggag

SEQ ID NO: 349036 - DNA, 16 bp, M. musculus
acaggagtgggggtgg

SEQ ID NO: 349037 - DNA, 16 bp, M. musculus
acaggagtgtgggtga

SEQ ID NO: 349038 - DNA, 16 bp, M. musculus
acaggatcagctcctg

SEQ ID NO: 349039 - DNA, 16 bp, M. musculus
acaggatcatccccag

SEQ ID NO: 349040 - DNA, 16 bp, M. musculus
acaggatgagtcagag

SEQ ID NO: 349041 - DNA, 16 bp, M. musculus
acaggattcacaggca

SEQ ID NO: 349042 - DNA, 16 bp, M. musculus
acaggattttcaacaa

SEQ ID NO: 349043 - DNA, 16 bp, M. musculus
acaggatttttaaaaa

SEQ ID NO: 349044 - DNA, 16 bp, M. musculus
acaggcaaacagctag

SEQ ID NO: 349045 - DNA, 16 bp, M. musculus
acaggcaactgtgagc

SEQ ID NO: 349046 - DNA, 16 bp, M. musculus
acaggcaagcaaggag

SEQ ID NO: 349047 - DNA, 16 bp, M. musculus
acaggcaagcagatct

SEQ ID NO: 349048 - DNA, 16 bp, M. musculus
acaggcacacacacac

SEQ ID NO: 349049 - DNA, 16 bp, M. musculus
acaggcacacacattt

SEQ ID NO: 349050 - DNA, 16 bp, M. musculus
acaggcacacactgcc

SEQ ID NO: 349051 - DNA, 16 bp, M. musculus
acaggcaccaagcaca

SEQ ID NO: 349052 - DNA, 16 bp, M. musculus
acaggcacccacacac

SEQ ID NO: 349053 - DNA, 16 bp, M. musculus
acaggcagaagccaca

SEQ ID NO: 349054 - DNA, 16 bp, M. musculus
acaggcagacccctgg

SEQ ID NO: 349055 - DNA, 16 bp, M. musculus
acaggcagatctctgt

SEQ ID NO: 349056 - DNA, 16 bp, M. musculus
acaggcagcaggcaga

SEQ ID NO: 349057 - DNA, 16 bp, M. musculus
acaggcagctgtgagc

SEQ ID NO: 349058 - DNA, 16 bp, M. musculus
acaggcaggcaaaaca

SEQ ID NO: 349059 - DNA, 16 bp, M. musculus
acaggcagggaacaga

SEQ ID NO: 349060 - DNA, 16 bp, M. musculus
acaggcaggtagatca

SEQ ID NO: 349061 - DNA, 16 bp, M. musculus
acaggcagtcctctgc

SEQ ID NO: 349062 - DNA, 16 bp, M. musculus
acaggcagtgtgagct

SEQ ID NO: 349063 - DNA, 16 bp, M. musculus
acaggcagttgtgagc

SEQ ID NO: 349064 - DNA, 16 bp, M. musculus
acaggcatacatgcag

SEQ ID NO: 349065 - DNA, 16 bp, M. musculus
acaggcatgaaaatca

SEQ ID NO: 349066 - DNA, 16 bp, M. musculus
acaggcatgctcagag

SEQ ID NO: 349067 - DNA, 16 bp, M. musculus
acaggcatgtacacac

SEQ ID NO: 349068 - DNA, 16 bp, M. musculus
acaggccaaatggcct

SEQ ID NO: 349069 - DNA, 16 bp, M. musculus
acaggcctcaacagct

SEQ ID NO: 349070 - DNA, 16 bp, M. musculus
acaggcctgcaccacc

SEQ ID NO: 349071 - DNA, 16 bp, M. musculus
acaggcctgggccacc

SEQ ID NO: 349072 - DNA, 16 bp, M. musculus
acaggcctgtaccacc

SEQ ID NO: 349073 - DNA, 16 bp, M. musculus
acaggcctgtgtcacc

SEQ ID NO: 349074 - DNA, 16 bp, M. musculus
acaggctcacaggatc

SEQ ID NO: 349075 - DNA, 16 bp, M. musculus
acaggctcagaaagaa

SEQ ID NO: 349076 - DNA, 16 bp, M. musculus
acaggctccagtcaga

SEQ ID NO: 349077 - DNA, 16 bp, M. musculus
acaggctctctcctct

SEQ ID NO: 349078 - DNA, 16 bp, M. musculus
acaggctgagacagaa

SEQ ID NO: 349079 - DNA, 16 bp, M. musculus
acaggctgagagagaa

SEQ ID NO: 349080 - DNA, 16 bp, M. musculus
acaggctgctcttcta

SEQ ID NO: 349081 - DNA, 16 bp, M. musculus
acaggctggacctagc

SEQ ID NO: 349082 - DNA, 16 bp, M. musculus
acaggctggcctgaaa

SEQ ID NO: 349083 - DNA, 16 bp, M. musculus
acaggctggcctggaa

SEQ ID NO: 349084 - DNA, 16 bp, M. musculus
acaggctggccttgaa

SEQ ID NO: 349085 - DNA, 16 bp, M. musculus
acaggctgggtgtggt

SEQ ID NO: 349086 - DNA, 16 bp, M. musculus
acaggctgtggttcag

SEQ ID NO: 349087 - DNA, 16 bp, M. musculus
acaggcttgcaggaga

SEQ ID NO: 349088 - DNA, 16 bp, M. musculus
acaggctttctttgtg

SEQ ID NO: 349089 - DNA, 16 bp, M. musculus
acagggaaacaacagg

SEQ ID NO: 349090 - DNA, 16 bp, M. musculus
acagggaaagctgtca

SEQ ID NO: 349091 - DNA, 16 bp, M. musculus
acagggaatagaactt

SEQ ID NO: 349092 - DNA, 16 bp, M. musculus
acagggaatggggaag

SEQ ID NO: 349093 - DNA, 16 bp, M. musculus
acagggacacagagaa

SEQ ID NO: 349094 - DNA, 16 bp, M. musculus
acagggacacagtgga

SEQ ID NO: 349095 - DNA, 16 bp, M. musculus
acagggacagagacag

SEQ ID NO: 349096 - DNA, 16 bp, M. musculus
acagggacaggaggat

SEQ ID NO: 349097 - DNA, 16 bp, M. musculus
acagggacagtgtact

SEQ ID NO: 349098 - DNA, 16 bp, M. musculus
acagggacatcatcct

SEQ ID NO: 349099 - DNA, 16 bp, M. musculus
acagggacccagaagg

SEQ ID NO: 349100 - DNA, 16 bp, M. musculus
acagggactgaaggaa

SEQ ID NO: 349101 - DNA, 16 bp, M. musculus
acagggagagacagaa

SEQ ID NO: 349102 - DNA, 16 bp, M. musculus
acagggagcacaggga

SEQ ID NO: 349103 - DNA, 16 bp, M. musculus
acagggagccaggcaa

SEQ ID NO: 349104 - DNA, 16 bp, M. musculus
acagggaggacattag

SEQ ID NO: 349105 - DNA, 16 bp, M. musculus
acagggaggacattcc

SEQ ID NO: 349106 - DNA, 16 bp, M. musculus
acagggaggcagagac

SEQ ID NO: 349107 - DNA, 16 bp, M. musculus
acagggatgaggagga

SEQ ID NO: 349108 - DNA, 16 bp, M. musculus
acagggattctctgtg

SEQ ID NO: 349109 - DNA, 26 bp, M. musculus
acagggcaatatacctgatgtaatga

SEQ ID NO: 349110 - DNA, 16 bp, M. musculus
acagggcagagatatc

SEQ ID NO: 349111 - DNA, 16 bp, M. musculus
acagggcagggcaggg

SEQ ID NO: 349112 - DNA, 16 bp, M. musculus
acagggcatggctggc

SEQ ID NO: 349113 - DNA, 16 bp, M. musculus
acagggccacacctct

SEQ ID NO: 349114 - DNA, 17 bp, M. musculus
acagggctacagtgcct

SEQ ID NO: 349115 - DNA, 16 bp, M. musculus
acagggctccaaatgg

SEQ ID NO: 349116 - DNA, 16 bp, M. musculus
acagggctctgggcag

SEQ ID NO: 349117 - DNA, 16 bp, M. musculus
acagggcttctttgtg

SEQ ID NO: 349118 - DNA, 16 bp, M. musculus
acagggcttttttttt

SEQ ID NO: 349119 - DNA, 16 bp, M. musculus
acaggggaacactgct

SEQ ID NO: 349120 - DNA, 20 bp, M. musculus
acaggggaacgccagggcca

SEQ ID NO: 349121 - DNA, 16 bp, M. musculus
acaggggagatgtaca

SEQ ID NO: 349122 - DNA, 16 bp, M. musculus
acaggggcaggggcag

SEQ ID NO: 349123 - DNA, 16 bp, M. musculus
acaggggcccagaggg

SEQ ID NO: 349124 - DNA, 16 bp, M. musculus
acagggtctcccactg

SEQ ID NO: 349125 - DNA, 16 bp, M. musculus
acagggtctttctttg

SEQ ID NO: 349126 - DNA, 16 bp, M. musculus
acagggttcccaatgg

SEQ ID NO: 349127 - DNA, 16 bp, M. musculus
acagggttgggggagg

SEQ ID NO: 349128 - DNA, 16 bp, M. musculus
acagggtttcactgta

SEQ ID NO: 349129 - DNA, 16 bp, M. musculus
acagggtttctccttg

SEQ ID NO: 349130 - DNA, 16 bp, M. musculus
acagggtttctctgag

SEQ ID NO: 349131 - DNA, 16 bp, M. musculus
acagggtttctcttca

SEQ ID NO: 349132 - DNA, 16 bp, M. musculus
acagggtttttttttt

SEQ ID NO: 349133 - DNA, 16 bp, M. musculus
acaggtaatgacatca

SEQ ID NO: 349134 - DNA, 16 bp, M. musculus
acaggtacatcaatgg

SEQ ID NO: 349135 - DNA, 16 bp, M. musculus
acaggtagcccaggct

SEQ ID NO: 349136 - DNA, 16 bp, M. musculus
acaggtatgtgccact

SEQ ID NO: 349137 - DNA, 16 bp, M. musculus
acaggtctcttccagg

SEQ ID NO: 349138 - DNA, 16 bp, M. musculus
acaggtgaaagtgtgg

SEQ ID NO: 349139 - DNA, 16 bp, M. musculus
acaggtgaatgaatgg

SEQ ID NO: 349140 - DNA, 16 bp, M. musculus
acaggtgacagaattg

SEQ ID NO: 349141 - DNA, 16 bp, M. musculus
acaggtgattatgagc

SEQ ID NO: 349142 - DNA, 16 bp, M. musculus
acaggtgctgggaatt

SEQ ID NO: 349143 - DNA, 16 bp, M. musculus
acaggtgctggggagg

SEQ ID NO: 349144 - DNA, 16 bp, M. musculus
acaggtggatttctgt

SEQ ID NO: 349145 - DNA, 16 bp, M. musculus
acaggtggttgtgagt

SEQ ID NO: 349146 - DNA, 16 bp, M. musculus
acaggtgtgtgccatc

SEQ ID NO: 349147 - DNA, 16 bp, M. musculus
acaggtgtgtgctgct

SEQ ID NO: 349148 - DNA, 16 bp, M. musculus
acaggtgtgtgtgtgt

SEQ ID NO: 349149 - DNA, 16 bp, M. musculus
acaggttcagcctctc

SEQ ID NO: 349150 - DNA, 16 bp, M. musculus
acaggttcagtgaagt

SEQ ID NO: 349151 - DNA, 16 bp, M. musculus
acaggttcatggagag

SEQ ID NO: 349152 - DNA, 16 bp, M. musculus
acaggttcctgtcagc

SEQ ID NO: 349153 - DNA, 16 bp, M. musculus
acaggttgtgtgtgtg

SEQ ID NO: 349154 - DNA, 16 bp, M. musculus
acaggtttgcctacag

SEQ ID NO: 349155 - DNA, 16 bp, M. musculus
acaggtttgtgtgtgt

SEQ ID NO: 349156 - DNA, 16 bp, M. musculus
acaggttttctcactg

SEQ ID NO: 349157 - DNA, 16 bp, M. musculus
acaggtttttgttgtt

SEQ ID NO: 349158 - DNA, 16 bp, M. musculus
acaggttttttgtttt

SEQ ID NO: 349159 - DNA, 16 bp, M. musculus
acagtaaaactcatgg

SEQ ID NO: 349160 - DNA, 16 bp, M. musculus
acagtaaaatcctgtc

SEQ ID NO: 349161 - DNA, 16 bp, M. musculus
acagtaaatattttta

SEQ ID NO: 349162 - DNA, 16 bp, M. musculus
acagtaacaaaacaga

SEQ ID NO: 349163 - DNA, 16 bp, M. musculus
acagtaataacaataa

SEQ ID NO: 349164 - DNA, 16 bp, M. musculus
acagtaatctggaaga

SEQ ID NO: 349165 - DNA, 16 bp, M. musculus
acagtaattaaaactt

SEQ ID NO: 349166 - DNA, 16 bp, M. musculus
acagtacatattgact

SEQ ID NO: 349167 - DNA, 16 bp, M. musculus
acagtacatgctggca

SEQ ID NO: 349168 - DNA, 16 bp, M. musculus
acagtactcaggaggc

SEQ ID NO: 349169 - DNA, 16 bp, M. musculus
acagtagaaaggacca

SEQ ID NO: 349170 - DNA, 16 bp, M. musculus
acagtatactcacata

SEQ ID NO: 349171 - DNA, 16 bp, M. musculus
acagtatctatctaca

SEQ ID NO: 349172 - DNA, 17 bp, M. musculus
acagtatttgcatttgt

SEQ ID NO: 349173 - DNA, 16 bp, M. musculus
acagtattttcttttt

SEQ ID NO: 349174 - DNA, 16 bp, M. musculus
acagtatttttttctt

SEQ ID NO: 349175 - DNA, 16 bp, M. musculus
acagtcaaagacagca

SEQ ID NO: 349176 - DNA, 16 bp, M. musculus
acagtcacactcacac

SEQ ID NO: 349177 - DNA, 16 bp, M. musculus
acagtcaccaaaccca

SEQ ID NO: 349178 - DNA, 17 bp, M. musculus
acagtcactgctgtttg

SEQ ID NO: 349179 - DNA, 16 bp, M. musculus
acagtcagcaattgga

SEQ ID NO: 349180 - DNA, 16 bp, M. musculus
acagtcagccctgaaa

SEQ ID NO: 349181 - DNA, 16 bp, M. musculus
acagtcaggaagcaga

SEQ ID NO: 349182 - DNA, 16 bp, M. musculus
acagtcagggagcaga

SEQ ID NO: 349183 - DNA, 16 bp, M. musculus
acagtccatcactgtg

SEQ ID NO: 349184 - DNA, 16 bp, M. musculus
acagtcccaccagcaa

SEQ ID NO: 349185 - DNA, 16 bp, M. musculus
acagtcccatatctcc

SEQ ID NO: 349186 - DNA, 16 bp, M. musculus
acagtccctgtttcag

SEQ ID NO: 349187 - DNA, 17 bp, M. musculus
acagtcgggtgctctta

SEQ ID NO: 349188 - DNA, 16 bp, M. musculus
acagtctagacaggaa

SEQ ID NO: 349189 - DNA, 16 bp, M. musculus
acagtctcaaaaataa

SEQ ID NO: 349190 - DNA, 16 bp, M. musculus
acagtctcactctgta

SEQ ID NO: 349191 - DNA, 16 bp, M. musculus
acagtctctcagcaga

SEQ ID NO: 349192 - DNA, 16 bp, M. musculus
acagtctgaaggcctc

SEQ ID NO: 349193 - DNA, 16 bp, M. musculus
acagtctgtcactgaa

SEQ ID NO: 349194 - DNA, 16 bp, M. musculus
acagtcttgctgtgta

SEQ ID NO: 349195 - DNA, 16 bp, M. musculus
acagtctttccaaata

SEQ ID NO: 349196 - DNA, 16 bp, M. musculus
acagtgaaaacaacaa

SEQ ID NO: 349197 - DNA, 17 bp, M. musculus
acagtgaaagcagtcct

SEQ ID NO: 349198 - DNA, 16 bp, M. musculus
acagtgacacacctag

SEQ ID NO: 349199 - DNA, 16 bp, M. musculus
acagtgacactcctac

SEQ ID NO: 349200 - DNA, 16 bp, M. musculus
acagtgacagaaatga

SEQ ID NO: 349201 - DNA, 16 bp, M. musculus
acagtgacagtgacag

SEQ ID NO: 349202 - DNA, 16 bp, M. musculus
acagtgacagtgtact

SEQ ID NO: 349203 - DNA, 16 bp, M. musculus
acagtgacatctgtag

SEQ ID NO: 349204 - DNA, 16 bp, M. musculus
acagtgaccatgaaga

SEQ ID NO: 349205 - DNA, 16 bp, M. musculus
acagtgactttttttt

SEQ ID NO: 349206 - DNA, 16 bp, M. musculus
acagtgagaaaaatta

SEQ ID NO: 349207 - DNA, 16 bp, M. musculus
acagtgagaccctgac

SEQ ID NO: 349208 - DNA, 16 bp, M. musculus
acagtgagaccctgcc

SEQ ID NO: 349209 - DNA, 16 bp, M. musculus
acagtgagactctgtc

SEQ ID NO: 349210 - DNA, 16 bp, M. musculus
acagtgagagagacag

SEQ ID NO: 349211 - DNA, 16 bp, M. musculus
acagtgagagcctgtg

SEQ ID NO: 349212 - DNA, 16 bp, M. musculus
acagtgagattttttt

SEQ ID NO: 349213 - DNA, 16 bp, M. musculus
acagtgagttcaagga

SEQ ID NO: 349214 - DNA, 16 bp, M. musculus
acagtgataactaaaa

SEQ ID NO: 349215 - DNA, 16 bp, M. musculus
acagtgatgatgatga

SEQ ID NO: 349216 - DNA, 16 bp, M. musculus
acagtgatgtggaaat

SEQ ID NO: 349217 - DNA, 16 bp, M. musculus
acagtgcaagttccag

SEQ ID NO: 349218 - DNA, 16 bp, M. musculus
acagtgcactcacata

SEQ ID NO: 349219 - DNA, 16 bp, M. musculus
acagtgccacctgctg

SEQ ID NO: 349220 - DNA, 16 bp, M. musculus
acagtgctgagcctca

SEQ ID NO: 349221 - DNA, 16 bp, M. musculus
acagtgctgcacacag

SEQ ID NO: 349222 - DNA, 16 bp, M. musculus
acagtgctggaggagc

SEQ ID NO: 349223 - DNA, 16 bp, M. musculus
acagtggaagaaggaa

SEQ ID NO: 349224 - DNA, 16 bp, M. musculus
acagtggagcagctgg

SEQ ID NO: 349225 - DNA, 16 bp, M. musculus
acagtggagcatgtgt

SEQ ID NO: 349226 - DNA, 16 bp, M. musculus
acagtggctacagcaa

SEQ ID NO: 349227 - DNA, 16 bp, M. musculus
acagtggctcacaact

SEQ ID NO: 349228 - DNA, 16 bp, M. musculus
acagtgggaagaggga

SEQ ID NO: 349229 - DNA, 16 bp, M. musculus
acagtgggagacaagc

SEQ ID NO: 349230 - DNA, 16 bp, M. musculus
acagtgggggaaaaaa

SEQ ID NO: 349231 - DNA, 16 bp, M. musculus
acagtgggggagggga

SEQ ID NO: 349232 - DNA, 16 bp, M. musculus
acagtggttaagagca

SEQ ID NO: 349233 - DNA, 16 bp, M. musculus
acagtggttctcagtc

SEQ ID NO: 349234 - DNA, 16 bp, M. musculus
acagtgtactcatatg

SEQ ID NO: 349235 - DNA, 16 bp, M. musculus
acagtgtactcttata

SEQ ID NO: 349236 - DNA, 16 bp, M. musculus
acagtgtcagctctgg

SEQ ID NO: 349237 - DNA, 16 bp, M. musculus
acagtgtcctaattaa

SEQ ID NO: 349238 - DNA, 16 bp, M. musculus
acagtgtcctgtgcct

SEQ ID NO: 349239 - DNA, 16 bp, M. musculus
acagtgtgctcacata

SEQ ID NO: 349240 - DNA, 16 bp, M. musculus
acagtgtgtgcatcca

SEQ ID NO: 349241 - DNA, 16 bp, M. musculus
acagtgtgtgctttga

SEQ ID NO: 349242 - DNA, 16 bp, M. musculus
acagtgttcttaacca

SEQ ID NO: 349243 - DNA, 16 bp, M. musculus
acagtgttgcagatct

SEQ ID NO: 349244 - DNA, 16 bp, M. musculus
acagttaaaagtctct

SEQ ID NO: 349245 - DNA, 16 bp, M. musculus
acagttaaagaaaaag

SEQ ID NO: 349246 - DNA, 16 bp, M. musculus
acagttaaagaaaatg

SEQ ID NO: 349247 - DNA, 16 bp, M. musculus
acagttaacactaacc

SEQ ID NO: 349248 - DNA, 16 bp, M. musculus
acagttaagaaattgc

SEQ ID NO: 349249 - DNA, 16 bp, M. musculus
acagttaggaagcaga

SEQ ID NO: 349250 - DNA, 16 bp, M. musculus
acagttagtgctctta

SEQ ID NO: 349251 - DNA, 16 bp, M. musculus
acagttataaaatagc

SEQ ID NO: 349252 - DNA, 16 bp, M. musculus
acagttataaagtagt

SEQ ID NO: 349253 - DNA, 16 bp, M. musculus
acagttatttatttat

SEQ ID NO: 349254 - DNA, 17 bp, M. musculus
acagttcaaggccagcc

SEQ ID NO: 349255 - DNA, 16 bp, M. musculus
acagttcagcagttaa

SEQ ID NO: 349256 - DNA, 16 bp, M. musculus
acagttcagttcacag

SEQ ID NO: 349257 - DNA, 27 bp, M. musculus
acagttcataagattcaaaaatggttt

SEQ ID NO: 349258 - DNA, 16 bp, M. musculus
acagttcatgttgtgg

SEQ ID NO: 349259 - DNA, 16 bp, M. musculus
acagttcctcatctca

SEQ ID NO: 349260 - DNA, 16 bp, M. musculus
acagttcctcattcca

SEQ ID NO: 349261 - DNA, 16 bp, M. musculus
acagttctcaaaagaa

SEQ ID NO: 349262 - DNA, 16 bp, M. musculus
acagttctcagaaaaa

SEQ ID NO: 349263 - DNA, 16 bp, M. musculus
acagttctggaagctg

SEQ ID NO: 349264 - DNA, 16 bp, M. musculus
acagttctgggtcaga

SEQ ID NO: 349265 - DNA, 16 bp, M. musculus
acagttgaaccagcac

SEQ ID NO: 349266 - DNA, 16 bp, M. musculus
acagttgaaggaattg

SEQ ID NO: 349267 - DNA, 16 bp, M. musculus
acagttggaaggtgga

SEQ ID NO: 349268 - DNA, 16 bp, M. musculus
acagttgttttgtttt

SEQ ID NO: 349269 - DNA, 16 bp, M. musculus
acagtttcaaaggttt

SEQ ID NO: 349270 - DNA, 16 bp, M. musculus
acagtttctctgtgta

SEQ ID NO: 349271 - DNA, 16 bp, M. musculus
acagtttgaggagaaa

SEQ ID NO: 349272 - DNA, 16 bp, M. musculus
acagtttgatgatgtg

SEQ ID NO: 349273 - DNA, 16 bp, M. musculus
acagtttgtaaagctt

SEQ ID NO: 349274 - DNA, 16 bp, M. musculus
acagtttgtttgtttg

SEQ ID NO: 349275 - DNA, 16 bp, M. musculus
acagttttacttattt

SEQ ID NO: 349276 - DNA, 16 bp, M. musculus
acagttttattaattt

SEQ ID NO: 349277 - DNA, 16 bp, M. musculus
acagttttatttttaa

SEQ ID NO: 349278 - DNA, 16 bp, M. musculus
acagttttctgagaaa

SEQ ID NO: 349279 - DNA, 16 bp, M. musculus
acagttttgttcaatt

SEQ ID NO: 349280 - DNA, 16 bp, M. musculus
acagttttgttgtttt

SEQ ID NO: 349281 - DNA, 16 bp, M. musculus
acagtttttaaaaaga

SEQ ID NO: 349282 - DNA, 16 bp, M. musculus
acagtttttccagcag

SEQ ID NO: 349283 - DNA, 16 bp, M. musculus
acataaaaacagagac

SEQ ID NO: 349284 - DNA, 16 bp, M. musculus
acataaaaatattctt

SEQ ID NO: 349285 - DNA, 16 bp, M. musculus
acataaaaatttaaag

SEQ ID NO: 349286 - DNA, 16 bp, M. musculus
acataaaacatctttc

SEQ ID NO: 349287 - DNA, 16 bp, M. musculus
acataaaagaacacat

SEQ ID NO: 349288 - DNA, 16 bp, M. musculus
acataaaagaagactt

SEQ ID NO: 349289 - DNA, 16 bp, M. musculus
acataaaagaatatat

SEQ ID NO: 349290 - DNA, 16 bp, M. musculus
acataaaagccaggta

SEQ ID NO: 349291 - DNA, 16 bp, M. musculus
acataaaatacatttt

SEQ ID NO: 349292 - DNA, 16 bp, M. musculus
acataaaatatgtttt

SEQ ID NO: 349293 - DNA, 16 bp, M. musculus
acataaacaaactgaa

SEQ ID NO: 349294 - DNA, 16 bp, M. musculus
acataaacagaatcag

SEQ ID NO: 349295 - DNA, 16 bp, M. musculus
acataaacatatacat

SEQ ID NO: 349296 - DNA, 16 bp, M. musculus
acataaatattgaaat

SEQ ID NO: 349297 - DNA, 16 bp, M. musculus
acataaatgcacacaa

SEQ ID NO: 349298 - DNA, 16 bp, M. musculus
acataaatgtgtatat

SEQ ID NO: 349299 - DNA, 16 bp, M. musculus
acataacatttttatt

SEQ ID NO: 349300 - DNA, 16 bp, M. musculus
acataagactctgtct

SEQ ID NO: 349301 - DNA, 16 bp, M. musculus
acataaggacattaga

SEQ ID NO: 349302 - DNA, 16 bp, M. musculus
acataatacacatgta

SEQ ID NO: 349303 - DNA, 16 bp, M. musculus
acataatagaagcaat

SEQ ID NO: 349304 - DNA, 16 bp, M. musculus
acataatatatatgca

SEQ ID NO: 349305 - DNA, 16 bp, M. musculus
acataatgactgtctc

SEQ ID NO: 349306 - DNA, 22 bp, M. musculus
acataatggtcttgaaatcatg

SEQ ID NO: 349307 - DNA, 16 bp, M. musculus
acataattaaaagcaa

SEQ ID NO: 349308 - DNA, 16 bp, M. musculus
acataattaaagataa

SEQ ID NO: 349309 - DNA, 16 bp, M. musculus
acataatttaagatta

SEQ ID NO: 349310 - DNA, 16 bp, M. musculus
acataattttaaaagt

SEQ ID NO: 349311 - DNA, 16 bp, M. musculus
acataattttgttctt

SEQ ID NO: 349312 - DNA, 16 bp, M. musculus
acatacaaacatacag

SEQ ID NO: 349313 - DNA, 16 bp, M. musculus
acatacaagcaaaata

SEQ ID NO: 349314 - DNA, 16 bp, M. musculus
acatacaatgtatttt

SEQ ID NO: 349315 - DNA, 16 bp, M. musculus
acatacacaaagatac

SEQ ID NO: 349316 - DNA, 16 bp, M. musculus
acatacacaatatata

SEQ ID NO: 349317 - DNA, 16 bp, M. musculus
acatacacacaaagca

SEQ ID NO: 349318 - DNA, 16 bp, M. musculus
acatacacacaaatga

SEQ ID NO: 349319 - DNA, 16 bp, M. musculus
acatacacacaatatt

SEQ ID NO: 349320 - DNA, 16 bp, M. musculus
acatacacacacacag

SEQ ID NO: 349321 - DNA, 16 bp, M. musculus
acatacacacacacat

SEQ ID NO: 349322 - DNA, 16 bp, M. musculus
acatacacacacatac

SEQ ID NO: 349323 - DNA, 18 bp, M. musculus
acatacacacacatacac

SEQ ID NO: 349324 - DNA, 16 bp, M. musculus
acatacacacacatta

SEQ ID NO: 349325 - DNA, 16 bp, M. musculus
acatacacacactcca

SEQ ID NO: 349326 - DNA, 16 bp, M. musculus
acatacacacacttgc

SEQ ID NO: 349327 - DNA, 16 bp, M. musculus
acatacacacagaaaa

SEQ ID NO: 349328 - DNA, 16 bp, M. musculus
acatacacacaggcac

SEQ ID NO: 349329 - DNA, 16 bp, M. musculus
acatacacacatatac

SEQ ID NO: 349330 - DNA, 16 bp, M. musculus
acatacacagagagag

SEQ ID NO: 349331 - DNA, 16 bp, M. musculus
acatacacagagatag

SEQ ID NO: 349332 - DNA, 16 bp, M. musculus
acatacacagaggacc

SEQ ID NO: 349333 - DNA, 16 bp, M. musculus
acatacacagcagagg

SEQ ID NO: 349334 - DNA, 16 bp, M. musculus
acatacacaggcacac

SEQ ID NO: 349335 - DNA, 16 bp, M. musculus
acatacacatgtgcat

SEQ ID NO: 349336 - DNA, 16 bp, M. musculus
acatacacatttaaaa

SEQ ID NO: 349337 - DNA, 16 bp, M. musculus
acatacacgcagacaa

SEQ ID NO: 349338 - DNA, 16 bp, M. musculus
acatacactacacaca

SEQ ID NO: 349339 - DNA, 16 bp, M. musculus
acatacactttttttt

SEQ ID NO: 349340 - DNA, 16 bp, M. musculus
acatacagagttccag

SEQ ID NO: 349341 - DNA, 16 bp, M. musculus
acatacagatacacat

SEQ ID NO: 349342 - DNA, 16 bp, M. musculus
acatacaggaagccta

SEQ ID NO: 349343 - DNA, 16 bp, M. musculus
acatacagtggaaaaa

SEQ ID NO: 349344 - DNA, 16 bp, M. musculus
acatacataaatattt

SEQ ID NO: 349345 - DNA, 16 bp, M. musculus
acatacatacacacat

SEQ ID NO: 349346 - DNA, 16 bp, M. musculus
acatacatacacatag

SEQ ID NO: 349347 - DNA, 16 bp, M. musculus
acatacatacatagat

SEQ ID NO: 349348 - DNA, 16 bp, M. musculus
acatacatacatgcag

SEQ ID NO: 349349 - DNA, 16 bp, M. musculus
acatacatacatgtgt

SEQ ID NO: 349350 - DNA, 16 bp, M. musculus
acatacataccacaca

SEQ ID NO: 349351 - DNA, 16 bp, M. musculus
acatacatagaataaa

SEQ ID NO: 349352 - DNA, 16 bp, M. musculus
acatacatagatatat

SEQ ID NO: 349353 - DNA, 16 bp, M. musculus
acatacatatacatgt

SEQ ID NO: 349354 - DNA, 16 bp, M. musculus
acatacatatatatag

SEQ ID NO: 349355 - DNA, 16 bp, M. musculus
acatacatatatatgt

SEQ ID NO: 349356 - DNA, 16 bp, M. musculus
acatacatatgaaaaa

SEQ ID NO: 349357 - DNA, 16 bp, M. musculus
acatacatatgcatat

SEQ ID NO: 349358 - DNA, 16 bp, M. musculus
acatacatatgtatac

SEQ ID NO: 349359 - DNA, 16 bp, M. musculus
acatacatcacatata

SEQ ID NO: 349360 - DNA, 16 bp, M. musculus
acatacatccacacat

SEQ ID NO: 349361 - DNA, 16 bp, M. musculus
acatacatgcacacta

SEQ ID NO: 349362 - DNA, 16 bp, M. musculus
acatacatgcacactt

SEQ ID NO: 349363 - DNA, 16 bp, M. musculus
acatacatgcacataa

SEQ ID NO: 349364 - DNA, 16 bp, M. musculus
acatacatgtacatgt

SEQ ID NO: 349365 - DNA, 16 bp, M. musculus
acatacatgtatatat

SEQ ID NO: 349366 - DNA, 16 bp, M. musculus
acatacatgtgtatat

SEQ ID NO: 349367 - DNA, 16 bp, M. musculus
acatacatttaaaaag

SEQ ID NO: 349368 - DNA, 16 bp, M. musculus
acatacatttatacat

SEQ ID NO: 349369 - DNA, 16 bp, M. musculus
acatacatttatttat

SEQ ID NO: 349370 - DNA, 16 bp, M. musculus
acataccacatgcaca

SEQ ID NO: 349371 - DNA, 16 bp, M. musculus
acataccaggcatgtc

SEQ ID NO: 349372 - DNA, 16 bp, M. musculus
acatacctacacacat

SEQ ID NO: 349373 - DNA, 16 bp, M. musculus
acatacctgcatacat

SEQ ID NO: 349374 - DNA, 16 bp, M. musculus
acatactacatacata

SEQ ID NO: 349375 - DNA, 16 bp, M. musculus
acatactcagtcacaa

SEQ ID NO: 349376 - DNA, 16 bp, M. musculus
acatactctcacacat

SEQ ID NO: 349377 - DNA, 16 bp, M. musculus
acatactgagaaagaa

SEQ ID NO: 349378 - DNA, 16 bp, M. musculus
acatactggagagaaa

SEQ ID NO: 349379 - DNA, 16 bp, M. musculus
acatacttacacacag

SEQ ID NO: 349380 - DNA, 16 bp, M. musculus
acatactttaaaatat

SEQ ID NO: 349381 - DNA, 16 bp, M. musculus
acatagaaaaatattt

SEQ ID NO: 349382 - DNA, 16 bp, M. musculus
acatagaaaaatcaag

SEQ ID NO: 349383 - DNA, 16 bp, M. musculus
acatagaaaattctag

SEQ ID NO: 349384 - DNA, 16 bp, M. musculus
acatagaaagaccctg

SEQ ID NO: 349385 - DNA, 16 bp, M. musculus
acatagacacaggcac

SEQ ID NO: 349386 - DNA, 16 bp, M. musculus
acatagatagatagat

SEQ ID NO: 349387 - DNA, 16 bp, M. musculus
acatagcaaaagacca

SEQ ID NO: 349388 - DNA, 16 bp, M. musculus
acatagcaactcacaa

SEQ ID NO: 349389 - DNA, 16 bp, M. musculus
acatagcaagatcttg

SEQ ID NO: 349390 - DNA, 16 bp, M. musculus
acatagcacatacaca

SEQ ID NO: 349391 - DNA, 16 bp, M. musculus
acatagctgtctcttg

SEQ ID NO: 349392 - DNA, 16 bp, M. musculus
acataggaagttccag

SEQ ID NO: 349393 - DNA, 16 bp, M. musculus
acatagtactacctga

SEQ ID NO: 349394 - DNA, 16 bp, M. musculus
acatagtgaattcaag

SEQ ID NO: 349395 - DNA, 16 bp, M. musculus
acatataactatatat

SEQ ID NO: 349396 - DNA, 16 bp, M. musculus
acatataatgtgtata

SEQ ID NO: 349397 - DNA, 16 bp, M. musculus
acatataattaaaagt

SEQ ID NO: 349398 - DNA, 16 bp, M. musculus
acatatacacacacat

SEQ ID NO: 349399 - DNA, 16 bp, M. musculus
acatatacagagagag

SEQ ID NO: 349400 - DNA, 16 bp, M. musculus
acatatactcacacag

SEQ ID NO: 349401 - DNA, 16 bp, M. musculus
acatatactcatatat

SEQ ID NO: 349402 - DNA, 16 bp, M. musculus
acatatacttttaaaa

SEQ ID NO: 349403 - DNA, 16 bp, M. musculus
acatatataaagaaca

SEQ ID NO: 349404 - DNA, 16 bp, M. musculus
acatatatacaaacac

SEQ ID NO: 349405 - DNA, 16 bp, M. musculus
acatatatacacacac

SEQ ID NO: 349406 - DNA, 16 bp, M. musculus
acatatatagtgtata

SEQ ID NO: 349407 - DNA, 16 bp, M. musculus
acatatatatatatgt

SEQ ID NO: 349408 - DNA, 16 bp, M. musculus
acatatatatatttgt

SEQ ID NO: 349409 - DNA, 16 bp, M. musculus
acatatatatgcacat

SEQ ID NO: 349410 - DNA, 16 bp, M. musculus
acatatatatttatgt

SEQ ID NO: 349411 - DNA, 16 bp, M. musculus
acatatatgaacacac

SEQ ID NO: 349412 - DNA, 16 bp, M. musculus
acatatatgaagaact

SEQ ID NO: 349413 - DNA, 16 bp, M. musculus
acatatatgaataaat

SEQ ID NO: 349414 - DNA, 16 bp, M. musculus
acatatatgagtgttt

SEQ ID NO: 349415 - DNA, 16 bp, M. musculus
acatatatgcaagcaa

SEQ ID NO: 349416 - DNA, 16 bp, M. musculus
acatatatgcacatat

SEQ ID NO: 349417 - DNA, 16 bp, M. musculus
acatatatgcacattt

SEQ ID NO: 349418 - DNA, 16 bp, M. musculus
acatatatgcaggcaa

SEQ ID NO: 349419 - DNA, 16 bp, M. musculus
acatatatgcatgtgt

SEQ ID NO: 349420 - DNA, 16 bp, M. musculus
acatatatgtacatat

SEQ ID NO: 349421 - DNA, 16 bp, M. musculus
acatatatgtatataa

SEQ ID NO: 349422 - DNA, 16 bp, M. musculus
acatatatgtatatat

SEQ ID NO: 349423 - DNA, 16 bp, M. musculus
acatatatgtatatga

SEQ ID NO: 349424 - DNA, 16 bp, M. musculus
acatatatgtatgtat

SEQ ID NO: 349425 - DNA, 16 bp, M. musculus
acatatatttggggct

SEQ ID NO: 349426 - DNA, 16 bp, M. musculus
acatatcaaagcagac

SEQ ID NO: 349427 - DNA, 16 bp, M. musculus
acatatccccctttcc

SEQ ID NO: 349428 - DNA, 16 bp, M. musculus
acatatgaactcagag

SEQ ID NO: 349429 - DNA, 16 bp, M. musculus
acatatgaatatatat

SEQ ID NO: 349430 - DNA, 16 bp, M. musculus
acatatgcaaacatgt

SEQ ID NO: 349431 - DNA, 16 bp, M. musculus
acatatgcaaatatat

SEQ ID NO: 349432 - DNA, 16 bp, M. musculus
acatatgcagctggag

SEQ ID NO: 349433 - DNA, 16 bp, M. musculus
acatatgcaggcaaaa

SEQ ID NO: 349434 - DNA, 16 bp, M. musculus
acatatggatggatgg

SEQ ID NO: 349435 - DNA, 16 bp, M. musculus
acatatgtaaatatgt

SEQ ID NO: 349436 - DNA, 16 bp, M. musculus
acatatgtacaaacac

SEQ ID NO: 349437 - DNA, 16 bp, M. musculus
acatatgtacacatgt

SEQ ID NO: 349438 - DNA, 16 bp, M. musculus
acatatgtacatactt

SEQ ID NO: 349439 - DNA, 16 bp, M. musculus
acatatgtacatgcat

SEQ ID NO: 349440 - DNA, 16 bp, M. musculus
acatatgtataaatat

SEQ ID NO: 349441 - DNA, 16 bp, M. musculus
acatatgtataatata

SEQ ID NO: 349442 - DNA, 16 bp, M. musculus
acatatgtatacacaa

SEQ ID NO: 349443 - DNA, 16 bp, M. musculus
acatatgtattatata

SEQ ID NO: 349444 - DNA, 16 bp, M. musculus
acatatgtgcagggaa

SEQ ID NO: 349445 - DNA, 16 bp, M. musculus
acatatgtggtgcaca

SEQ ID NO: 349446 - DNA, 16 bp, M. musculus
acatatgtgtatgtga

SEQ ID NO: 349447 - DNA, 16 bp, M. musculus
acatatgtgtgtgtat

SEQ ID NO: 349448 - DNA, 16 bp, M. musculus
acatattacatatata

SEQ ID NO: 349449 - DNA, 16 bp, M. musculus
acatattcacatgtgt

SEQ ID NO: 349450 - DNA, 16 bp, M. musculus
acatattcttaaatat

SEQ ID NO: 349451 - DNA, 16 bp, M. musculus
acatattgggaaagga

SEQ ID NO: 349452 - DNA, 16 bp, M. musculus
acatatttaaagaaaa

SEQ ID NO: 349453 - DNA, 16 bp, M. musculus
acatatttataccttt

SEQ ID NO: 349454 - DNA, 16 bp, M. musculus
acatatttatgcatat

SEQ ID NO: 349455 - DNA, 16 bp, M. musculus
acatatttgtatatat

SEQ ID NO: 349456 - DNA, 16 bp, M. musculus
acatatttgtgtatat

SEQ ID NO: 349457 - DNA, 16 bp, M. musculus
acatattttagatatt

SEQ ID NO: 349458 - DNA, 16 bp, M. musculus
acatattttcatcact

SEQ ID NO: 349459 - DNA, 16 bp, M. musculus
acatatttttaaaaga

SEQ ID NO: 349460 - DNA, 16 bp, M. musculus
acatatttttatatgt

SEQ ID NO: 349461 - DNA, 16 bp, M. musculus
acatcaaaacattcat

SEQ ID NO: 349462 - DNA, 16 bp, M. musculus
acatcaaaatgaccat

SEQ ID NO: 349463 - DNA, 16 bp, M. musculus
acatcaaactctgtct

SEQ ID NO: 349464 - DNA, 16 bp, M. musculus
acatcaaagccatcat

SEQ ID NO: 349465 - DNA, 16 bp, M. musculus
acatcaaagggaactt

SEQ ID NO: 349466 - DNA, 16 bp, M. musculus
acatcaaattgtaaag

SEQ ID NO: 349467 - DNA, 16 bp, M. musculus
acatcaacaatagtgt

SEQ ID NO: 349468 - DNA, 16 bp, M. musculus
acatcaacatggcttc

SEQ ID NO: 349469 - DNA, 16 bp, M. musculus
acatcaacatggtccc

SEQ ID NO: 349470 - DNA, 16 bp, M. musculus
acatcaacctcaattc

SEQ ID NO: 349471 - DNA, 16 bp, M. musculus
acatcaagccagacaa

SEQ ID NO: 349472 - DNA, 16 bp, M. musculus
acatcaagtggctcac

SEQ ID NO: 349473 - DNA, 16 bp, M. musculus
acatcaatcactaatt

SEQ ID NO: 349474 - DNA, 16 bp, M. musculus
acatcaatgagaggaa

SEQ ID NO: 349475 - DNA, 16 bp, M. musculus
acatcacaactagaaa

SEQ ID NO: 349476 - DNA, 16 bp, M. musculus
acatcacagctcctgc

SEQ ID NO: 349477 - DNA, 16 bp, M. musculus
acatcacatacataca

SEQ ID NO: 349478 - DNA, 16 bp, M. musculus
acatcacattcttctt

SEQ ID NO: 349479 - DNA, 17 bp, M. musculus
acatcactggaaagaga

SEQ ID NO: 349480 - DNA, 16 bp, M. musculus
acatcactttcaaaca

SEQ ID NO: 349481 - DNA, 16 bp, M. musculus
acatcagagaaatgca

SEQ ID NO: 349482 - DNA, 22 bp, M. musculus
acatcagcaacagaatacaaga

SEQ ID NO: 349483 - DNA, 16 bp, M. musculus
acatcagcagggagga

SEQ ID NO: 349484 - DNA, 18 bp, M. musculus
acatcatcgccagcatct

SEQ ID NO: 349485 - DNA, 16 bp, M. musculus
acatcatcttggtgga

SEQ ID NO: 349486 - DNA, 16 bp, M. musculus
acatcatgaggaactg

SEQ ID NO: 349487 - DNA, 16 bp, M. musculus
acatcatgcaccccag

SEQ ID NO: 349488 - DNA, 16 bp, M. musculus
acatcattatgaacta

SEQ ID NO: 349489 - DNA, 16 bp, M. musculus
acatcattgccagcat

SEQ ID NO: 349490 - DNA, 16 bp, M. musculus
acatcatttctctctt

SEQ ID NO: 349491 - DNA, 16 bp, M. musculus
acatcattttcccttc

SEQ ID NO: 349492 - DNA, 16 bp, M. musculus
acatcatttttgctga

SEQ ID NO: 349493 - DNA, 16 bp, M. musculus
acatccaaatttcaaa

SEQ ID NO: 349494 - DNA, 16 bp, M. musculus
acatccacaagaacag

SEQ ID NO: 349495 - DNA, 16 bp, M. musculus
acatccacacatgcac

SEQ ID NO: 349496 - DNA, 16 bp, M. musculus
acatccacacatgcat

SEQ ID NO: 349497 - DNA, 16 bp, M. musculus
acatccaccatcaaat

SEQ ID NO: 349498 - DNA, 16 bp, M. musculus
acatccagaagatgtt

SEQ ID NO: 349499 - DNA, 16 bp, M. musculus
acatccaggatctcag

SEQ ID NO: 349500 - DNA, 16 bp, M. musculus
acatccaggcagacat

SEQ ID NO: 349501 - DNA, 16 bp, M. musculus
acatccaggcaggcat

SEQ ID NO: 349502 - DNA, 16 bp, M. musculus
acatccagtggaagaa

SEQ ID NO: 349503 - DNA, 16 bp, M. musculus
acatcccaccagagtt

SEQ ID NO: 349504 - DNA, 16 bp, M. musculus
acatccctgcatccct

SEQ ID NO: 349505 - DNA, 16 bp, M. musculus
acatcccttccccact

SEQ ID NO: 349506 - DNA, 16 bp, M. musculus
acatcctcaacagcat

SEQ ID NO: 349507 - DNA, 16 bp, M. musculus
acatcctcacagacat

SEQ ID NO: 349508 - DNA, 16 bp, M. musculus
acatcctcaccaccat

SEQ ID NO: 349509 - DNA, 16 bp, M. musculus
acatcctcaccatcat

SEQ ID NO: 349510 - DNA, 16 bp, M. musculus
acatcctccccagcat

SEQ ID NO: 349511 - DNA, 16 bp, M. musculus
acatcctcctgcctca

SEQ ID NO: 349512 - DNA, 16 bp, M. musculus
acatcctctcacaaga

SEQ ID NO: 349513 - DNA, 16 bp, M. musculus
acatcctctcatgtgt

SEQ ID NO: 349514 - DNA, 16 bp, M. musculus
acatcctcttcaacat

SEQ ID NO: 349515 - DNA, 16 bp, M. musculus
acatcctgatccaaag

SEQ ID NO: 349516 - DNA, 16 bp, M. musculus
acatcctggaaacaga

SEQ ID NO: 349517 - DNA, 16 bp, M. musculus
acatccttaatcccag

SEQ ID NO: 349518 - DNA, 16 bp, M. musculus
acatccttaccaacat

SEQ ID NO: 349519 - DNA, 16 bp, M. musculus
acatcctttcatgtgt

SEQ ID NO: 349520 - DNA, 17 bp, M. musculus
acatcctttgcccattt

SEQ ID NO: 349521 - DNA, 16 bp, M. musculus
acatctacacacacat

SEQ ID NO: 349522 - DNA, 16 bp, M. musculus
acatctaccccatcaa

SEQ ID NO: 349523 - DNA, 16 bp, M. musculus
acatctataatcccag

SEQ ID NO: 349524 - DNA, 16 bp, M. musculus
acatctcaaatgacat

SEQ ID NO: 349525 - DNA, 16 bp, M. musculus
acatctcaaatgatat

SEQ ID NO: 349526 - DNA, 16 bp, M. musculus
acatctcccccttatt

SEQ ID NO: 349527 - DNA, 16 bp, M. musculus
acatctcctttgtgct

SEQ ID NO: 349528 - DNA, 16 bp, M. musculus
acatctctgaagaaag

SEQ ID NO: 349529 - DNA, 16 bp, M. musculus
acatctctgtattcca

SEQ ID NO: 349530 - DNA, 16 bp, M. musculus
acatctctgtgtgtgt

SEQ ID NO: 349531 - DNA, 17 bp, M. musculus
acatctgattggttaac

SEQ ID NO: 349532 - DNA, 16 bp, M. musculus
acatctgcacccagga

SEQ ID NO: 349533 - DNA, 16 bp, M. musculus
acatctgctacatctg

SEQ ID NO: 349534 - DNA, 16 bp, M. musculus
acatctggaatcccag

SEQ ID NO: 349535 - DNA, 16 bp, M. musculus
acatctggatccaaag

SEQ ID NO: 349536 - DNA, 16 bp, M. musculus
acatctgggcactttc

SEQ ID NO: 349537 - DNA, 16 bp, M. musculus
acatctgtaattccag

SEQ ID NO: 349538 - DNA, 16 bp, M. musculus
acatctgtaattcctg

SEQ ID NO: 349539 - DNA, 16 bp, M. musculus
acatctgtagtcatta

SEQ ID NO: 349540 - DNA, 16 bp, M. musculus
acatctgtagtcccag

SEQ ID NO: 349541 - DNA, 16 bp, M. musculus
acatctgtctgcctct

SEQ ID NO: 349542 - DNA, 16 bp, M. musculus
acatctgtgactccag

SEQ ID NO: 349543 - DNA, 16 bp, M. musculus
acatctgtggttccag

SEQ ID NO: 349544 - DNA, 16 bp, M. musculus
acatctgtttcattta

SEQ ID NO: 349545 - DNA, 16 bp, M. musculus
acatcttcacttttct

SEQ ID NO: 349546 - DNA, 16 bp, M. musculus
acatcttcatggatct

SEQ ID NO: 349547 - DNA, 16 bp, M. musculus
acatcttcatttgaag

SEQ ID NO: 349548 - DNA, 16 bp, M. musculus
acatcttccttccttc

SEQ ID NO: 349549 - DNA, 16 bp, M. musculus
acatcttctccagcat

SEQ ID NO: 349550 - DNA, 16 bp, M. musculus
acatcttgattggaag

SEQ ID NO: 349551 - DNA, 16 bp, M. musculus
acatcttgcagacagg

SEQ ID NO: 349552 - DNA, 16 bp, M. musculus
acatcttggccctggt

SEQ ID NO: 349553 - DNA, 16 bp, M. musculus
acatcttggttcctgg

SEQ ID NO: 349554 - DNA, 16 bp, M. musculus
acatctttaacaaatg

SEQ ID NO: 349555 - DNA, 16 bp, M. musculus
acatctttaatcttag

SEQ ID NO: 349556 - DNA, 16 bp, M. musculus
acatctttatccaaag

SEQ ID NO: 349557 - DNA, 16 bp, M. musculus
acatcttttcccactg

SEQ ID NO: 349558 - DNA, 16 bp, M. musculus
acatctttttttaaaa

SEQ ID NO: 349559 - DNA, 16 bp, M. musculus
acatgaaaagcaagat

SEQ ID NO: 349560 - DNA, 16 bp, M. musculus
acatgaaaataaatat

SEQ ID NO: 349561 - DNA, 16 bp, M. musculus
acatgaaaatggaaat

SEQ ID NO: 349562 - DNA, 16 bp, M. musculus
acatgaaaattgttat

SEQ ID NO: 349563 - DNA, 16 bp, M. musculus
acatgaaacttgagaa

SEQ ID NO: 349564 - DNA, 17 bp, M. musculus
acatgaaagcacacaga

SEQ ID NO: 349565 - DNA, 16 bp, M. musculus
acatgaaatatataaa

SEQ ID NO: 349566 - DNA, 16 bp, M. musculus
acatgaaatgaaaata

SEQ ID NO: 349567 - DNA, 16 bp, M. musculus
acatgaaattgaagaa

SEQ ID NO: 349568 - DNA, 16 bp, M. musculus
acatgaacacacatga

SEQ ID NO: 349569 - DNA, 16 bp, M. musculus
acatgaacatgaacat

SEQ ID NO: 349570 - DNA, 16 bp, M. musculus
acatgaacatgtacat

SEQ ID NO: 349571 - DNA, 16 bp, M. musculus
acatgaagaaggactt

SEQ ID NO: 349572 - DNA, 16 bp, M. musculus
acatgaagacaaaaca

SEQ ID NO: 349573 - DNA, 16 bp, M. musculus
acatgaagacacacac

SEQ ID NO: 349574 - DNA, 16 bp, M. musculus
acatgaagaccaagat

SEQ ID NO: 349575 - DNA, 16 bp, M. musculus
acatgaagaccaagtt

SEQ ID NO: 349576 - DNA, 16 bp, M. musculus
acatgaagactcacaa

SEQ ID NO: 349577 - DNA, 16 bp, M. musculus
acatgaaggaaattgt

SEQ ID NO: 349578 - DNA, 16 bp, M. musculus
acatgaaggagagaga

SEQ ID NO: 349579 - DNA, 16 bp, M. musculus
acatgaagttcaagaa

SEQ ID NO: 349580 - DNA, 16 bp, M. musculus
acatgaagttggaagg

SEQ ID NO: 349581 - DNA, 16 bp, M. musculus
acatgaagttgggaga

SEQ ID NO: 349582 - DNA, 16 bp, M. musculus
acatgaatgcatacat

SEQ ID NO: 349583 - DNA, 16 bp, M. musculus
acatgaatgctgggaa

SEQ ID NO: 349584 - DNA, 16 bp, M. musculus
acatgacacatgcata

SEQ ID NO: 349585 - DNA, 16 bp, M. musculus
acatgacagcagatgc

SEQ ID NO: 349586 - DNA, 35 bp, M. musculus
acatgacagccctcatcaggtcttcaatgttactt

SEQ ID NO: 349587 - DNA, 16 bp, M. musculus
acatgacatggagaaa

SEQ ID NO: 349588 - DNA, 16 bp, M. musculus
acatgactgatagcca

SEQ ID NO: 349589 - DNA, 16 bp, M. musculus
acatgagagaaagaga

SEQ ID NO: 349590 - DNA, 16 bp, M. musculus
acatgagagccacagg

SEQ ID NO: 349591 - DNA, 16 bp, M. musculus
acatgagatcctatct

SEQ ID NO: 349592 - DNA, 16 bp, M. musculus
acatgagcacatacat

SEQ ID NO: 349593 - DNA, 19 bp, M. musculus
acatgagcgaacacataca

SEQ ID NO: 349594 - DNA, 16 bp, M. musculus
acatgagctccggggg

SEQ ID NO: 349595 - DNA, 16 bp, M. musculus
acatgagctctgggga

SEQ ID NO: 349596 - DNA, 16 bp, M. musculus
acatgaggaactgtac

SEQ ID NO: 349597 - DNA, 16 bp, M. musculus
acatgaggaccagagt

SEQ ID NO: 349598 - DNA, 16 bp, M. musculus
acatgaggacccagct

SEQ ID NO: 349599 - DNA, 16 bp, M. musculus
acatgagtcctgggga

SEQ ID NO: 349600 - DNA, 16 bp, M. musculus
acatgagtctttgggg

SEQ ID NO: 349601 - DNA, 16 bp, M. musculus
acatgagtgcagtgcc

SEQ ID NO: 349602 - DNA, 16 bp, M. musculus
acatgatagccaccag

SEQ ID NO: 349603 - DNA, 16 bp, M. musculus
acatgatatgtacaca

SEQ ID NO: 349604 - DNA, 16 bp, M. musculus
acatgatcatctcaat

SEQ ID NO: 349605 - DNA, 16 bp, M. musculus
acatgatcatcttgat

SEQ ID NO: 349606 - DNA, 16 bp, M. musculus
acatgatcatcttgtt

SEQ ID NO: 349607 - DNA, 16 bp, M. musculus
acatgatcatttcctt

SEQ ID NO: 349608 - DNA, 16 bp, M. musculus
acatgatcctcctgcc

SEQ ID NO: 349609 - DNA, 16 bp, M. musculus
acatgatctcacagca

SEQ ID NO: 349610 - DNA, 16 bp, M. musculus
acatgatgattctggg

SEQ ID NO: 349611 - DNA, 16 bp, M. musculus
acatgatggaagaaga

SEQ ID NO: 349612 - DNA, 16 bp, M. musculus
acatgatggagggaga

SEQ ID NO: 349613 - DNA, 16 bp, M. musculus
acatgatggctcacag

SEQ ID NO: 349614 - DNA, 16 bp, M. musculus
acatgatggtcatgga

SEQ ID NO: 349615 - DNA, 16 bp, M. musculus
acatgatgtttggaag

SEQ ID NO: 349616 - DNA, 16 bp, M. musculus
acatgattaaaaataa

SEQ ID NO: 349617 - DNA, 16 bp, M. musculus
acatgattcttttttt

SEQ ID NO: 349618 - DNA, 16 bp, M. musculus
acatgatttttaaaaa

SEQ ID NO: 349619 - DNA, 16 bp, M. musculus
acatgcaagaaaaaca

SEQ ID NO: 349620 - DNA, 16 bp, M. musculus
acatgcaagcaaaaca

SEQ ID NO: 349621 - DNA, 16 bp, M. musculus
acatgcacacacaaat

SEQ ID NO: 349622 - DNA, 16 bp, M. musculus
acatgcacacacacaa

SEQ ID NO: 349623 - DNA, 16 bp, M. musculus
acatgcacacacacag

SEQ ID NO: 349624 - DNA, 16 bp, M. musculus
acatgcacacacccac

SEQ ID NO: 349625 - DNA, 16 bp, M. musculus
acatgcacacagatgt

SEQ ID NO: 349626 - DNA, 16 bp, M. musculus
acatgcacacgcacac

SEQ ID NO: 349627 - DNA, 16 bp, M. musculus
acatgcacactcacat

SEQ ID NO: 349628 - DNA, 16 bp, M. musculus
acatgcacactgtggc

SEQ ID NO: 349629 - DNA, 16 bp, M. musculus
acatgcacagacatat

SEQ ID NO: 349630 - DNA, 16 bp, M. musculus
acatgcacatacatgt

SEQ ID NO: 349631 - DNA, 16 bp, M. musculus
acatgcacataccaca

SEQ ID NO: 349632 - DNA, 16 bp, M. musculus
acatgcacataggcac

SEQ ID NO: 349633 - DNA, 16 bp, M. musculus
acatgcacatatacat

SEQ ID NO: 349634 - DNA, 16 bp, M. musculus
acatgcacatatatgt

SEQ ID NO: 349635 - DNA, 16 bp, M. musculus
acatgcacatatgcaa

SEQ ID NO: 349636 - DNA, 16 bp, M. musculus
acatgcacatattcat

SEQ ID NO: 349637 - DNA, 16 bp, M. musculus
acatgcacatgtgcac

SEQ ID NO: 349638 - DNA, 16 bp, M. musculus
acatgcaccatggcat

SEQ ID NO: 349639 - DNA, 16 bp, M. musculus
acatgcagacaaaaca

SEQ ID NO: 349640 - DNA, 16 bp, M. musculus
acatgcagatatacat

SEQ ID NO: 349641 - DNA, 16 bp, M. musculus
acatgcaggcaaaaac

SEQ ID NO: 349642 - DNA, 16 bp, M. musculus
acatgcaggcaaaaca

SEQ ID NO: 349643 - DNA, 16 bp, M. musculus
acatgcaggcaaaata

SEQ ID NO: 349644 - DNA, 16 bp, M. musculus
acatgcaggcaaagta

SEQ ID NO: 349645 - DNA, 16 bp, M. musculus
acatgcaggcagaaca

SEQ ID NO: 349646 - DNA, 16 bp, M. musculus
acatgcaggtaaaata

SEQ ID NO: 349647 - DNA, 16 bp, M. musculus
acatgcagtttcactg

SEQ ID NO: 349648 - DNA, 16 bp, M. musculus
acatgcatacatatat

SEQ ID NO: 349649 - DNA, 16 bp, M. musculus
acatgcatacatgtgt

SEQ ID NO: 349650 - DNA, 16 bp, M. musculus
acatgcatcacacaca

SEQ ID NO: 349651 - DNA, 16 bp, M. musculus
acatgcatgcagtacc

SEQ ID NO: 349652 - DNA, 16 bp, M. musculus
acatgcatggtttgta

SEQ ID NO: 349653 - DNA, 16 bp, M. musculus
acatgcatgtatgtgt

SEQ ID NO: 349654 - DNA, 16 bp, M. musculus
acatgcatgtgtgtgt

SEQ ID NO: 349655 - DNA, 16 bp, M. musculus
acatgcatttacacac

SEQ ID NO: 349656 - DNA, 16 bp, M. musculus
acatgccagaagaggg

SEQ ID NO: 349657 - DNA, 16 bp, M. musculus
acatgccagagacctg

SEQ ID NO: 349658 - DNA, 16 bp, M. musculus
acatgcctctcctagg

SEQ ID NO: 349659 - DNA, 16 bp, M. musculus
acatgcctgcctctgc

SEQ ID NO: 349660 - DNA, 17 bp, M. musculus
acatgcctgtaatccca

SEQ ID NO: 349661 - DNA, 18 bp, M. musculus
acatgcctttaatcccaa

SEQ ID NO: 349662 - DNA, 16 bp, M. musculus
acatgcctttaatcta

SEQ ID NO: 349663 - DNA, 16 bp, M. musculus
acatgcctttaattcc

SEQ ID NO: 349664 - DNA, 16 bp, M. musculus
acatgctaaataaaga

SEQ ID NO: 349665 - DNA, 16 bp, M. musculus
acatgctaggcaaaca

SEQ ID NO: 349666 - DNA, 46 bp, M. musculus
acatgctccactatgttcatagcagccttatttataatagccagaa

SEQ ID NO: 349667 - DNA, 16 bp, M. musculus
acatgctctcctgcat

SEQ ID NO: 349668 - DNA, 16 bp, M. musculus
acatgctgactgccag

SEQ ID NO: 349669 - DNA, 16 bp, M. musculus
acatgctgagacaaga

SEQ ID NO: 349670 - DNA, 16 bp, M. musculus
acatgctggagcatct

SEQ ID NO: 349671 - DNA, 16 bp, M. musculus
acatgctggccttgaa

SEQ ID NO: 349672 - DNA, 16 bp, M. musculus
acatgcttcacatgct

SEQ ID NO: 349673 - DNA, 16 bp, M. musculus
acatgctttaaaaaaa

SEQ ID NO: 349674 - DNA, 16 bp, M. musculus
acatgctttctttttt

SEQ ID NO: 349675 - DNA, 16 bp, M. musculus
acatgcttttaaaata

SEQ ID NO: 349676 - DNA, 16 bp, M. musculus
acatggaaaattccag

SEQ ID NO: 349677 - DNA, 16 bp, M. musculus
acatggaacacagaca

SEQ ID NO: 349678 - DNA, 16 bp, M. musculus
acatggaagaaggaag

SEQ ID NO: 349679 - DNA, 16 bp, M. musculus
acatggaaggccatgc

SEQ ID NO: 349680 - DNA, 16 bp, M. musculus
acatggaaggccattg

SEQ ID NO: 349681 - DNA, 16 bp, M. musculus
acatggaagtcagagg

SEQ ID NO: 349682 - DNA, 16 bp, M. musculus
acatggacacacacac

SEQ ID NO: 349683 - DNA, 16 bp, M. musculus
acatggacacagcaat

SEQ ID NO: 349684 - DNA, 16 bp, M. musculus
acatggagaaactctg

SEQ ID NO: 349685 - DNA, 16 bp, M. musculus
acatggagacaaaaca

SEQ ID NO: 349686 - DNA, 16 bp, M. musculus
acatggagacatggag

SEQ ID NO: 349687 - DNA, 16 bp, M. musculus
acatggagatgcagaa

SEQ ID NO: 349688 - DNA, 16 bp, M. musculus
acatggaggaaggaaa

SEQ ID NO: 349689 - DNA, 16 bp, M. musculus
acatggaggaggaggt

SEQ ID NO: 349690 - DNA, 16 bp, M. musculus
acatggaggctcacaa

SEQ ID NO: 349691 - DNA, 16 bp, M. musculus
acatggagggacccat

SEQ ID NO: 349692 - DNA, 16 bp, M. musculus
acatggagggagggag

SEQ ID NO: 349693 - DNA, 16 bp, M. musculus
acatggatctctgtga

SEQ ID NO: 349694 - DNA, 16 bp, M. musculus
acatggatgcacacac

SEQ ID NO: 349695 - DNA, 16 bp, M. musculus
acatggatgctgggga

SEQ ID NO: 349696 - DNA, 16 bp, M. musculus
acatggatggcagtag

SEQ ID NO: 349697 - DNA, 16 bp, M. musculus
acatggattttttttt

SEQ ID NO: 349698 - DNA, 16 bp, M. musculus
acatggcagcacacag

SEQ ID NO: 349699 - DNA, 16 bp, M. musculus
acatggcagcccacag

SEQ ID NO: 349700 - DNA, 16 bp, M. musculus
acatggcagctcacag

SEQ ID NO: 349701 - DNA, 16 bp, M. musculus
acatggcagcttacag

SEQ ID NO: 349702 - DNA, 16 bp, M. musculus
acatggcagtgttcag

SEQ ID NO: 349703 - DNA, 16 bp, M. musculus
acatggcccagctcag

SEQ ID NO: 349704 - DNA, 16 bp, M. musculus
acatgggagctggaga

SEQ ID NO: 349705 - DNA, 16 bp, M. musculus
acatgggcacagtgga

SEQ ID NO: 349706 - DNA, 16 bp, M. musculus
acatgggctggaccta

SEQ ID NO: 349707 - DNA, 16 bp, M. musculus
acatggggctggagag

SEQ ID NO: 349708 - DNA, 16 bp, M. musculus
acatggggctggagga

SEQ ID NO: 349709 - DNA, 16 bp, M. musculus
acatgggtactgggga

SEQ ID NO: 349710 - DNA, 16 bp, M. musculus
acatgggtcctggaga

SEQ ID NO: 349711 - DNA, 16 bp, M. musculus
acatgggtgctgagga

SEQ ID NO: 349712 - DNA, 16 bp, M. musculus
acatgggtgctgggaa

SEQ ID NO: 349713 - DNA, 16 bp, M. musculus
acatgggtgctgggga

SEQ ID NO: 349714 - DNA, 16 bp, M. musculus
acatgggtggctcaca

SEQ ID NO: 349715 - DNA, 16 bp, M. musculus
acatggtactacagga

SEQ ID NO: 349716 - DNA, 16 bp, M. musculus
acatggtagaagggga

SEQ ID NO: 349717 - DNA, 16 bp, M. musculus
acatggtagctgagag

SEQ ID NO: 349718 - DNA, 16 bp, M. musculus
acatggtaggagagag

SEQ ID NO: 349719 - DNA, 16 bp, M. musculus
acatggtcaggatgga

SEQ ID NO: 349720 - DNA, 16 bp, M. musculus
acatggtcatggctgg

SEQ ID NO: 349721 - DNA, 16 bp, M. musculus
acatggtgactcacaa

SEQ ID NO: 349722 - DNA, 16 bp, M. musculus
acatggtgattcacaa

SEQ ID NO: 349723 - DNA, 16 bp, M. musculus
acatggtgctggaaaa

SEQ ID NO: 349724 - DNA, 16 bp, M. musculus
acatggtgctggagta

SEQ ID NO: 349725 - DNA, 16 bp, M. musculus
acatggtggaaagaga

SEQ ID NO: 349726 - DNA, 16 bp, M. musculus
acatggtggaactcat

SEQ ID NO: 349727 - DNA, 16 bp, M. musculus
acatggtggaagaaaa

SEQ ID NO: 349728 - DNA, 16 bp, M. musculus
acatggtggctaacaa

SEQ ID NO: 349729 - DNA, 20 bp, M. musculus
acatggtggctcacaaccac

SEQ ID NO: 349730 - DNA, 16 bp, M. musculus
acatggtggctcacag

SEQ ID NO: 349731 - DNA, 16 bp, M. musculus
acatggtggcttacaa

SEQ ID NO: 349732 - DNA, 16 bp, M. musculus
acatggtggcttataa

SEQ ID NO: 349733 - DNA, 16 bp, M. musculus
acatggtgggacccat

SEQ ID NO: 349734 - DNA, 16 bp, M. musculus
acatggtgggaggaga

SEQ ID NO: 349735 - DNA, 16 bp, M. musculus
acatggtggtacacac

SEQ ID NO: 349736 - DNA, 16 bp, M. musculus
acatggtggttcacag

SEQ ID NO: 349737 - DNA, 16 bp, M. musculus
acatggtggtttacaa

SEQ ID NO: 349738 - DNA, 16 bp, M. musculus
acatggttgaacaagt

SEQ ID NO: 349739 - DNA, 16 bp, M. musculus
acatggttggactcat

SEQ ID NO: 349740 - DNA, 16 bp, M. musculus
acatggttttgttttg

SEQ ID NO: 349741 - DNA, 16 bp, M. musculus
acatgtaaatacacat

SEQ ID NO: 349742 - DNA, 16 bp, M. musculus
acatgtaagcaaaaca

SEQ ID NO: 349743 - DNA, 16 bp, M. musculus
acatgtaagcaagggc

SEQ ID NO: 349744 - DNA, 16 bp, M. musculus
acatgtaatttttaaa

SEQ ID NO: 349745 - DNA, 16 bp, M. musculus
acatgtacacaacaca

SEQ ID NO: 349746 - DNA, 16 bp, M. musculus
acatgtacacactcat

SEQ ID NO: 349747 - DNA, 16 bp, M. musculus
acatgtacatgtacat

SEQ ID NO: 349748 - DNA, 16 bp, M. musculus
acatgtactttgtaaa

SEQ ID NO: 349749 - DNA, 16 bp, M. musculus
acatgtagcacacaca

SEQ ID NO: 349750 - DNA, 16 bp, M. musculus
acatgtaggcaaaaca

SEQ ID NO: 349751 - DNA, 16 bp, M. musculus
acatgtatacacacac

SEQ ID NO: 349752 - DNA, 16 bp, M. musculus
acatgtatacatgtaa

SEQ ID NO: 349753 - DNA, 16 bp, M. musculus
acatgtatatacacac

SEQ ID NO: 349754 - DNA, 16 bp, M. musculus
acatgtatatatgtgt

SEQ ID NO: 349755 - DNA, 16 bp, M. musculus
acatgtatatatttca

SEQ ID NO: 349756 - DNA, 16 bp, M. musculus
acatgtatatgtatat

SEQ ID NO: 349757 - DNA, 16 bp, M. musculus
acatgtatatgtatgc

SEQ ID NO: 349758 - DNA, 16 bp, M. musculus
acatgtatatgtattt

SEQ ID NO: 349759 - DNA, 16 bp, M. musculus
acatgtatgaaattct

SEQ ID NO: 349760 - DNA, 16 bp, M. musculus
acatgtatgaatatgt

SEQ ID NO: 349761 - DNA, 16 bp, M. musculus
acatgtatgaggattt

SEQ ID NO: 349762 - DNA, 16 bp, M. musculus
acatgtatgcagagga

SEQ ID NO: 349763 - DNA, 16 bp, M. musculus
acatgtatgcctggtg

SEQ ID NO: 349764 - DNA, 16 bp, M. musculus
acatgtatgtaatata

SEQ ID NO: 349765 - DNA, 16 bp, M. musculus
acatgtatgtatatat

SEQ ID NO: 349766 - DNA, 16 bp, M. musculus
acatgtatgtatgtgt

SEQ ID NO: 349767 - DNA, 16 bp, M. musculus
acatgtatgtgtacat

SEQ ID NO: 349768 - DNA, 16 bp, M. musculus
acatgtatttatgtat

SEQ ID NO: 349769 - DNA, 16 bp, M. musculus
acatgtatttatttat

SEQ ID NO: 349770 - DNA, 16 bp, M. musculus
acatgtatttattttt

SEQ ID NO: 349771 - DNA, 16 bp, M. musculus
acatgtatttttaaaa

SEQ ID NO: 349772 - DNA, 16 bp, M. musculus
acatgtatttttttat

SEQ ID NO: 349773 - DNA, 16 bp, M. musculus
acatgtcatcccagaa

SEQ ID NO: 349774 - DNA, 16 bp, M. musculus
acatgtctctctctct

SEQ ID NO: 349775 - DNA, 16 bp, M. musculus
acatgtctgtttctgt

SEQ ID NO: 349776 - DNA, 16 bp, M. musculus
acatgtgaagacactg

SEQ ID NO: 349777 - DNA, 16 bp, M. musculus
acatgtgaaggaacat

SEQ ID NO: 349778 - DNA, 16 bp, M. musculus
acatgtgcacacagac

SEQ ID NO: 349779 - DNA, 16 bp, M. musculus
acatgtgcacacatgt

SEQ ID NO: 349780 - DNA, 16 bp, M. musculus
acatgtgcacatgtac

SEQ ID NO: 349781 - DNA, 16 bp, M. musculus
acatgtgcaccatggc

SEQ ID NO: 349782 - DNA, 16 bp, M. musculus
acatgtgcatgcacat

SEQ ID NO: 349783 - DNA, 16 bp, M. musculus
acatgtgcatgcatgt

SEQ ID NO: 349784 - DNA, 16 bp, M. musculus
acatgtgctgaggcaa

SEQ ID NO: 349785 - DNA, 16 bp, M. musculus
acatgtgctttgagct

SEQ ID NO: 349786 - DNA, 16 bp, M. musculus
acatgtgtatacacat

SEQ ID NO: 349787 - DNA, 16 bp, M. musculus
acatgtgtatatacat

SEQ ID NO: 349788 - DNA, 16 bp, M. musculus
acatgtgtatgtatga

SEQ ID NO: 349789 - DNA, 16 bp, M. musculus
acatgtgtatgtatgt

SEQ ID NO: 349790 - DNA, 16 bp, M. musculus
acatgtgtatgtgcat

SEQ ID NO: 349791 - DNA, 16 bp, M. musculus
acatgtgtgtgcactt

SEQ ID NO: 349792 - DNA, 16 bp, M. musculus
acatgtgtgtgctggg

SEQ ID NO: 349793 - DNA, 16 bp, M. musculus
acatgtgtgtgtacat

SEQ ID NO: 349794 - DNA, 16 bp, M. musculus
acatgttacatgttac

SEQ ID NO: 349795 - DNA, 16 bp, M. musculus
acatgttcatgcatgt

SEQ ID NO: 349796 - DNA, 16 bp, M. musculus
acatgttccctagtag

SEQ ID NO: 349797 - DNA, 16 bp, M. musculus
acatgtttatgtgtgt

SEQ ID NO: 349798 - DNA, 16 bp, M. musculus
acatgtttattatata

SEQ ID NO: 349799 - DNA, 16 bp, M. musculus
acatgtttgaatactt

SEQ ID NO: 349800 - DNA, 16 bp, M. musculus
acatgtttgtgtgtga

SEQ ID NO: 349801 - DNA, 16 bp, M. musculus
acatgtttgtttttgt

SEQ ID NO: 349802 - DNA, 16 bp, M. musculus
acatgttttgttttgt

SEQ ID NO: 349803 - DNA, 16 bp, M. musculus
acattaaaaatgtaaa

SEQ ID NO: 349804 - DNA, 16 bp, M. musculus
acattaatggatttct

SEQ ID NO: 349805 - DNA, 16 bp, M. musculus
acattaattaaagaaa

SEQ ID NO: 349806 - DNA, 16 bp, M. musculus
acattacaactcataa

SEQ ID NO: 349807 - DNA, 16 bp, M. musculus
acattacgattcataa

SEQ ID NO: 349808 - DNA, 16 bp, M. musculus
acattaggaaggttga

SEQ ID NO: 349809 - DNA, 16 bp, M. musculus
acattatacacacata

SEQ ID NO: 349810 - DNA, 16 bp, M. musculus
acattatcatctcctt

SEQ ID NO: 349811 - DNA, 16 bp, M. musculus
acattcaacaattcct

SEQ ID NO: 349812 - DNA, 30 bp, M. musculus
acattcacaaagaaactcacacaatatgta

SEQ ID NO: 349813 - DNA, 16 bp, M. musculus
acattcacataatgaa

SEQ ID NO: 349814 - DNA, 16 bp, M. musculus
acattcacattcacac

SEQ ID NO: 349815 - DNA, 16 bp, M. musculus
acattcacttcccagt

SEQ ID NO: 349816 - DNA, 16 bp, M. musculus
acattcagaaggcaga

SEQ ID NO: 349817 - DNA, 16 bp, M. musculus
acattcaggcaaacac

SEQ ID NO: 349818 - DNA, 16 bp, M. musculus
acattcataaaagaaa

SEQ ID NO: 349819 - DNA, 16 bp, M. musculus
acattcatgaaagaaa

SEQ ID NO: 349820 - DNA, 16 bp, M. musculus
acattcatttaagaaa

SEQ ID NO: 349821 - DNA, 20 bp, M. musculus
acattccaagaggttgtaaa

SEQ ID NO: 349822 - DNA, 16 bp, M. musculus
acattccacacctcct

SEQ ID NO: 349823 - DNA, 16 bp, M. musculus
acattccagaagaggg

SEQ ID NO: 349824 - DNA, 16 bp, M. musculus
acattcccattccaaa

SEQ ID NO: 349825 - DNA, 16 bp, M. musculus
acattcctctttatct

SEQ ID NO: 349826 - DNA, 16 bp, M. musculus
acattctaaatgtgct

SEQ ID NO: 349827 - DNA, 16 bp, M. musculus
acattctcctctataa

SEQ ID NO: 349828 - DNA, 16 bp, M. musculus
acattcttaacaaaat

SEQ ID NO: 349829 - DNA, 16 bp, M. musculus
acattcttaatcatca

SEQ ID NO: 349830 - DNA, 16 bp, M. musculus
acattcttgtggagac

SEQ ID NO: 349831 - DNA, 16 bp, M. musculus
acattgaaacttatag

SEQ ID NO: 349832 - DNA, 16 bp, M. musculus
acattgatttttatcc

SEQ ID NO: 349833 - DNA, 16 bp, M. musculus
acattgcatattaaaa

SEQ ID NO: 349834 - DNA, 16 bp, M. musculus
acattgctaaagaggt

SEQ ID NO: 349835 - DNA, 16 bp, M. musculus
acattggaaatgtaaa

SEQ ID NO: 349836 - DNA, 16 bp, M. musculus
acattggcacagggga

SEQ ID NO: 349837 - DNA, 16 bp, M. musculus
acattggctttctatt

SEQ ID NO: 349838 - DNA, 16 bp, M. musculus
acattgggaaaaaaaa

SEQ ID NO: 349839 - DNA, 16 bp, M. musculus
acattggtcatggtgt

SEQ ID NO: 349840 - DNA, 16 bp, M. musculus
acattggtgctgggaa

SEQ ID NO: 349841 - DNA, 16 bp, M. musculus
acattgtaccccacac

SEQ ID NO: 349842 - DNA, 16 bp, M. musculus
acattgtactttaagt

SEQ ID NO: 349843 - DNA, 16 bp, M. musculus
acattgtcatgcattc

SEQ ID NO: 349844 - DNA, 16 bp, M. musculus
acattgttctcttaaa

SEQ ID NO: 349845 - DNA, 16 bp, M. musculus
acattgtttcaaaaaa

SEQ ID NO: 349846 - DNA, 16 bp, M. musculus
acattgttttaaaatt

SEQ ID NO: 349847 - DNA, 16 bp, M. musculus
acatttaaaaaatgta

SEQ ID NO: 349848 - DNA, 16 bp, M. musculus
acatttaaaaagaaga

SEQ ID NO: 349849 - DNA, 16 bp, M. musculus
acatttaaaacagaaa

SEQ ID NO: 349850 - DNA, 16 bp, M. musculus
acatttaaaatgtata

SEQ ID NO: 349851 - DNA, 16 bp, M. musculus
acatttaaagaaatat

SEQ ID NO: 349852 - DNA, 16 bp, M. musculus
acatttaaataaatga

SEQ ID NO: 349853 - DNA, 16 bp, M. musculus
acatttaaatgaattt

SEQ ID NO: 349854 - DNA, 16 bp, M. musculus
acatttaacatttaac

SEQ ID NO: 349855 - DNA, 16 bp, M. musculus
acatttaatacatttt

SEQ ID NO: 349856 - DNA, 16 bp, M. musculus
acatttaatctcagca

SEQ ID NO: 349857 - DNA, 16 bp, M. musculus
acatttaattaggact

SEQ ID NO: 349858 - DNA, 16 bp, M. musculus
acatttaattggggct

SEQ ID NO: 349859 - DNA, 16 bp, M. musculus
acatttaattttctgt

SEQ ID NO: 349860 - DNA, 16 bp, M. musculus
acatttacaaaatgga

SEQ ID NO: 349861 - DNA, 16 bp, M. musculus
acatttacacaattta

SEQ ID NO: 349862 - DNA, 16 bp, M. musculus
acatttacatatacac

SEQ ID NO: 349863 - DNA, 16 bp, M. musculus
acatttactttgatgt

SEQ ID NO: 349864 - DNA, 16 bp, M. musculus
acatttagaatgttat

SEQ ID NO: 349865 - DNA, 16 bp, M. musculus
acatttaggagtcaat

SEQ ID NO: 349866 - DNA, 16 bp, M. musculus
acatttatacaacaga

SEQ ID NO: 349867 - DNA, 16 bp, M. musculus
acatttatgttttatt

SEQ ID NO: 349868 - DNA, 16 bp, M. musculus
acatttattaaaaact

SEQ ID NO: 349869 - DNA, 16 bp, M. musculus
acatttatttagtgtg

SEQ ID NO: 349870 - DNA, 16 bp, M. musculus
acatttatttgtgtgt

SEQ ID NO: 349871 - DNA, 16 bp, M. musculus
acatttattttgaaaa

SEQ ID NO: 349872 - DNA, 16 bp, M. musculus
acatttattttgtatt

SEQ ID NO: 349873 - DNA, 16 bp, M. musculus
acatttatttttgtat

SEQ ID NO: 349874 - DNA, 16 bp, M. musculus
acatttcaaatatttt

SEQ ID NO: 349875 - DNA, 16 bp, M. musculus
acatttcaaatgtcat

SEQ ID NO: 349876 - DNA, 16 bp, M. musculus
acatttcacattcaaa

SEQ ID NO: 349877 - DNA, 16 bp, M. musculus
acatttcacattttat

SEQ ID NO: 349878 - DNA, 16 bp, M. musculus
acatttcagttataaa

SEQ ID NO: 349879 - DNA, 16 bp, M. musculus
acatttcatattaaaa

SEQ ID NO: 349880 - DNA, 16 bp, M. musculus
acatttcattctcaaa

SEQ ID NO: 349881 - DNA, 16 bp, M. musculus
acatttcattttaaat

SEQ ID NO: 349882 - DNA, 16 bp, M. musculus
acatttcccagcttcc

SEQ ID NO: 349883 - DNA, 16 bp, M. musculus
acatttcccattcaaa

SEQ ID NO: 349884 - DNA, 16 bp, M. musculus
acatttctatttaaaa

SEQ ID NO: 349885 - DNA, 16 bp, M. musculus
acatttctcaaaagaa

SEQ ID NO: 349886 - DNA, 16 bp, M. musculus
acatttctcattcaga

SEQ ID NO: 349887 - DNA, 16 bp, M. musculus
acatttctcatttaaa

SEQ ID NO: 349888 - DNA, 16 bp, M. musculus
acatttcttaaaatgt

SEQ ID NO: 349889 - DNA, 16 bp, M. musculus
acatttcttaaagtgt

SEQ ID NO: 349890 - DNA, 16 bp, M. musculus
acatttcttctttaaa

SEQ ID NO: 349891 - DNA, 16 bp, M. musculus
acatttctttaggtgt

SEQ ID NO: 349892 - DNA, 16 bp, M. musculus
acatttcttttcaaaa

SEQ ID NO: 349893 - DNA, 16 bp, M. musculus
acatttgaaaaatatt

SEQ ID NO: 349894 - DNA, 16 bp, M. musculus
acatttgaaaatattt

SEQ ID NO: 349895 - DNA, 16 bp, M. musculus
acatttgaaaccctta

SEQ ID NO: 349896 - DNA, 16 bp, M. musculus
acatttgaaagaaaaa

SEQ ID NO: 349897 - DNA, 16 bp, M. musculus
acatttgaaatataag

SEQ ID NO: 349898 - DNA, 16 bp, M. musculus
acatttgaaatgcaaa

SEQ ID NO: 349899 - DNA, 16 bp, M. musculus
acatttgaaattaaaa

SEQ ID NO: 349900 - DNA, 16 bp, M. musculus
acatttgaattataaa

SEQ ID NO: 349901 - DNA, 16 bp, M. musculus
acatttgatcctaaaa

SEQ ID NO: 349902 - DNA, 16 bp, M. musculus
acatttgtaaaaagaa

SEQ ID NO: 349903 - DNA, 16 bp, M. musculus
acatttgtaaaataaa

SEQ ID NO: 349904 - DNA, 16 bp, M. musculus
acatttgtaatctcag

SEQ ID NO: 349905 - DNA, 16 bp, M. musculus
acatttgtacaatgga

SEQ ID NO: 349906 - DNA, 16 bp, M. musculus
acatttgtacatatat

SEQ ID NO: 349907 - DNA, 16 bp, M. musculus
acatttgtgtgtatgt

SEQ ID NO: 349908 - DNA, 16 bp, M. musculus
acatttgtttacatat

SEQ ID NO: 349909 - DNA, 16 bp, M. musculus
acattttaaaaaaatg

SEQ ID NO: 349910 - DNA, 16 bp, M. musculus
acattttaaaagcttt

SEQ ID NO: 349911 - DNA, 16 bp, M. musculus
acattttaaaagtaaa

SEQ ID NO: 349912 - DNA, 16 bp, M. musculus
acattttaaaatgaat

SEQ ID NO: 349913 - DNA, 16 bp, M. musculus
acattttaaacatttt

SEQ ID NO: 349914 - DNA, 16 bp, M. musculus
acattttaaagagaaa

SEQ ID NO: 349915 - DNA, 16 bp, M. musculus
acattttaaatgtctt

SEQ ID NO: 349916 - DNA, 16 bp, M. musculus
acattttaaatgtttt

SEQ ID NO: 349917 - DNA, 16 bp, M. musculus
acattttaaatttcaa

SEQ ID NO: 349918 - DNA, 16 bp, M. musculus
acattttaatatttca

SEQ ID NO: 349919 - DNA, 16 bp, M. musculus
acattttaccacttga

SEQ ID NO: 349920 - DNA, 16 bp, M. musculus
acattttataaaaatg

SEQ ID NO: 349921 - DNA, 16 bp, M. musculus
acattttataaaatca

SEQ ID NO: 349922 - DNA, 16 bp, M. musculus
acattttatacagaag

SEQ ID NO: 349923 - DNA, 16 bp, M. musculus
acattttatatacatt

SEQ ID NO: 349924 - DNA, 16 bp, M. musculus
acattttatgttattg

SEQ ID NO: 349925 - DNA, 16 bp, M. musculus
acattttattttacaa

SEQ ID NO: 349926 - DNA, 16 bp, M. musculus
acattttcaaaagaat

SEQ ID NO: 349927 - DNA, 16 bp, M. musculus
acattttcaacaaaat

SEQ ID NO: 349928 - DNA, 16 bp, M. musculus
acattttcattatctg

SEQ ID NO: 349929 - DNA, 16 bp, M. musculus
acattttcatttgttt

SEQ ID NO: 349930 - DNA, 16 bp, M. musculus
acattttccccttact

SEQ ID NO: 349931 - DNA, 16 bp, M. musculus
acattttcctcaatta

SEQ ID NO: 349932 - DNA, 16 bp, M. musculus
acattttctacatttt

SEQ ID NO: 349933 - DNA, 16 bp, M. musculus
acattttctttatgta

SEQ ID NO: 349934 - DNA, 16 bp, M. musculus
acattttctttggctg

SEQ ID NO: 349935 - DNA, 16 bp, M. musculus
acattttgaaaataaa

SEQ ID NO: 349936 - DNA, 16 bp, M. musculus
acattttgagacaagg

SEQ ID NO: 349937 - DNA, 16 bp, M. musculus
acattttgattttata

SEQ ID NO: 349938 - DNA, 32 bp, M. musculus
acattttgctagagaatgccctacacaaagac

SEQ ID NO: 349939 - DNA, 16 bp, M. musculus
acattttgctcatcat

SEQ ID NO: 349940 - DNA, 16 bp, M. musculus
acattttgctgcctac

SEQ ID NO: 349941 - DNA, 16 bp, M. musculus
acattttgggtggaag

SEQ ID NO: 349942 - DNA, 16 bp, M. musculus
acattttggtctttgt

SEQ ID NO: 349943 - DNA, 16 bp, M. musculus
acattttgttgcttat

SEQ ID NO: 349944 - DNA, 16 bp, M. musculus
acattttgttttaaaa

SEQ ID NO: 349945 - DNA, 16 bp, M. musculus
acatttttaaaacatt

SEQ ID NO: 349946 - DNA, 16 bp, M. musculus
acatttttaaaagaaa

SEQ ID NO: 349947 - DNA, 16 bp, M. musculus
acatttttaaaattgt

SEQ ID NO: 349948 - DNA, 16 bp, M. musculus
acatttttaaagaaaa

SEQ ID NO: 349949 - DNA, 16 bp, M. musculus
acatttttaaagaaat

SEQ ID NO: 349950 - DNA, 16 bp, M. musculus
acatttttaaagctga

SEQ ID NO: 349951 - DNA, 16 bp, M. musculus
acatttttaaatgtaa

SEQ ID NO: 349952 - DNA, 16 bp, M. musculus
acatttttatcataaa

SEQ ID NO: 349953 - DNA, 16 bp, M. musculus
acatttttcaaaaata

SEQ ID NO: 349954 - DNA, 16 bp, M. musculus
acatttttcaaaagaa

SEQ ID NO: 349955 - DNA, 16 bp, M. musculus
acatttttcaaagaaa

SEQ ID NO: 349956 - DNA, 16 bp, M. musculus
acatttttcatgaaaa

SEQ ID NO: 349957 - DNA, 16 bp, M. musculus
acatttttctcaatat

SEQ ID NO: 349958 - DNA, 16 bp, M. musculus
acatttttgtttaaaa

SEQ ID NO: 349959 - DNA, 16 bp, M. musculus
acattttttaaatcca

SEQ ID NO: 349960 - DNA, 16 bp, M. musculus
acattttttgagacag

SEQ ID NO: 349961 - DNA, 16 bp, M. musculus
acattttttgtgtgtg

SEQ ID NO: 349962 - DNA, 16 bp, M. musculus
acatttttttaaaaag

SEQ ID NO: 349963 - DNA, 16 bp, M. musculus
acatttttttaaatca

SEQ ID NO: 349964 - DNA, 16 bp, M. musculus
acatttttttaagtgt

SEQ ID NO: 349965 - DNA, 16 bp, M. musculus
acatttttttattaga

SEQ ID NO: 349966 - DNA, 16 bp, M. musculus
acatttttttcagtta

SEQ ID NO: 349967 - DNA, 16 bp, M. musculus
acatttttttcctctg

SEQ ID NO: 349968 - DNA, 16 bp, M. musculus
acattttttttaaatg

SEQ ID NO: 349969 - DNA, 16 bp, M. musculus
acattttttttaacca

SEQ ID NO: 349970 - DNA, 16 bp, M. musculus
accaaaaacaagttgg

SEQ ID NO: 349971 - DNA, 16 bp, M. musculus
accaaaaagagatgcc

SEQ ID NO: 349972 - DNA, 16 bp, M. musculus
accaaaaagcaaattg

SEQ ID NO: 349973 - DNA, 16 bp, M. musculus
accaaaaccaacttgg

SEQ ID NO: 349974 - DNA, 68 bp, M. musculus
accaaaacggggactctgtttaattggggcccagaccagcaaaaggcctatcaagaaatcaaacaggc

SEQ ID NO: 349975 - DNA, 16 bp, M. musculus
accaaaagagggtatc

SEQ ID NO: 349976 - DNA, 16 bp, M. musculus
accaaaagatgctcca

SEQ ID NO: 349977 - DNA, 16 bp, M. musculus
accaaaagcaacatgg

SEQ ID NO: 349978 - DNA, 16 bp, M. musculus
accaaaagcaactcag

SEQ ID NO: 349979 - DNA, 16 bp, M. musculus
accaaaagcaacttgg

SEQ ID NO: 349980 - DNA, 16 bp, M. musculus
accaaaagccacaata

SEQ ID NO: 349981 - DNA, 16 bp, M. musculus
accaaaagccagctgg

SEQ ID NO: 349982 - DNA, 16 bp, M. musculus
accaaaagccccccat

SEQ ID NO: 349983 - DNA, 16 bp, M. musculus
accaaaaggaagacag

SEQ ID NO: 349984 - DNA, 16 bp, M. musculus
accaaaaggggttttg

SEQ ID NO: 349985 - DNA, 16 bp, M. musculus
accaaaataaagtgag

SEQ ID NO: 349986 - DNA, 16 bp, M. musculus
accaaaatttaacagt

SEQ ID NO: 349987 - DNA, 16 bp, M. musculus
accaaacagatgggac

SEQ ID NO: 349988 - DNA, 16 bp, M. musculus
accaaacaggaatcag

SEQ ID NO: 349989 - DNA, 16 bp, M. musculus
accaaacccagacact

SEQ ID NO: 349990 - DNA, 16 bp, M. musculus
accaaacccagatact

SEQ ID NO: 349991 - DNA, 16 bp, M. musculus
accaaacctgagtcct

SEQ ID NO: 349992 - DNA, 16 bp, M. musculus
accaaactcagggcct

SEQ ID NO: 349993 - DNA, 16 bp, M. musculus
accaaacttacacaat

SEQ ID NO: 349994 - DNA, 16 bp, M. musculus
accaaagaaaacacat

SEQ ID NO: 349995 - DNA, 16 bp, M. musculus
accaaagaacaaagtc

SEQ ID NO: 349996 - DNA, 16 bp, M. musculus
accaaagaacatggac

SEQ ID NO: 349997 - DNA, 16 bp, M. musculus
accaaagaagctgaag

SEQ ID NO: 349998 - DNA, 16 bp, M. musculus
accaaagaatgcacat

SEQ ID NO: 349999 - DNA, 16 bp, M. musculus
accaaagagtacacag

SEQ ID NO: 350000 - DNA, 16 bp, M. musculus
accaaagagtacatac

SEQ ID NO: 350001 - DNA, 16 bp, M. musculus
accaaagagtgagcac

SEQ ID NO: 350002 - DNA, 16 bp, M. musculus
accaaagattaccaga

SEQ ID NO: 350003 - DNA, 16 bp, M. musculus
accaaagcaaaaggat

SEQ ID NO: 350004 - DNA, 16 bp, M. musculus
accaaagcaacctggg

SEQ ID NO: 350005 - DNA, 16 bp, M. musculus
accaaagcaactcttt

SEQ ID NO: 350006 - DNA, 16 bp, M. musculus
accaaagcaagactga

SEQ ID NO: 350007 - DNA, 16 bp, M. musculus
accaaaggatgcagga

SEQ ID NO: 350008 - DNA, 16 bp, M. musculus
accaaaggtcttaaga

SEQ ID NO: 350009 - DNA, 16 bp, M. musculus
accaaagtatggacac

SEQ ID NO: 350010 - DNA, 16 bp, M. musculus
accaaagtgtgtacac

SEQ ID NO: 350011 - DNA, 16 bp, M. musculus
accaaagttcaatcag

SEQ ID NO: 350012 - DNA, 16 bp, M. musculus
accaaagttgaatcag

SEQ ID NO: 350013 - DNA, 16 bp, M. musculus
accaaataaacccatt

SEQ ID NO: 350014 - DNA, 16 bp, M. musculus
accaaatacactgaaa

SEQ ID NO: 350015 - DNA, 16 bp, M. musculus
accaaatactgaccac

SEQ ID NO: 350016 - DNA, 16 bp, M. musculus
accaaatggaaacaag

SEQ ID NO: 350017 - DNA, 16 bp, M. musculus
accaaattctgaaaaa

SEQ ID NO: 350018 - DNA, 16 bp, M. musculus
accaaattgattttca

SEQ ID NO: 350019 - DNA, 16 bp, M. musculus
accaaattggactttg

SEQ ID NO: 350020 - DNA, 17 bp, M. musculus
accaaattgtggacact

SEQ ID NO: 350021 - DNA, 16 bp, M. musculus
accaaatttaaaaatg

SEQ ID NO: 350022 - DNA, 16 bp, M. musculus
accaacaacttgaaag

SEQ ID NO: 350023 - DNA, 16 bp, M. musculus
accaacaaggcagcat

SEQ ID NO: 350024 - DNA, 16 bp, M. musculus
accaacaaggtcatcc

SEQ ID NO: 350025 - DNA, 16 bp, M. musculus
accaacaatggagaaa

SEQ ID NO: 350026 - DNA, 16 bp, M. musculus
accaacagcctctcct

SEQ ID NO: 350027 - DNA, 16 bp, M. musculus
accaacagctctctaa

SEQ ID NO: 350028 - DNA, 16 bp, M. musculus
accaacagctctttaa

SEQ ID NO: 350029 - DNA, 16 bp, M. musculus
accaacagtgacacac

SEQ ID NO: 350030 - DNA, 16 bp, M. musculus
accaaccaaagagcat

SEQ ID NO: 350031 - DNA, 16 bp, M. musculus
accaaccacatggtgg

SEQ ID NO: 350032 - DNA, 16 bp, M. musculus
accaaccagggaccaa

SEQ ID NO: 350033 - DNA, 16 bp, M. musculus
accaaccccaattaaa

SEQ ID NO: 350034 - DNA, 16 bp, M. musculus
accaaccctgacctca

SEQ ID NO: 350035 - DNA, 16 bp, M. musculus
accaaccctggcctgg

SEQ ID NO: 350036 - DNA, 16 bp, M. musculus
accaacctaagacagg

SEQ ID NO: 350037 - DNA, 16 bp, M. musculus
accaacctggcagcat

SEQ ID NO: 350038 - DNA, 16 bp, M. musculus
accaactatgtggtca

SEQ ID NO: 350039 - DNA, 16 bp, M. musculus
accaactcctacaagt

SEQ ID NO: 350040 - DNA, 16 bp, M. musculus
accaactccttgccca

SEQ ID NO: 350041 - DNA, 16 bp, M. musculus
accaactgagctacac

SEQ ID NO: 350042 - DNA, 16 bp, M. musculus
accaactgagttacat

SEQ ID NO: 350043 - DNA, 16 bp, M. musculus
accaactggagaccaa

SEQ ID NO: 350044 - DNA, 16 bp, M. musculus
accaactgggaaccaa

SEQ ID NO: 350045 - DNA, 16 bp, M. musculus
accaactggggaccaa

SEQ ID NO: 350046 - DNA, 16 bp, M. musculus
accaacttctgtcttt

SEQ ID NO: 350047 - DNA, 16 bp, M. musculus
accaactttccaaaga

SEQ ID NO: 350048 - DNA, 16 bp, M. musculus
accaagaaacttctgg

SEQ ID NO: 350049 - DNA, 16 bp, M. musculus
accaagaacacatcaa

SEQ ID NO: 350050 - DNA, 16 bp, M. musculus
accaagaacagcagtg

SEQ ID NO: 350051 - DNA, 16 bp, M. musculus
accaagaaccaagttg

SEQ ID NO: 350052 - DNA, 16 bp, M. musculus
accaagaagagcagca

SEQ ID NO: 350053 - DNA, 16 bp, M. musculus
accaagaagcaaggtg

SEQ ID NO: 350054 - DNA, 16 bp, M. musculus
accaagaagcagttga

SEQ ID NO: 350055 - DNA, 16 bp, M. musculus
accaagaaggttttat

SEQ ID NO: 350056 - DNA, 16 bp, M. musculus
accaagaagtacacat

SEQ ID NO: 350057 - DNA, 16 bp, M. musculus
accaagacattttata

SEQ ID NO: 350058 - DNA, 16 bp, M. musculus
accaagaccaagacca

SEQ ID NO: 350059 - DNA, 16 bp, M. musculus
accaagaccactcacc

SEQ ID NO: 350060 - DNA, 16 bp, M. musculus
accaagaccacttacc

SEQ ID NO: 350061 - DNA, 16 bp, M. musculus
accaagactgcccaat

SEQ ID NO: 350062 - DNA, 16 bp, M. musculus
accaagagaaggcaca

SEQ ID NO: 350063 - DNA, 16 bp, M. musculus
accaagagcaacttgg

SEQ ID NO: 350064 - DNA, 16 bp, M. musculus
accaagagcagaaaag

SEQ ID NO: 350065 - DNA, 16 bp, M. musculus
accaagaggaagtctc

SEQ ID NO: 350066 - DNA, 16 bp, M. musculus
accaagaggcctctct

SEQ ID NO: 350067 - DNA, 16 bp, M. musculus
accaagagtggactgg

SEQ ID NO: 350068 - DNA, 17 bp, M. musculus
accaagagtgtctgtgt

SEQ ID NO: 350069 - DNA, 16 bp, M. musculus
accaagatccaggtca

SEQ ID NO: 350070 - DNA, 16 bp, M. musculus
accaagattacttggc

SEQ ID NO: 350071 - DNA, 16 bp, M. musculus
accaagcaggtgaaag

SEQ ID NO: 350072 - DNA, 16 bp, M. musculus
accaagcatacatgtg

SEQ ID NO: 350073 - DNA, 16 bp, M. musculus
accaagcccagacact

SEQ ID NO: 350074 - DNA, 16 bp, M. musculus
accaagcctgcctgga

SEQ ID NO: 350075 - DNA, 16 bp, M. musculus
accaagctgcacatat

SEQ ID NO: 350076 - DNA, 16 bp, M. musculus
accaagctgctcatct

SEQ ID NO: 350077 - DNA, 16 bp, M. musculus
accaagctggctttga

SEQ ID NO: 350078 - DNA, 16 bp, M. musculus
accaagcttctgggat

SEQ ID NO: 350079 - DNA, 16 bp, M. musculus
accaaggatggccttg

SEQ ID NO: 350080 - DNA, 16 bp, M. musculus
accaaggcaactatta

SEQ ID NO: 350081 - DNA, 16 bp, M. musculus
accaaggcaactcttt

SEQ ID NO: 350082 - DNA, 16 bp, M. musculus
accaaggcaatttata

SEQ ID NO: 350083 - DNA, 17 bp, M. musculus
accaagggacctctctt

SEQ ID NO: 350084 - DNA, 16 bp, M. musculus
accaagggcctcccca

SEQ ID NO: 350085 - DNA, 16 bp, M. musculus
accaagggcctctccc

SEQ ID NO: 350086 - DNA, 16 bp, M. musculus
accaagggcctctcct

SEQ ID NO: 350087 - DNA, 17 bp, M. musculus
accaaggggcctctctt

SEQ ID NO: 350088 - DNA, 16 bp, M. musculus
accaaggtggctcctg

SEQ ID NO: 350089 - DNA, 16 bp, M. musculus
accaagtagttttcat

SEQ ID NO: 350090 - DNA, 16 bp, M. musculus
accaagtatattcaaa

SEQ ID NO: 350091 - DNA, 16 bp, M. musculus
accaagtgagcaggaa

SEQ ID NO: 350092 - DNA, 16 bp, M. musculus
accaagtgttcagata

SEQ ID NO: 350093 - DNA, 16 bp, M. musculus
accaagttccaggaca

SEQ ID NO: 350094 - DNA, 16 bp, M. musculus
accaagttgcttttgg

SEQ ID NO: 350095 - DNA, 16 bp, M. musculus
accaagttggggagga

SEQ ID NO: 350096 - DNA, 16 bp, M. musculus
accaatacaaggatgg

SEQ ID NO: 350097 - DNA, 16 bp, M. musculus
accaatacatgcctgt

SEQ ID NO: 350098 - DNA, 16 bp, M. musculus
accaatacatgcgtgt

SEQ ID NO: 350099 - DNA, 16 bp, M. musculus
accaatactatgcagt

SEQ ID NO: 350100 - DNA, 16 bp, M. musculus
accaatagatgactgt

SEQ ID NO: 350101 - DNA, 17 bp, M. musculus
accaatatctcttatga

SEQ ID NO: 350102 - DNA, 16 bp, M. musculus
accaatcaggatttag

SEQ ID NO: 350103 - DNA, 16 bp, M. musculus
accaatcattaatcaa

SEQ ID NO: 350104 - DNA, 16 bp, M. musculus
accaatctaagacagg

SEQ ID NO: 350105 - DNA, 16 bp, M. musculus
accaatgcaaataaaa

SEQ ID NO: 350106 - DNA, 16 bp, M. musculus
accaatggatttgtgt

SEQ ID NO: 350107 - DNA, 16 bp, M. musculus
accaatggcctctcct

SEQ ID NO: 350108 - DNA, 16 bp, M. musculus
accaatggcctttcct

SEQ ID NO: 350109 - DNA, 16 bp, M. musculus
accaatgttaaatcag

SEQ ID NO: 350110 - DNA, 16 bp, M. musculus
accaattagggaacca

SEQ ID NO: 350111 - DNA, 16 bp, M. musculus
accaattgtgacaggc

SEQ ID NO: 350112 - DNA, 16 bp, M. musculus
accacaaaatagaaac

SEQ ID NO: 350113 - DNA, 16 bp, M. musculus
accacaaaccaccctg

SEQ ID NO: 350114 - DNA, 16 bp, M. musculus
accacaacataaggaa

SEQ ID NO: 350115 - DNA, 16 bp, M. musculus
accacaacgtacccaa

SEQ ID NO: 350116 - DNA, 16 bp, M. musculus
accacaagaaaaccta

SEQ ID NO: 350117 - DNA, 16 bp, M. musculus
accacaagaagaccca

SEQ ID NO: 350118 - DNA, 16 bp, M. musculus
accacaatttgtgact

SEQ ID NO: 350119 - DNA, 16 bp, M. musculus
accacacacacatgca

SEQ ID NO: 350120 - DNA, 16 bp, M. musculus
accacacaggggtaga

SEQ ID NO: 350121 - DNA, 16 bp, M. musculus
accacacagtggctca

SEQ ID NO: 350122 - DNA, 16 bp, M. musculus
accacacatataccac

SEQ ID NO: 350123 - DNA, 16 bp, M. musculus
accacacatgcacaca

SEQ ID NO: 350124 - DNA, 16 bp, M. musculus
accacacccagccctt

SEQ ID NO: 350125 - DNA, 16 bp, M. musculus
accacacccagctaaa

SEQ ID NO: 350126 - DNA, 16 bp, M. musculus
accacacccagctatg

SEQ ID NO: 350127 - DNA, 16 bp, M. musculus
accacacccagctctg

SEQ ID NO: 350128 - DNA, 16 bp, M. musculus
accacacctacttcaa

SEQ ID NO: 350129 - DNA, 16 bp, M. musculus
accacacctggctcat

SEQ ID NO: 350130 - DNA, 16 bp, M. musculus
accacacctggctctg

SEQ ID NO: 350131 - DNA, 16 bp, M. musculus
accacacctggctggc

SEQ ID NO: 350132 - DNA, 16 bp, M. musculus
accacacctttgaatt

SEQ ID NO: 350133 - DNA, 16 bp, M. musculus
accacactgccttctg

SEQ ID NO: 350134 - DNA, 16 bp, M. musculus
accacactgtaccata

SEQ ID NO: 350135 - DNA, 16 bp, M. musculus
accacactttttgtat

SEQ ID NO: 350136 - DNA, 16 bp, M. musculus
accacagaaagattca

SEQ ID NO: 350137 - DNA, 16 bp, M. musculus
accacagaaatgacaa

SEQ ID NO: 350138 - DNA, 16 bp, M. musculus
accacagagccacctc

SEQ ID NO: 350139 - DNA, 16 bp, M. musculus
accacagagtgtgctg

SEQ ID NO: 350140 - DNA, 16 bp, M. musculus
accacagatgccagcc

SEQ ID NO: 350141 - DNA, 16 bp, M. musculus
accacagattaaagct

SEQ ID NO: 350142 - DNA, 16 bp, M. musculus
accacagcaagccatg

SEQ ID NO: 350143 - DNA, 16 bp, M. musculus
accacagcaatgacca

SEQ ID NO: 350144 - DNA, 16 bp, M. musculus
accacagccaaggcaa

SEQ ID NO: 350145 - DNA, 16 bp, M. musculus
accacagccatggata

SEQ ID NO: 350146 - DNA, 16 bp, M. musculus
accacagcctataagc

SEQ ID NO: 350147 - DNA, 16 bp, M. musculus
accacaggacagagtc

SEQ ID NO: 350148 - DNA, 16 bp, M. musculus
accacaggcttgccca

SEQ ID NO: 350149 - DNA, 16 bp, M. musculus
accacagggaccaata

SEQ ID NO: 350150 - DNA, 16 bp, M. musculus
accacagggggaaaaa

SEQ ID NO: 350151 - DNA, 16 bp, M. musculus
accacaggtgacaaca

SEQ ID NO: 350152 - DNA, 16 bp, M. musculus
accacagtctatgcca

SEQ ID NO: 350153 - DNA, 16 bp, M. musculus
accacatatgtgcctg

SEQ ID NO: 350154 - DNA, 16 bp, M. musculus
accacatcaatgacca

SEQ ID NO: 350155 - DNA, 16 bp, M. musculus
accacatgaaacttaa

SEQ ID NO: 350156 - DNA, 16 bp, M. musculus
accacatttcctttat

SEQ ID NO: 350157 - DNA, 16 bp, M. musculus
accacattttcttttt

SEQ ID NO: 350158 - DNA, 16 bp, M. musculus
accaccaaacattcca

SEQ ID NO: 350159 - DNA, 16 bp, M. musculus
accaccaaacccagag

SEQ ID NO: 350160 - DNA, 16 bp, M. musculus
accaccaacaaattgg

SEQ ID NO: 350161 - DNA, 16 bp, M. musculus
accaccaacagattgg

SEQ ID NO: 350162 - DNA, 16 bp, M. musculus
accaccaaccagacag

SEQ ID NO: 350163 - DNA, 16 bp, M. musculus
accaccaagagattgg

SEQ ID NO: 350164 - DNA, 16 bp, M. musculus
accaccaagccatctt

SEQ ID NO: 350165 - DNA, 16 bp, M. musculus
accaccaaggacagca

SEQ ID NO: 350166 - DNA, 16 bp, M. musculus
accaccaatcaaggag

SEQ ID NO: 350167 - DNA, 16 bp, M. musculus
accaccaattaaagaa

SEQ ID NO: 350168 - DNA, 16 bp, M. musculus
accaccacaaccagct

SEQ ID NO: 350169 - DNA, 16 bp, M. musculus
accaccacacccagat

SEQ ID NO: 350170 - DNA, 16 bp, M. musculus
accaccacacctggct

SEQ ID NO: 350171 - DNA, 16 bp, M. musculus
accaccacactcagct

SEQ ID NO: 350172 - DNA, 16 bp, M. musculus
accaccacagcccggc

SEQ ID NO: 350173 - DNA, 16 bp, M. musculus
accaccacatctggct

SEQ ID NO: 350174 - DNA, 16 bp, M. musculus
accaccaccaccaagt

SEQ ID NO: 350175 - DNA, 17 bp, M. musculus
accaccaccaccactgc

SEQ ID NO: 350176 - DNA, 16 bp, M. musculus
accaccaccaccaggg

SEQ ID NO: 350177 - DNA, 16 bp, M. musculus
accaccaccaccatga

SEQ ID NO: 350178 - DNA, 16 bp, M. musculus
accaccaccaccctgg

SEQ ID NO: 350179 - DNA, 16 bp, M. musculus
accaccaccaccgtca

SEQ ID NO: 350180 - DNA, 16 bp, M. musculus
accaccaccacctctg

SEQ ID NO: 350181 - DNA, 16 bp, M. musculus
accaccaccacctggc

SEQ ID NO: 350182 - DNA, 16 bp, M. musculus
accaccaccagcatca

SEQ ID NO: 350183 - DNA, 16 bp, M. musculus
accaccacctggctgt

SEQ ID NO: 350184 - DNA, 16 bp, M. musculus
accaccacctggctta

SEQ ID NO: 350185 - DNA, 16 bp, M. musculus
accaccactaccatca

SEQ ID NO: 350186 - DNA, 16 bp, M. musculus
accaccactatcacca

SEQ ID NO: 350187 - DNA, 16 bp, M. musculus
accaccactgccaggc

SEQ ID NO: 350188 - DNA, 16 bp, M. musculus
accaccactgcctggc

SEQ ID NO: 350189 - DNA, 17 bp, M. musculus
accaccactgcctggcc

SEQ ID NO: 350190 - DNA, 16 bp, M. musculus
accaccactgtcacca

SEQ ID NO: 350191 - DNA, 16 bp, M. musculus
accaccagaagttctt

SEQ ID NO: 350192 - DNA, 16 bp, M. musculus
accaccagagcccagc

SEQ ID NO: 350193 - DNA, 16 bp, M. musculus
accaccagcagcacca

SEQ ID NO: 350194 - DNA, 16 bp, M. musculus
accaccagcccagaga

SEQ ID NO: 350195 - DNA, 16 bp, M. musculus
accaccagctggggac

SEQ ID NO: 350196 - DNA, 16 bp, M. musculus
accaccaggcctggct

SEQ ID NO: 350197 - DNA, 16 bp, M. musculus
accaccagggtcagct

SEQ ID NO: 350198 - DNA, 16 bp, M. musculus
accaccatactgctgt

SEQ ID NO: 350199 - DNA, 16 bp, M. musculus
accaccatcaccatca

SEQ ID NO: 350200 - DNA, 16 bp, M. musculus
accaccatcaccatga

SEQ ID NO: 350201 - DNA, 16 bp, M. musculus
accaccatcagcagca

SEQ ID NO: 350202 - DNA, 16 bp, M. musculus
accaccatgcccagct

SEQ ID NO: 350203 - DNA, 16 bp, M. musculus
accaccatgcctgttt

SEQ ID NO: 350204 - DNA, 16 bp, M. musculus
accaccatgccttgct

SEQ ID NO: 350205 - DNA, 22 bp, M. musculus
accaccatgtggttgctgggaa

SEQ ID NO: 350206 - DNA, 16 bp, M. musculus
accaccatgtggttgt

SEQ ID NO: 350207 - DNA, 16 bp, M. musculus
accacccagcagaggt

SEQ ID NO: 350208 - DNA, 16 bp, M. musculus
accacccaggctcaga

SEQ ID NO: 350209 - DNA, 16 bp, M. musculus
accacccattcccatt

SEQ ID NO: 350210 - DNA, 16 bp, M. musculus
accaccgcagctccag

SEQ ID NO: 350211 - DNA, 16 bp, M. musculus
accaccgcctggcttt

SEQ ID NO: 350212 - DNA, 16 bp, M. musculus
accacctccagtagga

SEQ ID NO: 350213 - DNA, 16 bp, M. musculus
accacctcctgggatt

SEQ ID NO: 350214 - DNA, 16 bp, M. musculus
accacctgcccaggga

SEQ ID NO: 350215 - DNA, 16 bp, M. musculus
accacctgcccagggt

SEQ ID NO: 350216 - DNA, 16 bp, M. musculus
accacctgtcactcca

SEQ ID NO: 350217 - DNA, 16 bp, M. musculus
accacctttaactcca

SEQ ID NO: 350218 - DNA, 22 bp, M. musculus
accacgaggtattgtgtccatc

SEQ ID NO: 350219 - DNA, 16 bp, M. musculus
accacgcccagcttct

SEQ ID NO: 350220 - DNA, 16 bp, M. musculus
accacgcccggctctg

SEQ ID NO: 350221 - DNA, 16 bp, M. musculus
accacgcccggcttac

SEQ ID NO: 350222 - DNA, 16 bp, M. musculus
accacgctggcctcaa

SEQ ID NO: 350223 - DNA, 16 bp, M. musculus
accacggagccacctc

SEQ ID NO: 350224 - DNA, 26 bp, M. musculus
accacgtggttgctgggatttgaact

SEQ ID NO: 350225 - DNA, 16 bp, M. musculus
accacgtgtgtgcctg

SEQ ID NO: 350226 - DNA, 16 bp, M. musculus
accactaccacaattt

SEQ ID NO: 350227 - DNA, 16 bp, M. musculus
accactaccaccatca

SEQ ID NO: 350228 - DNA, 16 bp, M. musculus
accactaccactacca

SEQ ID NO: 350229 - DNA, 16 bp, M. musculus
accactaccactacta

SEQ ID NO: 350230 - DNA, 16 bp, M. musculus
accactacctgctgag

SEQ ID NO: 350231 - DNA, 16 bp, M. musculus
accactcagaggagaa

SEQ ID NO: 350232 - DNA, 16 bp, M. musculus
accactcaggcccaga

SEQ ID NO: 350233 - DNA, 16 bp, M. musculus
accactcctgaacata

SEQ ID NO: 350234 - DNA, 16 bp, M. musculus
accactctggacatca

SEQ ID NO: 350235 - DNA, 16 bp, M. musculus
accactgaaccatcct

SEQ ID NO: 350236 - DNA, 16 bp, M. musculus
accactgaagaaaact

SEQ ID NO: 350237 - DNA, 16 bp, M. musculus
accactgagcaatccc

SEQ ID NO: 350238 - DNA, 16 bp, M. musculus
accactgagcagtctc

SEQ ID NO: 350239 - DNA, 16 bp, M. musculus
accactgagccacatc

SEQ ID NO: 350240 - DNA, 16 bp, M. musculus
accactgagccacctc

SEQ ID NO: 350241 - DNA, 16 bp, M. musculus
accactgagccatcct

SEQ ID NO: 350242 - DNA, 18 bp, M. musculus
accactgagccatctctt

SEQ ID NO: 350243 - DNA, 16 bp, M. musculus
accactgagccatctt

SEQ ID NO: 350244 - DNA, 16 bp, M. musculus
accactgagccttctt

SEQ ID NO: 350245 - DNA, 16 bp, M. musculus
accactgagctacatc

SEQ ID NO: 350246 - DNA, 16 bp, M. musculus
accactgagctatatc

SEQ ID NO: 350247 - DNA, 16 bp, M. musculus
accactgagctgtacc

SEQ ID NO: 350248 - DNA, 16 bp, M. musculus
accactgagctgtatc

SEQ ID NO: 350249 - DNA, 16 bp, M. musculus
accactgcagcatcct

SEQ ID NO: 350250 - DNA, 16 bp, M. musculus
accactgcccagcagc

SEQ ID NO: 350251 - DNA, 16 bp, M. musculus
accactgcccagcagg

SEQ ID NO: 350252 - DNA, 16 bp, M. musculus
accactgcccagcctc

SEQ ID NO: 350253 - DNA, 16 bp, M. musculus
accactgcccagctca

SEQ ID NO: 350254 - DNA, 16 bp, M. musculus
accactgcccagctgg

SEQ ID NO: 350255 - DNA, 16 bp, M. musculus
accactgcccagtgac

SEQ ID NO: 350256 - DNA, 16 bp, M. musculus
accactgcctggcctg

SEQ ID NO: 350257 - DNA, 16 bp, M. musculus
accactgcctggtgcc

SEQ ID NO: 350258 - DNA, 17 bp, M. musculus
accactgctgctgaggc

SEQ ID NO: 350259 - DNA, 16 bp, M. musculus
accacttccaggcact

SEQ ID NO: 350260 - DNA, 16 bp, M. musculus
accacttcctgggcca

SEQ ID NO: 350261 - DNA, 16 bp, M. musculus
accactttagctcctt

SEQ ID NO: 350262 - DNA, 16 bp, M. musculus
accactttgcaaatca

SEQ ID NO: 350263 - DNA, 16 bp, M. musculus
accagaaaacaaattc

SEQ ID NO: 350264 - DNA, 16 bp, M. musculus
accagaaaagaaattc

SEQ ID NO: 350265 - DNA, 16 bp, M. musculus
accagaaaataaattc

SEQ ID NO: 350266 - DNA, 16 bp, M. musculus
accagaaataaaacca

SEQ ID NO: 350267 - DNA, 16 bp, M. musculus
accagaaccccagagc

SEQ ID NO: 350268 - DNA, 16 bp, M. musculus
accagaactacacaga

SEQ ID NO: 350269 - DNA, 16 bp, M. musculus
accagaagagaacatc

SEQ ID NO: 350270 - DNA, 16 bp, M. musculus
accagaagagcgcatc

SEQ ID NO: 350271 - DNA, 16 bp, M. musculus
accagaagaggacgtc

SEQ ID NO: 350272 - DNA, 19 bp, M. musculus
accagaagagggcatcagg

SEQ ID NO: 350273 - DNA, 16 bp, M. musculus
accagaagagggcatg

SEQ ID NO: 350274 - DNA, 16 bp, M. musculus
accagaagagggcatt

SEQ ID NO: 350275 - DNA, 17 bp, M. musculus
accagaagagggtatca

SEQ ID NO: 350276 - DNA, 16 bp, M. musculus
accagaagagggtatt

SEQ ID NO: 350277 - DNA, 16 bp, M. musculus
accagaagaggttatc

SEQ ID NO: 350278 - DNA, 16 bp, M. musculus
accagaagagtgcatt

SEQ ID NO: 350279 - DNA, 17 bp, M. musculus
accagaagccactatgt

SEQ ID NO: 350280 - DNA, 16 bp, M. musculus
accagaaggatcttgt

SEQ ID NO: 350281 - DNA, 16 bp, M. musculus
accagaaggcaaaagg

SEQ ID NO: 350282 - DNA, 16 bp, M. musculus
accagaagggggcatc

SEQ ID NO: 350283 - DNA, 16 bp, M. musculus
accagacacaaccagc

SEQ ID NO: 350284 - DNA, 16 bp, M. musculus
accagaccagaccaaa

SEQ ID NO: 350285 - DNA, 16 bp, M. musculus
accagaccagaccaga

SEQ ID NO: 350286 - DNA, 16 bp, M. musculus
accagaccagggatgg

SEQ ID NO: 350287 - DNA, 18 bp, M. musculus
accagacctgaaaccaga

SEQ ID NO: 350288 - DNA, 16 bp, M. musculus
accagactgtcctgga

SEQ ID NO: 350289 - DNA, 16 bp, M. musculus
accagagaacaaagtc

SEQ ID NO: 350290 - DNA, 16 bp, M. musculus
accagagacactgaag

SEQ ID NO: 350291 - DNA, 16 bp, M. musculus
accagagaccccaaag

SEQ ID NO: 350292 - DNA, 16 bp, M. musculus
accagagacctggaag

SEQ ID NO: 350293 - DNA, 16 bp, M. musculus
accagagacctggggg

SEQ ID NO: 350294 - DNA, 16 bp, M. musculus
accagagactacaaaa

SEQ ID NO: 350295 - DNA, 16 bp, M. musculus
accagagactctaaaa

SEQ ID NO: 350296 - DNA, 16 bp, M. musculus
accagagagacttcat

SEQ ID NO: 350297 - DNA, 16 bp, M. musculus
accagagagatggctc

SEQ ID NO: 350298 - DNA, 16 bp, M. musculus
accagagatcctaaga

SEQ ID NO: 350299 - DNA, 16 bp, M. musculus
accagaggactcctaa

SEQ ID NO: 350300 - DNA, 16 bp, M. musculus
accagaggctgggatc

SEQ ID NO: 350301 - DNA, 16 bp, M. musculus
accagaggttgacatc

SEQ ID NO: 350302 - DNA, 16 bp, M. musculus
accagagtctctgttc

SEQ ID NO: 350303 - DNA, 23 bp, M. musculus
accagagtggaaccagtgaccct

SEQ ID NO: 350304 - DNA, 27 bp, M. musculus
accagagtggaaccagtgacccttgga

SEQ ID NO: 350305 - DNA, 16 bp, M. musculus
accagagttcagaaag

SEQ ID NO: 350306 - DNA, 16 bp, M. musculus
accagagtttggttcc

SEQ ID NO: 350307 - DNA, 16 bp, M. musculus
accagagtttggttct

SEQ ID NO: 350308 - DNA, 16 bp, M. musculus
accagatccccagagc

SEQ ID NO: 350309 - DNA, 17 bp, M. musculus
accagatccggtgttga

SEQ ID NO: 350310 - DNA, 16 bp, M. musculus
accagatccttctaca

SEQ ID NO: 350311 - DNA, 16 bp, M. musculus
accagatgatccagca

SEQ ID NO: 350312 - DNA, 16 bp, M. musculus
accagatggcaaaaag

SEQ ID NO: 350313 - DNA, 16 bp, M. musculus
accagatggcaagaag

SEQ ID NO: 350314 - DNA, 16 bp, M. musculus
accagcaaatcaaaag

SEQ ID NO: 350315 - DNA, 16 bp, M. musculus
accagcaacagcaaca

SEQ ID NO: 350316 - DNA, 16 bp, M. musculus
accagcaacagcagca

SEQ ID NO: 350317 - DNA, 16 bp, M. musculus
accagcaactgaccaa

SEQ ID NO: 350318 - DNA, 31 bp, M. musculus
accagcaagataaaaagcgagctactcagtc

SEQ ID NO: 350319 - DNA, 16 bp, M. musculus
accagcaagatggctt

SEQ ID NO: 350320 - DNA, 16 bp, M. musculus
accagcaaggaaaatg

SEQ ID NO: 350321 - DNA, 16 bp, M. musculus
accagcaatgaaagag

SEQ ID NO: 350322 - DNA, 16 bp, M. musculus
accagcacaccagcac

SEQ ID NO: 350323 - DNA, 16 bp, M. musculus
accagcacagactgga

SEQ ID NO: 350324 - DNA, 16 bp, M. musculus
accagcaccaccagca

SEQ ID NO: 350325 - DNA, 16 bp, M. musculus
accagcactcagaagg

SEQ ID NO: 350326 - DNA, 16 bp, M. musculus
accagcactcaggagg

SEQ ID NO: 350327 - DNA, 16 bp, M. musculus
accagcactttcaaat

SEQ ID NO: 350328 - DNA, 16 bp, M. musculus
accagcagaaaagaag

SEQ ID NO: 350329 - DNA, 16 bp, M. musculus
accagcagcaacaaca

SEQ ID NO: 350330 - DNA, 16 bp, M. musculus
accagcagcagcacca

SEQ ID NO: 350331 - DNA, 16 bp, M. musculus
accagcagcagcagct

SEQ ID NO: 350332 - DNA, 16 bp, M. musculus
accagcaggtgaaaga

SEQ ID NO: 350333 - DNA, 16 bp, M. musculus
accagcagtggaggaa

SEQ ID NO: 350334 - DNA, 16 bp, M. musculus
accagcatcctgctgt

SEQ ID NO: 350335 - DNA, 16 bp, M. musculus
accagcatctactgtc

SEQ ID NO: 350336 - DNA, 16 bp, M. musculus
accagcatgtgttgtc

SEQ ID NO: 350337 - DNA, 16 bp, M. musculus
accagccagcaacctg

SEQ ID NO: 350338 - DNA, 16 bp, M. musculus
accagccagccagaga

SEQ ID NO: 350339 - DNA, 16 bp, M. musculus
accagccaggcagcat

SEQ ID NO: 350340 - DNA, 16 bp, M. musculus
accagccagtacaatg

SEQ ID NO: 350341 - DNA, 16 bp, M. musculus
accagccatgtggcag

SEQ ID NO: 350342 - DNA, 16 bp, M. musculus
accagcccaactagag

SEQ ID NO: 350343 - DNA, 16 bp, M. musculus
accagcccaaggatgg

SEQ ID NO: 350344 - DNA, 16 bp, M. musculus
accagcccaggaaaag

SEQ ID NO: 350345 - DNA, 16 bp, M. musculus
accagcccaggcatgg

SEQ ID NO: 350346 - DNA, 16 bp, M. musculus
accagcccagggatga

SEQ ID NO: 350347 - DNA, 16 bp, M. musculus
accagccccaattaaa

SEQ ID NO: 350348 - DNA, 16 bp, M. musculus
accagcctaagctaca

SEQ ID NO: 350349 - DNA, 16 bp, M. musculus
accagcctgaggctct

SEQ ID NO: 350350 - DNA, 16 bp, M. musculus
accagcctggactata

SEQ ID NO: 350351 - DNA, 17 bp, M. musculus
accagcctgggctacat

SEQ ID NO: 350352 - DNA, 16 bp, M. musculus
accagcctggtctata

SEQ ID NO: 350353 - DNA, 16 bp, M. musculus
accagcctttgcctcc

SEQ ID NO: 350354 - DNA, 16 bp, M. musculus
accagctaatatcttc

SEQ ID NO: 350355 - DNA, 16 bp, M. musculus
accagctataccactc

SEQ ID NO: 350356 - DNA, 16 bp, M. musculus
accagctcaggggtgg

SEQ ID NO: 350357 - DNA, 16 bp, M. musculus
accagctcccacacac

SEQ ID NO: 350358 - DNA, 16 bp, M. musculus
accagctcctgcttcc

SEQ ID NO: 350359 - DNA, 16 bp, M. musculus
accagctcttcatttg

SEQ ID NO: 350360 - DNA, 16 bp, M. musculus
accagctctttcctgg

SEQ ID NO: 350361 - DNA, 17 bp, M. musculus
accagctgaaaggcatg

SEQ ID NO: 350362 - DNA, 16 bp, M. musculus
accagctgagccacct

SEQ ID NO: 350363 - DNA, 16 bp, M. musculus
accagctgctcttcca

SEQ ID NO: 350364 - DNA, 16 bp, M. musculus
accagctgtctcaact

SEQ ID NO: 350365 - DNA, 16 bp, M. musculus
accagctgtgtcaagt

SEQ ID NO: 350366 - DNA, 16 bp, M. musculus
accagctgtgtgacct

SEQ ID NO: 350367 - DNA, 16 bp, M. musculus
accagcttgatttctc

SEQ ID NO: 350368 - DNA, 16 bp, M. musculus
accagctttgaggaca

SEQ ID NO: 350369 - DNA, 16 bp, M. musculus
accaggaacacatgtg

SEQ ID NO: 350370 - DNA, 16 bp, M. musculus
accaggaagcagagaa

SEQ ID NO: 350371 - DNA, 16 bp, M. musculus
accaggaaggaggaca

SEQ ID NO: 350372 - DNA, 16 bp, M. musculus
accaggaaggggataa

SEQ ID NO: 350373 - DNA, 16 bp, M. musculus
accaggaagggggaaa

SEQ ID NO: 350374 - DNA, 16 bp, M. musculus
accaggacagccaggg

SEQ ID NO: 350375 - DNA, 16 bp, M. musculus
accaggacccctctag

SEQ ID NO: 350376 - DNA, 16 bp, M. musculus
accaggagaacaaggc

SEQ ID NO: 350377 - DNA, 16 bp, M. musculus
accaggagagagctgg

SEQ ID NO: 350378 - DNA, 16 bp, M. musculus
accaggagctggctct

SEQ ID NO: 350379 - DNA, 16 bp, M. musculus
accaggagctggtttt

SEQ ID NO: 350380 - DNA, 16 bp, M. musculus
accaggagctgttttt

SEQ ID NO: 350381 - DNA, 16 bp, M. musculus
accaggaggaggagga

SEQ ID NO: 350382 - DNA, 16 bp, M. musculus
accaggaggcagagaa

SEQ ID NO: 350383 - DNA, 16 bp, M. musculus
accaggagggaaataa

SEQ ID NO: 350384 - DNA, 16 bp, M. musculus
accaggagggagataa

SEQ ID NO: 350385 - DNA, 16 bp, M. musculus
accaggagggggataa

SEQ ID NO: 350386 - DNA, 16 bp, M. musculus
accaggatggcttcaa

SEQ ID NO: 350387 - DNA, 16 bp, M. musculus
accaggattacaggaa

SEQ ID NO: 350388 - DNA, 16 bp, M. musculus
accaggcacacatgta

SEQ ID NO: 350389 - DNA, 16 bp, M. musculus
accaggcagcttccag

SEQ ID NO: 350390 - DNA, 16 bp, M. musculus
accaggcagtccagtt

SEQ ID NO: 350391 - DNA, 16 bp, M. musculus
accaggcagtcctcta

SEQ ID NO: 350392 - DNA, 16 bp, M. musculus
accaggcagtcctctg

SEQ ID NO: 350393 - DNA, 16 bp, M. musculus
accaggctcctgacat

SEQ ID NO: 350394 - DNA, 16 bp, M. musculus
accaggctctgacaaa

SEQ ID NO: 350395 - DNA, 16 bp, M. musculus
accaggctgccctgga

SEQ ID NO: 350396 - DNA, 16 bp, M. musculus
accaggctgcctgtgc

SEQ ID NO: 350397 - DNA, 16 bp, M. musculus
accaggctgcctttca

SEQ ID NO: 350398 - DNA, 16 bp, M. musculus
accaggctggccagaa

SEQ ID NO: 350399 - DNA, 16 bp, M. musculus
accaggctggcctctg

SEQ ID NO: 350400 - DNA, 16 bp, M. musculus
accaggctgggcttga

SEQ ID NO: 350401 - DNA, 16 bp, M. musculus
accaggctgtccttga

SEQ ID NO: 350402 - DNA, 16 bp, M. musculus
accaggcttggtagca

SEQ ID NO: 350403 - DNA, 16 bp, M. musculus
accagggaagcaagag

SEQ ID NO: 350404 - DNA, 16 bp, M. musculus
accagggaccaggctg

SEQ ID NO: 350405 - DNA, 16 bp, M. musculus
accagggaggcagagg

SEQ ID NO: 350406 - DNA, 16 bp, M. musculus
accagggccatccaca

SEQ ID NO: 350407 - DNA, 16 bp, M. musculus
accagggctaagaagt

SEQ ID NO: 350408 - DNA, 17 bp, M. musculus
accagggctgccatctg

SEQ ID NO: 350409 - DNA, 16 bp, M. musculus
accagggttgcctcaa

SEQ ID NO: 350410 - DNA, 16 bp, M. musculus
accaggtacacacatg

SEQ ID NO: 350411 - DNA, 16 bp, M. musculus
accaggtacacatgtg

SEQ ID NO: 350412 - DNA, 16 bp, M. musculus
accaggtatgtttggc

SEQ ID NO: 350413 - DNA, 16 bp, M. musculus
accaggtcctctgtgt

SEQ ID NO: 350414 - DNA, 16 bp, M. musculus
accaggtctttgtttt

SEQ ID NO: 350415 - DNA, 16 bp, M. musculus
accaggtggatgctgg

SEQ ID NO: 350416 - DNA, 16 bp, M. musculus
accaggtgtggtggca

SEQ ID NO: 350417 - DNA, 16 bp, M. musculus
accagtaactccagag

SEQ ID NO: 350418 - DNA, 17 bp, M. musculus
accagtaagaagaacac

SEQ ID NO: 350419 - DNA, 16 bp, M. musculus
accagtacccccaggg

SEQ ID NO: 350420 - DNA, 16 bp, M. musculus
accagtaccccccgga

SEQ ID NO: 350421 - DNA, 16 bp, M. musculus
accagtacccccctgg

SEQ ID NO: 350422 - DNA, 16 bp, M. musculus
accagtagcaaaatta

SEQ ID NO: 350423 - DNA, 16 bp, M. musculus
accagtagccagcatc

SEQ ID NO: 350424 - DNA, 16 bp, M. musculus
accagtagctttcttg

SEQ ID NO: 350425 - DNA, 16 bp, M. musculus
accagtagtggaggag

SEQ ID NO: 350426 - DNA, 17 bp, M. musculus
accagtatcatgcagtt

SEQ ID NO: 350427 - DNA, 16 bp, M. musculus
accagtatcccccaga

SEQ ID NO: 350428 - DNA, 16 bp, M. musculus
accagtcagaatgtct

SEQ ID NO: 350429 - DNA, 16 bp, M. musculus
accagtctggcctgga

SEQ ID NO: 350430 - DNA, 16 bp, M. musculus
accagtgagaatggct

SEQ ID NO: 350431 - DNA, 16 bp, M. musculus
accagtgagctccaga

SEQ ID NO: 350432 - DNA, 16 bp, M. musculus
accagttggcccagtt

SEQ ID NO: 350433 - DNA, 16 bp, M. musculus
accagttgggccagca

SEQ ID NO: 350434 - DNA, 16 bp, M. musculus
accagttgtgccagaa

SEQ ID NO: 350435 - DNA, 16 bp, M. musculus
accataaaagaacttc

SEQ ID NO: 350436 - DNA, 16 bp, M. musculus
accataaaattattat

SEQ ID NO: 350437 - DNA, 16 bp, M. musculus
accataaccaaggcaa

SEQ ID NO: 350438 - DNA, 16 bp, M. musculus
accatacagagaaacc

SEQ ID NO: 350439 - DNA, 16 bp, M. musculus
accatacaggagagaa

SEQ ID NO: 350440 - DNA, 18 bp, M. musculus
accatacataaaatgtag

SEQ ID NO: 350441 - DNA, 16 bp, M. musculus
accataccacagggac

SEQ ID NO: 350442 - DNA, 16 bp, M. musculus
accatacctggtttat

SEQ ID NO: 350443 - DNA, 16 bp, M. musculus
accatagaagaaattg

SEQ ID NO: 350444 - DNA, 16 bp, M. musculus
accatagagaacatcg

SEQ ID NO: 350445 - DNA, 16 bp, M. musculus
accatagattcaagca

SEQ ID NO: 350446 - DNA, 16 bp, M. musculus
accatagccaaaagca

SEQ ID NO: 350447 - DNA, 16 bp, M. musculus
accatagctggagaaa

SEQ ID NO: 350448 - DNA, 16 bp, M. musculus
accatatatcaggggg

SEQ ID NO: 350449 - DNA, 16 bp, M. musculus
accatatatgtgtgtg

SEQ ID NO: 350450 - DNA, 16 bp, M. musculus
accatatctgcctgga

SEQ ID NO: 350451 - DNA, 16 bp, M. musculus
accatatgattgctgg

SEQ ID NO: 350452 - DNA, 16 bp, M. musculus
accatatgggtgctgg

SEQ ID NO: 350453 - DNA, 16 bp, M. musculus
accatatggtggcctc

SEQ ID NO: 350454 - DNA, 16 bp, M. musculus
accatcaaagacctaa

SEQ ID NO: 350455 - DNA, 16 bp, M. musculus
accatcaacatgaacc

SEQ ID NO: 350456 - DNA, 16 bp, M. musculus
accatcaacatgagat

SEQ ID NO: 350457 - DNA, 16 bp, M. musculus
accatcaaggtgggaa

SEQ ID NO: 350458 - DNA, 16 bp, M. musculus
accatcacaccagaaa

SEQ ID NO: 350459 - DNA, 16 bp, M. musculus
accatcaccaccactg

SEQ ID NO: 350460 - DNA, 16 bp, M. musculus
accatcaccactgtca

SEQ ID NO: 350461 - DNA, 16 bp, M. musculus
accatcagaagacaca

SEQ ID NO: 350462 - DNA, 16 bp, M. musculus
accatcagagaagctt

SEQ ID NO: 350463 - DNA, 16 bp, M. musculus
accatcagcagcagca

SEQ ID NO: 350464 - DNA, 16 bp, M. musculus
accatcataccagaaa

SEQ ID NO: 350465 - DNA, 16 bp, M. musculus
accatcatcaccatca

SEQ ID NO: 350466 - DNA, 16 bp, M. musculus
accatcatcactacca

SEQ ID NO: 350467 - DNA, 17 bp, M. musculus
accatcatcagaactca

SEQ ID NO: 350468 - DNA, 16 bp, M. musculus
accatcatgcccagtt

SEQ ID NO: 350469 - DNA, 16 bp, M. musculus
accatcatggcaggaa

SEQ ID NO: 350470 - DNA, 16 bp, M. musculus
accatcatggcaggga

SEQ ID NO: 350471 - DNA, 16 bp, M. musculus
accatcattaccacca

SEQ ID NO: 350472 - DNA, 16 bp, M. musculus
accatccaaccatcca

SEQ ID NO: 350473 - DNA, 16 bp, M. musculus
accatccagacactgc

SEQ ID NO: 350474 - DNA, 16 bp, M. musculus
accatccagaggaaaa

SEQ ID NO: 350475 - DNA, 16 bp, M. musculus
accatccaggatttaa

SEQ ID NO: 350476 - DNA, 16 bp, M. musculus
accatcccctaggcag

SEQ ID NO: 350477 - DNA, 16 bp, M. musculus
accatccctaggctgg

SEQ ID NO: 350478 - DNA, 16 bp, M. musculus
accatccctgcatcca

SEQ ID NO: 350479 - DNA, 19 bp, M. musculus
accatccctgcatccctgg

SEQ ID NO: 350480 - DNA, 16 bp, M. musculus
accatccctgcctccc

SEQ ID NO: 350481 - DNA, 16 bp, M. musculus
accatcctcagctcca

SEQ ID NO: 350482 - DNA, 16 bp, M. musculus
accatccttgccccct

SEQ ID NO: 350483 - DNA, 16 bp, M. musculus
accatccttgggctgg

SEQ ID NO: 350484 - DNA, 16 bp, M. musculus
accatcgtcatcatca

SEQ ID NO: 350485 - DNA, 16 bp, M. musculus
accatctagtgattga

SEQ ID NO: 350486 - DNA, 16 bp, M. musculus
accatctagtggaaga

SEQ ID NO: 350487 - DNA, 17 bp, M. musculus
accatctcaccagccca

SEQ ID NO: 350488 - DNA, 16 bp, M. musculus
accatctcactggccc

SEQ ID NO: 350489 - DNA, 16 bp, M. musculus
accatctcaggaagat

SEQ ID NO: 350490 - DNA, 16 bp, M. musculus
accatctctcctgccc

SEQ ID NO: 350491 - DNA, 16 bp, M. musculus
accatctctgacctca

SEQ ID NO: 350492 - DNA, 16 bp, M. musculus
accatctctgcatctc

SEQ ID NO: 350493 - DNA, 16 bp, M. musculus
accatctctggcctgg

SEQ ID NO: 350494 - DNA, 16 bp, M. musculus
accatctgtaatagaa

SEQ ID NO: 350495 - DNA, 16 bp, M. musculus
accatctgtaatgggg

SEQ ID NO: 350496 - DNA, 16 bp, M. musculus
accatctgtaatgggt

SEQ ID NO: 350497 - DNA, 16 bp, M. musculus
accatcttatgcctat

SEQ ID NO: 350498 - DNA, 16 bp, M. musculus
accatcttccccatct

SEQ ID NO: 350499 - DNA, 16 bp, M. musculus
accatcttccttattc

SEQ ID NO: 350500 - DNA, 16 bp, M. musculus
accatcttccttctga

SEQ ID NO: 350501 - DNA, 16 bp, M. musculus
accatcttctccatct

SEQ ID NO: 350502 - DNA, 16 bp, M. musculus
accatctttaatggga

SEQ ID NO: 350503 - DNA, 16 bp, M. musculus
accatgaaaagaccaa

SEQ ID NO: 350504 - DNA, 16 bp, M. musculus
accatgaatgaccacc

SEQ ID NO: 350505 - DNA, 16 bp, M. musculus
accatgacaaaggcaa

SEQ ID NO: 350506 - DNA, 16 bp, M. musculus
accatgacagcctgga

SEQ ID NO: 350507 - DNA, 16 bp, M. musculus
accatgaccaaaacaa

SEQ ID NO: 350508 - DNA, 16 bp, M. musculus
accatgaccaaaagca

SEQ ID NO: 350509 - DNA, 16 bp, M. musculus
accatgaccaaggcaa

SEQ ID NO: 350510 - DNA, 16 bp, M. musculus
accatgaccaccacca

SEQ ID NO: 350511 - DNA, 16 bp, M. musculus
accatgaccatggcaa

SEQ ID NO: 350512 - DNA, 16 bp, M. musculus
accatgactaaggcaa

SEQ ID NO: 350513 - DNA, 16 bp, M. musculus
accatgacttcttcct

SEQ ID NO: 350514 - DNA, 16 bp, M. musculus
accatgaggtcctgag

SEQ ID NO: 350515 - DNA, 16 bp, M. musculus
accatgatgacaatgg

SEQ ID NO: 350516 - DNA, 16 bp, M. musculus
accatgatgagaatgg

SEQ ID NO: 350517 - DNA, 17 bp, M. musculus
accatgatgctggtggt

SEQ ID NO: 350518 - DNA, 16 bp, M. musculus
accatgcatgtccttt

SEQ ID NO: 350519 - DNA, 16 bp, M. musculus
accatgcatgtttttt

SEQ ID NO: 350520 - DNA, 16 bp, M. musculus
accatgccagcctgga

SEQ ID NO: 350521 - DNA, 16 bp, M. musculus
accatgccaggctcct

SEQ ID NO: 350522 - DNA, 16 bp, M. musculus
accatgccattcccag

SEQ ID NO: 350523 - DNA, 16 bp, M. musculus
accatgcccagctgtc

SEQ ID NO: 350524 - DNA, 16 bp, M. musculus
accatgcccggctcaa

SEQ ID NO: 350525 - DNA, 16 bp, M. musculus
accatgcccggctgat

SEQ ID NO: 350526 - DNA, 16 bp, M. musculus
accatgcctgacccaa

SEQ ID NO: 350527 - DNA, 16 bp, M. musculus
accatgcctgcatccc

SEQ ID NO: 350528 - DNA, 16 bp, M. musculus
accatgccttccccac

SEQ ID NO: 350529 - DNA, 16 bp, M. musculus
accatgctctctctct

SEQ ID NO: 350530 - DNA, 16 bp, M. musculus
accatgctggcttcaa

SEQ ID NO: 350531 - DNA, 16 bp, M. musculus
accatgcttttgtttg

SEQ ID NO: 350532 - DNA, 16 bp, M. musculus
accatggagaagatag

SEQ ID NO: 350533 - DNA, 16 bp, M. musculus
accatggagactggca

SEQ ID NO: 350534 - DNA, 16 bp, M. musculus
accatggcaactctta

SEQ ID NO: 350535 - DNA, 16 bp, M. musculus
accatgggagatcttt

SEQ ID NO: 350536 - DNA, 16 bp, M. musculus
accatggggagcaagc

SEQ ID NO: 350537 - DNA, 16 bp, M. musculus
accatggtattttata

SEQ ID NO: 350538 - DNA, 16 bp, M. musculus
accatggtcccaggtg

SEQ ID NO: 350539 - DNA, 16 bp, M. musculus
accatgtaggtgctgg

SEQ ID NO: 350540 - DNA, 16 bp, M. musculus
accatgtatgtacctg

SEQ ID NO: 350541 - DNA, 16 bp, M. musculus
accatgtctacctgga

SEQ ID NO: 350542 - DNA, 16 bp, M. musculus
accatgtctgcctcca

SEQ ID NO: 350543 - DNA, 16 bp, M. musculus
accatgtctgcctgca

SEQ ID NO: 350544 - DNA, 16 bp, M. musculus
accatgtctgtctgca

SEQ ID NO: 350545 - DNA, 16 bp, M. musculus
accatgtgcaacatac

SEQ ID NO: 350546 - DNA, 16 bp, M. musculus
accatgtgcatacctg

SEQ ID NO: 350547 - DNA, 16 bp, M. musculus
accatgtgcatgctgg

SEQ ID NO: 350548 - DNA, 16 bp, M. musculus
accatgtgcttctgct

SEQ ID NO: 350549 - DNA, 16 bp, M. musculus
accatgtggatcccag

SEQ ID NO: 350550 - DNA, 16 bp, M. musculus
accatgtgggacccag

SEQ ID NO: 350551 - DNA, 16 bp, M. musculus
accatgtgggcgctgg

SEQ ID NO: 350552 - DNA, 16 bp, M. musculus
accatgtgggtcctga

SEQ ID NO: 350553 - DNA, 16 bp, M. musculus
accatgtgggtgttgg

SEQ ID NO: 350554 - DNA, 16 bp, M. musculus
accatgtgggttctgg

SEQ ID NO: 350555 - DNA, 16 bp, M. musculus
accatgtggttgatgg

SEQ ID NO: 350556 - DNA, 16 bp, M. musculus
accatgtggttggtag

SEQ ID NO: 350557 - DNA, 16 bp, M. musculus
accatgtggtttgctg

SEQ ID NO: 350558 - DNA, 16 bp, M. musculus
accatgtgtctgttct

SEQ ID NO: 350559 - DNA, 16 bp, M. musculus
accatgtgtgtcccag

SEQ ID NO: 350560 - DNA, 16 bp, M. musculus
accatgtgtgtgcctg

SEQ ID NO: 350561 - DNA, 16 bp, M. musculus
accatgtgtgttccag

SEQ ID NO: 350562 - DNA, 16 bp, M. musculus
accatgttgaagctga

SEQ ID NO: 350563 - DNA, 16 bp, M. musculus
accattatcaccatca

SEQ ID NO: 350564 - DNA, 16 bp, M. musculus
accattcctgggcata

SEQ ID NO: 350565 - DNA, 16 bp, M. musculus
accattctccaaaatg

SEQ ID NO: 350566 - DNA, 16 bp, M. musculus
accattgagccacacc

SEQ ID NO: 350567 - DNA, 16 bp, M. musculus
accattggaaaacaca

SEQ ID NO: 350568 - DNA, 16 bp, M. musculus
accattggttgaaaat

SEQ ID NO: 350569 - DNA, 16 bp, M. musculus
accatttagttcctgg

SEQ ID NO: 350570 - DNA, 17 bp, M. musculus
acccaaaaatgcagtct

SEQ ID NO: 350571 - DNA, 16 bp, M. musculus
acccaaaagaagacag

SEQ ID NO: 350572 - DNA, 16 bp, M. musculus
acccaaaaggacatgg

SEQ ID NO: 350573 - DNA, 16 bp, M. musculus
acccaaacaagggaat

SEQ ID NO: 350574 - DNA, 16 bp, M. musculus
acccaaagaagctaaa

SEQ ID NO: 350575 - DNA, 16 bp, M. musculus
acccaaagaagtcaaa

SEQ ID NO: 350576 - DNA, 16 bp, M. musculus
acccaaagctgtacta

SEQ ID NO: 350577 - DNA, 16 bp, M. musculus
acccaaattcttccca

SEQ ID NO: 350578 - DNA, 16 bp, M. musculus
acccaacaagctgctg

SEQ ID NO: 350579 - DNA, 16 bp, M. musculus
acccaacaaggagctg

SEQ ID NO: 350580 - DNA, 16 bp, M. musculus
acccaacaagtagctg

SEQ ID NO: 350581 - DNA, 16 bp, M. musculus
acccaacacccattca

SEQ ID NO: 350582 - DNA, 16 bp, M. musculus
acccaacaccctcttt

SEQ ID NO: 350583 - DNA, 16 bp, M. musculus
acccaacagcacttcc

SEQ ID NO: 350584 - DNA, 16 bp, M. musculus
acccaacatcctcttc

SEQ ID NO: 350585 - DNA, 16 bp, M. musculus
acccaacccagacact

SEQ ID NO: 350586 - DNA, 17 bp, M. musculus
acccaagaagacactga

SEQ ID NO: 350587 - DNA, 16 bp, M. musculus
acccaagaggagaaga

SEQ ID NO: 350588 - DNA, 16 bp, M. musculus
acccaagagtggtata

SEQ ID NO: 350589 - DNA, 16 bp, M. musculus
acccaagatattttat

SEQ ID NO: 350590 - DNA, 16 bp, M. musculus
acccaaggagaccaga

SEQ ID NO: 350591 - DNA, 16 bp, M. musculus
acccaaggagatgaag

SEQ ID NO: 350592 - DNA, 16 bp, M. musculus
acccaaggagccgaag

SEQ ID NO: 350593 - DNA, 16 bp, M. musculus
acccaaggagctaagg

SEQ ID NO: 350594 - DNA, 16 bp, M. musculus
acccaaggagctacag

SEQ ID NO: 350595 - DNA, 16 bp, M. musculus
acccaaggagttgaag

SEQ ID NO: 350596 - DNA, 16 bp, M. musculus
acccaaggggctaaag

SEQ ID NO: 350597 - DNA, 16 bp, M. musculus
acccaagtcagaatgg

SEQ ID NO: 350598 - DNA, 16 bp, M. musculus
acccaagttcaatttc

SEQ ID NO: 350599 - DNA, 16 bp, M. musculus
acccaagttcagttct

SEQ ID NO: 350600 - DNA, 16 bp, M. musculus
acccaagtttggatcc

SEQ ID NO: 350601 - DNA, 16 bp, M. musculus
acccaatcacacaaga

SEQ ID NO: 350602 - DNA, 16 bp, M. musculus
acccaatgaagaaaga

SEQ ID NO: 350603 - DNA, 16 bp, M. musculus
acccaattttttaata

SEQ ID NO: 350604 - DNA, 16 bp, M. musculus
acccacaaaactttct

SEQ ID NO: 350605 - DNA, 16 bp, M. musculus
acccacaaaatctatt

SEQ ID NO: 350606 - DNA, 16 bp, M. musculus
acccacaactggacaa

SEQ ID NO: 350607 - DNA, 16 bp, M. musculus
acccacacactcctgc

SEQ ID NO: 350608 - DNA, 16 bp, M. musculus
acccacacctgcttcc

SEQ ID NO: 350609 - DNA, 16 bp, M. musculus
acccacacggtagctc

SEQ ID NO: 350610 - DNA, 16 bp, M. musculus
acccacactggaatat

SEQ ID NO: 350611 - DNA, 16 bp, M. musculus
acccacactggatccc

SEQ ID NO: 350612 - DNA, 16 bp, M. musculus
acccacactgggtggc

SEQ ID NO: 350613 - DNA, 16 bp, M. musculus
acccacagagtccaga

SEQ ID NO: 350614 - DNA, 16 bp, M. musculus
acccacagccaaacat

SEQ ID NO: 350615 - DNA, 16 bp, M. musculus
acccacagccacacag

SEQ ID NO: 350616 - DNA, 16 bp, M. musculus
acccacagcccaacat

SEQ ID NO: 350617 - DNA, 16 bp, M. musculus
acccacagctggacaa

SEQ ID NO: 350618 - DNA, 16 bp, M. musculus
acccacaggaacattc

SEQ ID NO: 350619 - DNA, 16 bp, M. musculus
acccacaggctgagaa

SEQ ID NO: 350620 - DNA, 16 bp, M. musculus
acccacagggcagctc

SEQ ID NO: 350621 - DNA, 16 bp, M. musculus
acccacagggtagctc

SEQ ID NO: 350622 - DNA, 16 bp, M. musculus
acccacaggttgagaa

SEQ ID NO: 350623 - DNA, 16 bp, M. musculus
acccacagtgagctgg

SEQ ID NO: 350624 - DNA, 16 bp, M. musculus
acccacagtggcctgg

SEQ ID NO: 350625 - DNA, 16 bp, M. musculus
acccacatggcagccc

SEQ ID NO: 350626 - DNA, 16 bp, M. musculus
acccacatggcagttc

SEQ ID NO: 350627 - DNA, 16 bp, M. musculus
acccacatggtggatg

SEQ ID NO: 350628 - DNA, 16 bp, M. musculus
acccacattgcagcta

SEQ ID NO: 350629 - DNA, 16 bp, M. musculus
acccaccagaagaggg

SEQ ID NO: 350630 - DNA, 16 bp, M. musculus
acccacccactcctgc

SEQ ID NO: 350631 - DNA, 16 bp, M. musculus
acccacccattcccat

SEQ ID NO: 350632 - DNA, 16 bp, M. musculus
acccacctacccatct

SEQ ID NO: 350633 - DNA, 40 bp, M. musculus
acccacctgactggacttccatacaaccctcaaggacagg

SEQ ID NO: 350634 - DNA, 16 bp, M. musculus
acccacctgcctctgt

SEQ ID NO: 350635 - DNA, 16 bp, M. musculus
acccactcaacaaaga

SEQ ID NO: 350636 - DNA, 16 bp, M. musculus
acccactcccgcttcc

SEQ ID NO: 350637 - DNA, 16 bp, M. musculus
acccactgagccaact

SEQ ID NO: 350638 - DNA, 16 bp, M. musculus
acccactgagccacct

SEQ ID NO: 350639 - DNA, 16 bp, M. musculus
acccactgagccactt

SEQ ID NO: 350640 - DNA, 16 bp, M. musculus
acccactgagccatcc

SEQ ID NO: 350641 - DNA, 18 bp, M. musculus
acccactgagccatctcg

SEQ ID NO: 350642 - DNA, 16 bp, M. musculus
acccactgagtccagt

SEQ ID NO: 350643 - DNA, 16 bp, M. musculus
acccactgatccatct

SEQ ID NO: 350644 - DNA, 16 bp, M. musculus
acccactgcactcaga

SEQ ID NO: 350645 - DNA, 16 bp, M. musculus
acccactggcaacagg

SEQ ID NO: 350646 - DNA, 16 bp, M. musculus
acccacttcaacaagg

SEQ ID NO: 350647 - DNA, 16 bp, M. musculus
acccacttctacctca

SEQ ID NO: 350648 - DNA, 16 bp, M. musculus
acccacttctggcctc

SEQ ID NO: 350649 - DNA, 16 bp, M. musculus
acccacttcttggccc

SEQ ID NO: 350650 - DNA, 16 bp, M. musculus
acccagaaaaaccctg

SEQ ID NO: 350651 - DNA, 16 bp, M. musculus
acccagaaacacattt

SEQ ID NO: 350652 - DNA, 16 bp, M. musculus
acccagaaagacaagc

SEQ ID NO: 350653 - DNA, 16 bp, M. musculus
acccagaaagataaac

SEQ ID NO: 350654 - DNA, 16 bp, M. musculus
acccagaaccagaaag

SEQ ID NO: 350655 - DNA, 16 bp, M. musculus
acccagaactggtgct

SEQ ID NO: 350656 - DNA, 16 bp, M. musculus
acccagaagagaagaa

SEQ ID NO: 350657 - DNA, 16 bp, M. musculus
acccagaagattttcc

SEQ ID NO: 350658 - DNA, 16 bp, M. musculus
acccagaagctgactc

SEQ ID NO: 350659 - DNA, 16 bp, M. musculus
acccagaaggacatgc

SEQ ID NO: 350660 - DNA, 16 bp, M. musculus
acccagacaaactttc

SEQ ID NO: 350661 - DNA, 16 bp, M. musculus
acccagacacacagac

SEQ ID NO: 350662 - DNA, 16 bp, M. musculus
acccagacaccattgc

SEQ ID NO: 350663 - DNA, 16 bp, M. musculus
acccagacccagatcc

SEQ ID NO: 350664 - DNA, 16 bp, M. musculus
acccagaccccaggga

SEQ ID NO: 350665 - DNA, 16 bp, M. musculus
acccagacctctgtgc

SEQ ID NO: 350666 - DNA, 16 bp, M. musculus
acccagagagacaaac

SEQ ID NO: 350667 - DNA, 16 bp, M. musculus
acccagagagggaagg

SEQ ID NO: 350668 - DNA, 16 bp, M. musculus
acccagagattccacc

SEQ ID NO: 350669 - DNA, 16 bp, M. musculus
acccagagcacaggaa

SEQ ID NO: 350670 - DNA, 16 bp, M. musculus
acccagagctcaccaa

SEQ ID NO: 350671 - DNA, 16 bp, M. musculus
acccagagctgtgtct

SEQ ID NO: 350672 - DNA, 16 bp, M. musculus
acccagagcttccagg

SEQ ID NO: 350673 - DNA, 16 bp, M. musculus
acccagagcttgtgtc

SEQ ID NO: 350674 - DNA, 16 bp, M. musculus
acccagaggaagctca

SEQ ID NO: 350675 - DNA, 16 bp, M. musculus
acccagaggaggctca

SEQ ID NO: 350676 - DNA, 16 bp, M. musculus
acccagaggtcctaga

SEQ ID NO: 350677 - DNA, 17 bp, M. musculus
acccagatatgaaccca

SEQ ID NO: 350678 - DNA, 16 bp, M. musculus
acccagatgccctcaa

SEQ ID NO: 350679 - DNA, 16 bp, M. musculus
acccagatggtggaag

SEQ ID NO: 350680 - DNA, 16 bp, M. musculus
acccagatgttcttca

SEQ ID NO: 350681 - DNA, 16 bp, M. musculus
acccagcaaccacatg

SEQ ID NO: 350682 - DNA, 16 bp, M. musculus
acccagcaactgactc

SEQ ID NO: 350683 - DNA, 16 bp, M. musculus
acccagcactcacacc

SEQ ID NO: 350684 - DNA, 16 bp, M. musculus
acccagcactttgctg

SEQ ID NO: 350685 - DNA, 16 bp, M. musculus
acccagcagaggtagt

SEQ ID NO: 350686 - DNA, 16 bp, M. musculus
acccagcagtcctttg

SEQ ID NO: 350687 - DNA, 16 bp, M. musculus
acccagccagccagcc

SEQ ID NO: 350688 - DNA, 16 bp, M. musculus
acccagcccagcccag

SEQ ID NO: 350689 - DNA, 16 bp, M. musculus
acccagcccatggtgg

SEQ ID NO: 350690 - DNA, 16 bp, M. musculus
acccagcctcttggcc

SEQ ID NO: 350691 - DNA, 16 bp, M. musculus
acccagctattgtgct

SEQ ID NO: 350692 - DNA, 16 bp, M. musculus
acccagctcatgatgg

SEQ ID NO: 350693 - DNA, 16 bp, M. musculus
acccagctctcccacc

SEQ ID NO: 350694 - DNA, 16 bp, M. musculus
acccaggaaaggggat

SEQ ID NO: 350695 - DNA, 16 bp, M. musculus
acccaggaccaccagc

SEQ ID NO: 350696 - DNA, 16 bp, M. musculus
acccaggaccaccagg

SEQ ID NO: 350697 - DNA, 16 bp, M. musculus
acccaggaccagcagc

SEQ ID NO: 350698 - DNA, 16 bp, M. musculus
acccaggacctcctgc

SEQ ID NO: 350699 - DNA, 16 bp, M. musculus
acccaggactacacag

SEQ ID NO: 350700 - DNA, 16 bp, M. musculus
acccaggactcccagc

SEQ ID NO: 350701 - DNA, 16 bp, M. musculus
acccaggagaaagaag

SEQ ID NO: 350702 - DNA, 16 bp, M. musculus
acccaggaggcagagc

SEQ ID NO: 350703 - DNA, 16 bp, M. musculus
acccaggaggctgaga

SEQ ID NO: 350704 - DNA, 16 bp, M. musculus
acccaggatacaagat

SEQ ID NO: 350705 - DNA, 16 bp, M. musculus
acccaggccctaaaga

SEQ ID NO: 350706 - DNA, 16 bp, M. musculus
acccaggccctctgga

SEQ ID NO: 350707 - DNA, 16 bp, M. musculus
acccaggctttttact

SEQ ID NO: 350708 - DNA, 16 bp, M. musculus
acccagggagctgggg

SEQ ID NO: 350709 - DNA, 16 bp, M. musculus
acccagggccttgcat

SEQ ID NO: 350710 - DNA, 16 bp, M. musculus
acccagggctacacag

SEQ ID NO: 350711 - DNA, 16 bp, M. musculus
acccagggctacatag

SEQ ID NO: 350712 - DNA, 16 bp, M. musculus
acccaggtcctctgtg

SEQ ID NO: 350713 - DNA, 16 bp, M. musculus
acccaggttcaattcc

SEQ ID NO: 350714 - DNA, 16 bp, M. musculus
acccagtaccccctgg

SEQ ID NO: 350715 - DNA, 16 bp, M. musculus
acccagtaccttcccc

SEQ ID NO: 350716 - DNA, 16 bp, M. musculus
acccagtaggagggaa

SEQ ID NO: 350717 - DNA, 16 bp, M. musculus
acccagtcacaaagaa

SEQ ID NO: 350718 - DNA, 16 bp, M. musculus
acccagtccactgtgg

SEQ ID NO: 350719 - DNA, 16 bp, M. musculus
acccagtgaatttaat

SEQ ID NO: 350720 - DNA, 16 bp, M. musculus
acccagtgacatcaca

SEQ ID NO: 350721 - DNA, 16 bp, M. musculus
acccagtggaagaaag

SEQ ID NO: 350722 - DNA, 16 bp, M. musculus
acccagtgtgtgtgtg

SEQ ID NO: 350723 - DNA, 16 bp, M. musculus
acccagttccctctct

SEQ ID NO: 350724 - DNA, 16 bp, M. musculus
acccagttccttccct

SEQ ID NO: 350725 - DNA, 16 bp, M. musculus
acccagttgtgccagc

SEQ ID NO: 350726 - DNA, 16 bp, M. musculus
acccataagttctgtg

SEQ ID NO: 350727 - DNA, 16 bp, M. musculus
acccataggttgagaa

SEQ ID NO: 350728 - DNA, 16 bp, M. musculus
acccatcaacataatc

SEQ ID NO: 350729 - DNA, 16 bp, M. musculus
acccatccatccatca

SEQ ID NO: 350730 - DNA, 16 bp, M. musculus
acccatcccatctgca

SEQ ID NO: 350731 - DNA, 16 bp, M. musculus
acccatctccaaattt

SEQ ID NO: 350732 - DNA, 16 bp, M. musculus
acccatctctccagtc

SEQ ID NO: 350733 - DNA, 16 bp, M. musculus
acccatgatgaaggag

SEQ ID NO: 350734 - DNA, 16 bp, M. musculus
acccatgatttgactt

SEQ ID NO: 350735 - DNA, 16 bp, M. musculus
acccatgccaggcagc

SEQ ID NO: 350736 - DNA, 18 bp, M. musculus
acccatggaaggagttac

SEQ ID NO: 350737 - DNA, 16 bp, M. musculus
acccatggtggaagga

SEQ ID NO: 350738 - DNA, 16 bp, M. musculus
acccatgtcaggtggc

SEQ ID NO: 350739 - DNA, 16 bp, M. musculus
acccatgtcttctgga

SEQ ID NO: 350740 - DNA, 16 bp, M. musculus
acccattattttgtat

SEQ ID NO: 350741 - DNA, 16 bp, M. musculus
acccattcatccaccc

SEQ ID NO: 350742 - DNA, 16 bp, M. musculus
acccattccttcctgg

SEQ ID NO: 350743 - DNA, 16 bp, M. musculus
acccatttacctgcaa

SEQ ID NO: 350744 - DNA, 16 bp, M. musculus
acccatttctgcttcc

SEQ ID NO: 350745 - DNA, 16 bp, M. musculus
acccatttgtccaaga

SEQ ID NO: 350746 - DNA, 16 bp, M. musculus
accccaaaactcctca

SEQ ID NO: 350747 - DNA, 16 bp, M. musculus
accccaactcctcctg

SEQ ID NO: 350748 - DNA, 16 bp, M. musculus
accccaagaattccac

SEQ ID NO: 350749 - DNA, 16 bp, M. musculus
accccaagcttgggaa

SEQ ID NO: 350750 - DNA, 16 bp, M. musculus
accccaataaactcat

SEQ ID NO: 350751 - DNA, 16 bp, M. musculus
accccaatggagaagc

SEQ ID NO: 350752 - DNA, 16 bp, M. musculus
accccacctgacttct

SEQ ID NO: 350753 - DNA, 16 bp, M. musculus
accccactcaggatga

SEQ ID NO: 350754 - DNA, 16 bp, M. musculus
accccagaaaatggag

SEQ ID NO: 350755 - DNA, 16 bp, M. musculus
accccagaagagggtg

SEQ ID NO: 350756 - DNA, 16 bp, M. musculus
accccagacaaaggca

SEQ ID NO: 350757 - DNA, 16 bp, M. musculus
accccagactgacacc

SEQ ID NO: 350758 - DNA, 16 bp, M. musculus
accccagagagagaga

SEQ ID NO: 350759 - DNA, 16 bp, M. musculus
accccagagctccctg

SEQ ID NO: 350760 - DNA, 16 bp, M. musculus
accccagcacacagga

SEQ ID NO: 350761 - DNA, 16 bp, M. musculus
accccagcacaggaga

SEQ ID NO: 350762 - DNA, 16 bp, M. musculus
accccagcacccagga

SEQ ID NO: 350763 - DNA, 16 bp, M. musculus
accccagcactcagaa

SEQ ID NO: 350764 - DNA, 16 bp, M. musculus
accccagcactgggag

SEQ ID NO: 350765 - DNA, 16 bp, M. musculus
accccagcactgggga

SEQ ID NO: 350766 - DNA, 16 bp, M. musculus
accccagctccaggga

SEQ ID NO: 350767 - DNA, 16 bp, M. musculus
accccagctctcagga

SEQ ID NO: 350768 - DNA, 16 bp, M. musculus
accccagcttacctaa

SEQ ID NO: 350769 - DNA, 16 bp, M. musculus
accccaggaacccagg

SEQ ID NO: 350770 - DNA, 16 bp, M. musculus
accccaggacttggga

SEQ ID NO: 350771 - DNA, 16 bp, M. musculus
accccagggctacagg

SEQ ID NO: 350772 - DNA, 16 bp, M. musculus
accccagtcagaatgg

SEQ ID NO: 350773 - DNA, 16 bp, M. musculus
accccagtgctcgagt

SEQ ID NO: 350774 - DNA, 16 bp, M. musculus
accccagtggagaagt

SEQ ID NO: 350775 - DNA, 16 bp, M. musculus
accccatctccacgtg

SEQ ID NO: 350776 - DNA, 16 bp, M. musculus
accccatgtactctgc

SEQ ID NO: 350777 - DNA, 16 bp, M. musculus
acccccaagagctccc

SEQ ID NO: 350778 - DNA, 16 bp, M. musculus
acccccaaggtcccaa

SEQ ID NO: 350779 - DNA, 16 bp, M. musculus
acccccaatggaggag

SEQ ID NO: 350780 - DNA, 16 bp, M. musculus
acccccacacctatgg

SEQ ID NO: 350781 - DNA, 16 bp, M. musculus
acccccacagtcccca

SEQ ID NO: 350782 - DNA, 16 bp, M. musculus
acccccaccagcatcc

SEQ ID NO: 350783 - DNA, 16 bp, M. musculus
acccccaccccaggct

SEQ ID NO: 350784 - DNA, 16 bp, M. musculus
acccccaccccaggga

SEQ ID NO: 350785 - DNA, 16 bp, M. musculus
acccccaccccctttg

SEQ ID NO: 350786 - DNA, 16 bp, M. musculus
acccccacctctgcca

SEQ ID NO: 350787 - DNA, 16 bp, M. musculus
acccccagagatccca

SEQ ID NO: 350788 - DNA, 16 bp, M. musculus
acccccagccacagga

SEQ ID NO: 350789 - DNA, 16 bp, M. musculus
acccccagtgacacac

SEQ ID NO: 350790 - DNA, 16 bp, M. musculus
acccccatcccaccag

SEQ ID NO: 350791 - DNA, 16 bp, M. musculus
acccccatggtcccta

SEQ ID NO: 350792 - DNA, 16 bp, M. musculus
accccccagagctccc

SEQ ID NO: 350793 - DNA, 16 bp, M. musculus
accccccagagctctt

SEQ ID NO: 350794 - DNA, 16 bp, M. musculus
acccccctcagctcct

SEQ ID NO: 350795 - DNA, 16 bp, M. musculus
acccccctggagcttg

SEQ ID NO: 350796 - DNA, 16 bp, M. musculus
accccctagaccctcc

SEQ ID NO: 350797 - DNA, 16 bp, M. musculus
accccctcagctcctt

SEQ ID NO: 350798 - DNA, 16 bp, M. musculus
accccctcttctgacc

SEQ ID NO: 350799 - DNA, 16 bp, M. musculus
accccctggagctcgt

SEQ ID NO: 350800 - DNA, 16 bp, M. musculus
accccctggagctctt

SEQ ID NO: 350801 - DNA, 16 bp, M. musculus
acccccttctccctgt

SEQ ID NO: 350802 - DNA, 16 bp, M. musculus
acccccttctcctctg

SEQ ID NO: 350803 - DNA, 16 bp, M. musculus
accccgagaatgggag

SEQ ID NO: 350804 - DNA, 16 bp, M. musculus
acccctatgaaaggat

SEQ ID NO: 350805 - DNA, 16 bp, M. musculus
acccctatgaaagggt

SEQ ID NO: 350806 - DNA, 16 bp, M. musculus
acccctccagcatccc

SEQ ID NO: 350807 - DNA, 16 bp, M. musculus
acccctcccctcaggg

SEQ ID NO: 350808 - DNA, 16 bp, M. musculus
acccctcccctccaga

SEQ ID NO: 350809 - DNA, 16 bp, M. musculus
acccctcccctctgga

SEQ ID NO: 350810 - DNA, 16 bp, M. musculus
acccctcccttcctgg

SEQ ID NO: 350811 - DNA, 16 bp, M. musculus
acccctctagctcctt

SEQ ID NO: 350812 - DNA, 16 bp, M. musculus
acccctctccctgctc

SEQ ID NO: 350813 - DNA, 16 bp, M. musculus
acccctctccctgctt

SEQ ID NO: 350814 - DNA, 16 bp, M. musculus
acccctgactgtcctg

SEQ ID NO: 350815 - DNA, 16 bp, M. musculus
acccctgagccacacc

SEQ ID NO: 350816 - DNA, 16 bp, M. musculus
acccctggaactagag

SEQ ID NO: 350817 - DNA, 16 bp, M. musculus
acccctggaactggag

SEQ ID NO: 350818 - DNA, 16 bp, M. musculus
acccctggaagagcag

SEQ ID NO: 350819 - DNA, 16 bp, M. musculus
acccctggacaggtgg

SEQ ID NO: 350820 - DNA, 16 bp, M. musculus
acccctggctggcctg

SEQ ID NO: 350821 - DNA, 16 bp, M. musculus
acccctgggaaagggt

SEQ ID NO: 350822 - DNA, 16 bp, M. musculus
acccctgggagctccc

SEQ ID NO: 350823 - DNA, 16 bp, M. musculus
acccctgggcagatgg

SEQ ID NO: 350824 - DNA, 16 bp, M. musculus
acccctgggcaggtag

SEQ ID NO: 350825 - DNA, 16 bp, M. musculus
acccctgtaaaagggt

SEQ ID NO: 350826 - DNA, 16 bp, M. musculus
acccctgtcctctggc

SEQ ID NO: 350827 - DNA, 27 bp, M. musculus
acccctgtgctctcaccaggaaggtgg

SEQ ID NO: 350828 - DNA, 16 bp, M. musculus
accccttcagctcatt

SEQ ID NO: 350829 - DNA, 16 bp, M. musculus
accccttcagctcctc

SEQ ID NO: 350830 - DNA, 16 bp, M. musculus
accccttcagctcctt

SEQ ID NO: 350831 - DNA, 16 bp, M. musculus
accccttcagttcctt

SEQ ID NO: 350832 - DNA, 16 bp, M. musculus
accccttctctctcta

SEQ ID NO: 350833 - DNA, 16 bp, M. musculus
accccttctgtcctgg

SEQ ID NO: 350834 - DNA, 16 bp, M. musculus
acccctttaatcccaa

SEQ ID NO: 350835 - DNA, 16 bp, M. musculus
acccgagttcaatccc

SEQ ID NO: 350836 - DNA, 16 bp, M. musculus
acccgggcatccatcc

SEQ ID NO: 350837 - DNA, 17 bp, M. musculus
acccgtctggtcctggg

SEQ ID NO: 350838 - DNA, 16 bp, M. musculus
accctaaaacagaaaa

SEQ ID NO: 350839 - DNA, 16 bp, M. musculus
accctaaatgtgggca

SEQ ID NO: 350840 - DNA, 16 bp, M. musculus
accctaacctaaccct

SEQ ID NO: 350841 - DNA, 16 bp, M. musculus
accctaactaagacag

SEQ ID NO: 350842 - DNA, 16 bp, M. musculus
accctaagaaaacaca

SEQ ID NO: 350843 - DNA, 16 bp, M. musculus
accctaagtaaagttg

SEQ ID NO: 350844 - DNA, 16 bp, M. musculus
accctacccctgccct

SEQ ID NO: 350845 - DNA, 16 bp, M. musculus
accctacctgccctgt

SEQ ID NO: 350846 - DNA, 16 bp, M. musculus
accctacctgcccttg

SEQ ID NO: 350847 - DNA, 16 bp, M. musculus
accctagaaaaagaaa

SEQ ID NO: 350848 - DNA, 16 bp, M. musculus
accctagtcctctgga

SEQ ID NO: 350849 - DNA, 16 bp, M. musculus
accctatctcaaacaa

SEQ ID NO: 350850 - DNA, 16 bp, M. musculus
accctatctcaaagca

SEQ ID NO: 350851 - DNA, 16 bp, M. musculus
accctatctggaaaaa

SEQ ID NO: 350852 - DNA, 16 bp, M. musculus
accctcactggtgtga

SEQ ID NO: 350853 - DNA, 16 bp, M. musculus
accctcagagaccaga

SEQ ID NO: 350854 - DNA, 16 bp, M. musculus
accctcagaggccaga

SEQ ID NO: 350855 - DNA, 16 bp, M. musculus
accctcatagaagcag

SEQ ID NO: 350856 - DNA, 16 bp, M. musculus
accctcatcctatctg

SEQ ID NO: 350857 - DNA, 16 bp, M. musculus
accctcatctctctct

SEQ ID NO: 350858 - DNA, 16 bp, M. musculus
accctcatggtggaag

SEQ ID NO: 350859 - DNA, 16 bp, M. musculus
accctccaggtccacc

SEQ ID NO: 350860 - DNA, 16 bp, M. musculus
accctccctttgccct

SEQ ID NO: 350861 - DNA, 16 bp, M. musculus
accctcctgcctcagc

SEQ ID NO: 350862 - DNA, 16 bp, M. musculus
accctcctgcctctgc

SEQ ID NO: 350863 - DNA, 16 bp, M. musculus
accctccttacagctt

SEQ ID NO: 350864 - DNA, 16 bp, M. musculus
accctctccccctgct

SEQ ID NO: 350865 - DNA, 16 bp, M. musculus
accctctcctgcttcc

SEQ ID NO: 350866 - DNA, 16 bp, M. musculus
accctctctgggctgg

SEQ ID NO: 350867 - DNA, 16 bp, M. musculus
accctctgacagttcc

SEQ ID NO: 350868 - DNA, 16 bp, M. musculus
accctctgagccacct

SEQ ID NO: 350869 - DNA, 16 bp, M. musculus
accctctgcctctgcc

SEQ ID NO: 350870 - DNA, 16 bp, M. musculus
accctctgtacttctc

SEQ ID NO: 350871 - DNA, 16 bp, M. musculus
accctctgttcctctg

SEQ ID NO: 350872 - DNA, 19 bp, M. musculus
accctcttctggtgtgtct

SEQ ID NO: 350873 - DNA, 16 bp, M. musculus
accctctttttaaaaa

SEQ ID NO: 350874 - DNA, 16 bp, M. musculus
accctgaactctccag

SEQ ID NO: 350875 - DNA, 21 bp, M. musculus
accctgaccattgctggaacc

SEQ ID NO: 350876 - DNA, 16 bp, M. musculus
accctgactggcctgg

SEQ ID NO: 350877 - DNA, 16 bp, M. musculus
accctgagacctctgg

SEQ ID NO: 350878 - DNA, 17 bp, M. musculus
accctgagattcaacct

SEQ ID NO: 350879 - DNA, 16 bp, M. musculus
accctgagggccagca

SEQ ID NO: 350880 - DNA, 16 bp, M. musculus
accctgaggttccatc

SEQ ID NO: 350881 - DNA, 16 bp, M. musculus
accctgagtgctggga

SEQ ID NO: 350882 - DNA, 29 bp, M. musculus
accctgataccaccaagttcctgcttccc

SEQ ID NO: 350883 - DNA, 17 bp, M. musculus
accctgatggtcataat

SEQ ID NO: 350884 - DNA, 16 bp, M. musculus
accctgattaagacaa

SEQ ID NO: 350885 - DNA, 16 bp, M. musculus
accctgccctgctccc

SEQ ID NO: 350886 - DNA, 16 bp, M. musculus
accctgcctcctgcca

SEQ ID NO: 350887 - DNA, 16 bp, M. musculus
accctgcctgcctgga

SEQ ID NO: 350888 - DNA, 16 bp, M. musculus
accctgccttgaaaaa

SEQ ID NO: 350889 - DNA, 16 bp, M. musculus
accctgctcctcaacc

SEQ ID NO: 350890 - DNA, 16 bp, M. musculus
accctgctttcctccc

SEQ ID NO: 350891 - DNA, 16 bp, M. musculus
accctggaacatcaag

SEQ ID NO: 350892 - DNA, 16 bp, M. musculus
accctggagatctctc

SEQ ID NO: 350893 - DNA, 16 bp, M. musculus
accctggaggaagtgc

SEQ ID NO: 350894 - DNA, 16 bp, M. musculus
accctggaggcagagg

SEQ ID NO: 350895 - DNA, 16 bp, M. musculus
accctggcacttcaag

SEQ ID NO: 350896 - DNA, 16 bp, M. musculus
accctggctggcctgg

SEQ ID NO: 350897 - DNA, 16 bp, M. musculus
accctggtctacatag

SEQ ID NO: 350898 - DNA, 16 bp, M. musculus
accctggtgctggagt

SEQ ID NO: 350899 - DNA, 16 bp, M. musculus
accctggtgctggcgg

SEQ ID NO: 350900 - DNA, 16 bp, M. musculus
accctggttaccccaa

SEQ ID NO: 350901 - DNA, 16 bp, M. musculus
accctggttcaattcc

SEQ ID NO: 350902 - DNA, 16 bp, M. musculus
accctgtatcaaaaaa

SEQ ID NO: 350903 - DNA, 17 bp, M. musculus
accctgtctagaaaaac

SEQ ID NO: 350904 - DNA, 16 bp, M. musculus
accctgtctcaaaaga

SEQ ID NO: 350905 - DNA, 16 bp, M. musculus
accctgtctcaaaagc

SEQ ID NO: 350906 - DNA, 16 bp, M. musculus
accctgtctcaaaatg

SEQ ID NO: 350907 - DNA, 16 bp, M. musculus
accctgtctcaaacaa

SEQ ID NO: 350908 - DNA, 17 bp, M. musculus
accctgtctcaacaaaa

SEQ ID NO: 350909 - DNA, 16 bp, M. musculus
accctgtctcaacaga

SEQ ID NO: 350910 - DNA, 16 bp, M. musculus
accctgtctcaagaga

SEQ ID NO: 350911 - DNA, 16 bp, M. musculus
accctgtctcaataaa

SEQ ID NO: 350912 - DNA, 16 bp, M. musculus
accctgtctcagggga

SEQ ID NO: 350913 - DNA, 16 bp, M. musculus
accctgtctccaaaag

SEQ ID NO: 350914 - DNA, 16 bp, M. musculus
accctgtctctcaaaa

SEQ ID NO: 350915 - DNA, 16 bp, M. musculus
accctgtctgaaaaaa

SEQ ID NO: 350916 - DNA, 16 bp, M. musculus
accctgtctgaaaaca

SEQ ID NO: 350917 - DNA, 16 bp, M. musculus
accctgtctggggtgg

SEQ ID NO: 350918 - DNA, 16 bp, M. musculus
accctgtcttgaaaac

SEQ ID NO: 350919 - DNA, 17 bp, M. musculus
accctgtcttgaaacaa

SEQ ID NO: 350920 - DNA, 16 bp, M. musculus
accctgtcttgagaga

SEQ ID NO: 350921 - DNA, 16 bp, M. musculus
accctgtctttgaaaa

SEQ ID NO: 350922 - DNA, 16 bp, M. musculus
accctgtgatccatcc

SEQ ID NO: 350923 - DNA, 16 bp, M. musculus
accctgtgctctgtcc

SEQ ID NO: 350924 - DNA, 16 bp, M. musculus
accctgtttcaaaaca

SEQ ID NO: 350925 - DNA, 16 bp, M. musculus
acccttctcaaaagtc

SEQ ID NO: 350926 - DNA, 16 bp, M. musculus
acccttgaagaccctc

SEQ ID NO: 350927 - DNA, 16 bp, M. musculus
acccttgaatacagtt

SEQ ID NO: 350928 - DNA, 16 bp, M. musculus
acccttgagtctccag

SEQ ID NO: 350929 - DNA, 16 bp, M. musculus
acccttggaagagcag

SEQ ID NO: 350930 - DNA, 16 bp, M. musculus
accctttaacatagtt

SEQ ID NO: 350931 - DNA, 16 bp, M. musculus
accctttaatatagtt

SEQ ID NO: 350932 - DNA, 16 bp, M. musculus
accctttcacagaagt

SEQ ID NO: 350933 - DNA, 16 bp, M. musculus
accctttcacagggct

SEQ ID NO: 350934 - DNA, 16 bp, M. musculus
accctttcacaggggt

SEQ ID NO: 350935 - DNA, 16 bp, M. musculus
accctttcagctgctt

SEQ ID NO: 350936 - DNA, 16 bp, M. musculus
accctttcctagtttc

SEQ ID NO: 350937 - DNA, 16 bp, M. musculus
accctttcctccacaa

SEQ ID NO: 350938 - DNA, 16 bp, M. musculus
accctttctctctctg

SEQ ID NO: 350939 - DNA, 16 bp, M. musculus
accctttcttgaaaaa

SEQ ID NO: 350940 - DNA, 16 bp, M. musculus
accctttgactgttcc

SEQ ID NO: 350941 - DNA, 16 bp, M. musculus
acccttttacaggggt

SEQ ID NO: 350942 - DNA, 16 bp, M. musculus
acccttttctggagtg

SEQ ID NO: 350943 - DNA, 16 bp, M. musculus
acccttttttccccaa

SEQ ID NO: 350944 - DNA, 16 bp, M. musculus
accgaatggctgggaa

SEQ ID NO: 350945 - DNA, 57 bp, M. musculus
accgacccggtgacccggttctctttgacccgccaggtcctcaatatagggccccgc

SEQ ID NO: 350946 - DNA, 16 bp, M. musculus
accgccaggtggcaga

SEQ ID NO: 350947 - DNA, 16 bp, M. musculus
accgctgagccatctg

SEQ ID NO: 350948 - DNA, 16 bp, M. musculus
accgcttggtgcagag

SEQ ID NO: 350949 - DNA, 65 bp, M. musculus
accggacagggactctgcgtaggagcagttcccaaaacccatcaggccctgtgtaataccaccca

SEQ ID NO: 350950 - DNA, 16 bp, M. musculus
accggactcctggcag

SEQ ID NO: 350951 - DNA, 19 bp, M. musculus
accggccaggaagaacgca

SEQ ID NO: 350952 - DNA, 16 bp, M. musculus
accggggcacacaaag

SEQ ID NO: 350953 - DNA, 16 bp, M. musculus
accgggtacacctggg

SEQ ID NO: 350954 - DNA, 18 bp, M. musculus
accgtctagagactgcca

SEQ ID NO: 350955 - DNA, 18 bp, M. musculus
accgtgtggaatacagag

SEQ ID NO: 350956 - DNA, 16 bp, M. musculus
acctaaaaagcaagat

SEQ ID NO: 350957 - DNA, 26 bp, M. musculus
acctaaaacaggggccacagcagatg

SEQ ID NO: 350958 - DNA, 16 bp, M. musculus
acctaaaactttacta

SEQ ID NO: 350959 - DNA, 16 bp, M. musculus
acctaaaagaagaaag

SEQ ID NO: 350960 - DNA, 16 bp, M. musculus
acctaaaagtggaagt

SEQ ID NO: 350961 - DNA, 16 bp, M. musculus
acctaaagataataag

SEQ ID NO: 350962 - DNA, 16 bp, M. musculus
acctaaagcacacaaa

SEQ ID NO: 350963 - DNA, 16 bp, M. musculus
acctaaatttttaact

SEQ ID NO: 350964 - DNA, 16 bp, M. musculus
acctaagtcctctgca

SEQ ID NO: 350965 - DNA, 16 bp, M. musculus
acctaattaaaaattt

SEQ ID NO: 350966 - DNA, 16 bp, M. musculus
acctaattagtgatat

SEQ ID NO: 350967 - DNA, 16 bp, M. musculus
acctacaaccaccact

SEQ ID NO: 350968 - DNA, 16 bp, M. musculus
acctacaagttcaact

SEQ ID NO: 350969 - DNA, 16 bp, M. musculus
acctacacagtggctc

SEQ ID NO: 350970 - DNA, 16 bp, M. musculus
acctacaccaacaagg

SEQ ID NO: 350971 - DNA, 16 bp, M. musculus
acctacagagctcatg

SEQ ID NO: 350972 - DNA, 16 bp, M. musculus
acctacagggtttcag

SEQ ID NO: 350973 - DNA, 16 bp, M. musculus
acctacaggttgagaa

SEQ ID NO: 350974 - DNA, 16 bp, M. musculus
acctacagtgtactca

SEQ ID NO: 350975 - DNA, 16 bp, M. musculus
acctacatagtgagtt

SEQ ID NO: 350976 - DNA, 16 bp, M. musculus
acctacatggtggttc

SEQ ID NO: 350977 - DNA, 16 bp, M. musculus
acctacccactcctgc

SEQ ID NO: 350978 - DNA, 16 bp, M. musculus
acctacccattcctgc

SEQ ID NO: 350979 - DNA, 16 bp, M. musculus
acctacctacccacct

SEQ ID NO: 350980 - DNA, 16 bp, M. musculus
acctacctctctctct

SEQ ID NO: 350981 - DNA, 16 bp, M. musculus
acctactccaacgagg

SEQ ID NO: 350982 - DNA, 16 bp, M. musculus
acctagaatcacctgg

SEQ ID NO: 350983 - DNA, 16 bp, M. musculus
acctagacacacacac

SEQ ID NO: 350984 - DNA, 16 bp, M. musculus
acctagatttgcattc

SEQ ID NO: 350985 - DNA, 16 bp, M. musculus
acctaggatatccaag

SEQ ID NO: 350986 - DNA, 16 bp, M. musculus
acctaggccttctgca

SEQ ID NO: 350987 - DNA, 16 bp, M. musculus
acctaggctacatagt

SEQ ID NO: 350988 - DNA, 16 bp, M. musculus
acctagggcaaactct

SEQ ID NO: 350989 - DNA, 16 bp, M. musculus
acctagggctggagag

SEQ ID NO: 350990 - DNA, 16 bp, M. musculus
acctaggtttggttcc

SEQ ID NO: 350991 - DNA, 16 bp, M. musculus
acctataacctcagca

SEQ ID NO: 350992 - DNA, 16 bp, M. musculus
acctataatctcagca

SEQ ID NO: 350993 - DNA, 16 bp, M. musculus
acctatagctccagct

SEQ ID NO: 350994 - DNA, 16 bp, M. musculus
acctatatctatatat

SEQ ID NO: 350995 - DNA, 16 bp, M. musculus
acctatctctcttctg

SEQ ID NO: 350996 - DNA, 19 bp, M. musculus
acctatgatgacgtgcatg

SEQ ID NO: 350997 - DNA, 16 bp, M. musculus
acctatttttaatgat

SEQ ID NO: 350998 - DNA, 16 bp, M. musculus
acctcaaactcataga

SEQ ID NO: 350999 - DNA, 16 bp, M. musculus
acctcaaagcacagag

SEQ ID NO: 351000 - DNA, 16 bp, M. musculus
acctcaaagcccaccc

SEQ ID NO: 351001 - DNA, 16 bp, M. musculus
acctcaaagcccacct

SEQ ID NO: 351002 - DNA, 16 bp, M. musculus
acctcaacataagacc

SEQ ID NO: 351003 - DNA, 16 bp, M. musculus
acctcaacatgaggaa

SEQ ID NO: 351004 - DNA, 16 bp, M. musculus
acctcaagacccatct

SEQ ID NO: 351005 - DNA, 16 bp, M. musculus
acctcaagatccagct

SEQ ID NO: 351006 - DNA, 16 bp, M. musculus
acctcaagctgtacaa

SEQ ID NO: 351007 - DNA, 16 bp, M. musculus
acctcaatataaaact

SEQ ID NO: 351008 - DNA, 16 bp, M. musculus
acctcaatgatactgg

SEQ ID NO: 351009 - DNA, 16 bp, M. musculus
acctcacagcagtcag

SEQ ID NO: 351010 - DNA, 16 bp, M. musculus
acctcaccaccctggc

SEQ ID NO: 351011 - DNA, 70 bp, M. musculus
acctcaccaccgattactgtgtcctggttgagctctggccaaaggtgacctaccactcccctggttatgt

SEQ ID NO: 351012 - DNA, 16 bp, M. musculus
acctcacccagtcctg

SEQ ID NO: 351013 - DNA, 16 bp, M. musculus
acctcactccagatga

SEQ ID NO: 351014 - DNA, 16 bp, M. musculus
acctcacttgggtcct

SEQ ID NO: 351015 - DNA, 16 bp, M. musculus
acctcagaaacaaaga

SEQ ID NO: 351016 - DNA, 16 bp, M. musculus
acctcagagaaaaagg

SEQ ID NO: 351017 - DNA, 16 bp, M. musculus
acctcagagacaaaga

SEQ ID NO: 351018 - DNA, 16 bp, M. musculus
acctcagagcaaaagg

SEQ ID NO: 351019 - DNA, 16 bp, M. musculus
acctcagaggccagaa

SEQ ID NO: 351020 - DNA, 16 bp, M. musculus
acctcagatgacagca

SEQ ID NO: 351021 - DNA, 16 bp, M. musculus
acctcagattctctct

SEQ ID NO: 351022 - DNA, 18 bp, M. musculus
acctcagcctcagcagca

SEQ ID NO: 351023 - DNA, 16 bp, M. musculus
acctcaggaaactgga

SEQ ID NO: 351024 - DNA, 16 bp, M. musculus
acctcaggaaatagaa

SEQ ID NO: 351025 - DNA, 16 bp, M. musculus
acctcagggcctttgc

SEQ ID NO: 351026 - DNA, 16 bp, M. musculus
acctcaggtagtggtg

SEQ ID NO: 351027 - DNA, 16 bp, M. musculus
acctcaggtcaaacag

SEQ ID NO: 351028 - DNA, 16 bp, M. musculus
acctcagtctgtggaa

SEQ ID NO: 351029 - DNA, 16 bp, M. musculus
acctcagtgaaattct

SEQ ID NO: 351030 - DNA, 16 bp, M. musculus
acctcatgaaacagaa

SEQ ID NO: 351031 - DNA, 16 bp, M. musculus
acctcatgaaactgga

SEQ ID NO: 351032 - DNA, 16 bp, M. musculus
acctcattcaggatgg

SEQ ID NO: 351033 - DNA, 16 bp, M. musculus
acctccaaatagtgcc

SEQ ID NO: 351034 - DNA, 16 bp, M. musculus
acctccaaggtctctg

SEQ ID NO: 351035 - DNA, 16 bp, M. musculus
acctccaatggaggag

SEQ ID NO: 351036 - DNA, 16 bp, M. musculus
acctccacacacaggc

SEQ ID NO: 351037 - DNA, 16 bp, M. musculus
acctccagaatgctgg

SEQ ID NO: 351038 - DNA, 16 bp, M. musculus
acctccagatggtgcc

SEQ ID NO: 351039 - DNA, 16 bp, M. musculus
acctccagccccacct

SEQ ID NO: 351040 - DNA, 16 bp, M. musculus
acctccagtagccaga

SEQ ID NO: 351041 - DNA, 16 bp, M. musculus
acctccagtcccacct

SEQ ID NO: 351042 - DNA, 16 bp, M. musculus
acctccatgggcatca

SEQ ID NO: 351043 - DNA, 16 bp, M. musculus
acctccatgtggctaa

SEQ ID NO: 351044 - DNA, 16 bp, M. musculus
acctcccaaatgctgg

SEQ ID NO: 351045 - DNA, 16 bp, M. musculus
acctcccaaggagcag

SEQ ID NO: 351046 - DNA, 16 bp, M. musculus
acctcccaagtactgg

SEQ ID NO: 351047 - DNA, 16 bp, M. musculus
acctcccaagtctctg

SEQ ID NO: 351048 - DNA, 16 bp, M. musculus
acctcccacatgctgg

SEQ ID NO: 351049 - DNA, 16 bp, M. musculus
acctcccacctgccct

SEQ ID NO: 351050 - DNA, 16 bp, M. musculus
acctcccagatgctgg

SEQ ID NO: 351051 - DNA, 16 bp, M. musculus
acctcccaggtgctgg

SEQ ID NO: 351052 - DNA, 16 bp, M. musculus
acctccccacccctgt

SEQ ID NO: 351053 - DNA, 16 bp, M. musculus
acctccccactccctg

SEQ ID NO: 351054 - DNA, 16 bp, M. musculus
acctccccactccttg

SEQ ID NO: 351055 - DNA, 16 bp, M. musculus
acctccccagctctgg

SEQ ID NO: 351056 - DNA, 16 bp, M. musculus
acctccccagtgctga

SEQ ID NO: 351057 - DNA, 16 bp, M. musculus
acctccccagtgctgg

SEQ ID NO: 351058 - DNA, 16 bp, M. musculus
acctccccccttgatc

SEQ ID NO: 351059 - DNA, 16 bp, M. musculus
acctccccttgacctg

SEQ ID NO: 351060 - DNA, 16 bp, M. musculus
acctccccttgagcta

SEQ ID NO: 351061 - DNA, 16 bp, M. musculus
acctccctgtctccac

SEQ ID NO: 351062 - DNA, 16 bp, M. musculus
acctcctaatccttct

SEQ ID NO: 351063 - DNA, 16 bp, M. musculus
acctcctataactcca

SEQ ID NO: 351064 - DNA, 16 bp, M. musculus
acctcctccaacaagg

SEQ ID NO: 351065 - DNA, 16 bp, M. musculus
acctcctccaccaagg

SEQ ID NO: 351066 - DNA, 16 bp, M. musculus
acctcctccctgctcc

SEQ ID NO: 351067 - DNA, 16 bp, M. musculus
acctcctgagccatct

SEQ ID NO: 351068 - DNA, 16 bp, M. musculus
acctcctggccctggc

SEQ ID NO: 351069 - DNA, 16 bp, M. musculus
acctcctggctgagga

SEQ ID NO: 351070 - DNA, 16 bp, M. musculus
acctccttccaggctc

SEQ ID NO: 351071 - DNA, 16 bp, M. musculus
acctccttgtacaaag

SEQ ID NO: 351072 - DNA, 16 bp, M. musculus
acctcctttgagacag

SEQ ID NO: 351073 - DNA, 28 bp, M. musculus
acctcgggtatcgggcctcggccaagaa

SEQ ID NO: 351074 - DNA, 17 bp, M. musculus
acctctacataaaacca

SEQ ID NO: 351075 - DNA, 16 bp, M. musculus
acctctacctcccaag

SEQ ID NO: 351076 - DNA, 16 bp, M. musculus
acctctcaaatgctgg

SEQ ID NO: 351077 - DNA, 16 bp, M. musculus
acctctcagatgacag

SEQ ID NO: 351078 - DNA, 16 bp, M. musculus
acctctcaggcctggc

SEQ ID NO: 351079 - DNA, 17 bp, M. musculus
acctctcaggtagacca

SEQ ID NO: 351080 - DNA, 16 bp, M. musculus
acctctccagcctcta

SEQ ID NO: 351081 - DNA, 16 bp, M. musculus
acctctccagtcccaa

SEQ ID NO: 351082 - DNA, 16 bp, M. musculus
acctctccatggcctc

SEQ ID NO: 351083 - DNA, 16 bp, M. musculus
acctctctgagcctca

SEQ ID NO: 351084 - DNA, 16 bp, M. musculus
acctctctgatgatga

SEQ ID NO: 351085 - DNA, 16 bp, M. musculus
acctctctggaaacac

SEQ ID NO: 351086 - DNA, 16 bp, M. musculus
acctctctggctccct

SEQ ID NO: 351087 - DNA, 16 bp, M. musculus
acctctctgtgcctca

SEQ ID NO: 351088 - DNA, 16 bp, M. musculus
acctctgaaagaacag

SEQ ID NO: 351089 - DNA, 16 bp, M. musculus
acctctgaacctataa

SEQ ID NO: 351090 - DNA, 16 bp, M. musculus
acctctgagcctgtaa

SEQ ID NO: 351091 - DNA, 16 bp, M. musculus
acctctgcctcctaag

SEQ ID NO: 351092 - DNA, 16 bp, M. musculus
acctctgcctcctgag

SEQ ID NO: 351093 - DNA, 16 bp, M. musculus
acctctgcctgctgag

SEQ ID NO: 351094 - DNA, 16 bp, M. musculus
acctctggaaaaacag

SEQ ID NO: 351095 - DNA, 16 bp, M. musculus
acctctggaatagcag

SEQ ID NO: 351096 - DNA, 16 bp, M. musculus
acctctggaggagcag

SEQ ID NO: 351097 - DNA, 16 bp, M. musculus
acctctggcctccaca

SEQ ID NO: 351098 - DNA, 16 bp, M. musculus
acctctggcctctaca

SEQ ID NO: 351099 - DNA, 16 bp, M. musculus
acctctggcttctgct

SEQ ID NO: 351100 - DNA, 16 bp, M. musculus
acctctgggtatgtct

SEQ ID NO: 351101 - DNA, 16 bp, M. musculus
acctctggtttccaca

SEQ ID NO: 351102 - DNA, 16 bp, M. musculus
acctctgtccctgtgg

SEQ ID NO: 351103 - DNA, 16 bp, M. musculus
acctctgtgaaaggat

SEQ ID NO: 351104 - DNA, 16 bp, M. musculus
acctcttcagctcctt

SEQ ID NO: 351105 - DNA, 16 bp, M. musculus
acctcttgagtgctgg

SEQ ID NO: 351106 - DNA, 16 bp, M. musculus
acctcttgtgttagag

SEQ ID NO: 351107 - DNA, 16 bp, M. musculus
acctctttttcctcag

SEQ ID NO: 351108 - DNA, 16 bp, M. musculus
acctgaaaaaaatgct

SEQ ID NO: 351109 - DNA, 16 bp, M. musculus
acctgaaaacttcctt

SEQ ID NO: 351110 - DNA, 16 bp, M. musculus
acctgaaaagcaagat

SEQ ID NO: 351111 - DNA, 16 bp, M. musculus
acctgaaaataagcca

SEQ ID NO: 351112 - DNA, 16 bp, M. musculus
acctgaaaatatgaga

SEQ ID NO: 351113 - DNA, 16 bp, M. musculus
acctgaaagaagacag

SEQ ID NO: 351114 - DNA, 16 bp, M. musculus
acctgaaatctcagca

SEQ ID NO: 351115 - DNA, 16 bp, M. musculus
acctgaacaaggatga

SEQ ID NO: 351116 - DNA, 16 bp, M. musculus
acctgaacagaccaat

SEQ ID NO: 351117 - DNA, 16 bp, M. musculus
acctgaagaatatgag

SEQ ID NO: 351118 - DNA, 16 bp, M. musculus
acctgaagacccacct

SEQ ID NO: 351119 - DNA, 16 bp, M. musculus
acctgaagagaccaca

SEQ ID NO: 351120 - DNA, 16 bp, M. musculus
acctgaagagcaagat

SEQ ID NO: 351121 - DNA, 16 bp, M. musculus
acctgaagaggacagg

SEQ ID NO: 351122 - DNA, 16 bp, M. musculus
acctgaagatacagct

SEQ ID NO: 351123 - DNA, 16 bp, M. musculus
acctgaaggaaaaaaa

SEQ ID NO: 351124 - DNA, 16 bp, M. musculus
acctgaaggcccagct

SEQ ID NO: 351125 - DNA, 16 bp, M. musculus
acctgaattcaaaccc

SEQ ID NO: 351126 - DNA, 16 bp, M. musculus
acctgaattcaaatcc

SEQ ID NO: 351127 - DNA, 16 bp, M. musculus
acctgaattcaatccc

SEQ ID NO: 351128 - DNA, 16 bp, M. musculus
acctgaattcagttcc

SEQ ID NO: 351129 - DNA, 16 bp, M. musculus
acctgaattcagtttc

SEQ ID NO: 351130 - DNA, 16 bp, M. musculus
acctgaatttgatccc

SEQ ID NO: 351131 - DNA, 17 bp, M. musculus
acctgacaaaatgttca

SEQ ID NO: 351132 - DNA, 16 bp, M. musculus
acctgaccctcaagag

SEQ ID NO: 351133 - DNA, 16 bp, M. musculus
acctgaccttcagcta

SEQ ID NO: 351134 - DNA, 16 bp, M. musculus
acctgactctgggaac

SEQ ID NO: 351135 - DNA, 16 bp, M. musculus
acctgactggcctcaa

SEQ ID NO: 351136 - DNA, 16 bp, M. musculus
acctgactggccttcc

SEQ ID NO: 351137 - DNA, 16 bp, M. musculus
acctgagaatctctct

SEQ ID NO: 351138 - DNA, 16 bp, M. musculus
acctgagactagacag

SEQ ID NO: 351139 - DNA, 16 bp, M. musculus
acctgagactctgtct

SEQ ID NO: 351140 - DNA, 16 bp, M. musculus
acctgagaggtcagga

SEQ ID NO: 351141 - DNA, 16 bp, M. musculus
acctgaggaacacagt

SEQ ID NO: 351142 - DNA, 16 bp, M. musculus
acctgaggaaccagct

SEQ ID NO: 351143 - DNA, 16 bp, M. musculus
acctgaggaccaagct

SEQ ID NO: 351144 - DNA, 16 bp, M. musculus
acctgaggacccatct

SEQ ID NO: 351145 - DNA, 16 bp, M. musculus
acctgaggactcagca

SEQ ID NO: 351146 - DNA, 16 bp, M. musculus
acctgaggcaggagct

SEQ ID NO: 351147 - DNA, 16 bp, M. musculus
acctgagggcccagct

SEQ ID NO: 351148 - DNA, 16 bp, M. musculus
acctgagtctgattcc

SEQ ID NO: 351149 - DNA, 16 bp, M. musculus
acctgagttcaacccc

SEQ ID NO: 351150 - DNA, 16 bp, M. musculus
acctgagttcaatccc

SEQ ID NO: 351151 - DNA, 16 bp, M. musculus
acctgagttcaattcc

SEQ ID NO: 351152 - DNA, 16 bp, M. musculus
acctgagttcagtttc

SEQ ID NO: 351153 - DNA, 16 bp, M. musculus
acctgagttccaatcc

SEQ ID NO: 351154 - DNA, 16 bp, M. musculus
acctgagttccatccc

SEQ ID NO: 351155 - DNA, 16 bp, M. musculus
acctgagttcgatccc

SEQ ID NO: 351156 - DNA, 16 bp, M. musculus
acctgagtttagtccc

SEQ ID NO: 351157 - DNA, 16 bp, M. musculus
acctgagtttgaaccc

SEQ ID NO: 351158 - DNA, 16 bp, M. musculus
acctgagtttgatccc

SEQ ID NO: 351159 - DNA, 16 bp, M. musculus
acctgagtttgatcct

SEQ ID NO: 351160 - DNA, 16 bp, M. musculus
acctgagtttgatctc

SEQ ID NO: 351161 - DNA, 16 bp, M. musculus
acctgagtttggtccc

SEQ ID NO: 351162 - DNA, 16 bp, M. musculus
acctgagtttggtctc

SEQ ID NO: 351163 - DNA, 16 bp, M. musculus
acctgataaacaactt

SEQ ID NO: 351164 - DNA, 16 bp, M. musculus
acctgatacacagctt

SEQ ID NO: 351165 - DNA, 16 bp, M. musculus
acctgatgaaccatct

SEQ ID NO: 351166 - DNA, 16 bp, M. musculus
acctgatgaattcaaa

SEQ ID NO: 351167 - DNA, 16 bp, M. musculus
acctgatgtggcatgt

SEQ ID NO: 351168 - DNA, 16 bp, M. musculus
acctgatttttaaaaa

SEQ ID NO: 351169 - DNA, 16 bp, M. musculus
acctgatttttttaaa

SEQ ID NO: 351170 - DNA, 16 bp, M. musculus
acctgcaatggaagaa

SEQ ID NO: 351171 - DNA, 16 bp, M. musculus
acctgcaccagactct

SEQ ID NO: 351172 - DNA, 16 bp, M. musculus
acctgcaccccaggtt

SEQ ID NO: 351173 - DNA, 16 bp, M. musculus
acctgcagctttcctg

SEQ ID NO: 351174 - DNA, 16 bp, M. musculus
acctgcagggcatcat

SEQ ID NO: 351175 - DNA, 16 bp, M. musculus
acctgcatatatatat

SEQ ID NO: 351176 - DNA, 16 bp, M. musculus
acctgcatgcacacac

SEQ ID NO: 351177 - DNA, 16 bp, M. musculus
acctgccagtgggaac

SEQ ID NO: 351178 - DNA, 16 bp, M. musculus
acctgcccaggagcta

SEQ ID NO: 351179 - DNA, 16 bp, M. musculus
acctgcccaggggtgg

SEQ ID NO: 351180 - DNA, 16 bp, M. musculus
acctgcccctgcccct

SEQ ID NO: 351181 - DNA, 16 bp, M. musculus
acctgccctggctatg

SEQ ID NO: 351182 - DNA, 16 bp, M. musculus
acctgcccttgctgtc

SEQ ID NO: 351183 - DNA, 16 bp, M. musculus
acctgcctaggaatgg

SEQ ID NO: 351184 - DNA, 16 bp, M. musculus
acctgcctccacctct

SEQ ID NO: 351185 - DNA, 16 bp, M. musculus
acctgcctcctggtag

SEQ ID NO: 351186 - DNA, 16 bp, M. musculus
acctgcctctacctcc

SEQ ID NO: 351187 - DNA, 16 bp, M. musculus
acctgcctctctgcct

SEQ ID NO: 351188 - DNA, 16 bp, M. musculus
acctgcctctgactcc

SEQ ID NO: 351189 - DNA, 16 bp, M. musculus
acctgcctctgccgcc

SEQ ID NO: 351190 - DNA, 17 bp, M. musculus
acctgcctctgcctccg

SEQ ID NO: 351191 - DNA, 17 bp, M. musculus
acctgcctctgcctctg

SEQ ID NO: 351192 - DNA, 16 bp, M. musculus
acctgcctctgccttg

SEQ ID NO: 351193 - DNA, 16 bp, M. musculus
acctgcctctgctggg

SEQ ID NO: 351194 - DNA, 16 bp, M. musculus
acctgcctctgcttcc

SEQ ID NO: 351195 - DNA, 16 bp, M. musculus
acctgcctctgttccc

SEQ ID NO: 351196 - DNA, 16 bp, M. musculus
acctgcctgaggctga

SEQ ID NO: 351197 - DNA, 16 bp, M. musculus
acctgcctgcctcctg

SEQ ID NO: 351198 - DNA, 16 bp, M. musculus
acctgcctgcctctgc

SEQ ID NO: 351199 - DNA, 16 bp, M. musculus
acctgcctgtctccca

SEQ ID NO: 351200 - DNA, 16 bp, M. musculus
acctgcctgtctctgt

SEQ ID NO: 351201 - DNA, 16 bp, M. musculus
acctgccttcctgaga

SEQ ID NO: 351202 - DNA, 16 bp, M. musculus
acctgcctttgcctcc

SEQ ID NO: 351203 - DNA, 16 bp, M. musculus
acctgcgtctgcctcc

SEQ ID NO: 351204 - DNA, 16 bp, M. musculus
acctgctcttttctga

SEQ ID NO: 351205 - DNA, 16 bp, M. musculus
acctgctgagccacct

SEQ ID NO: 351206 - DNA, 16 bp, M. musculus
acctgctgagccatct

SEQ ID NO: 351207 - DNA, 16 bp, M. musculus
acctgctgagctgcct

SEQ ID NO: 351208 - DNA, 16 bp, M. musculus
acctgctgagtcacct

SEQ ID NO: 351209 - DNA, 16 bp, M. musculus
acctgcttcctacctt

SEQ ID NO: 351210 - DNA, 16 bp, M. musculus
acctgcttcctggcag

SEQ ID NO: 351211 - DNA, 16 bp, M. musculus
acctgcttctcacctt

SEQ ID NO: 351212 - DNA, 16 bp, M. musculus
acctgcttctgcctca

SEQ ID NO: 351213 - DNA, 17 bp, M. musculus
acctggaactcacagag

SEQ ID NO: 351214 - DNA, 16 bp, M. musculus
acctggaactcactat

SEQ ID NO: 351215 - DNA, 16 bp, M. musculus
acctggaactggtgtg

SEQ ID NO: 351216 - DNA, 16 bp, M. musculus
acctggaagagaagaa

SEQ ID NO: 351217 - DNA, 16 bp, M. musculus
acctggaaggcagagg

SEQ ID NO: 351218 - DNA, 16 bp, M. musculus
acctggaagtaggagc

SEQ ID NO: 351219 - DNA, 16 bp, M. musculus
acctggacagatcctg

SEQ ID NO: 351220 - DNA, 76 bp, M. musculus
acctggaccagactcccacagggtttcaaaaacagtcccaccctgtttgatgaggcactgcacagagacctagcag

SEQ ID NO: 351221 - DNA, 16 bp, M. musculus
acctggacccccaaga

SEQ ID NO: 351222 - DNA, 16 bp, M. musculus
acctggacccctggga

SEQ ID NO: 351223 - DNA, 16 bp, M. musculus
acctggaccctgagat

SEQ ID NO: 351224 - DNA, 16 bp, M. musculus
acctggacctctggga

SEQ ID NO: 351225 - DNA, 16 bp, M. musculus
acctggacctttggga

SEQ ID NO: 351226 - DNA, 16 bp, M. musculus
acctggagctcactga

SEQ ID NO: 351227 - DNA, 16 bp, M. musculus
acctggaggaaatgga

SEQ ID NO: 351228 - DNA, 16 bp, M. musculus
acctggaggcagaagc

SEQ ID NO: 351229 - DNA, 16 bp, M. musculus
acctggaggcaggaag

SEQ ID NO: 351230 - DNA, 16 bp, M. musculus
acctggaggccagagc

SEQ ID NO: 351231 - DNA, 16 bp, M. musculus
acctggagttctccat

SEQ ID NO: 351232 - DNA, 16 bp, M. musculus
acctggatcttggcat

SEQ ID NO: 351233 - DNA, 16 bp, M. musculus
acctggatgaaaagga

SEQ ID NO: 351234 - DNA, 16 bp, M. musculus
acctggatgaacagag

SEQ ID NO: 351235 - DNA, 16 bp, M. musculus
acctggatgctgccat

SEQ ID NO: 351236 - DNA, 16 bp, M. musculus
acctggatgtaatgga

SEQ ID NO: 351237 - DNA, 16 bp, M. musculus
acctggccaccaggtt

SEQ ID NO: 351238 - DNA, 16 bp, M. musculus
acctggctgtcttgga

SEQ ID NO: 351239 - DNA, 16 bp, M. musculus
acctgggaagaagaaa

SEQ ID NO: 351240 - DNA, 16 bp, M. musculus
acctgggaagctgagg

SEQ ID NO: 351241 - DNA, 18 bp, M. musculus
acctgggacatgtggaac

SEQ ID NO: 351242 - DNA, 16 bp, M. musculus
acctgggagagccatc

SEQ ID NO: 351243 - DNA, 16 bp, M. musculus
acctgggagataagag

SEQ ID NO: 351244 - DNA, 16 bp, M. musculus
acctgggaggagcaca

SEQ ID NO: 351245 - DNA, 50 bp, M. musculus
acctgggaggcacttgcctatgacccccctccgtgggtcaaaccgtttgt

SEQ ID NO: 351246 - DNA, 16 bp, M. musculus
acctgggaggcagaga

SEQ ID NO: 351247 - DNA, 16 bp, M. musculus
acctgggaggctgagg

SEQ ID NO: 351248 - DNA, 16 bp, M. musculus
acctgggcagcatagt

SEQ ID NO: 351249 - DNA, 16 bp, M. musculus
acctgggcatatatcc

SEQ ID NO: 351250 - DNA, 16 bp, M. musculus
acctgggccctctgca

SEQ ID NO: 351251 - DNA, 17 bp, M. musculus
acctgggcctgacctgg

SEQ ID NO: 351252 - DNA, 16 bp, M. musculus
acctgggctggtgaga

SEQ ID NO: 351253 - DNA, 16 bp, M. musculus
acctggggcctctgca

SEQ ID NO: 351254 - DNA, 16 bp, M. musculus
acctggggtccatccc

SEQ ID NO: 351255 - DNA, 16 bp, M. musculus
acctgggtcttttgga

SEQ ID NO: 351256 - DNA, 16 bp, M. musculus
acctgggttcaagtcc

SEQ ID NO: 351257 - DNA, 16 bp, M. musculus
acctgggttctctgga

SEQ ID NO: 351258 - DNA, 17 bp, M. musculus
acctggtaacttcaatg

SEQ ID NO: 351259 - DNA, 16 bp, M. musculus
acctggtctacagagc

SEQ ID NO: 351260 - DNA, 16 bp, M. musculus
acctggtctacatagt

SEQ ID NO: 351261 - DNA, 16 bp, M. musculus
acctggtctcaaaaaa

SEQ ID NO: 351262 - DNA, 16 bp, M. musculus
acctggtgcagaccca

SEQ ID NO: 351263 - DNA, 16 bp, M. musculus
acctggtgcccacaga

SEQ ID NO: 351264 - DNA, 16 bp, M. musculus
acctggtgctggcacc

SEQ ID NO: 351265 - DNA, 16 bp, M. musculus
acctggtggcttacaa

SEQ ID NO: 351266 - DNA, 16 bp, M. musculus
acctggttcctctgga

SEQ ID NO: 351267 - DNA, 16 bp, M. musculus
acctgtaaccacagca

SEQ ID NO: 351268 - DNA, 16 bp, M. musculus
acctgtaaccccagca

SEQ ID NO: 351269 - DNA, 16 bp, M. musculus
acctgtaagcctgccc

SEQ ID NO: 351270 - DNA, 16 bp, M. musculus
acctgtaagtcagccc

SEQ ID NO: 351271 - DNA, 17 bp, M. musculus
acctgtaatcccagcag

SEQ ID NO: 351272 - DNA, 16 bp, M. musculus
acctgtaatcccagct

SEQ ID NO: 351273 - DNA, 16 bp, M. musculus
acctgtaatccccaca

SEQ ID NO: 351274 - DNA, 16 bp, M. musculus
acctgtaatcctagaa

SEQ ID NO: 351275 - DNA, 16 bp, M. musculus
acctgtaggttgtgac

SEQ ID NO: 351276 - DNA, 16 bp, M. musculus
acctgtatattgtaat

SEQ ID NO: 351277 - DNA, 16 bp, M. musculus
acctgtattctcctgt

SEQ ID NO: 351278 - DNA, 16 bp, M. musculus
acctgtcagaattaca

SEQ ID NO: 351279 - DNA, 16 bp, M. musculus
acctgtctctgcctcc

SEQ ID NO: 351280 - DNA, 16 bp, M. musculus
acctgtctgttactgt

SEQ ID NO: 351281 - DNA, 16 bp, M. musculus
acctgtgatcctagca

SEQ ID NO: 351282 - DNA, 16 bp, M. musculus
acctgtgcacatacac

SEQ ID NO: 351283 - DNA, 16 bp, M. musculus
acctgtgcagactggt

SEQ ID NO: 351284 - DNA, 16 bp, M. musculus
acctgtgcagcctgcc

SEQ ID NO: 351285 - DNA, 16 bp, M. musculus
acctgtgcaggccctg

SEQ ID NO: 351286 - DNA, 16 bp, M. musculus
acctgtgctctcaggt

SEQ ID NO: 351287 - DNA, 16 bp, M. musculus
acctgtgctttcctgt

SEQ ID NO: 351288 - DNA, 16 bp, M. musculus
acctgtggagagaatg

SEQ ID NO: 351289 - DNA, 16 bp, M. musculus
acctgtggctccagct

SEQ ID NO: 351290 - DNA, 16 bp, M. musculus
acctgtggctcttggt

SEQ ID NO: 351291 - DNA, 16 bp, M. musculus
acctgtgtccacttta

SEQ ID NO: 351292 - DNA, 16 bp, M. musculus
acctgtgtcctgccag

SEQ ID NO: 351293 - DNA, 16 bp, M. musculus
acctgtgtctgtgtgt

SEQ ID NO: 351294 - DNA, 16 bp, M. musculus
acctgtgtgtctgtgt

SEQ ID NO: 351295 - DNA, 16 bp, M. musculus
acctgtgttctgtatt

SEQ ID NO: 351296 - DNA, 16 bp, M. musculus
acctgtgtttgatccc

SEQ ID NO: 351297 - DNA, 16 bp, M. musculus
acctgtgttttcctat

SEQ ID NO: 351298 - DNA, 16 bp, M. musculus
acctgttgagctgcct

SEQ ID NO: 351299 - DNA, 16 bp, M. musculus
acctgttgttatgact

SEQ ID NO: 351300 - DNA, 16 bp, M. musculus
acctgtttaacagtgt

SEQ ID NO: 351301 - DNA, 16 bp, M. musculus
acctgtttgattgttt

SEQ ID NO: 351302 - DNA, 16 bp, M. musculus
acctgtttgggtgtgt

SEQ ID NO: 351303 - DNA, 16 bp, M. musculus
accttaaactcttgat

SEQ ID NO: 351304 - DNA, 27 bp, M. musculus
accttaaattgacatttgatggaaaaa

SEQ ID NO: 351305 - DNA, 16 bp, M. musculus
accttaattaagaaaa

SEQ ID NO: 351306 - DNA, 16 bp, M. musculus
accttaatttataaat

SEQ ID NO: 351307 - DNA, 16 bp, M. musculus
accttacacctgtcag

SEQ ID NO: 351308 - DNA, 16 bp, M. musculus
accttactcagggtga

SEQ ID NO: 351309 - DNA, 16 bp, M. musculus
accttatccccaggga

SEQ ID NO: 351310 - DNA, 16 bp, M. musculus
accttcaaaaaagacc

SEQ ID NO: 351311 - DNA, 16 bp, M. musculus
accttcaaaagagcag

SEQ ID NO: 351312 - DNA, 16 bp, M. musculus
accttcaaagaacacc

SEQ ID NO: 351313 - DNA, 16 bp, M. musculus
accttcaaagatgacc

SEQ ID NO: 351314 - DNA, 16 bp, M. musculus
accttcacaggaccag

SEQ ID NO: 351315 - DNA, 16 bp, M. musculus
accttcagaagagcaa

SEQ ID NO: 351316 - DNA, 16 bp, M. musculus
accttcagaagagcac

SEQ ID NO: 351317 - DNA, 16 bp, M. musculus
accttcagcagggaga

SEQ ID NO: 351318 - DNA, 16 bp, M. musculus
accttcagcatttgga

SEQ ID NO: 351319 - DNA, 16 bp, M. musculus
accttcagccagcacc

SEQ ID NO: 351320 - DNA, 16 bp, M. musculus
accttcaggacagcct

SEQ ID NO: 351321 - DNA, 16 bp, M. musculus
accttcaggagagcag

SEQ ID NO: 351322 - DNA, 16 bp, M. musculus
accttcagtgacacac

SEQ ID NO: 351323 - DNA, 16 bp, M. musculus
accttcataggacaaa

SEQ ID NO: 351324 - DNA, 16 bp, M. musculus
accttcatcagaaccc

SEQ ID NO: 351325 - DNA, 16 bp, M. musculus
accttcatttaaaaaa

SEQ ID NO: 351326 - DNA, 16 bp, M. musculus
accttccaaatgctgg

SEQ ID NO: 351327 - DNA, 16 bp, M. musculus
accttccaggtcagag

SEQ ID NO: 351328 - DNA, 16 bp, M. musculus
accttccatgggtgtt

SEQ ID NO: 351329 - DNA, 16 bp, M. musculus
accttcccagcactgg

SEQ ID NO: 351330 - DNA, 16 bp, M. musculus
accttccctaaaagag

SEQ ID NO: 351331 - DNA, 16 bp, M. musculus
accttcctaatgctat

SEQ ID NO: 351332 - DNA, 16 bp, M. musculus
accttcctaatgctgc

SEQ ID NO: 351333 - DNA, 16 bp, M. musculus
accttcctcctctgcc

SEQ ID NO: 351334 - DNA, 16 bp, M. musculus
accttcctctgcctcc

SEQ ID NO: 351335 - DNA, 16 bp, M. musculus
accttcctgatgctga

SEQ ID NO: 351336 - DNA, 16 bp, M. musculus
accttcctgatgctgc

SEQ ID NO: 351337 - DNA, 16 bp, M. musculus
accttcgaagaagacc

SEQ ID NO: 351338 - DNA, 16 bp, M. musculus
accttcggaagagcaa

SEQ ID NO: 351339 - DNA, 52 bp, M. musculus
accttcggaagagcagtcgggtgctcttacccactgagccatctcaccagcc

SEQ ID NO: 351340 - DNA, 16 bp, M. musculus
accttcggctccagac

SEQ ID NO: 351341 - DNA, 16 bp, M. musculus
accttctagaatgtac

SEQ ID NO: 351342 - DNA, 20 bp, M. musculus
accttctccaaaattgacca

SEQ ID NO: 351343 - DNA, 17 bp, M. musculus
accttctcgagttcttt

SEQ ID NO: 351344 - DNA, 16 bp, M. musculus
accttctctgccagag

SEQ ID NO: 351345 - DNA, 16 bp, M. musculus
accttctgccatcttt

SEQ ID NO: 351346 - DNA, 16 bp, M. musculus
accttctgggacaggc

SEQ ID NO: 351347 - DNA, 16 bp, M. musculus
accttctgggttttca

SEQ ID NO: 351348 - DNA, 16 bp, M. musculus
accttctgtaactcca

SEQ ID NO: 351349 - DNA, 16 bp, M. musculus
accttctgtaatggga

SEQ ID NO: 351350 - DNA, 16 bp, M. musculus
accttctgtctggaga

SEQ ID NO: 351351 - DNA, 16 bp, M. musculus
accttctgttcctatt

SEQ ID NO: 351352 - DNA, 16 bp, M. musculus
accttctgtttcaatt

SEQ ID NO: 351353 - DNA, 16 bp, M. musculus
accttcttctggcctt

SEQ ID NO: 351354 - DNA, 16 bp, M. musculus
accttcttttccacag

SEQ ID NO: 351355 - DNA, 16 bp, M. musculus
accttgaaaaaatgtt

SEQ ID NO: 351356 - DNA, 16 bp, M. musculus
accttgaaagagaaat

SEQ ID NO: 351357 - DNA, 16 bp, M. musculus
accttgacagcacacc

SEQ ID NO: 351358 - DNA, 16 bp, M. musculus
accttgacttcttcct

SEQ ID NO: 351359 - DNA, 16 bp, M. musculus
accttgatcttggact

SEQ ID NO: 351360 - DNA, 16 bp, M. musculus
accttgcagtttttat

SEQ ID NO: 351361 - DNA, 16 bp, M. musculus
accttgccaacagagt

SEQ ID NO: 351362 - DNA, 16 bp, M. musculus
accttggcatgactct

SEQ ID NO: 351363 - DNA, 16 bp, M. musculus
accttggcattccaat

SEQ ID NO: 351364 - DNA, 20 bp, M. musculus
accttggcctggtctgctgt

SEQ ID NO: 351365 - DNA, 16 bp, M. musculus
accttggctctctctg

SEQ ID NO: 351366 - DNA, 16 bp, M. musculus
accttgggcacagagt

SEQ ID NO: 351367 - DNA, 16 bp, M. musculus
accttgggcctccaca

SEQ ID NO: 351368 - DNA, 17 bp, M. musculus
accttgggcttggaatt

SEQ ID NO: 351369 - DNA, 16 bp, M. musculus
accttgggtgtgaact

SEQ ID NO: 351370 - DNA, 16 bp, M. musculus
accttggtcatggtat

SEQ ID NO: 351371 - DNA, 16 bp, M. musculus
accttggtggaaggaa

SEQ ID NO: 351372 - DNA, 16 bp, M. musculus
accttgtcctgctgag

SEQ ID NO: 351373 - DNA, 16 bp, M. musculus
accttgtctagcctca

SEQ ID NO: 351374 - DNA, 16 bp, M. musculus
accttgtctcaagaaa

SEQ ID NO: 351375 - DNA, 16 bp, M. musculus
accttgtctcagaaaa

SEQ ID NO: 351376 - DNA, 16 bp, M. musculus
accttgtctcagaaga

SEQ ID NO: 351377 - DNA, 16 bp, M. musculus
accttgtcttaaaaac

SEQ ID NO: 351378 - DNA, 16 bp, M. musculus
accttgtcttaaaata

SEQ ID NO: 351379 - DNA, 16 bp, M. musculus
accttgtcttgaaaaa

SEQ ID NO: 351380 - DNA, 16 bp, M. musculus
accttgtggatgctgg

SEQ ID NO: 351381 - DNA, 16 bp, M. musculus
accttgtgggacagag

SEQ ID NO: 351382 - DNA, 16 bp, M. musculus
accttgtttcaaacaa

SEQ ID NO: 351383 - DNA, 16 bp, M. musculus
accttgtttggcctca

SEQ ID NO: 351384 - DNA, 16 bp, M. musculus
acctttaaagagaaaa

SEQ ID NO: 351385 - DNA, 17 bp, M. musculus
acctttaaccccagcat

SEQ ID NO: 351386 - DNA, 16 bp, M. musculus
acctttaattcctctg

SEQ ID NO: 351387 - DNA, 16 bp, M. musculus
acctttaatttcagca

SEQ ID NO: 351388 - DNA, 16 bp, M. musculus
acctttatttatttgt

SEQ ID NO: 351389 - DNA, 19 bp, M. musculus
acctttcacttttccagaa

SEQ ID NO: 351390 - DNA, 16 bp, M. musculus
acctttcctgtaagag

SEQ ID NO: 351391 - DNA, 40 bp, M. musculus
acctttctcagacactgtgttgctttggcagttcccaggt

SEQ ID NO: 351392 - DNA, 16 bp, M. musculus
acctttctggcatatg

SEQ ID NO: 351393 - DNA, 16 bp, M. musculus
acctttgatgactatg

SEQ ID NO: 351394 - DNA, 16 bp, M. musculus
acctttggaaaagcag

SEQ ID NO: 351395 - DNA, 16 bp, M. musculus
acctttggaagagcac

SEQ ID NO: 351396 - DNA, 17 bp, M. musculus
acctttggaagagcagt

SEQ ID NO: 351397 - DNA, 16 bp, M. musculus
acctttggaagagcat

SEQ ID NO: 351398 - DNA, 16 bp, M. musculus
acctttgtatttgtca

SEQ ID NO: 351399 - DNA, 16 bp, M. musculus
acctttgtgtccaagg

SEQ ID NO: 351400 - DNA, 16 bp, M. musculus
acctttgtgtgataca

SEQ ID NO: 351401 - DNA, 16 bp, M. musculus
acctttgttcttagga

SEQ ID NO: 351402 - DNA, 16 bp, M. musculus
accttttccaacaagg

SEQ ID NO: 351403 - DNA, 16 bp, M. musculus
accttttgctgatacc

SEQ ID NO: 351404 - DNA, 16 bp, M. musculus
accttttgggtctgag

SEQ ID NO: 351405 - DNA, 16 bp, M. musculus
acctttttctggcctc

SEQ ID NO: 351406 - DNA, 16 bp, M. musculus
accttttttttaaaaa

SEQ ID NO: 351407 - DNA, 16 bp, M. musculus
acgaattaaaaagggc

SEQ ID NO: 351408 - DNA, 16 bp, M. musculus
acgacgacgacgaaga

SEQ ID NO: 351409 - DNA, 16 bp, M. musculus
acgacgacgacgacga

SEQ ID NO: 351410 - DNA, 16 bp, M. musculus
acgacgacgacgatga

SEQ ID NO: 351411 - DNA, 16 bp, M. musculus
acgacgacgatgacga

SEQ ID NO: 351412 - DNA, 16 bp, M. musculus
acgacgaggaggagga

SEQ ID NO: 351413 - DNA, 17 bp, M. musculus
acgactctgagattcca

SEQ ID NO: 351414 - DNA, 22 bp, M. musculus
acgagaagacctgggacgagaa

SEQ ID NO: 351415 - DNA, 16 bp, M. musculus
acgaggaaactgaaca

SEQ ID NO: 351416 - DNA, 16 bp, M. musculus
acgaggataagagtcc

SEQ ID NO: 351417 - DNA, 16 bp, M. musculus
acgaggccatcctctg

SEQ ID NO: 351418 - DNA, 16 bp, M. musculus
acgatctgtccattga

SEQ ID NO: 351419 - DNA, 16 bp, M. musculus
acgatgacaacaacaa

SEQ ID NO: 351420 - DNA, 16 bp, M. musculus
acgatgacgacgacga

SEQ ID NO: 351421 - DNA, 16 bp, M. musculus
acgatgacgatgacga

SEQ ID NO: 351422 - DNA, 16 bp, M. musculus
acgatgatggtgatga

SEQ ID NO: 351423 - DNA, 16 bp, M. musculus
acgcacgcacgcatgc

SEQ ID NO: 351424 - DNA, 16 bp, M. musculus
acgcacgcgcgcgcgc

SEQ ID NO: 351425 - DNA, 16 bp, M. musculus
acgcagcagcagcagc

SEQ ID NO: 351426 - DNA, 16 bp, M. musculus
acgcaggcagacatgg

SEQ ID NO: 351427 - DNA, 16 bp, M. musculus
acgccaccatgcccag

SEQ ID NO: 351428 - DNA, 16 bp, M. musculus
acgccacttcaccagg

SEQ ID NO: 351429 - DNA, 16 bp, M. musculus
acgccagagattacca

SEQ ID NO: 351430 - DNA, 16 bp, M. musculus
acgcctttcatcccag

SEQ ID NO: 351431 - DNA, 17 bp, M. musculus
acgcctttgatcccagc

SEQ ID NO: 351432 - DNA, 21 bp, M. musculus
acgcgcgcgcacacacacaca

SEQ ID NO: 351433 - DNA, 16 bp, M. musculus
acgcgtgcgcgcacac

SEQ ID NO: 351434 - DNA, 16 bp, M. musculus
acgctgctgctgctgc

SEQ ID NO: 351435 - DNA, 16 bp, M. musculus
acggaaggagctgaag

SEQ ID NO: 351436 - DNA, 18 bp, M. musculus
acggactgaacctctgaa

SEQ ID NO: 351437 - DNA, 17 bp, M. musculus
acggcacacccactgcc

SEQ ID NO: 351438 - DNA, 28 bp, M. musculus
acggcgaatgtgggggcggctcccaaca

SEQ ID NO: 351439 - DNA, 41 bp, M. musculus
acgggaaaggcagaacacatggtgggaaaactgcccctgca

SEQ ID NO: 351440 - DNA, 21 bp, M. musculus
acggggaaggcagagcacatg

SEQ ID NO: 351441 - DNA, 16 bp, M. musculus
acggggctggtgagat

SEQ ID NO: 351442 - DNA, 16 bp, M. musculus
acgggtaaggggcatg

SEQ ID NO: 351443 - DNA, 16 bp, M. musculus
acggttttagctccct

SEQ ID NO: 351444 - DNA, 16 bp, M. musculus
acgtatatgtatatgt

SEQ ID NO: 351445 - DNA, 16 bp, M. musculus
acgtatgtgtgtgtgt

SEQ ID NO: 351446 - DNA, 16 bp, M. musculus
acgtctgttcagtcac

SEQ ID NO: 351447 - DNA, 16 bp, M. musculus
acgtgcacagcagcag

SEQ ID NO: 351448 - DNA, 16 bp, M. musculus
acgtgccaccatgccc

SEQ ID NO: 351449 - DNA, 16 bp, M. musculus
acgtgctcatggctgg

SEQ ID NO: 351450 - DNA, 16 bp, M. musculus
acgtggagaaagagga

SEQ ID NO: 351451 - DNA, 16 bp, M. musculus
acgtggatgttcctgt

SEQ ID NO: 351452 - DNA, 16 bp, M. musculus
acgtggggctgagaaa

SEQ ID NO: 351453 - DNA, 16 bp, M. musculus
acgtgtgcacacacat

SEQ ID NO: 351454 - DNA, 16 bp, M. musculus
acgtgtgtctgtgtgt

SEQ ID NO: 351455 - DNA, 16 bp, M. musculus
acgttgatggatttca

SEQ ID NO: 351456 - DNA, 16 bp, M. musculus
acgtttttgttgagtt

SEQ ID NO: 351457 - DNA, 16 bp, M. musculus
actaaaaagaaggaag

SEQ ID NO: 351458 - DNA, 16 bp, M. musculus
actaaaacaaagacct

SEQ ID NO: 351459 - DNA, 16 bp, M. musculus
actaaaactaatagaa

SEQ ID NO: 351460 - DNA, 16 bp, M. musculus
actaaaactgagactg

SEQ ID NO: 351461 - DNA, 16 bp, M. musculus
actaaaagacacagag

SEQ ID NO: 351462 - DNA, 16 bp, M. musculus
actaaaagacagagag

SEQ ID NO: 351463 - DNA, 16 bp, M. musculus
actaaaaggaaaaatg

SEQ ID NO: 351464 - DNA, 16 bp, M. musculus
actaaaatcagggcct

SEQ ID NO: 351465 - DNA, 16 bp, M. musculus
actaaaatcaggggct

SEQ ID NO: 351466 - DNA, 16 bp, M. musculus
actaaaattcttctcc

SEQ ID NO: 351467 - DNA, 16 bp, M. musculus
actaaacaaagaattt

SEQ ID NO: 351468 - DNA, 16 bp, M. musculus
actaaacagggaccca

SEQ ID NO: 351469 - DNA, 16 bp, M. musculus
actaaaccaccaaaga

SEQ ID NO: 351470 - DNA, 16 bp, M. musculus
actaaagaaagtcaag

SEQ ID NO: 351471 - DNA, 16 bp, M. musculus
actaaagatgtgcacc

SEQ ID NO: 351472 - DNA, 16 bp, M. musculus
actaaagatgtgtgcc

SEQ ID NO: 351473 - DNA, 16 bp, M. musculus
actaaagctcaaaaca

SEQ ID NO: 351474 - DNA, 16 bp, M. musculus
actaaaggaaaggtca

SEQ ID NO: 351475 - DNA, 16 bp, M. musculus
actaaaggaagtcaga

SEQ ID NO: 351476 - DNA, 16 bp, M. musculus
actaaaggaatggcca

SEQ ID NO: 351477 - DNA, 16 bp, M. musculus
actaaagggcccagag

SEQ ID NO: 351478 - DNA, 16 bp, M. musculus
actaaagtctcatgca

SEQ ID NO: 351479 - DNA, 16 bp, M. musculus
actaaagtttcttcaa

SEQ ID NO: 351480 - DNA, 16 bp, M. musculus
actaaataaaattctt

SEQ ID NO: 351481 - DNA, 16 bp, M. musculus
actaaataaagacaga

SEQ ID NO: 351482 - DNA, 16 bp, M. musculus
actaaatctctgaaac

SEQ ID NO: 351483 - DNA, 16 bp, M. musculus
actaaatgatcaaagg

SEQ ID NO: 351484 - DNA, 16 bp, M. musculus
actaaatttaatagaa

SEQ ID NO: 351485 - DNA, 18 bp, M. musculus
actaacagaagttatgaa

SEQ ID NO: 351486 - DNA, 16 bp, M. musculus
actaacagagtggcta

SEQ ID NO: 351487 - DNA, 16 bp, M. musculus
actaacatcagggact

SEQ ID NO: 351488 - DNA, 16 bp, M. musculus
actaaccctgacatca

SEQ ID NO: 351489 - DNA, 16 bp, M. musculus
actaagaaaatgaaag

SEQ ID NO: 351490 - DNA, 16 bp, M. musculus
actaagaagagaaata

SEQ ID NO: 351491 - DNA, 16 bp, M. musculus
actaagaagagaccag

SEQ ID NO: 351492 - DNA, 16 bp, M. musculus
actaagataaacaatt

SEQ ID NO: 351493 - DNA, 16 bp, M. musculus
actaagatcaaaaact

SEQ ID NO: 351494 - DNA, 16 bp, M. musculus
actaagatgaaaaatt

SEQ ID NO: 351495 - DNA, 16 bp, M. musculus
actaagcaagcattct

SEQ ID NO: 351496 - DNA, 16 bp, M. musculus
actaagccaccaagca

SEQ ID NO: 351497 - DNA, 16 bp, M. musculus
actaagctggccttga

SEQ ID NO: 351498 - DNA, 16 bp, M. musculus
actaaggatgttgaac

SEQ ID NO: 351499 - DNA, 16 bp, M. musculus
actaaggttctcagga

SEQ ID NO: 351500 - DNA, 16 bp, M. musculus
actaagtgagaaaatg

SEQ ID NO: 351501 - DNA, 16 bp, M. musculus
actaatattttaatgt

SEQ ID NO: 351502 - DNA, 16 bp, M. musculus
actaatcccacatctg

SEQ ID NO: 351503 - DNA, 16 bp, M. musculus
actaatgactggccca

SEQ ID NO: 351504 - DNA, 16 bp, M. musculus
actaattaagaaaata

SEQ ID NO: 351505 - DNA, 17 bp, M. musculus
actaattaggcattaca

SEQ ID NO: 351506 - DNA, 16 bp, M. musculus
actaattgaagaaaaa

SEQ ID NO: 351507 - DNA, 16 bp, M. musculus
actaattgaaggttga

SEQ ID NO: 351508 - DNA, 16 bp, M. musculus
actacaacaagaacat

SEQ ID NO: 351509 - DNA, 16 bp, M. musculus
actacaactcccagaa

SEQ ID NO: 351510 - DNA, 16 bp, M. musculus
actacaactcccagca

SEQ ID NO: 351511 - DNA, 16 bp, M. musculus
actacaagtctctgaa

SEQ ID NO: 351512 - DNA, 16 bp, M. musculus
actacagaagctaata

SEQ ID NO: 351513 - DNA, 16 bp, M. musculus
actacagatgtttctt

SEQ ID NO: 351514 - DNA, 16 bp, M. musculus
actacagcttccataa

SEQ ID NO: 351515 - DNA, 16 bp, M. musculus
actacaggcagctaag

SEQ ID NO: 351516 - DNA, 16 bp, M. musculus
actacaggtgtgtgcc

SEQ ID NO: 351517 - DNA, 16 bp, M. musculus
actacatctagaatta

SEQ ID NO: 351518 - DNA, 16 bp, M. musculus
actacatgagatcctg

SEQ ID NO: 351519 - DNA, 16 bp, M. musculus
actacatgatcatctc

SEQ ID NO: 351520 - DNA, 16 bp, M. musculus
actacatttcccagaa

SEQ ID NO: 351521 - DNA, 18 bp, M. musculus
actaccaaaactggtttt

SEQ ID NO: 351522 - DNA, 16 bp, M. musculus
actaccacacccagcc

SEQ ID NO: 351523 - DNA, 16 bp, M. musculus
actaccaccactacca

SEQ ID NO: 351524 - DNA, 16 bp, M. musculus
actaccaccatcatca

SEQ ID NO: 351525 - DNA, 16 bp, M. musculus
actaccactaccacca

SEQ ID NO: 351526 - DNA, 16 bp, M. musculus
actaccactgcctggc

SEQ ID NO: 351527 - DNA, 16 bp, M. musculus
actaccagcccccacc

SEQ ID NO: 351528 - DNA, 16 bp, M. musculus
actaccatgtcctgtg

SEQ ID NO: 351529 - DNA, 16 bp, M. musculus
actacccagagctccc

SEQ ID NO: 351530 - DNA, 16 bp, M. musculus
actacctgaggaccca

SEQ ID NO: 351531 - DNA, 16 bp, M. musculus
actacctgcaactcca

SEQ ID NO: 351532 - DNA, 16 bp, M. musculus
actacctggggcctcc

SEQ ID NO: 351533 - DNA, 16 bp, M. musculus
actactaaagcaaaat

SEQ ID NO: 351534 - DNA, 16 bp, M. musculus
actactaccaccacca

SEQ ID NO: 351535 - DNA, 16 bp, M. musculus
actactactggcttct

SEQ ID NO: 351536 - DNA, 16 bp, M. musculus
actactgctgctgctg

SEQ ID NO: 351537 - DNA, 16 bp, M. musculus
actactggtttgctgt

SEQ ID NO: 351538 - DNA, 16 bp, M. musculus
actacttaacaaacca

SEQ ID NO: 351539 - DNA, 16 bp, M. musculus
actacttaagaaaatg

SEQ ID NO: 351540 - DNA, 16 bp, M. musculus
actactttctgcagag

SEQ ID NO: 351541 - DNA, 16 bp, M. musculus
actagaaaataccatc

SEQ ID NO: 351542 - DNA, 16 bp, M. musculus
actagaaagttccaga

SEQ ID NO: 351543 - DNA, 16 bp, M. musculus
actagaagaagtgggg

SEQ ID NO: 351544 - DNA, 16 bp, M. musculus
actagaattaaaggtg

SEQ ID NO: 351545 - DNA, 16 bp, M. musculus
actagacctaggttag

SEQ ID NO: 351546 - DNA, 16 bp, M. musculus
actagagacatgtctg

SEQ ID NO: 351547 - DNA, 16 bp, M. musculus
actagagagatggctc

SEQ ID NO: 351548 - DNA, 16 bp, M. musculus
actagagaggcagagg

SEQ ID NO: 351549 - DNA, 16 bp, M. musculus
actagagaggctgagg

SEQ ID NO: 351550 - DNA, 16 bp, M. musculus
actagagcaggctgag

SEQ ID NO: 351551 - DNA, 16 bp, M. musculus
actagagtcatcagag

SEQ ID NO: 351552 - DNA, 16 bp, M. musculus
actagagttacagatg

SEQ ID NO: 351553 - DNA, 16 bp, M. musculus
actagattcttggacc

SEQ ID NO: 351554 - DNA, 16 bp, M. musculus
actagcagaaaccaag

SEQ ID NO: 351555 - DNA, 22 bp, M. musculus
actagcagcctttggatgaaga

SEQ ID NO: 351556 - DNA, 16 bp, M. musculus
actagcagttaagaaa

SEQ ID NO: 351557 - DNA, 16 bp, M. musculus
actagccagtacacat

SEQ ID NO: 351558 - DNA, 16 bp, M. musculus
actagccagtacatct

SEQ ID NO: 351559 - DNA, 16 bp, M. musculus
actagcctcgaactca

SEQ ID NO: 351560 - DNA, 16 bp, M. musculus
actagcctggctagcc

SEQ ID NO: 351561 - DNA, 16 bp, M. musculus
actagcctgggctatg

SEQ ID NO: 351562 - DNA, 16 bp, M. musculus
actagcctggtctaca

SEQ ID NO: 351563 - DNA, 16 bp, M. musculus
actagctgcctgaagc

SEQ ID NO: 351564 - DNA, 16 bp, M. musculus
actagcttctgtgggg

SEQ ID NO: 351565 - DNA, 16 bp, M. musculus
actaggaaatgtaaat

SEQ ID NO: 351566 - DNA, 16 bp, M. musculus
actaggacagaaagga

SEQ ID NO: 351567 - DNA, 16 bp, M. musculus
actaggcagtcctctg

SEQ ID NO: 351568 - DNA, 16 bp, M. musculus
actaggccatcctctg

SEQ ID NO: 351569 - DNA, 16 bp, M. musculus
actaggccatcttcag

SEQ ID NO: 351570 - DNA, 16 bp, M. musculus
actaggctggcctcag

SEQ ID NO: 351571 - DNA, 16 bp, M. musculus
actaggctggcctgga

SEQ ID NO: 351572 - DNA, 16 bp, M. musculus
actagggggctggaga

SEQ ID NO: 351573 - DNA, 16 bp, M. musculus
actagtttgtgtcaag

SEQ ID NO: 351574 - DNA, 16 bp, M. musculus
actataaaaacttcat

SEQ ID NO: 351575 - DNA, 16 bp, M. musculus
actataaaactatttt

SEQ ID NO: 351576 - DNA, 16 bp, M. musculus
actataaaaggggctg

SEQ ID NO: 351577 - DNA, 16 bp, M. musculus
actataaaattatttc

SEQ ID NO: 351578 - DNA, 16 bp, M. musculus
actataaattctcaaa

SEQ ID NO: 351579 - DNA, 16 bp, M. musculus
actatacagagaaacc

SEQ ID NO: 351580 - DNA, 16 bp, M. musculus
actataccagtaacat

SEQ ID NO: 351581 - DNA, 16 bp, M. musculus
actatactgaaaatgg

SEQ ID NO: 351582 - DNA, 16 bp, M. musculus
actatagagcaataat

SEQ ID NO: 351583 - DNA, 16 bp, M. musculus
actatagatggagaaa

SEQ ID NO: 351584 - DNA, 16 bp, M. musculus
actatattcatagcag

SEQ ID NO: 351585 - DNA, 16 bp, M. musculus
actatattgactagat

SEQ ID NO: 351586 - DNA, 16 bp, M. musculus
actatcaatattggat

SEQ ID NO: 351587 - DNA, 16 bp, M. musculus
actatcattatttttc

SEQ ID NO: 351588 - DNA, 16 bp, M. musculus
actatccagaaacaga

SEQ ID NO: 351589 - DNA, 19 bp, M. musculus
actatcctggaactcactc

SEQ ID NO: 351590 - DNA, 16 bp, M. musculus
actatctcttctatga

SEQ ID NO: 351591 - DNA, 16 bp, M. musculus
actatgaagtgtccct

SEQ ID NO: 351592 - DNA, 16 bp, M. musculus
actatgaccaaggcaa

SEQ ID NO: 351593 - DNA, 16 bp, M. musculus
actatgacctggaagt

SEQ ID NO: 351594 - DNA, 16 bp, M. musculus
actatgcagtccaggc

SEQ ID NO: 351595 - DNA, 16 bp, M. musculus
actatggaggcagagg

SEQ ID NO: 351596 - DNA, 16 bp, M. musculus
actatggctcaagatc

SEQ ID NO: 351597 - DNA, 16 bp, M. musculus
actatgggtggtgcca

SEQ ID NO: 351598 - DNA, 16 bp, M. musculus
actatgtaaccctggc

SEQ ID NO: 351599 - DNA, 16 bp, M. musculus
actatgtacagaggct

SEQ ID NO: 351600 - DNA, 17 bp, M. musculus
actatgtagaccaggct

SEQ ID NO: 351601 - DNA, 16 bp, M. musculus
actatgtagaccaggt

SEQ ID NO: 351602 - DNA, 16 bp, M. musculus
actatgtagactgggc

SEQ ID NO: 351603 - DNA, 20 bp, M. musculus
actatgtagatcaggctggc

SEQ ID NO: 351604 - DNA, 16 bp, M. musculus
actatgtagctgaaga

SEQ ID NO: 351605 - DNA, 16 bp, M. musculus
actatgtcaagttttc

SEQ ID NO: 351606 - DNA, 17 bp, M. musculus
actatgtccaattttca

SEQ ID NO: 351607 - DNA, 16 bp, M. musculus
actatgtgtgtgtgtg

SEQ ID NO: 351608 - DNA, 16 bp, M. musculus
actatgttcatagcca

SEQ ID NO: 351609 - DNA, 16 bp, M. musculus
actatgtttctatatt

SEQ ID NO: 351610 - DNA, 16 bp, M. musculus
actattaacttgcatt

SEQ ID NO: 351611 - DNA, 16 bp, M. musculus
actattaagagatgtg

SEQ ID NO: 351612 - DNA, 16 bp, M. musculus
actattaagctattaa

SEQ ID NO: 351613 - DNA, 16 bp, M. musculus
actattatgaggtgtg

SEQ ID NO: 351614 - DNA, 16 bp, M. musculus
actattattgatgcca

SEQ ID NO: 351615 - DNA, 16 bp, M. musculus
actattgcaaatgcca

SEQ ID NO: 351616 - DNA, 16 bp, M. musculus
actattgctttgctga

SEQ ID NO: 351617 - DNA, 16 bp, M. musculus
actattgtgaatgcca

SEQ ID NO: 351618 - DNA, 16 bp, M. musculus
actatttaaattgttt

SEQ ID NO: 351619 - DNA, 16 bp, M. musculus
actatttccagaagat

SEQ ID NO: 351620 - DNA, 16 bp, M. musculus
actatttgaaaaaaat

SEQ ID NO: 351621 - DNA, 16 bp, M. musculus
actatttggttggtgg

SEQ ID NO: 351622 - DNA, 16 bp, M. musculus
actatttgtaactcca

SEQ ID NO: 351623 - DNA, 16 bp, M. musculus
actattttgtaattta

SEQ ID NO: 351624 - DNA, 16 bp, M. musculus
actatttttttttcag

SEQ ID NO: 351625 - DNA, 16 bp, M. musculus
actcaaacacagatca

SEQ ID NO: 351626 - DNA, 16 bp, M. musculus
actcaaacagggaagg

SEQ ID NO: 351627 - DNA, 16 bp, M. musculus
actcaaagccctagat

SEQ ID NO: 351628 - DNA, 16 bp, M. musculus
actcaaagccctggat

SEQ ID NO: 351629 - DNA, 16 bp, M. musculus
actcaaagctctggat

SEQ ID NO: 351630 - DNA, 16 bp, M. musculus
actcaaagggaggaac

SEQ ID NO: 351631 - DNA, 16 bp, M. musculus
actcaaatgtaaatgt

SEQ ID NO: 351632 - DNA, 16 bp, M. musculus
actcaaattatatgta

SEQ ID NO: 351633 - DNA, 16 bp, M. musculus
actcaacaaaattaga

SEQ ID NO: 351634 - DNA, 16 bp, M. musculus
actcaacaaacctgga

SEQ ID NO: 351635 - DNA, 16 bp, M. musculus
actcaactgagaaaat

SEQ ID NO: 351636 - DNA, 16 bp, M. musculus
actcaagaaaacacaa

SEQ ID NO: 351637 - DNA, 16 bp, M. musculus
actcaagaaagaaaga

SEQ ID NO: 351638 - DNA, 16 bp, M. musculus
actcaagaagaccaaa

SEQ ID NO: 351639 - DNA, 16 bp, M. musculus
actcaagaaggaaaac

SEQ ID NO: 351640 - DNA, 16 bp, M. musculus
actcaagaaggtgtac

SEQ ID NO: 351641 - DNA, 16 bp, M. musculus
actcaagagaaggaga

SEQ ID NO: 351642 - DNA, 16 bp, M. musculus
actcaagagctccggg

SEQ ID NO: 351643 - DNA, 16 bp, M. musculus
actcaagaggcaaaga

SEQ ID NO: 351644 - DNA, 16 bp, M. musculus
actcaagaggctgaag

SEQ ID NO: 351645 - DNA, 16 bp, M. musculus
actcaagagggtagac

SEQ ID NO: 351646 - DNA, 16 bp, M. musculus
actcaagctgtcaggc

SEQ ID NO: 351647 - DNA, 16 bp, M. musculus
actcaaggcagaggca

SEQ ID NO: 351648 - DNA, 16 bp, M. musculus
actcaaggccaaggtt

SEQ ID NO: 351649 - DNA, 16 bp, M. musculus
actcaagtattttcat

SEQ ID NO: 351650 - DNA, 16 bp, M. musculus
actcaatggtaacttg

SEQ ID NO: 351651 - DNA, 16 bp, M. musculus
actcaatgtcaaagct

SEQ ID NO: 351652 - DNA, 16 bp, M. musculus
actcaattcttcagag

SEQ ID NO: 351653 - DNA, 16 bp, M. musculus
actcaattttttaaaa

SEQ ID NO: 351654 - DNA, 16 bp, M. musculus
actcacaacaatcctc

SEQ ID NO: 351655 - DNA, 16 bp, M. musculus
actcacaaccatctgc

SEQ ID NO: 351656 - DNA, 16 bp, M. musculus
actcacacacagaaaa

SEQ ID NO: 351657 - DNA, 16 bp, M. musculus
actcacacatacacat

SEQ ID NO: 351658 - DNA, 16 bp, M. musculus
actcacagaccatgtg

SEQ ID NO: 351659 - DNA, 16 bp, M. musculus
actcacagaggcctct

SEQ ID NO: 351660 - DNA, 16 bp, M. musculus
actcacagatatcctc

SEQ ID NO: 351661 - DNA, 16 bp, M. musculus
actcacagccagccat

SEQ ID NO: 351662 - DNA, 16 bp, M. musculus
actcacaggctgcagc

SEQ ID NO: 351663 - DNA, 16 bp, M. musculus
actcacaggttgagaa

SEQ ID NO: 351664 - DNA, 16 bp, M. musculus
actcacatggaaactg

SEQ ID NO: 351665 - DNA, 16 bp, M. musculus
actcacatggtgaaag

SEQ ID NO: 351666 - DNA, 16 bp, M. musculus
actcacatggtgcaca

SEQ ID NO: 351667 - DNA, 16 bp, M. musculus
actcacccatctccaa

SEQ ID NO: 351668 - DNA, 23 bp, M. musculus
actcaccttcaaggaattgggta

SEQ ID NO: 351669 - DNA, 16 bp, M. musculus
actcactatatagctc

SEQ ID NO: 351670 - DNA, 16 bp, M. musculus
actcactatgtaacca

SEQ ID NO: 351671 - DNA, 16 bp, M. musculus
actcactcacacactc

SEQ ID NO: 351672 - DNA, 16 bp, M. musculus
actcactcctgcttcc

SEQ ID NO: 351673 - DNA, 16 bp, M. musculus
actcactctgtacact

SEQ ID NO: 351674 - DNA, 16 bp, M. musculus
actcactgccccctcc

SEQ ID NO: 351675 - DNA, 21 bp, M. musculus
actcactggtggtcctaagat

SEQ ID NO: 351676 - DNA, 16 bp, M. musculus
actcactgtgtagcca

SEQ ID NO: 351677 - DNA, 16 bp, M. musculus
actcacttcatagacc

SEQ ID NO: 351678 - DNA, 16 bp, M. musculus
actcacttccaggcag

SEQ ID NO: 351679 - DNA, 18 bp, M. musculus
actcactttggaaaaatg

SEQ ID NO: 351680 - DNA, 16 bp, M. musculus
actcagaaaaataaat

SEQ ID NO: 351681 - DNA, 16 bp, M. musculus
actcagaaaatatttt

SEQ ID NO: 351682 - DNA, 16 bp, M. musculus
actcagaaatcctgcc

SEQ ID NO: 351683 - DNA, 16 bp, M. musculus
actcagaaatctgctt

SEQ ID NO: 351684 - DNA, 16 bp, M. musculus
actcagaaatgttcct

SEQ ID NO: 351685 - DNA, 16 bp, M. musculus
actcagaaattcactt

SEQ ID NO: 351686 - DNA, 16 bp, M. musculus
actcagaacctctgca

SEQ ID NO: 351687 - DNA, 16 bp, M. musculus
actcagaactgtgcat

SEQ ID NO: 351688 - DNA, 16 bp, M. musculus
actcagaagagaaggg

SEQ ID NO: 351689 - DNA, 16 bp, M. musculus
actcagaagatagagg

SEQ ID NO: 351690 - DNA, 16 bp, M. musculus
actcagaattccacct

SEQ ID NO: 351691 - DNA, 16 bp, M. musculus
actcagaattgctcct

SEQ ID NO: 351692 - DNA, 16 bp, M. musculus
actcagacaaatacag

SEQ ID NO: 351693 - DNA, 16 bp, M. musculus
actcagacactaggca

SEQ ID NO: 351694 - DNA, 16 bp, M. musculus
actcagacatctgcct

SEQ ID NO: 351695 - DNA, 16 bp, M. musculus
actcagagacctgcct

SEQ ID NO: 351696 - DNA, 16 bp, M. musculus
actcagagacctgtct

SEQ ID NO: 351697 - DNA, 16 bp, M. musculus
actcagagcaagtgtc

SEQ ID NO: 351698 - DNA, 16 bp, M. musculus
actcagaggcagaggg

SEQ ID NO: 351699 - DNA, 16 bp, M. musculus
actcagagtctacaaa

SEQ ID NO: 351700 - DNA, 16 bp, M. musculus
actcagatattaaaaa

SEQ ID NO: 351701 - DNA, 16 bp, M. musculus
actcagcaaagaaaga

SEQ ID NO: 351702 - DNA, 16 bp, M. musculus
actcagcagctttggc

SEQ ID NO: 351703 - DNA, 16 bp, M. musculus
actcagccatcatcag

SEQ ID NO: 351704 - DNA, 16 bp, M. musculus
actcagccattaagaa

SEQ ID NO: 351705 - DNA, 16 bp, M. musculus
actcagcctctgaaac

SEQ ID NO: 351706 - DNA, 16 bp, M. musculus
actcagctattgtcct

SEQ ID NO: 351707 - DNA, 16 bp, M. musculus
actcagctcactttct

SEQ ID NO: 351708 - DNA, 16 bp, M. musculus
actcagctcttaagaa

SEQ ID NO: 351709 - DNA, 16 bp, M. musculus
actcagctggctttct

SEQ ID NO: 351710 - DNA, 16 bp, M. musculus
actcagctgttaagag

SEQ ID NO: 351711 - DNA, 17 bp, M. musculus
actcaggaactctggaa

SEQ ID NO: 351712 - DNA, 16 bp, M. musculus
actcaggaagcagaga

SEQ ID NO: 351713 - DNA, 16 bp, M. musculus
actcaggaagtggagg

SEQ ID NO: 351714 - DNA, 16 bp, M. musculus
actcaggaataccaga

SEQ ID NO: 351715 - DNA, 16 bp, M. musculus
actcaggacctacgga

SEQ ID NO: 351716 - DNA, 16 bp, M. musculus
actcaggacctctgtt

SEQ ID NO: 351717 - DNA, 16 bp, M. musculus
actcaggactggaact

SEQ ID NO: 351718 - DNA, 16 bp, M. musculus
actcaggacttcacac

SEQ ID NO: 351719 - DNA, 16 bp, M. musculus
actcaggacttctggg

SEQ ID NO: 351720 - DNA, 16 bp, M. musculus
actcaggactttcaga

SEQ ID NO: 351721 - DNA, 16 bp, M. musculus
actcaggagacaaaga

SEQ ID NO: 351722 - DNA, 16 bp, M. musculus
actcaggagacagcag

SEQ ID NO: 351723 - DNA, 16 bp, M. musculus
actcaggagacaggca

SEQ ID NO: 351724 - DNA, 16 bp, M. musculus
actcaggagcctgagg

SEQ ID NO: 351725 - DNA, 16 bp, M. musculus
actcaggaggatattt

SEQ ID NO: 351726 - DNA, 16 bp, M. musculus
actcaggaggcaaaga

SEQ ID NO: 351727 - DNA, 16 bp, M. musculus
actcaggaggcagaca

SEQ ID NO: 351728 - DNA, 16 bp, M. musculus
actcaggaggcagcag

SEQ ID NO: 351729 - DNA, 16 bp, M. musculus
actcaggaggcaggtg

SEQ ID NO: 351730 - DNA, 16 bp, M. musculus
actcaggaggctcagg

SEQ ID NO: 351731 - DNA, 16 bp, M. musculus
actcaggaggctgaga

SEQ ID NO: 351732 - DNA, 16 bp, M. musculus
actcaggaggtagaga

SEQ ID NO: 351733 - DNA, 16 bp, M. musculus
actcaggaggtggaga

SEQ ID NO: 351734 - DNA, 16 bp, M. musculus
actcaggatacagagg

SEQ ID NO: 351735 - DNA, 16 bp, M. musculus
actcaggcagaggcag

SEQ ID NO: 351736 - DNA, 16 bp, M. musculus
actcaggccctcaagc

SEQ ID NO: 351737 - DNA, 16 bp, M. musculus
actcaggcccttgtgc

SEQ ID NO: 351738 - DNA, 16 bp, M. musculus
actcaggctggctttg

SEQ ID NO: 351739 - DNA, 16 bp, M. musculus
actcagggatccacct

SEQ ID NO: 351740 - DNA, 16 bp, M. musculus
actcagggcttcacac

SEQ ID NO: 351741 - DNA, 16 bp, M. musculus
actcagggtaatattt

SEQ ID NO: 351742 - DNA, 16 bp, M. musculus
actcaggtcatcaagc

SEQ ID NO: 351743 - DNA, 16 bp, M. musculus
actcaggtctccaggc

SEQ ID NO: 351744 - DNA, 16 bp, M. musculus
actcaggttctctgta

SEQ ID NO: 351745 - DNA, 16 bp, M. musculus
actcagtctctgctcc

SEQ ID NO: 351746 - DNA, 16 bp, M. musculus
actcagtggtagagca

SEQ ID NO: 351747 - DNA, 16 bp, M. musculus
actcagttcctctgca

SEQ ID NO: 351748 - DNA, 16 bp, M. musculus
actcagttggtaaaat

SEQ ID NO: 351749 - DNA, 16 bp, M. musculus
actcataaaagataaa

SEQ ID NO: 351750 - DNA, 16 bp, M. musculus
actcatacacataaaa

SEQ ID NO: 351751 - DNA, 16 bp, M. musculus
actcatacacttaaaa

SEQ ID NO: 351752 - DNA, 16 bp, M. musculus
actcataccctatccc

SEQ ID NO: 351753 - DNA, 16 bp, M. musculus
actcatagatctgcct

SEQ ID NO: 351754 - DNA, 16 bp, M. musculus
actcatatctctagct

SEQ ID NO: 351755 - DNA, 16 bp, M. musculus
actcatcatcttcctg

SEQ ID NO: 351756 - DNA, 16 bp, M. musculus
actcatctcagaggaa

SEQ ID NO: 351757 - DNA, 16 bp, M. musculus
actcatctctctgtcc

SEQ ID NO: 351758 - DNA, 16 bp, M. musculus
actcatgaagaaggaa

SEQ ID NO: 351759 - DNA, 17 bp, M. musculus
actcatgatgatatttt

SEQ ID NO: 351760 - DNA, 16 bp, M. musculus
actcatgcacacacat

SEQ ID NO: 351761 - DNA, 16 bp, M. musculus
actcatggagatcctc

SEQ ID NO: 351762 - DNA, 16 bp, M. musculus
actcatgtgtgtgtgt

SEQ ID NO: 351763 - DNA, 16 bp, M. musculus
actcattaaagaaact

SEQ ID NO: 351764 - DNA, 16 bp, M. musculus
actcattaaaggaaaa

SEQ ID NO: 351765 - DNA, 16 bp, M. musculus
actcattgtgtgtgtg

SEQ ID NO: 351766 - DNA, 16 bp, M. musculus
actcatttattaaaaa

SEQ ID NO: 351767 - DNA, 16 bp, M. musculus
actcattttgggaaag

SEQ ID NO: 351768 - DNA, 16 bp, M. musculus
actccaaaaaggccac

SEQ ID NO: 351769 - DNA, 16 bp, M. musculus
actccaaagtttttgc

SEQ ID NO: 351770 - DNA, 16 bp, M. musculus
actccaaccaggtcac

SEQ ID NO: 351771 - DNA, 16 bp, M. musculus
actccaacccaaggag

SEQ ID NO: 351772 - DNA, 16 bp, M. musculus
actccaactccaggga

SEQ ID NO: 351773 - DNA, 16 bp, M. musculus
actccaagatgatttg

SEQ ID NO: 351774 - DNA, 16 bp, M. musculus
actccaatcccagggg

SEQ ID NO: 351775 - DNA, 16 bp, M. musculus
actccaattccagggt

SEQ ID NO: 351776 - DNA, 16 bp, M. musculus
actccacagatacttg

SEQ ID NO: 351777 - DNA, 17 bp, M. musculus
actccactatgttcata

SEQ ID NO: 351778 - DNA, 17 bp, M. musculus
actccactgctgctgct

SEQ ID NO: 351779 - DNA, 16 bp, M. musculus
actccactggcaaggt

SEQ ID NO: 351780 - DNA, 16 bp, M. musculus
actccagaaaaacaaa

SEQ ID NO: 351781 - DNA, 16 bp, M. musculus
actccagaaattcaaa

SEQ ID NO: 351782 - DNA, 16 bp, M. musculus
actccagaagaaggag

SEQ ID NO: 351783 - DNA, 16 bp, M. musculus
actccagaagcagagg

SEQ ID NO: 351784 - DNA, 16 bp, M. musculus
actccagaagctgagg

SEQ ID NO: 351785 - DNA, 16 bp, M. musculus
actccagagatccaaa

SEQ ID NO: 351786 - DNA, 16 bp, M. musculus
actccagaggagggca

SEQ ID NO: 351787 - DNA, 16 bp, M. musculus
actccagaggcagtat

SEQ ID NO: 351788 - DNA, 16 bp, M. musculus
actccagcaccagatt

SEQ ID NO: 351789 - DNA, 16 bp, M. musculus
actccagcactctgga

SEQ ID NO: 351790 - DNA, 16 bp, M. musculus
actccagcacttggga

SEQ ID NO: 351791 - DNA, 16 bp, M. musculus
actccagccagtgctg

SEQ ID NO: 351792 - DNA, 16 bp, M. musculus
actccagctacatatg

SEQ ID NO: 351793 - DNA, 16 bp, M. musculus
actccagctccaggag

SEQ ID NO: 351794 - DNA, 16 bp, M. musculus
actccagctccaggga

SEQ ID NO: 351795 - DNA, 16 bp, M. musculus
actccagctccagggg

SEQ ID NO: 351796 - DNA, 16 bp, M. musculus
actccagctctgggga

SEQ ID NO: 351797 - DNA, 16 bp, M. musculus
actccagctggtgtca

SEQ ID NO: 351798 - DNA, 16 bp, M. musculus
actccagcttcaggaa

SEQ ID NO: 351799 - DNA, 16 bp, M. musculus
actccagcttcctggc

SEQ ID NO: 351800 - DNA, 16 bp, M. musculus
actccagcttcctggt

SEQ ID NO: 351801 - DNA, 16 bp, M. musculus
actccagcttttttct

SEQ ID NO: 351802 - DNA, 16 bp, M. musculus
actccaggacagccag

SEQ ID NO: 351803 - DNA, 16 bp, M. musculus
actccaggctgtgtca

SEQ ID NO: 351804 - DNA, 16 bp, M. musculus
actccaggtccaggga

SEQ ID NO: 351805 - DNA, 16 bp, M. musculus
actccagtcccaggag

SEQ ID NO: 351806 - DNA, 16 bp, M. musculus
actccagtcccaggga

SEQ ID NO: 351807 - DNA, 16 bp, M. musculus
actccagttccaaggg

SEQ ID NO: 351808 - DNA, 16 bp, M. musculus
actccagttccaagtg

SEQ ID NO: 351809 - DNA, 16 bp, M. musculus
actccagttccagaga

SEQ ID NO: 351810 - DNA, 16 bp, M. musculus
actccagttccagagg

SEQ ID NO: 351811 - DNA, 16 bp, M. musculus
actccagttccaggaa

SEQ ID NO: 351812 - DNA, 16 bp, M. musculus
actccagttctaggag

SEQ ID NO: 351813 - DNA, 16 bp, M. musculus
actccagttctgagga

SEQ ID NO: 351814 - DNA, 16 bp, M. musculus
actccagtttcaggaa

SEQ ID NO: 351815 - DNA, 16 bp, M. musculus
actccatacacacaca

SEQ ID NO: 351816 - DNA, 16 bp, M. musculus
actccatagagagaaa

SEQ ID NO: 351817 - DNA, 16 bp, M. musculus
actccatagcccaggc

SEQ ID NO: 351818 - DNA, 16 bp, M. musculus
actccatctcaaaaca

SEQ ID NO: 351819 - DNA, 16 bp, M. musculus
actccatctctgtaac

SEQ ID NO: 351820 - DNA, 16 bp, M. musculus
actccatgcccaaggt

SEQ ID NO: 351821 - DNA, 16 bp, M. musculus
actccattggagaaaa

SEQ ID NO: 351822 - DNA, 16 bp, M. musculus
actccatttccagggg

SEQ ID NO: 351823 - DNA, 16 bp, M. musculus
actccattttgtaaat

SEQ ID NO: 351824 - DNA, 16 bp, M. musculus
actccatttttaaata

SEQ ID NO: 351825 - DNA, 16 bp, M. musculus
actcccaaacacttca

SEQ ID NO: 351826 - DNA, 16 bp, M. musculus
actcccacaagttctg

SEQ ID NO: 351827 - DNA, 16 bp, M. musculus
actcccacagcctcct

SEQ ID NO: 351828 - DNA, 24 bp, M. musculus
actcccacaggctatgtcctgggg

SEQ ID NO: 351829 - DNA, 16 bp, M. musculus
actcccacccattcct

SEQ ID NO: 351830 - DNA, 16 bp, M. musculus
actcccaccccaccag

SEQ ID NO: 351831 - DNA, 16 bp, M. musculus
actcccacctcagaca

SEQ ID NO: 351832 - DNA, 16 bp, M. musculus
actcccacctcagcca

SEQ ID NO: 351833 - DNA, 22 bp, M. musculus
actcccacttcttggccctggt

SEQ ID NO: 351834 - DNA, 20 bp, M. musculus
actcccacttcttggctctg

SEQ ID NO: 351835 - DNA, 16 bp, M. musculus
actcccagaagctctg

SEQ ID NO: 351836 - DNA, 16 bp, M. musculus
actcccaggagcttgg

SEQ ID NO: 351837 - DNA, 16 bp, M. musculus
actcccatgccaccta

SEQ ID NO: 351838 - DNA, 16 bp, M. musculus
actcccctggcctcaa

SEQ ID NO: 351839 - DNA, 16 bp, M. musculus
actccccttcccagac

SEQ ID NO: 351840 - DNA, 16 bp, M. musculus
actccctcagtctctg

SEQ ID NO: 351841 - DNA, 16 bp, M. musculus
actccctggcctccat

SEQ ID NO: 351842 - DNA, 17 bp, M. musculus
actccctgggacaagca

SEQ ID NO: 351843 - DNA, 16 bp, M. musculus
actccctggggcctcc

SEQ ID NO: 351844 - DNA, 16 bp, M. musculus
actccctgtggcctcc

SEQ ID NO: 351845 - DNA, 16 bp, M. musculus
actcccttctcaactc

SEQ ID NO: 351846 - DNA, 16 bp, M. musculus
actcctaaatctgata

SEQ ID NO: 351847 - DNA, 20 bp, M. musculus
actcctacttcttggccctg

SEQ ID NO: 351848 - DNA, 16 bp, M. musculus
actcctataatcccag

SEQ ID NO: 351849 - DNA, 16 bp, M. musculus
actcctattatctgta

SEQ ID NO: 351850 - DNA, 16 bp, M. musculus
actcctcatgccttgt

SEQ ID NO: 351851 - DNA, 16 bp, M. musculus
actcctccaagatcct

SEQ ID NO: 351852 - DNA, 16 bp, M. musculus
actcctccacagcctc

SEQ ID NO: 351853 - DNA, 16 bp, M. musculus
actcctccattgggaa

SEQ ID NO: 351854 - DNA, 16 bp, M. musculus
actcctcctaatcctt

SEQ ID NO: 351855 - DNA, 16 bp, M. musculus
actcctcctcagcttc

SEQ ID NO: 351856 - DNA, 16 bp, M. musculus
actcctcctgcctcag

SEQ ID NO: 351857 - DNA, 16 bp, M. musculus
actcctgaaagttgtc

SEQ ID NO: 351858 - DNA, 16 bp, M. musculus
actcctgagcctcctg

SEQ ID NO: 351859 - DNA, 16 bp, M. musculus
actcctgatctcttcc

SEQ ID NO: 351860 - DNA, 16 bp, M. musculus
actcctgattccctgt

SEQ ID NO: 351861 - DNA, 16 bp, M. musculus
actcctgattcttctg

SEQ ID NO: 351862 - DNA, 16 bp, M. musculus
actcctgcattgctgg

SEQ ID NO: 351863 - DNA, 16 bp, M. musculus
actcctgcccctgcct

SEQ ID NO: 351864 - DNA, 16 bp, M. musculus
actcctgcctccaggt

SEQ ID NO: 351865 - DNA, 16 bp, M. musculus
actcctgccttgatga

SEQ ID NO: 351866 - DNA, 16 bp, M. musculus
actcctgctcctcctg

SEQ ID NO: 351867 - DNA, 16 bp, M. musculus
actcctgcttcctgga

SEQ ID NO: 351868 - DNA, 16 bp, M. musculus
actcctgggagaccaa

SEQ ID NO: 351869 - DNA, 16 bp, M. musculus
actcctgggagcttcc

SEQ ID NO: 351870 - DNA, 16 bp, M. musculus
actcctgtctctagct

SEQ ID NO: 351871 - DNA, 16 bp, M. musculus
actccttaaattattc

SEQ ID NO: 351872 - DNA, 33 bp, M. musculus
actccttaagactgataatggaccagcttatac

SEQ ID NO: 351873 - DNA, 16 bp, M. musculus
actccttcaactcctt

SEQ ID NO: 351874 - DNA, 16 bp, M. musculus
actccttcctttcatt

SEQ ID NO: 351875 - DNA, 16 bp, M. musculus
actccttctccctgtt

SEQ ID NO: 351876 - DNA, 16 bp, M. musculus
actccttgattggtgg

SEQ ID NO: 351877 - DNA, 16 bp, M. musculus
actcgcaaacacttca

SEQ ID NO: 351878 - DNA, 16 bp, M. musculus
actcgccagcaagaac

SEQ ID NO: 351879 - DNA, 16 bp, M. musculus
actcgctccttggttt

SEQ ID NO: 351880 - DNA, 16 bp, M. musculus
actcggagatctgcct

SEQ ID NO: 351881 - DNA, 16 bp, M. musculus
actcgggaggcagatg

SEQ ID NO: 351882 - DNA, 16 bp, M. musculus
actctaagccagcccc

SEQ ID NO: 351883 - DNA, 16 bp, M. musculus
actctaaggaaacact

SEQ ID NO: 351884 - DNA, 16 bp, M. musculus
actctaaggcattttc

SEQ ID NO: 351885 - DNA, 16 bp, M. musculus
actctaatatagtccc

SEQ ID NO: 351886 - DNA, 16 bp, M. musculus
actctacaaactgagc

SEQ ID NO: 351887 - DNA, 16 bp, M. musculus
actctaccaactgaac

SEQ ID NO: 351888 - DNA, 16 bp, M. musculus
actctaccaactgagc

SEQ ID NO: 351889 - DNA, 16 bp, M. musculus
actctaccacctgagc

SEQ ID NO: 351890 - DNA, 16 bp, M. musculus
actctaccagagaact

SEQ ID NO: 351891 - DNA, 16 bp, M. musculus
actctaccagcagctg

SEQ ID NO: 351892 - DNA, 16 bp, M. musculus
actctacccaactcat

SEQ ID NO: 351893 - DNA, 16 bp, M. musculus
actctactgctgagct

SEQ ID NO: 351894 - DNA, 16 bp, M. musculus
actctagaaaaatcaa

SEQ ID NO: 351895 - DNA, 16 bp, M. musculus
actctagaaagtccca

SEQ ID NO: 351896 - DNA, 16 bp, M. musculus
actctagcttgtgtcc

SEQ ID NO: 351897 - DNA, 17 bp, M. musculus
actctagcttgtttctt

SEQ ID NO: 351898 - DNA, 16 bp, M. musculus
actctcaaccactgag

SEQ ID NO: 351899 - DNA, 16 bp, M. musculus
actctcaagtgctggg

SEQ ID NO: 351900 - DNA, 17 bp, M. musculus
actctcaatcactatag

SEQ ID NO: 351901 - DNA, 16 bp, M. musculus
actctcacacactcat

SEQ ID NO: 351902 - DNA, 16 bp, M. musculus
actctcaccagcaatg

SEQ ID NO: 351903 - DNA, 16 bp, M. musculus
actctcacctgtacag

SEQ ID NO: 351904 - DNA, 17 bp, M. musculus
actctcacctgtgcaga

SEQ ID NO: 351905 - DNA, 16 bp, M. musculus
actctcagaagagact

SEQ ID NO: 351906 - DNA, 16 bp, M. musculus
actctcagcccctcca

SEQ ID NO: 351907 - DNA, 16 bp, M. musculus
actctcagctccagct

SEQ ID NO: 351908 - DNA, 16 bp, M. musculus
actctcagcttcctct

SEQ ID NO: 351909 - DNA, 16 bp, M. musculus
actctcagcttctcca

SEQ ID NO: 351910 - DNA, 16 bp, M. musculus
actctcagggtcattt

SEQ ID NO: 351911 - DNA, 16 bp, M. musculus
actctccacaccacag

SEQ ID NO: 351912 - DNA, 16 bp, M. musculus
actctcccttccccag

SEQ ID NO: 351913 - DNA, 16 bp, M. musculus
actctcctctccacca

SEQ ID NO: 351914 - DNA, 16 bp, M. musculus
actctcctctgtcagg

SEQ ID NO: 351915 - DNA, 16 bp, M. musculus
actctcctgcctcagc

SEQ ID NO: 351916 - DNA, 16 bp, M. musculus
actctcctgcctctgc

SEQ ID NO: 351917 - DNA, 16 bp, M. musculus
actctctagcctttct

SEQ ID NO: 351918 - DNA, 16 bp, M. musculus
actctctattcaatga

SEQ ID NO: 351919 - DNA, 16 bp, M. musculus
actctctcacacacac

SEQ ID NO: 351920 - DNA, 16 bp, M. musculus
actctctcagagaaga

SEQ ID NO: 351921 - DNA, 16 bp, M. musculus
actctctcctgcttct

SEQ ID NO: 351922 - DNA, 16 bp, M. musculus
actctctctctcactc

SEQ ID NO: 351923 - DNA, 16 bp, M. musculus
actctctctgtgtctc

SEQ ID NO: 351924 - DNA, 16 bp, M. musculus
actctctcttatttta

SEQ ID NO: 351925 - DNA, 16 bp, M. musculus
actctctcttccatct

SEQ ID NO: 351926 - DNA, 16 bp, M. musculus
actctctgaaggatgt

SEQ ID NO: 351927 - DNA, 16 bp, M. musculus
actctctgcagggaag

SEQ ID NO: 351928 - DNA, 16 bp, M. musculus
actctctgcatattgt

SEQ ID NO: 351929 - DNA, 16 bp, M. musculus
actctcttactctctt

SEQ ID NO: 351930 - DNA, 16 bp, M. musculus
actctcttatagaacc

SEQ ID NO: 351931 - DNA, 16 bp, M. musculus
actctcttcaggcaag

SEQ ID NO: 351932 - DNA, 16 bp, M. musculus
actctcttcccagtga

SEQ ID NO: 351933 - DNA, 16 bp, M. musculus
actctcttctgtacct

SEQ ID NO: 351934 - DNA, 16 bp, M. musculus
actctgactggccagg

SEQ ID NO: 351935 - DNA, 16 bp, M. musculus
actctgatatgcttgc

SEQ ID NO: 351936 - DNA, 16 bp, M. musculus
actctgcattctcctt

SEQ ID NO: 351937 - DNA, 16 bp, M. musculus
actctgccactgagct

SEQ ID NO: 351938 - DNA, 16 bp, M. musculus
actctgccagtgcctg

SEQ ID NO: 351939 - DNA, 16 bp, M. musculus
actctgccatgcttcc

SEQ ID NO: 351940 - DNA, 16 bp, M. musculus
actctgcctaccggag

SEQ ID NO: 351941 - DNA, 16 bp, M. musculus
actctgcctcaaaaaa

SEQ ID NO: 351942 - DNA, 16 bp, M. musculus
actctgcctcagaaaa

SEQ ID NO: 351943 - DNA, 16 bp, M. musculus
actctgcctgtctctg

SEQ ID NO: 351944 - DNA, 16 bp, M. musculus
actctgctgctgctgc

SEQ ID NO: 351945 - DNA, 16 bp, M. musculus
actctggagacagaaa

SEQ ID NO: 351946 - DNA, 16 bp, M. musculus
actctggcagttcctc

SEQ ID NO: 351947 - DNA, 16 bp, M. musculus
actctggccaaggaca

SEQ ID NO: 351948 - DNA, 16 bp, M. musculus
actctggctgtcttgg

SEQ ID NO: 351949 - DNA, 16 bp, M. musculus
actctggcttgtgtca

SEQ ID NO: 351950 - DNA, 16 bp, M. musculus
actctgggggtactgg

SEQ ID NO: 351951 - DNA, 16 bp, M. musculus
actctggtgagcctta

SEQ ID NO: 351952 - DNA, 16 bp, M. musculus
actctggttttgagat

SEQ ID NO: 351953 - DNA, 16 bp, M. musculus
actctgtagccctggc

SEQ ID NO: 351954 - DNA, 16 bp, M. musculus
actctgtctcaaaata

SEQ ID NO: 351955 - DNA, 16 bp, M. musculus
actctgtctcaaataa

SEQ ID NO: 351956 - DNA, 16 bp, M. musculus
actctgtctcagaaga

SEQ ID NO: 351957 - DNA, 16 bp, M. musculus
actctgtctccaaaac

SEQ ID NO: 351958 - DNA, 16 bp, M. musculus
actctgtctctgtagc

SEQ ID NO: 351959 - DNA, 16 bp, M. musculus
actctgtctttaaaaa

SEQ ID NO: 351960 - DNA, 16 bp, M. musculus
actctgtgcccaaggt

SEQ ID NO: 351961 - DNA, 16 bp, M. musculus
actctgttgcctacct

SEQ ID NO: 351962 - DNA, 16 bp, M. musculus
actctgttggtctttt

SEQ ID NO: 351963 - DNA, 16 bp, M. musculus
actctgttggttttcc

SEQ ID NO: 351964 - DNA, 16 bp, M. musculus
actcttaaaaaggaaa

SEQ ID NO: 351965 - DNA, 16 bp, M. musculus
actcttaacagctgag

SEQ ID NO: 351966 - DNA, 16 bp, M. musculus
actcttaaccgctgag

SEQ ID NO: 351967 - DNA, 16 bp, M. musculus
actcttaactgctgag

SEQ ID NO: 351968 - DNA, 16 bp, M. musculus
actcttacccgcgttc

SEQ ID NO: 351969 - DNA, 16 bp, M. musculus
actcttatgaggacaa

SEQ ID NO: 351970 - DNA, 16 bp, M. musculus
actcttcagacaagga

SEQ ID NO: 351971 - DNA, 16 bp, M. musculus
actcttcagccccagc

SEQ ID NO: 351972 - DNA, 16 bp, M. musculus
actcttctaaggacaa

SEQ ID NO: 351973 - DNA, 16 bp, M. musculus
actcttctgcctcagc

SEQ ID NO: 351974 - DNA, 16 bp, M. musculus
actcttctggcttcca

SEQ ID NO: 351975 - DNA, 16 bp, M. musculus
actcttgaaagttgtc

SEQ ID NO: 351976 - DNA, 16 bp, M. musculus
actcttgatcctcttg

SEQ ID NO: 351977 - DNA, 16 bp, M. musculus
actcttgcctgcatgg

SEQ ID NO: 351978 - DNA, 16 bp, M. musculus
actcttgcttccctct

SEQ ID NO: 351979 - DNA, 16 bp, M. musculus
actcttgcttcctggc

SEQ ID NO: 351980 - DNA, 16 bp, M. musculus
actcttggaagatttt

SEQ ID NO: 351981 - DNA, 16 bp, M. musculus
actcttgggggcaggg

SEQ ID NO: 351982 - DNA, 16 bp, M. musculus
actcttgtctgcaagc

SEQ ID NO: 351983 - DNA, 16 bp, M. musculus
actctttactgctgag

SEQ ID NO: 351984 - DNA, 16 bp, M. musculus
actctttcagcttctt

SEQ ID NO: 351985 - DNA, 16 bp, M. musculus
actctttcataggggt

SEQ ID NO: 351986 - DNA, 16 bp, M. musculus
actctttctgcctcct

SEQ ID NO: 351987 - DNA, 16 bp, M. musculus
actctttcttctataa

SEQ ID NO: 351988 - DNA, 16 bp, M. musculus
actctttgcatttaca

SEQ ID NO: 351989 - DNA, 16 bp, M. musculus
actcttttgcttcttc

SEQ ID NO: 351990 - DNA, 16 bp, M. musculus
actgaaaaaccttcag

SEQ ID NO: 351991 - DNA, 16 bp, M. musculus
actgaaaaagcatttg

SEQ ID NO: 351992 - DNA, 16 bp, M. musculus
actgaaaacaacaaca

SEQ ID NO: 351993 - DNA, 16 bp, M. musculus
actgaaaacacacaca

SEQ ID NO: 351994 - DNA, 16 bp, M. musculus
actgaaaagaggaaat

SEQ ID NO: 351995 - DNA, 16 bp, M. musculus
actgaaaagcaagatt

SEQ ID NO: 351996 - DNA, 16 bp, M. musculus
actgaaaagcttctgt

SEQ ID NO: 351997 - DNA, 16 bp, M. musculus
actgaaaataccccaa

SEQ ID NO: 351998 - DNA, 16 bp, M. musculus
actgaaaatggagaca

SEQ ID NO: 351999 - DNA, 16 bp, M. musculus
actgaaacagaagcag

SEQ ID NO: 352000 - DNA, 16 bp, M. musculus
actgaaacaggaggat

SEQ ID NO: 352001 - DNA, 16 bp, M. musculus
actgaaactcagagga

SEQ ID NO: 352002 - DNA, 16 bp, M. musculus
actgaaactcaggaga

SEQ ID NO: 352003 - DNA, 16 bp, M. musculus
actgaaactgtcatgg

SEQ ID NO: 352004 - DNA, 16 bp, M. musculus
actgaaagaaatcagg

SEQ ID NO: 352005 - DNA, 16 bp, M. musculus
actgaaaggaagaaaa

SEQ ID NO: 352006 - DNA, 16 bp, M. musculus
actgaaattacaggtg

SEQ ID NO: 352007 - DNA, 16 bp, M. musculus
actgaaattcagagga

SEQ ID NO: 352008 - DNA, 16 bp, M. musculus
actgaaattgtcccat

SEQ ID NO: 352009 - DNA, 16 bp, M. musculus
actgaaattttaagct

SEQ ID NO: 352010 - DNA, 16 bp, M. musculus
actgaaatttttaaaa

SEQ ID NO: 352011 - DNA, 16 bp, M. musculus
actgaacatgacatgg

SEQ ID NO: 352012 - DNA, 16 bp, M. musculus
actgaaccatctctca

SEQ ID NO: 352013 - DNA, 23 bp, M. musculus
actgaaccattgttgggaattgg

SEQ ID NO: 352014 - DNA, 16 bp, M. musculus
actgaacccaggccct

SEQ ID NO: 352015 - DNA, 16 bp, M. musculus
actgaacctggaactc

SEQ ID NO: 352016 - DNA, 16 bp, M. musculus
actgaactacacccca

SEQ ID NO: 352017 - DNA, 16 bp, M. musculus
actgaactcttcctca

SEQ ID NO: 352018 - DNA, 16 bp, M. musculus
actgaacttctgatcc

SEQ ID NO: 352019 - DNA, 16 bp, M. musculus
actgaacttgatagaa

SEQ ID NO: 352020 - DNA, 16 bp, M. musculus
actgaagaaaatgcca

SEQ ID NO: 352021 - DNA, 16 bp, M. musculus
actgaagaaatgatca

SEQ ID NO: 352022 - DNA, 16 bp, M. musculus
actgaagaaatggcca

SEQ ID NO: 352023 - DNA, 16 bp, M. musculus
actgaagaagacctca

SEQ ID NO: 352024 - DNA, 16 bp, M. musculus
actgaagaagaggagg

SEQ ID NO: 352025 - DNA, 16 bp, M. musculus
actgaagaatggacaa

SEQ ID NO: 352026 - DNA, 20 bp, M. musculus
actgaagacagctacagtgt

SEQ ID NO: 352027 - DNA, 16 bp, M. musculus
actgaagacctagaaa

SEQ ID NO: 352028 - DNA, 16 bp, M. musculus
actgaagactcagaaa

SEQ ID NO: 352029 - DNA, 16 bp, M. musculus
actgaagagctgagaa

SEQ ID NO: 352030 - DNA, 16 bp, M. musculus
actgaagagggaagac

SEQ ID NO: 352031 - DNA, 16 bp, M. musculus
actgaagcagaaatca

SEQ ID NO: 352032 - DNA, 16 bp, M. musculus
actgaagcagaggcca

SEQ ID NO: 352033 - DNA, 16 bp, M. musculus
actgaagcagaggccc

SEQ ID NO: 352034 - DNA, 16 bp, M. musculus
actgaagcagataaag

SEQ ID NO: 352035 - DNA, 16 bp, M. musculus
actgaagcagctgaag

SEQ ID NO: 352036 - DNA, 17 bp, M. musculus
actgaagcaggaggatt

SEQ ID NO: 352037 - DNA, 16 bp, M. musculus
actgaagcatgcacac

SEQ ID NO: 352038 - DNA, 16 bp, M. musculus
actgaagccagaaaag

SEQ ID NO: 352039 - DNA, 16 bp, M. musculus
actgaagctgctttct

SEQ ID NO: 352040 - DNA, 16 bp, M. musculus
actgaagctggagctc

SEQ ID NO: 352041 - DNA, 16 bp, M. musculus
actgaagctgtttatc

SEQ ID NO: 352042 - DNA, 16 bp, M. musculus
actgaaggaaaagcca

SEQ ID NO: 352043 - DNA, 16 bp, M. musculus
actgaaggaaagacaa

SEQ ID NO: 352044 - DNA, 16 bp, M. musculus
actgaaggaagccagg

SEQ ID NO: 352045 - DNA, 16 bp, M. musculus
actgaaggaaggacca

SEQ ID NO: 352046 - DNA, 16 bp, M. musculus
actgaaggaatgatca

SEQ ID NO: 352047 - DNA, 16 bp, M. musculus
actgaaggacctggaa

SEQ ID NO: 352048 - DNA, 16 bp, M. musculus
actgaaggagatcaag

SEQ ID NO: 352049 - DNA, 16 bp, M. musculus
actgaaggagctagag

SEQ ID NO: 352050 - DNA, 16 bp, M. musculus
actgaaggagctgaag

SEQ ID NO: 352051 - DNA, 16 bp, M. musculus
actgaaggatttgaag

SEQ ID NO: 352052 - DNA, 16 bp, M. musculus
actgaaggtggtctct

SEQ ID NO: 352053 - DNA, 16 bp, M. musculus
actgaagtctcccact

SEQ ID NO: 352054 - DNA, 16 bp, M. musculus
actgaagtggaaattt

SEQ ID NO: 352055 - DNA, 32 bp, M. musculus
actgaagtgtggacactatgcccctccttaga

SEQ ID NO: 352056 - DNA, 16 bp, M. musculus
actgaagttttgggat

SEQ ID NO: 352057 - DNA, 16 bp, M. musculus
actgaataaataaata

SEQ ID NO: 352058 - DNA, 16 bp, M. musculus
actgaatctgtttatc

SEQ ID NO: 352059 - DNA, 16 bp, M. musculus
actgaatctttttttt

SEQ ID NO: 352060 - DNA, 16 bp, M. musculus
actgaatgctcttcca

SEQ ID NO: 352061 - DNA, 16 bp, M. musculus
actgaatggctcagaa

SEQ ID NO: 352062 - DNA, 16 bp, M. musculus
actgaattcttttttt

SEQ ID NO: 352063 - DNA, 16 bp, M. musculus
actgacagactgacag

SEQ ID NO: 352064 - DNA, 16 bp, M. musculus
actgacagagagacag

SEQ ID NO: 352065 - DNA, 16 bp, M. musculus
actgacagcaaggccc

SEQ ID NO: 352066 - DNA, 16 bp, M. musculus
actgacatcactctgc

SEQ ID NO: 352067 - DNA, 16 bp, M. musculus
actgaccctttcacag

SEQ ID NO: 352068 - DNA, 48 bp, M. musculus
actgaccgaagaggagaagactagagcctggtttactgatggctctgc

SEQ ID NO: 352069 - DNA, 16 bp, M. musculus
actgacctggaacttg

SEQ ID NO: 352070 - DNA, 16 bp, M. musculus
actgactaggccatct

SEQ ID NO: 352071 - DNA, 16 bp, M. musculus
actgactcctgaaagc

SEQ ID NO: 352072 - DNA, 16 bp, M. musculus
actgactgactgacag

SEQ ID NO: 352073 - DNA, 16 bp, M. musculus
actgactgataagtgg

SEQ ID NO: 352074 - DNA, 16 bp, M. musculus
actgactgctcttcct

SEQ ID NO: 352075 - DNA, 16 bp, M. musculus
actgactgctctttcc

SEQ ID NO: 352076 - DNA, 16 bp, M. musculus
actgacttgttcatgg

SEQ ID NO: 352077 - DNA, 16 bp, M. musculus
actgagaaagaaatca

SEQ ID NO: 352078 - DNA, 16 bp, M. musculus
actgagaaagatgcag

SEQ ID NO: 352079 - DNA, 16 bp, M. musculus
actgagaagaaggtgt

SEQ ID NO: 352080 - DNA, 16 bp, M. musculus
actgagaataggaaca

SEQ ID NO: 352081 - DNA, 16 bp, M. musculus
actgagacagaaacag

SEQ ID NO: 352082 - DNA, 16 bp, M. musculus
actgagaccagaccag

SEQ ID NO: 352083 - DNA, 16 bp, M. musculus
actgagaccagtctac

SEQ ID NO: 352084 - DNA, 16 bp, M. musculus
actgagactcaggaga

SEQ ID NO: 352085 - DNA, 16 bp, M. musculus
actgagagacagacag

SEQ ID NO: 352086 - DNA, 16 bp, M. musculus
actgagaggcagaggc

SEQ ID NO: 352087 - DNA, 16 bp, M. musculus
actgagataaaaatct

SEQ ID NO: 352088 - DNA, 16 bp, M. musculus
actgagattaaagatg

SEQ ID NO: 352089 - DNA, 16 bp, M. musculus
actgagatttgacctt

SEQ ID NO: 352090 - DNA, 16 bp, M. musculus
actgagcacaaagtcc

SEQ ID NO: 352091 - DNA, 16 bp, M. musculus
actgagcaggttgcat

SEQ ID NO: 352092 - DNA, 16 bp, M. musculus
actgagcatgcccaga

SEQ ID NO: 352093 - DNA, 16 bp, M. musculus
actgagccacaccaca

SEQ ID NO: 352094 - DNA, 16 bp, M. musculus
actgagccaccaacca

SEQ ID NO: 352095 - DNA, 16 bp, M. musculus
actgagccatctcctc

SEQ ID NO: 352096 - DNA, 16 bp, M. musculus
actgagccatctcgct

SEQ ID NO: 352097 - DNA, 16 bp, M. musculus
actgagccatctctaa

SEQ ID NO: 352098 - DNA, 16 bp, M. musculus
actgagccatcttccc

SEQ ID NO: 352099 - DNA, 16 bp, M. musculus
actgagccatcttctc

SEQ ID NO: 352100 - DNA, 16 bp, M. musculus
actgagccatgtcccc

SEQ ID NO: 352101 - DNA, 16 bp, M. musculus
actgagccccttcccc

SEQ ID NO: 352102 - DNA, 16 bp, M. musculus
actgagcctggggact

SEQ ID NO: 352103 - DNA, 16 bp, M. musculus
actgagctaaggacac

SEQ ID NO: 352104 - DNA, 16 bp, M. musculus
actgagctacagtccc

SEQ ID NO: 352105 - DNA, 16 bp, M. musculus
actgagctacatccca

SEQ ID NO: 352106 - DNA, 16 bp, M. musculus
actgagctacatcctc

SEQ ID NO: 352107 - DNA, 16 bp, M. musculus
actgagctacatctcc

SEQ ID NO: 352108 - DNA, 16 bp, M. musculus
actgagctatctccct

SEQ ID NO: 352109 - DNA, 16 bp, M. musculus
actgagctgagaggcc

SEQ ID NO: 352110 - DNA, 16 bp, M. musculus
actgaggaaaaccaaa

SEQ ID NO: 352111 - DNA, 16 bp, M. musculus
actgaggaaaggccat

SEQ ID NO: 352112 - DNA, 16 bp, M. musculus
actgaggaagacatct

SEQ ID NO: 352113 - DNA, 16 bp, M. musculus
actgaggaagaggagg

SEQ ID NO: 352114 - DNA, 16 bp, M. musculus
actgaggaatgctggg

SEQ ID NO: 352115 - DNA, 16 bp, M. musculus
actgaggaccaccagc

SEQ ID NO: 352116 - DNA, 16 bp, M. musculus
actgaggagcagcctg

SEQ ID NO: 352117 - DNA, 16 bp, M. musculus
actgaggagctgaagg

SEQ ID NO: 352118 - DNA, 16 bp, M. musculus
actgaggaggagggtg

SEQ ID NO: 352119 - DNA, 16 bp, M. musculus
actgaggaggctgagg

SEQ ID NO: 352120 - DNA, 16 bp, M. musculus
actgaggaggtagagg

SEQ ID NO: 352121 - DNA, 16 bp, M. musculus
actgaggatgatgccc

SEQ ID NO: 352122 - DNA, 16 bp, M. musculus
actgaggcaagaggat

SEQ ID NO: 352123 - DNA, 16 bp, M. musculus
actgaggcacagaaag

SEQ ID NO: 352124 - DNA, 16 bp, M. musculus
actgaggcacagagag

SEQ ID NO: 352125 - DNA, 16 bp, M. musculus
actgaggcacataaag

SEQ ID NO: 352126 - DNA, 16 bp, M. musculus
actgaggcagcagcct

SEQ ID NO: 352127 - DNA, 16 bp, M. musculus
actgaggcaggagaac

SEQ ID NO: 352128 - DNA, 16 bp, M. musculus
actgaggcaggagcat

SEQ ID NO: 352129 - DNA, 16 bp, M. musculus
actgaggcaggaggat

SEQ ID NO: 352130 - DNA, 16 bp, M. musculus
actgaggcaggaggct

SEQ ID NO: 352131 - DNA, 16 bp, M. musculus
actgaggccaaacaag

SEQ ID NO: 352132 - DNA, 16 bp, M. musculus
actgaggccagaaaag

SEQ ID NO: 352133 - DNA, 16 bp, M. musculus
actgaggccagagaag

SEQ ID NO: 352134 - DNA, 16 bp, M. musculus
actgaggccagggaag

SEQ ID NO: 352135 - DNA, 16 bp, M. musculus
actgaggctcagagaa

SEQ ID NO: 352136 - DNA, 16 bp, M. musculus
actgaggcttcctctc

SEQ ID NO: 352137 - DNA, 16 bp, M. musculus
actgagggtttttttt

SEQ ID NO: 352138 - DNA, 16 bp, M. musculus
actgagtacagggtcc

SEQ ID NO: 352139 - DNA, 16 bp, M. musculus
actgagtcaggaggat

SEQ ID NO: 352140 - DNA, 16 bp, M. musculus
actgagtcatttcttc

SEQ ID NO: 352141 - DNA, 16 bp, M. musculus
actgagtccagaccag

SEQ ID NO: 352142 - DNA, 16 bp, M. musculus
actgagtccttcccca

SEQ ID NO: 352143 - DNA, 16 bp, M. musculus
actgataaaataattt

SEQ ID NO: 352144 - DNA, 16 bp, M. musculus
actgatatttctcatg

SEQ ID NO: 352145 - DNA, 16 bp, M. musculus
actgatcaatcagggc

SEQ ID NO: 352146 - DNA, 16 bp, M. musculus
actgatctcccaggag

SEQ ID NO: 352147 - DNA, 16 bp, M. musculus
actgatctgagatgtt

SEQ ID NO: 352148 - DNA, 16 bp, M. musculus
actgatcttcacttcc

SEQ ID NO: 352149 - DNA, 16 bp, M. musculus
actgatgaatggatat

SEQ ID NO: 352150 - DNA, 16 bp, M. musculus
actgatgcagaggcca

SEQ ID NO: 352151 - DNA, 16 bp, M. musculus
actgatgcatgacaag

SEQ ID NO: 352152 - DNA, 16 bp, M. musculus
actgatgccctcttct

SEQ ID NO: 352153 - DNA, 16 bp, M. musculus
actgatgcctgacaag

SEQ ID NO: 352154 - DNA, 16 bp, M. musculus
actgatggaaactgat

SEQ ID NO: 352155 - DNA, 16 bp, M. musculus
actgatggagctgaag

SEQ ID NO: 352156 - DNA, 16 bp, M. musculus
actgatgtcagataag

SEQ ID NO: 352157 - DNA, 17 bp, M. musculus
actgatgtttctcaagg

SEQ ID NO: 352158 - DNA, 16 bp, M. musculus
actgattagttcatat

SEQ ID NO: 352159 - DNA, 16 bp, M. musculus
actgattgcttttctc

SEQ ID NO: 352160 - DNA, 16 bp, M. musculus
actgatttctagagtg

SEQ ID NO: 352161 - DNA, 16 bp, M. musculus
actgattttattttat

SEQ ID NO: 352162 - DNA, 16 bp, M. musculus
actgcaaacacaaaca

SEQ ID NO: 352163 - DNA, 16 bp, M. musculus
actgcaaatcaaaaca

SEQ ID NO: 352164 - DNA, 16 bp, M. musculus
actgcaaccctttaat

SEQ ID NO: 352165 - DNA, 16 bp, M. musculus
actgcaagcagcaaaa

SEQ ID NO: 352166 - DNA, 16 bp, M. musculus
actgcacacacatggt

SEQ ID NO: 352167 - DNA, 16 bp, M. musculus
actgcacacactgcac

SEQ ID NO: 352168 - DNA, 16 bp, M. musculus
actgcacagagaaact

SEQ ID NO: 352169 - DNA, 16 bp, M. musculus
actgcactgaagctgt

SEQ ID NO: 352170 - DNA, 16 bp, M. musculus
actgcagactgacctt

SEQ ID NO: 352171 - DNA, 16 bp, M. musculus
actgcagagccatctc

SEQ ID NO: 352172 - DNA, 17 bp, M. musculus
actgcagaggcaacaca

SEQ ID NO: 352173 - DNA, 17 bp, M. musculus
actgcagcccaggctac

SEQ ID NO: 352174 - DNA, 16 bp, M. musculus
actgcagcccctccct

SEQ ID NO: 352175 - DNA, 16 bp, M. musculus
actgcagcctgtgtca

SEQ ID NO: 352176 - DNA, 16 bp, M. musculus
actgcagctgctggtt

SEQ ID NO: 352177 - DNA, 16 bp, M. musculus
actgcaggactaggtg

SEQ ID NO: 352178 - DNA, 16 bp, M. musculus
actgcagttacagaca

SEQ ID NO: 352179 - DNA, 16 bp, M. musculus
actgcatcacagggaa

SEQ ID NO: 352180 - DNA, 16 bp, M. musculus
actgcatgcacgtggt

SEQ ID NO: 352181 - DNA, 16 bp, M. musculus
actgcatgcatgtctg

SEQ ID NO: 352182 - DNA, 16 bp, M. musculus
actgcatgtgtgtgtg

SEQ ID NO: 352183 - DNA, 16 bp, M. musculus
actgcattgaagctgt

SEQ ID NO: 352184 - DNA, 16 bp, M. musculus
actgcattttttaaaa

SEQ ID NO: 352185 - DNA, 16 bp, M. musculus
actgccaaccaaagaa

SEQ ID NO: 352186 - DNA, 16 bp, M. musculus
actgccacacccagct

SEQ ID NO: 352187 - DNA, 16 bp, M. musculus
actgccacaggaacag

SEQ ID NO: 352188 - DNA, 16 bp, M. musculus
actgccaggttgctga

SEQ ID NO: 352189 - DNA, 16 bp, M. musculus
actgccagtaactcca

SEQ ID NO: 352190 - DNA, 16 bp, M. musculus
actgccattgctgatt

SEQ ID NO: 352191 - DNA, 17 bp, M. musculus
actgcccaagtatattt

SEQ ID NO: 352192 - DNA, 16 bp, M. musculus
actgcccagtggtttc

SEQ ID NO: 352193 - DNA, 16 bp, M. musculus
actgccccaccggggg

SEQ ID NO: 352194 - DNA, 16 bp, M. musculus
actgccccacctcggg

SEQ ID NO: 352195 - DNA, 16 bp, M. musculus
actgccccacctgggc

SEQ ID NO: 352196 - DNA, 16 bp, M. musculus
actgccccactgggga

SEQ ID NO: 352197 - DNA, 16 bp, M. musculus
actgccccagctgggg

SEQ ID NO: 352198 - DNA, 16 bp, M. musculus
actgccccctcccagt

SEQ ID NO: 352199 - DNA, 16 bp, M. musculus
actgcccggaggctga

SEQ ID NO: 352200 - DNA, 16 bp, M. musculus
actgccctacctgagg

SEQ ID NO: 352201 - DNA, 16 bp, M. musculus
actgccctgccatcag

SEQ ID NO: 352202 - DNA, 16 bp, M. musculus
actgccctgttgccca

SEQ ID NO: 352203 - DNA, 16 bp, M. musculus
actgcctccttctccc

SEQ ID NO: 352204 - DNA, 16 bp, M. musculus
actgcctctgcctccc

SEQ ID NO: 352205 - DNA, 16 bp, M. musculus
actgcctctgcctcct

SEQ ID NO: 352206 - DNA, 16 bp, M. musculus
actgcctctggataga

SEQ ID NO: 352207 - DNA, 16 bp, M. musculus
actgcctctgggccct

SEQ ID NO: 352208 - DNA, 16 bp, M. musculus
actgcctgactgcctg

SEQ ID NO: 352209 - DNA, 16 bp, M. musculus
actgcctgcctccaag

SEQ ID NO: 352210 - DNA, 16 bp, M. musculus
actgcctggcctggcc

SEQ ID NO: 352211 - DNA, 16 bp, M. musculus
actgcctggctccttt

SEQ ID NO: 352212 - DNA, 16 bp, M. musculus
actgcctggcttgttt

SEQ ID NO: 352213 - DNA, 16 bp, M. musculus
actgcctgtcctggaa

SEQ ID NO: 352214 - DNA, 20 bp, M. musculus
actgccttctgaagaactct

SEQ ID NO: 352215 - DNA, 16 bp, M. musculus
actgccttgcctggcc

SEQ ID NO: 352216 - DNA, 17 bp, M. musculus
actgcggggaaggagag

SEQ ID NO: 352217 - DNA, 16 bp, M. musculus
actgctacatatttct

SEQ ID NO: 352218 - DNA, 16 bp, M. musculus
actgctactgctgctg

SEQ ID NO: 352219 - DNA, 16 bp, M. musculus
actgctaggagtccca

SEQ ID NO: 352220 - DNA, 16 bp, M. musculus
actgctaggattaaag

SEQ ID NO: 352221 - DNA, 16 bp, M. musculus
actgctataaacagac

SEQ ID NO: 352222 - DNA, 16 bp, M. musculus
actgctatagactatg

SEQ ID NO: 352223 - DNA, 16 bp, M. musculus
actgctatgaatatag

SEQ ID NO: 352224 - DNA, 16 bp, M. musculus
actgctccagcaccat

SEQ ID NO: 352225 - DNA, 16 bp, M. musculus
actgctcctccctctg

SEQ ID NO: 352226 - DNA, 16 bp, M. musculus
actgctcctctgaagg

SEQ ID NO: 352227 - DNA, 16 bp, M. musculus
actgctctgccagagg

SEQ ID NO: 352228 - DNA, 16 bp, M. musculus
actgctcttcaggagg

SEQ ID NO: 352229 - DNA, 20 bp, M. musculus
actgctcttccaaaggtcca

SEQ ID NO: 352230 - DNA, 16 bp, M. musculus
actgctcttccaaatg

SEQ ID NO: 352231 - DNA, 16 bp, M. musculus
actgctcttccagaag

SEQ ID NO: 352232 - DNA, 18 bp, M. musculus
actgctcttccgaaggtt

SEQ ID NO: 352233 - DNA, 16 bp, M. musculus
actgctcttcctaaag

SEQ ID NO: 352234 - DNA, 16 bp, M. musculus
actgctcttcctgaag

SEQ ID NO: 352235 - DNA, 19 bp, M. musculus
actgctcttctgaaggtca

SEQ ID NO: 352236 - DNA, 16 bp, M. musculus
actgctctttcagagg

SEQ ID NO: 352237 - DNA, 16 bp, M. musculus
actgctgagaacagac

SEQ ID NO: 352238 - DNA, 16 bp, M. musculus
actgctgagccacccc

SEQ ID NO: 352239 - DNA, 16 bp, M. musculus
actgctgagccatctt

SEQ ID NO: 352240 - DNA, 16 bp, M. musculus
actgctgcccactgca

SEQ ID NO: 352241 - DNA, 16 bp, M. musculus
actgctgctactgttc

SEQ ID NO: 352242 - DNA, 16 bp, M. musculus
actgctgctcctccta

SEQ ID NO: 352243 - DNA, 16 bp, M. musculus
actgctgctctattca

SEQ ID NO: 352244 - DNA, 16 bp, M. musculus
actgctgctgctactg

SEQ ID NO: 352245 - DNA, 16 bp, M. musculus
actgctgctgctgcta

SEQ ID NO: 352246 - DNA, 18 bp, M. musculus
actgctgctgctgctctt

SEQ ID NO: 352247 - DNA, 16 bp, M. musculus
actgctgctgctgttc

SEQ ID NO: 352248 - DNA, 16 bp, M. musculus
actgctgctttgctga

SEQ ID NO: 352249 - DNA, 16 bp, M. musculus
actgctggatgaagcc

SEQ ID NO: 352250 - DNA, 16 bp, M. musculus
actgctgggattaaag

SEQ ID NO: 352251 - DNA, 16 bp, M. musculus
actgctgggtctggac

SEQ ID NO: 352252 - DNA, 16 bp, M. musculus
actgctgtacataggg

SEQ ID NO: 352253 - DNA, 16 bp, M. musculus
actgctgtgaaaagac

SEQ ID NO: 352254 - DNA, 16 bp, M. musculus
actgctgtgaagacac

SEQ ID NO: 352255 - DNA, 16 bp, M. musculus
actgctgtgaagagac

SEQ ID NO: 352256 - DNA, 16 bp, M. musculus
actgctgtgaagagat

SEQ ID NO: 352257 - DNA, 16 bp, M. musculus
actgctgtgagttcat

SEQ ID NO: 352258 - DNA, 16 bp, M. musculus
actgctgttggtcacc

SEQ ID NO: 352259 - DNA, 16 bp, M. musculus
actgcttcccactgtc

SEQ ID NO: 352260 - DNA, 16 bp, M. musculus
actgcttcctggccct

SEQ ID NO: 352261 - DNA, 16 bp, M. musculus
actgcttctatttttt

SEQ ID NO: 352262 - DNA, 16 bp, M. musculus
actgcttctgtttcct

SEQ ID NO: 352263 - DNA, 16 bp, M. musculus
actgcttgttgggcct

SEQ ID NO: 352264 - DNA, 16 bp, M. musculus
actgcttttccagaag

SEQ ID NO: 352265 - DNA, 16 bp, M. musculus
actgcttttgttttgt

SEQ ID NO: 352266 - DNA, 16 bp, M. musculus
actggaaaaaaaaatc

SEQ ID NO: 352267 - DNA, 16 bp, M. musculus
actggaaaaacaaaac

SEQ ID NO: 352268 - DNA, 16 bp, M. musculus
actggaaaaacaaaca

SEQ ID NO: 352269 - DNA, 16 bp, M. musculus
actggaaaacaaacaa

SEQ ID NO: 352270 - DNA, 16 bp, M. musculus
actggaaaagagaggc

SEQ ID NO: 352271 - DNA, 16 bp, M. musculus
actggaaacctagcta

SEQ ID NO: 352272 - DNA, 16 bp, M. musculus
actggaaagagtggcc

SEQ ID NO: 352273 - DNA, 16 bp, M. musculus
actggaaagcctggat

SEQ ID NO: 352274 - DNA, 16 bp, M. musculus
actggaaatgtaaatt

SEQ ID NO: 352275 - DNA, 16 bp, M. musculus
actggaacacaacttc

SEQ ID NO: 352276 - DNA, 16 bp, M. musculus
actggaactcacacag

SEQ ID NO: 352277 - DNA, 16 bp, M. musculus
actggaactcactctg

SEQ ID NO: 352278 - DNA, 16 bp, M. musculus
actggaactcaggtga

SEQ ID NO: 352279 - DNA, 17 bp, M. musculus
actggaactcgagcagg

SEQ ID NO: 352280 - DNA, 16 bp, M. musculus
actggaactggagtta

SEQ ID NO: 352281 - DNA, 16 bp, M. musculus
actggaagaagaaaca

SEQ ID NO: 352282 - DNA, 16 bp, M. musculus
actggaagagcagtca

SEQ ID NO: 352283 - DNA, 16 bp, M. musculus
actggaagagggcatc

SEQ ID NO: 352284 - DNA, 16 bp, M. musculus
actggaatgagatctt

SEQ ID NO: 352285 - DNA, 17 bp, M. musculus
actggaattaaaggcat

SEQ ID NO: 352286 - DNA, 16 bp, M. musculus
actggaattccacact

SEQ ID NO: 352287 - DNA, 16 bp, M. musculus
actggacaaccaaaca

SEQ ID NO: 352288 - DNA, 16 bp, M. musculus
actggaccaccaacca

SEQ ID NO: 352289 - DNA, 16 bp, M. musculus
actggacttgaactca

SEQ ID NO: 352290 - DNA, 16 bp, M. musculus
actggagaaaagaaag

SEQ ID NO: 352291 - DNA, 16 bp, M. musculus
actggagaaatggctc

SEQ ID NO: 352292 - DNA, 16 bp, M. musculus
actggagaagaaattt

SEQ ID NO: 352293 - DNA, 16 bp, M. musculus
actggagaccagcctg

SEQ ID NO: 352294 - DNA, 16 bp, M. musculus
actggagacctgggag

SEQ ID NO: 352295 - DNA, 16 bp, M. musculus
actggagagaagccct

SEQ ID NO: 352296 - DNA, 16 bp, M. musculus
actggagagatgactc

SEQ ID NO: 352297 - DNA, 18 bp, M. musculus
actggagagatggctcac

SEQ ID NO: 352298 - DNA, 16 bp, M. musculus
actggagagctggctc

SEQ ID NO: 352299 - DNA, 16 bp, M. musculus
actggagatgggcttt

SEQ ID NO: 352300 - DNA, 16 bp, M. musculus
actggagcaagcagag

SEQ ID NO: 352301 - DNA, 16 bp, M. musculus
actggagcagaagctg

SEQ ID NO: 352302 - DNA, 16 bp, M. musculus
actggagcagcagctg

SEQ ID NO: 352303 - DNA, 16 bp, M. musculus
actggagcgagcagag

SEQ ID NO: 352304 - DNA, 16 bp, M. musculus
actggagctgaggctg

SEQ ID NO: 352305 - DNA, 16 bp, M. musculus
actggaggaaaggcca

SEQ ID NO: 352306 - DNA, 16 bp, M. musculus
actggaggaagtatgt

SEQ ID NO: 352307 - DNA, 16 bp, M. musculus
actggaggaagtgtgt

SEQ ID NO: 352308 - DNA, 16 bp, M. musculus
actggaggagctgaga

SEQ ID NO: 352309 - DNA, 16 bp, M. musculus
actggaggatcccaca

SEQ ID NO: 352310 - DNA, 16 bp, M. musculus
actggaggccccagag

SEQ ID NO: 352311 - DNA, 16 bp, M. musculus
actggaggccccagga

SEQ ID NO: 352312 - DNA, 16 bp, M. musculus
actggaggccccaggt

SEQ ID NO: 352313 - DNA, 16 bp, M. musculus
actggagtcacagata

SEQ ID NO: 352314 - DNA, 16 bp, M. musculus
actggagtgaagtgga

SEQ ID NO: 352315 - DNA, 16 bp, M. musculus
actggagtggatgtag

SEQ ID NO: 352316 - DNA, 16 bp, M. musculus
actggagttagaaatg

SEQ ID NO: 352317 - DNA, 16 bp, M. musculus
actggatccttctcag

SEQ ID NO: 352318 - DNA, 16 bp, M. musculus
actggatctcctggaa

SEQ ID NO: 352319 - DNA, 16 bp, M. musculus
actggatgccctggaa

SEQ ID NO: 352320 - DNA, 16 bp, M. musculus
actggatgtagcttga

SEQ ID NO: 352321 - DNA, 16 bp, M. musculus
actggatgttctgggt

SEQ ID NO: 352322 - DNA, 16 bp, M. musculus
actggatttttaaaaa

SEQ ID NO: 352323 - DNA, 16 bp, M. musculus
actggatttttttttc

SEQ ID NO: 352324 - DNA, 16 bp, M. musculus
actggcacaaaaacag

SEQ ID NO: 352325 - DNA, 16 bp, M. musculus
actggcacaggagaca

SEQ ID NO: 352326 - DNA, 16 bp, M. musculus
actggcagttaccatg

SEQ ID NO: 352327 - DNA, 16 bp, M. musculus
actggccagccagctt

SEQ ID NO: 352328 - DNA, 16 bp, M. musculus
actggccagctagcct

SEQ ID NO: 352329 - DNA, 16 bp, M. musculus
actggccatggccaca

SEQ ID NO: 352330 - DNA, 16 bp, M. musculus
actggccctttaagat

SEQ ID NO: 352331 - DNA, 17 bp, M. musculus
actggcctcaaactcaa

SEQ ID NO: 352332 - DNA, 16 bp, M. musculus
actggcctcaaactga

SEQ ID NO: 352333 - DNA, 16 bp, M. musculus
actggcctggaagtca

SEQ ID NO: 352334 - DNA, 16 bp, M. musculus
actggcctggagcttg

SEQ ID NO: 352335 - DNA, 17 bp, M. musculus
actggccttgaactcat

SEQ ID NO: 352336 - DNA, 16 bp, M. musculus
actggctaagatcaaa

SEQ ID NO: 352337 - DNA, 16 bp, M. musculus
actggctacaaaaaca

SEQ ID NO: 352338 - DNA, 16 bp, M. musculus
actggctgcacaaaca

SEQ ID NO: 352339 - DNA, 16 bp, M. musculus
actggctgccaccctg

SEQ ID NO: 352340 - DNA, 16 bp, M. musculus
actggctgcctttcca

SEQ ID NO: 352341 - DNA, 16 bp, M. musculus
actggctggccactga

SEQ ID NO: 352342 - DNA, 16 bp, M. musculus
actggctgggtttgtg

SEQ ID NO: 352343 - DNA, 16 bp, M. musculus
actggctgtcctagaa

SEQ ID NO: 352344 - DNA, 16 bp, M. musculus
actggctgttcttcag

SEQ ID NO: 352345 - DNA, 17 bp, M. musculus
actggcttacagtttca

SEQ ID NO: 352346 - DNA, 19 bp, M. musculus
actggcttagttcaagata

SEQ ID NO: 352347 - DNA, 16 bp, M. musculus
actggcttctgggcag

SEQ ID NO: 352348 - DNA, 16 bp, M. musculus
actggcttgctcctcc

SEQ ID NO: 352349 - DNA, 16 bp, M. musculus
actggcttgttcagcc

SEQ ID NO: 352350 - DNA, 16 bp, M. musculus
actggctttaagacaa

SEQ ID NO: 352351 - DNA, 16 bp, M. musculus
actgggaaagaggata

SEQ ID NO: 352352 - DNA, 16 bp, M. musculus
actgggaagaaaggag

SEQ ID NO: 352353 - DNA, 16 bp, M. musculus
actgggaaggggataa

SEQ ID NO: 352354 - DNA, 16 bp, M. musculus
actgggacaccaaccc

SEQ ID NO: 352355 - DNA, 16 bp, M. musculus
actgggaccagcggga

SEQ ID NO: 352356 - DNA, 16 bp, M. musculus
actgggactcaggaaa

SEQ ID NO: 352357 - DNA, 16 bp, M. musculus
actgggagaagaggaa

SEQ ID NO: 352358 - DNA, 16 bp, M. musculus
actgggagactgggag

SEQ ID NO: 352359 - DNA, 16 bp, M. musculus
actgggaggagaaggg

SEQ ID NO: 352360 - DNA, 16 bp, M. musculus
actgggaggagagaag

SEQ ID NO: 352361 - DNA, 16 bp, M. musculus
actgggaggaggagga

SEQ ID NO: 352362 - DNA, 16 bp, M. musculus
actgggaggtgaggag

SEQ ID NO: 352363 - DNA, 16 bp, M. musculus
actgggaggtgtggcc

SEQ ID NO: 352364 - DNA, 16 bp, M. musculus
actgggagtcctgctt

SEQ ID NO: 352365 - DNA, 16 bp, M. musculus
actgggatcaaaaaga

SEQ ID NO: 352366 - DNA, 16 bp, M. musculus
actgggatcacaggtg

SEQ ID NO: 352367 - DNA, 16 bp, M. musculus
actgggatgccttgtc

SEQ ID NO: 352368 - DNA, 16 bp, M. musculus
actgggattacaggca

SEQ ID NO: 352369 - DNA, 16 bp, M. musculus
actgggattacaggtg

SEQ ID NO: 352370 - DNA, 16 bp, M. musculus
actgggatttgaacct

SEQ ID NO: 352371 - DNA, 16 bp, M. musculus
actgggcagagcctga

SEQ ID NO: 352372 - DNA, 16 bp, M. musculus
actgggcagtggtggt

SEQ ID NO: 352373 - DNA, 16 bp, M. musculus
actgggcataacttga

SEQ ID NO: 352374 - DNA, 16 bp, M. musculus
actgggcatggtggca

SEQ ID NO: 352375 - DNA, 16 bp, M. musculus
actgggcctgtcccag

SEQ ID NO: 352376 - DNA, 16 bp, M. musculus
actgggctcagaagga

SEQ ID NO: 352377 - DNA, 16 bp, M. musculus
actggggaccctgtgt

SEQ ID NO: 352378 - DNA, 16 bp, M. musculus
actggggagatggctc

SEQ ID NO: 352379 - DNA, 16 bp, M. musculus
actggggaggtagagg

SEQ ID NO: 352380 - DNA, 16 bp, M. musculus
actggggcaaagagcc

SEQ ID NO: 352381 - DNA, 16 bp, M. musculus
actggggctggctcac

SEQ ID NO: 352382 - DNA, 16 bp, M. musculus
actgggggagccatct

SEQ ID NO: 352383 - DNA, 16 bp, M. musculus
actgggggccatgcct

SEQ ID NO: 352384 - DNA, 16 bp, M. musculus
actgggggctacagct

SEQ ID NO: 352385 - DNA, 16 bp, M. musculus
actgggggctgcagct

SEQ ID NO: 352386 - DNA, 16 bp, M. musculus
actgggggctggagag

SEQ ID NO: 352387 - DNA, 16 bp, M. musculus
actggggggctggaga

SEQ ID NO: 352388 - DNA, 16 bp, M. musculus
actggggtattgctgt

SEQ ID NO: 352389 - DNA, 16 bp, M. musculus
actgggtaaagtgctt

SEQ ID NO: 352390 - DNA, 16 bp, M. musculus
actgggtgttcaggat

SEQ ID NO: 352391 - DNA, 16 bp, M. musculus
actgggtgttgtgaga

SEQ ID NO: 352392 - DNA, 16 bp, M. musculus
actggtctggcagagt

SEQ ID NO: 352393 - DNA, 16 bp, M. musculus
actggtgatcctcctg

SEQ ID NO: 352394 - DNA, 16 bp, M. musculus
actggtggaaggcttt

SEQ ID NO: 352395 - DNA, 18 bp, M. musculus
actggtgtgaggtggaat

SEQ ID NO: 352396 - DNA, 16 bp, M. musculus
actggtgtgtggtgga

SEQ ID NO: 352397 - DNA, 16 bp, M. musculus
actggtgtgtgtgtgt

SEQ ID NO: 352398 - DNA, 16 bp, M. musculus
actggtgttttgcctg

SEQ ID NO: 352399 - DNA, 16 bp, M. musculus
actggttaaaaaaaaa

SEQ ID NO: 352400 - DNA, 16 bp, M. musculus
actggttgaataaaga

SEQ ID NO: 352401 - DNA, 16 bp, M. musculus
actggttgtgtgtgtg

SEQ ID NO: 352402 - DNA, 16 bp, M. musculus
actggttttggttttg

SEQ ID NO: 352403 - DNA, 16 bp, M. musculus
actggttttgttttgt

SEQ ID NO: 352404 - DNA, 16 bp, M. musculus
actgtaaaaaattaaa

SEQ ID NO: 352405 - DNA, 16 bp, M. musculus
actgtaaagaaaaatg

SEQ ID NO: 352406 - DNA, 16 bp, M. musculus
actgtaaataaagaaa

SEQ ID NO: 352407 - DNA, 16 bp, M. musculus
actgtaagaccccctt

SEQ ID NO: 352408 - DNA, 16 bp, M. musculus
actgtaagagccagaa

SEQ ID NO: 352409 - DNA, 27 bp, M. musculus
actgtaagtcatcaataaattccttta

SEQ ID NO: 352410 - DNA, 16 bp, M. musculus
actgtaattgtcttca

SEQ ID NO: 352411 - DNA, 16 bp, M. musculus
actgtaattttccaaa

SEQ ID NO: 352412 - DNA, 16 bp, M. musculus
actgtaattttgctcc

SEQ ID NO: 352413 - DNA, 16 bp, M. musculus
actgtactgaagctgt

SEQ ID NO: 352414 - DNA, 18 bp, M. musculus
actgtagctgacttcaga

SEQ ID NO: 352415 - DNA, 16 bp, M. musculus
actgtagctgtttcca

SEQ ID NO: 352416 - DNA, 16 bp, M. musculus
actgtaggagtcagag

SEQ ID NO: 352417 - DNA, 16 bp, M. musculus
actgtaggcaagcctg

SEQ ID NO: 352418 - DNA, 16 bp, M. musculus
actgtagtcactgagg

SEQ ID NO: 352419 - DNA, 16 bp, M. musculus
actgtatagcccaggc

SEQ ID NO: 352420 - DNA, 16 bp, M. musculus
actgtatctgtacaga

SEQ ID NO: 352421 - DNA, 16 bp, M. musculus
actgtatcttctacac

SEQ ID NO: 352422 - DNA, 16 bp, M. musculus
actgtattaaagggtt

SEQ ID NO: 352423 - DNA, 16 bp, M. musculus
actgtcaagaaccagg

SEQ ID NO: 352424 - DNA, 16 bp, M. musculus
actgtcagactgattt

SEQ ID NO: 352425 - DNA, 16 bp, M. musculus
actgtccacagaacag

SEQ ID NO: 352426 - DNA, 16 bp, M. musculus
actgtccaggcagcca

SEQ ID NO: 352427 - DNA, 16 bp, M. musculus
actgtccatctctgca

SEQ ID NO: 352428 - DNA, 16 bp, M. musculus
actgtcccaacttgag

SEQ ID NO: 352429 - DNA, 16 bp, M. musculus
actgtcctggaactca

SEQ ID NO: 352430 - DNA, 16 bp, M. musculus
actgtcctggaactta

SEQ ID NO: 352431 - DNA, 16 bp, M. musculus
actgtcctggagctca

SEQ ID NO: 352432 - DNA, 16 bp, M. musculus
actgtcgctgtcctca

SEQ ID NO: 352433 - DNA, 20 bp, M. musculus
actgtcgctgtcttcagaca

SEQ ID NO: 352434 - DNA, 17 bp, M. musculus
actgtctcaaaataaaa

SEQ ID NO: 352435 - DNA, 17 bp, M. musculus
actgtctcctactgcca

SEQ ID NO: 352436 - DNA, 16 bp, M. musculus
actgtctctgtcttca

SEQ ID NO: 352437 - DNA, 16 bp, M. musculus
actgtctctgtgccat

SEQ ID NO: 352438 - DNA, 16 bp, M. musculus
actgtctgtgtccctc

SEQ ID NO: 352439 - DNA, 16 bp, M. musculus
actgtctgttgagtcc

SEQ ID NO: 352440 - DNA, 16 bp, M. musculus
actgtcttcagacaca

SEQ ID NO: 352441 - DNA, 16 bp, M. musculus
actgtcttcagacact

SEQ ID NO: 352442 - DNA, 16 bp, M. musculus
actgtcttctggacat

SEQ ID NO: 352443 - DNA, 16 bp, M. musculus
actgtcttgtagtgat

SEQ ID NO: 352444 - DNA, 16 bp, M. musculus
actgtgaaaaagaaaa

SEQ ID NO: 352445 - DNA, 16 bp, M. musculus
actgtgaaagactgga

SEQ ID NO: 352446 - DNA, 16 bp, M. musculus
actgtgaacatagtgg

SEQ ID NO: 352447 - DNA, 16 bp, M. musculus
actgtgaagaccaggc

SEQ ID NO: 352448 - DNA, 16 bp, M. musculus
actgtgaagagaggcc

SEQ ID NO: 352449 - DNA, 16 bp, M. musculus
actgtgacaaaacacc

SEQ ID NO: 352450 - DNA, 16 bp, M. musculus
actgtgacacactgca

SEQ ID NO: 352451 - DNA, 16 bp, M. musculus
actgtgaccaaaagca

SEQ ID NO: 352452 - DNA, 16 bp, M. musculus
actgtgacctagaagt

SEQ ID NO: 352453 - DNA, 16 bp, M. musculus
actgtgactcaggata

SEQ ID NO: 352454 - DNA, 16 bp, M. musculus
actgtgagagccagaa

SEQ ID NO: 352455 - DNA, 16 bp, M. musculus
actgtgagcagtgcca

SEQ ID NO: 352456 - DNA, 16 bp, M. musculus
actgtgattacaggca

SEQ ID NO: 352457 - DNA, 16 bp, M. musculus
actgtgcagcccaggc

SEQ ID NO: 352458 - DNA, 16 bp, M. musculus
actgtgcagtttttaa

SEQ ID NO: 352459 - DNA, 16 bp, M. musculus
actgtgcctgcctgga

SEQ ID NO: 352460 - DNA, 16 bp, M. musculus
actgtgccttctccat

SEQ ID NO: 352461 - DNA, 16 bp, M. musculus
actgtggaacttttaa

SEQ ID NO: 352462 - DNA, 16 bp, M. musculus
actgtggaagaagagg

SEQ ID NO: 352463 - DNA, 16 bp, M. musculus
actgtggaagagctga

SEQ ID NO: 352464 - DNA, 16 bp, M. musculus
actgtggacacaatgt

SEQ ID NO: 352465 - DNA, 16 bp, M. musculus
actgtggagaggagca

SEQ ID NO: 352466 - DNA, 16 bp, M. musculus
actgtggaggcagagg

SEQ ID NO: 352467 - DNA, 16 bp, M. musculus
actgtggcatgtgtgc

SEQ ID NO: 352468 - DNA, 16 bp, M. musculus
actgtggctgcccttg

SEQ ID NO: 352469 - DNA, 16 bp, M. musculus
actgtggctgtcttca

SEQ ID NO: 352470 - DNA, 16 bp, M. musculus
actgtggcttcaaaga

SEQ ID NO: 352471 - DNA, 16 bp, M. musculus
actgtggcttttctct

SEQ ID NO: 352472 - DNA, 16 bp, M. musculus
actgtgggaaactaga

SEQ ID NO: 352473 - DNA, 16 bp, M. musculus
actgtgggactgtggg

SEQ ID NO: 352474 - DNA, 16 bp, M. musculus
actgtgggcagtgcca

SEQ ID NO: 352475 - DNA, 16 bp, M. musculus
actgtgggcagtgctg

SEQ ID NO: 352476 - DNA, 16 bp, M. musculus
actgtggggaggagct

SEQ ID NO: 352477 - DNA, 16 bp, M. musculus
actgtggggcagagcc

SEQ ID NO: 352478 - DNA, 16 bp, M. musculus
actgtggggttttttt

SEQ ID NO: 352479 - DNA, 16 bp, M. musculus
actgtgggtgatacca

SEQ ID NO: 352480 - DNA, 16 bp, M. musculus
actgtgggtggtgcca

SEQ ID NO: 352481 - DNA, 16 bp, M. musculus
actgtgggtgtggact

SEQ ID NO: 352482 - DNA, 16 bp, M. musculus
actgtgggtgttggct

SEQ ID NO: 352483 - DNA, 16 bp, M. musculus
actgtggtaactgctg

SEQ ID NO: 352484 - DNA, 16 bp, M. musculus
actgtggtacaaaccc

SEQ ID NO: 352485 - DNA, 16 bp, M. musculus
actgtggtagagaaag

SEQ ID NO: 352486 - DNA, 16 bp, M. musculus
actgtggttctcaacc

SEQ ID NO: 352487 - DNA, 16 bp, M. musculus
actgtggtttgtccct

SEQ ID NO: 352488 - DNA, 16 bp, M. musculus
actgtgtacacacaca

SEQ ID NO: 352489 - DNA, 16 bp, M. musculus
actgtgtactgagact

SEQ ID NO: 352490 - DNA, 16 bp, M. musculus
actgtgtagctttggc

SEQ ID NO: 352491 - DNA, 16 bp, M. musculus
actgtgtataaggcag

SEQ ID NO: 352492 - DNA, 16 bp, M. musculus
actgtgtatgtgtgca

SEQ ID NO: 352493 - DNA, 16 bp, M. musculus
actgtgtccatgttta

SEQ ID NO: 352494 - DNA, 16 bp, M. musculus
actgtgtctctgtcta

SEQ ID NO: 352495 - DNA, 16 bp, M. musculus
actgtgtgacacactg

SEQ ID NO: 352496 - DNA, 16 bp, M. musculus
actgtgtgagtgtgtg

SEQ ID NO: 352497 - DNA, 16 bp, M. musculus
actgtgtgcacatgtg

SEQ ID NO: 352498 - DNA, 16 bp, M. musculus
actgtgtgcatgcaca

SEQ ID NO: 352499 - DNA, 16 bp, M. musculus
actgtgtgcatgtctg

SEQ ID NO: 352500 - DNA, 16 bp, M. musculus
actgtgtggccctggc

SEQ ID NO: 352501 - DNA, 16 bp, M. musculus
actgtgtgtatgtgtg

SEQ ID NO: 352502 - DNA, 16 bp, M. musculus
actgtgtgtgtgtgtg

SEQ ID NO: 352503 - DNA, 16 bp, M. musculus
actgtgtgtgtttgtg

SEQ ID NO: 352504 - DNA, 16 bp, M. musculus
actgtgtttgtgtgtg

SEQ ID NO: 352505 - DNA, 16 bp, M. musculus
actgttattattatta

SEQ ID NO: 352506 - DNA, 16 bp, M. musculus
actgttccacatccca

SEQ ID NO: 352507 - DNA, 16 bp, M. musculus
actgttcccatttcat

SEQ ID NO: 352508 - DNA, 16 bp, M. musculus
actgttccccagctga

SEQ ID NO: 352509 - DNA, 16 bp, M. musculus
actgttcctgatcctg

SEQ ID NO: 352510 - DNA, 16 bp, M. musculus
actgttctattgctgt

SEQ ID NO: 352511 - DNA, 16 bp, M. musculus
actgttctcccagagg

SEQ ID NO: 352512 - DNA, 16 bp, M. musculus
actgttctcccaggag

SEQ ID NO: 352513 - DNA, 16 bp, M. musculus
actgttctgagtgcag

SEQ ID NO: 352514 - DNA, 16 bp, M. musculus
actgttcttacagagg

SEQ ID NO: 352515 - DNA, 16 bp, M. musculus
actgttgagaaggatt

SEQ ID NO: 352516 - DNA, 16 bp, M. musculus
actgttgcatatgcca

SEQ ID NO: 352517 - DNA, 16 bp, M. musculus
actgttgctaagtaac

SEQ ID NO: 352518 - DNA, 16 bp, M. musculus
actgttgctctctcca

SEQ ID NO: 352519 - DNA, 19 bp, M. musculus
actgttggaagggcaagcc

SEQ ID NO: 352520 - DNA, 16 bp, M. musculus
actgttggtcatttca

SEQ ID NO: 352521 - DNA, 16 bp, M. musculus
actgttgtggatgcca

SEQ ID NO: 352522 - DNA, 16 bp, M. musculus
actgtttaaaagttca

SEQ ID NO: 352523 - DNA, 16 bp, M. musculus
actgtttaaaataaaa

SEQ ID NO: 352524 - DNA, 16 bp, M. musculus
actgtttaagcaacaa

SEQ ID NO: 352525 - DNA, 16 bp, M. musculus
actgtttcctttgctg

SEQ ID NO: 352526 - DNA, 16 bp, M. musculus
actgtttgttatcatg

SEQ ID NO: 352527 - DNA, 16 bp, M. musculus
actgttttaaaaaaat

SEQ ID NO: 352528 - DNA, 16 bp, M. musculus
actgttttcattttat

SEQ ID NO: 352529 - DNA, 16 bp, M. musculus
actgttttggaaggat

SEQ ID NO: 352530 - DNA, 16 bp, M. musculus
actgtttttctaaaaa

SEQ ID NO: 352531 - DNA, 16 bp, M. musculus
acttaaaaatgagaaa

SEQ ID NO: 352532 - DNA, 16 bp, M. musculus
acttaaaacattccac

SEQ ID NO: 352533 - DNA, 16 bp, M. musculus
acttaaaagaagacag

SEQ ID NO: 352534 - DNA, 16 bp, M. musculus
acttaaaatgtatttt

SEQ ID NO: 352535 - DNA, 16 bp, M. musculus
acttaaaggatgcctt

SEQ ID NO: 352536 - DNA, 16 bp, M. musculus
acttaacagatattta

SEQ ID NO: 352537 - DNA, 16 bp, M. musculus
acttaagaagaaggaa

SEQ ID NO: 352538 - DNA, 16 bp, M. musculus
acttaaggaaggaaga

SEQ ID NO: 352539 - DNA, 16 bp, M. musculus
acttaagggaaaaaaa

SEQ ID NO: 352540 - DNA, 16 bp, M. musculus
acttaataaaatactt

SEQ ID NO: 352541 - DNA, 16 bp, M. musculus
acttaataccaatact

SEQ ID NO: 352542 - DNA, 16 bp, M. musculus
acttaatgaaaatgaa

SEQ ID NO: 352543 - DNA, 16 bp, M. musculus
acttaatgctcttgca

SEQ ID NO: 352544 - DNA, 16 bp, M. musculus
acttaatggctaatat

SEQ ID NO: 352545 - DNA, 16 bp, M. musculus
acttacaaccatctgt

SEQ ID NO: 352546 - DNA, 16 bp, M. musculus
acttacacatcctaca

SEQ ID NO: 352547 - DNA, 16 bp, M. musculus
acttacagaagagaaa

SEQ ID NO: 352548 - DNA, 16 bp, M. musculus
acttacagagcccacc

SEQ ID NO: 352549 - DNA, 16 bp, M. musculus
acttacaggaacagaa

SEQ ID NO: 352550 - DNA, 16 bp, M. musculus
acttacaggaatgtgg

SEQ ID NO: 352551 - DNA, 16 bp, M. musculus
acttaccaaagttaaa

SEQ ID NO: 352552 - DNA, 16 bp, M. musculus
acttacctacctacct

SEQ ID NO: 352553 - DNA, 16 bp, M. musculus
acttactggtaccacc

SEQ ID NO: 352554 - DNA, 16 bp, M. musculus
acttacttattttaaa

SEQ ID NO: 352555 - DNA, 19 bp, M. musculus
acttagaacacaggatgtc

SEQ ID NO: 352556 - DNA, 16 bp, M. musculus
acttagacttgacttt

SEQ ID NO: 352557 - DNA, 16 bp, M. musculus
acttagagaaggaagg

SEQ ID NO: 352558 - DNA, 16 bp, M. musculus
acttagagatccatct

SEQ ID NO: 352559 - DNA, 16 bp, M. musculus
acttagattttatttt

SEQ ID NO: 352560 - DNA, 16 bp, M. musculus
acttaggaggctgagg

SEQ ID NO: 352561 - DNA, 16 bp, M. musculus
acttagggttggaagt

SEQ ID NO: 352562 - DNA, 16 bp, M. musculus
acttaggtcctctgca

SEQ ID NO: 352563 - DNA, 16 bp, M. musculus
acttaggttctctgca

SEQ ID NO: 352564 - DNA, 16 bp, M. musculus
acttataagtgaatgc

SEQ ID NO: 352565 - DNA, 16 bp, M. musculus
acttataatctcagca

SEQ ID NO: 352566 - DNA, 16 bp, M. musculus
acttatatgtagacat

SEQ ID NO: 352567 - DNA, 17 bp, M. musculus
acttatcagcgggaggg

SEQ ID NO: 352568 - DNA, 16 bp, M. musculus
acttattattccttaa

SEQ ID NO: 352569 - DNA, 16 bp, M. musculus
acttattcatcatcat

SEQ ID NO: 352570 - DNA, 16 bp, M. musculus
acttatttatttgtat

SEQ ID NO: 352571 - DNA, 16 bp, M. musculus
acttatttattttgaa

SEQ ID NO: 352572 - DNA, 16 bp, M. musculus
acttcaaaacattgga

SEQ ID NO: 352573 - DNA, 16 bp, M. musculus
acttcaaaagttccca

SEQ ID NO: 352574 - DNA, 16 bp, M. musculus
acttcaaaatttttag

SEQ ID NO: 352575 - DNA, 16 bp, M. musculus
acttcaaaggaaaaaa

SEQ ID NO: 352576 - DNA, 16 bp, M. musculus
acttcaaaggataata

SEQ ID NO: 352577 - DNA, 16 bp, M. musculus
acttcaaatctctcaa

SEQ ID NO: 352578 - DNA, 16 bp, M. musculus
acttcaacacccactc

SEQ ID NO: 352579 - DNA, 16 bp, M. musculus
acttcaacacccctct

SEQ ID NO: 352580 - DNA, 16 bp, M. musculus
acttcaacacctcact

SEQ ID NO: 352581 - DNA, 16 bp, M. musculus
acttcaacccaaaatt

SEQ ID NO: 352582 - DNA, 16 bp, M. musculus
acttcaagaaggaaaa

SEQ ID NO: 352583 - DNA, 16 bp, M. musculus
acttcaaggactatat

SEQ ID NO: 352584 - DNA, 16 bp, M. musculus
acttcaagtacaatgg

SEQ ID NO: 352585 - DNA, 16 bp, M. musculus
acttcaagtctctggg

SEQ ID NO: 352586 - DNA, 16 bp, M. musculus
acttcaagtgcaatgt

SEQ ID NO: 352587 - DNA, 16 bp, M. musculus
acttcaataacaaaga

SEQ ID NO: 352588 - DNA, 16 bp, M. musculus
acttcaatatgaacta

SEQ ID NO: 352589 - DNA, 16 bp, M. musculus
acttcaatcaggatga

SEQ ID NO: 352590 - DNA, 16 bp, M. musculus
acttcaatgtaccttg

SEQ ID NO: 352591 - DNA, 27 bp, M. musculus
acttcaatgtactttgcctgctgtgac

SEQ ID NO: 352592 - DNA, 16 bp, M. musculus
acttcaattctgttcc

SEQ ID NO: 352593 - DNA, 16 bp, M. musculus
acttcaatttgcttag

SEQ ID NO: 352594 - DNA, 16 bp, M. musculus
acttcacagatgagga

SEQ ID NO: 352595 - DNA, 16 bp, M. musculus
acttcactcaggaaga

SEQ ID NO: 352596 - DNA, 16 bp, M. musculus
acttcactcaggatga

SEQ ID NO: 352597 - DNA, 19 bp, M. musculus
acttcactcgagtgtcgag

SEQ ID NO: 352598 - DNA, 16 bp, M. musculus
acttcactgaagctgt

SEQ ID NO: 352599 - DNA, 16 bp, M. musculus
acttcactgtcttctg

SEQ ID NO: 352600 - DNA, 16 bp, M. musculus
acttcactgtgtaaat

SEQ ID NO: 352601 - DNA, 16 bp, M. musculus
acttcagaaaaacaaa

SEQ ID NO: 352602 - DNA, 16 bp, M. musculus
acttcagaaaacaaaa

SEQ ID NO: 352603 - DNA, 16 bp, M. musculus
acttcagaaaatcaaa

SEQ ID NO: 352604 - DNA, 16 bp, M. musculus
acttcagaaaattaaa

SEQ ID NO: 352605 - DNA, 16 bp, M. musculus
acttcagaatatcaaa

SEQ ID NO: 352606 - DNA, 16 bp, M. musculus
acttcagagacagaag

SEQ ID NO: 352607 - DNA, 16 bp, M. musculus
acttcagagcaatagt

SEQ ID NO: 352608 - DNA, 16 bp, M. musculus
acttcagattattcat

SEQ ID NO: 352609 - DNA, 16 bp, M. musculus
acttcagcccagaaag

SEQ ID NO: 352610 - DNA, 16 bp, M. musculus
acttcagcctcctgag

SEQ ID NO: 352611 - DNA, 16 bp, M. musculus
acttcagcctcttttg

SEQ ID NO: 352612 - DNA, 16 bp, M. musculus
acttcagctccaaggg

SEQ ID NO: 352613 - DNA, 16 bp, M. musculus
acttcaggaacaaaaa

SEQ ID NO: 352614 - DNA, 16 bp, M. musculus
acttcagggacaaaga

SEQ ID NO: 352615 - DNA, 16 bp, M. musculus
acttcaggggctggag

SEQ ID NO: 352616 - DNA, 16 bp, M. musculus
acttcaggttctctgt

SEQ ID NO: 352617 - DNA, 16 bp, M. musculus
acttcagtcattttcc

SEQ ID NO: 352618 - DNA, 16 bp, M. musculus
acttcagttccaagga

SEQ ID NO: 352619 - DNA, 16 bp, M. musculus
acttcagtttgtgtca

SEQ ID NO: 352620 - DNA, 16 bp, M. musculus
acttcataaaatcaaa

SEQ ID NO: 352621 - DNA, 16 bp, M. musculus
acttcataaagagaaa

SEQ ID NO: 352622 - DNA, 16 bp, M. musculus
acttcataactctaat

SEQ ID NO: 352623 - DNA, 16 bp, M. musculus
acttcatacatatata

SEQ ID NO: 352624 - DNA, 18 bp, M. musculus
acttcatactcatcaaag

SEQ ID NO: 352625 - DNA, 16 bp, M. musculus
acttcatctcaggatt

SEQ ID NO: 352626 - DNA, 16 bp, M. musculus
acttcatcttttctaa

SEQ ID NO: 352627 - DNA, 16 bp, M. musculus
acttcattccttttta

SEQ ID NO: 352628 - DNA, 16 bp, M. musculus
acttcattctttctta

SEQ ID NO: 352629 - DNA, 16 bp, M. musculus
acttcattgaagctgt

SEQ ID NO: 352630 - DNA, 16 bp, M. musculus
acttcattttaaaatt

SEQ ID NO: 352631 - DNA, 16 bp, M. musculus
acttcatttttaaaaa

SEQ ID NO: 352632 - DNA, 16 bp, M. musculus
acttccaaacctcccc

SEQ ID NO: 352633 - DNA, 16 bp, M. musculus
acttccaccagagaac

SEQ ID NO: 352634 - DNA, 16 bp, M. musculus
acttccacctcagcca

SEQ ID NO: 352635 - DNA, 16 bp, M. musculus
acttccaggaaatcca

SEQ ID NO: 352636 - DNA, 16 bp, M. musculus
acttccaggacagcca

SEQ ID NO: 352637 - DNA, 16 bp, M. musculus
acttccaggactcaaa

SEQ ID NO: 352638 - DNA, 16 bp, M. musculus
acttccaggagctctg

SEQ ID NO: 352639 - DNA, 16 bp, M. musculus
acttccaggtctgtgt

SEQ ID NO: 352640 - DNA, 16 bp, M. musculus
acttccagtggaagga

SEQ ID NO: 352641 - DNA, 16 bp, M. musculus
acttcccagaagatat

SEQ ID NO: 352642 - DNA, 16 bp, M. musculus
acttcccagttaaaaa

SEQ ID NO: 352643 - DNA, 16 bp, M. musculus
acttccccagcaacag

SEQ ID NO: 352644 - DNA, 16 bp, M. musculus
acttccccagctgaag

SEQ ID NO: 352645 - DNA, 16 bp, M. musculus
acttcccccagcaagg

SEQ ID NO: 352646 - DNA, 16 bp, M. musculus
acttccctaaaccaaa

SEQ ID NO: 352647 - DNA, 16 bp, M. musculus
acttccctggtgatga

SEQ ID NO: 352648 - DNA, 16 bp, M. musculus
acttccctgttttctt

SEQ ID NO: 352649 - DNA, 16 bp, M. musculus
acttcctatgatctcc

SEQ ID NO: 352650 - DNA, 16 bp, M. musculus
acttcctcaactatgt

SEQ ID NO: 352651 - DNA, 16 bp, M. musculus
acttcctcagtggttt

SEQ ID NO: 352652 - DNA, 16 bp, M. musculus
acttcctccaacaaag

SEQ ID NO: 352653 - DNA, 16 bp, M. musculus
acttcctccaacaagg

SEQ ID NO: 352654 - DNA, 16 bp, M. musculus
acttcctccagcaagg

SEQ ID NO: 352655 - DNA, 16 bp, M. musculus
acttcctctgagaccc

SEQ ID NO: 352656 - DNA, 16 bp, M. musculus
acttcctgactgtgga

SEQ ID NO: 352657 - DNA, 16 bp, M. musculus
acttcctgagtgctga

SEQ ID NO: 352658 - DNA, 16 bp, M. musculus
acttcctgcacctgca

SEQ ID NO: 352659 - DNA, 28 bp, M. musculus
acttcctggtcagcaggatggaagtctg

SEQ ID NO: 352660 - DNA, 16 bp, M. musculus
acttcctgtgttttct

SEQ ID NO: 352661 - DNA, 16 bp, M. musculus
acttcctgttttctct

SEQ ID NO: 352662 - DNA, 16 bp, M. musculus
acttccttagatgatg

SEQ ID NO: 352663 - DNA, 16 bp, M. musculus
acttccttattgtctt

SEQ ID NO: 352664 - DNA, 16 bp, M. musculus
acttccttcagtggtg

SEQ ID NO: 352665 - DNA, 16 bp, M. musculus
acttccttctgcctct

SEQ ID NO: 352666 - DNA, 16 bp, M. musculus
acttccttctgtgatg

SEQ ID NO: 352667 - DNA, 20 bp, M. musculus
acttccttggtgataaacag

SEQ ID NO: 352668 - DNA, 26 bp, M. musculus
acttccttgtgactcttaactggtat

SEQ ID NO: 352669 - DNA, 16 bp, M. musculus
acttctaaggacatga

SEQ ID NO: 352670 - DNA, 16 bp, M. musculus
acttctaaggaggggt

SEQ ID NO: 352671 - DNA, 16 bp, M. musculus
acttctactggagaag

SEQ ID NO: 352672 - DNA, 16 bp, M. musculus
acttctagttcttatg

SEQ ID NO: 352673 - DNA, 16 bp, M. musculus
acttctatttttaaaa

SEQ ID NO: 352674 - DNA, 16 bp, M. musculus
acttctatttttacat

SEQ ID NO: 352675 - DNA, 16 bp, M. musculus
acttctcaccagaggc

SEQ ID NO: 352676 - DNA, 16 bp, M. musculus
acttctcactagagac

SEQ ID NO: 352677 - DNA, 16 bp, M. musculus
acttctccagcatcat

SEQ ID NO: 352678 - DNA, 16 bp, M. musculus
acttctccagcccagg

SEQ ID NO: 352679 - DNA, 16 bp, M. musculus
acttctccagctctgc

SEQ ID NO: 352680 - DNA, 16 bp, M. musculus
acttctccattgctgt

SEQ ID NO: 352681 - DNA, 16 bp, M. musculus
acttctccccagagac

SEQ ID NO: 352682 - DNA, 16 bp, M. musculus
acttctcctgggcata

SEQ ID NO: 352683 - DNA, 16 bp, M. musculus
acttctctctctgtct

SEQ ID NO: 352684 - DNA, 16 bp, M. musculus
acttctctgagcctca

SEQ ID NO: 352685 - DNA, 64 bp, M. musculus
acttctctggctgtgaaatgagttccttggtcagaagcaatactgtgtggaataccatgacgat

SEQ ID NO: 352686 - DNA, 16 bp, M. musculus
acttctctggtagaat

SEQ ID NO: 352687 - DNA, 16 bp, M. musculus
acttctctgtttgcca

SEQ ID NO: 352688 - DNA, 16 bp, M. musculus
acttctgaaactgtga

SEQ ID NO: 352689 - DNA, 16 bp, M. musculus
acttctgaatctgtaa

SEQ ID NO: 352690 - DNA, 16 bp, M. musculus
acttctgcaggcacca

SEQ ID NO: 352691 - DNA, 16 bp, M. musculus
acttctgcatgtcaga

SEQ ID NO: 352692 - DNA, 16 bp, M. musculus
acttctgcttcctggc

SEQ ID NO: 352693 - DNA, 16 bp, M. musculus
acttctggagaaatca

SEQ ID NO: 352694 - DNA, 16 bp, M. musculus
acttctggcttctacc

SEQ ID NO: 352695 - DNA, 16 bp, M. musculus
acttctgggctcctcc

SEQ ID NO: 352696 - DNA, 16 bp, M. musculus
acttctggtggtgttc

SEQ ID NO: 352697 - DNA, 17 bp, M. musculus
acttctggtgtgtctga

SEQ ID NO: 352698 - DNA, 16 bp, M. musculus
acttctgtaatcccag

SEQ ID NO: 352699 - DNA, 16 bp, M. musculus
acttctgtatttatca

SEQ ID NO: 352700 - DNA, 16 bp, M. musculus
acttctgtccattggt

SEQ ID NO: 352701 - DNA, 16 bp, M. musculus
acttctgtgtgtgtgt

SEQ ID NO: 352702 - DNA, 16 bp, M. musculus
acttctgtgtttgaca

SEQ ID NO: 352703 - DNA, 16 bp, M. musculus
acttctgttagtttca

SEQ ID NO: 352704 - DNA, 16 bp, M. musculus
acttctgttttcctcc

SEQ ID NO: 352705 - DNA, 16 bp, M. musculus
acttcttagagttcaa

SEQ ID NO: 352706 - DNA, 16 bp, M. musculus
acttcttagccctggc

SEQ ID NO: 352707 - DNA, 16 bp, M. musculus
acttcttcatttccaa

SEQ ID NO: 352708 - DNA, 16 bp, M. musculus
acttcttcctctccaa

SEQ ID NO: 352709 - DNA, 16 bp, M. musculus
acttcttccttgccaa

SEQ ID NO: 352710 - DNA, 16 bp, M. musculus
acttcttcctttccaa

SEQ ID NO: 352711 - DNA, 16 bp, M. musculus
acttcttctttgccaa

SEQ ID NO: 352712 - DNA, 16 bp, M. musculus
acttcttgacttcttt

SEQ ID NO: 352713 - DNA, 16 bp, M. musculus
acttcttgcaaaccca

SEQ ID NO: 352714 - DNA, 16 bp, M. musculus
acttcttggtcctgga

SEQ ID NO: 352715 - DNA, 16 bp, M. musculus
acttcttggttggtgg

SEQ ID NO: 352716 - DNA, 16 bp, M. musculus
acttctttaaaaatta

SEQ ID NO: 352717 - DNA, 16 bp, M. musculus
acttctttcaatgatg

SEQ ID NO: 352718 - DNA, 16 bp, M. musculus
acttctttctcagtct

SEQ ID NO: 352719 - DNA, 16 bp, M. musculus
acttctttgcatcagc

SEQ ID NO: 352720 - DNA, 16 bp, M. musculus
acttctttgttctagc

SEQ ID NO: 352721 - DNA, 16 bp, M. musculus
acttgaaaaacaaaca

SEQ ID NO: 352722 - DNA, 16 bp, M. musculus
acttgaaaacacttca

SEQ ID NO: 352723 - DNA, 16 bp, M. musculus
acttgaaatcccacca

SEQ ID NO: 352724 - DNA, 16 bp, M. musculus
acttgaaatgtaaata

SEQ ID NO: 352725 - DNA, 16 bp, M. musculus
acttgaacccagagct

SEQ ID NO: 352726 - DNA, 16 bp, M. musculus
acttgaagaccaagct

SEQ ID NO: 352727 - DNA, 16 bp, M. musculus
acttgaagatatgggc

SEQ ID NO: 352728 - DNA, 16 bp, M. musculus
acttgaagctgctggc

SEQ ID NO: 352729 - DNA, 16 bp, M. musculus
acttgaagttattgcc

SEQ ID NO: 352730 - DNA, 16 bp, M. musculus
acttgaatttgatccc

SEQ ID NO: 352731 - DNA, 16 bp, M. musculus
acttgacacataaaca

SEQ ID NO: 352732 - DNA, 16 bp, M. musculus
acttgacctttttcct

SEQ ID NO: 352733 - DNA, 16 bp, M. musculus
acttgactcagagcag

SEQ ID NO: 352734 - DNA, 16 bp, M. musculus
acttgactctgcctcc

SEQ ID NO: 352735 - DNA, 16 bp, M. musculus
acttgagaccaatttc

SEQ ID NO: 352736 - DNA, 16 bp, M. musculus
acttgagaggcagaga

SEQ ID NO: 352737 - DNA, 16 bp, M. musculus
acttgagattctctct

SEQ ID NO: 352738 - DNA, 16 bp, M. musculus
acttgagccagtttgc

SEQ ID NO: 352739 - DNA, 16 bp, M. musculus
acttgagctttgtgca

SEQ ID NO: 352740 - DNA, 16 bp, M. musculus
acttgaggctggagag

SEQ ID NO: 352741 - DNA, 16 bp, M. musculus
acttgaggtgggaaga

SEQ ID NO: 352742 - DNA, 16 bp, M. musculus
acttgagttcagtccc

SEQ ID NO: 352743 - DNA, 16 bp, M. musculus
acttgagtttggtccc

SEQ ID NO: 352744 - DNA, 16 bp, M. musculus
acttgagttttttatt

SEQ ID NO: 352745 - DNA, 16 bp, M. musculus
acttgataaacaactt

SEQ ID NO: 352746 - DNA, 16 bp, M. musculus
acttgatcaagatgga

SEQ ID NO: 352747 - DNA, 16 bp, M. musculus
acttgatgaaatattt

SEQ ID NO: 352748 - DNA, 16 bp, M. musculus
acttgatgccctgact

SEQ ID NO: 352749 - DNA, 17 bp, M. musculus
acttgatgccctgcctt

SEQ ID NO: 352750 - DNA, 16 bp, M. musculus
acttgatgccctttct

SEQ ID NO: 352751 - DNA, 16 bp, M. musculus
acttgatgtcctgtct

SEQ ID NO: 352752 - DNA, 16 bp, M. musculus
acttgcaaatgaaaat

SEQ ID NO: 352753 - DNA, 16 bp, M. musculus
acttgcatttttaaaa

SEQ ID NO: 352754 - DNA, 16 bp, M. musculus
acttgccagcacatct

SEQ ID NO: 352755 - DNA, 16 bp, M. musculus
acttgcccaaggtcac

SEQ ID NO: 352756 - DNA, 16 bp, M. musculus
acttgccccaagaaac

SEQ ID NO: 352757 - DNA, 16 bp, M. musculus
acttgcctagcatgca

SEQ ID NO: 352758 - DNA, 16 bp, M. musculus
acttgcctcctggcag

SEQ ID NO: 352759 - DNA, 16 bp, M. musculus
acttgcctggcttcct

SEQ ID NO: 352760 - DNA, 16 bp, M. musculus
acttgccttggccatg

SEQ ID NO: 352761 - DNA, 16 bp, M. musculus
acttgctaccaagcct

SEQ ID NO: 352762 - DNA, 16 bp, M. musculus
acttgctatgtagaac

SEQ ID NO: 352763 - DNA, 16 bp, M. musculus
acttgctattgtggga

SEQ ID NO: 352764 - DNA, 16 bp, M. musculus
acttgctcagcttgct

SEQ ID NO: 352765 - DNA, 16 bp, M. musculus
acttgctgcacaagca

SEQ ID NO: 352766 - DNA, 16 bp, M. musculus
acttgctgtttctcct

SEQ ID NO: 352767 - DNA, 16 bp, M. musculus
acttgcttcccatggc

SEQ ID NO: 352768 - DNA, 16 bp, M. musculus
acttgcttctgtctcc

SEQ ID NO: 352769 - DNA, 16 bp, M. musculus
acttgcttgcttgctt

SEQ ID NO: 352770 - DNA, 16 bp, M. musculus
acttggaaaattgttt

SEQ ID NO: 352771 - DNA, 137 bp, M. musculus
acttggaaagatcacaattggaaaattggtgagaaagacatctggggaagaagtatgtggatagatctctccaaatgggcaaaggatgtgaagatatttgtgtcccatgtaaatgctcaccaaaaggtgacttcagc

SEQ ID NO: 352772 - DNA, 16 bp, M. musculus
acttggaaaggaaagg

SEQ ID NO: 352773 - DNA, 16 bp, M. musculus
acttggaagacaaagg

SEQ ID NO: 352774 - DNA, 16 bp, M. musculus
acttggaagagagaag

SEQ ID NO: 352775 - DNA, 16 bp, M. musculus
acttggaaggcagaag

SEQ ID NO: 352776 - DNA, 16 bp, M. musculus
acttggaaggctgagg

SEQ ID NO: 352777 - DNA, 16 bp, M. musculus
acttggacacttcagc

SEQ ID NO: 352778 - DNA, 16 bp, M. musculus
acttggagaaaaaaaa

SEQ ID NO: 352779 - DNA, 16 bp, M. musculus
acttggagaagctgag

SEQ ID NO: 352780 - DNA, 16 bp, M. musculus
acttggagatgaagaa

SEQ ID NO: 352781 - DNA, 16 bp, M. musculus
acttggaggcaggggc

SEQ ID NO: 352782 - DNA, 16 bp, M. musculus
acttggatcctctgaa

SEQ ID NO: 352783 - DNA, 16 bp, M. musculus
acttggatcctttgga

SEQ ID NO: 352784 - DNA, 16 bp, M. musculus
acttggatgctgggaa

SEQ ID NO: 352785 - DNA, 16 bp, M. musculus
acttggcaacaagcca

SEQ ID NO: 352786 - DNA, 16 bp, M. musculus
acttgggaagctaagg

SEQ ID NO: 352787 - DNA, 16 bp, M. musculus
acttgggaatgaaaaa

SEQ ID NO: 352788 - DNA, 16 bp, M. musculus
acttgggagactgagg

SEQ ID NO: 352789 - DNA, 16 bp, M. musculus
acttgggaggaaaaag

SEQ ID NO: 352790 - DNA, 16 bp, M. musculus
acttgggaggaggcag

SEQ ID NO: 352791 - DNA, 16 bp, M. musculus
acttgggaggccaaag

SEQ ID NO: 352792 - DNA, 16 bp, M. musculus
acttgggaggccaaga

SEQ ID NO: 352793 - DNA, 16 bp, M. musculus
acttgggaggccgagg

SEQ ID NO: 352794 - DNA, 16 bp, M. musculus
acttgggaggctgatg

SEQ ID NO: 352795 - DNA, 16 bp, M. musculus
acttgggaggtcagag

SEQ ID NO: 352796 - DNA, 16 bp, M. musculus
acttgggatgcagaag

SEQ ID NO: 352797 - DNA, 16 bp, M. musculus
acttgggggaaaaaaa

SEQ ID NO: 352798 - DNA, 16 bp, M. musculus
acttggggggcagaga

SEQ ID NO: 352799 - DNA, 16 bp, M. musculus
acttgggtcctctgaa

SEQ ID NO: 352800 - DNA, 17 bp, M. musculus
acttggtaatgtgtaag

SEQ ID NO: 352801 - DNA, 16 bp, M. musculus
acttggtaggcagagg

SEQ ID NO: 352802 - DNA, 16 bp, M. musculus
acttggtattggataa

SEQ ID NO: 352803 - DNA, 16 bp, M. musculus
acttggtctccagctg

SEQ ID NO: 352804 - DNA, 16 bp, M. musculus
acttggtggctcacaa

SEQ ID NO: 352805 - DNA, 16 bp, M. musculus
acttggtgtcctattg

SEQ ID NO: 352806 - DNA, 16 bp, M. musculus
acttggttttgtttgt

SEQ ID NO: 352807 - DNA, 16 bp, M. musculus
acttgtaaataaaata

SEQ ID NO: 352808 - DNA, 16 bp, M. musculus
acttgtaatcctcctg

SEQ ID NO: 352809 - DNA, 16 bp, M. musculus
acttgtacacataaaa

SEQ ID NO: 352810 - DNA, 16 bp, M. musculus
acttgtccatttcttc

SEQ ID NO: 352811 - DNA, 16 bp, M. musculus
acttgtgattgatttc

SEQ ID NO: 352812 - DNA, 16 bp, M. musculus
acttgtgattttcctg

SEQ ID NO: 352813 - DNA, 16 bp, M. musculus
acttgtgccccagatc

SEQ ID NO: 352814 - DNA, 17 bp, M. musculus
acttgtgcccctggtca

SEQ ID NO: 352815 - DNA, 16 bp, M. musculus
acttgtggaggcccac

SEQ ID NO: 352816 - DNA, 16 bp, M. musculus
acttgtgggaatcagt

SEQ ID NO: 352817 - DNA, 16 bp, M. musculus
acttgtgggagttggt

SEQ ID NO: 352818 - DNA, 16 bp, M. musculus
acttgtgtggaggtca

SEQ ID NO: 352819 - DNA, 16 bp, M. musculus
acttgttcctcttgca

SEQ ID NO: 352820 - DNA, 16 bp, M. musculus
acttgttcctgtctga

SEQ ID NO: 352821 - DNA, 16 bp, M. musculus
acttgttctgtagact

SEQ ID NO: 352822 - DNA, 16 bp, M. musculus
acttgttgcttttgca

SEQ ID NO: 352823 - DNA, 16 bp, M. musculus
acttgtttcaaattca

SEQ ID NO: 352824 - DNA, 16 bp, M. musculus
acttgtttggtttggt

SEQ ID NO: 352825 - DNA, 16 bp, M. musculus
acttgttttgttagag

SEQ ID NO: 352826 - DNA, 16 bp, M. musculus
acttgtttttgcagag

SEQ ID NO: 352827 - DNA, 16 bp, M. musculus
actttaaaaaagaaag

SEQ ID NO: 352828 - DNA, 16 bp, M. musculus
actttaaaaactatac

SEQ ID NO: 352829 - DNA, 16 bp, M. musculus
actttaaaaaggaaag

SEQ ID NO: 352830 - DNA, 16 bp, M. musculus
actttaaaaatgataa

SEQ ID NO: 352831 - DNA, 16 bp, M. musculus
actttaaagaaaaata

SEQ ID NO: 352832 - DNA, 16 bp, M. musculus
actttaacttttaaaa

SEQ ID NO: 352833 - DNA, 16 bp, M. musculus
actttaagaaatacag

SEQ ID NO: 352834 - DNA, 16 bp, M. musculus
actttaataagggttc

SEQ ID NO: 352835 - DNA, 16 bp, M. musculus
actttaatcctagcac

SEQ ID NO: 352836 - DNA, 16 bp, M. musculus
actttaattaaaatgt

SEQ ID NO: 352837 - DNA, 16 bp, M. musculus
actttacaataatgtt

SEQ ID NO: 352838 - DNA, 16 bp, M. musculus
actttaccaactgagc

SEQ ID NO: 352839 - DNA, 16 bp, M. musculus
actttaccaattgagc

SEQ ID NO: 352840 - DNA, 16 bp, M. musculus
actttactggaaggct

SEQ ID NO: 352841 - DNA, 16 bp, M. musculus
actttagaggcagagg

SEQ ID NO: 352842 - DNA, 16 bp, M. musculus
actttagccactgagc

SEQ ID NO: 352843 - DNA, 16 bp, M. musculus
actttagtttttgaga

SEQ ID NO: 352844 - DNA, 16 bp, M. musculus
actttatagctaatat

SEQ ID NO: 352845 - DNA, 16 bp, M. musculus
actttatatacatata

SEQ ID NO: 352846 - DNA, 16 bp, M. musculus
actttatattcccctc

SEQ ID NO: 352847 - DNA, 16 bp, M. musculus
actttatgaagatgat

SEQ ID NO: 352848 - DNA, 16 bp, M. musculus
actttattctaagttt

SEQ ID NO: 352849 - DNA, 16 bp, M. musculus
actttatttaaatgca

SEQ ID NO: 352850 - DNA, 16 bp, M. musculus
actttatttatgttca

SEQ ID NO: 352851 - DNA, 16 bp, M. musculus
actttattttggataa

SEQ ID NO: 352852 - DNA, 16 bp, M. musculus
actttatttttgaaat

SEQ ID NO: 352853 - DNA, 16 bp, M. musculus
actttcaaccaaaatt

SEQ ID NO: 352854 - DNA, 16 bp, M. musculus
actttcaaccccaaat

SEQ ID NO: 352855 - DNA, 16 bp, M. musculus
actttcaatttaaaaa

SEQ ID NO: 352856 - DNA, 16 bp, M. musculus
actttcactaatatct

SEQ ID NO: 352857 - DNA, 17 bp, M. musculus
actttcagatacattaa

SEQ ID NO: 352858 - DNA, 16 bp, M. musculus
actttcaggaaagcat

SEQ ID NO: 352859 - DNA, 16 bp, M. musculus
actttcaggaatcagt

SEQ ID NO: 352860 - DNA, 16 bp, M. musculus
actttcagtggagtcc

SEQ ID NO: 352861 - DNA, 16 bp, M. musculus
actttcatatcatctg

SEQ ID NO: 352862 - DNA, 16 bp, M. musculus
actttcatgaattaat

SEQ ID NO: 352863 - DNA, 16 bp, M. musculus
actttcatgtagtaat

SEQ ID NO: 352864 - DNA, 16 bp, M. musculus
actttccaaactgtac

SEQ ID NO: 352865 - DNA, 16 bp, M. musculus
actttccctagctcct

SEQ ID NO: 352866 - DNA, 16 bp, M. musculus
actttccctgtcttct

SEQ ID NO: 352867 - DNA, 16 bp, M. musculus
actttcctccctacta

SEQ ID NO: 352868 - DNA, 16 bp, M. musculus
actttccttactctcc

SEQ ID NO: 352869 - DNA, 16 bp, M. musculus
actttctaaattttaa

SEQ ID NO: 352870 - DNA, 16 bp, M. musculus
actttctagttctttc

SEQ ID NO: 352871 - DNA, 22 bp, M. musculus
actttctcctctataagtttca

SEQ ID NO: 352872 - DNA, 41 bp, M. musculus
actttctcctctataagtttcagtgtctctggttttatgtg

SEQ ID NO: 352873 - DNA, 16 bp, M. musculus
actttctctaaatcct

SEQ ID NO: 352874 - DNA, 16 bp, M. musculus
actttctctagcgcct

SEQ ID NO: 352875 - DNA, 16 bp, M. musculus
actttctctagcttcc

SEQ ID NO: 352876 - DNA, 16 bp, M. musculus
actttctctccatatt

SEQ ID NO: 352877 - DNA, 16 bp, M. musculus
actttctcttctacca

SEQ ID NO: 352878 - DNA, 16 bp, M. musculus
actttctcttgctcct

SEQ ID NO: 352879 - DNA, 16 bp, M. musculus
actttctgaaaaaaaa

SEQ ID NO: 352880 - DNA, 16 bp, M. musculus
actttctgctggagac

SEQ ID NO: 352881 - DNA, 16 bp, M. musculus
actttctgtctctgtc

SEQ ID NO: 352882 - DNA, 16 bp, M. musculus
actttcttcattcaca

SEQ ID NO: 352883 - DNA, 16 bp, M. musculus
actttcttctggcttc

SEQ ID NO: 352884 - DNA, 16 bp, M. musculus
actttcttgttctttc

SEQ ID NO: 352885 - DNA, 16 bp, M. musculus
actttctttcctttag

SEQ ID NO: 352886 - DNA, 16 bp, M. musculus
actttgaaagccagaa

SEQ ID NO: 352887 - DNA, 16 bp, M. musculus
actttgaaatattaaa

SEQ ID NO: 352888 - DNA, 16 bp, M. musculus
actttgaaatatttta

SEQ ID NO: 352889 - DNA, 16 bp, M. musculus
actttgaaattttaaa

SEQ ID NO: 352890 - DNA, 16 bp, M. musculus
actttgaacatttcat

SEQ ID NO: 352891 - DNA, 16 bp, M. musculus
actttgaactcagaga

SEQ ID NO: 352892 - DNA, 16 bp, M. musculus
actttgaattattgat

SEQ ID NO: 352893 - DNA, 16 bp, M. musculus
actttgacaaattaca

SEQ ID NO: 352894 - DNA, 16 bp, M. musculus
actttgacatcttcct

SEQ ID NO: 352895 - DNA, 40 bp, M. musculus
actttgactcctctggcgtaaattgggtgaaatctatcac

SEQ ID NO: 352896 - DNA, 16 bp, M. musculus
actttgagaaattaca

SEQ ID NO: 352897 - DNA, 16 bp, M. musculus
actttgagatttttat

SEQ ID NO: 352898 - DNA, 16 bp, M. musculus
actttgagcctgtcac

SEQ ID NO: 352899 - DNA, 16 bp, M. musculus
actttgaggtcagcct

SEQ ID NO: 352900 - DNA, 16 bp, M. musculus
actttgagttggaagt

SEQ ID NO: 352901 - DNA, 16 bp, M. musculus
actttgagttttcttt

SEQ ID NO: 352902 - DNA, 16 bp, M. musculus
actttgatgaatatga

SEQ ID NO: 352903 - DNA, 16 bp, M. musculus
actttgatgagaatga

SEQ ID NO: 352904 - DNA, 16 bp, M. musculus
actttgatttcatttt

SEQ ID NO: 352905 - DNA, 16 bp, M. musculus
actttgcaaaacacat

SEQ ID NO: 352906 - DNA, 16 bp, M. musculus
actttgcatatatata

SEQ ID NO: 352907 - DNA, 19 bp, M. musculus
actttgccccttcttagaa

SEQ ID NO: 352908 - DNA, 16 bp, M. musculus
actttgctcttcattc

SEQ ID NO: 352909 - DNA, 16 bp, M. musculus
actttgctgaagctgt

SEQ ID NO: 352910 - DNA, 16 bp, M. musculus
actttgcttggccagg

SEQ ID NO: 352911 - DNA, 16 bp, M. musculus
actttgcttgtttgtt

SEQ ID NO: 352912 - DNA, 16 bp, M. musculus
actttgcttttgtcac

SEQ ID NO: 352913 - DNA, 16 bp, M. musculus
actttggaaaaaaaaa

SEQ ID NO: 352914 - DNA, 16 bp, M. musculus
actttggactagaaaa

SEQ ID NO: 352915 - DNA, 16 bp, M. musculus
actttggacttcattc

SEQ ID NO: 352916 - DNA, 16 bp, M. musculus
actttggacttttaaa

SEQ ID NO: 352917 - DNA, 16 bp, M. musculus
actttggaggcagaga

SEQ ID NO: 352918 - DNA, 16 bp, M. musculus
actttggaggtagagg

SEQ ID NO: 352919 - DNA, 16 bp, M. musculus
actttggagtttcatg

SEQ ID NO: 352920 - DNA, 16 bp, M. musculus
actttggattaggaaa

SEQ ID NO: 352921 - DNA, 16 bp, M. musculus
actttggcttggaagt

SEQ ID NO: 352922 - DNA, 16 bp, M. musculus
actttgggttggaagt

SEQ ID NO: 352923 - DNA, 16 bp, M. musculus
actttggtaccaggta

SEQ ID NO: 352924 - DNA, 16 bp, M. musculus
actttggtctttcttc

SEQ ID NO: 352925 - DNA, 16 bp, M. musculus
actttggtgcctggta

SEQ ID NO: 352926 - DNA, 16 bp, M. musculus
actttggtttatccat

SEQ ID NO: 352927 - DNA, 16 bp, M. musculus
actttgtacaagaaga

SEQ ID NO: 352928 - DNA, 16 bp, M. musculus
actttgtataccaggc

SEQ ID NO: 352929 - DNA, 16 bp, M. musculus
actttgtattatttat

SEQ ID NO: 352930 - DNA, 16 bp, M. musculus
actttgtcatttgcta

SEQ ID NO: 352931 - DNA, 16 bp, M. musculus
actttgtccctgcatt

SEQ ID NO: 352932 - DNA, 16 bp, M. musculus
actttgtctcaaaaga

SEQ ID NO: 352933 - DNA, 16 bp, M. musculus
actttgtctccttcca

SEQ ID NO: 352934 - DNA, 16 bp, M. musculus
actttgtcttccttct

SEQ ID NO: 352935 - DNA, 16 bp, M. musculus
actttgtctttaaaaa

SEQ ID NO: 352936 - DNA, 16 bp, M. musculus
actttgtgcctccttc

SEQ ID NO: 352937 - DNA, 16 bp, M. musculus
actttgttccttctta

SEQ ID NO: 352938 - DNA, 16 bp, M. musculus
actttgttgatttcag

SEQ ID NO: 352939 - DNA, 17 bp, M. musculus
actttgttgctgggagt

SEQ ID NO: 352940 - DNA, 16 bp, M. musculus
actttgtttctagagg

SEQ ID NO: 352941 - DNA, 16 bp, M. musculus
actttgttttttccat

SEQ ID NO: 352942 - DNA, 16 bp, M. musculus
acttttaaaaaatgtt

SEQ ID NO: 352943 - DNA, 16 bp, M. musculus
acttttaaaaaattct

SEQ ID NO: 352944 - DNA, 16 bp, M. musculus
acttttaaaaacattt

SEQ ID NO: 352945 - DNA, 16 bp, M. musculus
acttttaaaaagcaaa

SEQ ID NO: 352946 - DNA, 16 bp, M. musculus
acttttaaaagagaaa

SEQ ID NO: 352947 - DNA, 16 bp, M. musculus
acttttaaaagttatt

SEQ ID NO: 352948 - DNA, 16 bp, M. musculus
acttttaaaattagat

SEQ ID NO: 352949 - DNA, 16 bp, M. musculus
acttttaaaattgttt

SEQ ID NO: 352950 - DNA, 16 bp, M. musculus
acttttaaagaaaaat

SEQ ID NO: 352951 - DNA, 16 bp, M. musculus
acttttaaagttattt

SEQ ID NO: 352952 - DNA, 16 bp, M. musculus
acttttaaagttgttt

SEQ ID NO: 352953 - DNA, 16 bp, M. musculus
acttttaaatatttca

SEQ ID NO: 352954 - DNA, 16 bp, M. musculus
acttttaactactgag

SEQ ID NO: 352955 - DNA, 16 bp, M. musculus
acttttaacttttaaa

SEQ ID NO: 352956 - DNA, 16 bp, M. musculus
acttttaatcctcctg

SEQ ID NO: 352957 - DNA, 16 bp, M. musculus
acttttaatggctgct

SEQ ID NO: 352958 - DNA, 16 bp, M. musculus
acttttacaaaggaaa

SEQ ID NO: 352959 - DNA, 16 bp, M. musculus
acttttagcttcagaa

SEQ ID NO: 352960 - DNA, 16 bp, M. musculus
acttttagtttttaaa

SEQ ID NO: 352961 - DNA, 16 bp, M. musculus
acttttatataaaagt

SEQ ID NO: 352962 - DNA, 16 bp, M. musculus
acttttatttaaaaca

SEQ ID NO: 352963 - DNA, 16 bp, M. musculus
acttttatttttagat

SEQ ID NO: 352964 - DNA, 16 bp, M. musculus
acttttcaaatacatt

SEQ ID NO: 352965 - DNA, 16 bp, M. musculus
acttttcaaatatatt

SEQ ID NO: 352966 - DNA, 16 bp, M. musculus
acttttccctaattca

SEQ ID NO: 352967 - DNA, 16 bp, M. musculus
acttttctacattcca

SEQ ID NO: 352968 - DNA, 16 bp, M. musculus
acttttctcattgctg

SEQ ID NO: 352969 - DNA, 16 bp, M. musculus
acttttctcctgtgcc

SEQ ID NO: 352970 - DNA, 16 bp, M. musculus
acttttctgctgctgt

SEQ ID NO: 352971 - DNA, 16 bp, M. musculus
acttttgaaaaatatt

SEQ ID NO: 352972 - DNA, 16 bp, M. musculus
acttttgaaaagaaaa

SEQ ID NO: 352973 - DNA, 16 bp, M. musculus
acttttgatgactgct

SEQ ID NO: 352974 - DNA, 16 bp, M. musculus
acttttgcagaggact

SEQ ID NO: 352975 - DNA, 16 bp, M. musculus
acttttgcatcaatgt

SEQ ID NO: 352976 - DNA, 16 bp, M. musculus
acttttggctgaaagt

SEQ ID NO: 352977 - DNA, 16 bp, M. musculus
acttttggtatatcat

SEQ ID NO: 352978 - DNA, 16 bp, M. musculus
acttttgtttttcaag

SEQ ID NO: 352979 - DNA, 16 bp, M. musculus
actttttaaaagaaag

SEQ ID NO: 352980 - DNA, 16 bp, M. musculus
actttttaaaagaaat

SEQ ID NO: 352981 - DNA, 16 bp, M. musculus
actttttaaaaggcaa

SEQ ID NO: 352982 - DNA, 16 bp, M. musculus
actttttaaaagtaaa

SEQ ID NO: 352983 - DNA, 16 bp, M. musculus
actttttaaaagttaa

SEQ ID NO: 352984 - DNA, 16 bp, M. musculus
actttttaaagaaata

SEQ ID NO: 352985 - DNA, 16 bp, M. musculus
actttttcagaaactg

SEQ ID NO: 352986 - DNA, 16 bp, M. musculus
actttttcttttaaca

SEQ ID NO: 352987 - DNA, 16 bp, M. musculus
actttttggaatttaa

SEQ ID NO: 352988 - DNA, 16 bp, M. musculus
actttttggagtgtaa

SEQ ID NO: 352989 - DNA, 16 bp, M. musculus
actttttggtcctggc

SEQ ID NO: 352990 - DNA, 16 bp, M. musculus
acttttttaaaaaaga

SEQ ID NO: 352991 - DNA, 16 bp, M. musculus
acttttttggggggag

SEQ ID NO: 352992 - DNA, 16 bp, M. musculus
actttttttttaaaga

SEQ ID NO: 352993 - DNA, 16 bp, M. musculus
agaaaaaaaaagtctt

SEQ ID NO: 352994 - DNA, 16 bp, M. musculus
agaaaaaaaaatcctg

SEQ ID NO: 352995 - DNA, 16 bp, M. musculus
agaaaaaaaaatgccc

SEQ ID NO: 352996 - DNA, 16 bp, M. musculus
agaaaaaaaaattgtc

SEQ ID NO: 352997 - DNA, 16 bp, M. musculus
agaaaaaaaatccttt

SEQ ID NO: 352998 - DNA, 16 bp, M. musculus
agaaaaaaaatgcatt

SEQ ID NO: 352999 - DNA, 16 bp, M. musculus
agaaaaaaaatgccag

SEQ ID NO: 353000 - DNA, 16 bp, M. musculus
agaaaaaaaatgtttg

SEQ ID NO: 353001 - DNA, 16 bp, M. musculus
agaaaaaaacatgttt

SEQ ID NO: 353002 - DNA, 16 bp, M. musculus
agaaaaaaaccacatg

SEQ ID NO: 353003 - DNA, 16 bp, M. musculus
agaaaaaaagacattt

SEQ ID NO: 353004 - DNA, 16 bp, M. musculus
agaaaaaaatagcatt

SEQ ID NO: 353005 - DNA, 16 bp, M. musculus
agaaaaaaatcaagtt

SEQ ID NO: 353006 - DNA, 16 bp, M. musculus
agaaaaaaatctattt

SEQ ID NO: 353007 - DNA, 16 bp, M. musculus
agaaaaaaatctcatt

SEQ ID NO: 353008 - DNA, 16 bp, M. musculus
agaaaaaaatctgcat

SEQ ID NO: 353009 - DNA, 16 bp, M. musculus
agaaaaaaatcttttt

SEQ ID NO: 353010 - DNA, 16 bp, M. musculus
agaaaaaaatggattt

SEQ ID NO: 353011 - DNA, 16 bp, M. musculus
agaaaaaaatggtttt

SEQ ID NO: 353012 - DNA, 16 bp, M. musculus
agaaaaaaatgtgtct

SEQ ID NO: 353013 - DNA, 16 bp, M. musculus
agaaaaaaattacctt

SEQ ID NO: 353014 - DNA, 16 bp, M. musculus
agaaaaaaattctctt

SEQ ID NO: 353015 - DNA, 16 bp, M. musculus
agaaaaaaattctttt

SEQ ID NO: 353016 - DNA, 16 bp, M. musculus
agaaaaaactcagccc

SEQ ID NO: 353017 - DNA, 16 bp, M. musculus
agaaaaaagccacatg

SEQ ID NO: 353018 - DNA, 16 bp, M. musculus
agaaaaaatggctatc

SEQ ID NO: 353019 - DNA, 16 bp, M. musculus
agaaaaacaaatgcca

SEQ ID NO: 353020 - DNA, 16 bp, M. musculus
agaaaaacaaatgttt

SEQ ID NO: 353021 - DNA, 16 bp, M. musculus
agaaaaacaaattatt

SEQ ID NO: 353022 - DNA, 16 bp, M. musculus
agaaaaacatatccca

SEQ ID NO: 353023 - DNA, 16 bp, M. musculus
agaaaaacatcatgtg

SEQ ID NO: 353024 - DNA, 16 bp, M. musculus
agaaaaacatgaggaa

SEQ ID NO: 353025 - DNA, 16 bp, M. musculus
agaaaaaccctgtctt

SEQ ID NO: 353026 - DNA, 16 bp, M. musculus
agaaaaactcaaagca

SEQ ID NO: 353027 - DNA, 16 bp, M. musculus
agaaaaagaaaaggct

SEQ ID NO: 353028 - DNA, 16 bp, M. musculus
agaaaaagaaaatctg

SEQ ID NO: 353029 - DNA, 16 bp, M. musculus
agaaaaagaaatctga

SEQ ID NO: 353030 - DNA, 16 bp, M. musculus
agaaaaagaaggtcca

SEQ ID NO: 353031 - DNA, 16 bp, M. musculus
agaaaaagatattcca

SEQ ID NO: 353032 - DNA, 16 bp, M. musculus
agaaaaagcaaaatgc

SEQ ID NO: 353033 - DNA, 16 bp, M. musculus
agaaaaaggaaaactc

SEQ ID NO: 353034 - DNA, 16 bp, M. musculus
agaaaaaggaacactt

SEQ ID NO: 353035 - DNA, 16 bp, M. musculus
agaaaaaggaacattc

SEQ ID NO: 353036 - DNA, 16 bp, M. musculus
agaaaaaggacagaat

SEQ ID NO: 353037 - DNA, 16 bp, M. musculus
agaaaaaggacccaag

SEQ ID NO: 353038 - DNA, 16 bp, M. musculus
agaaaaagtaattgtt

SEQ ID NO: 353039 - DNA, 16 bp, M. musculus
agaaaaagttcaaggt

SEQ ID NO: 353040 - DNA, 16 bp, M. musculus
agaaaaagttttattt

SEQ ID NO: 353041 - DNA, 16 bp, M. musculus
agaaaaataaacattt

SEQ ID NO: 353042 - DNA, 16 bp, M. musculus
agaaaaataaatctgt

SEQ ID NO: 353043 - DNA, 16 bp, M. musculus
agaaaaataacacttt

SEQ ID NO: 353044 - DNA, 16 bp, M. musculus
agaaaaataatctttt

SEQ ID NO: 353045 - DNA, 16 bp, M. musculus
agaaaaatacttttta

SEQ ID NO: 353046 - DNA, 16 bp, M. musculus
agaaaaatagatacag

SEQ ID NO: 353047 - DNA, 16 bp, M. musculus
agaaaaatattcaaat

SEQ ID NO: 353048 - DNA, 16 bp, M. musculus
agaaaaatcaagattt

SEQ ID NO: 353049 - DNA, 16 bp, M. musculus
agaaaaatcacatttt

SEQ ID NO: 353050 - DNA, 16 bp, M. musculus
agaaaaatcagaatat

SEQ ID NO: 353051 - DNA, 16 bp, M. musculus
agaaaaatcagcattt

SEQ ID NO: 353052 - DNA, 16 bp, M. musculus
agaaaaatcatatttt

SEQ ID NO: 353053 - DNA, 16 bp, M. musculus
agaaaaatcattatga

SEQ ID NO: 353054 - DNA, 16 bp, M. musculus
agaaaaatctcagaaa

SEQ ID NO: 353055 - DNA, 16 bp, M. musculus
agaaaaatctctgcaa

SEQ ID NO: 353056 - DNA, 16 bp, M. musculus
agaaaaatctgaaaat

SEQ ID NO: 353057 - DNA, 16 bp, M. musculus
agaaaaatctgcaaat

SEQ ID NO: 353058 - DNA, 16 bp, M. musculus
agaaaaatcttaaaat

SEQ ID NO: 353059 - DNA, 16 bp, M. musculus
agaaaaatcttcaaat

SEQ ID NO: 353060 - DNA, 16 bp, M. musculus
agaaaaatcttgttgg

SEQ ID NO: 353061 - DNA, 16 bp, M. musculus
agaaaaatctttgacc

SEQ ID NO: 353062 - DNA, 16 bp, M. musculus
agaaaaatgactcttc

SEQ ID NO: 353063 - DNA, 16 bp, M. musculus
agaaaaatgtaaaact

SEQ ID NO: 353064 - DNA, 16 bp, M. musculus
agaaaaatgtgaattt

SEQ ID NO: 353065 - DNA, 16 bp, M. musculus
agaaaaatgttcattt

SEQ ID NO: 353066 - DNA, 16 bp, M. musculus
agaaaaattagtattt

SEQ ID NO: 353067 - DNA, 16 bp, M. musculus
agaaaaattcatttta

SEQ ID NO: 353068 - DNA, 16 bp, M. musculus
agaaaaattgatttgc

SEQ ID NO: 353069 - DNA, 16 bp, M. musculus
agaaaaatttgaatgt

SEQ ID NO: 353070 - DNA, 16 bp, M. musculus
agaaaaattttccaag

SEQ ID NO: 353071 - DNA, 16 bp, M. musculus
agaaaacaaaaactgt

SEQ ID NO: 353072 - DNA, 16 bp, M. musculus
agaaaacaaaatattc

SEQ ID NO: 353073 - DNA, 16 bp, M. musculus
agaaaacaaataggca

SEQ ID NO: 353074 - DNA, 16 bp, M. musculus
agaaaacaatttttaa

SEQ ID NO: 353075 - DNA, 16 bp, M. musculus
agaaaacacaatggaa

SEQ ID NO: 353076 - DNA, 16 bp, M. musculus
agaaaacacagagaat

SEQ ID NO: 353077 - DNA, 16 bp, M. musculus
agaaaacacagatact

SEQ ID NO: 353078 - DNA, 16 bp, M. musculus
agaaaacacaggaagt

SEQ ID NO: 353079 - DNA, 16 bp, M. musculus
agaaaacacttcacag

SEQ ID NO: 353080 - DNA, 16 bp, M. musculus
agaaaacagaaaccat

SEQ ID NO: 353081 - DNA, 16 bp, M. musculus
agaaaacagaaagctg

SEQ ID NO: 353082 - DNA, 16 bp, M. musculus
agaaaacagaaatgtg

SEQ ID NO: 353083 - DNA, 16 bp, M. musculus
agaaaacagactgaaa

SEQ ID NO: 353084 - DNA, 16 bp, M. musculus
agaaaacagactgagc

SEQ ID NO: 353085 - DNA, 16 bp, M. musculus
agaaaacagattttta

SEQ ID NO: 353086 - DNA, 16 bp, M. musculus
agaaaacaggtaaaca

SEQ ID NO: 353087 - DNA, 16 bp, M. musculus
agaaaacagttcccag

SEQ ID NO: 353088 - DNA, 16 bp, M. musculus
agaaaacataaatatt

SEQ ID NO: 353089 - DNA, 16 bp, M. musculus
agaaaacatctgcaca

SEQ ID NO: 353090 - DNA, 16 bp, M. musculus
agaaaacatgagagaa

SEQ ID NO: 353091 - DNA, 16 bp, M. musculus
agaaaacatggacaca

SEQ ID NO: 353092 - DNA, 16 bp, M. musculus
agaaaacattgacaga

SEQ ID NO: 353093 - DNA, 16 bp, M. musculus
agaaaacatttaacaa

SEQ ID NO: 353094 - DNA, 16 bp, M. musculus
agaaaacatttaatta

SEQ ID NO: 353095 - DNA, 16 bp, M. musculus
agaaaacatttctttt

SEQ ID NO: 353096 - DNA, 16 bp, M. musculus
agaaaacatttgaaat

SEQ ID NO: 353097 - DNA, 16 bp, M. musculus
agaaaacattttcaaa

SEQ ID NO: 353098 - DNA, 16 bp, M. musculus
agaaaacattttgaaa

SEQ ID NO: 353099 - DNA, 16 bp, M. musculus
agaaaacatttttttt

SEQ ID NO: 353100 - DNA, 16 bp, M. musculus
agaaaaccaagaagat

SEQ ID NO: 353101 - DNA, 28 bp, M. musculus
agaaaaccacacctgatgcaaactgcaa

SEQ ID NO: 353102 - DNA, 16 bp, M. musculus
agaaaacccattttta

SEQ ID NO: 353103 - DNA, 16 bp, M. musculus
agaaaacctatgaaag

SEQ ID NO: 353104 - DNA, 16 bp, M. musculus
agaaaactaatttaaa

SEQ ID NO: 353105 - DNA, 16 bp, M. musculus
agaaaactattttaaa

SEQ ID NO: 353106 - DNA, 16 bp, M. musculus
agaaaactatttttaa

SEQ ID NO: 353107 - DNA, 16 bp, M. musculus
agaaaactccaagaaa

SEQ ID NO: 353108 - DNA, 16 bp, M. musculus
agaaaactgaaaatca

SEQ ID NO: 353109 - DNA, 16 bp, M. musculus
agaaaactgaagctgg

SEQ ID NO: 353110 - DNA, 16 bp, M. musculus
agaaaactgactgctc

SEQ ID NO: 353111 - DNA, 16 bp, M. musculus
agaaaactgggaattg

SEQ ID NO: 353112 - DNA, 16 bp, M. musculus
agaaaactttccaaac

SEQ ID NO: 353113 - DNA, 16 bp, M. musculus
agaaaacttttatttt

SEQ ID NO: 353114 - DNA, 16 bp, M. musculus
agaaaacttttttaaa

SEQ ID NO: 353115 - DNA, 16 bp, M. musculus
agaaaagaaaacttta

SEQ ID NO: 353116 - DNA, 16 bp, M. musculus
agaaaagaaaagctca

SEQ ID NO: 353117 - DNA, 16 bp, M. musculus
agaaaagaaacatttc

SEQ ID NO: 353118 - DNA, 16 bp, M. musculus
agaaaagaaactgaag

SEQ ID NO: 353119 - DNA, 16 bp, M. musculus
agaaaagaaagacatt

SEQ ID NO: 353120 - DNA, 16 bp, M. musculus
agaaaagaaatcagga

SEQ ID NO: 353121 - DNA, 16 bp, M. musculus
agaaaagaaatggttt

SEQ ID NO: 353122 - DNA, 17 bp, M. musculus
agaaaagaaattcctcc

SEQ ID NO: 353123 - DNA, 16 bp, M. musculus
agaaaagaacacattt

SEQ ID NO: 353124 - DNA, 16 bp, M. musculus
agaaaagaagcagcca

SEQ ID NO: 353125 - DNA, 16 bp, M. musculus
agaaaagaatcacaca

SEQ ID NO: 353126 - DNA, 16 bp, M. musculus
agaaaagaatctattt

SEQ ID NO: 353127 - DNA, 16 bp, M. musculus
agaaaagacagaatct

SEQ ID NO: 353128 - DNA, 16 bp, M. musculus
agaaaagaccatacag

SEQ ID NO: 353129 - DNA, 16 bp, M. musculus
agaaaagatagcatct

SEQ ID NO: 353130 - DNA, 16 bp, M. musculus
agaaaagatcaggcct

SEQ ID NO: 353131 - DNA, 16 bp, M. musculus
agaaaagatgaagtca

SEQ ID NO: 353132 - DNA, 16 bp, M. musculus
agaaaagatggtaaat

SEQ ID NO: 353133 - DNA, 16 bp, M. musculus
agaaaagattcaaaga

SEQ ID NO: 353134 - DNA, 16 bp, M. musculus
agaaaagattcaaagg

SEQ ID NO: 353135 - DNA, 16 bp, M. musculus
agaaaagattttgaaa

SEQ ID NO: 353136 - DNA, 16 bp, M. musculus
agaaaagcaatggctt

SEQ ID NO: 353137 - DNA, 16 bp, M. musculus
agaaaagcactctacc

SEQ ID NO: 353138 - DNA, 17 bp, M. musculus
agaaaagcagttatccc

SEQ ID NO: 353139 - DNA, 16 bp, M. musculus
agaaaagcattagcag

SEQ ID NO: 353140 - DNA, 16 bp, M. musculus
agaaaagctggaagaa

SEQ ID NO: 353141 - DNA, 16 bp, M. musculus
agaaaaggaaactaga

SEQ ID NO: 353142 - DNA, 16 bp, M. musculus
agaaaaggaaactgag

SEQ ID NO: 353143 - DNA, 16 bp, M. musculus
agaaaaggaaatagca

SEQ ID NO: 353144 - DNA, 16 bp, M. musculus
agaaaaggaactaaga

SEQ ID NO: 353145 - DNA, 16 bp, M. musculus
agaaaaggaagaactt

SEQ ID NO: 353146 - DNA, 16 bp, M. musculus
agaaaaggaagccagg

SEQ ID NO: 353147 - DNA, 16 bp, M. musculus
agaaaaggaatctgca

SEQ ID NO: 353148 - DNA, 16 bp, M. musculus
agaaaaggagtctgca

SEQ ID NO: 353149 - DNA, 16 bp, M. musculus
agaaaaggccaagctg

SEQ ID NO: 353150 - DNA, 16 bp, M. musculus
agaaaagggaatcaga

SEQ ID NO: 353151 - DNA, 16 bp, M. musculus
agaaaagggagcttca

SEQ ID NO: 353152 - DNA, 16 bp, M. musculus
agaaaagggcatcaga

SEQ ID NO: 353153 - DNA, 16 bp, M. musculus
agaaaaggggaggcct

SEQ ID NO: 353154 - DNA, 16 bp, M. musculus
agaaaagggtgacaaa

SEQ ID NO: 353155 - DNA, 16 bp, M. musculus
agaaaagggtgtcaga

SEQ ID NO: 353156 - DNA, 16 bp, M. musculus
agaaaagggtgtgtgt

SEQ ID NO: 353157 - DNA, 16 bp, M. musculus
agaaaagtaccagcca

SEQ ID NO: 353158 - DNA, 16 bp, M. musculus
agaaaagtcttggaaa

SEQ ID NO: 353159 - DNA, 16 bp, M. musculus
agaaaagtgaaattct

SEQ ID NO: 353160 - DNA, 16 bp, M. musculus
agaaaagttattttta

SEQ ID NO: 353161 - DNA, 16 bp, M. musculus
agaaaataaaacattc

SEQ ID NO: 353162 - DNA, 16 bp, M. musculus
agaaaataaaacttga

SEQ ID NO: 353163 - DNA, 16 bp, M. musculus
agaaaataaaatcact

SEQ ID NO: 353164 - DNA, 16 bp, M. musculus
agaaaataaacattta

SEQ ID NO: 353165 - DNA, 16 bp, M. musculus
agaaaataaaggaagc

SEQ ID NO: 353166 - DNA, 16 bp, M. musculus
agaaaataaatatttc

SEQ ID NO: 353167 - DNA, 16 bp, M. musculus
agaaaataacacacac

SEQ ID NO: 353168 - DNA, 16 bp, M. musculus
agaaaataatcaaatt

SEQ ID NO: 353169 - DNA, 16 bp, M. musculus
agaaaataatctaata

SEQ ID NO: 353170 - DNA, 16 bp, M. musculus
agaaaataatttttct

SEQ ID NO: 353171 - DNA, 16 bp, M. musculus
agaaaatacaatattt

SEQ ID NO: 353172 - DNA, 16 bp, M. musculus
agaaaatacatatttt

SEQ ID NO: 353173 - DNA, 16 bp, M. musculus
agaaaatacattattt

SEQ ID NO: 353174 - DNA, 16 bp, M. musculus
agaaaatactagaaga

SEQ ID NO: 353175 - DNA, 16 bp, M. musculus
agaaaatactttaaaa

SEQ ID NO: 353176 - DNA, 16 bp, M. musculus
agaaaatactttttaa

SEQ ID NO: 353177 - DNA, 16 bp, M. musculus
agaaaatagagacaga

SEQ ID NO: 353178 - DNA, 16 bp, M. musculus
agaaaatatacattta

SEQ ID NO: 353179 - DNA, 16 bp, M. musculus
agaaaatatattttct

SEQ ID NO: 353180 - DNA, 16 bp, M. musculus
agaaaatatcatcttt

SEQ ID NO: 353181 - DNA, 16 bp, M. musculus
agaaaatatggacaca

SEQ ID NO: 353182 - DNA, 16 bp, M. musculus
agaaaatatgtgtgtg

SEQ ID NO: 353183 - DNA, 16 bp, M. musculus
agaaaatattcaataa

SEQ ID NO: 353184 - DNA, 16 bp, M. musculus
agaaaatattcagaaa

SEQ ID NO: 353185 - DNA, 16 bp, M. musculus
agaaaatattgtttta

SEQ ID NO: 353186 - DNA, 16 bp, M. musculus
agaaaatattttagtg

SEQ ID NO: 353187 - DNA, 16 bp, M. musculus
agaaaatattttcaat

SEQ ID NO: 353188 - DNA, 16 bp, M. musculus
agaaaatattttccat

SEQ ID NO: 353189 - DNA, 17 bp, M. musculus
agaaaatcaaataaccc

SEQ ID NO: 353190 - DNA, 16 bp, M. musculus
agaaaatcaagaagat

SEQ ID NO: 353191 - DNA, 16 bp, M. musculus
agaaaatcaagaagca

SEQ ID NO: 353192 - DNA, 16 bp, M. musculus
agaaaatcatttgatc

SEQ ID NO: 353193 - DNA, 16 bp, M. musculus
agaaaatccactttgg

SEQ ID NO: 353194 - DNA, 16 bp, M. musculus
agaaaatctaagaaag

SEQ ID NO: 353195 - DNA, 16 bp, M. musculus
agaaaatctttttttt

SEQ ID NO: 353196 - DNA, 16 bp, M. musculus
agaaaatgaaaagcca

SEQ ID NO: 353197 - DNA, 16 bp, M. musculus
agaaaatgaaatttcc

SEQ ID NO: 353198 - DNA, 16 bp, M. musculus
agaaaatgaatgaatg

SEQ ID NO: 353199 - DNA, 16 bp, M. musculus
agaaaatgacctacag

SEQ ID NO: 353200 - DNA, 16 bp, M. musculus
agaaaatgactgaata

SEQ ID NO: 353201 - DNA, 16 bp, M. musculus
agaaaatgactttaaa

SEQ ID NO: 353202 - DNA, 16 bp, M. musculus
agaaaatgaggaagac

SEQ ID NO: 353203 - DNA, 16 bp, M. musculus
agaaaatgagtatttt

SEQ ID NO: 353204 - DNA, 16 bp, M. musculus
agaaaatgatttttaa

SEQ ID NO: 353205 - DNA, 16 bp, M. musculus
agaaaatgcaaaaatg

SEQ ID NO: 353206 - DNA, 16 bp, M. musculus
agaaaatgcaaaatac

SEQ ID NO: 353207 - DNA, 16 bp, M. musculus
agaaaatgcaaaatct

SEQ ID NO: 353208 - DNA, 16 bp, M. musculus
agaaaatgcaaaatga

SEQ ID NO: 353209 - DNA, 16 bp, M. musculus
agaaaatgcaaaatgc

SEQ ID NO: 353210 - DNA, 16 bp, M. musculus
agaaaatgcaaaggaa

SEQ ID NO: 353211 - DNA, 16 bp, M. musculus
agaaaatgcaaatcaa

SEQ ID NO: 353212 - DNA, 16 bp, M. musculus
agaaaatgcaaattgc

SEQ ID NO: 353213 - DNA, 16 bp, M. musculus
agaaaatgcagttcat

SEQ ID NO: 353214 - DNA, 16 bp, M. musculus
agaaaatgccaggccc

SEQ ID NO: 353215 - DNA, 16 bp, M. musculus
agaaaatgccccagag

SEQ ID NO: 353216 - DNA, 17 bp, M. musculus
agaaaatgcctatgaag

SEQ ID NO: 353217 - DNA, 16 bp, M. musculus
agaaaatgccttacag

SEQ ID NO: 353218 - DNA, 24 bp, M. musculus
agaaaatgccttacagctggatct

SEQ ID NO: 353219 - DNA, 16 bp, M. musculus
agaaaatgctctacag

SEQ ID NO: 353220 - DNA, 16 bp, M. musculus
agaaaatggaaagaac

SEQ ID NO: 353221 - DNA, 16 bp, M. musculus
agaaaatggaagcaat

SEQ ID NO: 353222 - DNA, 16 bp, M. musculus
agaaaatggagagatt

SEQ ID NO: 353223 - DNA, 16 bp, M. musculus
agaaaatgtacattta

SEQ ID NO: 353224 - DNA, 16 bp, M. musculus
agaaaatgtctaagaa

SEQ ID NO: 353225 - DNA, 16 bp, M. musculus
agaaaatgtcttatag

SEQ ID NO: 353226 - DNA, 16 bp, M. musculus
agaaaatgtgattcat

SEQ ID NO: 353227 - DNA, 16 bp, M. musculus
agaaaatgtgggacat

SEQ ID NO: 353228 - DNA, 16 bp, M. musculus
agaaaatgtggtttat

SEQ ID NO: 353229 - DNA, 16 bp, M. musculus
agaaaatgtgttatat

SEQ ID NO: 353230 - DNA, 16 bp, M. musculus
agaaaatgttaagtct

SEQ ID NO: 353231 - DNA, 16 bp, M. musculus
agaaaatgttcccacc

SEQ ID NO: 353232 - DNA, 16 bp, M. musculus
agaaaatgttctcaaa

SEQ ID NO: 353233 - DNA, 16 bp, M. musculus
agaaaatgtttaattt

SEQ ID NO: 353234 - DNA, 16 bp, M. musculus
agaaaattaaaagcag

SEQ ID NO: 353235 - DNA, 16 bp, M. musculus
agaaaattaaagcaat

SEQ ID NO: 353236 - DNA, 16 bp, M. musculus
agaaaattatccattt

SEQ ID NO: 353237 - DNA, 16 bp, M. musculus
agaaaattattttctt

SEQ ID NO: 353238 - DNA, 16 bp, M. musculus
agaaaattcaaagaat

SEQ ID NO: 353239 - DNA, 16 bp, M. musculus
agaaaattcacccaaa

SEQ ID NO: 353240 - DNA, 16 bp, M. musculus
agaaaattccaagaaa

SEQ ID NO: 353241 - DNA, 16 bp, M. musculus
agaaaattccagaaaa

SEQ ID NO: 353242 - DNA, 16 bp, M. musculus
agaaaattccttacag

SEQ ID NO: 353243 - DNA, 16 bp, M. musculus
agaaaattctaaacag

SEQ ID NO: 353244 - DNA, 16 bp, M. musculus
agaaaattctctctct

SEQ ID NO: 353245 - DNA, 16 bp, M. musculus
agaaaattctgcctct

SEQ ID NO: 353246 - DNA, 16 bp, M. musculus
agaaaattctggaaaa

SEQ ID NO: 353247 - DNA, 16 bp, M. musculus
agaaaattgaagcaat

SEQ ID NO: 353248 - DNA, 16 bp, M. musculus
agaaaattggacctag

SEQ ID NO: 353249 - DNA, 16 bp, M. musculus
agaaaatttggaaaat

SEQ ID NO: 353250 - DNA, 16 bp, M. musculus
agaaaattttatacta

SEQ ID NO: 353251 - DNA, 16 bp, M. musculus
agaaaattttcttttg

SEQ ID NO: 353252 - DNA, 16 bp, M. musculus
agaaaatttttcttct

SEQ ID NO: 353253 - DNA, 16 bp, M. musculus
agaaacaaaaatttta

SEQ ID NO: 353254 - DNA, 16 bp, M. musculus
agaaacaaaacatttt

SEQ ID NO: 353255 - DNA, 16 bp, M. musculus
agaaacaaaagtattt

SEQ ID NO: 353256 - DNA, 16 bp, M. musculus
agaaacaaagtatcca

SEQ ID NO: 353257 - DNA, 16 bp, M. musculus
agaaacaacagaaagt

SEQ ID NO: 353258 - DNA, 16 bp, M. musculus
agaaacaactataaca

SEQ ID NO: 353259 - DNA, 16 bp, M. musculus
agaaacaactgaaagt

SEQ ID NO: 353260 - DNA, 16 bp, M. musculus
agaaacaagctgaagt

SEQ ID NO: 353261 - DNA, 16 bp, M. musculus
agaaacaatacaagga

SEQ ID NO: 353262 - DNA, 16 bp, M. musculus
agaaacaatgaaatta

SEQ ID NO: 353263 - DNA, 16 bp, M. musculus
agaaacaattctgggt

SEQ ID NO: 353264 - DNA, 16 bp, M. musculus
agaaacaattgaaagt

SEQ ID NO: 353265 - DNA, 16 bp, M. musculus
agaaacaatttgaaaa

SEQ ID NO: 353266 - DNA, 16 bp, M. musculus
agaaacacacccagag

SEQ ID NO: 353267 - DNA, 16 bp, M. musculus
agaaacacagacagag

SEQ ID NO: 353268 - DNA, 16 bp, M. musculus
agaaacacaggagaac

SEQ ID NO: 353269 - DNA, 16 bp, M. musculus
agaaacacatacagac

SEQ ID NO: 353270 - DNA, 16 bp, M. musculus
agaaacacctgaagaa

SEQ ID NO: 353271 - DNA, 16 bp, M. musculus
agaaacacctggaaaa

SEQ ID NO: 353272 - DNA, 16 bp, M. musculus
agaaacactgaaactt

SEQ ID NO: 353273 - DNA, 16 bp, M. musculus
agaaacactgctttaa

SEQ ID NO: 353274 - DNA, 16 bp, M. musculus
agaaacactttaaaaa

SEQ ID NO: 353275 - DNA, 16 bp, M. musculus
agaaacagaaagagat

SEQ ID NO: 353276 - DNA, 16 bp, M. musculus
agaaacagaaagtaga

SEQ ID NO: 353277 - DNA, 16 bp, M. musculus
agaaacagaaatcaga

SEQ ID NO: 353278 - DNA, 16 bp, M. musculus
agaaacagaagccaag

SEQ ID NO: 353279 - DNA, 16 bp, M. musculus
agaaacagaagctact

SEQ ID NO: 353280 - DNA, 16 bp, M. musculus
agaaacagaaggaact

SEQ ID NO: 353281 - DNA, 16 bp, M. musculus
agaaacagaagggact

SEQ ID NO: 353282 - DNA, 16 bp, M. musculus
agaaacagacagatct

SEQ ID NO: 353283 - DNA, 16 bp, M. musculus
agaaacagacaggcag

SEQ ID NO: 353284 - DNA, 16 bp, M. musculus
agaaacagacaggttg

SEQ ID NO: 353285 - DNA, 16 bp, M. musculus
agaaacagacttggag

SEQ ID NO: 353286 - DNA, 16 bp, M. musculus
agaaacagagagaatg

SEQ ID NO: 353287 - DNA, 16 bp, M. musculus
agaaacagaggcagag

SEQ ID NO: 353288 - DNA, 16 bp, M. musculus
agaaacagatacagag

SEQ ID NO: 353289 - DNA, 16 bp, M. musculus
agaaacagatgcagag

SEQ ID NO: 353290 - DNA, 16 bp, M. musculus
agaaacagatggaaca

SEQ ID NO: 353291 - DNA, 16 bp, M. musculus
agaaacagcaagacca

SEQ ID NO: 353292 - DNA, 16 bp, M. musculus
agaaacagcagaaagc

SEQ ID NO: 353293 - DNA, 16 bp, M. musculus
agaaacagcccctgct

SEQ ID NO: 353294 - DNA, 16 bp, M. musculus
agaaacagctcagcag

SEQ ID NO: 353295 - DNA, 16 bp, M. musculus
agaaacaggaagccag

SEQ ID NO: 353296 - DNA, 16 bp, M. musculus
agaaacaggagcaaac

SEQ ID NO: 353297 - DNA, 16 bp, M. musculus
agaaacaggcagacag

SEQ ID NO: 353298 - DNA, 16 bp, M. musculus
agaaacagtctcaaaa

SEQ ID NO: 353299 - DNA, 16 bp, M. musculus
agaaacagtgaaactt

SEQ ID NO: 353300 - DNA, 16 bp, M. musculus
agaaacagtttttaaa

SEQ ID NO: 353301 - DNA, 16 bp, M. musculus
agaaacatagagacag

SEQ ID NO: 353302 - DNA, 16 bp, M. musculus
agaaacatctgaaaaa

SEQ ID NO: 353303 - DNA, 16 bp, M. musculus
agaaacatttagaaaa

SEQ ID NO: 353304 - DNA, 16 bp, M. musculus
agaaacatttttaaaa

SEQ ID NO: 353305 - DNA, 16 bp, M. musculus
agaaaccaaaattctt

SEQ ID NO: 353306 - DNA, 17 bp, M. musculus
agaaaccaaagttactt

SEQ ID NO: 353307 - DNA, 16 bp, M. musculus
agaaaccaagaacact

SEQ ID NO: 353308 - DNA, 16 bp, M. musculus
agaaaccaagatatcc

SEQ ID NO: 353309 - DNA, 16 bp, M. musculus
agaaaccaagatggct

SEQ ID NO: 353310 - DNA, 16 bp, M. musculus
agaaaccaataccact

SEQ ID NO: 353311 - DNA, 16 bp, M. musculus
agaaaccacacactca

SEQ ID NO: 353312 - DNA, 16 bp, M. musculus
agaaaccatccctaga

SEQ ID NO: 353313 - DNA, 34 bp, M. musculus
agaaaccctaggaaagaaatctggaaccatagac

SEQ ID NO: 353314 - DNA, 17 bp, M. musculus
agaaaccctagtaaaga

SEQ ID NO: 353315 - DNA, 20 bp, M. musculus
agaaaccctgtctcgaaaag

SEQ ID NO: 353316 - DNA, 16 bp, M. musculus
agaaaccctgtctctg

SEQ ID NO: 353317 - DNA, 16 bp, M. musculus
agaaacctcatgaatg

SEQ ID NO: 353318 - DNA, 16 bp, M. musculus
agaaacctgaggaaaa

SEQ ID NO: 353319 - DNA, 16 bp, M. musculus
agaaacctggaggcag

SEQ ID NO: 353320 - DNA, 16 bp, M. musculus
agaaaccttacaaatg

SEQ ID NO: 353321 - DNA, 16 bp, M. musculus
agaaaccttatgaatg

SEQ ID NO: 353322 - DNA, 17 bp, M. musculus
agaaaccttgtctcgaa

SEQ ID NO: 353323 - DNA, 16 bp, M. musculus
agaaacgctctaagtc

SEQ ID NO: 353324 - DNA, 16 bp, M. musculus
agaaacggctggcctc

SEQ ID NO: 353325 - DNA, 16 bp, M. musculus
agaaactaaaaaggga

SEQ ID NO: 353326 - DNA, 16 bp, M. musculus
agaaactaaagcagag

SEQ ID NO: 353327 - DNA, 16 bp, M. musculus
agaaactaatcagaga

SEQ ID NO: 353328 - DNA, 16 bp, M. musculus
agaaactagatataaa

SEQ ID NO: 353329 - DNA, 16 bp, M. musculus
agaaactatatatata

SEQ ID NO: 353330 - DNA, 16 bp, M. musculus
agaaactcacagccaa

SEQ ID NO: 353331 - DNA, 16 bp, M. musculus
agaaactcacctgcct

SEQ ID NO: 353332 - DNA, 16 bp, M. musculus
agaaactcaggggaga

SEQ ID NO: 353333 - DNA, 16 bp, M. musculus
agaaactccattttgt

SEQ ID NO: 353334 - DNA, 16 bp, M. musculus
agaaactctgtcttca

SEQ ID NO: 353335 - DNA, 16 bp, M. musculus
agaaactctgtcttgg

SEQ ID NO: 353336 - DNA, 16 bp, M. musculus
agaaactgaaaaagat

SEQ ID NO: 353337 - DNA, 16 bp, M. musculus
agaaactgaaaacaac

SEQ ID NO: 353338 - DNA, 16 bp, M. musculus
agaaactgaaaagaga

SEQ ID NO: 353339 - DNA, 16 bp, M. musculus
agaaactgaacaggga

SEQ ID NO: 353340 - DNA, 16 bp, M. musculus
agaaactgaagcagag

SEQ ID NO: 353341 - DNA, 16 bp, M. musculus
agaaactgaagcagga

SEQ ID NO: 353342 - DNA, 16 bp, M. musculus
agaaactgaagctgag

SEQ ID NO: 353343 - DNA, 16 bp, M. musculus
agaaactgaaggaaaa

SEQ ID NO: 353344 - DNA, 16 bp, M. musculus
agaaactgaaggaaag

SEQ ID NO: 353345 - DNA, 16 bp, M. musculus
agaaactgaaggaagg

SEQ ID NO: 353346 - DNA, 16 bp, M. musculus
agaaactgaagtaaag

SEQ ID NO: 353347 - DNA, 16 bp, M. musculus
agaaactgagagttct

SEQ ID NO: 353348 - DNA, 16 bp, M. musculus
agaaactgaggaagat

SEQ ID NO: 353349 - DNA, 16 bp, M. musculus
agaaactgaggcaggg

SEQ ID NO: 353350 - DNA, 16 bp, M. musculus
agaaactgaggctcag

SEQ ID NO: 353351 - DNA, 16 bp, M. musculus
agaaactggaaaaaac

SEQ ID NO: 353352 - DNA, 16 bp, M. musculus
agaaactggaaaacaa

SEQ ID NO: 353353 - DNA, 16 bp, M. musculus
agaaactggaaacaac

SEQ ID NO: 353354 - DNA, 16 bp, M. musculus
agaaactggacagagc

SEQ ID NO: 353355 - DNA, 16 bp, M. musculus
agaaactggagaaaac

SEQ ID NO: 353356 - DNA, 16 bp, M. musculus
agaaactggagaaaga

SEQ ID NO: 353357 - DNA, 16 bp, M. musculus
agaaactggagacaac

SEQ ID NO: 353358 - DNA, 16 bp, M. musculus
agaaactggagagaga

SEQ ID NO: 353359 - DNA, 16 bp, M. musculus
agaaactggatgaaat

SEQ ID NO: 353360 - DNA, 16 bp, M. musculus
agaaactgggaaagga

SEQ ID NO: 353361 - DNA, 16 bp, M. musculus
agaaactgggaaaggg

SEQ ID NO: 353362 - DNA, 16 bp, M. musculus
agaaactggggggggg

SEQ ID NO: 353363 - DNA, 16 bp, M. musculus
agaaactgggtgtggt

SEQ ID NO: 353364 - DNA, 16 bp, M. musculus
agaaactgttttagtg

SEQ ID NO: 353365 - DNA, 16 bp, M. musculus
agaaactgtttttaaa

SEQ ID NO: 353366 - DNA, 23 bp, M. musculus
agaaacttagaatacccaagata

SEQ ID NO: 353367 - DNA, 16 bp, M. musculus
agaaacttctgcatgt

SEQ ID NO: 353368 - DNA, 16 bp, M. musculus
agaaacttctttgatg

SEQ ID NO: 353369 - DNA, 22 bp, M. musculus
agaaacttgtggatttctttta

SEQ ID NO: 353370 - DNA, 16 bp, M. musculus
agaaactttattaaag

SEQ ID NO: 353371 - DNA, 16 bp, M. musculus
agaaactttgaatttt

SEQ ID NO: 353372 - DNA, 16 bp, M. musculus
agaaactttgtctcaa

SEQ ID NO: 353373 - DNA, 16 bp, M. musculus
agaaagaaaaaagctt

SEQ ID NO: 353374 - DNA, 16 bp, M. musculus
agaaagaaaaaggact

SEQ ID NO: 353375 - DNA, 16 bp, M. musculus
agaaagaaaacacatt

SEQ ID NO: 353376 - DNA, 16 bp, M. musculus
agaaagaaaacatgat

SEQ ID NO: 353377 - DNA, 16 bp, M. musculus
agaaagaaaacatggt

SEQ ID NO: 353378 - DNA, 16 bp, M. musculus
agaaagaaaactccaa

SEQ ID NO: 353379 - DNA, 16 bp, M. musculus
agaaagaaaagaatcc

SEQ ID NO: 353380 - DNA, 16 bp, M. musculus
agaaagaaaagacttc

SEQ ID NO: 353381 - DNA, 16 bp, M. musculus
agaaagaaaaggttta

SEQ ID NO: 353382 - DNA, 16 bp, M. musculus
agaaagaaaatagttt

SEQ ID NO: 353383 - DNA, 16 bp, M. musculus
agaaagaaaatcctca

SEQ ID NO: 353384 - DNA, 16 bp, M. musculus
agaaagaaacttcttt

SEQ ID NO: 353385 - DNA, 16 bp, M. musculus
agaaagaaagaaactt

SEQ ID NO: 353386 - DNA, 16 bp, M. musculus
agaaagaaagactgga

SEQ ID NO: 353387 - DNA, 16 bp, M. musculus
agaaagaaagcaaggt

SEQ ID NO: 353388 - DNA, 16 bp, M. musculus
agaaagaaagccagcc

SEQ ID NO: 353389 - DNA, 16 bp, M. musculus
agaaagaaagctagct

SEQ ID NO: 353390 - DNA, 16 bp, M. musculus
agaaagaaagctgagc

SEQ ID NO: 353391 - DNA, 16 bp, M. musculus
agaaagaaatacattt

SEQ ID NO: 353392 - DNA, 16 bp, M. musculus
agaaagaaatcagaga

SEQ ID NO: 353393 - DNA, 16 bp, M. musculus
agaaagaaatcgaaga

SEQ ID NO: 353394 - DNA, 16 bp, M. musculus
agaaagaaatgcacca

SEQ ID NO: 353395 - DNA, 16 bp, M. musculus
agaaagaaattacaga

SEQ ID NO: 353396 - DNA, 16 bp, M. musculus
agaaagaaattcaaag

SEQ ID NO: 353397 - DNA, 16 bp, M. musculus
agaaagaaattcaaga

SEQ ID NO: 353398 - DNA, 16 bp, M. musculus
agaaagaaccctggag

SEQ ID NO: 353399 - DNA, 16 bp, M. musculus
agaaagaactgaaaga

SEQ ID NO: 353400 - DNA, 16 bp, M. musculus
agaaagaactgaagga

SEQ ID NO: 353401 - DNA, 16 bp, M. musculus
agaaagaactgactcc

SEQ ID NO: 353402 - DNA, 16 bp, M. musculus
agaaagaactggaaag

SEQ ID NO: 353403 - DNA, 16 bp, M. musculus
agaaagaacttaagaa

SEQ ID NO: 353404 - DNA, 16 bp, M. musculus
agaaagaacttcagac

SEQ ID NO: 353405 - DNA, 16 bp, M. musculus
agaaagaagaaaagct

SEQ ID NO: 353406 - DNA, 16 bp, M. musculus
agaaagaagaaaatct

SEQ ID NO: 353407 - DNA, 16 bp, M. musculus
agaaagaagcagccat

SEQ ID NO: 353408 - DNA, 35 bp, M. musculus
agaaagaagctctttgttctctatagccagcaaaa

SEQ ID NO: 353409 - DNA, 16 bp, M. musculus
agaaagaagctgcctg

SEQ ID NO: 353410 - DNA, 16 bp, M. musculus
agaaagaaggcaggca

SEQ ID NO: 353411 - DNA, 16 bp, M. musculus
agaaagaatcaagtta

SEQ ID NO: 353412 - DNA, 16 bp, M. musculus
agaaagaatgcaagaa

SEQ ID NO: 353413 - DNA, 16 bp, M. musculus
agaaagaatgcaatga

SEQ ID NO: 353414 - DNA, 16 bp, M. musculus
agaaagaatggaaaca

SEQ ID NO: 353415 - DNA, 16 bp, M. musculus
agaaagaatttaggga

SEQ ID NO: 353416 - DNA, 16 bp, M. musculus
agaaagaatttggaaa

SEQ ID NO: 353417 - DNA, 16 bp, M. musculus
agaaagacaaagagat

SEQ ID NO: 353418 - DNA, 16 bp, M. musculus
agaaagacaaatgtat

SEQ ID NO: 353419 - DNA, 16 bp, M. musculus
agaaagacacacagac

SEQ ID NO: 353420 - DNA, 16 bp, M. musculus
agaaagacactgtctc

SEQ ID NO: 353421 - DNA, 16 bp, M. musculus
agaaagaccctgcctc

SEQ ID NO: 353422 - DNA, 16 bp, M. musculus
agaaagacctagaaag

SEQ ID NO: 353423 - DNA, 16 bp, M. musculus
agaaagactgaagaaa

SEQ ID NO: 353424 - DNA, 16 bp, M. musculus
agaaagactggaagaa

SEQ ID NO: 353425 - DNA, 16 bp, M. musculus
agaaagagaaactgag

SEQ ID NO: 353426 - DNA, 16 bp, M. musculus
agaaagagaaatctgc

SEQ ID NO: 353427 - DNA, 16 bp, M. musculus
agaaagagaagcagtt

SEQ ID NO: 353428 - DNA, 16 bp, M. musculus
agaaagagaatggcga

SEQ ID NO: 353429 - DNA, 16 bp, M. musculus
agaaagagaattacag

SEQ ID NO: 353430 - DNA, 16 bp, M. musculus
agaaagagagaaatca

SEQ ID NO: 353431 - DNA, 16 bp, M. musculus
agaaagagagaggctg

SEQ ID NO: 353432 - DNA, 16 bp, M. musculus
agaaagagagctagag

SEQ ID NO: 353433 - DNA, 16 bp, M. musculus
agaaagagatgactat

SEQ ID NO: 353434 - DNA, 16 bp, M. musculus
agaaagagatgccatg

SEQ ID NO: 353435 - DNA, 16 bp, M. musculus
agaaagagcagttctc

SEQ ID NO: 353436 - DNA, 16 bp, M. musculus
agaaagaggaagactc

SEQ ID NO: 353437 - DNA, 16 bp, M. musculus
agaaagaggaagactg

SEQ ID NO: 353438 - DNA, 16 bp, M. musculus
agaaagagggctagag

SEQ ID NO: 353439 - DNA, 16 bp, M. musculus
agaaagagtcttccaa

SEQ ID NO: 353440 - DNA, 16 bp, M. musculus
agaaagagtttatttt

SEQ ID NO: 353441 - DNA, 16 bp, M. musculus
agaaagatagacagac

SEQ ID NO: 353442 - DNA, 16 bp, M. musculus
agaaagatagctcagt

SEQ ID NO: 353443 - DNA, 16 bp, M. musculus
agaaagatcaagagtt

SEQ ID NO: 353444 - DNA, 16 bp, M. musculus
agaaagatgaaatttt

SEQ ID NO: 353445 - DNA, 16 bp, M. musculus
agaaagatgatataga

SEQ ID NO: 353446 - DNA, 16 bp, M. musculus
agaaagatgatgaaca

SEQ ID NO: 353447 - DNA, 16 bp, M. musculus
agaaagatggcctagt

SEQ ID NO: 353448 - DNA, 16 bp, M. musculus
agaaagattgcagagc

SEQ ID NO: 353449 - DNA, 16 bp, M. musculus
agaaagatttattttt

SEQ ID NO: 353450 - DNA, 19 bp, M. musculus
agaaagatttcacgtgtgc

SEQ ID NO: 353451 - DNA, 16 bp, M. musculus
agaaagatttgacaaa

SEQ ID NO: 353452 - DNA, 16 bp, M. musculus
agaaagcaaactgaac

SEQ ID NO: 353453 - DNA, 16 bp, M. musculus
agaaagcaaaggcagg

SEQ ID NO: 353454 - DNA, 16 bp, M. musculus
agaaagcaaatgaaga

SEQ ID NO: 353455 - DNA, 16 bp, M. musculus
agaaagcaagctgaag

SEQ ID NO: 353456 - DNA, 17 bp, M. musculus
agaaagcaagctgagca

SEQ ID NO: 353457 - DNA, 16 bp, M. musculus
agaaagcaaggcaaac

SEQ ID NO: 353458 - DNA, 16 bp, M. musculus
agaaagcaagtataga

SEQ ID NO: 353459 - DNA, 16 bp, M. musculus
agaaagcaatcaagga

SEQ ID NO: 353460 - DNA, 16 bp, M. musculus
agaaagcaattgaaga

SEQ ID NO: 353461 - DNA, 16 bp, M. musculus
agaaagcacccaagga

SEQ ID NO: 353462 - DNA, 16 bp, M. musculus
agaaagcagaagctga

SEQ ID NO: 353463 - DNA, 16 bp, M. musculus
agaaagcagacagaca

SEQ ID NO: 353464 - DNA, 16 bp, M. musculus
agaaagcagacagagc

SEQ ID NO: 353465 - DNA, 16 bp, M. musculus
agaaagcagagacagg

SEQ ID NO: 353466 - DNA, 16 bp, M. musculus
agaaagcagagagaat

SEQ ID NO: 353467 - DNA, 16 bp, M. musculus
agaaagcagagggcag

SEQ ID NO: 353468 - DNA, 16 bp, M. musculus
agaaagcaggagcaga

SEQ ID NO: 353469 - DNA, 16 bp, M. musculus
agaaagcaggagttga

SEQ ID NO: 353470 - DNA, 16 bp, M. musculus
agaaagcaggcttagc

SEQ ID NO: 353471 - DNA, 16 bp, M. musculus
agaaagcagggcagaa

SEQ ID NO: 353472 - DNA, 16 bp, M. musculus
agaaagccaaccaaag

SEQ ID NO: 353473 - DNA, 16 bp, M. musculus
agaaagccaagcagaa

SEQ ID NO: 353474 - DNA, 16 bp, M. musculus
agaaagccagaggaag

SEQ ID NO: 353475 - DNA, 16 bp, M. musculus
agaaagcccacattca

SEQ ID NO: 353476 - DNA, 16 bp, M. musculus
agaaagcccatataca

SEQ ID NO: 353477 - DNA, 16 bp, M. musculus
agaaagcctacatatt

SEQ ID NO: 353478 - DNA, 16 bp, M. musculus
agaaagcctgaaaagg

SEQ ID NO: 353479 - DNA, 16 bp, M. musculus
agaaagctgagcaagc

SEQ ID NO: 353480 - DNA, 16 bp, M. musculus
agaaagctgcctgcct

SEQ ID NO: 353481 - DNA, 16 bp, M. musculus
agaaagctggattctg

SEQ ID NO: 353482 - DNA, 16 bp, M. musculus
agaaagctgggaattg

SEQ ID NO: 353483 - DNA, 16 bp, M. musculus
agaaagctgggcatgg

SEQ ID NO: 353484 - DNA, 16 bp, M. musculus
agaaagctgtgttgag

SEQ ID NO: 353485 - DNA, 16 bp, M. musculus
agaaaggaaatttaat

SEQ ID NO: 353486 - DNA, 16 bp, M. musculus
agaaaggaactctggg

SEQ ID NO: 353487 - DNA, 16 bp, M. musculus
agaaaggaagccagag

SEQ ID NO: 353488 - DNA, 16 bp, M. musculus
agaaaggaagctgaga

SEQ ID NO: 353489 - DNA, 16 bp, M. musculus
agaaaggacaatctgc

SEQ ID NO: 353490 - DNA, 16 bp, M. musculus
agaaaggacacaggag

SEQ ID NO: 353491 - DNA, 16 bp, M. musculus
agaaaggacccaagaa

SEQ ID NO: 353492 - DNA, 16 bp, M. musculus
agaaaggaccgaagga

SEQ ID NO: 353493 - DNA, 16 bp, M. musculus
agaaaggagaagtttt

SEQ ID NO: 353494 - DNA, 24 bp, M. musculus
agaaaggagcctcccttgaggaaa

SEQ ID NO: 353495 - DNA, 16 bp, M. musculus
agaaaggagtctccct

SEQ ID NO: 353496 - DNA, 16 bp, M. musculus
agaaaggatcctccct

SEQ ID NO: 353497 - DNA, 16 bp, M. musculus
agaaaggattctggga

SEQ ID NO: 353498 - DNA, 16 bp, M. musculus
agaaaggcagaaaggc

SEQ ID NO: 353499 - DNA, 16 bp, M. musculus
agaaaggccagaagag

SEQ ID NO: 353500 - DNA, 16 bp, M. musculus
agaaaggccatccaga

SEQ ID NO: 353501 - DNA, 16 bp, M. musculus
agaaaggcccaagtga

SEQ ID NO: 353502 - DNA, 16 bp, M. musculus
agaaaggccccttggt

SEQ ID NO: 353503 - DNA, 16 bp, M. musculus
agaaaggctgcagctt

SEQ ID NO: 353504 - DNA, 16 bp, M. musculus
agaaaggctggaagaa

SEQ ID NO: 353505 - DNA, 16 bp, M. musculus
agaaagggagctgagc

SEQ ID NO: 353506 - DNA, 16 bp, M. musculus
agaaagggcaattggc

SEQ ID NO: 353507 - DNA, 16 bp, M. musculus
agaaagggctgaagga

SEQ ID NO: 353508 - DNA, 16 bp, M. musculus
agaaagggctgggttt

SEQ ID NO: 353509 - DNA, 16 bp, M. musculus
agaaaggggtcagaga

SEQ ID NO: 353510 - DNA, 16 bp, M. musculus
agaaaggggtgtgtgt

SEQ ID NO: 353511 - DNA, 16 bp, M. musculus
agaaagggtgagctta

SEQ ID NO: 353512 - DNA, 16 bp, M. musculus
agaaagggtgtgtgtg

SEQ ID NO: 353513 - DNA, 16 bp, M. musculus
agaaaggtaactaagg

SEQ ID NO: 353514 - DNA, 16 bp, M. musculus
agaaaggtaggtaggt

SEQ ID NO: 353515 - DNA, 16 bp, M. musculus
agaaaggttctttgga

SEQ ID NO: 353516 - DNA, 16 bp, M. musculus
agaaaggttgtaagag

SEQ ID NO: 353517 - DNA, 16 bp, M. musculus
agaaagtaaacagaga

SEQ ID NO: 353518 - DNA, 16 bp, M. musculus
agaaagtaaaccttca

SEQ ID NO: 353519 - DNA, 16 bp, M. musculus
agaaagtaattcttca

SEQ ID NO: 353520 - DNA, 16 bp, M. musculus
agaaagtaccaaagaa

SEQ ID NO: 353521 - DNA, 16 bp, M. musculus
agaaagtagcttcagt

SEQ ID NO: 353522 - DNA, 17 bp, M. musculus
agaaagtatacaaggag

SEQ ID NO: 353523 - DNA, 16 bp, M. musculus
agaaagtatttgacaa

SEQ ID NO: 353524 - DNA, 16 bp, M. musculus
agaaagtatttttaaa

SEQ ID NO: 353525 - DNA, 16 bp, M. musculus
agaaagtcaaaatatc

SEQ ID NO: 353526 - DNA, 16 bp, M. musculus
agaaagtcacacaaac

SEQ ID NO: 353527 - DNA, 16 bp, M. musculus
agaaagtccccaagaa

SEQ ID NO: 353528 - DNA, 16 bp, M. musculus
agaaagtccttaattt

SEQ ID NO: 353529 - DNA, 16 bp, M. musculus
agaaagtccttgaagc

SEQ ID NO: 353530 - DNA, 16 bp, M. musculus
agaaagtctgccaagg

SEQ ID NO: 353531 - DNA, 16 bp, M. musculus
agaaagtctttaattt

SEQ ID NO: 353532 - DNA, 16 bp, M. musculus
agaaagtctttcattt

SEQ ID NO: 353533 - DNA, 16 bp, M. musculus
agaaagtgaagcagaa

SEQ ID NO: 353534 - DNA, 16 bp, M. musculus
agaaagtgccctacag

SEQ ID NO: 353535 - DNA, 16 bp, M. musculus
agaaagtggacttcag

SEQ ID NO: 353536 - DNA, 16 bp, M. musculus
agaaagtgggaagcct

SEQ ID NO: 353537 - DNA, 16 bp, M. musculus
agaaagtggggaagac

SEQ ID NO: 353538 - DNA, 16 bp, M. musculus
agaaagtgtgtccctg

SEQ ID NO: 353539 - DNA, 16 bp, M. musculus
agaaagttagctttaa

SEQ ID NO: 353540 - DNA, 16 bp, M. musculus
agaaagttcaaggcca

SEQ ID NO: 353541 - DNA, 16 bp, M. musculus
agaaagttctagaaaa

SEQ ID NO: 353542 - DNA, 16 bp, M. musculus
agaaagttctagaaat

SEQ ID NO: 353543 - DNA, 16 bp, M. musculus
agaaataaaaatgtca

SEQ ID NO: 353544 - DNA, 16 bp, M. musculus
agaaataaaactgaag

SEQ ID NO: 353545 - DNA, 16 bp, M. musculus
agaaataaaatgcaga

SEQ ID NO: 353546 - DNA, 16 bp, M. musculus
agaaataaactatttt

SEQ ID NO: 353547 - DNA, 16 bp, M. musculus
agaaataaatacatct

SEQ ID NO: 353548 - DNA, 16 bp, M. musculus
agaaataaatgtatca

SEQ ID NO: 353549 - DNA, 16 bp, M. musculus
agaaataaatgtattt

SEQ ID NO: 353550 - DNA, 16 bp, M. musculus
agaaataaatgttttt

SEQ ID NO: 353551 - DNA, 16 bp, M. musculus
agaaataaccacacaa

SEQ ID NO: 353552 - DNA, 16 bp, M. musculus
agaaataagactcaga

SEQ ID NO: 353553 - DNA, 16 bp, M. musculus
agaaatacaaatttaa

SEQ ID NO: 353554 - DNA, 16 bp, M. musculus
agaaatacaggagagg

SEQ ID NO: 353555 - DNA, 16 bp, M. musculus
agaaatacatttatat

SEQ ID NO: 353556 - DNA, 16 bp, M. musculus
agaaatacatttctgt

SEQ ID NO: 353557 - DNA, 16 bp, M. musculus
agaaataccaactgat

SEQ ID NO: 353558 - DNA, 16 bp, M. musculus
agaaataccagaagag

SEQ ID NO: 353559 - DNA, 16 bp, M. musculus
agaaatactgaagaaa

SEQ ID NO: 353560 - DNA, 16 bp, M. musculus
agaaatagaagcagac

SEQ ID NO: 353561 - DNA, 16 bp, M. musculus
agaaatagatgataga

SEQ ID NO: 353562 - DNA, 16 bp, M. musculus
agaaatagatttttaa

SEQ ID NO: 353563 - DNA, 16 bp, M. musculus
agaaataggcttggga

SEQ ID NO: 353564 - DNA, 16 bp, M. musculus
agaaatatttcaaaat

SEQ ID NO: 353565 - DNA, 16 bp, M. musculus
agaaatatttctaaaa

SEQ ID NO: 353566 - DNA, 16 bp, M. musculus
agaaatatttgattag

SEQ ID NO: 353567 - DNA, 16 bp, M. musculus
agaaatcaaagaaatg

SEQ ID NO: 353568 - DNA, 16 bp, M. musculus
agaaatcaaagaagac

SEQ ID NO: 353569 - DNA, 16 bp, M. musculus
agaaatcaaagatttc

SEQ ID NO: 353570 - DNA, 16 bp, M. musculus
agaaatcaaggaaaca

SEQ ID NO: 353571 - DNA, 16 bp, M. musculus
agaaatcaatgaagat

SEQ ID NO: 353572 - DNA, 16 bp, M. musculus
agaaatcagagaaaca

SEQ ID NO: 353573 - DNA, 16 bp, M. musculus
agaaatcagctatttt

SEQ ID NO: 353574 - DNA, 16 bp, M. musculus
agaaatcagtttggtg

SEQ ID NO: 353575 - DNA, 16 bp, M. musculus
agaaatcatagaagat

SEQ ID NO: 353576 - DNA, 16 bp, M. musculus
agaaatcatggaggaa

SEQ ID NO: 353577 - DNA, 16 bp, M. musculus
agaaatcattaaaaat

SEQ ID NO: 353578 - DNA, 16 bp, M. musculus
agaaatcatttcacat

SEQ ID NO: 353579 - DNA, 16 bp, M. musculus
agaaatccaaacacca

SEQ ID NO: 353580 - DNA, 16 bp, M. musculus
agaaatccaggaaaac

SEQ ID NO: 353581 - DNA, 16 bp, M. musculus
agaaatccaggataca

SEQ ID NO: 353582 - DNA, 16 bp, M. musculus
agaaatcctgcctcag

SEQ ID NO: 353583 - DNA, 16 bp, M. musculus
agaaatcctgtcttaa

SEQ ID NO: 353584 - DNA, 16 bp, M. musculus
agaaatctatttaaaa

SEQ ID NO: 353585 - DNA, 16 bp, M. musculus
agaaatctgcatgcct

SEQ ID NO: 353586 - DNA, 16 bp, M. musculus
agaaatctgcctactt

SEQ ID NO: 353587 - DNA, 16 bp, M. musculus
agaaatctgcttgcct

SEQ ID NO: 353588 - DNA, 16 bp, M. musculus
agaaatctggaggcag

SEQ ID NO: 353589 - DNA, 16 bp, M. musculus
agaaatctgtcttggt

SEQ ID NO: 353590 - DNA, 16 bp, M. musculus
agaaatctttttttaa

SEQ ID NO: 353591 - DNA, 16 bp, M. musculus
agaaatgaaaatgggg

SEQ ID NO: 353592 - DNA, 16 bp, M. musculus
agaaatgaaaatgttt

SEQ ID NO: 353593 - DNA, 16 bp, M. musculus
agaaatgaaacaatta

SEQ ID NO: 353594 - DNA, 16 bp, M. musculus
agaaatgaaaccacat

SEQ ID NO: 353595 - DNA, 16 bp, M. musculus
agaaatgaaagccttt

SEQ ID NO: 353596 - DNA, 16 bp, M. musculus
agaaatgaacgcacac

SEQ ID NO: 353597 - DNA, 16 bp, M. musculus
agaaatgaagacacag

SEQ ID NO: 353598 - DNA, 16 bp, M. musculus
agaaatgacacctgag

SEQ ID NO: 353599 - DNA, 16 bp, M. musculus
agaaatgacagagaag

SEQ ID NO: 353600 - DNA, 16 bp, M. musculus
agaaatgacagggaaa

SEQ ID NO: 353601 - DNA, 16 bp, M. musculus
agaaatgacagggaag

SEQ ID NO: 353602 - DNA, 16 bp, M. musculus
agaaatgactcaaaaa

SEQ ID NO: 353603 - DNA, 16 bp, M. musculus
agaaatgactcagagg

SEQ ID NO: 353604 - DNA, 16 bp, M. musculus
agaaatgactcctgca

SEQ ID NO: 353605 - DNA, 16 bp, M. musculus
agaaatgactgaagga

SEQ ID NO: 353606 - DNA, 16 bp, M. musculus
agaaatgagagttcct

SEQ ID NO: 353607 - DNA, 16 bp, M. musculus
agaaatgatgaaatta

SEQ ID NO: 353608 - DNA, 16 bp, M. musculus
agaaatgcaaaccaaa

SEQ ID NO: 353609 - DNA, 16 bp, M. musculus
agaaatgcacaagcaa

SEQ ID NO: 353610 - DNA, 16 bp, M. musculus
agaaatgcagagaaaa

SEQ ID NO: 353611 - DNA, 16 bp, M. musculus
agaaatgcaggcacag

SEQ ID NO: 353612 - DNA, 16 bp, M. musculus
agaaatgcccatgaac

SEQ ID NO: 353613 - DNA, 16 bp, M. musculus
agaaatgctaatcaaa

SEQ ID NO: 353614 - DNA, 16 bp, M. musculus
agaaatggaaatggag

SEQ ID NO: 353615 - DNA, 16 bp, M. musculus
agaaatggaagaaaca

SEQ ID NO: 353616 - DNA, 16 bp, M. musculus
agaaatggaagcaaaa

SEQ ID NO: 353617 - DNA, 16 bp, M. musculus
agaaatggaagcagga

SEQ ID NO: 353618 - DNA, 16 bp, M. musculus
agaaatggacacagaa

SEQ ID NO: 353619 - DNA, 16 bp, M. musculus
agaaatggagaagagc

SEQ ID NO: 353620 - DNA, 16 bp, M. musculus
agaaatggaggacaca

SEQ ID NO: 353621 - DNA, 16 bp, M. musculus
agaaatggctcagagg

SEQ ID NO: 353622 - DNA, 16 bp, M. musculus
agaaatggctcaggag

SEQ ID NO: 353623 - DNA, 16 bp, M. musculus
agaaatggcttctctg

SEQ ID NO: 353624 - DNA, 17 bp, M. musculus
agaaatgggagttcaaa

SEQ ID NO: 353625 - DNA, 16 bp, M. musculus
agaaatgtacctgcct

SEQ ID NO: 353626 - DNA, 16 bp, M. musculus
agaaatgtctcaaaaa

SEQ ID NO: 353627 - DNA, 16 bp, M. musculus
agaaatgtctttaaaa

SEQ ID NO: 353628 - DNA, 16 bp, M. musculus
agaaatgtgactgtgg

SEQ ID NO: 353629 - DNA, 16 bp, M. musculus
agaaatgtggtacatt

SEQ ID NO: 353630 - DNA, 16 bp, M. musculus
agaaatgttataatta

SEQ ID NO: 353631 - DNA, 16 bp, M. musculus
agaaatgttcaaaatt

SEQ ID NO: 353632 - DNA, 16 bp, M. musculus
agaaatgttcaacatt

SEQ ID NO: 353633 - DNA, 16 bp, M. musculus
agaaatgttcagtatc

SEQ ID NO: 353634 - DNA, 16 bp, M. musculus
agaaatgtttgcattt

SEQ ID NO: 353635 - DNA, 16 bp, M. musculus
agaaattaaaaacatt

SEQ ID NO: 353636 - DNA, 16 bp, M. musculus
agaaattaaagaagac

SEQ ID NO: 353637 - DNA, 16 bp, M. musculus
agaaattaaagactct

SEQ ID NO: 353638 - DNA, 16 bp, M. musculus
agaaattaattttctc

SEQ ID NO: 353639 - DNA, 16 bp, M. musculus
agaaattaattttctt

SEQ ID NO: 353640 - DNA, 16 bp, M. musculus
agaaattactggcaga

SEQ ID NO: 353641 - DNA, 16 bp, M. musculus
agaaattagaggtgat

SEQ ID NO: 353642 - DNA, 16 bp, M. musculus
agaaattagatatcct

SEQ ID NO: 353643 - DNA, 16 bp, M. musculus
agaaattagtgaaaca

SEQ ID NO: 353644 - DNA, 16 bp, M. musculus
agaaattatatattct

SEQ ID NO: 353645 - DNA, 16 bp, M. musculus
agaaattcaaggccca

SEQ ID NO: 353646 - DNA, 16 bp, M. musculus
agaaattcaaggtcat

SEQ ID NO: 353647 - DNA, 16 bp, M. musculus
agaaattcaccttcct

SEQ ID NO: 353648 - DNA, 16 bp, M. musculus
agaaattcaggaaaca

SEQ ID NO: 353649 - DNA, 16 bp, M. musculus
agaaattcattttttt

SEQ ID NO: 353650 - DNA, 16 bp, M. musculus
agaaattgaagacatt

SEQ ID NO: 353651 - DNA, 16 bp, M. musculus
agaaattgaagacctc

SEQ ID NO: 353652 - DNA, 16 bp, M. musculus
agaaattgaagagatc

SEQ ID NO: 353653 - DNA, 16 bp, M. musculus
agaaattgaagatatc

SEQ ID NO: 353654 - DNA, 16 bp, M. musculus
agaaattgagctggtg

SEQ ID NO: 353655 - DNA, 16 bp, M. musculus
agaaattgccttacag

SEQ ID NO: 353656 - DNA, 16 bp, M. musculus
agaaattgtgattaaa

SEQ ID NO: 353657 - DNA, 16 bp, M. musculus
agaaatttatccattt

SEQ ID NO: 353658 - DNA, 16 bp, M. musculus
agaaatttattttctt

SEQ ID NO: 353659 - DNA, 16 bp, M. musculus
agaaatttatttttcc

SEQ ID NO: 353660 - DNA, 16 bp, M. musculus
agaaatttcattaaaa

SEQ ID NO: 353661 - DNA, 16 bp, M. musculus
agaaatttctttaaaa

SEQ ID NO: 353662 - DNA, 16 bp, M. musculus
agaaatttcttttctt

SEQ ID NO: 353663 - DNA, 16 bp, M. musculus
agaaattttggagttt

SEQ ID NO: 353664 - DNA, 16 bp, M. musculus
agaaattttgttttaa

SEQ ID NO: 353665 - DNA, 16 bp, M. musculus
agaaattttttctttt

SEQ ID NO: 353666 - DNA, 16 bp, M. musculus
agaaatttttttcttt

SEQ ID NO: 353667 - DNA, 16 bp, M. musculus
agaacaaaaagatgca

SEQ ID NO: 353668 - DNA, 16 bp, M. musculus
agaacaaacctaagga

SEQ ID NO: 353669 - DNA, 16 bp, M. musculus
agaacaaagactgaag

SEQ ID NO: 353670 - DNA, 16 bp, M. musculus
agaacaaagatcaaag

SEQ ID NO: 353671 - DNA, 16 bp, M. musculus
agaacaaaggctggga

SEQ ID NO: 353672 - DNA, 16 bp, M. musculus
agaacaaattccagga

SEQ ID NO: 353673 - DNA, 16 bp, M. musculus
agaacaaattgctaga

SEQ ID NO: 353674 - DNA, 16 bp, M. musculus
agaacaaattttaaaa

SEQ ID NO: 353675 - DNA, 16 bp, M. musculus
agaacaacagtcattc

SEQ ID NO: 353676 - DNA, 16 bp, M. musculus
agaacaacctaagaca

SEQ ID NO: 353677 - DNA, 16 bp, M. musculus
agaacaagaactcaaa

SEQ ID NO: 353678 - DNA, 16 bp, M. musculus
agaacaaggagatgag

SEQ ID NO: 353679 - DNA, 16 bp, M. musculus
agaacaaggaggccat

SEQ ID NO: 353680 - DNA, 16 bp, M. musculus
agaacaagttccagaa

SEQ ID NO: 353681 - DNA, 16 bp, M. musculus
agaacaatgcagaaga

SEQ ID NO: 353682 - DNA, 16 bp, M. musculus
agaacaattcaaagaa

SEQ ID NO: 353683 - DNA, 16 bp, M. musculus
agaacaattttttaaa

SEQ ID NO: 353684 - DNA, 16 bp, M. musculus
agaacacaaatggcag

SEQ ID NO: 353685 - DNA, 16 bp, M. musculus
agaacacaagcaacag

SEQ ID NO: 353686 - DNA, 16 bp, M. musculus
agaacacacagagaga

SEQ ID NO: 353687 - DNA, 16 bp, M. musculus
agaacacacataaaag

SEQ ID NO: 353688 - DNA, 16 bp, M. musculus
agaacacagaaggcag

SEQ ID NO: 353689 - DNA, 16 bp, M. musculus
agaacacaggaaccaa

SEQ ID NO: 353690 - DNA, 16 bp, M. musculus
agaacacaggctgctc

SEQ ID NO: 353691 - DNA, 16 bp, M. musculus
agaacacatcagaaag

SEQ ID NO: 353692 - DNA, 16 bp, M. musculus
agaacacattaaagca

SEQ ID NO: 353693 - DNA, 16 bp, M. musculus
agaacacattttaaaa

SEQ ID NO: 353694 - DNA, 16 bp, M. musculus
agaacaccaaataaat

SEQ ID NO: 353695 - DNA, 16 bp, M. musculus
agaacaccaatgtctt

SEQ ID NO: 353696 - DNA, 16 bp, M. musculus
agaacaccatcttgta

SEQ ID NO: 353697 - DNA, 16 bp, M. musculus
agaacacccttcacaa

SEQ ID NO: 353698 - DNA, 16 bp, M. musculus
agaacactctgccatc

SEQ ID NO: 353699 - DNA, 16 bp, M. musculus
agaacactgaaagcaa

SEQ ID NO: 353700 - DNA, 16 bp, M. musculus
agaacactgcagaagt

SEQ ID NO: 353701 - DNA, 16 bp, M. musculus
agaacacttctaaaca

SEQ ID NO: 353702 - DNA, 16 bp, M. musculus
agaacacttgctgttt

SEQ ID NO: 353703 - DNA, 16 bp, M. musculus
agaacagaatcccaat

SEQ ID NO: 353704 - DNA, 16 bp, M. musculus
agaacagaatccctct

SEQ ID NO: 353705 - DNA, 16 bp, M. musculus
agaacagatgcaagtg

SEQ ID NO: 353706 - DNA, 16 bp, M. musculus
agaacagcaagcactc

SEQ ID NO: 353707 - DNA, 16 bp, M. musculus
agaacagcaagtgccc

SEQ ID NO: 353708 - DNA, 16 bp, M. musculus
agaacagcaatggctt

SEQ ID NO: 353709 - DNA, 18 bp, M. musculus
agaacagcagcagcagca

SEQ ID NO: 353710 - DNA, 16 bp, M. musculus
agaacagcagcagtag

SEQ ID NO: 353711 - DNA, 16 bp, M. musculus
agaacagcagcatcag

SEQ ID NO: 353712 - DNA, 16 bp, M. musculus
agaacagcagtgctct

SEQ ID NO: 353713 - DNA, 16 bp, M. musculus
agaacagcagtggctt

SEQ ID NO: 353714 - DNA, 16 bp, M. musculus
agaacagccactgctc

SEQ ID NO: 353715 - DNA, 16 bp, M. musculus
agaacagccagagcta

SEQ ID NO: 353716 - DNA, 17 bp, M. musculus
agaacagccagggctac

SEQ ID NO: 353717 - DNA, 16 bp, M. musculus
agaacagccagtgctc

SEQ ID NO: 353718 - DNA, 16 bp, M. musculus
agaacagccggtgctc

SEQ ID NO: 353719 - DNA, 16 bp, M. musculus
agaacaggaagtagag

SEQ ID NO: 353720 - DNA, 16 bp, M. musculus
agaacaggagagatgg

SEQ ID NO: 353721 - DNA, 16 bp, M. musculus
agaacaggctgacctc

SEQ ID NO: 353722 - DNA, 16 bp, M. musculus
agaacaggtgctttta

SEQ ID NO: 353723 - DNA, 16 bp, M. musculus
agaacagtaactaaga

SEQ ID NO: 353724 - DNA, 16 bp, M. musculus
agaacagtcagggcta

SEQ ID NO: 353725 - DNA, 16 bp, M. musculus
agaacagtcagggctc

SEQ ID NO: 353726 - DNA, 19 bp, M. musculus
agaacagtcagtgctctta

SEQ ID NO: 353727 - DNA, 19 bp, M. musculus
agaacagtcggtgctctta

SEQ ID NO: 353728 - DNA, 16 bp, M. musculus
agaacagtgcagagag

SEQ ID NO: 353729 - DNA, 16 bp, M. musculus
agaacatagagactgt

SEQ ID NO: 353730 - DNA, 16 bp, M. musculus
agaacatatcccacat

SEQ ID NO: 353731 - DNA, 16 bp, M. musculus
agaacatcacagaaga

SEQ ID NO: 353732 - DNA, 16 bp, M. musculus
agaacatcatgagttt

SEQ ID NO: 353733 - DNA, 16 bp, M. musculus
agaacatccagggcta

SEQ ID NO: 353734 - DNA, 16 bp, M. musculus
agaacatccaggttta

SEQ ID NO: 353735 - DNA, 16 bp, M. musculus
agaacatcccacagag

SEQ ID NO: 353736 - DNA, 16 bp, M. musculus
agaacatcctgctgac

SEQ ID NO: 353737 - DNA, 16 bp, M. musculus
agaacatcctttctcc

SEQ ID NO: 353738 - DNA, 16 bp, M. musculus
agaacatcttcacaca

SEQ ID NO: 353739 - DNA, 16 bp, M. musculus
agaacatgaagttggg

SEQ ID NO: 353740 - DNA, 16 bp, M. musculus
agaacatgatcaaaat

SEQ ID NO: 353741 - DNA, 16 bp, M. musculus
agaacatggaagaagg

SEQ ID NO: 353742 - DNA, 16 bp, M. musculus
agaacatggaggccag

SEQ ID NO: 353743 - DNA, 16 bp, M. musculus
agaacatggctgcttt

SEQ ID NO: 353744 - DNA, 16 bp, M. musculus
agaacatgtgacattt

SEQ ID NO: 353745 - DNA, 16 bp, M. musculus
agaacattcatgagaa

SEQ ID NO: 353746 - DNA, 16 bp, M. musculus
agaacattccagaaga

SEQ ID NO: 353747 - DNA, 16 bp, M. musculus
agaacattccagaagg

SEQ ID NO: 353748 - DNA, 16 bp, M. musculus
agaacattctggaaaa

SEQ ID NO: 353749 - DNA, 16 bp, M. musculus
agaacatttcacctaa

SEQ ID NO: 353750 - DNA, 16 bp, M. musculus
agaacattttattcta

SEQ ID NO: 353751 - DNA, 16 bp, M. musculus
agaacattttattgta

SEQ ID NO: 353752 - DNA, 16 bp, M. musculus
agaaccaaacccaggt

SEQ ID NO: 353753 - DNA, 16 bp, M. musculus
agaaccaactcccaca

SEQ ID NO: 353754 - DNA, 16 bp, M. musculus
agaaccaactcccaga

SEQ ID NO: 353755 - DNA, 16 bp, M. musculus
agaaccaagctggagt

SEQ ID NO: 353756 - DNA, 16 bp, M. musculus
agaaccaaggaccacc

SEQ ID NO: 353757 - DNA, 16 bp, M. musculus
agaaccaaggctacca

SEQ ID NO: 353758 - DNA, 16 bp, M. musculus
agaaccaagttctccc

SEQ ID NO: 353759 - DNA, 16 bp, M. musculus
agaaccacactctgac

SEQ ID NO: 353760 - DNA, 16 bp, M. musculus
agaaccaccaacccag

SEQ ID NO: 353761 - DNA, 25 bp, M. musculus
agaaccaccctcggcacatgcgcag

SEQ ID NO: 353762 - DNA, 16 bp, M. musculus
agaaccactgccctgg

SEQ ID NO: 353763 - DNA, 16 bp, M. musculus
agaaccagaaatgaac

SEQ ID NO: 353764 - DNA, 16 bp, M. musculus
agaaccagaaccagaa

SEQ ID NO: 353765 - DNA, 16 bp, M. musculus
agaaccagagaaccag

SEQ ID NO: 353766 - DNA, 16 bp, M. musculus
agaaccagatggcccc

SEQ ID NO: 353767 - DNA, 16 bp, M. musculus
agaaccagctcctggc

SEQ ID NO: 353768 - DNA, 16 bp, M. musculus
agaaccagcttctggt

SEQ ID NO: 353769 - DNA, 16 bp, M. musculus
agaaccaggacaggca

SEQ ID NO: 353770 - DNA, 16 bp, M. musculus
agaaccagtatccagc

SEQ ID NO: 353771 - DNA, 16 bp, M. musculus
agaaccatccatttgc

SEQ ID NO: 353772 - DNA, 16 bp, M. musculus
agaaccattcttcatt

SEQ ID NO: 353773 - DNA, 17 bp, M. musculus
agaaccattgttcattg

SEQ ID NO: 353774 - DNA, 16 bp, M. musculus
agaacccaataaagta

SEQ ID NO: 353775 - DNA, 16 bp, M. musculus
agaacccacacagtag

SEQ ID NO: 353776 - DNA, 16 bp, M. musculus
agaacccacataaaaa

SEQ ID NO: 353777 - DNA, 16 bp, M. musculus
agaacccagagcctca

SEQ ID NO: 353778 - DNA, 16 bp, M. musculus
agaacccagagctttg

SEQ ID NO: 353779 - DNA, 16 bp, M. musculus
agaacccaggatcacc

SEQ ID NO: 353780 - DNA, 16 bp, M. musculus
agaacccagggatggc

SEQ ID NO: 353781 - DNA, 16 bp, M. musculus
agaacccagggccacc

SEQ ID NO: 353782 - DNA, 16 bp, M. musculus
agaacccagggcttca

SEQ ID NO: 353783 - DNA, 16 bp, M. musculus
agaacccaggtgcagt

SEQ ID NO: 353784 - DNA, 16 bp, M. musculus
agaacccaggtgcccc

SEQ ID NO: 353785 - DNA, 16 bp, M. musculus
agaacccagtacttcc

SEQ ID NO: 353786 - DNA, 16 bp, M. musculus
agaacccctgctctag

SEQ ID NO: 353787 - DNA, 16 bp, M. musculus
agaaccctatctcaaa

SEQ ID NO: 353788 - DNA, 16 bp, M. musculus
agaaccctcagctctg

SEQ ID NO: 353789 - DNA, 16 bp, M. musculus
agaaccctcagttcct

SEQ ID NO: 353790 - DNA, 16 bp, M. musculus
agaaccctgcagaaga

SEQ ID NO: 353791 - DNA, 16 bp, M. musculus
agaaccctttagctcc

SEQ ID NO: 353792 - DNA, 16 bp, M. musculus
agaacctactactgcc

SEQ ID NO: 353793 - DNA, 16 bp, M. musculus
agaacctccagaatgg

SEQ ID NO: 353794 - DNA, 16 bp, M. musculus
agaacctcccaaggaa

SEQ ID NO: 353795 - DNA, 18 bp, M. musculus
agaacctctggttgaatc

SEQ ID NO: 353796 - DNA, 16 bp, M. musculus
agaacctctttggcaa

SEQ ID NO: 353797 - DNA, 16 bp, M. musculus
agaacctgaagagacc

SEQ ID NO: 353798 - DNA, 16 bp, M. musculus
agaacctgaggcagga

SEQ ID NO: 353799 - DNA, 16 bp, M. musculus
agaacctgaggctaga

SEQ ID NO: 353800 - DNA, 16 bp, M. musculus
agaacctgagttcaat

SEQ ID NO: 353801 - DNA, 16 bp, M. musculus
agaacctgagtttggt

SEQ ID NO: 353802 - DNA, 16 bp, M. musculus
agaacctgcctcaaaa

SEQ ID NO: 353803 - DNA, 16 bp, M. musculus
agaacctggacgaaat

SEQ ID NO: 353804 - DNA, 16 bp, M. musculus
agaacctgggagaaaa

SEQ ID NO: 353805 - DNA, 16 bp, M. musculus
agaacctgtagagact

SEQ ID NO: 353806 - DNA, 16 bp, M. musculus
agaacctgtctcaaaa

SEQ ID NO: 353807 - DNA, 16 bp, M. musculus
agaacctgttgagacc

SEQ ID NO: 353808 - DNA, 16 bp, M. musculus
agaacctgtttttccc

SEQ ID NO: 353809 - DNA, 16 bp, M. musculus
agaaccttgaacacat

SEQ ID NO: 353810 - DNA, 16 bp, M. musculus
agaacctttcaggaga

SEQ ID NO: 353811 - DNA, 16 bp, M. musculus
agaacggatacagaaa

SEQ ID NO: 353812 - DNA, 16 bp, M. musculus
agaactaagctgtcct

SEQ ID NO: 353813 - DNA, 16 bp, M. musculus
agaactacaccagact

SEQ ID NO: 353814 - DNA, 16 bp, M. musculus
agaactacatagaaag

SEQ ID NO: 353815 - DNA, 16 bp, M. musculus
agaactagaactagaa

SEQ ID NO: 353816 - DNA, 16 bp, M. musculus
agaactagaagtttcc

SEQ ID NO: 353817 - DNA, 19 bp, M. musculus
agaactagaatcttctgtg

SEQ ID NO: 353818 - DNA, 55 bp, M. musculus
agaactagaatcttctgtgttgtcacctgtgttgtggtgacagcaactgcctgtg

SEQ ID NO: 353819 - DNA, 16 bp, M. musculus
agaactatacagagaa

SEQ ID NO: 353820 - DNA, 16 bp, M. musculus
agaactatttccaaat

SEQ ID NO: 353821 - DNA, 17 bp, M. musculus
agaactcaagcaggtca

SEQ ID NO: 353822 - DNA, 16 bp, M. musculus
agaactcaagttcagt

SEQ ID NO: 353823 - DNA, 16 bp, M. musculus
agaactcacagagatc

SEQ ID NO: 353824 - DNA, 16 bp, M. musculus
agaactcactctggag

SEQ ID NO: 353825 - DNA, 16 bp, M. musculus
agaactcagaaatcca

SEQ ID NO: 353826 - DNA, 16 bp, M. musculus
agaactcagaaatccg

SEQ ID NO: 353827 - DNA, 16 bp, M. musculus
agaactcaggacctct

SEQ ID NO: 353828 - DNA, 16 bp, M. musculus
agaactcagggcccca

SEQ ID NO: 353829 - DNA, 16 bp, M. musculus
agaactccaaaacctg

SEQ ID NO: 353830 - DNA, 16 bp, M. musculus
agaactccaaatacac

SEQ ID NO: 353831 - DNA, 16 bp, M. musculus
agaactccaaatatat

SEQ ID NO: 353832 - DNA, 23 bp, M. musculus
agaactccagagaggtaatgagg

SEQ ID NO: 353833 - DNA, 16 bp, M. musculus
agaactctcagctact

SEQ ID NO: 353834 - DNA, 16 bp, M. musculus
agaactctcagctatt

SEQ ID NO: 353835 - DNA, 16 bp, M. musculus
agaactctcagctcat

SEQ ID NO: 353836 - DNA, 16 bp, M. musculus
agaactctcctccatt

SEQ ID NO: 353837 - DNA, 16 bp, M. musculus
agaactctgactaata

SEQ ID NO: 353838 - DNA, 16 bp, M. musculus
agaactctgagtttga

SEQ ID NO: 353839 - DNA, 16 bp, M. musculus
agaactctgtagacca

SEQ ID NO: 353840 - DNA, 16 bp, M. musculus
agaactctgtgagttc

SEQ ID NO: 353841 - DNA, 16 bp, M. musculus
agaactctgtgctaaa

SEQ ID NO: 353842 - DNA, 16 bp, M. musculus
agaactcttaagcctg

SEQ ID NO: 353843 - DNA, 16 bp, M. musculus
agaactcttacaaaaa

SEQ ID NO: 353844 - DNA, 16 bp, M. musculus
agaactcttagctcct

SEQ ID NO: 353845 - DNA, 16 bp, M. musculus
agaactcttagttcct

SEQ ID NO: 353846 - DNA, 16 bp, M. musculus
agaactcttggctcct

SEQ ID NO: 353847 - DNA, 16 bp, M. musculus
agaactctttttaaaa

SEQ ID NO: 353848 - DNA, 16 bp, M. musculus
agaactgaaaaactaa

SEQ ID NO: 353849 - DNA, 16 bp, M. musculus
agaactgaaattagat

SEQ ID NO: 353850 - DNA, 16 bp, M. musculus
agaactgaacctggat

SEQ ID NO: 353851 - DNA, 16 bp, M. musculus
agaactgaagaaatta

SEQ ID NO: 353852 - DNA, 16 bp, M. musculus
agaactgaagacctag

SEQ ID NO: 353853 - DNA, 16 bp, M. musculus
agaactgaagagctct

SEQ ID NO: 353854 - DNA, 16 bp, M. musculus
agaactgactcataat

SEQ ID NO: 353855 - DNA, 16 bp, M. musculus
agaactgactgctctt

SEQ ID NO: 353856 - DNA, 16 bp, M. musculus
agaactgacttctgaa

SEQ ID NO: 353857 - DNA, 16 bp, M. musculus
agaactgagaaagaaa

SEQ ID NO: 353858 - DNA, 16 bp, M. musculus
agaactgagacaagtt

SEQ ID NO: 353859 - DNA, 16 bp, M. musculus
agaactgaggcttttt

SEQ ID NO: 353860 - DNA, 16 bp, M. musculus
agaactgatctcccag

SEQ ID NO: 353861 - DNA, 16 bp, M. musculus
agaactgattcctgaa

SEQ ID NO: 353862 - DNA, 16 bp, M. musculus
agaactgcaagtctct

SEQ ID NO: 353863 - DNA, 16 bp, M. musculus
agaactgcttggagaa

SEQ ID NO: 353864 - DNA, 16 bp, M. musculus
agaactggaactcaaa

SEQ ID NO: 353865 - DNA, 16 bp, M. musculus
agaactggagttagat

SEQ ID NO: 353866 - DNA, 18 bp, M. musculus
agaactgggaacaaaaca

SEQ ID NO: 353867 - DNA, 16 bp, M. musculus
agaactgggttctgat

SEQ ID NO: 353868 - DNA, 16 bp, M. musculus
agaactgtgagaaata

SEQ ID NO: 353869 - DNA, 16 bp, M. musculus
agaactgttcctgtct

SEQ ID NO: 353870 - DNA, 16 bp, M. musculus
agaacttaatgaaaat

SEQ ID NO: 353871 - DNA, 16 bp, M. musculus
agaacttcaaggctct

SEQ ID NO: 353872 - DNA, 17 bp, M. musculus
agaacttctcctggcat

SEQ ID NO: 353873 - DNA, 16 bp, M. musculus
agaacttctcctggtg

SEQ ID NO: 353874 - DNA, 16 bp, M. musculus
agaacttctgctgtag

SEQ ID NO: 353875 - DNA, 16 bp, M. musculus
agaacttctggaagag

SEQ ID NO: 353876 - DNA, 16 bp, M. musculus
agaacttctggcagaa

SEQ ID NO: 353877 - DNA, 16 bp, M. musculus
agaacttctgtgggaa

SEQ ID NO: 353878 - DNA, 16 bp, M. musculus
agaacttctttgaagg

SEQ ID NO: 353879 - DNA, 16 bp, M. musculus
agaacttgctatgcag

SEQ ID NO: 353880 - DNA, 16 bp, M. musculus
agaacttgctgtatag

SEQ ID NO: 353881 - DNA, 16 bp, M. musculus
agaacttggatgaaat

SEQ ID NO: 353882 - DNA, 16 bp, M. musculus
agaacttgggaagtag

SEQ ID NO: 353883 - DNA, 16 bp, M. musculus
agaacttggtgtctca

SEQ ID NO: 353884 - DNA, 16 bp, M. musculus
agaactttcacttcct

SEQ ID NO: 353885 - DNA, 16 bp, M. musculus
agaactttctttaaaa

SEQ ID NO: 353886 - DNA, 16 bp, M. musculus
agaagaaaaaaatcct

SEQ ID NO: 353887 - DNA, 16 bp, M. musculus
agaagaaaaacttcaa

SEQ ID NO: 353888 - DNA, 16 bp, M. musculus
agaagaaaaataatct

SEQ ID NO: 353889 - DNA, 16 bp, M. musculus
agaagaaaaataattc

SEQ ID NO: 353890 - DNA, 16 bp, M. musculus
agaagaaaaattccct

SEQ ID NO: 353891 - DNA, 16 bp, M. musculus
agaagaaaaatttcaa

SEQ ID NO: 353892 - DNA, 16 bp, M. musculus
agaagaaaaatttcca

SEQ ID NO: 353893 - DNA, 16 bp, M. musculus
agaagaaaaatttcct

SEQ ID NO: 353894 - DNA, 16 bp, M. musculus
agaagaaaacatggaa

SEQ ID NO: 353895 - DNA, 16 bp, M. musculus
agaagaaaaccaactc

SEQ ID NO: 353896 - DNA, 16 bp, M. musculus
agaagaaaacttgcct

SEQ ID NO: 353897 - DNA, 16 bp, M. musculus
agaagaaaacttttct

SEQ ID NO: 353898 - DNA, 16 bp, M. musculus
agaagaaaagcaatca

SEQ ID NO: 353899 - DNA, 16 bp, M. musculus
agaagaaaaggctttg

SEQ ID NO: 353900 - DNA, 16 bp, M. musculus
agaagaaaagtttatt

SEQ ID NO: 353901 - DNA, 16 bp, M. musculus
agaagaaaataattct

SEQ ID NO: 353902 - DNA, 16 bp, M. musculus
agaagaaaatgaagtt

SEQ ID NO: 353903 - DNA, 16 bp, M. musculus
agaagaaaatgtattt

SEQ ID NO: 353904 - DNA, 16 bp, M. musculus
agaagaaaatgtcaga

SEQ ID NO: 353905 - DNA, 16 bp, M. musculus
agaagaaaattatttt

SEQ ID NO: 353906 - DNA, 16 bp, M. musculus
agaagaaaattttcca

SEQ ID NO: 353907 - DNA, 16 bp, M. musculus
agaagaaaattttctt

SEQ ID NO: 353908 - DNA, 16 bp, M. musculus
agaagaaacaatgaag

SEQ ID NO: 353909 - DNA, 16 bp, M. musculus
agaagaaaccaaagta

SEQ ID NO: 353910 - DNA, 16 bp, M. musculus
agaagaaaccacagag

SEQ ID NO: 353911 - DNA, 16 bp, M. musculus
agaagaaaccagcatc

SEQ ID NO: 353912 - DNA, 16 bp, M. musculus
agaagaaacctcaagg

SEQ ID NO: 353913 - DNA, 16 bp, M. musculus
agaagaaactaagaca

SEQ ID NO: 353914 - DNA, 16 bp, M. musculus
agaagaaacttcccaa

SEQ ID NO: 353915 - DNA, 16 bp, M. musculus
agaagaaagaaatcac

SEQ ID NO: 353916 - DNA, 16 bp, M. musculus
agaagaaagaccaatg

SEQ ID NO: 353917 - DNA, 16 bp, M. musculus
agaagaaagatttcca

SEQ ID NO: 353918 - DNA, 16 bp, M. musculus
agaagaaagcaaagat

SEQ ID NO: 353919 - DNA, 16 bp, M. musculus
agaagaaagcaaattg

SEQ ID NO: 353920 - DNA, 16 bp, M. musculus
agaagaaagcaatcag

SEQ ID NO: 353921 - DNA, 16 bp, M. musculus
agaagaaagcatttat

SEQ ID NO: 353922 - DNA, 16 bp, M. musculus
agaagaaagctatgct

SEQ ID NO: 353923 - DNA, 16 bp, M. musculus
agaagaaagcttccct

SEQ ID NO: 353924 - DNA, 16 bp, M. musculus
agaagaaaggctggag

SEQ ID NO: 353925 - DNA, 16 bp, M. musculus
agaagaaagggaagct

SEQ ID NO: 353926 - DNA, 16 bp, M. musculus
agaagaaataaaggca

SEQ ID NO: 353927 - DNA, 16 bp, M. musculus
agaagaaatattcaaa

SEQ ID NO: 353928 - DNA, 16 bp, M. musculus
agaagaaatgaaattt

SEQ ID NO: 353929 - DNA, 16 bp, M. musculus
agaagaaatgaagaca

SEQ ID NO: 353930 - DNA, 16 bp, M. musculus
agaagaaatgcttatt

SEQ ID NO: 353931 - DNA, 16 bp, M. musculus
agaagaaattaataca

SEQ ID NO: 353932 - DNA, 16 bp, M. musculus
agaagaaattatattc

SEQ ID NO: 353933 - DNA, 16 bp, M. musculus
agaagaacacatggag

SEQ ID NO: 353934 - DNA, 16 bp, M. musculus
agaagaacagcaatgg

SEQ ID NO: 353935 - DNA, 16 bp, M. musculus
agaagaacggagacca

SEQ ID NO: 353936 - DNA, 16 bp, M. musculus
agaagaactcaccaac

SEQ ID NO: 353937 - DNA, 16 bp, M. musculus
agaagaacttagaagt

SEQ ID NO: 353938 - DNA, 16 bp, M. musculus
agaagaacttctggag

SEQ ID NO: 353939 - DNA, 16 bp, M. musculus
agaagaacttttcaaa

SEQ ID NO: 353940 - DNA, 16 bp, M. musculus
agaagaactttttttt

SEQ ID NO: 353941 - DNA, 16 bp, M. musculus
agaagaagaaaagcta

SEQ ID NO: 353942 - DNA, 16 bp, M. musculus
agaagaagaaactgtt

SEQ ID NO: 353943 - DNA, 16 bp, M. musculus
agaagaagaagaaact

SEQ ID NO: 353944 - DNA, 16 bp, M. musculus
agaagaagaagaactg

SEQ ID NO: 353945 - DNA, 16 bp, M. musculus
agaagaagaagaatcc

SEQ ID NO: 353946 - DNA, 16 bp, M. musculus
agaagaagaagcagcc

SEQ ID NO: 353947 - DNA, 16 bp, M. musculus
agaagaagaagcagct

SEQ ID NO: 353948 - DNA, 16 bp, M. musculus
agaagaagacactgga

SEQ ID NO: 353949 - DNA, 16 bp, M. musculus
agaagaagatgtcaga

SEQ ID NO: 353950 - DNA, 16 bp, M. musculus
agaagaagctgctggg

SEQ ID NO: 353951 - DNA, 16 bp, M. musculus
agaagaaggaagacct

SEQ ID NO: 353952 - DNA, 16 bp, M. musculus
agaagaaggaaggcca

SEQ ID NO: 353953 - DNA, 16 bp, M. musculus
agaagaaggcagcaga

SEQ ID NO: 353954 - DNA, 16 bp, M. musculus
agaagaaggcatcaga

SEQ ID NO: 353955 - DNA, 16 bp, M. musculus
agaagaaggcatcgga

SEQ ID NO: 353956 - DNA, 16 bp, M. musculus
agaagaaggcatctga

SEQ ID NO: 353957 - DNA, 16 bp, M. musculus
agaagaaggtatcaga

SEQ ID NO: 353958 - DNA, 16 bp, M. musculus
agaagaaggtgttggg

SEQ ID NO: 353959 - DNA, 16 bp, M. musculus
agaagaatagactgcc

SEQ ID NO: 353960 - DNA, 16 bp, M. musculus
agaagaatcagatggc

SEQ ID NO: 353961 - DNA, 16 bp, M. musculus
agaagaatccacaaag

SEQ ID NO: 353962 - DNA, 16 bp, M. musculus
agaagaatgaagacta

SEQ ID NO: 353963 - DNA, 16 bp, M. musculus
agaagaatgaagatca

SEQ ID NO: 353964 - DNA, 16 bp, M. musculus
agaagaatgcaaatag

SEQ ID NO: 353965 - DNA, 16 bp, M. musculus
agaagaatggatacaa

SEQ ID NO: 353966 - DNA, 16 bp, M. musculus
agaagaatggatcctg

SEQ ID NO: 353967 - DNA, 16 bp, M. musculus
agaagaatgtgaaatg

SEQ ID NO: 353968 - DNA, 19 bp, M. musculus
agaagaatgttgtttttat

SEQ ID NO: 353969 - DNA, 16 bp, M. musculus
agaagaattcaaatag

SEQ ID NO: 353970 - DNA, 16 bp, M. musculus
agaagaatttgaattg

SEQ ID NO: 353971 - DNA, 16 bp, M. musculus
agaagacaacatcaga

SEQ ID NO: 353972 - DNA, 16 bp, M. musculus
agaagacaacattttc

SEQ ID NO: 353973 - DNA, 16 bp, M. musculus
agaagacaaccttggg

SEQ ID NO: 353974 - DNA, 16 bp, M. musculus
agaagacaacttatgg

SEQ ID NO: 353975 - DNA, 16 bp, M. musculus
agaagacaacttgctg

SEQ ID NO: 353976 - DNA, 16 bp, M. musculus
agaagacaagatgtgt

SEQ ID NO: 353977 - DNA, 16 bp, M. musculus
agaagacacagaggag

SEQ ID NO: 353978 - DNA, 16 bp, M. musculus
agaagacacatggtgg

SEQ ID NO: 353979 - DNA, 16 bp, M. musculus
agaagacaccagaaga

SEQ ID NO: 353980 - DNA, 16 bp, M. musculus
agaagacactggagga

SEQ ID NO: 353981 - DNA, 16 bp, M. musculus
agaagacagaaaagat

SEQ ID NO: 353982 - DNA, 16 bp, M. musculus
agaagacagaattttc

SEQ ID NO: 353983 - DNA, 16 bp, M. musculus
agaagacagagccatg

SEQ ID NO: 353984 - DNA, 16 bp, M. musculus
agaagacagagcctca

SEQ ID NO: 353985 - DNA, 16 bp, M. musculus
agaagacagagctgga

SEQ ID NO: 353986 - DNA, 16 bp, M. musculus
agaagacagaggcagg

SEQ ID NO: 353987 - DNA, 16 bp, M. musculus
agaagacaggtaaaca

SEQ ID NO: 353988 - DNA, 16 bp, M. musculus
agaagacagtatcaga

SEQ ID NO: 353989 - DNA, 16 bp, M. musculus
agaagacagtgaagat

SEQ ID NO: 353990 - DNA, 16 bp, M. musculus
agaagacatgagttca

SEQ ID NO: 353991 - DNA, 16 bp, M. musculus
agaagacatttaattg

SEQ ID NO: 353992 - DNA, 16 bp, M. musculus
agaagacattttgcta

SEQ ID NO: 353993 - DNA, 16 bp, M. musculus
agaagaccaaccctac

SEQ ID NO: 353994 - DNA, 16 bp, M. musculus
agaagaccagagagga

SEQ ID NO: 353995 - DNA, 16 bp, M. musculus
agaagacccaagtttg

SEQ ID NO: 353996 - DNA, 16 bp, M. musculus
agaagacccaggttca

SEQ ID NO: 353997 - DNA, 16 bp, M. musculus
agaagacctacagagt

SEQ ID NO: 353998 - DNA, 16 bp, M. musculus
agaagacctgagttct

SEQ ID NO: 353999 - DNA, 16 bp, M. musculus
agaagacctgattcca

SEQ ID NO: 354000 - DNA, 16 bp, M. musculus
agaagactagcatcca

SEQ ID NO: 354001 - DNA, 16 bp, M. musculus
agaagactgaagtgtg

SEQ ID NO: 354002 - DNA, 16 bp, M. musculus
agaagactggcctcca

SEQ ID NO: 354003 - DNA, 16 bp, M. musculus
agaagactggggttca

SEQ ID NO: 354004 - DNA, 16 bp, M. musculus
agaagacttgagttca

SEQ ID NO: 354005 - DNA, 16 bp, M. musculus
agaagactttaagaag

SEQ ID NO: 354006 - DNA, 16 bp, M. musculus
agaagagaaaaatcat

SEQ ID NO: 354007 - DNA, 16 bp, M. musculus
agaagagaaaatgttt

SEQ ID NO: 354008 - DNA, 16 bp, M. musculus
agaagagaaatatttt

SEQ ID NO: 354009 - DNA, 16 bp, M. musculus
agaagagaaattattt

SEQ ID NO: 354010 - DNA, 16 bp, M. musculus
agaagagaacatgagg

SEQ ID NO: 354011 - DNA, 16 bp, M. musculus
agaagagacaggcaga

SEQ ID NO: 354012 - DNA, 16 bp, M. musculus
agaagagaccctgtct

SEQ ID NO: 354013 - DNA, 16 bp, M. musculus
agaagagactgaaaga

SEQ ID NO: 354014 - DNA, 16 bp, M. musculus
agaagagactgaggaa

SEQ ID NO: 354015 - DNA, 16 bp, M. musculus
agaagagagaatcaca

SEQ ID NO: 354016 - DNA, 16 bp, M. musculus
agaagagagactccaa

SEQ ID NO: 354017 - DNA, 16 bp, M. musculus
agaagagagcaccaga

SEQ ID NO: 354018 - DNA, 16 bp, M. musculus
agaagagagcatcaga

SEQ ID NO: 354019 - DNA, 16 bp, M. musculus
agaagagagggactca

SEQ ID NO: 354020 - DNA, 16 bp, M. musculus
agaagagagtgaagat

SEQ ID NO: 354021 - DNA, 17 bp, M. musculus
agaagagagtgaagatt

SEQ ID NO: 354022 - DNA, 16 bp, M. musculus
agaagagagtgaggat

SEQ ID NO: 354023 - DNA, 16 bp, M. musculus
agaagagatggccaga

SEQ ID NO: 354024 - DNA, 16 bp, M. musculus
agaagagcactcagtg

SEQ ID NO: 354025 - DNA, 16 bp, M. musculus
agaagagcagcaagtg

SEQ ID NO: 354026 - DNA, 16 bp, M. musculus
agaagagcagcagcag

SEQ ID NO: 354027 - DNA, 16 bp, M. musculus
agaagagcagcagtag

SEQ ID NO: 354028 - DNA, 36 bp, M. musculus
agaagagcagtcgggtgctcttacccactgagccat

SEQ ID NO: 354029 - DNA, 16 bp, M. musculus
agaagagcagtcggtg

SEQ ID NO: 354030 - DNA, 16 bp, M. musculus
agaagagcatccagtg

SEQ ID NO: 354031 - DNA, 16 bp, M. musculus
agaagagcatgagaga

SEQ ID NO: 354032 - DNA, 16 bp, M. musculus
agaagagcatggacag

SEQ ID NO: 354033 - DNA, 16 bp, M. musculus
agaagagcatgtgaag

SEQ ID NO: 354034 - DNA, 16 bp, M. musculus
agaagagcccagccca

SEQ ID NO: 354035 - DNA, 16 bp, M. musculus
agaagagctgaagaga

SEQ ID NO: 354036 - DNA, 16 bp, M. musculus
agaagagctggagaga

SEQ ID NO: 354037 - DNA, 16 bp, M. musculus
agaagagctggctctg

SEQ ID NO: 354038 - DNA, 16 bp, M. musculus
agaagaggaaactgaa

SEQ ID NO: 354039 - DNA, 16 bp, M. musculus
agaagaggaaactgag

SEQ ID NO: 354040 - DNA, 16 bp, M. musculus
agaagaggacactgga

SEQ ID NO: 354041 - DNA, 16 bp, M. musculus
agaagaggacattaga

SEQ ID NO: 354042 - DNA, 16 bp, M. musculus
agaagaggatgctcac

SEQ ID NO: 354043 - DNA, 16 bp, M. musculus
agaagaggatgctgga

SEQ ID NO: 354044 - DNA, 16 bp, M. musculus
agaagaggcaggcaga

SEQ ID NO: 354045 - DNA, 16 bp, M. musculus
agaagaggcagtcaga

SEQ ID NO: 354046 - DNA, 16 bp, M. musculus
agaagaggcatcagat

SEQ ID NO: 354047 - DNA, 16 bp, M. musculus
agaagaggccagaaga

SEQ ID NO: 354048 - DNA, 16 bp, M. musculus
agaagaggccagcatc

SEQ ID NO: 354049 - DNA, 16 bp, M. musculus
agaagaggctggccat

SEQ ID NO: 354050 - DNA, 24 bp, M. musculus
agaagagggagtcagatcttgttg

SEQ ID NO: 354051 - DNA, 16 bp, M. musculus
agaagagggcatagaa

SEQ ID NO: 354052 - DNA, 16 bp, M. musculus
agaagagggcatcata

SEQ ID NO: 354053 - DNA, 16 bp, M. musculus
agaagagggcatctga

SEQ ID NO: 354054 - DNA, 16 bp, M. musculus
agaagagggcattaca

SEQ ID NO: 354055 - DNA, 16 bp, M. musculus
agaagagggcattaga

SEQ ID NO: 354056 - DNA, 16 bp, M. musculus
agaagagggcattgga

SEQ ID NO: 354057 - DNA, 16 bp, M. musculus
agaagagggccctgga

SEQ ID NO: 354058 - DNA, 16 bp, M. musculus
agaagagggcctggga

SEQ ID NO: 354059 - DNA, 16 bp, M. musculus
agaagagggcttcaga

SEQ ID NO: 354060 - DNA, 17 bp, M. musculus
agaagagggggtcagat

SEQ ID NO: 354061 - DNA, 16 bp, M. musculus
agaagagggtatcaga

SEQ ID NO: 354062 - DNA, 16 bp, M. musculus
agaagagggtgacaga

SEQ ID NO: 354063 - DNA, 16 bp, M. musculus
agaagagggtgtcaga

SEQ ID NO: 354064 - DNA, 16 bp, M. musculus
agaagagggtgtttga

SEQ ID NO: 354065 - DNA, 16 bp, M. musculus
agaagaggtcatctga

SEQ ID NO: 354066 - DNA, 16 bp, M. musculus
agaagagtatgtcaga

SEQ ID NO: 354067 - DNA, 16 bp, M. musculus
agaagagtctgaggaa

SEQ ID NO: 354068 - DNA, 16 bp, M. musculus
agaagagtgcattgga

SEQ ID NO: 354069 - DNA, 16 bp, M. musculus
agaagataaaaagatc

SEQ ID NO: 354070 - DNA, 16 bp, M. musculus
agaagataacatagaa

SEQ ID NO: 354071 - DNA, 16 bp, M. musculus
agaagataccacagaa

SEQ ID NO: 354072 - DNA, 16 bp, M. musculus
agaagatactgtagaa

SEQ ID NO: 354073 - DNA, 16 bp, M. musculus
agaagatagcagaaga

SEQ ID NO: 354074 - DNA, 16 bp, M. musculus
agaagatagccacatg

SEQ ID NO: 354075 - DNA, 16 bp, M. musculus
agaagatattgacaca

SEQ ID NO: 354076 - DNA, 16 bp, M. musculus
agaagatcaacagagt

SEQ ID NO: 354077 - DNA, 16 bp, M. musculus
agaagatcacagaaga

SEQ ID NO: 354078 - DNA, 17 bp, M. musculus
agaagatcatggacaga

SEQ ID NO: 354079 - DNA, 16 bp, M. musculus
agaagatccagaaata

SEQ ID NO: 354080 - DNA, 16 bp, M. musculus
agaagatcctggacag

SEQ ID NO: 354081 - DNA, 16 bp, M. musculus
agaagatcctggagag

SEQ ID NO: 354082 - DNA, 16 bp, M. musculus
agaagatcctgggcaa

SEQ ID NO: 354083 - DNA, 16 bp, M. musculus
agaagatcctgggcag

SEQ ID NO: 354084 - DNA, 16 bp, M. musculus
agaagatctaattcaa

SEQ ID NO: 354085 - DNA, 16 bp, M. musculus
agaagatctcagaaca

SEQ ID NO: 354086 - DNA, 16 bp, M. musculus
agaagatctcagaaga

SEQ ID NO: 354087 - DNA, 16 bp, M. musculus
agaagatctctgaaga

SEQ ID NO: 354088 - DNA, 16 bp, M. musculus
agaagatgaaaatatc

SEQ ID NO: 354089 - DNA, 16 bp, M. musculus
agaagatgaccttgaa

SEQ ID NO: 354090 - DNA, 16 bp, M. musculus
agaagatgatgcagag

SEQ ID NO: 354091 - DNA, 16 bp, M. musculus
agaagatgcaccaaac

SEQ ID NO: 354092 - DNA, 16 bp, M. musculus
agaagatgcagctgtc

SEQ ID NO: 354093 - DNA, 16 bp, M. musculus
agaagatgctggagag

SEQ ID NO: 354094 - DNA, 16 bp, M. musculus
agaagatgcttcaaca

SEQ ID NO: 354095 - DNA, 16 bp, M. musculus
agaagatggaagacca

SEQ ID NO: 354096 - DNA, 16 bp, M. musculus
agaagatggagagatc

SEQ ID NO: 354097 - DNA, 16 bp, M. musculus
agaagatggagtcaga

SEQ ID NO: 354098 - DNA, 16 bp, M. musculus
agaagatggatggatg

SEQ ID NO: 354099 - DNA, 16 bp, M. musculus
agaagatggcaagatc

SEQ ID NO: 354100 - DNA, 16 bp, M. musculus
agaagatggcactgga

SEQ ID NO: 354101 - DNA, 16 bp, M. musculus
agaagatggcatagtt

SEQ ID NO: 354102 - DNA, 17 bp, M. musculus
agaagatggcctacttg

SEQ ID NO: 354103 - DNA, 16 bp, M. musculus
agaagatggtgtcaga

SEQ ID NO: 354104 - DNA, 16 bp, M. musculus
agaagatggtgtcagc

SEQ ID NO: 354105 - DNA, 16 bp, M. musculus
agaagatggtgttgga

SEQ ID NO: 354106 - DNA, 16 bp, M. musculus
agaagatgtggccttg

SEQ ID NO: 354107 - DNA, 16 bp, M. musculus
agaagatgttaaaacc

SEQ ID NO: 354108 - DNA, 16 bp, M. musculus
agaagatgttccagct

SEQ ID NO: 354109 - DNA, 16 bp, M. musculus
agaagattccagaaga

SEQ ID NO: 354110 - DNA, 16 bp, M. musculus
agaagattctagaaga

SEQ ID NO: 354111 - DNA, 16 bp, M. musculus
agaagattctagaagg

SEQ ID NO: 354112 - DNA, 16 bp, M. musculus
agaagattggaaatat

SEQ ID NO: 354113 - DNA, 16 bp, M. musculus
agaagattgtgagtgg

SEQ ID NO: 354114 - DNA, 16 bp, M. musculus
agaagatttccagttt

SEQ ID NO: 354115 - DNA, 16 bp, M. musculus
agaagattttgaattg

SEQ ID NO: 354116 - DNA, 17 bp, M. musculus
agaagcaacagaaacca

SEQ ID NO: 354117 - DNA, 16 bp, M. musculus
agaagcaacttaagag

SEQ ID NO: 354118 - DNA, 16 bp, M. musculus
agaagcaagaccaaag

SEQ ID NO: 354119 - DNA, 16 bp, M. musculus
agaagcaagagaaacc

SEQ ID NO: 354120 - DNA, 16 bp, M. musculus
agaagcaagagagtaa

SEQ ID NO: 354121 - DNA, 17 bp, M. musculus
agaagcaagcaataaag

SEQ ID NO: 354122 - DNA, 16 bp, M. musculus
agaagcaagttagaga

SEQ ID NO: 354123 - DNA, 16 bp, M. musculus
agaagcaagttgagga

SEQ ID NO: 354124 - DNA, 16 bp, M. musculus
agaagcaataaaggaa

SEQ ID NO: 354125 - DNA, 16 bp, M. musculus
agaagcacaaaatata

SEQ ID NO: 354126 - DNA, 17 bp, M. musculus
agaagcacctaaagaaa

SEQ ID NO: 354127 - DNA, 16 bp, M. musculus
agaagcacctagaaaa

SEQ ID NO: 354128 - DNA, 16 bp, M. musculus
agaagcactcaaagaa

SEQ ID NO: 354129 - DNA, 16 bp, M. musculus
agaagcactgaagcat

SEQ ID NO: 354130 - DNA, 16 bp, M. musculus
agaagcacttaaagaa

SEQ ID NO: 354131 - DNA, 16 bp, M. musculus
agaagcagaaacaata

SEQ ID NO: 354132 - DNA, 16 bp, M. musculus
agaagcagaaatgaaa

SEQ ID NO: 354133 - DNA, 16 bp, M. musculus
agaagcagaaatgcag

SEQ ID NO: 354134 - DNA, 16 bp, M. musculus
agaagcagaagcagag

SEQ ID NO: 354135 - DNA, 16 bp, M. musculus
agaagcagaagcagca

SEQ ID NO: 354136 - DNA, 16 bp, M. musculus
agaagcagaagctgat

SEQ ID NO: 354137 - DNA, 16 bp, M. musculus
agaagcagaagttact

SEQ ID NO: 354138 - DNA, 16 bp, M. musculus
agaagcagacagattt

SEQ ID NO: 354139 - DNA, 16 bp, M. musculus
agaagcagagacagag

SEQ ID NO: 354140 - DNA, 16 bp, M. musculus
agaagcagagacagga

SEQ ID NO: 354141 - DNA, 16 bp, M. musculus
agaagcagagaccagc

SEQ ID NO: 354142 - DNA, 16 bp, M. musculus
agaagcagagagacag

SEQ ID NO: 354143 - DNA, 16 bp, M. musculus
agaagcagagagctga

SEQ ID NO: 354144 - DNA, 16 bp, M. musculus
agaagcagagatggga

SEQ ID NO: 354145 - DNA, 16 bp, M. musculus
agaagcagaggcagag

SEQ ID NO: 354146 - DNA, 16 bp, M. musculus
agaagcagaggcaggc

SEQ ID NO: 354147 - DNA, 16 bp, M. musculus
agaagcagatgaagat

SEQ ID NO: 354148 - DNA, 16 bp, M. musculus
agaagcagcaagaagc

SEQ ID NO: 354149 - DNA, 16 bp, M. musculus
agaagcagcagaagca

SEQ ID NO: 354150 - DNA, 16 bp, M. musculus
agaagcagcagagcag

SEQ ID NO: 354151 - DNA, 16 bp, M. musculus
agaagcagcagcaaca

SEQ ID NO: 354152 - DNA, 16 bp, M. musculus
agaagcagcagcagaa

SEQ ID NO: 354153 - DNA, 16 bp, M. musculus
agaagcagcagcagct

SEQ ID NO: 354154 - DNA, 16 bp, M. musculus
agaagcagcaggagga

SEQ ID NO: 354155 - DNA, 16 bp, M. musculus
agaagcagccagaaca

SEQ ID NO: 354156 - DNA, 16 bp, M. musculus
agaagcagccagggaa

SEQ ID NO: 354157 - DNA, 16 bp, M. musculus
agaagcagccagtgct

SEQ ID NO: 354158 - DNA, 16 bp, M. musculus
agaagcaggaagacca

SEQ ID NO: 354159 - DNA, 16 bp, M. musculus
agaagcaggaagatgg

SEQ ID NO: 354160 - DNA, 16 bp, M. musculus
agaagcaggagcagga

SEQ ID NO: 354161 - DNA, 16 bp, M. musculus
agaagcaggcaaatct

SEQ ID NO: 354162 - DNA, 16 bp, M. musculus
agaagcaggtggacct

SEQ ID NO: 354163 - DNA, 16 bp, M. musculus
agaagcaggtggctct

SEQ ID NO: 354164 - DNA, 16 bp, M. musculus
agaagcaggtgtatct

SEQ ID NO: 354165 - DNA, 16 bp, M. musculus
agaagcatggggaggg

SEQ ID NO: 354166 - DNA, 16 bp, M. musculus
agaagcatttaaaaaa

SEQ ID NO: 354167 - DNA, 16 bp, M. musculus
agaagcattttctcaa

SEQ ID NO: 354168 - DNA, 16 bp, M. musculus
agaagccaaaagaagc

SEQ ID NO: 354169 - DNA, 16 bp, M. musculus
agaagccaaaaggcaa

SEQ ID NO: 354170 - DNA, 16 bp, M. musculus
agaagccaaaggcctt

SEQ ID NO: 354171 - DNA, 16 bp, M. musculus
agaagccaagaagcaa

SEQ ID NO: 354172 - DNA, 16 bp, M. musculus
agaagccaagatggag

SEQ ID NO: 354173 - DNA, 16 bp, M. musculus
agaagccaaggaggag

SEQ ID NO: 354174 - DNA, 16 bp, M. musculus
agaagccaaggcagaa

SEQ ID NO: 354175 - DNA, 16 bp, M. musculus
agaagccaatcactgg

SEQ ID NO: 354176 - DNA, 16 bp, M. musculus
agaagccaattgctgg

SEQ ID NO: 354177 - DNA, 16 bp, M. musculus
agaagccagaagaagg

SEQ ID NO: 354178 - DNA, 16 bp, M. musculus
agaagccagaagagga

SEQ ID NO: 354179 - DNA, 17 bp, M. musculus
agaagccagaagagggt

SEQ ID NO: 354180 - DNA, 16 bp, M. musculus
agaagccagaagatgg

SEQ ID NO: 354181 - DNA, 16 bp, M. musculus
agaagccagaagccag

SEQ ID NO: 354182 - DNA, 16 bp, M. musculus
agaagccagaagcctt

SEQ ID NO: 354183 - DNA, 16 bp, M. musculus
agaagccagagaaagt

SEQ ID NO: 354184 - DNA, 16 bp, M. musculus
agaagccagagaacaa

SEQ ID NO: 354185 - DNA, 16 bp, M. musculus
agaagccagagacctg

SEQ ID NO: 354186 - DNA, 16 bp, M. musculus
agaagccagagccctc

SEQ ID NO: 354187 - DNA, 16 bp, M. musculus
agaagccagaggagga

SEQ ID NO: 354188 - DNA, 16 bp, M. musculus
agaagccagaggcagg

SEQ ID NO: 354189 - DNA, 16 bp, M. musculus
agaagccagatgcccc

SEQ ID NO: 354190 - DNA, 16 bp, M. musculus
agaagccagggcagga

SEQ ID NO: 354191 - DNA, 16 bp, M. musculus
agaagcccagaagctt

SEQ ID NO: 354192 - DNA, 16 bp, M. musculus
agaagccctgaaagag

SEQ ID NO: 354193 - DNA, 16 bp, M. musculus
agaagcctacagaatt

SEQ ID NO: 354194 - DNA, 16 bp, M. musculus
agaagcctatagaaca

SEQ ID NO: 354195 - DNA, 16 bp, M. musculus
agaagcctccagaact

SEQ ID NO: 354196 - DNA, 16 bp, M. musculus
agaagcctgcagaact

SEQ ID NO: 354197 - DNA, 16 bp, M. musculus
agaagcctgcctgctc

SEQ ID NO: 354198 - DNA, 16 bp, M. musculus
agaagcctgggcagct

SEQ ID NO: 354199 - DNA, 16 bp, M. musculus
agaagcctgtgtcttc

SEQ ID NO: 354200 - DNA, 16 bp, M. musculus
agaagctaaaaagcaa

SEQ ID NO: 354201 - DNA, 16 bp, M. musculus
agaagctaaacaagga

SEQ ID NO: 354202 - DNA, 16 bp, M. musculus
agaagctaaagaaagc

SEQ ID NO: 354203 - DNA, 16 bp, M. musculus
agaagctaagaaacaa

SEQ ID NO: 354204 - DNA, 16 bp, M. musculus
agaagctagaaaaagt

SEQ ID NO: 354205 - DNA, 16 bp, M. musculus
agaagctcctaaagaa

SEQ ID NO: 354206 - DNA, 16 bp, M. musculus
agaagctctacccagc

SEQ ID NO: 354207 - DNA, 16 bp, M. musculus
agaagctctgccagag

SEQ ID NO: 354208 - DNA, 16 bp, M. musculus
agaagctctgtggctc

SEQ ID NO: 354209 - DNA, 16 bp, M. musculus
agaagctcttaaagaa

SEQ ID NO: 354210 - DNA, 16 bp, M. musculus
agaagctcttaaagag

SEQ ID NO: 354211 - DNA, 16 bp, M. musculus
agaagctgaagaggag

SEQ ID NO: 354212 - DNA, 16 bp, M. musculus
agaagctgaagcagag

SEQ ID NO: 354213 - DNA, 16 bp, M. musculus
agaagctgaagcagga

SEQ ID NO: 354214 - DNA, 16 bp, M. musculus
agaagctgaaggagag

SEQ ID NO: 354215 - DNA, 16 bp, M. musculus
agaagctgaaggagtt

SEQ ID NO: 354216 - DNA, 16 bp, M. musculus
agaagctgagaaaagc

SEQ ID NO: 354217 - DNA, 16 bp, M. musculus
agaagctgagaaagca

SEQ ID NO: 354218 - DNA, 16 bp, M. musculus
agaagctgagaaggag

SEQ ID NO: 354219 - DNA, 16 bp, M. musculus
agaagctgagaagggt

SEQ ID NO: 354220 - DNA, 16 bp, M. musculus
agaagctgagagaagt

SEQ ID NO: 354221 - DNA, 16 bp, M. musculus
agaagctgagagttct

SEQ ID NO: 354222 - DNA, 16 bp, M. musculus
agaagctgaggaagaa

SEQ ID NO: 354223 - DNA, 16 bp, M. musculus
agaagctgaggagaat

SEQ ID NO: 354224 - DNA, 16 bp, M. musculus
agaagctgaggaggat

SEQ ID NO: 354225 - DNA, 16 bp, M. musculus
agaagctgaggcagaa

SEQ ID NO: 354226 - DNA, 16 bp, M. musculus
agaagctgaggcagga

SEQ ID NO: 354227 - DNA, 16 bp, M. musculus
agaagctgcaggaccc

SEQ ID NO: 354228 - DNA, 16 bp, M. musculus
agaagctgctgaccct

SEQ ID NO: 354229 - DNA, 16 bp, M. musculus
agaagctgctgatccc

SEQ ID NO: 354230 - DNA, 16 bp, M. musculus
agaagctgctggcctc

SEQ ID NO: 354231 - DNA, 20 bp, M. musculus
agaagctggaaagaacccat

SEQ ID NO: 354232 - DNA, 16 bp, M. musculus
agaagctggaagaaat

SEQ ID NO: 354233 - DNA, 16 bp, M. musculus
agaagctggaccccag

SEQ ID NO: 354234 - DNA, 16 bp, M. musculus
agaagctggagagagc

SEQ ID NO: 354235 - DNA, 16 bp, M. musculus
agaagctggaggaagg

SEQ ID NO: 354236 - DNA, 16 bp, M. musculus
agaagctggctctgga

SEQ ID NO: 354237 - DNA, 16 bp, M. musculus
agaagctgtggaggag

SEQ ID NO: 354238 - DNA, 16 bp, M. musculus
agaagctgtggcccag

SEQ ID NO: 354239 - DNA, 16 bp, M. musculus
agaagctgtgttccag

SEQ ID NO: 354240 - DNA, 16 bp, M. musculus
agaagctgtgttctag

SEQ ID NO: 354241 - DNA, 16 bp, M. musculus
agaagctgttcagttt

SEQ ID NO: 354242 - DNA, 16 bp, M. musculus
agaagctgtttgcttc

SEQ ID NO: 354243 - DNA, 16 bp, M. musculus
agaagcttaaagaaca

SEQ ID NO: 354244 - DNA, 16 bp, M. musculus
agaagcttaacaagaa

SEQ ID NO: 354245 - DNA, 16 bp, M. musculus
agaagcttcagttgag

SEQ ID NO: 354246 - DNA, 16 bp, M. musculus
agaagcttccaggact

SEQ ID NO: 354247 - DNA, 16 bp, M. musculus
agaagcttccaggcct

SEQ ID NO: 354248 - DNA, 16 bp, M. musculus
agaagcttctagaagc

SEQ ID NO: 354249 - DNA, 16 bp, M. musculus
agaagcttctctgagg

SEQ ID NO: 354250 - DNA, 16 bp, M. musculus
agaaggaaaagagccc

SEQ ID NO: 354251 - DNA, 16 bp, M. musculus
agaaggaaaaggctga

SEQ ID NO: 354252 - DNA, 16 bp, M. musculus
agaaggaaaatgctga

SEQ ID NO: 354253 - DNA, 16 bp, M. musculus
agaaggaaagatttat

SEQ ID NO: 354254 - DNA, 16 bp, M. musculus
agaaggaaaggctgga

SEQ ID NO: 354255 - DNA, 16 bp, M. musculus
agaaggaaatctccaa

SEQ ID NO: 354256 - DNA, 16 bp, M. musculus
agaaggaacactactt

SEQ ID NO: 354257 - DNA, 16 bp, M. musculus
agaaggaacctgagct

SEQ ID NO: 354258 - DNA, 16 bp, M. musculus
agaaggaacctgtgcc

SEQ ID NO: 354259 - DNA, 16 bp, M. musculus
agaaggaactgaagga

SEQ ID NO: 354260 - DNA, 16 bp, M. musculus
agaaggaagaagccat

SEQ ID NO: 354261 - DNA, 16 bp, M. musculus
agaaggaagagtttat

SEQ ID NO: 354262 - DNA, 16 bp, M. musculus
agaaggaagatcaaag

SEQ ID NO: 354263 - DNA, 16 bp, M. musculus
agaaggaagcaaccat

SEQ ID NO: 354264 - DNA, 16 bp, M. musculus
agaaggaagcagccac

SEQ ID NO: 354265 - DNA, 16 bp, M. musculus
agaaggaagcaggctg

SEQ ID NO: 354266 - DNA, 16 bp, M. musculus
agaaggaaggaagatc

SEQ ID NO: 354267 - DNA, 16 bp, M. musculus
agaaggaaggaccatt

SEQ ID NO: 354268 - DNA, 16 bp, M. musculus
agaaggaaggccaaag

SEQ ID NO: 354269 - DNA, 16 bp, M. musculus
agaaggaaggcctaag

SEQ ID NO: 354270 - DNA, 16 bp, M. musculus
agaaggaagtaaatat

SEQ ID NO: 354271 - DNA, 16 bp, M. musculus
agaaggaattgaacaa

SEQ ID NO: 354272 - DNA, 16 bp, M. musculus
agaaggaatttatgaa

SEQ ID NO: 354273 - DNA, 16 bp, M. musculus
agaaggacatgcatgg

SEQ ID NO: 354274 - DNA, 16 bp, M. musculus
agaaggactgaaggaa

SEQ ID NO: 354275 - DNA, 16 bp, M. musculus
agaaggactggtggtt

SEQ ID NO: 354276 - DNA, 16 bp, M. musculus
agaaggagaaactgag

SEQ ID NO: 354277 - DNA, 16 bp, M. musculus
agaaggagaacaaaat

SEQ ID NO: 354278 - DNA, 16 bp, M. musculus
agaaggagaacttcag

SEQ ID NO: 354279 - DNA, 16 bp, M. musculus
agaaggagaagccctg

SEQ ID NO: 354280 - DNA, 16 bp, M. musculus
agaaggagaatgcaga

SEQ ID NO: 354281 - DNA, 16 bp, M. musculus
agaaggagacagagac

SEQ ID NO: 354282 - DNA, 16 bp, M. musculus
agaaggagagaactgg

SEQ ID NO: 354283 - DNA, 16 bp, M. musculus
agaaggagcagcagca

SEQ ID NO: 354284 - DNA, 16 bp, M. musculus
agaaggagccagaaga

SEQ ID NO: 354285 - DNA, 16 bp, M. musculus
agaaggagccagagga

SEQ ID NO: 354286 - DNA, 16 bp, M. musculus
agaaggagctagaaaa

SEQ ID NO: 354287 - DNA, 16 bp, M. musculus
agaaggagctagaaga

SEQ ID NO: 354288 - DNA, 16 bp, M. musculus
agaaggagctagagaa

SEQ ID NO: 354289 - DNA, 16 bp, M. musculus
agaaggagctgagact

SEQ ID NO: 354290 - DNA, 16 bp, M. musculus
agaaggagctgagtgt

SEQ ID NO: 354291 - DNA, 16 bp, M. musculus
agaaggagctggagaa

SEQ ID NO: 354292 - DNA, 16 bp, M. musculus
agaaggaggacatcct

SEQ ID NO: 354293 - DNA, 16 bp, M. musculus
agaaggaggcatcaga

SEQ ID NO: 354294 - DNA, 16 bp, M. musculus
agaaggagggaactga

SEQ ID NO: 354295 - DNA, 16 bp, M. musculus
agaaggatcatgagtt

SEQ ID NO: 354296 - DNA, 16 bp, M. musculus
agaaggatctgatgga

SEQ ID NO: 354297 - DNA, 16 bp, M. musculus
agaaggatggatggat

SEQ ID NO: 354298 - DNA, 16 bp, M. musculus
agaaggcagaaaatag

SEQ ID NO: 354299 - DNA, 16 bp, M. musculus
agaaggcagaaggcag

SEQ ID NO: 354300 - DNA, 16 bp, M. musculus
agaaggcagagctgga

SEQ ID NO: 354301 - DNA, 16 bp, M. musculus
agaaggcagaggcaag

SEQ ID NO: 354302 - DNA, 16 bp, M. musculus
agaaggcagaggcaga

SEQ ID NO: 354303 - DNA, 16 bp, M. musculus
agaaggcagaggcagc

SEQ ID NO: 354304 - DNA, 16 bp, M. musculus
agaaggcagaggctgg

SEQ ID NO: 354305 - DNA, 16 bp, M. musculus
agaaggcagcagaaag

SEQ ID NO: 354306 - DNA, 16 bp, M. musculus
agaaggcaggaggatc

SEQ ID NO: 354307 - DNA, 16 bp, M. musculus
agaaggcagtttgatg

SEQ ID NO: 354308 - DNA, 16 bp, M. musculus
agaaggccagagagaa

SEQ ID NO: 354309 - DNA, 16 bp, M. musculus
agaaggcccagtgaca

SEQ ID NO: 354310 - DNA, 16 bp, M. musculus
agaaggccttaaagaa

SEQ ID NO: 354311 - DNA, 16 bp, M. musculus
agaaggccttcctgca

SEQ ID NO: 354312 - DNA, 16 bp, M. musculus
agaaggctaaggcagg

SEQ ID NO: 354313 - DNA, 16 bp, M. musculus
agaaggctcacaacca

SEQ ID NO: 354314 - DNA, 16 bp, M. musculus
agaaggctcagaagtt

SEQ ID NO: 354315 - DNA, 16 bp, M. musculus
agaaggctcagctggt

SEQ ID NO: 354316 - DNA, 16 bp, M. musculus
agaaggctcagtgagt

SEQ ID NO: 354317 - DNA, 16 bp, M. musculus
agaaggctcagttggt

SEQ ID NO: 354318 - DNA, 16 bp, M. musculus
agaaggctgaagacag

SEQ ID NO: 354319 - DNA, 16 bp, M. musculus
agaaggctgaggcaga

SEQ ID NO: 354320 - DNA, 16 bp, M. musculus
agaaggctgaggcagg

SEQ ID NO: 354321 - DNA, 16 bp, M. musculus
agaaggctgtgtgtgt

SEQ ID NO: 354322 - DNA, 16 bp, M. musculus
agaagggagacccaca

SEQ ID NO: 354323 - DNA, 16 bp, M. musculus
agaagggagatcgagc

SEQ ID NO: 354324 - DNA, 16 bp, M. musculus
agaagggcacctgggt

SEQ ID NO: 354325 - DNA, 16 bp, M. musculus
agaagggcatcagatc

SEQ ID NO: 354326 - DNA, 16 bp, M. musculus
agaagggctgagaagc

SEQ ID NO: 354327 - DNA, 16 bp, M. musculus
agaaggggagacctcc

SEQ ID NO: 354328 - DNA, 16 bp, M. musculus
agaaggggctgaagga

SEQ ID NO: 354329 - DNA, 16 bp, M. musculus
agaagggtctcaaagc

SEQ ID NO: 354330 - DNA, 16 bp, M. musculus
agaagggtgaccctgt

SEQ ID NO: 354331 - DNA, 16 bp, M. musculus
agaagggtgttgtctc

SEQ ID NO: 354332 - DNA, 16 bp, M. musculus
agaaggtatatttttt

SEQ ID NO: 354333 - DNA, 16 bp, M. musculus
agaaggtgatggagaa

SEQ ID NO: 354334 - DNA, 16 bp, M. musculus
agaaggtgctccccca

SEQ ID NO: 354335 - DNA, 16 bp, M. musculus
agaaggtggaccccag

SEQ ID NO: 354336 - DNA, 16 bp, M. musculus
agaaggtgtgacccag

SEQ ID NO: 354337 - DNA, 16 bp, M. musculus
agaaggtgtgggatgt

SEQ ID NO: 354338 - DNA, 16 bp, M. musculus
agaaggtgttggatct

SEQ ID NO: 354339 - DNA, 16 bp, M. musculus
agaaggttatctattc

SEQ ID NO: 354340 - DNA, 16 bp, M. musculus
agaaggttctagaagg

SEQ ID NO: 354341 - DNA, 16 bp, M. musculus
agaaggttctggaaag

SEQ ID NO: 354342 - DNA, 16 bp, M. musculus
agaaggttctggaagg

SEQ ID NO: 354343 - DNA, 16 bp, M. musculus
agaaggttgtatttat

SEQ ID NO: 354344 - DNA, 16 bp, M. musculus
agaagtaagcaataaa

SEQ ID NO: 354345 - DNA, 16 bp, M. musculus
agaagtacactgtagc

SEQ ID NO: 354346 - DNA, 16 bp, M. musculus
agaagtacatgctgac

SEQ ID NO: 354347 - DNA, 16 bp, M. musculus
agaagtagaagcagaa

SEQ ID NO: 354348 - DNA, 16 bp, M. musculus
agaagtaggcagatct

SEQ ID NO: 354349 - DNA, 16 bp, M. musculus
agaagtataaggatga

SEQ ID NO: 354350 - DNA, 16 bp, M. musculus
agaagtcaaaatatta

SEQ ID NO: 354351 - DNA, 16 bp, M. musculus
agaagtcaatggcctt

SEQ ID NO: 354352 - DNA, 16 bp, M. musculus
agaagtcactttcaaa

SEQ ID NO: 354353 - DNA, 16 bp, M. musculus
agaagtcagaagagga

SEQ ID NO: 354354 - DNA, 16 bp, M. musculus
agaagtcagagctgtg

SEQ ID NO: 354355 - DNA, 16 bp, M. musculus
agaagtcagaggacag

SEQ ID NO: 354356 - DNA, 16 bp, M. musculus
agaagtcagaggcctc

SEQ ID NO: 354357 - DNA, 16 bp, M. musculus
agaagtcagcatttga

SEQ ID NO: 354358 - DNA, 16 bp, M. musculus
agaagtcaggacagga

SEQ ID NO: 354359 - DNA, 18 bp, M. musculus
agaagtcatgaaacaaat

SEQ ID NO: 354360 - DNA, 16 bp, M. musculus
agaagtcattgttttt

SEQ ID NO: 354361 - DNA, 16 bp, M. musculus
agaagtccagagggcc

SEQ ID NO: 354362 - DNA, 16 bp, M. musculus
agaagtccaggttagt

SEQ ID NO: 354363 - DNA, 16 bp, M. musculus
agaagtccttaaagaa

SEQ ID NO: 354364 - DNA, 16 bp, M. musculus
agaagtccttggtgag

SEQ ID NO: 354365 - DNA, 16 bp, M. musculus
agaagtgactttggat

SEQ ID NO: 354366 - DNA, 16 bp, M. musculus
agaagtgcttgctgac

SEQ ID NO: 354367 - DNA, 16 bp, M. musculus
agaagtggaggcagga

SEQ ID NO: 354368 - DNA, 16 bp, M. musculus
agaagtggatgctctt

SEQ ID NO: 354369 - DNA, 16 bp, M. musculus
agaagtggatgggttg

SEQ ID NO: 354370 - DNA, 17 bp, M. musculus
agaagtggatgttcaca

SEQ ID NO: 354371 - DNA, 16 bp, M. musculus
agaagtggcagagcag

SEQ ID NO: 354372 - DNA, 16 bp, M. musculus
agaagtggccagatgt

SEQ ID NO: 354373 - DNA, 16 bp, M. musculus
agaagtggctggccaa

SEQ ID NO: 354374 - DNA, 16 bp, M. musculus
agaagtgggtgagtgg

SEQ ID NO: 354375 - DNA, 16 bp, M. musculus
agaagtgtatgctcac

SEQ ID NO: 354376 - DNA, 16 bp, M. musculus
agaagtgtcttgccat

SEQ ID NO: 354377 - DNA, 16 bp, M. musculus
agaagtgtttttcttt

SEQ ID NO: 354378 - DNA, 16 bp, M. musculus
agaagttatgaaaaga

SEQ ID NO: 354379 - DNA, 16 bp, M. musculus
agaagttatggaacaa

SEQ ID NO: 354380 - DNA, 17 bp, M. musculus
agaagttcaaatcccag

SEQ ID NO: 354381 - DNA, 16 bp, M. musculus
agaagttcaagaccat

SEQ ID NO: 354382 - DNA, 16 bp, M. musculus
agaagttcaagggcat

SEQ ID NO: 354383 - DNA, 16 bp, M. musculus
agaagttcaaggtcag

SEQ ID NO: 354384 - DNA, 16 bp, M. musculus
agaagttctcagctgt

SEQ ID NO: 354385 - DNA, 16 bp, M. musculus
agaagttctctgccat

SEQ ID NO: 354386 - DNA, 16 bp, M. musculus
agaagttgaagaagat

SEQ ID NO: 354387 - DNA, 16 bp, M. musculus
agaagttggttctttg

SEQ ID NO: 354388 - DNA, 16 bp, M. musculus
agaagttgtcctctgg

SEQ ID NO: 354389 - DNA, 16 bp, M. musculus
agaagttgtcctttga

SEQ ID NO: 354390 - DNA, 16 bp, M. musculus
agaagttgtggccctg

SEQ ID NO: 354391 - DNA, 16 bp, M. musculus
agaagtttaaggttat

SEQ ID NO: 354392 - DNA, 16 bp, M. musculus
agaagtttctagaaag

SEQ ID NO: 354393 - DNA, 16 bp, M. musculus
agaagtttcttttctt

SEQ ID NO: 354394 - DNA, 16 bp, M. musculus
agaataaaacatttta

SEQ ID NO: 354395 - DNA, 16 bp, M. musculus
agaataaagactgaag

SEQ ID NO: 354396 - DNA, 16 bp, M. musculus
agaataaatgttcttt

SEQ ID NO: 354397 - DNA, 16 bp, M. musculus
agaataaatttctgtt

SEQ ID NO: 354398 - DNA, 16 bp, M. musculus
agaataacactgtcta

SEQ ID NO: 354399 - DNA, 16 bp, M. musculus
agaataaggaagacca

SEQ ID NO: 354400 - DNA, 16 bp, M. musculus
agaataaggagccaga

SEQ ID NO: 354401 - DNA, 16 bp, M. musculus
agaataatagtagtag

SEQ ID NO: 354402 - DNA, 16 bp, M. musculus
agaataattgggataa

SEQ ID NO: 354403 - DNA, 16 bp, M. musculus
agaatacaaattccag

SEQ ID NO: 354404 - DNA, 18 bp, M. musculus
agaatacaagagatagaa

SEQ ID NO: 354405 - DNA, 16 bp, M. musculus
agaatacacatggtat

SEQ ID NO: 354406 - DNA, 16 bp, M. musculus
agaatacaccagagac

SEQ ID NO: 354407 - DNA, 16 bp, M. musculus
agaatacagaatcttc

SEQ ID NO: 354408 - DNA, 16 bp, M. musculus
agaatacataaagaac

SEQ ID NO: 354409 - DNA, 16 bp, M. musculus
agaatacatttaaaaa

SEQ ID NO: 354410 - DNA, 16 bp, M. musculus
agaataccaatagctt

SEQ ID NO: 354411 - DNA, 16 bp, M. musculus
agaatacccaaaatgt

SEQ ID NO: 354412 - DNA, 16 bp, M. musculus
agaatactgactttca

SEQ ID NO: 354413 - DNA, 16 bp, M. musculus
agaatactgccttcca

SEQ ID NO: 354414 - DNA, 16 bp, M. musculus
agaatagcaatggctt

SEQ ID NO: 354415 - DNA, 18 bp, M. musculus
agaatagcaggaggagca

SEQ ID NO: 354416 - DNA, 16 bp, M. musculus
agaatagccatcacat

SEQ ID NO: 354417 - DNA, 16 bp, M. musculus
agaatagctgagttga

SEQ ID NO: 354418 - DNA, 16 bp, M. musculus
agaataggatatgccc

SEQ ID NO: 354419 - DNA, 16 bp, M. musculus
agaatataaaaaccat

SEQ ID NO: 354420 - DNA, 16 bp, M. musculus
agaatatacaaatcat

SEQ ID NO: 354421 - DNA, 16 bp, M. musculus
agaatatactgaagaa

SEQ ID NO: 354422 - DNA, 16 bp, M. musculus
agaatatgaaaagcag

SEQ ID NO: 354423 - DNA, 16 bp, M. musculus
agaatatgattttaat

SEQ ID NO: 354424 - DNA, 16 bp, M. musculus
agaatattattgagta

SEQ ID NO: 354425 - DNA, 16 bp, M. musculus
agaatattctctctct

SEQ ID NO: 354426 - DNA, 16 bp, M. musculus
agaatatttattttca

SEQ ID NO: 354427 - DNA, 16 bp, M. musculus
agaatattttacccaa

SEQ ID NO: 354428 - DNA, 16 bp, M. musculus
agaatattttcagttt

SEQ ID NO: 354429 - DNA, 16 bp, M. musculus
agaatatttttttcct

SEQ ID NO: 354430 - DNA, 16 bp, M. musculus
agaatcaaacccagga

SEQ ID NO: 354431 - DNA, 16 bp, M. musculus
agaatcaacaaaactg

SEQ ID NO: 354432 - DNA, 16 bp, M. musculus
agaatcaagagctccg

SEQ ID NO: 354433 - DNA, 16 bp, M. musculus
agaatcaatgaagaaa

SEQ ID NO: 354434 - DNA, 16 bp, M. musculus
agaatcaccatggaaa

SEQ ID NO: 354435 - DNA, 16 bp, M. musculus
agaatcacctgaaaaa

SEQ ID NO: 354436 - DNA, 16 bp, M. musculus
agaatcagaaggtggt

SEQ ID NO: 354437 - DNA, 16 bp, M. musculus
agaatcagagaaagat

SEQ ID NO: 354438 - DNA, 16 bp, M. musculus
agaatcaggagctcaa

SEQ ID NO: 354439 - DNA, 16 bp, M. musculus
agaatcaggagttcaa

SEQ ID NO: 354440 - DNA, 16 bp, M. musculus
agaatcagggggaggg

SEQ ID NO: 354441 - DNA, 16 bp, M. musculus
agaatcagtcattaaa

SEQ ID NO: 354442 - DNA, 16 bp, M. musculus
agaatcattttcagta

SEQ ID NO: 354443 - DNA, 16 bp, M. musculus
agaatccacataaaaa

SEQ ID NO: 354444 - DNA, 16 bp, M. musculus
agaatccagctgaaac

SEQ ID NO: 354445 - DNA, 17 bp, M. musculus
agaatccagttctccca

SEQ ID NO: 354446 - DNA, 16 bp, M. musculus
agaatccccaagctcc

SEQ ID NO: 354447 - DNA, 16 bp, M. musculus
agaatcctgaagaagt

SEQ ID NO: 354448 - DNA, 16 bp, M. musculus
agaatcctgtggaaga

SEQ ID NO: 354449 - DNA, 16 bp, M. musculus
agaatcctttctgcct

SEQ ID NO: 354450 - DNA, 16 bp, M. musculus
agaatctacaaccact

SEQ ID NO: 354451 - DNA, 16 bp, M. musculus
agaatctagagagagc

SEQ ID NO: 354452 - DNA, 16 bp, M. musculus
agaatctatcctctct

SEQ ID NO: 354453 - DNA, 16 bp, M. musculus
agaatctcagcatcac

SEQ ID NO: 354454 - DNA, 16 bp, M. musculus
agaatctcctgtctca

SEQ ID NO: 354455 - DNA, 16 bp, M. musculus
agaatctctctctctc

SEQ ID NO: 354456 - DNA, 16 bp, M. musculus
agaatctctggtagaa

SEQ ID NO: 354457 - DNA, 16 bp, M. musculus
agaatctgaggaaata

SEQ ID NO: 354458 - DNA, 16 bp, M. musculus
agaatctgaggattca

SEQ ID NO: 354459 - DNA, 16 bp, M. musculus
agaatcttcacaacca

SEQ ID NO: 354460 - DNA, 16 bp, M. musculus
agaatcttctggcttt

SEQ ID NO: 354461 - DNA, 16 bp, M. musculus
agaatctttgcaattt

SEQ ID NO: 354462 - DNA, 16 bp, M. musculus
agaatcttttcagttt

SEQ ID NO: 354463 - DNA, 16 bp, M. musculus
agaatgaaaacttggt

SEQ ID NO: 354464 - DNA, 16 bp, M. musculus
agaatgaaaagaagca

SEQ ID NO: 354465 - DNA, 16 bp, M. musculus
agaatgaaaataaatc

SEQ ID NO: 354466 - DNA, 16 bp, M. musculus
agaatgaaaatagacc

SEQ ID NO: 354467 - DNA, 16 bp, M. musculus
agaatgaaaattagta

SEQ ID NO: 354468 - DNA, 17 bp, M. musculus
agaatgaaattagggaa

SEQ ID NO: 354469 - DNA, 16 bp, M. musculus
agaatgaaattgaaga

SEQ ID NO: 354470 - DNA, 17 bp, M. musculus
agaatgaaattgtgagg

SEQ ID NO: 354471 - DNA, 16 bp, M. musculus
agaatgaagacaatca

SEQ ID NO: 354472 - DNA, 16 bp, M. musculus
agaatgaagaccagag

SEQ ID NO: 354473 - DNA, 17 bp, M. musculus
agaatgaagagtttcaa

SEQ ID NO: 354474 - DNA, 16 bp, M. musculus
agaatgaagatttaca

SEQ ID NO: 354475 - DNA, 16 bp, M. musculus
agaatgaagattttaa

SEQ ID NO: 354476 - DNA, 16 bp, M. musculus
agaatgaagtttttca

SEQ ID NO: 354477 - DNA, 16 bp, M. musculus
agaatgaatagaaatc

SEQ ID NO: 354478 - DNA, 16 bp, M. musculus
agaatgaatgagcagg

SEQ ID NO: 354479 - DNA, 16 bp, M. musculus
agaatgaattgggtag

SEQ ID NO: 354480 - DNA, 16 bp, M. musculus
agaatgacaaagatca

SEQ ID NO: 354481 - DNA, 16 bp, M. musculus
agaatgaccaacatta

SEQ ID NO: 354482 - DNA, 16 bp, M. musculus
agaatgaccctgaact

SEQ ID NO: 354483 - DNA, 16 bp, M. musculus
agaatgaccttaaact

SEQ ID NO: 354484 - DNA, 16 bp, M. musculus
agaatgaccttgaact

SEQ ID NO: 354485 - DNA, 16 bp, M. musculus
agaatgactgtcttgg

SEQ ID NO: 354486 - DNA, 16 bp, M. musculus
agaatgagaacttcag

SEQ ID NO: 354487 - DNA, 16 bp, M. musculus
agaatgagaaggagct

SEQ ID NO: 354488 - DNA, 16 bp, M. musculus
agaatgagaaggagtc

SEQ ID NO: 354489 - DNA, 16 bp, M. musculus
agaatgagaatgagag

SEQ ID NO: 354490 - DNA, 16 bp, M. musculus
agaatgagactccacc

SEQ ID NO: 354491 - DNA, 16 bp, M. musculus
agaatgagagacagag

SEQ ID NO: 354492 - DNA, 16 bp, M. musculus
agaatgagccagaaga

SEQ ID NO: 354493 - DNA, 16 bp, M. musculus
agaatgaggacatctt

SEQ ID NO: 354494 - DNA, 16 bp, M. musculus
agaatgagttcaaggc

SEQ ID NO: 354495 - DNA, 16 bp, M. musculus
agaatgagttccaggg

SEQ ID NO: 354496 - DNA, 16 bp, M. musculus
agaatgatgaccaaag

SEQ ID NO: 354497 - DNA, 19 bp, M. musculus
agaatgattgtaaaacaat

SEQ ID NO: 354498 - DNA, 16 bp, M. musculus
agaatgattttttaaa

SEQ ID NO: 354499 - DNA, 16 bp, M. musculus
agaatgcagggatggt

SEQ ID NO: 354500 - DNA, 16 bp, M. musculus
agaatgcctgtcttag

SEQ ID NO: 354501 - DNA, 16 bp, M. musculus
agaatgccttgggaga

SEQ ID NO: 354502 - DNA, 16 bp, M. musculus
agaatgctgagagcag

SEQ ID NO: 354503 - DNA, 16 bp, M. musculus
agaatgctggtcctcc

SEQ ID NO: 354504 - DNA, 16 bp, M. musculus
agaatgctttcattgt

SEQ ID NO: 354505 - DNA, 16 bp, M. musculus
agaatgcttttttttt

SEQ ID NO: 354506 - DNA, 16 bp, M. musculus
agaatggaagacccag

SEQ ID NO: 354507 - DNA, 16 bp, M. musculus
agaatggacagccttg

SEQ ID NO: 354508 - DNA, 17 bp, M. musculus
agaatggatacagaaaa

SEQ ID NO: 354509 - DNA, 16 bp, M. musculus
agaatggattcccagc

SEQ ID NO: 354510 - DNA, 16 bp, M. musculus
agaatggatttatgaa

SEQ ID NO: 354511 - DNA, 16 bp, M. musculus
agaatggccactccag

SEQ ID NO: 354512 - DNA, 16 bp, M. musculus
agaatggctaagatta

SEQ ID NO: 354513 - DNA, 16 bp, M. musculus
agaatggctactgcag

SEQ ID NO: 354514 - DNA, 16 bp, M. musculus
agaatggctagaatca

SEQ ID NO: 354515 - DNA, 16 bp, M. musculus
agaatggcttcaaact

SEQ ID NO: 354516 - DNA, 16 bp, M. musculus
agaatggcttccaggc

SEQ ID NO: 354517 - DNA, 16 bp, M. musculus
agaatgggaatcgatc

SEQ ID NO: 354518 - DNA, 16 bp, M. musculus
agaatgtaccagagac

SEQ ID NO: 354519 - DNA, 16 bp, M. musculus
agaatgtagaaatgct

SEQ ID NO: 354520 - DNA, 16 bp, M. musculus
agaatgtagggaaaag

SEQ ID NO: 354521 - DNA, 16 bp, M. musculus
agaatgtatatatata

SEQ ID NO: 354522 - DNA, 16 bp, M. musculus
agaatgtattgtatga

SEQ ID NO: 354523 - DNA, 16 bp, M. musculus
agaatgtatttatgaa

SEQ ID NO: 354524 - DNA, 19 bp, M. musculus
agaatgtctaagatcaaaa

SEQ ID NO: 354525 - DNA, 16 bp, M. musculus
agaatgtgactacttt

SEQ ID NO: 354526 - DNA, 16 bp, M. musculus
agaatgtgtctgcttt

SEQ ID NO: 354527 - DNA, 16 bp, M. musculus
agaatgtgtgtctgtg

SEQ ID NO: 354528 - DNA, 16 bp, M. musculus
agaatgttccagaatg

SEQ ID NO: 354529 - DNA, 16 bp, M. musculus
agaatgttctagaatg

SEQ ID NO: 354530 - DNA, 16 bp, M. musculus
agaatgttctggaatt

SEQ ID NO: 354531 - DNA, 16 bp, M. musculus
agaatgttgaacattt

SEQ ID NO: 354532 - DNA, 16 bp, M. musculus
agaatgttttgctgag

SEQ ID NO: 354533 - DNA, 16 bp, M. musculus
agaatgttttgtttgt

SEQ ID NO: 354534 - DNA, 16 bp, M. musculus
agaattaaacattggg

SEQ ID NO: 354535 - DNA, 16 bp, M. musculus
agaattaacagcagta

SEQ ID NO: 354536 - DNA, 17 bp, M. musculus
agaattacaccagcctt

SEQ ID NO: 354537 - DNA, 16 bp, M. musculus
agaattacaggtatgg

SEQ ID NO: 354538 - DNA, 16 bp, M. musculus
agaattacagttatga

SEQ ID NO: 354539 - DNA, 16 bp, M. musculus
agaattactttttaaa

SEQ ID NO: 354540 - DNA, 16 bp, M. musculus
agaattagaaagagca

SEQ ID NO: 354541 - DNA, 16 bp, M. musculus
agaattagcatcaaaa

SEQ ID NO: 354542 - DNA, 21 bp, M. musculus
agaattagggtagtagaaatt

SEQ ID NO: 354543 - DNA, 16 bp, M. musculus
agaattatgccaaata

SEQ ID NO: 354544 - DNA, 16 bp, M. musculus
agaattatgtccaatt

SEQ ID NO: 354545 - DNA, 16 bp, M. musculus
agaattcaagaagata

SEQ ID NO: 354546 - DNA, 16 bp, M. musculus
agaattcaataaaaat

SEQ ID NO: 354547 - DNA, 16 bp, M. musculus
agaattctaaacttat

SEQ ID NO: 354548 - DNA, 16 bp, M. musculus
agaattctcagctcct

SEQ ID NO: 354549 - DNA, 16 bp, M. musculus
agaattctcagctctg

SEQ ID NO: 354550 - DNA, 16 bp, M. musculus
agaattctccagcttt

SEQ ID NO: 354551 - DNA, 16 bp, M. musculus
agaattctctgtttat

SEQ ID NO: 354552 - DNA, 16 bp, M. musculus
agaattctctgtttgg

SEQ ID NO: 354553 - DNA, 16 bp, M. musculus
agaattctgcactgaa

SEQ ID NO: 354554 - DNA, 16 bp, M. musculus
agaattctgctctaaa

SEQ ID NO: 354555 - DNA, 16 bp, M. musculus
agaattctgtttagct

SEQ ID NO: 354556 - DNA, 16 bp, M. musculus
agaattctttgttcac

SEQ ID NO: 354557 - DNA, 16 bp, M. musculus
agaattgagtgggaat

SEQ ID NO: 354558 - DNA, 16 bp, M. musculus
agaattgataaatgtg

SEQ ID NO: 354559 - DNA, 16 bp, M. musculus
agaattgcagaaaaac

SEQ ID NO: 354560 - DNA, 16 bp, M. musculus
agaattgcctccatca

SEQ ID NO: 354561 - DNA, 16 bp, M. musculus
agaattgctcaaattt

SEQ ID NO: 354562 - DNA, 16 bp, M. musculus
agaattgctcaactta

SEQ ID NO: 354563 - DNA, 16 bp, M. musculus
agaattgctcaacttg

SEQ ID NO: 354564 - DNA, 16 bp, M. musculus
agaattgctcctgtca

SEQ ID NO: 354565 - DNA, 16 bp, M. musculus
agaattgctgcaagtt

SEQ ID NO: 354566 - DNA, 16 bp, M. musculus
agaattggaaataatc

SEQ ID NO: 354567 - DNA, 16 bp, M. musculus
agaattggaagactca

SEQ ID NO: 354568 - DNA, 16 bp, M. musculus
agaattggaaggttca

SEQ ID NO: 354569 - DNA, 16 bp, M. musculus
agaattggctcagcag

SEQ ID NO: 354570 - DNA, 16 bp, M. musculus
agaattgggttctggt

SEQ ID NO: 354571 - DNA, 16 bp, M. musculus
agaatttaatgaaaac

SEQ ID NO: 354572 - DNA, 16 bp, M. musculus
agaatttaattctata

SEQ ID NO: 354573 - DNA, 16 bp, M. musculus
agaatttatggaatgt

SEQ ID NO: 354574 - DNA, 16 bp, M. musculus
agaatttcaaagaaga

SEQ ID NO: 354575 - DNA, 16 bp, M. musculus
agaatttcatgaagtc

SEQ ID NO: 354576 - DNA, 16 bp, M. musculus
agaatttctgagttca

SEQ ID NO: 354577 - DNA, 16 bp, M. musculus
agaatttctttccttt

SEQ ID NO: 354578 - DNA, 16 bp, M. musculus
agaatttgaaatgtaa

SEQ ID NO: 354579 - DNA, 16 bp, M. musculus
agaatttgaaatgtat

SEQ ID NO: 354580 - DNA, 16 bp, M. musculus
agaatttgaacagaca

SEQ ID NO: 354581 - DNA, 16 bp, M. musculus
agaattttaaaagcat

SEQ ID NO: 354582 - DNA, 16 bp, M. musculus
agaattttaaaataca

SEQ ID NO: 354583 - DNA, 16 bp, M. musculus
agaattttaaacattt

SEQ ID NO: 354584 - DNA, 17 bp, M. musculus
agaattttacaacagag

SEQ ID NO: 354585 - DNA, 16 bp, M. musculus
agaattttagtatgtt

SEQ ID NO: 354586 - DNA, 16 bp, M. musculus
agaattttatcagacc

SEQ ID NO: 354587 - DNA, 16 bp, M. musculus
agaattttgaacattt

SEQ ID NO: 354588 - DNA, 16 bp, M. musculus
agaatttttttaaagt

SEQ ID NO: 354589 - DNA, 16 bp, M. musculus
agacaaaaaaggccac

SEQ ID NO: 354590 - DNA, 16 bp, M. musculus
agacaaaaaggccacg

SEQ ID NO: 354591 - DNA, 16 bp, M. musculus
agacaaaacatctata

SEQ ID NO: 354592 - DNA, 16 bp, M. musculus
agacaaaatcaaagac

SEQ ID NO: 354593 - DNA, 16 bp, M. musculus
agacaaaatgagaaga

SEQ ID NO: 354594 - DNA, 16 bp, M. musculus
agacaaaatgccaaca

SEQ ID NO: 354595 - DNA, 16 bp, M. musculus
agacaaaatttctctg

SEQ ID NO: 354596 - DNA, 16 bp, M. musculus
agacaaaccagagggc

SEQ ID NO: 354597 - DNA, 16 bp, M. musculus
agacaaaccctatgaa

SEQ ID NO: 354598 - DNA, 16 bp, M. musculus
agacaaagatggagca

SEQ ID NO: 354599 - DNA, 17 bp, M. musculus
agacaaagattggagct

SEQ ID NO: 354600 - DNA, 16 bp, M. musculus
agacaaaggcaggaga

SEQ ID NO: 354601 - DNA, 23 bp, M. musculus
agacaaaggggcccagagggtct

SEQ ID NO: 354602 - DNA, 16 bp, M. musculus
agacaaagtctctcac

SEQ ID NO: 354603 - DNA, 16 bp, M. musculus
agacaaagtctctcat

SEQ ID NO: 354604 - DNA, 16 bp, M. musculus
agacaaagtctggagc

SEQ ID NO: 354605 - DNA, 17 bp, M. musculus
agacaaagttagagcta

SEQ ID NO: 354606 - DNA, 16 bp, M. musculus
agacaaagttctctga

SEQ ID NO: 354607 - DNA, 16 bp, M. musculus
agacaaataaatgact

SEQ ID NO: 354608 - DNA, 16 bp, M. musculus
agacaaatgtaagaat

SEQ ID NO: 354609 - DNA, 16 bp, M. musculus
agacaacaaaaggatg

SEQ ID NO: 354610 - DNA, 16 bp, M. musculus
agacaacaacaggaga

SEQ ID NO: 354611 - DNA, 16 bp, M. musculus
agacaacaagaccagc

SEQ ID NO: 354612 - DNA, 16 bp, M. musculus
agacaacaagccacct

SEQ ID NO: 354613 - DNA, 16 bp, M. musculus
agacaacaggaaataa

SEQ ID NO: 354614 - DNA, 16 bp, M. musculus
agacaacatctacaca

SEQ ID NO: 354615 - DNA, 16 bp, M. musculus
agacaaccaaagtgaa

SEQ ID NO: 354616 - DNA, 17 bp, M. musculus
agacaactctggagata

SEQ ID NO: 354617 - DNA, 16 bp, M. musculus
agacaactcttacaaa

SEQ ID NO: 354618 - DNA, 17 bp, M. musculus
agacaactgtaacaact

SEQ ID NO: 354619 - DNA, 16 bp, M. musculus
agacaactgtggagat

SEQ ID NO: 354620 - DNA, 16 bp, M. musculus
agacaacttcctagac

SEQ ID NO: 354621 - DNA, 16 bp, M. musculus
agacaagagctccggg

SEQ ID NO: 354622 - DNA, 16 bp, M. musculus
agacaagagctcctgg

SEQ ID NO: 354623 - DNA, 16 bp, M. musculus
agacaagcactctacc

SEQ ID NO: 354624 - DNA, 16 bp, M. musculus
agacaagcactctact

SEQ ID NO: 354625 - DNA, 16 bp, M. musculus
agacaaggaaggacac

SEQ ID NO: 354626 - DNA, 16 bp, M. musculus
agacaaggagacagag

SEQ ID NO: 354627 - DNA, 16 bp, M. musculus
agacaaggagggatac

SEQ ID NO: 354628 - DNA, 16 bp, M. musculus
agacaaggatgcctac

SEQ ID NO: 354629 - DNA, 16 bp, M. musculus
agacaaggcagcccag

SEQ ID NO: 354630 - DNA, 16 bp, M. musculus
agacaaggctctccac

SEQ ID NO: 354631 - DNA, 16 bp, M. musculus
agacaaggctgccccc

SEQ ID NO: 354632 - DNA, 16 bp, M. musculus
agacaaggctgccctc

SEQ ID NO: 354633 - DNA, 16 bp, M. musculus
agacaaggctgtacac

SEQ ID NO: 354634 - DNA, 16 bp, M. musculus
agacaagggagcccag

SEQ ID NO: 354635 - DNA, 16 bp, M. musculus
agacaaggtctcacta

SEQ ID NO: 354636 - DNA, 16 bp, M. musculus
agacaaggtcttacta

SEQ ID NO: 354637 - DNA, 17 bp, M. musculus
agacaaggtttctctgt

SEQ ID NO: 354638 - DNA, 16 bp, M. musculus
agacaaggtttctctt

SEQ ID NO: 354639 - DNA, 16 bp, M. musculus
agacaagtctactcct

SEQ ID NO: 354640 - DNA, 16 bp, M. musculus
agacaagttatcccaa

SEQ ID NO: 354641 - DNA, 16 bp, M. musculus
agacaatacagagagg

SEQ ID NO: 354642 - DNA, 16 bp, M. musculus
agacaatactgatgtt

SEQ ID NO: 354643 - DNA, 20 bp, M. musculus
agacaatagcgcgtgtgaga

SEQ ID NO: 354644 - DNA, 16 bp, M. musculus
agacaatctctctctc

SEQ ID NO: 354645 - DNA, 16 bp, M. musculus
agacaatctgaagcag

SEQ ID NO: 354646 - DNA, 16 bp, M. musculus
agacaatgctggagat

SEQ ID NO: 354647 - DNA, 16 bp, M. musculus
agacaatgtctcacta

SEQ ID NO: 354648 - DNA, 17 bp, M. musculus
agacaatgttctgatca

SEQ ID NO: 354649 - DNA, 16 bp, M. musculus
agacaattacagaaaa

SEQ ID NO: 354650 - DNA, 16 bp, M. musculus
agacacaacaacagat

SEQ ID NO: 354651 - DNA, 16 bp, M. musculus
agacacaacaggactg

SEQ ID NO: 354652 - DNA, 16 bp, M. musculus
agacacaaccagcact

SEQ ID NO: 354653 - DNA, 16 bp, M. musculus
agacacaaggacagag

SEQ ID NO: 354654 - DNA, 16 bp, M. musculus
agacacaataatgaaa

SEQ ID NO: 354655 - DNA, 18 bp, M. musculus
agacacacaaactgaaag

SEQ ID NO: 354656 - DNA, 16 bp, M. musculus
agacacacacacacag

SEQ ID NO: 354657 - DNA, 16 bp, M. musculus
agacacacacacacat

SEQ ID NO: 354658 - DNA, 16 bp, M. musculus
agacacacacatataa

SEQ ID NO: 354659 - DNA, 16 bp, M. musculus
agacacacagacacca

SEQ ID NO: 354660 - DNA, 16 bp, M. musculus
agacacacagagacac

SEQ ID NO: 354661 - DNA, 16 bp, M. musculus
agacacacaggaagag

SEQ ID NO: 354662 - DNA, 16 bp, M. musculus
agacacacaggaagta

SEQ ID NO: 354663 - DNA, 16 bp, M. musculus
agacacacataaacac

SEQ ID NO: 354664 - DNA, 16 bp, M. musculus
agacacaccatgacca

SEQ ID NO: 354665 - DNA, 16 bp, M. musculus
agacacaccggaagag

SEQ ID NO: 354666 - DNA, 16 bp, M. musculus
agacacactagaaaag

SEQ ID NO: 354667 - DNA, 16 bp, M. musculus
agacacagaaaatgaa

SEQ ID NO: 354668 - DNA, 16 bp, M. musculus
agacacagacaaacag

SEQ ID NO: 354669 - DNA, 16 bp, M. musculus
agacacagacacacag

SEQ ID NO: 354670 - DNA, 16 bp, M. musculus
agacacagagacagat

SEQ ID NO: 354671 - DNA, 16 bp, M. musculus
agacacagagagaata

SEQ ID NO: 354672 - DNA, 16 bp, M. musculus
agacacagagagacac

SEQ ID NO: 354673 - DNA, 16 bp, M. musculus
agacacagagagtcag

SEQ ID NO: 354674 - DNA, 16 bp, M. musculus
agacacagagatacac

SEQ ID NO: 354675 - DNA, 16 bp, M. musculus
agacacagcagggcag

SEQ ID NO: 354676 - DNA, 16 bp, M. musculus
agacacagcctcagac

SEQ ID NO: 354677 - DNA, 16 bp, M. musculus
agacacagctatacca

SEQ ID NO: 354678 - DNA, 16 bp, M. musculus
agacacagctctgagg

SEQ ID NO: 354679 - DNA, 16 bp, M. musculus
agacacagggacacag

SEQ ID NO: 354680 - DNA, 16 bp, M. musculus
agacacatacacatac

SEQ ID NO: 354681 - DNA, 16 bp, M. musculus
agacacatacatacac

SEQ ID NO: 354682 - DNA, 16 bp, M. musculus
agacacatcagaagaa

SEQ ID NO: 354683 - DNA, 16 bp, M. musculus
agacacatgctccact

SEQ ID NO: 354684 - DNA, 16 bp, M. musculus
agacacatgggaggat

SEQ ID NO: 354685 - DNA, 16 bp, M. musculus
agacaccacagccaag

SEQ ID NO: 354686 - DNA, 16 bp, M. musculus
agacaccaggaccaca

SEQ ID NO: 354687 - DNA, 16 bp, M. musculus
agacaccatatgaatg

SEQ ID NO: 354688 - DNA, 16 bp, M. musculus
agacaccatgatgaag

SEQ ID NO: 354689 - DNA, 16 bp, M. musculus
agacacccagaggccc

SEQ ID NO: 354690 - DNA, 16 bp, M. musculus
agacaccccaaaagag

SEQ ID NO: 354691 - DNA, 16 bp, M. musculus
agacacctgaagaaca

SEQ ID NO: 354692 - DNA, 16 bp, M. musculus
agacacctgccaccaa

SEQ ID NO: 354693 - DNA, 16 bp, M. musculus
agacacctgctgccaa

SEQ ID NO: 354694 - DNA, 16 bp, M. musculus
agacacctgtgctctg

SEQ ID NO: 354695 - DNA, 16 bp, M. musculus
agacacctttaatccc

SEQ ID NO: 354696 - DNA, 16 bp, M. musculus
agacacgagctctgag

SEQ ID NO: 354697 - DNA, 16 bp, M. musculus
agacacgcccacaggc

SEQ ID NO: 354698 - DNA, 16 bp, M. musculus
agacacgggctctggg

SEQ ID NO: 354699 - DNA, 16 bp, M. musculus
agacactagcatatcc

SEQ ID NO: 354700 - DNA, 25 bp, M. musculus
agacactccagaagagggagtcaga

SEQ ID NO: 354701 - DNA, 16 bp, M. musculus
agacactccagaggag

SEQ ID NO: 354702 - DNA, 16 bp, M. musculus
agacactcctgaagag

SEQ ID NO: 354703 - DNA, 16 bp, M. musculus
agacactgagaaagca

SEQ ID NO: 354704 - DNA, 16 bp, M. musculus
agacactgattttttt

SEQ ID NO: 354705 - DNA, 16 bp, M. musculus
agacactgcatgcaca

SEQ ID NO: 354706 - DNA, 16 bp, M. musculus
agacactgcctctgct

SEQ ID NO: 354707 - DNA, 16 bp, M. musculus
agacactggaccacca

SEQ ID NO: 354708 - DNA, 16 bp, M. musculus
agacactggagctgag

SEQ ID NO: 354709 - DNA, 16 bp, M. musculus
agacactgtacagttt

SEQ ID NO: 354710 - DNA, 16 bp, M. musculus
agacactgtctcaaac

SEQ ID NO: 354711 - DNA, 16 bp, M. musculus
agacactgtctcagaa

SEQ ID NO: 354712 - DNA, 16 bp, M. musculus
agacactgtctgaaaa

SEQ ID NO: 354713 - DNA, 16 bp, M. musculus
agacactgtgagcaag

SEQ ID NO: 354714 - DNA, 16 bp, M. musculus
agacacttgatttttg

SEQ ID NO: 354715 - DNA, 16 bp, M. musculus
agacacttgccaccaa

SEQ ID NO: 354716 - DNA, 16 bp, M. musculus
agacacttgctaccaa

SEQ ID NO: 354717 - DNA, 16 bp, M. musculus
agacagaaaacctagg

SEQ ID NO: 354718 - DNA, 17 bp, M. musculus
agacagaaaccctagga

SEQ ID NO: 354719 - DNA, 16 bp, M. musculus
agacagaaagacagac

SEQ ID NO: 354720 - DNA, 16 bp, M. musculus
agacagaaagatagac

SEQ ID NO: 354721 - DNA, 16 bp, M. musculus
agacagaaatcaaaga

SEQ ID NO: 354722 - DNA, 16 bp, M. musculus
agacagaaatcctagg

SEQ ID NO: 354723 - DNA, 16 bp, M. musculus
agacagaacaagccag

SEQ ID NO: 354724 - DNA, 16 bp, M. musculus
agacagaagaactggt

SEQ ID NO: 354725 - DNA, 16 bp, M. musculus
agacagaagagagaat

SEQ ID NO: 354726 - DNA, 16 bp, M. musculus
agacagaagataaaat

SEQ ID NO: 354727 - DNA, 16 bp, M. musculus
agacagaagcaagcag

SEQ ID NO: 354728 - DNA, 16 bp, M. musculus
agacagaagcagagac

SEQ ID NO: 354729 - DNA, 16 bp, M. musculus
agacagaagcagagag

SEQ ID NO: 354730 - DNA, 16 bp, M. musculus
agacagaagcaggggg

SEQ ID NO: 354731 - DNA, 16 bp, M. musculus
agacagaagcaggtga

SEQ ID NO: 354732 - DNA, 16 bp, M. musculus
agacagaagctgctga

SEQ ID NO: 354733 - DNA, 16 bp, M. musculus
agacagaaggaaggat

SEQ ID NO: 354734 - DNA, 16 bp, M. musculus
agacagaagttggcac

SEQ ID NO: 354735 - DNA, 16 bp, M. musculus
agacagaataccagga

SEQ ID NO: 354736 - DNA, 16 bp, M. musculus
agacagaatttctctg

SEQ ID NO: 354737 - DNA, 16 bp, M. musculus
agacagacaaacagga

SEQ ID NO: 354738 - DNA, 16 bp, M. musculus
agacagacaatagata

SEQ ID NO: 354739 - DNA, 16 bp, M. musculus
agacagacacaaacag

SEQ ID NO: 354740 - DNA, 16 bp, M. musculus
agacagacacacacag

SEQ ID NO: 354741 - DNA, 16 bp, M. musculus
agacagacacacagag

SEQ ID NO: 354742 - DNA, 16 bp, M. musculus
agacagacacagacag

SEQ ID NO: 354743 - DNA, 16 bp, M. musculus
agacagacacagagaa

SEQ ID NO: 354744 - DNA, 16 bp, M. musculus
agacagacacatacat

SEQ ID NO: 354745 - DNA, 16 bp, M. musculus
agacagacagaagaca

SEQ ID NO: 354746 - DNA, 16 bp, M. musculus
agacagacagaagcca

SEQ ID NO: 354747 - DNA, 16 bp, M. musculus
agacagacagacacag

SEQ ID NO: 354748 - DNA, 16 bp, M. musculus
agacagacagacagaa

SEQ ID NO: 354749 - DNA, 17 bp, M. musculus
agacagacagacagaca

SEQ ID NO: 354750 - DNA, 16 bp, M. musculus
agacagacagacagag

SEQ ID NO: 354751 - DNA, 16 bp, M. musculus
agacagacagacagat

SEQ ID NO: 354752 - DNA, 16 bp, M. musculus
agacagacagacagca

SEQ ID NO: 354753 - DNA, 16 bp, M. musculus
agacagacagacatga

SEQ ID NO: 354754 - DNA, 16 bp, M. musculus
agacagacagaccaca

SEQ ID NO: 354755 - DNA, 16 bp, M. musculus
agacagacagactgcc

SEQ ID NO: 354756 - DNA, 16 bp, M. musculus
agacagacagagagag

SEQ ID NO: 354757 - DNA, 16 bp, M. musculus
agacagacagagagct

SEQ ID NO: 354758 - DNA, 16 bp, M. musculus
agacagacagaggcac

SEQ ID NO: 354759 - DNA, 16 bp, M. musculus
agacagacagatgaca

SEQ ID NO: 354760 - DNA, 16 bp, M. musculus
agacagacagatggga

SEQ ID NO: 354761 - DNA, 16 bp, M. musculus
agacagacaggaagca

SEQ ID NO: 354762 - DNA, 16 bp, M. musculus
agacagacatggtgct

SEQ ID NO: 354763 - DNA, 16 bp, M. musculus
agacagaccgacagac

SEQ ID NO: 354764 - DNA, 16 bp, M. musculus
agacagactctctcct

SEQ ID NO: 354765 - DNA, 16 bp, M. musculus
agacagactgactgac

SEQ ID NO: 354766 - DNA, 16 bp, M. musculus
agacagactggaagga

SEQ ID NO: 354767 - DNA, 16 bp, M. musculus
agacagagaaaatgaa

SEQ ID NO: 354768 - DNA, 16 bp, M. musculus
agacagagaaactgaa

SEQ ID NO: 354769 - DNA, 16 bp, M. musculus
agacagagaaagatgg

SEQ ID NO: 354770 - DNA, 16 bp, M. musculus
agacagagaaaggcag

SEQ ID NO: 354771 - DNA, 16 bp, M. musculus
agacagagaaataatg

SEQ ID NO: 354772 - DNA, 16 bp, M. musculus
agacagagaatgagga

SEQ ID NO: 354773 - DNA, 16 bp, M. musculus
agacagagacacaaag

SEQ ID NO: 354774 - DNA, 16 bp, M. musculus
agacagagacacagaa

SEQ ID NO: 354775 - DNA, 16 bp, M. musculus
agacagagacagacac

SEQ ID NO: 354776 - DNA, 19 bp, M. musculus
agacagagacagagacaga

SEQ ID NO: 354777 - DNA, 16 bp, M. musculus
agacagagacagagat

SEQ ID NO: 354778 - DNA, 16 bp, M. musculus
agacagagacagaggg

SEQ ID NO: 354779 - DNA, 16 bp, M. musculus
agacagagacagcaag

SEQ ID NO: 354780 - DNA, 16 bp, M. musculus
agacagagacagctag

SEQ ID NO: 354781 - DNA, 16 bp, M. musculus
agacagagacagtgag

SEQ ID NO: 354782 - DNA, 16 bp, M. musculus
agacagagagaacatg

SEQ ID NO: 354783 - DNA, 16 bp, M. musculus
agacagagagacaagg

SEQ ID NO: 354784 - DNA, 16 bp, M. musculus
agacagagagaccaag

SEQ ID NO: 354785 - DNA, 16 bp, M. musculus
agacagagagactggc

SEQ ID NO: 354786 - DNA, 16 bp, M. musculus
agacagagagagaact

SEQ ID NO: 354787 - DNA, 16 bp, M. musculus
agacagagagagcaga

SEQ ID NO: 354788 - DNA, 16 bp, M. musculus
agacagagagagggac

SEQ ID NO: 354789 - DNA, 16 bp, M. musculus
agacagagagcagaga

SEQ ID NO: 354790 - DNA, 16 bp, M. musculus
agacagagagcgagag

SEQ ID NO: 354791 - DNA, 16 bp, M. musculus
agacagagaggaacag

SEQ ID NO: 354792 - DNA, 16 bp, M. musculus
agacagagaggtggtg

SEQ ID NO: 354793 - DNA, 16 bp, M. musculus
agacagagatagaaaa

SEQ ID NO: 354794 - DNA, 16 bp, M. musculus
agacagagcactccta

SEQ ID NO: 354795 - DNA, 16 bp, M. musculus
agacagagctatacag

SEQ ID NO: 354796 - DNA, 16 bp, M. musculus
agacagagctcaggaa

SEQ ID NO: 354797 - DNA, 16 bp, M. musculus
agacagagctctgtga

SEQ ID NO: 354798 - DNA, 16 bp, M. musculus
agacagaggacagaca

SEQ ID NO: 354799 - DNA, 16 bp, M. musculus
agacagaggacagaga

SEQ ID NO: 354800 - DNA, 16 bp, M. musculus
agacagaggagagaca

SEQ ID NO: 354801 - DNA, 16 bp, M. musculus
agacagaggcagaaga

SEQ ID NO: 354802 - DNA, 16 bp, M. musculus
agacagaggcagaagg

SEQ ID NO: 354803 - DNA, 16 bp, M. musculus
agacagaggcaggaga

SEQ ID NO: 354804 - DNA, 16 bp, M. musculus
agacagaggcagggga

SEQ ID NO: 354805 - DNA, 16 bp, M. musculus
agacagaggcaggtag

SEQ ID NO: 354806 - DNA, 16 bp, M. musculus
agacagaggcagttgg

SEQ ID NO: 354807 - DNA, 16 bp, M. musculus
agacagaggccagcct

SEQ ID NO: 354808 - DNA, 16 bp, M. musculus
agacagaggctggaag

SEQ ID NO: 354809 - DNA, 16 bp, M. musculus
agacagagggaggcag

SEQ ID NO: 354810 - DNA, 16 bp, M. musculus
agacagagggaggtgg

SEQ ID NO: 354811 - DNA, 16 bp, M. musculus
agacagagtctcacat

SEQ ID NO: 354812 - DNA, 16 bp, M. musculus
agacagagtctcactg

SEQ ID NO: 354813 - DNA, 16 bp, M. musculus
agacagagtctctttg

SEQ ID NO: 354814 - DNA, 16 bp, M. musculus
agacagagtcttgctg

SEQ ID NO: 354815 - DNA, 17 bp, M. musculus
agacagagtttctctgt

SEQ ID NO: 354816 - DNA, 16 bp, M. musculus
agacagatacacagag

SEQ ID NO: 354817 - DNA, 16 bp, M. musculus
agacagatacatagat

SEQ ID NO: 354818 - DNA, 16 bp, M. musculus
agacagatagataggt

SEQ ID NO: 354819 - DNA, 16 bp, M. musculus
agacagatattggaga

SEQ ID NO: 354820 - DNA, 16 bp, M. musculus
agacagatctccattt

SEQ ID NO: 354821 - DNA, 16 bp, M. musculus
agacagatgcacacac

SEQ ID NO: 354822 - DNA, 16 bp, M. musculus
agacagatgcagagac

SEQ ID NO: 354823 - DNA, 16 bp, M. musculus
agacagatgctgatcc

SEQ ID NO: 354824 - DNA, 16 bp, M. musculus
agacagatgggagaga

SEQ ID NO: 354825 - DNA, 16 bp, M. musculus
agacagatgtagacac

SEQ ID NO: 354826 - DNA, 16 bp, M. musculus
agacagcaccacctgc

SEQ ID NO: 354827 - DNA, 16 bp, M. musculus
agacagcactgcctgc

SEQ ID NO: 354828 - DNA, 16 bp, M. musculus
agacagcagaaaataa

SEQ ID NO: 354829 - DNA, 16 bp, M. musculus
agacagcagaagggaa

SEQ ID NO: 354830 - DNA, 16 bp, M. musculus
agacagcaggaaatga

SEQ ID NO: 354831 - DNA, 16 bp, M. musculus
agacagcagtagggaa

SEQ ID NO: 354832 - DNA, 16 bp, M. musculus
agacagcatgaccaaa

SEQ ID NO: 354833 - DNA, 16 bp, M. musculus
agacagcatgcaccag

SEQ ID NO: 354834 - DNA, 16 bp, M. musculus
agacagccacagtgta

SEQ ID NO: 354835 - DNA, 16 bp, M. musculus
agacagccactgttgg

SEQ ID NO: 354836 - DNA, 16 bp, M. musculus
agacagccagagctat

SEQ ID NO: 354837 - DNA, 16 bp, M. musculus
agacagccaggactat

SEQ ID NO: 354838 - DNA, 16 bp, M. musculus
agacagccattgttgg

SEQ ID NO: 354839 - DNA, 16 bp, M. musculus
agacagccccagctcc

SEQ ID NO: 354840 - DNA, 16 bp, M. musculus
agacagcctgagctac

SEQ ID NO: 354841 - DNA, 16 bp, M. musculus
agacagcgtttctctg

SEQ ID NO: 354842 - DNA, 16 bp, M. musculus
agacagctacagcaca

SEQ ID NO: 354843 - DNA, 16 bp, M. musculus
agacagctataacagg

SEQ ID NO: 354844 - DNA, 18 bp, M. musculus
agacagctatatcagggt

SEQ ID NO: 354845 - DNA, 16 bp, M. musculus
agacagctatgagctg

SEQ ID NO: 354846 - DNA, 16 bp, M. musculus
agacagctattgttgg

SEQ ID NO: 354847 - DNA, 16 bp, M. musculus
agacagctcagcagtt

SEQ ID NO: 354848 - DNA, 16 bp, M. musculus
agacagctcagctctt

SEQ ID NO: 354849 - DNA, 16 bp, M. musculus
agacagctcagtgggt

SEQ ID NO: 354850 - DNA, 16 bp, M. musculus
agacagctctctgtct

SEQ ID NO: 354851 - DNA, 16 bp, M. musculus
agacagctctggagat

SEQ ID NO: 354852 - DNA, 16 bp, M. musculus
agacagctttctgaag

SEQ ID NO: 354853 - DNA, 16 bp, M. musculus
agacaggaaacctggg

SEQ ID NO: 354854 - DNA, 16 bp, M. musculus
agacaggaacaattct

SEQ ID NO: 354855 - DNA, 16 bp, M. musculus
agacaggaagattgct

SEQ ID NO: 354856 - DNA, 16 bp, M. musculus
agacaggaagccagag

SEQ ID NO: 354857 - DNA, 16 bp, M. musculus
agacaggaagccattg

SEQ ID NO: 354858 - DNA, 16 bp, M. musculus
agacaggacctcacta

SEQ ID NO: 354859 - DNA, 16 bp, M. musculus
agacaggagagagaca

SEQ ID NO: 354860 - DNA, 16 bp, M. musculus
agacaggagcagagcc

SEQ ID NO: 354861 - DNA, 16 bp, M. musculus
agacaggagcccagca

SEQ ID NO: 354862 - DNA, 16 bp, M. musculus
agacaggagcctagca

SEQ ID NO: 354863 - DNA, 16 bp, M. musculus
agacaggagctccggg

SEQ ID NO: 354864 - DNA, 16 bp, M. musculus
agacaggagctctgag

SEQ ID NO: 354865 - DNA, 16 bp, M. musculus
agacaggaggcaagaa

SEQ ID NO: 354866 - DNA, 16 bp, M. musculus
agacaggatctttcta

SEQ ID NO: 354867 - DNA, 17 bp, M. musculus
agacaggatttctctgt

SEQ ID NO: 354868 - DNA, 16 bp, M. musculus
agacaggatttctttg

SEQ ID NO: 354869 - DNA, 16 bp, M. musculus
agacaggcagacacag

SEQ ID NO: 354870 - DNA, 16 bp, M. musculus
agacaggcagagagaa

SEQ ID NO: 354871 - DNA, 16 bp, M. musculus
agacaggctctctcat

SEQ ID NO: 354872 - DNA, 16 bp, M. musculus
agacaggctttctctg

SEQ ID NO: 354873 - DNA, 16 bp, M. musculus
agacagggaaactgag

SEQ ID NO: 354874 - DNA, 16 bp, M. musculus
agacagggacacagtg

SEQ ID NO: 354875 - DNA, 16 bp, M. musculus
agacagggacagaaag

SEQ ID NO: 354876 - DNA, 16 bp, M. musculus
agacagggacagagac

SEQ ID NO: 354877 - DNA, 16 bp, M. musculus
agacagggcatcaaat

SEQ ID NO: 354878 - DNA, 16 bp, M. musculus
agacagggcctcacat

SEQ ID NO: 354879 - DNA, 16 bp, M. musculus
agacagggcttctcac

SEQ ID NO: 354880 - DNA, 16 bp, M. musculus
agacagggcttctctc

SEQ ID NO: 354881 - DNA, 17 bp, M. musculus
agacagggcttctctgt

SEQ ID NO: 354882 - DNA, 16 bp, M. musculus
agacaggggtggggtg

SEQ ID NO: 354883 - DNA, 16 bp, M. musculus
agacagggtatctctg

SEQ ID NO: 354884 - DNA, 16 bp, M. musculus
agacagggtccctcta

SEQ ID NO: 354885 - DNA, 16 bp, M. musculus
agacagggtctcaata

SEQ ID NO: 354886 - DNA, 16 bp, M. musculus
agacagggtctcacta

SEQ ID NO: 354887 - DNA, 17 bp, M. musculus
agacagggtctctctat

SEQ ID NO: 354888 - DNA, 16 bp, M. musculus
agacagggtctctctg

SEQ ID NO: 354889 - DNA, 16 bp, M. musculus
agacagggtctgtcac

SEQ ID NO: 354890 - DNA, 16 bp, M. musculus
agacagggtcttactg

SEQ ID NO: 354891 - DNA, 16 bp, M. musculus
agacagggtgtggtgg

SEQ ID NO: 354892 - DNA, 16 bp, M. musculus
agacagggttctctgt

SEQ ID NO: 354893 - DNA, 16 bp, M. musculus
agacagggtttcactt

SEQ ID NO: 354894 - DNA, 16 bp, M. musculus
agacagggtttccctg

SEQ ID NO: 354895 - DNA, 16 bp, M. musculus
agacagggtttctcca

SEQ ID NO: 354896 - DNA, 16 bp, M. musculus
agacagggtttctcta

SEQ ID NO: 354897 - DNA, 16 bp, M. musculus
agacagggtttctctc

SEQ ID NO: 354898 - DNA, 17 bp, M. musculus
agacagggtttctctga

SEQ ID NO: 354899 - DNA, 18 bp, M. musculus
agacagggtttctctgca

SEQ ID NO: 354900 - DNA, 17 bp, M. musculus
agacagggtttctctgg

SEQ ID NO: 354901 - DNA, 17 bp, M. musculus
agacagggtttctctgt

SEQ ID NO: 354902 - DNA, 16 bp, M. musculus
agacagggtttctctt

SEQ ID NO: 354903 - DNA, 16 bp, M. musculus
agacagggtttctgta

SEQ ID NO: 354904 - DNA, 17 bp, M. musculus
agacagggtttctgtgt

SEQ ID NO: 354905 - DNA, 17 bp, M. musculus
agacagggtttctttgt

SEQ ID NO: 354906 - DNA, 16 bp, M. musculus
agacagggttttacta

SEQ ID NO: 354907 - DNA, 16 bp, M. musculus
agacagggttttcttt

SEQ ID NO: 354908 - DNA, 16 bp, M. musculus
agacagggttttgctc

SEQ ID NO: 354909 - DNA, 16 bp, M. musculus
agacagggtttttcta

SEQ ID NO: 354910 - DNA, 17 bp, M. musculus
agacagggtttttctgt

SEQ ID NO: 354911 - DNA, 16 bp, M. musculus
agacaggtctcactgt

SEQ ID NO: 354912 - DNA, 27 bp, M. musculus
agacaggtgattttaagccacatggct

SEQ ID NO: 354913 - DNA, 16 bp, M. musculus
agacaggtggatctgt

SEQ ID NO: 354914 - DNA, 16 bp, M. musculus
agacaggtttctctgt

SEQ ID NO: 354915 - DNA, 16 bp, M. musculus
agacagtcagtcagtc

SEQ ID NO: 354916 - DNA, 16 bp, M. musculus
agacagtgaaaggcac

SEQ ID NO: 354917 - DNA, 16 bp, M. musculus
agacagtggggaaaag

SEQ ID NO: 354918 - DNA, 16 bp, M. musculus
agacagtggggaagag

SEQ ID NO: 354919 - DNA, 16 bp, M. musculus
agacagtgtctcactg

SEQ ID NO: 354920 - DNA, 16 bp, M. musculus
agacagtgtctctctg

SEQ ID NO: 354921 - DNA, 16 bp, M. musculus
agacagtgtttccctg

SEQ ID NO: 354922 - DNA, 16 bp, M. musculus
agacagtgtttctttg

SEQ ID NO: 354923 - DNA, 16 bp, M. musculus
agacagttacaatgta

SEQ ID NO: 354924 - DNA, 16 bp, M. musculus
agacagttatgggcat

SEQ ID NO: 354925 - DNA, 16 bp, M. musculus
agacagttatgttagg

SEQ ID NO: 354926 - DNA, 16 bp, M. musculus
agacagttgtgagctg

SEQ ID NO: 354927 - DNA, 16 bp, M. musculus
agacagttgtgaggca

SEQ ID NO: 354928 - DNA, 16 bp, M. musculus
agacataatacagttc

SEQ ID NO: 354929 - DNA, 16 bp, M. musculus
agacataatactgtcc

SEQ ID NO: 354930 - DNA, 16 bp, M. musculus
agacatacagacagat

SEQ ID NO: 354931 - DNA, 16 bp, M. musculus
agacatacatgtaggc

SEQ ID NO: 354932 - DNA, 16 bp, M. musculus
agacatagagacagag

SEQ ID NO: 354933 - DNA, 40 bp, M. musculus
agacatagagagatgagcaagctcttggccactgtagtta

SEQ ID NO: 354934 - DNA, 16 bp, M. musculus
agacatatagacatat

SEQ ID NO: 354935 - DNA, 16 bp, M. musculus
agacatatatacatgc

SEQ ID NO: 354936 - DNA, 16 bp, M. musculus
agacatcaagggaatg

SEQ ID NO: 354937 - DNA, 16 bp, M. musculus
agacatcaggaaaatg

SEQ ID NO: 354938 - DNA, 16 bp, M. musculus
agacatcaggagttca

SEQ ID NO: 354939 - DNA, 16 bp, M. musculus
agacatccagccttgt

SEQ ID NO: 354940 - DNA, 16 bp, M. musculus
agacatgaaaatggaa

SEQ ID NO: 354941 - DNA, 16 bp, M. musculus
agacatgagagaactc

SEQ ID NO: 354942 - DNA, 16 bp, M. musculus
agacatgagctctgtg

SEQ ID NO: 354943 - DNA, 16 bp, M. musculus
agacatgcacacacac

SEQ ID NO: 354944 - DNA, 16 bp, M. musculus
agacatgcctctccta

SEQ ID NO: 354945 - DNA, 16 bp, M. musculus
agacatggaagagaga

SEQ ID NO: 354946 - DNA, 16 bp, M. musculus
agacatggagatacag

SEQ ID NO: 354947 - DNA, 16 bp, M. musculus
agacatggagatgcag

SEQ ID NO: 354948 - DNA, 16 bp, M. musculus
agacatggccacaggc

SEQ ID NO: 354949 - DNA, 16 bp, M. musculus
agacatggtgctagag

SEQ ID NO: 354950 - DNA, 16 bp, M. musculus
agacatggtggtggag

SEQ ID NO: 354951 - DNA, 17 bp, M. musculus
agacatggtttctctgt

SEQ ID NO: 354952 - DNA, 16 bp, M. musculus
agacattaaagagaaa

SEQ ID NO: 354953 - DNA, 16 bp, M. musculus
agacattactaatcaa

SEQ ID NO: 354954 - DNA, 16 bp, M. musculus
agacattattttaaat

SEQ ID NO: 354955 - DNA, 16 bp, M. musculus
agacattccagaaaag

SEQ ID NO: 354956 - DNA, 16 bp, M. musculus
agacattggacattga

SEQ ID NO: 354957 - DNA, 16 bp, M. musculus
agacattgtctcaaaa

SEQ ID NO: 354958 - DNA, 16 bp, M. musculus
agacatttaaataaaa

SEQ ID NO: 354959 - DNA, 16 bp, M. musculus
agacatttattgtcat

SEQ ID NO: 354960 - DNA, 16 bp, M. musculus
agacatttctcattta

SEQ ID NO: 354961 - DNA, 16 bp, M. musculus
agacatttctttttct

SEQ ID NO: 354962 - DNA, 16 bp, M. musculus
agacatttcttttttt

SEQ ID NO: 354963 - DNA, 16 bp, M. musculus
agacattttaaaatta

SEQ ID NO: 354964 - DNA, 16 bp, M. musculus
agacattttcaacaaa

SEQ ID NO: 354965 - DNA, 16 bp, M. musculus
agacattttcaggtcc

SEQ ID NO: 354966 - DNA, 16 bp, M. musculus
agacattttctcattt

SEQ ID NO: 354967 - DNA, 16 bp, M. musculus
agacattttcttcatt

SEQ ID NO: 354968 - DNA, 16 bp, M. musculus
agacatttttactata

SEQ ID NO: 354969 - DNA, 16 bp, M. musculus
agacatttttatttct

SEQ ID NO: 354970 - DNA, 16 bp, M. musculus
agacattttttaaaaa

SEQ ID NO: 354971 - DNA, 16 bp, M. musculus
agacatttttttaaaa

SEQ ID NO: 354972 - DNA, 16 bp, M. musculus
agacattttttttttc

SEQ ID NO: 354973 - DNA, 16 bp, M. musculus
agaccaaaaccacatg

SEQ ID NO: 354974 - DNA, 16 bp, M. musculus
agaccaaacctcaaca

SEQ ID NO: 354975 - DNA, 16 bp, M. musculus
agaccaaacctcagca

SEQ ID NO: 354976 - DNA, 16 bp, M. musculus
agaccaaacctctgaa

SEQ ID NO: 354977 - DNA, 16 bp, M. musculus
agaccaaactgcacat

SEQ ID NO: 354978 - DNA, 16 bp, M. musculus
agaccaaagaaagaat

SEQ ID NO: 354979 - DNA, 17 bp, M. musculus
agaccaaagcccagtct

SEQ ID NO: 354980 - DNA, 16 bp, M. musculus
agaccaaatgaagctc

SEQ ID NO: 354981 - DNA, 16 bp, M. musculus
agaccaacaaaatcaa

SEQ ID NO: 354982 - DNA, 16 bp, M. musculus
agaccaacctaagaca

SEQ ID NO: 354983 - DNA, 16 bp, M. musculus
agaccaacctggcctc

SEQ ID NO: 354984 - DNA, 16 bp, M. musculus
agaccaagacaaagat

SEQ ID NO: 354985 - DNA, 16 bp, M. musculus
agaccaagagagagag

SEQ ID NO: 354986 - DNA, 16 bp, M. musculus
agaccaagatgcacat

SEQ ID NO: 354987 - DNA, 16 bp, M. musculus
agaccaagatggcctt

SEQ ID NO: 354988 - DNA, 16 bp, M. musculus
agaccaagctgctcat

SEQ ID NO: 354989 - DNA, 16 bp, M. musculus
agaccaagctggcctg

SEQ ID NO: 354990 - DNA, 16 bp, M. musculus
agaccaagctgtcctc

SEQ ID NO: 354991 - DNA, 16 bp, M. musculus
agaccaaggcagaagg

SEQ ID NO: 354992 - DNA, 16 bp, M. musculus
agaccaagtctcaaaa

SEQ ID NO: 354993 - DNA, 16 bp, M. musculus
agaccaagtgttcaaa

SEQ ID NO: 354994 - DNA, 16 bp, M. musculus
agaccaagttccagga

SEQ ID NO: 354995 - DNA, 16 bp, M. musculus
agaccacagggtggga

SEQ ID NO: 354996 - DNA, 16 bp, M. musculus
agaccacatgaagccc

SEQ ID NO: 354997 - DNA, 16 bp, M. musculus
agaccaccaaaagatt

SEQ ID NO: 354998 - DNA, 16 bp, M. musculus
agaccaccaaacagac

SEQ ID NO: 354999 - DNA, 16 bp, M. musculus
agaccaccaacagatt

SEQ ID NO: 355000 - DNA, 16 bp, M. musculus
agaccaccatggacta

SEQ ID NO: 355001 - DNA, 16 bp, M. musculus
agaccactaacagatt

SEQ ID NO: 355002 - DNA, 16 bp, M. musculus
agaccactacttctgc

SEQ ID NO: 355003 - DNA, 16 bp, M. musculus
agaccagaaaagggta

SEQ ID NO: 355004 - DNA, 16 bp, M. musculus
agaccagaagaagaca

SEQ ID NO: 355005 - DNA, 16 bp, M. musculus
agaccagaaggaagat

SEQ ID NO: 355006 - DNA, 16 bp, M. musculus
agaccagaatggcctc

SEQ ID NO: 355007 - DNA, 16 bp, M. musculus
agaccagaccagacca

SEQ ID NO: 355008 - DNA, 16 bp, M. musculus
agaccagaccaggctg

SEQ ID NO: 355009 - DNA, 16 bp, M. musculus
agaccagactgacctc

SEQ ID NO: 355010 - DNA, 16 bp, M. musculus
agaccagactgggctc

SEQ ID NO: 355011 - DNA, 16 bp, M. musculus
agaccagactggtctc

SEQ ID NO: 355012 - DNA, 16 bp, M. musculus
agaccagaggtcaaca

SEQ ID NO: 355013 - DNA, 16 bp, M. musculus
agaccagagtcagaat

SEQ ID NO: 355014 - DNA, 16 bp, M. musculus
agaccagagtttggat

SEQ ID NO: 355015 - DNA, 16 bp, M. musculus
agaccagcaaagcatt

SEQ ID NO: 355016 - DNA, 16 bp, M. musculus
agaccagcaacagatt

SEQ ID NO: 355017 - DNA, 16 bp, M. musculus
agaccagcagagggca

SEQ ID NO: 355018 - DNA, 16 bp, M. musculus
agaccagcatctccag

SEQ ID NO: 355019 - DNA, 16 bp, M. musculus
agaccagccaaggcta

SEQ ID NO: 355020 - DNA, 16 bp, M. musculus
agaccagccctgagct

SEQ ID NO: 355021 - DNA, 16 bp, M. musculus
agaccagcctagcctt

SEQ ID NO: 355022 - DNA, 16 bp, M. musculus
agaccagcctgatcta

SEQ ID NO: 355023 - DNA, 16 bp, M. musculus
agaccagcctggacca

SEQ ID NO: 355024 - DNA, 16 bp, M. musculus
agaccagcctggcctc

SEQ ID NO: 355025 - DNA, 16 bp, M. musculus
agaccagcctgggcta

SEQ ID NO: 355026 - DNA, 16 bp, M. musculus
agaccagcctggtcta

SEQ ID NO: 355027 - DNA, 16 bp, M. musculus
agaccagcctggtctg

SEQ ID NO: 355028 - DNA, 16 bp, M. musculus
agaccaggaagcagag

SEQ ID NO: 355029 - DNA, 16 bp, M. musculus
agaccaggcagacctc

SEQ ID NO: 355030 - DNA, 16 bp, M. musculus
agaccaggcagacctt

SEQ ID NO: 355031 - DNA, 17 bp, M. musculus
agaccaggctagcctcc

SEQ ID NO: 355032 - DNA, 16 bp, M. musculus
agaccaggctgccctc

SEQ ID NO: 355033 - DNA, 16 bp, M. musculus
agaccaggctgccctg

SEQ ID NO: 355034 - DNA, 16 bp, M. musculus
agaccaggctgcctca

SEQ ID NO: 355035 - DNA, 16 bp, M. musculus
agaccaggctgctctc

SEQ ID NO: 355036 - DNA, 17 bp, M. musculus
agaccaggctggcctta

SEQ ID NO: 355037 - DNA, 16 bp, M. musculus
agaccaggctggcttg

SEQ ID NO: 355038 - DNA, 16 bp, M. musculus
agaccaggctgggcct

SEQ ID NO: 355039 - DNA, 16 bp, M. musculus
agaccaggctgtccct

SEQ ID NO: 355040 - DNA, 16 bp, M. musculus
agaccaggctgtcttt

SEQ ID NO: 355041 - DNA, 16 bp, M. musculus
agaccaggctgttctc

SEQ ID NO: 355042 - DNA, 16 bp, M. musculus
agaccaggttggtctc

SEQ ID NO: 355043 - DNA, 16 bp, M. musculus
agaccagtctacacag

SEQ ID NO: 355044 - DNA, 16 bp, M. musculus
agaccagtctgacctc

SEQ ID NO: 355045 - DNA, 16 bp, M. musculus
agaccagtctggtcta

SEQ ID NO: 355046 - DNA, 16 bp, M. musculus
agaccagtgcacagag

SEQ ID NO: 355047 - DNA, 17 bp, M. musculus
agaccagtgtgaatgct

SEQ ID NO: 355048 - DNA, 16 bp, M. musculus
agaccatactgtgaga

SEQ ID NO: 355049 - DNA, 16 bp, M. musculus
agaccatattcagtgg

SEQ ID NO: 355050 - DNA, 16 bp, M. musculus
agaccatcagaaaaca

SEQ ID NO: 355051 - DNA, 16 bp, M. musculus
agaccatctaacaaaa

SEQ ID NO: 355052 - DNA, 16 bp, M. musculus
agaccatgaaagccag

SEQ ID NO: 355053 - DNA, 16 bp, M. musculus
agaccatgcctgagat

SEQ ID NO: 355054 - DNA, 16 bp, M. musculus
agaccatgggcttgaa

SEQ ID NO: 355055 - DNA, 16 bp, M. musculus
agaccatgtctcaaaa

SEQ ID NO: 355056 - DNA, 16 bp, M. musculus
agaccattggaaaaca

SEQ ID NO: 355057 - DNA, 16 bp, M. musculus
agaccatttttttttt

SEQ ID NO: 355058 - DNA, 16 bp, M. musculus
agacccaaagaaacta

SEQ ID NO: 355059 - DNA, 16 bp, M. musculus
agacccaaatgaagaa

SEQ ID NO: 355060 - DNA, 16 bp, M. musculus
agacccaacaagctgc

SEQ ID NO: 355061 - DNA, 16 bp, M. musculus
agacccaagtttgatc

SEQ ID NO: 355062 - DNA, 16 bp, M. musculus
agacccaatattttgc

SEQ ID NO: 355063 - DNA, 16 bp, M. musculus
agacccacaagcattg

SEQ ID NO: 355064 - DNA, 16 bp, M. musculus
agacccacctgcttct

SEQ ID NO: 355065 - DNA, 16 bp, M. musculus
agacccacctgtctct

SEQ ID NO: 355066 - DNA, 16 bp, M. musculus
agacccagaattaaac

SEQ ID NO: 355067 - DNA, 16 bp, M. musculus
agacccagacatggcc

SEQ ID NO: 355068 - DNA, 16 bp, M. musculus
agacccagagagagag

SEQ ID NO: 355069 - DNA, 16 bp, M. musculus
agacccagaggcagct

SEQ ID NO: 355070 - DNA, 16 bp, M. musculus
agacccagatttaaag

SEQ ID NO: 355071 - DNA, 16 bp, M. musculus
agacccagcaaagaga

SEQ ID NO: 355072 - DNA, 16 bp, M. musculus
agacccagcagtcctc

SEQ ID NO: 355073 - DNA, 16 bp, M. musculus
agacccagctataaca

SEQ ID NO: 355074 - DNA, 16 bp, M. musculus
agacccagctctacca

SEQ ID NO: 355075 - DNA, 16 bp, M. musculus
agacccaggctggcct

SEQ ID NO: 355076 - DNA, 16 bp, M. musculus
agacccaggtatacca

SEQ ID NO: 355077 - DNA, 16 bp, M. musculus
agacccagtctcaaaa

SEQ ID NO: 355078 - DNA, 16 bp, M. musculus
agaccccaaaatgtat

SEQ ID NO: 355079 - DNA, 16 bp, M. musculus
agaccccacctcaaaa

SEQ ID NO: 355080 - DNA, 17 bp, M. musculus
agaccccagagttcagg

SEQ ID NO: 355081 - DNA, 16 bp, M. musculus
agaccccagggagttt

SEQ ID NO: 355082 - DNA, 17 bp, M. musculus
agacccccatcagagcc

SEQ ID NO: 355083 - DNA, 16 bp, M. musculus
agacccccgaggtggg

SEQ ID NO: 355084 - DNA, 16 bp, M. musculus
agacccctggaactgg

SEQ ID NO: 355085 - DNA, 17 bp, M. musculus
agacccgtggaaaggcc

SEQ ID NO: 355086 - DNA, 16 bp, M. musculus
agaccctacctcaaaa

SEQ ID NO: 355087 - DNA, 16 bp, M. musculus
agaccctagctcaaaa

SEQ ID NO: 355088 - DNA, 16 bp, M. musculus
agaccctatctcaaaa

SEQ ID NO: 355089 - DNA, 16 bp, M. musculus
agaccctatttcaaaa

SEQ ID NO: 355090 - DNA, 16 bp, M. musculus
agaccctccctcaaaa

SEQ ID NO: 355091 - DNA, 16 bp, M. musculus
agaccctcctcctaac

SEQ ID NO: 355092 - DNA, 16 bp, M. musculus
agaccctcctcctcca

SEQ ID NO: 355093 - DNA, 16 bp, M. musculus
agaccctgactcaaaa

SEQ ID NO: 355094 - DNA, 16 bp, M. musculus
agaccctgagatgaac

SEQ ID NO: 355095 - DNA, 16 bp, M. musculus
agaccctgagcccaga

SEQ ID NO: 355096 - DNA, 16 bp, M. musculus
agaccctgagttcagt

SEQ ID NO: 355097 - DNA, 16 bp, M. musculus
agaccctgcctcaaag

SEQ ID NO: 355098 - DNA, 16 bp, M. musculus
agaccctggacagatg

SEQ ID NO: 355099 - DNA, 16 bp, M. musculus
agaccctgtctcaaaa

SEQ ID NO: 355100 - DNA, 16 bp, M. musculus
agaccctgtctcaaag

SEQ ID NO: 355101 - DNA, 16 bp, M. musculus
agaccctgtctcaagt

SEQ ID NO: 355102 - DNA, 16 bp, M. musculus
agaccctgtctcagaa

SEQ ID NO: 355103 - DNA, 16 bp, M. musculus
agaccctgtctcgaaa

SEQ ID NO: 355104 - DNA, 16 bp, M. musculus
agaccctgtctctaaa

SEQ ID NO: 355105 - DNA, 16 bp, M. musculus
agaccctgtcttaaaa

SEQ ID NO: 355106 - DNA, 19 bp, M. musculus
agaccctgtcttgaaaaaa

SEQ ID NO: 355107 - DNA, 16 bp, M. musculus
agaccctgtttcaagg

SEQ ID NO: 355108 - DNA, 16 bp, M. musculus
agaccctgtttcagaa

SEQ ID NO: 355109 - DNA, 16 bp, M. musculus
agaccctttctcaaaa

SEQ ID NO: 355110 - DNA, 16 bp, M. musculus
agaccgtgtctcaaaa

SEQ ID NO: 355111 - DNA, 16 bp, M. musculus
agacctaacacccagt

SEQ ID NO: 355112 - DNA, 16 bp, M. musculus
agacctaagttcagtt

SEQ ID NO: 355113 - DNA, 16 bp, M. musculus
agacctacagacagac

SEQ ID NO: 355114 - DNA, 16 bp, M. musculus
agacctacctgaagac

SEQ ID NO: 355115 - DNA, 16 bp, M. musculus
agacctataaagggaa

SEQ ID NO: 355116 - DNA, 16 bp, M. musculus
agacctatttgaatta

SEQ ID NO: 355117 - DNA, 16 bp, M. musculus
agacctcaaactcaga

SEQ ID NO: 355118 - DNA, 16 bp, M. musculus
agacctcagaactcag

SEQ ID NO: 355119 - DNA, 16 bp, M. musculus
agacctcagaagatga

SEQ ID NO: 355120 - DNA, 16 bp, M. musculus
agacctcaggacacag

SEQ ID NO: 355121 - DNA, 16 bp, M. musculus
agacctcaggagtcct

SEQ ID NO: 355122 - DNA, 16 bp, M. musculus
agacctcatctcaaaa

SEQ ID NO: 355123 - DNA, 16 bp, M. musculus
agacctcccagagctc

SEQ ID NO: 355124 - DNA, 16 bp, M. musculus
agacctccccactccc

SEQ ID NO: 355125 - DNA, 16 bp, M. musculus
agacctcctctgcact

SEQ ID NO: 355126 - DNA, 16 bp, M. musculus
agacctcgtctcaaaa

SEQ ID NO: 355127 - DNA, 16 bp, M. musculus
agacctctcagctctg

SEQ ID NO: 355128 - DNA, 16 bp, M. musculus
agacctctggcttctg

SEQ ID NO: 355129 - DNA, 16 bp, M. musculus
agacctctgggcacct

SEQ ID NO: 355130 - DNA, 16 bp, M. musculus
agacctgaaaagggaa

SEQ ID NO: 355131 - DNA, 16 bp, M. musculus
agacctgaaaatgaaa

SEQ ID NO: 355132 - DNA, 16 bp, M. musculus
agacctgagctttgta

SEQ ID NO: 355133 - DNA, 16 bp, M. musculus
agacctgatttctcca

SEQ ID NO: 355134 - DNA, 16 bp, M. musculus
agacctgcaaccctgt

SEQ ID NO: 355135 - DNA, 16 bp, M. musculus
agacctgcagtctcaa

SEQ ID NO: 355136 - DNA, 16 bp, M. musculus
agacctgcccactgtg

SEQ ID NO: 355137 - DNA, 16 bp, M. musculus
agacctgctgaggtgc

SEQ ID NO: 355138 - DNA, 16 bp, M. musculus
agacctggagagatgg

SEQ ID NO: 355139 - DNA, 16 bp, M. musculus
agacctggatgaacag

SEQ ID NO: 355140 - DNA, 16 bp, M. musculus
agacctggctgtcttg

SEQ ID NO: 355141 - DNA, 16 bp, M. musculus
agacctgggatgtgaa

SEQ ID NO: 355142 - DNA, 16 bp, M. musculus
agacctggggctggag

SEQ ID NO: 355143 - DNA, 16 bp, M. musculus
agacctggggtggggg

SEQ ID NO: 355144 - DNA, 16 bp, M. musculus
agacctgtccactgtg

SEQ ID NO: 355145 - DNA, 16 bp, M. musculus
agacctgtgattcatg

SEQ ID NO: 355146 - DNA, 16 bp, M. musculus
agacctgtgctgaggc

SEQ ID NO: 355147 - DNA, 16 bp, M. musculus
agacctgttgccaagg

SEQ ID NO: 355148 - DNA, 16 bp, M. musculus
agacctgttttgtgac

SEQ ID NO: 355149 - DNA, 16 bp, M. musculus
agaccttaaaagaaca

SEQ ID NO: 355150 - DNA, 16 bp, M. musculus
agaccttaaaagaaga

SEQ ID NO: 355151 - DNA, 16 bp, M. musculus
agaccttaagtgcttg

SEQ ID NO: 355152 - DNA, 16 bp, M. musculus
agaccttagatgaaat

SEQ ID NO: 355153 - DNA, 16 bp, M. musculus
agaccttatctcaaaa

SEQ ID NO: 355154 - DNA, 16 bp, M. musculus
agaccttatttcaaaa

SEQ ID NO: 355155 - DNA, 16 bp, M. musculus
agaccttcaaaggaga

SEQ ID NO: 355156 - DNA, 16 bp, M. musculus
agaccttcttcaattt

SEQ ID NO: 355157 - DNA, 16 bp, M. musculus
agaccttgaaagagaa

SEQ ID NO: 355158 - DNA, 16 bp, M. musculus
agaccttgaaaggaca

SEQ ID NO: 355159 - DNA, 16 bp, M. musculus
agaccttgcctcaaaa

SEQ ID NO: 355160 - DNA, 16 bp, M. musculus
agaccttgtcacaaaa

SEQ ID NO: 355161 - DNA, 16 bp, M. musculus
agaccttgtctcaaaa

SEQ ID NO: 355162 - DNA, 16 bp, M. musculus
agaccttgtctcaaac

SEQ ID NO: 355163 - DNA, 16 bp, M. musculus
agaccttgtctcaagc

SEQ ID NO: 355164 - DNA, 16 bp, M. musculus
agaccttgtcttaaaa

SEQ ID NO: 355165 - DNA, 16 bp, M. musculus
agaccttgtttcaaaa

SEQ ID NO: 355166 - DNA, 16 bp, M. musculus
agaccttgtttcagaa

SEQ ID NO: 355167 - DNA, 16 bp, M. musculus
agacctttcacttcct

SEQ ID NO: 355168 - DNA, 16 bp, M. musculus
agaccttttttaaaga

SEQ ID NO: 355169 - DNA, 45 bp, M. musculus
agaccttttttaaagattccttccgctgagttaaggcctttgttt

SEQ ID NO: 355170 - DNA, 16 bp, M. musculus
agacgaagacgaagac

SEQ ID NO: 355171 - DNA, 16 bp, M. musculus
agacgacgacgacgac

SEQ ID NO: 355172 - DNA, 16 bp, M. musculus
agacgaggctgcagat

SEQ ID NO: 355173 - DNA, 17 bp, M. musculus
agacgagggtgatgaag

SEQ ID NO: 355174 - DNA, 16 bp, M. musculus
agacggacagacagac

SEQ ID NO: 355175 - DNA, 16 bp, M. musculus
agacggacggacggac

SEQ ID NO: 355176 - DNA, 16 bp, M. musculus
agacggcagaaaataa

SEQ ID NO: 355177 - DNA, 16 bp, M. musculus
agactaaacctctgaa

SEQ ID NO: 355178 - DNA, 16 bp, M. musculus
agactaaaggcatgca

SEQ ID NO: 355179 - DNA, 16 bp, M. musculus
agactaagaaccccaa

SEQ ID NO: 355180 - DNA, 16 bp, M. musculus
agactaagacaggagg

SEQ ID NO: 355181 - DNA, 16 bp, M. musculus
agactaaggctggtct

SEQ ID NO: 355182 - DNA, 16 bp, M. musculus
agactacacaaagaaa

SEQ ID NO: 355183 - DNA, 16 bp, M. musculus
agactacattgcatat

SEQ ID NO: 355184 - DNA, 16 bp, M. musculus
agactagagcccggcc

SEQ ID NO: 355185 - DNA, 24 bp, M. musculus
agactagcatgtcttggttccatt

SEQ ID NO: 355186 - DNA, 16 bp, M. musculus
agactagccctgagct

SEQ ID NO: 355187 - DNA, 16 bp, M. musculus
agactagcctcaaact

SEQ ID NO: 355188 - DNA, 16 bp, M. musculus
agactagcctcagctt

SEQ ID NO: 355189 - DNA, 16 bp, M. musculus
agactagcctgggcta

SEQ ID NO: 355190 - DNA, 16 bp, M. musculus
agactagctctctcct

SEQ ID NO: 355191 - DNA, 16 bp, M. musculus
agactagctttgaact

SEQ ID NO: 355192 - DNA, 16 bp, M. musculus
agactaggcacttcct

SEQ ID NO: 355193 - DNA, 17 bp, M. musculus
agactagtgcctagtat

SEQ ID NO: 355194 - DNA, 16 bp, M. musculus
agactatgaaagccaa

SEQ ID NO: 355195 - DNA, 19 bp, M. musculus
agactatgtagtttttcaa

SEQ ID NO: 355196 - DNA, 16 bp, M. musculus
agactatgtctcaaaa

SEQ ID NO: 355197 - DNA, 16 bp, M. musculus
agactatgtgtgtgtg

SEQ ID NO: 355198 - DNA, 16 bp, M. musculus
agactcaaagaaacca

SEQ ID NO: 355199 - DNA, 16 bp, M. musculus
agactcaagagctccg

SEQ ID NO: 355200 - DNA, 16 bp, M. musculus
agactcacaagagaca

SEQ ID NO: 355201 - DNA, 16 bp, M. musculus
agactcacagttgaga

SEQ ID NO: 355202 - DNA, 16 bp, M. musculus
agactcagaaagaaaa

SEQ ID NO: 355203 - DNA, 16 bp, M. musculus
agactcagaaaggcaa

SEQ ID NO: 355204 - DNA, 16 bp, M. musculus
agactcagaaatgaac

SEQ ID NO: 355205 - DNA, 16 bp, M. musculus
agactcagagagaaga

SEQ ID NO: 355206 - DNA, 16 bp, M. musculus
agactcaggtcatcag

SEQ ID NO: 355207 - DNA, 16 bp, M. musculus
agactcatagagatct

SEQ ID NO: 355208 - DNA, 16 bp, M. musculus
agactcatgtgtttga

SEQ ID NO: 355209 - DNA, 16 bp, M. musculus
agactccaccaagact

SEQ ID NO: 355210 - DNA, 16 bp, M. musculus
agactccacctcaaaa

SEQ ID NO: 355211 - DNA, 16 bp, M. musculus
agactccactggagtg

SEQ ID NO: 355212 - DNA, 16 bp, M. musculus
agactccagagaaaca

SEQ ID NO: 355213 - DNA, 16 bp, M. musculus
agactccagggaacca

SEQ ID NO: 355214 - DNA, 16 bp, M. musculus
agactccagtcagaga

SEQ ID NO: 355215 - DNA, 16 bp, M. musculus
agactccatcttaaaa

SEQ ID NO: 355216 - DNA, 16 bp, M. musculus
agactccatgaccaca

SEQ ID NO: 355217 - DNA, 16 bp, M. musculus
agactcccagagctcc

SEQ ID NO: 355218 - DNA, 17 bp, M. musculus
agactccctgggcatgt

SEQ ID NO: 355219 - DNA, 28 bp, M. musculus
agactcccttcttccaatgtccttatat

SEQ ID NO: 355220 - DNA, 16 bp, M. musculus
agactccgccccacag

SEQ ID NO: 355221 - DNA, 16 bp, M. musculus
agactcctgacttgga

SEQ ID NO: 355222 - DNA, 16 bp, M. musculus
agactcctggacacct

SEQ ID NO: 355223 - DNA, 16 bp, M. musculus
agactcggtctcaaaa

SEQ ID NO: 355224 - DNA, 16 bp, M. musculus
agactctaaaatccag

SEQ ID NO: 355225 - DNA, 16 bp, M. musculus
agactctacctcaaaa

SEQ ID NO: 355226 - DNA, 16 bp, M. musculus
agactctcagaagaca

SEQ ID NO: 355227 - DNA, 16 bp, M. musculus
agactctccaggagac

SEQ ID NO: 355228 - DNA, 17 bp, M. musculus
agactctctctctctct

SEQ ID NO: 355229 - DNA, 16 bp, M. musculus
agactctcttagtaaa

SEQ ID NO: 355230 - DNA, 16 bp, M. musculus
agactctgaagaaaga

SEQ ID NO: 355231 - DNA, 16 bp, M. musculus
agactctgagaccaga

SEQ ID NO: 355232 - DNA, 16 bp, M. musculus
agactctgaggactca

SEQ ID NO: 355233 - DNA, 16 bp, M. musculus
agactctgcaaaatta

SEQ ID NO: 355234 - DNA, 16 bp, M. musculus
agactctgccagagcc

SEQ ID NO: 355235 - DNA, 17 bp, M. musculus
agactctgctggcatgg

SEQ ID NO: 355236 - DNA, 16 bp, M. musculus
agactctgggcctggc

SEQ ID NO: 355237 - DNA, 16 bp, M. musculus
agactctgtatcaaaa

SEQ ID NO: 355238 - DNA, 16 bp, M. musculus
agactctgtcacaaaa

SEQ ID NO: 355239 - DNA, 16 bp, M. musculus
agactctgtctcaaaa

SEQ ID NO: 355240 - DNA, 16 bp, M. musculus
agactctgtctcaaag

SEQ ID NO: 355241 - DNA, 16 bp, M. musculus
agactctgtctcaaca

SEQ ID NO: 355242 - DNA, 16 bp, M. musculus
agactctgtctccaaa

SEQ ID NO: 355243 - DNA, 16 bp, M. musculus
agactctgtcttaaaa

SEQ ID NO: 355244 - DNA, 16 bp, M. musculus
agactctgtttcaaaa

SEQ ID NO: 355245 - DNA, 16 bp, M. musculus
agactctgtttcagaa

SEQ ID NO: 355246 - DNA, 16 bp, M. musculus
agactctgttttaaaa

SEQ ID NO: 355247 - DNA, 16 bp, M. musculus
agactcttgtctcaaa

SEQ ID NO: 355248 - DNA, 16 bp, M. musculus
agactgaaaaagaaat

SEQ ID NO: 355249 - DNA, 16 bp, M. musculus
agactgaaacccagca

SEQ ID NO: 355250 - DNA, 16 bp, M. musculus
agactgaacccaggac

SEQ ID NO: 355251 - DNA, 16 bp, M. musculus
agactgaacctctgaa

SEQ ID NO: 355252 - DNA, 16 bp, M. musculus
agactgaagaaaaggc

SEQ ID NO: 355253 - DNA, 16 bp, M. musculus
agactgaagaagaaaa

SEQ ID NO: 355254 - DNA, 16 bp, M. musculus
agactgaaggaaagga

SEQ ID NO: 355255 - DNA, 16 bp, M. musculus
agactgaaggagttga

SEQ ID NO: 355256 - DNA, 16 bp, M. musculus
agactgaagtggctac

SEQ ID NO: 355257 - DNA, 16 bp, M. musculus
agactgaataaaaagg

SEQ ID NO: 355258 - DNA, 16 bp, M. musculus
agactgaattccagag

SEQ ID NO: 355259 - DNA, 17 bp, M. musculus
agactgaccaccatccc

SEQ ID NO: 355260 - DNA, 16 bp, M. musculus
agactgacctcgaact

SEQ ID NO: 355261 - DNA, 16 bp, M. musculus
agactgacttcaaact

SEQ ID NO: 355262 - DNA, 16 bp, M. musculus
agactgagaaagccat

SEQ ID NO: 355263 - DNA, 16 bp, M. musculus
agactgagaagtaaga

SEQ ID NO: 355264 - DNA, 16 bp, M. musculus
agactgagagagagag

SEQ ID NO: 355265 - DNA, 16 bp, M. musculus
agactgagcaggctgt

SEQ ID NO: 355266 - DNA, 16 bp, M. musculus
agactgagctgcacat

SEQ ID NO: 355267 - DNA, 16 bp, M. musculus
agactgaggaaaagga

SEQ ID NO: 355268 - DNA, 16 bp, M. musculus
agactgaggcagggga

SEQ ID NO: 355269 - DNA, 16 bp, M. musculus
agactgagggaatggc

SEQ ID NO: 355270 - DNA, 16 bp, M. musculus
agactgatctcagcag

SEQ ID NO: 355271 - DNA, 16 bp, M. musculus
agactgattgccagag

SEQ ID NO: 355272 - DNA, 16 bp, M. musculus
agactgatttccagaa

SEQ ID NO: 355273 - DNA, 16 bp, M. musculus
agactgattttttttt

SEQ ID NO: 355274 - DNA, 16 bp, M. musculus
agactgcaatagaacc

SEQ ID NO: 355275 - DNA, 16 bp, M. musculus
agactgccccaaccag

SEQ ID NO: 355276 - DNA, 16 bp, M. musculus
agactgccccacatag

SEQ ID NO: 355277 - DNA, 16 bp, M. musculus
agactgcctcaaaaca

SEQ ID NO: 355278 - DNA, 16 bp, M. musculus
agactgcctgcctctg

SEQ ID NO: 355279 - DNA, 16 bp, M. musculus
agactgctacagtgta

SEQ ID NO: 355280 - DNA, 16 bp, M. musculus
agactgctataaacat

SEQ ID NO: 355281 - DNA, 16 bp, M. musculus
agactgctgctcctcc

SEQ ID NO: 355282 - DNA, 16 bp, M. musculus
agactgctttcattgt

SEQ ID NO: 355283 - DNA, 16 bp, M. musculus
agactggaaaacaatt

SEQ ID NO: 355284 - DNA, 23 bp, M. musculus
agactggaactcaagcaggtcag

SEQ ID NO: 355285 - DNA, 16 bp, M. musculus
agactggagaccccag

SEQ ID NO: 355286 - DNA, 16 bp, M. musculus
agactggataaagaaa

SEQ ID NO: 355287 - DNA, 16 bp, M. musculus
agactggcagatctct

SEQ ID NO: 355288 - DNA, 16 bp, M. musculus
agactggcctcagact

SEQ ID NO: 355289 - DNA, 16 bp, M. musculus
agactggcctccaact

SEQ ID NO: 355290 - DNA, 16 bp, M. musculus
agactggccttcaact

SEQ ID NO: 355291 - DNA, 16 bp, M. musculus
agactggccttgaatt

SEQ ID NO: 355292 - DNA, 16 bp, M. musculus
agactggctacacaaa

SEQ ID NO: 355293 - DNA, 16 bp, M. musculus
agactggctactgtcc

SEQ ID NO: 355294 - DNA, 17 bp, M. musculus
agactggctcagggtct

SEQ ID NO: 355295 - DNA, 16 bp, M. musculus
agactggctctgaact

SEQ ID NO: 355296 - DNA, 16 bp, M. musculus
agactggctggccagc

SEQ ID NO: 355297 - DNA, 16 bp, M. musculus
agactggctggccagt

SEQ ID NO: 355298 - DNA, 16 bp, M. musculus
agactggctggtcagc

SEQ ID NO: 355299 - DNA, 16 bp, M. musculus
agactggcttggaact

SEQ ID NO: 355300 - DNA, 16 bp, M. musculus
agactgggaagatggc

SEQ ID NO: 355301 - DNA, 16 bp, M. musculus
agactgggctggagag

SEQ ID NO: 355302 - DNA, 16 bp, M. musculus
agactgggctggcctt

SEQ ID NO: 355303 - DNA, 16 bp, M. musculus
agactgggtttctctg

SEQ ID NO: 355304 - DNA, 16 bp, M. musculus
agactgggtttttctg

SEQ ID NO: 355305 - DNA, 16 bp, M. musculus
agactgtaaatcatca

SEQ ID NO: 355306 - DNA, 16 bp, M. musculus
agactgtcagaaaaca

SEQ ID NO: 355307 - DNA, 16 bp, M. musculus
agactgtctcaaaaca

SEQ ID NO: 355308 - DNA, 16 bp, M. musculus
agactgtgggaaagaa

SEQ ID NO: 355309 - DNA, 16 bp, M. musculus
agactgtgtcttctag

SEQ ID NO: 355310 - DNA, 16 bp, M. musculus
agactgtgtgtgtgtg

SEQ ID NO: 355311 - DNA, 17 bp, M. musculus
agactgttggaccaggg

SEQ ID NO: 355312 - DNA, 16 bp, M. musculus
agacttaaaatatttt

SEQ ID NO: 355313 - DNA, 16 bp, M. musculus
agacttaaaggattat

SEQ ID NO: 355314 - DNA, 16 bp, M. musculus
agacttagaaacagaa

SEQ ID NO: 355315 - DNA, 16 bp, M. musculus
agacttatttatttat

SEQ ID NO: 355316 - DNA, 16 bp, M. musculus
agacttcaaaccaaaa

SEQ ID NO: 355317 - DNA, 16 bp, M. musculus
agacttcaacatccca

SEQ ID NO: 355318 - DNA, 16 bp, M. musculus
agacttcaagttctta

SEQ ID NO: 355319 - DNA, 16 bp, M. musculus
agacttcagagaaaca

SEQ ID NO: 355320 - DNA, 16 bp, M. musculus
agacttcagtgttgta

SEQ ID NO: 355321 - DNA, 16 bp, M. musculus
agacttcatccagcag

SEQ ID NO: 355322 - DNA, 16 bp, M. musculus
agacttccaggactca

SEQ ID NO: 355323 - DNA, 16 bp, M. musculus
agacttcctcagcaac

SEQ ID NO: 355324 - DNA, 16 bp, M. musculus
agacttctcaccagaa

SEQ ID NO: 355325 - DNA, 16 bp, M. musculus
agacttctcactagag

SEQ ID NO: 355326 - DNA, 16 bp, M. musculus
agacttctccccagag

SEQ ID NO: 355327 - DNA, 16 bp, M. musculus
agacttctctccagag

SEQ ID NO: 355328 - DNA, 16 bp, M. musculus
agacttctgacaagat

SEQ ID NO: 355329 - DNA, 16 bp, M. musculus
agacttctgcttgaat

SEQ ID NO: 355330 - DNA, 16 bp, M. musculus
agacttctgtgtacct

SEQ ID NO: 355331 - DNA, 16 bp, M. musculus
agacttcttcttcttc

SEQ ID NO: 355332 - DNA, 16 bp, M. musculus
agacttgaagtcccag

SEQ ID NO: 355333 - DNA, 16 bp, M. musculus
agacttgagacccaca

SEQ ID NO: 355334 - DNA, 16 bp, M. musculus
agacttgagcttagta

SEQ ID NO: 355335 - DNA, 16 bp, M. musculus
agacttgatgccccag

SEQ ID NO: 355336 - DNA, 16 bp, M. musculus
agacttgatgctccag

SEQ ID NO: 355337 - DNA, 16 bp, M. musculus
agacttgcttccagaa

SEQ ID NO: 355338 - DNA, 16 bp, M. musculus
agacttggctgcagtc

SEQ ID NO: 355339 - DNA, 16 bp, M. musculus
agacttgggggagggg

SEQ ID NO: 355340 - DNA, 16 bp, M. musculus
agacttggtggcaaat

SEQ ID NO: 355341 - DNA, 16 bp, M. musculus
agacttgtcctgtcca

SEQ ID NO: 355342 - DNA, 16 bp, M. musculus
agacttgtgtgtgtgt

SEQ ID NO: 355343 - DNA, 16 bp, M. musculus
agactttaagaaggac

SEQ ID NO: 355344 - DNA, 16 bp, M. musculus
agactttaatagtgtg

SEQ ID NO: 355345 - DNA, 16 bp, M. musculus
agactttaattttttt

SEQ ID NO: 355346 - DNA, 16 bp, M. musculus
agactttatctcaaaa

SEQ ID NO: 355347 - DNA, 16 bp, M. musculus
agactttatgggtgtg

SEQ ID NO: 355348 - DNA, 16 bp, M. musculus
agactttatttttaaa

SEQ ID NO: 355349 - DNA, 16 bp, M. musculus
agactttcaaagaaaa

SEQ ID NO: 355350 - DNA, 16 bp, M. musculus
agactttcaaagaaca

SEQ ID NO: 355351 - DNA, 16 bp, M. musculus
agactttctgttggct

SEQ ID NO: 355352 - DNA, 16 bp, M. musculus
agactttgattttttt

SEQ ID NO: 355353 - DNA, 16 bp, M. musculus
agactttgtctcaaaa

SEQ ID NO: 355354 - DNA, 16 bp, M. musculus
agactttgtcttgaaa

SEQ ID NO: 355355 - DNA, 17 bp, M. musculus
agactttgttctctggt

SEQ ID NO: 355356 - DNA, 16 bp, M. musculus
agacttttaaaaaatt

SEQ ID NO: 355357 - DNA, 16 bp, M. musculus
agacttttaattataa

SEQ ID NO: 355358 - DNA, 16 bp, M. musculus
agacttttatttttaa

SEQ ID NO: 355359 - DNA, 16 bp, M. musculus
agacttttctcttttt

SEQ ID NO: 355360 - DNA, 16 bp, M. musculus
agactttttaaaaaat

SEQ ID NO: 355361 - DNA, 16 bp, M. musculus
agactttttagtgttt

SEQ ID NO: 355362 - DNA, 16 bp, M. musculus
agacttttttttaaat

SEQ ID NO: 355363 - DNA, 16 bp, M. musculus
agactttttttttaaa

SEQ ID NO: 355364 - DNA, 16 bp, M. musculus
agacttttttttttaa

SEQ ID NO: 355365 - DNA, 16 bp, M. musculus
agagaaaaacatttaa

SEQ ID NO: 355366 - DNA, 16 bp, M. musculus
agagaaaaagaagcct

SEQ ID NO: 355367 - DNA, 16 bp, M. musculus
agagaaaaagagactg

SEQ ID NO: 355368 - DNA, 16 bp, M. musculus
agagaaaaagctgaac

SEQ ID NO: 355369 - DNA, 16 bp, M. musculus
agagaaaaatgtcaag

SEQ ID NO: 355370 - DNA, 16 bp, M. musculus
agagaaaacatgcaat

SEQ ID NO: 355371 - DNA, 16 bp, M. musculus
agagaaaagcaaatca

SEQ ID NO: 355372 - DNA, 16 bp, M. musculus
agagaaaagctgaaaa

SEQ ID NO: 355373 - DNA, 16 bp, M. musculus
agagaaaaggctgaag

SEQ ID NO: 355374 - DNA, 16 bp, M. musculus
agagaaaagtctgctg

SEQ ID NO: 355375 - DNA, 16 bp, M. musculus
agagaaaatactcaag

SEQ ID NO: 355376 - DNA, 16 bp, M. musculus
agagaaaatatccaaa

SEQ ID NO: 355377 - DNA, 16 bp, M. musculus
agagaaaatgatgtaa

SEQ ID NO: 355378 - DNA, 16 bp, M. musculus
agagaaaatggaagca

SEQ ID NO: 355379 - DNA, 16 bp, M. musculus
agagaaaattaaagca

SEQ ID NO: 355380 - DNA, 16 bp, M. musculus
agagaaaattatttct

SEQ ID NO: 355381 - DNA, 16 bp, M. musculus
agagaaaatttcctga

SEQ ID NO: 355382 - DNA, 16 bp, M. musculus
agagaaacaacaccct

SEQ ID NO: 355383 - DNA, 16 bp, M. musculus
agagaaacaagctcta

SEQ ID NO: 355384 - DNA, 16 bp, M. musculus
agagaaacaccatgac

SEQ ID NO: 355385 - DNA, 16 bp, M. musculus
agagaaacactcctca

SEQ ID NO: 355386 - DNA, 16 bp, M. musculus
agagaaacactgtttc

SEQ ID NO: 355387 - DNA, 16 bp, M. musculus
agagaaacagaaaatc

SEQ ID NO: 355388 - DNA, 16 bp, M. musculus
agagaaacagaactga

SEQ ID NO: 355389 - DNA, 16 bp, M. musculus
agagaaacagaagatg

SEQ ID NO: 355390 - DNA, 16 bp, M. musculus
agagaaacagaagcca

SEQ ID NO: 355391 - DNA, 16 bp, M. musculus
agagaaacagacacac

SEQ ID NO: 355392 - DNA, 16 bp, M. musculus
agagaaacaggaagtt

SEQ ID NO: 355393 - DNA, 16 bp, M. musculus
agagaaacaggaatat

SEQ ID NO: 355394 - DNA, 16 bp, M. musculus
agagaaacattttaaa

SEQ ID NO: 355395 - DNA, 16 bp, M. musculus
agagaaaccatatgaa

SEQ ID NO: 355396 - DNA, 16 bp, M. musculus
agagaaaccctacctc

SEQ ID NO: 355397 - DNA, 16 bp, M. musculus
agagaaaccctataaa

SEQ ID NO: 355398 - DNA, 16 bp, M. musculus
agagaaaccctatcaa

SEQ ID NO: 355399 - DNA, 16 bp, M. musculus
agagaaaccctatgaa

SEQ ID NO: 355400 - DNA, 16 bp, M. musculus
agagaaaccctatgtc

SEQ ID NO: 355401 - DNA, 16 bp, M. musculus
agagaaaccctgtaaa

SEQ ID NO: 355402 - DNA, 16 bp, M. musculus
agagaaaccctgtatt

SEQ ID NO: 355403 - DNA, 23 bp, M. musculus
agagaaaccctgtctcgaaaaac

SEQ ID NO: 355404 - DNA, 16 bp, M. musculus
agagaaaccctgtgaa

SEQ ID NO: 355405 - DNA, 16 bp, M. musculus
agagaaacctatgaat

SEQ ID NO: 355406 - DNA, 16 bp, M. musculus
agagaaacctggtctc

SEQ ID NO: 355407 - DNA, 16 bp, M. musculus
agagaaaccttataaa

SEQ ID NO: 355408 - DNA, 16 bp, M. musculus
agagaaaccttctctc

SEQ ID NO: 355409 - DNA, 16 bp, M. musculus
agagaaactaaaagca

SEQ ID NO: 355410 - DNA, 16 bp, M. musculus
agagaaactaacagaa

SEQ ID NO: 355411 - DNA, 16 bp, M. musculus
agagaaactcaaagca

SEQ ID NO: 355412 - DNA, 16 bp, M. musculus
agagaaactgaaagaa

SEQ ID NO: 355413 - DNA, 16 bp, M. musculus
agagaaactgaagaaa

SEQ ID NO: 355414 - DNA, 16 bp, M. musculus
agagaaactgagacag

SEQ ID NO: 355415 - DNA, 16 bp, M. musculus
agagaaactgaggaaa

SEQ ID NO: 355416 - DNA, 16 bp, M. musculus
agagaaactgaggctg

SEQ ID NO: 355417 - DNA, 16 bp, M. musculus
agagaaactggaagca

SEQ ID NO: 355418 - DNA, 16 bp, M. musculus
agagaaactgtttcaa

SEQ ID NO: 355419 - DNA, 16 bp, M. musculus
agagaaacttaaagaa

SEQ ID NO: 355420 - DNA, 16 bp, M. musculus
agagaaacttggagca

SEQ ID NO: 355421 - DNA, 16 bp, M. musculus
agagaaactttacaaa

SEQ ID NO: 355422 - DNA, 16 bp, M. musculus
agagaaactttagcaa

SEQ ID NO: 355423 - DNA, 16 bp, M. musculus
agagaaagaaaccctg

SEQ ID NO: 355424 - DNA, 16 bp, M. musculus
agagaaagaactgaag

SEQ ID NO: 355425 - DNA, 16 bp, M. musculus
agagaaagacacctga

SEQ ID NO: 355426 - DNA, 16 bp, M. musculus
agagaaagagctataa

SEQ ID NO: 355427 - DNA, 16 bp, M. musculus
agagaaagatacagag

SEQ ID NO: 355428 - DNA, 16 bp, M. musculus
agagaaagatgcagct

SEQ ID NO: 355429 - DNA, 16 bp, M. musculus
agagaaagcaaactag

SEQ ID NO: 355430 - DNA, 16 bp, M. musculus
agagaaagcaaagcca

SEQ ID NO: 355431 - DNA, 16 bp, M. musculus
agagaaagcacacaga

SEQ ID NO: 355432 - DNA, 16 bp, M. musculus
agagaaagcactcaag

SEQ ID NO: 355433 - DNA, 16 bp, M. musculus
agagaaagcattcaaa

SEQ ID NO: 355434 - DNA, 16 bp, M. musculus
agagaaagcctgtctg

SEQ ID NO: 355435 - DNA, 16 bp, M. musculus
agagaaagctcagcag

SEQ ID NO: 355436 - DNA, 16 bp, M. musculus
agagaaaggaacttca

SEQ ID NO: 355437 - DNA, 16 bp, M. musculus
agagaaaggactaaag

SEQ ID NO: 355438 - DNA, 16 bp, M. musculus
agagaaaggactgagg

SEQ ID NO: 355439 - DNA, 16 bp, M. musculus
agagaaaggaggcagt

SEQ ID NO: 355440 - DNA, 16 bp, M. musculus
agagaaaggccataga

SEQ ID NO: 355441 - DNA, 16 bp, M. musculus
agagaaaggctggaag

SEQ ID NO: 355442 - DNA, 16 bp, M. musculus
agagaaagggatggac

SEQ ID NO: 355443 - DNA, 16 bp, M. musculus
agagaaagggcccaag

SEQ ID NO: 355444 - DNA, 16 bp, M. musculus
agagaaagtacccagg

SEQ ID NO: 355445 - DNA, 16 bp, M. musculus
agagaaagtatgttac

SEQ ID NO: 355446 - DNA, 16 bp, M. musculus
agagaaagtggtgaag

SEQ ID NO: 355447 - DNA, 16 bp, M. musculus
agagaaataaaaactt

SEQ ID NO: 355448 - DNA, 16 bp, M. musculus
agagaaataaatgcat

SEQ ID NO: 355449 - DNA, 17 bp, M. musculus
agagaaatagtgataaa

SEQ ID NO: 355450 - DNA, 16 bp, M. musculus
agagaaatatttcaaa

SEQ ID NO: 355451 - DNA, 16 bp, M. musculus
agagaaatcaaggcag

SEQ ID NO: 355452 - DNA, 16 bp, M. musculus
agagaaatcctgcctc

SEQ ID NO: 355453 - DNA, 16 bp, M. musculus
agagaaatctgtctca

SEQ ID NO: 355454 - DNA, 16 bp, M. musculus
agagaaatgactgaag

SEQ ID NO: 355455 - DNA, 16 bp, M. musculus
agagaaatgcaaagca

SEQ ID NO: 355456 - DNA, 16 bp, M. musculus
agagaaatgcaccaaa

SEQ ID NO: 355457 - DNA, 34 bp, M. musculus
agagaaatgctgagacacatcaagagctgctggg

SEQ ID NO: 355458 - DNA, 16 bp, M. musculus
agagaaatggagtcaa

SEQ ID NO: 355459 - DNA, 16 bp, M. musculus
agagaaatggctcagc

SEQ ID NO: 355460 - DNA, 16 bp, M. musculus
agagaaatgggcagaa

SEQ ID NO: 355461 - DNA, 16 bp, M. musculus
agagaacaaaataccc

SEQ ID NO: 355462 - DNA, 16 bp, M. musculus
agagaacaaagtcttt

SEQ ID NO: 355463 - DNA, 16 bp, M. musculus
agagaacaagctagac

SEQ ID NO: 355464 - DNA, 16 bp, M. musculus
agagaacacaaaagcc

SEQ ID NO: 355465 - DNA, 16 bp, M. musculus
agagaacacaaaggcc

SEQ ID NO: 355466 - DNA, 16 bp, M. musculus
agagaacacaagtgcc

SEQ ID NO: 355467 - DNA, 16 bp, M. musculus
agagaacacagatgcc

SEQ ID NO: 355468 - DNA, 16 bp, M. musculus
agagaacagactcctg

SEQ ID NO: 355469 - DNA, 16 bp, M. musculus
agagaacagccaacca

SEQ ID NO: 355470 - DNA, 16 bp, M. musculus
agagaacatcagaaca

SEQ ID NO: 355471 - DNA, 16 bp, M. musculus
agagaacatggacatc

SEQ ID NO: 355472 - DNA, 16 bp, M. musculus
agagaacattccagaa

SEQ ID NO: 355473 - DNA, 16 bp, M. musculus
agagaacattctagaa

SEQ ID NO: 355474 - DNA, 16 bp, M. musculus
agagaacattctggaa

SEQ ID NO: 355475 - DNA, 16 bp, M. musculus
agagaaccaactccat

SEQ ID NO: 355476 - DNA, 16 bp, M. musculus
agagaaccaactccca

SEQ ID NO: 355477 - DNA, 16 bp, M. musculus
agagaacccctgtctc

SEQ ID NO: 355478 - DNA, 16 bp, M. musculus
agagaacctaagttca

SEQ ID NO: 355479 - DNA, 16 bp, M. musculus
agagaacctgcctcaa

SEQ ID NO: 355480 - DNA, 16 bp, M. musculus
agagaacctggattca

SEQ ID NO: 355481 - DNA, 16 bp, M. musculus
agagaacctgggagag

SEQ ID NO: 355482 - DNA, 16 bp, M. musculus
agagaactcagcagtt

SEQ ID NO: 355483 - DNA, 16 bp, M. musculus
agagaactgactcctg

SEQ ID NO: 355484 - DNA, 16 bp, M. musculus
agagaactgattccca

SEQ ID NO: 355485 - DNA, 16 bp, M. musculus
agagaactggatggga

SEQ ID NO: 355486 - DNA, 16 bp, M. musculus
agagaactggggttca

SEQ ID NO: 355487 - DNA, 16 bp, M. musculus
agagaacttcagaaaa

SEQ ID NO: 355488 - DNA, 16 bp, M. musculus
agagaactttctggaa

SEQ ID NO: 355489 - DNA, 16 bp, M. musculus
agagaagaaaattatt

SEQ ID NO: 355490 - DNA, 16 bp, M. musculus
agagaagaaagggttt

SEQ ID NO: 355491 - DNA, 16 bp, M. musculus
agagaagaatgaagcc

SEQ ID NO: 355492 - DNA, 16 bp, M. musculus
agagaagaatttattt

SEQ ID NO: 355493 - DNA, 16 bp, M. musculus
agagaagacaatgaag

SEQ ID NO: 355494 - DNA, 16 bp, M. musculus
agagaagagaaagcat

SEQ ID NO: 355495 - DNA, 16 bp, M. musculus
agagaagagactgaag

SEQ ID NO: 355496 - DNA, 16 bp, M. musculus
agagaagagcttgcct

SEQ ID NO: 355497 - DNA, 16 bp, M. musculus
agagaagaggaagccc

SEQ ID NO: 355498 - DNA, 16 bp, M. musculus
agagaagagggagcct

SEQ ID NO: 355499 - DNA, 16 bp, M. musculus
agagaagatgtaccta

SEQ ID NO: 355500 - DNA, 16 bp, M. musculus
agagaagcaagtgctc

SEQ ID NO: 355501 - DNA, 16 bp, M. musculus
agagaagcacagctga

SEQ ID NO: 355502 - DNA, 16 bp, M. musculus
agagaagcagaagcca

SEQ ID NO: 355503 - DNA, 16 bp, M. musculus
agagaagcagaggcca

SEQ ID NO: 355504 - DNA, 16 bp, M. musculus
agagaagccagaagag

SEQ ID NO: 355505 - DNA, 16 bp, M. musculus
agagaagccagagaag

SEQ ID NO: 355506 - DNA, 16 bp, M. musculus
agagaagccagtgctc

SEQ ID NO: 355507 - DNA, 16 bp, M. musculus
agagaagcccacaaag

SEQ ID NO: 355508 - DNA, 16 bp, M. musculus
agagaagccctgaggg

SEQ ID NO: 355509 - DNA, 16 bp, M. musculus
agagaagctcaccaag

SEQ ID NO: 355510 - DNA, 16 bp, M. musculus
agagaagctctgtctc

SEQ ID NO: 355511 - DNA, 16 bp, M. musculus
agagaagctgcctgag

SEQ ID NO: 355512 - DNA, 16 bp, M. musculus
agagaagctggaagta

SEQ ID NO: 355513 - DNA, 16 bp, M. musculus
agagaagctggaggaa

SEQ ID NO: 355514 - DNA, 16 bp, M. musculus
agagaagcttccagaa

SEQ ID NO: 355515 - DNA, 16 bp, M. musculus
agagaagctttctcct

SEQ ID NO: 355516 - DNA, 16 bp, M. musculus
agagaaggaacactac

SEQ ID NO: 355517 - DNA, 16 bp, M. musculus
agagaaggaaggctag

SEQ ID NO: 355518 - DNA, 16 bp, M. musculus
agagaaggaagggttt

SEQ ID NO: 355519 - DNA, 16 bp, M. musculus
agagaaggaatatgtt

SEQ ID NO: 355520 - DNA, 16 bp, M. musculus
agagaaggagctgaga

SEQ ID NO: 355521 - DNA, 18 bp, M. musculus
agagaaggatgaagccaa

SEQ ID NO: 355522 - DNA, 16 bp, M. musculus
agagaaggcatggcag

SEQ ID NO: 355523 - DNA, 16 bp, M. musculus
agagaaggccttctct

SEQ ID NO: 355524 - DNA, 16 bp, M. musculus
agagaaggctcagtga

SEQ ID NO: 355525 - DNA, 16 bp, M. musculus
agagaaggggaagcct

SEQ ID NO: 355526 - DNA, 16 bp, M. musculus
agagaaggtgcccaga

SEQ ID NO: 355527 - DNA, 16 bp, M. musculus
agagaaggttctagaa

SEQ ID NO: 355528 - DNA, 16 bp, M. musculus
agagaagtacagagga

SEQ ID NO: 355529 - DNA, 16 bp, M. musculus
agagaagtcagagcag

SEQ ID NO: 355530 - DNA, 16 bp, M. musculus
agagaagtcagattga

SEQ ID NO: 355531 - DNA, 16 bp, M. musculus
agagaagttgagctgg

SEQ ID NO: 355532 - DNA, 16 bp, M. musculus
agagaagttgaggctt

SEQ ID NO: 355533 - DNA, 16 bp, M. musculus
agagaagtttcttttt

SEQ ID NO: 355534 - DNA, 16 bp, M. musculus
agagaataaaagacac

SEQ ID NO: 355535 - DNA, 16 bp, M. musculus
agagaataacagaatc

SEQ ID NO: 355536 - DNA, 16 bp, M. musculus
agagaatatgaatgag

SEQ ID NO: 355537 - DNA, 16 bp, M. musculus
agagaatattctggaa

SEQ ID NO: 355538 - DNA, 16 bp, M. musculus
agagaatctcaggtac

SEQ ID NO: 355539 - DNA, 16 bp, M. musculus
agagaatgaatgagag

SEQ ID NO: 355540 - DNA, 16 bp, M. musculus
agagaatgacagactc

SEQ ID NO: 355541 - DNA, 16 bp, M. musculus
agagaatggccttatc

SEQ ID NO: 355542 - DNA, 16 bp, M. musculus
agagaatgtgggaaag

SEQ ID NO: 355543 - DNA, 16 bp, M. musculus
agagaattacagatca

SEQ ID NO: 355544 - DNA, 16 bp, M. musculus
agagaattacaggaaa

SEQ ID NO: 355545 - DNA, 16 bp, M. musculus
agagaattgataaatg

SEQ ID NO: 355546 - DNA, 16 bp, M. musculus
agagaattttttaaaa

SEQ ID NO: 355547 - DNA, 16 bp, M. musculus
agagacaaagccacca

SEQ ID NO: 355548 - DNA, 16 bp, M. musculus
agagacaaagttagga

SEQ ID NO: 355549 - DNA, 16 bp, M. musculus
agagacaaatggatct

SEQ ID NO: 355550 - DNA, 16 bp, M. musculus
agagacaagatggctg

SEQ ID NO: 355551 - DNA, 16 bp, M. musculus
agagacaagggcaaga

SEQ ID NO: 355552 - DNA, 16 bp, M. musculus
agagacaaggtggtgg

SEQ ID NO: 355553 - DNA, 16 bp, M. musculus
agagacaaggtttctc

SEQ ID NO: 355554 - DNA, 16 bp, M. musculus
agagacaataaagatg

SEQ ID NO: 355555 - DNA, 16 bp, M. musculus
agagacaatgtgtgga

SEQ ID NO: 355556 - DNA, 16 bp, M. musculus
agagacacaaagacag

SEQ ID NO: 355557 - DNA, 16 bp, M. musculus
agagacacacaaagag

SEQ ID NO: 355558 - DNA, 16 bp, M. musculus
agagacacacaagaca

SEQ ID NO: 355559 - DNA, 16 bp, M. musculus
agagacacacacagac

SEQ ID NO: 355560 - DNA, 16 bp, M. musculus
agagacacacacagag

SEQ ID NO: 355561 - DNA, 16 bp, M. musculus
agagacacacacagct

SEQ ID NO: 355562 - DNA, 16 bp, M. musculus
agagacacagacagaa

SEQ ID NO: 355563 - DNA, 16 bp, M. musculus
agagacacagagaaca

SEQ ID NO: 355564 - DNA, 16 bp, M. musculus
agagacacagagagag

SEQ ID NO: 355565 - DNA, 16 bp, M. musculus
agagacacagagagga

SEQ ID NO: 355566 - DNA, 16 bp, M. musculus
agagacacagaggaga

SEQ ID NO: 355567 - DNA, 16 bp, M. musculus
agagacacagatacac

SEQ ID NO: 355568 - DNA, 16 bp, M. musculus
agagacacagctctga

SEQ ID NO: 355569 - DNA, 16 bp, M. musculus
agagacacagctcttg

SEQ ID NO: 355570 - DNA, 16 bp, M. musculus
agagacacagcttctg

SEQ ID NO: 355571 - DNA, 16 bp, M. musculus
agagacacattaaaaa

SEQ ID NO: 355572 - DNA, 16 bp, M. musculus
agagacactaagagaa

SEQ ID NO: 355573 - DNA, 16 bp, M. musculus
agagacagaagcagag

SEQ ID NO: 355574 - DNA, 16 bp, M. musculus
agagacagaagctctg

SEQ ID NO: 355575 - DNA, 16 bp, M. musculus
agagacagaaggcaga

SEQ ID NO: 355576 - DNA, 16 bp, M. musculus
agagacagaagggtca

SEQ ID NO: 355577 - DNA, 16 bp, M. musculus
agagacagacaagcag

SEQ ID NO: 355578 - DNA, 16 bp, M. musculus
agagacagacacagag

SEQ ID NO: 355579 - DNA, 16 bp, M. musculus
agagacagacaccaag

SEQ ID NO: 355580 - DNA, 16 bp, M. musculus
agagacagacactgag

SEQ ID NO: 355581 - DNA, 16 bp, M. musculus
agagacagacagagac

SEQ ID NO: 355582 - DNA, 16 bp, M. musculus
agagacagacagagga

SEQ ID NO: 355583 - DNA, 16 bp, M. musculus
agagacagacagattt

SEQ ID NO: 355584 - DNA, 16 bp, M. musculus
agagacagacagtgag

SEQ ID NO: 355585 - DNA, 16 bp, M. musculus
agagacagaccctgct

SEQ ID NO: 355586 - DNA, 16 bp, M. musculus
agagacagagaaactg

SEQ ID NO: 355587 - DNA, 16 bp, M. musculus
agagacagagacacag

SEQ ID NO: 355588 - DNA, 17 bp, M. musculus
agagacagagacagaga

SEQ ID NO: 355589 - DNA, 16 bp, M. musculus
agagacagagacaggc

SEQ ID NO: 355590 - DNA, 16 bp, M. musculus
agagacagagactgaa

SEQ ID NO: 355591 - DNA, 16 bp, M. musculus
agagacagaggacaca

SEQ ID NO: 355592 - DNA, 16 bp, M. musculus
agagacagaggcagag

SEQ ID NO: 355593 - DNA, 16 bp, M. musculus
agagacagaggggatg

SEQ ID NO: 355594 - DNA, 16 bp, M. musculus
agagacagcatcctaa

SEQ ID NO: 355595 - DNA, 16 bp, M. musculus
agagacagccacatct

SEQ ID NO: 355596 - DNA, 16 bp, M. musculus
agagacagccagacct

SEQ ID NO: 355597 - DNA, 16 bp, M. musculus
agagacagccaggcct

SEQ ID NO: 355598 - DNA, 16 bp, M. musculus
agagacagcccagctg

SEQ ID NO: 355599 - DNA, 16 bp, M. musculus
agagacagcccttgct

SEQ ID NO: 355600 - DNA, 16 bp, M. musculus
agagacagcctctgct

SEQ ID NO: 355601 - DNA, 16 bp, M. musculus
agagacagctagctat

SEQ ID NO: 355602 - DNA, 16 bp, M. musculus
agagacagctcagctg

SEQ ID NO: 355603 - DNA, 16 bp, M. musculus
agagacagctctgggg

SEQ ID NO: 355604 - DNA, 16 bp, M. musculus
agagacagctgactgc

SEQ ID NO: 355605 - DNA, 16 bp, M. musculus
agagacagctgcctac

SEQ ID NO: 355606 - DNA, 16 bp, M. musculus
agagacaggaacagag

SEQ ID NO: 355607 - DNA, 16 bp, M. musculus
agagacaggaaggcag

SEQ ID NO: 355608 - DNA, 16 bp, M. musculus
agagacaggacagaga

SEQ ID NO: 355609 - DNA, 16 bp, M. musculus
agagacaggagacaga

SEQ ID NO: 355610 - DNA, 16 bp, M. musculus
agagacaggagcctag

SEQ ID NO: 355611 - DNA, 16 bp, M. musculus
agagacaggaggagcc

SEQ ID NO: 355612 - DNA, 16 bp, M. musculus
agagacaggaggatca

SEQ ID NO: 355613 - DNA, 16 bp, M. musculus
agagacaggaggatct

SEQ ID NO: 355614 - DNA, 16 bp, M. musculus
agagacaggcaaatct

SEQ ID NO: 355615 - DNA, 16 bp, M. musculus
agagacaggcacagag

SEQ ID NO: 355616 - DNA, 16 bp, M. musculus
agagacaggcagacct

SEQ ID NO: 355617 - DNA, 16 bp, M. musculus
agagacaggcagaggc

SEQ ID NO: 355618 - DNA, 16 bp, M. musculus
agagacaggcaggtgg

SEQ ID NO: 355619 - DNA, 16 bp, M. musculus
agagacaggcaggttg

SEQ ID NO: 355620 - DNA, 16 bp, M. musculus
agagacaggctttgag

SEQ ID NO: 355621 - DNA, 16 bp, M. musculus
agagacaggtaaatct

SEQ ID NO: 355622 - DNA, 16 bp, M. musculus
agagacaggtggatcc

SEQ ID NO: 355623 - DNA, 16 bp, M. musculus
agagacaggtgggtcc

SEQ ID NO: 355624 - DNA, 16 bp, M. musculus
agagacagtaacagaa

SEQ ID NO: 355625 - DNA, 19 bp, M. musculus
agagacagtgggaagcagt

SEQ ID NO: 355626 - DNA, 16 bp, M. musculus
agagacagtgtttctc

SEQ ID NO: 355627 - DNA, 16 bp, M. musculus
agagacatctggaaga

SEQ ID NO: 355628 - DNA, 16 bp, M. musculus
agagacatgagctggg

SEQ ID NO: 355629 - DNA, 16 bp, M. musculus
agagacatgagctttg

SEQ ID NO: 355630 - DNA, 16 bp, M. musculus
agagacatggagagag

SEQ ID NO: 355631 - DNA, 16 bp, M. musculus
agagacatggctcagc

SEQ ID NO: 355632 - DNA, 16 bp, M. musculus
agagacattccataag

SEQ ID NO: 355633 - DNA, 16 bp, M. musculus
agagacattgtctcaa

SEQ ID NO: 355634 - DNA, 16 bp, M. musculus
agagacattttctcag

SEQ ID NO: 355635 - DNA, 16 bp, M. musculus
agagaccaacactgag

SEQ ID NO: 355636 - DNA, 16 bp, M. musculus
agagaccacagagaaa

SEQ ID NO: 355637 - DNA, 16 bp, M. musculus
agagaccacagaggag

SEQ ID NO: 355638 - DNA, 16 bp, M. musculus
agagaccacctgtcct

SEQ ID NO: 355639 - DNA, 16 bp, M. musculus
agagaccagaaccact

SEQ ID NO: 355640 - DNA, 16 bp, M. musculus
agagaccagagagaga

SEQ ID NO: 355641 - DNA, 16 bp, M. musculus
agagaccagcctgcct

SEQ ID NO: 355642 - DNA, 17 bp, M. musculus
agagaccaggagtctct

SEQ ID NO: 355643 - DNA, 16 bp, M. musculus
agagaccatcttgatg

SEQ ID NO: 355644 - DNA, 16 bp, M. musculus
agagaccatgaaaggg

SEQ ID NO: 355645 - DNA, 16 bp, M. musculus
agagaccatgaaggaa

SEQ ID NO: 355646 - DNA, 16 bp, M. musculus
agagaccatggagaaa

SEQ ID NO: 355647 - DNA, 16 bp, M. musculus
agagaccatgtctcaa

SEQ ID NO: 355648 - DNA, 16 bp, M. musculus
agagacccacaactga

SEQ ID NO: 355649 - DNA, 16 bp, M. musculus
agagacccagagagag

SEQ ID NO: 355650 - DNA, 16 bp, M. musculus
agagacccagtctcaa

SEQ ID NO: 355651 - DNA, 32 bp, M. musculus
agagacccatggggtggttgctctaaccaaag

SEQ ID NO: 355652 - DNA, 16 bp, M. musculus
agagaccccaagccca

SEQ ID NO: 355653 - DNA, 16 bp, M. musculus
agagaccccaatggag

SEQ ID NO: 355654 - DNA, 16 bp, M. musculus
agagaccctatctcag

SEQ ID NO: 355655 - DNA, 16 bp, M. musculus
agagaccctcaggact

SEQ ID NO: 355656 - DNA, 16 bp, M. musculus
agagaccctgactcag

SEQ ID NO: 355657 - DNA, 16 bp, M. musculus
agagaccctgcctcaa

SEQ ID NO: 355658 - DNA, 16 bp, M. musculus
agagaccctgtctcaa

SEQ ID NO: 355659 - DNA, 16 bp, M. musculus
agagaccctgtctcca

SEQ ID NO: 355660 - DNA, 16 bp, M. musculus
agagaccctgtcttaa

SEQ ID NO: 355661 - DNA, 16 bp, M. musculus
agagaccctttctcaa

SEQ ID NO: 355662 - DNA, 19 bp, M. musculus
agagacctaaccttaaatt

SEQ ID NO: 355663 - DNA, 16 bp, M. musculus
agagacctcaggagtc

SEQ ID NO: 355664 - DNA, 16 bp, M. musculus
agagacctgactcctg

SEQ ID NO: 355665 - DNA, 16 bp, M. musculus
agagacctggaggcag

SEQ ID NO: 355666 - DNA, 16 bp, M. musculus
agagacctgtttcctt

SEQ ID NO: 355667 - DNA, 16 bp, M. musculus
agagaccttatctcaa

SEQ ID NO: 355668 - DNA, 16 bp, M. musculus
agagaccttcctccta

SEQ ID NO: 355669 - DNA, 16 bp, M. musculus
agagaccttctgaggc

SEQ ID NO: 355670 - DNA, 16 bp, M. musculus
agagacggagacagag

SEQ ID NO: 355671 - DNA, 16 bp, M. musculus
agagacggagacggag

SEQ ID NO: 355672 - DNA, 16 bp, M. musculus
agagactaaaccacca

SEQ ID NO: 355673 - DNA, 16 bp, M. musculus
agagactaaagcagca

SEQ ID NO: 355674 - DNA, 16 bp, M. musculus
agagactaaatcacca

SEQ ID NO: 355675 - DNA, 16 bp, M. musculus
agagactcagagagag

SEQ ID NO: 355676 - DNA, 16 bp, M. musculus
agagactctgcctcag

SEQ ID NO: 355677 - DNA, 16 bp, M. musculus
agagactctgtttcaa

SEQ ID NO: 355678 - DNA, 16 bp, M. musculus
agagactgaaaaaaag

SEQ ID NO: 355679 - DNA, 16 bp, M. musculus
agagactgaaccacca

SEQ ID NO: 355680 - DNA, 16 bp, M. musculus
agagactgaaccatca

SEQ ID NO: 355681 - DNA, 16 bp, M. musculus
agagactgaagagaag

SEQ ID NO: 355682 - DNA, 16 bp, M. musculus
agagactgaagggaag

SEQ ID NO: 355683 - DNA, 16 bp, M. musculus
agagactgagaaggag

SEQ ID NO: 355684 - DNA, 16 bp, M. musculus
agagactgcaccaccc

SEQ ID NO: 355685 - DNA, 16 bp, M. musculus
agagactgcccacctg

SEQ ID NO: 355686 - DNA, 16 bp, M. musculus
agagactgccccacca

SEQ ID NO: 355687 - DNA, 16 bp, M. musculus
agagactgctcagcag

SEQ ID NO: 355688 - DNA, 16 bp, M. musculus
agagactggaagaggg

SEQ ID NO: 355689 - DNA, 16 bp, M. musculus
agagactggacagatg

SEQ ID NO: 355690 - DNA, 16 bp, M. musculus
agagactggagaaaag

SEQ ID NO: 355691 - DNA, 16 bp, M. musculus
agagactggagcagca

SEQ ID NO: 355692 - DNA, 16 bp, M. musculus
agagactggaggaaag

SEQ ID NO: 355693 - DNA, 16 bp, M. musculus
agagactggaggaccc

SEQ ID NO: 355694 - DNA, 16 bp, M. musculus
agagactggccttagc

SEQ ID NO: 355695 - DNA, 16 bp, M. musculus
agagactggggcagca

SEQ ID NO: 355696 - DNA, 16 bp, M. musculus
agagactgtcccactt

SEQ ID NO: 355697 - DNA, 16 bp, M. musculus
agagactgtctcaaaa

SEQ ID NO: 355698 - DNA, 16 bp, M. musculus
agagactgtgtttcat

SEQ ID NO: 355699 - DNA, 16 bp, M. musculus
agagacttcatcccag

SEQ ID NO: 355700 - DNA, 16 bp, M. musculus
agagacttgaagttct

SEQ ID NO: 355701 - DNA, 16 bp, M. musculus
agagacttgacatttt

SEQ ID NO: 355702 - DNA, 16 bp, M. musculus
agagacttgaggcctc

SEQ ID NO: 355703 - DNA, 16 bp, M. musculus
agagacttgcagttct

SEQ ID NO: 355704 - DNA, 16 bp, M. musculus
agagactttgtttcaa

SEQ ID NO: 355705 - DNA, 16 bp, M. musculus
agagagaaaaatcaca

SEQ ID NO: 355706 - DNA, 16 bp, M. musculus
agagagaaaactggaa

SEQ ID NO: 355707 - DNA, 16 bp, M. musculus
agagagaaacacacac

SEQ ID NO: 355708 - DNA, 16 bp, M. musculus
agagagaaacatacca

SEQ ID NO: 355709 - DNA, 16 bp, M. musculus
agagagaaacttgaag

SEQ ID NO: 355710 - DNA, 16 bp, M. musculus
agagagaaagaaattt

SEQ ID NO: 355711 - DNA, 16 bp, M. musculus
agagagaaagactgag

SEQ ID NO: 355712 - DNA, 16 bp, M. musculus
agagagaaagagattt

SEQ ID NO: 355713 - DNA, 16 bp, M. musculus
agagagaaagcatgaa

SEQ ID NO: 355714 - DNA, 16 bp, M. musculus
agagagaaagtttgga

SEQ ID NO: 355715 - DNA, 16 bp, M. musculus
agagagaaatatatat

SEQ ID NO: 355716 - DNA, 16 bp, M. musculus
agagagaaatgttgta

SEQ ID NO: 355717 - DNA, 16 bp, M. musculus
agagagaacaaactgg

SEQ ID NO: 355718 - DNA, 16 bp, M. musculus
agagagaacacaaaat

SEQ ID NO: 355719 - DNA, 16 bp, M. musculus
agagagaacctgtctc

SEQ ID NO: 355720 - DNA, 16 bp, M. musculus
agagagaagagagtca

SEQ ID NO: 355721 - DNA, 16 bp, M. musculus
agagagaagcaggcag

SEQ ID NO: 355722 - DNA, 16 bp, M. musculus
agagagaaggaagcca

SEQ ID NO: 355723 - DNA, 16 bp, M. musculus
agagagaaggaggact

SEQ ID NO: 355724 - DNA, 16 bp, M. musculus
agagagaagggagcct

SEQ ID NO: 355725 - DNA, 16 bp, M. musculus
agagagaatgaacaga

SEQ ID NO: 355726 - DNA, 16 bp, M. musculus
agagagaatgaattag

SEQ ID NO: 355727 - DNA, 16 bp, M. musculus
agagagaatgtgtgta

SEQ ID NO: 355728 - DNA, 16 bp, M. musculus
agagagaatgtgtgtt

SEQ ID NO: 355729 - DNA, 16 bp, M. musculus
agagagacagaaaata

SEQ ID NO: 355730 - DNA, 16 bp, M. musculus
agagagacagagagac

SEQ ID NO: 355731 - DNA, 17 bp, M. musculus
agagagacagagagaca

SEQ ID NO: 355732 - DNA, 16 bp, M. musculus
agagagacagagcaga

SEQ ID NO: 355733 - DNA, 16 bp, M. musculus
agagagacagaggaca

SEQ ID NO: 355734 - DNA, 16 bp, M. musculus
agagagacagtgaaag

SEQ ID NO: 355735 - DNA, 16 bp, M. musculus
agagagacagtgacag

SEQ ID NO: 355736 - DNA, 16 bp, M. musculus
agagagacccagtctc

SEQ ID NO: 355737 - DNA, 16 bp, M. musculus
agagagaccctgactc

SEQ ID NO: 355738 - DNA, 16 bp, M. musculus
agagagaccctgtcta

SEQ ID NO: 355739 - DNA, 16 bp, M. musculus
agagagaccttggaac

SEQ ID NO: 355740 - DNA, 16 bp, M. musculus
agagagacgcagagag

SEQ ID NO: 355741 - DNA, 16 bp, M. musculus
agagagactccaggaa

SEQ ID NO: 355742 - DNA, 16 bp, M. musculus
agagagactctgtgtg

SEQ ID NO: 355743 - DNA, 16 bp, M. musculus
agagagactgaagcag

SEQ ID NO: 355744 - DNA, 16 bp, M. musculus
agagagacttgaagca

SEQ ID NO: 355745 - DNA, 16 bp, M. musculus
agagagagaaaatcaa

SEQ ID NO: 355746 - DNA, 16 bp, M. musculus
agagagagaaaccagg

SEQ ID NO: 355747 - DNA, 16 bp, M. musculus
agagagagaaactttg

SEQ ID NO: 355748 - DNA, 16 bp, M. musculus
agagagagaacaagct

SEQ ID NO: 355749 - DNA, 16 bp, M. musculus
agagagagaacacatt

SEQ ID NO: 355750 - DNA, 16 bp, M. musculus
agagagagaagattca

SEQ ID NO: 355751 - DNA, 16 bp, M. musculus
agagagagaagcacag

SEQ ID NO: 355752 - DNA, 16 bp, M. musculus
agagagagaatattaa

SEQ ID NO: 355753 - DNA, 16 bp, M. musculus
agagagagaatgcaca

SEQ ID NO: 355754 - DNA, 16 bp, M. musculus
agagagagaatgcaga

SEQ ID NO: 355755 - DNA, 16 bp, M. musculus
agagagagaatgtgag

SEQ ID NO: 355756 - DNA, 16 bp, M. musculus
agagagagacagcaag

SEQ ID NO: 355757 - DNA, 16 bp, M. musculus
agagagagacaggcag

SEQ ID NO: 355758 - DNA, 16 bp, M. musculus
agagagagaccaagag

SEQ ID NO: 355759 - DNA, 16 bp, M. musculus
agagagagaccctatc

SEQ ID NO: 355760 - DNA, 16 bp, M. musculus
agagagagaccctgcc

SEQ ID NO: 355761 - DNA, 16 bp, M. musculus
agagagagactgactt

SEQ ID NO: 355762 - DNA, 16 bp, M. musculus
agagagagagaaacta

SEQ ID NO: 355763 - DNA, 16 bp, M. musculus
agagagagagaacaat

SEQ ID NO: 355764 - DNA, 16 bp, M. musculus
agagagagagaacctc

SEQ ID NO: 355765 - DNA, 16 bp, M. musculus
agagagagagaacctg

SEQ ID NO: 355766 - DNA, 16 bp, M. musculus
agagagagagaactta

SEQ ID NO: 355767 - DNA, 16 bp, M. musculus
agagagagagaagacc

SEQ ID NO: 355768 - DNA, 16 bp, M. musculus
agagagagagaagtta

SEQ ID NO: 355769 - DNA, 16 bp, M. musculus
agagagagagaattca

SEQ ID NO: 355770 - DNA, 16 bp, M. musculus
agagagagagaattta

SEQ ID NO: 355771 - DNA, 16 bp, M. musculus
agagagagagaccaca

SEQ ID NO: 355772 - DNA, 16 bp, M. musculus
agagagagagaccatt

SEQ ID NO: 355773 - DNA, 16 bp, M. musculus
agagagagagacccag

SEQ ID NO: 355774 - DNA, 16 bp, M. musculus
agagagagagacctcc

SEQ ID NO: 355775 - DNA, 16 bp, M. musculus
agagagagagaccttt

SEQ ID NO: 355776 - DNA, 16 bp, M. musculus
agagagagagactaac

SEQ ID NO: 355777 - DNA, 16 bp, M. musculus
agagagagagactggt

SEQ ID NO: 355778 - DNA, 16 bp, M. musculus
agagagagagacttta

SEQ ID NO: 355779 - DNA, 16 bp, M. musculus
agagagagagagacac

SEQ ID NO: 355780 - DNA, 16 bp, M. musculus
agagagagagagacat

SEQ ID NO: 355781 - DNA, 16 bp, M. musculus
agagagagagagacca

SEQ ID NO: 355782 - DNA, 16 bp, M. musculus
agagagagagagactg

SEQ ID NO: 355783 - DNA, 16 bp, M. musculus
agagagagagagagtt

SEQ ID NO: 355784 - DNA, 16 bp, M. musculus
agagagagagagatgt

SEQ ID NO: 355785 - DNA, 16 bp, M. musculus
agagagagagagcaac

SEQ ID NO: 355786 - DNA, 16 bp, M. musculus
agagagagagagcaat

SEQ ID NO: 355787 - DNA, 16 bp, M. musculus
agagagagagagcccc

SEQ ID NO: 355788 - DNA, 16 bp, M. musculus
agagagagagagcctt

SEQ ID NO: 355789 - DNA, 16 bp, M. musculus
agagagagagagcgct

SEQ ID NO: 355790 - DNA, 16 bp, M. musculus
agagagagagagctct

SEQ ID NO: 355791 - DNA, 16 bp, M. musculus
agagagagagaggttt

SEQ ID NO: 355792 - DNA, 16 bp, M. musculus
agagagagagagtctc

SEQ ID NO: 355793 - DNA, 16 bp, M. musculus
agagagagagagtttc

SEQ ID NO: 355794 - DNA, 16 bp, M. musculus
agagagagagatccat

SEQ ID NO: 355795 - DNA, 16 bp, M. musculus
agagagagagatcctg

SEQ ID NO: 355796 - DNA, 16 bp, M. musculus
agagagagagatctgg

SEQ ID NO: 355797 - DNA, 16 bp, M. musculus
agagagagagatgatg

SEQ ID NO: 355798 - DNA, 16 bp, M. musculus
agagagagagatgcac

SEQ ID NO: 355799 - DNA, 16 bp, M. musculus
agagagagagatgtga

SEQ ID NO: 355800 - DNA, 16 bp, M. musculus
agagagagagattcat

SEQ ID NO: 355801 - DNA, 16 bp, M. musculus
agagagagagatttga

SEQ ID NO: 355802 - DNA, 16 bp, M. musculus
agagagagagcagtga

SEQ ID NO: 355803 - DNA, 16 bp, M. musculus
agagagagagcatggg

SEQ ID NO: 355804 - DNA, 16 bp, M. musculus
agagagagagccactg

SEQ ID NO: 355805 - DNA, 16 bp, M. musculus
agagagagagcctgcc

SEQ ID NO: 355806 - DNA, 16 bp, M. musculus
agagagagagcctgtg

SEQ ID NO: 355807 - DNA, 16 bp, M. musculus
agagagagagcgagca

SEQ ID NO: 355808 - DNA, 16 bp, M. musculus
agagagagagctagag

SEQ ID NO: 355809 - DNA, 16 bp, M. musculus
agagagagagctcaga

SEQ ID NO: 355810 - DNA, 16 bp, M. musculus
agagagagagctgtct

SEQ ID NO: 355811 - DNA, 16 bp, M. musculus
agagagagaggaactc

SEQ ID NO: 355812 - DNA, 16 bp, M. musculus
agagagagaggaagcc

SEQ ID NO: 355813 - DNA, 16 bp, M. musculus
agagagagaggattct

SEQ ID NO: 355814 - DNA, 16 bp, M. musculus
agagagagaggccagc

SEQ ID NO: 355815 - DNA, 16 bp, M. musculus
agagagagaggctaga

SEQ ID NO: 355816 - DNA, 16 bp, M. musculus
agagagagaggtgttc

SEQ ID NO: 355817 - DNA, 16 bp, M. musculus
agagagagaggtttct

SEQ ID NO: 355818 - DNA, 16 bp, M. musculus
agagagagagtcagtc

SEQ ID NO: 355819 - DNA, 16 bp, M. musculus
agagagagatcaagga

SEQ ID NO: 355820 - DNA, 16 bp, M. musculus
agagagagatcagaga

SEQ ID NO: 355821 - DNA, 16 bp, M. musculus
agagagagatccagga

SEQ ID NO: 355822 - DNA, 16 bp, M. musculus
agagagagatctgtgt

SEQ ID NO: 355823 - DNA, 16 bp, M. musculus
agagagagatgtgtga

SEQ ID NO: 355824 - DNA, 16 bp, M. musculus
agagagagattaaaat

SEQ ID NO: 355825 - DNA, 16 bp, M. musculus
agagagagattaaata

SEQ ID NO: 355826 - DNA, 16 bp, M. musculus
agagagagattgtttt

SEQ ID NO: 355827 - DNA, 16 bp, M. musculus
agagagagattttttt

SEQ ID NO: 355828 - DNA, 16 bp, M. musculus
agagagagcaagcaag

SEQ ID NO: 355829 - DNA, 16 bp, M. musculus
agagagagcaagctag

SEQ ID NO: 355830 - DNA, 16 bp, M. musculus
agagagagcacacttt

SEQ ID NO: 355831 - DNA, 16 bp, M. musculus
agagagagcaggagca

SEQ ID NO: 355832 - DNA, 16 bp, M. musculus
agagagagcgagagca

SEQ ID NO: 355833 - DNA, 16 bp, M. musculus
agagagaggaagactg

SEQ ID NO: 355834 - DNA, 16 bp, M. musculus
agagagaggcagacag

SEQ ID NO: 355835 - DNA, 16 bp, M. musculus
agagagaggcaggcag

SEQ ID NO: 355836 - DNA, 16 bp, M. musculus
agagagaggctgaggc

SEQ ID NO: 355837 - DNA, 16 bp, M. musculus
agagagagggtgtgtg

SEQ ID NO: 355838 - DNA, 16 bp, M. musculus
agagagagtgagagat

SEQ ID NO: 355839 - DNA, 16 bp, M. musculus
agagagagtgagagca

SEQ ID NO: 355840 - DNA, 16 bp, M. musculus
agagagagtgggcagc

SEQ ID NO: 355841 - DNA, 16 bp, M. musculus
agagagagtggggact

SEQ ID NO: 355842 - DNA, 16 bp, M. musculus
agagagagtgtgtgta

SEQ ID NO: 355843 - DNA, 16 bp, M. musculus
agagagagtgtgtgtc

SEQ ID NO: 355844 - DNA, 16 bp, M. musculus
agagagagttccaaga

SEQ ID NO: 355845 - DNA, 16 bp, M. musculus
agagagagtttttaaa

SEQ ID NO: 355846 - DNA, 16 bp, M. musculus
agagagataagaatgg

SEQ ID NO: 355847 - DNA, 16 bp, M. musculus
agagagatacagaaag

SEQ ID NO: 355848 - DNA, 16 bp, M. musculus
agagagatagagagat

SEQ ID NO: 355849 - DNA, 16 bp, M. musculus
agagagatcaagagag

SEQ ID NO: 355850 - DNA, 16 bp, M. musculus
agagagatcagagaga

SEQ ID NO: 355851 - DNA, 16 bp, M. musculus
agagagatcctgtttc

SEQ ID NO: 355852 - DNA, 16 bp, M. musculus
agagagatgaacctgg

SEQ ID NO: 355853 - DNA, 17 bp, M. musculus
agagagatgaagactga

SEQ ID NO: 355854 - DNA, 16 bp, M. musculus
agagagatgatagata

SEQ ID NO: 355855 - DNA, 16 bp, M. musculus
agagagatgatgatga

SEQ ID NO: 355856 - DNA, 16 bp, M. musculus
agagagatgattcagt

SEQ ID NO: 355857 - DNA, 16 bp, M. musculus
agagagatgcacagag

SEQ ID NO: 355858 - DNA, 16 bp, M. musculus
agagagatggcccaga

SEQ ID NO: 355859 - DNA, 16 bp, M. musculus
agagagatggctcaat

SEQ ID NO: 355860 - DNA, 16 bp, M. musculus
agagagatggctcagc

SEQ ID NO: 355861 - DNA, 16 bp, M. musculus
agagagattgaaagag

SEQ ID NO: 355862 - DNA, 16 bp, M. musculus
agagagatttttaaaa

SEQ ID NO: 355863 - DNA, 16 bp, M. musculus
agagagcaaactggaa

SEQ ID NO: 355864 - DNA, 16 bp, M. musculus
agagagcaacagtgtg

SEQ ID NO: 355865 - DNA, 16 bp, M. musculus
agagagcaagaatgag

SEQ ID NO: 355866 - DNA, 16 bp, M. musculus
agagagcaagacagag

SEQ ID NO: 355867 - DNA, 17 bp, M. musculus
agagagcaagagcgcaa

SEQ ID NO: 355868 - DNA, 16 bp, M. musculus
agagagcaagccagca

SEQ ID NO: 355869 - DNA, 16 bp, M. musculus
agagagcaatggtgaa

SEQ ID NO: 355870 - DNA, 16 bp, M. musculus
agagagcacagagaca

SEQ ID NO: 355871 - DNA, 16 bp, M. musculus
agagagcacatactag

SEQ ID NO: 355872 - DNA, 16 bp, M. musculus
agagagcacctgtctg

SEQ ID NO: 355873 - DNA, 16 bp, M. musculus
agagagcagacaggaa

SEQ ID NO: 355874 - DNA, 16 bp, M. musculus
agagagcagagaagca

SEQ ID NO: 355875 - DNA, 16 bp, M. musculus
agagagcagagaatga

SEQ ID NO: 355876 - DNA, 16 bp, M. musculus
agagagcagagagcag

SEQ ID NO: 355877 - DNA, 16 bp, M. musculus
agagagcagagctgag

SEQ ID NO: 355878 - DNA, 16 bp, M. musculus
agagagcagagggagc

SEQ ID NO: 355879 - DNA, 16 bp, M. musculus
agagagcagaggtcct

SEQ ID NO: 355880 - DNA, 16 bp, M. musculus
agagagcagcacagag

SEQ ID NO: 355881 - DNA, 16 bp, M. musculus
agagagcagcctgagc

SEQ ID NO: 355882 - DNA, 16 bp, M. musculus
agagagcaggaagtga

SEQ ID NO: 355883 - DNA, 16 bp, M. musculus
agagagcaggaggcag

SEQ ID NO: 355884 - DNA, 16 bp, M. musculus
agagagcatcagaccc

SEQ ID NO: 355885 - DNA, 18 bp, M. musculus
agagagcatcagatccca

SEQ ID NO: 355886 - DNA, 16 bp, M. musculus
agagagcatgccccag

SEQ ID NO: 355887 - DNA, 16 bp, M. musculus
agagagcatttgacaa

SEQ ID NO: 355888 - DNA, 16 bp, M. musculus
agagagccacacaaac

SEQ ID NO: 355889 - DNA, 16 bp, M. musculus
agagagccacagagct

SEQ ID NO: 355890 - DNA, 16 bp, M. musculus
agagagccagagagct

SEQ ID NO: 355891 - DNA, 16 bp, M. musculus
agagagcccaggagag

SEQ ID NO: 355892 - DNA, 16 bp, M. musculus
agagagcgagagacag

SEQ ID NO: 355893 - DNA, 16 bp, M. musculus
agagagcgagcgagca

SEQ ID NO: 355894 - DNA, 16 bp, M. musculus
agagagctcacaaaaa

SEQ ID NO: 355895 - DNA, 16 bp, M. musculus
agagagctccagaaca

SEQ ID NO: 355896 - DNA, 16 bp, M. musculus
agagagctggctgcag

SEQ ID NO: 355897 - DNA, 16 bp, M. musculus
agagagctggtctcct

SEQ ID NO: 355898 - DNA, 16 bp, M. musculus
agagagctgtatcagg

SEQ ID NO: 355899 - DNA, 16 bp, M. musculus
agagagctgtctcaag

SEQ ID NO: 355900 - DNA, 16 bp, M. musculus
agagagcttgcctagc

SEQ ID NO: 355901 - DNA, 16 bp, M. musculus
agagaggactttaaga

SEQ ID NO: 355902 - DNA, 16 bp, M. musculus
agagaggagacagtga

SEQ ID NO: 355903 - DNA, 16 bp, M. musculus
agagaggagctagaga

SEQ ID NO: 355904 - DNA, 16 bp, M. musculus
agagaggagctgggag

SEQ ID NO: 355905 - DNA, 16 bp, M. musculus
agagaggaggctgagc

SEQ ID NO: 355906 - DNA, 16 bp, M. musculus
agagaggagggagcct

SEQ ID NO: 355907 - DNA, 16 bp, M. musculus
agagaggattctggga

SEQ ID NO: 355908 - DNA, 16 bp, M. musculus
agagaggcacagcaga

SEQ ID NO: 355909 - DNA, 16 bp, M. musculus
agagaggcagaactag

SEQ ID NO: 355910 - DNA, 16 bp, M. musculus
agagaggcagagaagc

SEQ ID NO: 355911 - DNA, 16 bp, M. musculus
agagaggcagagaggc

SEQ ID NO: 355912 - DNA, 16 bp, M. musculus
agagaggcaggagaca

SEQ ID NO: 355913 - DNA, 16 bp, M. musculus
agagaggcaggaggat

SEQ ID NO: 355914 - DNA, 16 bp, M. musculus
agagaggccagaagag

SEQ ID NO: 355915 - DNA, 16 bp, M. musculus
agagaggccagccatg

SEQ ID NO: 355916 - DNA, 16 bp, M. musculus
agagaggcccagagag

SEQ ID NO: 355917 - DNA, 16 bp, M. musculus
agagaggccctttgga

SEQ ID NO: 355918 - DNA, 16 bp, M. musculus
agagaggctgaggcag

SEQ ID NO: 355919 - DNA, 16 bp, M. musculus
agagagggcccttggt

SEQ ID NO: 355920 - DNA, 16 bp, M. musculus
agagaggggaacatga

SEQ ID NO: 355921 - DNA, 16 bp, M. musculus
agagagggtctcacta

SEQ ID NO: 355922 - DNA, 16 bp, M. musculus
agagaggtcagaagag

SEQ ID NO: 355923 - DNA, 16 bp, M. musculus
agagaggtggaggcag

SEQ ID NO: 355924 - DNA, 16 bp, M. musculus
agagaggtggctcagt

SEQ ID NO: 355925 - DNA, 16 bp, M. musculus
agagaggttgagagag

SEQ ID NO: 355926 - DNA, 16 bp, M. musculus
agagaggttgtaccag

SEQ ID NO: 355927 - DNA, 16 bp, M. musculus
agagagtaaatatttt

SEQ ID NO: 355928 - DNA, 16 bp, M. musculus
agagagtaagaaagct

SEQ ID NO: 355929 - DNA, 16 bp, M. musculus
agagagtagatatctg

SEQ ID NO: 355930 - DNA, 16 bp, M. musculus
agagagtcaccagaga

SEQ ID NO: 355931 - DNA, 16 bp, M. musculus
agagagtcagaaacag

SEQ ID NO: 355932 - DNA, 16 bp, M. musculus
agagagtcagagaaag

SEQ ID NO: 355933 - DNA, 16 bp, M. musculus
agagagtcagagagag

SEQ ID NO: 355934 - DNA, 16 bp, M. musculus
agagagtgaaaaatta

SEQ ID NO: 355935 - DNA, 16 bp, M. musculus
agagagtgaaggaatg

SEQ ID NO: 355936 - DNA, 16 bp, M. musculus
agagagtgacagacag

SEQ ID NO: 355937 - DNA, 16 bp, M. musculus
agagagtgagagaatg

SEQ ID NO: 355938 - DNA, 16 bp, M. musculus
agagagtgagtgagtg

SEQ ID NO: 355939 - DNA, 16 bp, M. musculus
agagagtgatagagaa

SEQ ID NO: 355940 - DNA, 16 bp, M. musculus
agagagtggacatcct

SEQ ID NO: 355941 - DNA, 16 bp, M. musculus
agagagtggatagcct

SEQ ID NO: 355942 - DNA, 16 bp, M. musculus
agagagtggcattatt

SEQ ID NO: 355943 - DNA, 16 bp, M. musculus
agagagtgtgtgagag

SEQ ID NO: 355944 - DNA, 16 bp, M. musculus
agagagtgttccagga

SEQ ID NO: 355945 - DNA, 16 bp, M. musculus
agagagttacaggaaa

SEQ ID NO: 355946 - DNA, 16 bp, M. musculus
agagagttctacatct

SEQ ID NO: 355947 - DNA, 16 bp, M. musculus
agagagttctcaacag

SEQ ID NO: 355948 - DNA, 16 bp, M. musculus
agagagttgttcagtt

SEQ ID NO: 355949 - DNA, 16 bp, M. musculus
agagatacagagaaag

SEQ ID NO: 355950 - DNA, 16 bp, M. musculus
agagatactgtctcaa

SEQ ID NO: 355951 - DNA, 16 bp, M. musculus
agagatagaaatggat

SEQ ID NO: 355952 - DNA, 16 bp, M. musculus
agagatagaagtgaga

SEQ ID NO: 355953 - DNA, 16 bp, M. musculus
agagatagacagagaa

SEQ ID NO: 355954 - DNA, 16 bp, M. musculus
agagatagagaaacag

SEQ ID NO: 355955 - DNA, 16 bp, M. musculus
agagatagagagacag

SEQ ID NO: 355956 - DNA, 16 bp, M. musculus
agagatagagagatgg

SEQ ID NO: 355957 - DNA, 19 bp, M. musculus
agagatagccaaggttgta

SEQ ID NO: 355958 - DNA, 16 bp, M. musculus
agagatagctcagttg

SEQ ID NO: 355959 - DNA, 16 bp, M. musculus
agagatattaaagaga

SEQ ID NO: 355960 - DNA, 16 bp, M. musculus
agagatcaacctgctt

SEQ ID NO: 355961 - DNA, 16 bp, M. musculus
agagatcagaggacaa

SEQ ID NO: 355962 - DNA, 16 bp, M. musculus
agagatcagcctgcct

SEQ ID NO: 355963 - DNA, 17 bp, M. musculus
agagatcatggccatca

SEQ ID NO: 355964 - DNA, 16 bp, M. musculus
agagatccaccttcct

SEQ ID NO: 355965 - DNA, 16 bp, M. musculus
agagatccctgctgcc

SEQ ID NO: 355966 - DNA, 16 bp, M. musculus
agagatcctatctcaa

SEQ ID NO: 355967 - DNA, 16 bp, M. musculus
agagatcctgtctaaa

SEQ ID NO: 355968 - DNA, 17 bp, M. musculus
agagatcctgtctcaaa

SEQ ID NO: 355969 - DNA, 16 bp, M. musculus
agagatcctgtctcca

SEQ ID NO: 355970 - DNA, 16 bp, M. musculus
agagatctacctgtct

SEQ ID NO: 355971 - DNA, 16 bp, M. musculus
agagatctacttgcct

SEQ ID NO: 355972 - DNA, 16 bp, M. musculus
agagatctcaggggtc

SEQ ID NO: 355973 - DNA, 24 bp, M. musculus
agagatctccttaaacaggcagaa

SEQ ID NO: 355974 - DNA, 16 bp, M. musculus
agagatctccttgagc

SEQ ID NO: 355975 - DNA, 16 bp, M. musculus
agagatctccttgtct

SEQ ID NO: 355976 - DNA, 16 bp, M. musculus
agagatctgcccgcct

SEQ ID NO: 355977 - DNA, 16 bp, M. musculus
agagatctgcctattt

SEQ ID NO: 355978 - DNA, 16 bp, M. musculus
agagatctgcctgtct

SEQ ID NO: 355979 - DNA, 16 bp, M. musculus
agagatctgccttcct

SEQ ID NO: 355980 - DNA, 16 bp, M. musculus
agagatctgcttgcct

SEQ ID NO: 355981 - DNA, 16 bp, M. musculus
agagatctgtctctgc

SEQ ID NO: 355982 - DNA, 16 bp, M. musculus
agagatgaaaccaaga

SEQ ID NO: 355983 - DNA, 31 bp, M. musculus
agagatgaacaagacagtatgttggataaat

SEQ ID NO: 355984 - DNA, 16 bp, M. musculus
agagatgaagagatgg

SEQ ID NO: 355985 - DNA, 16 bp, M. musculus
agagatgactgtgagc

SEQ ID NO: 355986 - DNA, 16 bp, M. musculus
agagatgacttggtgg

SEQ ID NO: 355987 - DNA, 16 bp, M. musculus
agagatgagacagaga

SEQ ID NO: 355988 - DNA, 16 bp, M. musculus
agagatgagagagatg

SEQ ID NO: 355989 - DNA, 16 bp, M. musculus
agagatgaggaaggca

SEQ ID NO: 355990 - DNA, 16 bp, M. musculus
agagatgaggacagag

SEQ ID NO: 355991 - DNA, 16 bp, M. musculus
agagatgatgtaccta

SEQ ID NO: 355992 - DNA, 16 bp, M. musculus
agagatgatttaaagt

SEQ ID NO: 355993 - DNA, 16 bp, M. musculus
agagatgcagagtttg

SEQ ID NO: 355994 - DNA, 16 bp, M. musculus
agagatgcagggatgg

SEQ ID NO: 355995 - DNA, 17 bp, M. musculus
agagatgcccatgaaca

SEQ ID NO: 355996 - DNA, 16 bp, M. musculus
agagatgcccctgcct

SEQ ID NO: 355997 - DNA, 16 bp, M. musculus
agagatgctcctgcct

SEQ ID NO: 355998 - DNA, 16 bp, M. musculus
agagatgctgagagga

SEQ ID NO: 355999 - DNA, 16 bp, M. musculus
agagatgcttcagcag

SEQ ID NO: 356000 - DNA, 16 bp, M. musculus
agagatggaagagtga

SEQ ID NO: 356001 - DNA, 16 bp, M. musculus
agagatggaatctcag

SEQ ID NO: 356002 - DNA, 16 bp, M. musculus
agagatggagaagcag

SEQ ID NO: 356003 - DNA, 16 bp, M. musculus
agagatggagaagtga

SEQ ID NO: 356004 - DNA, 16 bp, M. musculus
agagatggagacaaag

SEQ ID NO: 356005 - DNA, 16 bp, M. musculus
agagatggagacagac

SEQ ID NO: 356006 - DNA, 16 bp, M. musculus
agagatggagagaatg

SEQ ID NO: 356007 - DNA, 16 bp, M. musculus
agagatggagagacag

SEQ ID NO: 356008 - DNA, 16 bp, M. musculus
agagatggagagatga

SEQ ID NO: 356009 - DNA, 16 bp, M. musculus
agagatggagatagag

SEQ ID NO: 356010 - DNA, 16 bp, M. musculus
agagatggagccacca

SEQ ID NO: 356011 - DNA, 16 bp, M. musculus
agagatggatagatga

SEQ ID NO: 356012 - DNA, 16 bp, M. musculus
agagatggatagccag

SEQ ID NO: 356013 - DNA, 16 bp, M. musculus
agagatggatgctcac

SEQ ID NO: 356014 - DNA, 16 bp, M. musculus
agagatggatggagag

SEQ ID NO: 356015 - DNA, 16 bp, M. musculus
agagatggcacagcag

SEQ ID NO: 356016 - DNA, 16 bp, M. musculus
agagatggcccagaag

SEQ ID NO: 356017 - DNA, 16 bp, M. musculus
agagatggcccagcaa

SEQ ID NO: 356018 - DNA, 16 bp, M. musculus
agagatggcccagcag

SEQ ID NO: 356019 - DNA, 16 bp, M. musculus
agagatggcccagcgg

SEQ ID NO: 356020 - DNA, 16 bp, M. musculus
agagatggctaagtag

SEQ ID NO: 356021 - DNA, 16 bp, M. musculus
agagatggctcaccag

SEQ ID NO: 356022 - DNA, 16 bp, M. musculus
agagatggctcagaag

SEQ ID NO: 356023 - DNA, 17 bp, M. musculus
agagatggctcagtggc

SEQ ID NO: 356024 - DNA, 18 bp, M. musculus
agagatggctcagtgggt

SEQ ID NO: 356025 - DNA, 16 bp, M. musculus
agagatggctcatcgg

SEQ ID NO: 356026 - DNA, 16 bp, M. musculus
agagatggctcggagg

SEQ ID NO: 356027 - DNA, 16 bp, M. musculus
agagatggctctgcag

SEQ ID NO: 356028 - DNA, 16 bp, M. musculus
agagatggctctgctg

SEQ ID NO: 356029 - DNA, 16 bp, M. musculus
agagatggctgagcag

SEQ ID NO: 356030 - DNA, 16 bp, M. musculus
agagatggcttaacag

SEQ ID NO: 356031 - DNA, 16 bp, M. musculus
agagatggcttagggg

SEQ ID NO: 356032 - DNA, 16 bp, M. musculus
agagatggcttagtag

SEQ ID NO: 356033 - DNA, 16 bp, M. musculus
agagatggctttgcag

SEQ ID NO: 356034 - DNA, 16 bp, M. musculus
agagatggggagcaag

SEQ ID NO: 356035 - DNA, 16 bp, M. musculus
agagatggggcagggg

SEQ ID NO: 356036 - DNA, 16 bp, M. musculus
agagatggtacagtgg

SEQ ID NO: 356037 - DNA, 16 bp, M. musculus
agagatggtgcagcag

SEQ ID NO: 356038 - DNA, 22 bp, M. musculus
agagatgtccatggctggtatt

SEQ ID NO: 356039 - DNA, 16 bp, M. musculus
agagatgtctcagagg

SEQ ID NO: 356040 - DNA, 16 bp, M. musculus
agagatgtgactgtga

SEQ ID NO: 356041 - DNA, 16 bp, M. musculus
agagatgtgttatcag

SEQ ID NO: 356042 - DNA, 16 bp, M. musculus
agagattcaactgcct

SEQ ID NO: 356043 - DNA, 16 bp, M. musculus
agagattcatgtgttt

SEQ ID NO: 356044 - DNA, 16 bp, M. musculus
agagattcctattgaa

SEQ ID NO: 356045 - DNA, 16 bp, M. musculus
agagattctcctgtct

SEQ ID NO: 356046 - DNA, 16 bp, M. musculus
agagattcttctgcct

SEQ ID NO: 356047 - DNA, 16 bp, M. musculus
agagattgctcagcag

SEQ ID NO: 356048 - DNA, 16 bp, M. musculus
agagattgggaaagga

SEQ ID NO: 356049 - DNA, 16 bp, M. musculus
agagattgtggagttc

SEQ ID NO: 356050 - DNA, 16 bp, M. musculus
agagatttacctgcct

SEQ ID NO: 356051 - DNA, 16 bp, M. musculus
agagatttcatactag

SEQ ID NO: 356052 - DNA, 16 bp, M. musculus
agagatttctaaagag

SEQ ID NO: 356053 - DNA, 16 bp, M. musculus
agagatttctttttta

SEQ ID NO: 356054 - DNA, 16 bp, M. musculus
agagatttgaagttct

SEQ ID NO: 356055 - DNA, 16 bp, M. musculus
agagatttgatggaga

SEQ ID NO: 356056 - DNA, 16 bp, M. musculus
agagatttggagagag

SEQ ID NO: 356057 - DNA, 16 bp, M. musculus
agagatttgtctgtct

SEQ ID NO: 356058 - DNA, 16 bp, M. musculus
agagatttgtttttat

SEQ ID NO: 356059 - DNA, 16 bp, M. musculus
agagattttggcatta

SEQ ID NO: 356060 - DNA, 16 bp, M. musculus
agagattttggtattt

SEQ ID NO: 356061 - DNA, 16 bp, M. musculus
agagatttttttctct

SEQ ID NO: 356062 - DNA, 16 bp, M. musculus
agagcaaacaggaagt

SEQ ID NO: 356063 - DNA, 36 bp, M. musculus
agagcaaagaaacacttgctagttggtaacactgtc

SEQ ID NO: 356064 - DNA, 16 bp, M. musculus
agagcaaaggccacac

SEQ ID NO: 356065 - DNA, 16 bp, M. musculus
agagcaacaaatgctc

SEQ ID NO: 356066 - DNA, 20 bp, M. musculus
agagcaacaagaaagtatgt

SEQ ID NO: 356067 - DNA, 16 bp, M. musculus
agagcaactgaagaag

SEQ ID NO: 356068 - DNA, 16 bp, M. musculus
agagcaactgaggaag

SEQ ID NO: 356069 - DNA, 16 bp, M. musculus
agagcaacttccagga

SEQ ID NO: 356070 - DNA, 16 bp, M. musculus
agagcaacttcccaat

SEQ ID NO: 356071 - DNA, 16 bp, M. musculus
agagcaagaaggcaag

SEQ ID NO: 356072 - DNA, 16 bp, M. musculus
agagcaagagaataag

SEQ ID NO: 356073 - DNA, 16 bp, M. musculus
agagcaagagagcaag

SEQ ID NO: 356074 - DNA, 17 bp, M. musculus
agagcaagagagcaaga

SEQ ID NO: 356075 - DNA, 18 bp, M. musculus
agagcaagagctctattg

SEQ ID NO: 356076 - DNA, 16 bp, M. musculus
agagcaagcacaggct

SEQ ID NO: 356077 - DNA, 16 bp, M. musculus
agagcaagccagtgag

SEQ ID NO: 356078 - DNA, 16 bp, M. musculus
agagcaagctgcacat

SEQ ID NO: 356079 - DNA, 16 bp, M. musculus
agagcaaggtgggggc

SEQ ID NO: 356080 - DNA, 16 bp, M. musculus
agagcaagttcaagga

SEQ ID NO: 356081 - DNA, 18 bp, M. musculus
agagcaagttccaggaca

SEQ ID NO: 356082 - DNA, 16 bp, M. musculus
agagcaatagaaaagt

SEQ ID NO: 356083 - DNA, 16 bp, M. musculus
agagcaatgagaaaag

SEQ ID NO: 356084 - DNA, 16 bp, M. musculus
agagcaatggaggaag

SEQ ID NO: 356085 - DNA, 16 bp, M. musculus
agagcacagagaagct

SEQ ID NO: 356086 - DNA, 16 bp, M. musculus
agagcacagagacagt

SEQ ID NO: 356087 - DNA, 16 bp, M. musculus
agagcacagcctgggt

SEQ ID NO: 356088 - DNA, 16 bp, M. musculus
agagcacagctcctat

SEQ ID NO: 356089 - DNA, 16 bp, M. musculus
agagcacagggtctcc

SEQ ID NO: 356090 - DNA, 16 bp, M. musculus
agagcacagtcacaat

SEQ ID NO: 356091 - DNA, 16 bp, M. musculus
agagcaccagctgctc

SEQ ID NO: 356092 - DNA, 16 bp, M. musculus
agagcacctgggagta

SEQ ID NO: 356093 - DNA, 16 bp, M. musculus
agagcacgggctgctc

SEQ ID NO: 356094 - DNA, 22 bp, M. musculus
agagcactgactgctcttctgg

SEQ ID NO: 356095 - DNA, 16 bp, M. musculus
agagcactggatgctc

SEQ ID NO: 356096 - DNA, 16 bp, M. musculus
agagcactggccactc

SEQ ID NO: 356097 - DNA, 16 bp, M. musculus
agagcactggcctagc

SEQ ID NO: 356098 - DNA, 16 bp, M. musculus
agagcactggctgctt

SEQ ID NO: 356099 - DNA, 16 bp, M. musculus
agagcacttactgttc

SEQ ID NO: 356100 - DNA, 16 bp, M. musculus
agagcacttcagacca

SEQ ID NO: 356101 - DNA, 16 bp, M. musculus
agagcacttcctgttc

SEQ ID NO: 356102 - DNA, 16 bp, M. musculus
agagcagaaggagcag

SEQ ID NO: 356103 - DNA, 16 bp, M. musculus
agagcagaccctgcac

SEQ ID NO: 356104 - DNA, 16 bp, M. musculus
agagcagagaacagag

SEQ ID NO: 356105 - DNA, 16 bp, M. musculus
agagcagagacagaga

SEQ ID NO: 356106 - DNA, 16 bp, M. musculus
agagcagagagagaat

SEQ ID NO: 356107 - DNA, 16 bp, M. musculus
agagcagagagtgaag

SEQ ID NO: 356108 - DNA, 16 bp, M. musculus
agagcagagatggaga

SEQ ID NO: 356109 - DNA, 16 bp, M. musculus
agagcagagcacagca

SEQ ID NO: 356110 - DNA, 16 bp, M. musculus
agagcagagcagaaca

SEQ ID NO: 356111 - DNA, 16 bp, M. musculus
agagcagagcagagag

SEQ ID NO: 356112 - DNA, 16 bp, M. musculus
agagcagagcagagca

SEQ ID NO: 356113 - DNA, 16 bp, M. musculus
agagcagagcagagga

SEQ ID NO: 356114 - DNA, 20 bp, M. musculus
agagcagagccctgttccca

SEQ ID NO: 356115 - DNA, 16 bp, M. musculus
agagcagagcttgcct

SEQ ID NO: 356116 - DNA, 16 bp, M. musculus
agagcagaggcaggag

SEQ ID NO: 356117 - DNA, 16 bp, M. musculus
agagcagaggctgaag

SEQ ID NO: 356118 - DNA, 16 bp, M. musculus
agagcagcaaaccgaa

SEQ ID NO: 356119 - DNA, 16 bp, M. musculus
agagcagcaagtgctg

SEQ ID NO: 356120 - DNA, 16 bp, M. musculus
agagcagcaagttctc

SEQ ID NO: 356121 - DNA, 16 bp, M. musculus
agagcagcaatgaaca

SEQ ID NO: 356122 - DNA, 16 bp, M. musculus
agagcagcagcaggtg

SEQ ID NO: 356123 - DNA, 16 bp, M. musculus
agagcagcagcagtgg

SEQ ID NO: 356124 - DNA, 16 bp, M. musculus
agagcagcagccagtg

SEQ ID NO: 356125 - DNA, 16 bp, M. musculus
agagcagcaggtgctc

SEQ ID NO: 356126 - DNA, 16 bp, M. musculus
agagcagccagagttc

SEQ ID NO: 356127 - DNA, 16 bp, M. musculus
agagcagccagctctc

SEQ ID NO: 356128 - DNA, 16 bp, M. musculus
agagcagccatcttgt

SEQ ID NO: 356129 - DNA, 16 bp, M. musculus
agagcagcccagatgg

SEQ ID NO: 356130 - DNA, 16 bp, M. musculus
agagcagcctcagcag

SEQ ID NO: 356131 - DNA, 16 bp, M. musculus
agagcagctggtgctt

SEQ ID NO: 356132 - DNA, 16 bp, M. musculus
agagcaggaacatttg

SEQ ID NO: 356133 - DNA, 16 bp, M. musculus
agagcaggaagctgag

SEQ ID NO: 356134 - DNA, 16 bp, M. musculus
agagcaggagagctgg

SEQ ID NO: 356135 - DNA, 16 bp, M. musculus
agagcaggagcaagaa

SEQ ID NO: 356136 - DNA, 16 bp, M. musculus
agagcaggagtcacag

SEQ ID NO: 356137 - DNA, 17 bp, M. musculus
agagcaggatgagcaag

SEQ ID NO: 356138 - DNA, 16 bp, M. musculus
agagcaggccctgcac

SEQ ID NO: 356139 - DNA, 16 bp, M. musculus
agagcaggctgagaaa

SEQ ID NO: 356140 - DNA, 16 bp, M. musculus
agagcaggctgagcca

SEQ ID NO: 356141 - DNA, 16 bp, M. musculus
agagcaggggctacat

SEQ ID NO: 356142 - DNA, 16 bp, M. musculus
agagcaggtaaaagag

SEQ ID NO: 356143 - DNA, 16 bp, M. musculus
agagcaggtgtgcatg

SEQ ID NO: 356144 - DNA, 16 bp, M. musculus
agagcagtagctaaga

SEQ ID NO: 356145 - DNA, 16 bp, M. musculus
agagcagtagtaataa

SEQ ID NO: 356146 - DNA, 17 bp, M. musculus
agagcagtcagtgatct

SEQ ID NO: 356147 - DNA, 16 bp, M. musculus
agagcagtcagtgcct

SEQ ID NO: 356148 - DNA, 17 bp, M. musculus
agagcagtcagtgctcc

SEQ ID NO: 356149 - DNA, 16 bp, M. musculus
agagcagtgcagaaga

SEQ ID NO: 356150 - DNA, 16 bp, M. musculus
agagcagtgcttctca

SEQ ID NO: 356151 - DNA, 16 bp, M. musculus
agagcagtggctctca

SEQ ID NO: 356152 - DNA, 16 bp, M. musculus
agagcatcagaaaaca

SEQ ID NO: 356153 - DNA, 16 bp, M. musculus
agagcatcagcaacag

SEQ ID NO: 356154 - DNA, 16 bp, M. musculus
agagcatcagcagcag

SEQ ID NO: 356155 - DNA, 16 bp, M. musculus
agagcatccacctctg

SEQ ID NO: 356156 - DNA, 16 bp, M. musculus
agagcatctatggtga

SEQ ID NO: 356157 - DNA, 16 bp, M. musculus
agagcatctcagaaga

SEQ ID NO: 356158 - DNA, 16 bp, M. musculus
agagcatctcaggaga

SEQ ID NO: 356159 - DNA, 16 bp, M. musculus
agagcatgacagcatc

SEQ ID NO: 356160 - DNA, 16 bp, M. musculus
agagcatgctgggaaa

SEQ ID NO: 356161 - DNA, 16 bp, M. musculus
agagcatggagcagga

SEQ ID NO: 356162 - DNA, 16 bp, M. musculus
agagcattgactgcgt

SEQ ID NO: 356163 - DNA, 16 bp, M. musculus
agagccaactcccaca

SEQ ID NO: 356164 - DNA, 16 bp, M. musculus
agagccaaggcagagg

SEQ ID NO: 356165 - DNA, 16 bp, M. musculus
agagccacaagtccca

SEQ ID NO: 356166 - DNA, 16 bp, M. musculus
agagccacaagtttca

SEQ ID NO: 356167 - DNA, 16 bp, M. musculus
agagccacacagtgag

SEQ ID NO: 356168 - DNA, 16 bp, M. musculus
agagccacaggtgtat

SEQ ID NO: 356169 - DNA, 16 bp, M. musculus
agagccaccaaccaaa

SEQ ID NO: 356170 - DNA, 16 bp, M. musculus
agagccaccagccatg

SEQ ID NO: 356171 - DNA, 16 bp, M. musculus
agagccactgggcctg

SEQ ID NO: 356172 - DNA, 16 bp, M. musculus
agagccacttttcttt

SEQ ID NO: 356173 - DNA, 16 bp, M. musculus
agagccagaagggatg

SEQ ID NO: 356174 - DNA, 16 bp, M. musculus
agagccagagaaagag

SEQ ID NO: 356175 - DNA, 16 bp, M. musculus
agagccagagaagcag

SEQ ID NO: 356176 - DNA, 16 bp, M. musculus
agagccagagagatgg

SEQ ID NO: 356177 - DNA, 16 bp, M. musculus
agagccagagagcaaa

SEQ ID NO: 356178 - DNA, 17 bp, M. musculus
agagccagagagcttct

SEQ ID NO: 356179 - DNA, 16 bp, M. musculus
agagccagagccagag

SEQ ID NO: 356180 - DNA, 16 bp, M. musculus
agagccagaggaagga

SEQ ID NO: 356181 - DNA, 16 bp, M. musculus
agagccagaggaccag

SEQ ID NO: 356182 - DNA, 16 bp, M. musculus
agagccagagttacag

SEQ ID NO: 356183 - DNA, 16 bp, M. musculus
agagccagcagcagca

SEQ ID NO: 356184 - DNA, 16 bp, M. musculus
agagccagctcctggt

SEQ ID NO: 356185 - DNA, 16 bp, M. musculus
agagccagctctccca

SEQ ID NO: 356186 - DNA, 16 bp, M. musculus
agagccaggaagcaag

SEQ ID NO: 356187 - DNA, 16 bp, M. musculus
agagccaggagaatga

SEQ ID NO: 356188 - DNA, 16 bp, M. musculus
agagccaggatttgaa

SEQ ID NO: 356189 - DNA, 16 bp, M. musculus
agagccaggcagtggt

SEQ ID NO: 356190 - DNA, 16 bp, M. musculus
agagccaggcatggtg

SEQ ID NO: 356191 - DNA, 16 bp, M. musculus
agagccagttctctcc

SEQ ID NO: 356192 - DNA, 16 bp, M. musculus
agagccatcagaacac

SEQ ID NO: 356193 - DNA, 16 bp, M. musculus
agagccatgtttgcca

SEQ ID NO: 356194 - DNA, 16 bp, M. musculus
agagcccaagaaaagg

SEQ ID NO: 356195 - DNA, 16 bp, M. musculus
agagcccaagagaagg

SEQ ID NO: 356196 - DNA, 16 bp, M. musculus
agagcccaagagggca

SEQ ID NO: 356197 - DNA, 16 bp, M. musculus
agagcccagagcccag

SEQ ID NO: 356198 - DNA, 16 bp, M. musculus
agagcccagcccactg

SEQ ID NO: 356199 - DNA, 16 bp, M. musculus
agagcccaggaccacc

SEQ ID NO: 356200 - DNA, 16 bp, M. musculus
agagccccaagagtcc

SEQ ID NO: 356201 - DNA, 16 bp, M. musculus
agagcccccagagctc

SEQ ID NO: 356202 - DNA, 16 bp, M. musculus
agagcccctgaaactg

SEQ ID NO: 356203 - DNA, 16 bp, M. musculus
agagcccctggaactg

SEQ ID NO: 356204 - DNA, 16 bp, M. musculus
agagcctctcagaaaa

SEQ ID NO: 356205 - DNA, 16 bp, M. musculus
agagcctctcagaaga

SEQ ID NO: 356206 - DNA, 16 bp, M. musculus
agagcctctcaggaaa

SEQ ID NO: 356207 - DNA, 16 bp, M. musculus
agagcctctccagaga

SEQ ID NO: 356208 - DNA, 16 bp, M. musculus
agagcctctctgagga

SEQ ID NO: 356209 - DNA, 16 bp, M. musculus
agagcctctgcctaga

SEQ ID NO: 356210 - DNA, 16 bp, M. musculus
agagcctctggaagag

SEQ ID NO: 356211 - DNA, 16 bp, M. musculus
agagcctgaactggcc

SEQ ID NO: 356212 - DNA, 16 bp, M. musculus
agagcctgaaggaatg

SEQ ID NO: 356213 - DNA, 16 bp, M. musculus
agagcctgacagatac

SEQ ID NO: 356214 - DNA, 16 bp, M. musculus
agagcctgagaaaaag

SEQ ID NO: 356215 - DNA, 16 bp, M. musculus
agagcctgagagaaag

SEQ ID NO: 356216 - DNA, 16 bp, M. musculus
agagcctgagctgttg

SEQ ID NO: 356217 - DNA, 17 bp, M. musculus
agagcctgagggaaagg

SEQ ID NO: 356218 - DNA, 16 bp, M. musculus
agagcctgccatatcc

SEQ ID NO: 356219 - DNA, 16 bp, M. musculus
agagcctggcacacag

SEQ ID NO: 356220 - DNA, 16 bp, M. musculus
agagcctggcatggtg

SEQ ID NO: 356221 - DNA, 16 bp, M. musculus
agagcctgggcagagg

SEQ ID NO: 356222 - DNA, 16 bp, M. musculus
agagcctggtcagagg

SEQ ID NO: 356223 - DNA, 16 bp, M. musculus
agagcctgtctcaaac

SEQ ID NO: 356224 - DNA, 16 bp, M. musculus
agagcctgtgacagtg

SEQ ID NO: 356225 - DNA, 16 bp, M. musculus
agagccttcccaggac

SEQ ID NO: 356226 - DNA, 16 bp, M. musculus
agagccttctacaaaa

SEQ ID NO: 356227 - DNA, 16 bp, M. musculus
agagccttggctgtcc

SEQ ID NO: 356228 - DNA, 16 bp, M. musculus
agagcgagagcgagag

SEQ ID NO: 356229 - DNA, 16 bp, M. musculus
agagcgagcaagagag

SEQ ID NO: 356230 - DNA, 16 bp, M. musculus
agagcgagcgagcgag

SEQ ID NO: 356231 - DNA, 16 bp, M. musculus
agagcgcaagagcttt

SEQ ID NO: 356232 - DNA, 16 bp, M. musculus
agagcgcttgcctggc

SEQ ID NO: 356233 - DNA, 16 bp, M. musculus
agagcggcttgtggcc

SEQ ID NO: 356234 - DNA, 18 bp, M. musculus
agagcggggtaaaagatt

SEQ ID NO: 356235 - DNA, 16 bp, M. musculus
agagctaaacaaaaat

SEQ ID NO: 356236 - DNA, 16 bp, M. musculus
agagctaaacagaatt

SEQ ID NO: 356237 - DNA, 16 bp, M. musculus
agagctaaataaagaa

SEQ ID NO: 356238 - DNA, 16 bp, M. musculus
agagctaaatgaagaa

SEQ ID NO: 356239 - DNA, 16 bp, M. musculus
agagctacatatacaa

SEQ ID NO: 356240 - DNA, 16 bp, M. musculus
agagctagagcaagag

SEQ ID NO: 356241 - DNA, 16 bp, M. musculus
agagctagggagatgg

SEQ ID NO: 356242 - DNA, 16 bp, M. musculus
agagctagtctcccaa

SEQ ID NO: 356243 - DNA, 17 bp, M. musculus
agagctagtgaaaggca

SEQ ID NO: 356244 - DNA, 16 bp, M. musculus
agagctatatcctgat

SEQ ID NO: 356245 - DNA, 16 bp, M. musculus
agagctatcagaatta

SEQ ID NO: 356246 - DNA, 16 bp, M. musculus
agagctcacatctgat

SEQ ID NO: 356247 - DNA, 16 bp, M. musculus
agagctcacatcttca

SEQ ID NO: 356248 - DNA, 16 bp, M. musculus
agagctcagagcagga

SEQ ID NO: 356249 - DNA, 16 bp, M. musculus
agagctcagaggacaa

SEQ ID NO: 356250 - DNA, 16 bp, M. musculus
agagctcatattttga

SEQ ID NO: 356251 - DNA, 16 bp, M. musculus
agagctccacctgcct

SEQ ID NO: 356252 - DNA, 16 bp, M. musculus
agagctcccagaaact

SEQ ID NO: 356253 - DNA, 17 bp, M. musculus
agagctcccagggacta

SEQ ID NO: 356254 - DNA, 16 bp, M. musculus
agagctcccagtgtgg

SEQ ID NO: 356255 - DNA, 16 bp, M. musculus
agagctcctagagact

SEQ ID NO: 356256 - DNA, 16 bp, M. musculus
agagctcctggtgtgg

SEQ ID NO: 356257 - DNA, 16 bp, M. musculus
agagctctacctgcct

SEQ ID NO: 356258 - DNA, 16 bp, M. musculus
agagctctccctggag

SEQ ID NO: 356259 - DNA, 16 bp, M. musculus
agagctctggagtact

SEQ ID NO: 356260 - DNA, 16 bp, M. musculus
agagctctgtctgcct

SEQ ID NO: 356261 - DNA, 16 bp, M. musculus
agagctgaaaggagaa

SEQ ID NO: 356262 - DNA, 16 bp, M. musculus
agagctgaagaggttt

SEQ ID NO: 356263 - DNA, 16 bp, M. musculus
agagctgaaggggttt

SEQ ID NO: 356264 - DNA, 16 bp, M. musculus
agagctgaccaccagg

SEQ ID NO: 356265 - DNA, 16 bp, M. musculus
agagctgaccctgccc

SEQ ID NO: 356266 - DNA, 16 bp, M. musculus
agagctgaccctggtg

SEQ ID NO: 356267 - DNA, 16 bp, M. musculus
agagctgagaaggaag

SEQ ID NO: 356268 - DNA, 16 bp, M. musculus
agagctgagacaaaag

SEQ ID NO: 356269 - DNA, 16 bp, M. musculus
agagctgagacagaag

SEQ ID NO: 356270 - DNA, 16 bp, M. musculus
agagctgagacccaaa

SEQ ID NO: 356271 - DNA, 16 bp, M. musculus
agagctgagagttcta

SEQ ID NO: 356272 - DNA, 16 bp, M. musculus
agagctgagcaccagc

SEQ ID NO: 356273 - DNA, 16 bp, M. musculus
agagctgaggacagaa

SEQ ID NO: 356274 - DNA, 16 bp, M. musculus
agagctgaggcagaag

SEQ ID NO: 356275 - DNA, 16 bp, M. musculus
agagctgatgattggg

SEQ ID NO: 356276 - DNA, 16 bp, M. musculus
agagctgatggctcct

SEQ ID NO: 356277 - DNA, 16 bp, M. musculus
agagctgcagagatgg

SEQ ID NO: 356278 - DNA, 16 bp, M. musculus
agagctgcaggagaga

SEQ ID NO: 356279 - DNA, 16 bp, M. musculus
agagctgctgctgctg

SEQ ID NO: 356280 - DNA, 16 bp, M. musculus
agagctggaagaagct

SEQ ID NO: 356281 - DNA, 16 bp, M. musculus
agagctggaagctgag

SEQ ID NO: 356282 - DNA, 16 bp, M. musculus
agagctggagaaatga

SEQ ID NO: 356283 - DNA, 16 bp, M. musculus
agagctggagaagaga

SEQ ID NO: 356284 - DNA, 16 bp, M. musculus
agagctggagaagtga

SEQ ID NO: 356285 - DNA, 16 bp, M. musculus
agagctggagctacag

SEQ ID NO: 356286 - DNA, 17 bp, M. musculus
agagctggagttacagg

SEQ ID NO: 356287 - DNA, 16 bp, M. musculus
agagctggagttatca

SEQ ID NO: 356288 - DNA, 16 bp, M. musculus
agagctggcaggctga

SEQ ID NO: 356289 - DNA, 16 bp, M. musculus
agagctggccccaggg

SEQ ID NO: 356290 - DNA, 16 bp, M. musculus
agagctggccctgagg

SEQ ID NO: 356291 - DNA, 16 bp, M. musculus
agagctggccctgctc

SEQ ID NO: 356292 - DNA, 16 bp, M. musculus
agagctggccctgtcc

SEQ ID NO: 356293 - DNA, 16 bp, M. musculus
agagctggcctcccag

SEQ ID NO: 356294 - DNA, 16 bp, M. musculus
agagctggccttgccc

SEQ ID NO: 356295 - DNA, 16 bp, M. musculus
agagctggctcagcgg

SEQ ID NO: 356296 - DNA, 16 bp, M. musculus
agagctggctgcagga

SEQ ID NO: 356297 - DNA, 16 bp, M. musculus
agagctgggattacag

SEQ ID NO: 356298 - DNA, 16 bp, M. musculus
agagctgggattccag

SEQ ID NO: 356299 - DNA, 16 bp, M. musculus
agagctgggcagatat

SEQ ID NO: 356300 - DNA, 16 bp, M. musculus
agagctgggcaggtat

SEQ ID NO: 356301 - DNA, 16 bp, M. musculus
agagctgggcatggtg

SEQ ID NO: 356302 - DNA, 16 bp, M. musculus
agagctggggagacag

SEQ ID NO: 356303 - DNA, 16 bp, M. musculus
agagctggggagaggg

SEQ ID NO: 356304 - DNA, 16 bp, M. musculus
agagctggggagatgg

SEQ ID NO: 356305 - DNA, 16 bp, M. musculus
agagctggggttaaag

SEQ ID NO: 356306 - DNA, 16 bp, M. musculus
agagctgggtggagag

SEQ ID NO: 356307 - DNA, 16 bp, M. musculus
agagctggttcagtgg

SEQ ID NO: 356308 - DNA, 16 bp, M. musculus
agagctggttctttga

SEQ ID NO: 356309 - DNA, 16 bp, M. musculus
agagctgtgtctttag

SEQ ID NO: 356310 - DNA, 16 bp, M. musculus
agagcttactgctctt

SEQ ID NO: 356311 - DNA, 16 bp, M. musculus
agagcttccagggtct

SEQ ID NO: 356312 - DNA, 16 bp, M. musculus
agagcttccctgcaga

SEQ ID NO: 356313 - DNA, 16 bp, M. musculus
agagcttctcaggaga

SEQ ID NO: 356314 - DNA, 16 bp, M. musculus
agagcttgcctgcaca

SEQ ID NO: 356315 - DNA, 16 bp, M. musculus
agagcttggctgcaga

SEQ ID NO: 356316 - DNA, 16 bp, M. musculus
agagcttgtctcccac

SEQ ID NO: 356317 - DNA, 16 bp, M. musculus
agagcttgtctcccag

SEQ ID NO: 356318 - DNA, 16 bp, M. musculus
agagctttcagatgtg

SEQ ID NO: 356319 - DNA, 17 bp, M. musculus
agagctttcagtaaggc

SEQ ID NO: 356320 - DNA, 16 bp, M. musculus
agagctttgcatcctg

SEQ ID NO: 356321 - DNA, 17 bp, M. musculus
agagctttgtcttggtt

SEQ ID NO: 356322 - DNA, 16 bp, M. musculus
agaggaaaaaatattt

SEQ ID NO: 356323 - DNA, 16 bp, M. musculus
agaggaaaactcattg

SEQ ID NO: 356324 - DNA, 16 bp, M. musculus
agaggaaacagaaacc

SEQ ID NO: 356325 - DNA, 16 bp, M. musculus
agaggaaactagcaaa

SEQ ID NO: 356326 - DNA, 16 bp, M. musculus
agaggaaacttgactg

SEQ ID NO: 356327 - DNA, 16 bp, M. musculus
agaggaaacttggaaa

SEQ ID NO: 356328 - DNA, 16 bp, M. musculus
agaggaaagatttatt

SEQ ID NO: 356329 - DNA, 16 bp, M. musculus
agaggaaagcaaggtc

SEQ ID NO: 356330 - DNA, 17 bp, M. musculus
agaggaaagctactgat

SEQ ID NO: 356331 - DNA, 16 bp, M. musculus
agaggaaaggcccttg

SEQ ID NO: 356332 - DNA, 16 bp, M. musculus
agaggaaagggtttct

SEQ ID NO: 356333 - DNA, 16 bp, M. musculus
agaggaaaggtttatt

SEQ ID NO: 356334 - DNA, 16 bp, M. musculus
agaggaaatatttttt

SEQ ID NO: 356335 - DNA, 16 bp, M. musculus
agaggaaatccaggtg

SEQ ID NO: 356336 - DNA, 16 bp, M. musculus
agaggaaatctcaaaa

SEQ ID NO: 356337 - DNA, 16 bp, M. musculus
agaggaacacttctct

SEQ ID NO: 356338 - DNA, 16 bp, M. musculus
agaggaacaggaagtt

SEQ ID NO: 356339 - DNA, 16 bp, M. musculus
agaggaactcacacaa

SEQ ID NO: 356340 - DNA, 16 bp, M. musculus
agaggaagaactgaag

SEQ ID NO: 356341 - DNA, 16 bp, M. musculus
agaggaagacacccag

SEQ ID NO: 356342 - DNA, 16 bp, M. musculus
agaggaagacatctga

SEQ ID NO: 356343 - DNA, 16 bp, M. musculus
agaggaagaggagcca

SEQ ID NO: 356344 - DNA, 16 bp, M. musculus
agaggaagcaagccag

SEQ ID NO: 356345 - DNA, 16 bp, M. musculus
agaggaagcacagcaa

SEQ ID NO: 356346 - DNA, 16 bp, M. musculus
agaggaagcagagagc

SEQ ID NO: 356347 - DNA, 16 bp, M. musculus
agaggaagccaggcag

SEQ ID NO: 356348 - DNA, 16 bp, M. musculus
agaggaagctccactc

SEQ ID NO: 356349 - DNA, 16 bp, M. musculus
agaggaaggactgaag

SEQ ID NO: 356350 - DNA, 16 bp, M. musculus
agaggaaggagagcca

SEQ ID NO: 356351 - DNA, 16 bp, M. musculus
agaggaaggcagaggc

SEQ ID NO: 356352 - DNA, 16 bp, M. musculus
agaggaagggtttatt

SEQ ID NO: 356353 - DNA, 16 bp, M. musculus
agaggaaggtggatct

SEQ ID NO: 356354 - DNA, 16 bp, M. musculus
agaggaagtcagggca

SEQ ID NO: 356355 - DNA, 16 bp, M. musculus
agaggaatggaaacag

SEQ ID NO: 356356 - DNA, 16 bp, M. musculus
agaggaatgtgtgtgt

SEQ ID NO: 356357 - DNA, 16 bp, M. musculus
agaggacaacctgaag

SEQ ID NO: 356358 - DNA, 16 bp, M. musculus
agaggacaactcatgg

SEQ ID NO: 356359 - DNA, 16 bp, M. musculus
agaggacaacttgtag

SEQ ID NO: 356360 - DNA, 16 bp, M. musculus
agaggacaatttgggg

SEQ ID NO: 356361 - DNA, 16 bp, M. musculus
agaggacacagagaag

SEQ ID NO: 356362 - DNA, 16 bp, M. musculus
agaggacacagagaga

SEQ ID NO: 356363 - DNA, 16 bp, M. musculus
agaggacacagggaca

SEQ ID NO: 356364 - DNA, 16 bp, M. musculus
agaggacactgtgacc

SEQ ID NO: 356365 - DNA, 16 bp, M. musculus
agaggacagagagaca

SEQ ID NO: 356366 - DNA, 16 bp, M. musculus
agaggacagagcagag

SEQ ID NO: 356367 - DNA, 16 bp, M. musculus
agaggacagagctaga

SEQ ID NO: 356368 - DNA, 16 bp, M. musculus
agaggacagaggacag

SEQ ID NO: 356369 - DNA, 16 bp, M. musculus
agaggacagaggcagg

SEQ ID NO: 356370 - DNA, 16 bp, M. musculus
agaggacagagggcag

SEQ ID NO: 356371 - DNA, 16 bp, M. musculus
agaggacagccagggc

SEQ ID NO: 356372 - DNA, 16 bp, M. musculus
agaggacagctttatg

SEQ ID NO: 356373 - DNA, 16 bp, M. musculus
agaggacaggacagga

SEQ ID NO: 356374 - DNA, 16 bp, M. musculus
agaggacagttatact

SEQ ID NO: 356375 - DNA, 16 bp, M. musculus
agaggacatcaagaaa

SEQ ID NO: 356376 - DNA, 16 bp, M. musculus
agaggacatcagagcc

SEQ ID NO: 356377 - DNA, 16 bp, M. musculus
agaggacatcagattc

SEQ ID NO: 356378 - DNA, 16 bp, M. musculus
agaggacattcctcaa

SEQ ID NO: 356379 - DNA, 16 bp, M. musculus
agaggaccaagggcct

SEQ ID NO: 356380 - DNA, 16 bp, M. musculus
agaggaccagggttca

SEQ ID NO: 356381 - DNA, 16 bp, M. musculus
agaggaccagtgttca

SEQ ID NO: 356382 - DNA, 16 bp, M. musculus
agaggaccatggtgcc

SEQ ID NO: 356383 - DNA, 16 bp, M. musculus
agaggacccaagtcca

SEQ ID NO: 356384 - DNA, 16 bp, M. musculus
agaggacccagattct

SEQ ID NO: 356385 - DNA, 16 bp, M. musculus
agaggacctaaatttg

SEQ ID NO: 356386 - DNA, 16 bp, M. musculus
agaggacctaggtcag

SEQ ID NO: 356387 - DNA, 16 bp, M. musculus
agaggacctctcaatt

SEQ ID NO: 356388 - DNA, 16 bp, M. musculus
agaggacctgagctgg

SEQ ID NO: 356389 - DNA, 16 bp, M. musculus
agaggacctggattca

SEQ ID NO: 356390 - DNA, 16 bp, M. musculus
agaggacctgggccca

SEQ ID NO: 356391 - DNA, 16 bp, M. musculus
agaggacctgggttta

SEQ ID NO: 356392 - DNA, 16 bp, M. musculus
agaggactgcctggta

SEQ ID NO: 356393 - DNA, 16 bp, M. musculus
agaggactgtcttatc

SEQ ID NO: 356394 - DNA, 16 bp, M. musculus
agaggactgtggaagg

SEQ ID NO: 356395 - DNA, 16 bp, M. musculus
agaggacttgggttca

SEQ ID NO: 356396 - DNA, 16 bp, M. musculus
agaggactttaaggag

SEQ ID NO: 356397 - DNA, 16 bp, M. musculus
agaggactttgagaag

SEQ ID NO: 356398 - DNA, 16 bp, M. musculus
agaggagaaaactgag

SEQ ID NO: 356399 - DNA, 32 bp, M. musculus
agaggagaaaatttggctgcaaataatagaaa

SEQ ID NO: 356400 - DNA, 16 bp, M. musculus
agaggagaaactgtgg

SEQ ID NO: 356401 - DNA, 16 bp, M. musculus
agaggagaaagtgagc

SEQ ID NO: 356402 - DNA, 16 bp, M. musculus
agaggagaagacagca

SEQ ID NO: 356403 - DNA, 16 bp, M. musculus
agaggagaatgtaggg

SEQ ID NO: 356404 - DNA, 16 bp, M. musculus
agaggagacagacatg

SEQ ID NO: 356405 - DNA, 16 bp, M. musculus
agaggagactgaagga

SEQ ID NO: 356406 - DNA, 16 bp, M. musculus
agaggagagaatctca

SEQ ID NO: 356407 - DNA, 16 bp, M. musculus
agaggagagagagtgt

SEQ ID NO: 356408 - DNA, 16 bp, M. musculus
agaggagagaggctgt

SEQ ID NO: 356409 - DNA, 16 bp, M. musculus
agaggagagctggcct

SEQ ID NO: 356410 - DNA, 16 bp, M. musculus
agaggagaggagagcc

SEQ ID NO: 356411 - DNA, 16 bp, M. musculus
agaggagatggaggac

SEQ ID NO: 356412 - DNA, 16 bp, M. musculus
agaggagcaaggacca

SEQ ID NO: 356413 - DNA, 16 bp, M. musculus
agaggagcccaaggaa

SEQ ID NO: 356414 - DNA, 16 bp, M. musculus
agaggagcctaaggaa

SEQ ID NO: 356415 - DNA, 17 bp, M. musculus
agaggagcctgagaaaa

SEQ ID NO: 356416 - DNA, 16 bp, M. musculus
agaggagctggaaaga

SEQ ID NO: 356417 - DNA, 16 bp, M. musculus
agaggagctggggaga

SEQ ID NO: 356418 - DNA, 16 bp, M. musculus
agaggagctgggtttg

SEQ ID NO: 356419 - DNA, 16 bp, M. musculus
agaggaggaagcagca

SEQ ID NO: 356420 - DNA, 16 bp, M. musculus
agaggaggaagcctca

SEQ ID NO: 356421 - DNA, 16 bp, M. musculus
agaggaggaggaagcc

SEQ ID NO: 356422 - DNA, 16 bp, M. musculus
agaggaggaggaagct

SEQ ID NO: 356423 - DNA, 16 bp, M. musculus
agaggaggaggcagca

SEQ ID NO: 356424 - DNA, 16 bp, M. musculus
agaggaggatgctggg

SEQ ID NO: 356425 - DNA, 16 bp, M. musculus
agaggaggatgcttgc

SEQ ID NO: 356426 - DNA, 16 bp, M. musculus
agaggaggcagaaagt

SEQ ID NO: 356427 - DNA, 16 bp, M. musculus
agaggaggcaggcaga

SEQ ID NO: 356428 - DNA, 16 bp, M. musculus
agaggaggctgaggaa

SEQ ID NO: 356429 - DNA, 16 bp, M. musculus
agaggaggctggagag

SEQ ID NO: 356430 - DNA, 16 bp, M. musculus
agaggagggcactgga

SEQ ID NO: 356431 - DNA, 16 bp, M. musculus
agaggaggtcagaaga

SEQ ID NO: 356432 - DNA, 16 bp, M. musculus
agaggaggtgtgtgtg

SEQ ID NO: 356433 - DNA, 16 bp, M. musculus
agaggaggttatggag

SEQ ID NO: 356434 - DNA, 16 bp, M. musculus
agaggagtagaaggca

SEQ ID NO: 356435 - DNA, 16 bp, M. musculus
agaggagtctgaggaa

SEQ ID NO: 356436 - DNA, 16 bp, M. musculus
agaggagtgaggcagg

SEQ ID NO: 356437 - DNA, 17 bp, M. musculus
agaggatatgcagtata

SEQ ID NO: 356438 - DNA, 16 bp, M. musculus
agaggatcaggagttc

SEQ ID NO: 356439 - DNA, 16 bp, M. musculus
agaggatccaggttca

SEQ ID NO: 356440 - DNA, 16 bp, M. musculus
agaggatgaagggctt

SEQ ID NO: 356441 - DNA, 16 bp, M. musculus
agaggatgaccttgtg

SEQ ID NO: 356442 - DNA, 16 bp, M. musculus
agaggatgacgtgtgt

SEQ ID NO: 356443 - DNA, 16 bp, M. musculus
agaggatgagcttagt

SEQ ID NO: 356444 - DNA, 16 bp, M. musculus
agaggatgatgatgat

SEQ ID NO: 356445 - DNA, 16 bp, M. musculus
agaggatgcacttaat

SEQ ID NO: 356446 - DNA, 16 bp, M. musculus
agaggatgcagaggaa

SEQ ID NO: 356447 - DNA, 16 bp, M. musculus
agaggatgcagaggag

SEQ ID NO: 356448 - DNA, 16 bp, M. musculus
agaggatgctcctgac

SEQ ID NO: 356449 - DNA, 16 bp, M. musculus
agaggatgctgggaaa

SEQ ID NO: 356450 - DNA, 16 bp, M. musculus
agaggatgctgggaag

SEQ ID NO: 356451 - DNA, 16 bp, M. musculus
agaggatggaccatct

SEQ ID NO: 356452 - DNA, 18 bp, M. musculus
agaggatggccttgtcag

SEQ ID NO: 356453 - DNA, 16 bp, M. musculus
agaggatgtccccaac

SEQ ID NO: 356454 - DNA, 16 bp, M. musculus
agaggatgtggggaaa

SEQ ID NO: 356455 - DNA, 16 bp, M. musculus
agaggatgttcccacc

SEQ ID NO: 356456 - DNA, 16 bp, M. musculus
agaggattcaagttca

SEQ ID NO: 356457 - DNA, 16 bp, M. musculus
agaggatttattttta

SEQ ID NO: 356458 - DNA, 16 bp, M. musculus
agaggattttcagagg

SEQ ID NO: 356459 - DNA, 16 bp, M. musculus
agaggcaaatgggagg

SEQ ID NO: 356460 - DNA, 16 bp, M. musculus
agaggcaagaggatct

SEQ ID NO: 356461 - DNA, 16 bp, M. musculus
agaggcaagagggtca

SEQ ID NO: 356462 - DNA, 16 bp, M. musculus
agaggcaagtggatct

SEQ ID NO: 356463 - DNA, 16 bp, M. musculus
agaggcacagctgaga

SEQ ID NO: 356464 - DNA, 16 bp, M. musculus
agaggcacaggcacag

SEQ ID NO: 356465 - DNA, 16 bp, M. musculus
agaggcaccaggaagt

SEQ ID NO: 356466 - DNA, 16 bp, M. musculus
agaggcagaacaagca

SEQ ID NO: 356467 - DNA, 16 bp, M. musculus
agaggcagaagaatct

SEQ ID NO: 356468 - DNA, 16 bp, M. musculus
agaggcagaagcacaa

SEQ ID NO: 356469 - DNA, 16 bp, M. musculus
agaggcagaaggatcc

SEQ ID NO: 356470 - DNA, 16 bp, M. musculus
agaggcagaagggtca

SEQ ID NO: 356471 - DNA, 16 bp, M. musculus
agaggcagacagatct

SEQ ID NO: 356472 - DNA, 16 bp, M. musculus
agaggcagagacaaag

SEQ ID NO: 356473 - DNA, 16 bp, M. musculus
agaggcagagacagag

SEQ ID NO: 356474 - DNA, 16 bp, M. musculus
agaggcagagacaggc

SEQ ID NO: 356475 - DNA, 16 bp, M. musculus
agaggcagagactgga

SEQ ID NO: 356476 - DNA, 16 bp, M. musculus
agaggcagagactggg

SEQ ID NO: 356477 - DNA, 16 bp, M. musculus
agaggcagagagagat

SEQ ID NO: 356478 - DNA, 18 bp, M. musculus
agaggcagagaggcagag

SEQ ID NO: 356479 - DNA, 16 bp, M. musculus
agaggcagagatggag

SEQ ID NO: 356480 - DNA, 16 bp, M. musculus
agaggcagagccagag

SEQ ID NO: 356481 - DNA, 16 bp, M. musculus
agaggcagagccagga

SEQ ID NO: 356482 - DNA, 16 bp, M. musculus
agaggcagaggcagaa

SEQ ID NO: 356483 - DNA, 16 bp, M. musculus
agaggcagaggcagag

SEQ ID NO: 356484 - DNA, 16 bp, M. musculus
agaggcagaggcagga

SEQ ID NO: 356485 - DNA, 16 bp, M. musculus
agaggcagaggtaggc

SEQ ID NO: 356486 - DNA, 16 bp, M. musculus
agaggcagatagacag

SEQ ID NO: 356487 - DNA, 16 bp, M. musculus
agaggcagatagatct

SEQ ID NO: 356488 - DNA, 16 bp, M. musculus
agaggcagatggaggg

SEQ ID NO: 356489 - DNA, 16 bp, M. musculus
agaggcagcaagacca

SEQ ID NO: 356490 - DNA, 16 bp, M. musculus
agaggcagcagaaaga

SEQ ID NO: 356491 - DNA, 16 bp, M. musculus
agaggcagcagagcat

SEQ ID NO: 356492 - DNA, 16 bp, M. musculus
agaggcagcccctgct

SEQ ID NO: 356493 - DNA, 16 bp, M. musculus
agaggcagctcagcag

SEQ ID NO: 356494 - DNA, 16 bp, M. musculus
agaggcaggaagacag

SEQ ID NO: 356495 - DNA, 16 bp, M. musculus
agaggcaggaagatga

SEQ ID NO: 356496 - DNA, 16 bp, M. musculus
agaggcaggaagatgg

SEQ ID NO: 356497 - DNA, 16 bp, M. musculus
agaggcaggaagcaga

SEQ ID NO: 356498 - DNA, 16 bp, M. musculus
agaggcaggagaggca

SEQ ID NO: 356499 - DNA, 16 bp, M. musculus
agaggcaggagcagag

SEQ ID NO: 356500 - DNA, 16 bp, M. musculus
agaggcaggaggacag

SEQ ID NO: 356501 - DNA, 16 bp, M. musculus
agaggcaggaggacct

SEQ ID NO: 356502 - DNA, 16 bp, M. musculus
agaggcaggaggagct

SEQ ID NO: 356503 - DNA, 16 bp, M. musculus
agaggcaggaggatta

SEQ ID NO: 356504 - DNA, 16 bp, M. musculus
agaggcaggcagagga

SEQ ID NO: 356505 - DNA, 16 bp, M. musculus
agaggcaggcagatct

SEQ ID NO: 356506 - DNA, 16 bp, M. musculus
agaggcaggcaggtcc

SEQ ID NO: 356507 - DNA, 16 bp, M. musculus
agaggcaggcggctct

SEQ ID NO: 356508 - DNA, 16 bp, M. musculus
agaggcagggctcagg

SEQ ID NO: 356509 - DNA, 16 bp, M. musculus
agaggcagggggagct

SEQ ID NO: 356510 - DNA, 16 bp, M. musculus
agaggcaggtgaatct

SEQ ID NO: 356511 - DNA, 16 bp, M. musculus
agaggcaggtggagga

SEQ ID NO: 356512 - DNA, 16 bp, M. musculus
agaggcaggtggatct

SEQ ID NO: 356513 - DNA, 16 bp, M. musculus
agaggcatctggacaa

SEQ ID NO: 356514 - DNA, 16 bp, M. musculus
agaggcattacaatct

SEQ ID NO: 356515 - DNA, 16 bp, M. musculus
agaggcattttctcaa

SEQ ID NO: 356516 - DNA, 16 bp, M. musculus
agaggcattttcttga

SEQ ID NO: 356517 - DNA, 16 bp, M. musculus
agaggccaagagagca

SEQ ID NO: 356518 - DNA, 16 bp, M. musculus
agaggccaagcagcaa

SEQ ID NO: 356519 - DNA, 16 bp, M. musculus
agaggccaaggaggag

SEQ ID NO: 356520 - DNA, 16 bp, M. musculus
agaggccacagagaca

SEQ ID NO: 356521 - DNA, 16 bp, M. musculus
agaggccacggaaggc

SEQ ID NO: 356522 - DNA, 16 bp, M. musculus
agaggccagaaaagag

SEQ ID NO: 356523 - DNA, 16 bp, M. musculus
agaggccagaagaagg

SEQ ID NO: 356524 - DNA, 16 bp, M. musculus
agaggccagaagaggg

SEQ ID NO: 356525 - DNA, 16 bp, M. musculus
agaggccagaagagtg

SEQ ID NO: 356526 - DNA, 16 bp, M. musculus
agaggccagagaagga

SEQ ID NO: 356527 - DNA, 16 bp, M. musculus
agaggccagagagggc

SEQ ID NO: 356528 - DNA, 16 bp, M. musculus
agaggccagaggaaga

SEQ ID NO: 356529 - DNA, 16 bp, M. musculus
agaggccagaggacaa

SEQ ID NO: 356530 - DNA, 16 bp, M. musculus
agaggccagaggagtg

SEQ ID NO: 356531 - DNA, 16 bp, M. musculus
agaggccagagggcag

SEQ ID NO: 356532 - DNA, 16 bp, M. musculus
agaggccagatgaggg

SEQ ID NO: 356533 - DNA, 16 bp, M. musculus
agaggccagcagatct

SEQ ID NO: 356534 - DNA, 16 bp, M. musculus
agaggccagccaggaa

SEQ ID NO: 356535 - DNA, 16 bp, M. musculus
agaggccaggaaaggg

SEQ ID NO: 356536 - DNA, 16 bp, M. musculus
agaggccaggagaggc

SEQ ID NO: 356537 - DNA, 16 bp, M. musculus
agaggccaggcagtgg

SEQ ID NO: 356538 - DNA, 16 bp, M. musculus
agaggccagggaaggc

SEQ ID NO: 356539 - DNA, 16 bp, M. musculus
agaggccatggagaag

SEQ ID NO: 356540 - DNA, 16 bp, M. musculus
agaggccatggaggag

SEQ ID NO: 356541 - DNA, 16 bp, M. musculus
agaggccatggagggg

SEQ ID NO: 356542 - DNA, 16 bp, M. musculus
agaggccatggaggtg

SEQ ID NO: 356543 - DNA, 16 bp, M. musculus
agaggcccactggaca

SEQ ID NO: 356544 - DNA, 16 bp, M. musculus
agaggcccctgggtct

SEQ ID NO: 356545 - DNA, 16 bp, M. musculus
agaggcccctggtctt

SEQ ID NO: 356546 - DNA, 16 bp, M. musculus
agaggccctgactcaa

SEQ ID NO: 356547 - DNA, 16 bp, M. musculus
agaggccctgccagtg

SEQ ID NO: 356548 - DNA, 16 bp, M. musculus
agaggcccttgggtct

SEQ ID NO: 356549 - DNA, 16 bp, M. musculus
agaggccggccatgaa

SEQ ID NO: 356550 - DNA, 16 bp, M. musculus
agaggccggtggatct

SEQ ID NO: 356551 - DNA, 16 bp, M. musculus
agaggcctgaagaggg

SEQ ID NO: 356552 - DNA, 16 bp, M. musculus
agaggcctgggctgcc

SEQ ID NO: 356553 - DNA, 16 bp, M. musculus
agaggccttctacagg

SEQ ID NO: 356554 - DNA, 17 bp, M. musculus
agaggctaacagaatca

SEQ ID NO: 356555 - DNA, 16 bp, M. musculus
agaggctccaaggcct

SEQ ID NO: 356556 - DNA, 16 bp, M. musculus
agaggctcccaggaca

SEQ ID NO: 356557 - DNA, 16 bp, M. musculus
agaggctccttggtct

SEQ ID NO: 356558 - DNA, 16 bp, M. musculus
agaggctctgacagag

SEQ ID NO: 356559 - DNA, 16 bp, M. musculus
agaggctctgccagaa

SEQ ID NO: 356560 - DNA, 16 bp, M. musculus
agaggctgaagaaaag

SEQ ID NO: 356561 - DNA, 16 bp, M. musculus
agaggctgaagaaatg

SEQ ID NO: 356562 - DNA, 16 bp, M. musculus
agaggctgaagagatg

SEQ ID NO: 356563 - DNA, 16 bp, M. musculus
agaggctgaagcagaa

SEQ ID NO: 356564 - DNA, 16 bp, M. musculus
agaggctgaagcagag

SEQ ID NO: 356565 - DNA, 16 bp, M. musculus
agaggctgaagcagca

SEQ ID NO: 356566 - DNA, 16 bp, M. musculus
agaggctgagacagga

SEQ ID NO: 356567 - DNA, 16 bp, M. musculus
agaggctgagagagaa

SEQ ID NO: 356568 - DNA, 16 bp, M. musculus
agaggctgagaggctg

SEQ ID NO: 356569 - DNA, 16 bp, M. musculus
agaggctgagatggga

SEQ ID NO: 356570 - DNA, 16 bp, M. musculus
agaggctgaggaggag

SEQ ID NO: 356571 - DNA, 16 bp, M. musculus
agaggctgaggcaggc

SEQ ID NO: 356572 - DNA, 16 bp, M. musculus
agaggctgagggaatg

SEQ ID NO: 356573 - DNA, 16 bp, M. musculus
agaggctgagtaagcc

SEQ ID NO: 356574 - DNA, 16 bp, M. musculus
agaggctgatgcagga

SEQ ID NO: 356575 - DNA, 16 bp, M. musculus
agaggctgctggggaa

SEQ ID NO: 356576 - DNA, 16 bp, M. musculus
agaggctggaagctga

SEQ ID NO: 356577 - DNA, 16 bp, M. musculus
agaggctggactccag

SEQ ID NO: 356578 - DNA, 16 bp, M. musculus
agaggctggagagatg

SEQ ID NO: 356579 - DNA, 16 bp, M. musculus
agaggctggaggaaga

SEQ ID NO: 356580 - DNA, 16 bp, M. musculus
agaggctgggggattt

SEQ ID NO: 356581 - DNA, 16 bp, M. musculus
agaggctggtagatct

SEQ ID NO: 356582 - DNA, 16 bp, M. musculus
agaggctgtcaggttc

SEQ ID NO: 356583 - DNA, 16 bp, M. musculus
agaggctgtggaggaa

SEQ ID NO: 356584 - DNA, 16 bp, M. musculus
agaggctgtgtgtgtg

SEQ ID NO: 356585 - DNA, 16 bp, M. musculus
agaggcttcacccaga

SEQ ID NO: 356586 - DNA, 16 bp, M. musculus
agaggcttcctctggc

SEQ ID NO: 356587 - DNA, 16 bp, M. musculus
agagggaaactcagag

SEQ ID NO: 356588 - DNA, 16 bp, M. musculus
agagggaacttctaga

SEQ ID NO: 356589 - DNA, 16 bp, M. musculus
agagggaagaccaaag

SEQ ID NO: 356590 - DNA, 16 bp, M. musculus
agagggaagaccagtg

SEQ ID NO: 356591 - DNA, 16 bp, M. musculus
agagggaagcccatcc

SEQ ID NO: 356592 - DNA, 16 bp, M. musculus
agagggaagcctgcat

SEQ ID NO: 356593 - DNA, 16 bp, M. musculus
agagggaattggatcc

SEQ ID NO: 356594 - DNA, 16 bp, M. musculus
agagggacacagtgaa

SEQ ID NO: 356595 - DNA, 16 bp, M. musculus
agagggacagggacag

SEQ ID NO: 356596 - DNA, 16 bp, M. musculus
agagggagagaatatg

SEQ ID NO: 356597 - DNA, 16 bp, M. musculus
agagggagagagaact

SEQ ID NO: 356598 - DNA, 16 bp, M. musculus
agagggagagagatta

SEQ ID NO: 356599 - DNA, 16 bp, M. musculus
agagggagagaggcca

SEQ ID NO: 356600 - DNA, 16 bp, M. musculus
agagggaggagagcca

SEQ ID NO: 356601 - DNA, 16 bp, M. musculus
agagggagggactggg

SEQ ID NO: 356602 - DNA, 16 bp, M. musculus
agagggattaaaggta

SEQ ID NO: 356603 - DNA, 16 bp, M. musculus
agagggcacagagaaa

SEQ ID NO: 356604 - DNA, 16 bp, M. musculus
agagggcacagagaca

SEQ ID NO: 356605 - DNA, 16 bp, M. musculus
agagggcacaggacag

SEQ ID NO: 356606 - DNA, 16 bp, M. musculus
agagggcactggattc

SEQ ID NO: 356607 - DNA, 16 bp, M. musculus
agagggcagagctgga

SEQ ID NO: 356608 - DNA, 16 bp, M. musculus
agagggcagaggccag

SEQ ID NO: 356609 - DNA, 16 bp, M. musculus
agagggcagccatggc

SEQ ID NO: 356610 - DNA, 16 bp, M. musculus
agagggcatcaaatcc

SEQ ID NO: 356611 - DNA, 16 bp, M. musculus
agagggcatcagaccc

SEQ ID NO: 356612 - DNA, 16 bp, M. musculus
agagggccagagggcc

SEQ ID NO: 356613 - DNA, 16 bp, M. musculus
agagggccaggagaat

SEQ ID NO: 356614 - DNA, 16 bp, M. musculus
agagggccaggagagt

SEQ ID NO: 356615 - DNA, 16 bp, M. musculus
agagggcctgagtgtg

SEQ ID NO: 356616 - DNA, 16 bp, M. musculus
agagggcctgggtttg

SEQ ID NO: 356617 - DNA, 16 bp, M. musculus
agagggcgtcagatct

SEQ ID NO: 356618 - DNA, 16 bp, M. musculus
agagggctaatataca

SEQ ID NO: 356619 - DNA, 16 bp, M. musculus
agagggctcagggaca

SEQ ID NO: 356620 - DNA, 16 bp, M. musculus
agagggctcagtgttt

SEQ ID NO: 356621 - DNA, 16 bp, M. musculus
agagggctctgaggtc

SEQ ID NO: 356622 - DNA, 16 bp, M. musculus
agagggctgaggcagg

SEQ ID NO: 356623 - DNA, 16 bp, M. musculus
agagggctgatatcca

SEQ ID NO: 356624 - DNA, 16 bp, M. musculus
agagggcttcggatcc

SEQ ID NO: 356625 - DNA, 16 bp, M. musculus
agagggcttgatcttt

SEQ ID NO: 356626 - DNA, 16 bp, M. musculus
agaggggctggaaaga

SEQ ID NO: 356627 - DNA, 16 bp, M. musculus
agagggggaaactgag

SEQ ID NO: 356628 - DNA, 16 bp, M. musculus
agagggggctggagag

SEQ ID NO: 356629 - DNA, 16 bp, M. musculus
agaggggtcaagggca

SEQ ID NO: 356630 - DNA, 16 bp, M. musculus
agagggtacagggaca

SEQ ID NO: 356631 - DNA, 16 bp, M. musculus
agagggtctgcggcag

SEQ ID NO: 356632 - DNA, 16 bp, M. musculus
agagggtctgtggcac

SEQ ID NO: 356633 - DNA, 16 bp, M. musculus
agagggtgctggatct

SEQ ID NO: 356634 - DNA, 16 bp, M. musculus
agagggtggacaaggg

SEQ ID NO: 356635 - DNA, 16 bp, M. musculus
agagggtggcctagtt

SEQ ID NO: 356636 - DNA, 16 bp, M. musculus
agagggtggccttatc

SEQ ID NO: 356637 - DNA, 16 bp, M. musculus
agagggtggttctgat

SEQ ID NO: 356638 - DNA, 16 bp, M. musculus
agagggttagaatcca

SEQ ID NO: 356639 - DNA, 16 bp, M. musculus
agagggtttgcagagg

SEQ ID NO: 356640 - DNA, 16 bp, M. musculus
agagggtttgcagccc

SEQ ID NO: 356641 - DNA, 16 bp, M. musculus
agagggtttgtggagg

SEQ ID NO: 356642 - DNA, 16 bp, M. musculus
agaggtagaggtagag

SEQ ID NO: 356643 - DNA, 16 bp, M. musculus
agaggtaggctgatct

SEQ ID NO: 356644 - DNA, 16 bp, M. musculus
agaggtaggtagattt

SEQ ID NO: 356645 - DNA, 16 bp, M. musculus
agaggtaggtgggttt

SEQ ID NO: 356646 - DNA, 16 bp, M. musculus
agaggtattggaaaga

SEQ ID NO: 356647 - DNA, 16 bp, M. musculus
agaggtcaaaatatca

SEQ ID NO: 356648 - DNA, 16 bp, M. musculus
agaggtcaaaggacaa

SEQ ID NO: 356649 - DNA, 16 bp, M. musculus
agaggtcaaaggtcaa

SEQ ID NO: 356650 - DNA, 16 bp, M. musculus
agaggtcaacatcagg

SEQ ID NO: 356651 - DNA, 16 bp, M. musculus
agaggtcaactttcag

SEQ ID NO: 356652 - DNA, 16 bp, M. musculus
agaggtcagaaaaggg

SEQ ID NO: 356653 - DNA, 16 bp, M. musculus
agaggtcagaagagga

SEQ ID NO: 356654 - DNA, 16 bp, M. musculus
agaggtcagaagaggg

SEQ ID NO: 356655 - DNA, 16 bp, M. musculus
agaggtcagagaataa

SEQ ID NO: 356656 - DNA, 16 bp, M. musculus
agaggtcagagcacag

SEQ ID NO: 356657 - DNA, 16 bp, M. musculus
agaggtcagaggacaa

SEQ ID NO: 356658 - DNA, 16 bp, M. musculus
agaggtcagaggacag

SEQ ID NO: 356659 - DNA, 16 bp, M. musculus
agaggtcagaggtcaa

SEQ ID NO: 356660 - DNA, 16 bp, M. musculus
agaggtcagcagcttc

SEQ ID NO: 356661 - DNA, 16 bp, M. musculus
agaggtcaggggtcag

SEQ ID NO: 356662 - DNA, 16 bp, M. musculus
agaggtcatgaaggaa

SEQ ID NO: 356663 - DNA, 16 bp, M. musculus
agaggtcatggaaggc

SEQ ID NO: 356664 - DNA, 16 bp, M. musculus
agaggtccaaagactc

SEQ ID NO: 356665 - DNA, 16 bp, M. musculus
agaggtccacctgcct

SEQ ID NO: 356666 - DNA, 16 bp, M. musculus
agaggtcctaaattca

SEQ ID NO: 356667 - DNA, 16 bp, M. musculus
agaggtcctgagttcc

SEQ ID NO: 356668 - DNA, 16 bp, M. musculus
agaggtcctgagttct

SEQ ID NO: 356669 - DNA, 16 bp, M. musculus
agaggtcctgtctcaa

SEQ ID NO: 356670 - DNA, 16 bp, M. musculus
agaggtccttggtctt

SEQ ID NO: 356671 - DNA, 16 bp, M. musculus
agaggtctgcaaagaa

SEQ ID NO: 356672 - DNA, 16 bp, M. musculus
agaggtcttgagttca

SEQ ID NO: 356673 - DNA, 16 bp, M. musculus
agaggtctttgatcca

SEQ ID NO: 356674 - DNA, 16 bp, M. musculus
agaggtgaagacagaa

SEQ ID NO: 356675 - DNA, 16 bp, M. musculus
agaggtgactcagtgg

SEQ ID NO: 356676 - DNA, 16 bp, M. musculus
agaggtgagaaaccct

SEQ ID NO: 356677 - DNA, 16 bp, M. musculus
agaggtgcagggagag

SEQ ID NO: 356678 - DNA, 16 bp, M. musculus
agaggtgctgaggcag

SEQ ID NO: 356679 - DNA, 16 bp, M. musculus
agaggtgctgagttca

SEQ ID NO: 356680 - DNA, 16 bp, M. musculus
agaggtggaggaaaac

SEQ ID NO: 356681 - DNA, 16 bp, M. musculus
agaggtggaggcagag

SEQ ID NO: 356682 - DNA, 17 bp, M. musculus
agaggtggaggcagagg

SEQ ID NO: 356683 - DNA, 16 bp, M. musculus
agaggtggaggcagga

SEQ ID NO: 356684 - DNA, 16 bp, M. musculus
agaggtggcccagcag

SEQ ID NO: 356685 - DNA, 16 bp, M. musculus
agaggtggcccagtgg

SEQ ID NO: 356686 - DNA, 16 bp, M. musculus
agaggtggctcagagg

SEQ ID NO: 356687 - DNA, 16 bp, M. musculus
agaggtggggacagga

SEQ ID NO: 356688 - DNA, 16 bp, M. musculus
agaggtgggtggatct

SEQ ID NO: 356689 - DNA, 16 bp, M. musculus
agaggtggtcctcccc

SEQ ID NO: 356690 - DNA, 16 bp, M. musculus
agaggtggttctttga

SEQ ID NO: 356691 - DNA, 16 bp, M. musculus
agaggtgttagaatta

SEQ ID NO: 356692 - DNA, 16 bp, M. musculus
agaggttaagagcacc

SEQ ID NO: 356693 - DNA, 16 bp, M. musculus
agaggttctgagttca

SEQ ID NO: 356694 - DNA, 17 bp, M. musculus
agaggttgcaggcgaga

SEQ ID NO: 356695 - DNA, 16 bp, M. musculus
agaggttgttggatcc

SEQ ID NO: 356696 - DNA, 24 bp, M. musculus
agaggtttaaagtattttcagtag

SEQ ID NO: 356697 - DNA, 16 bp, M. musculus
agaggtttagggtagg

SEQ ID NO: 356698 - DNA, 16 bp, M. musculus
agaggtttagttcatt

SEQ ID NO: 356699 - DNA, 16 bp, M. musculus
agaggtttcagagaag

SEQ ID NO: 356700 - DNA, 16 bp, M. musculus
agagtaaaaggctgga

SEQ ID NO: 356701 - DNA, 16 bp, M. musculus
agagtaagaaaggtga

SEQ ID NO: 356702 - DNA, 16 bp, M. musculus
agagtaagaccctgtc

SEQ ID NO: 356703 - DNA, 16 bp, M. musculus
agagtaagagagtgag

SEQ ID NO: 356704 - DNA, 16 bp, M. musculus
agagtacaggaactct

SEQ ID NO: 356705 - DNA, 16 bp, M. musculus
agagtactctccacac

SEQ ID NO: 356706 - DNA, 16 bp, M. musculus
agagtactctctgaag

SEQ ID NO: 356707 - DNA, 16 bp, M. musculus
agagtacttgcttagc

SEQ ID NO: 356708 - DNA, 16 bp, M. musculus
agagtacttgttgctt

SEQ ID NO: 356709 - DNA, 16 bp, M. musculus
agagtagaagcaaaga

SEQ ID NO: 356710 - DNA, 16 bp, M. musculus
agagtagacatgacct

SEQ ID NO: 356711 - DNA, 16 bp, M. musculus
agagtagtcaaggttt

SEQ ID NO: 356712 - DNA, 16 bp, M. musculus
agagtcaaaggctgga

SEQ ID NO: 356713 - DNA, 16 bp, M. musculus
agagtcaacaaaacca

SEQ ID NO: 356714 - DNA, 19 bp, M. musculus
agagtcaatcctgtacatg

SEQ ID NO: 356715 - DNA, 16 bp, M. musculus
agagtcacttgggaag

SEQ ID NO: 356716 - DNA, 16 bp, M. musculus
agagtcagacagagac

SEQ ID NO: 356717 - DNA, 16 bp, M. musculus
agagtcagagacagag

SEQ ID NO: 356718 - DNA, 16 bp, M. musculus
agagtcagagacagcc

SEQ ID NO: 356719 - DNA, 16 bp, M. musculus
agagtcagaggagaga

SEQ ID NO: 356720 - DNA, 16 bp, M. musculus
agagtcagaggcagga

SEQ ID NO: 356721 - DNA, 16 bp, M. musculus
agagtcagagtcagag

SEQ ID NO: 356722 - DNA, 16 bp, M. musculus
agagtcagatgaagat

SEQ ID NO: 356723 - DNA, 16 bp, M. musculus
agagtcagcctacagg

SEQ ID NO: 356724 - DNA, 16 bp, M. musculus
agagtcagttctctcc

SEQ ID NO: 356725 - DNA, 16 bp, M. musculus
agagtcatctgggaaa

SEQ ID NO: 356726 - DNA, 16 bp, M. musculus
agagtccagaaaaggg

SEQ ID NO: 356727 - DNA, 16 bp, M. musculus
agagtccatggccatc

SEQ ID NO: 356728 - DNA, 16 bp, M. musculus
agagtccccaagttcc

SEQ ID NO: 356729 - DNA, 16 bp, M. musculus
agagtcctttgaaaat

SEQ ID NO: 356730 - DNA, 16 bp, M. musculus
agagtctcagagaaga

SEQ ID NO: 356731 - DNA, 16 bp, M. musculus
agagtctctcactgga

SEQ ID NO: 356732 - DNA, 16 bp, M. musculus
agagtctctgctgaga

SEQ ID NO: 356733 - DNA, 16 bp, M. musculus
agagtctctgtgtgtg

SEQ ID NO: 356734 - DNA, 16 bp, M. musculus
agagtctgaaagaaag

SEQ ID NO: 356735 - DNA, 16 bp, M. musculus
agagtctgaacatgag

SEQ ID NO: 356736 - DNA, 16 bp, M. musculus
agagtctgactttgaa

SEQ ID NO: 356737 - DNA, 16 bp, M. musculus
agagtctgatgcagat

SEQ ID NO: 356738 - DNA, 16 bp, M. musculus
agagtctgcatgacct

SEQ ID NO: 356739 - DNA, 16 bp, M. musculus
agagtctgcccagcta

SEQ ID NO: 356740 - DNA, 16 bp, M. musculus
agagtctgcctgaggc

SEQ ID NO: 356741 - DNA, 16 bp, M. musculus
agagtcttgaagttct

SEQ ID NO: 356742 - DNA, 16 bp, M. musculus
agagtgaaagaccttg

SEQ ID NO: 356743 - DNA, 16 bp, M. musculus
agagtgaagattacca

SEQ ID NO: 356744 - DNA, 16 bp, M. musculus
agagtgaagatttcca

SEQ ID NO: 356745 - DNA, 16 bp, M. musculus
agagtgaatgaatgaa

SEQ ID NO: 356746 - DNA, 16 bp, M. musculus
agagtgaccaggagcc

SEQ ID NO: 356747 - DNA, 16 bp, M. musculus
agagtgagagcgagag

SEQ ID NO: 356748 - DNA, 16 bp, M. musculus
agagtgagatccagaa

SEQ ID NO: 356749 - DNA, 16 bp, M. musculus
agagtgagcaaggaga

SEQ ID NO: 356750 - DNA, 16 bp, M. musculus
agagtgagctccaggg

SEQ ID NO: 356751 - DNA, 16 bp, M. musculus
agagtgagtctcagga

SEQ ID NO: 356752 - DNA, 17 bp, M. musculus
agagtgagttccaggaa

SEQ ID NO: 356753 - DNA, 16 bp, M. musculus
agagtgagttccagtg

SEQ ID NO: 356754 - DNA, 16 bp, M. musculus
agagtgagttcctgaa

SEQ ID NO: 356755 - DNA, 16 bp, M. musculus
agagtgagtttccagg

SEQ ID NO: 356756 - DNA, 16 bp, M. musculus
agagtgatccagggag

SEQ ID NO: 356757 - DNA, 17 bp, M. musculus
agagtgcaagagccaga

SEQ ID NO: 356758 - DNA, 16 bp, M. musculus
agagtgctacagaagg

SEQ ID NO: 356759 - DNA, 16 bp, M. musculus
agagtgctacagaggg

SEQ ID NO: 356760 - DNA, 16 bp, M. musculus
agagtgctcctccacc

SEQ ID NO: 356761 - DNA, 16 bp, M. musculus
agagtggaccagaaaa

SEQ ID NO: 356762 - DNA, 16 bp, M. musculus
agagtggccagccttg

SEQ ID NO: 356763 - DNA, 16 bp, M. musculus
agagtggcctcaaact

SEQ ID NO: 356764 - DNA, 16 bp, M. musculus
agagtggccttggtca

SEQ ID NO: 356765 - DNA, 16 bp, M. musculus
agagtggctgtacaag

SEQ ID NO: 356766 - DNA, 16 bp, M. musculus
agagtgggagaaataa

SEQ ID NO: 356767 - DNA, 16 bp, M. musculus
agagtgggagacttca

SEQ ID NO: 356768 - DNA, 16 bp, M. musculus
agagtggggaggcagg

SEQ ID NO: 356769 - DNA, 16 bp, M. musculus
agagtggtcagccttg

SEQ ID NO: 356770 - DNA, 16 bp, M. musculus
agagtggtggcacatg

SEQ ID NO: 356771 - DNA, 19 bp, M. musculus
agagtgtaagaagcaagag

SEQ ID NO: 356772 - DNA, 16 bp, M. musculus
agagtgtcaggtcccc

SEQ ID NO: 356773 - DNA, 16 bp, M. musculus
agagtgtgaggccagc

SEQ ID NO: 356774 - DNA, 16 bp, M. musculus
agagtgtgatgactga

SEQ ID NO: 356775 - DNA, 16 bp, M. musculus
agagtgtgccaccatg

SEQ ID NO: 356776 - DNA, 16 bp, M. musculus
agagtgtgcttttgaa

SEQ ID NO: 356777 - DNA, 16 bp, M. musculus
agagtgtggaccacag

SEQ ID NO: 356778 - DNA, 16 bp, M. musculus
agagtgtggactacag

SEQ ID NO: 356779 - DNA, 16 bp, M. musculus
agagtgtggagaaaga

SEQ ID NO: 356780 - DNA, 16 bp, M. musculus
agagtgtgtctgtgtg

SEQ ID NO: 356781 - DNA, 16 bp, M. musculus
agagtgtgtgcagcct

SEQ ID NO: 356782 - DNA, 16 bp, M. musculus
agagtgtgtgtatgag

SEQ ID NO: 356783 - DNA, 16 bp, M. musculus
agagtgttcccccacc

SEQ ID NO: 356784 - DNA, 16 bp, M. musculus
agagtgttcttgctca

SEQ ID NO: 356785 - DNA, 16 bp, M. musculus
agagtgtttgcctagt

SEQ ID NO: 356786 - DNA, 16 bp, M. musculus
agagttacaaagacaa

SEQ ID NO: 356787 - DNA, 16 bp, M. musculus
agagttacagagaaaa

SEQ ID NO: 356788 - DNA, 16 bp, M. musculus
agagttagaaagggca

SEQ ID NO: 356789 - DNA, 16 bp, M. musculus
agagttagagaaaggg

SEQ ID NO: 356790 - DNA, 16 bp, M. musculus
agagttaggtgcatca

SEQ ID NO: 356791 - DNA, 16 bp, M. musculus
agagttatcacagaga

SEQ ID NO: 356792 - DNA, 26 bp, M. musculus
agagttatcacagagaaaggagcttc

SEQ ID NO: 356793 - DNA, 16 bp, M. musculus
agagttatgccaaggt

SEQ ID NO: 356794 - DNA, 16 bp, M. musculus
agagttcaaggccagc

SEQ ID NO: 356795 - DNA, 18 bp, M. musculus
agagttcaaggtcagcct

SEQ ID NO: 356796 - DNA, 16 bp, M. musculus
agagttcagaaagaac

SEQ ID NO: 356797 - DNA, 16 bp, M. musculus
agagttcagctttctc

SEQ ID NO: 356798 - DNA, 16 bp, M. musculus
agagttcatcatggta

SEQ ID NO: 356799 - DNA, 16 bp, M. musculus
agagttccaggacagc

SEQ ID NO: 356800 - DNA, 16 bp, M. musculus
agagttccaggacagt

SEQ ID NO: 356801 - DNA, 16 bp, M. musculus
agagttccaggagcat

SEQ ID NO: 356802 - DNA, 16 bp, M. musculus
agagttccagggcagc

SEQ ID NO: 356803 - DNA, 16 bp, M. musculus
agagttcgaggccagc

SEQ ID NO: 356804 - DNA, 16 bp, M. musculus
agagttctacatcttt

SEQ ID NO: 356805 - DNA, 16 bp, M. musculus
agagttcttaaccact

SEQ ID NO: 356806 - DNA, 16 bp, M. musculus
agagttcttcagtttc

SEQ ID NO: 356807 - DNA, 16 bp, M. musculus
agagttcttcctgttt

SEQ ID NO: 356808 - DNA, 16 bp, M. musculus
agagttcttctcttcc

SEQ ID NO: 356809 - DNA, 16 bp, M. musculus
agagttgaccagagtg

SEQ ID NO: 356810 - DNA, 16 bp, M. musculus
agagttgcagacagtt

SEQ ID NO: 356811 - DNA, 16 bp, M. musculus
agagttgccatggtca

SEQ ID NO: 356812 - DNA, 16 bp, M. musculus
agagttggagatctga

SEQ ID NO: 356813 - DNA, 16 bp, M. musculus
agagttggaggaagaa

SEQ ID NO: 356814 - DNA, 16 bp, M. musculus
agagttggagtttatt

SEQ ID NO: 356815 - DNA, 16 bp, M. musculus
agagttggcagccttg

SEQ ID NO: 356816 - DNA, 16 bp, M. musculus
agagttggctcagagg

SEQ ID NO: 356817 - DNA, 16 bp, M. musculus
agagttgtaatgtttg

SEQ ID NO: 356818 - DNA, 16 bp, M. musculus
agagttgtggaaccca

SEQ ID NO: 356819 - DNA, 16 bp, M. musculus
agagttgtggagtcca

SEQ ID NO: 356820 - DNA, 16 bp, M. musculus
agagtttaaagaaaat

SEQ ID NO: 356821 - DNA, 16 bp, M. musculus
agagtttaaatctttc

SEQ ID NO: 356822 - DNA, 16 bp, M. musculus
agagtttattaagggc

SEQ ID NO: 356823 - DNA, 16 bp, M. musculus
agagtttattgaaaat

SEQ ID NO: 356824 - DNA, 16 bp, M. musculus
agagtttatttaaaaa

SEQ ID NO: 356825 - DNA, 16 bp, M. musculus
agagtttattttgctt

SEQ ID NO: 356826 - DNA, 16 bp, M. musculus
agagtttcaacttaaa

SEQ ID NO: 356827 - DNA, 16 bp, M. musculus
agagtttctactgctg

SEQ ID NO: 356828 - DNA, 16 bp, M. musculus
agagtttctattgctg

SEQ ID NO: 356829 - DNA, 16 bp, M. musculus
agagtttctccatgta

SEQ ID NO: 356830 - DNA, 16 bp, M. musculus
agagtttcttttattg

SEQ ID NO: 356831 - DNA, 16 bp, M. musculus
agagtttgaactccca

SEQ ID NO: 356832 - DNA, 16 bp, M. musculus
agagtttgagagaaaa

SEQ ID NO: 356833 - DNA, 16 bp, M. musculus
agagtttgaggccagc

SEQ ID NO: 356834 - DNA, 16 bp, M. musculus
agagtttgcagcccca

SEQ ID NO: 356835 - DNA, 16 bp, M. musculus
agagtttgcctagcat

SEQ ID NO: 356836 - DNA, 16 bp, M. musculus
agagtttggaggacaa

SEQ ID NO: 356837 - DNA, 16 bp, M. musculus
agagtttggatcccag

SEQ ID NO: 356838 - DNA, 16 bp, M. musculus
agagtttggctggata

SEQ ID NO: 356839 - DNA, 16 bp, M. musculus
agagttttatttttct

SEQ ID NO: 356840 - DNA, 16 bp, M. musculus
agagttttctcccttt

SEQ ID NO: 356841 - DNA, 16 bp, M. musculus
agataaaaacagaagg

SEQ ID NO: 356842 - DNA, 16 bp, M. musculus
agataaaaagagatca

SEQ ID NO: 356843 - DNA, 17 bp, M. musculus
agataaaaattcagaaa

SEQ ID NO: 356844 - DNA, 16 bp, M. musculus
agataaaatgcaagct

SEQ ID NO: 356845 - DNA, 16 bp, M. musculus
agataaacaagaagga

SEQ ID NO: 356846 - DNA, 16 bp, M. musculus
agataaacacaaatga

SEQ ID NO: 356847 - DNA, 16 bp, M. musculus
agataaactctttcct

SEQ ID NO: 356848 - DNA, 16 bp, M. musculus
agataaacttgaagca

SEQ ID NO: 356849 - DNA, 16 bp, M. musculus
agataaagaaactgag

SEQ ID NO: 356850 - DNA, 16 bp, M. musculus
agataaagatggagca

SEQ ID NO: 356851 - DNA, 16 bp, M. musculus
agataaagcaagaaag

SEQ ID NO: 356852 - DNA, 16 bp, M. musculus
agataaaggatgttgt

SEQ ID NO: 356853 - DNA, 16 bp, M. musculus
agataaatagatagat

SEQ ID NO: 356854 - DNA, 16 bp, M. musculus
agataaattatctaaa

SEQ ID NO: 356855 - DNA, 16 bp, M. musculus
agataacatttgaaat

SEQ ID NO: 356856 - DNA, 16 bp, M. musculus
agataacattttaaaa

SEQ ID NO: 356857 - DNA, 16 bp, M. musculus
agataaccagatggtg

SEQ ID NO: 356858 - DNA, 16 bp, M. musculus
agataactacagaaca

SEQ ID NO: 356859 - DNA, 16 bp, M. musculus
agataaggaggggcac

SEQ ID NO: 356860 - DNA, 16 bp, M. musculus
agataaggctggcctc

SEQ ID NO: 356861 - DNA, 16 bp, M. musculus
agataatagataatag

SEQ ID NO: 356862 - DNA, 16 bp, M. musculus
agataatcagcctcta

SEQ ID NO: 356863 - DNA, 16 bp, M. musculus
agataatgagtgaatt

SEQ ID NO: 356864 - DNA, 16 bp, M. musculus
agatacaagatacaaa

SEQ ID NO: 356865 - DNA, 19 bp, M. musculus
agatacactcgtgtccagg

SEQ ID NO: 356866 - DNA, 16 bp, M. musculus
agatacagaaaatgtg

SEQ ID NO: 356867 - DNA, 16 bp, M. musculus
agatacagaaagacag

SEQ ID NO: 356868 - DNA, 16 bp, M. musculus
agatacagagacagaa

SEQ ID NO: 356869 - DNA, 16 bp, M. musculus
agatacagagagacag

SEQ ID NO: 356870 - DNA, 16 bp, M. musculus
agatacagagagatac

SEQ ID NO: 356871 - DNA, 16 bp, M. musculus
agatacagcactccct

SEQ ID NO: 356872 - DNA, 16 bp, M. musculus
agatacagtagaagaa

SEQ ID NO: 356873 - DNA, 16 bp, M. musculus
agatacataaatagat

SEQ ID NO: 356874 - DNA, 16 bp, M. musculus
agatacatagagagat

SEQ ID NO: 356875 - DNA, 16 bp, M. musculus
agatacatgcatacat

SEQ ID NO: 356876 - DNA, 16 bp, M. musculus
agatacattatataga

SEQ ID NO: 356877 - DNA, 16 bp, M. musculus
agatacattttatttt

SEQ ID NO: 356878 - DNA, 16 bp, M. musculus
agatacattttttaaa

SEQ ID NO: 356879 - DNA, 16 bp, M. musculus
agatacattttttttt

SEQ ID NO: 356880 - DNA, 16 bp, M. musculus
agatactccagaagaa

SEQ ID NO: 356881 - DNA, 16 bp, M. musculus
agatactgcctcaaaa

SEQ ID NO: 356882 - DNA, 16 bp, M. musculus
agatacttacagacaa

SEQ ID NO: 356883 - DNA, 16 bp, M. musculus
agatacttacattatg

SEQ ID NO: 356884 - DNA, 16 bp, M. musculus
agatactttaaaaaat

SEQ ID NO: 356885 - DNA, 16 bp, M. musculus
agatactttcttcatt

SEQ ID NO: 356886 - DNA, 16 bp, M. musculus
agatactttgcccctt

SEQ ID NO: 356887 - DNA, 16 bp, M. musculus
agatacttttgtggat

SEQ ID NO: 356888 - DNA, 16 bp, M. musculus
agatacttttttaaaa

SEQ ID NO: 356889 - DNA, 16 bp, M. musculus
agatagaaaacccagg

SEQ ID NO: 356890 - DNA, 16 bp, M. musculus
agatagaaatctttta

SEQ ID NO: 356891 - DNA, 16 bp, M. musculus
agatagaagaatctca

SEQ ID NO: 356892 - DNA, 16 bp, M. musculus
agatagaagattctga

SEQ ID NO: 356893 - DNA, 16 bp, M. musculus
agatagacagacagac

SEQ ID NO: 356894 - DNA, 16 bp, M. musculus
agatagacagactgac

SEQ ID NO: 356895 - DNA, 16 bp, M. musculus
agatagagacagagga

SEQ ID NO: 356896 - DNA, 16 bp, M. musculus
agatagagacctggga

SEQ ID NO: 356897 - DNA, 16 bp, M. musculus
agatagagaggcagag

SEQ ID NO: 356898 - DNA, 16 bp, M. musculus
agatagagatcttcag

SEQ ID NO: 356899 - DNA, 16 bp, M. musculus
agatagagctctgtga

SEQ ID NO: 356900 - DNA, 16 bp, M. musculus
agatagaggcagagag

SEQ ID NO: 356901 - DNA, 16 bp, M. musculus
agatagaggcaggaag

SEQ ID NO: 356902 - DNA, 16 bp, M. musculus
agatagaggtttgcca

SEQ ID NO: 356903 - DNA, 16 bp, M. musculus
agatagataaatcttt

SEQ ID NO: 356904 - DNA, 16 bp, M. musculus
agatagatacatacat

SEQ ID NO: 356905 - DNA, 16 bp, M. musculus
agatagatactgctta

SEQ ID NO: 356906 - DNA, 16 bp, M. musculus
agatagatagacaaat

SEQ ID NO: 356907 - DNA, 16 bp, M. musculus
agatagatagatggag

SEQ ID NO: 356908 - DNA, 16 bp, M. musculus
agatagatagatggca

SEQ ID NO: 356909 - DNA, 16 bp, M. musculus
agatagatagatttat

SEQ ID NO: 356910 - DNA, 16 bp, M. musculus
agatagatgagagaga

SEQ ID NO: 356911 - DNA, 16 bp, M. musculus
agatagatttttaaaa

SEQ ID NO: 356912 - DNA, 16 bp, M. musculus
agatagcaagagcatt

SEQ ID NO: 356913 - DNA, 16 bp, M. musculus
agatagccctggggct

SEQ ID NO: 356914 - DNA, 16 bp, M. musculus
agatagctcagcaagt

SEQ ID NO: 356915 - DNA, 16 bp, M. musculus
agatagcttctgggtt

SEQ ID NO: 356916 - DNA, 16 bp, M. musculus
agataggagacccaaa

SEQ ID NO: 356917 - DNA, 16 bp, M. musculus
agataggagagagaat

SEQ ID NO: 356918 - DNA, 16 bp, M. musculus
agataggatctcatgt

SEQ ID NO: 356919 - DNA, 16 bp, M. musculus
agatagggtttctctg

SEQ ID NO: 356920 - DNA, 17 bp, M. musculus
agatagggtttctctgt

SEQ ID NO: 356921 - DNA, 16 bp, M. musculus
agataggtgtgagctg

SEQ ID NO: 356922 - DNA, 16 bp, M. musculus
agatagtcttcaaaaa

SEQ ID NO: 356923 - DNA, 18 bp, M. musculus
agatagtgtttgaccttg

SEQ ID NO: 356924 - DNA, 16 bp, M. musculus
agatagttgatagata

SEQ ID NO: 356925 - DNA, 16 bp, M. musculus
agatagttgtaagcca

SEQ ID NO: 356926 - DNA, 16 bp, M. musculus
agatatacacacatgc

SEQ ID NO: 356927 - DNA, 16 bp, M. musculus
agatatacctgcctct

SEQ ID NO: 356928 - DNA, 16 bp, M. musculus
agatatagagacaaag

SEQ ID NO: 356929 - DNA, 16 bp, M. musculus
agatatagagacagag

SEQ ID NO: 356930 - DNA, 16 bp, M. musculus
agatatatacatacat

SEQ ID NO: 356931 - DNA, 16 bp, M. musculus
agatatatacatatat

SEQ ID NO: 356932 - DNA, 16 bp, M. musculus
agatatattcttcatt

SEQ ID NO: 356933 - DNA, 16 bp, M. musculus
agatatattttctttt

SEQ ID NO: 356934 - DNA, 16 bp, M. musculus
agatatctgcctgcct

SEQ ID NO: 356935 - DNA, 16 bp, M. musculus
agatatctgtaatgac

SEQ ID NO: 356936 - DNA, 16 bp, M. musculus
agatatgaatttaaat

SEQ ID NO: 356937 - DNA, 16 bp, M. musculus
agatatgaccttagta

SEQ ID NO: 356938 - DNA, 16 bp, M. musculus
agatatgactgatttt

SEQ ID NO: 356939 - DNA, 16 bp, M. musculus
agatatgatgctggag

SEQ ID NO: 356940 - DNA, 30 bp, M. musculus
agatatgcccctgctgccctgattagctga

SEQ ID NO: 356941 - DNA, 16 bp, M. musculus
agatatggaaaaggat

SEQ ID NO: 356942 - DNA, 16 bp, M. musculus
agatatggacacagga

SEQ ID NO: 356943 - DNA, 16 bp, M. musculus
agatatggagacaaag

SEQ ID NO: 356944 - DNA, 16 bp, M. musculus
agatatgtacattatg

SEQ ID NO: 356945 - DNA, 16 bp, M. musculus
agatattaaaatggct

SEQ ID NO: 356946 - DNA, 16 bp, M. musculus
agatattattgttcag

SEQ ID NO: 356947 - DNA, 16 bp, M. musculus
agatattcttagctct

SEQ ID NO: 356948 - DNA, 16 bp, M. musculus
agatattgcctctgaa

SEQ ID NO: 356949 - DNA, 16 bp, M. musculus
agatattgctgacagg

SEQ ID NO: 356950 - DNA, 16 bp, M. musculus
agatattgtgtgaact

SEQ ID NO: 356951 - DNA, 16 bp, M. musculus
agatattgttttaaag

SEQ ID NO: 356952 - DNA, 16 bp, M. musculus
agatatttactggcca

SEQ ID NO: 356953 - DNA, 16 bp, M. musculus
agatatttagctcatt

SEQ ID NO: 356954 - DNA, 16 bp, M. musculus
agatatttatattatg

SEQ ID NO: 356955 - DNA, 16 bp, M. musculus
agatattttatacttt

SEQ ID NO: 356956 - DNA, 16 bp, M. musculus
agatattttcattata

SEQ ID NO: 356957 - DNA, 16 bp, M. musculus
agatattttctaaatt

SEQ ID NO: 356958 - DNA, 16 bp, M. musculus
agatattttcttattt

SEQ ID NO: 356959 - DNA, 16 bp, M. musculus
agatattttgtcacag

SEQ ID NO: 356960 - DNA, 16 bp, M. musculus
agatatttttaaatga

SEQ ID NO: 356961 - DNA, 16 bp, M. musculus
agatattttttaaagt

SEQ ID NO: 356962 - DNA, 16 bp, M. musculus
agatatttttttctct

SEQ ID NO: 356963 - DNA, 16 bp, M. musculus
agatcaaaaattaata

SEQ ID NO: 356964 - DNA, 16 bp, M. musculus
agatcaaaatgtagaa

SEQ ID NO: 356965 - DNA, 16 bp, M. musculus
agatcaaaccagtcaa

SEQ ID NO: 356966 - DNA, 16 bp, M. musculus
agatcaaacccagggc

SEQ ID NO: 356967 - DNA, 16 bp, M. musculus
agatcaacatgaagat

SEQ ID NO: 356968 - DNA, 16 bp, M. musculus
agatcaagaagataca

SEQ ID NO: 356969 - DNA, 16 bp, M. musculus
agatcaagaattcaag

SEQ ID NO: 356970 - DNA, 16 bp, M. musculus
agatcaagatacttgg

SEQ ID NO: 356971 - DNA, 16 bp, M. musculus
agatcaagcttgcccc

SEQ ID NO: 356972 - DNA, 16 bp, M. musculus
agatcaatgaaataaa

SEQ ID NO: 356973 - DNA, 16 bp, M. musculus
agatcacaaattcagg

SEQ ID NO: 356974 - DNA, 16 bp, M. musculus
agatcaccaatcttaa

SEQ ID NO: 356975 - DNA, 16 bp, M. musculus
agatcaccacaacatg

SEQ ID NO: 356976 - DNA, 16 bp, M. musculus
agatcaccactgacta

SEQ ID NO: 356977 - DNA, 16 bp, M. musculus
agatcacctggcacag

SEQ ID NO: 356978 - DNA, 16 bp, M. musculus
agatcactggttctca

SEQ ID NO: 356979 - DNA, 16 bp, M. musculus
agatcagaaactcagg

SEQ ID NO: 356980 - DNA, 16 bp, M. musculus
agatcagaagacaatt

SEQ ID NO: 356981 - DNA, 16 bp, M. musculus
agatcagcaaagatgt

SEQ ID NO: 356982 - DNA, 16 bp, M. musculus
agatcagcagttctca

SEQ ID NO: 356983 - DNA, 16 bp, M. musculus
agatcagcctgggcta

SEQ ID NO: 356984 - DNA, 16 bp, M. musculus
agatcagctgagacat

SEQ ID NO: 356985 - DNA, 16 bp, M. musculus
agatcaggaaatcaag

SEQ ID NO: 356986 - DNA, 16 bp, M. musculus
agatcaggctagcttt

SEQ ID NO: 356987 - DNA, 16 bp, M. musculus
agatcaggctggcttt

SEQ ID NO: 356988 - DNA, 16 bp, M. musculus
agatcagggatacaag

SEQ ID NO: 356989 - DNA, 16 bp, M. musculus
agatcaggttcccctc

SEQ ID NO: 356990 - DNA, 16 bp, M. musculus
agatcagtgaagatgt

SEQ ID NO: 356991 - DNA, 16 bp, M. musculus
agatcatcacggacta

SEQ ID NO: 356992 - DNA, 16 bp, M. musculus
agatcatcatcatcat

SEQ ID NO: 356993 - DNA, 16 bp, M. musculus
agatcatggaagcaga

SEQ ID NO: 356994 - DNA, 16 bp, M. musculus
agatcatggccatcac

SEQ ID NO: 356995 - DNA, 16 bp, M. musculus
agatccaaattcaggt

SEQ ID NO: 356996 - DNA, 16 bp, M. musculus
agatccaacaaagaca

SEQ ID NO: 356997 - DNA, 16 bp, M. musculus
agatccaatgtcctct

SEQ ID NO: 356998 - DNA, 16 bp, M. musculus
agatccaattatttta

SEQ ID NO: 356999 - DNA, 16 bp, M. musculus
agatccacatgaagac

SEQ ID NO: 357000 - DNA, 16 bp, M. musculus
agatccaccagcctct

SEQ ID NO: 357001 - DNA, 16 bp, M. musculus
agatccacctgcctct

SEQ ID NO: 357002 - DNA, 16 bp, M. musculus
agatccacctgtttct

SEQ ID NO: 357003 - DNA, 16 bp, M. musculus
agatccaccttcctct

SEQ ID NO: 357004 - DNA, 16 bp, M. musculus
agatccacttgcctcc

SEQ ID NO: 357005 - DNA, 16 bp, M. musculus
agatccagcaatttct

SEQ ID NO: 357006 - DNA, 30 bp, M. musculus
agatccagctgtaaggcattttctcaatta

SEQ ID NO: 357007 - DNA, 16 bp, M. musculus
agatccaggccagcct

SEQ ID NO: 357008 - DNA, 16 bp, M. musculus
agatccaggtcagcca

SEQ ID NO: 357009 - DNA, 16 bp, M. musculus
agatccatccttttgc

SEQ ID NO: 357010 - DNA, 16 bp, M. musculus
agatcccaagttgggc

SEQ ID NO: 357011 - DNA, 16 bp, M. musculus
agatcccatctcaaaa

SEQ ID NO: 357012 - DNA, 16 bp, M. musculus
agatcccattccagat

SEQ ID NO: 357013 - DNA, 16 bp, M. musculus
agatccccctgcctcc

SEQ ID NO: 357014 - DNA, 16 bp, M. musculus
agatccccctgcctct

SEQ ID NO: 357015 - DNA, 16 bp, M. musculus
agatcccctgaagctg

SEQ ID NO: 357016 - DNA, 16 bp, M. musculus
agatcccctgcctctg

SEQ ID NO: 357017 - DNA, 17 bp, M. musculus
agatcccgtggagggtc

SEQ ID NO: 357018 - DNA, 16 bp, M. musculus
agatccctatcctcag

SEQ ID NO: 357019 - DNA, 16 bp, M. musculus
agatccctggaactgg

SEQ ID NO: 357020 - DNA, 16 bp, M. musculus
agatccctggggctcc

SEQ ID NO: 357021 - DNA, 16 bp, M. musculus
agatcccttcagctcc

SEQ ID NO: 357022 - DNA, 16 bp, M. musculus
agatcctaaaattcaa

SEQ ID NO: 357023 - DNA, 16 bp, M. musculus
agatcctatctcaaaa

SEQ ID NO: 357024 - DNA, 16 bp, M. musculus
agatcctcctacctct

SEQ ID NO: 357025 - DNA, 16 bp, M. musculus
agatcctcctgtctca

SEQ ID NO: 357026 - DNA, 16 bp, M. musculus
agatcctcctgtctct

SEQ ID NO: 357027 - DNA, 16 bp, M. musculus
agatcctctcagagga

SEQ ID NO: 357028 - DNA, 16 bp, M. musculus
agatcctctggagctg

SEQ ID NO: 357029 - DNA, 16 bp, M. musculus
agatcctgaagaaatt

SEQ ID NO: 357030 - DNA, 16 bp, M. musculus
agatcctgacagagag

SEQ ID NO: 357031 - DNA, 16 bp, M. musculus
agatcctgagtgtgct

SEQ ID NO: 357032 - DNA, 16 bp, M. musculus
agatcctgcagctttg

SEQ ID NO: 357033 - DNA, 16 bp, M. musculus
agatcctgcctcaaaa

SEQ ID NO: 357034 - DNA, 16 bp, M. musculus
agatcctgggcagaag

SEQ ID NO: 357035 - DNA, 16 bp, M. musculus
agatcctgggttcaaa

SEQ ID NO: 357036 - DNA, 16 bp, M. musculus
agatcctgtcacaaaa

SEQ ID NO: 357037 - DNA, 16 bp, M. musculus
agatcctgtctcaaaa

SEQ ID NO: 357038 - DNA, 16 bp, M. musculus
agatcctgtctcaagg

SEQ ID NO: 357039 - DNA, 16 bp, M. musculus
agatcctgtgtgtgtg

SEQ ID NO: 357040 - DNA, 16 bp, M. musculus
agatcctgtttcaaca

SEQ ID NO: 357041 - DNA, 16 bp, M. musculus
agatcctgtttcagaa

SEQ ID NO: 357042 - DNA, 16 bp, M. musculus
agatccttctgcttct

SEQ ID NO: 357043 - DNA, 16 bp, M. musculus
agatcctttcctgtgg

SEQ ID NO: 357044 - DNA, 16 bp, M. musculus
agatcctttctcaaaa

SEQ ID NO: 357045 - DNA, 16 bp, M. musculus
agatcgagctggagag

SEQ ID NO: 357046 - DNA, 16 bp, M. musculus
agatcgagttccagga

SEQ ID NO: 357047 - DNA, 16 bp, M. musculus
agatctaaaggaacag

SEQ ID NO: 357048 - DNA, 16 bp, M. musculus
agatctacctgaagaa

SEQ ID NO: 357049 - DNA, 16 bp, M. musculus
agatctatttcaaatt

SEQ ID NO: 357050 - DNA, 16 bp, M. musculus
agatctatttccaaat

SEQ ID NO: 357051 - DNA, 16 bp, M. musculus
agatctcacatggctg

SEQ ID NO: 357052 - DNA, 16 bp, M. musculus
agatctcacattaaaa

SEQ ID NO: 357053 - DNA, 16 bp, M. musculus
agatctcagctgctgc

SEQ ID NO: 357054 - DNA, 16 bp, M. musculus
agatctcagtggtcca

SEQ ID NO: 357055 - DNA, 16 bp, M. musculus
agatctccaactcctt

SEQ ID NO: 357056 - DNA, 16 bp, M. musculus
agatctcccaaacact

SEQ ID NO: 357057 - DNA, 16 bp, M. musculus
agatctccctgcctct

SEQ ID NO: 357058 - DNA, 16 bp, M. musculus
agatctccctgggaag

SEQ ID NO: 357059 - DNA, 17 bp, M. musculus
agatctccggggtccag

SEQ ID NO: 357060 - DNA, 16 bp, M. musculus
agatctcctagaactg

SEQ ID NO: 357061 - DNA, 16 bp, M. musculus
agatctcctttgattt

SEQ ID NO: 357062 - DNA, 16 bp, M. musculus
agatctcgagggtcca

SEQ ID NO: 357063 - DNA, 16 bp, M. musculus
agatctctaaactccc

SEQ ID NO: 357064 - DNA, 16 bp, M. musculus
agatctctgagttcaa

SEQ ID NO: 357065 - DNA, 16 bp, M. musculus
agatctctgagttcga

SEQ ID NO: 357066 - DNA, 16 bp, M. musculus
agatctctgtgacttt

SEQ ID NO: 357067 - DNA, 16 bp, M. musculus
agatctctgtggaaag

SEQ ID NO: 357068 - DNA, 16 bp, M. musculus
agatctcttgagttca

SEQ ID NO: 357069 - DNA, 16 bp, M. musculus
agatctgaaaactgct

SEQ ID NO: 357070 - DNA, 16 bp, M. musculus
agatctgaagagcatt

SEQ ID NO: 357071 - DNA, 16 bp, M. musculus
agatctgacaccctca

SEQ ID NO: 357072 - DNA, 21 bp, M. musculus
agatctgactccctcttctgg

SEQ ID NO: 357073 - DNA, 16 bp, M. musculus
agatctgatgcccttt

SEQ ID NO: 357074 - DNA, 16 bp, M. musculus
agatctgcctgtctcc

SEQ ID NO: 357075 - DNA, 16 bp, M. musculus
agatctgcctgtcttt

SEQ ID NO: 357076 - DNA, 16 bp, M. musculus
agatctgccttcttct

SEQ ID NO: 357077 - DNA, 16 bp, M. musculus
agatctgctgcctctg

SEQ ID NO: 357078 - DNA, 16 bp, M. musculus
agatctggcattcagc

SEQ ID NO: 357079 - DNA, 17 bp, M. musculus
agatctgggaggtgaga

SEQ ID NO: 357080 - DNA, 17 bp, M. musculus
agatctgggtgcccgtc

SEQ ID NO: 357081 - DNA, 16 bp, M. musculus
agatctgtcagcctct

SEQ ID NO: 357082 - DNA, 16 bp, M. musculus
agatctgtctgcctct

SEQ ID NO: 357083 - DNA, 16 bp, M. musculus
agatctgtcttcctct

SEQ ID NO: 357084 - DNA, 16 bp, M. musculus
agatcttacactagca

SEQ ID NO: 357085 - DNA, 16 bp, M. musculus
agatcttagaggagaa

SEQ ID NO: 357086 - DNA, 16 bp, M. musculus
agatcttatttatttt

SEQ ID NO: 357087 - DNA, 16 bp, M. musculus
agatcttcaagtctct

SEQ ID NO: 357088 - DNA, 16 bp, M. musculus
agatcttcatgaagac

SEQ ID NO: 357089 - DNA, 16 bp, M. musculus
agatcttccatgctta

SEQ ID NO: 357090 - DNA, 16 bp, M. musculus
agatcttcccacttca

SEQ ID NO: 357091 - DNA, 16 bp, M. musculus
agatcttcctgaagac

SEQ ID NO: 357092 - DNA, 16 bp, M. musculus
agatcttcctgcctct

SEQ ID NO: 357093 - DNA, 16 bp, M. musculus
agatcttctaccagtt

SEQ ID NO: 357094 - DNA, 16 bp, M. musculus
agatcttctttgactt

SEQ ID NO: 357095 - DNA, 16 bp, M. musculus
agatcttgaggctggg

SEQ ID NO: 357096 - DNA, 16 bp, M. musculus
agatcttggacagatg

SEQ ID NO: 357097 - DNA, 16 bp, M. musculus
agatcttgtctcaaaa

SEQ ID NO: 357098 - DNA, 16 bp, M. musculus
agatcttgtctcacaa

SEQ ID NO: 357099 - DNA, 16 bp, M. musculus
agatcttgtctcagaa

SEQ ID NO: 357100 - DNA, 16 bp, M. musculus
agatcttgttatggat

SEQ ID NO: 357101 - DNA, 16 bp, M. musculus
agatcttgtttcaaaa

SEQ ID NO: 357102 - DNA, 17 bp, M. musculus
agatctttaatttcttt

SEQ ID NO: 357103 - DNA, 16 bp, M. musculus
agatctttcacctgct

SEQ ID NO: 357104 - DNA, 16 bp, M. musculus
agatctttcccttcct

SEQ ID NO: 357105 - DNA, 16 bp, M. musculus
agatctttctcttcct

SEQ ID NO: 357106 - DNA, 16 bp, M. musculus
agatctttctgaactc

SEQ ID NO: 357107 - DNA, 16 bp, M. musculus
agatctttgaaagtct

SEQ ID NO: 357108 - DNA, 17 bp, M. musculus
agatctttgacttcctt

SEQ ID NO: 357109 - DNA, 16 bp, M. musculus
agatctttttgtttcc

SEQ ID NO: 357110 - DNA, 16 bp, M. musculus
agatgaaaatatattt

SEQ ID NO: 357111 - DNA, 16 bp, M. musculus
agatgaaatatcaaag

SEQ ID NO: 357112 - DNA, 16 bp, M. musculus
agatgaaatcaaaata

SEQ ID NO: 357113 - DNA, 16 bp, M. musculus
agatgaaatccaggaa

SEQ ID NO: 357114 - DNA, 16 bp, M. musculus
agatgaacatgtggtt

SEQ ID NO: 357115 - DNA, 16 bp, M. musculus
agatgaaccagaagag

SEQ ID NO: 357116 - DNA, 16 bp, M. musculus
agatgaagaaaaagca

SEQ ID NO: 357117 - DNA, 16 bp, M. musculus
agatgaagaaaagctt

SEQ ID NO: 357118 - DNA, 16 bp, M. musculus
agatgaagaaaatggg

SEQ ID NO: 357119 - DNA, 16 bp, M. musculus
agatgaagaaacaaag

SEQ ID NO: 357120 - DNA, 16 bp, M. musculus
agatgaagaaactaag

SEQ ID NO: 357121 - DNA, 16 bp, M. musculus
agatgaagaaagacag

SEQ ID NO: 357122 - DNA, 16 bp, M. musculus
agatgaagaaattgaa

SEQ ID NO: 357123 - DNA, 16 bp, M. musculus
agatgaagaaattgag

SEQ ID NO: 357124 - DNA, 16 bp, M. musculus
agatgaagaagctgag

SEQ ID NO: 357125 - DNA, 16 bp, M. musculus
agatgaagacaaagaa

SEQ ID NO: 357126 - DNA, 16 bp, M. musculus
agatgaagactgaagt

SEQ ID NO: 357127 - DNA, 16 bp, M. musculus
agatgaagatagagcg

SEQ ID NO: 357128 - DNA, 19 bp, M. musculus
agatgaagatgaagatgaa

SEQ ID NO: 357129 - DNA, 16 bp, M. musculus
agatgaagatggagaa

SEQ ID NO: 357130 - DNA, 16 bp, M. musculus
agatgaagatggagcg

SEQ ID NO: 357131 - DNA, 16 bp, M. musculus
agatgaagatgtggaa

SEQ ID NO: 357132 - DNA, 16 bp, M. musculus
agatgaagcagaaaga

SEQ ID NO: 357133 - DNA, 16 bp, M. musculus
agatgaagcctctctg

SEQ ID NO: 357134 - DNA, 19 bp, M. musculus
agatgaaggagattagaga

SEQ ID NO: 357135 - DNA, 16 bp, M. musculus
agatgaaggagttagc

SEQ ID NO: 357136 - DNA, 16 bp, M. musculus
agatgaatgtctacca

SEQ ID NO: 357137 - DNA, 16 bp, M. musculus
agatgaatgtggaaca

SEQ ID NO: 357138 - DNA, 16 bp, M. musculus
agatgaatgtgtgtgt

SEQ ID NO: 357139 - DNA, 16 bp, M. musculus
agatgaatttaagaat

SEQ ID NO: 357140 - DNA, 16 bp, M. musculus
agatgaatttacagat

SEQ ID NO: 357141 - DNA, 16 bp, M. musculus
agatgaatttgaagat

SEQ ID NO: 357142 - DNA, 16 bp, M. musculus
agatgacaaccaggaa

SEQ ID NO: 357143 - DNA, 17 bp, M. musculus
agatgacatcaagaagg

SEQ ID NO: 357144 - DNA, 16 bp, M. musculus
agatgaccatgaacat

SEQ ID NO: 357145 - DNA, 16 bp, M. musculus
agatgactcagctgtt

SEQ ID NO: 357146 - DNA, 16 bp, M. musculus
agatgactgtcagcat

SEQ ID NO: 357147 - DNA, 16 bp, M. musculus
agatgactgtgaggat

SEQ ID NO: 357148 - DNA, 16 bp, M. musculus
agatgactgtgtgcat

SEQ ID NO: 357149 - DNA, 16 bp, M. musculus
agatgagaaaactgag

SEQ ID NO: 357150 - DNA, 16 bp, M. musculus
agatgagaaaatggag

SEQ ID NO: 357151 - DNA, 16 bp, M. musculus
agatgagaagaggcag

SEQ ID NO: 357152 - DNA, 16 bp, M. musculus
agatgagaagcagaga

SEQ ID NO: 357153 - DNA, 16 bp, M. musculus
agatgagacagagaga

SEQ ID NO: 357154 - DNA, 16 bp, M. musculus
agatgagagatgagag

SEQ ID NO: 357155 - DNA, 16 bp, M. musculus
agatgagagtgtggac

SEQ ID NO: 357156 - DNA, 16 bp, M. musculus
agatgagcaagccagg

SEQ ID NO: 357157 - DNA, 16 bp, M. musculus
agatgagcagcttggt

SEQ ID NO: 357158 - DNA, 16 bp, M. musculus
agatgaggaacatgca

SEQ ID NO: 357159 - DNA, 16 bp, M. musculus
agatgaggaagctgac

SEQ ID NO: 357160 - DNA, 16 bp, M. musculus
agatgaggaagctgag

SEQ ID NO: 357161 - DNA, 16 bp, M. musculus
agatgaggagaaagca

SEQ ID NO: 357162 - DNA, 16 bp, M. musculus
agatgaggagactgag

SEQ ID NO: 357163 - DNA, 68 bp, M. musculus
agatgaggatggaaaatcaggaaatattcagccgtatgttatgccaaatttgcctgtaaccctgtggg

SEQ ID NO: 357164 - DNA, 16 bp, M. musculus
agatgaggatgtagaa

SEQ ID NO: 357165 - DNA, 16 bp, M. musculus
agatgaggcagaaaga

SEQ ID NO: 357166 - DNA, 16 bp, M. musculus
agatgaggctgcagat

SEQ ID NO: 357167 - DNA, 16 bp, M. musculus
agatgaggctggagag

SEQ ID NO: 357168 - DNA, 16 bp, M. musculus
agatgaggtcagttgc

SEQ ID NO: 357169 - DNA, 16 bp, M. musculus
agatgagtgggattgg

SEQ ID NO: 357170 - DNA, 16 bp, M. musculus
agatgataaattgttt

SEQ ID NO: 357171 - DNA, 16 bp, M. musculus
agatgataatgaagat

SEQ ID NO: 357172 - DNA, 16 bp, M. musculus
agatgatcaagtggtt

SEQ ID NO: 357173 - DNA, 16 bp, M. musculus
agatgatcctcactga

SEQ ID NO: 357174 - DNA, 16 bp, M. musculus
agatgatgagaggcaa

SEQ ID NO: 357175 - DNA, 16 bp, M. musculus
agatgatggctcagtg

SEQ ID NO: 357176 - DNA, 16 bp, M. musculus
agatgatggggagaca

SEQ ID NO: 357177 - DNA, 16 bp, M. musculus
agatgattgtgagctg

SEQ ID NO: 357178 - DNA, 16 bp, M. musculus
agatgatttaaagtat

SEQ ID NO: 357179 - DNA, 16 bp, M. musculus
agatgatttttttcta

SEQ ID NO: 357180 - DNA, 17 bp, M. musculus
agatgcaaaacacatga

SEQ ID NO: 357181 - DNA, 16 bp, M. musculus
agatgcaagcatcatc

SEQ ID NO: 357182 - DNA, 16 bp, M. musculus
agatgcaatcatcacc

SEQ ID NO: 357183 - DNA, 16 bp, M. musculus
agatgcacacatgtgc

SEQ ID NO: 357184 - DNA, 16 bp, M. musculus
agatgcagaaaaccct

SEQ ID NO: 357185 - DNA, 16 bp, M. musculus
agatgcagaaactgag

SEQ ID NO: 357186 - DNA, 16 bp, M. musculus
agatgcagaactctca

SEQ ID NO: 357187 - DNA, 16 bp, M. musculus
agatgcagagaaagaa

SEQ ID NO: 357188 - DNA, 16 bp, M. musculus
agatgcagagagagac

SEQ ID NO: 357189 - DNA, 16 bp, M. musculus
agatgcagagagagag

SEQ ID NO: 357190 - DNA, 16 bp, M. musculus
agatgcagagatgcag

SEQ ID NO: 357191 - DNA, 16 bp, M. musculus
agatgcagagtttgga

SEQ ID NO: 357192 - DNA, 16 bp, M. musculus
agatgcagatgctcac

SEQ ID NO: 357193 - DNA, 16 bp, M. musculus
agatgcaggaggatct

SEQ ID NO: 357194 - DNA, 16 bp, M. musculus
agatgcagtcattaat

SEQ ID NO: 357195 - DNA, 16 bp, M. musculus
agatgcagtttggagt

SEQ ID NO: 357196 - DNA, 16 bp, M. musculus
agatgcatatgtaaca

SEQ ID NO: 357197 - DNA, 16 bp, M. musculus
agatgcatcccaggct

SEQ ID NO: 357198 - DNA, 16 bp, M. musculus
agatgccagagccatg

SEQ ID NO: 357199 - DNA, 16 bp, M. musculus
agatgccagcaccatg

SEQ ID NO: 357200 - DNA, 16 bp, M. musculus
agatgccaggcaggca

SEQ ID NO: 357201 - DNA, 16 bp, M. musculus
agatgccagtactatg

SEQ ID NO: 357202 - DNA, 16 bp, M. musculus
agatgcccaggagtgg

SEQ ID NO: 357203 - DNA, 16 bp, M. musculus
agatgcccatgaagat

SEQ ID NO: 357204 - DNA, 16 bp, M. musculus
agatgcccattacaga

SEQ ID NO: 357205 - DNA, 16 bp, M. musculus
agatgccccaaatatt

SEQ ID NO: 357206 - DNA, 17 bp, M. musculus
agatgcccctcaacaga

SEQ ID NO: 357207 - DNA, 16 bp, M. musculus
agatgcccctcaacat

SEQ ID NO: 357208 - DNA, 16 bp, M. musculus
agatgcccctgcctct

SEQ ID NO: 357209 - DNA, 16 bp, M. musculus
agatgccctagtcggc

SEQ ID NO: 357210 - DNA, 16 bp, M. musculus
agatgcctcagtggat

SEQ ID NO: 357211 - DNA, 16 bp, M. musculus
agatgcctgcctctgc

SEQ ID NO: 357212 - DNA, 16 bp, M. musculus
agatgcctggaagtca

SEQ ID NO: 357213 - DNA, 16 bp, M. musculus
agatgcctgtgagcca

SEQ ID NO: 357214 - DNA, 17 bp, M. musculus
agatgccttccaggctt

SEQ ID NO: 357215 - DNA, 16 bp, M. musculus
agatgccttcttttgc

SEQ ID NO: 357216 - DNA, 16 bp, M. musculus
agatgcctttgcagct

SEQ ID NO: 357217 - DNA, 20 bp, M. musculus
agatgcgacagtaatttcct

SEQ ID NO: 357218 - DNA, 20 bp, M. musculus
agatgctaagaggaacgctg

SEQ ID NO: 357219 - DNA, 16 bp, M. musculus
agatgctatctcaaaa

SEQ ID NO: 357220 - DNA, 16 bp, M. musculus
agatgctcccagccaa

SEQ ID NO: 357221 - DNA, 16 bp, M. musculus
agatgctgaagaggat

SEQ ID NO: 357222 - DNA, 16 bp, M. musculus
agatgctgacaaagca

SEQ ID NO: 357223 - DNA, 16 bp, M. musculus
agatgctgagaaaaag

SEQ ID NO: 357224 - DNA, 16 bp, M. musculus
agatgctgagaaagaa

SEQ ID NO: 357225 - DNA, 16 bp, M. musculus
agatgctgagaaatca

SEQ ID NO: 357226 - DNA, 16 bp, M. musculus
agatgctgaggaagca

SEQ ID NO: 357227 - DNA, 16 bp, M. musculus
agatgctgaggaggag

SEQ ID NO: 357228 - DNA, 16 bp, M. musculus
agatgctgccgaggat

SEQ ID NO: 357229 - DNA, 16 bp, M. musculus
agatgctgctgctgct

SEQ ID NO: 357230 - DNA, 16 bp, M. musculus
agatgctggaaacaac

SEQ ID NO: 357231 - DNA, 16 bp, M. musculus
agatgctggaaacaga

SEQ ID NO: 357232 - DNA, 16 bp, M. musculus
agatgctggaaaggat

SEQ ID NO: 357233 - DNA, 16 bp, M. musculus
agatgctggagagaat

SEQ ID NO: 357234 - DNA, 16 bp, M. musculus
agatgctggagagatg

SEQ ID NO: 357235 - DNA, 16 bp, M. musculus
agatgctggagaggat

SEQ ID NO: 357236 - DNA, 16 bp, M. musculus
agatgctggcctggat

SEQ ID NO: 357237 - DNA, 16 bp, M. musculus
agatgctgggaaggat

SEQ ID NO: 357238 - DNA, 16 bp, M. musculus
agatgctggggtgggc

SEQ ID NO: 357239 - DNA, 16 bp, M. musculus
agatgctgtgttccac

SEQ ID NO: 357240 - DNA, 16 bp, M. musculus
agatgctgttgaggat

SEQ ID NO: 357241 - DNA, 16 bp, M. musculus
agatgcttcctctccc

SEQ ID NO: 357242 - DNA, 16 bp, M. musculus
agatgcttgctgccaa

SEQ ID NO: 357243 - DNA, 16 bp, M. musculus
agatgcttgtgagcca

SEQ ID NO: 357244 - DNA, 16 bp, M. musculus
agatggaaaaactgag

SEQ ID NO: 357245 - DNA, 16 bp, M. musculus
agatggaaaacctagg

SEQ ID NO: 357246 - DNA, 16 bp, M. musculus
agatggaaaccagaaa

SEQ ID NO: 357247 - DNA, 16 bp, M. musculus
agatggaaacctgaag

SEQ ID NO: 357248 - DNA, 16 bp, M. musculus
agatggaaagaactca

SEQ ID NO: 357249 - DNA, 16 bp, M. musculus
agatggaaagacccac

SEQ ID NO: 357250 - DNA, 16 bp, M. musculus
agatggaaagctctcc

SEQ ID NO: 357251 - DNA, 18 bp, M. musculus
agatggaaagttctccca

SEQ ID NO: 357252 - DNA, 16 bp, M. musculus
agatggaagaagctga

SEQ ID NO: 357253 - DNA, 16 bp, M. musculus
agatggaagcctggct

SEQ ID NO: 357254 - DNA, 16 bp, M. musculus
agatggaaggaaaggc

SEQ ID NO: 357255 - DNA, 16 bp, M. musculus
agatggaagtgagaat

SEQ ID NO: 357256 - DNA, 16 bp, M. musculus
agatggaatcttaggg

SEQ ID NO: 357257 - DNA, 16 bp, M. musculus
agatggacagatggat

SEQ ID NO: 357258 - DNA, 16 bp, M. musculus
agatggagaaaacaag

SEQ ID NO: 357259 - DNA, 16 bp, M. musculus
agatggagaaactaaa

SEQ ID NO: 357260 - DNA, 16 bp, M. musculus
agatggagaaactgaa

SEQ ID NO: 357261 - DNA, 16 bp, M. musculus
agatggagaaactgag

SEQ ID NO: 357262 - DNA, 16 bp, M. musculus
agatggagaaagcaaa

SEQ ID NO: 357263 - DNA, 16 bp, M. musculus
agatggagaaaggtaa

SEQ ID NO: 357264 - DNA, 16 bp, M. musculus
agatggagaaatcaaa

SEQ ID NO: 357265 - DNA, 16 bp, M. musculus
agatggagaactctca

SEQ ID NO: 357266 - DNA, 16 bp, M. musculus
agatggagaagccaaa

SEQ ID NO: 357267 - DNA, 16 bp, M. musculus
agatggagacaggaag

SEQ ID NO: 357268 - DNA, 16 bp, M. musculus
agatggagatggagat

SEQ ID NO: 357269 - DNA, 16 bp, M. musculus
agatggagctctggtt

SEQ ID NO: 357270 - DNA, 16 bp, M. musculus
agatggaggaaccaaa

SEQ ID NO: 357271 - DNA, 16 bp, M. musculus
agatggaggagatgta

SEQ ID NO: 357272 - DNA, 16 bp, M. musculus
agatggaggatggaga

SEQ ID NO: 357273 - DNA, 16 bp, M. musculus
agatggatagatggat

SEQ ID NO: 357274 - DNA, 16 bp, M. musculus
agatggatcagtgggt

SEQ ID NO: 357275 - DNA, 16 bp, M. musculus
agatggatggacggac

SEQ ID NO: 357276 - DNA, 16 bp, M. musculus
agatggattcccaggt

SEQ ID NO: 357277 - DNA, 16 bp, M. musculus
agatggcaaaagacaa

SEQ ID NO: 357278 - DNA, 17 bp, M. musculus
agatggcaaaaggtaaa

SEQ ID NO: 357279 - DNA, 16 bp, M. musculus
agatggcacagcaggt

SEQ ID NO: 357280 - DNA, 16 bp, M. musculus
agatggcaccatccac

SEQ ID NO: 357281 - DNA, 16 bp, M. musculus
agatggcacccaggac

SEQ ID NO: 357282 - DNA, 16 bp, M. musculus
agatggcagagtgagt

SEQ ID NO: 357283 - DNA, 16 bp, M. musculus
agatggccacttcagg

SEQ ID NO: 357284 - DNA, 16 bp, M. musculus
agatggccagatggcc

SEQ ID NO: 357285 - DNA, 16 bp, M. musculus
agatggccatcactgg

SEQ ID NO: 357286 - DNA, 16 bp, M. musculus
agatggccatcagtgg

SEQ ID NO: 357287 - DNA, 16 bp, M. musculus
agatggcccagtggtt

SEQ ID NO: 357288 - DNA, 21 bp, M. musculus
agatggcctaatcggccatca

SEQ ID NO: 357289 - DNA, 16 bp, M. musculus
agatggcctagtgggc

SEQ ID NO: 357290 - DNA, 16 bp, M. musculus
agatggcctggtggga

SEQ ID NO: 357291 - DNA, 16 bp, M. musculus
agatggccttgtcaga

SEQ ID NO: 357292 - DNA, 16 bp, M. musculus
agatggcgccctggcc

SEQ ID NO: 357293 - DNA, 17 bp, M. musculus
agatggctataaaatat

SEQ ID NO: 357294 - DNA, 16 bp, M. musculus
agatggctcactgatt

SEQ ID NO: 357295 - DNA, 16 bp, M. musculus
agatggctcactgggt

SEQ ID NO: 357296 - DNA, 16 bp, M. musculus
agatggctcagcaaga

SEQ ID NO: 357297 - DNA, 16 bp, M. musculus
agatggctcagcaagt

SEQ ID NO: 357298 - DNA, 16 bp, M. musculus
agatggctcagcagat

SEQ ID NO: 357299 - DNA, 16 bp, M. musculus
agatggctcagctgct

SEQ ID NO: 357300 - DNA, 16 bp, M. musculus
agatggctcagctggt

SEQ ID NO: 357301 - DNA, 16 bp, M. musculus
agatggctcagtaggg

SEQ ID NO: 357302 - DNA, 16 bp, M. musculus
agatggctcagtaggt

SEQ ID NO: 357303 - DNA, 16 bp, M. musculus
agatggctccgtggat

SEQ ID NO: 357304 - DNA, 16 bp, M. musculus
agatggctctgaagag

SEQ ID NO: 357305 - DNA, 16 bp, M. musculus
agatggctctgtggtc

SEQ ID NO: 357306 - DNA, 16 bp, M. musculus
agatggctgagtggtt

SEQ ID NO: 357307 - DNA, 16 bp, M. musculus
agatggctggagagat

SEQ ID NO: 357308 - DNA, 16 bp, M. musculus
agatggctggttcagg

SEQ ID NO: 357309 - DNA, 16 bp, M. musculus
agatggctgtgggcca

SEQ ID NO: 357310 - DNA, 16 bp, M. musculus
agatggcttagcaatt

SEQ ID NO: 357311 - DNA, 16 bp, M. musculus
agatggcttagtgggt

SEQ ID NO: 357312 - DNA, 16 bp, M. musculus
agatgggaagatctct

SEQ ID NO: 357313 - DNA, 16 bp, M. musculus
agatgggatggatcca

SEQ ID NO: 357314 - DNA, 16 bp, M. musculus
agatgggatgggatgg

SEQ ID NO: 357315 - DNA, 16 bp, M. musculus
agatgggcagagataa

SEQ ID NO: 357316 - DNA, 16 bp, M. musculus
agatgggctgcccaca

SEQ ID NO: 357317 - DNA, 16 bp, M. musculus
agatggggaaactgag

SEQ ID NO: 357318 - DNA, 16 bp, M. musculus
agatggggaaaggcaa

SEQ ID NO: 357319 - DNA, 16 bp, M. musculus
agatggggccactaac

SEQ ID NO: 357320 - DNA, 16 bp, M. musculus
agatgggggctggaga

SEQ ID NO: 357321 - DNA, 16 bp, M. musculus
agatgggtgggtggat

SEQ ID NO: 357322 - DNA, 16 bp, M. musculus
agatgggtgggtggct

SEQ ID NO: 357323 - DNA, 16 bp, M. musculus
agatggtagtgagcca

SEQ ID NO: 357324 - DNA, 16 bp, M. musculus
agatggtccagcagtt

SEQ ID NO: 357325 - DNA, 16 bp, M. musculus
agatggtgaaaccaag

SEQ ID NO: 357326 - DNA, 16 bp, M. musculus
agatggtgaaagacaa

SEQ ID NO: 357327 - DNA, 18 bp, M. musculus
agatggtgactaagcaga

SEQ ID NO: 357328 - DNA, 16 bp, M. musculus
agatggttcagcagtt

SEQ ID NO: 357329 - DNA, 16 bp, M. musculus
agatggttcagtgagt

SEQ ID NO: 357330 - DNA, 16 bp, M. musculus
agatggttgtgaacct

SEQ ID NO: 357331 - DNA, 23 bp, M. musculus
agatggttgtgagccaccatgtg

SEQ ID NO: 357332 - DNA, 16 bp, M. musculus
agatggttgtgagctg

SEQ ID NO: 357333 - DNA, 16 bp, M. musculus
agatggttttgagtca

SEQ ID NO: 357334 - DNA, 16 bp, M. musculus
agatgtaaaattctca

SEQ ID NO: 357335 - DNA, 16 bp, M. musculus
agatgtaacacactca

SEQ ID NO: 357336 - DNA, 16 bp, M. musculus
agatgtaacccatttc

SEQ ID NO: 357337 - DNA, 16 bp, M. musculus
agatgtagaactctca

SEQ ID NO: 357338 - DNA, 16 bp, M. musculus
agatgtagagtttgga

SEQ ID NO: 357339 - DNA, 16 bp, M. musculus
agatgtatccattggg

SEQ ID NO: 357340 - DNA, 16 bp, M. musculus
agatgtattaaagctg

SEQ ID NO: 357341 - DNA, 16 bp, M. musculus
agatgtcaacctctgg

SEQ ID NO: 357342 - DNA, 17 bp, M. musculus
agatgtccctcaacaga

SEQ ID NO: 357343 - DNA, 16 bp, M. musculus
agatgtccctgcctct

SEQ ID NO: 357344 - DNA, 16 bp, M. musculus
agatgtctcagtgggt

SEQ ID NO: 357345 - DNA, 16 bp, M. musculus
agatgtctcagtgttt

SEQ ID NO: 357346 - DNA, 16 bp, M. musculus
agatgtctccatcctg

SEQ ID NO: 357347 - DNA, 27 bp, M. musculus
agatgtctgctgctgatgctcaggcaa

SEQ ID NO: 357348 - DNA, 16 bp, M. musculus
agatgtctgtgagttc

SEQ ID NO: 357349 - DNA, 16 bp, M. musculus
agatgtgaacaaaagt

SEQ ID NO: 357350 - DNA, 17 bp, M. musculus
agatgtgaatgaagaaa

SEQ ID NO: 357351 - DNA, 16 bp, M. musculus
agatgtgaattctcag

SEQ ID NO: 357352 - DNA, 16 bp, M. musculus
agatgtgactgagaac

SEQ ID NO: 357353 - DNA, 18 bp, M. musculus
agatgtgagcatcagcaa

SEQ ID NO: 357354 - DNA, 16 bp, M. musculus
agatgtgagctctcag

SEQ ID NO: 357355 - DNA, 16 bp, M. musculus
agatgtgatgctggag

SEQ ID NO: 357356 - DNA, 16 bp, M. musculus
agatgtgccagcacca

SEQ ID NO: 357357 - DNA, 16 bp, M. musculus
agatgtgcctgcttct

SEQ ID NO: 357358 - DNA, 16 bp, M. musculus
agatgtgggccaccac

SEQ ID NO: 357359 - DNA, 16 bp, M. musculus
agatgtggggctggag

SEQ ID NO: 357360 - DNA, 16 bp, M. musculus
agatgtgggtgctggg

SEQ ID NO: 357361 - DNA, 16 bp, M. musculus
agatgtgtaccaggct

SEQ ID NO: 357362 - DNA, 16 bp, M. musculus
agatgtgtgccaggct

SEQ ID NO: 357363 - DNA, 16 bp, M. musculus
agatgtgtgtgctgtg

SEQ ID NO: 357364 - DNA, 16 bp, M. musculus
agatgtgttgcctctg

SEQ ID NO: 357365 - DNA, 16 bp, M. musculus
agatgtgtttcctgta

SEQ ID NO: 357366 - DNA, 16 bp, M. musculus
agatgtgtttcttgta

SEQ ID NO: 357367 - DNA, 16 bp, M. musculus
agatgttagaaaaatt

SEQ ID NO: 357368 - DNA, 16 bp, M. musculus
agatgttcagaactga

SEQ ID NO: 357369 - DNA, 16 bp, M. musculus
agatgttgaactctca

SEQ ID NO: 357370 - DNA, 16 bp, M. musculus
agatgttgagagaaag

SEQ ID NO: 357371 - DNA, 17 bp, M. musculus
agatgtttcaactggta

SEQ ID NO: 357372 - DNA, 16 bp, M. musculus
agatgtttgtggttta

SEQ ID NO: 357373 - DNA, 16 bp, M. musculus
agatgttttcttttat

SEQ ID NO: 357374 - DNA, 16 bp, M. musculus
agatgtttttcttctt

SEQ ID NO: 357375 - DNA, 16 bp, M. musculus
agattaaaacaacaac

SEQ ID NO: 357376 - DNA, 16 bp, M. musculus
agattaaaataaatgg

SEQ ID NO: 357377 - DNA, 16 bp, M. musculus
agattaaaattcttct

SEQ ID NO: 357378 - DNA, 19 bp, M. musculus
agattaaaggtgtgcgcca

SEQ ID NO: 357379 - DNA, 16 bp, M. musculus
agattaaatgtgtgta

SEQ ID NO: 357380 - DNA, 16 bp, M. musculus
agattaagagcactga

SEQ ID NO: 357381 - DNA, 16 bp, M. musculus
agattacaggtatgag

SEQ ID NO: 357382 - DNA, 17 bp, M. musculus
agattacaggtgtgtgc

SEQ ID NO: 357383 - DNA, 16 bp, M. musculus
agattaccagatggct

SEQ ID NO: 357384 - DNA, 16 bp, M. musculus
agattagcatggcccc

SEQ ID NO: 357385 - DNA, 17 bp, M. musculus
agattagtataagaaaa

SEQ ID NO: 357386 - DNA, 16 bp, M. musculus
agattatataataatc

SEQ ID NO: 357387 - DNA, 16 bp, M. musculus
agattatctttaattg

SEQ ID NO: 357388 - DNA, 16 bp, M. musculus
agattatgttgatgga

SEQ ID NO: 357389 - DNA, 16 bp, M. musculus
agattatttcaatatt

SEQ ID NO: 357390 - DNA, 16 bp, M. musculus
agattatttgtgctgg

SEQ ID NO: 357391 - DNA, 16 bp, M. musculus
agattatttttcttct

SEQ ID NO: 357392 - DNA, 16 bp, M. musculus
agattcaagagctctg

SEQ ID NO: 357393 - DNA, 16 bp, M. musculus
agattcaatgcgatcc

SEQ ID NO: 357394 - DNA, 16 bp, M. musculus
agattcagaggttcag

SEQ ID NO: 357395 - DNA, 16 bp, M. musculus
agattcagattttaaa

SEQ ID NO: 357396 - DNA, 16 bp, M. musculus
agattcaggatctgtg

SEQ ID NO: 357397 - DNA, 16 bp, M. musculus
agattccacctcagac

SEQ ID NO: 357398 - DNA, 16 bp, M. musculus
agattccataaagaac

SEQ ID NO: 357399 - DNA, 16 bp, M. musculus
agattcccagaaccca

SEQ ID NO: 357400 - DNA, 16 bp, M. musculus
agattccctcttccca

SEQ ID NO: 357401 - DNA, 16 bp, M. musculus
agattctatggctaaa

SEQ ID NO: 357402 - DNA, 16 bp, M. musculus
agattctctcttctat

SEQ ID NO: 357403 - DNA, 16 bp, M. musculus
agattctgaagaaatc

SEQ ID NO: 357404 - DNA, 16 bp, M. musculus
agattctgctacctgc

SEQ ID NO: 357405 - DNA, 16 bp, M. musculus
agattctggaaacaga

SEQ ID NO: 357406 - DNA, 16 bp, M. musculus
agattctgtcaagttg

SEQ ID NO: 357407 - DNA, 16 bp, M. musculus
agattcttctgctgtg

SEQ ID NO: 357408 - DNA, 16 bp, M. musculus
agattcttttcttctt

SEQ ID NO: 357409 - DNA, 16 bp, M. musculus
agattgacaaaccctt

SEQ ID NO: 357410 - DNA, 16 bp, M. musculus
agattgacaattatag

SEQ ID NO: 357411 - DNA, 16 bp, M. musculus
agattgaccttgaact

SEQ ID NO: 357412 - DNA, 16 bp, M. musculus
agattgagaaccactg

SEQ ID NO: 357413 - DNA, 16 bp, M. musculus
agattgagagagagag

SEQ ID NO: 357414 - DNA, 16 bp, M. musculus
agattgagagccactg

SEQ ID NO: 357415 - DNA, 16 bp, M. musculus
agattgaggaagacac

SEQ ID NO: 357416 - DNA, 16 bp, M. musculus
agattgctttgagttt

SEQ ID NO: 357417 - DNA, 16 bp, M. musculus
agattgctttttgtaa

SEQ ID NO: 357418 - DNA, 16 bp, M. musculus
agattggaaaagaatc

SEQ ID NO: 357419 - DNA, 16 bp, M. musculus
agattggcaggcagca

SEQ ID NO: 357420 - DNA, 16 bp, M. musculus
agattggccttgaact

SEQ ID NO: 357421 - DNA, 16 bp, M. musculus
agattgggaaaagttc

SEQ ID NO: 357422 - DNA, 16 bp, M. musculus
agattgggaaaatatt

SEQ ID NO: 357423 - DNA, 17 bp, M. musculus
agattgggaaaggatct

SEQ ID NO: 357424 - DNA, 16 bp, M. musculus
agattgggactgctga

SEQ ID NO: 357425 - DNA, 16 bp, M. musculus
agattggttgcttgct

SEQ ID NO: 357426 - DNA, 16 bp, M. musculus
agattgtatttatata

SEQ ID NO: 357427 - DNA, 16 bp, M. musculus
agattgtcagcaatga

SEQ ID NO: 357428 - DNA, 16 bp, M. musculus
agattgtcctctgacc

SEQ ID NO: 357429 - DNA, 16 bp, M. musculus
agattgtcttgaattt

SEQ ID NO: 357430 - DNA, 16 bp, M. musculus
agattgtgtgttttct

SEQ ID NO: 357431 - DNA, 16 bp, M. musculus
agattgttcagtggtt

SEQ ID NO: 357432 - DNA, 16 bp, M. musculus
agattgttgccatcaa

SEQ ID NO: 357433 - DNA, 16 bp, M. musculus
agattgtttacatagt

SEQ ID NO: 357434 - DNA, 16 bp, M. musculus
agattgtttccagctt

SEQ ID NO: 357435 - DNA, 16 bp, M. musculus
agatttaaaaatggaa

SEQ ID NO: 357436 - DNA, 16 bp, M. musculus
agatttaaaatctttt

SEQ ID NO: 357437 - DNA, 16 bp, M. musculus
agatttaaataacttt

SEQ ID NO: 357438 - DNA, 16 bp, M. musculus
agatttaaatttttct

SEQ ID NO: 357439 - DNA, 16 bp, M. musculus
agatttatttactttt

SEQ ID NO: 357440 - DNA, 16 bp, M. musculus
agatttatttattact

SEQ ID NO: 357441 - DNA, 16 bp, M. musculus
agatttatttccaaag

SEQ ID NO: 357442 - DNA, 16 bp, M. musculus
agatttatttctttta

SEQ ID NO: 357443 - DNA, 16 bp, M. musculus
agatttattttatctt

SEQ ID NO: 357444 - DNA, 16 bp, M. musculus
agatttattttttcat

SEQ ID NO: 357445 - DNA, 16 bp, M. musculus
agatttcaaaacaaaa

SEQ ID NO: 357446 - DNA, 16 bp, M. musculus
agatttcaaaagagaa

SEQ ID NO: 357447 - DNA, 17 bp, M. musculus
agatttcacctcaatga

SEQ ID NO: 357448 - DNA, 16 bp, M. musculus
agatttcatcttaccc

SEQ ID NO: 357449 - DNA, 16 bp, M. musculus
agatttccaacttaaa

SEQ ID NO: 357450 - DNA, 16 bp, M. musculus
agatttccctcagttt

SEQ ID NO: 357451 - DNA, 16 bp, M. musculus
agatttcctcttagaa

SEQ ID NO: 357452 - DNA, 16 bp, M. musculus
agatttcctggaacta

SEQ ID NO: 357453 - DNA, 16 bp, M. musculus
agatttcctttgccaa

SEQ ID NO: 357454 - DNA, 16 bp, M. musculus
agatttctattcattt

SEQ ID NO: 357455 - DNA, 16 bp, M. musculus
agatttctccattttc

SEQ ID NO: 357456 - DNA, 16 bp, M. musculus
agatttctctgagttc

SEQ ID NO: 357457 - DNA, 17 bp, M. musculus
agatttctgagttcaag

SEQ ID NO: 357458 - DNA, 26 bp, M. musculus
agatttctgagttcgaggccagcctg

SEQ ID NO: 357459 - DNA, 16 bp, M. musculus
agatttctgcattttg

SEQ ID NO: 357460 - DNA, 16 bp, M. musculus
agatttctgtgagttc

SEQ ID NO: 357461 - DNA, 16 bp, M. musculus
agatttctttctctct

SEQ ID NO: 357462 - DNA, 16 bp, M. musculus
agatttcttttcttta

SEQ ID NO: 357463 - DNA, 16 bp, M. musculus
agatttctttttttaa

SEQ ID NO: 357464 - DNA, 16 bp, M. musculus
agatttgaactcagaa

SEQ ID NO: 357465 - DNA, 16 bp, M. musculus
agatttgaactcagga

SEQ ID NO: 357466 - DNA, 16 bp, M. musculus
agatttgaattcttta

SEQ ID NO: 357467 - DNA, 16 bp, M. musculus
agatttgacagaatga

SEQ ID NO: 357468 - DNA, 16 bp, M. musculus
agatttgataaacttt

SEQ ID NO: 357469 - DNA, 16 bp, M. musculus
agatttgcctacaggc

SEQ ID NO: 357470 - DNA, 17 bp, M. musculus
agatttggctgccaatt

SEQ ID NO: 357471 - DNA, 16 bp, M. musculus
agatttgggaacaaaa

SEQ ID NO: 357472 - DNA, 17 bp, M. musculus
agatttgggaagttttc

SEQ ID NO: 357473 - DNA, 16 bp, M. musculus
agatttgtggccatca

SEQ ID NO: 357474 - DNA, 16 bp, M. musculus
agatttgttggggaat

SEQ ID NO: 357475 - DNA, 16 bp, M. musculus
agatttgtttatgtat

SEQ ID NO: 357476 - DNA, 16 bp, M. musculus
agattttaaaaaacaa

SEQ ID NO: 357477 - DNA, 16 bp, M. musculus
agattttaaaaacata

SEQ ID NO: 357478 - DNA, 16 bp, M. musculus
agattttaaaacaaag

SEQ ID NO: 357479 - DNA, 16 bp, M. musculus
agattttaaaagatgt

SEQ ID NO: 357480 - DNA, 16 bp, M. musculus
agattttaaaatgtgt

SEQ ID NO: 357481 - DNA, 16 bp, M. musculus
agattttaaagtttaa

SEQ ID NO: 357482 - DNA, 16 bp, M. musculus
agattttatcctcctc

SEQ ID NO: 357483 - DNA, 16 bp, M. musculus
agattttattcccctc

SEQ ID NO: 357484 - DNA, 16 bp, M. musculus
agattttattgaaaag

SEQ ID NO: 357485 - DNA, 16 bp, M. musculus
agattttcattcattt

SEQ ID NO: 357486 - DNA, 16 bp, M. musculus
agattttccagagtta

SEQ ID NO: 357487 - DNA, 16 bp, M. musculus
agattttccagtttgg

SEQ ID NO: 357488 - DNA, 16 bp, M. musculus
agattttccagtttta

SEQ ID NO: 357489 - DNA, 16 bp, M. musculus
agattttccagttttg

SEQ ID NO: 357490 - DNA, 16 bp, M. musculus
agattttctatttctt

SEQ ID NO: 357491 - DNA, 16 bp, M. musculus
agattttctgtttctt

SEQ ID NO: 357492 - DNA, 16 bp, M. musculus
agattttgaaaaatat

SEQ ID NO: 357493 - DNA, 16 bp, M. musculus
agattttgaaagaaaa

SEQ ID NO: 357494 - DNA, 16 bp, M. musculus
agattttgaacatttt

SEQ ID NO: 357495 - DNA, 16 bp, M. musculus
agattttggaatcaca

SEQ ID NO: 357496 - DNA, 16 bp, M. musculus
agattttgttacagat

SEQ ID NO: 357497 - DNA, 16 bp, M. musculus
agatttttaaaggaaa

SEQ ID NO: 357498 - DNA, 16 bp, M. musculus
agatttttaactcaaa

SEQ ID NO: 357499 - DNA, 16 bp, M. musculus
agatttttaccatgaa

SEQ ID NO: 357500 - DNA, 16 bp, M. musculus
agatttttcaaagcct

SEQ ID NO: 357501 - DNA, 16 bp, M. musculus
agatttttctaaacct

SEQ ID NO: 357502 - DNA, 16 bp, M. musculus
agatttttctcttcca

SEQ ID NO: 357503 - DNA, 16 bp, M. musculus
agattttttaaaagaa

SEQ ID NO: 357504 - DNA, 16 bp, M. musculus
agatttttttcaaaga

SEQ ID NO: 357505 - DNA, 16 bp, M. musculus
agatttttttccccca

SEQ ID NO: 357506 - DNA, 16 bp, M. musculus
agatttttttccccct

SEQ ID NO: 357507 - DNA, 16 bp, M. musculus
agatttttttgggggg

SEQ ID NO: 357508 - DNA, 16 bp, M. musculus
agattttttttcccca

SEQ ID NO: 357509 - DNA, 16 bp, M. musculus
agatttttttttcaat

SEQ ID NO: 357510 - DNA, 16 bp, M. musculus
agatttttttttccct

SEQ ID NO: 357511 - DNA, 16 bp, M. musculus
agcaaaaaaataattt

SEQ ID NO: 357512 - DNA, 16 bp, M. musculus
agcaaaaacagaagtg

SEQ ID NO: 357513 - DNA, 16 bp, M. musculus
agcaaaaacataagtg

SEQ ID NO: 357514 - DNA, 16 bp, M. musculus
agcaaaaattactttt

SEQ ID NO: 357515 - DNA, 16 bp, M. musculus
agcaaaacttttaatc

SEQ ID NO: 357516 - DNA, 16 bp, M. musculus
agcaaaagacacagtc

SEQ ID NO: 357517 - DNA, 16 bp, M. musculus
agcaaaagcagcagca

SEQ ID NO: 357518 - DNA, 16 bp, M. musculus
agcaaaagctgctctg

SEQ ID NO: 357519 - DNA, 16 bp, M. musculus
agcaaaagcttccttc

SEQ ID NO: 357520 - DNA, 16 bp, M. musculus
agcaaaaggcaggaag

SEQ ID NO: 357521 - DNA, 16 bp, M. musculus
agcaaaatatcattaa

SEQ ID NO: 357522 - DNA, 16 bp, M. musculus
agcaaaatcttgctgg

SEQ ID NO: 357523 - DNA, 16 bp, M. musculus
agcaaaatctttcaag

SEQ ID NO: 357524 - DNA, 16 bp, M. musculus
agcaaaattacaatta

SEQ ID NO: 357525 - DNA, 16 bp, M. musculus
agcaaaattacagtta

SEQ ID NO: 357526 - DNA, 16 bp, M. musculus
agcaaaattacagttg

SEQ ID NO: 357527 - DNA, 16 bp, M. musculus
agcaaaattgcagtta

SEQ ID NO: 357528 - DNA, 16 bp, M. musculus
agcaaacacatacaca

SEQ ID NO: 357529 - DNA, 16 bp, M. musculus
agcaaacactttacaa

SEQ ID NO: 357530 - DNA, 16 bp, M. musculus
agcaaacagcaaacag

SEQ ID NO: 357531 - DNA, 16 bp, M. musculus
agcaaacatatggtgg

SEQ ID NO: 357532 - DNA, 16 bp, M. musculus
agcaaaccaggagcca

SEQ ID NO: 357533 - DNA, 16 bp, M. musculus
agcaaaccagtaagta

SEQ ID NO: 357534 - DNA, 16 bp, M. musculus
agcaaaccagtgagca

SEQ ID NO: 357535 - DNA, 16 bp, M. musculus
agcaaacctaaaagaa

SEQ ID NO: 357536 - DNA, 16 bp, M. musculus
agcaaacgctgctgct

SEQ ID NO: 357537 - DNA, 16 bp, M. musculus
agcaaactccaggcca

SEQ ID NO: 357538 - DNA, 16 bp, M. musculus
agcaaagaaaatattt

SEQ ID NO: 357539 - DNA, 16 bp, M. musculus
agcaaagaaggcaagg

SEQ ID NO: 357540 - DNA, 16 bp, M. musculus
agcaaagatgaaagga

SEQ ID NO: 357541 - DNA, 16 bp, M. musculus
agcaaagcaaagcaca

SEQ ID NO: 357542 - DNA, 16 bp, M. musculus
agcaaagcaattcagt

SEQ ID NO: 357543 - DNA, 16 bp, M. musculus
agcaaagcagcaggtt

SEQ ID NO: 357544 - DNA, 16 bp, M. musculus
agcaaagcttttattg

SEQ ID NO: 357545 - DNA, 16 bp, M. musculus
agcaaagtgaatctgg

SEQ ID NO: 357546 - DNA, 16 bp, M. musculus
agcaaatacacacaag

SEQ ID NO: 357547 - DNA, 16 bp, M. musculus
agcaaatatattcaac

SEQ ID NO: 357548 - DNA, 16 bp, M. musculus
agcaaatccaagaaca

SEQ ID NO: 357549 - DNA, 16 bp, M. musculus
agcaaatgaaagacct

SEQ ID NO: 357550 - DNA, 16 bp, M. musculus
agcaaatgtctttacc

SEQ ID NO: 357551 - DNA, 16 bp, M. musculus
agcaaattacagttat

SEQ ID NO: 357552 - DNA, 16 bp, M. musculus
agcaaattcaccaaga

SEQ ID NO: 357553 - DNA, 16 bp, M. musculus
agcaaattgtgtctta

SEQ ID NO: 357554 - DNA, 16 bp, M. musculus
agcaaattttatatgc

SEQ ID NO: 357555 - DNA, 16 bp, M. musculus
agcaacaaaaataact

SEQ ID NO: 357556 - DNA, 16 bp, M. musculus
agcaacaaaataacag

SEQ ID NO: 357557 - DNA, 16 bp, M. musculus
agcaacaacatcaaca

SEQ ID NO: 357558 - DNA, 16 bp, M. musculus
agcaacaactcttctc

SEQ ID NO: 357559 - DNA, 16 bp, M. musculus
agcaacaagaaaatat

SEQ ID NO: 357560 - DNA, 16 bp, M. musculus
agcaacaaggaaagta

SEQ ID NO: 357561 - DNA, 16 bp, M. musculus
agcaacaagtgttctt

SEQ ID NO: 357562 - DNA, 16 bp, M. musculus
agcaacaatgtcaaca

SEQ ID NO: 357563 - DNA, 16 bp, M. musculus
agcaacaatgtcaact

SEQ ID NO: 357564 - DNA, 16 bp, M. musculus
agcaacacccctccat

SEQ ID NO: 357565 - DNA, 16 bp, M. musculus
agcaacagaaaactga

SEQ ID NO: 357566 - DNA, 16 bp, M. musculus
agcaacagaaaatgga

SEQ ID NO: 357567 - DNA, 16 bp, M. musculus
agcaacagaaagtgaa

SEQ ID NO: 357568 - DNA, 16 bp, M. musculus
agcaacagaataaaag

SEQ ID NO: 357569 - DNA, 16 bp, M. musculus
agcaacagattgggaa

SEQ ID NO: 357570 - DNA, 16 bp, M. musculus
agcaacagcacatgct

SEQ ID NO: 357571 - DNA, 16 bp, M. musculus
agcaacaggaaaagta

SEQ ID NO: 357572 - DNA, 16 bp, M. musculus
agcaacaggaaagtat

SEQ ID NO: 357573 - DNA, 16 bp, M. musculus
agcaacaggaagcaaa

SEQ ID NO: 357574 - DNA, 16 bp, M. musculus
agcaacagtagcagca

SEQ ID NO: 357575 - DNA, 16 bp, M. musculus
agcaacagtgtattca

SEQ ID NO: 357576 - DNA, 16 bp, M. musculus
agcaacatgaaatgtg

SEQ ID NO: 357577 - DNA, 16 bp, M. musculus
agcaaccacagctggg

SEQ ID NO: 357578 - DNA, 18 bp, M. musculus
agcaaccacatggtgact

SEQ ID NO: 357579 - DNA, 16 bp, M. musculus
agcaaccactcctcag

SEQ ID NO: 357580 - DNA, 16 bp, M. musculus
agcaaccactgatcaa

SEQ ID NO: 357581 - DNA, 16 bp, M. musculus
agcaaccccacaggaa

SEQ ID NO: 357582 - DNA, 16 bp, M. musculus
agcaaccctaaatatc

SEQ ID NO: 357583 - DNA, 16 bp, M. musculus
agcaacctcatagaag

SEQ ID NO: 357584 - DNA, 16 bp, M. musculus
agcaacctgagcaagc

SEQ ID NO: 357585 - DNA, 16 bp, M. musculus
agcaactaaaataatt

SEQ ID NO: 357586 - DNA, 16 bp, M. musculus
agcaactataaccaaa

SEQ ID NO: 357587 - DNA, 16 bp, M. musculus
agcaactcaaggaagg

SEQ ID NO: 357588 - DNA, 16 bp, M. musculus
agcaactgggaggcag

SEQ ID NO: 357589 - DNA, 16 bp, M. musculus
agcaacttaaggaaaa

SEQ ID NO: 357590 - DNA, 16 bp, M. musculus
agcaacttaagggagg

SEQ ID NO: 357591 - DNA, 16 bp, M. musculus
agcaacttcagcaaag

SEQ ID NO: 357592 - DNA, 16 bp, M. musculus
agcaacttgggggagg

SEQ ID NO: 357593 - DNA, 16 bp, M. musculus
agcaagaaaaagctgt

SEQ ID NO: 357594 - DNA, 16 bp, M. musculus
agcaagaaaaataatt

SEQ ID NO: 357595 - DNA, 16 bp, M. musculus
agcaagaaaataattt

SEQ ID NO: 357596 - DNA, 16 bp, M. musculus
agcaagaaagcaagca

SEQ ID NO: 357597 - DNA, 16 bp, M. musculus
agcaagaagaaagcca

SEQ ID NO: 357598 - DNA, 16 bp, M. musculus
agcaagaagagagagt

SEQ ID NO: 357599 - DNA, 16 bp, M. musculus
agcaagaagagagcat

SEQ ID NO: 357600 - DNA, 16 bp, M. musculus
agcaagaagagcctgg

SEQ ID NO: 357601 - DNA, 16 bp, M. musculus
agcaagaagcagaggg

SEQ ID NO: 357602 - DNA, 16 bp, M. musculus
agcaagaagcagccag

SEQ ID NO: 357603 - DNA, 16 bp, M. musculus
agcaagacagtaaaca

SEQ ID NO: 357604 - DNA, 16 bp, M. musculus
agcaagaccaaagtgt

SEQ ID NO: 357605 - DNA, 16 bp, M. musculus
agcaagaccatgtctc

SEQ ID NO: 357606 - DNA, 16 bp, M. musculus
agcaagaccctgtttc

SEQ ID NO: 357607 - DNA, 16 bp, M. musculus
agcaagaccttgcctc

SEQ ID NO: 357608 - DNA, 16 bp, M. musculus
agcaagactctgtctc

SEQ ID NO: 357609 - DNA, 16 bp, M. musculus
agcaagacttggatct

SEQ ID NO: 357610 - DNA, 16 bp, M. musculus
agcaagactttgctga

SEQ ID NO: 357611 - DNA, 16 bp, M. musculus
agcaagagaaaccaag

SEQ ID NO: 357612 - DNA, 16 bp, M. musculus
agcaagagagaaaatg

SEQ ID NO: 357613 - DNA, 16 bp, M. musculus
agcaagagagagactg

SEQ ID NO: 357614 - DNA, 16 bp, M. musculus
agcaagagcaagaagg

SEQ ID NO: 357615 - DNA, 16 bp, M. musculus
agcaagagctcttaac

SEQ ID NO: 357616 - DNA, 16 bp, M. musculus
agcaagagcttgctga

SEQ ID NO: 357617 - DNA, 16 bp, M. musculus
agcaagaggctttatt

SEQ ID NO: 357618 - DNA, 16 bp, M. musculus
agcaagatccagaaca

SEQ ID NO: 357619 - DNA, 16 bp, M. musculus
agcaagatgaacccca

SEQ ID NO: 357620 - DNA, 16 bp, M. musculus
agcaagatgttgctga

SEQ ID NO: 357621 - DNA, 16 bp, M. musculus
agcaagattatgctga

SEQ ID NO: 357622 - DNA, 16 bp, M. musculus
agcaagcaagcaagcc

SEQ ID NO: 357623 - DNA, 16 bp, M. musculus
agcaagcaagcaagct

SEQ ID NO: 357624 - DNA, 16 bp, M. musculus
agcaagcaaggaaaca

SEQ ID NO: 357625 - DNA, 16 bp, M. musculus
agcaagcacaaggccc

SEQ ID NO: 357626 - DNA, 16 bp, M. musculus
agcaagcacagggcct

SEQ ID NO: 357627 - DNA, 16 bp, M. musculus
agcaagcaccaatccc

SEQ ID NO: 357628 - DNA, 16 bp, M. musculus
agcaagcacctttacc

SEQ ID NO: 357629 - DNA, 16 bp, M. musculus
agcaagcactcttacc

SEQ ID NO: 357630 - DNA, 16 bp, M. musculus
agcaagcactttccca

SEQ ID NO: 357631 - DNA, 16 bp, M. musculus
agcaagcagacaaaca

SEQ ID NO: 357632 - DNA, 16 bp, M. musculus
agcaagcagaggcagg

SEQ ID NO: 357633 - DNA, 16 bp, M. musculus
agcaagcagatcagaa

SEQ ID NO: 357634 - DNA, 16 bp, M. musculus
agcaagcagccagtgc

SEQ ID NO: 357635 - DNA, 16 bp, M. musculus
agcaagcaggcaaaga

SEQ ID NO: 357636 - DNA, 16 bp, M. musculus
agcaagcagggccaga

SEQ ID NO: 357637 - DNA, 16 bp, M. musculus
agcaagcaggtgaagg

SEQ ID NO: 357638 - DNA, 16 bp, M. musculus
agcaagcatggtggca

SEQ ID NO: 357639 - DNA, 16 bp, M. musculus
agcaagccaagaagca

SEQ ID NO: 357640 - DNA, 16 bp, M. musculus
agcaagccactaagta

SEQ ID NO: 357641 - DNA, 16 bp, M. musculus
agcaagccagcaagca

SEQ ID NO: 357642 - DNA, 16 bp, M. musculus
agcaagccagccagca

SEQ ID NO: 357643 - DNA, 16 bp, M. musculus
agcaagccaggaagca

SEQ ID NO: 357644 - DNA, 16 bp, M. musculus
agcaagccagtaagca

SEQ ID NO: 357645 - DNA, 16 bp, M. musculus
agcaagccagtcagca

SEQ ID NO: 357646 - DNA, 16 bp, M. musculus
agcaagccatggaaag

SEQ ID NO: 357647 - DNA, 16 bp, M. musculus
agcaagccccagggag

SEQ ID NO: 357648 - DNA, 16 bp, M. musculus
agcaagccccagggat

SEQ ID NO: 357649 - DNA, 16 bp, M. musculus
agcaagctcaaggcca

SEQ ID NO: 357650 - DNA, 16 bp, M. musculus
agcaagctccagccag

SEQ ID NO: 357651 - DNA, 16 bp, M. musculus
agcaagctccaggttc

SEQ ID NO: 357652 - DNA, 16 bp, M. musculus
agcaagctcctgttgg

SEQ ID NO: 357653 - DNA, 16 bp, M. musculus
agcaagctctctacca

SEQ ID NO: 357654 - DNA, 16 bp, M. musculus
agcaagctggctggct

SEQ ID NO: 357655 - DNA, 16 bp, M. musculus
agcaagctgggcaagc

SEQ ID NO: 357656 - DNA, 16 bp, M. musculus
agcaagcttttgctga

SEQ ID NO: 357657 - DNA, 16 bp, M. musculus
agcaaggaagacgcca

SEQ ID NO: 357658 - DNA, 16 bp, M. musculus
agcaaggatgcttgaa

SEQ ID NO: 357659 - DNA, 16 bp, M. musculus
agcaaggcagagagag

SEQ ID NO: 357660 - DNA, 16 bp, M. musculus
agcaaggcagaggaag

SEQ ID NO: 357661 - DNA, 16 bp, M. musculus
agcaaggcagaggcag

SEQ ID NO: 357662 - DNA, 16 bp, M. musculus
agcaaggctctgtctc

SEQ ID NO: 357663 - DNA, 16 bp, M. musculus
agcaagggctacacag

SEQ ID NO: 357664 - DNA, 16 bp, M. musculus
agcaagggctcttaac

SEQ ID NO: 357665 - DNA, 16 bp, M. musculus
agcaagggctggagag

SEQ ID NO: 357666 - DNA, 16 bp, M. musculus
agcaaggtacaaatga

SEQ ID NO: 357667 - DNA, 16 bp, M. musculus
agcaaggttaggccca

SEQ ID NO: 357668 - DNA, 16 bp, M. musculus
agcaagtccaggacag

SEQ ID NO: 357669 - DNA, 16 bp, M. musculus
agcaagtcctggatac

SEQ ID NO: 357670 - DNA, 16 bp, M. musculus
agcaagtgaaatatct

SEQ ID NO: 357671 - DNA, 16 bp, M. musculus
agcaagtgagagagag

SEQ ID NO: 357672 - DNA, 16 bp, M. musculus
agcaagtgcctttacc

SEQ ID NO: 357673 - DNA, 16 bp, M. musculus
agcaagtgctcttaac

SEQ ID NO: 357674 - DNA, 16 bp, M. musculus
agcaagtgctcttagc

SEQ ID NO: 357675 - DNA, 16 bp, M. musculus
agcaagtgcttttacc

SEQ ID NO: 357676 - DNA, 16 bp, M. musculus
agcaagtggaagatct

SEQ ID NO: 357677 - DNA, 16 bp, M. musculus
agcaagtggggaggaa

SEQ ID NO: 357678 - DNA, 16 bp, M. musculus
agcaagtgtagataaa

SEQ ID NO: 357679 - DNA, 16 bp, M. musculus
agcaagtgttcttgtg

SEQ ID NO: 357680 - DNA, 16 bp, M. musculus
agcaagttccaaggca

SEQ ID NO: 357681 - DNA, 16 bp, M. musculus
agcaagttccaggaaa

SEQ ID NO: 357682 - DNA, 16 bp, M. musculus
agcaagttccaggaca

SEQ ID NO: 357683 - DNA, 16 bp, M. musculus
agcaagttccaggcta

SEQ ID NO: 357684 - DNA, 16 bp, M. musculus
agcaagttccagggta

SEQ ID NO: 357685 - DNA, 16 bp, M. musculus
agcaagttccatgaca

SEQ ID NO: 357686 - DNA, 16 bp, M. musculus
agcaagttctaggaca

SEQ ID NO: 357687 - DNA, 16 bp, M. musculus
agcaagttctaggcca

SEQ ID NO: 357688 - DNA, 16 bp, M. musculus
agcaagttggggaggg

SEQ ID NO: 357689 - DNA, 16 bp, M. musculus
agcaagtttcaggaca

SEQ ID NO: 357690 - DNA, 16 bp, M. musculus
agcaagtttcaggcca

SEQ ID NO: 357691 - DNA, 16 bp, M. musculus
agcaataaaaccctga

SEQ ID NO: 357692 - DNA, 17 bp, M. musculus
agcaataaaagctttgc

SEQ ID NO: 357693 - DNA, 16 bp, M. musculus
agcaataaacttctat

SEQ ID NO: 357694 - DNA, 16 bp, M. musculus
agcaatagaaaagtaa

SEQ ID NO: 357695 - DNA, 16 bp, M. musculus
agcaatagaaacccca

SEQ ID NO: 357696 - DNA, 16 bp, M. musculus
agcaatagaaacctaa

SEQ ID NO: 357697 - DNA, 16 bp, M. musculus
agcaatatggatggct

SEQ ID NO: 357698 - DNA, 16 bp, M. musculus
agcaatcaagaaaatg

SEQ ID NO: 357699 - DNA, 16 bp, M. musculus
agcaatcacaagttgg

SEQ ID NO: 357700 - DNA, 16 bp, M. musculus
agcaatcaggaagcag

SEQ ID NO: 357701 - DNA, 16 bp, M. musculus
agcaatccagtaagca

SEQ ID NO: 357702 - DNA, 16 bp, M. musculus
agcaatccccctgcct

SEQ ID NO: 357703 - DNA, 16 bp, M. musculus
agcaatcctcctgact

SEQ ID NO: 357704 - DNA, 16 bp, M. musculus
agcaatcctcctgcct

SEQ ID NO: 357705 - DNA, 22 bp, M. musculus
agcaatcgccattataagatgg

SEQ ID NO: 357706 - DNA, 17 bp, M. musculus
agcaatcgcgtgtgtgc

SEQ ID NO: 357707 - DNA, 16 bp, M. musculus
agcaatcttcagattc

SEQ ID NO: 357708 - DNA, 16 bp, M. musculus
agcaatgaaaccctag

SEQ ID NO: 357709 - DNA, 16 bp, M. musculus
agcaatgaacagatca

SEQ ID NO: 357710 - DNA, 16 bp, M. musculus
agcaatgccactcctg

SEQ ID NO: 357711 - DNA, 16 bp, M. musculus
agcaatggctagtgct

SEQ ID NO: 357712 - DNA, 16 bp, M. musculus
agcaatgtggaagtat

SEQ ID NO: 357713 - DNA, 16 bp, M. musculus
agcaattagggaaatg

SEQ ID NO: 357714 - DNA, 16 bp, M. musculus
agcaattcagggcagg

SEQ ID NO: 357715 - DNA, 16 bp, M. musculus
agcaattgagaaaatg

SEQ ID NO: 357716 - DNA, 16 bp, M. musculus
agcaattgcaataaaa

SEQ ID NO: 357717 - DNA, 16 bp, M. musculus
agcaattggaaggcag

SEQ ID NO: 357718 - DNA, 16 bp, M. musculus
agcaattgggaggcag

SEQ ID NO: 357719 - DNA, 16 bp, M. musculus
agcaatttcatcacct

SEQ ID NO: 357720 - DNA, 16 bp, M. musculus
agcaatttctccagcc

SEQ ID NO: 357721 - DNA, 16 bp, M. musculus
agcacaaaaatctctt

SEQ ID NO: 357722 - DNA, 16 bp, M. musculus
agcacaaagctactgt

SEQ ID NO: 357723 - DNA, 16 bp, M. musculus
agcacaaatgccagcc

SEQ ID NO: 357724 - DNA, 16 bp, M. musculus
agcacaaattgtgact

SEQ ID NO: 357725 - DNA, 16 bp, M. musculus
agcacaactgacacca

SEQ ID NO: 357726 - DNA, 16 bp, M. musculus
agcacaactgactcca

SEQ ID NO: 357727 - DNA, 16 bp, M. musculus
agcacaagaccataag

SEQ ID NO: 357728 - DNA, 16 bp, M. musculus
agcacaagcaagcaag

SEQ ID NO: 357729 - DNA, 16 bp, M. musculus
agcacaagccatggct

SEQ ID NO: 357730 - DNA, 16 bp, M. musculus
agcacaagccattggt

SEQ ID NO: 357731 - DNA, 16 bp, M. musculus
agcacaaggcagagag

SEQ ID NO: 357732 - DNA, 16 bp, M. musculus
agcacacacaaagccc

SEQ ID NO: 357733 - DNA, 17 bp, M. musculus
agcacacacacacatac

SEQ ID NO: 357734 - DNA, 16 bp, M. musculus
agcacacacagcttgt

SEQ ID NO: 357735 - DNA, 16 bp, M. musculus
agcacacagaacacca

SEQ ID NO: 357736 - DNA, 16 bp, M. musculus
agcacacagaacactt

SEQ ID NO: 357737 - DNA, 16 bp, M. musculus
agcacacagaagctgt

SEQ ID NO: 357738 - DNA, 16 bp, M. musculus
agcacacagacacaga

SEQ ID NO: 357739 - DNA, 16 bp, M. musculus
agcacacaggacacag

SEQ ID NO: 357740 - DNA, 16 bp, M. musculus
agcacacaggaggctg

SEQ ID NO: 357741 - DNA, 16 bp, M. musculus
agcacacagtaggcac

SEQ ID NO: 357742 - DNA, 16 bp, M. musculus
agcacacatggtatgt

SEQ ID NO: 357743 - DNA, 16 bp, M. musculus
agcacacatgtgtgtg

SEQ ID NO: 357744 - DNA, 16 bp, M. musculus
agcacacccaggtcct

SEQ ID NO: 357745 - DNA, 16 bp, M. musculus
agcacactaggccaag

SEQ ID NO: 357746 - DNA, 16 bp, M. musculus
agcacactcactccat

SEQ ID NO: 357747 - DNA, 16 bp, M. musculus
agcacactgtagctgt

SEQ ID NO: 357748 - DNA, 16 bp, M. musculus
agcacagaaaaggagg

SEQ ID NO: 357749 - DNA, 16 bp, M. musculus
agcacagaaaggcctt

SEQ ID NO: 357750 - DNA, 16 bp, M. musculus
agcacagaacacagag

SEQ ID NO: 357751 - DNA, 16 bp, M. musculus
agcacagacagcagtg

SEQ ID NO: 357752 - DNA, 16 bp, M. musculus
agcacagagagggaga

SEQ ID NO: 357753 - DNA, 16 bp, M. musculus
agcacagagcctggca

SEQ ID NO: 357754 - DNA, 16 bp, M. musculus
agcacagaggacagct

SEQ ID NO: 357755 - DNA, 16 bp, M. musculus
agcacagataattgaa

SEQ ID NO: 357756 - DNA, 16 bp, M. musculus
agcacagcacagcaga

SEQ ID NO: 357757 - DNA, 16 bp, M. musculus
agcacagcacagcatg

SEQ ID NO: 357758 - DNA, 16 bp, M. musculus
agcacagcacaggaca

SEQ ID NO: 357759 - DNA, 16 bp, M. musculus
agcacagcagcacaca

SEQ ID NO: 357760 - DNA, 16 bp, M. musculus
agcacagcagcatcct

SEQ ID NO: 357761 - DNA, 16 bp, M. musculus
agcacagccagagcta

SEQ ID NO: 357762 - DNA, 16 bp, M. musculus
agcacagccagaggca

SEQ ID NO: 357763 - DNA, 16 bp, M. musculus
agcacagctgctgtga

SEQ ID NO: 357764 - DNA, 16 bp, M. musculus
agcacaggacaggaca

SEQ ID NO: 357765 - DNA, 16 bp, M. musculus
agcacaggctgctcct

SEQ ID NO: 357766 - DNA, 16 bp, M. musculus
agcacaggctggcctc

SEQ ID NO: 357767 - DNA, 16 bp, M. musculus
agcacagggatggcac

SEQ ID NO: 357768 - DNA, 16 bp, M. musculus
agcacaggtaagacca

SEQ ID NO: 357769 - DNA, 16 bp, M. musculus
agcacaggttgctctt

SEQ ID NO: 357770 - DNA, 16 bp, M. musculus
agcacagtgagcagca

SEQ ID NO: 357771 - DNA, 16 bp, M. musculus
agcacagtgcctggca

SEQ ID NO: 357772 - DNA, 16 bp, M. musculus
agcacagtggtggcag

SEQ ID NO: 357773 - DNA, 16 bp, M. musculus
agcacagtgtctgcct

SEQ ID NO: 357774 - DNA, 16 bp, M. musculus
agcacatgaaactgaa

SEQ ID NO: 357775 - DNA, 16 bp, M. musculus
agcacatgggcacaga

SEQ ID NO: 357776 - DNA, 16 bp, M. musculus
agcaccaatccctgac

SEQ ID NO: 357777 - DNA, 16 bp, M. musculus
agcaccaattcttaat

SEQ ID NO: 357778 - DNA, 16 bp, M. musculus
agcaccaccagcagca

SEQ ID NO: 357779 - DNA, 16 bp, M. musculus
agcaccacccacaagg

SEQ ID NO: 357780 - DNA, 16 bp, M. musculus
agcaccactgcctggc

SEQ ID NO: 357781 - DNA, 16 bp, M. musculus
agcaccagatgtcctg

SEQ ID NO: 357782 - DNA, 16 bp, M. musculus
agcaccagcaacagaa

SEQ ID NO: 357783 - DNA, 28 bp, M. musculus
agcaccagctctgggcaaaaagtctttt

SEQ ID NO: 357784 - DNA, 16 bp, M. musculus
agcaccaggcatgcac

SEQ ID NO: 357785 - DNA, 16 bp, M. musculus
agcaccatcagatcct

SEQ ID NO: 357786 - DNA, 16 bp, M. musculus
agcaccatgaccaaaa

SEQ ID NO: 357787 - DNA, 16 bp, M. musculus
agcaccatgtctccct

SEQ ID NO: 357788 - DNA, 16 bp, M. musculus
agcaccatgtctgcct

SEQ ID NO: 357789 - DNA, 22 bp, M. musculus
agcaccatttgttgaaaatgct

SEQ ID NO: 357790 - DNA, 16 bp, M. musculus
agcacccaagaggcag

SEQ ID NO: 357791 - DNA, 17 bp, M. musculus
agcacccacactttggt

SEQ ID NO: 357792 - DNA, 16 bp, M. musculus
agcacccacagggcag

SEQ ID NO: 357793 - DNA, 16 bp, M. musculus
agcacccacatctgta

SEQ ID NO: 357794 - DNA, 16 bp, M. musculus
agcacccacatggaag

SEQ ID NO: 357795 - DNA, 16 bp, M. musculus
agcacccacatggtgg

SEQ ID NO: 357796 - DNA, 16 bp, M. musculus
agcacccagaaggcag

SEQ ID NO: 357797 - DNA, 16 bp, M. musculus
agcacccagatgcccc

SEQ ID NO: 357798 - DNA, 16 bp, M. musculus
agcacccaggaccact

SEQ ID NO: 357799 - DNA, 16 bp, M. musculus
agcacccaggactacc

SEQ ID NO: 357800 - DNA, 16 bp, M. musculus
agcacccatacagcag

SEQ ID NO: 357801 - DNA, 16 bp, M. musculus
agcacccatgttgggt

SEQ ID NO: 357802 - DNA, 16 bp, M. musculus
agcaccctcagcacct

SEQ ID NO: 357803 - DNA, 16 bp, M. musculus
agcaccctctcagaag

SEQ ID NO: 357804 - DNA, 16 bp, M. musculus
agcacccttgtcaaag

SEQ ID NO: 357805 - DNA, 16 bp, M. musculus
agcacccttgtcgaag

SEQ ID NO: 357806 - DNA, 16 bp, M. musculus
agcaccgactgttctt

SEQ ID NO: 357807 - DNA, 16 bp, M. musculus
agcacctacactttgg

SEQ ID NO: 357808 - DNA, 16 bp, M. musculus
agcacctactatgtgc

SEQ ID NO: 357809 - DNA, 16 bp, M. musculus
agcacctactgctctt

SEQ ID NO: 357810 - DNA, 16 bp, M. musculus
agcacctactgtgtgc

SEQ ID NO: 357811 - DNA, 16 bp, M. musculus
agcacctcatcctaaa

SEQ ID NO: 357812 - DNA, 16 bp, M. musculus
agcacctctctctctc

SEQ ID NO: 357813 - DNA, 17 bp, M. musculus
agcacctgaaagagtca

SEQ ID NO: 357814 - DNA, 16 bp, M. musculus
agcacctgctgtcacc

SEQ ID NO: 357815 - DNA, 16 bp, M. musculus
agcacctggaaggcag

SEQ ID NO: 357816 - DNA, 17 bp, M. musculus
agcacctggaggagcca

SEQ ID NO: 357817 - DNA, 16 bp, M. musculus
agcacctgggagagcc

SEQ ID NO: 357818 - DNA, 16 bp, M. musculus
agcacctgggaggtgg

SEQ ID NO: 357819 - DNA, 16 bp, M. musculus
agcaccttccctgcca

SEQ ID NO: 357820 - DNA, 16 bp, M. musculus
agcacctttgcccact

SEQ ID NO: 357821 - DNA, 16 bp, M. musculus
agcactaactgctctt

SEQ ID NO: 357822 - DNA, 16 bp, M. musculus
agcactaactgctttt

SEQ ID NO: 357823 - DNA, 16 bp, M. musculus
agcactaagtgcctcc

SEQ ID NO: 357824 - DNA, 16 bp, M. musculus
agcactagaaaggcag

SEQ ID NO: 357825 - DNA, 16 bp, M. musculus
agcactcaaaaggcag

SEQ ID NO: 357826 - DNA, 16 bp, M. musculus
agcactcaagaagcag

SEQ ID NO: 357827 - DNA, 16 bp, M. musculus
agcactcaagagacag

SEQ ID NO: 357828 - DNA, 16 bp, M. musculus
agcactcactgctctt

SEQ ID NO: 357829 - DNA, 16 bp, M. musculus
agcactcactggctgc

SEQ ID NO: 357830 - DNA, 16 bp, M. musculus
agcactcagaaggaag

SEQ ID NO: 357831 - DNA, 16 bp, M. musculus
agcactcagagacaga

SEQ ID NO: 357832 - DNA, 16 bp, M. musculus
agcactcaggaaatgg

SEQ ID NO: 357833 - DNA, 16 bp, M. musculus
agcactcaggaagctg

SEQ ID NO: 357834 - DNA, 16 bp, M. musculus
agcactcaggaagtag

SEQ ID NO: 357835 - DNA, 16 bp, M. musculus
agcactcaggacacag

SEQ ID NO: 357836 - DNA, 16 bp, M. musculus
agcactcaggagaatg

SEQ ID NO: 357837 - DNA, 16 bp, M. musculus
agcactcaggagctga

SEQ ID NO: 357838 - DNA, 16 bp, M. musculus
agcactcaggaggaaa

SEQ ID NO: 357839 - DNA, 16 bp, M. musculus
agcactcaggaggccg

SEQ ID NO: 357840 - DNA, 16 bp, M. musculus
agcactcagggagcag

SEQ ID NO: 357841 - DNA, 16 bp, M. musculus
agcactcatgtggtgg

SEQ ID NO: 357842 - DNA, 16 bp, M. musculus
agcactcccatcccac

SEQ ID NO: 357843 - DNA, 16 bp, M. musculus
agcactcgggaggaag

SEQ ID NO: 357844 - DNA, 16 bp, M. musculus
agcactctcccactga

SEQ ID NO: 357845 - DNA, 16 bp, M. musculus
agcactctctgcaggc

SEQ ID NO: 357846 - DNA, 16 bp, M. musculus
agcactctctgcagtc

SEQ ID NO: 357847 - DNA, 16 bp, M. musculus
agcactctctgctggt

SEQ ID NO: 357848 - DNA, 16 bp, M. musculus
agcactctggaggtag

SEQ ID NO: 357849 - DNA, 16 bp, M. musculus
agcactcttccatggt

SEQ ID NO: 357850 - DNA, 16 bp, M. musculus
agcactgaccgctctt

SEQ ID NO: 357851 - DNA, 16 bp, M. musculus
agcactgactgctcct

SEQ ID NO: 357852 - DNA, 16 bp, M. musculus
agcactgactgctctc

SEQ ID NO: 357853 - DNA, 16 bp, M. musculus
agcactgactgctctg

SEQ ID NO: 357854 - DNA, 16 bp, M. musculus
agcactgactgctttc

SEQ ID NO: 357855 - DNA, 16 bp, M. musculus
agcactgacttctctt

SEQ ID NO: 357856 - DNA, 16 bp, M. musculus
agcactgaggaagctg

SEQ ID NO: 357857 - DNA, 16 bp, M. musculus
agcactgcacagctag

SEQ ID NO: 357858 - DNA, 16 bp, M. musculus
agcactgcagcaggag

SEQ ID NO: 357859 - DNA, 16 bp, M. musculus
agcactgctgctcttc

SEQ ID NO: 357860 - DNA, 16 bp, M. musculus
agcactggagaggcag

SEQ ID NO: 357861 - DNA, 16 bp, M. musculus
agcactggccgctctt

SEQ ID NO: 357862 - DNA, 16 bp, M. musculus
agcactggctgctctg

SEQ ID NO: 357863 - DNA, 16 bp, M. musculus
agcactggctgctctt

SEQ ID NO: 357864 - DNA, 16 bp, M. musculus
agcactggctgcttct

SEQ ID NO: 357865 - DNA, 16 bp, M. musculus
agcactgggaaagcag

SEQ ID NO: 357866 - DNA, 16 bp, M. musculus
agcactgggaaggtgg

SEQ ID NO: 357867 - DNA, 16 bp, M. musculus
agcactgggactacag

SEQ ID NO: 357868 - DNA, 16 bp, M. musculus
agcactgggattaaag

SEQ ID NO: 357869 - DNA, 16 bp, M. musculus
agcactggggagtcag

SEQ ID NO: 357870 - DNA, 16 bp, M. musculus
agcactggggttacag

SEQ ID NO: 357871 - DNA, 16 bp, M. musculus
agcactgtctgctctt

SEQ ID NO: 357872 - DNA, 16 bp, M. musculus
agcactgtggctggga

SEQ ID NO: 357873 - DNA, 16 bp, M. musculus
agcacttacccagcat

SEQ ID NO: 357874 - DNA, 16 bp, M. musculus
agcacttagaggcaga

SEQ ID NO: 357875 - DNA, 16 bp, M. musculus
agcacttaggaagcag

SEQ ID NO: 357876 - DNA, 16 bp, M. musculus
agcacttaggaagtag

SEQ ID NO: 357877 - DNA, 16 bp, M. musculus
agcacttattgctctt

SEQ ID NO: 357878 - DNA, 16 bp, M. musculus
agcacttctcagcagg

SEQ ID NO: 357879 - DNA, 16 bp, M. musculus
agcacttcttactaaa

SEQ ID NO: 357880 - DNA, 16 bp, M. musculus
agcacttcttggcttc

SEQ ID NO: 357881 - DNA, 16 bp, M. musculus
agcacttgactgctct

SEQ ID NO: 357882 - DNA, 16 bp, M. musculus
agcacttgagaggcag

SEQ ID NO: 357883 - DNA, 16 bp, M. musculus
agcacttgctactctt

SEQ ID NO: 357884 - DNA, 16 bp, M. musculus
agcacttgctggtctt

SEQ ID NO: 357885 - DNA, 16 bp, M. musculus
agcacttgctgttctt

SEQ ID NO: 357886 - DNA, 16 bp, M. musculus
agcacttgcttagcat

SEQ ID NO: 357887 - DNA, 16 bp, M. musculus
agcacttggaagcaga

SEQ ID NO: 357888 - DNA, 16 bp, M. musculus
agcacttggcagaggc

SEQ ID NO: 357889 - DNA, 16 bp, M. musculus
agcacttgggaaacag

SEQ ID NO: 357890 - DNA, 16 bp, M. musculus
agcacttgggaagctg

SEQ ID NO: 357891 - DNA, 16 bp, M. musculus
agcacttgggaaggag

SEQ ID NO: 357892 - DNA, 16 bp, M. musculus
agcacttgggaagtaa

SEQ ID NO: 357893 - DNA, 16 bp, M. musculus
agcacttgggagccag

SEQ ID NO: 357894 - DNA, 19 bp, M. musculus
agcacttgggaggcagagc

SEQ ID NO: 357895 - DNA, 17 bp, M. musculus
agcacttgggaggcagt

SEQ ID NO: 357896 - DNA, 16 bp, M. musculus
agcacttgggaggctg

SEQ ID NO: 357897 - DNA, 16 bp, M. musculus
agcacttgtctagcat

SEQ ID NO: 357898 - DNA, 16 bp, M. musculus
agcacttgtgaggctg

SEQ ID NO: 357899 - DNA, 16 bp, M. musculus
agcacttgttattctt

SEQ ID NO: 357900 - DNA, 16 bp, M. musculus
agcacttgttgctcct

SEQ ID NO: 357901 - DNA, 16 bp, M. musculus
agcacttgttgctctg

SEQ ID NO: 357902 - DNA, 16 bp, M. musculus
agcacttgttgctctt

SEQ ID NO: 357903 - DNA, 16 bp, M. musculus
agcactttacccacag

SEQ ID NO: 357904 - DNA, 16 bp, M. musculus
agcagaaaaatcctct

SEQ ID NO: 357905 - DNA, 18 bp, M. musculus
agcagaaaaccctgcctg

SEQ ID NO: 357906 - DNA, 16 bp, M. musculus
agcagaaacaataaag

SEQ ID NO: 357907 - DNA, 16 bp, M. musculus
agcagaaacaggagga

SEQ ID NO: 357908 - DNA, 16 bp, M. musculus
agcagaaacaggcaga

SEQ ID NO: 357909 - DNA, 16 bp, M. musculus
agcagaaaccagccaa

SEQ ID NO: 357910 - DNA, 16 bp, M. musculus
agcagaaaccaggaaa

SEQ ID NO: 357911 - DNA, 16 bp, M. musculus
agcagaaactatggag

SEQ ID NO: 357912 - DNA, 16 bp, M. musculus
agcagaaagagcaggc

SEQ ID NO: 357913 - DNA, 16 bp, M. musculus
agcagaaaggaatttg

SEQ ID NO: 357914 - DNA, 16 bp, M. musculus
agcagaaagtgttctt

SEQ ID NO: 357915 - DNA, 16 bp, M. musculus
agcagaaatgggtggg

SEQ ID NO: 357916 - DNA, 16 bp, M. musculus
agcagaacaccaatag

SEQ ID NO: 357917 - DNA, 16 bp, M. musculus
agcagaacaccaatgg

SEQ ID NO: 357918 - DNA, 16 bp, M. musculus
agcagaacactggctt

SEQ ID NO: 357919 - DNA, 16 bp, M. musculus
agcagaacagaacaga

SEQ ID NO: 357920 - DNA, 16 bp, M. musculus
agcagaacatcctttt

SEQ ID NO: 357921 - DNA, 16 bp, M. musculus
agcagaaccacatggc

SEQ ID NO: 357922 - DNA, 16 bp, M. musculus
agcagaagaaggccta

SEQ ID NO: 357923 - DNA, 16 bp, M. musculus
agcagaagatgaaggc

SEQ ID NO: 357924 - DNA, 16 bp, M. musculus
agcagaagatggcctt

SEQ ID NO: 357925 - DNA, 16 bp, M. musculus
agcagaagcaagtgga

SEQ ID NO: 357926 - DNA, 16 bp, M. musculus
agcagaagcacatggc

SEQ ID NO: 357927 - DNA, 17 bp, M. musculus
agcagaagcagaagcag

SEQ ID NO: 357928 - DNA, 16 bp, M. musculus
agcagaagcagatgga

SEQ ID NO: 357929 - DNA, 16 bp, M. musculus
agcagaagcagcagaa

SEQ ID NO: 357930 - DNA, 16 bp, M. musculus
agcagaagcagcagca

SEQ ID NO: 357931 - DNA, 16 bp, M. musculus
agcagaagcagcagga

SEQ ID NO: 357932 - DNA, 16 bp, M. musculus
agcagaagcagccaga

SEQ ID NO: 357933 - DNA, 16 bp, M. musculus
agcagaagcaggagga

SEQ ID NO: 357934 - DNA, 16 bp, M. musculus
agcagaagcaggcaga

SEQ ID NO: 357935 - DNA, 16 bp, M. musculus
agcagaagcaggtgga

SEQ ID NO: 357936 - DNA, 16 bp, M. musculus
agcagaagccagaaga

SEQ ID NO: 357937 - DNA, 16 bp, M. musculus
agcagaagccagagcc

SEQ ID NO: 357938 - DNA, 16 bp, M. musculus
agcagaagctatggag

SEQ ID NO: 357939 - DNA, 16 bp, M. musculus
agcagaaggagcaggc

SEQ ID NO: 357940 - DNA, 16 bp, M. musculus
agcagaaggatcagaa

SEQ ID NO: 357941 - DNA, 16 bp, M. musculus
agcagaataaatggaa

SEQ ID NO: 357942 - DNA, 16 bp, M. musculus
agcagaatggatacag

SEQ ID NO: 357943 - DNA, 16 bp, M. musculus
agcagacaagacagaa

SEQ ID NO: 357944 - DNA, 16 bp, M. musculus
agcagacaatgctctt

SEQ ID NO: 357945 - DNA, 16 bp, M. musculus
agcagacacaggagag

SEQ ID NO: 357946 - DNA, 16 bp, M. musculus
agcagacacaggtgaa

SEQ ID NO: 357947 - DNA, 16 bp, M. musculus
agcagacaccaaaccc

SEQ ID NO: 357948 - DNA, 16 bp, M. musculus
agcagacagagaccat

SEQ ID NO: 357949 - DNA, 16 bp, M. musculus
agcagacagagggtgg

SEQ ID NO: 357950 - DNA, 16 bp, M. musculus
agcagacagcagacag

SEQ ID NO: 357951 - DNA, 16 bp, M. musculus
agcagacagcaggaaa

SEQ ID NO: 357952 - DNA, 16 bp, M. musculus
agcagacattaaatta

SEQ ID NO: 357953 - DNA, 16 bp, M. musculus
agcagaccatgggctt

SEQ ID NO: 357954 - DNA, 16 bp, M. musculus
agcagacctcttccca

SEQ ID NO: 357955 - DNA, 17 bp, M. musculus
agcagaccttctcatga

SEQ ID NO: 357956 - DNA, 16 bp, M. musculus
agcagactgcctgctg

SEQ ID NO: 357957 - DNA, 16 bp, M. musculus
agcagagaacttctcc

SEQ ID NO: 357958 - DNA, 16 bp, M. musculus
agcagagaagagagac

SEQ ID NO: 357959 - DNA, 16 bp, M. musculus
agcagagaagctcaag

SEQ ID NO: 357960 - DNA, 16 bp, M. musculus
agcagagaatgaaaga

SEQ ID NO: 357961 - DNA, 16 bp, M. musculus
agcagagaatgaagaa

SEQ ID NO: 357962 - DNA, 16 bp, M. musculus
agcagagacaagcaga

SEQ ID NO: 357963 - DNA, 16 bp, M. musculus
agcagagacagaagga

SEQ ID NO: 357964 - DNA, 16 bp, M. musculus
agcagagacagaggca

SEQ ID NO: 357965 - DNA, 16 bp, M. musculus
agcagagacaggagga

SEQ ID NO: 357966 - DNA, 16 bp, M. musculus
agcagagacaggcaga

SEQ ID NO: 357967 - DNA, 16 bp, M. musculus
agcagagacaggtgga

SEQ ID NO: 357968 - DNA, 16 bp, M. musculus
agcagagacagtctgt

SEQ ID NO: 357969 - DNA, 16 bp, M. musculus
agcagagaccatggag

SEQ ID NO: 357970 - DNA, 16 bp, M. musculus
agcagagactaaagga

SEQ ID NO: 357971 - DNA, 17 bp, M. musculus
agcagagactgaaagaa

SEQ ID NO: 357972 - DNA, 16 bp, M. musculus
agcagagactgaaagg

SEQ ID NO: 357973 - DNA, 16 bp, M. musculus
agcagagactgaacaa

SEQ ID NO: 357974 - DNA, 17 bp, M. musculus
agcagagactgaaggaa

SEQ ID NO: 357975 - DNA, 16 bp, M. musculus
agcagagactgaaggg

SEQ ID NO: 357976 - DNA, 16 bp, M. musculus
agcagagactgaggga

SEQ ID NO: 357977 - DNA, 16 bp, M. musculus
agcagagactgtggga

SEQ ID NO: 357978 - DNA, 16 bp, M. musculus
agcagagagaaatgca

SEQ ID NO: 357979 - DNA, 16 bp, M. musculus
agcagagagaaatgga

SEQ ID NO: 357980 - DNA, 16 bp, M. musculus
agcagagagaagtgaa

SEQ ID NO: 357981 - DNA, 16 bp, M. musculus
agcagagagagatgaa

SEQ ID NO: 357982 - DNA, 16 bp, M. musculus
agcagagagagcagag

SEQ ID NO: 357983 - DNA, 16 bp, M. musculus
agcagagagcagagca

SEQ ID NO: 357984 - DNA, 16 bp, M. musculus
agcagagatgactcaa

SEQ ID NO: 357985 - DNA, 16 bp, M. musculus
agcagagattgaaaga

SEQ ID NO: 357986 - DNA, 16 bp, M. musculus
agcagagcaaagcaaa

SEQ ID NO: 357987 - DNA, 16 bp, M. musculus
agcagagcagaagcac

SEQ ID NO: 357988 - DNA, 16 bp, M. musculus
agcagagcagaatggg

SEQ ID NO: 357989 - DNA, 16 bp, M. musculus
agcagagcagaggaga

SEQ ID NO: 357990 - DNA, 16 bp, M. musculus
agcagagcagctgagg

SEQ ID NO: 357991 - DNA, 16 bp, M. musculus
agcagagcagctggga

SEQ ID NO: 357992 - DNA, 16 bp, M. musculus
agcagagccaggagga

SEQ ID NO: 357993 - DNA, 16 bp, M. musculus
agcagagcctgaagga

SEQ ID NO: 357994 - DNA, 16 bp, M. musculus
agcagagcctgaggga

SEQ ID NO: 357995 - DNA, 16 bp, M. musculus
agcagagccttgtctt

SEQ ID NO: 357996 - DNA, 16 bp, M. musculus
agcagagctatgagga

SEQ ID NO: 357997 - DNA, 16 bp, M. musculus
agcagagctggagaga

SEQ ID NO: 357998 - DNA, 16 bp, M. musculus
agcagaggaagcagga

SEQ ID NO: 357999 - DNA, 16 bp, M. musculus
agcagaggaaggcttt

SEQ ID NO: 358000 - DNA, 16 bp, M. musculus
agcagaggaagtgagg

SEQ ID NO: 358001 - DNA, 16 bp, M. musculus
agcagaggactgccaa

SEQ ID NO: 358002 - DNA, 16 bp, M. musculus
agcagaggactgcctg

SEQ ID NO: 358003 - DNA, 16 bp, M. musculus
agcagaggactgctgg

SEQ ID NO: 358004 - DNA, 16 bp, M. musculus
agcagaggactgtcag

SEQ ID NO: 358005 - DNA, 16 bp, M. musculus
agcagaggactgtggg

SEQ ID NO: 358006 - DNA, 16 bp, M. musculus
agcagaggatgatctt

SEQ ID NO: 358007 - DNA, 16 bp, M. musculus
agcagaggatggcttt

SEQ ID NO: 358008 - DNA, 16 bp, M. musculus
agcagaggcagaaaca

SEQ ID NO: 358009 - DNA, 16 bp, M. musculus
agcagaggcagacaga

SEQ ID NO: 358010 - DNA, 16 bp, M. musculus
agcagaggcagacgga

SEQ ID NO: 358011 - DNA, 16 bp, M. musculus
agcagaggcagagaaa

SEQ ID NO: 358012 - DNA, 16 bp, M. musculus
agcagaggcagagaga

SEQ ID NO: 358013 - DNA, 16 bp, M. musculus
agcagaggcaggaaga

SEQ ID NO: 358014 - DNA, 16 bp, M. musculus
agcagaggcaggagga

SEQ ID NO: 358015 - DNA, 16 bp, M. musculus
agcagaggcaggcaaa

SEQ ID NO: 358016 - DNA, 16 bp, M. musculus
agcagaggcaggtgga

SEQ ID NO: 358017 - DNA, 16 bp, M. musculus
agcagaggctgaagaa

SEQ ID NO: 358018 - DNA, 16 bp, M. musculus
agcagaggctgaagga

SEQ ID NO: 358019 - DNA, 16 bp, M. musculus
agcagaggctgaggga

SEQ ID NO: 358020 - DNA, 16 bp, M. musculus
agcagaggctggagag

SEQ ID NO: 358021 - DNA, 16 bp, M. musculus
agcagaggctggcaga

SEQ ID NO: 358022 - DNA, 16 bp, M. musculus
agcagagggaggtgga

SEQ ID NO: 358023 - DNA, 16 bp, M. musculus
agcagagtcactccca

SEQ ID NO: 358024 - DNA, 17 bp, M. musculus
agcagagtcgcctgaca

SEQ ID NO: 358025 - DNA, 16 bp, M. musculus
agcagagtgcttgcct

SEQ ID NO: 358026 - DNA, 16 bp, M. musculus
agcagagtgtcattaa

SEQ ID NO: 358027 - DNA, 16 bp, M. musculus
agcagatacacacaca

SEQ ID NO: 358028 - DNA, 16 bp, M. musculus
agcagatcaaggggat

SEQ ID NO: 358029 - DNA, 16 bp, M. musculus
agcagatctctgaatt

SEQ ID NO: 358030 - DNA, 16 bp, M. musculus
agcagatctctgcaga

SEQ ID NO: 358031 - DNA, 16 bp, M. musculus
agcagatgaagctcct

SEQ ID NO: 358032 - DNA, 16 bp, M. musculus
agcagatgagcagctt

SEQ ID NO: 358033 - DNA, 16 bp, M. musculus
agcagatgcacagctt

SEQ ID NO: 358034 - DNA, 16 bp, M. musculus
agcagatgctgaagag

SEQ ID NO: 358035 - DNA, 16 bp, M. musculus
agcagatgctgatgag

SEQ ID NO: 358036 - DNA, 16 bp, M. musculus
agcagatgctggagaa

SEQ ID NO: 358037 - DNA, 16 bp, M. musculus
agcagatgctggcctg

SEQ ID NO: 358038 - DNA, 16 bp, M. musculus
agcagatgctggcgag

SEQ ID NO: 358039 - DNA, 16 bp, M. musculus
agcagatgcttgcaag

SEQ ID NO: 358040 - DNA, 16 bp, M. musculus
agcagatggagaccat

SEQ ID NO: 358041 - DNA, 16 bp, M. musculus
agcagatggcagccct

SEQ ID NO: 358042 - DNA, 16 bp, M. musculus
agcagatgggagcagg

SEQ ID NO: 358043 - DNA, 16 bp, M. musculus
agcagatgttggagag

SEQ ID NO: 358044 - DNA, 16 bp, M. musculus
agcagcaaatgccctt

SEQ ID NO: 358045 - DNA, 16 bp, M. musculus
agcagcaacagcaaaa

SEQ ID NO: 358046 - DNA, 17 bp, M. musculus
agcagcaacagcaacaa

SEQ ID NO: 358047 - DNA, 16 bp, M. musculus
agcagcaacagcagct

SEQ ID NO: 358048 - DNA, 16 bp, M. musculus
agcagcaacaggagca

SEQ ID NO: 358049 - DNA, 16 bp, M. musculus
agcagcaagcagagag

SEQ ID NO: 358050 - DNA, 16 bp, M. musculus
agcagcaagcattctt

SEQ ID NO: 358051 - DNA, 16 bp, M. musculus
agcagcaagtgccctt

SEQ ID NO: 358052 - DNA, 16 bp, M. musculus
agcagcaagtgctgtt

SEQ ID NO: 358053 - DNA, 16 bp, M. musculus
agcagcacacccagca

SEQ ID NO: 358054 - DNA, 16 bp, M. musculus
agcagcacccctccaa

SEQ ID NO: 358055 - DNA, 16 bp, M. musculus
agcagcagaaacaaga

SEQ ID NO: 358056 - DNA, 16 bp, M. musculus
agcagcagaactcagc

SEQ ID NO: 358057 - DNA, 16 bp, M. musculus
agcagcagaaggagga

SEQ ID NO: 358058 - DNA, 16 bp, M. musculus
agcagcagagaactga

SEQ ID NO: 358059 - DNA, 16 bp, M. musculus
agcagcagagcagcag

SEQ ID NO: 358060 - DNA, 16 bp, M. musculus
agcagcagaggaggag

SEQ ID NO: 358061 - DNA, 16 bp, M. musculus
agcagcagaggcaggc

SEQ ID NO: 358062 - DNA, 16 bp, M. musculus
agcagcagatggccaa

SEQ ID NO: 358063 - DNA, 17 bp, M. musculus
agcagcagcaacaacag

SEQ ID NO: 358064 - DNA, 16 bp, M. musculus
agcagcagcaacagaa

SEQ ID NO: 358065 - DNA, 16 bp, M. musculus
agcagcagcaagaagc

SEQ ID NO: 358066 - DNA, 16 bp, M. musculus
agcagcagcagaagaa

SEQ ID NO: 358067 - DNA, 16 bp, M. musculus
agcagcagcagagaga

SEQ ID NO: 358068 - DNA, 16 bp, M. musculus
agcagcagcagaggag

SEQ ID NO: 358069 - DNA, 16 bp, M. musculus
agcagcagcagcaaaa

SEQ ID NO: 358070 - DNA, 16 bp, M. musculus
agcagcagcagcacta

SEQ ID NO: 358071 - DNA, 16 bp, M. musculus
agcagcagcagcactg

SEQ ID NO: 358072 - DNA, 16 bp, M. musculus
agcagcagcagcagaa

SEQ ID NO: 358073 - DNA, 17 bp, M. musculus
agcagcagcagcagcag

SEQ ID NO: 358074 - DNA, 16 bp, M. musculus
agcagcagcagcagcc

SEQ ID NO: 358075 - DNA, 16 bp, M. musculus
agcagcagcagcaggc

SEQ ID NO: 358076 - DNA, 16 bp, M. musculus
agcagcagcagcagta

SEQ ID NO: 358077 - DNA, 16 bp, M. musculus
agcagcagcagcagtg

SEQ ID NO: 358078 - DNA, 16 bp, M. musculus
agcagcagcagcatct

SEQ ID NO: 358079 - DNA, 16 bp, M. musculus
agcagcagcagccagg

SEQ ID NO: 358080 - DNA, 16 bp, M. musculus
agcagcagcagccctg
